United States Patent 11,254,933 (CRISPR/CAS TRANSCRIPTIONAL MODULATION) - sequence listing, part 9

SEQ ID NO: 374281 - DNA, 20 bp, human
ggcggcgctaccgaacgggg

SEQ ID NO: 374282 - DNA, 20 bp, human
gagcctggctccgccccgtt

SEQ ID NO: 374283 - DNA, 20 bp, human
gtggaggtctgtggctaact

SEQ ID NO: 374284 - DNA, 20 bp, human
gtggtccggaagaagcgagg

SEQ ID NO: 374285 - DNA, 20 bp, human
gcgggaaccggaaggtgcgg

SEQ ID NO: 374286 - DNA, 20 bp, human
ggatctggggcgtagaaggt

SEQ ID NO: 374287 - DNA, 20 bp, human
ggtgacccgggagagaccca

SEQ ID NO: 374288 - DNA, 20 bp, human
ggccgcccctgggtctctcc

SEQ ID NO: 374289 - DNA, 20 bp, human
gcgggcggggtggggacacc

SEQ ID NO: 374290 - DNA, 20 bp, human
gagggagcgcgcgagctggg

SEQ ID NO: 374291 - DNA, 20 bp, human
gcgagctgggggtccgggcg

SEQ ID NO: 374292 - DNA, 20 bp, human
gggcccggcaggcagccggg

SEQ ID NO: 374293 - DNA, 20 bp, human
gctctcccgggtcaccggcg

SEQ ID NO: 374294 - DNA, 20 bp, human
ggattccccgccggtgaccc

SEQ ID NO: 374295 - DNA, 20 bp, human
ggcggggacggattccccgc

SEQ ID NO: 374296 - DNA, 20 bp, human
ggggaggtgtagtctcccag

SEQ ID NO: 374297 - DNA, 20 bp, human
gcagccccaggtagatctag

SEQ ID NO: 374298 - DNA, 20 bp, human
gagacagtaactggagggtg

SEQ ID NO: 374299 - DNA, 20 bp, human
gggtaaaggcgctccgagga

SEQ ID NO: 374300 - DNA, 20 bp, human
ggcgagagacagtaactgga

SEQ ID NO: 374301 - DNA, 20 bp, human
ggaagcagcgctacagaagt

SEQ ID NO: 374302 - DNA, 20 bp, human
ggaggctcgcgtgctagcgt

SEQ ID NO: 374303 - DNA, 20 bp, human
ggctagcgtagggtgcagca

SEQ ID NO: 374304 - DNA, 20 bp, human
gtaactggagggtgggggaa

SEQ ID NO: 374305 - DNA, 20 bp, human
ggggtgcagcacggtgcgca

SEQ ID NO: 374306 - DNA, 20 bp, human
gtgtggccggaacttacaaa

SEQ ID NO: 374307 - DNA, 20 bp, human
gcgcgcgctgcgggatcacg

SEQ ID NO: 374308 - DNA, 20 bp, human
gatcacgcggtgaagctgga

SEQ ID NO: 374309 - DNA, 20 bp, human
gcgggatcacgcggtgaagc

SEQ ID NO: 374310 - DNA, 20 bp, human
gtagacgcggctcggtcgga

SEQ ID NO: 374311 - DNA, 20 bp, human
gtgggacgaagcaggtggcg

SEQ ID NO: 374312 - DNA, 20 bp, human
gcgggtgtgtcactgcgggc

SEQ ID NO: 374313 - DNA, 20 bp, human
gggcgcgggtgtgtcactgc

SEQ ID NO: 374314 - DNA, 20 bp, human
gatcccgcagcgcgcggccg

SEQ ID NO: 374315 - DNA, 20 bp, human
gaggaggcacccggggaagc

SEQ ID NO: 374316 - DNA, 20 bp, human
gtggctgccctgcaaagggg

SEQ ID NO: 374317 - DNA, 20 bp, human
gagggctacctccaaagatc

SEQ ID NO: 374318 - DNA, 20 bp, human
ggggactcctgggctggatc

SEQ ID NO: 374319 - DNA, 20 bp, human
ggaaacctgaaccctggggt

SEQ ID NO: 374320 - DNA, 20 bp, human
gatgcttggctgccctgcaa

SEQ ID NO: 374321 - DNA, 20 bp, human
gcccccccaccccagggttc

SEQ ID NO: 374322 - DNA, 20 bp, human
ggggtcgggacatcatcagg

SEQ ID NO: 374323 - DNA, 20 bp, human
gcatcatcaggcgggactcc

SEQ ID NO: 374324 - DNA, 20 bp, human
gagccaagcatcctgatctt

SEQ ID NO: 374325 - DNA, 20 bp, human
gggtagccctgatccagccc

SEQ ID NO: 374326 - DNA, 20 bp, human
ggagctccttgagcccgcgt

SEQ ID NO: 374327 - DNA, 20 bp, human
ggagcggcgcggggttactg

SEQ ID NO: 374328 - DNA, 20 bp, human
gctccaggaagcagccacaa

SEQ ID NO: 374329 - DNA, 20 bp, human
ggcggggcgagcacttgcgc

SEQ ID NO: 374330 - DNA, 20 bp, human
ggcgggctcaaggagctccg

SEQ ID NO: 374331 - DNA, 20 bp, human
ggagcccgcgtgggaaacct

SEQ ID NO: 374332 - DNA, 20 bp, human
gggaagtcccgggaggtgta

SEQ ID NO: 374333 - DNA, 20 bp, human
ggttactgcggccccggcgt

SEQ ID NO: 374334 - DNA, 20 bp, human
gcacgtggggccttggtttc

SEQ ID NO: 374335 - DNA, 20 bp, human
gtgtccgggcctggtccttt

SEQ ID NO: 374336 - DNA, 20 bp, human
gcggctgcatccttgagaaa

SEQ ID NO: 374337 - DNA, 20 bp, human
gctcaaggatgcagccgcgg

SEQ ID NO: 374338 - DNA, 20 bp, human
ggggcgggagccaaggccga

SEQ ID NO: 374339 - DNA, 20 bp, human
ggtaaagccgtggagagggc

SEQ ID NO: 374340 - DNA, 20 bp, human
ggagggcgggcgaactaaga

SEQ ID NO: 374341 - DNA, 20 bp, human
gttgaggaacaagtcatgga

SEQ ID NO: 374342 - DNA, 20 bp, human
ggaaggacagcctaagcggg

SEQ ID NO: 374343 - DNA, 20 bp, human
gacctcgccgcgtccagccc

SEQ ID NO: 374344 - DNA, 20 bp, human
ggcgtctggcgctccataaa

SEQ ID NO: 374345 - DNA, 20 bp, human
gggcacagagggtgtgtgtt

SEQ ID NO: 374346 - DNA, 20 bp, human
gtgagcggcgagtccgggag

SEQ ID NO: 374347 - DNA, 20 bp, human
gcgctcgcagtccctaatct

SEQ ID NO: 374348 - DNA, 20 bp, human
gaatccccatgcccagatta

SEQ ID NO: 374349 - DNA, 20 bp, human
ggcgtcaccgacgtcccgct

SEQ ID NO: 374350 - DNA, 20 bp, human
gtctcagcctagcgggacgt

SEQ ID NO: 374351 - DNA, 20 bp, human
gaaggacctccgcggctgag

SEQ ID NO: 374352 - DNA, 20 bp, human
ggtcctggtcgcgctggcgc

SEQ ID NO: 374353 - DNA, 20 bp, human
ggataagagtggcagacacg

SEQ ID NO: 374354 - DNA, 20 bp, human
ggcaccggtctcagcctagc

SEQ ID NO: 374355 - DNA, 20 bp, human
gctagtggccgctcttccgc

SEQ ID NO: 374356 - DNA, 20 bp, human
gcggggccgtctatctggga

SEQ ID NO: 374357 - DNA, 20 bp, human
gggcgcagaccggggatcag

SEQ ID NO: 374358 - DNA, 20 bp, human
gtggggcggggccgtctatc

SEQ ID NO: 374359 - DNA, 20 bp, human
gtggagggcgctctggagga

SEQ ID NO: 374360 - DNA, 20 bp, human
gagggcgggtcctccccgaa

SEQ ID NO: 374361 - DNA, 20 bp, human
ggaggcggggcctttcgggg

SEQ ID NO: 374362 - DNA, 20 bp, human
gacccgccctcccagataga

SEQ ID NO: 374363 - DNA, 20 bp, human
ggcggaggcggggcctttcg

SEQ ID NO: 374364 - DNA, 20 bp, human
ggctctctcaaggtggggcg

SEQ ID NO: 374365 - DNA, 20 bp, human
gcccccgctctctcaaggtg

SEQ ID NO: 374366 - DNA, 20 bp, human
gagcgcgcgcggccaatcag

SEQ ID NO: 374367 - DNA, 20 bp, human
gctgccgcctcgctagggcc

SEQ ID NO: 374368 - DNA, 20 bp, human
ggggccgggccctagcgagg

SEQ ID NO: 374369 - DNA, 20 bp, human
gggggctgcgggccgggcat

SEQ ID NO: 374370 - DNA, 20 bp, human
gtcaccccgcggcgctgaat

SEQ ID NO: 374371 - DNA, 20 bp, human
gccgcgctgccgcctcgcta

SEQ ID NO: 374372 - DNA, 20 bp, human
gagcccccgccgccgtgggg

SEQ ID NO: 374373 - DNA, 20 bp, human
gggcccgcagccccgaaggg

SEQ ID NO: 374374 - DNA, 20 bp, human
gcgtctgccggggttactgg

SEQ ID NO: 374375 - DNA, 20 bp, human
gcgcggcgctgaatggggtt

SEQ ID NO: 374376 - DNA, 20 bp, human
gggcgagcgaagcggtgcgt

SEQ ID NO: 374377 - DNA, 20 bp, human
gcaccgcttcgctcgcccat

SEQ ID NO: 374378 - DNA, 20 bp, human
gcccgggcgccgcacagaaa

SEQ ID NO: 374379 - DNA, 20 bp, human
gaatgcctggagtagccgtc

SEQ ID NO: 374380 - DNA, 20 bp, human
gactccaggcattcgctccg

SEQ ID NO: 374381 - DNA, 20 bp, human
gccgccccgccctttctgtg

SEQ ID NO: 374382 - DNA, 20 bp, human
ggccagcggtcgcaggtgga

SEQ ID NO: 374383 - DNA, 20 bp, human
gcaggctcatctcagccaat

SEQ ID NO: 374384 - DNA, 20 bp, human
gcccccctgtttgttgtcaa

SEQ ID NO: 374385 - DNA, 20 bp, human
ggggcgcaacgcaaacatgg

SEQ ID NO: 374386 - DNA, 20 bp, human
gcaacccggcggttctcgcg

SEQ ID NO: 374387 - DNA, 20 bp, human
gccagccggaagcgtcgccc

SEQ ID NO: 374388 - DNA, 20 bp, human
ggagcaggggagttgtgaaa

SEQ ID NO: 374389 - DNA, 20 bp, human
gcgtcgccccggcaacccgg

SEQ ID NO: 374390 - DNA, 20 bp, human
ggcagccgcgcgagaaccgc

SEQ ID NO: 374391 - DNA, 20 bp, human
ggagaaccgccgggttgccg

SEQ ID NO: 374392 - DNA, 20 bp, human
ggttgccggggcgacgcttc

SEQ ID NO: 374393 - DNA, 20 bp, human
gcggcctggcctactggtgc

SEQ ID NO: 374394 - DNA, 20 bp, human
gaggggagttgtgaaatggg

SEQ ID NO: 374395 - DNA, 20 bp, human
gtccgagaccggaaggaacc

SEQ ID NO: 374396 - DNA, 20 bp, human
ggggtccggtaacaacatgg

SEQ ID NO: 374397 - DNA, 20 bp, human
ggacgccgccatgttgttac

SEQ ID NO: 374398 - DNA, 20 bp, human
gacggcagaaccagtagatg

SEQ ID NO: 374399 - DNA, 20 bp, human
ggcaccgctaaccctgagaa

SEQ ID NO: 374400 - DNA, 20 bp, human
gacatggcggcgtccgtgag

SEQ ID NO: 374401 - DNA, 20 bp, human
gcctccaaaactatcagtaa

SEQ ID NO: 374402 - DNA, 20 bp, human
gctcgggtccggtaacaaca

SEQ ID NO: 374403 - DNA, 20 bp, human
gtagatgcggatgcagtttc

SEQ ID NO: 374404 - DNA, 20 bp, human
gctcagggttagcggtgctc

SEQ ID NO: 374405 - DNA, 20 bp, human
gagggacacttcataagtgt

SEQ ID NO: 374406 - DNA, 20 bp, human
gcaaataagcgccctcttgt

SEQ ID NO: 374407 - DNA, 20 bp, human
gaccacgcgctggcggcgga

SEQ ID NO: 374408 - DNA, 20 bp, human
gcccccgccccattggtccg

SEQ ID NO: 374409 - DNA, 20 bp, human
gaccgcgactctgagagggg

SEQ ID NO: 374410 - DNA, 20 bp, human
ggagatgacagcaacgagtt

SEQ ID NO: 374411 - DNA, 20 bp, human
gcagaccgcgactctgagag

SEQ ID NO: 374412 - DNA, 20 bp, human
ggccgagacggcgggtggag

SEQ ID NO: 374413 - DNA, 20 bp, human
gaaccacggaccaatggggc

SEQ ID NO: 374414 - DNA, 20 bp, human
gtggccgcggccgagacggc

SEQ ID NO: 374415 - DNA, 20 bp, human
ggccgtcagcgtcccccggg

SEQ ID NO: 374416 - DNA, 20 bp, human
ggacgcttggaagggaaaac

SEQ ID NO: 374417 - DNA, 20 bp, human
gggcgcagagggctacgcaa

SEQ ID NO: 374418 - DNA, 20 bp, human
gaacaagaaacattgacgct

SEQ ID NO: 374419 - DNA, 20 bp, human
ggcgtcgccacgcccctcaa

SEQ ID NO: 374420 - DNA, 20 bp, human
gcagccgcggtctgagagac

SEQ ID NO: 374421 - DNA, 20 bp, human
gactgagacagaacaactac

SEQ ID NO: 374422 - DNA, 20 bp, human
gtcctatggaaaccagacgg

SEQ ID NO: 374423 - DNA, 20 bp, human
gaggcggcagctagagcaga

SEQ ID NO: 374424 - DNA, 20 bp, human
gtgcgagcgcagtgtaccaa

SEQ ID NO: 374425 - DNA, 20 bp, human
ggcagaaggcggatgagttt

SEQ ID NO: 374426 - DNA, 20 bp, human
gccggcggcagcaaagttga

SEQ ID NO: 374427 - DNA, 20 bp, human
gcacacggctcgcgcctcgc

SEQ ID NO: 374428 - DNA, 20 bp, human
gcgggagcttggacggagaa

SEQ ID NO: 374429 - DNA, 20 bp, human
gcgagtgtgcctgtcactag

SEQ ID NO: 374430 - DNA, 20 bp, human
ggcgcccggctagcgatctg

SEQ ID NO: 374431 - DNA, 20 bp, human
gccaggaggccgctagtgac

SEQ ID NO: 374432 - DNA, 20 bp, human
gtgggggcagcagcggaaag

SEQ ID NO: 374433 - DNA, 20 bp, human
gccagccaggcgtttcctag

SEQ ID NO: 374434 - DNA, 20 bp, human
ggaaagggggacgcagagaa

SEQ ID NO: 374435 - DNA, 20 bp, human
gaatcccaggggatccccgg

SEQ ID NO: 374436 - DNA, 20 bp, human
gtgacaggcaagaacaggtc

SEQ ID NO: 374437 - DNA, 20 bp, human
gggtgggttgccattctggt

SEQ ID NO: 374438 - DNA, 20 bp, human
gtcctgcctagcacttggaa

SEQ ID NO: 374439 - DNA, 20 bp, human
gctaggggggccaggagcac

SEQ ID NO: 374440 - DNA, 20 bp, human
gaagtgagtcagcctagaag

SEQ ID NO: 374441 - DNA, 20 bp, human
gggatagcatgatgctaggg

SEQ ID NO: 374442 - DNA, 20 bp, human
gacctaactaccaatttcgc

SEQ ID NO: 374443 - DNA, 20 bp, human
gtgtagttccggagagatgg

SEQ ID NO: 374444 - DNA, 20 bp, human
ggcacttggaaaggtttctc

SEQ ID NO: 374445 - DNA, 20 bp, human
gaggaaaagaggtgctttgt

SEQ ID NO: 374446 - DNA, 20 bp, human
gggaagaaacgctcacaaaa

SEQ ID NO: 374447 - DNA, 20 bp, human
ggcaggaaaagtaatcgggt

SEQ ID NO: 374448 - DNA, 20 bp, human
gggcagcaggaaaagtaatc

SEQ ID NO: 374449 - DNA, 20 bp, human
ggaactcactgcaagcaaaa

SEQ ID NO: 374450 - DNA, 20 bp, human
gagtctagtgacgtgagcag

SEQ ID NO: 374451 - DNA, 20 bp, human
ggaaacgctcacaaaaggga

SEQ ID NO: 374452 - DNA, 20 bp, human
gtactgggatagtctagcag

SEQ ID NO: 374453 - DNA, 20 bp, human
gctagtgacgtgagcagtgg

SEQ ID NO: 374454 - DNA, 20 bp, human
ggcacagtgcaaaaaaaggg

SEQ ID NO: 374455 - DNA, 20 bp, human
gagagggcctgacccatgta

SEQ ID NO: 374456 - DNA, 20 bp, human
ggtccagtacagtttcataa

SEQ ID NO: 374457 - DNA, 20 bp, human
gaaattgtgacgtgtgttct

SEQ ID NO: 374458 - DNA, 20 bp, human
gacccattatgaaactgtac

SEQ ID NO: 374459 - DNA, 20 bp, human
gactgtactggactcccccc

SEQ ID NO: 374460 - DNA, 20 bp, human
gaaagtgcttggtgacgaaa

SEQ ID NO: 374461 - DNA, 20 bp, human
gtgggcagggtttgaggttt

SEQ ID NO: 374462 - DNA, 20 bp, human
gcttttgaaaaagcaggcct

SEQ ID NO: 374463 - DNA, 20 bp, human
gaatgctgattctactgttt

SEQ ID NO: 374464 - DNA, 20 bp, human
gctgattctactgtttcggt

SEQ ID NO: 374465 - DNA, 20 bp, human
gagtgaggtatgttactccc

SEQ ID NO: 374466 - DNA, 20 bp, human
gctcagtcggctgcccaagc

SEQ ID NO: 374467 - DNA, 20 bp, human
gagtaacaatgtgggttcct

SEQ ID NO: 374468 - DNA, 20 bp, human
gtcgggcaggttatcctacg

SEQ ID NO: 374469 - DNA, 20 bp, human
gcaccccacccgccctaaga

SEQ ID NO: 374470 - DNA, 20 bp, human
gaaccttcttagggcgggtg

SEQ ID NO: 374471 - DNA, 20 bp, human
gtagatacttagtaacaatg

SEQ ID NO: 374472 - DNA, 20 bp, human
ggtgctgctgttatatgaat

SEQ ID NO: 374473 - DNA, 20 bp, human
gataaaatgttggcacatag

SEQ ID NO: 374474 - DNA, 20 bp, human
gcaatgtgggttcctcgggc

SEQ ID NO: 374475 - DNA, 20 bp, human
gagattctaaatttggtaaa

SEQ ID NO: 374476 - DNA, 20 bp, human
ggccccagagcgcaccacgc

SEQ ID NO: 374477 - DNA, 20 bp, human
gccgccccgccctgccgcta

SEQ ID NO: 374478 - DNA, 20 bp, human
gacgaagaagcgcgcaggca

SEQ ID NO: 374479 - DNA, 20 bp, human
gcgcgcgcacaggcaagagc

SEQ ID NO: 374480 - DNA, 20 bp, human
ggagccacggccgcgcgcac

SEQ ID NO: 374481 - DNA, 20 bp, human
gctctggggcggccccctag

SEQ ID NO: 374482 - DNA, 20 bp, human
gtaatgcagtgcacgactga

SEQ ID NO: 374483 - DNA, 20 bp, human
gacgcccgcgtggtgcgctc

SEQ ID NO: 374484 - DNA, 20 bp, human
gtggggtggtgtattggtgt

SEQ ID NO: 374485 - DNA, 20 bp, human
gcactgcattagcgccgtaa

SEQ ID NO: 374486 - DNA, 20 bp, human
gttcatagagggcctctata

SEQ ID NO: 374487 - DNA, 20 bp, human
gacaaagaatgacctatcta

SEQ ID NO: 374488 - DNA, 20 bp, human
gaataaacatatttcataga

SEQ ID NO: 374489 - DNA, 20 bp, human
gaacagtcatatgtgggagc

SEQ ID NO: 374490 - DNA, 20 bp, human
gtgttggaacagtcatatgt

SEQ ID NO: 374491 - DNA, 20 bp, human
ggttcctagctgccttagat

SEQ ID NO: 374492 - DNA, 20 bp, human
ggttggttactgatttccag

SEQ ID NO: 374493 - DNA, 20 bp, human
ggggcctctatagggctaat

SEQ ID NO: 374494 - DNA, 20 bp, human
gacattgccctcttgacctc

SEQ ID NO: 374495 - DNA, 20 bp, human
ggttgagtaatgtttatagt

SEQ ID NO: 374496 - DNA, 20 bp, human
ggtcaccagggcaactagga

SEQ ID NO: 374497 - DNA, 20 bp, human
gacccatgtcatgtgatccc

SEQ ID NO: 374498 - DNA, 20 bp, human
gaagaagcccggaccccaga

SEQ ID NO: 374499 - DNA, 20 bp, human
gctccaccgcctgagcccaa

SEQ ID NO: 374500 - DNA, 20 bp, human
gccctgggatcacatgacat

SEQ ID NO: 374501 - DNA, 20 bp, human
gggcaactaggagggtgtga

SEQ ID NO: 374502 - DNA, 20 bp, human
ggacatgggtcacagggcgt

SEQ ID NO: 374503 - DNA, 20 bp, human
gggggaagagaatccagcca

SEQ ID NO: 374504 - DNA, 20 bp, human
gggctgggaaggttgttcca

SEQ ID NO: 374505 - DNA, 20 bp, human
ggctagagagtggtcagcta

SEQ ID NO: 374506 - DNA, 20 bp, human
ggtagtgcggcccgctccag

SEQ ID NO: 374507 - DNA, 20 bp, human
ggagcggcgcagagtggctg

SEQ ID NO: 374508 - DNA, 20 bp, human
gctcgcagagcggcgcagag

SEQ ID NO: 374509 - DNA, 20 bp, human
gtggccaccggctcgcagag

SEQ ID NO: 374510 - DNA, 20 bp, human
gcccgctccaggggccacgt

SEQ ID NO: 374511 - DNA, 20 bp, human
ggctgtggcgcgccgtccgt

SEQ ID NO: 374512 - DNA, 20 bp, human
gaaccccgagaaggaagcgg

SEQ ID NO: 374513 - DNA, 20 bp, human
gccctgctgccgccgacgga

SEQ ID NO: 374514 - DNA, 20 bp, human
gcccgccccggaacccgacc

SEQ ID NO: 374515 - DNA, 20 bp, human
gtgggccggcggaaggggtc

SEQ ID NO: 374516 - DNA, 20 bp, human
gcgtgcccacggagaagtgg

SEQ ID NO: 374517 - DNA, 20 bp, human
gacgggcggctgttggactg

SEQ ID NO: 374518 - DNA, 20 bp, human
gaggcctggcccatgcccaa

SEQ ID NO: 374519 - DNA, 20 bp, human
gcgtgggcacgggcggctgt

SEQ ID NO: 374520 - DNA, 20 bp, human
ggcccgtgcccacggagaag

SEQ ID NO: 374521 - DNA, 20 bp, human
ggaacagcagcgcttctccg

SEQ ID NO: 374522 - DNA, 20 bp, human
ggttggactgtggtgccctt

SEQ ID NO: 374523 - DNA, 20 bp, human
gggctctgcccagtcaggcc

SEQ ID NO: 374524 - DNA, 20 bp, human
gtctgaggacaggcgagtga

SEQ ID NO: 374525 - DNA, 20 bp, human
ggcagagggcagcttgggct

SEQ ID NO: 374526 - DNA, 20 bp, human
gcgcgccctgggacgtccgg

SEQ ID NO: 374527 - DNA, 20 bp, human
gctgtgacccggaggcgctg

SEQ ID NO: 374528 - DNA, 20 bp, human
gcgcctagcgcccgcgccct

SEQ ID NO: 374529 - DNA, 20 bp, human
gccagcctaggccgaacttc

SEQ ID NO: 374530 - DNA, 20 bp, human
gcgtccgggggcctgtgacc

SEQ ID NO: 374531 - DNA, 20 bp, human
gacaggcccccggacgtccc

SEQ ID NO: 374532 - DNA, 20 bp, human
gtcttctcttccaccaatcc

SEQ ID NO: 374533 - DNA, 20 bp, human
gaggacagccccagcgcctc

SEQ ID NO: 374534 - DNA, 20 bp, human
gcggaagtcccgcccagcct

SEQ ID NO: 374535 - DNA, 20 bp, human
ggtcccagggcgcgggcgct

SEQ ID NO: 374536 - DNA, 20 bp, human
ggcgccccacatggtcttcc

SEQ ID NO: 374537 - DNA, 20 bp, human
gggtcttcccggcttgggaa

SEQ ID NO: 374538 - DNA, 20 bp, human
ggacaggtgccggaacaaac

SEQ ID NO: 374539 - DNA, 20 bp, human
ggatcctggcgccgagcgac

SEQ ID NO: 374540 - DNA, 20 bp, human
gcacatggtcttcccggctt

SEQ ID NO: 374541 - DNA, 20 bp, human
gcatgattctctcgcgagaa

SEQ ID NO: 374542 - DNA, 20 bp, human
gggatctctagtctctgacg

SEQ ID NO: 374543 - DNA, 20 bp, human
gaggggaatctgtgtggttc

SEQ ID NO: 374544 - DNA, 20 bp, human
ggctgagaaactggaaacga

SEQ ID NO: 374545 - DNA, 20 bp, human
gcatgcaccgccactaaaaa

SEQ ID NO: 374546 - DNA, 20 bp, human
gcctccgcggaacaagcctc

SEQ ID NO: 374547 - DNA, 20 bp, human
ggaggtctcacgtgcgcctg

SEQ ID NO: 374548 - DNA, 20 bp, human
gactgaaggcagggatcccc

SEQ ID NO: 374549 - DNA, 20 bp, human
gtaaaataggaggctgtcta

SEQ ID NO: 374550 - DNA, 20 bp, human
gcacgtgagacctccgtaga

SEQ ID NO: 374551 - DNA, 20 bp, human
gccgccgcgttccttctacg

SEQ ID NO: 374552 - DNA, 20 bp, human
gtactcctgcagttattcag

SEQ ID NO: 374553 - DNA, 20 bp, human
gttagggctttgcagaccgg

SEQ ID NO: 374554 - DNA, 20 bp, human
gactgcaggagtaaagttag

SEQ ID NO: 374555 - DNA, 20 bp, human
ggagcaagccgcgcaggcac

SEQ ID NO: 374556 - DNA, 20 bp, human
gctgcagcaagggccgacgg

SEQ ID NO: 374557 - DNA, 20 bp, human
gcgagggatcctgtcatccc

SEQ ID NO: 374558 - DNA, 20 bp, human
gcagccacaattccggaccc

SEQ ID NO: 374559 - DNA, 20 bp, human
gcgggctgatgggatagcgg

SEQ ID NO: 374560 - DNA, 20 bp, human
gtggcgccctgctgcagcaa

SEQ ID NO: 374561 - DNA, 20 bp, human
ggcagcagggcgccatgtgc

SEQ ID NO: 374562 - DNA, 20 bp, human
gtggctgctgagatctcagg

SEQ ID NO: 374563 - DNA, 20 bp, human
gtgaggccgcagtgagaccg

SEQ ID NO: 374564 - DNA, 20 bp, human
gcatcccgggtccggaattg

SEQ ID NO: 374565 - DNA, 20 bp, human
gatgacaggatccctcgcgc

SEQ ID NO: 374566 - DNA, 20 bp, human
ggatacacctcacttgaagt

SEQ ID NO: 374567 - DNA, 20 bp, human
ggatctctgatgctgcctta

SEQ ID NO: 374568 - DNA, 20 bp, human
ggggccggacgatcatttat

SEQ ID NO: 374569 - DNA, 20 bp, human
gactccctatggcttctagt

SEQ ID NO: 374570 - DNA, 20 bp, human
gctccgaggcagccaagagg

SEQ ID NO: 374571 - DNA, 20 bp, human
gaaagtgcgggaagacattc

SEQ ID NO: 374572 - DNA, 20 bp, human
gcggactcctggacggggtt

SEQ ID NO: 374573 - DNA, 20 bp, human
ggggagtgtcttcagcccta

SEQ ID NO: 374574 - DNA, 20 bp, human
gaaaagaggcgtcggactcc

SEQ ID NO: 374575 - DNA, 20 bp, human
gggcgtcggactcctggacg

SEQ ID NO: 374576 - DNA, 20 bp, human
gtgccacagcgcccccggta

SEQ ID NO: 374577 - DNA, 20 bp, human
gagggcacggcaaccaatgc

SEQ ID NO: 374578 - DNA, 20 bp, human
gagccctgagggccacggga

SEQ ID NO: 374579 - DNA, 20 bp, human
gactcattcagccctaccgg

SEQ ID NO: 374580 - DNA, 20 bp, human
ggcgctgtggcagccggcat

SEQ ID NO: 374581 - DNA, 20 bp, human
ggtccgtcccgtggccctca

SEQ ID NO: 374582 - DNA, 20 bp, human
gcatggacggggctgtccaa

SEQ ID NO: 374583 - DNA, 20 bp, human
ggcgagacaagcggagggca

SEQ ID NO: 374584 - DNA, 20 bp, human
gagctgcggttcagccctga

SEQ ID NO: 374585 - DNA, 20 bp, human
ggctcgcccaatgggcagga

SEQ ID NO: 374586 - DNA, 20 bp, human
ggcgcagcggggaggaacgc

SEQ ID NO: 374587 - DNA, 20 bp, human
gacgccggggtgaacgttga

SEQ ID NO: 374588 - DNA, 20 bp, human
gcgcaagcgcgcggcatcgt

SEQ ID NO: 374589 - DNA, 20 bp, human
gaccacctgctcccgaggag

SEQ ID NO: 374590 - DNA, 20 bp, human
gagcgcgcggcatcgtgggg

SEQ ID NO: 374591 - DNA, 20 bp, human
gatgccgcgcgcttgcgcgt

SEQ ID NO: 374592 - DNA, 20 bp, human
gactgagggcggagtgtgag

SEQ ID NO: 374593 - DNA, 20 bp, human
gtgtgagcgggctcggtttt

SEQ ID NO: 374594 - DNA, 20 bp, human
gccccctcctcgggagcagg

SEQ ID NO: 374595 - DNA, 20 bp, human
gcgcgcttgcgcgttgggcg

SEQ ID NO: 374596 - DNA, 20 bp, human
gccagccgcaggatcgcagg

SEQ ID NO: 374597 - DNA, 20 bp, human
gtccggtgcccgggagaggc

SEQ ID NO: 374598 - DNA, 20 bp, human
ggcggcggccacttctgcac

SEQ ID NO: 374599 - DNA, 20 bp, human
gcgaccggccggggtgcgga

SEQ ID NO: 374600 - DNA, 20 bp, human
ggtcccgcgggtccggtgcc

SEQ ID NO: 374601 - DNA, 20 bp, human
ggacgggcgcatggagcagc

SEQ ID NO: 374602 - DNA, 20 bp, human
gccagcgcggccatgggcgg

SEQ ID NO: 374603 - DNA, 20 bp, human
ggggccagccgcaggatcgc

SEQ ID NO: 374604 - DNA, 20 bp, human
gcggggagggagggtcccgc

SEQ ID NO: 374605 - DNA, 20 bp, human
gtgggtccctgctggagcgg

SEQ ID NO: 374606 - DNA, 20 bp, human
ggcctgggtaatcacgtcac

SEQ ID NO: 374607 - DNA, 20 bp, human
gtaaagggaaaaagctccag

SEQ ID NO: 374608 - DNA, 20 bp, human
gcacttgtactgtactgcta

SEQ ID NO: 374609 - DNA, 20 bp, human
ggacaatagacatctacaac

SEQ ID NO: 374610 - DNA, 20 bp, human
ggcctgtgacgtgattaccc

SEQ ID NO: 374611 - DNA, 20 bp, human
gttgtactgtactgctaagg

SEQ ID NO: 374612 - DNA, 20 bp, human
gtaaacagatatgcaaccct

SEQ ID NO: 374613 - DNA, 20 bp, human
gctgtactgctaaggaggag

SEQ ID NO: 374614 - DNA, 20 bp, human
gaaaaagctccagaggcatc

SEQ ID NO: 374615 - DNA, 20 bp, human
gcatgactgtttatgaaagc

SEQ ID NO: 374616 - DNA, 20 bp, human
gaaggtatgcggtgcgggga

SEQ ID NO: 374617 - DNA, 20 bp, human
gggagcccgacctggggtac

SEQ ID NO: 374618 - DNA, 20 bp, human
ggagaacgggagcccgacct

SEQ ID NO: 374619 - DNA, 20 bp, human
gcccatgggaaccctgtccc

SEQ ID NO: 374620 - DNA, 20 bp, human
gggactcccagttgtcctag

SEQ ID NO: 374621 - DNA, 20 bp, human
gctgagggggaggtccacgc

SEQ ID NO: 374622 - DNA, 20 bp, human
ggcccggggcaccggagctg

SEQ ID NO: 374623 - DNA, 20 bp, human
ggtgaagcagcccgtacccc

SEQ ID NO: 374624 - DNA, 20 bp, human
gggggcttggcctaaggacc

SEQ ID NO: 374625 - DNA, 20 bp, human
ggtgcccttctcattcccat

SEQ ID NO: 374626 - DNA, 20 bp, human
ggcgcccccgggcggagatg

SEQ ID NO: 374627 - DNA, 20 bp, human
gaaggccagccaatggcggg

SEQ ID NO: 374628 - DNA, 20 bp, human
gaattggccagcggccctca

SEQ ID NO: 374629 - DNA, 20 bp, human
gccccgggcggagatgggga

SEQ ID NO: 374630 - DNA, 20 bp, human
gctgccccgcccaatgctct

SEQ ID NO: 374631 - DNA, 20 bp, human
gccacctagagcattgggcg

SEQ ID NO: 374632 - DNA, 20 bp, human
ggtatcgcaaggccagccaa

SEQ ID NO: 374633 - DNA, 20 bp, human
gagacggccacctagagcat

SEQ ID NO: 374634 - DNA, 20 bp, human
gggctccaggagaggtcacg

SEQ ID NO: 374635 - DNA, 20 bp, human
ggtttggcgcggagcagtga

SEQ ID NO: 374636 - DNA, 20 bp, human
gtcctcctacagaacgatag

SEQ ID NO: 374637 - DNA, 20 bp, human
ggatcccccaagtgcttgat

SEQ ID NO: 374638 - DNA, 20 bp, human
gagcacttgggggatcgccg

SEQ ID NO: 374639 - DNA, 20 bp, human
gtctgcccctatcgttctgt

SEQ ID NO: 374640 - DNA, 20 bp, human
ggctcccgaaactaccactg

SEQ ID NO: 374641 - DNA, 20 bp, human
gacaactcccatcaagcact

SEQ ID NO: 374642 - DNA, 20 bp, human
gacggtcgggaactcctcag

SEQ ID NO: 374643 - DNA, 20 bp, human
ggcagacaggttatttgtcg

SEQ ID NO: 374644 - DNA, 20 bp, human
gtgggggatcgccgcggctg

SEQ ID NO: 374645 - DNA, 20 bp, human
ggcccctatcgttctgtagg

SEQ ID NO: 374646 - DNA, 20 bp, human
ggaaccgcgcagtgttccag

SEQ ID NO: 374647 - DNA, 20 bp, human
gtgagggggcgcgcaaattg

SEQ ID NO: 374648 - DNA, 20 bp, human
gaacttggggcatggtcgtg

SEQ ID NO: 374649 - DNA, 20 bp, human
gcaaccgaggggattcagag

SEQ ID NO: 374650 - DNA, 20 bp, human
gaggatatttcgctctgctg

SEQ ID NO: 374651 - DNA, 20 bp, human
gacgtctgggatgttcgagg

SEQ ID NO: 374652 - DNA, 20 bp, human
gctctggccagaaaaagcgc

SEQ ID NO: 374653 - DNA, 20 bp, human
gagaacatggccatagtatc

SEQ ID NO: 374654 - DNA, 20 bp, human
gccccccctggaacactgcg

SEQ ID NO: 374655 - DNA, 20 bp, human
gtccctgctctgccagtaac

SEQ ID NO: 374656 - DNA, 20 bp, human
gtcacaaacaccaaagagag

SEQ ID NO: 374657 - DNA, 20 bp, human
gatagtgatgactaacacag

SEQ ID NO: 374658 - DNA, 20 bp, human
gtagtcatcactatattcac

SEQ ID NO: 374659 - DNA, 20 bp, human
gcagtgcaacacatctctgg

SEQ ID NO: 374660 - DNA, 20 bp, human
gcttcagtgcaacacatctc

SEQ ID NO: 374661 - DNA, 20 bp, human
gtgggagtctaaggaattac

SEQ ID NO: 374662 - DNA, 20 bp, human
gttcccacactaagaatgga

SEQ ID NO: 374663 - DNA, 20 bp, human
gaatggagggaaagcatgcc

SEQ ID NO: 374664 - DNA, 20 bp, human
gcccagtggtctctgatgga

SEQ ID NO: 374665 - DNA, 20 bp, human
gaactgtcttgcaatctata

SEQ ID NO: 374666 - DNA, 20 bp, human
gcgcgcgcgccgcccgtctg

SEQ ID NO: 374667 - DNA, 20 bp, human
gctaacccgcgagagaggta

SEQ ID NO: 374668 - DNA, 20 bp, human
gcccgccgccggttccagag

SEQ ID NO: 374669 - DNA, 20 bp, human
gcggggaaaggccgggaggt

SEQ ID NO: 374670 - DNA, 20 bp, human
gcggccaccgtcgttcggaa

SEQ ID NO: 374671 - DNA, 20 bp, human
ggcgcgccgcccgtctgtgg

SEQ ID NO: 374672 - DNA, 20 bp, human
gtcggagctgcgcgggatcc

SEQ ID NO: 374673 - DNA, 20 bp, human
gaatccggggcgggtctgag

SEQ ID NO: 374674 - DNA, 20 bp, human
gctccctttccgaacgacgg

SEQ ID NO: 374675 - DNA, 20 bp, human
gcccgcccctctggaaccgg

SEQ ID NO: 374676 - DNA, 20 bp, human
gggtacggggcagaagtcgc

SEQ ID NO: 374677 - DNA, 20 bp, human
gcggggcggcgcgtgaccta

SEQ ID NO: 374678 - DNA, 20 bp, human
gcatcccagtgctcggggtt

SEQ ID NO: 374679 - DNA, 20 bp, human
gctgccgcgcgcgcaggtac

SEQ ID NO: 374680 - DNA, 20 bp, human
gggagcgcggggataccgag

SEQ ID NO: 374681 - DNA, 20 bp, human
gtgctcggggttcgggactc

SEQ ID NO: 374682 - DNA, 20 bp, human
ggtcccgaaccccgagcact

SEQ ID NO: 374683 - DNA, 20 bp, human
gcgctgacgtcagagaccaa

SEQ ID NO: 374684 - DNA, 20 bp, human
gcagctgctgcccacatttc

SEQ ID NO: 374685 - DNA, 20 bp, human
gaacgcctaaggattaggcg

SEQ ID NO: 374686 - DNA, 20 bp, human
gagcaggcgcggcctcgtgt

SEQ ID NO: 374687 - DNA, 20 bp, human
ggcagggcggggcgactcga

SEQ ID NO: 374688 - DNA, 20 bp, human
ggcagccaatgggagcaaaa

SEQ ID NO: 374689 - DNA, 20 bp, human
gtgcgcacgagcgccagcgg

SEQ ID NO: 374690 - DNA, 20 bp, human
gcggcggcgcggtgtaccct

SEQ ID NO: 374691 - DNA, 20 bp, human
gggctctcggcgcactgagc

SEQ ID NO: 374692 - DNA, 20 bp, human
gactacctaccggggagttt

SEQ ID NO: 374693 - DNA, 20 bp, human
gtcggcgcactgagcaggcg

SEQ ID NO: 374694 - DNA, 20 bp, human
gccactacgggtcgaaggat

SEQ ID NO: 374695 - DNA, 20 bp, human
gaggccctaaactccccggt

SEQ ID NO: 374696 - DNA, 20 bp, human
gggcccctggtgcaggtcta

SEQ ID NO: 374697 - DNA, 20 bp, human
ggccccgcggccttttgcgc

SEQ ID NO: 374698 - DNA, 20 bp, human
ggtacttcgcggtgtggctt

SEQ ID NO: 374699 - DNA, 20 bp, human
gaatgctctgcatcgacagc

SEQ ID NO: 374700 - DNA, 20 bp, human
gttcaccggtatcacgtcct

SEQ ID NO: 374701 - DNA, 20 bp, human
gtggccagtgcaacgaagaa

SEQ ID NO: 374702 - DNA, 20 bp, human
gtaggccttccgctgcgggg

SEQ ID NO: 374703 - DNA, 20 bp, human
gggatatcgtctcccaacat

SEQ ID NO: 374704 - DNA, 20 bp, human
ggcgcactccagttcccggc

SEQ ID NO: 374705 - DNA, 20 bp, human
gcggagcccggatgtaattt

SEQ ID NO: 374706 - DNA, 20 bp, human
ggcggaggcaacagcccggg

SEQ ID NO: 374707 - DNA, 20 bp, human
ggcgccctccgcaggcctgg

SEQ ID NO: 374708 - DNA, 20 bp, human
gccgctgcgggcgttcctcc

SEQ ID NO: 374709 - DNA, 20 bp, human
gttgccccaggcgccttcca

SEQ ID NO: 374710 - DNA, 20 bp, human
gcgggctgttgcctccgctg

SEQ ID NO: 374711 - DNA, 20 bp, human
ggcaagggaggttattagtt

SEQ ID NO: 374712 - DNA, 20 bp, human
gggcaacagcccgggcggct

SEQ ID NO: 374713 - DNA, 20 bp, human
gtgggggaaacagatgtccc

SEQ ID NO: 374714 - DNA, 20 bp, human
ggaggcatgtcagccctgga

SEQ ID NO: 374715 - DNA, 20 bp, human
ggttcctccaggcctgcgga

SEQ ID NO: 374716 - DNA, 20 bp, human
gacaaaagcccgcaggtctt

SEQ ID NO: 374717 - DNA, 20 bp, human
ggggcgtgcgcctgtcacca

SEQ ID NO: 374718 - DNA, 20 bp, human
ggaggaaggccagcgatgat

SEQ ID NO: 374719 - DNA, 20 bp, human
gaaagcccgcaggtcttggg

SEQ ID NO: 374720 - DNA, 20 bp, human
gaggccagcgatgatgggag

SEQ ID NO: 374721 - DNA, 20 bp, human
ggaggaggagggggttggtg

SEQ ID NO: 374722 - DNA, 20 bp, human
gctctcgcacaatgtgacgt

SEQ ID NO: 374723 - DNA, 20 bp, human
gcgctgcaactcggtcgccg

SEQ ID NO: 374724 - DNA, 20 bp, human
gtctcccaaaagtgagggtc

SEQ ID NO: 374725 - DNA, 20 bp, human
gcagctacaagacttgcgaa

SEQ ID NO: 374726 - DNA, 20 bp, human
gagaggctcatctggcaaaa

SEQ ID NO: 374727 - DNA, 20 bp, human
gcccagagagaagtgggata

SEQ ID NO: 374728 - DNA, 20 bp, human
gccgggatctcggctccgag

SEQ ID NO: 374729 - DNA, 20 bp, human
gggtgcgactatactactgc

SEQ ID NO: 374730 - DNA, 20 bp, human
gaagggcgcggaaaccacgg

SEQ ID NO: 374731 - DNA, 20 bp, human
gcggtcctcaaaataacggg

SEQ ID NO: 374732 - DNA, 20 bp, human
gcctgggagcaggaacctgt

SEQ ID NO: 374733 - DNA, 20 bp, human
ggatggcaaatccgggatct

SEQ ID NO: 374734 - DNA, 20 bp, human
gctacccacgcatgcgcaaa

SEQ ID NO: 374735 - DNA, 20 bp, human
gttccaagacacaccccctt

SEQ ID NO: 374736 - DNA, 20 bp, human
gaggctggagatatttcctc

SEQ ID NO: 374737 - DNA, 20 bp, human
gtcaaggagcccatagtcag

SEQ ID NO: 374738 - DNA, 20 bp, human
gattcagcagatgtcttctg

SEQ ID NO: 374739 - DNA, 20 bp, human
ggtatgaagtcagaggtggg

SEQ ID NO: 374740 - DNA, 20 bp, human
ggactcatgcccagcattgc

SEQ ID NO: 374741 - DNA, 20 bp, human
ggcaatcaggtcatcgtcca

SEQ ID NO: 374742 - DNA, 20 bp, human
gggagcccatagtcagtggg

SEQ ID NO: 374743 - DNA, 20 bp, human
gaccgcttggggagtcagcg

SEQ ID NO: 374744 - DNA, 20 bp, human
gcaactgtgtgaagtaatag

SEQ ID NO: 374745 - DNA, 20 bp, human
gggtcagtgtctctctcgta

SEQ ID NO: 374746 - DNA, 20 bp, human
gggggagagcagggcgtgat

SEQ ID NO: 374747 - DNA, 20 bp, human
ggggaggcgaacaagccctc

SEQ ID NO: 374748 - DNA, 20 bp, human
gatgtgtcggggtcctaaga

SEQ ID NO: 374749 - DNA, 20 bp, human
ggagcagggcgtgatgggaa

SEQ ID NO: 374750 - DNA, 20 bp, human
ggccgcgcttggcccagccg

SEQ ID NO: 374751 - DNA, 20 bp, human
gcggcttttcgagacgataa

SEQ ID NO: 374752 - DNA, 20 bp, human
ggctcgagcgttaggaacta

SEQ ID NO: 374753 - DNA, 20 bp, human
gtaggaccccgacacatctg

SEQ ID NO: 374754 - DNA, 20 bp, human
gctaacaaaccgagcgcgaa

SEQ ID NO: 374755 - DNA, 20 bp, human
gccaccctcgcggccggaac

SEQ ID NO: 374756 - DNA, 20 bp, human
gagcgcaacgggtgctgcga

SEQ ID NO: 374757 - DNA, 20 bp, human
gcgcacgcgcgggagcgcaa

SEQ ID NO: 374758 - DNA, 20 bp, human
gacgtcaccctccccacgaa

SEQ ID NO: 374759 - DNA, 20 bp, human
gagctcggcgcacggatatg

SEQ ID NO: 374760 - DNA, 20 bp, human
gtcggcgcacggatatgggg

SEQ ID NO: 374761 - DNA, 20 bp, human
gtcccccgcgttcccagctt

SEQ ID NO: 374762 - DNA, 20 bp, human
ggctcccgcgcgtgcgtgtt

SEQ ID NO: 374763 - DNA, 20 bp, human
ggatcccaacacgcacgcgc

SEQ ID NO: 374764 - DNA, 20 bp, human
gtggcgggaaagagtctcgg

SEQ ID NO: 374765 - DNA, 20 bp, human
gggatatgggggggagacag

SEQ ID NO: 374766 - DNA, 20 bp, human
gcgtccgcctgcgcatgcgg

SEQ ID NO: 374767 - DNA, 20 bp, human
gcggacgcctggtgttctcg

SEQ ID NO: 374768 - DNA, 20 bp, human
gcagcgtcggtgtcattcgt

SEQ ID NO: 374769 - DNA, 20 bp, human
gactttgcgcggaggtagga

SEQ ID NO: 374770 - DNA, 20 bp, human
gaggcgtccgcctgcgcatg

SEQ ID NO: 374771 - DNA, 20 bp, human
gggagatgaagtggagtgta

SEQ ID NO: 374772 - DNA, 20 bp, human
ggccagccctccgcatgcgc

SEQ ID NO: 374773 - DNA, 20 bp, human
gagtgtaaggtagaaaacgg

SEQ ID NO: 374774 - DNA, 20 bp, human
ggaagtctcgcgagaagagt

SEQ ID NO: 374775 - DNA, 20 bp, human
gtgcgcccgactttgcgcgg

SEQ ID NO: 374776 - DNA, 20 bp, human
gaaggagcggggcatcccaa

SEQ ID NO: 374777 - DNA, 20 bp, human
gcgcgcgctcacgaaaggag

SEQ ID NO: 374778 - DNA, 20 bp, human
ggcgacatgttcaaagtcct

SEQ ID NO: 374779 - DNA, 20 bp, human
gagagtgaaggcccagcgcg

SEQ ID NO: 374780 - DNA, 20 bp, human
gcagagcgcgcgctcacgaa

SEQ ID NO: 374781 - DNA, 20 bp, human
gcacccgtgacgcttaaagg

SEQ ID NO: 374782 - DNA, 20 bp, human
gctgaagcggatagcggggc

SEQ ID NO: 374783 - DNA, 20 bp, human
gactgcgccgcagagagtga

SEQ ID NO: 374784 - DNA, 20 bp, human
ggtaccccaagggctgttga

SEQ ID NO: 374785 - DNA, 20 bp, human
gccccacccgtgacgcttaa

SEQ ID NO: 374786 - DNA, 20 bp, human
gggcccgctagtgtcgtggt

SEQ ID NO: 374787 - DNA, 20 bp, human
ggcgcagggcgcgtcagcgt

SEQ ID NO: 374788 - DNA, 20 bp, human
gctgctgggcctgcgcgggg

SEQ ID NO: 374789 - DNA, 20 bp, human
gctcgggcccgctagtgtcg

SEQ ID NO: 374790 - DNA, 20 bp, human
ggctgcaggcgacggctgct

SEQ ID NO: 374791 - DNA, 20 bp, human
gcggcggggcggagaaacgg

SEQ ID NO: 374792 - DNA, 20 bp, human
gccggtgcctctcatttctc

SEQ ID NO: 374793 - DNA, 20 bp, human
gcctccaaccacgacactag

SEQ ID NO: 374794 - DNA, 20 bp, human
gcctgcgccgcaaagcattg

SEQ ID NO: 374795 - DNA, 20 bp, human
gcctcccccgcggcgtgcgg

SEQ ID NO: 374796 - DNA, 20 bp, human
gagggccagtgtatgtcagg

SEQ ID NO: 374797 - DNA, 20 bp, human
ggcgagggccagtgtatgtc

SEQ ID NO: 374798 - DNA, 20 bp, human
gcccatacccggatcccata

SEQ ID NO: 374799 - DNA, 20 bp, human
ggccctatgggatccgggta

SEQ ID NO: 374800 - DNA, 20 bp, human
gcccaggccctatgggatcc

SEQ ID NO: 374801 - DNA, 20 bp, human
gcggccgttcccaggcccta

SEQ ID NO: 374802 - DNA, 20 bp, human
ggggggtcctggagtgcgac

SEQ ID NO: 374803 - DNA, 20 bp, human
gaggagggcggaggccaaga

SEQ ID NO: 374804 - DNA, 20 bp, human
gttagaggacccagaggtgg

SEQ ID NO: 374805 - DNA, 20 bp, human
gggctcaagaccagaggggc

SEQ ID NO: 374806 - DNA, 20 bp, human
ggggctgtgcgcaggcgctt

SEQ ID NO: 374807 - DNA, 20 bp, human
gcggcagggtcgttacgaag

SEQ ID NO: 374808 - DNA, 20 bp, human
gtgcgcaggcgcttcgggta

SEQ ID NO: 374809 - DNA, 20 bp, human
gaggccggacgatcgcgatt

SEQ ID NO: 374810 - DNA, 20 bp, human
gcaggcgcttcgggtagggg

SEQ ID NO: 374811 - DNA, 20 bp, human
ggccaaaaagcgcggagtca

SEQ ID NO: 374812 - DNA, 20 bp, human
ggggcgtgaacttggagtat

SEQ ID NO: 374813 - DNA, 20 bp, human
ggcgcggtgggccaatcaga

SEQ ID NO: 374814 - DNA, 20 bp, human
ggcgcctgcgcacagcccgg

SEQ ID NO: 374815 - DNA, 20 bp, human
gagcgcggagtcacggctgg

SEQ ID NO: 374816 - DNA, 20 bp, human
gggcgcgcgctcgttgtaac

SEQ ID NO: 374817 - DNA, 20 bp, human
ggagtctgtgggtaacctgg

SEQ ID NO: 374818 - DNA, 20 bp, human
gagcgcgctcccagcaaccg

SEQ ID NO: 374819 - DNA, 20 bp, human
ggaccgggaggaacgctcga

SEQ ID NO: 374820 - DNA, 20 bp, human
gggtgggtggagacgtgcgt

SEQ ID NO: 374821 - DNA, 20 bp, human
gtggaggtcgacagaccggg

SEQ ID NO: 374822 - DNA, 20 bp, human
gtgctgggagcgcgctctgg

SEQ ID NO: 374823 - DNA, 20 bp, human
gctccctcgagcgttcctcc

SEQ ID NO: 374824 - DNA, 20 bp, human
gcagaagaggccgtgacgta

SEQ ID NO: 374825 - DNA, 20 bp, human
ggaacgctcgagggagcacc

SEQ ID NO: 374826 - DNA, 20 bp, human
gcccgctcggccaggactgg

SEQ ID NO: 374827 - DNA, 20 bp, human
ggcggggcaaggtgatcgac

SEQ ID NO: 374828 - DNA, 20 bp, human
ggggcaaggtgatcgacagg

SEQ ID NO: 374829 - DNA, 20 bp, human
ggaggtgcggacacttccgg

SEQ ID NO: 374830 - DNA, 20 bp, human
gccccgaggcggaaggtaac

SEQ ID NO: 374831 - DNA, 20 bp, human
gaccttgccccgccgcacgt

SEQ ID NO: 374832 - DNA, 20 bp, human
gcccccgcccttccccgagg

SEQ ID NO: 374833 - DNA, 20 bp, human
gctcgcgcgagctcgccaaa

SEQ ID NO: 374834 - DNA, 20 bp, human
gcgcgcgttcgcttcccgct

SEQ ID NO: 374835 - DNA, 20 bp, human
gggcgcgccgacgtgcggcg

SEQ ID NO: 374836 - DNA, 20 bp, human
gccaccgcgggagcagggtt

SEQ ID NO: 374837 - DNA, 20 bp, human
ggtcactcgcagtgtcagag

SEQ ID NO: 374838 - DNA, 20 bp, human
gcccacccaccgcgggagca

SEQ ID NO: 374839 - DNA, 20 bp, human
gcgggggcgagaactcgttt

SEQ ID NO: 374840 - DNA, 20 bp, human
gtgaccgaaccctgctcccg

SEQ ID NO: 374841 - DNA, 20 bp, human
gggagggccggaaatttagg

SEQ ID NO: 374842 - DNA, 20 bp, human
gcggaaatttaggaggatgt

SEQ ID NO: 374843 - DNA, 20 bp, human
gttgggagggccggaaattt

SEQ ID NO: 374844 - DNA, 20 bp, human
gggaagacggaagttttggg

SEQ ID NO: 374845 - DNA, 20 bp, human
gtagggaagacggaagtttt

SEQ ID NO: 374846 - DNA, 20 bp, human
gtccgtcccgcgtcgtccct

SEQ ID NO: 374847 - DNA, 20 bp, human
gtctagcccagggacgacgc

SEQ ID NO: 374848 - DNA, 20 bp, human
gttcggggttgaagctcggg

SEQ ID NO: 374849 - DNA, 20 bp, human
gactgtgcgcgatctcttcg

SEQ ID NO: 374850 - DNA, 20 bp, human
gggtcgccgcggtctctgct

SEQ ID NO: 374851 - DNA, 20 bp, human
gcgcgctgacatcacgctcc

SEQ ID NO: 374852 - DNA, 20 bp, human
ggcgacgtttcggtgtagtg

SEQ ID NO: 374853 - DNA, 20 bp, human
gttttcaaagacggtgggga

SEQ ID NO: 374854 - DNA, 20 bp, human
gctcttcggggttgaagctc

SEQ ID NO: 374855 - DNA, 20 bp, human
gcgcccggtcagcaagacct

SEQ ID NO: 374856 - DNA, 20 bp, human
ggaagagtaactgcctaagt

SEQ ID NO: 374857 - DNA, 20 bp, human
gacacagaacgggcctttga

SEQ ID NO: 374858 - DNA, 20 bp, human
ggggcctttgagggtggaac

SEQ ID NO: 374859 - DNA, 20 bp, human
gatggaacactttcctactt

SEQ ID NO: 374860 - DNA, 20 bp, human
gccttgtttgcacattatta

SEQ ID NO: 374861 - DNA, 20 bp, human
gggagttctgagttaatctc

SEQ ID NO: 374862 - DNA, 20 bp, human
gcccgatcccctaaagaaaa

SEQ ID NO: 374863 - DNA, 20 bp, human
gtccattttctttaggggat

SEQ ID NO: 374864 - DNA, 20 bp, human
gaggaatctcttgaaaacag

SEQ ID NO: 374865 - DNA, 20 bp, human
gaagaggccaagtataaaca

SEQ ID NO: 374866 - DNA, 20 bp, human
gacagcatggggaaggcctc

SEQ ID NO: 374867 - DNA, 20 bp, human
ggggaaggcctcaggtttac

SEQ ID NO: 374868 - DNA, 20 bp, human
gctaacacgcgggtcatggg

SEQ ID NO: 374869 - DNA, 20 bp, human
gagactaacacgcgggtcat

SEQ ID NO: 374870 - DNA, 20 bp, human
gggagggggcgggacagcat

SEQ ID NO: 374871 - DNA, 20 bp, human
gaaggagggtgtagaaaacg

SEQ ID NO: 374872 - DNA, 20 bp, human
gtagaaaacggggagaggag

SEQ ID NO: 374873 - DNA, 20 bp, human
gcggagggatacgtttctat

SEQ ID NO: 374874 - DNA, 20 bp, human
gaactgaagagactaacacg

SEQ ID NO: 374875 - DNA, 20 bp, human
gagccaagaaacgacgcgga

SEQ ID NO: 374876 - DNA, 20 bp, human
gacctgccccgcagccgcca

SEQ ID NO: 374877 - DNA, 20 bp, human
gggcgtcttgggcgtcgcgc

SEQ ID NO: 374878 - DNA, 20 bp, human
gcgcgtggggacgccgggaa

SEQ ID NO: 374879 - DNA, 20 bp, human
gcatggcggcctcggcgtct

SEQ ID NO: 374880 - DNA, 20 bp, human
gaaccgcgagaaagaaacgc

SEQ ID NO: 374881 - DNA, 20 bp, human
ggcgctgctctgggcgctga

SEQ ID NO: 374882 - DNA, 20 bp, human
gagaataatagggaggagca

SEQ ID NO: 374883 - DNA, 20 bp, human
gaaaacgtagaataataggg

SEQ ID NO: 374884 - DNA, 20 bp, human
gtaatagggaggagcatggg

SEQ ID NO: 374885 - DNA, 20 bp, human
ggacctgcgtttctttctcg

SEQ ID NO: 374886 - DNA, 20 bp, human
ggaagcgaaggggtcggcgg

SEQ ID NO: 374887 - DNA, 20 bp, human
gagtcctcttaaagagaacg

SEQ ID NO: 374888 - DNA, 20 bp, human
gcccgagcgcggttcgcgct

SEQ ID NO: 374889 - DNA, 20 bp, human
ggggccttcgggcgctgaca

SEQ ID NO: 374890 - DNA, 20 bp, human
gaggcccttcgcacctccag

SEQ ID NO: 374891 - DNA, 20 bp, human
gctcggggatggcatccaca

SEQ ID NO: 374892 - DNA, 20 bp, human
ggcggaagcgaaggggtcgg

SEQ ID NO: 374893 - DNA, 20 bp, human
ggcactgcattgtgggaacg

SEQ ID NO: 374894 - DNA, 20 bp, human
ggcgccccctggaggtgcga

SEQ ID NO: 374895 - DNA, 20 bp, human
gtctccctgtcagcgcccga

SEQ ID NO: 374896 - DNA, 20 bp, human
gacgccgcgcggcgcagggg

SEQ ID NO: 374897 - DNA, 20 bp, human
ggggctcaggctctccaccg

SEQ ID NO: 374898 - DNA, 20 bp, human
gccggggagtggaaacgccc

SEQ ID NO: 374899 - DNA, 20 bp, human
gaggggcgcgggtgacgcac

SEQ ID NO: 374900 - DNA, 20 bp, human
gggagtggaaacgcccgggc

SEQ ID NO: 374901 - DNA, 20 bp, human
gcctgagccccgcgcgagtc

SEQ ID NO: 374902 - DNA, 20 bp, human
ggagccccgcgcgagtctgg

SEQ ID NO: 374903 - DNA, 20 bp, human
ggcaccggccgggccgactt

SEQ ID NO: 374904 - DNA, 20 bp, human
ggtggggatcataacctcgc

SEQ ID NO: 374905 - DNA, 20 bp, human
gagactggaagtggaaccgc

SEQ ID NO: 374906 - DNA, 20 bp, human
ggacagcagtagagcagtca

SEQ ID NO: 374907 - DNA, 20 bp, human
gagcagtagagcagtcaggg

SEQ ID NO: 374908 - DNA, 20 bp, human
ggctggttgggcggggttga

SEQ ID NO: 374909 - DNA, 20 bp, human
gacattgtcagggtactagg

SEQ ID NO: 374910 - DNA, 20 bp, human
gaatacattgtcagggtact

SEQ ID NO: 374911 - DNA, 20 bp, human
gtactagggggtaggctggt

SEQ ID NO: 374912 - DNA, 20 bp, human
gttatgcccaacttctagga

SEQ ID NO: 374913 - DNA, 20 bp, human
ggggggtaggctggttgggc

SEQ ID NO: 374914 - DNA, 20 bp, human
gcggggttgagggggtgttg

SEQ ID NO: 374915 - DNA, 20 bp, human
gagggtactagggggtaggc

SEQ ID NO: 374916 - DNA, 20 bp, human
gcacctcgggaatgcgggga

SEQ ID NO: 374917 - DNA, 20 bp, human
gggtgcccataaggagagct

SEQ ID NO: 374918 - DNA, 20 bp, human
ggctccggggccaagcggac

SEQ ID NO: 374919 - DNA, 20 bp, human
ggcccataaggagagctcgg

SEQ ID NO: 374920 - DNA, 20 bp, human
gtcccccgagctctccttat

SEQ ID NO: 374921 - DNA, 20 bp, human
gtgaaggaggcactctggcc

SEQ ID NO: 374922 - DNA, 20 bp, human
gcgcagaagcgagacatccc

SEQ ID NO: 374923 - DNA, 20 bp, human
gaggagagctcgggggatgc

SEQ ID NO: 374924 - DNA, 20 bp, human
gaggcctgaaggaggcactc

SEQ ID NO: 374925 - DNA, 20 bp, human
gcctgaatcgctgaagcgga

SEQ ID NO: 374926 - DNA, 20 bp, human
ggggcggcgtcaggcggcga

SEQ ID NO: 374927 - DNA, 20 bp, human
gagcgtcaggcggcgtcggg

SEQ ID NO: 374928 - DNA, 20 bp, human
gggtcaggccgaaccaccgg

SEQ ID NO: 374929 - DNA, 20 bp, human
gcggggtcaggccgaaccac

SEQ ID NO: 374930 - DNA, 20 bp, human
gggccgggcgctgggtgcga

SEQ ID NO: 374931 - DNA, 20 bp, human
gccgaaccaccggtggccgg

SEQ ID NO: 374932 - DNA, 20 bp, human
ggcctgacgccgcccgtcgc

SEQ ID NO: 374933 - DNA, 20 bp, human
gggtgcgagggggtcgccgg

SEQ ID NO: 374934 - DNA, 20 bp, human
gtagtggcgccgggagtcgc

SEQ ID NO: 374935 - DNA, 20 bp, human
ggtcctgcgctgccggcgac

SEQ ID NO: 374936 - DNA, 20 bp, human
gtacagggcggggtacagaa

SEQ ID NO: 374937 - DNA, 20 bp, human
gaaaacgcccccggcgttct

SEQ ID NO: 374938 - DNA, 20 bp, human
gaagggacgtcatttgtgac

SEQ ID NO: 374939 - DNA, 20 bp, human
gtctggagagcgaaacttgt

SEQ ID NO: 374940 - DNA, 20 bp, human
gccagactgcgcaagcgcaa

SEQ ID NO: 374941 - DNA, 20 bp, human
gcgtaggccccacctatcgt

SEQ ID NO: 374942 - DNA, 20 bp, human
ggtcccagcccccagaacgc

SEQ ID NO: 374943 - DNA, 20 bp, human
ggagagcgaaacttgtgggt

SEQ ID NO: 374944 - DNA, 20 bp, human
gctacgctctcgaagttgat

SEQ ID NO: 374945 - DNA, 20 bp, human
gcaactcgacccacgatagg

SEQ ID NO: 374946 - DNA, 20 bp, human
gcctcaatcccaaacagatt

SEQ ID NO: 374947 - DNA, 20 bp, human
ggccgcaagagctgccggga

SEQ ID NO: 374948 - DNA, 20 bp, human
gaccgtcccggcagctcttg

SEQ ID NO: 374949 - DNA, 20 bp, human
gcagctcttgcggcctgggt

SEQ ID NO: 374950 - DNA, 20 bp, human
gtaaagcgctccaagaagat

SEQ ID NO: 374951 - DNA, 20 bp, human
gaagaagatggggaccgtcc

SEQ ID NO: 374952 - DNA, 20 bp, human
ggaccgctccacctcgtccg

SEQ ID NO: 374953 - DNA, 20 bp, human
gccggcagctcttgcggcct

SEQ ID NO: 374954 - DNA, 20 bp, human
gcgcgcatgctcagagcaca

SEQ ID NO: 374955 - DNA, 20 bp, human
gggcagggccacggacgagg

SEQ ID NO: 374956 - DNA, 20 bp, human
ggcggaacttcagagttaag

SEQ ID NO: 374957 - DNA, 20 bp, human
gctagccggcagtatttcca

SEQ ID NO: 374958 - DNA, 20 bp, human
ggccaagtggtgagtttgga

SEQ ID NO: 374959 - DNA, 20 bp, human
gcggctagcgctgcgggaaa

SEQ ID NO: 374960 - DNA, 20 bp, human
gtctaactgggcccaggagg

SEQ ID NO: 374961 - DNA, 20 bp, human
gtgcgccttggaaatactgc

SEQ ID NO: 374962 - DNA, 20 bp, human
gaaagctcgccagaggaaaa

SEQ ID NO: 374963 - DNA, 20 bp, human
ggcgcacaaagagaagatcg

SEQ ID NO: 374964 - DNA, 20 bp, human
gctgctcgggttagatcgtc

SEQ ID NO: 374965 - DNA, 20 bp, human
gatggatcaacgccgccaag

SEQ ID NO: 374966 - DNA, 20 bp, human
gcttcggaaggccagaggga

SEQ ID NO: 374967 - DNA, 20 bp, human
gcgcgcttcggaaggccaga

SEQ ID NO: 374968 - DNA, 20 bp, human
gcttccgaagcgcgcggtgg

SEQ ID NO: 374969 - DNA, 20 bp, human
gggcaacgcgcgagactgac

SEQ ID NO: 374970 - DNA, 20 bp, human
ggggcggccaatagtggggg

SEQ ID NO: 374971 - DNA, 20 bp, human
gccccccttgcgcccgggtt

SEQ ID NO: 374972 - DNA, 20 bp, human
gtagccgccaccgcgcgctt

SEQ ID NO: 374973 - DNA, 20 bp, human
ggcgtggggcggccaatagt

SEQ ID NO: 374974 - DNA, 20 bp, human
gtcgcgcgttgcctgggcga

SEQ ID NO: 374975 - DNA, 20 bp, human
gtggctgcgtgggtcgccat

SEQ ID NO: 374976 - DNA, 20 bp, human
gagggacgccctgacagcgc

SEQ ID NO: 374977 - DNA, 20 bp, human
gagccgctgcctgctcctgc

SEQ ID NO: 374978 - DNA, 20 bp, human
ggccccggcgacagaaagag

SEQ ID NO: 374979 - DNA, 20 bp, human
ggcggtgggcgacgtggatc

SEQ ID NO: 374980 - DNA, 20 bp, human
gacgcccccagttcgcctgc

SEQ ID NO: 374981 - DNA, 20 bp, human
ggggcggcaacgtcccgcga

SEQ ID NO: 374982 - DNA, 20 bp, human
gtcagggcgtccctcccagc

SEQ ID NO: 374983 - DNA, 20 bp, human
gggagctgaggggcagataa

SEQ ID NO: 374984 - DNA, 20 bp, human
gtcggccaatcggcgcacgc

SEQ ID NO: 374985 - DNA, 20 bp, human
gtccccgcggcgtggaccac

SEQ ID NO: 374986 - DNA, 20 bp, human
gggcgcggctacacactcgc

SEQ ID NO: 374987 - DNA, 20 bp, human
gcgcgggcgcagctcttaaa

SEQ ID NO: 374988 - DNA, 20 bp, human
gcacgcgcagtgcccgccgc

SEQ ID NO: 374989 - DNA, 20 bp, human
gtaagagctgcgcccgcggg

SEQ ID NO: 374990 - DNA, 20 bp, human
gcgcgggtcaggatcccgga

SEQ ID NO: 374991 - DNA, 20 bp, human
gacagcccgcgcggaggaaa

SEQ ID NO: 374992 - DNA, 20 bp, human
ggcgtccctgggtggccgtc

SEQ ID NO: 374993 - DNA, 20 bp, human
gcactcgcgggtcaggatcc

SEQ ID NO: 374994 - DNA, 20 bp, human
ggctcttaaaggggcgatgg

SEQ ID NO: 374995 - DNA, 20 bp, human
gagtgcccgccgcggggggt

SEQ ID NO: 374996 - DNA, 20 bp, human
gcagacacccacacgggaga

SEQ ID NO: 374997 - DNA, 20 bp, human
gtggccgtctgctgaggcat

SEQ ID NO: 374998 - DNA, 20 bp, human
gtgctgaggcatggggggga

SEQ ID NO: 374999 - DNA, 20 bp, human
gccaactgcagacacccaca

SEQ ID NO: 375000 - DNA, 20 bp, human
ggtgcccagagatgcttagg

SEQ ID NO: 375001 - DNA, 20 bp, human
gccgtctgctgaggcatggg

SEQ ID NO: 375002 - DNA, 20 bp, human
ggggcgcagcatgagcggga

SEQ ID NO: 375003 - DNA, 20 bp, human
ggccaccccctaagcatctc

SEQ ID NO: 375004 - DNA, 20 bp, human
ggctgtgcccagagatgctt

SEQ ID NO: 375005 - DNA, 20 bp, human
gggagatggagacgacggcc

SEQ ID NO: 375006 - DNA, 20 bp, human
gctagtggcccgagggagcg

SEQ ID NO: 375007 - DNA, 20 bp, human
ggggagcgctagtggcccga

SEQ ID NO: 375008 - DNA, 20 bp, human
gtctgcgcgccttccctcgg

SEQ ID NO: 375009 - DNA, 20 bp, human
gaaggcgcgcagacgcgcag

SEQ ID NO: 375010 - DNA, 20 bp, human
gtccgggcgcgtcaggcagg

SEQ ID NO: 375011 - DNA, 20 bp, human
gcgcggccccggccggaagg

SEQ ID NO: 375012 - DNA, 20 bp, human
gagaaaacaagtgtctgctt

SEQ ID NO: 375013 - DNA, 20 bp, human
gggcctgctccgggcgcgtc

SEQ ID NO: 375014 - DNA, 20 bp, human
gccggcgcttcacatgaagg

SEQ ID NO: 375015 - DNA, 20 bp, human
ggggccggcgcttcacatga

SEQ ID NO: 375016 - DNA, 20 bp, human
gaggcctcagtgcgcggagt

SEQ ID NO: 375017 - DNA, 20 bp, human
ggcgcgcaggcctcagtgcg

SEQ ID NO: 375018 - DNA, 20 bp, human
gggacgtgatcgaccagccg

SEQ ID NO: 375019 - DNA, 20 bp, human
gtatcaggcctgggactcgg

SEQ ID NO: 375020 - DNA, 20 bp, human
gcctcagtgcgcggagtggg

SEQ ID NO: 375021 - DNA, 20 bp, human
gagtcccaggcctgatagcg

SEQ ID NO: 375022 - DNA, 20 bp, human
gcactgaggcctgcgcgcgc

SEQ ID NO: 375023 - DNA, 20 bp, human
gggctgcccgaggcctcggc

SEQ ID NO: 375024 - DNA, 20 bp, human
ggcgccccgctatcaggcct

SEQ ID NO: 375025 - DNA, 20 bp, human
gcgggcgggggcgcgtgtgt

SEQ ID NO: 375026 - DNA, 20 bp, human
gccagcttccggcaactcaa

SEQ ID NO: 375027 - DNA, 20 bp, human
gggccgagtgcgtgcgcctc

SEQ ID NO: 375028 - DNA, 20 bp, human
gagcccggtgaggggtccca

SEQ ID NO: 375029 - DNA, 20 bp, human
gcacgcactcggccagcttc

SEQ ID NO: 375030 - DNA, 20 bp, human
gagaggcggtagctgacagg

SEQ ID NO: 375031 - DNA, 20 bp, human
gcaactcaagggttacgacc

SEQ ID NO: 375032 - DNA, 20 bp, human
gaagggttacgaccaggcgg

SEQ ID NO: 375033 - DNA, 20 bp, human
gcgcgattccagcacgaagg

SEQ ID NO: 375034 - DNA, 20 bp, human
gactgggcgcagacagaact

SEQ ID NO: 375035 - DNA, 20 bp, human
gcataaaatggttgtctctc

SEQ ID NO: 375036 - DNA, 20 bp, human
gcgggcccgcggagcttctc

SEQ ID NO: 375037 - DNA, 20 bp, human
gggacctgagagcccctcat

SEQ ID NO: 375038 - DNA, 20 bp, human
gccgaacagcggagaccgga

SEQ ID NO: 375039 - DNA, 20 bp, human
gaacccaggaagcccatgag

SEQ ID NO: 375040 - DNA, 20 bp, human
gtggaggcccagaacagctc

SEQ ID NO: 375041 - DNA, 20 bp, human
gcagcccctgggcacaggtc

SEQ ID NO: 375042 - DNA, 20 bp, human
gcccgcggagcttctcaggg

SEQ ID NO: 375043 - DNA, 20 bp, human
gggctgggcgggccgaacag

SEQ ID NO: 375044 - DNA, 20 bp, human
gcgggccgaacagcggagac

SEQ ID NO: 375045 - DNA, 20 bp, human
ggacaggtctagagaggatc

SEQ ID NO: 375046 - DNA, 20 bp, human
ggcaccatattgaggtatgg

SEQ ID NO: 375047 - DNA, 20 bp, human
gaatgcaccatattgaggta

SEQ ID NO: 375048 - DNA, 20 bp, human
gaacacttagacgtgaagat

SEQ ID NO: 375049 - DNA, 20 bp, human
gggacttctaagtttgtgga

SEQ ID NO: 375050 - DNA, 20 bp, human
gggcagaatgcaccatattg

SEQ ID NO: 375051 - DNA, 20 bp, human
gaattgtcatacatcataga

SEQ ID NO: 375052 - DNA, 20 bp, human
gatacttaagcaactgttct

SEQ ID NO: 375053 - DNA, 20 bp, human
gtttcccccatacctcaata

SEQ ID NO: 375054 - DNA, 20 bp, human
gtacaagggggccgtctgca

SEQ ID NO: 375055 - DNA, 20 bp, human
gctgcaaggagacccgcctc

SEQ ID NO: 375056 - DNA, 20 bp, human
gcctgcgcacgactccccca

SEQ ID NO: 375057 - DNA, 20 bp, human
gcccggacaggagttgttag

SEQ ID NO: 375058 - DNA, 20 bp, human
ggccgagcgaatctcggagt

SEQ ID NO: 375059 - DNA, 20 bp, human
gagcgaatctcggagtcggt

SEQ ID NO: 375060 - DNA, 20 bp, human
ggcagccggcggcaccaggc

SEQ ID NO: 375061 - DNA, 20 bp, human
gcgccgcgccgagcgaatct

SEQ ID NO: 375062 - DNA, 20 bp, human
gccggtgctcacggtgttcc

SEQ ID NO: 375063 - DNA, 20 bp, human
gcggagtcggtgggtgcaga

SEQ ID NO: 375064 - DNA, 20 bp, human
ggacagcgctgcttccgcgg

SEQ ID NO: 375065 - DNA, 20 bp, human
gagcaccggcctggtgccgc

SEQ ID NO: 375066 - DNA, 20 bp, human
ggacccgcgccggtttccgc

SEQ ID NO: 375067 - DNA, 20 bp, human
ggaaaccggcgcgggtccct

SEQ ID NO: 375068 - DNA, 20 bp, human
ggcggccaagggacccgcgc

SEQ ID NO: 375069 - DNA, 20 bp, human
gcgcccgcggaaaccggcgc

SEQ ID NO: 375070 - DNA, 20 bp, human
gcagaggggggattcgaggg

SEQ ID NO: 375071 - DNA, 20 bp, human
gcagcagaggggggattcga

SEQ ID NO: 375072 - DNA, 20 bp, human
ggacctgcaaatcctgcccg

SEQ ID NO: 375073 - DNA, 20 bp, human
gacggggagcccgcagcaga

SEQ ID NO: 375074 - DNA, 20 bp, human
gggccccgggcaggatttgc

SEQ ID NO: 375075 - DNA, 20 bp, human
gggctccccgtggcctttgg

SEQ ID NO: 375076 - DNA, 20 bp, human
gccagctcctgcaccccgga

SEQ ID NO: 375077 - DNA, 20 bp, human
gaggcatgaggctagaaggg

SEQ ID NO: 375078 - DNA, 20 bp, human
gggcaaggcatgaggctaga

SEQ ID NO: 375079 - DNA, 20 bp, human
gtgggtggggacctgcatgg

SEQ ID NO: 375080 - DNA, 20 bp, human
gtagaagggtggctgaggcg

SEQ ID NO: 375081 - DNA, 20 bp, human
gatacggagtgtgcaggtct

SEQ ID NO: 375082 - DNA, 20 bp, human
gggtgtgatctgcgaagata

SEQ ID NO: 375083 - DNA, 20 bp, human
gactcccttggccaccatgc

SEQ ID NO: 375084 - DNA, 20 bp, human
ggagtggcagttaagtaagg

SEQ ID NO: 375085 - DNA, 20 bp, human
gagggagtggcagttaagta

SEQ ID NO: 375086 - DNA, 20 bp, human
gtgccgggtcgcaactgcgg

SEQ ID NO: 375087 - DNA, 20 bp, human
gcaccgggaagtcacgtggc

SEQ ID NO: 375088 - DNA, 20 bp, human
gaggccaccgggaagtcacg

SEQ ID NO: 375089 - DNA, 20 bp, human
ggcggaaggcggactctcgc

SEQ ID NO: 375090 - DNA, 20 bp, human
ggggtcgcaactgcggcgga

SEQ ID NO: 375091 - DNA, 20 bp, human
gagctgccgggtcgcaactg

SEQ ID NO: 375092 - DNA, 20 bp, human
gtctcgcgggagccacaaag

SEQ ID NO: 375093 - DNA, 20 bp, human
gagccggccacgtgacttcc

SEQ ID NO: 375094 - DNA, 20 bp, human
gtcgcaactgcggcggaagg

SEQ ID NO: 375095 - DNA, 20 bp, human
gtgagcagccacgtcggcgg

SEQ ID NO: 375096 - DNA, 20 bp, human
gggcaggcgggcactacaaa

SEQ ID NO: 375097 - DNA, 20 bp, human
gggagcgctcacagcctctc

SEQ ID NO: 375098 - DNA, 20 bp, human
gggcactacaaagggaaagg

SEQ ID NO: 375099 - DNA, 20 bp, human
gtggctccggaaaggcgttt

SEQ ID NO: 375100 - DNA, 20 bp, human
gggctgtgagcgctcctaag

SEQ ID NO: 375101 - DNA, 20 bp, human
ggagaacgcacaaacctctt

SEQ ID NO: 375102 - DNA, 20 bp, human
ggggatgccaacggtaagtc

SEQ ID NO: 375103 - DNA, 20 bp, human
gttgaaaagccccccaaaga

SEQ ID NO: 375104 - DNA, 20 bp, human
ggagaacgggtctgctctgg

SEQ ID NO: 375105 - DNA, 20 bp, human
ggttccgcccaatgccttgt

SEQ ID NO: 375106 - DNA, 20 bp, human
gggcgagcgggccagacttc

SEQ ID NO: 375107 - DNA, 20 bp, human
gcgcgctgacgggtcgttag

SEQ ID NO: 375108 - DNA, 20 bp, human
gcagcttggcgccactagat

SEQ ID NO: 375109 - DNA, 20 bp, human
ggcgaagagcaagcgtcccc

SEQ ID NO: 375110 - DNA, 20 bp, human
gccgctcgcccaatcacgcc

SEQ ID NO: 375111 - DNA, 20 bp, human
gtcagcgcggcgcgcggagg

SEQ ID NO: 375112 - DNA, 20 bp, human
ggccgcaggggcggagtcaa

SEQ ID NO: 375113 - DNA, 20 bp, human
gcgcccggaagcctatctag

SEQ ID NO: 375114 - DNA, 20 bp, human
ggccaagctggccaatcctg

SEQ ID NO: 375115 - DNA, 20 bp, human
ggagcaagcgtccccaggat

SEQ ID NO: 375116 - DNA, 20 bp, human
gccgctgccgccatgttgag

SEQ ID NO: 375117 - DNA, 20 bp, human
gtgctctaggcgccggaagg

SEQ ID NO: 375118 - DNA, 20 bp, human
gaggaagagcgacgcgtaag

SEQ ID NO: 375119 - DNA, 20 bp, human
gtcccagggacggcagagaa

SEQ ID NO: 375120 - DNA, 20 bp, human
ggcgcaccgaacggctgggc

SEQ ID NO: 375121 - DNA, 20 bp, human
ggcagcggtgctctaggcgc

SEQ ID NO: 375122 - DNA, 20 bp, human
ggccggcattgtgacgtctc

SEQ ID NO: 375123 - DNA, 20 bp, human
gtgcgtgtcgggacgtgcgg

SEQ ID NO: 375124 - DNA, 20 bp, human
gcagccgttcggtgcgcgat

SEQ ID NO: 375125 - DNA, 20 bp, human
gcgctctcgcgagagttcga

SEQ ID NO: 375126 - DNA, 20 bp, human
gagagcgtcagcgactctgg

SEQ ID NO: 375127 - DNA, 20 bp, human
ggtgaagcctctctcaccca

SEQ ID NO: 375128 - DNA, 20 bp, human
gttctaggccggattccccc

SEQ ID NO: 375129 - DNA, 20 bp, human
gtctggaggacctgagggaa

SEQ ID NO: 375130 - DNA, 20 bp, human
gcggcctagaaaatgtgtgt

SEQ ID NO: 375131 - DNA, 20 bp, human
ggcgactctggaggacctga

SEQ ID NO: 375132 - DNA, 20 bp, human
gctctcacccagggggaatc

SEQ ID NO: 375133 - DNA, 20 bp, human
gcgggtgttggtgtcatcgt

SEQ ID NO: 375134 - DNA, 20 bp, human
gagccagctcatcctctctg

SEQ ID NO: 375135 - DNA, 20 bp, human
gtggctagagagacgcgagt

SEQ ID NO: 375136 - DNA, 20 bp, human
gtgcccggggtggggcgtgt

SEQ ID NO: 375137 - DNA, 20 bp, human
gacctcgctgtgcccggggt

SEQ ID NO: 375138 - DNA, 20 bp, human
gctaccgagaacctgctcgg

SEQ ID NO: 375139 - DNA, 20 bp, human
ggggggacgcgtccgtcaac

SEQ ID NO: 375140 - DNA, 20 bp, human
gtggtccccttcatccacga

SEQ ID NO: 375141 - DNA, 20 bp, human
ggagaagtcgtcgacttctg

SEQ ID NO: 375142 - DNA, 20 bp, human
gtccgtcaaccggaatccag

SEQ ID NO: 375143 - DNA, 20 bp, human
ggccctgaacggagctggtg

SEQ ID NO: 375144 - DNA, 20 bp, human
ggaaagggaaaccccagggg

SEQ ID NO: 375145 - DNA, 20 bp, human
gtcccctggattccggttga

SEQ ID NO: 375146 - DNA, 20 bp, human
ggaggtgacaagatctaaag

SEQ ID NO: 375147 - DNA, 20 bp, human
gaacagggcatgtgtatggt

SEQ ID NO: 375148 - DNA, 20 bp, human
gaggctaatggtgcgtaaaa

SEQ ID NO: 375149 - DNA, 20 bp, human
gaaagattgtataaatcgtg

SEQ ID NO: 375150 - DNA, 20 bp, human
gaaaagggctggtgagatct

SEQ ID NO: 375151 - DNA, 20 bp, human
gatgacagatggagttgtct

SEQ ID NO: 375152 - DNA, 20 bp, human
gaaaaatactgcacacgcac

SEQ ID NO: 375153 - DNA, 20 bp, human
gcaatcacagaagacagggg

SEQ ID NO: 375154 - DNA, 20 bp, human
gagggcatgtgtatggtagg

SEQ ID NO: 375155 - DNA, 20 bp, human
ggtataaatcgtggggcatg

SEQ ID NO: 375156 - DNA, 20 bp, human
ggctgcgagggaaccccgga

SEQ ID NO: 375157 - DNA, 20 bp, human
ggaggcagatggtgctgcga

SEQ ID NO: 375158 - DNA, 20 bp, human
gccgccctccagtaaggccg

SEQ ID NO: 375159 - DNA, 20 bp, human
ggcactctgctcaactttag

SEQ ID NO: 375160 - DNA, 20 bp, human
gcagctacgaaaaaaggggg

SEQ ID NO: 375161 - DNA, 20 bp, human
gtggtgctgcgagggaaccc

SEQ ID NO: 375162 - DNA, 20 bp, human
ggcagagtgcaggactggga

SEQ ID NO: 375163 - DNA, 20 bp, human
gcagcagctacgaaaaaagg

SEQ ID NO: 375164 - DNA, 20 bp, human
gctgcaaggcaagcgagggt

SEQ ID NO: 375165 - DNA, 20 bp, human
ggttgagcagagtgcaggac

SEQ ID NO: 375166 - DNA, 20 bp, human
ggaaatgtgccgaggggccc

SEQ ID NO: 375167 - DNA, 20 bp, human
gtccttctgcaggacccggg

SEQ ID NO: 375168 - DNA, 20 bp, human
gagaccggctgaaacgcctg

SEQ ID NO: 375169 - DNA, 20 bp, human
gtacagacagccggggagcg

SEQ ID NO: 375170 - DNA, 20 bp, human
gccgctgtgacgtagcggga

SEQ ID NO: 375171 - DNA, 20 bp, human
gcggctgaaacgcctgcggg

SEQ ID NO: 375172 - DNA, 20 bp, human
gtcctcccgggtcctgcaga

SEQ ID NO: 375173 - DNA, 20 bp, human
gtctgcctgcggccacccgc

SEQ ID NO: 375174 - DNA, 20 bp, human
gtaaccttttacgcccccgc

SEQ ID NO: 375175 - DNA, 20 bp, human
gagagaggggacccgcctgc

SEQ ID NO: 375176 - DNA, 20 bp, human
ggcggggtgcaggttaaggg

SEQ ID NO: 375177 - DNA, 20 bp, human
ggggtgcaggttaagggagg

SEQ ID NO: 375178 - DNA, 20 bp, human
gaagggaggaggcccggaga

SEQ ID NO: 375179 - DNA, 20 bp, human
ggggcgcagaccctgttacc

SEQ ID NO: 375180 - DNA, 20 bp, human
gggccggagagcaggtgtgg

SEQ ID NO: 375181 - DNA, 20 bp, human
gacatggagcccgtgaagga

SEQ ID NO: 375182 - DNA, 20 bp, human
ggtggcctcacgagctgctc

SEQ ID NO: 375183 - DNA, 20 bp, human
gagccaaggccagcgggcgt

SEQ ID NO: 375184 - DNA, 20 bp, human
gcacgagctgctctggctac

SEQ ID NO: 375185 - DNA, 20 bp, human
ggggggcggggtgcaggtta

SEQ ID NO: 375186 - DNA, 20 bp, human
ggggagggggcgaccgaggt

SEQ ID NO: 375187 - DNA, 20 bp, human
gggggccggagacgactcca

SEQ ID NO: 375188 - DNA, 20 bp, human
gcgactggctcgcaccgctg

SEQ ID NO: 375189 - DNA, 20 bp, human
gcgaccgaggtgggaaaacg

SEQ ID NO: 375190 - DNA, 20 bp, human
gccagccctggagtcgtctc

SEQ ID NO: 375191 - DNA, 20 bp, human
gccgaggtgggaaaacgggg

SEQ ID NO: 375192 - DNA, 20 bp, human
ggggtgaggcgctgaccccc

SEQ ID NO: 375193 - DNA, 20 bp, human
gaccccgggagggccggacg

SEQ ID NO: 375194 - DNA, 20 bp, human
gcaccgcgcgggcgcccgac

SEQ ID NO: 375195 - DNA, 20 bp, human
gggcagagtcggcagcgggg

SEQ ID NO: 375196 - DNA, 20 bp, human
gtggcctggccgcagcatcc

SEQ ID NO: 375197 - DNA, 20 bp, human
gccccgggagcccagacgga

SEQ ID NO: 375198 - DNA, 20 bp, human
gcgacagcagccgtccgtct

SEQ ID NO: 375199 - DNA, 20 bp, human
ggtggccccgggagcccaga

SEQ ID NO: 375200 - DNA, 20 bp, human
gcggacggctgctgtcgata

SEQ ID NO: 375201 - DNA, 20 bp, human
gtgggtgcaggggcggccac

SEQ ID NO: 375202 - DNA, 20 bp, human
gcctgcacccagatggcgcc

SEQ ID NO: 375203 - DNA, 20 bp, human
gaggggcttcagggagacgc

SEQ ID NO: 375204 - DNA, 20 bp, human
gccaggaggcgcgggatcac

SEQ ID NO: 375205 - DNA, 20 bp, human
gtgccctcgtctaccaggta

SEQ ID NO: 375206 - DNA, 20 bp, human
gtgggggcgcaggcgatcat

SEQ ID NO: 375207 - DNA, 20 bp, human
ggactcccgggtcccacgtc

SEQ ID NO: 375208 - DNA, 20 bp, human
ggtggagggtccttgttcaa

SEQ ID NO: 375209 - DNA, 20 bp, human
ggctgtgggcgagtgcgcca

SEQ ID NO: 375210 - DNA, 20 bp, human
ggctctgcagacgtctctga

SEQ ID NO: 375211 - DNA, 20 bp, human
ggacagcaagaaaatagggt

SEQ ID NO: 375212 - DNA, 20 bp, human
ggttcccggaggccagacgt

SEQ ID NO: 375213 - DNA, 20 bp, human
ggggtcccacgtctggcctc

SEQ ID NO: 375214 - DNA, 20 bp, human
gtgggacccgggagtcgagc

SEQ ID NO: 375215 - DNA, 20 bp, human
gtggggttgtggagataagt

SEQ ID NO: 375216 - DNA, 20 bp, human
ggcccggcgtttcgtctctt

SEQ ID NO: 375217 - DNA, 20 bp, human
ggggccctcaatgctatctc

SEQ ID NO: 375218 - DNA, 20 bp, human
gttgccggagatagcattga

SEQ ID NO: 375219 - DNA, 20 bp, human
gtctctgctgcggacgccgg

SEQ ID NO: 375220 - DNA, 20 bp, human
gaggccggtaacagcggcac

SEQ ID NO: 375221 - DNA, 20 bp, human
gttcgcatcgctcccaaagg

SEQ ID NO: 375222 - DNA, 20 bp, human
gacccgcactccacaaggcc

SEQ ID NO: 375223 - DNA, 20 bp, human
gggagtgcgggtctctgctg

SEQ ID NO: 375224 - DNA, 20 bp, human
gggaacaacaggacgtcata

SEQ ID NO: 375225 - DNA, 20 bp, human
ggcatcgctcccaaaggcgg

SEQ ID NO: 375226 - DNA, 20 bp, human
gatcagagagatcccgagga

SEQ ID NO: 375227 - DNA, 20 bp, human
gaaggactcaacagggaagg

SEQ ID NO: 375228 - DNA, 20 bp, human
ggcacctgagaccctgggac

SEQ ID NO: 375229 - DNA, 20 bp, human
ggaagatcagagagatcccg

SEQ ID NO: 375230 - DNA, 20 bp, human
gagcacacagagccctcctc

SEQ ID NO: 375231 - DNA, 20 bp, human
gtcaaccatccatccccaga

SEQ ID NO: 375232 - DNA, 20 bp, human
ggctctgtgtgcttggatca

SEQ ID NO: 375233 - DNA, 20 bp, human
gtctcaggtgctctgtgatc

SEQ ID NO: 375234 - DNA, 20 bp, human
ggattgtggtacaggtgcag

SEQ ID NO: 375235 - DNA, 20 bp, human
gcaggaatagaagacagtct

SEQ ID NO: 375236 - DNA, 20 bp, human
gaccaccgaggaggtgggga

SEQ ID NO: 375237 - DNA, 20 bp, human
gaatgcaccaccgaggaggt

SEQ ID NO: 375238 - DNA, 20 bp, human
gtctgcaatgtcattgctcc

SEQ ID NO: 375239 - DNA, 20 bp, human
gtaacaatgcaccaccgagg

SEQ ID NO: 375240 - DNA, 20 bp, human
gggataacaatgcaccaccg

SEQ ID NO: 375241 - DNA, 20 bp, human
gaggtatgggattttttcct

SEQ ID NO: 375242 - DNA, 20 bp, human
gcaaccgtgagccgccgcac

SEQ ID NO: 375243 - DNA, 20 bp, human
ggggccggtgcggcggctca

SEQ ID NO: 375244 - DNA, 20 bp, human
gtaagaaatttgggccggtg

SEQ ID NO: 375245 - DNA, 20 bp, human
ggaaatttgggccggtgcgg

SEQ ID NO: 375246 - DNA, 20 bp, human
gaactggcggagccaatggg

SEQ ID NO: 375247 - DNA, 20 bp, human
gcggcctccgcaggtttccg

SEQ ID NO: 375248 - DNA, 20 bp, human
ggaaacctgcggaggccggg

SEQ ID NO: 375249 - DNA, 20 bp, human
gcgcgcggaccgcagggata

SEQ ID NO: 375250 - DNA, 20 bp, human
ggaacctcggaaacctgcgg

SEQ ID NO: 375251 - DNA, 20 bp, human
gcgcgctgcgggcgcagctg

SEQ ID NO: 375252 - DNA, 20 bp, human
gtgggaacctcggaaacctg

SEQ ID NO: 375253 - DNA, 20 bp, human
ggctaggcgatgaacaaccg

SEQ ID NO: 375254 - DNA, 20 bp, human
gcgctgcaggcgtcagaagg

SEQ ID NO: 375255 - DNA, 20 bp, human
ggcctgcattggtcgggtgg

SEQ ID NO: 375256 - DNA, 20 bp, human
gcagaacagtaggcggaaca

SEQ ID NO: 375257 - DNA, 20 bp, human
ggaaccttcccaaggcgggg

SEQ ID NO: 375258 - DNA, 20 bp, human
gtcgcacaaagtgtggctgg

SEQ ID NO: 375259 - DNA, 20 bp, human
gcctcccccccgccttggga

SEQ ID NO: 375260 - DNA, 20 bp, human
gggacagaaccttcccaagg

SEQ ID NO: 375261 - DNA, 20 bp, human
gtagggacagaaccttccca

SEQ ID NO: 375262 - DNA, 20 bp, human
gttgtcgcacaaagtgtggc

SEQ ID NO: 375263 - DNA, 20 bp, human
gtctcccctcccccccgcct

SEQ ID NO: 375264 - DNA, 20 bp, human
gccaaggggacgctttcggc

SEQ ID NO: 375265 - DNA, 20 bp, human
gacactttgtgcgacaaagt

SEQ ID NO: 375266 - DNA, 20 bp, human
gtccgccggaaggggaggtg

SEQ ID NO: 375267 - DNA, 20 bp, human
ggccgcgtcgccaggaaacc

SEQ ID NO: 375268 - DNA, 20 bp, human
ggggaacgcaaccgcctgca

SEQ ID NO: 375269 - DNA, 20 bp, human
gtgagaatgtatgcgcaggg

SEQ ID NO: 375270 - DNA, 20 bp, human
gacggcctaactcacgcgtc

SEQ ID NO: 375271 - DNA, 20 bp, human
gaagagaaagagggtaacga

SEQ ID NO: 375272 - DNA, 20 bp, human
gaatatgagaatgtatgcgc

SEQ ID NO: 375273 - DNA, 20 bp, human
gggagataacatcccctcca

SEQ ID NO: 375274 - DNA, 20 bp, human
gcgcgtcgggaagagaaaga

SEQ ID NO: 375275 - DNA, 20 bp, human
gcgagctgggaccgaccctc

SEQ ID NO: 375276 - DNA, 20 bp, human
gaccttcaggcccagagccg

SEQ ID NO: 375277 - DNA, 20 bp, human
gacggcgttcaccacccctc

SEQ ID NO: 375278 - DNA, 20 bp, human
gctcccgcctggagaacagg

SEQ ID NO: 375279 - DNA, 20 bp, human
gagagaccggaggcgcatga

SEQ ID NO: 375280 - DNA, 20 bp, human
gactcgggtggtggtcgcta

SEQ ID NO: 375281 - DNA, 20 bp, human
ggccctcaccatcaccacga

SEQ ID NO: 375282 - DNA, 20 bp, human
gaagatggttggcatcaagg

SEQ ID NO: 375283 - DNA, 20 bp, human
gcctggcccaggctccccgt

SEQ ID NO: 375284 - DNA, 20 bp, human
ggtgaacgccgtcgtggtga

SEQ ID NO: 375285 - DNA, 20 bp, human
ggtgaggccccctcaccttc

SEQ ID NO: 375286 - DNA, 20 bp, human
ggaccgctggagatgtgact

SEQ ID NO: 375287 - DNA, 20 bp, human
ggggctggcgccgagtggca

SEQ ID NO: 375288 - DNA, 20 bp, human
gcggtccggtgatggccgtg

SEQ ID NO: 375289 - DNA, 20 bp, human
ggcaagcaagcaaagaaact

SEQ ID NO: 375290 - DNA, 20 bp, human
ggcctcttgacagatactcg

SEQ ID NO: 375291 - DNA, 20 bp, human
gccggtgggagtcaagaaag

SEQ ID NO: 375292 - DNA, 20 bp, human
gccgtggggctggcgccgag

SEQ ID NO: 375293 - DNA, 20 bp, human
ggtggacaacagacccttgt

SEQ ID NO: 375294 - DNA, 20 bp, human
gccggcctgcgcggtccacg

SEQ ID NO: 375295 - DNA, 20 bp, human
gagtggcacggcctccacag

SEQ ID NO: 375296 - DNA, 20 bp, human
gacctcagagcgtcggggat

SEQ ID NO: 375297 - DNA, 20 bp, human
gggacccggaggggcgtgtc

SEQ ID NO: 375298 - DNA, 20 bp, human
gcaccgagggtcggccctgt

SEQ ID NO: 375299 - DNA, 20 bp, human
gaggaccgccgagctcccga

SEQ ID NO: 375300 - DNA, 20 bp, human
ggggatgggcgtggccccgt

SEQ ID NO: 375301 - DNA, 20 bp, human
ggcggggattggacccggag

SEQ ID NO: 375302 - DNA, 20 bp, human
gcgctctgaggtcacctaca

SEQ ID NO: 375303 - DNA, 20 bp, human
gcgccccgtcgggagctcgg

SEQ ID NO: 375304 - DNA, 20 bp, human
gcacctacagggccgaccct

SEQ ID NO: 375305 - DNA, 20 bp, human
gtcccacacgccgtataagt

SEQ ID NO: 375306 - DNA, 20 bp, human
ggggaccccgcgccgtagga

SEQ ID NO: 375307 - DNA, 20 bp, human
gacgacctggagcgtctgtc

SEQ ID NO: 375308 - DNA, 20 bp, human
gctacggcgcggggtcccct

SEQ ID NO: 375309 - DNA, 20 bp, human
ggcggggccggatggacccg

SEQ ID NO: 375310 - DNA, 20 bp, human
gacccaaggggaagccccga

SEQ ID NO: 375311 - DNA, 20 bp, human
gcgtccgcctcgggtccatc

SEQ ID NO: 375312 - DNA, 20 bp, human
gctagcctgacagacgctcc

SEQ ID NO: 375313 - DNA, 20 bp, human
gggcggggacgccccggtgg

SEQ ID NO: 375314 - DNA, 20 bp, human
gaggagccggcgaaccgcga

SEQ ID NO: 375315 - DNA, 20 bp, human
gctgggccccggctccatcg

SEQ ID NO: 375316 - DNA, 20 bp, human
gccgaacggaggcgcagagt

SEQ ID NO: 375317 - DNA, 20 bp, human
gggaaagccgagccaagttg

SEQ ID NO: 375318 - DNA, 20 bp, human
gcggccggggccgggtgcca

SEQ ID NO: 375319 - DNA, 20 bp, human
gaagccgagccaagttgggg

SEQ ID NO: 375320 - DNA, 20 bp, human
gaagcgaggaggcgggatga

SEQ ID NO: 375321 - DNA, 20 bp, human
gaggcggggcgaccgaggag

SEQ ID NO: 375322 - DNA, 20 bp, human
gaaggggagggccgcgcgca

SEQ ID NO: 375323 - DNA, 20 bp, human
ggcaggaagcccggagccaa

SEQ ID NO: 375324 - DNA, 20 bp, human
ggtgaaaggcggggcgaccg

SEQ ID NO: 375325 - DNA, 20 bp, human
ggagcccgctgcggtccacg

SEQ ID NO: 375326 - DNA, 20 bp, human
gctcagggggtccgccgtgc

SEQ ID NO: 375327 - DNA, 20 bp, human
gcacccctgcccggcttgaa

SEQ ID NO: 375328 - DNA, 20 bp, human
ggagacggggaggatgtgaa

SEQ ID NO: 375329 - DNA, 20 bp, human
gccggcttgaagggaagggt

SEQ ID NO: 375330 - DNA, 20 bp, human
gaagacagcgcgcgcatccc

SEQ ID NO: 375331 - DNA, 20 bp, human
ggcgccggcatgctgggata

SEQ ID NO: 375332 - DNA, 20 bp, human
ggggctttgtagtttcgcta

SEQ ID NO: 375333 - DNA, 20 bp, human
gcgcgcatcccagggattgt

SEQ ID NO: 375334 - DNA, 20 bp, human
gagcgggcgctgggtcgcta

SEQ ID NO: 375335 - DNA, 20 bp, human
ggcggcgctcggggagggtt

SEQ ID NO: 375336 - DNA, 20 bp, human
gctggcaccaatctgcgctg

SEQ ID NO: 375337 - DNA, 20 bp, human
gcccgaaggccattgattgg

SEQ ID NO: 375338 - DNA, 20 bp, human
gaatctgcgctgcggtcggg

SEQ ID NO: 375339 - DNA, 20 bp, human
ggcccccgaaggccattgat

SEQ ID NO: 375340 - DNA, 20 bp, human
gggtcccccagtctcgtgat

SEQ ID NO: 375341 - DNA, 20 bp, human
ggccccgccaatcacgagac

SEQ ID NO: 375342 - DNA, 20 bp, human
gagccccggtgcccgataga

SEQ ID NO: 375343 - DNA, 20 bp, human
gcccccagtctcgtgattgg

SEQ ID NO: 375344 - DNA, 20 bp, human
gaccaatctgcgctgcggtc

SEQ ID NO: 375345 - DNA, 20 bp, human
gtttccttgagtcacatgat

SEQ ID NO: 375346 - DNA, 20 bp, human
ggggcgggacggcaaatccg

SEQ ID NO: 375347 - DNA, 20 bp, human
ggcagcactgctctcgtggt

SEQ ID NO: 375348 - DNA, 20 bp, human
ggcactgctctcgtggtagg

SEQ ID NO: 375349 - DNA, 20 bp, human
gctctcgtggtaggcggggt

SEQ ID NO: 375350 - DNA, 20 bp, human
gcgcggctcctgcgtctatt

SEQ ID NO: 375351 - DNA, 20 bp, human
gcggggaacgcaaagtgcta

SEQ ID NO: 375352 - DNA, 20 bp, human
gcgcgcggccgcgacccggt

SEQ ID NO: 375353 - DNA, 20 bp, human
gcggggcgagaggttcgcgc

SEQ ID NO: 375354 - DNA, 20 bp, human
ggggcagcgcagctccgcat

SEQ ID NO: 375355 - DNA, 20 bp, human
gcgagcagcccaatagacgc

SEQ ID NO: 375356 - DNA, 20 bp, human
gtgccgcgcggtcgcaggct

SEQ ID NO: 375357 - DNA, 20 bp, human
gtgttcgcgcctccgagacc

SEQ ID NO: 375358 - DNA, 20 bp, human
gcgcggtcgcaggcttggga

SEQ ID NO: 375359 - DNA, 20 bp, human
gcggaagaggaggcctgatg

SEQ ID NO: 375360 - DNA, 20 bp, human
gacacggcggcccgactccc

SEQ ID NO: 375361 - DNA, 20 bp, human
gccaccctggcgccattcac

SEQ ID NO: 375362 - DNA, 20 bp, human
ggacacgcttgcgcacacgg

SEQ ID NO: 375363 - DNA, 20 bp, human
gggtgatgccgcgcggtcgc

SEQ ID NO: 375364 - DNA, 20 bp, human
gggacccgggcccgggttgg

SEQ ID NO: 375365 - DNA, 20 bp, human
ggcctgatggggtgagcaca

SEQ ID NO: 375366 - DNA, 20 bp, human
ggccccccttggttctggag

SEQ ID NO: 375367 - DNA, 20 bp, human
gtgcgcctgcaactttccgg

SEQ ID NO: 375368 - DNA, 20 bp, human
ggcgcggccagtcagccctg

SEQ ID NO: 375369 - DNA, 20 bp, human
gtgcagggacgcacccgggg

SEQ ID NO: 375370 - DNA, 20 bp, human
gggagagcacgatgcctccg

SEQ ID NO: 375371 - DNA, 20 bp, human
ggccagtcagccctgcggtg

SEQ ID NO: 375372 - DNA, 20 bp, human
gcggcggcccccagctgaat

SEQ ID NO: 375373 - DNA, 20 bp, human
ggcaatgcccaccgcaccgc

SEQ ID NO: 375374 - DNA, 20 bp, human
ggagcacgatgcctccgcgg

SEQ ID NO: 375375 - DNA, 20 bp, human
gcggaggaggggcgcgtggg

SEQ ID NO: 375376 - DNA, 20 bp, human
gctcccggagggtgaggcgt

SEQ ID NO: 375377 - DNA, 20 bp, human
gaaaggcggcgggtggcttc

SEQ ID NO: 375378 - DNA, 20 bp, human
gccgccccgcccgaaaggta

SEQ ID NO: 375379 - DNA, 20 bp, human
gaggctgcgggtctcccgga

SEQ ID NO: 375380 - DNA, 20 bp, human
gggcttcaggacaaggtagg

SEQ ID NO: 375381 - DNA, 20 bp, human
ggcggcagaagtaaacactg

SEQ ID NO: 375382 - DNA, 20 bp, human
gaaacaaaccagggcgggat

SEQ ID NO: 375383 - DNA, 20 bp, human
gcggtcccggcgcccggcga

SEQ ID NO: 375384 - DNA, 20 bp, human
gccggggctctgcccttcaa

SEQ ID NO: 375385 - DNA, 20 bp, human
ggaccggaaaatcaccgcga

SEQ ID NO: 375386 - DNA, 20 bp, human
gccggggctctgcccttcaa

SEQ ID NO: 375387 - DNA, 20 bp, human
ggcggcagaagtaaacactg

SEQ ID NO: 375388 - DNA, 20 bp, human
gactttagggagaacgaagg

SEQ ID NO: 375389 - DNA, 20 bp, human
gggcttcaggacaaggtagg

SEQ ID NO: 375390 - DNA, 20 bp, human
ggtttggtccctatcagaag

SEQ ID NO: 375391 - DNA, 20 bp, human
gggtactccccttccccgcc

SEQ ID NO: 375392 - DNA, 20 bp, human
gaaggagataaattacttta

SEQ ID NO: 375393 - DNA, 20 bp, human
ggggcagagccccggaattc

SEQ ID NO: 375394 - DNA, 20 bp, human
gaaacaaaccagggcgggat

SEQ ID NO: 375395 - DNA, 20 bp, human
gctgccagccgggcggggaa

SEQ ID NO: 375396 - DNA, 20 bp, human
gcgcccgcctagcgaggaca

SEQ ID NO: 375397 - DNA, 20 bp, human
gggactggaagggaggtagg

SEQ ID NO: 375398 - DNA, 20 bp, human
gtggcctagcgcgtgcacaa

SEQ ID NO: 375399 - DNA, 20 bp, human
gctcccttccagtccaacag

SEQ ID NO: 375400 - DNA, 20 bp, human
gtgcgcgcgcccgcctagcg

SEQ ID NO: 375401 - DNA, 20 bp, human
gagaccctgtcctcgctagg

SEQ ID NO: 375402 - DNA, 20 bp, human
gtagcagtgctctgctcact

SEQ ID NO: 375403 - DNA, 20 bp, human
gaaaagacagtgctgtttca

SEQ ID NO: 375404 - DNA, 20 bp, human
gtgagcagagcactgctagc

SEQ ID NO: 375405 - DNA, 20 bp, human
gtaggcgggcgcgcgcacag

SEQ ID NO: 375406 - DNA, 20 bp, human
gcctggaggtcgctagcgag

SEQ ID NO: 375407 - DNA, 20 bp, human
gcgacctccaggccggtttg

SEQ ID NO: 375408 - DNA, 20 bp, human
gctcaaggagggtggatcga

SEQ ID NO: 375409 - DNA, 20 bp, human
gcggtggcgagaggtggagt

SEQ ID NO: 375410 - DNA, 20 bp, human
gcggtgtggccggtggcgag

SEQ ID NO: 375411 - DNA, 20 bp, human
gtcagccggtagcagagacc

SEQ ID NO: 375412 - DNA, 20 bp, human
gccgcgtggcccctcccact

SEQ ID NO: 375413 - DNA, 20 bp, human
ggggtcaatccagcagtgtc

SEQ ID NO: 375414 - DNA, 20 bp, human
gtcgcggccaagcggggaag

SEQ ID NO: 375415 - DNA, 20 bp, human
gtgacccctcgcggccaagc

SEQ ID NO: 375416 - DNA, 20 bp, human
gaggttcctaccctatgccc

SEQ ID NO: 375417 - DNA, 20 bp, human
gtctagcaagactgtagcaa

SEQ ID NO: 375418 - DNA, 20 bp, human
gggagagagactgtttctta

SEQ ID NO: 375419 - DNA, 20 bp, human
ggcctcatgggagggttgta

SEQ ID NO: 375420 - DNA, 20 bp, human
gacagtcttgctagaatgct

SEQ ID NO: 375421 - DNA, 20 bp, human
gaaaaaccttgccttggggc

SEQ ID NO: 375422 - DNA, 20 bp, human
gaacataaaaaccttgcctt

SEQ ID NO: 375423 - DNA, 20 bp, human
ggctgggctttttagacttc

SEQ ID NO: 375424 - DNA, 20 bp, human
gctttttagacttcagggac

SEQ ID NO: 375425 - DNA, 20 bp, human
gtgttttctggcctgactgt

SEQ ID NO: 375426 - DNA, 20 bp, human
ggcccgggacccgagtgccc

SEQ ID NO: 375427 - DNA, 20 bp, human
ggtaaccttcggaagaacta

SEQ ID NO: 375428 - DNA, 20 bp, human
gcgggcggcggcaggaatgc

SEQ ID NO: 375429 - DNA, 20 bp, human
gggaatgcaggaatgcgcac

SEQ ID NO: 375430 - DNA, 20 bp, human
gtccggggcactcgggtccc

SEQ ID NO: 375431 - DNA, 20 bp, human
gcaccgcgcctggacacctc

SEQ ID NO: 375432 - DNA, 20 bp, human
gcaggaatgcgcacaggctg

SEQ ID NO: 375433 - DNA, 20 bp, human
gtgccaggcgggtactgtgc

SEQ ID NO: 375434 - DNA, 20 bp, human
gtacctgcacagtacccgcc

SEQ ID NO: 375435 - DNA, 20 bp, human
ggagtgccccggaggtgtcc

SEQ ID NO: 375436 - DNA, 20 bp, human
gctggcgtggcttaaaggaa

SEQ ID NO: 375437 - DNA, 20 bp, human
gataagctggcgtggcttaa

SEQ ID NO: 375438 - DNA, 20 bp, human
gcgccttcactgctgtatga

SEQ ID NO: 375439 - DNA, 20 bp, human
ggctgggagtctcaccgctc

SEQ ID NO: 375440 - DNA, 20 bp, human
gaaccctcacagccactcta

SEQ ID NO: 375441 - DNA, 20 bp, human
gaactcagcacttgccggag

SEQ ID NO: 375442 - DNA, 20 bp, human
gtggctcattgttaagacaa

SEQ ID NO: 375443 - DNA, 20 bp, human
gtgtatgaaggcttataagc

SEQ ID NO: 375444 - DNA, 20 bp, human
ggaaggcttataagctggcg

SEQ ID NO: 375445 - DNA, 20 bp, human
gcctggccaggaaacctgag

SEQ ID NO: 375446 - DNA, 20 bp, human
gcactcagccggggccgaga

SEQ ID NO: 375447 - DNA, 20 bp, human
gaggccgccagtctcgggtt

SEQ ID NO: 375448 - DNA, 20 bp, human
ggcctctggccactcagccg

SEQ ID NO: 375449 - DNA, 20 bp, human
gcacccgccacagagtctag

SEQ ID NO: 375450 - DNA, 20 bp, human
gccgggaggccgccagtctc

SEQ ID NO: 375451 - DNA, 20 bp, human
gggcagctccctctcggccc

SEQ ID NO: 375452 - DNA, 20 bp, human
ggacgccaggacagctggga

SEQ ID NO: 375453 - DNA, 20 bp, human
gcggggctggagtgtcgtcc

SEQ ID NO: 375454 - DNA, 20 bp, human
gcgagtgccgggcccgcaga

SEQ ID NO: 375455 - DNA, 20 bp, human
gctgcccaacccgagactgg

SEQ ID NO: 375456 - DNA, 20 bp, human
ggggccgcgggccagtggat

SEQ ID NO: 375457 - DNA, 20 bp, human
gcccgggtcacgtgccgtcc

SEQ ID NO: 375458 - DNA, 20 bp, human
gcccaggacggcacgtgacc

SEQ ID NO: 375459 - DNA, 20 bp, human
gacggcacgtgacccggggg

SEQ ID NO: 375460 - DNA, 20 bp, human
gactgaggagccgccggcgc

SEQ ID NO: 375461 - DNA, 20 bp, human
gcgggccagtggatggggac

SEQ ID NO: 375462 - DNA, 20 bp, human
gctgcagcaggcggggacct

SEQ ID NO: 375463 - DNA, 20 bp, human
gacaccgcggtccccttatt

SEQ ID NO: 375464 - DNA, 20 bp, human
ggcgcacgtcgagccgcgaa

SEQ ID NO: 375465 - DNA, 20 bp, human
ggatccaaataaggggaccg

SEQ ID NO: 375466 - DNA, 20 bp, human
gaggccccgcccctagctgg

SEQ ID NO: 375467 - DNA, 20 bp, human
gacctggggagggctctgcg

SEQ ID NO: 375468 - DNA, 20 bp, human
gtcgcgcaggccgcgctcgt

SEQ ID NO: 375469 - DNA, 20 bp, human
gcaggcggatcctacgagcg

SEQ ID NO: 375470 - DNA, 20 bp, human
gggggcgggacgtgaatggc

SEQ ID NO: 375471 - DNA, 20 bp, human
gagtctccgcccctcctcgc

SEQ ID NO: 375472 - DNA, 20 bp, human
ggcgcggcctgcgcgacctg

SEQ ID NO: 375473 - DNA, 20 bp, human
gcccccgggccgggccgact

SEQ ID NO: 375474 - DNA, 20 bp, human
ggcggcagtggaatctggaa

SEQ ID NO: 375475 - DNA, 20 bp, human
ggcggcgaggcctccagcta

SEQ ID NO: 375476 - DNA, 20 bp, human
gagcccgcggaccaagaagt

SEQ ID NO: 375477 - DNA, 20 bp, human
gtaaagaaggagaacctgat

SEQ ID NO: 375478 - DNA, 20 bp, human
gtacccacttcttggtccgc

SEQ ID NO: 375479 - DNA, 20 bp, human
ggatcgctgagagactacga

SEQ ID NO: 375480 - DNA, 20 bp, human
gaggggatgtagaggtcttt

SEQ ID NO: 375481 - DNA, 20 bp, human
gagaagtgggtacactggct

SEQ ID NO: 375482 - DNA, 20 bp, human
gttaaagataaataagcccg

SEQ ID NO: 375483 - DNA, 20 bp, human
gtttaggacccagcaggcgg

SEQ ID NO: 375484 - DNA, 20 bp, human
gtcacgttcagaatccaatc

SEQ ID NO: 375485 - DNA, 20 bp, human
gactaggaaactcagaggtc

SEQ ID NO: 375486 - DNA, 20 bp, human
ggaccgaggcgctcaccagg

SEQ ID NO: 375487 - DNA, 20 bp, human
ggggtggctccgcccacggg

SEQ ID NO: 375488 - DNA, 20 bp, human
ggagctggaggccctctgtg

SEQ ID NO: 375489 - DNA, 20 bp, human
gtcaccaggcggcggcaccc

SEQ ID NO: 375490 - DNA, 20 bp, human
gcgaggcgctcaccaggcgg

SEQ ID NO: 375491 - DNA, 20 bp, human
gcgcgggtggctccgcccac

SEQ ID NO: 375492 - DNA, 20 bp, human
gagcgcctcggtcaccccac

SEQ ID NO: 375493 - DNA, 20 bp, human
gcacactgcagggagccgaa

SEQ ID NO: 375494 - DNA, 20 bp, human
gtgggcccgatccacactgc

SEQ ID NO: 375495 - DNA, 20 bp, human
ggctccctgcagtgtggatc

SEQ ID NO: 375496 - DNA, 20 bp, human
ggctcggcgggaaatcgcgc

SEQ ID NO: 375497 - DNA, 20 bp, human
gccagaacgcgagggggcag

SEQ ID NO: 375498 - DNA, 20 bp, human
gaatggacccagaacgcgag

SEQ ID NO: 375499 - DNA, 20 bp, human
gcccgggacagctaggagaa

SEQ ID NO: 375500 - DNA, 20 bp, human
ggggacagctaggagaaggg

SEQ ID NO: 375501 - DNA, 20 bp, human
gtgagcctgaatcctgataa

SEQ ID NO: 375502 - DNA, 20 bp, human
gctccacgaaagccacttgt

SEQ ID NO: 375503 - DNA, 20 bp, human
gtccctacaagtggctttcg

SEQ ID NO: 375504 - DNA, 20 bp, human
ggcgccgaaggaaacgcctc

SEQ ID NO: 375505 - DNA, 20 bp, human
ggtagtggggaattgttgca

SEQ ID NO: 375506 - DNA, 20 bp, human
gggagcgtgtctcaagattg

SEQ ID NO: 375507 - DNA, 20 bp, human
ggggaccgagaagatttcga

SEQ ID NO: 375508 - DNA, 20 bp, human
ggcccgcgccccaggaagta

SEQ ID NO: 375509 - DNA, 20 bp, human
gcggcagctggaacgatcgg

SEQ ID NO: 375510 - DNA, 20 bp, human
gaggaactggggccaccgtg

SEQ ID NO: 375511 - DNA, 20 bp, human
ggggccagaacagcccaaga

SEQ ID NO: 375512 - DNA, 20 bp, human
ggctcggcagctggaacgat

SEQ ID NO: 375513 - DNA, 20 bp, human
gggccccagttccctgtcgg

SEQ ID NO: 375514 - DNA, 20 bp, human
ggggctacctgttctttcgt

SEQ ID NO: 375515 - DNA, 20 bp, human
ggggaatcctgggatagtgg

SEQ ID NO: 375516 - DNA, 20 bp, human
gcacaccggccgcttgtcga

SEQ ID NO: 375517 - DNA, 20 bp, human
gacaaacgcccggggattgg

SEQ ID NO: 375518 - DNA, 20 bp, human
gggagcccggggcaggatag

SEQ ID NO: 375519 - DNA, 20 bp, human
gcgtttgtctgcgaagtccg

SEQ ID NO: 375520 - DNA, 20 bp, human
gtgcgaagtccggggcgcag

SEQ ID NO: 375521 - DNA, 20 bp, human
gacttcgcagacaaacgccc

SEQ ID NO: 375522 - DNA, 20 bp, human
gagaacaagggcacgagtga

SEQ ID NO: 375523 - DNA, 20 bp, human
ggggaccgctatcctgcccc

SEQ ID NO: 375524 - DNA, 20 bp, human
gacaagcggccggtgtgccc

SEQ ID NO: 375525 - DNA, 20 bp, human
gcagacaaacgcccggggat

SEQ ID NO: 375526 - DNA, 20 bp, human
gcctggacgctggagttggt

SEQ ID NO: 375527 - DNA, 20 bp, human
gaccgcccggcgcacccctc

SEQ ID NO: 375528 - DNA, 20 bp, human
ggcggtgcgcgcacttccct

SEQ ID NO: 375529 - DNA, 20 bp, human
ggagcccgctcgctccctcc

SEQ ID NO: 375530 - DNA, 20 bp, human
gcaccgcgagcgaccgggta

SEQ ID NO: 375531 - DNA, 20 bp, human
gaaggctagcgcctggacgc

SEQ ID NO: 375532 - DNA, 20 bp, human
gactcctggcctagagagac

SEQ ID NO: 375533 - DNA, 20 bp, human
gccagcctgaggggtgcgcc

SEQ ID NO: 375534 - DNA, 20 bp, human
gaaactttgcgaggaggcga

SEQ ID NO: 375535 - DNA, 20 bp, human
gagaagcaaaggctagcgcc

SEQ ID NO: 375536 - DNA, 20 bp, human
gcccgagcctacggcctccc

SEQ ID NO: 375537 - DNA, 20 bp, human
ggagagcagcgggaccccgt

SEQ ID NO: 375538 - DNA, 20 bp, human
gcgcgcgcgtgtggcggagg

SEQ ID NO: 375539 - DNA, 20 bp, human
gcccccgcgcgtttccagcg

SEQ ID NO: 375540 - DNA, 20 bp, human
gagcgggaccccgtaggcag

SEQ ID NO: 375541 - DNA, 20 bp, human
gtcccaaataaccgggggga

SEQ ID NO: 375542 - DNA, 20 bp, human
gccgcgcgcccctgcctacg

SEQ ID NO: 375543 - DNA, 20 bp, human
gaatctcccaaataaccggg

SEQ ID NO: 375544 - DNA, 20 bp, human
gcggggcggtgccttaacga

SEQ ID NO: 375545 - DNA, 20 bp, human
gccggcaccctcagccgggg

SEQ ID NO: 375546 - DNA, 20 bp, human
gtgtatgtgcgcgagctcgc

SEQ ID NO: 375547 - DNA, 20 bp, human
ggcttggagagtaacgtccc

SEQ ID NO: 375548 - DNA, 20 bp, human
gcacagagcaggcagagccg

SEQ ID NO: 375549 - DNA, 20 bp, human
ggccccctcagcctggtgat

SEQ ID NO: 375550 - DNA, 20 bp, human
gaatgcttcaggtagagcta

SEQ ID NO: 375551 - DNA, 20 bp, human
gaagccaatcaccaggctga

SEQ ID NO: 375552 - DNA, 20 bp, human
gcactgtgagcttcctctcc

SEQ ID NO: 375553 - DNA, 20 bp, human
gctgcgcaaagccaatcacc

SEQ ID NO: 375554 - DNA, 20 bp, human
gcttcaggtagagctagggg

SEQ ID NO: 375555 - DNA, 20 bp, human
ggaatcacacacactctcct

SEQ ID NO: 375556 - DNA, 20 bp, human
gggcaaccgcgatccggcgc

SEQ ID NO: 375557 - DNA, 20 bp, human
gccgcagcaagggatcgcga

SEQ ID NO: 375558 - DNA, 20 bp, human
ggataggcgggccgtgggga

SEQ ID NO: 375559 - DNA, 20 bp, human
gcagtctggctaatgatagg

SEQ ID NO: 375560 - DNA, 20 bp, human
ggactggaggggtcgatgcg

SEQ ID NO: 375561 - DNA, 20 bp, human
gcgggcccggagatcaaacg

SEQ ID NO: 375562 - DNA, 20 bp, human
ggggcggagcgcaaaacgcc

SEQ ID NO: 375563 - DNA, 20 bp, human
ggcgctgggcaaccgcgatc

SEQ ID NO: 375564 - DNA, 20 bp, human
ggatccggcgccggactgga

SEQ ID NO: 375565 - DNA, 20 bp, human
gcggcagggcacagcgcgct

SEQ ID NO: 375566 - DNA, 20 bp, human
gcaactctgcctgcggagag

SEQ ID NO: 375567 - DNA, 20 bp, human
gcggggtcacctgaaggttg

SEQ ID NO: 375568 - DNA, 20 bp, human
gggcactcgggacgaggcga

SEQ ID NO: 375569 - DNA, 20 bp, human
ggacagcgaactggtatgag

SEQ ID NO: 375570 - DNA, 20 bp, human
gtggggactggggaattgct

SEQ ID NO: 375571 - DNA, 20 bp, human
gcccagctttcttcatgcgt

SEQ ID NO: 375572 - DNA, 20 bp, human
gggcagagttgtggtgtggc

SEQ ID NO: 375573 - DNA, 20 bp, human
gtgaagaaagctggggactg

SEQ ID NO: 375574 - DNA, 20 bp, human
gcatatggctgtatgatcta

SEQ ID NO: 375575 - DNA, 20 bp, human
gtgggcgtccgggggattcg

SEQ ID NO: 375576 - DNA, 20 bp, human
ggggacctgggctctatcag

SEQ ID NO: 375577 - DNA, 20 bp, human
gctggccactgaccccccat

SEQ ID NO: 375578 - DNA, 20 bp, human
ggggctcaggccgcccatgg

SEQ ID NO: 375579 - DNA, 20 bp, human
gcaggtcccggggctcatgg

SEQ ID NO: 375580 - DNA, 20 bp, human
gagccctgctcggggcttcc

SEQ ID NO: 375581 - DNA, 20 bp, human
ggccgcccatggggggtcag

SEQ ID NO: 375582 - DNA, 20 bp, human
gctcctggggtgctggtcgg

SEQ ID NO: 375583 - DNA, 20 bp, human
gacactgggctcgcaggcgg

SEQ ID NO: 375584 - DNA, 20 bp, human
gagccgggaagccccgagca

SEQ ID NO: 375585 - DNA, 20 bp, human
gtccaggccaccatgagccc

SEQ ID NO: 375586 - DNA, 20 bp, human
gagtaggcaggactagagga

SEQ ID NO: 375587 - DNA, 20 bp, human
gcagcagtaggcaggactag

SEQ ID NO: 375588 - DNA, 20 bp, human
gtggttgtggaaacattgac

SEQ ID NO: 375589 - DNA, 20 bp, human
gcataagtgagcacggtccc

SEQ ID NO: 375590 - DNA, 20 bp, human
gtcgcaggcacaaaaatccc

SEQ ID NO: 375591 - DNA, 20 bp, human
gaatgacaggatatcctgca

SEQ ID NO: 375592 - DNA, 20 bp, human
gtgctgtcgagcggggttgg

SEQ ID NO: 375593 - DNA, 20 bp, human
ggaaacattgacagggccgc

SEQ ID NO: 375594 - DNA, 20 bp, human
ggtgttccatggcgtggttg

SEQ ID NO: 375595 - DNA, 20 bp, human
gcagtcacttgttactgaag

SEQ ID NO: 375596 - DNA, 20 bp, human
ggcgcccgcggccacctcgc

SEQ ID NO: 375597 - DNA, 20 bp, human
gccagcgcctggagtagtga

SEQ ID NO: 375598 - DNA, 20 bp, human
gcgcacgccggcactgggtg

SEQ ID NO: 375599 - DNA, 20 bp, human
gagtggcagtcacgactgtg

SEQ ID NO: 375600 - DNA, 20 bp, human
gtctgctcgcccgcaggagg

SEQ ID NO: 375601 - DNA, 20 bp, human
gagagcaggggtcggagtgg

SEQ ID NO: 375602 - DNA, 20 bp, human
gagggggcagcgccctggaa

SEQ ID NO: 375603 - DNA, 20 bp, human
gcacctccccggcacttccg

SEQ ID NO: 375604 - DNA, 20 bp, human
ggtcacgactgtgaggtcgc

SEQ ID NO: 375605 - DNA, 20 bp, human
gcgggcttctgctcgcccgc

SEQ ID NO: 375606 - DNA, 20 bp, human
ggaactgggcggagtcttgg

SEQ ID NO: 375607 - DNA, 20 bp, human
gggctcgacacgatggggcg

SEQ ID NO: 375608 - DNA, 20 bp, human
gtgaaaaacccgggatggag

SEQ ID NO: 375609 - DNA, 20 bp, human
gggggagcggcgtagggcag

SEQ ID NO: 375610 - DNA, 20 bp, human
gtggggggctcgacacgatg

SEQ ID NO: 375611 - DNA, 20 bp, human
gcacactgaaaaacccggga

SEQ ID NO: 375612 - DNA, 20 bp, human
ggaggggcgtgaccagattg

SEQ ID NO: 375613 - DNA, 20 bp, human
gtggtcacgcccctccatcc

SEQ ID NO: 375614 - DNA, 20 bp, human
gccgcgcagccctgcaaatc

SEQ ID NO: 375615 - DNA, 20 bp, human
ggctgagagcctgatttgca

SEQ ID NO: 375616 - DNA, 20 bp, human
gaaggcgaacaggtgaataa

SEQ ID NO: 375617 - DNA, 20 bp, human
gcaaggaacagcagctctag

SEQ ID NO: 375618 - DNA, 20 bp, human
gacagctgacacagagaaat

SEQ ID NO: 375619 - DNA, 20 bp, human
gagagaaattggacactgag

SEQ ID NO: 375620 - DNA, 20 bp, human
gttccttgattcttcatcta

SEQ ID NO: 375621 - DNA, 20 bp, human
gataatggctgaattcagga

SEQ ID NO: 375622 - DNA, 20 bp, human
gttggacactgagaggtctg

SEQ ID NO: 375623 - DNA, 20 bp, human
gaaaaaaaagccatctagta

SEQ ID NO: 375624 - DNA, 20 bp, human
gcgccttagatgaagaatca

SEQ ID NO: 375625 - DNA, 20 bp, human
gttcttcatctaaggcgaac

SEQ ID NO: 375626 - DNA, 20 bp, human
gcgcacgcgcaccagcgggg

SEQ ID NO: 375627 - DNA, 20 bp, human
gggcgtaggcttctggataa

SEQ ID NO: 375628 - DNA, 20 bp, human
gaaacgtggccgctgcgtgg

SEQ ID NO: 375629 - DNA, 20 bp, human
gtgcgcgagcgctccgtgtg

SEQ ID NO: 375630 - DNA, 20 bp, human
gggagctgaggcgcgagcta

SEQ ID NO: 375631 - DNA, 20 bp, human
gagcctacgcctctcgcgat

SEQ ID NO: 375632 - DNA, 20 bp, human
gggacgggcctgcccggaaa

SEQ ID NO: 375633 - DNA, 20 bp, human
gggcgctgtggacggttctt

SEQ ID NO: 375634 - DNA, 20 bp, human
gagccaatcgcgagaggcgt

SEQ ID NO: 375635 - DNA, 20 bp, human
gcgagcgctccgtgtggggg

SEQ ID NO: 375636 - DNA, 20 bp, human
gagagcccgaactggaggtg

SEQ ID NO: 375637 - DNA, 20 bp, human
gaagggagggggcacgaggg

SEQ ID NO: 375638 - DNA, 20 bp, human
gtggtgctgggaacctaggg

SEQ ID NO: 375639 - DNA, 20 bp, human
gctcggaccgagggaggcga

SEQ ID NO: 375640 - DNA, 20 bp, human
ggggtgcgagccgtagtcgg

SEQ ID NO: 375641 - DNA, 20 bp, human
gtggtggtgctgggaaccta

SEQ ID NO: 375642 - DNA, 20 bp, human
gaggctcagttgtgtatatt

SEQ ID NO: 375643 - DNA, 20 bp, human
gagagcaaaatggtggtgct

SEQ ID NO: 375644 - DNA, 20 bp, human
gctaggagagcccgaactgg

SEQ ID NO: 375645 - DNA, 20 bp, human
ggtggggtgcgagccgtagt

SEQ ID NO: 375646 - DNA, 20 bp, human
ggggagggagcggcatctag

SEQ ID NO: 375647 - DNA, 20 bp, human
gccgccgagtggggtaaaca

SEQ ID NO: 375648 - DNA, 20 bp, human
gacccgcgcccggctcccgt

SEQ ID NO: 375649 - DNA, 20 bp, human
gacgcgcaggcgccatctgt

SEQ ID NO: 375650 - DNA, 20 bp, human
ggcgtcggagacgctgaacc

SEQ ID NO: 375651 - DNA, 20 bp, human
gagatgccgctccctcccaa

SEQ ID NO: 375652 - DNA, 20 bp, human
gcgggttcgtggccgacaga

SEQ ID NO: 375653 - DNA, 20 bp, human
gcgcccggctcccgttggga

SEQ ID NO: 375654 - DNA, 20 bp, human
gggaggcgaatggaacgcgc

SEQ ID NO: 375655 - DNA, 20 bp, human
ggctgaacccgggagtcagt

SEQ ID NO: 375656 - DNA, 20 bp, human
gtgcccaagcccacgtgaga

SEQ ID NO: 375657 - DNA, 20 bp, human
gcaatggagtaggagattga

SEQ ID NO: 375658 - DNA, 20 bp, human
gcaagcccacgtgagagggc

SEQ ID NO: 375659 - DNA, 20 bp, human
ggagcggcgtgactcaaacg

SEQ ID NO: 375660 - DNA, 20 bp, human
gtgcgcaagcgcaatcccaa

SEQ ID NO: 375661 - DNA, 20 bp, human
gagggccagtagctatcgcg

SEQ ID NO: 375662 - DNA, 20 bp, human
gtagcgcggaagctcggcag

SEQ ID NO: 375663 - DNA, 20 bp, human
ggacccggctggcactcagg

SEQ ID NO: 375664 - DNA, 20 bp, human
gggggcgtggtctccctcgg

SEQ ID NO: 375665 - DNA, 20 bp, human
gggtgggggcggggctaaag

SEQ ID NO: 375666 - DNA, 20 bp, human
gcactcctggggttgttagt

SEQ ID NO: 375667 - DNA, 20 bp, human
gcccccgcgcggagcttgtc

SEQ ID NO: 375668 - DNA, 20 bp, human
gcggagcttgtcgggaatct

SEQ ID NO: 375669 - DNA, 20 bp, human
ggagcctgccccatcggtaa

SEQ ID NO: 375670 - DNA, 20 bp, human
gcctgaaggaccccgtccta

SEQ ID NO: 375671 - DNA, 20 bp, human
ggctaggagtctccgtagga

SEQ ID NO: 375672 - DNA, 20 bp, human
gctacggagactcctagcca

SEQ ID NO: 375673 - DNA, 20 bp, human
gcatcggtaaaggctgaaca

SEQ ID NO: 375674 - DNA, 20 bp, human
ggctgctgccgcggttggtg

SEQ ID NO: 375675 - DNA, 20 bp, human
gtgcggcggcggcaacagca

SEQ ID NO: 375676 - DNA, 20 bp, human
gggaggacgcccatggtcgg

SEQ ID NO: 375677 - DNA, 20 bp, human
gggtcctagcgctggaaagg

SEQ ID NO: 375678 - DNA, 20 bp, human
gcggggtcctagcgctggaa

SEQ ID NO: 375679 - DNA, 20 bp, human
gctagccggggtcctagcgc

SEQ ID NO: 375680 - DNA, 20 bp, human
gttccggctccgaaggtccc

SEQ ID NO: 375681 - DNA, 20 bp, human
ggcgagatccctccgaccat

SEQ ID NO: 375682 - DNA, 20 bp, human
ggggacaggggcagcgacaa

SEQ ID NO: 375683 - DNA, 20 bp, human
gttccaggcgggactacttc

SEQ ID NO: 375684 - DNA, 20 bp, human
gacaggagcgcgggatcgaa

SEQ ID NO: 375685 - DNA, 20 bp, human
gccacgaagccggggacctt

SEQ ID NO: 375686 - DNA, 20 bp, human
ggggctagaatcggcacctg

SEQ ID NO: 375687 - DNA, 20 bp, human
gaacggagagctagtaggtg

SEQ ID NO: 375688 - DNA, 20 bp, human
ggcggaaaatccgaccaatg

SEQ ID NO: 375689 - DNA, 20 bp, human
ggcgccggatgtgacgtttc

SEQ ID NO: 375690 - DNA, 20 bp, human
gtcatccgcggggaaaggtg

SEQ ID NO: 375691 - DNA, 20 bp, human
gaacgacacagcggccatct

SEQ ID NO: 375692 - DNA, 20 bp, human
gtgtgtcgttcgctcctcat

SEQ ID NO: 375693 - DNA, 20 bp, human
gaacctccgggtgtcatccg

SEQ ID NO: 375694 - DNA, 20 bp, human
gtcgttcgctcctcattggt

SEQ ID NO: 375695 - DNA, 20 bp, human
ggggtgtcatccgcggggaa

SEQ ID NO: 375696 - DNA, 20 bp, human
ggcctagagcccgagtgaag

SEQ ID NO: 375697 - DNA, 20 bp, human
ggaagcagggcccctgcgga

SEQ ID NO: 375698 - DNA, 20 bp, human
gggctctaggccatccgcag

SEQ ID NO: 375699 - DNA, 20 bp, human
gctgtcggacaccccagcgc

SEQ ID NO: 375700 - DNA, 20 bp, human
ggcacccaaccgcttcactc

SEQ ID NO: 375701 - DNA, 20 bp, human
gaggcggcacccaggggccg

SEQ ID NO: 375702 - DNA, 20 bp, human
gtcaccgagatggacaggag

SEQ ID NO: 375703 - DNA, 20 bp, human
gtctggggagaagacgtgca

SEQ ID NO: 375704 - DNA, 20 bp, human
gaggcggaggcggcacccag

SEQ ID NO: 375705 - DNA, 20 bp, human
gtcctcgcaagcccacgcgc

SEQ ID NO: 375706 - DNA, 20 bp, human
gggtgtagactgactttcag

SEQ ID NO: 375707 - DNA, 20 bp, human
ggtagagattgtgaacttta

SEQ ID NO: 375708 - DNA, 20 bp, human
gtgccttttcctctcacaga

SEQ ID NO: 375709 - DNA, 20 bp, human
gttttccattactttttgtg

SEQ ID NO: 375710 - DNA, 20 bp, human
gcaccaacactaccaccaac

SEQ ID NO: 375711 - DNA, 20 bp, human
gttccgtgttcccataattg

SEQ ID NO: 375712 - DNA, 20 bp, human
gattatgggaacacggaata

SEQ ID NO: 375713 - DNA, 20 bp, human
gttattagtactacttctgt

SEQ ID NO: 375714 - DNA, 20 bp, human
gaccagaagatgaaagaaac

SEQ ID NO: 375715 - DNA, 20 bp, human
ggtcctgttggtggtagtgt

SEQ ID NO: 375716 - DNA, 20 bp, human
gagggaaatccccgcctctc

SEQ ID NO: 375717 - DNA, 20 bp, human
gggcaggggagggagttgac

SEQ ID NO: 375718 - DNA, 20 bp, human
gcagcaggtccagtgatcct

SEQ ID NO: 375719 - DNA, 20 bp, human
gagagactgcgctgcctccc

SEQ ID NO: 375720 - DNA, 20 bp, human
gtctcagttccacaccggag

SEQ ID NO: 375721 - DNA, 20 bp, human
ggggatttccctaggatcac

SEQ ID NO: 375722 - DNA, 20 bp, human
gtctgttctcagttccacac

SEQ ID NO: 375723 - DNA, 20 bp, human
gtggactcagtctctgaacc

SEQ ID NO: 375724 - DNA, 20 bp, human
gctgaggcgggcagaaaact

SEQ ID NO: 375725 - DNA, 20 bp, human
gggagttgacgggctgacac

SEQ ID NO: 375726 - DNA, 20 bp, human
ggggccaggcgagggatgga

SEQ ID NO: 375727 - DNA, 20 bp, human
gtgtggggagcttggggcgg

SEQ ID NO: 375728 - DNA, 20 bp, human
ggacagggccaggcgaggga

SEQ ID NO: 375729 - DNA, 20 bp, human
ggccccaagctccccacaaa

SEQ ID NO: 375730 - DNA, 20 bp, human
gtgctgctttggccgtttgt

SEQ ID NO: 375731 - DNA, 20 bp, human
ggccgtttgtggggagcttg

SEQ ID NO: 375732 - DNA, 20 bp, human
gctcccctccatccctcgcc

SEQ ID NO: 375733 - DNA, 20 bp, human
gcttagatgaaggcacacag

SEQ ID NO: 375734 - DNA, 20 bp, human
gggggcgggggagggtgcag

SEQ ID NO: 375735 - DNA, 20 bp, human
gactcactgtgcaaaggaag

SEQ ID NO: 375736 - DNA, 20 bp, human
gcccagcggggacagggaaa

SEQ ID NO: 375737 - DNA, 20 bp, human
gaggggaccctgcgcgcgag

SEQ ID NO: 375738 - DNA, 20 bp, human
gtacctgtgagtatgggagg

SEQ ID NO: 375739 - DNA, 20 bp, human
ggcgaggggcaagtccccag

SEQ ID NO: 375740 - DNA, 20 bp, human
gggccacgaggtgcaagaag

SEQ ID NO: 375741 - DNA, 20 bp, human
ggcacagcccagtgggaatg

SEQ ID NO: 375742 - DNA, 20 bp, human
gggcgtctctgggttgttct

SEQ ID NO: 375743 - DNA, 20 bp, human
gcaccacctcccatactcac

SEQ ID NO: 375744 - DNA, 20 bp, human
gcgctaggaccctgcggggt

SEQ ID NO: 375745 - DNA, 20 bp, human
ggacttgcccctcgcgcgca

SEQ ID NO: 375746 - DNA, 20 bp, human
ggacctcgggaaccaatgag

SEQ ID NO: 375747 - DNA, 20 bp, human
gtgcctctggtcggggctta

SEQ ID NO: 375748 - DNA, 20 bp, human
gggggccctcacgtgacctc

SEQ ID NO: 375749 - DNA, 20 bp, human
ggggttggaattctgagttg

SEQ ID NO: 375750 - DNA, 20 bp, human
gggtcacgtgagggccccgg

SEQ ID NO: 375751 - DNA, 20 bp, human
gtggttcccgaggtcacgtg

SEQ ID NO: 375752 - DNA, 20 bp, human
gagccctaagccccgaccag

SEQ ID NO: 375753 - DNA, 20 bp, human
ggggtctgttgagctgtcct

SEQ ID NO: 375754 - DNA, 20 bp, human
gttgctttcagcgttgtgtg

SEQ ID NO: 375755 - DNA, 20 bp, human
gcaaaagcagccctcactaa

SEQ ID NO: 375756 - DNA, 20 bp, human
gtacctaagggtaggggagt

SEQ ID NO: 375757 - DNA, 20 bp, human
gcagaagcggactcaaaggc

SEQ ID NO: 375758 - DNA, 20 bp, human
gtcccgaggggagtcctgtg

SEQ ID NO: 375759 - DNA, 20 bp, human
gagtctaagggcctacctaa

SEQ ID NO: 375760 - DNA, 20 bp, human
gaaaaaggggaatttcccga

SEQ ID NO: 375761 - DNA, 20 bp, human
gagtcccgcttcgctctcgg

SEQ ID NO: 375762 - DNA, 20 bp, human
gctcaaaggccggagtctaa

SEQ ID NO: 375763 - DNA, 20 bp, human
gtgcgcagaagcggactcaa

SEQ ID NO: 375764 - DNA, 20 bp, human
gctctcgggggcggactcag

SEQ ID NO: 375765 - DNA, 20 bp, human
gcgggacttgcgttcgcctg

SEQ ID NO: 375766 - DNA, 20 bp, human
gccggtctgcctgtaggaat

SEQ ID NO: 375767 - DNA, 20 bp, human
gtctgcctgtaggaatgggt

SEQ ID NO: 375768 - DNA, 20 bp, human
gcatagaggagccaacctat

SEQ ID NO: 375769 - DNA, 20 bp, human
gaggcactcaggaaccagtc

SEQ ID NO: 375770 - DNA, 20 bp, human
ggtaaacgacgcgggaagga

SEQ ID NO: 375771 - DNA, 20 bp, human
ggagggaccaaagacccgac

SEQ ID NO: 375772 - DNA, 20 bp, human
gacagctcgcatctcgctcg

SEQ ID NO: 375773 - DNA, 20 bp, human
gtgaccgggacccagtccag

SEQ ID NO: 375774 - DNA, 20 bp, human
gtactgaccagtaaacgacg

SEQ ID NO: 375775 - DNA, 20 bp, human
ggctgctgggtgcgggcggt

SEQ ID NO: 375776 - DNA, 20 bp, human
gtggcgcgggagcgtgtgga

SEQ ID NO: 375777 - DNA, 20 bp, human
gccccctggcccgatcccgg

SEQ ID NO: 375778 - DNA, 20 bp, human
gaacgtgcgcttgttcggat

SEQ ID NO: 375779 - DNA, 20 bp, human
gggaacaacgtgcgcttgtt

SEQ ID NO: 375780 - DNA, 20 bp, human
ggatgtctggggttgcctgc

SEQ ID NO: 375781 - DNA, 20 bp, human
gccgccccctggcccgatcc

SEQ ID NO: 375782 - DNA, 20 bp, human
gaggcaaccccagacatcca

SEQ ID NO: 375783 - DNA, 20 bp, human
gaaatggaatgattccgcgt

SEQ ID NO: 375784 - DNA, 20 bp, human
gtggctggcgcgggagcgtg

SEQ ID NO: 375785 - DNA, 20 bp, human
gaatgattccgcgtgggtgt

SEQ ID NO: 375786 - DNA, 20 bp, human
gccacagcgggacatgaagg

SEQ ID NO: 375787 - DNA, 20 bp, human
gccggcccgcccaaggcgtc

SEQ ID NO: 375788 - DNA, 20 bp, human
ggggaggcgggatccgtctg

SEQ ID NO: 375789 - DNA, 20 bp, human
gccgcctcccggagattggc

SEQ ID NO: 375790 - DNA, 20 bp, human
gtggaccaattcgggagcgg

SEQ ID NO: 375791 - DNA, 20 bp, human
gggtcccggacgccttgggc

SEQ ID NO: 375792 - DNA, 20 bp, human
ggacatgaaggaggcggata

SEQ ID NO: 375793 - DNA, 20 bp, human
gcccaggcgctgacgctaac

SEQ ID NO: 375794 - DNA, 20 bp, human
gggcgggtcccggacgcctt

SEQ ID NO: 375795 - DNA, 20 bp, human
gcccggagattggcaggaca

SEQ ID NO: 375796 - DNA, 20 bp, human
gcagagacaagatatgaccc

SEQ ID NO: 375797 - DNA, 20 bp, human
gacatgcttcacacaatagg

SEQ ID NO: 375798 - DNA, 20 bp, human
ggtcttgtagaattagcgtg

SEQ ID NO: 375799 - DNA, 20 bp, human
gcactacacgatctgacccc

SEQ ID NO: 375800 - DNA, 20 bp, human
gagatgagatgatatgctta

SEQ ID NO: 375801 - DNA, 20 bp, human
gtgttggttatgtgttcttg

SEQ ID NO: 375802 - DNA, 20 bp, human
ggtgaagcattatgagctgt

SEQ ID NO: 375803 - DNA, 20 bp, human
gtgaatgactatcgcatgcc

SEQ ID NO: 375804 - DNA, 20 bp, human
gtttctctcaaggtaaaatt

SEQ ID NO: 375805 - DNA, 20 bp, human
gaaagactgtaaggagagag

SEQ ID NO: 375806 - DNA, 20 bp, human
gcgggcgcgagcggagatga

SEQ ID NO: 375807 - DNA, 20 bp, human
gccaacatggcgccggcctg

SEQ ID NO: 375808 - DNA, 20 bp, human
gagctctgctgtgactgcgg

SEQ ID NO: 375809 - DNA, 20 bp, human
gcggggcggtgtccgggttg

SEQ ID NO: 375810 - DNA, 20 bp, human
gaaggagggtgtcttttcga

SEQ ID NO: 375811 - DNA, 20 bp, human
gaacaggcctgagctttcgg

SEQ ID NO: 375812 - DNA, 20 bp, human
ggtgcgcatgcgcggcagtg

SEQ ID NO: 375813 - DNA, 20 bp, human
gcaccgccccgcctcaggct

SEQ ID NO: 375814 - DNA, 20 bp, human
gaaccgccccaacatggcgc

SEQ ID NO: 375815 - DNA, 20 bp, human
gcctgaggcggggcggtgtc

SEQ ID NO: 375816 - DNA, 20 bp, human
gcggcggcgagagccgtcaa

SEQ ID NO: 375817 - DNA, 20 bp, human
gcgcctgctagcaaggtagg

SEQ ID NO: 375818 - DNA, 20 bp, human
gggagagtgaccctcggacc

SEQ ID NO: 375819 - DNA, 20 bp, human
gagagccgtcaagggcgcat

SEQ ID NO: 375820 - DNA, 20 bp, human
ggcctccgcgcatgcatgaa

SEQ ID NO: 375821 - DNA, 20 bp, human
gtgggctcctgggtgctcat

SEQ ID NO: 375822 - DNA, 20 bp, human
gcggaggccgcctgctagca

SEQ ID NO: 375823 - DNA, 20 bp, human
gggctgggacggccggaaga

SEQ ID NO: 375824 - DNA, 20 bp, human
gaggcggcatgctcccgcgg

SEQ ID NO: 375825 - DNA, 20 bp, human
gcgcgcatgcatgaaggggc

SEQ ID NO: 375826 - DNA, 20 bp, human
ggcgcctcccgcctcctgga

SEQ ID NO: 375827 - DNA, 20 bp, human
gggagagaggccggctaagg

SEQ ID NO: 375828 - DNA, 20 bp, human
gagaggccggctaaggagga

SEQ ID NO: 375829 - DNA, 20 bp, human
gtgccagcatgcaggtggcg

SEQ ID NO: 375830 - DNA, 20 bp, human
gcctggaaggccaccgaggg

SEQ ID NO: 375831 - DNA, 20 bp, human
gcgggtcactgattcaaact

SEQ ID NO: 375832 - DNA, 20 bp, human
gggcaggagggccggacacc

SEQ ID NO: 375833 - DNA, 20 bp, human
gcggggaactgtaatgttca

SEQ ID NO: 375834 - DNA, 20 bp, human
gtggccttccaggaggcggg

SEQ ID NO: 375835 - DNA, 20 bp, human
gctgtcccgttccagccaac

SEQ ID NO: 375836 - DNA, 20 bp, human
gggcgagtcaggaggcttta

SEQ ID NO: 375837 - DNA, 20 bp, human
gcggccaatcctgagcccgg

SEQ ID NO: 375838 - DNA, 20 bp, human
gaatcctgagcccggtgggc

SEQ ID NO: 375839 - DNA, 20 bp, human
ggggagttctcccgcccacc

SEQ ID NO: 375840 - DNA, 20 bp, human
ggaggctttaaggaggattg

SEQ ID NO: 375841 - DNA, 20 bp, human
gcgcccaccaggctaaggac

SEQ ID NO: 375842 - DNA, 20 bp, human
gggcgtcccaagaggctgta

SEQ ID NO: 375843 - DNA, 20 bp, human
gacgcgagctgccgcccgag

SEQ ID NO: 375844 - DNA, 20 bp, human
gctggctgcggcgcgtgttt

SEQ ID NO: 375845 - DNA, 20 bp, human
gactggccgaacgtccacac

SEQ ID NO: 375846 - DNA, 20 bp, human
gcagcgtggcaacacgggac

SEQ ID NO: 375847 - DNA, 20 bp, human
gcggaaataccccagcgcgt

SEQ ID NO: 375848 - DNA, 20 bp, human
gggcggcccccgccggaagc

SEQ ID NO: 375849 - DNA, 20 bp, human
gctgcagctcacccagccgg

SEQ ID NO: 375850 - DNA, 20 bp, human
gcagcgcgtgggcggagcag

SEQ ID NO: 375851 - DNA, 20 bp, human
gaaataccccagcgcgtggg

SEQ ID NO: 375852 - DNA, 20 bp, human
ggcccccaccaatcaccggg

SEQ ID NO: 375853 - DNA, 20 bp, human
ggccgcccggtgattggtgg

SEQ ID NO: 375854 - DNA, 20 bp, human
ggaggggctcggctgcaccg

SEQ ID NO: 375855 - DNA, 20 bp, human
gcggaacagccgcgtctaat

SEQ ID NO: 375856 - DNA, 20 bp, human
gtgagctcgcagtctgggaa

SEQ ID NO: 375857 - DNA, 20 bp, human
gcggaggggcggagttgcgg

SEQ ID NO: 375858 - DNA, 20 bp, human
gccagccgccaccccgacac

SEQ ID NO: 375859 - DNA, 20 bp, human
gtgggaagggcttgactgaa

SEQ ID NO: 375860 - DNA, 20 bp, human
gcttgtcccgccctgcggag

SEQ ID NO: 375861 - DNA, 20 bp, human
gaggggaggagtccaattag

SEQ ID NO: 375862 - DNA, 20 bp, human
gggacccgcccccttgtagt

SEQ ID NO: 375863 - DNA, 20 bp, human
gccttgggataggaagagga

SEQ ID NO: 375864 - DNA, 20 bp, human
ggagacgccaagggctccat

SEQ ID NO: 375865 - DNA, 20 bp, human
gaggcactttctacgagggg

SEQ ID NO: 375866 - DNA, 20 bp, human
gtgaaggggctgtaattcag

SEQ ID NO: 375867 - DNA, 20 bp, human
gagggaagagccgaggactt

SEQ ID NO: 375868 - DNA, 20 bp, human
gtgggcgaggattggctgaa

SEQ ID NO: 375869 - DNA, 20 bp, human
gcctccctccgccacagcga

SEQ ID NO: 375870 - DNA, 20 bp, human
gccccgcccactgaccaatg

SEQ ID NO: 375871 - DNA, 20 bp, human
gtggtcagtgggcggggctt

SEQ ID NO: 375872 - DNA, 20 bp, human
gcggttggggcttgttccct

SEQ ID NO: 375873 - DNA, 20 bp, human
ggcggcggcgcagactggga

SEQ ID NO: 375874 - DNA, 20 bp, human
gcttccctcgctgtggcgga

SEQ ID NO: 375875 - DNA, 20 bp, human
ggctgtaccgcacacgcact

SEQ ID NO: 375876 - DNA, 20 bp, human
gctaacacgcagaaactgcc

SEQ ID NO: 375877 - DNA, 20 bp, human
ggccgctgggagggataaga

SEQ ID NO: 375878 - DNA, 20 bp, human
ggaagaggacgcccggtgaa

SEQ ID NO: 375879 - DNA, 20 bp, human
ggcacaggaaagcctcaagt

SEQ ID NO: 375880 - DNA, 20 bp, human
gtgggtcaggtcaccctcgt

SEQ ID NO: 375881 - DNA, 20 bp, human
ggaggatctcagattgtcta

SEQ ID NO: 375882 - DNA, 20 bp, human
ggggtccgctcactccgacg

SEQ ID NO: 375883 - DNA, 20 bp, human
gcagcctggtgaaccacccc

SEQ ID NO: 375884 - DNA, 20 bp, human
gcagtgccaggaaaaagggg

SEQ ID NO: 375885 - DNA, 20 bp, human
gcagcagtgccaggaaaaag

SEQ ID NO: 375886 - DNA, 20 bp, human
gaacaaggaacccgctgaag

SEQ ID NO: 375887 - DNA, 20 bp, human
gcctacctatccctggaccg

SEQ ID NO: 375888 - DNA, 20 bp, human
gggcctgctgggactcccgg

SEQ ID NO: 375889 - DNA, 20 bp, human
gaggaacccgctgaagggga

SEQ ID NO: 375890 - DNA, 20 bp, human
gctgcctcgccctcagtcgc

SEQ ID NO: 375891 - DNA, 20 bp, human
gcaggggagccggcgactga

SEQ ID NO: 375892 - DNA, 20 bp, human
gccctgggagccgccgccga

SEQ ID NO: 375893 - DNA, 20 bp, human
gtgcaagtgcgcaacagcgg

SEQ ID NO: 375894 - DNA, 20 bp, human
gcgggctcgcgcgctgtgta

SEQ ID NO: 375895 - DNA, 20 bp, human
ggagcgtcccggaaccgggg

SEQ ID NO: 375896 - DNA, 20 bp, human
gggtccgggtccttcaaggg

SEQ ID NO: 375897 - DNA, 20 bp, human
gcccgcttcctggttccgcc

SEQ ID NO: 375898 - DNA, 20 bp, human
gggtccttcaagggcggtcg

SEQ ID NO: 375899 - DNA, 20 bp, human
gagggggcgcgagggacagc

SEQ ID NO: 375900 - DNA, 20 bp, human
ggggggtccgggtccttcaa

SEQ ID NO: 375901 - DNA, 20 bp, human
gcggccggagccgtcacccc

SEQ ID NO: 375902 - DNA, 20 bp, human
ggaccccctcggcacacccg

SEQ ID NO: 375903 - DNA, 20 bp, human
ggccacctcgggtgtgccga

SEQ ID NO: 375904 - DNA, 20 bp, human
gcctccgcgaccgcccttga

SEQ ID NO: 375905 - DNA, 20 bp, human
ggctcacgcgcggaggccca

SEQ ID NO: 375906 - DNA, 20 bp, human
gccactgcttacactgaaga

SEQ ID NO: 375907 - DNA, 20 bp, human
gtgtgcctcctgtgccgagt

SEQ ID NO: 375908 - DNA, 20 bp, human
ggccgagtgggggaacacgt

SEQ ID NO: 375909 - DNA, 20 bp, human
gggagccaggcagttagggg

SEQ ID NO: 375910 - DNA, 20 bp, human
gtgccccagcccgctgtttc

SEQ ID NO: 375911 - DNA, 20 bp, human
gaaggcgttccctgccggaa

SEQ ID NO: 375912 - DNA, 20 bp, human
gaggagaagccggaaacagc

SEQ ID NO: 375913 - DNA, 20 bp, human
gttgagggggacagagtaag

SEQ ID NO: 375914 - DNA, 20 bp, human
gagggggacagagtaagtgg

SEQ ID NO: 375915 - DNA, 20 bp, human
ggtcacgagaccgacctcta

SEQ ID NO: 375916 - DNA, 20 bp, human
gtcagcgctagactaacagt

SEQ ID NO: 375917 - DNA, 20 bp, human
gagtgggattaacatgcagt

SEQ ID NO: 375918 - DNA, 20 bp, human
gcacaagtatgtgtccaagg

SEQ ID NO: 375919 - DNA, 20 bp, human
gttccacaagtatgtgtcca

SEQ ID NO: 375920 - DNA, 20 bp, human
gtctgataactcgtggtaac

SEQ ID NO: 375921 - DNA, 20 bp, human
gttgcaaaatcactttgtta

SEQ ID NO: 375922 - DNA, 20 bp, human
gtcatagagttgttccacct

SEQ ID NO: 375923 - DNA, 20 bp, human
gcaattatgagatcacatta

SEQ ID NO: 375924 - DNA, 20 bp, human
gcatgttctctgataactcg

SEQ ID NO: 375925 - DNA, 20 bp, human
gccaaattcagtaatctttt

SEQ ID NO: 375926 - DNA, 20 bp, human
gcaggccccgggactcagga

SEQ ID NO: 375927 - DNA, 20 bp, human
gcgctcgcaaggcacgccgg

SEQ ID NO: 375928 - DNA, 20 bp, human
ggactcaggacgggccgctg

SEQ ID NO: 375929 - DNA, 20 bp, human
gacagggcgctcctcccgct

SEQ ID NO: 375930 - DNA, 20 bp, human
ggcggcccgtcctgagtccc

SEQ ID NO: 375931 - DNA, 20 bp, human
gaggagcgccctgtcccgcc

SEQ ID NO: 375932 - DNA, 20 bp, human
gcggtccgaaccacaagttc

SEQ ID NO: 375933 - DNA, 20 bp, human
gccggcaggccccgggactc

SEQ ID NO: 375934 - DNA, 20 bp, human
gagcccggcaggaagtgacg

SEQ ID NO: 375935 - DNA, 20 bp, human
ggctgcggtccaggcgggac

SEQ ID NO: 375936 - DNA, 20 bp, human
gggcgagggccattcccggg

SEQ ID NO: 375937 - DNA, 20 bp, human
ggagcccgaggggtggaagc

SEQ ID NO: 375938 - DNA, 20 bp, human
gaatggccgcgcttggtcgc

SEQ ID NO: 375939 - DNA, 20 bp, human
ggagctgggcccctgggcga

SEQ ID NO: 375940 - DNA, 20 bp, human
gtggaggtagagccggtgcc

SEQ ID NO: 375941 - DNA, 20 bp, human
ggggaatggccctcgcccag

SEQ ID NO: 375942 - DNA, 20 bp, human
gaggggcagccggagagcct

SEQ ID NO: 375943 - DNA, 20 bp, human
gagcctgggaaaggtacgag

SEQ ID NO: 375944 - DNA, 20 bp, human
gccacccttggcagacgagg

SEQ ID NO: 375945 - DNA, 20 bp, human
ggacgaggagactgcggacc

SEQ ID NO: 375946 - DNA, 20 bp, human
gtgtagggacagaagagcgc

SEQ ID NO: 375947 - DNA, 20 bp, human
gtctgcgccgggcactccgg

SEQ ID NO: 375948 - DNA, 20 bp, human
gtggccgctggcaactggca

SEQ ID NO: 375949 - DNA, 20 bp, human
gggccgggaacagaaagtgt

SEQ ID NO: 375950 - DNA, 20 bp, human
ggctggagtcttccccggga

SEQ ID NO: 375951 - DNA, 20 bp, human
ggggtggcccggaggacggc

SEQ ID NO: 375952 - DNA, 20 bp, human
gccggcgcagaaaccgtaaa

SEQ ID NO: 375953 - DNA, 20 bp, human
gagtactggtcgctcagggc

SEQ ID NO: 375954 - DNA, 20 bp, human
gtaaaaggctggagcgggcg

SEQ ID NO: 375955 - DNA, 20 bp, human
gcgggctccgccggagtgcc

SEQ ID NO: 375956 - DNA, 20 bp, human
ggaattgcatgccctcttat

SEQ ID NO: 375957 - DNA, 20 bp, human
gcttgggggaaatggatagc

SEQ ID NO: 375958 - DNA, 20 bp, human
ggtctggtgagccaataaga

SEQ ID NO: 375959 - DNA, 20 bp, human
gagagggcatgcaattcagc

SEQ ID NO: 375960 - DNA, 20 bp, human
gaccaatcaggtccctcaac

SEQ ID NO: 375961 - DNA, 20 bp, human
gggctcaccagaccagttga

SEQ ID NO: 375962 - DNA, 20 bp, human
gagaacggctataaaatccc

SEQ ID NO: 375963 - DNA, 20 bp, human
ggaaatggatagcaggggta

SEQ ID NO: 375964 - DNA, 20 bp, human
gaccagttgagggacctgat

SEQ ID NO: 375965 - DNA, 20 bp, human
gtgtacacacagagaagata

SEQ ID NO: 375966 - DNA, 20 bp, human
gtcccggccgtgttgtcaaa

SEQ ID NO: 375967 - DNA, 20 bp, human
ggcctgcgctcaactactac

SEQ ID NO: 375968 - DNA, 20 bp, human
gtgcgctcaactactacagg

SEQ ID NO: 375969 - DNA, 20 bp, human
gcgagcaggtgttgtcccgg

SEQ ID NO: 375970 - DNA, 20 bp, human
ggtcaaaagggccggggtct

SEQ ID NO: 375971 - DNA, 20 bp, human
gagtcgagcaggtgttgtcc

SEQ ID NO: 375972 - DNA, 20 bp, human
ggacaaagttgccgacctgg

SEQ ID NO: 375973 - DNA, 20 bp, human
gcccggcccttttgacaaca

SEQ ID NO: 375974 - DNA, 20 bp, human
gcaaacgcgtggccgccgcc

SEQ ID NO: 375975 - DNA, 20 bp, human
gaaagttgccgacctggcgg

SEQ ID NO: 375976 - DNA, 20 bp, human
ggccgtctgccctgcacctg

SEQ ID NO: 375977 - DNA, 20 bp, human
ggaaacggacctcaggtgca

SEQ ID NO: 375978 - DNA, 20 bp, human
gcgcctgagcctccagagcg

SEQ ID NO: 375979 - DNA, 20 bp, human
ggagcctccaagccagctgc

SEQ ID NO: 375980 - DNA, 20 bp, human
ggctggacgcgcaacggaca

SEQ ID NO: 375981 - DNA, 20 bp, human
gggtgttttaataagccccc

SEQ ID NO: 375982 - DNA, 20 bp, human
gggttccggaacgtccttgg

SEQ ID NO: 375983 - DNA, 20 bp, human
gagggcgcgaaacggacctc

SEQ ID NO: 375984 - DNA, 20 bp, human
gcagggttccggaacgtcct

SEQ ID NO: 375985 - DNA, 20 bp, human
ggactccccaagtcgcactc

SEQ ID NO: 375986 - DNA, 20 bp, human
gggcgcgaaacggacctcaa

SEQ ID NO: 375987 - DNA, 20 bp, human
ggaaacggacctcaagggca

SEQ ID NO: 375988 - DNA, 20 bp, human
gaagcctccaagcctgctgc

SEQ ID NO: 375989 - DNA, 20 bp, human
ggctggacgcgcaactgaca

SEQ ID NO: 375990 - DNA, 20 bp, human
ggccgtctgccctgcccttg

SEQ ID NO: 375991 - DNA, 20 bp, human
ggcggggcctgcagcaggct

SEQ ID NO: 375992 - DNA, 20 bp, human
gcggtgttttaatatgcccc

SEQ ID NO: 375993 - DNA, 20 bp, human
gggttcgggaacgtccttgg

SEQ ID NO: 375994 - DNA, 20 bp, human
gagggcagacggcatttgag

SEQ ID NO: 375995 - DNA, 20 bp, human
ggccccgcgtccgcagggtt

SEQ ID NO: 375996 - DNA, 20 bp, human
gaggaacgctgactggagtc

SEQ ID NO: 375997 - DNA, 20 bp, human
gaggagtcggggagctcgga

SEQ ID NO: 375998 - DNA, 20 bp, human
gagggcccagagcaccgagg

SEQ ID NO: 375999 - DNA, 20 bp, human
ggggcccgaggaacgctgac

SEQ ID NO: 376000 - DNA, 20 bp, human
gtggcagcgacgcgccgcta

SEQ ID NO: 376001 - DNA, 20 bp, human
gtgcgtgcccggacagctcg

SEQ ID NO: 376002 - DNA, 20 bp, human
gcccctgcggggttcctccg

SEQ ID NO: 376003 - DNA, 20 bp, human
gagggcccttggcgagagtt

SEQ ID NO: 376004 - DNA, 20 bp, human
ggagccagcagtgagtgcac

SEQ ID NO: 376005 - DNA, 20 bp, human
gcggacagctcgtggcgccg

SEQ ID NO: 376006 - DNA, 20 bp, human
gctcccccggggccgcaatc

SEQ ID NO: 376007 - DNA, 20 bp, human
gcagcccgccgcagcttatc

SEQ ID NO: 376008 - DNA, 20 bp, human
gacccggcggctcctgattg

SEQ ID NO: 376009 - DNA, 20 bp, human
gggccgagccggataagctg

SEQ ID NO: 376010 - DNA, 20 bp, human
gcggctcctgattgcggccc

SEQ ID NO: 376011 - DNA, 20 bp, human
gctcctgattgcggccccgg

SEQ ID NO: 376012 - DNA, 20 bp, human
ggagccggataagctgcggc

SEQ ID NO: 376013 - DNA, 20 bp, human
gtgcacagccccggcagcgg

SEQ ID NO: 376014 - DNA, 20 bp, human
ggacctcccgcctggggcca

SEQ ID NO: 376015 - DNA, 20 bp, human
gaatcaggaagtgttggcgc

SEQ ID NO: 376016 - DNA, 20 bp, human
gcccgcttcccgggggtcag

SEQ ID NO: 376017 - DNA, 20 bp, human
gccgggaagcggggatttta

SEQ ID NO: 376018 - DNA, 20 bp, human
ggatggtgccgctgaccccc

SEQ ID NO: 376019 - DNA, 20 bp, human
gagaaaacagcacctggact

SEQ ID NO: 376020 - DNA, 20 bp, human
ggaagccatgggttcttatg

SEQ ID NO: 376021 - DNA, 20 bp, human
ggccgctgacccccgggaag

SEQ ID NO: 376022 - DNA, 20 bp, human
ggaccggaacttctatactg

SEQ ID NO: 376023 - DNA, 20 bp, human
gagaccgtcccgcccttctc

SEQ ID NO: 376024 - DNA, 20 bp, human
ggtgcatcccagggtgattg

SEQ ID NO: 376025 - DNA, 20 bp, human
gctggatttcgcaagagaag

SEQ ID NO: 376026 - DNA, 20 bp, human
ggcccccagaggtgcatggg

SEQ ID NO: 376027 - DNA, 20 bp, human
gtgggcggggaaccccagac

SEQ ID NO: 376028 - DNA, 20 bp, human
ggacggggagcagcagattc

SEQ ID NO: 376029 - DNA, 20 bp, human
gcagggtatggcagaaccca

SEQ ID NO: 376030 - DNA, 20 bp, human
ggcagcagattcaggctagg

SEQ ID NO: 376031 - DNA, 20 bp, human
gccccgcccatgcacctctg

SEQ ID NO: 376032 - DNA, 20 bp, human
gagggcccctctggggtctt

SEQ ID NO: 376033 - DNA, 20 bp, human
gttccccaccatgggacaca

SEQ ID NO: 376034 - DNA, 20 bp, human
gatctgctgctccccgtctg

SEQ ID NO: 376035 - DNA, 20 bp, human
gggggaagggagcaccttgt

SEQ ID NO: 376036 - DNA, 20 bp, human
ggaaagcccagctaggtaga

SEQ ID NO: 376037 - DNA, 20 bp, human
gcacggtcgccgttacgtat

SEQ ID NO: 376038 - DNA, 20 bp, human
gcgagcgcggaaccagtgcg

SEQ ID NO: 376039 - DNA, 20 bp, human
gctccaagaagacttgggat

SEQ ID NO: 376040 - DNA, 20 bp, human
ggtgcggggcgctgattggt

SEQ ID NO: 376041 - DNA, 20 bp, human
gctccaggatcaaggatccg

SEQ ID NO: 376042 - DNA, 20 bp, human
gctcgccagtcagggagcgg

SEQ ID NO: 376043 - DNA, 20 bp, human
gacgtaacggcgaccgtgcg

SEQ ID NO: 376044 - DNA, 20 bp, human
ggccccgcctctgggacgtt

SEQ ID NO: 376045 - DNA, 20 bp, human
gtcggcacaccaatacgtaa

SEQ ID NO: 376046 - DNA, 20 bp, human
gccagcgcccagctggatcc

SEQ ID NO: 376047 - DNA, 20 bp, human
gttcccaagccgcagagagg

SEQ ID NO: 376048 - DNA, 20 bp, human
ggcctcgcctgacaaccaat

SEQ ID NO: 376049 - DNA, 20 bp, human
gggtccgggagagcccgcta

SEQ ID NO: 376050 - DNA, 20 bp, human
gccaaccgcgggccgtcggg

SEQ ID NO: 376051 - DNA, 20 bp, human
ggctggcccgggcttcgctg

SEQ ID NO: 376052 - DNA, 20 bp, human
gtggcgctggagactctcgg

SEQ ID NO: 376053 - DNA, 20 bp, human
gcagagaggcggaagccgat

SEQ ID NO: 376054 - DNA, 20 bp, human
gaggcccacgagggccactg

SEQ ID NO: 376055 - DNA, 20 bp, human
gaccaggggccgctgcgcat

SEQ ID NO: 376056 - DNA, 20 bp, human
gtatgcgagcgaatgtgcga

SEQ ID NO: 376057 - DNA, 20 bp, human
gcgagcgaatgtgcgagggg

SEQ ID NO: 376058 - DNA, 20 bp, human
gggacggtagtaccgtgggg

SEQ ID NO: 376059 - DNA, 20 bp, human
gccccggaggcgttcctaga

SEQ ID NO: 376060 - DNA, 20 bp, human
gcgaggggagggaggcgtcc

SEQ ID NO: 376061 - DNA, 20 bp, human
gtgcgccgtggagagcctga

SEQ ID NO: 376062 - DNA, 20 bp, human
ggagccgcgaagataggagg

SEQ ID NO: 376063 - DNA, 20 bp, human
ggcggtggtaccgtgaatga

SEQ ID NO: 376064 - DNA, 20 bp, human
gagcgagccgcgaagatagg

SEQ ID NO: 376065 - DNA, 20 bp, human
gcgaccagcgcgggccggag

SEQ ID NO: 376066 - DNA, 20 bp, human
gcactggtcgagttcttcta

SEQ ID NO: 376067 - DNA, 20 bp, human
gtcccccgcacctcaggatt

SEQ ID NO: 376068 - DNA, 20 bp, human
gtccccgctgtccaatgaga

SEQ ID NO: 376069 - DNA, 20 bp, human
gcattcgtggagcctgagat

SEQ ID NO: 376070 - DNA, 20 bp, human
ggcgggggaggcagggttga

SEQ ID NO: 376071 - DNA, 20 bp, human
gagcgcccaatcctgaggtg

SEQ ID NO: 376072 - DNA, 20 bp, human
gagaggagcgcccaatcctg

SEQ ID NO: 376073 - DNA, 20 bp, human
gaagaactcgaccagtgagc

SEQ ID NO: 376074 - DNA, 20 bp, human
gggtcccggtagcttctagt

SEQ ID NO: 376075 - DNA, 20 bp, human
gctcaggctccacgaatgga

SEQ ID NO: 376076 - DNA, 20 bp, human
gcggggacggtcccctggaa

SEQ ID NO: 376077 - DNA, 20 bp, human
gagccccgggaccccctaat

SEQ ID NO: 376078 - DNA, 20 bp, human
gggctcgcggagcgtggtgt

SEQ ID NO: 376079 - DNA, 20 bp, human
gagagcctcggacccgttcc

SEQ ID NO: 376080 - DNA, 20 bp, human
gggagcgcccgcagccaatt

SEQ ID NO: 376081 - DNA, 20 bp, human
gtcgcggagcgtggtgtggg

SEQ ID NO: 376082 - DNA, 20 bp, human
ggtggagccgggccggtggg

SEQ ID NO: 376083 - DNA, 20 bp, human
gtgggaccgctcatggactc

SEQ ID NO: 376084 - DNA, 20 bp, human
gccgtcgccgcagggcactc

SEQ ID NO: 376085 - DNA, 20 bp, human
gcacaagggaggcggccctg

SEQ ID NO: 376086 - DNA, 20 bp, human
gcgcccgagcggcgattggt

SEQ ID NO: 376087 - DNA, 20 bp, human
gccccgccgccgctgacgat

SEQ ID NO: 376088 - DNA, 20 bp, human
gcaaacgctccaatcgtcag

SEQ ID NO: 376089 - DNA, 20 bp, human
gcgccgaccaatcgccgctc

SEQ ID NO: 376090 - DNA, 20 bp, human
gcgggcgcccgagcggcgat

SEQ ID NO: 376091 - DNA, 20 bp, human
gcccgtgacgggcgtctccg

SEQ ID NO: 376092 - DNA, 20 bp, human
gagacgcccgtcacgggcag

SEQ ID NO: 376093 - DNA, 20 bp, human
gcccaccgaggtcacagccg

SEQ ID NO: 376094 - DNA, 20 bp, human
ggcaggttcaaccaacgggt

SEQ ID NO: 376095 - DNA, 20 bp, human
gcttggccccgcccgagggg

SEQ ID NO: 376096 - DNA, 20 bp, human
gggacccgggcctcagaact

SEQ ID NO: 376097 - DNA, 20 bp, human
gtcagggtcaacttcgtcct

SEQ ID NO: 376098 - DNA, 20 bp, human
gaagcccggtgcagggtctg

SEQ ID NO: 376099 - DNA, 20 bp, human
gcaccgggggtccgggacgg

SEQ ID NO: 376100 - DNA, 20 bp, human
gtctgaggcccgggtcccac

SEQ ID NO: 376101 - DNA, 20 bp, human
gcggtgcagggtctgcggac

SEQ ID NO: 376102 - DNA, 20 bp, human
ggacgaagttgaccctgacc

SEQ ID NO: 376103 - DNA, 20 bp, human
gcgagtccaagcccggtgca

SEQ ID NO: 376104 - DNA, 20 bp, human
gaggtccgctcggtcgtccg

SEQ ID NO: 376105 - DNA, 20 bp, human
gagtgctaggtcatcctccg

SEQ ID NO: 376106 - DNA, 20 bp, human
ggcccggcgcctatcaatga

SEQ ID NO: 376107 - DNA, 20 bp, human
gcaaacgaatcgaaaagggg

SEQ ID NO: 376108 - DNA, 20 bp, human
gcgcagggcgggggaataat

SEQ ID NO: 376109 - DNA, 20 bp, human
gaatcgaaaaggggcggtgc

SEQ ID NO: 376110 - DNA, 20 bp, human
gggctgtctcctgaccgcgg

SEQ ID NO: 376111 - DNA, 20 bp, human
gaggaccagacggggaggtt

SEQ ID NO: 376112 - DNA, 20 bp, human
gcatgcaaacgaatcgaaaa

SEQ ID NO: 376113 - DNA, 20 bp, human
gaataatgggtgcccagctc

SEQ ID NO: 376114 - DNA, 20 bp, human
ggtaggaggaccagacgggg

SEQ ID NO: 376115 - DNA, 20 bp, human
gtctacggcgcggtttccgg

SEQ ID NO: 376116 - DNA, 20 bp, human
gtccgggctagctaggtgta

SEQ ID NO: 376117 - DNA, 20 bp, human
gtgggcatccggaggatgtg

SEQ ID NO: 376118 - DNA, 20 bp, human
ggaaccctcaccagggtcct

SEQ ID NO: 376119 - DNA, 20 bp, human
ggtaggggtggacgggtccc

SEQ ID NO: 376120 - DNA, 20 bp, human
gactaggggtagtgggatac

SEQ ID NO: 376121 - DNA, 20 bp, human
gccactacccctagtctcag

SEQ ID NO: 376122 - DNA, 20 bp, human
ggagaggctccgggctagct

SEQ ID NO: 376123 - DNA, 20 bp, human
ggcaaccgctgggcatccgg

SEQ ID NO: 376124 - DNA, 20 bp, human
gaagtagagaaccctcacca

SEQ ID NO: 376125 - DNA, 20 bp, human
gtcagcaaccgctgggcatc

SEQ ID NO: 376126 - DNA, 20 bp, human
gggcgggcggccacggagtg

SEQ ID NO: 376127 - DNA, 20 bp, human
gcggccacggagtgaggccg

SEQ ID NO: 376128 - DNA, 20 bp, human
gcgggcgctcaggaccccgc

SEQ ID NO: 376129 - DNA, 20 bp, human
gccacggagtgaggccgggg

SEQ ID NO: 376130 - DNA, 20 bp, human
gtcgggcgcggggcggacgt

SEQ ID NO: 376131 - DNA, 20 bp, human
ggactcacagcaccaccctt

SEQ ID NO: 376132 - DNA, 20 bp, human
gcgtgaggcatcgggcgctc

SEQ ID NO: 376133 - DNA, 20 bp, human
gcgcgccctctgcagctcag

SEQ ID NO: 376134 - DNA, 20 bp, human
gctaacgcagtaggctgtcc

SEQ ID NO: 376135 - DNA, 20 bp, human
ggcaactctgctaacgcagt

SEQ ID NO: 376136 - DNA, 20 bp, human
gcgggagagccaatcggaac

SEQ ID NO: 376137 - DNA, 20 bp, human
ggagccaatcggaacgggtg

SEQ ID NO: 376138 - DNA, 20 bp, human
gggtctgtcacgtgacggga

SEQ ID NO: 376139 - DNA, 20 bp, human
gcctccgcacccgttccgat

SEQ ID NO: 376140 - DNA, 20 bp, human
ggcgcctggctggcccgagg

SEQ ID NO: 376141 - DNA, 20 bp, human
ggcgcaggtggggcgcactc

SEQ ID NO: 376142 - DNA, 20 bp, human
ggggtgggtctgtcacgtga

SEQ ID NO: 376143 - DNA, 20 bp, human
gcggccgggggcgcgtgtgc

SEQ ID NO: 376144 - DNA, 20 bp, human
gaaaactgcagccgcgtctg

SEQ ID NO: 376145 - DNA, 20 bp, human
gaacggcgatgccccagacg

SEQ ID NO: 376146 - DNA, 20 bp, human
gacgcccggggactcgttgg

SEQ ID NO: 376147 - DNA, 20 bp, human
gcgcacgcccggggactcgt

SEQ ID NO: 376148 - DNA, 20 bp, human
gccccacgccggccgcggat

SEQ ID NO: 376149 - DNA, 20 bp, human
gggcgcagagcagtgacgta

SEQ ID NO: 376150 - DNA, 20 bp, human
gcgggcgtccctcctagacc

SEQ ID NO: 376151 - DNA, 20 bp, human
gggtgtgagcttcacgaagg

SEQ ID NO: 376152 - DNA, 20 bp, human
gtagaccaggtgatgacgaa

SEQ ID NO: 376153 - DNA, 20 bp, human
gcacgccgccaacgagtccc

SEQ ID NO: 376154 - DNA, 20 bp, human
gcctcaggcccgtcagtgct

SEQ ID NO: 376155 - DNA, 20 bp, human
ggactcgttggcggcgtgga

SEQ ID NO: 376156 - DNA, 20 bp, human
gcccgggccgggccgacagg

SEQ ID NO: 376157 - DNA, 20 bp, human
gtgggcacgcggccagcctc

SEQ ID NO: 376158 - DNA, 20 bp, human
gcgccccgcgcttccgggag

SEQ ID NO: 376159 - DNA, 20 bp, human
gcgcgcttccgggaggggga

SEQ ID NO: 376160 - DNA, 20 bp, human
gagggcaggatcggagtcgg

SEQ ID NO: 376161 - DNA, 20 bp, human
gcgtcccgggcgagcccctg

SEQ ID NO: 376162 - DNA, 20 bp, human
ggcgccgggagggaccgagt

SEQ ID NO: 376163 - DNA, 20 bp, human
gcgcccgcccgcgggggcgt

SEQ ID NO: 376164 - DNA, 20 bp, human
gcagccgccgcctgtcggcc

SEQ ID NO: 376165 - DNA, 20 bp, human
ggtggccgcgcgggagccct

SEQ ID NO: 376166 - DNA, 20 bp, human
gtgcgcgccgcgaggctctc

SEQ ID NO: 376167 - DNA, 20 bp, human
gcccggaagcctgctggcgt

SEQ ID NO: 376168 - DNA, 20 bp, human
ggcggcgcgcatgcgagccc

SEQ ID NO: 376169 - DNA, 20 bp, human
gcccggcaggctgcgcgaga

SEQ ID NO: 376170 - DNA, 20 bp, human
gccctagtcctgctcccgaa

SEQ ID NO: 376171 - DNA, 20 bp, human
gggcccgcgcacggctctct

SEQ ID NO: 376172 - DNA, 20 bp, human
gagcccggaggcgacggcga

SEQ ID NO: 376173 - DNA, 20 bp, human
gaggcttccgggcccggagt

SEQ ID NO: 376174 - DNA, 20 bp, human
gccagcccgcgaagcaacgg

SEQ ID NO: 376175 - DNA, 20 bp, human
ggtcccagagagccgtgcgc

SEQ ID NO: 376176 - DNA, 20 bp, human
gccccagcctagagcggctc

SEQ ID NO: 376177 - DNA, 20 bp, human
gccagccaggccttcgtccc

SEQ ID NO: 376178 - DNA, 20 bp, human
gagcctgccgcggcctgggt

SEQ ID NO: 376179 - DNA, 20 bp, human
ggaggagccgcgctcctaag

SEQ ID NO: 376180 - DNA, 20 bp, human
gccctagcctgccctcacta

SEQ ID NO: 376181 - DNA, 20 bp, human
gcagagaaggtggacggagc

SEQ ID NO: 376182 - DNA, 20 bp, human
gtccctcccgcttaggagcg

SEQ ID NO: 376183 - DNA, 20 bp, human
ggcggatctccctcccgctt

SEQ ID NO: 376184 - DNA, 20 bp, human
gggccccagagccccgtgac

SEQ ID NO: 376185 - DNA, 20 bp, human
gaggctaggggcggagctct

SEQ ID NO: 376186 - DNA, 20 bp, human
gtgcgggagccgcctgacgc

SEQ ID NO: 376187 - DNA, 20 bp, human
gctcccgcacgcttcttcct

SEQ ID NO: 376188 - DNA, 20 bp, human
gctgcgccctggtgatttat

SEQ ID NO: 376189 - DNA, 20 bp, human
gccgcctaggaagaagcgtg

SEQ ID NO: 376190 - DNA, 20 bp, human
gcttcaagctgtgactttag

SEQ ID NO: 376191 - DNA, 20 bp, human
ggtcggcagcagccagcgtc

SEQ ID NO: 376192 - DNA, 20 bp, human
gcccggcctataaatcacca

SEQ ID NO: 376193 - DNA, 20 bp, human
ggtgactttagaggtgacgt

SEQ ID NO: 376194 - DNA, 20 bp, human
gacgtgactcccgctaacac

SEQ ID NO: 376195 - DNA, 20 bp, human
ggcgcagtgtggggcccttg

SEQ ID NO: 376196 - DNA, 20 bp, human
gcacagctaccccggagggg

SEQ ID NO: 376197 - DNA, 20 bp, human
ggaccccgggagggcgacgt

SEQ ID NO: 376198 - DNA, 20 bp, human
gcagcgcacagctaccccgg

SEQ ID NO: 376199 - DNA, 20 bp, human
gaaccgctgggcagtctcct

SEQ ID NO: 376200 - DNA, 20 bp, human
ggggcggcgctcggacccct

SEQ ID NO: 376201 - DNA, 20 bp, human
gctagacaaggaccccggga

SEQ ID NO: 376202 - DNA, 20 bp, human
gaggctgcgagcgccgggct

SEQ ID NO: 376203 - DNA, 20 bp, human
ggggtgagcgccagacgcct

SEQ ID NO: 376204 - DNA, 20 bp, human
gaggcacctgcggctgccaa

SEQ ID NO: 376205 - DNA, 20 bp, human
gttctggagagagcgctaag

SEQ ID NO: 376206 - DNA, 20 bp, human
gggaccgagctcccggccga

SEQ ID NO: 376207 - DNA, 20 bp, human
ggacgaaggcagcacgcagt

SEQ ID NO: 376208 - DNA, 20 bp, human
ggggaggaggggacggacga

SEQ ID NO: 376209 - DNA, 20 bp, human
gccgggagctcggtccctgc

SEQ ID NO: 376210 - DNA, 20 bp, human
gagccgaggcctggccatag

SEQ ID NO: 376211 - DNA, 20 bp, human
ggagggaggagggccgagca

SEQ ID NO: 376212 - DNA, 20 bp, human
gcttactgctgggttgtcgg

SEQ ID NO: 376213 - DNA, 20 bp, human
ggcagtagacggaggtctag

SEQ ID NO: 376214 - DNA, 20 bp, human
gggtttgtcagcacccacta

SEQ ID NO: 376215 - DNA, 20 bp, human
gtagaggtagaggggctctt

SEQ ID NO: 376216 - DNA, 20 bp, human
gagtgcctggagtgtcgcta

SEQ ID NO: 376217 - DNA, 20 bp, human
gctcctggaaggggtcgagg

SEQ ID NO: 376218 - DNA, 20 bp, human
gaggtgcggagcttcgggaa

SEQ ID NO: 376219 - DNA, 20 bp, human
gcaggggcggggctagtgcc

SEQ ID NO: 376220 - DNA, 20 bp, human
gggtggccgccaccagtcta

SEQ ID NO: 376221 - DNA, 20 bp, human
gtggagtgtcgctagggagt

SEQ ID NO: 376222 - DNA, 20 bp, human
gggagcttcgggaagggtag

SEQ ID NO: 376223 - DNA, 20 bp, human
ggcccccatccctagactgg

SEQ ID NO: 376224 - DNA, 20 bp, human
ggagctcctggaaggggtcg

SEQ ID NO: 376225 - DNA, 20 bp, human
ggccaccagtctagggatgg

SEQ ID NO: 376226 - DNA, 20 bp, human
gcgcggcagggggtcgggtg

SEQ ID NO: 376227 - DNA, 20 bp, human
ggagagcagcagcccgacaa

SEQ ID NO: 376228 - DNA, 20 bp, human
ggtctccatggcgaccgcgt

SEQ ID NO: 376229 - DNA, 20 bp, human
gcgcctgcgggattccgtac

SEQ ID NO: 376230 - DNA, 20 bp, human
ggggacgcggcaggtgagac

SEQ ID NO: 376231 - DNA, 20 bp, human
gggaggccacccagccaacg

SEQ ID NO: 376232 - DNA, 20 bp, human
gctgccgccgcccgcctcga

SEQ ID NO: 376233 - DNA, 20 bp, human
gtgtgatgcgcctgcgcgag

SEQ ID NO: 376234 - DNA, 20 bp, human
ggtgtggtgcgcctgcgctg

SEQ ID NO: 376235 - DNA, 20 bp, human
gtgtggtgcgcctgcccggg

SEQ ID NO: 376236 - DNA, 20 bp, human
ggggcagctcgccttagaga

SEQ ID NO: 376237 - DNA, 20 bp, human
gtctaaggcgagctgccctt

SEQ ID NO: 376238 - DNA, 20 bp, human
gcagccccaggcgcgcccaa

SEQ ID NO: 376239 - DNA, 20 bp, human
gcaaccccgcggcttggaga

SEQ ID NO: 376240 - DNA, 20 bp, human
ggggctgcacctgggtcacg

SEQ ID NO: 376241 - DNA, 20 bp, human
gctcctctgtgccccagacg

SEQ ID NO: 376242 - DNA, 20 bp, human
ggggagctggcctaaaaaga

SEQ ID NO: 376243 - DNA, 20 bp, human
gaccgcagggcagtggacgg

SEQ ID NO: 376244 - DNA, 20 bp, human
ggctgcccttgggcgcgcct

SEQ ID NO: 376245 - DNA, 20 bp, human
gggaggtgccggctgcacaa

SEQ ID NO: 376246 - DNA, 20 bp, human
ggggaggagcgtcacagagg

SEQ ID NO: 376247 - DNA, 20 bp, human
gaccgccgctgattgaacgg

SEQ ID NO: 376248 - DNA, 20 bp, human
ggcggggaggccaggagcgt

SEQ ID NO: 376249 - DNA, 20 bp, human
gccgctagggcttaattcaa

SEQ ID NO: 376250 - DNA, 20 bp, human
gggtccgctgggctccgcta

SEQ ID NO: 376251 - DNA, 20 bp, human
gcgccctcggggacttgggt

SEQ ID NO: 376252 - DNA, 20 bp, human
ggccccgcggcctacgctcc

SEQ ID NO: 376253 - DNA, 20 bp, human
gacgcggaggagccggacct

SEQ ID NO: 376254 - DNA, 20 bp, human
ggcccgcaggtcacaatcca

SEQ ID NO: 376255 - DNA, 20 bp, human
gaggcagcccgggcccggag

SEQ ID NO: 376256 - DNA, 20 bp, human
gggcgtgtggggtggagcga

SEQ ID NO: 376257 - DNA, 20 bp, human
gcggaggcggaaaactaaga

SEQ ID NO: 376258 - DNA, 20 bp, human
gcccttagggaagtcggagg

SEQ ID NO: 376259 - DNA, 20 bp, human
gggaaccggaaatgccctta

SEQ ID NO: 376260 - DNA, 20 bp, human
gacaaaggcgctcagaggtg

SEQ ID NO: 376261 - DNA, 20 bp, human
ggacgccgccatatcttcac

SEQ ID NO: 376262 - DNA, 20 bp, human
gatgcccttagggaagtcgg

SEQ ID NO: 376263 - DNA, 20 bp, human
ggccgggcctgatggccctg

SEQ ID NO: 376264 - DNA, 20 bp, human
gctgcgggccggtgaagata

SEQ ID NO: 376265 - DNA, 20 bp, human
gcgggccggtgaagatatgg

SEQ ID NO: 376266 - DNA, 20 bp, human
gtgtgaggcggtctcgaagt

SEQ ID NO: 376267 - DNA, 20 bp, human
gccagccagccctaggcagg

SEQ ID NO: 376268 - DNA, 20 bp, human
gaggcggtctcgaagtaggc

SEQ ID NO: 376269 - DNA, 20 bp, human
gtcccttcaccccctgccta

SEQ ID NO: 376270 - DNA, 20 bp, human
gcatgcgcgacttcccggag

SEQ ID NO: 376271 - DNA, 20 bp, human
ggccctaggcagggggtgaa

SEQ ID NO: 376272 - DNA, 20 bp, human
gcggtcccccgccgcggaga

SEQ ID NO: 376273 - DNA, 20 bp, human
gcgccagcccgtctccgcgg

SEQ ID NO: 376274 - DNA, 20 bp, human
ggcctagggctggctggacc

SEQ ID NO: 376275 - DNA, 20 bp, human
gcagcccgtctccgcggcgg

SEQ ID NO: 376276 - DNA, 20 bp, human
gtgcctcctcggcttctcgg

SEQ ID NO: 376277 - DNA, 20 bp, human
gcaaggctcgcgagagttca

SEQ ID NO: 376278 - DNA, 20 bp, human
gctgtggtgcgtatgacgtc

SEQ ID NO: 376279 - DNA, 20 bp, human
ggacgacagaaggctacttc

SEQ ID NO: 376280 - DNA, 20 bp, human
gcaccaggcggagatgggtg

SEQ ID NO: 376281 - DNA, 20 bp, human
gctcgcgagccttgcctcct

SEQ ID NO: 376282 - DNA, 20 bp, human
gaaccagtctggccttcacc

SEQ ID NO: 376283 - DNA, 20 bp, human
gtaaaaacggcagtgaggtg

SEQ ID NO: 376284 - DNA, 20 bp, human
ggacgggcgttgacgacaga

SEQ ID NO: 376285 - DNA, 20 bp, human
gcggcctcgccggaatctca

SEQ ID NO: 376286 - DNA, 20 bp, human
gccgccgaagccagctagga

SEQ ID NO: 376287 - DNA, 20 bp, human
gctgttctccgcctcggcga

SEQ ID NO: 376288 - DNA, 20 bp, human
gcgccctcggggtccccagg

SEQ ID NO: 376289 - DNA, 20 bp, human
ggcggcggttcccctcgccg

SEQ ID NO: 376290 - DNA, 20 bp, human
ggtccccgccgaagccagct

SEQ ID NO: 376291 - DNA, 20 bp, human
gccaaggcgcagggcgagca

SEQ ID NO: 376292 - DNA, 20 bp, human
gaacagcgcgcgctaggctc

SEQ ID NO: 376293 - DNA, 20 bp, human
gtccccggccgccagcggag

SEQ ID NO: 376294 - DNA, 20 bp, human
ggcggagaacagcgcgcgct

SEQ ID NO: 376295 - DNA, 20 bp, human
gtgcgccggccgagaggtgt

SEQ ID NO: 376296 - DNA, 20 bp, human
ggccgcgcgccgcttccggt

SEQ ID NO: 376297 - DNA, 20 bp, human
gcggaaccgccaagtggtga

SEQ ID NO: 376298 - DNA, 20 bp, human
gcggacccggaaccgccaag

SEQ ID NO: 376299 - DNA, 20 bp, human
gggccctgatcacgtggttc

SEQ ID NO: 376300 - DNA, 20 bp, human
gagccacggccctgatcacg

SEQ ID NO: 376301 - DNA, 20 bp, human
gtggtgaaggcgcctccagg

SEQ ID NO: 376302 - DNA, 20 bp, human
gacgcccgaaccacgtgatc

SEQ ID NO: 376303 - DNA, 20 bp, human
gggttcgggcgtgagtcttg

SEQ ID NO: 376304 - DNA, 20 bp, human
ggggcggaaagcggaagtgt

SEQ ID NO: 376305 - DNA, 20 bp, human
ggggcgtgagtcttgtggcg

SEQ ID NO: 376306 - DNA, 20 bp, human
gctggtgcctgataaccaag

SEQ ID NO: 376307 - DNA, 20 bp, human
gagggaccacagcataacaa

SEQ ID NO: 376308 - DNA, 20 bp, human
ggtgcctgataaccaagagg

SEQ ID NO: 376309 - DNA, 20 bp, human
gtttgtcaaagtattatcag

SEQ ID NO: 376310 - DNA, 20 bp, human
gtttgcagctgtctatctca

SEQ ID NO: 376311 - DNA, 20 bp, human
ggattcacaaatgtaatgat

SEQ ID NO: 376312 - DNA, 20 bp, human
gtgaccacctcttggttatc

SEQ ID NO: 376313 - DNA, 20 bp, human
gaatttcctttgttatgctg

SEQ ID NO: 376314 - DNA, 20 bp, human
gctcgtcatttagcatatga

SEQ ID NO: 376315 - DNA, 20 bp, human
gtaaaaacaacttgaactta

SEQ ID NO: 376316 - DNA, 20 bp, human
gggggcgccatcttgacgat

SEQ ID NO: 376317 - DNA, 20 bp, human
ggccccaatccgaaagccgt

SEQ ID NO: 376318 - DNA, 20 bp, human
gagaggccagagtccgattg

SEQ ID NO: 376319 - DNA, 20 bp, human
gacgatgggcggaagacttc

SEQ ID NO: 376320 - DNA, 20 bp, human
gtggaggccgaggctctaat

SEQ ID NO: 376321 - DNA, 20 bp, human
gtctccagccccacggcttt

SEQ ID NO: 376322 - DNA, 20 bp, human
gaggttctgtggggtcgggc

SEQ ID NO: 376323 - DNA, 20 bp, human
gccagagtccgattgaggat

SEQ ID NO: 376324 - DNA, 20 bp, human
ggcgccatcttgacgatggg

SEQ ID NO: 376325 - DNA, 20 bp, human
gaaacctgttacacgattgg

SEQ ID NO: 376326 - DNA, 20 bp, human
gaagtgtagtcctgtcccgg

SEQ ID NO: 376327 - DNA, 20 bp, human
gttctgagctatccaggtca

SEQ ID NO: 376328 - DNA, 20 bp, human
gtagtcctgtcccggagggc

SEQ ID NO: 376329 - DNA, 20 bp, human
gtccgcgcggggctccgcat

SEQ ID NO: 376330 - DNA, 20 bp, human
gggcaggaggacaatgccgg

SEQ ID NO: 376331 - DNA, 20 bp, human
gcgggaccccgaagcacctc

SEQ ID NO: 376332 - DNA, 20 bp, human
gagaccacccccctagtccc

SEQ ID NO: 376333 - DNA, 20 bp, human
ggctccacgcgggttgtggg

SEQ ID NO: 376334 - DNA, 20 bp, human
gccgccgctctcggccaatg

SEQ ID NO: 376335 - DNA, 20 bp, human
ggagggcaggaggacaatgc

SEQ ID NO: 376336 - DNA, 20 bp, human
gactctgcgggagtcatgtc

SEQ ID NO: 376337 - DNA, 20 bp, human
gaaaatggggggagccgaca

SEQ ID NO: 376338 - DNA, 20 bp, human
gtggggggagccgacaggga

SEQ ID NO: 376339 - DNA, 20 bp, human
gaccagaatgcagtttgaaa

SEQ ID NO: 376340 - DNA, 20 bp, human
gctacttggactgtactatc

SEQ ID NO: 376341 - DNA, 20 bp, human
gttggagattctgactctgc

SEQ ID NO: 376342 - DNA, 20 bp, human
gttaagccctgaagcttcct

SEQ ID NO: 376343 - DNA, 20 bp, human
gcttaaagctccactctact

SEQ ID NO: 376344 - DNA, 20 bp, human
ggtgccattgcacaattcaa

SEQ ID NO: 376345 - DNA, 20 bp, human
gattgatcggccaatggtgc

SEQ ID NO: 376346 - DNA, 20 bp, human
gagagagagagagactgcgg

SEQ ID NO: 376347 - DNA, 20 bp, human
gaaggggccgcggctctcag

SEQ ID NO: 376348 - DNA, 20 bp, human
gaggagcaagcgcctggctg

SEQ ID NO: 376349 - DNA, 20 bp, human
gcaagcgcctggctgcggaa

SEQ ID NO: 376350 - DNA, 20 bp, human
gcccgcctgccctggggaat

SEQ ID NO: 376351 - DNA, 20 bp, human
gtctgtgcctgccatcggag

SEQ ID NO: 376352 - DNA, 20 bp, human
gaggtcccacccatggggtg

SEQ ID NO: 376353 - DNA, 20 bp, human
gaggagcaggtcccacccat

SEQ ID NO: 376354 - DNA, 20 bp, human
gctgtcccgctgtgagcggt

SEQ ID NO: 376355 - DNA, 20 bp, human
ggatgagcccccattcccca

SEQ ID NO: 376356 - DNA, 20 bp, human
gtcatggcaagagcgagcag

SEQ ID NO: 376357 - DNA, 20 bp, human
gacccccagctcgcaagctg

SEQ ID NO: 376358 - DNA, 20 bp, human
gtctgtgattggccagcagt

SEQ ID NO: 376359 - DNA, 20 bp, human
gagtaactcttagcaggcca

SEQ ID NO: 376360 - DNA, 20 bp, human
gcagtgggttgcttggcaat

SEQ ID NO: 376361 - DNA, 20 bp, human
gcacctccaagctctgtgat

SEQ ID NO: 376362 - DNA, 20 bp, human
gtgagtgagtaactcttagc

SEQ ID NO: 376363 - DNA, 20 bp, human
ggagcttggaggtgatgtca

SEQ ID NO: 376364 - DNA, 20 bp, human
gctccaggaagctattttta

SEQ ID NO: 376365 - DNA, 20 bp, human
gagtctcctctggtggagca

SEQ ID NO: 376366 - DNA, 20 bp, human
gtggtccaggcaccaggggt

SEQ ID NO: 376367 - DNA, 20 bp, human
gtcatgcagacctgggacct

SEQ ID NO: 376368 - DNA, 20 bp, human
gcggcccctcgctctggata

SEQ ID NO: 376369 - DNA, 20 bp, human
ggcagccctatccagagcga

SEQ ID NO: 376370 - DNA, 20 bp, human
gctgggacctgggcggagat

SEQ ID NO: 376371 - DNA, 20 bp, human
gaagagtcccatctccgccc

SEQ ID NO: 376372 - DNA, 20 bp, human
gcaggcagcgggctttcccc

SEQ ID NO: 376373 - DNA, 20 bp, human
gtgaagaaaagcagatagtc

SEQ ID NO: 376374 - DNA, 20 bp, human
gagagacggctgttgagggc

SEQ ID NO: 376375 - DNA, 20 bp, human
gtcgcagagacggctgttga

SEQ ID NO: 376376 - DNA, 20 bp, human
gccggggccctgcaccggaa

SEQ ID NO: 376377 - DNA, 20 bp, human
gcacttcccgctagttctgt

SEQ ID NO: 376378 - DNA, 20 bp, human
gcgaagcagtcgcgccgtgg

SEQ ID NO: 376379 - DNA, 20 bp, human
ggggccctgcaccggaaggg

SEQ ID NO: 376380 - DNA, 20 bp, human
gggacaggagggcggggatt

SEQ ID NO: 376381 - DNA, 20 bp, human
ggtcccgccctcgtgagagt

SEQ ID NO: 376382 - DNA, 20 bp, human
gggacgtggagcagatggtg

SEQ ID NO: 376383 - DNA, 20 bp, human
ggggcggaagccacgggacg

SEQ ID NO: 376384 - DNA, 20 bp, human
gcctgcaccggaagggaggg

SEQ ID NO: 376385 - DNA, 20 bp, human
gagtcgcgccgtggagggac

SEQ ID NO: 376386 - DNA, 20 bp, human
gcgcagggggagccatgcga

SEQ ID NO: 376387 - DNA, 20 bp, human
gccgccgcgggtggccgcgc

SEQ ID NO: 376388 - DNA, 20 bp, human
gagggggagccatgcgacgg

SEQ ID NO: 376389 - DNA, 20 bp, human
gaggaccgaactgcagccca

SEQ ID NO: 376390 - DNA, 20 bp, human
gaggaggcgatgaccccagc

SEQ ID NO: 376391 - DNA, 20 bp, human
gcagggctactgggtgtgat

SEQ ID NO: 376392 - DNA, 20 bp, human
gaactgcagcccagggctac

SEQ ID NO: 376393 - DNA, 20 bp, human
gatgaccccagcggggtccg

SEQ ID NO: 376394 - DNA, 20 bp, human
ggcccgcttccgccgtcgca

SEQ ID NO: 376395 - DNA, 20 bp, human
gtcacccgcgcggccacccg

SEQ ID NO: 376396 - DNA, 20 bp, human
gggcgcgtcaagttgttccc

SEQ ID NO: 376397 - DNA, 20 bp, human
gaccttctagagaagggcga

SEQ ID NO: 376398 - DNA, 20 bp, human
gagcggaactgcaagaggaa

SEQ ID NO: 376399 - DNA, 20 bp, human
gcgaccaagtaacgctgatt

SEQ ID NO: 376400 - DNA, 20 bp, human
gtagagaagggcgaaggctg

SEQ ID NO: 376401 - DNA, 20 bp, human
gctgccggaagtacatccgg

SEQ ID NO: 376402 - DNA, 20 bp, human
gagaaggtctgcgtttccca

SEQ ID NO: 376403 - DNA, 20 bp, human
ggagctgccggaagtacatc

SEQ ID NO: 376404 - DNA, 20 bp, human
ggccttcgcccttctctaga

SEQ ID NO: 376405 - DNA, 20 bp, human
ggcaaactgagtctcgggtg

SEQ ID NO: 376406 - DNA, 20 bp, human
gggggtagttaccctggtga

SEQ ID NO: 376407 - DNA, 20 bp, human
gccctaaggggtagttaccc

SEQ ID NO: 376408 - DNA, 20 bp, human
gacggagagacacatgagtg

SEQ ID NO: 376409 - DNA, 20 bp, human
gaccagggtaactacccctt

SEQ ID NO: 376410 - DNA, 20 bp, human
gtatcaggcttccctcacca

SEQ ID NO: 376411 - DNA, 20 bp, human
gatcacacaagatttataca

SEQ ID NO: 376412 - DNA, 20 bp, human
gaagacatatcaagctttgg

SEQ ID NO: 376413 - DNA, 20 bp, human
gaggaagcaataccaccaga

SEQ ID NO: 376414 - DNA, 20 bp, human
gctccgtgaagcagctccat

SEQ ID NO: 376415 - DNA, 20 bp, human
gttacacagcaatattttac

SEQ ID NO: 376416 - DNA, 20 bp, human
gagggaagagaacggagcgt

SEQ ID NO: 376417 - DNA, 20 bp, human
gaagacccggggccgccgag

SEQ ID NO: 376418 - DNA, 20 bp, human
gcccggggccgccgagtgga

SEQ ID NO: 376419 - DNA, 20 bp, human
gaagaaggcgtgaagagaga

SEQ ID NO: 376420 - DNA, 20 bp, human
ggggaggagtcactgcgccg

SEQ ID NO: 376421 - DNA, 20 bp, human
gggagcgctctcccctcctc

SEQ ID NO: 376422 - DNA, 20 bp, human
ggacaccagaaaaactttgg

SEQ ID NO: 376423 - DNA, 20 bp, human
ggggacagaagatgcgctgg

SEQ ID NO: 376424 - DNA, 20 bp, human
gcagccacaccaggaggcgg

SEQ ID NO: 376425 - DNA, 20 bp, human
gtcggacaccagaaaaactt

SEQ ID NO: 376426 - DNA, 20 bp, human
gtccaaggggcagatacgtg

SEQ ID NO: 376427 - DNA, 20 bp, human
gtcccacagcctgatgtcca

SEQ ID NO: 376428 - DNA, 20 bp, human
gaggggcagatacgtgtggt

SEQ ID NO: 376429 - DNA, 20 bp, human
gggagccaggagctctagat

SEQ ID NO: 376430 - DNA, 20 bp, human
gtcaagaaggggcaggaaat

SEQ ID NO: 376431 - DNA, 20 bp, human
gccaggagctctagattgga

SEQ ID NO: 376432 - DNA, 20 bp, human
ggtgctatttcattagtgaa

SEQ ID NO: 376433 - DNA, 20 bp, human
gcactaatgaaatagcacca

SEQ ID NO: 376434 - DNA, 20 bp, human
ggatgcagtcaagaaggggc

SEQ ID NO: 376435 - DNA, 20 bp, human
gaggggatgatggtgtggga

SEQ ID NO: 376436 - DNA, 20 bp, human
gacaggaacagagtgaagta

SEQ ID NO: 376437 - DNA, 20 bp, human
gtaaaaggtgagggcatgac

SEQ ID NO: 376438 - DNA, 20 bp, human
gccaccccaagccttcttgt

SEQ ID NO: 376439 - DNA, 20 bp, human
gctgaatccacataggtcta

SEQ ID NO: 376440 - DNA, 20 bp, human
ggctgcccacaagaaggctt

SEQ ID NO: 376441 - DNA, 20 bp, human
gtaaaagccctagacctatg

SEQ ID NO: 376442 - DNA, 20 bp, human
gataccatctggagattgtt

SEQ ID NO: 376443 - DNA, 20 bp, human
gtggattcagtgtaatgtga

SEQ ID NO: 376444 - DNA, 20 bp, human
gcctgcctaaggcaagaaac

SEQ ID NO: 376445 - DNA, 20 bp, human
gcatttcagtataaaaggtg

SEQ ID NO: 376446 - DNA, 20 bp, human
ggaagtcgagggcatcgcca

SEQ ID NO: 376447 - DNA, 20 bp, human
gggccccaaagccaggtcga

SEQ ID NO: 376448 - DNA, 20 bp, human
gggccggcggagcgctctgg

SEQ ID NO: 376449 - DNA, 20 bp, human
gagcgcgcccctgggggaag

SEQ ID NO: 376450 - DNA, 20 bp, human
gggagctcgggacctcgagg

SEQ ID NO: 376451 - DNA, 20 bp, human
gcgaggcggctggaagtcga

SEQ ID NO: 376452 - DNA, 20 bp, human
ggggtggggcggccgtgctt

SEQ ID NO: 376453 - DNA, 20 bp, human
gttaggccggcggagcgctc

SEQ ID NO: 376454 - DNA, 20 bp, human
gtccacacccgggcccaact

SEQ ID NO: 376455 - DNA, 20 bp, human
gaaggcgagtctccccgccc

SEQ ID NO: 376456 - DNA, 20 bp, human
gtggctgggcgcctttaact

SEQ ID NO: 376457 - DNA, 20 bp, human
ggtcggggttagcagcaacg

SEQ ID NO: 376458 - DNA, 20 bp, human
gaggggccaatgcgccgccc

SEQ ID NO: 376459 - DNA, 20 bp, human
gggaggtcacgccgagttaa

SEQ ID NO: 376460 - DNA, 20 bp, human
gagcgctgaaaaaggaaatc

SEQ ID NO: 376461 - DNA, 20 bp, human
ggggtcccaggcccgcgtcc

SEQ ID NO: 376462 - DNA, 20 bp, human
gctaaccagctagaatccac

SEQ ID NO: 376463 - DNA, 20 bp, human
gaatgcgcgcggcgcgcgag

SEQ ID NO: 376464 - DNA, 20 bp, human
gggttagcagcaacgtggct

SEQ ID NO: 376465 - DNA, 20 bp, human
gtcaaatgcagcgctgaaaa

SEQ ID NO: 376466 - DNA, 20 bp, human
gaatctggaagctataagcc

SEQ ID NO: 376467 - DNA, 20 bp, human
gccccacacccccacggcga

SEQ ID NO: 376468 - DNA, 20 bp, human
gctggaagctataagccggg

SEQ ID NO: 376469 - DNA, 20 bp, human
gtgtagacgccgacgaggag

SEQ ID NO: 376470 - DNA, 20 bp, human
ggggggaaaggcacgttagg

SEQ ID NO: 376471 - DNA, 20 bp, human
gttatagcttccagattcct

SEQ ID NO: 376472 - DNA, 20 bp, human
gacttgcagcgtgaaggcaa

SEQ ID NO: 376473 - DNA, 20 bp, human
gctcccgcacgcccgatccc

SEQ ID NO: 376474 - DNA, 20 bp, human
gggcacgttaggaggctccc

SEQ ID NO: 376475 - DNA, 20 bp, human
gtgtgggacgtgtgtaaaat

SEQ ID NO: 376476 - DNA, 20 bp, human
gagaagccggccgaatttta

SEQ ID NO: 376477 - DNA, 20 bp, human
gggggtggggaactaataag

SEQ ID NO: 376478 - DNA, 20 bp, human
gaattcggccggcttctctg

SEQ ID NO: 376479 - DNA, 20 bp, human
gttacctcgcggacggcgga

SEQ ID NO: 376480 - DNA, 20 bp, human
ggctggagttacctcgcgga

SEQ ID NO: 376481 - DNA, 20 bp, human
gaggtggactcgcgaatgtt

SEQ ID NO: 376482 - DNA, 20 bp, human
ggcttaggttaattacatca

SEQ ID NO: 376483 - DNA, 20 bp, human
gtaacctaagccctaaaatt

SEQ ID NO: 376484 - DNA, 20 bp, human
gattggctggagttacctcg

SEQ ID NO: 376485 - DNA, 20 bp, human
gttgaaacgcctctaatgat

SEQ ID NO: 376486 - DNA, 20 bp, human
gtcctccccaggcttccggg

SEQ ID NO: 376487 - DNA, 20 bp, human
gtggggctgcagtagaagcg

SEQ ID NO: 376488 - DNA, 20 bp, human
gctctccgcccggaagcctg

SEQ ID NO: 376489 - DNA, 20 bp, human
gggtaaaaagagccgggaaa

SEQ ID NO: 376490 - DNA, 20 bp, human
gccttcctgggccgagccct

SEQ ID NO: 376491 - DNA, 20 bp, human
gacccggcgcgccttgaaga

SEQ ID NO: 376492 - DNA, 20 bp, human
gcagtctctagggagcgaag

SEQ ID NO: 376493 - DNA, 20 bp, human
ggagagaagtgggcggagtc

SEQ ID NO: 376494 - DNA, 20 bp, human
ggcttccgggcggagagaag

SEQ ID NO: 376495 - DNA, 20 bp, human
gttagaaaacgcgttaggaa

SEQ ID NO: 376496 - DNA, 20 bp, human
gggctgcgggacgtgaggga

SEQ ID NO: 376497 - DNA, 20 bp, human
gtggctaggggcatgagggt

SEQ ID NO: 376498 - DNA, 20 bp, human
ggggcgcgttccaagttcat

SEQ ID NO: 376499 - DNA, 20 bp, human
gcattggctgagggtcgtga

SEQ ID NO: 376500 - DNA, 20 bp, human
ggtcccgcagccaatgaact

SEQ ID NO: 376501 - DNA, 20 bp, human
gcagcgcgctccaggttcat

SEQ ID NO: 376502 - DNA, 20 bp, human
gcgggccgcaagctgagagg

SEQ ID NO: 376503 - DNA, 20 bp, human
gaacttggaacgcgccctcc

SEQ ID NO: 376504 - DNA, 20 bp, human
gcattggctgcgggacgtga

SEQ ID NO: 376505 - DNA, 20 bp, human
gagcccggagcatgccctcc

SEQ ID NO: 376506 - DNA, 20 bp, human
gtgtgtgaagtcaggtgcgg

SEQ ID NO: 376507 - DNA, 20 bp, human
gtctaggtgggcttgggaaa

SEQ ID NO: 376508 - DNA, 20 bp, human
gggcggcctgagccctgcaa

SEQ ID NO: 376509 - DNA, 20 bp, human
gcaggtatgtgtgtgaagtc

SEQ ID NO: 376510 - DNA, 20 bp, human
gtcctggccacacccttgca

SEQ ID NO: 376511 - DNA, 20 bp, human
gtctgtgggtctgtctaggt

SEQ ID NO: 376512 - DNA, 20 bp, human
ggcagtgcggagctggccgt

SEQ ID NO: 376513 - DNA, 20 bp, human
gcgagtgagacggaccgctg

SEQ ID NO: 376514 - DNA, 20 bp, human
gcaggccgccaatggtgctg

SEQ ID NO: 376515 - DNA, 20 bp, human
gggagccccggggccccaag

SEQ ID NO: 376516 - DNA, 20 bp, human
gtgaatgcagggatcttgga

SEQ ID NO: 376517 - DNA, 20 bp, human
ggggtggagtatttcaagac

SEQ ID NO: 376518 - DNA, 20 bp, human
gaggccaaggggcgcaaaaa

SEQ ID NO: 376519 - DNA, 20 bp, human
gcatatccagagctagtgag

SEQ ID NO: 376520 - DNA, 20 bp, human
gcccggcaggatctctgctg

SEQ ID NO: 376521 - DNA, 20 bp, human
gagggcagaatctatgttgc

SEQ ID NO: 376522 - DNA, 20 bp, human
gtgagctggatctgcaagga

SEQ ID NO: 376523 - DNA, 20 bp, human
gaaggatctatgttattgta

SEQ ID NO: 376524 - DNA, 20 bp, human
ggacaggatctatgttcctg

SEQ ID NO: 376525 - DNA, 20 bp, human
gcagatccagctcaacaccc

SEQ ID NO: 376526 - DNA, 20 bp, human
gcagccgcggccactcggaa

SEQ ID NO: 376527 - DNA, 20 bp, human
ggcgcggcgggaaagacaac

SEQ ID NO: 376528 - DNA, 20 bp, human
gaagtcccgccctttccgag

SEQ ID NO: 376529 - DNA, 20 bp, human
gctagggcctgccgcagccg

SEQ ID NO: 376530 - DNA, 20 bp, human
ggcgcagtggggcgaccggg

SEQ ID NO: 376531 - DNA, 20 bp, human
ggggaactgagaaccgctct

SEQ ID NO: 376532 - DNA, 20 bp, human
ggcggccactcggaaagggc

SEQ ID NO: 376533 - DNA, 20 bp, human
gcggcgcggcagtaaaactg

SEQ ID NO: 376534 - DNA, 20 bp, human
gcaggtggcttcaacaatga

SEQ ID NO: 376535 - DNA, 20 bp, human
gcatgcgcagtggggcgacc

SEQ ID NO: 376536 - DNA, 20 bp, human
gccccagcgcaagacctgct

SEQ ID NO: 376537 - DNA, 20 bp, human
gtgtccctgccacgcccggg

SEQ ID NO: 376538 - DNA, 20 bp, human
ggggccttcgagcttgaggc

SEQ ID NO: 376539 - DNA, 20 bp, human
gtggcagcccccacacaatt

SEQ ID NO: 376540 - DNA, 20 bp, human
gcaaccgcccgggcgtggca

SEQ ID NO: 376541 - DNA, 20 bp, human
gaggtcttgcgctggggccg

SEQ ID NO: 376542 - DNA, 20 bp, human
gccactgccagcaaccgccc

SEQ ID NO: 376543 - DNA, 20 bp, human
gtgggagagtggctctcctt

SEQ ID NO: 376544 - DNA, 20 bp, human
gcgccccgcctcaagctcga

SEQ ID NO: 376545 - DNA, 20 bp, human
gtgcggcgacaccgggtcaa

SEQ ID NO: 376546 - DNA, 20 bp, human
gacgctctaggcaccgggat

SEQ ID NO: 376547 - DNA, 20 bp, human
ggctggcccacgccgactaa

SEQ ID NO: 376548 - DNA, 20 bp, human
gcgactaagggagacgctct

SEQ ID NO: 376549 - DNA, 20 bp, human
gtcagtgctcgtgaggtaac

SEQ ID NO: 376550 - DNA, 20 bp, human
gccgctagagctcggggaca

SEQ ID NO: 376551 - DNA, 20 bp, human
ggagaagtatagaagggcgc

SEQ ID NO: 376552 - DNA, 20 bp, human
gaagagcgagaagtatagaa

SEQ ID NO: 376553 - DNA, 20 bp, human
gagggagacgctctaggcac

SEQ ID NO: 376554 - DNA, 20 bp, human
gcgtctcccttagtcggcgt

SEQ ID NO: 376555 - DNA, 20 bp, human
gcgctagttcagtgctcgtg

SEQ ID NO: 376556 - DNA, 20 bp, human
ggggcgcgcggcgaacgagg

SEQ ID NO: 376557 - DNA, 20 bp, human
ggcggcaggacgcgcgtgga

SEQ ID NO: 376558 - DNA, 20 bp, human
gggcaggtgcataaggccgc

SEQ ID NO: 376559 - DNA, 20 bp, human
gagggggcgcgcggcgaacg

SEQ ID NO: 376560 - DNA, 20 bp, human
gggcgctggccggcgctctc

SEQ ID NO: 376561 - DNA, 20 bp, human
ggctagcggcgtaactgcgg

SEQ ID NO: 376562 - DNA, 20 bp, human
ggctccggtctccgcttcgg

SEQ ID NO: 376563 - DNA, 20 bp, human
ggctgccctggtggcgctcg

SEQ ID NO: 376564 - DNA, 20 bp, human
gcgcaggcggcggcacagca

SEQ ID NO: 376565 - DNA, 20 bp, human
gttccgttccccagcagccg

SEQ ID NO: 376566 - DNA, 20 bp, human
gttggtgtatgtgatctctg

SEQ ID NO: 376567 - DNA, 20 bp, human
gcaccaaactttttcactta

SEQ ID NO: 376568 - DNA, 20 bp, human
gatccataagtgaaaaagtt

SEQ ID NO: 376569 - DNA, 20 bp, human
gtgagagggactaatgatag

SEQ ID NO: 376570 - DNA, 20 bp, human
gactaatgataggggatccc

SEQ ID NO: 376571 - DNA, 20 bp, human
gagaccaggggtgtaatctg

SEQ ID NO: 376572 - DNA, 20 bp, human
gcagtgatgcagaaaggaac

SEQ ID NO: 376573 - DNA, 20 bp, human
gaaggagctaagaagcaagt

SEQ ID NO: 376574 - DNA, 20 bp, human
gtaactcaagcaatctcctt

SEQ ID NO: 376575 - DNA, 20 bp, human
gtacccttctccagagctaa

SEQ ID NO: 376576 - DNA, 20 bp, human
gaggtattggtcagccaaga

SEQ ID NO: 376577 - DNA, 20 bp, human
gccagtgttagaagccatct

SEQ ID NO: 376578 - DNA, 20 bp, human
gctggccgccacacttaata

SEQ ID NO: 376579 - DNA, 20 bp, human
gaactgactgaagaagctaa

SEQ ID NO: 376580 - DNA, 20 bp, human
gctggccgccatattaagtg

SEQ ID NO: 376581 - DNA, 20 bp, human
ggccgccatattaagtgtgg

SEQ ID NO: 376582 - DNA, 20 bp, human
gacagaatatcgcgaggtat

SEQ ID NO: 376583 - DNA, 20 bp, human
gcgcgagagttgcatcacgg

SEQ ID NO: 376584 - DNA, 20 bp, human
ggccgccacacttaatatgg

SEQ ID NO: 376585 - DNA, 20 bp, human
gtccgcctaagccttgaaca

SEQ ID NO: 376586 - DNA, 20 bp, human
gaggcgattggctgctcgac

SEQ ID NO: 376587 - DNA, 20 bp, human
gctggcggacggagactcct

SEQ ID NO: 376588 - DNA, 20 bp, human
gtaggcggagactagagctc

SEQ ID NO: 376589 - DNA, 20 bp, human
gacctcctcgagtcccgctc

SEQ ID NO: 376590 - DNA, 20 bp, human
gagctgagagacaccgagtg

SEQ ID NO: 376591 - DNA, 20 bp, human
gaaaggtcgctacagggacg

SEQ ID NO: 376592 - DNA, 20 bp, human
ggagactagagctccggaaa

SEQ ID NO: 376593 - DNA, 20 bp, human
ggagcagccaatcgcctcgc

SEQ ID NO: 376594 - DNA, 20 bp, human
gtcaaggcccagctttcgcg

SEQ ID NO: 376595 - DNA, 20 bp, human
ggccggagcgggactcgagg

SEQ ID NO: 376596 - DNA, 20 bp, human
gggccggccgagcccgtgac

SEQ ID NO: 376597 - DNA, 20 bp, human
gccgggaaatgggtcaactg

SEQ ID NO: 376598 - DNA, 20 bp, human
gtgccgggaaatgtagtcgc

SEQ ID NO: 376599 - DNA, 20 bp, human
ggcggcccgggcggcctgta

SEQ ID NO: 376600 - DNA, 20 bp, human
gccgtgacgggccgggaaat

SEQ ID NO: 376601 - DNA, 20 bp, human
gccccggctcgccgcgtagg

SEQ ID NO: 376602 - DNA, 20 bp, human
gcgaggccacgcccaagctg

SEQ ID NO: 376603 - DNA, 20 bp, human
ggccctgcgtgctctcgctt

SEQ ID NO: 376604 - DNA, 20 bp, human
ggggagagcgggtttcctct

SEQ ID NO: 376605 - DNA, 20 bp, human
ggccccgcgactacatttcc

SEQ ID NO: 376606 - DNA, 20 bp, human
gagcccgggtcgccgttaga

SEQ ID NO: 376607 - DNA, 20 bp, human
gcccgccctcagacccgatc

SEQ ID NO: 376608 - DNA, 20 bp, human
ggtccggcctcaccctacgc

SEQ ID NO: 376609 - DNA, 20 bp, human
gctgcggccagacaccggat

SEQ ID NO: 376610 - DNA, 20 bp, human
ggttctcagtgcgccggcgt

SEQ ID NO: 376611 - DNA, 20 bp, human
gggtgaggccggactctatt

SEQ ID NO: 376612 - DNA, 20 bp, human
gcgccggcgtagggtgaggc

SEQ ID NO: 376613 - DNA, 20 bp, human
gtgggaaggggataggcgga

SEQ ID NO: 376614 - DNA, 20 bp, human
gcgccctctaacggcgaccc

SEQ ID NO: 376615 - DNA, 20 bp, human
gcccaggtgtccggtagctg

SEQ ID NO: 376616 - DNA, 20 bp, human
ggcgcgagcctcgcccaccc

SEQ ID NO: 376617 - DNA, 20 bp, human
gggcgcgatctcccacccgc

SEQ ID NO: 376618 - DNA, 20 bp, human
gcacccgggtctacaccgaa

SEQ ID NO: 376619 - DNA, 20 bp, human
gcggcgggggacagtaggaa

SEQ ID NO: 376620 - DNA, 20 bp, human
ggcgcccggcgggggacagt

SEQ ID NO: 376621 - DNA, 20 bp, human
gctacccttcggtgtagacc

SEQ ID NO: 376622 - DNA, 20 bp, human
ggcgcgggcacgctaccctt

SEQ ID NO: 376623 - DNA, 20 bp, human
ggcgcgcgcggtggttgcgg

SEQ ID NO: 376624 - DNA, 20 bp, human
ggggagatcgcgccccgagg

SEQ ID NO: 376625 - DNA, 20 bp, human
ggggtagcgtgcccgcgcgg

SEQ ID NO: 376626 - DNA, 20 bp, human
gtgcttgggcagataatgtg

SEQ ID NO: 376627 - DNA, 20 bp, human
gtgaagacaggtataagaga

SEQ ID NO: 376628 - DNA, 20 bp, human
ggacacaaatcataccgaag

SEQ ID NO: 376629 - DNA, 20 bp, human
gaaaccggattcttcagaag

SEQ ID NO: 376630 - DNA, 20 bp, human
gaggaacaggccagtgacat

SEQ ID NO: 376631 - DNA, 20 bp, human
gacacaatctgatacccaag

SEQ ID NO: 376632 - DNA, 20 bp, human
gctgctagcataaaccgctt

SEQ ID NO: 376633 - DNA, 20 bp, human
gggccaacagcactgtgctt

SEQ ID NO: 376634 - DNA, 20 bp, human
gagactgaacgggagtttaa

SEQ ID NO: 376635 - DNA, 20 bp, human
gctgaagaatccggtttacc

SEQ ID NO: 376636 - DNA, 20 bp, human
gtgtcggtttgcggacccac

SEQ ID NO: 376637 - DNA, 20 bp, human
gacccacggggagtcgcagt

SEQ ID NO: 376638 - DNA, 20 bp, human
ggccctcaaccaaactgctt

SEQ ID NO: 376639 - DNA, 20 bp, human
gccggcctatgacagctcgg

SEQ ID NO: 376640 - DNA, 20 bp, human
ggggccgaggagtgacgtgt

SEQ ID NO: 376641 - DNA, 20 bp, human
gtcccggaccgctcccccgt

SEQ ID NO: 376642 - DNA, 20 bp, human
gaaatccggaggcgtaaacc

SEQ ID NO: 376643 - DNA, 20 bp, human
gctctccagaagcgtcctat

SEQ ID NO: 376644 - DNA, 20 bp, human
gctggagagcgatagggtct

SEQ ID NO: 376645 - DNA, 20 bp, human
gggcctggagccagccaacg

SEQ ID NO: 376646 - DNA, 20 bp, human
ggctgcactggggatacgga

SEQ ID NO: 376647 - DNA, 20 bp, human
gtggggcgccggggccatct

SEQ ID NO: 376648 - DNA, 20 bp, human
gggcctcgcggcgctgaggg

SEQ ID NO: 376649 - DNA, 20 bp, human
gccgcgaggccggcggactg

SEQ ID NO: 376650 - DNA, 20 bp, human
ggagccccctggagtccggg

SEQ ID NO: 376651 - DNA, 20 bp, human
ggccgctctctcaacccaga

SEQ ID NO: 376652 - DNA, 20 bp, human
gctgggggtggaggaagcgg

SEQ ID NO: 376653 - DNA, 20 bp, human
gactccgcctccggcccgac

SEQ ID NO: 376654 - DNA, 20 bp, human
ggctccgcccggactccagg

SEQ ID NO: 376655 - DNA, 20 bp, human
gcgccgccgcagctgcactg

SEQ ID NO: 376656 - DNA, 20 bp, human
gactgggcccgcgacgtcgg

SEQ ID NO: 376657 - DNA, 20 bp, human
gaaccccaggtggtcgggac

SEQ ID NO: 376658 - DNA, 20 bp, human
gtgcgcccaaccagcctgga

SEQ ID NO: 376659 - DNA, 20 bp, human
ggacactgggcccgcgacgt

SEQ ID NO: 376660 - DNA, 20 bp, human
gtcccagcccccgacgtcgc

SEQ ID NO: 376661 - DNA, 20 bp, human
gcagcctggacggggacact

SEQ ID NO: 376662 - DNA, 20 bp, human
gtccccgcgctcttaagggt

SEQ ID NO: 376663 - DNA, 20 bp, human
gtctctgcgcgttgggacag

SEQ ID NO: 376664 - DNA, 20 bp, human
gcgcgtgcgcccaaccagcc

SEQ ID NO: 376665 - DNA, 20 bp, human
gcagcggggacgcacgcgtg

SEQ ID NO: 376666 - DNA, 20 bp, human
gcggtgtcggagttctgtct

SEQ ID NO: 376667 - DNA, 20 bp, human
ggcacgagagggctaagggg

SEQ ID NO: 376668 - DNA, 20 bp, human
gcctacggtgcggcacgaga

SEQ ID NO: 376669 - DNA, 20 bp, human
gtccgaactcggacccgaat

SEQ ID NO: 376670 - DNA, 20 bp, human
ggtgcggcacgagagggcta

SEQ ID NO: 376671 - DNA, 20 bp, human
ggacaccgccccctacggtg

SEQ ID NO: 376672 - DNA, 20 bp, human
gaaccaagatggctgaggag

SEQ ID NO: 376673 - DNA, 20 bp, human
gggggcgggggcatgtgcac

SEQ ID NO: 376674 - DNA, 20 bp, human
ggggtccgagttcggaattt

SEQ ID NO: 376675 - DNA, 20 bp, human
gtccgcacgtcgggcctccg

SEQ ID NO: 376676 - DNA, 20 bp, human
gcgcccctgggcttgcggga

SEQ ID NO: 376677 - DNA, 20 bp, human
ggtcccgagcgcatggactc

SEQ ID NO: 376678 - DNA, 20 bp, human
gaagcccaggggcgttcccg

SEQ ID NO: 376679 - DNA, 20 bp, human
gcagccggctcacagagcgc

SEQ ID NO: 376680 - DNA, 20 bp, human
gtggagcgcgtccccggctc

SEQ ID NO: 376681 - DNA, 20 bp, human
gccccagcgctgtcatcccg

SEQ ID NO: 376682 - DNA, 20 bp, human
gagcccgcgggaacgcccct

SEQ ID NO: 376683 - DNA, 20 bp, human
ggggaccagaggacgagcgg

SEQ ID NO: 376684 - DNA, 20 bp, human
gcgagcggaggaagtgtctt

SEQ ID NO: 376685 - DNA, 20 bp, human
gggaagccgtctctgagcgt

SEQ ID NO: 376686 - DNA, 20 bp, human
gagatgacgtcacctagttg

SEQ ID NO: 376687 - DNA, 20 bp, human
ggggactgtagcttagagac

SEQ ID NO: 376688 - DNA, 20 bp, human
gcccgaggcttggggatgca

SEQ ID NO: 376689 - DNA, 20 bp, human
gtgcgcgccgcgtgagggcg

SEQ ID NO: 376690 - DNA, 20 bp, human
gaagggcggggaaggagcta

SEQ ID NO: 376691 - DNA, 20 bp, human
gtgcgcactttggaccgggg

SEQ ID NO: 376692 - DNA, 20 bp, human
gaaagtgcgcaggcgccgct

SEQ ID NO: 376693 - DNA, 20 bp, human
gaaactgggaagagcaaggg

SEQ ID NO: 376694 - DNA, 20 bp, human
gacaggactccccgaggctt

SEQ ID NO: 376695 - DNA, 20 bp, human
ggcgcctgcgcactttggac

SEQ ID NO: 376696 - DNA, 20 bp, human
gctctcccggggtgctcctc

SEQ ID NO: 376697 - DNA, 20 bp, human
gcactcctgccccggggcac

SEQ ID NO: 376698 - DNA, 20 bp, human
gagtgctccgccctctcccg

SEQ ID NO: 376699 - DNA, 20 bp, human
gctagtgcctggacccagtt

SEQ ID NO: 376700 - DNA, 20 bp, human
gacagcacggaaacggtccg

SEQ ID NO: 376701 - DNA, 20 bp, human
ggcccggaacgttgcgagca

SEQ ID NO: 376702 - DNA, 20 bp, human
ggcactcgcgagggacggac

SEQ ID NO: 376703 - DNA, 20 bp, human
ggggcgcccgaggagcaccc

SEQ ID NO: 376704 - DNA, 20 bp, human
gaacgagcaggcctgagcct

SEQ ID NO: 376705 - DNA, 20 bp, human
ggggtccaggcactaggagc

SEQ ID NO: 376706 - DNA, 20 bp, human
gacggggcggggcatcacga

SEQ ID NO: 376707 - DNA, 20 bp, human
gggcggggcatcacgagggg

SEQ ID NO: 376708 - DNA, 20 bp, human
gagaacagaggaaaacggac

SEQ ID NO: 376709 - DNA, 20 bp, human
gtcctccaaaaactggtgga

SEQ ID NO: 376710 - DNA, 20 bp, human
gctgccctgtccacttcaca

SEQ ID NO: 376711 - DNA, 20 bp, human
ggggcttttggggacgggat

SEQ ID NO: 376712 - DNA, 20 bp, human
gggttgtgactcgagccaag

SEQ ID NO: 376713 - DNA, 20 bp, human
ggaaaactgcgaaatgcagt

SEQ ID NO: 376714 - DNA, 20 bp, human
gagacgcacaaacgctcttt

SEQ ID NO: 376715 - DNA, 20 bp, human
gttcacagggcttttgggga

SEQ ID NO: 376716 - DNA, 20 bp, human
gtaccgcggcgggaggaaaa

SEQ ID NO: 376717 - DNA, 20 bp, human
ggcgacgcgctctcgggcat

SEQ ID NO: 376718 - DNA, 20 bp, human
gggcctgcgccctgctaccg

SEQ ID NO: 376719 - DNA, 20 bp, human
gtctcccagcaaagcttgga

SEQ ID NO: 376720 - DNA, 20 bp, human
gctgcgccctgctaccgcgg

SEQ ID NO: 376721 - DNA, 20 bp, human
gtcctcccgccgcggtagca

SEQ ID NO: 376722 - DNA, 20 bp, human
gaaaccgcccggtctcagtg

SEQ ID NO: 376723 - DNA, 20 bp, human
gagggagccgccagaaggga

SEQ ID NO: 376724 - DNA, 20 bp, human
gaacctcgcgacgcgctctc

SEQ ID NO: 376725 - DNA, 20 bp, human
gagaccgggcggtttggttg

SEQ ID NO: 376726 - DNA, 20 bp, human
gtacgtagagtatttggcac

SEQ ID NO: 376727 - DNA, 20 bp, human
gtaaagaataggcgtctaac

SEQ ID NO: 376728 - DNA, 20 bp, human
gattggagctagtcggtaac

SEQ ID NO: 376729 - DNA, 20 bp, human
gactgcctacgtagagtatt

SEQ ID NO: 376730 - DNA, 20 bp, human
gctacgtaggcagtttaacg

SEQ ID NO: 376731 - DNA, 20 bp, human
gcattttcattggagctagt

SEQ ID NO: 376732 - DNA, 20 bp, human
gtgggtttgtatttaaacaa

SEQ ID NO: 376733 - DNA, 20 bp, human
gtatattacatatacaatgt

SEQ ID NO: 376734 - DNA, 20 bp, human
gcgcctattctttagattaa

SEQ ID NO: 376735 - DNA, 20 bp, human
gaaaaaattaaaagtaacgt

SEQ ID NO: 376736 - DNA, 20 bp, human
gcccgcacgagcagccccgt

SEQ ID NO: 376737 - DNA, 20 bp, human
ggggctgctcgtgcggggtg

SEQ ID NO: 376738 - DNA, 20 bp, human
gccccacggggctgctcgtg

SEQ ID NO: 376739 - DNA, 20 bp, human
gccagggcttcgatccccac

SEQ ID NO: 376740 - DNA, 20 bp, human
gccgggagcgatcacgcgtg

SEQ ID NO: 376741 - DNA, 20 bp, human
gcgtgatcgctcccggggat

SEQ ID NO: 376742 - DNA, 20 bp, human
gaaaaaacgagacagggctg

SEQ ID NO: 376743 - DNA, 20 bp, human
gtcacgcgtgcggaacgtcc

SEQ ID NO: 376744 - DNA, 20 bp, human
gcgcgcatgcggggctcaca

SEQ ID NO: 376745 - DNA, 20 bp, human
ggagctgctaagtcgggaag

SEQ ID NO: 376746 - DNA, 20 bp, human
ggggtggcccggcggaaaga

SEQ ID NO: 376747 - DNA, 20 bp, human
gggagcgcgcaaggagcagg

SEQ ID NO: 376748 - DNA, 20 bp, human
ggctgcgcgccgaccacctc

SEQ ID NO: 376749 - DNA, 20 bp, human
ggcctgggggttgtagtcac

SEQ ID NO: 376750 - DNA, 20 bp, human
gccaccctagcatctccgct

SEQ ID NO: 376751 - DNA, 20 bp, human
ggagccaagcggagatgcta

SEQ ID NO: 376752 - DNA, 20 bp, human
ggagatgctagggtggcccg

SEQ ID NO: 376753 - DNA, 20 bp, human
ggggtgacggaatgaattca

SEQ ID NO: 376754 - DNA, 20 bp, human
gagcccatgtgtgttcttgc

SEQ ID NO: 376755 - DNA, 20 bp, human
gtgggccaagaggtcctggg

SEQ ID NO: 376756 - DNA, 20 bp, human
gggaaagcgctgccgccgtg

SEQ ID NO: 376757 - DNA, 20 bp, human
gcagcctcgggtgtgaatga

SEQ ID NO: 376758 - DNA, 20 bp, human
ggtagcggaactgccagcct

SEQ ID NO: 376759 - DNA, 20 bp, human
gcccgcacccacccacacgg

SEQ ID NO: 376760 - DNA, 20 bp, human
gacggagcataacacggcag

SEQ ID NO: 376761 - DNA, 20 bp, human
gcagcgggagcccggagggg

SEQ ID NO: 376762 - DNA, 20 bp, human
gaatgtgctgggtgcagctt

SEQ ID NO: 376763 - DNA, 20 bp, human
gtgccagcctggggctcggc

SEQ ID NO: 376764 - DNA, 20 bp, human
gcggcggcagcgctttccag

SEQ ID NO: 376765 - DNA, 20 bp, human
gctttccagcgggagcccgg

SEQ ID NO: 376766 - DNA, 20 bp, human
gtccccgcctagcaaggagt

SEQ ID NO: 376767 - DNA, 20 bp, human
gcagacacgcgtggagtccg

SEQ ID NO: 376768 - DNA, 20 bp, human
ggccctgcggcaggatccgc

SEQ ID NO: 376769 - DNA, 20 bp, human
ggactccacgcgtgtctgga

SEQ ID NO: 376770 - DNA, 20 bp, human
gggctgctggcagtgaaagt

SEQ ID NO: 376771 - DNA, 20 bp, human
ggcgcctcgcgctccaaatc

SEQ ID NO: 376772 - DNA, 20 bp, human
gaagagcaagagcgactgtc

SEQ ID NO: 376773 - DNA, 20 bp, human
gtggagatacaggacggtca

SEQ ID NO: 376774 - DNA, 20 bp, human
ggcgcagcgctgatccgccc

SEQ ID NO: 376775 - DNA, 20 bp, human
ggcaggatccgccggtgcag

SEQ ID NO: 376776 - DNA, 20 bp, human
ggacgcggtgggggcaccat

SEQ ID NO: 376777 - DNA, 20 bp, human
ggagcggaagcggagatgcc

SEQ ID NO: 376778 - DNA, 20 bp, human
ggagaacttgctaccgtcac

SEQ ID NO: 376779 - DNA, 20 bp, human
ggttgcgccccgagcggaag

SEQ ID NO: 376780 - DNA, 20 bp, human
ggaaccgttgcatcttccaa

SEQ ID NO: 376781 - DNA, 20 bp, human
gaacggcgtcccagagacgg

SEQ ID NO: 376782 - DNA, 20 bp, human
gtccttgcccgaggctggga

SEQ ID NO: 376783 - DNA, 20 bp, human
gggaaatctggttgccaaaa

SEQ ID NO: 376784 - DNA, 20 bp, human
ggtagcaagttctcgcgtcc

SEQ ID NO: 376785 - DNA, 20 bp, human
gtggtcacgtgacgcggtgg

SEQ ID NO: 376786 - DNA, 20 bp, human
gcgcctgctgtagtactctg

SEQ ID NO: 376787 - DNA, 20 bp, human
gagcgatcccgccctcccat

SEQ ID NO: 376788 - DNA, 20 bp, human
gtactacagcaggcgctcag

SEQ ID NO: 376789 - DNA, 20 bp, human
ggggaccgccccctcgtcac

SEQ ID NO: 376790 - DNA, 20 bp, human
gcgccccagagtactacagc

SEQ ID NO: 376791 - DNA, 20 bp, human
gtgggggtggggttacgtgt

SEQ ID NO: 376792 - DNA, 20 bp, human
gcgggatcgctcttgcgttt

SEQ ID NO: 376793 - DNA, 20 bp, human
gaccgccccctcgtcactgg

SEQ ID NO: 376794 - DNA, 20 bp, human
gtatacctgcacgaccactc

SEQ ID NO: 376795 - DNA, 20 bp, human
ggtactctggggcggggtca

SEQ ID NO: 376796 - DNA, 20 bp, human
gcaccccgctcacgtgacca

SEQ ID NO: 376797 - DNA, 20 bp, human
gtgccctggtcacgtgagcg

SEQ ID NO: 376798 - DNA, 20 bp, human
gggtgcggaagtcgtgtttc

SEQ ID NO: 376799 - DNA, 20 bp, human
gctcctcccgaagcgtcgga

SEQ ID NO: 376800 - DNA, 20 bp, human
gcgtaagccccgcccactgg

SEQ ID NO: 376801 - DNA, 20 bp, human
gcaccctcaagcttgaggag

SEQ ID NO: 376802 - DNA, 20 bp, human
gttcaggcggcgttcgtgat

SEQ ID NO: 376803 - DNA, 20 bp, human
gaccccacccccgggaccct

SEQ ID NO: 376804 - DNA, 20 bp, human
gaagccccgcccactggggg

SEQ ID NO: 376805 - DNA, 20 bp, human
ggccctctcctcaagcttga

SEQ ID NO: 376806 - DNA, 20 bp, human
gggaaccggaggggcggtga

SEQ ID NO: 376807 - DNA, 20 bp, human
gccttagcttggaaccggag

SEQ ID NO: 376808 - DNA, 20 bp, human
gcatgcccgcagcacaactc

SEQ ID NO: 376809 - DNA, 20 bp, human
gccccgcgggccaatagaaa

SEQ ID NO: 376810 - DNA, 20 bp, human
gtgaagacccgcgtgcaaga

SEQ ID NO: 376811 - DNA, 20 bp, human
gcaggcaagagctaatgggg

SEQ ID NO: 376812 - DNA, 20 bp, human
ggacccgcgtgcaagaaggc

SEQ ID NO: 376813 - DNA, 20 bp, human
ggggttcaccccttttctat

SEQ ID NO: 376814 - DNA, 20 bp, human
gtagcttggaaccggagggg

SEQ ID NO: 376815 - DNA, 20 bp, human
gaagacaggcaagagctaat

SEQ ID NO: 376816 - DNA, 20 bp, human
gtcccctgcggacagtacac

SEQ ID NO: 376817 - DNA, 20 bp, human
gcgcgcacgggacgaactgc

SEQ ID NO: 376818 - DNA, 20 bp, human
ggctccagtgtactgtccgc

SEQ ID NO: 376819 - DNA, 20 bp, human
ggcagttcgcgtctcttggt

SEQ ID NO: 376820 - DNA, 20 bp, human
gagttcgtcccgtgcgcgac

SEQ ID NO: 376821 - DNA, 20 bp, human
gtttgcaaagtgagtagcta

SEQ ID NO: 376822 - DNA, 20 bp, human
ggcgtacaggactgatagga

SEQ ID NO: 376823 - DNA, 20 bp, human
gtcttagcagctgactacgg

SEQ ID NO: 376824 - DNA, 20 bp, human
gtgcggggagtgagccgcgc

SEQ ID NO: 376825 - DNA, 20 bp, human
gagtcacagactctacacaa

SEQ ID NO: 376826 - DNA, 20 bp, human
ggcgcccagccgcatctcgg

SEQ ID NO: 376827 - DNA, 20 bp, human
gaaccccgccccccgagatg

SEQ ID NO: 376828 - DNA, 20 bp, human
ggcctccgccaatcgcactg

SEQ ID NO: 376829 - DNA, 20 bp, human
gcgggccgcagtgcgattgg

SEQ ID NO: 376830 - DNA, 20 bp, human
gcgcggcgcgtgaggtgagg

SEQ ID NO: 376831 - DNA, 20 bp, human
ggcgcgcggcgcgtgaggtg

SEQ ID NO: 376832 - DNA, 20 bp, human
gcccggggcgcagggtaccc

SEQ ID NO: 376833 - DNA, 20 bp, human
gctggcgcccagccgcatct

SEQ ID NO: 376834 - DNA, 20 bp, human
gggcgagtgggtgacgccaa

SEQ ID NO: 376835 - DNA, 20 bp, human
gctccgggccgcagtgcgat

SEQ ID NO: 376836 - DNA, 20 bp, human
ggggcctgggcgagaaccga

SEQ ID NO: 376837 - DNA, 20 bp, human
gctgccgagcacgaagtcgc

SEQ ID NO: 376838 - DNA, 20 bp, human
gacctcccggggaagatgga

SEQ ID NO: 376839 - DNA, 20 bp, human
ggccagggactcaacttcct

SEQ ID NO: 376840 - DNA, 20 bp, human
gcgagaaccgacggcgggga

SEQ ID NO: 376841 - DNA, 20 bp, human
gccgccgtcggttctcgccc

SEQ ID NO: 376842 - DNA, 20 bp, human
gcctccagcgacttcgtgct

SEQ ID NO: 376843 - DNA, 20 bp, human
gcggcccggtggcatcgagt

SEQ ID NO: 376844 - DNA, 20 bp, human
ggccccgcgcgtcacccacg

SEQ ID NO: 376845 - DNA, 20 bp, human
gcgcggggcggggtccacgt

SEQ ID NO: 376846 - DNA, 20 bp, human
gcgacagcagcctcccgcta

SEQ ID NO: 376847 - DNA, 20 bp, human
gggaacctccgtgggaagtc

SEQ ID NO: 376848 - DNA, 20 bp, human
gctgacgcgcgtgacgtcac

SEQ ID NO: 376849 - DNA, 20 bp, human
gggaggctgcgcagtacagg

SEQ ID NO: 376850 - DNA, 20 bp, human
gtccgcccactcccggacgg

SEQ ID NO: 376851 - DNA, 20 bp, human
ggtactgcgcagcctccgtc

SEQ ID NO: 376852 - DNA, 20 bp, human
gacgtcacgcgcgtcagcaa

SEQ ID NO: 376853 - DNA, 20 bp, human
ggccacaggacgtcgaacct

SEQ ID NO: 376854 - DNA, 20 bp, human
ggcagcctccgtccgggagt

SEQ ID NO: 376855 - DNA, 20 bp, human
ggtacaggtggaacctccgt

SEQ ID NO: 376856 - DNA, 20 bp, human
ggctctggcgtcctggatgg

SEQ ID NO: 376857 - DNA, 20 bp, human
ggggtgggtgttagttcaga

SEQ ID NO: 376858 - DNA, 20 bp, human
gggacaggaggtgccgagag

SEQ ID NO: 376859 - DNA, 20 bp, human
ggctccgtctcgcgagatct

SEQ ID NO: 376860 - DNA, 20 bp, human
gaaggaacgcacctccatcc

SEQ ID NO: 376861 - DNA, 20 bp, human
gacagcggccacgtaagtga

SEQ ID NO: 376862 - DNA, 20 bp, human
ggggacaagccctcgctctg

SEQ ID NO: 376863 - DNA, 20 bp, human
gggcgcagacgcgagaggtg

SEQ ID NO: 376864 - DNA, 20 bp, human
gcaacccagatctcgcgaga

SEQ ID NO: 376865 - DNA, 20 bp, human
ggcgctgcagccttcgagcc

SEQ ID NO: 376866 - DNA, 20 bp, human
ggcggcccgcgctgtaaccg

SEQ ID NO: 376867 - DNA, 20 bp, human
gtactctggcaactcgactg

SEQ ID NO: 376868 - DNA, 20 bp, human
gttaagccccagcttcgctc

SEQ ID NO: 376869 - DNA, 20 bp, human
gcccagcccgagcgaagctg

SEQ ID NO: 376870 - DNA, 20 bp, human
gccagcggggaacggttcca

SEQ ID NO: 376871 - DNA, 20 bp, human
ggtaccgcagcccggctcct

SEQ ID NO: 376872 - DNA, 20 bp, human
ggaggcgccctgtcaggcga

SEQ ID NO: 376873 - DNA, 20 bp, human
gtctggcaactcgactgggg

SEQ ID NO: 376874 - DNA, 20 bp, human
gttagctgctgggatggaag

SEQ ID NO: 376875 - DNA, 20 bp, human
ggagaagcagctgcatactc

SEQ ID NO: 376876 - DNA, 20 bp, human
ggggtgcccggggacgtcaa

SEQ ID NO: 376877 - DNA, 20 bp, human
gcccggggacgtcaaagggc

SEQ ID NO: 376878 - DNA, 20 bp, human
gcaaagggcgggagtagctt

SEQ ID NO: 376879 - DNA, 20 bp, human
ggcagggcggggcaagctag

SEQ ID NO: 376880 - DNA, 20 bp, human
gcaagctaggggccggcccg

SEQ ID NO: 376881 - DNA, 20 bp, human
gcctgcctcccacggcggga

SEQ ID NO: 376882 - DNA, 20 bp, human
ggtaagttctgtggtctcca

SEQ ID NO: 376883 - DNA, 20 bp, human
gaccctatcgaatctaggat

SEQ ID NO: 376884 - DNA, 20 bp, human
gccagggcagaagaaatctg

SEQ ID NO: 376885 - DNA, 20 bp, human
gtcccccctcccactgtcat

SEQ ID NO: 376886 - DNA, 20 bp, human
ggggcaaagagcagcggcta

SEQ ID NO: 376887 - DNA, 20 bp, human
gggccctgagccaaagaccc

SEQ ID NO: 376888 - DNA, 20 bp, human
gacccgggagaaaccgatct

SEQ ID NO: 376889 - DNA, 20 bp, human
gagagccggtgcgactttca

SEQ ID NO: 376890 - DNA, 20 bp, human
gccggctcttgcacccagat

SEQ ID NO: 376891 - DNA, 20 bp, human
gaaggccaatgtaggggcgg

SEQ ID NO: 376892 - DNA, 20 bp, human
gggaaaggccaatgtagggg

SEQ ID NO: 376893 - DNA, 20 bp, human
gcgaagcaaacctgcccgcg

SEQ ID NO: 376894 - DNA, 20 bp, human
ggccgcgcgcgaaaagggag

SEQ ID NO: 376895 - DNA, 20 bp, human
gagcatgctcagtgccgccg

SEQ ID NO: 376896 - DNA, 20 bp, human
gcccgcgaagggaagtctgc

SEQ ID NO: 376897 - DNA, 20 bp, human
gccggcaaaggatggagttc

SEQ ID NO: 376898 - DNA, 20 bp, human
ggaggccgctgctacggggc

SEQ ID NO: 376899 - DNA, 20 bp, human
gaaaacggagtcacgataca

SEQ ID NO: 376900 - DNA, 20 bp, human
gcaaaggatggagttcgggc

SEQ ID NO: 376901 - DNA, 20 bp, human
gttcgggcgggctcccgcga

SEQ ID NO: 376902 - DNA, 20 bp, human
gacctctgctgcaactgtaa

SEQ ID NO: 376903 - DNA, 20 bp, human
gactccagtccaggtgaaaa

SEQ ID NO: 376904 - DNA, 20 bp, human
gacggccggccccgtagcag

SEQ ID NO: 376905 - DNA, 20 bp, human
gtacggggccggccgtgagg

SEQ ID NO: 376906 - DNA, 20 bp, human
ggcgggcagaaggcgagcgt

SEQ ID NO: 376907 - DNA, 20 bp, human
gctagagcgcagacgcttgg

SEQ ID NO: 376908 - DNA, 20 bp, human
gctagcgaaggggcggagca

SEQ ID NO: 376909 - DNA, 20 bp, human
ggtggcgcgctgacacctgg

SEQ ID NO: 376910 - DNA, 20 bp, human
gcgtctgcgctctagcgaag

SEQ ID NO: 376911 - DNA, 20 bp, human
gtgtggcctagcagcatccg

SEQ ID NO: 376912 - DNA, 20 bp, human
gggccacagctcacccggcg

SEQ ID NO: 376913 - DNA, 20 bp, human
ggaggcggggagacggttgt

SEQ ID NO: 376914 - DNA, 20 bp, human
gcgagtgaaggtcctgggaa

SEQ ID NO: 376915 - DNA, 20 bp, human
gcagaaggcgagcgtgggct

SEQ ID NO: 376916 - DNA, 20 bp, human
gctgcccagcgcctgctctc

SEQ ID NO: 376917 - DNA, 20 bp, human
ggccccagagagcaggcgct

SEQ ID NO: 376918 - DNA, 20 bp, human
gtgggcagtgtggaggtcgt

SEQ ID NO: 376919 - DNA, 20 bp, human
gggcacaggagctggtgacg

SEQ ID NO: 376920 - DNA, 20 bp, human
ggcgagcgcgaccggaagtc

SEQ ID NO: 376921 - DNA, 20 bp, human
gagaacccagccaaacaccg

SEQ ID NO: 376922 - DNA, 20 bp, human
ggagcgggaggggcaccgac

SEQ ID NO: 376923 - DNA, 20 bp, human
gcccaggtaggccagacgag

SEQ ID NO: 376924 - DNA, 20 bp, human
gagctcctgtgcctgccagt

SEQ ID NO: 376925 - DNA, 20 bp, human
ggaaagctgtgggaccatcc

SEQ ID NO: 376926 - DNA, 20 bp, human
gtgacgcgaaagtcagatgt

SEQ ID NO: 376927 - DNA, 20 bp, human
gaccctttccagggccttaa

SEQ ID NO: 376928 - DNA, 20 bp, human
gaccgcgtctcttcctaaat

SEQ ID NO: 376929 - DNA, 20 bp, human
gctggaaagggtctaagtgt

SEQ ID NO: 376930 - DNA, 20 bp, human
gaagagacgcggtcccttta

SEQ ID NO: 376931 - DNA, 20 bp, human
gactttcgcgtcacccattt

SEQ ID NO: 376932 - DNA, 20 bp, human
gcagaggcatgtattgaggt

SEQ ID NO: 376933 - DNA, 20 bp, human
ggcggtcacgtgatggggcg

SEQ ID NO: 376934 - DNA, 20 bp, human
gtattgaggtgggtgaagtg

SEQ ID NO: 376935 - DNA, 20 bp, human
gtctaagtgttggtttctgt

SEQ ID NO: 376936 - DNA, 20 bp, human
gtgagcactgaaccagcgac

SEQ ID NO: 376937 - DNA, 20 bp, human
gcttgccaaaaggtcccttc

SEQ ID NO: 376938 - DNA, 20 bp, human
gatccctaacagctcagaga

SEQ ID NO: 376939 - DNA, 20 bp, human
ggggccatgcaactgcttac

SEQ ID NO: 376940 - DNA, 20 bp, human
gttcttctcaagccagtcgc

SEQ ID NO: 376941 - DNA, 20 bp, human
ggtcctcttagtgcaccaga

SEQ ID NO: 376942 - DNA, 20 bp, human
gcaagatgccacttgccaaa

SEQ ID NO: 376943 - DNA, 20 bp, human
ggggctcaagtgatgtagtt

SEQ ID NO: 376944 - DNA, 20 bp, human
gggttcagtgctcacagttt

SEQ ID NO: 376945 - DNA, 20 bp, human
gggtcgaggctgccgtgagt

SEQ ID NO: 376946 - DNA, 20 bp, human
ggaccgcagggcagatattg

SEQ ID NO: 376947 - DNA, 20 bp, human
gccgcctcgcgccacccgtt

SEQ ID NO: 376948 - DNA, 20 bp, human
gcggctgcagtgttaacccg

SEQ ID NO: 376949 - DNA, 20 bp, human
gtcgcgccacccgttggggg

SEQ ID NO: 376950 - DNA, 20 bp, human
gagggcagatattggggctg

SEQ ID NO: 376951 - DNA, 20 bp, human
gaggccccgcccccaacggg

SEQ ID NO: 376952 - DNA, 20 bp, human
gcaggcgcacaggcgacagg

SEQ ID NO: 376953 - DNA, 20 bp, human
gagccgctagaccagctccc

SEQ ID NO: 376954 - DNA, 20 bp, human
gctgcggtgcccagttccaa

SEQ ID NO: 376955 - DNA, 20 bp, human
ggtaggtgagcgctgcagag

SEQ ID NO: 376956 - DNA, 20 bp, human
gaagagcggcagtgagaccg

SEQ ID NO: 376957 - DNA, 20 bp, human
gagtgagaccggggagacaa

SEQ ID NO: 376958 - DNA, 20 bp, human
gtgtgggcaatgtagtctga

SEQ ID NO: 376959 - DNA, 20 bp, human
gaagaggcatcctatcggag

SEQ ID NO: 376960 - DNA, 20 bp, human
gggccagcgcgtggcattgt

SEQ ID NO: 376961 - DNA, 20 bp, human
gaaaagctacgaaccagtcg

SEQ ID NO: 376962 - DNA, 20 bp, human
gggagaggcagataataact

SEQ ID NO: 376963 - DNA, 20 bp, human
gtgcccctgggaggtccccg

SEQ ID NO: 376964 - DNA, 20 bp, human
gagggacttgaagactagga

SEQ ID NO: 376965 - DNA, 20 bp, human
gcgctggccagtctcgcgtg

SEQ ID NO: 376966 - DNA, 20 bp, human
gcccccgggacgcaggggtc

SEQ ID NO: 376967 - DNA, 20 bp, human
gggcctgacccctgcgtccc

SEQ ID NO: 376968 - DNA, 20 bp, human
gaccccgagccctgcggtct

SEQ ID NO: 376969 - DNA, 20 bp, human
ggaccgctcaaagtgaaccg

SEQ ID NO: 376970 - DNA, 20 bp, human
ggggggcacaggcgttctta

SEQ ID NO: 376971 - DNA, 20 bp, human
gtcggggtctgtctttgctc

SEQ ID NO: 376972 - DNA, 20 bp, human
ggagcggtcccaaggcctga

SEQ ID NO: 376973 - DNA, 20 bp, human
gtgctcaggacgataacctg

SEQ ID NO: 376974 - DNA, 20 bp, human
ggctcaaagtgaaccggggc

SEQ ID NO: 376975 - DNA, 20 bp, human
gaaagtgaaccggggccggg

SEQ ID NO: 376976 - DNA, 20 bp, human
ggcaaataggatatgcaaat

SEQ ID NO: 376977 - DNA, 20 bp, human
gctgcatgaacatctctgac

SEQ ID NO: 376978 - DNA, 20 bp, human
ggactgaataaattattcct

SEQ ID NO: 376979 - DNA, 20 bp, human
gttctctgttgctttggtag

SEQ ID NO: 376980 - DNA, 20 bp, human
gaccaacatagcatatatcc

SEQ ID NO: 376981 - DNA, 20 bp, human
gtcaaagttattgaaaacag

SEQ ID NO: 376982 - DNA, 20 bp, human
gacctggatatatgctatgt

SEQ ID NO: 376983 - DNA, 20 bp, human
ggcttttgaattattaatct

SEQ ID NO: 376984 - DNA, 20 bp, human
gaattattaatcttggctgc

SEQ ID NO: 376985 - DNA, 20 bp, human
gtggtaaatactgcttatat

SEQ ID NO: 376986 - DNA, 20 bp, human
gacgcgtcacccaagtcccg

SEQ ID NO: 376987 - DNA, 20 bp, human
gccgttggtcgctggcctca

SEQ ID NO: 376988 - DNA, 20 bp, human
gtctccgcctgcgacgtcga

SEQ ID NO: 376989 - DNA, 20 bp, human
gacgcccccttcgacgtcgc

SEQ ID NO: 376990 - DNA, 20 bp, human
gggcctgcgcagaggctggt

SEQ ID NO: 376991 - DNA, 20 bp, human
ggaagggcggtccactgtaa

SEQ ID NO: 376992 - DNA, 20 bp, human
gccgcctgcgacgtcgaagg

SEQ ID NO: 376993 - DNA, 20 bp, human
gtgcgggcgccgcgggactt

SEQ ID NO: 376994 - DNA, 20 bp, human
ggggaaatgctgaggatcac

SEQ ID NO: 376995 - DNA, 20 bp, human
gtgaacgcaagccagcaagt

SEQ ID NO: 376996 - DNA, 20 bp, human
gctacgggcaggcccagcag

SEQ ID NO: 376997 - DNA, 20 bp, human
gtgcctgactctagcgaacc

SEQ ID NO: 376998 - DNA, 20 bp, human
gagccaggttcgctagagtc

SEQ ID NO: 376999 - DNA, 20 bp, human
gtcaacgtatagtgggggag

SEQ ID NO: 377000 - DNA, 20 bp, human
gggcaggcccagcagcggtc

SEQ ID NO: 377001 - DNA, 20 bp, human
gaatcctcaacgtatagtgg

SEQ ID NO: 377002 - DNA, 20 bp, human
gcgcccgcgctcggcaacgg

SEQ ID NO: 377003 - DNA, 20 bp, human
ggccgcctggcggctgtctc

SEQ ID NO: 377004 - DNA, 20 bp, human
gtccactcccccaaggatgg

SEQ ID NO: 377005 - DNA, 20 bp, human
gtaggggcggagggtttgaa

SEQ ID NO: 377006 - DNA, 20 bp, human
gcaccctctggcagactcgg

SEQ ID NO: 377007 - DNA, 20 bp, human
ggggcggcggggcgctaagg

SEQ ID NO: 377008 - DNA, 20 bp, human
ggggttcctcctaacactag

SEQ ID NO: 377009 - DNA, 20 bp, human
gggacactcccaacacaggg

SEQ ID NO: 377010 - DNA, 20 bp, human
gtctgccagagggtgcctcg

SEQ ID NO: 377011 - DNA, 20 bp, human
ggaaggtgtgacttgacaat

SEQ ID NO: 377012 - DNA, 20 bp, human
ggtctccccctagtgttagg

SEQ ID NO: 377013 - DNA, 20 bp, human
gtcggggcggcggggcgcta

SEQ ID NO: 377014 - DNA, 20 bp, human
ggggaccttagcacctcaga

SEQ ID NO: 377015 - DNA, 20 bp, human
gcgcctcccctccctgtgtt

SEQ ID NO: 377016 - DNA, 20 bp, human
ggctccgggaaggtgtaaaa

SEQ ID NO: 377017 - DNA, 20 bp, human
gggacttaggcatcgctgat

SEQ ID NO: 377018 - DNA, 20 bp, human
gaatagggcgagtctgaccg

SEQ ID NO: 377019 - DNA, 20 bp, human
gagggcgagtctgaccgagg

SEQ ID NO: 377020 - DNA, 20 bp, human
gcggggccgggctctcctcg

SEQ ID NO: 377021 - DNA, 20 bp, human
gaggcgatgcacactataac

SEQ ID NO: 377022 - DNA, 20 bp, human
ggaagcaggcgcgcgagacg

SEQ ID NO: 377023 - DNA, 20 bp, human
gtggcggcggcttgttgttg

SEQ ID NO: 377024 - DNA, 20 bp, human
gaggctgaggcttccgtttc

SEQ ID NO: 377025 - DNA, 20 bp, human
gacaagccgccgccacaggg

SEQ ID NO: 377026 - DNA, 20 bp, human
gaagaccgggtgagacgctg

SEQ ID NO: 377027 - DNA, 20 bp, human
gcggccacgtggggaaaggt

SEQ ID NO: 377028 - DNA, 20 bp, human
gcctgcgcaccaggactcgg

SEQ ID NO: 377029 - DNA, 20 bp, human
gaaccaaggtaaagccaacg

SEQ ID NO: 377030 - DNA, 20 bp, human
gccggccgccgtacgcgcgc

SEQ ID NO: 377031 - DNA, 20 bp, human
gaccgtgagcgtcccggaag

SEQ ID NO: 377032 - DNA, 20 bp, human
gcgcgctgtccgcttcttct

SEQ ID NO: 377033 - DNA, 20 bp, human
ggtgagcgtcccggaagggg

SEQ ID NO: 377034 - DNA, 20 bp, human
gagcgtccgcccagaagaag

SEQ ID NO: 377035 - DNA, 20 bp, human
gcccacgtggccgcgaagac

SEQ ID NO: 377036 - DNA, 20 bp, human
gccccaggcctccgtaacca

SEQ ID NO: 377037 - DNA, 20 bp, human
gcgtgggcgcggtggaaggg

SEQ ID NO: 377038 - DNA, 20 bp, human
gtggcgtgggcgcggtggaa

SEQ ID NO: 377039 - DNA, 20 bp, human
gtgggagtgcccgctggcgt

SEQ ID NO: 377040 - DNA, 20 bp, human
gtccgtaaccatggctgcga

SEQ ID NO: 377041 - DNA, 20 bp, human
gtggtctcttccgggagcag

SEQ ID NO: 377042 - DNA, 20 bp, human
gaaccgccacacgttcctta

SEQ ID NO: 377043 - DNA, 20 bp, human
ggggaggcgacacgccggcg

SEQ ID NO: 377044 - DNA, 20 bp, human
ggtactactgaaagctccgt

SEQ ID NO: 377045 - DNA, 20 bp, human
gccaccgcgcccacgccagc

SEQ ID NO: 377046 - DNA, 20 bp, human
ggggacacggctgaaaggac

SEQ ID NO: 377047 - DNA, 20 bp, human
gaaactgcgctgcagccggc

SEQ ID NO: 377048 - DNA, 20 bp, human
gacacggctgaaaggactgg

SEQ ID NO: 377049 - DNA, 20 bp, human
ggaggcagaagttacactaa

SEQ ID NO: 377050 - DNA, 20 bp, human
gtggcagcgttggttctatg

SEQ ID NO: 377051 - DNA, 20 bp, human
gctactgtgtcgggtgctca

SEQ ID NO: 377052 - DNA, 20 bp, human
gtgcccgccgccgtccaagc

SEQ ID NO: 377053 - DNA, 20 bp, human
gcacaggcagctactgtgtc

SEQ ID NO: 377054 - DNA, 20 bp, human
gtgcagccggccggcttgga

SEQ ID NO: 377055 - DNA, 20 bp, human
gaagggtgaatttcgggaca

SEQ ID NO: 377056 - DNA, 20 bp, human
gctgagggcagggctgaaac

SEQ ID NO: 377057 - DNA, 20 bp, human
ggtgctacagagaaggtgga

SEQ ID NO: 377058 - DNA, 20 bp, human
gagggtccccatcatctcag

SEQ ID NO: 377059 - DNA, 20 bp, human
gaatctcaggttacttgact

SEQ ID NO: 377060 - DNA, 20 bp, human
gctttctctctgaaaatctc

SEQ ID NO: 377061 - DNA, 20 bp, human
gggtgtctcttacggattgg

SEQ ID NO: 377062 - DNA, 20 bp, human
gttactgcccgtctatggaa

SEQ ID NO: 377063 - DNA, 20 bp, human
ggtgctccccctgagatgat

SEQ ID NO: 377064 - DNA, 20 bp, human
gcgggcagtaaaaatgttta

SEQ ID NO: 377065 - DNA, 20 bp, human
gctgggtgtctcttacggat

SEQ ID NO: 377066 - DNA, 20 bp, human
ggccgagcgcgcaccctcgc

SEQ ID NO: 377067 - DNA, 20 bp, human
gcgccgccccagccaaagtc

SEQ ID NO: 377068 - DNA, 20 bp, human
gggctggggcgatttaagag

SEQ ID NO: 377069 - DNA, 20 bp, human
ggcccaggagctggaaacga

SEQ ID NO: 377070 - DNA, 20 bp, human
gctccggggcggggagcgtc

SEQ ID NO: 377071 - DNA, 20 bp, human
gtgcccgccggcctccacgc

SEQ ID NO: 377072 - DNA, 20 bp, human
gggggctgtcgcactccccg

SEQ ID NO: 377073 - DNA, 20 bp, human
gcgaggggagcgcccggccg

SEQ ID NO: 377074 - DNA, 20 bp, human
gcgtctgtgtgtcccggcga

SEQ ID NO: 377075 - DNA, 20 bp, human
gcgagtccggaggcatcggg

SEQ ID NO: 377076 - DNA, 20 bp, human
gaccacaaggccagtctaga

SEQ ID NO: 377077 - DNA, 20 bp, human
ggcctggcagggtggagttc

SEQ ID NO: 377078 - DNA, 20 bp, human
gtacacagcaaactcagtcg

SEQ ID NO: 377079 - DNA, 20 bp, human
gtgaaaggggaaaggcccaa

SEQ ID NO: 377080 - DNA, 20 bp, human
gttagagagagcttgtctgt

SEQ ID NO: 377081 - DNA, 20 bp, human
gttcctaggtccactgtggg

SEQ ID NO: 377082 - DNA, 20 bp, human
ggggtttcctaggtccactg

SEQ ID NO: 377083 - DNA, 20 bp, human
gcacacacatccctctagac

SEQ ID NO: 377084 - DNA, 20 bp, human
gtgttggctgcctggcaggg

SEQ ID NO: 377085 - DNA, 20 bp, human
gctggagtgcatgggctgct

SEQ ID NO: 377086 - DNA, 20 bp, human
gccaaagccacgactgggtt

SEQ ID NO: 377087 - DNA, 20 bp, human
gttcttaggtcagtgtggga

SEQ ID NO: 377088 - DNA, 20 bp, human
gagtctggagtgatgcgtgt

SEQ ID NO: 377089 - DNA, 20 bp, human
gggggaaagggcccaatggt

SEQ ID NO: 377090 - DNA, 20 bp, human
ggggtttcttaggtcagtgt

SEQ ID NO: 377091 - DNA, 20 bp, human
gtacacaccaaacccagtcg

SEQ ID NO: 377092 - DNA, 20 bp, human
gggggtgttgtctgtgctga

SEQ ID NO: 377093 - DNA, 20 bp, human
ggaggcctgtgggttgcact

SEQ ID NO: 377094 - DNA, 20 bp, human
gtgatctccaaagccacgac

SEQ ID NO: 377095 - DNA, 20 bp, human
gtctgtgctgagggtttctt

SEQ ID NO: 377096 - DNA, 20 bp, human
ggggaactccaggaaggaag

SEQ ID NO: 377097 - DNA, 20 bp, human
gggctggagctgtggtggta

SEQ ID NO: 377098 - DNA, 20 bp, human
gtggagctgtggtggtaagg

SEQ ID NO: 377099 - DNA, 20 bp, human
gcatgaatgaaaggcaaaag

SEQ ID NO: 377100 - DNA, 20 bp, human
gagcttggctggagctgtgg

SEQ ID NO: 377101 - DNA, 20 bp, human
gccaagcttggctggagctg

SEQ ID NO: 377102 - DNA, 20 bp, human
gaggcaaaaggggccaacat

SEQ ID NO: 377103 - DNA, 20 bp, human
gggagttcagagggaaggtc

SEQ ID NO: 377104 - DNA, 20 bp, human
gaaaacccaaataccaatgt

SEQ ID NO: 377105 - DNA, 20 bp, human
gtacactaaactcacatatt

SEQ ID NO: 377106 - DNA, 20 bp, human
gaggcggggcgtctgtggtg

SEQ ID NO: 377107 - DNA, 20 bp, human
gggcgagggccctggtgaga

SEQ ID NO: 377108 - DNA, 20 bp, human
gctggccggtccttctcaac

SEQ ID NO: 377109 - DNA, 20 bp, human
ggacagaggcggggcgtctg

SEQ ID NO: 377110 - DNA, 20 bp, human
gtcaacaggcctgtgccccg

SEQ ID NO: 377111 - DNA, 20 bp, human
gccagaggaggcggaccccg

SEQ ID NO: 377112 - DNA, 20 bp, human
ggggacggggcctgtcgcag

SEQ ID NO: 377113 - DNA, 20 bp, human
gaggcctccccctctcacca

SEQ ID NO: 377114 - DNA, 20 bp, human
gacggggcctgtcgcagggg

SEQ ID NO: 377115 - DNA, 20 bp, human
gcaggcctgttgagaaggac

SEQ ID NO: 377116 - DNA, 20 bp, human
gggatccagctctttcttga

SEQ ID NO: 377117 - DNA, 20 bp, human
gtctagagtccagacgactt

SEQ ID NO: 377118 - DNA, 20 bp, human
ggtttccctcaagaaagagc

SEQ ID NO: 377119 - DNA, 20 bp, human
ggagtgcagcggagtactga

SEQ ID NO: 377120 - DNA, 20 bp, human
ggtggccaaagcgtgtcagt

SEQ ID NO: 377121 - DNA, 20 bp, human
gcatgctctgtcgaccacac

SEQ ID NO: 377122 - DNA, 20 bp, human
gcatcttagagatggggata

SEQ ID NO: 377123 - DNA, 20 bp, human
ggcaaagcaggccctgctca

SEQ ID NO: 377124 - DNA, 20 bp, human
ggaaacccactgacacgctt

SEQ ID NO: 377125 - DNA, 20 bp, human
ggcggagtactgatggccta

SEQ ID NO: 377126 - DNA, 20 bp, human
gcttgggaggccaacgggaa

SEQ ID NO: 377127 - DNA, 20 bp, human
gtcaagggatcctttcccgt

SEQ ID NO: 377128 - DNA, 20 bp, human
ggatgactcatcaaaaggag

SEQ ID NO: 377129 - DNA, 20 bp, human
gagagccttgggaggccaac

SEQ ID NO: 377130 - DNA, 20 bp, human
gcagttttcattcccgcacg

SEQ ID NO: 377131 - DNA, 20 bp, human
gcaaaaggaggggcccaggc

SEQ ID NO: 377132 - DNA, 20 bp, human
gctggagtgtagtgggatcc

SEQ ID NO: 377133 - DNA, 20 bp, human
gtcatcaaaaggaggggccc

SEQ ID NO: 377134 - DNA, 20 bp, human
ggctcaggtgagtgacacgt

SEQ ID NO: 377135 - DNA, 20 bp, human
ggcctcaaattcctaggctg

SEQ ID NO: 377136 - DNA, 20 bp, human
ggtgactgaaaggtgcggcc

SEQ ID NO: 377137 - DNA, 20 bp, human
ggccaggctggggaacgacc

SEQ ID NO: 377138 - DNA, 20 bp, human
gaaagcaaaaactctgcaaa

SEQ ID NO: 377139 - DNA, 20 bp, human
gcactcacaaagtcagtcag

SEQ ID NO: 377140 - DNA, 20 bp, human
gagctctgcaggtgactgaa

SEQ ID NO: 377141 - DNA, 20 bp, human
gtgcagagtttttgctttca

SEQ ID NO: 377142 - DNA, 20 bp, human
gaactctgcaaaggggcagc

SEQ ID NO: 377143 - DNA, 20 bp, human
gcaaaggggcagctgggtgc

SEQ ID NO: 377144 - DNA, 20 bp, human
gatcacaacagcaagaaagt

SEQ ID NO: 377145 - DNA, 20 bp, human
gtgcaggtgactgaaaggtg

SEQ ID NO: 377146 - DNA, 20 bp, human
gtgagcgggaggcgagccca

SEQ ID NO: 377147 - DNA, 20 bp, human
ggcacccagcgcagcgtgag

SEQ ID NO: 377148 - DNA, 20 bp, human
gaggccagaggcacgtgcgg

SEQ ID NO: 377149 - DNA, 20 bp, human
gatgctgcgcgcaccgccct

SEQ ID NO: 377150 - DNA, 20 bp, human
ggaggcagaggtcctggcgg

SEQ ID NO: 377151 - DNA, 20 bp, human
gcgaaggccagaggcacgtg

SEQ ID NO: 377152 - DNA, 20 bp, human
gcctcccgctcacgctgcgc

SEQ ID NO: 377153 - DNA, 20 bp, human
ggtggaggcccgaaggccag

SEQ ID NO: 377154 - DNA, 20 bp, human
ggtgcgcccagacctccgcc

SEQ ID NO: 377155 - DNA, 20 bp, human
gagaggtcctggcggaggtc

SEQ ID NO: 377156 - DNA, 20 bp, human
ggggaactccaggaaggaag

SEQ ID NO: 377157 - DNA, 20 bp, human
gggctggagctgtggtggta

SEQ ID NO: 377158 - DNA, 20 bp, human
gtggagctgtggtggtaagg

SEQ ID NO: 377159 - DNA, 20 bp, human
gcatgaatgaaaggcaaaag

SEQ ID NO: 377160 - DNA, 20 bp, human
gagcttggctggagctgtgg

SEQ ID NO: 377161 - DNA, 20 bp, human
gccaagcttggctggagctg

SEQ ID NO: 377162 - DNA, 20 bp, human
gaggcaaaaggggccaacat

SEQ ID NO: 377163 - DNA, 20 bp, human
gggagttcagagggaaggtc

SEQ ID NO: 377164 - DNA, 20 bp, human
gaaaacccaaataccaatgt

SEQ ID NO: 377165 - DNA, 20 bp, human
gtacactaaactcacatatt

SEQ ID NO: 377166 - DNA, 20 bp, human
gtctagagtccagacgactt

SEQ ID NO: 377167 - DNA, 20 bp, human
gggatccagctctttcttga

SEQ ID NO: 377168 - DNA, 20 bp, human
ggtttccctcaagaaagagc

SEQ ID NO: 377169 - DNA, 20 bp, human
ggagtgcagcggagtactga

SEQ ID NO: 377170 - DNA, 20 bp, human
ggtggccaaagcgtgtcagt

SEQ ID NO: 377171 - DNA, 20 bp, human
gcatcttagagatggggata

SEQ ID NO: 377172 - DNA, 20 bp, human
gcatgctctgtcgaccacac

SEQ ID NO: 377173 - DNA, 20 bp, human
ggcggagtactgatggccta

SEQ ID NO: 377174 - DNA, 20 bp, human
ggcaaagcaggccctgctca

SEQ ID NO: 377175 - DNA, 20 bp, human
gaaagaaaaggttcttccct

SEQ ID NO: 377176 - DNA, 20 bp, human
ggtgactgaaaggtgcggcc

SEQ ID NO: 377177 - DNA, 20 bp, human
ggccaggctggggaacgacc

SEQ ID NO: 377178 - DNA, 20 bp, human
gaaagcaaaaactctgcaaa

SEQ ID NO: 377179 - DNA, 20 bp, human
gcactcacaaagtcagtcag

SEQ ID NO: 377180 - DNA, 20 bp, human
gagctctgcaggtgactgaa

SEQ ID NO: 377181 - DNA, 20 bp, human
gtgcagagtttttgctttca

SEQ ID NO: 377182 - DNA, 20 bp, human
gaactctgcaaaggggcagc

SEQ ID NO: 377183 - DNA, 20 bp, human
gttcaaaatcccagggcctg

SEQ ID NO: 377184 - DNA, 20 bp, human
gcaaaggggcagctgggtgc

SEQ ID NO: 377185 - DNA, 20 bp, human
gatcacaacagcaagaaagt

SEQ ID NO: 377186 - DNA, 20 bp, human
gctgtgcttgtgctgactta

SEQ ID NO: 377187 - DNA, 20 bp, human
gaggcagctaagatataaaa

SEQ ID NO: 377188 - DNA, 20 bp, human
gttgctagctgttgaaacag

SEQ ID NO: 377189 - DNA, 20 bp, human
gtagcaatcactgagtttac

SEQ ID NO: 377190 - DNA, 20 bp, human
gaagtgtctgagaaatgcag

SEQ ID NO: 377191 - DNA, 20 bp, human
gttcaacagctagcaaagcc

SEQ ID NO: 377192 - DNA, 20 bp, human
gaactcacgtttattccaga

SEQ ID NO: 377193 - DNA, 20 bp, human
gtaatcatttccacaactct

SEQ ID NO: 377194 - DNA, 20 bp, human
gaccaccctgaaccacttcc

SEQ ID NO: 377195 - DNA, 20 bp, human
gcagagggaaagaacatgaa

SEQ ID NO: 377196 - DNA, 20 bp, human
gtcgaagcttaaacaggtgg

SEQ ID NO: 377197 - DNA, 20 bp, human
gctagctggtgaccgagagg

SEQ ID NO: 377198 - DNA, 20 bp, human
gactctagctggtgaccgag

SEQ ID NO: 377199 - DNA, 20 bp, human
gcctcccagggccaggtcac

SEQ ID NO: 377200 - DNA, 20 bp, human
gagggtcacatgagtgatca

SEQ ID NO: 377201 - DNA, 20 bp, human
gcacactctactcctcctct

SEQ ID NO: 377202 - DNA, 20 bp, human
gggtatttgcacagcagtca

SEQ ID NO: 377203 - DNA, 20 bp, human
gctctagttcatatgaacta

SEQ ID NO: 377204 - DNA, 20 bp, human
ggcctcgaagcttaaacagg

SEQ ID NO: 377205 - DNA, 20 bp, human
gttcgaggccagtgggagga

SEQ ID NO: 377206 - DNA, 20 bp, human
gaaataatcaatacctgttg

SEQ ID NO: 377207 - DNA, 20 bp, human
gcatagcaaccacataaaat

SEQ ID NO: 377208 - DNA, 20 bp, human
gaactattacctattttatg

SEQ ID NO: 377209 - DNA, 20 bp, human
gaccatattacttgttaatc

SEQ ID NO: 377210 - DNA, 20 bp, human
gtgttaatcgggaatataat

SEQ ID NO: 377211 - DNA, 20 bp, human
gggttgttaggtcatgcagc

SEQ ID NO: 377212 - DNA, 20 bp, human
ggttttatggttcatagtat

SEQ ID NO: 377213 - DNA, 20 bp, human
gcagcaggaaaaagactatt

SEQ ID NO: 377214 - DNA, 20 bp, human
gaacaagtaatatggttgtt

SEQ ID NO: 377215 - DNA, 20 bp, human
gtataaatctcagccccaac

SEQ ID NO: 377216 - DNA, 20 bp, human
ggaacgggacccagccagca

SEQ ID NO: 377217 - DNA, 20 bp, human
gtaactcacagagaacggaa

SEQ ID NO: 377218 - DNA, 20 bp, human
gagaacggaagggctggaac

SEQ ID NO: 377219 - DNA, 20 bp, human
ggtcacaaaccctgctggct

SEQ ID NO: 377220 - DNA, 20 bp, human
gaagtccctgcagtctctca

SEQ ID NO: 377221 - DNA, 20 bp, human
gactgcagggactttcccgt

SEQ ID NO: 377222 - DNA, 20 bp, human
gaccctgctggccagcaaac

SEQ ID NO: 377223 - DNA, 20 bp, human
gcgtgggctattaacagtgg

SEQ ID NO: 377224 - DNA, 20 bp, human
gtcacagagaacggaagggc

SEQ ID NO: 377225 - DNA, 20 bp, human
gtgctggccagcagggtttg

SEQ ID NO: 377226 - DNA, 20 bp, human
gaaggaggtggagattaatt

SEQ ID NO: 377227 - DNA, 20 bp, human
gcaagtctgccgtcaggggt

SEQ ID NO: 377228 - DNA, 20 bp, human
gacaaataatagcatgacta

SEQ ID NO: 377229 - DNA, 20 bp, human
gtacaacccaatgacttctt

SEQ ID NO: 377230 - DNA, 20 bp, human
gttcccaagtctgccgtcag

SEQ ID NO: 377231 - DNA, 20 bp, human
ggtgtggttactgcagctgc

SEQ ID NO: 377232 - DNA, 20 bp, human
gaggtctgcttaagagttaa

SEQ ID NO: 377233 - DNA, 20 bp, human
gttcaaaagaataaacttat

SEQ ID NO: 377234 - DNA, 20 bp, human
gacctccttctctggcattc

SEQ ID NO: 377235 - DNA, 20 bp, human
gtacattaactattgcatca

SEQ ID NO: 377236 - DNA, 20 bp, human
gttatctagagaccatttta

SEQ ID NO: 377237 - DNA, 20 bp, human
gagatcgaataacaaacacg

SEQ ID NO: 377238 - DNA, 20 bp, human
gaacaaacatgtgacatgct

SEQ ID NO: 377239 - DNA, 20 bp, human
gatcttcaatcttttgagta

SEQ ID NO: 377240 - DNA, 20 bp, human
gcatgtgacatgctgggaca

SEQ ID NO: 377241 - DNA, 20 bp, human
gtttacttgctgataaagag

SEQ ID NO: 377242 - DNA, 20 bp, human
gtgttaaaatgcacgattgc

SEQ ID NO: 377243 - DNA, 20 bp, human
gctgtgtggtcttttggatt

SEQ ID NO: 377244 - DNA, 20 bp, human
ggatcttgcagttcactctc

SEQ ID NO: 377245 - DNA, 20 bp, human
gagaacagataaagactgtg

SEQ ID NO: 377246 - DNA, 20 bp, human
gggcggggaggagcagtgat

SEQ ID NO: 377247 - DNA, 20 bp, human
ggcccacgccagaaccttcc

SEQ ID NO: 377248 - DNA, 20 bp, human
gagcagtgatgggcacgtcc

SEQ ID NO: 377249 - DNA, 20 bp, human
gggcctctccccgctgttgg

SEQ ID NO: 377250 - DNA, 20 bp, human
gtccccgctgttggaggcgt

SEQ ID NO: 377251 - DNA, 20 bp, human
gtaggccaccgctggggaag

SEQ ID NO: 377252 - DNA, 20 bp, human
gccagaactgccagcccgga

SEQ ID NO: 377253 - DNA, 20 bp, human
ggggcttggcactgaccccc

SEQ ID NO: 377254 - DNA, 20 bp, human
gctacccacgcctccaacag

SEQ ID NO: 377255 - DNA, 20 bp, human
ggcaccctggaaacagacac

SEQ ID NO: 377256 - DNA, 20 bp, human
gagcctccgccgcgcgtcgg

SEQ ID NO: 377257 - DNA, 20 bp, human
gaacgcacgcacgactgagg

SEQ ID NO: 377258 - DNA, 20 bp, human
gcgccatgacgtcatacccg

SEQ ID NO: 377259 - DNA, 20 bp, human
gggtcacccacccgctgccg

SEQ ID NO: 377260 - DNA, 20 bp, human
gccggggctgacagagaccc

SEQ ID NO: 377261 - DNA, 20 bp, human
gcagcgccgcggccgcgtgc

SEQ ID NO: 377262 - DNA, 20 bp, human
ggccgcggccgcgtgccggg

SEQ ID NO: 377263 - DNA, 20 bp, human
gtcatggcgccgccgacgcg

SEQ ID NO: 377264 - DNA, 20 bp, human
gggtggggcgcgagcgtgtg

SEQ ID NO: 377265 - DNA, 20 bp, human
gctccgcgggtatgacgtca

SEQ ID NO: 377266 - DNA, 20 bp, human
ggggtggacaggtgtatccc

SEQ ID NO: 377267 - DNA, 20 bp, human
ggcgccgaatctgtcagagg

SEQ ID NO: 377268 - DNA, 20 bp, human
gccctggtggtctgtagcaa

SEQ ID NO: 377269 - DNA, 20 bp, human
ggtccacccacaaagaagtg

SEQ ID NO: 377270 - DNA, 20 bp, human
gtgaggctctcggcttcagg

SEQ ID NO: 377271 - DNA, 20 bp, human
gaagtgaggtttactagctg

SEQ ID NO: 377272 - DNA, 20 bp, human
gcggctgccttggtgtatag

SEQ ID NO: 377273 - DNA, 20 bp, human
gagtaaacctcacttctttg

SEQ ID NO: 377274 - DNA, 20 bp, human
ggtgccgagaaggcaggcgc

SEQ ID NO: 377275 - DNA, 20 bp, human
gaagtgcgaataatactgta

SEQ ID NO: 377276 - DNA, 20 bp, human
gtaaaggggtgcacggtctg

SEQ ID NO: 377277 - DNA, 20 bp, human
ggctgcgcccgcactagggc

SEQ ID NO: 377278 - DNA, 20 bp, human
gcatggctgcgcccgcacta

SEQ ID NO: 377279 - DNA, 20 bp, human
gtcccgcgggccatgtgacc

SEQ ID NO: 377280 - DNA, 20 bp, human
gcaaagaagtacctgaagaa

SEQ ID NO: 377281 - DNA, 20 bp, human
gcgcagccatgttgtcccgc

SEQ ID NO: 377282 - DNA, 20 bp, human
gggtcccttgcgggttcttg

SEQ ID NO: 377283 - DNA, 20 bp, human
gggggtgcacggtctgtgga

SEQ ID NO: 377284 - DNA, 20 bp, human
ggaggacgagacccagctca

SEQ ID NO: 377285 - DNA, 20 bp, human
gccacacaccagccctagtg

SEQ ID NO: 377286 - DNA, 20 bp, human
ggacccctatgcacatgcgc

SEQ ID NO: 377287 - DNA, 20 bp, human
gggaaactgacggagcgagg

SEQ ID NO: 377288 - DNA, 20 bp, human
ggcacccaatagttcagcag

SEQ ID NO: 377289 - DNA, 20 bp, human
gccctgggcggtcctgaagg

SEQ ID NO: 377290 - DNA, 20 bp, human
gagcctgcgcatgtgcatag

SEQ ID NO: 377291 - DNA, 20 bp, human
gtgaactattgggtgcgggg

SEQ ID NO: 377292 - DNA, 20 bp, human
gggcggtcctgaaggtggtg

SEQ ID NO: 377293 - DNA, 20 bp, human
gacggccgggaccctcaacg

SEQ ID NO: 377294 - DNA, 20 bp, human
ggggggaaactgacggagcg

SEQ ID NO: 377295 - DNA, 20 bp, human
ggcgccctcatgcaccgcag

SEQ ID NO: 377296 - DNA, 20 bp, human
ggcgcctgccacagagggat

SEQ ID NO: 377297 - DNA, 20 bp, human
gtcagcttcctgaatcatcc

SEQ ID NO: 377298 - DNA, 20 bp, human
ggagaaccagatgatgtact

SEQ ID NO: 377299 - DNA, 20 bp, human
gtggctgagaaaacagaacc

SEQ ID NO: 377300 - DNA, 20 bp, human
gtggcaggcgcctctcacca

SEQ ID NO: 377301 - DNA, 20 bp, human
gaaggagaatgctttctttg

SEQ ID NO: 377302 - DNA, 20 bp, human
gtgagaggcgcctgccacag

SEQ ID NO: 377303 - DNA, 20 bp, human
gtggaacagagcactctgaa

SEQ ID NO: 377304 - DNA, 20 bp, human
ggcccaatgtgtgttgacga

SEQ ID NO: 377305 - DNA, 20 bp, human
ggtgtgttgacgatggctgg

SEQ ID NO: 377306 - DNA, 20 bp, human
ggtaacggagagagcaatct

SEQ ID NO: 377307 - DNA, 20 bp, human
gccgcttcgcgcagggagga

SEQ ID NO: 377308 - DNA, 20 bp, human
ggaaagacaaggcgggaaat

SEQ ID NO: 377309 - DNA, 20 bp, human
gagtactagggccatccccc

SEQ ID NO: 377310 - DNA, 20 bp, human
gcgcaggacctggtccttga

SEQ ID NO: 377311 - DNA, 20 bp, human
ggtcctgcgcatcagtacta

SEQ ID NO: 377312 - DNA, 20 bp, human
gggccatcccccaggagcaa

SEQ ID NO: 377313 - DNA, 20 bp, human
gtgtggagctgctttgccgg

SEQ ID NO: 377314 - DNA, 20 bp, human
ggcgaagcggaagtgacgcg

SEQ ID NO: 377315 - DNA, 20 bp, human
ggaagtgacgcgaggcgtag

SEQ ID NO: 377316 - DNA, 20 bp, human
ggctgtattgtcctccttcg

SEQ ID NO: 377317 - DNA, 20 bp, human
ggtcctcggtgggaacgatg

SEQ ID NO: 377318 - DNA, 20 bp, human
gtgtccgcgcctcttcccgc

SEQ ID NO: 377319 - DNA, 20 bp, human
gcgcctggcccaggacgcgg

SEQ ID NO: 377320 - DNA, 20 bp, human
ggcccaggacgcggtggcgt

SEQ ID NO: 377321 - DNA, 20 bp, human
gcctcttcccgccggccggg

SEQ ID NO: 377322 - DNA, 20 bp, human
gtcccacgccaccgcgtcct

SEQ ID NO: 377323 - DNA, 20 bp, human
gagtagccgaagcctcccat

SEQ ID NO: 377324 - DNA, 20 bp, human
gcgcggtggcgtgggacggg

SEQ ID NO: 377325 - DNA, 20 bp, human
ggtgctcgcgcacgcagggt

SEQ ID NO: 377326 - DNA, 20 bp, human
gggtcccgcgcgaccccgtc

SEQ ID NO: 377327 - DNA, 20 bp, human
gtggagatgcgtcacggggc

SEQ ID NO: 377328 - DNA, 20 bp, human
gctagggcgctgtggggcgc

SEQ ID NO: 377329 - DNA, 20 bp, human
ggaagccctagggcgctgtg

SEQ ID NO: 377330 - DNA, 20 bp, human
ggtcgggcgcggaagcccta

SEQ ID NO: 377331 - DNA, 20 bp, human
gtccctgcggccatgggcgg

SEQ ID NO: 377332 - DNA, 20 bp, human
gcggttggagatgcgtcacg

SEQ ID NO: 377333 - DNA, 20 bp, human
ggcgcccgacggggtcgcgc

SEQ ID NO: 377334 - DNA, 20 bp, human
ggcccccaggaaaggagtcg

SEQ ID NO: 377335 - DNA, 20 bp, human
gcacccgttggccggcacgg

SEQ ID NO: 377336 - DNA, 20 bp, human
gctggcgcacacagcgggag

SEQ ID NO: 377337 - DNA, 20 bp, human
gaggccccaacagctcgtgc

SEQ ID NO: 377338 - DNA, 20 bp, human
gagctgttggggcctcccat

SEQ ID NO: 377339 - DNA, 20 bp, human
gtcgtgctggcgcacacagc

SEQ ID NO: 377340 - DNA, 20 bp, human
gtgcaagaacacaaaagtgt

SEQ ID NO: 377341 - DNA, 20 bp, human
gtcacaaggagttgtatgaa

SEQ ID NO: 377342 - DNA, 20 bp, human
gggatctggcagcagccaat

SEQ ID NO: 377343 - DNA, 20 bp, human
ggcgccagcacgagctgttg

SEQ ID NO: 377344 - DNA, 20 bp, human
gaaacagttgtcaaatagac

SEQ ID NO: 377345 - DNA, 20 bp, human
gtgtgtgtagaaatggaaac

SEQ ID NO: 377346 - DNA, 20 bp, human
gaggggcctggatgcgtcac

SEQ ID NO: 377347 - DNA, 20 bp, human
gcccgtagccgcctcgtcat

SEQ ID NO: 377348 - DNA, 20 bp, human
gtcacggggtgggacgggcg

SEQ ID NO: 377349 - DNA, 20 bp, human
ggatgcgtcacggggtggga

SEQ ID NO: 377350 - DNA, 20 bp, human
gacgaggcggctacgggccg

SEQ ID NO: 377351 - DNA, 20 bp, human
gcgaggaggactccaggcgg

SEQ ID NO: 377352 - DNA, 20 bp, human
gaggccacgtcccggtatgg

SEQ ID NO: 377353 - DNA, 20 bp, human
gcgcgccacccgaagcgttc

SEQ ID NO: 377354 - DNA, 20 bp, human
ggttctggccaatgacgagg

SEQ ID NO: 377355 - DNA, 20 bp, human
gccggggcgcggcccgcgat

SEQ ID NO: 377356 - DNA, 20 bp, human
gtggctgactcgtgaaacca

SEQ ID NO: 377357 - DNA, 20 bp, human
gcctacacgcaactcaactc

SEQ ID NO: 377358 - DNA, 20 bp, human
ggaccaggggaaccctaaag

SEQ ID NO: 377359 - DNA, 20 bp, human
gatcctgagaaaaagaccag

SEQ ID NO: 377360 - DNA, 20 bp, human
ggttcctgggcttgtaacta

SEQ ID NO: 377361 - DNA, 20 bp, human
gagctcaggttgactgagac

SEQ ID NO: 377362 - DNA, 20 bp, human
gggtcaccctcaaaactcac

SEQ ID NO: 377363 - DNA, 20 bp, human
ggggcaccttccaagaaaca

SEQ ID NO: 377364 - DNA, 20 bp, human
gttcacgagtcagccacttt

SEQ ID NO: 377365 - DNA, 20 bp, human
gttttctcaggatatatgag

SEQ ID NO: 377366 - DNA, 20 bp, human
gctcccacgcgcggactcct

SEQ ID NO: 377367 - DNA, 20 bp, human
gggcagcggggcccacgcga

SEQ ID NO: 377368 - DNA, 20 bp, human
gccggcggggcctgaccaat

SEQ ID NO: 377369 - DNA, 20 bp, human
ggctcgccccgccctcgcgt

SEQ ID NO: 377370 - DNA, 20 bp, human
gagcctaggagtccgcgcgt

SEQ ID NO: 377371 - DNA, 20 bp, human
gcggggctttgtgttcaaac

SEQ ID NO: 377372 - DNA, 20 bp, human
ggcccaccgccgccacccat

SEQ ID NO: 377373 - DNA, 20 bp, human
gctgacaggccgcagcccat

SEQ ID NO: 377374 - DNA, 20 bp, human
gtcaccaggccggcgtccga

SEQ ID NO: 377375 - DNA, 20 bp, human
gagcggggcccacgcgaggg

SEQ ID NO: 377376 - DNA, 20 bp, human
gtctgtgagtaaagatgagg

SEQ ID NO: 377377 - DNA, 20 bp, human
gttaaagagaccagaagaga

SEQ ID NO: 377378 - DNA, 20 bp, human
gtaagtcccgagtttctttt

SEQ ID NO: 377379 - DNA, 20 bp, human
gcttcctttagcagattcag

SEQ ID NO: 377380 - DNA, 20 bp, human
gctgccactgaatctgctaa

SEQ ID NO: 377381 - DNA, 20 bp, human
gttctggtctctttaacttc

SEQ ID NO: 377382 - DNA, 20 bp, human
gtcatctgtgagtaaagatg

SEQ ID NO: 377383 - DNA, 20 bp, human
gatgacaccaaaaagaaact

SEQ ID NO: 377384 - DNA, 20 bp, human
gcaaaatgaagacatttaga

SEQ ID NO: 377385 - DNA, 20 bp, human
gaatttaactatgatgtgtc

SEQ ID NO: 377386 - DNA, 20 bp, human
ggaaaagcggtaggtacatg

SEQ ID NO: 377387 - DNA, 20 bp, human
ggggcctttgtattattcag

SEQ ID NO: 377388 - DNA, 20 bp, human
gcaaccacctctctgcttca

SEQ ID NO: 377389 - DNA, 20 bp, human
ggcattatgaggtgtcacgg

SEQ ID NO: 377390 - DNA, 20 bp, human
ggagattcagggatacttgg

SEQ ID NO: 377391 - DNA, 20 bp, human
gttcaggttgtagttatctg

SEQ ID NO: 377392 - DNA, 20 bp, human
gcacccactgaataatacaa

SEQ ID NO: 377393 - DNA, 20 bp, human
gggtggccatctgcattatg

SEQ ID NO: 377394 - DNA, 20 bp, human
ggcctgtccatgccctggct

SEQ ID NO: 377395 - DNA, 20 bp, human
gtgacacctcataatgcaga

SEQ ID NO: 377396 - DNA, 20 bp, human
ggccctagaacctcccccag

SEQ ID NO: 377397 - DNA, 20 bp, human
gtgaggcatcaagacaggaa

SEQ ID NO: 377398 - DNA, 20 bp, human
gggggtctcagaagctggac

SEQ ID NO: 377399 - DNA, 20 bp, human
ggggtcacaatggcttcctc

SEQ ID NO: 377400 - DNA, 20 bp, human
gggaggttctagggccaagc

SEQ ID NO: 377401 - DNA, 20 bp, human
gctaagaaggtgaaaagcct

SEQ ID NO: 377402 - DNA, 20 bp, human
gggaagggatctaggaaaca

SEQ ID NO: 377403 - DNA, 20 bp, human
gaaaagcatggttgggttac

SEQ ID NO: 377404 - DNA, 20 bp, human
gcactttcctttcttaagat

SEQ ID NO: 377405 - DNA, 20 bp, human
gttcctctgggggaggttct

SEQ ID NO: 377406 - DNA, 20 bp, human
gctaagaagcctgggagaag

SEQ ID NO: 377407 - DNA, 20 bp, human
ggggccagcgccgttatgtc

SEQ ID NO: 377408 - DNA, 20 bp, human
gaagcgggtggctcaaccat

SEQ ID NO: 377409 - DNA, 20 bp, human
gcgcctcctggagccgagac

SEQ ID NO: 377410 - DNA, 20 bp, human
gggctgagggataagctgag

SEQ ID NO: 377411 - DNA, 20 bp, human
ggggtggctcaaccattggc

SEQ ID NO: 377412 - DNA, 20 bp, human
gggaggcgggttccagccaa

SEQ ID NO: 377413 - DNA, 20 bp, human
ggcaggttgctaagaagcct

SEQ ID NO: 377414 - DNA, 20 bp, human
ggcttccagccaatggctga

SEQ ID NO: 377415 - DNA, 20 bp, human
gccggagtccattatacccc

SEQ ID NO: 377416 - DNA, 20 bp, human
gtcccccgtccatccgaaag

SEQ ID NO: 377417 - DNA, 20 bp, human
ggctgggctgagagttaata

SEQ ID NO: 377418 - DNA, 20 bp, human
gaatcgacgtcgtcacgtga

SEQ ID NO: 377419 - DNA, 20 bp, human
ggcctccttcgcttcgtcta

SEQ ID NO: 377420 - DNA, 20 bp, human
ggcaaagagtcgattttcgc

SEQ ID NO: 377421 - DNA, 20 bp, human
gagcggaaagggcatctttg

SEQ ID NO: 377422 - DNA, 20 bp, human
gtgagagttaataagggcgg

SEQ ID NO: 377423 - DNA, 20 bp, human
gggctgagagttaataaggg

SEQ ID NO: 377424 - DNA, 20 bp, human
gaaagagcgggatctagcgt

SEQ ID NO: 377425 - DNA, 20 bp, human
ggacgacgtcgattcgcgtg

SEQ ID NO: 377426 - DNA, 20 bp, human
gtccgagtccgcaaagtggg

SEQ ID NO: 377427 - DNA, 20 bp, human
gcccgcagagacttgcgtcc

SEQ ID NO: 377428 - DNA, 20 bp, human
gtccgcgcaggacgccggtg

SEQ ID NO: 377429 - DNA, 20 bp, human
gaagtctctgcgggcctcac

SEQ ID NO: 377430 - DNA, 20 bp, human
ggcccggacgcaagtctctg

SEQ ID NO: 377431 - DNA, 20 bp, human
ggcctcaccggcgtcctgcg

SEQ ID NO: 377432 - DNA, 20 bp, human
ggcgcggaacgcagcgctcc

SEQ ID NO: 377433 - DNA, 20 bp, human
gagtccgcaaagtgggaggg

SEQ ID NO: 377434 - DNA, 20 bp, human
gcggcggccgcacttccgat

SEQ ID NO: 377435 - DNA, 20 bp, human
gtcgccgctaggccccaaga

SEQ ID NO: 377436 - DNA, 20 bp, human
gtggcggaagtagctcgctc

SEQ ID NO: 377437 - DNA, 20 bp, human
gtgcgcccgcactgccagtg

SEQ ID NO: 377438 - DNA, 20 bp, human
ggcgtgagcccgactctcgg

SEQ ID NO: 377439 - DNA, 20 bp, human
ggactgaggagtaagcgata

SEQ ID NO: 377440 - DNA, 20 bp, human
ggaagtagctcgctcgggct

SEQ ID NO: 377441 - DNA, 20 bp, human
ggacgagctgagatcggtca

SEQ ID NO: 377442 - DNA, 20 bp, human
gcccgcactgccagtgcggg

SEQ ID NO: 377443 - DNA, 20 bp, human
ggcgttgtgcgcggccttca

SEQ ID NO: 377444 - DNA, 20 bp, human
gcgatggggggggtacaaga

SEQ ID NO: 377445 - DNA, 20 bp, human
ggacacgcttggaaaggggc

SEQ ID NO: 377446 - DNA, 20 bp, human
gcgccctcggcgggctcagg

SEQ ID NO: 377447 - DNA, 20 bp, human
gctacccccgccagaggaga

SEQ ID NO: 377448 - DNA, 20 bp, human
gagccgcagcgccgagacgc

SEQ ID NO: 377449 - DNA, 20 bp, human
gcgtccgcccacaccggaag

SEQ ID NO: 377450 - DNA, 20 bp, human
gagccacctgagcccgccga

SEQ ID NO: 377451 - DNA, 20 bp, human
gagctggcgtccgcccacac

SEQ ID NO: 377452 - DNA, 20 bp, human
gcgcttgcgcgggagtgtgt

SEQ ID NO: 377453 - DNA, 20 bp, human
gtctaagcgccggaagtggt

SEQ ID NO: 377454 - DNA, 20 bp, human
ggctgtgtggggtagtcagc

SEQ ID NO: 377455 - DNA, 20 bp, human
gggcgcggcggaggctgtgt

SEQ ID NO: 377456 - DNA, 20 bp, human
gagtgcggggccgacatctg

SEQ ID NO: 377457 - DNA, 20 bp, human
gcggggccgacatctgcgga

SEQ ID NO: 377458 - DNA, 20 bp, human
gcatctgcggagggttagga

SEQ ID NO: 377459 - DNA, 20 bp, human
gccgacatctgcggagggtt

SEQ ID NO: 377460 - DNA, 20 bp, human
gggctggcctgggcggagtg

SEQ ID NO: 377461 - DNA, 20 bp, human
gcgccatcttgagagaggca

SEQ ID NO: 377462 - DNA, 20 bp, human
gtcgtgttaggcgaggtcaa

SEQ ID NO: 377463 - DNA, 20 bp, human
gttaggcgaggtcaacgggt

SEQ ID NO: 377464 - DNA, 20 bp, human
gggtaggccaagctgcgagg

SEQ ID NO: 377465 - DNA, 20 bp, human
gttcgcacgacgcctgactg

SEQ ID NO: 377466 - DNA, 20 bp, human
gtaaccgaagcggctcagga

SEQ ID NO: 377467 - DNA, 20 bp, human
gagacgaaagcttccgagag

SEQ ID NO: 377468 - DNA, 20 bp, human
gctagagcggcctgagaaac

SEQ ID NO: 377469 - DNA, 20 bp, human
gctgccttcctgagccgctt

SEQ ID NO: 377470 - DNA, 20 bp, human
gagcccgagtctgatcttta

SEQ ID NO: 377471 - DNA, 20 bp, human
ggtgcgaaaggtaaccgaag

SEQ ID NO: 377472 - DNA, 20 bp, human
gagcttccggttccggggag

SEQ ID NO: 377473 - DNA, 20 bp, human
gtcggaagctttcgtctcgt

SEQ ID NO: 377474 - DNA, 20 bp, human
gggggctccgcgatacagtt

SEQ ID NO: 377475 - DNA, 20 bp, human
gcaacgtgctacgtcatttc

SEQ ID NO: 377476 - DNA, 20 bp, human
gaagttgcaccggttgagga

SEQ ID NO: 377477 - DNA, 20 bp, human
gaccgaagggtgggtttcga

SEQ ID NO: 377478 - DNA, 20 bp, human
gaacgtaaagaccgaagggt

SEQ ID NO: 377479 - DNA, 20 bp, human
gtcccagtggcgtctgtagg

SEQ ID NO: 377480 - DNA, 20 bp, human
gtggcgtctgtaggcggcga

SEQ ID NO: 377481 - DNA, 20 bp, human
ggggagagtgggacgtggac

SEQ ID NO: 377482 - DNA, 20 bp, human
ggacctggagcgttgcgaag

SEQ ID NO: 377483 - DNA, 20 bp, human
gcagacgccactgggagctt

SEQ ID NO: 377484 - DNA, 20 bp, human
gactgggagcttgggagagt

SEQ ID NO: 377485 - DNA, 20 bp, human
gagaaaaacaaaacggttat

SEQ ID NO: 377486 - DNA, 20 bp, human
gccgtgagggtgttctttca

SEQ ID NO: 377487 - DNA, 20 bp, human
gcaagtgtccagaagcacgt

SEQ ID NO: 377488 - DNA, 20 bp, human
gtgggtgagcagtgagagaa

SEQ ID NO: 377489 - DNA, 20 bp, human
gggaaaacgccgtgccgtga

SEQ ID NO: 377490 - DNA, 20 bp, human
gggaaaacgcctgaccgtta

SEQ ID NO: 377491 - DNA, 20 bp, human
gggatgtcatacatgagcgg

SEQ ID NO: 377492 - DNA, 20 bp, human
gttgggatgtcatacatgag

SEQ ID NO: 377493 - DNA, 20 bp, human
gaccacctttccctaaagaa

SEQ ID NO: 377494 - DNA, 20 bp, human
ggaaaataatcaggcatctt

SEQ ID NO: 377495 - DNA, 20 bp, human
ggccgagcaggtaagctgcc

SEQ ID NO: 377496 - DNA, 20 bp, human
gtcgcccggcaactcgctca

SEQ ID NO: 377497 - DNA, 20 bp, human
gcggccatgagcgagttgcc

SEQ ID NO: 377498 - DNA, 20 bp, human
ggaagggcgcagttgggatg

SEQ ID NO: 377499 - DNA, 20 bp, human
ggaaacgcccgcacgtcgcc

SEQ ID NO: 377500 - DNA, 20 bp, human
gggaacggagtggcggagaa

SEQ ID NO: 377501 - DNA, 20 bp, human
gttccgccgggctgctccgc

SEQ ID NO: 377502 - DNA, 20 bp, human
gaaggttcgcagcgcgggag

SEQ ID NO: 377503 - DNA, 20 bp, human
gggaagccgctcgcagaacc

SEQ ID NO: 377504 - DNA, 20 bp, human
ggacgtgcgggcgtttctgc

SEQ ID NO: 377505 - DNA, 20 bp, human
gggcggagaagggcgcagtt

SEQ ID NO: 377506 - DNA, 20 bp, human
gggtggctgcgttgcagctg

SEQ ID NO: 377507 - DNA, 20 bp, human
ggcggggccgggtgcgatgg

SEQ ID NO: 377508 - DNA, 20 bp, human
gggggcctgcggacacggac

SEQ ID NO: 377509 - DNA, 20 bp, human
gccaccgccgccatcgcacc

SEQ ID NO: 377510 - DNA, 20 bp, human
gcgtcccggaagcgcccgcg

SEQ ID NO: 377511 - DNA, 20 bp, human
gggctgggacgggtgagcgc

SEQ ID NO: 377512 - DNA, 20 bp, human
gtggccggggcctgcggaca

SEQ ID NO: 377513 - DNA, 20 bp, human
gggaagccgctcgcagaacc

SEQ ID NO: 377514 - DNA, 20 bp, human
gcctgcggacacggacgggc

SEQ ID NO: 377515 - DNA, 20 bp, human
gcggccccgcgggcgcttcc

SEQ ID NO: 377516 - DNA, 20 bp, human
gctggggccagcgcgcggga

SEQ ID NO: 377517 - DNA, 20 bp, human
ggtggacgctcgcccgtacg

SEQ ID NO: 377518 - DNA, 20 bp, human
ggcggggcctccagcgtgag

SEQ ID NO: 377519 - DNA, 20 bp, human
gccgccgcgcgcaggccctg

SEQ ID NO: 377520 - DNA, 20 bp, human
gcgccccggtgcgtcttaaa

SEQ ID NO: 377521 - DNA, 20 bp, human
ggggatcctccccgcccgaa

SEQ ID NO: 377522 - DNA, 20 bp, human
ggcctccagcgtgagaggcg

SEQ ID NO: 377523 - DNA, 20 bp, human
gggccggcctcgctccgcgt

SEQ ID NO: 377524 - DNA, 20 bp, human
gggaacgcgtcccttttaag

SEQ ID NO: 377525 - DNA, 20 bp, human
gggcgtggcttcgagcggat

SEQ ID NO: 377526 - DNA, 20 bp, human
ggcggggcgcacagcattgc

SEQ ID NO: 377527 - DNA, 20 bp, human
ggccctgctgcaccgactcc

SEQ ID NO: 377528 - DNA, 20 bp, human
ggtgcagcagggcacccccg

SEQ ID NO: 377529 - DNA, 20 bp, human
gcaggaacacgtgcgggacc

SEQ ID NO: 377530 - DNA, 20 bp, human
gctgctgcaccgactccggg

SEQ ID NO: 377531 - DNA, 20 bp, human
gagcaggcgctcatgagtag

SEQ ID NO: 377532 - DNA, 20 bp, human
gtagccaagcctgactccgc

SEQ ID NO: 377533 - DNA, 20 bp, human
ggggagcacaggaacacgtg

SEQ ID NO: 377534 - DNA, 20 bp, human
gcggggtgattgaggcactg

SEQ ID NO: 377535 - DNA, 20 bp, human
ggccaatctccgcccggagt

SEQ ID NO: 377536 - DNA, 20 bp, human
gtcgccgctcacattcgcaa

SEQ ID NO: 377537 - DNA, 20 bp, human
gtgctggggaggaaatgttg

SEQ ID NO: 377538 - DNA, 20 bp, human
ggaggattcaagccactcga

SEQ ID NO: 377539 - DNA, 20 bp, human
gtcctccccagcactctccg

SEQ ID NO: 377540 - DNA, 20 bp, human
ggcctccctgagccctcgag

SEQ ID NO: 377541 - DNA, 20 bp, human
ggaggcacccccggggagag

SEQ ID NO: 377542 - DNA, 20 bp, human
ggctcagggaggcacccccg

SEQ ID NO: 377543 - DNA, 20 bp, human
gaagcccaggccccgacaag

SEQ ID NO: 377544 - DNA, 20 bp, human
ggcagagccccggagagtgc

SEQ ID NO: 377545 - DNA, 20 bp, human
gcaaggcccagatgagaggt

SEQ ID NO: 377546 - DNA, 20 bp, human
gcacctgtggactttgagag

SEQ ID NO: 377547 - DNA, 20 bp, human
gggccaggaatgtgctaacg

SEQ ID NO: 377548 - DNA, 20 bp, human
gtgccccgttagcacattcc

SEQ ID NO: 377549 - DNA, 20 bp, human
gagggtcccagggccgatcc

SEQ ID NO: 377550 - DNA, 20 bp, human
gcccggcggggctgaagcag

SEQ ID NO: 377551 - DNA, 20 bp, human
ggatgagccggatgtccaga

SEQ ID NO: 377552 - DNA, 20 bp, human
ggggcggtgccgcagagtgc

SEQ ID NO: 377553 - DNA, 20 bp, human
gcgcaggcctggatcggccc

SEQ ID NO: 377554 - DNA, 20 bp, human
gtcgccctgcatgcaaggcg

SEQ ID NO: 377555 - DNA, 20 bp, human
ggcacccaactcatcctcag

SEQ ID NO: 377556 - DNA, 20 bp, human
gccagtccaacgtgtgggcg

SEQ ID NO: 377557 - DNA, 20 bp, human
ggggagaccaaatacccagc

SEQ ID NO: 377558 - DNA, 20 bp, human
gggggccgaggtccggccgg

SEQ ID NO: 377559 - DNA, 20 bp, human
ggctgtgggcgggggccctt

SEQ ID NO: 377560 - DNA, 20 bp, human
gacagaccacgcccacacgt

SEQ ID NO: 377561 - DNA, 20 bp, human
gtcggccccagtccaacgtg

SEQ ID NO: 377562 - DNA, 20 bp, human
gccttggcccgctgggtatt

SEQ ID NO: 377563 - DNA, 20 bp, human
gggagtgagcccggcttgtg

SEQ ID NO: 377564 - DNA, 20 bp, human
gactggggccgaggtccggc

SEQ ID NO: 377565 - DNA, 20 bp, human
ggcatggaaccgcccctggg

SEQ ID NO: 377566 - DNA, 20 bp, human
ggccgcgcgctcgcgagttc

SEQ ID NO: 377567 - DNA, 20 bp, human
gcgctcgcgagttcaggtag

SEQ ID NO: 377568 - DNA, 20 bp, human
gccgagcgggcgggtgttgg

SEQ ID NO: 377569 - DNA, 20 bp, human
gcgtggccggagactggcga

SEQ ID NO: 377570 - DNA, 20 bp, human
ggctgcgcgagcgagcgaga

SEQ ID NO: 377571 - DNA, 20 bp, human
gccccgccctcgccagtctc

SEQ ID NO: 377572 - DNA, 20 bp, human
gtccccaggcgcccccgagc

SEQ ID NO: 377573 - DNA, 20 bp, human
ggcgccggctgggttggcag

SEQ ID NO: 377574 - DNA, 20 bp, human
gccgcggcgtggccggagac

SEQ ID NO: 377575 - DNA, 20 bp, human
ggagacggaagcttcggcgg

SEQ ID NO: 377576 - DNA, 20 bp, human
gaagacccccgggagttcgg

SEQ ID NO: 377577 - DNA, 20 bp, human
gtgggccgccgaactcccgg

SEQ ID NO: 377578 - DNA, 20 bp, human
ggaggagcgcggagagccgg

SEQ ID NO: 377579 - DNA, 20 bp, human
gttcggcggcccaggcgctc

SEQ ID NO: 377580 - DNA, 20 bp, human
gctcccgggggtcttctctg

SEQ ID NO: 377581 - DNA, 20 bp, human
ggaggctcgggacgcagagc

SEQ ID NO: 377582 - DNA, 20 bp, human
gaggagcccccgcccgtctg

SEQ ID NO: 377583 - DNA, 20 bp, human
ggcgccacagagaagacccc

SEQ ID NO: 377584 - DNA, 20 bp, human
ggcgctctgcgggtacagcg

SEQ ID NO: 377585 - DNA, 20 bp, human
gcgcgccgggcgcgccgaga

SEQ ID NO: 377586 - DNA, 20 bp, human
gctgactgacggtgataaca

SEQ ID NO: 377587 - DNA, 20 bp, human
ggcagggaggggttcggtca

SEQ ID NO: 377588 - DNA, 20 bp, human
gcccgcctccgggaccgagc

SEQ ID NO: 377589 - DNA, 20 bp, human
gactgaggaaccactgcgac

SEQ ID NO: 377590 - DNA, 20 bp, human
gccgccgcccagacgcactc

SEQ ID NO: 377591 - DNA, 20 bp, human
gacagaccagcgcacgggca

SEQ ID NO: 377592 - DNA, 20 bp, human
ggactggctgataacgtgat

SEQ ID NO: 377593 - DNA, 20 bp, human
gcgcggcgagcacccgcctc

SEQ ID NO: 377594 - DNA, 20 bp, human
ggggttcggtcacggctctc

SEQ ID NO: 377595 - DNA, 20 bp, human
gctctccggttggtccgcgc

SEQ ID NO: 377596 - DNA, 20 bp, human
gcggccccaagcgcgaggag

SEQ ID NO: 377597 - DNA, 20 bp, human
gggcgtcctgacgtcactgg

SEQ ID NO: 377598 - DNA, 20 bp, human
gttggggccgggcctagctt

SEQ ID NO: 377599 - DNA, 20 bp, human
ggcgcctgcgccccaaagct

SEQ ID NO: 377600 - DNA, 20 bp, human
gggcggccgaccccccgccg

SEQ ID NO: 377601 - DNA, 20 bp, human
gtgcgccccaaagctaggcc

SEQ ID NO: 377602 - DNA, 20 bp, human
gccggcccgcgcgggacttg

SEQ ID NO: 377603 - DNA, 20 bp, human
ggcgcgtgctcccggatcct

SEQ ID NO: 377604 - DNA, 20 bp, human
gcacgggcagcggggaccta

SEQ ID NO: 377605 - DNA, 20 bp, human
ggtcggccgccagtgacgtc

SEQ ID NO: 377606 - DNA, 20 bp, human
gcccgcccgggcacggtgga

SEQ ID NO: 377607 - DNA, 20 bp, human
ggcagcggggcgatgaggtg

SEQ ID NO: 377608 - DNA, 20 bp, human
gccccgcgggcgccacgtta

SEQ ID NO: 377609 - DNA, 20 bp, human
ggggaggcgcgcgcacactg

SEQ ID NO: 377610 - DNA, 20 bp, human
gacggcggagggacaccgtg

SEQ ID NO: 377611 - DNA, 20 bp, human
gcccgacggcggagggacaa

SEQ ID NO: 377612 - DNA, 20 bp, human
ggcagggcagcggggcgatg

SEQ ID NO: 377613 - DNA, 20 bp, human
gaaggccgcggcctcgacgg

SEQ ID NO: 377614 - DNA, 20 bp, human
ggccgcaggggaccctaacg

SEQ ID NO: 377615 - DNA, 20 bp, human
gccccgtggaagcgccgcgg

SEQ ID NO: 377616 - DNA, 20 bp, human
ggggcgcggagggaaagagt

SEQ ID NO: 377617 - DNA, 20 bp, human
ggtgagcttcgtagcaacgg

SEQ ID NO: 377618 - DNA, 20 bp, human
gaagctcacggcgctcccat

SEQ ID NO: 377619 - DNA, 20 bp, human
ggccgaaagcgcagtctctc

SEQ ID NO: 377620 - DNA, 20 bp, human
gtcgcggcgtttgacggcgg

SEQ ID NO: 377621 - DNA, 20 bp, human
gcgtagcaacggaggagtgg

SEQ ID NO: 377622 - DNA, 20 bp, human
ggccgtgagcttcgtagcaa

SEQ ID NO: 377623 - DNA, 20 bp, human
gcccgccttcgctcacactg

SEQ ID NO: 377624 - DNA, 20 bp, human
gagttcgcggcgtttgacgg

SEQ ID NO: 377625 - DNA, 20 bp, human
gagagtggggcttggccaat

SEQ ID NO: 377626 - DNA, 20 bp, human
gggagacgaagtcgcgccac

SEQ ID NO: 377627 - DNA, 20 bp, human
gagtgggcggagcgaggcca

SEQ ID NO: 377628 - DNA, 20 bp, human
ggcggagcgaggccagggta

SEQ ID NO: 377629 - DNA, 20 bp, human
gacctctctgaccactctta

SEQ ID NO: 377630 - DNA, 20 bp, human
ggtttgggggcaacaaacta

SEQ ID NO: 377631 - DNA, 20 bp, human
gaggcggccgggcccgcgat

SEQ ID NO: 377632 - DNA, 20 bp, human
gtcccccgtcagtcacgcgg

SEQ ID NO: 377633 - DNA, 20 bp, human
gtcgcgggaaaattaggggt

SEQ ID NO: 377634 - DNA, 20 bp, human
ggcctccgcgtgactgacgg

SEQ ID NO: 377635 - DNA, 20 bp, human
ggattcccccgtcagtcacg

SEQ ID NO: 377636 - DNA, 20 bp, human
gcacggggagaaatgatgaa

SEQ ID NO: 377637 - DNA, 20 bp, human
gaccccgcgccactgagcat

SEQ ID NO: 377638 - DNA, 20 bp, human
gggagaaatgatgaaagggc

SEQ ID NO: 377639 - DNA, 20 bp, human
gcatcgggagagaccattgg

SEQ ID NO: 377640 - DNA, 20 bp, human
gagactggggtgctaaggaa

SEQ ID NO: 377641 - DNA, 20 bp, human
ggagcatcgggagagaccat

SEQ ID NO: 377642 - DNA, 20 bp, human
gtactaggaagggcctggga

SEQ ID NO: 377643 - DNA, 20 bp, human
gggtctctcccgatgctcag

SEQ ID NO: 377644 - DNA, 20 bp, human
gctcagtggcgcggggtagg

SEQ ID NO: 377645 - DNA, 20 bp, human
gtgatgttaggaagacaagt

SEQ ID NO: 377646 - DNA, 20 bp, human
gcccgggccgggaagaaagc

SEQ ID NO: 377647 - DNA, 20 bp, human
ggggtgtggagatagctcag

SEQ ID NO: 377648 - DNA, 20 bp, human
gccgaactaggatgcgtcag

SEQ ID NO: 377649 - DNA, 20 bp, human
ggccgggaagaaagcgggtt

SEQ ID NO: 377650 - DNA, 20 bp, human
gacgcatcctagttcggagt

SEQ ID NO: 377651 - DNA, 20 bp, human
gtagttcggagtgggtggaa

SEQ ID NO: 377652 - DNA, 20 bp, human
gtccaccccgcctagggcga

SEQ ID NO: 377653 - DNA, 20 bp, human
gcgccccctcgccctaggcg

SEQ ID NO: 377654 - DNA, 20 bp, human
gaggactagacgcaagttcc

SEQ ID NO: 377655 - DNA, 20 bp, human
gcccgcgctacagagcacgc

SEQ ID NO: 377656 - DNA, 20 bp, human
gcgtgtcagcggcgagagga

SEQ ID NO: 377657 - DNA, 20 bp, human
gggcgtggcgagagtaccag

SEQ ID NO: 377658 - DNA, 20 bp, human
ggtgactccctgcgcaccgc

SEQ ID NO: 377659 - DNA, 20 bp, human
gctgctgcggtgtgggactg

SEQ ID NO: 377660 - DNA, 20 bp, human
gagggagtcacggcgcgcgg

SEQ ID NO: 377661 - DNA, 20 bp, human
gaaggagagccacctccaag

SEQ ID NO: 377662 - DNA, 20 bp, human
gaggaccgcagcgtgcaagc

SEQ ID NO: 377663 - DNA, 20 bp, human
gtcgccgctgacacgctcag

SEQ ID NO: 377664 - DNA, 20 bp, human
gcctcagcaccgcgacttgc

SEQ ID NO: 377665 - DNA, 20 bp, human
gccggcactgcagcaccagg

SEQ ID NO: 377666 - DNA, 20 bp, human
gcccgggaggagaatgagag

SEQ ID NO: 377667 - DNA, 20 bp, human
gcctcccgggatcaagccaa

SEQ ID NO: 377668 - DNA, 20 bp, human
gacagaaagtagacaggagc

SEQ ID NO: 377669 - DNA, 20 bp, human
ggcagctcgggaactccgga

SEQ ID NO: 377670 - DNA, 20 bp, human
gccagaaccccgcgtctgtc

SEQ ID NO: 377671 - DNA, 20 bp, human
ggggcggccggactcgcaga

SEQ ID NO: 377672 - DNA, 20 bp, human
gccgagagtgccacagtaat

SEQ ID NO: 377673 - DNA, 20 bp, human
gaaaaaaagaggagagcgag

SEQ ID NO: 377674 - DNA, 20 bp, human
gtcgggaactccggagggaa

SEQ ID NO: 377675 - DNA, 20 bp, human
gagacatatgggatcaatca

SEQ ID NO: 377676 - DNA, 20 bp, human
gaatagccctggaaattcag

SEQ ID NO: 377677 - DNA, 20 bp, human
gaacaagctgaaagacagtg

SEQ ID NO: 377678 - DNA, 20 bp, human
ggcctgctgcaacagctgat

SEQ ID NO: 377679 - DNA, 20 bp, human
gagctacaacaatacagatt

SEQ ID NO: 377680 - DNA, 20 bp, human
gggtagatgagctggtatca

SEQ ID NO: 377681 - DNA, 20 bp, human
gctcgagttcaggccataaa

SEQ ID NO: 377682 - DNA, 20 bp, human
gagctacttcaaatgcaatt

SEQ ID NO: 377683 - DNA, 20 bp, human
ggcccatcagctgttgcagc

SEQ ID NO: 377684 - DNA, 20 bp, human
gtgtctgttacttacttttg

SEQ ID NO: 377685 - DNA, 20 bp, human
gcatctaccagaaatagccc

SEQ ID NO: 377686 - DNA, 20 bp, human
gccgcgcgggtcgcaagggg

SEQ ID NO: 377687 - DNA, 20 bp, human
gtgcgcgtgggcgcgtccct

SEQ ID NO: 377688 - DNA, 20 bp, human
gtgcgcgtggccagcaagga

SEQ ID NO: 377689 - DNA, 20 bp, human
gggaaggtctggagactcaa

SEQ ID NO: 377690 - DNA, 20 bp, human
ggcacgcgcccagcggctca

SEQ ID NO: 377691 - DNA, 20 bp, human
ggcgacctgtgccaacgctg

SEQ ID NO: 377692 - DNA, 20 bp, human
gtgggccgggcgcgcgccga

SEQ ID NO: 377693 - DNA, 20 bp, human
ggggccctacaattaatacc

SEQ ID NO: 377694 - DNA, 20 bp, human
gcgcacctgtgaaaaagtcg

SEQ ID NO: 377695 - DNA, 20 bp, human
gcgcctggcggccgacaccc

SEQ ID NO: 377696 - DNA, 20 bp, human
gcggagctgtgggtgaggaa

SEQ ID NO: 377697 - DNA, 20 bp, human
gaggaaggggcaatgcctta

SEQ ID NO: 377698 - DNA, 20 bp, human
ggccacaagcccagcggtcg

SEQ ID NO: 377699 - DNA, 20 bp, human
gtggtgtcgcgagaagaggg

SEQ ID NO: 377700 - DNA, 20 bp, human
gaagcccagcggtcgcgggg

SEQ ID NO: 377701 - DNA, 20 bp, human
ggcggagccgagccagtgga

SEQ ID NO: 377702 - DNA, 20 bp, human
gttgccgcagagaggcgagg

SEQ ID NO: 377703 - DNA, 20 bp, human
gcccccgccccgcgaccgct

SEQ ID NO: 377704 - DNA, 20 bp, human
ggggcaagcgcggaggacca

SEQ ID NO: 377705 - DNA, 20 bp, human
gtgggtagcaatgcagggaa

SEQ ID NO: 377706 - DNA, 20 bp, human
gttgcagttgtcctagtgtg

SEQ ID NO: 377707 - DNA, 20 bp, human
gttacttacaacgggagaaa

SEQ ID NO: 377708 - DNA, 20 bp, human
ggtcctagtgtggggttttc

SEQ ID NO: 377709 - DNA, 20 bp, human
gtatccgtagaatatataca

SEQ ID NO: 377710 - DNA, 20 bp, human
gtcctgttgatggacattct

SEQ ID NO: 377711 - DNA, 20 bp, human
gccccagaaaaccccacact

SEQ ID NO: 377712 - DNA, 20 bp, human
gaagccttgtatatattcta

SEQ ID NO: 377713 - DNA, 20 bp, human
gtgtttaattagcttggctg

SEQ ID NO: 377714 - DNA, 20 bp, human
ggcacattcttgttaactgt

SEQ ID NO: 377715 - DNA, 20 bp, human
gcttggaaatgtacgcatgt

SEQ ID NO: 377716 - DNA, 20 bp, human
gagaggcccggtgtgaaaag

SEQ ID NO: 377717 - DNA, 20 bp, human
gccctcacaaaaatcgaatg

SEQ ID NO: 377718 - DNA, 20 bp, human
gcaattaataaaaagtagta

SEQ ID NO: 377719 - DNA, 20 bp, human
gacctaaaaagtagtaggga

SEQ ID NO: 377720 - DNA, 20 bp, human
ggccttccctactacttttt

SEQ ID NO: 377721 - DNA, 20 bp, human
gctactactttttaggtatg

SEQ ID NO: 377722 - DNA, 20 bp, human
gattttgtgtgtagtgtgcc

SEQ ID NO: 377723 - DNA, 20 bp, human
gttttaggtatgtggctttg

SEQ ID NO: 377724 - DNA, 20 bp, human
gtggatagttagtatatgcc

SEQ ID NO: 377725 - DNA, 20 bp, human
gacctcattcgatttttgtg

SEQ ID NO: 377726 - DNA, 20 bp, human
gcccacagccgccagagtgt

SEQ ID NO: 377727 - DNA, 20 bp, human
gtgtgggcgcggcactggac

SEQ ID NO: 377728 - DNA, 20 bp, human
gcgcagaacccacactctgg

SEQ ID NO: 377729 - DNA, 20 bp, human
gactcgcagaacccacactc

SEQ ID NO: 377730 - DNA, 20 bp, human
ggccaagcattcttgccacc

SEQ ID NO: 377731 - DNA, 20 bp, human
ggggtcaggtgactgcgcgg

SEQ ID NO: 377732 - DNA, 20 bp, human
gagcgccccgcagtgaaaaa

SEQ ID NO: 377733 - DNA, 20 bp, human
gcacccaaaatggcccgaac

SEQ ID NO: 377734 - DNA, 20 bp, human
gtgtggctgcggaggttgag

SEQ ID NO: 377735 - DNA, 20 bp, human
gcgagtcaagccacgcctgg

SEQ ID NO: 377736 - DNA, 20 bp, human
gatactggagcgcagaatgg

SEQ ID NO: 377737 - DNA, 20 bp, human
gagaaatatgaagcggaagg

SEQ ID NO: 377738 - DNA, 20 bp, human
gcccgcccctctcccgaggt

SEQ ID NO: 377739 - DNA, 20 bp, human
gctgcgctccagtatcgccc

SEQ ID NO: 377740 - DNA, 20 bp, human
ggcgatcccggcaaccactg

SEQ ID NO: 377741 - DNA, 20 bp, human
gggcgtaaccagggcgatac

SEQ ID NO: 377742 - DNA, 20 bp, human
gctgatgttccccctaggag

SEQ ID NO: 377743 - DNA, 20 bp, human
ggggactatgggacctagga

SEQ ID NO: 377744 - DNA, 20 bp, human
gctcaaagatcaaagcccat

SEQ ID NO: 377745 - DNA, 20 bp, human
ggcgatactggagcgcagaa

SEQ ID NO: 377746 - DNA, 20 bp, human
gagaacctatgcggaggaat

SEQ ID NO: 377747 - DNA, 20 bp, human
gcaaatggttagaacctatg

SEQ ID NO: 377748 - DNA, 20 bp, human
ggaggaatgggtgcattcga

SEQ ID NO: 377749 - DNA, 20 bp, human
gcacggcttgggcgggacta

SEQ ID NO: 377750 - DNA, 20 bp, human
gtgcacccattcctccgcat

SEQ ID NO: 377751 - DNA, 20 bp, human
gcgtagctctgaccaatcgg

SEQ ID NO: 377752 - DNA, 20 bp, human
gctgaggaatcgagttttga

SEQ ID NO: 377753 - DNA, 20 bp, human
gcttgggcgggactaaggct

SEQ ID NO: 377754 - DNA, 20 bp, human
gtaagtgaactgtaccgatg

SEQ ID NO: 377755 - DNA, 20 bp, human
gaaataagacccttccctga

SEQ ID NO: 377756 - DNA, 20 bp, human
gcgcagaagcgtactgggga

SEQ ID NO: 377757 - DNA, 20 bp, human
gaatctaagcgagcgctgtg

SEQ ID NO: 377758 - DNA, 20 bp, human
ggggtgctgtagtctttgtt

SEQ ID NO: 377759 - DNA, 20 bp, human
gagactgcgcagtgtatcct

SEQ ID NO: 377760 - DNA, 20 bp, human
ggccggagttcaagcctcgg

SEQ ID NO: 377761 - DNA, 20 bp, human
gacactgcgcagtctggggg

SEQ ID NO: 377762 - DNA, 20 bp, human
gagcaggcatacagttggtg

SEQ ID NO: 377763 - DNA, 20 bp, human
gactggggacggcgtccaat

SEQ ID NO: 377764 - DNA, 20 bp, human
gtgagtaggtagtgcggatg

SEQ ID NO: 377765 - DNA, 20 bp, human
gactgcgcagaagcgtactg

SEQ ID NO: 377766 - DNA, 20 bp, human
gagggaaggcagggctacgc

SEQ ID NO: 377767 - DNA, 20 bp, human
ggcggagtcgtcatagaggc

SEQ ID NO: 377768 - DNA, 20 bp, human
gggagatgtccggaagtcgg

SEQ ID NO: 377769 - DNA, 20 bp, human
ggacctagtaggcatgtgga

SEQ ID NO: 377770 - DNA, 20 bp, human
gcgactcccagggagatgtc

SEQ ID NO: 377771 - DNA, 20 bp, human
gtcaccaggggcggagcctt

SEQ ID NO: 377772 - DNA, 20 bp, human
ggttttgtgcgcgtggatag

SEQ ID NO: 377773 - DNA, 20 bp, human
gagccctgcgggacctgaaa

SEQ ID NO: 377774 - DNA, 20 bp, human
gaagcgtcacttccgtccaa

SEQ ID NO: 377775 - DNA, 20 bp, human
gcgcggcggagtcgtcatag

SEQ ID NO: 377776 - DNA, 20 bp, human
gccccgaaggccgcaggtga

SEQ ID NO: 377777 - DNA, 20 bp, human
ggtgccgtggggaaatcggg

SEQ ID NO: 377778 - DNA, 20 bp, human
gggggggcgcggagtgccgt

SEQ ID NO: 377779 - DNA, 20 bp, human
gtagcggcatctccagccca

SEQ ID NO: 377780 - DNA, 20 bp, human
gagctcggcccggtgtaggc

SEQ ID NO: 377781 - DNA, 20 bp, human
gaaggagctcggcccggtgt

SEQ ID NO: 377782 - DNA, 20 bp, human
ggagctgcctctagcgagtg

SEQ ID NO: 377783 - DNA, 20 bp, human
gaagagggtggggtcacccc

SEQ ID NO: 377784 - DNA, 20 bp, human
ggccgcagcctgcctacacc

SEQ ID NO: 377785 - DNA, 20 bp, human
ggagggagggacaccggctc

SEQ ID NO: 377786 - DNA, 20 bp, human
gaaacaggcagctctctccc

SEQ ID NO: 377787 - DNA, 20 bp, human
gcaatcacacatgctcttat

SEQ ID NO: 377788 - DNA, 20 bp, human
gcatgctcttatgggaaaac

SEQ ID NO: 377789 - DNA, 20 bp, human
ggacccatatttttcttacc

SEQ ID NO: 377790 - DNA, 20 bp, human
gtgcagtgtggtgcgatctc

SEQ ID NO: 377791 - DNA, 20 bp, human
gaggaaagaaactgcattct

SEQ ID NO: 377792 - DNA, 20 bp, human
ggcttcacaacacgtcacga

SEQ ID NO: 377793 - DNA, 20 bp, human
gggtgatctgcacagcaaca

SEQ ID NO: 377794 - DNA, 20 bp, human
gatacattaagacaagggtt

SEQ ID NO: 377795 - DNA, 20 bp, human
gtgtgtgttatcattactat

SEQ ID NO: 377796 - DNA, 20 bp, human
gcgcatgcgtaaaggcgcga

SEQ ID NO: 377797 - DNA, 20 bp, human
gtgcccccgcgcatgtgcgc

SEQ ID NO: 377798 - DNA, 20 bp, human
gcatgtgcgctggcttccga

SEQ ID NO: 377799 - DNA, 20 bp, human
gggcgcgagggctacaaacg

SEQ ID NO: 377800 - DNA, 20 bp, human
ggaagccagcgcacatgcgc

SEQ ID NO: 377801 - DNA, 20 bp, human
ggcgagggctacaaacgcgg

SEQ ID NO: 377802 - DNA, 20 bp, human
gtactgctcgttggtgggga

SEQ ID NO: 377803 - DNA, 20 bp, human
gacacatgcgtactgctcgt

SEQ ID NO: 377804 - DNA, 20 bp, human
gggccaatcgcaagcctgga

SEQ ID NO: 377805 - DNA, 20 bp, human
ggaaccagggccggtcccct

SEQ ID NO: 377806 - DNA, 20 bp, human
gcaccagcctccctgtcggt

SEQ ID NO: 377807 - DNA, 20 bp, human
gcagatgctggagcagcgac

SEQ ID NO: 377808 - DNA, 20 bp, human
ggagacatggagagcgttta

SEQ ID NO: 377809 - DNA, 20 bp, human
gagaggacggccaaacgggg

SEQ ID NO: 377810 - DNA, 20 bp, human
ggcccgggagatccgtgccc

SEQ ID NO: 377811 - DNA, 20 bp, human
gtccccccgcccacctggcg

SEQ ID NO: 377812 - DNA, 20 bp, human
gcgctgctccagcatctgcg

SEQ ID NO: 377813 - DNA, 20 bp, human
gacttcgcgagaagcacaaa

SEQ ID NO: 377814 - DNA, 20 bp, human
gagcatctgcgaggacaaag

SEQ ID NO: 377815 - DNA, 20 bp, human
gccaatctgcggctcctcaa

SEQ ID NO: 377816 - DNA, 20 bp, human
ggcgccgtcctgctcccaag

SEQ ID NO: 377817 - DNA, 20 bp, human
gcgcgcagtcggcgcccctt

SEQ ID NO: 377818 - DNA, 20 bp, human
gagaacttgcgcggccaact

SEQ ID NO: 377819 - DNA, 20 bp, human
gacggggcgcccaggttata

SEQ ID NO: 377820 - DNA, 20 bp, human
ggaaactgctgcttaacggt

SEQ ID NO: 377821 - DNA, 20 bp, human
gccctctttgagaacttgcg

SEQ ID NO: 377822 - DNA, 20 bp, human
gtgggcgccccgtggaaccc

SEQ ID NO: 377823 - DNA, 20 bp, human
gggagcaggacggcgcgctc

SEQ ID NO: 377824 - DNA, 20 bp, human
gacttgcgcggccaactggg

SEQ ID NO: 377825 - DNA, 20 bp, human
gtcacaacacactcgtccgc

SEQ ID NO: 377826 - DNA, 20 bp, human
gagggcgagaggtcacttcc

SEQ ID NO: 377827 - DNA, 20 bp, human
gttcccgaggacacccaatg

SEQ ID NO: 377828 - DNA, 20 bp, human
gcggtgctggggacgtcctg

SEQ ID NO: 377829 - DNA, 20 bp, human
gaggtgggggcaaaactgtc

SEQ ID NO: 377830 - DNA, 20 bp, human
gtcggacgccgcagacctgt

SEQ ID NO: 377831 - DNA, 20 bp, human
gtccggggagggttcgctaa

SEQ ID NO: 377832 - DNA, 20 bp, human
gcggcgtccgagtctgggac

SEQ ID NO: 377833 - DNA, 20 bp, human
ggtctgcggcgtccgagtct

SEQ ID NO: 377834 - DNA, 20 bp, human
gggggacgtcctgaggttga

SEQ ID NO: 377835 - DNA, 20 bp, human
ggagggttcgctaacggaaa

SEQ ID NO: 377836 - DNA, 20 bp, human
ggcaacacagagggtggcat

SEQ ID NO: 377837 - DNA, 20 bp, human
gtctcccggctcctgaggga

SEQ ID NO: 377838 - DNA, 20 bp, human
gcgagataaggactcatcga

SEQ ID NO: 377839 - DNA, 20 bp, human
gagacaatagacagaacttg

SEQ ID NO: 377840 - DNA, 20 bp, human
ggcgcccctccctcaggagc

SEQ ID NO: 377841 - DNA, 20 bp, human
gcacaaccctgagtacaagg

SEQ ID NO: 377842 - DNA, 20 bp, human
gagacctgcctaacctaggt

SEQ ID NO: 377843 - DNA, 20 bp, human
gcagcgtccaccttgtactc

SEQ ID NO: 377844 - DNA, 20 bp, human
gtgggcttccgacctaggtt

SEQ ID NO: 377845 - DNA, 20 bp, human
gataaggactcatcgaggga

SEQ ID NO: 377846 - DNA, 20 bp, human
gtcttaggaaggaaacagat

SEQ ID NO: 377847 - DNA, 20 bp, human
ggtaggcaaagtggctctta

SEQ ID NO: 377848 - DNA, 20 bp, human
ggaatgctagggaaactgtc

SEQ ID NO: 377849 - DNA, 20 bp, human
gtggcaagcccacacagcga

SEQ ID NO: 377850 - DNA, 20 bp, human
gggcaaagtggctcttaggg

SEQ ID NO: 377851 - DNA, 20 bp, human
ggataaggacgtaggcaaag

SEQ ID NO: 377852 - DNA, 20 bp, human
ggctaggaacaattgtttcc

SEQ ID NO: 377853 - DNA, 20 bp, human
gctattgtcaaagaatgcta

SEQ ID NO: 377854 - DNA, 20 bp, human
gtggctcttagggtggcttg

SEQ ID NO: 377855 - DNA, 20 bp, human
gtccaagaggtcacaatctt

SEQ ID NO: 377856 - DNA, 20 bp, human
ggaccccggcgagcgttggc

SEQ ID NO: 377857 - DNA, 20 bp, human
gcgctcgcggggcgttcatc

SEQ ID NO: 377858 - DNA, 20 bp, human
gcggggacccactaacctga

SEQ ID NO: 377859 - DNA, 20 bp, human
gcccccgccaacgctcgccg

SEQ ID NO: 377860 - DNA, 20 bp, human
gggcgctgcggcggtccctg

SEQ ID NO: 377861 - DNA, 20 bp, human
gcgctcgccggggtcgcccg

SEQ ID NO: 377862 - DNA, 20 bp, human
ggcgccgggccgacgactcc

SEQ ID NO: 377863 - DNA, 20 bp, human
gcgcccgaggcctgagccaa

SEQ ID NO: 377864 - DNA, 20 bp, human
gggcgtccgcgtagtgtcgg

SEQ ID NO: 377865 - DNA, 20 bp, human
gcaggggcgagctggaccgg

SEQ ID NO: 377866 - DNA, 20 bp, human
gcacacaggccaaaccacct

SEQ ID NO: 377867 - DNA, 20 bp, human
gttaaggcggggcaaaaact

SEQ ID NO: 377868 - DNA, 20 bp, human
gagtgctggctttctcttaa

SEQ ID NO: 377869 - DNA, 20 bp, human
gaaaagccagaggggcggcc

SEQ ID NO: 377870 - DNA, 20 bp, human
ggcaagtaactagcgcacac

SEQ ID NO: 377871 - DNA, 20 bp, human
gccgcccctctggcttttta

SEQ ID NO: 377872 - DNA, 20 bp, human
gccccgccttaaaaagccag

SEQ ID NO: 377873 - DNA, 20 bp, human
gtgcgaaattccaaacagat

SEQ ID NO: 377874 - DNA, 20 bp, human
gggaccaaaaactgctcctc

SEQ ID NO: 377875 - DNA, 20 bp, human
ggtgagtgcgtgcgcccagg

SEQ ID NO: 377876 - DNA, 20 bp, human
gcgggttgcgagtacacttg

SEQ ID NO: 377877 - DNA, 20 bp, human
gcagagcgcaggcgtgaact

SEQ ID NO: 377878 - DNA, 20 bp, human
gccggcggccaaagcaccct

SEQ ID NO: 377879 - DNA, 20 bp, human
gcaccctgggccagctattt

SEQ ID NO: 377880 - DNA, 20 bp, human
gggcgaggctccgcccccat

SEQ ID NO: 377881 - DNA, 20 bp, human
ggggcgcgcaatcgccccat

SEQ ID NO: 377882 - DNA, 20 bp, human
gtactcgcaacccgctccgg

SEQ ID NO: 377883 - DNA, 20 bp, human
gagcgcaggcgtgaactggg

SEQ ID NO: 377884 - DNA, 20 bp, human
ggtgtactcgcaacccgctc

SEQ ID NO: 377885 - DNA, 20 bp, human
gggtgctttggccgccggag

SEQ ID NO: 377886 - DNA, 20 bp, human
gagtcccatccagggagggt

SEQ ID NO: 377887 - DNA, 20 bp, human
gaggtggaagacaagggatc

SEQ ID NO: 377888 - DNA, 20 bp, human
gggccgggaggggttggaat

SEQ ID NO: 377889 - DNA, 20 bp, human
ggatccgctccagcttcgat

SEQ ID NO: 377890 - DNA, 20 bp, human
gcccagagtcccatccaggg

SEQ ID NO: 377891 - DNA, 20 bp, human
gtcacccaccctccctggat

SEQ ID NO: 377892 - DNA, 20 bp, human
gcgctcgggccgcgggaaag

SEQ ID NO: 377893 - DNA, 20 bp, human
gggcccgagcgggcgatgct

SEQ ID NO: 377894 - DNA, 20 bp, human
gagaccaaggaagaagcttg

SEQ ID NO: 377895 - DNA, 20 bp, human
gatcacccagagtcccatcc

SEQ ID NO: 377896 - DNA, 20 bp, human
gtctgcgcccgagcctgagg

SEQ ID NO: 377897 - DNA, 20 bp, human
gactacgaaaacctgcccgg

SEQ ID NO: 377898 - DNA, 20 bp, human
gtcccccggcgtgctcacgt

SEQ ID NO: 377899 - DNA, 20 bp, human
ggcaccccaggcgtctcccg

SEQ ID NO: 377900 - DNA, 20 bp, human
gggctccgaggacagcggag

SEQ ID NO: 377901 - DNA, 20 bp, human
gagggcacccggagcagttg

SEQ ID NO: 377902 - DNA, 20 bp, human
gggccgccccccagagccat

SEQ ID NO: 377903 - DNA, 20 bp, human
gcgagcgcccccaactgctc

SEQ ID NO: 377904 - DNA, 20 bp, human
ggcccctccgcactccccgg

SEQ ID NO: 377905 - DNA, 20 bp, human
gggcgcagactgcgagccgc

SEQ ID NO: 377906 - DNA, 20 bp, human
gcagccgcgaaaagtagcgt

SEQ ID NO: 377907 - DNA, 20 bp, human
gggaagagctcagaatcgga

SEQ ID NO: 377908 - DNA, 20 bp, human
gcgggccgatacgtacgaat

SEQ ID NO: 377909 - DNA, 20 bp, human
gaggtaagtcgccaagaaaa

SEQ ID NO: 377910 - DNA, 20 bp, human
ggccccttccgggaggtctc

SEQ ID NO: 377911 - DNA, 20 bp, human
gtatcggcccgtttgtctga

SEQ ID NO: 377912 - DNA, 20 bp, human
gccaacttccggagacctcc

SEQ ID NO: 377913 - DNA, 20 bp, human
gctaaaagggtcccaacttc

SEQ ID NO: 377914 - DNA, 20 bp, human
ggtagcccattcgtacgtat

SEQ ID NO: 377915 - DNA, 20 bp, human
gtgcagaatagggggctatc

SEQ ID NO: 377916 - DNA, 20 bp, human
gaggcccgcggaatcggccc

SEQ ID NO: 377917 - DNA, 20 bp, human
gcccggagctgggcgggaat

SEQ ID NO: 377918 - DNA, 20 bp, human
gcctgcgaagggcccttgtc

SEQ ID NO: 377919 - DNA, 20 bp, human
gcgggcgaggcccgcggaat

SEQ ID NO: 377920 - DNA, 20 bp, human
gcaggcggcggcaggtgtag

SEQ ID NO: 377921 - DNA, 20 bp, human
gcgaagggcccttgtccggc

SEQ ID NO: 377922 - DNA, 20 bp, human
ggccgcctgggccgattccg

SEQ ID NO: 377923 - DNA, 20 bp, human
ggcgcccatgagcccggagc

SEQ ID NO: 377924 - DNA, 20 bp, human
gcccgcggaatcggcccagg

SEQ ID NO: 377925 - DNA, 20 bp, human
gcgacactgggaggaagtgc

SEQ ID NO: 377926 - DNA, 20 bp, human
gaactggtgtgtgttctgga

SEQ ID NO: 377927 - DNA, 20 bp, human
ggtgagatccccagcagcac

SEQ ID NO: 377928 - DNA, 20 bp, human
ggcggaaaggccaatgtgta

SEQ ID NO: 377929 - DNA, 20 bp, human
gaagaggccccgtgctgctg

SEQ ID NO: 377930 - DNA, 20 bp, human
gtggtcttgaattgctggaa

SEQ ID NO: 377931 - DNA, 20 bp, human
gtggacgatgtctgtaatta

SEQ ID NO: 377932 - DNA, 20 bp, human
gtgctggaatgggtatagcg

SEQ ID NO: 377933 - DNA, 20 bp, human
gcctcaactggtgtgtgttc

SEQ ID NO: 377934 - DNA, 20 bp, human
gaggccaatgtgtagggcag

SEQ ID NO: 377935 - DNA, 20 bp, human
ggagcagctgtctgaccagg

SEQ ID NO: 377936 - DNA, 20 bp, human
gtccgcccggtgcctccgaa

SEQ ID NO: 377937 - DNA, 20 bp, human
gacccagagccggaaatgaa

SEQ ID NO: 377938 - DNA, 20 bp, human
gtctgcccgcctccatacta

SEQ ID NO: 377939 - DNA, 20 bp, human
gggaaatgtagtcccttcgg

SEQ ID NO: 377940 - DNA, 20 bp, human
gtctgctcgccgtagtatgg

SEQ ID NO: 377941 - DNA, 20 bp, human
gcaagaccagccagccgtcc

SEQ ID NO: 377942 - DNA, 20 bp, human
gtcccttcggaggcaccggg

SEQ ID NO: 377943 - DNA, 20 bp, human
gtagtcccttcggaggcacc

SEQ ID NO: 377944 - DNA, 20 bp, human
gtgggtccggctaggccttc

SEQ ID NO: 377945 - DNA, 20 bp, human
ggcctagccggacccagagc

SEQ ID NO: 377946 - DNA, 20 bp, human
gaccgccgcctcagcactga

SEQ ID NO: 377947 - DNA, 20 bp, human
gggggcgaaggcactgtccg

SEQ ID NO: 377948 - DNA, 20 bp, human
gcgaccaaggtggccgggaa

SEQ ID NO: 377949 - DNA, 20 bp, human
gcggacgcgaccaaggtggc

SEQ ID NO: 377950 - DNA, 20 bp, human
gggcgcggacgcgaccaagg

SEQ ID NO: 377951 - DNA, 20 bp, human
gcgcgccttcagtgctgagg

SEQ ID NO: 377952 - DNA, 20 bp, human
gaccacgcgaggcgcgagat

SEQ ID NO: 377953 - DNA, 20 bp, human
gccgggaaggggagtttgcg

SEQ ID NO: 377954 - DNA, 20 bp, human
gtgccttcgcccccgcctgg

SEQ ID NO: 377955 - DNA, 20 bp, human
ggcgcatcccctatcagaga

SEQ ID NO: 377956 - DNA, 20 bp, human
gtccccgcatagtcacgctc

SEQ ID NO: 377957 - DNA, 20 bp, human
ggactctcggggcttgcagg

SEQ ID NO: 377958 - DNA, 20 bp, human
ggcgcgtctggcgactctcg

SEQ ID NO: 377959 - DNA, 20 bp, human
ggctaggtgccctccgtgag

SEQ ID NO: 377960 - DNA, 20 bp, human
gtgactatgcggggagggcg

SEQ ID NO: 377961 - DNA, 20 bp, human
gaacctgagcgtgactatgc

SEQ ID NO: 377962 - DNA, 20 bp, human
gggcgcgaggctcgcggaga

SEQ ID NO: 377963 - DNA, 20 bp, human
gccagctgaaatggaggcga

SEQ ID NO: 377964 - DNA, 20 bp, human
gaggtgtcagcctccctatg

SEQ ID NO: 377965 - DNA, 20 bp, human
ggtgccctccgtgagcgggg

SEQ ID NO: 377966 - DNA, 20 bp, human
gcgcgcgcgttgaggggcag

SEQ ID NO: 377967 - DNA, 20 bp, human
gccagcaaggcgttggggag

SEQ ID NO: 377968 - DNA, 20 bp, human
gtggggagaggcgtgggcga

SEQ ID NO: 377969 - DNA, 20 bp, human
gaggcgttggggagaggcgt

SEQ ID NO: 377970 - DNA, 20 bp, human
gcgcggcgccccattggctc

SEQ ID NO: 377971 - DNA, 20 bp, human
gtgaacccagcaaggcgttg

SEQ ID NO: 377972 - DNA, 20 bp, human
gccgcgccgcggcgccccat

SEQ ID NO: 377973 - DNA, 20 bp, human
ggggtgggcggggccgtccg

SEQ ID NO: 377974 - DNA, 20 bp, human
gaggggcgtctagacactcc

SEQ ID NO: 377975 - DNA, 20 bp, human
ggggcaacgaggcccccgga

SEQ ID NO: 377976 - DNA, 20 bp, human
gagaaggttcgggaagacga

SEQ ID NO: 377977 - DNA, 20 bp, human
gtgcaacgggacctcacgaa

SEQ ID NO: 377978 - DNA, 20 bp, human
gtggccggggctcctgccgg

SEQ ID NO: 377979 - DNA, 20 bp, human
gcccggaccagcctggggcg

SEQ ID NO: 377980 - DNA, 20 bp, human
gcgggcgcgcccacttggcc

SEQ ID NO: 377981 - DNA, 20 bp, human
ggacacccccaaacactcgc

SEQ ID NO: 377982 - DNA, 20 bp, human
ggacagggaaggtgctccct

SEQ ID NO: 377983 - DNA, 20 bp, human
ggggttagagagaactgcgg

SEQ ID NO: 377984 - DNA, 20 bp, human
ggcagggggagtcagaaggg

SEQ ID NO: 377985 - DNA, 20 bp, human
gcggcccttcccctcttggg

SEQ ID NO: 377986 - DNA, 20 bp, human
gggcgcgcgtcccgaggcgt

SEQ ID NO: 377987 - DNA, 20 bp, human
gggaaggcggcgcggcgtgg

SEQ ID NO: 377988 - DNA, 20 bp, human
gcgccaccgtcggagcggaa

SEQ ID NO: 377989 - DNA, 20 bp, human
ggggcgggcgggagctcggt

SEQ ID NO: 377990 - DNA, 20 bp, human
ggcgcatggtgtcgcgggga

SEQ ID NO: 377991 - DNA, 20 bp, human
ggggagggggagtgtcggga

SEQ ID NO: 377992 - DNA, 20 bp, human
gagaaagagaggagccgact

SEQ ID NO: 377993 - DNA, 20 bp, human
gcaccgtcggagcggaaggg

SEQ ID NO: 377994 - DNA, 20 bp, human
gcccgcgggcgcgcgtcccg

SEQ ID NO: 377995 - DNA, 20 bp, human
gggcgtgcgcatggtgtcgc

SEQ ID NO: 377996 - DNA, 20 bp, human
gtcggcccccgggagaggaa

SEQ ID NO: 377997 - DNA, 20 bp, human
gtggacgcgatcccccgcta

SEQ ID NO: 377998 - DNA, 20 bp, human
ggggcggagcccaaccctct

SEQ ID NO: 377999 - DNA, 20 bp, human
gcgaaggtggccaccaactt

SEQ ID NO: 378000 - DNA, 20 bp, human
gaccagggaggccctagcgg

SEQ ID NO: 378001 - DNA, 20 bp, human
gagcccgagcggcggggagt

SEQ ID NO: 378002 - DNA, 20 bp, human
ggggaggcctttaggaccga

SEQ ID NO: 378003 - DNA, 20 bp, human
gtcccccgctagggcctccc

SEQ ID NO: 378004 - DNA, 20 bp, human
gtgctgcccgactagaggaa

SEQ ID NO: 378005 - DNA, 20 bp, human
gatagctgcgggggactagg

SEQ ID NO: 378006 - DNA, 20 bp, human
gcgggtccggagtgcctggt

SEQ ID NO: 378007 - DNA, 20 bp, human
gaacccgcgtacccgcttcc

SEQ ID NO: 378008 - DNA, 20 bp, human
ggtgcctggtgggctgattc

SEQ ID NO: 378009 - DNA, 20 bp, human
gcaagggcctcccatcgctc

SEQ ID NO: 378010 - DNA, 20 bp, human
ggctccaggaagcgggtacg

SEQ ID NO: 378011 - DNA, 20 bp, human
gtggaagggagcacggagca

SEQ ID NO: 378012 - DNA, 20 bp, human
gggaggaggcggcgaagcga

SEQ ID NO: 378013 - DNA, 20 bp, human
gggcactccggacccggctc

SEQ ID NO: 378014 - DNA, 20 bp, human
gggaaagagggctcggctcc

SEQ ID NO: 378015 - DNA, 20 bp, human
gatcagcccaccaggcactc

SEQ ID NO: 378016 - DNA, 20 bp, human
ggcagcgcgtcccggctctc

SEQ ID NO: 378017 - DNA, 20 bp, human
ggagcggaacctatcctgaa

SEQ ID NO: 378018 - DNA, 20 bp, human
gggaggtggtcccggtataa

SEQ ID NO: 378019 - DNA, 20 bp, human
gacctcccgggggtcgaggt

SEQ ID NO: 378020 - DNA, 20 bp, human
ggcccttcctgggaccatca

SEQ ID NO: 378021 - DNA, 20 bp, human
gtaccgggaccacctcccgg

SEQ ID NO: 378022 - DNA, 20 bp, human
gaatttgagggagactggtc

SEQ ID NO: 378023 - DNA, 20 bp, human
gcccgggtgacctttctgag

SEQ ID NO: 378024 - DNA, 20 bp, human
ggaacctatcctgaaaggct

SEQ ID NO: 378025 - DNA, 20 bp, human
gcccgggcagtggaaaccgt

SEQ ID NO: 378026 - DNA, 20 bp, human
gaggaggaaccggtcgcgga

SEQ ID NO: 378027 - DNA, 20 bp, human
gggaggtggtcccggtataa

SEQ ID NO: 378028 - DNA, 20 bp, human
gcggggacccggaggctcgc

SEQ ID NO: 378029 - DNA, 20 bp, human
ggcagcgcgtcccggctctc

SEQ ID NO: 378030 - DNA, 20 bp, human
gcgcccgcgctcaccctggc

SEQ ID NO: 378031 - DNA, 20 bp, human
gacctcccgggggtcgaggt

SEQ ID NO: 378032 - DNA, 20 bp, human
gtaccgggaccacctcccgg

SEQ ID NO: 378033 - DNA, 20 bp, human
ggcccggctccgggatgcgc

SEQ ID NO: 378034 - DNA, 20 bp, human
gagccagccagggtgagcgc

SEQ ID NO: 378035 - DNA, 20 bp, human
gaaggccgtgcatctccagg

SEQ ID NO: 378036 - DNA, 20 bp, human
gggacatcagaggtggtgtg

SEQ ID NO: 378037 - DNA, 20 bp, human
gtggcgggcgcgctctacac

SEQ ID NO: 378038 - DNA, 20 bp, human
gtgctccgccccggcgctgg

SEQ ID NO: 378039 - DNA, 20 bp, human
gggagaaagttgcccgcccc

SEQ ID NO: 378040 - DNA, 20 bp, human
gctccctcaaaaagctcttc

SEQ ID NO: 378041 - DNA, 20 bp, human
ggaggggcgagcgcgggacc

SEQ ID NO: 378042 - DNA, 20 bp, human
ggctctacactggccgccga

SEQ ID NO: 378043 - DNA, 20 bp, human
gcccaggaatctacgggtgt

SEQ ID NO: 378044 - DNA, 20 bp, human
gtacccggggctgggtgaac

SEQ ID NO: 378045 - DNA, 20 bp, human
gccgtcttttgggacatcag

SEQ ID NO: 378046 - DNA, 20 bp, human
gaggaagcagggaacctgag

SEQ ID NO: 378047 - DNA, 20 bp, human
gagaggtgagcacgtttgtc

SEQ ID NO: 378048 - DNA, 20 bp, human
ggacccccggcaggacacct

SEQ ID NO: 378049 - DNA, 20 bp, human
gtgtcccaggtgtcctgccg

SEQ ID NO: 378050 - DNA, 20 bp, human
gcctgcccatggacccaggt

SEQ ID NO: 378051 - DNA, 20 bp, human
gttaggcagggaatgaaaac

SEQ ID NO: 378052 - DNA, 20 bp, human
gctcccctggtgctcccagt

SEQ ID NO: 378053 - DNA, 20 bp, human
ggtcaggaatggaattaggc

SEQ ID NO: 378054 - DNA, 20 bp, human
gcctctgggaaaactggcct

SEQ ID NO: 378055 - DNA, 20 bp, human
gtgcccaactgggagcacca

SEQ ID NO: 378056 - DNA, 20 bp, human
gtatctggaaccctcttgga

SEQ ID NO: 378057 - DNA, 20 bp, human
ggggactagctgatccccgg

SEQ ID NO: 378058 - DNA, 20 bp, human
gctgaggggagcggcatcta

SEQ ID NO: 378059 - DNA, 20 bp, human
gcactccacgccatccaaga

SEQ ID NO: 378060 - DNA, 20 bp, human
gaggctgcagggcgggttga

SEQ ID NO: 378061 - DNA, 20 bp, human
gcagggctcaagaagtcggg

SEQ ID NO: 378062 - DNA, 20 bp, human
ggctctgccgtccctcggga

SEQ ID NO: 378063 - DNA, 20 bp, human
ggtggcgcaggggttctatc

SEQ ID NO: 378064 - DNA, 20 bp, human
ggagaggtcggtagcctccg

SEQ ID NO: 378065 - DNA, 20 bp, human
gagctactggcctgctaggg

SEQ ID NO: 378066 - DNA, 20 bp, human
gaatctgggcctcccggagt

SEQ ID NO: 378067 - DNA, 20 bp, human
gcctcccggagtaggggtgg

SEQ ID NO: 378068 - DNA, 20 bp, human
gctagggtctctctgtctca

SEQ ID NO: 378069 - DNA, 20 bp, human
ggcggcagccgagagagagg

SEQ ID NO: 378070 - DNA, 20 bp, human
gtccctgaaatcatcatctc

SEQ ID NO: 378071 - DNA, 20 bp, human
gtcaaattaccccacagtgg

SEQ ID NO: 378072 - DNA, 20 bp, human
gccgagagagagggggggcg

SEQ ID NO: 378073 - DNA, 20 bp, human
gtctcacaatctgggcctcc

SEQ ID NO: 378074 - DNA, 20 bp, human
gacacagggccaaaatctag

SEQ ID NO: 378075 - DNA, 20 bp, human
ggtctggggtctgcatcttt

SEQ ID NO: 378076 - DNA, 20 bp, human
ggctcagaggggctgcgacc

SEQ ID NO: 378077 - DNA, 20 bp, human
gcggccgcgcgcgcagggga

SEQ ID NO: 378078 - DNA, 20 bp, human
gcggcccagggctcccgcga

SEQ ID NO: 378079 - DNA, 20 bp, human
ggcgcacgacgccccctcgc

SEQ ID NO: 378080 - DNA, 20 bp, human
gggcgcgctcgcagccagtg

SEQ ID NO: 378081 - DNA, 20 bp, human
gctgggcagcgcgcgacctc

SEQ ID NO: 378082 - DNA, 20 bp, human
ggcaggggaccggggatgcg

SEQ ID NO: 378083 - DNA, 20 bp, human
gtgcaaagaggtcaccgcac

SEQ ID NO: 378084 - DNA, 20 bp, human
gcagagccgacggctcagag

SEQ ID NO: 378085 - DNA, 20 bp, human
gggaccggggatgcggggca

SEQ ID NO: 378086 - DNA, 20 bp, human
ggggttgaggggctagtctc

SEQ ID NO: 378087 - DNA, 20 bp, human
gtagcccctcaaccccgagg

SEQ ID NO: 378088 - DNA, 20 bp, human
gaggcgccgctagggaccga

SEQ ID NO: 378089 - DNA, 20 bp, human
gcgcttctagaggcggggag

SEQ ID NO: 378090 - DNA, 20 bp, human
gggactgcgcttctagaggc

SEQ ID NO: 378091 - DNA, 20 bp, human
gccgggtccaccccacctcg

SEQ ID NO: 378092 - DNA, 20 bp, human
gaaagtgcggccctcgcgag

SEQ ID NO: 378093 - DNA, 20 bp, human
gcaccccacctcggggttga

SEQ ID NO: 378094 - DNA, 20 bp, human
ggctcgcccgccgctcgcga

SEQ ID NO: 378095 - DNA, 20 bp, human
ggactagcccctcaaccccg

SEQ ID NO: 378096 - DNA, 20 bp, human
gtaaaggggtaggaggtcca

SEQ ID NO: 378097 - DNA, 20 bp, human
gcgcgcccgcgccccccact

SEQ ID NO: 378098 - DNA, 20 bp, human
gccaccagccaggtccccgg

SEQ ID NO: 378099 - DNA, 20 bp, human
ggcctgccccggtcccgaga

SEQ ID NO: 378100 - DNA, 20 bp, human
gaggtccccgggggcagggt

SEQ ID NO: 378101 - DNA, 20 bp, human
gcccgcgcgcatggacccag

SEQ ID NO: 378102 - DNA, 20 bp, human
gcgcgcatggacccagtggg

SEQ ID NO: 378103 - DNA, 20 bp, human
gagccggtcccctctcccgt

SEQ ID NO: 378104 - DNA, 20 bp, human
gtgggaagggcacttgggtg

SEQ ID NO: 378105 - DNA, 20 bp, human
gctggcggggaggatctggt

SEQ ID NO: 378106 - DNA, 20 bp, human
gcccgcgcgcagtccgccaa

SEQ ID NO: 378107 - DNA, 20 bp, human
gtggacgcgagactccctag

SEQ ID NO: 378108 - DNA, 20 bp, human
gctcctgagtaggcggaaag

SEQ ID NO: 378109 - DNA, 20 bp, human
gcgagactccctagagggat

SEQ ID NO: 378110 - DNA, 20 bp, human
gaccccgccccatccctcta

SEQ ID NO: 378111 - DNA, 20 bp, human
gcaggagctgacacgagccg

SEQ ID NO: 378112 - DNA, 20 bp, human
gacaaagggaaggggcggtg

SEQ ID NO: 378113 - DNA, 20 bp, human
gcagctgtggaggagcgaaa

SEQ ID NO: 378114 - DNA, 20 bp, human
gtgagtaggcggaaagaggg

SEQ ID NO: 378115 - DNA, 20 bp, human
gtggccctccagagaagggg

SEQ ID NO: 378116 - DNA, 20 bp, human
gaaggggcggggcatcagga

SEQ ID NO: 378117 - DNA, 20 bp, human
gggcgcaatgcggaagagat

SEQ ID NO: 378118 - DNA, 20 bp, human
gccccggccgcggcgcaatg

SEQ ID NO: 378119 - DNA, 20 bp, human
gccgccccgcgcgagggaag

SEQ ID NO: 378120 - DNA, 20 bp, human
gcagccggtcggcgcagagt

SEQ ID NO: 378121 - DNA, 20 bp, human
ggaagatccgccccgcgcga

SEQ ID NO: 378122 - DNA, 20 bp, human
gaggaagggctcgggacggt

SEQ ID NO: 378123 - DNA, 20 bp, human
ggggcggccgcaggaggcaa

SEQ ID NO: 378124 - DNA, 20 bp, human
gacgctcccggcggctgtgg

SEQ ID NO: 378125 - DNA, 20 bp, human
ggcggaagtgacgctcccgg

SEQ ID NO: 378126 - DNA, 20 bp, human
ggggccgggctgcccatata

SEQ ID NO: 378127 - DNA, 20 bp, human
gggaatgcgtggcatccggg

SEQ ID NO: 378128 - DNA, 20 bp, human
gtggggaggcgcgagtgggg

SEQ ID NO: 378129 - DNA, 20 bp, human
ggccgcccgcagccttatat

SEQ ID NO: 378130 - DNA, 20 bp, human
ggcgcgccctcacctgcccc

SEQ ID NO: 378131 - DNA, 20 bp, human
gggccccgcgctccccccag

SEQ ID NO: 378132 - DNA, 20 bp, human
gccccggcgggaacagtcag

SEQ ID NO: 378133 - DNA, 20 bp, human
ggcggcgcaaagtgaaactc

SEQ ID NO: 378134 - DNA, 20 bp, human
gccgctccacgcccgcctgc

SEQ ID NO: 378135 - DNA, 20 bp, human
gcgaggaatgcgtggcatcc

SEQ ID NO: 378136 - DNA, 20 bp, human
ggggtggctagtaaaagtaa

SEQ ID NO: 378137 - DNA, 20 bp, human
gaaaggaagcccgaaggact

SEQ ID NO: 378138 - DNA, 20 bp, human
gctgggaatgctgggaatcg

SEQ ID NO: 378139 - DNA, 20 bp, human
gcagcctcgagacccggaaa

SEQ ID NO: 378140 - DNA, 20 bp, human
gatggattgcagtttctcac

SEQ ID NO: 378141 - DNA, 20 bp, human
gcaagcatgaggtgagcaag

SEQ ID NO: 378142 - DNA, 20 bp, human
gccagtgctccgagtccttc

SEQ ID NO: 378143 - DNA, 20 bp, human
ggttcccaaagccaagcatg

SEQ ID NO: 378144 - DNA, 20 bp, human
gactgcaatccattggcggt

SEQ ID NO: 378145 - DNA, 20 bp, human
gtcgtggttcctaccgccaa

SEQ ID NO: 378146 - DNA, 20 bp, human
ggggtggctagtaaaagtaa

SEQ ID NO: 378147 - DNA, 20 bp, human
gaaaggaagcccgaaggact

SEQ ID NO: 378148 - DNA, 20 bp, human
gctgggaatgctgggaatcg

SEQ ID NO: 378149 - DNA, 20 bp, human
gcagcctcgagacccggaaa

SEQ ID NO: 378150 - DNA, 20 bp, human
gatggattgcagtttctcac

SEQ ID NO: 378151 - DNA, 20 bp, human
gcaagcatgaggtgagcaag

SEQ ID NO: 378152 - DNA, 20 bp, human
gccagtgctccgagtccttc

SEQ ID NO: 378153 - DNA, 20 bp, human
ggttcccaaagccaagcatg

SEQ ID NO: 378154 - DNA, 20 bp, human
gactgcaatccattggcggt

SEQ ID NO: 378155 - DNA, 20 bp, human
gtcgtggttcctaccgccaa

SEQ ID NO: 378156 - DNA, 20 bp, human
gcgggcagtcgggtaacagc

SEQ ID NO: 378157 - DNA, 20 bp, human
gcggccgcaggtggtcggtg

SEQ ID NO: 378158 - DNA, 20 bp, human
gtaacagcgggcggggtggc

SEQ ID NO: 378159 - DNA, 20 bp, human
gcagtcgggtaacagcgggc

SEQ ID NO: 378160 - DNA, 20 bp, human
gcggacggggcgggcagact

SEQ ID NO: 378161 - DNA, 20 bp, human
gcggccgccaaggtgcggca

SEQ ID NO: 378162 - DNA, 20 bp, human
ggggcgggcggcctgggcga

SEQ ID NO: 378163 - DNA, 20 bp, human
ggtggtcggtgcgggcagtc

SEQ ID NO: 378164 - DNA, 20 bp, human
ggcggggtggcgggctagcc

SEQ ID NO: 378165 - DNA, 20 bp, human
ggaaaagccaccaatctcca

SEQ ID NO: 378166 - DNA, 20 bp, human
ggcccccgcctggagatggg

SEQ ID NO: 378167 - DNA, 20 bp, human
gggagggagtcgcaccccca

SEQ ID NO: 378168 - DNA, 20 bp, human
gcctcctagccgaaggagat

SEQ ID NO: 378169 - DNA, 20 bp, human
gtatggggacagaatcacaa

SEQ ID NO: 378170 - DNA, 20 bp, human
ggacccactggtgaagtcag

SEQ ID NO: 378171 - DNA, 20 bp, human
ggagagtgaggcacagcgag

SEQ ID NO: 378172 - DNA, 20 bp, human
gaaagagaggtgcccccgcc

SEQ ID NO: 378173 - DNA, 20 bp, human
gtactggggctgagacatag

SEQ ID NO: 378174 - DNA, 20 bp, human
ggagacatagcggggaagat

SEQ ID NO: 378175 - DNA, 20 bp, human
gtctgtatcgctaggtcggt

SEQ ID NO: 378176 - DNA, 20 bp, human
gcgtggggcgggtagattgg

SEQ ID NO: 378177 - DNA, 20 bp, human
gggcatgagtggagcccgga

SEQ ID NO: 378178 - DNA, 20 bp, human
gtgccctcagcaacagtgga

SEQ ID NO: 378179 - DNA, 20 bp, human
gaacagtggagggagttcag

SEQ ID NO: 378180 - DNA, 20 bp, human
gtgggcaggccccgatagca

SEQ ID NO: 378181 - DNA, 20 bp, human
gggggcgggtagattggcgg

SEQ ID NO: 378182 - DNA, 20 bp, human
gggagggaggaagatgaatc

SEQ ID NO: 378183 - DNA, 20 bp, human
gaagatgaatctggcagcgt

SEQ ID NO: 378184 - DNA, 20 bp, human
gggtggagaggccatttaaa

SEQ ID NO: 378185 - DNA, 20 bp, human
gcaggacatggaggatcaag

SEQ ID NO: 378186 - DNA, 20 bp, human
gctcacgtggggcgagataa

SEQ ID NO: 378187 - DNA, 20 bp, human
ggggcgagataagggaaagg

SEQ ID NO: 378188 - DNA, 20 bp, human
gcgcctgctgcgaatttgtg

SEQ ID NO: 378189 - DNA, 20 bp, human
gaggagagtgacgcaagagt

SEQ ID NO: 378190 - DNA, 20 bp, human
gcctgccgaggacgcaagac

SEQ ID NO: 378191 - DNA, 20 bp, human
gaatgggctcattctcaagg

SEQ ID NO: 378192 - DNA, 20 bp, human
gtcgaaggtgggccgagcaa

SEQ ID NO: 378193 - DNA, 20 bp, human
gttacccagtcttgcgtcct

SEQ ID NO: 378194 - DNA, 20 bp, human
gtcggcccaccttcgaggaa

SEQ ID NO: 378195 - DNA, 20 bp, human
ggctgctttcctttcctcga

SEQ ID NO: 378196 - DNA, 20 bp, human
gtctaggagtaacacagaag

SEQ ID NO: 378197 - DNA, 20 bp, human
gctggactgtaatgatccca

SEQ ID NO: 378198 - DNA, 20 bp, human
gggagaattgggaacatgga

SEQ ID NO: 378199 - DNA, 20 bp, human
gaggcccatgcaggagaatt

SEQ ID NO: 378200 - DNA, 20 bp, human
gaaccaatgtacaccctttc

SEQ ID NO: 378201 - DNA, 20 bp, human
gttcctgaaagggtgtacat

SEQ ID NO: 378202 - DNA, 20 bp, human
ggttgcctgcctgtggtgtg

SEQ ID NO: 378203 - DNA, 20 bp, human
gccttctctaataggaccat

SEQ ID NO: 378204 - DNA, 20 bp, human
gtgagcacatctgcgattga

SEQ ID NO: 378205 - DNA, 20 bp, human
gactcagaatacaaactctc

SEQ ID NO: 378206 - DNA, 20 bp, human
gcccaccccagtagacaatg

SEQ ID NO: 378207 - DNA, 20 bp, human
gagtgccggtgtgatggatg

SEQ ID NO: 378208 - DNA, 20 bp, human
gcatcacaccggcacttgtg

SEQ ID NO: 378209 - DNA, 20 bp, human
gcagtctcatccagcattat

SEQ ID NO: 378210 - DNA, 20 bp, human
ggaggaaagcataggatcct

SEQ ID NO: 378211 - DNA, 20 bp, human
gacctcattgtctactgggg

SEQ ID NO: 378212 - DNA, 20 bp, human
ggtgcccacatccatcacac

SEQ ID NO: 378213 - DNA, 20 bp, human
ggggctttaaaaggcgtggg

SEQ ID NO: 378214 - DNA, 20 bp, human
ggctctggggacaagacaaa

SEQ ID NO: 378215 - DNA, 20 bp, human
gcctgagtgtccaatatccc

SEQ ID NO: 378216 - DNA, 20 bp, human
gcagccgcgctccagagggg

SEQ ID NO: 378217 - DNA, 20 bp, human
gggcccacagacattggtgc

SEQ ID NO: 378218 - DNA, 20 bp, human
ggagcctgcaccaatgtctg

SEQ ID NO: 378219 - DNA, 20 bp, human
gccagagggcaccgggcgca

SEQ ID NO: 378220 - DNA, 20 bp, human
gctggctccggggaaacttt

SEQ ID NO: 378221 - DNA, 20 bp, human
ggggcagggtagatacaaca

SEQ ID NO: 378222 - DNA, 20 bp, human
gggggaaactttgggtctgt

SEQ ID NO: 378223 - DNA, 20 bp, human
gcccggagccagagggcacc

SEQ ID NO: 378224 - DNA, 20 bp, human
gactttgggtctgttggttt

SEQ ID NO: 378225 - DNA, 20 bp, human
gttggccagccgcgctccag

SEQ ID NO: 378226 - DNA, 20 bp, human
ggtcgcgggcgcctctccaa

SEQ ID NO: 378227 - DNA, 20 bp, human
ggcgcgccacgcctccccga

SEQ ID NO: 378228 - DNA, 20 bp, human
ggtgactcccccggccctcg

SEQ ID NO: 378229 - DNA, 20 bp, human
gtgaatctgggggacccctg

SEQ ID NO: 378230 - DNA, 20 bp, human
gacgcctccccgagggccgg

SEQ ID NO: 378231 - DNA, 20 bp, human
ggcgccgggtcacgtgccgt

SEQ ID NO: 378232 - DNA, 20 bp, human
ggcgcccacggcacgtgacc

SEQ ID NO: 378233 - DNA, 20 bp, human
gcgggctggtggggcggtcg

SEQ ID NO: 378234 - DNA, 20 bp, human
gcgccccatcgcccggtccg

SEQ ID NO: 378235 - DNA, 20 bp, human
gcccggtccgcggcgaggtg

SEQ ID NO: 378236 - DNA, 20 bp, human
gggttgtaccacagtctcac

SEQ ID NO: 378237 - DNA, 20 bp, human
gcgcgtggcgggcaaggagg

SEQ ID NO: 378238 - DNA, 20 bp, human
gatggctgccggtgagactg

SEQ ID NO: 378239 - DNA, 20 bp, human
gttgggaaaacacaagtcga

SEQ ID NO: 378240 - DNA, 20 bp, human
ggtctcaccggcagccattc

SEQ ID NO: 378241 - DNA, 20 bp, human
gaccggcagccattccggcc

SEQ ID NO: 378242 - DNA, 20 bp, human
gtccgggccggaatggctgc

SEQ ID NO: 378243 - DNA, 20 bp, human
gagcgtgcgggaatatgcgt

SEQ ID NO: 378244 - DNA, 20 bp, human
ggctgtgcgcaggcgcgtgg

SEQ ID NO: 378245 - DNA, 20 bp, human
gtccagcctccgggccggaa

SEQ ID NO: 378246 - DNA, 20 bp, human
ggggcggaaacggagtgggg

SEQ ID NO: 378247 - DNA, 20 bp, human
ggggcgcggcgcacgcagta

SEQ ID NO: 378248 - DNA, 20 bp, human
ggggctgaaccgcagggaag

SEQ ID NO: 378249 - DNA, 20 bp, human
ggcgaagagccctgacccgg

SEQ ID NO: 378250 - DNA, 20 bp, human
gtctggggcggaaacggagt

SEQ ID NO: 378251 - DNA, 20 bp, human
gtgccaggggctgaaccgca

SEQ ID NO: 378252 - DNA, 20 bp, human
gggggaagaccgagtgccag

SEQ ID NO: 378253 - DNA, 20 bp, human
ggcagcccggtggcgaggaa

SEQ ID NO: 378254 - DNA, 20 bp, human
gactgcgaagagccctgacc

SEQ ID NO: 378255 - DNA, 20 bp, human
ggtgagctcggggtcaagtg

SEQ ID NO: 378256 - DNA, 20 bp, human
gtgcccggcgagcggagaaa

SEQ ID NO: 378257 - DNA, 20 bp, human
gcggtggggaccggtcccgg

SEQ ID NO: 378258 - DNA, 20 bp, human
gcccgcggcggaactaacca

SEQ ID NO: 378259 - DNA, 20 bp, human
ggaggcctctggtcccttta

SEQ ID NO: 378260 - DNA, 20 bp, human
gtcctcctcgccgaagcctc

SEQ ID NO: 378261 - DNA, 20 bp, human
gtctcggtggggaccggtcc

SEQ ID NO: 378262 - DNA, 20 bp, human
gcggccgcggtgtctcggtg

SEQ ID NO: 378263 - DNA, 20 bp, human
ggcggcggaactaaccacgg

SEQ ID NO: 378264 - DNA, 20 bp, human
gggaccggtcccggaggctt

SEQ ID NO: 378265 - DNA, 20 bp, human
gggtcccggaggcttcggcg

SEQ ID NO: 378266 - DNA, 20 bp, human
gagagggcgcgcaagctctg

SEQ ID NO: 378267 - DNA, 20 bp, human
gaaacggaagagaggaacga

SEQ ID NO: 378268 - DNA, 20 bp, human
ggtgaaggcaaacggaagag

SEQ ID NO: 378269 - DNA, 20 bp, human
gtacctggttcaggaggttc

SEQ ID NO: 378270 - DNA, 20 bp, human
gaggacgcggtaatgatgtt

SEQ ID NO: 378271 - DNA, 20 bp, human
gagcttgcgcgccctctaga

SEQ ID NO: 378272 - DNA, 20 bp, human
gctatccggctgcttgtacc

SEQ ID NO: 378273 - DNA, 20 bp, human
gtaggaaagaaacgtttccg

SEQ ID NO: 378274 - DNA, 20 bp, human
gtccggggaaagcagcggag

SEQ ID NO: 378275 - DNA, 20 bp, human
ggcggcaggagcggctgcgt

SEQ ID NO: 378276 - DNA, 20 bp, human
ggtggagccaatcaggatgc

SEQ ID NO: 378277 - DNA, 20 bp, human
gcccgcgcactaataatagg

SEQ ID NO: 378278 - DNA, 20 bp, human
ggaactgggatgggcgatgt

SEQ ID NO: 378279 - DNA, 20 bp, human
ggctggggctcggagatgat

SEQ ID NO: 378280 - DNA, 20 bp, human
ggagagacactaacagaact

SEQ ID NO: 378281 - DNA, 20 bp, human
gtggcgcagcgtacccgagg

SEQ ID NO: 378282 - DNA, 20 bp, human
gtcctcactggagggattcc

SEQ ID NO: 378283 - DNA, 20 bp, human
gaaaacctctaggtagactc

SEQ ID NO: 378284 - DNA, 20 bp, human
ggacagggacctgggaagcg

SEQ ID NO: 378285 - DNA, 20 bp, human
gtccaggaatccctccagtg

SEQ ID NO: 378286 - DNA, 20 bp, human
gggcgctaggtgacaggcgg

SEQ ID NO: 378287 - DNA, 20 bp, human
ggcgggcgctaggtgacagg

SEQ ID NO: 378288 - DNA, 20 bp, human
gtccccgcgtcctctgaaga

SEQ ID NO: 378289 - DNA, 20 bp, human
ggggcgtgcttgcgagtcga

SEQ ID NO: 378290 - DNA, 20 bp, human
gcgcgctggaactagagacc

SEQ ID NO: 378291 - DNA, 20 bp, human
gctgaagaagggactcgcga

SEQ ID NO: 378292 - DNA, 20 bp, human
gaagaagggactcgcgaggg

SEQ ID NO: 378293 - DNA, 20 bp, human
ggtcacctagcgcccgcgcc

SEQ ID NO: 378294 - DNA, 20 bp, human
gtggaactagagacccggca

SEQ ID NO: 378295 - DNA, 20 bp, human
gtcagaggacgcggggagcc

SEQ ID NO: 378296 - DNA, 20 bp, human
gtgggcgcggcctcattctc

SEQ ID NO: 378297 - DNA, 20 bp, human
gtctcgggaaaactcggcgg

SEQ ID NO: 378298 - DNA, 20 bp, human
ggggaaaactcggcggtggg

SEQ ID NO: 378299 - DNA, 20 bp, human
gtcaggaagctctcccggag

SEQ ID NO: 378300 - DNA, 20 bp, human
ggctgacttccgtaatcttt

SEQ ID NO: 378301 - DNA, 20 bp, human
gcattctcgggaaaactcgg

SEQ ID NO: 378302 - DNA, 20 bp, human
gcgcctcttccgaaagatta

SEQ ID NO: 378303 - DNA, 20 bp, human
gtggaaccacagcgcgtcag

SEQ ID NO: 378304 - DNA, 20 bp, human
gaggaccattcggaagaagg

SEQ ID NO: 378305 - DNA, 20 bp, human
gagactccgcctcttccgaa

SEQ ID NO: 378306 - DNA, 20 bp, human
gaagagaacaggataaccca

SEQ ID NO: 378307 - DNA, 20 bp, human
gggcgtgggagcgaggggtt

SEQ ID NO: 378308 - DNA, 20 bp, human
gtccccaggcgtgggagcga

SEQ ID NO: 378309 - DNA, 20 bp, human
gaggataacccagggcgcgg

SEQ ID NO: 378310 - DNA, 20 bp, human
gtcccggaggtgcgcagtat

SEQ ID NO: 378311 - DNA, 20 bp, human
gaacaggataacccagggcg

SEQ ID NO: 378312 - DNA, 20 bp, human
gacccgatactgcgcacctc

SEQ ID NO: 378313 - DNA, 20 bp, human
gctgacctacagctcaatcg

SEQ ID NO: 378314 - DNA, 20 bp, human
gggctagaacccaggccggc

SEQ ID NO: 378315 - DNA, 20 bp, human
gacctacagctcaatcgtgg

SEQ ID NO: 378316 - DNA, 20 bp, human
gacggctgcgaggacgtcag

SEQ ID NO: 378317 - DNA, 20 bp, human
ggacccgcagccacgtcaac

SEQ ID NO: 378318 - DNA, 20 bp, human
gtgggggtccggtcacgtgt

SEQ ID NO: 378319 - DNA, 20 bp, human
gccggcccggggaaggtgag

SEQ ID NO: 378320 - DNA, 20 bp, human
ggctgcgaggacgtcagagg

SEQ ID NO: 378321 - DNA, 20 bp, human
ggggtccggtcacgtgttgg

SEQ ID NO: 378322 - DNA, 20 bp, human
ggaaggctccggctcctgtt

SEQ ID NO: 378323 - DNA, 20 bp, human
gcccccaccccaacaggagc

SEQ ID NO: 378324 - DNA, 20 bp, human
ggcaagctccagcacttctt

SEQ ID NO: 378325 - DNA, 20 bp, human
ggccagctgctggggtagaa

SEQ ID NO: 378326 - DNA, 20 bp, human
ggggtggcgtcacgtgccag

SEQ ID NO: 378327 - DNA, 20 bp, human
ggcgggggcagcagacgcga

SEQ ID NO: 378328 - DNA, 20 bp, human
ggcgcgggcccgtggctctc

SEQ ID NO: 378329 - DNA, 20 bp, human
ggaagaaatggaaccttccc

SEQ ID NO: 378330 - DNA, 20 bp, human
gagtggcaaatgatgtggtc

SEQ ID NO: 378331 - DNA, 20 bp, human
gagtccgccagcgagagggg

SEQ ID NO: 378332 - DNA, 20 bp, human
ggcccggcccggagagccac

SEQ ID NO: 378333 - DNA, 20 bp, human
gaaccaaggagacctgtcca

SEQ ID NO: 378334 - DNA, 20 bp, human
gcagacgcgagggctggcgg

SEQ ID NO: 378335 - DNA, 20 bp, human
gtggcgtcacgtgccagcgg

SEQ ID NO: 378336 - DNA, 20 bp, human
ggctccctgcggcttggggc

SEQ ID NO: 378337 - DNA, 20 bp, human
ggcccaggcccggcggtgga

SEQ ID NO: 378338 - DNA, 20 bp, human
ggtttccgggagctcacggt

SEQ ID NO: 378339 - DNA, 20 bp, human
gtgagctcccggaaaccgca

SEQ ID NO: 378340 - DNA, 20 bp, human
gaggtgtgaggggtcgggtg

SEQ ID NO: 378341 - DNA, 20 bp, human
ggccgcgcagtgcacggcag

SEQ ID NO: 378342 - DNA, 20 bp, human
gcgagagcgcaattctggag

SEQ ID NO: 378343 - DNA, 20 bp, human
gcggagccctgtgtcagacg

SEQ ID NO: 378344 - DNA, 20 bp, human
gaggggctccctgcggcttg

SEQ ID NO: 378345 - DNA, 20 bp, human
gtagccctgctctccgggat

SEQ ID NO: 378346 - DNA, 20 bp, human
gcatggctatggaggtgaat

SEQ ID NO: 378347 - DNA, 20 bp, human
gggcacaaaaagggatcatc

SEQ ID NO: 378348 - DNA, 20 bp, human
gcatccttaacagtgtgaaa

SEQ ID NO: 378349 - DNA, 20 bp, human
gctgttaaggatggtctatg

SEQ ID NO: 378350 - DNA, 20 bp, human
gtcagctctttgggatctgc

SEQ ID NO: 378351 - DNA, 20 bp, human
ggtaatgggttctgttcacg

SEQ ID NO: 378352 - DNA, 20 bp, human
gtatccttttcacactgtta

SEQ ID NO: 378353 - DNA, 20 bp, human
gcttactgaagacatgtccc

SEQ ID NO: 378354 - DNA, 20 bp, human
ggcttattagtcagctcttt

SEQ ID NO: 378355 - DNA, 20 bp, human
gttgaaatgtcatgcccaat

SEQ ID NO: 378356 - DNA, 20 bp, human
ggtgctaggcgcgtcgggtg

SEQ ID NO: 378357 - DNA, 20 bp, human
ggacgcgcctagcacggttg

SEQ ID NO: 378358 - DNA, 20 bp, human
ggcctagcacggttgcggtg

SEQ ID NO: 378359 - DNA, 20 bp, human
gctccctgctgcagacttca

SEQ ID NO: 378360 - DNA, 20 bp, human
ggcgccccagccacgaggac

SEQ ID NO: 378361 - DNA, 20 bp, human
ggggcagccgtggagccgag

SEQ ID NO: 378362 - DNA, 20 bp, human
gctaccgaaagcagcgcccc

SEQ ID NO: 378363 - DNA, 20 bp, human
gtaggcgcgtcgggtggggc

SEQ ID NO: 378364 - DNA, 20 bp, human
gaacggaggtgctgcgtcca

SEQ ID NO: 378365 - DNA, 20 bp, human
gccctctccccaaactgggt

SEQ ID NO: 378366 - DNA, 20 bp, human
gtgacctaagcggagagggg

SEQ ID NO: 378367 - DNA, 20 bp, human
gaccaagcggcgtgggaggg

SEQ ID NO: 378368 - DNA, 20 bp, human
ggagggcgggcctgcccccc

SEQ ID NO: 378369 - DNA, 20 bp, human
gctcctgctcaaggtcaagg

SEQ ID NO: 378370 - DNA, 20 bp, human
ggcaggaaggcggactggaa

SEQ ID NO: 378371 - DNA, 20 bp, human
gcagaaagaacccgtcccgg

SEQ ID NO: 378372 - DNA, 20 bp, human
gcgccgaggcggcagaggga

SEQ ID NO: 378373 - DNA, 20 bp, human
ggagaaggagctggctagaa

SEQ ID NO: 378374 - DNA, 20 bp, human
gagggagggggcctgatcga

SEQ ID NO: 378375 - DNA, 20 bp, human
ggcgggcctgccccccggga

SEQ ID NO: 378376 - DNA, 20 bp, human
ggggagattgcccgggacta

SEQ ID NO: 378377 - DNA, 20 bp, human
gaggaagcagggagattgcc

SEQ ID NO: 378378 - DNA, 20 bp, human
ggacctgcgacagtggcgag

SEQ ID NO: 378379 - DNA, 20 bp, human
gacgacgtgctgcttctcca

SEQ ID NO: 378380 - DNA, 20 bp, human
gtcacagaggtagaagtccg

SEQ ID NO: 378381 - DNA, 20 bp, human
gacccagtgggtttccacac

SEQ ID NO: 378382 - DNA, 20 bp, human
gctaccaccggccttcagag

SEQ ID NO: 378383 - DNA, 20 bp, human
ggtagaagtccggggacccc

SEQ ID NO: 378384 - DNA, 20 bp, human
gttgccgcgggttcggagtg

SEQ ID NO: 378385 - DNA, 20 bp, human
gcgtcgtgatcctagatctc

SEQ ID NO: 378386 - DNA, 20 bp, human
ggtggcaaatcactgtgcga

SEQ ID NO: 378387 - DNA, 20 bp, human
ggacgcaatcctgacgctac

SEQ ID NO: 378388 - DNA, 20 bp, human
ggtctccgagactccagacg

SEQ ID NO: 378389 - DNA, 20 bp, human
ggtcaggattgcgtcaattc

SEQ ID NO: 378390 - DNA, 20 bp, human
gagagccaaaacaggaaccg

SEQ ID NO: 378391 - DNA, 20 bp, human
ggccacctcggttcctgttt

SEQ ID NO: 378392 - DNA, 20 bp, human
gttctcagaagagccaaaac

SEQ ID NO: 378393 - DNA, 20 bp, human
gaactgacagggatcagttt

SEQ ID NO: 378394 - DNA, 20 bp, human
ggccaaaacaggaaccgagg

SEQ ID NO: 378395 - DNA, 20 bp, human
gctgttttgtgggggctcag

SEQ ID NO: 378396 - DNA, 20 bp, human
gctgtcccgggtgctgatcg

SEQ ID NO: 378397 - DNA, 20 bp, human
gggtctggacggccaacgac

SEQ ID NO: 378398 - DNA, 20 bp, human
ggggatcctgctccgctccg

SEQ ID NO: 378399 - DNA, 20 bp, human
gcaccaggataaacatctgt

SEQ ID NO: 378400 - DNA, 20 bp, human
gcgtcatcgaggttcccggg

SEQ ID NO: 378401 - DNA, 20 bp, human
ggggcgtcatcgaggttccc

SEQ ID NO: 378402 - DNA, 20 bp, human
ggcgccaccgcccacgtgca

SEQ ID NO: 378403 - DNA, 20 bp, human
gagctccgcgatcagcaccc

SEQ ID NO: 378404 - DNA, 20 bp, human
gtgtgcccgtatttggtctc

SEQ ID NO: 378405 - DNA, 20 bp, human
gggtgttaggggaacttaga

SEQ ID NO: 378406 - DNA, 20 bp, human
gggcgcccggctgaggaata

SEQ ID NO: 378407 - DNA, 20 bp, human
gcgggagaaacttgggtctg

SEQ ID NO: 378408 - DNA, 20 bp, human
gccccgagtcccagcttcgg

SEQ ID NO: 378409 - DNA, 20 bp, human
gcgacggtcaggcagggtct

SEQ ID NO: 378410 - DNA, 20 bp, human
gggtccccgggtccgtgcgt

SEQ ID NO: 378411 - DNA, 20 bp, human
gaggtagaagaccccaagac

SEQ ID NO: 378412 - DNA, 20 bp, human
ggggctgtcccgaatctcgg

SEQ ID NO: 378413 - DNA, 20 bp, human
gcgcatcgcccgcctgtctt

SEQ ID NO: 378414 - DNA, 20 bp, human
gggcggacccccagtctctc

SEQ ID NO: 378415 - DNA, 20 bp, human
gggcccccgagtcccagctt

SEQ ID NO: 378416 - DNA, 20 bp, human
gagcgcgcccggggcaccgc

SEQ ID NO: 378417 - DNA, 20 bp, human
gggcgggcgcgggtgcagtg

SEQ ID NO: 378418 - DNA, 20 bp, human
gaccgccgcggtgttgagtc

SEQ ID NO: 378419 - DNA, 20 bp, human
gcgccagccgccgaacgccg

SEQ ID NO: 378420 - DNA, 20 bp, human
gccgcctcgcagtccccgcg

SEQ ID NO: 378421 - DNA, 20 bp, human
ggccgcccgaagccgccccg

SEQ ID NO: 378422 - DNA, 20 bp, human
gcgaagccgccccgagggca

SEQ ID NO: 378423 - DNA, 20 bp, human
gccctcgagccgccagcaag

SEQ ID NO: 378424 - DNA, 20 bp, human
gctgtggccgcggcgttcgg

SEQ ID NO: 378425 - DNA, 20 bp, human
gccaaagggcacctcggagg

SEQ ID NO: 378426 - DNA, 20 bp, human
gtgggggcaagggtgctctg

SEQ ID NO: 378427 - DNA, 20 bp, human
gaggacgcatcctacagtgg

SEQ ID NO: 378428 - DNA, 20 bp, human
ggcaagggtgctctgaggtc

SEQ ID NO: 378429 - DNA, 20 bp, human
ggtgctctgaggtccggtga

SEQ ID NO: 378430 - DNA, 20 bp, human
gaggggaggcgccaatgtgg

SEQ ID NO: 378431 - DNA, 20 bp, human
ggcacccttgcccccactgt

SEQ ID NO: 378432 - DNA, 20 bp, human
ggtaggatgcgtcctccacc

SEQ ID NO: 378433 - DNA, 20 bp, human
gcaggcaggtggacgagtcc

SEQ ID NO: 378434 - DNA, 20 bp, human
ggggaaccagggtgctacat

SEQ ID NO: 378435 - DNA, 20 bp, human
gccacccttcggcatgtggg

SEQ ID NO: 378436 - DNA, 20 bp, human
gccgcagggtaggatagcgg

SEQ ID NO: 378437 - DNA, 20 bp, human
gaggagccggggagtacccc

SEQ ID NO: 378438 - DNA, 20 bp, human
gaccccaggtccccggtctg

SEQ ID NO: 378439 - DNA, 20 bp, human
ggcgccgcagggtaggatag

SEQ ID NO: 378440 - DNA, 20 bp, human
gagcggccgcgccctggctt

SEQ ID NO: 378441 - DNA, 20 bp, human
gggccccagaccggggacct

SEQ ID NO: 378442 - DNA, 20 bp, human
ggggcggagcgcaagcagag

SEQ ID NO: 378443 - DNA, 20 bp, human
gtagcggcggccccagaccg

SEQ ID NO: 378444 - DNA, 20 bp, human
gccccggcggccgcgagtag

SEQ ID NO: 378445 - DNA, 20 bp, human
gcgagcgcgagacttggctt

SEQ ID NO: 378446 - DNA, 20 bp, human
gcccccgcagccgactggag

SEQ ID NO: 378447 - DNA, 20 bp, human
gcaagctgggcctctccagt

SEQ ID NO: 378448 - DNA, 20 bp, human
gccatcctgccattcccctt

SEQ ID NO: 378449 - DNA, 20 bp, human
gccccaccttgcccacaacg

SEQ ID NO: 378450 - DNA, 20 bp, human
gaggaggaaacacctcggca

SEQ ID NO: 378451 - DNA, 20 bp, human
gggctgctacccgttctaga

SEQ ID NO: 378452 - DNA, 20 bp, human
gcagccccaaggggaatggc

SEQ ID NO: 378453 - DNA, 20 bp, human
gttcctatcagccccgttgt

SEQ ID NO: 378454 - DNA, 20 bp, human
gggcctctccagtcggctgc

SEQ ID NO: 378455 - DNA, 20 bp, human
gcctggactcccagcgcccg

SEQ ID NO: 378456 - DNA, 20 bp, human
gtggagccgtggcaatggaa

SEQ ID NO: 378457 - DNA, 20 bp, human
ggctcctgagggtgtcaaga

SEQ ID NO: 378458 - DNA, 20 bp, human
ggtgtcaagagggatcgctg

SEQ ID NO: 378459 - DNA, 20 bp, human
gcattgccacggctccaggt

SEQ ID NO: 378460 - DNA, 20 bp, human
gggggcccatgacttggtca

SEQ ID NO: 378461 - DNA, 20 bp, human
gcaggtggggctgagaccgg

SEQ ID NO: 378462 - DNA, 20 bp, human
gtggcaaggggcccatgact

SEQ ID NO: 378463 - DNA, 20 bp, human
ggagaccggcggaggcagct

SEQ ID NO: 378464 - DNA, 20 bp, human
ggatccctcttgacaccctc

SEQ ID NO: 378465 - DNA, 20 bp, human
gaagagggatcgctggggct

SEQ ID NO: 378466 - DNA, 20 bp, human
ggggcaaggtacacttgaga

SEQ ID NO: 378467 - DNA, 20 bp, human
ggggccggtcccgggtgctc

SEQ ID NO: 378468 - DNA, 20 bp, human
gcccggcgggcggtgcggtg

SEQ ID NO: 378469 - DNA, 20 bp, human
gtggcccgagcacccgggac

SEQ ID NO: 378470 - DNA, 20 bp, human
gggcgggggcggagggcgaa

SEQ ID NO: 378471 - DNA, 20 bp, human
gggagcgggcgaagcgccat

SEQ ID NO: 378472 - DNA, 20 bp, human
gggtgcggtggggccggtcc

SEQ ID NO: 378473 - DNA, 20 bp, human
gcaaggtacacttgagaagg

SEQ ID NO: 378474 - DNA, 20 bp, human
ggtcccttctcggagtgcag

SEQ ID NO: 378475 - DNA, 20 bp, human
gagcctctgcactccgagaa

SEQ ID NO: 378476 - DNA, 20 bp, human
gagcctgtgcccgacaggaa

SEQ ID NO: 378477 - DNA, 20 bp, human
gtggctactcccacatcact

SEQ ID NO: 378478 - DNA, 20 bp, human
ggcgtcagcctgtgcccgac

SEQ ID NO: 378479 - DNA, 20 bp, human
ggatgtgggagtagccaccg

SEQ ID NO: 378480 - DNA, 20 bp, human
gccagccttacatgcctcgg

SEQ ID NO: 378481 - DNA, 20 bp, human
gccaccccaaaaccacatca

SEQ ID NO: 378482 - DNA, 20 bp, human
gtgacgcagtgcaccctgtg

SEQ ID NO: 378483 - DNA, 20 bp, human
ggtagccaccgaggcatgta

SEQ ID NO: 378484 - DNA, 20 bp, human
gtggccagccttacatgcct

SEQ ID NO: 378485 - DNA, 20 bp, human
ggtccctgccctgctaactc

SEQ ID NO: 378486 - DNA, 20 bp, human
ggagcctcgtgctacccggg

SEQ ID NO: 378487 - DNA, 20 bp, human
ggcagagcctcgtgctaccc

SEQ ID NO: 378488 - DNA, 20 bp, human
gacaccccccgggtagcacg

SEQ ID NO: 378489 - DNA, 20 bp, human
gcccggtgaaaacacccccc

SEQ ID NO: 378490 - DNA, 20 bp, human
gtctgcgtttgtcggagtta

SEQ ID NO: 378491 - DNA, 20 bp, human
gcagcagctgctgcagaacc

SEQ ID NO: 378492 - DNA, 20 bp, human
gttgaggctttcttcttcta

SEQ ID NO: 378493 - DNA, 20 bp, human
gtggaaacatcttaaatgga

SEQ ID NO: 378494 - DNA, 20 bp, human
gaccgcgagcagaaaatgca

SEQ ID NO: 378495 - DNA, 20 bp, human
gaattatctgcttgcagctg

SEQ ID NO: 378496 - DNA, 20 bp, human
gcctcccgggagggtgagaa

SEQ ID NO: 378497 - DNA, 20 bp, human
ggccccgggctccttagcag

SEQ ID NO: 378498 - DNA, 20 bp, human
gagggaccgcccaagcagac

SEQ ID NO: 378499 - DNA, 20 bp, human
gacaagaggaatgtccttcc

SEQ ID NO: 378500 - DNA, 20 bp, human
gccgggagggtgagaagggc

SEQ ID NO: 378501 - DNA, 20 bp, human
gcccgcgaggggagccgaag

SEQ ID NO: 378502 - DNA, 20 bp, human
gggaggagctggactcttaa

SEQ ID NO: 378503 - DNA, 20 bp, human
gccccctgctaaggagcccg

SEQ ID NO: 378504 - DNA, 20 bp, human
ggtccttccaggttaggaat

SEQ ID NO: 378505 - DNA, 20 bp, human
gaccaacagatggaagtaag

SEQ ID NO: 378506 - DNA, 20 bp, human
ggactccagtacttactaac

SEQ ID NO: 378507 - DNA, 20 bp, human
gtgtctctgttgatcagcag

SEQ ID NO: 378508 - DNA, 20 bp, human
ggacagctatttcaagaaga

SEQ ID NO: 378509 - DNA, 20 bp, human
gtgctccaagtagttcacaa

SEQ ID NO: 378510 - DNA, 20 bp, human
gtaagaatagagattttcag

SEQ ID NO: 378511 - DNA, 20 bp, human
gtagattgtgggaatatgag

SEQ ID NO: 378512 - DNA, 20 bp, human
gaaacattactctgtgctac

SEQ ID NO: 378513 - DNA, 20 bp, human
gcactccataaccatagtcc

SEQ ID NO: 378514 - DNA, 20 bp, human
gttaaacattttttgacatg

SEQ ID NO: 378515 - DNA, 20 bp, human
gttgttatcacgtttctccc

SEQ ID NO: 378516 - DNA, 20 bp, human
gctcgcactgcgccctacgt

SEQ ID NO: 378517 - DNA, 20 bp, human
ggggtgatgtctacggggaa

SEQ ID NO: 378518 - DNA, 20 bp, human
gtagggcgcagtgcgagcca

SEQ ID NO: 378519 - DNA, 20 bp, human
gaagaggtccgagaggtggt

SEQ ID NO: 378520 - DNA, 20 bp, human
ggtatctggggtgatgtcta

SEQ ID NO: 378521 - DNA, 20 bp, human
gcccctgcgaaccggaactt

SEQ ID NO: 378522 - DNA, 20 bp, human
ggctgggcaagaggtccgag

SEQ ID NO: 378523 - DNA, 20 bp, human
gatggtgtcaccaccgtatc

SEQ ID NO: 378524 - DNA, 20 bp, human
ggggtcagacacctcacttc

SEQ ID NO: 378525 - DNA, 20 bp, human
gggccgagtcccccagtccg

SEQ ID NO: 378526 - DNA, 20 bp, human
gaggtcccaagtgtacatta

SEQ ID NO: 378527 - DNA, 20 bp, human
gttacagaatgggcgttcaa

SEQ ID NO: 378528 - DNA, 20 bp, human
ggctgccctaatgtacactt

SEQ ID NO: 378529 - DNA, 20 bp, human
gtgtaagacagataacgcgt

SEQ ID NO: 378530 - DNA, 20 bp, human
gcacgcaaggctttactcaa

SEQ ID NO: 378531 - DNA, 20 bp, human
ggaggcgcgcttcaaagcgc

SEQ ID NO: 378532 - DNA, 20 bp, human
gcggccctgccatgggacgg

SEQ ID NO: 378533 - DNA, 20 bp, human
gtgaagcgcgcctccgtcgc

SEQ ID NO: 378534 - DNA, 20 bp, human
ggtaccggaagtgtgttctg

SEQ ID NO: 378535 - DNA, 20 bp, human
gcgtatggggcccttccttg

SEQ ID NO: 378536 - DNA, 20 bp, human
gaggctaattggagcgggag

SEQ ID NO: 378537 - DNA, 20 bp, human
gaccgagagtgggctggcta

SEQ ID NO: 378538 - DNA, 20 bp, human
gagcggcggcgattagaggt

SEQ ID NO: 378539 - DNA, 20 bp, human
gcgggtacagggaccgagag

SEQ ID NO: 378540 - DNA, 20 bp, human
ggcctcggccgccgcaatgc

SEQ ID NO: 378541 - DNA, 20 bp, human
gcagaacccacggctgataa

SEQ ID NO: 378542 - DNA, 20 bp, human
ggctggcaagcttcgggtac

SEQ ID NO: 378543 - DNA, 20 bp, human
gtgcctgacaggagacagtc

SEQ ID NO: 378544 - DNA, 20 bp, human
gacggctgataagggaatgt

SEQ ID NO: 378545 - DNA, 20 bp, human
ggggcgaggctaattggagc

SEQ ID NO: 378546 - DNA, 20 bp, human
ggccccgagtcccactagtc

SEQ ID NO: 378547 - DNA, 20 bp, human
gaaagcctgcgcatcgggtg

SEQ ID NO: 378548 - DNA, 20 bp, human
gccggcgtcgggtgtccccg

SEQ ID NO: 378549 - DNA, 20 bp, human
ggcccagcgccaagcggtgt

SEQ ID NO: 378550 - DNA, 20 bp, human
ggcagcgctggggtgctcgg

SEQ ID NO: 378551 - DNA, 20 bp, human
gcgccaagcggtgtcggcag

SEQ ID NO: 378552 - DNA, 20 bp, human
gccagcccgcacttccgcga

SEQ ID NO: 378553 - DNA, 20 bp, human
gcggggtggtccggactagt

SEQ ID NO: 378554 - DNA, 20 bp, human
gacgccgcctggggctccgt

SEQ ID NO: 378555 - DNA, 20 bp, human
gaggaggacacttctcagaa

SEQ ID NO: 378556 - DNA, 20 bp, human
ggggagacttacattgtaaa

SEQ ID NO: 378557 - DNA, 20 bp, human
ggctgtactgaactattgaa

SEQ ID NO: 378558 - DNA, 20 bp, human
gaggaactgtaacctgatta

SEQ ID NO: 378559 - DNA, 20 bp, human
gtaaatgttttagaagtgag

SEQ ID NO: 378560 - DNA, 20 bp, human
ggtaacctgattatggattt

SEQ ID NO: 378561 - DNA, 20 bp, human
gtgttgaagaatagttattt

SEQ ID NO: 378562 - DNA, 20 bp, human
gttcttcaacagagagtaat

SEQ ID NO: 378563 - DNA, 20 bp, human
gccataggaagccagtctag

SEQ ID NO: 378564 - DNA, 20 bp, human
gcttctctgacctacaaatg

SEQ ID NO: 378565 - DNA, 20 bp, human
ggatcacacatcttaatcta

SEQ ID NO: 378566 - DNA, 20 bp, human
gctagctatgtattttcaca

SEQ ID NO: 378567 - DNA, 20 bp, human
gacgcccaagcagtggccgt

SEQ ID NO: 378568 - DNA, 20 bp, human
ggaaaatacatagctagtcc

SEQ ID NO: 378569 - DNA, 20 bp, human
gtactaagggaggttcagcc

SEQ ID NO: 378570 - DNA, 20 bp, human
ggcagattgtgccgtcataa

SEQ ID NO: 378571 - DNA, 20 bp, human
gtcttaataactttctaaca

SEQ ID NO: 378572 - DNA, 20 bp, human
gtcttcaagaactactagcc

SEQ ID NO: 378573 - DNA, 20 bp, human
gttctacccttttggctaat

SEQ ID NO: 378574 - DNA, 20 bp, human
gaacccaagctgcaatgcac

SEQ ID NO: 378575 - DNA, 20 bp, human
gagaaaagaaagaactacta

SEQ ID NO: 378576 - DNA, 20 bp, human
gcatttgattcagtacccag

SEQ ID NO: 378577 - DNA, 20 bp, human
gaacatagtacagtgcccct

SEQ ID NO: 378578 - DNA, 20 bp, human
gaaatgcagcatagtattca

SEQ ID NO: 378579 - DNA, 20 bp, human
gatcacagagtgaaacgaag

SEQ ID NO: 378580 - DNA, 20 bp, human
gaaagcttgattatatccat

SEQ ID NO: 378581 - DNA, 20 bp, human
gggcactttaaaactagtgt

SEQ ID NO: 378582 - DNA, 20 bp, human
gagctctagtttatatgact

SEQ ID NO: 378583 - DNA, 20 bp, human
gcatgctgaattcttctctt

SEQ ID NO: 378584 - DNA, 20 bp, human
gtataatcaagctttctttg

SEQ ID NO: 378585 - DNA, 20 bp, human
gttcttctcttgggaagagt

SEQ ID NO: 378586 - DNA, 20 bp, human
gcgcaggagcactgaaaatc

SEQ ID NO: 378587 - DNA, 20 bp, human
gtgtgcaacagtcgctgata

SEQ ID NO: 378588 - DNA, 20 bp, human
gcaatgggaaaatccctcga

SEQ ID NO: 378589 - DNA, 20 bp, human
gctgatatggaatgtaatta

SEQ ID NO: 378590 - DNA, 20 bp, human
gactacagggattccatcga

SEQ ID NO: 378591 - DNA, 20 bp, human
gtaacagagataaagataac

SEQ ID NO: 378592 - DNA, 20 bp, human
gatggaatccctgtagtgcg

SEQ ID NO: 378593 - DNA, 20 bp, human
ggttcacaccgcgcactaca

SEQ ID NO: 378594 - DNA, 20 bp, human
gttatattgcacaagattat

SEQ ID NO: 378595 - DNA, 20 bp, human
gattttcaacagtgattact

SEQ ID NO: 378596 - DNA, 20 bp, human
gtctgtccttccttgtgata

SEQ ID NO: 378597 - DNA, 20 bp, human
gtataatgggtacaatggat

SEQ ID NO: 378598 - DNA, 20 bp, human
ggagatggaagcttattaaa

SEQ ID NO: 378599 - DNA, 20 bp, human
gattcatagtagatttgctt

SEQ ID NO: 378600 - DNA, 20 bp, human
gatgggtacaatggattggc

SEQ ID NO: 378601 - DNA, 20 bp, human
gccatctcctaggacatttt

SEQ ID NO: 378602 - DNA, 20 bp, human
gcttgtgaagaatttataat

SEQ ID NO: 378603 - DNA, 20 bp, human
gtgtgaatccttcttttcaa

SEQ ID NO: 378604 - DNA, 20 bp, human
ggattcacaccttacactat

SEQ ID NO: 378605 - DNA, 20 bp, human
gttcacatgtatataaaacc

SEQ ID NO: 378606 - DNA, 20 bp, human
gactgctaaagtgctgctca

SEQ ID NO: 378607 - DNA, 20 bp, human
gtataccttcaaaatcccta

SEQ ID NO: 378608 - DNA, 20 bp, human
gcaagacgttatagttaata

SEQ ID NO: 378609 - DNA, 20 bp, human
gcataccatagggattttga

SEQ ID NO: 378610 - DNA, 20 bp, human
gagttaatatggaaaagcac

SEQ ID NO: 378611 - DNA, 20 bp, human
gtattgccagccatttaatt

SEQ ID NO: 378612 - DNA, 20 bp, human
ggaagtaattaggctatcaa

SEQ ID NO: 378613 - DNA, 20 bp, human
gaatttcaaagtcttctagg

SEQ ID NO: 378614 - DNA, 20 bp, human
gaattacttctcaactgtgg

SEQ ID NO: 378615 - DNA, 20 bp, human
gatattcctaattaaatggc

SEQ ID NO: 378616 - DNA, 20 bp, human
gcccacgcccgaagagggat

SEQ ID NO: 378617 - DNA, 20 bp, human
gacgacccccatccctcttc

SEQ ID NO: 378618 - DNA, 20 bp, human
ggccaccccacgcccgaaga

SEQ ID NO: 378619 - DNA, 20 bp, human
gtccccgcagagcagcgagt

SEQ ID NO: 378620 - DNA, 20 bp, human
gggctagagcggcccgaagg

SEQ ID NO: 378621 - DNA, 20 bp, human
gaagatgggcgaggagcaat

SEQ ID NO: 378622 - DNA, 20 bp, human
gagagggatgggggtcgtag

SEQ ID NO: 378623 - DNA, 20 bp, human
gcgtagcggaccgtgtgcgc

SEQ ID NO: 378624 - DNA, 20 bp, human
gttcgggcgtggggtggcgc

SEQ ID NO: 378625 - DNA, 20 bp, human
gcgaggagcaatcggccccg

SEQ ID NO: 378626 - DNA, 20 bp, human
gtcccctagccgaacggcgg

SEQ ID NO: 378627 - DNA, 20 bp, human
gctcccccgccgttcggcta

SEQ ID NO: 378628 - DNA, 20 bp, human
gagagcgagcgagagctggg

SEQ ID NO: 378629 - DNA, 20 bp, human
gagatctgcagccgcggctg

SEQ ID NO: 378630 - DNA, 20 bp, human
gacagccgccgcctcagccg

SEQ ID NO: 378631 - DNA, 20 bp, human
gtcgggggaggggtacaggt

SEQ ID NO: 378632 - DNA, 20 bp, human
gtagagactgcgagtgtcgg

SEQ ID NO: 378633 - DNA, 20 bp, human
gacacaatatggcggcgcgg

SEQ ID NO: 378634 - DNA, 20 bp, human
ggcctcccctagccgaacgg

SEQ ID NO: 378635 - DNA, 20 bp, human
gcgagccggagctgaggatt

SEQ ID NO: 378636 - DNA, 20 bp, human
ggcgccgccgggtactgccc

SEQ ID NO: 378637 - DNA, 20 bp, human
gaagcctcgcgagatcgccc

SEQ ID NO: 378638 - DNA, 20 bp, human
gcgccctgggcagtacccgg

SEQ ID NO: 378639 - DNA, 20 bp, human
gcgctcgccaggcacaaaga

SEQ ID NO: 378640 - DNA, 20 bp, human
gtgcccagggcgatctcgcg

SEQ ID NO: 378641 - DNA, 20 bp, human
gctcgcgaggcttcccccac

SEQ ID NO: 378642 - DNA, 20 bp, human
gaggcttcccccacaggaac

SEQ ID NO: 378643 - DNA, 20 bp, human
ggcaggcgcagtaacttctt

SEQ ID NO: 378644 - DNA, 20 bp, human
gggtgggagggacgcactga

SEQ ID NO: 378645 - DNA, 20 bp, human
gaatacgaggcgggcctcgg

SEQ ID NO: 378646 - DNA, 20 bp, human
ggaagcaggccgctccggat

SEQ ID NO: 378647 - DNA, 20 bp, human
gacgcaagcgaaaggagagg

SEQ ID NO: 378648 - DNA, 20 bp, human
gagacggaagcaggccgctc

SEQ ID NO: 378649 - DNA, 20 bp, human
gcgtcgatgcccataacatc

SEQ ID NO: 378650 - DNA, 20 bp, human
ggaggtctcgccatccaatc

SEQ ID NO: 378651 - DNA, 20 bp, human
gaattgggtccagatgttat

SEQ ID NO: 378652 - DNA, 20 bp, human
gaaacccagtttcgaaggag

SEQ ID NO: 378653 - DNA, 20 bp, human
gctcgccatccaatccggag

SEQ ID NO: 378654 - DNA, 20 bp, human
ggaaaagttaccgaagtcca

SEQ ID NO: 378655 - DNA, 20 bp, human
ggcgtcatttagaacccaat

SEQ ID NO: 378656 - DNA, 20 bp, human
gagtcccagctccctgataa

SEQ ID NO: 378657 - DNA, 20 bp, human
gaaggctctgggagggtcta

SEQ ID NO: 378658 - DNA, 20 bp, human
gcctccagccaccctgggat

SEQ ID NO: 378659 - DNA, 20 bp, human
ggctgagagtcaccaatccc

SEQ ID NO: 378660 - DNA, 20 bp, human
gctcgggtgctgttaggaaa

SEQ ID NO: 378661 - DNA, 20 bp, human
ggagtggaggggatctagga

SEQ ID NO: 378662 - DNA, 20 bp, human
gagagtcaccaatcccaggg

SEQ ID NO: 378663 - DNA, 20 bp, human
gcggcagcaccagtgtgtga

SEQ ID NO: 378664 - DNA, 20 bp, human
gtctcactgctgggtctgtg

SEQ ID NO: 378665 - DNA, 20 bp, human
gtcaccaatcccagggtggc

SEQ ID NO: 378666 - DNA, 20 bp, human
ggagaggcctctctgtacag

SEQ ID NO: 378667 - DNA, 20 bp, human
gtggacaggccaatgatatt

SEQ ID NO: 378668 - DNA, 20 bp, human
ggagcagctcctaatatcat

SEQ ID NO: 378669 - DNA, 20 bp, human
gagggaaacagccaaaggtg

SEQ ID NO: 378670 - DNA, 20 bp, human
gccccctaacatttgatccc

SEQ ID NO: 378671 - DNA, 20 bp, human
gcacacacagggactattga

SEQ ID NO: 378672 - DNA, 20 bp, human
gcctggtggcaggtgcacag

SEQ ID NO: 378673 - DNA, 20 bp, human
ggcatcagagtgttaagccc

SEQ ID NO: 378674 - DNA, 20 bp, human
ggaggagggggctcaaagac

SEQ ID NO: 378675 - DNA, 20 bp, human
gcatcttagaaataagggag

SEQ ID NO: 378676 - DNA, 20 bp, human
gggaagaggacagcgtgccc

SEQ ID NO: 378677 - DNA, 20 bp, human
gaaacggtcctcctctgccc

SEQ ID NO: 378678 - DNA, 20 bp, human
gctggtcgcggcccgactga

SEQ ID NO: 378679 - DNA, 20 bp, human
gcaagccccggccctcagtc

SEQ ID NO: 378680 - DNA, 20 bp, human
gcggggcttgccggctgcgc

SEQ ID NO: 378681 - DNA, 20 bp, human
gggcgccggggctttgaaga

SEQ ID NO: 378682 - DNA, 20 bp, human
gccgccggatccccctaccg

SEQ ID NO: 378683 - DNA, 20 bp, human
gcgcgaccagcgtgacgccg

SEQ ID NO: 378684 - DNA, 20 bp, human
gaccagcgtgacgccgcggt

SEQ ID NO: 378685 - DNA, 20 bp, human
gcctctgccccggacgccgg

SEQ ID NO: 378686 - DNA, 20 bp, human
gtgtgaagatgcaggcgttg

SEQ ID NO: 378687 - DNA, 20 bp, human
gggctccggaaacggggctg

SEQ ID NO: 378688 - DNA, 20 bp, human
ggggagctggggccctagaa

SEQ ID NO: 378689 - DNA, 20 bp, human
gcggcccaggactaagggga

SEQ ID NO: 378690 - DNA, 20 bp, human
gagcgccggtgtggtccgaa

SEQ ID NO: 378691 - DNA, 20 bp, human
gtgaccaccgagagagtagg

SEQ ID NO: 378692 - DNA, 20 bp, human
gcagctgcctccaggacccg

SEQ ID NO: 378693 - DNA, 20 bp, human
gaatgcgggcggtcccggcg

SEQ ID NO: 378694 - DNA, 20 bp, human
gcgggtatgagcgtgagcgc

SEQ ID NO: 378695 - DNA, 20 bp, human
gcggtcccggcgaggcggga

SEQ ID NO: 378696 - DNA, 20 bp, human
gcagctgcctccaggacccg

SEQ ID NO: 378697 - DNA, 20 bp, human
gcggcccaggactaagggga

SEQ ID NO: 378698 - DNA, 20 bp, human
ggggagctggggccctagaa

SEQ ID NO: 378699 - DNA, 20 bp, human
gtgaccaccgagagagtagg

SEQ ID NO: 378700 - DNA, 20 bp, human
gagaagccggcggtggaaaa

SEQ ID NO: 378701 - DNA, 20 bp, human
gtgtgcggtgcaaaggtcct

SEQ ID NO: 378702 - DNA, 20 bp, human
ggagccccctactctctcgg

SEQ ID NO: 378703 - DNA, 20 bp, human
gctcccggcccaggactaag

SEQ ID NO: 378704 - DNA, 20 bp, human
ggcggtgcaaaggtccttgg

SEQ ID NO: 378705 - DNA, 20 bp, human
gaaggaggggcgtggtggtc

SEQ ID NO: 378706 - DNA, 20 bp, human
ggcgccgacggttccgtttc

SEQ ID NO: 378707 - DNA, 20 bp, human
ggacggttccgtttccggag

SEQ ID NO: 378708 - DNA, 20 bp, human
ggtgccctccactccggaaa

SEQ ID NO: 378709 - DNA, 20 bp, human
gtgcggaactcgaaattcat

SEQ ID NO: 378710 - DNA, 20 bp, human
gccgcccgcggggcactcta

SEQ ID NO: 378711 - DNA, 20 bp, human
ggaaccgtcggcgcccgagc

SEQ ID NO: 378712 - DNA, 20 bp, human
ggtctcagcttcagacaccc

SEQ ID NO: 378713 - DNA, 20 bp, human
gccccccgctcgggcgccga

SEQ ID NO: 378714 - DNA, 20 bp, human
gcctggcgtgccctccactc

SEQ ID NO: 378715 - DNA, 20 bp, human
gagcacaggtggggaaactt

SEQ ID NO: 378716 - DNA, 20 bp, human
gaagatggggactcagtctg

SEQ ID NO: 378717 - DNA, 20 bp, human
gtctgccaagagacacgtgt

SEQ ID NO: 378718 - DNA, 20 bp, human
gggcctctgcgtgtgacgtg

SEQ ID NO: 378719 - DNA, 20 bp, human
gcccgggccaataagaaacc

SEQ ID NO: 378720 - DNA, 20 bp, human
gagcaatgagcacacctgtg

SEQ ID NO: 378721 - DNA, 20 bp, human
gcagtagagggcagaaaagc

SEQ ID NO: 378722 - DNA, 20 bp, human
gaagacctgcagactcattc

SEQ ID NO: 378723 - DNA, 20 bp, human
gagaaacccggatgagccag

SEQ ID NO: 378724 - DNA, 20 bp, human
ggcacgaccacttcccacac

SEQ ID NO: 378725 - DNA, 20 bp, human
gcagctgtcacgtctgtgtc

SEQ ID NO: 378726 - DNA, 20 bp, human
gacaaagtccggcgctctct

SEQ ID NO: 378727 - DNA, 20 bp, human
ggctctctaggcaaccgtga

SEQ ID NO: 378728 - DNA, 20 bp, human
gactaactagatctgctcaa

SEQ ID NO: 378729 - DNA, 20 bp, human
gagcgagtaccgtgcagcca

SEQ ID NO: 378730 - DNA, 20 bp, human
ggcccgcaaagtccgttccg

SEQ ID NO: 378731 - DNA, 20 bp, human
gaagtgtgctacgccatcaa

SEQ ID NO: 378732 - DNA, 20 bp, human
ggtaccgtgcagccacggaa

SEQ ID NO: 378733 - DNA, 20 bp, human
gatctgctcaagggcaagag

SEQ ID NO: 378734 - DNA, 20 bp, human
ggttagtgctcaagccctca

SEQ ID NO: 378735 - DNA, 20 bp, human
gagtcacaggcctttgggag

SEQ ID NO: 378736 - DNA, 20 bp, human
gagccccacgcactccgcga

SEQ ID NO: 378737 - DNA, 20 bp, human
gccccctcgcggagtgcgtg

SEQ ID NO: 378738 - DNA, 20 bp, human
gtccgcgagggggcagtagg

SEQ ID NO: 378739 - DNA, 20 bp, human
ggcaagtagcaagcagcaaa

SEQ ID NO: 378740 - DNA, 20 bp, human
gcccggctcgcagactccca

SEQ ID NO: 378741 - DNA, 20 bp, human
gtggaatcgtcgttgcacga

SEQ ID NO: 378742 - DNA, 20 bp, human
ggccgtgggagtctgcgagc

SEQ ID NO: 378743 - DNA, 20 bp, human
gtgcagagacgtcactggga

SEQ ID NO: 378744 - DNA, 20 bp, human
ggctgcttgctacttgccgt

SEQ ID NO: 378745 - DNA, 20 bp, human
gtcgttgcacgaggggtgct

SEQ ID NO: 378746 - DNA, 20 bp, human
gaaagtgaaactcccatcag

SEQ ID NO: 378747 - DNA, 20 bp, human
gcacgtggaaggatgtgata

SEQ ID NO: 378748 - DNA, 20 bp, human
gccaactgcggatccaaaat

SEQ ID NO: 378749 - DNA, 20 bp, human
gtgcggatccaaaatagggg

SEQ ID NO: 378750 - DNA, 20 bp, human
ggggaggggttactgaaacc

SEQ ID NO: 378751 - DNA, 20 bp, human
gttggatccgcagttgggag

SEQ ID NO: 378752 - DNA, 20 bp, human
gaatagtagtcacccctgat

SEQ ID NO: 378753 - DNA, 20 bp, human
gcacgtgtctatcacgtgga

SEQ ID NO: 378754 - DNA, 20 bp, human
gagttaatgttaatagtggt

SEQ ID NO: 378755 - DNA, 20 bp, human
gatagacacgtgtcaaaaaa

SEQ ID NO: 378756 - DNA, 20 bp, human
ggtacagagggcccagctct

SEQ ID NO: 378757 - DNA, 20 bp, human
gggagagacttgggggagat

SEQ ID NO: 378758 - DNA, 20 bp, human
gccaagcagggggtgggacc

SEQ ID NO: 378759 - DNA, 20 bp, human
ggctgcctgctcacgagggg

SEQ ID NO: 378760 - DNA, 20 bp, human
gacaaggccaagcagggggt

SEQ ID NO: 378761 - DNA, 20 bp, human
gaggtgctgcctgctcacga

SEQ ID NO: 378762 - DNA, 20 bp, human
gaagagacaaggccaagcag

SEQ ID NO: 378763 - DNA, 20 bp, human
gtacagaaggagttcgagcc

SEQ ID NO: 378764 - DNA, 20 bp, human
gtgctcacgagggggggctt

SEQ ID NO: 378765 - DNA, 20 bp, human
ggatttaggactggctgcag

SEQ ID NO: 378766 - DNA, 20 bp, human
gggcaagctgacccgcgcaa

SEQ ID NO: 378767 - DNA, 20 bp, human
ggtgcagccctcccttgcgc

SEQ ID NO: 378768 - DNA, 20 bp, human
gagctgactatccccttcgc

SEQ ID NO: 378769 - DNA, 20 bp, human
gggacacctaaaaacgtttg

SEQ ID NO: 378770 - DNA, 20 bp, human
gctcatggggtcccacgctt

SEQ ID NO: 378771 - DNA, 20 bp, human
gagtcacatcacacgtaggg

SEQ ID NO: 378772 - DNA, 20 bp, human
gggtgacgttgcaggggccg

SEQ ID NO: 378773 - DNA, 20 bp, human
gcacgcttcggtgacgttgc

SEQ ID NO: 378774 - DNA, 20 bp, human
ggggatgcagctggggctaa

SEQ ID NO: 378775 - DNA, 20 bp, human
ggcgaatgaatgaaatgcga

SEQ ID NO: 378776 - DNA, 20 bp, human
gggctgggaaagaacgaaaa

SEQ ID NO: 378777 - DNA, 20 bp, human
gcccgcgataggatcagaac

SEQ ID NO: 378778 - DNA, 20 bp, human
ggcgccaggtctgtagcagg

SEQ ID NO: 378779 - DNA, 20 bp, human
gagaaccgatactcacctgt

SEQ ID NO: 378780 - DNA, 20 bp, human
ggaagcctacaggtgagtat

SEQ ID NO: 378781 - DNA, 20 bp, human
gcgcgtctgggccgctctcc

SEQ ID NO: 378782 - DNA, 20 bp, human
gtagcaggaggccgcgccga

SEQ ID NO: 378783 - DNA, 20 bp, human
gggccggcttggccttccgt

SEQ ID NO: 378784 - DNA, 20 bp, human
ggacgcgccaggtctgtagc

SEQ ID NO: 378785 - DNA, 20 bp, human
gaaaagggagtcgcgtatag

SEQ ID NO: 378786 - DNA, 20 bp, human
ggggcgcgcgggtttaggat

SEQ ID NO: 378787 - DNA, 20 bp, human
gggcgcgcgacaaggtgaag

SEQ ID NO: 378788 - DNA, 20 bp, human
ggctccgcccgccttttcgc

SEQ ID NO: 378789 - DNA, 20 bp, human
gagcggatcacgtgactcga

SEQ ID NO: 378790 - DNA, 20 bp, human
ggatcacgtgactcgagggg

SEQ ID NO: 378791 - DNA, 20 bp, human
gcggctgcaacgttgctgac

SEQ ID NO: 378792 - DNA, 20 bp, human
ggggcaccttccctgcgaaa

SEQ ID NO: 378793 - DNA, 20 bp, human
gttccctgcgaaaaggcggg

SEQ ID NO: 378794 - DNA, 20 bp, human
gaggcggggcgcgcgggttt

SEQ ID NO: 378795 - DNA, 20 bp, human
gcaacgttgcagccgaggcg

SEQ ID NO: 378796 - DNA, 20 bp, human
gcgcggcggggaccgggaaa

SEQ ID NO: 378797 - DNA, 20 bp, human
ggaccgggaaaaggccaaga

SEQ ID NO: 378798 - DNA, 20 bp, human
ggggcaaagtgattactggt

SEQ ID NO: 378799 - DNA, 20 bp, human
gggcctccacggccgagggg

SEQ ID NO: 378800 - DNA, 20 bp, human
gtcgccactgcgccgcccgg

SEQ ID NO: 378801 - DNA, 20 bp, human
ggtccccgtgcccgaggact

SEQ ID NO: 378802 - DNA, 20 bp, human
gagcccctctagcgggacta

SEQ ID NO: 378803 - DNA, 20 bp, human
gcgggggcctccacggccga

SEQ ID NO: 378804 - DNA, 20 bp, human
ggggcctcgccgctctgtgg

SEQ ID NO: 378805 - DNA, 20 bp, human
gcgcgcgaccggcggctctt

SEQ ID NO: 378806 - DNA, 20 bp, human
gaggcccggcggtgggaaat

SEQ ID NO: 378807 - DNA, 20 bp, human
ggggagaaggcgctggacga

SEQ ID NO: 378808 - DNA, 20 bp, human
ggggccgggcgtccgcaagg

SEQ ID NO: 378809 - DNA, 20 bp, human
ggaggccgcgagctgacgat

SEQ ID NO: 378810 - DNA, 20 bp, human
ggacgataggcgagattgat

SEQ ID NO: 378811 - DNA, 20 bp, human
gcaggcagaaagcccggcgg

SEQ ID NO: 378812 - DNA, 20 bp, human
ggcatcgcgcaggcgccccg

SEQ ID NO: 378813 - DNA, 20 bp, human
gccggcggtgggaaatgggc

SEQ ID NO: 378814 - DNA, 20 bp, human
gcccaccgccgggcctgggg

SEQ ID NO: 378815 - DNA, 20 bp, human
gtccgcaaggtggcgcccgc

SEQ ID NO: 378816 - DNA, 20 bp, human
gagcgccaggagctgcgggt

SEQ ID NO: 378817 - DNA, 20 bp, human
gtcagattgggcaccaaatt

SEQ ID NO: 378818 - DNA, 20 bp, human
gcagaaccggaagaaacgaa

SEQ ID NO: 378819 - DNA, 20 bp, human
gccccttgcagttgacgcgg

SEQ ID NO: 378820 - DNA, 20 bp, human
gagcctactggagtttgccg

SEQ ID NO: 378821 - DNA, 20 bp, human
gaactgcagcgcggagatct

SEQ ID NO: 378822 - DNA, 20 bp, human
gacccgcaccccacctctag

SEQ ID NO: 378823 - DNA, 20 bp, human
gagcaaagccgctagaggtg

SEQ ID NO: 378824 - DNA, 20 bp, human
gacgaagggctcgtccgctt

SEQ ID NO: 378825 - DNA, 20 bp, human
gaaggcccaagcgttcgtaa

SEQ ID NO: 378826 - DNA, 20 bp, human
gaggatggatatgtggaaag

SEQ ID NO: 378827 - DNA, 20 bp, human
gaccggaagctcaaaacaga

SEQ ID NO: 378828 - DNA, 20 bp, human
gcgcgcggagcagtgggagc

SEQ ID NO: 378829 - DNA, 20 bp, human
ggatcaggaggatggatatg

SEQ ID NO: 378830 - DNA, 20 bp, human
gagctcgcgcgcggagcagt

SEQ ID NO: 378831 - DNA, 20 bp, human
gccgcgcgcgagctttctca

SEQ ID NO: 378832 - DNA, 20 bp, human
gaagagccactgctctaatt

SEQ ID NO: 378833 - DNA, 20 bp, human
gtcgacgctacgggatcagg

SEQ ID NO: 378834 - DNA, 20 bp, human
ggagctcagtaagtcacttc

SEQ ID NO: 378835 - DNA, 20 bp, human
ggcagccgggtcccatagac

SEQ ID NO: 378836 - DNA, 20 bp, human
ggacaggcggggcgagtcgt

SEQ ID NO: 378837 - DNA, 20 bp, human
gtccccgcctcctcccatag

SEQ ID NO: 378838 - DNA, 20 bp, human
gacggcagcgcagttcgcca

SEQ ID NO: 378839 - DNA, 20 bp, human
gtaacccgcagatccactat

SEQ ID NO: 378840 - DNA, 20 bp, human
gtgggcgcgtgacgtcaccc

SEQ ID NO: 378841 - DNA, 20 bp, human
ggcagatccactatgggagg

SEQ ID NO: 378842 - DNA, 20 bp, human
gggtctggacggaatcgccg

SEQ ID NO: 378843 - DNA, 20 bp, human
gggcagaggctagggcggaa

SEQ ID NO: 378844 - DNA, 20 bp, human
ggatccactatgggaggagg

SEQ ID NO: 378845 - DNA, 20 bp, human
ggccctatgtccctcgacta

SEQ ID NO: 378846 - DNA, 20 bp, human
gacccctcaggagagcggta

SEQ ID NO: 378847 - DNA, 20 bp, human
gacgacaggaagtaagatcc

SEQ ID NO: 378848 - DNA, 20 bp, human
gcgcctcaaaatgacccctc

SEQ ID NO: 378849 - DNA, 20 bp, human
gacccctaccgctctcctga

SEQ ID NO: 378850 - DNA, 20 bp, human
gactctgaggggttaacgaa

SEQ ID NO: 378851 - DNA, 20 bp, human
gcagtgggaagcgggaaaat

SEQ ID NO: 378852 - DNA, 20 bp, human
gtcggaaacccgagctgcac

SEQ ID NO: 378853 - DNA, 20 bp, human
gtcccccaactttactctga

SEQ ID NO: 378854 - DNA, 20 bp, human
gggcgcgcgtagaggactag

SEQ ID NO: 378855 - DNA, 20 bp, human
gtcgtggaatgaggctcccc

SEQ ID NO: 378856 - DNA, 20 bp, human
gcagactgccctccgacacg

SEQ ID NO: 378857 - DNA, 20 bp, human
gactgccctccgacacgtgg

SEQ ID NO: 378858 - DNA, 20 bp, human
gatcgccaccacgtgtcgga

SEQ ID NO: 378859 - DNA, 20 bp, human
gcaatatcgccaccacgtgt

SEQ ID NO: 378860 - DNA, 20 bp, human
gcggaagagccgcgcgtttc

SEQ ID NO: 378861 - DNA, 20 bp, human
gaacgcgcggctcttccggc

SEQ ID NO: 378862 - DNA, 20 bp, human
ggagggccgcgcagtcggac

SEQ ID NO: 378863 - DNA, 20 bp, human
gtaccccacaggtatcctgt

SEQ ID NO: 378864 - DNA, 20 bp, human
gttaactgcttgtggttgag

SEQ ID NO: 378865 - DNA, 20 bp, human
ggtgccggaagtagtcgggg

SEQ ID NO: 378866 - DNA, 20 bp, human
gcgacagtctctaagggagg

SEQ ID NO: 378867 - DNA, 20 bp, human
gggattacagggaggcgctc

SEQ ID NO: 378868 - DNA, 20 bp, human
ggaaatgcgacagtctctaa

SEQ ID NO: 378869 - DNA, 20 bp, human
gcgcctccctgtaatcccga

SEQ ID NO: 378870 - DNA, 20 bp, human
gctacggccccgcgcgtcac

SEQ ID NO: 378871 - DNA, 20 bp, human
ggcggcctgcgggaggacgg

SEQ ID NO: 378872 - DNA, 20 bp, human
gtcctcccgcaggccgcaga

SEQ ID NO: 378873 - DNA, 20 bp, human
ggacgcgcggggccgtagct

SEQ ID NO: 378874 - DNA, 20 bp, human
ggccctctgcggcctgcggg

SEQ ID NO: 378875 - DNA, 20 bp, human
gagctgggcctagccctctg

SEQ ID NO: 378876 - DNA, 20 bp, human
gctagcggaggggggaatag

SEQ ID NO: 378877 - DNA, 20 bp, human
ggccacgatcacgatcgggg

SEQ ID NO: 378878 - DNA, 20 bp, human
gaggagggatgtttctgcac

SEQ ID NO: 378879 - DNA, 20 bp, human
gagccgtaccattattgaga

SEQ ID NO: 378880 - DNA, 20 bp, human
gtaatggtacggctagcgga

SEQ ID NO: 378881 - DNA, 20 bp, human
gaatgccacgatcacgatcg

SEQ ID NO: 378882 - DNA, 20 bp, human
gaccccggcagccaatcagc

SEQ ID NO: 378883 - DNA, 20 bp, human
gatcacgatcggggaggaag

SEQ ID NO: 378884 - DNA, 20 bp, human
gtcctccccgatcgtgatcg

SEQ ID NO: 378885 - DNA, 20 bp, human
gtcaataatggtacggctag

SEQ ID NO: 378886 - DNA, 20 bp, human
gcgaagggagcattcaaaag

SEQ ID NO: 378887 - DNA, 20 bp, human
gaggcgcactgcacgagtgg

SEQ ID NO: 378888 - DNA, 20 bp, human
gcgcaggcgcactgcacgag

SEQ ID NO: 378889 - DNA, 20 bp, human
gcgaccccggaagtgacttc

SEQ ID NO: 378890 - DNA, 20 bp, human
gcactgcacgagtggaggtg

SEQ ID NO: 378891 - DNA, 20 bp, human
ggggttggcggctgggcgaa

SEQ ID NO: 378892 - DNA, 20 bp, human
gcgagccgagcagaaaccaa

SEQ ID NO: 378893 - DNA, 20 bp, human
gaaaatggaaattggggcga

SEQ ID NO: 378894 - DNA, 20 bp, human
gggaaattggggcgaggggt

SEQ ID NO: 378895 - DNA, 20 bp, human
gagacagttgaggggttcta

SEQ ID NO: 378896 - DNA, 20 bp, human
gtcttggaatgaatgatcgt

SEQ ID NO: 378897 - DNA, 20 bp, human
ggcgtcgcccactttcttat

SEQ ID NO: 378898 - DNA, 20 bp, human
gaaagctcgcagacccctcg

SEQ ID NO: 378899 - DNA, 20 bp, human
gaaagttaggtagtccgcga

SEQ ID NO: 378900 - DNA, 20 bp, human
gcggcacggggggtcggaca

SEQ ID NO: 378901 - DNA, 20 bp, human
gggcgacgcctactgctgag

SEQ ID NO: 378902 - DNA, 20 bp, human
gggagggcagaacccacgga

SEQ ID NO: 378903 - DNA, 20 bp, human
ggcagggaaaccgcgcgctc

SEQ ID NO: 378904 - DNA, 20 bp, human
ggatcaaaccactcagcagt

SEQ ID NO: 378905 - DNA, 20 bp, human
gaaccaaccaataagaaagt

SEQ ID NO: 378906 - DNA, 20 bp, human
gagtcccaatagtggaggcc

SEQ ID NO: 378907 - DNA, 20 bp, human
gtccacccggcctccactat

SEQ ID NO: 378908 - DNA, 20 bp, human
gggcgcgccaggaccctaag

SEQ ID NO: 378909 - DNA, 20 bp, human
gtcccgggaggagagggaac

SEQ ID NO: 378910 - DNA, 20 bp, human
ggtggaggccgggtggactt

SEQ ID NO: 378911 - DNA, 20 bp, human
gctcccttgagtcccaatag

SEQ ID NO: 378912 - DNA, 20 bp, human
ggcagctacccacggtcttc

SEQ ID NO: 378913 - DNA, 20 bp, human
gctccactattgggactcaa

SEQ ID NO: 378914 - DNA, 20 bp, human
ggggcgtgcaggcggcgcgt

SEQ ID NO: 378915 - DNA, 20 bp, human
gaggcacttccggtccaaac

SEQ ID NO: 378916 - DNA, 20 bp, human
gagggaggactgactaacgt

SEQ ID NO: 378917 - DNA, 20 bp, human
ggaggactgactaacgtggg

SEQ ID NO: 378918 - DNA, 20 bp, human
ggggaggagacgcgacgtgg

SEQ ID NO: 378919 - DNA, 20 bp, human
gtattctgaggaggcggggt

SEQ ID NO: 378920 - DNA, 20 bp, human
gcgggaagaaggcgagcggt

SEQ ID NO: 378921 - DNA, 20 bp, human
gtagcaaaacacccagagtc

SEQ ID NO: 378922 - DNA, 20 bp, human
gagaccaccggaaacgaacc

SEQ ID NO: 378923 - DNA, 20 bp, human
gtagctcgcgtattctgagg

SEQ ID NO: 378924 - DNA, 20 bp, human
gggtcccgggtgtgtggcga

SEQ ID NO: 378925 - DNA, 20 bp, human
gccctgcgcggcgagaaaaa

SEQ ID NO: 378926 - DNA, 20 bp, human
gtatcccttactcacctaaa

SEQ ID NO: 378927 - DNA, 20 bp, human
gctcccctttaggtgagtaa

SEQ ID NO: 378928 - DNA, 20 bp, human
gtacgaacaaattttcgaat

SEQ ID NO: 378929 - DNA, 20 bp, human
gcagccaacaggaagaccac

SEQ ID NO: 378930 - DNA, 20 bp, human
gaataggatgatcagtagaa

SEQ ID NO: 378931 - DNA, 20 bp, human
gcttttatagtcaatggtat

SEQ ID NO: 378932 - DNA, 20 bp, human
gctgggcatgttttctgagt

SEQ ID NO: 378933 - DNA, 20 bp, human
gcattatgggctatttaaat

SEQ ID NO: 378934 - DNA, 20 bp, human
ggatcagtagaaaggctagc

SEQ ID NO: 378935 - DNA, 20 bp, human
gataagagctgtagcattat

SEQ ID NO: 378936 - DNA, 20 bp, human
gtgccttggtaaatgatgaa

SEQ ID NO: 378937 - DNA, 20 bp, human
gcacccttcatcatttacca

SEQ ID NO: 378938 - DNA, 20 bp, human
gcatcgtctgctggtgtctt

SEQ ID NO: 378939 - DNA, 20 bp, human
ggatacccgctaaagtaaat

SEQ ID NO: 378940 - DNA, 20 bp, human
gcataatccgagtggtaaag

SEQ ID NO: 378941 - DNA, 20 bp, human
gacagcgaggaagattcatc

SEQ ID NO: 378942 - DNA, 20 bp, human
ggcagccgggtcgcataaac

SEQ ID NO: 378943 - DNA, 20 bp, human
gttgcagcccctttaccact

SEQ ID NO: 378944 - DNA, 20 bp, human
ggatgagtgtaagaagcact

SEQ ID NO: 378945 - DNA, 20 bp, human
gcggcaacatcagtggagcg

SEQ ID NO: 378946 - DNA, 20 bp, human
ggggcagggtgctagtaact

SEQ ID NO: 378947 - DNA, 20 bp, human
gcagggtgctagtaactggg

SEQ ID NO: 378948 - DNA, 20 bp, human
gggcacgcacctcctgattt

SEQ ID NO: 378949 - DNA, 20 bp, human
gcgaagagccaggtataaat

SEQ ID NO: 378950 - DNA, 20 bp, human
ggccaggtataaataggctg

SEQ ID NO: 378951 - DNA, 20 bp, human
gaaccaggaagtcttgtcaa

SEQ ID NO: 378952 - DNA, 20 bp, human
gtgctagtaactgggcgggg

SEQ ID NO: 378953 - DNA, 20 bp, human
ggaagtcttgtcaatgggca

SEQ ID NO: 378954 - DNA, 20 bp, human
gtgaacagacacactgggtc

SEQ ID NO: 378955 - DNA, 20 bp, human
ggaagtctcccgaaatcagg

SEQ ID NO: 378956 - DNA, 20 bp, human
ggggagcggaacgattcctc

SEQ ID NO: 378957 - DNA, 20 bp, human
gttcctcgggatcgcctctg

SEQ ID NO: 378958 - DNA, 20 bp, human
gctggaagccggccggaagc

SEQ ID NO: 378959 - DNA, 20 bp, human
gcgccccggcggccgtccag

SEQ ID NO: 378960 - DNA, 20 bp, human
gtgctggggcgctcacctgg

SEQ ID NO: 378961 - DNA, 20 bp, human
gggcctcagaggcgatcccg

SEQ ID NO: 378962 - DNA, 20 bp, human
gtgagaaagctccgcccctt

SEQ ID NO: 378963 - DNA, 20 bp, human
ggaatcgttccgctcccaag

SEQ ID NO: 378964 - DNA, 20 bp, human
gaagctccgccccttgggag

SEQ ID NO: 378965 - DNA, 20 bp, human
gagaggcaaacgagggatct

SEQ ID NO: 378966 - DNA, 20 bp, human
ggctgcgagcgctagaggcc

SEQ ID NO: 378967 - DNA, 20 bp, human
ggctgcggcgcgcgcttaaa

SEQ ID NO: 378968 - DNA, 20 bp, human
gggggcgcgggatgcgggaa

SEQ ID NO: 378969 - DNA, 20 bp, human
gggcgcgcgcttaaaaggcg

SEQ ID NO: 378970 - DNA, 20 bp, human
gcaatggctgcgagcgctag

SEQ ID NO: 378971 - DNA, 20 bp, human
gaggcgggcgggaacgggga

SEQ ID NO: 378972 - DNA, 20 bp, human
gcgcgccgcagccaatcgcc

SEQ ID NO: 378973 - DNA, 20 bp, human
gcgaggaggaggttccgact

SEQ ID NO: 378974 - DNA, 20 bp, human
gcgagcgcgcctgggcgagg

SEQ ID NO: 378975 - DNA, 20 bp, human
ggcccagcgcccgccccagt

SEQ ID NO: 378976 - DNA, 20 bp, human
gcgcgtgattggccaaggag

SEQ ID NO: 378977 - DNA, 20 bp, human
ggccggatcccggggaaacc

SEQ ID NO: 378978 - DNA, 20 bp, human
gcccgtgacgtcactgggga

SEQ ID NO: 378979 - DNA, 20 bp, human
gccagaatcgccagcaagga

SEQ ID NO: 378980 - DNA, 20 bp, human
ggtcactggggacggctcca

SEQ ID NO: 378981 - DNA, 20 bp, human
gagacctcgcgcacgcgccc

SEQ ID NO: 378982 - DNA, 20 bp, human
gcttgcccctcccacgtgat

SEQ ID NO: 378983 - DNA, 20 bp, human
gccgcgcccgtgacgtcact

SEQ ID NO: 378984 - DNA, 20 bp, human
ggccgtccccagtgacgtca

SEQ ID NO: 378985 - DNA, 20 bp, human
gcgggcgcggctccgctcct

SEQ ID NO: 378986 - DNA, 20 bp, human
gaaggaaggagaaacggaat

SEQ ID NO: 378987 - DNA, 20 bp, human
gtcaaaaccgagcgaaagaa

SEQ ID NO: 378988 - DNA, 20 bp, human
gctcctccccgccctccatg

SEQ ID NO: 378989 - DNA, 20 bp, human
gataaatggcaattattctc

SEQ ID NO: 378990 - DNA, 20 bp, human
gggccatttacggcagtagg

SEQ ID NO: 378991 - DNA, 20 bp, human
ggtaggccatttacggcagt

SEQ ID NO: 378992 - DNA, 20 bp, human
gaaaatgcaatcacgcttga

SEQ ID NO: 378993 - DNA, 20 bp, human
gaactctagtaggccattta

SEQ ID NO: 378994 - DNA, 20 bp, human
gtgcattttcgccacatgga

SEQ ID NO: 378995 - DNA, 20 bp, human
gttcctgcctttctttcgct

SEQ ID NO: 378996 - DNA, 20 bp, human
gggtaccggtcccacgtggt

SEQ ID NO: 378997 - DNA, 20 bp, human
gcgcgggtaccggtcccacg

SEQ ID NO: 378998 - DNA, 20 bp, human
gtcccgcgtccccaccacgt

SEQ ID NO: 378999 - DNA, 20 bp, human
gggacgcgggacccgtacag

SEQ ID NO: 379000 - DNA, 20 bp, human
gccgctgcgccgccggcgtc

SEQ ID NO: 379001 - DNA, 20 bp, human
ggacagctccgggtagacag

SEQ ID NO: 379002 - DNA, 20 bp, human
gctgcgccgccggcgtccgg

SEQ ID NO: 379003 - DNA, 20 bp, human
gcgtccccaccacgtgggac

SEQ ID NO: 379004 - DNA, 20 bp, human
ggcgtccggcggaaggagcg

SEQ ID NO: 379005 - DNA, 20 bp, human
ggaggcgcctcgcccattgg

SEQ ID NO: 379006 - DNA, 20 bp, human
gaagaggcgccacaaaacgg

SEQ ID NO: 379007 - DNA, 20 bp, human
ggatcagcccaacaagggtg

SEQ ID NO: 379008 - DNA, 20 bp, human
gcgcatgcgccgaccttcct

SEQ ID NO: 379009 - DNA, 20 bp, human
gccaggacctgctcccacga

SEQ ID NO: 379010 - DNA, 20 bp, human
gcctggcagccgggtagtga

SEQ ID NO: 379011 - DNA, 20 bp, human
ggcaaccttaaatccagccg

SEQ ID NO: 379012 - DNA, 20 bp, human
gaacgaggccccacccttgt

SEQ ID NO: 379013 - DNA, 20 bp, human
gtataaggagcactccctct

SEQ ID NO: 379014 - DNA, 20 bp, human
gggtggggcctcgttgctac

SEQ ID NO: 379015 - DNA, 20 bp, human
gaaatccagccgaggaaggt

SEQ ID NO: 379016 - DNA, 20 bp, human
gaggcttcctggctcttgat

SEQ ID NO: 379017 - DNA, 20 bp, human
gaacagactgtagagaccgg

SEQ ID NO: 379018 - DNA, 20 bp, human
gcgactggctgtattgggga

SEQ ID NO: 379019 - DNA, 20 bp, human
gcccgccgactggctgtatt

SEQ ID NO: 379020 - DNA, 20 bp, human
gctctacagtctgttcacac

SEQ ID NO: 379021 - DNA, 20 bp, human
gttccaaggcgcccgccgac

SEQ ID NO: 379022 - DNA, 20 bp, human
gggaaagtttccggccctcc

SEQ ID NO: 379023 - DNA, 20 bp, human
ggggcgccttggaaagtttc

SEQ ID NO: 379024 - DNA, 20 bp, human
gcactggccaatcaagagcc

SEQ ID NO: 379025 - DNA, 20 bp, human
gagaggttgctttaagaagc

SEQ ID NO: 379026 - DNA, 20 bp, human
gacagcccctccgggcggaa

SEQ ID NO: 379027 - DNA, 20 bp, human
ggaaaagatgagtttcacgc

SEQ ID NO: 379028 - DNA, 20 bp, human
ggcggagccccagctagcgc

SEQ ID NO: 379029 - DNA, 20 bp, human
gtccgcccttccgcccggag

SEQ ID NO: 379030 - DNA, 20 bp, human
gagaacttgtttttccggga

SEQ ID NO: 379031 - DNA, 20 bp, human
gtcgcgagaacttgtttttc

SEQ ID NO: 379032 - DNA, 20 bp, human
ggctacgtcgcgacgcgggg

SEQ ID NO: 379033 - DNA, 20 bp, human
gggggctccgcccttccgcc

SEQ ID NO: 379034 - DNA, 20 bp, human
ggagtgacagcccctccggg

SEQ ID NO: 379035 - DNA, 20 bp, human
gattgcgcctgcgctagctg

SEQ ID NO: 379036 - DNA, 20 bp, human
gacctcgcgaagcaagaccg

SEQ ID NO: 379037 - DNA, 20 bp, human
gctgggcgggaaggctcgaa

SEQ ID NO: 379038 - DNA, 20 bp, human
gctcccctcggcgctcccct

SEQ ID NO: 379039 - DNA, 20 bp, human
gggactggagcacgacttcg

SEQ ID NO: 379040 - DNA, 20 bp, human
gccgcccagcacgcggtgag

SEQ ID NO: 379041 - DNA, 20 bp, human
ggagggggacgcgactgctc

SEQ ID NO: 379042 - DNA, 20 bp, human
ggaaaggcgcggagcgccga

SEQ ID NO: 379043 - DNA, 20 bp, human
ggccgcgctgcccagcggac

SEQ ID NO: 379044 - DNA, 20 bp, human
gcgggaaggctcgaaaggcg

SEQ ID NO: 379045 - DNA, 20 bp, human
ggcttcaaaacaagttacct

SEQ ID NO: 379046 - DNA, 20 bp, human
ggggacgcctccggtgaccc

SEQ ID NO: 379047 - DNA, 20 bp, human
gaggcgtcccccaaccgact

SEQ ID NO: 379048 - DNA, 20 bp, human
gggtggctccggaacggtaa

SEQ ID NO: 379049 - DNA, 20 bp, human
gtcacgtgagccggggtcac

SEQ ID NO: 379050 - DNA, 20 bp, human
gtgggcttcggaaaaccaag

SEQ ID NO: 379051 - DNA, 20 bp, human
gcgtgagccggggtcaccgg

SEQ ID NO: 379052 - DNA, 20 bp, human
gacactacgccagaacaaga

SEQ ID NO: 379053 - DNA, 20 bp, human
gttccgaagcccagtcggtt

SEQ ID NO: 379054 - DNA, 20 bp, human
ggctccggaacggtaagggc

SEQ ID NO: 379055 - DNA, 20 bp, human
gctcggagccgagagagttt

SEQ ID NO: 379056 - DNA, 20 bp, human
ggacccgcccatcccatctg

SEQ ID NO: 379057 - DNA, 20 bp, human
gtcaacgccgagcctctcgg

SEQ ID NO: 379058 - DNA, 20 bp, human
ggggccgccggggcaggcta

SEQ ID NO: 379059 - DNA, 20 bp, human
gactggtcggcgcaagcgaa

SEQ ID NO: 379060 - DNA, 20 bp, human
gcgaaagccaggtaaccagt

SEQ ID NO: 379061 - DNA, 20 bp, human
gggtcggcgcaagcgaaggg

SEQ ID NO: 379062 - DNA, 20 bp, human
gtcccggggaccttccagac

SEQ ID NO: 379063 - DNA, 20 bp, human
gtcggcgttgagcccgggta

SEQ ID NO: 379064 - DNA, 20 bp, human
gtggagggtgggcataactc

SEQ ID NO: 379065 - DNA, 20 bp, human
ggcgcccgaagccgtcgcgg

SEQ ID NO: 379066 - DNA, 20 bp, human
ggggtgcccgagttcagtat

SEQ ID NO: 379067 - DNA, 20 bp, human
gtcagcaagccgctggccag

SEQ ID NO: 379068 - DNA, 20 bp, human
gcaggggaagagacgcgctg

SEQ ID NO: 379069 - DNA, 20 bp, human
gaggagggaaacggaaggcg

SEQ ID NO: 379070 - DNA, 20 bp, human
gaggagagaggagagctcgc

SEQ ID NO: 379071 - DNA, 20 bp, human
gagggacccccgcaaaggtg

SEQ ID NO: 379072 - DNA, 20 bp, human
gctgaaactcccgcccccgg

SEQ ID NO: 379073 - DNA, 20 bp, human
gccggcaaagggcaccaagt

SEQ ID NO: 379074 - DNA, 20 bp, human
ggggccaacctcacctttgc

SEQ ID NO: 379075 - DNA, 20 bp, human
gccgagttcagtattggaag

SEQ ID NO: 379076 - DNA, 20 bp, human
gagaccggaaagaacatcat

SEQ ID NO: 379077 - DNA, 20 bp, human
gacattcagcccataggtga

SEQ ID NO: 379078 - DNA, 20 bp, human
gagctgccctaaaaggaatg

SEQ ID NO: 379079 - DNA, 20 bp, human
gaagacatagctgccctaaa

SEQ ID NO: 379080 - DNA, 20 bp, human
gaatcagagccttcacctat

SEQ ID NO: 379081 - DNA, 20 bp, human
gtataagcgaaggggcgggc

SEQ ID NO: 379082 - DNA, 20 bp, human
gaggctctgattaatgtcat

SEQ ID NO: 379083 - DNA, 20 bp, human
gtcatgggctgtcacacgga

SEQ ID NO: 379084 - DNA, 20 bp, human
gctctgattaatgtcatagg

SEQ ID NO: 379085 - DNA, 20 bp, human
gtaacagtgtcccacatcca

SEQ ID NO: 379086 - DNA, 20 bp, human
gtcccccagtgactccacac

SEQ ID NO: 379087 - DNA, 20 bp, human
gccggtagactgctccaact

SEQ ID NO: 379088 - DNA, 20 bp, human
ggccgaggagcgagccagtg

SEQ ID NO: 379089 - DNA, 20 bp, human
gccacacaggctccatattt

SEQ ID NO: 379090 - DNA, 20 bp, human
gcctccctgctagaggaagc

SEQ ID NO: 379091 - DNA, 20 bp, human
ggaggctgacatcaccacgg

SEQ ID NO: 379092 - DNA, 20 bp, human
ggagtcactgggggagccgg

SEQ ID NO: 379093 - DNA, 20 bp, human
ggagccggcttcctctagca

SEQ ID NO: 379094 - DNA, 20 bp, human
gtggggagccgggaatccca

SEQ ID NO: 379095 - DNA, 20 bp, human
ggcagccgtaagtccgggca

SEQ ID NO: 379096 - DNA, 20 bp, human
gccataggaaggacccttgt

SEQ ID NO: 379097 - DNA, 20 bp, human
ggggaaagctaaagcaggcc

SEQ ID NO: 379098 - DNA, 20 bp, human
gaagaagtatgacgaggagc

SEQ ID NO: 379099 - DNA, 20 bp, human
gtcagagaggtgtctggagt

SEQ ID NO: 379100 - DNA, 20 bp, human
gaaagaggataccaggtctt

SEQ ID NO: 379101 - DNA, 20 bp, human
gcgcggctcatgccatagga

SEQ ID NO: 379102 - DNA, 20 bp, human
gacccttgttggccatgtct

SEQ ID NO: 379103 - DNA, 20 bp, human
gacttcgcggctcatgccat

SEQ ID NO: 379104 - DNA, 20 bp, human
gctgtgacaagtgtctagga

SEQ ID NO: 379105 - DNA, 20 bp, human
ggtgcagtgtggccctgatg

SEQ ID NO: 379106 - DNA, 20 bp, human
ggcgccgcagcgcagaagga

SEQ ID NO: 379107 - DNA, 20 bp, human
gtggaggctgaggtactcac

SEQ ID NO: 379108 - DNA, 20 bp, human
ggaggactgcttgagacaga

SEQ ID NO: 379109 - DNA, 20 bp, human
gcagccggggattttcagga

SEQ ID NO: 379110 - DNA, 20 bp, human
gagaccagagcaagggttaa

SEQ ID NO: 379111 - DNA, 20 bp, human
ggagtctgaatctacaaagg

SEQ ID NO: 379112 - DNA, 20 bp, human
gggtccgccccgtctgaggc

SEQ ID NO: 379113 - DNA, 20 bp, human
gctactggggcacaagtcta

SEQ ID NO: 379114 - DNA, 20 bp, human
gtctacaaaggcggctgcag

SEQ ID NO: 379115 - DNA, 20 bp, human
gagcaagggttaaaggttcg

SEQ ID NO: 379116 - DNA, 20 bp, human
gcagctgcacaaggggatga

SEQ ID NO: 379117 - DNA, 20 bp, human
gggaagagcaggtaattagc

SEQ ID NO: 379118 - DNA, 20 bp, human
gaacctccggccggtccagg

SEQ ID NO: 379119 - DNA, 20 bp, human
ggattccagcccccctggac

SEQ ID NO: 379120 - DNA, 20 bp, human
gtgctggcctcgtagacaat

SEQ ID NO: 379121 - DNA, 20 bp, human
gcggctgtctccccagaaga

SEQ ID NO: 379122 - DNA, 20 bp, human
gtgcagttcaacatgaaagg

SEQ ID NO: 379123 - DNA, 20 bp, human
gtgcaaagtgctactgagaa

SEQ ID NO: 379124 - DNA, 20 bp, human
gggctgcagttcaacatgaa

SEQ ID NO: 379125 - DNA, 20 bp, human
gaggcgggcttgattgacac

SEQ ID NO: 379126 - DNA, 20 bp, human
gaaccagaacccaattccag

SEQ ID NO: 379127 - DNA, 20 bp, human
gcggaggtccgtgttgggaa

SEQ ID NO: 379128 - DNA, 20 bp, human
gtacagaaatggagttggga

SEQ ID NO: 379129 - DNA, 20 bp, human
gaaagtacagcccctggaat

SEQ ID NO: 379130 - DNA, 20 bp, human
gagcccctggaattgggttc

SEQ ID NO: 379131 - DNA, 20 bp, human
ggtcttcagactctggtcgg

SEQ ID NO: 379132 - DNA, 20 bp, human
ggatgggcggaggtccgtgt

SEQ ID NO: 379133 - DNA, 20 bp, human
gttgggttctggtttcgctt

SEQ ID NO: 379134 - DNA, 20 bp, human
gatcagtagggagacgagaa

SEQ ID NO: 379135 - DNA, 20 bp, human
ggcgaatagtcttcagactc

SEQ ID NO: 379136 - DNA, 20 bp, human
ggccccccccggccatcgaa

SEQ ID NO: 379137 - DNA, 20 bp, human
gcacacgcgtacccccgtag

SEQ ID NO: 379138 - DNA, 20 bp, human
gtgcggacgtggggaaaaag

SEQ ID NO: 379139 - DNA, 20 bp, human
gcgaaaggaaccgagggaaa

SEQ ID NO: 379140 - DNA, 20 bp, human
gggccatcgaaaggaaccga

SEQ ID NO: 379141 - DNA, 20 bp, human
gtacgcgtgtggccattttg

SEQ ID NO: 379142 - DNA, 20 bp, human
gtgggattacagcgcgtcgg

SEQ ID NO: 379143 - DNA, 20 bp, human
ggcctcggcccatgctaacg

SEQ ID NO: 379144 - DNA, 20 bp, human
gggaaggaagagagtctccg

SEQ ID NO: 379145 - DNA, 20 bp, human
gtggccgaggcgcttatcgg

SEQ ID NO: 379146 - DNA, 20 bp, human
gcatatgtttgtgtccctgt

SEQ ID NO: 379147 - DNA, 20 bp, human
ggcgtcactgatgcctcgaa

SEQ ID NO: 379148 - DNA, 20 bp, human
gcgagaaaatctaacatctc

SEQ ID NO: 379149 - DNA, 20 bp, human
gatatgcctctcacctttcg

SEQ ID NO: 379150 - DNA, 20 bp, human
gtaggaagagttggttataa

SEQ ID NO: 379151 - DNA, 20 bp, human
ggacaaagcaatctttcaac

SEQ ID NO: 379152 - DNA, 20 bp, human
gaacatctcaggttcttggc

SEQ ID NO: 379153 - DNA, 20 bp, human
ggattcatttcctcattttc

SEQ ID NO: 379154 - DNA, 20 bp, human
gatctaacatctcaggttct

SEQ ID NO: 379155 - DNA, 20 bp, human
gaaggaagaaacaggagtat

SEQ ID NO: 379156 - DNA, 20 bp, human
gggcgctcgggcttcgtccc

SEQ ID NO: 379157 - DNA, 20 bp, human
gctacaggctgggtctcccc

SEQ ID NO: 379158 - DNA, 20 bp, human
gttcccgggcccgtccgcgg

SEQ ID NO: 379159 - DNA, 20 bp, human
ggctcgggcttcgtccccgg

SEQ ID NO: 379160 - DNA, 20 bp, human
gcccgcgggacgcaccggga

SEQ ID NO: 379161 - DNA, 20 bp, human
ggcccacaatgccccgcggg

SEQ ID NO: 379162 - DNA, 20 bp, human
ggaagcccgagcgccactgc

SEQ ID NO: 379163 - DNA, 20 bp, human
gagccgccgcggacgggccc

SEQ ID NO: 379164 - DNA, 20 bp, human
gaaaacacctgcacgacacg

SEQ ID NO: 379165 - DNA, 20 bp, human
gctgccccgcgggacgcacc

SEQ ID NO: 379166 - DNA, 20 bp, human
gggtcggaggagtgccctac

SEQ ID NO: 379167 - DNA, 20 bp, human
gtgcgacttggacaaatcgg

SEQ ID NO: 379168 - DNA, 20 bp, human
gggcactcctccgaccacga

SEQ ID NO: 379169 - DNA, 20 bp, human
gcggtgctcgccttagtgtg

SEQ ID NO: 379170 - DNA, 20 bp, human
gcgtgcgtggggcgtagcaa

SEQ ID NO: 379171 - DNA, 20 bp, human
gggagtgccctacaggctgg

SEQ ID NO: 379172 - DNA, 20 bp, human
gcgagcgtcacccgactccg

SEQ ID NO: 379173 - DNA, 20 bp, human
gacagaggctatcaaggctc

SEQ ID NO: 379174 - DNA, 20 bp, human
gcctcgcgttccccacacta

SEQ ID NO: 379175 - DNA, 20 bp, human
ggctcagggcccgcggagtc

SEQ ID NO: 379176 - DNA, 20 bp, human
gctgcggcggatccagggac

SEQ ID NO: 379177 - DNA, 20 bp, human
gccgggctgcggcggatcca

SEQ ID NO: 379178 - DNA, 20 bp, human
gcccttgcgcgtgttcccga

SEQ ID NO: 379179 - DNA, 20 bp, human
gacctcgcgcccaagccccg

SEQ ID NO: 379180 - DNA, 20 bp, human
gcgcgctgccaatgaggccc

SEQ ID NO: 379181 - DNA, 20 bp, human
ggacccggtgcccagaggga

SEQ ID NO: 379182 - DNA, 20 bp, human
gccgcgctccagccggtccc

SEQ ID NO: 379183 - DNA, 20 bp, human
ggggcgggcgcgcgagagga

SEQ ID NO: 379184 - DNA, 20 bp, human
gggagcgcgaactttccgcg

SEQ ID NO: 379185 - DNA, 20 bp, human
gcgcgagaggaaggtgcctt

SEQ ID NO: 379186 - DNA, 20 bp, human
gaataaatgattgagaggac

SEQ ID NO: 379187 - DNA, 20 bp, human
gataacttaaagggtacaac

SEQ ID NO: 379188 - DNA, 20 bp, human
gttattttcatagcataaga

SEQ ID NO: 379189 - DNA, 20 bp, human
gcatgttttaataacttaaa

SEQ ID NO: 379190 - DNA, 20 bp, human
gcaataaataaatgattgag

SEQ ID NO: 379191 - DNA, 20 bp, human
gtaattttcatttttaatta

SEQ ID NO: 379192 - DNA, 20 bp, human
gaagcacattatgaagaatg

SEQ ID NO: 379193 - DNA, 20 bp, human
gcaatcatttatttattgag

SEQ ID NO: 379194 - DNA, 20 bp, human
gtagttgtatatatttatgg

SEQ ID NO: 379195 - DNA, 20 bp, human
gatttgtttttactttttgt

SEQ ID NO: 379196 - DNA, 20 bp, human
gtgggcgcgctgtcgctcgg

SEQ ID NO: 379197 - DNA, 20 bp, human
gcccgcgcagcccgaagctt

SEQ ID NO: 379198 - DNA, 20 bp, human
gcgacagcgcgcccagccaa

SEQ ID NO: 379199 - DNA, 20 bp, human
gcgcccagccaacgggacgc

SEQ ID NO: 379200 - DNA, 20 bp, human
gcggggctgcgccaaagctt

SEQ ID NO: 379201 - DNA, 20 bp, human
gccccgaaggccgctggatc

SEQ ID NO: 379202 - DNA, 20 bp, human
gggagccgcggagtccccga

SEQ ID NO: 379203 - DNA, 20 bp, human
gtgacagatggtgtccatga

SEQ ID NO: 379204 - DNA, 20 bp, human
gtgccggcgtcccgttggct

SEQ ID NO: 379205 - DNA, 20 bp, human
gggcccaatggtgaacgcgc

SEQ ID NO: 379206 - DNA, 20 bp, human
ggtaagagggaacccaaaaa

SEQ ID NO: 379207 - DNA, 20 bp, human
ggggcggggccaaatcgatc

SEQ ID NO: 379208 - DNA, 20 bp, human
gaaggctctgggcacactat

SEQ ID NO: 379209 - DNA, 20 bp, human
gcttagtccggggggtaaga

SEQ ID NO: 379210 - DNA, 20 bp, human
gccgtcccggcttagtccgg

SEQ ID NO: 379211 - DNA, 20 bp, human
gccctgccgaggcgcctgag

SEQ ID NO: 379212 - DNA, 20 bp, human
ggccgccgccatgttaagtg

SEQ ID NO: 379213 - DNA, 20 bp, human
gttaccccccggactaagcc

SEQ ID NO: 379214 - DNA, 20 bp, human
ggggcagattagccattttt

SEQ ID NO: 379215 - DNA, 20 bp, human
gggggcgttcccgatcgatt

SEQ ID NO: 379216 - DNA, 20 bp, human
gtgggtggggcagggcggaa

SEQ ID NO: 379217 - DNA, 20 bp, human
gaagaggcggggacttggct

SEQ ID NO: 379218 - DNA, 20 bp, human
gcaggcactgccctctgaac

SEQ ID NO: 379219 - DNA, 20 bp, human
gtgggggagggcgctaggcg

SEQ ID NO: 379220 - DNA, 20 bp, human
gcctccacccaacaaggcca

SEQ ID NO: 379221 - DNA, 20 bp, human
gaatcctatgtcaagtgtaa

SEQ ID NO: 379222 - DNA, 20 bp, human
gtgacctttacacttgacat

SEQ ID NO: 379223 - DNA, 20 bp, human
gtcttcacctccacccaaca

SEQ ID NO: 379224 - DNA, 20 bp, human
gtttctaagaggcggggact

SEQ ID NO: 379225 - DNA, 20 bp, human
gaaatgaaagctgtaggagt

SEQ ID NO: 379226 - DNA, 20 bp, human
gtcagagctacagtcacgag

SEQ ID NO: 379227 - DNA, 20 bp, human
gaagttgggggatttctcag

SEQ ID NO: 379228 - DNA, 20 bp, human
gctgttgctagctacaaata

SEQ ID NO: 379229 - DNA, 20 bp, human
gttcagtatcgtgccatgat

SEQ ID NO: 379230 - DNA, 20 bp, human
gtcaaaaagcgacttcttaa

SEQ ID NO: 379231 - DNA, 20 bp, human
gcttctgagtacctaagctc

SEQ ID NO: 379232 - DNA, 20 bp, human
gagttcccacttcaacataa

SEQ ID NO: 379233 - DNA, 20 bp, human
gtaaggaagtcttcaagttg

SEQ ID NO: 379234 - DNA, 20 bp, human
gtttctgccttgagaactta

SEQ ID NO: 379235 - DNA, 20 bp, human
gtaaagtatcttgcttcaaa

SEQ ID NO: 379236 - DNA, 20 bp, human
ggtaaggaggcgctcacaaa

SEQ ID NO: 379237 - DNA, 20 bp, human
ggtctccgtcgccgcctcgg

SEQ ID NO: 379238 - DNA, 20 bp, human
ggggacgaccggggtcgagg

SEQ ID NO: 379239 - DNA, 20 bp, human
gctcgcgagatcggagacgg

SEQ ID NO: 379240 - DNA, 20 bp, human
gtctagtcctcacacagccg

SEQ ID NO: 379241 - DNA, 20 bp, human
ggatcggagacgggggatga

SEQ ID NO: 379242 - DNA, 20 bp, human
ggtggcggagggctgcgcgt

SEQ ID NO: 379243 - DNA, 20 bp, human
gaggcactcgcgaacatctg

SEQ ID NO: 379244 - DNA, 20 bp, human
gccctctcggtcccccgccg

SEQ ID NO: 379245 - DNA, 20 bp, human
ggggtggtgttggtggcgga

SEQ ID NO: 379246 - DNA, 20 bp, human
gcactctgtcccacgactgg

SEQ ID NO: 379247 - DNA, 20 bp, human
gagaagagctagacttgcaa

SEQ ID NO: 379248 - DNA, 20 bp, human
ggcggggcgggcgcgcactc

SEQ ID NO: 379249 - DNA, 20 bp, human
gagtcgtgggacagagtgcc

SEQ ID NO: 379250 - DNA, 20 bp, human
gtggcggctgccggtctccc

SEQ ID NO: 379251 - DNA, 20 bp, human
gtctgtccaccgccagtcgt

SEQ ID NO: 379252 - DNA, 20 bp, human
gggagcgcgcaggcgcggta

SEQ ID NO: 379253 - DNA, 20 bp, human
gaagctcgggctcagagcga

SEQ ID NO: 379254 - DNA, 20 bp, human
gcggcctggggtccgcgtgg

SEQ ID NO: 379255 - DNA, 20 bp, human
gctgccgcggcctgggagac

SEQ ID NO: 379256 - DNA, 20 bp, human
ggacaactccgccaatcctc

SEQ ID NO: 379257 - DNA, 20 bp, human
gccccaagctcggctccaat

SEQ ID NO: 379258 - DNA, 20 bp, human
ggtcgatggaacccgaggat

SEQ ID NO: 379259 - DNA, 20 bp, human
ggccctgtgccccgcgatca

SEQ ID NO: 379260 - DNA, 20 bp, human
ggattggcggagttgtcgat

SEQ ID NO: 379261 - DNA, 20 bp, human
gtgggaagccgagcggtcga

SEQ ID NO: 379262 - DNA, 20 bp, human
gatcgcggggcacagggccg

SEQ ID NO: 379263 - DNA, 20 bp, human
ggagcggtcgatggaacccg

SEQ ID NO: 379264 - DNA, 20 bp, human
gtacgggcccgcctggggtg

SEQ ID NO: 379265 - DNA, 20 bp, human
gtgtgccccgcgatcaggga

SEQ ID NO: 379266 - DNA, 20 bp, human
gatcaagtagatatcagaac

SEQ ID NO: 379267 - DNA, 20 bp, human
gtatctacttgataccataa

SEQ ID NO: 379268 - DNA, 20 bp, human
gtcctcttttgtaggtactg

SEQ ID NO: 379269 - DNA, 20 bp, human
gctatcaatgctcaccgtta

SEQ ID NO: 379270 - DNA, 20 bp, human
gctccctgcatactagagta

SEQ ID NO: 379271 - DNA, 20 bp, human
ggataaaaacagcgtgatct

SEQ ID NO: 379272 - DNA, 20 bp, human
ggcaagttttcctcttttgt

SEQ ID NO: 379273 - DNA, 20 bp, human
gaaaccttactctagtatgc

SEQ ID NO: 379274 - DNA, 20 bp, human
gtgacgttagctgtctgacc

SEQ ID NO: 379275 - DNA, 20 bp, human
ggcttaaagagagtacttcc

SEQ ID NO: 379276 - DNA, 20 bp, human
gaggcagggagaggcgagaa

SEQ ID NO: 379277 - DNA, 20 bp, human
ggggaaagcgaaatcgaaag

SEQ ID NO: 379278 - DNA, 20 bp, human
gtgccccgagacaagtgacg

SEQ ID NO: 379279 - DNA, 20 bp, human
gcgcggcgctaacgtgtgta

SEQ ID NO: 379280 - DNA, 20 bp, human
gaaaactggtgcaagtggaa

SEQ ID NO: 379281 - DNA, 20 bp, human
gcctcctggcggcgccgcga

SEQ ID NO: 379282 - DNA, 20 bp, human
gcccgcccggggtaagtccc

SEQ ID NO: 379283 - DNA, 20 bp, human
gccccagccgccagtagggg

SEQ ID NO: 379284 - DNA, 20 bp, human
gctgcctcgtcacttgtctc

SEQ ID NO: 379285 - DNA, 20 bp, human
ggaacaggctgatcctgcgc

SEQ ID NO: 379286 - DNA, 20 bp, human
gggaactggagcccgaactc

SEQ ID NO: 379287 - DNA, 20 bp, human
gggcgagtgagactcattgc

SEQ ID NO: 379288 - DNA, 20 bp, human
ggacccgcagacagcggaac

SEQ ID NO: 379289 - DNA, 20 bp, human
gactctggttcgcactgtac

SEQ ID NO: 379290 - DNA, 20 bp, human
gacagtgcgaaccagagttc

SEQ ID NO: 379291 - DNA, 20 bp, human
gcagcccagaatgaaggcct

SEQ ID NO: 379292 - DNA, 20 bp, human
ggcgcgagacccgcagacag

SEQ ID NO: 379293 - DNA, 20 bp, human
gagggcgggcgtcagggctc

SEQ ID NO: 379294 - DNA, 20 bp, human
gggaagcaggagcgtggagt

SEQ ID NO: 379295 - DNA, 20 bp, human
gtctcactcgcctttagtgg

SEQ ID NO: 379296 - DNA, 20 bp, human
gggggtgtcctggtgagaac

SEQ ID NO: 379297 - DNA, 20 bp, human
gttggggagggctcgaactc

SEQ ID NO: 379298 - DNA, 20 bp, human
gcaaggagggagtaagtcgt

SEQ ID NO: 379299 - DNA, 20 bp, human
gagtccaggagggcgcggta

SEQ ID NO: 379300 - DNA, 20 bp, human
ggtcctggtgagaactggag

SEQ ID NO: 379301 - DNA, 20 bp, human
gcggtaaggctggggtgtcc

SEQ ID NO: 379302 - DNA, 20 bp, human
ggggacgcggcacagatagg

SEQ ID NO: 379303 - DNA, 20 bp, human
gccccgctctggttaggtga

SEQ ID NO: 379304 - DNA, 20 bp, human
ggaactggagaggatctacc

SEQ ID NO: 379305 - DNA, 20 bp, human
gagcacacacaggagttggg

SEQ ID NO: 379306 - DNA, 20 bp, human
gaagcaggccccaacataac

SEQ ID NO: 379307 - DNA, 20 bp, human
gttggggcctgcttaagggc

SEQ ID NO: 379308 - DNA, 20 bp, human
gtatgttggggcctgcttaa

SEQ ID NO: 379309 - DNA, 20 bp, human
gttctcagccggttatgttg

SEQ ID NO: 379310 - DNA, 20 bp, human
gacgaggacaaatatggatg

SEQ ID NO: 379311 - DNA, 20 bp, human
gacaggatccacagtagcct

SEQ ID NO: 379312 - DNA, 20 bp, human
gaggggatttccgggtgagg

SEQ ID NO: 379313 - DNA, 20 bp, human
gaaatcaccaggggatttcc

SEQ ID NO: 379314 - DNA, 20 bp, human
ggctataactgtgggaaaag

SEQ ID NO: 379315 - DNA, 20 bp, human
gctcacccccgcccttaagc

SEQ ID NO: 379316 - DNA, 20 bp, human
gcgcctccggggctcgagtc

SEQ ID NO: 379317 - DNA, 20 bp, human
gccaccaccagctggggcgg

SEQ ID NO: 379318 - DNA, 20 bp, human
gaagatggcggctaccgtgg

SEQ ID NO: 379319 - DNA, 20 bp, human
gggcgccgcccgccaggtct

SEQ ID NO: 379320 - DNA, 20 bp, human
gaagaagatggcggctaccg

SEQ ID NO: 379321 - DNA, 20 bp, human
gctgcgcggtcccgcagagc

SEQ ID NO: 379322 - DNA, 20 bp, human
gcacgcgtcgctgacgccaa

SEQ ID NO: 379323 - DNA, 20 bp, human
gccgctgcccgcagtctgcg

SEQ ID NO: 379324 - DNA, 20 bp, human
gatggcggctaccgtggcgg

SEQ ID NO: 379325 - DNA, 20 bp, human
gaatggctcgcgccggtcgg

SEQ ID NO: 379326 - DNA, 20 bp, human
gcgcacgcgcacgtaggggc

SEQ ID NO: 379327 - DNA, 20 bp, human
gcaccggcccgggctcccaa

SEQ ID NO: 379328 - DNA, 20 bp, human
gggctcccaaaggaaggcgc

SEQ ID NO: 379329 - DNA, 20 bp, human
gagagagggggatcccagcc

SEQ ID NO: 379330 - DNA, 20 bp, human
gggcgctcggcaaatggagt

SEQ ID NO: 379331 - DNA, 20 bp, human
ggaccaggtgggttctatct

SEQ ID NO: 379332 - DNA, 20 bp, human
ggggcgcgcggccgcagaga

SEQ ID NO: 379333 - DNA, 20 bp, human
gcacgccggcgccttccttt

SEQ ID NO: 379334 - DNA, 20 bp, human
gaggtgggttctatctaggc

SEQ ID NO: 379335 - DNA, 20 bp, human
gggcagaccaacctccaatc

SEQ ID NO: 379336 - DNA, 20 bp, human
gcacgcagagggttgtgggg

SEQ ID NO: 379337 - DNA, 20 bp, human
ggaggggaagccgctgggta

SEQ ID NO: 379338 - DNA, 20 bp, human
gcacgcacgcagagggttgt

SEQ ID NO: 379339 - DNA, 20 bp, human
ggggaagccgctgggtaggg

SEQ ID NO: 379340 - DNA, 20 bp, human
ggcaggctgcaccgccttct

SEQ ID NO: 379341 - DNA, 20 bp, human
gggcgagccacgcacgcaga

SEQ ID NO: 379342 - DNA, 20 bp, human
gcacgaagtagggtgggcgg

SEQ ID NO: 379343 - DNA, 20 bp, human
ggaggctcacgaagtagggt

SEQ ID NO: 379344 - DNA, 20 bp, human
gcgcccgcggggacggagga

SEQ ID NO: 379345 - DNA, 20 bp, human
gcggccttctcgagaagcga

SEQ ID NO: 379346 - DNA, 20 bp, human
gccacctgggaggcaggata

SEQ ID NO: 379347 - DNA, 20 bp, human
gacctgggccggcggttggt

SEQ ID NO: 379348 - DNA, 20 bp, human
ggtaacgtagcagatggttt

SEQ ID NO: 379349 - DNA, 20 bp, human
ggggtcatcgtggctctcgt

SEQ ID NO: 379350 - DNA, 20 bp, human
gccaccggttgcctgtccag

SEQ ID NO: 379351 - DNA, 20 bp, human
gggtgggagaggacgccggt

SEQ ID NO: 379352 - DNA, 20 bp, human
gcatctgctacgttacgtgg

SEQ ID NO: 379353 - DNA, 20 bp, human
gttgcctgtccagaggtgga

SEQ ID NO: 379354 - DNA, 20 bp, human
gcgaccgagacctgggccgg

SEQ ID NO: 379355 - DNA, 20 bp, human
gaaccggtgggagaggacgc

SEQ ID NO: 379356 - DNA, 20 bp, human
gggaaatgctcctctgtctc

SEQ ID NO: 379357 - DNA, 20 bp, human
gcaagtctgaagcattttcg

SEQ ID NO: 379358 - DNA, 20 bp, human
gtgaaatctgcctgagacag

SEQ ID NO: 379359 - DNA, 20 bp, human
ggagtcaagtgctcgaacac

SEQ ID NO: 379360 - DNA, 20 bp, human
gtcgaacactggtgtgtgta

SEQ ID NO: 379361 - DNA, 20 bp, human
gggtgtctggttctgttacc

SEQ ID NO: 379362 - DNA, 20 bp, human
ggttcgagcacttgactcac

SEQ ID NO: 379363 - DNA, 20 bp, human
gcttcaatacgaacccttca

SEQ ID NO: 379364 - DNA, 20 bp, human
gtcctgaatgtggatatggg

SEQ ID NO: 379365 - DNA, 20 bp, human
gtcaacatgtttcctgaatg

SEQ ID NO: 379366 - DNA, 20 bp, human
gacatagcccaaagtgccca

SEQ ID NO: 379367 - DNA, 20 bp, human
gcaaagggagattcttataa

SEQ ID NO: 379368 - DNA, 20 bp, human
gtgggattcatatgtatgga

SEQ ID NO: 379369 - DNA, 20 bp, human
gctctaatgtatgggataca

SEQ ID NO: 379370 - DNA, 20 bp, human
gtcttgacttaacgtcagca

SEQ ID NO: 379371 - DNA, 20 bp, human
gaatcagactctctaatgta

SEQ ID NO: 379372 - DNA, 20 bp, human
ggggaagatttagaagattc

SEQ ID NO: 379373 - DNA, 20 bp, human
ggtatacaagaaaacttttt

SEQ ID NO: 379374 - DNA, 20 bp, human
gattttgggattcatatgta

SEQ ID NO: 379375 - DNA, 20 bp, human
gatatgatttataggtattt

SEQ ID NO: 379376 - DNA, 20 bp, human
gtaggaaatcaggtcgcgga

SEQ ID NO: 379377 - DNA, 20 bp, human
ggcgtccagaccaaggtcag

SEQ ID NO: 379378 - DNA, 20 bp, human
gaccaaggtcagcggagagt

SEQ ID NO: 379379 - DNA, 20 bp, human
gaggaaaggcgcacgcgcat

SEQ ID NO: 379380 - DNA, 20 bp, human
ggcgacctgatttcctagaa

SEQ ID NO: 379381 - DNA, 20 bp, human
gaatcaggtcgcggagggtg

SEQ ID NO: 379382 - DNA, 20 bp, human
gagagcccttctaggaaatc

SEQ ID NO: 379383 - DNA, 20 bp, human
gacccgaaaagattttccac

SEQ ID NO: 379384 - DNA, 20 bp, human
gagccagtggaaaatctttt

SEQ ID NO: 379385 - DNA, 20 bp, human
gctggaaagcgtccagacca

SEQ ID NO: 379386 - DNA, 20 bp, human
ggggtctgggggaatagcga

SEQ ID NO: 379387 - DNA, 20 bp, human
gaccgctgctggtgctgtgt

SEQ ID NO: 379388 - DNA, 20 bp, human
gaggtggtgccagactagag

SEQ ID NO: 379389 - DNA, 20 bp, human
gctagtctggcaccacctcc

SEQ ID NO: 379390 - DNA, 20 bp, human
gacctccaggaactccgaag

SEQ ID NO: 379391 - DNA, 20 bp, human
gaagggcaggtgaacttttg

SEQ ID NO: 379392 - DNA, 20 bp, human
ggcaccagcagcggtgtgag

SEQ ID NO: 379393 - DNA, 20 bp, human
gtacagctgccactctagtc

SEQ ID NO: 379394 - DNA, 20 bp, human
ggaaccactcacaccgctgc

SEQ ID NO: 379395 - DNA, 20 bp, human
gcctccacgtaattcttcat

SEQ ID NO: 379396 - DNA, 20 bp, human
ggggcggggacggagccatg

SEQ ID NO: 379397 - DNA, 20 bp, human
gtcacgggcagtggggaaat

SEQ ID NO: 379398 - DNA, 20 bp, human
gcggagccatggggcctcgt

SEQ ID NO: 379399 - DNA, 20 bp, human
gccccgcccctgcaacgtgt

SEQ ID NO: 379400 - DNA, 20 bp, human
gccctgcaacgtgtaggcct

SEQ ID NO: 379401 - DNA, 20 bp, human
gtgaggccaggcccacctta

SEQ ID NO: 379402 - DNA, 20 bp, human
gtggggaaatggggtctgaa

SEQ ID NO: 379403 - DNA, 20 bp, human
gcccactgcccgtgacccta

SEQ ID NO: 379404 - DNA, 20 bp, human
gcagcgcacggcagaagaca

SEQ ID NO: 379405 - DNA, 20 bp, human
gaggcccaccttagggtcac

SEQ ID NO: 379406 - DNA, 20 bp, human
gcgggcctgcggtcccactc

SEQ ID NO: 379407 - DNA, 20 bp, human
gtcaggcccccaaaaggggt

SEQ ID NO: 379408 - DNA, 20 bp, human
gcgtccagaggaagggtcac

SEQ ID NO: 379409 - DNA, 20 bp, human
gtgcggtcccactcaggaac

SEQ ID NO: 379410 - DNA, 20 bp, human
gccggatgcttcctaacttc

SEQ ID NO: 379411 - DNA, 20 bp, human
gccgcaggcccggaatgtca

SEQ ID NO: 379412 - DNA, 20 bp, human
gcacgctctgtgacttcacc

SEQ ID NO: 379413 - DNA, 20 bp, human
gggccaaggagtggcctcta

SEQ ID NO: 379414 - DNA, 20 bp, human
gccagtcccaccccttttgg

SEQ ID NO: 379415 - DNA, 20 bp, human
gggcacagatgcaaaccagg

SEQ ID NO: 379416 - DNA, 20 bp, human
gagaggggctaggtggtcta

SEQ ID NO: 379417 - DNA, 20 bp, human
gggtctaggggaaccctatt

SEQ ID NO: 379418 - DNA, 20 bp, human
gagggcatggccaagttatc

SEQ ID NO: 379419 - DNA, 20 bp, human
gactgtggggcacctggagc

SEQ ID NO: 379420 - DNA, 20 bp, human
gcaggcatgtagtgatgtat

SEQ ID NO: 379421 - DNA, 20 bp, human
gagagcatagaggggctagg

SEQ ID NO: 379422 - DNA, 20 bp, human
gtggtcctgccaccgactgt

SEQ ID NO: 379423 - DNA, 20 bp, human
gtctttcttagagcatagag

SEQ ID NO: 379424 - DNA, 20 bp, human
gccaggtgccccacagtcgg

SEQ ID NO: 379425 - DNA, 20 bp, human
ggccttctgccacttgtcca

SEQ ID NO: 379426 - DNA, 20 bp, human
gaggccactgccaggctcta

SEQ ID NO: 379427 - DNA, 20 bp, human
gcaacgctggccatagagcc

SEQ ID NO: 379428 - DNA, 20 bp, human
gctgacgcgcacaaactttc

SEQ ID NO: 379429 - DNA, 20 bp, human
gcctgcctgccggtcaacgc

SEQ ID NO: 379430 - DNA, 20 bp, human
gtgggagccagaagctcccg

SEQ ID NO: 379431 - DNA, 20 bp, human
gctgccctcccagtctgctt

SEQ ID NO: 379432 - DNA, 20 bp, human
gcagccacaggcagggaaca

SEQ ID NO: 379433 - DNA, 20 bp, human
gctctatggccagcgttgac

SEQ ID NO: 379434 - DNA, 20 bp, human
gtgggcaactccaggaatcg

SEQ ID NO: 379435 - DNA, 20 bp, human
gatggccagcgttgaccggc

SEQ ID NO: 379436 - DNA, 20 bp, human
gatggtacaaccagcaacat

SEQ ID NO: 379437 - DNA, 20 bp, human
ggcatattggagaactactc

SEQ ID NO: 379438 - DNA, 20 bp, human
gcatctgcagagtaattcag

SEQ ID NO: 379439 - DNA, 20 bp, human
gcatgtgtacaccaggtcaa

SEQ ID NO: 379440 - DNA, 20 bp, human
gtaagtagaatcacacctgt

SEQ ID NO: 379441 - DNA, 20 bp, human
gctcaggagtcctatgttgc

SEQ ID NO: 379442 - DNA, 20 bp, human
gcactcagcactgttcaccc

SEQ ID NO: 379443 - DNA, 20 bp, human
gttgctcaaccattgcatat

SEQ ID NO: 379444 - DNA, 20 bp, human
gaataattgattttgcctac

SEQ ID NO: 379445 - DNA, 20 bp, human
gcacttatgttatgatgata

SEQ ID NO: 379446 - DNA, 20 bp, human
gttaaatgcaaaatagtctc

SEQ ID NO: 379447 - DNA, 20 bp, human
gaatgcaaaatagtctcagg

SEQ ID NO: 379448 - DNA, 20 bp, human
gtccatctcaagccattact

SEQ ID NO: 379449 - DNA, 20 bp, human
gccccagtaatggcttgaga

SEQ ID NO: 379450 - DNA, 20 bp, human
gttagagtaagtatctacag

SEQ ID NO: 379451 - DNA, 20 bp, human
gcttgaaattgccccagtaa

SEQ ID NO: 379452 - DNA, 20 bp, human
gcatttaataaattgaattg

SEQ ID NO: 379453 - DNA, 20 bp, human
gtatgttttgtagacatatt

SEQ ID NO: 379454 - DNA, 20 bp, human
gaaaatttaagctcaactct

SEQ ID NO: 379455 - DNA, 20 bp, human
gctacaaaacatagctagtc

SEQ ID NO: 379456 - DNA, 20 bp, human
ggcactgctaagtagtgatg

SEQ ID NO: 379457 - DNA, 20 bp, human
ggctaagtagtgatgaggca

SEQ ID NO: 379458 - DNA, 20 bp, human
gtgtacctcagaactcaagc

SEQ ID NO: 379459 - DNA, 20 bp, human
gcactcttttgaaatagcat

SEQ ID NO: 379460 - DNA, 20 bp, human
gctcaccaccatccctccat

SEQ ID NO: 379461 - DNA, 20 bp, human
gtgaaggcatttggtgccta

SEQ ID NO: 379462 - DNA, 20 bp, human
gtttggtgcctatggaggga

SEQ ID NO: 379463 - DNA, 20 bp, human
gtttcttgtggagctaaagc

SEQ ID NO: 379464 - DNA, 20 bp, human
gaggcatttggtgcctatgg

SEQ ID NO: 379465 - DNA, 20 bp, human
gaattttctatgctcagaca

SEQ ID NO: 379466 - DNA, 20 bp, human
gaaccatccagatttgctaa

SEQ ID NO: 379467 - DNA, 20 bp, human
gcttcagcctactgtgtata

SEQ ID NO: 379468 - DNA, 20 bp, human
ggtataaggcacacagcatc

SEQ ID NO: 379469 - DNA, 20 bp, human
gggctgaagtcttttgtagc

SEQ ID NO: 379470 - DNA, 20 bp, human
gtgtgtgccttatacacagt

SEQ ID NO: 379471 - DNA, 20 bp, human
gagcaaatctggatggttgc

SEQ ID NO: 379472 - DNA, 20 bp, human
gttaacattccctttttaaa

SEQ ID NO: 379473 - DNA, 20 bp, human
gagtctgtcaaattgagttc

SEQ ID NO: 379474 - DNA, 20 bp, human
gtttacatacttccgtgttt

SEQ ID NO: 379475 - DNA, 20 bp, human
gtccagatttgctaatggct

SEQ ID NO: 379476 - DNA, 20 bp, human
gacaagaaaacccctctctc

SEQ ID NO: 379477 - DNA, 20 bp, human
gatgcaggacgtgaatgaac

SEQ ID NO: 379478 - DNA, 20 bp, human
gcatgagaactgggaagata

SEQ ID NO: 379479 - DNA, 20 bp, human
gatcaaatcacctcaggagc

SEQ ID NO: 379480 - DNA, 20 bp, human
gcagagcagaaacatcatgc

SEQ ID NO: 379481 - DNA, 20 bp, human
ggggcttctgaggttcgctt

SEQ ID NO: 379482 - DNA, 20 bp, human
gggaataatcaaatcacctc

SEQ ID NO: 379483 - DNA, 20 bp, human
gactagctgccatgagaact

SEQ ID NO: 379484 - DNA, 20 bp, human
gggacgtgaatgaacaggga

SEQ ID NO: 379485 - DNA, 20 bp, human
gctggggttcagcaattttg

SEQ ID NO: 379486 - DNA, 20 bp, human
ggggttttacaatttcccta

SEQ ID NO: 379487 - DNA, 20 bp, human
gaaaagtacagcatatagca

SEQ ID NO: 379488 - DNA, 20 bp, human
gttttatactgaggttgaag

SEQ ID NO: 379489 - DNA, 20 bp, human
gagattatcttggaaatccc

SEQ ID NO: 379490 - DNA, 20 bp, human
gtatcttggaaatccctggg

SEQ ID NO: 379491 - DNA, 20 bp, human
ggctgtacttttttatactg

SEQ ID NO: 379492 - DNA, 20 bp, human
gagatgctgtatacaaatta

SEQ ID NO: 379493 - DNA, 20 bp, human
ggtctttatagaaatagaaa

SEQ ID NO: 379494 - DNA, 20 bp, human
gcttggatgattttgataaa

SEQ ID NO: 379495 - DNA, 20 bp, human
gttcatctattagcatatgc

SEQ ID NO: 379496 - DNA, 20 bp, human
gtcaggcctaatgtcactga

SEQ ID NO: 379497 - DNA, 20 bp, human
gagtcaccatcagtgacatt

SEQ ID NO: 379498 - DNA, 20 bp, human
gagttcaatgctgcctttat

SEQ ID NO: 379499 - DNA, 20 bp, human
gctaacagtatttcccataa

SEQ ID NO: 379500 - DNA, 20 bp, human
gaaagagcctggtgaaatct

SEQ ID NO: 379501 - DNA, 20 bp, human
gaagtctctattcttgctat

SEQ ID NO: 379502 - DNA, 20 bp, human
ggttcagcccttcagttgtt

SEQ ID NO: 379503 - DNA, 20 bp, human
gtttttcatactgatgttga

SEQ ID NO: 379504 - DNA, 20 bp, human
gtttgatcctagatttcacc

SEQ ID NO: 379505 - DNA, 20 bp, human
gtctaggatcaaaatcacta

SEQ ID NO: 379506 - DNA, 20 bp, human
ggtccagtgtcacatagaga

SEQ ID NO: 379507 - DNA, 20 bp, human
ggagcggcaccaaatggagg

SEQ ID NO: 379508 - DNA, 20 bp, human
gacagtgaagcaacaggtag

SEQ ID NO: 379509 - DNA, 20 bp, human
ggtcctcttcacagatgata

SEQ ID NO: 379510 - DNA, 20 bp, human
gctctacgacagactaaatt

SEQ ID NO: 379511 - DNA, 20 bp, human
ggacttggactcagtttcaa

SEQ ID NO: 379512 - DNA, 20 bp, human
ggcaaagagctgcaaagttt

SEQ ID NO: 379513 - DNA, 20 bp, human
gcaaagtttaggttcattga

SEQ ID NO: 379514 - DNA, 20 bp, human
gaaagatgagcggcaccaaa

SEQ ID NO: 379515 - DNA, 20 bp, human
gcatgtaagccaggctccaa

SEQ ID NO: 379516 - DNA, 20 bp, human
gtgggctgaaaaccttgagt

SEQ ID NO: 379517 - DNA, 20 bp, human
gataaataaacattattcgt

SEQ ID NO: 379518 - DNA, 20 bp, human
gtactatacgatctacatat

SEQ ID NO: 379519 - DNA, 20 bp, human
gagtttccaggaggttgtcc

SEQ ID NO: 379520 - DNA, 20 bp, human
gcatttaaaaaagtccgtat

SEQ ID NO: 379521 - DNA, 20 bp, human
gtaaaaaatcagtttccagg

SEQ ID NO: 379522 - DNA, 20 bp, human
gtttcacctggacaacctcc

SEQ ID NO: 379523 - DNA, 20 bp, human
gaaataaaaaatcagtttcc

SEQ ID NO: 379524 - DNA, 20 bp, human
gttacttgagaaccacaggc

SEQ ID NO: 379525 - DNA, 20 bp, human
gtggagtattggcctgcctg

SEQ ID NO: 379526 - DNA, 20 bp, human
gaccgggaggaaggcgaccc

SEQ ID NO: 379527 - DNA, 20 bp, human
gggacaaagcttccaccggg

SEQ ID NO: 379528 - DNA, 20 bp, human
gctaaaatacaccaagcaac

SEQ ID NO: 379529 - DNA, 20 bp, human
gtctctcaatgtaatataac

SEQ ID NO: 379530 - DNA, 20 bp, human
gtatactttctgaatcgagt

SEQ ID NO: 379531 - DNA, 20 bp, human
gggttttacagtgcactgtt

SEQ ID NO: 379532 - DNA, 20 bp, human
gaaaggacaaagcttccacc

SEQ ID NO: 379533 - DNA, 20 bp, human
gcagcagcagcaacctgcct

SEQ ID NO: 379534 - DNA, 20 bp, human
gactctgataggacaaaaaa

SEQ ID NO: 379535 - DNA, 20 bp, human
ggcctgggtcgccttcctcc

SEQ ID NO: 379536 - DNA, 20 bp, human
gcacccccacaggtccagat

SEQ ID NO: 379537 - DNA, 20 bp, human
gcacgtaagagcttatcata

SEQ ID NO: 379538 - DNA, 20 bp, human
gactgatggttctacctctt

SEQ ID NO: 379539 - DNA, 20 bp, human
gtgggcatgcaaaactggat

SEQ ID NO: 379540 - DNA, 20 bp, human
gctcgctttgggatagatct

SEQ ID NO: 379541 - DNA, 20 bp, human
gtctgggaaggcggttgtac

SEQ ID NO: 379542 - DNA, 20 bp, human
gcatccgtgatgctgtgcta

SEQ ID NO: 379543 - DNA, 20 bp, human
gtgcccatctggacctgtgg

SEQ ID NO: 379544 - DNA, 20 bp, human
gtcatagggtggaagactga

SEQ ID NO: 379545 - DNA, 20 bp, human
gtaatcttgcatcacccaag

SEQ ID NO: 379546 - DNA, 20 bp, human
gtctactcaagcgcttccct

SEQ ID NO: 379547 - DNA, 20 bp, human
gtactgaggtccgtgttctt

SEQ ID NO: 379548 - DNA, 20 bp, human
gggttcaataatgaggccca

SEQ ID NO: 379549 - DNA, 20 bp, human
gcctcctatgacatcaatac

SEQ ID NO: 379550 - DNA, 20 bp, human
gtagagatgcaaatgttgga

SEQ ID NO: 379551 - DNA, 20 bp, human
gcatctagagatgcaaatgt

SEQ ID NO: 379552 - DNA, 20 bp, human
gtgcaaatgttggaaggatt

SEQ ID NO: 379553 - DNA, 20 bp, human
gaagaaactaaggcatacag

SEQ ID NO: 379554 - DNA, 20 bp, human
gcatgttcaaaaatagagag

SEQ ID NO: 379555 - DNA, 20 bp, human
gagcagctaacatggtactg

SEQ ID NO: 379556 - DNA, 20 bp, human
gcaagagcaggagggcgaga

SEQ ID NO: 379557 - DNA, 20 bp, human
gttgctggactcaagctctc

SEQ ID NO: 379558 - DNA, 20 bp, human
gaggcatttctaaggagaac

SEQ ID NO: 379559 - DNA, 20 bp, human
gctgagatgcaaatcttcca

SEQ ID NO: 379560 - DNA, 20 bp, human
gccactcctccaagagcagg

SEQ ID NO: 379561 - DNA, 20 bp, human
gagtccactcctccaagagc

SEQ ID NO: 379562 - DNA, 20 bp, human
ggaaatagtaatgtaatcct

SEQ ID NO: 379563 - DNA, 20 bp, human
ggtggcagcaacagattaga

SEQ ID NO: 379564 - DNA, 20 bp, human
gacctaggcttgctgtaatt

SEQ ID NO: 379565 - DNA, 20 bp, human
gggactcaagctctctggtt

SEQ ID NO: 379566 - DNA, 20 bp, human
gaatgagaggatctggttac

SEQ ID NO: 379567 - DNA, 20 bp, human
gtggaaataaccattaatga

SEQ ID NO: 379568 - DNA, 20 bp, human
gtgcaaataatgagaggatc

SEQ ID NO: 379569 - DNA, 20 bp, human
gtcacatgactacaagttag

SEQ ID NO: 379570 - DNA, 20 bp, human
gtagtcatgtgataaacaaa

SEQ ID NO: 379571 - DNA, 20 bp, human
gtttctgccgccctcattaa

SEQ ID NO: 379572 - DNA, 20 bp, human
gtgtggacttaaagtaaata

SEQ ID NO: 379573 - DNA, 20 bp, human
gcttgtattcattgcttatc

SEQ ID NO: 379574 - DNA, 20 bp, human
gattgcttatcaggtaaatg

SEQ ID NO: 379575 - DNA, 20 bp, human
gtgttcatatatgagcttat

SEQ ID NO: 379576 - DNA, 20 bp, human
ggaggatgctcaggctaaag

SEQ ID NO: 379577 - DNA, 20 bp, human
gaaccagagctcacttagag

SEQ ID NO: 379578 - DNA, 20 bp, human
gaagaggagaggtgtgctct

SEQ ID NO: 379579 - DNA, 20 bp, human
gtggcagcatgcaggaaaac

SEQ ID NO: 379580 - DNA, 20 bp, human
gcctagtggtaactgacact

SEQ ID NO: 379581 - DNA, 20 bp, human
gaaactggacaaggcaaatt

SEQ ID NO: 379582 - DNA, 20 bp, human
gcatgcaggaaaactggaca

SEQ ID NO: 379583 - DNA, 20 bp, human
gagtagagatctggatggag

SEQ ID NO: 379584 - DNA, 20 bp, human
gtaagcatggatgtgtaaca

SEQ ID NO: 379585 - DNA, 20 bp, human
ggcaaattagggtaatttgc

SEQ ID NO: 379586 - DNA, 20 bp, human
gaatcccaaaagatctacta

SEQ ID NO: 379587 - DNA, 20 bp, human
gaatggacacagaaactgtt

SEQ ID NO: 379588 - DNA, 20 bp, human
gaatgaaaacactcccgtga

SEQ ID NO: 379589 - DNA, 20 bp, human
ggcagtctcacataccttca

SEQ ID NO: 379590 - DNA, 20 bp, human
ggactctatccaacagcaga

SEQ ID NO: 379591 - DNA, 20 bp, human
gcatcccttagtagatcttt

SEQ ID NO: 379592 - DNA, 20 bp, human
ggatcagaaccttctgctgt

SEQ ID NO: 379593 - DNA, 20 bp, human
gagaaggttctgatcaagac

SEQ ID NO: 379594 - DNA, 20 bp, human
gatagagtctcatatactta

SEQ ID NO: 379595 - DNA, 20 bp, human
gccaagtggtgtagtttttc

SEQ ID NO: 379596 - DNA, 20 bp, human
gcagccgcggcaacctacct

SEQ ID NO: 379597 - DNA, 20 bp, human
gggagggaggattgataaaa

SEQ ID NO: 379598 - DNA, 20 bp, human
gcaacccaggtaggttgccg

SEQ ID NO: 379599 - DNA, 20 bp, human
gaaagtagccagtcggaggg

SEQ ID NO: 379600 - DNA, 20 bp, human
gcctaaaagtagccagtcgg

SEQ ID NO: 379601 - DNA, 20 bp, human
gtatcaatcctccctccgac

SEQ ID NO: 379602 - DNA, 20 bp, human
gtcatggcttcagccagccg

SEQ ID NO: 379603 - DNA, 20 bp, human
gatacttcctgaatcttgtg

SEQ ID NO: 379604 - DNA, 20 bp, human
gaagattcaggaagtatagc

SEQ ID NO: 379605 - DNA, 20 bp, human
gctctcaatctaataaaact

SEQ ID NO: 379606 - DNA, 20 bp, human
gatcaccatggcatgctaat

SEQ ID NO: 379607 - DNA, 20 bp, human
gggacagacagtgaatgaat

SEQ ID NO: 379608 - DNA, 20 bp, human
gtactatatgatctctgtat

SEQ ID NO: 379609 - DNA, 20 bp, human
gataattccagcctataaca

SEQ ID NO: 379610 - DNA, 20 bp, human
gattaagttcatcacctata

SEQ ID NO: 379611 - DNA, 20 bp, human
gtaaattcttaaaaggagct

SEQ ID NO: 379612 - DNA, 20 bp, human
gagcatgccatggtgatttc

SEQ ID NO: 379613 - DNA, 20 bp, human
gcactgtctgtccttgttat

SEQ ID NO: 379614 - DNA, 20 bp, human
gttagtgacttcagttgtta

SEQ ID NO: 379615 - DNA, 20 bp, human
gcatttaaaaaagtccatat

SEQ ID NO: 379616 - DNA, 20 bp, human
gggccaaagtctagacacca

SEQ ID NO: 379617 - DNA, 20 bp, human
gcaccggctctccatctcaa

SEQ ID NO: 379618 - DNA, 20 bp, human
ggccttgttacgttataccc

SEQ ID NO: 379619 - DNA, 20 bp, human
gcaaacagtaccacagacac

SEQ ID NO: 379620 - DNA, 20 bp, human
gtaccctggtgtctagactt

SEQ ID NO: 379621 - DNA, 20 bp, human
ggatggagagccggtgtctg

SEQ ID NO: 379622 - DNA, 20 bp, human
gtagcatatgagctcataac

SEQ ID NO: 379623 - DNA, 20 bp, human
gaatctctggttctacactc

SEQ ID NO: 379624 - DNA, 20 bp, human
gaccagggtataacgtaaca

SEQ ID NO: 379625 - DNA, 20 bp, human
gaacctttgagatggagagc

SEQ ID NO: 379626 - DNA, 20 bp, human
gcaatgtccgttcttgtgat

SEQ ID NO: 379627 - DNA, 20 bp, human
gttcaagcccatcacaagaa

SEQ ID NO: 379628 - DNA, 20 bp, human
ggcaacttcagctgttagat

SEQ ID NO: 379629 - DNA, 20 bp, human
ggtatgaacgatggactcgg

SEQ ID NO: 379630 - DNA, 20 bp, human
gataaatagtaaatccgtta

SEQ ID NO: 379631 - DNA, 20 bp, human
gactaggatcaccaccataa

SEQ ID NO: 379632 - DNA, 20 bp, human
gctgaacacaaattacgtat

SEQ ID NO: 379633 - DNA, 20 bp, human
ggtgatcctagttatgacta

SEQ ID NO: 379634 - DNA, 20 bp, human
gattacgtatcggttaaaca

SEQ ID NO: 379635 - DNA, 20 bp, human
gaaagaccttagtcataact

SEQ ID NO: 379636 - DNA, 20 bp, human
gggacgcaggctatcagagg

SEQ ID NO: 379637 - DNA, 20 bp, human
gagaggacgcaggctatcag

SEQ ID NO: 379638 - DNA, 20 bp, human
gaggccagagtagaggacgc

SEQ ID NO: 379639 - DNA, 20 bp, human
gtgccccaagcgcagaagct

SEQ ID NO: 379640 - DNA, 20 bp, human
gacagcgctcacatccacgg

SEQ ID NO: 379641 - DNA, 20 bp, human
ggaagagcaggcaaattttt

SEQ ID NO: 379642 - DNA, 20 bp, human
gtgcgcttggggcagctgga

SEQ ID NO: 379643 - DNA, 20 bp, human
ggtaaggacactaaatgcca

SEQ ID NO: 379644 - DNA, 20 bp, human
gagcaggcaaatttttgggc

SEQ ID NO: 379645 - DNA, 20 bp, human
gcagtagcgggtgtgcccca

SEQ ID NO: 379646 - DNA, 20 bp, human
gtaggtaaatgggcatacag

SEQ ID NO: 379647 - DNA, 20 bp, human
gacaatgcaggaccatgaaa

SEQ ID NO: 379648 - DNA, 20 bp, human
gcaggaccatgaaagggaat

SEQ ID NO: 379649 - DNA, 20 bp, human
gttccacatacggttaattt

SEQ ID NO: 379650 - DNA, 20 bp, human
ggtcctgcattgtctttctg

SEQ ID NO: 379651 - DNA, 20 bp, human
gaaatctagcaaccctattg

SEQ ID NO: 379652 - DNA, 20 bp, human
gaaaacagactacaacaaag

SEQ ID NO: 379653 - DNA, 20 bp, human
gagcctaaattaaccgtatg

SEQ ID NO: 379654 - DNA, 20 bp, human
gaacctgctgagtaggtaaa

SEQ ID NO: 379655 - DNA, 20 bp, human
ggatgttcaggttgccagaa

SEQ ID NO: 379656 - DNA, 20 bp, human
gatctgggagaactgatttg

SEQ ID NO: 379657 - DNA, 20 bp, human
gcttgctgtagctctatatt

SEQ ID NO: 379658 - DNA, 20 bp, human
gttaaacggctaattaggga

SEQ ID NO: 379659 - DNA, 20 bp, human
ggtgaaaatttctttgcatc

SEQ ID NO: 379660 - DNA, 20 bp, human
gaggaaatgaattgtcttca

SEQ ID NO: 379661 - DNA, 20 bp, human
gctcagaagtgaaatatgcc

SEQ ID NO: 379662 - DNA, 20 bp, human
gttcatttaaacggctaatt

SEQ ID NO: 379663 - DNA, 20 bp, human
ggaagttttatttacacagt

SEQ ID NO: 379664 - DNA, 20 bp, human
gatacaagagacagtgattc

SEQ ID NO: 379665 - DNA, 20 bp, human
gtgcaaagaaattttcactt

SEQ ID NO: 379666 - DNA, 20 bp, human
gaagcctctaggatgcaaat

SEQ ID NO: 379667 - DNA, 20 bp, human
gtggggccagtaatttcctt

SEQ ID NO: 379668 - DNA, 20 bp, human
gggaaagaatctaaaggtgt

SEQ ID NO: 379669 - DNA, 20 bp, human
gctaaagacttcaatgattg

SEQ ID NO: 379670 - DNA, 20 bp, human
gcaagaaggtatcaattact

SEQ ID NO: 379671 - DNA, 20 bp, human
gtgcatcacagctaacaaaa

SEQ ID NO: 379672 - DNA, 20 bp, human
ggtgatgactgaaagcctct

SEQ ID NO: 379673 - DNA, 20 bp, human
gtggctagaatttaatttgc

SEQ ID NO: 379674 - DNA, 20 bp, human
ggaggcttaaatggcataac

SEQ ID NO: 379675 - DNA, 20 bp, human
gtaggaagataggagtatta

SEQ ID NO: 379676 - DNA, 20 bp, human
ggcagcgctaactccacctg

SEQ ID NO: 379677 - DNA, 20 bp, human
gtgagccgctccgaagcgga

SEQ ID NO: 379678 - DNA, 20 bp, human
gcaggtgagccgctccgaag

SEQ ID NO: 379679 - DNA, 20 bp, human
gtccgccctccgcttcggag

SEQ ID NO: 379680 - DNA, 20 bp, human
gggaagcagcctcccacaag

SEQ ID NO: 379681 - DNA, 20 bp, human
gctgactccgccctccgctt

SEQ ID NO: 379682 - DNA, 20 bp, human
gggtaccccgaatgaccaat

SEQ ID NO: 379683 - DNA, 20 bp, human
gggtcattcggggtaccacg

SEQ ID NO: 379684 - DNA, 20 bp, human
ggcttattcaggggcggggt

SEQ ID NO: 379685 - DNA, 20 bp, human
gtcctcaccctggcaacggg

SEQ ID NO: 379686 - DNA, 20 bp, human
gggatgagaggcaatgacgg

SEQ ID NO: 379687 - DNA, 20 bp, human
ggcccagaaagagttaacac

SEQ ID NO: 379688 - DNA, 20 bp, human
gagaggcaatgacgggggag

SEQ ID NO: 379689 - DNA, 20 bp, human
ggtagagggtggtaatggtc

SEQ ID NO: 379690 - DNA, 20 bp, human
gttcctgctttgagggtggg

SEQ ID NO: 379691 - DNA, 20 bp, human
gtctcactcccaggggtaga

SEQ ID NO: 379692 - DNA, 20 bp, human
gttctgggcacttggtgaga

SEQ ID NO: 379693 - DNA, 20 bp, human
gaaattcctgctttgagggt

SEQ ID NO: 379694 - DNA, 20 bp, human
ggtctccacaaatgggcgtt

SEQ ID NO: 379695 - DNA, 20 bp, human
gattccagatgtttgaagtg

SEQ ID NO: 379696 - DNA, 20 bp, human
gtgagcggggccagccggaa

SEQ ID NO: 379697 - DNA, 20 bp, human
ggaccctcggggccccatgg

SEQ ID NO: 379698 - DNA, 20 bp, human
ggggaaggtcagcgccgtaa

SEQ ID NO: 379699 - DNA, 20 bp, human
gaggacctccccagcggaag

SEQ ID NO: 379700 - DNA, 20 bp, human
ggatggggacccaggactcg

SEQ ID NO: 379701 - DNA, 20 bp, human
gtttgctgatgggtcaggta

SEQ ID NO: 379702 - DNA, 20 bp, human
ggtaatggcgttcttggcgt

SEQ ID NO: 379703 - DNA, 20 bp, human
gggaaactgcacgcctgctg

SEQ ID NO: 379704 - DNA, 20 bp, human
gggaagggcggagttgccgg

SEQ ID NO: 379705 - DNA, 20 bp, human
gcctgctgcgggtgactgag

SEQ ID NO: 379706 - DNA, 20 bp, human
gggggcggagccactcacgt

SEQ ID NO: 379707 - DNA, 20 bp, human
gggtcagaagccagatgggg

SEQ ID NO: 379708 - DNA, 20 bp, human
ggctcgacccggcaaggggc

SEQ ID NO: 379709 - DNA, 20 bp, human
gtgagtggctccgccccatc

SEQ ID NO: 379710 - DNA, 20 bp, human
gccatctggcttctgaccaa

SEQ ID NO: 379711 - DNA, 20 bp, human
gcccttgccgggtcgagcaa

SEQ ID NO: 379712 - DNA, 20 bp, human
gagtcgggacggtacgcctt

SEQ ID NO: 379713 - DNA, 20 bp, human
gctcacgtgggctcgaacag

SEQ ID NO: 379714 - DNA, 20 bp, human
gggggcctgcgccaaacgga

SEQ ID NO: 379715 - DNA, 20 bp, human
gaggcgccttggagtcggga

SEQ ID NO: 379716 - DNA, 20 bp, human
gagaccccgccatttttcgt

SEQ ID NO: 379717 - DNA, 20 bp, human
gactgtgggcggggcactct

SEQ ID NO: 379718 - DNA, 20 bp, human
gaagtcttctcggggagtgg

SEQ ID NO: 379719 - DNA, 20 bp, human
ggcacccgaaagtcttctcg

SEQ ID NO: 379720 - DNA, 20 bp, human
gggtcaaggaccaccaactc

SEQ ID NO: 379721 - DNA, 20 bp, human
gactccccgagaagactttc

SEQ ID NO: 379722 - DNA, 20 bp, human
ggggacaaggagctcgcggc

SEQ ID NO: 379723 - DNA, 20 bp, human
gcggaaaagcgggttcacac

SEQ ID NO: 379724 - DNA, 20 bp, human
ggtgcgctgcacctcgaagc

SEQ ID NO: 379725 - DNA, 20 bp, human
gtctgctggccggtctaaag

SEQ ID NO: 379726 - DNA, 20 bp, human
ggtattgcagaagtgaaggg

SEQ ID NO: 379727 - DNA, 20 bp, human
gggaaggagtaagcaagtga

SEQ ID NO: 379728 - DNA, 20 bp, human
gttgaagtctgaaagaggaa

SEQ ID NO: 379729 - DNA, 20 bp, human
gagtggtattgcagaagtga

SEQ ID NO: 379730 - DNA, 20 bp, human
ggaggaaggggagctagtca

SEQ ID NO: 379731 - DNA, 20 bp, human
ggggattccgaatgctgctg

SEQ ID NO: 379732 - DNA, 20 bp, human
gaataccactctctcattgg

SEQ ID NO: 379733 - DNA, 20 bp, human
gtgttcttgaagtctgaaag

SEQ ID NO: 379734 - DNA, 20 bp, human
ggtagccaccaatgagagag

SEQ ID NO: 379735 - DNA, 20 bp, human
ggaggcttctgttttagtgc

SEQ ID NO: 379736 - DNA, 20 bp, human
ggggatgaggcgtcccgcgg

SEQ ID NO: 379737 - DNA, 20 bp, human
gagagagccagcctacccgc

SEQ ID NO: 379738 - DNA, 20 bp, human
ggcgggacgcctcatcccgc

SEQ ID NO: 379739 - DNA, 20 bp, human
ggacgcctcatcccgcgggt

SEQ ID NO: 379740 - DNA, 20 bp, human
gggggcgtgtcgtcgcggag

SEQ ID NO: 379741 - DNA, 20 bp, human
gccagcctacccgcgggatg

SEQ ID NO: 379742 - DNA, 20 bp, human
gggctgggggcgtgtcgtcg

SEQ ID NO: 379743 - DNA, 20 bp, human
gcccgcggcggagtgggctg

SEQ ID NO: 379744 - DNA, 20 bp, human
gaagcaagggagtgaccaca

SEQ ID NO: 379745 - DNA, 20 bp, human
ggtgacgcaaggcctactgt

SEQ ID NO: 379746 - DNA, 20 bp, human
gagagggcggagcgtgtccg

SEQ ID NO: 379747 - DNA, 20 bp, human
gtgcgcgtgcgcagaaaagc

SEQ ID NO: 379748 - DNA, 20 bp, human
gaagactgccgggaggtctc

SEQ ID NO: 379749 - DNA, 20 bp, human
gtccggggcgcccacggcgc

SEQ ID NO: 379750 - DNA, 20 bp, human
ggcgcagaaaagcgggcaga

SEQ ID NO: 379751 - DNA, 20 bp, human
gtgcgcagcccgagacctcc

SEQ ID NO: 379752 - DNA, 20 bp, human
gcgaaagcggagtggcgctc

SEQ ID NO: 379753 - DNA, 20 bp, human
ggggacttccgaaagcggag

SEQ ID NO: 379754 - DNA, 20 bp, human
gtgctcggaagactgccggg

SEQ ID NO: 379755 - DNA, 20 bp, human
gtggcgctccggccagtgat

SEQ ID NO: 379756 - DNA, 20 bp, human
gaggaagcgggagccccacg

SEQ ID NO: 379757 - DNA, 20 bp, human
ggacaaaaggcgagcgcagg

SEQ ID NO: 379758 - DNA, 20 bp, human
gtggcctcgctgccgtcaag

SEQ ID NO: 379759 - DNA, 20 bp, human
ggggccgcttgacggcagcg

SEQ ID NO: 379760 - DNA, 20 bp, human
gcgggtggatcagagtgtga

SEQ ID NO: 379761 - DNA, 20 bp, human
gccggaaagcgaacctgcgc

SEQ ID NO: 379762 - DNA, 20 bp, human
gacagggtccagccagaccc

SEQ ID NO: 379763 - DNA, 20 bp, human
gcgctttgcgacagtcggtc

SEQ ID NO: 379764 - DNA, 20 bp, human
gagtcggtcgggctgggcac

SEQ ID NO: 379765 - DNA, 20 bp, human
gactgtcgcaaagcgcgcac

SEQ ID NO: 379766 - DNA, 20 bp, human
gggaacagaacttgctggtc

SEQ ID NO: 379767 - DNA, 20 bp, human
gcagcccagaggccagctat

SEQ ID NO: 379768 - DNA, 20 bp, human
gacagcctatagctggcctc

SEQ ID NO: 379769 - DNA, 20 bp, human
gatggggatggtctcaacag

SEQ ID NO: 379770 - DNA, 20 bp, human
gtcctaggagggacccccat

SEQ ID NO: 379771 - DNA, 20 bp, human
gatgcactcaggagtagtct

SEQ ID NO: 379772 - DNA, 20 bp, human
gactggggctgtggcgctga

SEQ ID NO: 379773 - DNA, 20 bp, human
ggaggccagagctggagctt

SEQ ID NO: 379774 - DNA, 20 bp, human
gcatcctcccccatgcactc

SEQ ID NO: 379775 - DNA, 20 bp, human
gctggcctaagctccagctc

SEQ ID NO: 379776 - DNA, 20 bp, human
gagctccccggggaccgagt

SEQ ID NO: 379777 - DNA, 20 bp, human
gctggaggcgaggggaagac

SEQ ID NO: 379778 - DNA, 20 bp, human
gggaccgagtggggagatcc

SEQ ID NO: 379779 - DNA, 20 bp, human
gctgcactgcgggtccgccg

SEQ ID NO: 379780 - DNA, 20 bp, human
gcgcaggggtctggatgggg

SEQ ID NO: 379781 - DNA, 20 bp, human
gactgtacatcccgccacga

SEQ ID NO: 379782 - DNA, 20 bp, human
gcgtccgggccgtgctgccc

SEQ ID NO: 379783 - DNA, 20 bp, human
gagtgtctgtggggggaata

SEQ ID NO: 379784 - DNA, 20 bp, human
gcggcagcaacaggcaccgg

SEQ ID NO: 379785 - DNA, 20 bp, human
gagggcctgcatcacgcgcg

SEQ ID NO: 379786 - DNA, 20 bp, human
gccaacaagcccgaagtgag

SEQ ID NO: 379787 - DNA, 20 bp, human
gccgccccccggccttgcgg

SEQ ID NO: 379788 - DNA, 20 bp, human
ggggcgtggggggagagctc

SEQ ID NO: 379789 - DNA, 20 bp, human
gcgcggcgcccattgggcgt

SEQ ID NO: 379790 - DNA, 20 bp, human
gctctccccccacgcccaat

SEQ ID NO: 379791 - DNA, 20 bp, human
gaatgggcgccgcggacccc

SEQ ID NO: 379792 - DNA, 20 bp, human
gggcgcccattgggcgtggg

SEQ ID NO: 379793 - DNA, 20 bp, human
gtggccgccgcaaggccggg

SEQ ID NO: 379794 - DNA, 20 bp, human
ggcttgttggcgcccgccgg

SEQ ID NO: 379795 - DNA, 20 bp, human
gaataggcgccgcgcgtggg

SEQ ID NO: 379796 - DNA, 20 bp, human
gtggcgcggagccggctctg

SEQ ID NO: 379797 - DNA, 20 bp, human
ggggtgggtcatctggaaag

SEQ ID NO: 379798 - DNA, 20 bp, human
ggggctgtaagaccaatcag

SEQ ID NO: 379799 - DNA, 20 bp, human
ggctggaggcgaaaaagggg

SEQ ID NO: 379800 - DNA, 20 bp, human
ggctgtgcgagtaagaggtg

SEQ ID NO: 379801 - DNA, 20 bp, human
gggggctggaggcgaaaaag

SEQ ID NO: 379802 - DNA, 20 bp, human
gaatcgttggaatcgtgggc

SEQ ID NO: 379803 - DNA, 20 bp, human
gggctcgcccccaagcagga

SEQ ID NO: 379804 - DNA, 20 bp, human
ggaaaaaggggtgggtcatc

SEQ ID NO: 379805 - DNA, 20 bp, human
gagaggatttggacgaatag

SEQ ID NO: 379806 - DNA, 20 bp, human
gcccctgcgtctaacagtcc

SEQ ID NO: 379807 - DNA, 20 bp, human
gcgctgggggcccctcccaa

SEQ ID NO: 379808 - DNA, 20 bp, human
gttgccaaagctgtgtgagg

SEQ ID NO: 379809 - DNA, 20 bp, human
ggcccaggactgttagacgc

SEQ ID NO: 379810 - DNA, 20 bp, human
gacagctttggcaaccgctg

SEQ ID NO: 379811 - DNA, 20 bp, human
ggacaccccccacccttggg

SEQ ID NO: 379812 - DNA, 20 bp, human
ggttcctgtgctggtgtgga

SEQ ID NO: 379813 - DNA, 20 bp, human
gactgttagacgcaggggcc

SEQ ID NO: 379814 - DNA, 20 bp, human
gggaggtgaggtgctgcggg

SEQ ID NO: 379815 - DNA, 20 bp, human
gggtgctgcgggaggtgagc

SEQ ID NO: 379816 - DNA, 20 bp, human
gacggtagctagagagacgc

SEQ ID NO: 379817 - DNA, 20 bp, human
ggggtcggacagttgcttga

SEQ ID NO: 379818 - DNA, 20 bp, human
gtcggggaatctccaggtcg

SEQ ID NO: 379819 - DNA, 20 bp, human
gcagatggcggatcctagat

SEQ ID NO: 379820 - DNA, 20 bp, human
gtctctagctaccgtctcta

SEQ ID NO: 379821 - DNA, 20 bp, human
gctcgcgcacgcgcaaaagt

SEQ ID NO: 379822 - DNA, 20 bp, human
gctaccgtctctatggttcg

SEQ ID NO: 379823 - DNA, 20 bp, human
gagacgcaggctgccaatct

SEQ ID NO: 379824 - DNA, 20 bp, human
ggcacgcgcaaaagtcggac

SEQ ID NO: 379825 - DNA, 20 bp, human
gattccccgaaccatagaga

SEQ ID NO: 379826 - DNA, 20 bp, human
ggccaaatttgagaacccgc

SEQ ID NO: 379827 - DNA, 20 bp, human
gactggcggctacggccggc

SEQ ID NO: 379828 - DNA, 20 bp, human
gtggaagcgtgagagtcgag

SEQ ID NO: 379829 - DNA, 20 bp, human
gggggcctgaacagtttagc

SEQ ID NO: 379830 - DNA, 20 bp, human
gtcgaggggtggcacgtgac

SEQ ID NO: 379831 - DNA, 20 bp, human
gaagcgtgagagtcgagggg

SEQ ID NO: 379832 - DNA, 20 bp, human
gctgaggcggtggaacgcgc

SEQ ID NO: 379833 - DNA, 20 bp, human
gagcggggcaacctcgggtc

SEQ ID NO: 379834 - DNA, 20 bp, human
gttgccccgctcaacccggc

SEQ ID NO: 379835 - DNA, 20 bp, human
gacggccggccgggttgagc

SEQ ID NO: 379836 - DNA, 20 bp, human
ggcgggcggcccccggaaga

SEQ ID NO: 379837 - DNA, 20 bp, human
gcccccacggacatccgaca

SEQ ID NO: 379838 - DNA, 20 bp, human
gcccccggaagagggacagc

SEQ ID NO: 379839 - DNA, 20 bp, human
gccgccgcgggcctccggag

SEQ ID NO: 379840 - DNA, 20 bp, human
ggggcggggcgcaagtgcgt

SEQ ID NO: 379841 - DNA, 20 bp, human
gccccctgtcggatgtccgt

SEQ ID NO: 379842 - DNA, 20 bp, human
gcccggctgtccctcttccg

SEQ ID NO: 379843 - DNA, 20 bp, human
gcaggtaaggggccccctgt

SEQ ID NO: 379844 - DNA, 20 bp, human
ggcggcacgggcggaagaac

SEQ ID NO: 379845 - DNA, 20 bp, human
gacgccgctccggaggcccg

SEQ ID NO: 379846 - DNA, 20 bp, human
ggacgcgtgcgtgctgaact

SEQ ID NO: 379847 - DNA, 20 bp, human
gaactgggctcagagacggc

SEQ ID NO: 379848 - DNA, 20 bp, human
gggctcagagacggctgggg

SEQ ID NO: 379849 - DNA, 20 bp, human
gtcagcacgcacgcgtcagg

SEQ ID NO: 379850 - DNA, 20 bp, human
gcttccttggggaggacgtg

SEQ ID NO: 379851 - DNA, 20 bp, human
gtccgggcgggaaaagggcg

SEQ ID NO: 379852 - DNA, 20 bp, human
gtaacatccgggcgggaaaa

SEQ ID NO: 379853 - DNA, 20 bp, human
ggtggaggaaaggagccggg

SEQ ID NO: 379854 - DNA, 20 bp, human
gcaagcacaagcgtagcgtt

SEQ ID NO: 379855 - DNA, 20 bp, human
gtatgtccgagagacacgtg

SEQ ID NO: 379856 - DNA, 20 bp, human
gagggccagcagggaactag

SEQ ID NO: 379857 - DNA, 20 bp, human
gggacggggcacagtccccg

SEQ ID NO: 379858 - DNA, 20 bp, human
ggaactagaggcttgggccc

SEQ ID NO: 379859 - DNA, 20 bp, human
gcaagcctctagttccctgc

SEQ ID NO: 379860 - DNA, 20 bp, human
ggggacgccaggctcgggac

SEQ ID NO: 379861 - DNA, 20 bp, human
gtcgccgcgtcccggcctcg

SEQ ID NO: 379862 - DNA, 20 bp, human
gaggaagggaagatacgctc

SEQ ID NO: 379863 - DNA, 20 bp, human
gggtctccccgcccaccttc

SEQ ID NO: 379864 - DNA, 20 bp, human
gacgctccggaagacccccc

SEQ ID NO: 379865 - DNA, 20 bp, human
gcctggcgtccccaaaggaa

SEQ ID NO: 379866 - DNA, 20 bp, human
gccagcctggggagccaata

SEQ ID NO: 379867 - DNA, 20 bp, human
gagggctggggcccaagcga

SEQ ID NO: 379868 - DNA, 20 bp, human
gtattccactggaacctcga

SEQ ID NO: 379869 - DNA, 20 bp, human
gccctggggcggtggacggg

SEQ ID NO: 379870 - DNA, 20 bp, human
ggcacgtcagcatccgaacg

SEQ ID NO: 379871 - DNA, 20 bp, human
gaccactgtccggcccggag

SEQ ID NO: 379872 - DNA, 20 bp, human
gcagacgctgaaggtggatc

SEQ ID NO: 379873 - DNA, 20 bp, human
gggaggggaactgttttctc

SEQ ID NO: 379874 - DNA, 20 bp, human
gggccattgccccgggacca

SEQ ID NO: 379875 - DNA, 20 bp, human
gaggagccaccctcaggggg

SEQ ID NO: 379876 - DNA, 20 bp, human
gcggcggaaaaagaccgggg

SEQ ID NO: 379877 - DNA, 20 bp, human
gcgccggcggaaaaagaccg

SEQ ID NO: 379878 - DNA, 20 bp, human
ggaaaaagaccggggcgggg

SEQ ID NO: 379879 - DNA, 20 bp, human
gatagacaaggcaggaacaa

SEQ ID NO: 379880 - DNA, 20 bp, human
gcggcggaacgcagatgctg

SEQ ID NO: 379881 - DNA, 20 bp, human
gctgtggccttcaggcgctg

SEQ ID NO: 379882 - DNA, 20 bp, human
gttgtgcatcagaggcgctg

SEQ ID NO: 379883 - DNA, 20 bp, human
gtggtcccctcagcgcctga

SEQ ID NO: 379884 - DNA, 20 bp, human
gtcccagtgtaataaggtcc

SEQ ID NO: 379885 - DNA, 20 bp, human
ggaggagtcccagtgtaata

SEQ ID NO: 379886 - DNA, 20 bp, human
gcgcccccgcagcgctcagt

SEQ ID NO: 379887 - DNA, 20 bp, human
ggcacccggtcccgactctg

SEQ ID NO: 379888 - DNA, 20 bp, human
gagccgactgagcgctgcgg

SEQ ID NO: 379889 - DNA, 20 bp, human
gtggccagccgccgtaacct

SEQ ID NO: 379890 - DNA, 20 bp, human
gctccctggcttcaggttaa

SEQ ID NO: 379891 - DNA, 20 bp, human
gaagccacagagtcgggacc

SEQ ID NO: 379892 - DNA, 20 bp, human
ggaagcagctgggctttgca

SEQ ID NO: 379893 - DNA, 20 bp, human
ggggaagtgtagctagggac

SEQ ID NO: 379894 - DNA, 20 bp, human
gtaaagatggctgactggcg

SEQ ID NO: 379895 - DNA, 20 bp, human
gggcgtggcctggcggtgga

SEQ ID NO: 379896 - DNA, 20 bp, human
gggtgagcgctctgaggagt

SEQ ID NO: 379897 - DNA, 20 bp, human
ggtctgcgctgtagactcta

SEQ ID NO: 379898 - DNA, 20 bp, human
gggaggctgcggaaagagcg

SEQ ID NO: 379899 - DNA, 20 bp, human
ggatgacaggagttcgtgtg

SEQ ID NO: 379900 - DNA, 20 bp, human
ggtagcgcagggtcacgtgc

SEQ ID NO: 379901 - DNA, 20 bp, human
ggccggccgggcgtagcgca

SEQ ID NO: 379902 - DNA, 20 bp, human
gaccctgcgctacgcccggc

SEQ ID NO: 379903 - DNA, 20 bp, human
gaagcaaaggaaacgacagc

SEQ ID NO: 379904 - DNA, 20 bp, human
gttacagatgaaagaagcaa

SEQ ID NO: 379905 - DNA, 20 bp, human
gtcgtgtggggagacgagac

SEQ ID NO: 379906 - DNA, 20 bp, human
gaggacatggggatcagtgt

SEQ ID NO: 379907 - DNA, 20 bp, human
gcagaacacgcagtggaggt

SEQ ID NO: 379908 - DNA, 20 bp, human
ggttggattcagaggacatg

SEQ ID NO: 379909 - DNA, 20 bp, human
gggcactggtctggtggaat

SEQ ID NO: 379910 - DNA, 20 bp, human
ggggacttgtgacacactgc

SEQ ID NO: 379911 - DNA, 20 bp, human
gactgcagaacacgcagtgg

SEQ ID NO: 379912 - DNA, 20 bp, human
gaaaactgcagaacacgcag

SEQ ID NO: 379913 - DNA, 20 bp, human
gtgggctgtgctggtcaagg

SEQ ID NO: 379914 - DNA, 20 bp, human
gcattgtgatgagagttcca

SEQ ID NO: 379915 - DNA, 20 bp, human
ggagtcagagatagagagca

SEQ ID NO: 379916 - DNA, 20 bp, human
gagcgcccgtcgttattaaa

SEQ ID NO: 379917 - DNA, 20 bp, human
gacacgcatcgcggagggag

SEQ ID NO: 379918 - DNA, 20 bp, human
ggaagtcccgcctaagtccc

SEQ ID NO: 379919 - DNA, 20 bp, human
gacgttacacgcatcgcgga

SEQ ID NO: 379920 - DNA, 20 bp, human
ggctcctgggagtccgttgc

SEQ ID NO: 379921 - DNA, 20 bp, human
gtgggcgccgctgttgtgtc

SEQ ID NO: 379922 - DNA, 20 bp, human
gcactcgccaccagggactt

SEQ ID NO: 379923 - DNA, 20 bp, human
gggagccggcccagaacaga

SEQ ID NO: 379924 - DNA, 20 bp, human
ggtcccgcctaagtccctgg

SEQ ID NO: 379925 - DNA, 20 bp, human
gcgtaggcacaacttccgga

SEQ ID NO: 379926 - DNA, 20 bp, human
gcaaagttcctacccgcgag

SEQ ID NO: 379927 - DNA, 20 bp, human
ggctgggcacacaggtggac

SEQ ID NO: 379928 - DNA, 20 bp, human
gaagccgaccggtaacgtca

SEQ ID NO: 379929 - DNA, 20 bp, human
gcccgcgagagggaagaagc

SEQ ID NO: 379930 - DNA, 20 bp, human
gggaagaagcaggtaaggta

SEQ ID NO: 379931 - DNA, 20 bp, human
ggggccgaccaattgggagc

SEQ ID NO: 379932 - DNA, 20 bp, human
gggagcttggacgagccgag

SEQ ID NO: 379933 - DNA, 20 bp, human
gaactttgagccccgcctct

SEQ ID NO: 379934 - DNA, 20 bp, human
ggtggacgggccgaccaatt

SEQ ID NO: 379935 - DNA, 20 bp, human
gggcttgcgcagctcaccaa

SEQ ID NO: 379936 - DNA, 20 bp, human
gggccgaaaggcagcgtctt

SEQ ID NO: 379937 - DNA, 20 bp, human
gtggacgccgtcccagttgg

SEQ ID NO: 379938 - DNA, 20 bp, human
gcccccaagacgctgccttt

SEQ ID NO: 379939 - DNA, 20 bp, human
gacggcgtcccgaggccgaa

SEQ ID NO: 379940 - DNA, 20 bp, human
ggcaacgtcacggcgtcccg

SEQ ID NO: 379941 - DNA, 20 bp, human
gctggaggaacgcaacgtca

SEQ ID NO: 379942 - DNA, 20 bp, human
gcgcggcaccgtggcatctt

SEQ ID NO: 379943 - DNA, 20 bp, human
gcggtggacgccgtcccagt

SEQ ID NO: 379944 - DNA, 20 bp, human
gtcttgggacatgtagtctt

SEQ ID NO: 379945 - DNA, 20 bp, human
gcgccccgcccgcggcaccg

SEQ ID NO: 379946 - DNA, 20 bp, human
gcatgcgcgctgacggtcgg

SEQ ID NO: 379947 - DNA, 20 bp, human
ggccgcagcggcggaagctg

SEQ ID NO: 379948 - DNA, 20 bp, human
ggccgggaaccggtcccgtg

SEQ ID NO: 379949 - DNA, 20 bp, human
ggggcatgcgcgctgacggt

SEQ ID NO: 379950 - DNA, 20 bp, human
gggaccgcgactccgacagg

SEQ ID NO: 379951 - DNA, 20 bp, human
ggccctgccgagggcatcgg

SEQ ID NO: 379952 - DNA, 20 bp, human
ggaaccggtcccgtgcggag

SEQ ID NO: 379953 - DNA, 20 bp, human
gcgcatgcccagagccgggc

SEQ ID NO: 379954 - DNA, 20 bp, human
ggcaacggcagtgcggtccc

SEQ ID NO: 379955 - DNA, 20 bp, human
gagcgcgcatgcccagagcc

SEQ ID NO: 379956 - DNA, 20 bp, human
ggcaacagcactctaggcgc

SEQ ID NO: 379957 - DNA, 20 bp, human
gagcgtgcagacgcctactg

SEQ ID NO: 379958 - DNA, 20 bp, human
gagccccgcccccaaaagtc

SEQ ID NO: 379959 - DNA, 20 bp, human
ggcaacttgaggcggggtgt

SEQ ID NO: 379960 - DNA, 20 bp, human
gcaaaatgcccgacttttgg

SEQ ID NO: 379961 - DNA, 20 bp, human
gtcaaaacaaccaaaccacg

SEQ ID NO: 379962 - DNA, 20 bp, human
gctcgttcgccaagagaagg

SEQ ID NO: 379963 - DNA, 20 bp, human
gtgcgccccggcacgaggtg

SEQ ID NO: 379964 - DNA, 20 bp, human
gcatacttccggattcacgg

SEQ ID NO: 379965 - DNA, 20 bp, human
gagaggcgtgaggcaacttg

SEQ ID NO: 379966 - DNA, 20 bp, human
gttcaaggggtggagggtgc

SEQ ID NO: 379967 - DNA, 20 bp, human
ggactcattcccactacaga

SEQ ID NO: 379968 - DNA, 20 bp, human
gtgagtcatggcactccgga

SEQ ID NO: 379969 - DNA, 20 bp, human
gggaatgagtcatggcactc

SEQ ID NO: 379970 - DNA, 20 bp, human
gtcattcccactacagatgg

SEQ ID NO: 379971 - DNA, 20 bp, human
gtgagtttagggagcacccg

SEQ ID NO: 379972 - DNA, 20 bp, human
gtaagcatgcacgtgtatgt

SEQ ID NO: 379973 - DNA, 20 bp, human
gatggccatgggtcccgagg

SEQ ID NO: 379974 - DNA, 20 bp, human
gtgacacttcaaggggtgga

SEQ ID NO: 379975 - DNA, 20 bp, human
gaagggtgacccagtgtcct

SEQ ID NO: 379976 - DNA, 20 bp, human
ggctcaggggtgaccctcgt

SEQ ID NO: 379977 - DNA, 20 bp, human
gtcagtgcagaacatgtacc

SEQ ID NO: 379978 - DNA, 20 bp, human
gtcgccacagagtctctgtg

SEQ ID NO: 379979 - DNA, 20 bp, human
gtctgggcagatgccgacga

SEQ ID NO: 379980 - DNA, 20 bp, human
ggccattgcccaggtcaaga

SEQ ID NO: 379981 - DNA, 20 bp, human
gtccagcatggcaaagggta

SEQ ID NO: 379982 - DNA, 20 bp, human
ggtacccggtgagtgctcag

SEQ ID NO: 379983 - DNA, 20 bp, human
gcacggcccgggtcacatct

SEQ ID NO: 379984 - DNA, 20 bp, human
ggagatgtgtagagtcagag

SEQ ID NO: 379985 - DNA, 20 bp, human
gcactcacctgagtctgctc

SEQ ID NO: 379986 - DNA, 20 bp, human
gctgtagtgggaacgagtca

SEQ ID NO: 379987 - DNA, 20 bp, human
gtccttgccgccatctgtag

SEQ ID NO: 379988 - DNA, 20 bp, human
gggaacgagtcatggcactc

SEQ ID NO: 379989 - DNA, 20 bp, human
gcgagtcatggcactccgga

SEQ ID NO: 379990 - DNA, 20 bp, human
gtggcggcaaggaggctcca

SEQ ID NO: 379991 - DNA, 20 bp, human
gtcgttcccactacagatgg

SEQ ID NO: 379992 - DNA, 20 bp, human
gcccactacagatggcggca

SEQ ID NO: 379993 - DNA, 20 bp, human
gcctagcaggggactcatct

SEQ ID NO: 379994 - DNA, 20 bp, human
gtgagtttagggagcacctg

SEQ ID NO: 379995 - DNA, 20 bp, human
gacatatgagtggggcagct

SEQ ID NO: 379996 - DNA, 20 bp, human
gacagggggcggccagaaca

SEQ ID NO: 379997 - DNA, 20 bp, human
gctggagcctgagcaactga

SEQ ID NO: 379998 - DNA, 20 bp, human
ggggcttggtaccctttcgt

SEQ ID NO: 379999 - DNA, 20 bp, human
ggcctgagcaactgaagggc

SEQ ID NO: 380000 - DNA, 20 bp, human
gaaagggtaccaagcccaga

SEQ ID NO: 380001 - DNA, 20 bp, human
ggctctggggggtcagttcc

SEQ ID NO: 380002 - DNA, 20 bp, human
gtctctgctgacggtcccaa

SEQ ID NO: 380003 - DNA, 20 bp, human
gtgacggtcccaaaggaacc

SEQ ID NO: 380004 - DNA, 20 bp, human
gaccctttcgtgggtaccaa

SEQ ID NO: 380005 - DNA, 20 bp, human
gggctctgattctgtgcagc

SEQ ID NO: 380006 - DNA, 20 bp, human
ggctcacagccaggtcgatc

SEQ ID NO: 380007 - DNA, 20 bp, human
gagagggatggggatttccc

SEQ ID NO: 380008 - DNA, 20 bp, human
gacagggtcccagcggagat

SEQ ID NO: 380009 - DNA, 20 bp, human
gcatgtggttccttagtgtc

SEQ ID NO: 380010 - DNA, 20 bp, human
gggctgtgagccagacacta

SEQ ID NO: 380011 - DNA, 20 bp, human
gcacagccaggtcgatctgg

SEQ ID NO: 380012 - DNA, 20 bp, human
gccacccaccctccaaagcg

SEQ ID NO: 380013 - DNA, 20 bp, human
gacgtcaagccccgctttgg

SEQ ID NO: 380014 - DNA, 20 bp, human
gaagccccgctttggagggt

SEQ ID NO: 380015 - DNA, 20 bp, human
gtcgatccctgaagaacatg

SEQ ID NO: 380016 - DNA, 20 bp, human
gtggagcccaggtggcacga

SEQ ID NO: 380017 - DNA, 20 bp, human
gtcgcaggaccctgcctccg

SEQ ID NO: 380018 - DNA, 20 bp, human
gcacgaaggcaactgacccg

SEQ ID NO: 380019 - DNA, 20 bp, human
ggcggagcgaaggggcggtg

SEQ ID NO: 380020 - DNA, 20 bp, human
gcgggcgcgcaaagcaccct

SEQ ID NO: 380021 - DNA, 20 bp, human
gagcgaaggggcggtgcgga

SEQ ID NO: 380022 - DNA, 20 bp, human
ggctaccgcgcgccaaccgt

SEQ ID NO: 380023 - DNA, 20 bp, human
gcgggccgtgcggagcgaag

SEQ ID NO: 380024 - DNA, 20 bp, human
gtgcgcgcccgcgggccgtg

SEQ ID NO: 380025 - DNA, 20 bp, human
ggccctgccggatgaagcaa

SEQ ID NO: 380026 - DNA, 20 bp, human
gaaggcagtcttcggaggta

SEQ ID NO: 380027 - DNA, 20 bp, human
gttcggaggtagggctccct

SEQ ID NO: 380028 - DNA, 20 bp, human
ggtaaaataacaaaacacca

SEQ ID NO: 380029 - DNA, 20 bp, human
gatttaggaaatgccaacct

SEQ ID NO: 380030 - DNA, 20 bp, human
gttactagaaatgaatccca

SEQ ID NO: 380031 - DNA, 20 bp, human
ggagctaaggcagtcttcgg

SEQ ID NO: 380032 - DNA, 20 bp, human
gctattgcagactttgcagc

SEQ ID NO: 380033 - DNA, 20 bp, human
gttggagctaaggcagtctt

SEQ ID NO: 380034 - DNA, 20 bp, human
gtaagagtggaatttctcta

SEQ ID NO: 380035 - DNA, 20 bp, human
gtgcaacaggattcctttgt

SEQ ID NO: 380036 - DNA, 20 bp, human
gcccactggctccctgtctc

SEQ ID NO: 380037 - DNA, 20 bp, human
gaggggcagaacacccgtaa

SEQ ID NO: 380038 - DNA, 20 bp, human
gcttctcccaagatctggga

SEQ ID NO: 380039 - DNA, 20 bp, human
gggaacagagggagcaccaa

SEQ ID NO: 380040 - DNA, 20 bp, human
gcggccccgcctgcgcacgg

SEQ ID NO: 380041 - DNA, 20 bp, human
gcccagaagcgccagagaca

SEQ ID NO: 380042 - DNA, 20 bp, human
gcaaggggcgccagtctcag

SEQ ID NO: 380043 - DNA, 20 bp, human
gtgggcgcgtaactgcgttc

SEQ ID NO: 380044 - DNA, 20 bp, human
gtctctggcgcttctgggca

SEQ ID NO: 380045 - DNA, 20 bp, human
gtcccggcaccgccgtgcgc

SEQ ID NO: 380046 - DNA, 20 bp, human
gcaagcggccactccctctc

SEQ ID NO: 380047 - DNA, 20 bp, human
ggactctaagagaaggtctt

SEQ ID NO: 380048 - DNA, 20 bp, human
gtggccgcttgggcggattt

SEQ ID NO: 380049 - DNA, 20 bp, human
gcccggacccaaagccttct

SEQ ID NO: 380050 - DNA, 20 bp, human
gctaataacaaccaattgga

SEQ ID NO: 380051 - DNA, 20 bp, human
ggggaatcgtagttttttgc

SEQ ID NO: 380052 - DNA, 20 bp, human
ggccggagctcaaatttccc

SEQ ID NO: 380053 - DNA, 20 bp, human
ggggagcctaaaaccccacg

SEQ ID NO: 380054 - DNA, 20 bp, human
ggcccgggaaatttgagctc

SEQ ID NO: 380055 - DNA, 20 bp, human
gtcccagaaggctttgggtc

SEQ ID NO: 380056 - DNA, 20 bp, human
gtaccagaggcgagacctcg

SEQ ID NO: 380057 - DNA, 20 bp, human
ggggcgcccagagaatgttc

SEQ ID NO: 380058 - DNA, 20 bp, human
gcatcgtggcgttccgtcgt

SEQ ID NO: 380059 - DNA, 20 bp, human
gtacgtgcggcgtcgttccc

SEQ ID NO: 380060 - DNA, 20 bp, human
ggcgctcgccgcggtatccc

SEQ ID NO: 380061 - DNA, 20 bp, human
ggtccgcgaggtctcgcctc

SEQ ID NO: 380062 - DNA, 20 bp, human
gtgatgggaggacccgacga

SEQ ID NO: 380063 - DNA, 20 bp, human
gcccctgcttccccaaagta

SEQ ID NO: 380064 - DNA, 20 bp, human
gggagtgcaactggtgtcct

SEQ ID NO: 380065 - DNA, 20 bp, human
gtgaggtctgctggtactga

SEQ ID NO: 380066 - DNA, 20 bp, human
gagctgggctgcagctgcgg

SEQ ID NO: 380067 - DNA, 20 bp, human
gacaaaacgtggcctcgcgg

SEQ ID NO: 380068 - DNA, 20 bp, human
gagggagggacgggaacggc

SEQ ID NO: 380069 - DNA, 20 bp, human
ggctccggcaactactccag

SEQ ID NO: 380070 - DNA, 20 bp, human
gtgaccggctgtcacctgga

SEQ ID NO: 380071 - DNA, 20 bp, human
gggaggaggagcagcgagct

SEQ ID NO: 380072 - DNA, 20 bp, human
gcagtcctcaggaaaggctc

SEQ ID NO: 380073 - DNA, 20 bp, human
gaggaggagcggcccccgcg

SEQ ID NO: 380074 - DNA, 20 bp, human
ggggcgggggtcgaaggaag

SEQ ID NO: 380075 - DNA, 20 bp, human
gcgcggtcagtcctcaggaa

SEQ ID NO: 380076 - DNA, 20 bp, human
gcgggccgcgaggttattag

SEQ ID NO: 380077 - DNA, 20 bp, human
gcgcgagaagcgagtaggtg

SEQ ID NO: 380078 - DNA, 20 bp, human
gtagaggtggagcgcgggga

SEQ ID NO: 380079 - DNA, 20 bp, human
ggcgctcgcgcgcagacttc

SEQ ID NO: 380080 - DNA, 20 bp, human
gccgcgcgccggttggaagc

SEQ ID NO: 380081 - DNA, 20 bp, human
gccgcgggcagagctctcct

SEQ ID NO: 380082 - DNA, 20 bp, human
ggcagacttcaggtcccgtg

SEQ ID NO: 380083 - DNA, 20 bp, human
ggccgcgaggttattagagg

SEQ ID NO: 380084 - DNA, 20 bp, human
ggggtggcggcggtgaccag

SEQ ID NO: 380085 - DNA, 20 bp, human
gtaggtggggagtgagccgc

SEQ ID NO: 380086 - DNA, 20 bp, human
gtgaaacccgacgggatgaa

SEQ ID NO: 380087 - DNA, 20 bp, human
ggggagaaactacactactc

SEQ ID NO: 380088 - DNA, 20 bp, human
gagaaactacactactctgg

SEQ ID NO: 380089 - DNA, 20 bp, human
gaggggccgggtgcccacgg

SEQ ID NO: 380090 - DNA, 20 bp, human
gcccgacgggatgaagggct

SEQ ID NO: 380091 - DNA, 20 bp, human
ggggcaggcgggcaccgttg

SEQ ID NO: 380092 - DNA, 20 bp, human
gggacacgggagtgcaaccc

SEQ ID NO: 380093 - DNA, 20 bp, human
ggggaggcggcggggtacct

SEQ ID NO: 380094 - DNA, 20 bp, human
gttgcggggtagcaaggggc

SEQ ID NO: 380095 - DNA, 20 bp, human
gagattttgcggggtagcaa

SEQ ID NO: 380096 - DNA, 20 bp, human
gccggcgcgcagttccggag

SEQ ID NO: 380097 - DNA, 20 bp, human
gcgccggagcgccttggacg

SEQ ID NO: 380098 - DNA, 20 bp, human
ggcggggtaggggcggtcgg

SEQ ID NO: 380099 - DNA, 20 bp, human
gcggaaaaatgccctcggtg

SEQ ID NO: 380100 - DNA, 20 bp, human
gccgcgggagccgcggggta

SEQ ID NO: 380101 - DNA, 20 bp, human
gagggagcctggcgcaggat

SEQ ID NO: 380102 - DNA, 20 bp, human
gctcaggtcgaggtcaggga

SEQ ID NO: 380103 - DNA, 20 bp, human
gtcccgggtttccgcgtcca

SEQ ID NO: 380104 - DNA, 20 bp, human
gactgcgcgccggagcgcct

SEQ ID NO: 380105 - DNA, 20 bp, human
gttccgcgtccaaggcgctc

SEQ ID NO: 380106 - DNA, 20 bp, human
gaatacactggggtgagaat

SEQ ID NO: 380107 - DNA, 20 bp, human
gcctacgtgggagagaaggg

SEQ ID NO: 380108 - DNA, 20 bp, human
gactggggtgagaatgggtg

SEQ ID NO: 380109 - DNA, 20 bp, human
gggtgggggtgctttcaaag

SEQ ID NO: 380110 - DNA, 20 bp, human
gtggcggtagcgctgtggga

SEQ ID NO: 380111 - DNA, 20 bp, human
gacccttcccacaatacact

SEQ ID NO: 380112 - DNA, 20 bp, human
gtgagcacagaaaagcgcgt

SEQ ID NO: 380113 - DNA, 20 bp, human
gcagtctggcggtagcgctg

SEQ ID NO: 380114 - DNA, 20 bp, human
ggcaaaacacacttaactga

SEQ ID NO: 380115 - DNA, 20 bp, human
gtgctcaagcgactggaaca

SEQ ID NO: 380116 - DNA, 20 bp, human
ggggctaagggccacccgag

SEQ ID NO: 380117 - DNA, 20 bp, human
gagctcgagcaggtagagac

SEQ ID NO: 380118 - DNA, 20 bp, human
gcgcggggccgaatccgctc

SEQ ID NO: 380119 - DNA, 20 bp, human
gtcagcgccaggcagggcta

SEQ ID NO: 380120 - DNA, 20 bp, human
gggattcggccccgcggtca

SEQ ID NO: 380121 - DNA, 20 bp, human
gcccagcttggccctgaccg

SEQ ID NO: 380122 - DNA, 20 bp, human
ggggagctgggcttccctag

SEQ ID NO: 380123 - DNA, 20 bp, human
gcgacttcgggagctcgagc

SEQ ID NO: 380124 - DNA, 20 bp, human
gggcgcctgcggccccgaca

SEQ ID NO: 380125 - DNA, 20 bp, human
gagggccacccgagcggatt

SEQ ID NO: 380126 - DNA, 20 bp, human
gagggggcggcgcggaactc

SEQ ID NO: 380127 - DNA, 20 bp, human
ggacccaggccggaggccgt

SEQ ID NO: 380128 - DNA, 20 bp, human
gagcccacggcctccggcct

SEQ ID NO: 380129 - DNA, 20 bp, human
gagcgccacacgcccgccag

SEQ ID NO: 380130 - DNA, 20 bp, human
gctccggcctgggtccagaa

SEQ ID NO: 380131 - DNA, 20 bp, human
gcgtcccggagcggagcgtg

SEQ ID NO: 380132 - DNA, 20 bp, human
gtgggctgcaccgctccagg

SEQ ID NO: 380133 - DNA, 20 bp, human
gacagcggctcccctgtctg

SEQ ID NO: 380134 - DNA, 20 bp, human
gcccgccgccgtcggcgtcc

SEQ ID NO: 380135 - DNA, 20 bp, human
gcggaactcgggccgcgtgc

SEQ ID NO: 380136 - DNA, 20 bp, human
gggggcgcacgaggggtaaa

SEQ ID NO: 380137 - DNA, 20 bp, human
gtgcgcctgaagtaaaaaga

SEQ ID NO: 380138 - DNA, 20 bp, human
ggggcgggtttactagaggg

SEQ ID NO: 380139 - DNA, 20 bp, human
ggcggggcgggtttactaga

SEQ ID NO: 380140 - DNA, 20 bp, human
ggcacgaggggtaaagggac

SEQ ID NO: 380141 - DNA, 20 bp, human
gaggagggcacgtttcacta

SEQ ID NO: 380142 - DNA, 20 bp, human
ggcagaggctgcggctattt

SEQ ID NO: 380143 - DNA, 20 bp, human
ggggaaactaacgtctctct

SEQ ID NO: 380144 - DNA, 20 bp, human
ggagacgttagtttccccaa

SEQ ID NO: 380145 - DNA, 20 bp, human
gacgggtaaaggggcgcacg

SEQ ID NO: 380146 - DNA, 20 bp, human
gaagactgaagcccggaggt

SEQ ID NO: 380147 - DNA, 20 bp, human
gagctcgcccagtccgcgaa

SEQ ID NO: 380148 - DNA, 20 bp, human
gatggaaggcccctctggat

SEQ ID NO: 380149 - DNA, 20 bp, human
gagccctcttcctggcggtg

SEQ ID NO: 380150 - DNA, 20 bp, human
gctgggctggcccaagagta

SEQ ID NO: 380151 - DNA, 20 bp, human
gaggggccttccatagttca

SEQ ID NO: 380152 - DNA, 20 bp, human
ggggaagggacggcggcgat

SEQ ID NO: 380153 - DNA, 20 bp, human
gtccaatagcggcccgggaa

SEQ ID NO: 380154 - DNA, 20 bp, human
gttccccaccgccaggaaga

SEQ ID NO: 380155 - DNA, 20 bp, human
gcccgggaaaggaccagaac

SEQ ID NO: 380156 - DNA, 20 bp, human
ggggcggggccgactgacta

SEQ ID NO: 380157 - DNA, 20 bp, human
gggttcctctgcgtcggagg

SEQ ID NO: 380158 - DNA, 20 bp, human
gccgacgcagaggaaccaat

SEQ ID NO: 380159 - DNA, 20 bp, human
gcggggccgactgactatgg

SEQ ID NO: 380160 - DNA, 20 bp, human
gggacagcgcgcccggagga

SEQ ID NO: 380161 - DNA, 20 bp, human
ggacaaaggttcttgtggat

SEQ ID NO: 380162 - DNA, 20 bp, human
ggggaagacaaaggttcttg

SEQ ID NO: 380163 - DNA, 20 bp, human
ggatctgacatcatcatgtt

SEQ ID NO: 380164 - DNA, 20 bp, human
ggacttatatccgggattgt

SEQ ID NO: 380165 - DNA, 20 bp, human
gacccctagtagcggatctc

SEQ ID NO: 380166 - DNA, 20 bp, human
gttgctagagcggcagattg

SEQ ID NO: 380167 - DNA, 20 bp, human
gcaagcgtctgagaaaatct

SEQ ID NO: 380168 - DNA, 20 bp, human
ggctccaggtgccactgttg

SEQ ID NO: 380169 - DNA, 20 bp, human
gcgtctgagaaaatctaggc

SEQ ID NO: 380170 - DNA, 20 bp, human
ggcggaccccgttgctagag

SEQ ID NO: 380171 - DNA, 20 bp, human
gagtccgcaacagtggcacc

SEQ ID NO: 380172 - DNA, 20 bp, human
gggtcgagagtccgcaacag

SEQ ID NO: 380173 - DNA, 20 bp, human
gcaccagaaagcggtgggtc

SEQ ID NO: 380174 - DNA, 20 bp, human
gaaggcgcgacaccagaaag

SEQ ID NO: 380175 - DNA, 20 bp, human
gaagcggtgggtctggctcc

SEQ ID NO: 380176 - DNA, 20 bp, human
gtagaagcggagacgtcaga

SEQ ID NO: 380177 - DNA, 20 bp, human
ggcggcacgggcaaccagtt

SEQ ID NO: 380178 - DNA, 20 bp, human
gcggccgcgtgtgatgtccc

SEQ ID NO: 380179 - DNA, 20 bp, human
gagggggccggtcagagtga

SEQ ID NO: 380180 - DNA, 20 bp, human
gcgcggtagctcaggcagag

SEQ ID NO: 380181 - DNA, 20 bp, human
ggaggtacacgaaatccctc

SEQ ID NO: 380182 - DNA, 20 bp, human
ggttgcccgtgccgcctcgg

SEQ ID NO: 380183 - DNA, 20 bp, human
gggaggaagctcctgattgg

SEQ ID NO: 380184 - DNA, 20 bp, human
ggtggaaagtccgaggaagt

SEQ ID NO: 380185 - DNA, 20 bp, human
gtgacgtctccgcttctaat

SEQ ID NO: 380186 - DNA, 20 bp, human
ggggacggcgcgtgcacttg

SEQ ID NO: 380187 - DNA, 20 bp, human
gcccgcgcgcggtattttgg

SEQ ID NO: 380188 - DNA, 20 bp, human
gagcgcgccgtggaccccac

SEQ ID NO: 380189 - DNA, 20 bp, human
ggacctccgaccccactcgc

SEQ ID NO: 380190 - DNA, 20 bp, human
ggctccgccccgctgtcctc

SEQ ID NO: 380191 - DNA, 20 bp, human
gagcctgagcaggcggtgtg

SEQ ID NO: 380192 - DNA, 20 bp, human
ggcacgggtcccaaaggctc

SEQ ID NO: 380193 - DNA, 20 bp, human
gtcgcgccctgtggggtcca

SEQ ID NO: 380194 - DNA, 20 bp, human
gaggggcagggcttgcggtg

SEQ ID NO: 380195 - DNA, 20 bp, human
gtgcacttgaggacgcgagc

SEQ ID NO: 380196 - DNA, 20 bp, human
gatttccgagtgctgaaacc

SEQ ID NO: 380197 - DNA, 20 bp, human
gagaatgtcagcgacagtat

SEQ ID NO: 380198 - DNA, 20 bp, human
gccacccaagccccgcctct

SEQ ID NO: 380199 - DNA, 20 bp, human
gtggaacacgcgctttccct

SEQ ID NO: 380200 - DNA, 20 bp, human
gcaagccccgcctctgggcg

SEQ ID NO: 380201 - DNA, 20 bp, human
gcagccgtacctcactccgg

SEQ ID NO: 380202 - DNA, 20 bp, human
gatgtcagcgacagtattgg

SEQ ID NO: 380203 - DNA, 20 bp, human
gcctccaccggagtgaggta

SEQ ID NO: 380204 - DNA, 20 bp, human
gggtgggctgaccactcctc

SEQ ID NO: 380205 - DNA, 20 bp, human
gcgcttgggcccccgcccag

SEQ ID NO: 380206 - DNA, 20 bp, human
ggggatggctgcactggctt

SEQ ID NO: 380207 - DNA, 20 bp, human
gtggggttgccatggcgacg

SEQ ID NO: 380208 - DNA, 20 bp, human
gccgctgcgtgaatgggagg

SEQ ID NO: 380209 - DNA, 20 bp, human
ggcagccatccccgtcgcca

SEQ ID NO: 380210 - DNA, 20 bp, human
gaaccccagcgcggttgggg

SEQ ID NO: 380211 - DNA, 20 bp, human
ggggtcctccccaaccgcgc

SEQ ID NO: 380212 - DNA, 20 bp, human
ggcagcggacgtgacacgtg

SEQ ID NO: 380213 - DNA, 20 bp, human
gaaccgcgctggggttgcca

SEQ ID NO: 380214 - DNA, 20 bp, human
gggggtcacgtgttgttgtt

SEQ ID NO: 380215 - DNA, 20 bp, human
gctcgtgcccacccattgag

SEQ ID NO: 380216 - DNA, 20 bp, human
gccaccgcgacccaacgctg

SEQ ID NO: 380217 - DNA, 20 bp, human
gacatgaagcggaggaccac

SEQ ID NO: 380218 - DNA, 20 bp, human
gaagaggtgcggggggacgg

SEQ ID NO: 380219 - DNA, 20 bp, human
ggggaaggacaccacaagtc

SEQ ID NO: 380220 - DNA, 20 bp, human
gcgtggtatggcaggttaat

SEQ ID NO: 380221 - DNA, 20 bp, human
ggaagacgaggagcgtggta

SEQ ID NO: 380222 - DNA, 20 bp, human
ggattgaaaatactgggtga

SEQ ID NO: 380223 - DNA, 20 bp, human
gagtgagaaaggacccaatg

SEQ ID NO: 380224 - DNA, 20 bp, human
ggaggaaagaccccgacttg

SEQ ID NO: 380225 - DNA, 20 bp, human
ggaagaaaaggccaggctga

SEQ ID NO: 380226 - DNA, 20 bp, human
gcgcacgcctatggcccgtc

SEQ ID NO: 380227 - DNA, 20 bp, human
ggcggcggcaactgccgagt

SEQ ID NO: 380228 - DNA, 20 bp, human
ggcgagggcaacagtggacg

SEQ ID NO: 380229 - DNA, 20 bp, human
gcgcggccacggtaatgagg

SEQ ID NO: 380230 - DNA, 20 bp, human
ggcgcggggcgcggtcggtc

SEQ ID NO: 380231 - DNA, 20 bp, human
gccggaggccacgtgaccga

SEQ ID NO: 380232 - DNA, 20 bp, human
gtcggccagcgctcggggaa

SEQ ID NO: 380233 - DNA, 20 bp, human
gcaccgccggcgggctcccg

SEQ ID NO: 380234 - DNA, 20 bp, human
ggctgtggtgactaccagac

SEQ ID NO: 380235 - DNA, 20 bp, human
gctggtagtcaccacagccg

SEQ ID NO: 380236 - DNA, 20 bp, human
gtgcccgcgcaccgggaaat

SEQ ID NO: 380237 - DNA, 20 bp, human
gacagccccggtgcgcccgg

SEQ ID NO: 380238 - DNA, 20 bp, human
ggtcaggggccaaggggtcc

SEQ ID NO: 380239 - DNA, 20 bp, human
ggcctcccccgggcgcaccg

SEQ ID NO: 380240 - DNA, 20 bp, human
ggatcccagagttcaggaaa

SEQ ID NO: 380241 - DNA, 20 bp, human
gaaggcccagagctgcgcga

SEQ ID NO: 380242 - DNA, 20 bp, human
gagtgccttcggggtcgcag

SEQ ID NO: 380243 - DNA, 20 bp, human
ggacgcgaggggactgtccg

SEQ ID NO: 380244 - DNA, 20 bp, human
gtcccaggtcaggggccaag

SEQ ID NO: 380245 - DNA, 20 bp, human
ggtgtcacgtgagacgcgag

SEQ ID NO: 380246 - DNA, 20 bp, human
gaccagcccctcccctacga

SEQ ID NO: 380247 - DNA, 20 bp, human
gccggagtccctaccctcgt

SEQ ID NO: 380248 - DNA, 20 bp, human
gtccctaccctcgtagggga

SEQ ID NO: 380249 - DNA, 20 bp, human
gtcccctcccacggccgtga

SEQ ID NO: 380250 - DNA, 20 bp, human
gtccccactaggagccgcgg

SEQ ID NO: 380251 - DNA, 20 bp, human
ggggtccccactaggagccg

SEQ ID NO: 380252 - DNA, 20 bp, human
ggcccctccctcacggccgt

SEQ ID NO: 380253 - DNA, 20 bp, human
gcctccctcacggccgtggg

SEQ ID NO: 380254 - DNA, 20 bp, human
ggaggggctggttcgggacg

SEQ ID NO: 380255 - DNA, 20 bp, human
gcccctcccctacgagggta

SEQ ID NO: 380256 - DNA, 20 bp, human
ggcagcaaaacaaacccgag

SEQ ID NO: 380257 - DNA, 20 bp, human
ggagccccgcgggcactcga

SEQ ID NO: 380258 - DNA, 20 bp, human
gaaacccgagcggcctgcgc

SEQ ID NO: 380259 - DNA, 20 bp, human
ggaggggcgccgcggacgcc

SEQ ID NO: 380260 - DNA, 20 bp, human
gggctcagacactcaacact

SEQ ID NO: 380261 - DNA, 20 bp, human
ggcgccttcgagtgcccgcg

SEQ ID NO: 380262 - DNA, 20 bp, human
gcccccagtgccgccagagc

SEQ ID NO: 380263 - DNA, 20 bp, human
ggctgggcccgagacgggtg

SEQ ID NO: 380264 - DNA, 20 bp, human
gggagcccgcggcgtccttg

SEQ ID NO: 380265 - DNA, 20 bp, human
ggggccgccccccggacacg

SEQ ID NO: 380266 - DNA, 20 bp, human
gcaccctcggcataggggag

SEQ ID NO: 380267 - DNA, 20 bp, human
gctccccaacagccagctga

SEQ ID NO: 380268 - DNA, 20 bp, human
gagagggcacccactcgccg

SEQ ID NO: 380269 - DNA, 20 bp, human
ggggaggactgagagcgaga

SEQ ID NO: 380270 - DNA, 20 bp, human
gagggtggggaactgcgaac

SEQ ID NO: 380271 - DNA, 20 bp, human
gcccaccctccttaggggaa

SEQ ID NO: 380272 - DNA, 20 bp, human
gcggcgcaagggattggcac

SEQ ID NO: 380273 - DNA, 20 bp, human
gcggcggctgcagcgacaga

SEQ ID NO: 380274 - DNA, 20 bp, human
gggactgcacggcggcgcaa

SEQ ID NO: 380275 - DNA, 20 bp, human
gggcccctcccctatgccga

SEQ ID NO: 380276 - DNA, 20 bp, human
gctcgaggggcagaacccgg

SEQ ID NO: 380277 - DNA, 20 bp, human
gtcgaggcgctctaataact

SEQ ID NO: 380278 - DNA, 20 bp, human
gccgcccccaggcgctctaa

SEQ ID NO: 380279 - DNA, 20 bp, human
ggggccgcgcacgcacgcgg

SEQ ID NO: 380280 - DNA, 20 bp, human
gtggccgttagagcgcctgg

SEQ ID NO: 380281 - DNA, 20 bp, human
gggccgttaaagcacctcaa

SEQ ID NO: 380282 - DNA, 20 bp, human
gtgaaggcgttgtaacaacc

SEQ ID NO: 380283 - DNA, 20 bp, human
gtggaagtagaacatctcga

SEQ ID NO: 380284 - DNA, 20 bp, human
gtggagttagcgcgtctcga

SEQ ID NO: 380285 - DNA, 20 bp, human
gcctcgagcgccacaacagc

SEQ ID NO: 380286 - DNA, 20 bp, human
ggtcctgtgctgggttctcg

SEQ ID NO: 380287 - DNA, 20 bp, human
gttggccagccagacgatga

SEQ ID NO: 380288 - DNA, 20 bp, human
gttccccgagaacccagcac

SEQ ID NO: 380289 - DNA, 20 bp, human
gacgctctcactggacaaag

SEQ ID NO: 380290 - DNA, 20 bp, human
gcgatgaaggctctagagac

SEQ ID NO: 380291 - DNA, 20 bp, human
gtgggacaagacggagcctc

SEQ ID NO: 380292 - DNA, 20 bp, human
gggtaagattctgatagctt

SEQ ID NO: 380293 - DNA, 20 bp, human
gcctgcagaggcctagtccc

SEQ ID NO: 380294 - DNA, 20 bp, human
gaagttttaaggctagactg

SEQ ID NO: 380295 - DNA, 20 bp, human
gaggcagcgcgcaaactatg

SEQ ID NO: 380296 - DNA, 20 bp, human
gaagcgggcggagacgtttc

SEQ ID NO: 380297 - DNA, 20 bp, human
gagctgtgagggtgcttcgc

SEQ ID NO: 380298 - DNA, 20 bp, human
gggagggccgtgagctgtga

SEQ ID NO: 380299 - DNA, 20 bp, human
gtggcggctgcatcgggaag

SEQ ID NO: 380300 - DNA, 20 bp, human
gtgcatcgggaagcggaagc

SEQ ID NO: 380301 - DNA, 20 bp, human
ggagacgtttccggcctgga

SEQ ID NO: 380302 - DNA, 20 bp, human
ggaaaagcaggagtaaacgc

SEQ ID NO: 380303 - DNA, 20 bp, human
ggaagcaccctcacagctca

SEQ ID NO: 380304 - DNA, 20 bp, human
gagggtgcttcgcgggtcgg

SEQ ID NO: 380305 - DNA, 20 bp, human
gcgagcccaggggcagggtc

SEQ ID NO: 380306 - DNA, 20 bp, human
gagagatggctgtggcacgg

SEQ ID NO: 380307 - DNA, 20 bp, human
gaagctcttgaggagttccg

SEQ ID NO: 380308 - DNA, 20 bp, human
gagcaagggccaattagaga

SEQ ID NO: 380309 - DNA, 20 bp, human
gaggaggggcgaagctcttg

SEQ ID NO: 380310 - DNA, 20 bp, human
gtcacttcctgtgtttccat

SEQ ID NO: 380311 - DNA, 20 bp, human
gtgccacagccatctctaat

SEQ ID NO: 380312 - DNA, 20 bp, human
gcagcgagttgctcccacta

SEQ ID NO: 380313 - DNA, 20 bp, human
gagcaactcgctgaagccga

SEQ ID NO: 380314 - DNA, 20 bp, human
gcttgaggagttccggggcg

SEQ ID NO: 380315 - DNA, 20 bp, human
gctgaagccgagggcagaac

SEQ ID NO: 380316 - DNA, 20 bp, human
gctcggtgggaggtaagagg

SEQ ID NO: 380317 - DNA, 20 bp, human
ggggcggcgctaatgggcat

SEQ ID NO: 380318 - DNA, 20 bp, human
ggggggacggggaaagtgac

SEQ ID NO: 380319 - DNA, 20 bp, human
gagtgagagccggaaatgag

SEQ ID NO: 380320 - DNA, 20 bp, human
gacctcccaccgagcccagc

SEQ ID NO: 380321 - DNA, 20 bp, human
gagtggctagcgaggcaccc

SEQ ID NO: 380322 - DNA, 20 bp, human
gcacccaggagcgccctgtc

SEQ ID NO: 380323 - DNA, 20 bp, human
gcccaccgagcccagcgggt

SEQ ID NO: 380324 - DNA, 20 bp, human
gctcgctagccactcatttc

SEQ ID NO: 380325 - DNA, 20 bp, human
gccgccggacagggcgctcc

SEQ ID NO: 380326 - DNA, 20 bp, human
ggggaagcggagatgggcta

SEQ ID NO: 380327 - DNA, 20 bp, human
gggcgctgggaagcggagat

SEQ ID NO: 380328 - DNA, 20 bp, human
gaacccagctaccggcccat

SEQ ID NO: 380329 - DNA, 20 bp, human
gtggcactgggcgaaagagt

SEQ ID NO: 380330 - DNA, 20 bp, human
gggctaggggtgggccggag

SEQ ID NO: 380331 - DNA, 20 bp, human
ggcaccgagaatttctctcc

SEQ ID NO: 380332 - DNA, 20 bp, human
gggagaggggcgtctcgcct

SEQ ID NO: 380333 - DNA, 20 bp, human
gaattctcggtgcaagtgca

SEQ ID NO: 380334 - DNA, 20 bp, human
ggctaccggcccatgggcgc

SEQ ID NO: 380335 - DNA, 20 bp, human
ggagtggggtgactgccccc

SEQ ID NO: 380336 - DNA, 20 bp, human
gactgtcagcagctaaccaa

SEQ ID NO: 380337 - DNA, 20 bp, human
gacgatcatggcaaattgaa

SEQ ID NO: 380338 - DNA, 20 bp, human
gctcctggtagcgacgatca

SEQ ID NO: 380339 - DNA, 20 bp, human
gtcagcagctaaccaatggc

SEQ ID NO: 380340 - DNA, 20 bp, human
gatgaaacggctcctgccat

SEQ ID NO: 380341 - DNA, 20 bp, human
ggcttgtgcagccgatgaaa

SEQ ID NO: 380342 - DNA, 20 bp, human
gtgccatgatcgtcgctacc

SEQ ID NO: 380343 - DNA, 20 bp, human
gtttccctgggagaagagat

SEQ ID NO: 380344 - DNA, 20 bp, human
gcgctctaaaggggggaagg

SEQ ID NO: 380345 - DNA, 20 bp, human
gcagtggtcacagagcttaa

SEQ ID NO: 380346 - DNA, 20 bp, human
gggtctgggcggtgcgatcg

SEQ ID NO: 380347 - DNA, 20 bp, human
gttccggggcagggagagta

SEQ ID NO: 380348 - DNA, 20 bp, human
ggggacgtaacttccgggaa

SEQ ID NO: 380349 - DNA, 20 bp, human
ggacagctgggggctagtgc

SEQ ID NO: 380350 - DNA, 20 bp, human
gggaggaaagagacagctgg

SEQ ID NO: 380351 - DNA, 20 bp, human
gcggcagtgtgtaacttccg

SEQ ID NO: 380352 - DNA, 20 bp, human
gacaccgggacgtaacttcc

SEQ ID NO: 380353 - DNA, 20 bp, human
ggcggtgcgatcgtgggcac

SEQ ID NO: 380354 - DNA, 20 bp, human
gccgggaggaaagagacagc

SEQ ID NO: 380355 - DNA, 20 bp, human
gagtgtgtaacttccggggc

SEQ ID NO: 380356 - DNA, 20 bp, human
gagaaggggcggctgatcgt

SEQ ID NO: 380357 - DNA, 20 bp, human
gtacgcaagcagggagggat

SEQ ID NO: 380358 - DNA, 20 bp, human
gaagcggagcgataggtcat

SEQ ID NO: 380359 - DNA, 20 bp, human
gaggatggcgtactggtcgg

SEQ ID NO: 380360 - DNA, 20 bp, human
ggttccggggacagttaggg

SEQ ID NO: 380361 - DNA, 20 bp, human
gttccggccacacctttcgg

SEQ ID NO: 380362 - DNA, 20 bp, human
gagcttccggccacaccttt

SEQ ID NO: 380363 - DNA, 20 bp, human
gtggccggaagctggaggcg

SEQ ID NO: 380364 - DNA, 20 bp, human
gaggacgagtgagtggagac

SEQ ID NO: 380365 - DNA, 20 bp, human
ggagcctcgccccgcacgtc

SEQ ID NO: 380366 - DNA, 20 bp, human
gcgggcgggcggcagagcga

SEQ ID NO: 380367 - DNA, 20 bp, human
ggggagggaaaatttaaatg

SEQ ID NO: 380368 - DNA, 20 bp, human
gagccggtccgggcggtcgg

SEQ ID NO: 380369 - DNA, 20 bp, human
gaccgcccggaccggctcac

SEQ ID NO: 380370 - DNA, 20 bp, human
gcgcaccggtgagccggtcc

SEQ ID NO: 380371 - DNA, 20 bp, human
gcgggcggtcggggggcccc

SEQ ID NO: 380372 - DNA, 20 bp, human
gaggagaaacgcacgcgggc

SEQ ID NO: 380373 - DNA, 20 bp, human
gcctcctcggggccggcctg

SEQ ID NO: 380374 - DNA, 20 bp, human
gcgggccgagcgagccgcgg

SEQ ID NO: 380375 - DNA, 20 bp, human
gagagaggagaaacgcacgc

SEQ ID NO: 380376 - DNA, 20 bp, human
gtgggcccatcgatcaggaa

SEQ ID NO: 380377 - DNA, 20 bp, human
gacgcctgggcccatcgatc

SEQ ID NO: 380378 - DNA, 20 bp, human
gagtgggagcagcagattgc

SEQ ID NO: 380379 - DNA, 20 bp, human
gcaggcctggctgactggag

SEQ ID NO: 380380 - DNA, 20 bp, human
gggtgggagagtggttcttg

SEQ ID NO: 380381 - DNA, 20 bp, human
gggagagtggttcttgagga

SEQ ID NO: 380382 - DNA, 20 bp, human
ggcgggctgaatggcggagg

SEQ ID NO: 380383 - DNA, 20 bp, human
ggctggggggctcttagctg

SEQ ID NO: 380384 - DNA, 20 bp, human
gcggcagatgcgcaattgtc

SEQ ID NO: 380385 - DNA, 20 bp, human
gaggtcaggggtctgggtct

SEQ ID NO: 380386 - DNA, 20 bp, human
gtaggggcgcaggtcggatc

SEQ ID NO: 380387 - DNA, 20 bp, human
gagcgcctgccccggtgggt

SEQ ID NO: 380388 - DNA, 20 bp, human
gtgtgagcgcctgccccggt

SEQ ID NO: 380389 - DNA, 20 bp, human
ggcggtgcgctcctgtccga

SEQ ID NO: 380390 - DNA, 20 bp, human
ggatcacagggaggacggga

SEQ ID NO: 380391 - DNA, 20 bp, human
ggcttcccacccaccggggc

SEQ ID NO: 380392 - DNA, 20 bp, human
gcgctcatgcagcgagcggg

SEQ ID NO: 380393 - DNA, 20 bp, human
gtcctgcttcccacccaccg

SEQ ID NO: 380394 - DNA, 20 bp, human
gccgacctgcgcccctacgc

SEQ ID NO: 380395 - DNA, 20 bp, human
gcgggcgctcatgcagcgag

SEQ ID NO: 380396 - DNA, 20 bp, human
gagtgaaaagcgccgctgtc

SEQ ID NO: 380397 - DNA, 20 bp, human
gacggggctggactcagcta

SEQ ID NO: 380398 - DNA, 20 bp, human
gaggaaagctggagactacg

SEQ ID NO: 380399 - DNA, 20 bp, human
gacagagttcagcgtccgtg

SEQ ID NO: 380400 - DNA, 20 bp, human
gccgcgcccacttccttaca

SEQ ID NO: 380401 - DNA, 20 bp, human
gagtgtcaataaagcggcgg

SEQ ID NO: 380402 - DNA, 20 bp, human
gagttcagcgtccgtgtggc

SEQ ID NO: 380403 - DNA, 20 bp, human
gtggccggccgtctgggtga

SEQ ID NO: 380404 - DNA, 20 bp, human
gagacggccggccaatcagg

SEQ ID NO: 380405 - DNA, 20 bp, human
gtacaaggtagcgaaaaacc

SEQ ID NO: 380406 - DNA, 20 bp, human
gcgacccgcgccttcggccg

SEQ ID NO: 380407 - DNA, 20 bp, human
gaaggcgcgggtcgccgagt

SEQ ID NO: 380408 - DNA, 20 bp, human
gtaggcgcagcaaacagccg

SEQ ID NO: 380409 - DNA, 20 bp, human
gcgggcggccgccgcccact

SEQ ID NO: 380410 - DNA, 20 bp, human
gaagcacagggcggggagga

SEQ ID NO: 380411 - DNA, 20 bp, human
ggcgcgggtcgccgagtggg

SEQ ID NO: 380412 - DNA, 20 bp, human
gaacaaaaaagagcacccat

SEQ ID NO: 380413 - DNA, 20 bp, human
ggacacggccaatgcgctag

SEQ ID NO: 380414 - DNA, 20 bp, human
gtgcgcgccgcgtccctaca

SEQ ID NO: 380415 - DNA, 20 bp, human
gaaccgtctggagggtgacc

SEQ ID NO: 380416 - DNA, 20 bp, human
gttgcctgacagtgcagtct

SEQ ID NO: 380417 - DNA, 20 bp, human
ggtacctgaagaggtctaat

SEQ ID NO: 380418 - DNA, 20 bp, human
gaggtctaatcggtgtattg

SEQ ID NO: 380419 - DNA, 20 bp, human
ggtggcacctataaagaaaa

SEQ ID NO: 380420 - DNA, 20 bp, human
gtgccactgctcaagggtca

SEQ ID NO: 380421 - DNA, 20 bp, human
gtataaagaaaagggtcctg

SEQ ID NO: 380422 - DNA, 20 bp, human
gaggcccagactgcactgtc

SEQ ID NO: 380423 - DNA, 20 bp, human
gccctctcttaattactcat

SEQ ID NO: 380424 - DNA, 20 bp, human
ggtgcataaatcatgacatg

SEQ ID NO: 380425 - DNA, 20 bp, human
gacaccgattagacctcttc

SEQ ID NO: 380426 - DNA, 20 bp, human
ggccaagctccggccgggag

SEQ ID NO: 380427 - DNA, 20 bp, human
gcgaaagggcctgaggcgag

SEQ ID NO: 380428 - DNA, 20 bp, human
ggggcccggcggcccgtcat

SEQ ID NO: 380429 - DNA, 20 bp, human
ggacagctcaggccaagctc

SEQ ID NO: 380430 - DNA, 20 bp, human
gggcaggaggaggggtctcg

SEQ ID NO: 380431 - DNA, 20 bp, human
gggcggggttttgacagctc

SEQ ID NO: 380432 - DNA, 20 bp, human
gtctcccaggccccccctcc

SEQ ID NO: 380433 - DNA, 20 bp, human
gctcaggccaagctccggcc

SEQ ID NO: 380434 - DNA, 20 bp, human
gtagcgcaggggatccgagc

SEQ ID NO: 380435 - DNA, 20 bp, human
gtggaccaattgtgggtctc

SEQ ID NO: 380436 - DNA, 20 bp, human
gcccgcgtggcctgtcgccc

SEQ ID NO: 380437 - DNA, 20 bp, human
gaggaagcggtgacgtgaga

SEQ ID NO: 380438 - DNA, 20 bp, human
gcgcccggggctgtgagacc

SEQ ID NO: 380439 - DNA, 20 bp, human
gctggggtaccgaacagccg

SEQ ID NO: 380440 - DNA, 20 bp, human
gcacgcgggcgccgcaccct

SEQ ID NO: 380441 - DNA, 20 bp, human
ggaaaaagcgagaactcccg

SEQ ID NO: 380442 - DNA, 20 bp, human
gggcgcggagggcgcgccca

SEQ ID NO: 380443 - DNA, 20 bp, human
ggggagaggacacatcaccg

SEQ ID NO: 380444 - DNA, 20 bp, human
gcgcccccggcggcggaatc

SEQ ID NO: 380445 - DNA, 20 bp, human
gcggtgcgcgctgtcgggag

SEQ ID NO: 380446 - DNA, 20 bp, human
gccctctcgtggctaatact

SEQ ID NO: 380447 - DNA, 20 bp, human
gcaggcgcgcggcagctctc

SEQ ID NO: 380448 - DNA, 20 bp, human
gctgggctgaatttccccga

SEQ ID NO: 380449 - DNA, 20 bp, human
gagggtccagaagagagcca

SEQ ID NO: 380450 - DNA, 20 bp, human
gggccgaggtggcggagtgg

SEQ ID NO: 380451 - DNA, 20 bp, human
gaagccaggcgtcagagccc

SEQ ID NO: 380452 - DNA, 20 bp, human
gccgcgcgcctgccggacga

SEQ ID NO: 380453 - DNA, 20 bp, human
gccacttgggccatctcgga

SEQ ID NO: 380454 - DNA, 20 bp, human
ggctgcgactctagtgacag

SEQ ID NO: 380455 - DNA, 20 bp, human
gctcaaaggccctctcctac

SEQ ID NO: 380456 - DNA, 20 bp, human
gagtaacagcaggtcttctg

SEQ ID NO: 380457 - DNA, 20 bp, human
gaggtatggttgcaaccggg

SEQ ID NO: 380458 - DNA, 20 bp, human
gttcagagcctcaaggctgc

SEQ ID NO: 380459 - DNA, 20 bp, human
ggccaggtatggttgcaacc

SEQ ID NO: 380460 - DNA, 20 bp, human
ggcagtgtagagactctcag

SEQ ID NO: 380461 - DNA, 20 bp, human
ggtgttctggccctcagctg

SEQ ID NO: 380462 - DNA, 20 bp, human
ggaggcacttgctacttccg

SEQ ID NO: 380463 - DNA, 20 bp, human
gacaagagaacgtggtgttc

SEQ ID NO: 380464 - DNA, 20 bp, human
gttcagctttcagagcctca

SEQ ID NO: 380465 - DNA, 20 bp, human
ggaagacctgctgttactca

SEQ ID NO: 380466 - DNA, 20 bp, human
gtaacgtcgcagcgccgcat

SEQ ID NO: 380467 - DNA, 20 bp, human
ggggcgggcgggagccactg

SEQ ID NO: 380468 - DNA, 20 bp, human
gacaggcagtagtaccgatg

SEQ ID NO: 380469 - DNA, 20 bp, human
ggactgaggcatttcagacg

SEQ ID NO: 380470 - DNA, 20 bp, human
gagcgagcgagcgagctcag

SEQ ID NO: 380471 - DNA, 20 bp, human
ggagccggaggcctcttgat

SEQ ID NO: 380472 - DNA, 20 bp, human
gtcatccagccggggatcga

SEQ ID NO: 380473 - DNA, 20 bp, human
gttcacaggtcgagtgctgg

SEQ ID NO: 380474 - DNA, 20 bp, human
gcgcgcacagagtcgcctct

SEQ ID NO: 380475 - DNA, 20 bp, human
gctctcgataagccacctag

SEQ ID NO: 380476 - DNA, 20 bp, human
ggggccccgcgagccgggta

SEQ ID NO: 380477 - DNA, 20 bp, human
ggggcccgagggccaagagg

SEQ ID NO: 380478 - DNA, 20 bp, human
gcgcccgctgtcccccgggg

SEQ ID NO: 380479 - DNA, 20 bp, human
ggcactgggccgcgcggtgg

SEQ ID NO: 380480 - DNA, 20 bp, human
ggcgtggggctcgggatctt

SEQ ID NO: 380481 - DNA, 20 bp, human
gcctcctggttgtcgagcct

SEQ ID NO: 380482 - DNA, 20 bp, human
gcccggggaggggggctcca

SEQ ID NO: 380483 - DNA, 20 bp, human
gatcttggggaccgcgacgc

SEQ ID NO: 380484 - DNA, 20 bp, human
ggcgacgtcagcgcggaggg

SEQ ID NO: 380485 - DNA, 20 bp, human
gaggagggcactgggccgcg

SEQ ID NO: 380486 - DNA, 20 bp, human
gcggagctcagtaggagtga

SEQ ID NO: 380487 - DNA, 20 bp, human
gtattggggaacagccgaga

SEQ ID NO: 380488 - DNA, 20 bp, human
ggcctggaccccagttattg

SEQ ID NO: 380489 - DNA, 20 bp, human
gggctgttccccaataactg

SEQ ID NO: 380490 - DNA, 20 bp, human
gagtaggagtgagggactcg

SEQ ID NO: 380491 - DNA, 20 bp, human
gtgagctccggtggagcctg

SEQ ID NO: 380492 - DNA, 20 bp, human
gcagctgtggcaatgccgag

SEQ ID NO: 380493 - DNA, 20 bp, human
gtgtctgaggggttgggtga

SEQ ID NO: 380494 - DNA, 20 bp, human
gggctccaccggagctcagt

SEQ ID NO: 380495 - DNA, 20 bp, human
gtccccaataactggggtcc

SEQ ID NO: 380496 - DNA, 20 bp, human
ggcgcagacccggcactgat

SEQ ID NO: 380497 - DNA, 20 bp, human
ggcgctgtcacgtttggctg

SEQ ID NO: 380498 - DNA, 20 bp, human
gacctgtggctgcgcagacc

SEQ ID NO: 380499 - DNA, 20 bp, human
gcggcactgataggcgaaga

SEQ ID NO: 380500 - DNA, 20 bp, human
gccaagacgtccggaacctg

SEQ ID NO: 380501 - DNA, 20 bp, human
gccgctgcacctataggact

SEQ ID NO: 380502 - DNA, 20 bp, human
gagccaagatcgactttctt

SEQ ID NO: 380503 - DNA, 20 bp, human
gttcccggggccaagacgtc

SEQ ID NO: 380504 - DNA, 20 bp, human
gaaaccaacccggctttctc

SEQ ID NO: 380505 - DNA, 20 bp, human
gcaccagccgctgcacctat

SEQ ID NO: 380506 - DNA, 20 bp, human
gtgaaggtgcattgggatgg

SEQ ID NO: 380507 - DNA, 20 bp, human
gagtaggggtgatgagtagg

SEQ ID NO: 380508 - DNA, 20 bp, human
gaacgcggtcggcttctaat

SEQ ID NO: 380509 - DNA, 20 bp, human
gaatgtctgcaaggctgcgg

SEQ ID NO: 380510 - DNA, 20 bp, human
gtgcttctctgagcaagcgg

SEQ ID NO: 380511 - DNA, 20 bp, human
gcgactctggggtgaaggca

SEQ ID NO: 380512 - DNA, 20 bp, human
gccccagagtcgttgagagt

SEQ ID NO: 380513 - DNA, 20 bp, human
ggagtgttcgggaaatctag

SEQ ID NO: 380514 - DNA, 20 bp, human
ggtgatgagtagggggtgga

SEQ ID NO: 380515 - DNA, 20 bp, human
ggggaaatctagtggaaatt

SEQ ID NO: 380516 - DNA, 20 bp, human
gtaggggcagcgtcccaggg

SEQ ID NO: 380517 - DNA, 20 bp, human
ggcctaggggcagcgtccca

SEQ ID NO: 380518 - DNA, 20 bp, human
gggcccccgcgtggtccgtc

SEQ ID NO: 380519 - DNA, 20 bp, human
gtcagccgaggtcacggcgt

SEQ ID NO: 380520 - DNA, 20 bp, human
gagcagacgcagatcagccg

SEQ ID NO: 380521 - DNA, 20 bp, human
gcggcctcgcagccccctcg

SEQ ID NO: 380522 - DNA, 20 bp, human
gttgcagtccgaccgcgagg

SEQ ID NO: 380523 - DNA, 20 bp, human
ggcggcgcggttgcctccct

SEQ ID NO: 380524 - DNA, 20 bp, human
ggggtctccgggaaccggga

SEQ ID NO: 380525 - DNA, 20 bp, human
gctcgcagccccctcgcggt

SEQ ID NO: 380526 - DNA, 20 bp, human
gggatgcaatggcccgcgta

SEQ ID NO: 380527 - DNA, 20 bp, human
gacaggacgccctggggtcg

SEQ ID NO: 380528 - DNA, 20 bp, human
ggcccccacccgtcccagct

SEQ ID NO: 380529 - DNA, 20 bp, human
gcctccaggccgcgacccca

SEQ ID NO: 380530 - DNA, 20 bp, human
ggcaatggcccgcgtagggg

SEQ ID NO: 380531 - DNA, 20 bp, human
ggacggagagagcgagccgc

SEQ ID NO: 380532 - DNA, 20 bp, human
gggacaccctacagccttct

SEQ ID NO: 380533 - DNA, 20 bp, human
gactccaagtcagccaggcc

SEQ ID NO: 380534 - DNA, 20 bp, human
gcagccaggcccgggcccga

SEQ ID NO: 380535 - DNA, 20 bp, human
gcccccaggccaccggtggc

SEQ ID NO: 380536 - DNA, 20 bp, human
ggaagaggagggcacaacaa

SEQ ID NO: 380537 - DNA, 20 bp, human
gtgtctccctataaagagga

SEQ ID NO: 380538 - DNA, 20 bp, human
gcacggacttgtactctgag

SEQ ID NO: 380539 - DNA, 20 bp, human
gacaaagggtttcagtgtaa

SEQ ID NO: 380540 - DNA, 20 bp, human
gcaaccaagcaaacatcaca

SEQ ID NO: 380541 - DNA, 20 bp, human
gtgagaaagagcacattgtg

SEQ ID NO: 380542 - DNA, 20 bp, human
gagagtgtctccctataaag

SEQ ID NO: 380543 - DNA, 20 bp, human
gagcaaacatcacatggagt

SEQ ID NO: 380544 - DNA, 20 bp, human
gcaaagcaaagatcccgatt

SEQ ID NO: 380545 - DNA, 20 bp, human
gcaccaagtccattagttgc

SEQ ID NO: 380546 - DNA, 20 bp, human
gaatgctcttggggtgagga

SEQ ID NO: 380547 - DNA, 20 bp, human
gcagcttcttggatgctaca

SEQ ID NO: 380548 - DNA, 20 bp, human
gttccacttagtagtatctt

SEQ ID NO: 380549 - DNA, 20 bp, human
gtgccctggcaaaaagggag

SEQ ID NO: 380550 - DNA, 20 bp, human
gtgggtgtgagaaatgctct

SEQ ID NO: 380551 - DNA, 20 bp, human
ggaccccgggatgctgtcat

SEQ ID NO: 380552 - DNA, 20 bp, human
gtagtatcttaggccttcag

SEQ ID NO: 380553 - DNA, 20 bp, human
gccaagctaaaaccccttat

SEQ ID NO: 380554 - DNA, 20 bp, human
gtcttggatgctacagggcg

SEQ ID NO: 380555 - DNA, 20 bp, human
gaagtcacagacaccgaccc

SEQ ID NO: 380556 - DNA, 20 bp, human
gccgccccgcccctcgggac

SEQ ID NO: 380557 - DNA, 20 bp, human
gcctcgggacgggcgctaag

SEQ ID NO: 380558 - DNA, 20 bp, human
gggagtggagtggcgcagaa

SEQ ID NO: 380559 - DNA, 20 bp, human
gagcgcccgtcccgaggggc

SEQ ID NO: 380560 - DNA, 20 bp, human
gagaagggctgggcgcggag

SEQ ID NO: 380561 - DNA, 20 bp, human
gcgcggctcaggtacgcggg

SEQ ID NO: 380562 - DNA, 20 bp, human
gggacgggcgctaaggggcg

SEQ ID NO: 380563 - DNA, 20 bp, human
ggtaagtgatagggtagggg

SEQ ID NO: 380564 - DNA, 20 bp, human
gtggtgtgggagtgggtacg

SEQ ID NO: 380565 - DNA, 20 bp, human
gggggagggggtaagtgata

SEQ ID NO: 380566 - DNA, 20 bp, human
gagggcccagctgagaattc

SEQ ID NO: 380567 - DNA, 20 bp, human
gcgcgtccgaacagccctgc

SEQ ID NO: 380568 - DNA, 20 bp, human
ggtgggcgacaggctttgac

SEQ ID NO: 380569 - DNA, 20 bp, human
gcaccggggcgagggcaggt

SEQ ID NO: 380570 - DNA, 20 bp, human
gcagctgagaattcagggtt

SEQ ID NO: 380571 - DNA, 20 bp, human
gagggcggccggtaagaagg

SEQ ID NO: 380572 - DNA, 20 bp, human
gctcgaggcaagcccgggca

SEQ ID NO: 380573 - DNA, 20 bp, human
gagcgcgccgagacccctca

SEQ ID NO: 380574 - DNA, 20 bp, human
ggaaggttgaatccacgccc

SEQ ID NO: 380575 - DNA, 20 bp, human
ggggcgctcgaggcaagccc

SEQ ID NO: 380576 - DNA, 20 bp, human
gccccccggtcagaggtctg

SEQ ID NO: 380577 - DNA, 20 bp, human
gctggctgccccccggtcag

SEQ ID NO: 380578 - DNA, 20 bp, human
gtggaccccagacctctgac

SEQ ID NO: 380579 - DNA, 20 bp, human
gaccccagacctctgaccgg

SEQ ID NO: 380580 - DNA, 20 bp, human
gggacgccggacccagggca

SEQ ID NO: 380581 - DNA, 20 bp, human
gagagccaagactcactaat

SEQ ID NO: 380582 - DNA, 20 bp, human
ggggcagagggcaagtgcca

SEQ ID NO: 380583 - DNA, 20 bp, human
gggttggggtacctggacgc

SEQ ID NO: 380584 - DNA, 20 bp, human
gtcctggggtcaatgcctcc

SEQ ID NO: 380585 - DNA, 20 bp, human
gacctggaggcattgacccc

SEQ ID NO: 380586 - DNA, 20 bp, human
gttcccgccaggcgggcgtc

SEQ ID NO: 380587 - DNA, 20 bp, human
ggggatgtcccgatgcaata

SEQ ID NO: 380588 - DNA, 20 bp, human
gggtgaacgcgcagcaaaac

SEQ ID NO: 380589 - DNA, 20 bp, human
gccggctagagggtcgtgga

SEQ ID NO: 380590 - DNA, 20 bp, human
gaacccgccccgtgaggggg

SEQ ID NO: 380591 - DNA, 20 bp, human
ggggcgtcgggctagtgggc

SEQ ID NO: 380592 - DNA, 20 bp, human
gactgcagatcgctggtgag

SEQ ID NO: 380593 - DNA, 20 bp, human
gcgaaaacccgccccgtgag

SEQ ID NO: 380594 - DNA, 20 bp, human
ggcccgcctggcgggaacat

SEQ ID NO: 380595 - DNA, 20 bp, human
gtagcccgacgcccgcctgg

SEQ ID NO: 380596 - DNA, 20 bp, human
gggacagcaaggcccgaagc

SEQ ID NO: 380597 - DNA, 20 bp, human
gtcctggggcccggtcgctc

SEQ ID NO: 380598 - DNA, 20 bp, human
gctccctcgcggggtattgt

SEQ ID NO: 380599 - DNA, 20 bp, human
gcacgagtcactggcgacgg

SEQ ID NO: 380600 - DNA, 20 bp, human
ggtcccgcggcgtccttcgg

SEQ ID NO: 380601 - DNA, 20 bp, human
gccggggcgcctccctcgcg

SEQ ID NO: 380602 - DNA, 20 bp, human
gtgcgcgccgcgtggcgcct

SEQ ID NO: 380603 - DNA, 20 bp, human
ggagaagggagcagattcct

SEQ ID NO: 380604 - DNA, 20 bp, human
gctctgggaggggcgtgccc

SEQ ID NO: 380605 - DNA, 20 bp, human
gtcactggcgacggtgggtc

SEQ ID NO: 380606 - DNA, 20 bp, human
gccggccgatcgggcctcag

SEQ ID NO: 380607 - DNA, 20 bp, human
ggggccctgggaagcgttct

SEQ ID NO: 380608 - DNA, 20 bp, human
gagaggggaccctccaactc

SEQ ID NO: 380609 - DNA, 20 bp, human
gaggcccgatcggccggcgc

SEQ ID NO: 380610 - DNA, 20 bp, human
gccgcctcccaactgtgcgg

SEQ ID NO: 380611 - DNA, 20 bp, human
gcccctggaagggccggagt

SEQ ID NO: 380612 - DNA, 20 bp, human
gaagagagatttgggaagga

SEQ ID NO: 380613 - DNA, 20 bp, human
gtcccccggcgcccctggaa

SEQ ID NO: 380614 - DNA, 20 bp, human
gcagcctcgtccctcccctg

SEQ ID NO: 380615 - DNA, 20 bp, human
gggcgcccgagggtgtccca

SEQ ID NO: 380616 - DNA, 20 bp, human
gacaatgcctggtgtgtctc

SEQ ID NO: 380617 - DNA, 20 bp, human
ggtaactggggatctgagtt

SEQ ID NO: 380618 - DNA, 20 bp, human
gaacactagcaggcactagc

SEQ ID NO: 380619 - DNA, 20 bp, human
gactagatgcggaccgtctc

SEQ ID NO: 380620 - DNA, 20 bp, human
gggagaaagaggtggtacta

SEQ ID NO: 380621 - DNA, 20 bp, human
gacggtccgcatctagtctc

SEQ ID NO: 380622 - DNA, 20 bp, human
ggcagggccgcagatcaaag

SEQ ID NO: 380623 - DNA, 20 bp, human
gaggcactagcaggtggctg

SEQ ID NO: 380624 - DNA, 20 bp, human
gcagatcaaagtggtaactg

SEQ ID NO: 380625 - DNA, 20 bp, human
gactaggggaagtagcacag

SEQ ID NO: 380626 - DNA, 20 bp, human
gccccagcctccggtccctc

SEQ ID NO: 380627 - DNA, 20 bp, human
ggcgtcaggtaaagcaccta

SEQ ID NO: 380628 - DNA, 20 bp, human
ggtgtgtcaggcaagagcgg

SEQ ID NO: 380629 - DNA, 20 bp, human
gtccatccctgagggaccgg

SEQ ID NO: 380630 - DNA, 20 bp, human
gatggaaggtgaggtatgtc

SEQ ID NO: 380631 - DNA, 20 bp, human
gctccaaggtgaggtgtgtc

SEQ ID NO: 380632 - DNA, 20 bp, human
gccttccatccctgagggac

SEQ ID NO: 380633 - DNA, 20 bp, human
ggtgtagcaaagtggggtcg

SEQ ID NO: 380634 - DNA, 20 bp, human
gtgcctgacacacctcacct

SEQ ID NO: 380635 - DNA, 20 bp, human
gtgcgtttgtgtagcaaagt

SEQ ID NO: 380636 - DNA, 20 bp, human
gtggaggcccagtcagctta

SEQ ID NO: 380637 - DNA, 20 bp, human
gagtgtggagggcacagtca

SEQ ID NO: 380638 - DNA, 20 bp, human
ggggttcccctaagctgact

SEQ ID NO: 380639 - DNA, 20 bp, human
gacgtgagccagctgttccc

SEQ ID NO: 380640 - DNA, 20 bp, human
gagctgactgggcctccaag

SEQ ID NO: 380641 - DNA, 20 bp, human
gatgggcaggggccccaatt

SEQ ID NO: 380642 - DNA, 20 bp, human
gtgtgtgttcatgtaggtaa

SEQ ID NO: 380643 - DNA, 20 bp, human
gttcatgtaggtaaggggat

SEQ ID NO: 380644 - DNA, 20 bp, human
gggcacagtcagggccgaat

SEQ ID NO: 380645 - DNA, 20 bp, human
gttcaggcctctcagagcgc

SEQ ID NO: 380646 - DNA, 20 bp, human
ggaggtgggtcaggcaaggg

SEQ ID NO: 380647 - DNA, 20 bp, human
ggctggggacggtcggggtc

SEQ ID NO: 380648 - DNA, 20 bp, human
gcctcccggtccttcggggt

SEQ ID NO: 380649 - DNA, 20 bp, human
gcgggaggctggggacggtc

SEQ ID NO: 380650 - DNA, 20 bp, human
gccggtccttcggggttgga

SEQ ID NO: 380651 - DNA, 20 bp, human
gccagcctcccggtccttcg

SEQ ID NO: 380652 - DNA, 20 bp, human
ggcgccaggtaaagcacctg

SEQ ID NO: 380653 - DNA, 20 bp, human
ggtgtagcaaaggggggtca

SEQ ID NO: 380654 - DNA, 20 bp, human
gttggatggtgaggtgggtc

SEQ ID NO: 380655 - DNA, 20 bp, human
gcatctcacggcatcctcgc

SEQ ID NO: 380656 - DNA, 20 bp, human
ggaggtaagagggtacctgc

SEQ ID NO: 380657 - DNA, 20 bp, human
gagggcccagggaggtaaga

SEQ ID NO: 380658 - DNA, 20 bp, human
gaagagggtacctgctggag

SEQ ID NO: 380659 - DNA, 20 bp, human
ggtggggcggtggaactcct

SEQ ID NO: 380660 - DNA, 20 bp, human
gtggctggaagcggctggct

SEQ ID NO: 380661 - DNA, 20 bp, human
gggtaccctcttacctccct

SEQ ID NO: 380662 - DNA, 20 bp, human
gggctaggaggcggggcgtg

SEQ ID NO: 380663 - DNA, 20 bp, human
gtgggtctacgttatttcag

SEQ ID NO: 380664 - DNA, 20 bp, human
gaaaaggacaaaagggccca

SEQ ID NO: 380665 - DNA, 20 bp, human
ggagttgggcggtccagaag

SEQ ID NO: 380666 - DNA, 20 bp, human
gaatgggaaaggccccaatt

SEQ ID NO: 380667 - DNA, 20 bp, human
gggcagagcctgtcaggcaa

SEQ ID NO: 380668 - DNA, 20 bp, human
gggcccggccagggccgaat

SEQ ID NO: 380669 - DNA, 20 bp, human
ggagccagccattgcctgac

SEQ ID NO: 380670 - DNA, 20 bp, human
ggagcctgtcaggcaatggc

SEQ ID NO: 380671 - DNA, 20 bp, human
gaaaggccccaattcggccc

SEQ ID NO: 380672 - DNA, 20 bp, human
gttcatgtgggtgggggaat

SEQ ID NO: 380673 - DNA, 20 bp, human
ggcaggtccgtgaaagtacg

SEQ ID NO: 380674 - DNA, 20 bp, human
gcgctctgcgaagcctgaaa

SEQ ID NO: 380675 - DNA, 20 bp, human
gcagcgggctcacacggacg

SEQ ID NO: 380676 - DNA, 20 bp, human
gcagacggacagactagtga

SEQ ID NO: 380677 - DNA, 20 bp, human
ggctcctgacgcactttctg

SEQ ID NO: 380678 - DNA, 20 bp, human
gggtgctgagggcgctcaga

SEQ ID NO: 380679 - DNA, 20 bp, human
gggtccctccctgataacca

SEQ ID NO: 380680 - DNA, 20 bp, human
gtctctcgccccacagcacg

SEQ ID NO: 380681 - DNA, 20 bp, human
gacaaggtggattgtcaagt

SEQ ID NO: 380682 - DNA, 20 bp, human
ggtgacagggccccgtgctg

SEQ ID NO: 380683 - DNA, 20 bp, human
gggccaatagctctagaaga

SEQ ID NO: 380684 - DNA, 20 bp, human
ggcactttctgcgggtggga

SEQ ID NO: 380685 - DNA, 20 bp, human
gtggtctttgctaatcccac

SEQ ID NO: 380686 - DNA, 20 bp, human
gggtgtgtgtaacaaaggag

SEQ ID NO: 380687 - DNA, 20 bp, human
ggggaccaggaggttgcgga

SEQ ID NO: 380688 - DNA, 20 bp, human
gcgcaacctcctggtccctc

SEQ ID NO: 380689 - DNA, 20 bp, human
gaccaggaggttgcggaagg

SEQ ID NO: 380690 - DNA, 20 bp, human
gcctcctggtccctcgggga

SEQ ID NO: 380691 - DNA, 20 bp, human
gcccaccttccgcaacctcc

SEQ ID NO: 380692 - DNA, 20 bp, human
ggtgtgtaacaaaggagtgg

SEQ ID NO: 380693 - DNA, 20 bp, human
gggggtggctttctgatctc

SEQ ID NO: 380694 - DNA, 20 bp, human
gtggcctagctcccgtgacg

SEQ ID NO: 380695 - DNA, 20 bp, human
gcatccatccccgagggacc

SEQ ID NO: 380696 - DNA, 20 bp, human
gtggctgagaggcgattgga

SEQ ID NO: 380697 - DNA, 20 bp, human
gcagcgctgcagaagtggac

SEQ ID NO: 380698 - DNA, 20 bp, human
ggggtgggaggttggtaagc

SEQ ID NO: 380699 - DNA, 20 bp, human
gggagggaatggggtgaatt

SEQ ID NO: 380700 - DNA, 20 bp, human
gaagtggcgccttctccctg

SEQ ID NO: 380701 - DNA, 20 bp, human
gcccgggaatataaggactt

SEQ ID NO: 380702 - DNA, 20 bp, human
gaggcgccacttttgacctc

SEQ ID NO: 380703 - DNA, 20 bp, human
gctgagaggcgattggatgg

SEQ ID NO: 380704 - DNA, 20 bp, human
gaaaccagattggagggaat

SEQ ID NO: 380705 - DNA, 20 bp, human
gcttctgcagcgctgctggt

SEQ ID NO: 380706 - DNA, 20 bp, human
gggcgggctgcagtgttaat

SEQ ID NO: 380707 - DNA, 20 bp, human
gggctgcagtgttaatggga

SEQ ID NO: 380708 - DNA, 20 bp, human
gaaggcgaataaatactcca

SEQ ID NO: 380709 - DNA, 20 bp, human
gtcaagtggagggaacgcag

SEQ ID NO: 380710 - DNA, 20 bp, human
ggataggattccaggggaaa

SEQ ID NO: 380711 - DNA, 20 bp, human
gtgtaggggtcttggaggag

SEQ ID NO: 380712 - DNA, 20 bp, human
gtgttaatgggaggggtaac

SEQ ID NO: 380713 - DNA, 20 bp, human
gtggactgtaggggtcttgg

SEQ ID NO: 380714 - DNA, 20 bp, human
gaggggaaatggtggactgt

SEQ ID NO: 380715 - DNA, 20 bp, human
gggggctggaaaagaatcta

SEQ ID NO: 380716 - DNA, 20 bp, human
gtgcatgcgcgctagggaaa

SEQ ID NO: 380717 - DNA, 20 bp, human
gaccacgtgcgccggcctgt

SEQ ID NO: 380718 - DNA, 20 bp, human
gcgctcgcgcggcttcctag

SEQ ID NO: 380719 - DNA, 20 bp, human
gccggcctgtgggcttggat

SEQ ID NO: 380720 - DNA, 20 bp, human
gacccagtgcatgcgcgcta

SEQ ID NO: 380721 - DNA, 20 bp, human
gaggccggcgcacgtggtcc

SEQ ID NO: 380722 - DNA, 20 bp, human
gccgcgcgagcgcagtccca

SEQ ID NO: 380723 - DNA, 20 bp, human
gcgggactgggacaacgtca

SEQ ID NO: 380724 - DNA, 20 bp, human
gctagggaaatggctgccgt

SEQ ID NO: 380725 - DNA, 20 bp, human
gtccctagcgcgcatgcact

SEQ ID NO: 380726 - DNA, 20 bp, human
gggggcatgtagttctccgt

SEQ ID NO: 380727 - DNA, 20 bp, human
gggagctgaagtgacagcgg

SEQ ID NO: 380728 - DNA, 20 bp, human
gaccgtgcgcctcccgccta

SEQ ID NO: 380729 - DNA, 20 bp, human
gactacgaacttcttctcct

SEQ ID NO: 380730 - DNA, 20 bp, human
gcgggcggaaggcgcgctga

SEQ ID NO: 380731 - DNA, 20 bp, human
ggccccagcctgccccgcga

SEQ ID NO: 380732 - DNA, 20 bp, human
gcaagcgttagcgcgaagcg

SEQ ID NO: 380733 - DNA, 20 bp, human
gaggaggcggcagtttctgg

SEQ ID NO: 380734 - DNA, 20 bp, human
ggcggaagcaacggtcggtg

SEQ ID NO: 380735 - DNA, 20 bp, human
gttcgcgctaacgcttgcga

SEQ ID NO: 380736 - DNA, 20 bp, human
gactcccgagagcctctcta

SEQ ID NO: 380737 - DNA, 20 bp, human
ggggagatccgtacctggtg

SEQ ID NO: 380738 - DNA, 20 bp, human
ggctacgccctacctccaga

SEQ ID NO: 380739 - DNA, 20 bp, human
gtactataggggaaaagagt

SEQ ID NO: 380740 - DNA, 20 bp, human
gagggtctgcgctgcatgct

SEQ ID NO: 380741 - DNA, 20 bp, human
gagaagagctagactcggat

SEQ ID NO: 380742 - DNA, 20 bp, human
gcatccttagagaggctctc

SEQ ID NO: 380743 - DNA, 20 bp, human
gataggctggcctactatag

SEQ ID NO: 380744 - DNA, 20 bp, human
gtcccgcgcgtcgccgaaag

SEQ ID NO: 380745 - DNA, 20 bp, human
gtcacttccgtctggaggta

SEQ ID NO: 380746 - DNA, 20 bp, human
gtggaagcgggcggtatcga

SEQ ID NO: 380747 - DNA, 20 bp, human
gcgtgcggccgccatcccga

SEQ ID NO: 380748 - DNA, 20 bp, human
gcggagcctgcccaagatgg

SEQ ID NO: 380749 - DNA, 20 bp, human
gggcggtatcgaggggcgtg

SEQ ID NO: 380750 - DNA, 20 bp, human
gcggccgccatcccgacggc

SEQ ID NO: 380751 - DNA, 20 bp, human
ggccatgcccgccgtcggga

SEQ ID NO: 380752 - DNA, 20 bp, human
gtggcccgggcgaactcctt

SEQ ID NO: 380753 - DNA, 20 bp, human
gtgggcaggctccgcatttg

SEQ ID NO: 380754 - DNA, 20 bp, human
gccgccggaccgcaccaaca

SEQ ID NO: 380755 - DNA, 20 bp, human
gccctctgccagtcccaaga

SEQ ID NO: 380756 - DNA, 20 bp, human
gtccgccggggatgcacgga

SEQ ID NO: 380757 - DNA, 20 bp, human
gagcgcgcacacttgggcca

SEQ ID NO: 380758 - DNA, 20 bp, human
gcccccacacaccccagccg

SEQ ID NO: 380759 - DNA, 20 bp, human
gcacgcgagcacagggagcg

SEQ ID NO: 380760 - DNA, 20 bp, human
ggcccccagcgcgcacactt

SEQ ID NO: 380761 - DNA, 20 bp, human
ggagtgcgcggccgccgggt

SEQ ID NO: 380762 - DNA, 20 bp, human
ggccctccgtgcatccccgg

SEQ ID NO: 380763 - DNA, 20 bp, human
gcgcgcttccgtctccgccg

SEQ ID NO: 380764 - DNA, 20 bp, human
gtgggctcgcgtcgcgtcct

SEQ ID NO: 380765 - DNA, 20 bp, human
gcagggagcgggggtgccgg

SEQ ID NO: 380766 - DNA, 20 bp, human
gtggaacctgcgaacatgga

SEQ ID NO: 380767 - DNA, 20 bp, human
gccaagagctaagagggtca

SEQ ID NO: 380768 - DNA, 20 bp, human
gacaatgcagacaatcggga

SEQ ID NO: 380769 - DNA, 20 bp, human
ggacggcatgagtacgtatg

SEQ ID NO: 380770 - DNA, 20 bp, human
gcatcccaggctgacactca

SEQ ID NO: 380771 - DNA, 20 bp, human
gcagcacaatgcagacaatc

SEQ ID NO: 380772 - DNA, 20 bp, human
ggatgtggaacctgcgaaca

SEQ ID NO: 380773 - DNA, 20 bp, human
gtaggactgatgttgtgtga

SEQ ID NO: 380774 - DNA, 20 bp, human
gttaacctaatcaacctctg

SEQ ID NO: 380775 - DNA, 20 bp, human
gacacagactgaatcttctt

SEQ ID NO: 380776 - DNA, 20 bp, human
gagaagggtcttgatgctga

SEQ ID NO: 380777 - DNA, 20 bp, human
gcttgatgctgatggagccg

SEQ ID NO: 380778 - DNA, 20 bp, human
ggctgatggagccgaggttg

SEQ ID NO: 380779 - DNA, 20 bp, human
ggtattttactcctcaacct

SEQ ID NO: 380780 - DNA, 20 bp, human
gtggaagctgggtacatgga

SEQ ID NO: 380781 - DNA, 20 bp, human
gtacccagcttccacatctg

SEQ ID NO: 380782 - DNA, 20 bp, human
gtggcgtggaccgccccgat

SEQ ID NO: 380783 - DNA, 20 bp, human
gcgccccgattggctgcgtt

SEQ ID NO: 380784 - DNA, 20 bp, human
ggtggactgctgtgccccgc

SEQ ID NO: 380785 - DNA, 20 bp, human
gtgtgccccgcggggtcatt

SEQ ID NO: 380786 - DNA, 20 bp, human
gagaagggtcttgatgctga

SEQ ID NO: 380787 - DNA, 20 bp, human
ggctgatggagccgaggttg

SEQ ID NO: 380788 - DNA, 20 bp, human
gcttgatgctgatggagccg

SEQ ID NO: 380789 - DNA, 20 bp, human
ggtattttactcctcaacct

SEQ ID NO: 380790 - DNA, 20 bp, human
gtggaagctgggtacatgga

SEQ ID NO: 380791 - DNA, 20 bp, human
gtacccagcttccacatctg

SEQ ID NO: 380792 - DNA, 20 bp, human
gtggcgtggaccgccccgat

SEQ ID NO: 380793 - DNA, 20 bp, human
gcgccccgattggctgcgtt

SEQ ID NO: 380794 - DNA, 20 bp, human
ggctcaagccctgacccccc

SEQ ID NO: 380795 - DNA, 20 bp, human
gacacagagagaatcttctt

SEQ ID NO: 380796 - DNA, 20 bp, human
gggatgacaactctttacct

SEQ ID NO: 380797 - DNA, 20 bp, human
gtaagggagagagaggaaac

SEQ ID NO: 380798 - DNA, 20 bp, human
gagaagggtcttgatgctga

SEQ ID NO: 380799 - DNA, 20 bp, human
gcttgatgctgatggagccg

SEQ ID NO: 380800 - DNA, 20 bp, human
ggctgatggagccgaggttg

SEQ ID NO: 380801 - DNA, 20 bp, human
ggtattttactcctcaacct

SEQ ID NO: 380802 - DNA, 20 bp, human
gctcacacaacgtcaatccc

SEQ ID NO: 380803 - DNA, 20 bp, human
gtggaagctgggtacatgga

SEQ ID NO: 380804 - DNA, 20 bp, human
gtacccagcttccacatctg

SEQ ID NO: 380805 - DNA, 20 bp, human
gtggcgtggaccgccccgat

SEQ ID NO: 380806 - DNA, 20 bp, human
gcgcccgccgactttgaaag

SEQ ID NO: 380807 - DNA, 20 bp, human
gcagttgattggtgactcgg

SEQ ID NO: 380808 - DNA, 20 bp, human
gccgacccgacgtctcctat

SEQ ID NO: 380809 - DNA, 20 bp, human
gaaccgccggcgccctctcg

SEQ ID NO: 380810 - DNA, 20 bp, human
gataccgctttcaaagtcgg

SEQ ID NO: 380811 - DNA, 20 bp, human
gcgtcaatccccaacgagag

SEQ ID NO: 380812 - DNA, 20 bp, human
gcccccatttcgaagattga

SEQ ID NO: 380813 - DNA, 20 bp, human
gtggccagtagtagctcagg

SEQ ID NO: 380814 - DNA, 20 bp, human
ggcggtagccacgtgtctgt

SEQ ID NO: 380815 - DNA, 20 bp, human
gatgaagacagccagttgat

SEQ ID NO: 380816 - DNA, 20 bp, human
gcggccgcggaggacgtggg

SEQ ID NO: 380817 - DNA, 20 bp, human
ggggacccagcgcaccgcga

SEQ ID NO: 380818 - DNA, 20 bp, human
gccgctgcgcccctggaccc

SEQ ID NO: 380819 - DNA, 20 bp, human
ggagccaagtgagttcgctc

SEQ ID NO: 380820 - DNA, 20 bp, human
ggctccggagcgaactcact

SEQ ID NO: 380821 - DNA, 20 bp, human
ggccgtcagcgcggggatgt

SEQ ID NO: 380822 - DNA, 20 bp, human
ggggcggccgcggaggacgt

SEQ ID NO: 380823 - DNA, 20 bp, human
gctgcgcccctggacccggg

SEQ ID NO: 380824 - DNA, 20 bp, human
ggaggaggagcttcccgcgc

SEQ ID NO: 380825 - DNA, 20 bp, human
gagcttcccgcgcggggcag

SEQ ID NO: 380826 - DNA, 20 bp, human
gggcccggacgaggcttcgt

SEQ ID NO: 380827 - DNA, 20 bp, human
gggagggaagggttaacccg

SEQ ID NO: 380828 - DNA, 20 bp, human
gctcccaggaggcccggacg

SEQ ID NO: 380829 - DNA, 20 bp, human
gactgggaggagccgcaccg

SEQ ID NO: 380830 - DNA, 20 bp, human
gggggcggggaggagctgtc

SEQ ID NO: 380831 - DNA, 20 bp, human
gcgccgacgaagcctcgtcc

SEQ ID NO: 380832 - DNA, 20 bp, human
gggccccacttcctaggcgg

SEQ ID NO: 380833 - DNA, 20 bp, human
ggggtgaggcgggacggagt

SEQ ID NO: 380834 - DNA, 20 bp, human
gttgtccacccgccgcggtg

SEQ ID NO: 380835 - DNA, 20 bp, human
gctccgccgcctaggaagtg

SEQ ID NO: 380836 - DNA, 20 bp, human
gcaagtccttgcattggtgg

SEQ ID NO: 380837 - DNA, 20 bp, human
gcatcaagtccttgcattgg

SEQ ID NO: 380838 - DNA, 20 bp, human
gccaactcacagagcacaga

SEQ ID NO: 380839 - DNA, 20 bp, human
gggtatcctccaccaatgca

SEQ ID NO: 380840 - DNA, 20 bp, human
gacaaatctaataatttctt

SEQ ID NO: 380841 - DNA, 20 bp, human
ggctggaggtgtagcaagct

SEQ ID NO: 380842 - DNA, 20 bp, human
gaattaaattagagcacttg

SEQ ID NO: 380843 - DNA, 20 bp, human
gtggcagatggtaacgctgg

SEQ ID NO: 380844 - DNA, 20 bp, human
gacctcaaattttgtcttat

SEQ ID NO: 380845 - DNA, 20 bp, human
gttaagaggtatttgcatga

SEQ ID NO: 380846 - DNA, 20 bp, human
gtccgccgcgccctggccaa

SEQ ID NO: 380847 - DNA, 20 bp, human
gcccgggccgctttcaacct

SEQ ID NO: 380848 - DNA, 20 bp, human
gggcccctccctcgcctata

SEQ ID NO: 380849 - DNA, 20 bp, human
ggcaaggccgccccggccgg

SEQ ID NO: 380850 - DNA, 20 bp, human
gccgtcccccaggttgaaag

SEQ ID NO: 380851 - DNA, 20 bp, human
ggcccccgccttataggcga

SEQ ID NO: 380852 - DNA, 20 bp, human
ggggctagccagccgggaac

SEQ ID NO: 380853 - DNA, 20 bp, human
gaaagcggcccgggagccgg

SEQ ID NO: 380854 - DNA, 20 bp, human
gccgccggcccccgccttat

SEQ ID NO: 380855 - DNA, 20 bp, human
ggcggtgggagcgtcgccat

SEQ ID NO: 380856 - DNA, 20 bp, human
gtggaaggcgggagatcttg

SEQ ID NO: 380857 - DNA, 20 bp, human
gcggaagagaacacatgagc

SEQ ID NO: 380858 - DNA, 20 bp, human
gggggcgctgtccaatggcg

SEQ ID NO: 380859 - DNA, 20 bp, human
gcagtgaggaggagccgcct

SEQ ID NO: 380860 - DNA, 20 bp, human
gtgagctggccaatcgggaa

SEQ ID NO: 380861 - DNA, 20 bp, human
gcccccgtgccgttcccgat

SEQ ID NO: 380862 - DNA, 20 bp, human
gtcggagcatctccgcgccc

SEQ ID NO: 380863 - DNA, 20 bp, human
gttgggcccactaaatgcgt

SEQ ID NO: 380864 - DNA, 20 bp, human
gcttgcgcaggcgcggtcag

SEQ ID NO: 380865 - DNA, 20 bp, human
ggagcatctccgcgcccagg

SEQ ID NO: 380866 - DNA, 20 bp, human
gggaagcgaacttaagccag

SEQ ID NO: 380867 - DNA, 20 bp, human
ggcaccacctcttccacttc

SEQ ID NO: 380868 - DNA, 20 bp, human
gctcaagtttgcatcagact

SEQ ID NO: 380869 - DNA, 20 bp, human
gagccagcggtgcgtggccc

SEQ ID NO: 380870 - DNA, 20 bp, human
gatgcgcagcagttggaagc

SEQ ID NO: 380871 - DNA, 20 bp, human
gtgaggatccagctcaagtg

SEQ ID NO: 380872 - DNA, 20 bp, human
gaacttaagccagcggtgcg

SEQ ID NO: 380873 - DNA, 20 bp, human
ggccccctatgcgcagcagt

SEQ ID NO: 380874 - DNA, 20 bp, human
ggttggaagcagggcagcat

SEQ ID NO: 380875 - DNA, 20 bp, human
gtggatgcctgaagtggaag

SEQ ID NO: 380876 - DNA, 20 bp, human
gggggtccatagctctgcac

SEQ ID NO: 380877 - DNA, 20 bp, human
ggccaaagctgctcccctgg

SEQ ID NO: 380878 - DNA, 20 bp, human
gccccccaggggagcagctt

SEQ ID NO: 380879 - DNA, 20 bp, human
gcagagctatggaccccccc

SEQ ID NO: 380880 - DNA, 20 bp, human
gcccacagcctcctcagcga

SEQ ID NO: 380881 - DNA, 20 bp, human
ggcccagaaggccttcgctg

SEQ ID NO: 380882 - DNA, 20 bp, human
gtcctcagcgaaggccttct

SEQ ID NO: 380883 - DNA, 20 bp, human
ggctacccacaggaggtaca

SEQ ID NO: 380884 - DNA, 20 bp, human
gcagctttggcaatcagtat

SEQ ID NO: 380885 - DNA, 20 bp, human
ggcaatcagtatgggagtga

SEQ ID NO: 380886 - DNA, 20 bp, human
gcccggccacagttgggaga

SEQ ID NO: 380887 - DNA, 20 bp, human
gctcggccccggccacagtt

SEQ ID NO: 380888 - DNA, 20 bp, human
gagacccctttcacaaccgg

SEQ ID NO: 380889 - DNA, 20 bp, human
gacatgctgcttctcggccc

SEQ ID NO: 380890 - DNA, 20 bp, human
gagccaccttctcccaactg

SEQ ID NO: 380891 - DNA, 20 bp, human
gtctcttaagacgtcacaac

SEQ ID NO: 380892 - DNA, 20 bp, human
gcggggaaggtggaagatct

SEQ ID NO: 380893 - DNA, 20 bp, human
gtttccctccggttgtgaaa

SEQ ID NO: 380894 - DNA, 20 bp, human
gagatcgtttggctctttct

SEQ ID NO: 380895 - DNA, 20 bp, human
gaatttatctggggaataga

SEQ ID NO: 380896 - DNA, 20 bp, human
gaagaaggcaggaggatagt

SEQ ID NO: 380897 - DNA, 20 bp, human
gaggaggcccatgctgaaga

SEQ ID NO: 380898 - DNA, 20 bp, human
gctcaacagtggtcctatgg

SEQ ID NO: 380899 - DNA, 20 bp, human
gaacctcaacagtggtccta

SEQ ID NO: 380900 - DNA, 20 bp, human
gggagcaaacaggactgagt

SEQ ID NO: 380901 - DNA, 20 bp, human
ggaagtcacaggtccaccat

SEQ ID NO: 380902 - DNA, 20 bp, human
gggagtggccaagccttggg

SEQ ID NO: 380903 - DNA, 20 bp, human
ggctggaggaaggtattctg

SEQ ID NO: 380904 - DNA, 20 bp, human
gaggcggaggcttttcgcgg

SEQ ID NO: 380905 - DNA, 20 bp, human
gccactgttgaggttaggca

SEQ ID NO: 380906 - DNA, 20 bp, human
gccccgaggcgcctcgctga

SEQ ID NO: 380907 - DNA, 20 bp, human
ggcggcgtgtggagagtttg

SEQ ID NO: 380908 - DNA, 20 bp, human
gaagcggcctggaatcagac

SEQ ID NO: 380909 - DNA, 20 bp, human
ggcagcgcgaggttaaccac

SEQ ID NO: 380910 - DNA, 20 bp, human
gtaaccacaggcctcacccg

SEQ ID NO: 380911 - DNA, 20 bp, human
gaggcgggaacgctgcagtt

SEQ ID NO: 380912 - DNA, 20 bp, human
gctgggcaccggcctggaag

SEQ ID NO: 380913 - DNA, 20 bp, human
gtggaatcagactggactcg

SEQ ID NO: 380914 - DNA, 20 bp, human
gtctgccgccggctgcggtg

SEQ ID NO: 380915 - DNA, 20 bp, human
gaggcagtgagccgaggggc

SEQ ID NO: 380916 - DNA, 20 bp, human
gcctgcgcgtcgcggctctc

SEQ ID NO: 380917 - DNA, 20 bp, human
gcagacgccgccgctgaagc

SEQ ID NO: 380918 - DNA, 20 bp, human
gtcagcggcggcgtctgggc

SEQ ID NO: 380919 - DNA, 20 bp, human
gctgcggcgcctgcgcgtcg

SEQ ID NO: 380920 - DNA, 20 bp, human
gtctgcgcgccgtgcgcacc

SEQ ID NO: 380921 - DNA, 20 bp, human
gactcttggcgcgaggggtg

SEQ ID NO: 380922 - DNA, 20 bp, human
gggtgccccgcggggatgac

SEQ ID NO: 380923 - DNA, 20 bp, human
gcgcctgcgcactcttcgcg

SEQ ID NO: 380924 - DNA, 20 bp, human
gacccagctctccagagacc

SEQ ID NO: 380925 - DNA, 20 bp, human
gcactcttcgcgcggggtcg

SEQ ID NO: 380926 - DNA, 20 bp, human
gcccaggctctggacctcac

SEQ ID NO: 380927 - DNA, 20 bp, human
gtgctcgagaggccgagcta

SEQ ID NO: 380928 - DNA, 20 bp, human
gcctcacgagggtgctcgag

SEQ ID NO: 380929 - DNA, 20 bp, human
gacggcgcggggagaaatca

SEQ ID NO: 380930 - DNA, 20 bp, human
ggtggcggagggatccgcgt

SEQ ID NO: 380931 - DNA, 20 bp, human
gggaagccgcgaaagtctga

SEQ ID NO: 380932 - DNA, 20 bp, human
ggaggaccccgaatcccgtg

SEQ ID NO: 380933 - DNA, 20 bp, human
gggcggggcctcaccacgaa

SEQ ID NO: 380934 - DNA, 20 bp, human
ggggcccgaacgccctagct

SEQ ID NO: 380935 - DNA, 20 bp, human
gcggatccctccgccacctc

SEQ ID NO: 380936 - DNA, 20 bp, human
gcatcctagcctgcccgacc

SEQ ID NO: 380937 - DNA, 20 bp, human
gccctcggggtgggtgcgag

SEQ ID NO: 380938 - DNA, 20 bp, human
ggcaagtcgcgtctccccgc

SEQ ID NO: 380939 - DNA, 20 bp, human
gtgcccgttgcatccctcgg

SEQ ID NO: 380940 - DNA, 20 bp, human
ggacttgctccgggtcgggc

SEQ ID NO: 380941 - DNA, 20 bp, human
gggggagacgcgacttgctc

SEQ ID NO: 380942 - DNA, 20 bp, human
gcagcaaagaaatgggtggg

SEQ ID NO: 380943 - DNA, 20 bp, human
gtgcctccgagggatgcaac

SEQ ID NO: 380944 - DNA, 20 bp, human
ggggagggggaaacacgccg

SEQ ID NO: 380945 - DNA, 20 bp, human
gcctccccggagaagagagt

SEQ ID NO: 380946 - DNA, 20 bp, human
gcggaagagcgagcccttta

SEQ ID NO: 380947 - DNA, 20 bp, human
ggacccccgccctccacagc

SEQ ID NO: 380948 - DNA, 20 bp, human
gaggccgggacgcgcccact

SEQ ID NO: 380949 - DNA, 20 bp, human
gccactcggcatagccttaa

SEQ ID NO: 380950 - DNA, 20 bp, human
gaggaggcggcagaacccag

SEQ ID NO: 380951 - DNA, 20 bp, human
gtggcgggtcggaacatcaa

SEQ ID NO: 380952 - DNA, 20 bp, human
gtctctctcagggtgcgctc

SEQ ID NO: 380953 - DNA, 20 bp, human
gttgtccgacgtctctctca

SEQ ID NO: 380954 - DNA, 20 bp, human
ggcctctcccgggagaggag

SEQ ID NO: 380955 - DNA, 20 bp, human
gcgcaccctgagagagacgt

SEQ ID NO: 380956 - DNA, 20 bp, human
gcgcgcgcaccgcagctctc

SEQ ID NO: 380957 - DNA, 20 bp, human
gcgcggaacccggagagctg

SEQ ID NO: 380958 - DNA, 20 bp, human
ggggtgtcagcttgcagccg

SEQ ID NO: 380959 - DNA, 20 bp, human
gcgcccgcgcgccgatacgg

SEQ ID NO: 380960 - DNA, 20 bp, human
gaacctgcgcggagttctgg

SEQ ID NO: 380961 - DNA, 20 bp, human
gctgacacccgcgcgcctcg

SEQ ID NO: 380962 - DNA, 20 bp, human
gccgcgcgcctcgcggaacc

SEQ ID NO: 380963 - DNA, 20 bp, human
gccgtggggagggccgccga

SEQ ID NO: 380964 - DNA, 20 bp, human
gagggtgcagtgtgaggcgc

SEQ ID NO: 380965 - DNA, 20 bp, human
gcatcagctcgcgcactcgg

SEQ ID NO: 380966 - DNA, 20 bp, human
ggaacggagtagtctgggag

SEQ ID NO: 380967 - DNA, 20 bp, human
ggaagccggggggagacgga

SEQ ID NO: 380968 - DNA, 20 bp, human
gcggaggaacggagtagtct

SEQ ID NO: 380969 - DNA, 20 bp, human
ggggagcggagattattgac

SEQ ID NO: 380970 - DNA, 20 bp, human
gagcccgggattctgggcga

SEQ ID NO: 380971 - DNA, 20 bp, human
gccctctcccggcgcccgaa

SEQ ID NO: 380972 - DNA, 20 bp, human
gacggagggaggagtgtgca

SEQ ID NO: 380973 - DNA, 20 bp, human
gaaaaagggggatcgaaatc

SEQ ID NO: 380974 - DNA, 20 bp, human
gagacaatgcggggtgggag

SEQ ID NO: 380975 - DNA, 20 bp, human
gcggggaagccggggggaga

SEQ ID NO: 380976 - DNA, 20 bp, human
gagcatccgccgacgtgggg

SEQ ID NO: 380977 - DNA, 20 bp, human
gcctacgcggtgacaccctg

SEQ ID NO: 380978 - DNA, 20 bp, human
gtcggcggatgcttgcgcgg

SEQ ID NO: 380979 - DNA, 20 bp, human
gcgcaagcatccgccgacgt

SEQ ID NO: 380980 - DNA, 20 bp, human
gccctcgccgggcctcagcg

SEQ ID NO: 380981 - DNA, 20 bp, human
ggccgggcgtgcgggcggtt

SEQ ID NO: 380982 - DNA, 20 bp, human
gaaccgggcgtggcctgagc

SEQ ID NO: 380983 - DNA, 20 bp, human
gcggacgtggcttctcccca

SEQ ID NO: 380984 - DNA, 20 bp, human
gaatcagcgtgatacctacg

SEQ ID NO: 380985 - DNA, 20 bp, human
gaggggcgtggctgggaacc

SEQ ID NO: 380986 - DNA, 20 bp, human
gtaccagccccacctaacat

SEQ ID NO: 380987 - DNA, 20 bp, human
gaaggagacacccactctgt

SEQ ID NO: 380988 - DNA, 20 bp, human
gccacctctgtctccacaaa

SEQ ID NO: 380989 - DNA, 20 bp, human
gagacacccactctgtggga

SEQ ID NO: 380990 - DNA, 20 bp, human
gaagccatttgtggagacag

SEQ ID NO: 380991 - DNA, 20 bp, human
gtaccctcccatgttaggtg

SEQ ID NO: 380992 - DNA, 20 bp, human
gtggtaccctgactgtcagg

SEQ ID NO: 380993 - DNA, 20 bp, human
gagccccacctaacatggga

SEQ ID NO: 380994 - DNA, 20 bp, human
gtcaggccatcccacagagt

SEQ ID NO: 380995 - DNA, 20 bp, human
gagcagttgcttcaattcta

SEQ ID NO: 380996 - DNA, 20 bp, human
ggagcaggggagactggatt

SEQ ID NO: 380997 - DNA, 20 bp, human
gttaagaaggagacaccctc

SEQ ID NO: 380998 - DNA, 20 bp, human
gcaggggagactggatttgg

SEQ ID NO: 380999 - DNA, 20 bp, human
gtcaggtcattagacccaga

SEQ ID NO: 381000 - DNA, 20 bp, human
gtgacccaaacctgagagat

SEQ ID NO: 381001 - DNA, 20 bp, human
ggacacccatctctcaggtt

SEQ ID NO: 381002 - DNA, 20 bp, human
gacaaatcatagtgctggca

SEQ ID NO: 381003 - DNA, 20 bp, human
gaggaatcagatgacttatg

SEQ ID NO: 381004 - DNA, 20 bp, human
gcaaatacgggccatcttgt

SEQ ID NO: 381005 - DNA, 20 bp, human
gaggctcttcaaggtagtgt

SEQ ID NO: 381006 - DNA, 20 bp, human
ggctccctacgcgctgaagg

SEQ ID NO: 381007 - DNA, 20 bp, human
gccggcaacgagcccgacga

SEQ ID NO: 381008 - DNA, 20 bp, human
gggaagagaatgtaagtcag

SEQ ID NO: 381009 - DNA, 20 bp, human
gcgacgacggagcgtcgcaa

SEQ ID NO: 381010 - DNA, 20 bp, human
gaatacgtgtagtgcatgga

SEQ ID NO: 381011 - DNA, 20 bp, human
ggaaccggggcggcagtcag

SEQ ID NO: 381012 - DNA, 20 bp, human
ggggagcctgtgtttttctc

SEQ ID NO: 381013 - DNA, 20 bp, human
gtatctcccgctggccacga

SEQ ID NO: 381014 - DNA, 20 bp, human
gtaccatcacgtgaaggtga

SEQ ID NO: 381015 - DNA, 20 bp, human
gaagcctccttcagcgcgta

SEQ ID NO: 381016 - DNA, 20 bp, human
gagtccaggaagtctgggag

SEQ ID NO: 381017 - DNA, 20 bp, human
ggaggcgcttaatcccggag

SEQ ID NO: 381018 - DNA, 20 bp, human
gtctgggagaggttgagccc

SEQ ID NO: 381019 - DNA, 20 bp, human
ggtcctgaggcgcttaatcc

SEQ ID NO: 381020 - DNA, 20 bp, human
gctgcccggaaaggagtgag

SEQ ID NO: 381021 - DNA, 20 bp, human
gcggagctgcccctgcatcg

SEQ ID NO: 381022 - DNA, 20 bp, human
gaggctgtggcctggcggac

SEQ ID NO: 381023 - DNA, 20 bp, human
gcaaccgcgcgcgtctatgc

SEQ ID NO: 381024 - DNA, 20 bp, human
gctcaggcccagctcaggat

SEQ ID NO: 381025 - DNA, 20 bp, human
ggggccagcatagacgcgcg

SEQ ID NO: 381026 - DNA, 20 bp, human
gcggggcgtaaggcaggatg

SEQ ID NO: 381027 - DNA, 20 bp, human
gttggggcggggcgtaaggc

SEQ ID NO: 381028 - DNA, 20 bp, human
gctggccggggcctcgagga

SEQ ID NO: 381029 - DNA, 20 bp, human
ggggtcgggagaacgacctt

SEQ ID NO: 381030 - DNA, 20 bp, human
gaggatggggcggggtttgt

SEQ ID NO: 381031 - DNA, 20 bp, human
gggaaggcgcgggccagctg

SEQ ID NO: 381032 - DNA, 20 bp, human
ggggcgggaggacggccttg

SEQ ID NO: 381033 - DNA, 20 bp, human
gtgcggccgccaccaagcgg

SEQ ID NO: 381034 - DNA, 20 bp, human
gggagaacgaccttggggcg

SEQ ID NO: 381035 - DNA, 20 bp, human
gccgcgcaggcgctacgtcc

SEQ ID NO: 381036 - DNA, 20 bp, human
gtgggggcggggccagtcgg

SEQ ID NO: 381037 - DNA, 20 bp, human
gaatggagcagctccggcgt

SEQ ID NO: 381038 - DNA, 20 bp, human
ggctgctggaggcaaaaggg

SEQ ID NO: 381039 - DNA, 20 bp, human
gggagttaggaacccggcct

SEQ ID NO: 381040 - DNA, 20 bp, human
gcaggcctctgcaaggaatt

SEQ ID NO: 381041 - DNA, 20 bp, human
gtccttaaatggagcagctc

SEQ ID NO: 381042 - DNA, 20 bp, human
gagcagcggagttaggaacc

SEQ ID NO: 381043 - DNA, 20 bp, human
ggccaaagagcagcggagtt

SEQ ID NO: 381044 - DNA, 20 bp, human
gggcaaaagggcggctcccg

SEQ ID NO: 381045 - DNA, 20 bp, human
gaaaaaagcaacctgcagca

SEQ ID NO: 381046 - DNA, 20 bp, human
ggacttgaaggatgtggtta

SEQ ID NO: 381047 - DNA, 20 bp, human
gaaacccgaaggtttaggac

SEQ ID NO: 381048 - DNA, 20 bp, human
ggaagaagacttgaaggatg

SEQ ID NO: 381049 - DNA, 20 bp, human
ggatgtggttagggagaata

SEQ ID NO: 381050 - DNA, 20 bp, human
gggtttaggacaggagacaa

SEQ ID NO: 381051 - DNA, 20 bp, human
gggctgaggcaacctgaagg

SEQ ID NO: 381052 - DNA, 20 bp, human
ggcaaatattgagcaatgtc

SEQ ID NO: 381053 - DNA, 20 bp, human
gatatgaaacccgaaggttt

SEQ ID NO: 381054 - DNA, 20 bp, human
ggtctcctgtcctaaacctt

SEQ ID NO: 381055 - DNA, 20 bp, human
gagaggctgaggcaacctga

SEQ ID NO: 381056 - DNA, 20 bp, human
ggtccccccagctgttccag

SEQ ID NO: 381057 - DNA, 20 bp, human
ggctaggtgggcactaccag

SEQ ID NO: 381058 - DNA, 20 bp, human
gagcccgggaccagcgcaga

SEQ ID NO: 381059 - DNA, 20 bp, human
gagcagccctcctggaggta

SEQ ID NO: 381060 - DNA, 20 bp, human
ggaagctgcgtctctcggag

SEQ ID NO: 381061 - DNA, 20 bp, human
ggggaaggtctgtggtggcg

SEQ ID NO: 381062 - DNA, 20 bp, human
gggccctctgcgctggtccc

SEQ ID NO: 381063 - DNA, 20 bp, human
gggcgggggaaggtctgtgg

SEQ ID NO: 381064 - DNA, 20 bp, human
ggcacggctaagtctgcaga

SEQ ID NO: 381065 - DNA, 20 bp, human
gggtcccgggctctttaagc

SEQ ID NO: 381066 - DNA, 20 bp, human
gccgcccctcaaggcgaagg

SEQ ID NO: 381067 - DNA, 20 bp, human
ggccccgcccctcaaggcga

SEQ ID NO: 381068 - DNA, 20 bp, human
ggagcatgcggggctagaca

SEQ ID NO: 381069 - DNA, 20 bp, human
gcccgcatgctccgcgccaa

SEQ ID NO: 381070 - DNA, 20 bp, human
gggaaacgtagtcccctctc

SEQ ID NO: 381071 - DNA, 20 bp, human
gagggacccgcccccggggc

SEQ ID NO: 381072 - DNA, 20 bp, human
gtccgcccccttcgccttga

SEQ ID NO: 381073 - DNA, 20 bp, human
gacctcgcgcgccacacttc

SEQ ID NO: 381074 - DNA, 20 bp, human
gcatgctccgcgccaatggg

SEQ ID NO: 381075 - DNA, 20 bp, human
gaagtggcgggcggggacta

SEQ ID NO: 381076 - DNA, 20 bp, human
ggagagaaacaggactgtga

SEQ ID NO: 381077 - DNA, 20 bp, human
ggatgggaagggcgcgaaag

SEQ ID NO: 381078 - DNA, 20 bp, human
ggagaacggaagtcggatgt

SEQ ID NO: 381079 - DNA, 20 bp, human
gaagtgaggctccggggaag

SEQ ID NO: 381080 - DNA, 20 bp, human
ggaaagcggagaacggaagt

SEQ ID NO: 381081 - DNA, 20 bp, human
gagggcgcgaaagcggagaa

SEQ ID NO: 381082 - DNA, 20 bp, human
gtgtgacggaagtgaggctc

SEQ ID NO: 381083 - DNA, 20 bp, human
gagctggggtgtaactggag

SEQ ID NO: 381084 - DNA, 20 bp, human
gcaggactgtgacggaagtg

SEQ ID NO: 381085 - DNA, 20 bp, human
gttcccatcggctatctaat

SEQ ID NO: 381086 - DNA, 20 bp, human
gctcccgggcacgggtcttc

SEQ ID NO: 381087 - DNA, 20 bp, human
gctcgaggccgggtagccca

SEQ ID NO: 381088 - DNA, 20 bp, human
gcctcaacctaagggcgagc

SEQ ID NO: 381089 - DNA, 20 bp, human
ggtgccctccttgggctacc

SEQ ID NO: 381090 - DNA, 20 bp, human
gttgctctcaccatcctcca

SEQ ID NO: 381091 - DNA, 20 bp, human
ggccttcagcccacactgac

SEQ ID NO: 381092 - DNA, 20 bp, human
gcccacactgacggggtagg

SEQ ID NO: 381093 - DNA, 20 bp, human
gaggccgggtagcccaagga

SEQ ID NO: 381094 - DNA, 20 bp, human
gaatgtgtacaggaccccgg

SEQ ID NO: 381095 - DNA, 20 bp, human
gggccccagcctcaacctaa

SEQ ID NO: 381096 - DNA, 20 bp, human
gtatagaagctcatcgtcag

SEQ ID NO: 381097 - DNA, 20 bp, human
gttgtccacacgcagcacca

SEQ ID NO: 381098 - DNA, 20 bp, human
gggctcacctgagcctgctt

SEQ ID NO: 381099 - DNA, 20 bp, human
gttctctgagcatacattct

SEQ ID NO: 381100 - DNA, 20 bp, human
gcacgttgcgtattgaagac

SEQ ID NO: 381101 - DNA, 20 bp, human
gcgtgtggacaacatacacc

SEQ ID NO: 381102 - DNA, 20 bp, human
gaggacagccagggtttaac

SEQ ID NO: 381103 - DNA, 20 bp, human
gagtgacacacgtcccaagc

SEQ ID NO: 381104 - DNA, 20 bp, human
gatcacacggacaattcaga

SEQ ID NO: 381105 - DNA, 20 bp, human
gcttctatattaagaattgc

SEQ ID NO: 381106 - DNA, 20 bp, human
ggtaagaccaacactatttc

SEQ ID NO: 381107 - DNA, 20 bp, human
gacctctcagatgtcacaat

SEQ ID NO: 381108 - DNA, 20 bp, human
gtgttggtcttacatcagag

SEQ ID NO: 381109 - DNA, 20 bp, human
ggcccattgtgacatctgag

SEQ ID NO: 381110 - DNA, 20 bp, human
ggacatctgagaggtttttc

SEQ ID NO: 381111 - DNA, 20 bp, human
gtttatctggttatattatg

SEQ ID NO: 381112 - DNA, 20 bp, human
ggtatttttactcgggatgg

SEQ ID NO: 381113 - DNA, 20 bp, human
gtttattccagaaatagtgt

SEQ ID NO: 381114 - DNA, 20 bp, human
ggtagtcctgtttatctcat

SEQ ID NO: 381115 - DNA, 20 bp, human
gagaagaaagaaaaaggctg

SEQ ID NO: 381116 - DNA, 20 bp, human
ggaaaacagatgtatgagga

SEQ ID NO: 381117 - DNA, 20 bp, human
gctgttccataatgagtcca

SEQ ID NO: 381118 - DNA, 20 bp, human
gaggcaccgtggactcatta

SEQ ID NO: 381119 - DNA, 20 bp, human
gactcattatggaacaggat

SEQ ID NO: 381120 - DNA, 20 bp, human
gtggctagaaaaattcctcc

SEQ ID NO: 381121 - DNA, 20 bp, human
gttttgaaaacagatgtatg

SEQ ID NO: 381122 - DNA, 20 bp, human
gggtacgtaaggagtgagtg

SEQ ID NO: 381123 - DNA, 20 bp, human
gcgtaaggagtgagtggggt

SEQ ID NO: 381124 - DNA, 20 bp, human
ggtgcgcagaagaacctgcg

SEQ ID NO: 381125 - DNA, 20 bp, human
gaattcggtgatgaagtcac

SEQ ID NO: 381126 - DNA, 20 bp, human
gtccaggccatccttctcga

SEQ ID NO: 381127 - DNA, 20 bp, human
gaagccgagccacacccagg

SEQ ID NO: 381128 - DNA, 20 bp, human
gaagccaaccaggcctcgag

SEQ ID NO: 381129 - DNA, 20 bp, human
ggtcgccggggcaacgggac

SEQ ID NO: 381130 - DNA, 20 bp, human
gtcccgcccctcgagaagga

SEQ ID NO: 381131 - DNA, 20 bp, human
gtcgaggggcgggagctgac

SEQ ID NO: 381132 - DNA, 20 bp, human
gcagctcccgcccctcgaga

SEQ ID NO: 381133 - DNA, 20 bp, human
gggagctgaccggcatgaac

SEQ ID NO: 381134 - DNA, 20 bp, human
ggagccgctcgaggcctggt

SEQ ID NO: 381135 - DNA, 20 bp, human
gaaccctcctgggtgtggct

SEQ ID NO: 381136 - DNA, 20 bp, human
ggccgaaggggttcagtaag

SEQ ID NO: 381137 - DNA, 20 bp, human
ggagccccctgagcggtcat

SEQ ID NO: 381138 - DNA, 20 bp, human
ggaaacatggcgcctagggg

SEQ ID NO: 381139 - DNA, 20 bp, human
ggaggcgccagcccaatata

SEQ ID NO: 381140 - DNA, 20 bp, human
gtggccgatgaccgctcagg

SEQ ID NO: 381141 - DNA, 20 bp, human
ggccagctgagactcatcgg

SEQ ID NO: 381142 - DNA, 20 bp, human
gaccgctgcccacccgagtc

SEQ ID NO: 381143 - DNA, 20 bp, human
ggccgagaggacagcctcga

SEQ ID NO: 381144 - DNA, 20 bp, human
gaccgcttactgaacccctt

SEQ ID NO: 381145 - DNA, 20 bp, human
gtcgcccgccgcacgcagtg

SEQ ID NO: 381146 - DNA, 20 bp, human
gaggccgagaacagctcgga

SEQ ID NO: 381147 - DNA, 20 bp, human
ggcggcgagtggtgcggtcc

SEQ ID NO: 381148 - DNA, 20 bp, human
ggcggggtgagaagtgttta

SEQ ID NO: 381149 - DNA, 20 bp, human
gcgacggcgcgacggggcaa

SEQ ID NO: 381150 - DNA, 20 bp, human
gcgacggggcaaggggatcc

SEQ ID NO: 381151 - DNA, 20 bp, human
gggcgcggccatcacaaaac

SEQ ID NO: 381152 - DNA, 20 bp, human
gccgtcgtccccccgctatc

SEQ ID NO: 381153 - DNA, 20 bp, human
gcacaaaaccggatagcggg

SEQ ID NO: 381154 - DNA, 20 bp, human
gcgcaccactcgccgcgcgg

SEQ ID NO: 381155 - DNA, 20 bp, human
gcaacgccgggcgctcccgt

SEQ ID NO: 381156 - DNA, 20 bp, human
gtacaaatgaagaaccaaca

SEQ ID NO: 381157 - DNA, 20 bp, human
gtggaattttgtagccctgt

SEQ ID NO: 381158 - DNA, 20 bp, human
gaagagaggggagatcatca

SEQ ID NO: 381159 - DNA, 20 bp, human
gcctacctgtgacacaagat

SEQ ID NO: 381160 - DNA, 20 bp, human
gggtgccttggaaaccaaga

SEQ ID NO: 381161 - DNA, 20 bp, human
gggctgagatagacgtaagg

SEQ ID NO: 381162 - DNA, 20 bp, human
gcaccccgctaccctggaaa

SEQ ID NO: 381163 - DNA, 20 bp, human
gagaggggagatcatcaggg

SEQ ID NO: 381164 - DNA, 20 bp, human
ggggaagtaccattgtagcc

SEQ ID NO: 381165 - DNA, 20 bp, human
ggagcctgggcgggagggta

SEQ ID NO: 381166 - DNA, 20 bp, human
gtacaaatgaagaaccaaca

SEQ ID NO: 381167 - DNA, 20 bp, human
gtggaattttgtagccctgt

SEQ ID NO: 381168 - DNA, 20 bp, human
gaagagaggggagatcatca

SEQ ID NO: 381169 - DNA, 20 bp, human
gcaccccgctaccctggaaa

SEQ ID NO: 381170 - DNA, 20 bp, human
gggtgccttggaaaccaaga

SEQ ID NO: 381171 - DNA, 20 bp, human
gcctacctgtgacacaagat

SEQ ID NO: 381172 - DNA, 20 bp, human
ggcaagcagagcctcaccat

SEQ ID NO: 381173 - DNA, 20 bp, human
gagaggggagatcatcaggg

SEQ ID NO: 381174 - DNA, 20 bp, human
ggggaagtaccattgtagcc

SEQ ID NO: 381175 - DNA, 20 bp, human
gggctgagatagacgtaagg

SEQ ID NO: 381176 - DNA, 20 bp, human
gcagccgcgtggggcatcac

SEQ ID NO: 381177 - DNA, 20 bp, human
gtggggcatcacgggaactc

SEQ ID NO: 381178 - DNA, 20 bp, human
gaagagttggcagttcgggg

SEQ ID NO: 381179 - DNA, 20 bp, human
gccccaccctgcttgcttaa

SEQ ID NO: 381180 - DNA, 20 bp, human
ggtgaagagttggcagttcg

SEQ ID NO: 381181 - DNA, 20 bp, human
gttaagggatgagtgactcc

SEQ ID NO: 381182 - DNA, 20 bp, human
gcccacgcggctgcaatgat

SEQ ID NO: 381183 - DNA, 20 bp, human
gcgcgtaaacccagccaggg

SEQ ID NO: 381184 - DNA, 20 bp, human
gggctgcaatgattggttaa

SEQ ID NO: 381185 - DNA, 20 bp, human
gtccggggctataaaagacc

SEQ ID NO: 381186 - DNA, 20 bp, human
gccgctgcgcgccaggcacg

SEQ ID NO: 381187 - DNA, 20 bp, human
ggccaggcccggcctcggga

SEQ ID NO: 381188 - DNA, 20 bp, human
gcggcctcgggacggttccg

SEQ ID NO: 381189 - DNA, 20 bp, human
ggacgtgtctaggaacgggt

SEQ ID NO: 381190 - DNA, 20 bp, human
gcggccgctttgcgggtagt

SEQ ID NO: 381191 - DNA, 20 bp, human
gcgcaaagcggccgcttcca

SEQ ID NO: 381192 - DNA, 20 bp, human
gcgggacggttccgtggaag

SEQ ID NO: 381193 - DNA, 20 bp, human
gcgcgagtaagccgcgtgcc

SEQ ID NO: 381194 - DNA, 20 bp, human
gcggcccgctcctagcaacg

SEQ ID NO: 381195 - DNA, 20 bp, human
gcggcgcaggtctttgtcgt

SEQ ID NO: 381196 - DNA, 20 bp, human
ggccctagccagtcccgcga

SEQ ID NO: 381197 - DNA, 20 bp, human
gcccgagctaggcagggagt

SEQ ID NO: 381198 - DNA, 20 bp, human
gagcgagcacgcgcctgcgg

SEQ ID NO: 381199 - DNA, 20 bp, human
gcctagctcgggatcgaacc

SEQ ID NO: 381200 - DNA, 20 bp, human
gcaccggaagttatggaggt

SEQ ID NO: 381201 - DNA, 20 bp, human
gggaacgcggcggacggtca

SEQ ID NO: 381202 - DNA, 20 bp, human
ggggagacttccgccctcgc

SEQ ID NO: 381203 - DNA, 20 bp, human
gagcggggcaccggaagtta

SEQ ID NO: 381204 - DNA, 20 bp, human
gggggcaccggaagttatgg

SEQ ID NO: 381205 - DNA, 20 bp, human
gcggtaggaagtgcccgcca

SEQ ID NO: 381206 - DNA, 20 bp, human
gggaaaaggaacttgatgag

SEQ ID NO: 381207 - DNA, 20 bp, human
gaacttgatgaggggcccta

SEQ ID NO: 381208 - DNA, 20 bp, human
gactctgaggccggtctcca

SEQ ID NO: 381209 - DNA, 20 bp, human
ggcactctccctggactctg

SEQ ID NO: 381210 - DNA, 20 bp, human
gagctgccctaaggatgtag

SEQ ID NO: 381211 - DNA, 20 bp, human
gtgtagcgaggaagacattt

SEQ ID NO: 381212 - DNA, 20 bp, human
gtcccgcagacatcaggggc

SEQ ID NO: 381213 - DNA, 20 bp, human
ggccaacccaggacgcagcc

SEQ ID NO: 381214 - DNA, 20 bp, human
gcagcggccaagtccggccg

SEQ ID NO: 381215 - DNA, 20 bp, human
gcacaggcggtggaatgtgg

SEQ ID NO: 381216 - DNA, 20 bp, human
ggaaatagacgcggggcctg

SEQ ID NO: 381217 - DNA, 20 bp, human
ggcgcggctgatactgcctg

SEQ ID NO: 381218 - DNA, 20 bp, human
ggtggaagctgtcgcgcgtc

SEQ ID NO: 381219 - DNA, 20 bp, human
gggcgggaactggtcgcgtc

SEQ ID NO: 381220 - DNA, 20 bp, human
gagtcggaggaaatagacgc

SEQ ID NO: 381221 - DNA, 20 bp, human
gcggctgatactgcctgagg

SEQ ID NO: 381222 - DNA, 20 bp, human
gctcctggacttgaggtatt

SEQ ID NO: 381223 - DNA, 20 bp, human
ggacagcttccacccgcctc

SEQ ID NO: 381224 - DNA, 20 bp, human
ggggcttcagcgaggcggga

SEQ ID NO: 381225 - DNA, 20 bp, human
gcagggagggcggctgtgcg

SEQ ID NO: 381226 - DNA, 20 bp, human
gtaagccagagccagactgg

SEQ ID NO: 381227 - DNA, 20 bp, human
ggctctccctgatgactcag

SEQ ID NO: 381228 - DNA, 20 bp, human
gccggcgcagagttagggtg

SEQ ID NO: 381229 - DNA, 20 bp, human
gggggtgcccctgagtcatc

SEQ ID NO: 381230 - DNA, 20 bp, human
gtcacagcaacaatgctctc

SEQ ID NO: 381231 - DNA, 20 bp, human
ggactggagggagggatcct

SEQ ID NO: 381232 - DNA, 20 bp, human
gctggccccgctggcctgaa

SEQ ID NO: 381233 - DNA, 20 bp, human
gggttaagccagagccagac

SEQ ID NO: 381234 - DNA, 20 bp, human
gcatggcaactccacaacac

SEQ ID NO: 381235 - DNA, 20 bp, human
gcaggtgcctgagggagttt

SEQ ID NO: 381236 - DNA, 20 bp, human
gaggggcgagcactagtgag

SEQ ID NO: 381237 - DNA, 20 bp, human
ggatcccggatgaggccgga

SEQ ID NO: 381238 - DNA, 20 bp, human
gaagctgccggagactgact

SEQ ID NO: 381239 - DNA, 20 bp, human
gtgaagctggcgtaaacgag

SEQ ID NO: 381240 - DNA, 20 bp, human
gcgcggggcatcacgggaag

SEQ ID NO: 381241 - DNA, 20 bp, human
gcgcctgggtgaggcagcga

SEQ ID NO: 381242 - DNA, 20 bp, human
gggcggatcccggatgaggc

SEQ ID NO: 381243 - DNA, 20 bp, human
gggcgtgtaaatcccggctg

SEQ ID NO: 381244 - DNA, 20 bp, human
gtgccatcgctgcctcaccc

SEQ ID NO: 381245 - DNA, 20 bp, human
gtgaggcagggggcggatcc

SEQ ID NO: 381246 - DNA, 20 bp, human
gaggaacgccgcgctgtgat

SEQ ID NO: 381247 - DNA, 20 bp, human
gactaagtggagcaccggat

SEQ ID NO: 381248 - DNA, 20 bp, human
gtttgctgcttgactctggt

SEQ ID NO: 381249 - DNA, 20 bp, human
gcggtgctccacttagtacc

SEQ ID NO: 381250 - DNA, 20 bp, human
gaaaagcaggagtgcgtgtc

SEQ ID NO: 381251 - DNA, 20 bp, human
gcatttttgctgcttgactc

SEQ ID NO: 381252 - DNA, 20 bp, human
ggcaaccaccaatcggcggc

SEQ ID NO: 381253 - DNA, 20 bp, human
gcaaaaatgctaggccttgt

SEQ ID NO: 381254 - DNA, 20 bp, human
gcacagcgcggcgttcctcc

SEQ ID NO: 381255 - DNA, 20 bp, human
gagctatggcaaccaccaat

SEQ ID NO: 381256 - DNA, 20 bp, human
gcggcccgcgttaaggagga

SEQ ID NO: 381257 - DNA, 20 bp, human
gcacggcccggcccgcgtta

SEQ ID NO: 381258 - DNA, 20 bp, human
ggggccgtgcctccgttgcc

SEQ ID NO: 381259 - DNA, 20 bp, human
gaggccgggctcagtcctct

SEQ ID NO: 381260 - DNA, 20 bp, human
gggcccggcccgcgttaagg

SEQ ID NO: 381261 - DNA, 20 bp, human
gttctcattggctcatgaga

SEQ ID NO: 381262 - DNA, 20 bp, human
gaggttccgcgcccacttcg

SEQ ID NO: 381263 - DNA, 20 bp, human
gggaggagggcgcagaccga

SEQ ID NO: 381264 - DNA, 20 bp, human
ggacggttgccaggcaacgg

SEQ ID NO: 381265 - DNA, 20 bp, human
gtagcggaaggaaggcgcaa

SEQ ID NO: 381266 - DNA, 20 bp, human
gctggggcgccaacgagaag

SEQ ID NO: 381267 - DNA, 20 bp, human
gaggccaagcggcggagctg

SEQ ID NO: 381268 - DNA, 20 bp, human
gagaagggggtgagcgtgat

SEQ ID NO: 381269 - DNA, 20 bp, human
gccgcttggcctttcgggaa

SEQ ID NO: 381270 - DNA, 20 bp, human
gacgctcacccccttctcgt

SEQ ID NO: 381271 - DNA, 20 bp, human
gggccagtacgcgtgggatt

SEQ ID NO: 381272 - DNA, 20 bp, human
gcggaagtgcagcacagaaa

SEQ ID NO: 381273 - DNA, 20 bp, human
gctccgccgcttggcctttc

SEQ ID NO: 381274 - DNA, 20 bp, human
gggtggaggaccagaagacg

SEQ ID NO: 381275 - DNA, 20 bp, human
gggggacggtagaagcctgg

SEQ ID NO: 381276 - DNA, 20 bp, human
gcacctttgtttttccagaa

SEQ ID NO: 381277 - DNA, 20 bp, human
gtgtgtgtgtggggaagact

SEQ ID NO: 381278 - DNA, 20 bp, human
gcacccttctggaaaaacaa

SEQ ID NO: 381279 - DNA, 20 bp, human
gatggcccacacgcgggaag

SEQ ID NO: 381280 - DNA, 20 bp, human
gggggctcaaaacacccttc

SEQ ID NO: 381281 - DNA, 20 bp, human
gtcagtttctctaatcaagt

SEQ ID NO: 381282 - DNA, 20 bp, human
gcggggcggggagacctttc

SEQ ID NO: 381283 - DNA, 20 bp, human
ggcggggagacctttcaggt

SEQ ID NO: 381284 - DNA, 20 bp, human
gtgcaggctaaaatgatcag

SEQ ID NO: 381285 - DNA, 20 bp, human
gactaatgatagagatatta

SEQ ID NO: 381286 - DNA, 20 bp, human
ggtacaagaagcatgctgat

SEQ ID NO: 381287 - DNA, 20 bp, human
gggtaagcaggctacataaa

SEQ ID NO: 381288 - DNA, 20 bp, human
gtggctgatgcagggtaagc

SEQ ID NO: 381289 - DNA, 20 bp, human
gaaacatttggcatagtatt

SEQ ID NO: 381290 - DNA, 20 bp, human
gtttagagtggatttatgtt

SEQ ID NO: 381291 - DNA, 20 bp, human
gaggttcagttctgtaccaa

SEQ ID NO: 381292 - DNA, 20 bp, human
gcaagtcatacaactcaatt

SEQ ID NO: 381293 - DNA, 20 bp, human
gcatgctgattggctgatgc

SEQ ID NO: 381294 - DNA, 20 bp, human
gaagaactctgatgattgaa

SEQ ID NO: 381295 - DNA, 20 bp, human
gtctgatgattgaatggaag

SEQ ID NO: 381296 - DNA, 20 bp, human
gcgggtgtttacccaggacg

SEQ ID NO: 381297 - DNA, 20 bp, human
ggacccagcggtgggctctc

SEQ ID NO: 381298 - DNA, 20 bp, human
ggccgcccaacacgtacctg

SEQ ID NO: 381299 - DNA, 20 bp, human
gcggcggccgccgaaggggc

SEQ ID NO: 381300 - DNA, 20 bp, human
gcgcgcagttcaaaccctgg

SEQ ID NO: 381301 - DNA, 20 bp, human
gggctttaggacccagcggt

SEQ ID NO: 381302 - DNA, 20 bp, human
gagcggtgggctctccggaa

SEQ ID NO: 381303 - DNA, 20 bp, human
gagtgggcgcggactcggtg

SEQ ID NO: 381304 - DNA, 20 bp, human
ggccgaaggggcgggatccg

SEQ ID NO: 381305 - DNA, 20 bp, human
gtcctgggtaaacacccggc

SEQ ID NO: 381306 - DNA, 20 bp, human
gcatgcgcgcttcgtcacaa

SEQ ID NO: 381307 - DNA, 20 bp, human
gagcaaatcgcggaccaccg

SEQ ID NO: 381308 - DNA, 20 bp, human
gtgcgccgcaagggagccgc

SEQ ID NO: 381309 - DNA, 20 bp, human
gcgctcccgcatcaaccgcc

SEQ ID NO: 381310 - DNA, 20 bp, human
gtggtgcagctgcgccgcaa

SEQ ID NO: 381311 - DNA, 20 bp, human
gcctaggagcgcaagaggcc

SEQ ID NO: 381312 - DNA, 20 bp, human
gtaaaggggcggtgcagagg

SEQ ID NO: 381313 - DNA, 20 bp, human
gcggggaaatgcgctgctct

SEQ ID NO: 381314 - DNA, 20 bp, human
gccgcccctaggagcgcaag

SEQ ID NO: 381315 - DNA, 20 bp, human
gttcgcacccaccgccccgg

SEQ ID NO: 381316 - DNA, 20 bp, human
ggaaggcggagggaacacgt

SEQ ID NO: 381317 - DNA, 20 bp, human
gaggccaggagggcgcactg

SEQ ID NO: 381318 - DNA, 20 bp, human
gtggaggcgagggaagtgca

SEQ ID NO: 381319 - DNA, 20 bp, human
ggtgacccaagtgaccttcg

SEQ ID NO: 381320 - DNA, 20 bp, human
gcacaagctgcttccgggga

SEQ ID NO: 381321 - DNA, 20 bp, human
gaggagggcgcactggggat

SEQ ID NO: 381322 - DNA, 20 bp, human
gaagctgcttccggggaagg

SEQ ID NO: 381323 - DNA, 20 bp, human
ggaagtgcagggcgcatccc

SEQ ID NO: 381324 - DNA, 20 bp, human
gtgcttccggggaaggcgga

SEQ ID NO: 381325 - DNA, 20 bp, human
gcagcttgtgctctagttac

SEQ ID NO: 381326 - DNA, 20 bp, human
ggcgccgctcacccccggga

SEQ ID NO: 381327 - DNA, 20 bp, human
gcggctcggcccaggagcgt

SEQ ID NO: 381328 - DNA, 20 bp, human
gccgtgcccccgggctcaga

SEQ ID NO: 381329 - DNA, 20 bp, human
gcttgccggcagccaatccc

SEQ ID NO: 381330 - DNA, 20 bp, human
gccagtcacggggaatgcag

SEQ ID NO: 381331 - DNA, 20 bp, human
gcggcagggtggggttctca

SEQ ID NO: 381332 - DNA, 20 bp, human
gcgaggggcttccttcccgg

SEQ ID NO: 381333 - DNA, 20 bp, human
gggcctgaatcagaccctgc

SEQ ID NO: 381334 - DNA, 20 bp, human
ggcgacagacggtggacgga

SEQ ID NO: 381335 - DNA, 20 bp, human
ggaggcggcgggagtatccc

SEQ ID NO: 381336 - DNA, 20 bp, human
gggacaggcgagtgtccctg

SEQ ID NO: 381337 - DNA, 20 bp, human
ggccctgggaggcccggcta

SEQ ID NO: 381338 - DNA, 20 bp, human
gcggcccctctgtccctccg

SEQ ID NO: 381339 - DNA, 20 bp, human
gcactcgcctgtcccccgga

SEQ ID NO: 381340 - DNA, 20 bp, human
gtgtcccccggagggacaga

SEQ ID NO: 381341 - DNA, 20 bp, human
gaaggcacagcgccacgcgg

SEQ ID NO: 381342 - DNA, 20 bp, human
gacagcgccacgcggtggcc

SEQ ID NO: 381343 - DNA, 20 bp, human
gggccaggaggactgacgcg

SEQ ID NO: 381344 - DNA, 20 bp, human
gcaggaggactgacgcgcgg

SEQ ID NO: 381345 - DNA, 20 bp, human
gagtcctcctggccaccgcg

SEQ ID NO: 381346 - DNA, 20 bp, human
gtgagggcggaagctgtgtg

SEQ ID NO: 381347 - DNA, 20 bp, human
gtgaaggccgaatgcggcgg

SEQ ID NO: 381348 - DNA, 20 bp, human
gggcccctgcgggattacga

SEQ ID NO: 381349 - DNA, 20 bp, human
gcgggcttgaaggccgaatg

SEQ ID NO: 381350 - DNA, 20 bp, human
ggtccctggcttcctgaggg

SEQ ID NO: 381351 - DNA, 20 bp, human
gccaggccatggagagactc

SEQ ID NO: 381352 - DNA, 20 bp, human
gtaatcccgcaggggcccca

SEQ ID NO: 381353 - DNA, 20 bp, human
ggtgtgcggcctggtaaggg

SEQ ID NO: 381354 - DNA, 20 bp, human
gtgggtgtgacacattgggg

SEQ ID NO: 381355 - DNA, 20 bp, human
gaggccgaatgcggcggggg

SEQ ID NO: 381356 - DNA, 20 bp, human
gcctgaggagactgacgggt

SEQ ID NO: 381357 - DNA, 20 bp, human
ggtccaggaccgcgctaaaa

SEQ ID NO: 381358 - DNA, 20 bp, human
gtaaggcctgaggagactga

SEQ ID NO: 381359 - DNA, 20 bp, human
ggctgcgagggaacgcgtcc

SEQ ID NO: 381360 - DNA, 20 bp, human
gacaggcggccacctcagag

SEQ ID NO: 381361 - DNA, 20 bp, human
gggaccaaaaggcgaggtga

SEQ ID NO: 381362 - DNA, 20 bp, human
ggagggcaggataaggcctg

SEQ ID NO: 381363 - DNA, 20 bp, human
gtgggagccccacaccaggc

SEQ ID NO: 381364 - DNA, 20 bp, human
gtatcctgccctctctgagg

SEQ ID NO: 381365 - DNA, 20 bp, human
gtcactgtggtgtccgactg

SEQ ID NO: 381366 - DNA, 20 bp, human
gctcacacctgaccccggag

SEQ ID NO: 381367 - DNA, 20 bp, human
gtcggaggacgtaggcgcct

SEQ ID NO: 381368 - DNA, 20 bp, human
gcggacctcacacctgaccc

SEQ ID NO: 381369 - DNA, 20 bp, human
gccaccgcgtcggaggacgt

SEQ ID NO: 381370 - DNA, 20 bp, human
gggtggttggattggttcaa

SEQ ID NO: 381371 - DNA, 20 bp, human
ggcccagcggctcctgagac

SEQ ID NO: 381372 - DNA, 20 bp, human
gggccgccttccaggatccc

SEQ ID NO: 381373 - DNA, 20 bp, human
gcgccgcgttccagccccga

SEQ ID NO: 381374 - DNA, 20 bp, human
ggacgcggtgggaagacgcg

SEQ ID NO: 381375 - DNA, 20 bp, human
gcacctgccacgtgccctcg

SEQ ID NO: 381376 - DNA, 20 bp, human
gcggcggcctccagagtcga

SEQ ID NO: 381377 - DNA, 20 bp, human
gtctccgcggccggaagtgg

SEQ ID NO: 381378 - DNA, 20 bp, human
gtggccccgcccactctccg

SEQ ID NO: 381379 - DNA, 20 bp, human
gtgctcaatccctggtagtt

SEQ ID NO: 381380 - DNA, 20 bp, human
ggtgtcaggccgtcacacgg

SEQ ID NO: 381381 - DNA, 20 bp, human
gagggcccaaggagcttgtt

SEQ ID NO: 381382 - DNA, 20 bp, human
gacttccggccgcggagagt

SEQ ID NO: 381383 - DNA, 20 bp, human
gcgaaaaggaaatccctctc

SEQ ID NO: 381384 - DNA, 20 bp, human
gcctgtgtcaggccgtcaca

SEQ ID NO: 381385 - DNA, 20 bp, human
gtccggccgcggagagtggg

SEQ ID NO: 381386 - DNA, 20 bp, human
gtcgccccgccccgcttcga

SEQ ID NO: 381387 - DNA, 20 bp, human
gggcacgcgcagaaaccgct

SEQ ID NO: 381388 - DNA, 20 bp, human
gcacgcgcggacgccggcgt

SEQ ID NO: 381389 - DNA, 20 bp, human
gcggccgcgtcggcccacgc

SEQ ID NO: 381390 - DNA, 20 bp, human
gggacaacgcaggtacgcgc

SEQ ID NO: 381391 - DNA, 20 bp, human
gcggcgtccgcgcgtgggaa

SEQ ID NO: 381392 - DNA, 20 bp, human
gccgccgccggccggtgcgt

SEQ ID NO: 381393 - DNA, 20 bp, human
gagaaaccgctaggtggcga

SEQ ID NO: 381394 - DNA, 20 bp, human
gtctgcgcgtgcccacgcac

SEQ ID NO: 381395 - DNA, 20 bp, human
gcgtacctgcgttgtccacc

SEQ ID NO: 381396 - DNA, 20 bp, human
gcgccgcgcgcccttgtggg

SEQ ID NO: 381397 - DNA, 20 bp, human
gcccggcaggcctagcgcgg

SEQ ID NO: 381398 - DNA, 20 bp, human
gggcgctcaagcttcccctg

SEQ ID NO: 381399 - DNA, 20 bp, human
gcgcccttgtgggcgggctc

SEQ ID NO: 381400 - DNA, 20 bp, human
gaacgcgccgcgcgcccttg

SEQ ID NO: 381401 - DNA, 20 bp, human
gggccggcggcacgaggacc

SEQ ID NO: 381402 - DNA, 20 bp, human
gcacgaggaccaggcagcgc

SEQ ID NO: 381403 - DNA, 20 bp, human
ggcgcgcggcgcgttctgat

SEQ ID NO: 381404 - DNA, 20 bp, human
gggccggagcccgcccacaa

SEQ ID NO: 381405 - DNA, 20 bp, human
gctcaccctgggctcgctcg

SEQ ID NO: 381406 - DNA, 20 bp, human
ggggcagcccgcggaaggat

SEQ ID NO: 381407 - DNA, 20 bp, human
gctcaggggcagcccgcgga

SEQ ID NO: 381408 - DNA, 20 bp, human
ggggctgcccctgagcgacg

SEQ ID NO: 381409 - DNA, 20 bp, human
gcgctgcccaattacccgga

SEQ ID NO: 381410 - DNA, 20 bp, human
gtagccgctgcccaattacc

SEQ ID NO: 381411 - DNA, 20 bp, human
gcagcagccacgtcgctcag

SEQ ID NO: 381412 - DNA, 20 bp, human
gcggaaggattggttgtgac

SEQ ID NO: 381413 - DNA, 20 bp, human
gacgccgggaagcttgtaat

SEQ ID NO: 381414 - DNA, 20 bp, human
gacgggagaaggcgattggt

SEQ ID NO: 381415 - DNA, 20 bp, human
gccggcggggctcactgtgg

SEQ ID NO: 381416 - DNA, 20 bp, human
ggcgggcctggtcctgagga

SEQ ID NO: 381417 - DNA, 20 bp, human
gtggccacgccctccggcca

SEQ ID NO: 381418 - DNA, 20 bp, human
gagtaagtgggggtcggcgg

SEQ ID NO: 381419 - DNA, 20 bp, human
ggggcagtccgggagtaagt

SEQ ID NO: 381420 - DNA, 20 bp, human
gcgccggaggggatgagtcc

SEQ ID NO: 381421 - DNA, 20 bp, human
gcccacccccaaattcgacg

SEQ ID NO: 381422 - DNA, 20 bp, human
gaggccgcggcaaggctgag

SEQ ID NO: 381423 - DNA, 20 bp, human
gtggcggggaccacactggg

SEQ ID NO: 381424 - DNA, 20 bp, human
ggggagaggggaatttgcgg

SEQ ID NO: 381425 - DNA, 20 bp, human
gttggagcgggcctggttct

SEQ ID NO: 381426 - DNA, 20 bp, human
gccgccgccggtgacgtcat

SEQ ID NO: 381427 - DNA, 20 bp, human
gacgtcatggggaatcgggg

SEQ ID NO: 381428 - DNA, 20 bp, human
ggtgacgtcatggggaatcg

SEQ ID NO: 381429 - DNA, 20 bp, human
ggcccgcgccgggagacgga

SEQ ID NO: 381430 - DNA, 20 bp, human
gcgcgccgggagacggaggg

SEQ ID NO: 381431 - DNA, 20 bp, human
ggaatcggggcggaccggcg

SEQ ID NO: 381432 - DNA, 20 bp, human
gaactcgctccggaggggtg

SEQ ID NO: 381433 - DNA, 20 bp, human
ggcgagccacgctcccccgt

SEQ ID NO: 381434 - DNA, 20 bp, human
gaggaccgaactcgctccgg

SEQ ID NO: 381435 - DNA, 20 bp, human
ggggcggagtctcgcgccca

SEQ ID NO: 381436 - DNA, 20 bp, human
gactccaagtcggagggaaa

SEQ ID NO: 381437 - DNA, 20 bp, human
gtgtctggccacatggggaa

SEQ ID NO: 381438 - DNA, 20 bp, human
ggggcccccgggcaaaaaga

SEQ ID NO: 381439 - DNA, 20 bp, human
gcccctcccccgtgcgccgt

SEQ ID NO: 381440 - DNA, 20 bp, human
gtgccggaggggagtcgccc

SEQ ID NO: 381441 - DNA, 20 bp, human
gggagagattagtctatctc

SEQ ID NO: 381442 - DNA, 20 bp, human
gctggtaggaactcaggatt

SEQ ID NO: 381443 - DNA, 20 bp, human
gcaagcccctcccctgatgg

SEQ ID NO: 381444 - DNA, 20 bp, human
gggccagggcgactcccctc

SEQ ID NO: 381445 - DNA, 20 bp, human
gagtctatctcggggctggt

SEQ ID NO: 381446 - DNA, 20 bp, human
gagccctgcccgcgaggcga

SEQ ID NO: 381447 - DNA, 20 bp, human
gaaggcagctccgcacgggc

SEQ ID NO: 381448 - DNA, 20 bp, human
ggaggaaggcagctccgcac

SEQ ID NO: 381449 - DNA, 20 bp, human
ggggcgaggcccggagcgca

SEQ ID NO: 381450 - DNA, 20 bp, human
gccggagccccaaattccgg

SEQ ID NO: 381451 - DNA, 20 bp, human
ggggcacccgccggaatttg

SEQ ID NO: 381452 - DNA, 20 bp, human
gggcggagccctcgcctcgc

SEQ ID NO: 381453 - DNA, 20 bp, human
gtcgcgggcagggctcccgt

SEQ ID NO: 381454 - DNA, 20 bp, human
gcacggcccccggcaccgac

SEQ ID NO: 381455 - DNA, 20 bp, human
ggctcgggccgcctaccccg

SEQ ID NO: 381456 - DNA, 20 bp, human
gtcggagcggagagatcgaa

SEQ ID NO: 381457 - DNA, 20 bp, human
gggccaccggcacctcgggg

SEQ ID NO: 381458 - DNA, 20 bp, human
gcggcgcagtctcctccccg

SEQ ID NO: 381459 - DNA, 20 bp, human
ggggcggcgcagtgaaggcg

SEQ ID NO: 381460 - DNA, 20 bp, human
ggctggaatgcgcggaatga

SEQ ID NO: 381461 - DNA, 20 bp, human
gaatgagatgcgcgccgcgg

SEQ ID NO: 381462 - DNA, 20 bp, human
gccctggcctcgagtgtgcg

SEQ ID NO: 381463 - DNA, 20 bp, human
gagtcgggaccccgccagga

SEQ ID NO: 381464 - DNA, 20 bp, human
gaggggtccccgccgtccct

SEQ ID NO: 381465 - DNA, 20 bp, human
gaggaggacgctggaatgcg

SEQ ID NO: 381466 - DNA, 20 bp, human
ggaccggggcggggcgatcg

SEQ ID NO: 381467 - DNA, 20 bp, human
ggggcgatcgaggactgggc

SEQ ID NO: 381468 - DNA, 20 bp, human
gagggcccaagcgaccgggg

SEQ ID NO: 381469 - DNA, 20 bp, human
gtcaaggcaagtgaccggaa

SEQ ID NO: 381470 - DNA, 20 bp, human
gaggcggggtagggcgtcca

SEQ ID NO: 381471 - DNA, 20 bp, human
gtccacggggccagcaatcg

SEQ ID NO: 381472 - DNA, 20 bp, human
ggggcggggcgatcgaggac

SEQ ID NO: 381473 - DNA, 20 bp, human
gcgccccgccccggtcgctt

SEQ ID NO: 381474 - DNA, 20 bp, human
gcaggatcagaggcggggta

SEQ ID NO: 381475 - DNA, 20 bp, human
ggccgcccccggaaacctaa

SEQ ID NO: 381476 - DNA, 20 bp, human
ggcgacctgggacgtgcgat

SEQ ID NO: 381477 - DNA, 20 bp, human
ggcagccaatcgcacgtccc

SEQ ID NO: 381478 - DNA, 20 bp, human
gtggctgcggtgcgccgcgt

SEQ ID NO: 381479 - DNA, 20 bp, human
gctggcgcgaccccggaagt

SEQ ID NO: 381480 - DNA, 20 bp, human
gaactcgcttcagccgactc

SEQ ID NO: 381481 - DNA, 20 bp, human
ggcgcgcccgcccacttccg

SEQ ID NO: 381482 - DNA, 20 bp, human
gtccggggtcgcgccaggtc

SEQ ID NO: 381483 - DNA, 20 bp, human
gctcgaagccagcaccgacg

SEQ ID NO: 381484 - DNA, 20 bp, human
gcggtctgcaggagcggaga

SEQ ID NO: 381485 - DNA, 20 bp, human
ggaggctggccaatgggcac

SEQ ID NO: 381486 - DNA, 20 bp, human
gccacaagtggcagcgggcg

SEQ ID NO: 381487 - DNA, 20 bp, human
gacgcaaatgcgtttccggt

SEQ ID NO: 381488 - DNA, 20 bp, human
ggctccgccgggggctagag

SEQ ID NO: 381489 - DNA, 20 bp, human
gaatgcgtttccggtggggt

SEQ ID NO: 381490 - DNA, 20 bp, human
gggcttcgcgtctccttcta

SEQ ID NO: 381491 - DNA, 20 bp, human
gcaagtggcagcgggcgggg

SEQ ID NO: 381492 - DNA, 20 bp, human
gtctcccgagcagctcgcag

SEQ ID NO: 381493 - DNA, 20 bp, human
gagccaccccaccccgggaa

SEQ ID NO: 381494 - DNA, 20 bp, human
gtatggaaggtgcgtgagat

SEQ ID NO: 381495 - DNA, 20 bp, human
ggctctgccgctctagcccc

SEQ ID NO: 381496 - DNA, 20 bp, human
gtaggaggggctaaagagaa

SEQ ID NO: 381497 - DNA, 20 bp, human
gaacttgcgagaccaatcga

SEQ ID NO: 381498 - DNA, 20 bp, human
ggcggggcagagacctcctt

SEQ ID NO: 381499 - DNA, 20 bp, human
gggcggaacgcctgtaggag

SEQ ID NO: 381500 - DNA, 20 bp, human
gttgcgagaccaatcgaagg

SEQ ID NO: 381501 - DNA, 20 bp, human
ggcgccccgtcggccaatca

SEQ ID NO: 381502 - DNA, 20 bp, human
gaaggagcaggggcgaacgt

SEQ ID NO: 381503 - DNA, 20 bp, human
gtggaaaccaaggtaagcga

SEQ ID NO: 381504 - DNA, 20 bp, human
ggcgttccgcccccttcgat

SEQ ID NO: 381505 - DNA, 20 bp, human
gtgaccatccaccaatccaa

SEQ ID NO: 381506 - DNA, 20 bp, human
gcaagaaatcattcaattgc

SEQ ID NO: 381507 - DNA, 20 bp, human
gtttcatcatctctgagttc

SEQ ID NO: 381508 - DNA, 20 bp, human
gctaaataaaactgaactct

SEQ ID NO: 381509 - DNA, 20 bp, human
ggttctgtctattcttgctt

SEQ ID NO: 381510 - DNA, 20 bp, human
gtaaaactgaactcttggaa

SEQ ID NO: 381511 - DNA, 20 bp, human
gtgcatcagttaaatactgc

SEQ ID NO: 381512 - DNA, 20 bp, human
gatttaaaaaatcctgtcta

SEQ ID NO: 381513 - DNA, 20 bp, human
gacttctctttaccttagac

SEQ ID NO: 381514 - DNA, 20 bp, human
gcagttattttaagttcgtt

SEQ ID NO: 381515 - DNA, 20 bp, human
gtgttacatagtaatgtact

SEQ ID NO: 381516 - DNA, 20 bp, human
ggaacaccaggtgtgtttag

SEQ ID NO: 381517 - DNA, 20 bp, human
gaacatcaacagtgctgagt

SEQ ID NO: 381518 - DNA, 20 bp, human
gtgttctatgacggttttga

SEQ ID NO: 381519 - DNA, 20 bp, human
gagtggtatgcgtaaaggaa

SEQ ID NO: 381520 - DNA, 20 bp, human
gatgaagtgttgaacttcgg

SEQ ID NO: 381521 - DNA, 20 bp, human
ggctgaaatcccctgaatgc

SEQ ID NO: 381522 - DNA, 20 bp, human
gccagagtaaacagaacacc

SEQ ID NO: 381523 - DNA, 20 bp, human
gggaaatccaggtctcactg

SEQ ID NO: 381524 - DNA, 20 bp, human
ggtgagagtggtatgcgtaa

SEQ ID NO: 381525 - DNA, 20 bp, human
gtgacggttttgatggtctt

SEQ ID NO: 381526 - DNA, 20 bp, human
ggatggaaatgtcaggtact

SEQ ID NO: 381527 - DNA, 20 bp, human
ggggtacaaaggtagaaggg

SEQ ID NO: 381528 - DNA, 20 bp, human
gtatacagttgccttctttt

SEQ ID NO: 381529 - DNA, 20 bp, human
gtacctttgtacccaaaaga

SEQ ID NO: 381530 - DNA, 20 bp, human
gtccaggcaaaatctaacaa

SEQ ID NO: 381531 - DNA, 20 bp, human
gatagagtagagcctatctg

SEQ ID NO: 381532 - DNA, 20 bp, human
ggctctgcaggagataggac

SEQ ID NO: 381533 - DNA, 20 bp, human
gtttgggtacaaaggtagaa

SEQ ID NO: 381534 - DNA, 20 bp, human
gttcaacagtcgccacagat

SEQ ID NO: 381535 - DNA, 20 bp, human
ggtacttggagctgaaacct

SEQ ID NO: 381536 - DNA, 20 bp, human
gggctagcacagtaatccga

SEQ ID NO: 381537 - DNA, 20 bp, human
gactgtgtggggaataaaaa

SEQ ID NO: 381538 - DNA, 20 bp, human
gaagtaactgagcttcccat

SEQ ID NO: 381539 - DNA, 20 bp, human
gtgcttcaaccaagattggg

SEQ ID NO: 381540 - DNA, 20 bp, human
gtaactgcttcaaccaagat

SEQ ID NO: 381541 - DNA, 20 bp, human
gatgcattatccactgtgtg

SEQ ID NO: 381542 - DNA, 20 bp, human
gcaacttttcctcccaatct

SEQ ID NO: 381543 - DNA, 20 bp, human
gatgctcattgtgacttatc

SEQ ID NO: 381544 - DNA, 20 bp, human
ggttattttctgtacaaaag

SEQ ID NO: 381545 - DNA, 20 bp, human
gaagaattaaaactgtcacc

SEQ ID NO: 381546 - DNA, 20 bp, human
ggtaaccagaaggtcctcaa

SEQ ID NO: 381547 - DNA, 20 bp, human
gagggacaagtgtaaccaga

SEQ ID NO: 381548 - DNA, 20 bp, human
gaagcaagccatgagagaga

SEQ ID NO: 381549 - DNA, 20 bp, human
gtggacccttgaggaccttc

SEQ ID NO: 381550 - DNA, 20 bp, human
gcagtctgtgagagagcagt

SEQ ID NO: 381551 - DNA, 20 bp, human
ggagtaacccgggtcttctc

SEQ ID NO: 381552 - DNA, 20 bp, human
gtctactccgagcattgaac

SEQ ID NO: 381553 - DNA, 20 bp, human
ggctcggagtagaaaaagag

SEQ ID NO: 381554 - DNA, 20 bp, human
gcaattagttcccagtgtac

SEQ ID NO: 381555 - DNA, 20 bp, human
ggaggccaaggcagatctcg

SEQ ID NO: 381556 - DNA, 20 bp, human
gggggcaggcgcagatcctc

SEQ ID NO: 381557 - DNA, 20 bp, human
gaggctgcggtggttgggga

SEQ ID NO: 381558 - DNA, 20 bp, human
gcttccccggatcgttgctc

SEQ ID NO: 381559 - DNA, 20 bp, human
gcgcccctgtgtcccctgat

SEQ ID NO: 381560 - DNA, 20 bp, human
gcaggtgaggaccctcgcgg

SEQ ID NO: 381561 - DNA, 20 bp, human
gcctcgggccgtgattggtc

SEQ ID NO: 381562 - DNA, 20 bp, human
ggggataagatagacacgtg

SEQ ID NO: 381563 - DNA, 20 bp, human
gccggctgcccgaccaatca

SEQ ID NO: 381564 - DNA, 20 bp, human
gggcgccaatcaggggacac

SEQ ID NO: 381565 - DNA, 20 bp, human
gtccagcctgcgagaggggc

SEQ ID NO: 381566 - DNA, 20 bp, human
gaggctgggagccataactg

SEQ ID NO: 381567 - DNA, 20 bp, human
gaggctgggctctctgtcag

SEQ ID NO: 381568 - DNA, 20 bp, human
ggggctctctgtcagaggat

SEQ ID NO: 381569 - DNA, 20 bp, human
ggccctgccaagcagcggga

SEQ ID NO: 381570 - DNA, 20 bp, human
ggaaagggaagttctccccc

SEQ ID NO: 381571 - DNA, 20 bp, human
gcgcccgtccacccccggct

SEQ ID NO: 381572 - DNA, 20 bp, human
gtggacgggcgggctgggac

SEQ ID NO: 381573 - DNA, 20 bp, human
gagccgcaggctagggaggc

SEQ ID NO: 381574 - DNA, 20 bp, human
gctggcaggtggccgagccg

SEQ ID NO: 381575 - DNA, 20 bp, human
gaggcggggtgggagccttg

SEQ ID NO: 381576 - DNA, 20 bp, human
gcagtgggtcgtccgcgtct

SEQ ID NO: 381577 - DNA, 20 bp, human
gcggctctcaggagtcggta

SEQ ID NO: 381578 - DNA, 20 bp, human
gcggacgacccactgctcag

SEQ ID NO: 381579 - DNA, 20 bp, human
ggactcgggatccggggaca

SEQ ID NO: 381580 - DNA, 20 bp, human
ggcgctcggcctgcactcgg

SEQ ID NO: 381581 - DNA, 20 bp, human
ggggcgcagcacgcaggaac

SEQ ID NO: 381582 - DNA, 20 bp, human
gcgggagcgggatcaggtag

SEQ ID NO: 381583 - DNA, 20 bp, human
gcaggcaagggattaggtaa

SEQ ID NO: 381584 - DNA, 20 bp, human
gcgcaggaaccggaagtcaa

SEQ ID NO: 381585 - DNA, 20 bp, human
gcggcctgcactcggcggaa

SEQ ID NO: 381586 - DNA, 20 bp, human
gatgaattgcgagatggata

SEQ ID NO: 381587 - DNA, 20 bp, human
gaataggggtatcctctcat

SEQ ID NO: 381588 - DNA, 20 bp, human
gacttctaacagctctcccg

SEQ ID NO: 381589 - DNA, 20 bp, human
gagaaggagcttttgggtgt

SEQ ID NO: 381590 - DNA, 20 bp, human
gcataccatacataggtgga

SEQ ID NO: 381591 - DNA, 20 bp, human
gaggggtatcctctcatagg

SEQ ID NO: 381592 - DNA, 20 bp, human
ggctgctgctgtaggggcag

SEQ ID NO: 381593 - DNA, 20 bp, human
ggggaaaggctgtatcttaa

SEQ ID NO: 381594 - DNA, 20 bp, human
gcagctctcccggggctact

SEQ ID NO: 381595 - DNA, 20 bp, human
gaaggcatttggtatcagca

SEQ ID NO: 381596 - DNA, 20 bp, human
ggagggctcggactagacgc

SEQ ID NO: 381597 - DNA, 20 bp, human
gctcgggtcgcgctgtaccc

SEQ ID NO: 381598 - DNA, 20 bp, human
gccgcgggcgggatcatctc

SEQ ID NO: 381599 - DNA, 20 bp, human
gtctagtccgagccctcccg

SEQ ID NO: 381600 - DNA, 20 bp, human
ggatgatcccgcccgcggga

SEQ ID NO: 381601 - DNA, 20 bp, human
gggagtgtggcgtgtgggaa

SEQ ID NO: 381602 - DNA, 20 bp, human
gaacagagaggtaaacaacg

SEQ ID NO: 381603 - DNA, 20 bp, human
gaacaagtgacgcgttgcca

SEQ ID NO: 381604 - DNA, 20 bp, human
gacttcccggctgtacagtg

SEQ ID NO: 381605 - DNA, 20 bp, human
gtgccccgcgtcttcgcggt

SEQ ID NO: 381606 - DNA, 20 bp, human
gcctaccctaaaggcctccg

SEQ ID NO: 381607 - DNA, 20 bp, human
gggcctttagggtaggcgag

SEQ ID NO: 381608 - DNA, 20 bp, human
gcgcccctcgcctaccctaa

SEQ ID NO: 381609 - DNA, 20 bp, human
gcggacagggagagccccgt

SEQ ID NO: 381610 - DNA, 20 bp, human
gcggcgtcgggcggcgtccc

SEQ ID NO: 381611 - DNA, 20 bp, human
gcgaagcgggaaaggaggta

SEQ ID NO: 381612 - DNA, 20 bp, human
ggatgccccccacctctccc

SEQ ID NO: 381613 - DNA, 20 bp, human
gcgaagcgcccaggccgcgt

SEQ ID NO: 381614 - DNA, 20 bp, human
ggcggagagcgaagcgggaa

SEQ ID NO: 381615 - DNA, 20 bp, human
gcttcgcttggcaaccgcgg

SEQ ID NO: 381616 - DNA, 20 bp, human
gaccaaggaggtctcccgga

SEQ ID NO: 381617 - DNA, 20 bp, human
gagggaaacccgtcgggcgg

SEQ ID NO: 381618 - DNA, 20 bp, human
ggccaggagggaaacccgtc

SEQ ID NO: 381619 - DNA, 20 bp, human
ggccctccgggagacctcct

SEQ ID NO: 381620 - DNA, 20 bp, human
ggactggccagttataggag

SEQ ID NO: 381621 - DNA, 20 bp, human
gtggccagttataggagagg

SEQ ID NO: 381622 - DNA, 20 bp, human
ggagctgactggccagttat

SEQ ID NO: 381623 - DNA, 20 bp, human
ggcccgacgggtttccctcc

SEQ ID NO: 381624 - DNA, 20 bp, human
gccggctcgccggagctgac

SEQ ID NO: 381625 - DNA, 20 bp, human
gcgtcgggcggcggttacta

SEQ ID NO: 381626 - DNA, 20 bp, human
gcgctcagggtgaacaagac

SEQ ID NO: 381627 - DNA, 20 bp, human
gtcccctcgggggcagtctg

SEQ ID NO: 381628 - DNA, 20 bp, human
gccaggccaggtcccctcgg

SEQ ID NO: 381629 - DNA, 20 bp, human
ggactgcccccgaggggacc

SEQ ID NO: 381630 - DNA, 20 bp, human
gggaggggcattcagggtgg

SEQ ID NO: 381631 - DNA, 20 bp, human
gagggctgtggctgtcgtgt

SEQ ID NO: 381632 - DNA, 20 bp, human
gtgttgattgccccgaggcg

SEQ ID NO: 381633 - DNA, 20 bp, human
ggcctcagactgcccccgag

SEQ ID NO: 381634 - DNA, 20 bp, human
ggtggctgtcgtgtgggtgt

SEQ ID NO: 381635 - DNA, 20 bp, human
ggtgcggagctccgcgctca

SEQ ID NO: 381636 - DNA, 20 bp, human
gcctcccgcccagttgtaat

SEQ ID NO: 381637 - DNA, 20 bp, human
gtggggagagggactcttag

SEQ ID NO: 381638 - DNA, 20 bp, human
gcatcagctcagggacaatt

SEQ ID NO: 381639 - DNA, 20 bp, human
gcactggtgtcataaagcct

SEQ ID NO: 381640 - DNA, 20 bp, human
gggggcctttgctcacttac

SEQ ID NO: 381641 - DNA, 20 bp, human
gcctgagctgatgaattcac

SEQ ID NO: 381642 - DNA, 20 bp, human
gcttcttgcaaccgaatctg

SEQ ID NO: 381643 - DNA, 20 bp, human
gtggacaatatggctgcagc

SEQ ID NO: 381644 - DNA, 20 bp, human
ggtacaggagttactagtat

SEQ ID NO: 381645 - DNA, 20 bp, human
ggtccatctgaggtgaggca

SEQ ID NO: 381646 - DNA, 20 bp, human
ggaagcgcggccctgccctc

SEQ ID NO: 381647 - DNA, 20 bp, human
gaacccagctcgcagccacg

SEQ ID NO: 381648 - DNA, 20 bp, human
gtccccacgtggctgcgagc

SEQ ID NO: 381649 - DNA, 20 bp, human
gtctcagcgcgaatctgcgg

SEQ ID NO: 381650 - DNA, 20 bp, human
ggcctgacgcgtgagtgggg

SEQ ID NO: 381651 - DNA, 20 bp, human
gaggcgagaacccaccaccc

SEQ ID NO: 381652 - DNA, 20 bp, human
ggacggctgacatcactcca

SEQ ID NO: 381653 - DNA, 20 bp, human
gcctctggggcgggtctccg

SEQ ID NO: 381654 - DNA, 20 bp, human
gagcctggacgcgggagcgg

SEQ ID NO: 381655 - DNA, 20 bp, human
gggggcctgacgcgtgagtg

SEQ ID NO: 381656 - DNA, 20 bp, human
gaagtaagcaccgaccgagg

SEQ ID NO: 381657 - DNA, 20 bp, human
gacagcggcccagacagagg

SEQ ID NO: 381658 - DNA, 20 bp, human
gctcgggaaaggggctccga

SEQ ID NO: 381659 - DNA, 20 bp, human
gtcgtggctggggccggtcg

SEQ ID NO: 381660 - DNA, 20 bp, human
ggcgccggccggaccctagg

SEQ ID NO: 381661 - DNA, 20 bp, human
gccctctggcccagcgttag

SEQ ID NO: 381662 - DNA, 20 bp, human
ggccgccgagagatcggtga

SEQ ID NO: 381663 - DNA, 20 bp, human
gctgcctcctagggtccggc

SEQ ID NO: 381664 - DNA, 20 bp, human
ggccaggggaggctcccgag

SEQ ID NO: 381665 - DNA, 20 bp, human
ggccctcaccgatctctcgg

SEQ ID NO: 381666 - DNA, 20 bp, human
ggggacaactccagagttgg

SEQ ID NO: 381667 - DNA, 20 bp, human
gtcccagcagggtagatcct

SEQ ID NO: 381668 - DNA, 20 bp, human
gagggggagcaaaagatcac

SEQ ID NO: 381669 - DNA, 20 bp, human
gtggggccgggtgagaattc

SEQ ID NO: 381670 - DNA, 20 bp, human
gtgtgggacaactccagagt

SEQ ID NO: 381671 - DNA, 20 bp, human
gagtgtggtgtcccaggtgt

SEQ ID NO: 381672 - DNA, 20 bp, human
ggggcagaatctcaagacca

SEQ ID NO: 381673 - DNA, 20 bp, human
gctccagagttgggggagta

SEQ ID NO: 381674 - DNA, 20 bp, human
gtgggacaccacactctcca

SEQ ID NO: 381675 - DNA, 20 bp, human
gtcccaggatctaccctgct

SEQ ID NO: 381676 - DNA, 20 bp, human
gcatctggcagattcacaat

SEQ ID NO: 381677 - DNA, 20 bp, human
gagaggacaacgttgttcta

SEQ ID NO: 381678 - DNA, 20 bp, human
gcaaaaagataaatctaaga

SEQ ID NO: 381679 - DNA, 20 bp, human
gagagtgttattattgcctc

SEQ ID NO: 381680 - DNA, 20 bp, human
gaagacaggggctctgagta

SEQ ID NO: 381681 - DNA, 20 bp, human
ggtcctgataataccatcaa

SEQ ID NO: 381682 - DNA, 20 bp, human
gaggggctctgagtaaggga

SEQ ID NO: 381683 - DNA, 20 bp, human
gatgacatgaagctagccgg

SEQ ID NO: 381684 - DNA, 20 bp, human
gtagatgacatgaagctagc

SEQ ID NO: 381685 - DNA, 20 bp, human
gatcagatttgaaagtggtg

SEQ ID NO: 381686 - DNA, 20 bp, human
gttgcaaaagagattgtgca

SEQ ID NO: 381687 - DNA, 20 bp, human
gttcttgtaatcacagtctt

SEQ ID NO: 381688 - DNA, 20 bp, human
gtctggaataatggatgtaa

SEQ ID NO: 381689 - DNA, 20 bp, human
ggtatcgagttcttctattt

SEQ ID NO: 381690 - DNA, 20 bp, human
ggtgacaagtgccaaaactc

SEQ ID NO: 381691 - DNA, 20 bp, human
gacatccattattccagata

SEQ ID NO: 381692 - DNA, 20 bp, human
gtctatgctatagaaggctt

SEQ ID NO: 381693 - DNA, 20 bp, human
ggagagaatgtaattaaaga

SEQ ID NO: 381694 - DNA, 20 bp, human
gctgtttaatttaatagatt

SEQ ID NO: 381695 - DNA, 20 bp, human
ggagcatgaatcagaactga

SEQ ID NO: 381696 - DNA, 20 bp, human
ggtcctgctggtgacaactt

SEQ ID NO: 381697 - DNA, 20 bp, human
gctcagggttcaagtctcat

SEQ ID NO: 381698 - DNA, 20 bp, human
gagcctaagttgtcaccagc

SEQ ID NO: 381699 - DNA, 20 bp, human
gtaccatcccagattgagaa

SEQ ID NO: 381700 - DNA, 20 bp, human
gaccaagagcagacgagaga

SEQ ID NO: 381701 - DNA, 20 bp, human
gaagatacaaggtttgcatg

SEQ ID NO: 381702 - DNA, 20 bp, human
gtggtgacaacttaggctca

SEQ ID NO: 381703 - DNA, 20 bp, human
gtctcgtctgctcttggtca

SEQ ID NO: 381704 - DNA, 20 bp, human
gtcttggtcagggagcagta

SEQ ID NO: 381705 - DNA, 20 bp, human
gtacccttctcaatctggga

SEQ ID NO: 381706 - DNA, 20 bp, human
gtctgtgtgtaagagagcga

SEQ ID NO: 381707 - DNA, 20 bp, human
gggggcgccacgcaggtgat

SEQ ID NO: 381708 - DNA, 20 bp, human
gctcgccggcctcgtaggat

SEQ ID NO: 381709 - DNA, 20 bp, human
gccaaccccccagaagcctc

SEQ ID NO: 381710 - DNA, 20 bp, human
ggtgtaagagagcgagggtg

SEQ ID NO: 381711 - DNA, 20 bp, human
gcaggtgatgggcgcctctc

SEQ ID NO: 381712 - DNA, 20 bp, human
gaggttacatgaatgggagg

SEQ ID NO: 381713 - DNA, 20 bp, human
gagacagaggaaccgagact

SEQ ID NO: 381714 - DNA, 20 bp, human
ggcccccccgcgccggagtg

SEQ ID NO: 381715 - DNA, 20 bp, human
gtgggagcagggccgcactc

SEQ ID NO: 381716 - DNA, 20 bp, human
gcgggcaagacgacatgcca

SEQ ID NO: 381717 - DNA, 20 bp, human
gggtgcgggcggagactctc

SEQ ID NO: 381718 - DNA, 20 bp, human
gtagccagaggagacgaatt

SEQ ID NO: 381719 - DNA, 20 bp, human
ggccccagaaaaggcggcag

SEQ ID NO: 381720 - DNA, 20 bp, human
gcctagggacaggagaaaat

SEQ ID NO: 381721 - DNA, 20 bp, human
gggtagagggggaagcccta

SEQ ID NO: 381722 - DNA, 20 bp, human
gtggaagggcagcgagccga

SEQ ID NO: 381723 - DNA, 20 bp, human
gatctgagaagagacggtgc

SEQ ID NO: 381724 - DNA, 20 bp, human
ggacccctgccgccttttct

SEQ ID NO: 381725 - DNA, 20 bp, human
gaggagacgaatttggtaga

SEQ ID NO: 381726 - DNA, 20 bp, human
gaagctgtggcacttgcggt

SEQ ID NO: 381727 - DNA, 20 bp, human
gaggaggcggggcttgtcct

SEQ ID NO: 381728 - DNA, 20 bp, human
gtctccgtacacgtgtgggt

SEQ ID NO: 381729 - DNA, 20 bp, human
gggaggcaggactgcccttg

SEQ ID NO: 381730 - DNA, 20 bp, human
gagccccacccacacgtgta

SEQ ID NO: 381731 - DNA, 20 bp, human
gggcgggccaggcagaaaca

SEQ ID NO: 381732 - DNA, 20 bp, human
ggacgtgcgcgcggatctgg

SEQ ID NO: 381733 - DNA, 20 bp, human
gaggaagcgaggtcagtcta

SEQ ID NO: 381734 - DNA, 20 bp, human
gcggagccaggcggagcctt

SEQ ID NO: 381735 - DNA, 20 bp, human
gcgagacgtgcgcgcggatc

SEQ ID NO: 381736 - DNA, 20 bp, human
gaagccctgccctagactgg

SEQ ID NO: 381737 - DNA, 20 bp, human
gcggcggaagagactctccg

SEQ ID NO: 381738 - DNA, 20 bp, human
gacctgttccggcttctgat

SEQ ID NO: 381739 - DNA, 20 bp, human
gttcaagcctggcttctgat

SEQ ID NO: 381740 - DNA, 20 bp, human
gtgggcgagcggttcaagcc

SEQ ID NO: 381741 - DNA, 20 bp, human
gaacgcccagaggcaggaac

SEQ ID NO: 381742 - DNA, 20 bp, human
gttgccgccagtctagggca

SEQ ID NO: 381743 - DNA, 20 bp, human
gctcgcccatgtcccgccgg

SEQ ID NO: 381744 - DNA, 20 bp, human
gtgaatttgccgccagtcta

SEQ ID NO: 381745 - DNA, 20 bp, human
gcagggctttgtaggtaaac

SEQ ID NO: 381746 - DNA, 20 bp, human
gccgcccaggccggtgaacc

SEQ ID NO: 381747 - DNA, 20 bp, human
gccggccgcaatgcctcctg

SEQ ID NO: 381748 - DNA, 20 bp, human
gcaaaacccgccgggttcac

SEQ ID NO: 381749 - DNA, 20 bp, human
gcccaggccggtgaacccgg

SEQ ID NO: 381750 - DNA, 20 bp, human
ggaactacggcgtctgagaa

SEQ ID NO: 381751 - DNA, 20 bp, human
gttcaccggcctgggcggtg

SEQ ID NO: 381752 - DNA, 20 bp, human
gatggccgcgggagccggga

SEQ ID NO: 381753 - DNA, 20 bp, human
gaagtccacaccgcccaggc

SEQ ID NO: 381754 - DNA, 20 bp, human
ggccggcacatcgggaacta

SEQ ID NO: 381755 - DNA, 20 bp, human
gtcctcggctgtgacgccgc

SEQ ID NO: 381756 - DNA, 20 bp, human
gagggcccgacccaaaagta

SEQ ID NO: 381757 - DNA, 20 bp, human
gcgaagccccacctcttccg

SEQ ID NO: 381758 - DNA, 20 bp, human
ggcccgacccaaaagtaagg

SEQ ID NO: 381759 - DNA, 20 bp, human
gcggccgccatcttcccgga

SEQ ID NO: 381760 - DNA, 20 bp, human
ggccccctctcccccggaag

SEQ ID NO: 381761 - DNA, 20 bp, human
gccctctcccccggaagagg

SEQ ID NO: 381762 - DNA, 20 bp, human
ggggcactctcgatgcgccg

SEQ ID NO: 381763 - DNA, 20 bp, human
gccagactctcctaccgcaa

SEQ ID NO: 381764 - DNA, 20 bp, human
gaagatggcggccgtgcagg

SEQ ID NO: 381765 - DNA, 20 bp, human
gggggcttcgcaccttgacc

SEQ ID NO: 381766 - DNA, 20 bp, human
gcccacgtggcggagggact

SEQ ID NO: 381767 - DNA, 20 bp, human
ggggctcccagtggattcgc

SEQ ID NO: 381768 - DNA, 20 bp, human
gcaggaccgcgcttcccacg

SEQ ID NO: 381769 - DNA, 20 bp, human
gcggagcagctgcgctgtcg

SEQ ID NO: 381770 - DNA, 20 bp, human
ggaccgcgcttcccacgtgg

SEQ ID NO: 381771 - DNA, 20 bp, human
gcgcgcttcccacgtggcgg

SEQ ID NO: 381772 - DNA, 20 bp, human
gacccgggaggggtcgggac

SEQ ID NO: 381773 - DNA, 20 bp, human
gaggctgtggggtaacccga

SEQ ID NO: 381774 - DNA, 20 bp, human
gcggggccgcggaaaggaag

SEQ ID NO: 381775 - DNA, 20 bp, human
gctgctccgggcggacccgg

SEQ ID NO: 381776 - DNA, 20 bp, human
ggacgcccagagaatccctt

SEQ ID NO: 381777 - DNA, 20 bp, human
ggctggcaaggtgagaggcg

SEQ ID NO: 381778 - DNA, 20 bp, human
gtccgaggcggcgccctgct

SEQ ID NO: 381779 - DNA, 20 bp, human
gcccgagcgcggcgctggca

SEQ ID NO: 381780 - DNA, 20 bp, human
ggcccagcagggcgccgcct

SEQ ID NO: 381781 - DNA, 20 bp, human
gaccctgacctggtctccga

SEQ ID NO: 381782 - DNA, 20 bp, human
gcccttcggagaccaggtca

SEQ ID NO: 381783 - DNA, 20 bp, human
gccgggccgcaggcccgctg

SEQ ID NO: 381784 - DNA, 20 bp, human
gtgcggcgctcggtgattgg

SEQ ID NO: 381785 - DNA, 20 bp, human
gccggacccgggaacaaagg

SEQ ID NO: 381786 - DNA, 20 bp, human
ggagcactgctgcacgaacg

SEQ ID NO: 381787 - DNA, 20 bp, human
gaccccggagcccaccgctc

SEQ ID NO: 381788 - DNA, 20 bp, human
gcaggtgtgcggaagggacg

SEQ ID NO: 381789 - DNA, 20 bp, human
gcccggaaaccgccgggaag

SEQ ID NO: 381790 - DNA, 20 bp, human
gatccagcaggtgtgcggaa

SEQ ID NO: 381791 - DNA, 20 bp, human
gaacggggactccagagcgg

SEQ ID NO: 381792 - DNA, 20 bp, human
gggaggatgtaaggtgggat

SEQ ID NO: 381793 - DNA, 20 bp, human
gctaagatctggaggatgta

SEQ ID NO: 381794 - DNA, 20 bp, human
gcaggtgtgagcaaatttgg

SEQ ID NO: 381795 - DNA, 20 bp, human
gccccggcccggaaaccgcc

SEQ ID NO: 381796 - DNA, 20 bp, human
gaataacgggagggaattaa

SEQ ID NO: 381797 - DNA, 20 bp, human
gggaggagaggggactccct

SEQ ID NO: 381798 - DNA, 20 bp, human
gcgggggtgcgcacctgagg

SEQ ID NO: 381799 - DNA, 20 bp, human
gggccgcggagcctgatccc

SEQ ID NO: 381800 - DNA, 20 bp, human
gctcaacggacagtaaccca

SEQ ID NO: 381801 - DNA, 20 bp, human
ggcatcgcggccggaaagcg

SEQ ID NO: 381802 - DNA, 20 bp, human
gaggctccgcggcctgccgg

SEQ ID NO: 381803 - DNA, 20 bp, human
gcgggctggaaggagttaag

SEQ ID NO: 381804 - DNA, 20 bp, human
ggctggaaggagttaagcgg

SEQ ID NO: 381805 - DNA, 20 bp, human
gtgggctccagggaccaacg

SEQ ID NO: 381806 - DNA, 20 bp, human
gggaatgccacgtggtatga

SEQ ID NO: 381807 - DNA, 20 bp, human
ggactggctactctgaggga

SEQ ID NO: 381808 - DNA, 20 bp, human
gatgccacgtggtatgaggg

SEQ ID NO: 381809 - DNA, 20 bp, human
ggtatgagggtgggcacaat

SEQ ID NO: 381810 - DNA, 20 bp, human
gtagcgctaggaatgccacg

SEQ ID NO: 381811 - DNA, 20 bp, human
ggaggacgaagggaaccaat

SEQ ID NO: 381812 - DNA, 20 bp, human
gtgtgggaaaggcggaaccg

SEQ ID NO: 381813 - DNA, 20 bp, human
gtgcccaccctcataccacg

SEQ ID NO: 381814 - DNA, 20 bp, human
gaagcagtgtgtgggaaagg

SEQ ID NO: 381815 - DNA, 20 bp, human
ggccaactccggaggacgaa

SEQ ID NO: 381816 - DNA, 20 bp, human
ggggactgcatctacatgtg

SEQ ID NO: 381817 - DNA, 20 bp, human
gagacacggtgctcacaact

SEQ ID NO: 381818 - DNA, 20 bp, human
gtgagcaccgtgtctacgga

SEQ ID NO: 381819 - DNA, 20 bp, human
gggctcaggagactgagcga

SEQ ID NO: 381820 - DNA, 20 bp, human
ggtctcctgagccggagcaa

SEQ ID NO: 381821 - DNA, 20 bp, human
gacatcctttgctccggctc

SEQ ID NO: 381822 - DNA, 20 bp, human
ggacaaaccatccgtagaca

SEQ ID NO: 381823 - DNA, 20 bp, human
gaggagagctgtctgaaaat

SEQ ID NO: 381824 - DNA, 20 bp, human
gtcgtatcacacacttgaga

SEQ ID NO: 381825 - DNA, 20 bp, human
gtccgcttccccttttgagc

SEQ ID NO: 381826 - DNA, 20 bp, human
ggagaaggatccacccttgt

SEQ ID NO: 381827 - DNA, 20 bp, human
gggaaagtgcccaagatgtc

SEQ ID NO: 381828 - DNA, 20 bp, human
ggcagtgggcctgacatctt

SEQ ID NO: 381829 - DNA, 20 bp, human
gagttcctttcccacaaggg

SEQ ID NO: 381830 - DNA, 20 bp, human
ggagtccaggcatccagctt

SEQ ID NO: 381831 - DNA, 20 bp, human
gtgggcactttccaggttct

SEQ ID NO: 381832 - DNA, 20 bp, human
gggacaaataagtcttagag

SEQ ID NO: 381833 - DNA, 20 bp, human
ggctctgagaagtgtaggaa

SEQ ID NO: 381834 - DNA, 20 bp, human
gcacacccaagctggatgcc

SEQ ID NO: 381835 - DNA, 20 bp, human
ggtggaatggaattagttgc

SEQ ID NO: 381836 - DNA, 20 bp, human
gttgagagaggtggagaacg

SEQ ID NO: 381837 - DNA, 20 bp, human
gagggattccagctccagtt

SEQ ID NO: 381838 - DNA, 20 bp, human
gactgtgcagggtccagcga

SEQ ID NO: 381839 - DNA, 20 bp, human
gcacctctctacgtcttctt

SEQ ID NO: 381840 - DNA, 20 bp, human
gggtcgagagggagtcgagg

SEQ ID NO: 381841 - DNA, 20 bp, human
gacaccattgagcaatgtct

SEQ ID NO: 381842 - DNA, 20 bp, human
ggagctggatttacccaaac

SEQ ID NO: 381843 - DNA, 20 bp, human
ggtctctcgctcaactgtgc

SEQ ID NO: 381844 - DNA, 20 bp, human
gcgacctagacattgctcaa

SEQ ID NO: 381845 - DNA, 20 bp, human
gtggccctggacctcagtgg

SEQ ID NO: 381846 - DNA, 20 bp, human
ggcagcggcgagagcttggg

SEQ ID NO: 381847 - DNA, 20 bp, human
gcgcggcgctcgcgaggagg

SEQ ID NO: 381848 - DNA, 20 bp, human
ggggcgcgcagtggagacct

SEQ ID NO: 381849 - DNA, 20 bp, human
gggaggagagccggcggtag

SEQ ID NO: 381850 - DNA, 20 bp, human
ggtggcagcggcgagagctt

SEQ ID NO: 381851 - DNA, 20 bp, human
ggctaattccctgggagccg

SEQ ID NO: 381852 - DNA, 20 bp, human
ggacgtgacttgcatgcgag

SEQ ID NO: 381853 - DNA, 20 bp, human
gtgcggggggctaattccct

SEQ ID NO: 381854 - DNA, 20 bp, human
gcacctggggccgtacagcg

SEQ ID NO: 381855 - DNA, 20 bp, human
gcgcggccgccccgagacgc

SEQ ID NO: 381856 - DNA, 20 bp, human
ggccctgagtccatctgacc

SEQ ID NO: 381857 - DNA, 20 bp, human
gcctcaggggtgccggtcaa

SEQ ID NO: 381858 - DNA, 20 bp, human
gtccctgcttcataccactc

SEQ ID NO: 381859 - DNA, 20 bp, human
gtcagggccagtgtaccatg

SEQ ID NO: 381860 - DNA, 20 bp, human
gcacctgagtggtatgaagc

SEQ ID NO: 381861 - DNA, 20 bp, human
gtagctgccgtgagtcccca

SEQ ID NO: 381862 - DNA, 20 bp, human
gcagttgatggacctgttcc

SEQ ID NO: 381863 - DNA, 20 bp, human
gccgctggacccagtctgct

SEQ ID NO: 381864 - DNA, 20 bp, human
gagtgtaccatggggactca

SEQ ID NO: 381865 - DNA, 20 bp, human
gggtcagatgtgcacctgag

SEQ ID NO: 381866 - DNA, 20 bp, human
gctgctctgtgggaaccgga

SEQ ID NO: 381867 - DNA, 20 bp, human
gcagccgcgcgcaaccgggg

SEQ ID NO: 381868 - DNA, 20 bp, human
ggggtaccctcctctgtggg

SEQ ID NO: 381869 - DNA, 20 bp, human
gacagaggagggtaccccgc

SEQ ID NO: 381870 - DNA, 20 bp, human
gcggtaggccccgcccacag

SEQ ID NO: 381871 - DNA, 20 bp, human
gtggtgggcaggcaacttag

SEQ ID NO: 381872 - DNA, 20 bp, human
gcaggcaacttaggggatgt

SEQ ID NO: 381873 - DNA, 20 bp, human
gaggggccctgatttccggg

SEQ ID NO: 381874 - DNA, 20 bp, human
gaaagcgtggcgcataagtc

SEQ ID NO: 381875 - DNA, 20 bp, human
gcgcgcgcaaccggggaggc

SEQ ID NO: 381876 - DNA, 20 bp, human
gttgctcctgcccttgatcc

SEQ ID NO: 381877 - DNA, 20 bp, human
ggcactttgggaggcacctt

SEQ ID NO: 381878 - DNA, 20 bp, human
gccagcatataagaggcagg

SEQ ID NO: 381879 - DNA, 20 bp, human
gtcaatgaagcccggatcaa

SEQ ID NO: 381880 - DNA, 20 bp, human
gacacagcttaggctgctgt

SEQ ID NO: 381881 - DNA, 20 bp, human
ggggcattggctcttttaag

SEQ ID NO: 381882 - DNA, 20 bp, human
gggctcttttaagagggtca

SEQ ID NO: 381883 - DNA, 20 bp, human
gaagccagcatataagaggc

SEQ ID NO: 381884 - DNA, 20 bp, human
gcacaattgttgactataaa

SEQ ID NO: 381885 - DNA, 20 bp, human
gcactaattacatggggcat

SEQ ID NO: 381886 - DNA, 20 bp, human
ggaggaacgcggcacctcat

SEQ ID NO: 381887 - DNA, 20 bp, human
gaattcctggcaatctcgga

SEQ ID NO: 381888 - DNA, 20 bp, human
ggagggtgcgcatgctcgga

SEQ ID NO: 381889 - DNA, 20 bp, human
gaggctagggccactaaggt

SEQ ID NO: 381890 - DNA, 20 bp, human
gcgcaccctccgagattgcc

SEQ ID NO: 381891 - DNA, 20 bp, human
ggagtggcgggcaaaccggc

SEQ ID NO: 381892 - DNA, 20 bp, human
gacagcactcgaaaccccat

SEQ ID NO: 381893 - DNA, 20 bp, human
gttggtggatgcaaaagcat

SEQ ID NO: 381894 - DNA, 20 bp, human
ggaggcacgcaatggagggt

SEQ ID NO: 381895 - DNA, 20 bp, human
gctcggagggtgcgcatgct

SEQ ID NO: 381896 - DNA, 20 bp, human
gagactgggtcgcaaggctt

SEQ ID NO: 381897 - DNA, 20 bp, human
ggacaccgctagcgtcgcta

SEQ ID NO: 381898 - DNA, 20 bp, human
ggctccgtgacacagcgtaa

SEQ ID NO: 381899 - DNA, 20 bp, human
gtcagtcacttggtgagttc

SEQ ID NO: 381900 - DNA, 20 bp, human
gcgtaaaggccaagtgggag

SEQ ID NO: 381901 - DNA, 20 bp, human
gacgctagcggtgtcacgct

SEQ ID NO: 381902 - DNA, 20 bp, human
gcaggatctaaggtctagac

SEQ ID NO: 381903 - DNA, 20 bp, human
gaggtctagactgggtcgca

SEQ ID NO: 381904 - DNA, 20 bp, human
gcgccccctagcgacgctag

SEQ ID NO: 381905 - DNA, 20 bp, human
gcaagtgggagtggctttag

SEQ ID NO: 381906 - DNA, 20 bp, human
gaggctacggtggggaagtt

SEQ ID NO: 381907 - DNA, 20 bp, human
gaaaaagctgcctttccgtg

SEQ ID NO: 381908 - DNA, 20 bp, human
gtttccgtggggcctggctc

SEQ ID NO: 381909 - DNA, 20 bp, human
gtggctctgggaggctacgg

SEQ ID NO: 381910 - DNA, 20 bp, human
ggaaagagcgggagaaaacc

SEQ ID NO: 381911 - DNA, 20 bp, human
gcagcttagaatctcagcaa

SEQ ID NO: 381912 - DNA, 20 bp, human
gacacacaccggccttgctt

SEQ ID NO: 381913 - DNA, 20 bp, human
gacgagtattccaagtggag

SEQ ID NO: 381914 - DNA, 20 bp, human
gcggaaaggcagctttttcc

SEQ ID NO: 381915 - DNA, 20 bp, human
ggtttcacgagtattccaag

SEQ ID NO: 381916 - DNA, 20 bp, human
ggttgggagcccttaaaggt

SEQ ID NO: 381917 - DNA, 20 bp, human
gtcaagagggagggatacat

SEQ ID NO: 381918 - DNA, 20 bp, human
ggacccccctagaggttgaa

SEQ ID NO: 381919 - DNA, 20 bp, human
gcttaaaggtcggaagaaac

SEQ ID NO: 381920 - DNA, 20 bp, human
ggggacaaaccattgtcaag

SEQ ID NO: 381921 - DNA, 20 bp, human
gaggcccctgccactccatt

SEQ ID NO: 381922 - DNA, 20 bp, human
gcagagataccaggagtgga

SEQ ID NO: 381923 - DNA, 20 bp, human
gcccatgccaacggctagta

SEQ ID NO: 381924 - DNA, 20 bp, human
gcaaaccattgtcaagaggg

SEQ ID NO: 381925 - DNA, 20 bp, human
gctagtagggacccccctag

SEQ ID NO: 381926 - DNA, 20 bp, human
ggagtggtccggaaggactt

SEQ ID NO: 381927 - DNA, 20 bp, human
ggaaacaggagtggtccgga

SEQ ID NO: 381928 - DNA, 20 bp, human
gcatggtcgggagaccttga

SEQ ID NO: 381929 - DNA, 20 bp, human
ggggaacctgccacatggtc

SEQ ID NO: 381930 - DNA, 20 bp, human
gcaagggcaactgaggggtt

SEQ ID NO: 381931 - DNA, 20 bp, human
gtcctccaagggcaactgag

SEQ ID NO: 381932 - DNA, 20 bp, human
gaggcctctgccattccact

SEQ ID NO: 381933 - DNA, 20 bp, human
gtggcacaaaccattatgat

SEQ ID NO: 381934 - DNA, 20 bp, human
gagttgcccttggaggaaga

SEQ ID NO: 381935 - DNA, 20 bp, human
gggtctcccgaccatgtggc

SEQ ID NO: 381936 - DNA, 20 bp, human
gcaggctcacctgctaaccc

SEQ ID NO: 381937 - DNA, 20 bp, human
gggtgaagctggtgtctgcg

SEQ ID NO: 381938 - DNA, 20 bp, human
gacgtcttcccgcgcatcgc

SEQ ID NO: 381939 - DNA, 20 bp, human
gaggtgagcctgcgatgcgc

SEQ ID NO: 381940 - DNA, 20 bp, human
gagcgagggcgtgcggagtt

SEQ ID NO: 381941 - DNA, 20 bp, human
gaagactgaggcggcgctga

SEQ ID NO: 381942 - DNA, 20 bp, human
ggtcagacgtaaagcggaag

SEQ ID NO: 381943 - DNA, 20 bp, human
gccgctgtctccagcggtgc

SEQ ID NO: 381944 - DNA, 20 bp, human
gactgctgaggaactcctag

SEQ ID NO: 381945 - DNA, 20 bp, human
gacgctgtaaacatggacgt

SEQ ID NO: 381946 - DNA, 20 bp, human
ggtacagtggccaaaagatt

SEQ ID NO: 381947 - DNA, 20 bp, human
gcttgaacaaatggatctac

SEQ ID NO: 381948 - DNA, 20 bp, human
gtctctgaataactgtacag

SEQ ID NO: 381949 - DNA, 20 bp, human
gagagagcatgtcctttctg

SEQ ID NO: 381950 - DNA, 20 bp, human
gggtttcttgaaatgcacaa

SEQ ID NO: 381951 - DNA, 20 bp, human
gcctttctgtggaaataata

SEQ ID NO: 381952 - DNA, 20 bp, human
gtatagacaactattaatac

SEQ ID NO: 381953 - DNA, 20 bp, human
gccattttgtacatttccat

SEQ ID NO: 381954 - DNA, 20 bp, human
gtggcaaatactctttatta

SEQ ID NO: 381955 - DNA, 20 bp, human
gaactttcaattaaaattac

SEQ ID NO: 381956 - DNA, 20 bp, human
ggagggccatgtgcagcccc

SEQ ID NO: 381957 - DNA, 20 bp, human
gcctctgggggctggagatt

SEQ ID NO: 381958 - DNA, 20 bp, human
gtcaccagctccctccaagg

SEQ ID NO: 381959 - DNA, 20 bp, human
ggtgggtgctctccgtctgc

SEQ ID NO: 381960 - DNA, 20 bp, human
gaggacgtcgtgcccacgac

SEQ ID NO: 381961 - DNA, 20 bp, human
gacgacgggccagcaaccac

SEQ ID NO: 381962 - DNA, 20 bp, human
ggtgctctccgtctgcaggc

SEQ ID NO: 381963 - DNA, 20 bp, human
ggcatccagcctgtggttgc

SEQ ID NO: 381964 - DNA, 20 bp, human
gggatcacgttttacaaacg

SEQ ID NO: 381965 - DNA, 20 bp, human
ggcgaagagatgaaccacaa

SEQ ID NO: 381966 - DNA, 20 bp, human
ggcgcgcggtagaactggat

SEQ ID NO: 381967 - DNA, 20 bp, human
gcctcggcgcgcggtagaac

SEQ ID NO: 381968 - DNA, 20 bp, human
ggccgccaaccagagggcgc

SEQ ID NO: 381969 - DNA, 20 bp, human
gcggtagaactggattggtt

SEQ ID NO: 381970 - DNA, 20 bp, human
gcgcccttggagctagggag

SEQ ID NO: 381971 - DNA, 20 bp, human
gaggtgaggccgcggaaatg

SEQ ID NO: 381972 - DNA, 20 bp, human
ggccgccgccgccaaccaga

SEQ ID NO: 381973 - DNA, 20 bp, human
ggccaccgcccttggagcta

SEQ ID NO: 381974 - DNA, 20 bp, human
gtctaccgcgcgccgaggtg

SEQ ID NO: 381975 - DNA, 20 bp, human
gcaaccagagggcgcggggg

SEQ ID NO: 381976 - DNA, 20 bp, human
gcgtgctcccaaggggtgga

SEQ ID NO: 381977 - DNA, 20 bp, human
gcccggaagggcccgtgggg

SEQ ID NO: 381978 - DNA, 20 bp, human
ggctccgccgcgtgctccca

SEQ ID NO: 381979 - DNA, 20 bp, human
ggcaacggagcccagaacgc

SEQ ID NO: 381980 - DNA, 20 bp, human
gaccgccccacgggcccttc

SEQ ID NO: 381981 - DNA, 20 bp, human
ggggtccccggcgcatatcc

SEQ ID NO: 381982 - DNA, 20 bp, human
gcggccctgcgcccttcaag

SEQ ID NO: 381983 - DNA, 20 bp, human
ggacgcccggaagggcccgt

SEQ ID NO: 381984 - DNA, 20 bp, human
gcatcccccacccgccgcaa

SEQ ID NO: 381985 - DNA, 20 bp, human
ggggcggggcgacccaggac

SEQ ID NO: 381986 - DNA, 20 bp, human
ggagacaaggatcgggttcc

SEQ ID NO: 381987 - DNA, 20 bp, human
gtggcaggggcagaactccc

SEQ ID NO: 381988 - DNA, 20 bp, human
gaacctggccggcgcgggaa

SEQ ID NO: 381989 - DNA, 20 bp, human
gcacgcgtggaaacaggagt

SEQ ID NO: 381990 - DNA, 20 bp, human
gaacccgatccttgtctcca

SEQ ID NO: 381991 - DNA, 20 bp, human
gtcgccatggagacaaggat

SEQ ID NO: 381992 - DNA, 20 bp, human
ggagttctgcccctgccaag

SEQ ID NO: 381993 - DNA, 20 bp, human
gtgcccctgccaaggggtgc

SEQ ID NO: 381994 - DNA, 20 bp, human
ggaaatgcacgcgtggaaac

SEQ ID NO: 381995 - DNA, 20 bp, human
gcaaggggtgctggccacgc

SEQ ID NO: 381996 - DNA, 20 bp, human
gtccccgccccgcggacgac

SEQ ID NO: 381997 - DNA, 20 bp, human
gcgccgcccgccggagagga

SEQ ID NO: 381998 - DNA, 20 bp, human
ggatcccccgctccactgag

SEQ ID NO: 381999 - DNA, 20 bp, human
gcgaccaagcgcccatactg

SEQ ID NO: 382000 - DNA, 20 bp, human
gctagcgcgagcctggcccc

SEQ ID NO: 382001 - DNA, 20 bp, human
gggcggttggccctcctctc

SEQ ID NO: 382002 - DNA, 20 bp, human
gcccgcggacgacaggacga

SEQ ID NO: 382003 - DNA, 20 bp, human
ggtggagcgggggatcctgg

SEQ ID NO: 382004 - DNA, 20 bp, human
gacggtgcgccgccgccgag

SEQ ID NO: 382005 - DNA, 20 bp, human
gggaggcgggacggtgccca

SEQ ID NO: 382006 - DNA, 20 bp, human
ggccccagcgctggctgcgg

SEQ ID NO: 382007 - DNA, 20 bp, human
gctggctgcggcggaaccca

SEQ ID NO: 382008 - DNA, 20 bp, human
ggctccgccccctctcgcgg

SEQ ID NO: 382009 - DNA, 20 bp, human
gtccgccgcagccagcgctg

SEQ ID NO: 382010 - DNA, 20 bp, human
ggtgtgcctagccccagcgc

SEQ ID NO: 382011 - DNA, 20 bp, human
gcaaccggatagtttgttgg

SEQ ID NO: 382012 - DNA, 20 bp, human
gaggcgggaaggtacgccgt

SEQ ID NO: 382013 - DNA, 20 bp, human
gcgttgccatggagacgggg

SEQ ID NO: 382014 - DNA, 20 bp, human
ggccatgtcccgccgcgaga

SEQ ID NO: 382015 - DNA, 20 bp, human
gctagccccagcgctggctg

SEQ ID NO: 382016 - DNA, 20 bp, human
gatagcctgggctgttgtgg

SEQ ID NO: 382017 - DNA, 20 bp, human
gacaacagcccaggctatgg

SEQ ID NO: 382018 - DNA, 20 bp, human
gaccctgcccgccatagcct

SEQ ID NO: 382019 - DNA, 20 bp, human
gcctcctcaacaatcacacg

SEQ ID NO: 382020 - DNA, 20 bp, human
ggcccaggctatggcgggca

SEQ ID NO: 382021 - DNA, 20 bp, human
gttcgagtcagtcacgtcac

SEQ ID NO: 382022 - DNA, 20 bp, human
gccctccgcaagcaagtcaa

SEQ ID NO: 382023 - DNA, 20 bp, human
gcgtgcagctgcaaccgtaa

SEQ ID NO: 382024 - DNA, 20 bp, human
gcagctgcaaccgtaaaggt

SEQ ID NO: 382025 - DNA, 20 bp, human
gctcagggttctgagacggt

SEQ ID NO: 382026 - DNA, 20 bp, human
gacgctgctggggacaccat

SEQ ID NO: 382027 - DNA, 20 bp, human
gcagatgaacagatgtaggg

SEQ ID NO: 382028 - DNA, 20 bp, human
gactcagatgaacagatgta

SEQ ID NO: 382029 - DNA, 20 bp, human
gatgtagggagggagttcca

SEQ ID NO: 382030 - DNA, 20 bp, human
gacgcccacgtgacctcatg

SEQ ID NO: 382031 - DNA, 20 bp, human
gtccaggggcaagacgctgc

SEQ ID NO: 382032 - DNA, 20 bp, human
gtgggcgtcacacaggactt

SEQ ID NO: 382033 - DNA, 20 bp, human
gaggaaggaccgggacacaa

SEQ ID NO: 382034 - DNA, 20 bp, human
gtgcgtgtccaccttgacac

SEQ ID NO: 382035 - DNA, 20 bp, human
gaggaccgggacacaaagga

SEQ ID NO: 382036 - DNA, 20 bp, human
gtagtccgcgcgtacagccc

SEQ ID NO: 382037 - DNA, 20 bp, human
gggagtaacgaatcgactat

SEQ ID NO: 382038 - DNA, 20 bp, human
gcgcggactagcggagctag

SEQ ID NO: 382039 - DNA, 20 bp, human
gccgcgtgctactgaggcgg

SEQ ID NO: 382040 - DNA, 20 bp, human
gcgtccgcgtgctactgagg

SEQ ID NO: 382041 - DNA, 20 bp, human
ggagctaggggaaggtgcca

SEQ ID NO: 382042 - DNA, 20 bp, human
gctgggtgaggcggaaacgg

SEQ ID NO: 382043 - DNA, 20 bp, human
gcctgccccgccacagcgtt

SEQ ID NO: 382044 - DNA, 20 bp, human
gcgcgtacagccctgggatg

SEQ ID NO: 382045 - DNA, 20 bp, human
gatcgcgcctcggaatggag

SEQ ID NO: 382046 - DNA, 20 bp, human
ggctgataggcccacccgta

SEQ ID NO: 382047 - DNA, 20 bp, human
gcacacctggcatgtagtgg

SEQ ID NO: 382048 - DNA, 20 bp, human
gctcaactgacattctagag

SEQ ID NO: 382049 - DNA, 20 bp, human
gcaggagaaagccaggattg

SEQ ID NO: 382050 - DNA, 20 bp, human
ggcccacccgtagggaaaag

SEQ ID NO: 382051 - DNA, 20 bp, human
gagggctctgttacctcaga

SEQ ID NO: 382052 - DNA, 20 bp, human
gtgggcctatcagccctctg

SEQ ID NO: 382053 - DNA, 20 bp, human
ggcctcttttccctacgggt

SEQ ID NO: 382054 - DNA, 20 bp, human
gggagctcaaagcactaagt

SEQ ID NO: 382055 - DNA, 20 bp, human
gagaagaactagctctgtgt

SEQ ID NO: 382056 - DNA, 20 bp, human
gccactgagatgaggggttc

SEQ ID NO: 382057 - DNA, 20 bp, human
gtccacactgaggaggatca

SEQ ID NO: 382058 - DNA, 20 bp, human
gtcaccacagcttcaggcct

SEQ ID NO: 382059 - DNA, 20 bp, human
gtgaagctgtggtgacgctc

SEQ ID NO: 382060 - DNA, 20 bp, human
gagaaggaaagtccacactg

SEQ ID NO: 382061 - DNA, 20 bp, human
gaatgccaggacccacatgg

SEQ ID NO: 382062 - DNA, 20 bp, human
gaggcacgcgtcagaagcag

SEQ ID NO: 382063 - DNA, 20 bp, human
gtcagtggccgaagcccccc

SEQ ID NO: 382064 - DNA, 20 bp, human
gacgctctggaccaccatgt

SEQ ID NO: 382065 - DNA, 20 bp, human
gaaccgaccccacctcggac

SEQ ID NO: 382066 - DNA, 20 bp, human
gtggtcagctcagacaggta

SEQ ID NO: 382067 - DNA, 20 bp, human
gtgtgactccccagggtaag

SEQ ID NO: 382068 - DNA, 20 bp, human
gcctgtctgagctgaccaca

SEQ ID NO: 382069 - DNA, 20 bp, human
gagtggcaagaatcctccga

SEQ ID NO: 382070 - DNA, 20 bp, human
ggagtcttctaaaccctcgg

SEQ ID NO: 382071 - DNA, 20 bp, human
gtctctgaaaactaacaggt

SEQ ID NO: 382072 - DNA, 20 bp, human
gcgggtgcccattgttgtca

SEQ ID NO: 382073 - DNA, 20 bp, human
gtgtgccaggcaggtaagag

SEQ ID NO: 382074 - DNA, 20 bp, human
gttgcagctgtgactcccca

SEQ ID NO: 382075 - DNA, 20 bp, human
gactcctttgcccattgtga

SEQ ID NO: 382076 - DNA, 20 bp, human
ggtagagtatcggaaagcat

SEQ ID NO: 382077 - DNA, 20 bp, human
gaaggtaaatagagcccatg

SEQ ID NO: 382078 - DNA, 20 bp, human
gaggcctgggtggcagtctg

SEQ ID NO: 382079 - DNA, 20 bp, human
ggtgctgccaggattcatgt

SEQ ID NO: 382080 - DNA, 20 bp, human
gggacagggaactgacctgc

SEQ ID NO: 382081 - DNA, 20 bp, human
gacagggaccctcatcatac

SEQ ID NO: 382082 - DNA, 20 bp, human
gtcaaagacaggcgtggcag

SEQ ID NO: 382083 - DNA, 20 bp, human
gggcagtgggacacagcaac

SEQ ID NO: 382084 - DNA, 20 bp, human
ggagggtccctgtcattgtg

SEQ ID NO: 382085 - DNA, 20 bp, human
gggtgagtaggtggctgctt

SEQ ID NO: 382086 - DNA, 20 bp, human
gtgggttcaccataaggggt

SEQ ID NO: 382087 - DNA, 20 bp, human
gggacaatggcccttttctg

SEQ ID NO: 382088 - DNA, 20 bp, human
gtgaagtggtcctgggttaa

SEQ ID NO: 382089 - DNA, 20 bp, human
gtaggtgaaccagtctctga

SEQ ID NO: 382090 - DNA, 20 bp, human
gcccagtgaggaatgtaaca

SEQ ID NO: 382091 - DNA, 20 bp, human
gtctgtgggttcaccataag

SEQ ID NO: 382092 - DNA, 20 bp, human
gtaggtacagacaattcaat

SEQ ID NO: 382093 - DNA, 20 bp, human
gaggaggggacttcatccag

SEQ ID NO: 382094 - DNA, 20 bp, human
ggtcctgggttaatggaagg

SEQ ID NO: 382095 - DNA, 20 bp, human
gaacatccgtaagtacctga

SEQ ID NO: 382096 - DNA, 20 bp, human
gcgtggggatcagccaggat

SEQ ID NO: 382097 - DNA, 20 bp, human
gcagagacgcgggcctgaga

SEQ ID NO: 382098 - DNA, 20 bp, human
gaccctacacagtctcctcc

SEQ ID NO: 382099 - DNA, 20 bp, human
gtgcctggaggagactgtgt

SEQ ID NO: 382100 - DNA, 20 bp, human
gggagacgcgcagcccatcc

SEQ ID NO: 382101 - DNA, 20 bp, human
gcctctgcacacacattggc

SEQ ID NO: 382102 - DNA, 20 bp, human
gccagcctctgcacacacat

SEQ ID NO: 382103 - DNA, 20 bp, human
ggaatggcatctcgcgtgga

SEQ ID NO: 382104 - DNA, 20 bp, human
gtctcctccaggcagagacg

SEQ ID NO: 382105 - DNA, 20 bp, human
gcccggggaccctcggcctg

SEQ ID NO: 382106 - DNA, 20 bp, human
gcctgagagtgggaaggcgt

SEQ ID NO: 382107 - DNA, 20 bp, human
gcagcacagaacctgagagt

SEQ ID NO: 382108 - DNA, 20 bp, human
gggcgcgagcctctggcagc

SEQ ID NO: 382109 - DNA, 20 bp, human
gcgcccgggcgggaggcaac

SEQ ID NO: 382110 - DNA, 20 bp, human
ggcgggaggcaaccgggatg

SEQ ID NO: 382111 - DNA, 20 bp, human
gcgccgagtgctgcgagcaa

SEQ ID NO: 382112 - DNA, 20 bp, human
gtgggaaggcgtaggcgccc

SEQ ID NO: 382113 - DNA, 20 bp, human
gttgaaaagcacaacaggga

SEQ ID NO: 382114 - DNA, 20 bp, human
gaaggcgtaggcgcccgggc

SEQ ID NO: 382115 - DNA, 20 bp, human
ggcgtcgcagtcgccgaaga

SEQ ID NO: 382116 - DNA, 20 bp, human
gtcggtgccaggagcggcta

SEQ ID NO: 382117 - DNA, 20 bp, human
gagaaaatgaggtgatcagt

SEQ ID NO: 382118 - DNA, 20 bp, human
gcaggccgggaatggaataa

SEQ ID NO: 382119 - DNA, 20 bp, human
ggtgatcagtgggacgagta

SEQ ID NO: 382120 - DNA, 20 bp, human
gtcagtgggacgagtaagga

SEQ ID NO: 382121 - DNA, 20 bp, human
ggagacgacccgcgagtgga

SEQ ID NO: 382122 - DNA, 20 bp, human
gtgccaggagcggctacggc

SEQ ID NO: 382123 - DNA, 20 bp, human
ggagcgagccgcgatgacaa

SEQ ID NO: 382124 - DNA, 20 bp, human
gacacctggtggggagcaaa

SEQ ID NO: 382125 - DNA, 20 bp, human
gcccaggagcaggatttcga

SEQ ID NO: 382126 - DNA, 20 bp, human
gaatcacagcagatgaaaag

SEQ ID NO: 382127 - DNA, 20 bp, human
gaacccccaaaagatcagcc

SEQ ID NO: 382128 - DNA, 20 bp, human
ggggcaagaggactgaatgt

SEQ ID NO: 382129 - DNA, 20 bp, human
gctggaaaagtgggtggcac

SEQ ID NO: 382130 - DNA, 20 bp, human
gggtgtcagaaatgtgtcgt

SEQ ID NO: 382131 - DNA, 20 bp, human
gaaatagcactcagccaagg

SEQ ID NO: 382132 - DNA, 20 bp, human
ggtgcctggctgatcttttg

SEQ ID NO: 382133 - DNA, 20 bp, human
gccaaggaggctgacattag

SEQ ID NO: 382134 - DNA, 20 bp, human
ggttgatgatcagttcatga

SEQ ID NO: 382135 - DNA, 20 bp, human
gtgaactgatcatcaactcc

SEQ ID NO: 382136 - DNA, 20 bp, human
gtaagagccgcggagatgaa

SEQ ID NO: 382137 - DNA, 20 bp, human
gcgggagagcgtaccccggt

SEQ ID NO: 382138 - DNA, 20 bp, human
gccggtgggcggccttgcgg

SEQ ID NO: 382139 - DNA, 20 bp, human
ggaccccgaggtccgatcgg

SEQ ID NO: 382140 - DNA, 20 bp, human
gagagccctccgcaggctag

SEQ ID NO: 382141 - DNA, 20 bp, human
gcaatcctctagcctgcgga

SEQ ID NO: 382142 - DNA, 20 bp, human
gcgaagccagagccctccgc

SEQ ID NO: 382143 - DNA, 20 bp, human
gcgggccaggagggtgatgg

SEQ ID NO: 382144 - DNA, 20 bp, human
gccaacgccgggttggggtg

SEQ ID NO: 382145 - DNA, 20 bp, human
ggggggaggaataagagccg

SEQ ID NO: 382146 - DNA, 20 bp, human
gcccagccggagcgcacgga

SEQ ID NO: 382147 - DNA, 20 bp, human
ggaggacaatcagacctaaa

SEQ ID NO: 382148 - DNA, 20 bp, human
gcggagcccgcggccagaca

SEQ ID NO: 382149 - DNA, 20 bp, human
gagacctcgggatgcagcgg

SEQ ID NO: 382150 - DNA, 20 bp, human
gaccgcgtccgggcgctcgt

SEQ ID NO: 382151 - DNA, 20 bp, human
ggagagcccgagaggaggaa

SEQ ID NO: 382152 - DNA, 20 bp, human
gaaaaggctggggcagacct

SEQ ID NO: 382153 - DNA, 20 bp, human
ggaaggagggagagcccgag

SEQ ID NO: 382154 - DNA, 20 bp, human
gcgacccccgctgcatcccg

SEQ ID NO: 382155 - DNA, 20 bp, human
ggggccggggattccggatc

SEQ ID NO: 382156 - DNA, 20 bp, human
ggaggcctttatacctgtgt

SEQ ID NO: 382157 - DNA, 20 bp, human
gcgctccgacacaggtataa

SEQ ID NO: 382158 - DNA, 20 bp, human
gagcggccggcggcagattg

SEQ ID NO: 382159 - DNA, 20 bp, human
gcgctctagaagcaagttcg

SEQ ID NO: 382160 - DNA, 20 bp, human
gctcggagatctccctctaa

SEQ ID NO: 382161 - DNA, 20 bp, human
gtaggctgttggtaaagagc

SEQ ID NO: 382162 - DNA, 20 bp, human
gtcgcggcggagctcgagga

SEQ ID NO: 382163 - DNA, 20 bp, human
gtgtggtactggcgagcaat

SEQ ID NO: 382164 - DNA, 20 bp, human
gccgccggccgctccgacac

SEQ ID NO: 382165 - DNA, 20 bp, human
ggcaagttcgcggcgtagag

SEQ ID NO: 382166 - DNA, 20 bp, human
ggggagaggagcgtcggatt

SEQ ID NO: 382167 - DNA, 20 bp, human
gggtgtctgggtgtaaatac

SEQ ID NO: 382168 - DNA, 20 bp, human
gtaactatatgtgggtgtct

SEQ ID NO: 382169 - DNA, 20 bp, human
gccccatttccaattataga

SEQ ID NO: 382170 - DNA, 20 bp, human
gtgcgatgggagaggagcgt

SEQ ID NO: 382171 - DNA, 20 bp, human
gaacagatataagttgcgat

SEQ ID NO: 382172 - DNA, 20 bp, human
gcggaagagagtattttgaa

SEQ ID NO: 382173 - DNA, 20 bp, human
ggtgcttatataactatatg

SEQ ID NO: 382174 - DNA, 20 bp, human
gggaacatacatgaatagga

SEQ ID NO: 382175 - DNA, 20 bp, human
gtttatagtatatatgtctg

SEQ ID NO: 382176 - DNA, 20 bp, human
gtgacagccgaagacctgcg

SEQ ID NO: 382177 - DNA, 20 bp, human
ggacgaagcgcggagtcagt

SEQ ID NO: 382178 - DNA, 20 bp, human
gtgacagaaggaaggcgcgt

SEQ ID NO: 382179 - DNA, 20 bp, human
ggccgagccccacgctgtga

SEQ ID NO: 382180 - DNA, 20 bp, human
gcccaggcctcgcaggtctt

SEQ ID NO: 382181 - DNA, 20 bp, human
gtcggcgctgcgccaggccc

SEQ ID NO: 382182 - DNA, 20 bp, human
gtgcggggcggagctaggct

SEQ ID NO: 382183 - DNA, 20 bp, human
gcttcgtccctcacagcgtg

SEQ ID NO: 382184 - DNA, 20 bp, human
gctagctccgccccgcaccc

SEQ ID NO: 382185 - DNA, 20 bp, human
gaggtcttcggctgtcaacg

SEQ ID NO: 382186 - DNA, 20 bp, human
ggataagtccccacctcagt

SEQ ID NO: 382187 - DNA, 20 bp, human
ggaacctccagttccttatt

SEQ ID NO: 382188 - DNA, 20 bp, human
gaagcatcagcactgagaac

SEQ ID NO: 382189 - DNA, 20 bp, human
ggggaagtgttcattcctat

SEQ ID NO: 382190 - DNA, 20 bp, human
gatcagcactgagaactggg

SEQ ID NO: 382191 - DNA, 20 bp, human
ggtatagaaaagcatgataa

SEQ ID NO: 382192 - DNA, 20 bp, human
gaaggcagacaccccaatct

SEQ ID NO: 382193 - DNA, 20 bp, human
gtccagggagtggaaccaat

SEQ ID NO: 382194 - DNA, 20 bp, human
gtgggcaaaattgattcggg

SEQ ID NO: 382195 - DNA, 20 bp, human
ggaaaggcaaaatcaagcgg

SEQ ID NO: 382196 - DNA, 20 bp, human
gaggcggctctgatcaatgt

SEQ ID NO: 382197 - DNA, 20 bp, human
gtgcgagctgcgagcccaga

SEQ ID NO: 382198 - DNA, 20 bp, human
ggcgcccccgccactataac

SEQ ID NO: 382199 - DNA, 20 bp, human
gtggcagccgctggggaaaa

SEQ ID NO: 382200 - DNA, 20 bp, human
gtggcgggatcgggtagggt

SEQ ID NO: 382201 - DNA, 20 bp, human
ggctttggcgggatcgggta

SEQ ID NO: 382202 - DNA, 20 bp, human
gatcgggtagggtgggtagg

SEQ ID NO: 382203 - DNA, 20 bp, human
gatagagccaggcaaatgta

SEQ ID NO: 382204 - DNA, 20 bp, human
ggcagtggctttggcgggat

SEQ ID NO: 382205 - DNA, 20 bp, human
gccagcggctgccacagggg

SEQ ID NO: 382206 - DNA, 20 bp, human
ggccccctgcgccccgcgag

SEQ ID NO: 382207 - DNA, 20 bp, human
gactccgcggaaggaggccg

SEQ ID NO: 382208 - DNA, 20 bp, human
gcggggaccggctgcaaccg

SEQ ID NO: 382209 - DNA, 20 bp, human
gtacacacgcccggggaggc

SEQ ID NO: 382210 - DNA, 20 bp, human
ggcgtgaatggagcgagctg

SEQ ID NO: 382211 - DNA, 20 bp, human
gggtctgcaggcctctcgcg

SEQ ID NO: 382212 - DNA, 20 bp, human
gcagatgtctgtttcaaggc

SEQ ID NO: 382213 - DNA, 20 bp, human
gggccgcgggcgggcttgcg

SEQ ID NO: 382214 - DNA, 20 bp, human
gtgatcagatgtctgtttca

SEQ ID NO: 382215 - DNA, 20 bp, human
ggagctacatgcgccactat

SEQ ID NO: 382216 - DNA, 20 bp, human
gaccgcggacaggaaattcc

SEQ ID NO: 382217 - DNA, 20 bp, human
gccaccggaagcgatgaccg

SEQ ID NO: 382218 - DNA, 20 bp, human
ggggataggtctgaccaatg

SEQ ID NO: 382219 - DNA, 20 bp, human
gctaagtcctgccgcgagaa

SEQ ID NO: 382220 - DNA, 20 bp, human
gctcccccggctctcacagg

SEQ ID NO: 382221 - DNA, 20 bp, human
gacagggtggggtttttcgg

SEQ ID NO: 382222 - DNA, 20 bp, human
gggcttccgcctgtgagagc

SEQ ID NO: 382223 - DNA, 20 bp, human
gtggacagggtggggttttt

SEQ ID NO: 382224 - DNA, 20 bp, human
ggctctcccccggctctcac

SEQ ID NO: 382225 - DNA, 20 bp, human
gaccaatggggctgactccg

SEQ ID NO: 382226 - DNA, 20 bp, human
gaccgcggagcatagagcac

SEQ ID NO: 382227 - DNA, 20 bp, human
gggtcggtcgctctcctcaa

SEQ ID NO: 382228 - DNA, 20 bp, human
ggcggagcatagagcactgg

SEQ ID NO: 382229 - DNA, 20 bp, human
gcaaccatagagtacgagtc

SEQ ID NO: 382230 - DNA, 20 bp, human
ggccgcccgaggattgtgag

SEQ ID NO: 382231 - DNA, 20 bp, human
gtccctctgcgcacccctcg

SEQ ID NO: 382232 - DNA, 20 bp, human
gtgtccggactcgtactcta

SEQ ID NO: 382233 - DNA, 20 bp, human
gggctggcggcccgcgaccg

SEQ ID NO: 382234 - DNA, 20 bp, human
gtccagccggccagccgcga

SEQ ID NO: 382235 - DNA, 20 bp, human
ggattgtgagtggaccgttg

SEQ ID NO: 382236 - DNA, 20 bp, human
gatcgcccagcccatctcgg

SEQ ID NO: 382237 - DNA, 20 bp, human
gtctcggcagcgatgatagg

SEQ ID NO: 382238 - DNA, 20 bp, human
gacccggcgtgcaagtgtcc

SEQ ID NO: 382239 - DNA, 20 bp, human
gggcgatcacggggaggacc

SEQ ID NO: 382240 - DNA, 20 bp, human
gcagtctcggcagcgatgat

SEQ ID NO: 382241 - DNA, 20 bp, human
gagatgggctgggcgatcac

SEQ ID NO: 382242 - DNA, 20 bp, human
gggtgaccggaagtgatcgt

SEQ ID NO: 382243 - DNA, 20 bp, human
gtctgcccccgagatgggct

SEQ ID NO: 382244 - DNA, 20 bp, human
gagtccgccaggggtggagt

SEQ ID NO: 382245 - DNA, 20 bp, human
gtaagccgtggggttgagaa

SEQ ID NO: 382246 - DNA, 20 bp, human
gccggggcggccagaccaga

SEQ ID NO: 382247 - DNA, 20 bp, human
ggccagaccagagggctcta

SEQ ID NO: 382248 - DNA, 20 bp, human
gcggccctgggcgtagagtg

SEQ ID NO: 382249 - DNA, 20 bp, human
gtcgccggaaaggcacgcgc

SEQ ID NO: 382250 - DNA, 20 bp, human
gactcccgcgcgtgcctttc

SEQ ID NO: 382251 - DNA, 20 bp, human
ggggccgtgtggagcgggtt

SEQ ID NO: 382252 - DNA, 20 bp, human
gggctcggcgcatttatcgg

SEQ ID NO: 382253 - DNA, 20 bp, human
ggggcgcgccgaggacccag

SEQ ID NO: 382254 - DNA, 20 bp, human
gccggccggcaccgcgggtt

SEQ ID NO: 382255 - DNA, 20 bp, human
gcctccgggccgcgcttcct

SEQ ID NO: 382256 - DNA, 20 bp, human
gccagggcgcgcagcactgg

SEQ ID NO: 382257 - DNA, 20 bp, human
gcgcgtgcggagatgtagct

SEQ ID NO: 382258 - DNA, 20 bp, human
ggcgcgcggcgcggtgacgt

SEQ ID NO: 382259 - DNA, 20 bp, human
gaaggcgcgaaaaggcgcgc

SEQ ID NO: 382260 - DNA, 20 bp, human
gcgcggcgcggtgacgtggg

SEQ ID NO: 382261 - DNA, 20 bp, human
gccggcccgacgctcggcca

SEQ ID NO: 382262 - DNA, 20 bp, human
ggcgcgcgcactgcccgtcc

SEQ ID NO: 382263 - DNA, 20 bp, human
ggggcgccgaaggcgcgaaa

SEQ ID NO: 382264 - DNA, 20 bp, human
gatgtagctggggcctgcgc

SEQ ID NO: 382265 - DNA, 20 bp, human
ggtcacgccggcccgacgct

SEQ ID NO: 382266 - DNA, 20 bp, human
gcaaaagcaccacgagtttc

SEQ ID NO: 382267 - DNA, 20 bp, human
gcgagtttcagggggaaaag

SEQ ID NO: 382268 - DNA, 20 bp, human
gaagcaccacgagtttcagg

SEQ ID NO: 382269 - DNA, 20 bp, human
gtccaaagcagtcacaaagc

SEQ ID NO: 382270 - DNA, 20 bp, human
gagaaaactgtttagttaac

SEQ ID NO: 382271 - DNA, 20 bp, human
gaaaaatgcttaaagtaaaa

SEQ ID NO: 382272 - DNA, 20 bp, human
gtacatatcagagtatctgc

SEQ ID NO: 382273 - DNA, 20 bp, human
gaagcatttttattgcttct

SEQ ID NO: 382274 - DNA, 20 bp, human
gtgtataattcaaattatgc

SEQ ID NO: 382275 - DNA, 20 bp, human
gaaaagaaattgaaaagtgc

SEQ ID NO: 382276 - DNA, 20 bp, human
gccggcccggccaatccgtg

SEQ ID NO: 382277 - DNA, 20 bp, human
gccggccaatccgtggggag

SEQ ID NO: 382278 - DNA, 20 bp, human
gcaggcgtcgcacattctga

SEQ ID NO: 382279 - DNA, 20 bp, human
gcgggccggcagtgcgtgca

SEQ ID NO: 382280 - DNA, 20 bp, human
gggcgccgctccccacggat

SEQ ID NO: 382281 - DNA, 20 bp, human
gtcccccgcgcgagctttgg

SEQ ID NO: 382282 - DNA, 20 bp, human
ggcttccctttgagagtagg

SEQ ID NO: 382283 - DNA, 20 bp, human
gcgcctggcgccgctcccca

SEQ ID NO: 382284 - DNA, 20 bp, human
ggtaaacaaaccccgccccc

SEQ ID NO: 382285 - DNA, 20 bp, human
gttggccccctactctcaaa

SEQ ID NO: 382286 - DNA, 20 bp, human
gtgctgctgcgcacctcacg

SEQ ID NO: 382287 - DNA, 20 bp, human
gaaggcgtgaaaaggcacgc

SEQ ID NO: 382288 - DNA, 20 bp, human
gaaaggctgaaggcgtgaaa

SEQ ID NO: 382289 - DNA, 20 bp, human
ggtacgtggtgtgcagtacg

SEQ ID NO: 382290 - DNA, 20 bp, human
ggtgcgtggcataatgtgtg

SEQ ID NO: 382291 - DNA, 20 bp, human
ggtgcgcagcagcagggggg

SEQ ID NO: 382292 - DNA, 20 bp, human
gggcacgcaggcgcactgca

SEQ ID NO: 382293 - DNA, 20 bp, human
gccagcttcttgtgagacaa

SEQ ID NO: 382294 - DNA, 20 bp, human
gacgtggcgcatgttacgcc

SEQ ID NO: 382295 - DNA, 20 bp, human
gtattaagaggtagggccag

SEQ ID NO: 382296 - DNA, 20 bp, human
gggcagcgacaaataggcga

SEQ ID NO: 382297 - DNA, 20 bp, human
ggaagtgaccgcactgggga

SEQ ID NO: 382298 - DNA, 20 bp, human
gtggggatggatggcccgtc

SEQ ID NO: 382299 - DNA, 20 bp, human
gagggcggtcgtccggggtt

SEQ ID NO: 382300 - DNA, 20 bp, human
gcggaggcgtcgcttagggt

SEQ ID NO: 382301 - DNA, 20 bp, human
gtggccacgacccattagcg

SEQ ID NO: 382302 - DNA, 20 bp, human
gctaatgggtcgtggccaga

SEQ ID NO: 382303 - DNA, 20 bp, human
gacaggaagtgaccgcactg

SEQ ID NO: 382304 - DNA, 20 bp, human
gcgtccggggttaggttgag

SEQ ID NO: 382305 - DNA, 20 bp, human
gccggggttaggttgagggg

SEQ ID NO: 382306 - DNA, 20 bp, human
gtcagcggactaaggcttac

SEQ ID NO: 382307 - DNA, 20 bp, human
ggagaactacgcttcccagt

SEQ ID NO: 382308 - DNA, 20 bp, human
gaaatcccggcgtgcctagc

SEQ ID NO: 382309 - DNA, 20 bp, human
gcctcccagccgctctgcct

SEQ ID NO: 382310 - DNA, 20 bp, human
ggccctctgccgggcgcgga

SEQ ID NO: 382311 - DNA, 20 bp, human
ggggaaagaggctcttgact

SEQ ID NO: 382312 - DNA, 20 bp, human
gttctcgctgcagtcccgct

SEQ ID NO: 382313 - DNA, 20 bp, human
gggctgcaggttccttttag

SEQ ID NO: 382314 - DNA, 20 bp, human
ggatttgtagtcccgctcag

SEQ ID NO: 382315 - DNA, 20 bp, human
gttccctccgcgcccggcag

SEQ ID NO: 382316 - DNA, 20 bp, human
gcacaccccagaggtgtcac

SEQ ID NO: 382317 - DNA, 20 bp, human
ggcccccagtgacacctctg

SEQ ID NO: 382318 - DNA, 20 bp, human
ggcagcccctcactcgggat

SEQ ID NO: 382319 - DNA, 20 bp, human
gctccccccatcccgagtga

SEQ ID NO: 382320 - DNA, 20 bp, human
ggcctgaggccacaccccag

SEQ ID NO: 382321 - DNA, 20 bp, human
gtcggccagggcgggtgcag

SEQ ID NO: 382322 - DNA, 20 bp, human
ggcccctcactcgggatggg

SEQ ID NO: 382323 - DNA, 20 bp, human
gctcagggaaagggacaaga

SEQ ID NO: 382324 - DNA, 20 bp, human
gccgcgccccgggtgaggaa

SEQ ID NO: 382325 - DNA, 20 bp, human
ggatgaagcagcccctcact

SEQ ID NO: 382326 - DNA, 20 bp, human
gccaacaagagcttttactg

SEQ ID NO: 382327 - DNA, 20 bp, human
gaaaagagaagtggctcatt

SEQ ID NO: 382328 - DNA, 20 bp, human
ggttaattatggagccacaa

SEQ ID NO: 382329 - DNA, 20 bp, human
ggtgctctttctcaaattag

SEQ ID NO: 382330 - DNA, 20 bp, human
gtacatggttgttatcataa

SEQ ID NO: 382331 - DNA, 20 bp, human
gcaagataaaaattatcctg

SEQ ID NO: 382332 - DNA, 20 bp, human
gttactcctaaagtgacccc

SEQ ID NO: 382333 - DNA, 20 bp, human
ggcatatttcagataaagaa

SEQ ID NO: 382334 - DNA, 20 bp, human
gtggtaagaattgttaatta

SEQ ID NO: 382335 - DNA, 20 bp, human
ggaaattccaaccagggttc

SEQ ID NO: 382336 - DNA, 20 bp, human
gacctggattaaggtcaggt

SEQ ID NO: 382337 - DNA, 20 bp, human
gacaacagtggctcacgggg

SEQ ID NO: 382338 - DNA, 20 bp, human
ggtgaggtcatcttggctga

SEQ ID NO: 382339 - DNA, 20 bp, human
gacagagacgacatgtggtg

SEQ ID NO: 382340 - DNA, 20 bp, human
ggcctgccctataaaatccg

SEQ ID NO: 382341 - DNA, 20 bp, human
gcatggtcaagctacatgga

SEQ ID NO: 382342 - DNA, 20 bp, human
gatgagtaggacctggatta

SEQ ID NO: 382343 - DNA, 20 bp, human
gtggattaaggtcaggttgg

SEQ ID NO: 382344 - DNA, 20 bp, human
gtctgagaggccctcccgcc

SEQ ID NO: 382345 - DNA, 20 bp, human
gtagacatggtcaagctaca

SEQ ID NO: 382346 - DNA, 20 bp, human
gagcagggagagagtcaccc

SEQ ID NO: 382347 - DNA, 20 bp, human
gggaagaggtatcaccgagc

SEQ ID NO: 382348 - DNA, 20 bp, human
gtgacccaactctctgtcca

SEQ ID NO: 382349 - DNA, 20 bp, human
gcggaagcctcgcctgcaca

SEQ ID NO: 382350 - DNA, 20 bp, human
gaggctctaaccacagccct

SEQ ID NO: 382351 - DNA, 20 bp, human
gcccagcccttccaccgtgg

SEQ ID NO: 382352 - DNA, 20 bp, human
gtacaggccagcagatagca

SEQ ID NO: 382353 - DNA, 20 bp, human
gcaccgtggaggcgaagagg

SEQ ID NO: 382354 - DNA, 20 bp, human
ggctgtgccctgtgcaggcg

SEQ ID NO: 382355 - DNA, 20 bp, human
gaggtaagagactgctccca

SEQ ID NO: 382356 - DNA, 20 bp, human
gggttccgggtcctctactg

SEQ ID NO: 382357 - DNA, 20 bp, human
gtacaccaggccaggctagg

SEQ ID NO: 382358 - DNA, 20 bp, human
gcgctccccagtagaggacc

SEQ ID NO: 382359 - DNA, 20 bp, human
ggaactgacctctccccttt

SEQ ID NO: 382360 - DNA, 20 bp, human
gctgtctgggagcttgacaa

SEQ ID NO: 382361 - DNA, 20 bp, human
gcctggggctctcttgtcat

SEQ ID NO: 382362 - DNA, 20 bp, human
gtaagggcggattccagttc

SEQ ID NO: 382363 - DNA, 20 bp, human
gttgggagagaaaaactgtc

SEQ ID NO: 382364 - DNA, 20 bp, human
gtcagagctgcctgtctccg

SEQ ID NO: 382365 - DNA, 20 bp, human
gttttggcagcaagcggtaa

SEQ ID NO: 382366 - DNA, 20 bp, human
ggccgtcgcgcatgcgtcct

SEQ ID NO: 382367 - DNA, 20 bp, human
gtgtccacgcgcaataagga

SEQ ID NO: 382368 - DNA, 20 bp, human
ggccccgcgcatgcgtgcat

SEQ ID NO: 382369 - DNA, 20 bp, human
gagaacttgggctctgtacg

SEQ ID NO: 382370 - DNA, 20 bp, human
gcgcgacggcgcgaggcgca

SEQ ID NO: 382371 - DNA, 20 bp, human
ggcaggtgggggaagaacag

SEQ ID NO: 382372 - DNA, 20 bp, human
gggctctgtacgtggcaggt

SEQ ID NO: 382373 - DNA, 20 bp, human
gggtcgcgaagggcaaccga

SEQ ID NO: 382374 - DNA, 20 bp, human
gccccgatgcacgcatgcgc

SEQ ID NO: 382375 - DNA, 20 bp, human
ggaggtgcggcggtcgcgaa

SEQ ID NO: 382376 - DNA, 20 bp, human
gagggcagcgtgggacgcta

SEQ ID NO: 382377 - DNA, 20 bp, human
gtgggacgctacggcggata

SEQ ID NO: 382378 - DNA, 20 bp, human
ggccggctgggatcttagat

SEQ ID NO: 382379 - DNA, 20 bp, human
ggcagcgtgggacgctacgg

SEQ ID NO: 382380 - DNA, 20 bp, human
ggatatggctgcagagcggc

SEQ ID NO: 382381 - DNA, 20 bp, human
gcagggaggccgattccgcg

SEQ ID NO: 382382 - DNA, 20 bp, human
ggctgggatcttagatagga

SEQ ID NO: 382383 - DNA, 20 bp, human
gtcacagtacaaagcaggag

SEQ ID NO: 382384 - DNA, 20 bp, human
gggcggatatggctgcagag

SEQ ID NO: 382385 - DNA, 20 bp, human
gtgcaaggcctagaatagct

SEQ ID NO: 382386 - DNA, 20 bp, human
gatctctgaagccgactctg

SEQ ID NO: 382387 - DNA, 20 bp, human
gagtcggcttcagagatcac

SEQ ID NO: 382388 - DNA, 20 bp, human
gttagcaagtagctaaggta

SEQ ID NO: 382389 - DNA, 20 bp, human
ggagttgcagtgacctaaac

SEQ ID NO: 382390 - DNA, 20 bp, human
gatagcccaacttcctgttt

SEQ ID NO: 382391 - DNA, 20 bp, human
gagtgacctaaacaggaagt

SEQ ID NO: 382392 - DNA, 20 bp, human
gatagtgaattcaaataact

SEQ ID NO: 382393 - DNA, 20 bp, human
gttcagagatcactggcagt

SEQ ID NO: 382394 - DNA, 20 bp, human
gccaagttagcaagtagcta

SEQ ID NO: 382395 - DNA, 20 bp, human
gcttttttccccctagagtt

SEQ ID NO: 382396 - DNA, 20 bp, human
gtggactacaggagaaagtt

SEQ ID NO: 382397 - DNA, 20 bp, human
gctacaggagaaagtttggg

SEQ ID NO: 382398 - DNA, 20 bp, human
gcgctgcaaactgtgtaaga

SEQ ID NO: 382399 - DNA, 20 bp, human
gcatgaatcagccacccctc

SEQ ID NO: 382400 - DNA, 20 bp, human
ggggtggctgattcatgcac

SEQ ID NO: 382401 - DNA, 20 bp, human
gccctcagggcgtccccgtc

SEQ ID NO: 382402 - DNA, 20 bp, human
ggggaaatctgcaagctaga

SEQ ID NO: 382403 - DNA, 20 bp, human
gcggcagggtccgtagtcta

SEQ ID NO: 382404 - DNA, 20 bp, human
ggtccggccgacccccgccg

SEQ ID NO: 382405 - DNA, 20 bp, human
gtcaggctccgccccggcgg

SEQ ID NO: 382406 - DNA, 20 bp, human
gcgcgagagtgagacgtcat

SEQ ID NO: 382407 - DNA, 20 bp, human
gcggccaggaacatcgcgag

SEQ ID NO: 382408 - DNA, 20 bp, human
gtgatggagaccacggggag

SEQ ID NO: 382409 - DNA, 20 bp, human
ggaaacagtggtgcgcggag

SEQ ID NO: 382410 - DNA, 20 bp, human
gcgactaacgctagaaacag

SEQ ID NO: 382411 - DNA, 20 bp, human
gggcactaggcggagagagg

SEQ ID NO: 382412 - DNA, 20 bp, human
ggagtgtgatggagaccacg

SEQ ID NO: 382413 - DNA, 20 bp, human
gggtaagccgcgaggaggaa

SEQ ID NO: 382414 - DNA, 20 bp, human
gcactctcgcgccgttatag

SEQ ID NO: 382415 - DNA, 20 bp, human
gagtagctttgcctctataa

SEQ ID NO: 382416 - DNA, 20 bp, human
ggccacatgacgaggaccgg

SEQ ID NO: 382417 - DNA, 20 bp, human
gcagtggaggggcacggcct

SEQ ID NO: 382418 - DNA, 20 bp, human
gagacctaaggcctacgctg

SEQ ID NO: 382419 - DNA, 20 bp, human
gcagggagggccacatgacg

SEQ ID NO: 382420 - DNA, 20 bp, human
gacaacccctaggaaacctg

SEQ ID NO: 382421 - DNA, 20 bp, human
gcccactgtgggatcggcat

SEQ ID NO: 382422 - DNA, 20 bp, human
gagggccacatgacgaggac

SEQ ID NO: 382423 - DNA, 20 bp, human
ggggggctaacagttgtggt

SEQ ID NO: 382424 - DNA, 20 bp, human
gaagcctggatgggcggaac

SEQ ID NO: 382425 - DNA, 20 bp, human
gtggagcaggaggtgaagcc

SEQ ID NO: 382426 - DNA, 20 bp, human
gcgggcggggccctatgcgg

SEQ ID NO: 382427 - DNA, 20 bp, human
gcagcgggcggggccctatg

SEQ ID NO: 382428 - DNA, 20 bp, human
gcgggcgaggcgaaggccaa

SEQ ID NO: 382429 - DNA, 20 bp, human
gggaggctgccaggctacca

SEQ ID NO: 382430 - DNA, 20 bp, human
gccgcagcgccctccgcata

SEQ ID NO: 382431 - DNA, 20 bp, human
gagggtggaggaaggcgccg

SEQ ID NO: 382432 - DNA, 20 bp, human
ggggccaggctataaaccgc

SEQ ID NO: 382433 - DNA, 20 bp, human
gcaaggcagcaggtgccccg

SEQ ID NO: 382434 - DNA, 20 bp, human
gccccgaggagccgcgcgat

SEQ ID NO: 382435 - DNA, 20 bp, human
ggtgctctgacagatcgccc

SEQ ID NO: 382436 - DNA, 20 bp, human
gtggccacacgagtgccctc

SEQ ID NO: 382437 - DNA, 20 bp, human
gcctcctgagggcactcgtg

SEQ ID NO: 382438 - DNA, 20 bp, human
gcctcaggaggagtagacac

SEQ ID NO: 382439 - DNA, 20 bp, human
ggatcttgtctaaactgtgg

SEQ ID NO: 382440 - DNA, 20 bp, human
gcaagatcctcatgctccac

SEQ ID NO: 382441 - DNA, 20 bp, human
ggtgtggccagtggagcatg

SEQ ID NO: 382442 - DNA, 20 bp, human
gaaggagaaagggtagggtg

SEQ ID NO: 382443 - DNA, 20 bp, human
gatggggcactgcctcactg

SEQ ID NO: 382444 - DNA, 20 bp, human
ggaccaaagctctgtatctt

SEQ ID NO: 382445 - DNA, 20 bp, human
gcaaagctctgtatctttgg

SEQ ID NO: 382446 - DNA, 20 bp, human
gaagtccacgcctagtgaaa

SEQ ID NO: 382447 - DNA, 20 bp, human
gcaaacgcatgggcataaat

SEQ ID NO: 382448 - DNA, 20 bp, human
ggtagacattccttttcact

SEQ ID NO: 382449 - DNA, 20 bp, human
gtggccacatttatttctac

SEQ ID NO: 382450 - DNA, 20 bp, human
gtgggagatcaaatgacttc

SEQ ID NO: 382451 - DNA, 20 bp, human
gtggtcaaatgccataagtg

SEQ ID NO: 382452 - DNA, 20 bp, human
gttacggtcaccattcataa

SEQ ID NO: 382453 - DNA, 20 bp, human
gtgaaggtcacaaatgcatc

SEQ ID NO: 382454 - DNA, 20 bp, human
gttggagagaatgagattta

SEQ ID NO: 382455 - DNA, 20 bp, human
gcattccttttcactaggcg

SEQ ID NO: 382456 - DNA, 20 bp, human
gggggtcgcccggatggtag

SEQ ID NO: 382457 - DNA, 20 bp, human
gcacctggcggaccaggcaa

SEQ ID NO: 382458 - DNA, 20 bp, human
gggaccaggcaagggcggaa

SEQ ID NO: 382459 - DNA, 20 bp, human
gctagtgggcgggcagaaac

SEQ ID NO: 382460 - DNA, 20 bp, human
gccccgcccagcccgctagt

SEQ ID NO: 382461 - DNA, 20 bp, human
gggtccgccaggtgcaattg

SEQ ID NO: 382462 - DNA, 20 bp, human
gcgcccggatggtaggggta

SEQ ID NO: 382463 - DNA, 20 bp, human
gcccggaaatgccaccacta

SEQ ID NO: 382464 - DNA, 20 bp, human
gcgaccccaattgcacctgg

SEQ ID NO: 382465 - DNA, 20 bp, human
ggagcgaggcgcgtcgcaaa

SEQ ID NO: 382466 - DNA, 20 bp, human
gccgccgggcggaaatagga

SEQ ID NO: 382467 - DNA, 20 bp, human
ggcacggcgctggcagtcgg

SEQ ID NO: 382468 - DNA, 20 bp, human
gtgccagcgccgtgcggcag

SEQ ID NO: 382469 - DNA, 20 bp, human
gctgtgccccggtcgccgag

SEQ ID NO: 382470 - DNA, 20 bp, human
gcacccgttacctacaccga

SEQ ID NO: 382471 - DNA, 20 bp, human
gctgcccgccgggcggaaat

SEQ ID NO: 382472 - DNA, 20 bp, human
gacccccatcggggcgggag

SEQ ID NO: 382473 - DNA, 20 bp, human
gccaccctctgtgccctcag

SEQ ID NO: 382474 - DNA, 20 bp, human
gcccccctcccgccccgatg

SEQ ID NO: 382475 - DNA, 20 bp, human
gccgggcggaaataggaagg

SEQ ID NO: 382476 - DNA, 20 bp, human
gcggccaagcgccaccaaag

SEQ ID NO: 382477 - DNA, 20 bp, human
gagcccgcccacgcgagatg

SEQ ID NO: 382478 - DNA, 20 bp, human
gcccgcgggcggctcagagc

SEQ ID NO: 382479 - DNA, 20 bp, human
gcgcccacgcgagatgagga

SEQ ID NO: 382480 - DNA, 20 bp, human
gcggagaaggcttaatccgg

SEQ ID NO: 382481 - DNA, 20 bp, human
gcccgtccggggcacccccc

SEQ ID NO: 382482 - DNA, 20 bp, human
gcggctccgccccgcaaaca

SEQ ID NO: 382483 - DNA, 20 bp, human
gaggcagcaccctgtttgcg

SEQ ID NO: 382484 - DNA, 20 bp, human
ggcccccagggggagggcat

SEQ ID NO: 382485 - DNA, 20 bp, human
gtcaccagagaaagaggacc

SEQ ID NO: 382486 - DNA, 20 bp, human
ggacccgctgagatggggat

SEQ ID NO: 382487 - DNA, 20 bp, human
gaacgggggaacccgaggtg

SEQ ID NO: 382488 - DNA, 20 bp, human
gatgggggggcgatgaacgg

SEQ ID NO: 382489 - DNA, 20 bp, human
gagccgggacccgctgagat

SEQ ID NO: 382490 - DNA, 20 bp, human
gccgctgagatggggatggg

SEQ ID NO: 382491 - DNA, 20 bp, human
ggggatgggggggcgatgaa

SEQ ID NO: 382492 - DNA, 20 bp, human
gtgtaagtctccctagggag

SEQ ID NO: 382493 - DNA, 20 bp, human
gtggaaaggagggagcgccc

SEQ ID NO: 382494 - DNA, 20 bp, human
gtctccctagggagcggctc

SEQ ID NO: 382495 - DNA, 20 bp, human
gcgtgtctgtaagtctccct

SEQ ID NO: 382496 - DNA, 20 bp, human
gagctctccccgaaccgttg

SEQ ID NO: 382497 - DNA, 20 bp, human
gtgaggaccgctgtgggtaa

SEQ ID NO: 382498 - DNA, 20 bp, human
gtggaaatgaggaccgctgt

SEQ ID NO: 382499 - DNA, 20 bp, human
gtcgtggtctaagtaacgag

SEQ ID NO: 382500 - DNA, 20 bp, human
gggggtgaacgcaaccgcga

SEQ ID NO: 382501 - DNA, 20 bp, human
gcccagccagggtgtcgcaa

SEQ ID NO: 382502 - DNA, 20 bp, human
gggtcagcgcgcgcccgcca

SEQ ID NO: 382503 - DNA, 20 bp, human
gagggcgctcggtactcggt

SEQ ID NO: 382504 - DNA, 20 bp, human
ggcaacgtggagtaaccaag

SEQ ID NO: 382505 - DNA, 20 bp, human
gtcgcagggcgctcggtact

SEQ ID NO: 382506 - DNA, 20 bp, human
gtaacatcgtgcagcaaaag

SEQ ID NO: 382507 - DNA, 20 bp, human
gagggcgcgggacccggtag

SEQ ID NO: 382508 - DNA, 20 bp, human
gcaaaagaggctgcgtgcgc

SEQ ID NO: 382509 - DNA, 20 bp, human
gcgggaccgggggaccagga

SEQ ID NO: 382510 - DNA, 20 bp, human
gtggcaggagtgattccaag

SEQ ID NO: 382511 - DNA, 20 bp, human
gccggggcagggtccgcaga

SEQ ID NO: 382512 - DNA, 20 bp, human
gctccctcccatgacgtctc

SEQ ID NO: 382513 - DNA, 20 bp, human
gcggactgacagctggcgag

SEQ ID NO: 382514 - DNA, 20 bp, human
gcaggagggagagtagacgc

SEQ ID NO: 382515 - DNA, 20 bp, human
gggccagagacgtcatggga

SEQ ID NO: 382516 - DNA, 20 bp, human
ggggccggcccgtgcaagga

SEQ ID NO: 382517 - DNA, 20 bp, human
ggggagggagcggacgccag

SEQ ID NO: 382518 - DNA, 20 bp, human
gcaggggcgcacgggttggg

SEQ ID NO: 382519 - DNA, 20 bp, human
ggcacagtgcgggagcgggt

SEQ ID NO: 382520 - DNA, 20 bp, human
gcggcccgccctccttgcac

SEQ ID NO: 382521 - DNA, 20 bp, human
gagggcagccaggggcgcac

SEQ ID NO: 382522 - DNA, 20 bp, human
ggtagcctcaagatcagtga

SEQ ID NO: 382523 - DNA, 20 bp, human
gttgaggaagactgtggcga

SEQ ID NO: 382524 - DNA, 20 bp, human
gtaagtaagctgcgagcggg

SEQ ID NO: 382525 - DNA, 20 bp, human
gaggttaagtaagctgcgag

SEQ ID NO: 382526 - DNA, 20 bp, human
gggtacatctacaggtggag

SEQ ID NO: 382527 - DNA, 20 bp, human
gagcacggtacatctacagg

SEQ ID NO: 382528 - DNA, 20 bp, human
ggaaggagggatggcctctg

SEQ ID NO: 382529 - DNA, 20 bp, human
gtctacaggtggagaggacg

SEQ ID NO: 382530 - DNA, 20 bp, human
gtgtgggaaagcccaaagac

SEQ ID NO: 382531 - DNA, 20 bp, human
ggagagcacggtacatctac

SEQ ID NO: 382532 - DNA, 20 bp, human
gtagttgagttcacgtagac

SEQ ID NO: 382533 - DNA, 20 bp, human
gccgtgctctctgtcagaga

SEQ ID NO: 382534 - DNA, 20 bp, human
gccaaagacaggctgtttct

SEQ ID NO: 382535 - DNA, 20 bp, human
gttgagagtggtagggctgc

SEQ ID NO: 382536 - DNA, 20 bp, human
gggcgctcgcggctgcggat

SEQ ID NO: 382537 - DNA, 20 bp, human
gcacgccccacgctccccgg

SEQ ID NO: 382538 - DNA, 20 bp, human
gccagcccccggggagcgtg

SEQ ID NO: 382539 - DNA, 20 bp, human
gccccggcccgatcggctcc

SEQ ID NO: 382540 - DNA, 20 bp, human
gaaaccggcgctcgcggctg

SEQ ID NO: 382541 - DNA, 20 bp, human
gaccccagccccggcccgat

SEQ ID NO: 382542 - DNA, 20 bp, human
ggccgccgcgagctgccaag

SEQ ID NO: 382543 - DNA, 20 bp, human
gtcggagccgggagccgatc

SEQ ID NO: 382544 - DNA, 20 bp, human
gggccagaaaccggcgctcg

SEQ ID NO: 382545 - DNA, 20 bp, human
gggagggccgggtagagcga

SEQ ID NO: 382546 - DNA, 20 bp, human
ggtgaggggcagctgaaagt

SEQ ID NO: 382547 - DNA, 20 bp, human
gggcagctacgagagagcta

SEQ ID NO: 382548 - DNA, 20 bp, human
ggggctggacgtcgaggaga

SEQ ID NO: 382549 - DNA, 20 bp, human
gggagagggagaaggctctc

SEQ ID NO: 382550 - DNA, 20 bp, human
gctacgagagagctaggggc

SEQ ID NO: 382551 - DNA, 20 bp, human
gaggaactcctgagtggtgt

SEQ ID NO: 382552 - DNA, 20 bp, human
gggagcgaggaactcctgag

SEQ ID NO: 382553 - DNA, 20 bp, human
gactcctgagtggtgtggga

SEQ ID NO: 382554 - DNA, 20 bp, human
gaaggctctcgggcggagag

SEQ ID NO: 382555 - DNA, 20 bp, human
gccagcccctccgagagctt

SEQ ID NO: 382556 - DNA, 20 bp, human
ggggaggaggagtttctggg

SEQ ID NO: 382557 - DNA, 20 bp, human
gcggccgagagcccccggtg

SEQ ID NO: 382558 - DNA, 20 bp, human
gcccgcccgcgtgtgtgcga

SEQ ID NO: 382559 - DNA, 20 bp, human
gcatcagccgcggaggcaaa

SEQ ID NO: 382560 - DNA, 20 bp, human
gcacacacgcgggcggggac

SEQ ID NO: 382561 - DNA, 20 bp, human
gtcgtcccgaagggaagcac

SEQ ID NO: 382562 - DNA, 20 bp, human
ggggaagcgcgagggagacg

SEQ ID NO: 382563 - DNA, 20 bp, human
gccccgcgcgctgattgctg

SEQ ID NO: 382564 - DNA, 20 bp, human
ggccgcggaggcaaaggggg

SEQ ID NO: 382565 - DNA, 20 bp, human
gcgagcctgtgcttcccttc

SEQ ID NO: 382566 - DNA, 20 bp, human
gagggcttcgccagcttcgg

SEQ ID NO: 382567 - DNA, 20 bp, human
ggtgctgtcaccaacgagga

SEQ ID NO: 382568 - DNA, 20 bp, human
gaggcggctcccctttctaa

SEQ ID NO: 382569 - DNA, 20 bp, human
ggggcggaagagaagcggtg

SEQ ID NO: 382570 - DNA, 20 bp, human
gaagaggataccctcccaag

SEQ ID NO: 382571 - DNA, 20 bp, human
ggaagcgtctcagatcttgg

SEQ ID NO: 382572 - DNA, 20 bp, human
ggagcggggtcctggtaaaa

SEQ ID NO: 382573 - DNA, 20 bp, human
gaagctggcgaagccctccc

SEQ ID NO: 382574 - DNA, 20 bp, human
gcacctatctccccttagaa

SEQ ID NO: 382575 - DNA, 20 bp, human
gcccctttctaaggggagat

SEQ ID NO: 382576 - DNA, 20 bp, human
ggccgcctggctccgagcac

SEQ ID NO: 382577 - DNA, 20 bp, human
gtctcctggtggggcaccgg

SEQ ID NO: 382578 - DNA, 20 bp, human
ggtgccccaccaggagacga

SEQ ID NO: 382579 - DNA, 20 bp, human
gggcggaaggtgttcattcg

SEQ ID NO: 382580 - DNA, 20 bp, human
gtccctgaagctccccgcag

SEQ ID NO: 382581 - DNA, 20 bp, human
ggggtcccggtcaatcccta

SEQ ID NO: 382582 - DNA, 20 bp, human
gtccgagcacaggccgagac

SEQ ID NO: 382583 - DNA, 20 bp, human
ggccgcctgaccacgcgggc

SEQ ID NO: 382584 - DNA, 20 bp, human
gcccggagcagggcccgtct

SEQ ID NO: 382585 - DNA, 20 bp, human
gcaggagacgaaggcatggt

SEQ ID NO: 382586 - DNA, 20 bp, human
gcccgagggacgagtgacag

SEQ ID NO: 382587 - DNA, 20 bp, human
ggcgctcggtccagtcttcc

SEQ ID NO: 382588 - DNA, 20 bp, human
ggggggcggcggtgcggacg

SEQ ID NO: 382589 - DNA, 20 bp, human
ggtcactcgtccctcggggg

SEQ ID NO: 382590 - DNA, 20 bp, human
ggtctcgtgcggctagagca

SEQ ID NO: 382591 - DNA, 20 bp, human
gtgcccccaccgccgggcga

SEQ ID NO: 382592 - DNA, 20 bp, human
gagcgacagtgggaggtcgg

SEQ ID NO: 382593 - DNA, 20 bp, human
gaaagctgcgagttccggac

SEQ ID NO: 382594 - DNA, 20 bp, human
ggcggaaaggatcgtgtttc

SEQ ID NO: 382595 - DNA, 20 bp, human
ggccgctgtcactcgtccct

SEQ ID NO: 382596 - DNA, 20 bp, human
gcatggcctacccatagcgg

SEQ ID NO: 382597 - DNA, 20 bp, human
gcgcctactgtgctccttgc

SEQ ID NO: 382598 - DNA, 20 bp, human
gtgggcggggcgaagcccct

SEQ ID NO: 382599 - DNA, 20 bp, human
gctgcatggcctacccatag

SEQ ID NO: 382600 - DNA, 20 bp, human
gggagaggggatctgacgtc

SEQ ID NO: 382601 - DNA, 20 bp, human
gcccctccgggcgcgctggg

SEQ ID NO: 382602 - DNA, 20 bp, human
ggaggctcccaccgccgcta

SEQ ID NO: 382603 - DNA, 20 bp, human
ggaaacgccctccacgagga

SEQ ID NO: 382604 - DNA, 20 bp, human
gggcctacccatagcggcgg

SEQ ID NO: 382605 - DNA, 20 bp, human
ggggagaagcgcgtagtctc

SEQ ID NO: 382606 - DNA, 20 bp, human
ggggagaagcgcgtagtctc

SEQ ID NO: 382607 - DNA, 20 bp, human
gtacgcgcttctcccgcggg

SEQ ID NO: 382608 - DNA, 20 bp, human
ggggcggccaacatggagtc

SEQ ID NO: 382609 - DNA, 20 bp, human
gcggccgagagtgacagctg

SEQ ID NO: 382610 - DNA, 20 bp, human
gcgcgaacaaactttctccg

SEQ ID NO: 382611 - DNA, 20 bp, human
gagccccgaactgccggagt

SEQ ID NO: 382612 - DNA, 20 bp, human
gaactcgcgcgggctcccca

SEQ ID NO: 382613 - DNA, 20 bp, human
gtcaccttcggcctgcccga

SEQ ID NO: 382614 - DNA, 20 bp, human
gccggagcgggggggccctg

SEQ ID NO: 382615 - DNA, 20 bp, human
gggtgatccaagcctcccgc

SEQ ID NO: 382616 - DNA, 20 bp, human
gtagttacactcttttattg

SEQ ID NO: 382617 - DNA, 20 bp, human
gtggcacaatggcggcatct

SEQ ID NO: 382618 - DNA, 20 bp, human
gtccaggaagtgtaggggag

SEQ ID NO: 382619 - DNA, 20 bp, human
gaacatggaagaatggaaga

SEQ ID NO: 382620 - DNA, 20 bp, human
gaatagagttcgtcagttag

SEQ ID NO: 382621 - DNA, 20 bp, human
gtaccagagtaaaatcaaat

SEQ ID NO: 382622 - DNA, 20 bp, human
gggggcagcgtggagaagaa

SEQ ID NO: 382623 - DNA, 20 bp, human
gttcgtcagttagtggaaac

SEQ ID NO: 382624 - DNA, 20 bp, human
gaagaactccaggaagtgta

SEQ ID NO: 382625 - DNA, 20 bp, human
gtgcgtgaaatcaagtgcat

SEQ ID NO: 382626 - DNA, 20 bp, human
gaccagtttccactaactga

SEQ ID NO: 382627 - DNA, 20 bp, human
gcaaataggaagaaagtgat

SEQ ID NO: 382628 - DNA, 20 bp, human
gtccaggaagtgtaggggag

SEQ ID NO: 382629 - DNA, 20 bp, human
gaacatggaagaatggaaga

SEQ ID NO: 382630 - DNA, 20 bp, human
gaagaactccaggaagtgta

SEQ ID NO: 382631 - DNA, 20 bp, human
gtccgtcagttagtggaaac

SEQ ID NO: 382632 - DNA, 20 bp, human
gaatagagtccgtcagttag

SEQ ID NO: 382633 - DNA, 20 bp, human
gggggcagcgtggagaagaa

SEQ ID NO: 382634 - DNA, 20 bp, human
gtaccagagtaaaatcaaat

SEQ ID NO: 382635 - DNA, 20 bp, human
gtgcgtgaaatgaagtgcat

SEQ ID NO: 382636 - DNA, 20 bp, human
ggtgccaggggccatcacag

SEQ ID NO: 382637 - DNA, 20 bp, human
gccaggggccatcacagcgg

SEQ ID NO: 382638 - DNA, 20 bp, human
gaggcctctgggcgggaaat

SEQ ID NO: 382639 - DNA, 20 bp, human
gaggaatcagcctggtgcca

SEQ ID NO: 382640 - DNA, 20 bp, human
ggaggggccaaactgctgta

SEQ ID NO: 382641 - DNA, 20 bp, human
gggcttaggctgggctttgg

SEQ ID NO: 382642 - DNA, 20 bp, human
gtggggagaagatgctaggg

SEQ ID NO: 382643 - DNA, 20 bp, human
gaggtctgggggcttaggct

SEQ ID NO: 382644 - DNA, 20 bp, human
gctcacatgcccagtctggt

SEQ ID NO: 382645 - DNA, 20 bp, human
gacctggtaagtgacttatg

SEQ ID NO: 382646 - DNA, 20 bp, human
ggcccacgccgccagcgctg

SEQ ID NO: 382647 - DNA, 20 bp, human
gccagcgctggggctcaccc

SEQ ID NO: 382648 - DNA, 20 bp, human
gccccctgggggagcggaca

SEQ ID NO: 382649 - DNA, 20 bp, human
ggggcccgggactgggcaat

SEQ ID NO: 382650 - DNA, 20 bp, human
ggggaaggcggcgacctggg

SEQ ID NO: 382651 - DNA, 20 bp, human
gccaggtgtgtctgtatcct

SEQ ID NO: 382652 - DNA, 20 bp, human
ggtccctgtccgctccccca

SEQ ID NO: 382653 - DNA, 20 bp, human
gcgcgggaaggcggcgacct

SEQ ID NO: 382654 - DNA, 20 bp, human
ggccccagcgctggcggcgt

SEQ ID NO: 382655 - DNA, 20 bp, human
ggccacccattgcccagtcc

SEQ ID NO: 382656 - DNA, 20 bp, human
gaaacatgatgcacgtccat

SEQ ID NO: 382657 - DNA, 20 bp, human
ggactatttcctggattgta

SEQ ID NO: 382658 - DNA, 20 bp, human
gaggcactacaggaatgacc

SEQ ID NO: 382659 - DNA, 20 bp, human
gtttgtacaagaccagcttg

SEQ ID NO: 382660 - DNA, 20 bp, human
gcgacagacttgtcacccaa

SEQ ID NO: 382661 - DNA, 20 bp, human
gaagggttggagaccaccca

SEQ ID NO: 382662 - DNA, 20 bp, human
gttcctaaaccctacaatcc

SEQ ID NO: 382663 - DNA, 20 bp, human
gaattctaatgaagtgggcg

SEQ ID NO: 382664 - DNA, 20 bp, human
gaattctaattggggtgtgt

SEQ ID NO: 382665 - DNA, 20 bp, human
gaaacgtttacaggcactac

SEQ ID NO: 382666 - DNA, 20 bp, human
gcacatgtggtgtaggtcat

SEQ ID NO: 382667 - DNA, 20 bp, human
gcacatgtggcctgacattc

SEQ ID NO: 382668 - DNA, 20 bp, human
gctaacctttactgacttta

SEQ ID NO: 382669 - DNA, 20 bp, human
gcttttggtcacccactgtt

SEQ ID NO: 382670 - DNA, 20 bp, human
gtcttggctcctgatttcct

SEQ ID NO: 382671 - DNA, 20 bp, human
gtaggctcatataacagaca

SEQ ID NO: 382672 - DNA, 20 bp, human
gaaaaccctaaagtcagtaa

SEQ ID NO: 382673 - DNA, 20 bp, human
gccccttggcagccatagca

SEQ ID NO: 382674 - DNA, 20 bp, human
gatatcagacccaggaaatc

SEQ ID NO: 382675 - DNA, 20 bp, human
ggctagatgtggccttgcta

SEQ ID NO: 382676 - DNA, 20 bp, human
gcatccaggaaaaatttatt

SEQ ID NO: 382677 - DNA, 20 bp, human
ggagaccgtcaccctgccta

SEQ ID NO: 382678 - DNA, 20 bp, human
gtctagtggtgaagactccc

SEQ ID NO: 382679 - DNA, 20 bp, human
gacacctaataaatttttcc

SEQ ID NO: 382680 - DNA, 20 bp, human
ggcagggtgacggtctcatg

SEQ ID NO: 382681 - DNA, 20 bp, human
gaaatccataggcagggtga

SEQ ID NO: 382682 - DNA, 20 bp, human
gacagttgtaatcttttact

SEQ ID NO: 382683 - DNA, 20 bp, human
gtaaatttttcctggatgaa

SEQ ID NO: 382684 - DNA, 20 bp, human
gcaggctctttgaaatccat

SEQ ID NO: 382685 - DNA, 20 bp, human
gaaaagccagatctcagtat

SEQ ID NO: 382686 - DNA, 20 bp, human
ggacttccccccaaccctag

SEQ ID NO: 382687 - DNA, 20 bp, human
ggcacccatgcttgtcacgt

SEQ ID NO: 382688 - DNA, 20 bp, human
gctgaatgggagggaattca

SEQ ID NO: 382689 - DNA, 20 bp, human
gcatctcggagtgaagggga

SEQ ID NO: 382690 - DNA, 20 bp, human
gggcagctactgctgaagtg

SEQ ID NO: 382691 - DNA, 20 bp, human
gtagtcatctcggagtgaag

SEQ ID NO: 382692 - DNA, 20 bp, human
gcctggtgctctaggagtgt

SEQ ID NO: 382693 - DNA, 20 bp, human
gaccccacacctgaatggga

SEQ ID NO: 382694 - DNA, 20 bp, human
gcaatcagtcagactcactg

SEQ ID NO: 382695 - DNA, 20 bp, human
gtgtgcagggcatatgcacc

SEQ ID NO: 382696 - DNA, 20 bp, human
gcaaaggcccacacggcata

SEQ ID NO: 382697 - DNA, 20 bp, human
gggcccgccagagggatgca

SEQ ID NO: 382698 - DNA, 20 bp, human
ggtgttgctgaattgaaagg

SEQ ID NO: 382699 - DNA, 20 bp, human
gaagcctccaggagaaccga

SEQ ID NO: 382700 - DNA, 20 bp, human
ggagctatcaaaggcccaca

SEQ ID NO: 382701 - DNA, 20 bp, human
gccgccttcggttctcctgg

SEQ ID NO: 382702 - DNA, 20 bp, human
gactgccaagaaaaacctga

SEQ ID NO: 382703 - DNA, 20 bp, human
gtcacagccttatgccgtgt

SEQ ID NO: 382704 - DNA, 20 bp, human
gttaccgagcagatcacaac

SEQ ID NO: 382705 - DNA, 20 bp, human
ggtgctgtggtggagaagtc

SEQ ID NO: 382706 - DNA, 20 bp, human
gcacctagaggggttcactg

SEQ ID NO: 382707 - DNA, 20 bp, human
ggaaacacggagttgcgaat

SEQ ID NO: 382708 - DNA, 20 bp, human
gcctgtaattgcacctagag

SEQ ID NO: 382709 - DNA, 20 bp, human
gctcgtgggtgtcgctgcta

SEQ ID NO: 382710 - DNA, 20 bp, human
ggtgtcgctgctagggtgga

SEQ ID NO: 382711 - DNA, 20 bp, human
gtcgcaactccgtgtttcca

SEQ ID NO: 382712 - DNA, 20 bp, human
ggcctggcaagaaaaagaac

SEQ ID NO: 382713 - DNA, 20 bp, human
ggcagtgccgggtcagtctg

SEQ ID NO: 382714 - DNA, 20 bp, human
gagagaagactgagggaact

SEQ ID NO: 382715 - DNA, 20 bp, human
gggctcctgccaagagacct

SEQ ID NO: 382716 - DNA, 20 bp, human
gggcgtgcggggggtaggtg

SEQ ID NO: 382717 - DNA, 20 bp, human
gaatgactgagaagccacaa

SEQ ID NO: 382718 - DNA, 20 bp, human
ggtggcttctcagtcatttc

SEQ ID NO: 382719 - DNA, 20 bp, human
gcatggggaagtgttgatac

SEQ ID NO: 382720 - DNA, 20 bp, human
gttctgggaggtgcggcggg

SEQ ID NO: 382721 - DNA, 20 bp, human
gtcatttctgggaggtgcgg

SEQ ID NO: 382722 - DNA, 20 bp, human
gcacttcaggggttaagttt

SEQ ID NO: 382723 - DNA, 20 bp, human
gtgtgcggggggatcggcat

SEQ ID NO: 382724 - DNA, 20 bp, human
ggtgtgtgtgcgggggcgtg

SEQ ID NO: 382725 - DNA, 20 bp, human
gcctggagccacaatgatca

SEQ ID NO: 382726 - DNA, 20 bp, human
gtggcagccccgcccgactc

SEQ ID NO: 382727 - DNA, 20 bp, human
gccctcagcacatttttaca

SEQ ID NO: 382728 - DNA, 20 bp, human
gtggaagggaaggttctagt

SEQ ID NO: 382729 - DNA, 20 bp, human
gaggggaagccagaccgaac

SEQ ID NO: 382730 - DNA, 20 bp, human
ggaacaacgggaaatttaag

SEQ ID NO: 382731 - DNA, 20 bp, human
ggcccgactcagggatggaa

SEQ ID NO: 382732 - DNA, 20 bp, human
ggactcacaagtgatgtgaa

SEQ ID NO: 382733 - DNA, 20 bp, human
gaagctccctgggtcctgat

SEQ ID NO: 382734 - DNA, 20 bp, human
ggagtcttctcagctcaaaa

SEQ ID NO: 382735 - DNA, 20 bp, human
gtacatcttggcttaaggaa

SEQ ID NO: 382736 - DNA, 20 bp, human
gacgaagggcgggatttagg

SEQ ID NO: 382737 - DNA, 20 bp, human
gccgctgccgccaagacgaa

SEQ ID NO: 382738 - DNA, 20 bp, human
gcggaggggacgaaaaacgg

SEQ ID NO: 382739 - DNA, 20 bp, human
gaggtctcggaagtacgagg

SEQ ID NO: 382740 - DNA, 20 bp, human
gaagaggctcgcctcccact

SEQ ID NO: 382741 - DNA, 20 bp, human
gcagactgttgtggctgtgg

SEQ ID NO: 382742 - DNA, 20 bp, human
gcgcggaagtgaggtcacta

SEQ ID NO: 382743 - DNA, 20 bp, human
gtcgcgagagcattagaggg

SEQ ID NO: 382744 - DNA, 20 bp, human
gggccagactgttgtggctg

SEQ ID NO: 382745 - DNA, 20 bp, human
gaggcggaggggacgaaaaa

SEQ ID NO: 382746 - DNA, 20 bp, human
gggcgacagaagctcttcgg

SEQ ID NO: 382747 - DNA, 20 bp, human
gaagctcttcgggggatcag

SEQ ID NO: 382748 - DNA, 20 bp, human
gcctgcccgcgaagagactg

SEQ ID NO: 382749 - DNA, 20 bp, human
ggggccgacgcacctcggat

SEQ ID NO: 382750 - DNA, 20 bp, human
ggggggatcagtggccaagg

SEQ ID NO: 382751 - DNA, 20 bp, human
gctccgaggggccacgggaa

SEQ ID NO: 382752 - DNA, 20 bp, human
gagcggcgacagaagctctt

SEQ ID NO: 382753 - DNA, 20 bp, human
ggagactggggattccgagg

SEQ ID NO: 382754 - DNA, 20 bp, human
ggcgctggggcgcaacactg

SEQ ID NO: 382755 - DNA, 20 bp, human
gttcacacgggttgcttcgg

SEQ ID NO: 382756 - DNA, 20 bp, human
ggctgaggatgattcagaca

SEQ ID NO: 382757 - DNA, 20 bp, human
gaggagaaagggctcgtccg

SEQ ID NO: 382758 - DNA, 20 bp, human
gcgcgggcttgcggggacca

SEQ ID NO: 382759 - DNA, 20 bp, human
gtgaaggcaattagattcca

SEQ ID NO: 382760 - DNA, 20 bp, human
gaggatgattcagacagggc

SEQ ID NO: 382761 - DNA, 20 bp, human
gaggggctcgtgctctgcgg

SEQ ID NO: 382762 - DNA, 20 bp, human
gtccctgtgtgctctcttga

SEQ ID NO: 382763 - DNA, 20 bp, human
gtgaatcatcctcagcccgc

SEQ ID NO: 382764 - DNA, 20 bp, human
gctgacgtcaaagccccctc

SEQ ID NO: 382765 - DNA, 20 bp, human
ggctgtgcctgatggaggcg

SEQ ID NO: 382766 - DNA, 20 bp, human
gtgctccccgcaggcgtgcg

SEQ ID NO: 382767 - DNA, 20 bp, human
gaggtctacaccacgctgaa

SEQ ID NO: 382768 - DNA, 20 bp, human
gccgtctgggcacacccttc

SEQ ID NO: 382769 - DNA, 20 bp, human
gacgtctcccgcttcctgaa

SEQ ID NO: 382770 - DNA, 20 bp, human
gagggtgtgcccagacggga

SEQ ID NO: 382771 - DNA, 20 bp, human
gctttgctggagcgcttcag

SEQ ID NO: 382772 - DNA, 20 bp, human
ggcgtagaggcccttcagcg

SEQ ID NO: 382773 - DNA, 20 bp, human
ggggcacacccttcaggaag

SEQ ID NO: 382774 - DNA, 20 bp, human
gtacgccacgcacgcctgcg

SEQ ID NO: 382775 - DNA, 20 bp, human
gggaagaagagggacttgca

SEQ ID NO: 382776 - DNA, 20 bp, human
ggaggaggtcgtgacgtcac

SEQ ID NO: 382777 - DNA, 20 bp, human
gacctcctcgaactcctgat

SEQ ID NO: 382778 - DNA, 20 bp, human
gggggtggccggtagcaatc

SEQ ID NO: 382779 - DNA, 20 bp, human
ggcgctgacggtacagtggc

SEQ ID NO: 382780 - DNA, 20 bp, human
gaccgggtcagggcaaaggg

SEQ ID NO: 382781 - DNA, 20 bp, human
gtcctccaatcaggagttcg

SEQ ID NO: 382782 - DNA, 20 bp, human
gcgcggcgctgacggtacag

SEQ ID NO: 382783 - DNA, 20 bp, human
ggagggagagaggggtaacc

SEQ ID NO: 382784 - DNA, 20 bp, human
gaggctcgcagcgcggtcca

SEQ ID NO: 382785 - DNA, 20 bp, human
gtcctcgaactcctgattgg

SEQ ID NO: 382786 - DNA, 20 bp, human
gttcctgggaagctaactat

SEQ ID NO: 382787 - DNA, 20 bp, human
gcctgcctgccggaagctca

SEQ ID NO: 382788 - DNA, 20 bp, human
gagccccgggctgttcccgt

SEQ ID NO: 382789 - DNA, 20 bp, human
gcaggaaggaactgcttgtg

SEQ ID NO: 382790 - DNA, 20 bp, human
gtcaacctcacctctcgcga

SEQ ID NO: 382791 - DNA, 20 bp, human
gtcagagttgccgaagtggg

SEQ ID NO: 382792 - DNA, 20 bp, human
gaacccacgggaacagcccg

SEQ ID NO: 382793 - DNA, 20 bp, human
ggggacgcacccctcgcgag

SEQ ID NO: 382794 - DNA, 20 bp, human
ggcacccctcgcgagaggtg

SEQ ID NO: 382795 - DNA, 20 bp, human
ggcacactagtcacccccga

SEQ ID NO: 382796 - DNA, 20 bp, human
ggggaagaggctggccacac

SEQ ID NO: 382797 - DNA, 20 bp, human
gacagagcgggagtattggg

SEQ ID NO: 382798 - DNA, 20 bp, human
gaaaacagagcgggagtatt

SEQ ID NO: 382799 - DNA, 20 bp, human
ggctgaggtgggccgtaaag

SEQ ID NO: 382800 - DNA, 20 bp, human
gctcccgctctgtttttatg

SEQ ID NO: 382801 - DNA, 20 bp, human
gagccagtggacacaagcag

SEQ ID NO: 382802 - DNA, 20 bp, human
gcaccggaagtggcgatctg

SEQ ID NO: 382803 - DNA, 20 bp, human
gtattgggaggaggataagc

SEQ ID NO: 382804 - DNA, 20 bp, human
gaacctgctcagggttacca

SEQ ID NO: 382805 - DNA, 20 bp, human
ggccgtaaagaggaacggac

SEQ ID NO: 382806 - DNA, 20 bp, human
gcgcccgccggggacaagac

SEQ ID NO: 382807 - DNA, 20 bp, human
gaggacccgaatcctgatag

SEQ ID NO: 382808 - DNA, 20 bp, human
gtggctgcccgcctgcgctc

SEQ ID NO: 382809 - DNA, 20 bp, human
gcgagagaggcgtattaggt

SEQ ID NO: 382810 - DNA, 20 bp, human
gaagcggctcacttccgggg

SEQ ID NO: 382811 - DNA, 20 bp, human
gaggcggcgcttcggaggga

SEQ ID NO: 382812 - DNA, 20 bp, human
gcccgcctgcgctcgggagt

SEQ ID NO: 382813 - DNA, 20 bp, human
gctggcgcggggcattgtgg

SEQ ID NO: 382814 - DNA, 20 bp, human
gcctccgaagcgccgcctaa

SEQ ID NO: 382815 - DNA, 20 bp, human
ggaaagaatctgctcttcgg

SEQ ID NO: 382816 - DNA, 20 bp, human
gtaaggatacagctcttccg

SEQ ID NO: 382817 - DNA, 20 bp, human
gaacgctatagtgtgacaca

SEQ ID NO: 382818 - DNA, 20 bp, human
gttaacgtggcggtcggcgc

SEQ ID NO: 382819 - DNA, 20 bp, human
ggacctagtaatgacgctaa

SEQ ID NO: 382820 - DNA, 20 bp, human
gtccctttagcgtcattact

SEQ ID NO: 382821 - DNA, 20 bp, human
gaagagctgtatccttaacg

SEQ ID NO: 382822 - DNA, 20 bp, human
gaatgaaacttgggcttcta

SEQ ID NO: 382823 - DNA, 20 bp, human
gggttgctgccttttaaagt

SEQ ID NO: 382824 - DNA, 20 bp, human
ggtatccttaacgtggcggt

SEQ ID NO: 382825 - DNA, 20 bp, human
gagctgtatccttaacgtgg

SEQ ID NO: 382826 - DNA, 20 bp, human
gtagatccgctccctcttgg

SEQ ID NO: 382827 - DNA, 20 bp, human
gggaagaaggggtgtgtatg

SEQ ID NO: 382828 - DNA, 20 bp, human
gtcacacccaccgcagggtc

SEQ ID NO: 382829 - DNA, 20 bp, human
ggtgggtgtgaccctaggac

SEQ ID NO: 382830 - DNA, 20 bp, human
gggtctggcttggtacagtt

SEQ ID NO: 382831 - DNA, 20 bp, human
gcgactagagcccacagaac

SEQ ID NO: 382832 - DNA, 20 bp, human
gtcgcttgacttcaccaaca

SEQ ID NO: 382833 - DNA, 20 bp, human
gcgaaggcgactagagctcc

SEQ ID NO: 382834 - DNA, 20 bp, human
gggtcctcagagcaattaaa

SEQ ID NO: 382835 - DNA, 20 bp, human
ggggtgcatgcagaagtagg

SEQ ID NO: 382836 - DNA, 20 bp, human
gacccggggcgccacgtaaa

SEQ ID NO: 382837 - DNA, 20 bp, human
gaggacgcatagccactcac

SEQ ID NO: 382838 - DNA, 20 bp, human
ggaccctggggagacgcggg

SEQ ID NO: 382839 - DNA, 20 bp, human
ggccacgtaaaggggtgctc

SEQ ID NO: 382840 - DNA, 20 bp, human
gcagccacccgcgtctcccc

SEQ ID NO: 382841 - DNA, 20 bp, human
ggcgaccagcattggcgaat

SEQ ID NO: 382842 - DNA, 20 bp, human
gacactgaggggttggccgt

SEQ ID NO: 382843 - DNA, 20 bp, human
gaaccccaactcctagcctt

SEQ ID NO: 382844 - DNA, 20 bp, human
gtccgaccctggggagacgc

SEQ ID NO: 382845 - DNA, 20 bp, human
gcgggtcccgtccgaccctg

SEQ ID NO: 382846 - DNA, 20 bp, human
gtcctcgccagccgcgggtt

SEQ ID NO: 382847 - DNA, 20 bp, human
ggggtcgtgtcgtgggacga

SEQ ID NO: 382848 - DNA, 20 bp, human
ggctcggcgcgcccatgtcg

SEQ ID NO: 382849 - DNA, 20 bp, human
gggcccctcgcagcgtccgt

SEQ ID NO: 382850 - DNA, 20 bp, human
ggcaagatggctgctcggac

SEQ ID NO: 382851 - DNA, 20 bp, human
gcaagtccgtaccgcgacat

SEQ ID NO: 382852 - DNA, 20 bp, human
ggcgccgtacggcaagatgg

SEQ ID NO: 382853 - DNA, 20 bp, human
ggacccaggagcagttgtcg

SEQ ID NO: 382854 - DNA, 20 bp, human
gcgggccgacgcgagccccg

SEQ ID NO: 382855 - DNA, 20 bp, human
gcggccgtacgccaaaatgg

SEQ ID NO: 382856 - DNA, 20 bp, human
gtagggcgccgggatcacgt

SEQ ID NO: 382857 - DNA, 20 bp, human
gccggcttcaacccccgaaa

SEQ ID NO: 382858 - DNA, 20 bp, human
gaatgctagcgcaggcgcag

SEQ ID NO: 382859 - DNA, 20 bp, human
ggaaaaggcggtgcttaaac

SEQ ID NO: 382860 - DNA, 20 bp, human
ggcgccgggatcacgtgggg

SEQ ID NO: 382861 - DNA, 20 bp, human
ggcggtgcttaaaccggagg

SEQ ID NO: 382862 - DNA, 20 bp, human
ggtgcttaaaccggaggagg

SEQ ID NO: 382863 - DNA, 20 bp, human
gcgggggttgaagccggaag

SEQ ID NO: 382864 - DNA, 20 bp, human
gggaaggaggagcgctaggt

SEQ ID NO: 382865 - DNA, 20 bp, human
ggaaaactgttgttgctgct

SEQ ID NO: 382866 - DNA, 20 bp, human
ggtcaagagcgaggtcagcg

SEQ ID NO: 382867 - DNA, 20 bp, human
gtgggaggggtgtgctagag

SEQ ID NO: 382868 - DNA, 20 bp, human
gttgtcgctagtggccgctg

SEQ ID NO: 382869 - DNA, 20 bp, human
gaggatcggtggaatgtgag

SEQ ID NO: 382870 - DNA, 20 bp, human
gcccgggaagatggcgccag

SEQ ID NO: 382871 - DNA, 20 bp, human
ggctcctaagcacgtgaccc

SEQ ID NO: 382872 - DNA, 20 bp, human
gaccgctggcgccatcttcc

SEQ ID NO: 382873 - DNA, 20 bp, human
gatcctgggggaaggatcgg

SEQ ID NO: 382874 - DNA, 20 bp, human
gggttcccggggctacgagg

SEQ ID NO: 382875 - DNA, 20 bp, human
gagagaggcgcagcttctct

SEQ ID NO: 382876 - DNA, 20 bp, human
gtgacagaagtcaagagaat

SEQ ID NO: 382877 - DNA, 20 bp, human
gacccctcgcgagacttcgg

SEQ ID NO: 382878 - DNA, 20 bp, human
ggcgcacgcgcgctgacctg

SEQ ID NO: 382879 - DNA, 20 bp, human
gaatcggctgggacggggtt

SEQ ID NO: 382880 - DNA, 20 bp, human
gtggcctgtcgggtcccccc

SEQ ID NO: 382881 - DNA, 20 bp, human
gcggctctccgggcatccgg

SEQ ID NO: 382882 - DNA, 20 bp, human
gcggcggcggagcagtgacg

SEQ ID NO: 382883 - DNA, 20 bp, human
ggggccgctcccgaacgctg

SEQ ID NO: 382884 - DNA, 20 bp, human
gagccgccgctcctccccaa

SEQ ID NO: 382885 - DNA, 20 bp, human
ggagcagtgacgcggcatct

SEQ ID NO: 382886 - DNA, 20 bp, human
gtgaaagtcggggtgacgaa

SEQ ID NO: 382887 - DNA, 20 bp, human
gccaacggttgcccggatgt

SEQ ID NO: 382888 - DNA, 20 bp, human
gcaacacgtgatgaaagtcg

SEQ ID NO: 382889 - DNA, 20 bp, human
gccctcgtcacgtgacgaat

SEQ ID NO: 382890 - DNA, 20 bp, human
gctgtggaggggcgcctagt

SEQ ID NO: 382891 - DNA, 20 bp, human
gccaccctacgcctacatcc

SEQ ID NO: 382892 - DNA, 20 bp, human
ggttgcccggatgtaggcgt

SEQ ID NO: 382893 - DNA, 20 bp, human
gcgtgacgagggcgggactg

SEQ ID NO: 382894 - DNA, 20 bp, human
gaggtgcacagtactcgcta

SEQ ID NO: 382895 - DNA, 20 bp, human
ggggcggcgcttagaaccaa

SEQ ID NO: 382896 - DNA, 20 bp, human
gcggtcaaatgcacgtcttc

SEQ ID NO: 382897 - DNA, 20 bp, human
gaggctcaggcccttccgat

SEQ ID NO: 382898 - DNA, 20 bp, human
gtcaacgggcggagctaaag

SEQ ID NO: 382899 - DNA, 20 bp, human
gcctccctccgcgttggagg

SEQ ID NO: 382900 - DNA, 20 bp, human
gtggctgctgggacacaacg

SEQ ID NO: 382901 - DNA, 20 bp, human
ggctccgcccgttgactctg

SEQ ID NO: 382902 - DNA, 20 bp, human
gattccgcctccaacgcgga

SEQ ID NO: 382903 - DNA, 20 bp, human
gacccgaagttgctccgcag

SEQ ID NO: 382904 - DNA, 20 bp, human
ggcccactgcggagcaactt

SEQ ID NO: 382905 - DNA, 20 bp, human
gctctccgaaggccctgcgc

SEQ ID NO: 382906 - DNA, 20 bp, human
ggaggtgatcccatgcgcga

SEQ ID NO: 382907 - DNA, 20 bp, human
gctggcgcagggaggttctc

SEQ ID NO: 382908 - DNA, 20 bp, human
gaggaccaagagatgaaaga

SEQ ID NO: 382909 - DNA, 20 bp, human
gcgcatgggatcacctcgcc

SEQ ID NO: 382910 - DNA, 20 bp, human
ggggacagtcgtcttgttac

SEQ ID NO: 382911 - DNA, 20 bp, human
gaacctccctgcgccagggc

SEQ ID NO: 382912 - DNA, 20 bp, human
gaaagagggctgcacgcgtg

SEQ ID NO: 382913 - DNA, 20 bp, human
gtgcgcccgccctcgcgcat

SEQ ID NO: 382914 - DNA, 20 bp, human
gttctcgggcggggccgaca

SEQ ID NO: 382915 - DNA, 20 bp, human
gccctccctccctggacgtt

SEQ ID NO: 382916 - DNA, 20 bp, human
gactgcagcgtggagaacgg

SEQ ID NO: 382917 - DNA, 20 bp, human
ggcgccgcccggagcggtcc

SEQ ID NO: 382918 - DNA, 20 bp, human
gccgaggggagccaccgcgg

SEQ ID NO: 382919 - DNA, 20 bp, human
gcagtgcccctggaccgctc

SEQ ID NO: 382920 - DNA, 20 bp, human
gcgcgtgcaatgcgatccct

SEQ ID NO: 382921 - DNA, 20 bp, human
gccgcggcggagctgcccac

SEQ ID NO: 382922 - DNA, 20 bp, human
ggagcgcccgtctgcctgca

SEQ ID NO: 382923 - DNA, 20 bp, human
ggcccgcggagcggacttcc

SEQ ID NO: 382924 - DNA, 20 bp, human
gcaggactgcgtcgcggatg

SEQ ID NO: 382925 - DNA, 20 bp, human
ggtgccgtaggtgatcgaga

SEQ ID NO: 382926 - DNA, 20 bp, human
gtgtcctcaccccacgggga

SEQ ID NO: 382927 - DNA, 20 bp, human
ggcgccaaggctgcgtgggc

SEQ ID NO: 382928 - DNA, 20 bp, human
ggtgcgcgccaaggctgcgt

SEQ ID NO: 382929 - DNA, 20 bp, human
gagggcccgcggggtggcgc

SEQ ID NO: 382930 - DNA, 20 bp, human
ggcccccttcactttctagc

SEQ ID NO: 382931 - DNA, 20 bp, human
ggctggggagaccacctagg

SEQ ID NO: 382932 - DNA, 20 bp, human
gtttccagctagaaagtgaa

SEQ ID NO: 382933 - DNA, 20 bp, human
gagagtcagcgagggcccga

SEQ ID NO: 382934 - DNA, 20 bp, human
gtagaaagtgaagggggcgg

SEQ ID NO: 382935 - DNA, 20 bp, human
ggattcctccggccaatggg

SEQ ID NO: 382936 - DNA, 20 bp, human
gccgctgcaagggtgagcat

SEQ ID NO: 382937 - DNA, 20 bp, human
gagtgtgaggtccgctgcaa

SEQ ID NO: 382938 - DNA, 20 bp, human
gaacagaagcaaagtcctgc

SEQ ID NO: 382939 - DNA, 20 bp, human
ggttcagtgggtcatagagc

SEQ ID NO: 382940 - DNA, 20 bp, human
ggggcaggcgtctttcttgc

SEQ ID NO: 382941 - DNA, 20 bp, human
gctatgacccactgaactgc

SEQ ID NO: 382942 - DNA, 20 bp, human
gtgaacgggaaaccctgtga

SEQ ID NO: 382943 - DNA, 20 bp, human
ggagagtctatgacaaggga

SEQ ID NO: 382944 - DNA, 20 bp, human
gacctcacacttactggggc

SEQ ID NO: 382945 - DNA, 20 bp, human
gttaggagagtctatgacaa

SEQ ID NO: 382946 - DNA, 20 bp, human
ggacccctgcagcaggtact

SEQ ID NO: 382947 - DNA, 20 bp, human
ggacggcatccagtacagag

SEQ ID NO: 382948 - DNA, 20 bp, human
gagcaaatggtgagatcaga

SEQ ID NO: 382949 - DNA, 20 bp, human
ggcatccagtacagaggggc

SEQ ID NO: 382950 - DNA, 20 bp, human
gaagtccagcccctctgtac

SEQ ID NO: 382951 - DNA, 20 bp, human
ggctccgagtacctgctgca

SEQ ID NO: 382952 - DNA, 20 bp, human
ggatgatgtcattccttcga

SEQ ID NO: 382953 - DNA, 20 bp, human
gagcaggtactcggagcaaa

SEQ ID NO: 382954 - DNA, 20 bp, human
gggacttggacccctgcagc

SEQ ID NO: 382955 - DNA, 20 bp, human
ggctgtcaatcagacacacg

SEQ ID NO: 382956 - DNA, 20 bp, human
gctctgggaaccaggggcac

SEQ ID NO: 382957 - DNA, 20 bp, human
gcggagggacagaattggag

SEQ ID NO: 382958 - DNA, 20 bp, human
gcactgggaaagaatcctgg

SEQ ID NO: 382959 - DNA, 20 bp, human
gcccccaacaatgatgactg

SEQ ID NO: 382960 - DNA, 20 bp, human
gcacctgggggaggatcatt

SEQ ID NO: 382961 - DNA, 20 bp, human
gtgcggagagggaggcacct

SEQ ID NO: 382962 - DNA, 20 bp, human
gctggaggcatcatcagctc

SEQ ID NO: 382963 - DNA, 20 bp, human
gaacaatgatgactgcggag

SEQ ID NO: 382964 - DNA, 20 bp, human
gaggggcagtgctagacagt

SEQ ID NO: 382965 - DNA, 20 bp, human
ggcgtctgacgggaactgaa

SEQ ID NO: 382966 - DNA, 20 bp, human
gcagagggtgggcaagatgg

SEQ ID NO: 382967 - DNA, 20 bp, human
ggccccctccccagtcatca

SEQ ID NO: 382968 - DNA, 20 bp, human
ggggctgccgtcagtggacc

SEQ ID NO: 382969 - DNA, 20 bp, human
gccctgaccgcaacgatcgg

SEQ ID NO: 382970 - DNA, 20 bp, human
gaccgcaacgatcggagggg

SEQ ID NO: 382971 - DNA, 20 bp, human
gcgcccgtgctgagtagccc

SEQ ID NO: 382972 - DNA, 20 bp, human
ggcacacaaggaagtgtttc

SEQ ID NO: 382973 - DNA, 20 bp, human
gcagcctggccgtgctggtg

SEQ ID NO: 382974 - DNA, 20 bp, human
gaccgcccctccgatcgttg

SEQ ID NO: 382975 - DNA, 20 bp, human
ggccccctgaccgcaacgat

SEQ ID NO: 382976 - DNA, 20 bp, human
gacggaccaggtcctggggt

SEQ ID NO: 382977 - DNA, 20 bp, human
gccccgacgcgcgagggtag

SEQ ID NO: 382978 - DNA, 20 bp, human
gcccaggacctggtccgtcc

SEQ ID NO: 382979 - DNA, 20 bp, human
gcgagggtaggggcgaagat

SEQ ID NO: 382980 - DNA, 20 bp, human
gaaaggcgcgggtgtgagga

SEQ ID NO: 382981 - DNA, 20 bp, human
ggccgcagggagaaaggcgc

SEQ ID NO: 382982 - DNA, 20 bp, human
gcctggggtgggtgtagaca

SEQ ID NO: 382983 - DNA, 20 bp, human
gcgggaggaaaggggcgaaa

SEQ ID NO: 382984 - DNA, 20 bp, human
gaaaaggagcgcaaggagta

SEQ ID NO: 382985 - DNA, 20 bp, human
gtccccgccgtgcggtgctg

SEQ ID NO: 382986 - DNA, 20 bp, human
ggacaggaggagcccgggaa

SEQ ID NO: 382987 - DNA, 20 bp, human
gccagaccacggcctcgtag

SEQ ID NO: 382988 - DNA, 20 bp, human
gcggaggaggctcatggagc

SEQ ID NO: 382989 - DNA, 20 bp, human
gggcctcgtaggggcagcgt

SEQ ID NO: 382990 - DNA, 20 bp, human
ggtctggccacctccttaac

SEQ ID NO: 382991 - DNA, 20 bp, human
gaggtggggttggccagtta

SEQ ID NO: 382992 - DNA, 20 bp, human
gaccacatccagcaaactta

SEQ ID NO: 382993 - DNA, 20 bp, human
gtgggagcccagagaagcgt

SEQ ID NO: 382994 - DNA, 20 bp, human
ggctttctctgcacccttcc

SEQ ID NO: 382995 - DNA, 20 bp, human
gctcccaaacgcatcggggc

SEQ ID NO: 382996 - DNA, 20 bp, human
gtggaccgtggggaatgtga

SEQ ID NO: 382997 - DNA, 20 bp, human
gagacctgacgggaacctgc

SEQ ID NO: 382998 - DNA, 20 bp, human
ggggacaggaacaggagacg

SEQ ID NO: 382999 - DNA, 20 bp, human
gctgcaggggcatctagcta

SEQ ID NO: 383000 - DNA, 20 bp, human
gttcctaaaccaatcctggg

SEQ ID NO: 383001 - DNA, 20 bp, human
gactcaggacctcccaggat

SEQ ID NO: 383002 - DNA, 20 bp, human
gaagcccaggtgaccagcat

SEQ ID NO: 383003 - DNA, 20 bp, human
ggggctctggacattaccga

SEQ ID NO: 383004 - DNA, 20 bp, human
gtctccaatgctggtcacct

SEQ ID NO: 383005 - DNA, 20 bp, human
gcgtgcgccgtctccaatgc

SEQ ID NO: 383006 - DNA, 20 bp, human
gaccgaggcaagtttagaga

SEQ ID NO: 383007 - DNA, 20 bp, human
gaaggggtgtataggcacat

SEQ ID NO: 383008 - DNA, 20 bp, human
gctactgggccactgtacat

SEQ ID NO: 383009 - DNA, 20 bp, human
gtaactaggaaggggtgtat

SEQ ID NO: 383010 - DNA, 20 bp, human
ggcccctcccaagtgctact

SEQ ID NO: 383011 - DNA, 20 bp, human
gatagcatttggactggtaa

SEQ ID NO: 383012 - DNA, 20 bp, human
gcaccaaagtatgtaagcgg

SEQ ID NO: 383013 - DNA, 20 bp, human
ggggtgtataggcacatggg

SEQ ID NO: 383014 - DNA, 20 bp, human
gcgccgccgcttacatactt

SEQ ID NO: 383015 - DNA, 20 bp, human
ggttggtaacataactagga

SEQ ID NO: 383016 - DNA, 20 bp, human
gaggaaggcggagtgagatg

SEQ ID NO: 383017 - DNA, 20 bp, human
ggcggggctgtgtgggacta

SEQ ID NO: 383018 - DNA, 20 bp, human
gaccggggcggggctgtgta

SEQ ID NO: 383019 - DNA, 20 bp, human
ggctgtgtgggactagggcg

SEQ ID NO: 383020 - DNA, 20 bp, human
gcgtacaacgcgcaggaagg

SEQ ID NO: 383021 - DNA, 20 bp, human
gagtgagatgaggctgagtc

SEQ ID NO: 383022 - DNA, 20 bp, human
ggagacaggtcggtggagat

SEQ ID NO: 383023 - DNA, 20 bp, human
ggggctcgggggctagaccg

SEQ ID NO: 383024 - DNA, 20 bp, human
gatgaggctgagtccggccg

SEQ ID NO: 383025 - DNA, 20 bp, human
gcgggggctagaccggggcg

SEQ ID NO: 383026 - DNA, 20 bp, human
gaggcggtgcgcactactgg

SEQ ID NO: 383027 - DNA, 20 bp, human
gggccgcagcgggaggtctt

SEQ ID NO: 383028 - DNA, 20 bp, human
gaacccctggggtggacgca

SEQ ID NO: 383029 - DNA, 20 bp, human
gaacagccgggccacttccg

SEQ ID NO: 383030 - DNA, 20 bp, human
gggaggtcttcggaaagaaa

SEQ ID NO: 383031 - DNA, 20 bp, human
gaggtagagtgcgccgtcca

SEQ ID NO: 383032 - DNA, 20 bp, human
gcgccctgggtcatgtggga

SEQ ID NO: 383033 - DNA, 20 bp, human
gaggaggcggtgcgcactac

SEQ ID NO: 383034 - DNA, 20 bp, human
gcgtacgccctgggtcatgt

SEQ ID NO: 383035 - DNA, 20 bp, human
gaggggcccaaggcgataac

SEQ ID NO: 383036 - DNA, 20 bp, human
gtaaaggcgccgagcatctg

SEQ ID NO: 383037 - DNA, 20 bp, human
gccctccccaagcactgggt

SEQ ID NO: 383038 - DNA, 20 bp, human
gcaccctccaatcaagggac

SEQ ID NO: 383039 - DNA, 20 bp, human
ggggctcctagaccagctaa

SEQ ID NO: 383040 - DNA, 20 bp, human
gtacataaacaaatagtatg

SEQ ID NO: 383041 - DNA, 20 bp, human
gagctgcctgggggttctga

SEQ ID NO: 383042 - DNA, 20 bp, human
ggagccccacccagtgcttg

SEQ ID NO: 383043 - DNA, 20 bp, human
gaccagcaccctccaatcaa

SEQ ID NO: 383044 - DNA, 20 bp, human
gtatggggtatatagagcct

SEQ ID NO: 383045 - DNA, 20 bp, human
ggactggcttgagttgcaaa

SEQ ID NO: 383046 - DNA, 20 bp, human
gcggcgggacggaccacgta

SEQ ID NO: 383047 - DNA, 20 bp, human
gaccacgtagggcgctgaga

SEQ ID NO: 383048 - DNA, 20 bp, human
ggggaacgcgaaagtggcgc

SEQ ID NO: 383049 - DNA, 20 bp, human
ggtggcgcgggcctggacgg

SEQ ID NO: 383050 - DNA, 20 bp, human
ggggtctcgcgctgctggga

SEQ ID NO: 383051 - DNA, 20 bp, human
gaaagtggcgcgggcctgga

SEQ ID NO: 383052 - DNA, 20 bp, human
ggagaaggtcgcgccacggt

SEQ ID NO: 383053 - DNA, 20 bp, human
ggccactttcgcgttccctg

SEQ ID NO: 383054 - DNA, 20 bp, human
gacagcgcgagggcggccga

SEQ ID NO: 383055 - DNA, 20 bp, human
ggccccagggaacgcgaaag

SEQ ID NO: 383056 - DNA, 20 bp, human
gggagtagctctatgtgggg

SEQ ID NO: 383057 - DNA, 20 bp, human
gtgtggggaggacaatgaag

SEQ ID NO: 383058 - DNA, 20 bp, human
gggtggagtagctctatgtg

SEQ ID NO: 383059 - DNA, 20 bp, human
gctgaggtcagagttgcttg

SEQ ID NO: 383060 - DNA, 20 bp, human
gtccaggtgtgcatctacta

SEQ ID NO: 383061 - DNA, 20 bp, human
gcactgacagtatgcaaata

SEQ ID NO: 383062 - DNA, 20 bp, human
gtgcacacctggattaacaa

SEQ ID NO: 383063 - DNA, 20 bp, human
gacattgaagttgaacagga

SEQ ID NO: 383064 - DNA, 20 bp, human
gtcttaaaggagggtagggt

SEQ ID NO: 383065 - DNA, 20 bp, human
gtctgacattgaagttgaac

SEQ ID NO: 383066 - DNA, 20 bp, human
gcaaactagctgagtgaatg

SEQ ID NO: 383067 - DNA, 20 bp, human
gactgaatctggtacaacat

SEQ ID NO: 383068 - DNA, 20 bp, human
gtgtgtctacaaagtgggtg

SEQ ID NO: 383069 - DNA, 20 bp, human
gaagcatgctgttgtggatc

SEQ ID NO: 383070 - DNA, 20 bp, human
gttgcaggaaatactgaatc

SEQ ID NO: 383071 - DNA, 20 bp, human
gccctcaaggtggagagtaa

SEQ ID NO: 383072 - DNA, 20 bp, human
ggaatgtgggggagctactt

SEQ ID NO: 383073 - DNA, 20 bp, human
gtatttcctgcaatgctagc

SEQ ID NO: 383074 - DNA, 20 bp, human
gcccactttgtagacacaac

SEQ ID NO: 383075 - DNA, 20 bp, human
ggcacacttcaagttccaga

SEQ ID NO: 383076 - DNA, 20 bp, human
ggccccctgcagtaccctat

SEQ ID NO: 383077 - DNA, 20 bp, human
gtccccatagggtactgcag

SEQ ID NO: 383078 - DNA, 20 bp, human
ggcagtaccctatggggaag

SEQ ID NO: 383079 - DNA, 20 bp, human
gctaactgggagcactgctg

SEQ ID NO: 383080 - DNA, 20 bp, human
gggctcccgaatgtccctcc

SEQ ID NO: 383081 - DNA, 20 bp, human
ggtgcggggcggggcatcgg

SEQ ID NO: 383082 - DNA, 20 bp, human
ggtccctccaggacactcca

SEQ ID NO: 383083 - DNA, 20 bp, human
gacactccatggtcctctat

SEQ ID NO: 383084 - DNA, 20 bp, human
gctccctcctcaaacccaaa

SEQ ID NO: 383085 - DNA, 20 bp, human
gagtgctcccagttagaaaa

SEQ ID NO: 383086 - DNA, 20 bp, human
gcaagcgtggaaggtgctaa

SEQ ID NO: 383087 - DNA, 20 bp, human
gcccggaagtgttctcttcg

SEQ ID NO: 383088 - DNA, 20 bp, human
gtgggaggttaagaactaca

SEQ ID NO: 383089 - DNA, 20 bp, human
ggcgtggaaggtgctaacgg

SEQ ID NO: 383090 - DNA, 20 bp, human
gtcttcctcctcccgtcctg

SEQ ID NO: 383091 - DNA, 20 bp, human
ggaggaggaagaagcaagcg

SEQ ID NO: 383092 - DNA, 20 bp, human
gagagactatgactgcccta

SEQ ID NO: 383093 - DNA, 20 bp, human
gtgatttgccgcaggacggg

SEQ ID NO: 383094 - DNA, 20 bp, human
gaagagaacacttccggggc

SEQ ID NO: 383095 - DNA, 20 bp, human
ggccgcgaagagaacacttc

SEQ ID NO: 383096 - DNA, 20 bp, human
gccgccagggagacgaggga

SEQ ID NO: 383097 - DNA, 20 bp, human
gcaggccccaatcgcggtgt

SEQ ID NO: 383098 - DNA, 20 bp, human
gcgagcactccgatctcctc

SEQ ID NO: 383099 - DNA, 20 bp, human
gtccgcccacaccgcgattg

SEQ ID NO: 383100 - DNA, 20 bp, human
gcgcaaggccagcgccgcca

SEQ ID NO: 383101 - DNA, 20 bp, human
gcgcgaggccgctcggggaa

SEQ ID NO: 383102 - DNA, 20 bp, human
ggagatcggagtgctcggat

SEQ ID NO: 383103 - DNA, 20 bp, human
ggccctgcgcgaggccgctc

SEQ ID NO: 383104 - DNA, 20 bp, human
gtgtgagcaggccccaatcg

SEQ ID NO: 383105 - DNA, 20 bp, human
gcagcgccgccagggagacg

SEQ ID NO: 383106 - DNA, 20 bp, human
gatcccggaagcatcacgag

SEQ ID NO: 383107 - DNA, 20 bp, human
ggaggagagtgcgtgagcag

SEQ ID NO: 383108 - DNA, 20 bp, human
gaagccccaccgcaccgtca

SEQ ID NO: 383109 - DNA, 20 bp, human
gcgtccctgacggtgcggtg

SEQ ID NO: 383110 - DNA, 20 bp, human
gccctgcagcgaagactccg

SEQ ID NO: 383111 - DNA, 20 bp, human
gaagctgagaaccctagctc

SEQ ID NO: 383112 - DNA, 20 bp, human
ggagcagcggtgcgcgatcc

SEQ ID NO: 383113 - DNA, 20 bp, human
gtccccctcgtgatgcttcc

SEQ ID NO: 383114 - DNA, 20 bp, human
gaaaaaaaggggccgcggga

SEQ ID NO: 383115 - DNA, 20 bp, human
gccggtcggggccggagcta

SEQ ID NO: 383116 - DNA, 20 bp, human
gcacccgaactgagtcgcta

SEQ ID NO: 383117 - DNA, 20 bp, human
gctacccaagaaccccgagt

SEQ ID NO: 383118 - DNA, 20 bp, human
gactcagttcgggtgggcgt

SEQ ID NO: 383119 - DNA, 20 bp, human
gtcgcccgaccggtgttcac

SEQ ID NO: 383120 - DNA, 20 bp, human
gtggcctgtgaacaccggtc

SEQ ID NO: 383121 - DNA, 20 bp, human
gtagagtggcctgtgaacac

SEQ ID NO: 383122 - DNA, 20 bp, human
ggaaccccgagtaggctgtt

SEQ ID NO: 383123 - DNA, 20 bp, human
gttccctagcgactcagttc

SEQ ID NO: 383124 - DNA, 20 bp, human
gcagcctactcggggttctt

SEQ ID NO: 383125 - DNA, 20 bp, human
gtaggctgtttggctgactc

SEQ ID NO: 383126 - DNA, 20 bp, human
gcaacgacgtggagactcgc

SEQ ID NO: 383127 - DNA, 20 bp, human
gcacgcgagcgaagggtcaa

SEQ ID NO: 383128 - DNA, 20 bp, human
gagctcccggcattcctcgt

SEQ ID NO: 383129 - DNA, 20 bp, human
gccagcggaaacccgaggca

SEQ ID NO: 383130 - DNA, 20 bp, human
gggcaaggcagccaacgacg

SEQ ID NO: 383131 - DNA, 20 bp, human
gtggttaggggtagatatta

SEQ ID NO: 383132 - DNA, 20 bp, human
gcctttgcgaggttactaca

SEQ ID NO: 383133 - DNA, 20 bp, human
gtaaggccgaagacttcgga

SEQ ID NO: 383134 - DNA, 20 bp, human
gactcgcgggcccctttgcg

SEQ ID NO: 383135 - DNA, 20 bp, human
ggaagtaaggccgaagactt

SEQ ID NO: 383136 - DNA, 20 bp, human
gcggaagggactacaaatcc

SEQ ID NO: 383137 - DNA, 20 bp, human
gtctaccaaagaataggtaa

SEQ ID NO: 383138 - DNA, 20 bp, human
gttctcccttacctattctt

SEQ ID NO: 383139 - DNA, 20 bp, human
gcggaacaaccccagaagaa

SEQ ID NO: 383140 - DNA, 20 bp, human
gaactcatcacctttcttct

SEQ ID NO: 383141 - DNA, 20 bp, human
gtgtagtcccttccggggcg

SEQ ID NO: 383142 - DNA, 20 bp, human
ggggaagaggtgttaagaag

SEQ ID NO: 383143 - DNA, 20 bp, human
gtgagcttgtcccatgaaaa

SEQ ID NO: 383144 - DNA, 20 bp, human
gcagagctttctgctcttaa

SEQ ID NO: 383145 - DNA, 20 bp, human
ggctttctgctcttaaggga

SEQ ID NO: 383146 - DNA, 20 bp, human
gagctgctggacactctctt

SEQ ID NO: 383147 - DNA, 20 bp, human
gtcagcgcggaggcccccga

SEQ ID NO: 383148 - DNA, 20 bp, human
gtaaggaaggggcggccgac

SEQ ID NO: 383149 - DNA, 20 bp, human
gacgccaccacctccctcgg

SEQ ID NO: 383150 - DNA, 20 bp, human
gggacactctcttaggccct

SEQ ID NO: 383151 - DNA, 20 bp, human
ggggcggccgaccggaagcg

SEQ ID NO: 383152 - DNA, 20 bp, human
gggaagcgaggcgtagaggc

SEQ ID NO: 383153 - DNA, 20 bp, human
gcccgcgcaccatagagaac

SEQ ID NO: 383154 - DNA, 20 bp, human
gtggagcgcccactagctgc

SEQ ID NO: 383155 - DNA, 20 bp, human
ggggagtaagccactgccgg

SEQ ID NO: 383156 - DNA, 20 bp, human
gacaggggaggagtctctga

SEQ ID NO: 383157 - DNA, 20 bp, human
gcctgggggcctcgctgcaa

SEQ ID NO: 383158 - DNA, 20 bp, human
gcctcccgcgggccgccttg

SEQ ID NO: 383159 - DNA, 20 bp, human
ggggatctgggcgacagggg

SEQ ID NO: 383160 - DNA, 20 bp, human
gtggacgccaggtgcgtgta

SEQ ID NO: 383161 - DNA, 20 bp, human
gggtgggatctgggcgacag

SEQ ID NO: 383162 - DNA, 20 bp, human
gagggctgctgcaggatcat

SEQ ID NO: 383163 - DNA, 20 bp, human
gtcgcccagatcccacccgc

SEQ ID NO: 383164 - DNA, 20 bp, human
gggtctgcaggatgaatacg

SEQ ID NO: 383165 - DNA, 20 bp, human
gaatacggggtggggcgaat

SEQ ID NO: 383166 - DNA, 20 bp, human
ggccgcccccggggagtacc

SEQ ID NO: 383167 - DNA, 20 bp, human
ggccggcgcgagttggggcg

SEQ ID NO: 383168 - DNA, 20 bp, human
gtccgggcgagctcacctgg

SEQ ID NO: 383169 - DNA, 20 bp, human
gcgctcccggtactccccgg

SEQ ID NO: 383170 - DNA, 20 bp, human
ggccgggtaaacagccatgg

SEQ ID NO: 383171 - DNA, 20 bp, human
gcggggcggcctctgggcgt

SEQ ID NO: 383172 - DNA, 20 bp, human
gcccaggagaggcgggacta

SEQ ID NO: 383173 - DNA, 20 bp, human
ggggtgggctcgtttccctg

SEQ ID NO: 383174 - DNA, 20 bp, human
gggccgggcgggggctgcaa

SEQ ID NO: 383175 - DNA, 20 bp, human
gtgacggggacgcccggatc

SEQ ID NO: 383176 - DNA, 20 bp, human
gcaccccagcggctctggaa

SEQ ID NO: 383177 - DNA, 20 bp, human
ggcaccgccgagaccaataa

SEQ ID NO: 383178 - DNA, 20 bp, human
ggagccccgcccacagctaa

SEQ ID NO: 383179 - DNA, 20 bp, human
gacgcctctgagcctctgcg

SEQ ID NO: 383180 - DNA, 20 bp, human
gaaccctcccggtccgttat

SEQ ID NO: 383181 - DNA, 20 bp, human
ggttacggcgagtgcgcaga

SEQ ID NO: 383182 - DNA, 20 bp, human
gtctggaatggtagagcaag

SEQ ID NO: 383183 - DNA, 20 bp, human
gggtccgttattggtctcgg

SEQ ID NO: 383184 - DNA, 20 bp, human
gctggggtggctaggacgga

SEQ ID NO: 383185 - DNA, 20 bp, human
gctggggcggcgcgcgcaca

SEQ ID NO: 383186 - DNA, 20 bp, human
ggtggaccctggtccaggca

SEQ ID NO: 383187 - DNA, 20 bp, human
gtgggtggaggagtggaccc

SEQ ID NO: 383188 - DNA, 20 bp, human
ggaagagaaggcgtcacttc

SEQ ID NO: 383189 - DNA, 20 bp, human
gacaagataggactccctag

SEQ ID NO: 383190 - DNA, 20 bp, human
gccacggagaagatttggat

SEQ ID NO: 383191 - DNA, 20 bp, human
gagacactggtgaaggcccc

SEQ ID NO: 383192 - DNA, 20 bp, human
gagtgacgccttctcttccc

SEQ ID NO: 383193 - DNA, 20 bp, human
gagccaccagacactggtga

SEQ ID NO: 383194 - DNA, 20 bp, human
gggccttcaccagtgtctgg

SEQ ID NO: 383195 - DNA, 20 bp, human
gacacaccacggagaagatt

SEQ ID NO: 383196 - DNA, 20 bp, human
gcaccaagtacccactcctg

SEQ ID NO: 383197 - DNA, 20 bp, human
ggagcagccgcgagccggcc

SEQ ID NO: 383198 - DNA, 20 bp, human
gtggggagggcgagtccgag

SEQ ID NO: 383199 - DNA, 20 bp, human
ggcggccggacctctggcgg

SEQ ID NO: 383200 - DNA, 20 bp, human
ggcagggagcagccgcgagc

SEQ ID NO: 383201 - DNA, 20 bp, human
ggggcggctcccgcaggagt

SEQ ID NO: 383202 - DNA, 20 bp, human
ggaagttaaaaggacatcag

SEQ ID NO: 383203 - DNA, 20 bp, human
gtcacacagtgagttaccgg

SEQ ID NO: 383204 - DNA, 20 bp, human
gtcccgcaggagtgggtact

SEQ ID NO: 383205 - DNA, 20 bp, human
ggcttgccgggagaattggg

SEQ ID NO: 383206 - DNA, 20 bp, human
ggaggagggcggtggacgga

SEQ ID NO: 383207 - DNA, 20 bp, human
gtcacgcgctcggttgtcgg

SEQ ID NO: 383208 - DNA, 20 bp, human
gcggttgtcggcggtcacgt

SEQ ID NO: 383209 - DNA, 20 bp, human
ggcgtcacgcgctcggttgt

SEQ ID NO: 383210 - DNA, 20 bp, human
gtcccctccccccgcctggg

SEQ ID NO: 383211 - DNA, 20 bp, human
gagcgcgtgacgcaaagcgg

SEQ ID NO: 383212 - DNA, 20 bp, human
gcaagctggcccggagtggg

SEQ ID NO: 383213 - DNA, 20 bp, human
gtctacgccgtcgccgtcgt

SEQ ID NO: 383214 - DNA, 20 bp, human
ggatggcagccaagtcggcc

SEQ ID NO: 383215 - DNA, 20 bp, human
gttgggaaacgtagttctga

SEQ ID NO: 383216 - DNA, 20 bp, human
gtaggcgtaggaagctactg

SEQ ID NO: 383217 - DNA, 20 bp, human
gaaaagtggagagaccgggg

SEQ ID NO: 383218 - DNA, 20 bp, human
gtataaaagtggagagaccg

SEQ ID NO: 383219 - DNA, 20 bp, human
gtcgcgcgacgcccagtcgc

SEQ ID NO: 383220 - DNA, 20 bp, human
gcagcccggggcggtggcga

SEQ ID NO: 383221 - DNA, 20 bp, human
gagaccggggaggtgcggcg

SEQ ID NO: 383222 - DNA, 20 bp, human
gtgcaaaatgtcaactcctt

SEQ ID NO: 383223 - DNA, 20 bp, human
ggtaggaagctactgcggct

SEQ ID NO: 383224 - DNA, 20 bp, human
gtaagacagcgcccgggaag

SEQ ID NO: 383225 - DNA, 20 bp, human
gccggggagcgccggcgact

SEQ ID NO: 383226 - DNA, 20 bp, human
gagctgggatgacaagtaga

SEQ ID NO: 383227 - DNA, 20 bp, human
gaggctggcagatctgtctc

SEQ ID NO: 383228 - DNA, 20 bp, human
gggggcagtcatgcagagct

SEQ ID NO: 383229 - DNA, 20 bp, human
ggaagagtcgggttcttgct

SEQ ID NO: 383230 - DNA, 20 bp, human
gctgggattggcccaaaaca

SEQ ID NO: 383231 - DNA, 20 bp, human
ggagcctagaaatagtgcgg

SEQ ID NO: 383232 - DNA, 20 bp, human
ggatcacctgatacagatgc

SEQ ID NO: 383233 - DNA, 20 bp, human
ggggtgactccattgtgaaa

SEQ ID NO: 383234 - DNA, 20 bp, human
ggagtgaactgtgctttgga

SEQ ID NO: 383235 - DNA, 20 bp, human
gtgacccaacagctgggcat

SEQ ID NO: 383236 - DNA, 20 bp, human
gcggaccaggggtttaacga

SEQ ID NO: 383237 - DNA, 20 bp, human
gagctggggaccggcaggaa

SEQ ID NO: 383238 - DNA, 20 bp, human
gggcccgcccccgacggcgt

SEQ ID NO: 383239 - DNA, 20 bp, human
gtgcgctgcccagaaggggc

SEQ ID NO: 383240 - DNA, 20 bp, human
gtggcgagctggggaccggc

SEQ ID NO: 383241 - DNA, 20 bp, human
gcggccagccaaggtcctgc

SEQ ID NO: 383242 - DNA, 20 bp, human
gcggctgtgtgctgtggatg

SEQ ID NO: 383243 - DNA, 20 bp, human
gacacgggaccgggcgtggt

SEQ ID NO: 383244 - DNA, 20 bp, human
gaggggacctgcgtctgccg

SEQ ID NO: 383245 - DNA, 20 bp, human
gccagccaaggtcctgcggg

SEQ ID NO: 383246 - DNA, 20 bp, human
gtctgagctaacaggggagc

SEQ ID NO: 383247 - DNA, 20 bp, human
gcaaatagcctgtaatagat

SEQ ID NO: 383248 - DNA, 20 bp, human
gaaaaccagaaatgagcaaa

SEQ ID NO: 383249 - DNA, 20 bp, human
gtcagactctgagctaacag

SEQ ID NO: 383250 - DNA, 20 bp, human
gtaacaggggagctggtgct

SEQ ID NO: 383251 - DNA, 20 bp, human
ggtgcccagttatggttccc

SEQ ID NO: 383252 - DNA, 20 bp, human
gagcctgtaatagatggggc

SEQ ID NO: 383253 - DNA, 20 bp, human
gaaatcctgggaaccataac

SEQ ID NO: 383254 - DNA, 20 bp, human
ggtgctaggcacacttgtgc

SEQ ID NO: 383255 - DNA, 20 bp, human
gtactcaacttgcactgtta

SEQ ID NO: 383256 - DNA, 20 bp, human
gactcagtgtggttcacaat

SEQ ID NO: 383257 - DNA, 20 bp, human
gtaggagggcacagactaga

SEQ ID NO: 383258 - DNA, 20 bp, human
ggggcacagactagagggac

SEQ ID NO: 383259 - DNA, 20 bp, human
gaggtcaagccaaccttcct

SEQ ID NO: 383260 - DNA, 20 bp, human
gcagactagagggactgggt

SEQ ID NO: 383261 - DNA, 20 bp, human
ggggtaaagccagctcaaac

SEQ ID NO: 383262 - DNA, 20 bp, human
gcaaccttcctgggtcatat

SEQ ID NO: 383263 - DNA, 20 bp, human
gggaatctgatgtgtcagtt

SEQ ID NO: 383264 - DNA, 20 bp, human
gtacccaatatgacccagga

SEQ ID NO: 383265 - DNA, 20 bp, human
gtccgaacatcatatttcta

SEQ ID NO: 383266 - DNA, 20 bp, human
gcagcccccgccagctggag

SEQ ID NO: 383267 - DNA, 20 bp, human
ggagggaggcgagagcgcga

SEQ ID NO: 383268 - DNA, 20 bp, human
ggaggggggcgtgagcccaa

SEQ ID NO: 383269 - DNA, 20 bp, human
gcgtgagcccaaaggagcag

SEQ ID NO: 383270 - DNA, 20 bp, human
gtaggcgggtatgtcggagg

SEQ ID NO: 383271 - DNA, 20 bp, human
gcagccccctctgctccttt

SEQ ID NO: 383272 - DNA, 20 bp, human
ggggccccagctgactgagc

SEQ ID NO: 383273 - DNA, 20 bp, human
gagtcaaatgctagatctag

SEQ ID NO: 383274 - DNA, 20 bp, human
gcgagaaagggggcgagcaa

SEQ ID NO: 383275 - DNA, 20 bp, human
gtaaagaactccggtgcaca

SEQ ID NO: 383276 - DNA, 20 bp, human
ggcggggagcagaggaactg

SEQ ID NO: 383277 - DNA, 20 bp, human
gcggtggggaacagctgccg

SEQ ID NO: 383278 - DNA, 20 bp, human
ggtcgctcgccttggggagc

SEQ ID NO: 383279 - DNA, 20 bp, human
ggggtaggcgaggcgcaagg

SEQ ID NO: 383280 - DNA, 20 bp, human
ggcgcggcagaggcggtagg

SEQ ID NO: 383281 - DNA, 20 bp, human
gcgcccgcggtcgctcgcct

SEQ ID NO: 383282 - DNA, 20 bp, human
gtacacctctgcgcagccat

SEQ ID NO: 383283 - DNA, 20 bp, human
gggggaacagctgccggggt

SEQ ID NO: 383284 - DNA, 20 bp, human
gccccaaggcgagcgaccgc

SEQ ID NO: 383285 - DNA, 20 bp, human
gctggtgcgtccgagagccg

SEQ ID NO: 383286 - DNA, 20 bp, human
gccgtgcggggccaacaatg

SEQ ID NO: 383287 - DNA, 20 bp, human
gccgaggcgcggatgcatga

SEQ ID NO: 383288 - DNA, 20 bp, human
gctgaactggggctacaagg

SEQ ID NO: 383289 - DNA, 20 bp, human
gacccccaacgcaggcagat

SEQ ID NO: 383290 - DNA, 20 bp, human
gggtacaggtctcatgcctg

SEQ ID NO: 383291 - DNA, 20 bp, human
gacaaggcggcggggagagt

SEQ ID NO: 383292 - DNA, 20 bp, human
gacacgcgctatgtaatggg

SEQ ID NO: 383293 - DNA, 20 bp, human
ggagacacgcgctatgtaat

SEQ ID NO: 383294 - DNA, 20 bp, human
gctcgcgggacccacagagg

SEQ ID NO: 383295 - DNA, 20 bp, human
gatgggagatgtagttccaa

SEQ ID NO: 383296 - DNA, 20 bp, human
gtggctggagccagcttcaa

SEQ ID NO: 383297 - DNA, 20 bp, human
gcggtctgcaatcgtgaaag

SEQ ID NO: 383298 - DNA, 20 bp, human
gtctgcaatcgtgaaagggg

SEQ ID NO: 383299 - DNA, 20 bp, human
gcctggcgcagcacggaatg

SEQ ID NO: 383300 - DNA, 20 bp, human
gagcgacggcctcccctagc

SEQ ID NO: 383301 - DNA, 20 bp, human
gattctggaagtggtgtcgg

SEQ ID NO: 383302 - DNA, 20 bp, human
gcgtgctgcgccaggtccta

SEQ ID NO: 383303 - DNA, 20 bp, human
ggctggaggaacaggtacca

SEQ ID NO: 383304 - DNA, 20 bp, human
ggaggcttcgaggccggcta

SEQ ID NO: 383305 - DNA, 20 bp, human
gttgggtggaagaagctata

SEQ ID NO: 383306 - DNA, 20 bp, human
gggggcgtgtgatgccaaag

SEQ ID NO: 383307 - DNA, 20 bp, human
gagacccataggggccacag

SEQ ID NO: 383308 - DNA, 20 bp, human
gtcaaccaggaagacccata

SEQ ID NO: 383309 - DNA, 20 bp, human
gctggtgcctaatcaaggag

SEQ ID NO: 383310 - DNA, 20 bp, human
gtgagagagacggagagcct

SEQ ID NO: 383311 - DNA, 20 bp, human
gcagccctctgtggccccta

SEQ ID NO: 383312 - DNA, 20 bp, human
gccgaggccacgtgacccga

SEQ ID NO: 383313 - DNA, 20 bp, human
gagcgagccgctcgcgcccg

SEQ ID NO: 383314 - DNA, 20 bp, human
gtggcccctatgggtcttcc

SEQ ID NO: 383315 - DNA, 20 bp, human
gacgtgacccgaaggcgcga

SEQ ID NO: 383316 - DNA, 20 bp, human
gggttcccccacaaggtctt

SEQ ID NO: 383317 - DNA, 20 bp, human
gaagctgaaagcggagagtc

SEQ ID NO: 383318 - DNA, 20 bp, human
gcccacaaggtcttggggaa

SEQ ID NO: 383319 - DNA, 20 bp, human
gcggaagccgcccccggaaa

SEQ ID NO: 383320 - DNA, 20 bp, human
gagtcacggtggctccgcgc

SEQ ID NO: 383321 - DNA, 20 bp, human
ggaagtcaggctacgagtca

SEQ ID NO: 383322 - DNA, 20 bp, human
gtggggaaaggagcatgcgc

SEQ ID NO: 383323 - DNA, 20 bp, human
ggtcaggctacgagtcacgg

SEQ ID NO: 383324 - DNA, 20 bp, human
gggcgtgacctgaccgcaag

SEQ ID NO: 383325 - DNA, 20 bp, human
gggcggcgggttcccccaca

SEQ ID NO: 383326 - DNA, 20 bp, human
gcctgccagccacagggtga

SEQ ID NO: 383327 - DNA, 20 bp, human
gaatcagaggcggagattgg

SEQ ID NO: 383328 - DNA, 20 bp, human
gaaaaggggaacaaccattg

SEQ ID NO: 383329 - DNA, 20 bp, human
gggggccctcaccctgtggc

SEQ ID NO: 383330 - DNA, 20 bp, human
gagagaaggcggtcccgcat

SEQ ID NO: 383331 - DNA, 20 bp, human
ggaggaggataatgttcttt

SEQ ID NO: 383332 - DNA, 20 bp, human
gtgggggagaaaggacggca

SEQ ID NO: 383333 - DNA, 20 bp, human
gtcccgcattggtgtgagag

SEQ ID NO: 383334 - DNA, 20 bp, human
ggctgccgcaccctgatccc

SEQ ID NO: 383335 - DNA, 20 bp, human
gtggcaggttgcggcggaag

SEQ ID NO: 383336 - DNA, 20 bp, human
ggggaggactacaaccccca

SEQ ID NO: 383337 - DNA, 20 bp, human
gcgagcgcaacggaggtcga

SEQ ID NO: 383338 - DNA, 20 bp, human
gtgccaggcgggctcccaag

SEQ ID NO: 383339 - DNA, 20 bp, human
gctgtcccactgcaccctgg

SEQ ID NO: 383340 - DNA, 20 bp, human
gcccgccagtgcgagcgcaa

SEQ ID NO: 383341 - DNA, 20 bp, human
gtgggagcccgcctggcacc

SEQ ID NO: 383342 - DNA, 20 bp, human
ggaggcgcgccccgaaacgc

SEQ ID NO: 383343 - DNA, 20 bp, human
ggacccccgcggcgcttggt

SEQ ID NO: 383344 - DNA, 20 bp, human
gctgggttgttagggctcgt

SEQ ID NO: 383345 - DNA, 20 bp, human
ggcaggaggtcaagctccgg

SEQ ID NO: 383346 - DNA, 20 bp, human
gcggctacaccttaatccat

SEQ ID NO: 383347 - DNA, 20 bp, human
gctcgcgtcgggtggaagag

SEQ ID NO: 383348 - DNA, 20 bp, human
ggggacgcctcagactgcgc

SEQ ID NO: 383349 - DNA, 20 bp, human
gtctgaggcgtccctcgcgt

SEQ ID NO: 383350 - DNA, 20 bp, human
gaggcgtccctcgcgtcggg

SEQ ID NO: 383351 - DNA, 20 bp, human
gcaagtgaacctatggatta

SEQ ID NO: 383352 - DNA, 20 bp, human
ggcggcccgggtaactttgc

SEQ ID NO: 383353 - DNA, 20 bp, human
gtccactccctcataattcg

SEQ ID NO: 383354 - DNA, 20 bp, human
gaccgcgaattatgagggag

SEQ ID NO: 383355 - DNA, 20 bp, human
gaaaccccaatacaagatgg

SEQ ID NO: 383356 - DNA, 20 bp, human
gtgtccaccgtccctgagca

SEQ ID NO: 383357 - DNA, 20 bp, human
ggctccctgctcagggacgg

SEQ ID NO: 383358 - DNA, 20 bp, human
gcactgcccacggtgacaca

SEQ ID NO: 383359 - DNA, 20 bp, human
gcagatcagcagtcgggtgg

SEQ ID NO: 383360 - DNA, 20 bp, human
gagggtagaagccaagagtc

SEQ ID NO: 383361 - DNA, 20 bp, human
gccctctcagctccctgctc

SEQ ID NO: 383362 - DNA, 20 bp, human
gttgcctactgggacactct

SEQ ID NO: 383363 - DNA, 20 bp, human
gggtgtctgatgtctccacg

SEQ ID NO: 383364 - DNA, 20 bp, human
gtctcaaaatgccagactct

SEQ ID NO: 383365 - DNA, 20 bp, human
gggtggacaggttgcctact

SEQ ID NO: 383366 - DNA, 20 bp, human
gctgcaagggggacgaccga

SEQ ID NO: 383367 - DNA, 20 bp, human
gcagccgcgacagcctgcaa

SEQ ID NO: 383368 - DNA, 20 bp, human
gcgacgaccaggaagtcggc

SEQ ID NO: 383369 - DNA, 20 bp, human
gaaaggcggggagaccaagt

SEQ ID NO: 383370 - DNA, 20 bp, human
gcggcgggctgggaggtaaa

SEQ ID NO: 383371 - DNA, 20 bp, human
gcgtgcgacgaccaggaagt

SEQ ID NO: 383372 - DNA, 20 bp, human
gacccgccaggtcaccgctc

SEQ ID NO: 383373 - DNA, 20 bp, human
gggtcccagggtttcctcgg

SEQ ID NO: 383374 - DNA, 20 bp, human
gacgtgaagaggagacttct

SEQ ID NO: 383375 - DNA, 20 bp, human
gtcccccttgcaggctgtcg

SEQ ID NO: 383376 - DNA, 20 bp, human
gaatccgaggcggtggatgc

SEQ ID NO: 383377 - DNA, 20 bp, human
gccggccagccaatccgagg

SEQ ID NO: 383378 - DNA, 20 bp, human
gtggctgcggcgcggatacc

SEQ ID NO: 383379 - DNA, 20 bp, human
gcagccgcgcgctccgagcc

SEQ ID NO: 383380 - DNA, 20 bp, human
ggagcggggcgttcggagtt

SEQ ID NO: 383381 - DNA, 20 bp, human
ggggaaaccgagctccgatt

SEQ ID NO: 383382 - DNA, 20 bp, human
gcgcgcgcgcggctcggcat

SEQ ID NO: 383383 - DNA, 20 bp, human
ggcctgcgggcgatctcccc

SEQ ID NO: 383384 - DNA, 20 bp, human
gggagatcgcccgcaggcag

SEQ ID NO: 383385 - DNA, 20 bp, human
gcctccgcctgcggcctcgg

SEQ ID NO: 383386 - DNA, 20 bp, human
gtgcttctccagttaggatg

SEQ ID NO: 383387 - DNA, 20 bp, human
gtaaatctgcttctccagtt

SEQ ID NO: 383388 - DNA, 20 bp, human
gaggcaatgcagagtcaata

SEQ ID NO: 383389 - DNA, 20 bp, human
gggtcttcccacatcctaac

SEQ ID NO: 383390 - DNA, 20 bp, human
gcagcattctgttgtatctt

SEQ ID NO: 383391 - DNA, 20 bp, human
gcatccattctatcttcaaa

SEQ ID NO: 383392 - DNA, 20 bp, human
ggttaagtgattaactataa

SEQ ID NO: 383393 - DNA, 20 bp, human
gtcactgagctccattcaag

SEQ ID NO: 383394 - DNA, 20 bp, human
ggcattgcctgtatcactct

SEQ ID NO: 383395 - DNA, 20 bp, human
gagcatctggagtagtggct

SEQ ID NO: 383396 - DNA, 20 bp, human
ggagctaaaaaaggtctttc

SEQ ID NO: 383397 - DNA, 20 bp, human
ggaggaaaaggtccacgggg

SEQ ID NO: 383398 - DNA, 20 bp, human
gcggggaatcccacccccat

SEQ ID NO: 383399 - DNA, 20 bp, human
ggggaatgataacattcaac

SEQ ID NO: 383400 - DNA, 20 bp, human
gcgtccgggactaataccac

SEQ ID NO: 383401 - DNA, 20 bp, human
ggtgcctgtggtattagtcc

SEQ ID NO: 383402 - DNA, 20 bp, human
gactaataccacaggcacct

SEQ ID NO: 383403 - DNA, 20 bp, human
gcctggaggaaaaggtccac

SEQ ID NO: 383404 - DNA, 20 bp, human
ggctgaatcaagtaccgatg

SEQ ID NO: 383405 - DNA, 20 bp, human
gggggtgggattccccgttg

SEQ ID NO: 383406 - DNA, 20 bp, human
ggaacgtgaccgcaagggtt

SEQ ID NO: 383407 - DNA, 20 bp, human
gcccccgcccagatgactgt

SEQ ID NO: 383408 - DNA, 20 bp, human
gttgctgaacgtgaccgcaa

SEQ ID NO: 383409 - DNA, 20 bp, human
ggaagagagcgcatgggtgc

SEQ ID NO: 383410 - DNA, 20 bp, human
gctggccccctgcagacagt

SEQ ID NO: 383411 - DNA, 20 bp, human
ggcagcaccgggaaagtccc

SEQ ID NO: 383412 - DNA, 20 bp, human
gagaactcgcatctgctctc

SEQ ID NO: 383413 - DNA, 20 bp, human
gggttgggaagagagcgcat

SEQ ID NO: 383414 - DNA, 20 bp, human
gacccacccgggacgcggaa

SEQ ID NO: 383415 - DNA, 20 bp, human
gggacgtgaggtcacggttt

SEQ ID NO: 383416 - DNA, 20 bp, human
gcaatggggaactgtcaccg

SEQ ID NO: 383417 - DNA, 20 bp, human
gggaggaggggaaaccgcaa

SEQ ID NO: 383418 - DNA, 20 bp, human
gggaaggagctcgcaaagaa

SEQ ID NO: 383419 - DNA, 20 bp, human
gtgctgcaccccctaatcag

SEQ ID NO: 383420 - DNA, 20 bp, human
gcggtccagctgtgagtcag

SEQ ID NO: 383421 - DNA, 20 bp, human
gcaccccctaatcaggggta

SEQ ID NO: 383422 - DNA, 20 bp, human
gccaaccatacccctgatta

SEQ ID NO: 383423 - DNA, 20 bp, human
gaggagctcgcaaagaaggg

SEQ ID NO: 383424 - DNA, 20 bp, human
gtgtgagtcaggggttaatg

SEQ ID NO: 383425 - DNA, 20 bp, human
ggaaaagtcgagactatctt

SEQ ID NO: 383426 - DNA, 20 bp, human
gtagcgctggggagcatcta

SEQ ID NO: 383427 - DNA, 20 bp, human
gcaaccgcctgtaaccacgg

SEQ ID NO: 383428 - DNA, 20 bp, human
gctggggagcatctagggag

SEQ ID NO: 383429 - DNA, 20 bp, human
gcggccgccgtggttacagg

SEQ ID NO: 383430 - DNA, 20 bp, human
gggggcgagaccaggaaacg

SEQ ID NO: 383431 - DNA, 20 bp, human
gtggcggccgccgtggttac

SEQ ID NO: 383432 - DNA, 20 bp, human
gagcgctaagttcccagcgg

SEQ ID NO: 383433 - DNA, 20 bp, human
gaccaggaaacggggcgtgg

SEQ ID NO: 383434 - DNA, 20 bp, human
gcccagcgctaagttcccag

SEQ ID NO: 383435 - DNA, 20 bp, human
gggttacaggcggttggcga

SEQ ID NO: 383436 - DNA, 20 bp, human
ggccacgtttcccaagaccg

SEQ ID NO: 383437 - DNA, 20 bp, human
gaagtttcgccattggaaag

SEQ ID NO: 383438 - DNA, 20 bp, human
gtaaagaggtggtgcctcgg

SEQ ID NO: 383439 - DNA, 20 bp, human
gtggtggagggagtgacggt

SEQ ID NO: 383440 - DNA, 20 bp, human
ggagaaaacttcagtctgat

SEQ ID NO: 383441 - DNA, 20 bp, human
gtgctctcgtaacttacgta

SEQ ID NO: 383442 - DNA, 20 bp, human
gttgtgcgcagtcgtgagtg

SEQ ID NO: 383443 - DNA, 20 bp, human
gcatttttggcggtgattgg

SEQ ID NO: 383444 - DNA, 20 bp, human
ggacggtgggcgggtctctg

SEQ ID NO: 383445 - DNA, 20 bp, human
gcttcagtctgattggtgga

SEQ ID NO: 383446 - DNA, 20 bp, human
ggcctgggaggagtcacttg

SEQ ID NO: 383447 - DNA, 20 bp, human
gccccaatctggcccccaca

SEQ ID NO: 383448 - DNA, 20 bp, human
gggggggcctagaggctcaa

SEQ ID NO: 383449 - DNA, 20 bp, human
gtggggggaaggttatggta

SEQ ID NO: 383450 - DNA, 20 bp, human
ggaaatgaggtggcttgggt

SEQ ID NO: 383451 - DNA, 20 bp, human
gaatctggcccccacaaggc

SEQ ID NO: 383452 - DNA, 20 bp, human
gtgaggtggggggaaggtta

SEQ ID NO: 383453 - DNA, 20 bp, human
gaggacacagacagttacat

SEQ ID NO: 383454 - DNA, 20 bp, human
gttatggtaagggcagacct

SEQ ID NO: 383455 - DNA, 20 bp, human
gcacccccctcctcaatagg

SEQ ID NO: 383456 - DNA, 20 bp, human
gtcacctcgagaggaaggaa

SEQ ID NO: 383457 - DNA, 20 bp, human
ggaggagaggccactcgttt

SEQ ID NO: 383458 - DNA, 20 bp, human
ggccgcctctctcagttctc

SEQ ID NO: 383459 - DNA, 20 bp, human
gaactgagagaggcggccag

SEQ ID NO: 383460 - DNA, 20 bp, human
gggagcgcgagtggagcggg

SEQ ID NO: 383461 - DNA, 20 bp, human
gcggtggcgcggaggttttc

SEQ ID NO: 383462 - DNA, 20 bp, human
ggggaaggcgcggtccgggt

SEQ ID NO: 383463 - DNA, 20 bp, human
ggcgctctttacaaaggccc

SEQ ID NO: 383464 - DNA, 20 bp, human
ggaaggggcgggagcgcgag

SEQ ID NO: 383465 - DNA, 20 bp, human
gagctggcgcctttctcacc

SEQ ID NO: 383466 - DNA, 20 bp, human
gaccctgggtgcaggtccta

SEQ ID NO: 383467 - DNA, 20 bp, human
gtgcaggtcctaaggtccct

SEQ ID NO: 383468 - DNA, 20 bp, human
ggaccttaggacctgcaccc

SEQ ID NO: 383469 - DNA, 20 bp, human
gccctgagggtctcaggaga

SEQ ID NO: 383470 - DNA, 20 bp, human
gcaggccatctgtctcagaa

SEQ ID NO: 383471 - DNA, 20 bp, human
ggcagaactgaaacccagga

SEQ ID NO: 383472 - DNA, 20 bp, human
gggaactttgcagataccct

SEQ ID NO: 383473 - DNA, 20 bp, human
gggacagatggctacgggac

SEQ ID NO: 383474 - DNA, 20 bp, human
gagctcgggcgatggggagt

SEQ ID NO: 383475 - DNA, 20 bp, human
gcaacatggcacttccctga

SEQ ID NO: 383476 - DNA, 20 bp, human
gccgcagccggatcccagca

SEQ ID NO: 383477 - DNA, 20 bp, human
gcgggggaactgttcgggga

SEQ ID NO: 383478 - DNA, 20 bp, human
gcctgaggcagtggcgacag

SEQ ID NO: 383479 - DNA, 20 bp, human
gcgcaggcccggtttggaag

SEQ ID NO: 383480 - DNA, 20 bp, human
gtacccgggcccaaggctga

SEQ ID NO: 383481 - DNA, 20 bp, human
ggagcggaagtcactccctg

SEQ ID NO: 383482 - DNA, 20 bp, human
gcgggcgcgggggaactgtt

SEQ ID NO: 383483 - DNA, 20 bp, human
ggcggggcgcagcggaacgt

SEQ ID NO: 383484 - DNA, 20 bp, human
gttcggggaaggggccccgg

SEQ ID NO: 383485 - DNA, 20 bp, human
gtggctgtgccgcccggtag

SEQ ID NO: 383486 - DNA, 20 bp, human
gcagcgccatggtattccaa

SEQ ID NO: 383487 - DNA, 20 bp, human
gatggtattccaaaggctgc

SEQ ID NO: 383488 - DNA, 20 bp, human
ggtgattttaatgcatcgtc

SEQ ID NO: 383489 - DNA, 20 bp, human
gcagatgggattccagtgtc

SEQ ID NO: 383490 - DNA, 20 bp, human
gcagcaccataaatttgctc

SEQ ID NO: 383491 - DNA, 20 bp, human
gatgaagtcatcaacatacg

SEQ ID NO: 383492 - DNA, 20 bp, human
gtttccgtggtgtacggaat

SEQ ID NO: 383493 - DNA, 20 bp, human
gttaaccaacagaaaacaga

SEQ ID NO: 383494 - DNA, 20 bp, human
ggacttcatagatttacgtt

SEQ ID NO: 383495 - DNA, 20 bp, human
gttacgtttggatactccac

SEQ ID NO: 383496 - DNA, 20 bp, human
ggcgcccaggggagtcctgc

SEQ ID NO: 383497 - DNA, 20 bp, human
ggcccgacgagccctgtagg

SEQ ID NO: 383498 - DNA, 20 bp, human
ggcggggcttctagcgcgga

SEQ ID NO: 383499 - DNA, 20 bp, human
gagggcccgacgagccctgt

SEQ ID NO: 383500 - DNA, 20 bp, human
ggaaccagcaggactcccct

SEQ ID NO: 383501 - DNA, 20 bp, human
ggtcgggccctcggggtcgg

SEQ ID NO: 383502 - DNA, 20 bp, human
ggcttctagcgcggaggggc

SEQ ID NO: 383503 - DNA, 20 bp, human
gggttcgtcgagcccctctg

SEQ ID NO: 383504 - DNA, 20 bp, human
gcagcagccgccgaccccga

SEQ ID NO: 383505 - DNA, 20 bp, human
gcggtctagggtcacggcca

SEQ ID NO: 383506 - DNA, 20 bp, human
gggctgggttgagaggtcgc

SEQ ID NO: 383507 - DNA, 20 bp, human
gccgggcaaggccggattga

SEQ ID NO: 383508 - DNA, 20 bp, human
gttgcccggccacgtctcgg

SEQ ID NO: 383509 - DNA, 20 bp, human
gagggcggagggatcctcgt

SEQ ID NO: 383510 - DNA, 20 bp, human
ggacaccaccgagacgtggc

SEQ ID NO: 383511 - DNA, 20 bp, human
ggggagagagaggccgtcca

SEQ ID NO: 383512 - DNA, 20 bp, human
gtagcccgcctcccggagaa

SEQ ID NO: 383513 - DNA, 20 bp, human
gtcgccggtccgactgtcct

SEQ ID NO: 383514 - DNA, 20 bp, human
ggccttgcccggccacgtct

SEQ ID NO: 383515 - DNA, 20 bp, human
ggcggagggatcctcgtggg

SEQ ID NO: 383516 - DNA, 20 bp, human
gcccccaccggcgacaccac

SEQ ID NO: 383517 - DNA, 20 bp, human
gtggccgcgaagcgcagggg

SEQ ID NO: 383518 - DNA, 20 bp, human
gcctccgcggtcatctccaa

SEQ ID NO: 383519 - DNA, 20 bp, human
gtcgcggccagtggtgtcgc

SEQ ID NO: 383520 - DNA, 20 bp, human
gaagcgccgagtgacgcacg

SEQ ID NO: 383521 - DNA, 20 bp, human
gctgccggacccgcccccac

SEQ ID NO: 383522 - DNA, 20 bp, human
gcgccgagtgacgcacgagg

SEQ ID NO: 383523 - DNA, 20 bp, human
gccgtgccccgacacttcaa

SEQ ID NO: 383524 - DNA, 20 bp, human
gcactggccgcgaagcgcag

SEQ ID NO: 383525 - DNA, 20 bp, human
gcacaagtgctgggaacggg

SEQ ID NO: 383526 - DNA, 20 bp, human
gcctcgcggcgcaccggaag

SEQ ID NO: 383527 - DNA, 20 bp, human
gtgggtccgctcccaagcta

SEQ ID NO: 383528 - DNA, 20 bp, human
ggggtctccctggcgatccg

SEQ ID NO: 383529 - DNA, 20 bp, human
ggcggcgcaccggaagcggt

SEQ ID NO: 383530 - DNA, 20 bp, human
gggcacaccacggatcgcca

SEQ ID NO: 383531 - DNA, 20 bp, human
gacccacacgaactgctcaa

SEQ ID NO: 383532 - DNA, 20 bp, human
gtcgccagggagacccgtcc

SEQ ID NO: 383533 - DNA, 20 bp, human
gccggggagctcgaggaaga

SEQ ID NO: 383534 - DNA, 20 bp, human
gtccgctcccaagctagggc

SEQ ID NO: 383535 - DNA, 20 bp, human
gggctgttgcgcttgcgcca

SEQ ID NO: 383536 - DNA, 20 bp, human
gccgaaaggccgccgatctg

SEQ ID NO: 383537 - DNA, 20 bp, human
gccagagcgccggccggaag

SEQ ID NO: 383538 - DNA, 20 bp, human
gagcctcagaaagcgaggag

SEQ ID NO: 383539 - DNA, 20 bp, human
gggccaccgcctacggaaaa

SEQ ID NO: 383540 - DNA, 20 bp, human
ggcgccgcggccaccgccta

SEQ ID NO: 383541 - DNA, 20 bp, human
gctggctctgtacctggaca

SEQ ID NO: 383542 - DNA, 20 bp, human
gcagggctgcggtaggccag

SEQ ID NO: 383543 - DNA, 20 bp, human
gtcccctatggcttcgaccc

SEQ ID NO: 383544 - DNA, 20 bp, human
gggaggcagccattttccgt

SEQ ID NO: 383545 - DNA, 20 bp, human
gggccgaggtaaccgagaag

SEQ ID NO: 383546 - DNA, 20 bp, human
gatagggtgagccacaagaa

SEQ ID NO: 383547 - DNA, 20 bp, human
ggctactgatgaggaactgt

SEQ ID NO: 383548 - DNA, 20 bp, human
gttagaggtacactcgtctt

SEQ ID NO: 383549 - DNA, 20 bp, human
gctctgagaaaagacggtct

SEQ ID NO: 383550 - DNA, 20 bp, human
gacaaatacacaaactgcat

SEQ ID NO: 383551 - DNA, 20 bp, human
gtagccgactgcagatagga

SEQ ID NO: 383552 - DNA, 20 bp, human
gtgcagtcggctactttcag

SEQ ID NO: 383553 - DNA, 20 bp, human
ggaagaatctgctactgatg

SEQ ID NO: 383554 - DNA, 20 bp, human
gaaagtagccgactgcagat

SEQ ID NO: 383555 - DNA, 20 bp, human
ggtctcggaaaaaccaagtt

SEQ ID NO: 383556 - DNA, 20 bp, human
ggggggaagccatgtaggac

SEQ ID NO: 383557 - DNA, 20 bp, human
gcacacacacactagtcacc

SEQ ID NO: 383558 - DNA, 20 bp, human
gccaccctgtcagcattaac

SEQ ID NO: 383559 - DNA, 20 bp, human
gtgtgtgtggagggatggcg

SEQ ID NO: 383560 - DNA, 20 bp, human
gacagcagttgggacaactg

SEQ ID NO: 383561 - DNA, 20 bp, human
gacaactgtggcacatgcac

SEQ ID NO: 383562 - DNA, 20 bp, human
gctacatggcttcccccaat

SEQ ID NO: 383563 - DNA, 20 bp, human
gggcctccttgccctaataa

SEQ ID NO: 383564 - DNA, 20 bp, human
gtggatgcttgtgcacatat

SEQ ID NO: 383565 - DNA, 20 bp, human
gatcatgcatcgcccattgg

SEQ ID NO: 383566 - DNA, 20 bp, human
gagcctagagtcacctcctt

SEQ ID NO: 383567 - DNA, 20 bp, human
gggtgactctaggctctcac

SEQ ID NO: 383568 - DNA, 20 bp, human
gagtccagtgatgaaggatt

SEQ ID NO: 383569 - DNA, 20 bp, human
gtagtggaaggttgaggcca

SEQ ID NO: 383570 - DNA, 20 bp, human
ggctagacattgccctccag

SEQ ID NO: 383571 - DNA, 20 bp, human
gagattttgttgctagtgga

SEQ ID NO: 383572 - DNA, 20 bp, human
gctcatgtgccaatagctga

SEQ ID NO: 383573 - DNA, 20 bp, human
ggcaccttggttctgaacct

SEQ ID NO: 383574 - DNA, 20 bp, human
gattcctaatccttcatcac

SEQ ID NO: 383575 - DNA, 20 bp, human
gcactggactctcctctgga

SEQ ID NO: 383576 - DNA, 20 bp, human
ggaaaagggaagcgagtgca

SEQ ID NO: 383577 - DNA, 20 bp, human
gagcgaactggggcggagat

SEQ ID NO: 383578 - DNA, 20 bp, human
ggggcggagattggtgaaga

SEQ ID NO: 383579 - DNA, 20 bp, human
ggactccgagcgaactgggg

SEQ ID NO: 383580 - DNA, 20 bp, human
gcccgcctcgctcttcgcgc

SEQ ID NO: 383581 - DNA, 20 bp, human
gcgtgactccgagcgaactg

SEQ ID NO: 383582 - DNA, 20 bp, human
gtccgcttgactagaagaag

SEQ ID NO: 383583 - DNA, 20 bp, human
gagaatcaaagtccgattag

SEQ ID NO: 383584 - DNA, 20 bp, human
gagtaaagagctgaagtaca

SEQ ID NO: 383585 - DNA, 20 bp, human
gaggaatggtcttctgggat

SEQ ID NO: 383586 - DNA, 20 bp, human
gaactcggcgatcatagaga

SEQ ID NO: 383587 - DNA, 20 bp, human
gcaccccgcccaagcttcta

SEQ ID NO: 383588 - DNA, 20 bp, human
gggcgatcatagagagggag

SEQ ID NO: 383589 - DNA, 20 bp, human
gccgctcggtgacatcccaa

SEQ ID NO: 383590 - DNA, 20 bp, human
gtaccatagaagcttgggcg

SEQ ID NO: 383591 - DNA, 20 bp, human
gagtcggctgtctggaacgg

SEQ ID NO: 383592 - DNA, 20 bp, human
gcgacttgccagtgctagag

SEQ ID NO: 383593 - DNA, 20 bp, human
gaggagtcggctgtctggaa

SEQ ID NO: 383594 - DNA, 20 bp, human
gggctccagcggaagcacgt

SEQ ID NO: 383595 - DNA, 20 bp, human
gaataccaacgagacggcgc

SEQ ID NO: 383596 - DNA, 20 bp, human
gacgtcgcagattataaggg

SEQ ID NO: 383597 - DNA, 20 bp, human
ggccacgtcgcagattataa

SEQ ID NO: 383598 - DNA, 20 bp, human
gcggaaatgacgtcctctcc

SEQ ID NO: 383599 - DNA, 20 bp, human
gctctccgggcagaagaagc

SEQ ID NO: 383600 - DNA, 20 bp, human
ggtggccggcttcttctgcc

SEQ ID NO: 383601 - DNA, 20 bp, human
gctgctgctaggatcgcgac

SEQ ID NO: 383602 - DNA, 20 bp, human
gctaggatcgcgacgggaac

SEQ ID NO: 383603 - DNA, 20 bp, human
gggagctgacgtcgcagcca

SEQ ID NO: 383604 - DNA, 20 bp, human
gcggcaccgagaagctgaaa

SEQ ID NO: 383605 - DNA, 20 bp, human
gccgggccgctcttcccctc

SEQ ID NO: 383606 - DNA, 20 bp, human
ggggccctccgctcatgcgg

SEQ ID NO: 383607 - DNA, 20 bp, human
ggggtagctcgtgtaggtaa

SEQ ID NO: 383608 - DNA, 20 bp, human
ggagtccgcgcggacgggga

SEQ ID NO: 383609 - DNA, 20 bp, human
gggggggccctccgctcatg

SEQ ID NO: 383610 - DNA, 20 bp, human
gtcagcttgtgcaacagcgt

SEQ ID NO: 383611 - DNA, 20 bp, human
ggcctccagctcgtcccgaa

SEQ ID NO: 383612 - DNA, 20 bp, human
gcgcgcgcccgggccattca

SEQ ID NO: 383613 - DNA, 20 bp, human
gcaggcctccgcatgagcgg

SEQ ID NO: 383614 - DNA, 20 bp, human
gccccccgcgcgaccttgaa

SEQ ID NO: 383615 - DNA, 20 bp, human
gctactccccggccaagtca

SEQ ID NO: 383616 - DNA, 20 bp, human
ggccctgcccacgtcctcaa

SEQ ID NO: 383617 - DNA, 20 bp, human
gggccgcggcgtggcgagac

SEQ ID NO: 383618 - DNA, 20 bp, human
gcctcaaaggccgcgagtcc

SEQ ID NO: 383619 - DNA, 20 bp, human
gacgctggccacaggagtcc

SEQ ID NO: 383620 - DNA, 20 bp, human
ggtggtcggggcattggccg

SEQ ID NO: 383621 - DNA, 20 bp, human
gccgaccacacgctggccac

SEQ ID NO: 383622 - DNA, 20 bp, human
ggccgcgagtcccggctgtg

SEQ ID NO: 383623 - DNA, 20 bp, human
gtcgcggcctttgaggacgt

SEQ ID NO: 383624 - DNA, 20 bp, human
gcacactacccggtcaccag

SEQ ID NO: 383625 - DNA, 20 bp, human
gaggcggaagtgatcccgag

SEQ ID NO: 383626 - DNA, 20 bp, human
gcactcgtgcaggtagtgga

SEQ ID NO: 383627 - DNA, 20 bp, human
ggccaaggacgcactctcat

SEQ ID NO: 383628 - DNA, 20 bp, human
gccctccgcacttcagaaat

SEQ ID NO: 383629 - DNA, 20 bp, human
gcggaggggccgggcttctt

SEQ ID NO: 383630 - DNA, 20 bp, human
gtgaaggcctcgttgagaga

SEQ ID NO: 383631 - DNA, 20 bp, human
gtaactggactacgctcagg

SEQ ID NO: 383632 - DNA, 20 bp, human
gccggcagtcatggggacgc

SEQ ID NO: 383633 - DNA, 20 bp, human
gcgtagacgcacaccggcgt

SEQ ID NO: 383634 - DNA, 20 bp, human
ggcgacacgagagagacggg

SEQ ID NO: 383635 - DNA, 20 bp, human
gtttcaggctcggggagtga

SEQ ID NO: 383636 - DNA, 20 bp, human
gacgcctccgcgcccagcgt

SEQ ID NO: 383637 - DNA, 20 bp, human
gtccctggagcggcggaaag

SEQ ID NO: 383638 - DNA, 20 bp, human
gtgggcgcggaggcgtctgg

SEQ ID NO: 383639 - DNA, 20 bp, human
gctctggccgccttgaattg

SEQ ID NO: 383640 - DNA, 20 bp, human
gcgcagacgctgcgcgtccc

SEQ ID NO: 383641 - DNA, 20 bp, human
gctgaaccacgtagggtggg

SEQ ID NO: 383642 - DNA, 20 bp, human
ggaaagtggggtgttggtgg

SEQ ID NO: 383643 - DNA, 20 bp, human
gaaggacctgcgccgtgctc

SEQ ID NO: 383644 - DNA, 20 bp, human
ggggaaacccccgtcttcct

SEQ ID NO: 383645 - DNA, 20 bp, human
gccgcctgaaccacgtaggg

SEQ ID NO: 383646 - DNA, 20 bp, human
gagcacgcgcaacgcttcct

SEQ ID NO: 383647 - DNA, 20 bp, human
ggggaaatgtagttgggtgt

SEQ ID NO: 383648 - DNA, 20 bp, human
ggctgcagcgcggtgagtac

SEQ ID NO: 383649 - DNA, 20 bp, human
gtgcggggagaaggacgcga

SEQ ID NO: 383650 - DNA, 20 bp, human
gcggaaggtgcggtgagagg

SEQ ID NO: 383651 - DNA, 20 bp, human
gtcgccgcaggaggaagccg

SEQ ID NO: 383652 - DNA, 20 bp, human
ggccgcggccgcaacgctcc

SEQ ID NO: 383653 - DNA, 20 bp, human
gctgccgtgctccggatcgc

SEQ ID NO: 383654 - DNA, 20 bp, human
gtcgacaagcgtcacgttgc

SEQ ID NO: 383655 - DNA, 20 bp, human
gtcccggaaggtgcggtgag

SEQ ID NO: 383656 - DNA, 20 bp, human
gcgcccggagctttcccagc

SEQ ID NO: 383657 - DNA, 20 bp, human
ggaggcaggtggggtgccag

SEQ ID NO: 383658 - DNA, 20 bp, human
gcaaagcggcgcattgaggc

SEQ ID NO: 383659 - DNA, 20 bp, human
gaacgaatcccgaatcaaag

SEQ ID NO: 383660 - DNA, 20 bp, human
gcggcgcattgaggcaggtg

SEQ ID NO: 383661 - DNA, 20 bp, human
gaagcaggcagcggcagaga

SEQ ID NO: 383662 - DNA, 20 bp, human
gcctgacggcagctttccgg

SEQ ID NO: 383663 - DNA, 20 bp, human
ggaaagcaggcgagtgttta

SEQ ID NO: 383664 - DNA, 20 bp, human
gacggcagctttccggtggt

SEQ ID NO: 383665 - DNA, 20 bp, human
ggatcagcaattgcagaagc

SEQ ID NO: 383666 - DNA, 20 bp, human
gcgcccggagctttccgagc

SEQ ID NO: 383667 - DNA, 20 bp, human
ggaggcaggtggggtgccag

SEQ ID NO: 383668 - DNA, 20 bp, human
gcaaagcggcgcattgaggc

SEQ ID NO: 383669 - DNA, 20 bp, human
gaacgaatcccgaatcaaag

SEQ ID NO: 383670 - DNA, 20 bp, human
gcggaagtgtggcgcttaac

SEQ ID NO: 383671 - DNA, 20 bp, human
gaagcaggcagcggcagaga

SEQ ID NO: 383672 - DNA, 20 bp, human
gcctgacggcagctttccgg

SEQ ID NO: 383673 - DNA, 20 bp, human
gcggcgcattgaggcaggtg

SEQ ID NO: 383674 - DNA, 20 bp, human
gacggcagctttccggtggt

SEQ ID NO: 383675 - DNA, 20 bp, human
ggaaggtcagcgtgtgaagt

SEQ ID NO: 383676 - DNA, 20 bp, human
gatagggcggggcattaaaa

SEQ ID NO: 383677 - DNA, 20 bp, human
ggcggggcattaaaagggta

SEQ ID NO: 383678 - DNA, 20 bp, human
ggaaggacggggcccgtgac

SEQ ID NO: 383679 - DNA, 20 bp, human
gcaaaacactgccctatcag

SEQ ID NO: 383680 - DNA, 20 bp, human
gcaggagcggggtttcgggt

SEQ ID NO: 383681 - DNA, 20 bp, human
gcccgggccacatccagtca

SEQ ID NO: 383682 - DNA, 20 bp, human
gtgattgggcgcgactacga

SEQ ID NO: 383683 - DNA, 20 bp, human
gggagggtcagatctgtgat

SEQ ID NO: 383684 - DNA, 20 bp, human
ggtagggagagccctccgat

SEQ ID NO: 383685 - DNA, 20 bp, human
ggggcagtgttttggaagga

SEQ ID NO: 383686 - DNA, 20 bp, human
gagagaccaaaggcatcggg

SEQ ID NO: 383687 - DNA, 20 bp, human
ggaccctgggggcgacaact

SEQ ID NO: 383688 - DNA, 20 bp, human
ggaagcccgagagagaccaa

SEQ ID NO: 383689 - DNA, 20 bp, human
gcgagagagaccaaaggcat

SEQ ID NO: 383690 - DNA, 20 bp, human
gggcgctctgcaaggcccaa

SEQ ID NO: 383691 - DNA, 20 bp, human
ggcaatccgcccgatgcctt

SEQ ID NO: 383692 - DNA, 20 bp, human
gacagccaatggaaacgcgg

SEQ ID NO: 383693 - DNA, 20 bp, human
gaatcccagttgtcgccccc

SEQ ID NO: 383694 - DNA, 20 bp, human
gccaatggaaacgcggggga

SEQ ID NO: 383695 - DNA, 20 bp, human
gcgaagagggagcgagtggg

SEQ ID NO: 383696 - DNA, 20 bp, human
ggagtggaacccgccgactc

SEQ ID NO: 383697 - DNA, 20 bp, human
gtacgggattgcggggtccg

SEQ ID NO: 383698 - DNA, 20 bp, human
ggactccgggaacgaagcac

SEQ ID NO: 383699 - DNA, 20 bp, human
gctgtggggccagcacggaa

SEQ ID NO: 383700 - DNA, 20 bp, human
gggcgccggtgcttcgttcc

SEQ ID NO: 383701 - DNA, 20 bp, human
gaggcagctagctgtggttc

SEQ ID NO: 383702 - DNA, 20 bp, human
gagcaccggcgccaaggtgt

SEQ ID NO: 383703 - DNA, 20 bp, human
gcgacgcagtgcactcacgg

SEQ ID NO: 383704 - DNA, 20 bp, human
gcagcacggaatggatcacg

SEQ ID NO: 383705 - DNA, 20 bp, human
ggcctcccacaccttggcgc

SEQ ID NO: 383706 - DNA, 20 bp, human
gcaccaacccggaaccactt

SEQ ID NO: 383707 - DNA, 20 bp, human
gcgcctaagtggttccgggt

SEQ ID NO: 383708 - DNA, 20 bp, human
gccgggtgggagatctcttg

SEQ ID NO: 383709 - DNA, 20 bp, human
gagcgagtggggagcattct

SEQ ID NO: 383710 - DNA, 20 bp, human
ggtgggaattgtcgcctaag

SEQ ID NO: 383711 - DNA, 20 bp, human
ggaagtgaggactcatctgc

SEQ ID NO: 383712 - DNA, 20 bp, human
gttgtcgcctaagtggttcc

SEQ ID NO: 383713 - DNA, 20 bp, human
gggtccagatgtttacccga

SEQ ID NO: 383714 - DNA, 20 bp, human
gcacgacgacgaaagaaaac

SEQ ID NO: 383715 - DNA, 20 bp, human
gggaagtcgcagtcctgatg

SEQ ID NO: 383716 - DNA, 20 bp, human
gccacgtccctaacggtctt

SEQ ID NO: 383717 - DNA, 20 bp, human
gcatgcgtgttgtgtctcaa

SEQ ID NO: 383718 - DNA, 20 bp, human
gacgtgggattaggtaaatt

SEQ ID NO: 383719 - DNA, 20 bp, human
gaagcagtgtcaacagtccc

SEQ ID NO: 383720 - DNA, 20 bp, human
ggacagattcgggtcattat

SEQ ID NO: 383721 - DNA, 20 bp, human
gtcgcttccgaagaccgtta

SEQ ID NO: 383722 - DNA, 20 bp, human
gccgttagggacgtgggatt

SEQ ID NO: 383723 - DNA, 20 bp, human
gggaagtgggtgttgacctg

SEQ ID NO: 383724 - DNA, 20 bp, human
gactgtagagcggtcttgtg

SEQ ID NO: 383725 - DNA, 20 bp, human
gtcctcgcgttataacgaat

SEQ ID NO: 383726 - DNA, 20 bp, human
gtgcacccccggaagtgagt

SEQ ID NO: 383727 - DNA, 20 bp, human
gaaccacaaacacggagcga

SEQ ID NO: 383728 - DNA, 20 bp, human
gtggcagccaactcacttcc

SEQ ID NO: 383729 - DNA, 20 bp, human
gcgaccggggcaaaggccag

SEQ ID NO: 383730 - DNA, 20 bp, human
ggtcatgcaaacggtgtctg

SEQ ID NO: 383731 - DNA, 20 bp, human
ggacccaggaaccacaaaca

SEQ ID NO: 383732 - DNA, 20 bp, human
gaagacttccggttgagggc

SEQ ID NO: 383733 - DNA, 20 bp, human
gccaaaagacttccggttga

SEQ ID NO: 383734 - DNA, 20 bp, human
gggcccaacccgccctcaac

SEQ ID NO: 383735 - DNA, 20 bp, human
gacacggagcgaaggcctgc

SEQ ID NO: 383736 - DNA, 20 bp, human
gagggtgtatctcctttcgt

SEQ ID NO: 383737 - DNA, 20 bp, human
ggcctctaagctctccgctg

SEQ ID NO: 383738 - DNA, 20 bp, human
gtctaagctctccgctgagg

SEQ ID NO: 383739 - DNA, 20 bp, human
gagtgactgacgtggaggtg

SEQ ID NO: 383740 - DNA, 20 bp, human
gtccgctgaggcggcttgga

SEQ ID NO: 383741 - DNA, 20 bp, human
ggctggcccgggcgaggccc

SEQ ID NO: 383742 - DNA, 20 bp, human
ggaaggaatagtgactgacg

SEQ ID NO: 383743 - DNA, 20 bp, human
gttggcttctgcactgatgg

SEQ ID NO: 383744 - DNA, 20 bp, human
gtgggtgattggatagattc

SEQ ID NO: 383745 - DNA, 20 bp, human
gtgagtcatagggagcttgg

SEQ ID NO: 383746 - DNA, 20 bp, human
gaatgctgggaaagaggcgg

SEQ ID NO: 383747 - DNA, 20 bp, human
gaggggatgccgctgacatc

SEQ ID NO: 383748 - DNA, 20 bp, human
gtagacgaaccggatgtcag

SEQ ID NO: 383749 - DNA, 20 bp, human
ggaaagttggctgtgatctt

SEQ ID NO: 383750 - DNA, 20 bp, human
gtcatcagggccaagttcgt

SEQ ID NO: 383751 - DNA, 20 bp, human
gctggttggtgcgagaaagt

SEQ ID NO: 383752 - DNA, 20 bp, human
gtggtcaaaacagaaacttc

SEQ ID NO: 383753 - DNA, 20 bp, human
gtgggatgctatatgacttc

SEQ ID NO: 383754 - DNA, 20 bp, human
ggagggaaatatgagtcaaa

SEQ ID NO: 383755 - DNA, 20 bp, human
gaggtggtctggttgacttc

SEQ ID NO: 383756 - DNA, 20 bp, human
ggcccggcctggcacgtcgg

SEQ ID NO: 383757 - DNA, 20 bp, human
gagtcccccgcgctgagtca

SEQ ID NO: 383758 - DNA, 20 bp, human
gcacaacaaaagcgcgggct

SEQ ID NO: 383759 - DNA, 20 bp, human
gagcggggaccggggtcggg

SEQ ID NO: 383760 - DNA, 20 bp, human
gggcgcagaaggccacgcag

SEQ ID NO: 383761 - DNA, 20 bp, human
gttggccgccagccaccggg

SEQ ID NO: 383762 - DNA, 20 bp, human
ggccgggcacaacaaaagcg

SEQ ID NO: 383763 - DNA, 20 bp, human
gaaacggggaggtggcgaca

SEQ ID NO: 383764 - DNA, 20 bp, human
gcgcgggcgccaggtggtgc

SEQ ID NO: 383765 - DNA, 20 bp, human
gaggccacgcagcggggacc

SEQ ID NO: 383766 - DNA, 20 bp, human
ggccccgccccctttttgga

SEQ ID NO: 383767 - DNA, 20 bp, human
gcagacgagaaggggcacga

SEQ ID NO: 383768 - DNA, 20 bp, human
ggggcaaggggtaacggggc

SEQ ID NO: 383769 - DNA, 20 bp, human
ggccgggggcaaggggtaac

SEQ ID NO: 383770 - DNA, 20 bp, human
gaccccgcctcgggctgttg

SEQ ID NO: 383771 - DNA, 20 bp, human
ggatctgaacgatccggggg

SEQ ID NO: 383772 - DNA, 20 bp, human
ggccagggcgcagacgagaa

SEQ ID NO: 383773 - DNA, 20 bp, human
gggcggcattattccctata

SEQ ID NO: 383774 - DNA, 20 bp, human
gcctcatcggccctccaaaa

SEQ ID NO: 383775 - DNA, 20 bp, human
gaaggatctgaacgatccgg

SEQ ID NO: 383776 - DNA, 20 bp, human
gaagcgatctggaagcagag

SEQ ID NO: 383777 - DNA, 20 bp, human
ggaggggaagcactgggaga

SEQ ID NO: 383778 - DNA, 20 bp, human
gggactggacggccccagca

SEQ ID NO: 383779 - DNA, 20 bp, human
ggacttaggcagggaaacag

SEQ ID NO: 383780 - DNA, 20 bp, human
gaggcagggaaacagaggtc

SEQ ID NO: 383781 - DNA, 20 bp, human
gaaactgagggctgtgattc

SEQ ID NO: 383782 - DNA, 20 bp, human
gccagatcgcttcatgactt

SEQ ID NO: 383783 - DNA, 20 bp, human
gatactcagtaagatgcaga

SEQ ID NO: 383784 - DNA, 20 bp, human
gaaggaaggcggagcccgtc

SEQ ID NO: 383785 - DNA, 20 bp, human
gcatgaggacagaaaaactg

SEQ ID NO: 383786 - DNA, 20 bp, human
gactcaggtggagagaacta

SEQ ID NO: 383787 - DNA, 20 bp, human
gggaaccttcagtatcttga

SEQ ID NO: 383788 - DNA, 20 bp, human
gagaactaaggtcaccctca

SEQ ID NO: 383789 - DNA, 20 bp, human
gctgggccatgtatattcta

SEQ ID NO: 383790 - DNA, 20 bp, human
gcggtgtgaatgaactatgg

SEQ ID NO: 383791 - DNA, 20 bp, human
gtcagcaagaaattccctga

SEQ ID NO: 383792 - DNA, 20 bp, human
ggtcaagaaaagtcagtact

SEQ ID NO: 383793 - DNA, 20 bp, human
ggaagtaaatggtgaaccca

SEQ ID NO: 383794 - DNA, 20 bp, human
gagcctccttagaatataca

SEQ ID NO: 383795 - DNA, 20 bp, human
ggtcaaggaacaagtttgta

SEQ ID NO: 383796 - DNA, 20 bp, human
gtaactaccccacaactcat

SEQ ID NO: 383797 - DNA, 20 bp, human
gccagcagtggcggaaggga

SEQ ID NO: 383798 - DNA, 20 bp, human
gcgccccagcagtggcggaa

SEQ ID NO: 383799 - DNA, 20 bp, human
gtggggttcccctaagggaa

SEQ ID NO: 383800 - DNA, 20 bp, human
gcctgcaagcccatgagttg

SEQ ID NO: 383801 - DNA, 20 bp, human
gggcggaagccgttccctta

SEQ ID NO: 383802 - DNA, 20 bp, human
ggacaagcacacgattgtcc

SEQ ID NO: 383803 - DNA, 20 bp, human
gtggagctgaggggctctgg

SEQ ID NO: 383804 - DNA, 20 bp, human
gaaggattgcggtttcacac

SEQ ID NO: 383805 - DNA, 20 bp, human
gggtggagaaggggggatat

SEQ ID NO: 383806 - DNA, 20 bp, human
gtcagaaggccacgccccag

SEQ ID NO: 383807 - DNA, 20 bp, human
ggccgccaactcatgtcagc

SEQ ID NO: 383808 - DNA, 20 bp, human
ggccggctgacatgagttgg

SEQ ID NO: 383809 - DNA, 20 bp, human
ggccacagagggaaccgtga

SEQ ID NO: 383810 - DNA, 20 bp, human
gtgacatgagttggcggctg

SEQ ID NO: 383811 - DNA, 20 bp, human
gacggccacaacagcctcag

SEQ ID NO: 383812 - DNA, 20 bp, human
ggcggtaagagggagccaat

SEQ ID NO: 383813 - DNA, 20 bp, human
gaccctcgggctcgagacag

SEQ ID NO: 383814 - DNA, 20 bp, human
gaagccccgtcactcccgtg

SEQ ID NO: 383815 - DNA, 20 bp, human
gagccaatgggcggccacag

SEQ ID NO: 383816 - DNA, 20 bp, human
gcgcgtgcgcgttcgttcga

SEQ ID NO: 383817 - DNA, 20 bp, human
ggaggcgcgcgagttctgtg

SEQ ID NO: 383818 - DNA, 20 bp, human
gaaaggacacgccccctcgc

SEQ ID NO: 383819 - DNA, 20 bp, human
gtgcgcgttcgttcgagggg

SEQ ID NO: 383820 - DNA, 20 bp, human
gagcctgggcggccggagtt

SEQ ID NO: 383821 - DNA, 20 bp, human
ggccggagttcggtggggtg

SEQ ID NO: 383822 - DNA, 20 bp, human
gaggaggccgggcgctcagt

SEQ ID NO: 383823 - DNA, 20 bp, human
gtggacttatgctcccgcga

SEQ ID NO: 383824 - DNA, 20 bp, human
ggacactgcggacgcgagaa

SEQ ID NO: 383825 - DNA, 20 bp, human
gtgggcggccggagttcggt

SEQ ID NO: 383826 - DNA, 20 bp, human
ggtgggaccgaaggcgggac

SEQ ID NO: 383827 - DNA, 20 bp, human
ggtgctgggcggaacctgag

SEQ ID NO: 383828 - DNA, 20 bp, human
gtcagtagggcggaaattgt

SEQ ID NO: 383829 - DNA, 20 bp, human
ggccctactgaattcttcag

SEQ ID NO: 383830 - DNA, 20 bp, human
gcctgcaaaacccgcctctc

SEQ ID NO: 383831 - DNA, 20 bp, human
gggaactcctggggcgagaa

SEQ ID NO: 383832 - DNA, 20 bp, human
ggcggaaattgtgggaccga

SEQ ID NO: 383833 - DNA, 20 bp, human
gtggcgccaaatccgtgcgg

SEQ ID NO: 383834 - DNA, 20 bp, human
gaaggcgggaccggcgtgct

SEQ ID NO: 383835 - DNA, 20 bp, human
gttcctctgaagaattcagt

SEQ ID NO: 383836 - DNA, 20 bp, human
gacgccggaacgtaagacgt

SEQ ID NO: 383837 - DNA, 20 bp, human
ggcggcacttgggttgcaga

SEQ ID NO: 383838 - DNA, 20 bp, human
gacttgggttgcagaaggtg

SEQ ID NO: 383839 - DNA, 20 bp, human
ggcggggccgggcatggtaa

SEQ ID NO: 383840 - DNA, 20 bp, human
gtcacccaacgagttcaaga

SEQ ID NO: 383841 - DNA, 20 bp, human
gagtcagaggggcggcactt

SEQ ID NO: 383842 - DNA, 20 bp, human
gccgccctcttgaactcgtt

SEQ ID NO: 383843 - DNA, 20 bp, human
ggggaagcagagcccgcgtc

SEQ ID NO: 383844 - DNA, 20 bp, human
gtgacccacgtcttacgttc

SEQ ID NO: 383845 - DNA, 20 bp, human
gaagaggcggagaagaagac

SEQ ID NO: 383846 - DNA, 20 bp, human
gcgccccaacgcaagcggag

SEQ ID NO: 383847 - DNA, 20 bp, human
gccagacccgggagactctc

SEQ ID NO: 383848 - DNA, 20 bp, human
gcggaccgccccaacgcaag

SEQ ID NO: 383849 - DNA, 20 bp, human
ggagactctcgggcacaatc

SEQ ID NO: 383850 - DNA, 20 bp, human
ggcagcccctgtgtccactg

SEQ ID NO: 383851 - DNA, 20 bp, human
gttgtgcccgagagtctccc

SEQ ID NO: 383852 - DNA, 20 bp, human
gagtctcccgggtctggact

SEQ ID NO: 383853 - DNA, 20 bp, human
gtcgggccgcagtggacaca

SEQ ID NO: 383854 - DNA, 20 bp, human
gaatccggctgcgggagacg

SEQ ID NO: 383855 - DNA, 20 bp, human
gctcgggcacaatccggctg

SEQ ID NO: 383856 - DNA, 20 bp, human
gtgggacactaggtaggtga

SEQ ID NO: 383857 - DNA, 20 bp, human
gaggactggccacagaagga

SEQ ID NO: 383858 - DNA, 20 bp, human
gctctcctgaaagcagggat

SEQ ID NO: 383859 - DNA, 20 bp, human
ggggaggtgggacactaggt

SEQ ID NO: 383860 - DNA, 20 bp, human
ggtcaggagcagggcaatag

SEQ ID NO: 383861 - DNA, 20 bp, human
gtggcgtgtcgcgtcatctg

SEQ ID NO: 383862 - DNA, 20 bp, human
gactggccacagaaggaagg

SEQ ID NO: 383863 - DNA, 20 bp, human
gtcatctgaggcggggccat

SEQ ID NO: 383864 - DNA, 20 bp, human
ggtgtcgcgtcatctgaggc

SEQ ID NO: 383865 - DNA, 20 bp, human
gcagggcaatagcgggaagc

SEQ ID NO: 383866 - DNA, 20 bp, human
gggattagaggctatgacaa

SEQ ID NO: 383867 - DNA, 20 bp, human
ggaagcagcccaaggattag

SEQ ID NO: 383868 - DNA, 20 bp, human
ggccaggggtggcacttccc

SEQ ID NO: 383869 - DNA, 20 bp, human
ggactctgctggcactggtg

SEQ ID NO: 383870 - DNA, 20 bp, human
gtcggaaagcacagtacaat

SEQ ID NO: 383871 - DNA, 20 bp, human
gcccaggggacacatcttgt

SEQ ID NO: 383872 - DNA, 20 bp, human
ggctatgacaagggctgcgt

SEQ ID NO: 383873 - DNA, 20 bp, human
ggtggtgggatggactctgc

SEQ ID NO: 383874 - DNA, 20 bp, human
gcacactgccgcctggccag

SEQ ID NO: 383875 - DNA, 20 bp, human
gccctgggaagtgccacccc

SEQ ID NO: 383876 - DNA, 20 bp, human
ggacaagccacgcacatcat

SEQ ID NO: 383877 - DNA, 20 bp, human
gccactgagcatgcccggcc

SEQ ID NO: 383878 - DNA, 20 bp, human
gccgcccgggtcttctccac

SEQ ID NO: 383879 - DNA, 20 bp, human
gtcccgaccccaagcgcgga

SEQ ID NO: 383880 - DNA, 20 bp, human
gcggacgccgcgttccttgg

SEQ ID NO: 383881 - DNA, 20 bp, human
gccgggtaacccaagtaact

SEQ ID NO: 383882 - DNA, 20 bp, human
gaggaagactcgcacggcag

SEQ ID NO: 383883 - DNA, 20 bp, human
gtccttccgcgcttggggtc

SEQ ID NO: 383884 - DNA, 20 bp, human
gtgcacaggcgctttctcct

SEQ ID NO: 383885 - DNA, 20 bp, human
ggctcaccccatgatgtgcg

SEQ ID NO: 383886 - DNA, 20 bp, human
gtggaggggtgcaggcgtgg

SEQ ID NO: 383887 - DNA, 20 bp, human
gccttccccggcaggcgcgt

SEQ ID NO: 383888 - DNA, 20 bp, human
gaccacccacgcgcctgccg

SEQ ID NO: 383889 - DNA, 20 bp, human
ggccaatttgacagtttccc

SEQ ID NO: 383890 - DNA, 20 bp, human
gtccccggcaggcgcgtggg

SEQ ID NO: 383891 - DNA, 20 bp, human
gggcgccacgctcgggtcgg

SEQ ID NO: 383892 - DNA, 20 bp, human
gcaccccggcggttgggctg

SEQ ID NO: 383893 - DNA, 20 bp, human
gagcccgatggttcgctccg

SEQ ID NO: 383894 - DNA, 20 bp, human
gcacgcgcgactcctggccg

SEQ ID NO: 383895 - DNA, 20 bp, human
gacccgcagcccaaccgccg

SEQ ID NO: 383896 - DNA, 20 bp, human
gcagctgcgtctccctcccg

SEQ ID NO: 383897 - DNA, 20 bp, human
gtactttggggtgtcgggaa

SEQ ID NO: 383898 - DNA, 20 bp, human
gcccccgggaagcatggttg

SEQ ID NO: 383899 - DNA, 20 bp, human
gcacgcacgccactcagcgg

SEQ ID NO: 383900 - DNA, 20 bp, human
ggtgtcgggaaaggcggaga

SEQ ID NO: 383901 - DNA, 20 bp, human
gccactcagcggtggggcag

SEQ ID NO: 383902 - DNA, 20 bp, human
gcctccccgccgctgctctc

SEQ ID NO: 383903 - DNA, 20 bp, human
gtcgcgcgcccagaaccctc

SEQ ID NO: 383904 - DNA, 20 bp, human
gccagaaccctccggtctca

SEQ ID NO: 383905 - DNA, 20 bp, human
ggctgctcgcagcgctactt

SEQ ID NO: 383906 - DNA, 20 bp, human
ggccagagcccggcccgaca

SEQ ID NO: 383907 - DNA, 20 bp, human
gtatccacgcagccgagagg

SEQ ID NO: 383908 - DNA, 20 bp, human
gctcggctgcgtggataacc

SEQ ID NO: 383909 - DNA, 20 bp, human
ggggctgacccgagacctgg

SEQ ID NO: 383910 - DNA, 20 bp, human
ggctgccagcaagacccggc

SEQ ID NO: 383911 - DNA, 20 bp, human
gcagacacgccccctggacg

SEQ ID NO: 383912 - DNA, 20 bp, human
ggaaacctccgccgcgtcca

SEQ ID NO: 383913 - DNA, 20 bp, human
gataacccccgcgcttggaa

SEQ ID NO: 383914 - DNA, 20 bp, human
gacacgccccctggacgcgg

SEQ ID NO: 383915 - DNA, 20 bp, human
gctggcagccttgtcgggcc

SEQ ID NO: 383916 - DNA, 20 bp, human
gactgcgcacagatctgcgt

SEQ ID NO: 383917 - DNA, 20 bp, human
gcctaagcacctaccatgtg

SEQ ID NO: 383918 - DNA, 20 bp, human
gcaggagcaagctcacctct

SEQ ID NO: 383919 - DNA, 20 bp, human
ggcctcggcggtgagggcac

SEQ ID NO: 383920 - DNA, 20 bp, human
gaagccacagcctgatgggc

SEQ ID NO: 383921 - DNA, 20 bp, human
gtcaagcgtccgcacatggt

SEQ ID NO: 383922 - DNA, 20 bp, human
gagcaggaggactgggtgtg

SEQ ID NO: 383923 - DNA, 20 bp, human
gtcgcaaggtgccctcacgt

SEQ ID NO: 383924 - DNA, 20 bp, human
ggcctgtgccctcaccgccg

SEQ ID NO: 383925 - DNA, 20 bp, human
gctcacctctgggcaagcag

SEQ ID NO: 383926 - DNA, 20 bp, human
ggcggctgtagacgccatga

SEQ ID NO: 383927 - DNA, 20 bp, human
gacgccatgatggatgtgtc

SEQ ID NO: 383928 - DNA, 20 bp, human
ggacgtggctgatcggggtg

SEQ ID NO: 383929 - DNA, 20 bp, human
gaatccgggacgtgcgccca

SEQ ID NO: 383930 - DNA, 20 bp, human
gggcctggaaatcagggcga

SEQ ID NO: 383931 - DNA, 20 bp, human
gcgcccggccgctgacctgg

SEQ ID NO: 383932 - DNA, 20 bp, human
gatggcgtctacagccgcat

SEQ ID NO: 383933 - DNA, 20 bp, human
gctgggagggcctggaaatc

SEQ ID NO: 383934 - DNA, 20 bp, human
gccccctcgtgggaggaatc

SEQ ID NO: 383935 - DNA, 20 bp, human
gcagcccgccccctcgtggg

SEQ ID NO: 383936 - DNA, 20 bp, human
gcaagaggagaaatactcga

SEQ ID NO: 383937 - DNA, 20 bp, human
ggaagggagaggttcgccgc

SEQ ID NO: 383938 - DNA, 20 bp, human
ggcaacactcggaggatgga

SEQ ID NO: 383939 - DNA, 20 bp, human
gataacttggcaacactcgg

SEQ ID NO: 383940 - DNA, 20 bp, human
gctagcagtggtaaggcttc

SEQ ID NO: 383941 - DNA, 20 bp, human
ggcagaacgcacccataact

SEQ ID NO: 383942 - DNA, 20 bp, human
gtgaggacaagctcggagaa

SEQ ID NO: 383943 - DNA, 20 bp, human
gcagcgtcctagcagtggta

SEQ ID NO: 383944 - DNA, 20 bp, human
gtctgccagcgtcctagcag

SEQ ID NO: 383945 - DNA, 20 bp, human
gaataataccagcgactgaa

SEQ ID NO: 383946 - DNA, 20 bp, human
gggcccagcgcctaggggag

SEQ ID NO: 383947 - DNA, 20 bp, human
gcctaggcgctgggccgctg

SEQ ID NO: 383948 - DNA, 20 bp, human
gctaacctcgcagtccgcag

SEQ ID NO: 383949 - DNA, 20 bp, human
gtgggccgctgcggactgcg

SEQ ID NO: 383950 - DNA, 20 bp, human
ggctcccctcccctaggcgc

SEQ ID NO: 383951 - DNA, 20 bp, human
ggcggggctcggatcacccc

SEQ ID NO: 383952 - DNA, 20 bp, human
gcgccgtgacaagtccacgg

SEQ ID NO: 383953 - DNA, 20 bp, human
gactgagaggctttcgagtc

SEQ ID NO: 383954 - DNA, 20 bp, human
gataacataacgaacaactc

SEQ ID NO: 383955 - DNA, 20 bp, human
gaagtccacggaggactgtg

SEQ ID NO: 383956 - DNA, 20 bp, human
gcagctgggtccaggtgaga

SEQ ID NO: 383957 - DNA, 20 bp, human
gacccagaatgcaggctcct

SEQ ID NO: 383958 - DNA, 20 bp, human
ggtctaggacaacagggatc

SEQ ID NO: 383959 - DNA, 20 bp, human
gagatggcatttacactcga

SEQ ID NO: 383960 - DNA, 20 bp, human
gtgtggacagagagtgaatc

SEQ ID NO: 383961 - DNA, 20 bp, human
gcatggatatgcagaacaga

SEQ ID NO: 383962 - DNA, 20 bp, human
gaacagaggtctaggacaac

SEQ ID NO: 383963 - DNA, 20 bp, human
gagaatgcaggctccttgga

SEQ ID NO: 383964 - DNA, 20 bp, human
ggctcctttacccagaatgc

SEQ ID NO: 383965 - DNA, 20 bp, human
gtggcatgaaggaagacgtc

SEQ ID NO: 383966 - DNA, 20 bp, human
gccctccgcaagcaagtcaa

SEQ ID NO: 383967 - DNA, 20 bp, human
gctctcctgcaatctcaaaa

SEQ ID NO: 383968 - DNA, 20 bp, human
ggaccctgcacccgcgcgga

SEQ ID NO: 383969 - DNA, 20 bp, human
gaaaagggctccctccgcgc

SEQ ID NO: 383970 - DNA, 20 bp, human
ggcaagcaagtcaagggatc

SEQ ID NO: 383971 - DNA, 20 bp, human
gatagcctgggctgttgtgg

SEQ ID NO: 383972 - DNA, 20 bp, human
gctccctccgcgcgggtgca

SEQ ID NO: 383973 - DNA, 20 bp, human
gggagcccttttgagattgc

SEQ ID NO: 383974 - DNA, 20 bp, human
gaggtggagggagtggcacg

SEQ ID NO: 383975 - DNA, 20 bp, human
gagaagaccctgcacccgcg

SEQ ID NO: 383976 - DNA, 20 bp, human
gagggaacggtgcacatcag

SEQ ID NO: 383977 - DNA, 20 bp, human
gtcccgcgagactgaggaaa

SEQ ID NO: 383978 - DNA, 20 bp, human
gcactgccgcggtgggttgt

SEQ ID NO: 383979 - DNA, 20 bp, human
gtcgcgggaagctccgttgt

SEQ ID NO: 383980 - DNA, 20 bp, human
gccagccggggcgcccacaa

SEQ ID NO: 383981 - DNA, 20 bp, human
gctgggcgtggacagggaga

SEQ ID NO: 383982 - DNA, 20 bp, human
gggagcttcccgcgagactg

SEQ ID NO: 383983 - DNA, 20 bp, human
gcattcagctgggcgtggac

SEQ ID NO: 383984 - DNA, 20 bp, human
gactgaggaaacggaaacgt

SEQ ID NO: 383985 - DNA, 20 bp, human
ggcacccccacaacccaccg

SEQ ID NO: 383986 - DNA, 20 bp, human
gaggagccaaggggcctaga

SEQ ID NO: 383987 - DNA, 20 bp, human
gggcagcagcgcctgagggg

SEQ ID NO: 383988 - DNA, 20 bp, human
gagggcttcgccaactgtgt

SEQ ID NO: 383989 - DNA, 20 bp, human
gtggcctctcggccaccggc

SEQ ID NO: 383990 - DNA, 20 bp, human
gcggtggcccggggaaaagt

SEQ ID NO: 383991 - DNA, 20 bp, human
ggctctgcgcagaaagtaga

SEQ ID NO: 383992 - DNA, 20 bp, human
gtaactaggagctgtgctgg

SEQ ID NO: 383993 - DNA, 20 bp, human
gaatgaggccaggcgagcga

SEQ ID NO: 383994 - DNA, 20 bp, human
gtcgccgagacacccctcgc

SEQ ID NO: 383995 - DNA, 20 bp, human
ggcgccagcgaggggtgtct

SEQ ID NO: 383996 - DNA, 20 bp, human
gaccgcccaggcgagggact

SEQ ID NO: 383997 - DNA, 20 bp, human
gagcccccgaaccgctcccc

SEQ ID NO: 383998 - DNA, 20 bp, human
gccaatcaccgcccaggcga

SEQ ID NO: 383999 - DNA, 20 bp, human
gcacgcccagtccctcgcct

SEQ ID NO: 384000 - DNA, 20 bp, human
gggctggagcaagacgcaat

SEQ ID NO: 384001 - DNA, 20 bp, human
gtggagcaagacgcaatcgg

SEQ ID NO: 384002 - DNA, 20 bp, human
gaagacgcaatcggtggcca

SEQ ID NO: 384003 - DNA, 20 bp, human
ggactgggcgtggacgaacg

SEQ ID NO: 384004 - DNA, 20 bp, human
gccagccgggggagcggttc

SEQ ID NO: 384005 - DNA, 20 bp, human
gagctggggaggacccctat

SEQ ID NO: 384006 - DNA, 20 bp, human
gccagcaggccggggagtca

SEQ ID NO: 384007 - DNA, 20 bp, human
gccatgtggagcccatgcag

SEQ ID NO: 384008 - DNA, 20 bp, human
gggagtgagccgaacccggt

SEQ ID NO: 384009 - DNA, 20 bp, human
ggagccgcacccaccgggtt

SEQ ID NO: 384010 - DNA, 20 bp, human
gcaggcccgggaatccggcc

SEQ ID NO: 384011 - DNA, 20 bp, human
ggtggggcggaacccaagag

SEQ ID NO: 384012 - DNA, 20 bp, human
gagagggcggccaatgactc

SEQ ID NO: 384013 - DNA, 20 bp, human
ggagccgaacccggtgggtg

SEQ ID NO: 384014 - DNA, 20 bp, human
gggtccaatcgtggaagcgg

SEQ ID NO: 384015 - DNA, 20 bp, human
gaatggtgacgcgcctcaca

SEQ ID NO: 384016 - DNA, 20 bp, human
ggaattgcaaccagaatcta

SEQ ID NO: 384017 - DNA, 20 bp, human
gcagctcggcctggagtgac

SEQ ID NO: 384018 - DNA, 20 bp, human
gaaggaagcgctgataggtg

SEQ ID NO: 384019 - DNA, 20 bp, human
ggaggctcaggagtgcaaat

SEQ ID NO: 384020 - DNA, 20 bp, human
gaaccagaatctatggtgta

SEQ ID NO: 384021 - DNA, 20 bp, human
gtccaggccgagctgctgct

SEQ ID NO: 384022 - DNA, 20 bp, human
ggactcacccagcagcagct

SEQ ID NO: 384023 - DNA, 20 bp, human
ggcttggagagggaagtgaa

SEQ ID NO: 384024 - DNA, 20 bp, human
gggtgagtctgtgagcaact

SEQ ID NO: 384025 - DNA, 20 bp, human
gaaccatacaccatagattc

SEQ ID NO: 384026 - DNA, 20 bp, human
ggctgcgctgccatacgctc

SEQ ID NO: 384027 - DNA, 20 bp, human
gcgggcgcgcgctagcggga

SEQ ID NO: 384028 - DNA, 20 bp, human
gtggttgcagcgcacgcgat

SEQ ID NO: 384029 - DNA, 20 bp, human
ggcgtgcgctgcaaccaacg

SEQ ID NO: 384030 - DNA, 20 bp, human
gatggaagcgagaggagggg

SEQ ID NO: 384031 - DNA, 20 bp, human
gtggcagcgcagcgccggac

SEQ ID NO: 384032 - DNA, 20 bp, human
ggctgccatacgctccgggg

SEQ ID NO: 384033 - DNA, 20 bp, human
gcgcgccccccgcccgaacg

SEQ ID NO: 384034 - DNA, 20 bp, human
gcgctcctccccggagcgta

SEQ ID NO: 384035 - DNA, 20 bp, human
ggtgcagccggggaagctga

SEQ ID NO: 384036 - DNA, 20 bp, human
gcggcggcgccaccttaagg

SEQ ID NO: 384037 - DNA, 20 bp, human
gcggcccagggactgaagga

SEQ ID NO: 384038 - DNA, 20 bp, human
ggagccgcctccctccggcg

SEQ ID NO: 384039 - DNA, 20 bp, human
ggggtggggaccctgtttta

SEQ ID NO: 384040 - DNA, 20 bp, human
gttacccaccgtgggagcgg

SEQ ID NO: 384041 - DNA, 20 bp, human
gcgcccagtgccttaaaaca

SEQ ID NO: 384042 - DNA, 20 bp, human
gccccccccgctcccacggt

SEQ ID NO: 384043 - DNA, 20 bp, human
ggggcggcggcgccacctta

SEQ ID NO: 384044 - DNA, 20 bp, human
gcgagggcccggcatgatct

SEQ ID NO: 384045 - DNA, 20 bp, human
gacggtgtgaatttcttcac

SEQ ID NO: 384046 - DNA, 20 bp, human
gcaaataattatttagcggg

SEQ ID NO: 384047 - DNA, 20 bp, human
ggggactgcgcggacatcgt

SEQ ID NO: 384048 - DNA, 20 bp, human
gcccagcggcacccagtcgt

SEQ ID NO: 384049 - DNA, 20 bp, human
gcgaaagtcaccagcgggta

SEQ ID NO: 384050 - DNA, 20 bp, human
ggagtcccgcagccccacgt

SEQ ID NO: 384051 - DNA, 20 bp, human
gccgctggtgactttcgcat

SEQ ID NO: 384052 - DNA, 20 bp, human
ggagcgcggggcccccacgt

SEQ ID NO: 384053 - DNA, 20 bp, human
gtcgtccggcgctggccaat

SEQ ID NO: 384054 - DNA, 20 bp, human
gtggcagcttcgtccggcgc

SEQ ID NO: 384055 - DNA, 20 bp, human
gcgcgagagcagttccaaat

SEQ ID NO: 384056 - DNA, 20 bp, human
ggggcggccgcgcagcatcc

SEQ ID NO: 384057 - DNA, 20 bp, human
gacgcctaccgcaacggggg

SEQ ID NO: 384058 - DNA, 20 bp, human
ggagacgcctaccgcaacgg

SEQ ID NO: 384059 - DNA, 20 bp, human
ggggagatgtagtccgcccc

SEQ ID NO: 384060 - DNA, 20 bp, human
gcgccagagcgctcgcatgg

SEQ ID NO: 384061 - DNA, 20 bp, human
gtctcaggcagggtcgcccg

SEQ ID NO: 384062 - DNA, 20 bp, human
gcccccacgtgggtttcagc

SEQ ID NO: 384063 - DNA, 20 bp, human
gctgacaaatggcaagccag

SEQ ID NO: 384064 - DNA, 20 bp, human
gcaggcagggtcgcccgggg

SEQ ID NO: 384065 - DNA, 20 bp, human
ggcgacgcccggcccccacg

SEQ ID NO: 384066 - DNA, 20 bp, human
gagagccgaccaatcaggga

SEQ ID NO: 384067 - DNA, 20 bp, human
gggggagagccgaccaatca

SEQ ID NO: 384068 - DNA, 20 bp, human
gggacgaggcggggcccgat

SEQ ID NO: 384069 - DNA, 20 bp, human
gtacgccctccctgattggt

SEQ ID NO: 384070 - DNA, 20 bp, human
gccgcgaagcagatcaatga

SEQ ID NO: 384071 - DNA, 20 bp, human
ggcggcgccggccaatagcg

SEQ ID NO: 384072 - DNA, 20 bp, human
ggaccgaaagggtaaagcag

SEQ ID NO: 384073 - DNA, 20 bp, human
gcgcgacccacgtgcgtaaa

SEQ ID NO: 384074 - DNA, 20 bp, human
ggccagaggcctgccccccc

SEQ ID NO: 384075 - DNA, 20 bp, human
gaggcgcagtagctgcacgt

SEQ ID NO: 384076 - DNA, 20 bp, human
ggccgcctcccgggcgacgc

SEQ ID NO: 384077 - DNA, 20 bp, human
gagggaagagactagagcgc

SEQ ID NO: 384078 - DNA, 20 bp, human
gtcggcccccggcgtcgccc

SEQ ID NO: 384079 - DNA, 20 bp, human
ggggtggcggctgaggcggt

SEQ ID NO: 384080 - DNA, 20 bp, human
gccgcctgtaactgatgcag

SEQ ID NO: 384081 - DNA, 20 bp, human
ggggggccgacgcactgcag

SEQ ID NO: 384082 - DNA, 20 bp, human
ggcccccgcgcacgcgagtc

SEQ ID NO: 384083 - DNA, 20 bp, human
gtaacctctgcatcagttac

SEQ ID NO: 384084 - DNA, 20 bp, human
gggcgcccctgccgcacccg

SEQ ID NO: 384085 - DNA, 20 bp, human
gccggccgaggacacttccg

SEQ ID NO: 384086 - DNA, 20 bp, human
gctgacgggccgcaacgcga

SEQ ID NO: 384087 - DNA, 20 bp, human
gaacgcgaggggaggtccgg

SEQ ID NO: 384088 - DNA, 20 bp, human
gggaggaagccgcgcctcgc

SEQ ID NO: 384089 - DNA, 20 bp, human
gcgcaacgcgaggggaggtc

SEQ ID NO: 384090 - DNA, 20 bp, human
gccggcctcgggcagtcgca

SEQ ID NO: 384091 - DNA, 20 bp, human
gcgccgacagtgggggagca

SEQ ID NO: 384092 - DNA, 20 bp, human
ggcgggggccggcgacacaa

SEQ ID NO: 384093 - DNA, 20 bp, human
ggccgccgcctttgtgtcgc

SEQ ID NO: 384094 - DNA, 20 bp, human
ggggaggggacgaggaaggt

SEQ ID NO: 384095 - DNA, 20 bp, human
ggggggaagcgccgacagtg

SEQ ID NO: 384096 - DNA, 20 bp, human
gtaagcaggatgcaagtgat

SEQ ID NO: 384097 - DNA, 20 bp, human
gtggctaggggcccacgggt

SEQ ID NO: 384098 - DNA, 20 bp, human
gagcaaaagtgtgaggattt

SEQ ID NO: 384099 - DNA, 20 bp, human
ggggagggcgcaggcaaact

SEQ ID NO: 384100 - DNA, 20 bp, human
gtaaaaagacaggctggcgg

SEQ ID NO: 384101 - DNA, 20 bp, human
gtacaatcagggtcaggatc

SEQ ID NO: 384102 - DNA, 20 bp, human
gtaaggaactctgcactcgg

SEQ ID NO: 384103 - DNA, 20 bp, human
gctgcactcggaggcgggga

SEQ ID NO: 384104 - DNA, 20 bp, human
gagacaggctggcgggggga

SEQ ID NO: 384105 - DNA, 20 bp, human
gtcggcgagcggcgccccgc

SEQ ID NO: 384106 - DNA, 20 bp, human
gggcaccttcgcaacttcgg

SEQ ID NO: 384107 - DNA, 20 bp, human
gcctcgggcgcccgagtgat

SEQ ID NO: 384108 - DNA, 20 bp, human
ggctcctgaagatcgggact

SEQ ID NO: 384109 - DNA, 20 bp, human
gcgccccgggcaggcgcctt

SEQ ID NO: 384110 - DNA, 20 bp, human
gaggctgtgtggtccagccc

SEQ ID NO: 384111 - DNA, 20 bp, human
gcggagctggccccggcctt

SEQ ID NO: 384112 - DNA, 20 bp, human
gcccggcaccttcgcaactt

SEQ ID NO: 384113 - DNA, 20 bp, human
gtcttcaggagcagcattct

SEQ ID NO: 384114 - DNA, 20 bp, human
gcctgcctccgaagttgcga

SEQ ID NO: 384115 - DNA, 20 bp, human
gtgcttagggccccgggcga

SEQ ID NO: 384116 - DNA, 20 bp, human
gcctccctggcaggaagcga

SEQ ID NO: 384117 - DNA, 20 bp, human
gggtgcggcgcaatccggag

SEQ ID NO: 384118 - DNA, 20 bp, human
gggcccgcgctctatggtcg

SEQ ID NO: 384119 - DNA, 20 bp, human
gtcccacagtgccacggggt

SEQ ID NO: 384120 - DNA, 20 bp, human
ggtcgtcctggcgtcctctc

SEQ ID NO: 384121 - DNA, 20 bp, human
gggctcccgagcatcgagaa

SEQ ID NO: 384122 - DNA, 20 bp, human
ggcaccctcgcttcctgcca

SEQ ID NO: 384123 - DNA, 20 bp, human
gtctaccccaagctagaaaa

SEQ ID NO: 384124 - DNA, 20 bp, human
ggccctgggcccgcgctcta

SEQ ID NO: 384125 - DNA, 20 bp, human
gcccgagggcgggggttccg

SEQ ID NO: 384126 - DNA, 20 bp, human
ggtgacaagtagaacccctt

SEQ ID NO: 384127 - DNA, 20 bp, human
gggctaagagttattactac

SEQ ID NO: 384128 - DNA, 20 bp, human
ggaggacaacaacagcatat

SEQ ID NO: 384129 - DNA, 20 bp, human
ggcaagaggcagagagcctt

SEQ ID NO: 384130 - DNA, 20 bp, human
gtggagctccctcctcctaa

SEQ ID NO: 384131 - DNA, 20 bp, human
gccaagaggagcacctgaga

SEQ ID NO: 384132 - DNA, 20 bp, human
ggggaggtgtggtgaacatc

SEQ ID NO: 384133 - DNA, 20 bp, human
gttaatgtcctcaaggcaag

SEQ ID NO: 384134 - DNA, 20 bp, human
gcacgataataatttgtctt

SEQ ID NO: 384135 - DNA, 20 bp, human
gtctagggttaatgtcctca

SEQ ID NO: 384136 - DNA, 20 bp, human
gccaaacaaaagcttgggtg

SEQ ID NO: 384137 - DNA, 20 bp, human
gcaagtgggcaccactcttt

SEQ ID NO: 384138 - DNA, 20 bp, human
gggttctacagtccaatctc

SEQ ID NO: 384139 - DNA, 20 bp, human
gagcttgggtggggtttcct

SEQ ID NO: 384140 - DNA, 20 bp, human
ggaaagtcaggtttctggca

SEQ ID NO: 384141 - DNA, 20 bp, human
gagccccattcaggaaagtc

SEQ ID NO: 384142 - DNA, 20 bp, human
gaatgaagacacacccgctg

SEQ ID NO: 384143 - DNA, 20 bp, human
gtggagccaggaggcaacga

SEQ ID NO: 384144 - DNA, 20 bp, human
gaacctgactttcctgaatg

SEQ ID NO: 384145 - DNA, 20 bp, human
gaagagaactagccccattc

SEQ ID NO: 384146 - DNA, 20 bp, human
gagtctgtgggttacctgat

SEQ ID NO: 384147 - DNA, 20 bp, human
gcatatgtagcatagtctgt

SEQ ID NO: 384148 - DNA, 20 bp, human
gaattccagtggaattcggt

SEQ ID NO: 384149 - DNA, 20 bp, human
ggccacctaccgaattccac

SEQ ID NO: 384150 - DNA, 20 bp, human
gtccagtggaattcggtagg

SEQ ID NO: 384151 - DNA, 20 bp, human
gcttggcagaagtgtgcgtc

SEQ ID NO: 384152 - DNA, 20 bp, human
gaactgactgtagtgaaatt

SEQ ID NO: 384153 - DNA, 20 bp, human
gataatccacagatcataat

SEQ ID NO: 384154 - DNA, 20 bp, human
ggggaagatcattcatgtgc

SEQ ID NO: 384155 - DNA, 20 bp, human
gtgaagcacactcgtaaaga

SEQ ID NO: 384156 - DNA, 20 bp, human
gcatgcagaagagggcggat

SEQ ID NO: 384157 - DNA, 20 bp, human
gagtagcatgcagaagaggg

SEQ ID NO: 384158 - DNA, 20 bp, human
gctaaagcccgcaagaggct

SEQ ID NO: 384159 - DNA, 20 bp, human
gtaccagtagcatgcagaag

SEQ ID NO: 384160 - DNA, 20 bp, human
gctcagtcccgcaaatgtct

SEQ ID NO: 384161 - DNA, 20 bp, human
gttgcgctaaagcccgcaag

SEQ ID NO: 384162 - DNA, 20 bp, human
gtttaaaaatgcttaaggtc

SEQ ID NO: 384163 - DNA, 20 bp, human
gactacaggcgctcaccaac

SEQ ID NO: 384164 - DNA, 20 bp, human
ggcaggagggaattgaatcg

SEQ ID NO: 384165 - DNA, 20 bp, human
gttagcacttttttaaattg

SEQ ID NO: 384166 - DNA, 20 bp, human
gcgggcgccccctccttctg

SEQ ID NO: 384167 - DNA, 20 bp, human
gcctagctcacggtcaaggg

SEQ ID NO: 384168 - DNA, 20 bp, human
ggcgccgctgcgcagccgga

SEQ ID NO: 384169 - DNA, 20 bp, human
gcagcctagctcacggtcaa

SEQ ID NO: 384170 - DNA, 20 bp, human
ggcgcagccggagggaactc

SEQ ID NO: 384171 - DNA, 20 bp, human
gggccccgagcgagcccccg

SEQ ID NO: 384172 - DNA, 20 bp, human
gtcggggcaggacccgcctc

SEQ ID NO: 384173 - DNA, 20 bp, human
gcagcggcgcacgtgccccg

SEQ ID NO: 384174 - DNA, 20 bp, human
gcgcacgtgccccgtggaag

SEQ ID NO: 384175 - DNA, 20 bp, human
gctgctgggaagcacggccg

SEQ ID NO: 384176 - DNA, 20 bp, human
gcagacccgcccacatcaaa

SEQ ID NO: 384177 - DNA, 20 bp, human
ggagtctagcagaaaattga

SEQ ID NO: 384178 - DNA, 20 bp, human
gccgcccacatcaaatggtg

SEQ ID NO: 384179 - DNA, 20 bp, human
gggacctcaccatttgatgt

SEQ ID NO: 384180 - DNA, 20 bp, human
gaaagtggatcagcaggagt

SEQ ID NO: 384181 - DNA, 20 bp, human
gggtttgaaacgcctctctg

SEQ ID NO: 384182 - DNA, 20 bp, human
gaccctttcaatgaaatcca

SEQ ID NO: 384183 - DNA, 20 bp, human
gttgagtagtgtatggtcac

SEQ ID NO: 384184 - DNA, 20 bp, human
gcaacagctaaagttgaaag

SEQ ID NO: 384185 - DNA, 20 bp, human
gtaaaagccagacgaaagaa

SEQ ID NO: 384186 - DNA, 20 bp, human
gcagaggtcagatgactaat

SEQ ID NO: 384187 - DNA, 20 bp, human
gttctgggctaaagggtgag

SEQ ID NO: 384188 - DNA, 20 bp, human
gacagcaagaggaagctagt

SEQ ID NO: 384189 - DNA, 20 bp, human
ggaaaacgcctgcagaccag

SEQ ID NO: 384190 - DNA, 20 bp, human
ggcctgggcttggtgaattt

SEQ ID NO: 384191 - DNA, 20 bp, human
gaaagcagttctgggctaaa

SEQ ID NO: 384192 - DNA, 20 bp, human
gcgagccgccccacagcaat

SEQ ID NO: 384193 - DNA, 20 bp, human
gatagcccttgtaactctct

SEQ ID NO: 384194 - DNA, 20 bp, human
gatctcttttgtcacaggag

SEQ ID NO: 384195 - DNA, 20 bp, human
gtccacagctgaaacaaaat

SEQ ID NO: 384196 - DNA, 20 bp, human
gggaggcagaggttatgctc

SEQ ID NO: 384197 - DNA, 20 bp, human
gcagctcagggttttctctg

SEQ ID NO: 384198 - DNA, 20 bp, human
gaaaaccctgagctgcggcg

SEQ ID NO: 384199 - DNA, 20 bp, human
gctgtgagaggctaggcccg

SEQ ID NO: 384200 - DNA, 20 bp, human
gagctgcggcgtggccgaga

SEQ ID NO: 384201 - DNA, 20 bp, human
gcgtacgatgaggagaggat

SEQ ID NO: 384202 - DNA, 20 bp, human
gtcggccacgccgcagctca

SEQ ID NO: 384203 - DNA, 20 bp, human
ggtgatctcgatagacactg

SEQ ID NO: 384204 - DNA, 20 bp, human
gggtgggcgggcccttccgt

SEQ ID NO: 384205 - DNA, 20 bp, human
gtgcggcgtggccgagacgg

SEQ ID NO: 384206 - DNA, 20 bp, human
gaaaactgctaactcacctc

SEQ ID NO: 384207 - DNA, 20 bp, human
gtcacctccggacctttgaa

SEQ ID NO: 384208 - DNA, 20 bp, human
gtgagttagcagttttttct

SEQ ID NO: 384209 - DNA, 20 bp, human
ggtaggagtaattccagtgt

SEQ ID NO: 384210 - DNA, 20 bp, human
gttacctttcaaaggtccgg

SEQ ID NO: 384211 - DNA, 20 bp, human
gctcacacgaattagaaaat

SEQ ID NO: 384212 - DNA, 20 bp, human
gtggcaccaatctgtttcta

SEQ ID NO: 384213 - DNA, 20 bp, human
ggccatctgttggcccacac

SEQ ID NO: 384214 - DNA, 20 bp, human
gcggtaccttagaaacagat

SEQ ID NO: 384215 - DNA, 20 bp, human
gggtgacaaatgtaataacc

SEQ ID NO: 384216 - DNA, 20 bp, human
ggcaaagcccatatctgggg

SEQ ID NO: 384217 - DNA, 20 bp, human
gtaaggggcaaaaacacccc

SEQ ID NO: 384218 - DNA, 20 bp, human
gactacaaagatcaggtcgg

SEQ ID NO: 384219 - DNA, 20 bp, human
gaagatcaggtcgggggatg

SEQ ID NO: 384220 - DNA, 20 bp, human
gcttttgcaaagcccatatc

SEQ ID NO: 384221 - DNA, 20 bp, human
gtggaagggggcagtgctat

SEQ ID NO: 384222 - DNA, 20 bp, human
gtgggctttgcaaaagcacg

SEQ ID NO: 384223 - DNA, 20 bp, human
gggtgctaccaaatatccta

SEQ ID NO: 384224 - DNA, 20 bp, human
gtagttggaaactccagggc

SEQ ID NO: 384225 - DNA, 20 bp, human
gatctagtgggtatagagca

SEQ ID NO: 384226 - DNA, 20 bp, human
gtgtgtacaggggagaaaaa

SEQ ID NO: 384227 - DNA, 20 bp, human
gacgtcgtgtgtgtctgatt

SEQ ID NO: 384228 - DNA, 20 bp, human
gagacagcaccggtaggtat

SEQ ID NO: 384229 - DNA, 20 bp, human
ggagggagacccatacctac

SEQ ID NO: 384230 - DNA, 20 bp, human
gacacgctacgttctgctga

SEQ ID NO: 384231 - DNA, 20 bp, human
ggagaaagatgctcgctttg

SEQ ID NO: 384232 - DNA, 20 bp, human
ggcacagtcaattaatgatt

SEQ ID NO: 384233 - DNA, 20 bp, human
ggtatgggtctccctcccac

SEQ ID NO: 384234 - DNA, 20 bp, human
gtttgcggccacagcccagt

SEQ ID NO: 384235 - DNA, 20 bp, human
gaagcgagcatctttctcct

SEQ ID NO: 384236 - DNA, 20 bp, human
ggatgtaggctgtctgagag

SEQ ID NO: 384237 - DNA, 20 bp, human
gctgtcctctaccaagccca

SEQ ID NO: 384238 - DNA, 20 bp, human
gaccctgtcctcctcactgg

SEQ ID NO: 384239 - DNA, 20 bp, human
gacaggtgtgaggccctcat

SEQ ID NO: 384240 - DNA, 20 bp, human
gagacagcctacatcccatg

SEQ ID NO: 384241 - DNA, 20 bp, human
gtgaggccctcatgggatgt

SEQ ID NO: 384242 - DNA, 20 bp, human
ggagtggagggggagctact

SEQ ID NO: 384243 - DNA, 20 bp, human
ggtcctgagggcaccagctg

SEQ ID NO: 384244 - DNA, 20 bp, human
gcaaatggcctttgactcat

SEQ ID NO: 384245 - DNA, 20 bp, human
ggtgcaggagccaagacctg

SEQ ID NO: 384246 - DNA, 20 bp, human
gatgcaggagccagagatag

SEQ ID NO: 384247 - DNA, 20 bp, human
gggggtgaatgacagcgcga

SEQ ID NO: 384248 - DNA, 20 bp, human
gtgacagcgcgagggagggg

SEQ ID NO: 384249 - DNA, 20 bp, human
gctggctcctgcatctgtct

SEQ ID NO: 384250 - DNA, 20 bp, human
ggaatgacagcgcgagggag

SEQ ID NO: 384251 - DNA, 20 bp, human
gtgaggggagggctcccaac

SEQ ID NO: 384252 - DNA, 20 bp, human
gcctctccgcgcacagccaa

SEQ ID NO: 384253 - DNA, 20 bp, human
gggcctgggctccatacctg

SEQ ID NO: 384254 - DNA, 20 bp, human
gagggacggagaccaagact

SEQ ID NO: 384255 - DNA, 20 bp, human
gccacaaggcgtctgaggaa

SEQ ID NO: 384256 - DNA, 20 bp, human
gcctctccgcgcacagccaa

SEQ ID NO: 384257 - DNA, 20 bp, human
gctcgctcgctgttgactct

SEQ ID NO: 384258 - DNA, 20 bp, human
gggggtgaatgacagcgcga

SEQ ID NO: 384259 - DNA, 20 bp, human
gtgacagcgcgagggagggg

SEQ ID NO: 384260 - DNA, 20 bp, human
gtcaacagcgagcgagcagc

SEQ ID NO: 384261 - DNA, 20 bp, human
gcgagcgagcagccggagcg

SEQ ID NO: 384262 - DNA, 20 bp, human
ggaatgacagcgcgagggag

SEQ ID NO: 384263 - DNA, 20 bp, human
gagagcttcgcggtttcgac

SEQ ID NO: 384264 - DNA, 20 bp, human
gcagaaaggctaaagtagaa

SEQ ID NO: 384265 - DNA, 20 bp, human
gctctgggacatcaatcacc

SEQ ID NO: 384266 - DNA, 20 bp, human
ggactcagcggcccatgctc

SEQ ID NO: 384267 - DNA, 20 bp, human
gctggcggagatgtgcgggg

SEQ ID NO: 384268 - DNA, 20 bp, human
gcggggcccagcagttaaag

SEQ ID NO: 384269 - DNA, 20 bp, human
ggctggctggcggagatgtg

SEQ ID NO: 384270 - DNA, 20 bp, human
gcctgcggaggaagccggtg

SEQ ID NO: 384271 - DNA, 20 bp, human
gcatcgagaggcgaagagtg

SEQ ID NO: 384272 - DNA, 20 bp, human
gcggaggccagcaaggatgg

SEQ ID NO: 384273 - DNA, 20 bp, human
gtgtttgcgccaagcgcagg

SEQ ID NO: 384274 - DNA, 20 bp, human
ggcgggaggggcccgagcat

SEQ ID NO: 384275 - DNA, 20 bp, human
ggacagggggccagggtgtt

SEQ ID NO: 384276 - DNA, 20 bp, human
gggctcccggctttcaataa

SEQ ID NO: 384277 - DNA, 20 bp, human
gtattagcagggataatggg

SEQ ID NO: 384278 - DNA, 20 bp, human
ggccgccggaggaacgaaag

SEQ ID NO: 384279 - DNA, 20 bp, human
gtgatcgcagccaatggctg

SEQ ID NO: 384280 - DNA, 20 bp, human
gaaagccgggagccaatgag

SEQ ID NO: 384281 - DNA, 20 bp, human
ggaaaggggcgcactacccg

SEQ ID NO: 384282 - DNA, 20 bp, human
gaggcctaattcatggaaat

SEQ ID NO: 384283 - DNA, 20 bp, human
gtcatggaaataggagctta

SEQ ID NO: 384284 - DNA, 20 bp, human
gctctcctctcattggctcc

SEQ ID NO: 384285 - DNA, 20 bp, human
ggattccgccgggtcgtccc

SEQ ID NO: 384286 - DNA, 20 bp, human
gacagggcgaggttcttaaa

SEQ ID NO: 384287 - DNA, 20 bp, human
gtctcccaatgtgattccac

SEQ ID NO: 384288 - DNA, 20 bp, human
ggagcccgtggaatcacatt

SEQ ID NO: 384289 - DNA, 20 bp, human
gagggcgcgggaatgagaag

SEQ ID NO: 384290 - DNA, 20 bp, human
gaaagtgccagcggcgtcag

SEQ ID NO: 384291 - DNA, 20 bp, human
ggaacccttggaaggagcta

SEQ ID NO: 384292 - DNA, 20 bp, human
ggggacctcgcataggatag

SEQ ID NO: 384293 - DNA, 20 bp, human
gacacgcgaagagacggaac

SEQ ID NO: 384294 - DNA, 20 bp, human
gaagcctcagctaagggcgc

SEQ ID NO: 384295 - DNA, 20 bp, human
gacgccgctggcactttcag

SEQ ID NO: 384296 - DNA, 20 bp, human
ggccgggcacgcccacctag

SEQ ID NO: 384297 - DNA, 20 bp, human
gaaaaggtcgagcagacggg

SEQ ID NO: 384298 - DNA, 20 bp, human
gcgggcggggctacgcggaa

SEQ ID NO: 384299 - DNA, 20 bp, human
gtagaaaaggtcgagcagac

SEQ ID NO: 384300 - DNA, 20 bp, human
ggcggggcggatatgactgg

SEQ ID NO: 384301 - DNA, 20 bp, human
gggggcggggcggatatgac

SEQ ID NO: 384302 - DNA, 20 bp, human
gcctgccggggccccaagtc

SEQ ID NO: 384303 - DNA, 20 bp, human
gtccgccaaccaactagaaa

SEQ ID NO: 384304 - DNA, 20 bp, human
gcggcctcaaccacaacccc

SEQ ID NO: 384305 - DNA, 20 bp, human
ggggagcgagctcggaccga

SEQ ID NO: 384306 - DNA, 20 bp, human
ggcagtggaaccaggggtga

SEQ ID NO: 384307 - DNA, 20 bp, human
gcgggtcgcgggttttcttc

SEQ ID NO: 384308 - DNA, 20 bp, human
gccccggcccggaagtgcgc

SEQ ID NO: 384309 - DNA, 20 bp, human
gcaggcgctggcaagatggc

SEQ ID NO: 384310 - DNA, 20 bp, human
gcaggctcgcatcctcctcg

SEQ ID NO: 384311 - DNA, 20 bp, human
gacctcccagaaggctcaac

SEQ ID NO: 384312 - DNA, 20 bp, human
gttctgggaggtccccgagg

SEQ ID NO: 384313 - DNA, 20 bp, human
ggggtgagggcctcgtccaa

SEQ ID NO: 384314 - DNA, 20 bp, human
gcctcgtccaagggcgtgag

SEQ ID NO: 384315 - DNA, 20 bp, human
ggtctcctgcagtggaacca

SEQ ID NO: 384316 - DNA, 20 bp, human
gtccctgttgcctatgactg

SEQ ID NO: 384317 - DNA, 20 bp, human
ggtccgagatgcaacagccc

SEQ ID NO: 384318 - DNA, 20 bp, human
ggagaaacagcctcagtcat

SEQ ID NO: 384319 - DNA, 20 bp, human
gctgtggtgcgaagaggcag

SEQ ID NO: 384320 - DNA, 20 bp, human
gcagacgaaatccttgggac

SEQ ID NO: 384321 - DNA, 20 bp, human
ggatgcaacagccctggttg

SEQ ID NO: 384322 - DNA, 20 bp, human
gcagacagctgcatggagca

SEQ ID NO: 384323 - DNA, 20 bp, human
gagcctcagtcataggcaac

SEQ ID NO: 384324 - DNA, 20 bp, human
gccttgggacaggcaaaacc

SEQ ID NO: 384325 - DNA, 20 bp, human
gcccttcagacgaaatcctt

SEQ ID NO: 384326 - DNA, 20 bp, human
gaggaagttggggtgggaac

SEQ ID NO: 384327 - DNA, 20 bp, human
gcttgtgttaagaaggaagt

SEQ ID NO: 384328 - DNA, 20 bp, human
gccctgaccttgtgttaaga

SEQ ID NO: 384329 - DNA, 20 bp, human
gctctggattaaagcaccga

SEQ ID NO: 384330 - DNA, 20 bp, human
gtccttcttaacacaaggtc

SEQ ID NO: 384331 - DNA, 20 bp, human
gaaggtcagggttaagcctt

SEQ ID NO: 384332 - DNA, 20 bp, human
ggaaaaacaccgcattcctt

SEQ ID NO: 384333 - DNA, 20 bp, human
gcaccgcattcctttggcac

SEQ ID NO: 384334 - DNA, 20 bp, human
gttaaccctctctccactgt

SEQ ID NO: 384335 - DNA, 20 bp, human
gttcatccaacagtggagag

SEQ ID NO: 384336 - DNA, 20 bp, human
gcagtgactcatcaggacag

SEQ ID NO: 384337 - DNA, 20 bp, human
gagggtgaggtgtttctcac

SEQ ID NO: 384338 - DNA, 20 bp, human
gcggggtggcagatgaggac

SEQ ID NO: 384339 - DNA, 20 bp, human
gcaggacagcggagctcatg

SEQ ID NO: 384340 - DNA, 20 bp, human
gatgaggacaggaacagctg

SEQ ID NO: 384341 - DNA, 20 bp, human
ggtgcatccagtgactcatc

SEQ ID NO: 384342 - DNA, 20 bp, human
ggccaccccgcgaagaattt

SEQ ID NO: 384343 - DNA, 20 bp, human
gtgaaggcgcttccgctccc

SEQ ID NO: 384344 - DNA, 20 bp, human
ggagcagagggtgggtcatc

SEQ ID NO: 384345 - DNA, 20 bp, human
gatcaggacagggctctccg

SEQ ID NO: 384346 - DNA, 20 bp, human
ggttcagagtccaatagggt

SEQ ID NO: 384347 - DNA, 20 bp, human
gctaagacatgtgagagctt

SEQ ID NO: 384348 - DNA, 20 bp, human
gaggtgggctatctctaaat

SEQ ID NO: 384349 - DNA, 20 bp, human
gccttcacctcatcataata

SEQ ID NO: 384350 - DNA, 20 bp, human
gtaataaaggagtatattaa

SEQ ID NO: 384351 - DNA, 20 bp, human
gttagaagccatactaataa

SEQ ID NO: 384352 - DNA, 20 bp, human
gaatagttcagagtccaata

SEQ ID NO: 384353 - DNA, 20 bp, human
ggtaataatatcgatagaac

SEQ ID NO: 384354 - DNA, 20 bp, human
gtaataatgtcctaccctat

SEQ ID NO: 384355 - DNA, 20 bp, human
ggccttttatcccaatcttc

SEQ ID NO: 384356 - DNA, 20 bp, human
gagtgtcttgtctgtgctgg

SEQ ID NO: 384357 - DNA, 20 bp, human
gaaacaaagcacttcaggtc

SEQ ID NO: 384358 - DNA, 20 bp, human
gatgggcactgtcagattaa

SEQ ID NO: 384359 - DNA, 20 bp, human
ggggagacatgattttaacc

SEQ ID NO: 384360 - DNA, 20 bp, human
gatgtctcccaagtacttaa

SEQ ID NO: 384361 - DNA, 20 bp, human
gtgtcagattaaaggtgcag

SEQ ID NO: 384362 - DNA, 20 bp, human
ggtgagtgtcttgtctgtgc

SEQ ID NO: 384363 - DNA, 20 bp, human
gaacgtaatctcatttatgg

SEQ ID NO: 384364 - DNA, 20 bp, human
gttgcaatcgaagacagggc

SEQ ID NO: 384365 - DNA, 20 bp, human
ggattattaacagaggttat

SEQ ID NO: 384366 - DNA, 20 bp, human
ggctgcagccctgaggtgaa

SEQ ID NO: 384367 - DNA, 20 bp, human
ggcagccctgaggtgaaggg

SEQ ID NO: 384368 - DNA, 20 bp, human
gtggcaggatcagaatgata

SEQ ID NO: 384369 - DNA, 20 bp, human
gatgtggtgctggacaaggt

SEQ ID NO: 384370 - DNA, 20 bp, human
ggctatggacacattaccct

SEQ ID NO: 384371 - DNA, 20 bp, human
gacagaggcgtggcagaaac

SEQ ID NO: 384372 - DNA, 20 bp, human
gcaggtatggaaccaacaga

SEQ ID NO: 384373 - DNA, 20 bp, human
gggagctgtgcagaaaaaac

SEQ ID NO: 384374 - DNA, 20 bp, human
gcttggctaagttgcaaagc

SEQ ID NO: 384375 - DNA, 20 bp, human
gcaccgtgcccagacacaag

SEQ ID NO: 384376 - DNA, 20 bp, human
gggcacctgtccctgcgcgg

SEQ ID NO: 384377 - DNA, 20 bp, human
gaaaggtggaaccagatccg

SEQ ID NO: 384378 - DNA, 20 bp, human
ggggcccgcgggatcgtcta

SEQ ID NO: 384379 - DNA, 20 bp, human
gcccgcgggatcgtctatgg

SEQ ID NO: 384380 - DNA, 20 bp, human
gcgcggaggagacaccgctg

SEQ ID NO: 384381 - DNA, 20 bp, human
gcaggggcgccacggctcag

SEQ ID NO: 384382 - DNA, 20 bp, human
gccgcggccctgcgcacttg

SEQ ID NO: 384383 - DNA, 20 bp, human
gccgtgcagcagcccgccga

SEQ ID NO: 384384 - DNA, 20 bp, human
gagggccgcggtgcagtccc

SEQ ID NO: 384385 - DNA, 20 bp, human
gcccagcgggatgcggtgaa

SEQ ID NO: 384386 - DNA, 20 bp, human
gggaacacgcagggcggtca

SEQ ID NO: 384387 - DNA, 20 bp, human
gaccgccctgcgtgttccca

SEQ ID NO: 384388 - DNA, 20 bp, human
gggacggccattggagacga

SEQ ID NO: 384389 - DNA, 20 bp, human
gcgagggtgtcgatggtgag

SEQ ID NO: 384390 - DNA, 20 bp, human
ggtggggatgggaaactctg

SEQ ID NO: 384391 - DNA, 20 bp, human
gggctccctgggaacacgca

SEQ ID NO: 384392 - DNA, 20 bp, human
gtgagtagcgggacggccat

SEQ ID NO: 384393 - DNA, 20 bp, human
ggtcgatggtgaggggcgaa

SEQ ID NO: 384394 - DNA, 20 bp, human
ggaacgaagttgtggaggca

SEQ ID NO: 384395 - DNA, 20 bp, human
gagggacccgccccgcacaa

SEQ ID NO: 384396 - DNA, 20 bp, human
gcaccagccaatcggcgctc

SEQ ID NO: 384397 - DNA, 20 bp, human
ggctgggcgggcctttccgg

SEQ ID NO: 384398 - DNA, 20 bp, human
gcccccgagcgccgattggc

SEQ ID NO: 384399 - DNA, 20 bp, human
gtccgcccccgagcgccgat

SEQ ID NO: 384400 - DNA, 20 bp, human
ggggtcccgcagagacgtca

SEQ ID NO: 384401 - DNA, 20 bp, human
ggcttctgaggcgcccgcgt

SEQ ID NO: 384402 - DNA, 20 bp, human
gtggacacggaacgcagaca

SEQ ID NO: 384403 - DNA, 20 bp, human
gacagaccggtgcatggcag

SEQ ID NO: 384404 - DNA, 20 bp, human
gaaaaaccctgggacgagag

SEQ ID NO: 384405 - DNA, 20 bp, human
gcgcagccgctgccatgcac

SEQ ID NO: 384406 - DNA, 20 bp, human
ggggctcccgggagcaccgc

SEQ ID NO: 384407 - DNA, 20 bp, human
gcgtcacagcggcgggtctc

SEQ ID NO: 384408 - DNA, 20 bp, human
gaagaggaaacctctcgctg

SEQ ID NO: 384409 - DNA, 20 bp, human
gtcaagccaggacttcctgg

SEQ ID NO: 384410 - DNA, 20 bp, human
gtctcgctgcgtcacagcgg

SEQ ID NO: 384411 - DNA, 20 bp, human
ggggagcccccaggaagtcc

SEQ ID NO: 384412 - DNA, 20 bp, human
gcgcagcctgcggtgctccc

SEQ ID NO: 384413 - DNA, 20 bp, human
gttccccgcgcgccggcagg

SEQ ID NO: 384414 - DNA, 20 bp, human
gtgtgacgcagcgagagccc

SEQ ID NO: 384415 - DNA, 20 bp, human
ggctggggctaggagttcgg

SEQ ID NO: 384416 - DNA, 20 bp, human
gagaggagcgcgtcggtctg

SEQ ID NO: 384417 - DNA, 20 bp, human
ggcgccgccgcgacatcaag

SEQ ID NO: 384418 - DNA, 20 bp, human
gcggcgccctgaggacggat

SEQ ID NO: 384419 - DNA, 20 bp, human
gggagaacaagcacgtactc

SEQ ID NO: 384420 - DNA, 20 bp, human
ggaggcgcaaacgagaccac

SEQ ID NO: 384421 - DNA, 20 bp, human
gttgggtcacgtgacaccgg

SEQ ID NO: 384422 - DNA, 20 bp, human
gcctgaggacggattgggca

SEQ ID NO: 384423 - DNA, 20 bp, human
gaggacggattgggcaaggc

SEQ ID NO: 384424 - DNA, 20 bp, human
gcaggagcaaggcggaagtc

SEQ ID NO: 384425 - DNA, 20 bp, human
gcacactgcacatttccttc

SEQ ID NO: 384426 - DNA, 20 bp, human
gccggggaccccgtgaggct

SEQ ID NO: 384427 - DNA, 20 bp, human
gggggcaagccgagcctcac

SEQ ID NO: 384428 - DNA, 20 bp, human
gccaggggccgcagcagcga

SEQ ID NO: 384429 - DNA, 20 bp, human
gcccccgcctcgccgaagac

SEQ ID NO: 384430 - DNA, 20 bp, human
ggcctcgccgaagacgggcg

SEQ ID NO: 384431 - DNA, 20 bp, human
gctgaggtcgccgccggtga

SEQ ID NO: 384432 - DNA, 20 bp, human
gaccgcgctggacaccgctc

SEQ ID NO: 384433 - DNA, 20 bp, human
gcaaccccgtagaagtcggt

SEQ ID NO: 384434 - DNA, 20 bp, human
gcctggggactccttcgcga

SEQ ID NO: 384435 - DNA, 20 bp, human
gggtaagactgacgtgtcct

SEQ ID NO: 384436 - DNA, 20 bp, human
gtgcacatgctcagtgagaa

SEQ ID NO: 384437 - DNA, 20 bp, human
ggctcagtgagaacggtcgc

SEQ ID NO: 384438 - DNA, 20 bp, human
gggcaccaggaggagtttcc

SEQ ID NO: 384439 - DNA, 20 bp, human
ggagaacggtcgcaggcacc

SEQ ID NO: 384440 - DNA, 20 bp, human
gaacggtcgcaggcaccagg

SEQ ID NO: 384441 - DNA, 20 bp, human
gctcactgagcatgtgcaga

SEQ ID NO: 384442 - DNA, 20 bp, human
ggccagctgaggtggttgct

SEQ ID NO: 384443 - DNA, 20 bp, human
ggcgcggaaaacccggaaag

SEQ ID NO: 384444 - DNA, 20 bp, human
gcccgcaacagaaaccgaag

SEQ ID NO: 384445 - DNA, 20 bp, human
gttccgcgcgccagctgagg

SEQ ID NO: 384446 - DNA, 20 bp, human
gccgcggctcccaggagccg

SEQ ID NO: 384447 - DNA, 20 bp, human
gcggttgccgggccctccct

SEQ ID NO: 384448 - DNA, 20 bp, human
gggcctgccgagcactcggg

SEQ ID NO: 384449 - DNA, 20 bp, human
gccgcgtcgcgaggcacttc

SEQ ID NO: 384450 - DNA, 20 bp, human
ggcccgcccgagtgctcggc

SEQ ID NO: 384451 - DNA, 20 bp, human
ggatgacgtggctgagtcag

SEQ ID NO: 384452 - DNA, 20 bp, human
gcctgggagccgcggcgcta

SEQ ID NO: 384453 - DNA, 20 bp, human
ggggccgcgtcccggtgttt

SEQ ID NO: 384454 - DNA, 20 bp, human
gaggcagcaggtcagacgat

SEQ ID NO: 384455 - DNA, 20 bp, human
gaacccgaaacaccgggacg

SEQ ID NO: 384456 - DNA, 20 bp, human
gaatgcagcgggaataaggg

SEQ ID NO: 384457 - DNA, 20 bp, human
gagagagaacggtgtaacta

SEQ ID NO: 384458 - DNA, 20 bp, human
gtttctgccaggagctaata

SEQ ID NO: 384459 - DNA, 20 bp, human
ggcaggaagacccattgcca

SEQ ID NO: 384460 - DNA, 20 bp, human
gagtctggtctgggaaagta

SEQ ID NO: 384461 - DNA, 20 bp, human
ggaaagtaaggtcgctgatt

SEQ ID NO: 384462 - DNA, 20 bp, human
gctgctcgacagtctggtct

SEQ ID NO: 384463 - DNA, 20 bp, human
gcacaatgcagcgggaataa

SEQ ID NO: 384464 - DNA, 20 bp, human
gccgctgcattgtgggtaat

SEQ ID NO: 384465 - DNA, 20 bp, human
gtcaaccgctcctgtagtgg

SEQ ID NO: 384466 - DNA, 20 bp, human
gagcaacctcttcagacaag

SEQ ID NO: 384467 - DNA, 20 bp, human
ggctcccgcatctcaggggc

SEQ ID NO: 384468 - DNA, 20 bp, human
ggcgctctggagtcgtgctc

SEQ ID NO: 384469 - DNA, 20 bp, human
gcccggcgagcacgcaggtc

SEQ ID NO: 384470 - DNA, 20 bp, human
gggcggaagggagcttgcgg

SEQ ID NO: 384471 - DNA, 20 bp, human
gagcggcggaagggagcttg

SEQ ID NO: 384472 - DNA, 20 bp, human
ggcgggctcccgcatctcag

SEQ ID NO: 384473 - DNA, 20 bp, human
gctgcctggtgctgagtgcg

SEQ ID NO: 384474 - DNA, 20 bp, human
ggtcgtgctctgggacagat

SEQ ID NO: 384475 - DNA, 20 bp, human
gtggagacgctacacgcttc

SEQ ID NO: 384476 - DNA, 20 bp, human
gtccaggggcgggtactaac

SEQ ID NO: 384477 - DNA, 20 bp, human
ggcgggtactaacaggtcag

SEQ ID NO: 384478 - DNA, 20 bp, human
ggagtggcagacgattggtc

SEQ ID NO: 384479 - DNA, 20 bp, human
gaggtcagaggtcaactgag

SEQ ID NO: 384480 - DNA, 20 bp, human
gcaactgagtggcagacgat

SEQ ID NO: 384481 - DNA, 20 bp, human
gaaccctagctcctcgtacc

SEQ ID NO: 384482 - DNA, 20 bp, human
gacgccaggtacgaggagct

SEQ ID NO: 384483 - DNA, 20 bp, human
gtgtcctgccagggtagaat

SEQ ID NO: 384484 - DNA, 20 bp, human
gctgtctacgacagagggtg

SEQ ID NO: 384485 - DNA, 20 bp, human
gtgcgcgggaagagcactgc

SEQ ID NO: 384486 - DNA, 20 bp, human
ggacgcctcactaataacac

SEQ ID NO: 384487 - DNA, 20 bp, human
ggggcctcagggcgccgcca

SEQ ID NO: 384488 - DNA, 20 bp, human
gcttccccctgggaactagg

SEQ ID NO: 384489 - DNA, 20 bp, human
gtacccctgtgttattagtg

SEQ ID NO: 384490 - DNA, 20 bp, human
ggcagggctaggctcggctg

SEQ ID NO: 384491 - DNA, 20 bp, human
gccctgggaactaggagggg

SEQ ID NO: 384492 - DNA, 20 bp, human
gcaaagcgaacgcttccccc

SEQ ID NO: 384493 - DNA, 20 bp, human
gctgagaggcgcgcgcgccc

SEQ ID NO: 384494 - DNA, 20 bp, human
gccacgaggccggcgcgacg

SEQ ID NO: 384495 - DNA, 20 bp, human
ggttattagtgaggcgtcgt

SEQ ID NO: 384496 - DNA, 20 bp, human
gccagctgggcggagaaagc

SEQ ID NO: 384497 - DNA, 20 bp, human
gggatggctccgagttagaa

SEQ ID NO: 384498 - DNA, 20 bp, human
gccagcaagccgtgcggcgt

SEQ ID NO: 384499 - DNA, 20 bp, human
gccagccccagcaagccgtg

SEQ ID NO: 384500 - DNA, 20 bp, human
gcaagccgtgcggcgtcggc

SEQ ID NO: 384501 - DNA, 20 bp, human
gttcgcccgccgacgccgca

SEQ ID NO: 384502 - DNA, 20 bp, human
gggggctgggctcttcctcg

SEQ ID NO: 384503 - DNA, 20 bp, human
gagtggggaggaggcggttg

SEQ ID NO: 384504 - DNA, 20 bp, human
gcttcctcgcggaagtgggg

SEQ ID NO: 384505 - DNA, 20 bp, human
gcggttgcggttagtggacc

SEQ ID NO: 384506 - DNA, 20 bp, human
gcagcagcgcaccgtgaccc

SEQ ID NO: 384507 - DNA, 20 bp, human
ggcttactacggtaagaaag

SEQ ID NO: 384508 - DNA, 20 bp, human
gcccgcccgggacagcccga

SEQ ID NO: 384509 - DNA, 20 bp, human
gaaaagatcgggagcggaag

SEQ ID NO: 384510 - DNA, 20 bp, human
ggagaccttttgcttcgagg

SEQ ID NO: 384511 - DNA, 20 bp, human
gctaccccttcacaagccgt

SEQ ID NO: 384512 - DNA, 20 bp, human
gagtcttgatcgacaagctc

SEQ ID NO: 384513 - DNA, 20 bp, human
ggtgcggccaacggccaatg

SEQ ID NO: 384514 - DNA, 20 bp, human
gcagcccgacggcttgtgaa

SEQ ID NO: 384515 - DNA, 20 bp, human
gcgaacgccgggtaaaagat

SEQ ID NO: 384516 - DNA, 20 bp, human
gttcggaggccgaactcctg

SEQ ID NO: 384517 - DNA, 20 bp, human
gtgtgcccggcctagaaaac

SEQ ID NO: 384518 - DNA, 20 bp, human
ggaaatgcacacccttcatt

SEQ ID NO: 384519 - DNA, 20 bp, human
gtgaagggtgtgcatttctt

SEQ ID NO: 384520 - DNA, 20 bp, human
gtgctactgcgggccttctg

SEQ ID NO: 384521 - DNA, 20 bp, human
ggtgtttccaacaagtcctt

SEQ ID NO: 384522 - DNA, 20 bp, human
gtgcatcaggattatcagcc

SEQ ID NO: 384523 - DNA, 20 bp, human
gttctcaaagtctcctcaga

SEQ ID NO: 384524 - DNA, 20 bp, human
gaacaccagttttctaggcc

SEQ ID NO: 384525 - DNA, 20 bp, human
gttggaaacaccagttttct

SEQ ID NO: 384526 - DNA, 20 bp, human
gcacgtcttgagaaaaacag

SEQ ID NO: 384527 - DNA, 20 bp, human
gatcatcaactgcttaatga

SEQ ID NO: 384528 - DNA, 20 bp, human
ggacacaaacaaacaatgtg

SEQ ID NO: 384529 - DNA, 20 bp, human
gatgagataaacagtcataa

SEQ ID NO: 384530 - DNA, 20 bp, human
gtaaagcaatgtctatacac

SEQ ID NO: 384531 - DNA, 20 bp, human
ggaagaacaatgacacatgg

SEQ ID NO: 384532 - DNA, 20 bp, human
gtgaagagatgcttaacttt

SEQ ID NO: 384533 - DNA, 20 bp, human
ggaaaaacagctttatactt

SEQ ID NO: 384534 - DNA, 20 bp, human
gcctttaaacttaatagctt

SEQ ID NO: 384535 - DNA, 20 bp, human
gtttgaagaacaatgacaca

SEQ ID NO: 384536 - DNA, 20 bp, human
gggtcaaaggggttgaattt

SEQ ID NO: 384537 - DNA, 20 bp, human
gaccaggggagcactttcag

SEQ ID NO: 384538 - DNA, 20 bp, human
ggccactgaaagtgctcccc

SEQ ID NO: 384539 - DNA, 20 bp, human
gtgaatttggggttcatgtt

SEQ ID NO: 384540 - DNA, 20 bp, human
gcggagtactcaggtcaaag

SEQ ID NO: 384541 - DNA, 20 bp, human
ggagtactccgtcccttaaa

SEQ ID NO: 384542 - DNA, 20 bp, human
gagtgagtgcacccttagaa

SEQ ID NO: 384543 - DNA, 20 bp, human
ggtggctggctagtttggag

SEQ ID NO: 384544 - DNA, 20 bp, human
gaaacccaaacgccaagtgc

SEQ ID NO: 384545 - DNA, 20 bp, human
gagatggtgaaatggcacca

SEQ ID NO: 384546 - DNA, 20 bp, human
gcgcctgcctggggtcccct

SEQ ID NO: 384547 - DNA, 20 bp, human
gtcccgccccggcaggtgac

SEQ ID NO: 384548 - DNA, 20 bp, human
gtcaaagccgaggggacccc

SEQ ID NO: 384549 - DNA, 20 bp, human
gaagcaggaaggtcactctc

SEQ ID NO: 384550 - DNA, 20 bp, human
gaagcgggctctcaaagccg

SEQ ID NO: 384551 - DNA, 20 bp, human
ggctctgcggggctcagaac

SEQ ID NO: 384552 - DNA, 20 bp, human
gggtcttcaagggagacggg

SEQ ID NO: 384553 - DNA, 20 bp, human
ggcccccggcgcgctccttc

SEQ ID NO: 384554 - DNA, 20 bp, human
gtccccggaggaagcaaaca

SEQ ID NO: 384555 - DNA, 20 bp, human
gagagcttgtgagctctgcg

SEQ ID NO: 384556 - DNA, 20 bp, human
gtcagggcataaggggttaa

SEQ ID NO: 384557 - DNA, 20 bp, human
gatgccctgacagtcctgga

SEQ ID NO: 384558 - DNA, 20 bp, human
gaggactgtcagggcataag

SEQ ID NO: 384559 - DNA, 20 bp, human
ggtggctgaggcacacagat

SEQ ID NO: 384560 - DNA, 20 bp, human
gctggagtctagacagccaa

SEQ ID NO: 384561 - DNA, 20 bp, human
gggtgttcacaaaacactga

SEQ ID NO: 384562 - DNA, 20 bp, human
gcaagcgatgtgtagatcac

SEQ ID NO: 384563 - DNA, 20 bp, human
gaagaggcttagagacagta

SEQ ID NO: 384564 - DNA, 20 bp, human
ggatcaccgggccaaaccct

SEQ ID NO: 384565 - DNA, 20 bp, human
gctgaggcacacagattggc

SEQ ID NO: 384566 - DNA, 20 bp, human
gcaggtatctgggtgataaa

SEQ ID NO: 384567 - DNA, 20 bp, human
gtatctgggtgataaacggt

SEQ ID NO: 384568 - DNA, 20 bp, human
gtccaccaagtcccagggtg

SEQ ID NO: 384569 - DNA, 20 bp, human
gctgatgcgaaaggtctcct

SEQ ID NO: 384570 - DNA, 20 bp, human
gacttagtccaccaagtccc

SEQ ID NO: 384571 - DNA, 20 bp, human
gaggccaagcgatgagaaga

SEQ ID NO: 384572 - DNA, 20 bp, human
gtgtacctcaccctgggact

SEQ ID NO: 384573 - DNA, 20 bp, human
gccaggggcaggtgtgtacc

SEQ ID NO: 384574 - DNA, 20 bp, human
ggaaccaaactgtcaggccc

SEQ ID NO: 384575 - DNA, 20 bp, human
gtcagggccgctgatgcgaa

SEQ ID NO: 384576 - DNA, 20 bp, human
ggccataggtgcagctgtga

SEQ ID NO: 384577 - DNA, 20 bp, human
gggtgcagctgtgatggtag

SEQ ID NO: 384578 - DNA, 20 bp, human
gctagagtgtgaggtggtgt

SEQ ID NO: 384579 - DNA, 20 bp, human
ggtgagacctggttactcat

SEQ ID NO: 384580 - DNA, 20 bp, human
gactgagtccgcgacgatga

SEQ ID NO: 384581 - DNA, 20 bp, human
gaaaaggagccagtgcccgg

SEQ ID NO: 384582 - DNA, 20 bp, human
gtcgcggactcagtagacag

SEQ ID NO: 384583 - DNA, 20 bp, human
gagaaggaaatgcacaactt

SEQ ID NO: 384584 - DNA, 20 bp, human
gaggaaagagatgatagcca

SEQ ID NO: 384585 - DNA, 20 bp, human
gaccatcacagctgcaccta

SEQ ID NO: 384586 - DNA, 20 bp, human
gggaggggtcggaagttggc

SEQ ID NO: 384587 - DNA, 20 bp, human
gaaattggggacttcaacca

SEQ ID NO: 384588 - DNA, 20 bp, human
gggtcggaagttggcagggg

SEQ ID NO: 384589 - DNA, 20 bp, human
ggggccctttgccactccct

SEQ ID NO: 384590 - DNA, 20 bp, human
gggaaggcatagtcgccgcg

SEQ ID NO: 384591 - DNA, 20 bp, human
gggagtggcaaagggcccca

SEQ ID NO: 384592 - DNA, 20 bp, human
gcagctcagacctcaggagg

SEQ ID NO: 384593 - DNA, 20 bp, human
gcgcacctcccggcccacgt

SEQ ID NO: 384594 - DNA, 20 bp, human
gacctcccggcccacgtggg

SEQ ID NO: 384595 - DNA, 20 bp, human
ggagatactctgtgtccctg

SEQ ID NO: 384596 - DNA, 20 bp, human
ggagccttgccggatctccc

SEQ ID NO: 384597 - DNA, 20 bp, human
ggagcccgggagatccggca

SEQ ID NO: 384598 - DNA, 20 bp, human
gccggcaaggctccatccag

SEQ ID NO: 384599 - DNA, 20 bp, human
ggagcatcagggaccgcaga

SEQ ID NO: 384600 - DNA, 20 bp, human
ggcaaggctccatccagcgg

SEQ ID NO: 384601 - DNA, 20 bp, human
ggcttgtcgccaccgctgga

SEQ ID NO: 384602 - DNA, 20 bp, human
gccgggtcctggtggagact

SEQ ID NO: 384603 - DNA, 20 bp, human
gtgggagcccagtctccacc

SEQ ID NO: 384604 - DNA, 20 bp, human
gtggaatcccggctccgcga

SEQ ID NO: 384605 - DNA, 20 bp, human
ggctcagtgagacatcaggg

SEQ ID NO: 384606 - DNA, 20 bp, human
gccctgagatgcagaggtga

SEQ ID NO: 384607 - DNA, 20 bp, human
gatgcacagagctccctggg

SEQ ID NO: 384608 - DNA, 20 bp, human
gatgcagaggtgaaggtgac

SEQ ID NO: 384609 - DNA, 20 bp, human
gccctgactcctgtgcagag

SEQ ID NO: 384610 - DNA, 20 bp, human
ggcaggctggacatccctgg

SEQ ID NO: 384611 - DNA, 20 bp, human
gtgagctgggagcctgacat

SEQ ID NO: 384612 - DNA, 20 bp, human
gtgggagcctgacatgggtg

SEQ ID NO: 384613 - DNA, 20 bp, human
gcccggaccagtggacccta

SEQ ID NO: 384614 - DNA, 20 bp, human
ggcctgacatgggtggggat

SEQ ID NO: 384615 - DNA, 20 bp, human
gtaggccacttggcctccca

SEQ ID NO: 384616 - DNA, 20 bp, human
gctcctgagggcgtggtcta

SEQ ID NO: 384617 - DNA, 20 bp, human
gcctagtggggcgtggtctc

SEQ ID NO: 384618 - DNA, 20 bp, human
gtctcgggcggggacgtgga

SEQ ID NO: 384619 - DNA, 20 bp, human
gttgtggacgggactcctga

SEQ ID NO: 384620 - DNA, 20 bp, human
gtggtctcagggtgcgttgg

SEQ ID NO: 384621 - DNA, 20 bp, human
gacgtggaaggagtggcatc

SEQ ID NO: 384622 - DNA, 20 bp, human
gtggaggtcgtggtctcggg

SEQ ID NO: 384623 - DNA, 20 bp, human
gagggtggggcctctaccgg

SEQ ID NO: 384624 - DNA, 20 bp, human
ggcgtggtctagatctgcat

SEQ ID NO: 384625 - DNA, 20 bp, human
gctaaggcgtggcctcaggg

SEQ ID NO: 384626 - DNA, 20 bp, human
gggcgcacgcgcaagggagc

SEQ ID NO: 384627 - DNA, 20 bp, human
ggggcgcgcgcacgccgcag

SEQ ID NO: 384628 - DNA, 20 bp, human
ggccggcggcgcacgcgcaa

SEQ ID NO: 384629 - DNA, 20 bp, human
gggaggggccacgccttcca

SEQ ID NO: 384630 - DNA, 20 bp, human
gcagagaccgcgtgggaagg

SEQ ID NO: 384631 - DNA, 20 bp, human
gaccagcccagagaccgcgt

SEQ ID NO: 384632 - DNA, 20 bp, human
ggcacgcgcaagggagcggg

SEQ ID NO: 384633 - DNA, 20 bp, human
gcgcaagggagcgggcggac

SEQ ID NO: 384634 - DNA, 20 bp, human
gcctagcccgccttcccacg

SEQ ID NO: 384635 - DNA, 20 bp, human
ggcccagagaccgcgtggga

SEQ ID NO: 384636 - DNA, 20 bp, human
ggggaagcccgcggggctga

SEQ ID NO: 384637 - DNA, 20 bp, human
gggccaatgggaagcccgcg

SEQ ID NO: 384638 - DNA, 20 bp, human
gtcgcgcagcttcgtttttg

SEQ ID NO: 384639 - DNA, 20 bp, human
gtcgtcctccagccctctcc

SEQ ID NO: 384640 - DNA, 20 bp, human
gagggagtgacagcggcaac

SEQ ID NO: 384641 - DNA, 20 bp, human
gcgggaaggcgaggctagga

SEQ ID NO: 384642 - DNA, 20 bp, human
gacagcggcaaccggccaat

SEQ ID NO: 384643 - DNA, 20 bp, human
gaatgggtggaggaaatcct

SEQ ID NO: 384644 - DNA, 20 bp, human
ggcagcttcgtttttggggt

SEQ ID NO: 384645 - DNA, 20 bp, human
gtgagggaccctgccgagga

SEQ ID NO: 384646 - DNA, 20 bp, human
gagggcccagtgctatctct

SEQ ID NO: 384647 - DNA, 20 bp, human
gagaaggtgtgaagagataa

SEQ ID NO: 384648 - DNA, 20 bp, human
gtccatgagcccagggtatg

SEQ ID NO: 384649 - DNA, 20 bp, human
gtgtggttggctgatgactt

SEQ ID NO: 384650 - DNA, 20 bp, human
ggacacgcgtcacgttgatt

SEQ ID NO: 384651 - DNA, 20 bp, human
gtcaggagtcctcataccct

SEQ ID NO: 384652 - DNA, 20 bp, human
gctcctgatctcagtgattt

SEQ ID NO: 384653 - DNA, 20 bp, human
gtggctcccagagatagcac

SEQ ID NO: 384654 - DNA, 20 bp, human
gggtagtcccaaattcaaga

SEQ ID NO: 384655 - DNA, 20 bp, human
ggggccagctctgacctgta

SEQ ID NO: 384656 - DNA, 20 bp, human
gacattgcctcccgggtcgg

SEQ ID NO: 384657 - DNA, 20 bp, human
ggggagaaagagggctgtgt

SEQ ID NO: 384658 - DNA, 20 bp, human
gaagacattgcctcccgggt

SEQ ID NO: 384659 - DNA, 20 bp, human
gggcgaagacattgcctccc

SEQ ID NO: 384660 - DNA, 20 bp, human
ggctcagggcaatcatggtc

SEQ ID NO: 384661 - DNA, 20 bp, human
gtggatgtcgcttatctttt

SEQ ID NO: 384662 - DNA, 20 bp, human
gctcccccaccccgcggcgg

SEQ ID NO: 384663 - DNA, 20 bp, human
gatgtcttcgcctccctccc

SEQ ID NO: 384664 - DNA, 20 bp, human
gaatcaactttcagccaggg

SEQ ID NO: 384665 - DNA, 20 bp, human
ggtcaacagatagtgtagtg

SEQ ID NO: 384666 - DNA, 20 bp, human
gccggggcatagcaccggaa

SEQ ID NO: 384667 - DNA, 20 bp, human
ggcaccggaaaggctcgtat

SEQ ID NO: 384668 - DNA, 20 bp, human
gctcgtatcggagaacggtg

SEQ ID NO: 384669 - DNA, 20 bp, human
gaagcggaagtgcgatcttc

SEQ ID NO: 384670 - DNA, 20 bp, human
gagctgaagggctggtagtc

SEQ ID NO: 384671 - DNA, 20 bp, human
gtgtggccacgagagtctag

SEQ ID NO: 384672 - DNA, 20 bp, human
gtatcccaataactggattc

SEQ ID NO: 384673 - DNA, 20 bp, human
gcgccgccactatcctcctc

SEQ ID NO: 384674 - DNA, 20 bp, human
gtacctcagcccaacttctg

SEQ ID NO: 384675 - DNA, 20 bp, human
gaaaggctcgtatcggagaa

SEQ ID NO: 384676 - DNA, 20 bp, human
gacccaggccggtgcctggt

SEQ ID NO: 384677 - DNA, 20 bp, human
ggaaaacccaggccggtgcc

SEQ ID NO: 384678 - DNA, 20 bp, human
gtgtgatgtcactgttccaa

SEQ ID NO: 384679 - DNA, 20 bp, human
gtgagttagggggagtagtc

SEQ ID NO: 384680 - DNA, 20 bp, human
gtctgatctttggctagttc

SEQ ID NO: 384681 - DNA, 20 bp, human
ggcacagctcacaatggctc

SEQ ID NO: 384682 - DNA, 20 bp, human
gattcattggttgggtgagt

SEQ ID NO: 384683 - DNA, 20 bp, human
gatgaactgaaaacccaggc

SEQ ID NO: 384684 - DNA, 20 bp, human
gtgagtaagattcattggtt

SEQ ID NO: 384685 - DNA, 20 bp, human
gctcaaaaccaaccaggcac

SEQ ID NO: 384686 - DNA, 20 bp, human
gccgcggggactcccactcc

SEQ ID NO: 384687 - DNA, 20 bp, human
gcgcgtccagccctctgcga

SEQ ID NO: 384688 - DNA, 20 bp, human
gcgcggccgtccgaggacga

SEQ ID NO: 384689 - DNA, 20 bp, human
ggggcgtgggcgggtcccgt

SEQ ID NO: 384690 - DNA, 20 bp, human
gcgagccaaggccctcgcag

SEQ ID NO: 384691 - DNA, 20 bp, human
ggcggcgcgggggagatggt

SEQ ID NO: 384692 - DNA, 20 bp, human
gggggtccaacgccagcctg

SEQ ID NO: 384693 - DNA, 20 bp, human
gaggaagtgctcgccgcccg

SEQ ID NO: 384694 - DNA, 20 bp, human
ggtggggcgcgagctcccgt

SEQ ID NO: 384695 - DNA, 20 bp, human
ggggccttggctcgcccctg

SEQ ID NO: 384696 - DNA, 20 bp, human
gcggccgggcggagcactta

SEQ ID NO: 384697 - DNA, 20 bp, human
gccagctgcgggtcccgacc

SEQ ID NO: 384698 - DNA, 20 bp, human
gtcggggccgagtccttcgc

SEQ ID NO: 384699 - DNA, 20 bp, human
gcctccggggcccccttacc

SEQ ID NO: 384700 - DNA, 20 bp, human
gccggcacccctgtcgcgat

SEQ ID NO: 384701 - DNA, 20 bp, human
gtacctggaggcggctgcga

SEQ ID NO: 384702 - DNA, 20 bp, human
ggaggcggctgcgaaggcaa

SEQ ID NO: 384703 - DNA, 20 bp, human
gcccctgtcgcgatgggtgg

SEQ ID NO: 384704 - DNA, 20 bp, human
gcggcgccacatctgtgtgt

SEQ ID NO: 384705 - DNA, 20 bp, human
gcacttagggagcgcggcgc

SEQ ID NO: 384706 - DNA, 20 bp, human
ggcaacatgtcatagtgggg

SEQ ID NO: 384707 - DNA, 20 bp, human
gcggggcaacatgtcatagt

SEQ ID NO: 384708 - DNA, 20 bp, human
gcacacacttatctaggctc

SEQ ID NO: 384709 - DNA, 20 bp, human
gaacacgatgtgtatcttct

SEQ ID NO: 384710 - DNA, 20 bp, human
gtggatagcagtaggttcaa

SEQ ID NO: 384711 - DNA, 20 bp, human
ggaaatccacacacttatct

SEQ ID NO: 384712 - DNA, 20 bp, human
gatagtggggtgggtggcaa

SEQ ID NO: 384713 - DNA, 20 bp, human
gttcatggccaagtcttccc

SEQ ID NO: 384714 - DNA, 20 bp, human
gaatctcagaacattctgag

SEQ ID NO: 384715 - DNA, 20 bp, human
gagaggtcatgacataggat

SEQ ID NO: 384716 - DNA, 20 bp, human
gaagacaggaaatcaatcag

SEQ ID NO: 384717 - DNA, 20 bp, human
gctcccaggggcgtagaaga

SEQ ID NO: 384718 - DNA, 20 bp, human
ggacgcctcgcggggacggt

SEQ ID NO: 384719 - DNA, 20 bp, human
gagaggcagagcgacgcctc

SEQ ID NO: 384720 - DNA, 20 bp, human
gtgctggcttgggtcactcg

SEQ ID NO: 384721 - DNA, 20 bp, human
gagagcgacgcctctggctc

SEQ ID NO: 384722 - DNA, 20 bp, human
gcttgggtcactcgaggtca

SEQ ID NO: 384723 - DNA, 20 bp, human
ggcctctggctctggtctag

SEQ ID NO: 384724 - DNA, 20 bp, human
gcggcgagtggacgcctcgc

SEQ ID NO: 384725 - DNA, 20 bp, human
gcacagggcgggaacaggcg

SEQ ID NO: 384726 - DNA, 20 bp, human
gctgccccggtgctactcgg

SEQ ID NO: 384727 - DNA, 20 bp, human
ggacccccccactagagggc

SEQ ID NO: 384728 - DNA, 20 bp, human
ggaaggacccccccactaga

SEQ ID NO: 384729 - DNA, 20 bp, human
gcggcggagctcattggcag

SEQ ID NO: 384730 - DNA, 20 bp, human
ggccctgccccggtgctact

SEQ ID NO: 384731 - DNA, 20 bp, human
ggccctgtacgcgacccgta

SEQ ID NO: 384732 - DNA, 20 bp, human
gctctgggaaaaccacgtgg

SEQ ID NO: 384733 - DNA, 20 bp, human
gcacgtggaggtgactaaaa

SEQ ID NO: 384734 - DNA, 20 bp, human
gcgggccgcctgccctctag

SEQ ID NO: 384735 - DNA, 20 bp, human
ggtagggctcgcctataaaa

SEQ ID NO: 384736 - DNA, 20 bp, human
gtaaacttgcggttttgaca

SEQ ID NO: 384737 - DNA, 20 bp, human
gaggctgtgtctccggggat

SEQ ID NO: 384738 - DNA, 20 bp, human
gggtgggcgggcccagcgaa

SEQ ID NO: 384739 - DNA, 20 bp, human
ggggctgcccatacttgcca

SEQ ID NO: 384740 - DNA, 20 bp, human
gtaaaggagaattacttcca

SEQ ID NO: 384741 - DNA, 20 bp, human
gccccgccctcgcgcctagg

SEQ ID NO: 384742 - DNA, 20 bp, human
ggacggcatcagaaggtcag

SEQ ID NO: 384743 - DNA, 20 bp, human
gggtcagaggtgagtcacgt

SEQ ID NO: 384744 - DNA, 20 bp, human
gaactcgtgggtacatcttt

SEQ ID NO: 384745 - DNA, 20 bp, human
gcgcctaggcggccggtggg

SEQ ID NO: 384746 - DNA, 20 bp, human
ggcggcccgagcctggacgg

SEQ ID NO: 384747 - DNA, 20 bp, human
gccgcctgcgccaccagtgg

SEQ ID NO: 384748 - DNA, 20 bp, human
gtgcgcggcccgagcctgga

SEQ ID NO: 384749 - DNA, 20 bp, human
ggaggcacggcagccgccga

SEQ ID NO: 384750 - DNA, 20 bp, human
gcccgcagctgccacgtaaa

SEQ ID NO: 384751 - DNA, 20 bp, human
gagagtcgcttgtccctcgg

SEQ ID NO: 384752 - DNA, 20 bp, human
gagggacaagcgactctgcg

SEQ ID NO: 384753 - DNA, 20 bp, human
ggtggcgcaggcggaagggg

SEQ ID NO: 384754 - DNA, 20 bp, human
ggcctggacggcggctccga

SEQ ID NO: 384755 - DNA, 20 bp, human
ggcagctgccacgtaaaggg

SEQ ID NO: 384756 - DNA, 20 bp, human
gccccccgcaacgcctctcc

SEQ ID NO: 384757 - DNA, 20 bp, human
ggagacccaccctccgagcc

SEQ ID NO: 384758 - DNA, 20 bp, human
gcgctggccgcgctgcgcca

SEQ ID NO: 384759 - DNA, 20 bp, human
gacgcctctcccggctcgga

SEQ ID NO: 384760 - DNA, 20 bp, human
gagcgcgcagaacagcgggg

SEQ ID NO: 384761 - DNA, 20 bp, human
ggagctctgcgcttccggga

SEQ ID NO: 384762 - DNA, 20 bp, human
gcaaggagactggttctcga

SEQ ID NO: 384763 - DNA, 20 bp, human
gtggacctgggtcgacctgg

SEQ ID NO: 384764 - DNA, 20 bp, human
gcgagccgggagaggcgttg

SEQ ID NO: 384765 - DNA, 20 bp, human
gagggtgggtctccgcggag

SEQ ID NO: 384766 - DNA, 20 bp, human
gcgggcgccgggctgtgtga

SEQ ID NO: 384767 - DNA, 20 bp, human
gcccccgcaacgagagtaga

SEQ ID NO: 384768 - DNA, 20 bp, human
gggcggggcgcggcagtgtt

SEQ ID NO: 384769 - DNA, 20 bp, human
ggtaaggggcgagaaattaa

SEQ ID NO: 384770 - DNA, 20 bp, human
gggcgcggcagtgttcggta

SEQ ID NO: 384771 - DNA, 20 bp, human
ggaggtaagctgcggggtaa

SEQ ID NO: 384772 - DNA, 20 bp, human
ggcgccctctactctcgttg

SEQ ID NO: 384773 - DNA, 20 bp, human
gtacctccggcatctcgcag

SEQ ID NO: 384774 - DNA, 20 bp, human
gcggcagtgttcggtacgga

SEQ ID NO: 384775 - DNA, 20 bp, human
gtcggtacggatggagttgc

SEQ ID NO: 384776 - DNA, 20 bp, human
ggggaaccggaggccgtcag

SEQ ID NO: 384777 - DNA, 20 bp, human
gggcatcatggcggtaattg

SEQ ID NO: 384778 - DNA, 20 bp, human
gccggggcggggcagtgacc

SEQ ID NO: 384779 - DNA, 20 bp, human
gactgaggcggttgcggaat

SEQ ID NO: 384780 - DNA, 20 bp, human
ggcttgccggggatcgtggt

SEQ ID NO: 384781 - DNA, 20 bp, human
gccccggcgcagactgcgtg

SEQ ID NO: 384782 - DNA, 20 bp, human
ggggaagccatgggaaccgg

SEQ ID NO: 384783 - DNA, 20 bp, human
gcgcccgcctctccccctga

SEQ ID NO: 384784 - DNA, 20 bp, human
gtccgcaaccgcctcagtct

SEQ ID NO: 384785 - DNA, 20 bp, human
gggcggggcagtgaccgggt

SEQ ID NO: 384786 - DNA, 20 bp, human
gtatgtagcacccatgaagt

SEQ ID NO: 384787 - DNA, 20 bp, human
gcctcctgcgagccaaacat

SEQ ID NO: 384788 - DNA, 20 bp, human
gggtggaaagacctcttctg

SEQ ID NO: 384789 - DNA, 20 bp, human
gagcacccatgaagtaggtt

SEQ ID NO: 384790 - DNA, 20 bp, human
gcagaggaggctccagaaag

SEQ ID NO: 384791 - DNA, 20 bp, human
ggcttaccaaacctacttca

SEQ ID NO: 384792 - DNA, 20 bp, human
ggccatgatactcccatgtt

SEQ ID NO: 384793 - DNA, 20 bp, human
ggccaaacatgggagtatca

SEQ ID NO: 384794 - DNA, 20 bp, human
gtgacagccctaatgaaggg

SEQ ID NO: 384795 - DNA, 20 bp, human
gcccagccccaaagagcaaa

SEQ ID NO: 384796 - DNA, 20 bp, human
gggggcggggccagagtcgt

SEQ ID NO: 384797 - DNA, 20 bp, human
gtggccccgcccctcgtccc

SEQ ID NO: 384798 - DNA, 20 bp, human
gtagcgctggggagcatcta

SEQ ID NO: 384799 - DNA, 20 bp, human
gcaaccgcctgtaaccacgg

SEQ ID NO: 384800 - DNA, 20 bp, human
gacccggatgcgttcttctc

SEQ ID NO: 384801 - DNA, 20 bp, human
gtcgtcccaggctgcaacgg

SEQ ID NO: 384802 - DNA, 20 bp, human
gtcacgggagccggtgtctc

SEQ ID NO: 384803 - DNA, 20 bp, human
gacgcgttggagtgcgtacg

SEQ ID NO: 384804 - DNA, 20 bp, human
gggggcgagaccaggaaacg

SEQ ID NO: 384805 - DNA, 20 bp, human
gccctctccgcccacgactc

SEQ ID NO: 384806 - DNA, 20 bp, human
gggggcggggccagagtcgt

SEQ ID NO: 384807 - DNA, 20 bp, human
gtggccccgcccctcgtccc

SEQ ID NO: 384808 - DNA, 20 bp, human
gcaaccgcctgtaaccacgg

SEQ ID NO: 384809 - DNA, 20 bp, human
gtagcgctggggagcatcta

SEQ ID NO: 384810 - DNA, 20 bp, human
gacccggatgcgttcttctc

SEQ ID NO: 384811 - DNA, 20 bp, human
gtcgtcccaggctgcaacgg

SEQ ID NO: 384812 - DNA, 20 bp, human
gtcacgggagccggtgtctc

SEQ ID NO: 384813 - DNA, 20 bp, human
gacgcgttggagtgcgtacg

SEQ ID NO: 384814 - DNA, 20 bp, human
gggggcgagaccaggaaacg

SEQ ID NO: 384815 - DNA, 20 bp, human
gccctctccgcccacgactc

SEQ ID NO: 384816 - DNA, 20 bp, human
gcaatggggaactgtcaccg

SEQ ID NO: 384817 - DNA, 20 bp, human
gggaggaggggaaaccgcaa

SEQ ID NO: 384818 - DNA, 20 bp, human
gggaaggagctcgcaaagaa

SEQ ID NO: 384819 - DNA, 20 bp, human
gtgctgcaccccctaatcag

SEQ ID NO: 384820 - DNA, 20 bp, human
gcggtccagctgtgagtcag

SEQ ID NO: 384821 - DNA, 20 bp, human
gcaccccctaatcaggggta

SEQ ID NO: 384822 - DNA, 20 bp, human
gccaaccatacccctgatta

SEQ ID NO: 384823 - DNA, 20 bp, human
gaggagctcgcaaagaaggg

SEQ ID NO: 384824 - DNA, 20 bp, human
gtgtgagtcaggggttaatg

SEQ ID NO: 384825 - DNA, 20 bp, human
ggaaaagtcgagactatctt

SEQ ID NO: 384826 - DNA, 20 bp, human
gtgaaaagctagctgaccca

SEQ ID NO: 384827 - DNA, 20 bp, human
gagctcctgtggccgcccct

SEQ ID NO: 384828 - DNA, 20 bp, human
ggcctcatcgccagcctcag

SEQ ID NO: 384829 - DNA, 20 bp, human
gctgacccaggggcggccac

SEQ ID NO: 384830 - DNA, 20 bp, human
ggagacgctatcggaagttg

SEQ ID NO: 384831 - DNA, 20 bp, human
ggccgccgcgccgcttcttc

SEQ ID NO: 384832 - DNA, 20 bp, human
gacttccgatagcgtctcta

SEQ ID NO: 384833 - DNA, 20 bp, human
gcaaaacctggggaagagtc

SEQ ID NO: 384834 - DNA, 20 bp, human
gtggctccggaaacagccga

SEQ ID NO: 384835 - DNA, 20 bp, human
gggtcagctagcttttcaag

SEQ ID NO: 384836 - DNA, 20 bp, human
gcagggccgcgggacatctc

SEQ ID NO: 384837 - DNA, 20 bp, human
gagggcacccgctctctctc

SEQ ID NO: 384838 - DNA, 20 bp, human
ggcagtacctgattggggcg

SEQ ID NO: 384839 - DNA, 20 bp, human
gtggcgcggcagtacctgat

SEQ ID NO: 384840 - DNA, 20 bp, human
gtactgccgcgccagggccg

SEQ ID NO: 384841 - DNA, 20 bp, human
gtaaaagccgcgccccaatc

SEQ ID NO: 384842 - DNA, 20 bp, human
gccggcggaactcgcggtcc

SEQ ID NO: 384843 - DNA, 20 bp, human
gaggacaaagaagtggtaat

SEQ ID NO: 384844 - DNA, 20 bp, human
ggaaataagtttttattcta

SEQ ID NO: 384845 - DNA, 20 bp, human
ggcgaattgcgaacagagac

SEQ ID NO: 384846 - DNA, 20 bp, human
gacggtgcagcctaccgccg

SEQ ID NO: 384847 - DNA, 20 bp, human
gaccccggcccgcccggtga

SEQ ID NO: 384848 - DNA, 20 bp, human
gaggaggcgagcaagaggct

SEQ ID NO: 384849 - DNA, 20 bp, human
ggcggcaaacaagtctgcta

SEQ ID NO: 384850 - DNA, 20 bp, human
gggggccacccctcggcggt

SEQ ID NO: 384851 - DNA, 20 bp, human
gggaacaatagctcccctgg

SEQ ID NO: 384852 - DNA, 20 bp, human
gacaatagctcccctggagg

SEQ ID NO: 384853 - DNA, 20 bp, human
gcagccctgctgctgggcga

SEQ ID NO: 384854 - DNA, 20 bp, human
gtgacggagccgccggcggg

SEQ ID NO: 384855 - DNA, 20 bp, human
gggggcggagctgtcggcgc

SEQ ID NO: 384856 - DNA, 20 bp, human
ggagggaggggtcgacgagg

SEQ ID NO: 384857 - DNA, 20 bp, human
gcacgtgggaagaggcagtc

SEQ ID NO: 384858 - DNA, 20 bp, human
gagcccgcccggggtcacgt

SEQ ID NO: 384859 - DNA, 20 bp, human
gtggcgagcgagcccatctg

SEQ ID NO: 384860 - DNA, 20 bp, human
gggccgcggaagccacagat

SEQ ID NO: 384861 - DNA, 20 bp, human
ggcaggatgcaggtcccggg

SEQ ID NO: 384862 - DNA, 20 bp, human
gtggagcaggatgcaggtcc

SEQ ID NO: 384863 - DNA, 20 bp, human
gggcccgagtggggctaggc

SEQ ID NO: 384864 - DNA, 20 bp, human
ggaggcagtcgggctctgat

SEQ ID NO: 384865 - DNA, 20 bp, human
gcgggagggaggggtcgacg

SEQ ID NO: 384866 - DNA, 20 bp, human
gaggaagatctggaggtcgg

SEQ ID NO: 384867 - DNA, 20 bp, human
gaagatctggaggtcggcgg

SEQ ID NO: 384868 - DNA, 20 bp, human
gttagggaggggcaaacccg

SEQ ID NO: 384869 - DNA, 20 bp, human
gggacgggaggaagatctgg

SEQ ID NO: 384870 - DNA, 20 bp, human
gcgaggggacagatactcta

SEQ ID NO: 384871 - DNA, 20 bp, human
gaaaatgcctgatggacggg

SEQ ID NO: 384872 - DNA, 20 bp, human
gaaagctggctcctgtctct

SEQ ID NO: 384873 - DNA, 20 bp, human
ggggaggggcaaacccgagg

SEQ ID NO: 384874 - DNA, 20 bp, human
ggatggacgggaggaagatc

SEQ ID NO: 384875 - DNA, 20 bp, human
gggaatctgtagaaatgatt

SEQ ID NO: 384876 - DNA, 20 bp, human
gcagcacagcagcttctttc

SEQ ID NO: 384877 - DNA, 20 bp, human
gtgggaagggaggtgctcta

SEQ ID NO: 384878 - DNA, 20 bp, human
gagggtgtgctctgatcaca

SEQ ID NO: 384879 - DNA, 20 bp, human
gcagtaatgtagtaggtctg

SEQ ID NO: 384880 - DNA, 20 bp, human
ggagaactgtgtgcttataa

SEQ ID NO: 384881 - DNA, 20 bp, human
gaggtagcacaaatcctccc

SEQ ID NO: 384882 - DNA, 20 bp, human
ggaatccactgcactgatgg

SEQ ID NO: 384883 - DNA, 20 bp, human
ggtgacctccatcagtgcag

SEQ ID NO: 384884 - DNA, 20 bp, human
gagcttctttctggattccg

SEQ ID NO: 384885 - DNA, 20 bp, human
gcaaatcctccctggtgtac

SEQ ID NO: 384886 - DNA, 20 bp, human
ggctccatgagcagacgaga

SEQ ID NO: 384887 - DNA, 20 bp, human
ggggacaaatatggccctga

SEQ ID NO: 384888 - DNA, 20 bp, human
gaaggctggacttcgcaact

SEQ ID NO: 384889 - DNA, 20 bp, human
gcatgagcagacgagaaggc

SEQ ID NO: 384890 - DNA, 20 bp, human
ggggaaagggcagtccgctg

SEQ ID NO: 384891 - DNA, 20 bp, human
gtgaaaactagactagagga

SEQ ID NO: 384892 - DNA, 20 bp, human
gtcaccccagtcagagaagc

SEQ ID NO: 384893 - DNA, 20 bp, human
gccaagatggcgtcgaagat

SEQ ID NO: 384894 - DNA, 20 bp, human
gtcgacgccatcttgggaaa

SEQ ID NO: 384895 - DNA, 20 bp, human
gcgcgcctgcttctctgact

SEQ ID NO: 384896 - DNA, 20 bp, human
gtacttcagcggaacaggaa

SEQ ID NO: 384897 - DNA, 20 bp, human
gataacgcgggatttcagca

SEQ ID NO: 384898 - DNA, 20 bp, human
gacaactcccaggataacgc

SEQ ID NO: 384899 - DNA, 20 bp, human
gctaccacgccctagtagag

SEQ ID NO: 384900 - DNA, 20 bp, human
gccatcaggcactacttcag

SEQ ID NO: 384901 - DNA, 20 bp, human
ggtagtttcccgctctacta

SEQ ID NO: 384902 - DNA, 20 bp, human
gtgaaatcccgcgttatcct

SEQ ID NO: 384903 - DNA, 20 bp, human
gcagccacgcccctttctgg

SEQ ID NO: 384904 - DNA, 20 bp, human
gggcactacttcagcggaac

SEQ ID NO: 384905 - DNA, 20 bp, human
gagagtgattgagctctgac

SEQ ID NO: 384906 - DNA, 20 bp, human
gttctcacgcgcatgcggaa

SEQ ID NO: 384907 - DNA, 20 bp, human
gccggccgggcctgggaacg

SEQ ID NO: 384908 - DNA, 20 bp, human
ggccgtcagcatggcggaag

SEQ ID NO: 384909 - DNA, 20 bp, human
ggaaggggcggtagccggcc

SEQ ID NO: 384910 - DNA, 20 bp, human
gcagcgcgcgcgaaaaaggt

SEQ ID NO: 384911 - DNA, 20 bp, human
gcccacttccgccatgctga

SEQ ID NO: 384912 - DNA, 20 bp, human
ggcggctgccgtcagcatgg

SEQ ID NO: 384913 - DNA, 20 bp, human
ggaaatcgtcccccgcagaa

SEQ ID NO: 384914 - DNA, 20 bp, human
gatgcggaaggggcggtagc

SEQ ID NO: 384915 - DNA, 20 bp, human
gtccaaccagccacgttccc

SEQ ID NO: 384916 - DNA, 20 bp, human
gcagaggaggcgctgttgga

SEQ ID NO: 384917 - DNA, 20 bp, human
gccagcagagcaaaatgcag

SEQ ID NO: 384918 - DNA, 20 bp, human
gccactgttgggtttttcag

SEQ ID NO: 384919 - DNA, 20 bp, human
gtgccctgggggtgtgaaga

SEQ ID NO: 384920 - DNA, 20 bp, human
ggccgtggggatccagggtt

SEQ ID NO: 384921 - DNA, 20 bp, human
gacgcatggggacaagcctg

SEQ ID NO: 384922 - DNA, 20 bp, human
ggactctcagacggcccccc

SEQ ID NO: 384923 - DNA, 20 bp, human
gtgcagaggtgaccagccca

SEQ ID NO: 384924 - DNA, 20 bp, human
gaggcaggcgtgaccccagt

SEQ ID NO: 384925 - DNA, 20 bp, human
gcccagtcggggagtggact

SEQ ID NO: 384926 - DNA, 20 bp, human
gaggactagccagtccgggt

SEQ ID NO: 384927 - DNA, 20 bp, human
gctcttcaaacgttacccga

SEQ ID NO: 384928 - DNA, 20 bp, human
gtggcgaaggggcggaccgg

SEQ ID NO: 384929 - DNA, 20 bp, human
ggcgtggcgaaggggcggac

SEQ ID NO: 384930 - DNA, 20 bp, human
gaggctgctgcgtggcgaag

SEQ ID NO: 384931 - DNA, 20 bp, human
gaagcagcgtccgggccctc

SEQ ID NO: 384932 - DNA, 20 bp, human
gctgctgcgtggcgaagggg

SEQ ID NO: 384933 - DNA, 20 bp, human
gtacaagtacatacataacc

SEQ ID NO: 384934 - DNA, 20 bp, human
ggttcttggaaattcctacc

SEQ ID NO: 384935 - DNA, 20 bp, human
ggcactgagtcaaagcttga

SEQ ID NO: 384936 - DNA, 20 bp, human
gtgcgcagagcgctcccgga

SEQ ID NO: 384937 - DNA, 20 bp, human
ggacgcctctgggctcaaac

SEQ ID NO: 384938 - DNA, 20 bp, human
gacgccaggggtgtccctcc

SEQ ID NO: 384939 - DNA, 20 bp, human
ggggaggggtaggataacga

SEQ ID NO: 384940 - DNA, 20 bp, human
ggtagagctgggacggggga

SEQ ID NO: 384941 - DNA, 20 bp, human
ggcctctgggctcaaacagg

SEQ ID NO: 384942 - DNA, 20 bp, human
gataacgacggcatcagcag

SEQ ID NO: 384943 - DNA, 20 bp, human
gtcacacgatcgacgcctct

SEQ ID NO: 384944 - DNA, 20 bp, human
gcgccgtagagctgggacgg

SEQ ID NO: 384945 - DNA, 20 bp, human
gtgcgtcacgcgcacgccag

SEQ ID NO: 384946 - DNA, 20 bp, human
gtaccgcggcccaacagcaa

SEQ ID NO: 384947 - DNA, 20 bp, human
gcctcggttccggtagaggg

SEQ ID NO: 384948 - DNA, 20 bp, human
gggcccaacagcaagggtcg

SEQ ID NO: 384949 - DNA, 20 bp, human
ggagccgcgacccttgctgt

SEQ ID NO: 384950 - DNA, 20 bp, human
gctcgcgcgtgcgctcttcg

SEQ ID NO: 384951 - DNA, 20 bp, human
ggctccctcggttccggtag

SEQ ID NO: 384952 - DNA, 20 bp, human
gcgtgcgctcttcgcggctc

SEQ ID NO: 384953 - DNA, 20 bp, human
gagcaagggtcgcggctccc

SEQ ID NO: 384954 - DNA, 20 bp, human
ggagcatcatcccgactccg

SEQ ID NO: 384955 - DNA, 20 bp, human
gtgtctggctccctcggttc

SEQ ID NO: 384956 - DNA, 20 bp, human
gtcagggccagcgaaggtca

SEQ ID NO: 384957 - DNA, 20 bp, human
gcaactgggcggtgcctgag

SEQ ID NO: 384958 - DNA, 20 bp, human
ggaaggtcaggggtacccga

SEQ ID NO: 384959 - DNA, 20 bp, human
gtcgcgagcagtacattctc

SEQ ID NO: 384960 - DNA, 20 bp, human
gcccgcgtacacggttacca

SEQ ID NO: 384961 - DNA, 20 bp, human
ggggtacccctgaccttcgc

SEQ ID NO: 384962 - DNA, 20 bp, human
ggggctcggcgccgcgttct

SEQ ID NO: 384963 - DNA, 20 bp, human
gggcgccgagcccgcgtaca

SEQ ID NO: 384964 - DNA, 20 bp, human
gtgggcaacagcagaagcat

SEQ ID NO: 384965 - DNA, 20 bp, human
ggggagcgggtctgagtctt

SEQ ID NO: 384966 - DNA, 20 bp, human
gcccgctccgatgtctctgg

SEQ ID NO: 384967 - DNA, 20 bp, human
gccgagggcaatttggtgat

SEQ ID NO: 384968 - DNA, 20 bp, human
ggcgcccgctccgatgtctc

SEQ ID NO: 384969 - DNA, 20 bp, human
gctgacggacaaggccgggg

SEQ ID NO: 384970 - DNA, 20 bp, human
gggtgcgaggcgggcacaaa

SEQ ID NO: 384971 - DNA, 20 bp, human
ggctggtctcaccacgtgac

SEQ ID NO: 384972 - DNA, 20 bp, human
gaccgaacccccagagacat

SEQ ID NO: 384973 - DNA, 20 bp, human
gacccccagagacatcggag

SEQ ID NO: 384974 - DNA, 20 bp, human
gacgctgacggacaaggccg

SEQ ID NO: 384975 - DNA, 20 bp, human
gggcgctgccgagggcaatt

SEQ ID NO: 384976 - DNA, 20 bp, human
gaagactaggtgctcgttag

SEQ ID NO: 384977 - DNA, 20 bp, human
gaatgccgagtggtggcaag

SEQ ID NO: 384978 - DNA, 20 bp, human
ggcgcatgcgctcccggcac

SEQ ID NO: 384979 - DNA, 20 bp, human
ggacccaaaatgccgagtgg

SEQ ID NO: 384980 - DNA, 20 bp, human
ggggaacggaagtctctggc

SEQ ID NO: 384981 - DNA, 20 bp, human
gagcagggaacggaagtctc

SEQ ID NO: 384982 - DNA, 20 bp, human
gtatatctgggctgtagagt

SEQ ID NO: 384983 - DNA, 20 bp, human
gttcccaccgagagaagaat

SEQ ID NO: 384984 - DNA, 20 bp, human
ggaagtctctggctggaaag

SEQ ID NO: 384985 - DNA, 20 bp, human
gaccgagagaagaatgggat

SEQ ID NO: 384986 - DNA, 20 bp, human
gcgccctcgcagaaggacta

SEQ ID NO: 384987 - DNA, 20 bp, human
ggcccgtagtccttctgcga

SEQ ID NO: 384988 - DNA, 20 bp, human
gaggcggaagccagacccgg

SEQ ID NO: 384989 - DNA, 20 bp, human
gcggaactaccgtgcccaca

SEQ ID NO: 384990 - DNA, 20 bp, human
ggcagaaggactacgggccc

SEQ ID NO: 384991 - DNA, 20 bp, human
gggcaggcggaagccagacc

SEQ ID NO: 384992 - DNA, 20 bp, human
gtagtccggcctgcggtccg

SEQ ID NO: 384993 - DNA, 20 bp, human
gaggctgcctctcccgctgg

SEQ ID NO: 384994 - DNA, 20 bp, human
gaggactccaggagccgtcc

SEQ ID NO: 384995 - DNA, 20 bp, human
ggggccgccgcgctgtctgc

SEQ ID NO: 384996 - DNA, 20 bp, human
gcgggtggggagagctgccg

SEQ ID NO: 384997 - DNA, 20 bp, human
ggccacgcccgcaggtagac

SEQ ID NO: 384998 - DNA, 20 bp, human
gagccccgcccctcgggggc

SEQ ID NO: 384999 - DNA, 20 bp, human
gtcagacgtcgggttacgcg

SEQ ID NO: 385000 - DNA, 20 bp, human
gctgcggtggccggctcacc

SEQ ID NO: 385001 - DNA, 20 bp, human
gtgagccggccaccgcagac

SEQ ID NO: 385002 - DNA, 20 bp, human
ggcgcagccaaggttggggc

SEQ ID NO: 385003 - DNA, 20 bp, human
ggcactgcgatctcagacgt

SEQ ID NO: 385004 - DNA, 20 bp, human
gattggcgcagccaaggttg

SEQ ID NO: 385005 - DNA, 20 bp, human
gtgagatcgcagtgcctgat

SEQ ID NO: 385006 - DNA, 20 bp, human
gcgggtggggagagctgccg

SEQ ID NO: 385007 - DNA, 20 bp, human
ggccacgcccgcaggtagac

SEQ ID NO: 385008 - DNA, 20 bp, human
gtgagccggccaccgcagac

SEQ ID NO: 385009 - DNA, 20 bp, human
gctgcggtggccggctcacc

SEQ ID NO: 385010 - DNA, 20 bp, human
gagccccgcccctcgggggc

SEQ ID NO: 385011 - DNA, 20 bp, human
gtcagacgtcgggttacgcg

SEQ ID NO: 385012 - DNA, 20 bp, human
gcagaccggaatgagagcct

SEQ ID NO: 385013 - DNA, 20 bp, human
ggcgcagccaaggttggggc

SEQ ID NO: 385014 - DNA, 20 bp, human
ggcactgcgatctcagacgt

SEQ ID NO: 385015 - DNA, 20 bp, human
gattggcgcagccaaggttg

SEQ ID NO: 385016 - DNA, 20 bp, human
gatgatgaccatgacaacag

SEQ ID NO: 385017 - DNA, 20 bp, human
gcgagcacctactagagctg

SEQ ID NO: 385018 - DNA, 20 bp, human
gagtagaagtaatcgtcgta

SEQ ID NO: 385019 - DNA, 20 bp, human
gttgaggctcatctcgtgca

SEQ ID NO: 385020 - DNA, 20 bp, human
gcttgggcagcttaggtgaa

SEQ ID NO: 385021 - DNA, 20 bp, human
ggcctcaaccactgttgtca

SEQ ID NO: 385022 - DNA, 20 bp, human
ggattttccccagctctagt

SEQ ID NO: 385023 - DNA, 20 bp, human
gaccatgacaacagtggttg

SEQ ID NO: 385024 - DNA, 20 bp, human
gttagaaaccagctctggcc

SEQ ID NO: 385025 - DNA, 20 bp, human
ggtgtttgttgattgaatga

SEQ ID NO: 385026 - DNA, 20 bp, human
ggccggggaagagttgaaca

SEQ ID NO: 385027 - DNA, 20 bp, human
gcaccccgcgctcaccacaa

SEQ ID NO: 385028 - DNA, 20 bp, human
gtcccaggaggccatgagca

SEQ ID NO: 385029 - DNA, 20 bp, human
gtcccgttgtggtgagcgcg

SEQ ID NO: 385030 - DNA, 20 bp, human
gcccacctcctgagaaccga

SEQ ID NO: 385031 - DNA, 20 bp, human
gtgctgggatacggagtcct

SEQ ID NO: 385032 - DNA, 20 bp, human
gggtgagcgcggggtgtgct

SEQ ID NO: 385033 - DNA, 20 bp, human
gcctctaagcgcctgtcttc

SEQ ID NO: 385034 - DNA, 20 bp, human
ggcacggaccggtcccgttg

SEQ ID NO: 385035 - DNA, 20 bp, human
gtgcgcctgcgcgtccccgg

SEQ ID NO: 385036 - DNA, 20 bp, human
gctcacgtggacaccccagg

SEQ ID NO: 385037 - DNA, 20 bp, human
gactcggcgaagctcgcgta

SEQ ID NO: 385038 - DNA, 20 bp, human
gcactcgccgagtcttccgg

SEQ ID NO: 385039 - DNA, 20 bp, human
gggaggctcccatctgtcta

SEQ ID NO: 385040 - DNA, 20 bp, human
gacgttgcgggcgggaaaat

SEQ ID NO: 385041 - DNA, 20 bp, human
gtggccccgcccttttaccc

SEQ ID NO: 385042 - DNA, 20 bp, human
gcgcgtagggcctgggtaaa

SEQ ID NO: 385043 - DNA, 20 bp, human
gaaagggcggggccacgttg

SEQ ID NO: 385044 - DNA, 20 bp, human
gcccatctgtctagggtgag

SEQ ID NO: 385045 - DNA, 20 bp, human
ggagtcagcggtcacgtgac

SEQ ID NO: 385046 - DNA, 20 bp, human
ggctcccgccgcaaagtccg

SEQ ID NO: 385047 - DNA, 20 bp, human
gctggagtcagcccgtggtg

SEQ ID NO: 385048 - DNA, 20 bp, human
ggcgcggcgcggtgaagcac

SEQ ID NO: 385049 - DNA, 20 bp, human
ggcaggcgagggacggactc

SEQ ID NO: 385050 - DNA, 20 bp, human
gcacacagctggcatgatcg

SEQ ID NO: 385051 - DNA, 20 bp, human
gggagggcgcccggcgtagg

SEQ ID NO: 385052 - DNA, 20 bp, human
gacggactcaggaacctggt

SEQ ID NO: 385053 - DNA, 20 bp, human
gccacgggccgagcctgccc

SEQ ID NO: 385054 - DNA, 20 bp, human
ggagcggcagctgcaggcga

SEQ ID NO: 385055 - DNA, 20 bp, human
ggggcgcccggcgtaggcgg

SEQ ID NO: 385056 - DNA, 20 bp, human
gaaaggggacaagctcaggg

SEQ ID NO: 385057 - DNA, 20 bp, human
gctctggggaagaccagatg

SEQ ID NO: 385058 - DNA, 20 bp, human
gtgggtccgagcctgagaca

SEQ ID NO: 385059 - DNA, 20 bp, human
ggagttgggctccctgtctc

SEQ ID NO: 385060 - DNA, 20 bp, human
gctccaaaggggacaagctc

SEQ ID NO: 385061 - DNA, 20 bp, human
gtggaagagagagtccgtgc

SEQ ID NO: 385062 - DNA, 20 bp, human
gcctccccggctgggccgca

SEQ ID NO: 385063 - DNA, 20 bp, human
gcttgctcacactctcgctc

SEQ ID NO: 385064 - DNA, 20 bp, human
ggccctggggacccgaggtc

SEQ ID NO: 385065 - DNA, 20 bp, human
ggttcagaggcctctggaag

SEQ ID NO: 385066 - DNA, 20 bp, human
ggacaggggcggggtatggg

SEQ ID NO: 385067 - DNA, 20 bp, human
gcacgggcaccaatggggaa

SEQ ID NO: 385068 - DNA, 20 bp, human
gccaatccgggacaggggcg

SEQ ID NO: 385069 - DNA, 20 bp, human
gtgggcggggccgtatgcaa

SEQ ID NO: 385070 - DNA, 20 bp, human
ggtccaggccgcgagtcccg

SEQ ID NO: 385071 - DNA, 20 bp, human
ggccgccacgggcaccaatg

SEQ ID NO: 385072 - DNA, 20 bp, human
ggcggggccgtatgcaaggg

SEQ ID NO: 385073 - DNA, 20 bp, human
ggctgcagccgtcccagtcc

SEQ ID NO: 385074 - DNA, 20 bp, human
gccctgtcccggattggctg

SEQ ID NO: 385075 - DNA, 20 bp, human
gttgctagccccgggactcg

SEQ ID NO: 385076 - DNA, 20 bp, human
gagcctgccatgtcccggtc

SEQ ID NO: 385077 - DNA, 20 bp, human
gcgcgtgcggcgttccggac

SEQ ID NO: 385078 - DNA, 20 bp, human
gaggctcgcaaggtctttcg

SEQ ID NO: 385079 - DNA, 20 bp, human
gggccccgcctcccaggcgt

SEQ ID NO: 385080 - DNA, 20 bp, human
gggaacagctggtgcctccg

SEQ ID NO: 385081 - DNA, 20 bp, human
ggggacatggcaggctcgca

SEQ ID NO: 385082 - DNA, 20 bp, human
gcggaacgccgcacgcgggg

SEQ ID NO: 385083 - DNA, 20 bp, human
gccgcctcccaggcgtgggg

SEQ ID NO: 385084 - DNA, 20 bp, human
gcgcagaggcactgccaagg

SEQ ID NO: 385085 - DNA, 20 bp, human
ggggcggcgcagcgcagaga

SEQ ID NO: 385086 - DNA, 20 bp, human
ggcaaccggcgctgcggagg

SEQ ID NO: 385087 - DNA, 20 bp, human
gcgcgagccccgccggacct

SEQ ID NO: 385088 - DNA, 20 bp, human
ggtggcaaccggcgctgcgg

SEQ ID NO: 385089 - DNA, 20 bp, human
gccgcgcggtgctgtcgccg

SEQ ID NO: 385090 - DNA, 20 bp, human
gtgagtggggtcgctctagg

SEQ ID NO: 385091 - DNA, 20 bp, human
ggcgcggcggcgcgcaggac

SEQ ID NO: 385092 - DNA, 20 bp, human
gcgcgcaggactggtggctc

SEQ ID NO: 385093 - DNA, 20 bp, human
gccgtccaggaggcaagcta

SEQ ID NO: 385094 - DNA, 20 bp, human
gcgaccccactcagccggac

SEQ ID NO: 385095 - DNA, 20 bp, human
gcgcgcctgggggtgcgcga

SEQ ID NO: 385096 - DNA, 20 bp, human
gctccgggaacgagctcggc

SEQ ID NO: 385097 - DNA, 20 bp, human
gcgggctccgggaacgagct

SEQ ID NO: 385098 - DNA, 20 bp, human
gtgcccgccgagctcgttcc

SEQ ID NO: 385099 - DNA, 20 bp, human
ggacaaacccccccgggctc

SEQ ID NO: 385100 - DNA, 20 bp, human
gcgggccgccggagccagga

SEQ ID NO: 385101 - DNA, 20 bp, human
gtccctgcccagtgcggcgg

SEQ ID NO: 385102 - DNA, 20 bp, human
gtcgttcccggagcccgggg

SEQ ID NO: 385103 - DNA, 20 bp, human
gaggccagcagcgcgggcgt

SEQ ID NO: 385104 - DNA, 20 bp, human
gaggcccgggtgctctggcg

SEQ ID NO: 385105 - DNA, 20 bp, human
gctgcctcgccagagcaccc

SEQ ID NO: 385106 - DNA, 20 bp, human
gaaacggctcgcggtttctg

SEQ ID NO: 385107 - DNA, 20 bp, human
ggcggcgctcgccttcatcc

SEQ ID NO: 385108 - DNA, 20 bp, human
gcgtgcgactcagagtgaga

SEQ ID NO: 385109 - DNA, 20 bp, human
gaagcgcgcgcctgcgaggg

SEQ ID NO: 385110 - DNA, 20 bp, human
ggccccccgaatgaccaaat

SEQ ID NO: 385111 - DNA, 20 bp, human
gaccaaatagggcgcaggag

SEQ ID NO: 385112 - DNA, 20 bp, human
gggcgtggcgactcggctcg

SEQ ID NO: 385113 - DNA, 20 bp, human
ggccctatttggtcattcgg

SEQ ID NO: 385114 - DNA, 20 bp, human
ggaagagtagttttgcgggc

SEQ ID NO: 385115 - DNA, 20 bp, human
gccgcaaaactactcttcaa

SEQ ID NO: 385116 - DNA, 20 bp, human
gcttctgtccgctgcagtta

SEQ ID NO: 385117 - DNA, 20 bp, human
gtaaatcggggtcggagctg

SEQ ID NO: 385118 - DNA, 20 bp, human
gggccatgggtgcaccaaag

SEQ ID NO: 385119 - DNA, 20 bp, human
gtgccgggaggaggatgaac

SEQ ID NO: 385120 - DNA, 20 bp, human
ggtccgctgcagttagggct

SEQ ID NO: 385121 - DNA, 20 bp, human
ggaggcattcctgtgaaggg

SEQ ID NO: 385122 - DNA, 20 bp, human
gaatgcctcagcccagcaga

SEQ ID NO: 385123 - DNA, 20 bp, human
ggggcagggcctgagccgat

SEQ ID NO: 385124 - DNA, 20 bp, human
ggctaaagctaaatcggggt

SEQ ID NO: 385125 - DNA, 20 bp, human
gcagctgcagctagagttag

SEQ ID NO: 385126 - DNA, 20 bp, human
gagcctcccggcacctccta

SEQ ID NO: 385127 - DNA, 20 bp, human
gccgggtcgcggctgctaat

SEQ ID NO: 385128 - DNA, 20 bp, human
ggcggctgctaattggactg

SEQ ID NO: 385129 - DNA, 20 bp, human
gagaagcttccggccctagg

SEQ ID NO: 385130 - DNA, 20 bp, human
gggtacgttttcaatggaag

SEQ ID NO: 385131 - DNA, 20 bp, human
ggcccgaggtacgttttcaa

SEQ ID NO: 385132 - DNA, 20 bp, human
gtgcagccagcagcggcttt

SEQ ID NO: 385133 - DNA, 20 bp, human
gtccggccctaggaggtgcc

SEQ ID NO: 385134 - DNA, 20 bp, human
gaacgagcacactctacgcc

SEQ ID NO: 385135 - DNA, 20 bp, human
gaagttaagtaatatgcccg

SEQ ID NO: 385136 - DNA, 20 bp, human
gggcccgggctgcaatcgag

SEQ ID NO: 385137 - DNA, 20 bp, human
ggccgcgcccaatcacagtc

SEQ ID NO: 385138 - DNA, 20 bp, human
gaggaggtccaggcgcctgt

SEQ ID NO: 385139 - DNA, 20 bp, human
gaatactcggctggcgaggg

SEQ ID NO: 385140 - DNA, 20 bp, human
ggggaagtggtgctgattta

SEQ ID NO: 385141 - DNA, 20 bp, human
ggcgcggcgtctagaaatta

SEQ ID NO: 385142 - DNA, 20 bp, human
gctccatcctgactgtgatt

SEQ ID NO: 385143 - DNA, 20 bp, human
ggcggcttttgactgagtgg

SEQ ID NO: 385144 - DNA, 20 bp, human
gttcccgcccagggcgttct

SEQ ID NO: 385145 - DNA, 20 bp, human
gcggggacccagaacgccct

SEQ ID NO: 385146 - DNA, 20 bp, human
ggctctgcgcagggcctcac

SEQ ID NO: 385147 - DNA, 20 bp, human
gtcggcagggaaagcatcgc

SEQ ID NO: 385148 - DNA, 20 bp, human
ggcgcagggcctcacgggac

SEQ ID NO: 385149 - DNA, 20 bp, human
ggtagtcgctcccctcacct

SEQ ID NO: 385150 - DNA, 20 bp, human
gcccgcgcgcgtcacagcct

SEQ ID NO: 385151 - DNA, 20 bp, human
gtcacgggactggtagttcg

SEQ ID NO: 385152 - DNA, 20 bp, human
gcgcgccgccggctctgcgc

SEQ ID NO: 385153 - DNA, 20 bp, human
gcggggcgacccaggtcctc

SEQ ID NO: 385154 - DNA, 20 bp, human
gctgcggccgccataccctc

SEQ ID NO: 385155 - DNA, 20 bp, human
gtctgcgtaccgcccactcc

SEQ ID NO: 385156 - DNA, 20 bp, human
gagggtggagtcggcctcaa

SEQ ID NO: 385157 - DNA, 20 bp, human
gcgagcagctagggtggagt

SEQ ID NO: 385158 - DNA, 20 bp, human
gcatgagagcggaacctttg

SEQ ID NO: 385159 - DNA, 20 bp, human
gaacttgggaactcttccac

SEQ ID NO: 385160 - DNA, 20 bp, human
gggcacccggaagcctgcga

SEQ ID NO: 385161 - DNA, 20 bp, human
gagttagcgagcagctaggg

SEQ ID NO: 385162 - DNA, 20 bp, human
gcggccctggacgcatccag

SEQ ID NO: 385163 - DNA, 20 bp, human
gtggacgcatccagcggcag

SEQ ID NO: 385164 - DNA, 20 bp, human
gtttagttagcgagcagcta

SEQ ID NO: 385165 - DNA, 20 bp, human
gcgtaggtcggaataaactt

SEQ ID NO: 385166 - DNA, 20 bp, human
ggcgcgccggcggccatcaa

SEQ ID NO: 385167 - DNA, 20 bp, human
ggtgccctccactccggaaa

SEQ ID NO: 385168 - DNA, 20 bp, human
ggaaccgtcggcgcccgagc

SEQ ID NO: 385169 - DNA, 20 bp, human
gactccggaaacggaaccgt

SEQ ID NO: 385170 - DNA, 20 bp, human
gaggagggcgggcgtccaat

SEQ ID NO: 385171 - DNA, 20 bp, human
ggccgcgcgaaggcaaccgt

SEQ ID NO: 385172 - DNA, 20 bp, human
ggcgccgacggttccgtttc

SEQ ID NO: 385173 - DNA, 20 bp, human
ggtctcagcttcagacaccc

SEQ ID NO: 385174 - DNA, 20 bp, human
gccccccgctcgggcgccga

SEQ ID NO: 385175 - DNA, 20 bp, human
gcgggggcaggaccgcagga

SEQ ID NO: 385176 - DNA, 20 bp, human
gaggagccagggcgcaggaa

SEQ ID NO: 385177 - DNA, 20 bp, human
ggagagggacgcgggagcaa

SEQ ID NO: 385178 - DNA, 20 bp, human
ggtgggaagagacccggaga

SEQ ID NO: 385179 - DNA, 20 bp, human
ggcggccgggggtggatttg

SEQ ID NO: 385180 - DNA, 20 bp, human
gggaagagacccggagaggg

SEQ ID NO: 385181 - DNA, 20 bp, human
gaggggaaggatgcggccgg

SEQ ID NO: 385182 - DNA, 20 bp, human
ggacccggagagggaggacg

SEQ ID NO: 385183 - DNA, 20 bp, human
gcggccgtggagagggacgc

SEQ ID NO: 385184 - DNA, 20 bp, human
ggctcccgcgtccctctcca

SEQ ID NO: 385185 - DNA, 20 bp, human
gaggggcgatcgtggactcc

SEQ ID NO: 385186 - DNA, 20 bp, human
gccccgcccacgcaacgcgg

SEQ ID NO: 385187 - DNA, 20 bp, human
gcaatcacgtggagacgggg

SEQ ID NO: 385188 - DNA, 20 bp, human
gggctggggttgttctgtcc

SEQ ID NO: 385189 - DNA, 20 bp, human
gccacgctgtgccgacacct

SEQ ID NO: 385190 - DNA, 20 bp, human
ggccgcaggcctccgagagc

SEQ ID NO: 385191 - DNA, 20 bp, human
ggggcggccatactggaaac

SEQ ID NO: 385192 - DNA, 20 bp, human
ggggcaggggcggagttgcg

SEQ ID NO: 385193 - DNA, 20 bp, human
ggggcggacagactgaccgc

SEQ ID NO: 385194 - DNA, 20 bp, human
gtcaaagcggtcgagaggtg

SEQ ID NO: 385195 - DNA, 20 bp, human
gaggtagcggtaacgggctg

SEQ ID NO: 385196 - DNA, 20 bp, human
ggcgaccgaggtcgggaaga

SEQ ID NO: 385197 - DNA, 20 bp, human
gcgctcaggcgaccgaggtc

SEQ ID NO: 385198 - DNA, 20 bp, human
ggggaagagggccacgtccc

SEQ ID NO: 385199 - DNA, 20 bp, human
gggagcgaatcgcagcacat

SEQ ID NO: 385200 - DNA, 20 bp, human
gcagggattggggatccgta

SEQ ID NO: 385201 - DNA, 20 bp, human
gcctgagcgcgcagggattg

SEQ ID NO: 385202 - DNA, 20 bp, human
gctgcgcgctcaggcgaccg

SEQ ID NO: 385203 - DNA, 20 bp, human
ggtggccctcttcccgacct

SEQ ID NO: 385204 - DNA, 20 bp, human
gtcacggaagcttctgatca

SEQ ID NO: 385205 - DNA, 20 bp, human
gacgtccctggaagcaacag

SEQ ID NO: 385206 - DNA, 20 bp, human
gaggtgggaattaggaactg

SEQ ID NO: 385207 - DNA, 20 bp, human
gttccgaagtgactggtctc

SEQ ID NO: 385208 - DNA, 20 bp, human
gaagactgtagacactggag

SEQ ID NO: 385209 - DNA, 20 bp, human
gagcctgagaccagtcactt

SEQ ID NO: 385210 - DNA, 20 bp, human
ggagctcatattgtcttcat

SEQ ID NO: 385211 - DNA, 20 bp, human
gtactctgttccgaagtgac

SEQ ID NO: 385212 - DNA, 20 bp, human
gagctcaaaggcacggggac

SEQ ID NO: 385213 - DNA, 20 bp, human
gatacaggttgccaggacaa

SEQ ID NO: 385214 - DNA, 20 bp, human
gcggcttaatgctgtttgat

SEQ ID NO: 385215 - DNA, 20 bp, human
gagacaatatgagctcaaaa

SEQ ID NO: 385216 - DNA, 20 bp, human
gaacccccccgcccgggcta

SEQ ID NO: 385217 - DNA, 20 bp, human
gccccccgcccgggctaggg

SEQ ID NO: 385218 - DNA, 20 bp, human
ggcgaccgcggacagattga

SEQ ID NO: 385219 - DNA, 20 bp, human
gtgtgcccgggaaagaagac

SEQ ID NO: 385220 - DNA, 20 bp, human
gcgcaccctcaatctgtccg

SEQ ID NO: 385221 - DNA, 20 bp, human
gttcgcctgcccgccgggag

SEQ ID NO: 385222 - DNA, 20 bp, human
gggagccgtcccagccgcct

SEQ ID NO: 385223 - DNA, 20 bp, human
gatggagaacccccccgccc

SEQ ID NO: 385224 - DNA, 20 bp, human
gtcccgcagtgaccacggga

SEQ ID NO: 385225 - DNA, 20 bp, human
gacaccctccctagcccggg

SEQ ID NO: 385226 - DNA, 20 bp, human
gccgccctgcgcatctccca

SEQ ID NO: 385227 - DNA, 20 bp, human
ggctccgcaaggaccgcatc

SEQ ID NO: 385228 - DNA, 20 bp, human
gggaacggaggcgatcgcca

SEQ ID NO: 385229 - DNA, 20 bp, human
ggcaaggaccgcatccggaa

SEQ ID NO: 385230 - DNA, 20 bp, human
ggaccgcatccggaacggaa

SEQ ID NO: 385231 - DNA, 20 bp, human
gtccgcgctcgcagggaggg

SEQ ID NO: 385232 - DNA, 20 bp, human
gcacagctgtcactccgaaa

SEQ ID NO: 385233 - DNA, 20 bp, human
gtgcgcggaggagggcccgc

SEQ ID NO: 385234 - DNA, 20 bp, human
gggaggtgggatttactttg

SEQ ID NO: 385235 - DNA, 20 bp, human
ggatcgcctccgttccgttc

SEQ ID NO: 385236 - DNA, 20 bp, human
ggggagctgcacgtgcagtc

SEQ ID NO: 385237 - DNA, 20 bp, human
gcgaatccgaactcactcga

SEQ ID NO: 385238 - DNA, 20 bp, human
gcggcaccctcgagtgagtt

SEQ ID NO: 385239 - DNA, 20 bp, human
gaggccgggagattcagcac

SEQ ID NO: 385240 - DNA, 20 bp, human
ggcgcccccaccggctccga

SEQ ID NO: 385241 - DNA, 20 bp, human
gagtgagttcggattcgagc

SEQ ID NO: 385242 - DNA, 20 bp, human
gaggaaactggggattgcgt

SEQ ID NO: 385243 - DNA, 20 bp, human
ggcccgcggccaccgggctc

SEQ ID NO: 385244 - DNA, 20 bp, human
gacaccctcggagccggtgg

SEQ ID NO: 385245 - DNA, 20 bp, human
gtggggattgcgttggaagt

SEQ ID NO: 385246 - DNA, 20 bp, human
gaaaaattcactatgttgtg

SEQ ID NO: 385247 - DNA, 20 bp, human
gaacttgcatgaacacaacc

SEQ ID NO: 385248 - DNA, 20 bp, human
gatgcaagttacaaagcaca

SEQ ID NO: 385249 - DNA, 20 bp, human
gattatctaggtttccaagt

SEQ ID NO: 385250 - DNA, 20 bp, human
gtctccttgtttgatgtgag

SEQ ID NO: 385251 - DNA, 20 bp, human
gttggaaacctagataattt

SEQ ID NO: 385252 - DNA, 20 bp, human
gaaatcattgttgagaaacc

SEQ ID NO: 385253 - DNA, 20 bp, human
gtcacataactcaggagata

SEQ ID NO: 385254 - DNA, 20 bp, human
gcatacttcgtgaatgttac

SEQ ID NO: 385255 - DNA, 20 bp, human
ggtggttttgcttgttgcat

SEQ ID NO: 385256 - DNA, 20 bp, human
ggcaagcgacagcccgtgcc

SEQ ID NO: 385257 - DNA, 20 bp, human
ggccccgtgacgccactcag

SEQ ID NO: 385258 - DNA, 20 bp, human
gcctgagcgggctgatgggt

SEQ ID NO: 385259 - DNA, 20 bp, human
ggggctcggacacatccccc

SEQ ID NO: 385260 - DNA, 20 bp, human
gcccgcacatacacgcctgg

SEQ ID NO: 385261 - DNA, 20 bp, human
ggggctgtcgcttgccatgg

SEQ ID NO: 385262 - DNA, 20 bp, human
gtatgtgcgggggcttggag

SEQ ID NO: 385263 - DNA, 20 bp, human
gggccactgagtggcgtcac

SEQ ID NO: 385264 - DNA, 20 bp, human
gggggcgggcgcgctccgtc

SEQ ID NO: 385265 - DNA, 20 bp, human
ggagccctgagcgggctgat

SEQ ID NO: 385266 - DNA, 20 bp, human
gggcgcggctgggtgagcgg

SEQ ID NO: 385267 - DNA, 20 bp, human
gcgtgcgcgctccctcaaga

SEQ ID NO: 385268 - DNA, 20 bp, human
gtactctgggccaaagtcct

SEQ ID NO: 385269 - DNA, 20 bp, human
gccagcggatgccctcttga

SEQ ID NO: 385270 - DNA, 20 bp, human
gagcactcggaggtgcggaa

SEQ ID NO: 385271 - DNA, 20 bp, human
gcggccagcactcggaggtg

SEQ ID NO: 385272 - DNA, 20 bp, human
ggccgagcgctcaacatccg

SEQ ID NO: 385273 - DNA, 20 bp, human
gcacgagagcggggttactc

SEQ ID NO: 385274 - DNA, 20 bp, human
gtcggcgtatcgcagctcaa

SEQ ID NO: 385275 - DNA, 20 bp, human
ggggaaaggtcacgagagcg

SEQ ID NO: 385276 - DNA, 20 bp, human
ggggccaccgacgctccgaa

SEQ ID NO: 385277 - DNA, 20 bp, human
gggggtcaagagggatctag

SEQ ID NO: 385278 - DNA, 20 bp, human
ggagggtcctccttctctgg

SEQ ID NO: 385279 - DNA, 20 bp, human
gagctgtcccattgagggga

SEQ ID NO: 385280 - DNA, 20 bp, human
gagcgtcggtggcccggctc

SEQ ID NO: 385281 - DNA, 20 bp, human
ggaggacgaggctgtgacgg

SEQ ID NO: 385282 - DNA, 20 bp, human
gaagggtgcaagtacttagt

SEQ ID NO: 385283 - DNA, 20 bp, human
gctctggcgggggggtcaag

SEQ ID NO: 385284 - DNA, 20 bp, human
gctagcggtgacgtgagacc

SEQ ID NO: 385285 - DNA, 20 bp, human
ggatgagctgtcccattgag

SEQ ID NO: 385286 - DNA, 20 bp, human
gaggccgtgcgcagtgtggg

SEQ ID NO: 385287 - DNA, 20 bp, human
gggagccctaagtcagctag

SEQ ID NO: 385288 - DNA, 20 bp, human
gcacccgccgctctgctctg

SEQ ID NO: 385289 - DNA, 20 bp, human
gtacgagccggccctcagca

SEQ ID NO: 385290 - DNA, 20 bp, human
gaggaggaacgggagttagg

SEQ ID NO: 385291 - DNA, 20 bp, human
ggcaaggccgtgcgcagtgt

SEQ ID NO: 385292 - DNA, 20 bp, human
gctgagggccggctcgtagt

SEQ ID NO: 385293 - DNA, 20 bp, human
gagggccggctcgtagtggg

SEQ ID NO: 385294 - DNA, 20 bp, human
ggggccccgtctgcgccgtg

SEQ ID NO: 385295 - DNA, 20 bp, human
gtgccgcctcgccttcttat

SEQ ID NO: 385296 - DNA, 20 bp, human
gaaaaggggcggagactgac

SEQ ID NO: 385297 - DNA, 20 bp, human
gcagttggaagtcagcctta

SEQ ID NO: 385298 - DNA, 20 bp, human
gaatatgcgccgagagggaa

SEQ ID NO: 385299 - DNA, 20 bp, human
ggggctccacctacccgctc

SEQ ID NO: 385300 - DNA, 20 bp, human
gtctcattagggtacagcat

SEQ ID NO: 385301 - DNA, 20 bp, human
gcaggggtgcactctcatta

SEQ ID NO: 385302 - DNA, 20 bp, human
gtctgtcccaatccctgttc

SEQ ID NO: 385303 - DNA, 20 bp, human
gtgactggaagcggagacct

SEQ ID NO: 385304 - DNA, 20 bp, human
gtgcgtctctcccaagtgac

SEQ ID NO: 385305 - DNA, 20 bp, human
gtggtgggaagggccggagc

SEQ ID NO: 385306 - DNA, 20 bp, human
ggggagcttcgagagttctt

SEQ ID NO: 385307 - DNA, 20 bp, human
gtggaccagatgatcctgat

SEQ ID NO: 385308 - DNA, 20 bp, human
gggtttgccggctacagtgt

SEQ ID NO: 385309 - DNA, 20 bp, human
gggcaagggggcaccagctc

SEQ ID NO: 385310 - DNA, 20 bp, human
gggtaaagagtatgtcataa

SEQ ID NO: 385311 - DNA, 20 bp, human
gttactaggcacgactgcga

SEQ ID NO: 385312 - DNA, 20 bp, human
ggatctctaaaaggggttgg

SEQ ID NO: 385313 - DNA, 20 bp, human
gcacgactgcgaaggcaagg

SEQ ID NO: 385314 - DNA, 20 bp, human
gcctgactgccacactggct

SEQ ID NO: 385315 - DNA, 20 bp, human
gaatgagtaggaggtgacct

SEQ ID NO: 385316 - DNA, 20 bp, human
gacctgggagacgtgatctg

SEQ ID NO: 385317 - DNA, 20 bp, human
gcggcccgcgctggaacagg

SEQ ID NO: 385318 - DNA, 20 bp, human
gtccgcgcggcagcaggcgg

SEQ ID NO: 385319 - DNA, 20 bp, human
gcccgcgctggaacaggcgg

SEQ ID NO: 385320 - DNA, 20 bp, human
gccagcgcgggccggtccct

SEQ ID NO: 385321 - DNA, 20 bp, human
gcctaggagacggcgcctga

SEQ ID NO: 385322 - DNA, 20 bp, human
ggcgctggaacaggcggagg

SEQ ID NO: 385323 - DNA, 20 bp, human
gcccccagatcacgtctccc

SEQ ID NO: 385324 - DNA, 20 bp, human
gcctgcgcaggcccgctccc

SEQ ID NO: 385325 - DNA, 20 bp, human
gcctccgtccgtaactgcgc

SEQ ID NO: 385326 - DNA, 20 bp, human
gcgcgcccaaacgaggccgg

SEQ ID NO: 385327 - DNA, 20 bp, human
gcccgcgcgcagtccgccaa

SEQ ID NO: 385328 - DNA, 20 bp, human
gtggacgcgagactccctag

SEQ ID NO: 385329 - DNA, 20 bp, human
gacaaagggaaggggcggtg

SEQ ID NO: 385330 - DNA, 20 bp, human
gaccccgccccatccctcta

SEQ ID NO: 385331 - DNA, 20 bp, human
gcgagactccctagagggat

SEQ ID NO: 385332 - DNA, 20 bp, human
gtgacaaggagacactcctg

SEQ ID NO: 385333 - DNA, 20 bp, human
gcgtcgcgcccaaacgaggc

SEQ ID NO: 385334 - DNA, 20 bp, human
gtggccctccagagaagggg

SEQ ID NO: 385335 - DNA, 20 bp, human
gcatgcgtcgcgcccaaacg

SEQ ID NO: 385336 - DNA, 20 bp, human
gcaggaagtcaaggctggat

SEQ ID NO: 385337 - DNA, 20 bp, human
ggaaaggagggctttagcac

SEQ ID NO: 385338 - DNA, 20 bp, human
gggaacgggagtctgggtca

SEQ ID NO: 385339 - DNA, 20 bp, human
gtggaggtaaacgtcccagc

SEQ ID NO: 385340 - DNA, 20 bp, human
ggccgcccccagcacgtaga

SEQ ID NO: 385341 - DNA, 20 bp, human
ggtgacctagaggccttcat

SEQ ID NO: 385342 - DNA, 20 bp, human
gcaccctgggaacgggagtc

SEQ ID NO: 385343 - DNA, 20 bp, human
gacccagactcccgttccca

SEQ ID NO: 385344 - DNA, 20 bp, human
gttcgcgagcaccctgggaa

SEQ ID NO: 385345 - DNA, 20 bp, human
gcccagcaggaagtcaaggc

SEQ ID NO: 385346 - DNA, 20 bp, human
gtacgggactccaggagggg

SEQ ID NO: 385347 - DNA, 20 bp, human
gtgaacgtccccctcccacg

SEQ ID NO: 385348 - DNA, 20 bp, human
gtcccgcactggcccggcaa

SEQ ID NO: 385349 - DNA, 20 bp, human
gagcgcgcgcccccgattaa

SEQ ID NO: 385350 - DNA, 20 bp, human
gcccggcggcccctttaatc

SEQ ID NO: 385351 - DNA, 20 bp, human
ggagaagataggagtcaggt

SEQ ID NO: 385352 - DNA, 20 bp, human
gttaggacacaggaaaccat

SEQ ID NO: 385353 - DNA, 20 bp, human
gggaaaccataggtatctac

SEQ ID NO: 385354 - DNA, 20 bp, human
gcctcccacgcggagaagat

SEQ ID NO: 385355 - DNA, 20 bp, human
gagtttggggactacattga

SEQ ID NO: 385356 - DNA, 20 bp, human
gaccgcgatggcagcggtag

SEQ ID NO: 385357 - DNA, 20 bp, human
ggtggggcgggcctcaaacc

SEQ ID NO: 385358 - DNA, 20 bp, human
gggcccgcgcgcgaccttct

SEQ ID NO: 385359 - DNA, 20 bp, human
gggcgcaggcgatcgagtaa

SEQ ID NO: 385360 - DNA, 20 bp, human
gacgtcagagagcccgtggc

SEQ ID NO: 385361 - DNA, 20 bp, human
gaccgggaccgcgatggcag

SEQ ID NO: 385362 - DNA, 20 bp, human
gcaggagaccgggaccgcga

SEQ ID NO: 385363 - DNA, 20 bp, human
gacgggctctctgacgtcac

SEQ ID NO: 385364 - DNA, 20 bp, human
gcgggcccccgccagtcagg

SEQ ID NO: 385365 - DNA, 20 bp, human
gtctctgcgccggtcagggc

SEQ ID NO: 385366 - DNA, 20 bp, human
gccctccggctgaatccggg

SEQ ID NO: 385367 - DNA, 20 bp, human
gcagccggagggcatggacc

SEQ ID NO: 385368 - DNA, 20 bp, human
gatagacggagcaacgggtc

SEQ ID NO: 385369 - DNA, 20 bp, human
gatgccctccggctgaatcc

SEQ ID NO: 385370 - DNA, 20 bp, human
ggaccgggtggagtcctgca

SEQ ID NO: 385371 - DNA, 20 bp, human
gctgtgctgcaacatcccgg

SEQ ID NO: 385372 - DNA, 20 bp, human
ggggacacagcgcatgcgcg

SEQ ID NO: 385373 - DNA, 20 bp, human
ggccgcccggattcagccgg

SEQ ID NO: 385374 - DNA, 20 bp, human
gtccgggcggcctgtaggcc

SEQ ID NO: 385375 - DNA, 20 bp, human
gagggagggcgtttccagga

SEQ ID NO: 385376 - DNA, 20 bp, human
gcacgcgccctgcatcccgg

SEQ ID NO: 385377 - DNA, 20 bp, human
gtccccgcccccgggatgca

SEQ ID NO: 385378 - DNA, 20 bp, human
gggcgcgtgctggtaatccg

SEQ ID NO: 385379 - DNA, 20 bp, human
gccgttggcggggaaccggg

SEQ ID NO: 385380 - DNA, 20 bp, human
ggcgccccggggccgcggca

SEQ ID NO: 385381 - DNA, 20 bp, human
gggcgcgtgcgcagtgtcct

SEQ ID NO: 385382 - DNA, 20 bp, human
ggagagaggtgagcggagaa

SEQ ID NO: 385383 - DNA, 20 bp, human
gggagaaaggcgggacgtcg

SEQ ID NO: 385384 - DNA, 20 bp, human
gagcggagaatggggacagt

SEQ ID NO: 385385 - DNA, 20 bp, human
ggcatcgcggctagcgccgt

SEQ ID NO: 385386 - DNA, 20 bp, human
gcatgcgccctgcattcagc

SEQ ID NO: 385387 - DNA, 20 bp, human
gctgagtccagggaacgcgg

SEQ ID NO: 385388 - DNA, 20 bp, human
gagaggggcggtcagagaat

SEQ ID NO: 385389 - DNA, 20 bp, human
gtctccacccgctgaatgca

SEQ ID NO: 385390 - DNA, 20 bp, human
gtcagagaatggggacggtg

SEQ ID NO: 385391 - DNA, 20 bp, human
gtggccgagctcacgtggtc

SEQ ID NO: 385392 - DNA, 20 bp, human
ggcgccctgcattcagcggg

SEQ ID NO: 385393 - DNA, 20 bp, human
gggcgcatgctgctacttgg

SEQ ID NO: 385394 - DNA, 20 bp, human
ggcgctctccgtcccggtgg

SEQ ID NO: 385395 - DNA, 20 bp, human
gagaatggggacggtgcggg

SEQ ID NO: 385396 - DNA, 20 bp, human
gccccgcgcccgcgtcacgg

SEQ ID NO: 385397 - DNA, 20 bp, human
gtcagcaggtggggatctcg

SEQ ID NO: 385398 - DNA, 20 bp, human
gcgcgtcacgggggaaacgt

SEQ ID NO: 385399 - DNA, 20 bp, human
ggtcacgggggaaacgtggg

SEQ ID NO: 385400 - DNA, 20 bp, human
gggcggtgtcccaacttcgg

SEQ ID NO: 385401 - DNA, 20 bp, human
ggtgggcggtgtcccaactt

SEQ ID NO: 385402 - DNA, 20 bp, human
gcggccctttaaacctttca

SEQ ID NO: 385403 - DNA, 20 bp, human
gcgcccaggtcctccgaagt

SEQ ID NO: 385404 - DNA, 20 bp, human
ggcgaggcctggggcctcca

SEQ ID NO: 385405 - DNA, 20 bp, human
ggggagttgtagtctcgggc

SEQ ID NO: 385406 - DNA, 20 bp, human
gtgaggaaaccgcttgtggt

SEQ ID NO: 385407 - DNA, 20 bp, human
gagaggggatgtagacgtct

SEQ ID NO: 385408 - DNA, 20 bp, human
gtagacgtctaggaacacag

SEQ ID NO: 385409 - DNA, 20 bp, human
gccccaccaccaaccacaag

SEQ ID NO: 385410 - DNA, 20 bp, human
gggaaaccgcttgtggttgg

SEQ ID NO: 385411 - DNA, 20 bp, human
gtacacctctagagatagat

SEQ ID NO: 385412 - DNA, 20 bp, human
gtggaagtttccccagagag

SEQ ID NO: 385413 - DNA, 20 bp, human
gcgtctacatcccctctctg

SEQ ID NO: 385414 - DNA, 20 bp, human
gacgttgcactttcatattg

SEQ ID NO: 385415 - DNA, 20 bp, human
ggggtggaacaccggatgtc

SEQ ID NO: 385416 - DNA, 20 bp, human
ggggcccctaatagtcaccc

SEQ ID NO: 385417 - DNA, 20 bp, human
gcacacccggctcctgcccc

SEQ ID NO: 385418 - DNA, 20 bp, human
gctgccccgggtgactatta

SEQ ID NO: 385419 - DNA, 20 bp, human
gggaccccagaataagtcgg

SEQ ID NO: 385420 - DNA, 20 bp, human
ggtcacccggggcaggagcc

SEQ ID NO: 385421 - DNA, 20 bp, human
gtgactattaggggccccgg

SEQ ID NO: 385422 - DNA, 20 bp, human
ggggtcccatggtaggttgg

SEQ ID NO: 385423 - DNA, 20 bp, human
ggcagaagcccgagacccag

SEQ ID NO: 385424 - DNA, 20 bp, human
gccgcccccgacttattctg

SEQ ID NO: 385425 - DNA, 20 bp, human
gcggggaccccagaataagt

SEQ ID NO: 385426 - DNA, 20 bp, human
ggggtccagccgcccagcgg

SEQ ID NO: 385427 - DNA, 20 bp, human
gcgcccagcgggggcttctc

SEQ ID NO: 385428 - DNA, 20 bp, human
gcgggaagctcaggcgccag

SEQ ID NO: 385429 - DNA, 20 bp, human
gtcgcggggtcccatctcta

SEQ ID NO: 385430 - DNA, 20 bp, human
gggtcccatctctaaggagt

SEQ ID NO: 385431 - DNA, 20 bp, human
ggctgtaaaaccctcgagga

SEQ ID NO: 385432 - DNA, 20 bp, human
ggggcctactccttagagat

SEQ ID NO: 385433 - DNA, 20 bp, human
gcaagtgaggcttcagggat

SEQ ID NO: 385434 - DNA, 20 bp, human
ggaagcccccgctgggcggc

SEQ ID NO: 385435 - DNA, 20 bp, human
ggggacgggcggagcgcccg

SEQ ID NO: 385436 - DNA, 20 bp, human
gaacagatggagaggggttg

SEQ ID NO: 385437 - DNA, 20 bp, human
gcctcccgcgctcctatcct

SEQ ID NO: 385438 - DNA, 20 bp, human
gttcccagggcagaggagtg

SEQ ID NO: 385439 - DNA, 20 bp, human
gtctcccaggataggagcgc

SEQ ID NO: 385440 - DNA, 20 bp, human
gggagtaaggatcttcccta

SEQ ID NO: 385441 - DNA, 20 bp, human
gcacggagaacagatggaga

SEQ ID NO: 385442 - DNA, 20 bp, human
ggcacagattctcccaggat

SEQ ID NO: 385443 - DNA, 20 bp, human
gtgggaaggcggagtttggg

SEQ ID NO: 385444 - DNA, 20 bp, human
gacctcgggcaccgagtcca

SEQ ID NO: 385445 - DNA, 20 bp, human
gggtgctgttggttgaacct

SEQ ID NO: 385446 - DNA, 20 bp, human
gtggaggccgggactccaaa

SEQ ID NO: 385447 - DNA, 20 bp, human
gggacggtttcaaaagctgg

SEQ ID NO: 385448 - DNA, 20 bp, human
ggcagccccggagcctcacc

SEQ ID NO: 385449 - DNA, 20 bp, human
gtgggtcggtgctgacttga

SEQ ID NO: 385450 - DNA, 20 bp, human
gggccgggactccaaagggc

SEQ ID NO: 385451 - DNA, 20 bp, human
gcacagagtgagaatgcgtg

SEQ ID NO: 385452 - DNA, 20 bp, human
gcggggacggtttcaaaagc

SEQ ID NO: 385453 - DNA, 20 bp, human
gtatcccccaggtgaggctc

SEQ ID NO: 385454 - DNA, 20 bp, human
gccggggctgcctagaccct

SEQ ID NO: 385455 - DNA, 20 bp, human
gcggtgctgacttgaaggag

SEQ ID NO: 385456 - DNA, 20 bp, human
gtgggaacgcagcggagcta

SEQ ID NO: 385457 - DNA, 20 bp, human
gagggaccctactggatgtt

SEQ ID NO: 385458 - DNA, 20 bp, human
ggcttcgccgagatcctctc

SEQ ID NO: 385459 - DNA, 20 bp, human
gcagtcttccaggggaggtc

SEQ ID NO: 385460 - DNA, 20 bp, human
ggcggagctagggaccctac

SEQ ID NO: 385461 - DNA, 20 bp, human
gaaagcacggaccccggagt

SEQ ID NO: 385462 - DNA, 20 bp, human
ggctccgaggaaacgcgcca

SEQ ID NO: 385463 - DNA, 20 bp, human
gcgcgagggcgtcccgctat

SEQ ID NO: 385464 - DNA, 20 bp, human
gatcctctcaggtgctcttg

SEQ ID NO: 385465 - DNA, 20 bp, human
gccctaggagcgaacttccg

SEQ ID NO: 385466 - DNA, 20 bp, human
gtctgaaagtgcttatttgg

SEQ ID NO: 385467 - DNA, 20 bp, human
gaatgatctcaagaagcaag

SEQ ID NO: 385468 - DNA, 20 bp, human
gctcacaaaaataaaacggt

SEQ ID NO: 385469 - DNA, 20 bp, human
ggcagagataaacttaaagc

SEQ ID NO: 385470 - DNA, 20 bp, human
gaacggtgggctgggcgaag

SEQ ID NO: 385471 - DNA, 20 bp, human
gtatatttataaattgggtg

SEQ ID NO: 385472 - DNA, 20 bp, human
ggtgaatgtcagtcatgtct

SEQ ID NO: 385473 - DNA, 20 bp, human
gtttatctctgcagcacttt

SEQ ID NO: 385474 - DNA, 20 bp, human
gtttttaagtcttactcaaa

SEQ ID NO: 385475 - DNA, 20 bp, human
ggggtttatatttataaatt

SEQ ID NO: 385476 - DNA, 20 bp, human
gcctccgctcgccaggctcg

SEQ ID NO: 385477 - DNA, 20 bp, human
gggtgaatcgcgttctcaga

SEQ ID NO: 385478 - DNA, 20 bp, human
gggaagcctgcggacgcgcc

SEQ ID NO: 385479 - DNA, 20 bp, human
ggcggagagcggatcgcccg

SEQ ID NO: 385480 - DNA, 20 bp, human
ggggagaggaatcgccgggg

SEQ ID NO: 385481 - DNA, 20 bp, human
gaggctcggggactcagggg

SEQ ID NO: 385482 - DNA, 20 bp, human
gcgccaggctcggggactca

SEQ ID NO: 385483 - DNA, 20 bp, human
gcgcccgcccgcacgcaccc

SEQ ID NO: 385484 - DNA, 20 bp, human
gggcggggttccacgcgccg

SEQ ID NO: 385485 - DNA, 20 bp, human
gggcgcccgggcgcgtccgc

SEQ ID NO: 385486 - DNA, 20 bp, human
gggctcgccccgcccgtggc

SEQ ID NO: 385487 - DNA, 20 bp, human
gggccggaaggatccggcaa

SEQ ID NO: 385488 - DNA, 20 bp, human
ggcccgtggccggaaggatc

SEQ ID NO: 385489 - DNA, 20 bp, human
ggcccagaggagaagagccg

SEQ ID NO: 385490 - DNA, 20 bp, human
gcactccaagccagtcgtgt

SEQ ID NO: 385491 - DNA, 20 bp, human
ggcaaaggcgcgccaaggcc

SEQ ID NO: 385492 - DNA, 20 bp, human
gatccggcaaaggcgcgcca

SEQ ID NO: 385493 - DNA, 20 bp, human
gaaggaaagagcgtcccgag

SEQ ID NO: 385494 - DNA, 20 bp, human
gcgcctttgccggatccttc

SEQ ID NO: 385495 - DNA, 20 bp, human
gaaagcgcgctcgctcccac

SEQ ID NO: 385496 - DNA, 20 bp, human
gaaggagggacgggcactac

SEQ ID NO: 385497 - DNA, 20 bp, human
gctaccggcctagatgacag

SEQ ID NO: 385498 - DNA, 20 bp, human
gtccggcgtgaactgtccat

SEQ ID NO: 385499 - DNA, 20 bp, human
gatgggaggcggctggtggt

SEQ ID NO: 385500 - DNA, 20 bp, human
ggcgcgccgtaccgccccac

SEQ ID NO: 385501 - DNA, 20 bp, human
gaactgtccattggtcggaa

SEQ ID NO: 385502 - DNA, 20 bp, human
ggtacaaaatcaaggaggga

SEQ ID NO: 385503 - DNA, 20 bp, human
gcggccgtagtgcgaatcat

SEQ ID NO: 385504 - DNA, 20 bp, human
gcgccccaccggcctccggt

SEQ ID NO: 385505 - DNA, 20 bp, human
ggtggcgagcgcatagccaa

SEQ ID NO: 385506 - DNA, 20 bp, human
gttgagccggcaaatcacca

SEQ ID NO: 385507 - DNA, 20 bp, human
gcgagcggcctcctcgtccc

SEQ ID NO: 385508 - DNA, 20 bp, human
gcaaagtgaagattgtgtct

SEQ ID NO: 385509 - DNA, 20 bp, human
gttccggcatgcaacgcgag

SEQ ID NO: 385510 - DNA, 20 bp, human
gaattgtagttcagatacgc

SEQ ID NO: 385511 - DNA, 20 bp, human
gacacactgattggtcggac

SEQ ID NO: 385512 - DNA, 20 bp, human
gcaatcagtgtgtcttgagc

SEQ ID NO: 385513 - DNA, 20 bp, human
gggccgctcgcgttgcatgc

SEQ ID NO: 385514 - DNA, 20 bp, human
ggcgtggccgacctctctta

SEQ ID NO: 385515 - DNA, 20 bp, human
gaccagagtcgggctctaat

SEQ ID NO: 385516 - DNA, 20 bp, human
gcaggcgcagcacaggtacg

SEQ ID NO: 385517 - DNA, 20 bp, human
gtccgtgggtgccaggttgt

SEQ ID NO: 385518 - DNA, 20 bp, human
gtcctctaaagcaacttccg

SEQ ID NO: 385519 - DNA, 20 bp, human
gtgcgcttgcgaggaccctg

SEQ ID NO: 385520 - DNA, 20 bp, human
gcgcagcacaggtacgtggg

SEQ ID NO: 385521 - DNA, 20 bp, human
ggaccttgagagagcggagg

SEQ ID NO: 385522 - DNA, 20 bp, human
ggtgggcgggcggatcgtgg

SEQ ID NO: 385523 - DNA, 20 bp, human
gtcgaccccacgccacgcag

SEQ ID NO: 385524 - DNA, 20 bp, human
gtacgtgggcgggcggatcg

SEQ ID NO: 385525 - DNA, 20 bp, human
ggaccctgaggtagattggg

SEQ ID NO: 385526 - DNA, 20 bp, human
gagtggaggtgcacgggcgg

SEQ ID NO: 385527 - DNA, 20 bp, human
gcgcaccgaggcggacgaga

SEQ ID NO: 385528 - DNA, 20 bp, human
gccgcgcccgggccttgggg

SEQ ID NO: 385529 - DNA, 20 bp, human
gaaccagcgtgaggacccac

SEQ ID NO: 385530 - DNA, 20 bp, human
ggaccccagaggaatccagt

SEQ ID NO: 385531 - DNA, 20 bp, human
ggagcgcggcggcaacaacg

SEQ ID NO: 385532 - DNA, 20 bp, human
ggaagcccgcggccgcgcgt

SEQ ID NO: 385533 - DNA, 20 bp, human
gctctgccagggccgcctgt

SEQ ID NO: 385534 - DNA, 20 bp, human
gccgcggagtggaggtgcac

SEQ ID NO: 385535 - DNA, 20 bp, human
gcgggcttcgcggaccccag

SEQ ID NO: 385536 - DNA, 20 bp, human
gtggcccgagggcgtgtggt

SEQ ID NO: 385537 - DNA, 20 bp, human
gaggagtagtcgtggcccga

SEQ ID NO: 385538 - DNA, 20 bp, human
gggcgagagctgaactggac

SEQ ID NO: 385539 - DNA, 20 bp, human
ggggtgggaggtgtgaatgg

SEQ ID NO: 385540 - DNA, 20 bp, human
gccctcggggcttcactcac

SEQ ID NO: 385541 - DNA, 20 bp, human
gggtggggcgagagctgaac

SEQ ID NO: 385542 - DNA, 20 bp, human
gtgtacacggttgtgaagga

SEQ ID NO: 385543 - DNA, 20 bp, human
ggaggcggagccagtcaaca

SEQ ID NO: 385544 - DNA, 20 bp, human
ggcgcggcggccggtccccg

SEQ ID NO: 385545 - DNA, 20 bp, human
gcgggtgaggggagtgccag

SEQ ID NO: 385546 - DNA, 20 bp, human
ggagcgccggatccaatggg

SEQ ID NO: 385547 - DNA, 20 bp, human
ggcggtgaggatgcgagcag

SEQ ID NO: 385548 - DNA, 20 bp, human
gcgggagcgccggatccaat

SEQ ID NO: 385549 - DNA, 20 bp, human
gcctctgccaggttgaggtg

SEQ ID NO: 385550 - DNA, 20 bp, human
gtggatccggcgctcccggc

SEQ ID NO: 385551 - DNA, 20 bp, human
gcgagcagaggaaggacacg

SEQ ID NO: 385552 - DNA, 20 bp, human
gggcgctcccggcaggtacc

SEQ ID NO: 385553 - DNA, 20 bp, human
ggccctcctcccattggatc

SEQ ID NO: 385554 - DNA, 20 bp, human
gtgaggatgcgagcagagga

SEQ ID NO: 385555 - DNA, 20 bp, human
ggcgcgggccctcctcccat

SEQ ID NO: 385556 - DNA, 20 bp, human
gcggctggagagggcgagaa

SEQ ID NO: 385557 - DNA, 20 bp, human
gggctcctctccaccggaaa

SEQ ID NO: 385558 - DNA, 20 bp, human
gagaggtaggatccggaagt

SEQ ID NO: 385559 - DNA, 20 bp, human
gcaccgcctaccaagacggg

SEQ ID NO: 385560 - DNA, 20 bp, human
ggcggttaagacactaggat

SEQ ID NO: 385561 - DNA, 20 bp, human
gaagtagctgatactctcat

SEQ ID NO: 385562 - DNA, 20 bp, human
gcgggcgttttggaagatac

SEQ ID NO: 385563 - DNA, 20 bp, human
gaaccgcccgtcttggtagg

SEQ ID NO: 385564 - DNA, 20 bp, human
gcggaagtagagtcacggag

SEQ ID NO: 385565 - DNA, 20 bp, human
gccaaccggacggctggaga

SEQ ID NO: 385566 - DNA, 20 bp, human
gaagaagaacgctatctcga

SEQ ID NO: 385567 - DNA, 20 bp, human
gcccagccctacgcccgcag

SEQ ID NO: 385568 - DNA, 20 bp, human
gggaaactgcgtgtttacgt

SEQ ID NO: 385569 - DNA, 20 bp, human
gccgtagtacgcaggagcaa

SEQ ID NO: 385570 - DNA, 20 bp, human
ggtaaggaagagcagctcaa

SEQ ID NO: 385571 - DNA, 20 bp, human
gaaggcttcgtacttggccg

SEQ ID NO: 385572 - DNA, 20 bp, human
ggcgagcgccgaacgctatc

SEQ ID NO: 385573 - DNA, 20 bp, human
gcggatcgggaagtgtcaag

SEQ ID NO: 385574 - DNA, 20 bp, human
gcgccgaacgctatcaggag

SEQ ID NO: 385575 - DNA, 20 bp, human
gtgcgtgcccctgcgggcgt

SEQ ID NO: 385576 - DNA, 20 bp, human
gaaggcaggcgccttaggtg

SEQ ID NO: 385577 - DNA, 20 bp, human
ggcggcgcgcgggtttgggc

SEQ ID NO: 385578 - DNA, 20 bp, human
ggcgccgcgcagtttgaccc

SEQ ID NO: 385579 - DNA, 20 bp, human
ggggaagaccaccaaagatc

SEQ ID NO: 385580 - DNA, 20 bp, human
gaggtcccaggagtcgactt

SEQ ID NO: 385581 - DNA, 20 bp, human
gggaccgaacggggacaggg

SEQ ID NO: 385582 - DNA, 20 bp, human
ggctggaccgaacggggaca

SEQ ID NO: 385583 - DNA, 20 bp, human
gccgccggggtcaaactgcg

SEQ ID NO: 385584 - DNA, 20 bp, human
ggcactgtcagcctgatctt

SEQ ID NO: 385585 - DNA, 20 bp, human
gtgaggaaggcaggcgcctt

SEQ ID NO: 385586 - DNA, 20 bp, human
gtgggtctcagggacattcg

SEQ ID NO: 385587 - DNA, 20 bp, human
gaggtggctgtggtgacctg

SEQ ID NO: 385588 - DNA, 20 bp, human
ggtctcagggacattcgagg

SEQ ID NO: 385589 - DNA, 20 bp, human
ggccaagtggccatcgtcac

SEQ ID NO: 385590 - DNA, 20 bp, human
ggctctggcaccccgctgca

SEQ ID NO: 385591 - DNA, 20 bp, human
gccgatgcccgtggccccgc

SEQ ID NO: 385592 - DNA, 20 bp, human
gagggacattcgaggcgggc

SEQ ID NO: 385593 - DNA, 20 bp, human
gcggggttctggtggtcacg

SEQ ID NO: 385594 - DNA, 20 bp, human
gacctggggtaacctggaga

SEQ ID NO: 385595 - DNA, 20 bp, human
gtccaggagctccttcacga

SEQ ID NO: 385596 - DNA, 20 bp, human
gggtcccttccaggttgcgc

SEQ ID NO: 385597 - DNA, 20 bp, human
ggcctcggccgtgtacaaaa

SEQ ID NO: 385598 - DNA, 20 bp, human
ggagcccgcgcaacctggaa

SEQ ID NO: 385599 - DNA, 20 bp, human
ggagcgcgccggtcccttcc

SEQ ID NO: 385600 - DNA, 20 bp, human
gcgcgcggggctgcccggct

SEQ ID NO: 385601 - DNA, 20 bp, human
ggtccggagcccgcgcaacc

SEQ ID NO: 385602 - DNA, 20 bp, human
gggatctgccgttttgtaca

SEQ ID NO: 385603 - DNA, 20 bp, human
gcgagctcaaagcagaacta

SEQ ID NO: 385604 - DNA, 20 bp, human
gcgcgctcagagcgcgttcc

SEQ ID NO: 385605 - DNA, 20 bp, human
gggctgggctgggtctcgtc

SEQ ID NO: 385606 - DNA, 20 bp, human
ggccctgcgcccgagcgctg

SEQ ID NO: 385607 - DNA, 20 bp, human
gcgagccctgcgcaacgttg

SEQ ID NO: 385608 - DNA, 20 bp, human
gagagcgcgccgtccaggag

SEQ ID NO: 385609 - DNA, 20 bp, human
ggtcccagagcgcgccgtcc

SEQ ID NO: 385610 - DNA, 20 bp, human
gggacgcgccccctcctgga

SEQ ID NO: 385611 - DNA, 20 bp, human
gacaaggcgccgcagcgctc

SEQ ID NO: 385612 - DNA, 20 bp, human
gcgctgcggcgccttgtgat

SEQ ID NO: 385613 - DNA, 20 bp, human
gtggcagcgccgttgggatt

SEQ ID NO: 385614 - DNA, 20 bp, human
ggcgctcgggcgcagggcca

SEQ ID NO: 385615 - DNA, 20 bp, human
gcaggagggggcgcgtccgt

SEQ ID NO: 385616 - DNA, 20 bp, human
ggggccgaccggctgttgga

SEQ ID NO: 385617 - DNA, 20 bp, human
ggaagcgcggtctacgtcac

SEQ ID NO: 385618 - DNA, 20 bp, human
gtgcacgagtggcccgccgg

SEQ ID NO: 385619 - DNA, 20 bp, human
gcacgcgcgctgcagcgcga

SEQ ID NO: 385620 - DNA, 20 bp, human
gagagcgagaaggagggctt

SEQ ID NO: 385621 - DNA, 20 bp, human
gtgagcatgcgcagcggctc

SEQ ID NO: 385622 - DNA, 20 bp, human
gctgcagcgcgcgtggctga

SEQ ID NO: 385623 - DNA, 20 bp, human
gccgagcgacggcccgcagt

SEQ ID NO: 385624 - DNA, 20 bp, human
gggcgcgcgccctgagagac

SEQ ID NO: 385625 - DNA, 20 bp, human
ggcgcgaggggagagcgaga

SEQ ID NO: 385626 - DNA, 20 bp, human
ggcccggggcgcgcccgcga

SEQ ID NO: 385627 - DNA, 20 bp, human
gccaggacgcgcggtgggta

SEQ ID NO: 385628 - DNA, 20 bp, human
gcgaggaatctgggagaaat

SEQ ID NO: 385629 - DNA, 20 bp, human
gcagtgcaggagcgaccggt

SEQ ID NO: 385630 - DNA, 20 bp, human
gcctgaggcccagttctata

SEQ ID NO: 385631 - DNA, 20 bp, human
ggccgtgcgcgcgaggaatc

SEQ ID NO: 385632 - DNA, 20 bp, human
gtaggggcgcgagagagcgg

SEQ ID NO: 385633 - DNA, 20 bp, human
gcgggccaggcagccgtgga

SEQ ID NO: 385634 - DNA, 20 bp, human
gtgtgcgggccaggcagccg

SEQ ID NO: 385635 - DNA, 20 bp, human
gcgcgagggaatggagagcc

SEQ ID NO: 385636 - DNA, 20 bp, human
gagaaaccggcaggctctct

SEQ ID NO: 385637 - DNA, 20 bp, human
gcttctgggcagaaaccggc

SEQ ID NO: 385638 - DNA, 20 bp, human
gactcaggcccagctcatca

SEQ ID NO: 385639 - DNA, 20 bp, human
gcggttgtggggatgatatt

SEQ ID NO: 385640 - DNA, 20 bp, human
gccagctcatcagggctttg

SEQ ID NO: 385641 - DNA, 20 bp, human
gttactggtgctgggaagga

SEQ ID NO: 385642 - DNA, 20 bp, human
gaggaggggcacagaggaat

SEQ ID NO: 385643 - DNA, 20 bp, human
gagggtatttcctgttcctc

SEQ ID NO: 385644 - DNA, 20 bp, human
gtgcccagaaggcggttgtg

SEQ ID NO: 385645 - DNA, 20 bp, human
gagtgtgtggagtcctgctc

SEQ ID NO: 385646 - DNA, 20 bp, human
gacagggtgtaacacacaga

SEQ ID NO: 385647 - DNA, 20 bp, human
gaccttgtttagaagaataa

SEQ ID NO: 385648 - DNA, 20 bp, human
gttagggcttgtgcttaaca

SEQ ID NO: 385649 - DNA, 20 bp, human
gggtgtaacacacagagggc

SEQ ID NO: 385650 - DNA, 20 bp, human
gagttcttctataactaatt

SEQ ID NO: 385651 - DNA, 20 bp, human
gttagttatagaagaactta

SEQ ID NO: 385652 - DNA, 20 bp, human
gctatagaagagtacctcct

SEQ ID NO: 385653 - DNA, 20 bp, human
gatgtattgtcaacaagtgg

SEQ ID NO: 385654 - DNA, 20 bp, human
gacctttattcttctaaaca

SEQ ID NO: 385655 - DNA, 20 bp, human
gtacctcctggggccaaggc

SEQ ID NO: 385656 - DNA, 20 bp, human
gtgacgcgacgcgtcctcac

SEQ ID NO: 385657 - DNA, 20 bp, human
ggagctgacccggacggcga

SEQ ID NO: 385658 - DNA, 20 bp, human
gctcacgggcgcctacgtca

SEQ ID NO: 385659 - DNA, 20 bp, human
gccaggaagtgaggccgcgg

SEQ ID NO: 385660 - DNA, 20 bp, human
gcgcctcgacgccgtgacgt

SEQ ID NO: 385661 - DNA, 20 bp, human
gtgcagcagcgacatggcgg

SEQ ID NO: 385662 - DNA, 20 bp, human
gaagtgaggccgcggcggag

SEQ ID NO: 385663 - DNA, 20 bp, human
ggcggaagatggtgcacctc

SEQ ID NO: 385664 - DNA, 20 bp, human
gtggggcagacggtggaact

SEQ ID NO: 385665 - DNA, 20 bp, human
ggaggacgcgtcgcgtcagg

SEQ ID NO: 385666 - DNA, 20 bp, human
gagggcctggggtccgtctg

SEQ ID NO: 385667 - DNA, 20 bp, human
gaggactcacgtaggaggga

SEQ ID NO: 385668 - DNA, 20 bp, human
gcggccctgggaaagcccgt

SEQ ID NO: 385669 - DNA, 20 bp, human
gacggcagatgcacgggtgg

SEQ ID NO: 385670 - DNA, 20 bp, human
gcaggggagcgacgggaggg

SEQ ID NO: 385671 - DNA, 20 bp, human
gctgctgcgcgagggtcact

SEQ ID NO: 385672 - DNA, 20 bp, human
gagcccgcggccgagcagag

SEQ ID NO: 385673 - DNA, 20 bp, human
ggggttcatgacaggctgca

SEQ ID NO: 385674 - DNA, 20 bp, human
gcagcctgtcatgaacccga

SEQ ID NO: 385675 - DNA, 20 bp, human
gagcccctcgggttcatgac

SEQ ID NO: 385676 - DNA, 20 bp, human
gtggatgtgcacatcgatgt

SEQ ID NO: 385677 - DNA, 20 bp, human
ggtcagggacacagtctatg

SEQ ID NO: 385678 - DNA, 20 bp, human
gggctcggtgtcctgttcag

SEQ ID NO: 385679 - DNA, 20 bp, human
gcggctgctggtggcctcgt

SEQ ID NO: 385680 - DNA, 20 bp, human
gggaatgtgtgtagcagagg

SEQ ID NO: 385681 - DNA, 20 bp, human
gagactgtgtccctgacaat

SEQ ID NO: 385682 - DNA, 20 bp, human
gacggcagatgcacgggtgg

SEQ ID NO: 385683 - DNA, 20 bp, human
gcgaaaggggaggttcccgc

SEQ ID NO: 385684 - DNA, 20 bp, human
ggaccaggacagccattcat

SEQ ID NO: 385685 - DNA, 20 bp, human
gacccctggcccctcacgag

SEQ ID NO: 385686 - DNA, 20 bp, human
gctcgccggccggagatctc

SEQ ID NO: 385687 - DNA, 20 bp, human
gagctcgctcgacgggtctg

SEQ ID NO: 385688 - DNA, 20 bp, human
gtctcggggcgaggatttca

SEQ ID NO: 385689 - DNA, 20 bp, human
gctcgccggccccggatctt

SEQ ID NO: 385690 - DNA, 20 bp, human
gcggggcgaggatttcaggg

SEQ ID NO: 385691 - DNA, 20 bp, human
gttgggatggggacttcagg

SEQ ID NO: 385692 - DNA, 20 bp, human
gcacgccggccggggatctg

SEQ ID NO: 385693 - DNA, 20 bp, human
ggggaggggagctcgctcga

SEQ ID NO: 385694 - DNA, 20 bp, human
gtcaaggggatgtccgtggg

SEQ ID NO: 385695 - DNA, 20 bp, human
ggcctcaaggggatgtccgt

SEQ ID NO: 385696 - DNA, 20 bp, human
ggacgggaggggtgtgccga

SEQ ID NO: 385697 - DNA, 20 bp, human
gagggcggactgtggatcgg

SEQ ID NO: 385698 - DNA, 20 bp, human
ggggagggctaggagcccgg

SEQ ID NO: 385699 - DNA, 20 bp, human
ggggcgaggaggccgtagga

SEQ ID NO: 385700 - DNA, 20 bp, human
gcgaggaggccgtaggaggg

SEQ ID NO: 385701 - DNA, 20 bp, human
gcggcgcgcgagcccaccgg

SEQ ID NO: 385702 - DNA, 20 bp, human
gggactgtggatcggaggta

SEQ ID NO: 385703 - DNA, 20 bp, human
gcgagatcaggccaggggag

SEQ ID NO: 385704 - DNA, 20 bp, human
gcagaggagcaaatgagtgg

SEQ ID NO: 385705 - DNA, 20 bp, human
ggagtgggggaaagtgtgag

SEQ ID NO: 385706 - DNA, 20 bp, human
gtgccccgaagcagccgcct

SEQ ID NO: 385707 - DNA, 20 bp, human
ggggcagcggcgcccgaagc

SEQ ID NO: 385708 - DNA, 20 bp, human
ggatccggagaggctcccgc

SEQ ID NO: 385709 - DNA, 20 bp, human
gggcgccgctgccctcgggc

SEQ ID NO: 385710 - DNA, 20 bp, human
gggcctaaaaagttctgatc

SEQ ID NO: 385711 - DNA, 20 bp, human
gaaaaagttctgatccggag

SEQ ID NO: 385712 - DNA, 20 bp, human
gtcggggcagtcgcttcctg

SEQ ID NO: 385713 - DNA, 20 bp, human
ggaactcgcctgtctctctg

SEQ ID NO: 385714 - DNA, 20 bp, human
gccggggactgcggggatgg

SEQ ID NO: 385715 - DNA, 20 bp, human
gggagccgaggcggctgctt

SEQ ID NO: 385716 - DNA, 20 bp, human
gcgagcgcgggaagcgcctg

SEQ ID NO: 385717 - DNA, 20 bp, human
ggacagctcctggtgcgcgc

SEQ ID NO: 385718 - DNA, 20 bp, human
gtcccgggacgcgtgcgcat

SEQ ID NO: 385719 - DNA, 20 bp, human
gtgtgtgaggcccgtacagg

SEQ ID NO: 385720 - DNA, 20 bp, human
ggccagagaagggcggcctg

SEQ ID NO: 385721 - DNA, 20 bp, human
gggccgatgcgcacgcgtcc

SEQ ID NO: 385722 - DNA, 20 bp, human
ggcacagggtcggtccctcc

SEQ ID NO: 385723 - DNA, 20 bp, human
gtggaggagtcggggtccaa

SEQ ID NO: 385724 - DNA, 20 bp, human
ggtgcgcatcggccgagcgc

SEQ ID NO: 385725 - DNA, 20 bp, human
ggcgcctgcggtcagcaccg

SEQ ID NO: 385726 - DNA, 20 bp, human
gtatccggcgcgacccacga

SEQ ID NO: 385727 - DNA, 20 bp, human
gccggcgcgacccacgaagg

SEQ ID NO: 385728 - DNA, 20 bp, human
gaggggccactgactcagag

SEQ ID NO: 385729 - DNA, 20 bp, human
ggcgggcggggcggctggta

SEQ ID NO: 385730 - DNA, 20 bp, human
gggctggtacggccgatcat

SEQ ID NO: 385731 - DNA, 20 bp, human
gaggccgggctaggcccgta

SEQ ID NO: 385732 - DNA, 20 bp, human
gtgcagaaactgcccatgat

SEQ ID NO: 385733 - DNA, 20 bp, human
ggtccgagagcgcccaccgg

SEQ ID NO: 385734 - DNA, 20 bp, human
gaaggtggagacgtcatttc

SEQ ID NO: 385735 - DNA, 20 bp, human
gagagcgcccaccggcgggc

SEQ ID NO: 385736 - DNA, 20 bp, human
ggaggcgggtggaatttagg

SEQ ID NO: 385737 - DNA, 20 bp, human
ggacgccctcggcctcctgg

SEQ ID NO: 385738 - DNA, 20 bp, human
gtaagagtgcactgccctta

SEQ ID NO: 385739 - DNA, 20 bp, human
gagcgcaagtttcgtgagaa

SEQ ID NO: 385740 - DNA, 20 bp, human
gttaacagaggagcaggcgg

SEQ ID NO: 385741 - DNA, 20 bp, human
gaaaacttactacgctgctg

SEQ ID NO: 385742 - DNA, 20 bp, human
gttgtgctcgctccgccagg

SEQ ID NO: 385743 - DNA, 20 bp, human
gagggcagatctcacgagag

SEQ ID NO: 385744 - DNA, 20 bp, human
ggcggaggcgggtggaattt

SEQ ID NO: 385745 - DNA, 20 bp, human
gtcctctcgcggtaatttca

SEQ ID NO: 385746 - DNA, 20 bp, human
ggcgcctgcgcgcacttcta

SEQ ID NO: 385747 - DNA, 20 bp, human
gggagccaatcgctgggcgg

SEQ ID NO: 385748 - DNA, 20 bp, human
gtaaaggagaggggttgagc

SEQ ID NO: 385749 - DNA, 20 bp, human
ggagaggggttgagccggtc

SEQ ID NO: 385750 - DNA, 20 bp, human
gcaagcgcccgtgacaaaca

SEQ ID NO: 385751 - DNA, 20 bp, human
gcggcaggtgactgcgcctg

SEQ ID NO: 385752 - DNA, 20 bp, human
gaagccctagaagtgcgcgc

SEQ ID NO: 385753 - DNA, 20 bp, human
gccgccgccatgtttgtcac

SEQ ID NO: 385754 - DNA, 20 bp, human
gtccgcccccgcccagcgat

SEQ ID NO: 385755 - DNA, 20 bp, human
gtcgtggaggtaaaggagag

SEQ ID NO: 385756 - DNA, 20 bp, human
gccagcgctgccaatggcga

SEQ ID NO: 385757 - DNA, 20 bp, human
gccattggcagcgctgggaa

SEQ ID NO: 385758 - DNA, 20 bp, human
gcccgtgaagaggcctgagt

SEQ ID NO: 385759 - DNA, 20 bp, human
ggggcgacttctggcttctt

SEQ ID NO: 385760 - DNA, 20 bp, human
ggctcctcgcgtgctcgcgg

SEQ ID NO: 385761 - DNA, 20 bp, human
gacaaggtcgtctgccgccc

SEQ ID NO: 385762 - DNA, 20 bp, human
gcgctgggaagggaagacac

SEQ ID NO: 385763 - DNA, 20 bp, human
gtctgcctctcccggggcgg

SEQ ID NO: 385764 - DNA, 20 bp, human
gggggaggaagtgcaacaca

SEQ ID NO: 385765 - DNA, 20 bp, human
gagctcccgcgggcgacttc

SEQ ID NO: 385766 - DNA, 20 bp, human
gggctcccggggtaggtccg

SEQ ID NO: 385767 - DNA, 20 bp, human
gggtcactgggacatgaact

SEQ ID NO: 385768 - DNA, 20 bp, human
ggtctccgagaccagcctcg

SEQ ID NO: 385769 - DNA, 20 bp, human
gggcgcgggtatggagcttg

SEQ ID NO: 385770 - DNA, 20 bp, human
ggcagccgcggacctacccc

SEQ ID NO: 385771 - DNA, 20 bp, human
gggacatgaactcggccccg

SEQ ID NO: 385772 - DNA, 20 bp, human
gtgctgctgcgtccgacccc

SEQ ID NO: 385773 - DNA, 20 bp, human
gagacagagcaggaagcggc

SEQ ID NO: 385774 - DNA, 20 bp, human
gggcaagaggagagcttgat

SEQ ID NO: 385775 - DNA, 20 bp, human
ggagcagaagacaggaaccg

SEQ ID NO: 385776 - DNA, 20 bp, human
gtcctccaggggcgagcaaa

SEQ ID NO: 385777 - DNA, 20 bp, human
ggtcctagctcatgttttgg

SEQ ID NO: 385778 - DNA, 20 bp, human
gaaagggaatatgaatctgc

SEQ ID NO: 385779 - DNA, 20 bp, human
ggctgggctggagttcctcc

SEQ ID NO: 385780 - DNA, 20 bp, human
ggactatagagagaagtatc

SEQ ID NO: 385781 - DNA, 20 bp, human
ggaatatgaatctgccggtg

SEQ ID NO: 385782 - DNA, 20 bp, human
gcttctcgctcacgccccac

SEQ ID NO: 385783 - DNA, 20 bp, human
ggctgtcctagctcatgttt

SEQ ID NO: 385784 - DNA, 20 bp, human
gtattttaagatagtgattg

SEQ ID NO: 385785 - DNA, 20 bp, human
gtgttcagacacaagatttg

SEQ ID NO: 385786 - DNA, 20 bp, human
gcggcacccgcgaatcaagc

SEQ ID NO: 385787 - DNA, 20 bp, human
gggagagagagctgttgtac

SEQ ID NO: 385788 - DNA, 20 bp, human
gagagagctgttgtactggg

SEQ ID NO: 385789 - DNA, 20 bp, human
ggtacctcgtgtgagatgaa

SEQ ID NO: 385790 - DNA, 20 bp, human
gcggacccagcttgattcgc

SEQ ID NO: 385791 - DNA, 20 bp, human
ggcaaggatacgtcatcatc

SEQ ID NO: 385792 - DNA, 20 bp, human
ggctgggtccgggttccagg

SEQ ID NO: 385793 - DNA, 20 bp, human
gcaacagctctctctccacc

SEQ ID NO: 385794 - DNA, 20 bp, human
gtctctctccacctggaacc

SEQ ID NO: 385795 - DNA, 20 bp, human
gggacctggagtgtggacag

SEQ ID NO: 385796 - DNA, 20 bp, human
gcggcacccgcgaatcaagc

SEQ ID NO: 385797 - DNA, 20 bp, human
gggagagagagctgttgtac

SEQ ID NO: 385798 - DNA, 20 bp, human
gagagagctgttgtactggg

SEQ ID NO: 385799 - DNA, 20 bp, human
ggtacctcgtgtgagatgaa

SEQ ID NO: 385800 - DNA, 20 bp, human
gctcgcgagaacataggtcc

SEQ ID NO: 385801 - DNA, 20 bp, human
gcggacccagcttgattcgc

SEQ ID NO: 385802 - DNA, 20 bp, human
ggcaaggatacgtcatcatc

SEQ ID NO: 385803 - DNA, 20 bp, human
ggctgggtccgggttccagg

SEQ ID NO: 385804 - DNA, 20 bp, human
gcaacagctctctctccacc

SEQ ID NO: 385805 - DNA, 20 bp, human
gtctctctccacctggaacc

SEQ ID NO: 385806 - DNA, 20 bp, human
gtgccacccagcaaacaacc

SEQ ID NO: 385807 - DNA, 20 bp, human
ggacacgtgggagaggtctg

SEQ ID NO: 385808 - DNA, 20 bp, human
ggccacctggtggggacacg

SEQ ID NO: 385809 - DNA, 20 bp, human
gctgcctggccgtctggcat

SEQ ID NO: 385810 - DNA, 20 bp, human
gaggcggccagcaggttcct

SEQ ID NO: 385811 - DNA, 20 bp, human
ggtctggcataggcaggtga

SEQ ID NO: 385812 - DNA, 20 bp, human
gggctgacaccctatcctcc

SEQ ID NO: 385813 - DNA, 20 bp, human
gcgtgggagaggtctgcggc

SEQ ID NO: 385814 - DNA, 20 bp, human
gctcccggttgtttgctggg

SEQ ID NO: 385815 - DNA, 20 bp, human
gcactggggacgtgaggcac

SEQ ID NO: 385816 - DNA, 20 bp, human
ggtggcacgtggacagatgt

SEQ ID NO: 385817 - DNA, 20 bp, human
gcggacagggagattggtcc

SEQ ID NO: 385818 - DNA, 20 bp, human
gggtccaggctcacacccgc

SEQ ID NO: 385819 - DNA, 20 bp, human
ggggtcccaaaatccgggca

SEQ ID NO: 385820 - DNA, 20 bp, human
ggggctgcgtcactcgtgaa

SEQ ID NO: 385821 - DNA, 20 bp, human
gagctgtacccaggcaggta

SEQ ID NO: 385822 - DNA, 20 bp, human
gttcccccctgcccggattt

SEQ ID NO: 385823 - DNA, 20 bp, human
ggatgtgggtcccaaaatcc

SEQ ID NO: 385824 - DNA, 20 bp, human
gcccacgcacgcctgctacc

SEQ ID NO: 385825 - DNA, 20 bp, human
gcgcacgcacgagctcctgt

SEQ ID NO: 385826 - DNA, 20 bp, human
gccaaccgcgagagctttct

SEQ ID NO: 385827 - DNA, 20 bp, human
gcgcgccccaacccgcgggg

SEQ ID NO: 385828 - DNA, 20 bp, human
ggcagcccagaaagctctcg

SEQ ID NO: 385829 - DNA, 20 bp, human
gcccgccgccccgcgggttg

SEQ ID NO: 385830 - DNA, 20 bp, human
ggtgagtggcaagagaaccc

SEQ ID NO: 385831 - DNA, 20 bp, human
gtgaagcaccagcgagggtc

SEQ ID NO: 385832 - DNA, 20 bp, human
gcgggtcgcgccccaacccg

SEQ ID NO: 385833 - DNA, 20 bp, human
gcactgcctgggccttaaag

SEQ ID NO: 385834 - DNA, 20 bp, human
gagaagtgaagcaccagcga

SEQ ID NO: 385835 - DNA, 20 bp, human
gtcgtagctggttttgtgag

SEQ ID NO: 385836 - DNA, 20 bp, human
ggggctgcaggattgcgtac

SEQ ID NO: 385837 - DNA, 20 bp, human
gggcgcaaagtgagtcggat

SEQ ID NO: 385838 - DNA, 20 bp, human
gcagagggcgcaaagtgagt

SEQ ID NO: 385839 - DNA, 20 bp, human
gagagcaggtgcgtggaagt

SEQ ID NO: 385840 - DNA, 20 bp, human
gggatggggcgggcccagtt

SEQ ID NO: 385841 - DNA, 20 bp, human
gtctgattggtcagctgtgg

SEQ ID NO: 385842 - DNA, 20 bp, human
gtcactttgcgccctctgat

SEQ ID NO: 385843 - DNA, 20 bp, human
gaaagtgagtcggatggggc

SEQ ID NO: 385844 - DNA, 20 bp, human
gcgggctattgcaaggattc

SEQ ID NO: 385845 - DNA, 20 bp, human
gtgggtggaattgccgcaga

SEQ ID NO: 385846 - DNA, 20 bp, human
gtgagcagggccccgaggaa

SEQ ID NO: 385847 - DNA, 20 bp, human
gcgcgtgcggacacaaggat

SEQ ID NO: 385848 - DNA, 20 bp, human
gcgcccagagcgctcctcgc

SEQ ID NO: 385849 - DNA, 20 bp, human
ggaccggcggaggagatggc

SEQ ID NO: 385850 - DNA, 20 bp, human
gcgcatgcgcggccctcgta

SEQ ID NO: 385851 - DNA, 20 bp, human
gcagagcgctcctcgctggg

SEQ ID NO: 385852 - DNA, 20 bp, human
gtacggaagcccggaaggag

SEQ ID NO: 385853 - DNA, 20 bp, human
gtgtgtccgcacgcgaccgg

SEQ ID NO: 385854 - DNA, 20 bp, human
gaggggaaggcggttggcac

SEQ ID NO: 385855 - DNA, 20 bp, human
gcgccgcccgggagtctggc

SEQ ID NO: 385856 - DNA, 20 bp, human
gcgcggggaggcgaggatcc

SEQ ID NO: 385857 - DNA, 20 bp, human
gcgaggatcccggcagagat

SEQ ID NO: 385858 - DNA, 20 bp, human
gatcccggcagagatgggta

SEQ ID NO: 385859 - DNA, 20 bp, human
ggcttcccgggaacccgccc

SEQ ID NO: 385860 - DNA, 20 bp, human
gtagccccgggcgggttccc

SEQ ID NO: 385861 - DNA, 20 bp, human
gactccgggaacatggaggc

SEQ ID NO: 385862 - DNA, 20 bp, human
ggggcccgccccggccggca

SEQ ID NO: 385863 - DNA, 20 bp, human
ggggtgctggagcctcaccg

SEQ ID NO: 385864 - DNA, 20 bp, human
gaccccgcgcgcgcgagcag

SEQ ID NO: 385865 - DNA, 20 bp, human
gaatgcgtgtggggcccgaa

SEQ ID NO: 385866 - DNA, 20 bp, human
gcgcagggcacgtcgggaag

SEQ ID NO: 385867 - DNA, 20 bp, human
gaactcggcccggaacttcc

SEQ ID NO: 385868 - DNA, 20 bp, human
ggggcacgtcgggaagagga

SEQ ID NO: 385869 - DNA, 20 bp, human
ggctgagtcgcagggcacgt

SEQ ID NO: 385870 - DNA, 20 bp, human
ggtaaggtgcggctagaaac

SEQ ID NO: 385871 - DNA, 20 bp, human
gagttgcggtccaggaatcg

SEQ ID NO: 385872 - DNA, 20 bp, human
gctcccaggcgttatgggaa

SEQ ID NO: 385873 - DNA, 20 bp, human
gcggccgaacccggaagttc

SEQ ID NO: 385874 - DNA, 20 bp, human
gcgtggctgccgctactccc

SEQ ID NO: 385875 - DNA, 20 bp, human
gggcccggaacttccgggtt

SEQ ID NO: 385876 - DNA, 20 bp, human
gcccttgggaacggtctctc

SEQ ID NO: 385877 - DNA, 20 bp, human
gtgcgccaccggcccgactg

SEQ ID NO: 385878 - DNA, 20 bp, human
gtgccgagaggcccgcagtc

SEQ ID NO: 385879 - DNA, 20 bp, human
gaggcggtggcgcccgaggg

SEQ ID NO: 385880 - DNA, 20 bp, human
gaggcccgcagtcgggccgg

SEQ ID NO: 385881 - DNA, 20 bp, human
gcctcccgcggtcgcccgcc

SEQ ID NO: 385882 - DNA, 20 bp, human
gggccgcccccactgccgag

SEQ ID NO: 385883 - DNA, 20 bp, human
gcgcccggctcgtgcgccac

SEQ ID NO: 385884 - DNA, 20 bp, human
ggagaggcccgcagtcgggc

SEQ ID NO: 385885 - DNA, 20 bp, human
gggactcgaagcctgggaag

SEQ ID NO: 385886 - DNA, 20 bp, human
gctccggcgcgagccccgat

SEQ ID NO: 385887 - DNA, 20 bp, human
gcggagccgcgcaggccaat

SEQ ID NO: 385888 - DNA, 20 bp, human
gcagctgggcgcggaagctt

SEQ ID NO: 385889 - DNA, 20 bp, human
gtcgccgcccagctaggctt

SEQ ID NO: 385890 - DNA, 20 bp, human
ggcagccaaccgccgcgagc

SEQ ID NO: 385891 - DNA, 20 bp, human
gcgcgccgcgagctcccagt

SEQ ID NO: 385892 - DNA, 20 bp, human
gccgcgagctcccagtgggc

SEQ ID NO: 385893 - DNA, 20 bp, human
ggacgcagctggacgcagct

SEQ ID NO: 385894 - DNA, 20 bp, human
gcccggcgctgggcggtcat

SEQ ID NO: 385895 - DNA, 20 bp, human
gtcagccccggcagggctcc

SEQ ID NO: 385896 - DNA, 20 bp, human
gctccggcgcgagccccgat

SEQ ID NO: 385897 - DNA, 20 bp, human
gcggagccgcgcaggccaat

SEQ ID NO: 385898 - DNA, 20 bp, human
gcagctgggcgcggaagctt

SEQ ID NO: 385899 - DNA, 20 bp, human
gtcgccgcccagctaggctt

SEQ ID NO: 385900 - DNA, 20 bp, human
ggcagccaaccgccgcgagc

SEQ ID NO: 385901 - DNA, 20 bp, human
gcgcgccgcgagctcccagt

SEQ ID NO: 385902 - DNA, 20 bp, human
gccgcgagctcccagtgggc

SEQ ID NO: 385903 - DNA, 20 bp, human
ggacgcagctggacgcagct

SEQ ID NO: 385904 - DNA, 20 bp, human
gcccggcgctgggcggtcat

SEQ ID NO: 385905 - DNA, 20 bp, human
gtcagccccggcagggctcc

SEQ ID NO: 385906 - DNA, 20 bp, human
gtaggccagcggctgcaaag

SEQ ID NO: 385907 - DNA, 20 bp, human
ggcaacccggcggacggtga

SEQ ID NO: 385908 - DNA, 20 bp, human
gctagcgcctcgcccgctgt

SEQ ID NO: 385909 - DNA, 20 bp, human
ggggttgcgctctgcttttg

SEQ ID NO: 385910 - DNA, 20 bp, human
gtcgcctagctcacgtgggc

SEQ ID NO: 385911 - DNA, 20 bp, human
gccggctggacctgacccta

SEQ ID NO: 385912 - DNA, 20 bp, human
gcctcacgccggagcccacg

SEQ ID NO: 385913 - DNA, 20 bp, human
gcgggcgaggcgctagaggc

SEQ ID NO: 385914 - DNA, 20 bp, human
gaggcgcgggctttgctcct

SEQ ID NO: 385915 - DNA, 20 bp, human
gccggcgtgaggcgctgaag

SEQ ID NO: 385916 - DNA, 20 bp, human
gtcacccggggcgccctgag

SEQ ID NO: 385917 - DNA, 20 bp, human
ggtgtgctacggacgtggaa

SEQ ID NO: 385918 - DNA, 20 bp, human
gcaggggtgtgctacggacg

SEQ ID NO: 385919 - DNA, 20 bp, human
gcctggccatgcctggtcta

SEQ ID NO: 385920 - DNA, 20 bp, human
gccctgaggggtggggaact

SEQ ID NO: 385921 - DNA, 20 bp, human
ggggagtcaggggtgtgcta

SEQ ID NO: 385922 - DNA, 20 bp, human
gccggggcgccctgaggggt

SEQ ID NO: 385923 - DNA, 20 bp, human
gctagggtgttgattcttta

SEQ ID NO: 385924 - DNA, 20 bp, human
ggggactttccctaacaatg

SEQ ID NO: 385925 - DNA, 20 bp, human
gcgggcggggccggttgctg

SEQ ID NO: 385926 - DNA, 20 bp, human
gaaacccactacacactaaa

SEQ ID NO: 385927 - DNA, 20 bp, human
gaatgtgcttgggtattatg

SEQ ID NO: 385928 - DNA, 20 bp, human
gtcccaggagaaggataatt

SEQ ID NO: 385929 - DNA, 20 bp, human
ggaaccatttagtgtgtagt

SEQ ID NO: 385930 - DNA, 20 bp, human
ggacccaattatccttctcc

SEQ ID NO: 385931 - DNA, 20 bp, human
gactaaatggttcgctgaag

SEQ ID NO: 385932 - DNA, 20 bp, human
gtagacatcatcatagctct

SEQ ID NO: 385933 - DNA, 20 bp, human
gttacagtagccacaaaaaa

SEQ ID NO: 385934 - DNA, 20 bp, human
gtaatgattaaaatgtgctt

SEQ ID NO: 385935 - DNA, 20 bp, human
gggataaatttcccaggaga

SEQ ID NO: 385936 - DNA, 20 bp, human
ggagcgccacaaggagtact

SEQ ID NO: 385937 - DNA, 20 bp, human
ggcggtgccgacctctccgc

SEQ ID NO: 385938 - DNA, 20 bp, human
ggtaggaccggcggagaggt

SEQ ID NO: 385939 - DNA, 20 bp, human
ggcagcgcagcctctgcaag

SEQ ID NO: 385940 - DNA, 20 bp, human
gccacccagcggacccaggt

SEQ ID NO: 385941 - DNA, 20 bp, human
gtcccccacctgggtccgct

SEQ ID NO: 385942 - DNA, 20 bp, human
ggtggatcacccgttcccaa

SEQ ID NO: 385943 - DNA, 20 bp, human
gattgaggactgggaagtcc

SEQ ID NO: 385944 - DNA, 20 bp, human
ggaacgggtgatccacccag

SEQ ID NO: 385945 - DNA, 20 bp, human
gcctggccgagtcccccacc

SEQ ID NO: 385946 - DNA, 20 bp, human
gtgaaccacctcggttcctg

SEQ ID NO: 385947 - DNA, 20 bp, human
gcccagaagacctggactgt

SEQ ID NO: 385948 - DNA, 20 bp, human
ggaagccccaggaaccgagg

SEQ ID NO: 385949 - DNA, 20 bp, human
gtgggtaagagcgcaccgag

SEQ ID NO: 385950 - DNA, 20 bp, human
gagacctggactgtgggcgg

SEQ ID NO: 385951 - DNA, 20 bp, human
gtgtgccggcccagaagacc

SEQ ID NO: 385952 - DNA, 20 bp, human
gtagccaccgcccacagtcc

SEQ ID NO: 385953 - DNA, 20 bp, human
gtccgattggctgagatggt

SEQ ID NO: 385954 - DNA, 20 bp, human
gagagcgcaccgaggggctg

SEQ ID NO: 385955 - DNA, 20 bp, human
gccgcccccttagctccgat

SEQ ID NO: 385956 - DNA, 20 bp, human
ggctaaggggcgggactcat

SEQ ID NO: 385957 - DNA, 20 bp, human
gcgagcacccagccctccaa

SEQ ID NO: 385958 - DNA, 20 bp, human
ggacggaagcatgttgttag

SEQ ID NO: 385959 - DNA, 20 bp, human
gggactcatagggcccttgg

SEQ ID NO: 385960 - DNA, 20 bp, human
gcttcctgtcgccactgcta

SEQ ID NO: 385961 - DNA, 20 bp, human
gctctctcttcagttgctaa

SEQ ID NO: 385962 - DNA, 20 bp, human
gccctatcaaccaatgggat

SEQ ID NO: 385963 - DNA, 20 bp, human
gtcaccctagcagtggcgac

SEQ ID NO: 385964 - DNA, 20 bp, human
ggaaataccgagtttggtca

SEQ ID NO: 385965 - DNA, 20 bp, human
gggcgggtttcgtagaggat

SEQ ID NO: 385966 - DNA, 20 bp, human
gaggagcggaagtggcgcgg

SEQ ID NO: 385967 - DNA, 20 bp, human
gccggggcggagggagagtt

SEQ ID NO: 385968 - DNA, 20 bp, human
gacggccgggcggtccccag

SEQ ID NO: 385969 - DNA, 20 bp, human
gtgaggcccgaacgcgggaa

SEQ ID NO: 385970 - DNA, 20 bp, human
gcagcggagccggtccccta

SEQ ID NO: 385971 - DNA, 20 bp, human
ggacgccccgcgtgcgctgg

SEQ ID NO: 385972 - DNA, 20 bp, human
gagcgcacgcggggcgtcca

SEQ ID NO: 385973 - DNA, 20 bp, human
gaggccggaggagctttcgg

SEQ ID NO: 385974 - DNA, 20 bp, human
ggggctcagagaaggcggag

SEQ ID NO: 385975 - DNA, 20 bp, human
gccgccgtgccccgaggccg

SEQ ID NO: 385976 - DNA, 20 bp, human
gacaggggagttccttggtg

SEQ ID NO: 385977 - DNA, 20 bp, human
gagaaagacggaaaccccag

SEQ ID NO: 385978 - DNA, 20 bp, human
gaatgtcactaggactctca

SEQ ID NO: 385979 - DNA, 20 bp, human
gccaaggaactcccctgtct

SEQ ID NO: 385980 - DNA, 20 bp, human
gaggggaaagcaagggtctg

SEQ ID NO: 385981 - DNA, 20 bp, human
ggggcgaagaagcagttgat

SEQ ID NO: 385982 - DNA, 20 bp, human
gggaaggtgacaggctgtga

SEQ ID NO: 385983 - DNA, 20 bp, human
gtgtcaccttccgtgtcgta

SEQ ID NO: 385984 - DNA, 20 bp, human
gaggaacaaaatcaccgtgg

SEQ ID NO: 385985 - DNA, 20 bp, human
ggagaggaacaaaatcaccg

SEQ ID NO: 385986 - DNA, 20 bp, human
ggggctctcgctaccggaga

SEQ ID NO: 385987 - DNA, 20 bp, human
gaggggcaaactgcactcag

SEQ ID NO: 385988 - DNA, 20 bp, human
gtccctctcccgcactgagg

SEQ ID NO: 385989 - DNA, 20 bp, human
gccctcctcagtgcgggaga

SEQ ID NO: 385990 - DNA, 20 bp, human
ggcccccggggtggggtctc

SEQ ID NO: 385991 - DNA, 20 bp, human
ggtccgacgtgtcactgcaa

SEQ ID NO: 385992 - DNA, 20 bp, human
gggagctagtaggatctctg

SEQ ID NO: 385993 - DNA, 20 bp, human
ggtgcgccctgagtgacgtc

SEQ ID NO: 385994 - DNA, 20 bp, human
ggagaagggggaggttaaag

SEQ ID NO: 385995 - DNA, 20 bp, human
gactgaggagggggcacttc

SEQ ID NO: 385996 - DNA, 20 bp, human
gaaccgcccggccgcgggtc

SEQ ID NO: 385997 - DNA, 20 bp, human
gcgggcggaagtccgggttg

SEQ ID NO: 385998 - DNA, 20 bp, human
gctccggggtgggaccaggc

SEQ ID NO: 385999 - DNA, 20 bp, human
gtctgtgtcagcagccgggc

SEQ ID NO: 386000 - DNA, 20 bp, human
ggcgcggcgggcggaagtcc

SEQ ID NO: 386001 - DNA, 20 bp, human
gaggggccgccgggctgtac

SEQ ID NO: 386002 - DNA, 20 bp, human
gtctagccggctctccggtc

SEQ ID NO: 386003 - DNA, 20 bp, human
gcggaagttgctctgagctc

SEQ ID NO: 386004 - DNA, 20 bp, human
gcggtcaggtgaccccaacc

SEQ ID NO: 386005 - DNA, 20 bp, human
gacagagcccgacccgcggc

SEQ ID NO: 386006 - DNA, 20 bp, human
gcccctccgggagaaagagg

SEQ ID NO: 386007 - DNA, 20 bp, human
ggggccgggaactgtggatt

SEQ ID NO: 386008 - DNA, 20 bp, human
gcggcggcgcggggcagagt

SEQ ID NO: 386009 - DNA, 20 bp, human
gagaaagaggaggagaatcg

SEQ ID NO: 386010 - DNA, 20 bp, human
gggaagtgcgcgtcactctc

SEQ ID NO: 386011 - DNA, 20 bp, human
ggtccccgcgacaacagggg

SEQ ID NO: 386012 - DNA, 20 bp, human
gcccgagcgcactgccggcg

SEQ ID NO: 386013 - DNA, 20 bp, human
gtccccgcgagctgcgaaag

SEQ ID NO: 386014 - DNA, 20 bp, human
gccgagccgggctgcttgtc

SEQ ID NO: 386015 - DNA, 20 bp, human
gaggagcctgccatcagagg

SEQ ID NO: 386016 - DNA, 20 bp, human
gccgccgccccaaaacctgt

SEQ ID NO: 386017 - DNA, 20 bp, human
gggccggggcggacttccag

SEQ ID NO: 386018 - DNA, 20 bp, human
gtgaggagaaagcgtccgag

SEQ ID NO: 386019 - DNA, 20 bp, human
gtccgaggggcgtggagcca

SEQ ID NO: 386020 - DNA, 20 bp, human
gcaaagatgggttttgtctg

SEQ ID NO: 386021 - DNA, 20 bp, human
gcgcccgcgcagcccgccag

SEQ ID NO: 386022 - DNA, 20 bp, human
gagaggcgggccccacgggt

SEQ ID NO: 386023 - DNA, 20 bp, human
gcctcctggaggacgcagac

SEQ ID NO: 386024 - DNA, 20 bp, human
gtggcacggtccggggtcgc

SEQ ID NO: 386025 - DNA, 20 bp, human
gttgtggccgggacgcggat

SEQ ID NO: 386026 - DNA, 20 bp, human
gaggcggcagctcaggtcaa

SEQ ID NO: 386027 - DNA, 20 bp, human
gtagctgaaaggaccggacg

SEQ ID NO: 386028 - DNA, 20 bp, human
gtgtgcgcgcctggtgactc

SEQ ID NO: 386029 - DNA, 20 bp, human
gcgaaagcagcgcccgggga

SEQ ID NO: 386030 - DNA, 20 bp, human
gtcccagagcccctcatccc

SEQ ID NO: 386031 - DNA, 20 bp, human
gaggtcaaaggatcgcaggt

SEQ ID NO: 386032 - DNA, 20 bp, human
gcgggctggcccttggcgtc

SEQ ID NO: 386033 - DNA, 20 bp, human
ggatggcagaactcgggcca

SEQ ID NO: 386034 - DNA, 20 bp, human
ggctcaggtcaaaggatcgc

SEQ ID NO: 386035 - DNA, 20 bp, human
gtaggaaggggtcgcctttg

SEQ ID NO: 386036 - DNA, 20 bp, human
gcgggaggagggggcgtcac

SEQ ID NO: 386037 - DNA, 20 bp, human
ggtccgcaggggtcgctcgc

SEQ ID NO: 386038 - DNA, 20 bp, human
ggcccggcgagcgacccctg

SEQ ID NO: 386039 - DNA, 20 bp, human
gggtatgtaaagcacagtag

SEQ ID NO: 386040 - DNA, 20 bp, human
gcgggcctcccaggtccgca

SEQ ID NO: 386041 - DNA, 20 bp, human
gtcccccagcggtcgtgctg

SEQ ID NO: 386042 - DNA, 20 bp, human
gtggacttgatggaaatctt

SEQ ID NO: 386043 - DNA, 20 bp, human
gcccgggcaaggctgttccc

SEQ ID NO: 386044 - DNA, 20 bp, human
gggccccagcacgaccgctg

SEQ ID NO: 386045 - DNA, 20 bp, human
gcaccgtagcaaatggggcg

SEQ ID NO: 386046 - DNA, 20 bp, human
gaggccgccggtggcgatca

SEQ ID NO: 386047 - DNA, 20 bp, human
gtgagcagctagtgggcagt

SEQ ID NO: 386048 - DNA, 20 bp, human
gagctcgccatgatcgccac

SEQ ID NO: 386049 - DNA, 20 bp, human
ggtgcaagcctccatcccag

SEQ ID NO: 386050 - DNA, 20 bp, human
ggaaacaaggccgtgtacag

SEQ ID NO: 386051 - DNA, 20 bp, human
ggcaggactagcctctggga

SEQ ID NO: 386052 - DNA, 20 bp, human
gggagtgcaggactagcctc

SEQ ID NO: 386053 - DNA, 20 bp, human
gggcgatcatggcgagctcc

SEQ ID NO: 386054 - DNA, 20 bp, human
gtcttcctctgctttgcagc

SEQ ID NO: 386055 - DNA, 20 bp, human
gttagtggataaaggccctg

SEQ ID NO: 386056 - DNA, 20 bp, human
ggcgcagccaatcgggacga

SEQ ID NO: 386057 - DNA, 20 bp, human
gaaggcggggctttcctaca

SEQ ID NO: 386058 - DNA, 20 bp, human
gcgggagcgcgccgagtcag

SEQ ID NO: 386059 - DNA, 20 bp, human
gtcccgtcgcgcagccaatc

SEQ ID NO: 386060 - DNA, 20 bp, human
ggcccgctacaaagcggcga

SEQ ID NO: 386061 - DNA, 20 bp, human
ggcccgcgcccgctacaaag

SEQ ID NO: 386062 - DNA, 20 bp, human
gacgaggggtgagcccgggt

SEQ ID NO: 386063 - DNA, 20 bp, human
gtacaaagcggcgaaggtca

SEQ ID NO: 386064 - DNA, 20 bp, human
ggtcccgattggctgcgcga

SEQ ID NO: 386065 - DNA, 20 bp, human
gagcgcgccgagtcaggggg

SEQ ID NO: 386066 - DNA, 20 bp, human
gggagtaggtggagaatgga

SEQ ID NO: 386067 - DNA, 20 bp, human
gagaaacaggatctatgcca

SEQ ID NO: 386068 - DNA, 20 bp, human
ggttgggagtaggtggagaa

SEQ ID NO: 386069 - DNA, 20 bp, human
gtaaaagagttgggagtagg

SEQ ID NO: 386070 - DNA, 20 bp, human
gtgcatctcctcacacatgc

SEQ ID NO: 386071 - DNA, 20 bp, human
gggggaactcatatgcttgt

SEQ ID NO: 386072 - DNA, 20 bp, human
ggcttctgccagcatgtgtg

SEQ ID NO: 386073 - DNA, 20 bp, human
gcctcatagcaaataaaaaa

SEQ ID NO: 386074 - DNA, 20 bp, human
gacaaacattttgttagcag

SEQ ID NO: 386075 - DNA, 20 bp, human
gctgttttatatttttgatc

SEQ ID NO: 386076 - DNA, 20 bp, human
gaggatgtgtcggagagact

SEQ ID NO: 386077 - DNA, 20 bp, human
ggactcctacccggtggtga

SEQ ID NO: 386078 - DNA, 20 bp, human
gatcctgagccgtgcctgtc

SEQ ID NO: 386079 - DNA, 20 bp, human
gcgagccctcaccaccgggt

SEQ ID NO: 386080 - DNA, 20 bp, human
gcggagcggtccctgcaacc

SEQ ID NO: 386081 - DNA, 20 bp, human
ggaagctgcgggctcggcat

SEQ ID NO: 386082 - DNA, 20 bp, human
gttcggcagccagacaggca

SEQ ID NO: 386083 - DNA, 20 bp, human
gagccagacaggcacggctc

SEQ ID NO: 386084 - DNA, 20 bp, human
ggcggtccctgcaacccggc

SEQ ID NO: 386085 - DNA, 20 bp, human
ggccctggactcctacccgg

SEQ ID NO: 386086 - DNA, 20 bp, human
ggcggcagccagacaccaac

SEQ ID NO: 386087 - DNA, 20 bp, human
ggtcccgcacccggcatccc

SEQ ID NO: 386088 - DNA, 20 bp, human
gacaaatagcggccctgccg

SEQ ID NO: 386089 - DNA, 20 bp, human
ggggcaggcctggaacacac

SEQ ID NO: 386090 - DNA, 20 bp, human
ggcagggccgctatttgttg

SEQ ID NO: 386091 - DNA, 20 bp, human
gggtcctgggggcaactgga

SEQ ID NO: 386092 - DNA, 20 bp, human
gagagacccgtgtgcctgga

SEQ ID NO: 386093 - DNA, 20 bp, human
gaaagcaacaggcgagacga

SEQ ID NO: 386094 - DNA, 20 bp, human
ggggaggcttgtggttccta

SEQ ID NO: 386095 - DNA, 20 bp, human
gaatgctgccctcaaaaggg

SEQ ID NO: 386096 - DNA, 20 bp, human
gaagcgcagctgaagcgtga

SEQ ID NO: 386097 - DNA, 20 bp, human
gtggataaaagcccgtggag

SEQ ID NO: 386098 - DNA, 20 bp, human
gaaggcgccaatgaggcctt

SEQ ID NO: 386099 - DNA, 20 bp, human
ggggaggcgggacgaattat

SEQ ID NO: 386100 - DNA, 20 bp, human
gccttcggctactccggcag

SEQ ID NO: 386101 - DNA, 20 bp, human
gaggggcggaactaaaatgc

SEQ ID NO: 386102 - DNA, 20 bp, human
ggagtagccgaaggcctcat

SEQ ID NO: 386103 - DNA, 20 bp, human
gaagcgtgaaggcgccaatg

SEQ ID NO: 386104 - DNA, 20 bp, human
gttagtagccgcggcgtaat

SEQ ID NO: 386105 - DNA, 20 bp, human
gcagctgcgcttagtagccg

SEQ ID NO: 386106 - DNA, 20 bp, human
ggggtgagagctggtgtgag

SEQ ID NO: 386107 - DNA, 20 bp, human
ggagtcgcgaaagtgttgat

SEQ ID NO: 386108 - DNA, 20 bp, human
ggaggcctgcatgtgaccct

SEQ ID NO: 386109 - DNA, 20 bp, human
gacgcagaggcacgcgtcta

SEQ ID NO: 386110 - DNA, 20 bp, human
gccagctctcacccctgtgg

SEQ ID NO: 386111 - DNA, 20 bp, human
gaggcgaaaccggtccggag

SEQ ID NO: 386112 - DNA, 20 bp, human
gcatgcaggcctccgccaca

SEQ ID NO: 386113 - DNA, 20 bp, human
ggaaatgtagttctgggcgg

SEQ ID NO: 386114 - DNA, 20 bp, human
gccgcgaggcgaaaccggtc

SEQ ID NO: 386115 - DNA, 20 bp, human
gcggctccgcgaggcgaaac

SEQ ID NO: 386116 - DNA, 20 bp, human
gtaaagtgcatgctagggga

SEQ ID NO: 386117 - DNA, 20 bp, human
gactcgtaaagtgcatgcta

SEQ ID NO: 386118 - DNA, 20 bp, human
gtgctaggggaaggaatgtt

SEQ ID NO: 386119 - DNA, 20 bp, human
gatgttgggtacatgtttac

SEQ ID NO: 386120 - DNA, 20 bp, human
ggacagtcaacttaggatag

SEQ ID NO: 386121 - DNA, 20 bp, human
gtcaacttaggatagtggtt

SEQ ID NO: 386122 - DNA, 20 bp, human
gaacaaagagtaccaacaaa

SEQ ID NO: 386123 - DNA, 20 bp, human
gcaagtgcatgttttattcc

SEQ ID NO: 386124 - DNA, 20 bp, human
gcctaagtttgggttagacc

SEQ ID NO: 386125 - DNA, 20 bp, human
gtattaatgcatgtcctggt

SEQ ID NO: 386126 - DNA, 20 bp, human
gggaggcggcagggatgcga

SEQ ID NO: 386127 - DNA, 20 bp, human
gccaaagctcaggaccgcga

SEQ ID NO: 386128 - DNA, 20 bp, human
gaagccttgcgcagtggggg

SEQ ID NO: 386129 - DNA, 20 bp, human
gacagggcagctatcttctg

SEQ ID NO: 386130 - DNA, 20 bp, human
gctcaggcctagctctggac

SEQ ID NO: 386131 - DNA, 20 bp, human
gcccactgcgcaaggctttc

SEQ ID NO: 386132 - DNA, 20 bp, human
ggcggagtcgctgcccctgg

SEQ ID NO: 386133 - DNA, 20 bp, human
gcctccgcccccactgcgca

SEQ ID NO: 386134 - DNA, 20 bp, human
ggacccgccctcccgatccc

SEQ ID NO: 386135 - DNA, 20 bp, human
ggtgagaggaagccgccctc

SEQ ID NO: 386136 - DNA, 20 bp, human
ggaaacaggtctcggttttg

SEQ ID NO: 386137 - DNA, 20 bp, human
gaaaccgagacctgtttccc

SEQ ID NO: 386138 - DNA, 20 bp, human
gttaccagggaaacaggtct

SEQ ID NO: 386139 - DNA, 20 bp, human
gaagtagggcggctcaccgt

SEQ ID NO: 386140 - DNA, 20 bp, human
gggagcgttaccagggaaac

SEQ ID NO: 386141 - DNA, 20 bp, human
gtcttctcgcgagaaaggga

SEQ ID NO: 386142 - DNA, 20 bp, human
gggcgctcggagcgttacca

SEQ ID NO: 386143 - DNA, 20 bp, human
gcaagcggctctaaagttac

SEQ ID NO: 386144 - DNA, 20 bp, human
gagtctcttctcgcgagaaa

SEQ ID NO: 386145 - DNA, 20 bp, human
gggctcaccgtaggatagag

SEQ ID NO: 386146 - DNA, 20 bp, human
gggaatgggacaggtagggt

SEQ ID NO: 386147 - DNA, 20 bp, human
ggccaagcagctctgggaat

SEQ ID NO: 386148 - DNA, 20 bp, human
gaaggactgcccgtaagacc

SEQ ID NO: 386149 - DNA, 20 bp, human
ggcactccaggccccgatgt

SEQ ID NO: 386150 - DNA, 20 bp, human
gacagtaggactgtgaggtg

SEQ ID NO: 386151 - DNA, 20 bp, human
ggcagctctgggaatgggac

SEQ ID NO: 386152 - DNA, 20 bp, human
gggccaccgcacccacatcg

SEQ ID NO: 386153 - DNA, 20 bp, human
gtggggctggcctggtctta

SEQ ID NO: 386154 - DNA, 20 bp, human
gtgtaggtcaccttcctcca

SEQ ID NO: 386155 - DNA, 20 bp, human
gccaggccccgatgtgggtg

SEQ ID NO: 386156 - DNA, 20 bp, human
gtgagcctggagatgcaaat

SEQ ID NO: 386157 - DNA, 20 bp, human
gaaggggggctgatgatctg

SEQ ID NO: 386158 - DNA, 20 bp, human
gttgcatctccaggctcaag

SEQ ID NO: 386159 - DNA, 20 bp, human
gtggaggggcaaatgttcaa

SEQ ID NO: 386160 - DNA, 20 bp, human
gccgaggtgctccctagcca

SEQ ID NO: 386161 - DNA, 20 bp, human
gtgcccctccaccttcttca

SEQ ID NO: 386162 - DNA, 20 bp, human
gggtactaataactgtggtc

SEQ ID NO: 386163 - DNA, 20 bp, human
ggatcataacaccagatccc

SEQ ID NO: 386164 - DNA, 20 bp, human
ggtacttctagaatttgcta

SEQ ID NO: 386165 - DNA, 20 bp, human
gataactgtggtctggtagt

SEQ ID NO: 386166 - DNA, 20 bp, human
gctggcttaatcagattcaa

SEQ ID NO: 386167 - DNA, 20 bp, human
gaggcagcaatccaaagcaa

SEQ ID NO: 386168 - DNA, 20 bp, human
gtatgctggaaccactaggc

SEQ ID NO: 386169 - DNA, 20 bp, human
gctggggagtgaccacttcc

SEQ ID NO: 386170 - DNA, 20 bp, human
gcaacagttcgtatgtgtcg

SEQ ID NO: 386171 - DNA, 20 bp, human
gagtggtcactccccaggac

SEQ ID NO: 386172 - DNA, 20 bp, human
gcaaaacatgagcgtatgac

SEQ ID NO: 386173 - DNA, 20 bp, human
gtacgaactgttgatctact

SEQ ID NO: 386174 - DNA, 20 bp, human
gctcaactcaacctgcctag

SEQ ID NO: 386175 - DNA, 20 bp, human
gaatgtactcaaatagtcct

SEQ ID NO: 386176 - DNA, 20 bp, human
gacaccatggggtggagcaa

SEQ ID NO: 386177 - DNA, 20 bp, human
gagaagggaagccaaaccgt

SEQ ID NO: 386178 - DNA, 20 bp, human
gccttcctcagccaacggtt

SEQ ID NO: 386179 - DNA, 20 bp, human
gaggtgagagaaggtgtgac

SEQ ID NO: 386180 - DNA, 20 bp, human
gctcccaacttcagcatagt

SEQ ID NO: 386181 - DNA, 20 bp, human
gctacacctgcagatgggag

SEQ ID NO: 386182 - DNA, 20 bp, human
gcacccactatgctgaagtt

SEQ ID NO: 386183 - DNA, 20 bp, human
gatttgcgctcaggggagaa

SEQ ID NO: 386184 - DNA, 20 bp, human
gaacttatgctgggtgtttg

SEQ ID NO: 386185 - DNA, 20 bp, human
gggcagcaaactcatgtccc

SEQ ID NO: 386186 - DNA, 20 bp, human
gcctcccggcctcttcgcct

SEQ ID NO: 386187 - DNA, 20 bp, human
gcatcgggaagaggcttccg

SEQ ID NO: 386188 - DNA, 20 bp, human
gggcccccgcccaggcgaag

SEQ ID NO: 386189 - DNA, 20 bp, human
gcccgcccaggcgaagaggc

SEQ ID NO: 386190 - DNA, 20 bp, human
gtctcctgagcgaagagcat

SEQ ID NO: 386191 - DNA, 20 bp, human
gagcgtcgatgtgaaggcca

SEQ ID NO: 386192 - DNA, 20 bp, human
ggacttgtagtccctctcct

SEQ ID NO: 386193 - DNA, 20 bp, human
gttcccgatgctcttcgctc

SEQ ID NO: 386194 - DNA, 20 bp, human
gaggcttccgcggcagcctg

SEQ ID NO: 386195 - DNA, 20 bp, human
ggcgccggaccggaaagccg

SEQ ID NO: 386196 - DNA, 20 bp, human
ggctgcccggggtctcgtcg

SEQ ID NO: 386197 - DNA, 20 bp, human
gccgccgggtggcctccctc

SEQ ID NO: 386198 - DNA, 20 bp, human
gacggcggcggcacaaaccc

SEQ ID NO: 386199 - DNA, 20 bp, human
gcgagggggtcagccccaga

SEQ ID NO: 386200 - DNA, 20 bp, human
gcccccgcgccccgagtcga

SEQ ID NO: 386201 - DNA, 20 bp, human
gtcagcctccggaacggcgg

SEQ ID NO: 386202 - DNA, 20 bp, human
gtccgtgcccgggaagggtc

SEQ ID NO: 386203 - DNA, 20 bp, human
gtggccggagtcggaaacca

SEQ ID NO: 386204 - DNA, 20 bp, human
gcccgggcagcgcctgccgc

SEQ ID NO: 386205 - DNA, 20 bp, human
gtgtgccgccgccgttccgg

SEQ ID NO: 386206 - DNA, 20 bp, human
gctgcagacgacggcgtcgt

SEQ ID NO: 386207 - DNA, 20 bp, human
gcagacgacggcgtcgtggg

SEQ ID NO: 386208 - DNA, 20 bp, human
ggtggtcaccgttatccctt

SEQ ID NO: 386209 - DNA, 20 bp, human
gcctgaggtcctgcagacga

SEQ ID NO: 386210 - DNA, 20 bp, human
gctccagacctaagggataa

SEQ ID NO: 386211 - DNA, 20 bp, human
ggcccgcccgcggcactctg

SEQ ID NO: 386212 - DNA, 20 bp, human
gatcccttaggtctggagag

SEQ ID NO: 386213 - DNA, 20 bp, human
gcaagaaaaggtgtgagcga

SEQ ID NO: 386214 - DNA, 20 bp, human
gcaccgttatcccttaggtc

SEQ ID NO: 386215 - DNA, 20 bp, human
gtccgagcgagggccacttg

SEQ ID NO: 386216 - DNA, 20 bp, human
gcgtaaaggggagtggagtt

SEQ ID NO: 386217 - DNA, 20 bp, human
gtcaggaggggtgacctcag

SEQ ID NO: 386218 - DNA, 20 bp, human
gccgaagattgggcgtaaag

SEQ ID NO: 386219 - DNA, 20 bp, human
gtcaagataaagtaaggtca

SEQ ID NO: 386220 - DNA, 20 bp, human
ggggaaggtggccgaagatt

SEQ ID NO: 386221 - DNA, 20 bp, human
gtcagtgtcggccctggtct

SEQ ID NO: 386222 - DNA, 20 bp, human
gtgccgacctcagggatcaa

SEQ ID NO: 386223 - DNA, 20 bp, human
gggaggaacttccgagacca

SEQ ID NO: 386224 - DNA, 20 bp, human
gtgggtgtagaccggggtct

SEQ ID NO: 386225 - DNA, 20 bp, human
gtggatgtgggtgtagaccg

SEQ ID NO: 386226 - DNA, 20 bp, human
gcgaactgaggtcggtccaa

SEQ ID NO: 386227 - DNA, 20 bp, human
gaatcggagggcgtaacgaa

SEQ ID NO: 386228 - DNA, 20 bp, human
gaacgccgagcgcggtgggt

SEQ ID NO: 386229 - DNA, 20 bp, human
gctgacaggcaccgaccaat

SEQ ID NO: 386230 - DNA, 20 bp, human
gggtcagtctagcctgaggg

SEQ ID NO: 386231 - DNA, 20 bp, human
gccaccgcgctcggcgttgc

SEQ ID NO: 386232 - DNA, 20 bp, human
gctgctacccaaccgaactg

SEQ ID NO: 386233 - DNA, 20 bp, human
gctcccggcaacgccgagcg

SEQ ID NO: 386234 - DNA, 20 bp, human
ggaccgacctcagttcggtt

SEQ ID NO: 386235 - DNA, 20 bp, human
gacaggcaccgaccaatcgg

SEQ ID NO: 386236 - DNA, 20 bp, human
gtggtacgcccccaccctgg

SEQ ID NO: 386237 - DNA, 20 bp, human
gaaaggaaaacctccgtggg

SEQ ID NO: 386238 - DNA, 20 bp, human
gagggtgggggcgtaccaaa

SEQ ID NO: 386239 - DNA, 20 bp, human
gaaaacctccgtgggagggg

SEQ ID NO: 386240 - DNA, 20 bp, human
gcagaaaggaaaacctccgt

SEQ ID NO: 386241 - DNA, 20 bp, human
gtcgcagctcaccgccaggg

SEQ ID NO: 386242 - DNA, 20 bp, human
ggccccgctcgtgacgtcgc

SEQ ID NO: 386243 - DNA, 20 bp, human
ggcctcgcagctcaccgcca

SEQ ID NO: 386244 - DNA, 20 bp, human
ggtcacgagcggggccgcga

SEQ ID NO: 386245 - DNA, 20 bp, human
gcagctcaccgccagggtgg

SEQ ID NO: 386246 - DNA, 20 bp, human
gaccccgcggcgttcggggc

SEQ ID NO: 386247 - DNA, 20 bp, human
gcggcgccgtcctggtttcg

SEQ ID NO: 386248 - DNA, 20 bp, human
gggagcgcaggtctcggtgg

SEQ ID NO: 386249 - DNA, 20 bp, human
gtgaatgggtcgctgagtgg

SEQ ID NO: 386250 - DNA, 20 bp, human
gtgggaaagcgagtccctca

SEQ ID NO: 386251 - DNA, 20 bp, human
gcgcaggtctcggtggtgga

SEQ ID NO: 386252 - DNA, 20 bp, human
gcgagacctgcgctccctga

SEQ ID NO: 386253 - DNA, 20 bp, human
gcccgaacgccgcggggtgt

SEQ ID NO: 386254 - DNA, 20 bp, human
ggaacgccgcggggtgtagg

SEQ ID NO: 386255 - DNA, 20 bp, human
gggtagctttagtgaaaaca

SEQ ID NO: 386256 - DNA, 20 bp, human
ggggcggggaggccccacta

SEQ ID NO: 386257 - DNA, 20 bp, human
ggggaggccccactagggac

SEQ ID NO: 386258 - DNA, 20 bp, human
gaggcccagcggaccaagag

SEQ ID NO: 386259 - DNA, 20 bp, human
gagctcgctaagttcagaaa

SEQ ID NO: 386260 - DNA, 20 bp, human
gcccactagggactggatcg

SEQ ID NO: 386261 - DNA, 20 bp, human
gtgcttagggcggcaggggg

SEQ ID NO: 386262 - DNA, 20 bp, human
gccccgcgggcgccccctct

SEQ ID NO: 386263 - DNA, 20 bp, human
gcccgcgatccagtccctag

SEQ ID NO: 386264 - DNA, 20 bp, human
gcgccccctcttggtccgct

SEQ ID NO: 386265 - DNA, 20 bp, human
gtcgatgcttagggcggcag

SEQ ID NO: 386266 - DNA, 20 bp, human
gcataagcggcaaagactcg

SEQ ID NO: 386267 - DNA, 20 bp, human
gtccgggaagtgacgccatg

SEQ ID NO: 386268 - DNA, 20 bp, human
gcggggcggaccccatctcc

SEQ ID NO: 386269 - DNA, 20 bp, human
ggccccgctccgactggccc

SEQ ID NO: 386270 - DNA, 20 bp, human
gcggggctggcaggcgcata

SEQ ID NO: 386271 - DNA, 20 bp, human
gtgcagccgcggggcataag

SEQ ID NO: 386272 - DNA, 20 bp, human
gggaacgcggctcggattcc

SEQ ID NO: 386273 - DNA, 20 bp, human
gaatccgagccgcgttcctc

SEQ ID NO: 386274 - DNA, 20 bp, human
gacgagcggcaccagagccg

SEQ ID NO: 386275 - DNA, 20 bp, human
gtggcaggcgcatagggagt

SEQ ID NO: 386276 - DNA, 20 bp, human
gggcccgcccccctcgctca

SEQ ID NO: 386277 - DNA, 20 bp, human
gagggcggaaggcggctctg

SEQ ID NO: 386278 - DNA, 20 bp, human
gcctgggcgcccccgctaga

SEQ ID NO: 386279 - DNA, 20 bp, human
gggggcgggccctctagcgg

SEQ ID NO: 386280 - DNA, 20 bp, human
gtcccagccctgagcgaggg

SEQ ID NO: 386281 - DNA, 20 bp, human
gcagccctgagcgagggggg

SEQ ID NO: 386282 - DNA, 20 bp, human
ggcccagggagggcggaagg

SEQ ID NO: 386283 - DNA, 20 bp, human
gctccctcggtcacagtcac

SEQ ID NO: 386284 - DNA, 20 bp, human
gaggggggcgggccctctag

SEQ ID NO: 386285 - DNA, 20 bp, human
ggccccgtgactgtgaccga

SEQ ID NO: 386286 - DNA, 20 bp, human
gagaaagagctgtcacatac

SEQ ID NO: 386287 - DNA, 20 bp, human
gcacatacagggatcattag

SEQ ID NO: 386288 - DNA, 20 bp, human
ggtcactgggacctcccaat

SEQ ID NO: 386289 - DNA, 20 bp, human
gtagacgtgcatgactaaag

SEQ ID NO: 386290 - DNA, 20 bp, human
ggcacgtctaacttaattca

SEQ ID NO: 386291 - DNA, 20 bp, human
gtgagagagctatcagatat

SEQ ID NO: 386292 - DNA, 20 bp, human
gtttgtaggggccagtgaag

SEQ ID NO: 386293 - DNA, 20 bp, human
gatagctctctcaggacttc

SEQ ID NO: 386294 - DNA, 20 bp, human
ggattagttaacattttgta

SEQ ID NO: 386295 - DNA, 20 bp, human
gttcactccactaggcccca

SEQ ID NO: 386296 - DNA, 20 bp, human
gacctcgcccgggactggaa

SEQ ID NO: 386297 - DNA, 20 bp, human
ggcggcacctcgcccgggac

SEQ ID NO: 386298 - DNA, 20 bp, human
gcgggggctgatgcactcag

SEQ ID NO: 386299 - DNA, 20 bp, human
gtcaccctgcgcggcctaac

SEQ ID NO: 386300 - DNA, 20 bp, human
gcgccgcaccgagtcccaca

SEQ ID NO: 386301 - DNA, 20 bp, human
gatgcactcaggggactcgc

SEQ ID NO: 386302 - DNA, 20 bp, human
gcggagcccctgtgttgagt

SEQ ID NO: 386303 - DNA, 20 bp, human
gggtgcccgttaggccgcgc

SEQ ID NO: 386304 - DNA, 20 bp, human
gcgcgcagggagctccgtcc

SEQ ID NO: 386305 - DNA, 20 bp, human
gcttcccgagcagaccctgt

SEQ ID NO: 386306 - DNA, 20 bp, human
gcactcaaatgcaggcgggt

SEQ ID NO: 386307 - DNA, 20 bp, human
gggaggcagaggggtcggag

SEQ ID NO: 386308 - DNA, 20 bp, human
gtgctcctaggcgcccgtgg

SEQ ID NO: 386309 - DNA, 20 bp, human
gaggtagcccgggcctgcaa

SEQ ID NO: 386310 - DNA, 20 bp, human
ggcaggcccgggctacctga

SEQ ID NO: 386311 - DNA, 20 bp, human
gcaggcgggttggctaggac

SEQ ID NO: 386312 - DNA, 20 bp, human
ggctgcggtgcagggctctt

SEQ ID NO: 386313 - DNA, 20 bp, human
gcccgtggcggggccgaccc

SEQ ID NO: 386314 - DNA, 20 bp, human
gtccccacaactacaagctc

SEQ ID NO: 386315 - DNA, 20 bp, human
gaggagcacgccccctgcca

SEQ ID NO: 386316 - DNA, 20 bp, human
ggggatagggagtgtcagtg

SEQ ID NO: 386317 - DNA, 20 bp, human
gggacagcttatgcacttgg

SEQ ID NO: 386318 - DNA, 20 bp, human
ggtcccctgggatctactct

SEQ ID NO: 386319 - DNA, 20 bp, human
gggagtgtcagtgaggccta

SEQ ID NO: 386320 - DNA, 20 bp, human
ggaaaaacttagttgcaggg

SEQ ID NO: 386321 - DNA, 20 bp, human
gcccccaagagtagatccca

SEQ ID NO: 386322 - DNA, 20 bp, human
ggtgggacactgccctcaaa

SEQ ID NO: 386323 - DNA, 20 bp, human
gatcctgccggcacagcctg

SEQ ID NO: 386324 - DNA, 20 bp, human
ggctggctgcagtaacccgc

SEQ ID NO: 386325 - DNA, 20 bp, human
ggggaaaaagcctgcagacc

SEQ ID NO: 386326 - DNA, 20 bp, human
gggcccgaatgcttcttcgt

SEQ ID NO: 386327 - DNA, 20 bp, human
gaggaggcaccgggactccg

SEQ ID NO: 386328 - DNA, 20 bp, human
ggcgtcggaagttgcgtctc

SEQ ID NO: 386329 - DNA, 20 bp, human
gcggcggcaggcacaggtcg

SEQ ID NO: 386330 - DNA, 20 bp, human
gtgcaggtgacactcggtaa

SEQ ID NO: 386331 - DNA, 20 bp, human
ggggatcagtgcgccggaag

SEQ ID NO: 386332 - DNA, 20 bp, human
gaggggagaaaccacgtagc

SEQ ID NO: 386333 - DNA, 20 bp, human
gcattcgggccgtgcagccc

SEQ ID NO: 386334 - DNA, 20 bp, human
gccgccggctacctccgctg

SEQ ID NO: 386335 - DNA, 20 bp, human
gcctccctgggaagccacgg

SEQ ID NO: 386336 - DNA, 20 bp, human
gtggcgctgccggggacggt

SEQ ID NO: 386337 - DNA, 20 bp, human
gcgaaaggagccagtggcgg

SEQ ID NO: 386338 - DNA, 20 bp, human
gaagctaggccgaccgtccc

SEQ ID NO: 386339 - DNA, 20 bp, human
gggcgtggcgctgccgggga

SEQ ID NO: 386340 - DNA, 20 bp, human
ggtacacagctcgaaaagct

SEQ ID NO: 386341 - DNA, 20 bp, human
gtggcgggggcggggttagc

SEQ ID NO: 386342 - DNA, 20 bp, human
ggccgtggagaccgaggcga

SEQ ID NO: 386343 - DNA, 20 bp, human
gttagcgggcgtggcgctgc

SEQ ID NO: 386344 - DNA, 20 bp, human
gccgcaccgaaaggagccag

SEQ ID NO: 386345 - DNA, 20 bp, human
gcggcgatagaacgtttccg

SEQ ID NO: 386346 - DNA, 20 bp, human
gccggagcccaccaccaccg

SEQ ID NO: 386347 - DNA, 20 bp, human
ggggaccgacacagggatga

SEQ ID NO: 386348 - DNA, 20 bp, human
gcggctgccggggatatctg

SEQ ID NO: 386349 - DNA, 20 bp, human
gagcacacacagcttcccgt

SEQ ID NO: 386350 - DNA, 20 bp, human
gcagtggcccaggtccgacc

SEQ ID NO: 386351 - DNA, 20 bp, human
gtcttccggcaaccattaaa

SEQ ID NO: 386352 - DNA, 20 bp, human
gcgcggatgcatcgcagcgg

SEQ ID NO: 386353 - DNA, 20 bp, human
gcggacggatttgatggctt

SEQ ID NO: 386354 - DNA, 20 bp, human
gtgggggagtcgtcacccag

SEQ ID NO: 386355 - DNA, 20 bp, human
ggatgcatcgcagcgggggc

SEQ ID NO: 386356 - DNA, 20 bp, human
ggtgaagccgcttcttgccg

SEQ ID NO: 386357 - DNA, 20 bp, human
ggacagacgttgctctttta

SEQ ID NO: 386358 - DNA, 20 bp, human
gacacaaatgtggtggagac

SEQ ID NO: 386359 - DNA, 20 bp, human
gttttacggtctcgtgacca

SEQ ID NO: 386360 - DNA, 20 bp, human
ggtacatagcagaacattct

SEQ ID NO: 386361 - DNA, 20 bp, human
gtactcactgacgggtgctg

SEQ ID NO: 386362 - DNA, 20 bp, human
gctatgtactaaacaccaga

SEQ ID NO: 386363 - DNA, 20 bp, human
ggttctttaaaaacgaataa

SEQ ID NO: 386364 - DNA, 20 bp, human
gtttggtatgataggcgtgc

SEQ ID NO: 386365 - DNA, 20 bp, human
gaaagaacgcctctttttaa

SEQ ID NO: 386366 - DNA, 20 bp, human
gcaagagcctccccacaagg

SEQ ID NO: 386367 - DNA, 20 bp, human
gcgtccctccgacgatctca

SEQ ID NO: 386368 - DNA, 20 bp, human
gtaggggcgtactgagacat

SEQ ID NO: 386369 - DNA, 20 bp, human
gcactccctgagatcgtcgg

SEQ ID NO: 386370 - DNA, 20 bp, human
gagcgtcagcctgaggaaca

SEQ ID NO: 386371 - DNA, 20 bp, human
ggaggagcgcacggtctgtg

SEQ ID NO: 386372 - DNA, 20 bp, human
gtggccgccggcttgtggcg

SEQ ID NO: 386373 - DNA, 20 bp, human
ggctggcagaggacgcagaa

SEQ ID NO: 386374 - DNA, 20 bp, human
gcctagcccggacttcaaga

SEQ ID NO: 386375 - DNA, 20 bp, human
gcagcgggagcgtcagcctg

SEQ ID NO: 386376 - DNA, 20 bp, human
gggggcggagacccataatc

SEQ ID NO: 386377 - DNA, 20 bp, human
gagttaggggtattgcagtg

SEQ ID NO: 386378 - DNA, 20 bp, human
gtctacttccgggaacgaag

SEQ ID NO: 386379 - DNA, 20 bp, human
gacttccgggaacgaagggg

SEQ ID NO: 386380 - DNA, 20 bp, human
gcctcgcgtcacagccggga

SEQ ID NO: 386381 - DNA, 20 bp, human
ggccttcctcgcgtcacagc

SEQ ID NO: 386382 - DNA, 20 bp, human
gagtaggatcggcttctgtg

SEQ ID NO: 386383 - DNA, 20 bp, human
gcctactgcagggccatgag

SEQ ID NO: 386384 - DNA, 20 bp, human
gatggtgagtttcagagtta

SEQ ID NO: 386385 - DNA, 20 bp, human
gctacccagagacgccgcca

SEQ ID NO: 386386 - DNA, 20 bp, human
gcccgcgtgggcagccacac

SEQ ID NO: 386387 - DNA, 20 bp, human
gcctgcagagaggggatcag

SEQ ID NO: 386388 - DNA, 20 bp, human
gcacgcgggcgttgctcatg

SEQ ID NO: 386389 - DNA, 20 bp, human
gtgctcatggggctagtcct

SEQ ID NO: 386390 - DNA, 20 bp, human
gcctccaagggccaccatcc

SEQ ID NO: 386391 - DNA, 20 bp, human
gagccatcgcctaaggtctg

SEQ ID NO: 386392 - DNA, 20 bp, human
ggctgggcagccatcgccta

SEQ ID NO: 386393 - DNA, 20 bp, human
ggggctagtcctgggtggat

SEQ ID NO: 386394 - DNA, 20 bp, human
gagaggggatcagaggtctg

SEQ ID NO: 386395 - DNA, 20 bp, human
gtaaatctcaaacgaagggg

SEQ ID NO: 386396 - DNA, 20 bp, human
gtaagtattagggagaatcc

SEQ ID NO: 386397 - DNA, 20 bp, human
gaataaatatcttaagtatt

SEQ ID NO: 386398 - DNA, 20 bp, human
gctttatcaactttctaacc

SEQ ID NO: 386399 - DNA, 20 bp, human
gtaaaggaacaggaccattg

SEQ ID NO: 386400 - DNA, 20 bp, human
gcgggagcatgggtaaaagc

SEQ ID NO: 386401 - DNA, 20 bp, human
gagagcatgcccgggagcat

SEQ ID NO: 386402 - DNA, 20 bp, human
ggatcccagttcagtgtctg

SEQ ID NO: 386403 - DNA, 20 bp, human
gtgagtgatcacttccacaa

SEQ ID NO: 386404 - DNA, 20 bp, human
gaacaaccgtggtctcttaa

SEQ ID NO: 386405 - DNA, 20 bp, human
gagaccacggttgttaagtt

SEQ ID NO: 386406 - DNA, 20 bp, human
gcaggcctgcacagactcgt

SEQ ID NO: 386407 - DNA, 20 bp, human
gaggaccaacgagtctgtgc

SEQ ID NO: 386408 - DNA, 20 bp, human
gtggaagaatggtgtggata

SEQ ID NO: 386409 - DNA, 20 bp, human
gcctgcgcgcgcgaccgagc

SEQ ID NO: 386410 - DNA, 20 bp, human
gtgcgcgcggggtactagcc

SEQ ID NO: 386411 - DNA, 20 bp, human
ggggcggggacctggctcag

SEQ ID NO: 386412 - DNA, 20 bp, human
gcgcgcgcgaccgagccggg

SEQ ID NO: 386413 - DNA, 20 bp, human
ggccaggcgctgctgggttt

SEQ ID NO: 386414 - DNA, 20 bp, human
gtcaccgcaacatccccgca

SEQ ID NO: 386415 - DNA, 20 bp, human
ggggaccgaactcccggagt

SEQ ID NO: 386416 - DNA, 20 bp, human
gtagtcggggtgatctaaga

SEQ ID NO: 386417 - DNA, 20 bp, human
ggggacctgctcatctactc

SEQ ID NO: 386418 - DNA, 20 bp, human
ggcacccgtggctgtgcgcc

SEQ ID NO: 386419 - DNA, 20 bp, human
ggtagccaggcgcacagcca

SEQ ID NO: 386420 - DNA, 20 bp, human
ggacgcgagaaccagtagtc

SEQ ID NO: 386421 - DNA, 20 bp, human
gccgcctggtcacctgaacc

SEQ ID NO: 386422 - DNA, 20 bp, human
gggtgcgctctggacctgat

SEQ ID NO: 386423 - DNA, 20 bp, human
gcacccagggaggtcacata

SEQ ID NO: 386424 - DNA, 20 bp, human
gaggagctggagcgcgacta

SEQ ID NO: 386425 - DNA, 20 bp, human
gcaccccggaacgctctctc

SEQ ID NO: 386426 - DNA, 20 bp, human
gtgccctagggccctccctt

SEQ ID NO: 386427 - DNA, 20 bp, human
ggggatctgagttgtcagga

SEQ ID NO: 386428 - DNA, 20 bp, human
gaactcagatccccaaggga

SEQ ID NO: 386429 - DNA, 20 bp, human
gtgcagctctgcaaactcac

SEQ ID NO: 386430 - DNA, 20 bp, human
gcttggggatctgagttgtc

SEQ ID NO: 386431 - DNA, 20 bp, human
gtagggcagagaatcagcaa

SEQ ID NO: 386432 - DNA, 20 bp, human
gcagatgcccaagtagtaat

SEQ ID NO: 386433 - DNA, 20 bp, human
gaaagcagacctcgctccct

SEQ ID NO: 386434 - DNA, 20 bp, human
ggacccacagggaagacagc

SEQ ID NO: 386435 - DNA, 20 bp, human
gcacggccccacgtggtaac

SEQ ID NO: 386436 - DNA, 20 bp, human
gcaagagaggagtcactgta

SEQ ID NO: 386437 - DNA, 20 bp, human
gggaaagggacagggatcca

SEQ ID NO: 386438 - DNA, 20 bp, human
gccctctgcacggaccctcc

SEQ ID NO: 386439 - DNA, 20 bp, human
gcccagcccgggtcacaaag

SEQ ID NO: 386440 - DNA, 20 bp, human
gtctcatgggaagccctccc

SEQ ID NO: 386441 - DNA, 20 bp, human
ggcgagagagcagtttggaa

SEQ ID NO: 386442 - DNA, 20 bp, human
gccacccaagtccctctgca

SEQ ID NO: 386443 - DNA, 20 bp, human
ggggtggatatcagccagca

SEQ ID NO: 386444 - DNA, 20 bp, human
gggagtcactgtagggtgtg

SEQ ID NO: 386445 - DNA, 20 bp, human
gggtgggggtagatgagagt

SEQ ID NO: 386446 - DNA, 20 bp, human
gcatcgcagggaggacccga

SEQ ID NO: 386447 - DNA, 20 bp, human
gaccggaggactggcgtcca

SEQ ID NO: 386448 - DNA, 20 bp, human
gggcgcccctccaggaccgg

SEQ ID NO: 386449 - DNA, 20 bp, human
ggtcaccggacaggccaccg

SEQ ID NO: 386450 - DNA, 20 bp, human
ggggctgggtctgaccagac

SEQ ID NO: 386451 - DNA, 20 bp, human
ggactggcgtccagggtcac

SEQ ID NO: 386452 - DNA, 20 bp, human
gaccgccatcccccggacgc

SEQ ID NO: 386453 - DNA, 20 bp, human
ggcaaccccggcaccggccg

SEQ ID NO: 386454 - DNA, 20 bp, human
ggggtctgaccagactgggg

SEQ ID NO: 386455 - DNA, 20 bp, human
gccagccccggtggcctgtc

SEQ ID NO: 386456 - DNA, 20 bp, human
ggggccgcgccctcgaagga

SEQ ID NO: 386457 - DNA, 20 bp, human
gaaaggggccgcgccctcga

SEQ ID NO: 386458 - DNA, 20 bp, human
gttaagaaggcagacgccgg

SEQ ID NO: 386459 - DNA, 20 bp, human
gaagaatgaccgtccttcga

SEQ ID NO: 386460 - DNA, 20 bp, human
gccgcccagagacggccacg

SEQ ID NO: 386461 - DNA, 20 bp, human
gcgagctccgccaatcagcg

SEQ ID NO: 386462 - DNA, 20 bp, human
ggatggggtattgtgaactg

SEQ ID NO: 386463 - DNA, 20 bp, human
gaggaataggggctgtgctt

SEQ ID NO: 386464 - DNA, 20 bp, human
ggggcggtccccgcgctgat

SEQ ID NO: 386465 - DNA, 20 bp, human
ggagccacgtggccgtctct

SEQ ID NO: 386466 - DNA, 20 bp, human
gcctccaaggccgtctctta

SEQ ID NO: 386467 - DNA, 20 bp, human
gggtggaagcgagaaccagg

SEQ ID NO: 386468 - DNA, 20 bp, human
gttggagggcatcgcccctg

SEQ ID NO: 386469 - DNA, 20 bp, human
gtcctgtgcaatctgaagaa

SEQ ID NO: 386470 - DNA, 20 bp, human
gcctccctaagagacggcct

SEQ ID NO: 386471 - DNA, 20 bp, human
gtcactgcctcctacagtcg

SEQ ID NO: 386472 - DNA, 20 bp, human
gtgcaatctgaagaagggtc

SEQ ID NO: 386473 - DNA, 20 bp, human
gccgggtggaagcgagaacc

SEQ ID NO: 386474 - DNA, 20 bp, human
ggcacaggaggaggcggtag

SEQ ID NO: 386475 - DNA, 20 bp, human
gtgggcacagcacgtcttcc

SEQ ID NO: 386476 - DNA, 20 bp, human
gctaccctggcggcccagag

SEQ ID NO: 386477 - DNA, 20 bp, human
gcgccactggggaacgtagt

SEQ ID NO: 386478 - DNA, 20 bp, human
ggcgggcggcgctaccctgg

SEQ ID NO: 386479 - DNA, 20 bp, human
ggagagccacgcggcgccaa

SEQ ID NO: 386480 - DNA, 20 bp, human
gctagggcatagacaactgg

SEQ ID NO: 386481 - DNA, 20 bp, human
ggaacgcgggccagatgcgt

SEQ ID NO: 386482 - DNA, 20 bp, human
gaatcgcagtcccctcgccc

SEQ ID NO: 386483 - DNA, 20 bp, human
gccgaggccgccaatcccgc

SEQ ID NO: 386484 - DNA, 20 bp, human
ggcgccttggcccgcgggat

SEQ ID NO: 386485 - DNA, 20 bp, human
gcggtctaggcacagcgaga

SEQ ID NO: 386486 - DNA, 20 bp, human
gcgcagtagtgcaggatgat

SEQ ID NO: 386487 - DNA, 20 bp, human
gagaactccatcgtttaata

SEQ ID NO: 386488 - DNA, 20 bp, human
ggatagtgcggcaaataggc

SEQ ID NO: 386489 - DNA, 20 bp, human
gcttacgcgtggctcacaga

SEQ ID NO: 386490 - DNA, 20 bp, human
gattactcatacagccagag

SEQ ID NO: 386491 - DNA, 20 bp, human
ggcacttagcagcttacgcg

SEQ ID NO: 386492 - DNA, 20 bp, human
gtgagcttttcaattactcc

SEQ ID NO: 386493 - DNA, 20 bp, human
gtctcataccatttgtagtt

SEQ ID NO: 386494 - DNA, 20 bp, human
gctgcattcatgttgaagcg

SEQ ID NO: 386495 - DNA, 20 bp, human
gtgattgtttttagatagtg

SEQ ID NO: 386496 - DNA, 20 bp, human
gacaactcccgaaggggaaa

SEQ ID NO: 386497 - DNA, 20 bp, human
ggggaggcgcgcgagattgt

SEQ ID NO: 386498 - DNA, 20 bp, human
gaccctgcaaacttgttagc

SEQ ID NO: 386499 - DNA, 20 bp, human
ggaccttgcggacaccaagg

SEQ ID NO: 386500 - DNA, 20 bp, human
ggaaactacaactcccgaag

SEQ ID NO: 386501 - DNA, 20 bp, human
gtggtgggtctgtaaaccag

SEQ ID NO: 386502 - DNA, 20 bp, human
gcgcctccttggtgtccgca

SEQ ID NO: 386503 - DNA, 20 bp, human
gtttcctgcaagcgcttggt

SEQ ID NO: 386504 - DNA, 20 bp, human
gggagtcgggctagaaacgc

SEQ ID NO: 386505 - DNA, 20 bp, human
gagacccaccaagcgcttgc

SEQ ID NO: 386506 - DNA, 20 bp, human
ggcaaaaggcgccaactgat

SEQ ID NO: 386507 - DNA, 20 bp, human
ggcccccaagtcacgcaaac

SEQ ID NO: 386508 - DNA, 20 bp, human
gcagaagggaaagtccaagg

SEQ ID NO: 386509 - DNA, 20 bp, human
gttcctgtttgcgtgacttg

SEQ ID NO: 386510 - DNA, 20 bp, human
ggcggcttggggaaaaagga

SEQ ID NO: 386511 - DNA, 20 bp, human
ggagaccgcggcccccaaag

SEQ ID NO: 386512 - DNA, 20 bp, human
gtccctggctgcccatcagt

SEQ ID NO: 386513 - DNA, 20 bp, human
ggccaactgatgggcagcca

SEQ ID NO: 386514 - DNA, 20 bp, human
gacctgatgaaatataatgc

SEQ ID NO: 386515 - DNA, 20 bp, human
gcggcccccaaagcggcttg

SEQ ID NO: 386516 - DNA, 20 bp, human
gtaggctatgatgacgacag

SEQ ID NO: 386517 - DNA, 20 bp, human
gcctttgctgcccataagga

SEQ ID NO: 386518 - DNA, 20 bp, human
gtgacgacaggggattgtga

SEQ ID NO: 386519 - DNA, 20 bp, human
gtagcccataacagggtttg

SEQ ID NO: 386520 - DNA, 20 bp, human
gctagggcccctttggtgga

SEQ ID NO: 386521 - DNA, 20 bp, human
gtgggcctttgctgcccata

SEQ ID NO: 386522 - DNA, 20 bp, human
gcaggctgtggaatctggtg

SEQ ID NO: 386523 - DNA, 20 bp, human
gtgtgatggtggccaggctg

SEQ ID NO: 386524 - DNA, 20 bp, human
ggctccacaaaccctgttat

SEQ ID NO: 386525 - DNA, 20 bp, human
gaatacaatgccggtctcct

SEQ ID NO: 386526 - DNA, 20 bp, human
ggggacgggtagcgtgcatg

SEQ ID NO: 386527 - DNA, 20 bp, human
ggagaccacgcttccgggac

SEQ ID NO: 386528 - DNA, 20 bp, human
gagtgcgtgatggacgttta

SEQ ID NO: 386529 - DNA, 20 bp, human
gcacacgcacaacaccagac

SEQ ID NO: 386530 - DNA, 20 bp, human
ggttgccggagcccgaactg

SEQ ID NO: 386531 - DNA, 20 bp, human
ggacaagcttcgtcagaggc

SEQ ID NO: 386532 - DNA, 20 bp, human
ggcggcggagaccacgcttc

SEQ ID NO: 386533 - DNA, 20 bp, human
gggagcccgaactgaggcgg

SEQ ID NO: 386534 - DNA, 20 bp, human
ggtcccggccgcgccaccgt

SEQ ID NO: 386535 - DNA, 20 bp, human
gccgccgtgacctccgaccc

SEQ ID NO: 386536 - DNA, 20 bp, human
gagacctccaggggtcagag

SEQ ID NO: 386537 - DNA, 20 bp, human
gtggccttggtggctatggg

SEQ ID NO: 386538 - DNA, 20 bp, human
gttgagctgttgcctcagaa

SEQ ID NO: 386539 - DNA, 20 bp, human
gtcaggcccaccccacgcag

SEQ ID NO: 386540 - DNA, 20 bp, human
ggcaacagctcaacttcctg

SEQ ID NO: 386541 - DNA, 20 bp, human
ggggtgggcctgaggacacc

SEQ ID NO: 386542 - DNA, 20 bp, human
gggcttggccttggtggcta

SEQ ID NO: 386543 - DNA, 20 bp, human
gactgtccaagcccctgcgt

SEQ ID NO: 386544 - DNA, 20 bp, human
gcaggcacagctccctagcc

SEQ ID NO: 386545 - DNA, 20 bp, human
gctgctgatcacagagctgt

SEQ ID NO: 386546 - DNA, 20 bp, human
ggggcccttacccggcaggt

SEQ ID NO: 386547 - DNA, 20 bp, human
gccgcccacctgccgggtaa

SEQ ID NO: 386548 - DNA, 20 bp, human
gcgtccgcgggcgaggggac

SEQ ID NO: 386549 - DNA, 20 bp, human
gcggagagaagggcactcgg

SEQ ID NO: 386550 - DNA, 20 bp, human
gacgcaggagcaggcggagt

SEQ ID NO: 386551 - DNA, 20 bp, human
gcctgcgggaccgacgagac

SEQ ID NO: 386552 - DNA, 20 bp, human
gtgccgggtaagggcccctc

SEQ ID NO: 386553 - DNA, 20 bp, human
ggcccgcagggacttcgaga

SEQ ID NO: 386554 - DNA, 20 bp, human
gcgcagctgccccatcatgt

SEQ ID NO: 386555 - DNA, 20 bp, human
ggactcctggcgcggctgca

SEQ ID NO: 386556 - DNA, 20 bp, human
ggggcgatctgacgtcatga

SEQ ID NO: 386557 - DNA, 20 bp, human
ggctcggggaagctgcgcgg

SEQ ID NO: 386558 - DNA, 20 bp, human
ggggctggccaccacgggac

SEQ ID NO: 386559 - DNA, 20 bp, human
gaccaaaacaggtggaatcc

SEQ ID NO: 386560 - DNA, 20 bp, human
gatctgacgtcatgaggggc

SEQ ID NO: 386561 - DNA, 20 bp, human
gccccgagcgagaccaaaac

SEQ ID NO: 386562 - DNA, 20 bp, human
gactgcggcggcatccggga

SEQ ID NO: 386563 - DNA, 20 bp, human
gccggaagctccgactgcgg

SEQ ID NO: 386564 - DNA, 20 bp, human
gggtggcggcacgtccctcc

SEQ ID NO: 386565 - DNA, 20 bp, human
gggggaagctgcgcggcggg

SEQ ID NO: 386566 - DNA, 20 bp, human
gagtgtgggggcaataagtg

SEQ ID NO: 386567 - DNA, 20 bp, human
gggtctcttaatccccatgg

SEQ ID NO: 386568 - DNA, 20 bp, human
gagtggggattcattgaggg

SEQ ID NO: 386569 - DNA, 20 bp, human
gagtggggaattgccctcca

SEQ ID NO: 386570 - DNA, 20 bp, human
gaccagcgccttttaatcaa

SEQ ID NO: 386571 - DNA, 20 bp, human
ggctgtacgttcaaataact

SEQ ID NO: 386572 - DNA, 20 bp, human
gaataagtggggattcattg

SEQ ID NO: 386573 - DNA, 20 bp, human
gaacttctccagcttttagt

SEQ ID NO: 386574 - DNA, 20 bp, human
gtatacaatgctatgttttt

SEQ ID NO: 386575 - DNA, 20 bp, human
ggcgccttttaatcaaagga

SEQ ID NO: 386576 - DNA, 20 bp, human
gccaggatgggcagaaatga

SEQ ID NO: 386577 - DNA, 20 bp, human
gagtggccctgggtagatac

SEQ ID NO: 386578 - DNA, 20 bp, human
gcagaaaaggaacccaggat

SEQ ID NO: 386579 - DNA, 20 bp, human
gggatctagggagtggccct

SEQ ID NO: 386580 - DNA, 20 bp, human
gcccatggacactatcactc

SEQ ID NO: 386581 - DNA, 20 bp, human
gaggtaagtgaaaccagaaa

SEQ ID NO: 386582 - DNA, 20 bp, human
gggccactccctagatcctt

SEQ ID NO: 386583 - DNA, 20 bp, human
ggggaagggcacataatttg

SEQ ID NO: 386584 - DNA, 20 bp, human
gtggcagaggaaggctgtca

SEQ ID NO: 386585 - DNA, 20 bp, human
ggaggaaggctgtcagggat

SEQ ID NO: 386586 - DNA, 20 bp, human
gctccctcgccatccccgca

SEQ ID NO: 386587 - DNA, 20 bp, human
ggggccttggaatcacacct

SEQ ID NO: 386588 - DNA, 20 bp, human
gcctccgcgctcgcgctcga

SEQ ID NO: 386589 - DNA, 20 bp, human
gggcccgccgggccctcgta

SEQ ID NO: 386590 - DNA, 20 bp, human
gagctcccctcgccctacga

SEQ ID NO: 386591 - DNA, 20 bp, human
gggctggtcatcatcttgta

SEQ ID NO: 386592 - DNA, 20 bp, human
gggagaagatggtgctggtt

SEQ ID NO: 386593 - DNA, 20 bp, human
ggggctcaggtctggagggc

SEQ ID NO: 386594 - DNA, 20 bp, human
gcctgtctggccccagtaca

SEQ ID NO: 386595 - DNA, 20 bp, human
gcacctgggctcaggtctgg

SEQ ID NO: 386596 - DNA, 20 bp, human
gactaggatggggagactga

SEQ ID NO: 386597 - DNA, 20 bp, human
ggaggtggataactaggatg

SEQ ID NO: 386598 - DNA, 20 bp, human
ggctccctgtctggcttgga

SEQ ID NO: 386599 - DNA, 20 bp, human
ggctaaaactgctccctgtc

SEQ ID NO: 386600 - DNA, 20 bp, human
gcagccttccaagccagaca

SEQ ID NO: 386601 - DNA, 20 bp, human
gccctgtccaactatagaga

SEQ ID NO: 386602 - DNA, 20 bp, human
gggagggggaggcggcactt

SEQ ID NO: 386603 - DNA, 20 bp, human
gctggagatgatccagagaa

SEQ ID NO: 386604 - DNA, 20 bp, human
gagggccactctataatcaa

SEQ ID NO: 386605 - DNA, 20 bp, human
gggtcttgcgcaagcgcacg

SEQ ID NO: 386606 - DNA, 20 bp, human
gaaaccaggcggccgctgga

SEQ ID NO: 386607 - DNA, 20 bp, human
gggaaggggcggcgccgcga

SEQ ID NO: 386608 - DNA, 20 bp, human
ggggtcaccgtcccaggccg

SEQ ID NO: 386609 - DNA, 20 bp, human
gggagaagaaacgccggaga

SEQ ID NO: 386610 - DNA, 20 bp, human
gtagagcgaggaaggacgcg

SEQ ID NO: 386611 - DNA, 20 bp, human
gcactcagcggcaccgccaa

SEQ ID NO: 386612 - DNA, 20 bp, human
gggcccggggtcaccgtccc

SEQ ID NO: 386613 - DNA, 20 bp, human
gcggagcgcggggaggtgca

SEQ ID NO: 386614 - DNA, 20 bp, human
ggctcctggcggcgggactg

SEQ ID NO: 386615 - DNA, 20 bp, human
gaccccagatggaaggtgcc

SEQ ID NO: 386616 - DNA, 20 bp, human
ggcagagtggcgaagacgtc

SEQ ID NO: 386617 - DNA, 20 bp, human
gagtggcgaagacgtctggc

SEQ ID NO: 386618 - DNA, 20 bp, human
gccgaccgcccatgcaaata

SEQ ID NO: 386619 - DNA, 20 bp, human
gggagaaaccagcaccaatt

SEQ ID NO: 386620 - DNA, 20 bp, human
gcgggattggctggcctctt

SEQ ID NO: 386621 - DNA, 20 bp, human
gggcgaagacgtctggcggg

SEQ ID NO: 386622 - DNA, 20 bp, human
gactagggggatttgcgtca

SEQ ID NO: 386623 - DNA, 20 bp, human
ggggttgagggcgggactag

SEQ ID NO: 386624 - DNA, 20 bp, human
gtgcagcggttttacaaagg

SEQ ID NO: 386625 - DNA, 20 bp, human
gctctgcagcggttttacaa

SEQ ID NO: 386626 - DNA, 20 bp, human
ggcttaaattatatgactag

SEQ ID NO: 386627 - DNA, 20 bp, human
gagaagaaagttgaaaatgg

SEQ ID NO: 386628 - DNA, 20 bp, human
gtcttctaatggatcgaaat

SEQ ID NO: 386629 - DNA, 20 bp, human
gcaaagatgaagtggtttcc

SEQ ID NO: 386630 - DNA, 20 bp, human
gacttcactcaaagatgaag

SEQ ID NO: 386631 - DNA, 20 bp, human
gatattatgctagttgaatg

SEQ ID NO: 386632 - DNA, 20 bp, human
gaaatttgagttctctcagt

SEQ ID NO: 386633 - DNA, 20 bp, human
gtgagttaatattttttcta

SEQ ID NO: 386634 - DNA, 20 bp, human
gttttgggaagtgattgtga

SEQ ID NO: 386635 - DNA, 20 bp, human
gataaaaatgaacactgaag

SEQ ID NO: 386636 - DNA, 20 bp, human
gggcctgcggggacctggtg

SEQ ID NO: 386637 - DNA, 20 bp, human
gatggcaaccagtccctcca

SEQ ID NO: 386638 - DNA, 20 bp, human
gtggcgagcaggtcacgtga

SEQ ID NO: 386639 - DNA, 20 bp, human
ggagcgcgggctttggaagg

SEQ ID NO: 386640 - DNA, 20 bp, human
gtcgccacgcacagcctctt

SEQ ID NO: 386641 - DNA, 20 bp, human
ggtggagtggggacaagcgg

SEQ ID NO: 386642 - DNA, 20 bp, human
gcaggctgcgtcccctcaga

SEQ ID NO: 386643 - DNA, 20 bp, human
gggtggagaagggtacgcca

SEQ ID NO: 386644 - DNA, 20 bp, human
gcatgagagcagccgtctga

SEQ ID NO: 386645 - DNA, 20 bp, human
gtcgggtgtagagggagcag

SEQ ID NO: 386646 - DNA, 20 bp, human
gccctggagcggccgaggta

SEQ ID NO: 386647 - DNA, 20 bp, human
ggaggcctcaccccctacct

SEQ ID NO: 386648 - DNA, 20 bp, human
gtatactggcctcatagccg

SEQ ID NO: 386649 - DNA, 20 bp, human
gtggcacccacaatccaccg

SEQ ID NO: 386650 - DNA, 20 bp, human
gtgccaatatgcaaaagagg

SEQ ID NO: 386651 - DNA, 20 bp, human
gtcgccacgccgggcaagag

SEQ ID NO: 386652 - DNA, 20 bp, human
gctatgaggccagtataagg

SEQ ID NO: 386653 - DNA, 20 bp, human
gtgcgcccgcagagaacgct

SEQ ID NO: 386654 - DNA, 20 bp, human
gcatagccgcggtggattgt

SEQ ID NO: 386655 - DNA, 20 bp, human
gactggcctcatagccgcgg

SEQ ID NO: 386656 - DNA, 20 bp, human
gcgagggggcggaaagagga

SEQ ID NO: 386657 - DNA, 20 bp, human
gtcgtgatggggaagttctt

SEQ ID NO: 386658 - DNA, 20 bp, human
gacagccagaaaggcggagg

SEQ ID NO: 386659 - DNA, 20 bp, human
gcggggataccggacaggga

SEQ ID NO: 386660 - DNA, 20 bp, human
ggggaacctcacagaggccc

SEQ ID NO: 386661 - DNA, 20 bp, human
ggggggcggggataccggac

SEQ ID NO: 386662 - DNA, 20 bp, human
gggagactggccccgagatt

SEQ ID NO: 386663 - DNA, 20 bp, human
gctctcctcctccgcctttc

SEQ ID NO: 386664 - DNA, 20 bp, human
gcctgagaactcttcaaaga

SEQ ID NO: 386665 - DNA, 20 bp, human
ggaacttccccatcacgagg

SEQ ID NO: 386666 - DNA, 20 bp, human
ggaaaaccgcgagcgaggaa

SEQ ID NO: 386667 - DNA, 20 bp, human
gcacaggcctaccttctcca

SEQ ID NO: 386668 - DNA, 20 bp, human
ggcactgcgggaaaactcgc

SEQ ID NO: 386669 - DNA, 20 bp, human
gtaaaaggggggaatagcca

SEQ ID NO: 386670 - DNA, 20 bp, human
gccaaccaagtcagtataaa

SEQ ID NO: 386671 - DNA, 20 bp, human
ggctcctgccccctacggtg

SEQ ID NO: 386672 - DNA, 20 bp, human
ggccgggcttgctttttaaa

SEQ ID NO: 386673 - DNA, 20 bp, human
ggagaaggtaggcctgtggc

SEQ ID NO: 386674 - DNA, 20 bp, human
gcccgcgctcaggcggagaa

SEQ ID NO: 386675 - DNA, 20 bp, human
gaacccgcggaggctcgacc

SEQ ID NO: 386676 - DNA, 20 bp, human
ggtgcgcggaggaatcttaa

SEQ ID NO: 386677 - DNA, 20 bp, human
ggggacgctagcgcagtgcg

SEQ ID NO: 386678 - DNA, 20 bp, human
gaagttctcctccgcttcag

SEQ ID NO: 386679 - DNA, 20 bp, human
gcgccggaaagcagaatgcc

SEQ ID NO: 386680 - DNA, 20 bp, human
gtccgcttcagaggcggaaa

SEQ ID NO: 386681 - DNA, 20 bp, human
gaggaatcttaagggctgct

SEQ ID NO: 386682 - DNA, 20 bp, human
gacaaccttgtatgcgctgg

SEQ ID NO: 386683 - DNA, 20 bp, human
ggcaacaaccttgtatgcgc

SEQ ID NO: 386684 - DNA, 20 bp, human
gaccttttccgcctctgaag

SEQ ID NO: 386685 - DNA, 20 bp, human
ggcgtaaacgacgcaccgga

SEQ ID NO: 386686 - DNA, 20 bp, human
gttgaggtagagtcagagta

SEQ ID NO: 386687 - DNA, 20 bp, human
gagaatcgcagaaggggtcg

SEQ ID NO: 386688 - DNA, 20 bp, human
gaggtgggaagtgcatgtca

SEQ ID NO: 386689 - DNA, 20 bp, human
gaggtgaggcccttcacgga

SEQ ID NO: 386690 - DNA, 20 bp, human
gccgggtcacagaatggcta

SEQ ID NO: 386691 - DNA, 20 bp, human
gtgcacttcccaccttttcg

SEQ ID NO: 386692 - DNA, 20 bp, human
gtatctcagcctcgaaaagg

SEQ ID NO: 386693 - DNA, 20 bp, human
ggtcaaggaaacctctagac

SEQ ID NO: 386694 - DNA, 20 bp, human
gaaagggtgccctccgtgaa

SEQ ID NO: 386695 - DNA, 20 bp, human
gaggtatctcagcctcgaaa

SEQ ID NO: 386696 - DNA, 20 bp, human
ggatagaagcgggaacgaaa

SEQ ID NO: 386697 - DNA, 20 bp, human
gcgtcacaggacagatgatc

SEQ ID NO: 386698 - DNA, 20 bp, human
gggctggagacgccagaggg

SEQ ID NO: 386699 - DNA, 20 bp, human
ggacacttcgcgtgcggtgt

SEQ ID NO: 386700 - DNA, 20 bp, human
gtcaaggtggattgagtcgg

SEQ ID NO: 386701 - DNA, 20 bp, human
gacgggaagcgaaagtcggc

SEQ ID NO: 386702 - DNA, 20 bp, human
ggtcggctggagacgccaga

SEQ ID NO: 386703 - DNA, 20 bp, human
gtccgccaaaggctgctgac

SEQ ID NO: 386704 - DNA, 20 bp, human
gacgcagattcgcgatccaa

SEQ ID NO: 386705 - DNA, 20 bp, human
ggaagtgtcaccgtagctct

SEQ ID NO: 386706 - DNA, 20 bp, human
ggccccgggctgcctctgag

SEQ ID NO: 386707 - DNA, 20 bp, human
gggcggaggcggaactggga

SEQ ID NO: 386708 - DNA, 20 bp, human
gtccgatgacctggactgag

SEQ ID NO: 386709 - DNA, 20 bp, human
gagactgagtctaccaggtg

SEQ ID NO: 386710 - DNA, 20 bp, human
gccacctgctcacctcggaa

SEQ ID NO: 386711 - DNA, 20 bp, human
gcaggtgcgctgcacccccg

SEQ ID NO: 386712 - DNA, 20 bp, human
ggccgccactcacctaggag

SEQ ID NO: 386713 - DNA, 20 bp, human
gggtgtgggcactgctcgta

SEQ ID NO: 386714 - DNA, 20 bp, human
gtcctctcctaggtgagtgg

SEQ ID NO: 386715 - DNA, 20 bp, human
ggcggctcccggtgacccgc

SEQ ID NO: 386716 - DNA, 20 bp, human
gctggggcctgcctaaaagt

SEQ ID NO: 386717 - DNA, 20 bp, human
gcaaaaaaggacatgacgaa

SEQ ID NO: 386718 - DNA, 20 bp, human
ggggccttgcttaggactct

SEQ ID NO: 386719 - DNA, 20 bp, human
gacaggctgcaggcagttgc

SEQ ID NO: 386720 - DNA, 20 bp, human
gaggacatgacgaatggcac

SEQ ID NO: 386721 - DNA, 20 bp, human
gttgcgggttgcaggagttc

SEQ ID NO: 386722 - DNA, 20 bp, human
gcctcagcccacttttaggc

SEQ ID NO: 386723 - DNA, 20 bp, human
gagcagcctgggccttgctt

SEQ ID NO: 386724 - DNA, 20 bp, human
gggccccagagtcctaagca

SEQ ID NO: 386725 - DNA, 20 bp, human
gtaggcagtgacatgaaagg

SEQ ID NO: 386726 - DNA, 20 bp, human
ggacaggtggggctcaaatt

SEQ ID NO: 386727 - DNA, 20 bp, human
gtgagctaagaaatcaggat

SEQ ID NO: 386728 - DNA, 20 bp, human
gggccaatcggcggaaggac

SEQ ID NO: 386729 - DNA, 20 bp, human
ggcggtgcccagaggcatga

SEQ ID NO: 386730 - DNA, 20 bp, human
gcaatcggcggaaggacagg

SEQ ID NO: 386731 - DNA, 20 bp, human
gaacctggagccggcggcgt

SEQ ID NO: 386732 - DNA, 20 bp, human
gcccagtgagctaagaaatc

SEQ ID NO: 386733 - DNA, 20 bp, human
gggaagaggcggtgacaaag

SEQ ID NO: 386734 - DNA, 20 bp, human
gaaagagggggaaacgggag

SEQ ID NO: 386735 - DNA, 20 bp, human
gtcttccccacggaaatgaa

SEQ ID NO: 386736 - DNA, 20 bp, human
gtggcctgtgagcacacgta

SEQ ID NO: 386737 - DNA, 20 bp, human
gcgtgtgctcacaggccaaa

SEQ ID NO: 386738 - DNA, 20 bp, human
ggaaacttcaaatcttaaat

SEQ ID NO: 386739 - DNA, 20 bp, human
gtgaaggatgataagtggga

SEQ ID NO: 386740 - DNA, 20 bp, human
gcaaatcttaaatggggaga

SEQ ID NO: 386741 - DNA, 20 bp, human
gccccaggaatgaggaatta

SEQ ID NO: 386742 - DNA, 20 bp, human
gccttctttggcagcattga

SEQ ID NO: 386743 - DNA, 20 bp, human
gtaaaactggagttaaccac

SEQ ID NO: 386744 - DNA, 20 bp, human
gaacttcgagactgtccttt

SEQ ID NO: 386745 - DNA, 20 bp, human
gatgccctacgtgtgctcac

SEQ ID NO: 386746 - DNA, 20 bp, human
ggggaggacccggcacttgg

SEQ ID NO: 386747 - DNA, 20 bp, human
gtggggcgcagattcctcga

SEQ ID NO: 386748 - DNA, 20 bp, human
gcgacgctcccgaacctccg

SEQ ID NO: 386749 - DNA, 20 bp, human
gaggagcccctggggagccg

SEQ ID NO: 386750 - DNA, 20 bp, human
ggatccctccccccaagtgc

SEQ ID NO: 386751 - DNA, 20 bp, human
ggattacgctgagtcagcga

SEQ ID NO: 386752 - DNA, 20 bp, human
ggggatccctcgggtcccag

SEQ ID NO: 386753 - DNA, 20 bp, human
gcctttcccctgggacccga

SEQ ID NO: 386754 - DNA, 20 bp, human
gggacccggcacttgggggg

SEQ ID NO: 386755 - DNA, 20 bp, human
gagcgtaatccgagccgcgg

SEQ ID NO: 386756 - DNA, 20 bp, human
ggggcacccgtgcaaggcga

SEQ ID NO: 386757 - DNA, 20 bp, human
gcggcccccgcgggagagga

SEQ ID NO: 386758 - DNA, 20 bp, human
gcaccccgggacaggtggtg

SEQ ID NO: 386759 - DNA, 20 bp, human
gcagctgcgtccgtggtgct

SEQ ID NO: 386760 - DNA, 20 bp, human
ggggaacgggcgtcccgcgt

SEQ ID NO: 386761 - DNA, 20 bp, human
gaggggcgacggcccacccc

SEQ ID NO: 386762 - DNA, 20 bp, human
gcggcccaccccgggacagg

SEQ ID NO: 386763 - DNA, 20 bp, human
gagggacgggcccccagaac

SEQ ID NO: 386764 - DNA, 20 bp, human
gctggacggtcgggcgtccc

SEQ ID NO: 386765 - DNA, 20 bp, human
gcaccacggacgcagctgga

SEQ ID NO: 386766 - DNA, 20 bp, human
gaagacgctggacccttact

SEQ ID NO: 386767 - DNA, 20 bp, human
ggcctcggttctcctagtaa

SEQ ID NO: 386768 - DNA, 20 bp, human
gctccagccggctcttgcct

SEQ ID NO: 386769 - DNA, 20 bp, human
gccgcccacccgcctagcgc

SEQ ID NO: 386770 - DNA, 20 bp, human
gggttccccgcggctccagc

SEQ ID NO: 386771 - DNA, 20 bp, human
gaaccgaggcaagagccggc

SEQ ID NO: 386772 - DNA, 20 bp, human
gaacaaaacacggtcctcaa

SEQ ID NO: 386773 - DNA, 20 bp, human
gagggaacgcatagttcttg

SEQ ID NO: 386774 - DNA, 20 bp, human
gtcaccggcgctaggcgggt

SEQ ID NO: 386775 - DNA, 20 bp, human
gtaagggtccagcgtcttct

SEQ ID NO: 386776 - DNA, 20 bp, human
ggctagcggctgctaggtgc

SEQ ID NO: 386777 - DNA, 20 bp, human
gtgcgcaggtgcaaatggta

SEQ ID NO: 386778 - DNA, 20 bp, human
gtggccaacactggccggaa

SEQ ID NO: 386779 - DNA, 20 bp, human
gaccgcgagttaagaggaga

SEQ ID NO: 386780 - DNA, 20 bp, human
gggcgggaccgcgagttaag

SEQ ID NO: 386781 - DNA, 20 bp, human
ggccgaaagaggaaatgctt

SEQ ID NO: 386782 - DNA, 20 bp, human
gttcggcctcagtcagctag

SEQ ID NO: 386783 - DNA, 20 bp, human
gagctgactgaggccgaaag

SEQ ID NO: 386784 - DNA, 20 bp, human
ggattccggggacgcactcg

SEQ ID NO: 386785 - DNA, 20 bp, human
gcgccccttccggccagtgt

SEQ ID NO: 386786 - DNA, 20 bp, human
gctggtgaagagactcaaga

SEQ ID NO: 386787 - DNA, 20 bp, human
gctggcgcgcgcttcttaaa

SEQ ID NO: 386788 - DNA, 20 bp, human
gcagctgcaggaagggcgtg

SEQ ID NO: 386789 - DNA, 20 bp, human
gtgaagagactcaagaggga

SEQ ID NO: 386790 - DNA, 20 bp, human
gggagcgcgcggctgatacc

SEQ ID NO: 386791 - DNA, 20 bp, human
gggcaccgcctccgtccggg

SEQ ID NO: 386792 - DNA, 20 bp, human
gcgcaggcaccgcctccgtc

SEQ ID NO: 386793 - DNA, 20 bp, human
ggctacatttgcatacaagg

SEQ ID NO: 386794 - DNA, 20 bp, human
gtggtccacccctaggggag

SEQ ID NO: 386795 - DNA, 20 bp, human
gcttaaaggggccgcccgga

SEQ ID NO: 386796 - DNA, 20 bp, human
ggcccctccgcagtgttgta

SEQ ID NO: 386797 - DNA, 20 bp, human
ggggaagagtcaagtcagac

SEQ ID NO: 386798 - DNA, 20 bp, human
gagagtcaagtcagacagga

SEQ ID NO: 386799 - DNA, 20 bp, human
gtccaggagacagtgaaatg

SEQ ID NO: 386800 - DNA, 20 bp, human
gccagagcttggtacagcca

SEQ ID NO: 386801 - DNA, 20 bp, human
ggctgtaccaagctctggga

SEQ ID NO: 386802 - DNA, 20 bp, human
gggtggggcagctacatgcc

SEQ ID NO: 386803 - DNA, 20 bp, human
gccatcccagtgagcgagtg

SEQ ID NO: 386804 - DNA, 20 bp, human
gctgccctgcgcgtcccaga

SEQ ID NO: 386805 - DNA, 20 bp, human
gttccctacaacactgcgga

SEQ ID NO: 386806 - DNA, 20 bp, human
gcgccctctctgtccttcgg

SEQ ID NO: 386807 - DNA, 20 bp, human
ggagtcagaatcgggggcgg

SEQ ID NO: 386808 - DNA, 20 bp, human
ggcggagtcagaatcggggg

SEQ ID NO: 386809 - DNA, 20 bp, human
gttcccggagtctccaccga

SEQ ID NO: 386810 - DNA, 20 bp, human
gtgtccttcggtggagactc

SEQ ID NO: 386811 - DNA, 20 bp, human
ggagggcggagtcagaatcg

SEQ ID NO: 386812 - DNA, 20 bp, human
gcatggcgcgcccccagtgc

SEQ ID NO: 386813 - DNA, 20 bp, human
gaataagtggggaaagcgac

SEQ ID NO: 386814 - DNA, 20 bp, human
gaggccccacctcctgagcc

SEQ ID NO: 386815 - DNA, 20 bp, human
gagcacagacagacggagag

SEQ ID NO: 386816 - DNA, 20 bp, human
gcccgcccgcgggaaagagg

SEQ ID NO: 386817 - DNA, 20 bp, human
gcggggcggggcactgaagg

SEQ ID NO: 386818 - DNA, 20 bp, human
gagcacgcgaggctcggggg

SEQ ID NO: 386819 - DNA, 20 bp, human
gtcacccggctgcgactcgc

SEQ ID NO: 386820 - DNA, 20 bp, human
gtaatcacaggcacctccgg

SEQ ID NO: 386821 - DNA, 20 bp, human
ggctgcggaattgatgtaat

SEQ ID NO: 386822 - DNA, 20 bp, human
gggcggggcactgaaggggg

SEQ ID NO: 386823 - DNA, 20 bp, human
gtcgcggcactcgagtcacc

SEQ ID NO: 386824 - DNA, 20 bp, human
gacccggaagtgcggtccca

SEQ ID NO: 386825 - DNA, 20 bp, human
ggagcctcgcgtgctcgcgc

SEQ ID NO: 386826 - DNA, 20 bp, human
gccacagcgtccacagtacc

SEQ ID NO: 386827 - DNA, 20 bp, human
gccggagagcgattcccaag

SEQ ID NO: 386828 - DNA, 20 bp, human
gacggtgtcagcaggcaaca

SEQ ID NO: 386829 - DNA, 20 bp, human
gtgtgctctggggaggacgt

SEQ ID NO: 386830 - DNA, 20 bp, human
gtgccggagcgtggcgtcac

SEQ ID NO: 386831 - DNA, 20 bp, human
gctccggcctaacctgtagt

SEQ ID NO: 386832 - DNA, 20 bp, human
gctcctgtgacgccacgctc

SEQ ID NO: 386833 - DNA, 20 bp, human
gaggagcgtcgcgtcacgtg

SEQ ID NO: 386834 - DNA, 20 bp, human
gcacaaacctactacaggtt

SEQ ID NO: 386835 - DNA, 20 bp, human
ggcccagggtctctgccacc

SEQ ID NO: 386836 - DNA, 20 bp, human
gtgcgcgcggcgagacgtcc

SEQ ID NO: 386837 - DNA, 20 bp, human
gcgctcctcgacagctctcc

SEQ ID NO: 386838 - DNA, 20 bp, human
gagacgtcctggaaactata

SEQ ID NO: 386839 - DNA, 20 bp, human
gtcctggaaactatacggtc

SEQ ID NO: 386840 - DNA, 20 bp, human
ggtgcgcaggcgcatcaatg

SEQ ID NO: 386841 - DNA, 20 bp, human
gactgcctggagagctgtcg

SEQ ID NO: 386842 - DNA, 20 bp, human
gcggccaggccaacctcagc

SEQ ID NO: 386843 - DNA, 20 bp, human
gaaaatccgcgtggactcca

SEQ ID NO: 386844 - DNA, 20 bp, human
gcgccctcgcaaccgcggcc

SEQ ID NO: 386845 - DNA, 20 bp, human
gcagaaacactgggcacagg

SEQ ID NO: 386846 - DNA, 20 bp, human
gtgcgcgcgcacaaagactg

SEQ ID NO: 386847 - DNA, 20 bp, human
gaccgcgaagaggtcggcgg

SEQ ID NO: 386848 - DNA, 20 bp, human
gaccacgcccccttcacctc

SEQ ID NO: 386849 - DNA, 20 bp, human
gcgacagggcgcagtaaaaa

SEQ ID NO: 386850 - DNA, 20 bp, human
gcccgctccggccaggatgt

SEQ ID NO: 386851 - DNA, 20 bp, human
ggtggggtgcaagaccagga

SEQ ID NO: 386852 - DNA, 20 bp, human
gcccctcgcgctattgtcgg

SEQ ID NO: 386853 - DNA, 20 bp, human
gtgggtgaccgcgaagaggt

SEQ ID NO: 386854 - DNA, 20 bp, human
gcatgggtgctgggatcccg

SEQ ID NO: 386855 - DNA, 20 bp, human
ggaggtgggtgaccgcgaag

SEQ ID NO: 386856 - DNA, 20 bp, human
gcccgctggctgcatcctaa

SEQ ID NO: 386857 - DNA, 20 bp, human
gcagccagcgggcctgagag

SEQ ID NO: 386858 - DNA, 20 bp, human
gggcggcccgccactccgga

SEQ ID NO: 386859 - DNA, 20 bp, human
ggggcgggcccgaggccctc

SEQ ID NO: 386860 - DNA, 20 bp, human
gggaacagatgaagcacatc

SEQ ID NO: 386861 - DNA, 20 bp, human
ggccgggcggcccgccactc

SEQ ID NO: 386862 - DNA, 20 bp, human
gcgccactccggagggcctc

SEQ ID NO: 386863 - DNA, 20 bp, human
gtcgctgatgtggcactcgg

SEQ ID NO: 386864 - DNA, 20 bp, human
ggaggggcataacagggccg

SEQ ID NO: 386865 - DNA, 20 bp, human
ggcgcggccgggacggctcg

SEQ ID NO: 386866 - DNA, 20 bp, human
gatctccacgggaaagtcaa

SEQ ID NO: 386867 - DNA, 20 bp, human
gcatctcaggaggtccaggt

SEQ ID NO: 386868 - DNA, 20 bp, human
gggaccgggaagggcggtca

SEQ ID NO: 386869 - DNA, 20 bp, human
gcaggcctttgactttcccg

SEQ ID NO: 386870 - DNA, 20 bp, human
gaggttggttgcagtcctct

SEQ ID NO: 386871 - DNA, 20 bp, human
gggcggtcaagggtggaaag

SEQ ID NO: 386872 - DNA, 20 bp, human
gaagggtggaaaggggctgg

SEQ ID NO: 386873 - DNA, 20 bp, human
ggtcaagggtggaaaggggc

SEQ ID NO: 386874 - DNA, 20 bp, human
gctgttatcagatgggaaca

SEQ ID NO: 386875 - DNA, 20 bp, human
gcaaaggaagaaggtgccaa

SEQ ID NO: 386876 - DNA, 20 bp, human
gaggcggtgccgtacgggga

SEQ ID NO: 386877 - DNA, 20 bp, human
gcgggacaggcgcgagcctc

SEQ ID NO: 386878 - DNA, 20 bp, human
gcccgcctctggcccgcggg

SEQ ID NO: 386879 - DNA, 20 bp, human
ggccgcgcgctgcgaatcgg

SEQ ID NO: 386880 - DNA, 20 bp, human
gctccagttcccagtgccgg

SEQ ID NO: 386881 - DNA, 20 bp, human
gggccagcacttggtggctt

SEQ ID NO: 386882 - DNA, 20 bp, human
gaggcgcgagcctccggcac

SEQ ID NO: 386883 - DNA, 20 bp, human
gaaaaggaaacccacgtgac

SEQ ID NO: 386884 - DNA, 20 bp, human
gcgggaggcggtgccgtacg

SEQ ID NO: 386885 - DNA, 20 bp, human
gggtgccgtacggggagggg

SEQ ID NO: 386886 - DNA, 20 bp, human
gtctggaagcagcgtggggt

SEQ ID NO: 386887 - DNA, 20 bp, human
gtggatgagccgcgactgga

SEQ ID NO: 386888 - DNA, 20 bp, human
gcagtcgcggctcatccacc

SEQ ID NO: 386889 - DNA, 20 bp, human
gcaccttcgacactggagga

SEQ ID NO: 386890 - DNA, 20 bp, human
gggaggagggggtactggag

SEQ ID NO: 386891 - DNA, 20 bp, human
ggaaaggtgcaatgagtaca

SEQ ID NO: 386892 - DNA, 20 bp, human
gggctcatccacccggccga

SEQ ID NO: 386893 - DNA, 20 bp, human
gtgcccaccttcgacactgg

SEQ ID NO: 386894 - DNA, 20 bp, human
gacactggaggagggggtac

SEQ ID NO: 386895 - DNA, 20 bp, human
ggcggtgggcgtgtccgggg

SEQ ID NO: 386896 - DNA, 20 bp, human
gctcgtcacctcactcaaga

SEQ ID NO: 386897 - DNA, 20 bp, human
gttcgtacccgtcttgagtg

SEQ ID NO: 386898 - DNA, 20 bp, human
ggggtggcaggaagagtgcc

SEQ ID NO: 386899 - DNA, 20 bp, human
gtctgcgcatgcccgggcgc

SEQ ID NO: 386900 - DNA, 20 bp, human
gcagccctctcaggggtggg

SEQ ID NO: 386901 - DNA, 20 bp, human
ggcggggcgccgggtccgga

SEQ ID NO: 386902 - DNA, 20 bp, human
ggcgcagccctctcaggggt

SEQ ID NO: 386903 - DNA, 20 bp, human
gcatgcggacacggggcgga

SEQ ID NO: 386904 - DNA, 20 bp, human
gtccagctgtgaacccagag

SEQ ID NO: 386905 - DNA, 20 bp, human
ggcccgggcgctgggttcag

SEQ ID NO: 386906 - DNA, 20 bp, human
gggcgctcctcgcgaccaat

SEQ ID NO: 386907 - DNA, 20 bp, human
ggagctccgagggacggggt

SEQ ID NO: 386908 - DNA, 20 bp, human
gccacttgctgcacgccgat

SEQ ID NO: 386909 - DNA, 20 bp, human
ggggcgagctccgagggacg

SEQ ID NO: 386910 - DNA, 20 bp, human
gatagagcgccggtgaggcg

SEQ ID NO: 386911 - DNA, 20 bp, human
gtctgaactccggctccggg

SEQ ID NO: 386912 - DNA, 20 bp, human
gcggcggccgcccaccggca

SEQ ID NO: 386913 - DNA, 20 bp, human
gagacgcgaggatagagcgc

SEQ ID NO: 386914 - DNA, 20 bp, human
ggggtctgaactccggctcc

SEQ ID NO: 386915 - DNA, 20 bp, human
ggcccggaaccgtagatagc

SEQ ID NO: 386916 - DNA, 20 bp, human
gggcccgggggtggtgccga

SEQ ID NO: 386917 - DNA, 20 bp, human
gcagctgcgatccctcgcct

SEQ ID NO: 386918 - DNA, 20 bp, human
gtccctagggcccagagaat

SEQ ID NO: 386919 - DNA, 20 bp, human
ggggcggtgccggccaggag

SEQ ID NO: 386920 - DNA, 20 bp, human
gcgctccagcggcatacgct

SEQ ID NO: 386921 - DNA, 20 bp, human
gcaacccttgccagccgagt

SEQ ID NO: 386922 - DNA, 20 bp, human
gccagccgagttggataaga

SEQ ID NO: 386923 - DNA, 20 bp, human
gatccctcgcctcgggcccg

SEQ ID NO: 386924 - DNA, 20 bp, human
gcaagggttggggagaactt

SEQ ID NO: 386925 - DNA, 20 bp, human
ggcggcatacgctggggagt

SEQ ID NO: 386926 - DNA, 20 bp, human
gactgaaggcgcctcctacc

SEQ ID NO: 386927 - DNA, 20 bp, human
gttccaaaggcggaattcat

SEQ ID NO: 386928 - DNA, 20 bp, human
gaccgcctccagacgaaaat

SEQ ID NO: 386929 - DNA, 20 bp, human
gggcagctggctggcgtcac

SEQ ID NO: 386930 - DNA, 20 bp, human
gtacccatgaattccgcctt

SEQ ID NO: 386931 - DNA, 20 bp, human
gggatcgagccgaggactga

SEQ ID NO: 386932 - DNA, 20 bp, human
gacgccagccagctgcctat

SEQ ID NO: 386933 - DNA, 20 bp, human
gagccagaatggcgggctga

SEQ ID NO: 386934 - DNA, 20 bp, human
ggcggtggattcccggtagg

SEQ ID NO: 386935 - DNA, 20 bp, human
ggaggcggtggattcccggt

SEQ ID NO: 386936 - DNA, 20 bp, human
gcctgcgtggggcgtccagt

SEQ ID NO: 386937 - DNA, 20 bp, human
gcacaggcgcacacgcctac

SEQ ID NO: 386938 - DNA, 20 bp, human
ggctctgggcggtgcccgga

SEQ ID NO: 386939 - DNA, 20 bp, human
ggcgaggcctgcgacgaacg

SEQ ID NO: 386940 - DNA, 20 bp, human
ggcggggcctgcggcgaaca

SEQ ID NO: 386941 - DNA, 20 bp, human
ggagtggaggcccagcgaat

SEQ ID NO: 386942 - DNA, 20 bp, human
gaggcgtgtgcgcctgtggg

SEQ ID NO: 386943 - DNA, 20 bp, human
gagcaaaccgcgttcgtcgc

SEQ ID NO: 386944 - DNA, 20 bp, human
ggctgcgtgaggcgtcctgt

SEQ ID NO: 386945 - DNA, 20 bp, human
ggggcggggtttactctgag

SEQ ID NO: 386946 - DNA, 20 bp, human
gtcaatgggaagtgaagtca

SEQ ID NO: 386947 - DNA, 20 bp, human
gcagtcttaccccaatgctt

SEQ ID NO: 386948 - DNA, 20 bp, human
ggcattggggtaagactgag

SEQ ID NO: 386949 - DNA, 20 bp, human
ggagaggttgccaagtgaac

SEQ ID NO: 386950 - DNA, 20 bp, human
gaggaaagccatctcatctt

SEQ ID NO: 386951 - DNA, 20 bp, human
ggggtttcaaagagcaagaa

SEQ ID NO: 386952 - DNA, 20 bp, human
gatcaacatagtgaagggga

SEQ ID NO: 386953 - DNA, 20 bp, human
gtgattatcaacatagtgaa

SEQ ID NO: 386954 - DNA, 20 bp, human
gcatttatatccctaagcat

SEQ ID NO: 386955 - DNA, 20 bp, human
gctcagttatctatttcaat

SEQ ID NO: 386956 - DNA, 20 bp, human
ggggcggggcatggttgcta

SEQ ID NO: 386957 - DNA, 20 bp, human
gggctctggaagagactcgg

SEQ ID NO: 386958 - DNA, 20 bp, human
gtggctgcgggtcagtaata

SEQ ID NO: 386959 - DNA, 20 bp, human
gcgggtcagtaataggggcg

SEQ ID NO: 386960 - DNA, 20 bp, human
gtgctagggccgagctagtg

SEQ ID NO: 386961 - DNA, 20 bp, human
ggctagtggggtgaggcgag

SEQ ID NO: 386962 - DNA, 20 bp, human
ggcctctcacctacatgaga

SEQ ID NO: 386963 - DNA, 20 bp, human
gcctcacccgggcgcctcct

SEQ ID NO: 386964 - DNA, 20 bp, human
gggagggcggggccgcatga

SEQ ID NO: 386965 - DNA, 20 bp, human
gagagcgcggcgcagggatt

SEQ ID NO: 386966 - DNA, 20 bp, human
gccgccggtgggctgaggga

SEQ ID NO: 386967 - DNA, 20 bp, human
gcgggcccgcggcaagttgg

SEQ ID NO: 386968 - DNA, 20 bp, human
gccctcccggccggtcggac

SEQ ID NO: 386969 - DNA, 20 bp, human
gagggagggcggctcggcgc

SEQ ID NO: 386970 - DNA, 20 bp, human
gcgtgcccctcccggccggt

SEQ ID NO: 386971 - DNA, 20 bp, human
gcggcgggcccgctctagaa

SEQ ID NO: 386972 - DNA, 20 bp, human
ggggcggcccggggggtgac

SEQ ID NO: 386973 - DNA, 20 bp, human
ggactcagcgggcgggccat

SEQ ID NO: 386974 - DNA, 20 bp, human
gcggcgcctgactcagcggg

SEQ ID NO: 386975 - DNA, 20 bp, human
gctaaaggcaagcgcagaga

SEQ ID NO: 386976 - DNA, 20 bp, human
gggaagggaagcgcgctggg

SEQ ID NO: 386977 - DNA, 20 bp, human
gaaagggggtcgagagtaaa

SEQ ID NO: 386978 - DNA, 20 bp, human
ggctgctcctcccactctgc

SEQ ID NO: 386979 - DNA, 20 bp, human
gaaggcaggaagcgggggga

SEQ ID NO: 386980 - DNA, 20 bp, human
gccagccagccagagaaaag

SEQ ID NO: 386981 - DNA, 20 bp, human
gaagatgccaagtaactgaa

SEQ ID NO: 386982 - DNA, 20 bp, human
ggggcccgggatgtgtcaca

SEQ ID NO: 386983 - DNA, 20 bp, human
ggcgcgctgggaggcatggc

SEQ ID NO: 386984 - DNA, 20 bp, human
gggaccaactgggaaacgcg

SEQ ID NO: 386985 - DNA, 20 bp, human
gcgagagtaaatgggatgga

SEQ ID NO: 386986 - DNA, 20 bp, human
gcagaccaggaggtagggct

SEQ ID NO: 386987 - DNA, 20 bp, human
gcgtcgctccccaatggaaa

SEQ ID NO: 386988 - DNA, 20 bp, human
ggcagcctagccctacctcc

SEQ ID NO: 386989 - DNA, 20 bp, human
gccgtctagcagcacgtgat

SEQ ID NO: 386990 - DNA, 20 bp, human
gtaggctgcgtctgctcaac

SEQ ID NO: 386991 - DNA, 20 bp, human
gtttgtgcgtcgctccccaa

SEQ ID NO: 386992 - DNA, 20 bp, human
gggtctggaggtagcgcgat

SEQ ID NO: 386993 - DNA, 20 bp, human
ggcgaataatagcatgaccc

SEQ ID NO: 386994 - DNA, 20 bp, human
gaataatagcatgacccggg

SEQ ID NO: 386995 - DNA, 20 bp, human
ggcagctctccttttccatt

SEQ ID NO: 386996 - DNA, 20 bp, human
gggcaagaaggtctgctcgg

SEQ ID NO: 386997 - DNA, 20 bp, human
gaactggcgggactcgagtg

SEQ ID NO: 386998 - DNA, 20 bp, human
gcccgcagcggtcagtacct

SEQ ID NO: 386999 - DNA, 20 bp, human
gcacaccttgccaagggcag

SEQ ID NO: 387000 - DNA, 20 bp, human
gggcagagggtgcaattccc

SEQ ID NO: 387001 - DNA, 20 bp, human
gtctgctcggcggcccgcct

SEQ ID NO: 387002 - DNA, 20 bp, human
gggccccgcccactttggcc

SEQ ID NO: 387003 - DNA, 20 bp, human
gctccgaccctggccaaagt

SEQ ID NO: 387004 - DNA, 20 bp, human
ggccccaaagaagaactggc

SEQ ID NO: 387005 - DNA, 20 bp, human
gcagggcaagaaggtctgct

SEQ ID NO: 387006 - DNA, 20 bp, human
gggcaagaaggtctgctcgg

SEQ ID NO: 387007 - DNA, 20 bp, human
gaactggcgggactcgagtg

SEQ ID NO: 387008 - DNA, 20 bp, human
gcccgcagcggtcagtacct

SEQ ID NO: 387009 - DNA, 20 bp, human
gtctgctcggcggcccgcct

SEQ ID NO: 387010 - DNA, 20 bp, human
gcacaccttgccaagggcag

SEQ ID NO: 387011 - DNA, 20 bp, human
gggcagagggtgcaattccc

SEQ ID NO: 387012 - DNA, 20 bp, human
gggccccgcccactttggcc

SEQ ID NO: 387013 - DNA, 20 bp, human
gctccgaccctggccaaagt

SEQ ID NO: 387014 - DNA, 20 bp, human
gcagggcaagaaggtctgct

SEQ ID NO: 387015 - DNA, 20 bp, human
ggtaacccgagcccgcagtc

SEQ ID NO: 387016 - DNA, 20 bp, human
gccgctgtcggccaatccca

SEQ ID NO: 387017 - DNA, 20 bp, human
ggccgacagcggtttaccgg

SEQ ID NO: 387018 - DNA, 20 bp, human
gcggctccgacggacggccc

SEQ ID NO: 387019 - DNA, 20 bp, human
gctccgacggacggcccggg

SEQ ID NO: 387020 - DNA, 20 bp, human
gacccagacactataatgat

SEQ ID NO: 387021 - DNA, 20 bp, human
gcttccgtccttcaaagggg

SEQ ID NO: 387022 - DNA, 20 bp, human
gctagaacccgcccctttga

SEQ ID NO: 387023 - DNA, 20 bp, human
ggccaccggtaaaccgctgt

SEQ ID NO: 387024 - DNA, 20 bp, human
gggagggggtagcacgggga

SEQ ID NO: 387025 - DNA, 20 bp, human
gcctcctcggctccgacgga

SEQ ID NO: 387026 - DNA, 20 bp, human
gactacgaacttcttctcct

SEQ ID NO: 387027 - DNA, 20 bp, human
gggagctgaagtgacagcgg

SEQ ID NO: 387028 - DNA, 20 bp, human
gaggaggcggcagtttctgg

SEQ ID NO: 387029 - DNA, 20 bp, human
gcgggcggaaggcgcgctga

SEQ ID NO: 387030 - DNA, 20 bp, human
gggggcatgtagttctccgt

SEQ ID NO: 387031 - DNA, 20 bp, human
gctccagactgcaacctcgt

SEQ ID NO: 387032 - DNA, 20 bp, human
ggcggaagcaacggtcggtg

SEQ ID NO: 387033 - DNA, 20 bp, human
gttcgcgctaacgcttgcga

SEQ ID NO: 387034 - DNA, 20 bp, human
gaccgtgcgcctcccgccta

SEQ ID NO: 387035 - DNA, 20 bp, human
gggcggagctgaagtgacag

SEQ ID NO: 387036 - DNA, 20 bp, human
ggggcggggcaggtgcatcg

SEQ ID NO: 387037 - DNA, 20 bp, human
gcacccgaggcgtgcgggtc

SEQ ID NO: 387038 - DNA, 20 bp, human
gtgtcctgggacccccgcga

SEQ ID NO: 387039 - DNA, 20 bp, human
gccgcccgacccgcacgcct

SEQ ID NO: 387040 - DNA, 20 bp, human
gcccgcgatgggatagacgg

SEQ ID NO: 387041 - DNA, 20 bp, human
gacggaggatgcagcggctg

SEQ ID NO: 387042 - DNA, 20 bp, human
gttcccaggctgcctcgctc

SEQ ID NO: 387043 - DNA, 20 bp, human
gacccccgcgatgggataga

SEQ ID NO: 387044 - DNA, 20 bp, human
gagctgcgctgcggcacccg

SEQ ID NO: 387045 - DNA, 20 bp, human
ggcgatgggatagacggtgg

SEQ ID NO: 387046 - DNA, 20 bp, human
ggcccctgagcctaccctat

SEQ ID NO: 387047 - DNA, 20 bp, human
ggggacctctgaatccagat

SEQ ID NO: 387048 - DNA, 20 bp, human
ggacgccaatctggattcag

SEQ ID NO: 387049 - DNA, 20 bp, human
gcccgcgggcagcctcgttg

SEQ ID NO: 387050 - DNA, 20 bp, human
gggtagagaggacgccaatc

SEQ ID NO: 387051 - DNA, 20 bp, human
gaaagtaaggaaaggtcggt

SEQ ID NO: 387052 - DNA, 20 bp, human
gctaacccgtgacagtagag

SEQ ID NO: 387053 - DNA, 20 bp, human
gcccgcctctctactgtcac

SEQ ID NO: 387054 - DNA, 20 bp, human
gctactgtcacgggttagta

SEQ ID NO: 387055 - DNA, 20 bp, human
gggcgtcctctctacctata

SEQ ID NO: 387056 - DNA, 20 bp, human
gtgacggcccccaggaccca

SEQ ID NO: 387057 - DNA, 20 bp, human
ggggactcctaagccctgtc

SEQ ID NO: 387058 - DNA, 20 bp, human
gccgccctggagcgctcgcg

SEQ ID NO: 387059 - DNA, 20 bp, human
gcgcccccgcgagcgctcca

SEQ ID NO: 387060 - DNA, 20 bp, human
ggatccgcgccaaggcgttc

SEQ ID NO: 387061 - DNA, 20 bp, human
gcctccaggaccctagttcc

SEQ ID NO: 387062 - DNA, 20 bp, human
ggatcggaaccttgggtcct

SEQ ID NO: 387063 - DNA, 20 bp, human
gttggcgcggatcggaacct

SEQ ID NO: 387064 - DNA, 20 bp, human
gccttcctccccaggaacta

SEQ ID NO: 387065 - DNA, 20 bp, human
gtgaccggaacgccttggcg

SEQ ID NO: 387066 - DNA, 20 bp, human
gtaaggagatcgacccactg

SEQ ID NO: 387067 - DNA, 20 bp, human
gggaaggagaccgggaccag

SEQ ID NO: 387068 - DNA, 20 bp, human
gcacttgcgcggccagagag

SEQ ID NO: 387069 - DNA, 20 bp, human
gcaggagtgactgaccaagg

SEQ ID NO: 387070 - DNA, 20 bp, human
gaatgacggtggccgagtgg

SEQ ID NO: 387071 - DNA, 20 bp, human
gtctggccgcgcaagtgact

SEQ ID NO: 387072 - DNA, 20 bp, human
ggacggtggccgagtggtgg

SEQ ID NO: 387073 - DNA, 20 bp, human
gctgacgggcgcagcaccct

SEQ ID NO: 387074 - DNA, 20 bp, human
ggcctcccggccactggtcc

SEQ ID NO: 387075 - DNA, 20 bp, human
gagtcactcctgacctcagt

SEQ ID NO: 387076 - DNA, 20 bp, human
gcggggcagaggaccgccga

SEQ ID NO: 387077 - DNA, 20 bp, human
gaggtctgcaagccccggac

SEQ ID NO: 387078 - DNA, 20 bp, human
gcagctgactgcgcctcccg

SEQ ID NO: 387079 - DNA, 20 bp, human
gacgtgagctggccggtccg

SEQ ID NO: 387080 - DNA, 20 bp, human
gggcgcagtcagctgcgtac

SEQ ID NO: 387081 - DNA, 20 bp, human
gctgactgcgcctcccgcgg

SEQ ID NO: 387082 - DNA, 20 bp, human
ggacggaagagggtgcgccc

SEQ ID NO: 387083 - DNA, 20 bp, human
gcgtgccgggggacggaaga

SEQ ID NO: 387084 - DNA, 20 bp, human
ggaccgccgagggccaccgc

SEQ ID NO: 387085 - DNA, 20 bp, human
gcgcctcccgcggtggccct

SEQ ID NO: 387086 - DNA, 20 bp, human
gggctcatccaggacacagt

SEQ ID NO: 387087 - DNA, 20 bp, human
gagggggcgacatggagcaa

SEQ ID NO: 387088 - DNA, 20 bp, human
gagtgggcagatccccagag

SEQ ID NO: 387089 - DNA, 20 bp, human
gctccatgtcgccccctctg

SEQ ID NO: 387090 - DNA, 20 bp, human
ggcattgtgggacaatctca

SEQ ID NO: 387091 - DNA, 20 bp, human
gatccccagagggggcgaca

SEQ ID NO: 387092 - DNA, 20 bp, human
gacaatgcagccattctctg

SEQ ID NO: 387093 - DNA, 20 bp, human
ggggagtgaggtgttgtctg

SEQ ID NO: 387094 - DNA, 20 bp, human
ggacactgccaggcacgcag

SEQ ID NO: 387095 - DNA, 20 bp, human
gtagcctcgaggactcgtgt

SEQ ID NO: 387096 - DNA, 20 bp, human
gaagaggccgcgtggggcga

SEQ ID NO: 387097 - DNA, 20 bp, human
gaggccgcgtggggcgaagg

SEQ ID NO: 387098 - DNA, 20 bp, human
ggcgcgcaggcgctaggaag

SEQ ID NO: 387099 - DNA, 20 bp, human
gcggccgcggcagtgtatgg

SEQ ID NO: 387100 - DNA, 20 bp, human
ggctaggaagaggccgcgtg

SEQ ID NO: 387101 - DNA, 20 bp, human
gaggcggcgcttggctggtg

SEQ ID NO: 387102 - DNA, 20 bp, human
gcggcgagagcggtatggtg

SEQ ID NO: 387103 - DNA, 20 bp, human
ggcccgcggcgggattttcc

SEQ ID NO: 387104 - DNA, 20 bp, human
ggtggggcgaaggcggcgct

SEQ ID NO: 387105 - DNA, 20 bp, human
ggcccgggaaaatcccgccg

SEQ ID NO: 387106 - DNA, 20 bp, human
gggagcctgggtcttcgcgt

SEQ ID NO: 387107 - DNA, 20 bp, human
gccaaggttggcccctgctt

SEQ ID NO: 387108 - DNA, 20 bp, human
gcatgcctcagggagggcga

SEQ ID NO: 387109 - DNA, 20 bp, human
gagccagccccacctggcaa

SEQ ID NO: 387110 - DNA, 20 bp, human
gagcgacagggtctctgagg

SEQ ID NO: 387111 - DNA, 20 bp, human
ggcaggtcagagaagctttg

SEQ ID NO: 387112 - DNA, 20 bp, human
gtggcttcgcccagccggcg

SEQ ID NO: 387113 - DNA, 20 bp, human
gagatcctacgcgaagaccc

SEQ ID NO: 387114 - DNA, 20 bp, human
gcactgtgagagaggcatcc

SEQ ID NO: 387115 - DNA, 20 bp, human
ggccaaggcccaatgcatca

SEQ ID NO: 387116 - DNA, 20 bp, human
ggggcagcgcgtcacgggag

SEQ ID NO: 387117 - DNA, 20 bp, human
gctggcgggcagcgcgtcac

SEQ ID NO: 387118 - DNA, 20 bp, human
ggggcgggcaccaccggagt

SEQ ID NO: 387119 - DNA, 20 bp, human
ggctgcggagggaaaccact

SEQ ID NO: 387120 - DNA, 20 bp, human
gcggagggaaaccactggga

SEQ ID NO: 387121 - DNA, 20 bp, human
ggggtcgcctcggtccgaga

SEQ ID NO: 387122 - DNA, 20 bp, human
gccctctggccgacaagggg

SEQ ID NO: 387123 - DNA, 20 bp, human
ggagagcgaggctgcaacga

SEQ ID NO: 387124 - DNA, 20 bp, human
gtagaagggcgcggagtcag

SEQ ID NO: 387125 - DNA, 20 bp, human
gcgtccgcgtgggccagcgg

SEQ ID NO: 387126 - DNA, 20 bp, human
ggggccgccctccctcctag

SEQ ID NO: 387127 - DNA, 20 bp, human
gggtgcgtgaaggtggaagg

SEQ ID NO: 387128 - DNA, 20 bp, human
gccgccctccctcctagggg

SEQ ID NO: 387129 - DNA, 20 bp, human
gctcccgcgctggtgcgtga

SEQ ID NO: 387130 - DNA, 20 bp, human
gcaccttcacgcaccagcgc

SEQ ID NO: 387131 - DNA, 20 bp, human
gggaacggggcggggcgaaa

SEQ ID NO: 387132 - DNA, 20 bp, human
gcccacttctgctgccgcta

SEQ ID NO: 387133 - DNA, 20 bp, human
ggctggtgcgtgaaggtgga

SEQ ID NO: 387134 - DNA, 20 bp, human
gggcagcagaagtgggaacg

SEQ ID NO: 387135 - DNA, 20 bp, human
ggcacgctcctcccctagga

SEQ ID NO: 387136 - DNA, 20 bp, human
ggggaggcacggctggaggc

SEQ ID NO: 387137 - DNA, 20 bp, human
gccgcagcggcagtgacgta

SEQ ID NO: 387138 - DNA, 20 bp, human
gactgccgctgcggcccgtg

SEQ ID NO: 387139 - DNA, 20 bp, human
gaggcgtggcgccgcggtgt

SEQ ID NO: 387140 - DNA, 20 bp, human
gggcacggctggaggcgggt

SEQ ID NO: 387141 - DNA, 20 bp, human
gaagccgcgctgtgctccag

SEQ ID NO: 387142 - DNA, 20 bp, human
gttggcgcacggatccgttg

SEQ ID NO: 387143 - DNA, 20 bp, human
gcgtggcgccgcggtgtggg

SEQ ID NO: 387144 - DNA, 20 bp, human
gcgcggcggcgacaggccct

SEQ ID NO: 387145 - DNA, 20 bp, human
ggtaggcgatgcagtttgag

SEQ ID NO: 387146 - DNA, 20 bp, human
gggcaggtccagtaaagaat

SEQ ID NO: 387147 - DNA, 20 bp, human
ggacctgccaacttcgcgca

SEQ ID NO: 387148 - DNA, 20 bp, human
gcccccatcagcctctgcgg

SEQ ID NO: 387149 - DNA, 20 bp, human
gtaccaaccctgcgcgaagt

SEQ ID NO: 387150 - DNA, 20 bp, human
gagccccccatcagcctctg

SEQ ID NO: 387151 - DNA, 20 bp, human
gaaccctgcgcgaagttggc

SEQ ID NO: 387152 - DNA, 20 bp, human
gagttcctctacttacgata

SEQ ID NO: 387153 - DNA, 20 bp, human
gtgattggacaacccaagtc

SEQ ID NO: 387154 - DNA, 20 bp, human
ggcagccctatcgtaagtag

SEQ ID NO: 387155 - DNA, 20 bp, human
gacttccggtacccggactt

SEQ ID NO: 387156 - DNA, 20 bp, human
gctccgaggggccacgggaa

SEQ ID NO: 387157 - DNA, 20 bp, human
gccgccggaagtggctccga

SEQ ID NO: 387158 - DNA, 20 bp, human
gacttccggcggcagcgtcc

SEQ ID NO: 387159 - DNA, 20 bp, human
gctcgcgccgggaactagcc

SEQ ID NO: 387160 - DNA, 20 bp, human
gtggatgaggagatagaaac

SEQ ID NO: 387161 - DNA, 20 bp, human
gcgcctgccgggcctccgct

SEQ ID NO: 387162 - DNA, 20 bp, human
ggctgcagcccgggccgcga

SEQ ID NO: 387163 - DNA, 20 bp, human
gcgcccgcaagccctggatg

SEQ ID NO: 387164 - DNA, 20 bp, human
gaaccgagcggaggcccggc

SEQ ID NO: 387165 - DNA, 20 bp, human
gcgggcctccgctcggttac

SEQ ID NO: 387166 - DNA, 20 bp, human
gcctcaggcggcacgaggaa

SEQ ID NO: 387167 - DNA, 20 bp, human
ggggtatcgcactactggaa

SEQ ID NO: 387168 - DNA, 20 bp, human
gtgggcgcgtatgaatgagt

SEQ ID NO: 387169 - DNA, 20 bp, human
gccgcccttcgcttgggcgg

SEQ ID NO: 387170 - DNA, 20 bp, human
gcaaggggcgggctgtggga

SEQ ID NO: 387171 - DNA, 20 bp, human
gagacttcaggtaggagaaa

SEQ ID NO: 387172 - DNA, 20 bp, human
gcaagcgaagggcgggattc

SEQ ID NO: 387173 - DNA, 20 bp, human
ggacgcgcacacgagaagta

SEQ ID NO: 387174 - DNA, 20 bp, human
gacccaatgagacttcaggt

SEQ ID NO: 387175 - DNA, 20 bp, human
gcactcccccgcccaagcga

SEQ ID NO: 387176 - DNA, 20 bp, human
gataacgcgcgcggccggga

SEQ ID NO: 387177 - DNA, 20 bp, human
gtgggcatgcgccacttgtg

SEQ ID NO: 387178 - DNA, 20 bp, human
ggagccaaggacagagcggc

SEQ ID NO: 387179 - DNA, 20 bp, human
gcacccgactgccgcacaag

SEQ ID NO: 387180 - DNA, 20 bp, human
ggcatcacgcgggtgacgag

SEQ ID NO: 387181 - DNA, 20 bp, human
gccagcccgggacgcctgac

SEQ ID NO: 387182 - DNA, 20 bp, human
ggagcccgccgctctgtcct

SEQ ID NO: 387183 - DNA, 20 bp, human
gaagccgtgtctcgcagtcg

SEQ ID NO: 387184 - DNA, 20 bp, human
ggccagaaacagcatcacgc

SEQ ID NO: 387185 - DNA, 20 bp, human
ggctgccagtcaggcgtccc

SEQ ID NO: 387186 - DNA, 20 bp, human
gccactgatgtgagcccaac

SEQ ID NO: 387187 - DNA, 20 bp, human
gtgaggtcacacttcctgtt

SEQ ID NO: 387188 - DNA, 20 bp, human
gtgaccagggtgtaaccagc

SEQ ID NO: 387189 - DNA, 20 bp, human
gaccacccctccagtgacca

SEQ ID NO: 387190 - DNA, 20 bp, human
gtgagctaacttgtcacctt

SEQ ID NO: 387191 - DNA, 20 bp, human
gaccagctggcctgacacat

SEQ ID NO: 387192 - DNA, 20 bp, human
ggttacaccctggtcactgg

SEQ ID NO: 387193 - DNA, 20 bp, human
gaggccagctggttacaccc

SEQ ID NO: 387194 - DNA, 20 bp, human
gagatttcagagagtttcct

SEQ ID NO: 387195 - DNA, 20 bp, human
ggtagagctcaaagacttga

SEQ ID NO: 387196 - DNA, 20 bp, human
gcgcctgagatcggcgatta

SEQ ID NO: 387197 - DNA, 20 bp, human
gtgagatcggcgattagggc

SEQ ID NO: 387198 - DNA, 20 bp, human
gaggcggctgggctgcgctg

SEQ ID NO: 387199 - DNA, 20 bp, human
gcctggccgaggtgtgaata

SEQ ID NO: 387200 - DNA, 20 bp, human
ggctggcaattaaccgtttc

SEQ ID NO: 387201 - DNA, 20 bp, human
gcagcaggagcattcttcca

SEQ ID NO: 387202 - DNA, 20 bp, human
gaagggcctggcccactcct

SEQ ID NO: 387203 - DNA, 20 bp, human
gtgctcacacaaccccagcc

SEQ ID NO: 387204 - DNA, 20 bp, human
gtcgccgatctcaggcggct

SEQ ID NO: 387205 - DNA, 20 bp, human
gtcggcgattagggctgggc

SEQ ID NO: 387206 - DNA, 20 bp, human
gaggaagggtaaaacccaga

SEQ ID NO: 387207 - DNA, 20 bp, human
gaaaacccagaaggcgtggg

SEQ ID NO: 387208 - DNA, 20 bp, human
gcccacccggcggagccgag

SEQ ID NO: 387209 - DNA, 20 bp, human
gatggcgggaactcatctgc

SEQ ID NO: 387210 - DNA, 20 bp, human
ggggcagcgcccgccacggc

SEQ ID NO: 387211 - DNA, 20 bp, human
gccaccccgcccgccgtggc

SEQ ID NO: 387212 - DNA, 20 bp, human
ggcgggcgctgcccacccgg

SEQ ID NO: 387213 - DNA, 20 bp, human
gggagccgagcggcgtgcag

SEQ ID NO: 387214 - DNA, 20 bp, human
ggcccctggcctacaactcc

SEQ ID NO: 387215 - DNA, 20 bp, human
gtacaactcccgggatgctc

SEQ ID NO: 387216 - DNA, 20 bp, human
ggaggggcccgtggggtaag

SEQ ID NO: 387217 - DNA, 20 bp, human
ggacccggggtcctacctgg

SEQ ID NO: 387218 - DNA, 20 bp, human
gccaagaggggtgttctcct

SEQ ID NO: 387219 - DNA, 20 bp, human
gtggagtgctccgcccaaga

SEQ ID NO: 387220 - DNA, 20 bp, human
gcagcccccaggtaggaccc

SEQ ID NO: 387221 - DNA, 20 bp, human
gcggtctcctcgggcgcttg

SEQ ID NO: 387222 - DNA, 20 bp, human
gcccagatggaggggcccgt

SEQ ID NO: 387223 - DNA, 20 bp, human
gcgtcccgacctaaggacct

SEQ ID NO: 387224 - DNA, 20 bp, human
gggtgaacaggctgtgaaaa

SEQ ID NO: 387225 - DNA, 20 bp, human
gaggtcgggacggtctcctc

SEQ ID NO: 387226 - DNA, 20 bp, human
gggcagccgcctcacagcga

SEQ ID NO: 387227 - DNA, 20 bp, human
gggccgccatcgctgtgagg

SEQ ID NO: 387228 - DNA, 20 bp, human
gccactggtccgcaactgtg

SEQ ID NO: 387229 - DNA, 20 bp, human
gggaagtggggagacggcga

SEQ ID NO: 387230 - DNA, 20 bp, human
gagccaaggcccccccacag

SEQ ID NO: 387231 - DNA, 20 bp, human
gagccgcctcacagcgatgg

SEQ ID NO: 387232 - DNA, 20 bp, human
gcgcctgccaaatctcgcga

SEQ ID NO: 387233 - DNA, 20 bp, human
ggcgtgagagcagccaccga

SEQ ID NO: 387234 - DNA, 20 bp, human
gccggagacggcagtgttgg

SEQ ID NO: 387235 - DNA, 20 bp, human
gacggcagtgttggcggtag

SEQ ID NO: 387236 - DNA, 20 bp, human
gagtccgtccggcaccgctc

SEQ ID NO: 387237 - DNA, 20 bp, human
gcgctcgggcactttcggaa

SEQ ID NO: 387238 - DNA, 20 bp, human
gggcactttcggaagggaag

SEQ ID NO: 387239 - DNA, 20 bp, human
gcggaagccgagtcagcccg

SEQ ID NO: 387240 - DNA, 20 bp, human
gcggtgccggacggactaat

SEQ ID NO: 387241 - DNA, 20 bp, human
ggcactaagctctctctgag

SEQ ID NO: 387242 - DNA, 20 bp, human
gaggtggagaaccgacgttc

SEQ ID NO: 387243 - DNA, 20 bp, human
gggagcggacgtccgagcca

SEQ ID NO: 387244 - DNA, 20 bp, human
gactaatcgggcctcggccg

SEQ ID NO: 387245 - DNA, 20 bp, human
ggccgaatgctcccgaacgt

SEQ ID NO: 387246 - DNA, 20 bp, human
gaaaaagcgtgaagactagt

SEQ ID NO: 387247 - DNA, 20 bp, human
gtgaagactagtaggtaagg

SEQ ID NO: 387248 - DNA, 20 bp, human
ggcgtgaagactagtaggta

SEQ ID NO: 387249 - DNA, 20 bp, human
gccagcctgggttgacagtg

SEQ ID NO: 387250 - DNA, 20 bp, human
gctagtttatagaggggaag

SEQ ID NO: 387251 - DNA, 20 bp, human
gtaaactaggatctaaatta

SEQ ID NO: 387252 - DNA, 20 bp, human
gtcttctttgtcttcccaag

SEQ ID NO: 387253 - DNA, 20 bp, human
gaacacgaaaacggccagcg

SEQ ID NO: 387254 - DNA, 20 bp, human
gcattaagagaacacgaaaa

SEQ ID NO: 387255 - DNA, 20 bp, human
ggactttaaatccacctctt

SEQ ID NO: 387256 - DNA, 20 bp, human
gctgcccgggctccccattt

SEQ ID NO: 387257 - DNA, 20 bp, human
gtcccagctccaggcacacg

SEQ ID NO: 387258 - DNA, 20 bp, human
gtgcccttctgggcctcgaa

SEQ ID NO: 387259 - DNA, 20 bp, human
gcaccccacactgcccaaat

SEQ ID NO: 387260 - DNA, 20 bp, human
gtgggaggggtcaaaggccc

SEQ ID NO: 387261 - DNA, 20 bp, human
gcaggggtgttaacccttcg

SEQ ID NO: 387262 - DNA, 20 bp, human
gactgcccaaatggggagcc

SEQ ID NO: 387263 - DNA, 20 bp, human
ggggcaaaggtgtcggtgga

SEQ ID NO: 387264 - DNA, 20 bp, human
gtccccatttgggcagtgtg

SEQ ID NO: 387265 - DNA, 20 bp, human
gaaggacagaccaacgtcac

SEQ ID NO: 387266 - DNA, 20 bp, human
gccttggcacggcctcccaa

SEQ ID NO: 387267 - DNA, 20 bp, human
ggcatctcccaggggtcaga

SEQ ID NO: 387268 - DNA, 20 bp, human
gcaggcccccggctgctgct

SEQ ID NO: 387269 - DNA, 20 bp, human
ggctgccagggccaatgagc

SEQ ID NO: 387270 - DNA, 20 bp, human
gtatccgccttctgacccct

SEQ ID NO: 387271 - DNA, 20 bp, human
gccggctgctgctcggagaa

SEQ ID NO: 387272 - DNA, 20 bp, human
ggggctagctgacagaaccc

SEQ ID NO: 387273 - DNA, 20 bp, human
ggccagggccaatgagcggg

SEQ ID NO: 387274 - DNA, 20 bp, human
gtggcagcggtgacgtcacg

SEQ ID NO: 387275 - DNA, 20 bp, human
gcacccaggcaccggggtca

SEQ ID NO: 387276 - DNA, 20 bp, human
gctaacctccccaggcagat

SEQ ID NO: 387277 - DNA, 20 bp, human
gtccccaggcagataggagg

SEQ ID NO: 387278 - DNA, 20 bp, human
gcccgctgataaagcactgt

SEQ ID NO: 387279 - DNA, 20 bp, human
gcaaggggacaggcatttgt

SEQ ID NO: 387280 - DNA, 20 bp, human
ggccaacagtgctttatcag

SEQ ID NO: 387281 - DNA, 20 bp, human
gcccgcttcccatgatgggg

SEQ ID NO: 387282 - DNA, 20 bp, human
gaaagcactgttggcactgg

SEQ ID NO: 387283 - DNA, 20 bp, human
ggccaccccatcatgggaag

SEQ ID NO: 387284 - DNA, 20 bp, human
gtaacccaaggagcgtcctg

SEQ ID NO: 387285 - DNA, 20 bp, human
ggtgactgataacagggccc

SEQ ID NO: 387286 - DNA, 20 bp, human
gcagctgaccaggttccaac

SEQ ID NO: 387287 - DNA, 20 bp, human
gtgcgcaggcgtcatcctgt

SEQ ID NO: 387288 - DNA, 20 bp, human
gtctgtgcgccgtgagactt

SEQ ID NO: 387289 - DNA, 20 bp, human
gggaagaaggcgggacgaac

SEQ ID NO: 387290 - DNA, 20 bp, human
ggcgtcatcctgttggaacc

SEQ ID NO: 387291 - DNA, 20 bp, human
gagcagagccggaagaaggc

SEQ ID NO: 387292 - DNA, 20 bp, human
gctctaagggcgggattatc

SEQ ID NO: 387293 - DNA, 20 bp, human
gggcgggattatccgggtcc

SEQ ID NO: 387294 - DNA, 20 bp, human
ggcggagcttgtttgctgtg

SEQ ID NO: 387295 - DNA, 20 bp, human
gaggcgggacgaaccggaag

SEQ ID NO: 387296 - DNA, 20 bp, human
gagccggaacgtgcaaggga

SEQ ID NO: 387297 - DNA, 20 bp, human
ggaggcggggccgggtaggg

SEQ ID NO: 387298 - DNA, 20 bp, human
gaggcggggctcgggagtgt

SEQ ID NO: 387299 - DNA, 20 bp, human
gccgccggagtgtggagacg

SEQ ID NO: 387300 - DNA, 20 bp, human
ggaccgggaggcagggctta

SEQ ID NO: 387301 - DNA, 20 bp, human
ggaggagccggaacgtgcaa

SEQ ID NO: 387302 - DNA, 20 bp, human
gccggagtgtggagacgagg

SEQ ID NO: 387303 - DNA, 20 bp, human
gagggctggcagcccgagcg

SEQ ID NO: 387304 - DNA, 20 bp, human
gtgggctcagggcctagcgt

SEQ ID NO: 387305 - DNA, 20 bp, human
ggggtgggaggcgtggctcg

SEQ ID NO: 387306 - DNA, 20 bp, human
gggcgcctgtggaatgtcca

SEQ ID NO: 387307 - DNA, 20 bp, human
gactgcgcagaccctggcga

SEQ ID NO: 387308 - DNA, 20 bp, human
ggaggggctcaccctcgcca

SEQ ID NO: 387309 - DNA, 20 bp, human
gcccggggtgagtttctctg

SEQ ID NO: 387310 - DNA, 20 bp, human
gcagtcctccccatcaatca

SEQ ID NO: 387311 - DNA, 20 bp, human
gcgggcccggacacacactg

SEQ ID NO: 387312 - DNA, 20 bp, human
ggctaacggctggtggtagc

SEQ ID NO: 387313 - DNA, 20 bp, human
gagcaggttgagtaccggga

SEQ ID NO: 387314 - DNA, 20 bp, human
gacagtgcagtgcgagggtg

SEQ ID NO: 387315 - DNA, 20 bp, human
gtccacaggcgcctccgggg

SEQ ID NO: 387316 - DNA, 20 bp, human
gcaggtggcagctactgatg

SEQ ID NO: 387317 - DNA, 20 bp, human
gtgtggggcccgtacacggc

SEQ ID NO: 387318 - DNA, 20 bp, human
gctgcagccccgcccggcac

SEQ ID NO: 387319 - DNA, 20 bp, human
gctactgatggggcagctac

SEQ ID NO: 387320 - DNA, 20 bp, human
gcactctgagacgcaggcgg

SEQ ID NO: 387321 - DNA, 20 bp, human
gagggtgtggggcccgtaca

SEQ ID NO: 387322 - DNA, 20 bp, human
gcgcgtgagccgcagggtgt

SEQ ID NO: 387323 - DNA, 20 bp, human
gtggctgggttcagacgcga

SEQ ID NO: 387324 - DNA, 20 bp, human
gagggtccacggtctggctg

SEQ ID NO: 387325 - DNA, 20 bp, human
gcaggcggaggacaccgaca

SEQ ID NO: 387326 - DNA, 20 bp, human
gtgaggacaacggcagacct

SEQ ID NO: 387327 - DNA, 20 bp, human
ggaggtgctccctcagtttg

SEQ ID NO: 387328 - DNA, 20 bp, human
ggggaagaggcctggctcta

SEQ ID NO: 387329 - DNA, 20 bp, human
gtgggtcctgctgtcccagc

SEQ ID NO: 387330 - DNA, 20 bp, human
gaacctgctgccttagagcc

SEQ ID NO: 387331 - DNA, 20 bp, human
gctaggcccgctgggacagc

SEQ ID NO: 387332 - DNA, 20 bp, human
gaacccgggcacctggcaac

SEQ ID NO: 387333 - DNA, 20 bp, human
gggggccagctaggcccgct

SEQ ID NO: 387334 - DNA, 20 bp, human
gcctagggcccagcttcaaa

SEQ ID NO: 387335 - DNA, 20 bp, human
gcaggcctcttcccggggga

SEQ ID NO: 387336 - DNA, 20 bp, human
ggtcacgtggggcgccggta

SEQ ID NO: 387337 - DNA, 20 bp, human
gaaccggcggggaagccccg

SEQ ID NO: 387338 - DNA, 20 bp, human
gacgtggggcgccggtaggg

SEQ ID NO: 387339 - DNA, 20 bp, human
gccggggcgcgcgcggtccg

SEQ ID NO: 387340 - DNA, 20 bp, human
ggagctgggactcagcgaac

SEQ ID NO: 387341 - DNA, 20 bp, human
gcgagccgggaaggcgaggg

SEQ ID NO: 387342 - DNA, 20 bp, human
gcctgcgggcggaagtgccc

SEQ ID NO: 387343 - DNA, 20 bp, human
gcgggatggagggatcgcgg

SEQ ID NO: 387344 - DNA, 20 bp, human
ggggactcagcgaaccggcg

SEQ ID NO: 387345 - DNA, 20 bp, human
gccgcggagcccacgcctcg

SEQ ID NO: 387346 - DNA, 20 bp, human
gaagcccagcaggactaagt

SEQ ID NO: 387347 - DNA, 20 bp, human
gcgcccccgccctactctat

SEQ ID NO: 387348 - DNA, 20 bp, human
ggcagggtctcgggtagctg

SEQ ID NO: 387349 - DNA, 20 bp, human
ggggtctcgggtagctgagg

SEQ ID NO: 387350 - DNA, 20 bp, human
ggacctcgggctctgtgctt

SEQ ID NO: 387351 - DNA, 20 bp, human
gggggcgggctttactgaca

SEQ ID NO: 387352 - DNA, 20 bp, human
gggtagggacaaggggtcta

SEQ ID NO: 387353 - DNA, 20 bp, human
gtctgtggggcggtcgttgg

SEQ ID NO: 387354 - DNA, 20 bp, human
gagttggggaccaatagagt

SEQ ID NO: 387355 - DNA, 20 bp, human
gacaccggaggccacccccc

SEQ ID NO: 387356 - DNA, 20 bp, human
ggtcgagtaacacacggaga

SEQ ID NO: 387357 - DNA, 20 bp, human
gacatccccgcctccgtcaa

SEQ ID NO: 387358 - DNA, 20 bp, human
gtaaatgcccttgacggagg

SEQ ID NO: 387359 - DNA, 20 bp, human
ggcacgtgtcgagtaacaca

SEQ ID NO: 387360 - DNA, 20 bp, human
ggagacaaatgctggtcacg

SEQ ID NO: 387361 - DNA, 20 bp, human
gaaaaatcagagacaaatgc

SEQ ID NO: 387362 - DNA, 20 bp, human
gctctgaggcaacaaccttg

SEQ ID NO: 387363 - DNA, 20 bp, human
gttggggaaaagtccccaac

SEQ ID NO: 387364 - DNA, 20 bp, human
ggtttaaatgcccttgacgg

SEQ ID NO: 387365 - DNA, 20 bp, human
gagggtttaaatgcccttga

SEQ ID NO: 387366 - DNA, 20 bp, human
ggaggctcccccacaactgt

SEQ ID NO: 387367 - DNA, 20 bp, human
gcacaaggactgctgtgctc

SEQ ID NO: 387368 - DNA, 20 bp, human
gtgacccagtgctgtaggtc

SEQ ID NO: 387369 - DNA, 20 bp, human
gtggcagtccagacaggcat

SEQ ID NO: 387370 - DNA, 20 bp, human
gctgtctgtctgcccggccc

SEQ ID NO: 387371 - DNA, 20 bp, human
gcccttcccaacagttgtgg

SEQ ID NO: 387372 - DNA, 20 bp, human
gcctgtctggactgccaccc

SEQ ID NO: 387373 - DNA, 20 bp, human
ggttgtgggggagcctccat

SEQ ID NO: 387374 - DNA, 20 bp, human
gggctccgcgtgtgcctctg

SEQ ID NO: 387375 - DNA, 20 bp, human
gtcaggtgttcaaaatgtag

SEQ ID NO: 387376 - DNA, 20 bp, human
gcggggagactcttgcgcaa

SEQ ID NO: 387377 - DNA, 20 bp, human
gacagcgcggtcgggttaag

SEQ ID NO: 387378 - DNA, 20 bp, human
gagactcttgcgcaagggag

SEQ ID NO: 387379 - DNA, 20 bp, human
gacaagacccgccttcacct

SEQ ID NO: 387380 - DNA, 20 bp, human
gagacccgccttcacctggg

SEQ ID NO: 387381 - DNA, 20 bp, human
gtccccgcccaggtgaaggc

SEQ ID NO: 387382 - DNA, 20 bp, human
gacccgaccaaaccagaaaa

SEQ ID NO: 387383 - DNA, 20 bp, human
gtcgggttaaggggctgctc

SEQ ID NO: 387384 - DNA, 20 bp, human
gaggctgacgttcccttttc

SEQ ID NO: 387385 - DNA, 20 bp, human
gttcccttttctggtttggt

SEQ ID NO: 387386 - DNA, 20 bp, human
ggccccgcccgaaggggcta

SEQ ID NO: 387387 - DNA, 20 bp, human
gaaagcctggaaaaaatggg

SEQ ID NO: 387388 - DNA, 20 bp, human
ggtggctggcgtgacgcgga

SEQ ID NO: 387389 - DNA, 20 bp, human
gcttagaggcggggttaagt

SEQ ID NO: 387390 - DNA, 20 bp, human
gcggaaagccccgcccgaag

SEQ ID NO: 387391 - DNA, 20 bp, human
ggagccatagccccttcggg

SEQ ID NO: 387392 - DNA, 20 bp, human
gcggggtggctggcgtgacg

SEQ ID NO: 387393 - DNA, 20 bp, human
ggggagggaagcggggtggc

SEQ ID NO: 387394 - DNA, 20 bp, human
gggtcttttgcgctcgtggg

SEQ ID NO: 387395 - DNA, 20 bp, human
gggcggagccatagcccctt

SEQ ID NO: 387396 - DNA, 20 bp, human
gaaactggcaagccgaggtt

SEQ ID NO: 387397 - DNA, 20 bp, human
ggaaggccctggagaatccg

SEQ ID NO: 387398 - DNA, 20 bp, human
gtacatcattggttcattga

SEQ ID NO: 387399 - DNA, 20 bp, human
gagaaaaacccggagctgag

SEQ ID NO: 387400 - DNA, 20 bp, human
gataaacgattatgcctctt

SEQ ID NO: 387401 - DNA, 20 bp, human
gaatgtaaagcgtttaacac

SEQ ID NO: 387402 - DNA, 20 bp, human
gtattattgcgcaaagggga

SEQ ID NO: 387403 - DNA, 20 bp, human
gtaggcaatttacctaacct

SEQ ID NO: 387404 - DNA, 20 bp, human
gttattgtcctgtttcacgc

SEQ ID NO: 387405 - DNA, 20 bp, human
gttgtcctgtttcacgcggg

SEQ ID NO: 387406 - DNA, 20 bp, human
ggatgggggcggagctgcac

SEQ ID NO: 387407 - DNA, 20 bp, human
gtcccgaggcggggccccat

SEQ ID NO: 387408 - DNA, 20 bp, human
gcccataggtggagagaagt

SEQ ID NO: 387409 - DNA, 20 bp, human
gcaccgggagaggcggactc

SEQ ID NO: 387410 - DNA, 20 bp, human
gcacctatggggccccgcct

SEQ ID NO: 387411 - DNA, 20 bp, human
gttcctgtgtagagaaggcg

SEQ ID NO: 387412 - DNA, 20 bp, human
gagtctggggcacttaggag

SEQ ID NO: 387413 - DNA, 20 bp, human
ggggaggtagaagagattaa

SEQ ID NO: 387414 - DNA, 20 bp, human
ggccccgagtccgcctctcc

SEQ ID NO: 387415 - DNA, 20 bp, human
gctccgcccccatcccgagg

SEQ ID NO: 387416 - DNA, 20 bp, human
ggcgatgggcagagaaagca

SEQ ID NO: 387417 - DNA, 20 bp, human
ggctggggctcaaggaactg

SEQ ID NO: 387418 - DNA, 20 bp, human
ggcagggcttctgttgtgag

SEQ ID NO: 387419 - DNA, 20 bp, human
gacagcttcttcactggtgg

SEQ ID NO: 387420 - DNA, 20 bp, human
gaggcatctccagcaggcga

SEQ ID NO: 387421 - DNA, 20 bp, human
ggcactgcccatcctcagct

SEQ ID NO: 387422 - DNA, 20 bp, human
gcctcagctggggtaaagct

SEQ ID NO: 387423 - DNA, 20 bp, human
gtggaaccacaaacttgtga

SEQ ID NO: 387424 - DNA, 20 bp, human
ggaaggcccaaggccgccca

SEQ ID NO: 387425 - DNA, 20 bp, human
gctttaccccagctgaggat

SEQ ID NO: 387426 - DNA, 20 bp, human
gtccacgcgctatacttata

SEQ ID NO: 387427 - DNA, 20 bp, human
ggccgccaggagcgccgtgt

SEQ ID NO: 387428 - DNA, 20 bp, human
gtaagtatagcgcgtggaga

SEQ ID NO: 387429 - DNA, 20 bp, human
ggggacaccaggataccacg

SEQ ID NO: 387430 - DNA, 20 bp, human
gtgactaagccccgcccaca

SEQ ID NO: 387431 - DNA, 20 bp, human
gccccacagggcgcacccat

SEQ ID NO: 387432 - DNA, 20 bp, human
ggaggctcgtggacaggggg

SEQ ID NO: 387433 - DNA, 20 bp, human
gaagaggaggctcgtggaca

SEQ ID NO: 387434 - DNA, 20 bp, human
gggctactcagtgtagattg

SEQ ID NO: 387435 - DNA, 20 bp, human
gcccgcccacacggcgctcc

SEQ ID NO: 387436 - DNA, 20 bp, human
gcagacggagaggggagcgg

SEQ ID NO: 387437 - DNA, 20 bp, human
gagcgcggatgggtaccgca

SEQ ID NO: 387438 - DNA, 20 bp, human
gcccccgcggtggcccgtcc

SEQ ID NO: 387439 - DNA, 20 bp, human
gtccgggcggcagacggaga

SEQ ID NO: 387440 - DNA, 20 bp, human
gccgggctggcggtcccagg

SEQ ID NO: 387441 - DNA, 20 bp, human
gtccgccgccagcccccctg

SEQ ID NO: 387442 - DNA, 20 bp, human
ggcccggacgggccaccgcg

SEQ ID NO: 387443 - DNA, 20 bp, human
ggcgcctggcggcggggatt

SEQ ID NO: 387444 - DNA, 20 bp, human
gtggcggcggggatttggcg

SEQ ID NO: 387445 - DNA, 20 bp, human
gaccgcgggggcgcgaggaa

SEQ ID NO: 387446 - DNA, 20 bp, human
gacggtggtggcagttccgg

SEQ ID NO: 387447 - DNA, 20 bp, human
ggcggcggaagtttcggcgg

SEQ ID NO: 387448 - DNA, 20 bp, human
ggacgcggcggcggaagttt

SEQ ID NO: 387449 - DNA, 20 bp, human
gcccacggacccggaagagg

SEQ ID NO: 387450 - DNA, 20 bp, human
ggccacaagtcctcctcttc

SEQ ID NO: 387451 - DNA, 20 bp, human
ggcggcggcggaagtttcgg

SEQ ID NO: 387452 - DNA, 20 bp, human
ggaagactcgcccacggacc

SEQ ID NO: 387453 - DNA, 20 bp, human
gtgggcgagtcttcatctaa

SEQ ID NO: 387454 - DNA, 20 bp, human
ggcagctccggcggcggata

SEQ ID NO: 387455 - DNA, 20 bp, human
ggtggcagttccggcggcgg

SEQ ID NO: 387456 - DNA, 20 bp, human
gggccggggctaggccaagg

SEQ ID NO: 387457 - DNA, 20 bp, human
gaaccggttaccagtgcgaa

SEQ ID NO: 387458 - DNA, 20 bp, human
gccggccccgggacggaagg

SEQ ID NO: 387459 - DNA, 20 bp, human
gggaccaaggggaggcacat

SEQ ID NO: 387460 - DNA, 20 bp, human
gaggaagtgggtcacagcga

SEQ ID NO: 387461 - DNA, 20 bp, human
gagggaggccacgcccacga

SEQ ID NO: 387462 - DNA, 20 bp, human
ggcaaagctctactgggccc

SEQ ID NO: 387463 - DNA, 20 bp, human
ggcacatggggagctccaca

SEQ ID NO: 387464 - DNA, 20 bp, human
gagtttgctggggtctccgt

SEQ ID NO: 387465 - DNA, 20 bp, human
ggtaaggcagtgcctgttca

SEQ ID NO: 387466 - DNA, 20 bp, human
ggaaacccttccgcgttcct

SEQ ID NO: 387467 - DNA, 20 bp, human
gaacggcaaccctgcgctcc

SEQ ID NO: 387468 - DNA, 20 bp, human
gaagctatggctaccgatag

SEQ ID NO: 387469 - DNA, 20 bp, human
gcggggaaatcgacctctat

SEQ ID NO: 387470 - DNA, 20 bp, human
ggggttgccgttagttaccg

SEQ ID NO: 387471 - DNA, 20 bp, human
gacgtcacatccgggagcgc

SEQ ID NO: 387472 - DNA, 20 bp, human
ggttaccgaggaacgcggaa

SEQ ID NO: 387473 - DNA, 20 bp, human
gaatctacgagcccagagtt

SEQ ID NO: 387474 - DNA, 20 bp, human
gcgcgttcctcggtaactaa

SEQ ID NO: 387475 - DNA, 20 bp, human
gcgtctgtcgaccgaactct

SEQ ID NO: 387476 - DNA, 20 bp, human
gaggcccatttgcagaaggg

SEQ ID NO: 387477 - DNA, 20 bp, human
gagcctgcggcccgatctcc

SEQ ID NO: 387478 - DNA, 20 bp, human
gtctccagctctggtgtcca

SEQ ID NO: 387479 - DNA, 20 bp, human
gtccccagggacactgaggt

SEQ ID NO: 387480 - DNA, 20 bp, human
gaggcgctcagggatgtcct

SEQ ID NO: 387481 - DNA, 20 bp, human
gtccctggggatgcggaagg

SEQ ID NO: 387482 - DNA, 20 bp, human
gccatctgggacaagggggt

SEQ ID NO: 387483 - DNA, 20 bp, human
ggagggggacctgttgatta

SEQ ID NO: 387484 - DNA, 20 bp, human
gccctgagcgcctgtcacca

SEQ ID NO: 387485 - DNA, 20 bp, human
gccctccttcccgggagatc

SEQ ID NO: 387486 - DNA, 20 bp, human
gcggccccacctagtaaccg

SEQ ID NO: 387487 - DNA, 20 bp, human
gctagcctggggattgtgaa

SEQ ID NO: 387488 - DNA, 20 bp, human
ggggccggatattactaaca

SEQ ID NO: 387489 - DNA, 20 bp, human
gtctacctcggttactaggt

SEQ ID NO: 387490 - DNA, 20 bp, human
gtcttagagaagatagtaat

SEQ ID NO: 387491 - DNA, 20 bp, human
gtaagtttctatgtctacct

SEQ ID NO: 387492 - DNA, 20 bp, human
gtatgtctacctcggttact

SEQ ID NO: 387493 - DNA, 20 bp, human
gtcgtcccttcacaatcccc

SEQ ID NO: 387494 - DNA, 20 bp, human
gactgggcttgggttactag

SEQ ID NO: 387495 - DNA, 20 bp, human
gtcaaataaataagataact

SEQ ID NO: 387496 - DNA, 20 bp, human
ggaagtctgtcaactgggag

SEQ ID NO: 387497 - DNA, 20 bp, human
ggaagcagatgcaacaccca

SEQ ID NO: 387498 - DNA, 20 bp, human
ggaaaggcagtgtacggacc

SEQ ID NO: 387499 - DNA, 20 bp, human
ggcagtgtatgcaagtgagt

SEQ ID NO: 387500 - DNA, 20 bp, human
gctatctgaaaggcagtgta

SEQ ID NO: 387501 - DNA, 20 bp, human
ggggccagacaacagacgtc

SEQ ID NO: 387502 - DNA, 20 bp, human
gtggcaggaagtctgtcaac

SEQ ID NO: 387503 - DNA, 20 bp, human
gacaccggacgtctgttgtc

SEQ ID NO: 387504 - DNA, 20 bp, human
gcatctgcttctgcagcggg

SEQ ID NO: 387505 - DNA, 20 bp, human
gaactgaggcacgaggtggc

SEQ ID NO: 387506 - DNA, 20 bp, human
gcgtagtgggaggactcggg

SEQ ID NO: 387507 - DNA, 20 bp, human
ggcgaagtcccgggcgccag

SEQ ID NO: 387508 - DNA, 20 bp, human
gccggcccagtccttccgaa

SEQ ID NO: 387509 - DNA, 20 bp, human
gagggcgtcagtctcccatt

SEQ ID NO: 387510 - DNA, 20 bp, human
gcgtcagtctcccattcgga

SEQ ID NO: 387511 - DNA, 20 bp, human
gtctcccattcggaaggact

SEQ ID NO: 387512 - DNA, 20 bp, human
ggggacttcgcccggtgcta

SEQ ID NO: 387513 - DNA, 20 bp, human
gagactgacgccctagcacc

SEQ ID NO: 387514 - DNA, 20 bp, human
gccttccggccgtgcagggt

SEQ ID NO: 387515 - DNA, 20 bp, human
gctgcacggccggaaggagt

SEQ ID NO: 387516 - DNA, 20 bp, human
gccagggccgcgtcccgacg

SEQ ID NO: 387517 - DNA, 20 bp, human
ggcgcccgggcgcccccgag

SEQ ID NO: 387518 - DNA, 20 bp, human
ggcgcccccgagtggagggg

SEQ ID NO: 387519 - DNA, 20 bp, human
gccgggagcgcaggggagtc

SEQ ID NO: 387520 - DNA, 20 bp, human
gcgagcgcgggcccctgcct

SEQ ID NO: 387521 - DNA, 20 bp, human
gcctggtaccagcggggaag

SEQ ID NO: 387522 - DNA, 20 bp, human
gtggccgcgctgctgggaaa

SEQ ID NO: 387523 - DNA, 20 bp, human
ggcgggagctgtgggctcgg

SEQ ID NO: 387524 - DNA, 20 bp, human
gagcgacggtagagttatgt

SEQ ID NO: 387525 - DNA, 20 bp, human
gggagcggcgcttcaatcag

SEQ ID NO: 387526 - DNA, 20 bp, human
gaaccccgccacagctctgc

SEQ ID NO: 387527 - DNA, 20 bp, human
gagaggacacctgtcgggga

SEQ ID NO: 387528 - DNA, 20 bp, human
gcgggagaggacacctgtcg

SEQ ID NO: 387529 - DNA, 20 bp, human
gacacctgtcggggaagggc

SEQ ID NO: 387530 - DNA, 20 bp, human
gggcgagcgcggcgatcaac

SEQ ID NO: 387531 - DNA, 20 bp, human
ggtgtcctctcccggaatcg

SEQ ID NO: 387532 - DNA, 20 bp, human
gcagaccccgattccgggag

SEQ ID NO: 387533 - DNA, 20 bp, human
ggggaggaagcacctgggtc

SEQ ID NO: 387534 - DNA, 20 bp, human
gcggagagcgtggatggcaa

SEQ ID NO: 387535 - DNA, 20 bp, human
gtgtcaggatgctcgctcac

SEQ ID NO: 387536 - DNA, 20 bp, human
gcgcgcgtcggaggcgaagg

SEQ ID NO: 387537 - DNA, 20 bp, human
gtgaccctggtctttacaat

SEQ ID NO: 387538 - DNA, 20 bp, human
gctacagggcggtcgagtga

SEQ ID NO: 387539 - DNA, 20 bp, human
gtaaagaagcgcacatggca

SEQ ID NO: 387540 - DNA, 20 bp, human
gcgtgcgcactcccgtgccg

SEQ ID NO: 387541 - DNA, 20 bp, human
gacccaccgcacctacaggg

SEQ ID NO: 387542 - DNA, 20 bp, human
ggagtgcgcacgcgcgtcgg

SEQ ID NO: 387543 - DNA, 20 bp, human
gggaacccaccgcacctaca

SEQ ID NO: 387544 - DNA, 20 bp, human
gatgggcagaacgtaggaag

SEQ ID NO: 387545 - DNA, 20 bp, human
gccatagtaggtacttccac

SEQ ID NO: 387546 - DNA, 20 bp, human
gcagactggggcttgtatga

SEQ ID NO: 387547 - DNA, 20 bp, human
ggggcttgtatgaagggaag

SEQ ID NO: 387548 - DNA, 20 bp, human
gactcatatgtctcagactg

SEQ ID NO: 387549 - DNA, 20 bp, human
gtcagggctgggcagggtat

SEQ ID NO: 387550 - DNA, 20 bp, human
ggcaccaaataaggaggaac

SEQ ID NO: 387551 - DNA, 20 bp, human
gtagtggtcattaacagcca

SEQ ID NO: 387552 - DNA, 20 bp, human
gtgaccactagaggctctca

SEQ ID NO: 387553 - DNA, 20 bp, human
gagcaggaggagcccggtgc

SEQ ID NO: 387554 - DNA, 20 bp, human
gcagcaggcaccaaataagg

SEQ ID NO: 387555 - DNA, 20 bp, human
gccaccctctcccccggcac

SEQ ID NO: 387556 - DNA, 20 bp, human
gtatcggcgtctaaggggaa

SEQ ID NO: 387557 - DNA, 20 bp, human
gaacgcgcgccgccattggc

SEQ ID NO: 387558 - DNA, 20 bp, human
ggaggaagcgcggcggtgat

SEQ ID NO: 387559 - DNA, 20 bp, human
gagaagcgggccgggagcct

SEQ ID NO: 387560 - DNA, 20 bp, human
gcggcgtctaaggggaaggg

SEQ ID NO: 387561 - DNA, 20 bp, human
ggcggcggtgattggcgaga

SEQ ID NO: 387562 - DNA, 20 bp, human
gtcctcccgtcgcccgccaa

SEQ ID NO: 387563 - DNA, 20 bp, human
gggtagaaacgcagtttaaa

SEQ ID NO: 387564 - DNA, 20 bp, human
gaatggcggcgcgcgttctt

SEQ ID NO: 387565 - DNA, 20 bp, human
gagtacgacctgtcccttat

SEQ ID NO: 387566 - DNA, 20 bp, human
ggtacggggaggcattgcta

SEQ ID NO: 387567 - DNA, 20 bp, human
gggaggcattgctaggggac

SEQ ID NO: 387568 - DNA, 20 bp, human
gggacaggctggcggggaac

SEQ ID NO: 387569 - DNA, 20 bp, human
gcggcttgcgcgtaagtctg

SEQ ID NO: 387570 - DNA, 20 bp, human
gaggggcggtgccaggccgt

SEQ ID NO: 387571 - DNA, 20 bp, human
ggcttcgcgtcacttgacta

SEQ ID NO: 387572 - DNA, 20 bp, human
ggaggctggtggtcatgccg

SEQ ID NO: 387573 - DNA, 20 bp, human
gctgctgaaagcaggccctc

SEQ ID NO: 387574 - DNA, 20 bp, human
gctggctgctgggccgacga

SEQ ID NO: 387575 - DNA, 20 bp, human
gcagcagaaccagcaacaga

SEQ ID NO: 387576 - DNA, 20 bp, human
gagaagtttcaacccataga

SEQ ID NO: 387577 - DNA, 20 bp, human
gaaaatattgctttcttgtt

SEQ ID NO: 387578 - DNA, 20 bp, human
gtgcctgtactctcagaagt

SEQ ID NO: 387579 - DNA, 20 bp, human
gtacccacttctgagagtac

SEQ ID NO: 387580 - DNA, 20 bp, human
gctttcttcaaggccttcta

SEQ ID NO: 387581 - DNA, 20 bp, human
gtagatgtattagaagtcta

SEQ ID NO: 387582 - DNA, 20 bp, human
ggctgttcaacatgaattta

SEQ ID NO: 387583 - DNA, 20 bp, human
gaagcaatatttttttagta

SEQ ID NO: 387584 - DNA, 20 bp, human
gttatcacattaagtcattt

SEQ ID NO: 387585 - DNA, 20 bp, human
gtaattctagtacattccta

SEQ ID NO: 387586 - DNA, 20 bp, human
gaagagacaaggcagtataa

SEQ ID NO: 387587 - DNA, 20 bp, human
gcaaggcagtataatggaat

SEQ ID NO: 387588 - DNA, 20 bp, human
gaacagctttgaagtatgta

SEQ ID NO: 387589 - DNA, 20 bp, human
gaaaaaattacggcccagtt

SEQ ID NO: 387590 - DNA, 20 bp, human
gcctcttagctgaccaaact

SEQ ID NO: 387591 - DNA, 20 bp, human
gggcgatttagaaaaaatta

SEQ ID NO: 387592 - DNA, 20 bp, human
gaaaaactaaacttatgaac

SEQ ID NO: 387593 - DNA, 20 bp, human
gcaaggaagtttgtcattct

SEQ ID NO: 387594 - DNA, 20 bp, human
gtttctaaatcgccaagtca

SEQ ID NO: 387595 - DNA, 20 bp, human
gatgacaaacttccttgact

SEQ ID NO: 387596 - DNA, 20 bp, human
gcccaaaataccaccacaga

SEQ ID NO: 387597 - DNA, 20 bp, human
gaggagctctatgccatgaa

SEQ ID NO: 387598 - DNA, 20 bp, human
ggctctatgccatgaaagga

SEQ ID NO: 387599 - DNA, 20 bp, human
gctgactcacccatctgtgg

SEQ ID NO: 387600 - DNA, 20 bp, human
gtgtggtggtattttggggg

SEQ ID NO: 387601 - DNA, 20 bp, human
gacactgactcacccatctg

SEQ ID NO: 387602 - DNA, 20 bp, human
gtttcaaatgagtactgctg

SEQ ID NO: 387603 - DNA, 20 bp, human
gtacagtcggttttactggg

SEQ ID NO: 387604 - DNA, 20 bp, human
gagatacagtcggttttact

SEQ ID NO: 387605 - DNA, 20 bp, human
gcttggattggtgttctgag

SEQ ID NO: 387606 - DNA, 20 bp, human
gaaaccaatagtatgacttg

SEQ ID NO: 387607 - DNA, 20 bp, human
gatgacttgtggaagataat

SEQ ID NO: 387608 - DNA, 20 bp, human
gatcttggctggctgtgttg

SEQ ID NO: 387609 - DNA, 20 bp, human
gcttccacaagtcatactat

SEQ ID NO: 387610 - DNA, 20 bp, human
gctatagttgaggacaaagg

SEQ ID NO: 387611 - DNA, 20 bp, human
gaacacactactactagaag

SEQ ID NO: 387612 - DNA, 20 bp, human
gggtagtgcccattaatgta

SEQ ID NO: 387613 - DNA, 20 bp, human
gcatttaatcatacagatga

SEQ ID NO: 387614 - DNA, 20 bp, human
gacttgttaaacaagtttga

SEQ ID NO: 387615 - DNA, 20 bp, human
gtacggaaagtatgttctga

SEQ ID NO: 387616 - DNA, 20 bp, human
gaagtcttggctggtgtagt

SEQ ID NO: 387617 - DNA, 20 bp, human
gggacaaggacaaattttac

SEQ ID NO: 387618 - DNA, 20 bp, human
ggaaccagtctgacaagtct

SEQ ID NO: 387619 - DNA, 20 bp, human
gcagccaagacttgtcagac

SEQ ID NO: 387620 - DNA, 20 bp, human
gtgtgggctgaattgaagtg

SEQ ID NO: 387621 - DNA, 20 bp, human
gatatgtgactagcaggaca

SEQ ID NO: 387622 - DNA, 20 bp, human
gatcgaatgcaaattgtgtc

SEQ ID NO: 387623 - DNA, 20 bp, human
gctgacttttctaaaaaatc

SEQ ID NO: 387624 - DNA, 20 bp, human
gaaagtcagacgtataaatt

SEQ ID NO: 387625 - DNA, 20 bp, human
gatctctagtgtattttcaa

SEQ ID NO: 387626 - DNA, 20 bp, human
gagaagctccaagtagtaga

SEQ ID NO: 387627 - DNA, 20 bp, human
gttgacaggtttagtgagtg

SEQ ID NO: 387628 - DNA, 20 bp, human
gaagaccacacttttccagt

SEQ ID NO: 387629 - DNA, 20 bp, human
gtacttggagcttctctatg

SEQ ID NO: 387630 - DNA, 20 bp, human
gggaagtatgataagcattg

SEQ ID NO: 387631 - DNA, 20 bp, human
gcttatcatacttccccaac

SEQ ID NO: 387632 - DNA, 20 bp, human
gagggaataacaaggggtag

SEQ ID NO: 387633 - DNA, 20 bp, human
gacacactagagcacactga

SEQ ID NO: 387634 - DNA, 20 bp, human
gttccccaactggaaaagtg

SEQ ID NO: 387635 - DNA, 20 bp, human
gtatgataagcattgaggtg

SEQ ID NO: 387636 - DNA, 20 bp, human
ggaagccgatcagaccttga

SEQ ID NO: 387637 - DNA, 20 bp, human
gaggcggccgaggaataggt

SEQ ID NO: 387638 - DNA, 20 bp, human
gctcaccctcaaggtctgat

SEQ ID NO: 387639 - DNA, 20 bp, human
gagcaggagagacgtgtcag

SEQ ID NO: 387640 - DNA, 20 bp, human
ggattcttgctggacaggcc

SEQ ID NO: 387641 - DNA, 20 bp, human
ggtccctatccctatctgga

SEQ ID NO: 387642 - DNA, 20 bp, human
gcacccgccctgggcacgcg

SEQ ID NO: 387643 - DNA, 20 bp, human
gggattttgtaatgggtaga

SEQ ID NO: 387644 - DNA, 20 bp, human
gcgtgcgccccgcgtgccca

SEQ ID NO: 387645 - DNA, 20 bp, human
gtgggaggcggccgaggaat

SEQ ID NO: 387646 - DNA, 20 bp, human
gggccagcccccaccaaatg

SEQ ID NO: 387647 - DNA, 20 bp, human
gaactgggatggcctcgatg

SEQ ID NO: 387648 - DNA, 20 bp, human
gggggcagtttcatgagtaa

SEQ ID NO: 387649 - DNA, 20 bp, human
gtccccgccccatttggtgg

SEQ ID NO: 387650 - DNA, 20 bp, human
gccaaatggggcggggaagc

SEQ ID NO: 387651 - DNA, 20 bp, human
gggctctgccctttctctca

SEQ ID NO: 387652 - DNA, 20 bp, human
ggcctggaacgtcccctgtg

SEQ ID NO: 387653 - DNA, 20 bp, human
gcgatgaggggcagaggaac

SEQ ID NO: 387654 - DNA, 20 bp, human
gtccccacaggggacgttcc

SEQ ID NO: 387655 - DNA, 20 bp, human
gtggtattcgctgagtaact

SEQ ID NO: 387656 - DNA, 20 bp, human
gggtagaaggttgatctgtt

SEQ ID NO: 387657 - DNA, 20 bp, human
ggacagacaaattagtcact

SEQ ID NO: 387658 - DNA, 20 bp, human
gcttggcaaatggcctgttc

SEQ ID NO: 387659 - DNA, 20 bp, human
ggggaaagtacacttaaaca

SEQ ID NO: 387660 - DNA, 20 bp, human
gtttgattcaccttggcaaa

SEQ ID NO: 387661 - DNA, 20 bp, human
gagttaacatttacaactct

SEQ ID NO: 387662 - DNA, 20 bp, human
ggttctatggctactcttta

SEQ ID NO: 387663 - DNA, 20 bp, human
gtacattaagtatcattaaa

SEQ ID NO: 387664 - DNA, 20 bp, human
gacttaaacaaggcgttcta

SEQ ID NO: 387665 - DNA, 20 bp, human
gggtgaagttatgcaatgta

SEQ ID NO: 387666 - DNA, 20 bp, human
ggggaggaggcgtttcccaa

SEQ ID NO: 387667 - DNA, 20 bp, human
ggctgcggagggacccataa

SEQ ID NO: 387668 - DNA, 20 bp, human
gcccaagggaagtccgggac

SEQ ID NO: 387669 - DNA, 20 bp, human
gacacccccaagcgggtcgc

SEQ ID NO: 387670 - DNA, 20 bp, human
gcctggctcaaccccggctg

SEQ ID NO: 387671 - DNA, 20 bp, human
gctgcgccgcggaccggaga

SEQ ID NO: 387672 - DNA, 20 bp, human
gggacccataagggactctg

SEQ ID NO: 387673 - DNA, 20 bp, human
gatgggtccctccgcagccg

SEQ ID NO: 387674 - DNA, 20 bp, human
gctgcccgagggctcgagtt

SEQ ID NO: 387675 - DNA, 20 bp, human
gggtgacccgcgacccgctt

SEQ ID NO: 387676 - DNA, 20 bp, human
gccgccctctcagagttaca

SEQ ID NO: 387677 - DNA, 20 bp, human
ggggagtggctttggaccaa

SEQ ID NO: 387678 - DNA, 20 bp, human
gagcagccatgcctgatatc

SEQ ID NO: 387679 - DNA, 20 bp, human
gatgcctgatatctgggaga

SEQ ID NO: 387680 - DNA, 20 bp, human
gaccgggcaccggacggctc

SEQ ID NO: 387681 - DNA, 20 bp, human
ggggaacctgcttcctccaa

SEQ ID NO: 387682 - DNA, 20 bp, human
gattccctgtaactctgaga

SEQ ID NO: 387683 - DNA, 20 bp, human
gtacagggaatgacttagaa

SEQ ID NO: 387684 - DNA, 20 bp, human
gccaagggctaaaatccaca

SEQ ID NO: 387685 - DNA, 20 bp, human
gttgcatcaaaataaccccg

SEQ ID NO: 387686 - DNA, 20 bp, human
ggggtggaagtcattcaggc

SEQ ID NO: 387687 - DNA, 20 bp, human
gaggtgtgtcacctgttctg

SEQ ID NO: 387688 - DNA, 20 bp, human
ggtaacctgacacctatctt

SEQ ID NO: 387689 - DNA, 20 bp, human
ggcaggaagcactagtacat

SEQ ID NO: 387690 - DNA, 20 bp, human
gaaggcttttgttacgcctt

SEQ ID NO: 387691 - DNA, 20 bp, human
gtgtgtgggtgctttggttt

SEQ ID NO: 387692 - DNA, 20 bp, human
ggggaagttggagtggtctg

SEQ ID NO: 387693 - DNA, 20 bp, human
gggaccttcggcctcagaac

SEQ ID NO: 387694 - DNA, 20 bp, human
gggaagtcattcaggcggga

SEQ ID NO: 387695 - DNA, 20 bp, human
gcctcagccaacacccagtt

SEQ ID NO: 387696 - DNA, 20 bp, human
gcaacaaggggcctattcat

SEQ ID NO: 387697 - DNA, 20 bp, human
gttgcaggaaagggggacaa

SEQ ID NO: 387698 - DNA, 20 bp, human
gctgctgaggacccatgaat

SEQ ID NO: 387699 - DNA, 20 bp, human
gagaggaaaaggttatgggg

SEQ ID NO: 387700 - DNA, 20 bp, human
gaggccccttgttgcaggaa

SEQ ID NO: 387701 - DNA, 20 bp, human
gaaacagaggaaaaggttat

SEQ ID NO: 387702 - DNA, 20 bp, human
gaaaaggttatggggaggag

SEQ ID NO: 387703 - DNA, 20 bp, human
ggcccctcccatctgctaac

SEQ ID NO: 387704 - DNA, 20 bp, human
gctgtgtgagtgttggagta

SEQ ID NO: 387705 - DNA, 20 bp, human
gccccttgttgcaggaaagg

SEQ ID NO: 387706 - DNA, 20 bp, human
ggggaccaggggctgtaacc

SEQ ID NO: 387707 - DNA, 20 bp, human
ggtccccgagagcatgaggt

SEQ ID NO: 387708 - DNA, 20 bp, human
gaccaggcaacgggcctcgg

SEQ ID NO: 387709 - DNA, 20 bp, human
gccccgcatgggcaccccag

SEQ ID NO: 387710 - DNA, 20 bp, human
ggctgggcccatatactctg

SEQ ID NO: 387711 - DNA, 20 bp, human
gcatgaggtagggacagcca

SEQ ID NO: 387712 - DNA, 20 bp, human
ggtagggacagccaaggact

SEQ ID NO: 387713 - DNA, 20 bp, human
gtcatgctctcggggaccag

SEQ ID NO: 387714 - DNA, 20 bp, human
ggtgagtgcaggggctcaca

SEQ ID NO: 387715 - DNA, 20 bp, human
ggtcaccaggcaacgggcct

SEQ ID NO: 387716 - DNA, 20 bp, human
ggagatactcacaaagaatg

SEQ ID NO: 387717 - DNA, 20 bp, human
gtatctctgactactccctt

SEQ ID NO: 387718 - DNA, 20 bp, human
gcttttaggaaaccacctaa

SEQ ID NO: 387719 - DNA, 20 bp, human
gcctaaacatccaataaata

SEQ ID NO: 387720 - DNA, 20 bp, human
gtccaagtaattatgctttt

SEQ ID NO: 387721 - DNA, 20 bp, human
gctctgactactcccttagg

SEQ ID NO: 387722 - DNA, 20 bp, human
gttgacagcaacgttctagt

SEQ ID NO: 387723 - DNA, 20 bp, human
gattatctatagcaaaagtt

SEQ ID NO: 387724 - DNA, 20 bp, human
gtacaatgaagagattgcca

SEQ ID NO: 387725 - DNA, 20 bp, human
gagagattgccagggcatca

SEQ ID NO: 387726 - DNA, 20 bp, human
ggacagaaacacggggtcag

SEQ ID NO: 387727 - DNA, 20 bp, human
gcaggaggacgatttgaggt

SEQ ID NO: 387728 - DNA, 20 bp, human
gcgcgccccgccgtttttaa

SEQ ID NO: 387729 - DNA, 20 bp, human
gagttgcaacccttgcttat

SEQ ID NO: 387730 - DNA, 20 bp, human
gtatacccttaaaaacggcg

SEQ ID NO: 387731 - DNA, 20 bp, human
gcttctcttcccataagcaa

SEQ ID NO: 387732 - DNA, 20 bp, human
gacagcaagacagaaacacg

SEQ ID NO: 387733 - DNA, 20 bp, human
ggaggcaggaggacgatttg

SEQ ID NO: 387734 - DNA, 20 bp, human
gacacggggtcagaggctga

SEQ ID NO: 387735 - DNA, 20 bp, human
ggcaactatacccttaaaaa

SEQ ID NO: 387736 - DNA, 20 bp, human
ggctgtagtcgccgccagag

SEQ ID NO: 387737 - DNA, 20 bp, human
ggtcccatatcctttctgcg

SEQ ID NO: 387738 - DNA, 20 bp, human
ggcggggcgcggcgtatata

SEQ ID NO: 387739 - DNA, 20 bp, human
ggtgggagcaccaggatctc

SEQ ID NO: 387740 - DNA, 20 bp, human
ggggcggtgctggcacccga

SEQ ID NO: 387741 - DNA, 20 bp, human
ggggctggtagcccagcggg

SEQ ID NO: 387742 - DNA, 20 bp, human
gtcgcagtgtgcccagcgtg

SEQ ID NO: 387743 - DNA, 20 bp, human
gacgccctgggaccgagaag

SEQ ID NO: 387744 - DNA, 20 bp, human
gggcccacccagggtgtggt

SEQ ID NO: 387745 - DNA, 20 bp, human
ggcggcgtatataaggctag

SEQ ID NO: 387746 - DNA, 20 bp, human
gtagaggagagggtggacgc

SEQ ID NO: 387747 - DNA, 20 bp, human
gtgagtgtagtcaggatgaa

SEQ ID NO: 387748 - DNA, 20 bp, human
gccaccctctcctctaggat

SEQ ID NO: 387749 - DNA, 20 bp, human
gcgggctctgtacactcaag

SEQ ID NO: 387750 - DNA, 20 bp, human
ggctctgtacactcaagcgg

SEQ ID NO: 387751 - DNA, 20 bp, human
gagccccgatcctagaggag

SEQ ID NO: 387752 - DNA, 20 bp, human
gtgaaagagtgagtgtagtc

SEQ ID NO: 387753 - DNA, 20 bp, human
gagtaggggtgctcatagtg

SEQ ID NO: 387754 - DNA, 20 bp, human
gcaccaagccccgatcctag

SEQ ID NO: 387755 - DNA, 20 bp, human
gtggcgagcccggaaacctt

SEQ ID NO: 387756 - DNA, 20 bp, human
gcccccgcccacttcaatcc

SEQ ID NO: 387757 - DNA, 20 bp, human
ggggtgttgtcgggcgtcgg

SEQ ID NO: 387758 - DNA, 20 bp, human
gcatctggatgctgccgact

SEQ ID NO: 387759 - DNA, 20 bp, human
gaaaggagttgtggctcatc

SEQ ID NO: 387760 - DNA, 20 bp, human
gtgcctggattgaagtgggc

SEQ ID NO: 387761 - DNA, 20 bp, human
gtcccgcaggaaatgtacgg

SEQ ID NO: 387762 - DNA, 20 bp, human
gcgtcgggggcgggtgttcg

SEQ ID NO: 387763 - DNA, 20 bp, human
gaagtgggcgggggtgttgt

SEQ ID NO: 387764 - DNA, 20 bp, human
gcgcctggcgacagaggagg

SEQ ID NO: 387765 - DNA, 20 bp, human
ggatttgcctggattgaagt

SEQ ID NO: 387766 - DNA, 20 bp, human
gcaggctctggaggctcaag

SEQ ID NO: 387767 - DNA, 20 bp, human
ggctctggaggctcaagcgg

SEQ ID NO: 387768 - DNA, 20 bp, human
gagcaagagtgagtgtactt

SEQ ID NO: 387769 - DNA, 20 bp, human
gtgagtgtacttcggatgaa

SEQ ID NO: 387770 - DNA, 20 bp, human
ggaggggaaggaggcgagtc

SEQ ID NO: 387771 - DNA, 20 bp, human
gtggggcggcgcctgctaga

SEQ ID NO: 387772 - DNA, 20 bp, human
gaggcgagtccggaaaccct

SEQ ID NO: 387773 - DNA, 20 bp, human
gagatggtgggcgcaggctc

SEQ ID NO: 387774 - DNA, 20 bp, human
gtgcagggctctgggcggga

SEQ ID NO: 387775 - DNA, 20 bp, human
gacttcggatgaagggaatg

SEQ ID NO: 387776 - DNA, 20 bp, human
ggtctcggaacggcatccgg

SEQ ID NO: 387777 - DNA, 20 bp, human
gacggcatccggaggcctgc

SEQ ID NO: 387778 - DNA, 20 bp, human
gcctgccgggcttttgggga

SEQ ID NO: 387779 - DNA, 20 bp, human
ggaggcctgccgggcttttg

SEQ ID NO: 387780 - DNA, 20 bp, human
gtgcactagtggaccccggg

SEQ ID NO: 387781 - DNA, 20 bp, human
gttcgcgccgcgtctcggaa

SEQ ID NO: 387782 - DNA, 20 bp, human
gaaggagttaagcgggccgg

SEQ ID NO: 387783 - DNA, 20 bp, human
ggcggcgcgaaggagttaag

SEQ ID NO: 387784 - DNA, 20 bp, human
gtgcatgcactagtggaccc

SEQ ID NO: 387785 - DNA, 20 bp, human
ggaccagtgcataataacta

SEQ ID NO: 387786 - DNA, 20 bp, human
gaaacgctgtggaccaaaga

SEQ ID NO: 387787 - DNA, 20 bp, human
gagcgagaagggtttttttc

SEQ ID NO: 387788 - DNA, 20 bp, human
gagcgcggaacggcagcagt

SEQ ID NO: 387789 - DNA, 20 bp, human
gcatccttgcggagaggccg

SEQ ID NO: 387790 - DNA, 20 bp, human
ggaagctcgtgagcgcggaa

SEQ ID NO: 387791 - DNA, 20 bp, human
ggatccggcccgcatccttg

SEQ ID NO: 387792 - DNA, 20 bp, human
gaagccggtagggcggtggt

SEQ ID NO: 387793 - DNA, 20 bp, human
gaggactagaaagccggatc

SEQ ID NO: 387794 - DNA, 20 bp, human
gagcgttttgaaatatgggg

SEQ ID NO: 387795 - DNA, 20 bp, human
gtgcaagattcggctttgag

SEQ ID NO: 387796 - DNA, 20 bp, human
gcagcccgcagagccgtctg

SEQ ID NO: 387797 - DNA, 20 bp, human
gtgcagaggcatgtgtgcta

SEQ ID NO: 387798 - DNA, 20 bp, human
gcagcccagcacacaaagcg

SEQ ID NO: 387799 - DNA, 20 bp, human
ggcccggaagctagtcctgc

SEQ ID NO: 387800 - DNA, 20 bp, human
gctgggctgcagtgtggcgc

SEQ ID NO: 387801 - DNA, 20 bp, human
ggaggctgggagacggctcg

SEQ ID NO: 387802 - DNA, 20 bp, human
ggggccgcgctttgtgtgct

SEQ ID NO: 387803 - DNA, 20 bp, human
ggcctctctgcaaacaacgc

SEQ ID NO: 387804 - DNA, 20 bp, human
ggccgaaatgccgagagcgc

SEQ ID NO: 387805 - DNA, 20 bp, human
gagaaagcgggcgcaggacc

SEQ ID NO: 387806 - DNA, 20 bp, human
gtgcaagcaaggcgggccgg

SEQ ID NO: 387807 - DNA, 20 bp, human
gggcatgcgcagtggggcgg

SEQ ID NO: 387808 - DNA, 20 bp, human
ggggaaccggcccgcgtccc

SEQ ID NO: 387809 - DNA, 20 bp, human
gggcccgcgtcccgggattg

SEQ ID NO: 387810 - DNA, 20 bp, human
gctgcggggaaggacacccc

SEQ ID NO: 387811 - DNA, 20 bp, human
gagcgagcgggcatgcgcag

SEQ ID NO: 387812 - DNA, 20 bp, human
gccccccaatcccgggacgc

SEQ ID NO: 387813 - DNA, 20 bp, human
gcatccttctcccccgaatg

SEQ ID NO: 387814 - DNA, 20 bp, human
gatgcgcagtggggcggagg

SEQ ID NO: 387815 - DNA, 20 bp, human
gcacagccggacaccgcaag

SEQ ID NO: 387816 - DNA, 20 bp, human
gtgggccaagccgggatgga

SEQ ID NO: 387817 - DNA, 20 bp, human
gaggacgggaggctggtagg

SEQ ID NO: 387818 - DNA, 20 bp, human
ggggctgggccaagccggga

SEQ ID NO: 387819 - DNA, 20 bp, human
gcactgctccggtgtcgctc

SEQ ID NO: 387820 - DNA, 20 bp, human
gccaccgcttctcacttcac

SEQ ID NO: 387821 - DNA, 20 bp, human
gactccagaagctcccgcgt

SEQ ID NO: 387822 - DNA, 20 bp, human
ggtaggaggagccttccggg

SEQ ID NO: 387823 - DNA, 20 bp, human
gggaggagcctccagcccga

SEQ ID NO: 387824 - DNA, 20 bp, human
gccttccgggaggatctggg

SEQ ID NO: 387825 - DNA, 20 bp, human
gccaagccgggatggagggt

SEQ ID NO: 387826 - DNA, 20 bp, human
gacccacggtcgtgaactgt

SEQ ID NO: 387827 - DNA, 20 bp, human
gacaccgagctctgggactc

SEQ ID NO: 387828 - DNA, 20 bp, human
gccgagctctgggactccgg

SEQ ID NO: 387829 - DNA, 20 bp, human
gtcaggcagaactgcactct

SEQ ID NO: 387830 - DNA, 20 bp, human
gggtcccgagcaagccaaag

SEQ ID NO: 387831 - DNA, 20 bp, human
gaaacgtaaagcatcaccca

SEQ ID NO: 387832 - DNA, 20 bp, human
gctagcagccgctgccgctt

SEQ ID NO: 387833 - DNA, 20 bp, human
ggactgcgacggtaccgggg

SEQ ID NO: 387834 - DNA, 20 bp, human
ggactctgggtccagccaaa

SEQ ID NO: 387835 - DNA, 20 bp, human
ggatgagaaggcgtggaacg

SEQ ID NO: 387836 - DNA, 20 bp, human
gccccctggcctgacgtcac

SEQ ID NO: 387837 - DNA, 20 bp, human
gaatgagctgaggagggact

SEQ ID NO: 387838 - DNA, 20 bp, human
gggagcagcagccaatggtc

SEQ ID NO: 387839 - DNA, 20 bp, human
ggaccccggaggaaaagcga

SEQ ID NO: 387840 - DNA, 20 bp, human
gcggacgcgccggtgacgtc

SEQ ID NO: 387841 - DNA, 20 bp, human
ggccccctccgcccgaccat

SEQ ID NO: 387842 - DNA, 20 bp, human
gctgaggagggacttggctg

SEQ ID NO: 387843 - DNA, 20 bp, human
ggcagccaatggtcgggcgg

SEQ ID NO: 387844 - DNA, 20 bp, human
gcaggccagggggcgctagt

SEQ ID NO: 387845 - DNA, 20 bp, human
gtccctcctcagctcattgg

SEQ ID NO: 387846 - DNA, 20 bp, human
gtgcaggcgcagagaaccgc

SEQ ID NO: 387847 - DNA, 20 bp, human
ggccctgcggacccacgtgt

SEQ ID NO: 387848 - DNA, 20 bp, human
gccgcccggaagtgcccgag

SEQ ID NO: 387849 - DNA, 20 bp, human
ggcggcccctcgggcacttc

SEQ ID NO: 387850 - DNA, 20 bp, human
gcgggtggagccccacacgt

SEQ ID NO: 387851 - DNA, 20 bp, human
gtgcgcctgcagatcgcgaa

SEQ ID NO: 387852 - DNA, 20 bp, human
gagtgcccgaggggccgcga

SEQ ID NO: 387853 - DNA, 20 bp, human
gaggtgggaggggtgatgag

SEQ ID NO: 387854 - DNA, 20 bp, human
gacgtgggtccgcagggcgg

SEQ ID NO: 387855 - DNA, 20 bp, human
gccccacacgtgggtccgca

SEQ ID NO: 387856 - DNA, 20 bp, human
gtccgtaggggtcgggaaaa

SEQ ID NO: 387857 - DNA, 20 bp, human
gcccggaagctgttatacca

SEQ ID NO: 387858 - DNA, 20 bp, human
gtaagacgggctgacgtaaa

SEQ ID NO: 387859 - DNA, 20 bp, human
ggggtggagtcattgttggc

SEQ ID NO: 387860 - DNA, 20 bp, human
ggggagaagccggaagagac

SEQ ID NO: 387861 - DNA, 20 bp, human
gggaaagggaaacgtcgcac

SEQ ID NO: 387862 - DNA, 20 bp, human
gcggggccttaggcaatcca

SEQ ID NO: 387863 - DNA, 20 bp, human
gcggggccacgcctggtggg

SEQ ID NO: 387864 - DNA, 20 bp, human
gcgactgcggaaggttgccc

SEQ ID NO: 387865 - DNA, 20 bp, human
ggcgtggccccgctctggga

SEQ ID NO: 387866 - DNA, 20 bp, human
gagtggtgaagtcgggaaag

SEQ ID NO: 387867 - DNA, 20 bp, human
ggaggcgtggtgtaaaaagt

SEQ ID NO: 387868 - DNA, 20 bp, human
gtagggtgtcccaatattgt

SEQ ID NO: 387869 - DNA, 20 bp, human
gactctcaatgcgcatgaca

SEQ ID NO: 387870 - DNA, 20 bp, human
gaatattgggacaccctagg

SEQ ID NO: 387871 - DNA, 20 bp, human
gcccgacttcaccactcact

SEQ ID NO: 387872 - DNA, 20 bp, human
ggcgaggagcgcctgtctag

SEQ ID NO: 387873 - DNA, 20 bp, human
gcggctgcttctaccgccta

SEQ ID NO: 387874 - DNA, 20 bp, human
ggcggtgctttgaggaagaa

SEQ ID NO: 387875 - DNA, 20 bp, human
gcgtggtgtaaaaagtgggg

SEQ ID NO: 387876 - DNA, 20 bp, human
gtcaaggagccgcttgtcat

SEQ ID NO: 387877 - DNA, 20 bp, human
ggggctatatcgcaaacgta

SEQ ID NO: 387878 - DNA, 20 bp, human
ggtcccccgcccgcaggagg

SEQ ID NO: 387879 - DNA, 20 bp, human
gcgttcagagaactacatcc

SEQ ID NO: 387880 - DNA, 20 bp, human
gggggcgagacctacgacgc

SEQ ID NO: 387881 - DNA, 20 bp, human
gtgaggcatccaatgacaag

SEQ ID NO: 387882 - DNA, 20 bp, human
gtccgcctaagtcattttat

SEQ ID NO: 387883 - DNA, 20 bp, human
gtgtagttctctgaacgctg

SEQ ID NO: 387884 - DNA, 20 bp, human
gccgaagccgagtgcggttg

SEQ ID NO: 387885 - DNA, 20 bp, human
ggcagacacggagacagcgc

SEQ ID NO: 387886 - DNA, 20 bp, human
ggctctgacgacgcacttgc

SEQ ID NO: 387887 - DNA, 20 bp, human
gagaacatgaagttaagcgt

SEQ ID NO: 387888 - DNA, 20 bp, human
gcctccacgcccaggagcgt

SEQ ID NO: 387889 - DNA, 20 bp, human
ggcagggttcccacgctcct

SEQ ID NO: 387890 - DNA, 20 bp, human
gggagtgcggcgcatgcgag

SEQ ID NO: 387891 - DNA, 20 bp, human
gaaacggagccgacccggag

SEQ ID NO: 387892 - DNA, 20 bp, human
gagcgtgggaaccctgctta

SEQ ID NO: 387893 - DNA, 20 bp, human
gtccgtctccggctatgcgc

SEQ ID NO: 387894 - DNA, 20 bp, human
gcatagccggagacggagac

SEQ ID NO: 387895 - DNA, 20 bp, human
ggggggcaccgagagcgcaa

SEQ ID NO: 387896 - DNA, 20 bp, human
gggcaagcggcgataagagg

SEQ ID NO: 387897 - DNA, 20 bp, human
ggctgcccaggctccaataa

SEQ ID NO: 387898 - DNA, 20 bp, human
gggtcaggaagaaagggcgg

SEQ ID NO: 387899 - DNA, 20 bp, human
ggctccaataagggcagggt

SEQ ID NO: 387900 - DNA, 20 bp, human
gtaaccgacaccccgggcaa

SEQ ID NO: 387901 - DNA, 20 bp, human
gacgggcaagcggcgataag

SEQ ID NO: 387902 - DNA, 20 bp, human
gggcaacggcaagtggaggc

SEQ ID NO: 387903 - DNA, 20 bp, human
gcgcgtgtgggcttctctaa

SEQ ID NO: 387904 - DNA, 20 bp, human
gctgaggtaaccgacacccc

SEQ ID NO: 387905 - DNA, 20 bp, human
gcccgggcaacggcaagtgg

SEQ ID NO: 387906 - DNA, 20 bp, human
gaacagctactcggggtcgg

SEQ ID NO: 387907 - DNA, 20 bp, human
gggcacctcggagcgagtac

SEQ ID NO: 387908 - DNA, 20 bp, human
ggggttttctaattgtgaga

SEQ ID NO: 387909 - DNA, 20 bp, human
gacagccctcccagcggaac

SEQ ID NO: 387910 - DNA, 20 bp, human
gtaaccctgttccgctggga

SEQ ID NO: 387911 - DNA, 20 bp, human
gaagtacaagaggggagcca

SEQ ID NO: 387912 - DNA, 20 bp, human
gtgcaaatgggttccttccc

SEQ ID NO: 387913 - DNA, 20 bp, human
gcctggctctcggccaggga

SEQ ID NO: 387914 - DNA, 20 bp, human
gtgaaagacgcactcactcc

SEQ ID NO: 387915 - DNA, 20 bp, human
gaaaggaacagccctcccag

SEQ ID NO: 387916 - DNA, 20 bp, human
ggaatcggagcagggaggat

SEQ ID NO: 387917 - DNA, 20 bp, human
gtgtccctggggcgagagga

SEQ ID NO: 387918 - DNA, 20 bp, human
gaaccagcggaaaacttcct

SEQ ID NO: 387919 - DNA, 20 bp, human
gcaaatccccgcccccgcga

SEQ ID NO: 387920 - DNA, 20 bp, human
gcatctggaggaagcggtag

SEQ ID NO: 387921 - DNA, 20 bp, human
ggagaagaaaccgagacaga

SEQ ID NO: 387922 - DNA, 20 bp, human
gtggggacacacaagcatca

SEQ ID NO: 387923 - DNA, 20 bp, human
gtggcccagaagacccccct

SEQ ID NO: 387924 - DNA, 20 bp, human
gccccctcggaatcggagca

SEQ ID NO: 387925 - DNA, 20 bp, human
gcaccaaggaagttttccgc

SEQ ID NO: 387926 - DNA, 20 bp, human
gtctccgcgaagaccctcgg

SEQ ID NO: 387927 - DNA, 20 bp, human
gtggaggcggaatcccccga

SEQ ID NO: 387928 - DNA, 20 bp, human
gctctctccgcgaagaccct

SEQ ID NO: 387929 - DNA, 20 bp, human
gcatgcatagcgctctatcc

SEQ ID NO: 387930 - DNA, 20 bp, human
gaatcccccgagggtcttcg

SEQ ID NO: 387931 - DNA, 20 bp, human
gtagcgctctatccgggaaa

SEQ ID NO: 387932 - DNA, 20 bp, human
ggaaacagaggcccgagggg

SEQ ID NO: 387933 - DNA, 20 bp, human
gatccgggaaagggtggagg

SEQ ID NO: 387934 - DNA, 20 bp, human
gtggcaggctggctgggtac

SEQ ID NO: 387935 - DNA, 20 bp, human
ggagagagcagagctacttc

SEQ ID NO: 387936 - DNA, 20 bp, human
gcgcccggcctgcccagcgg

SEQ ID NO: 387937 - DNA, 20 bp, human
gcccctgcccggctgctggg

SEQ ID NO: 387938 - DNA, 20 bp, human
ggcaaccgcggaaaacccgc

SEQ ID NO: 387939 - DNA, 20 bp, human
gctgcccagcgggggatgcg

SEQ ID NO: 387940 - DNA, 20 bp, human
gaggagccgtcgtcggacaa

SEQ ID NO: 387941 - DNA, 20 bp, human
gtccgcccgcgggttttccg

SEQ ID NO: 387942 - DNA, 20 bp, human
gaccgcggaaaacccgcggg

SEQ ID NO: 387943 - DNA, 20 bp, human
gcggggacgacggggttgtc

SEQ ID NO: 387944 - DNA, 20 bp, human
ggctgtgtccctgcgtccca

SEQ ID NO: 387945 - DNA, 20 bp, human
gtccgacgacggctcctgat

SEQ ID NO: 387946 - DNA, 20 bp, human
gggggcccgcaggcccggtc

SEQ ID NO: 387947 - DNA, 20 bp, human
gcccgcccgggtcctgtctg

SEQ ID NO: 387948 - DNA, 20 bp, human
ggcccgcaggcccggtcggg

SEQ ID NO: 387949 - DNA, 20 bp, human
gcagagggcgcagggggcga

SEQ ID NO: 387950 - DNA, 20 bp, human
gcgtccagccggccgccaga

SEQ ID NO: 387951 - DNA, 20 bp, human
ggcgcggcctccgcccgacc

SEQ ID NO: 387952 - DNA, 20 bp, human
gccagagagtcacgtgactt

SEQ ID NO: 387953 - DNA, 20 bp, human
ggctgcgaagtgcgtccagc

SEQ ID NO: 387954 - DNA, 20 bp, human
gaaactccctcgccccgccc

SEQ ID NO: 387955 - DNA, 20 bp, human
ggactcacgcggggacaccc

SEQ ID NO: 387956 - DNA, 20 bp, human
gtcctctgactcatttgcat

SEQ ID NO: 387957 - DNA, 20 bp, human
gctacagcggaaaatgccat

SEQ ID NO: 387958 - DNA, 20 bp, human
ggcattggcaaccaaaacta

SEQ ID NO: 387959 - DNA, 20 bp, human
gcccaccctggaagaaaagc

SEQ ID NO: 387960 - DNA, 20 bp, human
gtggggtctgttgcagtctt

SEQ ID NO: 387961 - DNA, 20 bp, human
gtaattgtgtaactctacag

SEQ ID NO: 387962 - DNA, 20 bp, human
gactgcaacagaccccaccc

SEQ ID NO: 387963 - DNA, 20 bp, human
ggtgtcaattatgggatatg

SEQ ID NO: 387964 - DNA, 20 bp, human
gtaaggaagtcatatatcac

SEQ ID NO: 387965 - DNA, 20 bp, human
gtatttgcagtgtcaattat

SEQ ID NO: 387966 - DNA, 20 bp, human
ggagccgagcggctggggcg

SEQ ID NO: 387967 - DNA, 20 bp, human
gggaggagccgggaggtcgg

SEQ ID NO: 387968 - DNA, 20 bp, human
gaacttgcaggagggaccaa

SEQ ID NO: 387969 - DNA, 20 bp, human
gcgcaggagagcgcggagaa

SEQ ID NO: 387970 - DNA, 20 bp, human
gcaggagtcggaagtggccc

SEQ ID NO: 387971 - DNA, 20 bp, human
gaccgcgaggcccagatcgc

SEQ ID NO: 387972 - DNA, 20 bp, human
ggcaggagggaccaagggtg

SEQ ID NO: 387973 - DNA, 20 bp, human
ggagctggggaccggacagc

SEQ ID NO: 387974 - DNA, 20 bp, human
gctccagcgcccagcgatct

SEQ ID NO: 387975 - DNA, 20 bp, human
ggagagcgcggagaagggct

SEQ ID NO: 387976 - DNA, 20 bp, human
gccgcccgcgcggaagggac

SEQ ID NO: 387977 - DNA, 20 bp, human
ggggcgggcaatgtacgaaa

SEQ ID NO: 387978 - DNA, 20 bp, human
gcgcgggcggggcgagtgga

SEQ ID NO: 387979 - DNA, 20 bp, human
gcccaggcctggcaactctc

SEQ ID NO: 387980 - DNA, 20 bp, human
gggagcagggcactgcgacg

SEQ ID NO: 387981 - DNA, 20 bp, human
gacagacagagaacctgggg

SEQ ID NO: 387982 - DNA, 20 bp, human
gacattgcccgccctgtcat

SEQ ID NO: 387983 - DNA, 20 bp, human
gcgaaggggcccggatgcgg

SEQ ID NO: 387984 - DNA, 20 bp, human
gaagggaccggagagttgcc

SEQ ID NO: 387985 - DNA, 20 bp, human
gtcgcgaaggggcccggatg

SEQ ID NO: 387986 - DNA, 20 bp, human
gaggcggggctcaaggggtg

SEQ ID NO: 387987 - DNA, 20 bp, human
gcggaggttaagcagagagt

SEQ ID NO: 387988 - DNA, 20 bp, human
gtaagcagagagtaggtagg

SEQ ID NO: 387989 - DNA, 20 bp, human
ggtaggtaggcggggctcaa

SEQ ID NO: 387990 - DNA, 20 bp, human
gggtgacagaagtgatgaac

SEQ ID NO: 387991 - DNA, 20 bp, human
ggacagaagtgatgaaccgg

SEQ ID NO: 387992 - DNA, 20 bp, human
ggaggaaggtgctgggacca

SEQ ID NO: 387993 - DNA, 20 bp, human
ggtctcaattctttgaaggg

SEQ ID NO: 387994 - DNA, 20 bp, human
gtctggggtaggaggtcagt

SEQ ID NO: 387995 - DNA, 20 bp, human
gcatttctacagtactggga

SEQ ID NO: 387996 - DNA, 20 bp, human
gaggcggggctcaaggggtg

SEQ ID NO: 387997 - DNA, 20 bp, human
gcggaggttaagcagagagt

SEQ ID NO: 387998 - DNA, 20 bp, human
gtaagcagagagtaggtagg

SEQ ID NO: 387999 - DNA, 20 bp, human
ggtaggtaggcggggctcaa

SEQ ID NO: 388000 - DNA, 20 bp, human
gggtgacagaagtgatgaac

SEQ ID NO: 388001 - DNA, 20 bp, human
ggacagaagtgatgaaccgg

SEQ ID NO: 388002 - DNA, 20 bp, human
ggaggaaggtgctgggacca

SEQ ID NO: 388003 - DNA, 20 bp, human
ggtctcaattctttgaaggg

SEQ ID NO: 388004 - DNA, 20 bp, human
gtctggggtaggaggtcagt

SEQ ID NO: 388005 - DNA, 20 bp, human
gcatttctacagtactggga

SEQ ID NO: 388006 - DNA, 20 bp, human
gccgcgcgaggcaagtccaa

SEQ ID NO: 388007 - DNA, 20 bp, human
gccgacgcagggcgcgggta

SEQ ID NO: 388008 - DNA, 20 bp, human
gaactcgcgcaggaaaggag

SEQ ID NO: 388009 - DNA, 20 bp, human
gacgcagggcgcgggtaggg

SEQ ID NO: 388010 - DNA, 20 bp, human
gagcccgagcgtccggcgcc

SEQ ID NO: 388011 - DNA, 20 bp, human
gctggggttaaatatcccgg

SEQ ID NO: 388012 - DNA, 20 bp, human
gcaaacttggcctcacccta

SEQ ID NO: 388013 - DNA, 20 bp, human
ggggttaaatatcccggggg

SEQ ID NO: 388014 - DNA, 20 bp, human
ggcccggcgggctccaggct

SEQ ID NO: 388015 - DNA, 20 bp, human
gtcaccctagggaaggggct

SEQ ID NO: 388016 - DNA, 20 bp, human
gaagctgagagcggcaaggg

SEQ ID NO: 388017 - DNA, 20 bp, human
gcagaagctgagagcggcaa

SEQ ID NO: 388018 - DNA, 20 bp, human
gtgcagcggcatccacgcgg

SEQ ID NO: 388019 - DNA, 20 bp, human
gcaagggcggtcacagagga

SEQ ID NO: 388020 - DNA, 20 bp, human
ggaaaagggggcggggtcag

SEQ ID NO: 388021 - DNA, 20 bp, human
ggaatgcagcggcatccacg

SEQ ID NO: 388022 - DNA, 20 bp, human
gcaggcgctcggtggacgga

SEQ ID NO: 388023 - DNA, 20 bp, human
gcgcaggtgccccgaaaagg

SEQ ID NO: 388024 - DNA, 20 bp, human
gactcgcccggtagtgacgg

SEQ ID NO: 388025 - DNA, 20 bp, human
gaaaacgactccgaatgcag

SEQ ID NO: 388026 - DNA, 20 bp, human
gcaagcgcgtccaagtgggg

SEQ ID NO: 388027 - DNA, 20 bp, human
gccagggcgaaggttagttc

SEQ ID NO: 388028 - DNA, 20 bp, human
ggggcaggcgtcattcgggg

SEQ ID NO: 388029 - DNA, 20 bp, human
gtccgcaagcgcgtccaagt

SEQ ID NO: 388030 - DNA, 20 bp, human
gccgaatgacgcctgcccgg

SEQ ID NO: 388031 - DNA, 20 bp, human
gccgggctgtggtttgtttc

SEQ ID NO: 388032 - DNA, 20 bp, human
ggcgccgccccaagtcagcc

SEQ ID NO: 388033 - DNA, 20 bp, human
gaggacaggcaccgaaactt

SEQ ID NO: 388034 - DNA, 20 bp, human
gtgcaaattccaccacaggt

SEQ ID NO: 388035 - DNA, 20 bp, human
gtattgtcaccaacctgtgg

SEQ ID NO: 388036 - DNA, 20 bp, human
gaggaaggcctgggttttgg

SEQ ID NO: 388037 - DNA, 20 bp, human
gcccgcgggtataaattcag

SEQ ID NO: 388038 - DNA, 20 bp, human
gttcctggaggtgctagggg

SEQ ID NO: 388039 - DNA, 20 bp, human
gggccttcctggaggtgcta

SEQ ID NO: 388040 - DNA, 20 bp, human
gacttccaagcactcagaaa

SEQ ID NO: 388041 - DNA, 20 bp, human
gacccgcgggggaaaaggcg

SEQ ID NO: 388042 - DNA, 20 bp, human
gtgaactacctcctggccta

SEQ ID NO: 388043 - DNA, 20 bp, human
ggaccacgccttttcccccg

SEQ ID NO: 388044 - DNA, 20 bp, human
gtttatacccgcgggggaaa

SEQ ID NO: 388045 - DNA, 20 bp, human
gtgccccttttctgagtgct

SEQ ID NO: 388046 - DNA, 20 bp, human
gcccaccgccgctctgggga

SEQ ID NO: 388047 - DNA, 20 bp, human
gcacccccaccgccgctctg

SEQ ID NO: 388048 - DNA, 20 bp, human
gtggggaaggtggatagcat

SEQ ID NO: 388049 - DNA, 20 bp, human
gggggcacgcctgggcgaga

SEQ ID NO: 388050 - DNA, 20 bp, human
gtccaccttccccagagcgg

SEQ ID NO: 388051 - DNA, 20 bp, human
gggcaaggggagcgggatat

SEQ ID NO: 388052 - DNA, 20 bp, human
gaccttccccagagcggcgg

SEQ ID NO: 388053 - DNA, 20 bp, human
gtacccacagcctctcagga

SEQ ID NO: 388054 - DNA, 20 bp, human
gtccctgtccccagacggag

SEQ ID NO: 388055 - DNA, 20 bp, human
gtgccctgcccatgggtttc

SEQ ID NO: 388056 - DNA, 20 bp, human
gagtgcctggaagtgactgc

SEQ ID NO: 388057 - DNA, 20 bp, human
gaggagggcccaggttgtgt

SEQ ID NO: 388058 - DNA, 20 bp, human
ggcacccacccacacaacct

SEQ ID NO: 388059 - DNA, 20 bp, human
gccttcccgcagtcacttcc

SEQ ID NO: 388060 - DNA, 20 bp, human
gtgaccacgccttttttccg

SEQ ID NO: 388061 - DNA, 20 bp, human
gttccggggtataaaagcgg

SEQ ID NO: 388062 - DNA, 20 bp, human
gataccccggaaaaaaggcg

SEQ ID NO: 388063 - DNA, 20 bp, human
gtttttccggggtataaaag

SEQ ID NO: 388064 - DNA, 20 bp, human
gttgtgctttgaccatgcaa

SEQ ID NO: 388065 - DNA, 20 bp, human
gagggcccaggttgtgtggg

SEQ ID NO: 388066 - DNA, 20 bp, human
ggggcccggcggtgccagcc

SEQ ID NO: 388067 - DNA, 20 bp, human
ggggacgcggggccccgctc

SEQ ID NO: 388068 - DNA, 20 bp, human
gggcgcggcgaacacccccg

SEQ ID NO: 388069 - DNA, 20 bp, human
gcccaagctcccctggtttg

SEQ ID NO: 388070 - DNA, 20 bp, human
gggcggagaccggaccaagg

SEQ ID NO: 388071 - DNA, 20 bp, human
ggggctgcagacaggttggc

SEQ ID NO: 388072 - DNA, 20 bp, human
ggcgtcccaccgcaaaccag

SEQ ID NO: 388073 - DNA, 20 bp, human
gccgcctcccgggaaggaat

SEQ ID NO: 388074 - DNA, 20 bp, human
gcaggagccagtgccgtgaa

SEQ ID NO: 388075 - DNA, 20 bp, human
gcgcgcccgctgggccacag

SEQ ID NO: 388076 - DNA, 20 bp, human
ggggcggaaaggatccccca

SEQ ID NO: 388077 - DNA, 20 bp, human
gggggtgtgcagaaagctcc

SEQ ID NO: 388078 - DNA, 20 bp, human
gtcgcccagcgagaggacaa

SEQ ID NO: 388079 - DNA, 20 bp, human
gtggctggatcggactctca

SEQ ID NO: 388080 - DNA, 20 bp, human
gaacccgaagtgaaggggtc

SEQ ID NO: 388081 - DNA, 20 bp, human
ggcggtggtgtctggcccct

SEQ ID NO: 388082 - DNA, 20 bp, human
gtccagggttaacgctttca

SEQ ID NO: 388083 - DNA, 20 bp, human
gggcggctgctgtctccgcg

SEQ ID NO: 388084 - DNA, 20 bp, human
gtgcctgaccccttcacttc

SEQ ID NO: 388085 - DNA, 20 bp, human
gtagaaaaatgactgatcaa

SEQ ID NO: 388086 - DNA, 20 bp, human
ggagctgccaggaccccgca

SEQ ID NO: 388087 - DNA, 20 bp, human
gctgcgtccctgcggggtcc

SEQ ID NO: 388088 - DNA, 20 bp, human
gcgtcccgaagcggacctca

SEQ ID NO: 388089 - DNA, 20 bp, human
gggggcggggcgtcccgaag

SEQ ID NO: 388090 - DNA, 20 bp, human
gagagctccgccccggaagg

SEQ ID NO: 388091 - DNA, 20 bp, human
gtcctggcgcgggagctgcc

SEQ ID NO: 388092 - DNA, 20 bp, human
ggcacgctggactagatcac

SEQ ID NO: 388093 - DNA, 20 bp, human
gcccgccttgaggtccgctt

SEQ ID NO: 388094 - DNA, 20 bp, human
gaagggggtctgcgtccctg

SEQ ID NO: 388095 - DNA, 20 bp, human
gtagtccagcgtgcgtggtg

SEQ ID NO: 388096 - DNA, 20 bp, human
gtgacaggctgggacagtca

SEQ ID NO: 388097 - DNA, 20 bp, human
gagaatgagtaccacctgac

SEQ ID NO: 388098 - DNA, 20 bp, human
gaataagtatacccaggaag

SEQ ID NO: 388099 - DNA, 20 bp, human
gactgtcccagcctgtcagg

SEQ ID NO: 388100 - DNA, 20 bp, human
ggcccaggctcttctagatc

SEQ ID NO: 388101 - DNA, 20 bp, human
ggcttggggtgtgtgccggc

SEQ ID NO: 388102 - DNA, 20 bp, human
gagagcaggaggagccgacc

SEQ ID NO: 388103 - DNA, 20 bp, human
ggaatagaataagtataccc

SEQ ID NO: 388104 - DNA, 20 bp, human
gcacctcaatggagccttga

SEQ ID NO: 388105 - DNA, 20 bp, human
ggagtaccacctgacaggct

SEQ ID NO: 388106 - DNA, 20 bp, human
gccgcccccgcctgctgggt

SEQ ID NO: 388107 - DNA, 20 bp, human
gcccctccctacccaagagg

SEQ ID NO: 388108 - DNA, 20 bp, human
gggtcccacccagcaggcgg

SEQ ID NO: 388109 - DNA, 20 bp, human
gcagaccagagcctcctctt

SEQ ID NO: 388110 - DNA, 20 bp, human
gcctacccaagaggaggctc

SEQ ID NO: 388111 - DNA, 20 bp, human
ggggtgggaccgagctcgcc

SEQ ID NO: 388112 - DNA, 20 bp, human
gctggttgaggggctgaatt

SEQ ID NO: 388113 - DNA, 20 bp, human
gccaggcggtgctggttgag

SEQ ID NO: 388114 - DNA, 20 bp, human
gctcggtcccacccagcagg

SEQ ID NO: 388115 - DNA, 20 bp, human
ggaaccacaggtagaaagag

SEQ ID NO: 388116 - DNA, 20 bp, human
gggaagggccggtatgaagg

SEQ ID NO: 388117 - DNA, 20 bp, human
gcctcccaggggacgggtag

SEQ ID NO: 388118 - DNA, 20 bp, human
gaggaggcgcccgatgggag

SEQ ID NO: 388119 - DNA, 20 bp, human
gtatgaaggaggcgcccgat

SEQ ID NO: 388120 - DNA, 20 bp, human
gaggggaagggccggtatga

SEQ ID NO: 388121 - DNA, 20 bp, human
gtggactggaatggtgcagg

SEQ ID NO: 388122 - DNA, 20 bp, human
ggctgtccaggcaaagccga

SEQ ID NO: 388123 - DNA, 20 bp, human
ggggaccctcggctgctccc

SEQ ID NO: 388124 - DNA, 20 bp, human
gcaccattccagtccactcc

SEQ ID NO: 388125 - DNA, 20 bp, human
gcggcgctgggggacacagg

SEQ ID NO: 388126 - DNA, 20 bp, human
gagacagggtgtaaatatca

SEQ ID NO: 388127 - DNA, 20 bp, human
gcttggatggggtaagagac

SEQ ID NO: 388128 - DNA, 20 bp, human
ggcatcttgcaactgtcacc

SEQ ID NO: 388129 - DNA, 20 bp, human
gctaagtttgagtcttggat

SEQ ID NO: 388130 - DNA, 20 bp, human
gggggctgtctgtgtcttcg

SEQ ID NO: 388131 - DNA, 20 bp, human
gcagggagatagacaagaca

SEQ ID NO: 388132 - DNA, 20 bp, human
ggtactctgtgagaggtgcc

SEQ ID NO: 388133 - DNA, 20 bp, human
gaacattcggcttgatgctg

SEQ ID NO: 388134 - DNA, 20 bp, human
gataagctgtactctgtgag

SEQ ID NO: 388135 - DNA, 20 bp, human
gtgtgtcttcgcggcagcta

SEQ ID NO: 388136 - DNA, 20 bp, human
gtgaagtgcgtgtgaggagg

SEQ ID NO: 388137 - DNA, 20 bp, human
gacacagcccggtcccccgc

SEQ ID NO: 388138 - DNA, 20 bp, human
ggacctgagaatcccgaccc

SEQ ID NO: 388139 - DNA, 20 bp, human
gctggggaaccccacagaat

SEQ ID NO: 388140 - DNA, 20 bp, human
gccccgcaggtcgccggcag

SEQ ID NO: 388141 - DNA, 20 bp, human
gaatggggacagggacccct

SEQ ID NO: 388142 - DNA, 20 bp, human
ggggacggggcgtgtccaac

SEQ ID NO: 388143 - DNA, 20 bp, human
gcgcccctgccggcgacctg

SEQ ID NO: 388144 - DNA, 20 bp, human
ggggactcgcagataccacc

SEQ ID NO: 388145 - DNA, 20 bp, human
gacccccctcaggccaacct

SEQ ID NO: 388146 - DNA, 20 bp, human
gccactaggagccccgctca

SEQ ID NO: 388147 - DNA, 20 bp, human
gctcaccgcggctctcgccg

SEQ ID NO: 388148 - DNA, 20 bp, human
gctctcccgtagcccggcaa

SEQ ID NO: 388149 - DNA, 20 bp, human
gactgaagcggatgagtgtg

SEQ ID NO: 388150 - DNA, 20 bp, human
gcggctgacgcagtgtgcgc

SEQ ID NO: 388151 - DNA, 20 bp, human
gcgagagccgcggtgagggc

SEQ ID NO: 388152 - DNA, 20 bp, human
gctgacgcagtgtgcgctgg

SEQ ID NO: 388153 - DNA, 20 bp, human
gaaggtggggaacaccccgg

SEQ ID NO: 388154 - DNA, 20 bp, human
gccagccagaggggatacgg

SEQ ID NO: 388155 - DNA, 20 bp, human
gctggccgccgtatcccctc

SEQ ID NO: 388156 - DNA, 20 bp, human
gctcaagagaagccagagtt

SEQ ID NO: 388157 - DNA, 20 bp, human
gttgagctatactcccccac

SEQ ID NO: 388158 - DNA, 20 bp, human
gagctctcctaccagtccca

SEQ ID NO: 388159 - DNA, 20 bp, human
gagagctataattcagcctg

SEQ ID NO: 388160 - DNA, 20 bp, human
gtcagcgccgtgggactggt

SEQ ID NO: 388161 - DNA, 20 bp, human
gttagaaatcagccaaactc

SEQ ID NO: 388162 - DNA, 20 bp, human
gcggcgctgaatgatgtcat

SEQ ID NO: 388163 - DNA, 20 bp, human
gagactattgtgcctcacac

SEQ ID NO: 388164 - DNA, 20 bp, human
ggctataattcagcctgtgg

SEQ ID NO: 388165 - DNA, 20 bp, human
gatctgtctgccagctggaa

SEQ ID NO: 388166 - DNA, 20 bp, human
ggcacaaggcagccagatct

SEQ ID NO: 388167 - DNA, 20 bp, human
gagcacaggagtcccagatc

SEQ ID NO: 388168 - DNA, 20 bp, human
gtgggagtggtcggattggt

SEQ ID NO: 388169 - DNA, 20 bp, human
gtggttgggagtggtcggat

SEQ ID NO: 388170 - DNA, 20 bp, human
gagtgttgcaacagcgggac

SEQ ID NO: 388171 - DNA, 20 bp, human
gggactcctgtgcttgtgac

SEQ ID NO: 388172 - DNA, 20 bp, human
gtgaggcagtgttgcaacag

SEQ ID NO: 388173 - DNA, 20 bp, human
ggctgtgatccatctgggaa

SEQ ID NO: 388174 - DNA, 20 bp, human
gggtcggattggtgggttgg

SEQ ID NO: 388175 - DNA, 20 bp, human
ggtaaaggggaggattacta

SEQ ID NO: 388176 - DNA, 20 bp, human
gaggaggggacgataggagg

SEQ ID NO: 388177 - DNA, 20 bp, human
gtcgaagaggaggggacgat

SEQ ID NO: 388178 - DNA, 20 bp, human
gtggagatggtgattcgaag

SEQ ID NO: 388179 - DNA, 20 bp, human
gccagcgatgctggagtggt

SEQ ID NO: 388180 - DNA, 20 bp, human
gatggtgattcgaagaggag

SEQ ID NO: 388181 - DNA, 20 bp, human
gcggcccagcgatgctggag

SEQ ID NO: 388182 - DNA, 20 bp, human
gggtatcggcccagcgatgc

SEQ ID NO: 388183 - DNA, 20 bp, human
gggcccagcagcgtctgggg

SEQ ID NO: 388184 - DNA, 20 bp, human
ggacgataggaggaggttga

SEQ ID NO: 388185 - DNA, 20 bp, human
gcgtgggggaggcgtgtcca

SEQ ID NO: 388186 - DNA, 20 bp, human
gcctggagcagggtacagga

SEQ ID NO: 388187 - DNA, 20 bp, human
ggtgacccctaacactgcat

SEQ ID NO: 388188 - DNA, 20 bp, human
gactagggtacactgaggtg

SEQ ID NO: 388189 - DNA, 20 bp, human
gagtctgcactgatgatggc

SEQ ID NO: 388190 - DNA, 20 bp, human
gctgcctgcagacatgacta

SEQ ID NO: 388191 - DNA, 20 bp, human
gtccccctggagcagggtac

SEQ ID NO: 388192 - DNA, 20 bp, human
gggagggccaaacatttgca

SEQ ID NO: 388193 - DNA, 20 bp, human
gacatgactagggtacactg

SEQ ID NO: 388194 - DNA, 20 bp, human
ggtaccctagtcatgtctgc

SEQ ID NO: 388195 - DNA, 20 bp, human
ggggccaaacatttgcaggg

SEQ ID NO: 388196 - DNA, 20 bp, human
ggcacgcgcctgttgaccca

SEQ ID NO: 388197 - DNA, 20 bp, human
gaaggcgttccaggtagagc

SEQ ID NO: 388198 - DNA, 20 bp, human
gaaagagcccggcctcctcc

SEQ ID NO: 388199 - DNA, 20 bp, human
ggttccaggtagagcgggga

SEQ ID NO: 388200 - DNA, 20 bp, human
gggaaaggcgaaggcgttcc

SEQ ID NO: 388201 - DNA, 20 bp, human
gtgtgcggttggaaaggcga

SEQ ID NO: 388202 - DNA, 20 bp, human
gttcctcagcgaacgccaag

SEQ ID NO: 388203 - DNA, 20 bp, human
gtcccgggtgacatcacaaa

SEQ ID NO: 388204 - DNA, 20 bp, human
gtctccctccccgctctacc

SEQ ID NO: 388205 - DNA, 20 bp, human
gctttctcagcgctttccct

SEQ ID NO: 388206 - DNA, 20 bp, human
ggggctgcctgctgcgacca

SEQ ID NO: 388207 - DNA, 20 bp, human
gcacctggtcggactcggtt

SEQ ID NO: 388208 - DNA, 20 bp, human
gggtctaggccgagcagagg

SEQ ID NO: 388209 - DNA, 20 bp, human
gttggggcgagagtcggggt

SEQ ID NO: 388210 - DNA, 20 bp, human
gtagacctgagctcattagg

SEQ ID NO: 388211 - DNA, 20 bp, human
gcgccccgcgccgtcgagaa

SEQ ID NO: 388212 - DNA, 20 bp, human
gccaggcgggcccttctcga

SEQ ID NO: 388213 - DNA, 20 bp, human
gtcattaggcggcagcggac

SEQ ID NO: 388214 - DNA, 20 bp, human
ggggcccttctcgacggcgc

SEQ ID NO: 388215 - DNA, 20 bp, human
gctgaaggcggaaccacgac

SEQ ID NO: 388216 - DNA, 20 bp, human
ggtgccctggggtctgaaca

SEQ ID NO: 388217 - DNA, 20 bp, human
ggggcacaaaggcggggtct

SEQ ID NO: 388218 - DNA, 20 bp, human
ggtggctataaggactgtgg

SEQ ID NO: 388219 - DNA, 20 bp, human
gccctggggtctgaacacgg

SEQ ID NO: 388220 - DNA, 20 bp, human
gggtgtggctataaggactg

SEQ ID NO: 388221 - DNA, 20 bp, human
ggccctgaaggtccagactg

SEQ ID NO: 388222 - DNA, 20 bp, human
gcagaccccagggcacagta

SEQ ID NO: 388223 - DNA, 20 bp, human
ggtctgaacacggtggtctt

SEQ ID NO: 388224 - DNA, 20 bp, human
gggcagaataagccaatgct

SEQ ID NO: 388225 - DNA, 20 bp, human
ggctgctcagagctagtctt

SEQ ID NO: 388226 - DNA, 20 bp, human
gctgccctcctcagcacctg

SEQ ID NO: 388227 - DNA, 20 bp, human
ggggagggatggtaccaggt

SEQ ID NO: 388228 - DNA, 20 bp, human
gaggcagcctggtgtgtcgg

SEQ ID NO: 388229 - DNA, 20 bp, human
gggaaggaggagacccccgt

SEQ ID NO: 388230 - DNA, 20 bp, human
gggagggaggggttcctatg

SEQ ID NO: 388231 - DNA, 20 bp, human
gtgacactgtacttcctcca

SEQ ID NO: 388232 - DNA, 20 bp, human
gccagagctcagtccaaggg

SEQ ID NO: 388233 - DNA, 20 bp, human
gtcagtccaagggtggttct

SEQ ID NO: 388234 - DNA, 20 bp, human
gtctggggagggatggtacc

SEQ ID NO: 388235 - DNA, 20 bp, human
gagccaagctgcagttggta

SEQ ID NO: 388236 - DNA, 20 bp, human
gagcttctggccctggaggt

SEQ ID NO: 388237 - DNA, 20 bp, human
ggcccgccgcacctgggctg

SEQ ID NO: 388238 - DNA, 20 bp, human
gtggggactcacaggatatt

SEQ ID NO: 388239 - DNA, 20 bp, human
gtgtgctgcccgccgcacct

SEQ ID NO: 388240 - DNA, 20 bp, human
ggggccattcaaacagctaa

SEQ ID NO: 388241 - DNA, 20 bp, human
gactagtggtcctggctcta

SEQ ID NO: 388242 - DNA, 20 bp, human
gttgacggaactagtggtcc

SEQ ID NO: 388243 - DNA, 20 bp, human
ggcagagatgactcaggaaa

SEQ ID NO: 388244 - DNA, 20 bp, human
ggatattaggaggccccaag

SEQ ID NO: 388245 - DNA, 20 bp, human
ggtcctggctgatcgtgtca

SEQ ID NO: 388246 - DNA, 20 bp, human
gggggctctaggggatttcg

SEQ ID NO: 388247 - DNA, 20 bp, human
gtcccatgagaccccgcccc

SEQ ID NO: 388248 - DNA, 20 bp, human
ggatgtgtcacagatgacgc

SEQ ID NO: 388249 - DNA, 20 bp, human
ggccaggggcggggtctcat

SEQ ID NO: 388250 - DNA, 20 bp, human
gtcctggagagctatcttaa

SEQ ID NO: 388251 - DNA, 20 bp, human
gggcagggacgggggctcta

SEQ ID NO: 388252 - DNA, 20 bp, human
gtgaaatgaatgatttcata

SEQ ID NO: 388253 - DNA, 20 bp, human
gccccgtccctgcctgataa

SEQ ID NO: 388254 - DNA, 20 bp, human
gtgaagtgccattatcaggc

SEQ ID NO: 388255 - DNA, 20 bp, human
gggcacttcaaattgcttct

SEQ ID NO: 388256 - DNA, 20 bp, human
gaggggtgcatggatcctga

SEQ ID NO: 388257 - DNA, 20 bp, human
gttgaggtgagtgcagataa

SEQ ID NO: 388258 - DNA, 20 bp, human
gcttgtctcaaagtagtcgt

SEQ ID NO: 388259 - DNA, 20 bp, human
gagtgcagataaggggtgca

SEQ ID NO: 388260 - DNA, 20 bp, human
gttgcaggttcaatagatgt

SEQ ID NO: 388261 - DNA, 20 bp, human
gagaaaatccctcccctctt

SEQ ID NO: 388262 - DNA, 20 bp, human
gggctgaggacattatcaaa

SEQ ID NO: 388263 - DNA, 20 bp, human
gtgagacaagagctgtccct

SEQ ID NO: 388264 - DNA, 20 bp, human
gagctctaagcctcatggcc

SEQ ID NO: 388265 - DNA, 20 bp, human
gtcccctttcctactgccca

SEQ ID NO: 388266 - DNA, 20 bp, human
gacctccagaaagacagctg

SEQ ID NO: 388267 - DNA, 20 bp, human
ggaagaggcagcctcgcctg

SEQ ID NO: 388268 - DNA, 20 bp, human
gactgaagggcctccttcat

SEQ ID NO: 388269 - DNA, 20 bp, human
gaggctgggggctactccag

SEQ ID NO: 388270 - DNA, 20 bp, human
ggatgcaggaggaatgtctg

SEQ ID NO: 388271 - DNA, 20 bp, human
gccttggagggcccccatga

SEQ ID NO: 388272 - DNA, 20 bp, human
ggacagctgaggatggcaag

SEQ ID NO: 388273 - DNA, 20 bp, human
gtggagggcccccatgaagg

SEQ ID NO: 388274 - DNA, 20 bp, human
gccagaaagacagctgagga

SEQ ID NO: 388275 - DNA, 20 bp, human
gtggggctgattggctcccg

SEQ ID NO: 388276 - DNA, 20 bp, human
gtgcgcgcagcgaacggagt

SEQ ID NO: 388277 - DNA, 20 bp, human
ggggcgctcagaggtcgggt

SEQ ID NO: 388278 - DNA, 20 bp, human
gcgtgtgcgggcacctcctg

SEQ ID NO: 388279 - DNA, 20 bp, human
gcaaactccgagcctctcgc

SEQ ID NO: 388280 - DNA, 20 bp, human
ggcaacggacctcgccctgg

SEQ ID NO: 388281 - DNA, 20 bp, human
gctcccgcggccgcacgcaa

SEQ ID NO: 388282 - DNA, 20 bp, human
ggcccgggcgtgcaccacca

SEQ ID NO: 388283 - DNA, 20 bp, human
gggctgggcgctcagaggtc

SEQ ID NO: 388284 - DNA, 20 bp, human
gccgggacccgagggatcgg

SEQ ID NO: 388285 - DNA, 20 bp, human
ggcggggaggtggggaactc

SEQ ID NO: 388286 - DNA, 20 bp, human
gtgcgcgcagcgaacggagt

SEQ ID NO: 388287 - DNA, 20 bp, human
ggggcgctcagaggtcgggt

SEQ ID NO: 388288 - DNA, 20 bp, human
gcgtgtgcgggcacctcctg

SEQ ID NO: 388289 - DNA, 20 bp, human
gcaaactccgagcctctcgc

SEQ ID NO: 388290 - DNA, 20 bp, human
ggcaacggacctcgccctgg

SEQ ID NO: 388291 - DNA, 20 bp, human
gctcccgcggccgcacgcaa

SEQ ID NO: 388292 - DNA, 20 bp, human
ggcccgggcgtgcaccacca

SEQ ID NO: 388293 - DNA, 20 bp, human
gggctgggcgctcagaggtc

SEQ ID NO: 388294 - DNA, 20 bp, human
gccgggacccgagggatcgg

SEQ ID NO: 388295 - DNA, 20 bp, human
ggcggggaggtggggaactc

SEQ ID NO: 388296 - DNA, 20 bp, human
gtcgctggggcagttcacta

SEQ ID NO: 388297 - DNA, 20 bp, human
ggcagtgcgcaggaaccctg

SEQ ID NO: 388298 - DNA, 20 bp, human
ggtgccaggagcaggatggg

SEQ ID NO: 388299 - DNA, 20 bp, human
gaaaggaggggtgggctcga

SEQ ID NO: 388300 - DNA, 20 bp, human
ggctcctggcactccgtcgt

SEQ ID NO: 388301 - DNA, 20 bp, human
gggcaacgctggccccacga

SEQ ID NO: 388302 - DNA, 20 bp, human
gcaaccctggggccgcccca

SEQ ID NO: 388303 - DNA, 20 bp, human
gcactaggggtgactgaagg

SEQ ID NO: 388304 - DNA, 20 bp, human
gggaggaggaaagcaagcta

SEQ ID NO: 388305 - DNA, 20 bp, human
gcgggtaagggtacgggcag

SEQ ID NO: 388306 - DNA, 20 bp, human
gacagattgagcaatccaat

SEQ ID NO: 388307 - DNA, 20 bp, human
gtctacccctactgtacagt

SEQ ID NO: 388308 - DNA, 20 bp, human
gccacccttaagtgtagcaa

SEQ ID NO: 388309 - DNA, 20 bp, human
gcaaacctactgtacagtag

SEQ ID NO: 388310 - DNA, 20 bp, human
ggattgagcaatccaatcgg

SEQ ID NO: 388311 - DNA, 20 bp, human
gctgcgtgcactacatggca

SEQ ID NO: 388312 - DNA, 20 bp, human
gagttcccttgctacactta

SEQ ID NO: 388313 - DNA, 20 bp, human
gtcaggataactctcctgag

SEQ ID NO: 388314 - DNA, 20 bp, human
gctgtggtcacttattctaa

SEQ ID NO: 388315 - DNA, 20 bp, human
gtatggatgactccacagaa

SEQ ID NO: 388316 - DNA, 20 bp, human
gactcaggtggcaagtgcag

SEQ ID NO: 388317 - DNA, 20 bp, human
gcgggtaccggaagaagagg

SEQ ID NO: 388318 - DNA, 20 bp, human
gtacccgccgcccccggtct

SEQ ID NO: 388319 - DNA, 20 bp, human
ggctgcggacaggcacccgt

SEQ ID NO: 388320 - DNA, 20 bp, human
gtctgaaaatgtgactcagg

SEQ ID NO: 388321 - DNA, 20 bp, human
gtgaaccccagctctaaagg

SEQ ID NO: 388322 - DNA, 20 bp, human
gagactctcacactttccag

SEQ ID NO: 388323 - DNA, 20 bp, human
gcggcgggtaccggaagaag

SEQ ID NO: 388324 - DNA, 20 bp, human
ggcccccagctttcccttct

SEQ ID NO: 388325 - DNA, 20 bp, human
gtggatgcttcattcgcttg

SEQ ID NO: 388326 - DNA, 20 bp, human
gtgtgctcttgaagagggga

SEQ ID NO: 388327 - DNA, 20 bp, human
gacagtgtgctcttgaagag

SEQ ID NO: 388328 - DNA, 20 bp, human
ggtgcattctctagcagggt

SEQ ID NO: 388329 - DNA, 20 bp, human
gctggtcttctatttaatgg

SEQ ID NO: 388330 - DNA, 20 bp, human
gtccttctgtaaacgaagga

SEQ ID NO: 388331 - DNA, 20 bp, human
gcaaacttggtttctgttgt

SEQ ID NO: 388332 - DNA, 20 bp, human
gagtctggggagtgtgcttc

SEQ ID NO: 388333 - DNA, 20 bp, human
gagaagaccagctctcacag

SEQ ID NO: 388334 - DNA, 20 bp, human
gaggcggtgcattctctagc

SEQ ID NO: 388335 - DNA, 20 bp, human
gagcctccagtgcagggaac

SEQ ID NO: 388336 - DNA, 20 bp, human
ggcacgtgtagaggaggctt

SEQ ID NO: 388337 - DNA, 20 bp, human
gcagtacagtgcacgtgtag

SEQ ID NO: 388338 - DNA, 20 bp, human
gtggtaattagtagtgggtg

SEQ ID NO: 388339 - DNA, 20 bp, human
gatatctggagtatggtagg

SEQ ID NO: 388340 - DNA, 20 bp, human
gatacaacaaaaggaacgga

SEQ ID NO: 388341 - DNA, 20 bp, human
gaattagtagtgggtgtgga

SEQ ID NO: 388342 - DNA, 20 bp, human
gctgtactgccgtttgattt

SEQ ID NO: 388343 - DNA, 20 bp, human
gcgctcatgtacatgatatc

SEQ ID NO: 388344 - DNA, 20 bp, human
ggaggctaggatctctagtt

SEQ ID NO: 388345 - DNA, 20 bp, human
gccagatcaaatacaacaaa

SEQ ID NO: 388346 - DNA, 20 bp, human
gtgcaccagtaacaaattgt

SEQ ID NO: 388347 - DNA, 20 bp, human
gttaacgctgcaacttttgc

SEQ ID NO: 388348 - DNA, 20 bp, human
gcaactccctgttagcccag

SEQ ID NO: 388349 - DNA, 20 bp, human
gcagtcactcaaatcagaac

SEQ ID NO: 388350 - DNA, 20 bp, human
gtaacaaattgtgggtcact

SEQ ID NO: 388351 - DNA, 20 bp, human
gatttaagacaccttgggga

SEQ ID NO: 388352 - DNA, 20 bp, human
gtaggggaaatgctggccca

SEQ ID NO: 388353 - DNA, 20 bp, human
gatatgagctgctacattaa

SEQ ID NO: 388354 - DNA, 20 bp, human
gcaacttttgcaggcaggcg

SEQ ID NO: 388355 - DNA, 20 bp, human
gaagtgcagataagaacctt

SEQ ID NO: 388356 - DNA, 20 bp, human
gggcatccggtcgatgtctt

SEQ ID NO: 388357 - DNA, 20 bp, human
ggcgagaagacataagagtg

SEQ ID NO: 388358 - DNA, 20 bp, human
gtcttctcgcagaactcttt

SEQ ID NO: 388359 - DNA, 20 bp, human
gtagctacacttctggaatt

SEQ ID NO: 388360 - DNA, 20 bp, human
gaaattaaagtaggcgactc

SEQ ID NO: 388361 - DNA, 20 bp, human
gtaattccggttgatgtctt

SEQ ID NO: 388362 - DNA, 20 bp, human
gtctcaaaagagcctaattc

SEQ ID NO: 388363 - DNA, 20 bp, human
gatgacactagctacacttc

SEQ ID NO: 388364 - DNA, 20 bp, human
gtatcagactagctcaacaa

SEQ ID NO: 388365 - DNA, 20 bp, human
gtgtaggcagaaacaagccc

SEQ ID NO: 388366 - DNA, 20 bp, human
gtgaacaggaaggcgttttg

SEQ ID NO: 388367 - DNA, 20 bp, human
gaaggtgcagcttcttgaac

SEQ ID NO: 388368 - DNA, 20 bp, human
gcacaggcctcgctgaaaga

SEQ ID NO: 388369 - DNA, 20 bp, human
gaaactagctacagagaagg

SEQ ID NO: 388370 - DNA, 20 bp, human
gagcaaggactcattatctg

SEQ ID NO: 388371 - DNA, 20 bp, human
gagggcgcgtaggaaaatga

SEQ ID NO: 388372 - DNA, 20 bp, human
ggaaggtggctgatgtcaga

SEQ ID NO: 388373 - DNA, 20 bp, human
gtgtgtgccctttttccccc

SEQ ID NO: 388374 - DNA, 20 bp, human
gataggctactgctgaaaaa

SEQ ID NO: 388375 - DNA, 20 bp, human
gggacatgctgcaggttccc

SEQ ID NO: 388376 - DNA, 20 bp, human
gggacgaggggaaaggctct

SEQ ID NO: 388377 - DNA, 20 bp, human
ggtcacggggacgaggggaa

SEQ ID NO: 388378 - DNA, 20 bp, human
ggcagagtcacggggacgag

SEQ ID NO: 388379 - DNA, 20 bp, human
ggacagagaaagacgttaac

SEQ ID NO: 388380 - DNA, 20 bp, human
ggaaaattccgcagagtcac

SEQ ID NO: 388381 - DNA, 20 bp, human
ggagcttggaaggccggaaa

SEQ ID NO: 388382 - DNA, 20 bp, human
gggcacgcatagacataaat

SEQ ID NO: 388383 - DNA, 20 bp, human
ggaggggaaaggctctgggc

SEQ ID NO: 388384 - DNA, 20 bp, human
gcagagataccgggaaagag

SEQ ID NO: 388385 - DNA, 20 bp, human
gccgggaaagagcggcagag

SEQ ID NO: 388386 - DNA, 20 bp, human
ggaggcgtggtcttggactg

SEQ ID NO: 388387 - DNA, 20 bp, human
gcacgctggtgcagagggac

SEQ ID NO: 388388 - DNA, 20 bp, human
ggagcccgcaaaagcctggg

SEQ ID NO: 388389 - DNA, 20 bp, human
ggggaccgggtcaggaagcg

SEQ ID NO: 388390 - DNA, 20 bp, human
gggtgcagagggaccgggtc

SEQ ID NO: 388391 - DNA, 20 bp, human
gtcctcgggccgaacccgaa

SEQ ID NO: 388392 - DNA, 20 bp, human
gcccctccacgctggtgcag

SEQ ID NO: 388393 - DNA, 20 bp, human
ggtggtcttggactggggag

SEQ ID NO: 388394 - DNA, 20 bp, human
ggaggagcccgcaaaagcct

SEQ ID NO: 388395 - DNA, 20 bp, human
gtccaggcgcggaaagagta

SEQ ID NO: 388396 - DNA, 20 bp, human
gaagtcgctcctagagggga

SEQ ID NO: 388397 - DNA, 20 bp, human
gcgccggaagcccctgtcga

SEQ ID NO: 388398 - DNA, 20 bp, human
gagaggggaaggccgccgaa

SEQ ID NO: 388399 - DNA, 20 bp, human
ggaccgagcgaggtaaacac

SEQ ID NO: 388400 - DNA, 20 bp, human
gtccctggggccaccgtccc

SEQ ID NO: 388401 - DNA, 20 bp, human
gcggctgcctgcggttccgg

SEQ ID NO: 388402 - DNA, 20 bp, human
gaagggacgagagacaccgc

SEQ ID NO: 388403 - DNA, 20 bp, human
ggtgtctctcgtcccttcgg

SEQ ID NO: 388404 - DNA, 20 bp, human
gcagggaagtcgctcctaga

SEQ ID NO: 388405 - DNA, 20 bp, human
gccggagcgcgcggcgcgat

SEQ ID NO: 388406 - DNA, 20 bp, human
gaggtcttcaggacaatcta

SEQ ID NO: 388407 - DNA, 20 bp, human
ggggccctctgctctgccag

SEQ ID NO: 388408 - DNA, 20 bp, human
gagccagtctgggaagtgac

SEQ ID NO: 388409 - DNA, 20 bp, human
gggtaggataggaacggggt

SEQ ID NO: 388410 - DNA, 20 bp, human
gaggtggaggctgacaaata

SEQ ID NO: 388411 - DNA, 20 bp, human
ggcaacaggtaggataggaa

SEQ ID NO: 388412 - DNA, 20 bp, human
gggaaaaggcacccgagaat

SEQ ID NO: 388413 - DNA, 20 bp, human
gaatcccccaccttaggcga

SEQ ID NO: 388414 - DNA, 20 bp, human
gcactggaatcccccacctt

SEQ ID NO: 388415 - DNA, 20 bp, human
gggcacccgagaatgggctg

SEQ ID NO: 388416 - DNA, 20 bp, human
ggggtggggccgggcgagaa

SEQ ID NO: 388417 - DNA, 20 bp, human
ggggccgggctgtaggcggt

SEQ ID NO: 388418 - DNA, 20 bp, human
gcctgccgtccgcacccgtc

SEQ ID NO: 388419 - DNA, 20 bp, human
ggggctgggcgggctgccgt

SEQ ID NO: 388420 - DNA, 20 bp, human
gcaactctcccggacgggtg

SEQ ID NO: 388421 - DNA, 20 bp, human
gccgtcgggcggggctgcgc

SEQ ID NO: 388422 - DNA, 20 bp, human
ggcgcaccggggaaagttcc

SEQ ID NO: 388423 - DNA, 20 bp, human
gggcggggccgggctgtagg

SEQ ID NO: 388424 - DNA, 20 bp, human
gcgggctgtaggcggtggga

SEQ ID NO: 388425 - DNA, 20 bp, human
gcaggccaactctcccggac

SEQ ID NO: 388426 - DNA, 20 bp, human
gaggccgtgactaagacctg

SEQ ID NO: 388427 - DNA, 20 bp, human
gatcctgggaaatccctatt

SEQ ID NO: 388428 - DNA, 20 bp, human
gttcccaggatgtctcaaat

SEQ ID NO: 388429 - DNA, 20 bp, human
gaggctactgaggaaacact

SEQ ID NO: 388430 - DNA, 20 bp, human
gaacagttacctaattgctc

SEQ ID NO: 388431 - DNA, 20 bp, human
ggagaacttcctcctccagt

SEQ ID NO: 388432 - DNA, 20 bp, human
gttccaaatagggatttccc

SEQ ID NO: 388433 - DNA, 20 bp, human
gtataacagttaggctactg

SEQ ID NO: 388434 - DNA, 20 bp, human
gccagaaaatctcgccttta

SEQ ID NO: 388435 - DNA, 20 bp, human
gcaggatgtctcaaataggc

SEQ ID NO: 388436 - DNA, 20 bp, human
ggcaccccgagttccctagt

SEQ ID NO: 388437 - DNA, 20 bp, human
ggaggggccgccagtcgccc

SEQ ID NO: 388438 - DNA, 20 bp, human
gtgtcccactagggaactcg

SEQ ID NO: 388439 - DNA, 20 bp, human
gaatggggaagcgtgccctg

SEQ ID NO: 388440 - DNA, 20 bp, human
gagacagaggagtgaagtct

SEQ ID NO: 388441 - DNA, 20 bp, human
gtctcacagtcggggcgatc

SEQ ID NO: 388442 - DNA, 20 bp, human
gggacaaggtgacggtcccc

SEQ ID NO: 388443 - DNA, 20 bp, human
gaggggtccagatgtctgta

SEQ ID NO: 388444 - DNA, 20 bp, human
gcagtcggggcgatctggtc

SEQ ID NO: 388445 - DNA, 20 bp, human
gcgtgaaggaagacgagcag

SEQ ID NO: 388446 - DNA, 20 bp, human
gtgtttggggcgtgtgtctc

SEQ ID NO: 388447 - DNA, 20 bp, human
ggccctgccaggtacttcca

SEQ ID NO: 388448 - DNA, 20 bp, human
gagcaggtggtaaagatctg

SEQ ID NO: 388449 - DNA, 20 bp, human
gtccggcagcagcacaagag

SEQ ID NO: 388450 - DNA, 20 bp, human
gcccgggcaaggcgggcagt

SEQ ID NO: 388451 - DNA, 20 bp, human
gggccactctgagtcacccc

SEQ ID NO: 388452 - DNA, 20 bp, human
ggccgggagcggctgctcct

SEQ ID NO: 388453 - DNA, 20 bp, human
gactcagagtggcctgtgtt

SEQ ID NO: 388454 - DNA, 20 bp, human
gcggggagcattctggaaat

SEQ ID NO: 388455 - DNA, 20 bp, human
ggcacacccacaaccctccc

SEQ ID NO: 388456 - DNA, 20 bp, human
gaagagggcggcaggaatgg

SEQ ID NO: 388457 - DNA, 20 bp, human
gtccccacacaggtccatga

SEQ ID NO: 388458 - DNA, 20 bp, human
ggggtccaagcctcccactc

SEQ ID NO: 388459 - DNA, 20 bp, human
gtcactgccaagagggcggc

SEQ ID NO: 388460 - DNA, 20 bp, human
gaaacagcacgtatgaagca

SEQ ID NO: 388461 - DNA, 20 bp, human
gagacaggagctttgtgtat

SEQ ID NO: 388462 - DNA, 20 bp, human
gtgaatcactgccaagaggg

SEQ ID NO: 388463 - DNA, 20 bp, human
gtggacctgtgtggggacgt

SEQ ID NO: 388464 - DNA, 20 bp, human
gcacgtatgaagcagggctg

SEQ ID NO: 388465 - DNA, 20 bp, human
gtcctcccagccacccgcgc

SEQ ID NO: 388466 - DNA, 20 bp, human
gatgctaggcggggtagcag

SEQ ID NO: 388467 - DNA, 20 bp, human
gcaggggccaaagagaagga

SEQ ID NO: 388468 - DNA, 20 bp, human
gagaggcgggctttgtgacg

SEQ ID NO: 388469 - DNA, 20 bp, human
ggggctttgtcactgagagg

SEQ ID NO: 388470 - DNA, 20 bp, human
ggcggggctttgtcactgag

SEQ ID NO: 388471 - DNA, 20 bp, human
ggagaacagccaagggaacg

SEQ ID NO: 388472 - DNA, 20 bp, human
gaagagaaggagggaagtat

SEQ ID NO: 388473 - DNA, 20 bp, human
gaagccccgccccgttccct

SEQ ID NO: 388474 - DNA, 20 bp, human
gacagccaagggaacggggc

SEQ ID NO: 388475 - DNA, 20 bp, human
gttgtgacgtggtggcgggc

SEQ ID NO: 388476 - DNA, 20 bp, human
gtcgccccggtctgagactg

SEQ ID NO: 388477 - DNA, 20 bp, human
gcatgagccggttggaaccc

SEQ ID NO: 388478 - DNA, 20 bp, human
ggcagaattcgtcccaccgt

SEQ ID NO: 388479 - DNA, 20 bp, human
gggtgggacgaattctgcac

SEQ ID NO: 388480 - DNA, 20 bp, human
gcatgaggcttgcagatgag

SEQ ID NO: 388481 - DNA, 20 bp, human
gcgtcccaccgtcggcaaac

SEQ ID NO: 388482 - DNA, 20 bp, human
gccgccccagtctcagaccg

SEQ ID NO: 388483 - DNA, 20 bp, human
gcgcgcctgtttgccgacgg

SEQ ID NO: 388484 - DNA, 20 bp, human
gagcccgggaggggccgcca

SEQ ID NO: 388485 - DNA, 20 bp, human
gcgggagcgctcgggtaaaa

SEQ ID NO: 388486 - DNA, 20 bp, human
gatgagacagttctgaggga

SEQ ID NO: 388487 - DNA, 20 bp, human
gttggatgagacagttctga

SEQ ID NO: 388488 - DNA, 20 bp, human
gaaccactcccagctgcggg

SEQ ID NO: 388489 - DNA, 20 bp, human
gtgggctgggagaacgggac

SEQ ID NO: 388490 - DNA, 20 bp, human
gtaggccctggaaatccagt

SEQ ID NO: 388491 - DNA, 20 bp, human
gcagtgggaggccattgcta

SEQ ID NO: 388492 - DNA, 20 bp, human
ggggcttgagaacatccggg

SEQ ID NO: 388493 - DNA, 20 bp, human
gacagcctatgtatgaaaag

SEQ ID NO: 388494 - DNA, 20 bp, human
gccaccctgactgtcgtgga

SEQ ID NO: 388495 - DNA, 20 bp, human
ggccctggaaatccagtggg

SEQ ID NO: 388496 - DNA, 20 bp, human
gaggcggcgcgaagggtttg

SEQ ID NO: 388497 - DNA, 20 bp, human
ggtgaggcgagaggcttcgg

SEQ ID NO: 388498 - DNA, 20 bp, human
gaggcgagaggcttcggcgg

SEQ ID NO: 388499 - DNA, 20 bp, human
gtagccgaaacctgcccagc

SEQ ID NO: 388500 - DNA, 20 bp, human
gccaccgcaaagatggcggt

SEQ ID NO: 388501 - DNA, 20 bp, human
ggtgggaaatgtgaggcgag

SEQ ID NO: 388502 - DNA, 20 bp, human
gggctagcgaggcggcgcga

SEQ ID NO: 388503 - DNA, 20 bp, human
gaacctgcccagccggtgcc

SEQ ID NO: 388504 - DNA, 20 bp, human
gacgacgtcacgtgcgctcc

SEQ ID NO: 388505 - DNA, 20 bp, human
ggggcaggtttcggctagcg

SEQ ID NO: 388506 - DNA, 20 bp, human
gcacagaattccatccagaa

SEQ ID NO: 388507 - DNA, 20 bp, human
gatgaaaactattgtcctgg

SEQ ID NO: 388508 - DNA, 20 bp, human
gcccttccaacccaaccccc

SEQ ID NO: 388509 - DNA, 20 bp, human
gatgtcataccagagcctga

SEQ ID NO: 388510 - DNA, 20 bp, human
gaccaaatggaatcgaaatt

SEQ ID NO: 388511 - DNA, 20 bp, human
gaactattgtcctgggggtt

SEQ ID NO: 388512 - DNA, 20 bp, human
gtgcagggatattaaatgtc

SEQ ID NO: 388513 - DNA, 20 bp, human
gaatcatttcaatgtgttct

SEQ ID NO: 388514 - DNA, 20 bp, human
gatgtaacaaatcgcagcac

SEQ ID NO: 388515 - DNA, 20 bp, human
gtcctaatttcgattccatt

SEQ ID NO: 388516 - DNA, 20 bp, human
gtggcaggactctgaagtgg

SEQ ID NO: 388517 - DNA, 20 bp, human
gagcagagtccctgctagga

SEQ ID NO: 388518 - DNA, 20 bp, human
gggggcaggaataacagact

SEQ ID NO: 388519 - DNA, 20 bp, human
ggaagagcttctgtccctga

SEQ ID NO: 388520 - DNA, 20 bp, human
gagtgtgagacgatggatga

SEQ ID NO: 388521 - DNA, 20 bp, human
gactcacaagtgtgagacga

SEQ ID NO: 388522 - DNA, 20 bp, human
gagggtcagagtgggcttgt

SEQ ID NO: 388523 - DNA, 20 bp, human
ggatggggtgagggtcagag

SEQ ID NO: 388524 - DNA, 20 bp, human
gaggagcaaatggagactcc

SEQ ID NO: 388525 - DNA, 20 bp, human
ggttttcctcccttcctagc

SEQ ID NO: 388526 - DNA, 20 bp, human
gtgccctgggcagaggacgt

SEQ ID NO: 388527 - DNA, 20 bp, human
gctctggtcccagtgatctc

SEQ ID NO: 388528 - DNA, 20 bp, human
ggcagaggacgtggggactc

SEQ ID NO: 388529 - DNA, 20 bp, human
gcaggccagcctgagatcac

SEQ ID NO: 388530 - DNA, 20 bp, human
ggatcactgggaccagagga

SEQ ID NO: 388531 - DNA, 20 bp, human
gacaggagctacaaagtcgt

SEQ ID NO: 388532 - DNA, 20 bp, human
gggtcccagtgatctcaggc

SEQ ID NO: 388533 - DNA, 20 bp, human
gggcaacccgccaacctggt

SEQ ID NO: 388534 - DNA, 20 bp, human
gacgaacggctacaaggacc

SEQ ID NO: 388535 - DNA, 20 bp, human
gaggtgcaacacaacagctc

SEQ ID NO: 388536 - DNA, 20 bp, human
ggtgcccctacaaatcccgg

SEQ ID NO: 388537 - DNA, 20 bp, human
gcactggctccaagatggta

SEQ ID NO: 388538 - DNA, 20 bp, human
gaggtaatgggttcagactg

SEQ ID NO: 388539 - DNA, 20 bp, human
ggccttcctcacaagaatct

SEQ ID NO: 388540 - DNA, 20 bp, human
gctgccctgttccactgcct

SEQ ID NO: 388541 - DNA, 20 bp, human
gcctgcccaatcagatcctg

SEQ ID NO: 388542 - DNA, 20 bp, human
gtagcccccgggatttgtag

SEQ ID NO: 388543 - DNA, 20 bp, human
gaatgggttcagactgtggg

SEQ ID NO: 388544 - DNA, 20 bp, human
ggacgtcctagattcttgtg

SEQ ID NO: 388545 - DNA, 20 bp, human
gctcggtcggggggactcca

SEQ ID NO: 388546 - DNA, 20 bp, human
gcacacaacaggcacatagg

SEQ ID NO: 388547 - DNA, 20 bp, human
gtgaaaccagcacccacctg

SEQ ID NO: 388548 - DNA, 20 bp, human
gggaaagccatgtgaatttg

SEQ ID NO: 388549 - DNA, 20 bp, human
ggtgctgcaatgcacacaac

SEQ ID NO: 388550 - DNA, 20 bp, human
gatgcacacaacaggcacat

SEQ ID NO: 388551 - DNA, 20 bp, human
ggccacagtgaaggcccaga

SEQ ID NO: 388552 - DNA, 20 bp, human
gaggcaaattctgtgcacat

SEQ ID NO: 388553 - DNA, 20 bp, human
gagtctccccaggtgggtgc

SEQ ID NO: 388554 - DNA, 20 bp, human
gccatgtgaatttgtggctc

SEQ ID NO: 388555 - DNA, 20 bp, human
gctgggggaagaggaccatt

SEQ ID NO: 388556 - DNA, 20 bp, human
gtcctggctgcgaggaggaa

SEQ ID NO: 388557 - DNA, 20 bp, human
gcggtggcgtgggtctgtgg

SEQ ID NO: 388558 - DNA, 20 bp, human
ggaccctcagatttctagtt

SEQ ID NO: 388559 - DNA, 20 bp, human
gagggtggggccatcgagtg

SEQ ID NO: 388560 - DNA, 20 bp, human
gagccaaactagaaatctga

SEQ ID NO: 388561 - DNA, 20 bp, human
gaagggaatggagcagaggg

SEQ ID NO: 388562 - DNA, 20 bp, human
gacaggacttgctgctctcc

SEQ ID NO: 388563 - DNA, 20 bp, human
gcaaacagatacggtggcgt

SEQ ID NO: 388564 - DNA, 20 bp, human
gaagggagcagatggggttc

SEQ ID NO: 388565 - DNA, 20 bp, human
gtggggccatcgagtgagga

SEQ ID NO: 388566 - DNA, 20 bp, human
ggtcctcctcagaccaatgg

SEQ ID NO: 388567 - DNA, 20 bp, human
gcagtccaagaagtcttggt

SEQ ID NO: 388568 - DNA, 20 bp, human
gggctgggctactctattta

SEQ ID NO: 388569 - DNA, 20 bp, human
gtggctctccacgcccccat

SEQ ID NO: 388570 - DNA, 20 bp, human
gaccccccaccaagacttct

SEQ ID NO: 388571 - DNA, 20 bp, human
gcgcccagtccaagaagtct

SEQ ID NO: 388572 - DNA, 20 bp, human
gccaggccaggcggccggac

SEQ ID NO: 388573 - DNA, 20 bp, human
gacagctcgggtcagctgag

SEQ ID NO: 388574 - DNA, 20 bp, human
gggtataaatggcctccccc

SEQ ID NO: 388575 - DNA, 20 bp, human
gagtgggaaacccattgcag

SEQ ID NO: 388576 - DNA, 20 bp, human
gcccctgccccagaaggctt

SEQ ID NO: 388577 - DNA, 20 bp, human
gagggccaggccatcttctc

SEQ ID NO: 388578 - DNA, 20 bp, human
gggctgccccaagccttctg

SEQ ID NO: 388579 - DNA, 20 bp, human
gggagaggagggccagttgg

SEQ ID NO: 388580 - DNA, 20 bp, human
gtcaaaacatgacgaggagg

SEQ ID NO: 388581 - DNA, 20 bp, human
gcaggtcggccggtgaggtg

SEQ ID NO: 388582 - DNA, 20 bp, human
gtcagcagcgtcttggtggg

SEQ ID NO: 388583 - DNA, 20 bp, human
gtggctgtggcctggtcaca

SEQ ID NO: 388584 - DNA, 20 bp, human
gggggtcggagtgtgtgatg

SEQ ID NO: 388585 - DNA, 20 bp, human
gcaagacgctgctgaaagag

SEQ ID NO: 388586 - DNA, 20 bp, human
gaggaggggtctaggactcc

SEQ ID NO: 388587 - DNA, 20 bp, human
gtctaggactccaggatcag

SEQ ID NO: 388588 - DNA, 20 bp, human
gaacgggggcgcgtgagggg

SEQ ID NO: 388589 - DNA, 20 bp, human
gcccactatgccagataacg

SEQ ID NO: 388590 - DNA, 20 bp, human
gacctccgggcacaggaatc

SEQ ID NO: 388591 - DNA, 20 bp, human
gaccagccacctccgggcac

SEQ ID NO: 388592 - DNA, 20 bp, human
gggcctggactccttgtgtg

SEQ ID NO: 388593 - DNA, 20 bp, human
gatctggcatagtgggcagg

SEQ ID NO: 388594 - DNA, 20 bp, human
gtccggattcctgtgcccgg

SEQ ID NO: 388595 - DNA, 20 bp, human
ggataacgggggcgcgtgag

SEQ ID NO: 388596 - DNA, 20 bp, human
gggtccatgaaagtatgtat

SEQ ID NO: 388597 - DNA, 20 bp, human
gttcgagggtgaaatcataa

SEQ ID NO: 388598 - DNA, 20 bp, human
gtgtatgggtagataattga

SEQ ID NO: 388599 - DNA, 20 bp, human
gctacccatacatactttca

SEQ ID NO: 388600 - DNA, 20 bp, human
gaaatcgtgtgtgctttcga

SEQ ID NO: 388601 - DNA, 20 bp, human
gaataagcccaactgccaaa

SEQ ID NO: 388602 - DNA, 20 bp, human
gaatggcagttggtaaagag

SEQ ID NO: 388603 - DNA, 20 bp, human
gttctcctaagccaaaataa

SEQ ID NO: 388604 - DNA, 20 bp, human
gtatcaaagtatttttcaac

SEQ ID NO: 388605 - DNA, 20 bp, human
ggaaaaatactttgatagtc

SEQ ID NO: 388606 - DNA, 20 bp, human
ggctcctgggccatgcagat

SEQ ID NO: 388607 - DNA, 20 bp, human
gtggcggcagacaaaggggt

SEQ ID NO: 388608 - DNA, 20 bp, human
gcatggggacgtcaaagcac

SEQ ID NO: 388609 - DNA, 20 bp, human
gaggctcgggcccgccccga

SEQ ID NO: 388610 - DNA, 20 bp, human
ggaggtagttggagcaccac

SEQ ID NO: 388611 - DNA, 20 bp, human
gaaagcacagggagctataa

SEQ ID NO: 388612 - DNA, 20 bp, human
ggcacagggagctataaggg

SEQ ID NO: 388613 - DNA, 20 bp, human
ggagctataagggaggtagt

SEQ ID NO: 388614 - DNA, 20 bp, human
gcagagtccagaagcctccg

SEQ ID NO: 388615 - DNA, 20 bp, human
gcatgccaaccccatctgca

SEQ ID NO: 388616 - DNA, 20 bp, human
ggctccctgcggacgggtgt

SEQ ID NO: 388617 - DNA, 20 bp, human
gggaggggagagttagacct

SEQ ID NO: 388618 - DNA, 20 bp, human
gagtgagtgctgcactggga

SEQ ID NO: 388619 - DNA, 20 bp, human
gagaagaggcccagtggggt

SEQ ID NO: 388620 - DNA, 20 bp, human
ggaggagtgagtgctgcact

SEQ ID NO: 388621 - DNA, 20 bp, human
gggcgtgtccccatcccata

SEQ ID NO: 388622 - DNA, 20 bp, human
ggggccggccctatgggatg

SEQ ID NO: 388623 - DNA, 20 bp, human
gaccttccggctgctccctg

SEQ ID NO: 388624 - DNA, 20 bp, human
gagggggcgacctagactcc

SEQ ID NO: 388625 - DNA, 20 bp, human
gtcccctcccaagagctcct

SEQ ID NO: 388626 - DNA, 20 bp, human
ggtgccagggacaaggctac

SEQ ID NO: 388627 - DNA, 20 bp, human
gagggaggaatgtgcgacag

SEQ ID NO: 388628 - DNA, 20 bp, human
gaggaccacatgggcttata

SEQ ID NO: 388629 - DNA, 20 bp, human
ggttcctgtagccttgtccc

SEQ ID NO: 388630 - DNA, 20 bp, human
ggtgcgacaggggacgggtg

SEQ ID NO: 388631 - DNA, 20 bp, human
gacaggggacgggtggggca

SEQ ID NO: 388632 - DNA, 20 bp, human
gggaatgtgcgacaggggac

SEQ ID NO: 388633 - DNA, 20 bp, human
gggtgagccagccctgcgga

SEQ ID NO: 388634 - DNA, 20 bp, human
ggagccagccctgcggaggg

SEQ ID NO: 388635 - DNA, 20 bp, human
gcatgggcttatatggcgtg

SEQ ID NO: 388636 - DNA, 20 bp, human
gaggacgtgcttggagaagg

SEQ ID NO: 388637 - DNA, 20 bp, human
gcagcgggtacattctggat

SEQ ID NO: 388638 - DNA, 20 bp, human
gcaggccccttaccaagtat

SEQ ID NO: 388639 - DNA, 20 bp, human
gaggatgcagaggacgtgct

SEQ ID NO: 388640 - DNA, 20 bp, human
gtgtgtgcggagtcttgctg

SEQ ID NO: 388641 - DNA, 20 bp, human
gcagaggacgtgcttggaga

SEQ ID NO: 388642 - DNA, 20 bp, human
gcccttaccaagtataggaa

SEQ ID NO: 388643 - DNA, 20 bp, human
gcacccagtcactggccaat

SEQ ID NO: 388644 - DNA, 20 bp, human
gaggtcctccctccgcctcc

SEQ ID NO: 388645 - DNA, 20 bp, human
gaggcctcggagacccccca

SEQ ID NO: 388646 - DNA, 20 bp, human
ggtcggctgccacaagatgg

SEQ ID NO: 388647 - DNA, 20 bp, human
ggtgcccagcccgacgctgg

SEQ ID NO: 388648 - DNA, 20 bp, human
gccacgctgcccccatcttg

SEQ ID NO: 388649 - DNA, 20 bp, human
gaataacccaccccaggcga

SEQ ID NO: 388650 - DNA, 20 bp, human
ggaggaggagggtcagtgaa

SEQ ID NO: 388651 - DNA, 20 bp, human
gcccgcctcacccacgtctt

SEQ ID NO: 388652 - DNA, 20 bp, human
gtgtctgccccgccagcgtc

SEQ ID NO: 388653 - DNA, 20 bp, human
gggagggcctgggtgcccga

SEQ ID NO: 388654 - DNA, 20 bp, human
ggggacaggagggaaatatg

SEQ ID NO: 388655 - DNA, 20 bp, human
gagggccatcctctgtaagg

SEQ ID NO: 388656 - DNA, 20 bp, human
gaaaaggacctcaaaactga

SEQ ID NO: 388657 - DNA, 20 bp, human
gaggccttggccattgtgac

SEQ ID NO: 388658 - DNA, 20 bp, human
ggcccttgagctgcacgaaa

SEQ ID NO: 388659 - DNA, 20 bp, human
gtgtgaccaaagtgcagcaa

SEQ ID NO: 388660 - DNA, 20 bp, human
gaggggctttgcaaggcccg

SEQ ID NO: 388661 - DNA, 20 bp, human
ggggcagggtaactttcagt

SEQ ID NO: 388662 - DNA, 20 bp, human
gttccctgtcacaatggcca

SEQ ID NO: 388663 - DNA, 20 bp, human
gagggctgccctcagttttg

SEQ ID NO: 388664 - DNA, 20 bp, human
ggtccttttcgtgcagctca

SEQ ID NO: 388665 - DNA, 20 bp, human
gtttctcaataacacctctc

SEQ ID NO: 388666 - DNA, 20 bp, human
gagctctcaggggtaccctg

SEQ ID NO: 388667 - DNA, 20 bp, human
gctaccctgaaccagtagct

SEQ ID NO: 388668 - DNA, 20 bp, human
gagtcccagctactggttca

SEQ ID NO: 388669 - DNA, 20 bp, human
gcaggctggggcagctctca

SEQ ID NO: 388670 - DNA, 20 bp, human
ggtagctgggactatcccca

SEQ ID NO: 388671 - DNA, 20 bp, human
ggggaaactgggacttgttc

SEQ ID NO: 388672 - DNA, 20 bp, human
ggttcagggtaggagccctt

SEQ ID NO: 388673 - DNA, 20 bp, human
gttgttcaggcgaattccca

SEQ ID NO: 388674 - DNA, 20 bp, human
ggattagtgcccagatgatg

SEQ ID NO: 388675 - DNA, 20 bp, human
gtagtgcccagatgatgggg

SEQ ID NO: 388676 - DNA, 20 bp, human
ggacggaattagagatgggt

SEQ ID NO: 388677 - DNA, 20 bp, human
ggctcccgtgagcggatctt

SEQ ID NO: 388678 - DNA, 20 bp, human
gtggccccaagatccgctca

SEQ ID NO: 388679 - DNA, 20 bp, human
gctcttcaggtgtttcgcag

SEQ ID NO: 388680 - DNA, 20 bp, human
gtctggacggaattagagat

SEQ ID NO: 388681 - DNA, 20 bp, human
ggggccagattgcaaattcg

SEQ ID NO: 388682 - DNA, 20 bp, human
gtgcgtggcactaggaccca

SEQ ID NO: 388683 - DNA, 20 bp, human
gtgggttggagaaaactgcg

SEQ ID NO: 388684 - DNA, 20 bp, human
gaagtcagtagtaatctgga

SEQ ID NO: 388685 - DNA, 20 bp, human
gtttcgcaggggttttgata

SEQ ID NO: 388686 - DNA, 20 bp, human
gtcgccgcgctttggggttt

SEQ ID NO: 388687 - DNA, 20 bp, human
gagggtctctagaccaaccg

SEQ ID NO: 388688 - DNA, 20 bp, human
ggctccccatgcacctcggt

SEQ ID NO: 388689 - DNA, 20 bp, human
gtagaccaaccgaggtgcat

SEQ ID NO: 388690 - DNA, 20 bp, human
gcccgtcctgccatgcgcca

SEQ ID NO: 388691 - DNA, 20 bp, human
ggacgggatttgtagttcca

SEQ ID NO: 388692 - DNA, 20 bp, human
gcgccagggtcgccgcgctt

SEQ ID NO: 388693 - DNA, 20 bp, human
gccccaaagcgcggcgaccc

SEQ ID NO: 388694 - DNA, 20 bp, human
gagttccagggcttatcgga

SEQ ID NO: 388695 - DNA, 20 bp, human
ggccaccaaggcatgcgtaa

SEQ ID NO: 388696 - DNA, 20 bp, human
gggaaacccgggctgagaca

SEQ ID NO: 388697 - DNA, 20 bp, human
gagccgcggcggctcaccta

SEQ ID NO: 388698 - DNA, 20 bp, human
ggggaaaacgagacactggg

SEQ ID NO: 388699 - DNA, 20 bp, human
gagtgccagggcacgtgtga

SEQ ID NO: 388700 - DNA, 20 bp, human
gtcaaccttcacacgtgccc

SEQ ID NO: 388701 - DNA, 20 bp, human
gcaaagagttgccgtttctt

SEQ ID NO: 388702 - DNA, 20 bp, human
gtcccgccgagccaatcgga

SEQ ID NO: 388703 - DNA, 20 bp, human
gaactctttggtcacgtgac

SEQ ID NO: 388704 - DNA, 20 bp, human
gccgggtttcccaagtgcca

SEQ ID NO: 388705 - DNA, 20 bp, human
gtactcctcccaagtacctc

SEQ ID NO: 388706 - DNA, 20 bp, human
ggtgtgtggcctcccaagat

SEQ ID NO: 388707 - DNA, 20 bp, human
ggccctcagaagcctatctt

SEQ ID NO: 388708 - DNA, 20 bp, human
gggaagtgtgccaaaggtat

SEQ ID NO: 388709 - DNA, 20 bp, human
ggagacaagaggaggcgtgc

SEQ ID NO: 388710 - DNA, 20 bp, human
gccgcctggtacactacaaa

SEQ ID NO: 388711 - DNA, 20 bp, human
gctcccaagataggcttctg

SEQ ID NO: 388712 - DNA, 20 bp, human
gccacacaccagtgtaccta

SEQ ID NO: 388713 - DNA, 20 bp, human
gagggatggggcagtcggaa

SEQ ID NO: 388714 - DNA, 20 bp, human
gaagaggaggcgtgccggga

SEQ ID NO: 388715 - DNA, 20 bp, human
gggtgctgtcgcttccggtc

SEQ ID NO: 388716 - DNA, 20 bp, human
gcagctccaagagttgggtg

SEQ ID NO: 388717 - DNA, 20 bp, human
gcctacaagcagccccctag

SEQ ID NO: 388718 - DNA, 20 bp, human
gggactgttcaagaggattt

SEQ ID NO: 388719 - DNA, 20 bp, human
gggaatgcctaaagaggcag

SEQ ID NO: 388720 - DNA, 20 bp, human
ggctgaaatttcagcaagag

SEQ ID NO: 388721 - DNA, 20 bp, human
ggcaggaaccgactgtgcta

SEQ ID NO: 388722 - DNA, 20 bp, human
gtgaatctggactgttcaag

SEQ ID NO: 388723 - DNA, 20 bp, human
gcaggaccctgcctatgcag

SEQ ID NO: 388724 - DNA, 20 bp, human
gctctgacgtgaaagagagg

SEQ ID NO: 388725 - DNA, 20 bp, human
gcagttgtggggttctcaag

SEQ ID NO: 388726 - DNA, 20 bp, human
gacaatgcgtgtttctttgc

SEQ ID NO: 388727 - DNA, 20 bp, human
gggcgcgcgcggccaatgcg

SEQ ID NO: 388728 - DNA, 20 bp, human
gcacgcgcatgtaaacacct

SEQ ID NO: 388729 - DNA, 20 bp, human
gggtccgtaattggttttat

SEQ ID NO: 388730 - DNA, 20 bp, human
gaaaccaattacggacctag

SEQ ID NO: 388731 - DNA, 20 bp, human
ggagcccctaggtccgtaat

SEQ ID NO: 388732 - DNA, 20 bp, human
gggggctgaatgatcaaaac

SEQ ID NO: 388733 - DNA, 20 bp, human
gaagaaacacgcattgttcc

SEQ ID NO: 388734 - DNA, 20 bp, human
ggatcattcagccccgccga

SEQ ID NO: 388735 - DNA, 20 bp, human
gtttacatgcgcgtgattgg

SEQ ID NO: 388736 - DNA, 20 bp, human
gactccgcggggcgcctcgg

SEQ ID NO: 388737 - DNA, 20 bp, human
gtgggtgcagcgtgacacgc

SEQ ID NO: 388738 - DNA, 20 bp, human
gtctgcgggtccagttgcta

SEQ ID NO: 388739 - DNA, 20 bp, human
ggcagcgtgacacgccgggg

SEQ ID NO: 388740 - DNA, 20 bp, human
ggcaactggacccgcagatt

SEQ ID NO: 388741 - DNA, 20 bp, human
gggcccccccagccactccg

SEQ ID NO: 388742 - DNA, 20 bp, human
gggccgtggcgcccccggaa

SEQ ID NO: 388743 - DNA, 20 bp, human
gtgctagggcctccatcttg

SEQ ID NO: 388744 - DNA, 20 bp, human
gaggtccttggcaaccgccc

SEQ ID NO: 388745 - DNA, 20 bp, human
gtgtgacctccagggaggtc

SEQ ID NO: 388746 - DNA, 20 bp, human
gaggggcgaaggcagcaacg

SEQ ID NO: 388747 - DNA, 20 bp, human
gcagcaacgaggaattggag

SEQ ID NO: 388748 - DNA, 20 bp, human
gctgcctgagccaatcatgt

SEQ ID NO: 388749 - DNA, 20 bp, human
ggaaggcagcaacgaggaat

SEQ ID NO: 388750 - DNA, 20 bp, human
ggggaagcacttaaccaatg

SEQ ID NO: 388751 - DNA, 20 bp, human
gtgctgccttcgcccctcat

SEQ ID NO: 388752 - DNA, 20 bp, human
gtccctgcggccaatggagt

SEQ ID NO: 388753 - DNA, 20 bp, human
ggggtgtgtccccacatgat

SEQ ID NO: 388754 - DNA, 20 bp, human
ggggcggaacgacagcttga

SEQ ID NO: 388755 - DNA, 20 bp, human
ggggtcctcgaccgaggaag

SEQ ID NO: 388756 - DNA, 20 bp, human
gcctccgcccctagttgaag

SEQ ID NO: 388757 - DNA, 20 bp, human
ggactcatccccttcaacta

SEQ ID NO: 388758 - DNA, 20 bp, human
gggcggaggcatggacggat

SEQ ID NO: 388759 - DNA, 20 bp, human
gctaggggcggaggcatgga

SEQ ID NO: 388760 - DNA, 20 bp, human
gtcaactaggggcggaggca

SEQ ID NO: 388761 - DNA, 20 bp, human
ggggtggcccggacgcagac

SEQ ID NO: 388762 - DNA, 20 bp, human
gcatccccttcaactagggg

SEQ ID NO: 388763 - DNA, 20 bp, human
gccggggccagtctgcgtcc

SEQ ID NO: 388764 - DNA, 20 bp, human
ggcctcctgtagagctgcca

SEQ ID NO: 388765 - DNA, 20 bp, human
gcctgcccggcttgcggccg

SEQ ID NO: 388766 - DNA, 20 bp, human
gagccagcagagcactgcag

SEQ ID NO: 388767 - DNA, 20 bp, human
ggaaggaggcggtgcactgt

SEQ ID NO: 388768 - DNA, 20 bp, human
gcccggagccagccagcagt

SEQ ID NO: 388769 - DNA, 20 bp, human
gcctggggacaggacgggaa

SEQ ID NO: 388770 - DNA, 20 bp, human
gctgcactctagctggctct

SEQ ID NO: 388771 - DNA, 20 bp, human
gctggctggctccgggaagg

SEQ ID NO: 388772 - DNA, 20 bp, human
ggctagtcgggttccctccc

SEQ ID NO: 388773 - DNA, 20 bp, human
gaaatggccaaagggcttct

SEQ ID NO: 388774 - DNA, 20 bp, human
ggcactgttggcccgccccc

SEQ ID NO: 388775 - DNA, 20 bp, human
ggactctatagaaaagacgc

SEQ ID NO: 388776 - DNA, 20 bp, human
ggaggcgcgctgcattgtta

SEQ ID NO: 388777 - DNA, 20 bp, human
ggccagcgaagggaggtccc

SEQ ID NO: 388778 - DNA, 20 bp, human
gtactctaacaccggcccgg

SEQ ID NO: 388779 - DNA, 20 bp, human
gggagcctgggctgctcaat

SEQ ID NO: 388780 - DNA, 20 bp, human
gtaggctatgagctacagga

SEQ ID NO: 388781 - DNA, 20 bp, human
gcaggctccaagtggtctgg

SEQ ID NO: 388782 - DNA, 20 bp, human
ggggcgggggaccccggtga

SEQ ID NO: 388783 - DNA, 20 bp, human
gcggcagggccccctcgagg

SEQ ID NO: 388784 - DNA, 20 bp, human
ggccctgccgaggtgcgccc

SEQ ID NO: 388785 - DNA, 20 bp, human
ggcggcgcgggcaatcgcca

SEQ ID NO: 388786 - DNA, 20 bp, human
ggatccagtgagctcaggtg

SEQ ID NO: 388787 - DNA, 20 bp, human
ggaagcccaagcaggaactt

SEQ ID NO: 388788 - DNA, 20 bp, human
gaagggaagcactgggtggt

SEQ ID NO: 388789 - DNA, 20 bp, human
ggtggggcctactgctgtca

SEQ ID NO: 388790 - DNA, 20 bp, human
gcactggatccagcaggggt

SEQ ID NO: 388791 - DNA, 20 bp, human
ggcactgggtggtgggtttt

SEQ ID NO: 388792 - DNA, 20 bp, human
gtgagctcactggatccagc

SEQ ID NO: 388793 - DNA, 20 bp, human
gtggggcagaggccatgggt

SEQ ID NO: 388794 - DNA, 20 bp, human
gtgtgcagtgggcactcctc

SEQ ID NO: 388795 - DNA, 20 bp, human
gactcctcaggtgctggctg

SEQ ID NO: 388796 - DNA, 20 bp, human
ggggctgggggttgagatga

SEQ ID NO: 388797 - DNA, 20 bp, human
ggacgtgggaggtaagaccg

SEQ ID NO: 388798 - DNA, 20 bp, human
gggaggtaagaccggggctg

SEQ ID NO: 388799 - DNA, 20 bp, human
gaagaggaggggtggcatgt

SEQ ID NO: 388800 - DNA, 20 bp, human
gtggccatgaggaaggatat

SEQ ID NO: 388801 - DNA, 20 bp, human
gaggggagcggagatagggc

SEQ ID NO: 388802 - DNA, 20 bp, human
gagggaggggagcggagata

SEQ ID NO: 388803 - DNA, 20 bp, human
gtgatgctagacagggagtg

SEQ ID NO: 388804 - DNA, 20 bp, human
gctaaaaatggcatagggaa

SEQ ID NO: 388805 - DNA, 20 bp, human
gaggaggggtggcatgtggg

SEQ ID NO: 388806 - DNA, 20 bp, human
gagccggccggcgggggacc

SEQ ID NO: 388807 - DNA, 20 bp, human
gccgccggagctgtgtgacg

SEQ ID NO: 388808 - DNA, 20 bp, human
gccgccgcgcgtccggacag

SEQ ID NO: 388809 - DNA, 20 bp, human
ggggccaatgaaccgacgat

SEQ ID NO: 388810 - DNA, 20 bp, human
ggggacttggccaatggcgt

SEQ ID NO: 388811 - DNA, 20 bp, human
gacttggccaatggcgtcgg

SEQ ID NO: 388812 - DNA, 20 bp, human
gcaccccgacggaggggatg

SEQ ID NO: 388813 - DNA, 20 bp, human
gacgatcggagcactgggga

SEQ ID NO: 388814 - DNA, 20 bp, human
ggcaggcgggacttggccaa

SEQ ID NO: 388815 - DNA, 20 bp, human
gcgcggcggacgcaggggtg

SEQ ID NO: 388816 - DNA, 20 bp, human
gtcagctcgctggtatctcg

SEQ ID NO: 388817 - DNA, 20 bp, human
ggcgcggcgctgtgacaggg

SEQ ID NO: 388818 - DNA, 20 bp, human
gcggagggacgcatcacgca

SEQ ID NO: 388819 - DNA, 20 bp, human
gctgaggcgcggggctggct

SEQ ID NO: 388820 - DNA, 20 bp, human
gtaccagcgagctgaggcgc

SEQ ID NO: 388821 - DNA, 20 bp, human
ggccccgcgcctcagctcgc

SEQ ID NO: 388822 - DNA, 20 bp, human
gtcccaggggcgctccgtga

SEQ ID NO: 388823 - DNA, 20 bp, human
ggacgcatcacgcaggggtg

SEQ ID NO: 388824 - DNA, 20 bp, human
ggctggctgggaagtagtcc

SEQ ID NO: 388825 - DNA, 20 bp, human
ggacgcgcacaagttcagag

SEQ ID NO: 388826 - DNA, 20 bp, human
ggcgtggctcgggtccaccc

SEQ ID NO: 388827 - DNA, 20 bp, human
gcacgccccctggagtgcgc

SEQ ID NO: 388828 - DNA, 20 bp, human
gctttccggcgcactccagg

SEQ ID NO: 388829 - DNA, 20 bp, human
gtgccggctcgcagcccggg

SEQ ID NO: 388830 - DNA, 20 bp, human
gcggacccgggacgtctgaa

SEQ ID NO: 388831 - DNA, 20 bp, human
gcgggcgcgctagagctcgc

SEQ ID NO: 388832 - DNA, 20 bp, human
gactccagggggcgtggctc

SEQ ID NO: 388833 - DNA, 20 bp, human
gactaggagagggtcgtgtg

SEQ ID NO: 388834 - DNA, 20 bp, human
ggcgcgctagagctcgcggg

SEQ ID NO: 388835 - DNA, 20 bp, human
ggcgcgcgctaattgcctat

SEQ ID NO: 388836 - DNA, 20 bp, human
gccgccgggagccatttcgc

SEQ ID NO: 388837 - DNA, 20 bp, human
gtgcgcatgcccagtcatga

SEQ ID NO: 388838 - DNA, 20 bp, human
gcatgcgcaaacggccccgc

SEQ ID NO: 388839 - DNA, 20 bp, human
gcgcacgcgcgctccagggt

SEQ ID NO: 388840 - DNA, 20 bp, human
ggccgacaaccgtcatgact

SEQ ID NO: 388841 - DNA, 20 bp, human
gcagggctcgaggagagagc

SEQ ID NO: 388842 - DNA, 20 bp, human
gctgcagcgccgccacgcta

SEQ ID NO: 388843 - DNA, 20 bp, human
ggccctgcagcccggcgaaa

SEQ ID NO: 388844 - DNA, 20 bp, human
gcgtggcggcgctgcagtct

SEQ ID NO: 388845 - DNA, 20 bp, human
gatgactgggcatgcgcaaa

SEQ ID NO: 388846 - DNA, 20 bp, human
ggagggcgatgacctcactg

SEQ ID NO: 388847 - DNA, 20 bp, human
ggggcgtcacacacgatgta

SEQ ID NO: 388848 - DNA, 20 bp, human
ggtcccgcccccgaggcgga

SEQ ID NO: 388849 - DNA, 20 bp, human
ggccccgccctgagacgcca

SEQ ID NO: 388850 - DNA, 20 bp, human
gaggtcatcgccctccgcct

SEQ ID NO: 388851 - DNA, 20 bp, human
gaccctggcgtctcagggcg

SEQ ID NO: 388852 - DNA, 20 bp, human
gctcactgcggcttgctcgg

SEQ ID NO: 388853 - DNA, 20 bp, human
ggcgggaccctggcgtctca

SEQ ID NO: 388854 - DNA, 20 bp, human
ggaggccggcgaggaggcgt

SEQ ID NO: 388855 - DNA, 20 bp, human
gacgatgtagggtctggggt

SEQ ID NO: 388856 - DNA, 20 bp, human
gcctcctcgcgggtcccgca

SEQ ID NO: 388857 - DNA, 20 bp, human
ggcaccgagcgtgaggagct

SEQ ID NO: 388858 - DNA, 20 bp, human
ggcgccctgcgggacccgcg

SEQ ID NO: 388859 - DNA, 20 bp, human
gaagcgctcgggcgaagagg

SEQ ID NO: 388860 - DNA, 20 bp, human
ggtaccgagcgggtggagtc

SEQ ID NO: 388861 - DNA, 20 bp, human
gggtacaggcgggtagtggc

SEQ ID NO: 388862 - DNA, 20 bp, human
ggcacctgcagcgcgccctg

SEQ ID NO: 388863 - DNA, 20 bp, human
gggagccaagggtaccgagc

SEQ ID NO: 388864 - DNA, 20 bp, human
gcggctgcaggtggtacagg

SEQ ID NO: 388865 - DNA, 20 bp, human
gtgtatggagcctgcgagag

SEQ ID NO: 388866 - DNA, 20 bp, human
gcaccccgcagcgtccgatt

SEQ ID NO: 388867 - DNA, 20 bp, human
ggaggagcgagctaggtcac

SEQ ID NO: 388868 - DNA, 20 bp, human
gcccgcagcgtccgattggg

SEQ ID NO: 388869 - DNA, 20 bp, human
gaataggaggcgggcttcgt

SEQ ID NO: 388870 - DNA, 20 bp, human
gggtgccgccacggctgaca

SEQ ID NO: 388871 - DNA, 20 bp, human
gcccttgccgcgtctctatt

SEQ ID NO: 388872 - DNA, 20 bp, human
gacgcaaatggacggaacag

SEQ ID NO: 388873 - DNA, 20 bp, human
gtccgcccaatcggacgctg

SEQ ID NO: 388874 - DNA, 20 bp, human
gaggtgtaacgaccaatagg

SEQ ID NO: 388875 - DNA, 20 bp, human
gacggaacagaggtgaatct

SEQ ID NO: 388876 - DNA, 20 bp, human
gtgggtgtacgcactggagt

SEQ ID NO: 388877 - DNA, 20 bp, human
gcgccgctgggtgtacgcac

SEQ ID NO: 388878 - DNA, 20 bp, human
gcctgcgcagtgggcgaagc

SEQ ID NO: 388879 - DNA, 20 bp, human
gctcgttacagcatggtcgg

SEQ ID NO: 388880 - DNA, 20 bp, human
gagggcctcgaggtcgtccg

SEQ ID NO: 388881 - DNA, 20 bp, human
gcgtacgcctcgttacagca

SEQ ID NO: 388882 - DNA, 20 bp, human
gagcggcgcaggggaaacgc

SEQ ID NO: 388883 - DNA, 20 bp, human
gtccggtcccagtcaactaa

SEQ ID NO: 388884 - DNA, 20 bp, human
gtagctgacagccttgtttg

SEQ ID NO: 388885 - DNA, 20 bp, human
ggccgagcacacgccacttc

SEQ ID NO: 388886 - DNA, 20 bp, human
gaggaagccgagcgttcgag

SEQ ID NO: 388887 - DNA, 20 bp, human
ggaacgctcggcttcctcat

SEQ ID NO: 388888 - DNA, 20 bp, human
gccggcccgcgcccaacgct

SEQ ID NO: 388889 - DNA, 20 bp, human
gccaggcttgcggaccgatg

SEQ ID NO: 388890 - DNA, 20 bp, human
gcggcggcccatccggcctc

SEQ ID NO: 388891 - DNA, 20 bp, human
gcgtcccacaagccgagcgt

SEQ ID NO: 388892 - DNA, 20 bp, human
gcagaggcgtgtttggagaa

SEQ ID NO: 388893 - DNA, 20 bp, human
gggaggccccgaggccggat

SEQ ID NO: 388894 - DNA, 20 bp, human
gggagaaagggttcagaatt

SEQ ID NO: 388895 - DNA, 20 bp, human
ggcgttgacgcctcgcaccc

SEQ ID NO: 388896 - DNA, 20 bp, human
gccagtgcccgcagcgggtc

SEQ ID NO: 388897 - DNA, 20 bp, human
ggcaggggaaccccagtccc

SEQ ID NO: 388898 - DNA, 20 bp, human
gaagccccgacgcccggata

SEQ ID NO: 388899 - DNA, 20 bp, human
gcgacgcccggataaggcca

SEQ ID NO: 388900 - DNA, 20 bp, human
gagggctgccggacccgctg

SEQ ID NO: 388901 - DNA, 20 bp, human
ggcgccccagaacctctcac

SEQ ID NO: 388902 - DNA, 20 bp, human
ggcggcagccatgactgtag

SEQ ID NO: 388903 - DNA, 20 bp, human
ggacaccggaagcggaaagg

SEQ ID NO: 388904 - DNA, 20 bp, human
ggagcggcgccctctagccc

SEQ ID NO: 388905 - DNA, 20 bp, human
ggcgggcactggaggacccg

SEQ ID NO: 388906 - DNA, 20 bp, human
gcggggcggcagcatgctct

SEQ ID NO: 388907 - DNA, 20 bp, human
gcctctgcgcgtgctcggtt

SEQ ID NO: 388908 - DNA, 20 bp, human
gcgtgctcggtttggaactt

SEQ ID NO: 388909 - DNA, 20 bp, human
gagaacgccgtggatgacgc

SEQ ID NO: 388910 - DNA, 20 bp, human
gcggggcctgcgagacctgg

SEQ ID NO: 388911 - DNA, 20 bp, human
gtccttccctgcgtcatcca

SEQ ID NO: 388912 - DNA, 20 bp, human
gcccgccctctgcgcgtgct

SEQ ID NO: 388913 - DNA, 20 bp, human
gacggcgttctagcaactca

SEQ ID NO: 388914 - DNA, 20 bp, human
ggcagagggcgggacgctcc

SEQ ID NO: 388915 - DNA, 20 bp, human
ggccgtggatgacgcaggga

SEQ ID NO: 388916 - DNA, 20 bp, human
ggcggggcggaatcaaaaga

SEQ ID NO: 388917 - DNA, 20 bp, human
gcgctgcgagccaatgggaa

SEQ ID NO: 388918 - DNA, 20 bp, human
ggacgcgagccaataggcgc

SEQ ID NO: 388919 - DNA, 20 bp, human
gaggcggggcgatgcctcag

SEQ ID NO: 388920 - DNA, 20 bp, human
gcaagactcggtcttcccat

SEQ ID NO: 388921 - DNA, 20 bp, human
gtgcgagccaatgggaaggg

SEQ ID NO: 388922 - DNA, 20 bp, human
gtaaaccaatgggctaggtg

SEQ ID NO: 388923 - DNA, 20 bp, human
ggcgaggttgctgtgataat

SEQ ID NO: 388924 - DNA, 20 bp, human
gtatcacagcaacctcgccg

SEQ ID NO: 388925 - DNA, 20 bp, human
gtcgaaggacaggtaaaggt

SEQ ID NO: 388926 - DNA, 20 bp, human
gtaccatgggccaatgggaa

SEQ ID NO: 388927 - DNA, 20 bp, human
gggcccaagagcttcaaccc

SEQ ID NO: 388928 - DNA, 20 bp, human
gtggcccatggtaaatagcg

SEQ ID NO: 388929 - DNA, 20 bp, human
ggaggcgggcaggacttgat

SEQ ID NO: 388930 - DNA, 20 bp, human
ggcggggcccaatcagggtt

SEQ ID NO: 388931 - DNA, 20 bp, human
gctccagggttgaagctctt

SEQ ID NO: 388932 - DNA, 20 bp, human
ggcgggcaggacttgattgg

SEQ ID NO: 388933 - DNA, 20 bp, human
gattgggcggggcccaatca

SEQ ID NO: 388934 - DNA, 20 bp, human
gaagcctcgctatttaccat

SEQ ID NO: 388935 - DNA, 20 bp, human
ggagcgtacaagacactaga

SEQ ID NO: 388936 - DNA, 20 bp, human
gctgaagtgcggtgtgaagc

SEQ ID NO: 388937 - DNA, 20 bp, human
ggtcgagtgtggcaacgaga

SEQ ID NO: 388938 - DNA, 20 bp, human
gaagtgcggtgtgaagcggg

SEQ ID NO: 388939 - DNA, 20 bp, human
ggcaacgagagggcgggaac

SEQ ID NO: 388940 - DNA, 20 bp, human
ggacgtggattgtcccgtgc

SEQ ID NO: 388941 - DNA, 20 bp, human
gtcgttgccacactcgacga

SEQ ID NO: 388942 - DNA, 20 bp, human
gaccgcacttcagatcagct

SEQ ID NO: 388943 - DNA, 20 bp, human
gcgcgctctgctctccacgg

SEQ ID NO: 388944 - DNA, 20 bp, human
gcgacgatggatgcctgcac

SEQ ID NO: 388945 - DNA, 20 bp, human
gagtgtggcaacgagagggc

SEQ ID NO: 388946 - DNA, 20 bp, human
gagcaggggaccgtagaacc

SEQ ID NO: 388947 - DNA, 20 bp, human
gtagtccgacatccggaaga

SEQ ID NO: 388948 - DNA, 20 bp, human
gggagcgcggcccggttcta

SEQ ID NO: 388949 - DNA, 20 bp, human
gccgacatccggaagaggga

SEQ ID NO: 388950 - DNA, 20 bp, human
gggagagccggaggtgggac

SEQ ID NO: 388951 - DNA, 20 bp, human
gcgcctccacgaactctagg

SEQ ID NO: 388952 - DNA, 20 bp, human
gctgcgcctccacgaactct

SEQ ID NO: 388953 - DNA, 20 bp, human
gccacgaactctaggagggg

SEQ ID NO: 388954 - DNA, 20 bp, human
gcgaacagcgcccccactgc

SEQ ID NO: 388955 - DNA, 20 bp, human
gagaacgcgcagtactgaag

SEQ ID NO: 388956 - DNA, 20 bp, human
gtggttgcgatcatggctgg

SEQ ID NO: 388957 - DNA, 20 bp, human
gccgcctcgccggcagtagt

SEQ ID NO: 388958 - DNA, 20 bp, human
gctcacgactcctgccgtaa

SEQ ID NO: 388959 - DNA, 20 bp, human
ggcagtagtaggcgcatgcg

SEQ ID NO: 388960 - DNA, 20 bp, human
gtcgggaatccgaaagggaa

SEQ ID NO: 388961 - DNA, 20 bp, human
gctgccgtaaaggccgtgtg

SEQ ID NO: 388962 - DNA, 20 bp, human
ggcatgcgtggttgcgatca

SEQ ID NO: 388963 - DNA, 20 bp, human
ggcgcctactactgccggcg

SEQ ID NO: 388964 - DNA, 20 bp, human
ggcgccacacacggccttta

SEQ ID NO: 388965 - DNA, 20 bp, human
ggcgtggttgcgatcatggc

SEQ ID NO: 388966 - DNA, 20 bp, human
gggcgctcaagagatccgag

SEQ ID NO: 388967 - DNA, 20 bp, human
gccgggttaagggaaagcgt

SEQ ID NO: 388968 - DNA, 20 bp, human
ggggacaacaccagctacga

SEQ ID NO: 388969 - DNA, 20 bp, human
ggggtgtgagtaggagtctt

SEQ ID NO: 388970 - DNA, 20 bp, human
gcgcgtgcccgagaaaccaa

SEQ ID NO: 388971 - DNA, 20 bp, human
gagtggcagaagagttgtga

SEQ ID NO: 388972 - DNA, 20 bp, human
gctccctcttcggttgatac

SEQ ID NO: 388973 - DNA, 20 bp, human
gctccagtatcaaccgaaga

SEQ ID NO: 388974 - DNA, 20 bp, human
gaaaagcagcggcacagcac

SEQ ID NO: 388975 - DNA, 20 bp, human
ggcggatcagagcgagatgt

SEQ ID NO: 388976 - DNA, 20 bp, human
ggcccgccgccgccgtcgag

SEQ ID NO: 388977 - DNA, 20 bp, human
gcggggcattccgggaagta

SEQ ID NO: 388978 - DNA, 20 bp, human
gctcccgcacgagaactccg

SEQ ID NO: 388979 - DNA, 20 bp, human
ggcgggccgaccgtacttcc

SEQ ID NO: 388980 - DNA, 20 bp, human
gcatcctcggagttctcgtg

SEQ ID NO: 388981 - DNA, 20 bp, human
gccccgcccctcgacggcgg

SEQ ID NO: 388982 - DNA, 20 bp, human
gtctcgtgcgggaggagctg

SEQ ID NO: 388983 - DNA, 20 bp, human
ggggccgtcttcccggacgc

SEQ ID NO: 388984 - DNA, 20 bp, human
gtccgggaagacggccccta

SEQ ID NO: 388985 - DNA, 20 bp, human
gaacccggcgtccgggaaga

SEQ ID NO: 388986 - DNA, 20 bp, human
gtccgtctggcgaacagcga

SEQ ID NO: 388987 - DNA, 20 bp, human
gaaaaagcgtctggagagga

SEQ ID NO: 388988 - DNA, 20 bp, human
ggcttggggtgggacgccgt

SEQ ID NO: 388989 - DNA, 20 bp, human
gctccgctgtgatttgcata

SEQ ID NO: 388990 - DNA, 20 bp, human
gaaggggaggctgcttgggg

SEQ ID NO: 388991 - DNA, 20 bp, human
gcgctcgcggaaagaggcag

SEQ ID NO: 388992 - DNA, 20 bp, human
ggggcttgcgatgcaaagac

SEQ ID NO: 388993 - DNA, 20 bp, human
gcgcgcacggtccggaggcg

SEQ ID NO: 388994 - DNA, 20 bp, human
gatgcaaagacaggtccgtc

SEQ ID NO: 388995 - DNA, 20 bp, human
gcgagaaaaagcgtctggag

SEQ ID NO: 388996 - DNA, 20 bp, human
gaaggggcgctggaccacga

SEQ ID NO: 388997 - DNA, 20 bp, human
gcccagcggcgctcatccca

SEQ ID NO: 388998 - DNA, 20 bp, human
gggtccccgcccagcgtgaa

SEQ ID NO: 388999 - DNA, 20 bp, human
ggggcggtctaagcctgcac

SEQ ID NO: 389000 - DNA, 20 bp, human
gcggcgctcatcccaaggct

SEQ ID NO: 389001 - DNA, 20 bp, human
gcacgaaggcagggaaacca

SEQ ID NO: 389002 - DNA, 20 bp, human
gctgtgctgcagaggtcagt

SEQ ID NO: 389003 - DNA, 20 bp, human
ggcgctggaccacgaaggca

SEQ ID NO: 389004 - DNA, 20 bp, human
gtgtcctgccggcctccccc

SEQ ID NO: 389005 - DNA, 20 bp, human
gctggcagatgcgcgtggtg

SEQ ID NO: 389006 - DNA, 20 bp, human
gtagggaggcgggactagag

SEQ ID NO: 389007 - DNA, 20 bp, human
gcccgcctccctaacctgat

SEQ ID NO: 389008 - DNA, 20 bp, human
gggccaactcagccgttcat

SEQ ID NO: 389009 - DNA, 20 bp, human
gcaactcagccgttcatagg

SEQ ID NO: 389010 - DNA, 20 bp, human
ggtgagagcgagtcagggat

SEQ ID NO: 389011 - DNA, 20 bp, human
gtctccgctatgacgccgag

SEQ ID NO: 389012 - DNA, 20 bp, human
gtcatagcggagagattgac

SEQ ID NO: 389013 - DNA, 20 bp, human
gtaaaccaatcaggttaggg

SEQ ID NO: 389014 - DNA, 20 bp, human
gcggaaagcttggaagagat

SEQ ID NO: 389015 - DNA, 20 bp, human
ggcaccactcggcgtcatag

SEQ ID NO: 389016 - DNA, 20 bp, human
gagagcaggggctgcttcaa

SEQ ID NO: 389017 - DNA, 20 bp, human
gaggctgtggcgacaaggcc

SEQ ID NO: 389018 - DNA, 20 bp, human
gaggggggaaacgtcattgc

SEQ ID NO: 389019 - DNA, 20 bp, human
ggcaaccgaaaggaagactt

SEQ ID NO: 389020 - DNA, 20 bp, human
gattgcgggtagcaaccgaa

SEQ ID NO: 389021 - DNA, 20 bp, human
gccgagaggctgtggcgaca

SEQ ID NO: 389022 - DNA, 20 bp, human
ggtggcgacaaggcccggat

SEQ ID NO: 389023 - DNA, 20 bp, human
gcccaaaattccaagccccc

SEQ ID NO: 389024 - DNA, 20 bp, human
gaaagggtcgaattggcctc

SEQ ID NO: 389025 - DNA, 20 bp, human
gaaattccaagccccctgga

SEQ ID NO: 389026 - DNA, 20 bp, human
gtggcagaggggaacgtgct

SEQ ID NO: 389027 - DNA, 20 bp, human
ggcggcgggaaggtggcaga

SEQ ID NO: 389028 - DNA, 20 bp, human
gcaaccactgccgggaagga

SEQ ID NO: 389029 - DNA, 20 bp, human
ggggaacgtgcttggacgag

SEQ ID NO: 389030 - DNA, 20 bp, human
gagaggggcggagtgagacg

SEQ ID NO: 389031 - DNA, 20 bp, human
ggcgccgcggtagcaggatc

SEQ ID NO: 389032 - DNA, 20 bp, human
gctcctaggacgccacaacc

SEQ ID NO: 389033 - DNA, 20 bp, human
ggaggggcgcgggacagtct

SEQ ID NO: 389034 - DNA, 20 bp, human
gaacccggatcctgctaccg

SEQ ID NO: 389035 - DNA, 20 bp, human
gtcctgctcggaagtctacg

SEQ ID NO: 389036 - DNA, 20 bp, human
ggcgtgcaagtgccactccc

SEQ ID NO: 389037 - DNA, 20 bp, human
gaatctgggtgcagggcttg

SEQ ID NO: 389038 - DNA, 20 bp, human
gtggggatccctgcggtccg

SEQ ID NO: 389039 - DNA, 20 bp, human
gccggcgggtcggcgttctt

SEQ ID NO: 389040 - DNA, 20 bp, human
gagcgtctgccctccggctc

SEQ ID NO: 389041 - DNA, 20 bp, human
gaacgccgacccgccggagc

SEQ ID NO: 389042 - DNA, 20 bp, human
gggggaagaatctgggtgca

SEQ ID NO: 389043 - DNA, 20 bp, human
ggacgctggcacaccggacg

SEQ ID NO: 389044 - DNA, 20 bp, human
ggagtggcacttgcacgccg

SEQ ID NO: 389045 - DNA, 20 bp, human
gcggctggacccggaaatag

SEQ ID NO: 389046 - DNA, 20 bp, human
gaggccctccaaaaagacgc

SEQ ID NO: 389047 - DNA, 20 bp, human
ggcgcccgattgcattgcga

SEQ ID NO: 389048 - DNA, 20 bp, human
gcggaagtggggcgcgtaag

SEQ ID NO: 389049 - DNA, 20 bp, human
gggcctctcgcggagctccg

SEQ ID NO: 389050 - DNA, 20 bp, human
ggtgccagcgtctttttgga

SEQ ID NO: 389051 - DNA, 20 bp, human
gggatcccgaagcaccagtc

SEQ ID NO: 389052 - DNA, 20 bp, human
gcagtccctcgcaatgcaat

SEQ ID NO: 389053 - DNA, 20 bp, human
gtgggagaatgagccctgaa

SEQ ID NO: 389054 - DNA, 20 bp, human
ggacgctggcacggaactcg

SEQ ID NO: 389055 - DNA, 20 bp, human
gggaagtggggcctcgtgtc

SEQ ID NO: 389056 - DNA, 20 bp, human
gtgagcagtctgtgggcggt

SEQ ID NO: 389057 - DNA, 20 bp, human
gcttcagggaaagcttgggc

SEQ ID NO: 389058 - DNA, 20 bp, human
ggcggaaatgtcaaacgtgg

SEQ ID NO: 389059 - DNA, 20 bp, human
ggcgctgggcctactcgcag

SEQ ID NO: 389060 - DNA, 20 bp, human
gccggtggaagtgacgccat

SEQ ID NO: 389061 - DNA, 20 bp, human
gagagcggaaatgtcaaacg

SEQ ID NO: 389062 - DNA, 20 bp, human
ggcgtcacttccaccggaaa

SEQ ID NO: 389063 - DNA, 20 bp, human
gccaccggaaaaggcaagcg

SEQ ID NO: 389064 - DNA, 20 bp, human
ggccggaccctttgggttta

SEQ ID NO: 389065 - DNA, 20 bp, human
gcgaaagtcggttcccgttc

SEQ ID NO: 389066 - DNA, 20 bp, human
gggcaacggtaacctgacgg

SEQ ID NO: 389067 - DNA, 20 bp, human
gaagaggcggagtcgaggtg

SEQ ID NO: 389068 - DNA, 20 bp, human
ggggggcgaggggaaatatc

SEQ ID NO: 389069 - DNA, 20 bp, human
gaatggcaacggtaacctga

SEQ ID NO: 389070 - DNA, 20 bp, human
gccccaggagattaaaacga

SEQ ID NO: 389071 - DNA, 20 bp, human
gaaaccaaaaatcgcaaagg

SEQ ID NO: 389072 - DNA, 20 bp, human
gcgaataaatggggttccag

SEQ ID NO: 389073 - DNA, 20 bp, human
gggtaacctgacgggggcga

SEQ ID NO: 389074 - DNA, 20 bp, human
ggcggaagatcgtatcctcc

SEQ ID NO: 389075 - DNA, 20 bp, human
gactaaaccaaaaatcgcaa

SEQ ID NO: 389076 - DNA, 20 bp, human
gaacacgtggccaacagggg

SEQ ID NO: 389077 - DNA, 20 bp, human
gcggagcagaaccgagtttc

SEQ ID NO: 389078 - DNA, 20 bp, human
gaaaaacacgtggccaacag

SEQ ID NO: 389079 - DNA, 20 bp, human
gggttctgctccgcccctgt

SEQ ID NO: 389080 - DNA, 20 bp, human
gcctccgcgagaggaggaac

SEQ ID NO: 389081 - DNA, 20 bp, human
gggaaccggaagcgtgggtc

SEQ ID NO: 389082 - DNA, 20 bp, human
gttgtaccgaacaaagatgg

SEQ ID NO: 389083 - DNA, 20 bp, human
ggaggaggaaccggaagcgt

SEQ ID NO: 389084 - DNA, 20 bp, human
ggtccataaacaaaaacacg

SEQ ID NO: 389085 - DNA, 20 bp, human
ggcagccctcctcccgacgc

SEQ ID NO: 389086 - DNA, 20 bp, human
gggcccatggtgtgtcttga

SEQ ID NO: 389087 - DNA, 20 bp, human
ggggaaaaggagtgcgacga

SEQ ID NO: 389088 - DNA, 20 bp, human
gacgagccgccagaagtgta

SEQ ID NO: 389089 - DNA, 20 bp, human
gccagggcccccatccgaga

SEQ ID NO: 389090 - DNA, 20 bp, human
ggcccccatccgagagggaa

SEQ ID NO: 389091 - DNA, 20 bp, human
gcggcgggaagtgaggttct

SEQ ID NO: 389092 - DNA, 20 bp, human
gacggaggagttctgtacgc

SEQ ID NO: 389093 - DNA, 20 bp, human
gcgaagtcgccgtacacttc

SEQ ID NO: 389094 - DNA, 20 bp, human
gcccaccggggacctttctt

SEQ ID NO: 389095 - DNA, 20 bp, human
gctggctggaggcaccaaag

SEQ ID NO: 389096 - DNA, 20 bp, human
gagattgcatgggacctctg

SEQ ID NO: 389097 - DNA, 20 bp, human
gcagacgacctggcagtaga

SEQ ID NO: 389098 - DNA, 20 bp, human
gaaggcgcccgtggaatcct

SEQ ID NO: 389099 - DNA, 20 bp, human
gcacggagactactagtccc

SEQ ID NO: 389100 - DNA, 20 bp, human
gtgtcagcatgagattgcat

SEQ ID NO: 389101 - DNA, 20 bp, human
gtctgacccagcgacaggcg

SEQ ID NO: 389102 - DNA, 20 bp, human
gacctggcagtagagggtga

SEQ ID NO: 389103 - DNA, 20 bp, human
ggggaccctggacgacattc

SEQ ID NO: 389104 - DNA, 20 bp, human
gcatttaccgcgcctgtcgc

SEQ ID NO: 389105 - DNA, 20 bp, human
gggcagtagagggtgaagga

SEQ ID NO: 389106 - DNA, 20 bp, human
ggggcggtgccatcgttctt

SEQ ID NO: 389107 - DNA, 20 bp, human
gggaccactcccaagaacga

SEQ ID NO: 389108 - DNA, 20 bp, human
gcagacccgcccactccctt

SEQ ID NO: 389109 - DNA, 20 bp, human
gccaacatggccgcccccaa

SEQ ID NO: 389110 - DNA, 20 bp, human
ggttcttgggagtggtccga

SEQ ID NO: 389111 - DNA, 20 bp, human
gaaacagtctcctacacctt

SEQ ID NO: 389112 - DNA, 20 bp, human
ggtgccatcgttcttgggag

SEQ ID NO: 389113 - DNA, 20 bp, human
ggggagtgggcgggtctgcg

SEQ ID NO: 389114 - DNA, 20 bp, human
gggaagtccgtcctgccgct

SEQ ID NO: 389115 - DNA, 20 bp, human
gatggccgcccccaagggag

SEQ ID NO: 389116 - DNA, 20 bp, human
ggcggcccgccgtcccggat

SEQ ID NO: 389117 - DNA, 20 bp, human
gaactaggggaccatcgtag

SEQ ID NO: 389118 - DNA, 20 bp, human
gcccgccgtcccggattgga

SEQ ID NO: 389119 - DNA, 20 bp, human
gaacgacgggcgggccttgg

SEQ ID NO: 389120 - DNA, 20 bp, human
gccaccttctggtcctgctg

SEQ ID NO: 389121 - DNA, 20 bp, human
ggttccgcagcaggaccaga

SEQ ID NO: 389122 - DNA, 20 bp, human
gcgaaccgtccaatccggga

SEQ ID NO: 389123 - DNA, 20 bp, human
gtaccgtggccatggaaacg

SEQ ID NO: 389124 - DNA, 20 bp, human
gcccgcgaaccgtccaatcc

SEQ ID NO: 389125 - DNA, 20 bp, human
gtggtcctgctgcggaacga

SEQ ID NO: 389126 - DNA, 20 bp, human
ggaacccgaaaccctgtctg

SEQ ID NO: 389127 - DNA, 20 bp, human
gctggcctgaagtcagtctc

SEQ ID NO: 389128 - DNA, 20 bp, human
gcagtcccgagactgacttc

SEQ ID NO: 389129 - DNA, 20 bp, human
gcctctcaggaccccagaca

SEQ ID NO: 389130 - DNA, 20 bp, human
gcccgcctgggtcacgtgta

SEQ ID NO: 389131 - DNA, 20 bp, human
gcaggccaggtgcaactagc

SEQ ID NO: 389132 - DNA, 20 bp, human
gagtctcgggactgcctctc

SEQ ID NO: 389133 - DNA, 20 bp, human
gaggaccccagacagggttt

SEQ ID NO: 389134 - DNA, 20 bp, human
ggcctgggtcacgtgtacgg

SEQ ID NO: 389135 - DNA, 20 bp, human
gggctctggtggcccatcag

SEQ ID NO: 389136 - DNA, 20 bp, human
gacctccggccaggggatct

SEQ ID NO: 389137 - DNA, 20 bp, human
gccggcttgcccagatcccc

SEQ ID NO: 389138 - DNA, 20 bp, human
gcgggacttgggctggacgg

SEQ ID NO: 389139 - DNA, 20 bp, human
gtgcaaaggaagtgagtcag

SEQ ID NO: 389140 - DNA, 20 bp, human
gctagcgctcagagccctcc

SEQ ID NO: 389141 - DNA, 20 bp, human
gaggctcaggacacctggtg

SEQ ID NO: 389142 - DNA, 20 bp, human
ggaggggcagcgacacctgt

SEQ ID NO: 389143 - DNA, 20 bp, human
gggacggaggcgccaaaggg

SEQ ID NO: 389144 - DNA, 20 bp, human
gggaatgtgacctccggcca

SEQ ID NO: 389145 - DNA, 20 bp, human
gtgcggcccaggcgggactt

SEQ ID NO: 389146 - DNA, 20 bp, human
gcggcggcgggaccaagagg

SEQ ID NO: 389147 - DNA, 20 bp, human
gcagcccggcacacgcgctc

SEQ ID NO: 389148 - DNA, 20 bp, human
gggtgcgcgccgcggcttgg

SEQ ID NO: 389149 - DNA, 20 bp, human
ggtggagcaggctgcgcgct

SEQ ID NO: 389150 - DNA, 20 bp, human
gagccgcggcgcgcacccgt

SEQ ID NO: 389151 - DNA, 20 bp, human
gtcaactctcccccaagccg

SEQ ID NO: 389152 - DNA, 20 bp, human
ggagcccgagcgcgtgtgcc

SEQ ID NO: 389153 - DNA, 20 bp, human
ggccggggaccggagaaagg

SEQ ID NO: 389154 - DNA, 20 bp, human
gcggggatccagaagggaca

SEQ ID NO: 389155 - DNA, 20 bp, human
gttggaggcccgggatgtgg

SEQ ID NO: 389156 - DNA, 20 bp, human
gcccgcgcgcgctattgttc

SEQ ID NO: 389157 - DNA, 20 bp, human
ggacaggcgcgcccccctca

SEQ ID NO: 389158 - DNA, 20 bp, human
gaggaaggacctccacgccc

SEQ ID NO: 389159 - DNA, 20 bp, human
ggctcccgcgggcagtgcct

SEQ ID NO: 389160 - DNA, 20 bp, human
ggcgtggaggtccttcctcc

SEQ ID NO: 389161 - DNA, 20 bp, human
gcccggccctgcatccctga

SEQ ID NO: 389162 - DNA, 20 bp, human
gcgcgctattgttccggcct

SEQ ID NO: 389163 - DNA, 20 bp, human
gctggggaggggtgccgttc

SEQ ID NO: 389164 - DNA, 20 bp, human
ggtgaggagagaagcccgaa

SEQ ID NO: 389165 - DNA, 20 bp, human
gacaatagcgcgcgcgggcg

SEQ ID NO: 389166 - DNA, 20 bp, human
gagaagaggggccccggaga

SEQ ID NO: 389167 - DNA, 20 bp, human
gcctcggcccggaccgcctc

SEQ ID NO: 389168 - DNA, 20 bp, human
ggggacaaagaggaccggag

SEQ ID NO: 389169 - DNA, 20 bp, human
gcgcggccgccccctctccg

SEQ ID NO: 389170 - DNA, 20 bp, human
gtccgggccgaggagcgcac

SEQ ID NO: 389171 - DNA, 20 bp, human
ggccgggccccttgtctccg

SEQ ID NO: 389172 - DNA, 20 bp, human
ggggccgaggagcgcaccgg

SEQ ID NO: 389173 - DNA, 20 bp, human
gcgaggcagtggggacaaag

SEQ ID NO: 389174 - DNA, 20 bp, human
gctggcgtccgcttcggccg

SEQ ID NO: 389175 - DNA, 20 bp, human
ggagacgagccgcggagaca

SEQ ID NO: 389176 - DNA, 20 bp, human
ggtggttcgccttcaaggct

SEQ ID NO: 389177 - DNA, 20 bp, human
gactagtttaaagtagtgag

SEQ ID NO: 389178 - DNA, 20 bp, human
gtgcaatagagacgtgatct

SEQ ID NO: 389179 - DNA, 20 bp, human
gcgacctaaggatgattccg

SEQ ID NO: 389180 - DNA, 20 bp, human
gagaagatcggtagattgag

SEQ ID NO: 389181 - DNA, 20 bp, human
gactccccggaatcatcctt

SEQ ID NO: 389182 - DNA, 20 bp, human
gcgtccctggaggtggcgta

SEQ ID NO: 389183 - DNA, 20 bp, human
gttcccggaccagagaaggg

SEQ ID NO: 389184 - DNA, 20 bp, human
ggtgctagaagcgtccctgg

SEQ ID NO: 389185 - DNA, 20 bp, human
ggacttcccggaccagagaa

SEQ ID NO: 389186 - DNA, 20 bp, human
gcgcctgccggaggaagcaa

SEQ ID NO: 389187 - DNA, 20 bp, human
gtgtgccaggagcctcgcag

SEQ ID NO: 389188 - DNA, 20 bp, human
gcagtcgccatgacaagtaa

SEQ ID NO: 389189 - DNA, 20 bp, human
ggaggctcctggcacaaagc

SEQ ID NO: 389190 - DNA, 20 bp, human
gcaagtaatccgcctgccgg

SEQ ID NO: 389191 - DNA, 20 bp, human
gctgcaagccagagctgtga

SEQ ID NO: 389192 - DNA, 20 bp, human
gagtcttgagcacatgggag

SEQ ID NO: 389193 - DNA, 20 bp, human
gagtatctacggcaccaggt

SEQ ID NO: 389194 - DNA, 20 bp, human
ggccgtagatactaacattt

SEQ ID NO: 389195 - DNA, 20 bp, human
ggcaggggttgatgggattg

SEQ ID NO: 389196 - DNA, 20 bp, human
ggggggtgaaggcaacgggt

SEQ ID NO: 389197 - DNA, 20 bp, human
gggagcgagcccataggctg

SEQ ID NO: 389198 - DNA, 20 bp, human
gctgctgggggtgaaggcaa

SEQ ID NO: 389199 - DNA, 20 bp, human
gagcccgagcacggcctctc

SEQ ID NO: 389200 - DNA, 20 bp, human
ggggccccctgaagtcctgg

SEQ ID NO: 389201 - DNA, 20 bp, human
gtggcaggcccgcagtggtg

SEQ ID NO: 389202 - DNA, 20 bp, human
gacagtgtgagccacgtggc

SEQ ID NO: 389203 - DNA, 20 bp, human
gagcagcactggttgtgaaa

SEQ ID NO: 389204 - DNA, 20 bp, human
ggtccttggcaggcccgcag

SEQ ID NO: 389205 - DNA, 20 bp, human
gtccctgagaggccgtgctc

SEQ ID NO: 389206 - DNA, 20 bp, human
gaaccgaagggaccttgaga

SEQ ID NO: 389207 - DNA, 20 bp, human
gcgccactcaagaaatcccg

SEQ ID NO: 389208 - DNA, 20 bp, human
gccggctctactaaagggga

SEQ ID NO: 389209 - DNA, 20 bp, human
gcaaggataccgtcattctc

SEQ ID NO: 389210 - DNA, 20 bp, human
gtagtagagccggagaatga

SEQ ID NO: 389211 - DNA, 20 bp, human
gaagaaatcccgtggatgat

SEQ ID NO: 389212 - DNA, 20 bp, human
gtcaaggtcccttcggttca

SEQ ID NO: 389213 - DNA, 20 bp, human
gtgcaacgtccatgctgcca

SEQ ID NO: 389214 - DNA, 20 bp, human
gcgtggatgataggtagctg

SEQ ID NO: 389215 - DNA, 20 bp, human
gacacggcggcgcgtttcca

SEQ ID NO: 389216 - DNA, 20 bp, human
ggctcccctcagttcgggcg

SEQ ID NO: 389217 - DNA, 20 bp, human
ggtactggggagggcgtggt

SEQ ID NO: 389218 - DNA, 20 bp, human
gggcaacgatacaaactcgg

SEQ ID NO: 389219 - DNA, 20 bp, human
gtccacttagacttgagcgg

SEQ ID NO: 389220 - DNA, 20 bp, human
ggtctcgccaggctagaggg

SEQ ID NO: 389221 - DNA, 20 bp, human
ggcagcctcgcccgaactga

SEQ ID NO: 389222 - DNA, 20 bp, human
gtggggcgaggcggttgcct

SEQ ID NO: 389223 - DNA, 20 bp, human
gaccgcctcgccccaccaat

SEQ ID NO: 389224 - DNA, 20 bp, human
gaagatggctcccctcagtt

SEQ ID NO: 389225 - DNA, 20 bp, human
gctctgggggacccattggt

SEQ ID NO: 389226 - DNA, 20 bp, human
gcggctgggtagacggggag

SEQ ID NO: 389227 - DNA, 20 bp, human
gcggagccggggcaattgga

SEQ ID NO: 389228 - DNA, 20 bp, human
gccggactgaagtgcggtcg

SEQ ID NO: 389229 - DNA, 20 bp, human
gaaactacccgactccctgg

SEQ ID NO: 389230 - DNA, 20 bp, human
gctcggctggggcccgaccc

SEQ ID NO: 389231 - DNA, 20 bp, human
gtggagcgcgcgcctcctag

SEQ ID NO: 389232 - DNA, 20 bp, human
ggcgggcccggctgggtaga

SEQ ID NO: 389233 - DNA, 20 bp, human
gcgcgcagctcccgttcccg

SEQ ID NO: 389234 - DNA, 20 bp, human
gctagcggagccggggcaat

SEQ ID NO: 389235 - DNA, 20 bp, human
gaaaacaggatggtagtgaa

SEQ ID NO: 389236 - DNA, 20 bp, human
gcgcgcccgagagaaggcgc

SEQ ID NO: 389237 - DNA, 20 bp, human
ggcccccgggagagcctcgc

SEQ ID NO: 389238 - DNA, 20 bp, human
gaggcagcccggcgcgtggg

SEQ ID NO: 389239 - DNA, 20 bp, human
gctcccgggggccgcctgca

SEQ ID NO: 389240 - DNA, 20 bp, human
ggcccccagggtggccgccg

SEQ ID NO: 389241 - DNA, 20 bp, human
ggcgaggcagcccggcgcgt

SEQ ID NO: 389242 - DNA, 20 bp, human
gccgggggaggaagccgcgc

SEQ ID NO: 389243 - DNA, 20 bp, human
gccgccggggcgggcgggat

SEQ ID NO: 389244 - DNA, 20 bp, human
ggcccgagagaaggcgccgg

SEQ ID NO: 389245 - DNA, 20 bp, human
gccgtcccctcccacgcgcc

SEQ ID NO: 389246 - DNA, 20 bp, human
gtggggcggggcgataccgg

SEQ ID NO: 389247 - DNA, 20 bp, human
ggggcccctttcctcgtccg

SEQ ID NO: 389248 - DNA, 20 bp, human
gggaaccgggtcagcgcgca

SEQ ID NO: 389249 - DNA, 20 bp, human
gcgcgcgagcccagggccaa

SEQ ID NO: 389250 - DNA, 20 bp, human
gcctggatgagatcgtggag

SEQ ID NO: 389251 - DNA, 20 bp, human
gaatccccggacgaggaaag

SEQ ID NO: 389252 - DNA, 20 bp, human
gcattggggcggggcgatac

SEQ ID NO: 389253 - DNA, 20 bp, human
gctgtgggcgggcattgggg

SEQ ID NO: 389254 - DNA, 20 bp, human
gacactccgctgctgtgggc

SEQ ID NO: 389255 - DNA, 20 bp, human
gcagcgcgcaaggctcagta

SEQ ID NO: 389256 - DNA, 20 bp, human
gggacctggggtagccggag

SEQ ID NO: 389257 - DNA, 20 bp, human
gggaggcagaggcagtcctg

SEQ ID NO: 389258 - DNA, 20 bp, human
gtggggtagccggaggggtg

SEQ ID NO: 389259 - DNA, 20 bp, human
gcgccagcatccttctcctg

SEQ ID NO: 389260 - DNA, 20 bp, human
gccccaggactgtcaggagg

SEQ ID NO: 389261 - DNA, 20 bp, human
ggcctctgcctccaccggaa

SEQ ID NO: 389262 - DNA, 20 bp, human
ggaaaggagccgttgggagt

SEQ ID NO: 389263 - DNA, 20 bp, human
gcaggtccagccgtccattc

SEQ ID NO: 389264 - DNA, 20 bp, human
ggaccaatccgcccgccaag

SEQ ID NO: 389265 - DNA, 20 bp, human
ggtccagccgtccattccgg

SEQ ID NO: 389266 - DNA, 20 bp, human
ggccgggccccaccaatcgg

SEQ ID NO: 389267 - DNA, 20 bp, human
gtgacctggcgcccggccgg

SEQ ID NO: 389268 - DNA, 20 bp, human
gcccggggccgccctgcgag

SEQ ID NO: 389269 - DNA, 20 bp, human
gggcgccaggtcacgtgcgt

SEQ ID NO: 389270 - DNA, 20 bp, human
gcaggccgggccccaccaat

SEQ ID NO: 389271 - DNA, 20 bp, human
ggggcccccgcaccgccgat

SEQ ID NO: 389272 - DNA, 20 bp, human
gccaccaatcggcggtgcgg

SEQ ID NO: 389273 - DNA, 20 bp, human
gaaccggcgggcaacgggaa

SEQ ID NO: 389274 - DNA, 20 bp, human
gcgggagcggggtgcgtaag

SEQ ID NO: 389275 - DNA, 20 bp, human
gaaggcctgggcgagcggaa

SEQ ID NO: 389276 - DNA, 20 bp, human
gccggcccgcaaaccgggag

SEQ ID NO: 389277 - DNA, 20 bp, human
gcggggcggcggccaatccc

SEQ ID NO: 389278 - DNA, 20 bp, human
gcccgcccgcctcgcgtcac

SEQ ID NO: 389279 - DNA, 20 bp, human
ggggatccgcagcccgggat

SEQ ID NO: 389280 - DNA, 20 bp, human
ggcccgcaaaccgggagggg

SEQ ID NO: 389281 - DNA, 20 bp, human
gaaacgttctcggaaccggg

SEQ ID NO: 389282 - DNA, 20 bp, human
gagcgcccggcccgcaaacc

SEQ ID NO: 389283 - DNA, 20 bp, human
gccgcggcgagctctccgcg

SEQ ID NO: 389284 - DNA, 20 bp, human
gcccgccagccggtgacgcg

SEQ ID NO: 389285 - DNA, 20 bp, human
gtcgggccgggaaacgttct

SEQ ID NO: 389286 - DNA, 20 bp, human
ggagtcggaggagcccgaca

SEQ ID NO: 389287 - DNA, 20 bp, human
gcagggatcgggatcggcaa

SEQ ID NO: 389288 - DNA, 20 bp, human
ggggatcggcaaggggttcg

SEQ ID NO: 389289 - DNA, 20 bp, human
gggacgctcagtagttgaac

SEQ ID NO: 389290 - DNA, 20 bp, human
ggccgatcccgatccctgtc

SEQ ID NO: 389291 - DNA, 20 bp, human
ggaggagcccgacagggatc

SEQ ID NO: 389292 - DNA, 20 bp, human
gcggcaaggggttcgtggcg

SEQ ID NO: 389293 - DNA, 20 bp, human
gcggcgcggacggctctcgc

SEQ ID NO: 389294 - DNA, 20 bp, human
gaaggggttcgtggcgcggc

SEQ ID NO: 389295 - DNA, 20 bp, human
gagttgaactggcgctggca

SEQ ID NO: 389296 - DNA, 20 bp, human
gtacaggccggaagtgtccg

SEQ ID NO: 389297 - DNA, 20 bp, human
ggttacgcctcccaactttt

SEQ ID NO: 389298 - DNA, 20 bp, human
gcgtccaccccggacacttc

SEQ ID NO: 389299 - DNA, 20 bp, human
ggacacttccggcctgtaag

SEQ ID NO: 389300 - DNA, 20 bp, human
gttcggcaacgctcagtaag

SEQ ID NO: 389301 - DNA, 20 bp, human
ggggaggcgtaaccacttac

SEQ ID NO: 389302 - DNA, 20 bp, human
gcacaagagcccttcctgca

SEQ ID NO: 389303 - DNA, 20 bp, human
gaggccggaagtgtccgggg

SEQ ID NO: 389304 - DNA, 20 bp, human
ggccccgccttccgcctctt

SEQ ID NO: 389305 - DNA, 20 bp, human
gttcagagagccgaaaagtt

SEQ ID NO: 389306 - DNA, 20 bp, human
gatcccaccaaatgggataa

SEQ ID NO: 389307 - DNA, 20 bp, human
gtaaaatattattgcatccc

SEQ ID NO: 389308 - DNA, 20 bp, human
gaatagatcagtaatgggta

SEQ ID NO: 389309 - DNA, 20 bp, human
gttcatttgcaactacgttg

SEQ ID NO: 389310 - DNA, 20 bp, human
gaattcaaaagcactttaaa

SEQ ID NO: 389311 - DNA, 20 bp, human
gttacaagaaaaacaattac

SEQ ID NO: 389312 - DNA, 20 bp, human
ggtgggatatcattgtacat

SEQ ID NO: 389313 - DNA, 20 bp, human
gctgatacaaaaaccagaga

SEQ ID NO: 389314 - DNA, 20 bp, human
gttgaaaaaattgaaggagg

SEQ ID NO: 389315 - DNA, 20 bp, human
gaatatgaatagatcagtaa

SEQ ID NO: 389316 - DNA, 20 bp, human
gggctgcagcactggaggaa

SEQ ID NO: 389317 - DNA, 20 bp, human
ggcctcagaaggccagggac

SEQ ID NO: 389318 - DNA, 20 bp, human
ggcaagcggggccaattaag

SEQ ID NO: 389319 - DNA, 20 bp, human
gcccgcctctgcatgagact

SEQ ID NO: 389320 - DNA, 20 bp, human
gcgtgtgtacgtgtttgtgt

SEQ ID NO: 389321 - DNA, 20 bp, human
gcgcttgcctcagaaggcca

SEQ ID NO: 389322 - DNA, 20 bp, human
ggggcatgatatggagagtt

SEQ ID NO: 389323 - DNA, 20 bp, human
gtggccccgcttgcctcaga

SEQ ID NO: 389324 - DNA, 20 bp, human
ggatatggagagttgggcat

SEQ ID NO: 389325 - DNA, 20 bp, human
gggttcagcacaaatggagg

SEQ ID NO: 389326 - DNA, 20 bp, human
ggggagaggcctcactccat

SEQ ID NO: 389327 - DNA, 20 bp, human
gggaagttgatggattggac

SEQ ID NO: 389328 - DNA, 20 bp, human
gctggactcctccactccaa

SEQ ID NO: 389329 - DNA, 20 bp, human
gcaggtggaagttgatggat

SEQ ID NO: 389330 - DNA, 20 bp, human
gaggcctcactccattggag

SEQ ID NO: 389331 - DNA, 20 bp, human
gtctaactacttaatgagat

SEQ ID NO: 389332 - DNA, 20 bp, human
ggtggtggtgcggtttgttt

SEQ ID NO: 389333 - DNA, 20 bp, human
gaaccactggcatttctctg

SEQ ID NO: 389334 - DNA, 20 bp, human
gcctcctcatgcctatagtt

SEQ ID NO: 389335 - DNA, 20 bp, human
gcttctgtaaatcgtggtgg

SEQ ID NO: 389336 - DNA, 20 bp, human
gacctgcttcggccctgcgt

SEQ ID NO: 389337 - DNA, 20 bp, human
gtcgggcacagagtcggcac

SEQ ID NO: 389338 - DNA, 20 bp, human
gtggacgcggccagctggag

SEQ ID NO: 389339 - DNA, 20 bp, human
ggcgggccaccgagtcgcgg

SEQ ID NO: 389340 - DNA, 20 bp, human
gcgggaccccgacttggacg

SEQ ID NO: 389341 - DNA, 20 bp, human
gtggccccgccgcgactcgg

SEQ ID NO: 389342 - DNA, 20 bp, human
gccggcgaggccgcccacgc

SEQ ID NO: 389343 - DNA, 20 bp, human
gagcgcgggccaccgagtcg

SEQ ID NO: 389344 - DNA, 20 bp, human
ggacgcgcgccaaaaggcgg

SEQ ID NO: 389345 - DNA, 20 bp, human
gaggcgccgcggggagtagg

SEQ ID NO: 389346 - DNA, 20 bp, human
gaacctcggcagccgtaggt

SEQ ID NO: 389347 - DNA, 20 bp, human
gggggagggccaggactgtc

SEQ ID NO: 389348 - DNA, 20 bp, human
ggaaccacccaaggatgtcg

SEQ ID NO: 389349 - DNA, 20 bp, human
gctcggcagccgtaggtagg

SEQ ID NO: 389350 - DNA, 20 bp, human
ggctggggtgcgaagagagt

SEQ ID NO: 389351 - DNA, 20 bp, human
gtgggctgcgcgcctcctcc

SEQ ID NO: 389352 - DNA, 20 bp, human
gcaaaatgaggaaccaccca

SEQ ID NO: 389353 - DNA, 20 bp, human
gccacccaaggatgtcgggg

SEQ ID NO: 389354 - DNA, 20 bp, human
gtgggaaaaaccaacccggg

SEQ ID NO: 389355 - DNA, 20 bp, human
gagagtcggcgcccgcaacg

SEQ ID NO: 389356 - DNA, 20 bp, human
gtgggaggctcccgagaatc

SEQ ID NO: 389357 - DNA, 20 bp, human
gagggcgcggagactccgct

SEQ ID NO: 389358 - DNA, 20 bp, human
gccgcctcccacggcgagga

SEQ ID NO: 389359 - DNA, 20 bp, human
ggtggggcggggcccgactg

SEQ ID NO: 389360 - DNA, 20 bp, human
gtcccgagaatcagggctgt

SEQ ID NO: 389361 - DNA, 20 bp, human
gctccaggagccaaacttct

SEQ ID NO: 389362 - DNA, 20 bp, human
gtctcggcagcccggagggg

SEQ ID NO: 389363 - DNA, 20 bp, human
ggacccagcttaaatgttgg

SEQ ID NO: 389364 - DNA, 20 bp, human
gtcccacggcgaggagggcg

SEQ ID NO: 389365 - DNA, 20 bp, human
gtccgcgccctcctcgccgt

SEQ ID NO: 389366 - DNA, 20 bp, human
ggggttggactcaacgagta

SEQ ID NO: 389367 - DNA, 20 bp, human
gcgggcagggagtaccgcat

SEQ ID NO: 389368 - DNA, 20 bp, human
gcgagtaaggcggggaacaa

SEQ ID NO: 389369 - DNA, 20 bp, human
ggggaacaagggaggagtaa

SEQ ID NO: 389370 - DNA, 20 bp, human
ggggttgagaggacggtagg

SEQ ID NO: 389371 - DNA, 20 bp, human
gctgcccgcctccttaagaa

SEQ ID NO: 389372 - DNA, 20 bp, human
ggcagggagtaccgcatcgg

SEQ ID NO: 389373 - DNA, 20 bp, human
gtgcggaaggacgtgatagt

SEQ ID NO: 389374 - DNA, 20 bp, human
ggtctcgcccgccgccgatg

SEQ ID NO: 389375 - DNA, 20 bp, human
gttggactcaacgagtaagg

SEQ ID NO: 389376 - DNA, 20 bp, human
gcctccctccccgttctcat

SEQ ID NO: 389377 - DNA, 20 bp, human
gcagccaatgagaacgggga

SEQ ID NO: 389378 - DNA, 20 bp, human
ggagctccaccctagagggg

SEQ ID NO: 389379 - DNA, 20 bp, human
gtgagtggggcggagctaaa

SEQ ID NO: 389380 - DNA, 20 bp, human
gagggcggggcagcgttctg

SEQ ID NO: 389381 - DNA, 20 bp, human
gaacgctgccccgccctggg

SEQ ID NO: 389382 - DNA, 20 bp, human
ggtcccagccaatgagaacg

SEQ ID NO: 389383 - DNA, 20 bp, human
ggcacggcactgtggcgcag

SEQ ID NO: 389384 - DNA, 20 bp, human
ggcagcgttctggggcttaa

SEQ ID NO: 389385 - DNA, 20 bp, human
gtctggggcttaagggccga

SEQ ID NO: 389386 - DNA, 20 bp, human
gccgacgtggcggagcgcac

SEQ ID NO: 389387 - DNA, 20 bp, human
ggggcggcgcagcgctagga

SEQ ID NO: 389388 - DNA, 20 bp, human
ggcggagcgcacaggtcgac

SEQ ID NO: 389389 - DNA, 20 bp, human
gtcgaccgggtcaggtggtt

SEQ ID NO: 389390 - DNA, 20 bp, human
gggcctggagcgctttcctg

SEQ ID NO: 389391 - DNA, 20 bp, human
gtggaagtcggccgggagga

SEQ ID NO: 389392 - DNA, 20 bp, human
ggccgcccgcgccgacgtgg

SEQ ID NO: 389393 - DNA, 20 bp, human
gcgcacaggtcgaccgggtc

SEQ ID NO: 389394 - DNA, 20 bp, human
gtcccgcaccggctggaagt

SEQ ID NO: 389395 - DNA, 20 bp, human
ggtcacccaaccacctgacc

SEQ ID NO: 389396 - DNA, 20 bp, human
gcccactcccggcgctataa

SEQ ID NO: 389397 - DNA, 20 bp, human
gggcggaaggcacccactcc

SEQ ID NO: 389398 - DNA, 20 bp, human
ggctctgtacagccggcgga

SEQ ID NO: 389399 - DNA, 20 bp, human
gtgtacagagcgccggcagg

SEQ ID NO: 389400 - DNA, 20 bp, human
gtgccggcgctctgtacagc

SEQ ID NO: 389401 - DNA, 20 bp, human
gcggcgctctgtacagccgg

SEQ ID NO: 389402 - DNA, 20 bp, human
gaaccagaagcggctagtgg

SEQ ID NO: 389403 - DNA, 20 bp, human
gtgggccaggtggactggaa

SEQ ID NO: 389404 - DNA, 20 bp, human
gcggcgagcttgttccagct

SEQ ID NO: 389405 - DNA, 20 bp, human
ggcccttatagcgccgggag

SEQ ID NO: 389406 - DNA, 20 bp, human
gggccccaggggatcttccg

SEQ ID NO: 389407 - DNA, 20 bp, human
gcgggcgaaccaggaaaggg

SEQ ID NO: 389408 - DNA, 20 bp, human
gttacccgactcaacctgat

SEQ ID NO: 389409 - DNA, 20 bp, human
ggaaccacgcctccctttcc

SEQ ID NO: 389410 - DNA, 20 bp, human
gctgcgggcgaaccaggaaa

SEQ ID NO: 389411 - DNA, 20 bp, human
gaggttgagtcgggtaaacc

SEQ ID NO: 389412 - DNA, 20 bp, human
gaaagggaggcgtggttcgg

SEQ ID NO: 389413 - DNA, 20 bp, human
ggtagaacggtcagagtagc

SEQ ID NO: 389414 - DNA, 20 bp, human
gcgccccggaagatcccctg

SEQ ID NO: 389415 - DNA, 20 bp, human
gctcgctggtggagtcaacc

SEQ ID NO: 389416 - DNA, 20 bp, human
ggaggcgcaacccacactgg

SEQ ID NO: 389417 - DNA, 20 bp, human
ggggctggtcagggttgcgg

SEQ ID NO: 389418 - DNA, 20 bp, human
ggtggggagccgggctggtc

SEQ ID NO: 389419 - DNA, 20 bp, human
ggctgaggcgcaacccacac

SEQ ID NO: 389420 - DNA, 20 bp, human
ggccgggctggtcagggttg

SEQ ID NO: 389421 - DNA, 20 bp, human
gacttcccgcccaaaccgcg

SEQ ID NO: 389422 - DNA, 20 bp, human
gtggtcagggttgcggaggt

SEQ ID NO: 389423 - DNA, 20 bp, human
ggccaaaatgccgccagtgt

SEQ ID NO: 389424 - DNA, 20 bp, human
gagctcgtggtgttcacttc

SEQ ID NO: 389425 - DNA, 20 bp, human
gcgtggtgttcacttccggg

SEQ ID NO: 389426 - DNA, 20 bp, human
gtatcccgctgggagacttt

SEQ ID NO: 389427 - DNA, 20 bp, human
gaggcggccatcttgattaa

SEQ ID NO: 389428 - DNA, 20 bp, human
ggactcgctcactacccaaa

SEQ ID NO: 389429 - DNA, 20 bp, human
gagaagagagagtgccaata

SEQ ID NO: 389430 - DNA, 20 bp, human
gtcgctgagggcagcgggac

SEQ ID NO: 389431 - DNA, 20 bp, human
gtcaatatacacaaagaggg

SEQ ID NO: 389432 - DNA, 20 bp, human
gccgctgccctcagcgaaga

SEQ ID NO: 389433 - DNA, 20 bp, human
gagggcaccggtatcccgct

SEQ ID NO: 389434 - DNA, 20 bp, human
ggggctgggtccagcagtcc

SEQ ID NO: 389435 - DNA, 20 bp, human
gcaagatggccgccttgggg

SEQ ID NO: 389436 - DNA, 20 bp, human
gcctgcggggcgagagggtg

SEQ ID NO: 389437 - DNA, 20 bp, human
gaagctacgtcccggaggtg

SEQ ID NO: 389438 - DNA, 20 bp, human
gaggggaagctacgtcccgg

SEQ ID NO: 389439 - DNA, 20 bp, human
gtcgcgtggcagtccgagag

SEQ ID NO: 389440 - DNA, 20 bp, human
ggccctccacgggacggcga

SEQ ID NO: 389441 - DNA, 20 bp, human
gcactcggggcgtcgcgcct

SEQ ID NO: 389442 - DNA, 20 bp, human
gcagcagctccgtggggcgc

SEQ ID NO: 389443 - DNA, 20 bp, human
gaagcgcggcgcagtgatga

SEQ ID NO: 389444 - DNA, 20 bp, human
gcgtcccggaggtgcggtgt

SEQ ID NO: 389445 - DNA, 20 bp, human
gctgcgcggccggcccctgc

SEQ ID NO: 389446 - DNA, 20 bp, human
gcaagtaacacgttgatgga

SEQ ID NO: 389447 - DNA, 20 bp, human
ggcaccaagtaacacgttga

SEQ ID NO: 389448 - DNA, 20 bp, human
gtgcagtcaggggtctattc

SEQ ID NO: 389449 - DNA, 20 bp, human
gtgtgacaactatgaaatgg

SEQ ID NO: 389450 - DNA, 20 bp, human
gcaaggtgttgtatggcatg

SEQ ID NO: 389451 - DNA, 20 bp, human
gtcaactaatgtgtggactt

SEQ ID NO: 389452 - DNA, 20 bp, human
gaggagatgtgatatgtaaa

SEQ ID NO: 389453 - DNA, 20 bp, human
ggaactaaaatgctgcagtc

SEQ ID NO: 389454 - DNA, 20 bp, human
gtgtacgctctgcaaagcaa

SEQ ID NO: 389455 - DNA, 20 bp, human
gagatggtactggctaaaaa

SEQ ID NO: 389456 - DNA, 20 bp, human
gctggcggagattgagagga

SEQ ID NO: 389457 - DNA, 20 bp, human
gagaggggcagtagcagcgc

SEQ ID NO: 389458 - DNA, 20 bp, human
gtataaaggagcccggggat

SEQ ID NO: 389459 - DNA, 20 bp, human
gaaaggagcccggggatggg

SEQ ID NO: 389460 - DNA, 20 bp, human
gggtggagaacaatacataa

SEQ ID NO: 389461 - DNA, 20 bp, human
gatgagagaactaacgtcag

SEQ ID NO: 389462 - DNA, 20 bp, human
gcattcatataaaggagccc

SEQ ID NO: 389463 - DNA, 20 bp, human
gactaacgtcagaggataga

SEQ ID NO: 389464 - DNA, 20 bp, human
ggcagcagggggtactagag

SEQ ID NO: 389465 - DNA, 20 bp, human
gcacaattgcttaaagactg

SEQ ID NO: 389466 - DNA, 20 bp, human
gacagtgcatcatcgggcgg

SEQ ID NO: 389467 - DNA, 20 bp, human
gcgtcggaacagtgcatcat

SEQ ID NO: 389468 - DNA, 20 bp, human
gaacgttctaggagagtcgg

SEQ ID NO: 389469 - DNA, 20 bp, human
gccacaagaagggggaacgt

SEQ ID NO: 389470 - DNA, 20 bp, human
gggaacagtgcatcatcggg

SEQ ID NO: 389471 - DNA, 20 bp, human
ggaaagccccgcaatcgagg

SEQ ID NO: 389472 - DNA, 20 bp, human
ggactcaagtcgccaagcga

SEQ ID NO: 389473 - DNA, 20 bp, human
gaacgggcggaagcagagtc

SEQ ID NO: 389474 - DNA, 20 bp, human
ggctctatataagtgggcag

SEQ ID NO: 389475 - DNA, 20 bp, human
ggggcaggtaaggacgtttt

SEQ ID NO: 389476 - DNA, 20 bp, human
gaagccttggagacttgagg

SEQ ID NO: 389477 - DNA, 20 bp, human
gtacccacctcaagtctcca

SEQ ID NO: 389478 - DNA, 20 bp, human
ggtgccggacgcagagcaca

SEQ ID NO: 389479 - DNA, 20 bp, human
ggggctaaaacctgcgagcg

SEQ ID NO: 389480 - DNA, 20 bp, human
gtccgggagccggaggcaag

SEQ ID NO: 389481 - DNA, 20 bp, human
gaggtcaagcatgggtgata

SEQ ID NO: 389482 - DNA, 20 bp, human
ggcacagtggaaagtaagtt

SEQ ID NO: 389483 - DNA, 20 bp, human
gacgaagccttggagacttg

SEQ ID NO: 389484 - DNA, 20 bp, human
gcggggccacctcgcgtccc

SEQ ID NO: 389485 - DNA, 20 bp, human
ggcctccggctcccggaagc

SEQ ID NO: 389486 - DNA, 20 bp, human
gccgccggcctcccagttga

SEQ ID NO: 389487 - DNA, 20 bp, human
gccaccgtcaactgggaggc

SEQ ID NO: 389488 - DNA, 20 bp, human
gccggcggccggcagcgaat

SEQ ID NO: 389489 - DNA, 20 bp, human
gaacctgcgcgccagggaga

SEQ ID NO: 389490 - DNA, 20 bp, human
gggccggcacccagccatta

SEQ ID NO: 389491 - DNA, 20 bp, human
gggaatgcggtcgccccctt

SEQ ID NO: 389492 - DNA, 20 bp, human
ggagaagggcacgcggaggg

SEQ ID NO: 389493 - DNA, 20 bp, human
gcgccagggagagggcgttg

SEQ ID NO: 389494 - DNA, 20 bp, human
gagggcggagggttgcgcct

SEQ ID NO: 389495 - DNA, 20 bp, human
ggtggatatgactatatatg

SEQ ID NO: 389496 - DNA, 20 bp, human
ggcgccgtggatcccgggac

SEQ ID NO: 389497 - DNA, 20 bp, human
ggcactgcgcatgctcgcgg

SEQ ID NO: 389498 - DNA, 20 bp, human
gtgacccggggtaacggagc

SEQ ID NO: 389499 - DNA, 20 bp, human
ggtaacggagctggctgcta

SEQ ID NO: 389500 - DNA, 20 bp, human
ggcggcgcggtggtgacccg

SEQ ID NO: 389501 - DNA, 20 bp, human
gcgcggaggggccctagaag

SEQ ID NO: 389502 - DNA, 20 bp, human
gccgggaggccactgcacta

SEQ ID NO: 389503 - DNA, 20 bp, human
gagccgcgcgcgcccgcctg

SEQ ID NO: 389504 - DNA, 20 bp, human
ggtggatcccgggactggct

SEQ ID NO: 389505 - DNA, 20 bp, human
ggctctggcttccacttcta

SEQ ID NO: 389506 - DNA, 20 bp, human
gcgaaggggaggggaccctt

SEQ ID NO: 389507 - DNA, 20 bp, human
gcagaagcacggcccggccg

SEQ ID NO: 389508 - DNA, 20 bp, human
gggaggcggtccccagtggg

SEQ ID NO: 389509 - DNA, 20 bp, human
gactggggaccgcctccctt

SEQ ID NO: 389510 - DNA, 20 bp, human
gtggcagggaagagggggat

SEQ ID NO: 389511 - DNA, 20 bp, human
gacctcggcccaaaccttgt

SEQ ID NO: 389512 - DNA, 20 bp, human
gtccccagtgggtgggcgaa

SEQ ID NO: 389513 - DNA, 20 bp, human
gggaaaaagtggccgacggt

SEQ ID NO: 389514 - DNA, 20 bp, human
gcccggcgatgcgaagggga

SEQ ID NO: 389515 - DNA, 20 bp, human
gcggaggaaaaagtggccga

SEQ ID NO: 389516 - DNA, 20 bp, human
gtgggacggggttgggacga

SEQ ID NO: 389517 - DNA, 20 bp, human
ggggaaggcagtccactgga

SEQ ID NO: 389518 - DNA, 20 bp, human
gcggctcccggccttacctt

SEQ ID NO: 389519 - DNA, 20 bp, human
gtggagggagagccgcggca

SEQ ID NO: 389520 - DNA, 20 bp, human
gcaaaggggccaaccattgt

SEQ ID NO: 389521 - DNA, 20 bp, human
gtcccagtcgccctggagta

SEQ ID NO: 389522 - DNA, 20 bp, human
gggacgagggagtgttacca

SEQ ID NO: 389523 - DNA, 20 bp, human
gagcctggcgggagaggcta

SEQ ID NO: 389524 - DNA, 20 bp, human
gagtaaactgggacggggtt

SEQ ID NO: 389525 - DNA, 20 bp, human
gaggccgggagccgtactcc

SEQ ID NO: 389526 - DNA, 20 bp, human
gacgtcaggccctcccccag

SEQ ID NO: 389527 - DNA, 20 bp, human
gcgtcagcaccgctggggga

SEQ ID NO: 389528 - DNA, 20 bp, human
gggccagcggtgccgacgtc

SEQ ID NO: 389529 - DNA, 20 bp, human
gggaaggcggggagagccgc

SEQ ID NO: 389530 - DNA, 20 bp, human
gtccaaataagtcccgaaaa

SEQ ID NO: 389531 - DNA, 20 bp, human
gcatccctgcacacgtacgt

SEQ ID NO: 389532 - DNA, 20 bp, human
gaggcggggagagccgcagg

SEQ ID NO: 389533 - DNA, 20 bp, human
gcgccgacgtcagcaccgct

SEQ ID NO: 389534 - DNA, 20 bp, human
ggctggaaagtgcccctttt

SEQ ID NO: 389535 - DNA, 20 bp, human
gggaccgcccctgcacctcg

SEQ ID NO: 389536 - DNA, 20 bp, human
gcggcagccctcgccttatt

SEQ ID NO: 389537 - DNA, 20 bp, human
gtgccgggagcacggtgagc

SEQ ID NO: 389538 - DNA, 20 bp, human
gggacctaggattttcttaa

SEQ ID NO: 389539 - DNA, 20 bp, human
gggccagctcaccgtgctcc

SEQ ID NO: 389540 - DNA, 20 bp, human
gtcccgggcaggacctaggg

SEQ ID NO: 389541 - DNA, 20 bp, human
gaatgaagagggctgtgggt

SEQ ID NO: 389542 - DNA, 20 bp, human
gcccaccctaggtcctgccc

SEQ ID NO: 389543 - DNA, 20 bp, human
gagccgccactcgcttgctc

SEQ ID NO: 389544 - DNA, 20 bp, human
ggtgggggaggggggaaacg

SEQ ID NO: 389545 - DNA, 20 bp, human
gcgccactcgcttgctcagg

SEQ ID NO: 389546 - DNA, 20 bp, human
gggtcacgccgtgacagggg

SEQ ID NO: 389547 - DNA, 20 bp, human
gagcgctgcggctaaagcga

SEQ ID NO: 389548 - DNA, 20 bp, human
gtcacggcgtgacccggggt

SEQ ID NO: 389549 - DNA, 20 bp, human
ggtgcaacgaggtacggggc

SEQ ID NO: 389550 - DNA, 20 bp, human
gcggggcgggagtggagacg

SEQ ID NO: 389551 - DNA, 20 bp, human
ggcggggcgcggagaagtgg

SEQ ID NO: 389552 - DNA, 20 bp, human
gccccggcgcttggggaagt

SEQ ID NO: 389553 - DNA, 20 bp, human
gagtctgtgcaacgaggtac

SEQ ID NO: 389554 - DNA, 20 bp, human
ggagaggcgcccgcagtcca

SEQ ID NO: 389555 - DNA, 20 bp, human
gggaggagccgacaggacta

SEQ ID NO: 389556 - DNA, 20 bp, human
gcgtggggacagaatgtctg

SEQ ID NO: 389557 - DNA, 20 bp, human
gagtggcgtccgttcttcgt

SEQ ID NO: 389558 - DNA, 20 bp, human
gacaaagtgccatgtcatcg

SEQ ID NO: 389559 - DNA, 20 bp, human
ggagaagaggaaaaaaggtc

SEQ ID NO: 389560 - DNA, 20 bp, human
gcatgtggaccccgatgaca

SEQ ID NO: 389561 - DNA, 20 bp, human
gttgtagagcgagtcatcgg

SEQ ID NO: 389562 - DNA, 20 bp, human
gggaacatgtgagtcctgta

SEQ ID NO: 389563 - DNA, 20 bp, human
ggcctcttgtgtgtcctgac

SEQ ID NO: 389564 - DNA, 20 bp, human
gaaactaggggcttggggac

SEQ ID NO: 389565 - DNA, 20 bp, human
gaggggctgttaatcttccg

SEQ ID NO: 389566 - DNA, 20 bp, human
ggggaccaggctcaggacgc

SEQ ID NO: 389567 - DNA, 20 bp, human
gcaaatgctaggcaagggtg

SEQ ID NO: 389568 - DNA, 20 bp, human
ggggaccacccatgcaaggg

SEQ ID NO: 389569 - DNA, 20 bp, human
gccagaggggagaatccggg

SEQ ID NO: 389570 - DNA, 20 bp, human
gcaagcactgagtaagccca

SEQ ID NO: 389571 - DNA, 20 bp, human
gcaggctcaggacgcaggtg

SEQ ID NO: 389572 - DNA, 20 bp, human
gcacttgtggtgattcccag

SEQ ID NO: 389573 - DNA, 20 bp, human
gaggaagaaccccagtctgt

SEQ ID NO: 389574 - DNA, 20 bp, human
gggcttactcagtgcttgac

SEQ ID NO: 389575 - DNA, 20 bp, human
gtagtaactagtgacggtac

SEQ ID NO: 389576 - DNA, 20 bp, human
gagtctgaggacattactgg

SEQ ID NO: 389577 - DNA, 20 bp, human
gcgggcctagctcctgagag

SEQ ID NO: 389578 - DNA, 20 bp, human
gctcctgagagcggcgccgt

SEQ ID NO: 389579 - DNA, 20 bp, human
gtgcagcccgggcaatactc

SEQ ID NO: 389580 - DNA, 20 bp, human
gcgggctgcagtgaaggggg

SEQ ID NO: 389581 - DNA, 20 bp, human
gctaggcccgagtattgccc

SEQ ID NO: 389582 - DNA, 20 bp, human
ggccgggattggtggaagac

SEQ ID NO: 389583 - DNA, 20 bp, human
gcagcgcgaggacacccgtg

SEQ ID NO: 389584 - DNA, 20 bp, human
ggtgctgctacgtaagccaa

SEQ ID NO: 389585 - DNA, 20 bp, human
gcgaacctggggccttgaag

SEQ ID NO: 389586 - DNA, 20 bp, human
gagtcggccttgtaaggcag

SEQ ID NO: 389587 - DNA, 20 bp, human
gcggccgacccgcgggtcgt

SEQ ID NO: 389588 - DNA, 20 bp, human
gtacaaggccgactctgctc

SEQ ID NO: 389589 - DNA, 20 bp, human
gccgagacctctgccttaca

SEQ ID NO: 389590 - DNA, 20 bp, human
gcagcggttcccacgacccg

SEQ ID NO: 389591 - DNA, 20 bp, human
ggcgcgtccccgggccgggt

SEQ ID NO: 389592 - DNA, 20 bp, human
ggccccgcccagcccggtcc

SEQ ID NO: 389593 - DNA, 20 bp, human
gtcctgcggggcggagagat

SEQ ID NO: 389594 - DNA, 20 bp, human
ggttcccacgacccgcgggt

SEQ ID NO: 389595 - DNA, 20 bp, human
gcggatacccggcggtccgc

SEQ ID NO: 389596 - DNA, 20 bp, human
gaaggcaatggctgtagctg

SEQ ID NO: 389597 - DNA, 20 bp, human
ggaaatgtgatcatctgaaa

SEQ ID NO: 389598 - DNA, 20 bp, human
gctacagccattgccttcaa

SEQ ID NO: 389599 - DNA, 20 bp, human
gcaattcggcatgcaaggta

SEQ ID NO: 389600 - DNA, 20 bp, human
gccattgccttcaaaggagg

SEQ ID NO: 389601 - DNA, 20 bp, human
ggccaagcttacccatcctc

SEQ ID NO: 389602 - DNA, 20 bp, human
ggtaagcttggctgaaatga

SEQ ID NO: 389603 - DNA, 20 bp, human
gtctgaaaaggtcagaaagt

SEQ ID NO: 389604 - DNA, 20 bp, human
gcaaaagccccctcctttga

SEQ ID NO: 389605 - DNA, 20 bp, human
gcccagaggatgggtaagct

SEQ ID NO: 389606 - DNA, 20 bp, human
gcggggtggggtcacttact

SEQ ID NO: 389607 - DNA, 20 bp, human
ggcaacatgaccaatggggg

SEQ ID NO: 389608 - DNA, 20 bp, human
gcacctggacagacctgcac

SEQ ID NO: 389609 - DNA, 20 bp, human
gttcctgtgcaggtctgtcc

SEQ ID NO: 389610 - DNA, 20 bp, human
ggcggagtttattcagagtt

SEQ ID NO: 389611 - DNA, 20 bp, human
gtccgcaagttcaacattag

SEQ ID NO: 389612 - DNA, 20 bp, human
gagttcaacattagtgggtg

SEQ ID NO: 389613 - DNA, 20 bp, human
gccaaagcaacatgaccaat

SEQ ID NO: 389614 - DNA, 20 bp, human
gcaccccacactctcaggta

SEQ ID NO: 389615 - DNA, 20 bp, human
gagggaggcattgggttggt

SEQ ID NO: 389616 - DNA, 20 bp, human
ggcggctcccggagagtctc

SEQ ID NO: 389617 - DNA, 20 bp, human
gaactccgcggtcctcgcga

SEQ ID NO: 389618 - DNA, 20 bp, human
gacccccgaggctgtctcgg

SEQ ID NO: 389619 - DNA, 20 bp, human
ggaggaccgcggagttgcgg

SEQ ID NO: 389620 - DNA, 20 bp, human
gtcccggagagtctcgggga

SEQ ID NO: 389621 - DNA, 20 bp, human
gctgcagttcggggcgtctt

SEQ ID NO: 389622 - DNA, 20 bp, human
gaccgcggagttgcggggga

SEQ ID NO: 389623 - DNA, 20 bp, human
gagggcggggcctcgtgggc

SEQ ID NO: 389624 - DNA, 20 bp, human
gcccctcccccgcaactccg

SEQ ID NO: 389625 - DNA, 20 bp, human
gcgccctccccgagactctc

SEQ ID NO: 389626 - DNA, 20 bp, human
gggccgagataggagagcca

SEQ ID NO: 389627 - DNA, 20 bp, human
gtgagagggcggtgcagcat

SEQ ID NO: 389628 - DNA, 20 bp, human
gtgggtgcgcaagaggatca

SEQ ID NO: 389629 - DNA, 20 bp, human
ggccctacaaggcctgaagt

SEQ ID NO: 389630 - DNA, 20 bp, human
gcgtgcggacagcggttacg

SEQ ID NO: 389631 - DNA, 20 bp, human
ggagaaaaacggaagctgag

SEQ ID NO: 389632 - DNA, 20 bp, human
gcggtgcagcattgggctcc

SEQ ID NO: 389633 - DNA, 20 bp, human
gcacccacttcaggccttgt

SEQ ID NO: 389634 - DNA, 20 bp, human
ggagctggaagccggaaaat

SEQ ID NO: 389635 - DNA, 20 bp, human
gggggtgacgagtacgtatg

SEQ ID NO: 389636 - DNA, 20 bp, human
gggcgggcctgagtgataac

SEQ ID NO: 389637 - DNA, 20 bp, human
gtataggaataagtcatcac

SEQ ID NO: 389638 - DNA, 20 bp, human
ggagacaagacgctgcttca

SEQ ID NO: 389639 - DNA, 20 bp, human
gaggaataagtcatcactgg

SEQ ID NO: 389640 - DNA, 20 bp, human
gaggctccgccccgacggtc

SEQ ID NO: 389641 - DNA, 20 bp, human
ggctgcttcacggaagagag

SEQ ID NO: 389642 - DNA, 20 bp, human
ggtctctttaagaggtcagc

SEQ ID NO: 389643 - DNA, 20 bp, human
gggaaggcgcgtagggcgag

SEQ ID NO: 389644 - DNA, 20 bp, human
gcggtcgccgctgtcgggaa

SEQ ID NO: 389645 - DNA, 20 bp, human
gctaacctccagcagcctat

SEQ ID NO: 389646 - DNA, 20 bp, human
gtggaggcatacagaagcca

SEQ ID NO: 389647 - DNA, 20 bp, human
gccgtcagaggcagagaatt

SEQ ID NO: 389648 - DNA, 20 bp, human
ggggccccccatctagggag

SEQ ID NO: 389649 - DNA, 20 bp, human
ggtggaactcaacccgtcag

SEQ ID NO: 389650 - DNA, 20 bp, human
gtcaaggggccccccatcta

SEQ ID NO: 389651 - DNA, 20 bp, human
gaggcatacagaagccatgg

SEQ ID NO: 389652 - DNA, 20 bp, human
gtatccccctccctagatgg

SEQ ID NO: 389653 - DNA, 20 bp, human
ggatgtgtattagagggagt

SEQ ID NO: 389654 - DNA, 20 bp, human
gaggactgaggatgtttaca

SEQ ID NO: 389655 - DNA, 20 bp, human
gtcagctggatgtgtattag

SEQ ID NO: 389656 - DNA, 20 bp, human
gctgtcacgaggaacgacgc

SEQ ID NO: 389657 - DNA, 20 bp, human
ggtgcagccaagatgctgat

SEQ ID NO: 389658 - DNA, 20 bp, human
gtcacgaggaacgacgcagg

SEQ ID NO: 389659 - DNA, 20 bp, human
gacaggattatgctgaggga

SEQ ID NO: 389660 - DNA, 20 bp, human
gtggacatagcccacatcga

SEQ ID NO: 389661 - DNA, 20 bp, human
gagggagcaggcgctgaacc

SEQ ID NO: 389662 - DNA, 20 bp, human
gcaggtgtctgagggaacgt

SEQ ID NO: 389663 - DNA, 20 bp, human
gtcactgtgctcgtatggac

SEQ ID NO: 389664 - DNA, 20 bp, human
gagggtagagaacttggttt

SEQ ID NO: 389665 - DNA, 20 bp, human
gtgctcgtatggactggatt

SEQ ID NO: 389666 - DNA, 20 bp, human
gggaggagagccaatcccga

SEQ ID NO: 389667 - DNA, 20 bp, human
ggggcgggagcgattgtgaa

SEQ ID NO: 389668 - DNA, 20 bp, human
gacaccctggcaaccggctt

SEQ ID NO: 389669 - DNA, 20 bp, human
ggtcgcttccggcccggcga

SEQ ID NO: 389670 - DNA, 20 bp, human
gaaggcggagccaatcgcgg

SEQ ID NO: 389671 - DNA, 20 bp, human
gagccaatcccgagggtcgg

SEQ ID NO: 389672 - DNA, 20 bp, human
ggtccgccgaccctcgggat

SEQ ID NO: 389673 - DNA, 20 bp, human
gtcagggtcggggtcggtaa

SEQ ID NO: 389674 - DNA, 20 bp, human
gggaagcgaccgtcacgcgc

SEQ ID NO: 389675 - DNA, 20 bp, human
ggagagccaatcccgagggt

SEQ ID NO: 389676 - DNA, 20 bp, human
gccaacctgggtcccgtcaa

SEQ ID NO: 389677 - DNA, 20 bp, human
ggaagaatgggcgggaccat

SEQ ID NO: 389678 - DNA, 20 bp, human
ggtcccgtcaacggacgcga

SEQ ID NO: 389679 - DNA, 20 bp, human
gaacggacgcgaaggagaac

SEQ ID NO: 389680 - DNA, 20 bp, human
gaggggctgtatatcacttc

SEQ ID NO: 389681 - DNA, 20 bp, human
ggttggggaggcggaagaat

SEQ ID NO: 389682 - DNA, 20 bp, human
gcggaagcacccctcctacc

SEQ ID NO: 389683 - DNA, 20 bp, human
gaggaaatggaagaatctat

SEQ ID NO: 389684 - DNA, 20 bp, human
gagccggcctatccggaaac

SEQ ID NO: 389685 - DNA, 20 bp, human
gcggggtggccatctgtttc

SEQ ID NO: 389686 - DNA, 20 bp, human
gaggcaccggggtgtgtccg

SEQ ID NO: 389687 - DNA, 20 bp, human
gggaggcccacctatggcag

SEQ ID NO: 389688 - DNA, 20 bp, human
ggaggcgagtgttgtccaat

SEQ ID NO: 389689 - DNA, 20 bp, human
gagtgagcggcgcgaggcac

SEQ ID NO: 389690 - DNA, 20 bp, human
gctcctcccctgccataggt

SEQ ID NO: 389691 - DNA, 20 bp, human
ggagtgttgtccaatcggta

SEQ ID NO: 389692 - DNA, 20 bp, human
ggcctcccaagggacttcat

SEQ ID NO: 389693 - DNA, 20 bp, human
gcccgggccaccgaccattg

SEQ ID NO: 389694 - DNA, 20 bp, human
gcgtgcgggaggcccaccta

SEQ ID NO: 389695 - DNA, 20 bp, human
gggaggccagctccggtgat

SEQ ID NO: 389696 - DNA, 20 bp, human
gttggaaaaataaaacgagt

SEQ ID NO: 389697 - DNA, 20 bp, human
gggtgaggagaaaggggtta

SEQ ID NO: 389698 - DNA, 20 bp, human
gtggatggattggatgtaag

SEQ ID NO: 389699 - DNA, 20 bp, human
gccttctcatctccacccag

SEQ ID NO: 389700 - DNA, 20 bp, human
gagatgacaggacttatgga

SEQ ID NO: 389701 - DNA, 20 bp, human
ggatttctgcctgagccact

SEQ ID NO: 389702 - DNA, 20 bp, human
gtaatgcacatgattgcagc

SEQ ID NO: 389703 - DNA, 20 bp, human
ggtgaactataccatgttca

SEQ ID NO: 389704 - DNA, 20 bp, human
gactgattctgaagttgcta

SEQ ID NO: 389705 - DNA, 20 bp, human
ggctggaaaaagtggggtta

SEQ ID NO: 389706 - DNA, 20 bp, human
gcgccccctcctgatctgga

SEQ ID NO: 389707 - DNA, 20 bp, human
gcccaagagggacacgggtg

SEQ ID NO: 389708 - DNA, 20 bp, human
gtcctcacccgtgtccctct

SEQ ID NO: 389709 - DNA, 20 bp, human
gcaaccaagtgagtcgagga

SEQ ID NO: 389710 - DNA, 20 bp, human
gcccccaaccaagtgagtcg

SEQ ID NO: 389711 - DNA, 20 bp, human
gcaagtgagtcgaggagggc

SEQ ID NO: 389712 - DNA, 20 bp, human
gtgagacccctttgtcagat

SEQ ID NO: 389713 - DNA, 20 bp, human
gctgatctggaaggataaat

SEQ ID NO: 389714 - DNA, 20 bp, human
gcttcccgtctcttggagcg

SEQ ID NO: 389715 - DNA, 20 bp, human
gactccgaatccacgggggt

SEQ ID NO: 389716 - DNA, 20 bp, human
gcagcgagtgggcatcgttg

SEQ ID NO: 389717 - DNA, 20 bp, human
gacgggtgacacccctctta

SEQ ID NO: 389718 - DNA, 20 bp, human
gcaggtggcctggctgtccc

SEQ ID NO: 389719 - DNA, 20 bp, human
gaacaggtttcaggagcgat

SEQ ID NO: 389720 - DNA, 20 bp, human
gaggtggtgggttctagtgc

SEQ ID NO: 389721 - DNA, 20 bp, human
gcaggcctggggctgcttcc

SEQ ID NO: 389722 - DNA, 20 bp, human
ggccaggccctgcagcgagt

SEQ ID NO: 389723 - DNA, 20 bp, human
gctggcgagccgcgcctacg

SEQ ID NO: 389724 - DNA, 20 bp, human
gccaagagggacacggggtg

SEQ ID NO: 389725 - DNA, 20 bp, human
gcagcagcagattcagcatc

SEQ ID NO: 389726 - DNA, 20 bp, human
gcaaccaagtgagtcgagga

SEQ ID NO: 389727 - DNA, 20 bp, human
gcccccaaccaagtgagtcg

SEQ ID NO: 389728 - DNA, 20 bp, human
gcaagtgagtcgaggagggc

SEQ ID NO: 389729 - DNA, 20 bp, human
ggccaggcaggccccgccga

SEQ ID NO: 389730 - DNA, 20 bp, human
gggggaggggagagcccgct

SEQ ID NO: 389731 - DNA, 20 bp, human
gaaggaacagggagtggcca

SEQ ID NO: 389732 - DNA, 20 bp, human
ggtcagggtctctgagagta

SEQ ID NO: 389733 - DNA, 20 bp, human
gcctgttccttctacccagc

SEQ ID NO: 389734 - DNA, 20 bp, human
gccaagagggacacggggtg

SEQ ID NO: 389735 - DNA, 20 bp, human
gactccgaatccacgggggt

SEQ ID NO: 389736 - DNA, 20 bp, human
ggggctgtggcgtccacaca

SEQ ID NO: 389737 - DNA, 20 bp, human
gaagtggccggctccgtcaa

SEQ ID NO: 389738 - DNA, 20 bp, human
gtccacacagggataaatgg

SEQ ID NO: 389739 - DNA, 20 bp, human
gggctccgtcaagggaaagc

SEQ ID NO: 389740 - DNA, 20 bp, human
gctgcctgacagcaggtgtg

SEQ ID NO: 389741 - DNA, 20 bp, human
gagccggccacttggtgcca

SEQ ID NO: 389742 - DNA, 20 bp, human
gagggggtggcgtgccccga

SEQ ID NO: 389743 - DNA, 20 bp, human
gcttccccgctttcccttga

SEQ ID NO: 389744 - DNA, 20 bp, human
gccctccaaaaattactccc

SEQ ID NO: 389745 - DNA, 20 bp, human
gtcaccttgtctctgctccg

SEQ ID NO: 389746 - DNA, 20 bp, human
gctgcccaccgaaggaggcg

SEQ ID NO: 389747 - DNA, 20 bp, human
gcaccgaaggaggcgcggct

SEQ ID NO: 389748 - DNA, 20 bp, human
gcgcacgggaagggctgtgg

SEQ ID NO: 389749 - DNA, 20 bp, human
gtcgggagcgcgcacgggaa

SEQ ID NO: 389750 - DNA, 20 bp, human
ggctgccgggaagccccctc

SEQ ID NO: 389751 - DNA, 20 bp, human
ggccacgcgcgctgttgcta

SEQ ID NO: 389752 - DNA, 20 bp, human
gccccctcgggagcgcgcac

SEQ ID NO: 389753 - DNA, 20 bp, human
gtgtgatcccgccacctccc

SEQ ID NO: 389754 - DNA, 20 bp, human
gatcacacatctgctacgat

SEQ ID NO: 389755 - DNA, 20 bp, human
gtgctctgattcgtgagttc

SEQ ID NO: 389756 - DNA, 20 bp, human
gcggtcccgaggcgcagtgg

SEQ ID NO: 389757 - DNA, 20 bp, human
gtaagccagcgagcagacag

SEQ ID NO: 389758 - DNA, 20 bp, human
gtggtcgggaagtttcccgg

SEQ ID NO: 389759 - DNA, 20 bp, human
ggcgacgtgacgtacggggg

SEQ ID NO: 389760 - DNA, 20 bp, human
gggttcccggggcgagcctc

SEQ ID NO: 389761 - DNA, 20 bp, human
gccagcctctgctcacctcg

SEQ ID NO: 389762 - DNA, 20 bp, human
ggaggcgcagtggaggggat

SEQ ID NO: 389763 - DNA, 20 bp, human
ggaagcccctgtctgctcgc

SEQ ID NO: 389764 - DNA, 20 bp, human
ggccgcggcgacgtgacgta

SEQ ID NO: 389765 - DNA, 20 bp, human
gtgctcacctcgcggtcccg

SEQ ID NO: 389766 - DNA, 20 bp, human
gaggccatgcagtctccctg

SEQ ID NO: 389767 - DNA, 20 bp, human
gcctcctctctggggaatca

SEQ ID NO: 389768 - DNA, 20 bp, human
ggtgcccgctgccagtccac

SEQ ID NO: 389769 - DNA, 20 bp, human
gaagccctgattccccagag

SEQ ID NO: 389770 - DNA, 20 bp, human
gccagagaccagggcaagtc

SEQ ID NO: 389771 - DNA, 20 bp, human
ggagaggcaggcccatcgca

SEQ ID NO: 389772 - DNA, 20 bp, human
gcacaggtgagcaacaagac

SEQ ID NO: 389773 - DNA, 20 bp, human
gggaaggagctagaattctg

SEQ ID NO: 389774 - DNA, 20 bp, human
gaggctgactgatccttcaa

SEQ ID NO: 389775 - DNA, 20 bp, human
gcaagactggatccagaaga

SEQ ID NO: 389776 - DNA, 20 bp, human
gtcggggaggtgagcatccg

SEQ ID NO: 389777 - DNA, 20 bp, human
ggtgagcatccggggacttg

SEQ ID NO: 389778 - DNA, 20 bp, human
ggacttgaggcggagacaca

SEQ ID NO: 389779 - DNA, 20 bp, human
gcaggcggccccgtggggta

SEQ ID NO: 389780 - DNA, 20 bp, human
gcacgccagcgggtaggggt

SEQ ID NO: 389781 - DNA, 20 bp, human
gggtgcgcgcgcagcgtggg

SEQ ID NO: 389782 - DNA, 20 bp, human
gcctccggaagcgacgcagg

SEQ ID NO: 389783 - DNA, 20 bp, human
gccacagcgggggcgagtcg

SEQ ID NO: 389784 - DNA, 20 bp, human
ggggaggaggccaactctcg

SEQ ID NO: 389785 - DNA, 20 bp, human
gtgtctccgcctcaagtccc

SEQ ID NO: 389786 - DNA, 20 bp, human
gggagtcgccgagcaagaac

SEQ ID NO: 389787 - DNA, 20 bp, human
gtgcctgcgcacaccctcgc

SEQ ID NO: 389788 - DNA, 20 bp, human
gtgcggcggcgggcggaacg

SEQ ID NO: 389789 - DNA, 20 bp, human
gcgcactaccagttcttgct

SEQ ID NO: 389790 - DNA, 20 bp, human
gaaggcagctgtgcgtgctc

SEQ ID NO: 389791 - DNA, 20 bp, human
gggagggggttggcccgcga

SEQ ID NO: 389792 - DNA, 20 bp, human
gacgcacaagagaccgcacg

SEQ ID NO: 389793 - DNA, 20 bp, human
ggtaattcgggggtgaccca

SEQ ID NO: 389794 - DNA, 20 bp, human
gcccaaaatctcttttgaaa

SEQ ID NO: 389795 - DNA, 20 bp, human
gcaagagaccgcacgcggcg

SEQ ID NO: 389796 - DNA, 20 bp, human
gctaagggttatgcatctaa

SEQ ID NO: 389797 - DNA, 20 bp, human
ggacaaccccccaaaatagt

SEQ ID NO: 389798 - DNA, 20 bp, human
gtggcatttgcccactattt

SEQ ID NO: 389799 - DNA, 20 bp, human
gtaaattggcaacccccttt

SEQ ID NO: 389800 - DNA, 20 bp, human
gtacaaatgctacctcaata

SEQ ID NO: 389801 - DNA, 20 bp, human
gattatgtaattccaaaagg

SEQ ID NO: 389802 - DNA, 20 bp, human
gtgattttttggccttctaa

SEQ ID NO: 389803 - DNA, 20 bp, human
gtgttggtggcactgtaaat

SEQ ID NO: 389804 - DNA, 20 bp, human
gtgcaagaggtttttttggg

SEQ ID NO: 389805 - DNA, 20 bp, human
ggggtatgttctccaggaac

SEQ ID NO: 389806 - DNA, 20 bp, human
gaaggaggcaaccaacaaga

SEQ ID NO: 389807 - DNA, 20 bp, human
gggagtaccaccctatattg

SEQ ID NO: 389808 - DNA, 20 bp, human
gagatggcaaccaacatctt

SEQ ID NO: 389809 - DNA, 20 bp, human
gacaaaggctgtcacgcatt

SEQ ID NO: 389810 - DNA, 20 bp, human
gatgttggttgccatcttgt

SEQ ID NO: 389811 - DNA, 20 bp, human
gctgtcacgcattgggactg

SEQ ID NO: 389812 - DNA, 20 bp, human
gagggtcaaaaacatttcta

SEQ ID NO: 389813 - DNA, 20 bp, human
ggcttttttctcttctcctg

SEQ ID NO: 389814 - DNA, 20 bp, human
gcagaactctgccacaatat

SEQ ID NO: 389815 - DNA, 20 bp, human
ggactgaggtcataataaag

SEQ ID NO: 389816 - DNA, 20 bp, human
gtccgggccgcgttgttcgc

SEQ ID NO: 389817 - DNA, 20 bp, human
gaacgcggcccggagttcct

SEQ ID NO: 389818 - DNA, 20 bp, human
gtacacttcccaggaactcc

SEQ ID NO: 389819 - DNA, 20 bp, human
ggcggtctgtagggccaatc

SEQ ID NO: 389820 - DNA, 20 bp, human
gggtacctccttctgacttc

SEQ ID NO: 389821 - DNA, 20 bp, human
ggaggtaccagcgaacaacg

SEQ ID NO: 389822 - DNA, 20 bp, human
gtgttccagtggactcacgc

SEQ ID NO: 389823 - DNA, 20 bp, human
gggtattgctgcggtctgta

SEQ ID NO: 389824 - DNA, 20 bp, human
ggcgccgggaaagcaattcc

SEQ ID NO: 389825 - DNA, 20 bp, human
gaatgagtcccgcggcgggt

SEQ ID NO: 389826 - DNA, 20 bp, human
gcggcctgcgctctcaacct

SEQ ID NO: 389827 - DNA, 20 bp, human
gccgaggtgagtctgaagtt

SEQ ID NO: 389828 - DNA, 20 bp, human
gctcccgcgaggctttgtgt

SEQ ID NO: 389829 - DNA, 20 bp, human
gtcggctgggcctggagcga

SEQ ID NO: 389830 - DNA, 20 bp, human
ggcgcccaggttgagagcgc

SEQ ID NO: 389831 - DNA, 20 bp, human
gccgcgattccaaggcgccc

SEQ ID NO: 389832 - DNA, 20 bp, human
gagcgagggtggaggttggc

SEQ ID NO: 389833 - DNA, 20 bp, human
gaaggggctaaggtcatata

SEQ ID NO: 389834 - DNA, 20 bp, human
ggcgaggctttgtgtcggct

SEQ ID NO: 389835 - DNA, 20 bp, human
gtcagagcacgacgtaaagg

SEQ ID NO: 389836 - DNA, 20 bp, human
gaggcaaaccagaataccat

SEQ ID NO: 389837 - DNA, 20 bp, human
gactgactcccatggtattc

SEQ ID NO: 389838 - DNA, 20 bp, human
gtcagtaaaatgagatacgg

SEQ ID NO: 389839 - DNA, 20 bp, human
ggaggcaatttctcatgaaa

SEQ ID NO: 389840 - DNA, 20 bp, human
gcactttaatacaaattgaa

SEQ ID NO: 389841 - DNA, 20 bp, human
gccttcttgattatgtatgt

SEQ ID NO: 389842 - DNA, 20 bp, human
gattatgtatgtagggaata

SEQ ID NO: 389843 - DNA, 20 bp, human
gcctctgtgaatactgcctt

SEQ ID NO: 389844 - DNA, 20 bp, human
gtcctactgctaaatgagac

SEQ ID NO: 389845 - DNA, 20 bp, human
ggtgtatccctgtgactaaa

SEQ ID NO: 389846 - DNA, 20 bp, human
gaaagcgcgcgtttctggga

SEQ ID NO: 389847 - DNA, 20 bp, human
gctcatagaggctcgtgaat

SEQ ID NO: 389848 - DNA, 20 bp, human
ggaggctcgtgaatgggggt

SEQ ID NO: 389849 - DNA, 20 bp, human
ggcacgggctctaactctac

SEQ ID NO: 389850 - DNA, 20 bp, human
gggaaagctagcgtgtcgtt

SEQ ID NO: 389851 - DNA, 20 bp, human
gggtcacgtcacttcctgtg

SEQ ID NO: 389852 - DNA, 20 bp, human
gggaacctgccgagtgtgca

SEQ ID NO: 389853 - DNA, 20 bp, human
gtagctttcccgcctcatag

SEQ ID NO: 389854 - DNA, 20 bp, human
gtcacgagcctctatgaggc

SEQ ID NO: 389855 - DNA, 20 bp, human
gcaagaaagcgcgcgtttct

SEQ ID NO: 389856 - DNA, 20 bp, human
ggccccgcgcgctaccccct

SEQ ID NO: 389857 - DNA, 20 bp, human
gtggccccggcccgcaactt

SEQ ID NO: 389858 - DNA, 20 bp, human
gccgatgttccttaggaccc

SEQ ID NO: 389859 - DNA, 20 bp, human
gcatcggcgcgcactcagga

SEQ ID NO: 389860 - DNA, 20 bp, human
gggccaagcaggaggcgcgt

SEQ ID NO: 389861 - DNA, 20 bp, human
gcggcgcgcactcaggaggg

SEQ ID NO: 389862 - DNA, 20 bp, human
ggctcccaagctgtgaaatg

SEQ ID NO: 389863 - DNA, 20 bp, human
ggacccccggaggacggact

SEQ ID NO: 389864 - DNA, 20 bp, human
ggaaagggacagccgatagt

SEQ ID NO: 389865 - DNA, 20 bp, human
ggaggcgcgcccacgttctc

SEQ ID NO: 389866 - DNA, 20 bp, human
gccaccccatggcacgactg

SEQ ID NO: 389867 - DNA, 20 bp, human
gcgtcggcccagccaacagg

SEQ ID NO: 389868 - DNA, 20 bp, human
gtacgcctgtggccatggac

SEQ ID NO: 389869 - DNA, 20 bp, human
gggaagggctgtggcgacgt

SEQ ID NO: 389870 - DNA, 20 bp, human
gcgcctctgaggccggccta

SEQ ID NO: 389871 - DNA, 20 bp, human
gccatggcacgactggggtc

SEQ ID NO: 389872 - DNA, 20 bp, human
ggtgcacaggtctcctgtca

SEQ ID NO: 389873 - DNA, 20 bp, human
gagcccttcccccatgggtg

SEQ ID NO: 389874 - DNA, 20 bp, human
gccggcctagggtacgcctg

SEQ ID NO: 389875 - DNA, 20 bp, human
gccggcctcagaggcgggtc

SEQ ID NO: 389876 - DNA, 20 bp, human
gggtcagccccgcgcctagg

SEQ ID NO: 389877 - DNA, 20 bp, human
gggggtgagcccggcagcag

SEQ ID NO: 389878 - DNA, 20 bp, human
gcggcggccccggcagggtt

SEQ ID NO: 389879 - DNA, 20 bp, human
gggtttgggcgggagaaacg

SEQ ID NO: 389880 - DNA, 20 bp, human
gggcgggagaaacgcggttc

SEQ ID NO: 389881 - DNA, 20 bp, human
gcgggactccgctgccgcct

SEQ ID NO: 389882 - DNA, 20 bp, human
gtccgctgccgcctaggcgc

SEQ ID NO: 389883 - DNA, 20 bp, human
gtgcggtcacacgaggtggg

SEQ ID NO: 389884 - DNA, 20 bp, human
gggggctgacctgcgggggt

SEQ ID NO: 389885 - DNA, 20 bp, human
gccccgcgcctaggcggcag

SEQ ID NO: 389886 - DNA, 20 bp, human
gcgtgtgagggagcgaacga

SEQ ID NO: 389887 - DNA, 20 bp, human
ggggccgcagcttccccgtg

SEQ ID NO: 389888 - DNA, 20 bp, human
gtccccgtgcggccgccaga

SEQ ID NO: 389889 - DNA, 20 bp, human
ggcccggtcgcgcctggcga

SEQ ID NO: 389890 - DNA, 20 bp, human
gggaagagggagaccctcta

SEQ ID NO: 389891 - DNA, 20 bp, human
gaggcggggtctgatgggca

SEQ ID NO: 389892 - DNA, 20 bp, human
ggagcagcatggcggagccc

SEQ ID NO: 389893 - DNA, 20 bp, human
gcctgccgcccggcccgtcc

SEQ ID NO: 389894 - DNA, 20 bp, human
ggctccctcacacgcgcgga

SEQ ID NO: 389895 - DNA, 20 bp, human
ggcctccctccgcgcgtgtg

SEQ ID NO: 389896 - DNA, 20 bp, human
ggactggcagcagaggacag

SEQ ID NO: 389897 - DNA, 20 bp, human
ggacggggcggctcgggcta

SEQ ID NO: 389898 - DNA, 20 bp, human
gcaggaagacccgactttgg

SEQ ID NO: 389899 - DNA, 20 bp, human
gcctgctcggcggaccagat

SEQ ID NO: 389900 - DNA, 20 bp, human
ggcgcccaaggttagacggc

SEQ ID NO: 389901 - DNA, 20 bp, human
gtggtgtcttacctgctcgg

SEQ ID NO: 389902 - DNA, 20 bp, human
gggtgtgcgcggaggcgctg

SEQ ID NO: 389903 - DNA, 20 bp, human
gcggcaggaagacccgactt

SEQ ID NO: 389904 - DNA, 20 bp, human
gcggacgggaagcagccacc

SEQ ID NO: 389905 - DNA, 20 bp, human
gccagacttcggtaaatcaa

SEQ ID NO: 389906 - DNA, 20 bp, human
gtgtggcgataaaaatcccc

SEQ ID NO: 389907 - DNA, 20 bp, human
gtccctgggcacatcggagg

SEQ ID NO: 389908 - DNA, 20 bp, human
gagctgagtcacagcaggga

SEQ ID NO: 389909 - DNA, 20 bp, human
ggagcaggaattaccctttg

SEQ ID NO: 389910 - DNA, 20 bp, human
gaggctgctcagaggtgcca

SEQ ID NO: 389911 - DNA, 20 bp, human
gtggcttcccccacttccct

SEQ ID NO: 389912 - DNA, 20 bp, human
gccctcctccgatgtgccca

SEQ ID NO: 389913 - DNA, 20 bp, human
gtcccctggttgagaatcgc

SEQ ID NO: 389914 - DNA, 20 bp, human
gacttccctgggcacatcgg

SEQ ID NO: 389915 - DNA, 20 bp, human
gcagcctgcgattctcaacc

SEQ ID NO: 389916 - DNA, 20 bp, human
ggggcgagcgatccctgtga

SEQ ID NO: 389917 - DNA, 20 bp, human
gcggccaggcccggagcttc

SEQ ID NO: 389918 - DNA, 20 bp, human
gagctggagcggggagttcg

SEQ ID NO: 389919 - DNA, 20 bp, human
gcctggccgccggtaggcgg

SEQ ID NO: 389920 - DNA, 20 bp, human
ggtgaaggacgcagccgcac

SEQ ID NO: 389921 - DNA, 20 bp, human
gccaggcccggagcttccgg

SEQ ID NO: 389922 - DNA, 20 bp, human
ggggcctggccgccggtagg

SEQ ID NO: 389923 - DNA, 20 bp, human
gacactccaccggaagctcc

SEQ ID NO: 389924 - DNA, 20 bp, human
ggaaactgagtctgagggcc

SEQ ID NO: 389925 - DNA, 20 bp, human
ggggagttcggggcgaggaa

SEQ ID NO: 389926 - DNA, 20 bp, human
gcgggctcgctggttggctc

SEQ ID NO: 389927 - DNA, 20 bp, human
gctcctgcgggctcgctggt

SEQ ID NO: 389928 - DNA, 20 bp, human
ggcagcgtgcgccgattggt

SEQ ID NO: 389929 - DNA, 20 bp, human
ggctccggcgtcagtccgtc

SEQ ID NO: 389930 - DNA, 20 bp, human
ggctcggagcggggcgtatc

SEQ ID NO: 389931 - DNA, 20 bp, human
gaaaaagcagagggcgactt

SEQ ID NO: 389932 - DNA, 20 bp, human
gggtcggcgctgagacggcg

SEQ ID NO: 389933 - DNA, 20 bp, human
gcgtctcagcgccgaccaat

SEQ ID NO: 389934 - DNA, 20 bp, human
ggcggctcctgcgggctcgc

SEQ ID NO: 389935 - DNA, 20 bp, human
gtgcgcctgacggacggaca

SEQ ID NO: 389936 - DNA, 20 bp, human
gcccccctggggagctgatg

SEQ ID NO: 389937 - DNA, 20 bp, human
gccctgggggagcccccctg

SEQ ID NO: 389938 - DNA, 20 bp, human
gtgccccgtgcactggcctg

SEQ ID NO: 389939 - DNA, 20 bp, human
gcccctcaggccagtgcacg

SEQ ID NO: 389940 - DNA, 20 bp, human
gcagggcaatccctgataaa

SEQ ID NO: 389941 - DNA, 20 bp, human
ggcctctgtgccccgtgcac

SEQ ID NO: 389942 - DNA, 20 bp, human
gggactctggcccggagctg

SEQ ID NO: 389943 - DNA, 20 bp, human
ggcctgagggggtgaggcca

SEQ ID NO: 389944 - DNA, 20 bp, human
ggacaggagtgtttccagga

SEQ ID NO: 389945 - DNA, 20 bp, human
gttgaagcaaacctccctcc

SEQ ID NO: 389946 - DNA, 20 bp, human
ggggctgcgtgagggagcga

SEQ ID NO: 389947 - DNA, 20 bp, human
gcgcccgcgacccgttgcta

SEQ ID NO: 389948 - DNA, 20 bp, human
gcgagaggaagtgcctgcgc

SEQ ID NO: 389949 - DNA, 20 bp, human
gcgcccggccttagcaacgg

SEQ ID NO: 389950 - DNA, 20 bp, human
gtggggccggcggcgctcgc

SEQ ID NO: 389951 - DNA, 20 bp, human
ggcgctagggcccttagcaa

SEQ ID NO: 389952 - DNA, 20 bp, human
ggggcggccgccgggcgcta

SEQ ID NO: 389953 - DNA, 20 bp, human
gcaaccccggctcgcgcacg

SEQ ID NO: 389954 - DNA, 20 bp, human
gccgcccgcgcgcgtgggag

SEQ ID NO: 389955 - DNA, 20 bp, human
ggcgccgccgttgctaaggc

SEQ ID NO: 389956 - DNA, 20 bp, human
gcgcccgcgcaggcaggagt

SEQ ID NO: 389957 - DNA, 20 bp, human
ggcagggcgttcggtcacta

SEQ ID NO: 389958 - DNA, 20 bp, human
gctcccgcaaatccctcccg

SEQ ID NO: 389959 - DNA, 20 bp, human
gccgtcgctcggcagaggag

SEQ ID NO: 389960 - DNA, 20 bp, human
gctgcgcgggcgctggaagg

SEQ ID NO: 389961 - DNA, 20 bp, human
gttccgcgggagggatttgc

SEQ ID NO: 389962 - DNA, 20 bp, human
gagtgcggctgtgccagagc

SEQ ID NO: 389963 - DNA, 20 bp, human
gcgaggccgtcgctcggcag

SEQ ID NO: 389964 - DNA, 20 bp, human
ggccgcgcaggcgctgtggt

SEQ ID NO: 389965 - DNA, 20 bp, human
ggtgaccgaacgccctgcgg

SEQ ID NO: 389966 - DNA, 20 bp, human
gctccaaaggaggggattgt

SEQ ID NO: 389967 - DNA, 20 bp, human
gctcccggagacaccctccc

SEQ ID NO: 389968 - DNA, 20 bp, human
gggattgtgggcagataatg

SEQ ID NO: 389969 - DNA, 20 bp, human
ggggcactgcgactacactg

SEQ ID NO: 389970 - DNA, 20 bp, human
ggagacaccctcccaggcga

SEQ ID NO: 389971 - DNA, 20 bp, human
gaaagggccagtgaccaatt

SEQ ID NO: 389972 - DNA, 20 bp, human
ggcagtgccctcgcctggga

SEQ ID NO: 389973 - DNA, 20 bp, human
gggcagtgaatcaacggctg

SEQ ID NO: 389974 - DNA, 20 bp, human
gtcctgggcagcttcttagc

SEQ ID NO: 389975 - DNA, 20 bp, human
gatgccgcctaattggtcac

SEQ ID NO: 389976 - DNA, 20 bp, human
gggccggggtgcctactgat

SEQ ID NO: 389977 - DNA, 20 bp, human
gcaatccagtagcaagagaa

SEQ ID NO: 389978 - DNA, 20 bp, human
gtggaggcctcagagttcag

SEQ ID NO: 389979 - DNA, 20 bp, human
gaggagctcctcccatcagt

SEQ ID NO: 389980 - DNA, 20 bp, human
ggcaagagaaagggtggccg

SEQ ID NO: 389981 - DNA, 20 bp, human
gcggggtgcctactgatggg

SEQ ID NO: 389982 - DNA, 20 bp, human
gggtcagattcagacctttg

SEQ ID NO: 389983 - DNA, 20 bp, human
gtctctggtatcatctaagt

SEQ ID NO: 389984 - DNA, 20 bp, human
gataccagagagcaagagag

SEQ ID NO: 389985 - DNA, 20 bp, human
gttagaaaaggatagtcctc

SEQ ID NO: 389986 - DNA, 20 bp, human
gcggaggtgaagccagcgga

SEQ ID NO: 389987 - DNA, 20 bp, human
gcatctctctgctctagtag

SEQ ID NO: 389988 - DNA, 20 bp, human
gctctagtagaggttgctta

SEQ ID NO: 389989 - DNA, 20 bp, human
ggatccttgggattctaata

SEQ ID NO: 389990 - DNA, 20 bp, human
gacgcagatcttcaaaccca

SEQ ID NO: 389991 - DNA, 20 bp, human
ggcggagggagctgatcctt

SEQ ID NO: 389992 - DNA, 20 bp, human
gagagcctatggtatccaaa

SEQ ID NO: 389993 - DNA, 20 bp, human
gaaggcccagagacatccgg

SEQ ID NO: 389994 - DNA, 20 bp, human
ggagcagagagatgagctgt

SEQ ID NO: 389995 - DNA, 20 bp, human
gttcacctccggatgtctct

SEQ ID NO: 389996 - DNA, 20 bp, human
ggggctgggcccgacctcgg

SEQ ID NO: 389997 - DNA, 20 bp, human
gaagctggggccacggttcc

SEQ ID NO: 389998 - DNA, 20 bp, human
ggggcccgacctcggtggca

SEQ ID NO: 389999 - DNA, 20 bp, human
ggggaagtgcgggtcggaaa

SEQ ID NO: 390000 - DNA, 20 bp, human
gccccgagtgcatggttttt

SEQ ID NO: 390001 - DNA, 20 bp, human
ggccccggggaagtgcgggt

SEQ ID NO: 390002 - DNA, 20 bp, human
gcgcccacccacgggatcat

SEQ ID NO: 390003 - DNA, 20 bp, human
ggggctgctcacggccccgg

SEQ ID NO: 390004 - DNA, 20 bp, human
gcgtgggtgggcgagactgg

SEQ ID NO: 390005 - DNA, 20 bp, human
ggtccgccctctcttccgga

SEQ ID NO: 390006 - DNA, 20 bp, human
gcggacgcgcaggaaggggt

SEQ ID NO: 390007 - DNA, 20 bp, human
gagagcggacgcgcaggaag

SEQ ID NO: 390008 - DNA, 20 bp, human
gcgcgcaggaaggggtcggg

SEQ ID NO: 390009 - DNA, 20 bp, human
gtgagcaaatgggtcaacac

SEQ ID NO: 390010 - DNA, 20 bp, human
ggatactaacggttctgaag

SEQ ID NO: 390011 - DNA, 20 bp, human
gctcacgtgcgtctgaattg

SEQ ID NO: 390012 - DNA, 20 bp, human
ggctgagaccgtcatccagg

SEQ ID NO: 390013 - DNA, 20 bp, human
gtaacggttctgaagcgggt

SEQ ID NO: 390014 - DNA, 20 bp, human
ggaggctgagaccgtcatcc

SEQ ID NO: 390015 - DNA, 20 bp, human
gtcttccgtcaggcacaaca

SEQ ID NO: 390016 - DNA, 20 bp, human
gccgaacccgagtgtgtcaa

SEQ ID NO: 390017 - DNA, 20 bp, human
ggcgacgagaagatccctcc

SEQ ID NO: 390018 - DNA, 20 bp, human
gcgcgccacagtccgcctgg

SEQ ID NO: 390019 - DNA, 20 bp, human
ggcccgcgccacagtccgcc

SEQ ID NO: 390020 - DNA, 20 bp, human
gcccgagcaggaagaaagcc

SEQ ID NO: 390021 - DNA, 20 bp, human
gctggcggtgatcctccagg

SEQ ID NO: 390022 - DNA, 20 bp, human
gactcccttggaccggatga

SEQ ID NO: 390023 - DNA, 20 bp, human
ggtgcaacgaattcccaggt

SEQ ID NO: 390024 - DNA, 20 bp, human
gtgatcctccaggcggactg

SEQ ID NO: 390025 - DNA, 20 bp, human
ggaagagcaggtaataatag

SEQ ID NO: 390026 - DNA, 20 bp, human
ggaagcctaacggtgagtga

SEQ ID NO: 390027 - DNA, 20 bp, human
gttgcagatcgaagtctgat

SEQ ID NO: 390028 - DNA, 20 bp, human
gaagggaggagcttcgggtc

SEQ ID NO: 390029 - DNA, 20 bp, human
gccgccggaagtcgtagttt

SEQ ID NO: 390030 - DNA, 20 bp, human
gagggagcggagcgtaccag

SEQ ID NO: 390031 - DNA, 20 bp, human
ggcgcgtgaggcagccgtcc

SEQ ID NO: 390032 - DNA, 20 bp, human
gctgcataagggaggagctt

SEQ ID NO: 390033 - DNA, 20 bp, human
ggagcggagcgtaccagcgg

SEQ ID NO: 390034 - DNA, 20 bp, human
gtccggcggcctcgtcgtcg

SEQ ID NO: 390035 - DNA, 20 bp, human
gcggcctcgtcgtcgcgggg

SEQ ID NO: 390036 - DNA, 20 bp, human
gcctctgcatacctgggatc

SEQ ID NO: 390037 - DNA, 20 bp, human
gtagaggcctgcctgagccg

SEQ ID NO: 390038 - DNA, 20 bp, human
ggctcaggcaggcctctagg

SEQ ID NO: 390039 - DNA, 20 bp, human
gcctgctgtggggcaccgtg

SEQ ID NO: 390040 - DNA, 20 bp, human
gtggtggtggaaggctgctg

SEQ ID NO: 390041 - DNA, 20 bp, human
gaagagctggatgggctctt

SEQ ID NO: 390042 - DNA, 20 bp, human
gtctgcgtcaccgtccctca

SEQ ID NO: 390043 - DNA, 20 bp, human
gggtccttcaccccgatccc

SEQ ID NO: 390044 - DNA, 20 bp, human
gtgactgcgtcccgccacgt

SEQ ID NO: 390045 - DNA, 20 bp, human
ggcccgggcctctgcatacc

SEQ ID NO: 390046 - DNA, 20 bp, human
ggcgtcgattggctccctgg

SEQ ID NO: 390047 - DNA, 20 bp, human
gagttgctaaactcagcaac

SEQ ID NO: 390048 - DNA, 20 bp, human
gtccagatgtgcaggggcca

SEQ ID NO: 390049 - DNA, 20 bp, human
ggctccctggaggcccacgg

SEQ ID NO: 390050 - DNA, 20 bp, human
gtccagggacacgcccccgt

SEQ ID NO: 390051 - DNA, 20 bp, human
ggggcgcgctcctccgcgat

SEQ ID NO: 390052 - DNA, 20 bp, human
gccgccttctgcgcgtcgat

SEQ ID NO: 390053 - DNA, 20 bp, human
ggctccagctgtcggcccat

SEQ ID NO: 390054 - DNA, 20 bp, human
gacgcccccgtgggcctcca

SEQ ID NO: 390055 - DNA, 20 bp, human
gcaggggcggctccagctgt

SEQ ID NO: 390056 - DNA, 20 bp, human
gctccgcccaggattctcta

SEQ ID NO: 390057 - DNA, 20 bp, human
gcgctctcaggcgtcctctg

SEQ ID NO: 390058 - DNA, 20 bp, human
gcgaggccgtagagaatcct

SEQ ID NO: 390059 - DNA, 20 bp, human
gctcggatgggcggaactat

SEQ ID NO: 390060 - DNA, 20 bp, human
ggcggagcgcggtcgctctc

SEQ ID NO: 390061 - DNA, 20 bp, human
gggacaaattctcggatggg

SEQ ID NO: 390062 - DNA, 20 bp, human
gatgggcggaactatgggcg

SEQ ID NO: 390063 - DNA, 20 bp, human
ggagaatcctgggcggagcg

SEQ ID NO: 390064 - DNA, 20 bp, human
gggagcgtgaatacttcgcc

SEQ ID NO: 390065 - DNA, 20 bp, human
gagagcgcagcattatatca

SEQ ID NO: 390066 - DNA, 20 bp, human
ggtggggtggagcacttggc

SEQ ID NO: 390067 - DNA, 20 bp, human
ggtggagcacttggcggggt

SEQ ID NO: 390068 - DNA, 20 bp, human
gcacaggaagtctctcatct

SEQ ID NO: 390069 - DNA, 20 bp, human
gcagttgctgtgagacttct

SEQ ID NO: 390070 - DNA, 20 bp, human
gcataggagccacccccttc

SEQ ID NO: 390071 - DNA, 20 bp, human
gaccactcctcattgctgct

SEQ ID NO: 390072 - DNA, 20 bp, human
gctcctggcccagcatcacc

SEQ ID NO: 390073 - DNA, 20 bp, human
gggaaaggtggagagggtct

SEQ ID NO: 390074 - DNA, 20 bp, human
gggaatgccctgctaggcgc

SEQ ID NO: 390075 - DNA, 20 bp, human
gtgtgggcgggcttaagatg

SEQ ID NO: 390076 - DNA, 20 bp, human
gccccagcgcaagacctgct

SEQ ID NO: 390077 - DNA, 20 bp, human
ggggccttcgagcttgaggc

SEQ ID NO: 390078 - DNA, 20 bp, human
gcgccccgcctcaagctcga

SEQ ID NO: 390079 - DNA, 20 bp, human
gcgttcccagcgggtagcct

SEQ ID NO: 390080 - DNA, 20 bp, human
ggggcgaatgcgttcccagc

SEQ ID NO: 390081 - DNA, 20 bp, human
gggaactctgcaccagtccc

SEQ ID NO: 390082 - DNA, 20 bp, human
gaggtcttgcgctggggccg

SEQ ID NO: 390083 - DNA, 20 bp, human
gttcccagcaggtcttgcgc

SEQ ID NO: 390084 - DNA, 20 bp, human
gcccacccgcgccggggtcg

SEQ ID NO: 390085 - DNA, 20 bp, human
gtggcagcccccacacaatt

SEQ ID NO: 390086 - DNA, 20 bp, human
ggagcccacagcgccacctg

SEQ ID NO: 390087 - DNA, 20 bp, human
ggcggcctccggtccccagg

SEQ ID NO: 390088 - DNA, 20 bp, human
gccagggagcgtcgtctccc

SEQ ID NO: 390089 - DNA, 20 bp, human
gacgacgctccctggtgccg

SEQ ID NO: 390090 - DNA, 20 bp, human
gagcgccacctggggaccgg

SEQ ID NO: 390091 - DNA, 20 bp, human
gaccggaggccgctggcccg

SEQ ID NO: 390092 - DNA, 20 bp, human
gcggcccggcggctgcgtac

SEQ ID NO: 390093 - DNA, 20 bp, human
ggagcgtgcaggaatgtgag

SEQ ID NO: 390094 - DNA, 20 bp, human
gccagcggcctccggtcccc

SEQ ID NO: 390095 - DNA, 20 bp, human
gaacagctagcccgcagcgg

SEQ ID NO: 390096 - DNA, 20 bp, human
gcctacccggcgccaggccc

SEQ ID NO: 390097 - DNA, 20 bp, human
gccaggcccggggttgcgag

SEQ ID NO: 390098 - DNA, 20 bp, human
ggcaaccccgggcctggcgc

SEQ ID NO: 390099 - DNA, 20 bp, human
ggaattcaggagcatcttgg

SEQ ID NO: 390100 - DNA, 20 bp, human
gctggcgccgggtaggggcg

SEQ ID NO: 390101 - DNA, 20 bp, human
ggcaactggtaattagtact

SEQ ID NO: 390102 - DNA, 20 bp, human
gcagggggacggcggaggca

SEQ ID NO: 390103 - DNA, 20 bp, human
gagatcaccgctcgcaaccc

SEQ ID NO: 390104 - DNA, 20 bp, human
gaaaaataaatcaaaggcga

SEQ ID NO: 390105 - DNA, 20 bp, human
gttgtctcttgaaaaggggt

SEQ ID NO: 390106 - DNA, 20 bp, human
gcacgcgcgggctaccgggg

SEQ ID NO: 390107 - DNA, 20 bp, human
ggggccaggcgcgccgagtg

SEQ ID NO: 390108 - DNA, 20 bp, human
ggcgctggcgcgggacgagg

SEQ ID NO: 390109 - DNA, 20 bp, human
ggtagcccgcgcgtgcccag

SEQ ID NO: 390110 - DNA, 20 bp, human
gccggggcggaggcgtacgg

SEQ ID NO: 390111 - DNA, 20 bp, human
gctaccggggcggaggcgta

SEQ ID NO: 390112 - DNA, 20 bp, human
gcgcgtgcccagcggctaga

SEQ ID NO: 390113 - DNA, 20 bp, human
gccagcccgcggcccgcact

SEQ ID NO: 390114 - DNA, 20 bp, human
gagagggttaagcccgcggg

SEQ ID NO: 390115 - DNA, 20 bp, human
gccagcgcggaacaacttcg

SEQ ID NO: 390116 - DNA, 20 bp, human
ggcgttcaaaaggggcgttt

SEQ ID NO: 390117 - DNA, 20 bp, human
gctacccagccgcgatcaga

SEQ ID NO: 390118 - DNA, 20 bp, human
gaaggagaaaacccacgctg

SEQ ID NO: 390119 - DNA, 20 bp, human
ggaaacttggaataggtctg

SEQ ID NO: 390120 - DNA, 20 bp, human
gcacgtcgctgctgagtggg

SEQ ID NO: 390121 - DNA, 20 bp, human
gcctagtccctcctggtaaa

SEQ ID NO: 390122 - DNA, 20 bp, human
gaccacctccgacactcctc

SEQ ID NO: 390123 - DNA, 20 bp, human
gcccccgccccctctgatcg

SEQ ID NO: 390124 - DNA, 20 bp, human
ggcccgaggagtgtcggagg

SEQ ID NO: 390125 - DNA, 20 bp, human
gcctcccggacaacattgat

SEQ ID NO: 390126 - DNA, 20 bp, human
ggcccgaccgtccacgagac

SEQ ID NO: 390127 - DNA, 20 bp, human
ggtactacccgtctcgtgga

SEQ ID NO: 390128 - DNA, 20 bp, human
gtacccgtctcgtggacggt

SEQ ID NO: 390129 - DNA, 20 bp, human
gggaccgtacacgatgggaa

SEQ ID NO: 390130 - DNA, 20 bp, human
gaccttggatcgcgttgtca

SEQ ID NO: 390131 - DNA, 20 bp, human
gctcgtggacggtcgggcct

SEQ ID NO: 390132 - DNA, 20 bp, human
ggggccttgcgcgcggaggt

SEQ ID NO: 390133 - DNA, 20 bp, human
gacgcgggaccgtacacgat

SEQ ID NO: 390134 - DNA, 20 bp, human
gaggcgcagccggccagcgt

SEQ ID NO: 390135 - DNA, 20 bp, human
gcccttgacaacgcgatcca

SEQ ID NO: 390136 - DNA, 20 bp, human
gggctccggtggccacagat

SEQ ID NO: 390137 - DNA, 20 bp, human
gtctgcgagcgtggtctcgc

SEQ ID NO: 390138 - DNA, 20 bp, human
gggagtctgacaagcagcac

SEQ ID NO: 390139 - DNA, 20 bp, human
gccacagattggctgaggga

SEQ ID NO: 390140 - DNA, 20 bp, human
ggtggccacagattggctga

SEQ ID NO: 390141 - DNA, 20 bp, human
gcgtgagagggggatctcag

SEQ ID NO: 390142 - DNA, 20 bp, human
gccgagcgagaaccccccta

SEQ ID NO: 390143 - DNA, 20 bp, human
gaggcggagccgtggacagt

SEQ ID NO: 390144 - DNA, 20 bp, human
gcgagaacccccctaagggg

SEQ ID NO: 390145 - DNA, 20 bp, human
ggacgtcatcgaggcgagag

SEQ ID NO: 390146 - DNA, 20 bp, human
gggcccgggcgcacttccgt

SEQ ID NO: 390147 - DNA, 20 bp, human
ggggcgcccactgccgaggg

SEQ ID NO: 390148 - DNA, 20 bp, human
gcgagctgcggggaacgcga

SEQ ID NO: 390149 - DNA, 20 bp, human
ggcggggcgcccactgccga

SEQ ID NO: 390150 - DNA, 20 bp, human
gcactgccgagggaggaaga

SEQ ID NO: 390151 - DNA, 20 bp, human
gccggccgcgcgggaccggg

SEQ ID NO: 390152 - DNA, 20 bp, human
gaggaagatggacgtgtccc

SEQ ID NO: 390153 - DNA, 20 bp, human
gccgcgcgggaccgggaggt

SEQ ID NO: 390154 - DNA, 20 bp, human
gccgggcgcacttccgtcgg

SEQ ID NO: 390155 - DNA, 20 bp, human
gcggggacactcagcggcga

SEQ ID NO: 390156 - DNA, 20 bp, human
ggccccaccagccgcggctc

SEQ ID NO: 390157 - DNA, 20 bp, human
gaggagcggcgtaaagttcc

SEQ ID NO: 390158 - DNA, 20 bp, human
gtgggctgtgggctacgagc

SEQ ID NO: 390159 - DNA, 20 bp, human
ggccgctcctccaagcgtca

SEQ ID NO: 390160 - DNA, 20 bp, human
ggccggagccgcggctggtg

SEQ ID NO: 390161 - DNA, 20 bp, human
gccgcgcccgcgctgggaga

SEQ ID NO: 390162 - DNA, 20 bp, human
gggcacaggaagcactttct

SEQ ID NO: 390163 - DNA, 20 bp, human
ggaactcggggcaccccggc

SEQ ID NO: 390164 - DNA, 20 bp, human
gaaagtgcttcctgtgccgg

SEQ ID NO: 390165 - DNA, 20 bp, human
ggggagacgctgcacttccc

SEQ ID NO: 390166 - DNA, 20 bp, human
gtgaacgcgcacaggcaacc

SEQ ID NO: 390167 - DNA, 20 bp, human
gccaggagccggtagttgag

SEQ ID NO: 390168 - DNA, 20 bp, human
gccgcccacagcagacgaac

SEQ ID NO: 390169 - DNA, 20 bp, human
gcggaaatggggttcgtttc

SEQ ID NO: 390170 - DNA, 20 bp, human
ggggcctcgggttcctgcat

SEQ ID NO: 390171 - DNA, 20 bp, human
ggtccgctcccctcaactac

SEQ ID NO: 390172 - DNA, 20 bp, human
gctgcccccaggccggaaat

SEQ ID NO: 390173 - DNA, 20 bp, human
ggcagatggggcgggtgaaa

SEQ ID NO: 390174 - DNA, 20 bp, human
gcctaggtgtgaacgcgcac

SEQ ID NO: 390175 - DNA, 20 bp, human
gcggaccctgtacttggaaa

SEQ ID NO: 390176 - DNA, 20 bp, human
gcagccagggcgtgaactga

SEQ ID NO: 390177 - DNA, 20 bp, human
ggaacctgtccagcccccgt

SEQ ID NO: 390178 - DNA, 20 bp, human
gacaatacgcggcctcccaa

SEQ ID NO: 390179 - DNA, 20 bp, human
gcgtgaactgagggcggtga

SEQ ID NO: 390180 - DNA, 20 bp, human
gaggtaccaccaccagagag

SEQ ID NO: 390181 - DNA, 20 bp, human
gtcccaaaggccaacgttgc

SEQ ID NO: 390182 - DNA, 20 bp, human
gccagggcgtgaactgaggg

SEQ ID NO: 390183 - DNA, 20 bp, human
gcgcgatgtgtgattgcaga

SEQ ID NO: 390184 - DNA, 20 bp, human
ggccgcgtattgttacctag

SEQ ID NO: 390185 - DNA, 20 bp, human
gtcttctatcttagaaacgt

SEQ ID NO: 390186 - DNA, 20 bp, human
gggcggggacccagacacta

SEQ ID NO: 390187 - DNA, 20 bp, human
gcgccgtagctcttcagctc

SEQ ID NO: 390188 - DNA, 20 bp, human
gttcccgagctgaagagcta

SEQ ID NO: 390189 - DNA, 20 bp, human
gggacccaggcacgactcaa

SEQ ID NO: 390190 - DNA, 20 bp, human
gtgctctcgcgatacgtagg

SEQ ID NO: 390191 - DNA, 20 bp, human
ggacagaggcagggttctga

SEQ ID NO: 390192 - DNA, 20 bp, human
gaaccctcgggacagaggca

SEQ ID NO: 390193 - DNA, 20 bp, human
gtttccggaagttgccggac

SEQ ID NO: 390194 - DNA, 20 bp, human
gcagccagtccggcaacttc

SEQ ID NO: 390195 - DNA, 20 bp, human
gcgggaaggctatatttagc

SEQ ID NO: 390196 - DNA, 20 bp, human
gagcaggagcaggatgttgg

SEQ ID NO: 390197 - DNA, 20 bp, human
gcggggccagagtccgcgga

SEQ ID NO: 390198 - DNA, 20 bp, human
gggggcggggccagagtccg

SEQ ID NO: 390199 - DNA, 20 bp, human
gtccgccggcccttccggct

SEQ ID NO: 390200 - DNA, 20 bp, human
gtggacggccacgtgactcg

SEQ ID NO: 390201 - DNA, 20 bp, human
gcggcggacgctcgctaggt

SEQ ID NO: 390202 - DNA, 20 bp, human
ggctcccgtggttgccatgg

SEQ ID NO: 390203 - DNA, 20 bp, human
ggagcgtccgccggcccttc

SEQ ID NO: 390204 - DNA, 20 bp, human
gaggtggtggcagctgttgc

SEQ ID NO: 390205 - DNA, 20 bp, human
gtgtcgcggcgacgaggtgg

SEQ ID NO: 390206 - DNA, 20 bp, human
gaagaggcggtgctgccaaa

SEQ ID NO: 390207 - DNA, 20 bp, human
gggcgcgcgcggagcactcc

SEQ ID NO: 390208 - DNA, 20 bp, human
gatgctgcccagcgcaagct

SEQ ID NO: 390209 - DNA, 20 bp, human
gtgtgacccaggattaccga

SEQ ID NO: 390210 - DNA, 20 bp, human
gggctgcggacgccacccag

SEQ ID NO: 390211 - DNA, 20 bp, human
gccaggattaccgaaggctg

SEQ ID NO: 390212 - DNA, 20 bp, human
ggggcagcatcctggccgct

SEQ ID NO: 390213 - DNA, 20 bp, human
gcaacacccaacagcccctt

SEQ ID NO: 390214 - DNA, 20 bp, human
gtgtagttgactgtgttaag

SEQ ID NO: 390215 - DNA, 20 bp, human
ggggtggcgtccgcagcctt

SEQ ID NO: 390216 - DNA, 20 bp, human
gaccactcttgaactccctc

SEQ ID NO: 390217 - DNA, 20 bp, human
ggcccgagggagttcaagag

SEQ ID NO: 390218 - DNA, 20 bp, human
ggatccctcaactacaccaa

SEQ ID NO: 390219 - DNA, 20 bp, human
gataaccattggtgtagttg

SEQ ID NO: 390220 - DNA, 20 bp, human
gcacacaagatagggatcta

SEQ ID NO: 390221 - DNA, 20 bp, human
gaaaaaattctttagcccga

SEQ ID NO: 390222 - DNA, 20 bp, human
ggatagggatctatggtttt

SEQ ID NO: 390223 - DNA, 20 bp, human
gttcacattatcagctttta

SEQ ID NO: 390224 - DNA, 20 bp, human
gtgatccatggcaagttacg

SEQ ID NO: 390225 - DNA, 20 bp, human
gctaacatttagatctatct

SEQ ID NO: 390226 - DNA, 20 bp, human
gctcgccctctagcctgagg

SEQ ID NO: 390227 - DNA, 20 bp, human
gagtgcgcaagtgcagcagg

SEQ ID NO: 390228 - DNA, 20 bp, human
gccaggcagaagaagtccca

SEQ ID NO: 390229 - DNA, 20 bp, human
ggggaggggccgtcgggtag

SEQ ID NO: 390230 - DNA, 20 bp, human
gagggcgagcgcttcgccgt

SEQ ID NO: 390231 - DNA, 20 bp, human
gcactgggagcgacacgctc

SEQ ID NO: 390232 - DNA, 20 bp, human
gctagcctgaggcggaagac

SEQ ID NO: 390233 - DNA, 20 bp, human
gttcaggggtgtgaagtcgc

SEQ ID NO: 390234 - DNA, 20 bp, human
gtcacaactagcgcagactc

SEQ ID NO: 390235 - DNA, 20 bp, human
ggactccggcagtatttagg

SEQ ID NO: 390236 - DNA, 20 bp, human
ggagcagccatcacggccgt

SEQ ID NO: 390237 - DNA, 20 bp, human
ggcgccctgagcaggtgact

SEQ ID NO: 390238 - DNA, 20 bp, human
ggtccctgggtccggctccg

SEQ ID NO: 390239 - DNA, 20 bp, human
gtgcctgagagcggccgcag

SEQ ID NO: 390240 - DNA, 20 bp, human
gcatgtgcaagggtatacat

SEQ ID NO: 390241 - DNA, 20 bp, human
gcaagcgtcccctccagcgt

SEQ ID NO: 390242 - DNA, 20 bp, human
gacgcgcggagcagccatca

SEQ ID NO: 390243 - DNA, 20 bp, human
gggctctgggtggcccacgc

SEQ ID NO: 390244 - DNA, 20 bp, human
gtgcgtgcgcaggcgctcga

SEQ ID NO: 390245 - DNA, 20 bp, human
ggtccgcggagccggaccca

SEQ ID NO: 390246 - DNA, 20 bp, human
gcgtgagcctgggacactag

SEQ ID NO: 390247 - DNA, 20 bp, human
gcgcacaccacctgagtccg

SEQ ID NO: 390248 - DNA, 20 bp, human
gggcgcgagccctcctactc

SEQ ID NO: 390249 - DNA, 20 bp, human
ggtggtgtgcgcgtgagcct

SEQ ID NO: 390250 - DNA, 20 bp, human
gacaccacctgagtccgggg

SEQ ID NO: 390251 - DNA, 20 bp, human
gggcgggcctacgccttctc

SEQ ID NO: 390252 - DNA, 20 bp, human
gttgtgcgacgaggaaagtc

SEQ ID NO: 390253 - DNA, 20 bp, human
gatgtggccagagaaggcgt

SEQ ID NO: 390254 - DNA, 20 bp, human
gtgcagaagagtcacatgaa

SEQ ID NO: 390255 - DNA, 20 bp, human
gagcctgggacactaggggg

SEQ ID NO: 390256 - DNA, 20 bp, human
gaggccagcgcccagatatg

SEQ ID NO: 390257 - DNA, 20 bp, human
gcgctggcctctccgggctt

SEQ ID NO: 390258 - DNA, 20 bp, human
gcccgacatcgtggtgagag

SEQ ID NO: 390259 - DNA, 20 bp, human
ggggaaccttcctcatatct

SEQ ID NO: 390260 - DNA, 20 bp, human
ggccgaatgccggggtagag

SEQ ID NO: 390261 - DNA, 20 bp, human
gtcccctctcaccacgatgt

SEQ ID NO: 390262 - DNA, 20 bp, human
gtagagctggccgaatgccg

SEQ ID NO: 390263 - DNA, 20 bp, human
gctctctcccaagcccggag

SEQ ID NO: 390264 - DNA, 20 bp, human
gagttcctctctcccaagcc

SEQ ID NO: 390265 - DNA, 20 bp, human
gaactcagtgatcatagagc

SEQ ID NO: 390266 - DNA, 20 bp, human
gcggggcggggctacaagtg

SEQ ID NO: 390267 - DNA, 20 bp, human
gggagccggaagtgttgtga

SEQ ID NO: 390268 - DNA, 20 bp, human
ggggaagtgaaaaacgacgg

SEQ ID NO: 390269 - DNA, 20 bp, human
ggggctacaagtgcggtggg

SEQ ID NO: 390270 - DNA, 20 bp, human
gggcggggctacaagtgcgg

SEQ ID NO: 390271 - DNA, 20 bp, human
ggggggaggtgcacaactgt

SEQ ID NO: 390272 - DNA, 20 bp, human
gtccacctgccgctagtagg

SEQ ID NO: 390273 - DNA, 20 bp, human
gagagggaagtgaaaaacga

SEQ ID NO: 390274 - DNA, 20 bp, human
gaaaaacgacggaggccggt

SEQ ID NO: 390275 - DNA, 20 bp, human
gctacaagtgcggtgggcgg

SEQ ID NO: 390276 - DNA, 20 bp, human
gagcaagggggtaggagcga

SEQ ID NO: 390277 - DNA, 20 bp, human
gaaaacccgggacggatcgg

SEQ ID NO: 390278 - DNA, 20 bp, human
gagagacgcgagggaagcaa

SEQ ID NO: 390279 - DNA, 20 bp, human
gagagagagaagcgggggac

SEQ ID NO: 390280 - DNA, 20 bp, human
gaagcggcggggacagaact

SEQ ID NO: 390281 - DNA, 20 bp, human
gtgggcccccgatccgtccc

SEQ ID NO: 390282 - DNA, 20 bp, human
ggccctgaaggactggtaag

SEQ ID NO: 390283 - DNA, 20 bp, human
ggggcggcgcagctggaagg

SEQ ID NO: 390284 - DNA, 20 bp, human
gggttttgcaagagacgcga

SEQ ID NO: 390285 - DNA, 20 bp, human
gtctcttgcaaaacccggga

SEQ ID NO: 390286 - DNA, 20 bp, human
ggacttaaattgtgtaacgt

SEQ ID NO: 390287 - DNA, 20 bp, human
gtaaatagtaagcaacccgt

SEQ ID NO: 390288 - DNA, 20 bp, human
gctagcctcgcattaagatg

SEQ ID NO: 390289 - DNA, 20 bp, human
gttacttgtgaagagatgac

SEQ ID NO: 390290 - DNA, 20 bp, human
gcaaacaggaaatgtggtga

SEQ ID NO: 390291 - DNA, 20 bp, human
gtattaagattctgggatgg

SEQ ID NO: 390292 - DNA, 20 bp, human
gcattaagatgaggtataga

SEQ ID NO: 390293 - DNA, 20 bp, human
gttgtcaggtggctctagat

SEQ ID NO: 390294 - DNA, 20 bp, human
gtatacctcatcttaatgcg

SEQ ID NO: 390295 - DNA, 20 bp, human
gtgataaggtgaggattgtc

SEQ ID NO: 390296 - DNA, 20 bp, human
ggcggcctggggattggcaa

SEQ ID NO: 390297 - DNA, 20 bp, human
gctggagcggtaggagacgg

SEQ ID NO: 390298 - DNA, 20 bp, human
gggagcggcgcgatggaggg

SEQ ID NO: 390299 - DNA, 20 bp, human
gcccgtgagcgaatagagag

SEQ ID NO: 390300 - DNA, 20 bp, human
ggcaaggggcggacactgtg

SEQ ID NO: 390301 - DNA, 20 bp, human
ggattggcaagggtctagag

SEQ ID NO: 390302 - DNA, 20 bp, human
gtctggaggggtggacacgg

SEQ ID NO: 390303 - DNA, 20 bp, human
ggggtgctggagctatacag

SEQ ID NO: 390304 - DNA, 20 bp, human
ggagggagcggcgcgatgga

SEQ ID NO: 390305 - DNA, 20 bp, human
gaccggcaggcctagctccg

SEQ ID NO: 390306 - DNA, 20 bp, human
gtatcttagagaaactgcgg

SEQ ID NO: 390307 - DNA, 20 bp, human
gaaagtgctgaagagtccta

SEQ ID NO: 390308 - DNA, 20 bp, human
gaagggcttaggttgtttcc

SEQ ID NO: 390309 - DNA, 20 bp, human
gggcttaggttgtttccagg

SEQ ID NO: 390310 - DNA, 20 bp, human
gcctttccaagcagcacttg

SEQ ID NO: 390311 - DNA, 20 bp, human
ggaaactgcgggggcttaga

SEQ ID NO: 390312 - DNA, 20 bp, human
gtaagataattacagatcct

SEQ ID NO: 390313 - DNA, 20 bp, human
gggtcccaaatgtctatcac

SEQ ID NO: 390314 - DNA, 20 bp, human
gaataactgcacttgctaag

SEQ ID NO: 390315 - DNA, 20 bp, human
gctatcacaggcaaaaggga

SEQ ID NO: 390316 - DNA, 20 bp, human
gtttgaggcgtggccacctg

SEQ ID NO: 390317 - DNA, 20 bp, human
gaccaagcacacgtcccctc

SEQ ID NO: 390318 - DNA, 20 bp, human
gtgagactgtgaaatagaag

SEQ ID NO: 390319 - DNA, 20 bp, human
gtggggccacccaaggaacc

SEQ ID NO: 390320 - DNA, 20 bp, human
gccccaccaccatgctctga

SEQ ID NO: 390321 - DNA, 20 bp, human
gagtgggcacccaaaggcca

SEQ ID NO: 390322 - DNA, 20 bp, human
gtccctcagagcatggtggt

SEQ ID NO: 390323 - DNA, 20 bp, human
gacctgaggggacgtgtgct

SEQ ID NO: 390324 - DNA, 20 bp, human
gtggctcaagatcctgtccc

SEQ ID NO: 390325 - DNA, 20 bp, human
gctcacctgcctgtccaagt

SEQ ID NO: 390326 - DNA, 20 bp, human
gttaactgagaagtgagtct

SEQ ID NO: 390327 - DNA, 20 bp, human
gaggatatgaggccattcct

SEQ ID NO: 390328 - DNA, 20 bp, human
ggaagccaagagaacccacg

SEQ ID NO: 390329 - DNA, 20 bp, human
gcctcctggtgatgaagagg

SEQ ID NO: 390330 - DNA, 20 bp, human
gtcgcagcctctccctatgt

SEQ ID NO: 390331 - DNA, 20 bp, human
gaggcaccacaatgacctag

SEQ ID NO: 390332 - DNA, 20 bp, human
gtagtgtagtgaagagagtc

SEQ ID NO: 390333 - DNA, 20 bp, human
gcacaatgacctagaggctt

SEQ ID NO: 390334 - DNA, 20 bp, human
gagagagtcaggcccacata

SEQ ID NO: 390335 - DNA, 20 bp, human
gtcagccccgtgggttctct

SEQ ID NO: 390336 - DNA, 20 bp, human
gtctggaggcggtgcagggt

SEQ ID NO: 390337 - DNA, 20 bp, human
gggggtctggaggcggtgca

SEQ ID NO: 390338 - DNA, 20 bp, human
gtaagcaatagtcaggactg

SEQ ID NO: 390339 - DNA, 20 bp, human
gtgtgaggatagtgatccct

SEQ ID NO: 390340 - DNA, 20 bp, human
gtggggattaagcaatagtc

SEQ ID NO: 390341 - DNA, 20 bp, human
ggggtctgaatacagctgtg

SEQ ID NO: 390342 - DNA, 20 bp, human
ggggtggcccccagatggtt

SEQ ID NO: 390343 - DNA, 20 bp, human
gcttaccagccccaaccatc

SEQ ID NO: 390344 - DNA, 20 bp, human
gagatggcgggcattgcagc

SEQ ID NO: 390345 - DNA, 20 bp, human
gcaccctggctggcaccagc

SEQ ID NO: 390346 - DNA, 20 bp, human
gcccggctaaggggtgagat

SEQ ID NO: 390347 - DNA, 20 bp, human
gggaactgccctgagggtaa

SEQ ID NO: 390348 - DNA, 20 bp, human
ggggtaagggtgggcaagac

SEQ ID NO: 390349 - DNA, 20 bp, human
gtgagggtgcacagctatga

SEQ ID NO: 390350 - DNA, 20 bp, human
gggaggattgtgacaattgg

SEQ ID NO: 390351 - DNA, 20 bp, human
gggggctggggcccggctaa

SEQ ID NO: 390352 - DNA, 20 bp, human
gatgggcacctccaggggtg

SEQ ID NO: 390353 - DNA, 20 bp, human
gtcagaaagtcacttggggt

SEQ ID NO: 390354 - DNA, 20 bp, human
gctgccctgagggtaagggt

SEQ ID NO: 390355 - DNA, 20 bp, human
gatgggaggattgtgacaat

SEQ ID NO: 390356 - DNA, 20 bp, human
gaatccctgcggttggctgg

SEQ ID NO: 390357 - DNA, 20 bp, human
gccagcaccgccctcataat

SEQ ID NO: 390358 - DNA, 20 bp, human
ggcccccttgctggatccta

SEQ ID NO: 390359 - DNA, 20 bp, human
ggtccctaggatccagcaag

SEQ ID NO: 390360 - DNA, 20 bp, human
gcccaacctcccccagaaac

SEQ ID NO: 390361 - DNA, 20 bp, human
gctctgactgtgagtcctcc

SEQ ID NO: 390362 - DNA, 20 bp, human
gcccaggggtgcgggctctt

SEQ ID NO: 390363 - DNA, 20 bp, human
gggatccagcaagggggctg

SEQ ID NO: 390364 - DNA, 20 bp, human
gcctagggaccagtttctgg

SEQ ID NO: 390365 - DNA, 20 bp, human
gactgtgagtcctcccggct

SEQ ID NO: 390366 - DNA, 20 bp, human
gacttctgaactgctgtcca

SEQ ID NO: 390367 - DNA, 20 bp, human
gactcgggattctactggtg

SEQ ID NO: 390368 - DNA, 20 bp, human
gagtgctggtcagggaaagt

SEQ ID NO: 390369 - DNA, 20 bp, human
ggctagaccagaaggattca

SEQ ID NO: 390370 - DNA, 20 bp, human
gctggcctcaggtgacatgg

SEQ ID NO: 390371 - DNA, 20 bp, human
gagctacagggtctgtctct

SEQ ID NO: 390372 - DNA, 20 bp, human
ggtgggatgaagaatgagtg

SEQ ID NO: 390373 - DNA, 20 bp, human
ggaaaaaagggagccctctc

SEQ ID NO: 390374 - DNA, 20 bp, human
gtctgggacaagcccaatgc

SEQ ID NO: 390375 - DNA, 20 bp, human
gagctgacacagaatgactc

SEQ ID NO: 390376 - DNA, 20 bp, human
gcccactcggggccgagccg

SEQ ID NO: 390377 - DNA, 20 bp, human
gccatcgcttagagggaagg

SEQ ID NO: 390378 - DNA, 20 bp, human
gaccggggagcggataagga

SEQ ID NO: 390379 - DNA, 20 bp, human
ggggtaccggggagcggata

SEQ ID NO: 390380 - DNA, 20 bp, human
gcccgagtgggctgcgaccg

SEQ ID NO: 390381 - DNA, 20 bp, human
ggataaggagggttaaggga

SEQ ID NO: 390382 - DNA, 20 bp, human
gggggagtaagtttcctgaa

SEQ ID NO: 390383 - DNA, 20 bp, human
gtgaaaaaaggggggtaccg

SEQ ID NO: 390384 - DNA, 20 bp, human
gtggccggggagggcgcatg

SEQ ID NO: 390385 - DNA, 20 bp, human
ggtgggtaatgggtgaaaaa

SEQ ID NO: 390386 - DNA, 20 bp, human
gcccccgggagcaggggagt

SEQ ID NO: 390387 - DNA, 20 bp, human
ggcaggacccggaccctgag

SEQ ID NO: 390388 - DNA, 20 bp, human
ggtggtgagagggacagacc

SEQ ID NO: 390389 - DNA, 20 bp, human
gcaggaactgcccagagaac

SEQ ID NO: 390390 - DNA, 20 bp, human
ggggaagtgaaacttggcgt

SEQ ID NO: 390391 - DNA, 20 bp, human
gcacagctgtggatcttgga

SEQ ID NO: 390392 - DNA, 20 bp, human
gcatgaaagggccgcagcag

SEQ ID NO: 390393 - DNA, 20 bp, human
ggggtgtgggggggaacgga

SEQ ID NO: 390394 - DNA, 20 bp, human
gaaggcagatcagttaccat

SEQ ID NO: 390395 - DNA, 20 bp, human
gacccacaggtgggcatgaa

SEQ ID NO: 390396 - DNA, 20 bp, human
ggggaagggtcggtcgggaa

SEQ ID NO: 390397 - DNA, 20 bp, human
gtgggcgggaagaacgctgg

SEQ ID NO: 390398 - DNA, 20 bp, human
gaggcaggaccacagtgaag

SEQ ID NO: 390399 - DNA, 20 bp, human
ggagatgtcgcccaatggga

SEQ ID NO: 390400 - DNA, 20 bp, human
gccgaccgacccttcccatt

SEQ ID NO: 390401 - DNA, 20 bp, human
gaacgctggaggttgattgg

SEQ ID NO: 390402 - DNA, 20 bp, human
ggtcgcccaatgggaagggt

SEQ ID NO: 390403 - DNA, 20 bp, human
gagcccggggcccgcgcagg

SEQ ID NO: 390404 - DNA, 20 bp, human
gggcggagatgtcgcccaat

SEQ ID NO: 390405 - DNA, 20 bp, human
gaagaacgctggaggttgat

SEQ ID NO: 390406 - DNA, 20 bp, human
gaatctggggcggggacggt

SEQ ID NO: 390407 - DNA, 20 bp, human
gctgctcctccggaaatctg

SEQ ID NO: 390408 - DNA, 20 bp, human
gcgagtgaggtcagcgggga

SEQ ID NO: 390409 - DNA, 20 bp, human
gtgcctccgcgccccggctc

SEQ ID NO: 390410 - DNA, 20 bp, human
ggaggcactggccgcaggat

SEQ ID NO: 390411 - DNA, 20 bp, human
gcctccggaaatctggggcg

SEQ ID NO: 390412 - DNA, 20 bp, human
gaggcgggcggggtcccgcg

SEQ ID NO: 390413 - DNA, 20 bp, human
gaggcgcacgagagagctag

SEQ ID NO: 390414 - DNA, 20 bp, human
gctggcgcagatataagcgg

SEQ ID NO: 390415 - DNA, 20 bp, human
gcgtcagcgccccttcccgg

SEQ ID NO: 390416 - DNA, 20 bp, human
gaagagcgagggtgtagaga

SEQ ID NO: 390417 - DNA, 20 bp, human
gctagggagaaggacgggag

SEQ ID NO: 390418 - DNA, 20 bp, human
gtctcggctagggagaagga

SEQ ID NO: 390419 - DNA, 20 bp, human
gaacgccgccgctggagtgg

SEQ ID NO: 390420 - DNA, 20 bp, human
gtccctagccgagaaccggt

SEQ ID NO: 390421 - DNA, 20 bp, human
gcggttctcggctagggaga

SEQ ID NO: 390422 - DNA, 20 bp, human
gggagaaggacgggagcggt

SEQ ID NO: 390423 - DNA, 20 bp, human
gtccgcgggagccttccaac

SEQ ID NO: 390424 - DNA, 20 bp, human
gtagccgagaaccggttgga

SEQ ID NO: 390425 - DNA, 20 bp, human
gccagcaggaggaagtccca

SEQ ID NO: 390426 - DNA, 20 bp, human
gtgaatcagtgaggactgac

SEQ ID NO: 390427 - DNA, 20 bp, human
gaaagctgaaatcataagcc

SEQ ID NO: 390428 - DNA, 20 bp, human
gattcagagtcttctgctct

SEQ ID NO: 390429 - DNA, 20 bp, human
gcagagtcttctgctcttgg

SEQ ID NO: 390430 - DNA, 20 bp, human
gccaggggtctagaagcagc

SEQ ID NO: 390431 - DNA, 20 bp, human
ggatgagacagtctttaatt

SEQ ID NO: 390432 - DNA, 20 bp, human
gggccatgtctagactgaga

SEQ ID NO: 390433 - DNA, 20 bp, human
gtcaagtgaatcagtacaat

SEQ ID NO: 390434 - DNA, 20 bp, human
gcagaagattgcagctgaaa

SEQ ID NO: 390435 - DNA, 20 bp, human
ggcgtgtatgttctcattag

SEQ ID NO: 390436 - DNA, 20 bp, human
gcccgcccagaggggcccga

SEQ ID NO: 390437 - DNA, 20 bp, human
gccctggcgcccgcccagag

SEQ ID NO: 390438 - DNA, 20 bp, human
ggggatgaggcggggagtgt

SEQ ID NO: 390439 - DNA, 20 bp, human
gaaggccagggccatctagg

SEQ ID NO: 390440 - DNA, 20 bp, human
ggatcctcaggtaaaggcca

SEQ ID NO: 390441 - DNA, 20 bp, human
ggtaaaggccagggccatct

SEQ ID NO: 390442 - DNA, 20 bp, human
gtgggccttcgggcccctct

SEQ ID NO: 390443 - DNA, 20 bp, human
gacgcgcgggcgcactgcgg

SEQ ID NO: 390444 - DNA, 20 bp, human
gaaggcggatcctcaggtaa

SEQ ID NO: 390445 - DNA, 20 bp, human
gtggtcgcggttggtgtggc

SEQ ID NO: 390446 - DNA, 20 bp, human
gccgcccagcgagcagtctc

SEQ ID NO: 390447 - DNA, 20 bp, human
ggagcagtctccggagcgga

SEQ ID NO: 390448 - DNA, 20 bp, human
ggaagccgggttgtgcaatg

SEQ ID NO: 390449 - DNA, 20 bp, human
ggaggtggctgcgacgactc

SEQ ID NO: 390450 - DNA, 20 bp, human
ggccgggctgtgtaaacagt

SEQ ID NO: 390451 - DNA, 20 bp, human
ggccgggttgtgcaatgagg

SEQ ID NO: 390452 - DNA, 20 bp, human
gcgctccggagactgctcgc

SEQ ID NO: 390453 - DNA, 20 bp, human
ggggaatgggggtggactta

SEQ ID NO: 390454 - DNA, 20 bp, human
gaaggaggagtgcactggcc

SEQ ID NO: 390455 - DNA, 20 bp, human
ggaagtgggcgggagggacg

SEQ ID NO: 390456 - DNA, 20 bp, human
ggcgcccggcgcaatgaggg

SEQ ID NO: 390457 - DNA, 20 bp, human
gagcggcggggctgattgat

SEQ ID NO: 390458 - DNA, 20 bp, human
ggccccgggcgcagcaccct

SEQ ID NO: 390459 - DNA, 20 bp, human
gtgggcgcccggcgcaatga

SEQ ID NO: 390460 - DNA, 20 bp, human
gaggctccgtggaaatgtgt

SEQ ID NO: 390461 - DNA, 20 bp, human
gaggccggtgctggcgcccc

SEQ ID NO: 390462 - DNA, 20 bp, human
ggggcccccaggctcagatg

SEQ ID NO: 390463 - DNA, 20 bp, human
gcggggagccgcccgaggac

SEQ ID NO: 390464 - DNA, 20 bp, human
gcgggcccccctcattgcgc

SEQ ID NO: 390465 - DNA, 20 bp, human
gtacctccccggccgggcga

SEQ ID NO: 390466 - DNA, 20 bp, human
ggcccgagggcatcagacgg

SEQ ID NO: 390467 - DNA, 20 bp, human
gctgaccagacgcccctagg

SEQ ID NO: 390468 - DNA, 20 bp, human
ggacggcggctgattagctc

SEQ ID NO: 390469 - DNA, 20 bp, human
ggcccctagggggccagcga

SEQ ID NO: 390470 - DNA, 20 bp, human
gcgccctcgctggcccccta

SEQ ID NO: 390471 - DNA, 20 bp, human
ggcgggggatggtgcgatcc

SEQ ID NO: 390472 - DNA, 20 bp, human
gaggtgatagggagagtccg

SEQ ID NO: 390473 - DNA, 20 bp, human
gcagcggatgcagaggagag

SEQ ID NO: 390474 - DNA, 20 bp, human
gccaggtgcagcggatgcag

SEQ ID NO: 390475 - DNA, 20 bp, human
gcctgcccgggtcctagcag

SEQ ID NO: 390476 - DNA, 20 bp, human
gtgcagctggggaatccact

SEQ ID NO: 390477 - DNA, 20 bp, human
gtccggagagctggattccc

SEQ ID NO: 390478 - DNA, 20 bp, human
gagggacccaagtctgcgag

SEQ ID NO: 390479 - DNA, 20 bp, human
gtctgcgagcggagagcaaa

SEQ ID NO: 390480 - DNA, 20 bp, human
ggggaggaggaaacactaag

SEQ ID NO: 390481 - DNA, 20 bp, human
gggagcacgcgggctgcgtc

SEQ ID NO: 390482 - DNA, 20 bp, human
gctcgctcgcggtcccggac

SEQ ID NO: 390483 - DNA, 20 bp, human
ggtccccgcgggcagagtgt

SEQ ID NO: 390484 - DNA, 20 bp, human
ggctggggaatccactcggc

SEQ ID NO: 390485 - DNA, 20 bp, human
gcacgcgggctgcgtccgga

SEQ ID NO: 390486 - DNA, 20 bp, human
gcagagacactcacagtaga

SEQ ID NO: 390487 - DNA, 20 bp, human
gtggaatattccctatgatg

SEQ ID NO: 390488 - DNA, 20 bp, human
gttgctgatgggcaagccct

SEQ ID NO: 390489 - DNA, 20 bp, human
gcactctcctgcttgctgat

SEQ ID NO: 390490 - DNA, 20 bp, human
gggcttgcccatcagcaagc

SEQ ID NO: 390491 - DNA, 20 bp, human
gctcctgccaacagcagaga

SEQ ID NO: 390492 - DNA, 20 bp, human
gactgcaccagcaacttcaa

SEQ ID NO: 390493 - DNA, 20 bp, human
ggctggtgcagtgtacaccc

SEQ ID NO: 390494 - DNA, 20 bp, human
gagataaggtccttgtgcca

SEQ ID NO: 390495 - DNA, 20 bp, human
gtgcaggcctcaaaagaggc

SEQ ID NO: 390496 - DNA, 20 bp, human
gcccgcgggcgggacggaat

SEQ ID NO: 390497 - DNA, 20 bp, human
gaggactcaggcgcagggga

SEQ ID NO: 390498 - DNA, 20 bp, human
gcgcccgcgggccgcgtgac

SEQ ID NO: 390499 - DNA, 20 bp, human
gctggccacaagaaccggag

SEQ ID NO: 390500 - DNA, 20 bp, human
gactggcagcggccaatcgg

SEQ ID NO: 390501 - DNA, 20 bp, human
ggccacaagaaccggagcgg

SEQ ID NO: 390502 - DNA, 20 bp, human
gaagcaggaagcgactgggt

SEQ ID NO: 390503 - DNA, 20 bp, human
gaagacctggccacaagaac

SEQ ID NO: 390504 - DNA, 20 bp, human
ggtgactggcagcggccaat

SEQ ID NO: 390505 - DNA, 20 bp, human
gctggggaggactcaggcgc

SEQ ID NO: 390506 - DNA, 20 bp, human
gggaggcgggcgacggggaa

SEQ ID NO: 390507 - DNA, 20 bp, human
gggccggggaggcgggacac

SEQ ID NO: 390508 - DNA, 20 bp, human
gcacccggctccctccgcca

SEQ ID NO: 390509 - DNA, 20 bp, human
gaggcgggacacaggcgaag

SEQ ID NO: 390510 - DNA, 20 bp, human
ggacacaggcgaagcgggac

SEQ ID NO: 390511 - DNA, 20 bp, human
gcgcgcctcgccttggcgga

SEQ ID NO: 390512 - DNA, 20 bp, human
gcggccgcgcctcgccttgg

SEQ ID NO: 390513 - DNA, 20 bp, human
gaccgtgcggtccctgtagt

SEQ ID NO: 390514 - DNA, 20 bp, human
gggaacgcggtctcaccacc

SEQ ID NO: 390515 - DNA, 20 bp, human
gcgggcgcaggactctggaa

SEQ ID NO: 390516 - DNA, 20 bp, human
gaggtggtcccaccagaaat

SEQ ID NO: 390517 - DNA, 20 bp, human
gggagcaccctgctggtcgg

SEQ ID NO: 390518 - DNA, 20 bp, human
gcggccggccgacccctagg

SEQ ID NO: 390519 - DNA, 20 bp, human
ggagggagcaccctgctggt

SEQ ID NO: 390520 - DNA, 20 bp, human
ggagccagctaggagagggt

SEQ ID NO: 390521 - DNA, 20 bp, human
gttctggtgggaccacctcc

SEQ ID NO: 390522 - DNA, 20 bp, human
gaagcccaccctctcctagc

SEQ ID NO: 390523 - DNA, 20 bp, human
gcacagggcggggctcccaa

SEQ ID NO: 390524 - DNA, 20 bp, human
gtaatgagccagctaggaga

SEQ ID NO: 390525 - DNA, 20 bp, human
ggcccgccgggagcagcgtc

SEQ ID NO: 390526 - DNA, 20 bp, human
gggagccaggagtaaagaac

SEQ ID NO: 390527 - DNA, 20 bp, human
gtgctctgttctccacccta

SEQ ID NO: 390528 - DNA, 20 bp, human
gcatgaggtcacagggggat

SEQ ID NO: 390529 - DNA, 20 bp, human
gacactgcaggtagggtgta

SEQ ID NO: 390530 - DNA, 20 bp, human
gggagtgggtccaaattcca

SEQ ID NO: 390531 - DNA, 20 bp, human
gagtaaagaactggcttact

SEQ ID NO: 390532 - DNA, 20 bp, human
gcacagtggctggggagaac

SEQ ID NO: 390533 - DNA, 20 bp, human
gcctggccaccacctatcag

SEQ ID NO: 390534 - DNA, 20 bp, human
gggtggtggccagggttcta

SEQ ID NO: 390535 - DNA, 20 bp, human
gtctgccggaagtgtgtggg

SEQ ID NO: 390536 - DNA, 20 bp, human
gtgtcgtcagacgagtgcag

SEQ ID NO: 390537 - DNA, 20 bp, human
gaagaaccacacagaaaact

SEQ ID NO: 390538 - DNA, 20 bp, human
gcagttccaagttttctgtg

SEQ ID NO: 390539 - DNA, 20 bp, human
gagtgcgcgccgaggctcct

SEQ ID NO: 390540 - DNA, 20 bp, human
ggaggtcagcctatccaata

SEQ ID NO: 390541 - DNA, 20 bp, human
gaatgtagtccggagcggcc

SEQ ID NO: 390542 - DNA, 20 bp, human
gaagcataagaaacaatttt

SEQ ID NO: 390543 - DNA, 20 bp, human
gtatttttcatgtaattcat

SEQ ID NO: 390544 - DNA, 20 bp, human
gtctgtcgcccgggccgctc

SEQ ID NO: 390545 - DNA, 20 bp, human
gctacatttcccaggagcct

SEQ ID NO: 390546 - DNA, 20 bp, human
gatccattcagattgttggg

SEQ ID NO: 390547 - DNA, 20 bp, human
gtcagattgttggggggctt

SEQ ID NO: 390548 - DNA, 20 bp, human
ggggaggcacgaagggttgg

SEQ ID NO: 390549 - DNA, 20 bp, human
gagtatgggtatggcaagga

SEQ ID NO: 390550 - DNA, 20 bp, human
gggtgagcccgtgccctcct

SEQ ID NO: 390551 - DNA, 20 bp, human
ggctgactgcagccccagga

SEQ ID NO: 390552 - DNA, 20 bp, human
gaccagccgggaggcacgaa

SEQ ID NO: 390553 - DNA, 20 bp, human
gtgggaagggaggtcagaca

SEQ ID NO: 390554 - DNA, 20 bp, human
ggccgggaggcacgaagggt

SEQ ID NO: 390555 - DNA, 20 bp, human
gagctagtatgggtatggca

SEQ ID NO: 390556 - DNA, 20 bp, human
gggcaggcgagcgtcagggt

SEQ ID NO: 390557 - DNA, 20 bp, human
ggggacagctggtggggcta

SEQ ID NO: 390558 - DNA, 20 bp, human
ggagttggggggttacttgg

SEQ ID NO: 390559 - DNA, 20 bp, human
gtgggcgagggagtgttcgg

SEQ ID NO: 390560 - DNA, 20 bp, human
gaggcgagcgtcagggtggg

SEQ ID NO: 390561 - DNA, 20 bp, human
ggggtgctgactgggcggtg

SEQ ID NO: 390562 - DNA, 20 bp, human
gtggtccacagcccagcgaa

SEQ ID NO: 390563 - DNA, 20 bp, human
ggacttttaggggaggttaa

SEQ ID NO: 390564 - DNA, 20 bp, human
gggaggggaatgctgggcga

SEQ ID NO: 390565 - DNA, 20 bp, human
ggggcggcgcctcttaggag

SEQ ID NO: 390566 - DNA, 20 bp, human
gcagaaatccagtagaaata

SEQ ID NO: 390567 - DNA, 20 bp, human
gtggtgcgcgcgactgaaac

SEQ ID NO: 390568 - DNA, 20 bp, human
gaaggagccacaaagatgac

SEQ ID NO: 390569 - DNA, 20 bp, human
gcatgttaggttaactggaa

SEQ ID NO: 390570 - DNA, 20 bp, human
gagaaccttactgtctgagg

SEQ ID NO: 390571 - DNA, 20 bp, human
gagccacaaagatgacaggc

SEQ ID NO: 390572 - DNA, 20 bp, human
ggagtgaaggaagtggtctc

SEQ ID NO: 390573 - DNA, 20 bp, human
ggccgctgaagtgactgtgc

SEQ ID NO: 390574 - DNA, 20 bp, human
gggagccccctcagacagta

SEQ ID NO: 390575 - DNA, 20 bp, human
gtggggacagacacgagtgt

SEQ ID NO: 390576 - DNA, 20 bp, human
gagaagtcagagttgagctg

SEQ ID NO: 390577 - DNA, 20 bp, human
gagcgcgcaaccaggaccac

SEQ ID NO: 390578 - DNA, 20 bp, human
gcaggaggcttctctgagac

SEQ ID NO: 390579 - DNA, 20 bp, human
gtctacaagacgggggagtc

SEQ ID NO: 390580 - DNA, 20 bp, human
gtggacatagcgtctaggtg

SEQ ID NO: 390581 - DNA, 20 bp, human
gtctcagacttgcttctgag

SEQ ID NO: 390582 - DNA, 20 bp, human
gggtaaaatatctacaagac

SEQ ID NO: 390583 - DNA, 20 bp, human
gactcagtagcccgtggtcc

SEQ ID NO: 390584 - DNA, 20 bp, human
gtctggaagtaagcagatgg

SEQ ID NO: 390585 - DNA, 20 bp, human
gagacatggacatagcgtct

SEQ ID NO: 390586 - DNA, 20 bp, human
gtacataacaataaaccctg

SEQ ID NO: 390587 - DNA, 20 bp, human
gagcatctgctgtactggca

SEQ ID NO: 390588 - DNA, 20 bp, human
gtagcagctgacattgtgaa

SEQ ID NO: 390589 - DNA, 20 bp, human
gcacaaatgagtttccccac

SEQ ID NO: 390590 - DNA, 20 bp, human
gggaagtgataattaattga

SEQ ID NO: 390591 - DNA, 20 bp, human
gcttgaaatgcagtctgacg

SEQ ID NO: 390592 - DNA, 20 bp, human
ggtctgtctggattaggagc

SEQ ID NO: 390593 - DNA, 20 bp, human
gcatcctcatctggtctgtc

SEQ ID NO: 390594 - DNA, 20 bp, human
ggagtgaatctggtttacac

SEQ ID NO: 390595 - DNA, 20 bp, human
gtcatgttacccagccactg

SEQ ID NO: 390596 - DNA, 20 bp, human
gcagccagggcgtgaactga

SEQ ID NO: 390597 - DNA, 20 bp, human
gcctccccgcaatcgtcggg

SEQ ID NO: 390598 - DNA, 20 bp, human
gcgtgaactgagggcggtga

SEQ ID NO: 390599 - DNA, 20 bp, human
gtcctcctccccgcaatcgt

SEQ ID NO: 390600 - DNA, 20 bp, human
gccagggcgtgaactgaggg

SEQ ID NO: 390601 - DNA, 20 bp, human
gaggcctctgcgcacgccac

SEQ ID NO: 390602 - DNA, 20 bp, human
gggagtaagagtcggctaag

SEQ ID NO: 390603 - DNA, 20 bp, human
gactaaccacccgacgattg

SEQ ID NO: 390604 - DNA, 20 bp, human
gacaatacgcggcctcccaa

SEQ ID NO: 390605 - DNA, 20 bp, human
gtcctactgcgcctgtgcgc

SEQ ID NO: 390606 - DNA, 20 bp, human
gtattccacgagcgcctcgg

SEQ ID NO: 390607 - DNA, 20 bp, human
ggaaggagggtatctgtcag

SEQ ID NO: 390608 - DNA, 20 bp, human
gctccctctcccagcaactg

SEQ ID NO: 390609 - DNA, 20 bp, human
gaggcgcggccgctattggg

SEQ ID NO: 390610 - DNA, 20 bp, human
ggagaccgttcctcgcaccg

SEQ ID NO: 390611 - DNA, 20 bp, human
ggtgcagcctccccggtgcg

SEQ ID NO: 390612 - DNA, 20 bp, human
gaccgttcctcgcaccgggg

SEQ ID NO: 390613 - DNA, 20 bp, human
gagcaactgaggcttcggtg

SEQ ID NO: 390614 - DNA, 20 bp, human
gctcccagcaactgaggctt

SEQ ID NO: 390615 - DNA, 20 bp, human
gccaaccgccgaggcgctcg

SEQ ID NO: 390616 - DNA, 20 bp, human
gggcctcgcgaggtactccc

SEQ ID NO: 390617 - DNA, 20 bp, human
gccgaccttcgccagctcat

SEQ ID NO: 390618 - DNA, 20 bp, human
gccagcccgcgggagctctt

SEQ ID NO: 390619 - DNA, 20 bp, human
gaagccgtcaggaagtcacg

SEQ ID NO: 390620 - DNA, 20 bp, human
gcggaagcgcggctggacct

SEQ ID NO: 390621 - DNA, 20 bp, human
gcgcgggagctcttggggat

SEQ ID NO: 390622 - DNA, 20 bp, human
gagtcacgtggggtgcgggg

SEQ ID NO: 390623 - DNA, 20 bp, human
gcgggcggcgaggactgggc

SEQ ID NO: 390624 - DNA, 20 bp, human
ggcttctgggggccactctg

SEQ ID NO: 390625 - DNA, 20 bp, human
gaccccacgtgacttcctga

SEQ ID NO: 390626 - DNA, 20 bp, human
gagtgacgtaaaagagacta

SEQ ID NO: 390627 - DNA, 20 bp, human
gcaccgcccgcggctgtctg

SEQ ID NO: 390628 - DNA, 20 bp, human
gtcggcaggagccaatcccg

SEQ ID NO: 390629 - DNA, 20 bp, human
gcaaatccccagacagccgc

SEQ ID NO: 390630 - DNA, 20 bp, human
gtagccgggagattacgggg

SEQ ID NO: 390631 - DNA, 20 bp, human
gacgcgccaaactcaggctg

SEQ ID NO: 390632 - DNA, 20 bp, human
ggcgaagggccccgaatagc

SEQ ID NO: 390633 - DNA, 20 bp, human
gcggggacgagctgtcgcgc

SEQ ID NO: 390634 - DNA, 20 bp, human
gcgggagaaatctcggcgaa

SEQ ID NO: 390635 - DNA, 20 bp, human
gtctaagggagtaaatgcta

SEQ ID NO: 390636 - DNA, 20 bp, human
gcctcctcggcctttccaag

SEQ ID NO: 390637 - DNA, 20 bp, human
gtttcctcttggaaaggccg

SEQ ID NO: 390638 - DNA, 20 bp, human
gaggctccgccactctcctt

SEQ ID NO: 390639 - DNA, 20 bp, human
gcgcgctgaagctctatcct

SEQ ID NO: 390640 - DNA, 20 bp, human
gggaaacagctcaggccccc

SEQ ID NO: 390641 - DNA, 20 bp, human
gagcgagtgacaaggtttcg

SEQ ID NO: 390642 - DNA, 20 bp, human
ggagagtggcggagcctcct

SEQ ID NO: 390643 - DNA, 20 bp, human
gagcggaagaggcggctcgc

SEQ ID NO: 390644 - DNA, 20 bp, human
gacaaggtttcgtggcctgg

SEQ ID NO: 390645 - DNA, 20 bp, human
gttccaagaggaaacagctc

SEQ ID NO: 390646 - DNA, 20 bp, human
ggggcccaggccggtcggtg

SEQ ID NO: 390647 - DNA, 20 bp, human
ggctggagacgactctacgg

SEQ ID NO: 390648 - DNA, 20 bp, human
gaccgccaaccccacgtcgg

SEQ ID NO: 390649 - DNA, 20 bp, human
gggggccaagaccgagtgaa

SEQ ID NO: 390650 - DNA, 20 bp, human
ggaggctggagacgactcta

SEQ ID NO: 390651 - DNA, 20 bp, human
gctacggcggcgaagagacg

SEQ ID NO: 390652 - DNA, 20 bp, human
gacaagagccccaccgacgt

SEQ ID NO: 390653 - DNA, 20 bp, human
ggccccgcctacttctccat

SEQ ID NO: 390654 - DNA, 20 bp, human
gccactggcggattcaattg

SEQ ID NO: 390655 - DNA, 20 bp, human
gtggcggtggtggaaggact

SEQ ID NO: 390656 - DNA, 20 bp, human
gtctcccgggccgctgtgtc

SEQ ID NO: 390657 - DNA, 20 bp, human
gaggttagggatgaatgtgc

SEQ ID NO: 390658 - DNA, 20 bp, human
gcagcggcccgggagaagca

SEQ ID NO: 390659 - DNA, 20 bp, human
gaagcctgacacagcggccc

SEQ ID NO: 390660 - DNA, 20 bp, human
gcagaggcctaccagacaca

SEQ ID NO: 390661 - DNA, 20 bp, human
ggggatgaatgtgcagggcg

SEQ ID NO: 390662 - DNA, 20 bp, human
gtgagaagcaagtgcgtcag

SEQ ID NO: 390663 - DNA, 20 bp, human
gcacaactcagcaaccagtt

SEQ ID NO: 390664 - DNA, 20 bp, human
ggcagagcagataattgcac

SEQ ID NO: 390665 - DNA, 20 bp, human
gtaacagccctgtgtctggt

SEQ ID NO: 390666 - DNA, 20 bp, human
gacaagggcttagttcaaga

SEQ ID NO: 390667 - DNA, 20 bp, human
gaaggaggagccagccactg

SEQ ID NO: 390668 - DNA, 20 bp, human
ggagccccaaaagtccccag

SEQ ID NO: 390669 - DNA, 20 bp, human
ggccgataagggcagagttg

SEQ ID NO: 390670 - DNA, 20 bp, human
gcaggaaccgagtgaatgct

SEQ ID NO: 390671 - DNA, 20 bp, human
gcagagggtcgggtcagcag

SEQ ID NO: 390672 - DNA, 20 bp, human
gcttagttcaagagggtgga

SEQ ID NO: 390673 - DNA, 20 bp, human
gtggatctgcctgggagata

SEQ ID NO: 390674 - DNA, 20 bp, human
gtgctggcagcctaaggtga

SEQ ID NO: 390675 - DNA, 20 bp, human
ggagataggggaagggctat

SEQ ID NO: 390676 - DNA, 20 bp, human
ggggcgtgcgggtgcggtag

SEQ ID NO: 390677 - DNA, 20 bp, human
gaggcagcgtccgcaggagg

SEQ ID NO: 390678 - DNA, 20 bp, human
gggagggggtgactccagta

SEQ ID NO: 390679 - DNA, 20 bp, human
ggtgcgggtgcggtaggggt

SEQ ID NO: 390680 - DNA, 20 bp, human
gccaaggaggcagcgtccgc

SEQ ID NO: 390681 - DNA, 20 bp, human
gcccctccctccggcctgtg

SEQ ID NO: 390682 - DNA, 20 bp, human
gaggaggcagcgtccgcagg

SEQ ID NO: 390683 - DNA, 20 bp, human
gcgttggcgggggggcgtgc

SEQ ID NO: 390684 - DNA, 20 bp, human
gccgggaagggcggtgtagt

SEQ ID NO: 390685 - DNA, 20 bp, human
gtgcctccttggtgctgcta

SEQ ID NO: 390686 - DNA, 20 bp, human
gtcccaatcagctctgagta

SEQ ID NO: 390687 - DNA, 20 bp, human
gctctgagtagggagtggag

SEQ ID NO: 390688 - DNA, 20 bp, human
ggcaccaaacaccacttatg

SEQ ID NO: 390689 - DNA, 20 bp, human
gggtggtgatgcctactgaa

SEQ ID NO: 390690 - DNA, 20 bp, human
gccaaagcattgcagtgaac

SEQ ID NO: 390691 - DNA, 20 bp, human
ggtagagcatctggaaagta

SEQ ID NO: 390692 - DNA, 20 bp, human
gtgaggagccaaagcacctg

SEQ ID NO: 390693 - DNA, 20 bp, human
gtccctactcagagctgatt

SEQ ID NO: 390694 - DNA, 20 bp, human
gaaccactccctagctcagt

SEQ ID NO: 390695 - DNA, 20 bp, human
gctccctagctcagtaggat

SEQ ID NO: 390696 - DNA, 20 bp, human
gcggggctcagtgacggaca

SEQ ID NO: 390697 - DNA, 20 bp, human
gtaaggccccgggttctcag

SEQ ID NO: 390698 - DNA, 20 bp, human
gcagctggccccaagcgcgc

SEQ ID NO: 390699 - DNA, 20 bp, human
gccgacgcccatgggcgaaa

SEQ ID NO: 390700 - DNA, 20 bp, human
gccaagcgcgcggggcaagg

SEQ ID NO: 390701 - DNA, 20 bp, human
gtacgtgtcgctaaggcccc

SEQ ID NO: 390702 - DNA, 20 bp, human
gctggggcttgtcgtgcagc

SEQ ID NO: 390703 - DNA, 20 bp, human
ggacagggagctctgcgaat

SEQ ID NO: 390704 - DNA, 20 bp, human
gcaccaaggagacggaaaac

SEQ ID NO: 390705 - DNA, 20 bp, human
gaggctaccgttttgtgaag

SEQ ID NO: 390706 - DNA, 20 bp, human
gaggcgggaactcggttcgc

SEQ ID NO: 390707 - DNA, 20 bp, human
gcgcgggcgcggagcggtcc

SEQ ID NO: 390708 - DNA, 20 bp, human
ggcgtcgcgcgtttgaagga

SEQ ID NO: 390709 - DNA, 20 bp, human
gggaactcggttcgcgggcg

SEQ ID NO: 390710 - DNA, 20 bp, human
gcggcactgacgcaaggaac

SEQ ID NO: 390711 - DNA, 20 bp, human
gcaaacgcgcgacgcgaggg

SEQ ID NO: 390712 - DNA, 20 bp, human
gcgtgcgcgcgcgctctcgt

SEQ ID NO: 390713 - DNA, 20 bp, human
gcgcaaggaactggcttcga

SEQ ID NO: 390714 - DNA, 20 bp, human
ggggacacgctcgcagggac

SEQ ID NO: 390715 - DNA, 20 bp, human
ggcagggaccggaaccgtcc

SEQ ID NO: 390716 - DNA, 20 bp, human
gaaaaggggaaggagcgtct

SEQ ID NO: 390717 - DNA, 20 bp, human
gttaatccagtgattctcga

SEQ ID NO: 390718 - DNA, 20 bp, human
gaagtccctccctcctgagg

SEQ ID NO: 390719 - DNA, 20 bp, human
gtagcacacaagtggatcgt

SEQ ID NO: 390720 - DNA, 20 bp, human
gtgaaatttttggggctgtc

SEQ ID NO: 390721 - DNA, 20 bp, human
gaatgaaagtgaaatttttg

SEQ ID NO: 390722 - DNA, 20 bp, human
ggagggacttcttcacacag

SEQ ID NO: 390723 - DNA, 20 bp, human
gcatgaaagtggtaggagaa

SEQ ID NO: 390724 - DNA, 20 bp, human
gaggcagttcctcctcagga

SEQ ID NO: 390725 - DNA, 20 bp, human
gagcattaccttctgtccag

SEQ ID NO: 390726 - DNA, 20 bp, human
gcggcccgactcctcccaga

SEQ ID NO: 390727 - DNA, 20 bp, human
ggggaggagtcgggccgcct

SEQ ID NO: 390728 - DNA, 20 bp, human
gccgtccgttcaacggccaa

SEQ ID NO: 390729 - DNA, 20 bp, human
gctcacttcctggagcggcc

SEQ ID NO: 390730 - DNA, 20 bp, human
gccgctctgcaggtcgggtt

SEQ ID NO: 390731 - DNA, 20 bp, human
gcggtgctcacttcctggag

SEQ ID NO: 390732 - DNA, 20 bp, human
gtgtgggtccgtccgttcaa

SEQ ID NO: 390733 - DNA, 20 bp, human
gccgcaaactcctgacctgt

SEQ ID NO: 390734 - DNA, 20 bp, human
gcactgcaaaccattttgtc

SEQ ID NO: 390735 - DNA, 20 bp, human
gcacctttgcagctgggaat

SEQ ID NO: 390736 - DNA, 20 bp, human
gcacggaagggtctcccagg

SEQ ID NO: 390737 - DNA, 20 bp, human
ggggaaatcttgggagagcg

SEQ ID NO: 390738 - DNA, 20 bp, human
ggacccgcccggacctgagg

SEQ ID NO: 390739 - DNA, 20 bp, human
gggtgtgcgcgggaaatctt

SEQ ID NO: 390740 - DNA, 20 bp, human
gcgtgcgggggggatggcga

SEQ ID NO: 390741 - DNA, 20 bp, human
gcggcgctggccaatcgtgc

SEQ ID NO: 390742 - DNA, 20 bp, human
gcgcacaccggaagtgggtg

SEQ ID NO: 390743 - DNA, 20 bp, human
gttcccgcgcacaccggaag

SEQ ID NO: 390744 - DNA, 20 bp, human
gtctcccaggcggcgtagta

SEQ ID NO: 390745 - DNA, 20 bp, human
gtagcacggaagggtctccc

SEQ ID NO: 390746 - DNA, 20 bp, human
gggtaggccgggtgtctgag

SEQ ID NO: 390747 - DNA, 20 bp, human
gagggaggggctgatgcgta

SEQ ID NO: 390748 - DNA, 20 bp, human
gccgcctggggctggtaggc

SEQ ID NO: 390749 - DNA, 20 bp, human
gagcgccagtcgcacaaaag

SEQ ID NO: 390750 - DNA, 20 bp, human
gcagtcgcacaaaagaggcg

SEQ ID NO: 390751 - DNA, 20 bp, human
ggcgggactcggctgggcgt

SEQ ID NO: 390752 - DNA, 20 bp, human
ggggctgatgcgtaggggga

SEQ ID NO: 390753 - DNA, 20 bp, human
gctgatgcgtagggggaagg

SEQ ID NO: 390754 - DNA, 20 bp, human
ggtctgagtggtaggctgag

SEQ ID NO: 390755 - DNA, 20 bp, human
gcgtgggtgtggcacgcggt

SEQ ID NO: 390756 - DNA, 20 bp, human
gtcactgtctggaggtgcga

SEQ ID NO: 390757 - DNA, 20 bp, human
gtcctcgggggtcgcggcag

SEQ ID NO: 390758 - DNA, 20 bp, human
ggcagcggttcggaccgcag

SEQ ID NO: 390759 - DNA, 20 bp, human
gcggcatgcgataaaggccg

SEQ ID NO: 390760 - DNA, 20 bp, human
gaggccggggaatgtctagc

SEQ ID NO: 390761 - DNA, 20 bp, human
gcagaggaggcgcaacaaag

SEQ ID NO: 390762 - DNA, 20 bp, human
gccggcaggttggccgtccc

SEQ ID NO: 390763 - DNA, 20 bp, human
gctaacggaacaaacgaggg

SEQ ID NO: 390764 - DNA, 20 bp, human
ggggggtcgcggcagcggtt

SEQ ID NO: 390765 - DNA, 20 bp, human
gggaggcgcaacaaaggggc

SEQ ID NO: 390766 - DNA, 20 bp, human
ggcggggcgcatacgagact

SEQ ID NO: 390767 - DNA, 20 bp, human
gcatgcgcgcaggacgctgt

SEQ ID NO: 390768 - DNA, 20 bp, human
gcctccgccaaggtgggcgt

SEQ ID NO: 390769 - DNA, 20 bp, human
gttggcgactcgctgcctca

SEQ ID NO: 390770 - DNA, 20 bp, human
gaggccgcctgcgcaggcta

SEQ ID NO: 390771 - DNA, 20 bp, human
gcggccctagcctgcgcagg

SEQ ID NO: 390772 - DNA, 20 bp, human
gcccccagctgctctggtta

SEQ ID NO: 390773 - DNA, 20 bp, human
gccacccacgcccaccttgg

SEQ ID NO: 390774 - DNA, 20 bp, human
gaagctcaggccgcctgcgc

SEQ ID NO: 390775 - DNA, 20 bp, human
ggccccgcaacgcgggaact

SEQ ID NO: 390776 - DNA, 20 bp, human
gtccccctcctttaccggag

SEQ ID NO: 390777 - DNA, 20 bp, human
gcgcctctccggtaaaggag

SEQ ID NO: 390778 - DNA, 20 bp, human
ggaaactactgtgggaggcg

SEQ ID NO: 390779 - DNA, 20 bp, human
ggggtcacatgatagtttac

SEQ ID NO: 390780 - DNA, 20 bp, human
gcatttgcactccgcctctc

SEQ ID NO: 390781 - DNA, 20 bp, human
gggcggggctcataagattt

SEQ ID NO: 390782 - DNA, 20 bp, human
ggaagtgaaactactgtggg

SEQ ID NO: 390783 - DNA, 20 bp, human
gctgagaagtgaaactactg

SEQ ID NO: 390784 - DNA, 20 bp, human
ggaagtaacatcagctagga

SEQ ID NO: 390785 - DNA, 20 bp, human
gacacagagtatctaaaaac

SEQ ID NO: 390786 - DNA, 20 bp, human
ggggcccgggaagaggtgat

SEQ ID NO: 390787 - DNA, 20 bp, human
gaccccatgcgaaggagcta

SEQ ID NO: 390788 - DNA, 20 bp, human
gagtgggtagaggtgtgaaa

SEQ ID NO: 390789 - DNA, 20 bp, human
gctggggaggggctagtagt

SEQ ID NO: 390790 - DNA, 20 bp, human
ggcggtcggaccccatgcga

SEQ ID NO: 390791 - DNA, 20 bp, human
gcccagactggcccgaagag

SEQ ID NO: 390792 - DNA, 20 bp, human
ggtggcggcggccaattacg

SEQ ID NO: 390793 - DNA, 20 bp, human
gaagtggaaagaacaggcct

SEQ ID NO: 390794 - DNA, 20 bp, human
gcgcggttccagctctcccc

SEQ ID NO: 390795 - DNA, 20 bp, human
gaaggtgagcagcagagacg

SEQ ID NO: 390796 - DNA, 20 bp, human
ggcagagacaagtctgttag

SEQ ID NO: 390797 - DNA, 20 bp, human
gccactcccaagttaaatta

SEQ ID NO: 390798 - DNA, 20 bp, human
gacaagtctgttagaggctg

SEQ ID NO: 390799 - DNA, 20 bp, human
ggcggctttggagaacttac

SEQ ID NO: 390800 - DNA, 20 bp, human
gtagggataaatgtcgggtc

SEQ ID NO: 390801 - DNA, 20 bp, human
ggctttggagaacttacagg

SEQ ID NO: 390802 - DNA, 20 bp, human
gtctgcagcctctacagctg

SEQ ID NO: 390803 - DNA, 20 bp, human
gggagttaggacttaacata

SEQ ID NO: 390804 - DNA, 20 bp, human
gtaacatagggataaatgtc

SEQ ID NO: 390805 - DNA, 20 bp, human
gtggtgggaggacctagaga

SEQ ID NO: 390806 - DNA, 20 bp, human
ggcaggacgggaccggtgag

SEQ ID NO: 390807 - DNA, 20 bp, human
gcggcctgagcgcgcaagac

SEQ ID NO: 390808 - DNA, 20 bp, human
gaccgcgagggggttggttc

SEQ ID NO: 390809 - DNA, 20 bp, human
gatccgcgccggaaccgcga

SEQ ID NO: 390810 - DNA, 20 bp, human
gagggggttggttcaggcct

SEQ ID NO: 390811 - DNA, 20 bp, human
gtcaggcctaggcgcggggc

SEQ ID NO: 390812 - DNA, 20 bp, human
gagctgctgggtatccgcgc

SEQ ID NO: 390813 - DNA, 20 bp, human
ggcctgaaccaaccccctcg

SEQ ID NO: 390814 - DNA, 20 bp, human
ggcctaggcgcggggcagga

SEQ ID NO: 390815 - DNA, 20 bp, human
gggaaagctacagaggactt

SEQ ID NO: 390816 - DNA, 20 bp, human
gtggaaggtgagatggactt

SEQ ID NO: 390817 - DNA, 20 bp, human
gaggggaggaggaaggtctt

SEQ ID NO: 390818 - DNA, 20 bp, human
ggcgtggcttgtttgctcaa

SEQ ID NO: 390819 - DNA, 20 bp, human
gtcagtaaatctcagggcgg

SEQ ID NO: 390820 - DNA, 20 bp, human
gtgagatggactttggtgca

SEQ ID NO: 390821 - DNA, 20 bp, human
gccaagactagcctgactgg

SEQ ID NO: 390822 - DNA, 20 bp, human
gggcttgtttgctcaagggg

SEQ ID NO: 390823 - DNA, 20 bp, human
gcctgtcatatcgacgtcaa

SEQ ID NO: 390824 - DNA, 20 bp, human
gctaaggggtgccactaata

SEQ ID NO: 390825 - DNA, 20 bp, human
gattacctagggtagctgga

SEQ ID NO: 390826 - DNA, 20 bp, human
ggaaacgccgactacagttg

SEQ ID NO: 390827 - DNA, 20 bp, human
gagaaagcgcttcgcgggtt

SEQ ID NO: 390828 - DNA, 20 bp, human
gtcgttgtggaggactcaga

SEQ ID NO: 390829 - DNA, 20 bp, human
gtaggcagacgacttcgttg

SEQ ID NO: 390830 - DNA, 20 bp, human
gtaaaccatgagacagtgtc

SEQ ID NO: 390831 - DNA, 20 bp, human
ggcctgagaaagcgcttcgc

SEQ ID NO: 390832 - DNA, 20 bp, human
gagggtcgtccgggtcggac

SEQ ID NO: 390833 - DNA, 20 bp, human
gaggactcagagggtcgtcc

SEQ ID NO: 390834 - DNA, 20 bp, human
gcgccgactacagttgggga

SEQ ID NO: 390835 - DNA, 20 bp, human
ggcgcgccctgaagtacttc

SEQ ID NO: 390836 - DNA, 20 bp, human
gtccatggaaccagctgtag

SEQ ID NO: 390837 - DNA, 20 bp, human
gcggccttgtgggtggtagc

SEQ ID NO: 390838 - DNA, 20 bp, human
gggaaccagctgtagaggag

SEQ ID NO: 390839 - DNA, 20 bp, human
gtgggtggtagctggtatgt

SEQ ID NO: 390840 - DNA, 20 bp, human
ggcaggcagaacaccaaaca

SEQ ID NO: 390841 - DNA, 20 bp, human
ggtggtagctggtatgttgg

SEQ ID NO: 390842 - DNA, 20 bp, human
gggtgatgcaatgagcatcc

SEQ ID NO: 390843 - DNA, 20 bp, human
gctaggtagatagcaggatg

SEQ ID NO: 390844 - DNA, 20 bp, human
gtagcaggatgcggccttgt

SEQ ID NO: 390845 - DNA, 20 bp, human
gataccagctaccacccaca

SEQ ID NO: 390846 - DNA, 20 bp, human
gtaaatgttttttaatattt

SEQ ID NO: 390847 - DNA, 20 bp, human
gttcaccaagattgggtgta

SEQ ID NO: 390848 - DNA, 20 bp, human
ggcaatcaattggaagaaag

SEQ ID NO: 390849 - DNA, 20 bp, human
gcctgtgaaatgcaatcaat

SEQ ID NO: 390850 - DNA, 20 bp, human
gcaattggaagaaaggggtg

SEQ ID NO: 390851 - DNA, 20 bp, human
ggcatttcacagggcgtagg

SEQ ID NO: 390852 - DNA, 20 bp, human
gattgcatttcacagggcgt

SEQ ID NO: 390853 - DNA, 20 bp, human
gtcttccttacacccaatct

SEQ ID NO: 390854 - DNA, 20 bp, human
gcaaattaattctagtttat

SEQ ID NO: 390855 - DNA, 20 bp, human
gatttataaaccgacacttc

SEQ ID NO: 390856 - DNA, 20 bp, human
gaggcctcctgacggggaaa

SEQ ID NO: 390857 - DNA, 20 bp, human
ggaaagggaaagtggaaccg

SEQ ID NO: 390858 - DNA, 20 bp, human
gcccgcgggaaaagcagaaa

SEQ ID NO: 390859 - DNA, 20 bp, human
gaaaaggaggcctcctgacg

SEQ ID NO: 390860 - DNA, 20 bp, human
gagcgggcggcgcgacgcgg

SEQ ID NO: 390861 - DNA, 20 bp, human
gtctcagcgtgccttggagg

SEQ ID NO: 390862 - DNA, 20 bp, human
gatctctccctggtagcggg

SEQ ID NO: 390863 - DNA, 20 bp, human
gggcacgctgagatttggag

SEQ ID NO: 390864 - DNA, 20 bp, human
gcacagggacaccagcctag

SEQ ID NO: 390865 - DNA, 20 bp, human
gtccaaggcacgctgagatt

SEQ ID NO: 390866 - DNA, 20 bp, human
ggccccccgcgtgagtggac

SEQ ID NO: 390867 - DNA, 20 bp, human
gggactcgccggagtagacc

SEQ ID NO: 390868 - DNA, 20 bp, human
gcgtgggcggggcggccgaa

SEQ ID NO: 390869 - DNA, 20 bp, human
ggcggggcccggagcggcga

SEQ ID NO: 390870 - DNA, 20 bp, human
ggtcccgccccccgcgtgag

SEQ ID NO: 390871 - DNA, 20 bp, human
gttagtggcgtcactctgga

SEQ ID NO: 390872 - DNA, 20 bp, human
ggacctgacaaggccgtggg

SEQ ID NO: 390873 - DNA, 20 bp, human
ggaagggcttagagtgcggc

SEQ ID NO: 390874 - DNA, 20 bp, human
gcgccagtccactcacgcgg

SEQ ID NO: 390875 - DNA, 20 bp, human
gggcagaaagaaggccgtcc

SEQ ID NO: 390876 - DNA, 20 bp, human
gaacagcgcccgtcggggta

SEQ ID NO: 390877 - DNA, 20 bp, human
gggaggaaataatgcgtcga

SEQ ID NO: 390878 - DNA, 20 bp, human
ggggtgcccgatcccggctg

SEQ ID NO: 390879 - DNA, 20 bp, human
ggttctcgaaagccggtcgg

SEQ ID NO: 390880 - DNA, 20 bp, human
gcggaccagtgcgtccatga

SEQ ID NO: 390881 - DNA, 20 bp, human
ggaaggggagggggcgtata

SEQ ID NO: 390882 - DNA, 20 bp, human
gtcggaagcagccctgagtg

SEQ ID NO: 390883 - DNA, 20 bp, human
gacggtagggccatggcaga

SEQ ID NO: 390884 - DNA, 20 bp, human
gttaaggtggggtcgaggga

SEQ ID NO: 390885 - DNA, 20 bp, human
ggggctagcgatggcagaaa

SEQ ID NO: 390886 - DNA, 20 bp, human
gtccccgcccagacaacgca

SEQ ID NO: 390887 - DNA, 20 bp, human
gacccccaggggagtccgcg

SEQ ID NO: 390888 - DNA, 20 bp, human
gcaggccggagcacaatcgg

SEQ ID NO: 390889 - DNA, 20 bp, human
gaccacgcggactcccctgg

SEQ ID NO: 390890 - DNA, 20 bp, human
gccgcagcaccgcccgcctg

SEQ ID NO: 390891 - DNA, 20 bp, human
gaggaagggcgctgctgaaa

SEQ ID NO: 390892 - DNA, 20 bp, human
gccaggccagcgctccgcag

SEQ ID NO: 390893 - DNA, 20 bp, human
gcctccctgcgttgtctggg

SEQ ID NO: 390894 - DNA, 20 bp, human
gtagacgcgcccagcccctg

SEQ ID NO: 390895 - DNA, 20 bp, human
gcccagaaggaccagaggga

SEQ ID NO: 390896 - DNA, 20 bp, human
gcagaggatcacttgaagac

SEQ ID NO: 390897 - DNA, 20 bp, human
gttggacttccaaagtgctt

SEQ ID NO: 390898 - DNA, 20 bp, human
gtttggaagtccaagaccag

SEQ ID NO: 390899 - DNA, 20 bp, human
gaatttaatcagccgtgcaa

SEQ ID NO: 390900 - DNA, 20 bp, human
gtaaataaatgtgcccttaa

SEQ ID NO: 390901 - DNA, 20 bp, human
gtttagatcacacctttgca

SEQ ID NO: 390902 - DNA, 20 bp, human
gtaaaggaatgcctgtatct

SEQ ID NO: 390903 - DNA, 20 bp, human
gagtgtatgtcaaatctgat

SEQ ID NO: 390904 - DNA, 20 bp, human
gtgagcttcatccaagatac

SEQ ID NO: 390905 - DNA, 20 bp, human
gtttcagtcatggtttttta

SEQ ID NO: 390906 - DNA, 20 bp, human
gggatcaagtccatgaccca

SEQ ID NO: 390907 - DNA, 20 bp, human
gttaagcagagaatgtccac

SEQ ID NO: 390908 - DNA, 20 bp, human
gtgggaaacttgtgaaaccc

SEQ ID NO: 390909 - DNA, 20 bp, human
gcttgtgaaaccctgggtca

SEQ ID NO: 390910 - DNA, 20 bp, human
gggtcatggacttgatcctg

SEQ ID NO: 390911 - DNA, 20 bp, human
gacattctctgcttaaattc

SEQ ID NO: 390912 - DNA, 20 bp, human
ggagggcagtagccattttg

SEQ ID NO: 390913 - DNA, 20 bp, human
gtgtacaaagagggaaatga

SEQ ID NO: 390914 - DNA, 20 bp, human
gagtacatgtatgtacaaag

SEQ ID NO: 390915 - DNA, 20 bp, human
ggggtacacttcctagttac

SEQ ID NO: 390916 - DNA, 20 bp, human
ggaatgagcttctgacgttg

SEQ ID NO: 390917 - DNA, 20 bp, human
ggtccttttataagaatctg

SEQ ID NO: 390918 - DNA, 20 bp, human
gactttgaattcaaggctgc

SEQ ID NO: 390919 - DNA, 20 bp, human
ggaggattactttgaattca

SEQ ID NO: 390920 - DNA, 20 bp, human
gagcctatgtatgctctgat

SEQ ID NO: 390921 - DNA, 20 bp, human
gtaaatacccataaagaggt

SEQ ID NO: 390922 - DNA, 20 bp, human
gaccacacccacctctttat

SEQ ID NO: 390923 - DNA, 20 bp, human
gcaagctcagttttctctga

SEQ ID NO: 390924 - DNA, 20 bp, human
gtgacctctgaaattcagta

SEQ ID NO: 390925 - DNA, 20 bp, human
ggtatttagagcattcagaa

SEQ ID NO: 390926 - DNA, 20 bp, human
gggatcaagtccatgaccca

SEQ ID NO: 390927 - DNA, 20 bp, human
gttaagcagagaatgtccac

SEQ ID NO: 390928 - DNA, 20 bp, human
gggtcatggacttgatcctg

SEQ ID NO: 390929 - DNA, 20 bp, human
gtgggaaacttgtgaaaccc

SEQ ID NO: 390930 - DNA, 20 bp, human
gacattctctgcttaaattc

SEQ ID NO: 390931 - DNA, 20 bp, human
gcttgtgaaaccctgggtca

SEQ ID NO: 390932 - DNA, 20 bp, human
gacagaagtaagatctgtgc

SEQ ID NO: 390933 - DNA, 20 bp, human
ggagggcagtagccattttg

SEQ ID NO: 390934 - DNA, 20 bp, human
ggggtacacttcctagttac

SEQ ID NO: 390935 - DNA, 20 bp, human
gtgtacaaagagggaaatga

SEQ ID NO: 390936 - DNA, 20 bp, human
gtatcagatttgacatacac

SEQ ID NO: 390937 - DNA, 20 bp, human
gatatgattcatttaaatca

SEQ ID NO: 390938 - DNA, 20 bp, human
gaggctcaaaccatcccacc

SEQ ID NO: 390939 - DNA, 20 bp, human
gtgagcttcatccaagatac

SEQ ID NO: 390940 - DNA, 20 bp, human
gtttaaatcatggtttttta

SEQ ID NO: 390941 - DNA, 20 bp, human
gtaaaaaaacattagccagg

SEQ ID NO: 390942 - DNA, 20 bp, human
gttttcatagagtcagggta

SEQ ID NO: 390943 - DNA, 20 bp, human
gaaaacttttcatagagtca

SEQ ID NO: 390944 - DNA, 20 bp, human
gcacacccacctctttaagt

SEQ ID NO: 390945 - DNA, 20 bp, human
gacccacctctttaagtggg

SEQ ID NO: 390946 - DNA, 20 bp, human
ggtaactagcaagtgtactc

SEQ ID NO: 390947 - DNA, 20 bp, human
gaataaaggcctggagtatg

SEQ ID NO: 390948 - DNA, 20 bp, human
gcattacatccccatactcc

SEQ ID NO: 390949 - DNA, 20 bp, human
ggctgctgcagccgactgtc

SEQ ID NO: 390950 - DNA, 20 bp, human
gcactcacgtaggacctact

SEQ ID NO: 390951 - DNA, 20 bp, human
gtatggggatgtaatgctca

SEQ ID NO: 390952 - DNA, 20 bp, human
gaggggataggaacagagaa

SEQ ID NO: 390953 - DNA, 20 bp, human
gtcatccagcaattagagag

SEQ ID NO: 390954 - DNA, 20 bp, human
gcacgtaggacctactggga

SEQ ID NO: 390955 - DNA, 20 bp, human
gcagcaattagagaggggat

SEQ ID NO: 390956 - DNA, 20 bp, human
ggcccggctgattcattcag

SEQ ID NO: 390957 - DNA, 20 bp, human
gaaagtgaaagataaactat

SEQ ID NO: 390958 - DNA, 20 bp, human
ggagaaaagggagattgagt

SEQ ID NO: 390959 - DNA, 20 bp, human
gtgtgaacagcacagctaca

SEQ ID NO: 390960 - DNA, 20 bp, human
gggactcaccaggccctacg

SEQ ID NO: 390961 - DNA, 20 bp, human
gggaatgcctctagttccca

SEQ ID NO: 390962 - DNA, 20 bp, human
gacagcacagctacacggcc

SEQ ID NO: 390963 - DNA, 20 bp, human
gaatggcatttctccacgta

SEQ ID NO: 390964 - DNA, 20 bp, human
gtcagagggcgggactcacc

SEQ ID NO: 390965 - DNA, 20 bp, human
gctgttcacaggaggagccg

SEQ ID NO: 390966 - DNA, 20 bp, human
gggaccacgcagggcacgtt

SEQ ID NO: 390967 - DNA, 20 bp, human
gggcacgttgggtacgtgca

SEQ ID NO: 390968 - DNA, 20 bp, human
gctacagaggccacgcggtg

SEQ ID NO: 390969 - DNA, 20 bp, human
ggtacccaacgtgccctgcg

SEQ ID NO: 390970 - DNA, 20 bp, human
gggaagcgcacgaaacatga

SEQ ID NO: 390971 - DNA, 20 bp, human
gtgcgaggtatgatccgtaa

SEQ ID NO: 390972 - DNA, 20 bp, human
gggccacgcggtgaggtgcg

SEQ ID NO: 390973 - DNA, 20 bp, human
ggtttcgtgcgcttccatta

SEQ ID NO: 390974 - DNA, 20 bp, human
gtacctcgcacctcaccgcg

SEQ ID NO: 390975 - DNA, 20 bp, human
gtgcgccccgctgccctccc

SEQ ID NO: 390976 - DNA, 20 bp, human
ggtctcttctacatccattt

SEQ ID NO: 390977 - DNA, 20 bp, human
gaaatatttttaaaattctt

SEQ ID NO: 390978 - DNA, 20 bp, human
gtcaaagtaaaaaagactag

SEQ ID NO: 390979 - DNA, 20 bp, human
gatcactaaataggtggttg

SEQ ID NO: 390980 - DNA, 20 bp, human
gaaaaaccactgcctgaatg

SEQ ID NO: 390981 - DNA, 20 bp, human
gaccctaaatatcactaaat

SEQ ID NO: 390982 - DNA, 20 bp, human
gaatttaatcagtgatgaaa

SEQ ID NO: 390983 - DNA, 20 bp, human
gcaagctcatatttctccag

SEQ ID NO: 390984 - DNA, 20 bp, human
gctaaatatcactaaatagg

SEQ ID NO: 390985 - DNA, 20 bp, human
gatatttagggtattaagaa

SEQ ID NO: 390986 - DNA, 20 bp, human
gggaatggggtcttgaggag

SEQ ID NO: 390987 - DNA, 20 bp, human
gcgcgggccgggagttgggt

SEQ ID NO: 390988 - DNA, 20 bp, human
gagccgctctgccggcccga

SEQ ID NO: 390989 - DNA, 20 bp, human
gccgggaagaggcccggctt

SEQ ID NO: 390990 - DNA, 20 bp, human
gtagccagcggctgcatctg

SEQ ID NO: 390991 - DNA, 20 bp, human
ggagaaggggcttgggaatg

SEQ ID NO: 390992 - DNA, 20 bp, human
gcggcagagcggctctgatc

SEQ ID NO: 390993 - DNA, 20 bp, human
ggcggaggaccacgtctcta

SEQ ID NO: 390994 - DNA, 20 bp, human
gccggggccgagttggtccg

SEQ ID NO: 390995 - DNA, 20 bp, human
gctggagagacgctctaggc

SEQ ID NO: 390996 - DNA, 20 bp, human
gactcccttgagcaagggca

SEQ ID NO: 390997 - DNA, 20 bp, human
gaggagccttcagagtgaga

SEQ ID NO: 390998 - DNA, 20 bp, human
gaggcgagccacagctgtca

SEQ ID NO: 390999 - DNA, 20 bp, human
gactcactccatgacagctg

SEQ ID NO: 391000 - DNA, 20 bp, human
gggaggaggaccagggtcac

SEQ ID NO: 391001 - DNA, 20 bp, human
ggagtgaccctgactcactc

SEQ ID NO: 391002 - DNA, 20 bp, human
gaagggcccaagccagaaca

SEQ ID NO: 391003 - DNA, 20 bp, human
gcatgagctaaattgggaat

SEQ ID NO: 391004 - DNA, 20 bp, human
gtgctgccctctcactctga

SEQ ID NO: 391005 - DNA, 20 bp, human
gcccaccctgagctatgtat

SEQ ID NO: 391006 - DNA, 20 bp, human
gcccagggagtgaagagagt

SEQ ID NO: 391007 - DNA, 20 bp, human
gctcactgagaacttggcga

SEQ ID NO: 391008 - DNA, 20 bp, human
gagggcatggttcagtggct

SEQ ID NO: 391009 - DNA, 20 bp, human
gcctgcggtcacgtgacggt

SEQ ID NO: 391010 - DNA, 20 bp, human
gcaggaggatggatcctgac

SEQ ID NO: 391011 - DNA, 20 bp, human
ggagtcaacattcttgcccc

SEQ ID NO: 391012 - DNA, 20 bp, human
gctgacaggtgacggagagc

SEQ ID NO: 391013 - DNA, 20 bp, human
gctcctgtcactggcttata

SEQ ID NO: 391014 - DNA, 20 bp, human
gtcacaaccccgtctaaatg

SEQ ID NO: 391015 - DNA, 20 bp, human
ggtccatataagccagtgac

SEQ ID NO: 391016 - DNA, 20 bp, human
gttctctgagtagagggtgg

SEQ ID NO: 391017 - DNA, 20 bp, human
gaggcgagtcggtgtgtccc

SEQ ID NO: 391018 - DNA, 20 bp, human
ggcaggcagctggcaggctt

SEQ ID NO: 391019 - DNA, 20 bp, human
ggcagctggcaggcttgggc

SEQ ID NO: 391020 - DNA, 20 bp, human
ggggccttggcgggagagga

SEQ ID NO: 391021 - DNA, 20 bp, human
gctggactgacaggccgacc

SEQ ID NO: 391022 - DNA, 20 bp, human
gtgccagctgcctgccgggg

SEQ ID NO: 391023 - DNA, 20 bp, human
ggacaggccgacctggctgg

SEQ ID NO: 391024 - DNA, 20 bp, human
ggccctgaggctggactgac

SEQ ID NO: 391025 - DNA, 20 bp, human
gactgacaggccgacctggc

SEQ ID NO: 391026 - DNA, 20 bp, human
gggtggcttttcaccgggtg

SEQ ID NO: 391027 - DNA, 20 bp, human
ggtgaaaatagcatatgagg

SEQ ID NO: 391028 - DNA, 20 bp, human
gatagggagcgcctgagtgg

SEQ ID NO: 391029 - DNA, 20 bp, human
gtcccctcgcggtctgcaca

SEQ ID NO: 391030 - DNA, 20 bp, human
ggccgggagcgcagccctcc

SEQ ID NO: 391031 - DNA, 20 bp, human
gaccgcgaggggagacggtg

SEQ ID NO: 391032 - DNA, 20 bp, human
ggaaagcaggcgccgacggg

SEQ ID NO: 391033 - DNA, 20 bp, human
ggggaggcgggtcatggcct

SEQ ID NO: 391034 - DNA, 20 bp, human
gtcaggcgctccctatgtcg

SEQ ID NO: 391035 - DNA, 20 bp, human
gcggtgaaaagccaccactc

SEQ ID NO: 391036 - DNA, 20 bp, human
ggggctcgttcgaaagtaaa

SEQ ID NO: 391037 - DNA, 20 bp, human
gaggccaagcttccgagagg

SEQ ID NO: 391038 - DNA, 20 bp, human
ggccaatgggaactattgct

SEQ ID NO: 391039 - DNA, 20 bp, human
ggcgaggccaagcttccgag

SEQ ID NO: 391040 - DNA, 20 bp, human
gagcccttcggggcagagga

SEQ ID NO: 391041 - DNA, 20 bp, human
gcgggtctgtgaggcaacga

SEQ ID NO: 391042 - DNA, 20 bp, human
ggcccagcaatagttcccat

SEQ ID NO: 391043 - DNA, 20 bp, human
gggtggcgggagtcagttta

SEQ ID NO: 391044 - DNA, 20 bp, human
gcggcctgcgcctagcacgc

SEQ ID NO: 391045 - DNA, 20 bp, human
gactcaccgcggggaggaag

SEQ ID NO: 391046 - DNA, 20 bp, human
gcaggccgaaagactcaggg

SEQ ID NO: 391047 - DNA, 20 bp, human
gcggcccgactcctcccaga

SEQ ID NO: 391048 - DNA, 20 bp, human
gacccaggccgaaagactca

SEQ ID NO: 391049 - DNA, 20 bp, human
gtcggcctgggtggaggacg

SEQ ID NO: 391050 - DNA, 20 bp, human
gccgctctgcaggtcgggtt

SEQ ID NO: 391051 - DNA, 20 bp, human
gctcactaacctggaatctg

SEQ ID NO: 391052 - DNA, 20 bp, human
gaatcggctggatctcctgc

SEQ ID NO: 391053 - DNA, 20 bp, human
gccttcccccctgagtcttt

SEQ ID NO: 391054 - DNA, 20 bp, human
ggagatccagccgattccat

SEQ ID NO: 391055 - DNA, 20 bp, human
gtcactggtgaccacaccca

SEQ ID NO: 391056 - DNA, 20 bp, human
gcggcccgactcctcccaga

SEQ ID NO: 391057 - DNA, 20 bp, human
gcaggccgaaagactcaggg

SEQ ID NO: 391058 - DNA, 20 bp, human
ggggaggagtcgggccgcct

SEQ ID NO: 391059 - DNA, 20 bp, human
gccgctctgcaggtcgggtt

SEQ ID NO: 391060 - DNA, 20 bp, human
gacccaggccgaaagactca

SEQ ID NO: 391061 - DNA, 20 bp, human
gcactgcaaaccattttgtc

SEQ ID NO: 391062 - DNA, 20 bp, human
gccgtccgttcaacggccaa

SEQ ID NO: 391063 - DNA, 20 bp, human
gtcggcctgggtggaggacg

SEQ ID NO: 391064 - DNA, 20 bp, human
gctcactaacctggaatctg

SEQ ID NO: 391065 - DNA, 20 bp, human
gcacctttgcagctgggaat

SEQ ID NO: 391066 - DNA, 20 bp, human
ggggcggttccctccgtggt

SEQ ID NO: 391067 - DNA, 20 bp, human
gcctagggcggttccctccg

SEQ ID NO: 391068 - DNA, 20 bp, human
gtcagggaccccaccacgga

SEQ ID NO: 391069 - DNA, 20 bp, human
gtggctgctccaccggaagt

SEQ ID NO: 391070 - DNA, 20 bp, human
ggctcaatgccgcagggtgc

SEQ ID NO: 391071 - DNA, 20 bp, human
gcaccggaagtgggcgggaa

SEQ ID NO: 391072 - DNA, 20 bp, human
gggtccctgatggcttcagt

SEQ ID NO: 391073 - DNA, 20 bp, human
gtgacccactgaagccatca

SEQ ID NO: 391074 - DNA, 20 bp, human
gttctgaggagagcctaggg

SEQ ID NO: 391075 - DNA, 20 bp, human
gacagggtctggtgcggtct

SEQ ID NO: 391076 - DNA, 20 bp, human
ggggccctgatcacggaaga

SEQ ID NO: 391077 - DNA, 20 bp, human
ggccaacggggccctgatca

SEQ ID NO: 391078 - DNA, 20 bp, human
ggcgccctcttccgtgatca

SEQ ID NO: 391079 - DNA, 20 bp, human
ggggaattaaatgccagttg

SEQ ID NO: 391080 - DNA, 20 bp, human
gtccgtgatcagggccccgt

SEQ ID NO: 391081 - DNA, 20 bp, human
ggggccccgttggccccaac

SEQ ID NO: 391082 - DNA, 20 bp, human
gcggtggttggcagttgccc

SEQ ID NO: 391083 - DNA, 20 bp, human
gatgccagttggggccaacg

SEQ ID NO: 391084 - DNA, 20 bp, human
gactccctcaccatctggga

SEQ ID NO: 391085 - DNA, 20 bp, human
ggtcccctcccagatggtga

SEQ ID NO: 391086 - DNA, 20 bp, human
gacaccccgaaggaacagct

SEQ ID NO: 391087 - DNA, 20 bp, human
gcgaagcccagctgttcctt

SEQ ID NO: 391088 - DNA, 20 bp, human
gggggtggggcggggtcaac

SEQ ID NO: 391089 - DNA, 20 bp, human
gtgcgggggcggagttgctt

SEQ ID NO: 391090 - DNA, 20 bp, human
ggcctccccgcccccgtggg

SEQ ID NO: 391091 - DNA, 20 bp, human
gttccttcggggtgtgtact

SEQ ID NO: 391092 - DNA, 20 bp, human
ggggaggcagccgcggccac

SEQ ID NO: 391093 - DNA, 20 bp, human
ggcttgggtcccgcccacgg

SEQ ID NO: 391094 - DNA, 20 bp, human
gtaaacaaggagcatctttc

SEQ ID NO: 391095 - DNA, 20 bp, human
gttccaagtacacaccccga

SEQ ID NO: 391096 - DNA, 20 bp, human
gcctaagcctgcctctgaac

SEQ ID NO: 391097 - DNA, 20 bp, human
gtgagccacggggattcaag

SEQ ID NO: 391098 - DNA, 20 bp, human
gacaagaacagcctgttcag

SEQ ID NO: 391099 - DNA, 20 bp, human
ggcaggcttagggcaagact

SEQ ID NO: 391100 - DNA, 20 bp, human
gcccccggcaccaggctagt

SEQ ID NO: 391101 - DNA, 20 bp, human
gaatcactattctgctggga

SEQ ID NO: 391102 - DNA, 20 bp, human
ggccctctcaaatcacatgc

SEQ ID NO: 391103 - DNA, 20 bp, human
ggggggagaccaatttctgg

SEQ ID NO: 391104 - DNA, 20 bp, human
gacccagcaagtgagccacg

SEQ ID NO: 391105 - DNA, 20 bp, human
gcactattctgctgggacgg

SEQ ID NO: 391106 - DNA, 20 bp, human
gtcctggaccgaaccttcaa

SEQ ID NO: 391107 - DNA, 20 bp, human
ggccattgaaggttcggtcc

SEQ ID NO: 391108 - DNA, 20 bp, human
ggtattcaggagatgggttt

SEQ ID NO: 391109 - DNA, 20 bp, human
gttccctcaatagccattga

SEQ ID NO: 391110 - DNA, 20 bp, human
ggataaagtattcaggagat

SEQ ID NO: 391111 - DNA, 20 bp, human
ggtacaagtttggcagggtg

SEQ ID NO: 391112 - DNA, 20 bp, human
gggacagagctcaagtagaa

SEQ ID NO: 391113 - DNA, 20 bp, human
gagaaaggaaaattgtccac

SEQ ID NO: 391114 - DNA, 20 bp, human
gtcaatagccattgaaggtt

SEQ ID NO: 391115 - DNA, 20 bp, human
gctcttattagtaaatggtg

SEQ ID NO: 391116 - DNA, 20 bp, human
ggggccccgggcgtcttaaa

SEQ ID NO: 391117 - DNA, 20 bp, human
ggggcggggcgagatccggg

SEQ ID NO: 391118 - DNA, 20 bp, human
gggaacgcggaaccttcgag

SEQ ID NO: 391119 - DNA, 20 bp, human
gtgcggcggtcgctcgtcga

SEQ ID NO: 391120 - DNA, 20 bp, human
gtcgtcgagggtgtcagaga

SEQ ID NO: 391121 - DNA, 20 bp, human
ggcgagatccgcgcccggga

SEQ ID NO: 391122 - DNA, 20 bp, human
gagatccgcgcccgggaagg

SEQ ID NO: 391123 - DNA, 20 bp, human
gggcgtggctaacgcggggc

SEQ ID NO: 391124 - DNA, 20 bp, human
gtggcgtggaccctaacgga

SEQ ID NO: 391125 - DNA, 20 bp, human
gcggggcgagatccgcgccc

SEQ ID NO: 391126 - DNA, 20 bp, human
gaagaatgaacagggttgac

SEQ ID NO: 391127 - DNA, 20 bp, human
gctggaggagacattaggat

SEQ ID NO: 391128 - DNA, 20 bp, human
gtgggtagagttaactgcca

SEQ ID NO: 391129 - DNA, 20 bp, human
gagaggattaggacttcgga

SEQ ID NO: 391130 - DNA, 20 bp, human
ggcacagagcaaccagatga

SEQ ID NO: 391131 - DNA, 20 bp, human
ggggatgtgcttggaaagac

SEQ ID NO: 391132 - DNA, 20 bp, human
gatccagtcacacacaagca

SEQ ID NO: 391133 - DNA, 20 bp, human
gtacgatgcacaaaggtcct

SEQ ID NO: 391134 - DNA, 20 bp, human
ggtgtgtgactggatcttcc

SEQ ID NO: 391135 - DNA, 20 bp, human
ggatgcacaaaggtcctggg

SEQ ID NO: 391136 - DNA, 20 bp, human
gagagcagagagtaatgggg

SEQ ID NO: 391137 - DNA, 20 bp, human
gtcgcgcggcccaaggtcag

SEQ ID NO: 391138 - DNA, 20 bp, human
gcccagggagacgatggcag

SEQ ID NO: 391139 - DNA, 20 bp, human
gtagccgcccaccggagcca

SEQ ID NO: 391140 - DNA, 20 bp, human
gaatcaaggggcaattttaa

SEQ ID NO: 391141 - DNA, 20 bp, human
gtccagagcagagagtaatg

SEQ ID NO: 391142 - DNA, 20 bp, human
gggctcgcctcttgctgcta

SEQ ID NO: 391143 - DNA, 20 bp, human
ggccacccgccgggtcgctg

SEQ ID NO: 391144 - DNA, 20 bp, human
gcttgctgctagggaatcaa

SEQ ID NO: 391145 - DNA, 20 bp, human
ggccatagaagggtgaaaac

SEQ ID NO: 391146 - DNA, 20 bp, human
gtgtgggggcagccaatcac

SEQ ID NO: 391147 - DNA, 20 bp, human
gtctcatcaccaattggcta

SEQ ID NO: 391148 - DNA, 20 bp, human
gccaattggtgatgagacgg

SEQ ID NO: 391149 - DNA, 20 bp, human
gggcccagccggccgctcat

SEQ ID NO: 391150 - DNA, 20 bp, human
gctaggccccgctcgcggga

SEQ ID NO: 391151 - DNA, 20 bp, human
gccctgggcgaagccaacct

SEQ ID NO: 391152 - DNA, 20 bp, human
gacggcagccaatgagcggc

SEQ ID NO: 391153 - DNA, 20 bp, human
ggggaatctgagtcggtgaa

SEQ ID NO: 391154 - DNA, 20 bp, human
gccaatcacaggcagggacc

SEQ ID NO: 391155 - DNA, 20 bp, human
gggctctaggccccgctcgc

SEQ ID NO: 391156 - DNA, 20 bp, human
gcaaactcccggaactggat

SEQ ID NO: 391157 - DNA, 20 bp, human
ggacgagcgaccctgggctc

SEQ ID NO: 391158 - DNA, 20 bp, human
ggcccagggtcgctcgtcac

SEQ ID NO: 391159 - DNA, 20 bp, human
ggtcgctcgtcaccggtctc

SEQ ID NO: 391160 - DNA, 20 bp, human
gctgggctcgggttttgatt

SEQ ID NO: 391161 - DNA, 20 bp, human
ggaccggtgacgagcgaccc

SEQ ID NO: 391162 - DNA, 20 bp, human
gaggagaaggtactcgacga

SEQ ID NO: 391163 - DNA, 20 bp, human
ggctttccgagaaaggggaa

SEQ ID NO: 391164 - DNA, 20 bp, human
ggatggacgcgcccaggctg

SEQ ID NO: 391165 - DNA, 20 bp, human
ggcgtgcaaactcccggaac

SEQ ID NO: 391166 - DNA, 20 bp, human
ggggaggcgcacgttgacta

SEQ ID NO: 391167 - DNA, 20 bp, human
gctggtggagcgcagatccg

SEQ ID NO: 391168 - DNA, 20 bp, human
ggaagggcggggctgccact

SEQ ID NO: 391169 - DNA, 20 bp, human
gagcgcagatccggggcgca

SEQ ID NO: 391170 - DNA, 20 bp, human
ggcgctgtcccgcacttgaa

SEQ ID NO: 391171 - DNA, 20 bp, human
ggaaacgggccgcgacaggt

SEQ ID NO: 391172 - DNA, 20 bp, human
gtggagagtctgagggacgg

SEQ ID NO: 391173 - DNA, 20 bp, human
ggccgagggcccactgggag

SEQ ID NO: 391174 - DNA, 20 bp, human
gtgtcgcggcccgtttcccg

SEQ ID NO: 391175 - DNA, 20 bp, human
gcaggcagagactcgagccc

SEQ ID NO: 391176 - DNA, 20 bp, human
gcggcccccaagttatccgg

SEQ ID NO: 391177 - DNA, 20 bp, human
gttaatgcctgcagtgtcgg

SEQ ID NO: 391178 - DNA, 20 bp, human
gaacaagccccgacaggcga

SEQ ID NO: 391179 - DNA, 20 bp, human
gtgttccggcgttccctctt

SEQ ID NO: 391180 - DNA, 20 bp, human
gacgcggcccccaagttatc

SEQ ID NO: 391181 - DNA, 20 bp, human
gaggagagagcggacgaggt

SEQ ID NO: 391182 - DNA, 20 bp, human
gagagagcggacgaggtggg

SEQ ID NO: 391183 - DNA, 20 bp, human
ggggaggtcggaagactccc

SEQ ID NO: 391184 - DNA, 20 bp, human
gcggacgtggcgaggccaag

SEQ ID NO: 391185 - DNA, 20 bp, human
gacgtcgcgcggggagacac

SEQ ID NO: 391186 - DNA, 20 bp, human
gcggggagagaacagtggat

SEQ ID NO: 391187 - DNA, 20 bp, human
gggctctgagctctgactcc

SEQ ID NO: 391188 - DNA, 20 bp, human
gaaaggccctggctccccgc

SEQ ID NO: 391189 - DNA, 20 bp, human
gagctggagagtgtggaggt

SEQ ID NO: 391190 - DNA, 20 bp, human
gtcagccctcacttttagaa

SEQ ID NO: 391191 - DNA, 20 bp, human
ggggcacacatcacatgaca

SEQ ID NO: 391192 - DNA, 20 bp, human
gagtggacaccacgcgtgat

SEQ ID NO: 391193 - DNA, 20 bp, human
gaccctcccagactgagcca

SEQ ID NO: 391194 - DNA, 20 bp, human
gggccatggctcagtctggg

SEQ ID NO: 391195 - DNA, 20 bp, human
ggtgagggctgagtagtccc

SEQ ID NO: 391196 - DNA, 20 bp, human
gcgacggcggcattacattc

SEQ ID NO: 391197 - DNA, 20 bp, human
ggccaggtgtggcccgtaat

SEQ ID NO: 391198 - DNA, 20 bp, human
ggagggcccagacgtttcgg

SEQ ID NO: 391199 - DNA, 20 bp, human
gcacggtgagttgccaggtg

SEQ ID NO: 391200 - DNA, 20 bp, human
ggcacattgggcacttgcag

SEQ ID NO: 391201 - DNA, 20 bp, human
gcggagcgcacaaaacatga

SEQ ID NO: 391202 - DNA, 20 bp, human
gtggaactacagaggtcgca

SEQ ID NO: 391203 - DNA, 20 bp, human
gggaccacacagggcacatt

SEQ ID NO: 391204 - DNA, 20 bp, human
gtccgattacgggccacacc

SEQ ID NO: 391205 - DNA, 20 bp, human
gggtcgcacggtgagttgcc

SEQ ID NO: 391206 - DNA, 20 bp, human
ggcccaaggtcatgtgggtt

SEQ ID NO: 391207 - DNA, 20 bp, human
gctgaggcccaaggtcatgt

SEQ ID NO: 391208 - DNA, 20 bp, human
gcacacacacgtatcttcaa

SEQ ID NO: 391209 - DNA, 20 bp, human
gtggtgggtgagtgctggac

SEQ ID NO: 391210 - DNA, 20 bp, human
gtcctaacccacatgacctt

SEQ ID NO: 391211 - DNA, 20 bp, human
gcagggggaggggagtggac

SEQ ID NO: 391212 - DNA, 20 bp, human
gggtcatgtgggttaggact

SEQ ID NO: 391213 - DNA, 20 bp, human
gtgggttaggactgggatcc

SEQ ID NO: 391214 - DNA, 20 bp, human
gaagactgcagtgaaaaaac

SEQ ID NO: 391215 - DNA, 20 bp, human
gaaaattctggtgctcctta

SEQ ID NO: 391216 - DNA, 20 bp, human
gtcttatatcctttttgggg

SEQ ID NO: 391217 - DNA, 20 bp, human
gtgctcctgtcggggtcgtg

SEQ ID NO: 391218 - DNA, 20 bp, human
ggaccccgacaggagcagac

SEQ ID NO: 391219 - DNA, 20 bp, human
gcacacctcacgaccccgac

SEQ ID NO: 391220 - DNA, 20 bp, human
gcacctgtctgctcctgtcg

SEQ ID NO: 391221 - DNA, 20 bp, human
gggacacaggggtgttgctg

SEQ ID NO: 391222 - DNA, 20 bp, human
gttgctcttatatccttttt

SEQ ID NO: 391223 - DNA, 20 bp, human
gggaaactgggttacatcac

SEQ ID NO: 391224 - DNA, 20 bp, human
gtggggaggcagcctttgtt

SEQ ID NO: 391225 - DNA, 20 bp, human
ggggttacatcacaggactg

SEQ ID NO: 391226 - DNA, 20 bp, human
gcaggtgagggcccagacgt

SEQ ID NO: 391227 - DNA, 20 bp, human
gcgtctacgcccccacgtct

SEQ ID NO: 391228 - DNA, 20 bp, human
gcgtgggggcgtagacgctg

SEQ ID NO: 391229 - DNA, 20 bp, human
ggccaggtgtggcccgtaat

SEQ ID NO: 391230 - DNA, 20 bp, human
gcctcctcgtggccccagaa

SEQ ID NO: 391231 - DNA, 20 bp, human
gtggaactacagaggtcgca

SEQ ID NO: 391232 - DNA, 20 bp, human
gggaccacacagggcacatt

SEQ ID NO: 391233 - DNA, 20 bp, human
gcacggtgagttgccaggtg

SEQ ID NO: 391234 - DNA, 20 bp, human
gcggagcgcacaaaacatga

SEQ ID NO: 391235 - DNA, 20 bp, human
ggcacattgggcacttgcag

SEQ ID NO: 391236 - DNA, 20 bp, human
gctcttatatccttttttgg

SEQ ID NO: 391237 - DNA, 20 bp, human
gtgctcctgtcggggtcgtg

SEQ ID NO: 391238 - DNA, 20 bp, human
gcacctgtctgctcctgtcg

SEQ ID NO: 391239 - DNA, 20 bp, human
ggaccccgacaggagcagac

SEQ ID NO: 391240 - DNA, 20 bp, human
gggacacaggggtgttgctg

SEQ ID NO: 391241 - DNA, 20 bp, human
gcacacctcacgaccccgac

SEQ ID NO: 391242 - DNA, 20 bp, human
gttgctcttatatccttttt

SEQ ID NO: 391243 - DNA, 20 bp, human
gtggggaggcagcctttgtt

SEQ ID NO: 391244 - DNA, 20 bp, human
gggaaactgggttacatcac

SEQ ID NO: 391245 - DNA, 20 bp, human
ggggttacatcacaggactg

SEQ ID NO: 391246 - DNA, 20 bp, human
ggctcatttcatatgccatg

SEQ ID NO: 391247 - DNA, 20 bp, human
gcataaaaattacaagtcct

SEQ ID NO: 391248 - DNA, 20 bp, human
ggtatgcattgtagcatgac

SEQ ID NO: 391249 - DNA, 20 bp, human
gtctgcctctggacattatt

SEQ ID NO: 391250 - DNA, 20 bp, human
ggcatccaaataatgtccag

SEQ ID NO: 391251 - DNA, 20 bp, human
ggtaatttttatgtttttgt

SEQ ID NO: 391252 - DNA, 20 bp, human
gtgtttgtgtaaccactttg

SEQ ID NO: 391253 - DNA, 20 bp, human
ggccaaggttgtcaagaaag

SEQ ID NO: 391254 - DNA, 20 bp, human
gaaaatagtgctataggcca

SEQ ID NO: 391255 - DNA, 20 bp, human
gaactggaaaatagtgctat

SEQ ID NO: 391256 - DNA, 20 bp, human
gcggcctgcgctcgtccccg

SEQ ID NO: 391257 - DNA, 20 bp, human
gcgcgccccaatgtcagccg

SEQ ID NO: 391258 - DNA, 20 bp, human
gccgctaggcgctcgggagg

SEQ ID NO: 391259 - DNA, 20 bp, human
gctcccgctaggcgctcggg

SEQ ID NO: 391260 - DNA, 20 bp, human
gtccaccaggaggtgcccgc

SEQ ID NO: 391261 - DNA, 20 bp, human
gcgtccccgcggctgacatt

SEQ ID NO: 391262 - DNA, 20 bp, human
gtgccctagccgcgccgacg

SEQ ID NO: 391263 - DNA, 20 bp, human
gggggaggcggcctcttata

SEQ ID NO: 391264 - DNA, 20 bp, human
gcgggactccagccttggag

SEQ ID NO: 391265 - DNA, 20 bp, human
gggtccaaattccatataag

SEQ ID NO: 391266 - DNA, 20 bp, human
gacgaggagacggacgggtc

SEQ ID NO: 391267 - DNA, 20 bp, human
gaggagacggacgggtctgg

SEQ ID NO: 391268 - DNA, 20 bp, human
gcgtgcggaggctaggggac

SEQ ID NO: 391269 - DNA, 20 bp, human
gcgtctccgcaggccacagg

SEQ ID NO: 391270 - DNA, 20 bp, human
ggactctaccgaaccccctg

SEQ ID NO: 391271 - DNA, 20 bp, human
ggcctgcggagacgaggaga

SEQ ID NO: 391272 - DNA, 20 bp, human
gggccggcgtgcggaggcta

SEQ ID NO: 391273 - DNA, 20 bp, human
gagcccactcgctgcgggga

SEQ ID NO: 391274 - DNA, 20 bp, human
ggcggagacgaggagacgga

SEQ ID NO: 391275 - DNA, 20 bp, human
gtcggtagagtctgaggata

SEQ ID NO: 391276 - DNA, 20 bp, human
gcaccaccccgacctgacac

SEQ ID NO: 391277 - DNA, 20 bp, human
gagcctgtgtcaggtcgggg

SEQ ID NO: 391278 - DNA, 20 bp, human
gaaagtccacggccgggtgc

SEQ ID NO: 391279 - DNA, 20 bp, human
gccaagcctgtgtcaggtcg

SEQ ID NO: 391280 - DNA, 20 bp, human
ggtctcgatcatccagtgag

SEQ ID NO: 391281 - DNA, 20 bp, human
gagaacaggttccctggaca

SEQ ID NO: 391282 - DNA, 20 bp, human
ggtgatccaactccagcttc

SEQ ID NO: 391283 - DNA, 20 bp, human
gatgatcgagactaacaggt

SEQ ID NO: 391284 - DNA, 20 bp, human
gacagacctgaagctggagt

SEQ ID NO: 391285 - DNA, 20 bp, human
gctggatgatcgagactaac

SEQ ID NO: 391286 - DNA, 20 bp, human
gtgctagaggctgaggattc

SEQ ID NO: 391287 - DNA, 20 bp, human
gtggaaccatgtgagcatgt

SEQ ID NO: 391288 - DNA, 20 bp, human
gggtgaggagcccagtatac

SEQ ID NO: 391289 - DNA, 20 bp, human
gacaccaaggaatacttcag

SEQ ID NO: 391290 - DNA, 20 bp, human
ggagcatgtgggttttaggc

SEQ ID NO: 391291 - DNA, 20 bp, human
gtgtggaactcctgtatact

SEQ ID NO: 391292 - DNA, 20 bp, human
gagataagtctcaaagtttg

SEQ ID NO: 391293 - DNA, 20 bp, human
ggaagagctctcattttgtt

SEQ ID NO: 391294 - DNA, 20 bp, human
ggtggagttcccaaaagatt

SEQ ID NO: 391295 - DNA, 20 bp, human
gggttttaggctggaagctt

SEQ ID NO: 391296 - DNA, 20 bp, human
gaaaacgcaagcctcttcac

SEQ ID NO: 391297 - DNA, 20 bp, human
gaatcagagaccctgtgaag

SEQ ID NO: 391298 - DNA, 20 bp, human
gttaaggagctagaggtgtt

SEQ ID NO: 391299 - DNA, 20 bp, human
gggaccccaccgtagatttc

SEQ ID NO: 391300 - DNA, 20 bp, human
gattccagaaatctacggtg

SEQ ID NO: 391301 - DNA, 20 bp, human
gtatggaatctgtcacagat

SEQ ID NO: 391302 - DNA, 20 bp, human
gggaatctgtcacagatggg

SEQ ID NO: 391303 - DNA, 20 bp, human
gttcacagacgccttcctga

SEQ ID NO: 391304 - DNA, 20 bp, human
gcgccctcacaccatcagga

SEQ ID NO: 391305 - DNA, 20 bp, human
ggccccgccctcacaccatc

SEQ ID NO: 391306 - DNA, 20 bp, human
gttccggcgaacttcgtcaa

SEQ ID NO: 391307 - DNA, 20 bp, human
ggggaggctgcaggaacgtt

SEQ ID NO: 391308 - DNA, 20 bp, human
gaacccgggtgaaaggaaaa

SEQ ID NO: 391309 - DNA, 20 bp, human
gggagcccatccgcccaacg

SEQ ID NO: 391310 - DNA, 20 bp, human
ggaggggcttcggtaatttc

SEQ ID NO: 391311 - DNA, 20 bp, human
gccaccgccgagcccaggct

SEQ ID NO: 391312 - DNA, 20 bp, human
gccgagggaacccgggtgaa

SEQ ID NO: 391313 - DNA, 20 bp, human
gttcgtcaagggccgagcct

SEQ ID NO: 391314 - DNA, 20 bp, human
gggcccttgacgaagttcgc

SEQ ID NO: 391315 - DNA, 20 bp, human
gggggccgcgttgggcggat

SEQ ID NO: 391316 - DNA, 20 bp, human
gggacctgccgcaacgggac

SEQ ID NO: 391317 - DNA, 20 bp, human
ggggaagccgagacaaacag

SEQ ID NO: 391318 - DNA, 20 bp, human
ggaagcgcgagacgggccgg

SEQ ID NO: 391319 - DNA, 20 bp, human
gacggcggggtgggcggatg

SEQ ID NO: 391320 - DNA, 20 bp, human
gcaacgggacgggcgcgcta

SEQ ID NO: 391321 - DNA, 20 bp, human
gaagccgagacaaacagcgg

SEQ ID NO: 391322 - DNA, 20 bp, human
ggccaatggaagcgcgagac

SEQ ID NO: 391323 - DNA, 20 bp, human
gaggacccgagcgggccaat

SEQ ID NO: 391324 - DNA, 20 bp, human
ggggcgggacctgccgcaac

SEQ ID NO: 391325 - DNA, 20 bp, human
gcgggacgggcgcgctaggg

SEQ ID NO: 391326 - DNA, 20 bp, human
ggggagtcacggagagatca

SEQ ID NO: 391327 - DNA, 20 bp, human
gggaccagcgcgtcatgcat

SEQ ID NO: 391328 - DNA, 20 bp, human
gcgcgtcatgcatgggaaga

SEQ ID NO: 391329 - DNA, 20 bp, human
ggtagcgtactcatcctccc

SEQ ID NO: 391330 - DNA, 20 bp, human
ggctaaagtgtgcgcccggg

SEQ ID NO: 391331 - DNA, 20 bp, human
gcctaggcagtggggtccag

SEQ ID NO: 391332 - DNA, 20 bp, human
gtctcattgaagcgaggctg

SEQ ID NO: 391333 - DNA, 20 bp, human
ggctgggaggtccctttaaa

SEQ ID NO: 391334 - DNA, 20 bp, human
gcattgaagcgaggctgggg

SEQ ID NO: 391335 - DNA, 20 bp, human
gggcctggtggacggaactt

SEQ ID NO: 391336 - DNA, 20 bp, human
gcccccgaatcgcagtgctt

SEQ ID NO: 391337 - DNA, 20 bp, human
gagcccaagcactgcgattc

SEQ ID NO: 391338 - DNA, 20 bp, human
ggggccggctcgcaagaacg

SEQ ID NO: 391339 - DNA, 20 bp, human
gggccacagggcggatgaga

SEQ ID NO: 391340 - DNA, 20 bp, human
gcccggggagactcagccga

SEQ ID NO: 391341 - DNA, 20 bp, human
ggggaagaaccgtttggagc

SEQ ID NO: 391342 - DNA, 20 bp, human
ggcagtgcttgggctccgcg

SEQ ID NO: 391343 - DNA, 20 bp, human
ggcaacgttgctttaaaagg

SEQ ID NO: 391344 - DNA, 20 bp, human
gtcggtccagcggcgtcgag

SEQ ID NO: 391345 - DNA, 20 bp, human
ggcgtggcagagcgtgcagg

SEQ ID NO: 391346 - DNA, 20 bp, human
gcctcttggcggtcctatgt

SEQ ID NO: 391347 - DNA, 20 bp, human
gcgggctcccctaatccccc

SEQ ID NO: 391348 - DNA, 20 bp, human
gaccgcccccagcaagggga

SEQ ID NO: 391349 - DNA, 20 bp, human
gagatggaggtctccgacat

SEQ ID NO: 391350 - DNA, 20 bp, human
gcttccagggatcccccgat

SEQ ID NO: 391351 - DNA, 20 bp, human
ggattaggggagcccgagct

SEQ ID NO: 391352 - DNA, 20 bp, human
ggggccggagaacagcgccc

SEQ ID NO: 391353 - DNA, 20 bp, human
gaaattgagtcacccatcgg

SEQ ID NO: 391354 - DNA, 20 bp, human
gtccccttccacgcccctct

SEQ ID NO: 391355 - DNA, 20 bp, human
ggacctccatctcccggccg

SEQ ID NO: 391356 - DNA, 20 bp, human
ggcgccaaggacacgtccgg

SEQ ID NO: 391357 - DNA, 20 bp, human
gcaggcggccagcttcggcc

SEQ ID NO: 391358 - DNA, 20 bp, human
ggcttcggccggggaaggaa

SEQ ID NO: 391359 - DNA, 20 bp, human
gaagccgccggacgtgtcct

SEQ ID NO: 391360 - DNA, 20 bp, human
gctaaccttgcgctaggcac

SEQ ID NO: 391361 - DNA, 20 bp, human
gcgtgtccttggcgcaaggg

SEQ ID NO: 391362 - DNA, 20 bp, human
gcgcaaggttaggtgcatgc

SEQ ID NO: 391363 - DNA, 20 bp, human
gctcgctcggaaagcggcag

SEQ ID NO: 391364 - DNA, 20 bp, human
gctggacggtgggaattcgt

SEQ ID NO: 391365 - DNA, 20 bp, human
gagttggcaggagtaaccca

SEQ ID NO: 391366 - DNA, 20 bp, human
gcccttcgagggaccaggaa

SEQ ID NO: 391367 - DNA, 20 bp, human
ggggatcgggcggagatcgg

SEQ ID NO: 391368 - DNA, 20 bp, human
gcggcaccgctgcctactgg

SEQ ID NO: 391369 - DNA, 20 bp, human
gggacaaagtagttccccga

SEQ ID NO: 391370 - DNA, 20 bp, human
gctccgcccgatcccttcga

SEQ ID NO: 391371 - DNA, 20 bp, human
gcgagccgggaggcgtggga

SEQ ID NO: 391372 - DNA, 20 bp, human
ggaccggcaccgctgcctac

SEQ ID NO: 391373 - DNA, 20 bp, human
gccgcggacgagcccgtaac

SEQ ID NO: 391374 - DNA, 20 bp, human
gctgctgagagagtcgagcc

SEQ ID NO: 391375 - DNA, 20 bp, human
gtgtcctcgggctccggtta

SEQ ID NO: 391376 - DNA, 20 bp, human
ggccgccgcctcaccctcgt

SEQ ID NO: 391377 - DNA, 20 bp, human
gggaacagctggcacccggt

SEQ ID NO: 391378 - DNA, 20 bp, human
gccagcgagctcggcaacct

SEQ ID NO: 391379 - DNA, 20 bp, human
gctccaggaccggggtgagt

SEQ ID NO: 391380 - DNA, 20 bp, human
gaacctcggcgcagcgagcg

SEQ ID NO: 391381 - DNA, 20 bp, human
gggaaccgggcacacgtgag

SEQ ID NO: 391382 - DNA, 20 bp, human
ggtggcggccaaggtccgac

SEQ ID NO: 391383 - DNA, 20 bp, human
gcggcgcggcccagcgagct

SEQ ID NO: 391384 - DNA, 20 bp, human
ggctgggccgcgccggaaac

SEQ ID NO: 391385 - DNA, 20 bp, human
ggagtggcgctcgtcctacg

SEQ ID NO: 391386 - DNA, 20 bp, human
gaagcaggaggcgcacagat

SEQ ID NO: 391387 - DNA, 20 bp, human
gcactgacagagctcgactc

SEQ ID NO: 391388 - DNA, 20 bp, human
gagatgggcgggatctgcac

SEQ ID NO: 391389 - DNA, 20 bp, human
gtgacagagctcgactccgg

SEQ ID NO: 391390 - DNA, 20 bp, human
ggcggtgcgaccttgcgggg

SEQ ID NO: 391391 - DNA, 20 bp, human
gtgggcgggatctgcactgg

SEQ ID NO: 391392 - DNA, 20 bp, human
gggcggaacccgcgtgagag

SEQ ID NO: 391393 - DNA, 20 bp, human
gagagaggttggtgttgcga

SEQ ID NO: 391394 - DNA, 20 bp, human
ggaacccgcgtgagagaggt

SEQ ID NO: 391395 - DNA, 20 bp, human
gcttgccaatcgctaaacgt

SEQ ID NO: 391396 - DNA, 20 bp, human
ggggctgactcagggagaaa

SEQ ID NO: 391397 - DNA, 20 bp, human
gagagccctcccctctcggc

SEQ ID NO: 391398 - DNA, 20 bp, human
gtgaccctcccccaggaatg

SEQ ID NO: 391399 - DNA, 20 bp, human
gggggatcccgagtcactgg

SEQ ID NO: 391400 - DNA, 20 bp, human
gccctcccctctcggcagga

SEQ ID NO: 391401 - DNA, 20 bp, human
gcagccccctcctgccgaga

SEQ ID NO: 391402 - DNA, 20 bp, human
gtggcagtttagggcctagg

SEQ ID NO: 391403 - DNA, 20 bp, human
gcccgcaacccccagtgact

SEQ ID NO: 391404 - DNA, 20 bp, human
gccgggggatcccgagtcac

SEQ ID NO: 391405 - DNA, 20 bp, human
gcccctcctgccgagagggg

SEQ ID NO: 391406 - DNA, 20 bp, human
gcctcagcctgctctcggat

SEQ ID NO: 391407 - DNA, 20 bp, human
ggtccaggacgcaaaggcgc

SEQ ID NO: 391408 - DNA, 20 bp, human
ggagacaggtattagaactc

SEQ ID NO: 391409 - DNA, 20 bp, human
gctactcccaaagggtgagg

SEQ ID NO: 391410 - DNA, 20 bp, human
ggtgaggcggaaaagaggcg

SEQ ID NO: 391411 - DNA, 20 bp, human
gacagtgcgcccttccactt

SEQ ID NO: 391412 - DNA, 20 bp, human
gcccctactcccaaagggtg

SEQ ID NO: 391413 - DNA, 20 bp, human
gacgccggtccaggacgcaa

SEQ ID NO: 391414 - DNA, 20 bp, human
gggccgaccaatccgagagc

SEQ ID NO: 391415 - DNA, 20 bp, human
gagggatgatcctgtgaatt

SEQ ID NO: 391416 - DNA, 20 bp, human
gaaaagacggcgggtagttg

SEQ ID NO: 391417 - DNA, 20 bp, human
ggtgactgcagtcaactaac

SEQ ID NO: 391418 - DNA, 20 bp, human
gatccgcgcaggcgcataga

SEQ ID NO: 391419 - DNA, 20 bp, human
gcaaagcctgagatccgcgc

SEQ ID NO: 391420 - DNA, 20 bp, human
gtttgtagcgaggttgctta

SEQ ID NO: 391421 - DNA, 20 bp, human
ggtagcgaggttgcttaggg

SEQ ID NO: 391422 - DNA, 20 bp, human
ggatctcaggctttgtagcg

SEQ ID NO: 391423 - DNA, 20 bp, human
gatgcgcctgcgcggatctc

SEQ ID NO: 391424 - DNA, 20 bp, human
gtgactgcagtcacgtcgcc

SEQ ID NO: 391425 - DNA, 20 bp, human
gggcgcatagacggttgcca

SEQ ID NO: 391426 - DNA, 20 bp, human
ggggacgtgtcctctcccag

SEQ ID NO: 391427 - DNA, 20 bp, human
gcgcgctgatcgtgctgttc

SEQ ID NO: 391428 - DNA, 20 bp, human
gggcgcccaggtcctaattc

SEQ ID NO: 391429 - DNA, 20 bp, human
gtaatcacagtggatcccct

SEQ ID NO: 391430 - DNA, 20 bp, human
ggccatgttggcacagtggg

SEQ ID NO: 391431 - DNA, 20 bp, human
gtgaggaaacgtacggtggg

SEQ ID NO: 391432 - DNA, 20 bp, human
gtgggcgaatcacatgatag

SEQ ID NO: 391433 - DNA, 20 bp, human
gaagaggaccaataagtgtt

SEQ ID NO: 391434 - DNA, 20 bp, human
ggatcagcgcgcttccttta

SEQ ID NO: 391435 - DNA, 20 bp, human
gcccacccactgtgccaaca

SEQ ID NO: 391436 - DNA, 20 bp, human
gaggggcggtagttacgcag

SEQ ID NO: 391437 - DNA, 20 bp, human
gagcccttgttgctagtagg

SEQ ID NO: 391438 - DNA, 20 bp, human
gtacgcagtggaggctacgg

SEQ ID NO: 391439 - DNA, 20 bp, human
gagccccctactagcaacaa

SEQ ID NO: 391440 - DNA, 20 bp, human
gcgaacccgcaatggaagaa

SEQ ID NO: 391441 - DNA, 20 bp, human
gctagcaacaagggcttccg

SEQ ID NO: 391442 - DNA, 20 bp, human
gtaaccaggccaacccagaa

SEQ ID NO: 391443 - DNA, 20 bp, human
gggtctggagttagtgtttt

SEQ ID NO: 391444 - DNA, 20 bp, human
gaaggggaggggtttatgcg

SEQ ID NO: 391445 - DNA, 20 bp, human
ggggagcgccaaccagtgcc

SEQ ID NO: 391446 - DNA, 20 bp, human
gacgcagctccctaccgcca

SEQ ID NO: 391447 - DNA, 20 bp, human
gactcccagccctggcggta

SEQ ID NO: 391448 - DNA, 20 bp, human
ggctccctaccgccagggct

SEQ ID NO: 391449 - DNA, 20 bp, human
gtcggagcggagttacgaag

SEQ ID NO: 391450 - DNA, 20 bp, human
gccagcagacggggagacag

SEQ ID NO: 391451 - DNA, 20 bp, human
ggctggacattgcgaaactg

SEQ ID NO: 391452 - DNA, 20 bp, human
gagccctgtgaagttggtaa

SEQ ID NO: 391453 - DNA, 20 bp, human
gtcgtggggccgagccggag

SEQ ID NO: 391454 - DNA, 20 bp, human
gggccccacgagcaccctgc

SEQ ID NO: 391455 - DNA, 20 bp, human
gacaggaagcgggagtggag

SEQ ID NO: 391456 - DNA, 20 bp, human
gagaggagacggctgtcagt

SEQ ID NO: 391457 - DNA, 20 bp, human
gacggctgtcagtaggcaac

SEQ ID NO: 391458 - DNA, 20 bp, human
gagaagcgccttagaggaga

SEQ ID NO: 391459 - DNA, 20 bp, human
gagggagagggcggaacttc

SEQ ID NO: 391460 - DNA, 20 bp, human
gactacgctctcagttgtca

SEQ ID NO: 391461 - DNA, 20 bp, human
gccccagcgaccgctctggt

SEQ ID NO: 391462 - DNA, 20 bp, human
ggtgacgtaaaaagcagcgc

SEQ ID NO: 391463 - DNA, 20 bp, human
ggtaaaaagcagcgccggaa

SEQ ID NO: 391464 - DNA, 20 bp, human
gagcagcgccggaagggaga

SEQ ID NO: 391465 - DNA, 20 bp, human
ggctaaaagaagcgccttag

SEQ ID NO: 391466 - DNA, 20 bp, human
gtcggagcgcgagaaacgtc

SEQ ID NO: 391467 - DNA, 20 bp, human
gagcgctggtagctggtgag

SEQ ID NO: 391468 - DNA, 20 bp, human
ggagcctgaagggccggaag

SEQ ID NO: 391469 - DNA, 20 bp, human
gaactccggccgctgtggga

SEQ ID NO: 391470 - DNA, 20 bp, human
gctcacctgtgaatgcctgg

SEQ ID NO: 391471 - DNA, 20 bp, human
gtccgaaactccggccgctg

SEQ ID NO: 391472 - DNA, 20 bp, human
gtggagactgggctttggga

SEQ ID NO: 391473 - DNA, 20 bp, human
gcggaagcggaagctctgcg

SEQ ID NO: 391474 - DNA, 20 bp, human
gcgctccgagtccgaaactc

SEQ ID NO: 391475 - DNA, 20 bp, human
gtgggagacccctaaccacc

SEQ ID NO: 391476 - DNA, 20 bp, human
gatccccggaagtgaggcag

SEQ ID NO: 391477 - DNA, 20 bp, human
gggtaggtgaaagacctgtc

SEQ ID NO: 391478 - DNA, 20 bp, human
gtagccaggagaaccggaag

SEQ ID NO: 391479 - DNA, 20 bp, human
gaggagcatccccggaagtg

SEQ ID NO: 391480 - DNA, 20 bp, human
gtctcagcaggaggttccta

SEQ ID NO: 391481 - DNA, 20 bp, human
gctcgtgtttgtgggagctg

SEQ ID NO: 391482 - DNA, 20 bp, human
gcgcgcctgcgcagtggagg

SEQ ID NO: 391483 - DNA, 20 bp, human
gtgtgggagctgaggtaggt

SEQ ID NO: 391484 - DNA, 20 bp, human
gctccgctgcctcacttccg

SEQ ID NO: 391485 - DNA, 20 bp, human
gctaccggaagcgtctcagc

SEQ ID NO: 391486 - DNA, 20 bp, human
gaatggcgttgccgttgctg

SEQ ID NO: 391487 - DNA, 20 bp, human
gcacccggccatgccggtgc

SEQ ID NO: 391488 - DNA, 20 bp, human
gccggaaatgacgtgcaaag

SEQ ID NO: 391489 - DNA, 20 bp, human
ggcggccgccatctttttta

SEQ ID NO: 391490 - DNA, 20 bp, human
ggcatggccgggtgagctgc

SEQ ID NO: 391491 - DNA, 20 bp, human
gtgcacgtcatttccggcac

SEQ ID NO: 391492 - DNA, 20 bp, human
gagagagtgcatgaggtttc

SEQ ID NO: 391493 - DNA, 20 bp, human
gttccggcaccggcatggcc

SEQ ID NO: 391494 - DNA, 20 bp, human
gctgttataaatgtcttcct

SEQ ID NO: 391495 - DNA, 20 bp, human
gaggtagcctgcagctcacc

SEQ ID NO: 391496 - DNA, 20 bp, human
gaaccggaagaatccgatgg

SEQ ID NO: 391497 - DNA, 20 bp, human
gcctctcaggctaatcccga

SEQ ID NO: 391498 - DNA, 20 bp, human
gcggttctgcggaggataaa

SEQ ID NO: 391499 - DNA, 20 bp, human
ggattcttccggttctgcgg

SEQ ID NO: 391500 - DNA, 20 bp, human
gcagaaccggaagaatccga

SEQ ID NO: 391501 - DNA, 20 bp, human
gagccaccatcggattcttc

SEQ ID NO: 391502 - DNA, 20 bp, human
gaggcagccatgtttgttaa

SEQ ID NO: 391503 - DNA, 20 bp, human
ggataaagggaagacggttg

SEQ ID NO: 391504 - DNA, 20 bp, human
gggaggtcgccataattcta

SEQ ID NO: 391505 - DNA, 20 bp, human
gtggcgctcggcttctgcgg

SEQ ID NO: 391506 - DNA, 20 bp, human
ggggtgctgtagtctttgtt

SEQ ID NO: 391507 - DNA, 20 bp, human
gcgcagaagcgtactgggga

SEQ ID NO: 391508 - DNA, 20 bp, human
gagactgcgcagtgtatcct

SEQ ID NO: 391509 - DNA, 20 bp, human
gactggggacggcgtccaat

SEQ ID NO: 391510 - DNA, 20 bp, human
gtaagagggttcggtttcta

SEQ ID NO: 391511 - DNA, 20 bp, human
gacactgcgcagtctggggg

SEQ ID NO: 391512 - DNA, 20 bp, human
gaatctaagcgagcgctgtg

SEQ ID NO: 391513 - DNA, 20 bp, human
ggggctggatccaaggagtg

SEQ ID NO: 391514 - DNA, 20 bp, human
gagcaggcatacagttggtg

SEQ ID NO: 391515 - DNA, 20 bp, human
gactgcgcagaagcgtactg

SEQ ID NO: 391516 - DNA, 20 bp, human
gcgcgctggcggactaagag

SEQ ID NO: 391517 - DNA, 20 bp, human
gcggcccgcccgtcagccag

SEQ ID NO: 391518 - DNA, 20 bp, human
gcgctcctctggctgacggg

SEQ ID NO: 391519 - DNA, 20 bp, human
gcccgcgcgcacttccgtcc

SEQ ID NO: 391520 - DNA, 20 bp, human
ggagctggctaaagtggttg

SEQ ID NO: 391521 - DNA, 20 bp, human
gccgggagtgcgcgctcctc

SEQ ID NO: 391522 - DNA, 20 bp, human
gaagtgcgcgcgggtgtcgc

SEQ ID NO: 391523 - DNA, 20 bp, human
ggggccggggccgttatcag

SEQ ID NO: 391524 - DNA, 20 bp, human
gcccgcctggggcgaagccg

SEQ ID NO: 391525 - DNA, 20 bp, human
gcttcccgccaaaacgcccg

SEQ ID NO: 391526 - DNA, 20 bp, human
ggcagacatcagatccctaa

SEQ ID NO: 391527 - DNA, 20 bp, human
gaactgcgttagccatccca

SEQ ID NO: 391528 - DNA, 20 bp, human
gcatcagatccctaacgggt

SEQ ID NO: 391529 - DNA, 20 bp, human
gttaaactgcaagcacccct

SEQ ID NO: 391530 - DNA, 20 bp, human
gtgtagatccaccaatggga

SEQ ID NO: 391531 - DNA, 20 bp, human
gccaatcttccaacccgtta

SEQ ID NO: 391532 - DNA, 20 bp, human
gtccgtgaaatggcatcctt

SEQ ID NO: 391533 - DNA, 20 bp, human
gatccaccaatgggacggtg

SEQ ID NO: 391534 - DNA, 20 bp, human
gtctttcctcaccgtcccat

SEQ ID NO: 391535 - DNA, 20 bp, human
gacagggtggttccgtgaaa

SEQ ID NO: 391536 - DNA, 20 bp, human
gcctggcaggggttgaactg

SEQ ID NO: 391537 - DNA, 20 bp, human
gcgcgttgacgtcatggagg

SEQ ID NO: 391538 - DNA, 20 bp, human
ggttgaactgtggagtgtgt

SEQ ID NO: 391539 - DNA, 20 bp, human
gagcaggaaaggatctccag

SEQ ID NO: 391540 - DNA, 20 bp, human
gccaccgggctgcgtcatct

SEQ ID NO: 391541 - DNA, 20 bp, human
gatgacgcagcccggtggcg

SEQ ID NO: 391542 - DNA, 20 bp, human
ggtcatggaggcggggtgct

SEQ ID NO: 391543 - DNA, 20 bp, human
gcggcgcgttgacgtcatgg

SEQ ID NO: 391544 - DNA, 20 bp, human
ggcgttccacacccgctggc

SEQ ID NO: 391545 - DNA, 20 bp, human
gggagatcctttcctgcttt

SEQ ID NO: 391546 - DNA, 20 bp, human
ggaagtacggaatgccggaa

SEQ ID NO: 391547 - DNA, 20 bp, human
gtccaggccctggtgaagta

SEQ ID NO: 391548 - DNA, 20 bp, human
gtgccctgcgctccagtcgt

SEQ ID NO: 391549 - DNA, 20 bp, human
gctctggcgcgaccgacgac

SEQ ID NO: 391550 - DNA, 20 bp, human
gcgaccgacgactggagcgc

SEQ ID NO: 391551 - DNA, 20 bp, human
gaggggtagaggctcgtaga

SEQ ID NO: 391552 - DNA, 20 bp, human
gacggaatgccggaagggcc

SEQ ID NO: 391553 - DNA, 20 bp, human
gatgacgcgcgccctcttcg

SEQ ID NO: 391554 - DNA, 20 bp, human
gctggtgaagtacggaatgc

SEQ ID NO: 391555 - DNA, 20 bp, human
gcttcggcctccgcttcttc

SEQ ID NO: 391556 - DNA, 20 bp, human
gagaagcggcaagacgagag

SEQ ID NO: 391557 - DNA, 20 bp, human
gtggccagacggaagccgag

SEQ ID NO: 391558 - DNA, 20 bp, human
gaagcggcgtgcaacacgtg

SEQ ID NO: 391559 - DNA, 20 bp, human
gagcggcaagacgagagggg

SEQ ID NO: 391560 - DNA, 20 bp, human
gcggaagcggtcttgaggtc

SEQ ID NO: 391561 - DNA, 20 bp, human
gaccgcttccggaagcctct

SEQ ID NO: 391562 - DNA, 20 bp, human
gtctggccaaactccttgat

SEQ ID NO: 391563 - DNA, 20 bp, human
gttcgcttgaggcatttttg

SEQ ID NO: 391564 - DNA, 20 bp, human
gctgggccggaaagcggaag

SEQ ID NO: 391565 - DNA, 20 bp, human
gaagcctctcggcttccgtc

SEQ ID NO: 391566 - DNA, 20 bp, human
gtcgcccaggaaacgtcctc

SEQ ID NO: 391567 - DNA, 20 bp, human
gcctcccagaggacgtttcc

SEQ ID NO: 391568 - DNA, 20 bp, human
ggcggcggccacaacacttc

SEQ ID NO: 391569 - DNA, 20 bp, human
gaaacgtcctctgggagggg

SEQ ID NO: 391570 - DNA, 20 bp, human
gcggggcgcgacgtcatcag

SEQ ID NO: 391571 - DNA, 20 bp, human
gcctccgcgcacgggatcct

SEQ ID NO: 391572 - DNA, 20 bp, human
gatgagggaagaagtcgccc

SEQ ID NO: 391573 - DNA, 20 bp, human
ggctcccaggatcccgtgcg

SEQ ID NO: 391574 - DNA, 20 bp, human
gaacccccaggggccgtcaa

SEQ ID NO: 391575 - DNA, 20 bp, human
gcgcggagccggaagtgttg

SEQ ID NO: 391576 - DNA, 20 bp, human
gggtgcgctaggtcaagcta

SEQ ID NO: 391577 - DNA, 20 bp, human
gctaggtcaagctagggcgc

SEQ ID NO: 391578 - DNA, 20 bp, human
gcccgacgcaggcgcagtcg

SEQ ID NO: 391579 - DNA, 20 bp, human
ggcatggcgcagcagcccga

SEQ ID NO: 391580 - DNA, 20 bp, human
gcgcgcgactgggaaagaag

SEQ ID NO: 391581 - DNA, 20 bp, human
gggaaagaaggggtcgcgct

SEQ ID NO: 391582 - DNA, 20 bp, human
gaccgccccctccccgacgc

SEQ ID NO: 391583 - DNA, 20 bp, human
gtccgcgactgcgcctgcgt

SEQ ID NO: 391584 - DNA, 20 bp, human
gctgcgcctgcgtcggggag

SEQ ID NO: 391585 - DNA, 20 bp, human
gcggccgccgttttcctttt

SEQ ID NO: 391586 - DNA, 20 bp, human
ggagcctcaggggtgagcgc

SEQ ID NO: 391587 - DNA, 20 bp, human
gtagctgcagctggcgaagt

SEQ ID NO: 391588 - DNA, 20 bp, human
ggggaacccgccgcgggaca

SEQ ID NO: 391589 - DNA, 20 bp, human
gtcggcgccccgcgggtcgg

SEQ ID NO: 391590 - DNA, 20 bp, human
gtgagcgcaggccggagaca

SEQ ID NO: 391591 - DNA, 20 bp, human
gagacaggggaacccgccgc

SEQ ID NO: 391592 - DNA, 20 bp, human
ggaggctccaccgacccgcg

SEQ ID NO: 391593 - DNA, 20 bp, human
ggggaaggccggacggaacg

SEQ ID NO: 391594 - DNA, 20 bp, human
gagcgcggaccctacggccg

SEQ ID NO: 391595 - DNA, 20 bp, human
gcggccaagggcgtcctaga

SEQ ID NO: 391596 - DNA, 20 bp, human
gcggaagcctagcgcccagt

SEQ ID NO: 391597 - DNA, 20 bp, human
gcctccgacggcttctgcgc

SEQ ID NO: 391598 - DNA, 20 bp, human
gacagagcatgcgcctccga

SEQ ID NO: 391599 - DNA, 20 bp, human
gctagcgcccagtgggttgc

SEQ ID NO: 391600 - DNA, 20 bp, human
gtaggcttccggatcgcggt

SEQ ID NO: 391601 - DNA, 20 bp, human
gcccgcgcgggcgccaatcc

SEQ ID NO: 391602 - DNA, 20 bp, human
gaactccgcccaccgcgatc

SEQ ID NO: 391603 - DNA, 20 bp, human
gtgaacacactgcccgaccc

SEQ ID NO: 391604 - DNA, 20 bp, human
ggggcgggccagataccacc

SEQ ID NO: 391605 - DNA, 20 bp, human
ggtgggttgcaggaaaaacc

SEQ ID NO: 391606 - DNA, 20 bp, human
gactctgaggggccaaacca

SEQ ID NO: 391607 - DNA, 20 bp, human
gcgggcgcgcctctggggtg

SEQ ID NO: 391608 - DNA, 20 bp, human
gggggggcggggcggattca

SEQ ID NO: 391609 - DNA, 20 bp, human
gcggagcagaatccggcgaa

SEQ ID NO: 391610 - DNA, 20 bp, human
gtggccgtgtctagctgttc

SEQ ID NO: 391611 - DNA, 20 bp, human
ggccctagcggagcagaatc

SEQ ID NO: 391612 - DNA, 20 bp, human
gaggggaccggatgccctag

SEQ ID NO: 391613 - DNA, 20 bp, human
gagaacacggggcggagcga

SEQ ID NO: 391614 - DNA, 20 bp, human
gccctcccccggatggagac

SEQ ID NO: 391615 - DNA, 20 bp, human
ggggagaggcgaaaggggac

SEQ ID NO: 391616 - DNA, 20 bp, human
gtcgccccagcgggcctcgg

SEQ ID NO: 391617 - DNA, 20 bp, human
gtcacggtggggaggagcga

SEQ ID NO: 391618 - DNA, 20 bp, human
gggaagtcgcggcggggcga

SEQ ID NO: 391619 - DNA, 20 bp, human
ggggcggggcccggaccgaa

SEQ ID NO: 391620 - DNA, 20 bp, human
gacgggaggcggaagccctt

SEQ ID NO: 391621 - DNA, 20 bp, human
gggtggggaggagcgacggg

SEQ ID NO: 391622 - DNA, 20 bp, human
ggaggcccgctggggcgaag

SEQ ID NO: 391623 - DNA, 20 bp, human
ggccgccaacccatgtgcgt

SEQ ID NO: 391624 - DNA, 20 bp, human
gaggcggaagcccttcggtc

SEQ ID NO: 391625 - DNA, 20 bp, human
gggccctgaggaaaccggcg

SEQ ID NO: 391626 - DNA, 20 bp, human
ggggagtgataactgaatag

SEQ ID NO: 391627 - DNA, 20 bp, human
ggaaaaagggagctacattg

SEQ ID NO: 391628 - DNA, 20 bp, human
gggaaagttgaaagtaggta

SEQ ID NO: 391629 - DNA, 20 bp, human
gtaggaacggagatacagag

SEQ ID NO: 391630 - DNA, 20 bp, human
ggatagagggtctgtaggaa

SEQ ID NO: 391631 - DNA, 20 bp, human
gaacggagacccccctctgg

SEQ ID NO: 391632 - DNA, 20 bp, human
gggagctacattgaggagaa

SEQ ID NO: 391633 - DNA, 20 bp, human
gggagactgacaggcaggaa

SEQ ID NO: 391634 - DNA, 20 bp, human
ggaagagagacatagacaca

SEQ ID NO: 391635 - DNA, 20 bp, human
gtctggaggcggaaagaggc

SEQ ID NO: 391636 - DNA, 20 bp, human
gggaaggaatagagtcaggc

SEQ ID NO: 391637 - DNA, 20 bp, human
gaagagcagtaagtgaactc

SEQ ID NO: 391638 - DNA, 20 bp, human
gcctctccttcaccatgtaa

SEQ ID NO: 391639 - DNA, 20 bp, human
gagtaagtgaactcaggatg

SEQ ID NO: 391640 - DNA, 20 bp, human
gttaattaaccactgctcag

SEQ ID NO: 391641 - DNA, 20 bp, human
gtggttaattaaaatggggt

SEQ ID NO: 391642 - DNA, 20 bp, human
ggcagtggttaattaaaatg

SEQ ID NO: 391643 - DNA, 20 bp, human
ggggaaggcctttgtggaaa

SEQ ID NO: 391644 - DNA, 20 bp, human
ggggctttagcgaggccaaa

SEQ ID NO: 391645 - DNA, 20 bp, human
gtaaccactgctcagaggaa

SEQ ID NO: 391646 - DNA, 20 bp, human
gggccggccattggcaggac

SEQ ID NO: 391647 - DNA, 20 bp, human
gggcgaggtcgcggtactga

SEQ ID NO: 391648 - DNA, 20 bp, human
gccggggaaggcgtagccac

SEQ ID NO: 391649 - DNA, 20 bp, human
gcgcaggaggggccaaaaga

SEQ ID NO: 391650 - DNA, 20 bp, human
ggcgatgcccgcggattgga

SEQ ID NO: 391651 - DNA, 20 bp, human
gcccagcggcgctccactct

SEQ ID NO: 391652 - DNA, 20 bp, human
gaatccgcgggcatcgcagg

SEQ ID NO: 391653 - DNA, 20 bp, human
ggaggcctcaggaccggcta

SEQ ID NO: 391654 - DNA, 20 bp, human
gtggcccggtcgcgctcccg

SEQ ID NO: 391655 - DNA, 20 bp, human
gactcagccgtccaatccgc

SEQ ID NO: 391656 - DNA, 20 bp, human
gacccgtagcggattcggaa

SEQ ID NO: 391657 - DNA, 20 bp, human
gaagtaggcggggtgacgtg

SEQ ID NO: 391658 - DNA, 20 bp, human
gcgggatcctcgcccctctg

SEQ ID NO: 391659 - DNA, 20 bp, human
gaggctgtcgggaagtaggc

SEQ ID NO: 391660 - DNA, 20 bp, human
gagcggattcggaagggctg

SEQ ID NO: 391661 - DNA, 20 bp, human
gtacgggtgctgcaaggcct

SEQ ID NO: 391662 - DNA, 20 bp, human
gaagagtttcgatgtctcta

SEQ ID NO: 391663 - DNA, 20 bp, human
ggcagcacccgtagcggatt

SEQ ID NO: 391664 - DNA, 20 bp, human
gaggggcaggactcgttccc

SEQ ID NO: 391665 - DNA, 20 bp, human
ggagagcgagaggtggatcg

SEQ ID NO: 391666 - DNA, 20 bp, human
ggagtcaagcgtgtcaggtc

SEQ ID NO: 391667 - DNA, 20 bp, human
gagctgcagcagcgcactga

SEQ ID NO: 391668 - DNA, 20 bp, human
ggtggggggtgtaaagagag

SEQ ID NO: 391669 - DNA, 20 bp, human
gccctgaaggggcgagtcca

SEQ ID NO: 391670 - DNA, 20 bp, human
gggcgagtccaaggcagacg

SEQ ID NO: 391671 - DNA, 20 bp, human
gagaagaaggtgcacgtggt

SEQ ID NO: 391672 - DNA, 20 bp, human
gagctccttcgcaaagaggg

SEQ ID NO: 391673 - DNA, 20 bp, human
gcggagaggaggtagaaacg

SEQ ID NO: 391674 - DNA, 20 bp, human
ggtagtgcaggaagcaggcg

SEQ ID NO: 391675 - DNA, 20 bp, human
gtgcacgtggtgggaaacac

SEQ ID NO: 391676 - DNA, 20 bp, human
gagtaccctgggtgtggaaa

SEQ ID NO: 391677 - DNA, 20 bp, human
gtgaggtgaaccgcagtctg

SEQ ID NO: 391678 - DNA, 20 bp, human
gcctgcggtggggacgcact

SEQ ID NO: 391679 - DNA, 20 bp, human
gaggagcagaggatgacgtg

SEQ ID NO: 391680 - DNA, 20 bp, human
ggctgcagcttccttcgctc

SEQ ID NO: 391681 - DNA, 20 bp, human
gtgtagcgacgacactaggg

SEQ ID NO: 391682 - DNA, 20 bp, human
gcctgcggcaagcggggcgt

SEQ ID NO: 391683 - DNA, 20 bp, human
gaagaggacgagagatctgt

SEQ ID NO: 391684 - DNA, 20 bp, human
gaggagcctgcggcaagggc

SEQ ID NO: 391685 - DNA, 20 bp, human
gaatggagagccagactcgt

SEQ ID NO: 391686 - DNA, 20 bp, human
gttctcttccagaggatcta

SEQ ID NO: 391687 - DNA, 20 bp, human
gaaatcagacagaccgcagg

SEQ ID NO: 391688 - DNA, 20 bp, human
gggagtacgaaggcactcag

SEQ ID NO: 391689 - DNA, 20 bp, human
gtctccagctctgtctgata

SEQ ID NO: 391690 - DNA, 20 bp, human
gtacgaaggcactcagggga

SEQ ID NO: 391691 - DNA, 20 bp, human
gtaggacagcatcgttactc

SEQ ID NO: 391692 - DNA, 20 bp, human
gcgagcggggctctggtgct

SEQ ID NO: 391693 - DNA, 20 bp, human
gggttcaaccaagtcttacc

SEQ ID NO: 391694 - DNA, 20 bp, human
gtacagaaacaagtttccta

SEQ ID NO: 391695 - DNA, 20 bp, human
gaaagcatcacttgttcgtt

SEQ ID NO: 391696 - DNA, 20 bp, human
gcgcccagagaagcgggagt

SEQ ID NO: 391697 - DNA, 20 bp, human
gagggggaggtaaccgccag

SEQ ID NO: 391698 - DNA, 20 bp, human
ggggcggggtgcctttctct

SEQ ID NO: 391699 - DNA, 20 bp, human
gtctgtgcggaccccgagcc

SEQ ID NO: 391700 - DNA, 20 bp, human
gcatcctccagctcttgcaa

SEQ ID NO: 391701 - DNA, 20 bp, human
ggggtccgcacagaccgcgc

SEQ ID NO: 391702 - DNA, 20 bp, human
gcggcagccaccagggacgg

SEQ ID NO: 391703 - DNA, 20 bp, human
gtgccagtcgcccagagaag

SEQ ID NO: 391704 - DNA, 20 bp, human
gaggtggaggctattcgagg

SEQ ID NO: 391705 - DNA, 20 bp, human
gagcggatgagcccagagaa

SEQ ID NO: 391706 - DNA, 20 bp, human
ggaggcgcaagccgcgtggc

SEQ ID NO: 391707 - DNA, 20 bp, human
ggcgtggcagggaccgtgtg

SEQ ID NO: 391708 - DNA, 20 bp, human
ggaaaccggcagtgcaggaa

SEQ ID NO: 391709 - DNA, 20 bp, human
gaggcaggaagcggactcga

SEQ ID NO: 391710 - DNA, 20 bp, human
gtccgccgacggcccactgg

SEQ ID NO: 391711 - DNA, 20 bp, human
ggcgcggcagcggggtaggt

SEQ ID NO: 391712 - DNA, 20 bp, human
ggggaccgtgtgcggcgtgg

SEQ ID NO: 391713 - DNA, 20 bp, human
gtcgccgcagcgcccccagt

SEQ ID NO: 391714 - DNA, 20 bp, human
ggcccccagtgggccgtcgg

SEQ ID NO: 391715 - DNA, 20 bp, human
gggcggaggcgcaagccgcg

SEQ ID NO: 391716 - DNA, 20 bp, human
ggggcactggcgaaggtgaa

SEQ ID NO: 391717 - DNA, 20 bp, human
gcgaaggtgaaaggtgagga

SEQ ID NO: 391718 - DNA, 20 bp, human
ggacacggggaaactgacag

SEQ ID NO: 391719 - DNA, 20 bp, human
gctggcgaaggtgaaaggtg

SEQ ID NO: 391720 - DNA, 20 bp, human
gaataactgagcatccaaag

SEQ ID NO: 391721 - DNA, 20 bp, human
gggagtgggtgcgcttgaag

SEQ ID NO: 391722 - DNA, 20 bp, human
gtgggtgggcggatgagcac

SEQ ID NO: 391723 - DNA, 20 bp, human
gaggagggccgatctgttac

SEQ ID NO: 391724 - DNA, 20 bp, human
gagtttcagggcactggcga

SEQ ID NO: 391725 - DNA, 20 bp, human
gactggctgcgtgaagggag

SEQ ID NO: 391726 - DNA, 20 bp, human
gctatctcggccaatcaaaa

SEQ ID NO: 391727 - DNA, 20 bp, human
gagagtctcctcccctactg

SEQ ID NO: 391728 - DNA, 20 bp, human
gcagaagtatatttctatct

SEQ ID NO: 391729 - DNA, 20 bp, human
gttgtacagaccattttgat

SEQ ID NO: 391730 - DNA, 20 bp, human
gtcctgtcgcagtgtggtta

SEQ ID NO: 391731 - DNA, 20 bp, human
gttgcacagaccattctgat

SEQ ID NO: 391732 - DNA, 20 bp, human
gtagcattcctcagtagggg

SEQ ID NO: 391733 - DNA, 20 bp, human
ggaacatagcattcctcagt

SEQ ID NO: 391734 - DNA, 20 bp, human
gactgccaattgctcattaa

SEQ ID NO: 391735 - DNA, 20 bp, human
ggagtatcccctggtttctt

SEQ ID NO: 391736 - DNA, 20 bp, human
gggtatgagcctgaactagg

SEQ ID NO: 391737 - DNA, 20 bp, human
gagagtgcgggggatgaagg

SEQ ID NO: 391738 - DNA, 20 bp, human
ggaaaaaaagagtgcgtgcc

SEQ ID NO: 391739 - DNA, 20 bp, human
gggcggtatgagcctgaact

SEQ ID NO: 391740 - DNA, 20 bp, human
ggagccaactaaatagtgga

SEQ ID NO: 391741 - DNA, 20 bp, human
gtggaaacgtgggaaacatc

SEQ ID NO: 391742 - DNA, 20 bp, human
gtaccaactgcggacttcgt

SEQ ID NO: 391743 - DNA, 20 bp, human
gttagtaaggataccaactg

SEQ ID NO: 391744 - DNA, 20 bp, human
ggtcgctcggatccctttaa

SEQ ID NO: 391745 - DNA, 20 bp, human
gttaaaggtggggatcttga

SEQ ID NO: 391746 - DNA, 20 bp, human
gtgtgtgtgatgtactattc

SEQ ID NO: 391747 - DNA, 20 bp, human
gagggcaggtagaaatcctg

SEQ ID NO: 391748 - DNA, 20 bp, human
gtcaagctacgtcggggaga

SEQ ID NO: 391749 - DNA, 20 bp, human
gcatgctgccttatataacg

SEQ ID NO: 391750 - DNA, 20 bp, human
gtagaaatcctgaggagcta

SEQ ID NO: 391751 - DNA, 20 bp, human
gaatcctgaggagctatggc

SEQ ID NO: 391752 - DNA, 20 bp, human
gacacacacctcgttatata

SEQ ID NO: 391753 - DNA, 20 bp, human
gtccccgacgtagcttgaaa

SEQ ID NO: 391754 - DNA, 20 bp, human
gatgtactattctggggcag

SEQ ID NO: 391755 - DNA, 20 bp, human
gccgacgtagcttgaaaggg

SEQ ID NO: 391756 - DNA, 20 bp, human
ggagctgagacccacagcct

SEQ ID NO: 391757 - DNA, 20 bp, human
gctggaaaggcgcattgcga

SEQ ID NO: 391758 - DNA, 20 bp, human
gcctcagatgccagcagcaa

SEQ ID NO: 391759 - DNA, 20 bp, human
gacggggcgaaaatgcgcac

SEQ ID NO: 391760 - DNA, 20 bp, human
gcggttggccaggtgggcac

SEQ ID NO: 391761 - DNA, 20 bp, human
gactcaggcggttggccagg

SEQ ID NO: 391762 - DNA, 20 bp, human
ggtgtcgctgccagattaac

SEQ ID NO: 391763 - DNA, 20 bp, human
gtctctgagactcaggcggt

SEQ ID NO: 391764 - DNA, 20 bp, human
gtctggatgccaccctccaa

SEQ ID NO: 391765 - DNA, 20 bp, human
gcagaggcccggtgcccacc

SEQ ID NO: 391766 - DNA, 20 bp, human
gtactcccccagagtgtccg

SEQ ID NO: 391767 - DNA, 20 bp, human
gctggggcccccggacactc

SEQ ID NO: 391768 - DNA, 20 bp, human
gtgtccgggggccccagcca

SEQ ID NO: 391769 - DNA, 20 bp, human
gtcccagcggccgttcataa

SEQ ID NO: 391770 - DNA, 20 bp, human
gggcagctgggaacatgtgc

SEQ ID NO: 391771 - DNA, 20 bp, human
gcagctgcacccgtggggga

SEQ ID NO: 391772 - DNA, 20 bp, human
gcggatgagggcttcacatg

SEQ ID NO: 391773 - DNA, 20 bp, human
ggagctgtgtcccttggctg

SEQ ID NO: 391774 - DNA, 20 bp, human
ggcaggctgatgaagagaac

SEQ ID NO: 391775 - DNA, 20 bp, human
ggatgaagagaaccggatga

SEQ ID NO: 391776 - DNA, 20 bp, human
ggggtcctgggtctcgttgt

SEQ ID NO: 391777 - DNA, 20 bp, human
gcgtgcccccaaccctccga

SEQ ID NO: 391778 - DNA, 20 bp, human
gtgtgccttcggagggttgg

SEQ ID NO: 391779 - DNA, 20 bp, human
gcgcgcgagggtccggttcc

SEQ ID NO: 391780 - DNA, 20 bp, human
gaaggcacacatccgcgcga

SEQ ID NO: 391781 - DNA, 20 bp, human
gaaggcagggcaggagtcgc

SEQ ID NO: 391782 - DNA, 20 bp, human
gcctgaatggccaacgggag

SEQ ID NO: 391783 - DNA, 20 bp, human
ggggagggcgggctcgcagg

SEQ ID NO: 391784 - DNA, 20 bp, human
gtagagccaaggacacgcca

SEQ ID NO: 391785 - DNA, 20 bp, human
gcggcgcgggagacgctctc

SEQ ID NO: 391786 - DNA, 20 bp, human
gaacgcaggtcaggcgttgg

SEQ ID NO: 391787 - DNA, 20 bp, human
gagaactggtacggggggag

SEQ ID NO: 391788 - DNA, 20 bp, human
ggctttgctagcttggtttg

SEQ ID NO: 391789 - DNA, 20 bp, human
gagccaggaggatcgcaaaa

SEQ ID NO: 391790 - DNA, 20 bp, human
gagggactgagaactggtac

SEQ ID NO: 391791 - DNA, 20 bp, human
ggtaaacgcaggtcaggcgt

SEQ ID NO: 391792 - DNA, 20 bp, human
ggactgagaactggtacggg

SEQ ID NO: 391793 - DNA, 20 bp, human
gctgcctgctgcttcgggga

SEQ ID NO: 391794 - DNA, 20 bp, human
gctgacctgcgtttactggg

SEQ ID NO: 391795 - DNA, 20 bp, human
gaccacaggctgttttgtgc

SEQ ID NO: 391796 - DNA, 20 bp, human
ggccgcgataaggggacaga

SEQ ID NO: 391797 - DNA, 20 bp, human
ggggtcccaggccgcgataa

SEQ ID NO: 391798 - DNA, 20 bp, human
gtccctctgtccccttatcg

SEQ ID NO: 391799 - DNA, 20 bp, human
gccggacctctgcacccccc

SEQ ID NO: 391800 - DNA, 20 bp, human
gcccaggctaggctggaaag

SEQ ID NO: 391801 - DNA, 20 bp, human
gcacacaggggagactccaa

SEQ ID NO: 391802 - DNA, 20 bp, human
gggggtgcagaggtccgggc

SEQ ID NO: 391803 - DNA, 20 bp, human
gccaagggcaagcgcgagat

SEQ ID NO: 391804 - DNA, 20 bp, human
gtgtccccttatcgcggcct

SEQ ID NO: 391805 - DNA, 20 bp, human
gagggggagacaaagactta

SEQ ID NO: 391806 - DNA, 20 bp, human
gaacctgaggtgccctgagt

SEQ ID NO: 391807 - DNA, 20 bp, human
gccacctccctcccctcagg

SEQ ID NO: 391808 - DNA, 20 bp, human
gtccctggggcagagatgcc

SEQ ID NO: 391809 - DNA, 20 bp, human
gtctccagaggccttttgtg

SEQ ID NO: 391810 - DNA, 20 bp, human
gagcagagccagccccctga

SEQ ID NO: 391811 - DNA, 20 bp, human
gctgggaaggagcttggttg

SEQ ID NO: 391812 - DNA, 20 bp, human
gtctccttgtgcatgttggc

SEQ ID NO: 391813 - DNA, 20 bp, human
gcaacatgcacaaggagacc

SEQ ID NO: 391814 - DNA, 20 bp, human
gtctccagccaacatgcaca

SEQ ID NO: 391815 - DNA, 20 bp, human
ggcgagtgtcggagctgcag

SEQ ID NO: 391816 - DNA, 20 bp, human
gaagaataacgaggatcaaa

SEQ ID NO: 391817 - DNA, 20 bp, human
ggacatgcccaataagtcac

SEQ ID NO: 391818 - DNA, 20 bp, human
ggttactgttgagtcagtgt

SEQ ID NO: 391819 - DNA, 20 bp, human
ggatctgtcacaataccttt

SEQ ID NO: 391820 - DNA, 20 bp, human
gaaaaggcagcgtgtggagg

SEQ ID NO: 391821 - DNA, 20 bp, human
gttaggtaactgaagccgaa

SEQ ID NO: 391822 - DNA, 20 bp, human
gtgagtcagtgtggggcgtg

SEQ ID NO: 391823 - DNA, 20 bp, human
gtgtaaaaggcagcgtgtgg

SEQ ID NO: 391824 - DNA, 20 bp, human
gttactacctgtgacttatt

SEQ ID NO: 391825 - DNA, 20 bp, human
gggctgtaaaaggcagcgtg

SEQ ID NO: 391826 - DNA, 20 bp, human
gacaggccaggcctagttag

SEQ ID NO: 391827 - DNA, 20 bp, human
ggtcccgcctaggtacccaa

SEQ ID NO: 391828 - DNA, 20 bp, human
gaacccagaggcggtcggcg

SEQ ID NO: 391829 - DNA, 20 bp, human
gggaggcggcctggaatcga

SEQ ID NO: 391830 - DNA, 20 bp, human
ggaacaccccaccactttct

SEQ ID NO: 391831 - DNA, 20 bp, human
gcgccacgccgaccgcctct

SEQ ID NO: 391832 - DNA, 20 bp, human
ggggttcccagaaagtggtg

SEQ ID NO: 391833 - DNA, 20 bp, human
gtaggtacccaacggagata

SEQ ID NO: 391834 - DNA, 20 bp, human
gcgcgccgcgcgcacgcgct

SEQ ID NO: 391835 - DNA, 20 bp, human
ggcgggtcgggtcacgtgaa

SEQ ID NO: 391836 - DNA, 20 bp, human
gtagcagtggaatacgagta

SEQ ID NO: 391837 - DNA, 20 bp, human
ggtggaatacgagtagggaa

SEQ ID NO: 391838 - DNA, 20 bp, human
gaaattgctgctatgcttgg

SEQ ID NO: 391839 - DNA, 20 bp, human
gagccccgccttcttctctg

SEQ ID NO: 391840 - DNA, 20 bp, human
gcaagctaagagcaggaatt

SEQ ID NO: 391841 - DNA, 20 bp, human
gaggcaagagggcatcatgg

SEQ ID NO: 391842 - DNA, 20 bp, human
gactgcatttagttggtatg

SEQ ID NO: 391843 - DNA, 20 bp, human
gaatggataattagtgaaca

SEQ ID NO: 391844 - DNA, 20 bp, human
ggctaaattgctgctatgct

SEQ ID NO: 391845 - DNA, 20 bp, human
gctgaggttcttttaagcag

SEQ ID NO: 391846 - DNA, 20 bp, human
gtgtctggggaacgtcggtt

SEQ ID NO: 391847 - DNA, 20 bp, human
gcgttcacagacgggaggtg

SEQ ID NO: 391848 - DNA, 20 bp, human
gggagcgccgcaaatgagag

SEQ ID NO: 391849 - DNA, 20 bp, human
gggcggggcgggaaggtagc

SEQ ID NO: 391850 - DNA, 20 bp, human
gtgaacgtgcgggctggaaa

SEQ ID NO: 391851 - DNA, 20 bp, human
gctcccgtctgtgaacgtgc

SEQ ID NO: 391852 - DNA, 20 bp, human
gacgcgcgctgtctctttaa

SEQ ID NO: 391853 - DNA, 20 bp, human
gaagacgaggacttaccttg

SEQ ID NO: 391854 - DNA, 20 bp, human
gctgagtgtctggggaacgt

SEQ ID NO: 391855 - DNA, 20 bp, human
gcatttgcggcgctccgact

SEQ ID NO: 391856 - DNA, 20 bp, human
gggcacttccgcttcgggga

SEQ ID NO: 391857 - DNA, 20 bp, human
ggcgcggggacccctttcca

SEQ ID NO: 391858 - DNA, 20 bp, human
ggaaaagccgcgtggaaagg

SEQ ID NO: 391859 - DNA, 20 bp, human
ggcggcggggacaaacctcc

SEQ ID NO: 391860 - DNA, 20 bp, human
gaggaggtctgcgacagagg

SEQ ID NO: 391861 - DNA, 20 bp, human
gcctaccatccagaggtctt

SEQ ID NO: 391862 - DNA, 20 bp, human
gcgcctgaacccaagacctc

SEQ ID NO: 391863 - DNA, 20 bp, human
ggggacccctttccagggcc

SEQ ID NO: 391864 - DNA, 20 bp, human
gcaggggtctgcctccgacc

SEQ ID NO: 391865 - DNA, 20 bp, human
ggtgagcgcccgctggaggc

SEQ ID NO: 391866 - DNA, 20 bp, human
ggctcggcctctcaaacctg

SEQ ID NO: 391867 - DNA, 20 bp, human
gcccccggaggtctgggaaa

SEQ ID NO: 391868 - DNA, 20 bp, human
gcaggagccacaggtttgag

SEQ ID NO: 391869 - DNA, 20 bp, human
gctcctgcccccggaggtct

SEQ ID NO: 391870 - DNA, 20 bp, human
ggctgcccgccacacagtac

SEQ ID NO: 391871 - DNA, 20 bp, human
gggtaagtgctctgcagccc

SEQ ID NO: 391872 - DNA, 20 bp, human
ggagaggcctaagagagtta

SEQ ID NO: 391873 - DNA, 20 bp, human
gggtccccaaacctggagta

SEQ ID NO: 391874 - DNA, 20 bp, human
gacgctagttttgacgtcgc

SEQ ID NO: 391875 - DNA, 20 bp, human
gttggggacccaggaacgag

SEQ ID NO: 391876 - DNA, 20 bp, human
gatagctgtcagtggacttg

SEQ ID NO: 391877 - DNA, 20 bp, human
gcagccgtgtggcccataaa

SEQ ID NO: 391878 - DNA, 20 bp, human
gagaggcagcccttggatgc

SEQ ID NO: 391879 - DNA, 20 bp, human
gcaggtggagacaaggaggt

SEQ ID NO: 391880 - DNA, 20 bp, human
gccagcaggtggagacaagg

SEQ ID NO: 391881 - DNA, 20 bp, human
ggaccttagtggctagaagg

SEQ ID NO: 391882 - DNA, 20 bp, human
gtggaagctgccatggatgg

SEQ ID NO: 391883 - DNA, 20 bp, human
gggccacacggctgcttgga

SEQ ID NO: 391884 - DNA, 20 bp, human
gcagaccagggccccgttgg

SEQ ID NO: 391885 - DNA, 20 bp, human
gctgatgtggacagccccca

SEQ ID NO: 391886 - DNA, 20 bp, human
gcccaccggagaaaaggcag

SEQ ID NO: 391887 - DNA, 20 bp, human
gcagcatggaatgccagaga

SEQ ID NO: 391888 - DNA, 20 bp, human
gaaaaggcaggggaggccgc

SEQ ID NO: 391889 - DNA, 20 bp, human
gggtgccaagatcgaagttg

SEQ ID NO: 391890 - DNA, 20 bp, human
gtgactcacacgggccacgt

SEQ ID NO: 391891 - DNA, 20 bp, human
gtcccctgccttttctccgg

SEQ ID NO: 391892 - DNA, 20 bp, human
gggaaaaataggcctgagat

SEQ ID NO: 391893 - DNA, 20 bp, human
gctcatccccaccggagaaa

SEQ ID NO: 391894 - DNA, 20 bp, human
gggcagggactgcccatctc

SEQ ID NO: 391895 - DNA, 20 bp, human
gcagctgtggctggtgggcg

SEQ ID NO: 391896 - DNA, 20 bp, human
gctccccgtgggttcgggga

SEQ ID NO: 391897 - DNA, 20 bp, human
ggccgtctgccctgcggagc

SEQ ID NO: 391898 - DNA, 20 bp, human
gcgtccccgcccgctccgca

SEQ ID NO: 391899 - DNA, 20 bp, human
gtagctggcgacacagacca

SEQ ID NO: 391900 - DNA, 20 bp, human
gagcctcagcgccgggcaca

SEQ ID NO: 391901 - DNA, 20 bp, human
ggaacatcgccatcgagcgg

SEQ ID NO: 391902 - DNA, 20 bp, human
ggcgccggcggcgatgagca

SEQ ID NO: 391903 - DNA, 20 bp, human
gtatggaggccagagcgggt

SEQ ID NO: 391904 - DNA, 20 bp, human
ggggttcggggagggtatgg

SEQ ID NO: 391905 - DNA, 20 bp, human
gttcagcgccgtctgccctg

SEQ ID NO: 391906 - DNA, 20 bp, human
gggcgggcggggtgcgagta

SEQ ID NO: 391907 - DNA, 20 bp, human
gcgagcgcaggccctagaag

SEQ ID NO: 391908 - DNA, 20 bp, human
ggtaggggccgccccttcta

SEQ ID NO: 391909 - DNA, 20 bp, human
gtcacggagcaagatcgaat

SEQ ID NO: 391910 - DNA, 20 bp, human
gccagggcggcccgaagtca

SEQ ID NO: 391911 - DNA, 20 bp, human
gcggctggaacctgagccgg

SEQ ID NO: 391912 - DNA, 20 bp, human
gtagagcggcagacggtctt

SEQ ID NO: 391913 - DNA, 20 bp, human
ggccctgcacctcccccgca

SEQ ID NO: 391914 - DNA, 20 bp, human
gccgcaggggaggccctcgc

SEQ ID NO: 391915 - DNA, 20 bp, human
gaccgtctgccgctctatcc

SEQ ID NO: 391916 - DNA, 20 bp, human
gaaccaccctggggaagaaa

SEQ ID NO: 391917 - DNA, 20 bp, human
gacccgagaagctaagaggt

SEQ ID NO: 391918 - DNA, 20 bp, human
gaaggaaggttcctaactgt

SEQ ID NO: 391919 - DNA, 20 bp, human
gtgcacagttagttgcatga

SEQ ID NO: 391920 - DNA, 20 bp, human
gaaggttcctaactgtgggc

SEQ ID NO: 391921 - DNA, 20 bp, human
gtgagacccgagaagctaag

SEQ ID NO: 391922 - DNA, 20 bp, human
gaagaaaagggatggaaggt

SEQ ID NO: 391923 - DNA, 20 bp, human
ggaaggtgggtccacaaaca

SEQ ID NO: 391924 - DNA, 20 bp, human
gccccacctcttagcttctc

SEQ ID NO: 391925 - DNA, 20 bp, human
gcagccacagaaccaccctg

SEQ ID NO: 391926 - DNA, 20 bp, human
gccacagacctgcctaccaa

SEQ ID NO: 391927 - DNA, 20 bp, human
gggcacaagtcccccttggt

SEQ ID NO: 391928 - DNA, 20 bp, human
gccctgggtggagaaagaat

SEQ ID NO: 391929 - DNA, 20 bp, human
gtcactgcctagagtctctc

SEQ ID NO: 391930 - DNA, 20 bp, human
gagccagccaggactctgca

SEQ ID NO: 391931 - DNA, 20 bp, human
gacctaccctgagagactct

SEQ ID NO: 391932 - DNA, 20 bp, human
gagttggcacaagtccccct

SEQ ID NO: 391933 - DNA, 20 bp, human
ggcctcgccagtctttctga

SEQ ID NO: 391934 - DNA, 20 bp, human
gaaagtgtggcgctccctcc

SEQ ID NO: 391935 - DNA, 20 bp, human
gagtcctcaacattgggaat

SEQ ID NO: 391936 - DNA, 20 bp, human
gaggctgtcggggatttaaa

SEQ ID NO: 391937 - DNA, 20 bp, human
gggtacccgggcattccccg

SEQ ID NO: 391938 - DNA, 20 bp, human
gtaaagggccgggacccacc

SEQ ID NO: 391939 - DNA, 20 bp, human
ggggaggggcgtccgccgtc

SEQ ID NO: 391940 - DNA, 20 bp, human
gggaatgcccgggtaccctg

SEQ ID NO: 391941 - DNA, 20 bp, human
gcaggcctcggggaatgccc

SEQ ID NO: 391942 - DNA, 20 bp, human
ggggcgtccgccgtccgggt

SEQ ID NO: 391943 - DNA, 20 bp, human
gccggcgcgccgcccccaag

SEQ ID NO: 391944 - DNA, 20 bp, human
gcggccccgtcaaggctgtc

SEQ ID NO: 391945 - DNA, 20 bp, human
gggcctgcgcgggcacgggg

SEQ ID NO: 391946 - DNA, 20 bp, human
gggtctatatgggaaggcca

SEQ ID NO: 391947 - DNA, 20 bp, human
gtccacgatgaaacaggtct

SEQ ID NO: 391948 - DNA, 20 bp, human
gagaggtcgcacggacttgt

SEQ ID NO: 391949 - DNA, 20 bp, human
ggctgcgaccccgtcagcaa

SEQ ID NO: 391950 - DNA, 20 bp, human
ggcaagctcttggtctatat

SEQ ID NO: 391951 - DNA, 20 bp, human
gcaacaagagtgcgcctgac

SEQ ID NO: 391952 - DNA, 20 bp, human
gaccgcgaagctgcgcagaa

SEQ ID NO: 391953 - DNA, 20 bp, human
gtgcacctccacgatgaaac

SEQ ID NO: 391954 - DNA, 20 bp, human
gcttcgcggtatgaggaaga

SEQ ID NO: 391955 - DNA, 20 bp, human
gtgaggaagagggtcctgtc

SEQ ID NO: 391956 - DNA, 20 bp, human
gggcgtccgcggaggatggg

SEQ ID NO: 391957 - DNA, 20 bp, human
gcgggagcccgcagagccga

SEQ ID NO: 391958 - DNA, 20 bp, human
ggtagcctacggcctttcga

SEQ ID NO: 391959 - DNA, 20 bp, human
gcgggctcccgggcctacag

SEQ ID NO: 391960 - DNA, 20 bp, human
gcctttgcagacactttctg

SEQ ID NO: 391961 - DNA, 20 bp, human
ggagcccgcagagccgacgg

SEQ ID NO: 391962 - DNA, 20 bp, human
ggggcgcagcagagtcgcca

SEQ ID NO: 391963 - DNA, 20 bp, human
gtatagtcttcggggaaaac

SEQ ID NO: 391964 - DNA, 20 bp, human
gctgtcaggcgacggagcgt

SEQ ID NO: 391965 - DNA, 20 bp, human
gaggggaaacatcgcttcac

SEQ ID NO: 391966 - DNA, 20 bp, human
gcacgacgaaggcactggga

SEQ ID NO: 391967 - DNA, 20 bp, human
ggacagagagcgcacgacga

SEQ ID NO: 391968 - DNA, 20 bp, human
gcgggactaaggctgtcaat

SEQ ID NO: 391969 - DNA, 20 bp, human
gagcgcacgacgaaggcact

SEQ ID NO: 391970 - DNA, 20 bp, human
gcgcatgtgtgtcaactcta

SEQ ID NO: 391971 - DNA, 20 bp, human
ggcagcgcgaacgtcggcgc

SEQ ID NO: 391972 - DNA, 20 bp, human
gccgacgttcgcgctgcacg

SEQ ID NO: 391973 - DNA, 20 bp, human
gtgtctggccgttcttgcgt

SEQ ID NO: 391974 - DNA, 20 bp, human
gtgaggtgtaagccctgagg

SEQ ID NO: 391975 - DNA, 20 bp, human
gcacaggcgcttgcgcagta

SEQ ID NO: 391976 - DNA, 20 bp, human
gcataactgacgatgtgggt

SEQ ID NO: 391977 - DNA, 20 bp, human
gcagccccgccggaaggaag

SEQ ID NO: 391978 - DNA, 20 bp, human
gggcggaaggatccgaaagg

SEQ ID NO: 391979 - DNA, 20 bp, human
gcacctcccccgtcgtgaaa

SEQ ID NO: 391980 - DNA, 20 bp, human
gccgggcggaaggatccgaa

SEQ ID NO: 391981 - DNA, 20 bp, human
gccacatcgtcagttatgag

SEQ ID NO: 391982 - DNA, 20 bp, human
ggagccacgcgagagcccga

SEQ ID NO: 391983 - DNA, 20 bp, human
gaaagggccaaggccgacgg

SEQ ID NO: 391984 - DNA, 20 bp, human
gacctcccctccttctcgaa

SEQ ID NO: 391985 - DNA, 20 bp, human
gagggcgccacgcaagcgaa

SEQ ID NO: 391986 - DNA, 20 bp, human
gcggtcatgccggactcctg

SEQ ID NO: 391987 - DNA, 20 bp, human
ggatccttgcatcacgtgac

SEQ ID NO: 391988 - DNA, 20 bp, human
ggggccgcgggggtgtaggg

SEQ ID NO: 391989 - DNA, 20 bp, human
gtcacgtgacggggccgcat

SEQ ID NO: 391990 - DNA, 20 bp, human
ggggcctctccggagaagag

SEQ ID NO: 391991 - DNA, 20 bp, human
ggcgctcaaggcggtcatgc

SEQ ID NO: 391992 - DNA, 20 bp, human
ggctgggccgcgggggtgta

SEQ ID NO: 391993 - DNA, 20 bp, human
gcggcctttccgccagaggg

SEQ ID NO: 391994 - DNA, 20 bp, human
ggctcctccctacacccccg

SEQ ID NO: 391995 - DNA, 20 bp, human
gtcctgcggactacacatcc

SEQ ID NO: 391996 - DNA, 20 bp, human
ggtgtcccgcggctgcttaa

SEQ ID NO: 391997 - DNA, 20 bp, human
gtccccggagctgtgtcccg

SEQ ID NO: 391998 - DNA, 20 bp, human
gccaccccacgagcgggatc

SEQ ID NO: 391999 - DNA, 20 bp, human
gtctccagatcccgctcgtg

SEQ ID NO: 392000 - DNA, 20 bp, human
gggaggacctggaagggagt

SEQ ID NO: 392001 - DNA, 20 bp, human
gagccgcgggacacagctcc

SEQ ID NO: 392002 - DNA, 20 bp, human
ggccgtgctcagagggagtg

SEQ ID NO: 392003 - DNA, 20 bp, human
gcccagtagctcagacggtt

SEQ ID NO: 392004 - DNA, 20 bp, human
gggcccccatagtatttttc

SEQ ID NO: 392005 - DNA, 20 bp, human
gggcgcgggccgtgctcaga

SEQ ID NO: 392006 - DNA, 20 bp, human
gacgccggtgcgtcacggaa

SEQ ID NO: 392007 - DNA, 20 bp, human
gttccattgtaagcttccct

SEQ ID NO: 392008 - DNA, 20 bp, human
gcctccgctgggccaagatg

SEQ ID NO: 392009 - DNA, 20 bp, human
gccggtgcgtcacggaacgg

SEQ ID NO: 392010 - DNA, 20 bp, human
gttcgcgtggaacctggggt

SEQ ID NO: 392011 - DNA, 20 bp, human
ggaaactgcaggaaaccgga

SEQ ID NO: 392012 - DNA, 20 bp, human
ggcagcggcggcattttagt

SEQ ID NO: 392013 - DNA, 20 bp, human
gggggctaaaggttaaaaaa

SEQ ID NO: 392014 - DNA, 20 bp, human
gggccaagatggggctgaaa

SEQ ID NO: 392015 - DNA, 20 bp, human
gaaacgagggcgataggaat

SEQ ID NO: 392016 - DNA, 20 bp, human
gtgtccagggagtatgacat

SEQ ID NO: 392017 - DNA, 20 bp, human
gttgaagggaagtgactcga

SEQ ID NO: 392018 - DNA, 20 bp, human
ggggccacaaagcccggtac

SEQ ID NO: 392019 - DNA, 20 bp, human
gcctccctgaaccttaggct

SEQ ID NO: 392020 - DNA, 20 bp, human
gagtcccagcctaaggttca

SEQ ID NO: 392021 - DNA, 20 bp, human
gcatcccctccctgaacctt

SEQ ID NO: 392022 - DNA, 20 bp, human
ggctgcgtcacatggcgtca

SEQ ID NO: 392023 - DNA, 20 bp, human
gaggagccggctgcgtcaca

SEQ ID NO: 392024 - DNA, 20 bp, human
ggtggagtttgtgacatacg

SEQ ID NO: 392025 - DNA, 20 bp, human
gtgacaaagtatgtgtgcag

SEQ ID NO: 392026 - DNA, 20 bp, human
gccggcaggtgtggggttaa

SEQ ID NO: 392027 - DNA, 20 bp, human
gagtggggctagggcccggc

SEQ ID NO: 392028 - DNA, 20 bp, human
ggcccctccctgcaagagtg

SEQ ID NO: 392029 - DNA, 20 bp, human
gccctagccccactcttgca

SEQ ID NO: 392030 - DNA, 20 bp, human
gcttcccgccagctggcccg

SEQ ID NO: 392031 - DNA, 20 bp, human
ggctagggcccggcaggtgt

SEQ ID NO: 392032 - DNA, 20 bp, human
gggactgggaacttctgggt

SEQ ID NO: 392033 - DNA, 20 bp, human
gagccccactcttgcaggga

SEQ ID NO: 392034 - DNA, 20 bp, human
gccgaggaggcaggacttcc

SEQ ID NO: 392035 - DNA, 20 bp, human
gggagcagtcagcaggcccg

SEQ ID NO: 392036 - DNA, 20 bp, human
gagagggctcagaaactggg

SEQ ID NO: 392037 - DNA, 20 bp, human
gtcgcagctgcagtgcgaga

SEQ ID NO: 392038 - DNA, 20 bp, human
ggctaccttggtcagaagga

SEQ ID NO: 392039 - DNA, 20 bp, human
gtgcgagagggctcagaaac

SEQ ID NO: 392040 - DNA, 20 bp, human
ggataactctctgagaaagt

SEQ ID NO: 392041 - DNA, 20 bp, human
gaactctctgagaaagttgg

SEQ ID NO: 392042 - DNA, 20 bp, human
gtcggggaagcggaacccac

SEQ ID NO: 392043 - DNA, 20 bp, human
gcagcccctccttctgacca

SEQ ID NO: 392044 - DNA, 20 bp, human
gtctagctaccttggtcaga

SEQ ID NO: 392045 - DNA, 20 bp, human
gcggcagcactgacttaaag

SEQ ID NO: 392046 - DNA, 20 bp, human
gactgcggagtatgaggcgg

SEQ ID NO: 392047 - DNA, 20 bp, human
gagctcccgtcgggacttgg

SEQ ID NO: 392048 - DNA, 20 bp, human
gcagccgcagagctcccgtc

SEQ ID NO: 392049 - DNA, 20 bp, human
ggcactccgccaagtcccga

SEQ ID NO: 392050 - DNA, 20 bp, human
gcctgcgcacggccggctgg

SEQ ID NO: 392051 - DNA, 20 bp, human
gtctgccactgcggagtatg

SEQ ID NO: 392052 - DNA, 20 bp, human
ggcgtcttgcaggatcgttc

SEQ ID NO: 392053 - DNA, 20 bp, human
gctgcggctgcgcactcggc

SEQ ID NO: 392054 - DNA, 20 bp, human
gcagagctcccgtcgggact

SEQ ID NO: 392055 - DNA, 20 bp, human
ggccactgcggagtatgagg

SEQ ID NO: 392056 - DNA, 20 bp, human
gtgggtggggccacaagctt

SEQ ID NO: 392057 - DNA, 20 bp, human
gtctgtggccccgcccacat

SEQ ID NO: 392058 - DNA, 20 bp, human
gcaccctggcccggtcccgt

SEQ ID NO: 392059 - DNA, 20 bp, human
gaggcctggtgggatcgccc

SEQ ID NO: 392060 - DNA, 20 bp, human
gcccagcaggtggtgaacgg

SEQ ID NO: 392061 - DNA, 20 bp, human
gcccccttgtaaatactcat

SEQ ID NO: 392062 - DNA, 20 bp, human
gagtcgagaacggagagctg

SEQ ID NO: 392063 - DNA, 20 bp, human
gcatcggaacagtgacccta

SEQ ID NO: 392064 - DNA, 20 bp, human
gcaaaggggcggaaccccga

SEQ ID NO: 392065 - DNA, 20 bp, human
gactcggccggatgtgggtg

SEQ ID NO: 392066 - DNA, 20 bp, human
gcggaagcgcaccccgacgc

SEQ ID NO: 392067 - DNA, 20 bp, human
gccgccggatcgggaacgga

SEQ ID NO: 392068 - DNA, 20 bp, human
ggagctcccagacccggcgt

SEQ ID NO: 392069 - DNA, 20 bp, human
ggcaccccgacgccgggtct

SEQ ID NO: 392070 - DNA, 20 bp, human
ggctaggaccggggacaatc

SEQ ID NO: 392071 - DNA, 20 bp, human
gtggagagaagccccgagga

SEQ ID NO: 392072 - DNA, 20 bp, human
gaatcaggagggcgcagagc

SEQ ID NO: 392073 - DNA, 20 bp, human
ggagggctaggggcaaaaga

SEQ ID NO: 392074 - DNA, 20 bp, human
gcgggggcagaggtgacctg

SEQ ID NO: 392075 - DNA, 20 bp, human
gtccgggcgggcacgagttg

SEQ ID NO: 392076 - DNA, 20 bp, human
gggaacgcaccaaacgagta

SEQ ID NO: 392077 - DNA, 20 bp, human
gaagggccagaattctccag

SEQ ID NO: 392078 - DNA, 20 bp, human
gaacctacggcgcggcggaa

SEQ ID NO: 392079 - DNA, 20 bp, human
gaggtggcaccatactcgtt

SEQ ID NO: 392080 - DNA, 20 bp, human
gggcccttccgccgcgccgt

SEQ ID NO: 392081 - DNA, 20 bp, human
ggtctcaagaaatcaagtag

SEQ ID NO: 392082 - DNA, 20 bp, human
gcgccggagggtgtttatcg

SEQ ID NO: 392083 - DNA, 20 bp, human
gggcgaggactgtgttcctc

SEQ ID NO: 392084 - DNA, 20 bp, human
gtagagagatgtcgctgctg

SEQ ID NO: 392085 - DNA, 20 bp, human
ggggcagggaagcgacctta

SEQ ID NO: 392086 - DNA, 20 bp, human
gcaccgtgtgggattgagag

SEQ ID NO: 392087 - DNA, 20 bp, human
gcggcccggaagtgacgtag

SEQ ID NO: 392088 - DNA, 20 bp, human
ggattccggcactcgagggg

SEQ ID NO: 392089 - DNA, 20 bp, human
gggattgagaggggcctggt

SEQ ID NO: 392090 - DNA, 20 bp, human
gactcgaggggcgggttggt

SEQ ID NO: 392091 - DNA, 20 bp, human
gggcccctctcaatcccaca

SEQ ID NO: 392092 - DNA, 20 bp, human
ggccgccgtcctgcgggcaa

SEQ ID NO: 392093 - DNA, 20 bp, human
gagggtcgaaactctggttc

SEQ ID NO: 392094 - DNA, 20 bp, human
gcaacccgcccctcgagtgc

SEQ ID NO: 392095 - DNA, 20 bp, human
gaatcgggtcccaaagatgt

SEQ ID NO: 392096 - DNA, 20 bp, human
gtggaagacgagccccactc

SEQ ID NO: 392097 - DNA, 20 bp, human
gccccgccccggcggatcgg

SEQ ID NO: 392098 - DNA, 20 bp, human
gccgccctcacgctctgtac

SEQ ID NO: 392099 - DNA, 20 bp, human
gggcggggccacggcggcac

SEQ ID NO: 392100 - DNA, 20 bp, human
gctcacgctctgtaccggag

SEQ ID NO: 392101 - DNA, 20 bp, human
gcggcggatcggaggaagga

SEQ ID NO: 392102 - DNA, 20 bp, human
gtggccccgccccggcggat

SEQ ID NO: 392103 - DNA, 20 bp, human
gggcggggccaggacgattt

SEQ ID NO: 392104 - DNA, 20 bp, human
ggacggagcccgcgggaagg

SEQ ID NO: 392105 - DNA, 20 bp, human
gtacgcgtcgctccgtgcgt

SEQ ID NO: 392106 - DNA, 20 bp, human
gagtcctcagccagtctcaa

SEQ ID NO: 392107 - DNA, 20 bp, human
ggcaaaaagcatgctaggaa

SEQ ID NO: 392108 - DNA, 20 bp, human
gttgccagacccattgagac

SEQ ID NO: 392109 - DNA, 20 bp, human
gtctgcgctaaatgactcct

SEQ ID NO: 392110 - DNA, 20 bp, human
gaggtcacacggggagcctg

SEQ ID NO: 392111 - DNA, 20 bp, human
gcagatggatggggaaacac

SEQ ID NO: 392112 - DNA, 20 bp, human
gctacggtgcggatggggga

SEQ ID NO: 392113 - DNA, 20 bp, human
gctgccctggtcacaccgac

SEQ ID NO: 392114 - DNA, 20 bp, human
gcagccagtctcaatgggtc

SEQ ID NO: 392115 - DNA, 20 bp, human
gctcccctgtacagatggat

SEQ ID NO: 392116 - DNA, 20 bp, human
gggggacagcattttaagta

SEQ ID NO: 392117 - DNA, 20 bp, human
gggctggcaaaataagagat

SEQ ID NO: 392118 - DNA, 20 bp, human
gcaaatggctgaagagattg

SEQ ID NO: 392119 - DNA, 20 bp, human
gatgctgaggtgttctgtgt

SEQ ID NO: 392120 - DNA, 20 bp, human
gtgaaaaggccaaaacttaa

SEQ ID NO: 392121 - DNA, 20 bp, human
gtaggcaatctagaatgctg

SEQ ID NO: 392122 - DNA, 20 bp, human
ggtgtagagaagtcataggc

SEQ ID NO: 392123 - DNA, 20 bp, human
gtaaatatgcctttaagttt

SEQ ID NO: 392124 - DNA, 20 bp, human
gaaaacattggcttaggtag

SEQ ID NO: 392125 - DNA, 20 bp, human
ggcagtgaaaacattggctt

SEQ ID NO: 392126 - DNA, 20 bp, human
ggaacatggccacatctgac

SEQ ID NO: 392127 - DNA, 20 bp, human
gttattttgaaacagaagag

SEQ ID NO: 392128 - DNA, 20 bp, human
gtcagagggattatcctgaa

SEQ ID NO: 392129 - DNA, 20 bp, human
ggtataaacaagaagatcag

SEQ ID NO: 392130 - DNA, 20 bp, human
gagaatgactctgaggaaca

SEQ ID NO: 392131 - DNA, 20 bp, human
gacatcatctaaataagtct

SEQ ID NO: 392132 - DNA, 20 bp, human
ggtgtagttcaaaatatttt

SEQ ID NO: 392133 - DNA, 20 bp, human
gaaatttatttggggcttga

SEQ ID NO: 392134 - DNA, 20 bp, human
gtgtctaaatacattttatt

SEQ ID NO: 392135 - DNA, 20 bp, human
ggggaataaaaatttatttg

SEQ ID NO: 392136 - DNA, 20 bp, human
gcagacggagcggactgcgt

SEQ ID NO: 392137 - DNA, 20 bp, human
gtgtcagggaacagacggag

SEQ ID NO: 392138 - DNA, 20 bp, human
gtgctgggaagaatcgggaa

SEQ ID NO: 392139 - DNA, 20 bp, human
gccgcaccgcgggctagcca

SEQ ID NO: 392140 - DNA, 20 bp, human
gacccgggagcgggaggggt

SEQ ID NO: 392141 - DNA, 20 bp, human
ggggtgcagggcgacggctt

SEQ ID NO: 392142 - DNA, 20 bp, human
gagtggctcccaggcagaca

SEQ ID NO: 392143 - DNA, 20 bp, human
ggggtccagtatggaaattc

SEQ ID NO: 392144 - DNA, 20 bp, human
gactgcaggggccactccgg

SEQ ID NO: 392145 - DNA, 20 bp, human
gcgcctctgaccctcagcag

SEQ ID NO: 392146 - DNA, 20 bp, human
gtcagggtgacgttggcgag

SEQ ID NO: 392147 - DNA, 20 bp, human
gcaccctgacaattacaaat

SEQ ID NO: 392148 - DNA, 20 bp, human
ggtaattgtcagggtgacgt

SEQ ID NO: 392149 - DNA, 20 bp, human
gtaacccactggctgatacc

SEQ ID NO: 392150 - DNA, 20 bp, human
ggacctatttgtaattgtca

SEQ ID NO: 392151 - DNA, 20 bp, human
gttaaaaagattgacaggta

SEQ ID NO: 392152 - DNA, 20 bp, human
gttacccggtatcagccagt

SEQ ID NO: 392153 - DNA, 20 bp, human
ggaggagtaaaaactgaagc

SEQ ID NO: 392154 - DNA, 20 bp, human
gtgttgttattgtaacccac

SEQ ID NO: 392155 - DNA, 20 bp, human
gaacataaaagattgtacat

SEQ ID NO: 392156 - DNA, 20 bp, human
gcagcgtcccgcaggggaga

SEQ ID NO: 392157 - DNA, 20 bp, human
ggcagcgggagcctattaaa

SEQ ID NO: 392158 - DNA, 20 bp, human
gtccccgcgacctgatgaca

SEQ ID NO: 392159 - DNA, 20 bp, human
ggggacgctgtccctttaat

SEQ ID NO: 392160 - DNA, 20 bp, human
ggcctggcgctctgcggctg

SEQ ID NO: 392161 - DNA, 20 bp, human
ggccctcgccccggcggaga

SEQ ID NO: 392162 - DNA, 20 bp, human
gaaagggacagcgtcccgca

SEQ ID NO: 392163 - DNA, 20 bp, human
gggcgcggggacacccctcc

SEQ ID NO: 392164 - DNA, 20 bp, human
gtctccctgtcatcaggtcg

SEQ ID NO: 392165 - DNA, 20 bp, human
gggtgggcacgccctcgccc

SEQ ID NO: 392166 - DNA, 20 bp, human
gaccccgcgcacctcgtctg

SEQ ID NO: 392167 - DNA, 20 bp, human
gagagggcgggcagagcggt

SEQ ID NO: 392168 - DNA, 20 bp, human
gacccccggcctaggggcgg

SEQ ID NO: 392169 - DNA, 20 bp, human
ggcgaaccccgaacgtgcgg

SEQ ID NO: 392170 - DNA, 20 bp, human
gcgaacgtgcggagggaaga

SEQ ID NO: 392171 - DNA, 20 bp, human
gtcggggagggaggagcacg

SEQ ID NO: 392172 - DNA, 20 bp, human
gaccgcgctgccggcggaat

SEQ ID NO: 392173 - DNA, 20 bp, human
ggaagaaggagggcgggcga

SEQ ID NO: 392174 - DNA, 20 bp, human
ggcacgttcggggttcgcgg

SEQ ID NO: 392175 - DNA, 20 bp, human
gcggccgctctccggggggg

SEQ ID NO: 392176 - DNA, 20 bp, human
gtgaccccacgcttagtctc

SEQ ID NO: 392177 - DNA, 20 bp, human
gggcccaggtcattccccta

SEQ ID NO: 392178 - DNA, 20 bp, human
gggtcggcccacggattctt

SEQ ID NO: 392179 - DNA, 20 bp, human
gaaccctaggggaatgacct

SEQ ID NO: 392180 - DNA, 20 bp, human
gtgaagacggggggcacatt

SEQ ID NO: 392181 - DNA, 20 bp, human
gcactggagctctgaagacg

SEQ ID NO: 392182 - DNA, 20 bp, human
gcgacccattgttaagttac

SEQ ID NO: 392183 - DNA, 20 bp, human
gagtccactgagaaccctag

SEQ ID NO: 392184 - DNA, 20 bp, human
gtctccctgagactaagcgt

SEQ ID NO: 392185 - DNA, 20 bp, human
gaggggacagtggatcctga

SEQ ID NO: 392186 - DNA, 20 bp, human
ggagcccgggttccactcta

SEQ ID NO: 392187 - DNA, 20 bp, human
gtgagcgaggccaactagag

SEQ ID NO: 392188 - DNA, 20 bp, human
gtggaacccgggctcggctc

SEQ ID NO: 392189 - DNA, 20 bp, human
ggctccctagagtggaaccc

SEQ ID NO: 392190 - DNA, 20 bp, human
gtgctcccgccccctctagt

SEQ ID NO: 392191 - DNA, 20 bp, human
ggattgctggggcgcgcagg

SEQ ID NO: 392192 - DNA, 20 bp, human
gcgaggccaactagaggggg

SEQ ID NO: 392193 - DNA, 20 bp, human
gcatacacaggcacgtactc

SEQ ID NO: 392194 - DNA, 20 bp, human
ggggaacatctggaggtcgc

SEQ ID NO: 392195 - DNA, 20 bp, human
gttagattgctggggcgcgc

SEQ ID NO: 392196 - DNA, 20 bp, human
ggtccggcgcctccgcgctc

SEQ ID NO: 392197 - DNA, 20 bp, human
gcgctcctcccaagtctcca

SEQ ID NO: 392198 - DNA, 20 bp, human
gttaggggcaccacctgctg

SEQ ID NO: 392199 - DNA, 20 bp, human
gctccgccccctggagactt

SEQ ID NO: 392200 - DNA, 20 bp, human
ggggagaggaagtctctatc

SEQ ID NO: 392201 - DNA, 20 bp, human
gacttgggaggagcgagcgt

SEQ ID NO: 392202 - DNA, 20 bp, human
gaaggaagaaccaaccgcgg

SEQ ID NO: 392203 - DNA, 20 bp, human
gcgccccctggagacttggg

SEQ ID NO: 392204 - DNA, 20 bp, human
gggaggcgccggaccccagc

SEQ ID NO: 392205 - DNA, 20 bp, human
gggacgagggaacgttgtta

SEQ ID NO: 392206 - DNA, 20 bp, human
gaccgaggcgcgcgtccaaa

SEQ ID NO: 392207 - DNA, 20 bp, human
ggcgcgcgtccaaagggcag

SEQ ID NO: 392208 - DNA, 20 bp, human
ggacgggcgtgtaggtggtg

SEQ ID NO: 392209 - DNA, 20 bp, human
gtaggtggtgcgggcaagtg

SEQ ID NO: 392210 - DNA, 20 bp, human
gtcgcggcgcgccggaggac

SEQ ID NO: 392211 - DNA, 20 bp, human
gccgtcgctagggtcctccg

SEQ ID NO: 392212 - DNA, 20 bp, human
gtcaggcccacgtgctccga

SEQ ID NO: 392213 - DNA, 20 bp, human
gaggaccctagcgacggtcg

SEQ ID NO: 392214 - DNA, 20 bp, human
gacgcagcggacggcgcctc

SEQ ID NO: 392215 - DNA, 20 bp, human
gtccgctgcgttcggaaccg

SEQ ID NO: 392216 - DNA, 20 bp, human
gaaggtggaggtcacgtgga

SEQ ID NO: 392217 - DNA, 20 bp, human
gctcgcgcgcgcacccgcag

SEQ ID NO: 392218 - DNA, 20 bp, human
ggagccggaagcggcgcgga

SEQ ID NO: 392219 - DNA, 20 bp, human
gcatatggggatgacggcga

SEQ ID NO: 392220 - DNA, 20 bp, human
gccgccgtccgcgccgcttc

SEQ ID NO: 392221 - DNA, 20 bp, human
gggcggtcggctgggccaag

SEQ ID NO: 392222 - DNA, 20 bp, human
gcgctgaggcgcttcgggag

SEQ ID NO: 392223 - DNA, 20 bp, human
ggggccgtcacgtgatgttt

SEQ ID NO: 392224 - DNA, 20 bp, human
gccgagcccggacctcacac

SEQ ID NO: 392225 - DNA, 20 bp, human
ggaaacggaggcccaccacc

SEQ ID NO: 392226 - DNA, 20 bp, human
gtacgctcgcgcggcggtgg

SEQ ID NO: 392227 - DNA, 20 bp, human
ggaagggtaaggtgtcccga

SEQ ID NO: 392228 - DNA, 20 bp, human
gccgcccaccgcgtggtcca

SEQ ID NO: 392229 - DNA, 20 bp, human
gggtccttggaccacgcggt

SEQ ID NO: 392230 - DNA, 20 bp, human
gcaggccggaagtacgtgag

SEQ ID NO: 392231 - DNA, 20 bp, human
gggcctgcgtccggagggga

SEQ ID NO: 392232 - DNA, 20 bp, human
gctgctgcgcctgaagagag

SEQ ID NO: 392233 - DNA, 20 bp, human
gggcaccggaggtcccgctc

SEQ ID NO: 392234 - DNA, 20 bp, human
gccgcgcgagcgtactattg

SEQ ID NO: 392235 - DNA, 20 bp, human
gttcgcgcgcggtgctgtgg

SEQ ID NO: 392236 - DNA, 20 bp, human
gtcgagaggcggagcaactc

SEQ ID NO: 392237 - DNA, 20 bp, human
ggaggcggagcaactcgggc

SEQ ID NO: 392238 - DNA, 20 bp, human
gcgggctggtagagaattct

SEQ ID NO: 392239 - DNA, 20 bp, human
gtgggacaggcttatggctg

SEQ ID NO: 392240 - DNA, 20 bp, human
gtctcgatgggacaggctta

SEQ ID NO: 392241 - DNA, 20 bp, human
ggggaaaccgagtccgagtc

SEQ ID NO: 392242 - DNA, 20 bp, human
gcccgccggcaaagcggctc

SEQ ID NO: 392243 - DNA, 20 bp, human
gatgcagagctctcgagagg

SEQ ID NO: 392244 - DNA, 20 bp, human
gggtgtcccgacgtctcgat

SEQ ID NO: 392245 - DNA, 20 bp, human
gggcgtgtcagtgtccaaag

SEQ ID NO: 392246 - DNA, 20 bp, human
ggggcagcagggtcaaggag

SEQ ID NO: 392247 - DNA, 20 bp, human
gcagggctggtgttgccagg

SEQ ID NO: 392248 - DNA, 20 bp, human
ggcccagggctggtgttgcc

SEQ ID NO: 392249 - DNA, 20 bp, human
gatcaggaggggcgttgccc

SEQ ID NO: 392250 - DNA, 20 bp, human
ggagggcacgcagacattct

SEQ ID NO: 392251 - DNA, 20 bp, human
gcctgctgaggcagtggttg

SEQ ID NO: 392252 - DNA, 20 bp, human
ggaagaagcagcccaggggt

SEQ ID NO: 392253 - DNA, 20 bp, human
gcgcctgctggccccacccg

SEQ ID NO: 392254 - DNA, 20 bp, human
gatcggtctccaggcagcag

SEQ ID NO: 392255 - DNA, 20 bp, human
gaggctaactggccacgggt

SEQ ID NO: 392256 - DNA, 20 bp, human
ggggatggggaacagcctaa

SEQ ID NO: 392257 - DNA, 20 bp, human
gccggagaggacatcagccc

SEQ ID NO: 392258 - DNA, 20 bp, human
gagcctaaaggaggagaaca

SEQ ID NO: 392259 - DNA, 20 bp, human
gtgtgagggtatgggtgtgc

SEQ ID NO: 392260 - DNA, 20 bp, human
gagaatggttgaagggccga

SEQ ID NO: 392261 - DNA, 20 bp, human
gggtaagaaaagtgaaggtc

SEQ ID NO: 392262 - DNA, 20 bp, human
ggctgtaaccgggtttctgt

SEQ ID NO: 392263 - DNA, 20 bp, human
gtccaggctaccttcccaag

SEQ ID NO: 392264 - DNA, 20 bp, human
gtgtcaaggagcgtttgtga

SEQ ID NO: 392265 - DNA, 20 bp, human
ggtgaaggtcaggaggggga

SEQ ID NO: 392266 - DNA, 20 bp, human
gcagccctgggcatgggaat

SEQ ID NO: 392267 - DNA, 20 bp, human
ggagctgaagtccgcatggg

SEQ ID NO: 392268 - DNA, 20 bp, human
gtgactccggcatctgggta

SEQ ID NO: 392269 - DNA, 20 bp, human
ggacccacagagccagggct

SEQ ID NO: 392270 - DNA, 20 bp, human
gccagcgccaatctatcccc

SEQ ID NO: 392271 - DNA, 20 bp, human
ggaatcagaccctggtaaat

SEQ ID NO: 392272 - DNA, 20 bp, human
gcaaccagggaatcagaccc

SEQ ID NO: 392273 - DNA, 20 bp, human
gtgactcaggcaggcatgtt

SEQ ID NO: 392274 - DNA, 20 bp, human
gaacaagccgggggatagat

SEQ ID NO: 392275 - DNA, 20 bp, human
gccaatcccaagagacccat

SEQ ID NO: 392276 - DNA, 20 bp, human
ggctcccgggcgcgtcctgc

SEQ ID NO: 392277 - DNA, 20 bp, human
gagggacacggcagtgatgg

SEQ ID NO: 392278 - DNA, 20 bp, human
gagacctaagcggggagctg

SEQ ID NO: 392279 - DNA, 20 bp, human
gaggggccgacaaacgtaaa

SEQ ID NO: 392280 - DNA, 20 bp, human
gcccgggaaggtcagcgtgt

SEQ ID NO: 392281 - DNA, 20 bp, human
gagccggcagctcgcgtgcg

SEQ ID NO: 392282 - DNA, 20 bp, human
gcgcgcccctgcgcccactg

SEQ ID NO: 392283 - DNA, 20 bp, human
gagccggcgccggggcgtcg

SEQ ID NO: 392284 - DNA, 20 bp, human
gcaggcggggactagagggc

SEQ ID NO: 392285 - DNA, 20 bp, human
ggctccgcagctccccgctt

SEQ ID NO: 392286 - DNA, 20 bp, human
gggactctcgctgggtgaga

SEQ ID NO: 392287 - DNA, 20 bp, human
gactcggagaggacttggga

SEQ ID NO: 392288 - DNA, 20 bp, human
gtccctttggggactctcgc

SEQ ID NO: 392289 - DNA, 20 bp, human
gagtccggacgaggcagcgg

SEQ ID NO: 392290 - DNA, 20 bp, human
ggggacaagaaacacccact

SEQ ID NO: 392291 - DNA, 20 bp, human
ggcctcgtccggactcggag

SEQ ID NO: 392292 - DNA, 20 bp, human
ggccggggttgggtcctagt

SEQ ID NO: 392293 - DNA, 20 bp, human
gggtggcgtcgaaggaatgg

SEQ ID NO: 392294 - DNA, 20 bp, human
gtcctctccgagtccggacg

SEQ ID NO: 392295 - DNA, 20 bp, human
gacaggaggtggctccataa

SEQ ID NO: 392296 - DNA, 20 bp, human
gcctcccggatcccggtcgg

SEQ ID NO: 392297 - DNA, 20 bp, human
ggcccctcccggatcccggt

SEQ ID NO: 392298 - DNA, 20 bp, human
gcgcgcggggcgagacgaag

SEQ ID NO: 392299 - DNA, 20 bp, human
ggaggggcggagcggtcccg

SEQ ID NO: 392300 - DNA, 20 bp, human
gagggccaaggccgtgtggg

SEQ ID NO: 392301 - DNA, 20 bp, human
gcgctccgccgaccgggatc

SEQ ID NO: 392302 - DNA, 20 bp, human
gaggccgccgctctggcctg

SEQ ID NO: 392303 - DNA, 20 bp, human
gggagcggtcccggggcgag

SEQ ID NO: 392304 - DNA, 20 bp, human
gtacaccaaggccgccgctc

SEQ ID NO: 392305 - DNA, 20 bp, human
ggagccccaggccagagcgg

SEQ ID NO: 392306 - DNA, 20 bp, human
gggaagcggcgccccttcct

SEQ ID NO: 392307 - DNA, 20 bp, human
gcgcccggggccgcaccggg

SEQ ID NO: 392308 - DNA, 20 bp, human
ggggcgggagggcgcgactc

SEQ ID NO: 392309 - DNA, 20 bp, human
gcctgcgccgcgcacccact

SEQ ID NO: 392310 - DNA, 20 bp, human
gaccgcccagagcgggacaa

SEQ ID NO: 392311 - DNA, 20 bp, human
gctcccggcccgcgcggcac

SEQ ID NO: 392312 - DNA, 20 bp, human
gcggcgcctgccgtctgccg

SEQ ID NO: 392313 - DNA, 20 bp, human
ggcaccggggaccgcgaggc

SEQ ID NO: 392314 - DNA, 20 bp, human
gcctgccgtctgccgaggaa

SEQ ID NO: 392315 - DNA, 20 bp, human
ggcgccgcgcacccactggg

SEQ ID NO: 392316 - DNA, 20 bp, human
gtctctccttagagcacctc

SEQ ID NO: 392317 - DNA, 20 bp, human
ggtgaaccagaggtgctcta

SEQ ID NO: 392318 - DNA, 20 bp, human
gccctagaggggaccaagaa

SEQ ID NO: 392319 - DNA, 20 bp, human
gctgcctagcgtctgggagg

SEQ ID NO: 392320 - DNA, 20 bp, human
gccgccaccggcgttctctc

SEQ ID NO: 392321 - DNA, 20 bp, human
gcggctgcctagcgtctggg

SEQ ID NO: 392322 - DNA, 20 bp, human
gtgctgccctgggccctaga

SEQ ID NO: 392323 - DNA, 20 bp, human
gggcagccgcggcctcccat

SEQ ID NO: 392324 - DNA, 20 bp, human
gaacgcctgtgctaatgcag

SEQ ID NO: 392325 - DNA, 20 bp, human
gccgccccctcccagacgct

SEQ ID NO: 392326 - DNA, 20 bp, human
gtggcatctggagggtacca

SEQ ID NO: 392327 - DNA, 20 bp, human
ggccccaaactgccccctgt

SEQ ID NO: 392328 - DNA, 20 bp, human
gtatgcccacagggtcctgg

SEQ ID NO: 392329 - DNA, 20 bp, human
ggagcaaggctcatggtcca

SEQ ID NO: 392330 - DNA, 20 bp, human
gttggggcacctgatttccc

SEQ ID NO: 392331 - DNA, 20 bp, human
gggctcctcatccttcaaac

SEQ ID NO: 392332 - DNA, 20 bp, human
ggataaaaggcttatgacca

SEQ ID NO: 392333 - DNA, 20 bp, human
gggggatccaagcgggggag

SEQ ID NO: 392334 - DNA, 20 bp, human
gccttcaaacaggtcacagc

SEQ ID NO: 392335 - DNA, 20 bp, human
gaaggatgaggagccaacag

SEQ ID NO: 392336 - DNA, 20 bp, human
ggggactgagttgatctatg

SEQ ID NO: 392337 - DNA, 20 bp, human
ggggactccaaagggactga

SEQ ID NO: 392338 - DNA, 20 bp, human
gtgagccccgcctctggacc

SEQ ID NO: 392339 - DNA, 20 bp, human
gtcaggaggcgggactccaa

SEQ ID NO: 392340 - DNA, 20 bp, human
ggaagcggagccaggtccag

SEQ ID NO: 392341 - DNA, 20 bp, human
gctgcgaggaggtccgaatc

SEQ ID NO: 392342 - DNA, 20 bp, human
gaggacgctgggaaacgcgg

SEQ ID NO: 392343 - DNA, 20 bp, human
gacgctgggaaacgcggcgg

SEQ ID NO: 392344 - DNA, 20 bp, human
ggaggtccgaatcaggctgt

SEQ ID NO: 392345 - DNA, 20 bp, human
gggagtcccgcctcctgacc

SEQ ID NO: 392346 - DNA, 20 bp, human
ggagaagcgcgtctcctctg

SEQ ID NO: 392347 - DNA, 20 bp, human
ggggcccaaacgcaggggtt

SEQ ID NO: 392348 - DNA, 20 bp, human
ggtggtcggaggcggaggaa

SEQ ID NO: 392349 - DNA, 20 bp, human
gacggcgtctggagccggga

SEQ ID NO: 392350 - DNA, 20 bp, human
gccgggaggggcggaggttt

SEQ ID NO: 392351 - DNA, 20 bp, human
gagagggcccgcgagcagag

SEQ ID NO: 392352 - DNA, 20 bp, human
gagcaacggcgtctggagcc

SEQ ID NO: 392353 - DNA, 20 bp, human
gtggagccccgcgacgccgg

SEQ ID NO: 392354 - DNA, 20 bp, human
gcacctcccgctctgctcgc

SEQ ID NO: 392355 - DNA, 20 bp, human
gcaaggcctggacgcggggt

SEQ ID NO: 392356 - DNA, 20 bp, human
ggagccggggtcttaagact

SEQ ID NO: 392357 - DNA, 20 bp, human
gccaaggaatctcgctgctg

SEQ ID NO: 392358 - DNA, 20 bp, human
gtcgctgctgaggggtgagc

SEQ ID NO: 392359 - DNA, 20 bp, human
gaatcccagtcttaagaccc

SEQ ID NO: 392360 - DNA, 20 bp, human
gtgaacagctgtgggagctc

SEQ ID NO: 392361 - DNA, 20 bp, human
ggagggaggtgaacagctgt

SEQ ID NO: 392362 - DNA, 20 bp, human
ggggagagaccgcgggtcag

SEQ ID NO: 392363 - DNA, 20 bp, human
gagcacctgtagggaaaaac

SEQ ID NO: 392364 - DNA, 20 bp, human
gagactgggattcccgttga

SEQ ID NO: 392365 - DNA, 20 bp, human
gtggccagacttccagcaaa

SEQ ID NO: 392366 - DNA, 20 bp, human
gggggcgcgtggaccccaag

SEQ ID NO: 392367 - DNA, 20 bp, human
gtggagatcgagcagcccga

SEQ ID NO: 392368 - DNA, 20 bp, human
gcggcggtgcgcccactgga

SEQ ID NO: 392369 - DNA, 20 bp, human
ggcgtggctggcgacgggtg

SEQ ID NO: 392370 - DNA, 20 bp, human
gaagagcgaacgtgctccct

SEQ ID NO: 392371 - DNA, 20 bp, human
gaggcccgggcgatgcttga

SEQ ID NO: 392372 - DNA, 20 bp, human
gtcaaaccggtctccgcaca

SEQ ID NO: 392373 - DNA, 20 bp, human
gcagccctggacactcagtc

SEQ ID NO: 392374 - DNA, 20 bp, human
ggcgtggaccccaagcggcg

SEQ ID NO: 392375 - DNA, 20 bp, human
gcacagggcgctgattaaat

SEQ ID NO: 392376 - DNA, 20 bp, human
ggcggccagaggccaagaaa

SEQ ID NO: 392377 - DNA, 20 bp, human
gcagccaatcgcctctgcgg

SEQ ID NO: 392378 - DNA, 20 bp, human
gtgcgtccaagggcggccag

SEQ ID NO: 392379 - DNA, 20 bp, human
gaggccaagaaaaggcgctg

SEQ ID NO: 392380 - DNA, 20 bp, human
ggggagccatctgcgtccaa

SEQ ID NO: 392381 - DNA, 20 bp, human
gataagggtggcatagtcat

SEQ ID NO: 392382 - DNA, 20 bp, human
ggtccaccagaacctcccta

SEQ ID NO: 392383 - DNA, 20 bp, human
gaggagcgaggcacttgctg

SEQ ID NO: 392384 - DNA, 20 bp, human
ggtgaggccacgcctcttaa

SEQ ID NO: 392385 - DNA, 20 bp, human
gtagaaagatagcactcaga

SEQ ID NO: 392386 - DNA, 20 bp, human
gcgggtcggtgacgtaatgc

SEQ ID NO: 392387 - DNA, 20 bp, human
gtgacgtaatgcgggttgat

SEQ ID NO: 392388 - DNA, 20 bp, human
gggtgcaggcgcagagtatt

SEQ ID NO: 392389 - DNA, 20 bp, human
gagagggacagaaggcgggt

SEQ ID NO: 392390 - DNA, 20 bp, human
ggtttctagagactctctta

SEQ ID NO: 392391 - DNA, 20 bp, human
gaaacttaaaactaggggca

SEQ ID NO: 392392 - DNA, 20 bp, human
gtctgagagctgggcaaaaa

SEQ ID NO: 392393 - DNA, 20 bp, human
gtgtggtcggagttaggaga

SEQ ID NO: 392394 - DNA, 20 bp, human
gctggaggaacttaggtgaa

SEQ ID NO: 392395 - DNA, 20 bp, human
gggctaatcctggacgtcca

SEQ ID NO: 392396 - DNA, 20 bp, human
gcacccagcagctcggtcct

SEQ ID NO: 392397 - DNA, 20 bp, human
gggtgccccggaagaagggc

SEQ ID NO: 392398 - DNA, 20 bp, human
gcggatgcagcctacctcct

SEQ ID NO: 392399 - DNA, 20 bp, human
gtgggggcaccagggtgagg

SEQ ID NO: 392400 - DNA, 20 bp, human
gtgtctgtcaacatcgccct

SEQ ID NO: 392401 - DNA, 20 bp, human
gaacgaggccatgtcttcct

SEQ ID NO: 392402 - DNA, 20 bp, human
gctgagagggggaaagtcat

SEQ ID NO: 392403 - DNA, 20 bp, human
gtgctgggtgccccggaaga

SEQ ID NO: 392404 - DNA, 20 bp, human
ggagaggagaggaaccgtca

SEQ ID NO: 392405 - DNA, 20 bp, human
gggcagtgagctgcggtctg

SEQ ID NO: 392406 - DNA, 20 bp, human
gagctggagctcaaagttta

SEQ ID NO: 392407 - DNA, 20 bp, human
gaagaagtgagaatatcttc

SEQ ID NO: 392408 - DNA, 20 bp, human
gtgagaatatcttcaggcga

SEQ ID NO: 392409 - DNA, 20 bp, human
gtcttcaggcgaaggcaact

SEQ ID NO: 392410 - DNA, 20 bp, human
ggtcacctcagtgtgagggg

SEQ ID NO: 392411 - DNA, 20 bp, human
ggtaataccaacaagcacag

SEQ ID NO: 392412 - DNA, 20 bp, human
ggtggctctgagaattcccc

SEQ ID NO: 392413 - DNA, 20 bp, human
gtctatagcaagcttctact

SEQ ID NO: 392414 - DNA, 20 bp, human
gtcacccacccctcacactg

SEQ ID NO: 392415 - DNA, 20 bp, human
gctcacactgaggtgaccag

SEQ ID NO: 392416 - DNA, 20 bp, human
gggggcttcccgtgcgtccc

SEQ ID NO: 392417 - DNA, 20 bp, human
gcggaacagcggagaacgag

SEQ ID NO: 392418 - DNA, 20 bp, human
gcctgggcctgtgcgtcccg

SEQ ID NO: 392419 - DNA, 20 bp, human
gcgggcgcgtccactgttgc

SEQ ID NO: 392420 - DNA, 20 bp, human
gcagggccgtaaagctgcgg

SEQ ID NO: 392421 - DNA, 20 bp, human
gccgggatgcaccaagacgg

SEQ ID NO: 392422 - DNA, 20 bp, human
gcgggaagcccctatcgcgg

SEQ ID NO: 392423 - DNA, 20 bp, human
gcgtacagggatgatcatgg

SEQ ID NO: 392424 - DNA, 20 bp, human
ggggccggtggagggacggc

SEQ ID NO: 392425 - DNA, 20 bp, human
ggcgccgggatgcaccaaga

SEQ ID NO: 392426 - DNA, 20 bp, human
gcacgtggctgggtggggta

SEQ ID NO: 392427 - DNA, 20 bp, human
ggctccgcacgtggctgggt

SEQ ID NO: 392428 - DNA, 20 bp, human
gcccaagcgtgcagtggatc

SEQ ID NO: 392429 - DNA, 20 bp, human
ggatctggctagcaccactc

SEQ ID NO: 392430 - DNA, 20 bp, human
gtcgtggctccgcacgtggc

SEQ ID NO: 392431 - DNA, 20 bp, human
ggatgcctggaacccaacac

SEQ ID NO: 392432 - DNA, 20 bp, human
ggatgtgcgtccactcatcc

SEQ ID NO: 392433 - DNA, 20 bp, human
ggcgtctgccttagttgcag

SEQ ID NO: 392434 - DNA, 20 bp, human
ggggtatggcaaatgccact

SEQ ID NO: 392435 - DNA, 20 bp, human
gacgaagggttttctgggtc

SEQ ID NO: 392436 - DNA, 20 bp, human
gcgcagctctggagggacgc

SEQ ID NO: 392437 - DNA, 20 bp, human
gtgggagggtggaggaccgc

SEQ ID NO: 392438 - DNA, 20 bp, human
gcgcgcgcgcgcacggggtc

SEQ ID NO: 392439 - DNA, 20 bp, human
gcttggggttggcccgagaa

SEQ ID NO: 392440 - DNA, 20 bp, human
gcgtcgctgcggggtaggta

SEQ ID NO: 392441 - DNA, 20 bp, human
gccgcccgccgcccaagcct

SEQ ID NO: 392442 - DNA, 20 bp, human
gcgcctagccaaggcttggg

SEQ ID NO: 392443 - DNA, 20 bp, human
ggggtcgctcctcggggaga

SEQ ID NO: 392444 - DNA, 20 bp, human
gcgcgcgcctagccaaggct

SEQ ID NO: 392445 - DNA, 20 bp, human
gaccctggaaggggtgtcgg

SEQ ID NO: 392446 - DNA, 20 bp, human
gtcagagcgccccctgccga

SEQ ID NO: 392447 - DNA, 20 bp, human
ggtagagggtaaagtatggg

SEQ ID NO: 392448 - DNA, 20 bp, human
gtgggaggctgtccggaaag

SEQ ID NO: 392449 - DNA, 20 bp, human
gggggcgggaaagattcctt

SEQ ID NO: 392450 - DNA, 20 bp, human
gcgagcgtccacaactgaga

SEQ ID NO: 392451 - DNA, 20 bp, human
gtaaagtatgggaggctgtc

SEQ ID NO: 392452 - DNA, 20 bp, human
gctagtgtcggaaatttcat

SEQ ID NO: 392453 - DNA, 20 bp, human
gtgaaattgttgccactttc

SEQ ID NO: 392454 - DNA, 20 bp, human
gcccgcagcgctctgagatt

SEQ ID NO: 392455 - DNA, 20 bp, human
gggtgaagttataaggagag

SEQ ID NO: 392456 - DNA, 20 bp, human
gcgcgttcgcaatactgcgc

SEQ ID NO: 392457 - DNA, 20 bp, human
gcgtgagcgcgcaccgcgcg

SEQ ID NO: 392458 - DNA, 20 bp, human
gcggggcgcggcaggacagt

SEQ ID NO: 392459 - DNA, 20 bp, human
gaggccaggcgaggcgacac

SEQ ID NO: 392460 - DNA, 20 bp, human
gcgggcagtgactgcgcatg

SEQ ID NO: 392461 - DNA, 20 bp, human
gtcgcctccctcctccgctg

SEQ ID NO: 392462 - DNA, 20 bp, human
gctactgaaaaagccgggcc

SEQ ID NO: 392463 - DNA, 20 bp, human
ggggctcctactgaaaaagc

SEQ ID NO: 392464 - DNA, 20 bp, human
gagaggcctcgtgagcgcgc

SEQ ID NO: 392465 - DNA, 20 bp, human
gcgggggcgcgtgccgcgag

SEQ ID NO: 392466 - DNA, 20 bp, human
gcaggagctatgacaagcaa

SEQ ID NO: 392467 - DNA, 20 bp, human
gtccccatagttgaaatgga

SEQ ID NO: 392468 - DNA, 20 bp, human
gtaaacagatatcaagtgaa

SEQ ID NO: 392469 - DNA, 20 bp, human
gccgccctccatttcaacta

SEQ ID NO: 392470 - DNA, 20 bp, human
gaagggaatggcactggatc

SEQ ID NO: 392471 - DNA, 20 bp, human
ggcaaaggaacatacttgcc

SEQ ID NO: 392472 - DNA, 20 bp, human
gtatcgcaaaggctatctcc

SEQ ID NO: 392473 - DNA, 20 bp, human
gggagggcagatacatgtaa

SEQ ID NO: 392474 - DNA, 20 bp, human
gtatctgtttactttagagg

SEQ ID NO: 392475 - DNA, 20 bp, human
gtatttccccatagttgaaa

SEQ ID NO: 392476 - DNA, 20 bp, human
gggggcggagaaggatcgca

SEQ ID NO: 392477 - DNA, 20 bp, human
gaggcacgggtgctctctcg

SEQ ID NO: 392478 - DNA, 20 bp, human
ggctgggtcccctgcgttag

SEQ ID NO: 392479 - DNA, 20 bp, human
gcggaccggccgctcctccg

SEQ ID NO: 392480 - DNA, 20 bp, human
gcgggatcatagcacctcgg

SEQ ID NO: 392481 - DNA, 20 bp, human
gggccccgtgccccgtcccc

SEQ ID NO: 392482 - DNA, 20 bp, human
gcacggggcccgcgaggcac

SEQ ID NO: 392483 - DNA, 20 bp, human
gttagaggaaggggagcccg

SEQ ID NO: 392484 - DNA, 20 bp, human
gaggcccttgggtgccgtgt

SEQ ID NO: 392485 - DNA, 20 bp, human
ggccgccgccagcggaaaca

SEQ ID NO: 392486 - DNA, 20 bp, human
gctgcagcccaacctgccag

SEQ ID NO: 392487 - DNA, 20 bp, human
gggccctggcggtcgcagtg

SEQ ID NO: 392488 - DNA, 20 bp, human
ggggcacaggcgaccatggc

SEQ ID NO: 392489 - DNA, 20 bp, human
ggaggcaggtggcccctggc

SEQ ID NO: 392490 - DNA, 20 bp, human
gggccctgcgtgcaggtgac

SEQ ID NO: 392491 - DNA, 20 bp, human
gcccgcggccgcccctggaa

SEQ ID NO: 392492 - DNA, 20 bp, human
gcgcagggcccaagcccatc

SEQ ID NO: 392493 - DNA, 20 bp, human
gtggccgtcgcagtgacccc

SEQ ID NO: 392494 - DNA, 20 bp, human
gttccccactgcgaccgcca

SEQ ID NO: 392495 - DNA, 20 bp, human
gggaccctccagcagactgt

SEQ ID NO: 392496 - DNA, 20 bp, human
ggtcccgcggggacgcgagt

SEQ ID NO: 392497 - DNA, 20 bp, human
gaggcagaagcgcgtcccgc

SEQ ID NO: 392498 - DNA, 20 bp, human
gctggccgggcggccgtcac

SEQ ID NO: 392499 - DNA, 20 bp, human
gcctcactcaccagcggcga

SEQ ID NO: 392500 - DNA, 20 bp, human
ggaagcgcgtcccgcgggag

SEQ ID NO: 392501 - DNA, 20 bp, human
gggcccactcgcgtccccgc

SEQ ID NO: 392502 - DNA, 20 bp, human
gcggccgcgagcaagtctct

SEQ ID NO: 392503 - DNA, 20 bp, human
gccctcgggtgtccagtctg

SEQ ID NO: 392504 - DNA, 20 bp, human
gtcctcctccccatggtgac

SEQ ID NO: 392505 - DNA, 20 bp, human
ggcgagtgggcccagtgccc

SEQ ID NO: 392506 - DNA, 20 bp, human
ggcaggaagctcatacccca

SEQ ID NO: 392507 - DNA, 20 bp, human
gcatcctgacactctgggaa

SEQ ID NO: 392508 - DNA, 20 bp, human
gtcataccccatggctccag

SEQ ID NO: 392509 - DNA, 20 bp, human
gtcagactggcacactcatg

SEQ ID NO: 392510 - DNA, 20 bp, human
gtttccattcccagagtgtc

SEQ ID NO: 392511 - DNA, 20 bp, human
gcaagcatccaggtttcttg

SEQ ID NO: 392512 - DNA, 20 bp, human
gcaggagccagaaattcctg

SEQ ID NO: 392513 - DNA, 20 bp, human
gtcctgcccaaattcaaact

SEQ ID NO: 392514 - DNA, 20 bp, human
gtgactagaaaagagtcccc

SEQ ID NO: 392515 - DNA, 20 bp, human
gagtcaggccacaagaaacc

SEQ ID NO: 392516 - DNA, 20 bp, human
gccctggcatgtactctcgc

SEQ ID NO: 392517 - DNA, 20 bp, human
ggcactgtaggctagaaccc

SEQ ID NO: 392518 - DNA, 20 bp, human
gacctgcgagagtacatgcc

SEQ ID NO: 392519 - DNA, 20 bp, human
gtggaattcgtctgcactgt

SEQ ID NO: 392520 - DNA, 20 bp, human
gtcgtggccaatcaatggaa

SEQ ID NO: 392521 - DNA, 20 bp, human
gtggccaatcaatggaaggg

SEQ ID NO: 392522 - DNA, 20 bp, human
gtgagtcggggcgggtatgt

SEQ ID NO: 392523 - DNA, 20 bp, human
ggcctagcagaagtgagtcg

SEQ ID NO: 392524 - DNA, 20 bp, human
gaagtcacctgcttgtgcag

SEQ ID NO: 392525 - DNA, 20 bp, human
gcatgtactctcgcaggtcg

SEQ ID NO: 392526 - DNA, 20 bp, human
gaaagcccagagaatccggt

SEQ ID NO: 392527 - DNA, 20 bp, human
gccagccaaccggattctct

SEQ ID NO: 392528 - DNA, 20 bp, human
ggagcggcggaaccaatccc

SEQ ID NO: 392529 - DNA, 20 bp, human
gagaatccggttggctggca

SEQ ID NO: 392530 - DNA, 20 bp, human
ggctagatgcatctcaaggt

SEQ ID NO: 392531 - DNA, 20 bp, human
gccgctccctgccagccaac

SEQ ID NO: 392532 - DNA, 20 bp, human
ggaaatgttagtgagactgt

SEQ ID NO: 392533 - DNA, 20 bp, human
gtttcagcggcggtgtcgtc

SEQ ID NO: 392534 - DNA, 20 bp, human
gagtcgctagatgcatctca

SEQ ID NO: 392535 - DNA, 20 bp, human
gagtctcactaacatttcag

SEQ ID NO: 392536 - DNA, 20 bp, human
gattgcgtgagagcgggcag

SEQ ID NO: 392537 - DNA, 20 bp, human
gcaagcggattgcgtgagag

SEQ ID NO: 392538 - DNA, 20 bp, human
gagggagtcagcccgttgat

SEQ ID NO: 392539 - DNA, 20 bp, human
ggagtcagcccgttgattgg

SEQ ID NO: 392540 - DNA, 20 bp, human
gctcgggcccgccaatcaac

SEQ ID NO: 392541 - DNA, 20 bp, human
ggggctgactccctcagcga

SEQ ID NO: 392542 - DNA, 20 bp, human
gagggaaactgcagggcgat

SEQ ID NO: 392543 - DNA, 20 bp, human
ggactccctcagcgacggga

SEQ ID NO: 392544 - DNA, 20 bp, human
gcgacgggagggaaactgca

SEQ ID NO: 392545 - DNA, 20 bp, human
gttggctgcgaggaaagctg

SEQ ID NO: 392546 - DNA, 20 bp, human
gcgcgcgagaactctctgcg

SEQ ID NO: 392547 - DNA, 20 bp, human
ggtagcaccgccgagagtaa

SEQ ID NO: 392548 - DNA, 20 bp, human
gagaagacaaaggaatacga

SEQ ID NO: 392549 - DNA, 20 bp, human
ggcaccgccgagagtaaagg

SEQ ID NO: 392550 - DNA, 20 bp, human
gcatggcaactggtgatgtc

SEQ ID NO: 392551 - DNA, 20 bp, human
gactctcggcggtgctacca

SEQ ID NO: 392552 - DNA, 20 bp, human
ggccttagaaattcattcag

SEQ ID NO: 392553 - DNA, 20 bp, human
gacccctcctttactctcgg

SEQ ID NO: 392554 - DNA, 20 bp, human
gagaatttcgtcagtctgga

SEQ ID NO: 392555 - DNA, 20 bp, human
ggcctctgaatgaatttcta

SEQ ID NO: 392556 - DNA, 20 bp, human
gagtccgcgcgagatggggg

SEQ ID NO: 392557 - DNA, 20 bp, human
gccgcgcggaagagatgaaa

SEQ ID NO: 392558 - DNA, 20 bp, human
gagcgagtccgcgcgagatg

SEQ ID NO: 392559 - DNA, 20 bp, human
ggatgggggacaggtggtga

SEQ ID NO: 392560 - DNA, 20 bp, human
gacgtgatgcgcccggtgat

SEQ ID NO: 392561 - DNA, 20 bp, human
gctcccacccccatctcgcg

SEQ ID NO: 392562 - DNA, 20 bp, human
ggtctcctgcgcagccgcag

SEQ ID NO: 392563 - DNA, 20 bp, human
gagcggcggcgccaatcacc

SEQ ID NO: 392564 - DNA, 20 bp, human
gttctctgatatgcgctcgc

SEQ ID NO: 392565 - DNA, 20 bp, human
gacaactgtaccgtcgcgag

SEQ ID NO: 392566 - DNA, 20 bp, human
gcctcagtctcgcgagtctg

SEQ ID NO: 392567 - DNA, 20 bp, human
gcagtctcgcgagtctgtgg

SEQ ID NO: 392568 - DNA, 20 bp, human
gtgtcgcgagactgaggggt

SEQ ID NO: 392569 - DNA, 20 bp, human
ggtgagtgtcgcgagactga

SEQ ID NO: 392570 - DNA, 20 bp, human
ggtgtcgcgagactgaagag

SEQ ID NO: 392571 - DNA, 20 bp, human
gaagagtgggcggcgcaaat

SEQ ID NO: 392572 - DNA, 20 bp, human
gtcagcccagtagagaaata

SEQ ID NO: 392573 - DNA, 20 bp, human
ggatgagtaatgatattaca

SEQ ID NO: 392574 - DNA, 20 bp, human
gctctcttgtgcagtatccg

SEQ ID NO: 392575 - DNA, 20 bp, human
gtagtatctagcatgtacaa

SEQ ID NO: 392576 - DNA, 20 bp, human
gtccctgcgccctctcgcga

SEQ ID NO: 392577 - DNA, 20 bp, human
gcgtgagagcgccgtgttag

SEQ ID NO: 392578 - DNA, 20 bp, human
gcggccgggaaggaccttgt

SEQ ID NO: 392579 - DNA, 20 bp, human
gcttggcgaacccgctaaca

SEQ ID NO: 392580 - DNA, 20 bp, human
gcaaaaaaatgacaatgcaa

SEQ ID NO: 392581 - DNA, 20 bp, human
gggaaaagaccttcgcgaga

SEQ ID NO: 392582 - DNA, 20 bp, human
ggggccaggacaagcgcttc

SEQ ID NO: 392583 - DNA, 20 bp, human
gagcctcgacagtctacatc

SEQ ID NO: 392584 - DNA, 20 bp, human
gcaaccacacactgcgaagt

SEQ ID NO: 392585 - DNA, 20 bp, human
ggtgggaaaagttcccagcg

SEQ ID NO: 392586 - DNA, 20 bp, human
ggcgcaggtgggtgtcgtgc

SEQ ID NO: 392587 - DNA, 20 bp, human
gcaaacaagcccctggtccc

SEQ ID NO: 392588 - DNA, 20 bp, human
ggcacagcggacgtcggaca

SEQ ID NO: 392589 - DNA, 20 bp, human
ggacacccacttaggacgtg

SEQ ID NO: 392590 - DNA, 20 bp, human
gtcctaagtgggtgtcgtgc

SEQ ID NO: 392591 - DNA, 20 bp, human
gggcggcgcgggcactgaat

SEQ ID NO: 392592 - DNA, 20 bp, human
ggcttccccacgtcctaagt

SEQ ID NO: 392593 - DNA, 20 bp, human
ggcccgcacgacacccactt

SEQ ID NO: 392594 - DNA, 20 bp, human
gcagcggacgtcggacaagg

SEQ ID NO: 392595 - DNA, 20 bp, human
gggcactgaatgggcagctc

SEQ ID NO: 392596 - DNA, 20 bp, human
gcagacctgaaggacgtgtg

SEQ ID NO: 392597 - DNA, 20 bp, human
gcaaaggacaccagacctga

SEQ ID NO: 392598 - DNA, 20 bp, human
gatggccccacacgtccttc

SEQ ID NO: 392599 - DNA, 20 bp, human
gaagccgagcctgagaacac

SEQ ID NO: 392600 - DNA, 20 bp, human
gtccctctgtagctcggccc

SEQ ID NO: 392601 - DNA, 20 bp, human
gcttgcgtctcgttctgcct

SEQ ID NO: 392602 - DNA, 20 bp, human
gacgtggactgccccccata

SEQ ID NO: 392603 - DNA, 20 bp, human
ggccgagctacagagggatt

SEQ ID NO: 392604 - DNA, 20 bp, human
gtccgcagtacccacggatc

SEQ ID NO: 392605 - DNA, 20 bp, human
ggcctgggccgagctacaga

SEQ ID NO: 392606 - DNA, 20 bp, human
ggcgcggtcacgtgaagtga

SEQ ID NO: 392607 - DNA, 20 bp, human
ggcggctcctgttgctcctc

SEQ ID NO: 392608 - DNA, 20 bp, human
gcggccgggccactcaccgc

SEQ ID NO: 392609 - DNA, 20 bp, human
ggtcacgtgaccacggggac

SEQ ID NO: 392610 - DNA, 20 bp, human
gcgagagcccgaggagcaac

SEQ ID NO: 392611 - DNA, 20 bp, human
gcgctgcggcgcgatggcgg

SEQ ID NO: 392612 - DNA, 20 bp, human
gagaccgtgagcggggaggc

SEQ ID NO: 392613 - DNA, 20 bp, human
gactccgggccgtaactctc

SEQ ID NO: 392614 - DNA, 20 bp, human
ggaccttgccgcttcccgta

SEQ ID NO: 392615 - DNA, 20 bp, human
gacttcacgtgaccgcgcgg

SEQ ID NO: 392616 - DNA, 20 bp, human
gagtccccgcgctgagagcc

SEQ ID NO: 392617 - DNA, 20 bp, human
gtcagcgcggggactcctgg

SEQ ID NO: 392618 - DNA, 20 bp, human
gccagaggaaataagttggt

SEQ ID NO: 392619 - DNA, 20 bp, human
gcggcccagaggaaataagt

SEQ ID NO: 392620 - DNA, 20 bp, human
gcttgtgcgcatggccactt

SEQ ID NO: 392621 - DNA, 20 bp, human
gcacccacagccggcctccg

SEQ ID NO: 392622 - DNA, 20 bp, human
gcgccgctgccattggtcgc

SEQ ID NO: 392623 - DNA, 20 bp, human
gaggtgagaacccggcccag

SEQ ID NO: 392624 - DNA, 20 bp, human
gcatccgggctctcagcgcg

SEQ ID NO: 392625 - DNA, 20 bp, human
ggctccgagcgcaggccgtc

SEQ ID NO: 392626 - DNA, 20 bp, human
gacgccccggcccttgggtc

SEQ ID NO: 392627 - DNA, 20 bp, human
ggagccggacccaagggccg

SEQ ID NO: 392628 - DNA, 20 bp, human
gcggggcgtggaggagtaga

SEQ ID NO: 392629 - DNA, 20 bp, human
gcggcggcccagttccttgt

SEQ ID NO: 392630 - DNA, 20 bp, human
ggcttccgagccggacccaa

SEQ ID NO: 392631 - DNA, 20 bp, human
ggccgctcccgacgcctgtc

SEQ ID NO: 392632 - DNA, 20 bp, human
gtccggctcggaagcagccc

SEQ ID NO: 392633 - DNA, 20 bp, human
gtacacgtcccgacaggcgt

SEQ ID NO: 392634 - DNA, 20 bp, human
gggaaacgacggcatttgtt

SEQ ID NO: 392635 - DNA, 20 bp, human
ggggaaaccgagtgctctgc

SEQ ID NO: 392636 - DNA, 20 bp, human
ggggactgtgtgggacacat

SEQ ID NO: 392637 - DNA, 20 bp, human
gaggtagaaggggactgtgt

SEQ ID NO: 392638 - DNA, 20 bp, human
gtcagcgagtgaagtcacaa

SEQ ID NO: 392639 - DNA, 20 bp, human
gaaggtgggagcagagtgta

SEQ ID NO: 392640 - DNA, 20 bp, human
gcgtgtcttgctgggacctg

SEQ ID NO: 392641 - DNA, 20 bp, human
gggcctgcatagaaaagggt

SEQ ID NO: 392642 - DNA, 20 bp, human
gcagagtgtagggaaccctg

SEQ ID NO: 392643 - DNA, 20 bp, human
ggcgagtgaagtcacaaagg

SEQ ID NO: 392644 - DNA, 20 bp, human
gaggggtctgctactatctt

SEQ ID NO: 392645 - DNA, 20 bp, human
gcacaaaggaggagtgccct

SEQ ID NO: 392646 - DNA, 20 bp, human
gactgggctgagggagaaca

SEQ ID NO: 392647 - DNA, 20 bp, human
gtgagggagaacagggtctc

SEQ ID NO: 392648 - DNA, 20 bp, human
gtgtccccaggacaggactc

SEQ ID NO: 392649 - DNA, 20 bp, human
gccactccccgcccgctgga

SEQ ID NO: 392650 - DNA, 20 bp, human
ggccaccagagtcctgtcct

SEQ ID NO: 392651 - DNA, 20 bp, human
gaacagggtctctggaaccg

SEQ ID NO: 392652 - DNA, 20 bp, human
gccccaggacaggactctgg

SEQ ID NO: 392653 - DNA, 20 bp, human
gtccagcttgacttgtgaca

SEQ ID NO: 392654 - DNA, 20 bp, human
gctctggaaccgtggaagcc

SEQ ID NO: 392655 - DNA, 20 bp, human
gggcttccttccagcgggcg

SEQ ID NO: 392656 - DNA, 20 bp, human
gctcggcggtgacttaatcc

SEQ ID NO: 392657 - DNA, 20 bp, human
ggcctcgcggcgggttgccc

SEQ ID NO: 392658 - DNA, 20 bp, human
gccgccgcgtctgtgtggac

SEQ ID NO: 392659 - DNA, 20 bp, human
gccgagcccgcccccgtgcc

SEQ ID NO: 392660 - DNA, 20 bp, human
gtcagcgcgggccagaatcg

SEQ ID NO: 392661 - DNA, 20 bp, human
gttcccggtccacacagacg

SEQ ID NO: 392662 - DNA, 20 bp, human
gagaccccggacacccgagg

SEQ ID NO: 392663 - DNA, 20 bp, human
ggccgtcgctcacctcccgg

SEQ ID NO: 392664 - DNA, 20 bp, human
gcgcccccctcgggtgtccg

SEQ ID NO: 392665 - DNA, 20 bp, human
gccgaggagccgcgcattcc

SEQ ID NO: 392666 - DNA, 20 bp, human
ggtggccaacgatggatagg

SEQ ID NO: 392667 - DNA, 20 bp, human
ggccaacgatggataggagg

SEQ ID NO: 392668 - DNA, 20 bp, human
gaggtggattgtgatgtatt

SEQ ID NO: 392669 - DNA, 20 bp, human
ggaaacgtactcattcccag

SEQ ID NO: 392670 - DNA, 20 bp, human
gtccacctcctatccatcgt

SEQ ID NO: 392671 - DNA, 20 bp, human
gtaggagtttcaccagactg

SEQ ID NO: 392672 - DNA, 20 bp, human
gttgagaatgaagtgcggcc

SEQ ID NO: 392673 - DNA, 20 bp, human
ggaggagttccgtaaccaaa

SEQ ID NO: 392674 - DNA, 20 bp, human
gtttgtggccaacgatggat

SEQ ID NO: 392675 - DNA, 20 bp, human
gagtttcaccagactgtgga

SEQ ID NO: 392676 - DNA, 20 bp, human
gccgcccgggaccggaagtg

SEQ ID NO: 392677 - DNA, 20 bp, human
gcgaccgcgcgggaaagctc

SEQ ID NO: 392678 - DNA, 20 bp, human
gaagcacttgagatggtccg

SEQ ID NO: 392679 - DNA, 20 bp, human
ggtggcggaagcacttgaga

SEQ ID NO: 392680 - DNA, 20 bp, human
gaggacatgcctccgccggg

SEQ ID NO: 392681 - DNA, 20 bp, human
ggacccgacagtcctcgacg

SEQ ID NO: 392682 - DNA, 20 bp, human
gggcctgcgcaacaccccag

SEQ ID NO: 392683 - DNA, 20 bp, human
gttcccggcggtgtgaccgg

SEQ ID NO: 392684 - DNA, 20 bp, human
gttgccgcgtcgaggactgt

SEQ ID NO: 392685 - DNA, 20 bp, human
gcgccggggtctcagagtct

SEQ ID NO: 392686 - DNA, 20 bp, human
gctcccgcgcgggacctggg

SEQ ID NO: 392687 - DNA, 20 bp, human
gcaacctgcagcggaccaaa

SEQ ID NO: 392688 - DNA, 20 bp, human
ggggacccgcgggggtctga

SEQ ID NO: 392689 - DNA, 20 bp, human
gcggagcgggcgtaccccca

SEQ ID NO: 392690 - DNA, 20 bp, human
ggcccggccagtggaaggcg

SEQ ID NO: 392691 - DNA, 20 bp, human
gccacggcccggccagtgga

SEQ ID NO: 392692 - DNA, 20 bp, human
gcgtccccctcagacccccg

SEQ ID NO: 392693 - DNA, 20 bp, human
gagacccccgcgggtcccgg

SEQ ID NO: 392694 - DNA, 20 bp, human
ggagacccgggtaactgccg

SEQ ID NO: 392695 - DNA, 20 bp, human
gcccgcgccttccactggcc

SEQ ID NO: 392696 - DNA, 20 bp, human
gcggcccgggacttcgtccg

SEQ ID NO: 392697 - DNA, 20 bp, human
gggtccccggacgaagtccc

SEQ ID NO: 392698 - DNA, 20 bp, human
gtgcccgcggagccaggtgg

SEQ ID NO: 392699 - DNA, 20 bp, human
gcgggggcgcgcagcgtccc

SEQ ID NO: 392700 - DNA, 20 bp, human
ggcgtcggaaggagcctcgc

SEQ ID NO: 392701 - DNA, 20 bp, human
gggtgacagtgcaagtgctt

SEQ ID NO: 392702 - DNA, 20 bp, human
ggaagcgcagtctcgtccgc

SEQ ID NO: 392703 - DNA, 20 bp, human
gcccgggcacagctgggact

SEQ ID NO: 392704 - DNA, 20 bp, human
gcgggggcggaaccctggga

SEQ ID NO: 392705 - DNA, 20 bp, human
ggctaaagaggttgcggccc

SEQ ID NO: 392706 - DNA, 20 bp, human
gagaatgttaagggcttctg

SEQ ID NO: 392707 - DNA, 20 bp, human
ggcgccgcgaacaggtgctg

SEQ ID NO: 392708 - DNA, 20 bp, human
gccagcccgtggcccacaaa

SEQ ID NO: 392709 - DNA, 20 bp, human
gtgggccaaaaacgacacac

SEQ ID NO: 392710 - DNA, 20 bp, human
gaagggctgtgccaagttca

SEQ ID NO: 392711 - DNA, 20 bp, human
gagggaacgggagatgttgc

SEQ ID NO: 392712 - DNA, 20 bp, human
gagaccggatccggaagcaa

SEQ ID NO: 392713 - DNA, 20 bp, human
gatgttaagggcttctgcgg

SEQ ID NO: 392714 - DNA, 20 bp, human
gccgcgaacaggtgctgcgg

SEQ ID NO: 392715 - DNA, 20 bp, human
gacccggagtcctggttcct

SEQ ID NO: 392716 - DNA, 20 bp, human
gtacgacgaccgcggcccgg

SEQ ID NO: 392717 - DNA, 20 bp, human
gtgaaggcgggtcgtgccgg

SEQ ID NO: 392718 - DNA, 20 bp, human
gggaccggcctgagcggagg

SEQ ID NO: 392719 - DNA, 20 bp, human
ggcggaggcggagactagag

SEQ ID NO: 392720 - DNA, 20 bp, human
gttcaggcgtacgacgaccg

SEQ ID NO: 392721 - DNA, 20 bp, human
ggtcgtcgtacgcctgaagg

SEQ ID NO: 392722 - DNA, 20 bp, human
gccggcgtgaggaagctcag

SEQ ID NO: 392723 - DNA, 20 bp, human
gtccgctcaggccggtcctc

SEQ ID NO: 392724 - DNA, 20 bp, human
gcccggaggaccggcctgag

SEQ ID NO: 392725 - DNA, 20 bp, human
gcaggcggaggcagcccgag

SEQ ID NO: 392726 - DNA, 20 bp, human
gcgaaccgggtagtgccgca

SEQ ID NO: 392727 - DNA, 20 bp, human
gagccaggcaccggccgaac

SEQ ID NO: 392728 - DNA, 20 bp, human
gtacaccttgcggcactacc

SEQ ID NO: 392729 - DNA, 20 bp, human
gcggcactacccggttcggc

SEQ ID NO: 392730 - DNA, 20 bp, human
gacccggttcggccggtgcc

SEQ ID NO: 392731 - DNA, 20 bp, human
ggagcagggcgccaggaggc

SEQ ID NO: 392732 - DNA, 20 bp, human
ggtatgaaaatcatgttata

SEQ ID NO: 392733 - DNA, 20 bp, human
gtgttcttaactctgatagc

SEQ ID NO: 392734 - DNA, 20 bp, human
gaagcagtaattacaccttg

SEQ ID NO: 392735 - DNA, 20 bp, human
gggcatttggaaagaaacta

SEQ ID NO: 392736 - DNA, 20 bp, human
gcgtcggaacgtgatgtcag

SEQ ID NO: 392737 - DNA, 20 bp, human
ggcggcgggcggtgatgtca

SEQ ID NO: 392738 - DNA, 20 bp, human
gcggaacgtgatgtcagagg

SEQ ID NO: 392739 - DNA, 20 bp, human
ggccgcccgctctgacatca

SEQ ID NO: 392740 - DNA, 20 bp, human
ggggccgggccgggatgatc

SEQ ID NO: 392741 - DNA, 20 bp, human
ggggcggctcagtgcggcgt

SEQ ID NO: 392742 - DNA, 20 bp, human
gctgggagatggagtcaagc

SEQ ID NO: 392743 - DNA, 20 bp, human
gggagacaggtgagttttat

SEQ ID NO: 392744 - DNA, 20 bp, human
gtgtgggatggtcccagaag

SEQ ID NO: 392745 - DNA, 20 bp, human
gcgggtggcagagagctgta

SEQ ID NO: 392746 - DNA, 20 bp, human
gaggctgtgtcgggttacga

SEQ ID NO: 392747 - DNA, 20 bp, human
gtctccgcccccttcgtgat

SEQ ID NO: 392748 - DNA, 20 bp, human
gtgtcccgaggagagaagta

SEQ ID NO: 392749 - DNA, 20 bp, human
gacgaagggggcggagagtc

SEQ ID NO: 392750 - DNA, 20 bp, human
ggcggcaattctccggtggg

SEQ ID NO: 392751 - DNA, 20 bp, human
gtcccattgcctatcacgaa

SEQ ID NO: 392752 - DNA, 20 bp, human
gcccccttcgtgataggcaa

SEQ ID NO: 392753 - DNA, 20 bp, human
gccgaactcgcagcgtcggt

SEQ ID NO: 392754 - DNA, 20 bp, human
ggaagatagcggcaattctc

SEQ ID NO: 392755 - DNA, 20 bp, human
gcctgagagggcgagttacc

SEQ ID NO: 392756 - DNA, 20 bp, human
gcggcgtgacatttgagaga

SEQ ID NO: 392757 - DNA, 20 bp, human
ggctgtgtgacgtcattgta

SEQ ID NO: 392758 - DNA, 20 bp, human
ggagagatggttgccatctt

SEQ ID NO: 392759 - DNA, 20 bp, human
gaaatgtagcgaaactctca

SEQ ID NO: 392760 - DNA, 20 bp, human
gtggttgccatcttgggtta

SEQ ID NO: 392761 - DNA, 20 bp, human
ggtcttgccgtaacccaaga

SEQ ID NO: 392762 - DNA, 20 bp, human
gggaagtgcacctgactgag

SEQ ID NO: 392763 - DNA, 20 bp, human
gtgtagcgaaactctcaggg

SEQ ID NO: 392764 - DNA, 20 bp, human
gatagtgaaacgaacaccac

SEQ ID NO: 392765 - DNA, 20 bp, human
gctcttcgtgcagagtaacg

SEQ ID NO: 392766 - DNA, 20 bp, human
gccggagcgcgccaagttga

SEQ ID NO: 392767 - DNA, 20 bp, human
gtaccgcagagctctagctc

SEQ ID NO: 392768 - DNA, 20 bp, human
gaaagccaggaggcgggaca

SEQ ID NO: 392769 - DNA, 20 bp, human
gggcatcccaacctcgactt

SEQ ID NO: 392770 - DNA, 20 bp, human
ggacggggtcaaaagccagg

SEQ ID NO: 392771 - DNA, 20 bp, human
gaaggacggggtcaaaagcc

SEQ ID NO: 392772 - DNA, 20 bp, human
ggacggaggaagcaaagtgc

SEQ ID NO: 392773 - DNA, 20 bp, human
gtcgactttggccttcaact

SEQ ID NO: 392774 - DNA, 20 bp, human
ggtctccccgcgccaggcat

SEQ ID NO: 392775 - DNA, 20 bp, human
ggatgcccgatgcctggcgc

SEQ ID NO: 392776 - DNA, 20 bp, human
gcagcccggggccgccttgc

SEQ ID NO: 392777 - DNA, 20 bp, human
ggggaatggtagtcccagct

SEQ ID NO: 392778 - DNA, 20 bp, human
ggggagaagcattgtgtgct

SEQ ID NO: 392779 - DNA, 20 bp, human
gccgcgcggcgcaagtcttc

SEQ ID NO: 392780 - DNA, 20 bp, human
gcggcgcaagtcttccggtc

SEQ ID NO: 392781 - DNA, 20 bp, human
gtgcgccgcgcgggcttatt

SEQ ID NO: 392782 - DNA, 20 bp, human
gcgtagtcccggcaccggca

SEQ ID NO: 392783 - DNA, 20 bp, human
gaagacgtcagacgccagac

SEQ ID NO: 392784 - DNA, 20 bp, human
gagtcccggcaccggcaagg

SEQ ID NO: 392785 - DNA, 20 bp, human
gggcaccggcaaggcggccc

SEQ ID NO: 392786 - DNA, 20 bp, human
gtacacccggaagtgttctg

SEQ ID NO: 392787 - DNA, 20 bp, human
gcgagactacggaaggccga

SEQ ID NO: 392788 - DNA, 20 bp, human
ggctcggtttcgcgagatcg

SEQ ID NO: 392789 - DNA, 20 bp, human
gaaccgagcgagactacgga

SEQ ID NO: 392790 - DNA, 20 bp, human
gtacggaaggccgaaggatt

SEQ ID NO: 392791 - DNA, 20 bp, human
ggcgaaaccgagcgagacta

SEQ ID NO: 392792 - DNA, 20 bp, human
ggctccgccgcgccgccgtg

SEQ ID NO: 392793 - DNA, 20 bp, human
gggcgaccccagaacacttc

SEQ ID NO: 392794 - DNA, 20 bp, human
gtctggggtcgcccccacgg

SEQ ID NO: 392795 - DNA, 20 bp, human
gtacgcagagagtacgtcga

SEQ ID NO: 392796 - DNA, 20 bp, human
gtcaaaaaggcattgtccct

SEQ ID NO: 392797 - DNA, 20 bp, human
gagtgctcgtttcccgggtg

SEQ ID NO: 392798 - DNA, 20 bp, human
gtggcaggggcactcaccat

SEQ ID NO: 392799 - DNA, 20 bp, human
ggggcactcaccatcggtaa

SEQ ID NO: 392800 - DNA, 20 bp, human
ggaaggcacactgctcaaaa

SEQ ID NO: 392801 - DNA, 20 bp, human
gtggagagagatacagatct

SEQ ID NO: 392802 - DNA, 20 bp, human
ggcattgtccctggggacac

SEQ ID NO: 392803 - DNA, 20 bp, human
gagtctctgccagatctaaa

SEQ ID NO: 392804 - DNA, 20 bp, human
gatctggcagagacttgaag

SEQ ID NO: 392805 - DNA, 20 bp, human
ggcacagagtgctcgtttcc

SEQ ID NO: 392806 - DNA, 20 bp, human
ggggccgctcacaccggaag

SEQ ID NO: 392807 - DNA, 20 bp, human
gttcctggccgccaaaaccg

SEQ ID NO: 392808 - DNA, 20 bp, human
gtcggagcgtgggaaccgga

SEQ ID NO: 392809 - DNA, 20 bp, human
gaaccgaggtggaggaaact

SEQ ID NO: 392810 - DNA, 20 bp, human
gaagctgggagagtagccga

SEQ ID NO: 392811 - DNA, 20 bp, human
gctggccgccaaaaccgagg

SEQ ID NO: 392812 - DNA, 20 bp, human
gagggccgacctcttcaaga

SEQ ID NO: 392813 - DNA, 20 bp, human
gggccaggaagcgcgacctt

SEQ ID NO: 392814 - DNA, 20 bp, human
gggaagcggaagctagtctc

SEQ ID NO: 392815 - DNA, 20 bp, human
ggcaaggcggcagctcgtac

SEQ ID NO: 392816 - DNA, 20 bp, human
ggcaggctctcgaagtgagg

SEQ ID NO: 392817 - DNA, 20 bp, human
gcgagagcctgctgtttccg

SEQ ID NO: 392818 - DNA, 20 bp, human
gtgcgcctgcgccctagcgc

SEQ ID NO: 392819 - DNA, 20 bp, human
gacagcaggctctcgaagtg

SEQ ID NO: 392820 - DNA, 20 bp, human
ggaggctgcagccggcgcta

SEQ ID NO: 392821 - DNA, 20 bp, human
ggtgcccgtcgaaggaatag

SEQ ID NO: 392822 - DNA, 20 bp, human
gcgaaggaatagtggatgag

SEQ ID NO: 392823 - DNA, 20 bp, human
ggactcgcgataaccctctg

SEQ ID NO: 392824 - DNA, 20 bp, human
gtggcaaggtaaagcatccg

SEQ ID NO: 392825 - DNA, 20 bp, human
gaagcatccgcggaaacagc

SEQ ID NO: 392826 - DNA, 20 bp, human
ggcggtccgccggtcgtgga

SEQ ID NO: 392827 - DNA, 20 bp, human
gtgactgcgcctacctgtgg

SEQ ID NO: 392828 - DNA, 20 bp, human
gaggacacgccctccacgac

SEQ ID NO: 392829 - DNA, 20 bp, human
ggggcgagacggagtgacgt

SEQ ID NO: 392830 - DNA, 20 bp, human
gagggcccggccaatccgga

SEQ ID NO: 392831 - DNA, 20 bp, human
ggcgctcggcgcgtggtcgg

SEQ ID NO: 392832 - DNA, 20 bp, human
gccgtctcgccctgccccgg

SEQ ID NO: 392833 - DNA, 20 bp, human
gacacgccctccacgaccgg

SEQ ID NO: 392834 - DNA, 20 bp, human
ggtcagctggagcgtcgcgg

SEQ ID NO: 392835 - DNA, 20 bp, human
gactccgtctcgccctgccc

SEQ ID NO: 392836 - DNA, 20 bp, human
ggcgcagcgggactggacct

SEQ ID NO: 392837 - DNA, 20 bp, human
gagcccgcaggcggcgccga

SEQ ID NO: 392838 - DNA, 20 bp, human
gcgcccgggcgtccggtcgc

SEQ ID NO: 392839 - DNA, 20 bp, human
gcacccaggcggaaacactc

SEQ ID NO: 392840 - DNA, 20 bp, human
ggcgtcgggtcggtccgggt

SEQ ID NO: 392841 - DNA, 20 bp, human
ggagtcggtgctactggcgt

SEQ ID NO: 392842 - DNA, 20 bp, human
gtcggtccgggtaggcgcag

SEQ ID NO: 392843 - DNA, 20 bp, human
ggcaactcaccccgtggagg

SEQ ID NO: 392844 - DNA, 20 bp, human
ggaggtgccccctgcccggt

SEQ ID NO: 392845 - DNA, 20 bp, human
ggctaggagcgtccagtgtc

SEQ ID NO: 392846 - DNA, 20 bp, human
gtgctgtaatggagcagggg

SEQ ID NO: 392847 - DNA, 20 bp, human
gccctcgcagccctcacctc

SEQ ID NO: 392848 - DNA, 20 bp, human
gctgggaaaagggcctccgc

SEQ ID NO: 392849 - DNA, 20 bp, human
gtatcggggctggtaaaaaa

SEQ ID NO: 392850 - DNA, 20 bp, human
gggcggggatcgtgctgtaa

SEQ ID NO: 392851 - DNA, 20 bp, human
gctgccggcgcgggaaaaag

SEQ ID NO: 392852 - DNA, 20 bp, human
gtcgtgctgtaatggagcag

SEQ ID NO: 392853 - DNA, 20 bp, human
ggagggtccgggctgggaaa

SEQ ID NO: 392854 - DNA, 20 bp, human
gagagcgctccgggaggcta

SEQ ID NO: 392855 - DNA, 20 bp, human
ggccgcgattggctgtcgga

SEQ ID NO: 392856 - DNA, 20 bp, human
gagctggggcgtacccaagt

SEQ ID NO: 392857 - DNA, 20 bp, human
gacagcggcaggagtaaggg

SEQ ID NO: 392858 - DNA, 20 bp, human
gggcgcctcccgcaggtggg

SEQ ID NO: 392859 - DNA, 20 bp, human
ggtggctgccgcagctagaa

SEQ ID NO: 392860 - DNA, 20 bp, human
ggggacagcggcaggagtaa

SEQ ID NO: 392861 - DNA, 20 bp, human
ggaggcgccctgagaccgag

SEQ ID NO: 392862 - DNA, 20 bp, human
gtggaaccccagtttgctga

SEQ ID NO: 392863 - DNA, 20 bp, human
gaacctcggtgcaaggcaaa

SEQ ID NO: 392864 - DNA, 20 bp, human
ggttccaggtctacctactt

SEQ ID NO: 392865 - DNA, 20 bp, human
gaggcacattgtcaaatacg

SEQ ID NO: 392866 - DNA, 20 bp, human
ggacaaacttcaatatcaac

SEQ ID NO: 392867 - DNA, 20 bp, human
gagtttgcaaaccaatcttt

SEQ ID NO: 392868 - DNA, 20 bp, human
gagcactcaccaatagcgag

SEQ ID NO: 392869 - DNA, 20 bp, human
gacctctggctcccaaagat

SEQ ID NO: 392870 - DNA, 20 bp, human
gggaaaaaaatcctctaagc

SEQ ID NO: 392871 - DNA, 20 bp, human
gggtaacttttgtgtcaatg

SEQ ID NO: 392872 - DNA, 20 bp, human
ggggtacctcacaaaactcc

SEQ ID NO: 392873 - DNA, 20 bp, human
gtgtgagaacttcaagagtg

SEQ ID NO: 392874 - DNA, 20 bp, human
gcgtgaaatcaccagcttag

SEQ ID NO: 392875 - DNA, 20 bp, human
gactcttctccactcgctat

SEQ ID NO: 392876 - DNA, 20 bp, human
gaacccgcgccagagggagc

SEQ ID NO: 392877 - DNA, 20 bp, human
ggttctcgcgctttcacgat

SEQ ID NO: 392878 - DNA, 20 bp, human
ggagcggaacccgcgccaga

SEQ ID NO: 392879 - DNA, 20 bp, human
gtgaaagcgcgagaacacag

SEQ ID NO: 392880 - DNA, 20 bp, human
gaacacaggggattatcgcg

SEQ ID NO: 392881 - DNA, 20 bp, human
gggcgctggaagccaagcgg

SEQ ID NO: 392882 - DNA, 20 bp, human
ggtagagctgtccgcctcgt

SEQ ID NO: 392883 - DNA, 20 bp, human
gccccagctccctctggcgc

SEQ ID NO: 392884 - DNA, 20 bp, human
ggggcggagcgccgggcgtc

SEQ ID NO: 392885 - DNA, 20 bp, human
ggggccgcgggccgcagagt

SEQ ID NO: 392886 - DNA, 20 bp, human
gacgcggggcacttccggtt

SEQ ID NO: 392887 - DNA, 20 bp, human
ggggctgcggaaggtaactg

SEQ ID NO: 392888 - DNA, 20 bp, human
gtggcgacgcggggcacttc

SEQ ID NO: 392889 - DNA, 20 bp, human
gccctcggaggtgaaggcgt

SEQ ID NO: 392890 - DNA, 20 bp, human
gtcggagagtccctgttgtc

SEQ ID NO: 392891 - DNA, 20 bp, human
ggccgggcgcgtctaacctg

SEQ ID NO: 392892 - DNA, 20 bp, human
ggcgtctaacctgcggggaa

SEQ ID NO: 392893 - DNA, 20 bp, human
gctgtaggcgccagacaaca

SEQ ID NO: 392894 - DNA, 20 bp, human
ggagacaataccgttgccat

SEQ ID NO: 392895 - DNA, 20 bp, human
gaagccgcgccgtcgggctc

SEQ ID NO: 392896 - DNA, 20 bp, human
gtgtcccagagcctggtagc

SEQ ID NO: 392897 - DNA, 20 bp, human
gagtgggcggcatcgggtgg

SEQ ID NO: 392898 - DNA, 20 bp, human
ggggtccccagtctccacat

SEQ ID NO: 392899 - DNA, 20 bp, human
gggcagtgggctgctagctc

SEQ ID NO: 392900 - DNA, 20 bp, human
gaaaatgggagcctgctacc

SEQ ID NO: 392901 - DNA, 20 bp, human
gagctcgccgagggcatggt

SEQ ID NO: 392902 - DNA, 20 bp, human
gggtaccaggccaaagcttg

SEQ ID NO: 392903 - DNA, 20 bp, human
gtgggccactaccagccaca

SEQ ID NO: 392904 - DNA, 20 bp, human
gagctgtctctcttgagcat

SEQ ID NO: 392905 - DNA, 20 bp, human
gcaccctgaagagaaggcac

SEQ ID NO: 392906 - DNA, 20 bp, human
gccagggagtgatgattgcg

SEQ ID NO: 392907 - DNA, 20 bp, human
ggcccagtgcgcggcagaac

SEQ ID NO: 392908 - DNA, 20 bp, human
gtggaggcaaagttccgaat

SEQ ID NO: 392909 - DNA, 20 bp, human
gaaaacaggaagagggttgg

SEQ ID NO: 392910 - DNA, 20 bp, human
gaactggcgcaagcgcacgc

SEQ ID NO: 392911 - DNA, 20 bp, human
gcactccctggcccagtgcg

SEQ ID NO: 392912 - DNA, 20 bp, human
gttccgcccccgtctggcaa

SEQ ID NO: 392913 - DNA, 20 bp, human
gtgcacggcgtaccgccatt

SEQ ID NO: 392914 - DNA, 20 bp, human
gtggcaagggcccggattct

SEQ ID NO: 392915 - DNA, 20 bp, human
gtgctctctccccctaatgg

SEQ ID NO: 392916 - DNA, 20 bp, human
gaagagccgaggttcctctt

SEQ ID NO: 392917 - DNA, 20 bp, human
gctgcggtgcacatagtcaa

SEQ ID NO: 392918 - DNA, 20 bp, human
ggaggagagcgtcgttctct

SEQ ID NO: 392919 - DNA, 20 bp, human
gaggaacctcggctcttccg

SEQ ID NO: 392920 - DNA, 20 bp, human
gtgggctgagagcgaaagtt

SEQ ID NO: 392921 - DNA, 20 bp, human
gctcctcccaagaggaacct

SEQ ID NO: 392922 - DNA, 20 bp, human
gttctgccgcggaagagccg

SEQ ID NO: 392923 - DNA, 20 bp, human
ggttggagaaccagcgcccg

SEQ ID NO: 392924 - DNA, 20 bp, human
gacgacgctctcctcccaag

SEQ ID NO: 392925 - DNA, 20 bp, human
gttccgtgcagcttctgccg

SEQ ID NO: 392926 - DNA, 20 bp, human
gtgagtgtgcctcccaccga

SEQ ID NO: 392927 - DNA, 20 bp, human
gcaccccggggcgggcaata

SEQ ID NO: 392928 - DNA, 20 bp, human
gtgcctcccaccgagggcta

SEQ ID NO: 392929 - DNA, 20 bp, human
ggggcaatagggggagttga

SEQ ID NO: 392930 - DNA, 20 bp, human
gaaccctagccctcggtggg

SEQ ID NO: 392931 - DNA, 20 bp, human
gtggggcataaccacccaac

SEQ ID NO: 392932 - DNA, 20 bp, human
gaagaacccgagcttgagta

SEQ ID NO: 392933 - DNA, 20 bp, human
gttcttggaagcggtcccac

SEQ ID NO: 392934 - DNA, 20 bp, human
gttgaaccctagccctcggt

SEQ ID NO: 392935 - DNA, 20 bp, human
gaggctccttactcaagctc

SEQ ID NO: 392936 - DNA, 20 bp, human
ggggcctgggacgacggtct

SEQ ID NO: 392937 - DNA, 20 bp, human
gtggcccagaccgtcgtccc

SEQ ID NO: 392938 - DNA, 20 bp, human
ggggcgcgcgcgcggtttgg

SEQ ID NO: 392939 - DNA, 20 bp, human
gtgcttgcacacctccacga

SEQ ID NO: 392940 - DNA, 20 bp, human
gcgcaagaagtgtcgagtta

SEQ ID NO: 392941 - DNA, 20 bp, human
gcgggggcgcgcgcgcggtt

SEQ ID NO: 392942 - DNA, 20 bp, human
gcccaggccccgcgtcgtgg

SEQ ID NO: 392943 - DNA, 20 bp, human
gaagcggcagtgtggggaaa

SEQ ID NO: 392944 - DNA, 20 bp, human
gaacagcggccagctccaga

SEQ ID NO: 392945 - DNA, 20 bp, human
gcgtcccaggccccgcgtcg

SEQ ID NO: 392946 - DNA, 20 bp, human
ggaggggtggagcttactga

SEQ ID NO: 392947 - DNA, 20 bp, human
gtgggggcggagtctggcga

SEQ ID NO: 392948 - DNA, 20 bp, human
gggcagctcccagactcttc

SEQ ID NO: 392949 - DNA, 20 bp, human
gaggcgaggcatgacggccg

SEQ ID NO: 392950 - DNA, 20 bp, human
gaaaccgggcctcgggattg

SEQ ID NO: 392951 - DNA, 20 bp, human
gaaaagcctcagctatctgg

SEQ ID NO: 392952 - DNA, 20 bp, human
gggcggagtctggcgagggg

SEQ ID NO: 392953 - DNA, 20 bp, human
ggggtggagttaggctaaac

SEQ ID NO: 392954 - DNA, 20 bp, human
gcccccaagcccgaagagtc

SEQ ID NO: 392955 - DNA, 20 bp, human
ggggagctgccccaatcccg

SEQ ID NO: 392956 - DNA, 20 bp, human
ggcaacccccaccctggcgc

SEQ ID NO: 392957 - DNA, 20 bp, human
gggcgcacaacgaccctccc

SEQ ID NO: 392958 - DNA, 20 bp, human
ggaagcgaggtgcgtcacgt

SEQ ID NO: 392959 - DNA, 20 bp, human
gtggggaagaggaaaacctg

SEQ ID NO: 392960 - DNA, 20 bp, human
ggctggctcccacccgggga

SEQ ID NO: 392961 - DNA, 20 bp, human
gacaacgaccctccccgggt

SEQ ID NO: 392962 - DNA, 20 bp, human
ggctcgcgacggcgaaggag

SEQ ID NO: 392963 - DNA, 20 bp, human
gtgggcgtatgaaggacccg

SEQ ID NO: 392964 - DNA, 20 bp, human
gcgctcgctggctcccaccc

SEQ ID NO: 392965 - DNA, 20 bp, human
ggggggcgggcgtgatcccg

SEQ ID NO: 392966 - DNA, 20 bp, human
gagtgcccctcatctttagg

SEQ ID NO: 392967 - DNA, 20 bp, human
gagtgaccgtgcgtccacac

SEQ ID NO: 392968 - DNA, 20 bp, human
gagcgtggcggcagtcagaa

SEQ ID NO: 392969 - DNA, 20 bp, human
gtcctgtggcgccgctgcgc

SEQ ID NO: 392970 - DNA, 20 bp, human
ggagtcgggtcggtgcaaca

SEQ ID NO: 392971 - DNA, 20 bp, human
ggcaaccgggcaaccggaaa

SEQ ID NO: 392972 - DNA, 20 bp, human
ggccacggaaggaatctgtt

SEQ ID NO: 392973 - DNA, 20 bp, human
gccggcatgcatcgttcctg

SEQ ID NO: 392974 - DNA, 20 bp, human
gaacgatgcatgccgggacc

SEQ ID NO: 392975 - DNA, 20 bp, human
gtccctgccccctaaagatg

SEQ ID NO: 392976 - DNA, 20 bp, human
gacccgcgccgcggaaccac

SEQ ID NO: 392977 - DNA, 20 bp, human
gggagtggcggcattcagga

SEQ ID NO: 392978 - DNA, 20 bp, human
gagactgaatctactcgtcc

SEQ ID NO: 392979 - DNA, 20 bp, human
ggcaacagagcaaccggaag

SEQ ID NO: 392980 - DNA, 20 bp, human
gcaccgttccagtggttccg

SEQ ID NO: 392981 - DNA, 20 bp, human
gcgccgcggaaccactggaa

SEQ ID NO: 392982 - DNA, 20 bp, human
gagcgcccctcatctttaag

SEQ ID NO: 392983 - DNA, 20 bp, human
gccggcatgcaccgttccag

SEQ ID NO: 392984 - DNA, 20 bp, human
gggaggggaaagactactcc

SEQ ID NO: 392985 - DNA, 20 bp, human
gcccccacgggccgccggtt

SEQ ID NO: 392986 - DNA, 20 bp, human
gactcccggactggagaaaa

SEQ ID NO: 392987 - DNA, 20 bp, human
gttggtccgtgcagggaagt

SEQ ID NO: 392988 - DNA, 20 bp, human
gcagggaagtgggaatcgtt

SEQ ID NO: 392989 - DNA, 20 bp, human
gtggcccaggcgtctcgctc

SEQ ID NO: 392990 - DNA, 20 bp, human
ggggcggggtgggacagagt

SEQ ID NO: 392991 - DNA, 20 bp, human
ggtccccgcgactcccggac

SEQ ID NO: 392992 - DNA, 20 bp, human
gtgaaggtccccgcgactcc

SEQ ID NO: 392993 - DNA, 20 bp, human
ggaaaacggctcttgcgatg

SEQ ID NO: 392994 - DNA, 20 bp, human
gagcacgagagagtccatga

SEQ ID NO: 392995 - DNA, 20 bp, human
gttctccagtccgggagtcg

SEQ ID NO: 392996 - DNA, 20 bp, human
gaggaaggcgggtccaacac

SEQ ID NO: 392997 - DNA, 20 bp, human
ggcaaccctaacactcgccc

SEQ ID NO: 392998 - DNA, 20 bp, human
gaggcacaaacctagcgcca

SEQ ID NO: 392999 - DNA, 20 bp, human
ggctgtcaaggtagattcca

SEQ ID NO: 393000 - DNA, 20 bp, human
gtgagcctgggcgagtgtta

SEQ ID NO: 393001 - DNA, 20 bp, human
gggaggccgcgcaagcgcac

SEQ ID NO: 393002 - DNA, 20 bp, human
ggcagccaaggcctagtttt

SEQ ID NO: 393003 - DNA, 20 bp, human
ggcaaacgccccgccagcag

SEQ ID NO: 393004 - DNA, 20 bp, human
gtacaccgaaaactaggcct

SEQ ID NO: 393005 - DNA, 20 bp, human
gtaagcggagtacagtgcct

SEQ ID NO: 393006 - DNA, 20 bp, human
gaggctgcgcggtaccgcgg

SEQ ID NO: 393007 - DNA, 20 bp, human
gcgtgcgctgcggtcactca

SEQ ID NO: 393008 - DNA, 20 bp, human
gcagcctcgcgtcccgtcag

SEQ ID NO: 393009 - DNA, 20 bp, human
gcgggaaaatgaggctgcgc

SEQ ID NO: 393010 - DNA, 20 bp, human
ggcacgagcgcgggaaaatg

SEQ ID NO: 393011 - DNA, 20 bp, human
ggaccgcagcgcacgagcgc

SEQ ID NO: 393012 - DNA, 20 bp, human
gtcagtggggaacaaggtga

SEQ ID NO: 393013 - DNA, 20 bp, human
gttcccgcgctcgtgcgctg

SEQ ID NO: 393014 - DNA, 20 bp, human
gtgtagtagtcagggccacg

SEQ ID NO: 393015 - DNA, 20 bp, human
gcccagaaggtcatgcagtg

SEQ ID NO: 393016 - DNA, 20 bp, human
ggccccagccaggctccaat

SEQ ID NO: 393017 - DNA, 20 bp, human
ggtcctgcagcgccccgctg

SEQ ID NO: 393018 - DNA, 20 bp, human
gcagagaaccctgagttcat

SEQ ID NO: 393019 - DNA, 20 bp, human
gtggaggctggccccggcta

SEQ ID NO: 393020 - DNA, 20 bp, human
gccaacacccccatgaactc

SEQ ID NO: 393021 - DNA, 20 bp, human
gcagcccattggagcctggc

SEQ ID NO: 393022 - DNA, 20 bp, human
gcactctcccgggaaaccgc

SEQ ID NO: 393023 - DNA, 20 bp, human
gacctcggcctggtagcctc

SEQ ID NO: 393024 - DNA, 20 bp, human
gaggctggccccggctatgg

SEQ ID NO: 393025 - DNA, 20 bp, human
ggcacagcctgcggtttccc

SEQ ID NO: 393026 - DNA, 20 bp, human
gcgccctgaggaccctgcgg

SEQ ID NO: 393027 - DNA, 20 bp, human
gagggggcgccgcacccggg

SEQ ID NO: 393028 - DNA, 20 bp, human
ggtcccccgcagggtcctca

SEQ ID NO: 393029 - DNA, 20 bp, human
gaccctgcgggggaccgtgc

SEQ ID NO: 393030 - DNA, 20 bp, human
gaccgtctggaagtcctcca

SEQ ID NO: 393031 - DNA, 20 bp, human
ggactcgcggcgcgccatgg

SEQ ID NO: 393032 - DNA, 20 bp, human
gcccctgctccactaccgtc

SEQ ID NO: 393033 - DNA, 20 bp, human
gcagagccaggagaggtgcg

SEQ ID NO: 393034 - DNA, 20 bp, human
ggctgcacgccggggactcg

SEQ ID NO: 393035 - DNA, 20 bp, human
ggcttctgcgcgctgcacgc

SEQ ID NO: 393036 - DNA, 20 bp, human
gtggcctggagggttgaccc

SEQ ID NO: 393037 - DNA, 20 bp, human
ggggagacactcctcacgaa

SEQ ID NO: 393038 - DNA, 20 bp, human
gtgaggaccaccccttcgtg

SEQ ID NO: 393039 - DNA, 20 bp, human
ggacactcctcacgaagggg

SEQ ID NO: 393040 - DNA, 20 bp, human
ggtagcatttgctcaacctg

SEQ ID NO: 393041 - DNA, 20 bp, human
gtgagcaaatgctacagcca

SEQ ID NO: 393042 - DNA, 20 bp, human
gctagctgcactccacctta

SEQ ID NO: 393043 - DNA, 20 bp, human
gagcaggaagttgatctgaa

SEQ ID NO: 393044 - DNA, 20 bp, human
gagagggagggacgtggtga

SEQ ID NO: 393045 - DNA, 20 bp, human
gaagttgatctgaaaggatg

SEQ ID NO: 393046 - DNA, 20 bp, human
gtgcgcgctctccgcctgat

SEQ ID NO: 393047 - DNA, 20 bp, human
ggataggagttgtagttctg

SEQ ID NO: 393048 - DNA, 20 bp, human
gactcccaaagcttgcagtt

SEQ ID NO: 393049 - DNA, 20 bp, human
gctagggagagaacgccaga

SEQ ID NO: 393050 - DNA, 20 bp, human
gctactgctgtgggtgtcgg

SEQ ID NO: 393051 - DNA, 20 bp, human
ggggagagaacgccagaggg

SEQ ID NO: 393052 - DNA, 20 bp, human
gtagttctgcgggtgaagct

SEQ ID NO: 393053 - DNA, 20 bp, human
gaactacaactcctatcagg

SEQ ID NO: 393054 - DNA, 20 bp, human
ggtactggcccccggagcag

SEQ ID NO: 393055 - DNA, 20 bp, human
ggattaaaaggtcttaacgt

SEQ ID NO: 393056 - DNA, 20 bp, human
gttgtccggtcgggcctctg

SEQ ID NO: 393057 - DNA, 20 bp, human
ggcaacgcgacgggtccctt

SEQ ID NO: 393058 - DNA, 20 bp, human
gtggccctggtccaggatcc

SEQ ID NO: 393059 - DNA, 20 bp, human
gcccgccccagaggcccgac

SEQ ID NO: 393060 - DNA, 20 bp, human
gctcccgctcgctcactggt

SEQ ID NO: 393061 - DNA, 20 bp, human
ggggcggtcgcggaaagggg

SEQ ID NO: 393062 - DNA, 20 bp, human
gggacaactctgcaacgcga

SEQ ID NO: 393063 - DNA, 20 bp, human
gcgttgcagagttgtccggt

SEQ ID NO: 393064 - DNA, 20 bp, human
gcggagctccctgctcccaa

SEQ ID NO: 393065 - DNA, 20 bp, human
gcgacgggtcccttgggagc

SEQ ID NO: 393066 - DNA, 20 bp, human
gcggggcggaagctgtgggg

SEQ ID NO: 393067 - DNA, 20 bp, human
ggggctctcacctgtcggag

SEQ ID NO: 393068 - DNA, 20 bp, human
gtgtctgcgcagagggcgcc

SEQ ID NO: 393069 - DNA, 20 bp, human
gcacccgcaccgtagggcca

SEQ ID NO: 393070 - DNA, 20 bp, human
gctctgcgcagacaccgccc

SEQ ID NO: 393071 - DNA, 20 bp, human
gcggccatggccctacggtg

SEQ ID NO: 393072 - DNA, 20 bp, human
ggggagcgagctcccggccc

SEQ ID NO: 393073 - DNA, 20 bp, human
gctctcacctgtcggagcgg

SEQ ID NO: 393074 - DNA, 20 bp, human
gccgcaccgccgggggttct

SEQ ID NO: 393075 - DNA, 20 bp, human
ggatggtgacggctcaggtg

SEQ ID NO: 393076 - DNA, 20 bp, human
ggcggcgtccggggaggaaa

SEQ ID NO: 393077 - DNA, 20 bp, human
gtctggcacgccctctggga

SEQ ID NO: 393078 - DNA, 20 bp, human
ggcagccccgcccaagtggg

SEQ ID NO: 393079 - DNA, 20 bp, human
gccagagggcgtgccagacc

SEQ ID NO: 393080 - DNA, 20 bp, human
gagaccgggaaactttatct

SEQ ID NO: 393081 - DNA, 20 bp, human
ggaggtgactccacccactt

SEQ ID NO: 393082 - DNA, 20 bp, human
ggcggcagccccgcccaagt

SEQ ID NO: 393083 - DNA, 20 bp, human
ggccagcggcgcggcgtccg

SEQ ID NO: 393084 - DNA, 20 bp, human
ggggggccgggcaagtggcc

SEQ ID NO: 393085 - DNA, 20 bp, human
ggctccctccgggtctcggg

SEQ ID NO: 393086 - DNA, 20 bp, human
gcaagccggtccccgagcgg

SEQ ID NO: 393087 - DNA, 20 bp, human
gaggagccgcggcccggctg

SEQ ID NO: 393088 - DNA, 20 bp, human
gcggcttggggacccgggag

SEQ ID NO: 393089 - DNA, 20 bp, human
gtgctgctgagtaatccccg

SEQ ID NO: 393090 - DNA, 20 bp, human
gcgcgagttgggtgcttcgg

SEQ ID NO: 393091 - DNA, 20 bp, human
ggcggccgccgctcggggac

SEQ ID NO: 393092 - DNA, 20 bp, human
gggcgtgggaggtgggcgtc

SEQ ID NO: 393093 - DNA, 20 bp, human
gggtgagagacacccggaaa

SEQ ID NO: 393094 - DNA, 20 bp, human
gcgccccaccctcccccgaa

SEQ ID NO: 393095 - DNA, 20 bp, human
gggacccaggagtcgggagg

SEQ ID NO: 393096 - DNA, 20 bp, human
ggcgaggccaggcactgccg

SEQ ID NO: 393097 - DNA, 20 bp, human
ggcgctgccgggaggattga

SEQ ID NO: 393098 - DNA, 20 bp, human
gccaccccaaaagcattcga

SEQ ID NO: 393099 - DNA, 20 bp, human
gcccgcgccttgggttccgc

SEQ ID NO: 393100 - DNA, 20 bp, human
gcccggccttcgaatgcttt

SEQ ID NO: 393101 - DNA, 20 bp, human
gggccgggggaggagcgtat

SEQ ID NO: 393102 - DNA, 20 bp, human
gtgccttagcaactcctaga

SEQ ID NO: 393103 - DNA, 20 bp, human
gcccaggccggcggaaccca

SEQ ID NO: 393104 - DNA, 20 bp, human
gactgccgaggagggcgggc

SEQ ID NO: 393105 - DNA, 20 bp, human
ggaaggaacagggaacagtc

SEQ ID NO: 393106 - DNA, 20 bp, human
gcacacaggagccctgagcg

SEQ ID NO: 393107 - DNA, 20 bp, human
gccgcgggagtgagacacca

SEQ ID NO: 393108 - DNA, 20 bp, human
ggggcagcgacccccggcga

SEQ ID NO: 393109 - DNA, 20 bp, human
gcggacgcggggctacgggt

SEQ ID NO: 393110 - DNA, 20 bp, human
gaaggtggagggtgagcccg

SEQ ID NO: 393111 - DNA, 20 bp, human
gcggcggcggggccacactt

SEQ ID NO: 393112 - DNA, 20 bp, human
gcggggccacacttcgggga

SEQ ID NO: 393113 - DNA, 20 bp, human
gagttcccggggaaggtgga

SEQ ID NO: 393114 - DNA, 20 bp, human
gacaccagggcagcgacccc

SEQ ID NO: 393115 - DNA, 20 bp, human
gcaggcgcgaaggacgcagt

SEQ ID NO: 393116 - DNA, 20 bp, human
gagaacgccagatgtcgctg

SEQ ID NO: 393117 - DNA, 20 bp, human
ggtggttccgcggtgagaga

SEQ ID NO: 393118 - DNA, 20 bp, human
gaatcttagtataaataagt

SEQ ID NO: 393119 - DNA, 20 bp, human
gtggaaataaatggttaagt

SEQ ID NO: 393120 - DNA, 20 bp, human
gctgaggacattttgtttcc

SEQ ID NO: 393121 - DNA, 20 bp, human
gcgcacgccctctctcaccg

SEQ ID NO: 393122 - DNA, 20 bp, human
ggtttgaagcaaagcccttc

SEQ ID NO: 393123 - DNA, 20 bp, human
ggcatctctgtggaaataaa

SEQ ID NO: 393124 - DNA, 20 bp, human
gacattttgtttccaggatc

SEQ ID NO: 393125 - DNA, 20 bp, human
ggcggaaccacagcgacatc

SEQ ID NO: 393126 - DNA, 20 bp, human
ggtcgcgcgcagcggtgaag

SEQ ID NO: 393127 - DNA, 20 bp, human
ggagggccccgcttggggga

SEQ ID NO: 393128 - DNA, 20 bp, human
gggtttaggcccggaggcta

SEQ ID NO: 393129 - DNA, 20 bp, human
gggcgggcgggctagggctc

SEQ ID NO: 393130 - DNA, 20 bp, human
ggcccggaggctagggaaag

SEQ ID NO: 393131 - DNA, 20 bp, human
gtttgtgcggcggacaaatg

SEQ ID NO: 393132 - DNA, 20 bp, human
ggcagcccgctcacttcccg

SEQ ID NO: 393133 - DNA, 20 bp, human
gaagtgagggccccgcttgg

SEQ ID NO: 393134 - DNA, 20 bp, human
ggcgcgcagcggtgaagcgg

SEQ ID NO: 393135 - DNA, 20 bp, human
gccgaggtgcacctgcaagg

SEQ ID NO: 393136 - DNA, 20 bp, human
gccccggagcgggtcccgca

SEQ ID NO: 393137 - DNA, 20 bp, human
gagggcgcgcggctcgttgc

SEQ ID NO: 393138 - DNA, 20 bp, human
gtcagtccaagaggctcttc

SEQ ID NO: 393139 - DNA, 20 bp, human
gggtttggggtccaagtccg

SEQ ID NO: 393140 - DNA, 20 bp, human
ggccgggagaagtgaggcct

SEQ ID NO: 393141 - DNA, 20 bp, human
gggtgctgggggctcctaca

SEQ ID NO: 393142 - DNA, 20 bp, human
gcgccttgcgggacccgctc

SEQ ID NO: 393143 - DNA, 20 bp, human
gaggcgggtgcacttgaggt

SEQ ID NO: 393144 - DNA, 20 bp, human
gtcccaagatggctactctc

SEQ ID NO: 393145 - DNA, 20 bp, human
gtttagcgccgggagaagtg

SEQ ID NO: 393146 - DNA, 20 bp, human
gagccccgatgggatgggga

SEQ ID NO: 393147 - DNA, 20 bp, human
ggcggacccgcccctggccg

SEQ ID NO: 393148 - DNA, 20 bp, human
gtggggaggcctcggcgagc

SEQ ID NO: 393149 - DNA, 20 bp, human
gtccacccccgcgggggcgt

SEQ ID NO: 393150 - DNA, 20 bp, human
gacagcagccaggcgcgcga

SEQ ID NO: 393151 - DNA, 20 bp, human
gcgacaggccccaaccccga

SEQ ID NO: 393152 - DNA, 20 bp, human
gctcggcgagccgggctcgc

SEQ ID NO: 393153 - DNA, 20 bp, human
ggctaagagccccgatggga

SEQ ID NO: 393154 - DNA, 20 bp, human
gaggacccaggcccgttccc

SEQ ID NO: 393155 - DNA, 20 bp, human
gtcgcgggcggggtcgacgg

SEQ ID NO: 393156 - DNA, 20 bp, human
ggggctagggcgggagacag

SEQ ID NO: 393157 - DNA, 20 bp, human
gccggccccggtcagtgctg

SEQ ID NO: 393158 - DNA, 20 bp, human
ggcgggagacaggggcccga

SEQ ID NO: 393159 - DNA, 20 bp, human
gcggagccgcagcactgacc

SEQ ID NO: 393160 - DNA, 20 bp, human
ggggcggggtgaagaccgag

SEQ ID NO: 393161 - DNA, 20 bp, human
gctgcggctccggccctggc

SEQ ID NO: 393162 - DNA, 20 bp, human
ggggaaggtcaccgcccggt

SEQ ID NO: 393163 - DNA, 20 bp, human
ggctccggccctggccggca

SEQ ID NO: 393164 - DNA, 20 bp, human
gagagagatctgaccaaggg

SEQ ID NO: 393165 - DNA, 20 bp, human
gtgaggggtctggtggggta

SEQ ID NO: 393166 - DNA, 20 bp, human
gtctgcccggcaacccgcga

SEQ ID NO: 393167 - DNA, 20 bp, human
gacaaggccccagccgtcgc

SEQ ID NO: 393168 - DNA, 20 bp, human
gcggcaacccgcgacggctg

SEQ ID NO: 393169 - DNA, 20 bp, human
gcaagcagaactcggctaca

SEQ ID NO: 393170 - DNA, 20 bp, human
gctaggcagctgcgcctcct

SEQ ID NO: 393171 - DNA, 20 bp, human
gccgcagcgcgcctgagaac

SEQ ID NO: 393172 - DNA, 20 bp, human
gtgggcgtggagtgaagagc

SEQ ID NO: 393173 - DNA, 20 bp, human
gggactcttccggacctgca

SEQ ID NO: 393174 - DNA, 20 bp, human
gcagacagagatcaactcca

SEQ ID NO: 393175 - DNA, 20 bp, human
gaacaaccgcaagcagaact

SEQ ID NO: 393176 - DNA, 20 bp, human
ggggaccgtggccccgagtg

SEQ ID NO: 393177 - DNA, 20 bp, human
gtcgcagagcgggattgaat

SEQ ID NO: 393178 - DNA, 20 bp, human
ggggcccgggactagcgctg

SEQ ID NO: 393179 - DNA, 20 bp, human
gcccgggactagcgctgcgg

SEQ ID NO: 393180 - DNA, 20 bp, human
ggccacccgcaggttgcgga

SEQ ID NO: 393181 - DNA, 20 bp, human
gaccgtggccccgagtgggg

SEQ ID NO: 393182 - DNA, 20 bp, human
gtagtctgaaaggaggtggg

SEQ ID NO: 393183 - DNA, 20 bp, human
gacaacctggatccacaaaa

SEQ ID NO: 393184 - DNA, 20 bp, human
ggtcccgggcccgcgagcac

SEQ ID NO: 393185 - DNA, 20 bp, human
gcgctgacccggaagaagct

SEQ ID NO: 393186 - DNA, 20 bp, human
gtcggctgccggaggtgagg

SEQ ID NO: 393187 - DNA, 20 bp, human
ggggaatgggaacaattcgg

SEQ ID NO: 393188 - DNA, 20 bp, human
gagcatgggggaagtctcga

SEQ ID NO: 393189 - DNA, 20 bp, human
gctaccgcatcgccccccgc

SEQ ID NO: 393190 - DNA, 20 bp, human
gcacctccggcagccgactc

SEQ ID NO: 393191 - DNA, 20 bp, human
gaaggggaatgggaacaatt

SEQ ID NO: 393192 - DNA, 20 bp, human
gggtttccctagacccatag

SEQ ID NO: 393193 - DNA, 20 bp, human
ggatgcggtagctgcagcgg

SEQ ID NO: 393194 - DNA, 20 bp, human
ggatatgccaaatggccagt

SEQ ID NO: 393195 - DNA, 20 bp, human
ggggggcgggctggagaact

SEQ ID NO: 393196 - DNA, 20 bp, human
ggggggcgggtccaatagaa

SEQ ID NO: 393197 - DNA, 20 bp, human
gggcgggtccaatagaaagg

SEQ ID NO: 393198 - DNA, 20 bp, human
gccccgacctggaagtagaa

SEQ ID NO: 393199 - DNA, 20 bp, human
gtgaaccaccagcgacactg

SEQ ID NO: 393200 - DNA, 20 bp, human
ggacccgcccccccccgacc

SEQ ID NO: 393201 - DNA, 20 bp, human
gggaaaaatccggacgatca

SEQ ID NO: 393202 - DNA, 20 bp, human
gagaaaaagggcgggttcaa

SEQ ID NO: 393203 - DNA, 20 bp, human
gtgtcgctggtggttcacct

SEQ ID NO: 393204 - DNA, 20 bp, human
gacctggaagtagaagggag

SEQ ID NO: 393205 - DNA, 20 bp, human
ggtgagaacgcctgggacac

SEQ ID NO: 393206 - DNA, 20 bp, human
gacccagaaggaaaatgggt

SEQ ID NO: 393207 - DNA, 20 bp, human
gcatggcagcgtgacgccga

SEQ ID NO: 393208 - DNA, 20 bp, human
gctcctgaaacgaagaaagt

SEQ ID NO: 393209 - DNA, 20 bp, human
ggacgtctaaaggacccaga

SEQ ID NO: 393210 - DNA, 20 bp, human
gacgtgatggagagtgacta

SEQ ID NO: 393211 - DNA, 20 bp, human
gtaccccacctgacgtctaa

SEQ ID NO: 393212 - DNA, 20 bp, human
ggggtcctttagacgtcagg

SEQ ID NO: 393213 - DNA, 20 bp, human
gggctgccgctaggccttgg

SEQ ID NO: 393214 - DNA, 20 bp, human
gagcggcagccgtgttacca

SEQ ID NO: 393215 - DNA, 20 bp, human
gcattagtacgtcaatggag

SEQ ID NO: 393216 - DNA, 20 bp, human
gtaggacgggtgaaggccaa

SEQ ID NO: 393217 - DNA, 20 bp, human
gtcggcgcgcgccatacctg

SEQ ID NO: 393218 - DNA, 20 bp, human
gagcgaagttcctatatgat

SEQ ID NO: 393219 - DNA, 20 bp, human
gctaactggcgctaccccta

SEQ ID NO: 393220 - DNA, 20 bp, human
ggccaagggcggagaattat

SEQ ID NO: 393221 - DNA, 20 bp, human
gacctgagggcagctgtgat

SEQ ID NO: 393222 - DNA, 20 bp, human
gtggctgatagcggctagga

SEQ ID NO: 393223 - DNA, 20 bp, human
ggacgggtgaaggccaaggg

SEQ ID NO: 393224 - DNA, 20 bp, human
gtggggagaagcttagaagg

SEQ ID NO: 393225 - DNA, 20 bp, human
ggcaagagctgagtgatggt

SEQ ID NO: 393226 - DNA, 20 bp, human
gactgccaggggtgcgagaa

SEQ ID NO: 393227 - DNA, 20 bp, human
gggcaagggccggagcagag

SEQ ID NO: 393228 - DNA, 20 bp, human
gccgcgagagcgaggtcaaa

SEQ ID NO: 393229 - DNA, 20 bp, human
gagcggccgccgcctccaaa

SEQ ID NO: 393230 - DNA, 20 bp, human
ggagcgaggtcaaagggcaa

SEQ ID NO: 393231 - DNA, 20 bp, human
gaggtcgggtggccatcttg

SEQ ID NO: 393232 - DNA, 20 bp, human
ggcaaggagagtagttcccc

SEQ ID NO: 393233 - DNA, 20 bp, human
ggaggggcaccgagaggcgt

SEQ ID NO: 393234 - DNA, 20 bp, human
gaccgctcgagcctgcacac

SEQ ID NO: 393235 - DNA, 20 bp, human
ggctctcgcggcagggtgag

SEQ ID NO: 393236 - DNA, 20 bp, human
ggctcgggaaaatgacggag

SEQ ID NO: 393237 - DNA, 20 bp, human
gcgggaaaatgacggagagg

SEQ ID NO: 393238 - DNA, 20 bp, human
gcgtaaagcaataaagatcc

SEQ ID NO: 393239 - DNA, 20 bp, human
gtccaggctcgggaaaatga

SEQ ID NO: 393240 - DNA, 20 bp, human
gtgcggcagcaatatgagct

SEQ ID NO: 393241 - DNA, 20 bp, human
gcagaaacacaattagcgag

SEQ ID NO: 393242 - DNA, 20 bp, human
gaaaaaagggcacccgaaaa

SEQ ID NO: 393243 - DNA, 20 bp, human
gcatacgtcgtgaaataaga

SEQ ID NO: 393244 - DNA, 20 bp, human
gggtgttgcggcagtactgg

SEQ ID NO: 393245 - DNA, 20 bp, human
ggaaggtgttgcggcagtac

SEQ ID NO: 393246 - DNA, 20 bp, human
gcccgccccggaagagcctg

SEQ ID NO: 393247 - DNA, 20 bp, human
gtagcctgacgcaggaggag

SEQ ID NO: 393248 - DNA, 20 bp, human
gtagaagcgacagtcgtgat

SEQ ID NO: 393249 - DNA, 20 bp, human
ggcggccgcaggctcttccg

SEQ ID NO: 393250 - DNA, 20 bp, human
gcccaggcgccgcacgggtg

SEQ ID NO: 393251 - DNA, 20 bp, human
gcgtcaggctaggcccgccc

SEQ ID NO: 393252 - DNA, 20 bp, human
ggccgcaggctcttccgggg

SEQ ID NO: 393253 - DNA, 20 bp, human
gaccccacccgtgcggcgcc

SEQ ID NO: 393254 - DNA, 20 bp, human
gggccgcgaccccacccgtg

SEQ ID NO: 393255 - DNA, 20 bp, human
gcacgactgtcgcttctacg

SEQ ID NO: 393256 - DNA, 20 bp, human
gcagggttggagacccgcgg

SEQ ID NO: 393257 - DNA, 20 bp, human
gcggaatcacgggacagagg

SEQ ID NO: 393258 - DNA, 20 bp, human
gccgggggagggtacggaaa

SEQ ID NO: 393259 - DNA, 20 bp, human
ggcgctctggaggagcccgt

SEQ ID NO: 393260 - DNA, 20 bp, human
gcggccccgccgcgctctgg

SEQ ID NO: 393261 - DNA, 20 bp, human
gccgcccccgggggagggta

SEQ ID NO: 393262 - DNA, 20 bp, human
gggagggtacggaaagggcg

SEQ ID NO: 393263 - DNA, 20 bp, human
ggccgggccgcgcggaatca

SEQ ID NO: 393264 - DNA, 20 bp, human
gccgcagcgggcggactgtg

SEQ ID NO: 393265 - DNA, 20 bp, human
gaaagccgcgcccaccgccg

SEQ ID NO: 393266 - DNA, 20 bp, human
gcgggcggccgctatgccca

SEQ ID NO: 393267 - DNA, 20 bp, human
gatagcggccgcccgaggta

SEQ ID NO: 393268 - DNA, 20 bp, human
ggccaggccgtccaccctct

SEQ ID NO: 393269 - DNA, 20 bp, human
gaagccgaggtagaaggggt

SEQ ID NO: 393270 - DNA, 20 bp, human
gtgcccagggcttggatcct

SEQ ID NO: 393271 - DNA, 20 bp, human
gcaacccaggacgcgaccgc

SEQ ID NO: 393272 - DNA, 20 bp, human
gccccaggcaagtctgactc

SEQ ID NO: 393273 - DNA, 20 bp, human
gccagaaaggagattgagaa

SEQ ID NO: 393274 - DNA, 20 bp, human
gtccggagtcagacttgcct

SEQ ID NO: 393275 - DNA, 20 bp, human
gttgggctccatacctcggg

SEQ ID NO: 393276 - DNA, 20 bp, human
ggacccaaggggccattgtc

SEQ ID NO: 393277 - DNA, 20 bp, human
gccccgctgctccgagagag

SEQ ID NO: 393278 - DNA, 20 bp, human
gtgtcaggccgggagacgag

SEQ ID NO: 393279 - DNA, 20 bp, human
ggatgtcatgggtgacccaa

SEQ ID NO: 393280 - DNA, 20 bp, human
gccaaggccaaggcctccct

SEQ ID NO: 393281 - DNA, 20 bp, human
gggcccctctctcggagcag

SEQ ID NO: 393282 - DNA, 20 bp, human
gcgagagaggggccagctgt

SEQ ID NO: 393283 - DNA, 20 bp, human
gcaaggggccattgtcaggc

SEQ ID NO: 393284 - DNA, 20 bp, human
gtcccacaggagggtcagag

SEQ ID NO: 393285 - DNA, 20 bp, human
ggctggcaccacccctggaa

SEQ ID NO: 393286 - DNA, 20 bp, human
ggagaagggcacagcttcat

SEQ ID NO: 393287 - DNA, 20 bp, human
gctgcctcccagtcactgct

SEQ ID NO: 393288 - DNA, 20 bp, human
gccgctgtggagtgagaaca

SEQ ID NO: 393289 - DNA, 20 bp, human
gggtccctgagccgtctctc

SEQ ID NO: 393290 - DNA, 20 bp, human
ggggcctgagagacggctca

SEQ ID NO: 393291 - DNA, 20 bp, human
gggtgagcttgggttttcgg

SEQ ID NO: 393292 - DNA, 20 bp, human
gcaagctcacctctgggttc

SEQ ID NO: 393293 - DNA, 20 bp, human
ggggcggaggggcagcaact

SEQ ID NO: 393294 - DNA, 20 bp, human
gccacccagccggaacccag

SEQ ID NO: 393295 - DNA, 20 bp, human
gctcagggaccatcctggga

SEQ ID NO: 393296 - DNA, 20 bp, human
gcggatgcgctggatctcga

SEQ ID NO: 393297 - DNA, 20 bp, human
gcggcggccatgttggaaga

SEQ ID NO: 393298 - DNA, 20 bp, human
gcgagccccagcgacctcat

SEQ ID NO: 393299 - DNA, 20 bp, human
ggtggcgaggagaagcggga

SEQ ID NO: 393300 - DNA, 20 bp, human
gtccgggaagggacaatcgc

SEQ ID NO: 393301 - DNA, 20 bp, human
gatccagcgcatccgcgggg

SEQ ID NO: 393302 - DNA, 20 bp, human
gcccggaccccgtctcgatg

SEQ ID NO: 393303 - DNA, 20 bp, human
gatctcgagggcgcagaact

SEQ ID NO: 393304 - DNA, 20 bp, human
ggggcagattgagcgcgcgt

SEQ ID NO: 393305 - DNA, 20 bp, human
gctcgcctatgaggtcgctg

SEQ ID NO: 393306 - DNA, 20 bp, human
gaccccggggaatgccggga

SEQ ID NO: 393307 - DNA, 20 bp, human
gtcagcgcgcggcgaccccg

SEQ ID NO: 393308 - DNA, 20 bp, human
gcggcgaccccggggaatgc

SEQ ID NO: 393309 - DNA, 20 bp, human
gccggaaaaggccccaccga

SEQ ID NO: 393310 - DNA, 20 bp, human
gacggcccggaaggtgtcct

SEQ ID NO: 393311 - DNA, 20 bp, human
ggcgctgtcaggaccggaaa

SEQ ID NO: 393312 - DNA, 20 bp, human
gtatagggcgctgtcaggac

SEQ ID NO: 393313 - DNA, 20 bp, human
gacaccttccgggccgtcgg

SEQ ID NO: 393314 - DNA, 20 bp, human
gggcggggtgcctacgtata

SEQ ID NO: 393315 - DNA, 20 bp, human
gggcaggccctgcgcatcgg

SEQ ID NO: 393316 - DNA, 20 bp, human
ggggccgaggctaccttggg

SEQ ID NO: 393317 - DNA, 20 bp, human
ggaggccggccagctccaaa

SEQ ID NO: 393318 - DNA, 20 bp, human
gggaactgccctcgtgtcca

SEQ ID NO: 393319 - DNA, 20 bp, human
ggccacacccacttgggcgc

SEQ ID NO: 393320 - DNA, 20 bp, human
gcctcggcccgcgcccaagt

SEQ ID NO: 393321 - DNA, 20 bp, human
gaactggcttcgaagcggga

SEQ ID NO: 393322 - DNA, 20 bp, human
gccccaggacgcttctccaa

SEQ ID NO: 393323 - DNA, 20 bp, human
gcgcgggccgaggctacctt

SEQ ID NO: 393324 - DNA, 20 bp, human
gccgaggctaccttgggtgg

SEQ ID NO: 393325 - DNA, 20 bp, human
gacacgagggcagttcccat

SEQ ID NO: 393326 - DNA, 20 bp, human
gaactctgaagcttggaggg

SEQ ID NO: 393327 - DNA, 20 bp, human
ggactggcaggaggcccact

SEQ ID NO: 393328 - DNA, 20 bp, human
gaggaaggtgtgatgaagcc

SEQ ID NO: 393329 - DNA, 20 bp, human
gcagactgtcaggacccctt

SEQ ID NO: 393330 - DNA, 20 bp, human
ggggtggggcccagactgtc

SEQ ID NO: 393331 - DNA, 20 bp, human
gctgccagtccccatgcctc

SEQ ID NO: 393332 - DNA, 20 bp, human
gggaagccagtcatagactc

SEQ ID NO: 393333 - DNA, 20 bp, human
ggttctctctccgacccagt

SEQ ID NO: 393334 - DNA, 20 bp, human
gccctgtgtgctggccgctg

SEQ ID NO: 393335 - DNA, 20 bp, human
gcagtcatagactcagggtg

SEQ ID NO: 393336 - DNA, 20 bp, human
gcggaggggcgcgggatcag

SEQ ID NO: 393337 - DNA, 20 bp, human
ggggcggcgcggtgtgcaac

SEQ ID NO: 393338 - DNA, 20 bp, human
gcctccgcccagtccgagga

SEQ ID NO: 393339 - DNA, 20 bp, human
gtcagtgccctgctcatcaa

SEQ ID NO: 393340 - DNA, 20 bp, human
gcggcgcgccgaggggaaac

SEQ ID NO: 393341 - DNA, 20 bp, human
gagggcttccttatgacctg

SEQ ID NO: 393342 - DNA, 20 bp, human
gctcaggagcagtggcgcgt

SEQ ID NO: 393343 - DNA, 20 bp, human
gactcggagcggcgcgccga

SEQ ID NO: 393344 - DNA, 20 bp, human
gccccagctccctcgcgctc

SEQ ID NO: 393345 - DNA, 20 bp, human
gaacggggcggggcttggaa

SEQ ID NO: 393346 - DNA, 20 bp, human
gcaagcgcggggaatctcgg

SEQ ID NO: 393347 - DNA, 20 bp, human
ggatccggcgagcggaattc

SEQ ID NO: 393348 - DNA, 20 bp, human
ggggaatctcgggggttctg

SEQ ID NO: 393349 - DNA, 20 bp, human
gaggcaagcgcggggaatct

SEQ ID NO: 393350 - DNA, 20 bp, human
gccggatcccaccgcactga

SEQ ID NO: 393351 - DNA, 20 bp, human
gctcccagaattccgctcgc

SEQ ID NO: 393352 - DNA, 20 bp, human
gaccgagagtctggaagaag

SEQ ID NO: 393353 - DNA, 20 bp, human
gaaaacagtccatagggagt

SEQ ID NO: 393354 - DNA, 20 bp, human
gcgcagtcccttcagtgcgg

SEQ ID NO: 393355 - DNA, 20 bp, human
gtgcggtgggatccggcgag

SEQ ID NO: 393356 - DNA, 20 bp, human
ggctgcctaagcctctcccc

SEQ ID NO: 393357 - DNA, 20 bp, human
gtttggagtcaacctcttag

SEQ ID NO: 393358 - DNA, 20 bp, human
gttcgcccgagcaggagatg

SEQ ID NO: 393359 - DNA, 20 bp, human
ggctctgcgcccgcgctgcg

SEQ ID NO: 393360 - DNA, 20 bp, human
gggagtcaacctcttagggg

SEQ ID NO: 393361 - DNA, 20 bp, human
ggagcggcgtacctggggag

SEQ ID NO: 393362 - DNA, 20 bp, human
gcctgctcgccccgaaccat

SEQ ID NO: 393363 - DNA, 20 bp, human
gggcgtgagcggcgtacctg

SEQ ID NO: 393364 - DNA, 20 bp, human
gccgctgattggcagtaaag

SEQ ID NO: 393365 - DNA, 20 bp, human
gggggcggagaaaaaaacag

SEQ ID NO: 393366 - DNA, 20 bp, human
gtactgcaggggccaatcga

SEQ ID NO: 393367 - DNA, 20 bp, human
gcggttaattggattcggga

SEQ ID NO: 393368 - DNA, 20 bp, human
gtgggcggttaattggattc

SEQ ID NO: 393369 - DNA, 20 bp, human
ggcgtctcccgggacaaccg

SEQ ID NO: 393370 - DNA, 20 bp, human
gccctcccctagcgcctggg

SEQ ID NO: 393371 - DNA, 20 bp, human
ggcgcgcccacggttgtccc

SEQ ID NO: 393372 - DNA, 20 bp, human
gcgcccctcccctagcgcct

SEQ ID NO: 393373 - DNA, 20 bp, human
ggccccgtatgcaaatatga

SEQ ID NO: 393374 - DNA, 20 bp, human
gtaattggattcgggaggga

SEQ ID NO: 393375 - DNA, 20 bp, human
ggcacggcgcccgacggcac

SEQ ID NO: 393376 - DNA, 20 bp, human
ggggaccaaggcaaacgggg

SEQ ID NO: 393377 - DNA, 20 bp, human
gggacaggagggatcaacgg

SEQ ID NO: 393378 - DNA, 20 bp, human
gagggcccggaggtagaagg

SEQ ID NO: 393379 - DNA, 20 bp, human
gtcggggctcctttagaacg

SEQ ID NO: 393380 - DNA, 20 bp, human
gcaggacctcctgactccga

SEQ ID NO: 393381 - DNA, 20 bp, human
gctctcgcatctctgaggag

SEQ ID NO: 393382 - DNA, 20 bp, human
gagcgcctctcgcatctctg

SEQ ID NO: 393383 - DNA, 20 bp, human
gcggtagccgccacccgctt

SEQ ID NO: 393384 - DNA, 20 bp, human
gcgacggttgggaggaacaa

SEQ ID NO: 393385 - DNA, 20 bp, human
gtgtctgtggtcagataggc

SEQ ID NO: 393386 - DNA, 20 bp, human
gctggccaccccttggtggg

SEQ ID NO: 393387 - DNA, 20 bp, human
gggcgctggccaccccttgg

SEQ ID NO: 393388 - DNA, 20 bp, human
gcgggggcacagtgcgtcag

SEQ ID NO: 393389 - DNA, 20 bp, human
gccgctgtgtgtcctagggt

SEQ ID NO: 393390 - DNA, 20 bp, human
ggacacacagcgggcggcgc

SEQ ID NO: 393391 - DNA, 20 bp, human
gtaaaataaaaggtatctcc

SEQ ID NO: 393392 - DNA, 20 bp, human
ggggaggaggctgcagctcg

SEQ ID NO: 393393 - DNA, 20 bp, human
gtaaaaggtatctccaggct

SEQ ID NO: 393394 - DNA, 20 bp, human
gcagtgcgtcagaggccaga

SEQ ID NO: 393395 - DNA, 20 bp, human
gaacttggaatctgtccatc

SEQ ID NO: 393396 - DNA, 20 bp, human
gcctggggcagttcgttcag

SEQ ID NO: 393397 - DNA, 20 bp, human
ggccaagggcatgctctcgg

SEQ ID NO: 393398 - DNA, 20 bp, human
ggggcagttcgttcagaggc

SEQ ID NO: 393399 - DNA, 20 bp, human
gtccgccgagagcatgccct

SEQ ID NO: 393400 - DNA, 20 bp, human
ggaaaggttgaggaagtcgg

SEQ ID NO: 393401 - DNA, 20 bp, human
ggacgcccaatagcctccag

SEQ ID NO: 393402 - DNA, 20 bp, human
gcaatagcctccagaggttc

SEQ ID NO: 393403 - DNA, 20 bp, human
gttggctcatccaatcagag

SEQ ID NO: 393404 - DNA, 20 bp, human
ggctcatccaatcagagcgg

SEQ ID NO: 393405 - DNA, 20 bp, human
gctcgcctctccgcgaccct

SEQ ID NO: 393406 - DNA, 20 bp, human
ggggccccacatgaccgaag

SEQ ID NO: 393407 - DNA, 20 bp, human
ggcagcctggcggggaacgg

SEQ ID NO: 393408 - DNA, 20 bp, human
gagaacagaaggtcagaggc

SEQ ID NO: 393409 - DNA, 20 bp, human
gccgccgcccccgggatcat

SEQ ID NO: 393410 - DNA, 20 bp, human
gacacagagtcacggagaga

SEQ ID NO: 393411 - DNA, 20 bp, human
gcgccgcccgggaagcgatc

SEQ ID NO: 393412 - DNA, 20 bp, human
gtccctgtgactcgagaccg

SEQ ID NO: 393413 - DNA, 20 bp, human
gccattgcccatgatcccgg

SEQ ID NO: 393414 - DNA, 20 bp, human
gtgtgaccggatcgcttccc

SEQ ID NO: 393415 - DNA, 20 bp, human
gccgtcagggcagctgtgac

SEQ ID NO: 393416 - DNA, 20 bp, human
gggccctgcctaaggatgtg

SEQ ID NO: 393417 - DNA, 20 bp, human
gaggcagggccctgggtgat

SEQ ID NO: 393418 - DNA, 20 bp, human
gaggactggggcctgactca

SEQ ID NO: 393419 - DNA, 20 bp, human
gttaaagaataactgtgttg

SEQ ID NO: 393420 - DNA, 20 bp, human
gtgatgggagaggacctatt

SEQ ID NO: 393421 - DNA, 20 bp, human
gtgtcttaggaaagcatgat

SEQ ID NO: 393422 - DNA, 20 bp, human
ggtggggctgtcagcagatc

SEQ ID NO: 393423 - DNA, 20 bp, human
gcgaaaatgcaggtttaaag

SEQ ID NO: 393424 - DNA, 20 bp, human
gtaagacagccaatcaccca

SEQ ID NO: 393425 - DNA, 20 bp, human
ggtatgtgacactaccaaat

SEQ ID NO: 393426 - DNA, 20 bp, human
gatcaggacagaagagagat

SEQ ID NO: 393427 - DNA, 20 bp, human
gggagacctaacagacctga

SEQ ID NO: 393428 - DNA, 20 bp, human
gagccctcttgcttccaagg

SEQ ID NO: 393429 - DNA, 20 bp, human
gaagactcaggcatccaccg

SEQ ID NO: 393430 - DNA, 20 bp, human
gttgctcatgcgtaagactc

SEQ ID NO: 393431 - DNA, 20 bp, human
gcaaagcaaggaggggtaac

SEQ ID NO: 393432 - DNA, 20 bp, human
gaatctccacatcccccatc

SEQ ID NO: 393433 - DNA, 20 bp, human
gggtgctgccgccagtgtgt

SEQ ID NO: 393434 - DNA, 20 bp, human
gggaggcacttcaggacctg

SEQ ID NO: 393435 - DNA, 20 bp, human
gatctcagcctcagatgagg

SEQ ID NO: 393436 - DNA, 20 bp, human
gactaaagctgctaaacagg

SEQ ID NO: 393437 - DNA, 20 bp, human
gccctcgctgggaaaaagct

SEQ ID NO: 393438 - DNA, 20 bp, human
gcaggtggctagcacccgtg

SEQ ID NO: 393439 - DNA, 20 bp, human
gctaactaaagctgctaaac

SEQ ID NO: 393440 - DNA, 20 bp, human
gaccctcggccccgcctctg

SEQ ID NO: 393441 - DNA, 20 bp, human
gcggggcgcgcgcttttccc

SEQ ID NO: 393442 - DNA, 20 bp, human
gctggagagtggttgtgcga

SEQ ID NO: 393443 - DNA, 20 bp, human
gggagaccgccctgccaggc

SEQ ID NO: 393444 - DNA, 20 bp, human
gggtctccggcctcgcacgc

SEQ ID NO: 393445 - DNA, 20 bp, human
ggctctgctcgccgcgggtc

SEQ ID NO: 393446 - DNA, 20 bp, human
gctgccggagctccgagctg

SEQ ID NO: 393447 - DNA, 20 bp, human
ggagctccgagctgcggacc

SEQ ID NO: 393448 - DNA, 20 bp, human
gcgccggaagtgacgatcca

SEQ ID NO: 393449 - DNA, 20 bp, human
gcatgtgcgacgcctccccg

SEQ ID NO: 393450 - DNA, 20 bp, human
gataagccgggtttgacaag

SEQ ID NO: 393451 - DNA, 20 bp, human
gaccagccgcttgtcaaacc

SEQ ID NO: 393452 - DNA, 20 bp, human
gttggtgttcagtccccacc

SEQ ID NO: 393453 - DNA, 20 bp, human
gcggagctccggcagccagg

SEQ ID NO: 393454 - DNA, 20 bp, human
gtgacgatccagggcgtggg

SEQ ID NO: 393455 - DNA, 20 bp, human
gcaaacccggcttatagatg

SEQ ID NO: 393456 - DNA, 20 bp, human
gtctagagagattagagcat

SEQ ID NO: 393457 - DNA, 20 bp, human
ggctctaatctctctagaca

SEQ ID NO: 393458 - DNA, 20 bp, human
gttagtgcacgcagtcacac

SEQ ID NO: 393459 - DNA, 20 bp, human
gtgcgtgcactaacattctt

SEQ ID NO: 393460 - DNA, 20 bp, human
ggggataagcagcctagctc

SEQ ID NO: 393461 - DNA, 20 bp, human
gcatgcatagaaatatgtga

SEQ ID NO: 393462 - DNA, 20 bp, human
gataggtcatttgaccagtt

SEQ ID NO: 393463 - DNA, 20 bp, human
gttgcacttgatggatccat

SEQ ID NO: 393464 - DNA, 20 bp, human
gtctatgaaatattcttaat

SEQ ID NO: 393465 - DNA, 20 bp, human
ggtcaataatcagaatcagc

SEQ ID NO: 393466 - DNA, 20 bp, human
gacacactgatcccattatc

SEQ ID NO: 393467 - DNA, 20 bp, human
gcgtctgtgttatactgagt

SEQ ID NO: 393468 - DNA, 20 bp, human
gttggattcaccggtgccct

SEQ ID NO: 393469 - DNA, 20 bp, human
gcgtgtcttctctacaccca

SEQ ID NO: 393470 - DNA, 20 bp, human
ggacacactgctatcaacca

SEQ ID NO: 393471 - DNA, 20 bp, human
ggcagaaaccattcttgctt

SEQ ID NO: 393472 - DNA, 20 bp, human
gtgaaaggatttattctttg

SEQ ID NO: 393473 - DNA, 20 bp, human
gacacttacgttcctgataa

SEQ ID NO: 393474 - DNA, 20 bp, human
gcaaaattgatcagagtgaa

SEQ ID NO: 393475 - DNA, 20 bp, human
gatgtgtataatgaatttta

SEQ ID NO: 393476 - DNA, 20 bp, human
gtgggagccgcgaccggggt

SEQ ID NO: 393477 - DNA, 20 bp, human
gccgcgccccaccccggtcg

SEQ ID NO: 393478 - DNA, 20 bp, human
gggcctcgtatggacaagga

SEQ ID NO: 393479 - DNA, 20 bp, human
gggggactgcgggagtcggg

SEQ ID NO: 393480 - DNA, 20 bp, human
gcaggtgggagccgcgaccg

SEQ ID NO: 393481 - DNA, 20 bp, human
gcggcggggactgcgggagt

SEQ ID NO: 393482 - DNA, 20 bp, human
ggggtggggcgcggagcgct

SEQ ID NO: 393483 - DNA, 20 bp, human
gggggtggggggcggagatt

SEQ ID NO: 393484 - DNA, 20 bp, human
gaccgcgctgctggcgtcgg

SEQ ID NO: 393485 - DNA, 20 bp, human
gcagcagcgcggtacctgcg

SEQ ID NO: 393486 - DNA, 20 bp, human
ggggctgcgcgcccagaact

SEQ ID NO: 393487 - DNA, 20 bp, human
gtcctggccggatgggagga

SEQ ID NO: 393488 - DNA, 20 bp, human
gacagatccccgcccagaaa

SEQ ID NO: 393489 - DNA, 20 bp, human
ggcagtcaacagcccctttc

SEQ ID NO: 393490 - DNA, 20 bp, human
ggcgcgcccagaactgggac

SEQ ID NO: 393491 - DNA, 20 bp, human
gggatctgtcctggccggat

SEQ ID NO: 393492 - DNA, 20 bp, human
gagaactgggactgggatcg

SEQ ID NO: 393493 - DNA, 20 bp, human
gactgggactgggatcgcgg

SEQ ID NO: 393494 - DNA, 20 bp, human
gcgtcccaagggcttgtcac

SEQ ID NO: 393495 - DNA, 20 bp, human
ggggcgactgcccgtcccaa

SEQ ID NO: 393496 - DNA, 20 bp, human
ggagccggggccagaatcct

SEQ ID NO: 393497 - DNA, 20 bp, human
gcacctgcccatgggactga

SEQ ID NO: 393498 - DNA, 20 bp, human
gcacagccccctcagtccca

SEQ ID NO: 393499 - DNA, 20 bp, human
gtcaactgccacctgcccat

SEQ ID NO: 393500 - DNA, 20 bp, human
gagacccctaggtgggggta

SEQ ID NO: 393501 - DNA, 20 bp, human
ggctgtggctggtggatcct

SEQ ID NO: 393502 - DNA, 20 bp, human
gtgggggtagggatggtaag

SEQ ID NO: 393503 - DNA, 20 bp, human
ggagcagtggccgatgggaa

SEQ ID NO: 393504 - DNA, 20 bp, human
gcctatcagcccaacagctg

SEQ ID NO: 393505 - DNA, 20 bp, human
gccccctcagtcccatgggc

SEQ ID NO: 393506 - DNA, 20 bp, human
gagtgggcggggcacgctgt

SEQ ID NO: 393507 - DNA, 20 bp, human
gtgtggggcgggatcggcgg

SEQ ID NO: 393508 - DNA, 20 bp, human
gtctgccggcggactaatga

SEQ ID NO: 393509 - DNA, 20 bp, human
gggcggggccattgggtaat

SEQ ID NO: 393510 - DNA, 20 bp, human
gggcggggcacgctgtgggg

SEQ ID NO: 393511 - DNA, 20 bp, human
ggtacagaggcggggccgaa

SEQ ID NO: 393512 - DNA, 20 bp, human
gtcggcgggggatagaccaa

SEQ ID NO: 393513 - DNA, 20 bp, human
gaccaatggtgggtaagagg

SEQ ID NO: 393514 - DNA, 20 bp, human
ggcgggggatagaccaatgg

SEQ ID NO: 393515 - DNA, 20 bp, human
ggggcggggatgcgagtgga

SEQ ID NO: 393516 - DNA, 20 bp, human
gagaccttgaggattcagtc

SEQ ID NO: 393517 - DNA, 20 bp, human
ggtctccccccaaacccttc

SEQ ID NO: 393518 - DNA, 20 bp, human
gtgggttactatagcaaccc

SEQ ID NO: 393519 - DNA, 20 bp, human
gccatctggaggaaccaccg

SEQ ID NO: 393520 - DNA, 20 bp, human
gggacaaaggccccatctgg

SEQ ID NO: 393521 - DNA, 20 bp, human
gaggacatggaaacatcttc

SEQ ID NO: 393522 - DNA, 20 bp, human
gcacagggacacccaattgc

SEQ ID NO: 393523 - DNA, 20 bp, human
gtgcggacaaaggccccatc

SEQ ID NO: 393524 - DNA, 20 bp, human
ggcacacatcgtgccttcta

SEQ ID NO: 393525 - DNA, 20 bp, human
ggattcagtctggtcctgaa

SEQ ID NO: 393526 - DNA, 20 bp, human
gtacggatgctagagaaaaa

SEQ ID NO: 393527 - DNA, 20 bp, human
gggccggggccttttcctgt

SEQ ID NO: 393528 - DNA, 20 bp, human
gcggctccctatatacaact

SEQ ID NO: 393529 - DNA, 20 bp, human
gatgctagagaaaaaggggt

SEQ ID NO: 393530 - DNA, 20 bp, human
gtgattggtgcaagcgacgt

SEQ ID NO: 393531 - DNA, 20 bp, human
gaaaggatgcaaacagtcta

SEQ ID NO: 393532 - DNA, 20 bp, human
gatgacaggagactggtgat

SEQ ID NO: 393533 - DNA, 20 bp, human
ggtgcaagcgacgtgggatg

SEQ ID NO: 393534 - DNA, 20 bp, human
gtatacaactcggtcaccat

SEQ ID NO: 393535 - DNA, 20 bp, human
gccgccccataatggatgct

SEQ ID NO: 393536 - DNA, 20 bp, human
gtactgcagtgtgcggcgca

SEQ ID NO: 393537 - DNA, 20 bp, human
ggaggcttgccttaattcgg

SEQ ID NO: 393538 - DNA, 20 bp, human
gccaccccgcggccgcgcga

SEQ ID NO: 393539 - DNA, 20 bp, human
ggtgcggcgcatggctgcga

SEQ ID NO: 393540 - DNA, 20 bp, human
ggcctggccgccgcagaggc

SEQ ID NO: 393541 - DNA, 20 bp, human
gcgcgcgttgcccgcaggcg

SEQ ID NO: 393542 - DNA, 20 bp, human
ggcgagggcctgccgagggg

SEQ ID NO: 393543 - DNA, 20 bp, human
gggctgcgagggcctgccga

SEQ ID NO: 393544 - DNA, 20 bp, human
gactggcgcgcgttgcccgc

SEQ ID NO: 393545 - DNA, 20 bp, human
gccgaggggcgggcgcgagt

SEQ ID NO: 393546 - DNA, 20 bp, human
ggcgcggtcgccctcttacc

SEQ ID NO: 393547 - DNA, 20 bp, human
gctggagaatgggccgggac

SEQ ID NO: 393548 - DNA, 20 bp, human
gcaggccagggctcgaaggt

SEQ ID NO: 393549 - DNA, 20 bp, human
ggccgcgcgcccccactccg

SEQ ID NO: 393550 - DNA, 20 bp, human
gcggccgcacccgcggagtg

SEQ ID NO: 393551 - DNA, 20 bp, human
gcgcccccactccgcgggtg

SEQ ID NO: 393552 - DNA, 20 bp, human
gaccccgccccgtgccgctg

SEQ ID NO: 393553 - DNA, 20 bp, human
gcggccccaccttcgagccc

SEQ ID NO: 393554 - DNA, 20 bp, human
ggggccgcagcggcacgggg

SEQ ID NO: 393555 - DNA, 20 bp, human
gggcgcaggccagggctcga

SEQ ID NO: 393556 - DNA, 20 bp, human
ggggtcagagggcagtgcgt

SEQ ID NO: 393557 - DNA, 20 bp, human
gagagggcgtccccactacg

SEQ ID NO: 393558 - DNA, 20 bp, human
ggccgtgcgctgtctgggat

SEQ ID NO: 393559 - DNA, 20 bp, human
gccagacagcgcacggcggg

SEQ ID NO: 393560 - DNA, 20 bp, human
gaggacgtccggaccaatgg

SEQ ID NO: 393561 - DNA, 20 bp, human
gaaaactaggatccgagcct

SEQ ID NO: 393562 - DNA, 20 bp, human
gtgggctgagacgtttccgg

SEQ ID NO: 393563 - DNA, 20 bp, human
gacaacggccaatcaaaact

SEQ ID NO: 393564 - DNA, 20 bp, human
ggggccctctgactggatgc

SEQ ID NO: 393565 - DNA, 20 bp, human
ggcccgcctcccaggacgtc

SEQ ID NO: 393566 - DNA, 20 bp, human
gccggggtgtcttctgacca

SEQ ID NO: 393567 - DNA, 20 bp, human
gcattgctcaacatgtgtac

SEQ ID NO: 393568 - DNA, 20 bp, human
gtctgaattaggcagggaga

SEQ ID NO: 393569 - DNA, 20 bp, human
gacgctctctgattggatgt

SEQ ID NO: 393570 - DNA, 20 bp, human
ggttcctgggaggcgggctg

SEQ ID NO: 393571 - DNA, 20 bp, human
gaggcagcgggggtcatcaa

SEQ ID NO: 393572 - DNA, 20 bp, human
gactggggacgctctctgat

SEQ ID NO: 393573 - DNA, 20 bp, human
gctctgattggatgtaggat

SEQ ID NO: 393574 - DNA, 20 bp, human
ggcagtagctgttccaaccc

SEQ ID NO: 393575 - DNA, 20 bp, human
gggtgtcttctgaccagggt

SEQ ID NO: 393576 - DNA, 20 bp, human
gaaggcagcggggtcatcaa

SEQ ID NO: 393577 - DNA, 20 bp, human
gttcctgggaggcaggccga

SEQ ID NO: 393578 - DNA, 20 bp, human
gttgctcaacacgtgtagtg

SEQ ID NO: 393579 - DNA, 20 bp, human
gggtgtcttccgaccaggat

SEQ ID NO: 393580 - DNA, 20 bp, human
gaatcacttttctgacccaa

SEQ ID NO: 393581 - DNA, 20 bp, human
gtccggggtgtcttccgacc

SEQ ID NO: 393582 - DNA, 20 bp, human
gagtggggatgctctctgat

SEQ ID NO: 393583 - DNA, 20 bp, human
gtagctgttccaatcctggt

SEQ ID NO: 393584 - DNA, 20 bp, human
gggccctcggcctgcctccc

SEQ ID NO: 393585 - DNA, 20 bp, human
ggcagtagctgttccaatcc

SEQ ID NO: 393586 - DNA, 20 bp, human
ggtccctcacctgtcccgct

SEQ ID NO: 393587 - DNA, 20 bp, human
gccggggaccaggaagcgtc

SEQ ID NO: 393588 - DNA, 20 bp, human
gaagcggcccccccgagggg

SEQ ID NO: 393589 - DNA, 20 bp, human
gttccccgctcgcccactag

SEQ ID NO: 393590 - DNA, 20 bp, human
gacccccgcgcagcttgggg

SEQ ID NO: 393591 - DNA, 20 bp, human
gccccccccgcctataaggg

SEQ ID NO: 393592 - DNA, 20 bp, human
ggggggccgcttaccctccc

SEQ ID NO: 393593 - DNA, 20 bp, human
ggggcctccgcggagatgca

SEQ ID NO: 393594 - DNA, 20 bp, human
ggtgggcgagcggggaacgc

SEQ ID NO: 393595 - DNA, 20 bp, human
ggcaccctgcatctccgcgg

SEQ ID NO: 393596 - DNA, 20 bp, human
ggacccggagatttgagccg

SEQ ID NO: 393597 - DNA, 20 bp, human
gtccccgctgcgagcgcccc

SEQ ID NO: 393598 - DNA, 20 bp, human
gccggcagctggggtcacga

SEQ ID NO: 393599 - DNA, 20 bp, human
ggcagccaggcgaatcgcgc

SEQ ID NO: 393600 - DNA, 20 bp, human
gccctcccggtgtgtcacaa

SEQ ID NO: 393601 - DNA, 20 bp, human
gcgccggcggtgttggaacg

SEQ ID NO: 393602 - DNA, 20 bp, human
ggcagcggggactgcgcccg

SEQ ID NO: 393603 - DNA, 20 bp, human
gacccgcggctcaaatctcc

SEQ ID NO: 393604 - DNA, 20 bp, human
gccccggcatcacagtgccg

SEQ ID NO: 393605 - DNA, 20 bp, human
gccagcgggtcggaggagaa

SEQ ID NO: 393606 - DNA, 20 bp, human
gcggaaatgactccacctga

SEQ ID NO: 393607 - DNA, 20 bp, human
gtgttgggcctgaacaaccc

SEQ ID NO: 393608 - DNA, 20 bp, human
gtgtgtacaaactttatccc

SEQ ID NO: 393609 - DNA, 20 bp, human
ggaagaaagctccagccctc

SEQ ID NO: 393610 - DNA, 20 bp, human
gtataagttggacgcagatt

SEQ ID NO: 393611 - DNA, 20 bp, human
ggtctcagagtagctgtgtt

SEQ ID NO: 393612 - DNA, 20 bp, human
ggaaagctccagccctcagg

SEQ ID NO: 393613 - DNA, 20 bp, human
ggcattggcagagaaaagga

SEQ ID NO: 393614 - DNA, 20 bp, human
gactttatcccgggttgttc

SEQ ID NO: 393615 - DNA, 20 bp, human
ggtggttgagaggcatgcat

SEQ ID NO: 393616 - DNA, 20 bp, human
gtggacgcctggtacatgac

SEQ ID NO: 393617 - DNA, 20 bp, human
ggggactacaactcccaaag

SEQ ID NO: 393618 - DNA, 20 bp, human
ggaccggcatcgactaatca

SEQ ID NO: 393619 - DNA, 20 bp, human
ggcagcatggacaacaatag

SEQ ID NO: 393620 - DNA, 20 bp, human
ggacgagcgcagtcctcttt

SEQ ID NO: 393621 - DNA, 20 bp, human
gcgctcgtccactggctcag

SEQ ID NO: 393622 - DNA, 20 bp, human
ggaggactgcgctcgtccac

SEQ ID NO: 393623 - DNA, 20 bp, human
gcccagctgcagtacctcta

SEQ ID NO: 393624 - DNA, 20 bp, human
gtcgatgccggtcatgtacc

SEQ ID NO: 393625 - DNA, 20 bp, human
gccactggctcagaggccaa

SEQ ID NO: 393626 - DNA, 20 bp, human
gtgggcgcgcggggacaatg

SEQ ID NO: 393627 - DNA, 20 bp, human
ggtagcgcgcccctgccggc

SEQ ID NO: 393628 - DNA, 20 bp, human
gctacgttgtagcagaaggg

SEQ ID NO: 393629 - DNA, 20 bp, human
gcacgcgcgaagtcttttgt

SEQ ID NO: 393630 - DNA, 20 bp, human
gacaatgcggcgttgcccgc

SEQ ID NO: 393631 - DNA, 20 bp, human
gggcaggggcgcgctacctt

SEQ ID NO: 393632 - DNA, 20 bp, human
gtgcgccgcagtcacgtgga

SEQ ID NO: 393633 - DNA, 20 bp, human
ggcgcgaagtcttttgtcgg

SEQ ID NO: 393634 - DNA, 20 bp, human
gcgcggttacagtgtagcgg

SEQ ID NO: 393635 - DNA, 20 bp, human
gccgcagtcacgtggagggc

SEQ ID NO: 393636 - DNA, 20 bp, human
ggggcagtattctgtgttga

SEQ ID NO: 393637 - DNA, 20 bp, human
gagagtgagtgcaagattaa

SEQ ID NO: 393638 - DNA, 20 bp, human
gtaccctcacaatgtgacca

SEQ ID NO: 393639 - DNA, 20 bp, human
ggtaaccagaccacctccaa

SEQ ID NO: 393640 - DNA, 20 bp, human
ggaccgtggtatgatgactg

SEQ ID NO: 393641 - DNA, 20 bp, human
ggcctgtcatgcttttggaa

SEQ ID NO: 393642 - DNA, 20 bp, human
ggggaccaaagtctggaaaa

SEQ ID NO: 393643 - DNA, 20 bp, human
gtcccttccaaaagcatgac

SEQ ID NO: 393644 - DNA, 20 bp, human
ggcggggcacggggcttctg

SEQ ID NO: 393645 - DNA, 20 bp, human
gcaagattaaaggccacctc

SEQ ID NO: 393646 - DNA, 20 bp, human
gcggggcgcggtgcgaggtg

SEQ ID NO: 393647 - DNA, 20 bp, human
gtgggactgcggcaccgcga

SEQ ID NO: 393648 - DNA, 20 bp, human
ggctgctgccgctgggtcta

SEQ ID NO: 393649 - DNA, 20 bp, human
gggcgcggtgcgaggtgtgg

SEQ ID NO: 393650 - DNA, 20 bp, human
gacccagcggcagcagcaat

SEQ ID NO: 393651 - DNA, 20 bp, human
gccgcccgtcatgacgtcac

SEQ ID NO: 393652 - DNA, 20 bp, human
gggtccccagcccccctcgg

SEQ ID NO: 393653 - DNA, 20 bp, human
gctgcccggtgacgtcatga

SEQ ID NO: 393654 - DNA, 20 bp, human
ggctgccgctgggtctaggg

SEQ ID NO: 393655 - DNA, 20 bp, human
ggtcgcccgtgcccgtggat

SEQ ID NO: 393656 - DNA, 20 bp, human
gagccctagggaccgtccgg

SEQ ID NO: 393657 - DNA, 20 bp, human
ggggctggaccaccggcccg

SEQ ID NO: 393658 - DNA, 20 bp, human
ggccccccggacggtcccta

SEQ ID NO: 393659 - DNA, 20 bp, human
gccgagccctagggaccgtc

SEQ ID NO: 393660 - DNA, 20 bp, human
gtcggcacgcccgctctgat

SEQ ID NO: 393661 - DNA, 20 bp, human
gggggcgtgcgcattgtctg

SEQ ID NO: 393662 - DNA, 20 bp, human
gcgggcgtgccgaccgggag

SEQ ID NO: 393663 - DNA, 20 bp, human
gtggagagcgccagcgcgaa

SEQ ID NO: 393664 - DNA, 20 bp, human
gtggcaccggatgggaacga

SEQ ID NO: 393665 - DNA, 20 bp, human
gggtggtccagccccccgga

SEQ ID NO: 393666 - DNA, 20 bp, human
gcgcacgcgggaggctatgg

SEQ ID NO: 393667 - DNA, 20 bp, human
gggaggctagaacatcgctg

SEQ ID NO: 393668 - DNA, 20 bp, human
gtcgcaggccgcaccttgca

SEQ ID NO: 393669 - DNA, 20 bp, human
gtccgccgcggaactcacag

SEQ ID NO: 393670 - DNA, 20 bp, human
gggaccgtgtgccccttgca

SEQ ID NO: 393671 - DNA, 20 bp, human
gggaacctctgtgagttccg

SEQ ID NO: 393672 - DNA, 20 bp, human
ggaagcgcaggagcgcacgc

SEQ ID NO: 393673 - DNA, 20 bp, human
gtagaacatcgctgtggctg

SEQ ID NO: 393674 - DNA, 20 bp, human
ggtgtgccccttgcaaggtg

SEQ ID NO: 393675 - DNA, 20 bp, human
gacctctgtgagttccgcgg

SEQ ID NO: 393676 - DNA, 20 bp, human
gcccagcgctgggggatcct

SEQ ID NO: 393677 - DNA, 20 bp, human
ggcggccccgcccttcgcat

SEQ ID NO: 393678 - DNA, 20 bp, human
gtcaccgcgggtggccaatc

SEQ ID NO: 393679 - DNA, 20 bp, human
ggaaccgagagggtagctgg

SEQ ID NO: 393680 - DNA, 20 bp, human
gtgcggcggcgcctcccgat

SEQ ID NO: 393681 - DNA, 20 bp, human
ggggatccttggctgcggga

SEQ ID NO: 393682 - DNA, 20 bp, human
gcgggcggggacgcgcggtg

SEQ ID NO: 393683 - DNA, 20 bp, human
gccgcccgccgcgcgcaatg

SEQ ID NO: 393684 - DNA, 20 bp, human
gaggggcgccgcattgcgcg

SEQ ID NO: 393685 - DNA, 20 bp, human
gggcgcccctcccgcagcca

SEQ ID NO: 393686 - DNA, 20 bp, human
gactgagcctgcgtaggagt

SEQ ID NO: 393687 - DNA, 20 bp, human
ggaggccggcagtcaggggt

SEQ ID NO: 393688 - DNA, 20 bp, human
gcatcagccgactcctacgc

SEQ ID NO: 393689 - DNA, 20 bp, human
gttctgaggccggcagtcag

SEQ ID NO: 393690 - DNA, 20 bp, human
gcctccattgagcctgtccc

SEQ ID NO: 393691 - DNA, 20 bp, human
gattgagcctgtcccaggaa

SEQ ID NO: 393692 - DNA, 20 bp, human
gcagccggcggagaagtccc

SEQ ID NO: 393693 - DNA, 20 bp, human
gcctctgctgggagaccgga

SEQ ID NO: 393694 - DNA, 20 bp, human
ggatgtgaggcttctgaaga

SEQ ID NO: 393695 - DNA, 20 bp, human
gctgggaaatgcttgatgtg

SEQ ID NO: 393696 - DNA, 20 bp, human
ggggcctcccagagaagtcc

SEQ ID NO: 393697 - DNA, 20 bp, human
ggggacgggggagactgcac

SEQ ID NO: 393698 - DNA, 20 bp, human
gatcccggggcgggaccaag

SEQ ID NO: 393699 - DNA, 20 bp, human
gctaaggggcctcaccccca

SEQ ID NO: 393700 - DNA, 20 bp, human
ggcactggtggctccctaag

SEQ ID NO: 393701 - DNA, 20 bp, human
gaggggagcgcctggtaaac

SEQ ID NO: 393702 - DNA, 20 bp, human
gaccaaggggcggagcggga

SEQ ID NO: 393703 - DNA, 20 bp, human
gcccgccccgggatgatgga

SEQ ID NO: 393704 - DNA, 20 bp, human
ggccccgcccgctcatatag

SEQ ID NO: 393705 - DNA, 20 bp, human
ggtggcgtcccggacttctc

SEQ ID NO: 393706 - DNA, 20 bp, human
gcctcgggcaagcgcagtct

SEQ ID NO: 393707 - DNA, 20 bp, human
ggcgagtgcgggcttccggt

SEQ ID NO: 393708 - DNA, 20 bp, human
gccaggagggggattgtgat

SEQ ID NO: 393709 - DNA, 20 bp, human
gcctccgctagtctcggaat

SEQ ID NO: 393710 - DNA, 20 bp, human
gccggcgcgcggacggggtg

SEQ ID NO: 393711 - DNA, 20 bp, human
gagggagggtatataagcgt

SEQ ID NO: 393712 - DNA, 20 bp, human
gcggcagccagccaatgaga

SEQ ID NO: 393713 - DNA, 20 bp, human
gggcaaggccaatcaaacga

SEQ ID NO: 393714 - DNA, 20 bp, human
gtaggcagcttgattgacgg

SEQ ID NO: 393715 - DNA, 20 bp, human
ggggattgtgatagggagat

SEQ ID NO: 393716 - DNA, 20 bp, human
gctggatgttgtgagaaagg

SEQ ID NO: 393717 - DNA, 20 bp, human
gcagtggcccccccggggag

SEQ ID NO: 393718 - DNA, 20 bp, human
ggagctggtggactcggtgc

SEQ ID NO: 393719 - DNA, 20 bp, human
ggggccactgccaattccca

SEQ ID NO: 393720 - DNA, 20 bp, human
gcccaaagtgtcagacacag

SEQ ID NO: 393721 - DNA, 20 bp, human
gcgaaaaaagccgagtgaca

SEQ ID NO: 393722 - DNA, 20 bp, human
gtcactcggcttttttcgca

SEQ ID NO: 393723 - DNA, 20 bp, human
gagtggtgctgggaacaact

SEQ ID NO: 393724 - DNA, 20 bp, human
gttaacaaacccctccccgg

SEQ ID NO: 393725 - DNA, 20 bp, human
gaccagtagtgctgtctacc

SEQ ID NO: 393726 - DNA, 20 bp, human
gtccgcccggctcccggcaa

SEQ ID NO: 393727 - DNA, 20 bp, human
gacgcgcgggcgccagtcgg

SEQ ID NO: 393728 - DNA, 20 bp, human
gtctggcggggcaccacaag

SEQ ID NO: 393729 - DNA, 20 bp, human
ggggaccccgcgggccacgt

SEQ ID NO: 393730 - DNA, 20 bp, human
ggagccgggcggaaaaggac

SEQ ID NO: 393731 - DNA, 20 bp, human
gaggacgcgcgggcgccagt

SEQ ID NO: 393732 - DNA, 20 bp, human
ggcagccgagggaggacgcg

SEQ ID NO: 393733 - DNA, 20 bp, human
gccggcaagggtcccccgac

SEQ ID NO: 393734 - DNA, 20 bp, human
gacactgccctggggttcgg

SEQ ID NO: 393735 - DNA, 20 bp, human
gaggggcagcgaaacggtgg

SEQ ID NO: 393736 - DNA, 20 bp, human
gctgggagccgaatccgagg

SEQ ID NO: 393737 - DNA, 20 bp, human
gggagccgaatccgaggcgg

SEQ ID NO: 393738 - DNA, 20 bp, human
gccgaatccgaggcggaggg

SEQ ID NO: 393739 - DNA, 20 bp, human
gaacagatgttcagcgccag

SEQ ID NO: 393740 - DNA, 20 bp, human
ggttggggaaagctgctcgc

SEQ ID NO: 393741 - DNA, 20 bp, human
gaacacccatagcttattgt

SEQ ID NO: 393742 - DNA, 20 bp, human
gatgggtgttagagacagtc

SEQ ID NO: 393743 - DNA, 20 bp, human
gctaacccacaataagctat

SEQ ID NO: 393744 - DNA, 20 bp, human
gtggagtcttctttagagta

SEQ ID NO: 393745 - DNA, 20 bp, human
gaacatctgttggaaagctc

SEQ ID NO: 393746 - DNA, 20 bp, human
gtggacatgcgcagaactat

SEQ ID NO: 393747 - DNA, 20 bp, human
ggcgtaggagcatgcgtaca

SEQ ID NO: 393748 - DNA, 20 bp, human
gggctcctaaagttcagcgt

SEQ ID NO: 393749 - DNA, 20 bp, human
gcgggcccatgaggcgacga

SEQ ID NO: 393750 - DNA, 20 bp, human
gtccctgtctcggaagtccg

SEQ ID NO: 393751 - DNA, 20 bp, human
ggttccgtgaagccaaacag

SEQ ID NO: 393752 - DNA, 20 bp, human
ggaagccaaacagtgggcag

SEQ ID NO: 393753 - DNA, 20 bp, human
gagaactatcggcaggatcc

SEQ ID NO: 393754 - DNA, 20 bp, human
gcatgcgcagaactatcggc

SEQ ID NO: 393755 - DNA, 20 bp, human
gcctaagcagccggtgatgg

SEQ ID NO: 393756 - DNA, 20 bp, human
gtccagaagcccagtcgcta

SEQ ID NO: 393757 - DNA, 20 bp, human
gagcccagtcgctacggtaa

SEQ ID NO: 393758 - DNA, 20 bp, human
gcacttgcgcggccttctga

SEQ ID NO: 393759 - DNA, 20 bp, human
ggtgtcgttaagctgttcgt

SEQ ID NO: 393760 - DNA, 20 bp, human
gggaggccggggtaactggc

SEQ ID NO: 393761 - DNA, 20 bp, human
gaccgtagcgactgggcttc

SEQ ID NO: 393762 - DNA, 20 bp, human
gacacgcaagtgcacttgcg

SEQ ID NO: 393763 - DNA, 20 bp, human
gtccaccgccccgggtgttg

SEQ ID NO: 393764 - DNA, 20 bp, human
gcgtctgtaggttcaggcta

SEQ ID NO: 393765 - DNA, 20 bp, human
gctccggaggccggggtaac

SEQ ID NO: 393766 - DNA, 20 bp, human
gcggctccgcgcctcagtga

SEQ ID NO: 393767 - DNA, 20 bp, human
gcagatgcgcgattcggcgg

SEQ ID NO: 393768 - DNA, 20 bp, human
gtggagcggaggaagttcgt

SEQ ID NO: 393769 - DNA, 20 bp, human
gcctcagtgagggcggggta

SEQ ID NO: 393770 - DNA, 20 bp, human
ggcgcaatctgcatgaacga

SEQ ID NO: 393771 - DNA, 20 bp, human
gcaagcaggcgcccacccag

SEQ ID NO: 393772 - DNA, 20 bp, human
ggcgcagatgcgcgattcgg

SEQ ID NO: 393773 - DNA, 20 bp, human
gggctcggcgcctccggatc

SEQ ID NO: 393774 - DNA, 20 bp, human
ggcggcagccacaacatccg

SEQ ID NO: 393775 - DNA, 20 bp, human
gcttgcgcgcaggcccaagc

SEQ ID NO: 393776 - DNA, 20 bp, human
gttggggaggagaggaacgg

SEQ ID NO: 393777 - DNA, 20 bp, human
gtcggaacctggatgtgttg

SEQ ID NO: 393778 - DNA, 20 bp, human
gtgtcctcacctaccaatat

SEQ ID NO: 393779 - DNA, 20 bp, human
gcctgcgcagtgagactcgt

SEQ ID NO: 393780 - DNA, 20 bp, human
ggggccggggagcccaacct

SEQ ID NO: 393781 - DNA, 20 bp, human
ggggtggcagggtcggaacc

SEQ ID NO: 393782 - DNA, 20 bp, human
gtgcgcaggcgcggagcggt

SEQ ID NO: 393783 - DNA, 20 bp, human
gtctcctccccaacacatcc

SEQ ID NO: 393784 - DNA, 20 bp, human
ggtcagctttgctagatcaa

SEQ ID NO: 393785 - DNA, 20 bp, human
ggagggagaaaatgatgccc

SEQ ID NO: 393786 - DNA, 20 bp, human
gggcgcgcaacgaagcgaaa

SEQ ID NO: 393787 - DNA, 20 bp, human
gcctgtagagcgggatcccg

SEQ ID NO: 393788 - DNA, 20 bp, human
ggatcccgctctacaggcag

SEQ ID NO: 393789 - DNA, 20 bp, human
gtcgccgccgtaggccccac

SEQ ID NO: 393790 - DNA, 20 bp, human
ggggcctacgactgcggggc

SEQ ID NO: 393791 - DNA, 20 bp, human
gtgggaggggcctacgactg

SEQ ID NO: 393792 - DNA, 20 bp, human
gggagccgctgcctgtagag

SEQ ID NO: 393793 - DNA, 20 bp, human
gggccccgccccgcagtcgt

SEQ ID NO: 393794 - DNA, 20 bp, human
gccggagcgcgggatgactg

SEQ ID NO: 393795 - DNA, 20 bp, human
ggatccagtggggcctacgg

SEQ ID NO: 393796 - DNA, 20 bp, human
gccggagtcgcgagcgtgac

SEQ ID NO: 393797 - DNA, 20 bp, human
gcggtcggccgagaaagttc

SEQ ID NO: 393798 - DNA, 20 bp, human
gctgtcgcccggaactttct

SEQ ID NO: 393799 - DNA, 20 bp, human
gtgcgcggacagagcggccc

SEQ ID NO: 393800 - DNA, 20 bp, human
gggaatgcaccagacagggc

SEQ ID NO: 393801 - DNA, 20 bp, human
ggcggcgcagggaagaagcg

SEQ ID NO: 393802 - DNA, 20 bp, human
gcgggtaactgggacgtcct

SEQ ID NO: 393803 - DNA, 20 bp, human
gctctgtccgcgcagctcga

SEQ ID NO: 393804 - DNA, 20 bp, human
gaaggccataatttggtgtg

SEQ ID NO: 393805 - DNA, 20 bp, human
gcccccccggcccgggtaac

SEQ ID NO: 393806 - DNA, 20 bp, human
gcggaggcaaggatgcgagg

SEQ ID NO: 393807 - DNA, 20 bp, human
ggggccagcctcacccactc

SEQ ID NO: 393808 - DNA, 20 bp, human
gtcagggtcggaccccgagt

SEQ ID NO: 393809 - DNA, 20 bp, human
gagggagacgctcccagggg

SEQ ID NO: 393810 - DNA, 20 bp, human
ggagcccgggcgggagtagc

SEQ ID NO: 393811 - DNA, 20 bp, human
gcctccagaggcctctgacc

SEQ ID NO: 393812 - DNA, 20 bp, human
ggaggcctctgacccggcta

SEQ ID NO: 393813 - DNA, 20 bp, human
ggtaacccggagccgtcgtg

SEQ ID NO: 393814 - DNA, 20 bp, human
gagggaccgcacgacggctc

SEQ ID NO: 393815 - DNA, 20 bp, human
ggaccccgagtgggtgaggc

SEQ ID NO: 393816 - DNA, 20 bp, human
ggcctggcgctgtcccgtgg

SEQ ID NO: 393817 - DNA, 20 bp, human
gctcgcgacagttcgagctc

SEQ ID NO: 393818 - DNA, 20 bp, human
gactgcctggcgctgtcccg

SEQ ID NO: 393819 - DNA, 20 bp, human
gacagttcgagctccggctg

SEQ ID NO: 393820 - DNA, 20 bp, human
gagaatgccgccagctccgg

SEQ ID NO: 393821 - DNA, 20 bp, human
gcgaactgtcgcgagaatag

SEQ ID NO: 393822 - DNA, 20 bp, human
gagagttcgcgctcccgcgc

SEQ ID NO: 393823 - DNA, 20 bp, human
gcgcactccagtccccacca

SEQ ID NO: 393824 - DNA, 20 bp, human
gttcgagctccggctgtgga

SEQ ID NO: 393825 - DNA, 20 bp, human
ggactggagtgcgcattttc

SEQ ID NO: 393826 - DNA, 20 bp, human
gcgagcgtgctcagtaaagg

SEQ ID NO: 393827 - DNA, 20 bp, human
ggcagcgcgtgaagttggtg

SEQ ID NO: 393828 - DNA, 20 bp, human
ggggaagcacgggtgggaga

SEQ ID NO: 393829 - DNA, 20 bp, human
gctgggccgcggcatacttc

SEQ ID NO: 393830 - DNA, 20 bp, human
gcacccgcggtgccggactc

SEQ ID NO: 393831 - DNA, 20 bp, human
gcaccgcgggtgagagaccg

SEQ ID NO: 393832 - DNA, 20 bp, human
gcgcgccggaaatacgtcac

SEQ ID NO: 393833 - DNA, 20 bp, human
gggacgggccggggcgcgat

SEQ ID NO: 393834 - DNA, 20 bp, human
gcggcctgagtccggcaccg

SEQ ID NO: 393835 - DNA, 20 bp, human
gtcaggccggaagtatgccg

SEQ ID NO: 393836 - DNA, 20 bp, human
ggagggggctggtgtctcga

SEQ ID NO: 393837 - DNA, 20 bp, human
ggctgaagacgtcatggagg

SEQ ID NO: 393838 - DNA, 20 bp, human
gtcagccgcgcgcccgacgt

SEQ ID NO: 393839 - DNA, 20 bp, human
gcgcgcggctgaagacgtca

SEQ ID NO: 393840 - DNA, 20 bp, human
gtctcgagggcggagtatga

SEQ ID NO: 393841 - DNA, 20 bp, human
gtccaccactcgcgcctctc

SEQ ID NO: 393842 - DNA, 20 bp, human
gggggctggtgtctcgaggg

SEQ ID NO: 393843 - DNA, 20 bp, human
gtcagccgacgtcgggcgcg

SEQ ID NO: 393844 - DNA, 20 bp, human
gtctctctggcggtcgcagg

SEQ ID NO: 393845 - DNA, 20 bp, human
gtggccgtctcagccgacgt

SEQ ID NO: 393846 - DNA, 20 bp, human
ggggcatgtcccagacccat

SEQ ID NO: 393847 - DNA, 20 bp, human
gggtctgggacatgccccat

SEQ ID NO: 393848 - DNA, 20 bp, human
gtgggcggagccaatgggtc

SEQ ID NO: 393849 - DNA, 20 bp, human
gcaggggcggggctgaagat

SEQ ID NO: 393850 - DNA, 20 bp, human
gataggcgaggaggtgaggt

SEQ ID NO: 393851 - DNA, 20 bp, human
gaggccgcgcccccagttcg

SEQ ID NO: 393852 - DNA, 20 bp, human
gtgaggtgggcggagccaat

SEQ ID NO: 393853 - DNA, 20 bp, human
gtgtataggcccatcagggg

SEQ ID NO: 393854 - DNA, 20 bp, human
gaacgataggcgaggaggtg

SEQ ID NO: 393855 - DNA, 20 bp, human
gggggcttgggagcgacatg

SEQ ID NO: 393856 - DNA, 20 bp, human
gcctagcaggggagggtcgt

SEQ ID NO: 393857 - DNA, 20 bp, human
gaaaggggtgcgataggcaa

SEQ ID NO: 393858 - DNA, 20 bp, human
gctgctaggcccaggccact

SEQ ID NO: 393859 - DNA, 20 bp, human
ggagaagcccccagaagctt

SEQ ID NO: 393860 - DNA, 20 bp, human
gttagcaggagtcgggaggg

SEQ ID NO: 393861 - DNA, 20 bp, human
gcgggatgaaaccctccgag

SEQ ID NO: 393862 - DNA, 20 bp, human
ggcagagaaaggggtgcgat

SEQ ID NO: 393863 - DNA, 20 bp, human
gtcccccttagcagggtctg

SEQ ID NO: 393864 - DNA, 20 bp, human
ggaggcccacacctctcgga

SEQ ID NO: 393865 - DNA, 20 bp, human
gtggaggcctggccgcgctg

SEQ ID NO: 393866 - DNA, 20 bp, human
gaccgcgccgggccggtctc

SEQ ID NO: 393867 - DNA, 20 bp, human
gcagccaggcaaccctgctc

SEQ ID NO: 393868 - DNA, 20 bp, human
gccaggcaaccctgctccgg

SEQ ID NO: 393869 - DNA, 20 bp, human
gtgaacacgaatgccgtgtg

SEQ ID NO: 393870 - DNA, 20 bp, human
gccggtctctggtctcttta

SEQ ID NO: 393871 - DNA, 20 bp, human
gaagcgagatgtgtacagtg

SEQ ID NO: 393872 - DNA, 20 bp, human
gcgggagaccagagacctcg

SEQ ID NO: 393873 - DNA, 20 bp, human
ggttcagaacccccggagca

SEQ ID NO: 393874 - DNA, 20 bp, human
gaagaaacttaaaagaggcg

SEQ ID NO: 393875 - DNA, 20 bp, human
gtgtgtacagtgaggccgcg

SEQ ID NO: 393876 - DNA, 20 bp, human
ggagcgttaaggtcacgtga

SEQ ID NO: 393877 - DNA, 20 bp, human
gcaacctgggggccgagcca

SEQ ID NO: 393878 - DNA, 20 bp, human
gaccccgggggatcccggga

SEQ ID NO: 393879 - DNA, 20 bp, human
ggcgtctagcagcagggcac

SEQ ID NO: 393880 - DNA, 20 bp, human
ggggtccccggcggtgcggg

SEQ ID NO: 393881 - DNA, 20 bp, human
gcgagccagggccccggacg

SEQ ID NO: 393882 - DNA, 20 bp, human
gggtgagcgggatgcagcaa

SEQ ID NO: 393883 - DNA, 20 bp, human
gtccggcgcgagcccccgtc

SEQ ID NO: 393884 - DNA, 20 bp, human
gggagcccggagcccgcctt

SEQ ID NO: 393885 - DNA, 20 bp, human
gcggagctacggcctaacgg

SEQ ID NO: 393886 - DNA, 20 bp, human
ggatgcgggagggttgctaa

SEQ ID NO: 393887 - DNA, 20 bp, human
gcgggagggttgctaagggg

SEQ ID NO: 393888 - DNA, 20 bp, human
gggggcccaacgatgcggga

SEQ ID NO: 393889 - DNA, 20 bp, human
gtgccggggcccaacgatgc

SEQ ID NO: 393890 - DNA, 20 bp, human
gggtggggtgacgcgagcta

SEQ ID NO: 393891 - DNA, 20 bp, human
ggccccgcgaggcgctccag

SEQ ID NO: 393892 - DNA, 20 bp, human
gctaaggggcgggaggcgag

SEQ ID NO: 393893 - DNA, 20 bp, human
gagcaaccctcccgcatcgt

SEQ ID NO: 393894 - DNA, 20 bp, human
gaacacggaccaatcggcgg

SEQ ID NO: 393895 - DNA, 20 bp, human
gagcaggcgagtccggtcag

SEQ ID NO: 393896 - DNA, 20 bp, human
gtgtacttacacattcacac

SEQ ID NO: 393897 - DNA, 20 bp, human
ggggaagcagacgcttcgta

SEQ ID NO: 393898 - DNA, 20 bp, human
gccagccgtgaataatctga

SEQ ID NO: 393899 - DNA, 20 bp, human
gggagcaacttgacaccagt

SEQ ID NO: 393900 - DNA, 20 bp, human
gccagtgggctcaggagccc

SEQ ID NO: 393901 - DNA, 20 bp, human
gcacattcacacgggaagac

SEQ ID NO: 393902 - DNA, 20 bp, human
gttgatgtaagtgtaaagat

SEQ ID NO: 393903 - DNA, 20 bp, human
gtgatggttcctgaaatgac

SEQ ID NO: 393904 - DNA, 20 bp, human
gggtaaaatccaatagtgaa

SEQ ID NO: 393905 - DNA, 20 bp, human
gttgtgtgttgtcttgagtc

SEQ ID NO: 393906 - DNA, 20 bp, human
ggcggccggggtgacgacgg

SEQ ID NO: 393907 - DNA, 20 bp, human
ggaggagaggaggtcgcggg

SEQ ID NO: 393908 - DNA, 20 bp, human
gccaggcgcgggcaagttcg

SEQ ID NO: 393909 - DNA, 20 bp, human
gctgacacacagttcccccg

SEQ ID NO: 393910 - DNA, 20 bp, human
gggcaagttcggggctggca

SEQ ID NO: 393911 - DNA, 20 bp, human
gccctggcacaactcagctg

SEQ ID NO: 393912 - DNA, 20 bp, human
ggcgcgggcaagttcggggc

SEQ ID NO: 393913 - DNA, 20 bp, human
ggaacagcaaagcactcccc

SEQ ID NO: 393914 - DNA, 20 bp, human
ggctggcttagagccaaagg

SEQ ID NO: 393915 - DNA, 20 bp, human
gacaggacacgcctcagtct

SEQ ID NO: 393916 - DNA, 20 bp, human
gtggctgttgctcaagtcgt

SEQ ID NO: 393917 - DNA, 20 bp, human
gctcccaccgaggaaagtgg

SEQ ID NO: 393918 - DNA, 20 bp, human
gtgggatgcccagcatctaa

SEQ ID NO: 393919 - DNA, 20 bp, human
gcaagcgcgatctgaccagc

SEQ ID NO: 393920 - DNA, 20 bp, human
gtcgtgggggcgggaccaat

SEQ ID NO: 393921 - DNA, 20 bp, human
gatcgcgcttgctgggacct

SEQ ID NO: 393922 - DNA, 20 bp, human
gcagccgagcctgcggaagg

SEQ ID NO: 393923 - DNA, 20 bp, human
gaatgggcgcccttagatgc

SEQ ID NO: 393924 - DNA, 20 bp, human
gcggccaccactttcctcgg

SEQ ID NO: 393925 - DNA, 20 bp, human
gtggtcagatcgcgcttgct

SEQ ID NO: 393926 - DNA, 20 bp, human
gccggaccagcgctgaggag

SEQ ID NO: 393927 - DNA, 20 bp, human
ggccctgggacctcaatctg

SEQ ID NO: 393928 - DNA, 20 bp, human
gagaagacctggaaaggcgc

SEQ ID NO: 393929 - DNA, 20 bp, human
ggaggagaggagtggtcctt

SEQ ID NO: 393930 - DNA, 20 bp, human
gacctggaaaggcgcgggat

SEQ ID NO: 393931 - DNA, 20 bp, human
gcgagggagccaggcttcgg

SEQ ID NO: 393932 - DNA, 20 bp, human
ggcctcagattgaggtccca

SEQ ID NO: 393933 - DNA, 20 bp, human
ggctggactacccagtaatt

SEQ ID NO: 393934 - DNA, 20 bp, human
gagtaattgggttcagtagc

SEQ ID NO: 393935 - DNA, 20 bp, human
ggtgcctcaggccttccagt

SEQ ID NO: 393936 - DNA, 20 bp, human
gctgccagggtggttctctg

SEQ ID NO: 393937 - DNA, 20 bp, human
gggctcaggctcagtcaggg

SEQ ID NO: 393938 - DNA, 20 bp, human
ggagctgcaacagaaaccgg

SEQ ID NO: 393939 - DNA, 20 bp, human
gaaaaggaaaagcatcacca

SEQ ID NO: 393940 - DNA, 20 bp, human
gaaaagcatcaccaaggagg

SEQ ID NO: 393941 - DNA, 20 bp, human
gtctgggtgggatgtaatag

SEQ ID NO: 393942 - DNA, 20 bp, human
gcagaggcaaaatcctgcca

SEQ ID NO: 393943 - DNA, 20 bp, human
gaggaaaagcatcaccaagg

SEQ ID NO: 393944 - DNA, 20 bp, human
gctcctctgggcagggtctc

SEQ ID NO: 393945 - DNA, 20 bp, human
ggggtccaggcaggatccag

SEQ ID NO: 393946 - DNA, 20 bp, human
gaaacggaacccagagtcga

SEQ ID NO: 393947 - DNA, 20 bp, human
gactggacagcggctagaaa

SEQ ID NO: 393948 - DNA, 20 bp, human
ggtcgaaggagcttggtttc

SEQ ID NO: 393949 - DNA, 20 bp, human
gaaccaagctccttcgactc

SEQ ID NO: 393950 - DNA, 20 bp, human
gaataaaggcggaggatcgg

SEQ ID NO: 393951 - DNA, 20 bp, human
gtcctgaaacgggcggggac

SEQ ID NO: 393952 - DNA, 20 bp, human
gtccagtccccgcccgtttc

SEQ ID NO: 393953 - DNA, 20 bp, human
ggcgccgcttttcctgaaac

SEQ ID NO: 393954 - DNA, 20 bp, human
gccgcccgtttcaggaaaag

SEQ ID NO: 393955 - DNA, 20 bp, human
ggacgcacgggtgtctactg

SEQ ID NO: 393956 - DNA, 20 bp, human
gcgaaaggacaaaggagttc

SEQ ID NO: 393957 - DNA, 20 bp, human
gtgctgtgaatgtccaggat

SEQ ID NO: 393958 - DNA, 20 bp, human
gggctccagttatgcaagtc

SEQ ID NO: 393959 - DNA, 20 bp, human
ggatcagtgagcaacatttg

SEQ ID NO: 393960 - DNA, 20 bp, human
gacagtgtgcgaaaggacaa

SEQ ID NO: 393961 - DNA, 20 bp, human
gttgtgagacagtgtgcgaa

SEQ ID NO: 393962 - DNA, 20 bp, human
gacaagggtgttagcgcttg

SEQ ID NO: 393963 - DNA, 20 bp, human
gaagtctggaatgaaagctg

SEQ ID NO: 393964 - DNA, 20 bp, human
gagagagggcaaggggcgaa

SEQ ID NO: 393965 - DNA, 20 bp, human
gctgggacaaagcagggaca

SEQ ID NO: 393966 - DNA, 20 bp, human
gcgtcagcgaatggtgtgga

SEQ ID NO: 393967 - DNA, 20 bp, human
ggggcggctgcgtcagcgaa

SEQ ID NO: 393968 - DNA, 20 bp, human
ggctgcgtcagcgaatggtg

SEQ ID NO: 393969 - DNA, 20 bp, human
gtgtggacggcgcataaacg

SEQ ID NO: 393970 - DNA, 20 bp, human
ggggcagccgcattcagggt

SEQ ID NO: 393971 - DNA, 20 bp, human
gtgcggacagagatagtggg

SEQ ID NO: 393972 - DNA, 20 bp, human
ggtggatgtagcgaatgata

SEQ ID NO: 393973 - DNA, 20 bp, human
gggcagggaggcaacggcct

SEQ ID NO: 393974 - DNA, 20 bp, human
gtggtgggcagccgcattca

SEQ ID NO: 393975 - DNA, 20 bp, human
ggggcctaaggcgcagtcgc

SEQ ID NO: 393976 - DNA, 20 bp, human
gcccaggcgcctaagctcca

SEQ ID NO: 393977 - DNA, 20 bp, human
gaccttgcgccctggagctt

SEQ ID NO: 393978 - DNA, 20 bp, human
ggaaagaagtacataaaggt

SEQ ID NO: 393979 - DNA, 20 bp, human
ggattggcaatagagttccc

SEQ ID NO: 393980 - DNA, 20 bp, human
gtgatgaaagaagtacataa

SEQ ID NO: 393981 - DNA, 20 bp, human
gtctttcatcagttgtaaag

SEQ ID NO: 393982 - DNA, 20 bp, human
ggccctggagcttaggcgcc

SEQ ID NO: 393983 - DNA, 20 bp, human
gtaaaggttggtgatatgat

SEQ ID NO: 393984 - DNA, 20 bp, human
gttcatcagttgtaaagtgg

SEQ ID NO: 393985 - DNA, 20 bp, human
gctccctcaaagcggaagtg

SEQ ID NO: 393986 - DNA, 20 bp, human
gcccaggcgcctaagctcca

SEQ ID NO: 393987 - DNA, 20 bp, human
gaccttgcgccctggagctt

SEQ ID NO: 393988 - DNA, 20 bp, human
ggattggcaatagagttccc

SEQ ID NO: 393989 - DNA, 20 bp, human
ggccctggagcttaggcgcc

SEQ ID NO: 393990 - DNA, 20 bp, human
gggccacagtgggctccaag

SEQ ID NO: 393991 - DNA, 20 bp, human
gctccctcaaagcggaggtg

SEQ ID NO: 393992 - DNA, 20 bp, human
ggcattcggggcagcgacgc

SEQ ID NO: 393993 - DNA, 20 bp, human
gttcggggcagcgacgctgg

SEQ ID NO: 393994 - DNA, 20 bp, human
gaggtataaacttagactcc

SEQ ID NO: 393995 - DNA, 20 bp, human
gagcagcccggacacggcgg

SEQ ID NO: 393996 - DNA, 20 bp, human
gcccaggcgcctaagctcca

SEQ ID NO: 393997 - DNA, 20 bp, human
gaccttgcgccctggagctt

SEQ ID NO: 393998 - DNA, 20 bp, human
ggattggcaatagagttccc

SEQ ID NO: 393999 - DNA, 20 bp, human
ggccctggagcttaggcgcc

SEQ ID NO: 394000 - DNA, 20 bp, human
gtaaaggttggtgatatgat

SEQ ID NO: 394001 - DNA, 20 bp, human
gggccacagtgggctccaag

SEQ ID NO: 394002 - DNA, 20 bp, human
gctccctcaaagcggaggtg

SEQ ID NO: 394003 - DNA, 20 bp, human
ggcattcggggcagcgacgc

SEQ ID NO: 394004 - DNA, 20 bp, human
gttcggggcagcgacgctgg

SEQ ID NO: 394005 - DNA, 20 bp, human
gaggtataaacttagactcc

SEQ ID NO: 394006 - DNA, 20 bp, human
gcggcggcaagagcagaagc

SEQ ID NO: 394007 - DNA, 20 bp, human
gaactaggatagcgaggccg

SEQ ID NO: 394008 - DNA, 20 bp, human
gcggggcggccgcgggtcgc

SEQ ID NO: 394009 - DNA, 20 bp, human
ggcactcagtcaacctcacg

SEQ ID NO: 394010 - DNA, 20 bp, human
gaggcagcgaatggcggcgt

SEQ ID NO: 394011 - DNA, 20 bp, human
ggttgtcagagagcagacgt

SEQ ID NO: 394012 - DNA, 20 bp, human
ggcaaaggggtgctcaaaaa

SEQ ID NO: 394013 - DNA, 20 bp, human
ggcggccgccccgccccgtg

SEQ ID NO: 394014 - DNA, 20 bp, human
gtgtcccccccggaagaagc

SEQ ID NO: 394015 - DNA, 20 bp, human
gttctgcggcatgtcccccc

SEQ ID NO: 394016 - DNA, 20 bp, human
gtccctgccgcgcctgtcgg

SEQ ID NO: 394017 - DNA, 20 bp, human
gcgcccgggaagctgcgcga

SEQ ID NO: 394018 - DNA, 20 bp, human
ggcagcctgcgcctcggtcc

SEQ ID NO: 394019 - DNA, 20 bp, human
gctcggtccgggtgggtcta

SEQ ID NO: 394020 - DNA, 20 bp, human
gcctgcgcctcggtccgggt

SEQ ID NO: 394021 - DNA, 20 bp, human
ggaccctcgcgcagcttccc

SEQ ID NO: 394022 - DNA, 20 bp, human
ggggtcctgcggcaccgccc

SEQ ID NO: 394023 - DNA, 20 bp, human
gacgccagcgcgttcctctg

SEQ ID NO: 394024 - DNA, 20 bp, human
gctgccacagaggaacgcgc

SEQ ID NO: 394025 - DNA, 20 bp, human
gcacaagcagaccccttcct

SEQ ID NO: 394026 - DNA, 20 bp, human
ggtggcagccccatccggag

SEQ ID NO: 394027 - DNA, 20 bp, human
gcagcccaggaagcggtcgg

SEQ ID NO: 394028 - DNA, 20 bp, human
gcggctaggaggcgggtgga

SEQ ID NO: 394029 - DNA, 20 bp, human
gtggcctgacgtgaggagga

SEQ ID NO: 394030 - DNA, 20 bp, human
ggggccaggtcgtttttgaa

SEQ ID NO: 394031 - DNA, 20 bp, human
gagggcggctaggaggcggg

SEQ ID NO: 394032 - DNA, 20 bp, human
ggggctgcgctagggttcgg

SEQ ID NO: 394033 - DNA, 20 bp, human
ggttagaccccgaggaaggg

SEQ ID NO: 394034 - DNA, 20 bp, human
gttgggggcagcagtgtcat

SEQ ID NO: 394035 - DNA, 20 bp, human
ggtcacagccactccggatg

SEQ ID NO: 394036 - DNA, 20 bp, human
gagtgccctgcgttcggggt

SEQ ID NO: 394037 - DNA, 20 bp, human
gccgaacgcagggcactctc

SEQ ID NO: 394038 - DNA, 20 bp, human
gggggccgatctctacgttg

SEQ ID NO: 394039 - DNA, 20 bp, human
gaccccccaaagcccagtgg

SEQ ID NO: 394040 - DNA, 20 bp, human
gaaaactgaaagtgccgcgc

SEQ ID NO: 394041 - DNA, 20 bp, human
gtgggcgtgaggggctagag

SEQ ID NO: 394042 - DNA, 20 bp, human
gtggccgggcctagggctcg

SEQ ID NO: 394043 - DNA, 20 bp, human
gttgaggcgtagacaaagcc

SEQ ID NO: 394044 - DNA, 20 bp, human
gaaaccgaggtctccgggag

SEQ ID NO: 394045 - DNA, 20 bp, human
gcaagttctggggccttcgc

SEQ ID NO: 394046 - DNA, 20 bp, human
gcggttccccctgctggtca

SEQ ID NO: 394047 - DNA, 20 bp, human
gtacgcagccctgaccagca

SEQ ID NO: 394048 - DNA, 20 bp, human
ggaaaagaggggaaattcct

SEQ ID NO: 394049 - DNA, 20 bp, human
gaaaacgcggttccccctgc

SEQ ID NO: 394050 - DNA, 20 bp, human
gttcctaggggcgtggtcgt

SEQ ID NO: 394051 - DNA, 20 bp, human
ggcgtaatgcagcgaaaaga

SEQ ID NO: 394052 - DNA, 20 bp, human
gcaccaacgaccacgcccct

SEQ ID NO: 394053 - DNA, 20 bp, human
ggggtttggtagaattttac

SEQ ID NO: 394054 - DNA, 20 bp, human
gcaaccgactgctcttttaa

SEQ ID NO: 394055 - DNA, 20 bp, human
ggggacaggagagaactagt

SEQ ID NO: 394056 - DNA, 20 bp, human
gtgcgcgctgacaggagcgc

SEQ ID NO: 394057 - DNA, 20 bp, human
gtggaggcgtggcacgaggg

SEQ ID NO: 394058 - DNA, 20 bp, human
gagggaggggcgaaaccggg

SEQ ID NO: 394059 - DNA, 20 bp, human
gagggggcgtggcgttggga

SEQ ID NO: 394060 - DNA, 20 bp, human
gaaaccgggtggcgcggagg

SEQ ID NO: 394061 - DNA, 20 bp, human
gcggtggaggcgtggcacga

SEQ ID NO: 394062 - DNA, 20 bp, human
gcacgagggaggggcgaaac

SEQ ID NO: 394063 - DNA, 20 bp, human
gagcgcgcacgcccccatct

SEQ ID NO: 394064 - DNA, 20 bp, human
gccggtgcggagaagcgcga

SEQ ID NO: 394065 - DNA, 20 bp, human
ggcggctgtggaccccagcg

SEQ ID NO: 394066 - DNA, 20 bp, human
gatctccatcccaatctctg

SEQ ID NO: 394067 - DNA, 20 bp, human
ggcagataccctcagagatt

SEQ ID NO: 394068 - DNA, 20 bp, human
gattagtctctcatccccaa

SEQ ID NO: 394069 - DNA, 20 bp, human
gaaactgccctctctggact

SEQ ID NO: 394070 - DNA, 20 bp, human
gaaccctaaaatgtgattgg

SEQ ID NO: 394071 - DNA, 20 bp, human
ggcgagtcacccacaccttt

SEQ ID NO: 394072 - DNA, 20 bp, human
ggaaggcacagacagaataa

SEQ ID NO: 394073 - DNA, 20 bp, human
gcccaaggccacaccgtgag

SEQ ID NO: 394074 - DNA, 20 bp, human
gctaaaatgtgattggggga

SEQ ID NO: 394075 - DNA, 20 bp, human
gtcagcagacactttatttg

SEQ ID NO: 394076 - DNA, 20 bp, human
gcctaggagagcatcacttc

SEQ ID NO: 394077 - DNA, 20 bp, human
gcgaacattagccctgacaa

SEQ ID NO: 394078 - DNA, 20 bp, human
gaatgcaaaaaccaggccag

SEQ ID NO: 394079 - DNA, 20 bp, human
gttctcaggctcttctcctc

SEQ ID NO: 394080 - DNA, 20 bp, human
gctgaggaaatgcaaaaacc

SEQ ID NO: 394081 - DNA, 20 bp, human
gcagtgtggtttcccttctc

SEQ ID NO: 394082 - DNA, 20 bp, human
gccagacagtctaatttttt

SEQ ID NO: 394083 - DNA, 20 bp, human
gaatcccactgaaatgttga

SEQ ID NO: 394084 - DNA, 20 bp, human
gcctaggaaatctgttagca

SEQ ID NO: 394085 - DNA, 20 bp, human
gtctggcaccttggccagtg

SEQ ID NO: 394086 - DNA, 20 bp, human
ggggctagccgcagatccca

SEQ ID NO: 394087 - DNA, 20 bp, human
gggaagagggatagagtcct

SEQ ID NO: 394088 - DNA, 20 bp, human
gtggggaagccatcggacgt

SEQ ID NO: 394089 - DNA, 20 bp, human
ggctgggaaggacgaagcga

SEQ ID NO: 394090 - DNA, 20 bp, human
gggcactcgtgcagaatgac

SEQ ID NO: 394091 - DNA, 20 bp, human
gggaagccatcggacgtcgg

SEQ ID NO: 394092 - DNA, 20 bp, human
ggccggcgccggctattgat

SEQ ID NO: 394093 - DNA, 20 bp, human
ggctagcccctgcgtaaaga

SEQ ID NO: 394094 - DNA, 20 bp, human
gggccggcagcagttactcg

SEQ ID NO: 394095 - DNA, 20 bp, human
gcataagggactgtagtcct

SEQ ID NO: 394096 - DNA, 20 bp, human
ggcaacagctagggaagctt

SEQ ID NO: 394097 - DNA, 20 bp, human
ggcagcagtctggaggaggt

SEQ ID NO: 394098 - DNA, 20 bp, human
gacgccacaggcactgatgg

SEQ ID NO: 394099 - DNA, 20 bp, human
gactgatggaggcagcagtc

SEQ ID NO: 394100 - DNA, 20 bp, human
gcacacgccacaggcactga

SEQ ID NO: 394101 - DNA, 20 bp, human
gtctgctaaggtatttcccc

SEQ ID NO: 394102 - DNA, 20 bp, human
ggcttccctagctgttgcca

SEQ ID NO: 394103 - DNA, 20 bp, human
ggctggctgtgttcttacaa

SEQ ID NO: 394104 - DNA, 20 bp, human
gcactagcttaattagtgtc

SEQ ID NO: 394105 - DNA, 20 bp, human
gaaagactgcatttgcaacg

SEQ ID NO: 394106 - DNA, 20 bp, human
gcggatcgggaatgggactc

SEQ ID NO: 394107 - DNA, 20 bp, human
ggggcttcagcaagaccgaa

SEQ ID NO: 394108 - DNA, 20 bp, human
gatggggagcattgaatact

SEQ ID NO: 394109 - DNA, 20 bp, human
gcgaggggacggagcgagat

SEQ ID NO: 394110 - DNA, 20 bp, human
gaagaccgaagggcagatag

SEQ ID NO: 394111 - DNA, 20 bp, human
gagtctgcgcggatcgggaa

SEQ ID NO: 394112 - DNA, 20 bp, human
gcgcaggctcggatcgggat

SEQ ID NO: 394113 - DNA, 20 bp, human
gaaggggcacagaatctcgc

SEQ ID NO: 394114 - DNA, 20 bp, human
ggaggaggttggcccccgag

SEQ ID NO: 394115 - DNA, 20 bp, human
ggtgagacttcccacgtgac

SEQ ID NO: 394116 - DNA, 20 bp, human
gcggggctggcgcaagcgtg

SEQ ID NO: 394117 - DNA, 20 bp, human
gagcgtggggcggagctcca

SEQ ID NO: 394118 - DNA, 20 bp, human
ggggcggagctccagggctt

SEQ ID NO: 394119 - DNA, 20 bp, human
gagcctgcgagccgggatcg

SEQ ID NO: 394120 - DNA, 20 bp, human
ggagctgggcttggggttac

SEQ ID NO: 394121 - DNA, 20 bp, human
gtcccggctcgcaggctcca

SEQ ID NO: 394122 - DNA, 20 bp, human
ggagggaccttgtgtctctg

SEQ ID NO: 394123 - DNA, 20 bp, human
gtcgcactccagctggaagt

SEQ ID NO: 394124 - DNA, 20 bp, human
gcggtccccatctcgagcgt

SEQ ID NO: 394125 - DNA, 20 bp, human
ggacgcatccccaggtgacc

SEQ ID NO: 394126 - DNA, 20 bp, human
ggtggcgcgcgcctctagtc

SEQ ID NO: 394127 - DNA, 20 bp, human
ggggctgaggcacagttgaa

SEQ ID NO: 394128 - DNA, 20 bp, human
ggtggctcgaggtggtgtcg

SEQ ID NO: 394129 - DNA, 20 bp, human
gcctgtcgtcacttcctcgg

SEQ ID NO: 394130 - DNA, 20 bp, human
gaggccgtcggggaacggat

SEQ ID NO: 394131 - DNA, 20 bp, human
gctccctgcaatgcgagcgg

SEQ ID NO: 394132 - DNA, 20 bp, human
gtacctccctgcaatgcgag

SEQ ID NO: 394133 - DNA, 20 bp, human
gagcccgccattcccattgg

SEQ ID NO: 394134 - DNA, 20 bp, human
gacctcgagccacccccaca

SEQ ID NO: 394135 - DNA, 20 bp, human
gacgcctgtcgtcacttcct

SEQ ID NO: 394136 - DNA, 20 bp, human
gcccgcccggactccgtgag

SEQ ID NO: 394137 - DNA, 20 bp, human
gagcggggtcgtgaccggtg

SEQ ID NO: 394138 - DNA, 20 bp, human
ggcagggcgtggcccgttgg

SEQ ID NO: 394139 - DNA, 20 bp, human
ggaccggtggggccaagact

SEQ ID NO: 394140 - DNA, 20 bp, human
gcctgcgcagactccgtgag

SEQ ID NO: 394141 - DNA, 20 bp, human
gcccaccgctcacggagtcc

SEQ ID NO: 394142 - DNA, 20 bp, human
gcagctccgcccaccgctca

SEQ ID NO: 394143 - DNA, 20 bp, human
gtgggcggagctgcgtgctc

SEQ ID NO: 394144 - DNA, 20 bp, human
gcccgcgggccttatcccaa

SEQ ID NO: 394145 - DNA, 20 bp, human
gaaggcccgcggggaatact

SEQ ID NO: 394146 - DNA, 20 bp, human
gaagtgcagcggttcttggg

SEQ ID NO: 394147 - DNA, 20 bp, human
ggtgcctccggggtccggtt

SEQ ID NO: 394148 - DNA, 20 bp, human
gtaggccaagatagtagggg

SEQ ID NO: 394149 - DNA, 20 bp, human
gtgggatggagtgagcttaa

SEQ ID NO: 394150 - DNA, 20 bp, human
gggacggagcgggaaaatgt

SEQ ID NO: 394151 - DNA, 20 bp, human
ggtggccgcgcggcatcctg

SEQ ID NO: 394152 - DNA, 20 bp, human
ggggacacaacagaacgctc

SEQ ID NO: 394153 - DNA, 20 bp, human
gtctcctcagagaccctcgc

SEQ ID NO: 394154 - DNA, 20 bp, human
ggggtggtgcctccggggtc

SEQ ID NO: 394155 - DNA, 20 bp, human
ggatgtgggtggtgcctccg

SEQ ID NO: 394156 - DNA, 20 bp, human
gcgtccgcccgactccaaga

SEQ ID NO: 394157 - DNA, 20 bp, human
ggtctccagtccagcgccga

SEQ ID NO: 394158 - DNA, 20 bp, human
gctgccaggtgttaagatgg

SEQ ID NO: 394159 - DNA, 20 bp, human
ggcctctagccgctggccgt

SEQ ID NO: 394160 - DNA, 20 bp, human
gtggctctgggaatgaagcg

SEQ ID NO: 394161 - DNA, 20 bp, human
ggtccagcgccgacggccag

SEQ ID NO: 394162 - DNA, 20 bp, human
ggggcggtgcatgagatgat

SEQ ID NO: 394163 - DNA, 20 bp, human
gacgcggggcggtcgtcgac

SEQ ID NO: 394164 - DNA, 20 bp, human
ggccgacggccagcggctag

SEQ ID NO: 394165 - DNA, 20 bp, human
ggaggagagcctgggagcgc

SEQ ID NO: 394166 - DNA, 20 bp, human
gaacgggcggtgcagtagca

SEQ ID NO: 394167 - DNA, 20 bp, human
gtacaggggcgggagaaagt

SEQ ID NO: 394168 - DNA, 20 bp, human
gagggccccgagatctgatt

SEQ ID NO: 394169 - DNA, 20 bp, human
gacgcgcccaatcagatctc

SEQ ID NO: 394170 - DNA, 20 bp, human
gcagggccaatcagcagcgt

SEQ ID NO: 394171 - DNA, 20 bp, human
gaaccaatgggaaacgtggt

SEQ ID NO: 394172 - DNA, 20 bp, human
gcgcaggacccgtcgctcga

SEQ ID NO: 394173 - DNA, 20 bp, human
gtcccgccggcgcgaacggg

SEQ ID NO: 394174 - DNA, 20 bp, human
gtcctcccgccggcgcgaac

SEQ ID NO: 394175 - DNA, 20 bp, human
ggggtgggaagtacaggggc

SEQ ID NO: 394176 - DNA, 20 bp, human
gcggggctgggactagatta

SEQ ID NO: 394177 - DNA, 20 bp, human
gccagcgccgctaaagacta

SEQ ID NO: 394178 - DNA, 20 bp, human
gcctacgcgggacccaaccg

SEQ ID NO: 394179 - DNA, 20 bp, human
gaacaggcgcagggcggctt

SEQ ID NO: 394180 - DNA, 20 bp, human
ggatggattgtggtcgtcag

SEQ ID NO: 394181 - DNA, 20 bp, human
gactgggaggcgggcaacgg

SEQ ID NO: 394182 - DNA, 20 bp, human
ggctagcgcagaaagatctg

SEQ ID NO: 394183 - DNA, 20 bp, human
gcgccctgcgcctgttgcta

SEQ ID NO: 394184 - DNA, 20 bp, human
gtagcggcgctggcttccgc

SEQ ID NO: 394185 - DNA, 20 bp, human
gcggaagcgcggccttgttg

SEQ ID NO: 394186 - DNA, 20 bp, human
ggggaaagaggctgtctagc

SEQ ID NO: 394187 - DNA, 20 bp, human
gcacaagtcccgtccagcct

SEQ ID NO: 394188 - DNA, 20 bp, human
gtggttgattcacagaaccc

SEQ ID NO: 394189 - DNA, 20 bp, human
gggtcacaaagctagggtgg

SEQ ID NO: 394190 - DNA, 20 bp, human
gctggagaaagatgataaga

SEQ ID NO: 394191 - DNA, 20 bp, human
gaaagagaatgttggagctg

SEQ ID NO: 394192 - DNA, 20 bp, human
gcttaggagctggtcacaat

SEQ ID NO: 394193 - DNA, 20 bp, human
gccacaggatggggtagatg

SEQ ID NO: 394194 - DNA, 20 bp, human
gtaaggtcacaaagctaggg

SEQ ID NO: 394195 - DNA, 20 bp, human
gtttgcagaggaggctaaca

SEQ ID NO: 394196 - DNA, 20 bp, human
gtccgcgcaccggcagggaa

SEQ ID NO: 394197 - DNA, 20 bp, human
ggcaggaggccggactcgga

SEQ ID NO: 394198 - DNA, 20 bp, human
gggagcgagggaccgagtct

SEQ ID NO: 394199 - DNA, 20 bp, human
ggagccccggctccgcgcac

SEQ ID NO: 394200 - DNA, 20 bp, human
gcggaaggctctcccagact

SEQ ID NO: 394201 - DNA, 20 bp, human
gcggaggggcaggtcagcct

SEQ ID NO: 394202 - DNA, 20 bp, human
gcaggagcctcgcgggattg

SEQ ID NO: 394203 - DNA, 20 bp, human
ggggcgagccgtcccatggc

SEQ ID NO: 394204 - DNA, 20 bp, human
gtgtgagctgagattagccg

SEQ ID NO: 394205 - DNA, 20 bp, human
ggcgggtagcggtcgcgcgc

SEQ ID NO: 394206 - DNA, 20 bp, human
gcttacttctcatttggtga

SEQ ID NO: 394207 - DNA, 20 bp, human
gttctcatttggtgatggga

SEQ ID NO: 394208 - DNA, 20 bp, human
gccctcagttttctgattct

SEQ ID NO: 394209 - DNA, 20 bp, human
gtccacaaatgaactagtca

SEQ ID NO: 394210 - DNA, 20 bp, human
ggccatgactagttcatttg

SEQ ID NO: 394211 - DNA, 20 bp, human
gcaggaaactcattattata

SEQ ID NO: 394212 - DNA, 20 bp, human
gcatggcataaaagtgaaat

SEQ ID NO: 394213 - DNA, 20 bp, human
gagcaaaataacaaagttca

SEQ ID NO: 394214 - DNA, 20 bp, human
gaacatgtcatctcagaacc

SEQ ID NO: 394215 - DNA, 20 bp, human
gcatttggtgatgggatgga

SEQ ID NO: 394216 - DNA, 20 bp, human
gagttcggccgtgtacccgg

SEQ ID NO: 394217 - DNA, 20 bp, human
gtgtacccggaggaaagcaa

SEQ ID NO: 394218 - DNA, 20 bp, human
gggtacacggccgaactgga

SEQ ID NO: 394219 - DNA, 20 bp, human
gggtcggacaccttgggttc

SEQ ID NO: 394220 - DNA, 20 bp, human
ggaaggggcgggcggtcggg

SEQ ID NO: 394221 - DNA, 20 bp, human
gagcaagggtcggacacctt

SEQ ID NO: 394222 - DNA, 20 bp, human
ggctttgcggccttccagtt

SEQ ID NO: 394223 - DNA, 20 bp, human
ggtcacatccgcctccttat

SEQ ID NO: 394224 - DNA, 20 bp, human
gagaggaaggggcgggcggt

SEQ ID NO: 394225 - DNA, 20 bp, human
gaccttggacgccagaggaa

SEQ ID NO: 394226 - DNA, 20 bp, human
gcgtggacacggtgtgctcc

SEQ ID NO: 394227 - DNA, 20 bp, human
gccacagcgatctcactgat

SEQ ID NO: 394228 - DNA, 20 bp, human
gctctggagcggcgcaggga

SEQ ID NO: 394229 - DNA, 20 bp, human
gttctcccgggtccagtgga

SEQ ID NO: 394230 - DNA, 20 bp, human
ggacacggtgtgctcctggc

SEQ ID NO: 394231 - DNA, 20 bp, human
ggcgatctcactgattggtc

SEQ ID NO: 394232 - DNA, 20 bp, human
gctcctggtaaacaaggacc

SEQ ID NO: 394233 - DNA, 20 bp, human
gaatgggagggatgtgcacg

SEQ ID NO: 394234 - DNA, 20 bp, human
gagaagagccacgcgagcgc

SEQ ID NO: 394235 - DNA, 20 bp, human
gcagggcgacaggccatcgg

SEQ ID NO: 394236 - DNA, 20 bp, human
gaagaacagtaagtgatcaa

SEQ ID NO: 394237 - DNA, 20 bp, human
gacagtaagtgatcaaagga

SEQ ID NO: 394238 - DNA, 20 bp, human
gaatgcttgggtggcatgca

SEQ ID NO: 394239 - DNA, 20 bp, human
gctctgggaacatccttcaa

SEQ ID NO: 394240 - DNA, 20 bp, human
gtgtgtgataaggaatgctt

SEQ ID NO: 394241 - DNA, 20 bp, human
gccttcaggtgagaatgaga

SEQ ID NO: 394242 - DNA, 20 bp, human
gtcggctttgagcttcctca

SEQ ID NO: 394243 - DNA, 20 bp, human
gtagctgatatttacccctg

SEQ ID NO: 394244 - DNA, 20 bp, human
gtgtgtagactactgggtga

SEQ ID NO: 394245 - DNA, 20 bp, human
gtatgggtgtgtagactact

SEQ ID NO: 394246 - DNA, 20 bp, human
gaggctactcagtcgagggt

SEQ ID NO: 394247 - DNA, 20 bp, human
gtgggcgctgaaggccaaac

SEQ ID NO: 394248 - DNA, 20 bp, human
ggcgcagaggagacgtgtag

SEQ ID NO: 394249 - DNA, 20 bp, human
gcgcgaggctactcagtcga

SEQ ID NO: 394250 - DNA, 20 bp, human
gggactacgcttcgcgtttt

SEQ ID NO: 394251 - DNA, 20 bp, human
gggaaatgacgtcacgccgg

SEQ ID NO: 394252 - DNA, 20 bp, human
gaggaggatgggaaggcgtg

SEQ ID NO: 394253 - DNA, 20 bp, human
gcgcttcgcgttttgggatt

SEQ ID NO: 394254 - DNA, 20 bp, human
gaaggccaaaccggacgacg

SEQ ID NO: 394255 - DNA, 20 bp, human
gttgagcggcgcaggcgcag

SEQ ID NO: 394256 - DNA, 20 bp, human
gcgccgcgcgaacgtgtagt

SEQ ID NO: 394257 - DNA, 20 bp, human
gccgtcagcacgcacggcgt

SEQ ID NO: 394258 - DNA, 20 bp, human
gtgtagttggccgggtggag

SEQ ID NO: 394259 - DNA, 20 bp, human
gagttggccgggtggagcgg

SEQ ID NO: 394260 - DNA, 20 bp, human
ggggcaccgtggagcgccgt

SEQ ID NO: 394261 - DNA, 20 bp, human
ggctgacggcatgtgcgtat

SEQ ID NO: 394262 - DNA, 20 bp, human
gatagcagctgtcggagtgg

SEQ ID NO: 394263 - DNA, 20 bp, human
gcgcgaacgtgtagttggcc

SEQ ID NO: 394264 - DNA, 20 bp, human
gaggtcgccgccgctccacc

SEQ ID NO: 394265 - DNA, 20 bp, human
gcggaaccaacggcgctcca

SEQ ID NO: 394266 - DNA, 20 bp, human
gacatcccgcctctagtctg

SEQ ID NO: 394267 - DNA, 20 bp, human
gcctgcccccagactagagg

SEQ ID NO: 394268 - DNA, 20 bp, human
gggggcgcgcaaagtattaa

SEQ ID NO: 394269 - DNA, 20 bp, human
ggtagctttgggcggataga

SEQ ID NO: 394270 - DNA, 20 bp, human
gggtcagagccgagcaaggt

SEQ ID NO: 394271 - DNA, 20 bp, human
gtgtggaacggtacgccaac

SEQ ID NO: 394272 - DNA, 20 bp, human
gcctccgcccgtattaaaga

SEQ ID NO: 394273 - DNA, 20 bp, human
gctgatcagagccccagagg

SEQ ID NO: 394274 - DNA, 20 bp, human
ggattggtcacaaggagact

SEQ ID NO: 394275 - DNA, 20 bp, human
ggtacgccaacaggctctca

SEQ ID NO: 394276 - DNA, 20 bp, human
ggcctccgccaggcgtcctt

SEQ ID NO: 394277 - DNA, 20 bp, human
gggtcggagaacgcggtggg

SEQ ID NO: 394278 - DNA, 20 bp, human
gggccgcgggtcggagaacg

SEQ ID NO: 394279 - DNA, 20 bp, human
ggaggccgcgagccccctgc

SEQ ID NO: 394280 - DNA, 20 bp, human
gcgcgggtcggagaacgcgg

SEQ ID NO: 394281 - DNA, 20 bp, human
gggagccgaaggacgcctgg

SEQ ID NO: 394282 - DNA, 20 bp, human
ggccgaaggacgcctggcgg

SEQ ID NO: 394283 - DNA, 20 bp, human
gaggaaagaacggtcgctaa

SEQ ID NO: 394284 - DNA, 20 bp, human
ggaaggataaggattttggg

SEQ ID NO: 394285 - DNA, 20 bp, human
gcgcgcccagccgaaggata

SEQ ID NO: 394286 - DNA, 20 bp, human
gagggtggaacactgggata

SEQ ID NO: 394287 - DNA, 20 bp, human
gaatgcggccggattcgggg

SEQ ID NO: 394288 - DNA, 20 bp, human
gggggccttcagacctaggg

SEQ ID NO: 394289 - DNA, 20 bp, human
ggagagcgctggctagaccg

SEQ ID NO: 394290 - DNA, 20 bp, human
gaaggcccccgccccgaatc

SEQ ID NO: 394291 - DNA, 20 bp, human
gtggggtggggaatctggat

SEQ ID NO: 394292 - DNA, 20 bp, human
ggctagaccggggccgaatg

SEQ ID NO: 394293 - DNA, 20 bp, human
ggcggccggattcggggcgg

SEQ ID NO: 394294 - DNA, 20 bp, human
gggatagggtgtggggaatt

SEQ ID NO: 394295 - DNA, 20 bp, human
gagacctagggtggaacact

SEQ ID NO: 394296 - DNA, 20 bp, human
ggaccacccaatcttggcga

SEQ ID NO: 394297 - DNA, 20 bp, human
gcgaagggcaggtgacacct

SEQ ID NO: 394298 - DNA, 20 bp, human
gggtacccgcccctttgcga

SEQ ID NO: 394299 - DNA, 20 bp, human
ggtcacctgcccttcgcaaa

SEQ ID NO: 394300 - DNA, 20 bp, human
ggcacaacctggagataaag

SEQ ID NO: 394301 - DNA, 20 bp, human
gctgcccttcgcaaaggggc

SEQ ID NO: 394302 - DNA, 20 bp, human
ggccccgcgcatgcgaaatt

SEQ ID NO: 394303 - DNA, 20 bp, human
gtccggagaccacccaatct

SEQ ID NO: 394304 - DNA, 20 bp, human
ggcaggtgacacctaggctg

SEQ ID NO: 394305 - DNA, 20 bp, human
gcgccatcgccaagattggg

SEQ ID NO: 394306 - DNA, 20 bp, human
ggagaatcccagtaggttaa

SEQ ID NO: 394307 - DNA, 20 bp, human
gtaggttaatggtctgaata

SEQ ID NO: 394308 - DNA, 20 bp, human
gactctggatgtgcatttac

SEQ ID NO: 394309 - DNA, 20 bp, human
gtattaaaggatcgggtgat

SEQ ID NO: 394310 - DNA, 20 bp, human
gttcagaccattaacctact

SEQ ID NO: 394311 - DNA, 20 bp, human
gcaacattggaataactcta

SEQ ID NO: 394312 - DNA, 20 bp, human
gtgtttctgtattaaaggat

SEQ ID NO: 394313 - DNA, 20 bp, human
gctgaattaaagtccaacat

SEQ ID NO: 394314 - DNA, 20 bp, human
gactggaaataagaggttgc

SEQ ID NO: 394315 - DNA, 20 bp, human
gaataagaggttgctggccc

SEQ ID NO: 394316 - DNA, 20 bp, human
ggtggacctctgggttaaga

SEQ ID NO: 394317 - DNA, 20 bp, human
gtaagataaagtggacctct

SEQ ID NO: 394318 - DNA, 20 bp, human
gggtttacaactaccgtaaa

SEQ ID NO: 394319 - DNA, 20 bp, human
gaggggaaaagcctgctgga

SEQ ID NO: 394320 - DNA, 20 bp, human
gaaccttggcaaaaattgat

SEQ ID NO: 394321 - DNA, 20 bp, human
gcttactgccttaaacagaa

SEQ ID NO: 394322 - DNA, 20 bp, human
gatccaccctcttaacccag

SEQ ID NO: 394323 - DNA, 20 bp, human
gtataattcctttctgttta

SEQ ID NO: 394324 - DNA, 20 bp, human
gggctgcttcttgcacgact

SEQ ID NO: 394325 - DNA, 20 bp, human
ggacctctgggttaagaggg

SEQ ID NO: 394326 - DNA, 20 bp, human
gggaggaggcgtctcggcgg

SEQ ID NO: 394327 - DNA, 20 bp, human
gccgagacgcctcctcccat

SEQ ID NO: 394328 - DNA, 20 bp, human
ggtgccgactcagccaatcg

SEQ ID NO: 394329 - DNA, 20 bp, human
ggggaggggcttgcgagagg

SEQ ID NO: 394330 - DNA, 20 bp, human
gctgaaacgcacacgcccat

SEQ ID NO: 394331 - DNA, 20 bp, human
ggggcttgcgagaggcggga

SEQ ID NO: 394332 - DNA, 20 bp, human
gactcggtggacggagacgg

SEQ ID NO: 394333 - DNA, 20 bp, human
gaatccaatggtgacgagca

SEQ ID NO: 394334 - DNA, 20 bp, human
ggcgctgtcgcttctgctat

SEQ ID NO: 394335 - DNA, 20 bp, human
gacaagcagtagctacccgc

SEQ ID NO: 394336 - DNA, 20 bp, human
ggggcccggggccgtcggcg

SEQ ID NO: 394337 - DNA, 20 bp, human
ggacccacgccgggcgggac

SEQ ID NO: 394338 - DNA, 20 bp, human
gcccgcccggcgtgggtctc

SEQ ID NO: 394339 - DNA, 20 bp, human
gaccccaccgagggcgggag

SEQ ID NO: 394340 - DNA, 20 bp, human
gcgtcggcgggggtgatccc

SEQ ID NO: 394341 - DNA, 20 bp, human
gggcaccgggggattggccg

SEQ ID NO: 394342 - DNA, 20 bp, human
ggggtctcgacgttcggacg

SEQ ID NO: 394343 - DNA, 20 bp, human
gaacgtcgagaccccaccga

SEQ ID NO: 394344 - DNA, 20 bp, human
gcgtgggtctcgggcgtctg

SEQ ID NO: 394345 - DNA, 20 bp, human
gccccctcccgccctcggtg

SEQ ID NO: 394346 - DNA, 20 bp, human
gaacctggatgcaggtgcgg

SEQ ID NO: 394347 - DNA, 20 bp, human
gcgaccagacggttcccaaa

SEQ ID NO: 394348 - DNA, 20 bp, human
ggaccccgccgagcaggaag

SEQ ID NO: 394349 - DNA, 20 bp, human
gggccacagctgagagtctt

SEQ ID NO: 394350 - DNA, 20 bp, human
gcgcacgctctctagagcgg

SEQ ID NO: 394351 - DNA, 20 bp, human
gcccgccgagcaggaagagg

SEQ ID NO: 394352 - DNA, 20 bp, human
gaacccgggaacctggatgc

SEQ ID NO: 394353 - DNA, 20 bp, human
ggaaggcgcggtcgaccaga

SEQ ID NO: 394354 - DNA, 20 bp, human
gccgttctgtgccacacccg

SEQ ID NO: 394355 - DNA, 20 bp, human
ggggaaggactgcgcccttt

SEQ ID NO: 394356 - DNA, 20 bp, human
ggcaaatgagaggtagtgtc

SEQ ID NO: 394357 - DNA, 20 bp, human
gtaacataggcctatcccac

SEQ ID NO: 394358 - DNA, 20 bp, human
gcgtatcccaccagtgggat

SEQ ID NO: 394359 - DNA, 20 bp, human
gggtgggagtggtattatat

SEQ ID NO: 394360 - DNA, 20 bp, human
gtggctcgtatcccaccagt

SEQ ID NO: 394361 - DNA, 20 bp, human
gataggcctatcccactggt

SEQ ID NO: 394362 - DNA, 20 bp, human
gactgacttttctttcgaat

SEQ ID NO: 394363 - DNA, 20 bp, human
gaactgggtttgcttaggtc

SEQ ID NO: 394364 - DNA, 20 bp, human
gataagaattaaactattaa

SEQ ID NO: 394365 - DNA, 20 bp, human
gtcagtcatgtgcttttcag

SEQ ID NO: 394366 - DNA, 20 bp, human
ggaccccgcgctgctgacgg

SEQ ID NO: 394367 - DNA, 20 bp, human
ggtcagcagcgcggggtccc

SEQ ID NO: 394368 - DNA, 20 bp, human
gaggggctggggccgcccgt

SEQ ID NO: 394369 - DNA, 20 bp, human
gcgctccgagccagtcgccg

SEQ ID NO: 394370 - DNA, 20 bp, human
ggacggcagtggaaggagcg

SEQ ID NO: 394371 - DNA, 20 bp, human
ggagcgcggtggcgcgggag

SEQ ID NO: 394372 - DNA, 20 bp, human
gggaaggagcgcggtggcgc

SEQ ID NO: 394373 - DNA, 20 bp, human
gccagcgccgcaaacccccg

SEQ ID NO: 394374 - DNA, 20 bp, human
ggtcgccgccgtcagcagcg

SEQ ID NO: 394375 - DNA, 20 bp, human
gcccggcccgcgagcgagga

SEQ ID NO: 394376 - DNA, 20 bp, human
gcacccaggggccatgccac

SEQ ID NO: 394377 - DNA, 20 bp, human
gaatcaggcccagacaccca

SEQ ID NO: 394378 - DNA, 20 bp, human
gcccagcaactagacgtgaa

SEQ ID NO: 394379 - DNA, 20 bp, human
gaactagacgtgaagggcaa

SEQ ID NO: 394380 - DNA, 20 bp, human
gtgaaggaggaagtctgagg

SEQ ID NO: 394381 - DNA, 20 bp, human
gcagtgtcatgaccttcctc

SEQ ID NO: 394382 - DNA, 20 bp, human
ggcgtccaggcaagtgaagg

SEQ ID NO: 394383 - DNA, 20 bp, human
ggcatggcccctgggtgtct

SEQ ID NO: 394384 - DNA, 20 bp, human
ggggcctgtggcatggcccc

SEQ ID NO: 394385 - DNA, 20 bp, human
gtcacctccgtccccagtca

SEQ ID NO: 394386 - DNA, 20 bp, human
gtgctgatcaagtccttaaa

SEQ ID NO: 394387 - DNA, 20 bp, human
gccagccccccgcctagttt

SEQ ID NO: 394388 - DNA, 20 bp, human
gaaggccagaagcactaatt

SEQ ID NO: 394389 - DNA, 20 bp, human
gctcacccaaactaggcggg

SEQ ID NO: 394390 - DNA, 20 bp, human
gctgctcacccaaactaggc

SEQ ID NO: 394391 - DNA, 20 bp, human
gcacaaggaaatcagttgga

SEQ ID NO: 394392 - DNA, 20 bp, human
gttaacagttctgacgtgag

SEQ ID NO: 394393 - DNA, 20 bp, human
gttaccttgctagagcaacc

SEQ ID NO: 394394 - DNA, 20 bp, human
gcagaactgttaagtgcatg

SEQ ID NO: 394395 - DNA, 20 bp, human
gtgaatatttctgcccttta

SEQ ID NO: 394396 - DNA, 20 bp, human
gcggttggacaaactaacga

SEQ ID NO: 394397 - DNA, 20 bp, human
gaatcgggtcgggtcaattg

SEQ ID NO: 394398 - DNA, 20 bp, human
gtgacccgacccgattggct

SEQ ID NO: 394399 - DNA, 20 bp, human
gtctccccggggctcatccg

SEQ ID NO: 394400 - DNA, 20 bp, human
gggtacaagcccagccaatc

SEQ ID NO: 394401 - DNA, 20 bp, human
gcttcctcatcgagcccgat

SEQ ID NO: 394402 - DNA, 20 bp, human
gcaagcccagccaatcgggt

SEQ ID NO: 394403 - DNA, 20 bp, human
gcggcgtcacgaggaatcag

SEQ ID NO: 394404 - DNA, 20 bp, human
ggggctcatccgggggaatg

SEQ ID NO: 394405 - DNA, 20 bp, human
gtagccaatcgggctcgatg

SEQ ID NO: 394406 - DNA, 20 bp, human
gctgggaggtgcttatttct

SEQ ID NO: 394407 - DNA, 20 bp, human
ggagttccaggcgatgaagg

SEQ ID NO: 394408 - DNA, 20 bp, human
gcatcgcctggaactctggg

SEQ ID NO: 394409 - DNA, 20 bp, human
gatgccaatcatttctctct

SEQ ID NO: 394410 - DNA, 20 bp, human
gtaatagcgagtccatcctc

SEQ ID NO: 394411 - DNA, 20 bp, human
gtaatgctgaaaccatatga

SEQ ID NO: 394412 - DNA, 20 bp, human
gtttttgggaaacccgagga

SEQ ID NO: 394413 - DNA, 20 bp, human
gtcacagcgcccggccggtt

SEQ ID NO: 394414 - DNA, 20 bp, human
ggcacttgggaagccgaagc

SEQ ID NO: 394415 - DNA, 20 bp, human
gaaaatacccccaaccggcc

SEQ ID NO: 394416 - DNA, 20 bp, human
ggcgtcgtgcagatactagt

SEQ ID NO: 394417 - DNA, 20 bp, human
gtccctgctctgattaaaga

SEQ ID NO: 394418 - DNA, 20 bp, human
gaatcataggtttatttcat

SEQ ID NO: 394419 - DNA, 20 bp, human
gaacaaaagaacgacactcc

SEQ ID NO: 394420 - DNA, 20 bp, human
gttgtactaatattatttga

SEQ ID NO: 394421 - DNA, 20 bp, human
gagcagggatatgcttgcat

SEQ ID NO: 394422 - DNA, 20 bp, human
gcagacagcccccatttttt

SEQ ID NO: 394423 - DNA, 20 bp, human
gaaacagactcctaaaaaat

SEQ ID NO: 394424 - DNA, 20 bp, human
gattaaagaaggatgggtaa

SEQ ID NO: 394425 - DNA, 20 bp, human
gtgggtaagggaatgcatcc

SEQ ID NO: 394426 - DNA, 20 bp, human
gttcgcctaggggtggagag

SEQ ID NO: 394427 - DNA, 20 bp, human
gctgcccccagggagagacg

SEQ ID NO: 394428 - DNA, 20 bp, human
ggggtggagcctgcaaaagt

SEQ ID NO: 394429 - DNA, 20 bp, human
gagagacgaggctaccatga

SEQ ID NO: 394430 - DNA, 20 bp, human
gtgtgcgcctcgctccaccc

SEQ ID NO: 394431 - DNA, 20 bp, human
ggcacatcctgggtggagcg

SEQ ID NO: 394432 - DNA, 20 bp, human
gtgggaattaaaatctgcgt

SEQ ID NO: 394433 - DNA, 20 bp, human
gccctggaggggaatggctt

SEQ ID NO: 394434 - DNA, 20 bp, human
ggccaccgctcgcttcaata

SEQ ID NO: 394435 - DNA, 20 bp, human
gtagtgccttcgcctagggg

SEQ ID NO: 394436 - DNA, 20 bp, human
gcggtgtcggagaaagagac

SEQ ID NO: 394437 - DNA, 20 bp, human
gcgcggggcgggttgccgaa

SEQ ID NO: 394438 - DNA, 20 bp, human
gaactggggtagcaaacgag

SEQ ID NO: 394439 - DNA, 20 bp, human
ggacggggccgactcaccag

SEQ ID NO: 394440 - DNA, 20 bp, human
gtgccgaagggcctcggcct

SEQ ID NO: 394441 - DNA, 20 bp, human
ggtgctggagagcggggacg

SEQ ID NO: 394442 - DNA, 20 bp, human
ggaaggctgcggggagtccc

SEQ ID NO: 394443 - DNA, 20 bp, human
ggaccgagagtgcaggaact

SEQ ID NO: 394444 - DNA, 20 bp, human
gccggcaggcaccggtgtga

SEQ ID NO: 394445 - DNA, 20 bp, human
ggggcagcgaccgagagtgc

SEQ ID NO: 394446 - DNA, 20 bp, human
gcgagaaggcgagagagcta

SEQ ID NO: 394447 - DNA, 20 bp, human
gcgggttcccaggaccgaaa

SEQ ID NO: 394448 - DNA, 20 bp, human
gagcacgtagtgcgcgtggg

SEQ ID NO: 394449 - DNA, 20 bp, human
gggcgggacgcatgcgcgta

SEQ ID NO: 394450 - DNA, 20 bp, human
ggttcccaggaccgaaaagg

SEQ ID NO: 394451 - DNA, 20 bp, human
ggggtagcgctgccacgtcg

SEQ ID NO: 394452 - DNA, 20 bp, human
gtagcgctgccacgtcgggg

SEQ ID NO: 394453 - DNA, 20 bp, human
gagggagcacgtagtgcgcg

SEQ ID NO: 394454 - DNA, 20 bp, human
gtccgggtgacgtctcccga

SEQ ID NO: 394455 - DNA, 20 bp, human
ggctccgccttttcggtcct

SEQ ID NO: 394456 - DNA, 20 bp, human
gccccagggcgcttgcgcgt

SEQ ID NO: 394457 - DNA, 20 bp, human
ggccctccccatagactccc

SEQ ID NO: 394458 - DNA, 20 bp, human
gaccggggagtctatgggga

SEQ ID NO: 394459 - DNA, 20 bp, human
ggactggcaaggatgaacag

SEQ ID NO: 394460 - DNA, 20 bp, human
gtcctaccggggagtctatg

SEQ ID NO: 394461 - DNA, 20 bp, human
gggggcgcgaccaagttccc

SEQ ID NO: 394462 - DNA, 20 bp, human
gtcccagtgctcctaagcaa

SEQ ID NO: 394463 - DNA, 20 bp, human
gcagggcgcttgcgcgtggg

SEQ ID NO: 394464 - DNA, 20 bp, human
gtggagattgtagtcttctt

SEQ ID NO: 394465 - DNA, 20 bp, human
gcttggtaagcgcctggaga

SEQ ID NO: 394466 - DNA, 20 bp, human
ggcgcttcggagccaggctc

SEQ ID NO: 394467 - DNA, 20 bp, human
gttgcccctccccccgagcc

SEQ ID NO: 394468 - DNA, 20 bp, human
ggaagcgcctcggctatctc

SEQ ID NO: 394469 - DNA, 20 bp, human
ggggggaggggcaagctcgc

SEQ ID NO: 394470 - DNA, 20 bp, human
gcttcggagccaggctcggg

SEQ ID NO: 394471 - DNA, 20 bp, human
gcgaactcgcagaggggact

SEQ ID NO: 394472 - DNA, 20 bp, human
gtactggacgaaggcgaagc

SEQ ID NO: 394473 - DNA, 20 bp, human
gccgcccgctccagccgctt

SEQ ID NO: 394474 - DNA, 20 bp, human
gtggacgaaggcgaagcagg

SEQ ID NO: 394475 - DNA, 20 bp, human
ggcctggctccgaagcgcct

SEQ ID NO: 394476 - DNA, 20 bp, human
gaaaactagcggagtgagcg

SEQ ID NO: 394477 - DNA, 20 bp, human
gaccaagcaccgtgactccc

SEQ ID NO: 394478 - DNA, 20 bp, human
gacaccggaagtcacgtgag

SEQ ID NO: 394479 - DNA, 20 bp, human
gtgactcccaggaaaactag

SEQ ID NO: 394480 - DNA, 20 bp, human
gtggtcgcgttattgggtcc

SEQ ID NO: 394481 - DNA, 20 bp, human
gggtgcttggtcgcgttatt

SEQ ID NO: 394482 - DNA, 20 bp, human
gcagccgctcacgtgacttc

SEQ ID NO: 394483 - DNA, 20 bp, human
gctcactccgctagttttcc

SEQ ID NO: 394484 - DNA, 20 bp, human
ggagtcgagcaccgaaagag

SEQ ID NO: 394485 - DNA, 20 bp, human
gggttggcgttgggataaga

SEQ ID NO: 394486 - DNA, 20 bp, human
gtgacccgctgccctggcgg

SEQ ID NO: 394487 - DNA, 20 bp, human
ggggtcaattggctacggga

SEQ ID NO: 394488 - DNA, 20 bp, human
ggcagcgggtcaattggcta

SEQ ID NO: 394489 - DNA, 20 bp, human
gcggaatgcgggaatggggc

SEQ ID NO: 394490 - DNA, 20 bp, human
gaccaatcggaatgcgggaa

SEQ ID NO: 394491 - DNA, 20 bp, human
gccgggcagcagacgtcgac

SEQ ID NO: 394492 - DNA, 20 bp, human
gcccattcccgcattccgat

SEQ ID NO: 394493 - DNA, 20 bp, human
ggggaactttagcccgggaa

SEQ ID NO: 394494 - DNA, 20 bp, human
ggccagggcagcgggtcaat

SEQ ID NO: 394495 - DNA, 20 bp, human
ggtggcaaaccgcgaccaat

SEQ ID NO: 394496 - DNA, 20 bp, human
gccctcctgcgcactaactg

SEQ ID NO: 394497 - DNA, 20 bp, human
gcccctctcgccacgactag

SEQ ID NO: 394498 - DNA, 20 bp, human
gcggcgctgacgtgtctggg

SEQ ID NO: 394499 - DNA, 20 bp, human
ggccgcggccccccggatga

SEQ ID NO: 394500 - DNA, 20 bp, human
gagtggctgccgacgcctga

SEQ ID NO: 394501 - DNA, 20 bp, human
ggtaacccaccgggccgggg

SEQ ID NO: 394502 - DNA, 20 bp, human
ggggagcacagacgacgacg

SEQ ID NO: 394503 - DNA, 20 bp, human
gagggtgaaggatgtcggtt

SEQ ID NO: 394504 - DNA, 20 bp, human
gaatagttctggagcgcagt

SEQ ID NO: 394505 - DNA, 20 bp, human
gaactgagggtgaaggatgt

SEQ ID NO: 394506 - DNA, 20 bp, human
gagaacccggacagagtctg

SEQ ID NO: 394507 - DNA, 20 bp, human
ggggacaggctggagagatg

SEQ ID NO: 394508 - DNA, 20 bp, human
gcgggtccaggggacggaga

SEQ ID NO: 394509 - DNA, 20 bp, human
gagacaccggagcgggtcca

SEQ ID NO: 394510 - DNA, 20 bp, human
gaccggacgcgggggggctg

SEQ ID NO: 394511 - DNA, 20 bp, human
gcggggcccgccccactggg

SEQ ID NO: 394512 - DNA, 20 bp, human
gccagctggcgcgacccaga

SEQ ID NO: 394513 - DNA, 20 bp, human
gcagagtctggggtgcgcag

SEQ ID NO: 394514 - DNA, 20 bp, human
ggcggggcgcggagtggaca

SEQ ID NO: 394515 - DNA, 20 bp, human
gcggtccgagactcgagaca

SEQ ID NO: 394516 - DNA, 20 bp, human
gaatgaatcgcaaccgagta

SEQ ID NO: 394517 - DNA, 20 bp, human
gaaacagaggccacgcctca

SEQ ID NO: 394518 - DNA, 20 bp, human
gcaccacctggtggacattg

SEQ ID NO: 394519 - DNA, 20 bp, human
gtggcagtaacaacgaaaac

SEQ ID NO: 394520 - DNA, 20 bp, human
gacgaaaacaggtaaaacag

SEQ ID NO: 394521 - DNA, 20 bp, human
gtgccacaatgtccaccagg

SEQ ID NO: 394522 - DNA, 20 bp, human
ggaagtggaacagcaccacc

SEQ ID NO: 394523 - DNA, 20 bp, human
gaagcgaagaaaaaccgtta

SEQ ID NO: 394524 - DNA, 20 bp, human
gtactgccacaatgtccacc

SEQ ID NO: 394525 - DNA, 20 bp, human
ggcgcggcccgcttgcatcc

SEQ ID NO: 394526 - DNA, 20 bp, human
ggggccgtaccacaacctgt

SEQ ID NO: 394527 - DNA, 20 bp, human
ggggtcatctgggtctgaaa

SEQ ID NO: 394528 - DNA, 20 bp, human
gacaacctgtagggtcatct

SEQ ID NO: 394529 - DNA, 20 bp, human
gcaaatgcgcgcggcatgct

SEQ ID NO: 394530 - DNA, 20 bp, human
gccttggagagccccgggtc

SEQ ID NO: 394531 - DNA, 20 bp, human
gaaacgggcaccagcgacgc

SEQ ID NO: 394532 - DNA, 20 bp, human
gggtacggcccaaatgcgcg

SEQ ID NO: 394533 - DNA, 20 bp, human
gcagacccagatgaccctac

SEQ ID NO: 394534 - DNA, 20 bp, human
gcaccagcgacgcgggagca

SEQ ID NO: 394535 - DNA, 20 bp, human
gagtgcctggtgcacgtggt

SEQ ID NO: 394536 - DNA, 20 bp, human
gcctccggcagacacaggca

SEQ ID NO: 394537 - DNA, 20 bp, human
gaccggcaggctcttgcaaa

SEQ ID NO: 394538 - DNA, 20 bp, human
gcaggcagggcacatcgcgc

SEQ ID NO: 394539 - DNA, 20 bp, human
gtgctgcagcccgcggggac

SEQ ID NO: 394540 - DNA, 20 bp, human
ggacctccagctgagaccgg

SEQ ID NO: 394541 - DNA, 20 bp, human
gggtgtgggaataacaccgc

SEQ ID NO: 394542 - DNA, 20 bp, human
ggcaggctcttgcaaagggc

SEQ ID NO: 394543 - DNA, 20 bp, human
gggcgggcctatgctggtgt

SEQ ID NO: 394544 - DNA, 20 bp, human
ggggtgtgctgcagcccgcg

SEQ ID NO: 394545 - DNA, 20 bp, human
gtaacaccgccggtctcagc

SEQ ID NO: 394546 - DNA, 20 bp, human
gggaggtgcgaggttgactg

SEQ ID NO: 394547 - DNA, 20 bp, human
gcaacctcgcacctccctgc

SEQ ID NO: 394548 - DNA, 20 bp, human
ggcgaggccagaaacacaac

SEQ ID NO: 394549 - DNA, 20 bp, human
ggccagaaacacaaccggca

SEQ ID NO: 394550 - DNA, 20 bp, human
gtgcgaggttgactgcggct

SEQ ID NO: 394551 - DNA, 20 bp, human
gaaagctctggcatactggg

SEQ ID NO: 394552 - DNA, 20 bp, human
gggagcgggactggcaaagc

SEQ ID NO: 394553 - DNA, 20 bp, human
gagaaacacaaccggcaggg

SEQ ID NO: 394554 - DNA, 20 bp, human
gctccccgccctgccgcgcg

SEQ ID NO: 394555 - DNA, 20 bp, human
gtgcagagcaacattatgca

SEQ ID NO: 394556 - DNA, 20 bp, human
gttagccggcccagcgagga

SEQ ID NO: 394557 - DNA, 20 bp, human
gcctcggcccatgctctaga

SEQ ID NO: 394558 - DNA, 20 bp, human
gccggggtgataagtgtcca

SEQ ID NO: 394559 - DNA, 20 bp, human
gacggcgcgtaggctgtgtg

SEQ ID NO: 394560 - DNA, 20 bp, human
ggtctgcgacgcaccggaag

SEQ ID NO: 394561 - DNA, 20 bp, human
gccccagcatcgaattcgga

SEQ ID NO: 394562 - DNA, 20 bp, human
gtatcaccccggtgctgctg

SEQ ID NO: 394563 - DNA, 20 bp, human
gagggtcccgttcagaaaaa

SEQ ID NO: 394564 - DNA, 20 bp, human
gaatagcagctcatgcctgt

SEQ ID NO: 394565 - DNA, 20 bp, human
gaacgtcccctctagagcat

SEQ ID NO: 394566 - DNA, 20 bp, human
gcggacgcaaacacggggag

SEQ ID NO: 394567 - DNA, 20 bp, human
gagggcccgccaaccgccag

SEQ ID NO: 394568 - DNA, 20 bp, human
gcggggcccacaaccggaag

SEQ ID NO: 394569 - DNA, 20 bp, human
gaaccgccagcggttgtcag

SEQ ID NO: 394570 - DNA, 20 bp, human
gccgcagcgcacgtgggtga

SEQ ID NO: 394571 - DNA, 20 bp, human
gggcgggcggggcccacaac

SEQ ID NO: 394572 - DNA, 20 bp, human
ggcccacaaccggaagcggg

SEQ ID NO: 394573 - DNA, 20 bp, human
gaggcagcggacgcaaacac

SEQ ID NO: 394574 - DNA, 20 bp, human
gaaggtcgcccacccgcttc

SEQ ID NO: 394575 - DNA, 20 bp, human
gaacgaagccgcagcgcacg

SEQ ID NO: 394576 - DNA, 20 bp, human
gccaggcttggaggagtgaa

SEQ ID NO: 394577 - DNA, 20 bp, human
gagcacccgtgcggtcagga

SEQ ID NO: 394578 - DNA, 20 bp, human
gttcctgaagagcacccgtg

SEQ ID NO: 394579 - DNA, 20 bp, human
ggggcaggaccagttggact

SEQ ID NO: 394580 - DNA, 20 bp, human
ggtgtgtgagaagcctagca

SEQ ID NO: 394581 - DNA, 20 bp, human
gtgagaagcctagcagggcc

SEQ ID NO: 394582 - DNA, 20 bp, human
gtgaaaggaagacaggtact

SEQ ID NO: 394583 - DNA, 20 bp, human
gcgtgcggtcaggagggtgg

SEQ ID NO: 394584 - DNA, 20 bp, human
ggtactggggcaggaccagt

SEQ ID NO: 394585 - DNA, 20 bp, human
gtggacttggtgcaggcaaa

SEQ ID NO: 394586 - DNA, 20 bp, human
gcatgcggccacacccaaac

SEQ ID NO: 394587 - DNA, 20 bp, human
gggaaaccaggacgccccta

SEQ ID NO: 394588 - DNA, 20 bp, human
ggcaacagtaacgccccctt

SEQ ID NO: 394589 - DNA, 20 bp, human
gaggacgcccctagggttga

SEQ ID NO: 394590 - DNA, 20 bp, human
ggccttcccgtcaaccctag

SEQ ID NO: 394591 - DNA, 20 bp, human
gtgcaccacagcacgccatg

SEQ ID NO: 394592 - DNA, 20 bp, human
ggggcggagacgtcatcaga

SEQ ID NO: 394593 - DNA, 20 bp, human
gggctactggaaggtaggaa

SEQ ID NO: 394594 - DNA, 20 bp, human
ggcccctagggttgacggga

SEQ ID NO: 394595 - DNA, 20 bp, human
ggcgtcctggtttccggttt

SEQ ID NO: 394596 - DNA, 20 bp, human
gccaggttttagaccctgaa

SEQ ID NO: 394597 - DNA, 20 bp, human
gtctctgagtgtcagacctg

SEQ ID NO: 394598 - DNA, 20 bp, human
gagccccagacaggccattc

SEQ ID NO: 394599 - DNA, 20 bp, human
gtgagtgtcagacctgaggg

SEQ ID NO: 394600 - DNA, 20 bp, human
ggaacctggggccagttctc

SEQ ID NO: 394601 - DNA, 20 bp, human
gagaccctgaatggcctgtc

SEQ ID NO: 394602 - DNA, 20 bp, human
gaaaacctgggatgagttcc

SEQ ID NO: 394603 - DNA, 20 bp, human
gggcgtctggaggcaggatc

SEQ ID NO: 394604 - DNA, 20 bp, human
ggagttccaggactctcaag

SEQ ID NO: 394605 - DNA, 20 bp, human
ggtctggggctggcgtctgg

SEQ ID NO: 394606 - DNA, 20 bp, human
gtgggggccgggaacagcgg

SEQ ID NO: 394607 - DNA, 20 bp, human
gggaggacggtctgggatgc

SEQ ID NO: 394608 - DNA, 20 bp, human
ggcactcacaccaacgtcct

SEQ ID NO: 394609 - DNA, 20 bp, human
ggggtgggaagctgtatggg

SEQ ID NO: 394610 - DNA, 20 bp, human
ggggaagctgtatgggagga

SEQ ID NO: 394611 - DNA, 20 bp, human
gccggcccccagtcccacta

SEQ ID NO: 394612 - DNA, 20 bp, human
gctgtatgggaggacggtct

SEQ ID NO: 394613 - DNA, 20 bp, human
gctacctcctggtgagctgt

SEQ ID NO: 394614 - DNA, 20 bp, human
gaggaactgacggctgagat

SEQ ID NO: 394615 - DNA, 20 bp, human
ggttgggtgggaagctgtat

SEQ ID NO: 394616 - DNA, 20 bp, human
ggggccgccgtcactctccg

SEQ ID NO: 394617 - DNA, 20 bp, human
gtcaccacgtgggacctcat

SEQ ID NO: 394618 - DNA, 20 bp, human
gcgcgctgtggccaccgcaa

SEQ ID NO: 394619 - DNA, 20 bp, human
ggggaaccgcctgcagctcg

SEQ ID NO: 394620 - DNA, 20 bp, human
gccgtgacgcacttcctttg

SEQ ID NO: 394621 - DNA, 20 bp, human
gcccggggcactcaccacgt

SEQ ID NO: 394622 - DNA, 20 bp, human
gcgcccgcgcgctccttcgc

SEQ ID NO: 394623 - DNA, 20 bp, human
ggctgcaggcggttcccacc

SEQ ID NO: 394624 - DNA, 20 bp, human
gcggggcggcggcccagcga

SEQ ID NO: 394625 - DNA, 20 bp, human
gtggcgcatgccgggagatg

SEQ ID NO: 394626 - DNA, 20 bp, human
ggaagtgcgtcggtagggga

SEQ ID NO: 394627 - DNA, 20 bp, human
gcgggtgcgccgttcgtcag

SEQ ID NO: 394628 - DNA, 20 bp, human
gccggcgcatgcgcagtcag

SEQ ID NO: 394629 - DNA, 20 bp, human
gaagggaagtgcgtcggtag

SEQ ID NO: 394630 - DNA, 20 bp, human
gaaggagggcgctgacccag

SEQ ID NO: 394631 - DNA, 20 bp, human
ggccactcgccgctgacgaa

SEQ ID NO: 394632 - DNA, 20 bp, human
gccggggaagggaagtgcgt

SEQ ID NO: 394633 - DNA, 20 bp, human
gccttccccggcaggaagga

SEQ ID NO: 394634 - DNA, 20 bp, human
gggcactgagcacaagtgtg

SEQ ID NO: 394635 - DNA, 20 bp, human
ggcgccgggcgtccagtctc

SEQ ID NO: 394636 - DNA, 20 bp, human
gcgcccgctgtgcggatgtc

SEQ ID NO: 394637 - DNA, 20 bp, human
gccgggcttcgcgtccccta

SEQ ID NO: 394638 - DNA, 20 bp, human
gacgtggacgcgcccggctc

SEQ ID NO: 394639 - DNA, 20 bp, human
gcccggctcgggttacggcc

SEQ ID NO: 394640 - DNA, 20 bp, human
gggcgcaaatgcctgaccac

SEQ ID NO: 394641 - DNA, 20 bp, human
gggcccggacatccgcacag

SEQ ID NO: 394642 - DNA, 20 bp, human
gcccctgctctggcacggat

SEQ ID NO: 394643 - DNA, 20 bp, human
ggcaccgagcgcccgctgtg

SEQ ID NO: 394644 - DNA, 20 bp, human
gcccgccagagcaggggcgt

SEQ ID NO: 394645 - DNA, 20 bp, human
gacgcgcccggctcgggtta

SEQ ID NO: 394646 - DNA, 20 bp, human
gcggggccgcgcactctgat

SEQ ID NO: 394647 - DNA, 20 bp, human
gtgggccggcccaacgttcg

SEQ ID NO: 394648 - DNA, 20 bp, human
gccagcgcccggctcccgta

SEQ ID NO: 394649 - DNA, 20 bp, human
gtgagggccccacaggccgc

SEQ ID NO: 394650 - DNA, 20 bp, human
gtcgaatcctgcggcctgtg

SEQ ID NO: 394651 - DNA, 20 bp, human
gccgtgaccaaccacgaggc

SEQ ID NO: 394652 - DNA, 20 bp, human
ggcgaaaagagaaacagtga

SEQ ID NO: 394653 - DNA, 20 bp, human
gacgttcgattcgaatcctg

SEQ ID NO: 394654 - DNA, 20 bp, human
gggcggagctcggcgccgtg

SEQ ID NO: 394655 - DNA, 20 bp, human
gttcgcccggccgcgcccat

SEQ ID NO: 394656 - DNA, 20 bp, human
gtcggctcctcccattggtc

SEQ ID NO: 394657 - DNA, 20 bp, human
gacacgcccggaccaatggg

SEQ ID NO: 394658 - DNA, 20 bp, human
ggagctcccgacagccccta

SEQ ID NO: 394659 - DNA, 20 bp, human
ggcgccgcgctccacacgcc

SEQ ID NO: 394660 - DNA, 20 bp, human
gaggagctactccggcaaca

SEQ ID NO: 394661 - DNA, 20 bp, human
gtaaaccctgctgacctaag

SEQ ID NO: 394662 - DNA, 20 bp, human
gcaacatggagcattgcaat

SEQ ID NO: 394663 - DNA, 20 bp, human
gagattagttatgtcaccgt

SEQ ID NO: 394664 - DNA, 20 bp, human
gttctagcgaggagctactc

SEQ ID NO: 394665 - DNA, 20 bp, human
gccggagcgggcagagttgg

SEQ ID NO: 394666 - DNA, 20 bp, human
gtaagggtatttagcccaag

SEQ ID NO: 394667 - DNA, 20 bp, human
gtgaatctgggtcttatcag

SEQ ID NO: 394668 - DNA, 20 bp, human
gatcataaactcagccactt

SEQ ID NO: 394669 - DNA, 20 bp, human
gataatgtgtacttccagtc

SEQ ID NO: 394670 - DNA, 20 bp, human
gcccagattcattcattgat

SEQ ID NO: 394671 - DNA, 20 bp, human
gccccatcaatgaatgaatc

SEQ ID NO: 394672 - DNA, 20 bp, human
gatagagtgattaagttggt

SEQ ID NO: 394673 - DNA, 20 bp, human
gagtgctcaacagctgaatg

SEQ ID NO: 394674 - DNA, 20 bp, human
gatgtggatcacgtttcaat

SEQ ID NO: 394675 - DNA, 20 bp, human
gtcattcttcaattattaac

SEQ ID NO: 394676 - DNA, 20 bp, human
gagagcgagcccaggaacgt

SEQ ID NO: 394677 - DNA, 20 bp, human
ggcttcagagtcagcctagg

SEQ ID NO: 394678 - DNA, 20 bp, human
ggacctcgcgtcacgggcga

SEQ ID NO: 394679 - DNA, 20 bp, human
gcaggcttgccctgagtggt

SEQ ID NO: 394680 - DNA, 20 bp, human
ggggaggtgtagtcctggcg

SEQ ID NO: 394681 - DNA, 20 bp, human
ggtccccacctccacgcggt

SEQ ID NO: 394682 - DNA, 20 bp, human
ggatgccgcccgccatgtgg

SEQ ID NO: 394683 - DNA, 20 bp, human
gagaccttagagccgaggga

SEQ ID NO: 394684 - DNA, 20 bp, human
ggcgcacgagcgacgtgttg

SEQ ID NO: 394685 - DNA, 20 bp, human
gaccacgctccgccacatgg

SEQ ID NO: 394686 - DNA, 20 bp, human
ggactcgcggagccggaaag

SEQ ID NO: 394687 - DNA, 20 bp, human
gagggccgccgtgaaggagg

SEQ ID NO: 394688 - DNA, 20 bp, human
gtcagcgcgtgacgctaaaa

SEQ ID NO: 394689 - DNA, 20 bp, human
gtccccctgacacgtgactc

SEQ ID NO: 394690 - DNA, 20 bp, human
gagcgagcgcgagagggaaa

SEQ ID NO: 394691 - DNA, 20 bp, human
ggcgtcacgtggtggaggca

SEQ ID NO: 394692 - DNA, 20 bp, human
gcaggaaggcaagtgggcgg

SEQ ID NO: 394693 - DNA, 20 bp, human
ggccggaaagaggtgtctcg

SEQ ID NO: 394694 - DNA, 20 bp, human
gtctgagcgctcgacgctcc

SEQ ID NO: 394695 - DNA, 20 bp, human
gcggccatccgtgcgtcacg

SEQ ID NO: 394696 - DNA, 20 bp, human
gagggacttggctagtattc

SEQ ID NO: 394697 - DNA, 20 bp, human
gtcccgtgcaggggctcggt

SEQ ID NO: 394698 - DNA, 20 bp, human
gtcccgtggtggaaacagtt

SEQ ID NO: 394699 - DNA, 20 bp, human
gcacgggatcagcctctgta

SEQ ID NO: 394700 - DNA, 20 bp, human
gagaggctgatcccgtgcag

SEQ ID NO: 394701 - DNA, 20 bp, human
gcgagacaatagatagagtg

SEQ ID NO: 394702 - DNA, 20 bp, human
gagaatgcgtgagagcatgg

SEQ ID NO: 394703 - DNA, 20 bp, human
gtttccaccacgggagtttg

SEQ ID NO: 394704 - DNA, 20 bp, human
ggcaagaatgcgtgagagca

SEQ ID NO: 394705 - DNA, 20 bp, human
gaaagatcaaaaagagcttg

SEQ ID NO: 394706 - DNA, 20 bp, human
gactacagctcttgcccgca

SEQ ID NO: 394707 - DNA, 20 bp, human
gtagtcgcgctacttggaga

SEQ ID NO: 394708 - DNA, 20 bp, human
gagcacacaagcagcccata

SEQ ID NO: 394709 - DNA, 20 bp, human
gaaagcggccgcgctgtccg

SEQ ID NO: 394710 - DNA, 20 bp, human
gacaagcagcccataaggtt

SEQ ID NO: 394711 - DNA, 20 bp, human
gcggaggatcccaaccttat

SEQ ID NO: 394712 - DNA, 20 bp, human
gtgtccgaggctgctccgtg

SEQ ID NO: 394713 - DNA, 20 bp, human
gtgcccgcacggagcagcct

SEQ ID NO: 394714 - DNA, 20 bp, human
gagcgcggccgctttaagag

SEQ ID NO: 394715 - DNA, 20 bp, human
gtgggcgggtatgccagcca

SEQ ID NO: 394716 - DNA, 20 bp, human
gcaaccgcccctaaatgctc

SEQ ID NO: 394717 - DNA, 20 bp, human
gcggagacggcgtctacgtg

SEQ ID NO: 394718 - DNA, 20 bp, human
gcccgcagccgtaacgacct

SEQ ID NO: 394719 - DNA, 20 bp, human
gccgccagcccggagcattt

SEQ ID NO: 394720 - DNA, 20 bp, human
gagcccggagcatttagggg

SEQ ID NO: 394721 - DNA, 20 bp, human
gaaagcctaaactgcctctc

SEQ ID NO: 394722 - DNA, 20 bp, human
gccgcgcccaacctcccgag

SEQ ID NO: 394723 - DNA, 20 bp, human
gaccaaccacgtccacccac

SEQ ID NO: 394724 - DNA, 20 bp, human
gtaggggcggttggctttgt

SEQ ID NO: 394725 - DNA, 20 bp, human
gaaggaagagaagcgcatag

SEQ ID NO: 394726 - DNA, 20 bp, human
ggagccgcggctaaggaacg

SEQ ID NO: 394727 - DNA, 20 bp, human
gcgggacttgggtgactcta

SEQ ID NO: 394728 - DNA, 20 bp, human
gaggccgctgcaccgggagc

SEQ ID NO: 394729 - DNA, 20 bp, human
gctgcggagggatctccgtg

SEQ ID NO: 394730 - DNA, 20 bp, human
gggcccgcgttccttagccg

SEQ ID NO: 394731 - DNA, 20 bp, human
ggcagcgctcgccgtgagga

SEQ ID NO: 394732 - DNA, 20 bp, human
gccacccgctcccggtgcag

SEQ ID NO: 394733 - DNA, 20 bp, human
gcgctgccacgtcagacgaa

SEQ ID NO: 394734 - DNA, 20 bp, human
gcggtcgcggggggctcccg

SEQ ID NO: 394735 - DNA, 20 bp, human
gtgctgatactggggttcta

SEQ ID NO: 394736 - DNA, 20 bp, human
ggggctgtgggtatagatcc

SEQ ID NO: 394737 - DNA, 20 bp, human
gcaaacctcattccaaacat

SEQ ID NO: 394738 - DNA, 20 bp, human
gagatctgcagcttaggttt

SEQ ID NO: 394739 - DNA, 20 bp, human
gccatcccatgtttggaatg

SEQ ID NO: 394740 - DNA, 20 bp, human
gtagctgtgtctgtgtctat

SEQ ID NO: 394741 - DNA, 20 bp, human
ggaggaaaaggcatgctcag

SEQ ID NO: 394742 - DNA, 20 bp, human
ggtggagatggcagagagat

SEQ ID NO: 394743 - DNA, 20 bp, human
gggacacataacccaggatg

SEQ ID NO: 394744 - DNA, 20 bp, human
gatgctcagtggcgtggaga

SEQ ID NO: 394745 - DNA, 20 bp, human
ggggatttccaactcaactc

SEQ ID NO: 394746 - DNA, 20 bp, human
gaggccgtaccaagacgggg

SEQ ID NO: 394747 - DNA, 20 bp, human
gccgcgagcgcagaggcgta

SEQ ID NO: 394748 - DNA, 20 bp, human
gcggacaggccgtaccaaga

SEQ ID NO: 394749 - DNA, 20 bp, human
gggaacgtcgagcgccggac

SEQ ID NO: 394750 - DNA, 20 bp, human
gcgtaccaagacggggcggg

SEQ ID NO: 394751 - DNA, 20 bp, human
gaaagccccacgggaggccc

SEQ ID NO: 394752 - DNA, 20 bp, human
gggaggagctcgtggtggaa

SEQ ID NO: 394753 - DNA, 20 bp, human
gcgagctcctccagcgcccg

SEQ ID NO: 394754 - DNA, 20 bp, human
gggggtggaacgtcgagcgc

SEQ ID NO: 394755 - DNA, 20 bp, human
ggtagggtacgccggagccc

SEQ ID NO: 394756 - DNA, 20 bp, human
gggaaccgcgccccgctgaa

SEQ ID NO: 394757 - DNA, 20 bp, human
ggcggggcgcggttccccct

SEQ ID NO: 394758 - DNA, 20 bp, human
gccgctgaagggctcgggga

SEQ ID NO: 394759 - DNA, 20 bp, human
gtcccccagcactcacactg

SEQ ID NO: 394760 - DNA, 20 bp, human
gcctaaactagtgacgggga

SEQ ID NO: 394761 - DNA, 20 bp, human
gcggagggatccggaggcgg

SEQ ID NO: 394762 - DNA, 20 bp, human
gacactgtggtagcggcgga

SEQ ID NO: 394763 - DNA, 20 bp, human
gcggagggagacgtcattgc

SEQ ID NO: 394764 - DNA, 20 bp, human
gctcggcggggtggagaaag

SEQ ID NO: 394765 - DNA, 20 bp, human
gactcacactgtggtagcgg

SEQ ID NO: 394766 - DNA, 20 bp, human
gtgggatgaacccctccttc

SEQ ID NO: 394767 - DNA, 20 bp, human
gcccgcttctgacaaccgat

SEQ ID NO: 394768 - DNA, 20 bp, human
gcccactggcgcaccgctat

SEQ ID NO: 394769 - DNA, 20 bp, human
ggggggcgtcgaccaatcaa

SEQ ID NO: 394770 - DNA, 20 bp, human
gctggcgcaccgctattggg

SEQ ID NO: 394771 - DNA, 20 bp, human
gcactgctagacctacccac

SEQ ID NO: 394772 - DNA, 20 bp, human
ggcgctccggagcgtctcat

SEQ ID NO: 394773 - DNA, 20 bp, human
gcccgagggaaattggatca

SEQ ID NO: 394774 - DNA, 20 bp, human
gttgaattgtaaccctctgg

SEQ ID NO: 394775 - DNA, 20 bp, human
gaggaggggttcatcccacg

SEQ ID NO: 394776 - DNA, 20 bp, human
ggggcctgcagccgaggaca

SEQ ID NO: 394777 - DNA, 20 bp, human
gccgccccgcctggcacact

SEQ ID NO: 394778 - DNA, 20 bp, human
ggctctaaatgagactgtag

SEQ ID NO: 394779 - DNA, 20 bp, human
ggtagttccagccctgtcct

SEQ ID NO: 394780 - DNA, 20 bp, human
ggttacctggcagcgtccgg

SEQ ID NO: 394781 - DNA, 20 bp, human
gaaccaaggaggtaagtagg

SEQ ID NO: 394782 - DNA, 20 bp, human
gctgcagccgaggacagggc

SEQ ID NO: 394783 - DNA, 20 bp, human
gcacttcccagtgtgccagg

SEQ ID NO: 394784 - DNA, 20 bp, human
ggctctcaccttaagctgcc

SEQ ID NO: 394785 - DNA, 20 bp, human
gtaagttacctggcagcgtc

SEQ ID NO: 394786 - DNA, 20 bp, human
gacgccctccggggccgtgg

SEQ ID NO: 394787 - DNA, 20 bp, human
gtcgccgccacggccccgga

SEQ ID NO: 394788 - DNA, 20 bp, human
gcggtgcgtagcttactcac

SEQ ID NO: 394789 - DNA, 20 bp, human
gcgtagcttactcacagggg

SEQ ID NO: 394790 - DNA, 20 bp, human
gtcgcagcgtcacgccctcc

SEQ ID NO: 394791 - DNA, 20 bp, human
gacggggtgggcccgaccga

SEQ ID NO: 394792 - DNA, 20 bp, human
gcgcggggattggcgggcca

SEQ ID NO: 394793 - DNA, 20 bp, human
gcgtgacgctgcgaagccct

SEQ ID NO: 394794 - DNA, 20 bp, human
ggggccgtcggagcacgggg

SEQ ID NO: 394795 - DNA, 20 bp, human
ggggtggggccgtcggagca

SEQ ID NO: 394796 - DNA, 20 bp, human
gggcttgcttcccacgtccg

SEQ ID NO: 394797 - DNA, 20 bp, human
ggttccgagaagaaggaaaa

SEQ ID NO: 394798 - DNA, 20 bp, human
gggaggaggatcatgagctg

SEQ ID NO: 394799 - DNA, 20 bp, human
gagaagcatcgagaaccgga

SEQ ID NO: 394800 - DNA, 20 bp, human
gatcggagattggaccagga

SEQ ID NO: 394801 - DNA, 20 bp, human
gcgagcacaagaccgatgtg

SEQ ID NO: 394802 - DNA, 20 bp, human
ggcgttggcggactgatccg

SEQ ID NO: 394803 - DNA, 20 bp, human
gttggcggactgatccgcgg

SEQ ID NO: 394804 - DNA, 20 bp, human
ggcaccggctcgaactgggg

SEQ ID NO: 394805 - DNA, 20 bp, human
gaccggaaggagaccatggg

SEQ ID NO: 394806 - DNA, 20 bp, human
gagaggccagcgaagaggag

SEQ ID NO: 394807 - DNA, 20 bp, human
gccggggccttgctgactag

SEQ ID NO: 394808 - DNA, 20 bp, human
gcgagcgtgtggcaccttga

SEQ ID NO: 394809 - DNA, 20 bp, human
gacgcccaggatgtaggaac

SEQ ID NO: 394810 - DNA, 20 bp, human
ggcgaagaggaggggctcgt

SEQ ID NO: 394811 - DNA, 20 bp, human
gcgggtggccagcgtaaccc

SEQ ID NO: 394812 - DNA, 20 bp, human
gtacgctggccacccgcacc

SEQ ID NO: 394813 - DNA, 20 bp, human
gcgtgccgagcgtcctggcg

SEQ ID NO: 394814 - DNA, 20 bp, human
gccagccataaggcgtacga

SEQ ID NO: 394815 - DNA, 20 bp, human
gacagcctgggaagacgccc

SEQ ID NO: 394816 - DNA, 20 bp, human
gccccaggaggtgttgcagg

SEQ ID NO: 394817 - DNA, 20 bp, human
gtccccctgcaacacctcct

SEQ ID NO: 394818 - DNA, 20 bp, human
gaggggaagccgatggagat

SEQ ID NO: 394819 - DNA, 20 bp, human
ggggtgcgcgaggaagaccc

SEQ ID NO: 394820 - DNA, 20 bp, human
gtgggggacagggtttcctg

SEQ ID NO: 394821 - DNA, 20 bp, human
gggaagccgatggagatggg

SEQ ID NO: 394822 - DNA, 20 bp, human
gtcctccggacgcccgggaa

SEQ ID NO: 394823 - DNA, 20 bp, human
ggggtgggtgggaccgggcc

SEQ ID NO: 394824 - DNA, 20 bp, human
ggcaactattaaacaggcaa

SEQ ID NO: 394825 - DNA, 20 bp, human
gggaactagatggaataggg

SEQ ID NO: 394826 - DNA, 20 bp, human
gtgccccgccggtcgggaga

SEQ ID NO: 394827 - DNA, 20 bp, human
ggcgccgcatggccgacgtg

SEQ ID NO: 394828 - DNA, 20 bp, human
ggaggcgagcgtgaagtcaa

SEQ ID NO: 394829 - DNA, 20 bp, human
ggcgggctgccccgccggtc

SEQ ID NO: 394830 - DNA, 20 bp, human
gcaccccctctcccgaccgg

SEQ ID NO: 394831 - DNA, 20 bp, human
gcgctctcgcggtctctccc

SEQ ID NO: 394832 - DNA, 20 bp, human
gtgggtcccgcgcgcagact

SEQ ID NO: 394833 - DNA, 20 bp, human
ggagagcgcgagccccacgt

SEQ ID NO: 394834 - DNA, 20 bp, human
gtgagcgaggggcgtcccac

SEQ ID NO: 394835 - DNA, 20 bp, human
gggaaggaacgacaaggacg

SEQ ID NO: 394836 - DNA, 20 bp, human
gcccccgccttctctggcac

SEQ ID NO: 394837 - DNA, 20 bp, human
ggcacagcggccccgcgata

SEQ ID NO: 394838 - DNA, 20 bp, human
gcggcctgggcccgcctccg

SEQ ID NO: 394839 - DNA, 20 bp, human
gtgggctacccgcgtcccca

SEQ ID NO: 394840 - DNA, 20 bp, human
ggaggtgtggagagcgcgca

SEQ ID NO: 394841 - DNA, 20 bp, human
gggaacagctcgcgcccgcc

SEQ ID NO: 394842 - DNA, 20 bp, human
ggcggccaggacaaagagcg

SEQ ID NO: 394843 - DNA, 20 bp, human
gcaggccggaagccaccccg

SEQ ID NO: 394844 - DNA, 20 bp, human
gggcgcgggcaccgtatcgc

SEQ ID NO: 394845 - DNA, 20 bp, human
gcggggcgaggctgcccatt

SEQ ID NO: 394846 - DNA, 20 bp, human
ggattggcgagtagcgttag

SEQ ID NO: 394847 - DNA, 20 bp, human
gcgcccagcccagtcccgat

SEQ ID NO: 394848 - DNA, 20 bp, human
gccaatgagcgaggtccgag

SEQ ID NO: 394849 - DNA, 20 bp, human
gggcgtgcgccgatcgggac

SEQ ID NO: 394850 - DNA, 20 bp, human
gggacctcgctcattggcag

SEQ ID NO: 394851 - DNA, 20 bp, human
gaggggcggggattccgagt

SEQ ID NO: 394852 - DNA, 20 bp, human
gggcgagtagcgttaggggc

SEQ ID NO: 394853 - DNA, 20 bp, human
gctggagcccgagcgccgga

SEQ ID NO: 394854 - DNA, 20 bp, human
gccgccgccgggagccggtg

SEQ ID NO: 394855 - DNA, 20 bp, human
ggggcgcagcacacggtttg

SEQ ID NO: 394856 - DNA, 20 bp, human
ggacaactgcgctcaagggg

SEQ ID NO: 394857 - DNA, 20 bp, human
gaaggcaccggtggggccga

SEQ ID NO: 394858 - DNA, 20 bp, human
gggcgggacgcttcccaagt

SEQ ID NO: 394859 - DNA, 20 bp, human
gtccgcggggcgtctaccag

SEQ ID NO: 394860 - DNA, 20 bp, human
ggcgggggaaggcaccggtg

SEQ ID NO: 394861 - DNA, 20 bp, human
ggcggggcgtctaccagcgg

SEQ ID NO: 394862 - DNA, 20 bp, human
gcgacgggcgggttgaagga

SEQ ID NO: 394863 - DNA, 20 bp, human
gcaccggtggggccgacggg

SEQ ID NO: 394864 - DNA, 20 bp, human
gactcacgcccggaagggga

SEQ ID NO: 394865 - DNA, 20 bp, human
ggaggggtcgggctagcggg

SEQ ID NO: 394866 - DNA, 20 bp, human
ggggcccaggaactcttccg

SEQ ID NO: 394867 - DNA, 20 bp, human
gcaaccccgcagagcgacta

SEQ ID NO: 394868 - DNA, 20 bp, human
gaccgcggctacgattctct

SEQ ID NO: 394869 - DNA, 20 bp, human
gggagctcaacccgcgaccg

SEQ ID NO: 394870 - DNA, 20 bp, human
gccgcagagcgactaaggcg

SEQ ID NO: 394871 - DNA, 20 bp, human
gtcgctctgcggggttggtt

SEQ ID NO: 394872 - DNA, 20 bp, human
ggggtggggaggatggtcgc

SEQ ID NO: 394873 - DNA, 20 bp, human
ggaatcgtagccgcggtcgc

SEQ ID NO: 394874 - DNA, 20 bp, human
gcggggacgagataagaggt

SEQ ID NO: 394875 - DNA, 20 bp, human
gggcgcgtgcgcgatcgccg

SEQ ID NO: 394876 - DNA, 20 bp, human
gccctccgatgacgtcacag

SEQ ID NO: 394877 - DNA, 20 bp, human
gtctggtcgctgagaggggt

SEQ ID NO: 394878 - DNA, 20 bp, human
gcgggtctggtcgctgagag

SEQ ID NO: 394879 - DNA, 20 bp, human
ggtcacctctgtgacgtcat

SEQ ID NO: 394880 - DNA, 20 bp, human
gcgcggcgtgggctttcccg

SEQ ID NO: 394881 - DNA, 20 bp, human
ggggaacaccgggcactgtc

SEQ ID NO: 394882 - DNA, 20 bp, human
gttgagggatgaagtaggtg

SEQ ID NO: 394883 - DNA, 20 bp, human
gacctctgtgacgtcatcgg

SEQ ID NO: 394884 - DNA, 20 bp, human
gggctttcccggggagttct

SEQ ID NO: 394885 - DNA, 20 bp, human
ggaagtaggtggggaagttg

SEQ ID NO: 394886 - DNA, 20 bp, human
gtggacgcgggcagcccgaa

SEQ ID NO: 394887 - DNA, 20 bp, human
gccgaactggccaattgcaa

SEQ ID NO: 394888 - DNA, 20 bp, human
gaccgacgggaggagaagtg

SEQ ID NO: 394889 - DNA, 20 bp, human
ggcaattggccagttcgggg

SEQ ID NO: 394890 - DNA, 20 bp, human
ggagccgcgtccccgatgtg

SEQ ID NO: 394891 - DNA, 20 bp, human
gttaagggcgtaggtgtcca

SEQ ID NO: 394892 - DNA, 20 bp, human
gcggcggggcgcgggcaacg

SEQ ID NO: 394893 - DNA, 20 bp, human
gacggggtcagctcattggg

SEQ ID NO: 394894 - DNA, 20 bp, human
gctccctcacatcggggacg

SEQ ID NO: 394895 - DNA, 20 bp, human
gagggagggaatgacggagt

SEQ ID NO: 394896 - DNA, 20 bp, human
gggcctgcgactacccgagg

SEQ ID NO: 394897 - DNA, 20 bp, human
ggccgcccgcccggcgaagc

SEQ ID NO: 394898 - DNA, 20 bp, human
gcgcccggcgaagccggctt

SEQ ID NO: 394899 - DNA, 20 bp, human
ggccccctccgagctctcga

SEQ ID NO: 394900 - DNA, 20 bp, human
gggccggggcggcgctgaac

SEQ ID NO: 394901 - DNA, 20 bp, human
gcacaaatcccggacgaggg

SEQ ID NO: 394902 - DNA, 20 bp, human
gagggcgggtgacgcaagcc

SEQ ID NO: 394903 - DNA, 20 bp, human
ggcgggtgacgcaagccggg

SEQ ID NO: 394904 - DNA, 20 bp, human
ggggccctcgagagctcgga

SEQ ID NO: 394905 - DNA, 20 bp, human
gctgggcctgcgactacccg

SEQ ID NO: 394906 - DNA, 20 bp, human
ggacggcgacagagagtcgt

SEQ ID NO: 394907 - DNA, 20 bp, human
gcggctccgggcaccgttag

SEQ ID NO: 394908 - DNA, 20 bp, human
ggggctctcgcgcccactaa

SEQ ID NO: 394909 - DNA, 20 bp, human
gtcgccgtcgaccccggggt

SEQ ID NO: 394910 - DNA, 20 bp, human
gccgcgagcggccatcttgg

SEQ ID NO: 394911 - DNA, 20 bp, human
gcctcccctaagggccgggt

SEQ ID NO: 394912 - DNA, 20 bp, human
ggccctgggccgtggcacat

SEQ ID NO: 394913 - DNA, 20 bp, human
gtctctgtcgccgtcgaccc

SEQ ID NO: 394914 - DNA, 20 bp, human
gcccgggcatggagcgtccc

SEQ ID NO: 394915 - DNA, 20 bp, human
ggcgctgcggcgggttcggt

SEQ ID NO: 394916 - DNA, 20 bp, human
gcgttcagcctccgggttcc

SEQ ID NO: 394917 - DNA, 20 bp, human
ggcggcgtcggaaacccgtt

SEQ ID NO: 394918 - DNA, 20 bp, human
gtccgccctgccggcgtctg

SEQ ID NO: 394919 - DNA, 20 bp, human
gccctcgcggccccagacgc

SEQ ID NO: 394920 - DNA, 20 bp, human
gcgagctcgcgtctcggctg

SEQ ID NO: 394921 - DNA, 20 bp, human
ggccccagacgccggcaggg

SEQ ID NO: 394922 - DNA, 20 bp, human
gcaccaaaatggcgccgggt

SEQ ID NO: 394923 - DNA, 20 bp, human
gggagcggaggcgccgggaa

SEQ ID NO: 394924 - DNA, 20 bp, human
gctcgtggctcgggcgtatg

SEQ ID NO: 394925 - DNA, 20 bp, human
gtccgggtctagctgagtca

SEQ ID NO: 394926 - DNA, 20 bp, human
gccggccgcgatgcattctg

SEQ ID NO: 394927 - DNA, 20 bp, human
gggaaccgacgaggccgtgt

SEQ ID NO: 394928 - DNA, 20 bp, human
gcaagtgaaccgcacagact

SEQ ID NO: 394929 - DNA, 20 bp, human
gcccgctccaggaagtgcgg

SEQ ID NO: 394930 - DNA, 20 bp, human
gaggccgcggtccgatctga

SEQ ID NO: 394931 - DNA, 20 bp, human
gacgcgccccccagcacagt

SEQ ID NO: 394932 - DNA, 20 bp, human
ggggcgtggggcggcgtcct

SEQ ID NO: 394933 - DNA, 20 bp, human
ggactgggcctcagcgttta

SEQ ID NO: 394934 - DNA, 20 bp, human
ggaaggtaaaagccattctc

SEQ ID NO: 394935 - DNA, 20 bp, human
gcaggctcaaggtgctaacg

SEQ ID NO: 394936 - DNA, 20 bp, human
ggaggccaggaggccgtcga

SEQ ID NO: 394937 - DNA, 20 bp, human
gggtgcacggcgcaccccgc

SEQ ID NO: 394938 - DNA, 20 bp, human
gggggtgcgccgtgcaccgg

SEQ ID NO: 394939 - DNA, 20 bp, human
gagcgctcgccgccggtgca

SEQ ID NO: 394940 - DNA, 20 bp, human
gccggggagcggtgctcgga

SEQ ID NO: 394941 - DNA, 20 bp, human
gcctccagccgtcgctgcgt

SEQ ID NO: 394942 - DNA, 20 bp, human
gcacaaagaccgtgagtccc

SEQ ID NO: 394943 - DNA, 20 bp, human
gggtctttgtgcggagacgg

SEQ ID NO: 394944 - DNA, 20 bp, human
gccgctccggcgaggccagg

SEQ ID NO: 394945 - DNA, 20 bp, human
ggggtccgagccttccgcgc

SEQ ID NO: 394946 - DNA, 20 bp, human
gccggccccgcgaaagtcgc

SEQ ID NO: 394947 - DNA, 20 bp, human
gtcgccggaagtgacctgca

SEQ ID NO: 394948 - DNA, 20 bp, human
gcatggagatgacgcttcgg

SEQ ID NO: 394949 - DNA, 20 bp, human
ggcccgagtccagccgaagg

SEQ ID NO: 394950 - DNA, 20 bp, human
ggagcaacgcgggtttgcgg

SEQ ID NO: 394951 - DNA, 20 bp, human
gcgtctgccccactcaaaga

SEQ ID NO: 394952 - DNA, 20 bp, human
gaatgcccgagtccagccga

SEQ ID NO: 394953 - DNA, 20 bp, human
ggggttcggcctccttcggc

SEQ ID NO: 394954 - DNA, 20 bp, human
gctgcgcaggcgcacaacgc

SEQ ID NO: 394955 - DNA, 20 bp, human
gtagtcgccatctttgagtg

SEQ ID NO: 394956 - DNA, 20 bp, human
gaatgaatgggatacgtcgt

SEQ ID NO: 394957 - DNA, 20 bp, human
gccggtggacgacgtaacag

SEQ ID NO: 394958 - DNA, 20 bp, human
ggcagtgaacgactgaggtg

SEQ ID NO: 394959 - DNA, 20 bp, human
gcctgcccgcgacggtggta

SEQ ID NO: 394960 - DNA, 20 bp, human
gtggccgagcctgcccgcga

SEQ ID NO: 394961 - DNA, 20 bp, human
ggacttgggacaggccgcga

SEQ ID NO: 394962 - DNA, 20 bp, human
gggaaatgtagtccctgctc

SEQ ID NO: 394963 - DNA, 20 bp, human
ggtagtccctgctcgggcgc

SEQ ID NO: 394964 - DNA, 20 bp, human
gggcgggcttccctccgacc

SEQ ID NO: 394965 - DNA, 20 bp, human
gccaccgtcgcgggcaggct

SEQ ID NO: 394966 - DNA, 20 bp, human
gtcccctagcgacgaggcgg

SEQ ID NO: 394967 - DNA, 20 bp, human
gggatggaatccactaagaa

SEQ ID NO: 394968 - DNA, 20 bp, human
gcatcccggctccctgacga

SEQ ID NO: 394969 - DNA, 20 bp, human
gacgctgaagatgccgcggg

SEQ ID NO: 394970 - DNA, 20 bp, human
ggggacgctgaagatgccgc

SEQ ID NO: 394971 - DNA, 20 bp, human
gagaaggggcgagaccagtg

SEQ ID NO: 394972 - DNA, 20 bp, human
ggggacacgtcagcgcgcta

SEQ ID NO: 394973 - DNA, 20 bp, human
gctgcgtggcgccgtcgtca

SEQ ID NO: 394974 - DNA, 20 bp, human
ggccaccgcctcgtcgctag

SEQ ID NO: 394975 - DNA, 20 bp, human
gtcagcgtcccctagcgacg

SEQ ID NO: 394976 - DNA, 20 bp, human
gagagcagggaagtcacgtg

SEQ ID NO: 394977 - DNA, 20 bp, human
ggcaccgagtcacgtgagag

SEQ ID NO: 394978 - DNA, 20 bp, human
gggccccgggtcacatgtgg

SEQ ID NO: 394979 - DNA, 20 bp, human
gagacggagagatcacgtgg

SEQ ID NO: 394980 - DNA, 20 bp, human
gaacaggggggcgggaaaga

SEQ ID NO: 394981 - DNA, 20 bp, human
gggtggcaggcgagaacagg

SEQ ID NO: 394982 - DNA, 20 bp, human
ggagaggggagcgcaggcga

SEQ ID NO: 394983 - DNA, 20 bp, human
gaccctccacatgtgacccg

SEQ ID NO: 394984 - DNA, 20 bp, human
gtcacgtgagaggggagcgc

SEQ ID NO: 394985 - DNA, 20 bp, human
gggcggggccgcctaggagg

SEQ ID NO: 394986 - DNA, 20 bp, human
gcagggcgcgccagggtgag

SEQ ID NO: 394987 - DNA, 20 bp, human
ggcggccccgcggcttaaaa

SEQ ID NO: 394988 - DNA, 20 bp, human
ggaacaagggagctgggtca

SEQ ID NO: 394989 - DNA, 20 bp, human
ggcacccgctaacctcactg

SEQ ID NO: 394990 - DNA, 20 bp, human
ggatccgccacgcacgtgtc

SEQ ID NO: 394991 - DNA, 20 bp, human
ggccagggtgagggggacgg

SEQ ID NO: 394992 - DNA, 20 bp, human
gggtcgggaacaagggagct

SEQ ID NO: 394993 - DNA, 20 bp, human
gcgggccccagaagtcgggg

SEQ ID NO: 394994 - DNA, 20 bp, human
ggcgcccgggccccagaagt

SEQ ID NO: 394995 - DNA, 20 bp, human
gagtccgcgggtgcgaagaa

SEQ ID NO: 394996 - DNA, 20 bp, human
gccagcccgggacccggcaa

SEQ ID NO: 394997 - DNA, 20 bp, human
gcgggacccggcaagggaaa

SEQ ID NO: 394998 - DNA, 20 bp, human
ggccccgcgcgacaaggcgc

SEQ ID NO: 394999 - DNA, 20 bp, human
gggaaagggcaagcgcgcgg

SEQ ID NO: 395000 - DNA, 20 bp, human
ggcgcccgctgccctctcgc

SEQ ID NO: 395001 - DNA, 20 bp, human
gccgcgcgacaaggcgccgg

SEQ ID NO: 395002 - DNA, 20 bp, human
gggcgcgggcgacgccagcc

SEQ ID NO: 395003 - DNA, 20 bp, human
ggagctggccccgcgcgaca

SEQ ID NO: 395004 - DNA, 20 bp, human
ggccgggggcccccgcgaga

SEQ ID NO: 395005 - DNA, 20 bp, human
gagggcagcgggcgccaggg

SEQ ID NO: 395006 - DNA, 20 bp, human
gcgcgcgggagaccgagagg

SEQ ID NO: 395007 - DNA, 20 bp, human
gcgagaggaggcgtggaaac

SEQ ID NO: 395008 - DNA, 20 bp, human
ggaccgcgcgggagaccgag

SEQ ID NO: 395009 - DNA, 20 bp, human
ggaggagagccaggcacggt

SEQ ID NO: 395010 - DNA, 20 bp, human
gcctggatccacagtgggga

SEQ ID NO: 395011 - DNA, 20 bp, human
ggaggcccctggatccacag

SEQ ID NO: 395012 - DNA, 20 bp, human
gaagcagcggggaccaaggg

SEQ ID NO: 395013 - DNA, 20 bp, human
ggaggaggcgtggaaacggg

SEQ ID NO: 395014 - DNA, 20 bp, human
gacaaagcgccgcgaccgcg

SEQ ID NO: 395015 - DNA, 20 bp, human
gccgcacaaccgtcactctg

SEQ ID NO: 395016 - DNA, 20 bp, human
gcgggcgcgccctgacgctg

SEQ ID NO: 395017 - DNA, 20 bp, human
gcgcgctgacgtcacggttg

SEQ ID NO: 395018 - DNA, 20 bp, human
gaacgtgcgcgctgacgtca

SEQ ID NO: 395019 - DNA, 20 bp, human
ggaaggcgctcgggccaata

SEQ ID NO: 395020 - DNA, 20 bp, human
gactgatagagaccggtcag

SEQ ID NO: 395021 - DNA, 20 bp, human
ggggttctcaaagaacggag

SEQ ID NO: 395022 - DNA, 20 bp, human
gaaactatggtcagaagcga

SEQ ID NO: 395023 - DNA, 20 bp, human
gtggtcagaagcgagggaag

SEQ ID NO: 395024 - DNA, 20 bp, human
ggcgactaacggtcttcctg

SEQ ID NO: 395025 - DNA, 20 bp, human
ggggtagcgggccggccaat

SEQ ID NO: 395026 - DNA, 20 bp, human
ggggttcagccgcagggtgt

SEQ ID NO: 395027 - DNA, 20 bp, human
ggactgccggatgacgtctc

SEQ ID NO: 395028 - DNA, 20 bp, human
gtcatccggcagtccaaatt

SEQ ID NO: 395029 - DNA, 20 bp, human
gagccaccgctcctctctat

SEQ ID NO: 395030 - DNA, 20 bp, human
gtgaaccctgagacgtcatc

SEQ ID NO: 395031 - DNA, 20 bp, human
gggtggctgcgcttctttcc

SEQ ID NO: 395032 - DNA, 20 bp, human
gtggcccacagtaatccacc

SEQ ID NO: 395033 - DNA, 20 bp, human
ggcgtgagcgttcagagcac

SEQ ID NO: 395034 - DNA, 20 bp, human
gtcaaatgagagcgcgcgct

SEQ ID NO: 395035 - DNA, 20 bp, human
gggctgcgcttctttcccgg

SEQ ID NO: 395036 - DNA, 20 bp, human
gtcaaaggggaaactgttgt

SEQ ID NO: 395037 - DNA, 20 bp, human
gccttctcaggccacgaaca

SEQ ID NO: 395038 - DNA, 20 bp, human
gtggggccgccgagagacgg

SEQ ID NO: 395039 - DNA, 20 bp, human
ggaaaggccaatgagattcg

SEQ ID NO: 395040 - DNA, 20 bp, human
gggcaacaccacgccttctc

SEQ ID NO: 395041 - DNA, 20 bp, human
gaaactgtgcgggaagagat

SEQ ID NO: 395042 - DNA, 20 bp, human
gcctgccccctgtcgctgat

SEQ ID NO: 395043 - DNA, 20 bp, human
ggtaagtgactggtaggtac

SEQ ID NO: 395044 - DNA, 20 bp, human
gctcacccaatcagcgacag

SEQ ID NO: 395045 - DNA, 20 bp, human
gcaaaactagtgtagaggat

SEQ ID NO: 395046 - DNA, 20 bp, human
gcggagacctgcacgacccg

SEQ ID NO: 395047 - DNA, 20 bp, human
gtctccggggcgggcgtcag

SEQ ID NO: 395048 - DNA, 20 bp, human
gagggccgggggacgggtaa

SEQ ID NO: 395049 - DNA, 20 bp, human
gcgcgcctgcgcatcagggc

SEQ ID NO: 395050 - DNA, 20 bp, human
ggagaagggcaggggtgact

SEQ ID NO: 395051 - DNA, 20 bp, human
ggtcgtgcaggtctccgggg

SEQ ID NO: 395052 - DNA, 20 bp, human
gcacacatcgggtgcgaggg

SEQ ID NO: 395053 - DNA, 20 bp, human
ggcacgacccgtggcctgga

SEQ ID NO: 395054 - DNA, 20 bp, human
gcctgcaagtccccacacat

SEQ ID NO: 395055 - DNA, 20 bp, human
ggaaatatctgcgtgctcga

SEQ ID NO: 395056 - DNA, 20 bp, human
gcacgtgcgcgctgtccctc

SEQ ID NO: 395057 - DNA, 20 bp, human
gacgtgggccgaggggtcgc

SEQ ID NO: 395058 - DNA, 20 bp, human
gtcccggaagtgacgcgcga

SEQ ID NO: 395059 - DNA, 20 bp, human
gttgagagcgggattcacaa

SEQ ID NO: 395060 - DNA, 20 bp, human
gctaaagaataagttcatga

SEQ ID NO: 395061 - DNA, 20 bp, human
gcagcgcgcacgtgggccga

SEQ ID NO: 395062 - DNA, 20 bp, human
gcgccctgcacgcgtcacag

SEQ ID NO: 395063 - DNA, 20 bp, human
ggggattcacaagggaattg

SEQ ID NO: 395064 - DNA, 20 bp, human
gagcggactccgcccccggc

SEQ ID NO: 395065 - DNA, 20 bp, human
ggtccgctgtgacgcgtgca

SEQ ID NO: 395066 - DNA, 20 bp, human
ggacgggaggaggggctacg

SEQ ID NO: 395067 - DNA, 20 bp, human
gggctggcgcgcagggcgga

SEQ ID NO: 395068 - DNA, 20 bp, human
gcgggggcggggtctgcgat

SEQ ID NO: 395069 - DNA, 20 bp, human
gggggcgagggcgcggtaaa

SEQ ID NO: 395070 - DNA, 20 bp, human
gatggagcgaggggattggc

SEQ ID NO: 395071 - DNA, 20 bp, human
gtgaaccgcacaactgtggt

SEQ ID NO: 395072 - DNA, 20 bp, human
gtgctcgcgtcacgccgcgg

SEQ ID NO: 395073 - DNA, 20 bp, human
ggggctcaacatcccgggcg

SEQ ID NO: 395074 - DNA, 20 bp, human
gggcggggtctgcgatggga

SEQ ID NO: 395075 - DNA, 20 bp, human
gcggcgaggccagagacgca

SEQ ID NO: 395076 - DNA, 20 bp, human
ggggaactagcaggccgtga

SEQ ID NO: 395077 - DNA, 20 bp, human
gagcaggccgtgatggttct

SEQ ID NO: 395078 - DNA, 20 bp, human
gcgtcctggaggaccgtagg

SEQ ID NO: 395079 - DNA, 20 bp, human
gtccacagcccagacggtgc

SEQ ID NO: 395080 - DNA, 20 bp, human
gcacgagcccagaaccatca

SEQ ID NO: 395081 - DNA, 20 bp, human
gctaaccatgcagacgtctg

SEQ ID NO: 395082 - DNA, 20 bp, human
gcgtccacctacggtcctcc

SEQ ID NO: 395083 - DNA, 20 bp, human
gacggtcctccaggacggga

SEQ ID NO: 395084 - DNA, 20 bp, human
ggggcggagccagcaccgtc

SEQ ID NO: 395085 - DNA, 20 bp, human
gccccgccccaaccagcgag

SEQ ID NO: 395086 - DNA, 20 bp, human
gaggcggggccggcgaagga

SEQ ID NO: 395087 - DNA, 20 bp, human
ggagcctggtgggactccga

SEQ ID NO: 395088 - DNA, 20 bp, human
ggcgacggcaagcgggaggg

SEQ ID NO: 395089 - DNA, 20 bp, human
ggcggcgacggcaagcggga

SEQ ID NO: 395090 - DNA, 20 bp, human
gcgcacgggccattgggaag

SEQ ID NO: 395091 - DNA, 20 bp, human
gggcccctcggagtcccacc

SEQ ID NO: 395092 - DNA, 20 bp, human
ggggcggggccaagacgcgc

SEQ ID NO: 395093 - DNA, 20 bp, human
gccaatggcccgtgcgccgg

SEQ ID NO: 395094 - DNA, 20 bp, human
ggatggcgaccgagcctggt

SEQ ID NO: 395095 - DNA, 20 bp, human
ggccgggacgcggggacgtg

SEQ ID NO: 395096 - DNA, 20 bp, human
gcctctgcggggcggaagtg

SEQ ID NO: 395097 - DNA, 20 bp, human
ggggcggtgcccatggacta

SEQ ID NO: 395098 - DNA, 20 bp, human
gcccctaggcgcacaacgga

SEQ ID NO: 395099 - DNA, 20 bp, human
gacagcggaagttatcgctc

SEQ ID NO: 395100 - DNA, 20 bp, human
gaacccggactgagagaggc

SEQ ID NO: 395101 - DNA, 20 bp, human
gcagaggggaggcaaggtgt

SEQ ID NO: 395102 - DNA, 20 bp, human
ggcagctgaaatagcggagg

SEQ ID NO: 395103 - DNA, 20 bp, human
gctccccagccgagaaaagc

SEQ ID NO: 395104 - DNA, 20 bp, human
ggaaaagctggaacccactc

SEQ ID NO: 395105 - DNA, 20 bp, human
gctggcccctaggcgcacaa

SEQ ID NO: 395106 - DNA, 20 bp, human
gtggaactgccgcctcggga

SEQ ID NO: 395107 - DNA, 20 bp, human
ggccgtgccgtcaatggcgg

SEQ ID NO: 395108 - DNA, 20 bp, human
gagcgccgtgccgtcaatgg

SEQ ID NO: 395109 - DNA, 20 bp, human
ggcggggccgcgcacgctag

SEQ ID NO: 395110 - DNA, 20 bp, human
gtgcgcgcctccgccattga

SEQ ID NO: 395111 - DNA, 20 bp, human
gagggccgcgcacgcactga

SEQ ID NO: 395112 - DNA, 20 bp, human
ggcacctggaactgccgcct

SEQ ID NO: 395113 - DNA, 20 bp, human
gaggggcggcaatactggag

SEQ ID NO: 395114 - DNA, 20 bp, human
gcagcggcccgagctgtggc

SEQ ID NO: 395115 - DNA, 20 bp, human
ggcacgctagcggaaccgcc

SEQ ID NO: 395116 - DNA, 20 bp, human
ggggtcacgcgccttctcgg

SEQ ID NO: 395117 - DNA, 20 bp, human
gggagagtgcaccaccgaga

SEQ ID NO: 395118 - DNA, 20 bp, human
gtggcccagagtgctgagaa

SEQ ID NO: 395119 - DNA, 20 bp, human
gggcccgggtcaacaggacc

SEQ ID NO: 395120 - DNA, 20 bp, human
gcggtggtgcactctccggc

SEQ ID NO: 395121 - DNA, 20 bp, human
ggcgcctgtgccagatcgca

SEQ ID NO: 395122 - DNA, 20 bp, human
gcagccctgcgatctggcac

SEQ ID NO: 395123 - DNA, 20 bp, human
ggacccagggttcacacctt

SEQ ID NO: 395124 - DNA, 20 bp, human
ggagaaaggtgggcggcgag

SEQ ID NO: 395125 - DNA, 20 bp, human
ggcactctccggccggcagg

SEQ ID NO: 395126 - DNA, 20 bp, human
gtgcgctagcttgttagggg

SEQ ID NO: 395127 - DNA, 20 bp, human
gcatctccgcgccggaagca

SEQ ID NO: 395128 - DNA, 20 bp, human
gccaaagcgcactgccaggt

SEQ ID NO: 395129 - DNA, 20 bp, human
ggcatgcgctagcttgttag

SEQ ID NO: 395130 - DNA, 20 bp, human
gggtgtgcaggctcaccggg

SEQ ID NO: 395131 - DNA, 20 bp, human
ggctgtgctgagtcggaagt

SEQ ID NO: 395132 - DNA, 20 bp, human
gtggaagttcatctccgcgc

SEQ ID NO: 395133 - DNA, 20 bp, human
gaagctagcgcatgcgctgt

SEQ ID NO: 395134 - DNA, 20 bp, human
gaagtggcaagaagtggcct

SEQ ID NO: 395135 - DNA, 20 bp, human
gtggccttggcatcggattg

SEQ ID NO: 395136 - DNA, 20 bp, human
gcggctgcgcgggacggggt

SEQ ID NO: 395137 - DNA, 20 bp, human
gacggggtgggacggaggcg

SEQ ID NO: 395138 - DNA, 20 bp, human
gagccccagcgcggtcgccg

SEQ ID NO: 395139 - DNA, 20 bp, human
ggacgcaggcgagaggaact

SEQ ID NO: 395140 - DNA, 20 bp, human
gcggcgggcctgagccaggt

SEQ ID NO: 395141 - DNA, 20 bp, human
gacgactcccagactcgcgt

SEQ ID NO: 395142 - DNA, 20 bp, human
ggccgcgccggacgtgggga

SEQ ID NO: 395143 - DNA, 20 bp, human
gagccccgcctccctgacgg

SEQ ID NO: 395144 - DNA, 20 bp, human
gtgccacggcgaccgcgctg

SEQ ID NO: 395145 - DNA, 20 bp, human
ggcaggcgagaggaactcgg

SEQ ID NO: 395146 - DNA, 20 bp, human
gcgtggcaggggccggacct

SEQ ID NO: 395147 - DNA, 20 bp, human
gcccggccggaaacaggtgg

SEQ ID NO: 395148 - DNA, 20 bp, human
gttaaggggcaaggctgcgc

SEQ ID NO: 395149 - DNA, 20 bp, human
ggaaagcgaaagcgtggcag

SEQ ID NO: 395150 - DNA, 20 bp, human
gaaacaggtggaggtttcta

SEQ ID NO: 395151 - DNA, 20 bp, human
gaatcccacgcccccctgga

SEQ ID NO: 395152 - DNA, 20 bp, human
gtcacagcccggccggaaac

SEQ ID NO: 395153 - DNA, 20 bp, human
ggccgggctgtgagagatta

SEQ ID NO: 395154 - DNA, 20 bp, human
gtgcggccgcagccgtccag

SEQ ID NO: 395155 - DNA, 20 bp, human
gcggccgcactcgccaccag

SEQ ID NO: 395156 - DNA, 20 bp, human
gcggcgcgggctggaccgga

SEQ ID NO: 395157 - DNA, 20 bp, human
gaggggcggggccagaccgg

SEQ ID NO: 395158 - DNA, 20 bp, human
gggccggggcgggaatggac

SEQ ID NO: 395159 - DNA, 20 bp, human
gcccgcccggaaacaggtgc

SEQ ID NO: 395160 - DNA, 20 bp, human
gtggaggcccgcccggaaac

SEQ ID NO: 395161 - DNA, 20 bp, human
gggcagggccgagtcagagg

SEQ ID NO: 395162 - DNA, 20 bp, human
ggccgccggcacctgtttcc

SEQ ID NO: 395163 - DNA, 20 bp, human
gcccaggtgacgggtagtag

SEQ ID NO: 395164 - DNA, 20 bp, human
gcagccgtgggctctaacgc

SEQ ID NO: 395165 - DNA, 20 bp, human
gcagaggccggcgcacaaga

SEQ ID NO: 395166 - DNA, 20 bp, human
ggctgcctgagtgcgactaa

SEQ ID NO: 395167 - DNA, 20 bp, human
gagtgcgactaagggaaacg

SEQ ID NO: 395168 - DNA, 20 bp, human
ggacaccaagtgcgtcacca

SEQ ID NO: 395169 - DNA, 20 bp, human
ggtgacgcacttggtgtccg

SEQ ID NO: 395170 - DNA, 20 bp, human
gacgggaagtgtagtctacg

SEQ ID NO: 395171 - DNA, 20 bp, human
ggaggacccggcctcttccg

SEQ ID NO: 395172 - DNA, 20 bp, human
gcacttcccgtgatgctcga

SEQ ID NO: 395173 - DNA, 20 bp, human
ggtagtctacgagggtgggg

SEQ ID NO: 395174 - DNA, 20 bp, human
ggccgacttcggctggtccc

SEQ ID NO: 395175 - DNA, 20 bp, human
gctcgagggaatggtctccg

SEQ ID NO: 395176 - DNA, 20 bp, human
ggccgccggaagcagcgaga

SEQ ID NO: 395177 - DNA, 20 bp, human
gtgctaggcgggaccccggg

SEQ ID NO: 395178 - DNA, 20 bp, human
gccggggcgcaattgggccg

SEQ ID NO: 395179 - DNA, 20 bp, human
gctcccagatgacgccaacc

SEQ ID NO: 395180 - DNA, 20 bp, human
gactcctcccggggcgcaat

SEQ ID NO: 395181 - DNA, 20 bp, human
ggggtgggccaggcagtccg

SEQ ID NO: 395182 - DNA, 20 bp, human
gcccctctcgctgcttccgg

SEQ ID NO: 395183 - DNA, 20 bp, human
gcgcgtgctaggcgggaccc

SEQ ID NO: 395184 - DNA, 20 bp, human
gcctcccaaagcaacgacgc

SEQ ID NO: 395185 - DNA, 20 bp, human
gcccggggggactcctcccg

SEQ ID NO: 395186 - DNA, 20 bp, human
gggacagcaaaggggtattt

SEQ ID NO: 395187 - DNA, 20 bp, human
ggagaccagggacccagctt

SEQ ID NO: 395188 - DNA, 20 bp, human
gagaggagaaaaagagcact

SEQ ID NO: 395189 - DNA, 20 bp, human
ggcactaggaaagaaaatgt

SEQ ID NO: 395190 - DNA, 20 bp, human
gagtgagactagggaaaggg

SEQ ID NO: 395191 - DNA, 20 bp, human
gtcgtggaggaaggatgctc

SEQ ID NO: 395192 - DNA, 20 bp, human
gacaaagggctagtagtccc

SEQ ID NO: 395193 - DNA, 20 bp, human
gggaaagaaaatgtgggact

SEQ ID NO: 395194 - DNA, 20 bp, human
gggggggctcatttccagag

SEQ ID NO: 395195 - DNA, 20 bp, human
gtgctctttttctcctctcg

SEQ ID NO: 395196 - DNA, 20 bp, human
gggcgtggagcgagagtcag

SEQ ID NO: 395197 - DNA, 20 bp, human
gagagtcagaggtcaggcgc

SEQ ID NO: 395198 - DNA, 20 bp, human
gagggggtgtggtcaacact

SEQ ID NO: 395199 - DNA, 20 bp, human
gaggcgcgccgggtagagag

SEQ ID NO: 395200 - DNA, 20 bp, human
ggaccccctgggttcattca

SEQ ID NO: 395201 - DNA, 20 bp, human
gtacccggcgcgcctaccac

SEQ ID NO: 395202 - DNA, 20 bp, human
ggggacaccgaaaccgtacc

SEQ ID NO: 395203 - DNA, 20 bp, human
ggcgacacctgtcaagcctt

SEQ ID NO: 395204 - DNA, 20 bp, human
gtagagaggggggcctcggc

SEQ ID NO: 395205 - DNA, 20 bp, human
gcactgggacaagttcttcc

SEQ ID NO: 395206 - DNA, 20 bp, human
gtggagggaagggtcggagt

SEQ ID NO: 395207 - DNA, 20 bp, human
ggcgctagttgcaaagcttc

SEQ ID NO: 395208 - DNA, 20 bp, human
gccacgccttcccccagaac

SEQ ID NO: 395209 - DNA, 20 bp, human
ggcaaagcttccggttctgg

SEQ ID NO: 395210 - DNA, 20 bp, human
gctgaagaatgactggaaat

SEQ ID NO: 395211 - DNA, 20 bp, human
ggggaaccggcccttctgga

SEQ ID NO: 395212 - DNA, 20 bp, human
gagactggctgtttataagg

SEQ ID NO: 395213 - DNA, 20 bp, human
ggggaagggtcggagtggga

SEQ ID NO: 395214 - DNA, 20 bp, human
gggggagcgcgggaatcacc

SEQ ID NO: 395215 - DNA, 20 bp, human
gtcggagtgggaggggatcc

SEQ ID NO: 395216 - DNA, 20 bp, human
gtctctctcagactggcacc

SEQ ID NO: 395217 - DNA, 20 bp, human
gtactccaaagtctattctt

SEQ ID NO: 395218 - DNA, 20 bp, human
gaggcatagggcgtaccatc

SEQ ID NO: 395219 - DNA, 20 bp, human
gtggcacctggcggtgaagc

SEQ ID NO: 395220 - DNA, 20 bp, human
ggagagagcgcgaaagagag

SEQ ID NO: 395221 - DNA, 20 bp, human
ggaaaaaggggcatacagaa

SEQ ID NO: 395222 - DNA, 20 bp, human
gcaatgtgacactgttgaag

SEQ ID NO: 395223 - DNA, 20 bp, human
ggacactgttgaagaggcat

SEQ ID NO: 395224 - DNA, 20 bp, human
gattcaaccctttggtgggt

SEQ ID NO: 395225 - DNA, 20 bp, human
gtctagttctggcctcctga

SEQ ID NO: 395226 - DNA, 20 bp, human
gagagcggccacccagggat

SEQ ID NO: 395227 - DNA, 20 bp, human
gcgtgcgctcgttctgggct

SEQ ID NO: 395228 - DNA, 20 bp, human
ggaaaggcctggcttcttcg

SEQ ID NO: 395229 - DNA, 20 bp, human
gcggaagtgaagggcgggac

SEQ ID NO: 395230 - DNA, 20 bp, human
gagcacccgaagagattcaa

SEQ ID NO: 395231 - DNA, 20 bp, human
gctgcgcgtgcgctcgttct

SEQ ID NO: 395232 - DNA, 20 bp, human
gtgaagggcgggaccggaac

SEQ ID NO: 395233 - DNA, 20 bp, human
gtgggagcggatgggtgctg

SEQ ID NO: 395234 - DNA, 20 bp, human
gctgaaaaaccggaagtggg

SEQ ID NO: 395235 - DNA, 20 bp, human
gttctgggctgggagcggat

SEQ ID NO: 395236 - DNA, 20 bp, human
gtggtcgggcccactccaat

SEQ ID NO: 395237 - DNA, 20 bp, human
gccggcccccgtcacgtggt

SEQ ID NO: 395238 - DNA, 20 bp, human
gccggcgccgcccattggag

SEQ ID NO: 395239 - DNA, 20 bp, human
gcgcggtgacgtcagagtag

SEQ ID NO: 395240 - DNA, 20 bp, human
gcgcgcccgccggggatcat

SEQ ID NO: 395241 - DNA, 20 bp, human
gtcgccccggcgccgcccat

SEQ ID NO: 395242 - DNA, 20 bp, human
ggggatcattggtcgaccga

SEQ ID NO: 395243 - DNA, 20 bp, human
gcgggaacagcaagtcgccc

SEQ ID NO: 395244 - DNA, 20 bp, human
gacagccggcccccgtcacg

SEQ ID NO: 395245 - DNA, 20 bp, human
gcccgtgcgtcggcggtggt

SEQ ID NO: 395246 - DNA, 20 bp, human
gtggagtccagacaggtcgg

SEQ ID NO: 395247 - DNA, 20 bp, human
ggtcggcggaagtgacgaca

SEQ ID NO: 395248 - DNA, 20 bp, human
gcctcaaagggagggttctg

SEQ ID NO: 395249 - DNA, 20 bp, human
gtctccgtttccacggaaac

SEQ ID NO: 395250 - DNA, 20 bp, human
gcggaagtgacgacatggct

SEQ ID NO: 395251 - DNA, 20 bp, human
gccggggctagcatcgggat

SEQ ID NO: 395252 - DNA, 20 bp, human
gtgcacccttcctcaaaggg

SEQ ID NO: 395253 - DNA, 20 bp, human
gagactgttgggaggaaaag

SEQ ID NO: 395254 - DNA, 20 bp, human
ggtctggagtccagacaggt

SEQ ID NO: 395255 - DNA, 20 bp, human
gtgcgcatgcgcccgctcag

SEQ ID NO: 395256 - DNA, 20 bp, human
gcagagggaaaacaccttcc

SEQ ID NO: 395257 - DNA, 20 bp, human
ggggaaaacaccttcctgga

SEQ ID NO: 395258 - DNA, 20 bp, human
ggctgcgcgagtgacggatg

SEQ ID NO: 395259 - DNA, 20 bp, human
ggggcagttggccggaagtg

SEQ ID NO: 395260 - DNA, 20 bp, human
gacgttgttgaggaggcagg

SEQ ID NO: 395261 - DNA, 20 bp, human
ggcgcagcaggcggaagtag

SEQ ID NO: 395262 - DNA, 20 bp, human
gcagagcgatccatccagga

SEQ ID NO: 395263 - DNA, 20 bp, human
gaggacgttgttgaggaggc

SEQ ID NO: 395264 - DNA, 20 bp, human
gctccagtggaaaatgtcct

SEQ ID NO: 395265 - DNA, 20 bp, human
ggaagtagcgggcagttggc

SEQ ID NO: 395266 - DNA, 20 bp, human
gggaagaggcggtgccaaaa

SEQ ID NO: 395267 - DNA, 20 bp, human
gcggctgggaacagccgcgt

SEQ ID NO: 395268 - DNA, 20 bp, human
gaactgagcaatacctgcaa

SEQ ID NO: 395269 - DNA, 20 bp, human
gcctaagcgcggggctgtac

SEQ ID NO: 395270 - DNA, 20 bp, human
gcactctctggacagttcct

SEQ ID NO: 395271 - DNA, 20 bp, human
ggggaacagccgcgtgggcg

SEQ ID NO: 395272 - DNA, 20 bp, human
ggggagtggccctaagcgcg

SEQ ID NO: 395273 - DNA, 20 bp, human
gagcgcggggctgtacgggg

SEQ ID NO: 395274 - DNA, 20 bp, human
gacggggagggccgaggcgt

SEQ ID NO: 395275 - DNA, 20 bp, human
gcggaaactggcagcccttt

SEQ ID NO: 395276 - DNA, 20 bp, human
gggcgtcgccgagtcatccc

SEQ ID NO: 395277 - DNA, 20 bp, human
gtcgccgagtcatccccggc

SEQ ID NO: 395278 - DNA, 20 bp, human
ggtaaggtggggagactacc

SEQ ID NO: 395279 - DNA, 20 bp, human
gcgccggcgaagggacgtgg

SEQ ID NO: 395280 - DNA, 20 bp, human
ggcgccagccggggatgact

SEQ ID NO: 395281 - DNA, 20 bp, human
ggggaaaggaaaaggcacgc

SEQ ID NO: 395282 - DNA, 20 bp, human
gttagcgaaattactagaaa

SEQ ID NO: 395283 - DNA, 20 bp, human
ggctgccgagcgcctgaccc

SEQ ID NO: 395284 - DNA, 20 bp, human
ggcactttgggcaatggagc

SEQ ID NO: 395285 - DNA, 20 bp, human
gggcgcagggccaccgtagc

SEQ ID NO: 395286 - DNA, 20 bp, human
gcggtcggatcacaaggcgg

SEQ ID NO: 395287 - DNA, 20 bp, human
gaggcctagattgatagatt

SEQ ID NO: 395288 - DNA, 20 bp, human
gtggcgccgcgtcagcagag

SEQ ID NO: 395289 - DNA, 20 bp, human
gcggggatcagcaggcggag

SEQ ID NO: 395290 - DNA, 20 bp, human
gcgagcgcggaactggggga

SEQ ID NO: 395291 - DNA, 20 bp, human
gaacacctccagtaggggaa

SEQ ID NO: 395292 - DNA, 20 bp, human
gggaaggggcggggatcagc

SEQ ID NO: 395293 - DNA, 20 bp, human
gcccgccccctctgctgacg

SEQ ID NO: 395294 - DNA, 20 bp, human
ggagcggctgccagagttgc

SEQ ID NO: 395295 - DNA, 20 bp, human
gtgcgcgcggtcggatcaca

SEQ ID NO: 395296 - DNA, 20 bp, human
ggggagagcaagagttccca

SEQ ID NO: 395297 - DNA, 20 bp, human
gtggaggctcagactgggat

SEQ ID NO: 395298 - DNA, 20 bp, human
gctaaggagctcgggatccc

SEQ ID NO: 395299 - DNA, 20 bp, human
gctccacaggaaggcacttg

SEQ ID NO: 395300 - DNA, 20 bp, human
ggataccaggaagaagaccc

SEQ ID NO: 395301 - DNA, 20 bp, human
gtcagctacttcctggtcca

SEQ ID NO: 395302 - DNA, 20 bp, human
gtggtccagggtcttcttcc

SEQ ID NO: 395303 - DNA, 20 bp, human
gagctgaatgtgggtctgaa

SEQ ID NO: 395304 - DNA, 20 bp, human
gagtagaagtggtaaaagat

SEQ ID NO: 395305 - DNA, 20 bp, human
gcacctcaagtgccttcctg

SEQ ID NO: 395306 - DNA, 20 bp, human
gcagggccaagccccaggtc

SEQ ID NO: 395307 - DNA, 20 bp, human
gcccccgcctggcgagaccc

SEQ ID NO: 395308 - DNA, 20 bp, human
gtggctgcggctggtccgga

SEQ ID NO: 395309 - DNA, 20 bp, human
gctgcagcggggtccgccca

SEQ ID NO: 395310 - DNA, 20 bp, human
ggcccggccagggtctcgcc

SEQ ID NO: 395311 - DNA, 20 bp, human
gaccgggggggccactgcag

SEQ ID NO: 395312 - DNA, 20 bp, human
ggcgccccgggcggaccggg

SEQ ID NO: 395313 - DNA, 20 bp, human
gtggcccccccggtccgccc

SEQ ID NO: 395314 - DNA, 20 bp, human
ggcctggcgagaccctggcc

SEQ ID NO: 395315 - DNA, 20 bp, human
gccctcccagaggcccccca

SEQ ID NO: 395316 - DNA, 20 bp, human
ggggaaggaggacatattta

SEQ ID NO: 395317 - DNA, 20 bp, human
gctatcctcgcagtcaccct

SEQ ID NO: 395318 - DNA, 20 bp, human
gctggcccagggtgactgcg

SEQ ID NO: 395319 - DNA, 20 bp, human
gggacatatttaggggtcca

SEQ ID NO: 395320 - DNA, 20 bp, human
gagaatgcagtctctcccat

SEQ ID NO: 395321 - DNA, 20 bp, human
gcaagtctaacatccctata

SEQ ID NO: 395322 - DNA, 20 bp, human
gtagacttgtatgaaaagtt

SEQ ID NO: 395323 - DNA, 20 bp, human
gagggacaaagttctctgga

SEQ ID NO: 395324 - DNA, 20 bp, human
gtgtgtgtatgttccttata

SEQ ID NO: 395325 - DNA, 20 bp, human
ggtggtgatgacttctccta

SEQ ID NO: 395326 - DNA, 20 bp, human
gttgacgcagactcgaggag

SEQ ID NO: 395327 - DNA, 20 bp, human
ggcaagcgtcacgacgtgaa

SEQ ID NO: 395328 - DNA, 20 bp, human
gcgtcacgacgtgaagggac

SEQ ID NO: 395329 - DNA, 20 bp, human
ggacgcttgcttccgggaag

SEQ ID NO: 395330 - DNA, 20 bp, human
gttacgacggcccctgaagt

SEQ ID NO: 395331 - DNA, 20 bp, human
gtacgcctgataaattagag

SEQ ID NO: 395332 - DNA, 20 bp, human
gacccccggccagaggcaag

SEQ ID NO: 395333 - DNA, 20 bp, human
gagggacgacacttttacga

SEQ ID NO: 395334 - DNA, 20 bp, human
gagactcgaggagtggcttc

SEQ ID NO: 395335 - DNA, 20 bp, human
gacgtcgtgacgcttgcttc

SEQ ID NO: 395336 - DNA, 20 bp, human
gcaaggggcgctggcttaaa

SEQ ID NO: 395337 - DNA, 20 bp, human
gtctgcccaacgagaatcat

SEQ ID NO: 395338 - DNA, 20 bp, human
gtgcccctcgaatgcattgt

SEQ ID NO: 395339 - DNA, 20 bp, human
gaggggaagcggagctttct

SEQ ID NO: 395340 - DNA, 20 bp, human
gggcttaaatggcagataag

SEQ ID NO: 395341 - DNA, 20 bp, human
gtcttcccatgattctcgtt

SEQ ID NO: 395342 - DNA, 20 bp, human
gtaaatggcagataagcggg

SEQ ID NO: 395343 - DNA, 20 bp, human
gccaaagagaaagatactgt

SEQ ID NO: 395344 - DNA, 20 bp, human
gagccagcgccccttgagaa

SEQ ID NO: 395345 - DNA, 20 bp, human
gactcccacaatgcattcga

SEQ ID NO: 395346 - DNA, 20 bp, human
gggcgcctgtggaccaagct

SEQ ID NO: 395347 - DNA, 20 bp, human
gccacaggcgcccaggagag

SEQ ID NO: 395348 - DNA, 20 bp, human
gggagcctagcttggtccac

SEQ ID NO: 395349 - DNA, 20 bp, human
gcccctacacacgccccctc

SEQ ID NO: 395350 - DNA, 20 bp, human
ggcccgagggggcgtgtgta

SEQ ID NO: 395351 - DNA, 20 bp, human
gcggaggagcgcggacgctc

SEQ ID NO: 395352 - DNA, 20 bp, human
gtccgggtatcgcgagagtt

SEQ ID NO: 395353 - DNA, 20 bp, human
ggaaagttgggagcctagct

SEQ ID NO: 395354 - DNA, 20 bp, human
gggtatcgcgagagttgggc

SEQ ID NO: 395355 - DNA, 20 bp, human
ggctcttaacttagaaagtt

SEQ ID NO: 395356 - DNA, 20 bp, human
gtcgagccgcggcgagggaa

SEQ ID NO: 395357 - DNA, 20 bp, human
gccgcggcgagggaacggat

SEQ ID NO: 395358 - DNA, 20 bp, human
gtcgaccccggtgagagcaa

SEQ ID NO: 395359 - DNA, 20 bp, human
gtgagcaactcccaccgcgc

SEQ ID NO: 395360 - DNA, 20 bp, human
ggcggcctttgctctcaccg

SEQ ID NO: 395361 - DNA, 20 bp, human
gtgctcagaaggtagcgcag

SEQ ID NO: 395362 - DNA, 20 bp, human
gggttcagtgggcaagtcta

SEQ ID NO: 395363 - DNA, 20 bp, human
gaaggtagcgcagcggggaa

SEQ ID NO: 395364 - DNA, 20 bp, human
gcaagcaggtggtagcgact

SEQ ID NO: 395365 - DNA, 20 bp, human
ggggtcaaaaacgcgacgcg

SEQ ID NO: 395366 - DNA, 20 bp, human
ggttccggagagcacgtgtt

SEQ ID NO: 395367 - DNA, 20 bp, human
gcggcaaggccccctcgatt

SEQ ID NO: 395368 - DNA, 20 bp, human
gtgggctgctcaacgttgtc

SEQ ID NO: 395369 - DNA, 20 bp, human
gttgagcagcccaatcgagg

SEQ ID NO: 395370 - DNA, 20 bp, human
gaggcggggctccgggaaac

SEQ ID NO: 395371 - DNA, 20 bp, human
ggggagccgaacggaccaat

SEQ ID NO: 395372 - DNA, 20 bp, human
gcggggctccgggaaacggg

SEQ ID NO: 395373 - DNA, 20 bp, human
gctctccggaacactcactc

SEQ ID NO: 395374 - DNA, 20 bp, human
gaggctgcgggctaacctgc

SEQ ID NO: 395375 - DNA, 20 bp, human
ggtcgggccacgacgctgta

SEQ ID NO: 395376 - DNA, 20 bp, human
gtccggcgcaggcgggagaa

SEQ ID NO: 395377 - DNA, 20 bp, human
ggggaagcgccacccggagg

SEQ ID NO: 395378 - DNA, 20 bp, human
gctcccgcctgcgccggacg

SEQ ID NO: 395379 - DNA, 20 bp, human
gagctgctgggagagtacgt

SEQ ID NO: 395380 - DNA, 20 bp, human
gagagtacgtcgggcaggaa

SEQ ID NO: 395381 - DNA, 20 bp, human
gaagctgcgggtgtcctgtg

SEQ ID NO: 395382 - DNA, 20 bp, human
gaggagcgacttccgacaaa

SEQ ID NO: 395383 - DNA, 20 bp, human
gcggccgtgaggggcgtagc

SEQ ID NO: 395384 - DNA, 20 bp, human
gccggcggaggcgggaaaag

SEQ ID NO: 395385 - DNA, 20 bp, human
ggaaaaaaagcgaaggaagg

SEQ ID NO: 395386 - DNA, 20 bp, human
gcgagccggcggaagggaga

SEQ ID NO: 395387 - DNA, 20 bp, human
gggcaccgcgagccggcgga

SEQ ID NO: 395388 - DNA, 20 bp, human
gaaaatcaggcccagcccta

SEQ ID NO: 395389 - DNA, 20 bp, human
ggtcacatgcgcacctgggg

SEQ ID NO: 395390 - DNA, 20 bp, human
ggcctggggcggggttaggc

SEQ ID NO: 395391 - DNA, 20 bp, human
gcctcccgagccaatctccg

SEQ ID NO: 395392 - DNA, 20 bp, human
gggggcggtacgcaccacgg

SEQ ID NO: 395393 - DNA, 20 bp, human
gcgaactagagaccgtggga

SEQ ID NO: 395394 - DNA, 20 bp, human
gctgggcctgattttctcat

SEQ ID NO: 395395 - DNA, 20 bp, human
gtcggtcacatgcgcacctg

SEQ ID NO: 395396 - DNA, 20 bp, human
gcgggccgagcccaggccgt

SEQ ID NO: 395397 - DNA, 20 bp, human
ggcgccgccctccgcaccca

SEQ ID NO: 395398 - DNA, 20 bp, human
gccggcccgcccggaatcgc

SEQ ID NO: 395399 - DNA, 20 bp, human
ggctgcggcccgcccgggat

SEQ ID NO: 395400 - DNA, 20 bp, human
ggggacgcagggggctaggt

SEQ ID NO: 395401 - DNA, 20 bp, human
gcgcgcgccgccctcgcctt

SEQ ID NO: 395402 - DNA, 20 bp, human
gagggctggcccatcccggg

SEQ ID NO: 395403 - DNA, 20 bp, human
gcccaggccgtgggtgcgga

SEQ ID NO: 395404 - DNA, 20 bp, human
ggcggggctcgcctggactc

SEQ ID NO: 395405 - DNA, 20 bp, human
ggcggtgggtggagcggcga

SEQ ID NO: 395406 - DNA, 20 bp, human
gggtcggtgtgcgctctacg

SEQ ID NO: 395407 - DNA, 20 bp, human
ggcggggggtgtgcgagctg

SEQ ID NO: 395408 - DNA, 20 bp, human
gcttccctcccactgctcta

SEQ ID NO: 395409 - DNA, 20 bp, human
ggaccccggcgaacagatgg

SEQ ID NO: 395410 - DNA, 20 bp, human
gtaggaggacgatttctctg

SEQ ID NO: 395411 - DNA, 20 bp, human
gaacgcagagcgatggaggc

SEQ ID NO: 395412 - DNA, 20 bp, human
gcccagctcgcactcacctg

SEQ ID NO: 395413 - DNA, 20 bp, human
ggcgatggaggcggggtagg

SEQ ID NO: 395414 - DNA, 20 bp, human
gttgcccgtcagagccgcct

SEQ ID NO: 395415 - DNA, 20 bp, human
ggggctggagccggcgagcg

SEQ ID NO: 395416 - DNA, 20 bp, human
gccacagcagcctggcgcct

SEQ ID NO: 395417 - DNA, 20 bp, human
ggcctggcgccttggcttgg

SEQ ID NO: 395418 - DNA, 20 bp, human
ggtgaggcaggatgaagttc

SEQ ID NO: 395419 - DNA, 20 bp, human
gactttccgtgggtgggaac

SEQ ID NO: 395420 - DNA, 20 bp, human
gggaagtgccggatctgttt

SEQ ID NO: 395421 - DNA, 20 bp, human
ggtgcggctctgaaacccgt

SEQ ID NO: 395422 - DNA, 20 bp, human
gacgtgggggcggatgtcga

SEQ ID NO: 395423 - DNA, 20 bp, human
gaggatgaagttccgggaac

SEQ ID NO: 395424 - DNA, 20 bp, human
ggccaggactttccgtgggt

SEQ ID NO: 395425 - DNA, 20 bp, human
ggtcccttagcgcaatgctt

SEQ ID NO: 395426 - DNA, 20 bp, human
ggaggccgtgaactccaggt

SEQ ID NO: 395427 - DNA, 20 bp, human
gaggcggtgacgctaggaag

SEQ ID NO: 395428 - DNA, 20 bp, human
ggccgtgaactccaggtcgg

SEQ ID NO: 395429 - DNA, 20 bp, human
gtggctggggacatcaaagg

SEQ ID NO: 395430 - DNA, 20 bp, human
gaggccaggcaatccactcc

SEQ ID NO: 395431 - DNA, 20 bp, human
gggcggaggccgtgaactcc

SEQ ID NO: 395432 - DNA, 20 bp, human
gaaacagaggcggtgacgct

SEQ ID NO: 395433 - DNA, 20 bp, human
gggtgcagatgctgttgata

SEQ ID NO: 395434 - DNA, 20 bp, human
gcaccgcctctgtttctctc

SEQ ID NO: 395435 - DNA, 20 bp, human
gggctcgcaatccaccgacc

SEQ ID NO: 395436 - DNA, 20 bp, human
gtgagagggctccaggtccg

SEQ ID NO: 395437 - DNA, 20 bp, human
gagaatgcaccgctctgaga

SEQ ID NO: 395438 - DNA, 20 bp, human
gagcaacctgcagacagcga

SEQ ID NO: 395439 - DNA, 20 bp, human
gaacctgcagacagcgaagg

SEQ ID NO: 395440 - DNA, 20 bp, human
gcgaagaataccgactctgt

SEQ ID NO: 395441 - DNA, 20 bp, human
gtacagatgaggctctggga

SEQ ID NO: 395442 - DNA, 20 bp, human
gaccctcaggtgcgggagga

SEQ ID NO: 395443 - DNA, 20 bp, human
ggggctccaggtccggggcg

SEQ ID NO: 395444 - DNA, 20 bp, human
ggcctgtgctcggattctat

SEQ ID NO: 395445 - DNA, 20 bp, human
gtgctggcagcctcacattc

SEQ ID NO: 395446 - DNA, 20 bp, human
gtagccgccgggccagtggt

SEQ ID NO: 395447 - DNA, 20 bp, human
gctagctgccttcatgggta

SEQ ID NO: 395448 - DNA, 20 bp, human
gcgggcgcttcaagtcccgg

SEQ ID NO: 395449 - DNA, 20 bp, human
gcgcgctcctcgggtctgcg

SEQ ID NO: 395450 - DNA, 20 bp, human
gaagcacactctgggttctc

SEQ ID NO: 395451 - DNA, 20 bp, human
gcatgaaggcagctagccgc

SEQ ID NO: 395452 - DNA, 20 bp, human
gtacccaggtaagcacactc

SEQ ID NO: 395453 - DNA, 20 bp, human
gccggcgggaacggcgctaa

SEQ ID NO: 395454 - DNA, 20 bp, human
gaacccagagtgtgcttacc

SEQ ID NO: 395455 - DNA, 20 bp, human
gtcaacattgtcagaatgca

SEQ ID NO: 395456 - DNA, 20 bp, human
gcggccggaagcggtctcgt

SEQ ID NO: 395457 - DNA, 20 bp, human
gcggagctcgagagcgagaa

SEQ ID NO: 395458 - DNA, 20 bp, human
gtccggccgcagccacggcg

SEQ ID NO: 395459 - DNA, 20 bp, human
gcagcgccccgccgtggctg

SEQ ID NO: 395460 - DNA, 20 bp, human
ggaggagcgagcagccggga

SEQ ID NO: 395461 - DNA, 20 bp, human
ggcgctggagccttgacgca

SEQ ID NO: 395462 - DNA, 20 bp, human
ggcttcgcagcgccccgccg

SEQ ID NO: 395463 - DNA, 20 bp, human
gtcaaggctccagcgccgca

SEQ ID NO: 395464 - DNA, 20 bp, human
ggggccaacgagaccgcttc

SEQ ID NO: 395465 - DNA, 20 bp, human
ggaagccggccagcccttcc

SEQ ID NO: 395466 - DNA, 20 bp, human
ggtaccatccaatccttgat

SEQ ID NO: 395467 - DNA, 20 bp, human
gctaaaagcagaactctgcc

SEQ ID NO: 395468 - DNA, 20 bp, human
gcactgtaggccgccctaga

SEQ ID NO: 395469 - DNA, 20 bp, human
gtgcctggcaaccgcaggag

SEQ ID NO: 395470 - DNA, 20 bp, human
ggggccagcaccggaagcgg

SEQ ID NO: 395471 - DNA, 20 bp, human
gggtgggccagcaccggaag

SEQ ID NO: 395472 - DNA, 20 bp, human
gggaggggcgaagacgcgca

SEQ ID NO: 395473 - DNA, 20 bp, human
gcaaaaaggtgggccagcac

SEQ ID NO: 395474 - DNA, 20 bp, human
gaaggagaaaccaaaaaggt

SEQ ID NO: 395475 - DNA, 20 bp, human
gcgcgtcttcgcccctcctg

SEQ ID NO: 395476 - DNA, 20 bp, human
ggggttgcgactgtgacgtg

SEQ ID NO: 395477 - DNA, 20 bp, human
gctggggcacggacaccgac

SEQ ID NO: 395478 - DNA, 20 bp, human
gccccaggaccttctctcgt

SEQ ID NO: 395479 - DNA, 20 bp, human
gaaccgctaagacacgtcgg

SEQ ID NO: 395480 - DNA, 20 bp, human
gcgtcacagtcgcaacccgt

SEQ ID NO: 395481 - DNA, 20 bp, human
gcttgtgcggagccggaggt

SEQ ID NO: 395482 - DNA, 20 bp, human
ggtggaggaaagcggtaaga

SEQ ID NO: 395483 - DNA, 20 bp, human
ggcctccggtcgcgcagtcc

SEQ ID NO: 395484 - DNA, 20 bp, human
ggtgcgggcgcgcgcccgct

SEQ ID NO: 395485 - DNA, 20 bp, human
gcgccaacgagagaaggtcc

SEQ ID NO: 395486 - DNA, 20 bp, human
gcgctggagccgcgtctctg

SEQ ID NO: 395487 - DNA, 20 bp, human
gtcgccctggcaacggagtc

SEQ ID NO: 395488 - DNA, 20 bp, human
ggcggctccagcgtacagag

SEQ ID NO: 395489 - DNA, 20 bp, human
gcggaagaaccacagagacg

SEQ ID NO: 395490 - DNA, 20 bp, human
ggggcggccgctctgtacgc

SEQ ID NO: 395491 - DNA, 20 bp, human
ggcactcgtcgccctggcaa

SEQ ID NO: 395492 - DNA, 20 bp, human
gaaggcaccgagcgctagag

SEQ ID NO: 395493 - DNA, 20 bp, human
gcttccggactccgttgcca

SEQ ID NO: 395494 - DNA, 20 bp, human
gctagcgctcggtgccttgc

SEQ ID NO: 395495 - DNA, 20 bp, human
ggacgagtgcacctctcgat

SEQ ID NO: 395496 - DNA, 20 bp, human
gaagaactgcggggagccca

SEQ ID NO: 395497 - DNA, 20 bp, human
gagctgtgggaggactagat

SEQ ID NO: 395498 - DNA, 20 bp, human
ggggaggactagataggcag

SEQ ID NO: 395499 - DNA, 20 bp, human
ggactcatgaagacccaccc

SEQ ID NO: 395500 - DNA, 20 bp, human
gggaagggctctctggccaa

SEQ ID NO: 395501 - DNA, 20 bp, human
gaagacccagatatcggatg

SEQ ID NO: 395502 - DNA, 20 bp, human
gtatcggatgaggccggggt

SEQ ID NO: 395503 - DNA, 20 bp, human
ggcagggtccatggctggtt

SEQ ID NO: 395504 - DNA, 20 bp, human
gcaacaaaatgccatttccc

SEQ ID NO: 395505 - DNA, 20 bp, human
ggtgggagggcgttgtgcag

SEQ ID NO: 395506 - DNA, 20 bp, human
ggcgcctgcgcagaccgctg

SEQ ID NO: 395507 - DNA, 20 bp, human
gcgtccccagcggtctgcgc

SEQ ID NO: 395508 - DNA, 20 bp, human
ggagcagccaacccgagagc

SEQ ID NO: 395509 - DNA, 20 bp, human
ggctccaaggctagcctcgc

SEQ ID NO: 395510 - DNA, 20 bp, human
gctagccttggagcccggag

SEQ ID NO: 395511 - DNA, 20 bp, human
gacaccgcacggcgaagtgg

SEQ ID NO: 395512 - DNA, 20 bp, human
gcgcaggcgcattttccgac

SEQ ID NO: 395513 - DNA, 20 bp, human
gaatcgacaccgcgcctgcg

SEQ ID NO: 395514 - DNA, 20 bp, human
gttcgccgtgcggtgtgcgc

SEQ ID NO: 395515 - DNA, 20 bp, human
gccgaaggaagcttcggtct

SEQ ID NO: 395516 - DNA, 20 bp, human
gtgggagagggtcaataacg

SEQ ID NO: 395517 - DNA, 20 bp, human
gagcctgggctctagagcgg

SEQ ID NO: 395518 - DNA, 20 bp, human
gcgccaccatggcttcacgt

SEQ ID NO: 395519 - DNA, 20 bp, human
gaccccacgtgaagccatgg

SEQ ID NO: 395520 - DNA, 20 bp, human
gagccaccgctctagagccc

SEQ ID NO: 395521 - DNA, 20 bp, human
gacggccgtgtcgttattga

SEQ ID NO: 395522 - DNA, 20 bp, human
gaaaacgcggccggaagggg

SEQ ID NO: 395523 - DNA, 20 bp, human
gtggacatcatgtgacttgg

SEQ ID NO: 395524 - DNA, 20 bp, human
ggagctccagacacacaagg

SEQ ID NO: 395525 - DNA, 20 bp, human
ggaaccagagactgcggacg

SEQ ID NO: 395526 - DNA, 20 bp, human
gagtgagactgcaaggtttg

SEQ ID NO: 395527 - DNA, 20 bp, human
gggactgctccatacactca

SEQ ID NO: 395528 - DNA, 20 bp, human
gactccgcgctgcgcacggg

SEQ ID NO: 395529 - DNA, 20 bp, human
gtgcgcagcgcggagtggta

SEQ ID NO: 395530 - DNA, 20 bp, human
gcaggggcagaaccaagcga

SEQ ID NO: 395531 - DNA, 20 bp, human
gaaccaccagattatctcac

SEQ ID NO: 395532 - DNA, 20 bp, human
gagggggaaacggacggtcg

SEQ ID NO: 395533 - DNA, 20 bp, human
gcgccggtgagataatctgg

SEQ ID NO: 395534 - DNA, 20 bp, human
gcggggggttcgtacccatc

SEQ ID NO: 395535 - DNA, 20 bp, human
gaccggcgagtgagactgca

SEQ ID NO: 395536 - DNA, 20 bp, human
gccacccacgccagccagtg

SEQ ID NO: 395537 - DNA, 20 bp, human
gaacccctggttctagatgt

SEQ ID NO: 395538 - DNA, 20 bp, human
gactaaatggaaacaccagt

SEQ ID NO: 395539 - DNA, 20 bp, human
gtggctggcgtgggtggtgt

SEQ ID NO: 395540 - DNA, 20 bp, human
gagacagacgggcccttctc

SEQ ID NO: 395541 - DNA, 20 bp, human
ggagccccactggctggcgt

SEQ ID NO: 395542 - DNA, 20 bp, human
gtgaaagtgcaaagaacaga

SEQ ID NO: 395543 - DNA, 20 bp, human
gttctggtcacacatcccac

SEQ ID NO: 395544 - DNA, 20 bp, human
ggatgtgtgaccagaacccc

SEQ ID NO: 395545 - DNA, 20 bp, human
gtcagccaacatctagaacc

SEQ ID NO: 395546 - DNA, 20 bp, human
gcggaagagtccaagcgtga

SEQ ID NO: 395547 - DNA, 20 bp, human
gtgaccacgcggtcccagac

SEQ ID NO: 395548 - DNA, 20 bp, human
gagaacgcgagcgctcggca

SEQ ID NO: 395549 - DNA, 20 bp, human
gcctgcacggagcggttaag

SEQ ID NO: 395550 - DNA, 20 bp, human
gcgctcggcaaggctcggct

SEQ ID NO: 395551 - DNA, 20 bp, human
gtgcaagaatgggaaggtgc

SEQ ID NO: 395552 - DNA, 20 bp, human
ggcacgcctcctagcgcagt

SEQ ID NO: 395553 - DNA, 20 bp, human
gcctacggccctgcacggag

SEQ ID NO: 395554 - DNA, 20 bp, human
ggcgagcgctcggcaaggct

SEQ ID NO: 395555 - DNA, 20 bp, human
ggtccaagcgtgaggggaga

SEQ ID NO: 395556 - DNA, 20 bp, human
gcgggatcctcgcccctctg

SEQ ID NO: 395557 - DNA, 20 bp, human
gacccgtagcggattcggaa

SEQ ID NO: 395558 - DNA, 20 bp, human
gtatcacagaggaataacga

SEQ ID NO: 395559 - DNA, 20 bp, human
gaggggcaggactcgttccc

SEQ ID NO: 395560 - DNA, 20 bp, human
gaggggatgcggtgcgtcaa

SEQ ID NO: 395561 - DNA, 20 bp, human
gagcggattcggaagggctg

SEQ ID NO: 395562 - DNA, 20 bp, human
gccgccggggattccaggtt

SEQ ID NO: 395563 - DNA, 20 bp, human
gtacgggtgctgcaaggcct

SEQ ID NO: 395564 - DNA, 20 bp, human
ggcagcacccgtagcggatt

SEQ ID NO: 395565 - DNA, 20 bp, human
ggggctgctagactagtgga

SEQ ID NO: 395566 - DNA, 20 bp, human
ggggggccgcgcatgcgtga

SEQ ID NO: 395567 - DNA, 20 bp, human
ggggagttgtagtccaccgg

SEQ ID NO: 395568 - DNA, 20 bp, human
gggcccgaggccggcacacc

SEQ ID NO: 395569 - DNA, 20 bp, human
gcgcccagcgccgaggtcgg

SEQ ID NO: 395570 - DNA, 20 bp, human
gacaaggtctcagactcaag

SEQ ID NO: 395571 - DNA, 20 bp, human
gcgccgaaagctggctggca

SEQ ID NO: 395572 - DNA, 20 bp, human
gcagcctcggggtgcggaac

SEQ ID NO: 395573 - DNA, 20 bp, human
gctgcgcccgggcctcgagc

SEQ ID NO: 395574 - DNA, 20 bp, human
ggagtctgagaccttgtagc

SEQ ID NO: 395575 - DNA, 20 bp, human
gctcccggaagtgatcgctc

SEQ ID NO: 395576 - DNA, 20 bp, human
ggcgccctagtggaccctgg

SEQ ID NO: 395577 - DNA, 20 bp, human
gggagaaagggttaaccggg

SEQ ID NO: 395578 - DNA, 20 bp, human
gcgtcggagaaagggttaac

SEQ ID NO: 395579 - DNA, 20 bp, human
gtttcccccagggtccacta

SEQ ID NO: 395580 - DNA, 20 bp, human
gctagggcgcgtcggagaaa

SEQ ID NO: 395581 - DNA, 20 bp, human
gcgcccgaggtctctgcgaa

SEQ ID NO: 395582 - DNA, 20 bp, human
gctgctattcgccgaggcgg

SEQ ID NO: 395583 - DNA, 20 bp, human
gagcctgtttctttccccca

SEQ ID NO: 395584 - DNA, 20 bp, human
gagcgcgctgctattcgccg

SEQ ID NO: 395585 - DNA, 20 bp, human
ggctgctgctccaatccggg

SEQ ID NO: 395586 - DNA, 20 bp, human
gggcggaggctgccgaacta

SEQ ID NO: 395587 - DNA, 20 bp, human
gccctggtcccgagtggcgt

SEQ ID NO: 395588 - DNA, 20 bp, human
gaaggccgcgcggcgggcat

SEQ ID NO: 395589 - DNA, 20 bp, human
gttgtggggcttgtagtccg

SEQ ID NO: 395590 - DNA, 20 bp, human
ggcggggccctccaggcacg

SEQ ID NO: 395591 - DNA, 20 bp, human
gagtccgcggtgggcaagag

SEQ ID NO: 395592 - DNA, 20 bp, human
ggcatgggggacccgtagtt

SEQ ID NO: 395593 - DNA, 20 bp, human
ggccccacaaggccgcgcgg

SEQ ID NO: 395594 - DNA, 20 bp, human
ggcccgtccccacgccactc

SEQ ID NO: 395595 - DNA, 20 bp, human
gggggcttgtagtccgcggt

SEQ ID NO: 395596 - DNA, 20 bp, human
ggaagcagagcttgtagtta

SEQ ID NO: 395597 - DNA, 20 bp, human
ggaggctgggataccactgg

SEQ ID NO: 395598 - DNA, 20 bp, human
ggccctgggtgggacggtct

SEQ ID NO: 395599 - DNA, 20 bp, human
gtgtagttagggccctgggt

SEQ ID NO: 395600 - DNA, 20 bp, human
gcaggaggctgggataccac

SEQ ID NO: 395601 - DNA, 20 bp, human
ggggtgggacggtcttggag

SEQ ID NO: 395602 - DNA, 20 bp, human
gaatgactggaatacccatc

SEQ ID NO: 395603 - DNA, 20 bp, human
ggatccccagacacggacat

SEQ ID NO: 395604 - DNA, 20 bp, human
gaccggggccctaacgtccc

SEQ ID NO: 395605 - DNA, 20 bp, human
gcactggaaccctgactgtt

SEQ ID NO: 395606 - DNA, 20 bp, human
gacggctggcgggcccccgg

SEQ ID NO: 395607 - DNA, 20 bp, human
ggctagccccaggggcacga

SEQ ID NO: 395608 - DNA, 20 bp, human
gtggggcgtaaagactgctc

SEQ ID NO: 395609 - DNA, 20 bp, human
ggcttccagcgctagcccca

SEQ ID NO: 395610 - DNA, 20 bp, human
gtggaagcagcactggacgc

SEQ ID NO: 395611 - DNA, 20 bp, human
gctagcgctggaagcagcac

SEQ ID NO: 395612 - DNA, 20 bp, human
gctgacggctggcgggcccc

SEQ ID NO: 395613 - DNA, 20 bp, human
gcggggcgagggactcccgt

SEQ ID NO: 395614 - DNA, 20 bp, human
gtcagtgggtcccactgtgt

SEQ ID NO: 395615 - DNA, 20 bp, human
ggtgcccctggggctagcgc

SEQ ID NO: 395616 - DNA, 20 bp, human
ggctaaggacacccccggga

SEQ ID NO: 395617 - DNA, 20 bp, human
gcccgggagggatgagtcat

SEQ ID NO: 395618 - DNA, 20 bp, human
gaaaagagtagatagggtgg

SEQ ID NO: 395619 - DNA, 20 bp, human
gtccccggaaaagagtagat

SEQ ID NO: 395620 - DNA, 20 bp, human
gcggaaaagagtagataggg

SEQ ID NO: 395621 - DNA, 20 bp, human
gtcttttccggggacaagtt

SEQ ID NO: 395622 - DNA, 20 bp, human
ggtaccagctcccaccccag

SEQ ID NO: 395623 - DNA, 20 bp, human
ggggggctaaggacaccccc

SEQ ID NO: 395624 - DNA, 20 bp, human
gacaagacagtgaccaggac

SEQ ID NO: 395625 - DNA, 20 bp, human
gttatctccctcagccccct

SEQ ID NO: 395626 - DNA, 20 bp, human
gagtgtgtgacaagcacaag

SEQ ID NO: 395627 - DNA, 20 bp, human
gaggatgcaaaaggagttgg

SEQ ID NO: 395628 - DNA, 20 bp, human
ggcacaaggggctacgtgtg

SEQ ID NO: 395629 - DNA, 20 bp, human
ggtcgtctgcatgacgtgga

SEQ ID NO: 395630 - DNA, 20 bp, human
gggtacggcagaagagccca

SEQ ID NO: 395631 - DNA, 20 bp, human
gagttagggcaaggggaatg

SEQ ID NO: 395632 - DNA, 20 bp, human
gatcaatgaagcaagttgct

SEQ ID NO: 395633 - DNA, 20 bp, human
gcacaaaacaacacggcaac

SEQ ID NO: 395634 - DNA, 20 bp, human
gtagactttatgtggggagt

SEQ ID NO: 395635 - DNA, 20 bp, human
gaaaacaacacggcaacagg

SEQ ID NO: 395636 - DNA, 20 bp, human
gcggccggcccagggctttc

SEQ ID NO: 395637 - DNA, 20 bp, human
gcaccgagcgagaatgggaa

SEQ ID NO: 395638 - DNA, 20 bp, human
gacaccgcacgtcggaggga

SEQ ID NO: 395639 - DNA, 20 bp, human
gcgaggcaccgagcgagaat

SEQ ID NO: 395640 - DNA, 20 bp, human
ggcgccctccctccgacgtg

SEQ ID NO: 395641 - DNA, 20 bp, human
gggggcgtgtccgggagcac

SEQ ID NO: 395642 - DNA, 20 bp, human
gtctcagaagacccgggcgt

SEQ ID NO: 395643 - DNA, 20 bp, human
ggcggggcgcagacaaccag

SEQ ID NO: 395644 - DNA, 20 bp, human
ggcgaggtctcagaagaccc

SEQ ID NO: 395645 - DNA, 20 bp, human
gggctttcggggagcgaagc

SEQ ID NO: 395646 - DNA, 20 bp, human
gcgctcgctcgcaggagggt

SEQ ID NO: 395647 - DNA, 20 bp, human
gcggaaaggcggctgctcca

SEQ ID NO: 395648 - DNA, 20 bp, human
gaaggcaagaggtgtgtgac

SEQ ID NO: 395649 - DNA, 20 bp, human
gtgatgggacgcacggaaac

SEQ ID NO: 395650 - DNA, 20 bp, human
ggcaagggagtgaccatctc

SEQ ID NO: 395651 - DNA, 20 bp, human
ggggaacgaaggagtaaacg

SEQ ID NO: 395652 - DNA, 20 bp, human
gggcctgccagctcctactt

SEQ ID NO: 395653 - DNA, 20 bp, human
gaaggagtaaacgcggtgat

SEQ ID NO: 395654 - DNA, 20 bp, human
gcgagcccaacggctgttgt

SEQ ID NO: 395655 - DNA, 20 bp, human
gcgggccgccaacctctgtg

SEQ ID NO: 395656 - DNA, 20 bp, human
gtggtgacaagggtgtatgg

SEQ ID NO: 395657 - DNA, 20 bp, human
ggacgcttccttggtgacaa

SEQ ID NO: 395658 - DNA, 20 bp, human
gacaagaggctggctggtga

SEQ ID NO: 395659 - DNA, 20 bp, human
ggtgcccagcctatcgtggg

SEQ ID NO: 395660 - DNA, 20 bp, human
gggtcaaggcctcccacgat

SEQ ID NO: 395661 - DNA, 20 bp, human
ggctgtgcccagcctatcgt

SEQ ID NO: 395662 - DNA, 20 bp, human
gggtgagtgagttccagatc

SEQ ID NO: 395663 - DNA, 20 bp, human
gtggttcagtcctcttgact

SEQ ID NO: 395664 - DNA, 20 bp, human
gccttggtgacaagggtgta

SEQ ID NO: 395665 - DNA, 20 bp, human
gtaagctgtggacgcttcct

SEQ ID NO: 395666 - DNA, 20 bp, human
gagcccggggcgttgaatgc

SEQ ID NO: 395667 - DNA, 20 bp, human
gcggctgcgcccggaatccg

SEQ ID NO: 395668 - DNA, 20 bp, human
ggcccactccggggtcacga

SEQ ID NO: 395669 - DNA, 20 bp, human
gcggagtgggcaagtgacga

SEQ ID NO: 395670 - DNA, 20 bp, human
gaggagaggccccggattcc

SEQ ID NO: 395671 - DNA, 20 bp, human
gcacccgcattcaacgcccc

SEQ ID NO: 395672 - DNA, 20 bp, human
gaagtccggaagaaggtccg

SEQ ID NO: 395673 - DNA, 20 bp, human
gggcctctccttcgtgaccc

SEQ ID NO: 395674 - DNA, 20 bp, human
gaaaccacgacccatcttcc

SEQ ID NO: 395675 - DNA, 20 bp, human
gtgggcaagtgacgagggca

SEQ ID NO: 395676 - DNA, 20 bp, human
gcactcacaagcgggtaact

SEQ ID NO: 395677 - DNA, 20 bp, human
ggcgccgtcatctttactat

SEQ ID NO: 395678 - DNA, 20 bp, human
gtcaccgcataaggcacaaa

SEQ ID NO: 395679 - DNA, 20 bp, human
gctatgggaagatgagacgt

SEQ ID NO: 395680 - DNA, 20 bp, human
ggaaaagcgccttggggttg

SEQ ID NO: 395681 - DNA, 20 bp, human
gcttcccatagtaaagatga

SEQ ID NO: 395682 - DNA, 20 bp, human
ggcgccttgaggtaagctac

SEQ ID NO: 395683 - DNA, 20 bp, human
gggaaagctcttagaacttc

SEQ ID NO: 395684 - DNA, 20 bp, human
gataggtgtcatatatagga

SEQ ID NO: 395685 - DNA, 20 bp, human
gtcaccctttgtgccttatg

SEQ ID NO: 395686 - DNA, 20 bp, human
gggtgcccgggacaaagcgt

SEQ ID NO: 395687 - DNA, 20 bp, human
ggggccctactaaattcgtc

SEQ ID NO: 395688 - DNA, 20 bp, human
gtcctcgatggctgaagcag

SEQ ID NO: 395689 - DNA, 20 bp, human
ggttccgcccgagtcctcga

SEQ ID NO: 395690 - DNA, 20 bp, human
gcctccagacgaatttagta

SEQ ID NO: 395691 - DNA, 20 bp, human
ggcagccgacgctttgtccc

SEQ ID NO: 395692 - DNA, 20 bp, human
gtgtgggtagtgtagtcgta

SEQ ID NO: 395693 - DNA, 20 bp, human
gcccctccgggtctcgggtc

SEQ ID NO: 395694 - DNA, 20 bp, human
gcagccatcgaggactcggg

SEQ ID NO: 395695 - DNA, 20 bp, human
gaaggccaggcgaagacgct

SEQ ID NO: 395696 - DNA, 20 bp, human
ggagactggcggggctgcgg

SEQ ID NO: 395697 - DNA, 20 bp, human
gcctcccggcgagactggcg

SEQ ID NO: 395698 - DNA, 20 bp, human
ggggtcgtgggcaggatgca

SEQ ID NO: 395699 - DNA, 20 bp, human
ggcagccccgccagtctcgc

SEQ ID NO: 395700 - DNA, 20 bp, human
gaagtgccgtggttgtaccg

SEQ ID NO: 395701 - DNA, 20 bp, human
gcagcgccgcggtacaacca

SEQ ID NO: 395702 - DNA, 20 bp, human
gggccgcgcagagggacaag

SEQ ID NO: 395703 - DNA, 20 bp, human
gcacgtcagccgacaggcgg

SEQ ID NO: 395704 - DNA, 20 bp, human
ggggttcctcccggcgagac

SEQ ID NO: 395705 - DNA, 20 bp, human
gtgactcgcagtagacgcgg

SEQ ID NO: 395706 - DNA, 20 bp, human
gaagcgtgggcatagagcgt

SEQ ID NO: 395707 - DNA, 20 bp, human
gtggatagcaacaacttcgg

SEQ ID NO: 395708 - DNA, 20 bp, human
gagtcaggcagaataagcgt

SEQ ID NO: 395709 - DNA, 20 bp, human
gtaggaccctaggttccagt

SEQ ID NO: 395710 - DNA, 20 bp, human
gcgttggatagcaacaactt

SEQ ID NO: 395711 - DNA, 20 bp, human
gcaggttggggcggaagtaa

SEQ ID NO: 395712 - DNA, 20 bp, human
gggggcggaagtaagggtat

SEQ ID NO: 395713 - DNA, 20 bp, human
gaccctaggttccagttggc

SEQ ID NO: 395714 - DNA, 20 bp, human
gcctaagagctcatgctaga

SEQ ID NO: 395715 - DNA, 20 bp, human
gtggacttggggcgaagctc

SEQ ID NO: 395716 - DNA, 20 bp, human
ggggctggagggcaagaaac

SEQ ID NO: 395717 - DNA, 20 bp, human
gaggctagctggcacggcgg

SEQ ID NO: 395718 - DNA, 20 bp, human
gcagaacgccggaatcacgg

SEQ ID NO: 395719 - DNA, 20 bp, human
gagctcgcgcctgcgtaatg

SEQ ID NO: 395720 - DNA, 20 bp, human
ggggcgcggcggagcattgt

SEQ ID NO: 395721 - DNA, 20 bp, human
gggcaggctagctggcacgg

SEQ ID NO: 395722 - DNA, 20 bp, human
ggtgccagctagcctgcctg

SEQ ID NO: 395723 - DNA, 20 bp, human
gcctgcgggcctcattacgc

SEQ ID NO: 395724 - DNA, 20 bp, human
ggccgagtctatgcaggagc

SEQ ID NO: 395725 - DNA, 20 bp, human
gcgaggcgggcgcaaggcaa

SEQ ID NO: 395726 - DNA, 20 bp, human
gtatcctcccacagcgtgct

SEQ ID NO: 395727 - DNA, 20 bp, human
gcacgctgtgggaggatacg

SEQ ID NO: 395728 - DNA, 20 bp, human
gcccgcctcgccgtccgcga

SEQ ID NO: 395729 - DNA, 20 bp, human
gcaactcccgacatgctcgg

SEQ ID NO: 395730 - DNA, 20 bp, human
ggtagccgaagacttatgtt

SEQ ID NO: 395731 - DNA, 20 bp, human
ggctcggcggcatgacgtca

SEQ ID NO: 395732 - DNA, 20 bp, human
gtcccacagcgtgcttggaa

SEQ ID NO: 395733 - DNA, 20 bp, human
ggggcaacctggacgagctg

SEQ ID NO: 395734 - DNA, 20 bp, human
gtccgcgagggactgcggtg

SEQ ID NO: 395735 - DNA, 20 bp, human
gaccacaccgcagtccctcg

SEQ ID NO: 395736 - DNA, 20 bp, human
gatcgtgtcctgctgcccgc

SEQ ID NO: 395737 - DNA, 20 bp, human
gggcgcgcgggcgacagggt

SEQ ID NO: 395738 - DNA, 20 bp, human
gcagcaggacacgatctccc

SEQ ID NO: 395739 - DNA, 20 bp, human
gaagcccggcctgcgtcctg

SEQ ID NO: 395740 - DNA, 20 bp, human
gccgctgccgcccacctagg

SEQ ID NO: 395741 - DNA, 20 bp, human
gggtgggcgtggaccgatgg

SEQ ID NO: 395742 - DNA, 20 bp, human
gcggctcgcgccccactcct

SEQ ID NO: 395743 - DNA, 20 bp, human
gcgtcccgcccccggaaccg

SEQ ID NO: 395744 - DNA, 20 bp, human
ggcgggacgcgccgaggagt

SEQ ID NO: 395745 - DNA, 20 bp, human
gaggctcgggagaggcgaac

SEQ ID NO: 395746 - DNA, 20 bp, human
gtcccgctacacaaggccca

SEQ ID NO: 395747 - DNA, 20 bp, human
gccagcgccgctcgcggtag

SEQ ID NO: 395748 - DNA, 20 bp, human
gcctgagccgtgaaggaaat

SEQ ID NO: 395749 - DNA, 20 bp, human
gggagctaggaagcagctga

SEQ ID NO: 395750 - DNA, 20 bp, human
gtccttcacggctcaggggc

SEQ ID NO: 395751 - DNA, 20 bp, human
gactggggctggtcctggct

SEQ ID NO: 395752 - DNA, 20 bp, human
gtagctgggcaaatccgctt

SEQ ID NO: 395753 - DNA, 20 bp, human
ggccctgggccttgtgtagc

SEQ ID NO: 395754 - DNA, 20 bp, human
ggatttgcccagctaggcca

SEQ ID NO: 395755 - DNA, 20 bp, human
gccgctggaccaggggacgg

SEQ ID NO: 395756 - DNA, 20 bp, human
gcatctccgagggttgggga

SEQ ID NO: 395757 - DNA, 20 bp, human
ggtcgccctctcatctccga

SEQ ID NO: 395758 - DNA, 20 bp, human
gccaaccctcggagatgaga

SEQ ID NO: 395759 - DNA, 20 bp, human
gaccctgaaaggcggaagtg

SEQ ID NO: 395760 - DNA, 20 bp, human
ggggcgaccgcgcgacgctc

SEQ ID NO: 395761 - DNA, 20 bp, human
ggcgaacgctggaggacttc

SEQ ID NO: 395762 - DNA, 20 bp, human
ggcctacccgccaccctgaa

SEQ ID NO: 395763 - DNA, 20 bp, human
ggggctgctaggtctcgact

SEQ ID NO: 395764 - DNA, 20 bp, human
ggcaggaagcggaagtaaaa

SEQ ID NO: 395765 - DNA, 20 bp, human
gttcccaagaccttgaagac

SEQ ID NO: 395766 - DNA, 20 bp, human
gcgccccggcggctccgacg

SEQ ID NO: 395767 - DNA, 20 bp, human
gtccgagaacccaaagtcct

SEQ ID NO: 395768 - DNA, 20 bp, human
gtccgacgtggcccagtgtc

SEQ ID NO: 395769 - DNA, 20 bp, human
gcggcgcggtttagtgggtg

SEQ ID NO: 395770 - DNA, 20 bp, human
ggcggcgccgggttgctgag

SEQ ID NO: 395771 - DNA, 20 bp, human
gtggacccggcacccagtaa

SEQ ID NO: 395772 - DNA, 20 bp, human
gcagcaacccggcgccgccc

SEQ ID NO: 395773 - DNA, 20 bp, human
ggggccacgtcggagccgcc

SEQ ID NO: 395774 - DNA, 20 bp, human
gtgcgtgtcccgctccggcg

SEQ ID NO: 395775 - DNA, 20 bp, human
ggcgtcacagatgctcccgc

SEQ ID NO: 395776 - DNA, 20 bp, human
ggcagacccgtgcaccggcg

SEQ ID NO: 395777 - DNA, 20 bp, human
gggtctcggaggcggaattt

SEQ ID NO: 395778 - DNA, 20 bp, human
ggcggggcgagaatatgtac

SEQ ID NO: 395779 - DNA, 20 bp, human
ggagcccagacgcttctcag

SEQ ID NO: 395780 - DNA, 20 bp, human
ggctcagtgcccaactccga

SEQ ID NO: 395781 - DNA, 20 bp, human
gctggagggcgtggggactt

SEQ ID NO: 395782 - DNA, 20 bp, human
gtcccgcccaagcaggggtc

SEQ ID NO: 395783 - DNA, 20 bp, human
gctgacgggtggacaagggg

SEQ ID NO: 395784 - DNA, 20 bp, human
gtgttaaccggggttttcgg

SEQ ID NO: 395785 - DNA, 20 bp, human
gcgggagccgctgttaaccg

SEQ ID NO: 395786 - DNA, 20 bp, human
gaccataagctactgttgtc

SEQ ID NO: 395787 - DNA, 20 bp, human
gaggcgagccccaatttagg

SEQ ID NO: 395788 - DNA, 20 bp, human
gagccccaatttaggaggtt

SEQ ID NO: 395789 - DNA, 20 bp, human
gcaatgcttttggaccttga

SEQ ID NO: 395790 - DNA, 20 bp, human
gagagtatttggttgcctaa

SEQ ID NO: 395791 - DNA, 20 bp, human
gcacaggcgagccccaattt

SEQ ID NO: 395792 - DNA, 20 bp, human
gcccaatttaggaggttagg

SEQ ID NO: 395793 - DNA, 20 bp, human
gcatgagttgccatcttctc

SEQ ID NO: 395794 - DNA, 20 bp, human
gggttaggaggtcagtgcta

SEQ ID NO: 395795 - DNA, 20 bp, human
gagcattttagaggcttctc

SEQ ID NO: 395796 - DNA, 20 bp, human
gactgggcatgatctgtcca

SEQ ID NO: 395797 - DNA, 20 bp, human
ggggccttgctgtctttcct

SEQ ID NO: 395798 - DNA, 20 bp, human
gctgggaagtcggtgctaag

SEQ ID NO: 395799 - DNA, 20 bp, human
gaaactcacgttacagcact

SEQ ID NO: 395800 - DNA, 20 bp, human
gatgatttactcataagaac

SEQ ID NO: 395801 - DNA, 20 bp, human
gagggttgtcaatgtcattt

SEQ ID NO: 395802 - DNA, 20 bp, human
gtgtcatttcggcatttcag

SEQ ID NO: 395803 - DNA, 20 bp, human
ggccccaatttcttgccagc

SEQ ID NO: 395804 - DNA, 20 bp, human
gattggtatcctatgttcca

SEQ ID NO: 395805 - DNA, 20 bp, human
gtagcttatagtctctgcct

SEQ ID NO: 395806 - DNA, 20 bp, human
gttatggtcttcgccttgga

SEQ ID NO: 395807 - DNA, 20 bp, human
gctcccaactggcaagaaac

SEQ ID NO: 395808 - DNA, 20 bp, human
gtagattatggtcttcgcct

SEQ ID NO: 395809 - DNA, 20 bp, human
gttagcactgacctcccaac

SEQ ID NO: 395810 - DNA, 20 bp, human
gattggcatctcatgttcca

SEQ ID NO: 395811 - DNA, 20 bp, human
gagggttgtcaatctcattt

SEQ ID NO: 395812 - DNA, 20 bp, human
gaagtccctggtatggtcca

SEQ ID NO: 395813 - DNA, 20 bp, human
ggcctccatggaccatacca

SEQ ID NO: 395814 - DNA, 20 bp, human
gtccctggtatggtccatgg

SEQ ID NO: 395815 - DNA, 20 bp, human
gattgacaaccctgcctcca

SEQ ID NO: 395816 - DNA, 20 bp, human
gtgaccctgtgctcactctg

SEQ ID NO: 395817 - DNA, 20 bp, human
ggcagagagcatatgactgg

SEQ ID NO: 395818 - DNA, 20 bp, human
gccagcagagagcatatgac

SEQ ID NO: 395819 - DNA, 20 bp, human
gtcatgatcggtcttttcca

SEQ ID NO: 395820 - DNA, 20 bp, human
gagcatatgactgggggcta

SEQ ID NO: 395821 - DNA, 20 bp, human
gtatcactgtttttcactgt

SEQ ID NO: 395822 - DNA, 20 bp, human
gagctgctgcctgataaaca

SEQ ID NO: 395823 - DNA, 20 bp, human
gatggttaataattaactag

SEQ ID NO: 395824 - DNA, 20 bp, human
gctttctctgaacagcgtgg

SEQ ID NO: 395825 - DNA, 20 bp, human
ggttaataattaactagagg

SEQ ID NO: 395826 - DNA, 20 bp, human
ggggttgggcccataacgaa

SEQ ID NO: 395827 - DNA, 20 bp, human
gtcagcagagaacatgtggt

SEQ ID NO: 395828 - DNA, 20 bp, human
gtacatgctgatttgctagg

SEQ ID NO: 395829 - DNA, 20 bp, human
gtataactgcctttcgttat

SEQ ID NO: 395830 - DNA, 20 bp, human
gataaaaaaaagctccgggg

SEQ ID NO: 395831 - DNA, 20 bp, human
gaattcccaacacaaggctg

SEQ ID NO: 395832 - DNA, 20 bp, human
gatatggttaacagagtaga

SEQ ID NO: 395833 - DNA, 20 bp, human
gaaggcagttatagattaat

SEQ ID NO: 395834 - DNA, 20 bp, human
ggaacttggatgttccccag

SEQ ID NO: 395835 - DNA, 20 bp, human
gacattcagcagagaacatg

SEQ ID NO: 395836 - DNA, 20 bp, human
ggccctagtccccaaccata

SEQ ID NO: 395837 - DNA, 20 bp, human
gcagcagagaccatatggtt

SEQ ID NO: 395838 - DNA, 20 bp, human
gtataattgtcttgcattat

SEQ ID NO: 395839 - DNA, 20 bp, human
ggtgctgtgttacccatatg

SEQ ID NO: 395840 - DNA, 20 bp, human
gtattaagagttagcaaata

SEQ ID NO: 395841 - DNA, 20 bp, human
gtactctttcttcccacata

SEQ ID NO: 395842 - DNA, 20 bp, human
gctttctttaaacagggagt

SEQ ID NO: 395843 - DNA, 20 bp, human
gcaagacaattatagattaa

SEQ ID NO: 395844 - DNA, 20 bp, human
ggagacagtgacatgaaatg

SEQ ID NO: 395845 - DNA, 20 bp, human
gacatccagcagagaccata

SEQ ID NO: 395846 - DNA, 20 bp, human
gaggggccactccaaggaca

SEQ ID NO: 395847 - DNA, 20 bp, human
gcaagacctgtgtagaaact

SEQ ID NO: 395848 - DNA, 20 bp, human
gacctccggtgccaaacttg

SEQ ID NO: 395849 - DNA, 20 bp, human
ggggaccgccctcagcagtg

SEQ ID NO: 395850 - DNA, 20 bp, human
gaggtgtgcatgactagctc

SEQ ID NO: 395851 - DNA, 20 bp, human
gccccatggggaacataacc

SEQ ID NO: 395852 - DNA, 20 bp, human
ggccactccaaggacagggc

SEQ ID NO: 395853 - DNA, 20 bp, human
gtagatagcaataagactcc

SEQ ID NO: 395854 - DNA, 20 bp, human
gtggcaccggaggtgttctg

SEQ ID NO: 395855 - DNA, 20 bp, human
ggattagaggggccactcca

SEQ ID NO: 395856 - DNA, 20 bp, human
gaattggcagggggtcctca

SEQ ID NO: 395857 - DNA, 20 bp, human
gatgaggaatccagcaagtt

SEQ ID NO: 395858 - DNA, 20 bp, human
gtcgggatagagaattggca

SEQ ID NO: 395859 - DNA, 20 bp, human
ggagaaacacccagaagctc

SEQ ID NO: 395860 - DNA, 20 bp, human
gacagacaacgtcaatgatg

SEQ ID NO: 395861 - DNA, 20 bp, human
gtgacttggagagacccctg

SEQ ID NO: 395862 - DNA, 20 bp, human
gaagctgacacggccatagt

SEQ ID NO: 395863 - DNA, 20 bp, human
gttgctataacttttcagag

SEQ ID NO: 395864 - DNA, 20 bp, human
gtgggttcttacatatcaaa

SEQ ID NO: 395865 - DNA, 20 bp, human
gcaacactttgaagatgact

SEQ ID NO: 395866 - DNA, 20 bp, human
gtaagcaggtatctcagcaa

SEQ ID NO: 395867 - DNA, 20 bp, human
gagaacctgccctcaaaaga

SEQ ID NO: 395868 - DNA, 20 bp, human
gagtacacgccttcttttga

SEQ ID NO: 395869 - DNA, 20 bp, human
gtaactcatcatctttgcct

SEQ ID NO: 395870 - DNA, 20 bp, human
gttcttgaaaacatataagc

SEQ ID NO: 395871 - DNA, 20 bp, human
gcttccacttactatattat

SEQ ID NO: 395872 - DNA, 20 bp, human
gcacgccttcttttgagggc

SEQ ID NO: 395873 - DNA, 20 bp, human
gacgacattgaaagataaaa

SEQ ID NO: 395874 - DNA, 20 bp, human
gttatctttcaatgtcgtca

SEQ ID NO: 395875 - DNA, 20 bp, human
gagggcatgatctgtcccca

SEQ ID NO: 395876 - DNA, 20 bp, human
gaaaagctgtcagtccacaa

SEQ ID NO: 395877 - DNA, 20 bp, human
ggtggagtgggcactcttac

SEQ ID NO: 395878 - DNA, 20 bp, human
gtaggcaacaacagttgaac

SEQ ID NO: 395879 - DNA, 20 bp, human
gtgtacccccgctttcgcca

SEQ ID NO: 395880 - DNA, 20 bp, human
gactatgtagtgaacaagtt

SEQ ID NO: 395881 - DNA, 20 bp, human
gtcagtccacaaaggtagca

SEQ ID NO: 395882 - DNA, 20 bp, human
gttaatggatcctgaggttc

SEQ ID NO: 395883 - DNA, 20 bp, human
gagtgagcaggcagtaccgg

SEQ ID NO: 395884 - DNA, 20 bp, human
gcctctctggtaacacttgt

SEQ ID NO: 395885 - DNA, 20 bp, human
gtcaagaccccacactgtgc

SEQ ID NO: 395886 - DNA, 20 bp, human
gaccataagctactgttgtc

SEQ ID NO: 395887 - DNA, 20 bp, human
gaggcgagccccaatttagg

SEQ ID NO: 395888 - DNA, 20 bp, human
gagccccaatttaggaggtt

SEQ ID NO: 395889 - DNA, 20 bp, human
gcaatgcttttggaccttga

SEQ ID NO: 395890 - DNA, 20 bp, human
gagagtatttggttgcctaa

SEQ ID NO: 395891 - DNA, 20 bp, human
gcacaggcgagccccaattt

SEQ ID NO: 395892 - DNA, 20 bp, human
gcccaatttaggaggttagg

SEQ ID NO: 395893 - DNA, 20 bp, human
gcatgagttgccatcttctc

SEQ ID NO: 395894 - DNA, 20 bp, human
gggttaggaggtcagtgcta

SEQ ID NO: 395895 - DNA, 20 bp, human
gagcattttagaggcttctc

SEQ ID NO: 395896 - DNA, 20 bp, human
gtcagggcaaatagttgcta

SEQ ID NO: 395897 - DNA, 20 bp, human
gtgcttcacagtgtagtggg

SEQ ID NO: 395898 - DNA, 20 bp, human
gtacttggttagttggggta

SEQ ID NO: 395899 - DNA, 20 bp, human
gttgctagggaaccaacaga

SEQ ID NO: 395900 - DNA, 20 bp, human
gaggttacacctttgacaaa

SEQ ID NO: 395901 - DNA, 20 bp, human
gatctgcttcacagtgtagt

SEQ ID NO: 395902 - DNA, 20 bp, human
gctggcatacttggttagtt

SEQ ID NO: 395903 - DNA, 20 bp, human
gcaaaggtgtaaccttctgt

SEQ ID NO: 395904 - DNA, 20 bp, human
gcaaggatggtgcataatga

SEQ ID NO: 395905 - DNA, 20 bp, human
gaattttgcatttactatca

SEQ ID NO: 395906 - DNA, 20 bp, human
gtcagggcaaatagttgcta

SEQ ID NO: 395907 - DNA, 20 bp, human
gtgcttcacagtgtagtggg

SEQ ID NO: 395908 - DNA, 20 bp, human
gtacttggttagttggggta

SEQ ID NO: 395909 - DNA, 20 bp, human
gttgctagggaaccaacaga

SEQ ID NO: 395910 - DNA, 20 bp, human
gaggttacacctttgacaaa

SEQ ID NO: 395911 - DNA, 20 bp, human
gatctgcttcacagtgtagt

SEQ ID NO: 395912 - DNA, 20 bp, human
gctggcatacttggttagtt

SEQ ID NO: 395913 - DNA, 20 bp, human
gcaaaggtgtaaccttctgt

SEQ ID NO: 395914 - DNA, 20 bp, human
gcaaggatggtgcataatga

SEQ ID NO: 395915 - DNA, 20 bp, human
gaattttgcatttactatca

SEQ ID NO: 395916 - DNA, 20 bp, human
ggctcacaaggacaatacaa

SEQ ID NO: 395917 - DNA, 20 bp, human
gccaaggcatcagatggttt

SEQ ID NO: 395918 - DNA, 20 bp, human
gcaaaaaaatgcaatgtatc

SEQ ID NO: 395919 - DNA, 20 bp, human
gtgatgccttggacttagtg

SEQ ID NO: 395920 - DNA, 20 bp, human
gccagtttaacatgtactga

SEQ ID NO: 395921 - DNA, 20 bp, human
ggttttgtagttactaagca

SEQ ID NO: 395922 - DNA, 20 bp, human
gtaaatatacttttattacc

SEQ ID NO: 395923 - DNA, 20 bp, human
gttttctttatcatcaatcc

SEQ ID NO: 395924 - DNA, 20 bp, human
gttttaagagtaaagttcac

SEQ ID NO: 395925 - DNA, 20 bp, human
gttaataaggcatttgactt

SEQ ID NO: 395926 - DNA, 20 bp, human
gtggatgcagaaatttggtg

SEQ ID NO: 395927 - DNA, 20 bp, human
ggagatgagaactaatacac

SEQ ID NO: 395928 - DNA, 20 bp, human
gtaatatatttactttggat

SEQ ID NO: 395929 - DNA, 20 bp, human
gatatcttgtaaatctttgt

SEQ ID NO: 395930 - DNA, 20 bp, human
gtctgtgtcaagggctctgc

SEQ ID NO: 395931 - DNA, 20 bp, human
gcttgacactattataaagt

SEQ ID NO: 395932 - DNA, 20 bp, human
gataaaactgattgttacgt

SEQ ID NO: 395933 - DNA, 20 bp, human
gtatatttactttggattgg

SEQ ID NO: 395934 - DNA, 20 bp, human
gaagtaggttacataaaaca

SEQ ID NO: 395935 - DNA, 20 bp, human
gtcctataatatatttactt

SEQ ID NO: 395936 - DNA, 20 bp, human
gtctgaataggtgcatgcca

SEQ ID NO: 395937 - DNA, 20 bp, human
ggaggtcatcaatcttttgt

SEQ ID NO: 395938 - DNA, 20 bp, human
gtaatactaacagtctgaat

SEQ ID NO: 395939 - DNA, 20 bp, human
gataatactgattattgtag

SEQ ID NO: 395940 - DNA, 20 bp, human
gagtaattatacaactcaaa

SEQ ID NO: 395941 - DNA, 20 bp, human
ggatgcaaaatttcagagtg

SEQ ID NO: 395942 - DNA, 20 bp, human
gtttcagagtggggggttag

SEQ ID NO: 395943 - DNA, 20 bp, human
ggctattgtatagaatcttt

SEQ ID NO: 395944 - DNA, 20 bp, human
gtatgtcaagggcaccgaac

SEQ ID NO: 395945 - DNA, 20 bp, human
gtcaagggcaccgaacaggc

SEQ ID NO: 395946 - DNA, 20 bp, human
ggcaccacgatattaaaaaa

SEQ ID NO: 395947 - DNA, 20 bp, human
gtggatgcaaaatttcagag

SEQ ID NO: 395948 - DNA, 20 bp, human
gtcccatctgccatgatcac

SEQ ID NO: 395949 - DNA, 20 bp, human
ggagggttttccagtgatca

SEQ ID NO: 395950 - DNA, 20 bp, human
gtgcaaaatttcagagtggg

SEQ ID NO: 395951 - DNA, 20 bp, human
gttccagtgatcatggcaga

SEQ ID NO: 395952 - DNA, 20 bp, human
gtttgcatccatcctaccct

SEQ ID NO: 395953 - DNA, 20 bp, human
gtctatagattagcattttc

SEQ ID NO: 395954 - DNA, 20 bp, human
ggtggttgcctagggtagga

SEQ ID NO: 395955 - DNA, 20 bp, human
gtttcagagtggggggttag

SEQ ID NO: 395956 - DNA, 20 bp, human
gtaaacgcacttgtgtaaac

SEQ ID NO: 395957 - DNA, 20 bp, human
gcagctaatatcaatgatct

SEQ ID NO: 395958 - DNA, 20 bp, human
ggggtttcactgtattcggc

SEQ ID NO: 395959 - DNA, 20 bp, human
ggcacttaaaaatctagggc

SEQ ID NO: 395960 - DNA, 20 bp, human
gcttcttgactgatttatac

SEQ ID NO: 395961 - DNA, 20 bp, human
gtgacaaagagacaaataaa

SEQ ID NO: 395962 - DNA, 20 bp, human
gtacagcacttaaaaatcta

SEQ ID NO: 395963 - DNA, 20 bp, human
ggcataagagtagcagtgag

SEQ ID NO: 395964 - DNA, 20 bp, human
ggaaatatattacatgagtc

SEQ ID NO: 395965 - DNA, 20 bp, human
ggtgcgtttaatgttctttt

SEQ ID NO: 395966 - DNA, 20 bp, human
gatggcaaagagacaaatga

SEQ ID NO: 395967 - DNA, 20 bp, human
gaggggaaatgcagaaacta

SEQ ID NO: 395968 - DNA, 20 bp, human
ggaaatgcagaaactagggg

SEQ ID NO: 395969 - DNA, 20 bp, human
ggctctccaactgattgtta

SEQ ID NO: 395970 - DNA, 20 bp, human
gtctgtcactgctactgttc

SEQ ID NO: 395971 - DNA, 20 bp, human
ggatccttgatattagctga

SEQ ID NO: 395972 - DNA, 20 bp, human
ggaaaaaggctaaggactat

SEQ ID NO: 395973 - DNA, 20 bp, human
gtatccttcagctaatatca

SEQ ID NO: 395974 - DNA, 20 bp, human
gatatattgcataagacaga

SEQ ID NO: 395975 - DNA, 20 bp, human
gtaatatcaaggatcttgta

SEQ ID NO: 395976 - DNA, 20 bp, human
gcagagaaaggttacagatc

SEQ ID NO: 395977 - DNA, 20 bp, human
gacctgaagtcagtaggagg

SEQ ID NO: 395978 - DNA, 20 bp, human
gtaatcacagctgtcctatc

SEQ ID NO: 395979 - DNA, 20 bp, human
ggaagtcagtaggagggggt

SEQ ID NO: 395980 - DNA, 20 bp, human
gtgattacgcaggcagagaa

SEQ ID NO: 395981 - DNA, 20 bp, human
gaggtagtttgatagggtga

SEQ ID NO: 395982 - DNA, 20 bp, human
gcaaactacctgaagtcagt

SEQ ID NO: 395983 - DNA, 20 bp, human
ggtgagggcagattatccca

SEQ ID NO: 395984 - DNA, 20 bp, human
gaaagacaggtggtttcctt

SEQ ID NO: 395985 - DNA, 20 bp, human
gtgacttcaggtagtttgat

SEQ ID NO: 395986 - DNA, 20 bp, human
ggcagagcagggttaagtat

SEQ ID NO: 395987 - DNA, 20 bp, human
gaggagggctgtgatcacaa

SEQ ID NO: 395988 - DNA, 20 bp, human
ggacccctcctactgactgc

SEQ ID NO: 395989 - DNA, 20 bp, human
gctactgactgctggtagtt

SEQ ID NO: 395990 - DNA, 20 bp, human
gccttactgtgagtgaggaa

SEQ ID NO: 395991 - DNA, 20 bp, human
ggtaatagaggcagttagaa

SEQ ID NO: 395992 - DNA, 20 bp, human
gcaatggagcacgagggagg

SEQ ID NO: 395993 - DNA, 20 bp, human
gaaaatccttactgtgagtg

SEQ ID NO: 395994 - DNA, 20 bp, human
gcctggaagggaatccccaa

SEQ ID NO: 395995 - DNA, 20 bp, human
gtggcgcactgaggtgcaca

SEQ ID NO: 395996 - DNA, 20 bp, human
gctcgcaaagagggaagagt

SEQ ID NO: 395997 - DNA, 20 bp, human
gtggaggcgctcgcagtcag

SEQ ID NO: 395998 - DNA, 20 bp, human
gggcacagggactacgtggg

SEQ ID NO: 395999 - DNA, 20 bp, human
ggtcagaggcgagtgatgct

SEQ ID NO: 396000 - DNA, 20 bp, human
gcgcaactcgagcgcccaga

SEQ ID NO: 396001 - DNA, 20 bp, human
gtgcgtgcggcgagcagagt

SEQ ID NO: 396002 - DNA, 20 bp, human
ggggcaaggggcagcgcgtt

SEQ ID NO: 396003 - DNA, 20 bp, human
ggccaagtgcggaagggcag

SEQ ID NO: 396004 - DNA, 20 bp, human
gctgcgagcgcgtggtacga

SEQ ID NO: 396005 - DNA, 20 bp, human
ggagccgccttgatgataaa

SEQ ID NO: 396006 - DNA, 20 bp, human
gatacaggccgaaggagggg

SEQ ID NO: 396007 - DNA, 20 bp, human
ggaggaagagcctatcatac

SEQ ID NO: 396008 - DNA, 20 bp, human
gtgtgaaagcggttaacact

SEQ ID NO: 396009 - DNA, 20 bp, human
gtcccagaagccggaaatgg

SEQ ID NO: 396010 - DNA, 20 bp, human
gagaagagattagacgcgct

SEQ ID NO: 396011 - DNA, 20 bp, human
gggttcctagtggtgaggta

SEQ ID NO: 396012 - DNA, 20 bp, human
gagattagacgcgctaggtt

SEQ ID NO: 396013 - DNA, 20 bp, human
gcccccgtgtcgccaaccat

SEQ ID NO: 396014 - DNA, 20 bp, human
gaccgtggacctggaggtga

SEQ ID NO: 396015 - DNA, 20 bp, human
gctccttcggcctgtatgat

SEQ ID NO: 396016 - DNA, 20 bp, human
ggccgtggcccactaggcgg

SEQ ID NO: 396017 - DNA, 20 bp, human
ggcgcccagcagagcgcgca

SEQ ID NO: 396018 - DNA, 20 bp, human
gaggcggctcaagtgaaggg

SEQ ID NO: 396019 - DNA, 20 bp, human
gggagccgtggcccactagg

SEQ ID NO: 396020 - DNA, 20 bp, human
gcagccctgcgcgctctgct

SEQ ID NO: 396021 - DNA, 20 bp, human
gtgcgcgcgtggcccggctg

SEQ ID NO: 396022 - DNA, 20 bp, human
gagccgccggggaggatgtc

SEQ ID NO: 396023 - DNA, 20 bp, human
gaagaggcggctcaagtgaa

SEQ ID NO: 396024 - DNA, 20 bp, human
gcccgccgccgggactacag

SEQ ID NO: 396025 - DNA, 20 bp, human
gcacggcgcctccgcctagt

SEQ ID NO: 396026 - DNA, 20 bp, human
gaggcggacgggagcgcgga

SEQ ID NO: 396027 - DNA, 20 bp, human
gcacccgccggccttgcttg

SEQ ID NO: 396028 - DNA, 20 bp, human
gcagaggcgcgcgcggtgag

SEQ ID NO: 396029 - DNA, 20 bp, human
ggcgctcccgtccgcctctc

SEQ ID NO: 396030 - DNA, 20 bp, human
ggaagcgtttcagacccgag

SEQ ID NO: 396031 - DNA, 20 bp, human
gggaaccgcacacccctcag

SEQ ID NO: 396032 - DNA, 20 bp, human
gtcagacccgagaggcggac

SEQ ID NO: 396033 - DNA, 20 bp, human
gtggccgccgcaagcaaggc

SEQ ID NO: 396034 - DNA, 20 bp, human
gcctctggccgccgcaagca

SEQ ID NO: 396035 - DNA, 20 bp, human
ggcgctggtgggtgggatcg

SEQ ID NO: 396036 - DNA, 20 bp, human
gcaagggccctgtgtcgcga

SEQ ID NO: 396037 - DNA, 20 bp, human
gatggtgtattgagagtcaa

SEQ ID NO: 396038 - DNA, 20 bp, human
ggaggcgggaacaccagcag

SEQ ID NO: 396039 - DNA, 20 bp, human
gtcgcgagggctaagaaccc

SEQ ID NO: 396040 - DNA, 20 bp, human
gaacccggagcatcacgctc

SEQ ID NO: 396041 - DNA, 20 bp, human
ggccctccaccgagtctctt

SEQ ID NO: 396042 - DNA, 20 bp, human
gcggggccaacgccggctct

SEQ ID NO: 396043 - DNA, 20 bp, human
ggggaggattaaggccaaga

SEQ ID NO: 396044 - DNA, 20 bp, human
gggcgggaggtttgtggcat

SEQ ID NO: 396045 - DNA, 20 bp, human
gtccaggcggggccggcacg

SEQ ID NO: 396046 - DNA, 20 bp, human
ggagagggttacagacccga

SEQ ID NO: 396047 - DNA, 20 bp, human
gtggccaggtgcaggcggtg

SEQ ID NO: 396048 - DNA, 20 bp, human
ggacccgagggaacgaaaat

SEQ ID NO: 396049 - DNA, 20 bp, human
gaaaatgggcaggcgcggag

SEQ ID NO: 396050 - DNA, 20 bp, human
ggggtctgtaaccctctccc

SEQ ID NO: 396051 - DNA, 20 bp, human
ggtgcccagtggccaggtgc

SEQ ID NO: 396052 - DNA, 20 bp, human
gcaggcggtggggcaagtaa

SEQ ID NO: 396053 - DNA, 20 bp, human
gcgagggaacgaaaatgggc

SEQ ID NO: 396054 - DNA, 20 bp, human
ggggcacgccctctagcctt

SEQ ID NO: 396055 - DNA, 20 bp, human
ggaacgaaaatgggcaggcg

SEQ ID NO: 396056 - DNA, 20 bp, human
gaaggtgcgagccggctcac

SEQ ID NO: 396057 - DNA, 20 bp, human
ggcgctgaccgcccgtgagc

SEQ ID NO: 396058 - DNA, 20 bp, human
gacccccggcaacccggaga

SEQ ID NO: 396059 - DNA, 20 bp, human
ggacgtaccaactgcgcggg

SEQ ID NO: 396060 - DNA, 20 bp, human
gcgggacgtaccaactgcgc

SEQ ID NO: 396061 - DNA, 20 bp, human
gagccggctcgcaccttgcg

SEQ ID NO: 396062 - DNA, 20 bp, human
ggtgcgagccggctcacggg

SEQ ID NO: 396063 - DNA, 20 bp, human
gcgccccgagagcgtgtctc

SEQ ID NO: 396064 - DNA, 20 bp, human
ggcagttggtacgtcccgga

SEQ ID NO: 396065 - DNA, 20 bp, human
gtcagcgcctcccgcgcagt

SEQ ID NO: 396066 - DNA, 20 bp, human
gagcccggggcgtgacgggg

SEQ ID NO: 396067 - DNA, 20 bp, human
gcgggctcgtcatctgacag

SEQ ID NO: 396068 - DNA, 20 bp, human
gcgccgccaccaagccgcgg

SEQ ID NO: 396069 - DNA, 20 bp, human
gtgacgagcccggggcgtga

SEQ ID NO: 396070 - DNA, 20 bp, human
ggggccatggaaggaacgga

SEQ ID NO: 396071 - DNA, 20 bp, human
ggccgcgcgcagggatacac

SEQ ID NO: 396072 - DNA, 20 bp, human
gccaagccgcgggggcgggt

SEQ ID NO: 396073 - DNA, 20 bp, human
gctccaccccgtcacgcccc

SEQ ID NO: 396074 - DNA, 20 bp, human
gctaggcatgcacttttttg

SEQ ID NO: 396075 - DNA, 20 bp, human
gacggcgtcctggcccgctc

SEQ ID NO: 396076 - DNA, 20 bp, human
gccagacaccaacccgaagg

SEQ ID NO: 396077 - DNA, 20 bp, human
gacaaaggggagggacgccc

SEQ ID NO: 396078 - DNA, 20 bp, human
ggggagggacgcccgggaag

SEQ ID NO: 396079 - DNA, 20 bp, human
gggcgcgcccgtacataggg

SEQ ID NO: 396080 - DNA, 20 bp, human
gcgaagggggttgggacaaa

SEQ ID NO: 396081 - DNA, 20 bp, human
ggaaggggagggacaccgtc

SEQ ID NO: 396082 - DNA, 20 bp, human
ggggggcgcgcccgtacata

SEQ ID NO: 396083 - DNA, 20 bp, human
gaactggcgcagtagtggag

SEQ ID NO: 396084 - DNA, 20 bp, human
gacctcgcggcgcaggcgga

SEQ ID NO: 396085 - DNA, 20 bp, human
gacgcggctagaaatatgat

SEQ ID NO: 396086 - DNA, 20 bp, human
gagcccggggcgggacgaag

SEQ ID NO: 396087 - DNA, 20 bp, human
ggggacggggcgggataggg

SEQ ID NO: 396088 - DNA, 20 bp, human
ggctgtcaggccacgagccc

SEQ ID NO: 396089 - DNA, 20 bp, human
gacagcaggcataggctccc

SEQ ID NO: 396090 - DNA, 20 bp, human
gtcaggccacgagcccgggg

SEQ ID NO: 396091 - DNA, 20 bp, human
ggcggagccacagcaggcat

SEQ ID NO: 396092 - DNA, 20 bp, human
gtcgtcccgccccgggctcg

SEQ ID NO: 396093 - DNA, 20 bp, human
ggctccgcttcgtcccgccc

SEQ ID NO: 396094 - DNA, 20 bp, human
gacgcctgcccacgtttgga

SEQ ID NO: 396095 - DNA, 20 bp, human
gctcccctggatcccggggc

SEQ ID NO: 396096 - DNA, 20 bp, human
ggggccgggaggcgggatga

SEQ ID NO: 396097 - DNA, 20 bp, human
gaaggggcgtggaagggagt

SEQ ID NO: 396098 - DNA, 20 bp, human
ggggcgtgacgaacagacgg

SEQ ID NO: 396099 - DNA, 20 bp, human
gtctctgctctcaccggggc

SEQ ID NO: 396100 - DNA, 20 bp, human
ggctgggccgggccattgcg

SEQ ID NO: 396101 - DNA, 20 bp, human
ggcggctgcgcgggcgtctc

SEQ ID NO: 396102 - DNA, 20 bp, human
gagcccacccggccccgcaa

SEQ ID NO: 396103 - DNA, 20 bp, human
gcagagaggcgcgctgaccc

SEQ ID NO: 396104 - DNA, 20 bp, human
ggtgacgaacagacgggggg

SEQ ID NO: 396105 - DNA, 20 bp, human
ggacccgggagcgggccacg

SEQ ID NO: 396106 - DNA, 20 bp, human
gctggagcccggggcgtggt

SEQ ID NO: 396107 - DNA, 20 bp, human
ggctcctgaggcggggacga

SEQ ID NO: 396108 - DNA, 20 bp, human
ggggctgcgggctccgttct

SEQ ID NO: 396109 - DNA, 20 bp, human
gcgacccgctgcggccacag

SEQ ID NO: 396110 - DNA, 20 bp, human
gtgcggccacagcgggttac

SEQ ID NO: 396111 - DNA, 20 bp, human
gggctccctccgccggggaa

SEQ ID NO: 396112 - DNA, 20 bp, human
gcgaagggcgcgacccgctg

SEQ ID NO: 396113 - DNA, 20 bp, human
gcggctcgaatctgctcccc

SEQ ID NO: 396114 - DNA, 20 bp, human
gctcggccgctcctgaggcg

SEQ ID NO: 396115 - DNA, 20 bp, human
gtctgaagtccgcctcccag

SEQ ID NO: 396116 - DNA, 20 bp, human
gggcccacgtggggatacgg

SEQ ID NO: 396117 - DNA, 20 bp, human
gggcctccgtatccccacgt

SEQ ID NO: 396118 - DNA, 20 bp, human
gacggccggcgtggtctccg

SEQ ID NO: 396119 - DNA, 20 bp, human
ggcagcgcgcatcggggacg

SEQ ID NO: 396120 - DNA, 20 bp, human
gcagggcccacgtggggata

SEQ ID NO: 396121 - DNA, 20 bp, human
gcgagcctagaagttaacaa

SEQ ID NO: 396122 - DNA, 20 bp, human
ggtctccggggactcctagc

SEQ ID NO: 396123 - DNA, 20 bp, human
gtgcgcccgctaggagtccc

SEQ ID NO: 396124 - DNA, 20 bp, human
gggaaatgcagcgcgcatcg

SEQ ID NO: 396125 - DNA, 20 bp, human
ggggcagcccacaggattag

SEQ ID NO: 396126 - DNA, 20 bp, human
ggaggggcgtcgcctccgta

SEQ ID NO: 396127 - DNA, 20 bp, human
gtggacgaatccaaacctgg

SEQ ID NO: 396128 - DNA, 20 bp, human
gaagccgaccagccttacgg

SEQ ID NO: 396129 - DNA, 20 bp, human
gcggaagtgagagaccacga

SEQ ID NO: 396130 - DNA, 20 bp, human
gaagaagccgaccagcctta

SEQ ID NO: 396131 - DNA, 20 bp, human
gtcgcctccgtaaggctggt

SEQ ID NO: 396132 - DNA, 20 bp, human
gagaacgccggaagaagctc

SEQ ID NO: 396133 - DNA, 20 bp, human
gtggacctgtcctgaggcag

SEQ ID NO: 396134 - DNA, 20 bp, human
ggcccctccctccacccaaa

SEQ ID NO: 396135 - DNA, 20 bp, human
gtgctgccgtggaaaccgta

SEQ ID NO: 396136 - DNA, 20 bp, human
gcccccaatgtcaatcattt

SEQ ID NO: 396137 - DNA, 20 bp, human
gcaggtgcacctcccatctg

SEQ ID NO: 396138 - DNA, 20 bp, human
gaccccaaatgattgacatt

SEQ ID NO: 396139 - DNA, 20 bp, human
gagaactagagactaattgg

SEQ ID NO: 396140 - DNA, 20 bp, human
gtcactgacaagggcagggt

SEQ ID NO: 396141 - DNA, 20 bp, human
gaaggtgctgggcttcttct

SEQ ID NO: 396142 - DNA, 20 bp, human
gtcttcttggtcactgacaa

SEQ ID NO: 396143 - DNA, 20 bp, human
gaactgggaaagcagtgcca

SEQ ID NO: 396144 - DNA, 20 bp, human
gttgccttgtccaagctgtg

SEQ ID NO: 396145 - DNA, 20 bp, human
gatgggaggtgcacctgtct

SEQ ID NO: 396146 - DNA, 20 bp, human
gcaagactgggatgttggtg

SEQ ID NO: 396147 - DNA, 20 bp, human
gtaaagtcccagcaaaacaa

SEQ ID NO: 396148 - DNA, 20 bp, human
gggagccaagactgggatgt

SEQ ID NO: 396149 - DNA, 20 bp, human
gccaggaggtgtcacttata

SEQ ID NO: 396150 - DNA, 20 bp, human
gcctgtgaacagagatggat

SEQ ID NO: 396151 - DNA, 20 bp, human
ggatgttggtgaggtaagga

SEQ ID NO: 396152 - DNA, 20 bp, human
ggaattggggagccaagact

SEQ ID NO: 396153 - DNA, 20 bp, human
gtatagtatacaactccagg

SEQ ID NO: 396154 - DNA, 20 bp, human
gactgcagcccttgttttgc

SEQ ID NO: 396155 - DNA, 20 bp, human
gtccagaacactattccatc

SEQ ID NO: 396156 - DNA, 20 bp, human
ggactcgcaggggcggagaa

SEQ ID NO: 396157 - DNA, 20 bp, human
gactggggcgggactcgcag

SEQ ID NO: 396158 - DNA, 20 bp, human
gtcgcaggggcggagaaggg

SEQ ID NO: 396159 - DNA, 20 bp, human
ggagacgctcagtgcacgtg

SEQ ID NO: 396160 - DNA, 20 bp, human
ggcgagtcccgccccagttc

SEQ ID NO: 396161 - DNA, 20 bp, human
ggtgagaagagccaatggag

SEQ ID NO: 396162 - DNA, 20 bp, human
gtcagtgcacgtggggtgtg

SEQ ID NO: 396163 - DNA, 20 bp, human
gggcggagaaggggggagac

SEQ ID NO: 396164 - DNA, 20 bp, human
gtggcagagaaaccagggag

SEQ ID NO: 396165 - DNA, 20 bp, human
gcacccctaaccgacgtcct

SEQ ID NO: 396166 - DNA, 20 bp, human
gggaagaggcgggacttcgc

SEQ ID NO: 396167 - DNA, 20 bp, human
gttccccgggctcaagggtc

SEQ ID NO: 396168 - DNA, 20 bp, human
gaggcagcgcgcgacaatgg

SEQ ID NO: 396169 - DNA, 20 bp, human
gtgagcccggggaaacccac

SEQ ID NO: 396170 - DNA, 20 bp, human
gcccgggctcaagggtcagg

SEQ ID NO: 396171 - DNA, 20 bp, human
ggcctcgtctgcagctttcc

SEQ ID NO: 396172 - DNA, 20 bp, human
gcccacgggtgcagcaagcc

SEQ ID NO: 396173 - DNA, 20 bp, human
gacttcgcgggtgacgtcat

SEQ ID NO: 396174 - DNA, 20 bp, human
gtcccggcttgctgcacccg

SEQ ID NO: 396175 - DNA, 20 bp, human
gagaagcacaaactggcgct

SEQ ID NO: 396176 - DNA, 20 bp, human
gcgcccgtcgcatttcggga

SEQ ID NO: 396177 - DNA, 20 bp, human
gcaaccctcccgaaatgcga

SEQ ID NO: 396178 - DNA, 20 bp, human
ggcgcgggggatgggagtcg

SEQ ID NO: 396179 - DNA, 20 bp, human
gcggggcggggcagtacctg

SEQ ID NO: 396180 - DNA, 20 bp, human
gcccgcgcccgtcgcatttc

SEQ ID NO: 396181 - DNA, 20 bp, human
gaaaaacagaatgaagccca

SEQ ID NO: 396182 - DNA, 20 bp, human
gtacctggggccccggccgg

SEQ ID NO: 396183 - DNA, 20 bp, human
gtcttgtactggtactagtg

SEQ ID NO: 396184 - DNA, 20 bp, human
gaccctgagcctggaactca

SEQ ID NO: 396185 - DNA, 20 bp, human
gcggatgctcccacttcccc

SEQ ID NO: 396186 - DNA, 20 bp, human
gaaattccggggcacactga

SEQ ID NO: 396187 - DNA, 20 bp, human
gggcagggaccgaaggggta

SEQ ID NO: 396188 - DNA, 20 bp, human
gcagacctagaacccctagg

SEQ ID NO: 396189 - DNA, 20 bp, human
gacccctaggtggcactatt

SEQ ID NO: 396190 - DNA, 20 bp, human
ggggaagcacagtggcgatt

SEQ ID NO: 396191 - DNA, 20 bp, human
gggccaaatagtgccaccta

SEQ ID NO: 396192 - DNA, 20 bp, human
ggacccaagggtagaaccct

SEQ ID NO: 396193 - DNA, 20 bp, human
gcctcagcatcctgtggccc

SEQ ID NO: 396194 - DNA, 20 bp, human
gagtgccacctaggggttct

SEQ ID NO: 396195 - DNA, 20 bp, human
gcagatagatggggacccaa

SEQ ID NO: 396196 - DNA, 20 bp, human
ggcagccttcgatccattca

SEQ ID NO: 396197 - DNA, 20 bp, human
gtatttggggatggaagttt

SEQ ID NO: 396198 - DNA, 20 bp, human
ggggaattccacagcccccc

SEQ ID NO: 396199 - DNA, 20 bp, human
gggctgctcatgtgcacctc

SEQ ID NO: 396200 - DNA, 20 bp, human
ggcgcggtaactatggagag

SEQ ID NO: 396201 - DNA, 20 bp, human
ggaggcggcggccatcttgg

SEQ ID NO: 396202 - DNA, 20 bp, human
gcggtaactatggagagcgg

SEQ ID NO: 396203 - DNA, 20 bp, human
ggcgggcgcccggggggctg

SEQ ID NO: 396204 - DNA, 20 bp, human
gcactcctgcggggcccggg

SEQ ID NO: 396205 - DNA, 20 bp, human
gtgctataggagtcagccca

SEQ ID NO: 396206 - DNA, 20 bp, human
ggagcccagggacgcctgat

SEQ ID NO: 396207 - DNA, 20 bp, human
ggggctgggggggcgttaaa

SEQ ID NO: 396208 - DNA, 20 bp, human
gcccctgcaacgaggaggtg

SEQ ID NO: 396209 - DNA, 20 bp, human
gcctcgttgcagggggacaa

SEQ ID NO: 396210 - DNA, 20 bp, human
gccccacacctcctcgttgc

SEQ ID NO: 396211 - DNA, 20 bp, human
gcagggacgcctgatggggc

SEQ ID NO: 396212 - DNA, 20 bp, human
gagggcctggctccgggaag

SEQ ID NO: 396213 - DNA, 20 bp, human
ggcgacggcggcccccaagc

SEQ ID NO: 396214 - DNA, 20 bp, human
ggcagggggacaaggggcga

SEQ ID NO: 396215 - DNA, 20 bp, human
gctgacgtggcgctgatgcg

SEQ ID NO: 396216 - DNA, 20 bp, human
ggaagctccgcccactaatc

SEQ ID NO: 396217 - DNA, 20 bp, human
gagtgggcggagcttccttc

SEQ ID NO: 396218 - DNA, 20 bp, human
gccccccgcgagcacgtagg

SEQ ID NO: 396219 - DNA, 20 bp, human
gggactgggcgtgagttaat

SEQ ID NO: 396220 - DNA, 20 bp, human
gcccgcgagcacgtaggagg

SEQ ID NO: 396221 - DNA, 20 bp, human
gcggatcccgggtggaatga

SEQ ID NO: 396222 - DNA, 20 bp, human
gagtaagcctgattagtggg

SEQ ID NO: 396223 - DNA, 20 bp, human
gcctgggcggagccaacccg

SEQ ID NO: 396224 - DNA, 20 bp, human
gtgcagtaagcctgattagt

SEQ ID NO: 396225 - DNA, 20 bp, human
ggggggcggggtcggtggac

SEQ ID NO: 396226 - DNA, 20 bp, human
ggcacaggacagcgacaatg

SEQ ID NO: 396227 - DNA, 20 bp, human
gacagatggagctttgcttc

SEQ ID NO: 396228 - DNA, 20 bp, human
ggacactacatggagttatg

SEQ ID NO: 396229 - DNA, 20 bp, human
gatgcttgccttggattttc

SEQ ID NO: 396230 - DNA, 20 bp, human
gtgatacttgtttacttttc

SEQ ID NO: 396231 - DNA, 20 bp, human
gatcactggaaagagcagga

SEQ ID NO: 396232 - DNA, 20 bp, human
gttttgaaacgtgttggaaa

SEQ ID NO: 396233 - DNA, 20 bp, human
ggaatacttttgaaacgtgt

SEQ ID NO: 396234 - DNA, 20 bp, human
gtgtgaaagacattctttcc

SEQ ID NO: 396235 - DNA, 20 bp, human
gagagcaggaagggcaggca

SEQ ID NO: 396236 - DNA, 20 bp, human
gtggacgcactcgaggaagt

SEQ ID NO: 396237 - DNA, 20 bp, human
ggtggctgggagggacggaa

SEQ ID NO: 396238 - DNA, 20 bp, human
gcccaggtcagcttctctca

SEQ ID NO: 396239 - DNA, 20 bp, human
gagtgcgtccagacgtgggg

SEQ ID NO: 396240 - DNA, 20 bp, human
ggggctgccaccctctgtca

SEQ ID NO: 396241 - DNA, 20 bp, human
ggccagaggagggtcctgta

SEQ ID NO: 396242 - DNA, 20 bp, human
ggtcctgtagggatcccagc

SEQ ID NO: 396243 - DNA, 20 bp, human
ggacgtgggtggtggcaagc

SEQ ID NO: 396244 - DNA, 20 bp, human
ggggacaacgctctcagcag

SEQ ID NO: 396245 - DNA, 20 bp, human
gcctacagaggccctgggaa

SEQ ID NO: 396246 - DNA, 20 bp, human
gagaggggcagggctaagga

SEQ ID NO: 396247 - DNA, 20 bp, human
gctaaggagggagcgcgccc

SEQ ID NO: 396248 - DNA, 20 bp, human
ggcgcttggctctggatcgc

SEQ ID NO: 396249 - DNA, 20 bp, human
gtcgcggcggaggacccaga

SEQ ID NO: 396250 - DNA, 20 bp, human
gcgccccactcttgcgtcgg

SEQ ID NO: 396251 - DNA, 20 bp, human
gccactcttgcgtcggaggt

SEQ ID NO: 396252 - DNA, 20 bp, human
gtgtccccgcagagacctgc

SEQ ID NO: 396253 - DNA, 20 bp, human
ggcggggcgagtctgggttc

SEQ ID NO: 396254 - DNA, 20 bp, human
gcagaagtgcacgaggtcta

SEQ ID NO: 396255 - DNA, 20 bp, human
ggtctctgcggggacagctt

SEQ ID NO: 396256 - DNA, 20 bp, human
gaaggcccggaagtggcccg

SEQ ID NO: 396257 - DNA, 20 bp, human
ggggagggattgcccggtgg

SEQ ID NO: 396258 - DNA, 20 bp, human
ggcggtcggcgtaggggagg

SEQ ID NO: 396259 - DNA, 20 bp, human
ggagcccggcggtcggcgta

SEQ ID NO: 396260 - DNA, 20 bp, human
gaccgggcaatccctcccca

SEQ ID NO: 396261 - DNA, 20 bp, human
gccggcggtcggcgtagggg

SEQ ID NO: 396262 - DNA, 20 bp, human
gtcccggggtcggacagccc

SEQ ID NO: 396263 - DNA, 20 bp, human
ggcccggggctgtccgaccc

SEQ ID NO: 396264 - DNA, 20 bp, human
ggcggtggaactttgctcgg

SEQ ID NO: 396265 - DNA, 20 bp, human
ggaggcggtggaactttgct

SEQ ID NO: 396266 - DNA, 20 bp, human
gcaccaggataacccagagt

SEQ ID NO: 396267 - DNA, 20 bp, human
gccgcccaagcaccccactc

SEQ ID NO: 396268 - DNA, 20 bp, human
ggtcagtcatgaccacgtgg

SEQ ID NO: 396269 - DNA, 20 bp, human
gtggtcatgactgaccagtc

SEQ ID NO: 396270 - DNA, 20 bp, human
gtctgggttatcctggtggg

SEQ ID NO: 396271 - DNA, 20 bp, human
ggactgaccagtctggggag

SEQ ID NO: 396272 - DNA, 20 bp, human
gtaacccagagtggggtgct

SEQ ID NO: 396273 - DNA, 20 bp, human
gctggtcagtcatgaccacg

SEQ ID NO: 396274 - DNA, 20 bp, human
ggagtctgtcactgatactc

SEQ ID NO: 396275 - DNA, 20 bp, human
gtatcagtgacagactccag

SEQ ID NO: 396276 - DNA, 20 bp, human
ggtagggccgaggactacgg

SEQ ID NO: 396277 - DNA, 20 bp, human
ggcaacacttgcaaccgggt

SEQ ID NO: 396278 - DNA, 20 bp, human
ggcctcgctcgctcccgacc

SEQ ID NO: 396279 - DNA, 20 bp, human
ggcggtagggccgaggacta

SEQ ID NO: 396280 - DNA, 20 bp, human
gagccagcggcaacaacttc

SEQ ID NO: 396281 - DNA, 20 bp, human
gttccggtcccctgagactg

SEQ ID NO: 396282 - DNA, 20 bp, human
gcggttgcaagtgttgcggt

SEQ ID NO: 396283 - DNA, 20 bp, human
gtctcggcccccgtagtcct

SEQ ID NO: 396284 - DNA, 20 bp, human
gcaagggccggctccgttga

SEQ ID NO: 396285 - DNA, 20 bp, human
gccgagaggtggcgcgtccg

SEQ ID NO: 396286 - DNA, 20 bp, human
gaaaacccggactggagcga

SEQ ID NO: 396287 - DNA, 20 bp, human
gctggagcgacggagcgggg

SEQ ID NO: 396288 - DNA, 20 bp, human
ggcctcaggcatcgcccaga

SEQ ID NO: 396289 - DNA, 20 bp, human
gctgaggctcccccagggag

SEQ ID NO: 396290 - DNA, 20 bp, human
gcggtgggcgccgcaaaacc

SEQ ID NO: 396291 - DNA, 20 bp, human
gcggactggagcgacggagc

SEQ ID NO: 396292 - DNA, 20 bp, human
gcatcgcccagagggattcc

SEQ ID NO: 396293 - DNA, 20 bp, human
gggggcaggagtctgaaacc

SEQ ID NO: 396294 - DNA, 20 bp, human
gcccgcgcgcagaggtgccc

SEQ ID NO: 396295 - DNA, 20 bp, human
gcctgtccctggagaccccg

SEQ ID NO: 396296 - DNA, 20 bp, human
ggggcctgggcgaccgaggg

SEQ ID NO: 396297 - DNA, 20 bp, human
ggccgacagggggaccttga

SEQ ID NO: 396298 - DNA, 20 bp, human
gaccgagggcggagccgaca

SEQ ID NO: 396299 - DNA, 20 bp, human
gcgcgcgcggtcccctcggt

SEQ ID NO: 396300 - DNA, 20 bp, human
ggacagggggaccttgaggg

SEQ ID NO: 396301 - DNA, 20 bp, human
ggccgcgcccagatggccgt

SEQ ID NO: 396302 - DNA, 20 bp, human
gctcgcgaggaccctccccc

SEQ ID NO: 396303 - DNA, 20 bp, human
gagcggtcgcgcaacttcgg

SEQ ID NO: 396304 - DNA, 20 bp, human
gaccttgaggggggatccga

SEQ ID NO: 396305 - DNA, 20 bp, human
gagagcgcatactacagaca

SEQ ID NO: 396306 - DNA, 20 bp, human
gcccccacttgggaagtcca

SEQ ID NO: 396307 - DNA, 20 bp, human
ggggcagagcagtcgctcgc

SEQ ID NO: 396308 - DNA, 20 bp, human
gtggccgccttgcgcctccc

SEQ ID NO: 396309 - DNA, 20 bp, human
gggcgtgagaacactgagat

SEQ ID NO: 396310 - DNA, 20 bp, human
ggcgggagacgtcagttaga

SEQ ID NO: 396311 - DNA, 20 bp, human
gcacccgtgcgccctactct

SEQ ID NO: 396312 - DNA, 20 bp, human
gctccctggacttcccaagt

SEQ ID NO: 396313 - DNA, 20 bp, human
gtccgccgcacgccgaagtc

SEQ ID NO: 396314 - DNA, 20 bp, human
gaaaggcaggggccaaaagg

SEQ ID NO: 396315 - DNA, 20 bp, human
gcgactgctctgcccccact

SEQ ID NO: 396316 - DNA, 20 bp, human
gcctcccagctgtctaaaga

SEQ ID NO: 396317 - DNA, 20 bp, human
gggagagtgtccctgtctat

SEQ ID NO: 396318 - DNA, 20 bp, human
ggcagagggcactgtaagga

SEQ ID NO: 396319 - DNA, 20 bp, human
gggaggcagggagacaacct

SEQ ID NO: 396320 - DNA, 20 bp, human
gaccagcagagggcactgta

SEQ ID NO: 396321 - DNA, 20 bp, human
gaggtgcagcacctacaccc

SEQ ID NO: 396322 - DNA, 20 bp, human
gagggagacaacctgggtgt

SEQ ID NO: 396323 - DNA, 20 bp, human
gcaaagtccagcccaggtaa

SEQ ID NO: 396324 - DNA, 20 bp, human
gcctcagctaatcccttacc

SEQ ID NO: 396325 - DNA, 20 bp, human
gactgtaaggaggggtttca

SEQ ID NO: 396326 - DNA, 20 bp, human
gcggagccggctggcctctt

SEQ ID NO: 396327 - DNA, 20 bp, human
gcgctcgcggagagaggaag

SEQ ID NO: 396328 - DNA, 20 bp, human
gaagcgggctgggagtcggg

SEQ ID NO: 396329 - DNA, 20 bp, human
gccttcccctcccctccgag

SEQ ID NO: 396330 - DNA, 20 bp, human
gggaagcaggtgactgagtt

SEQ ID NO: 396331 - DNA, 20 bp, human
gccgccccagcccggctcat

SEQ ID NO: 396332 - DNA, 20 bp, human
ggggcacgtggagcggcctc

SEQ ID NO: 396333 - DNA, 20 bp, human
gcggggatgcggccacgccg

SEQ ID NO: 396334 - DNA, 20 bp, human
gggctgccgctcggagggga

SEQ ID NO: 396335 - DNA, 20 bp, human
gtcctctctccgcgagcggg

SEQ ID NO: 396336 - DNA, 20 bp, human
ggagcaggaggggctcggtt

SEQ ID NO: 396337 - DNA, 20 bp, human
gagaggaaggggctgttctt

SEQ ID NO: 396338 - DNA, 20 bp, human
gcgagtcgggccgcgtgggg

SEQ ID NO: 396339 - DNA, 20 bp, human
ggtgaccctgagcgggacga

SEQ ID NO: 396340 - DNA, 20 bp, human
gcgactcgcgcggcgacgtc

SEQ ID NO: 396341 - DNA, 20 bp, human
gagcccctcctgctccgtct

SEQ ID NO: 396342 - DNA, 20 bp, human
gacgacggcaggggagggcg

SEQ ID NO: 396343 - DNA, 20 bp, human
gactcctagacggagcagga

SEQ ID NO: 396344 - DNA, 20 bp, human
gcgggccacgtgaccctgag

SEQ ID NO: 396345 - DNA, 20 bp, human
ggtgcgttcgctggatccat

SEQ ID NO: 396346 - DNA, 20 bp, human
gggccggagaagcgaatccg

SEQ ID NO: 396347 - DNA, 20 bp, human
gcctccccgcgcgtggaaca

SEQ ID NO: 396348 - DNA, 20 bp, human
ggtgggaggtgctgaaagca

SEQ ID NO: 396349 - DNA, 20 bp, human
ggggacgagcgcctgcgatg

SEQ ID NO: 396350 - DNA, 20 bp, human
gcgcgggccgctgtccacag

SEQ ID NO: 396351 - DNA, 20 bp, human
gcggggaaagccgaattccg

SEQ ID NO: 396352 - DNA, 20 bp, human
gggtgctgaaagcagggagc

SEQ ID NO: 396353 - DNA, 20 bp, human
gcccgctccgagctgcactc

SEQ ID NO: 396354 - DNA, 20 bp, human
gcctgcggctcaagctgccc

SEQ ID NO: 396355 - DNA, 20 bp, human
ggaaagcagggagcgggtgc

SEQ ID NO: 396356 - DNA, 20 bp, human
gcagggatgggctgccacgt

SEQ ID NO: 396357 - DNA, 20 bp, human
gctggcccggctgacaccgt

SEQ ID NO: 396358 - DNA, 20 bp, human
gatacaggtgttgcagggat

SEQ ID NO: 396359 - DNA, 20 bp, human
gcccctggctggcagcgtcg

SEQ ID NO: 396360 - DNA, 20 bp, human
gggacaagaagttcctgttg

SEQ ID NO: 396361 - DNA, 20 bp, human
gcgtgggcggaggcctggat

SEQ ID NO: 396362 - DNA, 20 bp, human
gtggcagcgtcgcggcacct

SEQ ID NO: 396363 - DNA, 20 bp, human
gtgccacgtgggcggaggcc

SEQ ID NO: 396364 - DNA, 20 bp, human
gcattggcgccctcccgctg

SEQ ID NO: 396365 - DNA, 20 bp, human
gcagttgtccaggaagatac

SEQ ID NO: 396366 - DNA, 20 bp, human
ggagccgccgctctacccga

SEQ ID NO: 396367 - DNA, 20 bp, human
gacgacccaggcaaccctga

SEQ ID NO: 396368 - DNA, 20 bp, human
gcaccccagagggcacacac

SEQ ID NO: 396369 - DNA, 20 bp, human
gacacacacacgtgtcctgg

SEQ ID NO: 396370 - DNA, 20 bp, human
gtccatggcccgaactactg

SEQ ID NO: 396371 - DNA, 20 bp, human
gggcggtcgcagggactccg

SEQ ID NO: 396372 - DNA, 20 bp, human
gaaccctgaggggagcttaa

SEQ ID NO: 396373 - DNA, 20 bp, human
gactacccccggggccatgg

SEQ ID NO: 396374 - DNA, 20 bp, human
ggtagttcgggccatggagg

SEQ ID NO: 396375 - DNA, 20 bp, human
gccgctctacccgatggcgg

SEQ ID NO: 396376 - DNA, 20 bp, human
gtaatcggctctgacgtcag

SEQ ID NO: 396377 - DNA, 20 bp, human
gggccggccccgagtgaagt

SEQ ID NO: 396378 - DNA, 20 bp, human
gggaactgtcacaacaagac

SEQ ID NO: 396379 - DNA, 20 bp, human
gcagaggcgtgctgggtgca

SEQ ID NO: 396380 - DNA, 20 bp, human
gcacctcaataaacagtatc

SEQ ID NO: 396381 - DNA, 20 bp, human
gctgacgtcagaggcgtgct

SEQ ID NO: 396382 - DNA, 20 bp, human
gtagccccccacttcactcg

SEQ ID NO: 396383 - DNA, 20 bp, human
gagccgcggcccggggaatt

SEQ ID NO: 396384 - DNA, 20 bp, human
ggtcacaacaagacgggctg

SEQ ID NO: 396385 - DNA, 20 bp, human
gcccccacttcactcggggc

SEQ ID NO: 396386 - DNA, 20 bp, human
gccagtgcgcatgtgcggga

SEQ ID NO: 396387 - DNA, 20 bp, human
gggagtgcaacgcccctggg

SEQ ID NO: 396388 - DNA, 20 bp, human
gggcccgcgcatgctccgag

SEQ ID NO: 396389 - DNA, 20 bp, human
ggaggaggtggggcgtgcaa

SEQ ID NO: 396390 - DNA, 20 bp, human
gaccacgtggggacgcggtg

SEQ ID NO: 396391 - DNA, 20 bp, human
ggagcctgtccaaagagcag

SEQ ID NO: 396392 - DNA, 20 bp, human
gaaaagaccacgtggggacg

SEQ ID NO: 396393 - DNA, 20 bp, human
gtggggcgtgcaacggtgcc

SEQ ID NO: 396394 - DNA, 20 bp, human
gtgccccttaggggtgttgt

SEQ ID NO: 396395 - DNA, 20 bp, human
gacaaagcgaatgaaagaat

SEQ ID NO: 396396 - DNA, 20 bp, human
gcacaggaccacaataccca

SEQ ID NO: 396397 - DNA, 20 bp, human
gaccccccacacggcagcag

SEQ ID NO: 396398 - DNA, 20 bp, human
ggccagcaaccctctgccga

SEQ ID NO: 396399 - DNA, 20 bp, human
gcaaggatccctgggtattg

SEQ ID NO: 396400 - DNA, 20 bp, human
ggtcgcaggccctcagcatc

SEQ ID NO: 396401 - DNA, 20 bp, human
gcaacccctgctgccgtgtg

SEQ ID NO: 396402 - DNA, 20 bp, human
gccggctggaattttaccgt

SEQ ID NO: 396403 - DNA, 20 bp, human
ggacccgccgcagggatgaa

SEQ ID NO: 396404 - DNA, 20 bp, human
gcgcaggcgcactgggtcct

SEQ ID NO: 396405 - DNA, 20 bp, human
gaccgtcggcagagggttgc

SEQ ID NO: 396406 - DNA, 20 bp, human
gggcgcgcggggatatccgg

SEQ ID NO: 396407 - DNA, 20 bp, human
gcgggcaggaccagcgtccc

SEQ ID NO: 396408 - DNA, 20 bp, human
gacagcaggggcgaccatcg

SEQ ID NO: 396409 - DNA, 20 bp, human
gccgcgcgtgggacccgcga

SEQ ID NO: 396410 - DNA, 20 bp, human
ggaaccaagaggctgatgtc

SEQ ID NO: 396411 - DNA, 20 bp, human
gaccccttggcccttccgcc

SEQ ID NO: 396412 - DNA, 20 bp, human
ggcaccgggcggaagggcca

SEQ ID NO: 396413 - DNA, 20 bp, human
gccaagaggctgatgtcagg

SEQ ID NO: 396414 - DNA, 20 bp, human
ggggtcccacgcgcggcccc

SEQ ID NO: 396415 - DNA, 20 bp, human
gagccaggcaccgggcggaa

SEQ ID NO: 396416 - DNA, 20 bp, human
gtggccgtgtgctgcggagg

SEQ ID NO: 396417 - DNA, 20 bp, human
gagcctccagggcctcacgt

SEQ ID NO: 396418 - DNA, 20 bp, human
gcggcaagaggaacgtgtcc

SEQ ID NO: 396419 - DNA, 20 bp, human
ggtgtcctggcacgtgccga

SEQ ID NO: 396420 - DNA, 20 bp, human
gcgtgccgaaggagcgctaa

SEQ ID NO: 396421 - DNA, 20 bp, human
ggagcgctaaaggccagggg

SEQ ID NO: 396422 - DNA, 20 bp, human
ggcagccaatccgccttcca

SEQ ID NO: 396423 - DNA, 20 bp, human
ggaggtgcccaggcccggtc

SEQ ID NO: 396424 - DNA, 20 bp, human
gtccagggcctcacgtgggg

SEQ ID NO: 396425 - DNA, 20 bp, human
ggctgattggccgtgtgctg

SEQ ID NO: 396426 - DNA, 20 bp, human
ggcggctggcggtgtggact

SEQ ID NO: 396427 - DNA, 20 bp, human
ggcgtccccaattagcagtt

SEQ ID NO: 396428 - DNA, 20 bp, human
gcggcggcagctcgaggact

SEQ ID NO: 396429 - DNA, 20 bp, human
ggaagcgcgcgcgctcttcg

SEQ ID NO: 396430 - DNA, 20 bp, human
gcccgccccaactgctaatt

SEQ ID NO: 396431 - DNA, 20 bp, human
gaccacctatgtagggtatt

SEQ ID NO: 396432 - DNA, 20 bp, human
gctgctaattggggacgccc

SEQ ID NO: 396433 - DNA, 20 bp, human
gcgcaccgcgcacgcgcagg

SEQ ID NO: 396434 - DNA, 20 bp, human
gacaccgtcgcagcgaccac

SEQ ID NO: 396435 - DNA, 20 bp, human
gctagccgaataccctacat

SEQ ID NO: 396436 - DNA, 20 bp, human
ggcgcggccgggctgagagt

SEQ ID NO: 396437 - DNA, 20 bp, human
gagggcatcggcatgccgca

SEQ ID NO: 396438 - DNA, 20 bp, human
gcaaaccagggccccagcgg

SEQ ID NO: 396439 - DNA, 20 bp, human
ggggccctcggctgcgagat

SEQ ID NO: 396440 - DNA, 20 bp, human
ggcggggcggagctcacggg

SEQ ID NO: 396441 - DNA, 20 bp, human
gggggtgggaagcgcgaatg

SEQ ID NO: 396442 - DNA, 20 bp, human
gcgcgctggtgagtggcggg

SEQ ID NO: 396443 - DNA, 20 bp, human
gcgccactcaccagcgcggc

SEQ ID NO: 396444 - DNA, 20 bp, human
gctcggctgcgagataggtg

SEQ ID NO: 396445 - DNA, 20 bp, human
ggatgccctcagcttgactc

SEQ ID NO: 396446 - DNA, 20 bp, human
gcgcggccgccgctccctga

SEQ ID NO: 396447 - DNA, 20 bp, human
gggtcggggccgcccacgaa

SEQ ID NO: 396448 - DNA, 20 bp, human
gccggggccgccctaaaccg

SEQ ID NO: 396449 - DNA, 20 bp, human
gctgcgggactagtcggggt

SEQ ID NO: 396450 - DNA, 20 bp, human
ggcgccggcggctttggtcc

SEQ ID NO: 396451 - DNA, 20 bp, human
gaggcgctgcgggactagtc

SEQ ID NO: 396452 - DNA, 20 bp, human
gcctgacccggcggaaagcc

SEQ ID NO: 396453 - DNA, 20 bp, human
gctctcgcgaggtttcgtcg

SEQ ID NO: 396454 - DNA, 20 bp, human
ggagcggcggccgcggttta

SEQ ID NO: 396455 - DNA, 20 bp, human
gacacagcctggctttccgc

SEQ ID NO: 396456 - DNA, 20 bp, human
ggggccgcgaggggattggg

SEQ ID NO: 396457 - DNA, 20 bp, human
gagggagtctgggccgcgag

SEQ ID NO: 396458 - DNA, 20 bp, human
ggcgggccccgagggagtct

SEQ ID NO: 396459 - DNA, 20 bp, human
gagagcttggcaggacccaa

SEQ ID NO: 396460 - DNA, 20 bp, human
gtctgggccgcgaggggatt

SEQ ID NO: 396461 - DNA, 20 bp, human
gctaatgacgcgcgaagggg

SEQ ID NO: 396462 - DNA, 20 bp, human
ggcgccacccaatcccctcg

SEQ ID NO: 396463 - DNA, 20 bp, human
gattgggtggcgcaggaact

SEQ ID NO: 396464 - DNA, 20 bp, human
ggcaggacccaatggaacgt

SEQ ID NO: 396465 - DNA, 20 bp, human
gcctgaacgcccaacaaaag

SEQ ID NO: 396466 - DNA, 20 bp, human
gtacgcccaggcccctcctt

SEQ ID NO: 396467 - DNA, 20 bp, human
gaggggcctgggcgtatata

SEQ ID NO: 396468 - DNA, 20 bp, human
gctggatgaacagctttgat

SEQ ID NO: 396469 - DNA, 20 bp, human
ggggagactagcccaaggag

SEQ ID NO: 396470 - DNA, 20 bp, human
gataaatcatgggggtggca

SEQ ID NO: 396471 - DNA, 20 bp, human
gtcccaggctttgttggcgg

SEQ ID NO: 396472 - DNA, 20 bp, human
gtctgggtcccaggctttgt

SEQ ID NO: 396473 - DNA, 20 bp, human
gccagattgtgtaggaccca

SEQ ID NO: 396474 - DNA, 20 bp, human
gcaaagctgttcatccagcc

SEQ ID NO: 396475 - DNA, 20 bp, human
ggtgttttggggcacggcag

SEQ ID NO: 396476 - DNA, 20 bp, human
ggaggcgggggagtaaccgg

SEQ ID NO: 396477 - DNA, 20 bp, human
gcccccgcctcagcgaggca

SEQ ID NO: 396478 - DNA, 20 bp, human
gtgcctgccctgcctcgctg

SEQ ID NO: 396479 - DNA, 20 bp, human
ggccctgcctcgctgaggcg

SEQ ID NO: 396480 - DNA, 20 bp, human
gtccaggaaagcgatgagtg

SEQ ID NO: 396481 - DNA, 20 bp, human
ggaaatcaactgacagcctc

SEQ ID NO: 396482 - DNA, 20 bp, human
ggggaagggtagtctgtgat

SEQ ID NO: 396483 - DNA, 20 bp, human
gaatgtgtgactctgacaga

SEQ ID NO: 396484 - DNA, 20 bp, human
gggttcaaagaattgcagga

SEQ ID NO: 396485 - DNA, 20 bp, human
gttactcccccgcctcagcg

SEQ ID NO: 396486 - DNA, 20 bp, human
ggggccctatagcctcaaag

SEQ ID NO: 396487 - DNA, 20 bp, human
gggtcttgatggtgtaacta

SEQ ID NO: 396488 - DNA, 20 bp, human
ggccaggaggggggatgccc

SEQ ID NO: 396489 - DNA, 20 bp, human
gtgcacgggcatctggagac

SEQ ID NO: 396490 - DNA, 20 bp, human
gtgccctggctgggtcttga

SEQ ID NO: 396491 - DNA, 20 bp, human
gtgatggtgtaactaaggtg

SEQ ID NO: 396492 - DNA, 20 bp, human
gtaggaagagaatactccaa

SEQ ID NO: 396493 - DNA, 20 bp, human
ggagactggccagtccttgg

SEQ ID NO: 396494 - DNA, 20 bp, human
gcccaaggggcaggttggac

SEQ ID NO: 396495 - DNA, 20 bp, human
gctatagcctcaaaggggtg

SEQ ID NO: 396496 - DNA, 20 bp, human
gggagaaggtcctgcccggt

SEQ ID NO: 396497 - DNA, 20 bp, human
ggggccatagccagagaatg

SEQ ID NO: 396498 - DNA, 20 bp, human
gccccagggcgcaatcccac

SEQ ID NO: 396499 - DNA, 20 bp, human
ggggcaccgcgcacgggtcg

SEQ ID NO: 396500 - DNA, 20 bp, human
gggcactcgcgaaacaaaat

SEQ ID NO: 396501 - DNA, 20 bp, human
ggcatgggcaagttcatgga

SEQ ID NO: 396502 - DNA, 20 bp, human
gccacagcgtctctcaccaa

SEQ ID NO: 396503 - DNA, 20 bp, human
gcacagtaggcgctttgatg

SEQ ID NO: 396504 - DNA, 20 bp, human
gacccgtgcgcggtgcccca

SEQ ID NO: 396505 - DNA, 20 bp, human
ggcatggagagatgcttagg

SEQ ID NO: 396506 - DNA, 20 bp, human
gctgggaggggccccaatcc

SEQ ID NO: 396507 - DNA, 20 bp, human
gcatcccggagcctggattg

SEQ ID NO: 396508 - DNA, 20 bp, human
gggggccccaatccaggctc

SEQ ID NO: 396509 - DNA, 20 bp, human
gagggccagcgtgctgtgat

SEQ ID NO: 396510 - DNA, 20 bp, human
gtgggaggatgtggcctcgt

SEQ ID NO: 396511 - DNA, 20 bp, human
ggtatccagccccactgcca

SEQ ID NO: 396512 - DNA, 20 bp, human
gggaacccaggctgcgaact

SEQ ID NO: 396513 - DNA, 20 bp, human
gtctccagggccaagctgtt

SEQ ID NO: 396514 - DNA, 20 bp, human
ggggtctggcttttggaaac

SEQ ID NO: 396515 - DNA, 20 bp, human
gtccaggctccgggatggcc

SEQ ID NO: 396516 - DNA, 20 bp, human
gtccagggagtttgcttgag

SEQ ID NO: 396517 - DNA, 20 bp, human
gactaccccccccacccacc

SEQ ID NO: 396518 - DNA, 20 bp, human
gtacagttgcaagacaagcc

SEQ ID NO: 396519 - DNA, 20 bp, human
ggccgctcaagcaaactccc

SEQ ID NO: 396520 - DNA, 20 bp, human
gacaccaactcctcctaggt

SEQ ID NO: 396521 - DNA, 20 bp, human
gaacaaaaaaccaacctagg

SEQ ID NO: 396522 - DNA, 20 bp, human
gataaataaaagagactcca

SEQ ID NO: 396523 - DNA, 20 bp, human
ggtgtctgtttttggttcat

SEQ ID NO: 396524 - DNA, 20 bp, human
gaaaccaacctaggaggagt

SEQ ID NO: 396525 - DNA, 20 bp, human
gtttttttttggggggggca

SEQ ID NO: 396526 - DNA, 20 bp, human
gggcgggcggggcttgtctg

SEQ ID NO: 396527 - DNA, 20 bp, human
ggagcctcccgggaccttcg

SEQ ID NO: 396528 - DNA, 20 bp, human
gctgcccgggggttaccgct

SEQ ID NO: 396529 - DNA, 20 bp, human
gtcccgggaccttcgcggga

SEQ ID NO: 396530 - DNA, 20 bp, human
gaactcagctgaccgcatcc

SEQ ID NO: 396531 - DNA, 20 bp, human
ggtaacccccgggcagggcg

SEQ ID NO: 396532 - DNA, 20 bp, human
gcaccctcccgcgaaggtcc

SEQ ID NO: 396533 - DNA, 20 bp, human
gcttgtctgcgggatggccc

SEQ ID NO: 396534 - DNA, 20 bp, human
gcagccctggcccggtggtc

SEQ ID NO: 396535 - DNA, 20 bp, human
ggcggggcttgtctgcggga

SEQ ID NO: 396536 - DNA, 20 bp, human
gaatgaaaacaagttggcga

SEQ ID NO: 396537 - DNA, 20 bp, human
gggatcaaggacagatgtaa

SEQ ID NO: 396538 - DNA, 20 bp, human
ggcaacatcaaacctgtgtt

SEQ ID NO: 396539 - DNA, 20 bp, human
gctgtccttgatcccaacac

SEQ ID NO: 396540 - DNA, 20 bp, human
ggatgccacaccttcaaagg

SEQ ID NO: 396541 - DNA, 20 bp, human
gagcacttcctcaagaagat

SEQ ID NO: 396542 - DNA, 20 bp, human
ggctttgagacaactgtata

SEQ ID NO: 396543 - DNA, 20 bp, human
gagttttgagaagacctggt

SEQ ID NO: 396544 - DNA, 20 bp, human
gccaacctggtcaaagagct

SEQ ID NO: 396545 - DNA, 20 bp, human
gtggttagcttgttaactat

SEQ ID NO: 396546 - DNA, 20 bp, human
ggtagcaagggtgactcaaa

SEQ ID NO: 396547 - DNA, 20 bp, human
ggcggggagtgcagccaata

SEQ ID NO: 396548 - DNA, 20 bp, human
gttgctacgtgggttcccac

SEQ ID NO: 396549 - DNA, 20 bp, human
ggcctgcctagacaccctat

SEQ ID NO: 396550 - DNA, 20 bp, human
gaagcagtggcgccgcagag

SEQ ID NO: 396551 - DNA, 20 bp, human
gcaggcagtacgtctggtgt

SEQ ID NO: 396552 - DNA, 20 bp, human
gtcctcagaacatctaaccc

SEQ ID NO: 396553 - DNA, 20 bp, human
gtgagtcacccttgctacgt

SEQ ID NO: 396554 - DNA, 20 bp, human
ggccagggttagatgttctg

SEQ ID NO: 396555 - DNA, 20 bp, human
gtctaggcaggcagtacgtc

SEQ ID NO: 396556 - DNA, 20 bp, human
gacagcagggagagcgtgcc

SEQ ID NO: 396557 - DNA, 20 bp, human
gtgagaagccccgaggtctg

SEQ ID NO: 396558 - DNA, 20 bp, human
ggtgcccgggcacgacagcc

SEQ ID NO: 396559 - DNA, 20 bp, human
gaaaggaggacgtagaaaag

SEQ ID NO: 396560 - DNA, 20 bp, human
ggcaccaggctgtcgtgccc

SEQ ID NO: 396561 - DNA, 20 bp, human
ggaaccactgttacgtgtag

SEQ ID NO: 396562 - DNA, 20 bp, human
ggcacgcgctgttgttttct

SEQ ID NO: 396563 - DNA, 20 bp, human
gcccccactacacgtaacag

SEQ ID NO: 396564 - DNA, 20 bp, human
ggccggcgaaagactggcaa

SEQ ID NO: 396565 - DNA, 20 bp, human
gggggggcgcaggcgcaaag

SEQ ID NO: 396566 - DNA, 20 bp, human
gcaccgctactctccgtgta

SEQ ID NO: 396567 - DNA, 20 bp, human
gtgggcatgcgcgactttgt

SEQ ID NO: 396568 - DNA, 20 bp, human
ggacgaagactgaattagct

SEQ ID NO: 396569 - DNA, 20 bp, human
ggcccctacacggagagtag

SEQ ID NO: 396570 - DNA, 20 bp, human
ggcctcccgctccactccta

SEQ ID NO: 396571 - DNA, 20 bp, human
ggaacacgcggggcccaaga

SEQ ID NO: 396572 - DNA, 20 bp, human
gcacgcggggcccaagatgg

SEQ ID NO: 396573 - DNA, 20 bp, human
gggcgagcagcgcccctaca

SEQ ID NO: 396574 - DNA, 20 bp, human
gaggagtcggcgccgacgaa

SEQ ID NO: 396575 - DNA, 20 bp, human
gccgactcctcccgctaagg

SEQ ID NO: 396576 - DNA, 20 bp, human
gtaagccgggactgggcgga

SEQ ID NO: 396577 - DNA, 20 bp, human
gagaaggtgatggcgcgcga

SEQ ID NO: 396578 - DNA, 20 bp, human
gtctgtggttcaaaacacga

SEQ ID NO: 396579 - DNA, 20 bp, human
gcaggataggaatacctctg

SEQ ID NO: 396580 - DNA, 20 bp, human
ggggaatctaagccgggact

SEQ ID NO: 396581 - DNA, 20 bp, human
gaccttccgcgagacgtcga

SEQ ID NO: 396582 - DNA, 20 bp, human
gacgtctcgcggaaggtacc

SEQ ID NO: 396583 - DNA, 20 bp, human
ggtacgcgacgcgaggacgc

SEQ ID NO: 396584 - DNA, 20 bp, human
gaaggtacctggctccccgg

SEQ ID NO: 396585 - DNA, 20 bp, human
gtattcctatcctgggaatg

SEQ ID NO: 396586 - DNA, 20 bp, human
gcggagaagtggtccggagt

SEQ ID NO: 396587 - DNA, 20 bp, human
ggggtctgcgcgcacagtgg

SEQ ID NO: 396588 - DNA, 20 bp, human
gttctggccacgtggtctgg

SEQ ID NO: 396589 - DNA, 20 bp, human
gcggagcccagaagcacaat

SEQ ID NO: 396590 - DNA, 20 bp, human
ggccctaacgccgcccactc

SEQ ID NO: 396591 - DNA, 20 bp, human
gactaggcgcacaaaatcac

SEQ ID NO: 396592 - DNA, 20 bp, human
ggcgttagggcggtgctttc

SEQ ID NO: 396593 - DNA, 20 bp, human
gggcgagggttggacgaccg

SEQ ID NO: 396594 - DNA, 20 bp, human
gagaagtggtccggagtggg

SEQ ID NO: 396595 - DNA, 20 bp, human
gtgtgcttctgggctccgcg

SEQ ID NO: 396596 - DNA, 20 bp, human
gcgtaagcacctctcggcca

SEQ ID NO: 396597 - DNA, 20 bp, human
gagggtgaggccaatggagt

SEQ ID NO: 396598 - DNA, 20 bp, human
gtgcttacgcaggtgctgaa

SEQ ID NO: 396599 - DNA, 20 bp, human
gtcacatcgcgaacagagaa

SEQ ID NO: 396600 - DNA, 20 bp, human
gaatgccccgcctactccat

SEQ ID NO: 396601 - DNA, 20 bp, human
gtggcctcaccctggccgag

SEQ ID NO: 396602 - DNA, 20 bp, human
ggaggccaatggagtaggcg

SEQ ID NO: 396603 - DNA, 20 bp, human
gagagaaaggccgcttgcgc

SEQ ID NO: 396604 - DNA, 20 bp, human
gatgtgacgtaacgcgcctg

SEQ ID NO: 396605 - DNA, 20 bp, human
gcaagctgggcccagtccgc

SEQ ID NO: 396606 - DNA, 20 bp, human
ggggagatggactgcacggc

SEQ ID NO: 396607 - DNA, 20 bp, human
gacggcgggcggacctgctc

SEQ ID NO: 396608 - DNA, 20 bp, human
gcgggctgatggacggcagg

SEQ ID NO: 396609 - DNA, 20 bp, human
gcggccgagcaccaactgta

SEQ ID NO: 396610 - DNA, 20 bp, human
gaggtggactgatgtgcgca

SEQ ID NO: 396611 - DNA, 20 bp, human
gacctgctcgggctgatgga

SEQ ID NO: 396612 - DNA, 20 bp, human
gcgaacctgcggacacgctg

SEQ ID NO: 396613 - DNA, 20 bp, human
gccgcctcctggcgggaacc

SEQ ID NO: 396614 - DNA, 20 bp, human
ggactgtcccggttcccgcc

SEQ ID NO: 396615 - DNA, 20 bp, human
gcgtactgaggtctggcggg

SEQ ID NO: 396616 - DNA, 20 bp, human
gaagcacaggggtcctgctg

SEQ ID NO: 396617 - DNA, 20 bp, human
gactgtgtccccaagcacag

SEQ ID NO: 396618 - DNA, 20 bp, human
ggggtccttgatagccaatc

SEQ ID NO: 396619 - DNA, 20 bp, human
gtggctatcaaggacccaca

SEQ ID NO: 396620 - DNA, 20 bp, human
ggtactgagtcactcaggtg

SEQ ID NO: 396621 - DNA, 20 bp, human
gcttatgaatcctggagtca

SEQ ID NO: 396622 - DNA, 20 bp, human
gacagttagaagtgtccctg

SEQ ID NO: 396623 - DNA, 20 bp, human
gggcagggacttatgaatcc

SEQ ID NO: 396624 - DNA, 20 bp, human
gagtcatgcttggaaaacag

SEQ ID NO: 396625 - DNA, 20 bp, human
gtgtggtgtgacgagtcatt

SEQ ID NO: 396626 - DNA, 20 bp, human
gcggaagagcccaagatagc

SEQ ID NO: 396627 - DNA, 20 bp, human
gtcctccaagactcagaata

SEQ ID NO: 396628 - DNA, 20 bp, human
gtagcggggggagttgtgac

SEQ ID NO: 396629 - DNA, 20 bp, human
gaagagcccaagatagcggg

SEQ ID NO: 396630 - DNA, 20 bp, human
gcaagagaggcgcgtcccat

SEQ ID NO: 396631 - DNA, 20 bp, human
gacgtgggaaagtgttagcg

SEQ ID NO: 396632 - DNA, 20 bp, human
ggcatgcggagtcccaagag

SEQ ID NO: 396633 - DNA, 20 bp, human
ggaccctcccggtgtgtccc

SEQ ID NO: 396634 - DNA, 20 bp, human
ggtgcaggtgtcatcccgga

SEQ ID NO: 396635 - DNA, 20 bp, human
gcaactccccccgctatctt

SEQ ID NO: 396636 - DNA, 20 bp, human
ggggcggggcaaacttggag

SEQ ID NO: 396637 - DNA, 20 bp, human
gtggagaggcgctgcgtcgg

SEQ ID NO: 396638 - DNA, 20 bp, human
gtggcaccgggacctacagg

SEQ ID NO: 396639 - DNA, 20 bp, human
ggggctacaagccgtcgctg

SEQ ID NO: 396640 - DNA, 20 bp, human
gaggtggcaccgggacctac

SEQ ID NO: 396641 - DNA, 20 bp, human
gtctcgggacactgacgagg

SEQ ID NO: 396642 - DNA, 20 bp, human
ggggcttgcggcccacctgt

SEQ ID NO: 396643 - DNA, 20 bp, human
gcagccctctcgttcttctg

SEQ ID NO: 396644 - DNA, 20 bp, human
ggcggcccacctgtaggtcc

SEQ ID NO: 396645 - DNA, 20 bp, human
ggatccccagaagaacgaga

SEQ ID NO: 396646 - DNA, 20 bp, human
gtacccctaacctctgcctg

SEQ ID NO: 396647 - DNA, 20 bp, human
gaagtgcggcacactcatcg

SEQ ID NO: 396648 - DNA, 20 bp, human
gcggctccataagcgatatg

SEQ ID NO: 396649 - DNA, 20 bp, human
gcgcccgcacagctcgaaca

SEQ ID NO: 396650 - DNA, 20 bp, human
ggtccgcgggcgacactctc

SEQ ID NO: 396651 - DNA, 20 bp, human
gaccatggaggccacgtccc

SEQ ID NO: 396652 - DNA, 20 bp, human
gagcccgagagtgtcgcccg

SEQ ID NO: 396653 - DNA, 20 bp, human
gtgggtgtggtatgactaag

SEQ ID NO: 396654 - DNA, 20 bp, human
gagccgcaggcagaggttag

SEQ ID NO: 396655 - DNA, 20 bp, human
ggtagcggcggcaacgacca

SEQ ID NO: 396656 - DNA, 20 bp, human
gttcagtggcggagcacctg

SEQ ID NO: 396657 - DNA, 20 bp, human
gtaaagtgtcactttcagct

SEQ ID NO: 396658 - DNA, 20 bp, human
ggtgacactttaatactttc

SEQ ID NO: 396659 - DNA, 20 bp, human
gataaagagaagtttctggc

SEQ ID NO: 396660 - DNA, 20 bp, human
ggtctcaaactcttggccac

SEQ ID NO: 396661 - DNA, 20 bp, human
gagatgattgttaagagctc

SEQ ID NO: 396662 - DNA, 20 bp, human
gaatactttcaggaaattat

SEQ ID NO: 396663 - DNA, 20 bp, human
gaatccagaagttcaagatc

SEQ ID NO: 396664 - DNA, 20 bp, human
gagtttctggccgggaacgg

SEQ ID NO: 396665 - DNA, 20 bp, human
gcaggataaagagaagtttc

SEQ ID NO: 396666 - DNA, 20 bp, human
gacgaacgagtcaaccggat

SEQ ID NO: 396667 - DNA, 20 bp, human
gccggtggggtggagcctag

SEQ ID NO: 396668 - DNA, 20 bp, human
ggagcctagcggaggacgtc

SEQ ID NO: 396669 - DNA, 20 bp, human
gccaaggcacctcccaccta

SEQ ID NO: 396670 - DNA, 20 bp, human
ggactgggtgacccgtaggt

SEQ ID NO: 396671 - DNA, 20 bp, human
gggctgactgggtgacccgt

SEQ ID NO: 396672 - DNA, 20 bp, human
gggggacagtggacaggcgg

SEQ ID NO: 396673 - DNA, 20 bp, human
gaggccctgcccgggccggt

SEQ ID NO: 396674 - DNA, 20 bp, human
ggtggggtggagcctagcgg

SEQ ID NO: 396675 - DNA, 20 bp, human
gtcggggattgaactgactt

SEQ ID NO: 396676 - DNA, 20 bp, human
gctgcctttgattatgggaa

SEQ ID NO: 396677 - DNA, 20 bp, human
ggggagcagagatctctgca

SEQ ID NO: 396678 - DNA, 20 bp, human
gcccctgctgcctttgatta

SEQ ID NO: 396679 - DNA, 20 bp, human
gcccataatcaaaggcagca

SEQ ID NO: 396680 - DNA, 20 bp, human
gattatgggaatggtttggt

SEQ ID NO: 396681 - DNA, 20 bp, human
gtttgattatgggaatggtt

SEQ ID NO: 396682 - DNA, 20 bp, human
gtaatgcttagagtgaaata

SEQ ID NO: 396683 - DNA, 20 bp, human
gctggatctgcttctcccaa

SEQ ID NO: 396684 - DNA, 20 bp, human
gaggcatttaaaacacgcga

SEQ ID NO: 396685 - DNA, 20 bp, human
ggttcattacacaagtattc

SEQ ID NO: 396686 - DNA, 20 bp, human
gaggctgggaccggcggaag

SEQ ID NO: 396687 - DNA, 20 bp, human
gcagaaggggcggggcgata

SEQ ID NO: 396688 - DNA, 20 bp, human
ggtaccggttgtcccggtca

SEQ ID NO: 396689 - DNA, 20 bp, human
gctctggatccccaagactc

SEQ ID NO: 396690 - DNA, 20 bp, human
gacccgcgcgaggctgggac

SEQ ID NO: 396691 - DNA, 20 bp, human
gacatggagccccaagactc

SEQ ID NO: 396692 - DNA, 20 bp, human
gggggaaaggccggcggaag

SEQ ID NO: 396693 - DNA, 20 bp, human
gaagctaggggtcgaagtca

SEQ ID NO: 396694 - DNA, 20 bp, human
gaaaggtctgggagttcttc

SEQ ID NO: 396695 - DNA, 20 bp, human
gcgggaaggtggattcgcct

SEQ ID NO: 396696 - DNA, 20 bp, human
ggaggcgcctcgcccattgg

SEQ ID NO: 396697 - DNA, 20 bp, human
ggccgaggcgcctcgcccat

SEQ ID NO: 396698 - DNA, 20 bp, human
gggtaccggtcccacgtggt

SEQ ID NO: 396699 - DNA, 20 bp, human
gcgcaaccgtctccgccaat

SEQ ID NO: 396700 - DNA, 20 bp, human
ggctccgtgtcagtcagtca

SEQ ID NO: 396701 - DNA, 20 bp, human
gccgtcggagtgagaccctg

SEQ ID NO: 396702 - DNA, 20 bp, human
gtgcgcgttggaggcccgag

SEQ ID NO: 396703 - DNA, 20 bp, human
ggctccatgactgactgaca

SEQ ID NO: 396704 - DNA, 20 bp, human
gccgccgccgcctccgggat

SEQ ID NO: 396705 - DNA, 20 bp, human
gggagacggttgcgcgttgg

SEQ ID NO: 396706 - DNA, 20 bp, human
gccgggacgcgctccagggg

SEQ ID NO: 396707 - DNA, 20 bp, human
gtgggcaggtgggcgttggg

SEQ ID NO: 396708 - DNA, 20 bp, human
gggacgcgctccaggggtgg

SEQ ID NO: 396709 - DNA, 20 bp, human
gggcaccgcccggcgagttc

SEQ ID NO: 396710 - DNA, 20 bp, human
gcgctccgggacgcgctcca

SEQ ID NO: 396711 - DNA, 20 bp, human
ggtggggtaaggtgggcccg

SEQ ID NO: 396712 - DNA, 20 bp, human
ggagcagcccggggacagct

SEQ ID NO: 396713 - DNA, 20 bp, human
ggaggccggaactcgccggg

SEQ ID NO: 396714 - DNA, 20 bp, human
ggcgggctgcgggctgacct

SEQ ID NO: 396715 - DNA, 20 bp, human
gactcgccgggcggtgcctg

SEQ ID NO: 396716 - DNA, 20 bp, human
ggggtccccggcagcggggt

SEQ ID NO: 396717 - DNA, 20 bp, human
gccggcgtgcagcttggtgg

SEQ ID NO: 396718 - DNA, 20 bp, human
gctcgcgcaatccctttctc

SEQ ID NO: 396719 - DNA, 20 bp, human
gcgcccgggtccccggcagc

SEQ ID NO: 396720 - DNA, 20 bp, human
gcgcgcgcaagcgcaggctg

SEQ ID NO: 396721 - DNA, 20 bp, human
gccctgtagggtatccagaa

SEQ ID NO: 396722 - DNA, 20 bp, human
ggccgctgccgtgaagtgaa

SEQ ID NO: 396723 - DNA, 20 bp, human
ggccgtgaagtgaaaggtga

SEQ ID NO: 396724 - DNA, 20 bp, human
ggtgaagtgaaaggtgacgg

SEQ ID NO: 396725 - DNA, 20 bp, human
gccatcctaccccgctgccg

SEQ ID NO: 396726 - DNA, 20 bp, human
gccgggacgcgctccagggg

SEQ ID NO: 396727 - DNA, 20 bp, human
gtgggcaggtgggcgttggg

SEQ ID NO: 396728 - DNA, 20 bp, human
gggacgcgctccaggggtgg

SEQ ID NO: 396729 - DNA, 20 bp, human
gggcaccgcccggcgagttc

SEQ ID NO: 396730 - DNA, 20 bp, human
gcgctccgggacgcgctcca

SEQ ID NO: 396731 - DNA, 20 bp, human
ggtggggtaaggtgggcccg

SEQ ID NO: 396732 - DNA, 20 bp, human
ggagcagcccggggacagct

SEQ ID NO: 396733 - DNA, 20 bp, human
ggaggccggaactcgccggg

SEQ ID NO: 396734 - DNA, 20 bp, human
ggcgggctgcgggctgacct

SEQ ID NO: 396735 - DNA, 20 bp, human
gactcgccgggcggtgcctg

SEQ ID NO: 396736 - DNA, 20 bp, human
ggatgcgaaccgcgtggctg

SEQ ID NO: 396737 - DNA, 20 bp, human
gcgcgagctgggcgtgtcgg

SEQ ID NO: 396738 - DNA, 20 bp, human
ggggcctgcgcgcttgcttc

SEQ ID NO: 396739 - DNA, 20 bp, human
ggcagcgccaaacgacgggg

SEQ ID NO: 396740 - DNA, 20 bp, human
ggggcactcaaggcgacacg

SEQ ID NO: 396741 - DNA, 20 bp, human
gggcggggcctgcgcgagct

SEQ ID NO: 396742 - DNA, 20 bp, human
gcatcaagcgcactcccctg

SEQ ID NO: 396743 - DNA, 20 bp, human
gaagcgcactcccctggggg

SEQ ID NO: 396744 - DNA, 20 bp, human
ggcgcttgatgcgaaccgcg

SEQ ID NO: 396745 - DNA, 20 bp, human
gcgcctggctgggcccgcac

SEQ ID NO: 396746 - DNA, 20 bp, human
ggtggcagagggactatcac

SEQ ID NO: 396747 - DNA, 20 bp, human
ggttggaggaagtcatcgag

SEQ ID NO: 396748 - DNA, 20 bp, human
gactatcaccggcgctgttg

SEQ ID NO: 396749 - DNA, 20 bp, human
gaggaagtcatcgaggggag

SEQ ID NO: 396750 - DNA, 20 bp, human
gcgggtgccgcggacggaag

SEQ ID NO: 396751 - DNA, 20 bp, human
ggtgccgcggacggaagagg

SEQ ID NO: 396752 - DNA, 20 bp, human
gacaaggcgcttcccaccct

SEQ ID NO: 396753 - DNA, 20 bp, human
gggcgcgcccgcaaatttcc

SEQ ID NO: 396754 - DNA, 20 bp, human
ggagcccagtcggtgaaaga

SEQ ID NO: 396755 - DNA, 20 bp, human
gcgggcgcgccggaagttga

SEQ ID NO: 396756 - DNA, 20 bp, human
gcacttgcagcgctgacctg

SEQ ID NO: 396757 - DNA, 20 bp, human
gacagcacagccctcctgga

SEQ ID NO: 396758 - DNA, 20 bp, human
gaggccaggcgcccaatgag

SEQ ID NO: 396759 - DNA, 20 bp, human
gggagccatgtgcaggtcgg

SEQ ID NO: 396760 - DNA, 20 bp, human
gtgggcgcctggcctgtgca

SEQ ID NO: 396761 - DNA, 20 bp, human
ggggtcactggcctcaggta

SEQ ID NO: 396762 - DNA, 20 bp, human
gggggaggacattgctctgc

SEQ ID NO: 396763 - DNA, 20 bp, human
ggatccccacatcgaatgtt

SEQ ID NO: 396764 - DNA, 20 bp, human
gtgggtggggctctaatgct

SEQ ID NO: 396765 - DNA, 20 bp, human
gtgaccctccgacctgcaca

SEQ ID NO: 396766 - DNA, 20 bp, human
gaaaaaaggtaggggtccta

SEQ ID NO: 396767 - DNA, 20 bp, human
ggtcctacgggcagcagcca

SEQ ID NO: 396768 - DNA, 20 bp, human
gtgacagtctgggtatccgg

SEQ ID NO: 396769 - DNA, 20 bp, human
gggttccctacagaaagggg

SEQ ID NO: 396770 - DNA, 20 bp, human
gggctccgcccctttctgta

SEQ ID NO: 396771 - DNA, 20 bp, human
gatgttgaagatcacatgat

SEQ ID NO: 396772 - DNA, 20 bp, human
gcaaactttacggtgaaaaa

SEQ ID NO: 396773 - DNA, 20 bp, human
gtgtagcgacgcaacaacaa

SEQ ID NO: 396774 - DNA, 20 bp, human
ggggacttgcgccaagcctc

SEQ ID NO: 396775 - DNA, 20 bp, human
gccgctgtaaatgtatctta

SEQ ID NO: 396776 - DNA, 20 bp, human
ggaatccagcaggggcattg

SEQ ID NO: 396777 - DNA, 20 bp, human
gggtccggaaggtcaggcaa

SEQ ID NO: 396778 - DNA, 20 bp, human
gcagcccatagtagccaagg

SEQ ID NO: 396779 - DNA, 20 bp, human
gaaccactacgggaagggga

SEQ ID NO: 396780 - DNA, 20 bp, human
gaacctctggcctcattccg

SEQ ID NO: 396781 - DNA, 20 bp, human
gtcacccccttggctactat

SEQ ID NO: 396782 - DNA, 20 bp, human
ggaccagcccatagtagcca

SEQ ID NO: 396783 - DNA, 20 bp, human
gaagctggacgtgactgtaa

SEQ ID NO: 396784 - DNA, 20 bp, human
ggggttgaaccactacggga

SEQ ID NO: 396785 - DNA, 20 bp, human
gtcaaccccaatgcccctgc

SEQ ID NO: 396786 - DNA, 20 bp, human
gccggctgcgcacgcggatc

SEQ ID NO: 396787 - DNA, 20 bp, human
gcagacagcttggagtcggt

SEQ ID NO: 396788 - DNA, 20 bp, human
ggacccgggactgtcgtgtc

SEQ ID NO: 396789 - DNA, 20 bp, human
gaggctggggaggtcccagc

SEQ ID NO: 396790 - DNA, 20 bp, human
gatatgaaatgggtacacga

SEQ ID NO: 396791 - DNA, 20 bp, human
ggaaatgggtacacgaaggc

SEQ ID NO: 396792 - DNA, 20 bp, human
ggggtctagtgcgctgaccc

SEQ ID NO: 396793 - DNA, 20 bp, human
gagccgggaggggcggaacc

SEQ ID NO: 396794 - DNA, 20 bp, human
ggcgcagccggcagacagct

SEQ ID NO: 396795 - DNA, 20 bp, human
gagcctcccggcaccccgct

SEQ ID NO: 396796 - DNA, 20 bp, human
gcgcctaagtaagaatgggg

SEQ ID NO: 396797 - DNA, 20 bp, human
gggccagctaacgagcgcgg

SEQ ID NO: 396798 - DNA, 20 bp, human
gcgcccggaaggccacttga

SEQ ID NO: 396799 - DNA, 20 bp, human
gtagctggcccatctttgtt

SEQ ID NO: 396800 - DNA, 20 bp, human
gtcgtcctatcattcccgaa

SEQ ID NO: 396801 - DNA, 20 bp, human
gttaacccttcgggaatgat

SEQ ID NO: 396802 - DNA, 20 bp, human
gggcccatctttgtttggag

SEQ ID NO: 396803 - DNA, 20 bp, human
ggggaatgataggacgaccg

SEQ ID NO: 396804 - DNA, 20 bp, human
gatgggccagctaacgagcg

SEQ ID NO: 396805 - DNA, 20 bp, human
gttcccccgcgctcgttagc

SEQ ID NO: 396806 - DNA, 20 bp, human
gctcatcaagatggagtgag

SEQ ID NO: 396807 - DNA, 20 bp, human
gaagatggagtgagcggaag

SEQ ID NO: 396808 - DNA, 20 bp, human
gtgggaggccatcttggcgc

SEQ ID NO: 396809 - DNA, 20 bp, human
gccggaaagaagccgtgtcc

SEQ ID NO: 396810 - DNA, 20 bp, human
ggatgagagttggtgtttgt

SEQ ID NO: 396811 - DNA, 20 bp, human
gacaccaactctcatcaaga

SEQ ID NO: 396812 - DNA, 20 bp, human
gggaggcgccatctttaaca

SEQ ID NO: 396813 - DNA, 20 bp, human
gccctcaccaacatggccgc

SEQ ID NO: 396814 - DNA, 20 bp, human
gagaatccagctgagatcaa

SEQ ID NO: 396815 - DNA, 20 bp, human
gttaaagatggcgcctccgt

SEQ ID NO: 396816 - DNA, 20 bp, human
gcaaacagtggggtcatgtg

SEQ ID NO: 396817 - DNA, 20 bp, human
gagcgggcgggcagctgggt

SEQ ID NO: 396818 - DNA, 20 bp, human
gcgcgcgagccggcgatcca

SEQ ID NO: 396819 - DNA, 20 bp, human
ggcgcggcgtcccggagcct

SEQ ID NO: 396820 - DNA, 20 bp, human
gacagtggggtcatgtgagg

SEQ ID NO: 396821 - DNA, 20 bp, human
gtgatcacggggacaaacag

SEQ ID NO: 396822 - DNA, 20 bp, human
gcgcgctggtctgtctccgg

SEQ ID NO: 396823 - DNA, 20 bp, human
gagccgctcgcgctgatcac

SEQ ID NO: 396824 - DNA, 20 bp, human
gcggactgggccaagccggg

SEQ ID NO: 396825 - DNA, 20 bp, human
gcgccgccctggtgaaacgc

SEQ ID NO: 396826 - DNA, 20 bp, human
gcaggcccataggcacactg

SEQ ID NO: 396827 - DNA, 20 bp, human
gtgggccccagtgtgcctat

SEQ ID NO: 396828 - DNA, 20 bp, human
gctggggcccatttgctccc

SEQ ID NO: 396829 - DNA, 20 bp, human
gtcgcctcccactgaagcct

SEQ ID NO: 396830 - DNA, 20 bp, human
gcagcggccccgccccacag

SEQ ID NO: 396831 - DNA, 20 bp, human
ggcccagctactgccacctc

SEQ ID NO: 396832 - DNA, 20 bp, human
gcagccgccctcggagctgg

SEQ ID NO: 396833 - DNA, 20 bp, human
gagggcggctggcccggtcg

SEQ ID NO: 396834 - DNA, 20 bp, human
gactgaagcctgggagcaaa

SEQ ID NO: 396835 - DNA, 20 bp, human
gcgtttgaggaagaagatcg

SEQ ID NO: 396836 - DNA, 20 bp, human
gcactgtgacgcccagtccg

SEQ ID NO: 396837 - DNA, 20 bp, human
gtggaacgaaccgagagctg

SEQ ID NO: 396838 - DNA, 20 bp, human
gggacccaggggaagaccgg

SEQ ID NO: 396839 - DNA, 20 bp, human
gcatgcacctcaatacacga

SEQ ID NO: 396840 - DNA, 20 bp, human
ggactgggcgtcacagtgcg

SEQ ID NO: 396841 - DNA, 20 bp, human
gggtcacggtgccccttctt

SEQ ID NO: 396842 - DNA, 20 bp, human
ggggtcaccctcgtgtattg

SEQ ID NO: 396843 - DNA, 20 bp, human
gcacgagggtgacccacgca

SEQ ID NO: 396844 - DNA, 20 bp, human
ggactccgttcaggcggcgg

SEQ ID NO: 396845 - DNA, 20 bp, human
gacagatctctgactgtccc

SEQ ID NO: 396846 - DNA, 20 bp, human
gtaaggaattaaatggattg

SEQ ID NO: 396847 - DNA, 20 bp, human
gggcccattgatagaagttt

SEQ ID NO: 396848 - DNA, 20 bp, human
gctggaaattattccttgtg

SEQ ID NO: 396849 - DNA, 20 bp, human
gcttgtgtggtgtttaatag

SEQ ID NO: 396850 - DNA, 20 bp, human
ggaggggggattataggata

SEQ ID NO: 396851 - DNA, 20 bp, human
gctatcaatgggccaagctt

SEQ ID NO: 396852 - DNA, 20 bp, human
gtggtagatcattttgatta

SEQ ID NO: 396853 - DNA, 20 bp, human
gtgtatgcatgatcccatcc

SEQ ID NO: 396854 - DNA, 20 bp, human
ggatgtgatctctaaatgtt

SEQ ID NO: 396855 - DNA, 20 bp, human
gtgtaaggaagcatgtatta

SEQ ID NO: 396856 - DNA, 20 bp, human
ggcttcctgcagccctagcg

SEQ ID NO: 396857 - DNA, 20 bp, human
ggaagccgctgtccccgaga

SEQ ID NO: 396858 - DNA, 20 bp, human
ggctagaagggccatgagtt

SEQ ID NO: 396859 - DNA, 20 bp, human
gccaagagtcagagctagaa

SEQ ID NO: 396860 - DNA, 20 bp, human
ggaggaggggctgaaacctt

SEQ ID NO: 396861 - DNA, 20 bp, human
gaggtatgtgtgccccgcta

SEQ ID NO: 396862 - DNA, 20 bp, human
gaagtcacgtgaccagggga

SEQ ID NO: 396863 - DNA, 20 bp, human
gtaacaagtcacgtgaccag

SEQ ID NO: 396864 - DNA, 20 bp, human
ggtttccttctcggggacag

SEQ ID NO: 396865 - DNA, 20 bp, human
gtagaatgggccgagcacca

SEQ ID NO: 396866 - DNA, 20 bp, human
gtaccgcggcgcgaggttag

SEQ ID NO: 396867 - DNA, 20 bp, human
gcaacacagcaacggaagta

SEQ ID NO: 396868 - DNA, 20 bp, human
gccgtggcgctggtgagtaa

SEQ ID NO: 396869 - DNA, 20 bp, human
gcacctccgcaacacagcaa

SEQ ID NO: 396870 - DNA, 20 bp, human
gttgagcccgcccacacttc

SEQ ID NO: 396871 - DNA, 20 bp, human
gaggtggttacattcgttga

SEQ ID NO: 396872 - DNA, 20 bp, human
gacttccggaagaattgcac

SEQ ID NO: 396873 - DNA, 20 bp, human
gttccgttgctgtgttgcgg

SEQ ID NO: 396874 - DNA, 20 bp, human
gctagagacaggaatcggaa

SEQ ID NO: 396875 - DNA, 20 bp, human
ggcaattcttccggaagtgt

SEQ ID NO: 396876 - DNA, 20 bp, human
gaggaggcgtgcccctgcgg

SEQ ID NO: 396877 - DNA, 20 bp, human
ggcagtgggtggggcttcgg

SEQ ID NO: 396878 - DNA, 20 bp, human
ggggacgtggcattacgtgg

SEQ ID NO: 396879 - DNA, 20 bp, human
gggtaggaggcgtgcccctg

SEQ ID NO: 396880 - DNA, 20 bp, human
ggatcaatccgcgaagggtg

SEQ ID NO: 396881 - DNA, 20 bp, human
gcagcaggatcaatccgcga

SEQ ID NO: 396882 - DNA, 20 bp, human
gcgaaggttgaaggcaaaag

SEQ ID NO: 396883 - DNA, 20 bp, human
ggcggggtctgcgcagtggg

SEQ ID NO: 396884 - DNA, 20 bp, human
ggaaggcaaaaggggagcgg

SEQ ID NO: 396885 - DNA, 20 bp, human
gtcggcggaacctagctaag

SEQ ID NO: 396886 - DNA, 20 bp, human
ggacagagagcagacgggat

SEQ ID NO: 396887 - DNA, 20 bp, human
gcgggcggaggctaaaacac

SEQ ID NO: 396888 - DNA, 20 bp, human
gaggacccgcacgagctgcc

SEQ ID NO: 396889 - DNA, 20 bp, human
gggcgcgcgcgaggtgctag

SEQ ID NO: 396890 - DNA, 20 bp, human
gccagcgctgcgattgaacg

SEQ ID NO: 396891 - DNA, 20 bp, human
gccggagcccgtgcgtgcca

SEQ ID NO: 396892 - DNA, 20 bp, human
gcgcacgaatggttaaaaaa

SEQ ID NO: 396893 - DNA, 20 bp, human
gagttgagggaaaagcgtac

SEQ ID NO: 396894 - DNA, 20 bp, human
gggcaggagccgtctcgcga

SEQ ID NO: 396895 - DNA, 20 bp, human
gagggaaaagcgtacgggtc

SEQ ID NO: 396896 - DNA, 20 bp, human
gggtcgcggggctcagagtc

SEQ ID NO: 396897 - DNA, 20 bp, human
gaccctcgggcggaagcggc

SEQ ID NO: 396898 - DNA, 20 bp, human
gggcccaggtggcccccagt

SEQ ID NO: 396899 - DNA, 20 bp, human
gcctggctgtggatccggaa

SEQ ID NO: 396900 - DNA, 20 bp, human
gcgcttccgcccgagggtcg

SEQ ID NO: 396901 - DNA, 20 bp, human
ggcggggcaggggatgtccg

SEQ ID NO: 396902 - DNA, 20 bp, human
ggagccccgcgaccctcggg

SEQ ID NO: 396903 - DNA, 20 bp, human
gtctgagccccgcgaccctc

SEQ ID NO: 396904 - DNA, 20 bp, human
gcccggccgcttccgcccga

SEQ ID NO: 396905 - DNA, 20 bp, human
gcccggagcccgggagtcgc

SEQ ID NO: 396906 - DNA, 20 bp, human
gcgtgcacagacgcgtcgaa

SEQ ID NO: 396907 - DNA, 20 bp, human
gggtggggtaaaatcttcag

SEQ ID NO: 396908 - DNA, 20 bp, human
gacgcgtcgaagggctaggt

SEQ ID NO: 396909 - DNA, 20 bp, human
ggagccccccaaacagtcgc

SEQ ID NO: 396910 - DNA, 20 bp, human
gcacggggccatttccaata

SEQ ID NO: 396911 - DNA, 20 bp, human
gtcggcagagggaacggtgg

SEQ ID NO: 396912 - DNA, 20 bp, human
gacagacgcgtcgaagggct

SEQ ID NO: 396913 - DNA, 20 bp, human
gtagccccgcgactgtttgg

SEQ ID NO: 396914 - DNA, 20 bp, human
gaatccggaagtggctgttg

SEQ ID NO: 396915 - DNA, 20 bp, human
ggggctctgcttccgtttcc

SEQ ID NO: 396916 - DNA, 20 bp, human
ggccgcggaggggttgccga

SEQ ID NO: 396917 - DNA, 20 bp, human
gcctctgccgcgcgcggggt

SEQ ID NO: 396918 - DNA, 20 bp, human
gtgcgcgagccggggaactc

SEQ ID NO: 396919 - DNA, 20 bp, human
gccgccgaggccctaatgcc

SEQ ID NO: 396920 - DNA, 20 bp, human
ggggacggaccggagttccc

SEQ ID NO: 396921 - DNA, 20 bp, human
gcaccccgcccagcgcacag

SEQ ID NO: 396922 - DNA, 20 bp, human
gaggccgggcattagggcct

SEQ ID NO: 396923 - DNA, 20 bp, human
gggaggggttgccgaggggt

SEQ ID NO: 396924 - DNA, 20 bp, human
gggctcgcgcacaagggccg

SEQ ID NO: 396925 - DNA, 20 bp, human
ggacccagagacccccgcgt

SEQ ID NO: 396926 - DNA, 20 bp, human
gactagggcggtgacgtccc

SEQ ID NO: 396927 - DNA, 20 bp, human
gagccgcagcgtgccgggga

SEQ ID NO: 396928 - DNA, 20 bp, human
gccccctccccggcacgctg

SEQ ID NO: 396929 - DNA, 20 bp, human
gggagaggggccctgcgcgt

SEQ ID NO: 396930 - DNA, 20 bp, human
gcagaggggcaactccgagg

SEQ ID NO: 396931 - DNA, 20 bp, human
gccagctgcagcgtcaggcg

SEQ ID NO: 396932 - DNA, 20 bp, human
gctcccgcgccaacgcctca

SEQ ID NO: 396933 - DNA, 20 bp, human
gggcggagggcgaacccctg

SEQ ID NO: 396934 - DNA, 20 bp, human
ggggccccgggaaaacacca

SEQ ID NO: 396935 - DNA, 20 bp, human
gaacccctgaggcgttggcg

SEQ ID NO: 396936 - DNA, 20 bp, human
gcctagaggtggcgagagga

SEQ ID NO: 396937 - DNA, 20 bp, human
gcgcaggcgcgcacctgctg

SEQ ID NO: 396938 - DNA, 20 bp, human
gcgactgcagcgaggagact

SEQ ID NO: 396939 - DNA, 20 bp, human
gagactgggcggcaggaccg

SEQ ID NO: 396940 - DNA, 20 bp, human
ggggccccatccaccgcagc

SEQ ID NO: 396941 - DNA, 20 bp, human
ggccctgcggcagatgaagt

SEQ ID NO: 396942 - DNA, 20 bp, human
ggagggagcaagtgagggac

SEQ ID NO: 396943 - DNA, 20 bp, human
gcgcacctgctgcggtggat

SEQ ID NO: 396944 - DNA, 20 bp, human
gcgcactggccacgtggtcc

SEQ ID NO: 396945 - DNA, 20 bp, human
gccacgtggccagtgcgcgc

SEQ ID NO: 396946 - DNA, 20 bp, human
ggacgggcggggaccgatgg

SEQ ID NO: 396947 - DNA, 20 bp, human
gggaggggaaggcaacgctg

SEQ ID NO: 396948 - DNA, 20 bp, human
gctggacgggcggggaccga

SEQ ID NO: 396949 - DNA, 20 bp, human
gccaaggcaagatgctggac

SEQ ID NO: 396950 - DNA, 20 bp, human
gtgctcctcgggacaagagg

SEQ ID NO: 396951 - DNA, 20 bp, human
gggacaagaggaggccccgg

SEQ ID NO: 396952 - DNA, 20 bp, human
ggcaagatgctggacgggcg

SEQ ID NO: 396953 - DNA, 20 bp, human
gggaaggcaacgctgaggac

SEQ ID NO: 396954 - DNA, 20 bp, human
ggggtgctcctcgggacaag

SEQ ID NO: 396955 - DNA, 20 bp, human
gaaggcgtcagtgggaaaga

SEQ ID NO: 396956 - DNA, 20 bp, human
gccccacctcccgggaccat

SEQ ID NO: 396957 - DNA, 20 bp, human
gtaggggtttggttgtcaat

SEQ ID NO: 396958 - DNA, 20 bp, human
gcgtcagagccgatggtccc

SEQ ID NO: 396959 - DNA, 20 bp, human
ggtaaatctgcgcctgcgtg

SEQ ID NO: 396960 - DNA, 20 bp, human
gaacgcggcattatgggaag

SEQ ID NO: 396961 - DNA, 20 bp, human
gcggcttgcgccggatgttc

SEQ ID NO: 396962 - DNA, 20 bp, human
ggccggatgttcgggtttag

SEQ ID NO: 396963 - DNA, 20 bp, human
gttactagcgtcagagccga

SEQ ID NO: 396964 - DNA, 20 bp, human
gctgaagtgtgggcatccgg

SEQ ID NO: 396965 - DNA, 20 bp, human
gcagagccgatggtcccggg

SEQ ID NO: 396966 - DNA, 20 bp, human
gagctgggcgccagcgtgcg

SEQ ID NO: 396967 - DNA, 20 bp, human
gagcaggtgcgcggctgcaa

SEQ ID NO: 396968 - DNA, 20 bp, human
gcgggcccggagcggaactt

SEQ ID NO: 396969 - DNA, 20 bp, human
gcgagcgcggggccagacca

SEQ ID NO: 396970 - DNA, 20 bp, human
ggcgcggggccagaccaagg

SEQ ID NO: 396971 - DNA, 20 bp, human
gaaaaaggcgcctgtaggtc

SEQ ID NO: 396972 - DNA, 20 bp, human
gggcggggtgccacgagcgc

SEQ ID NO: 396973 - DNA, 20 bp, human
ggggaccgaagttccgctcc

SEQ ID NO: 396974 - DNA, 20 bp, human
gccaaatgactctaacacgt

SEQ ID NO: 396975 - DNA, 20 bp, human
gacggcagccgcgggaagct

SEQ ID NO: 396976 - DNA, 20 bp, human
ggggcccgagcggaaggagg

SEQ ID NO: 396977 - DNA, 20 bp, human
ggctccgagcccattcccgc

SEQ ID NO: 396978 - DNA, 20 bp, human
gggcgggcccgagcggaagg

SEQ ID NO: 396979 - DNA, 20 bp, human
gcggaagtgcgtcaccagct

SEQ ID NO: 396980 - DNA, 20 bp, human
gagtccagacaacacagtgg

SEQ ID NO: 396981 - DNA, 20 bp, human
ggacgcacttccggcgggaa

SEQ ID NO: 396982 - DNA, 20 bp, human
ggggaggcggagcgccaagc

SEQ ID NO: 396983 - DNA, 20 bp, human
gctggtgacgcacttccggc

SEQ ID NO: 396984 - DNA, 20 bp, human
gggagcgacccgcagctccg

SEQ ID NO: 396985 - DNA, 20 bp, human
gcggggcgggcccgagcgga

SEQ ID NO: 396986 - DNA, 20 bp, human
gggacccgaacgaggcgaca

SEQ ID NO: 396987 - DNA, 20 bp, human
gccgaacgaggcgacaaggt

SEQ ID NO: 396988 - DNA, 20 bp, human
ggcggggtagaggcgaggtg

SEQ ID NO: 396989 - DNA, 20 bp, human
gcggcacgcggacccgaacg

SEQ ID NO: 396990 - DNA, 20 bp, human
ggccccagcgctgacgtcgc

SEQ ID NO: 396991 - DNA, 20 bp, human
gcgcccccggcgccggcacg

SEQ ID NO: 396992 - DNA, 20 bp, human
gggccccgcgacgtcagcgc

SEQ ID NO: 396993 - DNA, 20 bp, human
gtcaaccccgaggccggcca

SEQ ID NO: 396994 - DNA, 20 bp, human
gctcgcctctaccccgcccc

SEQ ID NO: 396995 - DNA, 20 bp, human
ggtccgcgtgccggcgccgg

SEQ ID NO: 396996 - DNA, 20 bp, human
gtgcccctttaattctcctg

SEQ ID NO: 396997 - DNA, 20 bp, human
gcaagccccaggagaattaa

SEQ ID NO: 396998 - DNA, 20 bp, human
ggggccagtgccagccaagg

SEQ ID NO: 396999 - DNA, 20 bp, human
gccagccaaggaggtctgtg

SEQ ID NO: 397000 - DNA, 20 bp, human
ggtggcgtgctcaccttgag

SEQ ID NO: 397001 - DNA, 20 bp, human
gggctggcactggcccgaaa

SEQ ID NO: 397002 - DNA, 20 bp, human
gaagagtggggctaactgta

SEQ ID NO: 397003 - DNA, 20 bp, human
gccttgaggggctgcccttt

SEQ ID NO: 397004 - DNA, 20 bp, human
gtggaaggggggcattttga

SEQ ID NO: 397005 - DNA, 20 bp, human
gtgaaaagagcacagagggg

SEQ ID NO: 397006 - DNA, 20 bp, human
gaggctgacgccaggagagg

SEQ ID NO: 397007 - DNA, 20 bp, human
gacgaccggcatggtgacaa

SEQ ID NO: 397008 - DNA, 20 bp, human
gccgccgcgcctctgcgcag

SEQ ID NO: 397009 - DNA, 20 bp, human
gcgcgcgccggaagcagcct

SEQ ID NO: 397010 - DNA, 20 bp, human
gtcagagcgcctgccccgtc

SEQ ID NO: 397011 - DNA, 20 bp, human
gaggcgacgcgcagggttgt

SEQ ID NO: 397012 - DNA, 20 bp, human
ggcgcggcggctgtacaact

SEQ ID NO: 397013 - DNA, 20 bp, human
gccggcacgcacagtccgcg

SEQ ID NO: 397014 - DNA, 20 bp, human
gtctgccgtccaatcggaag

SEQ ID NO: 397015 - DNA, 20 bp, human
gcggggcgactcggagtcag

SEQ ID NO: 397016 - DNA, 20 bp, human
gcaagcgccaagggaccggt

SEQ ID NO: 397017 - DNA, 20 bp, human
gcagccaagtttagggtcgc

SEQ ID NO: 397018 - DNA, 20 bp, human
gggaaacgcagccaagttta

SEQ ID NO: 397019 - DNA, 20 bp, human
ggtgtcgatcgcggagccgt

SEQ ID NO: 397020 - DNA, 20 bp, human
gcgggctcacgcaagcgcca

SEQ ID NO: 397021 - DNA, 20 bp, human
gggctccgcgatcgacacca

SEQ ID NO: 397022 - DNA, 20 bp, human
ggaaccagcgaccctaaact

SEQ ID NO: 397023 - DNA, 20 bp, human
ggccccatcctatagcccat

SEQ ID NO: 397024 - DNA, 20 bp, human
gtggtctgcgggctggaccc

SEQ ID NO: 397025 - DNA, 20 bp, human
gaacagcaggggcgcaagta

SEQ ID NO: 397026 - DNA, 20 bp, human
gcccgaggaagcgtggtagg

SEQ ID NO: 397027 - DNA, 20 bp, human
gcgctctcgcggttcgcgga

SEQ ID NO: 397028 - DNA, 20 bp, human
gggttcgcggagggtgtcgc

SEQ ID NO: 397029 - DNA, 20 bp, human
gctaacgggcgcgcgagtgt

SEQ ID NO: 397030 - DNA, 20 bp, human
gggtctacccagagcctaac

SEQ ID NO: 397031 - DNA, 20 bp, human
ggaggcggctctgtaccaga

SEQ ID NO: 397032 - DNA, 20 bp, human
gcaccttcggctattgtcat

SEQ ID NO: 397033 - DNA, 20 bp, human
gaaccgcgagagcgcagcgc

SEQ ID NO: 397034 - DNA, 20 bp, human
gcgcctgcgctgcgctctcg

SEQ ID NO: 397035 - DNA, 20 bp, human
gtcgcgcgcccgttaggctc

SEQ ID NO: 397036 - DNA, 20 bp, human
gctcccggaagcggcacggg

SEQ ID NO: 397037 - DNA, 20 bp, human
ggccaaccctagcctgccaa

SEQ ID NO: 397038 - DNA, 20 bp, human
gggcaggctagggttggcgg

SEQ ID NO: 397039 - DNA, 20 bp, human
gcggctcccggaagcggcac

SEQ ID NO: 397040 - DNA, 20 bp, human
ggcggcccctcccgtcccgg

SEQ ID NO: 397041 - DNA, 20 bp, human
gggagcgtgcctaaggtgaa

SEQ ID NO: 397042 - DNA, 20 bp, human
gaggcgaccgtgctcgccgt

SEQ ID NO: 397043 - DNA, 20 bp, human
gggggaggaggccaacatgg

SEQ ID NO: 397044 - DNA, 20 bp, human
gggttcccccgggacgggag

SEQ ID NO: 397045 - DNA, 20 bp, human
gcggcgaaacaggcgggcgg

SEQ ID NO: 397046 - DNA, 20 bp, human
ggcccggagggtcacaatgt

SEQ ID NO: 397047 - DNA, 20 bp, human
ggcgttcccgggtggggcga

SEQ ID NO: 397048 - DNA, 20 bp, human
gggaacgccaggcccgcgca

SEQ ID NO: 397049 - DNA, 20 bp, human
ggggtcacaatgtagggtta

SEQ ID NO: 397050 - DNA, 20 bp, human
gagggaggaggactcgcgga

SEQ ID NO: 397051 - DNA, 20 bp, human
ggcgcaacctgccgcagggg

SEQ ID NO: 397052 - DNA, 20 bp, human
ggtcgcgcaacctgccgcag

SEQ ID NO: 397053 - DNA, 20 bp, human
gggcctggcgttcccgggtg

SEQ ID NO: 397054 - DNA, 20 bp, human
gcgccaggcccgcgcaggga

SEQ ID NO: 397055 - DNA, 20 bp, human
gtcacaatgtagggttaggg

SEQ ID NO: 397056 - DNA, 20 bp, human
gaataaggagcaaaggcccg

SEQ ID NO: 397057 - DNA, 20 bp, human
gcaaaggcccggggtgtgga

SEQ ID NO: 397058 - DNA, 20 bp, human
ggtgggagtagacagtatcc

SEQ ID NO: 397059 - DNA, 20 bp, human
gcaccctcaaagatcctgat

SEQ ID NO: 397060 - DNA, 20 bp, human
gggcctttgctccttattgg

SEQ ID NO: 397061 - DNA, 20 bp, human
gaccacgcagaaagtctcgt

SEQ ID NO: 397062 - DNA, 20 bp, human
gctcccaccttctctataac

SEQ ID NO: 397063 - DNA, 20 bp, human
gggtgggaaggattattgct

SEQ ID NO: 397064 - DNA, 20 bp, human
ggggaaggattattgcttgg

SEQ ID NO: 397065 - DNA, 20 bp, human
gttgctccttattggtggga

SEQ ID NO: 397066 - DNA, 20 bp, human
gtcggcgggaggattcccgg

SEQ ID NO: 397067 - DNA, 20 bp, human
gcgccgaagccccctagtgg

SEQ ID NO: 397068 - DNA, 20 bp, human
gcggaagcaggcgacgcccc

SEQ ID NO: 397069 - DNA, 20 bp, human
gagaagcagcctccactagg

SEQ ID NO: 397070 - DNA, 20 bp, human
gtgcagaagcagcctccact

SEQ ID NO: 397071 - DNA, 20 bp, human
gtgtggcagctggacccaaa

SEQ ID NO: 397072 - DNA, 20 bp, human
gtcccgccgaagccccctag

SEQ ID NO: 397073 - DNA, 20 bp, human
gcaaaagggactttcactga

SEQ ID NO: 397074 - DNA, 20 bp, human
gagaggggaggagacgatga

SEQ ID NO: 397075 - DNA, 20 bp, human
gtctctaactagggccccag

SEQ ID NO: 397076 - DNA, 20 bp, human
gcgcccggctgaccagacgt

SEQ ID NO: 397077 - DNA, 20 bp, human
ggggagcacgcagaactgtt

SEQ ID NO: 397078 - DNA, 20 bp, human
gtgcgcgcgcatgccggggg

SEQ ID NO: 397079 - DNA, 20 bp, human
gcggccccgcctgtcgctgt

SEQ ID NO: 397080 - DNA, 20 bp, human
gcgcggcccgcagcctccac

SEQ ID NO: 397081 - DNA, 20 bp, human
gtgaccaacagcgacaggcg

SEQ ID NO: 397082 - DNA, 20 bp, human
gacggagcggggtggagggc

SEQ ID NO: 397083 - DNA, 20 bp, human
ggggcctagtcctgagaggc

SEQ ID NO: 397084 - DNA, 20 bp, human
ggggccgcgctgccagtgtc

SEQ ID NO: 397085 - DNA, 20 bp, human
ggcgggagaccggtgacccg

SEQ ID NO: 397086 - DNA, 20 bp, human
gagcccgtacctagacccgt

SEQ ID NO: 397087 - DNA, 20 bp, human
ggcgcaggcctcccgaccta

SEQ ID NO: 397088 - DNA, 20 bp, human
gcctcccgacctacgggtct

SEQ ID NO: 397089 - DNA, 20 bp, human
gtctgcgcagtgccgggcgc

SEQ ID NO: 397090 - DNA, 20 bp, human
ggacctacgggtctaggtac

SEQ ID NO: 397091 - DNA, 20 bp, human
gggcgtaacggcaggagtta

SEQ ID NO: 397092 - DNA, 20 bp, human
gaagcgaggtggggtgtggt

SEQ ID NO: 397093 - DNA, 20 bp, human
gacgggctctagcgtggccg

SEQ ID NO: 397094 - DNA, 20 bp, human
gtcctggcctagagctggtg

SEQ ID NO: 397095 - DNA, 20 bp, human
gtagagctggtggggcgtaa

SEQ ID NO: 397096 - DNA, 20 bp, human
gggcggaagcctccagtcta

SEQ ID NO: 397097 - DNA, 20 bp, human
gtaggggtggctgcagaacc

SEQ ID NO: 397098 - DNA, 20 bp, human
ggcagccacccctagactgg

SEQ ID NO: 397099 - DNA, 20 bp, human
gctcggagttacacgttcta

SEQ ID NO: 397100 - DNA, 20 bp, human
gtctgcagccacccctagac

SEQ ID NO: 397101 - DNA, 20 bp, human
gccaccagctggagctcgcc

SEQ ID NO: 397102 - DNA, 20 bp, human
gcagctggtggcgcagagtc

SEQ ID NO: 397103 - DNA, 20 bp, human
gccccggccccgggaagggt

SEQ ID NO: 397104 - DNA, 20 bp, human
ggtgactaggaaagtcactt

SEQ ID NO: 397105 - DNA, 20 bp, human
gaacgtgtaactccgagatc

SEQ ID NO: 397106 - DNA, 20 bp, human
gacgccggggcctgttgcta

SEQ ID NO: 397107 - DNA, 20 bp, human
gcccggagagcaatagctga

SEQ ID NO: 397108 - DNA, 20 bp, human
gagaccgcaggacagctccc

SEQ ID NO: 397109 - DNA, 20 bp, human
gccagcgtagcaaccgacgc

SEQ ID NO: 397110 - DNA, 20 bp, human
gttcccttagcaacaggccc

SEQ ID NO: 397111 - DNA, 20 bp, human
gtcgggggaacgtagaccgc

SEQ ID NO: 397112 - DNA, 20 bp, human
gaacagccgaaagtcgggtc

SEQ ID NO: 397113 - DNA, 20 bp, human
ggaggccaacagccgaaagt

SEQ ID NO: 397114 - DNA, 20 bp, human
ggaccggaagtagctgcccc

SEQ ID NO: 397115 - DNA, 20 bp, human
gccgcaggttccgctgtctc

SEQ ID NO: 397116 - DNA, 20 bp, human
ggggaggcacgtcacgtgag

SEQ ID NO: 397117 - DNA, 20 bp, human
gagcctccaggcatcgcgtc

SEQ ID NO: 397118 - DNA, 20 bp, human
gtctagtgtgggcgccgtcc

SEQ ID NO: 397119 - DNA, 20 bp, human
gacggcgcccacactagaca

SEQ ID NO: 397120 - DNA, 20 bp, human
ggggaggccatgtctagtgt

SEQ ID NO: 397121 - DNA, 20 bp, human
gtcggccgccatgttcactg

SEQ ID NO: 397122 - DNA, 20 bp, human
ggcatcgcgtccggctggag

SEQ ID NO: 397123 - DNA, 20 bp, human
gactagacatggcctccctc

SEQ ID NO: 397124 - DNA, 20 bp, human
gcctgctgcgtgaagcccga

SEQ ID NO: 397125 - DNA, 20 bp, human
gctgggctcccgttggatgg

SEQ ID NO: 397126 - DNA, 20 bp, human
gcagctccgccgagggtcac

SEQ ID NO: 397127 - DNA, 20 bp, human
ggccctgggcggccgttacc

SEQ ID NO: 397128 - DNA, 20 bp, human
gcctgcgcgcggttagcttg

SEQ ID NO: 397129 - DNA, 20 bp, human
gtggcaagagggcgtgagga

SEQ ID NO: 397130 - DNA, 20 bp, human
ggaccctcggcggagctggc

SEQ ID NO: 397131 - DNA, 20 bp, human
gtaaccgcgcgcaggagcgc

SEQ ID NO: 397132 - DNA, 20 bp, human
ggcgcggttagcttggggag

SEQ ID NO: 397133 - DNA, 20 bp, human
ggcggaagagtcacgtgatc

SEQ ID NO: 397134 - DNA, 20 bp, human
gcgggtcccgtgaccctcgg

SEQ ID NO: 397135 - DNA, 20 bp, human
gctgcgattggcgggaagat

SEQ ID NO: 397136 - DNA, 20 bp, human
gcggccccggagacaccgga

SEQ ID NO: 397137 - DNA, 20 bp, human
ggctccttccggtgtctccg

SEQ ID NO: 397138 - DNA, 20 bp, human
gtgcagtcagagtagggagc

SEQ ID NO: 397139 - DNA, 20 bp, human
ggcgtctccggcgatagggg

SEQ ID NO: 397140 - DNA, 20 bp, human
gtctccggcgataggggagg

SEQ ID NO: 397141 - DNA, 20 bp, human
gactgcaaactaactgtaca

SEQ ID NO: 397142 - DNA, 20 bp, human
ggcggcggccccggagacac

SEQ ID NO: 397143 - DNA, 20 bp, human
gcccccacctcccctatcgc

SEQ ID NO: 397144 - DNA, 20 bp, human
gcaggcgtctccggcgatag

SEQ ID NO: 397145 - DNA, 20 bp, human
gcgatgggagcccgccccag

SEQ ID NO: 397146 - DNA, 20 bp, human
gcgcggagggggtggaccga

SEQ ID NO: 397147 - DNA, 20 bp, human
ggggtgggcgagcgcgcgga

SEQ ID NO: 397148 - DNA, 20 bp, human
gcggggaggccggacggaag

SEQ ID NO: 397149 - DNA, 20 bp, human
gcagcccggatctctgtcag

SEQ ID NO: 397150 - DNA, 20 bp, human
gcggcgagccggccacggcg

SEQ ID NO: 397151 - DNA, 20 bp, human
gcgtgcggcgtgtgtgcgga

SEQ ID NO: 397152 - DNA, 20 bp, human
gtctctgtcagcggccggaa

SEQ ID NO: 397153 - DNA, 20 bp, human
ggacagagatccgggctggg

SEQ ID NO: 397154 - DNA, 20 bp, human
gggagcgtgcggcgtgtgtg

SEQ ID NO: 397155 - DNA, 20 bp, human
gggggggagtccgggtgagt

SEQ ID NO: 397156 - DNA, 20 bp, human
ggggactggtagttctctct

SEQ ID NO: 397157 - DNA, 20 bp, human
gccagccggccggacaccgg

SEQ ID NO: 397158 - DNA, 20 bp, human
ggggagaggctgcagagcga

SEQ ID NO: 397159 - DNA, 20 bp, human
gacaccggcggggacgaggc

SEQ ID NO: 397160 - DNA, 20 bp, human
gaggccagccggccggacac

SEQ ID NO: 397161 - DNA, 20 bp, human
gggccagcgcagctttgcga

SEQ ID NO: 397162 - DNA, 20 bp, human
ggggcgaggtgcgtgaaatg

SEQ ID NO: 397163 - DNA, 20 bp, human
gactaccggcgagggtacgt

SEQ ID NO: 397164 - DNA, 20 bp, human
ggcgaactccatctcccagg

SEQ ID NO: 397165 - DNA, 20 bp, human
gggtctgtgcgctgccttcc

SEQ ID NO: 397166 - DNA, 20 bp, human
gcgcacttgcgtcatcacgt

SEQ ID NO: 397167 - DNA, 20 bp, human
ggacgtaggcgacacggaag

SEQ ID NO: 397168 - DNA, 20 bp, human
gctggcggggtcccgtgatg

SEQ ID NO: 397169 - DNA, 20 bp, human
gcgctgcgctaactccgaaa

SEQ ID NO: 397170 - DNA, 20 bp, human
ggcgacacggaagcggcggt

SEQ ID NO: 397171 - DNA, 20 bp, human
ggtaggcgacacggaagcgg

SEQ ID NO: 397172 - DNA, 20 bp, human
gtaactccgaaagggttggg

SEQ ID NO: 397173 - DNA, 20 bp, human
gtcaccctgccgcggcacag

SEQ ID NO: 397174 - DNA, 20 bp, human
gcgtgatggggaggtgacgt

SEQ ID NO: 397175 - DNA, 20 bp, human
gggaggtgacgtaggcgaca

SEQ ID NO: 397176 - DNA, 20 bp, human
ggcgtcgaaatcgggtgagg

SEQ ID NO: 397177 - DNA, 20 bp, human
gcggggcgagggcgtgtgag

SEQ ID NO: 397178 - DNA, 20 bp, human
gcccctgccgtgactgtagt

SEQ ID NO: 397179 - DNA, 20 bp, human
gtacagtcacggcaggggcg

SEQ ID NO: 397180 - DNA, 20 bp, human
gcccgactgggttgcgtagg

SEQ ID NO: 397181 - DNA, 20 bp, human
ggtgggggggcgtcgaaatc

SEQ ID NO: 397182 - DNA, 20 bp, human
ggccccgccagtacctagag

SEQ ID NO: 397183 - DNA, 20 bp, human
gggagcgagccggagtcgga

SEQ ID NO: 397184 - DNA, 20 bp, human
gggggcgtcgaaatcgggtg

SEQ ID NO: 397185 - DNA, 20 bp, human
gcgcgtgcctactacagtca

SEQ ID NO: 397186 - DNA, 20 bp, human
ggggaagggagtctacgact

SEQ ID NO: 397187 - DNA, 20 bp, human
ggagagaggcggacaggcgg

SEQ ID NO: 397188 - DNA, 20 bp, human
gagtctacgactcgggaggg

SEQ ID NO: 397189 - DNA, 20 bp, human
gtacgactcgggagggaggt

SEQ ID NO: 397190 - DNA, 20 bp, human
gggagagtgtgtcgagtcac

SEQ ID NO: 397191 - DNA, 20 bp, human
ggagaaggagagaggcggac

SEQ ID NO: 397192 - DNA, 20 bp, human
gggaaggagactcccagcgc

SEQ ID NO: 397193 - DNA, 20 bp, human
ggggagtctacgactcggga

SEQ ID NO: 397194 - DNA, 20 bp, human
gaaggagagaggcggacagg

SEQ ID NO: 397195 - DNA, 20 bp, human
gaggagactcccagcgccgg

SEQ ID NO: 397196 - DNA, 20 bp, human
ggcgactcgtagagagttcg

SEQ ID NO: 397197 - DNA, 20 bp, human
gggcccacagaaggttctaa

SEQ ID NO: 397198 - DNA, 20 bp, human
ggctgcagaaaatttgtggg

SEQ ID NO: 397199 - DNA, 20 bp, human
gtccccttagaaccttctgt

SEQ ID NO: 397200 - DNA, 20 bp, human
gtctctacgagtcgccactg

SEQ ID NO: 397201 - DNA, 20 bp, human
ggcacaaggccaatcaggag

SEQ ID NO: 397202 - DNA, 20 bp, human
gcacgctgcagaaaatttgt

SEQ ID NO: 397203 - DNA, 20 bp, human
ggtaaactgtaaacgacagt

SEQ ID NO: 397204 - DNA, 20 bp, human
gtaccagcccctctcctgat

SEQ ID NO: 397205 - DNA, 20 bp, human
gggcggtgctgttcctgcac

SEQ ID NO: 397206 - DNA, 20 bp, human
gcggccctttaaacctttca

SEQ ID NO: 397207 - DNA, 20 bp, human
ggcgaggcctggggcctcca

SEQ ID NO: 397208 - DNA, 20 bp, human
gcagccctgaaaggtttaaa

SEQ ID NO: 397209 - DNA, 20 bp, human
ggctagagtcggcgccacga

SEQ ID NO: 397210 - DNA, 20 bp, human
gctccggggaggtgcgtact

SEQ ID NO: 397211 - DNA, 20 bp, human
gccctcggagcagccctgaa

SEQ ID NO: 397212 - DNA, 20 bp, human
ggtggcgccgactctagctg

SEQ ID NO: 397213 - DNA, 20 bp, human
gaccctgctcggccccctcg

SEQ ID NO: 397214 - DNA, 20 bp, human
gccccgcgcccgcgtcacgg

SEQ ID NO: 397215 - DNA, 20 bp, human
gagcccagtacgcacctccc

SEQ ID NO: 397216 - DNA, 20 bp, human
gctcgcgccacctagctcac

SEQ ID NO: 397217 - DNA, 20 bp, human
ggcgcccgaaggccgcgtag

SEQ ID NO: 397218 - DNA, 20 bp, human
gctagctcaccggcgaacag

SEQ ID NO: 397219 - DNA, 20 bp, human
gaggcacacgcgagaggggt

SEQ ID NO: 397220 - DNA, 20 bp, human
gcggaaaggcacacgcgaga

SEQ ID NO: 397221 - DNA, 20 bp, human
gtaggtggcgcgagagcgga

SEQ ID NO: 397222 - DNA, 20 bp, human
gggggtgcccgatgggtcgt

SEQ ID NO: 397223 - DNA, 20 bp, human
gtcaccggcgaacagtggag

SEQ ID NO: 397224 - DNA, 20 bp, human
ggaaggccgcggctcgaggt

SEQ ID NO: 397225 - DNA, 20 bp, human
gcgcgcgcggggcggatgtc

SEQ ID NO: 397226 - DNA, 20 bp, human
gggacccgcgaactcaccag

SEQ ID NO: 397227 - DNA, 20 bp, human
gccctcgcacggggccttat

SEQ ID NO: 397228 - DNA, 20 bp, human
gaggggccggcgctccagcg

SEQ ID NO: 397229 - DNA, 20 bp, human
ggagcgccggcccctcgcac

SEQ ID NO: 397230 - DNA, 20 bp, human
gagctcgcttacaagtccgc

SEQ ID NO: 397231 - DNA, 20 bp, human
gaagtccgctggtgagttcg

SEQ ID NO: 397232 - DNA, 20 bp, human
gtcttctgctccaagagttt

SEQ ID NO: 397233 - DNA, 20 bp, human
gagagtttgggaactggagc

SEQ ID NO: 397234 - DNA, 20 bp, human
ggcgctccagcggggcatcc

SEQ ID NO: 397235 - DNA, 20 bp, human
ggaacgaatgagtggtccgc

SEQ ID NO: 397236 - DNA, 20 bp, human
gtatccttccagggaggaac

SEQ ID NO: 397237 - DNA, 20 bp, human
gcagacatatccttccaggg

SEQ ID NO: 397238 - DNA, 20 bp, human
gtcccaaagctcggtggttg

SEQ ID NO: 397239 - DNA, 20 bp, human
gcacctggagccaatgaggc

SEQ ID NO: 397240 - DNA, 20 bp, human
gtctcctagctgttgcccga

SEQ ID NO: 397241 - DNA, 20 bp, human
gcctgcacctggagccaatg

SEQ ID NO: 397242 - DNA, 20 bp, human
gtagctgttgcccgagggat

SEQ ID NO: 397243 - DNA, 20 bp, human
gtacctgcctcattggctcc

SEQ ID NO: 397244 - DNA, 20 bp, human
gcccgcagacatatccttcc

SEQ ID NO: 397245 - DNA, 20 bp, human
gaggcatgggacttgcccac

SEQ ID NO: 397246 - DNA, 20 bp, human
gggccgtcgcacaagaagcg

SEQ ID NO: 397247 - DNA, 20 bp, human
ggcccaagagccgtgggcga

SEQ ID NO: 397248 - DNA, 20 bp, human
gaagcacggcgagtgtggga

SEQ ID NO: 397249 - DNA, 20 bp, human
gcgtctgcgcgccggcgaaa

SEQ ID NO: 397250 - DNA, 20 bp, human
gctaacaagcacggcgagtg

SEQ ID NO: 397251 - DNA, 20 bp, human
gggcgcgcagctaacaagca

SEQ ID NO: 397252 - DNA, 20 bp, human
ggggcgcggcgctgacccgg

SEQ ID NO: 397253 - DNA, 20 bp, human
gctccctctgccggcccgac

SEQ ID NO: 397254 - DNA, 20 bp, human
ggccttcgcccacggctctt

SEQ ID NO: 397255 - DNA, 20 bp, human
gcgtcaccagagcgccggtc

SEQ ID NO: 397256 - DNA, 20 bp, human
ggcggcaccaggcaggggta

SEQ ID NO: 397257 - DNA, 20 bp, human
gtggcccggcgctgccctgg

SEQ ID NO: 397258 - DNA, 20 bp, human
gtacgaggtaaggaagggtg

SEQ ID NO: 397259 - DNA, 20 bp, human
ggccccgcgcgggaatccgg

SEQ ID NO: 397260 - DNA, 20 bp, human
gcggcgaaacccaggtctgt

SEQ ID NO: 397261 - DNA, 20 bp, human
ggactgggagtcttcgtggt

SEQ ID NO: 397262 - DNA, 20 bp, human
ggggcagacggtctggaagg

SEQ ID NO: 397263 - DNA, 20 bp, human
gactcccagtcagcgcagcg

SEQ ID NO: 397264 - DNA, 20 bp, human
gtgaaggctgctcgaggaac

SEQ ID NO: 397265 - DNA, 20 bp, human
gccagtcagcgcagcggggg

SEQ ID NO: 397266 - DNA, 20 bp, human
gaagagccggcgcaggggtg

SEQ ID NO: 397267 - DNA, 20 bp, human
gccctgcgccggctcttcgc

SEQ ID NO: 397268 - DNA, 20 bp, human
gcggcgccggggaccgtccg

SEQ ID NO: 397269 - DNA, 20 bp, human
gggtccccggcgccgcaagt

SEQ ID NO: 397270 - DNA, 20 bp, human
ggccgccttccgcgcctcgt

SEQ ID NO: 397271 - DNA, 20 bp, human
gcggccgcgacgacccggtg

SEQ ID NO: 397272 - DNA, 20 bp, human
gtggccccgacccccccacg

SEQ ID NO: 397273 - DNA, 20 bp, human
gggcaccgagaacctgccgg

SEQ ID NO: 397274 - DNA, 20 bp, human
ggccttccgcgcctcgtggg

SEQ ID NO: 397275 - DNA, 20 bp, human
gccgccgcaccgggtcgtcg

SEQ ID NO: 397276 - DNA, 20 bp, human
gttacgatgcaaatagaagc

SEQ ID NO: 397277 - DNA, 20 bp, human
gataatgcactgctgggggt

SEQ ID NO: 397278 - DNA, 20 bp, human
gtggccggtactaggaactg

SEQ ID NO: 397279 - DNA, 20 bp, human
gctggggatcagggaagcaa

SEQ ID NO: 397280 - DNA, 20 bp, human
gggatggggatctgcacgcc

SEQ ID NO: 397281 - DNA, 20 bp, human
gacagtcccggcccccaaag

SEQ ID NO: 397282 - DNA, 20 bp, human
ggcataataatgcactgctg

SEQ ID NO: 397283 - DNA, 20 bp, human
ggagcgtggaagtgatgttt

SEQ ID NO: 397284 - DNA, 20 bp, human
ggggagcaagtgcacagtcc

SEQ ID NO: 397285 - DNA, 20 bp, human
gtttaagccaaacctgaaag

SEQ ID NO: 397286 - DNA, 20 bp, human
gcggactcctgcaacatccg

SEQ ID NO: 397287 - DNA, 20 bp, human
gctaacaaattgctagtcgg

SEQ ID NO: 397288 - DNA, 20 bp, human
ggcgccgcctggaaccctcc

SEQ ID NO: 397289 - DNA, 20 bp, human
gggggaggggtgaaagggcg

SEQ ID NO: 397290 - DNA, 20 bp, human
ggcccccagccaggaccggg

SEQ ID NO: 397291 - DNA, 20 bp, human
gaccctcccggtcctggctg

SEQ ID NO: 397292 - DNA, 20 bp, human
gagggcggggccggcttgcg

SEQ ID NO: 397293 - DNA, 20 bp, human
gagattatcagggactctcc

SEQ ID NO: 397294 - DNA, 20 bp, human
gctgcggacacgcagaacgc

SEQ ID NO: 397295 - DNA, 20 bp, human
gggtaacggagggaaatcgg

SEQ ID NO: 397296 - DNA, 20 bp, human
ggcgccgcgtgagtccgagc

SEQ ID NO: 397297 - DNA, 20 bp, human
gcagcctggagcgctctgag

SEQ ID NO: 397298 - DNA, 20 bp, human
gagggccgccgcttccgcgt

SEQ ID NO: 397299 - DNA, 20 bp, human
gtcccagccaaactgaaagc

SEQ ID NO: 397300 - DNA, 20 bp, human
ggaccccgacgcggaagcgg

SEQ ID NO: 397301 - DNA, 20 bp, human
gcggactggaatgccgggcc

SEQ ID NO: 397302 - DNA, 20 bp, human
gccgggggacctgcgaggtg

SEQ ID NO: 397303 - DNA, 20 bp, human
gttccagtccgaatagaaag

SEQ ID NO: 397304 - DNA, 20 bp, human
gcccccggccgaccccgacg

SEQ ID NO: 397305 - DNA, 20 bp, human
gaatcaaatggaaaagcagg

SEQ ID NO: 397306 - DNA, 20 bp, human
gcaagcccggcgcctggcgt

SEQ ID NO: 397307 - DNA, 20 bp, human
gggcagagggagtcccgaga

SEQ ID NO: 397308 - DNA, 20 bp, human
ggcccggcgcctggcgtcgg

SEQ ID NO: 397309 - DNA, 20 bp, human
ggccccgggaggtacagaat

SEQ ID NO: 397310 - DNA, 20 bp, human
ggccaattctgtacctcccg

SEQ ID NO: 397311 - DNA, 20 bp, human
gagaagctagcgacaagtgc

SEQ ID NO: 397312 - DNA, 20 bp, human
ggcctggggtatctgaagag

SEQ ID NO: 397313 - DNA, 20 bp, human
ggagtccgaagagcccgaga

SEQ ID NO: 397314 - DNA, 20 bp, human
ggggctccaagcccggcgcc

SEQ ID NO: 397315 - DNA, 20 bp, human
gccacagccgccttcgtcgt

SEQ ID NO: 397316 - DNA, 20 bp, human
gagtgcgccgccctgaacgg

SEQ ID NO: 397317 - DNA, 20 bp, human
gtagaggaagcgtacgtccg

SEQ ID NO: 397318 - DNA, 20 bp, human
gcccctaacccgacgggctg

SEQ ID NO: 397319 - DNA, 20 bp, human
gcccgcgcccctaacccgac

SEQ ID NO: 397320 - DNA, 20 bp, human
gcgcgggcgcggggtgtgtc

SEQ ID NO: 397321 - DNA, 20 bp, human
gaggaagcgtacgtccgagg

SEQ ID NO: 397322 - DNA, 20 bp, human
gcgcccgcggacgttaaagg

SEQ ID NO: 397323 - DNA, 20 bp, human
gtacctcagcccgtcgggtt

SEQ ID NO: 397324 - DNA, 20 bp, human
gtcctctacctcagcccgtc

SEQ ID NO: 397325 - DNA, 20 bp, human
gaggtcccatgacgtcagga

SEQ ID NO: 397326 - DNA, 20 bp, human
ggcaccggcacccgttccga

SEQ ID NO: 397327 - DNA, 20 bp, human
ggcggcgcgaaccctcggaa

SEQ ID NO: 397328 - DNA, 20 bp, human
gtgggccgcgaccccggcac

SEQ ID NO: 397329 - DNA, 20 bp, human
gtaaggggcggcggcgtagg

SEQ ID NO: 397330 - DNA, 20 bp, human
ggccgcaggcgcaaagttta

SEQ ID NO: 397331 - DNA, 20 bp, human
ggaaccctcggaacgggtgc

SEQ ID NO: 397332 - DNA, 20 bp, human
gttgagcctggcgtaagggg

SEQ ID NO: 397333 - DNA, 20 bp, human
gcacaggagggtaaataaga

SEQ ID NO: 397334 - DNA, 20 bp, human
gcggcccagcgctgcgccgt

SEQ ID NO: 397335 - DNA, 20 bp, human
gcaaagcggccgcgcgtttg

SEQ ID NO: 397336 - DNA, 20 bp, human
gcggggcaggggcggagcac

SEQ ID NO: 397337 - DNA, 20 bp, human
gcgcgagaatggcagttgga

SEQ ID NO: 397338 - DNA, 20 bp, human
ggcacgtagagcagctaggt

SEQ ID NO: 397339 - DNA, 20 bp, human
gtcagtcaagcgcggggcag

SEQ ID NO: 397340 - DNA, 20 bp, human
gtcgttaggggcatgcgccg

SEQ ID NO: 397341 - DNA, 20 bp, human
gcgccctggaggagtgggat

SEQ ID NO: 397342 - DNA, 20 bp, human
gaatgagcgccactcgttag

SEQ ID NO: 397343 - DNA, 20 bp, human
gacgtgcgctcccgccctgg

SEQ ID NO: 397344 - DNA, 20 bp, human
gtgtccggtcggaaagtcga

SEQ ID NO: 397345 - DNA, 20 bp, human
gggaggggactgggaacggt

SEQ ID NO: 397346 - DNA, 20 bp, human
gcaggccccccgccaatcca

SEQ ID NO: 397347 - DNA, 20 bp, human
ggagaccttggattggcggg

SEQ ID NO: 397348 - DNA, 20 bp, human
gtcagcagaaatgtgggtcg

SEQ ID NO: 397349 - DNA, 20 bp, human
ggacaaggagcccacttttc

SEQ ID NO: 397350 - DNA, 20 bp, human
gctcgaatccctccctggtg

SEQ ID NO: 397351 - DNA, 20 bp, human
ggagagagaccttggattgg

SEQ ID NO: 397352 - DNA, 20 bp, human
gtggaaatgaacacgacatg

SEQ ID NO: 397353 - DNA, 20 bp, human
gaagagaatcagcagaaatg

SEQ ID NO: 397354 - DNA, 20 bp, human
ggaggatggagccatcagtc

SEQ ID NO: 397355 - DNA, 20 bp, human
gaatgtgggtcggggatttg

SEQ ID NO: 397356 - DNA, 20 bp, human
ggggtgaggaaattccctca

SEQ ID NO: 397357 - DNA, 20 bp, human
gactgagttagtggacacta

SEQ ID NO: 397358 - DNA, 20 bp, human
gatgtacggaaaatccaagt

SEQ ID NO: 397359 - DNA, 20 bp, human
ggtgtccactaactcagtgg

SEQ ID NO: 397360 - DNA, 20 bp, human
gtggtgtagtcgctgggaag

SEQ ID NO: 397361 - DNA, 20 bp, human
gtgccatgagacactgttac

SEQ ID NO: 397362 - DNA, 20 bp, human
gcaacatgatagaatcttga

SEQ ID NO: 397363 - DNA, 20 bp, human
gtggaaatcctcgctccccg

SEQ ID NO: 397364 - DNA, 20 bp, human
gtggaaaggattatgatgta

SEQ ID NO: 397365 - DNA, 20 bp, human
gagggaatttcctcaccccg

SEQ ID NO: 397366 - DNA, 20 bp, human
gaggggcctctcagttgagt

SEQ ID NO: 397367 - DNA, 20 bp, human
gcagatcatgccaggggact

SEQ ID NO: 397368 - DNA, 20 bp, human
ggggtccgctggatctccgg

SEQ ID NO: 397369 - DNA, 20 bp, human
ggccgatgggaggggtcctg

SEQ ID NO: 397370 - DNA, 20 bp, human
gagctcaagggccgatggga

SEQ ID NO: 397371 - DNA, 20 bp, human
gggaacagaaggctagcgag

SEQ ID NO: 397372 - DNA, 20 bp, human
gcccacctccggagatccag

SEQ ID NO: 397373 - DNA, 20 bp, human
gagaggcccctggagctgat

SEQ ID NO: 397374 - DNA, 20 bp, human
ggaaggctagcgagcggtgg

SEQ ID NO: 397375 - DNA, 20 bp, human
ggcaccgcggccatgacgct

SEQ ID NO: 397376 - DNA, 20 bp, human
gaaggcggagcccgctccga

SEQ ID NO: 397377 - DNA, 20 bp, human
gagcggaggcggagttacct

SEQ ID NO: 397378 - DNA, 20 bp, human
gaaagccgggaaatcgcgag

SEQ ID NO: 397379 - DNA, 20 bp, human
gtcgagcccgcccctcggag

SEQ ID NO: 397380 - DNA, 20 bp, human
gatacagttggcttcctcgg

SEQ ID NO: 397381 - DNA, 20 bp, human
gacctcggtgagcgtgaagg

SEQ ID NO: 397382 - DNA, 20 bp, human
gcacagggtcgggctctggg

SEQ ID NO: 397383 - DNA, 20 bp, human
gcacgccatcaaatccccgc

SEQ ID NO: 397384 - DNA, 20 bp, human
gtattcccgcggggatttga

SEQ ID NO: 397385 - DNA, 20 bp, human
gcagagcccgaccctgtgag

SEQ ID NO: 397386 - DNA, 20 bp, human
ggaacaggatatcagagaga

SEQ ID NO: 397387 - DNA, 20 bp, human
gaatagctagagctgtgggg

SEQ ID NO: 397388 - DNA, 20 bp, human
ggggaatagctagagctgtg

SEQ ID NO: 397389 - DNA, 20 bp, human
ggttctgcgggaagtccttg

SEQ ID NO: 397390 - DNA, 20 bp, human
ggtgctgagttcctggtagt

SEQ ID NO: 397391 - DNA, 20 bp, human
gctctgatatcctgttctgc

SEQ ID NO: 397392 - DNA, 20 bp, human
gattgtcagtgctgagttcc

SEQ ID NO: 397393 - DNA, 20 bp, human
gaacaataaggtttgcaggg

SEQ ID NO: 397394 - DNA, 20 bp, human
gactgtgaatctaaaccaca

SEQ ID NO: 397395 - DNA, 20 bp, human
gggctgctgcttccaaagaa

SEQ ID NO: 397396 - DNA, 20 bp, human
gtttcacgggtgtcccggac

SEQ ID NO: 397397 - DNA, 20 bp, human
gtcccggacaggcgtggagg

SEQ ID NO: 397398 - DNA, 20 bp, human
gcggcttcaaggcgtttcac

SEQ ID NO: 397399 - DNA, 20 bp, human
gccccacctccacgcctgtc

SEQ ID NO: 397400 - DNA, 20 bp, human
ggcgaggatgaagcttgagt

SEQ ID NO: 397401 - DNA, 20 bp, human
gcgggtgtcccggacaggcg

SEQ ID NO: 397402 - DNA, 20 bp, human
gaccgcgtccgtcggggctg

SEQ ID NO: 397403 - DNA, 20 bp, human
gcaggcgggaccgcgtccgt

SEQ ID NO: 397404 - DNA, 20 bp, human
gttctcgtgtgctctcgcca

SEQ ID NO: 397405 - DNA, 20 bp, human
gtgctgggaaaatgaatctt

SEQ ID NO: 397406 - DNA, 20 bp, human
gaggactcggttcgactcga

SEQ ID NO: 397407 - DNA, 20 bp, human
ggcccctcctgactgctagt

SEQ ID NO: 397408 - DNA, 20 bp, human
gatggtgcgggcctaagccc

SEQ ID NO: 397409 - DNA, 20 bp, human
gctcccccagcggcttgtct

SEQ ID NO: 397410 - DNA, 20 bp, human
gggcctaagccccgggaagc

SEQ ID NO: 397411 - DNA, 20 bp, human
gcggttcgactcgatggtgc

SEQ ID NO: 397412 - DNA, 20 bp, human
ggggagaggggaaacacttc

SEQ ID NO: 397413 - DNA, 20 bp, human
gtcccggcttcccggggctt

SEQ ID NO: 397414 - DNA, 20 bp, human
gcaaggtagcgtcgagtgag

SEQ ID NO: 397415 - DNA, 20 bp, human
ggggacagctagcggcgcgg

SEQ ID NO: 397416 - DNA, 20 bp, human
gatatcgagacacaagatga

SEQ ID NO: 397417 - DNA, 20 bp, human
gtcaagccgctgtttgttag

SEQ ID NO: 397418 - DNA, 20 bp, human
gggctggtgtgcctcatagt

SEQ ID NO: 397419 - DNA, 20 bp, human
gatggaatgctggtgtaggc

SEQ ID NO: 397420 - DNA, 20 bp, human
gtccatccgctaacaaacag

SEQ ID NO: 397421 - DNA, 20 bp, human
gaggctacatcccaactatg

SEQ ID NO: 397422 - DNA, 20 bp, human
gggagaaaaaaaccttgctg

SEQ ID NO: 397423 - DNA, 20 bp, human
gctgaaacgggctgaaacag

SEQ ID NO: 397424 - DNA, 20 bp, human
gttgttagcggatggaatgc

SEQ ID NO: 397425 - DNA, 20 bp, human
gcaaagctgatcattgttga

SEQ ID NO: 397426 - DNA, 20 bp, human
gggagcgcagggcggagcac

SEQ ID NO: 397427 - DNA, 20 bp, human
gtagccctgcggaggtgaac

SEQ ID NO: 397428 - DNA, 20 bp, human
gagcgagcgaggagagcaag

SEQ ID NO: 397429 - DNA, 20 bp, human
gcagccccgcggcggaccct

SEQ ID NO: 397430 - DNA, 20 bp, human
gagcgaggagagcaagcggg

SEQ ID NO: 397431 - DNA, 20 bp, human
gcggtgacttagccctgcgg

SEQ ID NO: 397432 - DNA, 20 bp, human
gcccaggagcggcaatgagg

SEQ ID NO: 397433 - DNA, 20 bp, human
gtgaaatgtcacatccgcat

SEQ ID NO: 397434 - DNA, 20 bp, human
ggcagggctaagtcaccggg

SEQ ID NO: 397435 - DNA, 20 bp, human
gcaacctccagcgctcgccc

SEQ ID NO: 397436 - DNA, 20 bp, human
ggcgagggatggtcgaggga

SEQ ID NO: 397437 - DNA, 20 bp, human
ggccctcaccgaaaagggga

SEQ ID NO: 397438 - DNA, 20 bp, human
ggggtcgaggaggacgttat

SEQ ID NO: 397439 - DNA, 20 bp, human
ggcggggcgagggatggtcg

SEQ ID NO: 397440 - DNA, 20 bp, human
ggggtgggcggtggcggcaa

SEQ ID NO: 397441 - DNA, 20 bp, human
gccgcggccctcaccgaaaa

SEQ ID NO: 397442 - DNA, 20 bp, human
gcgaggaggacgttatgggt

SEQ ID NO: 397443 - DNA, 20 bp, human
gtctccagacgtcacggcag

SEQ ID NO: 397444 - DNA, 20 bp, human
gaatgcagggtgcagtgcgg

SEQ ID NO: 397445 - DNA, 20 bp, human
ggccctccccttttcggtga

SEQ ID NO: 397446 - DNA, 20 bp, human
gaaggggcgggccctgacgg

SEQ ID NO: 397447 - DNA, 20 bp, human
gaacccggagagctagggtg

SEQ ID NO: 397448 - DNA, 20 bp, human
gcgaaaggaggggcctgaaa

SEQ ID NO: 397449 - DNA, 20 bp, human
gtgaaaggggcgggccctga

SEQ ID NO: 397450 - DNA, 20 bp, human
ggagaacttcgggtcttggg

SEQ ID NO: 397451 - DNA, 20 bp, human
gcgaagcccggccccctcag

SEQ ID NO: 397452 - DNA, 20 bp, human
gccttgacggcccggggtgg

SEQ ID NO: 397453 - DNA, 20 bp, human
ggggggagggccgaaaggag

SEQ ID NO: 397454 - DNA, 20 bp, human
ggagctgtgtaaggcgggga

SEQ ID NO: 397455 - DNA, 20 bp, human
gaccccgggccgtcaaggct

SEQ ID NO: 397456 - DNA, 20 bp, human
ggctgagtcgggctttttat

SEQ ID NO: 397457 - DNA, 20 bp, human
gaatgaaacggcaggcaaaa

SEQ ID NO: 397458 - DNA, 20 bp, human
gcaaacctgaaaagggacga

SEQ ID NO: 397459 - DNA, 20 bp, human
gagtcaggcaaacctgaaaa

SEQ ID NO: 397460 - DNA, 20 bp, human
gtgggggaggggcaagccat

SEQ ID NO: 397461 - DNA, 20 bp, human
gtcagcctgtggcctgtttt

SEQ ID NO: 397462 - DNA, 20 bp, human
gctaacaaagtgagcaaggt

SEQ ID NO: 397463 - DNA, 20 bp, human
gaaacccctcgtcccttttc

SEQ ID NO: 397464 - DNA, 20 bp, human
gccctctaatatggctgagt

SEQ ID NO: 397465 - DNA, 20 bp, human
gcaatcataaatgaaacggc

SEQ ID NO: 397466 - DNA, 20 bp, human
ggcagacgcagttgcgactg

SEQ ID NO: 397467 - DNA, 20 bp, human
gcgactgcggcgacgaggag

SEQ ID NO: 397468 - DNA, 20 bp, human
gtgagcccgccatgtgtgag

SEQ ID NO: 397469 - DNA, 20 bp, human
gctgctggaaagcgcccgag

SEQ ID NO: 397470 - DNA, 20 bp, human
gacagccacgcctctgcgga

SEQ ID NO: 397471 - DNA, 20 bp, human
gccagccactcacacatggc

SEQ ID NO: 397472 - DNA, 20 bp, human
gtgcgtctgcggccacaggg

SEQ ID NO: 397473 - DNA, 20 bp, human
ggctgggcctgaaaggacgg

SEQ ID NO: 397474 - DNA, 20 bp, human
gaactgcgtctgcggccaca

SEQ ID NO: 397475 - DNA, 20 bp, human
gtgaaaggacggtggcgtgg

SEQ ID NO: 397476 - DNA, 20 bp, human
gcccgagacccgagcggaga

SEQ ID NO: 397477 - DNA, 20 bp, human
gcgaaatcccgagacccgag

SEQ ID NO: 397478 - DNA, 20 bp, human
ggggtctcgggatttcgctc

SEQ ID NO: 397479 - DNA, 20 bp, human
ggcgcagcgcctgaactccc

SEQ ID NO: 397480 - DNA, 20 bp, human
ggagacccgagcggagaggg

SEQ ID NO: 397481 - DNA, 20 bp, human
ggcccccaagaggtcgctgg

SEQ ID NO: 397482 - DNA, 20 bp, human
gtacaagagggaagtcagcg

SEQ ID NO: 397483 - DNA, 20 bp, human
gagtgctgcggagcgccgga

SEQ ID NO: 397484 - DNA, 20 bp, human
ggcgccaccagcgacctctt

SEQ ID NO: 397485 - DNA, 20 bp, human
gggggcccccaagaggtcgc

SEQ ID NO: 397486 - DNA, 20 bp, human
gccgcccgccgggtcctaag

SEQ ID NO: 397487 - DNA, 20 bp, human
gcacacctcgacgggggcgg

SEQ ID NO: 397488 - DNA, 20 bp, human
gtccgcacacacctcgacgg

SEQ ID NO: 397489 - DNA, 20 bp, human
gcacctgcacgcgaggggtc

SEQ ID NO: 397490 - DNA, 20 bp, human
gggctccgcacacacctcga

SEQ ID NO: 397491 - DNA, 20 bp, human
gaaaacgagcggagccgccg

SEQ ID NO: 397492 - DNA, 20 bp, human
gccgccgggtcctaaggggt

SEQ ID NO: 397493 - DNA, 20 bp, human
gtgccgcgatgcctaagccc

SEQ ID NO: 397494 - DNA, 20 bp, human
ggcccccgtcgaggtgtgtg

SEQ ID NO: 397495 - DNA, 20 bp, human
ggcgctggcgcccccttgtc

SEQ ID NO: 397496 - DNA, 20 bp, human
gtaacagaggcagtcaccgc

SEQ ID NO: 397497 - DNA, 20 bp, human
gggcgctagcgaataagaac

SEQ ID NO: 397498 - DNA, 20 bp, human
gcaagcgcgaaggcgagatc

SEQ ID NO: 397499 - DNA, 20 bp, human
ggagtcacgagactatatct

SEQ ID NO: 397500 - DNA, 20 bp, human
gagatctgggtagcgtggac

SEQ ID NO: 397501 - DNA, 20 bp, human
ggaagtacgtcatttaacag

SEQ ID NO: 397502 - DNA, 20 bp, human
ggtcaccgcaggctgcttct

SEQ ID NO: 397503 - DNA, 20 bp, human
gctgaaagccggctccggat

SEQ ID NO: 397504 - DNA, 20 bp, human
gccacgcgggccaagcgcga

SEQ ID NO: 397505 - DNA, 20 bp, human
gaggcgagatctgggtagcg

SEQ ID NO: 397506 - DNA, 20 bp, human
gcgccagagaaatacggggt

SEQ ID NO: 397507 - DNA, 20 bp, human
ggaggggcctgcagaaaact

SEQ ID NO: 397508 - DNA, 20 bp, human
gtgggaggcctgagatgaaa

SEQ ID NO: 397509 - DNA, 20 bp, human
gaagcaggagccgtgtaggg

SEQ ID NO: 397510 - DNA, 20 bp, human
gaaacggctgtcagcgggtg

SEQ ID NO: 397511 - DNA, 20 bp, human
gtacgaggcgtgagagaagc

SEQ ID NO: 397512 - DNA, 20 bp, human
ggagaagcaggagccgtgta

SEQ ID NO: 397513 - DNA, 20 bp, human
gcccgcgcgccagagaaata

SEQ ID NO: 397514 - DNA, 20 bp, human
gtgggccacgtggaaaccag

SEQ ID NO: 397515 - DNA, 20 bp, human
ggcccaaggtgggttagctt

SEQ ID NO: 397516 - DNA, 20 bp, human
gcagccaatagaatatgccg

SEQ ID NO: 397517 - DNA, 20 bp, human
gacgcctcggcatattctat

SEQ ID NO: 397518 - DNA, 20 bp, human
gcgaacactagtctacgcct

SEQ ID NO: 397519 - DNA, 20 bp, human
gggctcccgcccccgtgggc

SEQ ID NO: 397520 - DNA, 20 bp, human
gagcgacggctgtcaatcac

SEQ ID NO: 397521 - DNA, 20 bp, human
gctattggctggaaggccgt

SEQ ID NO: 397522 - DNA, 20 bp, human
gcgtagactagtgttcggcg

SEQ ID NO: 397523 - DNA, 20 bp, human
gactgctgtcccgcccacgg

SEQ ID NO: 397524 - DNA, 20 bp, human
gcaggcgggggcttctagtg

SEQ ID NO: 397525 - DNA, 20 bp, human
gcgggggcttctagtggggg

SEQ ID NO: 397526 - DNA, 20 bp, human
ggggcggggcgatctggagt

SEQ ID NO: 397527 - DNA, 20 bp, human
gtgaccggagggcgaaattg

SEQ ID NO: 397528 - DNA, 20 bp, human
gcggggcgatctggagtagg

SEQ ID NO: 397529 - DNA, 20 bp, human
ggagtaggaggtgtgaccgg

SEQ ID NO: 397530 - DNA, 20 bp, human
ggggcctcggagcgtaaagg

SEQ ID NO: 397531 - DNA, 20 bp, human
gactccggcaggatgggcct

SEQ ID NO: 397532 - DNA, 20 bp, human
gtcgcggccaaaacaagccc

SEQ ID NO: 397533 - DNA, 20 bp, human
gacgcagcccggcggcgcag

SEQ ID NO: 397534 - DNA, 20 bp, human
gggttcgctgtgtgtgtcgc

SEQ ID NO: 397535 - DNA, 20 bp, human
ggatgggcctcggagcgtaa

SEQ ID NO: 397536 - DNA, 20 bp, human
ggggagcgggagttacgtag

SEQ ID NO: 397537 - DNA, 20 bp, human
gcgggagttacgtagaggga

SEQ ID NO: 397538 - DNA, 20 bp, human
gcccgtgtgggagttcctcc

SEQ ID NO: 397539 - DNA, 20 bp, human
gtagggggaagcggcgtgac

SEQ ID NO: 397540 - DNA, 20 bp, human
gacccagccccgccccgtgt

SEQ ID NO: 397541 - DNA, 20 bp, human
gggaagcggcgtgactggag

SEQ ID NO: 397542 - DNA, 20 bp, human
gccccctacacccggaagat

SEQ ID NO: 397543 - DNA, 20 bp, human
gggaagattggccctcccgg

SEQ ID NO: 397544 - DNA, 20 bp, human
gacgtggcaagaggctgcgc

SEQ ID NO: 397545 - DNA, 20 bp, human
gaggctgcgcaggctccttc

SEQ ID NO: 397546 - DNA, 20 bp, human
ggggctgcgcacataagggc

SEQ ID NO: 397547 - DNA, 20 bp, human
gcacataagggcgggcgttt

SEQ ID NO: 397548 - DNA, 20 bp, human
gggcggggctgcgcacataa

SEQ ID NO: 397549 - DNA, 20 bp, human
gcgcaggcgcaccctttggt

SEQ ID NO: 397550 - DNA, 20 bp, human
gtaggccccaccccaccaaa

SEQ ID NO: 397551 - DNA, 20 bp, human
gacggcgcaggcgcaccctt

SEQ ID NO: 397552 - DNA, 20 bp, human
gaagggcgggcgtttgggtg

SEQ ID NO: 397553 - DNA, 20 bp, human
gcgcaccctttggtggggtg

SEQ ID NO: 397554 - DNA, 20 bp, human
gcgatgcaggtacgtagtga

SEQ ID NO: 397555 - DNA, 20 bp, human
gtcttctaaacctttaccga

SEQ ID NO: 397556 - DNA, 20 bp, human
gttaaaggggcggtccctta

SEQ ID NO: 397557 - DNA, 20 bp, human
ggtgcccgcgcttaaagggg

SEQ ID NO: 397558 - DNA, 20 bp, human
gggaccgcccctttaagcgc

SEQ ID NO: 397559 - DNA, 20 bp, human
gggcgcacatgcgcagtctg

SEQ ID NO: 397560 - DNA, 20 bp, human
ggcagtgcccgcgcttaaag

SEQ ID NO: 397561 - DNA, 20 bp, human
gaaggggcggtcccttaggg

SEQ ID NO: 397562 - DNA, 20 bp, human
gcgcacaagttccgccctaa

SEQ ID NO: 397563 - DNA, 20 bp, human
ggtggaagcgcgcgctggtc

SEQ ID NO: 397564 - DNA, 20 bp, human
ggtacgctggaaaaccgctg

SEQ ID NO: 397565 - DNA, 20 bp, human
gggtgcgcgattccgcacgg

SEQ ID NO: 397566 - DNA, 20 bp, human
gagcccgagaaagcgttctg

SEQ ID NO: 397567 - DNA, 20 bp, human
gcctccaggcgaggtcccga

SEQ ID NO: 397568 - DNA, 20 bp, human
gaacgcccccgggacttctc

SEQ ID NO: 397569 - DNA, 20 bp, human
gccacgcggagagcatgctg

SEQ ID NO: 397570 - DNA, 20 bp, human
gggtcccgatggccaataga

SEQ ID NO: 397571 - DNA, 20 bp, human
gtccgcgtggcgtacgattg

SEQ ID NO: 397572 - DNA, 20 bp, human
gcatggtggggagatcccgg

SEQ ID NO: 397573 - DNA, 20 bp, human
gaggagtctgcaaactccgg

SEQ ID NO: 397574 - DNA, 20 bp, human
gggaatcgactggcgttaaa

SEQ ID NO: 397575 - DNA, 20 bp, human
gtcccgggggcgttccattg

SEQ ID NO: 397576 - DNA, 20 bp, human
gcctccctgtggccgattgt

SEQ ID NO: 397577 - DNA, 20 bp, human
gtacttaggggaaggccctt

SEQ ID NO: 397578 - DNA, 20 bp, human
gccacctcctacttagggga

SEQ ID NO: 397579 - DNA, 20 bp, human
ggggccttcccctaagtagg

SEQ ID NO: 397580 - DNA, 20 bp, human
ggtcctgcccaagaccaggg

SEQ ID NO: 397581 - DNA, 20 bp, human
gaggggcggggctagacggg

SEQ ID NO: 397582 - DNA, 20 bp, human
gtctagcggacaggagttga

SEQ ID NO: 397583 - DNA, 20 bp, human
gctcgctgcaatcccacaat

SEQ ID NO: 397584 - DNA, 20 bp, human
gagcgcctccaggtgtagag

SEQ ID NO: 397585 - DNA, 20 bp, human
ggtggcggaagcggaaaagg

SEQ ID NO: 397586 - DNA, 20 bp, human
gttaccaagtcctctttcta

SEQ ID NO: 397587 - DNA, 20 bp, human
gataagcgccgtaatggcag

SEQ ID NO: 397588 - DNA, 20 bp, human
ggtgtgcataagcgccgtaa

SEQ ID NO: 397589 - DNA, 20 bp, human
gtgtcaagctgaaccatcgt

SEQ ID NO: 397590 - DNA, 20 bp, human
ggacatagcctctgccatta

SEQ ID NO: 397591 - DNA, 20 bp, human
gtagtcataacaccattgcc

SEQ ID NO: 397592 - DNA, 20 bp, human
gaagagcttcctatgtgaag

SEQ ID NO: 397593 - DNA, 20 bp, human
gaagccttagaaagaggact

SEQ ID NO: 397594 - DNA, 20 bp, human
gatcaatacctaaaaggaaa

SEQ ID NO: 397595 - DNA, 20 bp, human
gaagccttctctaattgccc

SEQ ID NO: 397596 - DNA, 20 bp, human
ggaggatgatgtcaggtcat

SEQ ID NO: 397597 - DNA, 20 bp, human
gtggccaaagcaaagagacg

SEQ ID NO: 397598 - DNA, 20 bp, human
ggttgcctagtgtacaaagt

SEQ ID NO: 397599 - DNA, 20 bp, human
gcacagattgtcattcttca

SEQ ID NO: 397600 - DNA, 20 bp, human
ggctctgcgtcacttctgct

SEQ ID NO: 397601 - DNA, 20 bp, human
gaaaatgaatttattggcta

SEQ ID NO: 397602 - DNA, 20 bp, human
gaatccacgtctctttgctt

SEQ ID NO: 397603 - DNA, 20 bp, human
gagcataagatgaaatacgt

SEQ ID NO: 397604 - DNA, 20 bp, human
gtttataaatctggcaaaag

SEQ ID NO: 397605 - DNA, 20 bp, human
gtacagaattgtcttgagcc

SEQ ID NO: 397606 - DNA, 20 bp, human
gttgttatggagtcaatggc

SEQ ID NO: 397607 - DNA, 20 bp, human
ggggtatgagatgtattgat

SEQ ID NO: 397608 - DNA, 20 bp, human
gctaaagctgagagcataga

SEQ ID NO: 397609 - DNA, 20 bp, human
gagatttgttatggagtcaa

SEQ ID NO: 397610 - DNA, 20 bp, human
gtgcttttagtgaagtgggc

SEQ ID NO: 397611 - DNA, 20 bp, human
ggttaacatgattcactact

SEQ ID NO: 397612 - DNA, 20 bp, human
gtgcaaataacatcactatc

SEQ ID NO: 397613 - DNA, 20 bp, human
gtgtctcactatattagaaa

SEQ ID NO: 397614 - DNA, 20 bp, human
ggtgcatctatttgaatgtg

SEQ ID NO: 397615 - DNA, 20 bp, human
gatgcttgcttttagtgaag

SEQ ID NO: 397616 - DNA, 20 bp, human
ggggagcccacgtgactctg

SEQ ID NO: 397617 - DNA, 20 bp, human
ggggctgccctcctgtgttc

SEQ ID NO: 397618 - DNA, 20 bp, human
ggggaacgaggccatcacag

SEQ ID NO: 397619 - DNA, 20 bp, human
gccagtgccctccaactctc

SEQ ID NO: 397620 - DNA, 20 bp, human
gtcccaggaggccactgtga

SEQ ID NO: 397621 - DNA, 20 bp, human
gaggcctgggggggcgcaat

SEQ ID NO: 397622 - DNA, 20 bp, human
gagagagtcccgagagttgg

SEQ ID NO: 397623 - DNA, 20 bp, human
gtccagagagtcccgagagt

SEQ ID NO: 397624 - DNA, 20 bp, human
ggtgcacagacaagaaagtg

SEQ ID NO: 397625 - DNA, 20 bp, human
ggccatgggacctacagtga

SEQ ID NO: 397626 - DNA, 20 bp, human
gccgcccagccagttcgcca

SEQ ID NO: 397627 - DNA, 20 bp, human
ggtcacgtctatggagaaaa

SEQ ID NO: 397628 - DNA, 20 bp, human
gggtccttggcgaactggct

SEQ ID NO: 397629 - DNA, 20 bp, human
gtggttgatggtcacgtcta

SEQ ID NO: 397630 - DNA, 20 bp, human
gcagcagcctaggagtacag

SEQ ID NO: 397631 - DNA, 20 bp, human
gctgaccgctggttggttga

SEQ ID NO: 397632 - DNA, 20 bp, human
ggctgactgattctgaccgc

SEQ ID NO: 397633 - DNA, 20 bp, human
gggggcgcaaatgcgaaaag

SEQ ID NO: 397634 - DNA, 20 bp, human
gaaaagggtagtctctggga

SEQ ID NO: 397635 - DNA, 20 bp, human
gagaccttgcggggcatggc

SEQ ID NO: 397636 - DNA, 20 bp, human
gggacccaacggcagaaaag

SEQ ID NO: 397637 - DNA, 20 bp, human
ggggcgtgctattgggtaga

SEQ ID NO: 397638 - DNA, 20 bp, human
gagaaaaggggcgtgctatt

SEQ ID NO: 397639 - DNA, 20 bp, human
gaacgccccaggtttcaccc

SEQ ID NO: 397640 - DNA, 20 bp, human
ggctggcattactggacttg

SEQ ID NO: 397641 - DNA, 20 bp, human
ggtaacaggcctccggtgga

SEQ ID NO: 397642 - DNA, 20 bp, human
gggtccccgccctccaccgg

SEQ ID NO: 397643 - DNA, 20 bp, human
gaacgggcagagtctcctgg

SEQ ID NO: 397644 - DNA, 20 bp, human
ggtcaagccggggtgaaacc

SEQ ID NO: 397645 - DNA, 20 bp, human
gagcgctccgggtctcagcg

SEQ ID NO: 397646 - DNA, 20 bp, human
gggtggggcaacggcgagaa

SEQ ID NO: 397647 - DNA, 20 bp, human
gaccggaaagggtggggcaa

SEQ ID NO: 397648 - DNA, 20 bp, human
ggagctcagggcacgtgcta

SEQ ID NO: 397649 - DNA, 20 bp, human
ggccttgaccggaaagggtg

SEQ ID NO: 397650 - DNA, 20 bp, human
gcgcctgcgcctcctgggct

SEQ ID NO: 397651 - DNA, 20 bp, human
gggcggggccttgaccggaa

SEQ ID NO: 397652 - DNA, 20 bp, human
gcgagaaaggccgcgtcgag

SEQ ID NO: 397653 - DNA, 20 bp, human
gtcgtcgctgtggtgacccc

SEQ ID NO: 397654 - DNA, 20 bp, human
gaaaggccgcgtcgagcggt

SEQ ID NO: 397655 - DNA, 20 bp, human
gccggacgcatcaggacctg

SEQ ID NO: 397656 - DNA, 20 bp, human
gcgcctgcgggtagagaagc

SEQ ID NO: 397657 - DNA, 20 bp, human
ggggggcggagccggaggaa

SEQ ID NO: 397658 - DNA, 20 bp, human
gtcgaagaatgtgacctgga

SEQ ID NO: 397659 - DNA, 20 bp, human
gcgcctccacccccttcctc

SEQ ID NO: 397660 - DNA, 20 bp, human
gtgcgggtagagaagccgga

SEQ ID NO: 397661 - DNA, 20 bp, human
gaaggcggcaactgcgcctg

SEQ ID NO: 397662 - DNA, 20 bp, human
gccgcggcgcatgcgcgttc

SEQ ID NO: 397663 - DNA, 20 bp, human
gcacccgcgcgctttaactc

SEQ ID NO: 397664 - DNA, 20 bp, human
gaaagcgcgcgggtgccagc

SEQ ID NO: 397665 - DNA, 20 bp, human
gcagtcgtgcccttgggttg

SEQ ID NO: 397666 - DNA, 20 bp, human
gagcctatggagaccgtgtg

SEQ ID NO: 397667 - DNA, 20 bp, human
ggggccgtctggcaataaac

SEQ ID NO: 397668 - DNA, 20 bp, human
gggaagaagacgggccaaag

SEQ ID NO: 397669 - DNA, 20 bp, human
ggagaccgtgtgtggctggt

SEQ ID NO: 397670 - DNA, 20 bp, human
gagccacacacggtctccat

SEQ ID NO: 397671 - DNA, 20 bp, human
ggcaataaaccggccaatgg

SEQ ID NO: 397672 - DNA, 20 bp, human
ggactagggcgtgcgagcag

SEQ ID NO: 397673 - DNA, 20 bp, human
gggcccgtcttcttccactc

SEQ ID NO: 397674 - DNA, 20 bp, human
gaggcgcgacgcacaggtgg

SEQ ID NO: 397675 - DNA, 20 bp, human
gagagaagggcagggcttca

SEQ ID NO: 397676 - DNA, 20 bp, human
gccaactgatggcacgtggt

SEQ ID NO: 397677 - DNA, 20 bp, human
gcacctgcggcctgcggtgg

SEQ ID NO: 397678 - DNA, 20 bp, human
ggcgctgcgcgccaggtagc

SEQ ID NO: 397679 - DNA, 20 bp, human
gtgtgggtggagccttccga

SEQ ID NO: 397680 - DNA, 20 bp, human
gggcgtggccaatccacctg

SEQ ID NO: 397681 - DNA, 20 bp, human
ggggccctcgcgacggaagg

SEQ ID NO: 397682 - DNA, 20 bp, human
ggaggggcgggccctcgcga

SEQ ID NO: 397683 - DNA, 20 bp, human
ggcgatagtgtgtgcagtgt

SEQ ID NO: 397684 - DNA, 20 bp, human
ggattggccacgccctcgga

SEQ ID NO: 397685 - DNA, 20 bp, human
gccgcaggccgcaggtggat

SEQ ID NO: 397686 - DNA, 20 bp, human
gctctcatccgactccggaa

SEQ ID NO: 397687 - DNA, 20 bp, human
ggaaaggagcggttgctgtg

SEQ ID NO: 397688 - DNA, 20 bp, human
gcgggctaggcctgtagcgc

SEQ ID NO: 397689 - DNA, 20 bp, human
gctctcctctcatccgactc

SEQ ID NO: 397690 - DNA, 20 bp, human
ggcgtggtcagcactaataa

SEQ ID NO: 397691 - DNA, 20 bp, human
gtggtcagcactaataaagg

SEQ ID NO: 397692 - DNA, 20 bp, human
ggaccacgcctcccggataa

SEQ ID NO: 397693 - DNA, 20 bp, human
gtggtcgcattgatcactga

SEQ ID NO: 397694 - DNA, 20 bp, human
ggacggtcgcccagcgctac

SEQ ID NO: 397695 - DNA, 20 bp, human
ggactggcaattggcagggg

SEQ ID NO: 397696 - DNA, 20 bp, human
gagtgccgagggagctgccg

SEQ ID NO: 397697 - DNA, 20 bp, human
gcagctccctcggcactcgc

SEQ ID NO: 397698 - DNA, 20 bp, human
gagcggggaccttactgcta

SEQ ID NO: 397699 - DNA, 20 bp, human
ggggcgcggggcaagacctt

SEQ ID NO: 397700 - DNA, 20 bp, human
ggggagacgcgtcgcgagcg

SEQ ID NO: 397701 - DNA, 20 bp, human
gcggggcccgtggtcctgcc

SEQ ID NO: 397702 - DNA, 20 bp, human
gggtcccaacccatcaccgc

SEQ ID NO: 397703 - DNA, 20 bp, human
gtcgtgccgggcaggaccac

SEQ ID NO: 397704 - DNA, 20 bp, human
gcatgccccggcagctccct

SEQ ID NO: 397705 - DNA, 20 bp, human
ggcggggcgggggtcgtgcc

SEQ ID NO: 397706 - DNA, 20 bp, human
gtcccaagtgacctcgtccg

SEQ ID NO: 397707 - DNA, 20 bp, human
ggggaacttgagggccacag

SEQ ID NO: 397708 - DNA, 20 bp, human
gaagtgggcgggggcgtcgt

SEQ ID NO: 397709 - DNA, 20 bp, human
gggactgcgtggataagtga

SEQ ID NO: 397710 - DNA, 20 bp, human
gtcgtgggtgggtgcgtcca

SEQ ID NO: 397711 - DNA, 20 bp, human
gaggggtcccagggcggtcc

SEQ ID NO: 397712 - DNA, 20 bp, human
ggggcaaagacgtcactagg

SEQ ID NO: 397713 - DNA, 20 bp, human
gtccccggacgaggtcactt

SEQ ID NO: 397714 - DNA, 20 bp, human
gtcagagcccggaccgccct

SEQ ID NO: 397715 - DNA, 20 bp, human
gtgcgtggataagtgagggt

SEQ ID NO: 397716 - DNA, 20 bp, human
gtgtgggttcgggctctttt

SEQ ID NO: 397717 - DNA, 20 bp, human
ggcgccggagtgcgtggctg

SEQ ID NO: 397718 - DNA, 20 bp, human
gcgtgcgtggagggcgatta

SEQ ID NO: 397719 - DNA, 20 bp, human
gctaaactgcgtgtgggttc

SEQ ID NO: 397720 - DNA, 20 bp, human
gctaaagcacagcataaatt

SEQ ID NO: 397721 - DNA, 20 bp, human
gacgcacgccggatcacgac

SEQ ID NO: 397722 - DNA, 20 bp, human
gccactggttgtccacgttc

SEQ ID NO: 397723 - DNA, 20 bp, human
gttatgctgtgctttagggg

SEQ ID NO: 397724 - DNA, 20 bp, human
gcgtggagggcgattagggg

SEQ ID NO: 397725 - DNA, 20 bp, human
gcaggccgccgagcgccgat

SEQ ID NO: 397726 - DNA, 20 bp, human
gggccccaggagcctgaatt

SEQ ID NO: 397727 - DNA, 20 bp, human
gcgacctgggtccgtagagt

SEQ ID NO: 397728 - DNA, 20 bp, human
gggggcgggccgccgagcga

SEQ ID NO: 397729 - DNA, 20 bp, human
gcacctcggggccggatctg

SEQ ID NO: 397730 - DNA, 20 bp, human
gagctcgagttcagctgaaa

SEQ ID NO: 397731 - DNA, 20 bp, human
ggacacctctgcctggtgaa

SEQ ID NO: 397732 - DNA, 20 bp, human
gtggtgaacgggcacacctc

SEQ ID NO: 397733 - DNA, 20 bp, human
gccgggagggtccgactcta

SEQ ID NO: 397734 - DNA, 20 bp, human
gagaggtgtcatccgaattc

SEQ ID NO: 397735 - DNA, 20 bp, human
gaacgggcacacctcggggc

SEQ ID NO: 397736 - DNA, 20 bp, human
gggcagcaggcgacacggct

SEQ ID NO: 397737 - DNA, 20 bp, human
gcggctcctgggaagtgcgg

SEQ ID NO: 397738 - DNA, 20 bp, human
gcgtctacgcgtggcctctt

SEQ ID NO: 397739 - DNA, 20 bp, human
gagtgggagcgctcctccaa

SEQ ID NO: 397740 - DNA, 20 bp, human
gccaatggcagcaggcgaca

SEQ ID NO: 397741 - DNA, 20 bp, human
ggaagcgccccgtctacgcg

SEQ ID NO: 397742 - DNA, 20 bp, human
gaggagccgtactgcattct

SEQ ID NO: 397743 - DNA, 20 bp, human
ggtagacggggcgcttcatg

SEQ ID NO: 397744 - DNA, 20 bp, human
gctgggaagtgcggggggct

SEQ ID NO: 397745 - DNA, 20 bp, human
ggagcgctcccactcccaag

SEQ ID NO: 397746 - DNA, 20 bp, human
gaagaatgcccgcctacctg

SEQ ID NO: 397747 - DNA, 20 bp, human
ggcgactcgagatgcgaggt

SEQ ID NO: 397748 - DNA, 20 bp, human
gtggagcgactcgagatgcg

SEQ ID NO: 397749 - DNA, 20 bp, human
gcaagcaggaagtgaactga

SEQ ID NO: 397750 - DNA, 20 bp, human
gctccagccacacctaactc

SEQ ID NO: 397751 - DNA, 20 bp, human
gaactcaggtttccccaggt

SEQ ID NO: 397752 - DNA, 20 bp, human
gcagcctctggaaacctcgg

SEQ ID NO: 397753 - DNA, 20 bp, human
gactcgagatgcgaggtggg

SEQ ID NO: 397754 - DNA, 20 bp, human
gggacctcctgatctagaaa

SEQ ID NO: 397755 - DNA, 20 bp, human
gcatgccaggcctagctcac

SEQ ID NO: 397756 - DNA, 20 bp, human
ggctcctaggaactctccgc

SEQ ID NO: 397757 - DNA, 20 bp, human
gctcctccgcagagcaatgg

SEQ ID NO: 397758 - DNA, 20 bp, human
ggtcctaagcctacctgagc

SEQ ID NO: 397759 - DNA, 20 bp, human
gcagccgctgacgcgtcggg

SEQ ID NO: 397760 - DNA, 20 bp, human
gagctgccgcgtctgaacgg

SEQ ID NO: 397761 - DNA, 20 bp, human
gggcgaggtccgcgcggacc

SEQ ID NO: 397762 - DNA, 20 bp, human
ggggaagcaaattctcctgg

SEQ ID NO: 397763 - DNA, 20 bp, human
gcctccggcggagagttcct

SEQ ID NO: 397764 - DNA, 20 bp, human
gtaggagcgctggtctcaga

SEQ ID NO: 397765 - DNA, 20 bp, human
gcgtcgggaggcggagccta

SEQ ID NO: 397766 - DNA, 20 bp, human
gggtgtcggagatcaatccc

SEQ ID NO: 397767 - DNA, 20 bp, human
ggctagctgttcttggctcg

SEQ ID NO: 397768 - DNA, 20 bp, human
gacacccgggacacacacga

SEQ ID NO: 397769 - DNA, 20 bp, human
gtcccgggtgtgtggggtcg

SEQ ID NO: 397770 - DNA, 20 bp, human
ggggctgtgcacgtctgtgt

SEQ ID NO: 397771 - DNA, 20 bp, human
gcacgccttcgtgtgtgtcc

SEQ ID NO: 397772 - DNA, 20 bp, human
gcagaagagagtgggttact

SEQ ID NO: 397773 - DNA, 20 bp, human
gcccgccctccgctgcaggt

SEQ ID NO: 397774 - DNA, 20 bp, human
ggacgaggtgagggggacgc

SEQ ID NO: 397775 - DNA, 20 bp, human
ggaaagcagcagtgcagcgg

SEQ ID NO: 397776 - DNA, 20 bp, human
ggggccgcagacaatggacg

SEQ ID NO: 397777 - DNA, 20 bp, human
gccgccgcgtccattgtctg

SEQ ID NO: 397778 - DNA, 20 bp, human
gagagcggggccgcagacaa

SEQ ID NO: 397779 - DNA, 20 bp, human
ggctgggcatctgaaggcgc

SEQ ID NO: 397780 - DNA, 20 bp, human
gcggcgactccgggaagagc

SEQ ID NO: 397781 - DNA, 20 bp, human
gagcccccggggccttgagg

SEQ ID NO: 397782 - DNA, 20 bp, human
gatcctgggaatccgcggtg

SEQ ID NO: 397783 - DNA, 20 bp, human
gtctgcggccccgctcttcc

SEQ ID NO: 397784 - DNA, 20 bp, human
gcgcggtggggctgacactc

SEQ ID NO: 397785 - DNA, 20 bp, human
gaatggacgcggcggtagga

SEQ ID NO: 397786 - DNA, 20 bp, human
ggaggcggggcaaaggtccg

SEQ ID NO: 397787 - DNA, 20 bp, human
ggagcgcagcccagctgtca

SEQ ID NO: 397788 - DNA, 20 bp, human
gcgcgcacgtaggcacgcag

SEQ ID NO: 397789 - DNA, 20 bp, human
gcctccaggccggcctagcg

SEQ ID NO: 397790 - DNA, 20 bp, human
gcacgcagaggccgtcacgt

SEQ ID NO: 397791 - DNA, 20 bp, human
gagcccagctgtcaagggaa

SEQ ID NO: 397792 - DNA, 20 bp, human
gcctgcgctgcgcatcgcgt

SEQ ID NO: 397793 - DNA, 20 bp, human
ggacacagcggcaggcgtta

SEQ ID NO: 397794 - DNA, 20 bp, human
ggctagaagctcccggccgg

SEQ ID NO: 397795 - DNA, 20 bp, human
gggccggcctagcgcggcgc

SEQ ID NO: 397796 - DNA, 20 bp, human
gcctgcgcactgtcccggaa

SEQ ID NO: 397797 - DNA, 20 bp, human
ggggactgcggggcagtaag

SEQ ID NO: 397798 - DNA, 20 bp, human
gcctgcgccgccggctccag

SEQ ID NO: 397799 - DNA, 20 bp, human
gggcgcggcacaagccacgg

SEQ ID NO: 397800 - DNA, 20 bp, human
gccaccgcggaaactattaa

SEQ ID NO: 397801 - DNA, 20 bp, human
ggggcccttaatagtttccg

SEQ ID NO: 397802 - DNA, 20 bp, human
gcggcacaagccacgggggc

SEQ ID NO: 397803 - DNA, 20 bp, human
gtcgggccgctcaggaggcg

SEQ ID NO: 397804 - DNA, 20 bp, human
gtccccgcccctggagccgg

SEQ ID NO: 397805 - DNA, 20 bp, human
ggcgcgcgtagagccccttc

SEQ ID NO: 397806 - DNA, 20 bp, human
gagggccggccgaccctctt

SEQ ID NO: 397807 - DNA, 20 bp, human
ggtgtccgacactgccccgg

SEQ ID NO: 397808 - DNA, 20 bp, human
gcacctccccgctaccgggt

SEQ ID NO: 397809 - DNA, 20 bp, human
gacgggagcgtcgtgctcag

SEQ ID NO: 397810 - DNA, 20 bp, human
gggcgcggacgcaggacgag

SEQ ID NO: 397811 - DNA, 20 bp, human
ggggcagtgtcggacacggc

SEQ ID NO: 397812 - DNA, 20 bp, human
gagcggggaggtgcccagca

SEQ ID NO: 397813 - DNA, 20 bp, human
gccgcctgatgaggaccgaa

SEQ ID NO: 397814 - DNA, 20 bp, human
gtgggcacctccccgctacc

SEQ ID NO: 397815 - DNA, 20 bp, human
gggcaccttgtgcgggtcct

SEQ ID NO: 397816 - DNA, 20 bp, human
ggtcccgggcgcctccccgt

SEQ ID NO: 397817 - DNA, 20 bp, human
gaggagcgagtccgccgcga

SEQ ID NO: 397818 - DNA, 20 bp, human
gcccgtggggtttgccttcg

SEQ ID NO: 397819 - DNA, 20 bp, human
ggccgcgaaggcaaacccca

SEQ ID NO: 397820 - DNA, 20 bp, human
gatagctagcagtgcggtcc

SEQ ID NO: 397821 - DNA, 20 bp, human
gcctctccctaccggtccaa

SEQ ID NO: 397822 - DNA, 20 bp, human
gaccccacggggaggcgccc

SEQ ID NO: 397823 - DNA, 20 bp, human
gagagcgcgggacttggaca

SEQ ID NO: 397824 - DNA, 20 bp, human
gcaagcccagaccgcgtcca

SEQ ID NO: 397825 - DNA, 20 bp, human
gtggtctacagcctttggac

SEQ ID NO: 397826 - DNA, 20 bp, human
gtcgcggcgccctgacagct

SEQ ID NO: 397827 - DNA, 20 bp, human
gaatgcccaccggcgtcctt

SEQ ID NO: 397828 - DNA, 20 bp, human
gggcgtccttggggtaactt

SEQ ID NO: 397829 - DNA, 20 bp, human
ggggacagaggcaccgccgc

SEQ ID NO: 397830 - DNA, 20 bp, human
gcctcctcacccagctgtca

SEQ ID NO: 397831 - DNA, 20 bp, human
ggtcctccgcagcttcgcac

SEQ ID NO: 397832 - DNA, 20 bp, human
gcgcccaccaggctcgacta

SEQ ID NO: 397833 - DNA, 20 bp, human
gcggctggtgggcttctcgt

SEQ ID NO: 397834 - DNA, 20 bp, human
ggctccgtcccccccttaaa

SEQ ID NO: 397835 - DNA, 20 bp, human
gtctgtcccaagttacccca

SEQ ID NO: 397836 - DNA, 20 bp, human
ggcgggaggggacaggagta

SEQ ID NO: 397837 - DNA, 20 bp, human
gaggggttctctggcgggag

SEQ ID NO: 397838 - DNA, 20 bp, human
ggctccaggggttctctggc

SEQ ID NO: 397839 - DNA, 20 bp, human
gaggggtcgtggcacttcga

SEQ ID NO: 397840 - DNA, 20 bp, human
ggctcgggactctacaaccc

SEQ ID NO: 397841 - DNA, 20 bp, human
gggctccgcgacgctctgat

SEQ ID NO: 397842 - DNA, 20 bp, human
ggacccgcccctctttgttg

SEQ ID NO: 397843 - DNA, 20 bp, human
gattggctccaggggttctc

SEQ ID NO: 397844 - DNA, 20 bp, human
gtccagcccgcggggctctc

SEQ ID NO: 397845 - DNA, 20 bp, human
ggggctggagcgtttggcca

SEQ ID NO: 397846 - DNA, 20 bp, human
ggagcccctcggtggggaag

SEQ ID NO: 397847 - DNA, 20 bp, human
gtccccaccgaggggctcgt

SEQ ID NO: 397848 - DNA, 20 bp, human
ggggagaccttgcccgtcgt

SEQ ID NO: 397849 - DNA, 20 bp, human
gcacgccccttccccaccga

SEQ ID NO: 397850 - DNA, 20 bp, human
gtctccacgcggctccgccc

SEQ ID NO: 397851 - DNA, 20 bp, human
gtctccccgcgcaggtcagg

SEQ ID NO: 397852 - DNA, 20 bp, human
ggcccacgagcccctcggtg

SEQ ID NO: 397853 - DNA, 20 bp, human
ggggcaaggtctccccgcgc

SEQ ID NO: 397854 - DNA, 20 bp, human
gaaacctgcccagtgtcatc

SEQ ID NO: 397855 - DNA, 20 bp, human
ggaaggggcgtgtctccacg

SEQ ID NO: 397856 - DNA, 20 bp, human
gcgcgtgcgcctccaggcga

SEQ ID NO: 397857 - DNA, 20 bp, human
ggggtggagggcgcttaaaa

SEQ ID NO: 397858 - DNA, 20 bp, human
gcacccctgggctacaacat

SEQ ID NO: 397859 - DNA, 20 bp, human
gtgaggggcaagttggtgaa

SEQ ID NO: 397860 - DNA, 20 bp, human
gggggagaggagcgagatcg

SEQ ID NO: 397861 - DNA, 20 bp, human
gtagcccaggggtgcaccct

SEQ ID NO: 397862 - DNA, 20 bp, human
ggcgagatcgcggaagccga

SEQ ID NO: 397863 - DNA, 20 bp, human
ggggctacaacattggggag

SEQ ID NO: 397864 - DNA, 20 bp, human
gggagcgaactaggaagcaa

SEQ ID NO: 397865 - DNA, 20 bp, human
gcccacagtgggagcgaact

SEQ ID NO: 397866 - DNA, 20 bp, human
gagctgggagagcacgaaaa

SEQ ID NO: 397867 - DNA, 20 bp, human
gggccatagtggcgcaagct

SEQ ID NO: 397868 - DNA, 20 bp, human
gccgctggatcccgcagccg

SEQ ID NO: 397869 - DNA, 20 bp, human
gcaggaacgtctgtgctctt

SEQ ID NO: 397870 - DNA, 20 bp, human
ggctgcgggatccagcggga

SEQ ID NO: 397871 - DNA, 20 bp, human
gtcgggaagagccgcggctg

SEQ ID NO: 397872 - DNA, 20 bp, human
gtaaagggccagggccatag

SEQ ID NO: 397873 - DNA, 20 bp, human
ggagcacgaaaaggggcacc

SEQ ID NO: 397874 - DNA, 20 bp, human
gctcccagcttgcgccacta

SEQ ID NO: 397875 - DNA, 20 bp, human
gtgaataaataaatcacagt

SEQ ID NO: 397876 - DNA, 20 bp, human
ggggtgaagcgcttagggca

SEQ ID NO: 397877 - DNA, 20 bp, human
ggtactgggcccacaggaag

SEQ ID NO: 397878 - DNA, 20 bp, human
gccacaggaagggggatgac

SEQ ID NO: 397879 - DNA, 20 bp, human
gtggaccgagactaatgtct

SEQ ID NO: 397880 - DNA, 20 bp, human
gtcgcggtaaggcatcctcc

SEQ ID NO: 397881 - DNA, 20 bp, human
gcttgtgaggattacggcgg

SEQ ID NO: 397882 - DNA, 20 bp, human
ggcgatcccgaccctaactt

SEQ ID NO: 397883 - DNA, 20 bp, human
gatgacagggtggtctctct

SEQ ID NO: 397884 - DNA, 20 bp, human
gttagggcacggctcttgtg

SEQ ID NO: 397885 - DNA, 20 bp, human
gctggagttgaggcttcgtt

SEQ ID NO: 397886 - DNA, 20 bp, human
gaggaggagccatggggcgg

SEQ ID NO: 397887 - DNA, 20 bp, human
ggcccaggcctgtgtcgagt

SEQ ID NO: 397888 - DNA, 20 bp, human
ggcccactcgacacaggcct

SEQ ID NO: 397889 - DNA, 20 bp, human
gtgcatggaaggcgtggggt

SEQ ID NO: 397890 - DNA, 20 bp, human
gtaactgtcgccctgagagg

SEQ ID NO: 397891 - DNA, 20 bp, human
ggctggaccagacagaggag

SEQ ID NO: 397892 - DNA, 20 bp, human
gaggacagactgtggggtac

SEQ ID NO: 397893 - DNA, 20 bp, human
gtcttccgcccactcgacac

SEQ ID NO: 397894 - DNA, 20 bp, human
ggccagctagactatgagat

SEQ ID NO: 397895 - DNA, 20 bp, human
ggaccagctgagtgatgacg

SEQ ID NO: 397896 - DNA, 20 bp, human
gcgcccgcgaaagttgcggt

SEQ ID NO: 397897 - DNA, 20 bp, human
gctaccgcccgcgaaagttg

SEQ ID NO: 397898 - DNA, 20 bp, human
ggggcggcgcttgggacacg

SEQ ID NO: 397899 - DNA, 20 bp, human
ggagaaagtcggccggacct

SEQ ID NO: 397900 - DNA, 20 bp, human
gacgcccggccatcactcca

SEQ ID NO: 397901 - DNA, 20 bp, human
gtccggccgactttctccaa

SEQ ID NO: 397902 - DNA, 20 bp, human
gccgcccaccgcaactttcg

SEQ ID NO: 397903 - DNA, 20 bp, human
gcgagggcgcccagcgcgac

SEQ ID NO: 397904 - DNA, 20 bp, human
gcgagaggagcccgaggagt

SEQ ID NO: 397905 - DNA, 20 bp, human
gaggtgccaggcgagtgctc

SEQ ID NO: 397906 - DNA, 20 bp, human
gacgccggccggtctcgctg

SEQ ID NO: 397907 - DNA, 20 bp, human
ggggggcggcggccagaaag

SEQ ID NO: 397908 - DNA, 20 bp, human
gagtccccagacgcgcgggt

SEQ ID NO: 397909 - DNA, 20 bp, human
ggtcctggggtcttctctcg

SEQ ID NO: 397910 - DNA, 20 bp, human
gaggggcaactaggaggaat

SEQ ID NO: 397911 - DNA, 20 bp, human
gggaggggatagagctgcaa

SEQ ID NO: 397912 - DNA, 20 bp, human
ggggcgcgggatcccctttc

SEQ ID NO: 397913 - DNA, 20 bp, human
gctggggtcttctctcgggg

SEQ ID NO: 397914 - DNA, 20 bp, human
ggctcccacccgcgcgtctg

SEQ ID NO: 397915 - DNA, 20 bp, human
gggcggcttcccggctttgc

SEQ ID NO: 397916 - DNA, 20 bp, human
gctacctgatcgccaggctg

SEQ ID NO: 397917 - DNA, 20 bp, human
gtcgctgttgcaattgatta

SEQ ID NO: 397918 - DNA, 20 bp, human
gtgtccccagcctggcgatc

SEQ ID NO: 397919 - DNA, 20 bp, human
gtgaggtaaccgaaacgtgg

SEQ ID NO: 397920 - DNA, 20 bp, human
gtggacgtgctcagaggacg

SEQ ID NO: 397921 - DNA, 20 bp, human
ggctaaacccctacttgatt

SEQ ID NO: 397922 - DNA, 20 bp, human
ggacgcgggtgctgacgagg

SEQ ID NO: 397923 - DNA, 20 bp, human
gtccttgtccccaatcaagt

SEQ ID NO: 397924 - DNA, 20 bp, human
gggacactggacgtgctcag

SEQ ID NO: 397925 - DNA, 20 bp, human
gccagtctggtccaggatcc

SEQ ID NO: 397926 - DNA, 20 bp, human
ggactcccgcccaatcagca

SEQ ID NO: 397927 - DNA, 20 bp, human
gccgcccaatcagcagggag

SEQ ID NO: 397928 - DNA, 20 bp, human
gtccgcgccagggggagagg

SEQ ID NO: 397929 - DNA, 20 bp, human
gaggaggaggagtcgagcgg

SEQ ID NO: 397930 - DNA, 20 bp, human
gtggggaggtgagtaggcta

SEQ ID NO: 397931 - DNA, 20 bp, human
gtaggctaggggaacggtgg

SEQ ID NO: 397932 - DNA, 20 bp, human
gcctgctccaagcccggcag

SEQ ID NO: 397933 - DNA, 20 bp, human
gtggagcagggctagactag

SEQ ID NO: 397934 - DNA, 20 bp, human
gcctcccctccctgctgatt

SEQ ID NO: 397935 - DNA, 20 bp, human
gcgccggggctccgcgccag

SEQ ID NO: 397936 - DNA, 20 bp, human
gcgaaagtagcccaacctct

SEQ ID NO: 397937 - DNA, 20 bp, human
gcaatcagcacctagaggtt

SEQ ID NO: 397938 - DNA, 20 bp, human
gcatctccatgcacattcat

SEQ ID NO: 397939 - DNA, 20 bp, human
gacaagtccccgttctcctt

SEQ ID NO: 397940 - DNA, 20 bp, human
ggtgctaaagccctaggaat

SEQ ID NO: 397941 - DNA, 20 bp, human
gggagaacggggacttgtgg

SEQ ID NO: 397942 - DNA, 20 bp, human
ggtgctgattggctgcgctc

SEQ ID NO: 397943 - DNA, 20 bp, human
ggcagccaatcagcacctag

SEQ ID NO: 397944 - DNA, 20 bp, human
ggccgccgggattccgtgat

SEQ ID NO: 397945 - DNA, 20 bp, human
gaaagagaagctggagcgac

SEQ ID NO: 397946 - DNA, 20 bp, human
gcccttcaaggggaaaccca

SEQ ID NO: 397947 - DNA, 20 bp, human
gcaactgaaggggttaatag

SEQ ID NO: 397948 - DNA, 20 bp, human
gcggagggaaatcccttcaa

SEQ ID NO: 397949 - DNA, 20 bp, human
gaatccaatgtgggttaagg

SEQ ID NO: 397950 - DNA, 20 bp, human
gggtcttgttgcagaggcgg

SEQ ID NO: 397951 - DNA, 20 bp, human
gataaagggtcttgttgcag

SEQ ID NO: 397952 - DNA, 20 bp, human
gcctcatcttcgactccaaa

SEQ ID NO: 397953 - DNA, 20 bp, human
gcaatgtgggttaagggggt

SEQ ID NO: 397954 - DNA, 20 bp, human
gcttttgccaggacagagag

SEQ ID NO: 397955 - DNA, 20 bp, human
gaggggttaatagtggaact

SEQ ID NO: 397956 - DNA, 20 bp, human
gaggaggagggttcattcac

SEQ ID NO: 397957 - DNA, 20 bp, human
gcagccactcctaagagtcc

SEQ ID NO: 397958 - DNA, 20 bp, human
gccaagaggtgggagtgcct

SEQ ID NO: 397959 - DNA, 20 bp, human
gagactcagcgagaagaagg

SEQ ID NO: 397960 - DNA, 20 bp, human
ggcttggaaagcaggcggag

SEQ ID NO: 397961 - DNA, 20 bp, human
ggcggtccctaccgcaggcg

SEQ ID NO: 397962 - DNA, 20 bp, human
gtccaggcttggaaagcagg

SEQ ID NO: 397963 - DNA, 20 bp, human
gggcaggcggtccctaccgc

SEQ ID NO: 397964 - DNA, 20 bp, human
gggaagaaacgccaagaggt

SEQ ID NO: 397965 - DNA, 20 bp, human
gagctccccgcgcctgcggt

SEQ ID NO: 397966 - DNA, 20 bp, human
ggggcggagcatctcgaaaa

SEQ ID NO: 397967 - DNA, 20 bp, human
gaatccggtagcaatcccgg

SEQ ID NO: 397968 - DNA, 20 bp, human
gtaaggagcgcccggcgtta

SEQ ID NO: 397969 - DNA, 20 bp, human
gcaggcccctcccttaggaa

SEQ ID NO: 397970 - DNA, 20 bp, human
ggcccctcccttaggaatgg

SEQ ID NO: 397971 - DNA, 20 bp, human
gtcccccattcctaagggag

SEQ ID NO: 397972 - DNA, 20 bp, human
gcgccgggcgctccttataa

SEQ ID NO: 397973 - DNA, 20 bp, human
ggagccgccgggattgctac

SEQ ID NO: 397974 - DNA, 20 bp, human
gcctgggccgccactcctac

SEQ ID NO: 397975 - DNA, 20 bp, human
ggggaatccggtagcaatcc

SEQ ID NO: 397976 - DNA, 20 bp, human
ggtccctgttagtagtcaac

SEQ ID NO: 397977 - DNA, 20 bp, human
ggtacctgttacttagagac

SEQ ID NO: 397978 - DNA, 20 bp, human
gcgcaagcgaatttcctgat

SEQ ID NO: 397979 - DNA, 20 bp, human
gcctgattggctgtgatctg

SEQ ID NO: 397980 - DNA, 20 bp, human
gccgagaagagccgaatcat

SEQ ID NO: 397981 - DNA, 20 bp, human
gcaacgctacgcttcctcga

SEQ ID NO: 397982 - DNA, 20 bp, human
gccaatcagcgcctgccctg

SEQ ID NO: 397983 - DNA, 20 bp, human
gtaggcgtgtcgcatcactg

SEQ ID NO: 397984 - DNA, 20 bp, human
gggcgagatcgattagtgaa

SEQ ID NO: 397985 - DNA, 20 bp, human
ggcgtgtcgcatcactgagg

SEQ ID NO: 397986 - DNA, 20 bp, human
gcggttcagcgctagaggag

SEQ ID NO: 397987 - DNA, 20 bp, human
gaggacggcaacaggaaaag

SEQ ID NO: 397988 - DNA, 20 bp, human
gaaaaggggcgaaagaaaga

SEQ ID NO: 397989 - DNA, 20 bp, human
gttcagcgctagaggagagg

SEQ ID NO: 397990 - DNA, 20 bp, human
gccaagcggttcagcgctag

SEQ ID NO: 397991 - DNA, 20 bp, human
gacgttcggggcaacggcta

SEQ ID NO: 397992 - DNA, 20 bp, human
ggaagactctaattcccaga

SEQ ID NO: 397993 - DNA, 20 bp, human
gagagtggggaagacgacga

SEQ ID NO: 397994 - DNA, 20 bp, human
gttctggactcaagatccta

SEQ ID NO: 397995 - DNA, 20 bp, human
ggtgctggccatcaagccct

SEQ ID NO: 397996 - DNA, 20 bp, human
gaagcgcgtcgggtaagcag

SEQ ID NO: 397997 - DNA, 20 bp, human
gggaggctgccaagcgcgtc

SEQ ID NO: 397998 - DNA, 20 bp, human
ggaaggcagcgttacctggg

SEQ ID NO: 397999 - DNA, 20 bp, human
gtgtgatttagggtagaggg

SEQ ID NO: 398000 - DNA, 20 bp, human
gcgctgcgtcgccaactcag

SEQ ID NO: 398001 - DNA, 20 bp, human
gcccggaaggcagcgttacc

SEQ ID NO: 398002 - DNA, 20 bp, human
gtgcgcccggcaacagaaag

SEQ ID NO: 398003 - DNA, 20 bp, human
ggatacgctggagtcctcgc

SEQ ID NO: 398004 - DNA, 20 bp, human
gaagccaaacgtgtgattta

SEQ ID NO: 398005 - DNA, 20 bp, human
gcgcgcgagttaacaaagcc

SEQ ID NO: 398006 - DNA, 20 bp, human
gcacacacacaatatcctgt

SEQ ID NO: 398007 - DNA, 20 bp, human
gcaggctgggtttcggtatc

SEQ ID NO: 398008 - DNA, 20 bp, human
gtcacacattgactcaatgt

SEQ ID NO: 398009 - DNA, 20 bp, human
gtcggtatcaggctgggttt

SEQ ID NO: 398010 - DNA, 20 bp, human
gctggttaacaaataggcaa

SEQ ID NO: 398011 - DNA, 20 bp, human
gtagaaggaaaacacacaac

SEQ ID NO: 398012 - DNA, 20 bp, human
gttgaataggcatttctaga

SEQ ID NO: 398013 - DNA, 20 bp, human
gtcagctgggtatcggtatc

SEQ ID NO: 398014 - DNA, 20 bp, human
gatatatagggcaagtgagc

SEQ ID NO: 398015 - DNA, 20 bp, human
gacagtttattctaagtaat

SEQ ID NO: 398016 - DNA, 20 bp, human
gcacacaaaaagtatcctgt

SEQ ID NO: 398017 - DNA, 20 bp, human
gacacaatgtgggggggtct

SEQ ID NO: 398018 - DNA, 20 bp, human
gacattcacacaatgtgggg

SEQ ID NO: 398019 - DNA, 20 bp, human
gctgaaatatgtagggcaag

SEQ ID NO: 398020 - DNA, 20 bp, human
gctggttaacaaataggcaa

SEQ ID NO: 398021 - DNA, 20 bp, human
gtcgaaagaaaacacacaac

SEQ ID NO: 398022 - DNA, 20 bp, human
ggtagggcaagtgggcagcc

SEQ ID NO: 398023 - DNA, 20 bp, human
gacagtttattctaagcaat

SEQ ID NO: 398024 - DNA, 20 bp, human
ggcagaagcttttagtttcc

SEQ ID NO: 398025 - DNA, 20 bp, human
gaaacacacaactggccaac

SEQ ID NO: 398026 - DNA, 20 bp, human
gattcacttcttggctgcca

SEQ ID NO: 398027 - DNA, 20 bp, human
gttggcagatcatgtggcaa

SEQ ID NO: 398028 - DNA, 20 bp, human
gccactgaatgggggttccg

SEQ ID NO: 398029 - DNA, 20 bp, human
ggtaatgatggtagttgtgg

SEQ ID NO: 398030 - DNA, 20 bp, human
ggcagatcatgtggcaaggg

SEQ ID NO: 398031 - DNA, 20 bp, human
gtgggtaatgatggtagttg

SEQ ID NO: 398032 - DNA, 20 bp, human
gtcagttttggcagatcatg

SEQ ID NO: 398033 - DNA, 20 bp, human
gctgggagaagcatgtgaga

SEQ ID NO: 398034 - DNA, 20 bp, human
gggttccgggggaaacatgt

SEQ ID NO: 398035 - DNA, 20 bp, human
gagatggaaaagttgttcca

SEQ ID NO: 398036 - DNA, 20 bp, human
gattcacttcttggctgcca

SEQ ID NO: 398037 - DNA, 20 bp, human
gttggcagatcatgtggcaa

SEQ ID NO: 398038 - DNA, 20 bp, human
gccactgaatgggggttccg

SEQ ID NO: 398039 - DNA, 20 bp, human
ggtaatgatggtagttgtgg

SEQ ID NO: 398040 - DNA, 20 bp, human
ggcagatcatgtggcaaggg

SEQ ID NO: 398041 - DNA, 20 bp, human
gtgggtaatgatggtagttg

SEQ ID NO: 398042 - DNA, 20 bp, human
gtcagttttggcagatcatg

SEQ ID NO: 398043 - DNA, 20 bp, human
gctgggagaagcatgtgaga

SEQ ID NO: 398044 - DNA, 20 bp, human
gggttccgggggaaacatgt

SEQ ID NO: 398045 - DNA, 20 bp, human
gagatggaaaagttgttcca

SEQ ID NO: 398046 - DNA, 20 bp, human
gccggcctggacgctgtccc

SEQ ID NO: 398047 - DNA, 20 bp, human
ggggacacgcgggttcttgc

SEQ ID NO: 398048 - DNA, 20 bp, human
gtaagaacgcggctcgctag

SEQ ID NO: 398049 - DNA, 20 bp, human
ggcccggaagggtaagaacg

SEQ ID NO: 398050 - DNA, 20 bp, human
gcagtggcagcgctcgggaa

SEQ ID NO: 398051 - DNA, 20 bp, human
gggccccagtggcagcgctc

SEQ ID NO: 398052 - DNA, 20 bp, human
gggaggacctgcgtgagtcg

SEQ ID NO: 398053 - DNA, 20 bp, human
ggggctgcgacgcggaggca

SEQ ID NO: 398054 - DNA, 20 bp, human
gcccgcccgggacagcgtcc

SEQ ID NO: 398055 - DNA, 20 bp, human
ggaggcagggagccgagcca

SEQ ID NO: 398056 - DNA, 20 bp, human
gcgggcagcctcagaggcga

SEQ ID NO: 398057 - DNA, 20 bp, human
gtggccggggcgatagggcg

SEQ ID NO: 398058 - DNA, 20 bp, human
ggccccgcgcgaacgcgtca

SEQ ID NO: 398059 - DNA, 20 bp, human
gcgcgaacgcgtcacggacg

SEQ ID NO: 398060 - DNA, 20 bp, human
ggacagcgccccggtcctgc

SEQ ID NO: 398061 - DNA, 20 bp, human
gccttccggatccccaccga

SEQ ID NO: 398062 - DNA, 20 bp, human
gctgcctccgtccgtcggtg

SEQ ID NO: 398063 - DNA, 20 bp, human
ggcagcggcggggtcctgtc

SEQ ID NO: 398064 - DNA, 20 bp, human
gagggcgcggctgcgcacca

SEQ ID NO: 398065 - DNA, 20 bp, human
gtgtcccactcgttctccct

SEQ ID NO: 398066 - DNA, 20 bp, human
gtgcgcaggagggctcggtg

SEQ ID NO: 398067 - DNA, 20 bp, human
gcgaccgtggcgcgacacgc

SEQ ID NO: 398068 - DNA, 20 bp, human
gtggacagtgaggttgactg

SEQ ID NO: 398069 - DNA, 20 bp, human
ggcacaggcgctctcgggga

SEQ ID NO: 398070 - DNA, 20 bp, human
gcgcgcttcggagcaaggcg

SEQ ID NO: 398071 - DNA, 20 bp, human
gcgctgcggagccggacagt

SEQ ID NO: 398072 - DNA, 20 bp, human
gaggcgctctcggggagggg

SEQ ID NO: 398073 - DNA, 20 bp, human
gtgcggagccggacagttgg

SEQ ID NO: 398074 - DNA, 20 bp, human
gcggcgcacaggcgctctcg

SEQ ID NO: 398075 - DNA, 20 bp, human
gaggcgcggagacgaacagc

SEQ ID NO: 398076 - DNA, 20 bp, human
gtcacgagttagagtatcta

SEQ ID NO: 398077 - DNA, 20 bp, human
gtacagcgtggcctataggg

SEQ ID NO: 398078 - DNA, 20 bp, human
gacggagctcctggcaagag

SEQ ID NO: 398079 - DNA, 20 bp, human
ggcggggcctgaccgagagg

SEQ ID NO: 398080 - DNA, 20 bp, human
gtgccttgccctatggacga

SEQ ID NO: 398081 - DNA, 20 bp, human
gttggaatcaaccaccctat

SEQ ID NO: 398082 - DNA, 20 bp, human
gagtatctaaggctacagcg

SEQ ID NO: 398083 - DNA, 20 bp, human
gaggctacagcgtggcctat

SEQ ID NO: 398084 - DNA, 20 bp, human
gagaaccacggcaggaaggg

SEQ ID NO: 398085 - DNA, 20 bp, human
gagaggactggacctgtggg

SEQ ID NO: 398086 - DNA, 20 bp, human
ggcccgagccgcgtgtggaa

SEQ ID NO: 398087 - DNA, 20 bp, human
ggtagcggggaggatcgcgg

SEQ ID NO: 398088 - DNA, 20 bp, human
gcagctgcgggatcccaagg

SEQ ID NO: 398089 - DNA, 20 bp, human
ggcagcccgccgcaatgaag

SEQ ID NO: 398090 - DNA, 20 bp, human
gccccgcgggcgcgtgtctc

SEQ ID NO: 398091 - DNA, 20 bp, human
ggggcggatgggtaattttc

SEQ ID NO: 398092 - DNA, 20 bp, human
ggggcagccgggtagctcgg

SEQ ID NO: 398093 - DNA, 20 bp, human
ggggaggatcgcggaggctt

SEQ ID NO: 398094 - DNA, 20 bp, human
gctggtagcggggaggatcg

SEQ ID NO: 398095 - DNA, 20 bp, human
gacacgcgcccgcggggcat

SEQ ID NO: 398096 - DNA, 20 bp, human
gccgccgcggcaggggaaag

SEQ ID NO: 398097 - DNA, 20 bp, human
ggaaaggggacgcaccgccc

SEQ ID NO: 398098 - DNA, 20 bp, human
gcgccgccgccactacccgg

SEQ ID NO: 398099 - DNA, 20 bp, human
ggccgccactacccggaggg

SEQ ID NO: 398100 - DNA, 20 bp, human
gcccgccctccgggtagtgg

SEQ ID NO: 398101 - DNA, 20 bp, human
gcgccccgccctccgggtag

SEQ ID NO: 398102 - DNA, 20 bp, human
gccggtggggagcgcgtgtc

SEQ ID NO: 398103 - DNA, 20 bp, human
gacgcaccgcccaggaggct

SEQ ID NO: 398104 - DNA, 20 bp, human
gcccgccccacgggccggtg

SEQ ID NO: 398105 - DNA, 20 bp, human
ggggggggcgaggccgtcgg

SEQ ID NO: 398106 - DNA, 20 bp, human
ggggagaaactgggcaccgt

SEQ ID NO: 398107 - DNA, 20 bp, human
gacccctccgaggtcccata

SEQ ID NO: 398108 - DNA, 20 bp, human
gaaccctatgggacctcgga

SEQ ID NO: 398109 - DNA, 20 bp, human
gggaggggcaagttcagtcc

SEQ ID NO: 398110 - DNA, 20 bp, human
gccgctccccgcaggggaca

SEQ ID NO: 398111 - DNA, 20 bp, human
gccagggagacggcttccga

SEQ ID NO: 398112 - DNA, 20 bp, human
gggagcccccgctttatcct

SEQ ID NO: 398113 - DNA, 20 bp, human
ggtggccgaggataaagcgg

SEQ ID NO: 398114 - DNA, 20 bp, human
gagatccagaggggggccgg

SEQ ID NO: 398115 - DNA, 20 bp, human
ggagagatccagaggggggc

SEQ ID NO: 398116 - DNA, 20 bp, human
ggaggccgttcacacctccc

SEQ ID NO: 398117 - DNA, 20 bp, human
gagacatcgaggagccgggg

SEQ ID NO: 398118 - DNA, 20 bp, human
gccggctcctcgatgtctgg

SEQ ID NO: 398119 - DNA, 20 bp, human
ggacaggcccaagtgggagt

SEQ ID NO: 398120 - DNA, 20 bp, human
gctcctcgatgtctggggga

SEQ ID NO: 398121 - DNA, 20 bp, human
gcgggccctggttaatggag

SEQ ID NO: 398122 - DNA, 20 bp, human
gagaggcgatggttcgggat

SEQ ID NO: 398123 - DNA, 20 bp, human
gggagcccggtttgcataca

SEQ ID NO: 398124 - DNA, 20 bp, human
gaggtcgcccggcacctccc

SEQ ID NO: 398125 - DNA, 20 bp, human
gatcgcctctccattaacca

SEQ ID NO: 398126 - DNA, 20 bp, human
gcacggtgagtcaatgggga

SEQ ID NO: 398127 - DNA, 20 bp, human
gttagcaggcatcaggaaaa

SEQ ID NO: 398128 - DNA, 20 bp, human
gattccgcacggtgagtcaa

SEQ ID NO: 398129 - DNA, 20 bp, human
gggcatcaggaaaaaggctt

SEQ ID NO: 398130 - DNA, 20 bp, human
gaagagaagcaaaatagcta

SEQ ID NO: 398131 - DNA, 20 bp, human
gagggaatgaaatgtaccac

SEQ ID NO: 398132 - DNA, 20 bp, human
gaggcttggggagggaatgc

SEQ ID NO: 398133 - DNA, 20 bp, human
gagatgtggggccttttagc

SEQ ID NO: 398134 - DNA, 20 bp, human
ggagggatccccaatgaatt

SEQ ID NO: 398135 - DNA, 20 bp, human
ggggccttttagcaggcatc

SEQ ID NO: 398136 - DNA, 20 bp, human
gttgtgagatctcagggaga

SEQ ID NO: 398137 - DNA, 20 bp, human
gaaaacgtttgtgagatctc

SEQ ID NO: 398138 - DNA, 20 bp, human
gaggtgaacggaatggctgt

SEQ ID NO: 398139 - DNA, 20 bp, human
gaagggatactttctttagg

SEQ ID NO: 398140 - DNA, 20 bp, human
gcactgggaggtaactccgc

SEQ ID NO: 398141 - DNA, 20 bp, human
ggcagccccagagaccggtc

SEQ ID NO: 398142 - DNA, 20 bp, human
ggtaaagggatactttcttt

SEQ ID NO: 398143 - DNA, 20 bp, human
ggacactccgatggagaaaa

SEQ ID NO: 398144 - DNA, 20 bp, human
gctcaagcaggtgaacggaa

SEQ ID NO: 398145 - DNA, 20 bp, human
gtggggctgccggtggcatc

SEQ ID NO: 398146 - DNA, 20 bp, human
gcccgctggcggtggggtca

SEQ ID NO: 398147 - DNA, 20 bp, human
ggcaccacacacccccgcgg

SEQ ID NO: 398148 - DNA, 20 bp, human
gccccaccgccagcgggcac

SEQ ID NO: 398149 - DNA, 20 bp, human
gcggcagcggggacgcccag

SEQ ID NO: 398150 - DNA, 20 bp, human
ggacaccgtgtctgagtcac

SEQ ID NO: 398151 - DNA, 20 bp, human
ggagaagatggaggacgcca

SEQ ID NO: 398152 - DNA, 20 bp, human
gggcgcggcgtccccccccg

SEQ ID NO: 398153 - DNA, 20 bp, human
gccgggacgcaccaccgcgg

SEQ ID NO: 398154 - DNA, 20 bp, human
ggtctcccgtgactcagaca

SEQ ID NO: 398155 - DNA, 20 bp, human
ggggtctaacagggacgcga

SEQ ID NO: 398156 - DNA, 20 bp, human
ggaagctcgagccctccgat

SEQ ID NO: 398157 - DNA, 20 bp, human
gctagcctcctccaatcgga

SEQ ID NO: 398158 - DNA, 20 bp, human
gagccctagcctcctccaat

SEQ ID NO: 398159 - DNA, 20 bp, human
ggggcgccccctgctagtcg

SEQ ID NO: 398160 - DNA, 20 bp, human
gcgagccctccgattggagg

SEQ ID NO: 398161 - DNA, 20 bp, human
gaataagcgggctcgaaaag

SEQ ID NO: 398162 - DNA, 20 bp, human
gctcgaaaagggggcgtgag

SEQ ID NO: 398163 - DNA, 20 bp, human
gtgctagtcgcggccgtaaa

SEQ ID NO: 398164 - DNA, 20 bp, human
gctcgcccgcccgaccccgg

SEQ ID NO: 398165 - DNA, 20 bp, human
ggtgagcgtgtaagcgagag

SEQ ID NO: 398166 - DNA, 20 bp, human
gaaggacgcccgacgattgg

SEQ ID NO: 398167 - DNA, 20 bp, human
gggagcgcgcggggtcacgt

SEQ ID NO: 398168 - DNA, 20 bp, human
gaggaaggacgcccgacgat

SEQ ID NO: 398169 - DNA, 20 bp, human
gtcgaggtctggcgtcccgt

SEQ ID NO: 398170 - DNA, 20 bp, human
ggacgtcaatgttcattcat

SEQ ID NO: 398171 - DNA, 20 bp, human
gcaggcaccctccaatcgtc

SEQ ID NO: 398172 - DNA, 20 bp, human
gctgaaggggtgtgcgctag

SEQ ID NO: 398173 - DNA, 20 bp, human
gcctccaccgccttataaag

SEQ ID NO: 398174 - DNA, 20 bp, human
gcgctggggccttcggctga

SEQ ID NO: 398175 - DNA, 20 bp, human
gccaccgctcggagccgagg

SEQ ID NO: 398176 - DNA, 20 bp, human
gggggcggaaagtaacaagg

SEQ ID NO: 398177 - DNA, 20 bp, human
gagaggggcggaaagtaaca

SEQ ID NO: 398178 - DNA, 20 bp, human
gtgtacagtcccagctagag

SEQ ID NO: 398179 - DNA, 20 bp, human
gcctgagactgatgtgacat

SEQ ID NO: 398180 - DNA, 20 bp, human
gaacctggttgggcacctgc

SEQ ID NO: 398181 - DNA, 20 bp, human
gtccaacaagtcaacctggt

SEQ ID NO: 398182 - DNA, 20 bp, human
gaggagtctggacttgtcac

SEQ ID NO: 398183 - DNA, 20 bp, human
gcaattcagggcaggaggtt

SEQ ID NO: 398184 - DNA, 20 bp, human
gtgagattgtctcttaaact

SEQ ID NO: 398185 - DNA, 20 bp, human
ggtactccaacaagtcaacc

SEQ ID NO: 398186 - DNA, 20 bp, human
ggggagcgagggacgcttgt

SEQ ID NO: 398187 - DNA, 20 bp, human
gaggcggggacgaagggatc

SEQ ID NO: 398188 - DNA, 20 bp, human
gctgggaaccgcatagtctc

SEQ ID NO: 398189 - DNA, 20 bp, human
gagcgagggacgcttgttgg

SEQ ID NO: 398190 - DNA, 20 bp, human
gagaaggaggcggggacgaa

SEQ ID NO: 398191 - DNA, 20 bp, human
gaagggtgccggagactatg

SEQ ID NO: 398192 - DNA, 20 bp, human
gactccctaggggattccaa

SEQ ID NO: 398193 - DNA, 20 bp, human
gcccacctctgacaagcatg

SEQ ID NO: 398194 - DNA, 20 bp, human
gtctgacaagcatgcggcca

SEQ ID NO: 398195 - DNA, 20 bp, human
gtactcgcggtgcgaagcct

SEQ ID NO: 398196 - DNA, 20 bp, human
gagtagggaagccctcgccc

SEQ ID NO: 398197 - DNA, 20 bp, human
gtcccagcatgggatggtgg

SEQ ID NO: 398198 - DNA, 20 bp, human
gggaggggaatggtatgcag

SEQ ID NO: 398199 - DNA, 20 bp, human
gggaacctgccgagccttga

SEQ ID NO: 398200 - DNA, 20 bp, human
ggcctccccaggctctgacg

SEQ ID NO: 398201 - DNA, 20 bp, human
gtccgcgtcagagcctgggg

SEQ ID NO: 398202 - DNA, 20 bp, human
gagccgggagcacccgtgat

SEQ ID NO: 398203 - DNA, 20 bp, human
gccggggctcgtcctatcac

SEQ ID NO: 398204 - DNA, 20 bp, human
gggggaacgccggggagaag

SEQ ID NO: 398205 - DNA, 20 bp, human
gcggccaggtgacagagaca

SEQ ID NO: 398206 - DNA, 20 bp, human
ggcagggagggcttctgcac

SEQ ID NO: 398207 - DNA, 20 bp, human
ggggagagactctagagacg

SEQ ID NO: 398208 - DNA, 20 bp, human
ggcgccgcgctgccgaggca

SEQ ID NO: 398209 - DNA, 20 bp, human
ggactctagagacggggcct

SEQ ID NO: 398210 - DNA, 20 bp, human
gcgcgctgccgaggcaggga

SEQ ID NO: 398211 - DNA, 20 bp, human
gtcactgcgccgcgctgccg

SEQ ID NO: 398212 - DNA, 20 bp, human
gcaagccgctgcaaaaccgt

SEQ ID NO: 398213 - DNA, 20 bp, human
ggcggcgcagtgagcatgct

SEQ ID NO: 398214 - DNA, 20 bp, human
gcaacacttgctacattgag

SEQ ID NO: 398215 - DNA, 20 bp, human
gtcctcctacggttttgcag

SEQ ID NO: 398216 - DNA, 20 bp, human
gcgcggaaatagccggccgg

SEQ ID NO: 398217 - DNA, 20 bp, human
gaaggatcctccagcaccgt

SEQ ID NO: 398218 - DNA, 20 bp, human
gcacgcgcacagcctccggc

SEQ ID NO: 398219 - DNA, 20 bp, human
gcgagcgcgcgcgaagacta

SEQ ID NO: 398220 - DNA, 20 bp, human
gttacaacggcctacggtgc

SEQ ID NO: 398221 - DNA, 20 bp, human
gcctccgttacaacggccta

SEQ ID NO: 398222 - DNA, 20 bp, human
ggcgcgcgcgaagactacgg

SEQ ID NO: 398223 - DNA, 20 bp, human
gccgccccgcgtccgacccg

SEQ ID NO: 398224 - DNA, 20 bp, human
gggccgttgtaacggaggcg

SEQ ID NO: 398225 - DNA, 20 bp, human
ggctcgcggaaatagccggc

SEQ ID NO: 398226 - DNA, 20 bp, human
gaactgccttcaccatataa

SEQ ID NO: 398227 - DNA, 20 bp, human
gtgaaggcagttcctagagg

SEQ ID NO: 398228 - DNA, 20 bp, human
gcacatcagctctcattgtc

SEQ ID NO: 398229 - DNA, 20 bp, human
gtcaccatataagggaagat

SEQ ID NO: 398230 - DNA, 20 bp, human
gtggtgaaggcagttcctag

SEQ ID NO: 398231 - DNA, 20 bp, human
gtctgagtgagcaagggatg

SEQ ID NO: 398232 - DNA, 20 bp, human
ggttcctagaggaggggggg

SEQ ID NO: 398233 - DNA, 20 bp, human
gtcactcagaagccaaggga

SEQ ID NO: 398234 - DNA, 20 bp, human
gtgctgtctgcctgtggtga

SEQ ID NO: 398235 - DNA, 20 bp, human
gtctgcctgtggtgagggcc

SEQ ID NO: 398236 - DNA, 20 bp, human
ggggccatgccacccctctc

SEQ ID NO: 398237 - DNA, 20 bp, human
gccaccccagcgggtgtcat

SEQ ID NO: 398238 - DNA, 20 bp, human
ggaagtctgcctgagagggg

SEQ ID NO: 398239 - DNA, 20 bp, human
gtggggaagtctgcctgaga

SEQ ID NO: 398240 - DNA, 20 bp, human
gatggtgccggtacccgagg

SEQ ID NO: 398241 - DNA, 20 bp, human
ggggtggcatggcccggcac

SEQ ID NO: 398242 - DNA, 20 bp, human
gacggtaaccgcccccttgt

SEQ ID NO: 398243 - DNA, 20 bp, human
ggaagcggcaagttgagagc

SEQ ID NO: 398244 - DNA, 20 bp, human
gtccgcggagatcaggaagt

SEQ ID NO: 398245 - DNA, 20 bp, human
gctcaacttgccgcttccca

SEQ ID NO: 398246 - DNA, 20 bp, human
ggggagggcgctggtcccga

SEQ ID NO: 398247 - DNA, 20 bp, human
ggggaccagcgccctcccca

SEQ ID NO: 398248 - DNA, 20 bp, human
gactccgggtgagggatcag

SEQ ID NO: 398249 - DNA, 20 bp, human
ggtacccaggcagtgagacc

SEQ ID NO: 398250 - DNA, 20 bp, human
gcaggaggggaaggtggtca

SEQ ID NO: 398251 - DNA, 20 bp, human
gctggactgggctaagaggt

SEQ ID NO: 398252 - DNA, 20 bp, human
gaggcctggactgggctaag

SEQ ID NO: 398253 - DNA, 20 bp, human
gccagtggccagagagagca

SEQ ID NO: 398254 - DNA, 20 bp, human
gtggtggggtgtgtcctgca

SEQ ID NO: 398255 - DNA, 20 bp, human
ggggcccctgatccctcacc

SEQ ID NO: 398256 - DNA, 20 bp, human
gccggagcaggaaggctcga

SEQ ID NO: 398257 - DNA, 20 bp, human
gctgctgtcccgccgattga

SEQ ID NO: 398258 - DNA, 20 bp, human
gacctagcgagaagcgggga

SEQ ID NO: 398259 - DNA, 20 bp, human
gggtggggtcgcttagtcac

SEQ ID NO: 398260 - DNA, 20 bp, human
gaaggcaagtcgatggacag

SEQ ID NO: 398261 - DNA, 20 bp, human
gagggctcctagcggtttag

SEQ ID NO: 398262 - DNA, 20 bp, human
ggcgccgcccgcttggaaag

SEQ ID NO: 398263 - DNA, 20 bp, human
ggatctgggaggcccacgta

SEQ ID NO: 398264 - DNA, 20 bp, human
gaggaaagcccgagggagag

SEQ ID NO: 398265 - DNA, 20 bp, human
gaactcccgccgtccgaagc

SEQ ID NO: 398266 - DNA, 20 bp, human
ggtcgctgggccaaacgcag

SEQ ID NO: 398267 - DNA, 20 bp, human
ggcaggggggcgtggccgag

SEQ ID NO: 398268 - DNA, 20 bp, human
ggggccgggacagcgcgtgt

SEQ ID NO: 398269 - DNA, 20 bp, human
gcggccccggcgagcgtagc

SEQ ID NO: 398270 - DNA, 20 bp, human
gaaatcccggctacgctcgc

SEQ ID NO: 398271 - DNA, 20 bp, human
gggcggggtcggcctgcgat

SEQ ID NO: 398272 - DNA, 20 bp, human
gctatctcttggcttgagtc

SEQ ID NO: 398273 - DNA, 20 bp, human
ggggcgcgccacgtgtgcgt

SEQ ID NO: 398274 - DNA, 20 bp, human
gccggacgcggtcgtggtcc

SEQ ID NO: 398275 - DNA, 20 bp, human
gcacgtggcgcgcccggacg

SEQ ID NO: 398276 - DNA, 20 bp, human
ggacggccatgggatgaata

SEQ ID NO: 398277 - DNA, 20 bp, human
gcgtcacagtatgacggcca

SEQ ID NO: 398278 - DNA, 20 bp, human
gataagccctataaaatgat

SEQ ID NO: 398279 - DNA, 20 bp, human
ggaaggaatcccaatggccc

SEQ ID NO: 398280 - DNA, 20 bp, human
ggattgtagtgttatagcca

SEQ ID NO: 398281 - DNA, 20 bp, human
ggtgttatagccagggccat

SEQ ID NO: 398282 - DNA, 20 bp, human
gctctagagcttttaaagtt

SEQ ID NO: 398283 - DNA, 20 bp, human
gtgaagtctttattttctga

SEQ ID NO: 398284 - DNA, 20 bp, human
ggaaagacgtcacagtatga

SEQ ID NO: 398285 - DNA, 20 bp, human
gacgaaatgtaataatagga

SEQ ID NO: 398286 - DNA, 20 bp, human
ggctgtcccgacgaaccaca

SEQ ID NO: 398287 - DNA, 20 bp, human
gacggtgcttggggtttctg

SEQ ID NO: 398288 - DNA, 20 bp, human
ggcggaagggaataatcgta

SEQ ID NO: 398289 - DNA, 20 bp, human
gtgggacggaagtaaccggt

SEQ ID NO: 398290 - DNA, 20 bp, human
gcgcggaaggtctcgcggaa

SEQ ID NO: 398291 - DNA, 20 bp, human
gaaggtctcgcggaaaggag

SEQ ID NO: 398292 - DNA, 20 bp, human
gataaccgcggaaggtctcg

SEQ ID NO: 398293 - DNA, 20 bp, human
ggaagtaaccggtgggagtg

SEQ ID NO: 398294 - DNA, 20 bp, human
gaggagccggaagttaagga

SEQ ID NO: 398295 - DNA, 20 bp, human
gaagaagccttgtggttcgt

SEQ ID NO: 398296 - DNA, 20 bp, human
ggggccgccgcgcaggtatg

SEQ ID NO: 398297 - DNA, 20 bp, human
gccgccgcgcaggtatgggg

SEQ ID NO: 398298 - DNA, 20 bp, human
ggggcggcggatctagccaa

SEQ ID NO: 398299 - DNA, 20 bp, human
gccctcgcgggtctcgtcca

SEQ ID NO: 398300 - DNA, 20 bp, human
ggaagaccaaggtgtgggat

SEQ ID NO: 398301 - DNA, 20 bp, human
gtcggcgcgaaggatgaatt

SEQ ID NO: 398302 - DNA, 20 bp, human
gcagaggtgggagcttgcga

SEQ ID NO: 398303 - DNA, 20 bp, human
ggatctagccaatggatggg

SEQ ID NO: 398304 - DNA, 20 bp, human
ggatgagcccggaggggcga

SEQ ID NO: 398305 - DNA, 20 bp, human
gcccacctgtgcgtctccga

SEQ ID NO: 398306 - DNA, 20 bp, human
ggcggagcgggggttctcgg

SEQ ID NO: 398307 - DNA, 20 bp, human
ggcgcagcggaaggggaagt

SEQ ID NO: 398308 - DNA, 20 bp, human
gggaggagggagacgaggat

SEQ ID NO: 398309 - DNA, 20 bp, human
gacggcgcgcccaccccgga

SEQ ID NO: 398310 - DNA, 20 bp, human
gacgaggattggggcagcgc

SEQ ID NO: 398311 - DNA, 20 bp, human
gagagaggctgggggggtcg

SEQ ID NO: 398312 - DNA, 20 bp, human
gaagcggccagagacccgtc

SEQ ID NO: 398313 - DNA, 20 bp, human
gggggggtcgaggagaccag

SEQ ID NO: 398314 - DNA, 20 bp, human
gggcggggcgcgtgggggac

SEQ ID NO: 398315 - DNA, 20 bp, human
ggccagagacccgtccgggg

SEQ ID NO: 398316 - DNA, 20 bp, human
gggactgaactgcacaaaga

SEQ ID NO: 398317 - DNA, 20 bp, human
gtcaaaagctagtgaacagc

SEQ ID NO: 398318 - DNA, 20 bp, human
gttactgaaagtttgtgctt

SEQ ID NO: 398319 - DNA, 20 bp, human
ggttttagtgctgaattagg

SEQ ID NO: 398320 - DNA, 20 bp, human
gctggttttagtgctgaatt

SEQ ID NO: 398321 - DNA, 20 bp, human
gttgacattctaaaaagtag

SEQ ID NO: 398322 - DNA, 20 bp, human
ggacacaagataatcatagt

SEQ ID NO: 398323 - DNA, 20 bp, human
gaacttgccaaaacgcagaa

SEQ ID NO: 398324 - DNA, 20 bp, human
gaaaaatagcattaatatgt

SEQ ID NO: 398325 - DNA, 20 bp, human
gaaatgactcaattatatgc

SEQ ID NO: 398326 - DNA, 20 bp, human
gctagtcaagcgggcgagtt

SEQ ID NO: 398327 - DNA, 20 bp, human
ggacccaaatggctgttcca

SEQ ID NO: 398328 - DNA, 20 bp, human
ggaagcgggtaagggacgtg

SEQ ID NO: 398329 - DNA, 20 bp, human
gcgcggctgcaaggcatcaa

SEQ ID NO: 398330 - DNA, 20 bp, human
gaatgccgggactagtgaag

SEQ ID NO: 398331 - DNA, 20 bp, human
ggggtcgtggagtgcgagca

SEQ ID NO: 398332 - DNA, 20 bp, human
gcgccctggaacagccattt

SEQ ID NO: 398333 - DNA, 20 bp, human
ggaaaacagcgaagaatgcc

SEQ ID NO: 398334 - DNA, 20 bp, human
gggccaatcgccgagtcaga

SEQ ID NO: 398335 - DNA, 20 bp, human
gggactagtgaagcgggtaa

SEQ ID NO: 398336 - DNA, 20 bp, human
gccaaaaggagtgaggcgga

SEQ ID NO: 398337 - DNA, 20 bp, human
ggagtgcgcaacggccgaag

SEQ ID NO: 398338 - DNA, 20 bp, human
gccgaagaggccggatcggc

SEQ ID NO: 398339 - DNA, 20 bp, human
gacggccgaagaggccggat

SEQ ID NO: 398340 - DNA, 20 bp, human
ggatcggcgggcggagactg

SEQ ID NO: 398341 - DNA, 20 bp, human
ggcgcaacggccgaagaggc

SEQ ID NO: 398342 - DNA, 20 bp, human
ggcggccggtcgcgcgcgag

SEQ ID NO: 398343 - DNA, 20 bp, human
ggagggggtggagtgcgcaa

SEQ ID NO: 398344 - DNA, 20 bp, human
gaagaggccggatcggcggg

SEQ ID NO: 398345 - DNA, 20 bp, human
gaaccgccccaaaaggagtg

SEQ ID NO: 398346 - DNA, 20 bp, human
gtgcaagaggagcgcgtcga

SEQ ID NO: 398347 - DNA, 20 bp, human
gtgctccgcgcgttcgcctg

SEQ ID NO: 398348 - DNA, 20 bp, human
ggccacccggaccgctctag

SEQ ID NO: 398349 - DNA, 20 bp, human
gtaggacaggcacccgggat

SEQ ID NO: 398350 - DNA, 20 bp, human
ggcagccacgaccacgaccg

SEQ ID NO: 398351 - DNA, 20 bp, human
gagcgcgtcgagggaaagga

SEQ ID NO: 398352 - DNA, 20 bp, human
gcgttcgcctggggctcacg

SEQ ID NO: 398353 - DNA, 20 bp, human
gcggcgcgcgagccaaccag

SEQ ID NO: 398354 - DNA, 20 bp, human
gtgagccccaggcgaacgcg

SEQ ID NO: 398355 - DNA, 20 bp, human
ggcccggggcgaccgctggt

SEQ ID NO: 398356 - DNA, 20 bp, human
gcgctcacatgacttaccgg

SEQ ID NO: 398357 - DNA, 20 bp, human
gaggcctgctcctcgagcac

SEQ ID NO: 398358 - DNA, 20 bp, human
gggcgcgccgcagcgacgca

SEQ ID NO: 398359 - DNA, 20 bp, human
gcaacagccctgcgtcgctg

SEQ ID NO: 398360 - DNA, 20 bp, human
gtcacatgacttaccggcgg

SEQ ID NO: 398361 - DNA, 20 bp, human
ggggcgctcacatgacttac

SEQ ID NO: 398362 - DNA, 20 bp, human
ggcggcgggccacagtacgc

SEQ ID NO: 398363 - DNA, 20 bp, human
gcttaccggcggtggctccg

SEQ ID NO: 398364 - DNA, 20 bp, human
gcacgccgcggagccaccgc

SEQ ID NO: 398365 - DNA, 20 bp, human
gctcgagcacaggcccctcc

SEQ ID NO: 398366 - DNA, 20 bp, human
gagggaggggacagtatcga

SEQ ID NO: 398367 - DNA, 20 bp, human
ggggccgtggacaggatcag

SEQ ID NO: 398368 - DNA, 20 bp, human
gacagccgcggggtgaacag

SEQ ID NO: 398369 - DNA, 20 bp, human
gttagcttccaagtagggag

SEQ ID NO: 398370 - DNA, 20 bp, human
gcgaacctgtggcctgtcag

SEQ ID NO: 398371 - DNA, 20 bp, human
gcgcgagccgccaaaggatg

SEQ ID NO: 398372 - DNA, 20 bp, human
ggggcggagtttcatgatcc

SEQ ID NO: 398373 - DNA, 20 bp, human
gagactgtataagggatgaa

SEQ ID NO: 398374 - DNA, 20 bp, human
gctagagtgagcccaaactc

SEQ ID NO: 398375 - DNA, 20 bp, human
gcaaacccaaacactaccac

SEQ ID NO: 398376 - DNA, 20 bp, human
gcccagagctagggtaggag

SEQ ID NO: 398377 - DNA, 20 bp, human
ggcccctcctaccctagctc

SEQ ID NO: 398378 - DNA, 20 bp, human
gcctccgggagcaggaaata

SEQ ID NO: 398379 - DNA, 20 bp, human
gttcctgctcccggaggcag

SEQ ID NO: 398380 - DNA, 20 bp, human
gagagcagagaccagggcta

SEQ ID NO: 398381 - DNA, 20 bp, human
ggtcccaccagtgacgggat

SEQ ID NO: 398382 - DNA, 20 bp, human
gagcctctgcctccgggagc

SEQ ID NO: 398383 - DNA, 20 bp, human
gcgggagtcccaccagtgac

SEQ ID NO: 398384 - DNA, 20 bp, human
gcctcacaacaatttttggg

SEQ ID NO: 398385 - DNA, 20 bp, human
gtactataggctacgaatta

SEQ ID NO: 398386 - DNA, 20 bp, human
ggccctgtgggtgtggcaag

SEQ ID NO: 398387 - DNA, 20 bp, human
gagaagggaaggcgcgagtg

SEQ ID NO: 398388 - DNA, 20 bp, human
ggaaaggaggtactgtaggt

SEQ ID NO: 398389 - DNA, 20 bp, human
gtcctcgcgggatttcagtt

SEQ ID NO: 398390 - DNA, 20 bp, human
gtgaggaaaggaggtactgt

SEQ ID NO: 398391 - DNA, 20 bp, human
gtgttcgctgcccagaagaa

SEQ ID NO: 398392 - DNA, 20 bp, human
gctacctcttccggggttcc

SEQ ID NO: 398393 - DNA, 20 bp, human
ggcgtgagctacctcttccg

SEQ ID NO: 398394 - DNA, 20 bp, human
gtcagttaggctcttagtgc

SEQ ID NO: 398395 - DNA, 20 bp, human
ggagctcgccgaaaggaggg

SEQ ID NO: 398396 - DNA, 20 bp, human
gcccaactccagtctgaatg

SEQ ID NO: 398397 - DNA, 20 bp, human
gcagactggagttgggatcc

SEQ ID NO: 398398 - DNA, 20 bp, human
gtggctgagaatcaagtccg

SEQ ID NO: 398399 - DNA, 20 bp, human
gtcctcattcagactggagt

SEQ ID NO: 398400 - DNA, 20 bp, human
gttagcttcctcattcagac

SEQ ID NO: 398401 - DNA, 20 bp, human
gcccctagattttgatgaaa

SEQ ID NO: 398402 - DNA, 20 bp, human
ggccatttcatcaaaatcta

SEQ ID NO: 398403 - DNA, 20 bp, human
gattctcagccaactggcct

SEQ ID NO: 398404 - DNA, 20 bp, human
gcttttggaaaagtaaaatc

SEQ ID NO: 398405 - DNA, 20 bp, human
gtgtaagccctgagttttat

SEQ ID NO: 398406 - DNA, 20 bp, human
gatgcgaacttgaacctgcc

SEQ ID NO: 398407 - DNA, 20 bp, human
gacaaggaataaaaacaaag

SEQ ID NO: 398408 - DNA, 20 bp, human
gtcgcattttgcctgtaagt

SEQ ID NO: 398409 - DNA, 20 bp, human
gctgtctttgcaataaaacc

SEQ ID NO: 398410 - DNA, 20 bp, human
gagactgaaatataatgaca

SEQ ID NO: 398411 - DNA, 20 bp, human
gtatatttcagtcttgtagt

SEQ ID NO: 398412 - DNA, 20 bp, human
gattttgcctgtaagtaggg

SEQ ID NO: 398413 - DNA, 20 bp, human
gtacacacagagaggtgaag

SEQ ID NO: 398414 - DNA, 20 bp, human
gatagtaatgcctgcctcat

SEQ ID NO: 398415 - DNA, 20 bp, human
gttaaagagcacttcccatg

SEQ ID NO: 398416 - DNA, 20 bp, human
gtatgtacattagttcgcta

SEQ ID NO: 398417 - DNA, 20 bp, human
gaacttagtaccttaaacta

SEQ ID NO: 398418 - DNA, 20 bp, human
gaaattactgcaataaggta

SEQ ID NO: 398419 - DNA, 20 bp, human
gggcagccatctatgggtca

SEQ ID NO: 398420 - DNA, 20 bp, human
gcctgtgttaaagattagag

SEQ ID NO: 398421 - DNA, 20 bp, human
gaatctttaacacagggaaa

SEQ ID NO: 398422 - DNA, 20 bp, human
gtgacaaaaaaagctagagc

SEQ ID NO: 398423 - DNA, 20 bp, human
gtttatagaaagaagacacg

SEQ ID NO: 398424 - DNA, 20 bp, human
gtctttccttcaccgccctc

SEQ ID NO: 398425 - DNA, 20 bp, human
gaattaacttccgtagttta

SEQ ID NO: 398426 - DNA, 20 bp, human
gatgactcctatcgtataca

SEQ ID NO: 398427 - DNA, 20 bp, human
gtatacgataggagtcatcc

SEQ ID NO: 398428 - DNA, 20 bp, human
gtcctatcgtatacaaggca

SEQ ID NO: 398429 - DNA, 20 bp, human
gagaacaaaggagcaaataa

SEQ ID NO: 398430 - DNA, 20 bp, human
gaagcccaaaacaaggaaga

SEQ ID NO: 398431 - DNA, 20 bp, human
gtccatgccttgtatacgat

SEQ ID NO: 398432 - DNA, 20 bp, human
gactgtgcagaatgactaga

SEQ ID NO: 398433 - DNA, 20 bp, human
gaagacggggaacagaaaac

SEQ ID NO: 398434 - DNA, 20 bp, human
ggggaaaccagtgcagagaa

SEQ ID NO: 398435 - DNA, 20 bp, human
ggaaaacaggaaatccacac

SEQ ID NO: 398436 - DNA, 20 bp, human
gagaatgtttgcataacatg

SEQ ID NO: 398437 - DNA, 20 bp, human
gaaaatgatgataaagtaaa

SEQ ID NO: 398438 - DNA, 20 bp, human
gttcagtctctgaaacagct

SEQ ID NO: 398439 - DNA, 20 bp, human
gacatgtggctgccagttac

SEQ ID NO: 398440 - DNA, 20 bp, human
gctgtttcagagactgaaga

SEQ ID NO: 398441 - DNA, 20 bp, human
gacaatcagaaagtattaca

SEQ ID NO: 398442 - DNA, 20 bp, human
gactttctgattgtcttaaa

SEQ ID NO: 398443 - DNA, 20 bp, human
ggttcttaagattataaagt

SEQ ID NO: 398444 - DNA, 20 bp, human
gaaagtaaaaggccagtaac

SEQ ID NO: 398445 - DNA, 20 bp, human
gacttttctttctttaaaag

SEQ ID NO: 398446 - DNA, 20 bp, human
gttgaaggacagtctggagt

SEQ ID NO: 398447 - DNA, 20 bp, human
gcagaaagtgaaatcaaaac

SEQ ID NO: 398448 - DNA, 20 bp, human
gctcctgtctgtcatctcaa

SEQ ID NO: 398449 - DNA, 20 bp, human
gaacatggacatggactctg

SEQ ID NO: 398450 - DNA, 20 bp, human
ggaaccacagcaatagaatc

SEQ ID NO: 398451 - DNA, 20 bp, human
ggcatcttcagtcagacacc

SEQ ID NO: 398452 - DNA, 20 bp, human
gtctgtcatctcaaagggta

SEQ ID NO: 398453 - DNA, 20 bp, human
gtgaatatgagagtcgactt

SEQ ID NO: 398454 - DNA, 20 bp, human
gttctttcaaggagttgtat

SEQ ID NO: 398455 - DNA, 20 bp, human
gtctcctgattctattgctg

SEQ ID NO: 398456 - DNA, 20 bp, human
gcgacaggacgacctccctt

SEQ ID NO: 398457 - DNA, 20 bp, human
gggacgacctcccttgggaa

SEQ ID NO: 398458 - DNA, 20 bp, human
ggcaccgcctggcgaatggg

SEQ ID NO: 398459 - DNA, 20 bp, human
gccgcctggcgaatgggagg

SEQ ID NO: 398460 - DNA, 20 bp, human
gtgagcagtgggttcgtctg

SEQ ID NO: 398461 - DNA, 20 bp, human
gcgctaggcccgcgacgctg

SEQ ID NO: 398462 - DNA, 20 bp, human
gccttcctgggtttagtcta

SEQ ID NO: 398463 - DNA, 20 bp, human
gcgggggcggagcgcagcca

SEQ ID NO: 398464 - DNA, 20 bp, human
gcgctcccgacacgcccggc

SEQ ID NO: 398465 - DNA, 20 bp, human
gcggccttcccatcacgcgt

SEQ ID NO: 398466 - DNA, 20 bp, human
gaggaccgcgagcaaggggc

SEQ ID NO: 398467 - DNA, 20 bp, human
gcgaactgctgagtactcat

SEQ ID NO: 398468 - DNA, 20 bp, human
ggcgcgaggaccgcgagcaa

SEQ ID NO: 398469 - DNA, 20 bp, human
gaagagaacgcctgcacgat

SEQ ID NO: 398470 - DNA, 20 bp, human
gaagagctcatgcgtcaatt

SEQ ID NO: 398471 - DNA, 20 bp, human
gaagttccgcgtctaggggc

SEQ ID NO: 398472 - DNA, 20 bp, human
ggacgcatgagctcttcgcc

SEQ ID NO: 398473 - DNA, 20 bp, human
gaaatgaagttccgcgtcta

SEQ ID NO: 398474 - DNA, 20 bp, human
gcgcgaccacggctccacag

SEQ ID NO: 398475 - DNA, 20 bp, human
gctcatgcgtcaattgggac

SEQ ID NO: 398476 - DNA, 20 bp, human
gagggaggacacatcctcgg

SEQ ID NO: 398477 - DNA, 20 bp, human
gagtgtcggggcagcatttg

SEQ ID NO: 398478 - DNA, 20 bp, human
gtggccccagagtctccagc

SEQ ID NO: 398479 - DNA, 20 bp, human
gggtctgcaacgtcggttac

SEQ ID NO: 398480 - DNA, 20 bp, human
gcggttaccggaacagtgtc

SEQ ID NO: 398481 - DNA, 20 bp, human
gtgccatatggaagcattca

SEQ ID NO: 398482 - DNA, 20 bp, human
gtaccatcccagactttctt

SEQ ID NO: 398483 - DNA, 20 bp, human
gtggctctgatcttgccata

SEQ ID NO: 398484 - DNA, 20 bp, human
gctggggtgcggtttcctca

SEQ ID NO: 398485 - DNA, 20 bp, human
gccaaaggcctccagggcac

SEQ ID NO: 398486 - DNA, 20 bp, human
ggaaggaggggcggtgactg

SEQ ID NO: 398487 - DNA, 20 bp, human
gactgcacatgaggacttct

SEQ ID NO: 398488 - DNA, 20 bp, human
gccctccttcctcagtcaat

SEQ ID NO: 398489 - DNA, 20 bp, human
ggtgccaggaccctgacatt

SEQ ID NO: 398490 - DNA, 20 bp, human
gccctgtgccccaaagcacc

SEQ ID NO: 398491 - DNA, 20 bp, human
gcacaaggccttccaagaat

SEQ ID NO: 398492 - DNA, 20 bp, human
gttcccaaatgtcagggtcc

SEQ ID NO: 398493 - DNA, 20 bp, human
gagaaaatctcggctgaggg

SEQ ID NO: 398494 - DNA, 20 bp, human
ggcctattgactgaggaagg

SEQ ID NO: 398495 - DNA, 20 bp, human
gacttctgggctcctattct

SEQ ID NO: 398496 - DNA, 20 bp, human
ggacgctgtcaccccgactc

SEQ ID NO: 398497 - DNA, 20 bp, human
ggcccaggagctcctgagtc

SEQ ID NO: 398498 - DNA, 20 bp, human
gagccagcgaatcacgtggt

SEQ ID NO: 398499 - DNA, 20 bp, human
gggtgacagcgtcccgctgc

SEQ ID NO: 398500 - DNA, 20 bp, human
gtgccgaccacgtgattcgc

SEQ ID NO: 398501 - DNA, 20 bp, human
gtgacaaagctcccggaggt

SEQ ID NO: 398502 - DNA, 20 bp, human
ggagccctgggccaaaatgg

SEQ ID NO: 398503 - DNA, 20 bp, human
gctgcagtgtgcgagtttgc

SEQ ID NO: 398504 - DNA, 20 bp, human
ggatctaggactaccccgcg

SEQ ID NO: 398505 - DNA, 20 bp, human
gtaccgggagatcaagatga

SEQ ID NO: 398506 - DNA, 20 bp, human
gtgggcgcgcagccctgaga

SEQ ID NO: 398507 - DNA, 20 bp, human
ggtcccgttgccaggcgatg

SEQ ID NO: 398508 - DNA, 20 bp, human
gggcggggtcggaaaaaatc

SEQ ID NO: 398509 - DNA, 20 bp, human
ggccgggctcggcgcgaaaa

SEQ ID NO: 398510 - DNA, 20 bp, human
gccgacaggaaagaggagcc

SEQ ID NO: 398511 - DNA, 20 bp, human
gtggcaacgggacaccggtc

SEQ ID NO: 398512 - DNA, 20 bp, human
ggcgcgcagccctgagaggg

SEQ ID NO: 398513 - DNA, 20 bp, human
gaagcggccaccaccttcta

SEQ ID NO: 398514 - DNA, 20 bp, human
gtcgcctggcaacgggacac

SEQ ID NO: 398515 - DNA, 20 bp, human
gctcgcccctgagtaagggt

SEQ ID NO: 398516 - DNA, 20 bp, human
gcagccggaccggatttctc

SEQ ID NO: 398517 - DNA, 20 bp, human
gagctctaggaggtgtctaa

SEQ ID NO: 398518 - DNA, 20 bp, human
gaagtggcgctccggggaga

SEQ ID NO: 398519 - DNA, 20 bp, human
gggggtggggggaaccgtaa

SEQ ID NO: 398520 - DNA, 20 bp, human
gactctgcgcgtcttcgtga

SEQ ID NO: 398521 - DNA, 20 bp, human
gcagcctgagaaatccggtc

SEQ ID NO: 398522 - DNA, 20 bp, human
gccactctacgcagccggac

SEQ ID NO: 398523 - DNA, 20 bp, human
gccaagacggacctccacat

SEQ ID NO: 398524 - DNA, 20 bp, human
gaacttggttgggttcactg

SEQ ID NO: 398525 - DNA, 20 bp, human
gccggcggcggttcccgatg

SEQ ID NO: 398526 - DNA, 20 bp, human
ggcggcgcctacaaagcctc

SEQ ID NO: 398527 - DNA, 20 bp, human
ggtcgcccggccggtagcta

SEQ ID NO: 398528 - DNA, 20 bp, human
ggccctctagaggccgacgg

SEQ ID NO: 398529 - DNA, 20 bp, human
gtcctccgtcggcctctaga

SEQ ID NO: 398530 - DNA, 20 bp, human
ggcccggccggtagctaagg

SEQ ID NO: 398531 - DNA, 20 bp, human
gttcccccgcactcctccgt

SEQ ID NO: 398532 - DNA, 20 bp, human
gaagcctcgggatcacagct

SEQ ID NO: 398533 - DNA, 20 bp, human
gcgtgaccccgccggtgcgc

SEQ ID NO: 398534 - DNA, 20 bp, human
ggaggccgacggaggagtgc

SEQ ID NO: 398535 - DNA, 20 bp, human
gaaccgcccggcgcagctga

SEQ ID NO: 398536 - DNA, 20 bp, human
gacactggggcttattttat

SEQ ID NO: 398537 - DNA, 20 bp, human
ggaggggcccgcaccactgc

SEQ ID NO: 398538 - DNA, 20 bp, human
gagtggtgcgggcccctcca

SEQ ID NO: 398539 - DNA, 20 bp, human
gcgctcggctggccaggcac

SEQ ID NO: 398540 - DNA, 20 bp, human
gccagggttcgcggacactg

SEQ ID NO: 398541 - DNA, 20 bp, human
gcccctgtggctgcgaagtg

SEQ ID NO: 398542 - DNA, 20 bp, human
ggtggctgcgaagtggggaa

SEQ ID NO: 398543 - DNA, 20 bp, human
ggagcgccgagttatcgagg

SEQ ID NO: 398544 - DNA, 20 bp, human
ggtgtccgcgaaccctggag

SEQ ID NO: 398545 - DNA, 20 bp, human
gcccgacccgaccaatcgag

SEQ ID NO: 398546 - DNA, 20 bp, human
gcgggcgcgaagcccaggta

SEQ ID NO: 398547 - DNA, 20 bp, human
gcgaagggaaagcaaggcga

SEQ ID NO: 398548 - DNA, 20 bp, human
gtgacccggacgggcggaag

SEQ ID NO: 398549 - DNA, 20 bp, human
ggcgacccccagtgcccgaa

SEQ ID NO: 398550 - DNA, 20 bp, human
gtcggggcggcagccaagtg

SEQ ID NO: 398551 - DNA, 20 bp, human
gtccgcccgtccgggtcacg

SEQ ID NO: 398552 - DNA, 20 bp, human
ggaagcccaggtacgggctg

SEQ ID NO: 398553 - DNA, 20 bp, human
ggcggcctcgccacgtgacc

SEQ ID NO: 398554 - DNA, 20 bp, human
gctcgccacgtgacccggac

SEQ ID NO: 398555 - DNA, 20 bp, human
ggaaagcaaggcgatggagg

SEQ ID NO: 398556 - DNA, 20 bp, human
gaaggcgagacgagggctga

SEQ ID NO: 398557 - DNA, 20 bp, human
gggaactgcagcaggatcct

SEQ ID NO: 398558 - DNA, 20 bp, human
gcgctggcgcacaacgtcgc

SEQ ID NO: 398559 - DNA, 20 bp, human
gaggctggacagaccacccg

SEQ ID NO: 398560 - DNA, 20 bp, human
gcgccgggccagccagcaga

SEQ ID NO: 398561 - DNA, 20 bp, human
ggggcacgaaagccaaaact

SEQ ID NO: 398562 - DNA, 20 bp, human
gttgtgcgccagcgtacgcg

SEQ ID NO: 398563 - DNA, 20 bp, human
ggagcgggagctggtcaggg

SEQ ID NO: 398564 - DNA, 20 bp, human
gaacccggaagttacgtttt

SEQ ID NO: 398565 - DNA, 20 bp, human
ggccccgcgccgcccagttt

SEQ ID NO: 398566 - DNA, 20 bp, human
gtaggataacagcgagggac

SEQ ID NO: 398567 - DNA, 20 bp, human
gtggaaagagagagaccggc

SEQ ID NO: 398568 - DNA, 20 bp, human
gaaggccggaagtccttagc

SEQ ID NO: 398569 - DNA, 20 bp, human
gccaaaagatagggcttttt

SEQ ID NO: 398570 - DNA, 20 bp, human
gaggcaatgcagaaaggttc

SEQ ID NO: 398571 - DNA, 20 bp, human
ggagggactgggtcatgacg

SEQ ID NO: 398572 - DNA, 20 bp, human
gctttttaggataacagcga

SEQ ID NO: 398573 - DNA, 20 bp, human
gcccggacgtgcggaagcga

SEQ ID NO: 398574 - DNA, 20 bp, human
gtgccttctgcccggacgtg

SEQ ID NO: 398575 - DNA, 20 bp, human
gggctgggatctggagatct

SEQ ID NO: 398576 - DNA, 20 bp, human
gctggccgccaggcactccg

SEQ ID NO: 398577 - DNA, 20 bp, human
gtgaacagaggcgggttcgc

SEQ ID NO: 398578 - DNA, 20 bp, human
gcgtccggtgaccgaagaga

SEQ ID NO: 398579 - DNA, 20 bp, human
gctctccccggagtgcctgg

SEQ ID NO: 398580 - DNA, 20 bp, human
gtcgccgtctcttcggtcac

SEQ ID NO: 398581 - DNA, 20 bp, human
ggcaaattacgtcgagtggg

SEQ ID NO: 398582 - DNA, 20 bp, human
ggagaggccgcttggaggcg

SEQ ID NO: 398583 - DNA, 20 bp, human
gccggggagaggccgcttgg

SEQ ID NO: 398584 - DNA, 20 bp, human
gaggagaggaaggattcatc

SEQ ID NO: 398585 - DNA, 20 bp, human
gcgggcaaattacgtcgagt

SEQ ID NO: 398586 - DNA, 20 bp, human
ggggagtcccaggagcgtta

SEQ ID NO: 398587 - DNA, 20 bp, human
gcggccggcgctccagcggt

SEQ ID NO: 398588 - DNA, 20 bp, human
ggggactgcgcggcacgcgt

SEQ ID NO: 398589 - DNA, 20 bp, human
gcgcatgcgcagggagagcg

SEQ ID NO: 398590 - DNA, 20 bp, human
gagctccagcccggatgcgc

SEQ ID NO: 398591 - DNA, 20 bp, human
gtgcgcagcgagctctcctc

SEQ ID NO: 398592 - DNA, 20 bp, human
gaactgggcgggccgaaaag

SEQ ID NO: 398593 - DNA, 20 bp, human
gcggagccgccgaagcgcct

SEQ ID NO: 398594 - DNA, 20 bp, human
ggcacgctcagagaactggg

SEQ ID NO: 398595 - DNA, 20 bp, human
gtggcagctgctacctcgct

SEQ ID NO: 398596 - DNA, 20 bp, human
gtgccaggcagccacgggga

SEQ ID NO: 398597 - DNA, 20 bp, human
ggccgagctgccgatgggga

SEQ ID NO: 398598 - DNA, 20 bp, human
gggcgcgggcgcaggcgtga

SEQ ID NO: 398599 - DNA, 20 bp, human
gcccgcgcccgcccggactt

SEQ ID NO: 398600 - DNA, 20 bp, human
gcgcgcaggcgcagacatga

SEQ ID NO: 398601 - DNA, 20 bp, human
ggcagcccccgggacgtaac

SEQ ID NO: 398602 - DNA, 20 bp, human
gcgggtgggcggggtaagac

SEQ ID NO: 398603 - DNA, 20 bp, human
ggagggaatgtcccgaagtc

SEQ ID NO: 398604 - DNA, 20 bp, human
ggctgcgccggttacgtccc

SEQ ID NO: 398605 - DNA, 20 bp, human
gtgagcgccgagctgccgat

SEQ ID NO: 398606 - DNA, 20 bp, human
gcacctgggccgtcgagctg

SEQ ID NO: 398607 - DNA, 20 bp, human
gaaggcgcgcctcagctcga

SEQ ID NO: 398608 - DNA, 20 bp, human
ggccatccgccctaaaaagc

SEQ ID NO: 398609 - DNA, 20 bp, human
gcgcctcagctcgacggccc

SEQ ID NO: 398610 - DNA, 20 bp, human
gttcccaaacggctttacgg

SEQ ID NO: 398611 - DNA, 20 bp, human
gaaaagcgcgggcaacatcc

SEQ ID NO: 398612 - DNA, 20 bp, human
gggagacagaaattgccgta

SEQ ID NO: 398613 - DNA, 20 bp, human
gctccgccgtaaagccgttt

SEQ ID NO: 398614 - DNA, 20 bp, human
gcggcggagaagggtccgtg

SEQ ID NO: 398615 - DNA, 20 bp, human
gcctaaaaagcaggctcgga

SEQ ID NO: 398616 - DNA, 20 bp, human
gccaccggggtagaagaaag

SEQ ID NO: 398617 - DNA, 20 bp, human
gttggcgtgcgctgccgtac

SEQ ID NO: 398618 - DNA, 20 bp, human
gagaatctgaataaccaccg

SEQ ID NO: 398619 - DNA, 20 bp, human
gaagaaagaggcggacacta

SEQ ID NO: 398620 - DNA, 20 bp, human
ggcgtccgtggtcctcccgt

SEQ ID NO: 398621 - DNA, 20 bp, human
gaggaaccggcggactcggt

SEQ ID NO: 398622 - DNA, 20 bp, human
gcgcacgccaacccggaaac

SEQ ID NO: 398623 - DNA, 20 bp, human
gcgagtccgccggttcctac

SEQ ID NO: 398624 - DNA, 20 bp, human
gcggacactagggccagact

SEQ ID NO: 398625 - DNA, 20 bp, human
gtggtcactccaggagtcgt

SEQ ID NO: 398626 - DNA, 20 bp, human
gtggggtcgcagcactccag

SEQ ID NO: 398627 - DNA, 20 bp, human
gaggggacggcgtcctgaaa

SEQ ID NO: 398628 - DNA, 20 bp, human
ggggagaatcgctcgagtca

SEQ ID NO: 398629 - DNA, 20 bp, human
gtcgcgtaccaggaagggga

SEQ ID NO: 398630 - DNA, 20 bp, human
gtgggagcgaaagggacttc

SEQ ID NO: 398631 - DNA, 20 bp, human
gaacgcgtctattaattagg

SEQ ID NO: 398632 - DNA, 20 bp, human
gggcaacgcgtctattaatt

SEQ ID NO: 398633 - DNA, 20 bp, human
ggcgtctattaattaggtgg

SEQ ID NO: 398634 - DNA, 20 bp, human
gaattaggtggcggcgcctg

SEQ ID NO: 398635 - DNA, 20 bp, human
gcgcttcgcgtaccaggaag

SEQ ID NO: 398636 - DNA, 20 bp, human
gcatctagcgttaagtgaca

SEQ ID NO: 398637 - DNA, 20 bp, human
gcacagcgtgcgagagtggg

SEQ ID NO: 398638 - DNA, 20 bp, human
gagagtgggcggagcagtgc

SEQ ID NO: 398639 - DNA, 20 bp, human
gacgctgtggtgagattggc

SEQ ID NO: 398640 - DNA, 20 bp, human
gtcgcacgctgtggtgagat

SEQ ID NO: 398641 - DNA, 20 bp, human
gtcaccacagcgtgcgagag

SEQ ID NO: 398642 - DNA, 20 bp, human
gtcacttaacgctagatgga

SEQ ID NO: 398643 - DNA, 20 bp, human
gacccccggcgcatctggat

SEQ ID NO: 398644 - DNA, 20 bp, human
ggcggtgaacgtggacttgt

SEQ ID NO: 398645 - DNA, 20 bp, human
gagtgccggcgccatggggt

SEQ ID NO: 398646 - DNA, 20 bp, human
gtggaccgcctgctgatcaa

SEQ ID NO: 398647 - DNA, 20 bp, human
gcggctgcgaggtgcgcccg

SEQ ID NO: 398648 - DNA, 20 bp, human
gagtcggggcgggtgaggga

SEQ ID NO: 398649 - DNA, 20 bp, human
gcgaggtgcgcccggggacg

SEQ ID NO: 398650 - DNA, 20 bp, human
gaagcgagtcggggcgggtg

SEQ ID NO: 398651 - DNA, 20 bp, human
ggcggggtgcgaatctacga

SEQ ID NO: 398652 - DNA, 20 bp, human
gggacggaagcgagtcgggg

SEQ ID NO: 398653 - DNA, 20 bp, human
ggcgccccctagcgtcggac

SEQ ID NO: 398654 - DNA, 20 bp, human
ggccgctggtccaaacgaag

SEQ ID NO: 398655 - DNA, 20 bp, human
gacgggacggaagcgagtcg

SEQ ID NO: 398656 - DNA, 20 bp, human
gatgacgcgacacgcagagg

SEQ ID NO: 398657 - DNA, 20 bp, human
ggggcggggcacgcaagtga

SEQ ID NO: 398658 - DNA, 20 bp, human
gcaggacgtgcgaaaagcga

SEQ ID NO: 398659 - DNA, 20 bp, human
gacgcgacacgcagaggggg

SEQ ID NO: 398660 - DNA, 20 bp, human
gaacctgagagggtgcgcga

SEQ ID NO: 398661 - DNA, 20 bp, human
gcggggcacgcaagtgacgg

SEQ ID NO: 398662 - DNA, 20 bp, human
gggttagggaagtagaaagg

SEQ ID NO: 398663 - DNA, 20 bp, human
gtagagacagcactcggcgg

SEQ ID NO: 398664 - DNA, 20 bp, human
ggctccctggctggccggtt

SEQ ID NO: 398665 - DNA, 20 bp, human
gtcgcagtgggacggaaatt

SEQ ID NO: 398666 - DNA, 20 bp, human
gggacgtgacgtaagtgtcg

SEQ ID NO: 398667 - DNA, 20 bp, human
gggacagtcgggacttctaa

SEQ ID NO: 398668 - DNA, 20 bp, human
gaggggaagggccctatgat

SEQ ID NO: 398669 - DNA, 20 bp, human
gggaatgtgtcagggacagt

SEQ ID NO: 398670 - DNA, 20 bp, human
gacttctaaagggaggggaa

SEQ ID NO: 398671 - DNA, 20 bp, human
ggcttggagtggaatgtgtc

SEQ ID NO: 398672 - DNA, 20 bp, human
gtcgggacttctaaagggag

SEQ ID NO: 398673 - DNA, 20 bp, human
ggtgatgacgtcacgaccca

SEQ ID NO: 398674 - DNA, 20 bp, human
ggacacgtgacgccagccct

SEQ ID NO: 398675 - DNA, 20 bp, human
ggggttccgtgcatcgggct

SEQ ID NO: 398676 - DNA, 20 bp, human
gagcgctggaggggtctcgt

SEQ ID NO: 398677 - DNA, 20 bp, human
gccgcccgggccacaaccac

SEQ ID NO: 398678 - DNA, 20 bp, human
gccggcgcactagcccagag

SEQ ID NO: 398679 - DNA, 20 bp, human
gcgtgcggcgagcgctggag

SEQ ID NO: 398680 - DNA, 20 bp, human
gtcctcgctggccactcgga

SEQ ID NO: 398681 - DNA, 20 bp, human
gctggccactcggaaggcgg

SEQ ID NO: 398682 - DNA, 20 bp, human
gcggccccgcccccggtaag

SEQ ID NO: 398683 - DNA, 20 bp, human
gggtctcgtgggcgctcccg

SEQ ID NO: 398684 - DNA, 20 bp, human
gtacacagctcgatcttggg

SEQ ID NO: 398685 - DNA, 20 bp, human
ggcaacgtccggcgccccag

SEQ ID NO: 398686 - DNA, 20 bp, human
gagcagggcggctcagattc

SEQ ID NO: 398687 - DNA, 20 bp, human
gccggctccaggatccgctc

SEQ ID NO: 398688 - DNA, 20 bp, human
ggctcctttaagagcgggag

SEQ ID NO: 398689 - DNA, 20 bp, human
ggggcggctcagattccggg

SEQ ID NO: 398690 - DNA, 20 bp, human
ggatcctggggtgctggagg

SEQ ID NO: 398691 - DNA, 20 bp, human
gggtgctggggcgcagagca

SEQ ID NO: 398692 - DNA, 20 bp, human
ggcgcccctcccgctcttaa

SEQ ID NO: 398693 - DNA, 20 bp, human
gcccgctcttaaaggagccg

SEQ ID NO: 398694 - DNA, 20 bp, human
ggggtgggagagtccgtgcc

SEQ ID NO: 398695 - DNA, 20 bp, human
gctgggcgatcctggggtgc

SEQ ID NO: 398696 - DNA, 20 bp, human
gactcgggatggagtagcta

SEQ ID NO: 398697 - DNA, 20 bp, human
gtatgggtccagagtgacga

SEQ ID NO: 398698 - DNA, 20 bp, human
gaggggcgggacttcggctg

SEQ ID NO: 398699 - DNA, 20 bp, human
gagcccatggctactcggga

SEQ ID NO: 398700 - DNA, 20 bp, human
ggggacttcggctgcggaag

SEQ ID NO: 398701 - DNA, 20 bp, human
gggtaagcccatggctactc

SEQ ID NO: 398702 - DNA, 20 bp, human
gactccatcccgagtagcca

SEQ ID NO: 398703 - DNA, 20 bp, human
gcgtctgaggtcgacgccaa

SEQ ID NO: 398704 - DNA, 20 bp, human
gtagagtgcaccgggaggaa

SEQ ID NO: 398705 - DNA, 20 bp, human
gttagaactgctttaggcag

SEQ ID NO: 398706 - DNA, 20 bp, human
gagcctggaaatctcttcta

SEQ ID NO: 398707 - DNA, 20 bp, human
gctaggggacggacctgcta

SEQ ID NO: 398708 - DNA, 20 bp, human
gtcccctagaagagatttcc

SEQ ID NO: 398709 - DNA, 20 bp, human
ggccaattctccaaactcaa

SEQ ID NO: 398710 - DNA, 20 bp, human
gagcagaattccattgagtt

SEQ ID NO: 398711 - DNA, 20 bp, human
gcaatggaattctgctttga

SEQ ID NO: 398712 - DNA, 20 bp, human
gagcagaaatgaaccctagc

SEQ ID NO: 398713 - DNA, 20 bp, human
ggatagtaggaattgctgtg

SEQ ID NO: 398714 - DNA, 20 bp, human
gtaagctatagtattagcaa

SEQ ID NO: 398715 - DNA, 20 bp, human
gtataaatggggatgatagt

SEQ ID NO: 398716 - DNA, 20 bp, human
ggagccgaacagcactcctg

SEQ ID NO: 398717 - DNA, 20 bp, human
gcctgccagggtagttaaaa

SEQ ID NO: 398718 - DNA, 20 bp, human
gtaactaccctggcaggtgg

SEQ ID NO: 398719 - DNA, 20 bp, human
ggaggggcctgtcctgatta

SEQ ID NO: 398720 - DNA, 20 bp, human
gctcccccaggagtgctgtt

SEQ ID NO: 398721 - DNA, 20 bp, human
gactcagcttcctaattcat

SEQ ID NO: 398722 - DNA, 20 bp, human
gggctccattttaactaccc

SEQ ID NO: 398723 - DNA, 20 bp, human
gaaccaggccgccacctgcc

SEQ ID NO: 398724 - DNA, 20 bp, human
gatacccttcactttggaag

SEQ ID NO: 398725 - DNA, 20 bp, human
gtgggtcatgggtttataaa

SEQ ID NO: 398726 - DNA, 20 bp, human
gactcccggaagccgaatcc

SEQ ID NO: 398727 - DNA, 20 bp, human
gccccggggatggaaaaatc

SEQ ID NO: 398728 - DNA, 20 bp, human
gaccaagcctaccccgggga

SEQ ID NO: 398729 - DNA, 20 bp, human
gcggcccaggccgtctcagc

SEQ ID NO: 398730 - DNA, 20 bp, human
gaagccgaatcccggctggg

SEQ ID NO: 398731 - DNA, 20 bp, human
gtggaaaaatccggctgaga

SEQ ID NO: 398732 - DNA, 20 bp, human
ggagacccggccaacagact

SEQ ID NO: 398733 - DNA, 20 bp, human
gcctgggccgctgccacgcg

SEQ ID NO: 398734 - DNA, 20 bp, human
gggggaccaagcctaccccg

SEQ ID NO: 398735 - DNA, 20 bp, human
gcttcctcccagccgggatt

SEQ ID NO: 398736 - DNA, 20 bp, human
gcgagaggcaggactgactg

SEQ ID NO: 398737 - DNA, 20 bp, human
gccttcgccgaggcagggag

SEQ ID NO: 398738 - DNA, 20 bp, human
gcctcggcgaaggcaggggg

SEQ ID NO: 398739 - DNA, 20 bp, human
gtgactggggacgaggaggt

SEQ ID NO: 398740 - DNA, 20 bp, human
gctagggcgagacggacagg

SEQ ID NO: 398741 - DNA, 20 bp, human
ggagcgcagcccagagcggt

SEQ ID NO: 398742 - DNA, 20 bp, human
gggcggagcggggtagaatc

SEQ ID NO: 398743 - DNA, 20 bp, human
gggactgactggggacgagg

SEQ ID NO: 398744 - DNA, 20 bp, human
gtggcgggacgtacattctc

SEQ ID NO: 398745 - DNA, 20 bp, human
gcctgcctcggcgaaggcag

SEQ ID NO: 398746 - DNA, 20 bp, human
gccgagcccgacttccgcca

SEQ ID NO: 398747 - DNA, 20 bp, human
gcgcaggcgcactgagactc

SEQ ID NO: 398748 - DNA, 20 bp, human
ggaagccaatcgagccctgg

SEQ ID NO: 398749 - DNA, 20 bp, human
gacttccgccagggctcgat

SEQ ID NO: 398750 - DNA, 20 bp, human
gtgggccgggagaagtagcc

SEQ ID NO: 398751 - DNA, 20 bp, human
gcctgcgctgtggctagaga

SEQ ID NO: 398752 - DNA, 20 bp, human
ggagaagggagtctggtgac

SEQ ID NO: 398753 - DNA, 20 bp, human
ggcccaaagcccccagtcgg

SEQ ID NO: 398754 - DNA, 20 bp, human
gctggaagccaatcgagccc

SEQ ID NO: 398755 - DNA, 20 bp, human
ggtggggagggtcggagctc

SEQ ID NO: 398756 - DNA, 20 bp, human
gtccccgggtgcaaaggttc

SEQ ID NO: 398757 - DNA, 20 bp, human
gctcccggaacctttgcacc

SEQ ID NO: 398758 - DNA, 20 bp, human
gtctagtctcgaaggaccta

SEQ ID NO: 398759 - DNA, 20 bp, human
gctgtcttccccgggtgcaa

SEQ ID NO: 398760 - DNA, 20 bp, human
ggacggggaggaggcacttc

SEQ ID NO: 398761 - DNA, 20 bp, human
ggggggaactctagtctcga

SEQ ID NO: 398762 - DNA, 20 bp, human
gaatatgtgcccagatgcaa

SEQ ID NO: 398763 - DNA, 20 bp, human
gcatctgggcacatattccg

SEQ ID NO: 398764 - DNA, 20 bp, human
gccccaacctgcactctcgc

SEQ ID NO: 398765 - DNA, 20 bp, human
ggcctgcgagagtgcaggtt

SEQ ID NO: 398766 - DNA, 20 bp, human
gacggattccagtcttacca

SEQ ID NO: 398767 - DNA, 20 bp, human
gggaagaggcggtgcgatct

SEQ ID NO: 398768 - DNA, 20 bp, human
ggtcgcgctgaaacagtttc

SEQ ID NO: 398769 - DNA, 20 bp, human
gaaaggcgcaccggaagttg

SEQ ID NO: 398770 - DNA, 20 bp, human
gctgcgatgccgctggatca

SEQ ID NO: 398771 - DNA, 20 bp, human
gaccatggctgcagcacaag

SEQ ID NO: 398772 - DNA, 20 bp, human
ggaagtggttagagctgaaa

SEQ ID NO: 398773 - DNA, 20 bp, human
gcgaggaagggtcactgctc

SEQ ID NO: 398774 - DNA, 20 bp, human
ggatctaggagaagtgcttc

SEQ ID NO: 398775 - DNA, 20 bp, human
gccgctctctcttccacagg

SEQ ID NO: 398776 - DNA, 20 bp, human
ggggcaacgcagtatcccgg

SEQ ID NO: 398777 - DNA, 20 bp, human
gcctgccggaagtgccggag

SEQ ID NO: 398778 - DNA, 20 bp, human
ggggaactgtgggatcacgg

SEQ ID NO: 398779 - DNA, 20 bp, human
ggggagacacctgacgtgac

SEQ ID NO: 398780 - DNA, 20 bp, human
gtccgggaccggggaactgt

SEQ ID NO: 398781 - DNA, 20 bp, human
gtcagtgcggggcgcgcctt

SEQ ID NO: 398782 - DNA, 20 bp, human
ggcggcgttcctgtcacgtc

SEQ ID NO: 398783 - DNA, 20 bp, human
gcccgggcaacgcagtatcc

SEQ ID NO: 398784 - DNA, 20 bp, human
gcgggtgtccccggccacgg

SEQ ID NO: 398785 - DNA, 20 bp, human
gggaccccgaggttggggta

SEQ ID NO: 398786 - DNA, 20 bp, human
ggcagaagcgctagaggcag

SEQ ID NO: 398787 - DNA, 20 bp, human
ggacacccgggagagacgtg

SEQ ID NO: 398788 - DNA, 20 bp, human
ggagccgcgcggtggattgt

SEQ ID NO: 398789 - DNA, 20 bp, human
gaggccggcgtgcccgtcgc

SEQ ID NO: 398790 - DNA, 20 bp, human
gcgcagccagagttctctcg

SEQ ID NO: 398791 - DNA, 20 bp, human
gagaactgggttgttgcgga

SEQ ID NO: 398792 - DNA, 20 bp, human
gtcccggggaaggcggcagg

SEQ ID NO: 398793 - DNA, 20 bp, human
gcgtgtaggactattagagg

SEQ ID NO: 398794 - DNA, 20 bp, human
gggggagcgcccgccgcctg

SEQ ID NO: 398795 - DNA, 20 bp, human
ggggcggggaatacaccgcg

SEQ ID NO: 398796 - DNA, 20 bp, human
gcggcctagagcatccgcgc

SEQ ID NO: 398797 - DNA, 20 bp, human
gagagcatccgcgcaggagt

SEQ ID NO: 398798 - DNA, 20 bp, human
gtaaagagggtttagagggt

SEQ ID NO: 398799 - DNA, 20 bp, human
gtgcgggtggccaccagcgg

SEQ ID NO: 398800 - DNA, 20 bp, human
gaagagtaaagagggtttag

SEQ ID NO: 398801 - DNA, 20 bp, human
ggggtttagagggtgggact

SEQ ID NO: 398802 - DNA, 20 bp, human
ggccaccagcggcggaagtc

SEQ ID NO: 398803 - DNA, 20 bp, human
ggagaggctgaagagtaaag

SEQ ID NO: 398804 - DNA, 20 bp, human
ggcggaagtcgggcgtttac

SEQ ID NO: 398805 - DNA, 20 bp, human
ggctcgacatcactacctgc

SEQ ID NO: 398806 - DNA, 20 bp, human
gtatctctggccctttaaat

SEQ ID NO: 398807 - DNA, 20 bp, human
gtcaccacgcccctatttaa

SEQ ID NO: 398808 - DNA, 20 bp, human
gggggaagacggcgtatctc

SEQ ID NO: 398809 - DNA, 20 bp, human
gttcccccctacggaaaaaa

SEQ ID NO: 398810 - DNA, 20 bp, human
gaggcgcggaccgcccagga

SEQ ID NO: 398811 - DNA, 20 bp, human
gtgcgtgaggctagagcagt

SEQ ID NO: 398812 - DNA, 20 bp, human
ggaagaggcgcggaccgccc

SEQ ID NO: 398813 - DNA, 20 bp, human
gggggcgtggtgaagaggcg

SEQ ID NO: 398814 - DNA, 20 bp, human
gacccattttttccgtaggg

SEQ ID NO: 398815 - DNA, 20 bp, human
gttttccgtaggggggaaga

SEQ ID NO: 398816 - DNA, 20 bp, human
gcccgccactaacacccgtg

SEQ ID NO: 398817 - DNA, 20 bp, human
gcgggccccacgggtgttag

SEQ ID NO: 398818 - DNA, 20 bp, human
ggggcccgcagtacgcgcgg

SEQ ID NO: 398819 - DNA, 20 bp, human
ggggctggacgggcgaccgg

SEQ ID NO: 398820 - DNA, 20 bp, human
gcggggtctcacgtagagag

SEQ ID NO: 398821 - DNA, 20 bp, human
gggcgggcgggctgcagaaa

SEQ ID NO: 398822 - DNA, 20 bp, human
gcgccagccccgtctcaaga

SEQ ID NO: 398823 - DNA, 20 bp, human
ggccccacgggtgttagtgg

SEQ ID NO: 398824 - DNA, 20 bp, human
ggccccctccgcgcgtactg

SEQ ID NO: 398825 - DNA, 20 bp, human
gtccgtcgcgacaacccacc

SEQ ID NO: 398826 - DNA, 20 bp, human
gggctcggaggcgacgagga

SEQ ID NO: 398827 - DNA, 20 bp, human
ggggagttggagtctcttag

SEQ ID NO: 398828 - DNA, 20 bp, human
ggctcccggcattcccgggg

SEQ ID NO: 398829 - DNA, 20 bp, human
gagcgctcccaaggcatcct

SEQ ID NO: 398830 - DNA, 20 bp, human
gctgtggtccagcgctccca

SEQ ID NO: 398831 - DNA, 20 bp, human
gcacagctcccggcattccc

SEQ ID NO: 398832 - DNA, 20 bp, human
ggggaaggctccatactgca

SEQ ID NO: 398833 - DNA, 20 bp, human
gcccaaggcatcctgggagt

SEQ ID NO: 398834 - DNA, 20 bp, human
gcgggacgagtggtaacgcg

SEQ ID NO: 398835 - DNA, 20 bp, human
gtggagtctcttagcggcaa

SEQ ID NO: 398836 - DNA, 20 bp, human
gggcccgcggagcctcacac

SEQ ID NO: 398837 - DNA, 20 bp, human
ggcgcggctacatggggaat

SEQ ID NO: 398838 - DNA, 20 bp, human
ggcgtggacaggccgctgaa

SEQ ID NO: 398839 - DNA, 20 bp, human
gcgctgaaaggaaccggctg

SEQ ID NO: 398840 - DNA, 20 bp, human
gcagcggcctgtccacgccc

SEQ ID NO: 398841 - DNA, 20 bp, human
ggagagggcgcggctacatg

SEQ ID NO: 398842 - DNA, 20 bp, human
gagaagttaggcaggtccta

SEQ ID NO: 398843 - DNA, 20 bp, human
ggcgtctccggggcgtggac

SEQ ID NO: 398844 - DNA, 20 bp, human
gcgtcggcctcgcagtgcag

SEQ ID NO: 398845 - DNA, 20 bp, human
gacgccccggagacgcccag

SEQ ID NO: 398846 - DNA, 20 bp, human
gcggctagaacggaggggag

SEQ ID NO: 398847 - DNA, 20 bp, human
gccaaagcggctagaacgga

SEQ ID NO: 398848 - DNA, 20 bp, human
gcgttccaaagcggctagaa

SEQ ID NO: 398849 - DNA, 20 bp, human
gcccgccctctgattccaga

SEQ ID NO: 398850 - DNA, 20 bp, human
gaccagaaggcgttccaaag

SEQ ID NO: 398851 - DNA, 20 bp, human
ggaagtaaggggcggagttg

SEQ ID NO: 398852 - DNA, 20 bp, human
gctctgattccagacggaat

SEQ ID NO: 398853 - DNA, 20 bp, human
gcgcgcgcatcctgaatctg

SEQ ID NO: 398854 - DNA, 20 bp, human
ggtgtcagtgtcagaccaat

SEQ ID NO: 398855 - DNA, 20 bp, human
ggtacctctccaccaatcag

SEQ ID NO: 398856 - DNA, 20 bp, human
ggaaagaagtgcaaattcgg

SEQ ID NO: 398857 - DNA, 20 bp, human
ggctgctatcactttaccat

SEQ ID NO: 398858 - DNA, 20 bp, human
gcactttaacacccccagct

SEQ ID NO: 398859 - DNA, 20 bp, human
gcctaggggaagaaagtctg

SEQ ID NO: 398860 - DNA, 20 bp, human
gggtacagagcacttgaggg

SEQ ID NO: 398861 - DNA, 20 bp, human
ggggccttcctggatgggaa

SEQ ID NO: 398862 - DNA, 20 bp, human
gaagggagactgccccatga

SEQ ID NO: 398863 - DNA, 20 bp, human
gctactcacggccccatcat

SEQ ID NO: 398864 - DNA, 20 bp, human
gaaagtggggccttcctgga

SEQ ID NO: 398865 - DNA, 20 bp, human
ggatgaaagaagtgcaaatt

SEQ ID NO: 398866 - DNA, 20 bp, human
gcaagcaaacatgcctcttt

SEQ ID NO: 398867 - DNA, 20 bp, human
gttactaaaacgttgtactt

SEQ ID NO: 398868 - DNA, 20 bp, human
gttgggctgggggatatggt

SEQ ID NO: 398869 - DNA, 20 bp, human
gtctttgaaacacttttcat

SEQ ID NO: 398870 - DNA, 20 bp, human
ggggctcacgggaagggcac

SEQ ID NO: 398871 - DNA, 20 bp, human
gttactgctagttttggtgg

SEQ ID NO: 398872 - DNA, 20 bp, human
gggagatggggctcacggga

SEQ ID NO: 398873 - DNA, 20 bp, human
gtgtcagcttttatttgcat

SEQ ID NO: 398874 - DNA, 20 bp, human
gcacagtagcaaatatatca

SEQ ID NO: 398875 - DNA, 20 bp, human
ggatgcccagcagataagcc

SEQ ID NO: 398876 - DNA, 20 bp, human
ggacagcagtaccgagtcgc

SEQ ID NO: 398877 - DNA, 20 bp, human
gctgcagaacccggaggaag

SEQ ID NO: 398878 - DNA, 20 bp, human
gtaccgagtcgcggggacag

SEQ ID NO: 398879 - DNA, 20 bp, human
ggactcggtactgctgtccc

SEQ ID NO: 398880 - DNA, 20 bp, human
ggtcccgggcggagtggact

SEQ ID NO: 398881 - DNA, 20 bp, human
gcctccgggttctgcagccc

SEQ ID NO: 398882 - DNA, 20 bp, human
ggcgtcctgcggcagctgca

SEQ ID NO: 398883 - DNA, 20 bp, human
gtgagcgtctcgagggattc

SEQ ID NO: 398884 - DNA, 20 bp, human
ggggcggagtggactgggga

SEQ ID NO: 398885 - DNA, 20 bp, human
gggcgcccgccctgcgccca

SEQ ID NO: 398886 - DNA, 20 bp, human
ggcaacagagagccgtggga

SEQ ID NO: 398887 - DNA, 20 bp, human
gagaggtggggctctcggaa

SEQ ID NO: 398888 - DNA, 20 bp, human
gaagctgtggccatcagagg

SEQ ID NO: 398889 - DNA, 20 bp, human
gcagacgagtccaacaggac

SEQ ID NO: 398890 - DNA, 20 bp, human
gacactggggttgaggatct

SEQ ID NO: 398891 - DNA, 20 bp, human
gttctccagcttccccctgg

SEQ ID NO: 398892 - DNA, 20 bp, human
gtggactcgtctgacccggg

SEQ ID NO: 398893 - DNA, 20 bp, human
ggaccagctaatgaagagag

SEQ ID NO: 398894 - DNA, 20 bp, human
gcgggtcagacgagtccaac

SEQ ID NO: 398895 - DNA, 20 bp, human
gggactgcacccatccctcc

SEQ ID NO: 398896 - DNA, 20 bp, human
gggagggcgggtcaccaaga

SEQ ID NO: 398897 - DNA, 20 bp, human
gaggggcggggccagaacga

SEQ ID NO: 398898 - DNA, 20 bp, human
gaggaggagcagcataccgg

SEQ ID NO: 398899 - DNA, 20 bp, human
gcggaggggcggagacacct

SEQ ID NO: 398900 - DNA, 20 bp, human
ggaaaggggcggggccagca

SEQ ID NO: 398901 - DNA, 20 bp, human
gcgggagtaggggaatgcct

SEQ ID NO: 398902 - DNA, 20 bp, human
gtggccccgcctcttatcct

SEQ ID NO: 398903 - DNA, 20 bp, human
ggagcagcataccggtgggt

SEQ ID NO: 398904 - DNA, 20 bp, human
gagaacgagggcggggctag

SEQ ID NO: 398905 - DNA, 20 bp, human
ggcaaggaggagcagcatac

SEQ ID NO: 398906 - DNA, 20 bp, human
gcagagggattgcagaatcg

SEQ ID NO: 398907 - DNA, 20 bp, human
gccggacagcttcagacctt

SEQ ID NO: 398908 - DNA, 20 bp, human
gattgcagaatcggggctgg

SEQ ID NO: 398909 - DNA, 20 bp, human
gtcacagtgaggctccgagg

SEQ ID NO: 398910 - DNA, 20 bp, human
gcggccttgggaaaagcgct

SEQ ID NO: 398911 - DNA, 20 bp, human
ggggaaaagcgctgggcttg

SEQ ID NO: 398912 - DNA, 20 bp, human
gataccccagagctggcaag

SEQ ID NO: 398913 - DNA, 20 bp, human
gggccttctgcagagacgga

SEQ ID NO: 398914 - DNA, 20 bp, human
gaaaagcgctgtggacagga

SEQ ID NO: 398915 - DNA, 20 bp, human
ggcaaggggagtccccacct

SEQ ID NO: 398916 - DNA, 20 bp, human
gaaagaccagaaagccccat

SEQ ID NO: 398917 - DNA, 20 bp, human
gcaagtcaataccctagcag

SEQ ID NO: 398918 - DNA, 20 bp, human
gctccctgggctcaccacaa

SEQ ID NO: 398919 - DNA, 20 bp, human
gactttccttggagccaatg

SEQ ID NO: 398920 - DNA, 20 bp, human
gaacaccgccatactggagt

SEQ ID NO: 398921 - DNA, 20 bp, human
gggaacctccaaccccaagg

SEQ ID NO: 398922 - DNA, 20 bp, human
ggtgggaagactcatcccaa

SEQ ID NO: 398923 - DNA, 20 bp, human
ggcagcctatgcaactggac

SEQ ID NO: 398924 - DNA, 20 bp, human
gacaccctgtccagttgcat

SEQ ID NO: 398925 - DNA, 20 bp, human
gcaatggataaggctgttat

SEQ ID NO: 398926 - DNA, 20 bp, human
gacagggaagagcttgggtg

SEQ ID NO: 398927 - DNA, 20 bp, human
gctgtgccactcttaggaca

SEQ ID NO: 398928 - DNA, 20 bp, human
ggggcctggtccccgccttg

SEQ ID NO: 398929 - DNA, 20 bp, human
gctcttccctgtcctaagag

SEQ ID NO: 398930 - DNA, 20 bp, human
gaagagcttgggtgagggct

SEQ ID NO: 398931 - DNA, 20 bp, human
gtcaccctgaggatgtggcc

SEQ ID NO: 398932 - DNA, 20 bp, human
gggaggaagtgaagtttaac

SEQ ID NO: 398933 - DNA, 20 bp, human
gcccaggaaccctaattagc

SEQ ID NO: 398934 - DNA, 20 bp, human
gtgagggctgggtaatgccc

SEQ ID NO: 398935 - DNA, 20 bp, human
ggccagcgggacttgtaatt

SEQ ID NO: 398936 - DNA, 20 bp, human
gggcgcatgctcagtcggag

SEQ ID NO: 398937 - DNA, 20 bp, human
ggccccagctaggagaactc

SEQ ID NO: 398938 - DNA, 20 bp, human
gaccaaaagccgcctggcga

SEQ ID NO: 398939 - DNA, 20 bp, human
ggagacgtggaatccacccg

SEQ ID NO: 398940 - DNA, 20 bp, human
gtcccgagttctcctagctg

SEQ ID NO: 398941 - DNA, 20 bp, human
gccaggcggcttttggtcac

SEQ ID NO: 398942 - DNA, 20 bp, human
ggcgatggcgcatgctcagt

SEQ ID NO: 398943 - DNA, 20 bp, human
gagcatgcgccatcgccagg

SEQ ID NO: 398944 - DNA, 20 bp, human
gtaccggagcaacccgcacc

SEQ ID NO: 398945 - DNA, 20 bp, human
ggagcaacccgcacctggac

SEQ ID NO: 398946 - DNA, 20 bp, human
ggggaagaagttatcatcga

SEQ ID NO: 398947 - DNA, 20 bp, human
gaggtaggacagagctcggg

SEQ ID NO: 398948 - DNA, 20 bp, human
gcacacacaccggattcatg

SEQ ID NO: 398949 - DNA, 20 bp, human
ggacagagctcgggcgggtg

SEQ ID NO: 398950 - DNA, 20 bp, human
gggcttcttgtttcctgagt

SEQ ID NO: 398951 - DNA, 20 bp, human
gagaaggaaactgcaagagt

SEQ ID NO: 398952 - DNA, 20 bp, human
gtccttctcacaaccgactc

SEQ ID NO: 398953 - DNA, 20 bp, human
ggagctggctagtgggtaca

SEQ ID NO: 398954 - DNA, 20 bp, human
gtcctgagtcggttgtgaga

SEQ ID NO: 398955 - DNA, 20 bp, human
gtacatttacagaaaactct

SEQ ID NO: 398956 - DNA, 20 bp, human
gccagcgcgcacagagttaa

SEQ ID NO: 398957 - DNA, 20 bp, human
gggagccggctcgggaagtg

SEQ ID NO: 398958 - DNA, 20 bp, human
gccggctccgtgtttaggga

SEQ ID NO: 398959 - DNA, 20 bp, human
gcatcatcgcagccattaga

SEQ ID NO: 398960 - DNA, 20 bp, human
gccggcgcgagctcccgggc

SEQ ID NO: 398961 - DNA, 20 bp, human
ggggctcgtcggcgccgctg

SEQ ID NO: 398962 - DNA, 20 bp, human
gggcgggctgaggacttcgc

SEQ ID NO: 398963 - DNA, 20 bp, human
gagatcgctcggtgccgagg

SEQ ID NO: 398964 - DNA, 20 bp, human
ggagccagaaagacacccga

SEQ ID NO: 398965 - DNA, 20 bp, human
gggagcaaaaggttccggga

SEQ ID NO: 398966 - DNA, 20 bp, human
ggggggcgatgcagcggtgg

SEQ ID NO: 398967 - DNA, 20 bp, human
ggcccccgccggttcctccg

SEQ ID NO: 398968 - DNA, 20 bp, human
gccccgccccgcacccgctt

SEQ ID NO: 398969 - DNA, 20 bp, human
gcagcgcagcgcggggagag

SEQ ID NO: 398970 - DNA, 20 bp, human
ggagggcgggggcgatgcag

SEQ ID NO: 398971 - DNA, 20 bp, human
ggggtccggcgtggcggacc

SEQ ID NO: 398972 - DNA, 20 bp, human
gccggagccggagagaggcg

SEQ ID NO: 398973 - DNA, 20 bp, human
gggcgggggcgatgcagcgg

SEQ ID NO: 398974 - DNA, 20 bp, human
gacgccaggtctgcgcgccg

SEQ ID NO: 398975 - DNA, 20 bp, human
ggagctgcagagaggaccga

SEQ ID NO: 398976 - DNA, 20 bp, human
ggggaaccgcgtccctgggg

SEQ ID NO: 398977 - DNA, 20 bp, human
gccgcctccgcactcgggcg

SEQ ID NO: 398978 - DNA, 20 bp, human
gttcccccgcccgagtgcgg

SEQ ID NO: 398979 - DNA, 20 bp, human
gtatcatcaaagttttgccc

SEQ ID NO: 398980 - DNA, 20 bp, human
gctcgggcgggggaaagttg

SEQ ID NO: 398981 - DNA, 20 bp, human
gccgctggacggcatttctg

SEQ ID NO: 398982 - DNA, 20 bp, human
gtgcgggaaccgcgtccctg

SEQ ID NO: 398983 - DNA, 20 bp, human
gtcagagaggggtagacacc

SEQ ID NO: 398984 - DNA, 20 bp, human
gccgccctgccggtaaagtt

SEQ ID NO: 398985 - DNA, 20 bp, human
gggctctctccgccccatcc

SEQ ID NO: 398986 - DNA, 20 bp, human
ggggtcccgaggcccgcacc

SEQ ID NO: 398987 - DNA, 20 bp, human
ggccgcccggcgctgtgacg

SEQ ID NO: 398988 - DNA, 20 bp, human
ggggaaatggggctgttgaa

SEQ ID NO: 398989 - DNA, 20 bp, human
gcggttcgctccaggatctg

SEQ ID NO: 398990 - DNA, 20 bp, human
gctggagcgaaccgatcgcg

SEQ ID NO: 398991 - DNA, 20 bp, human
ggagcgaaccgatcgcgcgg

SEQ ID NO: 398992 - DNA, 20 bp, human
ggcggctcccgcgcccggtg

SEQ ID NO: 398993 - DNA, 20 bp, human
gctctcccgcgtcacagcgc

SEQ ID NO: 398994 - DNA, 20 bp, human
gccgaggcccgcaccgggcg

SEQ ID NO: 398995 - DNA, 20 bp, human
gccttgggccgcctgccacg

SEQ ID NO: 398996 - DNA, 20 bp, human
ggcgcgggagagaattaata

SEQ ID NO: 398997 - DNA, 20 bp, human
gcccccgcccccccatcctt

SEQ ID NO: 398998 - DNA, 20 bp, human
gtcaggacagagctagtcat

SEQ ID NO: 398999 - DNA, 20 bp, human
ggctggggatacaaggatgt

SEQ ID NO: 399000 - DNA, 20 bp, human
gtaaaatgggtgtgaacgga

SEQ ID NO: 399001 - DNA, 20 bp, human
gtgaaccagttcccaaggat

SEQ ID NO: 399002 - DNA, 20 bp, human
gggagagaattaatatggga

SEQ ID NO: 399003 - DNA, 20 bp, human
gccagttcccaaggatgggg

SEQ ID NO: 399004 - DNA, 20 bp, human
gctggttgaaccagttccca

SEQ ID NO: 399005 - DNA, 20 bp, human
ggaatcaataccagtaaaat

SEQ ID NO: 399006 - DNA, 20 bp, human
gacgggcattcaacgcagta

SEQ ID NO: 399007 - DNA, 20 bp, human
gaattggaatgagctcactg

SEQ ID NO: 399008 - DNA, 20 bp, human
gtactccacaaagtagagaa

SEQ ID NO: 399009 - DNA, 20 bp, human
gctgaagtttccatagagtc

SEQ ID NO: 399010 - DNA, 20 bp, human
gcaacccaatagcctaagct

SEQ ID NO: 399011 - DNA, 20 bp, human
gccttccgagcttaggctat

SEQ ID NO: 399012 - DNA, 20 bp, human
gcgttgaatgcccgtgagtc

SEQ ID NO: 399013 - DNA, 20 bp, human
gcttcacacaatgtgggaaa

SEQ ID NO: 399014 - DNA, 20 bp, human
gacgtgcggtccggactcac

SEQ ID NO: 399015 - DNA, 20 bp, human
gaaatcaacacaaatgcctg

SEQ ID NO: 399016 - DNA, 20 bp, human
gtgtgcagagggtgatgtag

SEQ ID NO: 399017 - DNA, 20 bp, human
gtggggctctgggcagattc

SEQ ID NO: 399018 - DNA, 20 bp, human
gggctctgcaggatgcccat

SEQ ID NO: 399019 - DNA, 20 bp, human
gacaaccaggttcaggttca

SEQ ID NO: 399020 - DNA, 20 bp, human
gaccggggccaggagcgatt

SEQ ID NO: 399021 - DNA, 20 bp, human
gaggcaatgtcgaatggcca

SEQ ID NO: 399022 - DNA, 20 bp, human
gcgccgcaggcaatgtcgaa

SEQ ID NO: 399023 - DNA, 20 bp, human
gacagccctgaacctgaacc

SEQ ID NO: 399024 - DNA, 20 bp, human
gtgtctcacttcggcccctg

SEQ ID NO: 399025 - DNA, 20 bp, human
gccgcctggttggataaaag

SEQ ID NO: 399026 - DNA, 20 bp, human
gcccagctgggacaacctca

SEQ ID NO: 399027 - DNA, 20 bp, human
gcaactacggatccccagct

SEQ ID NO: 399028 - DNA, 20 bp, human
gaaaatgctcgggtcttctg

SEQ ID NO: 399029 - DNA, 20 bp, human
gcataagcgccaaaatgctc

SEQ ID NO: 399030 - DNA, 20 bp, human
gccgagagccaagcaccctg

SEQ ID NO: 399031 - DNA, 20 bp, human
gagcgctctctgctggtagg

SEQ ID NO: 399032 - DNA, 20 bp, human
gagcgacgtcaagtcaacta

SEQ ID NO: 399033 - DNA, 20 bp, human
gaccctgaggttgtcccagc

SEQ ID NO: 399034 - DNA, 20 bp, human
ggctaccgcccagacggaag

SEQ ID NO: 399035 - DNA, 20 bp, human
gggcacttccgcttccgtct

SEQ ID NO: 399036 - DNA, 20 bp, human
gggccctgaagcaagggcca

SEQ ID NO: 399037 - DNA, 20 bp, human
gttccctggcccttgcttca

SEQ ID NO: 399038 - DNA, 20 bp, human
gccaaagtcaagacttggaa

SEQ ID NO: 399039 - DNA, 20 bp, human
gccaagtcttgactttggga

SEQ ID NO: 399040 - DNA, 20 bp, human
gactgtggaagggagctgta

SEQ ID NO: 399041 - DNA, 20 bp, human
gggctcaggtatgaggaaac

SEQ ID NO: 399042 - DNA, 20 bp, human
gaaggccaatacacgggagc

SEQ ID NO: 399043 - DNA, 20 bp, human
gtgtagacggctcaggtatg

SEQ ID NO: 399044 - DNA, 20 bp, human
gtggaatagctcaaagtgtc

SEQ ID NO: 399045 - DNA, 20 bp, human
gcggccagccagccaagcca

SEQ ID NO: 399046 - DNA, 20 bp, human
gagcgggagagtcctggcga

SEQ ID NO: 399047 - DNA, 20 bp, human
gactgcgcagggggcctgag

SEQ ID NO: 399048 - DNA, 20 bp, human
gagcctgctcccactctggt

SEQ ID NO: 399049 - DNA, 20 bp, human
ggcgctggccgagaggtgct

SEQ ID NO: 399050 - DNA, 20 bp, human
ggtaacagagactgcgcagg

SEQ ID NO: 399051 - DNA, 20 bp, human
gtccggagggaggtttgagg

SEQ ID NO: 399052 - DNA, 20 bp, human
ggcgacgaacaaccaggaag

SEQ ID NO: 399053 - DNA, 20 bp, human
gtggggggaggcactaattg

SEQ ID NO: 399054 - DNA, 20 bp, human
gacaagcagagagcaaaccc

SEQ ID NO: 399055 - DNA, 20 bp, human
gggccgccccggatatgcga

SEQ ID NO: 399056 - DNA, 20 bp, human
gcggcctaggcgactcctga

SEQ ID NO: 399057 - DNA, 20 bp, human
gcacgccgggggatgtagtt

SEQ ID NO: 399058 - DNA, 20 bp, human
gcgaaagcctgacgagaagt

SEQ ID NO: 399059 - DNA, 20 bp, human
gtcgccgcgcgggctgaacc

SEQ ID NO: 399060 - DNA, 20 bp, human
gcggagcaacgcgcgacccc

SEQ ID NO: 399061 - DNA, 20 bp, human
gactgccgatcgccccggcg

SEQ ID NO: 399062 - DNA, 20 bp, human
gtcagcccgcgcggcgacag

SEQ ID NO: 399063 - DNA, 20 bp, human
gccggggcgatcggcagtcg

SEQ ID NO: 399064 - DNA, 20 bp, human
ggggccccgccggccggcga

SEQ ID NO: 399065 - DNA, 20 bp, human
gaagtgccgggtccgggttg

SEQ ID NO: 399066 - DNA, 20 bp, human
gcgcccaggcccagtgttcc

SEQ ID NO: 399067 - DNA, 20 bp, human
ggcagcaaaggtcacattcc

SEQ ID NO: 399068 - DNA, 20 bp, human
gacactgggcctgggcgagc

SEQ ID NO: 399069 - DNA, 20 bp, human
gggaaggggaattagcaccg

SEQ ID NO: 399070 - DNA, 20 bp, human
gaatcattaggtcatcggaa

SEQ ID NO: 399071 - DNA, 20 bp, human
ggtcacattcctggaacact

SEQ ID NO: 399072 - DNA, 20 bp, human
gggaattagcaccgtggatc

SEQ ID NO: 399073 - DNA, 20 bp, human
gttagcaccgtggatctgga

SEQ ID NO: 399074 - DNA, 20 bp, human
gattcctggaacactgggcc

SEQ ID NO: 399075 - DNA, 20 bp, human
gcccaacaccccatgaagca

SEQ ID NO: 399076 - DNA, 20 bp, human
ggggccacgcgcacagaccc

SEQ ID NO: 399077 - DNA, 20 bp, human
gaggccacgcccacgccctc

SEQ ID NO: 399078 - DNA, 20 bp, human
gcgctcgcgccggagggcgt

SEQ ID NO: 399079 - DNA, 20 bp, human
ggccctccggcgcgagcgga

SEQ ID NO: 399080 - DNA, 20 bp, human
gtgggtgtggccgctcgggg

SEQ ID NO: 399081 - DNA, 20 bp, human
gagcgtgggccgcacagcct

SEQ ID NO: 399082 - DNA, 20 bp, human
gacgcgcacagaccccggag

SEQ ID NO: 399083 - DNA, 20 bp, human
ggtgggcgtggcctcggcgt

SEQ ID NO: 399084 - DNA, 20 bp, human
gcggagaggggtggagagcg

SEQ ID NO: 399085 - DNA, 20 bp, human
gtgcctgcgcgtgcgtgcct

SEQ ID NO: 399086 - DNA, 20 bp, human
gagggcggcacgacccgacc

SEQ ID NO: 399087 - DNA, 20 bp, human
gaggatgatggccaaaaggt

SEQ ID NO: 399088 - DNA, 20 bp, human
gcccaactgcaacaatagga

SEQ ID NO: 399089 - DNA, 20 bp, human
gcgccctccaatcttaagca

SEQ ID NO: 399090 - DNA, 20 bp, human
gcaatcttaagcaaggatga

SEQ ID NO: 399091 - DNA, 20 bp, human
ggctgacggcacagtgttcg

SEQ ID NO: 399092 - DNA, 20 bp, human
ggacccgacccggctgaggt

SEQ ID NO: 399093 - DNA, 20 bp, human
ggctctatgcacctccctgg

SEQ ID NO: 399094 - DNA, 20 bp, human
gtcgcggctgcaccgctcgg

SEQ ID NO: 399095 - DNA, 20 bp, human
gccgtcagctgactcctcca

SEQ ID NO: 399096 - DNA, 20 bp, human
gtccctgccccgagctgcag

SEQ ID NO: 399097 - DNA, 20 bp, human
ggaaaaccttcctcacccca

SEQ ID NO: 399098 - DNA, 20 bp, human
gaacccaagggaatctgaga

SEQ ID NO: 399099 - DNA, 20 bp, human
ggttgataaccacttctccc

SEQ ID NO: 399100 - DNA, 20 bp, human
gctgccacatgtgtcaaagg

SEQ ID NO: 399101 - DNA, 20 bp, human
gaaggccacaggcacgcacc

SEQ ID NO: 399102 - DNA, 20 bp, human
ggcgaagaggtcactgagct

SEQ ID NO: 399103 - DNA, 20 bp, human
gcttcctgtggtaggaacag

SEQ ID NO: 399104 - DNA, 20 bp, human
gcagccctggtgcgtgcctg

SEQ ID NO: 399105 - DNA, 20 bp, human
gcagcacagaactatggttt

SEQ ID NO: 399106 - DNA, 20 bp, human
gctcactggggcgatggctg

SEQ ID NO: 399107 - DNA, 20 bp, human
ggggcgatggctgcggaccg

SEQ ID NO: 399108 - DNA, 20 bp, human
gcacagaccgcgccctcact

SEQ ID NO: 399109 - DNA, 20 bp, human
gccggcgtccggaaccaccc

SEQ ID NO: 399110 - DNA, 20 bp, human
gctgcggaccgtggccaaga

SEQ ID NO: 399111 - DNA, 20 bp, human
gccgaggccgtcaccgagcc

SEQ ID NO: 399112 - DNA, 20 bp, human
gaggccacgctagagggaca

SEQ ID NO: 399113 - DNA, 20 bp, human
gtccgcacctggctcggtga

SEQ ID NO: 399114 - DNA, 20 bp, human
gtagcgtggcctctgtttgg

SEQ ID NO: 399115 - DNA, 20 bp, human
gccaggagccgcgctgtgat

SEQ ID NO: 399116 - DNA, 20 bp, human
ggtagcgactacaagactaa

SEQ ID NO: 399117 - DNA, 20 bp, human
gtaggggaggggcaacttgg

SEQ ID NO: 399118 - DNA, 20 bp, human
gaaagaaccgcccccttcta

SEQ ID NO: 399119 - DNA, 20 bp, human
ggtagtcgctactttataac

SEQ ID NO: 399120 - DNA, 20 bp, human
gataaccggtccctagaagg

SEQ ID NO: 399121 - DNA, 20 bp, human
gaaggaaaagtcttcgactt

SEQ ID NO: 399122 - DNA, 20 bp, human
gcagctgcagtcataatttc

SEQ ID NO: 399123 - DNA, 20 bp, human
gacccatgacaggaagactt

SEQ ID NO: 399124 - DNA, 20 bp, human
gctgtaggggaggggcaact

SEQ ID NO: 399125 - DNA, 20 bp, human
gaccggtccctagaaggggg

SEQ ID NO: 399126 - DNA, 20 bp, human
gcctcagctaatccctgctg

SEQ ID NO: 399127 - DNA, 20 bp, human
gccagggaggagctgcccga

SEQ ID NO: 399128 - DNA, 20 bp, human
gcccgaaggactgttatcac

SEQ ID NO: 399129 - DNA, 20 bp, human
gtctcctgtgctccggagaa

SEQ ID NO: 399130 - DNA, 20 bp, human
gcctgtgctccggagaaggg

SEQ ID NO: 399131 - DNA, 20 bp, human
gattagctgaggctgctaag

SEQ ID NO: 399132 - DNA, 20 bp, human
gcagtgttgaaataccctgg

SEQ ID NO: 399133 - DNA, 20 bp, human
ggcctgtgataacagtcctt

SEQ ID NO: 399134 - DNA, 20 bp, human
gaccagcggtgtgtgcgtat

SEQ ID NO: 399135 - DNA, 20 bp, human
gtgggactctaagggtgaat

SEQ ID NO: 399136 - DNA, 20 bp, human
gtgaccgcccccacccccgg

SEQ ID NO: 399137 - DNA, 20 bp, human
ggaggcccccggccctgcga

SEQ ID NO: 399138 - DNA, 20 bp, human
ggtagggagcggtaacctgg

SEQ ID NO: 399139 - DNA, 20 bp, human
gaggtacgggggtggctgcg

SEQ ID NO: 399140 - DNA, 20 bp, human
gggccggagtggaggggtta

SEQ ID NO: 399141 - DNA, 20 bp, human
gcgggggtggctgcgaggtt

SEQ ID NO: 399142 - DNA, 20 bp, human
gcgggaaggcggaggtttaa

SEQ ID NO: 399143 - DNA, 20 bp, human
gggccgccagctgtcggaag

SEQ ID NO: 399144 - DNA, 20 bp, human
gtggagatggaagatgctcc

SEQ ID NO: 399145 - DNA, 20 bp, human
ggcaggcgtggtggcgagga

SEQ ID NO: 399146 - DNA, 20 bp, human
gctgcagcccccaaggattc

SEQ ID NO: 399147 - DNA, 20 bp, human
gacccccagcggctcaccat

SEQ ID NO: 399148 - DNA, 20 bp, human
gcagaggggtgcgtctatct

SEQ ID NO: 399149 - DNA, 20 bp, human
ggggagtgaggccctggttc

SEQ ID NO: 399150 - DNA, 20 bp, human
ggtgaggccctggttctgga

SEQ ID NO: 399151 - DNA, 20 bp, human
gtgggtgcctgaatccttgg

SEQ ID NO: 399152 - DNA, 20 bp, human
gggagtaagcagcgtgactc

SEQ ID NO: 399153 - DNA, 20 bp, human
gcctctgccctccagaacca

SEQ ID NO: 399154 - DNA, 20 bp, human
ggacgacaagaggattttgt

SEQ ID NO: 399155 - DNA, 20 bp, human
gtcctcttgtcgtctgtggt

SEQ ID NO: 399156 - DNA, 20 bp, human
gaaagagccggcaccgtccc

SEQ ID NO: 399157 - DNA, 20 bp, human
gcctgcatggcccagacggg

SEQ ID NO: 399158 - DNA, 20 bp, human
gtgggatcgcagggaaacgg

SEQ ID NO: 399159 - DNA, 20 bp, human
gggcagtcccgggacggtgc

SEQ ID NO: 399160 - DNA, 20 bp, human
ggcagggaaacggcgggtga

SEQ ID NO: 399161 - DNA, 20 bp, human
gtcggagcacccccgcggtg

SEQ ID NO: 399162 - DNA, 20 bp, human
gcccgcggtgcgggcagtcc

SEQ ID NO: 399163 - DNA, 20 bp, human
gcgggctgagtctactgagc

SEQ ID NO: 399164 - DNA, 20 bp, human
gggccatgcagggccgggta

SEQ ID NO: 399165 - DNA, 20 bp, human
gaaggagtttccggcggact

SEQ ID NO: 399166 - DNA, 20 bp, human
gggttctggctcatcccgga

SEQ ID NO: 399167 - DNA, 20 bp, human
ggcgcggcctctcttcgcga

SEQ ID NO: 399168 - DNA, 20 bp, human
gaaggaaagagcccgagaat

SEQ ID NO: 399169 - DNA, 20 bp, human
gcaaggctcgagagaagttg

SEQ ID NO: 399170 - DNA, 20 bp, human
gtcatcccggagggacgcta

SEQ ID NO: 399171 - DNA, 20 bp, human
ggagagcttcagggtcgccc

SEQ ID NO: 399172 - DNA, 20 bp, human
gcgccccctagcgtccctcc

SEQ ID NO: 399173 - DNA, 20 bp, human
ggattggccatcgcgaagag

SEQ ID NO: 399174 - DNA, 20 bp, human
ggagaggggtggccgcggat

SEQ ID NO: 399175 - DNA, 20 bp, human
gcgagaatggggagagattc

SEQ ID NO: 399176 - DNA, 20 bp, human
gccggccgcagaccctgcca

SEQ ID NO: 399177 - DNA, 20 bp, human
ggcaaagtgaatgactcgac

SEQ ID NO: 399178 - DNA, 20 bp, human
gcggcggtagggcctctccg

SEQ ID NO: 399179 - DNA, 20 bp, human
gctctccgggggcagcgcga

SEQ ID NO: 399180 - DNA, 20 bp, human
ggcagcgcgagggcctcccc

SEQ ID NO: 399181 - DNA, 20 bp, human
ggcgcggacgagtgacaggt

SEQ ID NO: 399182 - DNA, 20 bp, human
ggcaaagggagcgggtgcgg

SEQ ID NO: 399183 - DNA, 20 bp, human
gcagagggggccaattagga

SEQ ID NO: 399184 - DNA, 20 bp, human
ggatgggagcggggagagat

SEQ ID NO: 399185 - DNA, 20 bp, human
gggccgcgcggacgagtgac

SEQ ID NO: 399186 - DNA, 20 bp, human
gcggatgcgcgcattaggag

SEQ ID NO: 399187 - DNA, 20 bp, human
ggggctcagaagccagttgt

SEQ ID NO: 399188 - DNA, 20 bp, human
ggcccatccaagaacgcgtt

SEQ ID NO: 399189 - DNA, 20 bp, human
gtacctaacgcgttcttgga

SEQ ID NO: 399190 - DNA, 20 bp, human
gctgggatttcgacagagct

SEQ ID NO: 399191 - DNA, 20 bp, human
gcacggacagcgccaacaac

SEQ ID NO: 399192 - DNA, 20 bp, human
gtgtatacctaacgcgttct

SEQ ID NO: 399193 - DNA, 20 bp, human
gaagtctttctgccaccaaa

SEQ ID NO: 399194 - DNA, 20 bp, human
gtacagcggatgcgcgcatt

SEQ ID NO: 399195 - DNA, 20 bp, human
gaacaaactgcaggaaaacc

SEQ ID NO: 399196 - DNA, 20 bp, human
ggtctcgggtcccaccgaca

SEQ ID NO: 399197 - DNA, 20 bp, human
ggggcatggcccctgtcggt

SEQ ID NO: 399198 - DNA, 20 bp, human
gaggctgcgcgccccgggca

SEQ ID NO: 399199 - DNA, 20 bp, human
ggagcccggggcttcaaaag

SEQ ID NO: 399200 - DNA, 20 bp, human
gccccgggcatggcccctgt

SEQ ID NO: 399201 - DNA, 20 bp, human
ggaaacagacttcgggaaca

SEQ ID NO: 399202 - DNA, 20 bp, human
gccgggaggaaacagacttc

SEQ ID NO: 399203 - DNA, 20 bp, human
gcctgccccggtttgggagt

SEQ ID NO: 399204 - DNA, 20 bp, human
ggcctggggcagctgcagaa

SEQ ID NO: 399205 - DNA, 20 bp, human
ggactgaaggcgtcagaccg

SEQ ID NO: 399206 - DNA, 20 bp, human
ggcccagcgtgtaccggcag

SEQ ID NO: 399207 - DNA, 20 bp, human
gagccaggagtcaagctaca

SEQ ID NO: 399208 - DNA, 20 bp, human
gagccactgccggtacacgc

SEQ ID NO: 399209 - DNA, 20 bp, human
gcgtctgcagatacaatcat

SEQ ID NO: 399210 - DNA, 20 bp, human
gaacagcaagacgcagcggg

SEQ ID NO: 399211 - DNA, 20 bp, human
gatccctgtagcttgactcc

SEQ ID NO: 399212 - DNA, 20 bp, human
gtagaacagcaagacgcagc

SEQ ID NO: 399213 - DNA, 20 bp, human
gggcagtggctccgccgcct

SEQ ID NO: 399214 - DNA, 20 bp, human
gcgtcttgctgttctaacag

SEQ ID NO: 399215 - DNA, 20 bp, human
gccggtacacgctgggctat

SEQ ID NO: 399216 - DNA, 20 bp, human
gaagaccagggatcaagtgt

SEQ ID NO: 399217 - DNA, 20 bp, human
gagggcaaggcagttaatta

SEQ ID NO: 399218 - DNA, 20 bp, human
gcttcctgatccagcttcca

SEQ ID NO: 399219 - DNA, 20 bp, human
gcacacaggtggggcactct

SEQ ID NO: 399220 - DNA, 20 bp, human
gtgtagggatagggggtgtt

SEQ ID NO: 399221 - DNA, 20 bp, human
gcctggttatcccacacagg

SEQ ID NO: 399222 - DNA, 20 bp, human
gacagcagcaaaattggctc

SEQ ID NO: 399223 - DNA, 20 bp, human
gaagctttgtagagtttgga

SEQ ID NO: 399224 - DNA, 20 bp, human
gaccggatccttcatacctg

SEQ ID NO: 399225 - DNA, 20 bp, human
ggctgtgagctgccacaaca

SEQ ID NO: 399226 - DNA, 20 bp, human
ggggtccggaacaccgccct

SEQ ID NO: 399227 - DNA, 20 bp, human
gagaggacggtggggcgcga

SEQ ID NO: 399228 - DNA, 20 bp, human
gtgctcgaggctgatctcag

SEQ ID NO: 399229 - DNA, 20 bp, human
gccccagaacgcagcttccg

SEQ ID NO: 399230 - DNA, 20 bp, human
ggccagccgaggtttgccga

SEQ ID NO: 399231 - DNA, 20 bp, human
gtccgcccgtggtctcgcca

SEQ ID NO: 399232 - DNA, 20 bp, human
gcggctgcgcgtgcgcccag

SEQ ID NO: 399233 - DNA, 20 bp, human
gccttccggaagaggacggt

SEQ ID NO: 399234 - DNA, 20 bp, human
gggcccggcggaaactgccg

SEQ ID NO: 399235 - DNA, 20 bp, human
ggccctcggcaaacctcggc

SEQ ID NO: 399236 - DNA, 20 bp, human
gaggtcgcgggccgaggacc

SEQ ID NO: 399237 - DNA, 20 bp, human
gtccgcggccgggccaatgg

SEQ ID NO: 399238 - DNA, 20 bp, human
gactgtgggaagcggagtga

SEQ ID NO: 399239 - DNA, 20 bp, human
gtccaggtccgcgaggtcgc

SEQ ID NO: 399240 - DNA, 20 bp, human
gagcggctgttggaggaagg

SEQ ID NO: 399241 - DNA, 20 bp, human
gagcgcaaatggcgttgaga

SEQ ID NO: 399242 - DNA, 20 bp, human
ggtggctgccgagaccggga

SEQ ID NO: 399243 - DNA, 20 bp, human
gggcgggcgccggagcatgc

SEQ ID NO: 399244 - DNA, 20 bp, human
gcctggactacaactcccgt

SEQ ID NO: 399245 - DNA, 20 bp, human
ggcgagcggctgttggagga

SEQ ID NO: 399246 - DNA, 20 bp, human
gagactgtccaatcaggggt

SEQ ID NO: 399247 - DNA, 20 bp, human
gcaggcaacccacccctgat

SEQ ID NO: 399248 - DNA, 20 bp, human
gccaccctgcattcagctaa

SEQ ID NO: 399249 - DNA, 20 bp, human
ggatgagactgtccaatcag

SEQ ID NO: 399250 - DNA, 20 bp, human
gaatggctcgattctcaaga

SEQ ID NO: 399251 - DNA, 20 bp, human
ggggtggggaggttatttgg

SEQ ID NO: 399252 - DNA, 20 bp, human
gcacactgacgctgagggtg

SEQ ID NO: 399253 - DNA, 20 bp, human
ggtggggaacgggaagaggg

SEQ ID NO: 399254 - DNA, 20 bp, human
gagagggtggggaggttatt

SEQ ID NO: 399255 - DNA, 20 bp, human
gggtctcaacctggcccccc

SEQ ID NO: 399256 - DNA, 20 bp, human
ggcgcagcgcagccgctatc

SEQ ID NO: 399257 - DNA, 20 bp, human
gcagcgcagccgctatcggg

SEQ ID NO: 399258 - DNA, 20 bp, human
gactgcagtccgcccgatag

SEQ ID NO: 399259 - DNA, 20 bp, human
gactgcagttcttgccgagc

SEQ ID NO: 399260 - DNA, 20 bp, human
gggagtcgcgagactgggat

SEQ ID NO: 399261 - DNA, 20 bp, human
gaagcaggagtcgcgagact

SEQ ID NO: 399262 - DNA, 20 bp, human
gtgcttgctgggcgcggctt

SEQ ID NO: 399263 - DNA, 20 bp, human
ggactcctgcttgctgggcg

SEQ ID NO: 399264 - DNA, 20 bp, human
gcagttcttgccgagcaggt

SEQ ID NO: 399265 - DNA, 20 bp, human
gtggaaggagaatttccttg

SEQ ID NO: 399266 - DNA, 20 bp, human
ggggcccatctccttctgac

SEQ ID NO: 399267 - DNA, 20 bp, human
gcctccaggggccccttggt

SEQ ID NO: 399268 - DNA, 20 bp, human
gtgggcctggcctcctcgtt

SEQ ID NO: 399269 - DNA, 20 bp, human
gggccccagagagtaagaaa

SEQ ID NO: 399270 - DNA, 20 bp, human
ggggccctccgccatcagat

SEQ ID NO: 399271 - DNA, 20 bp, human
gggtctaagcagtcaagtgg

SEQ ID NO: 399272 - DNA, 20 bp, human
ggtgggtctaagcagtcaag

SEQ ID NO: 399273 - DNA, 20 bp, human
gtaagcagtcaagtggagga

SEQ ID NO: 399274 - DNA, 20 bp, human
ggaggagggttccaatctga

SEQ ID NO: 399275 - DNA, 20 bp, human
gggacccaagctgatccaaa

SEQ ID NO: 399276 - DNA, 20 bp, human
ggggacccgcgccagaagca

SEQ ID NO: 399277 - DNA, 20 bp, human
gcgagcttcggccccactaa

SEQ ID NO: 399278 - DNA, 20 bp, human
ggaatggaacatccattcgg

SEQ ID NO: 399279 - DNA, 20 bp, human
gaagcgcgagagggcacaat

SEQ ID NO: 399280 - DNA, 20 bp, human
gccacagaacctcaggaaag

SEQ ID NO: 399281 - DNA, 20 bp, human
gtggccaggaatagctcctg

SEQ ID NO: 399282 - DNA, 20 bp, human
gcctcccccaaactgaggat

SEQ ID NO: 399283 - DNA, 20 bp, human
gcattcgggggcggggtcaa

SEQ ID NO: 399284 - DNA, 20 bp, human
gtcgggggcggggtcaaagg

SEQ ID NO: 399285 - DNA, 20 bp, human
gacccgcgccagaagcaggg

SEQ ID NO: 399286 - DNA, 20 bp, human
gcccgggtggagctctgggg

SEQ ID NO: 399287 - DNA, 20 bp, human
gacgcaaaagacgtactcac

SEQ ID NO: 399288 - DNA, 20 bp, human
ggcggggaatcgcgtaatgg

SEQ ID NO: 399289 - DNA, 20 bp, human
gagggcggggaatcgcgtaa

SEQ ID NO: 399290 - DNA, 20 bp, human
gccgcaatcggagtaaacag

SEQ ID NO: 399291 - DNA, 20 bp, human
gtcagccagggcagaaagta

SEQ ID NO: 399292 - DNA, 20 bp, human
gagtcgcccgggtggagctc

SEQ ID NO: 399293 - DNA, 20 bp, human
ggacacaggcagggcgagcg

SEQ ID NO: 399294 - DNA, 20 bp, human
gggtgcaaaccaagtgaagt

SEQ ID NO: 399295 - DNA, 20 bp, human
ggggcttcggggcattccat

SEQ ID NO: 399296 - DNA, 20 bp, human
ggagcgacggtgccgagggg

SEQ ID NO: 399297 - DNA, 20 bp, human
ggcgctcgccggctccctat

SEQ ID NO: 399298 - DNA, 20 bp, human
ggtgccggctccaccaacca

SEQ ID NO: 399299 - DNA, 20 bp, human
gcggccccgtgagttggccc

SEQ ID NO: 399300 - DNA, 20 bp, human
gccaaccagggccaactcac

SEQ ID NO: 399301 - DNA, 20 bp, human
ggcctcggccaatagggagc

SEQ ID NO: 399302 - DNA, 20 bp, human
ggtgaagcggccccgtgagt

SEQ ID NO: 399303 - DNA, 20 bp, human
ggaggggcgggggattgcgg

SEQ ID NO: 399304 - DNA, 20 bp, human
ggggcgggggattgcggagg

SEQ ID NO: 399305 - DNA, 20 bp, human
gctcgccaatcctggtgaag

SEQ ID NO: 399306 - DNA, 20 bp, human
gggcgagaccacaggacgga

SEQ ID NO: 399307 - DNA, 20 bp, human
gggagcgcgccggaaacgcg

SEQ ID NO: 399308 - DNA, 20 bp, human
gaggcccgccgccgagtggg

SEQ ID NO: 399309 - DNA, 20 bp, human
ggagaaacccccccactcgg

SEQ ID NO: 399310 - DNA, 20 bp, human
gccgcgcctcggccggaagg

SEQ ID NO: 399311 - DNA, 20 bp, human
gggcgggcgagaccacagga

SEQ ID NO: 399312 - DNA, 20 bp, human
ggcggagctaagtggaatcc

SEQ ID NO: 399313 - DNA, 20 bp, human
ggcggccgcacaatccaaca

SEQ ID NO: 399314 - DNA, 20 bp, human
gcggaccgcgcggagctaag

SEQ ID NO: 399315 - DNA, 20 bp, human
gaaacccccccactcggcgg

SEQ ID NO: 399316 - DNA, 20 bp, human
gcttcggggcggctgttcgt

SEQ ID NO: 399317 - DNA, 20 bp, human
gtaggtgaaggttcgaccca

SEQ ID NO: 399318 - DNA, 20 bp, human
gacagacaaagagtaggtga

SEQ ID NO: 399319 - DNA, 20 bp, human
gtcttccagccgggattacc

SEQ ID NO: 399320 - DNA, 20 bp, human
gccacggccctgactgacag

SEQ ID NO: 399321 - DNA, 20 bp, human
gctcttgttgtctgggtgag

SEQ ID NO: 399322 - DNA, 20 bp, human
gcacgccaggtaatcccggc

SEQ ID NO: 399323 - DNA, 20 bp, human
gcagcggcaaccttgctctt

SEQ ID NO: 399324 - DNA, 20 bp, human
ggaagcacgccaggtaatcc

SEQ ID NO: 399325 - DNA, 20 bp, human
ggctgctgtggattggtcac

SEQ ID NO: 399326 - DNA, 20 bp, human
gtactcaattggttggttgt

SEQ ID NO: 399327 - DNA, 20 bp, human
ggtactagatgagcgcaatg

SEQ ID NO: 399328 - DNA, 20 bp, human
gctaagagaaggcgggacag

SEQ ID NO: 399329 - DNA, 20 bp, human
gaagatagctgctaactgag

SEQ ID NO: 399330 - DNA, 20 bp, human
gtagatgagcgcaatgaggc

SEQ ID NO: 399331 - DNA, 20 bp, human
gtcggacggctcaacgtacc

SEQ ID NO: 399332 - DNA, 20 bp, human
gacgttgagccgtccgagaa

SEQ ID NO: 399333 - DNA, 20 bp, human
gaagcggcgctaagagaagg

SEQ ID NO: 399334 - DNA, 20 bp, human
ggtcaagcggcgctaagaga

SEQ ID NO: 399335 - DNA, 20 bp, human
gaattcttgggtattctcta

SEQ ID NO: 399336 - DNA, 20 bp, human
gctgggctgaaaagtgggaa

SEQ ID NO: 399337 - DNA, 20 bp, human
gcctcgctgggctgaaaagt

SEQ ID NO: 399338 - DNA, 20 bp, human
ggattggaccctccactaca

SEQ ID NO: 399339 - DNA, 20 bp, human
gcatggagaagtagtatgat

SEQ ID NO: 399340 - DNA, 20 bp, human
gtctgggtaccatgtagtgg

SEQ ID NO: 399341 - DNA, 20 bp, human
gcagcaagagtgacatctcc

SEQ ID NO: 399342 - DNA, 20 bp, human
gtgtttaaaattattggcag

SEQ ID NO: 399343 - DNA, 20 bp, human
gatttctgggtaccatgtag

SEQ ID NO: 399344 - DNA, 20 bp, human
gccagatatacaagtcttaa

SEQ ID NO: 399345 - DNA, 20 bp, human
gtgatgacaataaagctaaa

SEQ ID NO: 399346 - DNA, 20 bp, human
ggcagccaataaaaagtagg

SEQ ID NO: 399347 - DNA, 20 bp, human
gcgcagcattcaagatggtc

SEQ ID NO: 399348 - DNA, 20 bp, human
gagtctctcgcgtgtctggg

SEQ ID NO: 399349 - DNA, 20 bp, human
ggtggagcagagccggaagc

SEQ ID NO: 399350 - DNA, 20 bp, human
gccgccactctctgcgggtt

SEQ ID NO: 399351 - DNA, 20 bp, human
gaagcagcttcataaggggg

SEQ ID NO: 399352 - DNA, 20 bp, human
gcgtcccaacccgcagagag

SEQ ID NO: 399353 - DNA, 20 bp, human
ggcggaagcagcttcataag

SEQ ID NO: 399354 - DNA, 20 bp, human
gctgcttccgccactctctg

SEQ ID NO: 399355 - DNA, 20 bp, human
gtgcatcgcttcgtcttcag

SEQ ID NO: 399356 - DNA, 20 bp, human
gaatcaaagctcgagtgcgg

SEQ ID NO: 399357 - DNA, 20 bp, human
gcctcggcctgtccctatgc

SEQ ID NO: 399358 - DNA, 20 bp, human
gggcaacgcccccgcagcct

SEQ ID NO: 399359 - DNA, 20 bp, human
gaccacgtgacgttcgggtc

SEQ ID NO: 399360 - DNA, 20 bp, human
gcggcctgtccctatgctgg

SEQ ID NO: 399361 - DNA, 20 bp, human
gaaagctcgagtgcggaggc

SEQ ID NO: 399362 - DNA, 20 bp, human
gcaattcaggcctatgatcc

SEQ ID NO: 399363 - DNA, 20 bp, human
gttgtagtctcctggatcat

SEQ ID NO: 399364 - DNA, 20 bp, human
gacgttcgggtcaggtgttt

SEQ ID NO: 399365 - DNA, 20 bp, human
gagggacaggccgaggctgc

SEQ ID NO: 399366 - DNA, 20 bp, human
gtagaggcccccgccgagaa

SEQ ID NO: 399367 - DNA, 20 bp, human
ggtggggcgcggttctgaag

SEQ ID NO: 399368 - DNA, 20 bp, human
ggagaccgggtcacgtggtg

SEQ ID NO: 399369 - DNA, 20 bp, human
gcggggcggagtcagggtag

SEQ ID NO: 399370 - DNA, 20 bp, human
gacgtggtggggcagtgccc

SEQ ID NO: 399371 - DNA, 20 bp, human
ggggcggagattatgacgta

SEQ ID NO: 399372 - DNA, 20 bp, human
ggcgctcgagccaattctca

SEQ ID NO: 399373 - DNA, 20 bp, human
gtaaaggcagggggctaagg

SEQ ID NO: 399374 - DNA, 20 bp, human
gaacccaagtccatacctaa

SEQ ID NO: 399375 - DNA, 20 bp, human
gttatgacgtaaggaggagg

SEQ ID NO: 399376 - DNA, 20 bp, human
gaggtggggtcggtataaag

SEQ ID NO: 399377 - DNA, 20 bp, human
gctcccggctccaaagaggt

SEQ ID NO: 399378 - DNA, 20 bp, human
gggaaggggtaaaagcgcga

SEQ ID NO: 399379 - DNA, 20 bp, human
gggtactcccggctccaaag

SEQ ID NO: 399380 - DNA, 20 bp, human
gacgcccacgcgctcggatg

SEQ ID NO: 399381 - DNA, 20 bp, human
gcgagcgcgtgggcgtcgta

SEQ ID NO: 399382 - DNA, 20 bp, human
gagccagcgagcctagaagg

SEQ ID NO: 399383 - DNA, 20 bp, human
gggagtaccgcccctgtagg

SEQ ID NO: 399384 - DNA, 20 bp, human
gcgtgggcgtcgtaggggag

SEQ ID NO: 399385 - DNA, 20 bp, human
gataaaggggttgaggtcac

SEQ ID NO: 399386 - DNA, 20 bp, human
gggccaaatgtataagtggg

SEQ ID NO: 399387 - DNA, 20 bp, human
gacagggccaaatgtataag

SEQ ID NO: 399388 - DNA, 20 bp, human
gctgatggaggagttatcct

SEQ ID NO: 399389 - DNA, 20 bp, human
gtccactcccaccaaaagcg

SEQ ID NO: 399390 - DNA, 20 bp, human
gctagaggagggacgactga

SEQ ID NO: 399391 - DNA, 20 bp, human
gcgccccccacttatacatt

SEQ ID NO: 399392 - DNA, 20 bp, human
gcttctgccgcgcttttggt

SEQ ID NO: 399393 - DNA, 20 bp, human
gtcagtagctccagaaaaag

SEQ ID NO: 399394 - DNA, 20 bp, human
gtctacgtcaccagtgagct

SEQ ID NO: 399395 - DNA, 20 bp, human
ggactctgattactagggag

SEQ ID NO: 399396 - DNA, 20 bp, human
ggacggcagcccaaggctca

SEQ ID NO: 399397 - DNA, 20 bp, human
ggtggcgtggcgatggtgag

SEQ ID NO: 399398 - DNA, 20 bp, human
gtgtcgcggggcaatagcaa

SEQ ID NO: 399399 - DNA, 20 bp, human
gaggacacgcagtttcgcta

SEQ ID NO: 399400 - DNA, 20 bp, human
gggacggcctggggcggcgt

SEQ ID NO: 399401 - DNA, 20 bp, human
gcggggttaggggcgggatt

SEQ ID NO: 399402 - DNA, 20 bp, human
ggagcagaccggagcggaga

SEQ ID NO: 399403 - DNA, 20 bp, human
gacctgggcaggggatgcga

SEQ ID NO: 399404 - DNA, 20 bp, human
gtcccctcaaacctatcgac

SEQ ID NO: 399405 - DNA, 20 bp, human
ggctgcagccgtctccgctc

SEQ ID NO: 399406 - DNA, 20 bp, human
gaaccggggagctgtgcgct

SEQ ID NO: 399407 - DNA, 20 bp, human
gcgcacgagtcggcgaaccg

SEQ ID NO: 399408 - DNA, 20 bp, human
gacagggtggcgaagagcgg

SEQ ID NO: 399409 - DNA, 20 bp, human
gcggccgccgacagcctctc

SEQ ID NO: 399410 - DNA, 20 bp, human
ggaacgaacccgcccgctca

SEQ ID NO: 399411 - DNA, 20 bp, human
gggtgcgcgcgcgcacgagt

SEQ ID NO: 399412 - DNA, 20 bp, human
ggggacagggtggcgaagag

SEQ ID NO: 399413 - DNA, 20 bp, human
gtgccgagcgcacagctccc

SEQ ID NO: 399414 - DNA, 20 bp, human
gtgcccgcgacgttttggga

SEQ ID NO: 399415 - DNA, 20 bp, human
gcgacagcctctcggggaca

SEQ ID NO: 399416 - DNA, 20 bp, human
gaccaaccgactcctctcat

SEQ ID NO: 399417 - DNA, 20 bp, human
ggggcctgcagcaacctcca

SEQ ID NO: 399418 - DNA, 20 bp, human
gctgtggccagtcacgtaaa

SEQ ID NO: 399419 - DNA, 20 bp, human
gcaacatggcagccatgcgc

SEQ ID NO: 399420 - DNA, 20 bp, human
gaccggccaatgagaggagt

SEQ ID NO: 399421 - DNA, 20 bp, human
gtggccagtcacgtaaaggg

SEQ ID NO: 399422 - DNA, 20 bp, human
ggggctgatgacataaaaac

SEQ ID NO: 399423 - DNA, 20 bp, human
gagtcctcgctcctaggccc

SEQ ID NO: 399424 - DNA, 20 bp, human
ggccaatgagaggagtcggt

SEQ ID NO: 399425 - DNA, 20 bp, human
gagagaaaccggccaatgag

SEQ ID NO: 399426 - DNA, 20 bp, human
gccgccagccaatgagctca

SEQ ID NO: 399427 - DNA, 20 bp, human
gctccagccttggtagagca

SEQ ID NO: 399428 - DNA, 20 bp, human
gccacaagccttgagctcat

SEQ ID NO: 399429 - DNA, 20 bp, human
gcgcagtccctgctctacca

SEQ ID NO: 399430 - DNA, 20 bp, human
ggccagtcaaaggaaggcgc

SEQ ID NO: 399431 - DNA, 20 bp, human
gaaaatagccagtcaaagga

SEQ ID NO: 399432 - DNA, 20 bp, human
ggtggccagggtcgcaacac

SEQ ID NO: 399433 - DNA, 20 bp, human
gaccgcctgcccgcaatgat

SEQ ID NO: 399434 - DNA, 20 bp, human
gaaaaccaatcattgcgggc

SEQ ID NO: 399435 - DNA, 20 bp, human
ggggtttaggggcttctcgg

SEQ ID NO: 399436 - DNA, 20 bp, human
gtctgagcccaacacggcca

SEQ ID NO: 399437 - DNA, 20 bp, human
gtccacgtctgagcccaaca

SEQ ID NO: 399438 - DNA, 20 bp, human
gagacctccttggccgtgtt

SEQ ID NO: 399439 - DNA, 20 bp, human
gctggggaaatccgacccga

SEQ ID NO: 399440 - DNA, 20 bp, human
ggccgtgttgggctcagacg

SEQ ID NO: 399441 - DNA, 20 bp, human
gtgggctcagacgtggactg

SEQ ID NO: 399442 - DNA, 20 bp, human
ggagcccaacacggccaagg

SEQ ID NO: 399443 - DNA, 20 bp, human
gacgtggactgaggtttcag

SEQ ID NO: 399444 - DNA, 20 bp, human
gcaagtgccgcctaggaacg

SEQ ID NO: 399445 - DNA, 20 bp, human
gttcagaggaagcagtggag

SEQ ID NO: 399446 - DNA, 20 bp, human
ggtgcggcggcagcactcgg

SEQ ID NO: 399447 - DNA, 20 bp, human
gcgcgcaagctgaaagtctg

SEQ ID NO: 399448 - DNA, 20 bp, human
gcgcccaggcgtcagctgat

SEQ ID NO: 399449 - DNA, 20 bp, human
gcatccccaggcaatacggg

SEQ ID NO: 399450 - DNA, 20 bp, human
gcggagaaatggggaaagta

SEQ ID NO: 399451 - DNA, 20 bp, human
gcggcatccccaggcaatac

SEQ ID NO: 399452 - DNA, 20 bp, human
gcgcaccgcccgtattgcct

SEQ ID NO: 399453 - DNA, 20 bp, human
gggggcgcctgcggagaaat

SEQ ID NO: 399454 - DNA, 20 bp, human
gagcactcgggggcttacgg

SEQ ID NO: 399455 - DNA, 20 bp, human
ggcggtgcggcggcagcact

SEQ ID NO: 399456 - DNA, 20 bp, human
ggcgcccggggagtcgcgga

SEQ ID NO: 399457 - DNA, 20 bp, human
gagggaggagcctaaccctt

SEQ ID NO: 399458 - DNA, 20 bp, human
gcctaacccttgggtgtgta

SEQ ID NO: 399459 - DNA, 20 bp, human
gctggcaagcgcgtccccag

SEQ ID NO: 399460 - DNA, 20 bp, human
gtagccgctggtgggcgcga

SEQ ID NO: 399461 - DNA, 20 bp, human
ggggactgacgcacgcgcat

SEQ ID NO: 399462 - DNA, 20 bp, human
gacttccgggagggtggtga

SEQ ID NO: 399463 - DNA, 20 bp, human
gaggcagagagaagaccgcg

SEQ ID NO: 399464 - DNA, 20 bp, human
ggttcacgggaggttaaaga

SEQ ID NO: 399465 - DNA, 20 bp, human
gctctgccttacacacccaa

SEQ ID NO: 399466 - DNA, 20 bp, human
ggggaagaggcgcgtctgga

SEQ ID NO: 399467 - DNA, 20 bp, human
gtgagcggctgcaatttctg

SEQ ID NO: 399468 - DNA, 20 bp, human
gggcaagagcgggaagccga

SEQ ID NO: 399469 - DNA, 20 bp, human
ggagcgggaagccgagggaa

SEQ ID NO: 399470 - DNA, 20 bp, human
gtccagctgggagcatccag

SEQ ID NO: 399471 - DNA, 20 bp, human
gggcggggaagaggcgcgtc

SEQ ID NO: 399472 - DNA, 20 bp, human
ggtggggttgaagtccagct

SEQ ID NO: 399473 - DNA, 20 bp, human
gggcgcgtctggaaggcagt

SEQ ID NO: 399474 - DNA, 20 bp, human
gagcgccgcggagaggggca

SEQ ID NO: 399475 - DNA, 20 bp, human
ggcggcgctgtctgcagaca

SEQ ID NO: 399476 - DNA, 20 bp, human
gtggtcaagcggtgctggtt

SEQ ID NO: 399477 - DNA, 20 bp, human
gtctgcagcaaggccccttg

SEQ ID NO: 399478 - DNA, 20 bp, human
gcagcaccgcttgaccacgg

SEQ ID NO: 399479 - DNA, 20 bp, human
gcaacccatgccatgtccag

SEQ ID NO: 399480 - DNA, 20 bp, human
gaatccagacctactcttct

SEQ ID NO: 399481 - DNA, 20 bp, human
gccgtggtcggctggagagt

SEQ ID NO: 399482 - DNA, 20 bp, human
gactccagcagctccgtggt

SEQ ID NO: 399483 - DNA, 20 bp, human
ggagttctggcgggtgactt

SEQ ID NO: 399484 - DNA, 20 bp, human
gagcccagccctagaagagt

SEQ ID NO: 399485 - DNA, 20 bp, human
gcacggagctgctggagttc

SEQ ID NO: 399486 - DNA, 20 bp, human
gagggagctgaacacggaag

SEQ ID NO: 399487 - DNA, 20 bp, human
gttgcccgggcaaatcaggg

SEQ ID NO: 399488 - DNA, 20 bp, human
gcgggcaaatcagggaggaa

SEQ ID NO: 399489 - DNA, 20 bp, human
gcaaccggctaatttccacg

SEQ ID NO: 399490 - DNA, 20 bp, human
gcctccgcgtggaaattagc

SEQ ID NO: 399491 - DNA, 20 bp, human
gcggttgcccgggcaaatca

SEQ ID NO: 399492 - DNA, 20 bp, human
gccagcgcaggtcccgacag

SEQ ID NO: 399493 - DNA, 20 bp, human
gaggtcccgacagaggtcgc

SEQ ID NO: 399494 - DNA, 20 bp, human
gaccacccggcgacctctgt

SEQ ID NO: 399495 - DNA, 20 bp, human
ggagctgaacacggaagtgg

SEQ ID NO: 399496 - DNA, 20 bp, human
gtgacactctggaggggcgg

SEQ ID NO: 399497 - DNA, 20 bp, human
ggacgaccggacagcttctc

SEQ ID NO: 399498 - DNA, 20 bp, human
gcagtctcagtcacgcgcgt

SEQ ID NO: 399499 - DNA, 20 bp, human
gctcccatgagggtaaacgt

SEQ ID NO: 399500 - DNA, 20 bp, human
gcgagcgtgtcgctccctct

SEQ ID NO: 399501 - DNA, 20 bp, human
ggattgcaaagtagtccctg

SEQ ID NO: 399502 - DNA, 20 bp, human
gcacgctcgcttggtctctt

SEQ ID NO: 399503 - DNA, 20 bp, human
gcgtgtgtaactctagggag

SEQ ID NO: 399504 - DNA, 20 bp, human
gcctgaggaaactgtggcgg

SEQ ID NO: 399505 - DNA, 20 bp, human
ggcgggggaattgataagtt

SEQ ID NO: 399506 - DNA, 20 bp, human
ggccctgcgcgctgtggttg

SEQ ID NO: 399507 - DNA, 20 bp, human
gccgcgggcccttgaaaagg

SEQ ID NO: 399508 - DNA, 20 bp, human
gaatgcttctgggagtcggg

SEQ ID NO: 399509 - DNA, 20 bp, human
gagtcaagcgctcggctcgg

SEQ ID NO: 399510 - DNA, 20 bp, human
ggaccgcgcttccgggttcg

SEQ ID NO: 399511 - DNA, 20 bp, human
gaggtccgcgcaggctcgcc

SEQ ID NO: 399512 - DNA, 20 bp, human
gtcccagaagcattctgacg

SEQ ID NO: 399513 - DNA, 20 bp, human
ggcgcctgccctgcgcgctg

SEQ ID NO: 399514 - DNA, 20 bp, human
ggagtggagtgggcggtccg

SEQ ID NO: 399515 - DNA, 20 bp, human
gccgagcgcttgactatata

SEQ ID NO: 399516 - DNA, 20 bp, human
ggggccacccggactctgtt

SEQ ID NO: 399517 - DNA, 20 bp, human
ggggcgatggaatccgggag

SEQ ID NO: 399518 - DNA, 20 bp, human
gctgacccgcaaccaggaag

SEQ ID NO: 399519 - DNA, 20 bp, human
gtcggcgcgcaccctcacgg

SEQ ID NO: 399520 - DNA, 20 bp, human
gagcacaaccgcctaagcgg

SEQ ID NO: 399521 - DNA, 20 bp, human
gtgaaggcaacggaacctgg

SEQ ID NO: 399522 - DNA, 20 bp, human
gaactgaaggcaacggaacc

SEQ ID NO: 399523 - DNA, 20 bp, human
gggcggaactctggagagtg

SEQ ID NO: 399524 - DNA, 20 bp, human
ggtgcggaacctaggatcct

SEQ ID NO: 399525 - DNA, 20 bp, human
gcaacggaacctgggggcga

SEQ ID NO: 399526 - DNA, 20 bp, human
gtgagagaggaaacggtcga

SEQ ID NO: 399527 - DNA, 20 bp, human
gatagtggtcctactgtcgt

SEQ ID NO: 399528 - DNA, 20 bp, human
gggtctgggcgtctgtagaa

SEQ ID NO: 399529 - DNA, 20 bp, human
ggagaggaaacggtcgacgg

SEQ ID NO: 399530 - DNA, 20 bp, human
gattacgggcccacacgtat

SEQ ID NO: 399531 - DNA, 20 bp, human
gtgctctgcgcgctcccggt

SEQ ID NO: 399532 - DNA, 20 bp, human
gagagcagtcccacgacagt

SEQ ID NO: 399533 - DNA, 20 bp, human
gtgtgggcccgtaatcgatt

SEQ ID NO: 399534 - DNA, 20 bp, human
ggcagaggaaatttgatatc

SEQ ID NO: 399535 - DNA, 20 bp, human
gggagaccagcataatgcgc

SEQ ID NO: 399536 - DNA, 20 bp, human
gtccaagggacatagcgtca

SEQ ID NO: 399537 - DNA, 20 bp, human
ggcttcaagcccaaggacgg

SEQ ID NO: 399538 - DNA, 20 bp, human
gagactcccacgccctggga

SEQ ID NO: 399539 - DNA, 20 bp, human
ggggtggagcctccgtcctt

SEQ ID NO: 399540 - DNA, 20 bp, human
gagggcggcggggacaagat

SEQ ID NO: 399541 - DNA, 20 bp, human
ggccctgagaccactgtcgc

SEQ ID NO: 399542 - DNA, 20 bp, human
ggagcccagagcgaatcgat

SEQ ID NO: 399543 - DNA, 20 bp, human
gcaggcgcattgagggacat

SEQ ID NO: 399544 - DNA, 20 bp, human
gtatacaaggataatgtcca

SEQ ID NO: 399545 - DNA, 20 bp, human
gacgagtgggtagaagtcaa

SEQ ID NO: 399546 - DNA, 20 bp, human
gaatgaaggggtatggggac

SEQ ID NO: 399547 - DNA, 20 bp, human
gagtcacagactctacacaa

SEQ ID NO: 399548 - DNA, 20 bp, human
gaactcgaactcggcaggct

SEQ ID NO: 399549 - DNA, 20 bp, human
gttggaaatgaaggggtatg

SEQ ID NO: 399550 - DNA, 20 bp, human
gcagactctacacaagggga

SEQ ID NO: 399551 - DNA, 20 bp, human
ggcaggctgggtttctgcgc

SEQ ID NO: 399552 - DNA, 20 bp, human
ggcgtacaggactgatagga

SEQ ID NO: 399553 - DNA, 20 bp, human
gatgctaatgaactcgaact

SEQ ID NO: 399554 - DNA, 20 bp, human
gcagcgtcttctggtcgtta

SEQ ID NO: 399555 - DNA, 20 bp, human
gtaatgaactcgaactcggc

SEQ ID NO: 399556 - DNA, 20 bp, human
gccctcagcctagtctccaa

SEQ ID NO: 399557 - DNA, 20 bp, human
ggccgcgagcccgatctcca

SEQ ID NO: 399558 - DNA, 20 bp, human
gtgagggagaagtggttacc

SEQ ID NO: 399559 - DNA, 20 bp, human
gtgggcccaagaaggtctgt

SEQ ID NO: 399560 - DNA, 20 bp, human
gggaagtggctcgtgaccct

SEQ ID NO: 399561 - DNA, 20 bp, human
gacccttggagactaggctg

SEQ ID NO: 399562 - DNA, 20 bp, human
ggattggagcgcccgagagg

SEQ ID NO: 399563 - DNA, 20 bp, human
gctcgtgacccttggagact

SEQ ID NO: 399564 - DNA, 20 bp, human
gggtccctcaagaaagagac

SEQ ID NO: 399565 - DNA, 20 bp, human
ggcccacgtgacagctacac

SEQ ID NO: 399566 - DNA, 20 bp, human
gcgcccgtgcctcggagaga

SEQ ID NO: 399567 - DNA, 20 bp, human
gcggcctgcttagagatctg

SEQ ID NO: 399568 - DNA, 20 bp, human
gcgcgcgaccctcgagtctc

SEQ ID NO: 399569 - DNA, 20 bp, human
gcgcgcatgcgcccgtgcct

SEQ ID NO: 399570 - DNA, 20 bp, human
gccctcgagtctcaggtaag

SEQ ID NO: 399571 - DNA, 20 bp, human
gaagaaagcccctctctccg

SEQ ID NO: 399572 - DNA, 20 bp, human
gcccacgcgggccagagcgg

SEQ ID NO: 399573 - DNA, 20 bp, human
ggcgggtcggccacccgctg

SEQ ID NO: 399574 - DNA, 20 bp, human
ggcccctctctccgaggcac

SEQ ID NO: 399575 - DNA, 20 bp, human
gcctccccagatctctaagc

SEQ ID NO: 399576 - DNA, 20 bp, human
ggcaccgccctctgcgaggg

SEQ ID NO: 399577 - DNA, 20 bp, human
gtcgcgacgcccaacttccc

SEQ ID NO: 399578 - DNA, 20 bp, human
gagcgcaccgccctctgcga

SEQ ID NO: 399579 - DNA, 20 bp, human
gttgaaaggcggtgcctcga

SEQ ID NO: 399580 - DNA, 20 bp, human
gcacccaccctcgcagaggg

SEQ ID NO: 399581 - DNA, 20 bp, human
gcatcagagacgctaaccct

SEQ ID NO: 399582 - DNA, 20 bp, human
gagattcgtccgggagagac

SEQ ID NO: 399583 - DNA, 20 bp, human
gcacccggtctccaccaagc

SEQ ID NO: 399584 - DNA, 20 bp, human
ggcgagtgctaattgaaagg

SEQ ID NO: 399585 - DNA, 20 bp, human
gctctcacccaccctcgcag

SEQ ID NO: 399586 - DNA, 20 bp, human
gcgggccaaagggaaggggt

SEQ ID NO: 399587 - DNA, 20 bp, human
gccgcccggaggccacaccc

SEQ ID NO: 399588 - DNA, 20 bp, human
ggagggcgggccaaagggaa

SEQ ID NO: 399589 - DNA, 20 bp, human
gggctggcccgcgggtggga

SEQ ID NO: 399590 - DNA, 20 bp, human
gcctgcgagggcgggccaaa

SEQ ID NO: 399591 - DNA, 20 bp, human
gggccctggcggctgcggaa

SEQ ID NO: 399592 - DNA, 20 bp, human
gcacccgactgggcgtccgc

SEQ ID NO: 399593 - DNA, 20 bp, human
ggaaggggtgggcttgttta

SEQ ID NO: 399594 - DNA, 20 bp, human
gcagtcgggtggagcacgcc

SEQ ID NO: 399595 - DNA, 20 bp, human
ggcaccctcaagttcacctc

SEQ ID NO: 399596 - DNA, 20 bp, human
gcaggaggggcccgggattg

SEQ ID NO: 399597 - DNA, 20 bp, human
gcagggagctgcgttggcag

SEQ ID NO: 399598 - DNA, 20 bp, human
gccgggtcagggagctgcgt

SEQ ID NO: 399599 - DNA, 20 bp, human
gccctgacccggaactttcg

SEQ ID NO: 399600 - DNA, 20 bp, human
gaccacgaaagttccgggtc

SEQ ID NO: 399601 - DNA, 20 bp, human
gccgacaccacgaaagttcc

SEQ ID NO: 399602 - DNA, 20 bp, human
ggcaatggcaacgcccaggg

SEQ ID NO: 399603 - DNA, 20 bp, human
gagcgcaatggcaacgccca

SEQ ID NO: 399604 - DNA, 20 bp, human
ggcacagcaccgcagcgcaa

SEQ ID NO: 399605 - DNA, 20 bp, human
ggtaagaagaggaccacttc

SEQ ID NO: 399606 - DNA, 20 bp, human
gtaagcgaggggagtaaggc

SEQ ID NO: 399607 - DNA, 20 bp, human
gggcccgacggcgccgtcat

SEQ ID NO: 399608 - DNA, 20 bp, human
gggcagaggccgccactgat

SEQ ID NO: 399609 - DNA, 20 bp, human
ggaggggagtaaggccgggg

SEQ ID NO: 399610 - DNA, 20 bp, human
gagggtaagcgaggggagta

SEQ ID NO: 399611 - DNA, 20 bp, human
ggctgtctcctgggcgtccg

SEQ ID NO: 399612 - DNA, 20 bp, human
gccgcgcgaacagccaatga

SEQ ID NO: 399613 - DNA, 20 bp, human
gaacaggcggagacgatgaa

SEQ ID NO: 399614 - DNA, 20 bp, human
ggcgtcggaacgtgactgga

SEQ ID NO: 399615 - DNA, 20 bp, human
ggctgggcagggtaagcgag

SEQ ID NO: 399616 - DNA, 20 bp, human
gcacccagcacgtgcatcgg

SEQ ID NO: 399617 - DNA, 20 bp, human
gggcaggtatggaacctata

SEQ ID NO: 399618 - DNA, 20 bp, human
ggggctgtcccgggggtcag

SEQ ID NO: 399619 - DNA, 20 bp, human
gctgccaccggaagtgagtg

SEQ ID NO: 399620 - DNA, 20 bp, human
ggcggggccggggataggat

SEQ ID NO: 399621 - DNA, 20 bp, human
gccaccggaagtgagtgagg

SEQ ID NO: 399622 - DNA, 20 bp, human
ggataggatcggataggagt

SEQ ID NO: 399623 - DNA, 20 bp, human
ggccggggataggatcggat

SEQ ID NO: 399624 - DNA, 20 bp, human
gaggagtcggggtcgtggat

SEQ ID NO: 399625 - DNA, 20 bp, human
gtgtcacccagcacgtgcat

SEQ ID NO: 399626 - DNA, 20 bp, human
ggggagtggtggtgagtccg

SEQ ID NO: 399627 - DNA, 20 bp, human
ggggccgcgctttatacatc

SEQ ID NO: 399628 - DNA, 20 bp, human
gggtccggatgtataaagcg

SEQ ID NO: 399629 - DNA, 20 bp, human
gcggaggcggaagtgacgct

SEQ ID NO: 399630 - DNA, 20 bp, human
gtccggcgaggctccggcct

SEQ ID NO: 399631 - DNA, 20 bp, human
gtgtcgcgagatagcgaaag

SEQ ID NO: 399632 - DNA, 20 bp, human
gcccgaggccggagcctcgc

SEQ ID NO: 399633 - DNA, 20 bp, human
gtccgcctccggcgaggctc

SEQ ID NO: 399634 - DNA, 20 bp, human
ggtagcgcggcgcccactca

SEQ ID NO: 399635 - DNA, 20 bp, human
gagtgggcgccgcgctacgg

SEQ ID NO: 399636 - DNA, 20 bp, human
ggaccagctgcaaatgctct

SEQ ID NO: 399637 - DNA, 20 bp, human
gtacggcgagtcaaagtccc

SEQ ID NO: 399638 - DNA, 20 bp, human
ggagaaagccgggcgctgat

SEQ ID NO: 399639 - DNA, 20 bp, human
gaggaaatgacggagaaagc

SEQ ID NO: 399640 - DNA, 20 bp, human
ggcggaagaggcttccggaa

SEQ ID NO: 399641 - DNA, 20 bp, human
gtcggctgggagcctcgtgg

SEQ ID NO: 399642 - DNA, 20 bp, human
gagtcctggaggtgcgtggt

SEQ ID NO: 399643 - DNA, 20 bp, human
gtgggcgggtccaatcggct

SEQ ID NO: 399644 - DNA, 20 bp, human
gagcaggagcgcgccgagta

SEQ ID NO: 399645 - DNA, 20 bp, human
gactcacctcagcctccacg

SEQ ID NO: 399646 - DNA, 20 bp, human
ggcacaagcgtcctctcctc

SEQ ID NO: 399647 - DNA, 20 bp, human
gagcctccgggcaccctcgc

SEQ ID NO: 399648 - DNA, 20 bp, human
ggggacgggaactgagcgcc

SEQ ID NO: 399649 - DNA, 20 bp, human
ggaacggaactgcggttcgg

SEQ ID NO: 399650 - DNA, 20 bp, human
gggcgaacggaactgcggtt

SEQ ID NO: 399651 - DNA, 20 bp, human
gcaggcgcacgttgctaggg

SEQ ID NO: 399652 - DNA, 20 bp, human
gtcttcgtgatcaggtccag

SEQ ID NO: 399653 - DNA, 20 bp, human
gcagcaggcgcacgttgcta

SEQ ID NO: 399654 - DNA, 20 bp, human
gcgttcgcctaaagctggga

SEQ ID NO: 399655 - DNA, 20 bp, human
ggttccgttcgcctaaagct

SEQ ID NO: 399656 - DNA, 20 bp, human
gaggacgcgctacctcctgg

SEQ ID NO: 399657 - DNA, 20 bp, human
gtagcgcgtcctactcgctc

SEQ ID NO: 399658 - DNA, 20 bp, human
gggaccgagcccaccgagag

SEQ ID NO: 399659 - DNA, 20 bp, human
gacaaaggaagcgctctgca

SEQ ID NO: 399660 - DNA, 20 bp, human
gcctactcgctccggaacaa

SEQ ID NO: 399661 - DNA, 20 bp, human
gtgtgtgccgggatctgcca

SEQ ID NO: 399662 - DNA, 20 bp, human
gtcgatctgcgcatgtgcct

SEQ ID NO: 399663 - DNA, 20 bp, human
gcccacagatccactctcgg

SEQ ID NO: 399664 - DNA, 20 bp, human
gctgcgcatgtgcctaggtg

SEQ ID NO: 399665 - DNA, 20 bp, human
gagtaggacgcgctacctcc

SEQ ID NO: 399666 - DNA, 20 bp, human
ggcggaaaacggggaatgtg

SEQ ID NO: 399667 - DNA, 20 bp, human
ggcccctacgccgccatgag

SEQ ID NO: 399668 - DNA, 20 bp, human
gcatggcggcgtaggggcgg

SEQ ID NO: 399669 - DNA, 20 bp, human
ggccgccatgagcggaaaac

SEQ ID NO: 399670 - DNA, 20 bp, human
gacggggaatgtgaggctga

SEQ ID NO: 399671 - DNA, 20 bp, human
gctctcgtgcggacgcactc

SEQ ID NO: 399672 - DNA, 20 bp, human
gcgcagaagcgaagagaggg

SEQ ID NO: 399673 - DNA, 20 bp, human
gtttccgctcatggcggcgt

SEQ ID NO: 399674 - DNA, 20 bp, human
gcagccggggccactcagcc

SEQ ID NO: 399675 - DNA, 20 bp, human
ggaagtgaggcattggtgcc

SEQ ID NO: 399676 - DNA, 20 bp, human
gcgcctgcgcggacgtcgat

SEQ ID NO: 399677 - DNA, 20 bp, human
gcggacgtcgatgggtttgt

SEQ ID NO: 399678 - DNA, 20 bp, human
gacgccctcgcaccgggcac

SEQ ID NO: 399679 - DNA, 20 bp, human
gcggcagtgaccacgagacg

SEQ ID NO: 399680 - DNA, 20 bp, human
gaacgggcgcctctcctctt

SEQ ID NO: 399681 - DNA, 20 bp, human
gcccggtgcgagggcgtcac

SEQ ID NO: 399682 - DNA, 20 bp, human
gaacccatcgacgtccgcgc

SEQ ID NO: 399683 - DNA, 20 bp, human
ggctccatagcgatcatcac

SEQ ID NO: 399684 - DNA, 20 bp, human
gcagagggcgagcgcacggc

SEQ ID NO: 399685 - DNA, 20 bp, human
gaccacgagacggggcgcag

SEQ ID NO: 399686 - DNA, 20 bp, human
gctcccatgtgagctctgga

SEQ ID NO: 399687 - DNA, 20 bp, human
gcacatgggaggcgtgactt

SEQ ID NO: 399688 - DNA, 20 bp, human
gctccctccagagctcacat

SEQ ID NO: 399689 - DNA, 20 bp, human
gcaagggcgggaaacaaaga

SEQ ID NO: 399690 - DNA, 20 bp, human
gacgcctcccatgtgagctc

SEQ ID NO: 399691 - DNA, 20 bp, human
gcggtggaaggaagctcgtt

SEQ ID NO: 399692 - DNA, 20 bp, human
gacaatgctaggcaacgtgc

SEQ ID NO: 399693 - DNA, 20 bp, human
gggttccgacagaaccgcaa

SEQ ID NO: 399694 - DNA, 20 bp, human
gagagctggagaacaatgct

SEQ ID NO: 399695 - DNA, 20 bp, human
gacttgggttccgagggcca

SEQ ID NO: 399696 - DNA, 20 bp, human
gccgcagccccgaggggtct

SEQ ID NO: 399697 - DNA, 20 bp, human
gggacggcgcggtcagtgtt

SEQ ID NO: 399698 - DNA, 20 bp, human
gcgctggtgagtcactgcgg

SEQ ID NO: 399699 - DNA, 20 bp, human
ggcaccgcggccctgagcgc

SEQ ID NO: 399700 - DNA, 20 bp, human
gccgcctgcgctcagggccg

SEQ ID NO: 399701 - DNA, 20 bp, human
gtgccccgtagcccggcagc

SEQ ID NO: 399702 - DNA, 20 bp, human
gccaagtcccacctttcgca

SEQ ID NO: 399703 - DNA, 20 bp, human
ggcaggcggccccgggtctc

SEQ ID NO: 399704 - DNA, 20 bp, human
gggcgccggaagtcacgccc

SEQ ID NO: 399705 - DNA, 20 bp, human
gctcaggcggaccgcgcccc

SEQ ID NO: 399706 - DNA, 20 bp, human
gcggctgcgcgtccactcta

SEQ ID NO: 399707 - DNA, 20 bp, human
gtcgcgcggggcaacacggc

SEQ ID NO: 399708 - DNA, 20 bp, human
gaccgcttgcagttcggcgg

SEQ ID NO: 399709 - DNA, 20 bp, human
gcgcgagagctgccctagag

SEQ ID NO: 399710 - DNA, 20 bp, human
gcgaagccacgaggactgac

SEQ ID NO: 399711 - DNA, 20 bp, human
gctagggcagctctcgcgcg

SEQ ID NO: 399712 - DNA, 20 bp, human
gggggcggggcgtgcggcca

SEQ ID NO: 399713 - DNA, 20 bp, human
ggccgcggtcccgcctgctg

SEQ ID NO: 399714 - DNA, 20 bp, human
ggctctcgcgcggggcaaca

SEQ ID NO: 399715 - DNA, 20 bp, human
gaagggacttcccgcgccag

SEQ ID NO: 399716 - DNA, 20 bp, human
gccaccagccacaacccgga

SEQ ID NO: 399717 - DNA, 20 bp, human
ggccaaacccgaaacaccga

SEQ ID NO: 399718 - DNA, 20 bp, human
ggtgaccgccctccgggttg

SEQ ID NO: 399719 - DNA, 20 bp, human
gtgcgcctggcgtcaccgac

SEQ ID NO: 399720 - DNA, 20 bp, human
gtgccttgagcatgcgtgaa

SEQ ID NO: 399721 - DNA, 20 bp, human
ggcactccatcagatcacct

SEQ ID NO: 399722 - DNA, 20 bp, human
gtggtggccttcggtgtttc

SEQ ID NO: 399723 - DNA, 20 bp, human
gaggtgctgtgaccgccctc

SEQ ID NO: 399724 - DNA, 20 bp, human
gccgccctccgggttgtggc

SEQ ID NO: 399725 - DNA, 20 bp, human
gcacgtaccgcgcatgctca

SEQ ID NO: 399726 - DNA, 20 bp, human
ggctccgcgcgcgtccacca

SEQ ID NO: 399727 - DNA, 20 bp, human
gtgcccaaactaagcctccg

SEQ ID NO: 399728 - DNA, 20 bp, human
gcggagcagcaacccgaccc

SEQ ID NO: 399729 - DNA, 20 bp, human
gcccgtgggctgatctgggg

SEQ ID NO: 399730 - DNA, 20 bp, human
ggctccgagtgagcacgcgc

SEQ ID NO: 399731 - DNA, 20 bp, human
gcgagcctggggcggagttt

SEQ ID NO: 399732 - DNA, 20 bp, human
gagcctccgtggctgggtac

SEQ ID NO: 399733 - DNA, 20 bp, human
gcgggtagcgcacggagctt

SEQ ID NO: 399734 - DNA, 20 bp, human
gggagcttaggtagctcgag

SEQ ID NO: 399735 - DNA, 20 bp, human
gcgcgcttgctcgccggggt

SEQ ID NO: 399736 - DNA, 20 bp, human
gcgggccaccgtccacaggg

SEQ ID NO: 399737 - DNA, 20 bp, human
gtagcgggccaccgtccaca

SEQ ID NO: 399738 - DNA, 20 bp, human
gttctggcggatccgccctg

SEQ ID NO: 399739 - DNA, 20 bp, human
gcgcgtcgcaggagagcttc

SEQ ID NO: 399740 - DNA, 20 bp, human
gtgggcgggagtgggagtat

SEQ ID NO: 399741 - DNA, 20 bp, human
gggcggatccgccctgtgga

SEQ ID NO: 399742 - DNA, 20 bp, human
ggagtggatcttcgcgtcgc

SEQ ID NO: 399743 - DNA, 20 bp, human
gtcgctatcttgttctgggc

SEQ ID NO: 399744 - DNA, 20 bp, human
gtcttgttctgggcgggagt

SEQ ID NO: 399745 - DNA, 20 bp, human
ggcctgtcgctatcttgttc

SEQ ID NO: 399746 - DNA, 20 bp, human
gcggaggggcggtaatacgt

SEQ ID NO: 399747 - DNA, 20 bp, human
gcgttgagggcgttcggtga

SEQ ID NO: 399748 - DNA, 20 bp, human
gcaggagcagcgtggtgccc

SEQ ID NO: 399749 - DNA, 20 bp, human
gcaagcgcgttgagggcgtt

SEQ ID NO: 399750 - DNA, 20 bp, human
gagggggtgagcctcccgaa

SEQ ID NO: 399751 - DNA, 20 bp, human
gggcgggggcggttccagag

SEQ ID NO: 399752 - DNA, 20 bp, human
gaggggcggtaatacgtggg

SEQ ID NO: 399753 - DNA, 20 bp, human
gagcgcgcggccgacgtagg

SEQ ID NO: 399754 - DNA, 20 bp, human
gtaccctcgcgagatttcgg

SEQ ID NO: 399755 - DNA, 20 bp, human
gcttctcgggccgaagtaat

SEQ ID NO: 399756 - DNA, 20 bp, human
ggagcatcgcgagtgacagt

SEQ ID NO: 399757 - DNA, 20 bp, human
gagtgacagtggggttctcc

SEQ ID NO: 399758 - DNA, 20 bp, human
gaggcgaagggggttcctca

SEQ ID NO: 399759 - DNA, 20 bp, human
gacagtggggttctccgggg

SEQ ID NO: 399760 - DNA, 20 bp, human
ggccccttggtcacccacaa

SEQ ID NO: 399761 - DNA, 20 bp, human
gtgagggaacccggaagggt

SEQ ID NO: 399762 - DNA, 20 bp, human
gctccgaagacccgggaact

SEQ ID NO: 399763 - DNA, 20 bp, human
gaactaggcgaggaaggcgg

SEQ ID NO: 399764 - DNA, 20 bp, human
ggctccctcccccggaagta

SEQ ID NO: 399765 - DNA, 20 bp, human
gaagacgcggacctccgcgg

SEQ ID NO: 399766 - DNA, 20 bp, human
gctccataggctccctggtg

SEQ ID NO: 399767 - DNA, 20 bp, human
gaggctccctggtggggcgc

SEQ ID NO: 399768 - DNA, 20 bp, human
gaaggaggatggcccgttga

SEQ ID NO: 399769 - DNA, 20 bp, human
gcggcgctccataggctccc

SEQ ID NO: 399770 - DNA, 20 bp, human
ggatgcgctcggcgctccat

SEQ ID NO: 399771 - DNA, 20 bp, human
gggagcgcagagcacgttcg

SEQ ID NO: 399772 - DNA, 20 bp, human
gaccgaagcgaggcgagacg

SEQ ID NO: 399773 - DNA, 20 bp, human
ggcgcgcccgcgccccacca

SEQ ID NO: 399774 - DNA, 20 bp, human
gagcgcatctaaccgaagcg

SEQ ID NO: 399775 - DNA, 20 bp, human
gtacctgacggtcggaggaa

SEQ ID NO: 399776 - DNA, 20 bp, human
gcacgctctccttagagggg

SEQ ID NO: 399777 - DNA, 20 bp, human
gagggcacgctctccttaga

SEQ ID NO: 399778 - DNA, 20 bp, human
gaaactgttccgcccctcta

SEQ ID NO: 399779 - DNA, 20 bp, human
gggagccaggggctaagtag

SEQ ID NO: 399780 - DNA, 20 bp, human
gcgactgtgtggcagctgag

SEQ ID NO: 399781 - DNA, 20 bp, human
gtacgctgctgattggatga

SEQ ID NO: 399782 - DNA, 20 bp, human
gagaaaggtagaggcctccc

SEQ ID NO: 399783 - DNA, 20 bp, human
gacatccttgcccggcttgg

SEQ ID NO: 399784 - DNA, 20 bp, human
gcaggggctaagtagcggtg

SEQ ID NO: 399785 - DNA, 20 bp, human
gaccaggtatgaagctctct

SEQ ID NO: 399786 - DNA, 20 bp, human
gaggggcgggcccaaagctg

SEQ ID NO: 399787 - DNA, 20 bp, human
gaggcaggtgcctgagccga

SEQ ID NO: 399788 - DNA, 20 bp, human
gcctgagccgaagggcgagt

SEQ ID NO: 399789 - DNA, 20 bp, human
gagccgaagggcgagtcggc

SEQ ID NO: 399790 - DNA, 20 bp, human
ggccccgccgactcgccctt

SEQ ID NO: 399791 - DNA, 20 bp, human
gcccctccccgccccagctt

SEQ ID NO: 399792 - DNA, 20 bp, human
gactcccccgggcccctagc

SEQ ID NO: 399793 - DNA, 20 bp, human
gggcgggggtcgggcttgga

SEQ ID NO: 399794 - DNA, 20 bp, human
ggggagtagcagaacgggtg

SEQ ID NO: 399795 - DNA, 20 bp, human
gggcttggagggaccggcta

SEQ ID NO: 399796 - DNA, 20 bp, human
ggggagagagccacttttca

SEQ ID NO: 399797 - DNA, 20 bp, human
gcaagatggcggcccatcac

SEQ ID NO: 399798 - DNA, 20 bp, human
gctccctcagccctgaaaag

SEQ ID NO: 399799 - DNA, 20 bp, human
gtggccaagggttagtggcg

SEQ ID NO: 399800 - DNA, 20 bp, human
gggccggtagccatgtgatg

SEQ ID NO: 399801 - DNA, 20 bp, human
ggcagggcggaggaaagtgc

SEQ ID NO: 399802 - DNA, 20 bp, human
gggcggggctgaaggtaaac

SEQ ID NO: 399803 - DNA, 20 bp, human
ggcggaggaaagtgcaggta

SEQ ID NO: 399804 - DNA, 20 bp, human
gtccggaagaccgaggaacc

SEQ ID NO: 399805 - DNA, 20 bp, human
gtgcaagtataatgctgatg

SEQ ID NO: 399806 - DNA, 20 bp, human
gtaaactttcagttggagag

SEQ ID NO: 399807 - DNA, 20 bp, human
gtgaaagggaaagttttagt

SEQ ID NO: 399808 - DNA, 20 bp, human
gttggagagggggaagtgaa

SEQ ID NO: 399809 - DNA, 20 bp, human
gtcgtttaataaaaaatgag

SEQ ID NO: 399810 - DNA, 20 bp, human
gtggctttgtgttggttgcc

SEQ ID NO: 399811 - DNA, 20 bp, human
gcaaacaactccacattgct

SEQ ID NO: 399812 - DNA, 20 bp, human
gacaacttttaccattatat

SEQ ID NO: 399813 - DNA, 20 bp, human
gagagaaaagcatgaaattc

SEQ ID NO: 399814 - DNA, 20 bp, human
gttgcttgcagtgtcattac

SEQ ID NO: 399815 - DNA, 20 bp, human
gtatcacattttcaacaagt

SEQ ID NO: 399816 - DNA, 20 bp, human
ggcgctacgggcagcgacag

SEQ ID NO: 399817 - DNA, 20 bp, human
ggcctctcggaggagcgcta

SEQ ID NO: 399818 - DNA, 20 bp, human
ggacagcggccagaatgcct

SEQ ID NO: 399819 - DNA, 20 bp, human
ggccggcccaacgctttaaa

SEQ ID NO: 399820 - DNA, 20 bp, human
ggggccggcccgaggcattc

SEQ ID NO: 399821 - DNA, 20 bp, human
ggctgtctgtggaaacgcga

SEQ ID NO: 399822 - DNA, 20 bp, human
ggtgcgcgtgcgcgagggga

SEQ ID NO: 399823 - DNA, 20 bp, human
gcggccagaatgcctcgggc

SEQ ID NO: 399824 - DNA, 20 bp, human
gaaagcgttgggccggcccg

SEQ ID NO: 399825 - DNA, 20 bp, human
gccgctggtgtctgtgtaca

SEQ ID NO: 399826 - DNA, 20 bp, human
gagaaggcccgaccaaaggg

SEQ ID NO: 399827 - DNA, 20 bp, human
gcggagaaggcccgaccaaa

SEQ ID NO: 399828 - DNA, 20 bp, human
gccaaagggcggataggtac

SEQ ID NO: 399829 - DNA, 20 bp, human
gggccggcgtccagctctcc

SEQ ID NO: 399830 - DNA, 20 bp, human
gcggataggtaccgggttcc

SEQ ID NO: 399831 - DNA, 20 bp, human
gtaggggataataaactcgt

SEQ ID NO: 399832 - DNA, 20 bp, human
gaggggtcctgggagatagt

SEQ ID NO: 399833 - DNA, 20 bp, human
gaagctgcctactatctccc

SEQ ID NO: 399834 - DNA, 20 bp, human
gttcccggagagctggacgc

SEQ ID NO: 399835 - DNA, 20 bp, human
ggcccgaccaaagggcggat

SEQ ID NO: 399836 - DNA, 20 bp, human
gcgcacgcccagctcgttcg

SEQ ID NO: 399837 - DNA, 20 bp, human
ggcgcgccccgcctcactga

SEQ ID NO: 399838 - DNA, 20 bp, human
gggttgagggcacgaagcaa

SEQ ID NO: 399839 - DNA, 20 bp, human
ggctccgccatgcgggttga

SEQ ID NO: 399840 - DNA, 20 bp, human
gcctctccgcggcgcgccag

SEQ ID NO: 399841 - DNA, 20 bp, human
ggtgccctcaacccgcatgg

SEQ ID NO: 399842 - DNA, 20 bp, human
ggaggaaccgcgaacgagct

SEQ ID NO: 399843 - DNA, 20 bp, human
gggcgggtgaggttatcact

SEQ ID NO: 399844 - DNA, 20 bp, human
ggccagcggctccgccatgc

SEQ ID NO: 399845 - DNA, 20 bp, human
gagccaaacagtcacatccg

SEQ ID NO: 399846 - DNA, 20 bp, human
gtgcccaggcgactgttagg

SEQ ID NO: 399847 - DNA, 20 bp, human
gcggtgggcgggagcaagta

SEQ ID NO: 399848 - DNA, 20 bp, human
ggccccgcccacagttgccc

SEQ ID NO: 399849 - DNA, 20 bp, human
gagtcaggcgagccgatctg

SEQ ID NO: 399850 - DNA, 20 bp, human
gcagtcgcctgggcaaccac

SEQ ID NO: 399851 - DNA, 20 bp, human
gagccacctaacagtcgcct

SEQ ID NO: 399852 - DNA, 20 bp, human
gttgccggggcaactgtggg

SEQ ID NO: 399853 - DNA, 20 bp, human
gcggttgccggggcaactgt

SEQ ID NO: 399854 - DNA, 20 bp, human
gcgtacgcacggcccttggg

SEQ ID NO: 399855 - DNA, 20 bp, human
gaacgcggtcgcagcaacgc

SEQ ID NO: 399856 - DNA, 20 bp, human
gcgtctacctagcccaaacg

SEQ ID NO: 399857 - DNA, 20 bp, human
gggagcgaagagaccgcatc

SEQ ID NO: 399858 - DNA, 20 bp, human
ggctccacccgcaccagcag

SEQ ID NO: 399859 - DNA, 20 bp, human
ggtagccgatctcccagatg

SEQ ID NO: 399860 - DNA, 20 bp, human
gtcctgctgtgaccccgttt

SEQ ID NO: 399861 - DNA, 20 bp, human
gacggggtcacagcaggaca

SEQ ID NO: 399862 - DNA, 20 bp, human
gcacccacctctcctgtaag

SEQ ID NO: 399863 - DNA, 20 bp, human
gtcggaaccacccacactgc

SEQ ID NO: 399864 - DNA, 20 bp, human
gactcctcccgcagtgtggg

SEQ ID NO: 399865 - DNA, 20 bp, human
ggggacgttcttcctcttac

SEQ ID NO: 399866 - DNA, 20 bp, human
gggtgactcaaaccaagtga

SEQ ID NO: 399867 - DNA, 20 bp, human
gcccgcaatcgcgaggagcg

SEQ ID NO: 399868 - DNA, 20 bp, human
gagcgtgggtgacctgggaa

SEQ ID NO: 399869 - DNA, 20 bp, human
gcgtgtcggggctgattctc

SEQ ID NO: 399870 - DNA, 20 bp, human
gcaagtgacggaagtgagcg

SEQ ID NO: 399871 - DNA, 20 bp, human
gtcccggcagagctcgcggc

SEQ ID NO: 399872 - DNA, 20 bp, human
ggggaagggctcgcaggttt

SEQ ID NO: 399873 - DNA, 20 bp, human
gtccaagctcgagcaagcgt

SEQ ID NO: 399874 - DNA, 20 bp, human
ggggtgtgcccgcaatcgcg

SEQ ID NO: 399875 - DNA, 20 bp, human
gcaactcccggcagagctcg

SEQ ID NO: 399876 - DNA, 20 bp, human
gaccgagccgagatgaccaa

SEQ ID NO: 399877 - DNA, 20 bp, human
gtgagtgcattagctgggta

SEQ ID NO: 399878 - DNA, 20 bp, human
gcagcctggcgcatgtgcaa

SEQ ID NO: 399879 - DNA, 20 bp, human
gcgagatgaccaatgggaga

SEQ ID NO: 399880 - DNA, 20 bp, human
gcggctcggtagtggtagga

SEQ ID NO: 399881 - DNA, 20 bp, human
gagggcggggcgaaaaagac

SEQ ID NO: 399882 - DNA, 20 bp, human
gaaagaccggaaatgaacat

SEQ ID NO: 399883 - DNA, 20 bp, human
ggcgaaagcgactgccttct

SEQ ID NO: 399884 - DNA, 20 bp, human
gggtcatctcggctcggtag

SEQ ID NO: 399885 - DNA, 20 bp, human
gagctgggtagggtctgtcc

SEQ ID NO: 399886 - DNA, 20 bp, human
gtgggacgaagggtcgtcat

SEQ ID NO: 399887 - DNA, 20 bp, human
ggccccgcaagcgtcacgtg

SEQ ID NO: 399888 - DNA, 20 bp, human
gctggattgcgtgggacgaa

SEQ ID NO: 399889 - DNA, 20 bp, human
ggggcgggatgcccctccgc

SEQ ID NO: 399890 - DNA, 20 bp, human
gccgcaagcgtcacgtgagg

SEQ ID NO: 399891 - DNA, 20 bp, human
gcaatccagctcatcattgg

SEQ ID NO: 399892 - DNA, 20 bp, human
ggcgtcacgtgagggggcga

SEQ ID NO: 399893 - DNA, 20 bp, human
gcaacagcgccctcagctac

SEQ ID NO: 399894 - DNA, 20 bp, human
gcagcccgctgcacctatcg

SEQ ID NO: 399895 - DNA, 20 bp, human
ggctacaggtagcagagacc

SEQ ID NO: 399896 - DNA, 20 bp, human
gaagcgcaggcgcattggga

SEQ ID NO: 399897 - DNA, 20 bp, human
gcggggaagcgcaggcgcat

SEQ ID NO: 399898 - DNA, 20 bp, human
ggtactgcacctaccccttg

SEQ ID NO: 399899 - DNA, 20 bp, human
gctaggagccggggaagcgc

SEQ ID NO: 399900 - DNA, 20 bp, human
ggcccctgcaccccaagtca

SEQ ID NO: 399901 - DNA, 20 bp, human
gaaaaatgccggggatgcgc

SEQ ID NO: 399902 - DNA, 20 bp, human
gcgcactgggagaggccgca

SEQ ID NO: 399903 - DNA, 20 bp, human
gtgggaacccggggcgggtt

SEQ ID NO: 399904 - DNA, 20 bp, human
gcagaggaccgagcggtcgt

SEQ ID NO: 399905 - DNA, 20 bp, human
gtcgctgctcggcgtgcccg

SEQ ID NO: 399906 - DNA, 20 bp, human
ggcggggcagacgccgacga

SEQ ID NO: 399907 - DNA, 20 bp, human
ggcgcccgttgccgtcgcta

SEQ ID NO: 399908 - DNA, 20 bp, human
ggggcagacgccgacgaggg

SEQ ID NO: 399909 - DNA, 20 bp, human
ggacgagggtgggcggagag

SEQ ID NO: 399910 - DNA, 20 bp, human
gcccgccatagcgacggcaa

SEQ ID NO: 399911 - DNA, 20 bp, human
ggcgacggcaacgggcgctg

SEQ ID NO: 399912 - DNA, 20 bp, human
gcccgcgcccgccatagcga

SEQ ID NO: 399913 - DNA, 20 bp, human
gggagtgctccgagccgtga

SEQ ID NO: 399914 - DNA, 20 bp, human
gcggccccgccctcacggct

SEQ ID NO: 399915 - DNA, 20 bp, human
gcgcaaagatgagctatcga

SEQ ID NO: 399916 - DNA, 20 bp, human
ggggcggcgcttagaaccaa

SEQ ID NO: 399917 - DNA, 20 bp, human
gagaaccaatgggggcgaag

SEQ ID NO: 399918 - DNA, 20 bp, human
gaggcggagcgagtgcctgg

SEQ ID NO: 399919 - DNA, 20 bp, human
gaagaggcggagcgagtgcc

SEQ ID NO: 399920 - DNA, 20 bp, human
gggggccacagccagtgtac

SEQ ID NO: 399921 - DNA, 20 bp, human
ggcccggcctagccaatcgc

SEQ ID NO: 399922 - DNA, 20 bp, human
gaatcaggcatccagtacac

SEQ ID NO: 399923 - DNA, 20 bp, human
gccaacggttgcccggatgt

SEQ ID NO: 399924 - DNA, 20 bp, human
gcgggcccgtcgcgtccaat

SEQ ID NO: 399925 - DNA, 20 bp, human
gcaatcgcagggatgccggg

SEQ ID NO: 399926 - DNA, 20 bp, human
gccccagaaagattcttctc

SEQ ID NO: 399927 - DNA, 20 bp, human
gactcaacgcgaaccgggtg

SEQ ID NO: 399928 - DNA, 20 bp, human
gtagggagcggacactgtat

SEQ ID NO: 399929 - DNA, 20 bp, human
gttcaaagcagacttgtgat

SEQ ID NO: 399930 - DNA, 20 bp, human
gtgagattgcggtgggtgtg

SEQ ID NO: 399931 - DNA, 20 bp, human
gcagcagctttccactacca

SEQ ID NO: 399932 - DNA, 20 bp, human
gacgtcactcaacgcgaacc

SEQ ID NO: 399933 - DNA, 20 bp, human
ggcctgaccccaggtctaac

SEQ ID NO: 399934 - DNA, 20 bp, human
gaccgagcctgttagacctg

SEQ ID NO: 399935 - DNA, 20 bp, human
gagcgagctgggccctccta

SEQ ID NO: 399936 - DNA, 20 bp, human
gggtgagaagagatacacga

SEQ ID NO: 399937 - DNA, 20 bp, human
gtcctccttatgaaggaagt

SEQ ID NO: 399938 - DNA, 20 bp, human
gggacactgatgacattgtg

SEQ ID NO: 399939 - DNA, 20 bp, human
gtgccttcctcacaataccg

SEQ ID NO: 399940 - DNA, 20 bp, human
ggtcatcagtgtccttcata

SEQ ID NO: 399941 - DNA, 20 bp, human
gtgcaatgaggaccctatga

SEQ ID NO: 399942 - DNA, 20 bp, human
gatactgcttgagagggaaa

SEQ ID NO: 399943 - DNA, 20 bp, human
gttgtgtatactgcttgaga

SEQ ID NO: 399944 - DNA, 20 bp, human
gttccgcggtattgtgagga

SEQ ID NO: 399945 - DNA, 20 bp, human
gtactttccgcggtattgtg

SEQ ID NO: 399946 - DNA, 20 bp, human
ggggtatcccgagacccaag

SEQ ID NO: 399947 - DNA, 20 bp, human
ggagccacggcgtgggagta

SEQ ID NO: 399948 - DNA, 20 bp, human
gactccgaatccgagagcgg

SEQ ID NO: 399949 - DNA, 20 bp, human
ggcacgtggagccacggcgt

SEQ ID NO: 399950 - DNA, 20 bp, human
gacgcccagccccacgagct

SEQ ID NO: 399951 - DNA, 20 bp, human
gccgactccgaatccgagag

SEQ ID NO: 399952 - DNA, 20 bp, human
gacgcacgtcccacacctac

SEQ ID NO: 399953 - DNA, 20 bp, human
gccaagcggctagcagaggg

SEQ ID NO: 399954 - DNA, 20 bp, human
gcggcggcaaaccatacttc

SEQ ID NO: 399955 - DNA, 20 bp, human
gctactgctcaacttttgat

SEQ ID NO: 399956 - DNA, 20 bp, human
ggggacgggaccatgtgaaa

SEQ ID NO: 399957 - DNA, 20 bp, human
ggcctcctgccggtcgctgg

SEQ ID NO: 399958 - DNA, 20 bp, human
gggatcgtgcgagcggagga

SEQ ID NO: 399959 - DNA, 20 bp, human
gcgggaccatgtgaaaaggt

SEQ ID NO: 399960 - DNA, 20 bp, human
ggaggaaggacagaaaagcg

SEQ ID NO: 399961 - DNA, 20 bp, human
ggaccggcaggaggcacgtc

SEQ ID NO: 399962 - DNA, 20 bp, human
gcgtgcctcctgccggtcgc

SEQ ID NO: 399963 - DNA, 20 bp, human
ggccctgccctgtcgcttta

SEQ ID NO: 399964 - DNA, 20 bp, human
gggtgggatcgtgcgagcgg

SEQ ID NO: 399965 - DNA, 20 bp, human
ggccgccagcgaccggcagg

SEQ ID NO: 399966 - DNA, 20 bp, human
gagagccagccgcgttacga

SEQ ID NO: 399967 - DNA, 20 bp, human
ggtaacgcggctggctctct

SEQ ID NO: 399968 - DNA, 20 bp, human
gcggctggctctctcggcgc

SEQ ID NO: 399969 - DNA, 20 bp, human
gttacgatggagaccgaaag

SEQ ID NO: 399970 - DNA, 20 bp, human
gggtcctcccaactggagag

SEQ ID NO: 399971 - DNA, 20 bp, human
ggttgtgggaagtctcgtct

SEQ ID NO: 399972 - DNA, 20 bp, human
gcaactgtcgcaaaaatgag

SEQ ID NO: 399973 - DNA, 20 bp, human
ggtctccatcgtaacgcggc

SEQ ID NO: 399974 - DNA, 20 bp, human
gaggctgtcctctctccagt

SEQ ID NO: 399975 - DNA, 20 bp, human
ggaggaccaagatggagcga

SEQ ID NO: 399976 - DNA, 20 bp, human
gcggcaccgccctaccggac

SEQ ID NO: 399977 - DNA, 20 bp, human
gggaggggagaagtagtatc

SEQ ID NO: 399978 - DNA, 20 bp, human
gcaccgccctaccggacagg

SEQ ID NO: 399979 - DNA, 20 bp, human
gtcccgcctgtccggtaggg

SEQ ID NO: 399980 - DNA, 20 bp, human
gctgcgcggcaccgccctac

SEQ ID NO: 399981 - DNA, 20 bp, human
gacaggtgccggctaatttt

SEQ ID NO: 399982 - DNA, 20 bp, human
gggtgccgcgcagaaagccg

SEQ ID NO: 399983 - DNA, 20 bp, human
ggccttccgcagagggaccg

SEQ ID NO: 399984 - DNA, 20 bp, human
gcgccgctgtagcttgaagg

SEQ ID NO: 399985 - DNA, 20 bp, human
gcggcgccgctgtagcttga

SEQ ID NO: 399986 - DNA, 20 bp, human
gcgggtccaggttgcaggaa

SEQ ID NO: 399987 - DNA, 20 bp, human
gcgccaccgcaagtgagaga

SEQ ID NO: 399988 - DNA, 20 bp, human
gcccccgcagcgcgcggacc

SEQ ID NO: 399989 - DNA, 20 bp, human
ggctggagagaattagttag

SEQ ID NO: 399990 - DNA, 20 bp, human
gggcagcgggtccaggttgc

SEQ ID NO: 399991 - DNA, 20 bp, human
gtgagaggacaggcaaccgc

SEQ ID NO: 399992 - DNA, 20 bp, human
ggccggtacccgtgacccta

SEQ ID NO: 399993 - DNA, 20 bp, human
gggagagaattagttagggg

SEQ ID NO: 399994 - DNA, 20 bp, human
gagcgggtgcacccgcccgc

SEQ ID NO: 399995 - DNA, 20 bp, human
gtctccagccctgagaggac

SEQ ID NO: 399996 - DNA, 20 bp, human
gcgttaggggcggggttaac

SEQ ID NO: 399997 - DNA, 20 bp, human
gtgggcagggcctcccgtta

SEQ ID NO: 399998 - DNA, 20 bp, human
gagagccgcgcggcccccga

SEQ ID NO: 399999 - DNA, 20 bp, human
gcgcccgccaggcaagctcc

SEQ ID NO: 400000 - DNA, 20 bp, human
ggatcctggggacgactggc

SEQ ID NO: 400001 - DNA, 20 bp, human
gcccggcatgggtgggttac

SEQ ID NO: 400002 - DNA, 20 bp, human
gtccgcctgcgagccttcgg

SEQ ID NO: 400003 - DNA, 20 bp, human
gctctcgcgagatgtgggca

SEQ ID NO: 400004 - DNA, 20 bp, human
ggggcctcccgttaggggcg

SEQ ID NO: 400005 - DNA, 20 bp, human
gcgcggctctcgcgagatgt

SEQ ID NO: 400006 - DNA, 20 bp, human
gggagccgggagacagacta

SEQ ID NO: 400007 - DNA, 20 bp, human
gccgggagacagactagggc

SEQ ID NO: 400008 - DNA, 20 bp, human
gcaactacactgcgctgcat

SEQ ID NO: 400009 - DNA, 20 bp, human
gtgatccggccacgcagtcc

SEQ ID NO: 400010 - DNA, 20 bp, human
ggcagcgtgtgcgtcaccag

SEQ ID NO: 400011 - DNA, 20 bp, human
gggtgcttgtttatgtagat

SEQ ID NO: 400012 - DNA, 20 bp, human
gcatggaagctttactgttt

SEQ ID NO: 400013 - DNA, 20 bp, human
ggatgtgtggggcttcgttc

SEQ ID NO: 400014 - DNA, 20 bp, human
ggggtgaaaagcacctttcc

SEQ ID NO: 400015 - DNA, 20 bp, human
gtacataaacaagcacctcc

SEQ ID NO: 400016 - DNA, 20 bp, human
gctaaaaaagcgaaaggggc

SEQ ID NO: 400017 - DNA, 20 bp, human
gcaggcggcggaagaagtag

SEQ ID NO: 400018 - DNA, 20 bp, human
gcgggcattgaaatcacgac

SEQ ID NO: 400019 - DNA, 20 bp, human
ggatcctaaaaaagcgaaag

SEQ ID NO: 400020 - DNA, 20 bp, human
gggaaagccgaaaaacccct

SEQ ID NO: 400021 - DNA, 20 bp, human
gagtagaggacgtttaaata

SEQ ID NO: 400022 - DNA, 20 bp, human
gtgaaatcacgactggtgtg

SEQ ID NO: 400023 - DNA, 20 bp, human
ggccacaatcggggaaaagg

SEQ ID NO: 400024 - DNA, 20 bp, human
gtatgcaaaacaaactgagc

SEQ ID NO: 400025 - DNA, 20 bp, human
ggatagttaccataactggt

SEQ ID NO: 400026 - DNA, 20 bp, human
gagtcctaccaccgagtctc

SEQ ID NO: 400027 - DNA, 20 bp, human
ggggacgactggaggtcacg

SEQ ID NO: 400028 - DNA, 20 bp, human
gagaaagcgacgcctccggt

SEQ ID NO: 400029 - DNA, 20 bp, human
gacgcctccggtgggacgac

SEQ ID NO: 400030 - DNA, 20 bp, human
gcccttctaggcctgagact

SEQ ID NO: 400031 - DNA, 20 bp, human
gcctccggtgggacgactgg

SEQ ID NO: 400032 - DNA, 20 bp, human
gaggcctgagactcggtggt

SEQ ID NO: 400033 - DNA, 20 bp, human
gtgacctccagtcgtcccac

SEQ ID NO: 400034 - DNA, 20 bp, human
gctcaggcctagaagggccc

SEQ ID NO: 400035 - DNA, 20 bp, human
gcaacgaaggaagttcaggg

SEQ ID NO: 400036 - DNA, 20 bp, human
ggcgccagagcaggaagttg

SEQ ID NO: 400037 - DNA, 20 bp, human
gcctcccgccgcaatcttgg

SEQ ID NO: 400038 - DNA, 20 bp, human
gggccgctggggatctgagt

SEQ ID NO: 400039 - DNA, 20 bp, human
gagcccactcagatccccag

SEQ ID NO: 400040 - DNA, 20 bp, human
gtaagaaggccgccttggcc

SEQ ID NO: 400041 - DNA, 20 bp, human
gaaaccccaacttcctgctc

SEQ ID NO: 400042 - DNA, 20 bp, human
gagtgggctccgccccgcct

SEQ ID NO: 400043 - DNA, 20 bp, human
gcttcttaagaaggccgcct

SEQ ID NO: 400044 - DNA, 20 bp, human
gcggcctcccgccgcaatct

SEQ ID NO: 400045 - DNA, 20 bp, human
gttacgcgcgcttcttaaga

SEQ ID NO: 400046 - DNA, 20 bp, human
gctcgcgagaagtagagttg

SEQ ID NO: 400047 - DNA, 20 bp, human
gcccgataggagaatctgtc

SEQ ID NO: 400048 - DNA, 20 bp, human
gagggagcgtggggtcttga

SEQ ID NO: 400049 - DNA, 20 bp, human
gctcgcgagaattgcttcta

SEQ ID NO: 400050 - DNA, 20 bp, human
ggctgagagcctatcgcatg

SEQ ID NO: 400051 - DNA, 20 bp, human
gatctcccaaggaaagttga

SEQ ID NO: 400052 - DNA, 20 bp, human
gagggcgacagccggaaagc

SEQ ID NO: 400053 - DNA, 20 bp, human
ggctgtcgccctcatgcgat

SEQ ID NO: 400054 - DNA, 20 bp, human
ggctcagaggtgcaccacgt

SEQ ID NO: 400055 - DNA, 20 bp, human
ggcgtccctgtgaccccgat

SEQ ID NO: 400056 - DNA, 20 bp, human
gggctgcaggcggatggatg

SEQ ID NO: 400057 - DNA, 20 bp, human
gggaagctccggacgacgac

SEQ ID NO: 400058 - DNA, 20 bp, human
gccggacgacgactggaaga

SEQ ID NO: 400059 - DNA, 20 bp, human
gggagcccctcatcccaaac

SEQ ID NO: 400060 - DNA, 20 bp, human
gcggccgcgcggttggctgg

SEQ ID NO: 400061 - DNA, 20 bp, human
gaagttaagggtcttccggg

SEQ ID NO: 400062 - DNA, 20 bp, human
gggctggcggcacgaggccg

SEQ ID NO: 400063 - DNA, 20 bp, human
gcgcctggcttgctctccgc

SEQ ID NO: 400064 - DNA, 20 bp, human
gccgcgctgggaatccgctg

SEQ ID NO: 400065 - DNA, 20 bp, human
ggcccctccccggaagttaa

SEQ ID NO: 400066 - DNA, 20 bp, human
gtgggctccgcttcctcccg

SEQ ID NO: 400067 - DNA, 20 bp, human
gctccgctctggctcggtct

SEQ ID NO: 400068 - DNA, 20 bp, human
gccgctgctccgctctggct

SEQ ID NO: 400069 - DNA, 20 bp, human
gcttcctcccggggctgaaa

SEQ ID NO: 400070 - DNA, 20 bp, human
gcaccgggctccaccgtgac

SEQ ID NO: 400071 - DNA, 20 bp, human
ggaccccgcttcctgcccgg

SEQ ID NO: 400072 - DNA, 20 bp, human
ggtgacgggtcagctgacgc

SEQ ID NO: 400073 - DNA, 20 bp, human
gagaccctttcagccccggg

SEQ ID NO: 400074 - DNA, 20 bp, human
gcgtgctggagggagtaggg

SEQ ID NO: 400075 - DNA, 20 bp, human
gcggtccgcacttaactaag

SEQ ID NO: 400076 - DNA, 20 bp, human
gcgggcgccctggctctgat

SEQ ID NO: 400077 - DNA, 20 bp, human
gagagccagggcgcccggag

SEQ ID NO: 400078 - DNA, 20 bp, human
gggccgacggggcctcgccc

SEQ ID NO: 400079 - DNA, 20 bp, human
gcgccctggtcccgcctctc

SEQ ID NO: 400080 - DNA, 20 bp, human
gtgaggagccggccaataga

SEQ ID NO: 400081 - DNA, 20 bp, human
ggcccggagaggcgggacca

SEQ ID NO: 400082 - DNA, 20 bp, human
gagccggccaatagacggac

SEQ ID NO: 400083 - DNA, 20 bp, human
ggccctggctctgattggca

SEQ ID NO: 400084 - DNA, 20 bp, human
gctggctctgattggcaagg

SEQ ID NO: 400085 - DNA, 20 bp, human
gtctaagcgggtcgctgacg

SEQ ID NO: 400086 - DNA, 20 bp, human
gcggccgcggcggagtgtag

SEQ ID NO: 400087 - DNA, 20 bp, human
gacgtgcagggccttcccgg

SEQ ID NO: 400088 - DNA, 20 bp, human
ggcggagtgtagtggcgggg

SEQ ID NO: 400089 - DNA, 20 bp, human
ggagacgtgcagggccttcc

SEQ ID NO: 400090 - DNA, 20 bp, human
ggcggggcgggctgctggca

SEQ ID NO: 400091 - DNA, 20 bp, human
gtctgcctgtcgccccaaaa

SEQ ID NO: 400092 - DNA, 20 bp, human
ggagccgggggcccttgcgc

SEQ ID NO: 400093 - DNA, 20 bp, human
gccgcggcggagtgtagtgg

SEQ ID NO: 400094 - DNA, 20 bp, human
gcaagggcccccggctccca

SEQ ID NO: 400095 - DNA, 20 bp, human
gtagtggcggggcgggctgc

SEQ ID NO: 400096 - DNA, 20 bp, human
gatgaggaacggaaatgcga

SEQ ID NO: 400097 - DNA, 20 bp, human
gagtccaagcctctgtcatg

SEQ ID NO: 400098 - DNA, 20 bp, human
gacccagagaacggagattt

SEQ ID NO: 400099 - DNA, 20 bp, human
gccggcgtgcaagctgaggg

SEQ ID NO: 400100 - DNA, 20 bp, human
gcttccggcgtgcaagctga

SEQ ID NO: 400101 - DNA, 20 bp, human
ggggcacgggttcgggttgt

SEQ ID NO: 400102 - DNA, 20 bp, human
ggcgattcctgcagcggaag

SEQ ID NO: 400103 - DNA, 20 bp, human
gagtggacatagcgagtcga

SEQ ID NO: 400104 - DNA, 20 bp, human
ggaacccggaagtgataaac

SEQ ID NO: 400105 - DNA, 20 bp, human
gcgacaggctcgagggtcag

SEQ ID NO: 400106 - DNA, 20 bp, human
gacccccgaagcccgcgcgt

SEQ ID NO: 400107 - DNA, 20 bp, human
gccggccgggccaatcgggg

SEQ ID NO: 400108 - DNA, 20 bp, human
gacagtctagaggtgtgggt

SEQ ID NO: 400109 - DNA, 20 bp, human
gggcgcctacgcgcgggctt

SEQ ID NO: 400110 - DNA, 20 bp, human
gtatcccccggcccgagcac

SEQ ID NO: 400111 - DNA, 20 bp, human
ggggttccccggccctggaa

SEQ ID NO: 400112 - DNA, 20 bp, human
gagacccggccgggccaatc

SEQ ID NO: 400113 - DNA, 20 bp, human
ggcgcggtctggaggctcac

SEQ ID NO: 400114 - DNA, 20 bp, human
gcttcgggggtctgcgctcg

SEQ ID NO: 400115 - DNA, 20 bp, human
gaggcgggagcggtggccgc

SEQ ID NO: 400116 - DNA, 20 bp, human
gatgaggaacggaaatgcga

SEQ ID NO: 400117 - DNA, 20 bp, human
gacccagagaacggagattt

SEQ ID NO: 400118 - DNA, 20 bp, human
gagtccaagcctctgtcatg

SEQ ID NO: 400119 - DNA, 20 bp, human
ggaacccggaagtgataaac

SEQ ID NO: 400120 - DNA, 20 bp, human
gccggcgtgcaagctgaggg

SEQ ID NO: 400121 - DNA, 20 bp, human
gcttccggcgtgcaagctga

SEQ ID NO: 400122 - DNA, 20 bp, human
gactccccttacccagagaa

SEQ ID NO: 400123 - DNA, 20 bp, human
ggcgattcctgcagcggaag

SEQ ID NO: 400124 - DNA, 20 bp, human
gggacccggaatgaagacga

SEQ ID NO: 400125 - DNA, 20 bp, human
gaacggaaatgcgagggcct

SEQ ID NO: 400126 - DNA, 20 bp, human
ggcagcccgggcagctagga

SEQ ID NO: 400127 - DNA, 20 bp, human
gcagctaggagggtcgcacg

SEQ ID NO: 400128 - DNA, 20 bp, human
ggctcaggggacccaggcgg

SEQ ID NO: 400129 - DNA, 20 bp, human
gggggcgcagcccgagaagt

SEQ ID NO: 400130 - DNA, 20 bp, human
gctgcccgggctgcgcctct

SEQ ID NO: 400131 - DNA, 20 bp, human
gggacccgcacagcgacgaa

SEQ ID NO: 400132 - DNA, 20 bp, human
ggggaggcggacaaagggtc

SEQ ID NO: 400133 - DNA, 20 bp, human
gcccgcacagcgacgaaggg

SEQ ID NO: 400134 - DNA, 20 bp, human
gcgtcgctgtgcgggtccgg

SEQ ID NO: 400135 - DNA, 20 bp, human
ggtcccctgagccaagggcc

SEQ ID NO: 400136 - DNA, 20 bp, human
gccccgaggggcgtgaggga

SEQ ID NO: 400137 - DNA, 20 bp, human
ggcttcgcgcgagtcctcct

SEQ ID NO: 400138 - DNA, 20 bp, human
gcccgcgcacgcgcggtcgt

SEQ ID NO: 400139 - DNA, 20 bp, human
gcgcgaagcggcttggaagt

SEQ ID NO: 400140 - DNA, 20 bp, human
gcgagcctggcagagagtga

SEQ ID NO: 400141 - DNA, 20 bp, human
gacagactggagctgcacga

SEQ ID NO: 400142 - DNA, 20 bp, human
gagcacttccgcagccccga

SEQ ID NO: 400143 - DNA, 20 bp, human
gcagcgcggcggtgcgccta

SEQ ID NO: 400144 - DNA, 20 bp, human
ggggcgaaactacagttccc

SEQ ID NO: 400145 - DNA, 20 bp, human
gaagggtggcggggaatcgg

SEQ ID NO: 400146 - DNA, 20 bp, human
gcgtagcgcgcgcctccgaa

SEQ ID NO: 400147 - DNA, 20 bp, human
gcccgcaccaagcccttcgg

SEQ ID NO: 400148 - DNA, 20 bp, human
ggcaaagcccatttttctat

SEQ ID NO: 400149 - DNA, 20 bp, human
gggagccagggaaaccacag

SEQ ID NO: 400150 - DNA, 20 bp, human
ggccagggaaaccacagcgg

SEQ ID NO: 400151 - DNA, 20 bp, human
ggaggaggcagcgaagtcgc

SEQ ID NO: 400152 - DNA, 20 bp, human
ggcctccgaagggcttggtg

SEQ ID NO: 400153 - DNA, 20 bp, human
ggcgcccgcaccaagccctt

SEQ ID NO: 400154 - DNA, 20 bp, human
gcgcgcgcctccgaagggct

SEQ ID NO: 400155 - DNA, 20 bp, human
gtaacctgtgctgcgcgggg

SEQ ID NO: 400156 - DNA, 20 bp, human
ggtacgctgggtctacgaag

SEQ ID NO: 400157 - DNA, 20 bp, human
gacgcgacgcgaaagaagtg

SEQ ID NO: 400158 - DNA, 20 bp, human
gaagtggggcatagcggccc

SEQ ID NO: 400159 - DNA, 20 bp, human
gaacgcagcgtacggcgtgg

SEQ ID NO: 400160 - DNA, 20 bp, human
ggctgcgcggcggcttagag

SEQ ID NO: 400161 - DNA, 20 bp, human
gaagctagcaagaattcccc

SEQ ID NO: 400162 - DNA, 20 bp, human
gtggccacgcatcccaccaa

SEQ ID NO: 400163 - DNA, 20 bp, human
gccaataaagggcaagaata

SEQ ID NO: 400164 - DNA, 20 bp, human
ggccccattggtgggatgcg

SEQ ID NO: 400165 - DNA, 20 bp, human
ggctaacgcagcgtacggcg

SEQ ID NO: 400166 - DNA, 20 bp, human
gagtaccccgctcacgtcag

SEQ ID NO: 400167 - DNA, 20 bp, human
gcaaagggcagcgggattcg

SEQ ID NO: 400168 - DNA, 20 bp, human
ggccacgtgacctccccggt

SEQ ID NO: 400169 - DNA, 20 bp, human
ggggcccggcggattcagaa

SEQ ID NO: 400170 - DNA, 20 bp, human
ggggtcatccccgtccatca

SEQ ID NO: 400171 - DNA, 20 bp, human
ggcggctggagcaaccctgg

SEQ ID NO: 400172 - DNA, 20 bp, human
ggggcccggccgcaggacac

SEQ ID NO: 400173 - DNA, 20 bp, human
gcctctggacggcgagagag

SEQ ID NO: 400174 - DNA, 20 bp, human
gtggaggccgctgacgtgag

SEQ ID NO: 400175 - DNA, 20 bp, human
gactgggcgaaggagtacgt

SEQ ID NO: 400176 - DNA, 20 bp, human
gctaccagcccgcacgcact

SEQ ID NO: 400177 - DNA, 20 bp, human
gctggtcgcccagtgcgtgc

SEQ ID NO: 400178 - DNA, 20 bp, human
gccctcgccactcctcggga

SEQ ID NO: 400179 - DNA, 20 bp, human
gccactcctcgggaggggta

SEQ ID NO: 400180 - DNA, 20 bp, human
gggggtaagggtgactcgag

SEQ ID NO: 400181 - DNA, 20 bp, human
gcgggctggtaggcctgtcg

SEQ ID NO: 400182 - DNA, 20 bp, human
gacctcccctcgccactcct

SEQ ID NO: 400183 - DNA, 20 bp, human
gtcgagcggccaggcgggct

SEQ ID NO: 400184 - DNA, 20 bp, human
ggcctgggagaaatggggcg

SEQ ID NO: 400185 - DNA, 20 bp, human
ggccccgccccatttctccc

SEQ ID NO: 400186 - DNA, 20 bp, human
gtggggcagaatacggaaag

SEQ ID NO: 400187 - DNA, 20 bp, human
gtgcgaaaggcagtgggtaa

SEQ ID NO: 400188 - DNA, 20 bp, human
gccccggcctgtgacgtttt

SEQ ID NO: 400189 - DNA, 20 bp, human
gtcacaggccggggacctgc

SEQ ID NO: 400190 - DNA, 20 bp, human
gggaaaggggcggagctgca

SEQ ID NO: 400191 - DNA, 20 bp, human
ggcctgtgacgttttaggaa

SEQ ID NO: 400192 - DNA, 20 bp, human
gggccggtgggggggaaaac

SEQ ID NO: 400193 - DNA, 20 bp, human
ggcgcatctggcattatccg

SEQ ID NO: 400194 - DNA, 20 bp, human
ggggctgggagttgcgcggc

SEQ ID NO: 400195 - DNA, 20 bp, human
gttacccaggtcacccgcaa

SEQ ID NO: 400196 - DNA, 20 bp, human
gtcgcacggggctcaggcgt

SEQ ID NO: 400197 - DNA, 20 bp, human
gaagcgggtgaaggcgtcca

SEQ ID NO: 400198 - DNA, 20 bp, human
gtcggtcccggccctgggtc

SEQ ID NO: 400199 - DNA, 20 bp, human
gcaaaggccacgagtcgcac

SEQ ID NO: 400200 - DNA, 20 bp, human
gtgggactgaccgttccctg

SEQ ID NO: 400201 - DNA, 20 bp, human
gtcagccggtgtcccgtcgt

SEQ ID NO: 400202 - DNA, 20 bp, human
gggggcccgtcggatcccca

SEQ ID NO: 400203 - DNA, 20 bp, human
gaccgccgacgacgggacac

SEQ ID NO: 400204 - DNA, 20 bp, human
gagtctctccgccccagagg

SEQ ID NO: 400205 - DNA, 20 bp, human
gtccatggcttctagcccaa

SEQ ID NO: 400206 - DNA, 20 bp, human
gtggcttgccgctcacccat

SEQ ID NO: 400207 - DNA, 20 bp, human
gtctgagccgagcagattgg

SEQ ID NO: 400208 - DNA, 20 bp, human
gcggcaagccaagcgagggg

SEQ ID NO: 400209 - DNA, 20 bp, human
gagccgagcagattggtgga

SEQ ID NO: 400210 - DNA, 20 bp, human
gtgctcggctcagaagggag

SEQ ID NO: 400211 - DNA, 20 bp, human
ggagcggcaagccaagcgag

SEQ ID NO: 400212 - DNA, 20 bp, human
ggtctgccgctctcggccaa

SEQ ID NO: 400213 - DNA, 20 bp, human
ggctgtgtacacccgtatcc

SEQ ID NO: 400214 - DNA, 20 bp, human
gggccaaagcgcagagccaa

SEQ ID NO: 400215 - DNA, 20 bp, human
ggcccattggctctgcgctt

SEQ ID NO: 400216 - DNA, 20 bp, human
gcgcgcatgcgccgcctcag

SEQ ID NO: 400217 - DNA, 20 bp, human
gcgcccgcggggacccagag

SEQ ID NO: 400218 - DNA, 20 bp, human
gcatgcgccgcctcaggggc

SEQ ID NO: 400219 - DNA, 20 bp, human
gccgcctcaggggccggtcc

SEQ ID NO: 400220 - DNA, 20 bp, human
ggaggaactcgcagtccggg

SEQ ID NO: 400221 - DNA, 20 bp, human
ggacccagagcggagggagt

SEQ ID NO: 400222 - DNA, 20 bp, human
gctagggtcaaggcgatttc

SEQ ID NO: 400223 - DNA, 20 bp, human
gtcccctaggggtctctccc

SEQ ID NO: 400224 - DNA, 20 bp, human
gtgcccgggagagaccccta

SEQ ID NO: 400225 - DNA, 20 bp, human
gctccgccctgggtctccac

SEQ ID NO: 400226 - DNA, 20 bp, human
ggcgcccactaacctgctag

SEQ ID NO: 400227 - DNA, 20 bp, human
ggccggcagcagacgttgac

SEQ ID NO: 400228 - DNA, 20 bp, human
gcgcccggccgcttccagaa

SEQ ID NO: 400229 - DNA, 20 bp, human
gcccactaacctgctagtgg

SEQ ID NO: 400230 - DNA, 20 bp, human
gcggcgaagcccattggcca

SEQ ID NO: 400231 - DNA, 20 bp, human
gtcccccactagcaggttag

SEQ ID NO: 400232 - DNA, 20 bp, human
gcccggtcaacgtctgctgc

SEQ ID NO: 400233 - DNA, 20 bp, human
gggcgcgggggggtaagtgg

SEQ ID NO: 400234 - DNA, 20 bp, human
gccgcaccgccgtggccaat

SEQ ID NO: 400235 - DNA, 20 bp, human
gggggcccggctagccattc

SEQ ID NO: 400236 - DNA, 20 bp, human
ggggaagcccgggacgaagt

SEQ ID NO: 400237 - DNA, 20 bp, human
ggctccgcctacttcgtccc

SEQ ID NO: 400238 - DNA, 20 bp, human
gggtggagcccaagcgaagt

SEQ ID NO: 400239 - DNA, 20 bp, human
ggggaggctcttccaaccag

SEQ ID NO: 400240 - DNA, 20 bp, human
ggacgaagtaggcggagctc

SEQ ID NO: 400241 - DNA, 20 bp, human
gggccggggcagtttccggg

SEQ ID NO: 400242 - DNA, 20 bp, human
gtgggttcccggcgtggggt

SEQ ID NO: 400243 - DNA, 20 bp, human
gggacccgcccacttcgctt

SEQ ID NO: 400244 - DNA, 20 bp, human
gagtggcgcgaactcccggt

SEQ ID NO: 400245 - DNA, 20 bp, human
gggcaagcggcgccagttcc

SEQ ID NO: 400246 - DNA, 20 bp, human
ggggcctatgagcgagcctg

SEQ ID NO: 400247 - DNA, 20 bp, human
gcgcccgaacaccgcccgga

SEQ ID NO: 400248 - DNA, 20 bp, human
gccgccccaggctcgctcat

SEQ ID NO: 400249 - DNA, 20 bp, human
gagggcgcgacgtagcccgc

SEQ ID NO: 400250 - DNA, 20 bp, human
gggctcgccccaggggacga

SEQ ID NO: 400251 - DNA, 20 bp, human
gtccaggccggctttcgggt

SEQ ID NO: 400252 - DNA, 20 bp, human
gcgacgtagcccgcggggga

SEQ ID NO: 400253 - DNA, 20 bp, human
gcccctggggcgagccactg

SEQ ID NO: 400254 - DNA, 20 bp, human
ggtagctggtccttcccccg

SEQ ID NO: 400255 - DNA, 20 bp, human
gagaaggcccagccccgtcc

SEQ ID NO: 400256 - DNA, 20 bp, human
ggatcactggaaaacagcaa

SEQ ID NO: 400257 - DNA, 20 bp, human
ggagatgcctgaattagggc

SEQ ID NO: 400258 - DNA, 20 bp, human
gggagggagatgcctgaatt

SEQ ID NO: 400259 - DNA, 20 bp, human
gtccagtcaagatatgttag

SEQ ID NO: 400260 - DNA, 20 bp, human
gacagctaacagctgcagga

SEQ ID NO: 400261 - DNA, 20 bp, human
ggttagctattgggtgggtg

SEQ ID NO: 400262 - DNA, 20 bp, human
ggaagcccctatgagaagga

SEQ ID NO: 400263 - DNA, 20 bp, human
gcagagaagcccctatgaga

SEQ ID NO: 400264 - DNA, 20 bp, human
ggcctctaacatatcttgac

SEQ ID NO: 400265 - DNA, 20 bp, human
gctgctgttagctattgggt

SEQ ID NO: 400266 - DNA, 20 bp, human
gctcggggctggacatgcag

SEQ ID NO: 400267 - DNA, 20 bp, human
ggccctggttggagcgtctg

SEQ ID NO: 400268 - DNA, 20 bp, human
gggccccagacgctccaacc

SEQ ID NO: 400269 - DNA, 20 bp, human
ggtgtcaagcacacctcctt

SEQ ID NO: 400270 - DNA, 20 bp, human
gaggaccccggcgggtgcaa

SEQ ID NO: 400271 - DNA, 20 bp, human
ggacgcggacacatgatccg

SEQ ID NO: 400272 - DNA, 20 bp, human
ggcagcccaggcagctcagt

SEQ ID NO: 400273 - DNA, 20 bp, human
gaccgcccactgagctgcct

SEQ ID NO: 400274 - DNA, 20 bp, human
ggggctgcagacgccctggt

SEQ ID NO: 400275 - DNA, 20 bp, human
gtcaggcaggaggaccccgg

SEQ ID NO: 400276 - DNA, 20 bp, human
gtcgttcgtcatgtgggata

SEQ ID NO: 400277 - DNA, 20 bp, human
gggaggaggcgtcattcctg

SEQ ID NO: 400278 - DNA, 20 bp, human
gacaagactggttatgtgaa

SEQ ID NO: 400279 - DNA, 20 bp, human
gctgcctctactggccaagt

SEQ ID NO: 400280 - DNA, 20 bp, human
ggccttgtcgttcgtcatgt

SEQ ID NO: 400281 - DNA, 20 bp, human
gggggcaagcaaaaagagga

SEQ ID NO: 400282 - DNA, 20 bp, human
gtcccacatgacgaacgaca

SEQ ID NO: 400283 - DNA, 20 bp, human
gtgacgaacgacaaggccag

SEQ ID NO: 400284 - DNA, 20 bp, human
gatcggcaagaacacaagac

SEQ ID NO: 400285 - DNA, 20 bp, human
gagctcctcactgcctctac

SEQ ID NO: 400286 - DNA, 20 bp, human
gagggtgctgatgagacata

SEQ ID NO: 400287 - DNA, 20 bp, human
gtaaatggagtgtgctccca

SEQ ID NO: 400288 - DNA, 20 bp, human
gaaagacatagttgcaagat

SEQ ID NO: 400289 - DNA, 20 bp, human
gggagcacactccatttagc

SEQ ID NO: 400290 - DNA, 20 bp, human
gcttccctcaaagggctcat

SEQ ID NO: 400291 - DNA, 20 bp, human
ggagggaattgtcttactca

SEQ ID NO: 400292 - DNA, 20 bp, human
gcaaccaatgagccctttga

SEQ ID NO: 400293 - DNA, 20 bp, human
gcatggtagggaatacagca

SEQ ID NO: 400294 - DNA, 20 bp, human
gtgcggctagtgttaatgtc

SEQ ID NO: 400295 - DNA, 20 bp, human
gtagccgcaagcctgctaaa

SEQ ID NO: 400296 - DNA, 20 bp, human
gctcccaacaggaaacaatg

SEQ ID NO: 400297 - DNA, 20 bp, human
gcaccacattgtttcctgtt

SEQ ID NO: 400298 - DNA, 20 bp, human
gattgcagggagctcccaac

SEQ ID NO: 400299 - DNA, 20 bp, human
gggtgaattcatttttttgc

SEQ ID NO: 400300 - DNA, 20 bp, human
gattcatttttttgcggggc

SEQ ID NO: 400301 - DNA, 20 bp, human
gagggggggtgggtattgca

SEQ ID NO: 400302 - DNA, 20 bp, human
gtcattctgacatcaaaacc

SEQ ID NO: 400303 - DNA, 20 bp, human
gtttttgcggggcagggggg

SEQ ID NO: 400304 - DNA, 20 bp, human
gcatttttttgcggggcagg

SEQ ID NO: 400305 - DNA, 20 bp, human
gtagctttttgatatactgc

SEQ ID NO: 400306 - DNA, 20 bp, human
ggaccctcgttcttcacacg

SEQ ID NO: 400307 - DNA, 20 bp, human
gcccaagtccctcctcagaa

SEQ ID NO: 400308 - DNA, 20 bp, human
gtgaaggctcaaaatggcaa

SEQ ID NO: 400309 - DNA, 20 bp, human
gtggccctggtggcgcctaa

SEQ ID NO: 400310 - DNA, 20 bp, human
gcaaactatcttatggaagg

SEQ ID NO: 400311 - DNA, 20 bp, human
gaacaagtccggggcagcac

SEQ ID NO: 400312 - DNA, 20 bp, human
ggagggactgatagagaaca

SEQ ID NO: 400313 - DNA, 20 bp, human
gctcctcgtgtgaagaacga

SEQ ID NO: 400314 - DNA, 20 bp, human
gttggaaatggccccttctg

SEQ ID NO: 400315 - DNA, 20 bp, human
ggaaatggccccttctgagg

SEQ ID NO: 400316 - DNA, 20 bp, human
ggtcaagattaggggaataa

SEQ ID NO: 400317 - DNA, 20 bp, human
gatagcaaggtcaagattag

SEQ ID NO: 400318 - DNA, 20 bp, human
gacagatgaaagagatagca

SEQ ID NO: 400319 - DNA, 20 bp, human
gaccctggagtgggtgtgat

SEQ ID NO: 400320 - DNA, 20 bp, human
gacactacgtgaccctggag

SEQ ID NO: 400321 - DNA, 20 bp, human
gtactccaatcaaaaccggc

SEQ ID NO: 400322 - DNA, 20 bp, human
gctgccctgccggttttgat

SEQ ID NO: 400323 - DNA, 20 bp, human
gtgaaaacactacgtgaccc

SEQ ID NO: 400324 - DNA, 20 bp, human
ggtgaaaggctagtcacact

SEQ ID NO: 400325 - DNA, 20 bp, human
ggcttggattcctgccctgc

SEQ ID NO: 400326 - DNA, 20 bp, human
gtggggtcagccagatgaga

SEQ ID NO: 400327 - DNA, 20 bp, human
gtgtccccagtgggcggttg

SEQ ID NO: 400328 - DNA, 20 bp, human
gggcctgagggccaaggctc

SEQ ID NO: 400329 - DNA, 20 bp, human
gggtggagccgagcggggaa

SEQ ID NO: 400330 - DNA, 20 bp, human
gtatcactcttggccccggt

SEQ ID NO: 400331 - DNA, 20 bp, human
gcctcctcaaccgcccactg

SEQ ID NO: 400332 - DNA, 20 bp, human
gtgggcggttgaggaggata

SEQ ID NO: 400333 - DNA, 20 bp, human
gtggagaaacctcggagtct

SEQ ID NO: 400334 - DNA, 20 bp, human
ggccctgagccttggccctc

SEQ ID NO: 400335 - DNA, 20 bp, human
gtggaagctgcttaagttcc

SEQ ID NO: 400336 - DNA, 20 bp, human
gcagccgcggggacctagcg

SEQ ID NO: 400337 - DNA, 20 bp, human
gggagctgcggggttaccat

SEQ ID NO: 400338 - DNA, 20 bp, human
ggacctagcggggccgagag

SEQ ID NO: 400339 - DNA, 20 bp, human
gcggccccgctaggtccccg

SEQ ID NO: 400340 - DNA, 20 bp, human
ggcgtcgccagtggctccca

SEQ ID NO: 400341 - DNA, 20 bp, human
gccggcccccacaactccgc

SEQ ID NO: 400342 - DNA, 20 bp, human
ggagtccagcggagttgtgg

SEQ ID NO: 400343 - DNA, 20 bp, human
gtgagcccagacctcaccgg

SEQ ID NO: 400344 - DNA, 20 bp, human
gtggcgacgccgagcagccg

SEQ ID NO: 400345 - DNA, 20 bp, human
gggcgcccccggtgaggtct

SEQ ID NO: 400346 - DNA, 20 bp, human
gatgtctaggcagcgggtag

SEQ ID NO: 400347 - DNA, 20 bp, human
ggtcacaatagctgaagata

SEQ ID NO: 400348 - DNA, 20 bp, human
gtcaccgatacaggcaagac

SEQ ID NO: 400349 - DNA, 20 bp, human
gatagctgaagatagggtgg

SEQ ID NO: 400350 - DNA, 20 bp, human
gtgacttgggctgtgatctt

SEQ ID NO: 400351 - DNA, 20 bp, human
ggcggcacatcctgcatgtg

SEQ ID NO: 400352 - DNA, 20 bp, human
ggagtcctcgggccctcagg

SEQ ID NO: 400353 - DNA, 20 bp, human
gcgctgcctagacatcgctg

SEQ ID NO: 400354 - DNA, 20 bp, human
ggatccagtcttgcctgtat

SEQ ID NO: 400355 - DNA, 20 bp, human
gtgggcaagtcttgtctctc

SEQ ID NO: 400356 - DNA, 20 bp, human
gtaaacctccccttctgcta

SEQ ID NO: 400357 - DNA, 20 bp, human
gtacctggtacctacactgg

SEQ ID NO: 400358 - DNA, 20 bp, human
gaaggtgctgggccacaccg

SEQ ID NO: 400359 - DNA, 20 bp, human
ggatccctgaggccatcagt

SEQ ID NO: 400360 - DNA, 20 bp, human
gttaacctgcaaactccccc

SEQ ID NO: 400361 - DNA, 20 bp, human
ggctcccttagcagaagggg

SEQ ID NO: 400362 - DNA, 20 bp, human
gcctgatcggggagtctggc

SEQ ID NO: 400363 - DNA, 20 bp, human
gtaccaggtagtcccactga

SEQ ID NO: 400364 - DNA, 20 bp, human
gagagggcacatgttgtctt

SEQ ID NO: 400365 - DNA, 20 bp, human
gagaaagcctcagattgctg

SEQ ID NO: 400366 - DNA, 20 bp, human
gagctggaacaggtcaagga

SEQ ID NO: 400367 - DNA, 20 bp, human
gttgagaaaggcatccccct

SEQ ID NO: 400368 - DNA, 20 bp, human
gtcaaggagggtgtctctgt

SEQ ID NO: 400369 - DNA, 20 bp, human
gcatccccctggggctagag

SEQ ID NO: 400370 - DNA, 20 bp, human
ggccacggctggctccgtgt

SEQ ID NO: 400371 - DNA, 20 bp, human
ggcaggggagcagatgaggg

SEQ ID NO: 400372 - DNA, 20 bp, human
gtcagagctggaacaggtca

SEQ ID NO: 400373 - DNA, 20 bp, human
gtggggtgagcagagtgtcc

SEQ ID NO: 400374 - DNA, 20 bp, human
ggtctctgtaggagggctgc

SEQ ID NO: 400375 - DNA, 20 bp, human
gctgcccctctagccccagg

SEQ ID NO: 400376 - DNA, 20 bp, human
gagggctggcagggatacgt

SEQ ID NO: 400377 - DNA, 20 bp, human
ggacccattaagcatgagat

SEQ ID NO: 400378 - DNA, 20 bp, human
ggaaccttacagagagattg

SEQ ID NO: 400379 - DNA, 20 bp, human
gagaacccgagataaagagt

SEQ ID NO: 400380 - DNA, 20 bp, human
ggctccccaatctctctgta

SEQ ID NO: 400381 - DNA, 20 bp, human
gcagagagattggggagcat

SEQ ID NO: 400382 - DNA, 20 bp, human
gacccgagataaagagtggg

SEQ ID NO: 400383 - DNA, 20 bp, human
gataggatggcggtgcacca

SEQ ID NO: 400384 - DNA, 20 bp, human
gtgagaggatatgatgtgac

SEQ ID NO: 400385 - DNA, 20 bp, human
gattggggagcataggatgg

SEQ ID NO: 400386 - DNA, 20 bp, human
gagcccaggggtggacgaag

SEQ ID NO: 400387 - DNA, 20 bp, human
ggccatgagggtcaccgggg

SEQ ID NO: 400388 - DNA, 20 bp, human
gacgaccctcagtagggtgg

SEQ ID NO: 400389 - DNA, 20 bp, human
gggtcccccgggccaggtcc

SEQ ID NO: 400390 - DNA, 20 bp, human
gcccgccccggtgaccctca

SEQ ID NO: 400391 - DNA, 20 bp, human
gtaggagcctggggtccaga

SEQ ID NO: 400392 - DNA, 20 bp, human
gccagtggctctgtgctcat

SEQ ID NO: 400393 - DNA, 20 bp, human
gacgaaggggttcaggttac

SEQ ID NO: 400394 - DNA, 20 bp, human
gtccttgacgaccctcagta

SEQ ID NO: 400395 - DNA, 20 bp, human
gcagccacgctctgcgggga

SEQ ID NO: 400396 - DNA, 20 bp, human
gaggcctttaaccccttcaa

SEQ ID NO: 400397 - DNA, 20 bp, human
gtggcccttgaaggggttaa

SEQ ID NO: 400398 - DNA, 20 bp, human
gggcccggccccaaggaggt

SEQ ID NO: 400399 - DNA, 20 bp, human
ggcaagctcactctgaagga

SEQ ID NO: 400400 - DNA, 20 bp, human
ggcagcgtatctggcacggt

SEQ ID NO: 400401 - DNA, 20 bp, human
ggaaggggttaaaggcctcc

SEQ ID NO: 400402 - DNA, 20 bp, human
ggcgcaggcccgccctggaa

SEQ ID NO: 400403 - DNA, 20 bp, human
gccgggcgatgctaacccgg

SEQ ID NO: 400404 - DNA, 20 bp, human
gcgggccccctcctcccctt

SEQ ID NO: 400405 - DNA, 20 bp, human
gcggccccggccctttgtgg

SEQ ID NO: 400406 - DNA, 20 bp, human
gaggcgaggcgcaccgtgat

SEQ ID NO: 400407 - DNA, 20 bp, human
gccctcgggcccaaccacgc

SEQ ID NO: 400408 - DNA, 20 bp, human
ggggccgcgtctggagtgga

SEQ ID NO: 400409 - DNA, 20 bp, human
gggcccgaggggccagaagg

SEQ ID NO: 400410 - DNA, 20 bp, human
gaggggccagaaggcgggtc

SEQ ID NO: 400411 - DNA, 20 bp, human
ggcccggcactccccctgcg

SEQ ID NO: 400412 - DNA, 20 bp, human
gcgaggcgcaccgtgattgg

SEQ ID NO: 400413 - DNA, 20 bp, human
gggtgcgcctcgcctagctg

SEQ ID NO: 400414 - DNA, 20 bp, human
gggcactccccctgcgtggt

SEQ ID NO: 400415 - DNA, 20 bp, human
gtcgggcccaaccacgcagg

SEQ ID NO: 400416 - DNA, 20 bp, human
gtacaagaggcattcggggt

SEQ ID NO: 400417 - DNA, 20 bp, human
gggcccccggcacttctgat

SEQ ID NO: 400418 - DNA, 20 bp, human
gtggttgggtgatagacgag

SEQ ID NO: 400419 - DNA, 20 bp, human
gagaggcattcggggttggt

SEQ ID NO: 400420 - DNA, 20 bp, human
ggggcttacaagaggcattc

SEQ ID NO: 400421 - DNA, 20 bp, human
gtcctcgcaccgcctgtcac

SEQ ID NO: 400422 - DNA, 20 bp, human
gaggtgagaaggtctccctc

SEQ ID NO: 400423 - DNA, 20 bp, human
ggcgagatgattgactcctg

SEQ ID NO: 400424 - DNA, 20 bp, human
gagccaatcagaagtgccgg

SEQ ID NO: 400425 - DNA, 20 bp, human
ggcaacctgttcaggagtct

SEQ ID NO: 400426 - DNA, 20 bp, human
gcgcgcccggcgctactctg

SEQ ID NO: 400427 - DNA, 20 bp, human
gccctgctcccgctactcgg

SEQ ID NO: 400428 - DNA, 20 bp, human
ggcccggcgctactctgagg

SEQ ID NO: 400429 - DNA, 20 bp, human
gcgcccaacgccagcctccg

SEQ ID NO: 400430 - DNA, 20 bp, human
ggggcgggcaggcacgcggc

SEQ ID NO: 400431 - DNA, 20 bp, human
gggcaggcacgcggcgggtg

SEQ ID NO: 400432 - DNA, 20 bp, human
gctactctgaggcggctcgc

SEQ ID NO: 400433 - DNA, 20 bp, human
ggccgcctcgcagaagccgc

SEQ ID NO: 400434 - DNA, 20 bp, human
gggtgcgcgccgccgagtag

SEQ ID NO: 400435 - DNA, 20 bp, human
gcggccgcggaggctggcgt

SEQ ID NO: 400436 - DNA, 20 bp, human
ggctagcgtctggacgacta

SEQ ID NO: 400437 - DNA, 20 bp, human
gcgagagggccgaggaacga

SEQ ID NO: 400438 - DNA, 20 bp, human
ggcggcccgcggccaatgag

SEQ ID NO: 400439 - DNA, 20 bp, human
gggaggaagcggcgagtcgg

SEQ ID NO: 400440 - DNA, 20 bp, human
ggccccagcgtcccgaacca

SEQ ID NO: 400441 - DNA, 20 bp, human
ggaggaacgagggacgggga

SEQ ID NO: 400442 - DNA, 20 bp, human
ggacggggagggactgtacg

SEQ ID NO: 400443 - DNA, 20 bp, human
ggggccgaggaacgagggac

SEQ ID NO: 400444 - DNA, 20 bp, human
gtccctggttcgggacgctg

SEQ ID NO: 400445 - DNA, 20 bp, human
gcgcgaaccaggaacgcccg

SEQ ID NO: 400446 - DNA, 20 bp, human
ggaatagggaggtacggcgc

SEQ ID NO: 400447 - DNA, 20 bp, human
gtggagtgacactacgggac

SEQ ID NO: 400448 - DNA, 20 bp, human
ggggcaactcgccaataatc

SEQ ID NO: 400449 - DNA, 20 bp, human
gtctgggcgagaagcaacta

SEQ ID NO: 400450 - DNA, 20 bp, human
ggggcagggtgaaagcttct

SEQ ID NO: 400451 - DNA, 20 bp, human
gagggcagagttgacacctg

SEQ ID NO: 400452 - DNA, 20 bp, human
gcggcggagggagaccatat

SEQ ID NO: 400453 - DNA, 20 bp, human
gtaaactcgtccaaccgctg

SEQ ID NO: 400454 - DNA, 20 bp, human
gcactcagggttaggaggtc

SEQ ID NO: 400455 - DNA, 20 bp, human
ggacgtacgaggagttcctg

SEQ ID NO: 400456 - DNA, 20 bp, human
gggcggcagagacgtaagac

SEQ ID NO: 400457 - DNA, 20 bp, human
gcgcgcaagaagatggggcg

SEQ ID NO: 400458 - DNA, 20 bp, human
ggcgctgtggggcccccccg

SEQ ID NO: 400459 - DNA, 20 bp, human
gcccgcgaagtgggcgtgta

SEQ ID NO: 400460 - DNA, 20 bp, human
gcgagtcgcgcaagaagatg

SEQ ID NO: 400461 - DNA, 20 bp, human
ggggccaagggaggcttcgg

SEQ ID NO: 400462 - DNA, 20 bp, human
gagagcgagaacagaagagc

SEQ ID NO: 400463 - DNA, 20 bp, human
gaagaagatggggcgcgggc

SEQ ID NO: 400464 - DNA, 20 bp, human
gaagactggcaaagctggcg

SEQ ID NO: 400465 - DNA, 20 bp, human
gcgcgagcgaggtgcgagcg

SEQ ID NO: 400466 - DNA, 20 bp, human
ggcggcggggcgggatggtc

SEQ ID NO: 400467 - DNA, 20 bp, human
ggccccgccgcgatcctctg

SEQ ID NO: 400468 - DNA, 20 bp, human
ggcggcgcgtccacatgtgg

SEQ ID NO: 400469 - DNA, 20 bp, human
gccctcgccgcgcaggggag

SEQ ID NO: 400470 - DNA, 20 bp, human
gcagaggggcgggaactgga

SEQ ID NO: 400471 - DNA, 20 bp, human
ggggaccgaggcaagaggac

SEQ ID NO: 400472 - DNA, 20 bp, human
ggcccgcagaggatcgcggc

SEQ ID NO: 400473 - DNA, 20 bp, human
ggcctgccccgccagcaatg

SEQ ID NO: 400474 - DNA, 20 bp, human
gctcgcggcgcgtccacatg

SEQ ID NO: 400475 - DNA, 20 bp, human
gcgcagagccccattgctgg

SEQ ID NO: 400476 - DNA, 20 bp, human
gcccctgccggcccacgtaa

SEQ ID NO: 400477 - DNA, 20 bp, human
ggcccacgtaaaggcggaag

SEQ ID NO: 400478 - DNA, 20 bp, human
gaaaggcggaagcggttgag

SEQ ID NO: 400479 - DNA, 20 bp, human
ggttgagtggacgccatctt

SEQ ID NO: 400480 - DNA, 20 bp, human
gctgccggcccacgtaaagg

SEQ ID NO: 400481 - DNA, 20 bp, human
gtccgcgaacaaaatggagg

SEQ ID NO: 400482 - DNA, 20 bp, human
gtgggaagcccgccccctgc

SEQ ID NO: 400483 - DNA, 20 bp, human
gtcctgtgaccttcctaaga

SEQ ID NO: 400484 - DNA, 20 bp, human
gaagagacggtgttcgagtc

SEQ ID NO: 400485 - DNA, 20 bp, human
gaccgcttccgcctttacgt

SEQ ID NO: 400486 - DNA, 20 bp, human
ggaggcgggtcccaagtcgg

SEQ ID NO: 400487 - DNA, 20 bp, human
ggcccagcacagctactctg

SEQ ID NO: 400488 - DNA, 20 bp, human
gggtcgctctgggaccctgg

SEQ ID NO: 400489 - DNA, 20 bp, human
gccgccccgcggcagggaca

SEQ ID NO: 400490 - DNA, 20 bp, human
gctggaggcgggtcccaagt

SEQ ID NO: 400491 - DNA, 20 bp, human
ggcggagagactgaggccta

SEQ ID NO: 400492 - DNA, 20 bp, human
gtctctccgcagctgagact

SEQ ID NO: 400493 - DNA, 20 bp, human
gccgcgcaacagctcctatt

SEQ ID NO: 400494 - DNA, 20 bp, human
ggtcggcgggcgcgcctccc

SEQ ID NO: 400495 - DNA, 20 bp, human
gcggcgggcggggtcgctct

SEQ ID NO: 400496 - DNA, 20 bp, human
gtgcccgccagccgtggctt

SEQ ID NO: 400497 - DNA, 20 bp, human
gcagctggaggggcgagaag

SEQ ID NO: 400498 - DNA, 20 bp, human
ggtcctcgggaccagctgga

SEQ ID NO: 400499 - DNA, 20 bp, human
gtggccacgagcccaagcca

SEQ ID NO: 400500 - DNA, 20 bp, human
ggggcggtgcccgccagccg

SEQ ID NO: 400501 - DNA, 20 bp, human
ggcaggggccccgccctatc

SEQ ID NO: 400502 - DNA, 20 bp, human
gaatgaaaacaccgccacgt

SEQ ID NO: 400503 - DNA, 20 bp, human
gccgccgcaagggtgacagg

SEQ ID NO: 400504 - DNA, 20 bp, human
ggcgttacgaagccaggggc

SEQ ID NO: 400505 - DNA, 20 bp, human
ggggccgccgcaagggtgac

SEQ ID NO: 400506 - DNA, 20 bp, human
gtcaccgcctgcctgggctt

SEQ ID NO: 400507 - DNA, 20 bp, human
gcgcaggcgtggggacgcgt

SEQ ID NO: 400508 - DNA, 20 bp, human
ggagcggcgcagtcgcactg

SEQ ID NO: 400509 - DNA, 20 bp, human
ggcggccgctcatgcgcatg

SEQ ID NO: 400510 - DNA, 20 bp, human
ggctcgaggccgtgcgtcgc

SEQ ID NO: 400511 - DNA, 20 bp, human
gccacgcctgcgtgatccac

SEQ ID NO: 400512 - DNA, 20 bp, human
gcggggccgcgcaggcgtac

SEQ ID NO: 400513 - DNA, 20 bp, human
gtctgccccatgcgcatgag

SEQ ID NO: 400514 - DNA, 20 bp, human
ggcctgggcttgggttccgg

SEQ ID NO: 400515 - DNA, 20 bp, human
ggccattgagtgttattaag

SEQ ID NO: 400516 - DNA, 20 bp, human
gaggctggccaagctcaggc

SEQ ID NO: 400517 - DNA, 20 bp, human
gagctctgacagttcttaaa

SEQ ID NO: 400518 - DNA, 20 bp, human
ggctgcggaagaggcatatc

SEQ ID NO: 400519 - DNA, 20 bp, human
gcccccaagggctgcggaag

SEQ ID NO: 400520 - DNA, 20 bp, human
gaggctatgacttcacacta

SEQ ID NO: 400521 - DNA, 20 bp, human
ggcaggaaaagttttttcag

SEQ ID NO: 400522 - DNA, 20 bp, human
gtggggtaacagtatctcct

SEQ ID NO: 400523 - DNA, 20 bp, human
gctacagtagtgaaagacct

SEQ ID NO: 400524 - DNA, 20 bp, human
gcccaggcaggcgggtgtgt

SEQ ID NO: 400525 - DNA, 20 bp, human
gagtagtgaaagacctaggc

SEQ ID NO: 400526 - DNA, 20 bp, human
gccagcctgcggtttctggc

SEQ ID NO: 400527 - DNA, 20 bp, human
gccgcggctacccagagtca

SEQ ID NO: 400528 - DNA, 20 bp, human
gccgctggggttcggacagg

SEQ ID NO: 400529 - DNA, 20 bp, human
gaaactgtgaaggccaccaa

SEQ ID NO: 400530 - DNA, 20 bp, human
gacggagcttaggagacctt

SEQ ID NO: 400531 - DNA, 20 bp, human
ggatgagcccatttacctga

SEQ ID NO: 400532 - DNA, 20 bp, human
ggcccagggaagttttgctc

SEQ ID NO: 400533 - DNA, 20 bp, human
gctgcctcccggctctggaa

SEQ ID NO: 400534 - DNA, 20 bp, human
gttggcagccacccagaggt

SEQ ID NO: 400535 - DNA, 20 bp, human
gtcctttgagccatgaggat

SEQ ID NO: 400536 - DNA, 20 bp, human
gcctgcccccgacaacgggt

SEQ ID NO: 400537 - DNA, 20 bp, human
gggaccccacccgttgtcgg

SEQ ID NO: 400538 - DNA, 20 bp, human
gagagcctgcccccgacaac

SEQ ID NO: 400539 - DNA, 20 bp, human
gggcaaggaagggaatgacg

SEQ ID NO: 400540 - DNA, 20 bp, human
gctagagaggacccggagca

SEQ ID NO: 400541 - DNA, 20 bp, human
gtccgagagaatctgagctg

SEQ ID NO: 400542 - DNA, 20 bp, human
gcgtgtcacaggtcaggaat

SEQ ID NO: 400543 - DNA, 20 bp, human
gttcgcagtgagcgtgtcac

SEQ ID NO: 400544 - DNA, 20 bp, human
ggcctgcactctgtacgtga

SEQ ID NO: 400545 - DNA, 20 bp, human
ggtgggaccccacccgttgt

SEQ ID NO: 400546 - DNA, 20 bp, human
gccctcagggcccagacgaa

SEQ ID NO: 400547 - DNA, 20 bp, human
gctagggatagagatgtccg

SEQ ID NO: 400548 - DNA, 20 bp, human
gcctcagggcgcgcccaggt

SEQ ID NO: 400549 - DNA, 20 bp, human
gctgcagccgtccgccctca

SEQ ID NO: 400550 - DNA, 20 bp, human
gtgggtgcatccgctagcca

SEQ ID NO: 400551 - DNA, 20 bp, human
gatagagatgtccggggact

SEQ ID NO: 400552 - DNA, 20 bp, human
ggggctggggcggcggttag

SEQ ID NO: 400553 - DNA, 20 bp, human
gggaatggggcagggtccta

SEQ ID NO: 400554 - DNA, 20 bp, human
gcggggcggagcgggtttgg

SEQ ID NO: 400555 - DNA, 20 bp, human
gctagcggatgcacccacgc

SEQ ID NO: 400556 - DNA, 20 bp, human
gggcgcctggctcccgagtc

SEQ ID NO: 400557 - DNA, 20 bp, human
gagccccgaactggtgggca

SEQ ID NO: 400558 - DNA, 20 bp, human
gagagctctgagccccgaac

SEQ ID NO: 400559 - DNA, 20 bp, human
gtaccccttgcccaccagtt

SEQ ID NO: 400560 - DNA, 20 bp, human
gctctgagccccgaactggt

SEQ ID NO: 400561 - DNA, 20 bp, human
gggtatgtgcccaataaccg

SEQ ID NO: 400562 - DNA, 20 bp, human
gccttggagagacaggttgc

SEQ ID NO: 400563 - DNA, 20 bp, human
gcgtaagttaaaggtctgca

SEQ ID NO: 400564 - DNA, 20 bp, human
gcatcagaccttggagagac

SEQ ID NO: 400565 - DNA, 20 bp, human
gaagtcaacgcgtaagttaa

SEQ ID NO: 400566 - DNA, 20 bp, human
gcgctccggggcttttgcgc

SEQ ID NO: 400567 - DNA, 20 bp, human
gaaggcatcacggaagtcgt

SEQ ID NO: 400568 - DNA, 20 bp, human
gcacgcctgcgcaaaagccc

SEQ ID NO: 400569 - DNA, 20 bp, human
gggacttatagtttacgggt

SEQ ID NO: 400570 - DNA, 20 bp, human
gcgcaggcgtgctagccccg

SEQ ID NO: 400571 - DNA, 20 bp, human
gcaaaagccccggagcgagt

SEQ ID NO: 400572 - DNA, 20 bp, human
gccctgggacttatagttta

SEQ ID NO: 400573 - DNA, 20 bp, human
gctcgcgcggacttcgggat

SEQ ID NO: 400574 - DNA, 20 bp, human
gacgggttggcggggatgaa

SEQ ID NO: 400575 - DNA, 20 bp, human
gggaaaccgtcccttctgaa

SEQ ID NO: 400576 - DNA, 20 bp, human
gttctgctaggctgtcccgg

SEQ ID NO: 400577 - DNA, 20 bp, human
ggggaggctcggcactcaca

SEQ ID NO: 400578 - DNA, 20 bp, human
ggcggccgccgagacgtccc

SEQ ID NO: 400579 - DNA, 20 bp, human
gaggacggggtccgagttcc

SEQ ID NO: 400580 - DNA, 20 bp, human
gcggctgcctccaagcccgg

SEQ ID NO: 400581 - DNA, 20 bp, human
ggacgggcctgtggtgtccc

SEQ ID NO: 400582 - DNA, 20 bp, human
gtgggagagaggacctgcta

SEQ ID NO: 400583 - DNA, 20 bp, human
gggcgcgctccgcgatgagg

SEQ ID NO: 400584 - DNA, 20 bp, human
gcggccagggcgtgcgaggc

SEQ ID NO: 400585 - DNA, 20 bp, human
ggcggagcctcgggcgaagg

SEQ ID NO: 400586 - DNA, 20 bp, human
gcacctcgctgcgatagggg

SEQ ID NO: 400587 - DNA, 20 bp, human
gggatgcgcgtcgaggagaa

SEQ ID NO: 400588 - DNA, 20 bp, human
ggagagagggatgcgcgtcg

SEQ ID NO: 400589 - DNA, 20 bp, human
gagagagagcgagagcgctt

SEQ ID NO: 400590 - DNA, 20 bp, human
gtaggggcggttccgagttg

SEQ ID NO: 400591 - DNA, 20 bp, human
gagacccaagggtgggcagt

SEQ ID NO: 400592 - DNA, 20 bp, human
ggaggggcggagaaagccaa

SEQ ID NO: 400593 - DNA, 20 bp, human
gggcgtgcgcgcactctagt

SEQ ID NO: 400594 - DNA, 20 bp, human
gcggcacctcgctgcgatag

SEQ ID NO: 400595 - DNA, 20 bp, human
gcaacggagcagccccaact

SEQ ID NO: 400596 - DNA, 20 bp, human
gctcgcgggatccgcaccgc

SEQ ID NO: 400597 - DNA, 20 bp, human
ggaaagaaggggacgcggct

SEQ ID NO: 400598 - DNA, 20 bp, human
gcccctccgagctgctcccg

SEQ ID NO: 400599 - DNA, 20 bp, human
gccctcctccgcgcacaaac

SEQ ID NO: 400600 - DNA, 20 bp, human
gactccggacagttaggagg

SEQ ID NO: 400601 - DNA, 20 bp, human
gcggggcggtgactaaggtg

SEQ ID NO: 400602 - DNA, 20 bp, human
gccgagctgctcccgcggtg

SEQ ID NO: 400603 - DNA, 20 bp, human
gctgggcggggcggtgacta

SEQ ID NO: 400604 - DNA, 20 bp, human
gtgggggattacttaggggg

SEQ ID NO: 400605 - DNA, 20 bp, human
gtgtcaggccgcctcctctc

SEQ ID NO: 400606 - DNA, 20 bp, human
ggggctgcgaagaagtcttg

SEQ ID NO: 400607 - DNA, 20 bp, human
gaaaatgggccgaaagtttt

SEQ ID NO: 400608 - DNA, 20 bp, human
gtcccaggcgcttttgagag

SEQ ID NO: 400609 - DNA, 20 bp, human
gaaacgcggggtcaccccca

SEQ ID NO: 400610 - DNA, 20 bp, human
gaagaagtcttggggatgta

SEQ ID NO: 400611 - DNA, 20 bp, human
gctctctgcaggcgtgtgtc

SEQ ID NO: 400612 - DNA, 20 bp, human
gaaaacgcctggtagaagtc

SEQ ID NO: 400613 - DNA, 20 bp, human
gcttcgcagcccaaaacttt

SEQ ID NO: 400614 - DNA, 20 bp, human
ggggcgtaatcacaccttac

SEQ ID NO: 400615 - DNA, 20 bp, human
gtcggggccagacttctacc

SEQ ID NO: 400616 - DNA, 20 bp, human
ggggcccggggtgacgtcga

SEQ ID NO: 400617 - DNA, 20 bp, human
ggcgtgggagggtgtcccaa

SEQ ID NO: 400618 - DNA, 20 bp, human
gggttaggggcgcagacaat

SEQ ID NO: 400619 - DNA, 20 bp, human
gccgcctcgccgcccgcggt

SEQ ID NO: 400620 - DNA, 20 bp, human
ggagggtgtcccaaggggag

SEQ ID NO: 400621 - DNA, 20 bp, human
gagctctcggctcagacggg

SEQ ID NO: 400622 - DNA, 20 bp, human
gaggggtccgcggccagtgc

SEQ ID NO: 400623 - DNA, 20 bp, human
ggcgccctggtgccacagtg

SEQ ID NO: 400624 - DNA, 20 bp, human
ggcaccagggcgcaccggtt

SEQ ID NO: 400625 - DNA, 20 bp, human
gtccgggcctgcactggccg

SEQ ID NO: 400626 - DNA, 20 bp, human
ggaggcgtgtacgagtcccg

SEQ ID NO: 400627 - DNA, 20 bp, human
ggcaacagagggaaaggtgt

SEQ ID NO: 400628 - DNA, 20 bp, human
gactgcgtccgctggggact

SEQ ID NO: 400629 - DNA, 20 bp, human
gcctgtgtgtggagcgcgct

SEQ ID NO: 400630 - DNA, 20 bp, human
gccctctgttgccctcagca

SEQ ID NO: 400631 - DNA, 20 bp, human
ggaggccactgcgtccgctg

SEQ ID NO: 400632 - DNA, 20 bp, human
gcccacgtgacgtcacgcgg

SEQ ID NO: 400633 - DNA, 20 bp, human
gaccgcgaggtgtgtgtgcc

SEQ ID NO: 400634 - DNA, 20 bp, human
ggtgggagcgtccctgctga

SEQ ID NO: 400635 - DNA, 20 bp, human
gtaccccacgtgacgtcacg

SEQ ID NO: 400636 - DNA, 20 bp, human
gcaagcctgaacccaggcgt

SEQ ID NO: 400637 - DNA, 20 bp, human
gcattcgcctggtcaaggct

SEQ ID NO: 400638 - DNA, 20 bp, human
gaccctctcccccgacgcct

SEQ ID NO: 400639 - DNA, 20 bp, human
ggcacccggggtactcagag

SEQ ID NO: 400640 - DNA, 20 bp, human
gtggccacctccttcttcag

SEQ ID NO: 400641 - DNA, 20 bp, human
ggggtgtagtaaccttccta

SEQ ID NO: 400642 - DNA, 20 bp, human
ggccttggcgaccccagatc

SEQ ID NO: 400643 - DNA, 20 bp, human
gacctgatctggggtcgcca

SEQ ID NO: 400644 - DNA, 20 bp, human
gggcaggagaagcacacgtc

SEQ ID NO: 400645 - DNA, 20 bp, human
gggctgcattcgcctggtca

SEQ ID NO: 400646 - DNA, 20 bp, human
ggctgcgcgaccaacaccta

SEQ ID NO: 400647 - DNA, 20 bp, human
gggcgggcgccgccggtcag

SEQ ID NO: 400648 - DNA, 20 bp, human
ggacagagtactaagttctc

SEQ ID NO: 400649 - DNA, 20 bp, human
gcgcggacgccactgaccgg

SEQ ID NO: 400650 - DNA, 20 bp, human
ggtactctgtcgagttacaa

SEQ ID NO: 400651 - DNA, 20 bp, human
gcgggccccacgcgtgtcgc

SEQ ID NO: 400652 - DNA, 20 bp, human
gccccgcggacgccactgac

SEQ ID NO: 400653 - DNA, 20 bp, human
ggggactcgctcactacagc

SEQ ID NO: 400654 - DNA, 20 bp, human
gaaagcccgctgtaaacctt

SEQ ID NO: 400655 - DNA, 20 bp, human
ggggtctcagtctggagccg

SEQ ID NO: 400656 - DNA, 20 bp, human
gcccgcgcctggctcgaatt

SEQ ID NO: 400657 - DNA, 20 bp, human
gcggaggcggcgggttaagg

SEQ ID NO: 400658 - DNA, 20 bp, human
gagtcgaggacccggagctg

SEQ ID NO: 400659 - DNA, 20 bp, human
ggccgcgcctaattcgagcc

SEQ ID NO: 400660 - DNA, 20 bp, human
gcccggccagaggggctcga

SEQ ID NO: 400661 - DNA, 20 bp, human
gccgccgcgctcggcctccc

SEQ ID NO: 400662 - DNA, 20 bp, human
gaggggctcgaaggcgcgtt

SEQ ID NO: 400663 - DNA, 20 bp, human
gaggcgcgggacgcgtcccc

SEQ ID NO: 400664 - DNA, 20 bp, human
gtccggctgccccggccaga

SEQ ID NO: 400665 - DNA, 20 bp, human
gaggggacgcccgccgcgct

SEQ ID NO: 400666 - DNA, 20 bp, human
ggccgcgcctggagcctgat

SEQ ID NO: 400667 - DNA, 20 bp, human
ggtcccgagatgatgagatg

SEQ ID NO: 400668 - DNA, 20 bp, human
gccccgcatctcatcatctc

SEQ ID NO: 400669 - DNA, 20 bp, human
gggctcttattggtggagag

SEQ ID NO: 400670 - DNA, 20 bp, human
gcaaccttgggggaaagcgt

SEQ ID NO: 400671 - DNA, 20 bp, human
gtctggacacgctgtccctg

SEQ ID NO: 400672 - DNA, 20 bp, human
ggggtaacccagatgttggt

SEQ ID NO: 400673 - DNA, 20 bp, human
gcaggctccaggcgcggcca

SEQ ID NO: 400674 - DNA, 20 bp, human
ggacctcaggctcttattgg

SEQ ID NO: 400675 - DNA, 20 bp, human
gggacagcgtgtccagacct

SEQ ID NO: 400676 - DNA, 20 bp, human
ggggaggcgcgcagagcttt

SEQ ID NO: 400677 - DNA, 20 bp, human
gtcgctgcgcctggggaatt

SEQ ID NO: 400678 - DNA, 20 bp, human
ggatgaggtgaggcggggaa

SEQ ID NO: 400679 - DNA, 20 bp, human
gtggcctggagcttccctaa

SEQ ID NO: 400680 - DNA, 20 bp, human
gagagcccacggatgctctt

SEQ ID NO: 400681 - DNA, 20 bp, human
ggaggggagcagagcggacg

SEQ ID NO: 400682 - DNA, 20 bp, human
gtgggcccagcgagcgataa

SEQ ID NO: 400683 - DNA, 20 bp, human
ggctgtgggcgaggcggtcc

SEQ ID NO: 400684 - DNA, 20 bp, human
gcccctccgggcgcagccga

SEQ ID NO: 400685 - DNA, 20 bp, human
gcaggccaaagagcatccgt

SEQ ID NO: 400686 - DNA, 20 bp, human
ggaggcggctgctacaccta

SEQ ID NO: 400687 - DNA, 20 bp, human
gcggtggcgcggtgtcggca

SEQ ID NO: 400688 - DNA, 20 bp, human
gtggcgcgcgggagccccga

SEQ ID NO: 400689 - DNA, 20 bp, human
ggcgtcccgtcgcagcgtgc

SEQ ID NO: 400690 - DNA, 20 bp, human
gacacgcgcggcccttaggg

SEQ ID NO: 400691 - DNA, 20 bp, human
gggccgtcacccatagaagt

SEQ ID NO: 400692 - DNA, 20 bp, human
gctgctcccgcacgctgcga

SEQ ID NO: 400693 - DNA, 20 bp, human
gtaagggccgcgcgtgtccc

SEQ ID NO: 400694 - DNA, 20 bp, human
ggggcgcttggggcgcagga

SEQ ID NO: 400695 - DNA, 20 bp, human
gggctctcattggacgggac

SEQ ID NO: 400696 - DNA, 20 bp, human
gggaggggcgcgtgattgac

SEQ ID NO: 400697 - DNA, 20 bp, human
gcccgcccggcccacaactc

SEQ ID NO: 400698 - DNA, 20 bp, human
gacaactcgggctccgggaa

SEQ ID NO: 400699 - DNA, 20 bp, human
gtgggcccgcgaggaatcga

SEQ ID NO: 400700 - DNA, 20 bp, human
gcggcccacaactcgggctc

SEQ ID NO: 400701 - DNA, 20 bp, human
gcgaagccccgcggcgtccg

SEQ ID NO: 400702 - DNA, 20 bp, human
gcgggcaggtcaggatcaga

SEQ ID NO: 400703 - DNA, 20 bp, human
gggaccgcggcggtagcaga

SEQ ID NO: 400704 - DNA, 20 bp, human
gaatcagcgcccgcggccta

SEQ ID NO: 400705 - DNA, 20 bp, human
gggaccctctgctaccgccg

SEQ ID NO: 400706 - DNA, 20 bp, human
gcgggtgcgcgggtgtgcgc

SEQ ID NO: 400707 - DNA, 20 bp, human
ggcgtcgctgggccctcctg

SEQ ID NO: 400708 - DNA, 20 bp, human
ggggcggcgctgcgccaggt

SEQ ID NO: 400709 - DNA, 20 bp, human
ggggtgtgcgcgggctccga

SEQ ID NO: 400710 - DNA, 20 bp, human
gagctcccgggccgcgtcct

SEQ ID NO: 400711 - DNA, 20 bp, human
gggcccccgcctgctgccgt

SEQ ID NO: 400712 - DNA, 20 bp, human
gcgcacccgcggccgcagga

SEQ ID NO: 400713 - DNA, 20 bp, human
gacgggagcccgaaccgcgg

SEQ ID NO: 400714 - DNA, 20 bp, human
gacacccacggcagcaggcg

SEQ ID NO: 400715 - DNA, 20 bp, human
gggagcccgaaccgcggcgg

SEQ ID NO: 400716 - DNA, 20 bp, human
gcctccggagcgcccagccg

SEQ ID NO: 400717 - DNA, 20 bp, human
gcctccccggctgggcgctc

SEQ ID NO: 400718 - DNA, 20 bp, human
ggcccgggacacccccccgg

SEQ ID NO: 400719 - DNA, 20 bp, human
ggggcgctccggaggacttg

SEQ ID NO: 400720 - DNA, 20 bp, human
gcggctgccgccttagcccg

SEQ ID NO: 400721 - DNA, 20 bp, human
gccgccttagcccgcgggac

SEQ ID NO: 400722 - DNA, 20 bp, human
ggccgaggatggggttacct

SEQ ID NO: 400723 - DNA, 20 bp, human
gccgggggcgggccgaggat

SEQ ID NO: 400724 - DNA, 20 bp, human
gcgcccccgggggggtgtcc

SEQ ID NO: 400725 - DNA, 20 bp, human
gcccgggcctaggggacagg

SEQ ID NO: 400726 - DNA, 20 bp, human
gccgccagaggctgccaagg

SEQ ID NO: 400727 - DNA, 20 bp, human
gaggcggggtggccagcgcg

SEQ ID NO: 400728 - DNA, 20 bp, human
gactctcgcgcgctggtccc

SEQ ID NO: 400729 - DNA, 20 bp, human
gacgttcttcagccagacta

SEQ ID NO: 400730 - DNA, 20 bp, human
ggaagtggctttccccacat

SEQ ID NO: 400731 - DNA, 20 bp, human
gtggagcgcgctgccgccag

SEQ ID NO: 400732 - DNA, 20 bp, human
ggatgggggcaggacgcggg

SEQ ID NO: 400733 - DNA, 20 bp, human
gaggtcgggtctcccaacca

SEQ ID NO: 400734 - DNA, 20 bp, human
gtcttcagccagactaggga

SEQ ID NO: 400735 - DNA, 20 bp, human
gtcttccacggactgagaga

SEQ ID NO: 400736 - DNA, 20 bp, human
gacggctagagggactctaa

SEQ ID NO: 400737 - DNA, 20 bp, human
gaaggcagagcgtagcggag

SEQ ID NO: 400738 - DNA, 20 bp, human
gagcggcaacacagggacca

SEQ ID NO: 400739 - DNA, 20 bp, human
gaggggcaagcggcaacaca

SEQ ID NO: 400740 - DNA, 20 bp, human
ggtacctgactgatgaagac

SEQ ID NO: 400741 - DNA, 20 bp, human
gcacagggaccacggctaga

SEQ ID NO: 400742 - DNA, 20 bp, human
gcagctggggacagcattag

SEQ ID NO: 400743 - DNA, 20 bp, human
ggacacaggggcgacagctg

SEQ ID NO: 400744 - DNA, 20 bp, human
gctctggggctcgccgttga

SEQ ID NO: 400745 - DNA, 20 bp, human
ggtcttccccgcacaatcaa

SEQ ID NO: 400746 - DNA, 20 bp, human
gtgcctgctaatggtcactg

SEQ ID NO: 400747 - DNA, 20 bp, human
gtcgtggaaagcccggggcg

SEQ ID NO: 400748 - DNA, 20 bp, human
gccccgggctttccacgagg

SEQ ID NO: 400749 - DNA, 20 bp, human
gaaggcaggaagctgtatgg

SEQ ID NO: 400750 - DNA, 20 bp, human
gaggacagagagcgtcctga

SEQ ID NO: 400751 - DNA, 20 bp, human
gtccgagccaaagacaggcc

SEQ ID NO: 400752 - DNA, 20 bp, human
ggccgcctcgtggaaagccc

SEQ ID NO: 400753 - DNA, 20 bp, human
gtgaccattagcaggcaccc

SEQ ID NO: 400754 - DNA, 20 bp, human
gaggcctgggtgcctgctaa

SEQ ID NO: 400755 - DNA, 20 bp, human
gctgtgactgcccccaggac

SEQ ID NO: 400756 - DNA, 20 bp, human
gaggctggtggcagccgtgt

SEQ ID NO: 400757 - DNA, 20 bp, human
gagcaactgagtgctggtaa

SEQ ID NO: 400758 - DNA, 20 bp, human
gaaggatagcaactgagtgc

SEQ ID NO: 400759 - DNA, 20 bp, human
gtgacccacaggagaatcac

SEQ ID NO: 400760 - DNA, 20 bp, human
gaggagaatcactggggcgc

SEQ ID NO: 400761 - DNA, 20 bp, human
ggccccagtgattctcctgt

SEQ ID NO: 400762 - DNA, 20 bp, human
gttcctccaggtaagctctc

SEQ ID NO: 400763 - DNA, 20 bp, human
gatccagagagcttacctgg

SEQ ID NO: 400764 - DNA, 20 bp, human
gagctctctggatgacccac

SEQ ID NO: 400765 - DNA, 20 bp, human
ggcgaaaactgcatttttca

SEQ ID NO: 400766 - DNA, 20 bp, human
gcggggccccagcgcgcttc

SEQ ID NO: 400767 - DNA, 20 bp, human
ggcgcggggtgcttcggcga

SEQ ID NO: 400768 - DNA, 20 bp, human
gggggctccaagtccgagag

SEQ ID NO: 400769 - DNA, 20 bp, human
gtccgagagaggcgaggcga

SEQ ID NO: 400770 - DNA, 20 bp, human
ggggagcgagccgtgcgccc

SEQ ID NO: 400771 - DNA, 20 bp, human
ggagaagaaatcagagccgg

SEQ ID NO: 400772 - DNA, 20 bp, human
gcacagcccgaagcgcgctg

SEQ ID NO: 400773 - DNA, 20 bp, human
gaatgggggacgggctggaa

SEQ ID NO: 400774 - DNA, 20 bp, human
ggtcaggcagcgggactctc

SEQ ID NO: 400775 - DNA, 20 bp, human
ggcggtgcggagggagatgc

SEQ ID NO: 400776 - DNA, 20 bp, human
gcccctgcgcccgcgggaca

SEQ ID NO: 400777 - DNA, 20 bp, human
gcccgggagcgcgcatggaa

SEQ ID NO: 400778 - DNA, 20 bp, human
gctgcaccccggagcaggga

SEQ ID NO: 400779 - DNA, 20 bp, human
gggacagggccgcctgcaca

SEQ ID NO: 400780 - DNA, 20 bp, human
ggggtggagtggaccagact

SEQ ID NO: 400781 - DNA, 20 bp, human
gtgcaggcggccctgtcccg

SEQ ID NO: 400782 - DNA, 20 bp, human
gtgcaagttagtgacgggtg

SEQ ID NO: 400783 - DNA, 20 bp, human
gtctggtccactccacccga

SEQ ID NO: 400784 - DNA, 20 bp, human
gagcacagcccggttggagg

SEQ ID NO: 400785 - DNA, 20 bp, human
gccacctgcaccccggagca

SEQ ID NO: 400786 - DNA, 20 bp, human
gtccccggagggcaatcgga

SEQ ID NO: 400787 - DNA, 20 bp, human
gagggcaatcggaagggagc

SEQ ID NO: 400788 - DNA, 20 bp, human
gcgagcgcgccccaggtagg

SEQ ID NO: 400789 - DNA, 20 bp, human
gccagtccccggagggcaat

SEQ ID NO: 400790 - DNA, 20 bp, human
gggcttgggtgacgagtggt

SEQ ID NO: 400791 - DNA, 20 bp, human
gagagggcttgggtgacgag

SEQ ID NO: 400792 - DNA, 20 bp, human
ggagcgagcgcgccccaggt

SEQ ID NO: 400793 - DNA, 20 bp, human
gcacaaacgcatctaccccc

SEQ ID NO: 400794 - DNA, 20 bp, human
gcctacccccgcgtgcgcgg

SEQ ID NO: 400795 - DNA, 20 bp, human
gaggcggatcctcctacctg

SEQ ID NO: 400796 - DNA, 20 bp, human
gggagcgtgggcagtctgtg

SEQ ID NO: 400797 - DNA, 20 bp, human
gcctccgcgcagttcccccg

SEQ ID NO: 400798 - DNA, 20 bp, human
gggctccagaaggtgcacgt

SEQ ID NO: 400799 - DNA, 20 bp, human
ggtcccagccaaggcaactt

SEQ ID NO: 400800 - DNA, 20 bp, human
ggctccccgggggaactgcg

SEQ ID NO: 400801 - DNA, 20 bp, human
gtgtggctccctaaaggtgg

SEQ ID NO: 400802 - DNA, 20 bp, human
ggagctgtgtggctccctaa

SEQ ID NO: 400803 - DNA, 20 bp, human
gctgtgtggctccctaaagg

SEQ ID NO: 400804 - DNA, 20 bp, human
ggaggcttgtgctcctcttg

SEQ ID NO: 400805 - DNA, 20 bp, human
ggggggaggaggcggatgta

SEQ ID NO: 400806 - DNA, 20 bp, human
gagaaatgggccaaagaagc

SEQ ID NO: 400807 - DNA, 20 bp, human
ggggctctcactgacagatg

SEQ ID NO: 400808 - DNA, 20 bp, human
gcctccttctcattctggga

SEQ ID NO: 400809 - DNA, 20 bp, human
gacactgtagctccaagaat

SEQ ID NO: 400810 - DNA, 20 bp, human
gttgctagaatgtggtggaa

SEQ ID NO: 400811 - DNA, 20 bp, human
ggctgggtccttaaccctga

SEQ ID NO: 400812 - DNA, 20 bp, human
ggcccagtgggggatctggg

SEQ ID NO: 400813 - DNA, 20 bp, human
ggattattaacaccttgggg

SEQ ID NO: 400814 - DNA, 20 bp, human
ggcagcctccttctcattct

SEQ ID NO: 400815 - DNA, 20 bp, human
gcataaagcaactccatctg

SEQ ID NO: 400816 - DNA, 20 bp, human
gactccatgcagtgattatg

SEQ ID NO: 400817 - DNA, 20 bp, human
gccccaaaagggatccagaa

SEQ ID NO: 400818 - DNA, 20 bp, human
gacacagcctggtccccaaa

SEQ ID NO: 400819 - DNA, 20 bp, human
ggaaaaggttgtggtgtgat

SEQ ID NO: 400820 - DNA, 20 bp, human
gcccagacaaatgcagaaga

SEQ ID NO: 400821 - DNA, 20 bp, human
gagagaatacactagatggt

SEQ ID NO: 400822 - DNA, 20 bp, human
gaggttgtggtgtgatggga

SEQ ID NO: 400823 - DNA, 20 bp, human
gcctccacataatcactgca

SEQ ID NO: 400824 - DNA, 20 bp, human
gagtgtgcataggtgggaaa

SEQ ID NO: 400825 - DNA, 20 bp, human
gcagtctcaaagtgctacag

SEQ ID NO: 400826 - DNA, 20 bp, human
ggggccccgagtggccggga

SEQ ID NO: 400827 - DNA, 20 bp, human
gagcccctcccggccactcg

SEQ ID NO: 400828 - DNA, 20 bp, human
gcgctcccggcgcgggtctc

SEQ ID NO: 400829 - DNA, 20 bp, human
ggcccgggaggggatcacgc

SEQ ID NO: 400830 - DNA, 20 bp, human
gaggggaggcggagagcggt

SEQ ID NO: 400831 - DNA, 20 bp, human
gcgctccgggcgctataaga

SEQ ID NO: 400832 - DNA, 20 bp, human
ggggaagcgggtagagcgtt

SEQ ID NO: 400833 - DNA, 20 bp, human
gccccggggcgggattgagg

SEQ ID NO: 400834 - DNA, 20 bp, human
gcgccggcgtgatcccctcc

SEQ ID NO: 400835 - DNA, 20 bp, human
gtccgggcgctataagaggg

SEQ ID NO: 400836 - DNA, 20 bp, human
gtgccccacccgcgacgggg

SEQ ID NO: 400837 - DNA, 20 bp, human
ggggcaggcggcgctgggaa

SEQ ID NO: 400838 - DNA, 20 bp, human
ggccccgccccgtcgcgggt

SEQ ID NO: 400839 - DNA, 20 bp, human
gaggcggggaggagggtacg

SEQ ID NO: 400840 - DNA, 20 bp, human
ggcggtggggccaatggggc

SEQ ID NO: 400841 - DNA, 20 bp, human
ggccggagggcggggcaatg

SEQ ID NO: 400842 - DNA, 20 bp, human
gcgagggcggtggggccaat

SEQ ID NO: 400843 - DNA, 20 bp, human
ggctgaacgtgaagcccccc

SEQ ID NO: 400844 - DNA, 20 bp, human
gcggggaggagggtacgagg

SEQ ID NO: 400845 - DNA, 20 bp, human
ggggacgcatctggagtcgg

SEQ ID NO: 400846 - DNA, 20 bp, human
gtggtccatccaggttaggg

SEQ ID NO: 400847 - DNA, 20 bp, human
gtgccaaggcacagcctaaa

SEQ ID NO: 400848 - DNA, 20 bp, human
gggctctgcgtggtccatcc

SEQ ID NO: 400849 - DNA, 20 bp, human
ggctgtgtggtggactcttc

SEQ ID NO: 400850 - DNA, 20 bp, human
ggcgtggtccatccaggtta

SEQ ID NO: 400851 - DNA, 20 bp, human
gtcctcagctgacatcactc

SEQ ID NO: 400852 - DNA, 20 bp, human
gcaaaacgagctcatggccc

SEQ ID NO: 400853 - DNA, 20 bp, human
gctcacccccctaacctgga

SEQ ID NO: 400854 - DNA, 20 bp, human
gtggctcctggttcttgtca

SEQ ID NO: 400855 - DNA, 20 bp, human
gatccccaggcgtggaggca

SEQ ID NO: 400856 - DNA, 20 bp, human
gaggagccctagggcttgat

SEQ ID NO: 400857 - DNA, 20 bp, human
gcaagccctagggctcctcg

SEQ ID NO: 400858 - DNA, 20 bp, human
gcggcggcccaatcggaagg

SEQ ID NO: 400859 - DNA, 20 bp, human
gcgcggagccgggacgtgaa

SEQ ID NO: 400860 - DNA, 20 bp, human
gccgttcccatcaagcccta

SEQ ID NO: 400861 - DNA, 20 bp, human
gatgcggcggcccaatcgga

SEQ ID NO: 400862 - DNA, 20 bp, human
gcgggacgtgaaaggttaga

SEQ ID NO: 400863 - DNA, 20 bp, human
gcgcccgcgaaatctgatcc

SEQ ID NO: 400864 - DNA, 20 bp, human
gcatcccggatcagatttcg

SEQ ID NO: 400865 - DNA, 20 bp, human
gtaccgcgggactcggtagg

SEQ ID NO: 400866 - DNA, 20 bp, human
gttctcgggtcggaaatccc

SEQ ID NO: 400867 - DNA, 20 bp, human
gcctttgaggtaaggttctc

SEQ ID NO: 400868 - DNA, 20 bp, human
gcctagctggaggtgctcaa

SEQ ID NO: 400869 - DNA, 20 bp, human
gaatgccgcgcggaagccgg

SEQ ID NO: 400870 - DNA, 20 bp, human
gcccacgtttcttccgacca

SEQ ID NO: 400871 - DNA, 20 bp, human
gtccgaggccggaagtcaga

SEQ ID NO: 400872 - DNA, 20 bp, human
gggaagccggcggcgctgat

SEQ ID NO: 400873 - DNA, 20 bp, human
gggcttccgcgcggcattgt

SEQ ID NO: 400874 - DNA, 20 bp, human
gtgaggtaaggttctcgggt

SEQ ID NO: 400875 - DNA, 20 bp, human
gttgtgccgcagggctttaa

SEQ ID NO: 400876 - DNA, 20 bp, human
gcgtcggcgcgcctgttctg

SEQ ID NO: 400877 - DNA, 20 bp, human
gcacgcccagtggtcggccg

SEQ ID NO: 400878 - DNA, 20 bp, human
gcgagggcgacgcagttcgc

SEQ ID NO: 400879 - DNA, 20 bp, human
gcgaaggcccaggagaaacc

SEQ ID NO: 400880 - DNA, 20 bp, human
gcgtccggctccagttggag

SEQ ID NO: 400881 - DNA, 20 bp, human
ggcggggccgttttttcgtc

SEQ ID NO: 400882 - DNA, 20 bp, human
gacgcagttcgcaggcgcgt

SEQ ID NO: 400883 - DNA, 20 bp, human
ggatgggtgctagaaggcta

SEQ ID NO: 400884 - DNA, 20 bp, human
gggagcggttaacacgttcc

SEQ ID NO: 400885 - DNA, 20 bp, human
gacggccccgcctcccgcga

SEQ ID NO: 400886 - DNA, 20 bp, human
gggttgcagcgccgcgagaa

SEQ ID NO: 400887 - DNA, 20 bp, human
ggggtgcagcgggagtgcga

SEQ ID NO: 400888 - DNA, 20 bp, human
gcctgcatcccggtggaatc

SEQ ID NO: 400889 - DNA, 20 bp, human
gggtggggcaggaacggggg

SEQ ID NO: 400890 - DNA, 20 bp, human
gctagagtcctgcatcccgg

SEQ ID NO: 400891 - DNA, 20 bp, human
gcagctagagtcctgcatcc

SEQ ID NO: 400892 - DNA, 20 bp, human
gggaagtgtagtctcttcgc

SEQ ID NO: 400893 - DNA, 20 bp, human
ggcgaggggactggacaggt

SEQ ID NO: 400894 - DNA, 20 bp, human
gacacagtacacatcagctc

SEQ ID NO: 400895 - DNA, 20 bp, human
gactggacaggtgggaagat

SEQ ID NO: 400896 - DNA, 20 bp, human
gtgtcgggaagtgtagttcg

SEQ ID NO: 400897 - DNA, 20 bp, human
gcagctggggcgaatggccg

SEQ ID NO: 400898 - DNA, 20 bp, human
ggtgccgcgcgaggtattct

SEQ ID NO: 400899 - DNA, 20 bp, human
gccgctggcagcgcctcacg

SEQ ID NO: 400900 - DNA, 20 bp, human
gcgtgcgcgaggttgcgcgg

SEQ ID NO: 400901 - DNA, 20 bp, human
gaatggacgcacggcagctg

SEQ ID NO: 400902 - DNA, 20 bp, human
gccgcgcgaggtattctcgg

SEQ ID NO: 400903 - DNA, 20 bp, human
ggcgcctcacgcggcgtgtc

SEQ ID NO: 400904 - DNA, 20 bp, human
gaggcctgcgagtcgcgcga

SEQ ID NO: 400905 - DNA, 20 bp, human
gtcgtggccgtttgccccgg

SEQ ID NO: 400906 - DNA, 20 bp, human
gcaggcccagaagacgccac

SEQ ID NO: 400907 - DNA, 20 bp, human
gtaggccggtggcgtcttct

SEQ ID NO: 400908 - DNA, 20 bp, human
gttgcctgggggcctcgcag

SEQ ID NO: 400909 - DNA, 20 bp, human
gagagtcagcggaaccagcc

SEQ ID NO: 400910 - DNA, 20 bp, human
ggcagggggagatccagccc

SEQ ID NO: 400911 - DNA, 20 bp, human
gcccggcgcgggcgttgcct

SEQ ID NO: 400912 - DNA, 20 bp, human
ggactctgcctgtaggccgg

SEQ ID NO: 400913 - DNA, 20 bp, human
ggcccccgcctcccgacgca

SEQ ID NO: 400914 - DNA, 20 bp, human
ggagatcacgtcccgtgcgt

SEQ ID NO: 400915 - DNA, 20 bp, human
gccccaggcaacgcccgcgc

SEQ ID NO: 400916 - DNA, 20 bp, human
ggggcagctgagggaaaaga

SEQ ID NO: 400917 - DNA, 20 bp, human
gaaagctgaggggttgctca

SEQ ID NO: 400918 - DNA, 20 bp, human
gggttgctcaggggaaacgg

SEQ ID NO: 400919 - DNA, 20 bp, human
gcggggaggcggtacgctga

SEQ ID NO: 400920 - DNA, 20 bp, human
ggggttgtgcggggtcctga

SEQ ID NO: 400921 - DNA, 20 bp, human
gaaaacccaggggttgtgcg

SEQ ID NO: 400922 - DNA, 20 bp, human
gtgctcaggggaaacggggg

SEQ ID NO: 400923 - DNA, 20 bp, human
gctgacgggataaaagctga

SEQ ID NO: 400924 - DNA, 20 bp, human
gggtgcggacgggataaaaa

SEQ ID NO: 400925 - DNA, 20 bp, human
ggcgaacgggataaaaccca

SEQ ID NO: 400926 - DNA, 20 bp, human
ggggccccggtgaaaggctg

SEQ ID NO: 400927 - DNA, 20 bp, human
ggggtcgcggctccgccgga

SEQ ID NO: 400928 - DNA, 20 bp, human
gcccgcgcgcgtgttctcgc

SEQ ID NO: 400929 - DNA, 20 bp, human
gcccgtggggccccggtgaa

SEQ ID NO: 400930 - DNA, 20 bp, human
gggaggggtcgcggctccgc

SEQ ID NO: 400931 - DNA, 20 bp, human
gcaccggcgcctctaggacc

SEQ ID NO: 400932 - DNA, 20 bp, human
gggcggcgggaggtgcgcac

SEQ ID NO: 400933 - DNA, 20 bp, human
gtctctgggaagcagtgatt

SEQ ID NO: 400934 - DNA, 20 bp, human
ggcagtgccccgtgtgtttg

SEQ ID NO: 400935 - DNA, 20 bp, human
gcgcgtgttctcgcgggccg

SEQ ID NO: 400936 - DNA, 20 bp, human
ggctggagacgtgaagtcca

SEQ ID NO: 400937 - DNA, 20 bp, human
gaagtccaggggagcgagca

SEQ ID NO: 400938 - DNA, 20 bp, human
ggcggcgcgggagctagggc

SEQ ID NO: 400939 - DNA, 20 bp, human
ggacccaagcccaaaccata

SEQ ID NO: 400940 - DNA, 20 bp, human
gcactgaggccggaaggctg

SEQ ID NO: 400941 - DNA, 20 bp, human
gtgcctcgccgctgcctcct

SEQ ID NO: 400942 - DNA, 20 bp, human
gggcatagccggtgccaggc

SEQ ID NO: 400943 - DNA, 20 bp, human
gcccgggcccggtgcgcgca

SEQ ID NO: 400944 - DNA, 20 bp, human
gtccagcgaccctatggttt

SEQ ID NO: 400945 - DNA, 20 bp, human
gcccggtgcgcgcagggcac

SEQ ID NO: 400946 - DNA, 20 bp, human
gagcgcgcgctgctccttgg

SEQ ID NO: 400947 - DNA, 20 bp, human
gagcgcgtgttgggttgaag

SEQ ID NO: 400948 - DNA, 20 bp, human
gggggtgagggcgggtccga

SEQ ID NO: 400949 - DNA, 20 bp, human
gcgtgttgggttgaagagga

SEQ ID NO: 400950 - DNA, 20 bp, human
gccagctgagagcgcgtgtt

SEQ ID NO: 400951 - DNA, 20 bp, human
gtccgagggagcgtccctct

SEQ ID NO: 400952 - DNA, 20 bp, human
ggggcagggtcgaatgcggt

SEQ ID NO: 400953 - DNA, 20 bp, human
ggaggctcccacactggcga

SEQ ID NO: 400954 - DNA, 20 bp, human
ggaggagggtgtctccgaga

SEQ ID NO: 400955 - DNA, 20 bp, human
gtccgagagggacgctccct

SEQ ID NO: 400956 - DNA, 20 bp, human
gtactcgccggggccacctg

SEQ ID NO: 400957 - DNA, 20 bp, human
gaaggtggaagtactcgccg

SEQ ID NO: 400958 - DNA, 20 bp, human
ggtcagccccagggcatcac

SEQ ID NO: 400959 - DNA, 20 bp, human
gggccagaaggcgaacatgg

SEQ ID NO: 400960 - DNA, 20 bp, human
gaaggcgaacatggcggagc

SEQ ID NO: 400961 - DNA, 20 bp, human
gaggtcggaggtcagcccca

SEQ ID NO: 400962 - DNA, 20 bp, human
gaggggcgggccagcgaggt

SEQ ID NO: 400963 - DNA, 20 bp, human
gctcctgtgagtgggccaga

SEQ ID NO: 400964 - DNA, 20 bp, human
ggcctgcggcgcgttcggac

SEQ ID NO: 400965 - DNA, 20 bp, human
ggtgcctcgaggccccgatc

SEQ ID NO: 400966 - DNA, 20 bp, human
gatgatgttaggagacaggt

SEQ ID NO: 400967 - DNA, 20 bp, human
gctgtctcctaacatcatgc

SEQ ID NO: 400968 - DNA, 20 bp, human
ggtttgcttaattgtggctt

SEQ ID NO: 400969 - DNA, 20 bp, human
gacatcatgcaggaagtttc

SEQ ID NO: 400970 - DNA, 20 bp, human
gcatatgtactaaaaacaat

SEQ ID NO: 400971 - DNA, 20 bp, human
gatctgttcaaatgcaaggc

SEQ ID NO: 400972 - DNA, 20 bp, human
gctgacctctcacagaaact

SEQ ID NO: 400973 - DNA, 20 bp, human
gtaacttacactataataca

SEQ ID NO: 400974 - DNA, 20 bp, human
gttattgtagtatagaaata

SEQ ID NO: 400975 - DNA, 20 bp, human
gtgtactaaaaacaatgggg

SEQ ID NO: 400976 - DNA, 20 bp, human
gcgctgcgccgggacctcgg

SEQ ID NO: 400977 - DNA, 20 bp, human
gccgcgctgcgccgggacct

SEQ ID NO: 400978 - DNA, 20 bp, human
gccgggacctcggaggggcg

SEQ ID NO: 400979 - DNA, 20 bp, human
gtgggtcggccctgcagcgc

SEQ ID NO: 400980 - DNA, 20 bp, human
ggggcggagggactcctttg

SEQ ID NO: 400981 - DNA, 20 bp, human
gtcgactgcttggatctctc

SEQ ID NO: 400982 - DNA, 20 bp, human
gctcggaggggcgtggaggc

SEQ ID NO: 400983 - DNA, 20 bp, human
ggggacgggcgaagcgccgt

SEQ ID NO: 400984 - DNA, 20 bp, human
ggggaaagctgtcgactgct

SEQ ID NO: 400985 - DNA, 20 bp, human
gtgcggcctctggaatgtgg

SEQ ID NO: 400986 - DNA, 20 bp, human
gcccgcgcgcagcgcctcga

SEQ ID NO: 400987 - DNA, 20 bp, human
gccgagacgcgccccctcgt

SEQ ID NO: 400988 - DNA, 20 bp, human
gcacctgcgtcccagaccta

SEQ ID NO: 400989 - DNA, 20 bp, human
gcctggcaggggcagcgtaa

SEQ ID NO: 400990 - DNA, 20 bp, human
ggccgggcgcctgggttccc

SEQ ID NO: 400991 - DNA, 20 bp, human
ggcctcgagggcgggtccta

SEQ ID NO: 400992 - DNA, 20 bp, human
ggccctaggacccgccctcg

SEQ ID NO: 400993 - DNA, 20 bp, human
gcggctgggactgtcccacg

SEQ ID NO: 400994 - DNA, 20 bp, human
gggtctgggacgcaggtgag

SEQ ID NO: 400995 - DNA, 20 bp, human
gctgccccggaaacgggagg

SEQ ID NO: 400996 - DNA, 20 bp, human
gaatgcgcatgcagatgagg

SEQ ID NO: 400997 - DNA, 20 bp, human
gcagcggcggggttaagctc

SEQ ID NO: 400998 - DNA, 20 bp, human
gggcccaggggagctatctg

SEQ ID NO: 400999 - DNA, 20 bp, human
ggccgtctgggctcggatcc

SEQ ID NO: 401000 - DNA, 20 bp, human
gaggaatgcgcatgcagatg

SEQ ID NO: 401001 - DNA, 20 bp, human
gcggggcagtgcgtccgagc

SEQ ID NO: 401002 - DNA, 20 bp, human
ggctaatcgcatgcaaatga

SEQ ID NO: 401003 - DNA, 20 bp, human
gtcccggatccgagcccaga

SEQ ID NO: 401004 - DNA, 20 bp, human
gtctcagccgaggtcatcga

SEQ ID NO: 401005 - DNA, 20 bp, human
gacccaccgacgcactccca

SEQ ID NO: 401006 - DNA, 20 bp, human
gcctcccgaatctcccacgg

SEQ ID NO: 401007 - DNA, 20 bp, human
ggctcctcccgaatctccca

SEQ ID NO: 401008 - DNA, 20 bp, human
gggcctgggtgagaacgggg

SEQ ID NO: 401009 - DNA, 20 bp, human
gtgggtggagccgccggcgt

SEQ ID NO: 401010 - DNA, 20 bp, human
gggagtgggtggaaaagcag

SEQ ID NO: 401011 - DNA, 20 bp, human
ggcgccgaggaggaccccga

SEQ ID NO: 401012 - DNA, 20 bp, human
ggcggggcctgggtgagaac

SEQ ID NO: 401013 - DNA, 20 bp, human
ggagaggcgcggaggacgcg

SEQ ID NO: 401014 - DNA, 20 bp, human
gggtggaaaagcagaggcgg

SEQ ID NO: 401015 - DNA, 20 bp, human
gggagcctccgtgggagatt

SEQ ID NO: 401016 - DNA, 20 bp, human
gaagcccaggacaacagcat

SEQ ID NO: 401017 - DNA, 20 bp, human
gggcgtgcgcatccagtttc

SEQ ID NO: 401018 - DNA, 20 bp, human
ggcgacggccggcgtcaaag

SEQ ID NO: 401019 - DNA, 20 bp, human
gggccggcgtcaaaggggca

SEQ ID NO: 401020 - DNA, 20 bp, human
gcctccccgccgcagggaag

SEQ ID NO: 401021 - DNA, 20 bp, human
gacaacgcggaagtgattac

SEQ ID NO: 401022 - DNA, 20 bp, human
gggagcccggcaattggata

SEQ ID NO: 401023 - DNA, 20 bp, human
gcggcggagcggcccctgga

SEQ ID NO: 401024 - DNA, 20 bp, human
gggcggcagcgcgatctctt

SEQ ID NO: 401025 - DNA, 20 bp, human
gttgttctggccaatcctgc

SEQ ID NO: 401026 - DNA, 20 bp, human
gcctcgctgcgcatgctcgg

SEQ ID NO: 401027 - DNA, 20 bp, human
ggggacggacagccaatagt

SEQ ID NO: 401028 - DNA, 20 bp, human
ggcggcgcgctcccgaggaa

SEQ ID NO: 401029 - DNA, 20 bp, human
gtgaacgtgtggaaggggcg

SEQ ID NO: 401030 - DNA, 20 bp, human
gggacagccaatagtaggga

SEQ ID NO: 401031 - DNA, 20 bp, human
gggggcctgaacgtgtggaa

SEQ ID NO: 401032 - DNA, 20 bp, human
ggactgctcggaagacccgg

SEQ ID NO: 401033 - DNA, 20 bp, human
ggaggagcggagttttccta

SEQ ID NO: 401034 - DNA, 20 bp, human
ggaggcgcgcgcttagggcg

SEQ ID NO: 401035 - DNA, 20 bp, human
gcgcccaaagcctccaactc

SEQ ID NO: 401036 - DNA, 20 bp, human
gcggtcacctgacccggaag

SEQ ID NO: 401037 - DNA, 20 bp, human
ggacccggaagaggctggcc

SEQ ID NO: 401038 - DNA, 20 bp, human
gggtgcgggccacctaggcc

SEQ ID NO: 401039 - DNA, 20 bp, human
ggacccggcccgagtgcggg

SEQ ID NO: 401040 - DNA, 20 bp, human
gctgcccatcaaccttatag

SEQ ID NO: 401041 - DNA, 20 bp, human
gggccacctaggcctggcct

SEQ ID NO: 401042 - DNA, 20 bp, human
gtggccaggctcgcaggtgc

SEQ ID NO: 401043 - DNA, 20 bp, human
gggcacctctggcctcgagg

SEQ ID NO: 401044 - DNA, 20 bp, human
gacctgtccctgcctctata

SEQ ID NO: 401045 - DNA, 20 bp, human
gcacctgacccggaagaggc

SEQ ID NO: 401046 - DNA, 20 bp, human
gggcgtgatgggtactttac

SEQ ID NO: 401047 - DNA, 20 bp, human
ggacttggggcgggatcaaa

SEQ ID NO: 401048 - DNA, 20 bp, human
gttactgggtaagaggagac

SEQ ID NO: 401049 - DNA, 20 bp, human
gaaagtacccatcacgccca

SEQ ID NO: 401050 - DNA, 20 bp, human
ggggtactttactgggtaag

SEQ ID NO: 401051 - DNA, 20 bp, human
gtgatcccgccccaagtccg

SEQ ID NO: 401052 - DNA, 20 bp, human
gaggggctcaggcctaggaa

SEQ ID NO: 401053 - DNA, 20 bp, human
gggctggccggctagggact

SEQ ID NO: 401054 - DNA, 20 bp, human
gagaaaaccctgggcgtgat

SEQ ID NO: 401055 - DNA, 20 bp, human
gtgagcgggagaggtccgcg

SEQ ID NO: 401056 - DNA, 20 bp, human
gttgaccgggagaaacgaga

SEQ ID NO: 401057 - DNA, 20 bp, human
ggaaaagaagtcaataacgt

SEQ ID NO: 401058 - DNA, 20 bp, human
gcggaggggcgggccgtcag

SEQ ID NO: 401059 - DNA, 20 bp, human
gggccaatcagcttcagcaa

SEQ ID NO: 401060 - DNA, 20 bp, human
gcagcaagacagaagctcac

SEQ ID NO: 401061 - DNA, 20 bp, human
ggaaaacgggtctggctcgg

SEQ ID NO: 401062 - DNA, 20 bp, human
gtgaagatgaggttggaaat

SEQ ID NO: 401063 - DNA, 20 bp, human
ggagcttctgtcttgctgga

SEQ ID NO: 401064 - DNA, 20 bp, human
gggtcggctttgggcggaac

SEQ ID NO: 401065 - DNA, 20 bp, human
gttgctggagggtcggcttt

SEQ ID NO: 401066 - DNA, 20 bp, human
gagcctcagggaggtagatg

SEQ ID NO: 401067 - DNA, 20 bp, human
gcagcaaagaatgacggcca

SEQ ID NO: 401068 - DNA, 20 bp, human
gacggccaagggcgacagca

SEQ ID NO: 401069 - DNA, 20 bp, human
ggatgatcacagtgatagga

SEQ ID NO: 401070 - DNA, 20 bp, human
gggctggccatgctgtaaag

SEQ ID NO: 401071 - DNA, 20 bp, human
gcccgtggcgtctgccaatg

SEQ ID NO: 401072 - DNA, 20 bp, human
gggtgggtgccgcctctctg

SEQ ID NO: 401073 - DNA, 20 bp, human
ggtccagcctcaggaatcaa

SEQ ID NO: 401074 - DNA, 20 bp, human
gcagcccctgctgtcgccct

SEQ ID NO: 401075 - DNA, 20 bp, human
gaccagaagggagccggaga

SEQ ID NO: 401076 - DNA, 20 bp, human
gccctactgtagaaaatagg

SEQ ID NO: 401077 - DNA, 20 bp, human
gaaaccctactgtagaaaat

SEQ ID NO: 401078 - DNA, 20 bp, human
gtgaagatatctttctatga

SEQ ID NO: 401079 - DNA, 20 bp, human
gctctcttagctttgaaatg

SEQ ID NO: 401080 - DNA, 20 bp, human
gaatatccctctgtagattg

SEQ ID NO: 401081 - DNA, 20 bp, human
gagccgagcagattattctg

SEQ ID NO: 401082 - DNA, 20 bp, human
gtctcctcctcaatctacag

SEQ ID NO: 401083 - DNA, 20 bp, human
gttatatagttgtttctcaa

SEQ ID NO: 401084 - DNA, 20 bp, human
gctgtcaaagagtttgattg

SEQ ID NO: 401085 - DNA, 20 bp, human
gatccctctgtagattgagg

SEQ ID NO: 401086 - DNA, 20 bp, human
gcatgggcaacaagggactt

SEQ ID NO: 401087 - DNA, 20 bp, human
gtaaggcgcatgggcaacaa

SEQ ID NO: 401088 - DNA, 20 bp, human
gaagggacttgggcagtaag

SEQ ID NO: 401089 - DNA, 20 bp, human
gggggcgttcacactgagtc

SEQ ID NO: 401090 - DNA, 20 bp, human
ggcacatgcaaggccagcca

SEQ ID NO: 401091 - DNA, 20 bp, human
gactgagtcaggcacatgca

SEQ ID NO: 401092 - DNA, 20 bp, human
gagggagaaggaccatagat

SEQ ID NO: 401093 - DNA, 20 bp, human
gcatggcctcctaggtggaa

SEQ ID NO: 401094 - DNA, 20 bp, human
ggagaaggaccatagatggg

SEQ ID NO: 401095 - DNA, 20 bp, human
gcctcagtgggaaccaggga

SEQ ID NO: 401096 - DNA, 20 bp, human
ggaactgcgcggcgcggcat

SEQ ID NO: 401097 - DNA, 20 bp, human
ggcgcggcgcggcatggggt

SEQ ID NO: 401098 - DNA, 20 bp, human
gagaggcgccacagcccact

SEQ ID NO: 401099 - DNA, 20 bp, human
ggagagggtagagaactgcg

SEQ ID NO: 401100 - DNA, 20 bp, human
gtcagtgggaacctgggaga

SEQ ID NO: 401101 - DNA, 20 bp, human
gcagttctctaccctctccc

SEQ ID NO: 401102 - DNA, 20 bp, human
gaggaaggagggccatagag

SEQ ID NO: 401103 - DNA, 20 bp, human
ggggacgtgcacactgagtc

SEQ ID NO: 401104 - DNA, 20 bp, human
gaggtcggtgcctgcctagt

SEQ ID NO: 401105 - DNA, 20 bp, human
gaggttcccactgaagactt

SEQ ID NO: 401106 - DNA, 20 bp, human
gctagcttgacgaacataag

SEQ ID NO: 401107 - DNA, 20 bp, human
gaaggctggaatgtcgtgga

SEQ ID NO: 401108 - DNA, 20 bp, human
ggtcgtggacggtaaggaag

SEQ ID NO: 401109 - DNA, 20 bp, human
ggagcaatccttagggctta

SEQ ID NO: 401110 - DNA, 20 bp, human
gcaccgggcgggcacctctg

SEQ ID NO: 401111 - DNA, 20 bp, human
gccagccttgatgtcccttg

SEQ ID NO: 401112 - DNA, 20 bp, human
gtctccatcgtgagacattt

SEQ ID NO: 401113 - DNA, 20 bp, human
gggggtggcggtcaccagtc

SEQ ID NO: 401114 - DNA, 20 bp, human
ggttcgttatacaaaccttg

SEQ ID NO: 401115 - DNA, 20 bp, human
gctgggcagtcctcaccggg

SEQ ID NO: 401116 - DNA, 20 bp, human
gctagcttgacgaacataag

SEQ ID NO: 401117 - DNA, 20 bp, human
gattcgccccccggttcaag

SEQ ID NO: 401118 - DNA, 20 bp, human
gaaaaccagaatattgtgat

SEQ ID NO: 401119 - DNA, 20 bp, human
gccatggaagtgctcaagtg

SEQ ID NO: 401120 - DNA, 20 bp, human
gtcaagtgtggtatacactc

SEQ ID NO: 401121 - DNA, 20 bp, human
ggagcaatccttagggctta

SEQ ID NO: 401122 - DNA, 20 bp, human
gacattgaaaagtaagtcag

SEQ ID NO: 401123 - DNA, 20 bp, human
gttttccaatcacaatattc

SEQ ID NO: 401124 - DNA, 20 bp, human
gggctgcaacattcgccccc

SEQ ID NO: 401125 - DNA, 20 bp, human
gacacacggtatttccaatg

SEQ ID NO: 401126 - DNA, 20 bp, human
ggacgctggccaatcgcgga

SEQ ID NO: 401127 - DNA, 20 bp, human
gacgccggactccatagcca

SEQ ID NO: 401128 - DNA, 20 bp, human
gctgcccggcggggcgtttc

SEQ ID NO: 401129 - DNA, 20 bp, human
gggaccgtggctatggagtc

SEQ ID NO: 401130 - DNA, 20 bp, human
gagctcggcgtccattggtc

SEQ ID NO: 401131 - DNA, 20 bp, human
ggagggccacgaccgtagaa

SEQ ID NO: 401132 - DNA, 20 bp, human
gaccccaagtacctttggcc

SEQ ID NO: 401133 - DNA, 20 bp, human
ggcgtggcagcggcaatccc

SEQ ID NO: 401134 - DNA, 20 bp, human
ggccgtgcgtcacgcgacgc

SEQ ID NO: 401135 - DNA, 20 bp, human
gtacttggggtcattttccg

SEQ ID NO: 401136 - DNA, 20 bp, human
gacctcttttatgcctccag

SEQ ID NO: 401137 - DNA, 20 bp, human
gaccactggaggcataaaag

SEQ ID NO: 401138 - DNA, 20 bp, human
ggagatggggtgaagaaagg

SEQ ID NO: 401139 - DNA, 20 bp, human
gggggtgacttgaatgaagg

SEQ ID NO: 401140 - DNA, 20 bp, human
gggggagatggggtgaagaa

SEQ ID NO: 401141 - DNA, 20 bp, human
gttgggtacctggggagatg

SEQ ID NO: 401142 - DNA, 20 bp, human
gatgagaaccaagaaagcaa

SEQ ID NO: 401143 - DNA, 20 bp, human
gaattgtttcttgggtacct

SEQ ID NO: 401144 - DNA, 20 bp, human
gcagttatttaattgtttct

SEQ ID NO: 401145 - DNA, 20 bp, human
ggtaaaggccacaaggcgtt

SEQ ID NO: 401146 - DNA, 20 bp, human
gggggtgacttgaatgaagg

SEQ ID NO: 401147 - DNA, 20 bp, human
gatgagaaccaagaaagcaa

SEQ ID NO: 401148 - DNA, 20 bp, human
ggtaaaggccacaaggcgat

SEQ ID NO: 401149 - DNA, 20 bp, human
ggggctttcgaggtgggtat

SEQ ID NO: 401150 - DNA, 20 bp, human
ggaagtgcactgaccattgg

SEQ ID NO: 401151 - DNA, 20 bp, human
gcaggaagtgcactgaccat

SEQ ID NO: 401152 - DNA, 20 bp, human
gccttcaggcatgtctacgg

SEQ ID NO: 401153 - DNA, 20 bp, human
gaccacagacaaaggggtaa

SEQ ID NO: 401154 - DNA, 20 bp, human
gcagccttcaggcatgtcta

SEQ ID NO: 401155 - DNA, 20 bp, human
gcgataggttagtatgaaca

SEQ ID NO: 401156 - DNA, 20 bp, human
gggacagctagtgagagagg

SEQ ID NO: 401157 - DNA, 20 bp, human
gctcactagctgtccccctc

SEQ ID NO: 401158 - DNA, 20 bp, human
gagggatatatgttcaaaaa

SEQ ID NO: 401159 - DNA, 20 bp, human
gcaaaggcgtgccaaggaga

SEQ ID NO: 401160 - DNA, 20 bp, human
gaaaatcaagctgcaagccc

SEQ ID NO: 401161 - DNA, 20 bp, human
gaacacctgtcctgcccaga

SEQ ID NO: 401162 - DNA, 20 bp, human
gcttggaaaaagcactactc

SEQ ID NO: 401163 - DNA, 20 bp, human
ggtttgaaggagttccacca

SEQ ID NO: 401164 - DNA, 20 bp, human
gtcacatgcttcctcccgat

SEQ ID NO: 401165 - DNA, 20 bp, human
gatgagacaaaggcgtgcca

SEQ ID NO: 401166 - DNA, 20 bp, human
gcacctgtgtcaaagagcac

SEQ ID NO: 401167 - DNA, 20 bp, human
gggaaccagctcagagcttc

SEQ ID NO: 401168 - DNA, 20 bp, human
gctaggcgactgtgggtctt

SEQ ID NO: 401169 - DNA, 20 bp, human
gtctctgtcttgcagcaagt

SEQ ID NO: 401170 - DNA, 20 bp, human
gcaacaaccttactgatatc

SEQ ID NO: 401171 - DNA, 20 bp, human
gtgacaaatgtagacacaga

SEQ ID NO: 401172 - DNA, 20 bp, human
gacttggcactaggcgactg

SEQ ID NO: 401173 - DNA, 20 bp, human
gctacatccagatatcagta

SEQ ID NO: 401174 - DNA, 20 bp, human
gataaggtccaccaatggga

SEQ ID NO: 401175 - DNA, 20 bp, human
ggaaagcaactgagttctga

SEQ ID NO: 401176 - DNA, 20 bp, human
gtgcagcagcacagacgatg

SEQ ID NO: 401177 - DNA, 20 bp, human
ggagacggttgttcaggaaa

SEQ ID NO: 401178 - DNA, 20 bp, human
gcttggagaagaaacatgac

SEQ ID NO: 401179 - DNA, 20 bp, human
gttcaggaaaaggagatatg

SEQ ID NO: 401180 - DNA, 20 bp, human
gaggcggccagtgtcttctc

SEQ ID NO: 401181 - DNA, 20 bp, human
gaaagccaagacttcaactg

SEQ ID NO: 401182 - DNA, 20 bp, human
gtcagcagagacggttgttc

SEQ ID NO: 401183 - DNA, 20 bp, human
gcacctacaaagacaactga

SEQ ID NO: 401184 - DNA, 20 bp, human
gggaagtcactgagtttgtt

SEQ ID NO: 401185 - DNA, 20 bp, human
gatgactcctgctttcacaa

SEQ ID NO: 401186 - DNA, 20 bp, human
gccggcgtggcgctcatcga

SEQ ID NO: 401187 - DNA, 20 bp, human
gcacctccccgaaccggatg

SEQ ID NO: 401188 - DNA, 20 bp, human
ggagggacgcccggcccaag

SEQ ID NO: 401189 - DNA, 20 bp, human
gcaagtggtaagttgaaaaa

SEQ ID NO: 401190 - DNA, 20 bp, human
ggcccccatccggttcgggg

SEQ ID NO: 401191 - DNA, 20 bp, human
gaagttgaaaaatggcggag

SEQ ID NO: 401192 - DNA, 20 bp, human
ggaggctgacctcccggccg

SEQ ID NO: 401193 - DNA, 20 bp, human
gtcccgccacctccccgaac

SEQ ID NO: 401194 - DNA, 20 bp, human
gttactgcccccatccggtt

SEQ ID NO: 401195 - DNA, 20 bp, human
gtccgtcagtctcccagccc

SEQ ID NO: 401196 - DNA, 20 bp, human
gtgtaactgattccccagga

SEQ ID NO: 401197 - DNA, 20 bp, human
ggacatgtaactgattcccc

SEQ ID NO: 401198 - DNA, 20 bp, human
gaagtggttcggttattttt

SEQ ID NO: 401199 - DNA, 20 bp, human
gtcagctgggttgtgaggtt

SEQ ID NO: 401200 - DNA, 20 bp, human
gaatcagttacatgtccttt

SEQ ID NO: 401201 - DNA, 20 bp, human
gttacatgtcctttgggctg

SEQ ID NO: 401202 - DNA, 20 bp, human
gcaatccccagatcagactt

SEQ ID NO: 401203 - DNA, 20 bp, human
gtgagagagtgactaagaag

SEQ ID NO: 401204 - DNA, 20 bp, human
gcggtgggtggagacacgtc

SEQ ID NO: 401205 - DNA, 20 bp, human
gaagtcactcttccatcctg

SEQ ID NO: 401206 - DNA, 20 bp, human
gcaacttggcacctattttt

SEQ ID NO: 401207 - DNA, 20 bp, human
gaactgagctctgtataggt

SEQ ID NO: 401208 - DNA, 20 bp, human
gcattactgagggcactatg

SEQ ID NO: 401209 - DNA, 20 bp, human
ggccctcagtaatgtatgca

SEQ ID NO: 401210 - DNA, 20 bp, human
ggccatgcatacattactga

SEQ ID NO: 401211 - DNA, 20 bp, human
gaccagtgccgatgaggaaa

SEQ ID NO: 401212 - DNA, 20 bp, human
ggacactcttcttaaaagag

SEQ ID NO: 401213 - DNA, 20 bp, human
gagggcactatgaggcagag

SEQ ID NO: 401214 - DNA, 20 bp, human
gaacatgaattcttgggaag

SEQ ID NO: 401215 - DNA, 20 bp, human
gtaggaactgagctctgtat

SEQ ID NO: 401216 - DNA, 20 bp, human
gttcgcggcccgccagggga

SEQ ID NO: 401217 - DNA, 20 bp, human
gagtgccggctgcgtctctg

SEQ ID NO: 401218 - DNA, 20 bp, human
ggctgcgcgcgacgcccgca

SEQ ID NO: 401219 - DNA, 20 bp, human
gcatggagcgggagctcaaa

SEQ ID NO: 401220 - DNA, 20 bp, human
ggcgaacccgcgccctacga

SEQ ID NO: 401221 - DNA, 20 bp, human
gagtcccttgggtcctatct

SEQ ID NO: 401222 - DNA, 20 bp, human
gggcgtcgcgcgcagcctct

SEQ ID NO: 401223 - DNA, 20 bp, human
gcgggcccagaattggagtc

SEQ ID NO: 401224 - DNA, 20 bp, human
gccatggcctgagccgtcgt

SEQ ID NO: 401225 - DNA, 20 bp, human
gctcgctcgctcgccagtgc

SEQ ID NO: 401226 - DNA, 20 bp, human
gctgtaggcagcaggtatct

SEQ ID NO: 401227 - DNA, 20 bp, human
gaattagattctaactctgt

SEQ ID NO: 401228 - DNA, 20 bp, human
gtatatgaaattgaagcacg

SEQ ID NO: 401229 - DNA, 20 bp, human
gctatgctatagctgttaca

SEQ ID NO: 401230 - DNA, 20 bp, human
gtttataacatactcgttct

SEQ ID NO: 401231 - DNA, 20 bp, human
gagaggctgagaggggataa

SEQ ID NO: 401232 - DNA, 20 bp, human
ggtagcacagaggctgagag

SEQ ID NO: 401233 - DNA, 20 bp, human
gaaaaatgcatgtagcacag

SEQ ID NO: 401234 - DNA, 20 bp, human
gtacaaattaatttatcaaa

SEQ ID NO: 401235 - DNA, 20 bp, human
gactacatctttaaattttt

SEQ ID NO: 401236 - DNA, 20 bp, human
gcgagccagggtgggagcga

SEQ ID NO: 401237 - DNA, 20 bp, human
ggcccctcccgagccagggt

SEQ ID NO: 401238 - DNA, 20 bp, human
gctcccaccctggctcggga

SEQ ID NO: 401239 - DNA, 20 bp, human
gctccaccagctgactccga

SEQ ID NO: 401240 - DNA, 20 bp, human
ggaggagcgcgctgagagga

SEQ ID NO: 401241 - DNA, 20 bp, human
ggcctgagggtgacagtcga

SEQ ID NO: 401242 - DNA, 20 bp, human
gcctcgcccctcccgagcca

SEQ ID NO: 401243 - DNA, 20 bp, human
gtccctgcgtgcagccctcg

SEQ ID NO: 401244 - DNA, 20 bp, human
gccagctgactccgagggag

SEQ ID NO: 401245 - DNA, 20 bp, human
ggcccccactcccgggattt

SEQ ID NO: 401246 - DNA, 20 bp, human
gtcgtagtggccagcagggg

SEQ ID NO: 401247 - DNA, 20 bp, human
ggggccgcgtgcaggggaag

SEQ ID NO: 401248 - DNA, 20 bp, human
gaaagcgcttggtgagcgtc

SEQ ID NO: 401249 - DNA, 20 bp, human
gggagggagggaggatgctt

SEQ ID NO: 401250 - DNA, 20 bp, human
gactgcgcaggttcctcggg

SEQ ID NO: 401251 - DNA, 20 bp, human
gctcctgataagggcagaag

SEQ ID NO: 401252 - DNA, 20 bp, human
gaggtccgggctcctgataa

SEQ ID NO: 401253 - DNA, 20 bp, human
gaggtggtggagtccagctc

SEQ ID NO: 401254 - DNA, 20 bp, human
gtaggcgcgaattgtatgtc

SEQ ID NO: 401255 - DNA, 20 bp, human
gcgactgcgggtggcatttc

SEQ ID NO: 401256 - DNA, 20 bp, human
ggggcgggacctctgaggga

SEQ ID NO: 401257 - DNA, 20 bp, human
ggccgaggggtcaacctgat

SEQ ID NO: 401258 - DNA, 20 bp, human
gagctgcgacgctgaggaag

SEQ ID NO: 401259 - DNA, 20 bp, human
gggaggggcgggacctctga

SEQ ID NO: 401260 - DNA, 20 bp, human
ggggcagtgccagacgtttt

SEQ ID NO: 401261 - DNA, 20 bp, human
gccccctccagggatcactt

SEQ ID NO: 401262 - DNA, 20 bp, human
gtgtctatgtctcacctctt

SEQ ID NO: 401263 - DNA, 20 bp, human
gcgggggagcaaacgaacga

SEQ ID NO: 401264 - DNA, 20 bp, human
gaatccggctggcccgagtg

SEQ ID NO: 401265 - DNA, 20 bp, human
gagacattttgattgggggg

SEQ ID NO: 401266 - DNA, 20 bp, human
gcctgcttccgcattcccgg

SEQ ID NO: 401267 - DNA, 20 bp, human
gcccccacccgcctgagctg

SEQ ID NO: 401268 - DNA, 20 bp, human
gcccccttcggccgcagctc

SEQ ID NO: 401269 - DNA, 20 bp, human
gcgcctgagctgcggccgaa

SEQ ID NO: 401270 - DNA, 20 bp, human
gggccgcagctcaggcgggt

SEQ ID NO: 401271 - DNA, 20 bp, human
gccgcgcctccgaggaagga

SEQ ID NO: 401272 - DNA, 20 bp, human
gagaaggaagtgcagtccga

SEQ ID NO: 401273 - DNA, 20 bp, human
gaggagggagagggtgacct

SEQ ID NO: 401274 - DNA, 20 bp, human
gtgcggaagcaggggaggcg

SEQ ID NO: 401275 - DNA, 20 bp, human
gtggcctgggtctgacgggg

SEQ ID NO: 401276 - DNA, 20 bp, human
gttagctggggttcgggcgg

SEQ ID NO: 401277 - DNA, 20 bp, human
gcgaggcccgcggttgtccc

SEQ ID NO: 401278 - DNA, 20 bp, human
ggcctcgctcctccccggac

SEQ ID NO: 401279 - DNA, 20 bp, human
ggcgggagcagagcatcgag

SEQ ID NO: 401280 - DNA, 20 bp, human
ggaggacctgggacaaccgc

SEQ ID NO: 401281 - DNA, 20 bp, human
ggaggcccaagaaagcgaga

SEQ ID NO: 401282 - DNA, 20 bp, human
ggggcctccgggcgcctcaa

SEQ ID NO: 401283 - DNA, 20 bp, human
gtccccggacggggcgggac

SEQ ID NO: 401284 - DNA, 20 bp, human
gcgactgcccttcgcttcgc

SEQ ID NO: 401285 - DNA, 20 bp, human
ggcggcttttagctggggtt

SEQ ID NO: 401286 - DNA, 20 bp, human
ggatgcctcgcaacccggga

SEQ ID NO: 401287 - DNA, 20 bp, human
ggagggaggggattggccag

SEQ ID NO: 401288 - DNA, 20 bp, human
ggggctgcgcgggcagtggt

SEQ ID NO: 401289 - DNA, 20 bp, human
gcctcgcaacccgggaggga

SEQ ID NO: 401290 - DNA, 20 bp, human
gcgccggcgtgtcgcctatc

SEQ ID NO: 401291 - DNA, 20 bp, human
gggacgctactcgctatccc

SEQ ID NO: 401292 - DNA, 20 bp, human
gggatccggcagctaggccg

SEQ ID NO: 401293 - DNA, 20 bp, human
gcacgtgatgcctcgcaacc

SEQ ID NO: 401294 - DNA, 20 bp, human
ggggggcggtgcggaactag

SEQ ID NO: 401295 - DNA, 20 bp, human
gagctgccggatccccgccc

SEQ ID NO: 401296 - DNA, 20 bp, human
gcgcctgcccgggaactctc

SEQ ID NO: 401297 - DNA, 20 bp, human
gtctccgaatgcagtgttga

SEQ ID NO: 401298 - DNA, 20 bp, human
gccccaagaccgcctggccc

SEQ ID NO: 401299 - DNA, 20 bp, human
gcactagcaaagtttctccg

SEQ ID NO: 401300 - DNA, 20 bp, human
gaacactgcattcggagaca

SEQ ID NO: 401301 - DNA, 20 bp, human
ggatgtgcggggcgccaacc

SEQ ID NO: 401302 - DNA, 20 bp, human
gtgcccgggaactctccggc

SEQ ID NO: 401303 - DNA, 20 bp, human
gcagagcgcgctcgctctac

SEQ ID NO: 401304 - DNA, 20 bp, human
ggacctccgtccagccaggt

SEQ ID NO: 401305 - DNA, 20 bp, human
ggagaaactttgctagtgag

SEQ ID NO: 401306 - DNA, 20 bp, human
gtgcgcagttaaggggctcg

SEQ ID NO: 401307 - DNA, 20 bp, human
gaagagagcaggtagttagg

SEQ ID NO: 401308 - DNA, 20 bp, human
gagagcgcctgcgcagttaa

SEQ ID NO: 401309 - DNA, 20 bp, human
gcaggcgctctcactcagaa

SEQ ID NO: 401310 - DNA, 20 bp, human
gggcggagtctgggtatgcg

SEQ ID NO: 401311 - DNA, 20 bp, human
ggcagttaaggggctcgggg

SEQ ID NO: 401312 - DNA, 20 bp, human
gagaaaggccgctgggtgcg

SEQ ID NO: 401313 - DNA, 20 bp, human
gcagggcggctggctcgcct

SEQ ID NO: 401314 - DNA, 20 bp, human
ggtctgggtatgcgcggaca

SEQ ID NO: 401315 - DNA, 20 bp, human
gctcttgtcatccgggagaa

SEQ ID NO: 401316 - DNA, 20 bp, human
gcaagagcaacgtcaatctc

SEQ ID NO: 401317 - DNA, 20 bp, human
gaagctccaccccatacccg

SEQ ID NO: 401318 - DNA, 20 bp, human
gggccacgccccttcgttgg

SEQ ID NO: 401319 - DNA, 20 bp, human
gtggggtggagcttccttta

SEQ ID NO: 401320 - DNA, 20 bp, human
gcttggccacgccccttcgt

SEQ ID NO: 401321 - DNA, 20 bp, human
gtggccaagcgcaccgcctc

SEQ ID NO: 401322 - DNA, 20 bp, human
gcaagcgcaccgcctcgggg

SEQ ID NO: 401323 - DNA, 20 bp, human
ggcttcccgcagttttttag

SEQ ID NO: 401324 - DNA, 20 bp, human
gggcctagtcacgcccctaa

SEQ ID NO: 401325 - DNA, 20 bp, human
gtgactaggcctccaacgaa

SEQ ID NO: 401326 - DNA, 20 bp, human
ggctgtgcctggacatgaca

SEQ ID NO: 401327 - DNA, 20 bp, human
gcacacagatatcacagttc

SEQ ID NO: 401328 - DNA, 20 bp, human
gcagggatgtaactacacat

SEQ ID NO: 401329 - DNA, 20 bp, human
gttcacacgatctagattgt

SEQ ID NO: 401330 - DNA, 20 bp, human
gctggctaaacaatggctca

SEQ ID NO: 401331 - DNA, 20 bp, human
ggatttggaacacatgttga

SEQ ID NO: 401332 - DNA, 20 bp, human
ggtgatatatgtgcagttgg

SEQ ID NO: 401333 - DNA, 20 bp, human
gaataacatagataagtagc

SEQ ID NO: 401334 - DNA, 20 bp, human
gggttttttaacagcacatc

SEQ ID NO: 401335 - DNA, 20 bp, human
ggtctgagtaggcttatagt

SEQ ID NO: 401336 - DNA, 20 bp, human
gaaccccaggtccgggagtg

SEQ ID NO: 401337 - DNA, 20 bp, human
gcggccgcgaaccccaggtc

SEQ ID NO: 401338 - DNA, 20 bp, human
gctcccggacctggggttcg

SEQ ID NO: 401339 - DNA, 20 bp, human
gaatgcggactggtgtggaa

SEQ ID NO: 401340 - DNA, 20 bp, human
ggcgcctgcggcccagagcg

SEQ ID NO: 401341 - DNA, 20 bp, human
gctctgggccgcaggcgctg

SEQ ID NO: 401342 - DNA, 20 bp, human
ggggcgggctagcgccgggt

SEQ ID NO: 401343 - DNA, 20 bp, human
gccagcgcccgccacgggcg

SEQ ID NO: 401344 - DNA, 20 bp, human
gcagaccagctgatcacccg

SEQ ID NO: 401345 - DNA, 20 bp, human
gccaggtccgggagtgtggg

SEQ ID NO: 401346 - DNA, 20 bp, human
gagggaaggggaccgaatta

SEQ ID NO: 401347 - DNA, 20 bp, human
gtggggctctgccgctgaga

SEQ ID NO: 401348 - DNA, 20 bp, human
gtttcccagccccctctcag

SEQ ID NO: 401349 - DNA, 20 bp, human
gccagagtgtgggagctaat

SEQ ID NO: 401350 - DNA, 20 bp, human
gccccagccattccttaatt

SEQ ID NO: 401351 - DNA, 20 bp, human
gaggggaccgaattaaggaa

SEQ ID NO: 401352 - DNA, 20 bp, human
gatcagcttgctggagggaa

SEQ ID NO: 401353 - DNA, 20 bp, human
gttcctagtcgtgtaggata

SEQ ID NO: 401354 - DNA, 20 bp, human
gggggctggcgtcaagaagg

SEQ ID NO: 401355 - DNA, 20 bp, human
ggaccgaattaaggaatggc

SEQ ID NO: 401356 - DNA, 20 bp, human
ggagataacatcccctccag

SEQ ID NO: 401357 - DNA, 20 bp, human
gcttggacgtcgccccctgg

SEQ ID NO: 401358 - DNA, 20 bp, human
gtccgccggaaggggaggtg

SEQ ID NO: 401359 - DNA, 20 bp, human
gcgagctgggaccgaccctc

SEQ ID NO: 401360 - DNA, 20 bp, human
ggccgcgtcgccaggaaacc

SEQ ID NO: 401361 - DNA, 20 bp, human
gaaaaagggcgtggagccgg

SEQ ID NO: 401362 - DNA, 20 bp, human
ggggaacgcaaccgcctgca

SEQ ID NO: 401363 - DNA, 20 bp, human
gaaaaaaaagggcgtggagc

SEQ ID NO: 401364 - DNA, 20 bp, human
gcctccccttccggcggagg

SEQ ID NO: 401365 - DNA, 20 bp, human
ggtggtgggcgaaactgggg

SEQ ID NO: 401366 - DNA, 20 bp, human
gggtcattcgcgtgtgcggg

SEQ ID NO: 401367 - DNA, 20 bp, human
ggcgaaggaaagccgcgtgg

SEQ ID NO: 401368 - DNA, 20 bp, human
gaactgaccaataggagggc

SEQ ID NO: 401369 - DNA, 20 bp, human
ggcaaatcgctgctgaaaag

SEQ ID NO: 401370 - DNA, 20 bp, human
gccgaagcggcgggctcgtg

SEQ ID NO: 401371 - DNA, 20 bp, human
gcgcggagcgtttggaacct

SEQ ID NO: 401372 - DNA, 20 bp, human
ggccagtcaatcccgcctca

SEQ ID NO: 401373 - DNA, 20 bp, human
gtgagtagaaaagagagcga

SEQ ID NO: 401374 - DNA, 20 bp, human
gtgcccgcagagtgggggag

SEQ ID NO: 401375 - DNA, 20 bp, human
ggagagataggctcatggcg

SEQ ID NO: 401376 - DNA, 20 bp, human
gcgggctgccgggttccggg

SEQ ID NO: 401377 - DNA, 20 bp, human
ggcgacgccggtgtcgacag

SEQ ID NO: 401378 - DNA, 20 bp, human
gagcccggccagacccgccg

SEQ ID NO: 401379 - DNA, 20 bp, human
gacggccctgggagcgcgtg

SEQ ID NO: 401380 - DNA, 20 bp, human
gcgggctgtactagggtagt

SEQ ID NO: 401381 - DNA, 20 bp, human
gcccgcgcatgcgtggtgtc

SEQ ID NO: 401382 - DNA, 20 bp, human
gtgaaaggaggtgcgctctg

SEQ ID NO: 401383 - DNA, 20 bp, human
gccaggggaggcggtgtgca

SEQ ID NO: 401384 - DNA, 20 bp, human
gaactggcgtcgtggatctg

SEQ ID NO: 401385 - DNA, 20 bp, human
gtccccgggcgggctgtact

SEQ ID NO: 401386 - DNA, 20 bp, human
gcacgcgcccgcggaagtgg

SEQ ID NO: 401387 - DNA, 20 bp, human
gggcggggcgggaggcggaa

SEQ ID NO: 401388 - DNA, 20 bp, human
gctgcgaagggccgttgacg

SEQ ID NO: 401389 - DNA, 20 bp, human
gacgacggagaaaccgagaa

SEQ ID NO: 401390 - DNA, 20 bp, human
ggtgcaggttgagcctaggt

SEQ ID NO: 401391 - DNA, 20 bp, human
gcaatgcagccgccagactg

SEQ ID NO: 401392 - DNA, 20 bp, human
gagcagggatcagacgagag

SEQ ID NO: 401393 - DNA, 20 bp, human
gcggtgcgcagccgcgtcaa

SEQ ID NO: 401394 - DNA, 20 bp, human
gagtggcggctcccgtgtgc

SEQ ID NO: 401395 - DNA, 20 bp, human
gaaccgagaagggatcgtaa

SEQ ID NO: 401396 - DNA, 20 bp, human
gagggcggggctgcacctga

SEQ ID NO: 401397 - DNA, 20 bp, human
gagagggcgtggtaagaagg

SEQ ID NO: 401398 - DNA, 20 bp, human
gaatcgagcggggcgagcgg

SEQ ID NO: 401399 - DNA, 20 bp, human
gcgctggaaccggaccaatc

SEQ ID NO: 401400 - DNA, 20 bp, human
ggccccgctcgattccggat

SEQ ID NO: 401401 - DNA, 20 bp, human
gaagagagggcgtggtaaga

SEQ ID NO: 401402 - DNA, 20 bp, human
ggaccaatccggaatcgagc

SEQ ID NO: 401403 - DNA, 20 bp, human
gtacgggcggagcatcgagc

SEQ ID NO: 401404 - DNA, 20 bp, human
gaccgcccgtgcgtccacgc

SEQ ID NO: 401405 - DNA, 20 bp, human
gcgggctgccattttagtaa

SEQ ID NO: 401406 - DNA, 20 bp, human
gaaggcgcgggcaacgtcag

SEQ ID NO: 401407 - DNA, 20 bp, human
gtgggacggcgtaaaggcgc

SEQ ID NO: 401408 - DNA, 20 bp, human
gtcagcggcccggagacgcc

SEQ ID NO: 401409 - DNA, 20 bp, human
gcaccgctgggacggcgtaa

SEQ ID NO: 401410 - DNA, 20 bp, human
gggccgggggagcgcgaagg

SEQ ID NO: 401411 - DNA, 20 bp, human
gacgtccaggggcgagtcaa

SEQ ID NO: 401412 - DNA, 20 bp, human
gggagaatgcgcagcaccgc

SEQ ID NO: 401413 - DNA, 20 bp, human
gtcagctgcgcaggccccgg

SEQ ID NO: 401414 - DNA, 20 bp, human
gggcgcagcggcgacggcgt

SEQ ID NO: 401415 - DNA, 20 bp, human
gcattctccaaccacggccc

SEQ ID NO: 401416 - DNA, 20 bp, human
ggcagcccgcgggctgacgc

SEQ ID NO: 401417 - DNA, 20 bp, human
gccggaaggcgtggtcaccg

SEQ ID NO: 401418 - DNA, 20 bp, human
gcctcgccgcccggaagcgc

SEQ ID NO: 401419 - DNA, 20 bp, human
gctccctggcgctcgccgga

SEQ ID NO: 401420 - DNA, 20 bp, human
ggcctccggcgtcagcccgc

SEQ ID NO: 401421 - DNA, 20 bp, human
gcctgcatgctgggagttgt

SEQ ID NO: 401422 - DNA, 20 bp, human
ggggatgaggcatccggccc

SEQ ID NO: 401423 - DNA, 20 bp, human
ggcccgcgggctgacgccgg

SEQ ID NO: 401424 - DNA, 20 bp, human
gcggccgctccctgcatgct

SEQ ID NO: 401425 - DNA, 20 bp, human
ggagctgggtagggactcct

SEQ ID NO: 401426 - DNA, 20 bp, human
ggaggtgcctccagcacgta

SEQ ID NO: 401427 - DNA, 20 bp, human
gacgtacggcccacaagggg

SEQ ID NO: 401428 - DNA, 20 bp, human
gtccctggatctcttcagtc

SEQ ID NO: 401429 - DNA, 20 bp, human
gagcacgtacggcccacaag

SEQ ID NO: 401430 - DNA, 20 bp, human
gcctacaccgccctgacgaa

SEQ ID NO: 401431 - DNA, 20 bp, human
gacgaagggggtgctgtaag

SEQ ID NO: 401432 - DNA, 20 bp, human
gttaagactccgccccttgt

SEQ ID NO: 401433 - DNA, 20 bp, human
gagccagactgaagagatcc

SEQ ID NO: 401434 - DNA, 20 bp, human
gtcttcagtctggctcctgt

SEQ ID NO: 401435 - DNA, 20 bp, human
gcatggcgatgacgtccaga

SEQ ID NO: 401436 - DNA, 20 bp, human
ggctagagcggggttgtgtg

SEQ ID NO: 401437 - DNA, 20 bp, human
gcagtcgcgcctctccagag

SEQ ID NO: 401438 - DNA, 20 bp, human
gcggggttgtgtgtggcgga

SEQ ID NO: 401439 - DNA, 20 bp, human
gagagcggggttgtgtgtgg

SEQ ID NO: 401440 - DNA, 20 bp, human
gaaccccggcgcgccggcgc

SEQ ID NO: 401441 - DNA, 20 bp, human
ggaggaaacgctcgttgcta

SEQ ID NO: 401442 - DNA, 20 bp, human
gacgtccgaaccctgctttc

SEQ ID NO: 401443 - DNA, 20 bp, human
ggggttcggacgtcattggg

SEQ ID NO: 401444 - DNA, 20 bp, human
ggtagagtatggggtccgag

SEQ ID NO: 401445 - DNA, 20 bp, human
gagcagggttcggacgtcat

SEQ ID NO: 401446 - DNA, 20 bp, human
gaccccggagcgatctccaa

SEQ ID NO: 401447 - DNA, 20 bp, human
gtccccttggagatcgctcc

SEQ ID NO: 401448 - DNA, 20 bp, human
gcgcggaagtctgacgtcac

SEQ ID NO: 401449 - DNA, 20 bp, human
gagcgatctccaaggggacg

SEQ ID NO: 401450 - DNA, 20 bp, human
gggcgggagcatgcgcaata

SEQ ID NO: 401451 - DNA, 20 bp, human
gcagacttccgcgtcccccg

SEQ ID NO: 401452 - DNA, 20 bp, human
gacgcgggagagcgccgcgg

SEQ ID NO: 401453 - DNA, 20 bp, human
gacgtcacaggaactggggg

SEQ ID NO: 401454 - DNA, 20 bp, human
gagtctgcgcagttggtgaa

SEQ ID NO: 401455 - DNA, 20 bp, human
gtgcgcactgcgccaggccg

SEQ ID NO: 401456 - DNA, 20 bp, human
gggtacgctccgcccctctc

SEQ ID NO: 401457 - DNA, 20 bp, human
gaccaatcggcggcgagggc

SEQ ID NO: 401458 - DNA, 20 bp, human
gcaggggcggtgcccttaca

SEQ ID NO: 401459 - DNA, 20 bp, human
gcccttacacggattggaga

SEQ ID NO: 401460 - DNA, 20 bp, human
gctcagggagattgagactt

SEQ ID NO: 401461 - DNA, 20 bp, human
ggatcaccaatcggcggcga

SEQ ID NO: 401462 - DNA, 20 bp, human
gcctgaggtcgatcaccaat

SEQ ID NO: 401463 - DNA, 20 bp, human
ggtctcaatctccctgagag

SEQ ID NO: 401464 - DNA, 20 bp, human
ggaggtcgatcaccaatcgg

SEQ ID NO: 401465 - DNA, 20 bp, human
gggcgcctagcaccctgagt

SEQ ID NO: 401466 - DNA, 20 bp, human
gcggctggagagggcgagaa

SEQ ID NO: 401467 - DNA, 20 bp, human
gcaccgcctaccaagacggg

SEQ ID NO: 401468 - DNA, 20 bp, human
gccaaccggacggctggaga

SEQ ID NO: 401469 - DNA, 20 bp, human
gaaccgcccgtcttggtagg

SEQ ID NO: 401470 - DNA, 20 bp, human
gcacccttccggggctcagg

SEQ ID NO: 401471 - DNA, 20 bp, human
gggctcctctccaccggaaa

SEQ ID NO: 401472 - DNA, 20 bp, human
ggtgccgtgacaagcccaac

SEQ ID NO: 401473 - DNA, 20 bp, human
ggcggttaagacactaggat

SEQ ID NO: 401474 - DNA, 20 bp, human
gaagtggggctcccaggtcg

SEQ ID NO: 401475 - DNA, 20 bp, human
gacggcaccgcctaccaaga

SEQ ID NO: 401476 - DNA, 20 bp, human
gcacacgctcccgactacgg

SEQ ID NO: 401477 - DNA, 20 bp, human
ggggcggggaaaccgtgccc

SEQ ID NO: 401478 - DNA, 20 bp, human
ggcgcatgctcagagttccg

SEQ ID NO: 401479 - DNA, 20 bp, human
gggcctagcaggaaacgaag

SEQ ID NO: 401480 - DNA, 20 bp, human
gcaccacacgctcccgacta

SEQ ID NO: 401481 - DNA, 20 bp, human
gctcgcttccggtggacaag

SEQ ID NO: 401482 - DNA, 20 bp, human
ggctaggcctgaaaggggcg

SEQ ID NO: 401483 - DNA, 20 bp, human
ggtggacaagcggcagatag

SEQ ID NO: 401484 - DNA, 20 bp, human
ggctcccgactacggcggaa

SEQ ID NO: 401485 - DNA, 20 bp, human
gctctccattccgccgtagt

SEQ ID NO: 401486 - DNA, 20 bp, human
gagggcccacacggaagagg

SEQ ID NO: 401487 - DNA, 20 bp, human
gggggcggggctctcgctga

SEQ ID NO: 401488 - DNA, 20 bp, human
ggggagggcccacacggaag

SEQ ID NO: 401489 - DNA, 20 bp, human
gaccggcaacgactactgtg

SEQ ID NO: 401490 - DNA, 20 bp, human
ggtgcgcactatatcgcgtc

SEQ ID NO: 401491 - DNA, 20 bp, human
gcccgccccctcttccgtgt

SEQ ID NO: 401492 - DNA, 20 bp, human
gacataggtagaagctggtt

SEQ ID NO: 401493 - DNA, 20 bp, human
gcctgacgtaggaaggggcg

SEQ ID NO: 401494 - DNA, 20 bp, human
gggggctctcgctgatgggt

SEQ ID NO: 401495 - DNA, 20 bp, human
gcagggacataggtagaagc

SEQ ID NO: 401496 - DNA, 20 bp, human
gcgcggggcccgatgctgtt

SEQ ID NO: 401497 - DNA, 20 bp, human
gaggggcggggcgagggcat

SEQ ID NO: 401498 - DNA, 20 bp, human
gagggcagcagcgaaatccg

SEQ ID NO: 401499 - DNA, 20 bp, human
gcagctccgcccaacagcat

SEQ ID NO: 401500 - DNA, 20 bp, human
gtggctgggctgaagacgtt

SEQ ID NO: 401501 - DNA, 20 bp, human
gggggcccgatgctgttggg

SEQ ID NO: 401502 - DNA, 20 bp, human
ggggttgttacagcctttga

SEQ ID NO: 401503 - DNA, 20 bp, human
ggaagacgttaggcgggagg

SEQ ID NO: 401504 - DNA, 20 bp, human
gaagacatgtcacccacact

SEQ ID NO: 401505 - DNA, 20 bp, human
gagggcctgggcggtcgcgt

SEQ ID NO: 401506 - DNA, 20 bp, human
ggcggtcagggaatctgcgg

SEQ ID NO: 401507 - DNA, 20 bp, human
ggggccgcggtactgtccag

SEQ ID NO: 401508 - DNA, 20 bp, human
ggtactgtccagtggcggtc

SEQ ID NO: 401509 - DNA, 20 bp, human
gcggccgcgcgaggcccgga

SEQ ID NO: 401510 - DNA, 20 bp, human
gcctagagcggcaggatccg

SEQ ID NO: 401511 - DNA, 20 bp, human
gggaatctgcggaggtttgc

SEQ ID NO: 401512 - DNA, 20 bp, human
gtagccctccgggcctcgcg

SEQ ID NO: 401513 - DNA, 20 bp, human
ggtggcggtcagggaatctg

SEQ ID NO: 401514 - DNA, 20 bp, human
ggaaaaccgtacgaaggtgt

SEQ ID NO: 401515 - DNA, 20 bp, human
gccgcggtactgtccagtgg

SEQ ID NO: 401516 - DNA, 20 bp, human
gaggaggcttcgctggatga

SEQ ID NO: 401517 - DNA, 20 bp, human
gccggggctgggaccaccga

SEQ ID NO: 401518 - DNA, 20 bp, human
gtcgctggatgagggagcgg

SEQ ID NO: 401519 - DNA, 20 bp, human
ggcggcggaccgggtggcga

SEQ ID NO: 401520 - DNA, 20 bp, human
gtgtgggaggcggagtccgg

SEQ ID NO: 401521 - DNA, 20 bp, human
ggccttgccgggctgtttgt

SEQ ID NO: 401522 - DNA, 20 bp, human
gcggcggaaaagggccttgc

SEQ ID NO: 401523 - DNA, 20 bp, human
ggccgagcgcgtctgagttg

SEQ ID NO: 401524 - DNA, 20 bp, human
ggatgagggagcggcggaaa

SEQ ID NO: 401525 - DNA, 20 bp, human
ggagcgcgtctgagttgcgg

SEQ ID NO: 401526 - DNA, 20 bp, human
ggcgccgcgcggagtcaatc

SEQ ID NO: 401527 - DNA, 20 bp, human
gcggcttcagacaagtcgga

SEQ ID NO: 401528 - DNA, 20 bp, human
gtcagacaagtcggagggga

SEQ ID NO: 401529 - DNA, 20 bp, human
gcaatcggcttcagacaagt

SEQ ID NO: 401530 - DNA, 20 bp, human
ggatcccgattgactccgcg

SEQ ID NO: 401531 - DNA, 20 bp, human
gttgtctgaagccgattggc

SEQ ID NO: 401532 - DNA, 20 bp, human
ggctggcgcgaggtagtcag

SEQ ID NO: 401533 - DNA, 20 bp, human
ggccagcaagacccaaacta

SEQ ID NO: 401534 - DNA, 20 bp, human
ggcgaggtagtcagaggacg

SEQ ID NO: 401535 - DNA, 20 bp, human
gtcaatcgggatccgtagtt

SEQ ID NO: 401536 - DNA, 20 bp, human
gcggcgcccggcgttgggag

SEQ ID NO: 401537 - DNA, 20 bp, human
gtccaagggtattagaggag

SEQ ID NO: 401538 - DNA, 20 bp, human
gccaggcggcggccatgaaa

SEQ ID NO: 401539 - DNA, 20 bp, human
gggtattagaggaggggtta

SEQ ID NO: 401540 - DNA, 20 bp, human
gccctcagcacgctggagtc

SEQ ID NO: 401541 - DNA, 20 bp, human
gcctctggggctcgccgcgt

SEQ ID NO: 401542 - DNA, 20 bp, human
ggcctggcgccggggctaag

SEQ ID NO: 401543 - DNA, 20 bp, human
gggatccggcgcccggcgtt

SEQ ID NO: 401544 - DNA, 20 bp, human
ggaggggttagggtgggatc

SEQ ID NO: 401545 - DNA, 20 bp, human
gcgttgggagggggggattc

SEQ ID NO: 401546 - DNA, 20 bp, human
ggctccgcccggccggactg

SEQ ID NO: 401547 - DNA, 20 bp, human
gtggaccggagtcacgaggc

SEQ ID NO: 401548 - DNA, 20 bp, human
gcaagcccgcctcgtgactc

SEQ ID NO: 401549 - DNA, 20 bp, human
gggtgcgcttcgaaggaaag

SEQ ID NO: 401550 - DNA, 20 bp, human
gtggcccaggcgtcctctaa

SEQ ID NO: 401551 - DNA, 20 bp, human
gccggctcgcgtagccccgc

SEQ ID NO: 401552 - DNA, 20 bp, human
gactgtggaccggagtcacg

SEQ ID NO: 401553 - DNA, 20 bp, human
ggcccctgagtcaccaccat

SEQ ID NO: 401554 - DNA, 20 bp, human
gccgcgtcctgtgcaatcga

SEQ ID NO: 401555 - DNA, 20 bp, human
gacgccgcgtggcggacgga

SEQ ID NO: 401556 - DNA, 20 bp, human
ggacgtagtgggagtaggat

SEQ ID NO: 401557 - DNA, 20 bp, human
gacacccctcaggacgtagt

SEQ ID NO: 401558 - DNA, 20 bp, human
gctactcccactacgtcctg

SEQ ID NO: 401559 - DNA, 20 bp, human
gcgggcccaccctcaaccaa

SEQ ID NO: 401560 - DNA, 20 bp, human
ggggcccgctcagaatccag

SEQ ID NO: 401561 - DNA, 20 bp, human
gaggcaggggccgcgaaaca

SEQ ID NO: 401562 - DNA, 20 bp, human
gccgcgaaacaggggacctt

SEQ ID NO: 401563 - DNA, 20 bp, human
gtcccaaggcggaaaaagag

SEQ ID NO: 401564 - DNA, 20 bp, human
gaacaggggacctttggttg

SEQ ID NO: 401565 - DNA, 20 bp, human
gccctggaccgcgaactccg

SEQ ID NO: 401566 - DNA, 20 bp, human
gggcctgcggggccaaagca

SEQ ID NO: 401567 - DNA, 20 bp, human
gcacggcgcaccgcaggcta

SEQ ID NO: 401568 - DNA, 20 bp, human
gtcccggcagtcgcgggcgt

SEQ ID NO: 401569 - DNA, 20 bp, human
gccaaagcacggcgcaccgc

SEQ ID NO: 401570 - DNA, 20 bp, human
ggcgcaccgcaggctagggg

SEQ ID NO: 401571 - DNA, 20 bp, human
gtgggagccaggggcaccgg

SEQ ID NO: 401572 - DNA, 20 bp, human
gcgctcgcggccgggttgca

SEQ ID NO: 401573 - DNA, 20 bp, human
gagcccacgcccgcgactgc

SEQ ID NO: 401574 - DNA, 20 bp, human
gctcgcaacaccttcagtcc

SEQ ID NO: 401575 - DNA, 20 bp, human
gggagcacacgtgggagcca

SEQ ID NO: 401576 - DNA, 20 bp, human
gtgcctcgctcacaactcac

SEQ ID NO: 401577 - DNA, 20 bp, human
ggggcgaagacggcgagtgg

SEQ ID NO: 401578 - DNA, 20 bp, human
gcgcaagcgaaaggctccgg

SEQ ID NO: 401579 - DNA, 20 bp, human
ggctgcgtgtgcgcggaggc

SEQ ID NO: 401580 - DNA, 20 bp, human
gcaccgcaagcgaaaggctc

SEQ ID NO: 401581 - DNA, 20 bp, human
gccagaccatggtaagacta

SEQ ID NO: 401582 - DNA, 20 bp, human
gaagacggcgagtggaggct

SEQ ID NO: 401583 - DNA, 20 bp, human
gcatcaacactgccaaccga

SEQ ID NO: 401584 - DNA, 20 bp, human
ggaggcaattacggggtcgc

SEQ ID NO: 401585 - DNA, 20 bp, human
gcaaaatcaccgcaagcgaa

SEQ ID NO: 401586 - DNA, 20 bp, human
gtggccgcgtttgaagtctc

SEQ ID NO: 401587 - DNA, 20 bp, human
ggcagccgggggtaccaagg

SEQ ID NO: 401588 - DNA, 20 bp, human
ggctgctggttggccggcga

SEQ ID NO: 401589 - DNA, 20 bp, human
gcccgccggctaactcgccg

SEQ ID NO: 401590 - DNA, 20 bp, human
gcccgcggcgagttagccgg

SEQ ID NO: 401591 - DNA, 20 bp, human
ggcgctccagagcccctctg

SEQ ID NO: 401592 - DNA, 20 bp, human
ggcgccggagacttcaaacg

SEQ ID NO: 401593 - DNA, 20 bp, human
gggtaccaagggggcaacgg

SEQ ID NO: 401594 - DNA, 20 bp, human
ggggcgcacgtgaccctcgc

SEQ ID NO: 401595 - DNA, 20 bp, human
ggggtagctaaggacagcgg

SEQ ID NO: 401596 - DNA, 20 bp, human
gcgccccggctccactggtc

SEQ ID NO: 401597 - DNA, 20 bp, human
gcctccgtcaagggagttgg

SEQ ID NO: 401598 - DNA, 20 bp, human
gccaatccgggtccgaactg

SEQ ID NO: 401599 - DNA, 20 bp, human
gctacattcctgcacactcc

SEQ ID NO: 401600 - DNA, 20 bp, human
gcgggcgggcgcgcagagga

SEQ ID NO: 401601 - DNA, 20 bp, human
gccgcgggccgggagtgtgc

SEQ ID NO: 401602 - DNA, 20 bp, human
ggcaaacgatgggtccaatc

SEQ ID NO: 401603 - DNA, 20 bp, human
ggttcgcggggcagaatacg

SEQ ID NO: 401604 - DNA, 20 bp, human
gggtcacgtgcggccgggag

SEQ ID NO: 401605 - DNA, 20 bp, human
gcacgcttcgggcccctgcc

SEQ ID NO: 401606 - DNA, 20 bp, human
gaggtcgatgagacgggaaa

SEQ ID NO: 401607 - DNA, 20 bp, human
gaaaccgtcccgcctctagg

SEQ ID NO: 401608 - DNA, 20 bp, human
gagccagtgggcacggtggg

SEQ ID NO: 401609 - DNA, 20 bp, human
gtggagccagtgggcacggt

SEQ ID NO: 401610 - DNA, 20 bp, human
ggggctgaggcgcctgagcg

SEQ ID NO: 401611 - DNA, 20 bp, human
gcggggcacaaccctcctag

SEQ ID NO: 401612 - DNA, 20 bp, human
gaaccctcctagaggcggga

SEQ ID NO: 401613 - DNA, 20 bp, human
gcagccgggccaacaccagg

SEQ ID NO: 401614 - DNA, 20 bp, human
ggagcagcagagagtcgagc

SEQ ID NO: 401615 - DNA, 20 bp, human
ggggaaaaggtggagccagt

SEQ ID NO: 401616 - DNA, 20 bp, human
gtaaggcgacggctctgagg

SEQ ID NO: 401617 - DNA, 20 bp, human
gttaagggaacgtaaggcga

SEQ ID NO: 401618 - DNA, 20 bp, human
gctaggagctgtaagtaggt

SEQ ID NO: 401619 - DNA, 20 bp, human
gcggaatcgccacttggagt

SEQ ID NO: 401620 - DNA, 20 bp, human
ggtaactacgtaaccgtctc

SEQ ID NO: 401621 - DNA, 20 bp, human
gtggggacgaggtgcaatta

SEQ ID NO: 401622 - DNA, 20 bp, human
gtggaagagccgatgaatac

SEQ ID NO: 401623 - DNA, 20 bp, human
gacgtaaggcgacggctctg

SEQ ID NO: 401624 - DNA, 20 bp, human
gttccctaggagctgtaagt

SEQ ID NO: 401625 - DNA, 20 bp, human
gacactgaagcaccttccct

SEQ ID NO: 401626 - DNA, 20 bp, human
gggcccctcggaaagacttg

SEQ ID NO: 401627 - DNA, 20 bp, human
gcgaaccggaagtcggtccg

SEQ ID NO: 401628 - DNA, 20 bp, human
ggagagaaggggctggaatg

SEQ ID NO: 401629 - DNA, 20 bp, human
ggggttgtggggagcggaac

SEQ ID NO: 401630 - DNA, 20 bp, human
gggcgcccgcagacccacgc

SEQ ID NO: 401631 - DNA, 20 bp, human
ggggcgagacggtgagcgtg

SEQ ID NO: 401632 - DNA, 20 bp, human
ggcgcctcaagtctttccga

SEQ ID NO: 401633 - DNA, 20 bp, human
ggctccgagggaagccaggt

SEQ ID NO: 401634 - DNA, 20 bp, human
gaaccggatcgcagcgggcg

SEQ ID NO: 401635 - DNA, 20 bp, human
gaacgccgcggaccgacttc

SEQ ID NO: 401636 - DNA, 20 bp, human
gcacgcccgaacgctgggca

SEQ ID NO: 401637 - DNA, 20 bp, human
gacccgagaggacgggcaga

SEQ ID NO: 401638 - DNA, 20 bp, human
gcggaggcaggaacggttgt

SEQ ID NO: 401639 - DNA, 20 bp, human
gcggccgcgcggggtccaca

SEQ ID NO: 401640 - DNA, 20 bp, human
gctagggcgggtcgctcgta

SEQ ID NO: 401641 - DNA, 20 bp, human
gcgccggccgccatagagac

SEQ ID NO: 401642 - DNA, 20 bp, human
gctagggattggggtcaggt

SEQ ID NO: 401643 - DNA, 20 bp, human
gcgccctaggcgttgttcac

SEQ ID NO: 401644 - DNA, 20 bp, human
gggccagtgaacaacgccta

SEQ ID NO: 401645 - DNA, 20 bp, human
gaaaggtccaatgagaatgg

SEQ ID NO: 401646 - DNA, 20 bp, human
ggggcccaggtgtacttact

SEQ ID NO: 401647 - DNA, 20 bp, human
ggggccgccggccaatgggt

SEQ ID NO: 401648 - DNA, 20 bp, human
ggggtcggcgtgcggtccgg

SEQ ID NO: 401649 - DNA, 20 bp, human
gccccctggccgccacgtga

SEQ ID NO: 401650 - DNA, 20 bp, human
gaaaggggccgccggccaat

SEQ ID NO: 401651 - DNA, 20 bp, human
gccgcggtgcgaagtccggg

SEQ ID NO: 401652 - DNA, 20 bp, human
gccgcccagtaagtacacct

SEQ ID NO: 401653 - DNA, 20 bp, human
gtcccgcggccggtggaaag

SEQ ID NO: 401654 - DNA, 20 bp, human
gggcccccggcccaacccat

SEQ ID NO: 401655 - DNA, 20 bp, human
ggggccgcggtgcgaagtcc

SEQ ID NO: 401656 - DNA, 20 bp, human
ggcaccggcccgggagggaa

SEQ ID NO: 401657 - DNA, 20 bp, human
ggggcgcccgggttgtcttc

SEQ ID NO: 401658 - DNA, 20 bp, human
gcagctgcgggtgtcaagac

SEQ ID NO: 401659 - DNA, 20 bp, human
ggacccgcgcgctcgcgtcc

SEQ ID NO: 401660 - DNA, 20 bp, human
ggggtggggaaacttggctc

SEQ ID NO: 401661 - DNA, 20 bp, human
ggcggcgcaccggcccggga

SEQ ID NO: 401662 - DNA, 20 bp, human
gtctaggcggcgcaccggcc

SEQ ID NO: 401663 - DNA, 20 bp, human
gggagccatagaaagcgcac

SEQ ID NO: 401664 - DNA, 20 bp, human
gccgggcgccccgttcaccc

SEQ ID NO: 401665 - DNA, 20 bp, human
ggtgctgcgcgctctctctt

SEQ ID NO: 401666 - DNA, 20 bp, human
gttagcgcgggagcagttgc

SEQ ID NO: 401667 - DNA, 20 bp, human
gttctcgccacctagcggtc

SEQ ID NO: 401668 - DNA, 20 bp, human
gggcacgccggaccgctagg

SEQ ID NO: 401669 - DNA, 20 bp, human
gctgtccggcccactcccct

SEQ ID NO: 401670 - DNA, 20 bp, human
gcgcacctgggcgtgtgcgt

SEQ ID NO: 401671 - DNA, 20 bp, human
ggcgtgcccctgcaaggacc

SEQ ID NO: 401672 - DNA, 20 bp, human
gcgcatgcgagggcgggaca

SEQ ID NO: 401673 - DNA, 20 bp, human
gaatgaatccatcactggtc

SEQ ID NO: 401674 - DNA, 20 bp, human
gggggcccgggcagcgtccg

SEQ ID NO: 401675 - DNA, 20 bp, human
gtcactggtctggttagcgc

SEQ ID NO: 401676 - DNA, 20 bp, human
gcctcggggcggagctccca

SEQ ID NO: 401677 - DNA, 20 bp, human
ggcccgcgagggcacttcct

SEQ ID NO: 401678 - DNA, 20 bp, human
ggcggagctcccagggatga

SEQ ID NO: 401679 - DNA, 20 bp, human
gctgggaccccggcccgcga

SEQ ID NO: 401680 - DNA, 20 bp, human
gtgcccaggaagtgccctcg

SEQ ID NO: 401681 - DNA, 20 bp, human
gcccgccccgccctcatccc

SEQ ID NO: 401682 - DNA, 20 bp, human
ggctcccagggatgagggcg

SEQ ID NO: 401683 - DNA, 20 bp, human
gcagctgctgacgtgcgggg

SEQ ID NO: 401684 - DNA, 20 bp, human
gtgggcgtcgattcttgcaa

SEQ ID NO: 401685 - DNA, 20 bp, human
ggcccagctgctgacgtgcg

SEQ ID NO: 401686 - DNA, 20 bp, human
ggcggctgcagtcacatcac

SEQ ID NO: 401687 - DNA, 20 bp, human
gggagaacgccgcgaaaaga

SEQ ID NO: 401688 - DNA, 20 bp, human
ggccgcgaaaagaggggcga

SEQ ID NO: 401689 - DNA, 20 bp, human
gtgtacactgcgcacgcgcc

SEQ ID NO: 401690 - DNA, 20 bp, human
gaaaagttgtccagatgtta

SEQ ID NO: 401691 - DNA, 20 bp, human
gaactcatctccttaacatc

SEQ ID NO: 401692 - DNA, 20 bp, human
gaggccattcaggcccgcgc

SEQ ID NO: 401693 - DNA, 20 bp, human
ggccgtcgcccctcttttcg

SEQ ID NO: 401694 - DNA, 20 bp, human
gcacacactagattggtagt

SEQ ID NO: 401695 - DNA, 20 bp, human
gcgacggccgcaccgcgcgc

SEQ ID NO: 401696 - DNA, 20 bp, human
ggggtccggggcggattccc

SEQ ID NO: 401697 - DNA, 20 bp, human
gcccgccgccatgttgggtc

SEQ ID NO: 401698 - DNA, 20 bp, human
gccaacatggcggcggggtc

SEQ ID NO: 401699 - DNA, 20 bp, human
gtggcccgagttccggtgag

SEQ ID NO: 401700 - DNA, 20 bp, human
gcgcgccgccgtccgctcac

SEQ ID NO: 401701 - DNA, 20 bp, human
gcccgctagaagtcaggggg

SEQ ID NO: 401702 - DNA, 20 bp, human
ggctccgggccgctttgctg

SEQ ID NO: 401703 - DNA, 20 bp, human
gcgcggaggggacctgacgg

SEQ ID NO: 401704 - DNA, 20 bp, human
gcgcccccgggaatccgccc

SEQ ID NO: 401705 - DNA, 20 bp, human
gcgtccgctcaccggaactc

SEQ ID NO: 401706 - DNA, 20 bp, human
gcaacatccgggtgagggac

SEQ ID NO: 401707 - DNA, 20 bp, human
ggtgcctgggattggatcac

SEQ ID NO: 401708 - DNA, 20 bp, human
gggagcgacttgcggtgcct

SEQ ID NO: 401709 - DNA, 20 bp, human
ggacttgcggtgcctgggat

SEQ ID NO: 401710 - DNA, 20 bp, human
ggggcttgccagttcacggt

SEQ ID NO: 401711 - DNA, 20 bp, human
gcctgccattggctcttcgg

SEQ ID NO: 401712 - DNA, 20 bp, human
gggacaggcggagcgacttg

SEQ ID NO: 401713 - DNA, 20 bp, human
ggaaggcaacatccgggtga

SEQ ID NO: 401714 - DNA, 20 bp, human
gtcaggccagagctcgtcag

SEQ ID NO: 401715 - DNA, 20 bp, human
gtcagtggccaattgggaga

SEQ ID NO: 401716 - DNA, 20 bp, human
ggggcggtgccttacgtaag

SEQ ID NO: 401717 - DNA, 20 bp, human
gccagccccccccttcacgg

SEQ ID NO: 401718 - DNA, 20 bp, human
gaggcggagactgggctact

SEQ ID NO: 401719 - DNA, 20 bp, human
gtacgtaagaggcggagact

SEQ ID NO: 401720 - DNA, 20 bp, human
gcgtccaggcctccgtgaag

SEQ ID NO: 401721 - DNA, 20 bp, human
gccaggcctccgtgaagggg

SEQ ID NO: 401722 - DNA, 20 bp, human
gcctcgccctcctgccactc

SEQ ID NO: 401723 - DNA, 20 bp, human
gcggtgccttacgtaagagg

SEQ ID NO: 401724 - DNA, 20 bp, human
gcacccggcaggcttggcgg

SEQ ID NO: 401725 - DNA, 20 bp, human
gcgaaccgcggcttaggtgg

SEQ ID NO: 401726 - DNA, 20 bp, human
gttcttaaagagacaggcga

SEQ ID NO: 401727 - DNA, 20 bp, human
gcaggcgagggcggagtggt

SEQ ID NO: 401728 - DNA, 20 bp, human
gtcgctgagtgtgactactt

SEQ ID NO: 401729 - DNA, 20 bp, human
gttaaagagacaggcgaggg

SEQ ID NO: 401730 - DNA, 20 bp, human
ggccggaagccggagatccg

SEQ ID NO: 401731 - DNA, 20 bp, human
gcagagaaacctgcgtgctg

SEQ ID NO: 401732 - DNA, 20 bp, human
gaactgggctggaccgaaac

SEQ ID NO: 401733 - DNA, 20 bp, human
ggaggcggggctcttcccgg

SEQ ID NO: 401734 - DNA, 20 bp, human
ggttccgccccccggatctc

SEQ ID NO: 401735 - DNA, 20 bp, human
gagctgctgtctctttaagg

SEQ ID NO: 401736 - DNA, 20 bp, human
gcggaagaggatggccgcgg

SEQ ID NO: 401737 - DNA, 20 bp, human
gactcccgggctcttaacgt

SEQ ID NO: 401738 - DNA, 20 bp, human
gaggacccccaagacggaag

SEQ ID NO: 401739 - DNA, 20 bp, human
gttgcgcagaagagactccc

SEQ ID NO: 401740 - DNA, 20 bp, human
gaccggaagtggcttcccaa

SEQ ID NO: 401741 - DNA, 20 bp, human
gtacccgacgttaagagccc

SEQ ID NO: 401742 - DNA, 20 bp, human
gagtggcttcccaacgggag

SEQ ID NO: 401743 - DNA, 20 bp, human
gcccccaagacggaagagga

SEQ ID NO: 401744 - DNA, 20 bp, human
gggccatcctcttccgtctt

SEQ ID NO: 401745 - DNA, 20 bp, human
gacctgggccggcgtggctg

SEQ ID NO: 401746 - DNA, 20 bp, human
gtagccctgctccgtctccg

SEQ ID NO: 401747 - DNA, 20 bp, human
gttgccacggagacggagca

SEQ ID NO: 401748 - DNA, 20 bp, human
gctcgtggagagattgaaga

SEQ ID NO: 401749 - DNA, 20 bp, human
gcggtgcgttgccacggaga

SEQ ID NO: 401750 - DNA, 20 bp, human
gaggaggcggtgcgttgcca

SEQ ID NO: 401751 - DNA, 20 bp, human
gcggaacagggatgggtctt

SEQ ID NO: 401752 - DNA, 20 bp, human
ggcggcttctcaggcggtgg

SEQ ID NO: 401753 - DNA, 20 bp, human
ggtggagagattgaagatgg

SEQ ID NO: 401754 - DNA, 20 bp, human
gttggcgtggggatagctgt

SEQ ID NO: 401755 - DNA, 20 bp, human
gaatctctccacgagactag

SEQ ID NO: 401756 - DNA, 20 bp, human
gacgacgccggcaccctgac

SEQ ID NO: 401757 - DNA, 20 bp, human
gtgccggcgtcgtggtgctt

SEQ ID NO: 401758 - DNA, 20 bp, human
gcacccaagcaccacgacgc

SEQ ID NO: 401759 - DNA, 20 bp, human
gaggaccataacagtgacag

SEQ ID NO: 401760 - DNA, 20 bp, human
gggaacaaaagcacccaagg

SEQ ID NO: 401761 - DNA, 20 bp, human
gctctcccattggctcccgg

SEQ ID NO: 401762 - DNA, 20 bp, human
gcaagtgaacttcctgtcct

SEQ ID NO: 401763 - DNA, 20 bp, human
gccggaggaagattctgatt

SEQ ID NO: 401764 - DNA, 20 bp, human
gtgcgagcgaggccagaaac

SEQ ID NO: 401765 - DNA, 20 bp, human
gcctgtcctgggtaaacttc

SEQ ID NO: 401766 - DNA, 20 bp, human
gggaggaggagacacgagta

SEQ ID NO: 401767 - DNA, 20 bp, human
gcggctggcccgtgccaaag

SEQ ID NO: 401768 - DNA, 20 bp, human
ggcttccggcagcctggtta

SEQ ID NO: 401769 - DNA, 20 bp, human
gtgccccggaagccgttctt

SEQ ID NO: 401770 - DNA, 20 bp, human
gccggcagcctggttagggg

SEQ ID NO: 401771 - DNA, 20 bp, human
ggcagtatctacccaacctg

SEQ ID NO: 401772 - DNA, 20 bp, human
gtatctacccaacctgcggc

SEQ ID NO: 401773 - DNA, 20 bp, human
gtgacacgtagcaacggggc

SEQ ID NO: 401774 - DNA, 20 bp, human
gggccaaagaacggcttccg

SEQ ID NO: 401775 - DNA, 20 bp, human
gttagcaggttgggcaccgg

SEQ ID NO: 401776 - DNA, 20 bp, human
gaggaccgagggacagcgaa

SEQ ID NO: 401777 - DNA, 20 bp, human
gaaatgggcgggagtcggtg

SEQ ID NO: 401778 - DNA, 20 bp, human
gctgacaccccgaggaccga

SEQ ID NO: 401779 - DNA, 20 bp, human
ggcggagggagcaggaggtt

SEQ ID NO: 401780 - DNA, 20 bp, human
gtcgccttgtctcgcttctt

SEQ ID NO: 401781 - DNA, 20 bp, human
gggcgcctggcaatggccgg

SEQ ID NO: 401782 - DNA, 20 bp, human
gccggcccttcgctgtccct

SEQ ID NO: 401783 - DNA, 20 bp, human
gtgacggccgcgtcacctaa

SEQ ID NO: 401784 - DNA, 20 bp, human
gatgacgcgctgaccggcag

SEQ ID NO: 401785 - DNA, 20 bp, human
ggccccgaagaagcgagaca

SEQ ID NO: 401786 - DNA, 20 bp, human
gcggcggaggcgtcaggaga

SEQ ID NO: 401787 - DNA, 20 bp, human
gagggtccacatgacccggg

SEQ ID NO: 401788 - DNA, 20 bp, human
gccccagccccgacccacga

SEQ ID NO: 401789 - DNA, 20 bp, human
ggggtcatgtggaccctcgt

SEQ ID NO: 401790 - DNA, 20 bp, human
gtaccccccgtaggatccgg

SEQ ID NO: 401791 - DNA, 20 bp, human
gcggtccgcgccgacccttg

SEQ ID NO: 401792 - DNA, 20 bp, human
ggcaagctgcgccgccgctt

SEQ ID NO: 401793 - DNA, 20 bp, human
gcggaagcaacccgaagcgg

SEQ ID NO: 401794 - DNA, 20 bp, human
gctcgcgccacgagccactg

SEQ ID NO: 401795 - DNA, 20 bp, human
gcatgtggaccctcgtgggt

SEQ ID NO: 401796 - DNA, 20 bp, human
gcgaccgcgcgggaaagctc

SEQ ID NO: 401797 - DNA, 20 bp, human
gggcctgcgcaacaccccag

SEQ ID NO: 401798 - DNA, 20 bp, human
gaagcacttgagatggtccg

SEQ ID NO: 401799 - DNA, 20 bp, human
ggtggcggaagcacttgaga

SEQ ID NO: 401800 - DNA, 20 bp, human
gagctctggcggcggaccct

SEQ ID NO: 401801 - DNA, 20 bp, human
gagaggcaaggtgaacgcga

SEQ ID NO: 401802 - DNA, 20 bp, human
gccgcgcgggaaagctctgg

SEQ ID NO: 401803 - DNA, 20 bp, human
gcgcgggaaagctctggcgg

SEQ ID NO: 401804 - DNA, 20 bp, human
gcggcacggctaggaagtcc

SEQ ID NO: 401805 - DNA, 20 bp, human
gggaaaaggggccttaactg

SEQ ID NO: 401806 - DNA, 20 bp, human
gtgcagggaaagtaagtcgg

SEQ ID NO: 401807 - DNA, 20 bp, human
ggtgggctcctggcacgaaa

SEQ ID NO: 401808 - DNA, 20 bp, human
ggctgcgcgtcaccattggt

SEQ ID NO: 401809 - DNA, 20 bp, human
gagacacggggatatctgca

SEQ ID NO: 401810 - DNA, 20 bp, human
gggctcctcgctccctgaga

SEQ ID NO: 401811 - DNA, 20 bp, human
ggcgcgtcaccattggtcgg

SEQ ID NO: 401812 - DNA, 20 bp, human
gccagcctggagaggtaagt

SEQ ID NO: 401813 - DNA, 20 bp, human
gaggcgctgcgcgtcaccat

SEQ ID NO: 401814 - DNA, 20 bp, human
gcgggggaagcaaccaagat

SEQ ID NO: 401815 - DNA, 20 bp, human
gtaagcgcatccgtggaggg

SEQ ID NO: 401816 - DNA, 20 bp, human
gcggaagtacaatgcagcga

SEQ ID NO: 401817 - DNA, 20 bp, human
gtccacctggcgagcaggga

SEQ ID NO: 401818 - DNA, 20 bp, human
gagtacaatgcagcgagggg

SEQ ID NO: 401819 - DNA, 20 bp, human
ggaggggccaagcttacgcg

SEQ ID NO: 401820 - DNA, 20 bp, human
gcgactccacctggcgagca

SEQ ID NO: 401821 - DNA, 20 bp, human
gcacccagcacaagacagta

SEQ ID NO: 401822 - DNA, 20 bp, human
ggccacgcctcgcgtaagct

SEQ ID NO: 401823 - DNA, 20 bp, human
gcggaagtggattgcgagcc

SEQ ID NO: 401824 - DNA, 20 bp, human
ggccaagcttacgcgaggcg

SEQ ID NO: 401825 - DNA, 20 bp, human
gagtatgagaaccctcaacc

SEQ ID NO: 401826 - DNA, 20 bp, human
ggaaggcggggacgcgactt

SEQ ID NO: 401827 - DNA, 20 bp, human
ggctgggcccgcgaccggga

SEQ ID NO: 401828 - DNA, 20 bp, human
gaggccccggagcgtgtaaa

SEQ ID NO: 401829 - DNA, 20 bp, human
gctgcgcagtaaccaccgag

SEQ ID NO: 401830 - DNA, 20 bp, human
gaccacgagtcgccaagtaa

SEQ ID NO: 401831 - DNA, 20 bp, human
ggtctcacagccgaaagagg

SEQ ID NO: 401832 - DNA, 20 bp, human
gggatctctaccacctcttt

SEQ ID NO: 401833 - DNA, 20 bp, human
gggcccgcgaccgggaaggc

SEQ ID NO: 401834 - DNA, 20 bp, human
gtccccgccttcccggtcgc

SEQ ID NO: 401835 - DNA, 20 bp, human
gtgcgccggcgctcccgagc

SEQ ID NO: 401836 - DNA, 20 bp, human
gtccgcgggaaagaacgcgc

SEQ ID NO: 401837 - DNA, 20 bp, human
ggggcaagtgagcgcccaca

SEQ ID NO: 401838 - DNA, 20 bp, human
gtaaatgtcaactacttccg

SEQ ID NO: 401839 - DNA, 20 bp, human
gtaactcaacagtacttccg

SEQ ID NO: 401840 - DNA, 20 bp, human
gagcgcctcgccttccgggg

SEQ ID NO: 401841 - DNA, 20 bp, human
gcgcaggcacttggccttgt

SEQ ID NO: 401842 - DNA, 20 bp, human
gcgaagaaaaagtccaaaga

SEQ ID NO: 401843 - DNA, 20 bp, human
gacagacaatccgccccgga

SEQ ID NO: 401844 - DNA, 20 bp, human
ggcctgcgcgttctttcccg

SEQ ID NO: 401845 - DNA, 20 bp, human
ggaaagaacgcgcaggcact

SEQ ID NO: 401846 - DNA, 20 bp, human
gggaaggagttcctgaatga

SEQ ID NO: 401847 - DNA, 20 bp, human
gtgctcaagaaaagagggcg

SEQ ID NO: 401848 - DNA, 20 bp, human
gtaaacctccgtattcctaa

SEQ ID NO: 401849 - DNA, 20 bp, human
gagtgaggtgccctccgcgt

SEQ ID NO: 401850 - DNA, 20 bp, human
gggcacctcactcgctctat

SEQ ID NO: 401851 - DNA, 20 bp, human
gcgcgcttgctaaggtacta

SEQ ID NO: 401852 - DNA, 20 bp, human
gttatcgcgacgcttcggtg

SEQ ID NO: 401853 - DNA, 20 bp, human
gtgaatgaaggtctggagat

SEQ ID NO: 401854 - DNA, 20 bp, human
ggctacctatagagcgagtg

SEQ ID NO: 401855 - DNA, 20 bp, human
gaggtggtggcagtgtaagg

SEQ ID NO: 401856 - DNA, 20 bp, human
ggggacgcggggcggaacgg

SEQ ID NO: 401857 - DNA, 20 bp, human
gagctcgcacccggccggga

SEQ ID NO: 401858 - DNA, 20 bp, human
gagctccgccagctcgcacc

SEQ ID NO: 401859 - DNA, 20 bp, human
gtccctcggcccttacaggc

SEQ ID NO: 401860 - DNA, 20 bp, human
ggcccggcgggtcagccaat

SEQ ID NO: 401861 - DNA, 20 bp, human
gtaagggccgagggacacgg

SEQ ID NO: 401862 - DNA, 20 bp, human
ggcgagctggcggagctcct

SEQ ID NO: 401863 - DNA, 20 bp, human
gcctcggagccagcctgtaa

SEQ ID NO: 401864 - DNA, 20 bp, human
gggcgcgccccgcggcacgt

SEQ ID NO: 401865 - DNA, 20 bp, human
gcgtgggctcctgcccgtcc

SEQ ID NO: 401866 - DNA, 20 bp, human
ggttagggtcccgcccgtcc

SEQ ID NO: 401867 - DNA, 20 bp, human
ggctctgcgcggatgggctg

SEQ ID NO: 401868 - DNA, 20 bp, human
ggctgcgcccggccaacccg

SEQ ID NO: 401869 - DNA, 20 bp, human
gtgggcggtcggggaagcgg

SEQ ID NO: 401870 - DNA, 20 bp, human
gagttccgtcctctgatgat

SEQ ID NO: 401871 - DNA, 20 bp, human
gagagccaatcatcagagga

SEQ ID NO: 401872 - DNA, 20 bp, human
ggacccggagggatgcggag

SEQ ID NO: 401873 - DNA, 20 bp, human
gaggggagagcggctggtta

SEQ ID NO: 401874 - DNA, 20 bp, human
gaacacgccgcgggttggcc

SEQ ID NO: 401875 - DNA, 20 bp, human
gagcacatagcaacacgccg

SEQ ID NO: 401876 - DNA, 20 bp, human
gtcccgccggcccggaaatg

SEQ ID NO: 401877 - DNA, 20 bp, human
ggggccgcagccgcatttcc

SEQ ID NO: 401878 - DNA, 20 bp, human
gggcgctccgcatgcaaatg

SEQ ID NO: 401879 - DNA, 20 bp, human
ggctccgcatgcaaatgagg

SEQ ID NO: 401880 - DNA, 20 bp, human
gaggaatgcgagcaggcctg

SEQ ID NO: 401881 - DNA, 20 bp, human
ggacccgcctcctgtcccgg

SEQ ID NO: 401882 - DNA, 20 bp, human
gggcgctgggacgcatgctc

SEQ ID NO: 401883 - DNA, 20 bp, human
ggggcgcggagcgaggaagc

SEQ ID NO: 401884 - DNA, 20 bp, human
gcacaagcaggaatgcgagc

SEQ ID NO: 401885 - DNA, 20 bp, human
ggagggggcgcgtcacacgg

SEQ ID NO: 401886 - DNA, 20 bp, human
gcacctcccacgtcagagca

SEQ ID NO: 401887 - DNA, 20 bp, human
gccgagggacaaggcggcga

SEQ ID NO: 401888 - DNA, 20 bp, human
gaggaggcgggtcggaagga

SEQ ID NO: 401889 - DNA, 20 bp, human
ggggacaaggcggcgatggt

SEQ ID NO: 401890 - DNA, 20 bp, human
gggcaaggatgcagtgaggg

SEQ ID NO: 401891 - DNA, 20 bp, human
gcccagccctgctctgacgt

SEQ ID NO: 401892 - DNA, 20 bp, human
gcatcaagggacggggctag

SEQ ID NO: 401893 - DNA, 20 bp, human
gaggcggcgatggtgggcaa

SEQ ID NO: 401894 - DNA, 20 bp, human
ggagaggcaggttgttaagg

SEQ ID NO: 401895 - DNA, 20 bp, human
ggggagggggtaggcatcaa

SEQ ID NO: 401896 - DNA, 20 bp, human
gaggaggccgaggacagggg

SEQ ID NO: 401897 - DNA, 20 bp, human
ggccccgcgaaaaaggcagg

SEQ ID NO: 401898 - DNA, 20 bp, human
gccgcgaagcggaggggtgc

SEQ ID NO: 401899 - DNA, 20 bp, human
ggggcggggccccgcgaaaa

SEQ ID NO: 401900 - DNA, 20 bp, human
ggggcggggcctagaaataa

SEQ ID NO: 401901 - DNA, 20 bp, human
ggggtgggccgcgaagcgga

SEQ ID NO: 401902 - DNA, 20 bp, human
ggcctcctgcctttttcgcg

SEQ ID NO: 401903 - DNA, 20 bp, human
gtagaaataaagggcgttct

SEQ ID NO: 401904 - DNA, 20 bp, human
gagcggaggggtgcgggagt

SEQ ID NO: 401905 - DNA, 20 bp, human
gtgggtctgcggcttctgag

SEQ ID NO: 401906 - DNA, 20 bp, human
gcgtggaccgcgggaaggcg

SEQ ID NO: 401907 - DNA, 20 bp, human
gccctaacgcagcgctgggg

SEQ ID NO: 401908 - DNA, 20 bp, human
gtaaagggaccacgaccccc

SEQ ID NO: 401909 - DNA, 20 bp, human
ggaaggagaccggtggggac

SEQ ID NO: 401910 - DNA, 20 bp, human
gaagccctaacgcagcgctg

SEQ ID NO: 401911 - DNA, 20 bp, human
gaggattgaaggagaccggt

SEQ ID NO: 401912 - DNA, 20 bp, human
gtctgcgccgggcagcttaa

SEQ ID NO: 401913 - DNA, 20 bp, human
ggcccaggcccgcttccggg

SEQ ID NO: 401914 - DNA, 20 bp, human
gcgacccccaggaggattga

SEQ ID NO: 401915 - DNA, 20 bp, human
ggggcctgggcggatgtctc

SEQ ID NO: 401916 - DNA, 20 bp, human
gaacgtcacagtgcggagag

SEQ ID NO: 401917 - DNA, 20 bp, human
gctctgggaacgtcacagtg

SEQ ID NO: 401918 - DNA, 20 bp, human
gacggcgggcggcgctaaaa

SEQ ID NO: 401919 - DNA, 20 bp, human
gccgctgtacggcctataac

SEQ ID NO: 401920 - DNA, 20 bp, human
gctggaaggagtcttattca

SEQ ID NO: 401921 - DNA, 20 bp, human
gaggttacccaggttgttca

SEQ ID NO: 401922 - DNA, 20 bp, human
gaaacagcgcagggcatttc

SEQ ID NO: 401923 - DNA, 20 bp, human
gtttacgcttcgttcctctc

SEQ ID NO: 401924 - DNA, 20 bp, human
gccctcagcccactggtacc

SEQ ID NO: 401925 - DNA, 20 bp, human
gagagcgactctagctaaga

SEQ ID NO: 401926 - DNA, 20 bp, human
gtgtctgcggagctatggtg

SEQ ID NO: 401927 - DNA, 20 bp, human
ggacccttggtgggcggcgc

SEQ ID NO: 401928 - DNA, 20 bp, human
ggccgctgcgcgcctaaagg

SEQ ID NO: 401929 - DNA, 20 bp, human
ggaggctgtctgcggagcta

SEQ ID NO: 401930 - DNA, 20 bp, human
gatgaggagcgacccttggt

SEQ ID NO: 401931 - DNA, 20 bp, human
ggggcgtaatgacgtcacca

SEQ ID NO: 401932 - DNA, 20 bp, human
ggttctccaatgtacatcga

SEQ ID NO: 401933 - DNA, 20 bp, human
ggccgccgctgcgcgcctaa

SEQ ID NO: 401934 - DNA, 20 bp, human
ggcgctgaggtcacgggcgc

SEQ ID NO: 401935 - DNA, 20 bp, human
gccacgccttcgatgtacat

SEQ ID NO: 401936 - DNA, 20 bp, human
gaagtcacgtggggcgtgtc

SEQ ID NO: 401937 - DNA, 20 bp, human
gcctgcgcgctcccgtctta

SEQ ID NO: 401938 - DNA, 20 bp, human
gtgagccggggaagtcacgt

SEQ ID NO: 401939 - DNA, 20 bp, human
gcgccccgccgcacgagact

SEQ ID NO: 401940 - DNA, 20 bp, human
gacgccccacgtgacttccc

SEQ ID NO: 401941 - DNA, 20 bp, human
ggcggggaagccctgagccg

SEQ ID NO: 401942 - DNA, 20 bp, human
ggtcccagtctcgtgcggcg

SEQ ID NO: 401943 - DNA, 20 bp, human
gtcacgtggggcgtgtccgg

SEQ ID NO: 401944 - DNA, 20 bp, human
ggcggggaccgcagccggct

SEQ ID NO: 401945 - DNA, 20 bp, human
gcgcgacctggaacacgcgg

SEQ ID NO: 401946 - DNA, 20 bp, human
ggcgccctctggcggattgg

SEQ ID NO: 401947 - DNA, 20 bp, human
ggcccggcgcgaagaacccc

SEQ ID NO: 401948 - DNA, 20 bp, human
gcgccgggccccttccgcgt

SEQ ID NO: 401949 - DNA, 20 bp, human
ggcagagcgccgaacagcgg

SEQ ID NO: 401950 - DNA, 20 bp, human
ggcgcgaagaaccccgggaa

SEQ ID NO: 401951 - DNA, 20 bp, human
ggctgcgccctctggcggat

SEQ ID NO: 401952 - DNA, 20 bp, human
gtcactcacccacgcggaag

SEQ ID NO: 401953 - DNA, 20 bp, human
gaccccctaggccttaatcc

SEQ ID NO: 401954 - DNA, 20 bp, human
gcggccggcctctcccttcc

SEQ ID NO: 401955 - DNA, 20 bp, human
gcgcgtaaaagcatagagac

SEQ ID NO: 401956 - DNA, 20 bp, human
gtgggcgcatgcgtcatgga

SEQ ID NO: 401957 - DNA, 20 bp, human
gtgagcgcgggtccggtctc

SEQ ID NO: 401958 - DNA, 20 bp, human
gccggtctccggtgacgtgg

SEQ ID NO: 401959 - DNA, 20 bp, human
ggacccgcgctcacggccgg

SEQ ID NO: 401960 - DNA, 20 bp, human
ggcggagccaagatcagcgg

SEQ ID NO: 401961 - DNA, 20 bp, human
gaggaagagcgaggtgagcg

SEQ ID NO: 401962 - DNA, 20 bp, human
ggggccctgcagcctcggag

SEQ ID NO: 401963 - DNA, 20 bp, human
ggcccaccggccgtgagcgc

SEQ ID NO: 401964 - DNA, 20 bp, human
gggtccggtctccggtgacg

SEQ ID NO: 401965 - DNA, 20 bp, human
gcggtgacgtggcggtgagg

SEQ ID NO: 401966 - DNA, 20 bp, human
ggggaggggcgcagacggaa

SEQ ID NO: 401967 - DNA, 20 bp, human
gtgccacggccccacgggag

SEQ ID NO: 401968 - DNA, 20 bp, human
gaggggcgcagacggaaggg

SEQ ID NO: 401969 - DNA, 20 bp, human
gccgtctgcgcccctcccgt

SEQ ID NO: 401970 - DNA, 20 bp, human
gctgggggtggtcaagatac

SEQ ID NO: 401971 - DNA, 20 bp, human
ggggcagggcggatggccgg

SEQ ID NO: 401972 - DNA, 20 bp, human
gaggaggtgggcggagaaga

SEQ ID NO: 401973 - DNA, 20 bp, human
gtacgggctgtgtgggaata

SEQ ID NO: 401974 - DNA, 20 bp, human
gcattgggcaagcgaggcac

SEQ ID NO: 401975 - DNA, 20 bp, human
gcccaaaccgtgttctcatt

SEQ ID NO: 401976 - DNA, 20 bp, human
gggcccccggggaacgagaa

SEQ ID NO: 401977 - DNA, 20 bp, human
gtggaactcggcgcccgaag

SEQ ID NO: 401978 - DNA, 20 bp, human
ggctccctggcaactggcgc

SEQ ID NO: 401979 - DNA, 20 bp, human
gggaactgcgactgccgaaa

SEQ ID NO: 401980 - DNA, 20 bp, human
gagagacctgggtcagaccg

SEQ ID NO: 401981 - DNA, 20 bp, human
ggcgctcgttccagccgctt

SEQ ID NO: 401982 - DNA, 20 bp, human
gagcccttctcgttccccgg

SEQ ID NO: 401983 - DNA, 20 bp, human
gtgcgactgccgaaagggag

SEQ ID NO: 401984 - DNA, 20 bp, human
gaacgagaagggctgaggcg

SEQ ID NO: 401985 - DNA, 20 bp, human
gccccccgcgccagttgcca

SEQ ID NO: 401986 - DNA, 20 bp, human
gggcggggcgggaggctcaa

SEQ ID NO: 401987 - DNA, 20 bp, human
gccaggggcccatgcgtccg

SEQ ID NO: 401988 - DNA, 20 bp, human
gctcaagggggaggcgtaag

SEQ ID NO: 401989 - DNA, 20 bp, human
gggcgcagtgggaaaggacg

SEQ ID NO: 401990 - DNA, 20 bp, human
gccgggctcgggcggggcat

SEQ ID NO: 401991 - DNA, 20 bp, human
gctgaggagaccaaggacaa

SEQ ID NO: 401992 - DNA, 20 bp, human
ggagcggggagttctagccg

SEQ ID NO: 401993 - DNA, 20 bp, human
gcgcccacgccgcatgacga

SEQ ID NO: 401994 - DNA, 20 bp, human
gcgcgcagtgagcccagctg

SEQ ID NO: 401995 - DNA, 20 bp, human
ggcggggcttgcggacgggt

SEQ ID NO: 401996 - DNA, 20 bp, human
gaagggcgggccggccctaa

SEQ ID NO: 401997 - DNA, 20 bp, human
ggagtggcgcgtttcagggt

SEQ ID NO: 401998 - DNA, 20 bp, human
gagactgcggagccggtgga

SEQ ID NO: 401999 - DNA, 20 bp, human
gctggccactctcactgcgc

SEQ ID NO: 402000 - DNA, 20 bp, human
gggcggtggctatttatagt

SEQ ID NO: 402001 - DNA, 20 bp, human
ggccctaacggtctatttca

SEQ ID NO: 402002 - DNA, 20 bp, human
gcactcgcagagcgcctgcg

SEQ ID NO: 402003 - DNA, 20 bp, human
gtttaccgccgcagagatgg

SEQ ID NO: 402004 - DNA, 20 bp, human
gcccggcctgaaagccgcgc

SEQ ID NO: 402005 - DNA, 20 bp, human
ggggagaccgcgtgccccga

SEQ ID NO: 402006 - DNA, 20 bp, human
gcgggaaggtgcggggccaa

SEQ ID NO: 402007 - DNA, 20 bp, human
ggggtcggtacggggaagtt

SEQ ID NO: 402008 - DNA, 20 bp, human
ggccgcacccagaagtgccg

SEQ ID NO: 402009 - DNA, 20 bp, human
gggagcgggagggaacgcgg

SEQ ID NO: 402010 - DNA, 20 bp, human
gaggaccgagcgcgcggaag

SEQ ID NO: 402011 - DNA, 20 bp, human
gacggggaagttcggttggc

SEQ ID NO: 402012 - DNA, 20 bp, human
gagggaacgcggaggctagg

SEQ ID NO: 402013 - DNA, 20 bp, human
gctaggagggtgggtcggta

SEQ ID NO: 402014 - DNA, 20 bp, human
gacgcggaggctaggagggt

SEQ ID NO: 402015 - DNA, 20 bp, human
ggagaagctcggcgcatcat

SEQ ID NO: 402016 - DNA, 20 bp, human
gggggagcggcggttacgcg

SEQ ID NO: 402017 - DNA, 20 bp, human
gcgctgtgggcaccaatcaa

SEQ ID NO: 402018 - DNA, 20 bp, human
gcgcggggccccgatcgctg

SEQ ID NO: 402019 - DNA, 20 bp, human
gggaggaaaccccgtgtctg

SEQ ID NO: 402020 - DNA, 20 bp, human
gtccgctcgccctccagcgc

SEQ ID NO: 402021 - DNA, 20 bp, human
gagggcgttggggacccaaa

SEQ ID NO: 402022 - DNA, 20 bp, human
gaaaccccgtgtctgcggag

SEQ ID NO: 402023 - DNA, 20 bp, human
ggggacaagcgtagaggagc

SEQ ID NO: 402024 - DNA, 20 bp, human
ggattggtgcccacagcgat

SEQ ID NO: 402025 - DNA, 20 bp, human
gatgacgtcaaacgctgcta

SEQ ID NO: 402026 - DNA, 20 bp, human
gggccagcggacagatcgat

SEQ ID NO: 402027 - DNA, 20 bp, human
ggccgagaggagaatcgaga

SEQ ID NO: 402028 - DNA, 20 bp, human
gcggccagggcgggcggttg

SEQ ID NO: 402029 - DNA, 20 bp, human
ggggcggctcgcacgcgccc

SEQ ID NO: 402030 - DNA, 20 bp, human
gcgggaggagcccggcgagt

SEQ ID NO: 402031 - DNA, 20 bp, human
gcgggcgagtggcagcgagg

SEQ ID NO: 402032 - DNA, 20 bp, human
gcggcggcgagatctgggct

SEQ ID NO: 402033 - DNA, 20 bp, human
ggccccgcccccggtcccat

SEQ ID NO: 402034 - DNA, 20 bp, human
ggagaatcgagagggcgaac

SEQ ID NO: 402035 - DNA, 20 bp, human
gaagcggagcgccggcccgg

SEQ ID NO: 402036 - DNA, 20 bp, human
gcgcgcgaggagtgtagggt

SEQ ID NO: 402037 - DNA, 20 bp, human
gcgcacgcgcgaggagtgta

SEQ ID NO: 402038 - DNA, 20 bp, human
gaccgcggcgaggggatcga

SEQ ID NO: 402039 - DNA, 20 bp, human
ggggaccggcaaagcgagtc

SEQ ID NO: 402040 - DNA, 20 bp, human
gcgcggcgacgaacccaggg

SEQ ID NO: 402041 - DNA, 20 bp, human
ggcgccgcggcgacgaaccc

SEQ ID NO: 402042 - DNA, 20 bp, human
gcctcgccgcggtcccatgg

SEQ ID NO: 402043 - DNA, 20 bp, human
ggcggcgaggggatcgaggg

SEQ ID NO: 402044 - DNA, 20 bp, human
gccctctgccggccggtggt

SEQ ID NO: 402045 - DNA, 20 bp, human
ggtcccgcggtggggactgt

SEQ ID NO: 402046 - DNA, 20 bp, human
ggcagggtggcaaacgtacg

SEQ ID NO: 402047 - DNA, 20 bp, human
gaacagctgggcggggtcgc

SEQ ID NO: 402048 - DNA, 20 bp, human
ggttatatgggatggacagg

SEQ ID NO: 402049 - DNA, 20 bp, human
gttggcagatactgttatat

SEQ ID NO: 402050 - DNA, 20 bp, human
gtaaaaggagtaggcttttt

SEQ ID NO: 402051 - DNA, 20 bp, human
ggcacgtgcacgtgcttttg

SEQ ID NO: 402052 - DNA, 20 bp, human
gcagatactgttatatggga

SEQ ID NO: 402053 - DNA, 20 bp, human
gaaaaaagcataaaaggagt

SEQ ID NO: 402054 - DNA, 20 bp, human
gacagacgcgccagttgcct

SEQ ID NO: 402055 - DNA, 20 bp, human
gaagagcctgcttacgaaag

SEQ ID NO: 402056 - DNA, 20 bp, human
gaaatgcaggggacactcgt

SEQ ID NO: 402057 - DNA, 20 bp, human
gagtgtcccctgcatttcgg

SEQ ID NO: 402058 - DNA, 20 bp, human
ggtcagccaccgaaatgcag

SEQ ID NO: 402059 - DNA, 20 bp, human
ggacactcgtgggccctgat

SEQ ID NO: 402060 - DNA, 20 bp, human
gagacgctcaatgcctgccc

SEQ ID NO: 402061 - DNA, 20 bp, human
gcaggcattgagcgtctcaa

SEQ ID NO: 402062 - DNA, 20 bp, human
gcgtctcaacgggttccagg

SEQ ID NO: 402063 - DNA, 20 bp, human
gggtggaaatggagcgggac

SEQ ID NO: 402064 - DNA, 20 bp, human
gacactctgcccaaaggttt

SEQ ID NO: 402065 - DNA, 20 bp, human
gtgcttaacgatgtgagatg

SEQ ID NO: 402066 - DNA, 20 bp, human
ggacggcgggcaagggggga

SEQ ID NO: 402067 - DNA, 20 bp, human
gtcggggccgcagacgaccg

SEQ ID NO: 402068 - DNA, 20 bp, human
gaacccgggcgcaccacccc

SEQ ID NO: 402069 - DNA, 20 bp, human
gcgcaccaccccgggtgtcc

SEQ ID NO: 402070 - DNA, 20 bp, human
ggtccccaggccgggacacc

SEQ ID NO: 402071 - DNA, 20 bp, human
ggtggtgcgcccgggttcgc

SEQ ID NO: 402072 - DNA, 20 bp, human
gcggggcggcagcggtcccc

SEQ ID NO: 402073 - DNA, 20 bp, human
gtctcccgcgccaggaggaa

SEQ ID NO: 402074 - DNA, 20 bp, human
gacacccggggtggtgcgcc

SEQ ID NO: 402075 - DNA, 20 bp, human
gcggggagggtggggatatc

SEQ ID NO: 402076 - DNA, 20 bp, human
ggccccccgggcgcaggcca

SEQ ID NO: 402077 - DNA, 20 bp, human
gtctctgcacggcgccaatg

SEQ ID NO: 402078 - DNA, 20 bp, human
gcggcccagccgtttcgcgc

SEQ ID NO: 402079 - DNA, 20 bp, human
gcagcaaggcaggtgtgtct

SEQ ID NO: 402080 - DNA, 20 bp, human
gtccctggcctgcgcccggg

SEQ ID NO: 402081 - DNA, 20 bp, human
gccgctcgcccgcgcgtgtg

SEQ ID NO: 402082 - DNA, 20 bp, human
gggggcggatggtgcccccc

SEQ ID NO: 402083 - DNA, 20 bp, human
gcgccctcccctcacacgcg

SEQ ID NO: 402084 - DNA, 20 bp, human
gtggggacgcaaagaaatag

SEQ ID NO: 402085 - DNA, 20 bp, human
gctcccggcgcgaaacggct

SEQ ID NO: 402086 - DNA, 20 bp, human
gcaactggagagttaggtga

SEQ ID NO: 402087 - DNA, 20 bp, human
gcagtggcaactggagagtt

SEQ ID NO: 402088 - DNA, 20 bp, human
ggactgcaaacggctggacg

SEQ ID NO: 402089 - DNA, 20 bp, human
gaggaaggactgcaaacggc

SEQ ID NO: 402090 - DNA, 20 bp, human
gaactggcaacagtggcaac

SEQ ID NO: 402091 - DNA, 20 bp, human
gggagaaagataagtcacag

SEQ ID NO: 402092 - DNA, 20 bp, human
gattctataactggcaacag

SEQ ID NO: 402093 - DNA, 20 bp, human
gaaggactgcaaatgcctac

SEQ ID NO: 402094 - DNA, 20 bp, human
gttctccgtgatttgccagt

SEQ ID NO: 402095 - DNA, 20 bp, human
ggtgaaggaaggactgcaaa

SEQ ID NO: 402096 - DNA, 20 bp, human
gtggatgcgaagacaggaaa

SEQ ID NO: 402097 - DNA, 20 bp, human
ggaggcagagggcatttccg

SEQ ID NO: 402098 - DNA, 20 bp, human
ggcctgcccagctgcaggat

SEQ ID NO: 402099 - DNA, 20 bp, human
ggggaggaagcctgcatacc

SEQ ID NO: 402100 - DNA, 20 bp, human
gtcaaaggggcgtcgccctg

SEQ ID NO: 402101 - DNA, 20 bp, human
ggcccctttgaggggaaaat

SEQ ID NO: 402102 - DNA, 20 bp, human
ggcaggaaccgtcagaaggg

SEQ ID NO: 402103 - DNA, 20 bp, human
gctgcctaccctccggttcc

SEQ ID NO: 402104 - DNA, 20 bp, human
ggcagcaggaaccgtcagaa

SEQ ID NO: 402105 - DNA, 20 bp, human
ggaaggacgactccagcagc

SEQ ID NO: 402106 - DNA, 20 bp, human
gaaccaaggcgcccgaggtg

SEQ ID NO: 402107 - DNA, 20 bp, human
gtagggagaaggacgaagag

SEQ ID NO: 402108 - DNA, 20 bp, human
gcggggatggccctcggcgg

SEQ ID NO: 402109 - DNA, 20 bp, human
gggcgtggagagtttctgta

SEQ ID NO: 402110 - DNA, 20 bp, human
gggctttctttgtgatgaaa

SEQ ID NO: 402111 - DNA, 20 bp, human
gggtcattgtgccaacatcc

SEQ ID NO: 402112 - DNA, 20 bp, human
gaagaggggccccctcggcg

SEQ ID NO: 402113 - DNA, 20 bp, human
gggcccgcgtccccgccgag

SEQ ID NO: 402114 - DNA, 20 bp, human
gcaggcacctggaacaatca

SEQ ID NO: 402115 - DNA, 20 bp, human
ggagagtttctgtagggaga

SEQ ID NO: 402116 - DNA, 20 bp, human
ggccgccgggagaagcgtga

SEQ ID NO: 402117 - DNA, 20 bp, human
ggaggggacagatttgtgac

SEQ ID NO: 402118 - DNA, 20 bp, human
ggcgcctcgggtgtcttttg

SEQ ID NO: 402119 - DNA, 20 bp, human
gggcagaggcggagccgctg

SEQ ID NO: 402120 - DNA, 20 bp, human
gtgtcccctcacgcttctcc

SEQ ID NO: 402121 - DNA, 20 bp, human
gcacgcaccacccggaagtc

SEQ ID NO: 402122 - DNA, 20 bp, human
gcctcgggtgtcttttgcgg

SEQ ID NO: 402123 - DNA, 20 bp, human
gcccacccaggcctgacttc

SEQ ID NO: 402124 - DNA, 20 bp, human
gccacccggaagtcaggcct

SEQ ID NO: 402125 - DNA, 20 bp, human
ggacacccgaggcgcagcag

SEQ ID NO: 402126 - DNA, 20 bp, human
ggggttctgccactgtccgc

SEQ ID NO: 402127 - DNA, 20 bp, human
gaagggcggaaaaactcaac

SEQ ID NO: 402128 - DNA, 20 bp, human
ggagaatggtgatcacagga

SEQ ID NO: 402129 - DNA, 20 bp, human
ggctccttttcgccctctgc

SEQ ID NO: 402130 - DNA, 20 bp, human
ggctatccgcggccatccgg

SEQ ID NO: 402131 - DNA, 20 bp, human
ggccctctgccggcggacag

SEQ ID NO: 402132 - DNA, 20 bp, human
gcaccaccgccggatggccg

SEQ ID NO: 402133 - DNA, 20 bp, human
gagaccaagacggaaactcc

SEQ ID NO: 402134 - DNA, 20 bp, human
gatccgcggccatccggcgg

SEQ ID NO: 402135 - DNA, 20 bp, human
ggccactgtccgccggcaga

SEQ ID NO: 402136 - DNA, 20 bp, human
gtgcccgccccgaaccgccc

SEQ ID NO: 402137 - DNA, 20 bp, human
gcgcccgcccggacggacgg

SEQ ID NO: 402138 - DNA, 20 bp, human
gggcggtgcgggatcccaga

SEQ ID NO: 402139 - DNA, 20 bp, human
ggaccccgcccgggccctct

SEQ ID NO: 402140 - DNA, 20 bp, human
gcctaccgcgtagacccgca

SEQ ID NO: 402141 - DNA, 20 bp, human
gggcgggcgcagagtcccgc

SEQ ID NO: 402142 - DNA, 20 bp, human
gcggacaaccgaccccagcc

SEQ ID NO: 402143 - DNA, 20 bp, human
ggccgcagacaatggcgaca

SEQ ID NO: 402144 - DNA, 20 bp, human
gcagccaggacacccccccc

SEQ ID NO: 402145 - DNA, 20 bp, human
ggccatgtcgccattgtctg

SEQ ID NO: 402146 - DNA, 20 bp, human
gtggaggtgccctccttctg

SEQ ID NO: 402147 - DNA, 20 bp, human
gtgttgcagaaaaacccaac

SEQ ID NO: 402148 - DNA, 20 bp, human
gaaagcaagcgatttgaagg

SEQ ID NO: 402149 - DNA, 20 bp, human
gaggcacagacacacctacc

SEQ ID NO: 402150 - DNA, 20 bp, human
ggccaggaacatccttttct

SEQ ID NO: 402151 - DNA, 20 bp, human
gttgctgcatgacatatgcc

SEQ ID NO: 402152 - DNA, 20 bp, human
gggaagcattgtttccaggt

SEQ ID NO: 402153 - DNA, 20 bp, human
gacaatgcttccctagaagt

SEQ ID NO: 402154 - DNA, 20 bp, human
gatgcttccctagaagtggg

SEQ ID NO: 402155 - DNA, 20 bp, human
gagaaggaaaacctaccaag

SEQ ID NO: 402156 - DNA, 20 bp, human
gcacacgtctgcggggaaag

SEQ ID NO: 402157 - DNA, 20 bp, human
ggcgagcgacagatttgtgt

SEQ ID NO: 402158 - DNA, 20 bp, human
gtgtcccaacctaggttgga

SEQ ID NO: 402159 - DNA, 20 bp, human
gcgggaattcaggtcttgga

SEQ ID NO: 402160 - DNA, 20 bp, human
ggggcgaaggccacacgtga

SEQ ID NO: 402161 - DNA, 20 bp, human
gaatccctccaacctaggtt

SEQ ID NO: 402162 - DNA, 20 bp, human
gcatctgtcccaacctaggt

SEQ ID NO: 402163 - DNA, 20 bp, human
gcgctgcattcacacgtctg

SEQ ID NO: 402164 - DNA, 20 bp, human
ggggcctgagtctcagagcg

SEQ ID NO: 402165 - DNA, 20 bp, human
ggcatgatgtcacaagttat

SEQ ID NO: 402166 - DNA, 20 bp, human
gcgctggcgggcgacgggaa

SEQ ID NO: 402167 - DNA, 20 bp, human
ggggcggggcctactctcgc

SEQ ID NO: 402168 - DNA, 20 bp, human
gacgaggcggggcgggtacg

SEQ ID NO: 402169 - DNA, 20 bp, human
gcgcccggccagggacgagg

SEQ ID NO: 402170 - DNA, 20 bp, human
gccaggagggcaaactacgc

SEQ ID NO: 402171 - DNA, 20 bp, human
ggccccgcctcgtccctggc

SEQ ID NO: 402172 - DNA, 20 bp, human
ggggaagggcttaggcgctc

SEQ ID NO: 402173 - DNA, 20 bp, human
gggggtcgggcggaagacgc

SEQ ID NO: 402174 - DNA, 20 bp, human
gggacgctgcgcccctccca

SEQ ID NO: 402175 - DNA, 20 bp, human
gacactgcgcctgcgagagt

SEQ ID NO: 402176 - DNA, 20 bp, human
gagcagcggggcgggaccaa

SEQ ID NO: 402177 - DNA, 20 bp, human
gctaggtagcacggccgctg

SEQ ID NO: 402178 - DNA, 20 bp, human
gaccaagctcggttgaggcg

SEQ ID NO: 402179 - DNA, 20 bp, human
gaaaggaccaagctcggttg

SEQ ID NO: 402180 - DNA, 20 bp, human
gtacctaggtgatagcggag

SEQ ID NO: 402181 - DNA, 20 bp, human
gcaaaggaaaggaccaagct

SEQ ID NO: 402182 - DNA, 20 bp, human
gtggtggcgggacgcaaatc

SEQ ID NO: 402183 - DNA, 20 bp, human
gcggggcgggaccaaaggaa

SEQ ID NO: 402184 - DNA, 20 bp, human
gcgggctggggtgattcacg

SEQ ID NO: 402185 - DNA, 20 bp, human
gtaggtgatagcggagcggc

SEQ ID NO: 402186 - DNA, 20 bp, human
gaaaagtgagcgggagcctg

SEQ ID NO: 402187 - DNA, 20 bp, human
gagggccgcgaccgggaggt

SEQ ID NO: 402188 - DNA, 20 bp, human
gtgggggggaggggtcgtta

SEQ ID NO: 402189 - DNA, 20 bp, human
gggggtggggtgaacggggt

SEQ ID NO: 402190 - DNA, 20 bp, human
gtcccctcgcccctgggtcg

SEQ ID NO: 402191 - DNA, 20 bp, human
gcccggcgagggccgcgacc

SEQ ID NO: 402192 - DNA, 20 bp, human
gctgggtcgcggcctatccc

SEQ ID NO: 402193 - DNA, 20 bp, human
gtcccggtcgcggccctcgc

SEQ ID NO: 402194 - DNA, 20 bp, human
gccgtgggggtggggtgaac

SEQ ID NO: 402195 - DNA, 20 bp, human
gcgctctgacttcccgggat

SEQ ID NO: 402196 - DNA, 20 bp, human
gggggaccgctgcagacctg

SEQ ID NO: 402197 - DNA, 20 bp, human
gcagctgggggaaatcactc

SEQ ID NO: 402198 - DNA, 20 bp, human
ggagggaggaaattcctcat

SEQ ID NO: 402199 - DNA, 20 bp, human
gctcagaaggtagtggctgt

SEQ ID NO: 402200 - DNA, 20 bp, human
gagcaccctgtcccaagagt

SEQ ID NO: 402201 - DNA, 20 bp, human
ggaccgaggtacggtatcca

SEQ ID NO: 402202 - DNA, 20 bp, human
gtctccgccacccattgctt

SEQ ID NO: 402203 - DNA, 20 bp, human
ggagacgggggaccgaggta

SEQ ID NO: 402204 - DNA, 20 bp, human
gacagcccactcttgggaca

SEQ ID NO: 402205 - DNA, 20 bp, human
gtgtcccaagcaatgggtgg

SEQ ID NO: 402206 - DNA, 20 bp, human
gtggatgagcaagacagagt

SEQ ID NO: 402207 - DNA, 20 bp, human
ggtctcaaaggcctcttcgg

SEQ ID NO: 402208 - DNA, 20 bp, human
gtccctgtcaacatcaagtc

SEQ ID NO: 402209 - DNA, 20 bp, human
gaaaatgtagaggtccaggt

SEQ ID NO: 402210 - DNA, 20 bp, human
gagcatgcaccacgtggagg

SEQ ID NO: 402211 - DNA, 20 bp, human
gacctgacttgatgttgaca

SEQ ID NO: 402212 - DNA, 20 bp, human
gctggctaggcatctatttc

SEQ ID NO: 402213 - DNA, 20 bp, human
gtagccaggccggccagatt

SEQ ID NO: 402214 - DNA, 20 bp, human
gtctgtcttgctcatccacc

SEQ ID NO: 402215 - DNA, 20 bp, human
ggggaagtcctctgtctcaa

SEQ ID NO: 402216 - DNA, 20 bp, human
gctccccagggcaggatgcg

SEQ ID NO: 402217 - DNA, 20 bp, human
gcgcgagccacccagggcgg

SEQ ID NO: 402218 - DNA, 20 bp, human
ggacgccgcagcgaactggt

SEQ ID NO: 402219 - DNA, 20 bp, human
gtggctgctaggggcacccg

SEQ ID NO: 402220 - DNA, 20 bp, human
gtagcagccagcggcagagt

SEQ ID NO: 402221 - DNA, 20 bp, human
gtgagccggccccgcttacg

SEQ ID NO: 402222 - DNA, 20 bp, human
gcagccagcggcagagtggg

SEQ ID NO: 402223 - DNA, 20 bp, human
gcgcccacccactctgccgc

SEQ ID NO: 402224 - DNA, 20 bp, human
gggcggacgccgcagcgaac

SEQ ID NO: 402225 - DNA, 20 bp, human
gcccaagcctacccttgaga

SEQ ID NO: 402226 - DNA, 20 bp, human
gggcgcgggtaggtgcgtgt

SEQ ID NO: 402227 - DNA, 20 bp, human
ggcgccaggggaccgggaaa

SEQ ID NO: 402228 - DNA, 20 bp, human
gtaaccgctggagggggaaa

SEQ ID NO: 402229 - DNA, 20 bp, human
ggtgaactcgtggcgagaga

SEQ ID NO: 402230 - DNA, 20 bp, human
gggtagcagtaaccgctgga

SEQ ID NO: 402231 - DNA, 20 bp, human
gtcgcacaatgcatcaaagg

SEQ ID NO: 402232 - DNA, 20 bp, human
gaaaatgcgcgtcccgggcg

SEQ ID NO: 402233 - DNA, 20 bp, human
gacgactggagttatctgat

SEQ ID NO: 402234 - DNA, 20 bp, human
ggggttggggacaaaaggcc

SEQ ID NO: 402235 - DNA, 20 bp, human
gcactgggaagtattgacat

SEQ ID NO: 402236 - DNA, 20 bp, human
gcgggtggacattttggaag

SEQ ID NO: 402237 - DNA, 20 bp, human
gacccttcactgcagttcga

SEQ ID NO: 402238 - DNA, 20 bp, human
gggagcgcactctcgttttc

SEQ ID NO: 402239 - DNA, 20 bp, human
gcggaagtgacgcaaggcaa

SEQ ID NO: 402240 - DNA, 20 bp, human
ggagccgatccagtgacgtc

SEQ ID NO: 402241 - DNA, 20 bp, human
gccagtgacgtcaggaatgc

SEQ ID NO: 402242 - DNA, 20 bp, human
gtccctcgaactgcagtgaa

SEQ ID NO: 402243 - DNA, 20 bp, human
gctaaggagccacgtgtagg

SEQ ID NO: 402244 - DNA, 20 bp, human
gccgctggcgactgacaaaa

SEQ ID NO: 402245 - DNA, 20 bp, human
gattcctgacgtcactggat

SEQ ID NO: 402246 - DNA, 20 bp, human
gcacgcgcaaactggccgcg

SEQ ID NO: 402247 - DNA, 20 bp, human
ggcggggcttggaggtacag

SEQ ID NO: 402248 - DNA, 20 bp, human
gggtgctggtgaagaaaggg

SEQ ID NO: 402249 - DNA, 20 bp, human
gaactggccgcggggcttgg

SEQ ID NO: 402250 - DNA, 20 bp, human
ggtggaacgtatttccgctc

SEQ ID NO: 402251 - DNA, 20 bp, human
gtgggggtgctggtgaagaa

SEQ ID NO: 402252 - DNA, 20 bp, human
gcccaggggtggtgcgtctc

SEQ ID NO: 402253 - DNA, 20 bp, human
gcgtcggctaggactcgggg

SEQ ID NO: 402254 - DNA, 20 bp, human
ggcggcgtcggctaggactc

SEQ ID NO: 402255 - DNA, 20 bp, human
gcggccctttaaccgcgtgg

SEQ ID NO: 402256 - DNA, 20 bp, human
gccaacgaaagcgtcggcaa

SEQ ID NO: 402257 - DNA, 20 bp, human
gcccgaccgggtctctaagt

SEQ ID NO: 402258 - DNA, 20 bp, human
gcgcgcgcgggagaaggagt

SEQ ID NO: 402259 - DNA, 20 bp, human
gcgcaggcacggaacccgac

SEQ ID NO: 402260 - DNA, 20 bp, human
gcgcgcgcgtgcgcaggcca

SEQ ID NO: 402261 - DNA, 20 bp, human
gccctcccgccctggttcgt

SEQ ID NO: 402262 - DNA, 20 bp, human
gactacggggccgcccccgg

SEQ ID NO: 402263 - DNA, 20 bp, human
gcgcgggagaaggagtgggc

SEQ ID NO: 402264 - DNA, 20 bp, human
gtagtctccaacgaaagcgt

SEQ ID NO: 402265 - DNA, 20 bp, human
ggcaggccagggccctccgg

SEQ ID NO: 402266 - DNA, 20 bp, human
gtcggccagtgcggggtggt

SEQ ID NO: 402267 - DNA, 20 bp, human
ggggactcagaatccttaat

SEQ ID NO: 402268 - DNA, 20 bp, human
gtcaggcgaagcccggagcg

SEQ ID NO: 402269 - DNA, 20 bp, human
gccagcagcagctagatgtc

SEQ ID NO: 402270 - DNA, 20 bp, human
ggaggcgcgcagtaaccagg

SEQ ID NO: 402271 - DNA, 20 bp, human
ggccggcggccgcctctcac

SEQ ID NO: 402272 - DNA, 20 bp, human
gccgagccccctcccctgca

SEQ ID NO: 402273 - DNA, 20 bp, human
gaggcgccggggccttgcag

SEQ ID NO: 402274 - DNA, 20 bp, human
gccgctcggccggtgagagg

SEQ ID NO: 402275 - DNA, 20 bp, human
gcgcgggctcggccagtgcg

SEQ ID NO: 402276 - DNA, 20 bp, human
gtgagcgccgaagtactgta

SEQ ID NO: 402277 - DNA, 20 bp, human
gtactgtaaggtggaacttt

SEQ ID NO: 402278 - DNA, 20 bp, human
ggcttcccggctgcaacttc

SEQ ID NO: 402279 - DNA, 20 bp, human
gggcgcatgcgtctgtctat

SEQ ID NO: 402280 - DNA, 20 bp, human
gcagggaaggggataatgtt

SEQ ID NO: 402281 - DNA, 20 bp, human
ggtagaagaggggccacgga

SEQ ID NO: 402282 - DNA, 20 bp, human
ggcgccgaagtactgtaagg

SEQ ID NO: 402283 - DNA, 20 bp, human
gctaccaaaaaggtagaaga

SEQ ID NO: 402284 - DNA, 20 bp, human
gtatgggcgctctcctagcg

SEQ ID NO: 402285 - DNA, 20 bp, human
ggacttgcatggcccctccg

SEQ ID NO: 402286 - DNA, 20 bp, human
gctaagaaaaagctggtggc

SEQ ID NO: 402287 - DNA, 20 bp, human
gagtgtagaggagtagcata

SEQ ID NO: 402288 - DNA, 20 bp, human
gctgtcttaagttggtggac

SEQ ID NO: 402289 - DNA, 20 bp, human
gcaacacttctgtcttaagt

SEQ ID NO: 402290 - DNA, 20 bp, human
gtgacagcacactcaagcca

SEQ ID NO: 402291 - DNA, 20 bp, human
gtcaagccacggtgctattc

SEQ ID NO: 402292 - DNA, 20 bp, human
ggcggtaataatgttgaaat

SEQ ID NO: 402293 - DNA, 20 bp, human
ggcattaaaaggagcacagc

SEQ ID NO: 402294 - DNA, 20 bp, human
gcacttctgtcttaagttgg

SEQ ID NO: 402295 - DNA, 20 bp, human
gctggagatgtcaaatgggt

SEQ ID NO: 402296 - DNA, 20 bp, human
gggcagtggagtgctgcagg

SEQ ID NO: 402297 - DNA, 20 bp, human
gagaggcggcgagagagcag

SEQ ID NO: 402298 - DNA, 20 bp, human
gggcagaaggatacgagcag

SEQ ID NO: 402299 - DNA, 20 bp, human
gaacttctctccacctattg

SEQ ID NO: 402300 - DNA, 20 bp, human
gtctctccacctattggggc

SEQ ID NO: 402301 - DNA, 20 bp, human
gagtggagtgctgcaggcgg

SEQ ID NO: 402302 - DNA, 20 bp, human
gcaagtccttgagatgctcg

SEQ ID NO: 402303 - DNA, 20 bp, human
ggctgcgagcggctcccgcc

SEQ ID NO: 402304 - DNA, 20 bp, human
gagtgcaaagaggctgcgag

SEQ ID NO: 402305 - DNA, 20 bp, human
gagtcaagggacaagggtaa

SEQ ID NO: 402306 - DNA, 20 bp, human
gaaaggcagtctagatggca

SEQ ID NO: 402307 - DNA, 20 bp, human
gcaggcctggaatagcaggg

SEQ ID NO: 402308 - DNA, 20 bp, human
gtgatgtggacaggagtcga

SEQ ID NO: 402309 - DNA, 20 bp, human
ggctctggggtgaagattgt

SEQ ID NO: 402310 - DNA, 20 bp, human
gaggccaggcctggaatagc

SEQ ID NO: 402311 - DNA, 20 bp, human
gtaaacccccctgctattcc

SEQ ID NO: 402312 - DNA, 20 bp, human
ggtcgcttagtgatgtggac

SEQ ID NO: 402313 - DNA, 20 bp, human
gtagcaggggggtttaggtc

SEQ ID NO: 402314 - DNA, 20 bp, human
gtaccacagtcagaaaaaga

SEQ ID NO: 402315 - DNA, 20 bp, human
ggaaagcgcctcatcagctc

SEQ ID NO: 402316 - DNA, 20 bp, human
gtatagcggggagagataga

SEQ ID NO: 402317 - DNA, 20 bp, human
ggggagagatagagggttcg

SEQ ID NO: 402318 - DNA, 20 bp, human
gtgggcggcaacctcacgag

SEQ ID NO: 402319 - DNA, 20 bp, human
gggagcccgtcagaccggac

SEQ ID NO: 402320 - DNA, 20 bp, human
gcactccagtccggtctgac

SEQ ID NO: 402321 - DNA, 20 bp, human
ggaagagtgcattttgttta

SEQ ID NO: 402322 - DNA, 20 bp, human
gggagtgaagcgtccaatgt

SEQ ID NO: 402323 - DNA, 20 bp, human
ggaatgggacgcccctcgtg

SEQ ID NO: 402324 - DNA, 20 bp, human
gtgggggtgggcgaagtgga

SEQ ID NO: 402325 - DNA, 20 bp, human
ggtgagagctatcctatagc

SEQ ID NO: 402326 - DNA, 20 bp, human
gccgccgcaggctcccctca

SEQ ID NO: 402327 - DNA, 20 bp, human
gccgcgctctcggtccatga

SEQ ID NO: 402328 - DNA, 20 bp, human
ggcctcgcggcgcaggggga

SEQ ID NO: 402329 - DNA, 20 bp, human
gatgacctcatccctggtgt

SEQ ID NO: 402330 - DNA, 20 bp, human
gagagcgcgggcttgcagcg

SEQ ID NO: 402331 - DNA, 20 bp, human
gaccgcggccgaatgacccg

SEQ ID NO: 402332 - DNA, 20 bp, human
gggcgcgctcctcgccgcga

SEQ ID NO: 402333 - DNA, 20 bp, human
gaggacgcgctcccgttcac

SEQ ID NO: 402334 - DNA, 20 bp, human
gccagggatgaggtcatcgc

SEQ ID NO: 402335 - DNA, 20 bp, human
gcggcactctgattgggcgc

SEQ ID NO: 402336 - DNA, 20 bp, human
ggggagctcaggacttggtt

SEQ ID NO: 402337 - DNA, 20 bp, human
ggagcctggggaacgatacc

SEQ ID NO: 402338 - DNA, 20 bp, human
gtgagctcccagcggaggag

SEQ ID NO: 402339 - DNA, 20 bp, human
gcgtgccgctgggcaatact

SEQ ID NO: 402340 - DNA, 20 bp, human
gggtccaggtatcgttcccc

SEQ ID NO: 402341 - DNA, 20 bp, human
ggggcttcagtgggactgta

SEQ ID NO: 402342 - DNA, 20 bp, human
ggggacctgatcttttaagg

SEQ ID NO: 402343 - DNA, 20 bp, human
gtacctggacccatcgccaa

SEQ ID NO: 402344 - DNA, 20 bp, human
gacccatcgccaatgggaaa

SEQ ID NO: 402345 - DNA, 20 bp, human
gtcggccgagtattgcccag

SEQ ID NO: 402346 - DNA, 20 bp, human
ggggcgcgaaggcagttcaa

SEQ ID NO: 402347 - DNA, 20 bp, human
gcgaaggcagttcaagggtt

SEQ ID NO: 402348 - DNA, 20 bp, human
gcaaggcggggcgagaatgc

SEQ ID NO: 402349 - DNA, 20 bp, human
gcggggcgagatggcggggc

SEQ ID NO: 402350 - DNA, 20 bp, human
gagggcaaggcggggcgcga

SEQ ID NO: 402351 - DNA, 20 bp, human
gacctccaggggcgcctctg

SEQ ID NO: 402352 - DNA, 20 bp, human
gtcaagggttggggcgtggc

SEQ ID NO: 402353 - DNA, 20 bp, human
ggggcgagatggcaggcccg

SEQ ID NO: 402354 - DNA, 20 bp, human
gcgaaccacgtggcccgcag

SEQ ID NO: 402355 - DNA, 20 bp, human
gtggcgccgcgcttccgggt

SEQ ID NO: 402356 - DNA, 20 bp, human
gaagcggggccggctcagtg

SEQ ID NO: 402357 - DNA, 20 bp, human
gctgccgcaccgcactgagc

SEQ ID NO: 402358 - DNA, 20 bp, human
ggacgccgcagcgaactggt

SEQ ID NO: 402359 - DNA, 20 bp, human
ggggctgcgcggagaggctc

SEQ ID NO: 402360 - DNA, 20 bp, human
ggacccggggactttcccca

SEQ ID NO: 402361 - DNA, 20 bp, human
ggggtcacgcggttgtttgt

SEQ ID NO: 402362 - DNA, 20 bp, human
gtgccggcgcgtcaggtccc

SEQ ID NO: 402363 - DNA, 20 bp, human
gcctggcagccgcccgtcac

SEQ ID NO: 402364 - DNA, 20 bp, human
gtggctgctaggggcacccg

SEQ ID NO: 402365 - DNA, 20 bp, human
ggctgcgaggacccggtgac

SEQ ID NO: 402366 - DNA, 20 bp, human
gggaaggctcggaggacaac

SEQ ID NO: 402367 - DNA, 20 bp, human
ggtcctctccgccaatcgga

SEQ ID NO: 402368 - DNA, 20 bp, human
ggtcctccgagccttccgat

SEQ ID NO: 402369 - DNA, 20 bp, human
gggacccaacggaaccggaa

SEQ ID NO: 402370 - DNA, 20 bp, human
gcgccaatcggaaggctcgg

SEQ ID NO: 402371 - DNA, 20 bp, human
ggattggcggagaggaccat

SEQ ID NO: 402372 - DNA, 20 bp, human
ggacggagggcaccgtactc

SEQ ID NO: 402373 - DNA, 20 bp, human
ggagggaatttctgcgttgt

SEQ ID NO: 402374 - DNA, 20 bp, human
ggtgggcggggcgcagacgg

SEQ ID NO: 402375 - DNA, 20 bp, human
gaatttctgcgttgtgggcg

SEQ ID NO: 402376 - DNA, 20 bp, human
gggacgaagaggaaaagttg

SEQ ID NO: 402377 - DNA, 20 bp, human
ggcctccgagccctcaggat

SEQ ID NO: 402378 - DNA, 20 bp, human
gcaaggaaggcgggacgaag

SEQ ID NO: 402379 - DNA, 20 bp, human
ggtagacggcagttagaggg

SEQ ID NO: 402380 - DNA, 20 bp, human
gctgactgcaaaagcgatgg

SEQ ID NO: 402381 - DNA, 20 bp, human
ggaccaatccgtgacagggg

SEQ ID NO: 402382 - DNA, 20 bp, human
gcgcctgactgcaaaagcga

SEQ ID NO: 402383 - DNA, 20 bp, human
ggcgagcacccaattgtaga

SEQ ID NO: 402384 - DNA, 20 bp, human
gctaactgccgtctacaatt

SEQ ID NO: 402385 - DNA, 20 bp, human
ggccaatcctgagggctcgg

SEQ ID NO: 402386 - DNA, 20 bp, human
gaaaaccacaccccttcggg

SEQ ID NO: 402387 - DNA, 20 bp, human
gtctgccacagtccccccga

SEQ ID NO: 402388 - DNA, 20 bp, human
gtagaaaaccacaccccttc

SEQ ID NO: 402389 - DNA, 20 bp, human
gtgaggagacaggaggctag

SEQ ID NO: 402390 - DNA, 20 bp, human
gcaggggcggggctagctcc

SEQ ID NO: 402391 - DNA, 20 bp, human
ggtgtgcattctggaggtag

SEQ ID NO: 402392 - DNA, 20 bp, human
gactgtggcagactgatact

SEQ ID NO: 402393 - DNA, 20 bp, human
gagggggtggtctctcctgc

SEQ ID NO: 402394 - DNA, 20 bp, human
gcaccccttcggggggactg

SEQ ID NO: 402395 - DNA, 20 bp, human
gacaaacgaagtgaggagac

SEQ ID NO: 402396 - DNA, 20 bp, human
gcccttgcggaaagaaccga

SEQ ID NO: 402397 - DNA, 20 bp, human
gcaggccggggtggtccgga

SEQ ID NO: 402398 - DNA, 20 bp, human
ggcagagcacggcgccgaag

SEQ ID NO: 402399 - DNA, 20 bp, human
ggaagggcccgagcttgagg

SEQ ID NO: 402400 - DNA, 20 bp, human
ggcttgaggcggctccactt

SEQ ID NO: 402401 - DNA, 20 bp, human
ggcgctgtgccctctgtcgg

SEQ ID NO: 402402 - DNA, 20 bp, human
ggcctgcgctcggaagagga

SEQ ID NO: 402403 - DNA, 20 bp, human
gcggcgccgtgctctgcctt

SEQ ID NO: 402404 - DNA, 20 bp, human
gccggaagggcccgagcttg

SEQ ID NO: 402405 - DNA, 20 bp, human
gtgggaagctcttgtgtgtt

SEQ ID NO: 402406 - DNA, 20 bp, human
gtcccggagtcgggactccg

SEQ ID NO: 402407 - DNA, 20 bp, human
gaggggctcccggaatcgaa

SEQ ID NO: 402408 - DNA, 20 bp, human
ggctcccggaatcgaacggg

SEQ ID NO: 402409 - DNA, 20 bp, human
gggagaagggcggtgcagtg

SEQ ID NO: 402410 - DNA, 20 bp, human
gcaggcgccaacccgggtgg

SEQ ID NO: 402411 - DNA, 20 bp, human
gaccccggagtcccgactcc

SEQ ID NO: 402412 - DNA, 20 bp, human
gtagcccgcggcgaggctct

SEQ ID NO: 402413 - DNA, 20 bp, human
gcgactccgggaagcggcgt

SEQ ID NO: 402414 - DNA, 20 bp, human
ggcaacgccaccacccgggt

SEQ ID NO: 402415 - DNA, 20 bp, human
ggaccccgggccctggctag

SEQ ID NO: 402416 - DNA, 20 bp, human
gggaaaaggggcggacttaa

SEQ ID NO: 402417 - DNA, 20 bp, human
ggcgaggaagggcggggaaa

SEQ ID NO: 402418 - DNA, 20 bp, human
gcgaggcaaggaaagctctg

SEQ ID NO: 402419 - DNA, 20 bp, human
ggagcacggcatcacgtgga

SEQ ID NO: 402420 - DNA, 20 bp, human
gcccgccctcctcccgactg

SEQ ID NO: 402421 - DNA, 20 bp, human
gtgcccacaatggcgaggaa

SEQ ID NO: 402422 - DNA, 20 bp, human
gcaaggaaagctctggggat

SEQ ID NO: 402423 - DNA, 20 bp, human
ggaaggtgatactggatgag

SEQ ID NO: 402424 - DNA, 20 bp, human
ggccctcctcccgactgagg

SEQ ID NO: 402425 - DNA, 20 bp, human
gacgtcgcccgctccgtggg

SEQ ID NO: 402426 - DNA, 20 bp, human
gaggacgcagcccgtccggg

SEQ ID NO: 402427 - DNA, 20 bp, human
ggcggcggcgggacccgtga

SEQ ID NO: 402428 - DNA, 20 bp, human
ggcagaggacgcagcccgtc

SEQ ID NO: 402429 - DNA, 20 bp, human
gccgctgcctccttggtggg

SEQ ID NO: 402430 - DNA, 20 bp, human
gtggccactgggtcgggcat

SEQ ID NO: 402431 - DNA, 20 bp, human
ggggccttacggggccctca

SEQ ID NO: 402432 - DNA, 20 bp, human
gcagccggggccccccacca

SEQ ID NO: 402433 - DNA, 20 bp, human
ggacccgtgagggccccgta

SEQ ID NO: 402434 - DNA, 20 bp, human
ggggccgacctcctcccgga

SEQ ID NO: 402435 - DNA, 20 bp, human
gccaaggaccaggcctcagg

SEQ ID NO: 402436 - DNA, 20 bp, human
gctgccctgccactcggaag

SEQ ID NO: 402437 - DNA, 20 bp, human
gccactcggaaggggacaaa

SEQ ID NO: 402438 - DNA, 20 bp, human
ggagggcctctggacatcaa

SEQ ID NO: 402439 - DNA, 20 bp, human
gctcctctcagcacactcgc

SEQ ID NO: 402440 - DNA, 20 bp, human
gtgccggcgagtgtgctgag

SEQ ID NO: 402441 - DNA, 20 bp, human
ggggcagtgagaggtcccca

SEQ ID NO: 402442 - DNA, 20 bp, human
gctcgccggcacagaccagc

SEQ ID NO: 402443 - DNA, 20 bp, human
gaagtaggaagggcggctgg

SEQ ID NO: 402444 - DNA, 20 bp, human
ggctgttccggaagtaggaa

SEQ ID NO: 402445 - DNA, 20 bp, human
ggccgggcgtgggtgacgtc

SEQ ID NO: 402446 - DNA, 20 bp, human
gaggaggcagcgccccccca

SEQ ID NO: 402447 - DNA, 20 bp, human
ggggtccaggacctgcgcga

SEQ ID NO: 402448 - DNA, 20 bp, human
gaggcagcgcccccccacgg

SEQ ID NO: 402449 - DNA, 20 bp, human
gacctgcgcgaggggtgcag

SEQ ID NO: 402450 - DNA, 20 bp, human
ggcgccccccgccgtcccgg

SEQ ID NO: 402451 - DNA, 20 bp, human
gtgtgagcgtagaacagggg

SEQ ID NO: 402452 - DNA, 20 bp, human
ggacccggccccgccgtggg

SEQ ID NO: 402453 - DNA, 20 bp, human
gagtcccgcgcacagtggat

SEQ ID NO: 402454 - DNA, 20 bp, human
gcggctcgccgcgacggccc

SEQ ID NO: 402455 - DNA, 20 bp, human
gctggacccggccccgccgt

SEQ ID NO: 402456 - DNA, 20 bp, human
gccgggacggttggagaaga

SEQ ID NO: 402457 - DNA, 20 bp, human
gcgcctgcgcaggcccgcaa

SEQ ID NO: 402458 - DNA, 20 bp, human
gagagcgcggccgggacggt

SEQ ID NO: 402459 - DNA, 20 bp, human
gagaaggcggctcccggaag

SEQ ID NO: 402460 - DNA, 20 bp, human
gcggccccgtagcgcaaggg

SEQ ID NO: 402461 - DNA, 20 bp, human
ggggtgcgagccagagtcgt

SEQ ID NO: 402462 - DNA, 20 bp, human
gccgtagcgcaagggagggc

SEQ ID NO: 402463 - DNA, 20 bp, human
gaggcggccccgtagcgcaa

SEQ ID NO: 402464 - DNA, 20 bp, human
gctcagaagcgccgagagcg

SEQ ID NO: 402465 - DNA, 20 bp, human
gaagtaaccgggttcctgaa

SEQ ID NO: 402466 - DNA, 20 bp, human
ggcgcagtgtcatgccgcgg

SEQ ID NO: 402467 - DNA, 20 bp, human
gtcggtgtccacccgcccgg

SEQ ID NO: 402468 - DNA, 20 bp, human
ggcgcccgacggccttcccc

SEQ ID NO: 402469 - DNA, 20 bp, human
gcgggctgcagcatcccggc

SEQ ID NO: 402470 - DNA, 20 bp, human
ggcggcgcagtgtcatgccg

SEQ ID NO: 402471 - DNA, 20 bp, human
gcccgcccggtggcccagcg

SEQ ID NO: 402472 - DNA, 20 bp, human
gccaccgacccccagggaaa

SEQ ID NO: 402473 - DNA, 20 bp, human
ggggccgggctgcagcatcc

SEQ ID NO: 402474 - DNA, 20 bp, human
gagtcctggggaaggccgtc

SEQ ID NO: 402475 - DNA, 20 bp, human
gcggagctttgtgtcggtgt

SEQ ID NO: 402476 - DNA, 20 bp, human
ggcccccgccgtcctagcat

SEQ ID NO: 402477 - DNA, 20 bp, human
gcccgccgtcctagcatagg

SEQ ID NO: 402478 - DNA, 20 bp, human
gttacttaggaagtgtgggg

SEQ ID NO: 402479 - DNA, 20 bp, human
ggcgccgcggtcacgtgctg

SEQ ID NO: 402480 - DNA, 20 bp, human
gggcgcgcaatgggtatcag

SEQ ID NO: 402481 - DNA, 20 bp, human
gaaggcggccatcttgaggc

SEQ ID NO: 402482 - DNA, 20 bp, human
gtgaccgcggcgcgtggggc

SEQ ID NO: 402483 - DNA, 20 bp, human
gtccacctatgctaggacgg

SEQ ID NO: 402484 - DNA, 20 bp, human
ggcaatgggtatcagagggg

SEQ ID NO: 402485 - DNA, 20 bp, human
ggaagagcctagcaaccagc

SEQ ID NO: 402486 - DNA, 20 bp, human
ggcgccggtctctctcagga

SEQ ID NO: 402487 - DNA, 20 bp, human
gtctgtggggcgttttccca

SEQ ID NO: 402488 - DNA, 20 bp, human
ggggggctgaacccggaagt

SEQ ID NO: 402489 - DNA, 20 bp, human
gcggagaatgcgcttgtagt

SEQ ID NO: 402490 - DNA, 20 bp, human
ggagcggttgacgtgttcgt

SEQ ID NO: 402491 - DNA, 20 bp, human
gagaagtggggtcaaccaga

SEQ ID NO: 402492 - DNA, 20 bp, human
gagccttgggttcccggtaa

SEQ ID NO: 402493 - DNA, 20 bp, human
ggggtctccgagggagtacg

SEQ ID NO: 402494 - DNA, 20 bp, human
gcaaccagagggacgactaa

SEQ ID NO: 402495 - DNA, 20 bp, human
gtcctggggccgtctctcac

SEQ ID NO: 402496 - DNA, 20 bp, human
ggccccgcgcgcagccagca

SEQ ID NO: 402497 - DNA, 20 bp, human
gggcgggccgagcgacttcc

SEQ ID NO: 402498 - DNA, 20 bp, human
ggggtggggcggacagggaa

SEQ ID NO: 402499 - DNA, 20 bp, human
gcggccgggtggggcggaca

SEQ ID NO: 402500 - DNA, 20 bp, human
ggacagggaagggggggcga

SEQ ID NO: 402501 - DNA, 20 bp, human
gcggagcggcggaaccgctg

SEQ ID NO: 402502 - DNA, 20 bp, human
gagagagcgaaactcggggc

SEQ ID NO: 402503 - DNA, 20 bp, human
ggccgagcgacttcccggag

SEQ ID NO: 402504 - DNA, 20 bp, human
gggggtgtgaggggggttta

SEQ ID NO: 402505 - DNA, 20 bp, human
gccagagagagcgaaactcg

SEQ ID NO: 402506 - DNA, 20 bp, human
gagaaagcggagtgcgcatg

SEQ ID NO: 402507 - DNA, 20 bp, human
gctggagcgggtcaatttta

SEQ ID NO: 402508 - DNA, 20 bp, human
ggcgcctgcgcagtacactc

SEQ ID NO: 402509 - DNA, 20 bp, human
ggaaactgacagtgcttccg

SEQ ID NO: 402510 - DNA, 20 bp, human
gtaccgtctgagctgggcgt

SEQ ID NO: 402511 - DNA, 20 bp, human
gggagagagcgcggaggtag

SEQ ID NO: 402512 - DNA, 20 bp, human
gtgggcgtcgggagagagcg

SEQ ID NO: 402513 - DNA, 20 bp, human
gtgactacgctgttgaaaat

SEQ ID NO: 402514 - DNA, 20 bp, human
gtgcgcagtacactctggag

SEQ ID NO: 402515 - DNA, 20 bp, human
ggaagcactgtcagtttcgg

SEQ ID NO: 402516 - DNA, 20 bp, human
ggtgagcggagcggcaacgg

SEQ ID NO: 402517 - DNA, 20 bp, human
gcgctggcgaccgttgggga

SEQ ID NO: 402518 - DNA, 20 bp, human
gacgcaggctccaccgtcta

SEQ ID NO: 402519 - DNA, 20 bp, human
ggagcctgcgtgacccagaa

SEQ ID NO: 402520 - DNA, 20 bp, human
gggagtgagcggagcggcaa

SEQ ID NO: 402521 - DNA, 20 bp, human
gacggctcgcgtgttcccag

SEQ ID NO: 402522 - DNA, 20 bp, human
gcgccggcgcagagcattgt

SEQ ID NO: 402523 - DNA, 20 bp, human
gcaagtcccgacggccaaga

SEQ ID NO: 402524 - DNA, 20 bp, human
gcggggcggagcgcgctcgg

SEQ ID NO: 402525 - DNA, 20 bp, human
ggctccaccgtctaaggaga

SEQ ID NO: 402526 - DNA, 20 bp, human
ggcgtcgcccaggagatcag

SEQ ID NO: 402527 - DNA, 20 bp, human
gagccggagtgcagactggc

SEQ ID NO: 402528 - DNA, 20 bp, human
ggccctagcctcttcgactt

SEQ ID NO: 402529 - DNA, 20 bp, human
ggtgcctgaagaggagtcgg

SEQ ID NO: 402530 - DNA, 20 bp, human
gcgacgccggaagagtgctc

SEQ ID NO: 402531 - DNA, 20 bp, human
gctccggctctcctcttagt

SEQ ID NO: 402532 - DNA, 20 bp, human
gaccaaagtcgaagaggcta

SEQ ID NO: 402533 - DNA, 20 bp, human
gccgcgtcgcgaggaatgtc

SEQ ID NO: 402534 - DNA, 20 bp, human
gaggaggctggggcgtgcca

SEQ ID NO: 402535 - DNA, 20 bp, human
gtgaagaggagtcggaggtg

SEQ ID NO: 402536 - DNA, 20 bp, human
gccgcgccgcggggtcgcag

SEQ ID NO: 402537 - DNA, 20 bp, human
gcggccgggccggcgtgggc

SEQ ID NO: 402538 - DNA, 20 bp, human
ggggcggggtcagggtccgc

SEQ ID NO: 402539 - DNA, 20 bp, human
gggagctcgctgggcattgt

SEQ ID NO: 402540 - DNA, 20 bp, human
gggagcggcgaccccggcga

SEQ ID NO: 402541 - DNA, 20 bp, human
gggtccgttctcccccccgc

SEQ ID NO: 402542 - DNA, 20 bp, human
gcccacgcgcaggttcctcg

SEQ ID NO: 402543 - DNA, 20 bp, human
gtgtccggctgcccgcgggg

SEQ ID NO: 402544 - DNA, 20 bp, human
gggagaacggacccccggcg

SEQ ID NO: 402545 - DNA, 20 bp, human
gcgccggcctgacggaccga

SEQ ID NO: 402546 - DNA, 20 bp, human
gcaagcgcacatatgtgggg

SEQ ID NO: 402547 - DNA, 20 bp, human
ggaggaggggatgtccacag

SEQ ID NO: 402548 - DNA, 20 bp, human
ggaccacggggcactagacc

SEQ ID NO: 402549 - DNA, 20 bp, human
gtgttggcaggaggctgtaa

SEQ ID NO: 402550 - DNA, 20 bp, human
ggggaggggtgtggaatatc

SEQ ID NO: 402551 - DNA, 20 bp, human
gggtgtggaatatcaggatg

SEQ ID NO: 402552 - DNA, 20 bp, human
ggcagtagtgagcttggggt

SEQ ID NO: 402553 - DNA, 20 bp, human
gggcctctcctctacaatgg

SEQ ID NO: 402554 - DNA, 20 bp, human
gcggggcactagacctggca

SEQ ID NO: 402555 - DNA, 20 bp, human
gggctggctctgttggcagg

SEQ ID NO: 402556 - DNA, 20 bp, human
ggcccagcgccaaaagaaca

SEQ ID NO: 402557 - DNA, 20 bp, human
gtgggcggtcagccttttcc

SEQ ID NO: 402558 - DNA, 20 bp, human
gacgcctcgccctgttcttt

SEQ ID NO: 402559 - DNA, 20 bp, human
gtgcctagcaacgtcaatct

SEQ ID NO: 402560 - DNA, 20 bp, human
gagaacggccaatgggatgc

SEQ ID NO: 402561 - DNA, 20 bp, human
ggctaggcaactccggaggc

SEQ ID NO: 402562 - DNA, 20 bp, human
gcccgcagagaacggccaat

SEQ ID NO: 402563 - DNA, 20 bp, human
gtgacgttgctaggcaactc

SEQ ID NO: 402564 - DNA, 20 bp, human
gtcccattggccgttctctg

SEQ ID NO: 402565 - DNA, 20 bp, human
gcgcccagattgacgttgct

SEQ ID NO: 402566 - DNA, 20 bp, human
gctgcaccgcgaagcctgag

SEQ ID NO: 402567 - DNA, 20 bp, human
gcctgagaggcaggtagctg

SEQ ID NO: 402568 - DNA, 20 bp, human
ggggctcagagagtgagtag

SEQ ID NO: 402569 - DNA, 20 bp, human
gcctcccaggtcggacctct

SEQ ID NO: 402570 - DNA, 20 bp, human
gacctgcctctcaggcttcg

SEQ ID NO: 402571 - DNA, 20 bp, human
gccagtggaagtgacgccaa

SEQ ID NO: 402572 - DNA, 20 bp, human
gtgaaaccgttggcgggcgc

SEQ ID NO: 402573 - DNA, 20 bp, human
gggaagcaggaaggcggttc

SEQ ID NO: 402574 - DNA, 20 bp, human
gtggcccagaggtccgacct

SEQ ID NO: 402575 - DNA, 20 bp, human
gagcaggagtgagatctgaa

SEQ ID NO: 402576 - DNA, 20 bp, human
ggattggtcagtttttccgg

SEQ ID NO: 402577 - DNA, 20 bp, human
gaggcggaatggggcggagt

SEQ ID NO: 402578 - DNA, 20 bp, human
gcactctgagaacacggcgg

SEQ ID NO: 402579 - DNA, 20 bp, human
gggaggagctaggggactag

SEQ ID NO: 402580 - DNA, 20 bp, human
gcaactgggagaggcggaat

SEQ ID NO: 402581 - DNA, 20 bp, human
gggcggcgcccgaggataag

SEQ ID NO: 402582 - DNA, 20 bp, human
gaactggctggaggagctag

SEQ ID NO: 402583 - DNA, 20 bp, human
gccggagaggcgggccctca

SEQ ID NO: 402584 - DNA, 20 bp, human
gagtgcagccagccggcgcg

SEQ ID NO: 402585 - DNA, 20 bp, human
gcaaccaatcagcaatggga

SEQ ID NO: 402586 - DNA, 20 bp, human
gaactgggacaagagagatg

SEQ ID NO: 402587 - DNA, 20 bp, human
gtccttccggggcgcctaga

SEQ ID NO: 402588 - DNA, 20 bp, human
gccctcttggaatgacagaa

SEQ ID NO: 402589 - DNA, 20 bp, human
gcggctcgagtgccgaaact

SEQ ID NO: 402590 - DNA, 20 bp, human
gatggggcttgccggcattc

SEQ ID NO: 402591 - DNA, 20 bp, human
ggccctctaggcgccccgga

SEQ ID NO: 402592 - DNA, 20 bp, human
ggtctcagaatgtccttccg

SEQ ID NO: 402593 - DNA, 20 bp, human
gggagacggggtttgaggtt

SEQ ID NO: 402594 - DNA, 20 bp, human
gtcctcctgaacatccgaat

SEQ ID NO: 402595 - DNA, 20 bp, human
gttccaagaggggggaagtg

SEQ ID NO: 402596 - DNA, 20 bp, human
gcgggcgaagccccacggga

SEQ ID NO: 402597 - DNA, 20 bp, human
ggcagcgggcgaagccccac

SEQ ID NO: 402598 - DNA, 20 bp, human
ggggggggcgggctgggcgt

SEQ ID NO: 402599 - DNA, 20 bp, human
ggggtcctcccttgtcttaa

SEQ ID NO: 402600 - DNA, 20 bp, human
gtggcctcggaggccagaac

SEQ ID NO: 402601 - DNA, 20 bp, human
gggcagagacgtggcaagag

SEQ ID NO: 402602 - DNA, 20 bp, human
gcgcgccccggggagctctg

SEQ ID NO: 402603 - DNA, 20 bp, human
gccacgggagggcagagacg

SEQ ID NO: 402604 - DNA, 20 bp, human
gcccgctgcgccggggagac

SEQ ID NO: 402605 - DNA, 20 bp, human
ggggagaccgggctgttatt

SEQ ID NO: 402606 - DNA, 20 bp, human
gtccctccgccgtttgcagc

SEQ ID NO: 402607 - DNA, 20 bp, human
ggggccgcgcagccggaagc

SEQ ID NO: 402608 - DNA, 20 bp, human
gtggggacggttacacaacc

SEQ ID NO: 402609 - DNA, 20 bp, human
ggggatgcgcggcctagcgc

SEQ ID NO: 402610 - DNA, 20 bp, human
ggggcgggcggacccagatc

SEQ ID NO: 402611 - DNA, 20 bp, human
gcccgggcccggcctgcgct

SEQ ID NO: 402612 - DNA, 20 bp, human
gagggcgatgcaaattaccc

SEQ ID NO: 402613 - DNA, 20 bp, human
gccccccgcccgtggggggg

SEQ ID NO: 402614 - DNA, 20 bp, human
gccccagcccgggtggggat

SEQ ID NO: 402615 - DNA, 20 bp, human
gtgtcggcgcggggcaccct

SEQ ID NO: 402616 - DNA, 20 bp, human
gggggggcgggtgaaaaacc

SEQ ID NO: 402617 - DNA, 20 bp, human
gtgggagccaggtgaatgta

SEQ ID NO: 402618 - DNA, 20 bp, human
gtccttattgggcggaggga

SEQ ID NO: 402619 - DNA, 20 bp, human
ggaggcgggccctgaggggg

SEQ ID NO: 402620 - DNA, 20 bp, human
gcccacccgcccccccctca

SEQ ID NO: 402621 - DNA, 20 bp, human
ggggggcggagtttgagtta

SEQ ID NO: 402622 - DNA, 20 bp, human
gtggagatgagcgggtattc

SEQ ID NO: 402623 - DNA, 20 bp, human
ggcagcaaagggctggatgg

SEQ ID NO: 402624 - DNA, 20 bp, human
gagggtgtttctaagtgttg

SEQ ID NO: 402625 - DNA, 20 bp, human
gcaccgccctgtccgctcat

SEQ ID NO: 402626 - DNA, 20 bp, human
gtaaagggcccggatgtgtg

SEQ ID NO: 402627 - DNA, 20 bp, human
ggggggcgcacagggctaaa

SEQ ID NO: 402628 - DNA, 20 bp, human
gacaggcgaccgcacacatc

SEQ ID NO: 402629 - DNA, 20 bp, human
gccggctcggggggcgcaca

SEQ ID NO: 402630 - DNA, 20 bp, human
gagcaagtgcatgtgccgcg

SEQ ID NO: 402631 - DNA, 20 bp, human
gggggggcgcccgggactgg

SEQ ID NO: 402632 - DNA, 20 bp, human
gggtcccaagcctgcgctgg

SEQ ID NO: 402633 - DNA, 20 bp, human
gagccccgagcggttggtgg

SEQ ID NO: 402634 - DNA, 20 bp, human
gcgggagtcaggacccgacg

SEQ ID NO: 402635 - DNA, 20 bp, human
gcaccgccaccaaccgctcg

SEQ ID NO: 402636 - DNA, 20 bp, human
ggtactgttaagcgcaggac

SEQ ID NO: 402637 - DNA, 20 bp, human
gtactagagaaggagagtgg

SEQ ID NO: 402638 - DNA, 20 bp, human
ggctcccggccaaatacttc

SEQ ID NO: 402639 - DNA, 20 bp, human
ggtgaagcgtaacgcgcgag

SEQ ID NO: 402640 - DNA, 20 bp, human
gccctccaaccagaagtatt

SEQ ID NO: 402641 - DNA, 20 bp, human
gcacctgtactgttaagcgc

SEQ ID NO: 402642 - DNA, 20 bp, human
gaacagtacaggtggaccaa

SEQ ID NO: 402643 - DNA, 20 bp, human
gataaaggcaagggcggtgg

SEQ ID NO: 402644 - DNA, 20 bp, human
ggcagaaataaaggcaaggg

SEQ ID NO: 402645 - DNA, 20 bp, human
gcaaccagaagtatttggcc

SEQ ID NO: 402646 - DNA, 20 bp, human
ggcgcctccggagggcagaa

SEQ ID NO: 402647 - DNA, 20 bp, human
gtgggaaaggcgcctccgga

SEQ ID NO: 402648 - DNA, 20 bp, human
ggggctggggacacaattaa

SEQ ID NO: 402649 - DNA, 20 bp, human
ggtgcagcgagtgtgggcaa

SEQ ID NO: 402650 - DNA, 20 bp, human
ggcacgctccagagacaccg

SEQ ID NO: 402651 - DNA, 20 bp, human
gtggagcgtgcagcgagtgt

SEQ ID NO: 402652 - DNA, 20 bp, human
gattctctagcagttgactg

SEQ ID NO: 402653 - DNA, 20 bp, human
gagtacaagggaaaattctg

SEQ ID NO: 402654 - DNA, 20 bp, human
ggcggatcatgattttagtc

SEQ ID NO: 402655 - DNA, 20 bp, human
gctgggcaccccggtgtctc

SEQ ID NO: 402656 - DNA, 20 bp, human
gtgaaggcgctggtgctcgc

SEQ ID NO: 402657 - DNA, 20 bp, human
gccgccccgcctctcatcgg

SEQ ID NO: 402658 - DNA, 20 bp, human
gcagccgccccgcctctcat

SEQ ID NO: 402659 - DNA, 20 bp, human
gcaatggcgctggtgcccct

SEQ ID NO: 402660 - DNA, 20 bp, human
gagggcgccaggtgaatgaa

SEQ ID NO: 402661 - DNA, 20 bp, human
ggcagggtggtcaatggcgc

SEQ ID NO: 402662 - DNA, 20 bp, human
gcgcgggagcgcctggcctc

SEQ ID NO: 402663 - DNA, 20 bp, human
gagtcaaagctcttattccc

SEQ ID NO: 402664 - DNA, 20 bp, human
gcttcagagcgcatcctccg

SEQ ID NO: 402665 - DNA, 20 bp, human
ggcgggcccttcggccagca

SEQ ID NO: 402666 - DNA, 20 bp, human
gccgaagtccggtggatgaa

SEQ ID NO: 402667 - DNA, 20 bp, human
ggcgcgcaatcgctggaagt

SEQ ID NO: 402668 - DNA, 20 bp, human
ggctggaagtcggctcgggg

SEQ ID NO: 402669 - DNA, 20 bp, human
ggcagggtagggactaaagt

SEQ ID NO: 402670 - DNA, 20 bp, human
gagtcggctcggggaggcgt

SEQ ID NO: 402671 - DNA, 20 bp, human
gctactccgcgcgtctggat

SEQ ID NO: 402672 - DNA, 20 bp, human
gaagtccggtggatgaaggg

SEQ ID NO: 402673 - DNA, 20 bp, human
gtgccggggccgacccagga

SEQ ID NO: 402674 - DNA, 20 bp, human
gcaaggggcggagtctagag

SEQ ID NO: 402675 - DNA, 20 bp, human
ggtaactccgggccgaagtc

SEQ ID NO: 402676 - DNA, 20 bp, human
gtggctactgcagacgagga

SEQ ID NO: 402677 - DNA, 20 bp, human
ggagggcggtgctagtagga

SEQ ID NO: 402678 - DNA, 20 bp, human
gggtgctagtaggagggcac

SEQ ID NO: 402679 - DNA, 20 bp, human
gcgaggagggcggtgctagt

SEQ ID NO: 402680 - DNA, 20 bp, human
gagaacagcccggtcggagg

SEQ ID NO: 402681 - DNA, 20 bp, human
ggcagtagccaatcaacacg

SEQ ID NO: 402682 - DNA, 20 bp, human
gtcctcgcaacgggcgtccc

SEQ ID NO: 402683 - DNA, 20 bp, human
ggcccagggtgtcctcgcaa

SEQ ID NO: 402684 - DNA, 20 bp, human
gacggcccaccccctccgac

SEQ ID NO: 402685 - DNA, 20 bp, human
gctacaagcctcgtgttgat

SEQ ID NO: 402686 - DNA, 20 bp, human
gtaacccggagagacggaca

SEQ ID NO: 402687 - DNA, 20 bp, human
gccggagagacggacagggg

SEQ ID NO: 402688 - DNA, 20 bp, human
gggttcctgcggtctcctcc

SEQ ID NO: 402689 - DNA, 20 bp, human
gctctccgggttactctcca

SEQ ID NO: 402690 - DNA, 20 bp, human
gggcggaggcgaggttcctg

SEQ ID NO: 402691 - DNA, 20 bp, human
ggtgctgaggtactctaaat

SEQ ID NO: 402692 - DNA, 20 bp, human
gcaaggctggagtcaaacaa

SEQ ID NO: 402693 - DNA, 20 bp, human
gggctccctggagagtaacc

SEQ ID NO: 402694 - DNA, 20 bp, human
ggagtacctcagcacctcat

SEQ ID NO: 402695 - DNA, 20 bp, human
gcccgcagttgcggaaccaa

SEQ ID NO: 402696 - DNA, 20 bp, human
gtgggatttaggaacagtga

SEQ ID NO: 402697 - DNA, 20 bp, human
gacttcttgcaacagattag

SEQ ID NO: 402698 - DNA, 20 bp, human
gtattttaatcaagtatgaa

SEQ ID NO: 402699 - DNA, 20 bp, human
gtactggatgacttgctttt

SEQ ID NO: 402700 - DNA, 20 bp, human
gtttcccttgctgtatacaa

SEQ ID NO: 402701 - DNA, 20 bp, human
gttcaacatcagttaatgct

SEQ ID NO: 402702 - DNA, 20 bp, human
ggtggcaaaactgaatatta

SEQ ID NO: 402703 - DNA, 20 bp, human
gttaaactttttcaaggttt

SEQ ID NO: 402704 - DNA, 20 bp, human
gctgagaaggttccactgtt

SEQ ID NO: 402705 - DNA, 20 bp, human
gactgatttaaactttttca

SEQ ID NO: 402706 - DNA, 20 bp, human
ggactgggtcaagtgacctt

SEQ ID NO: 402707 - DNA, 20 bp, human
gccctcgccgcgaactcctc

SEQ ID NO: 402708 - DNA, 20 bp, human
gagttggccggacactgact

SEQ ID NO: 402709 - DNA, 20 bp, human
gtcctcggggagacgcgcgc

SEQ ID NO: 402710 - DNA, 20 bp, human
gacccggggcgaccgggggt

SEQ ID NO: 402711 - DNA, 20 bp, human
ggcagtgcaccagcgacccg

SEQ ID NO: 402712 - DNA, 20 bp, human
gtgggggtgcggtcagccca

SEQ ID NO: 402713 - DNA, 20 bp, human
gcagcgacccggggcgaccg

SEQ ID NO: 402714 - DNA, 20 bp, human
gcccccacccccggtcgccc

SEQ ID NO: 402715 - DNA, 20 bp, human
gctggaccgagctgcagagt

SEQ ID NO: 402716 - DNA, 20 bp, human
ggtaccgcccctttccagga

SEQ ID NO: 402717 - DNA, 20 bp, human
ggacccggaaccatactcta

SEQ ID NO: 402718 - DNA, 20 bp, human
ggtgacacgcaaagcgtgct

SEQ ID NO: 402719 - DNA, 20 bp, human
gaggcacgacatggtctaag

SEQ ID NO: 402720 - DNA, 20 bp, human
gaaaggggcggtaccagcat

SEQ ID NO: 402721 - DNA, 20 bp, human
gtagaccatgtcgtgccttt

SEQ ID NO: 402722 - DNA, 20 bp, human
gcacgctttgcgtgtcacta

SEQ ID NO: 402723 - DNA, 20 bp, human
gcatgtcgtgcctttgggtt

SEQ ID NO: 402724 - DNA, 20 bp, human
ggtctaagcggtagtcgcca

SEQ ID NO: 402725 - DNA, 20 bp, human
ggcgtgctgggaacgccctg

SEQ ID NO: 402726 - DNA, 20 bp, human
ggggtcacagggtcacgtga

SEQ ID NO: 402727 - DNA, 20 bp, human
gcagaggaatgcctcgaagc

SEQ ID NO: 402728 - DNA, 20 bp, human
gttcgaggcattcctctgaa

SEQ ID NO: 402729 - DNA, 20 bp, human
gtatgaggcgatgcctaaga

SEQ ID NO: 402730 - DNA, 20 bp, human
gatggctgctccgggtcaca

SEQ ID NO: 402731 - DNA, 20 bp, human
gatgcctaagatggctgctc

SEQ ID NO: 402732 - DNA, 20 bp, human
gcgggggaggcgctgggtcg

SEQ ID NO: 402733 - DNA, 20 bp, human
gaaatgaggtaataagcggg

SEQ ID NO: 402734 - DNA, 20 bp, human
gaaattgagcgcttactgaa

SEQ ID NO: 402735 - DNA, 20 bp, human
gtaataagcgggagggccgc

SEQ ID NO: 402736 - DNA, 20 bp, human
gcgtatgcgcaagataagca

SEQ ID NO: 402737 - DNA, 20 bp, human
gcgccggacggggcccaagc

SEQ ID NO: 402738 - DNA, 20 bp, human
gcccccgcttgggccccgtc

SEQ ID NO: 402739 - DNA, 20 bp, human
gccgtcccgggagaccgccc

SEQ ID NO: 402740 - DNA, 20 bp, human
ggaggctccgacccccgctt

SEQ ID NO: 402741 - DNA, 20 bp, human
ggcccccggggcggtctccc

SEQ ID NO: 402742 - DNA, 20 bp, human
gcggagcctcaaggctgcgg

SEQ ID NO: 402743 - DNA, 20 bp, human
gcgcgcgccgccccatataa

SEQ ID NO: 402744 - DNA, 20 bp, human
gtggtggtgaggcactgacg

SEQ ID NO: 402745 - DNA, 20 bp, human
gcgaggagcggagcaggaag

SEQ ID NO: 402746 - DNA, 20 bp, human
ggtgcaagagtttgactgtg

SEQ ID NO: 402747 - DNA, 20 bp, human
gagagtttgactgtgtggtt

SEQ ID NO: 402748 - DNA, 20 bp, human
gtgtcgcagggtggggtacg

SEQ ID NO: 402749 - DNA, 20 bp, human
ggtacgggggcgacaggagc

SEQ ID NO: 402750 - DNA, 20 bp, human
gaaaagaatgccactgcatg

SEQ ID NO: 402751 - DNA, 20 bp, human
ggaaacacttcctggcagaa

SEQ ID NO: 402752 - DNA, 20 bp, human
ggcttggaatccacatgcag

SEQ ID NO: 402753 - DNA, 20 bp, human
gtaagaaactacaggatttt

SEQ ID NO: 402754 - DNA, 20 bp, human
gtaaaatgtcgtggtagcga

SEQ ID NO: 402755 - DNA, 20 bp, human
gtgtgtccatgtcgcagggt

SEQ ID NO: 402756 - DNA, 20 bp, human
ggcgccgtcctgcaccaggt

SEQ ID NO: 402757 - DNA, 20 bp, human
ggggctcgacccagccgctg

SEQ ID NO: 402758 - DNA, 20 bp, human
gggagctgctggaacctgtc

SEQ ID NO: 402759 - DNA, 20 bp, human
gggaccgctgggttgggccg

SEQ ID NO: 402760 - DNA, 20 bp, human
gggaacctgccctaagaagg

SEQ ID NO: 402761 - DNA, 20 bp, human
ggggcagggaataggcgcga

SEQ ID NO: 402762 - DNA, 20 bp, human
gaggtcgggaccgctgggtt

SEQ ID NO: 402763 - DNA, 20 bp, human
ggccaaggggaaaacccgag

SEQ ID NO: 402764 - DNA, 20 bp, human
gtggagaaggtgtcgccgag

SEQ ID NO: 402765 - DNA, 20 bp, human
ggtaacactgatcatgtccc

SEQ ID NO: 402766 - DNA, 20 bp, human
gaaagcaattaaaggggcgg

SEQ ID NO: 402767 - DNA, 20 bp, human
gcagcaagtctccgtgagga

SEQ ID NO: 402768 - DNA, 20 bp, human
gcaaaacaaaccctccgtga

SEQ ID NO: 402769 - DNA, 20 bp, human
ggacttgctgccctcacgga

SEQ ID NO: 402770 - DNA, 20 bp, human
ggactgtggcgtgcaggaag

SEQ ID NO: 402771 - DNA, 20 bp, human
gcggagacttgctgccctca

SEQ ID NO: 402772 - DNA, 20 bp, human
ggaacagcattcagagtcca

SEQ ID NO: 402773 - DNA, 20 bp, human
gggcatgaagtggctcctag

SEQ ID NO: 402774 - DNA, 20 bp, human
ggagaacccctgttccaagt

SEQ ID NO: 402775 - DNA, 20 bp, human
gaagaaagcaattaaagggg

SEQ ID NO: 402776 - DNA, 20 bp, human
gagggcgtgtccacgaaggg

SEQ ID NO: 402777 - DNA, 20 bp, human
gaagctgcctgggtctacag

SEQ ID NO: 402778 - DNA, 20 bp, human
gcgagcggtaagagtgcggc

SEQ ID NO: 402779 - DNA, 20 bp, human
gtagagggcgtgtccacgaa

SEQ ID NO: 402780 - DNA, 20 bp, human
ggacacgccctctaggcgta

SEQ ID NO: 402781 - DNA, 20 bp, human
ggcgcagacaccacccttcg

SEQ ID NO: 402782 - DNA, 20 bp, human
ggtaagagtgcggcgggact

SEQ ID NO: 402783 - DNA, 20 bp, human
ggatcctaggaaaggaaact

SEQ ID NO: 402784 - DNA, 20 bp, human
gtaggcgatggcccagaaag

SEQ ID NO: 402785 - DNA, 20 bp, human
gcgcactcttaccgctcgca

SEQ ID NO: 402786 - DNA, 20 bp, human
gcgtgcgcaggcgcggacac

SEQ ID NO: 402787 - DNA, 20 bp, human
gggcgcatgcgcgttcactc

SEQ ID NO: 402788 - DNA, 20 bp, human
gacacggcgtatccccgccc

SEQ ID NO: 402789 - DNA, 20 bp, human
gcacaggtttcgcgggtaga

SEQ ID NO: 402790 - DNA, 20 bp, human
gtgcctgagcacaggtttcg

SEQ ID NO: 402791 - DNA, 20 bp, human
gaaaggtccccgaggtgccc

SEQ ID NO: 402792 - DNA, 20 bp, human
ggcgggtagaaggcgtgcgc

SEQ ID NO: 402793 - DNA, 20 bp, human
gggcggcggcgtgcgcgtgc

SEQ ID NO: 402794 - DNA, 20 bp, human
gccgcctcccgggcacctcg

SEQ ID NO: 402795 - DNA, 20 bp, human
gcggcgcgcagtgccggccg

SEQ ID NO: 402796 - DNA, 20 bp, human
gccactgcgtcccactagga

SEQ ID NO: 402797 - DNA, 20 bp, human
gcgatgtcgcagagcatagt

SEQ ID NO: 402798 - DNA, 20 bp, human
gcatagtgggtagcgaggag

SEQ ID NO: 402799 - DNA, 20 bp, human
gcaaacgcggcctttgcgac

SEQ ID NO: 402800 - DNA, 20 bp, human
ggggggcagggacgggacgt

SEQ ID NO: 402801 - DNA, 20 bp, human
ggtccctgccccctcctagt

SEQ ID NO: 402802 - DNA, 20 bp, human
gagggtgaatctgggcgagc

SEQ ID NO: 402803 - DNA, 20 bp, human
ggtgatgtcgcgcatccgat

SEQ ID NO: 402804 - DNA, 20 bp, human
gtcaggatggggatggtaca

SEQ ID NO: 402805 - DNA, 20 bp, human
gcagagcatagtgggtagcg

SEQ ID NO: 402806 - DNA, 20 bp, human
ggggttcggctggctcgcgc

SEQ ID NO: 402807 - DNA, 20 bp, human
gcggcgggttcttcatcccc

SEQ ID NO: 402808 - DNA, 20 bp, human
gctgcgctgtagcgggggtt

SEQ ID NO: 402809 - DNA, 20 bp, human
ggctgtagcgggggttcggc

SEQ ID NO: 402810 - DNA, 20 bp, human
gggcgcctgcgctgtagcgg

SEQ ID NO: 402811 - DNA, 20 bp, human
ggggtcacgtgacggggctc

SEQ ID NO: 402812 - DNA, 20 bp, human
gcggccgccgggtcacgtga

SEQ ID NO: 402813 - DNA, 20 bp, human
gcacggggagttcgcttctc

SEQ ID NO: 402814 - DNA, 20 bp, human
ggaaccgcgcggaggccgga

SEQ ID NO: 402815 - DNA, 20 bp, human
gctacagcgcaggcgccacg

SEQ ID NO: 402816 - DNA, 20 bp, human
gccgggaagtggcctggtaa

SEQ ID NO: 402817 - DNA, 20 bp, human
ggtcgcgctgacaacggcag

SEQ ID NO: 402818 - DNA, 20 bp, human
gtgggaaggaactgcggtat

SEQ ID NO: 402819 - DNA, 20 bp, human
gaagtggcctggtaacggct

SEQ ID NO: 402820 - DNA, 20 bp, human
gcgcacgcgcagaacgaggc

SEQ ID NO: 402821 - DNA, 20 bp, human
ggcctggtaacggctgggaa

SEQ ID NO: 402822 - DNA, 20 bp, human
gccctcgccaagtctcccaa

SEQ ID NO: 402823 - DNA, 20 bp, human
gactagtgagcgccgggaag

SEQ ID NO: 402824 - DNA, 20 bp, human
ggccgcgcacgcgcagaacg

SEQ ID NO: 402825 - DNA, 20 bp, human
gacggcgggtcctcggcggt

SEQ ID NO: 402826 - DNA, 20 bp, human
gcaggcccccggttgggccg

SEQ ID NO: 402827 - DNA, 20 bp, human
ggcggcccggcccaacatgg

SEQ ID NO: 402828 - DNA, 20 bp, human
ggaggaagggcggggtcggt

SEQ ID NO: 402829 - DNA, 20 bp, human
gccggggctgcgtccccggg

SEQ ID NO: 402830 - DNA, 20 bp, human
gggggcctgacctgtcgtca

SEQ ID NO: 402831 - DNA, 20 bp, human
gcgcagccccggcccaaccg

SEQ ID NO: 402832 - DNA, 20 bp, human
gtccgcggcccggcccaaca

SEQ ID NO: 402833 - DNA, 20 bp, human
gcctcccgctccctgacgac

SEQ ID NO: 402834 - DNA, 20 bp, human
ggggcgtcgggggaacacgg

SEQ ID NO: 402835 - DNA, 20 bp, human
gcgctccctgacgacaggtc

SEQ ID NO: 402836 - DNA, 20 bp, human
gggggtgtaggacccatgga

SEQ ID NO: 402837 - DNA, 20 bp, human
gcagtcgatgatgtcatcat

SEQ ID NO: 402838 - DNA, 20 bp, human
gaggggagtttaaggacctg

SEQ ID NO: 402839 - DNA, 20 bp, human
ggggcttggtagtccctcag

SEQ ID NO: 402840 - DNA, 20 bp, human
gcagagctagaaacactggc

SEQ ID NO: 402841 - DNA, 20 bp, human
gaatagcagcagcttatgtt

SEQ ID NO: 402842 - DNA, 20 bp, human
ggcagcagcttatgttagga

SEQ ID NO: 402843 - DNA, 20 bp, human
ggtcgagtgacgtcacctcc

SEQ ID NO: 402844 - DNA, 20 bp, human
gtatgttaggacggttatga

SEQ ID NO: 402845 - DNA, 20 bp, human
gcgaacttcagtctgcaaat

SEQ ID NO: 402846 - DNA, 20 bp, human
gggccgagcgcgttgaccat

SEQ ID NO: 402847 - DNA, 20 bp, human
gcagcccacgggacctacga

SEQ ID NO: 402848 - DNA, 20 bp, human
gcgagcgcgttgaccattgg

SEQ ID NO: 402849 - DNA, 20 bp, human
ggccgcccggccccgccact

SEQ ID NO: 402850 - DNA, 20 bp, human
ggggcggcgagagacgcggc

SEQ ID NO: 402851 - DNA, 20 bp, human
ggacgggcactctcctccaa

SEQ ID NO: 402852 - DNA, 20 bp, human
gtggccctcgtaggtcccgt

SEQ ID NO: 402853 - DNA, 20 bp, human
gacaccttgcccgggactaa

SEQ ID NO: 402854 - DNA, 20 bp, human
gaagcgctggtggccctcgt

SEQ ID NO: 402855 - DNA, 20 bp, human
gggcggaggcggcagcctag

SEQ ID NO: 402856 - DNA, 20 bp, human
ggggccgcgcgtcgacgccg

SEQ ID NO: 402857 - DNA, 20 bp, human
gggaaggccacgttgcgcac

SEQ ID NO: 402858 - DNA, 20 bp, human
gtggcgccacgtctgactgg

SEQ ID NO: 402859 - DNA, 20 bp, human
ggccggggctccggattgaa

SEQ ID NO: 402860 - DNA, 20 bp, human
ggagccccggcgtcgacgcg

SEQ ID NO: 402861 - DNA, 20 bp, human
ggcccgggagacgccgccat

SEQ ID NO: 402862 - DNA, 20 bp, human
gcgcaacgtggccttcccat

SEQ ID NO: 402863 - DNA, 20 bp, human
gcgtcgacgcgcggcccact

SEQ ID NO: 402864 - DNA, 20 bp, human
gcggtggcgccacgtctgac

SEQ ID NO: 402865 - DNA, 20 bp, human
gactgggtgagccaatggga

SEQ ID NO: 402866 - DNA, 20 bp, human
ggccgcgagcggccagccga

SEQ ID NO: 402867 - DNA, 20 bp, human
ggacgggagccgagctctct

SEQ ID NO: 402868 - DNA, 20 bp, human
gggggggcgtgggggcgagt

SEQ ID NO: 402869 - DNA, 20 bp, human
ggcacctggggagaagggcg

SEQ ID NO: 402870 - DNA, 20 bp, human
gtccaggcatgagctttcga

SEQ ID NO: 402871 - DNA, 20 bp, human
ggcacctggaagccggagaa

SEQ ID NO: 402872 - DNA, 20 bp, human
ggagctttcgacggggaatg

SEQ ID NO: 402873 - DNA, 20 bp, human
gcgctcgcggcagcacccgc

SEQ ID NO: 402874 - DNA, 20 bp, human
gcacagatggggaagggcgg

SEQ ID NO: 402875 - DNA, 20 bp, human
gggggacttttgacacagat

SEQ ID NO: 402876 - DNA, 20 bp, human
gtacagaagggcaaccacgg

SEQ ID NO: 402877 - DNA, 20 bp, human
ggacgaaaaagcttacagaa

SEQ ID NO: 402878 - DNA, 20 bp, human
gcgcagagccgaggcgaagg

SEQ ID NO: 402879 - DNA, 20 bp, human
gggcctgcccagagtcgcgg

SEQ ID NO: 402880 - DNA, 20 bp, human
ggccctccgcgactctgggc

SEQ ID NO: 402881 - DNA, 20 bp, human
gctgcgcagagccgaggcga

SEQ ID NO: 402882 - DNA, 20 bp, human
gcaccgccctccgcgactct

SEQ ID NO: 402883 - DNA, 20 bp, human
gctccctgcctccttcgcct

SEQ ID NO: 402884 - DNA, 20 bp, human
gcccggcctgcccagagtcg

SEQ ID NO: 402885 - DNA, 20 bp, human
ggcttacagaagggcaacca

SEQ ID NO: 402886 - DNA, 20 bp, human
gtcgcaggaagcgctcgcta

SEQ ID NO: 402887 - DNA, 20 bp, human
gggggtgcgcactcctcaac

SEQ ID NO: 402888 - DNA, 20 bp, human
ggccgagcctagaaccgaga

SEQ ID NO: 402889 - DNA, 20 bp, human
gcctggggtaccacgatctg

SEQ ID NO: 402890 - DNA, 20 bp, human
gaacgcgcgggcaaatctgc

SEQ ID NO: 402891 - DNA, 20 bp, human
ggaaactaaaagcgatcttg

SEQ ID NO: 402892 - DNA, 20 bp, human
gtcggttctaggctcggcga

SEQ ID NO: 402893 - DNA, 20 bp, human
gcagcccagcgatccactct

SEQ ID NO: 402894 - DNA, 20 bp, human
gggaaagaaagagaacgcgc

SEQ ID NO: 402895 - DNA, 20 bp, human
ggtggccccctctcggttct

SEQ ID NO: 402896 - DNA, 20 bp, human
gacggcgcctgcggatcccc

SEQ ID NO: 402897 - DNA, 20 bp, human
gcaggcggggacagcgttga

SEQ ID NO: 402898 - DNA, 20 bp, human
gacaactggtagtgctaggg

SEQ ID NO: 402899 - DNA, 20 bp, human
gaagacaactggtagtgcta

SEQ ID NO: 402900 - DNA, 20 bp, human
gatcccctggacgtggactc

SEQ ID NO: 402901 - DNA, 20 bp, human
ggccccggcgcgtggaagca

SEQ ID NO: 402902 - DNA, 20 bp, human
gaagcagggtacggcgcctg

SEQ ID NO: 402903 - DNA, 20 bp, human
gtccgcccaggcaccgttca

SEQ ID NO: 402904 - DNA, 20 bp, human
gcctgcggatcccctggacg

SEQ ID NO: 402905 - DNA, 20 bp, human
gcagcgaacagcccggggat

SEQ ID NO: 402906 - DNA, 20 bp, human
gcctccttaagctcgctcta

SEQ ID NO: 402907 - DNA, 20 bp, human
gccggagccttcaaactctc

SEQ ID NO: 402908 - DNA, 20 bp, human
gggctgggaaagtctaaccg

SEQ ID NO: 402909 - DNA, 20 bp, human
gccggaacttccgtcctggg

SEQ ID NO: 402910 - DNA, 20 bp, human
ggaaccttagagcgagctta

SEQ ID NO: 402911 - DNA, 20 bp, human
ggctccggaacttccgtcct

SEQ ID NO: 402912 - DNA, 20 bp, human
gtaaatatgctagttgataa

SEQ ID NO: 402913 - DNA, 20 bp, human
gtgtcagtccaaattcagca

SEQ ID NO: 402914 - DNA, 20 bp, human
gaggcggatattaacctccc

SEQ ID NO: 402915 - DNA, 20 bp, human
gctcttgaggcagcctggct

SEQ ID NO: 402916 - DNA, 20 bp, human
gcggctgcaggaagggaaac

SEQ ID NO: 402917 - DNA, 20 bp, human
gttaaagtgcggctgcagga

SEQ ID NO: 402918 - DNA, 20 bp, human
ggcccccgaagggagcgaat

SEQ ID NO: 402919 - DNA, 20 bp, human
ggaaacaggcatgtctcgct

SEQ ID NO: 402920 - DNA, 20 bp, human
gaggtgcgagggcccccgaa

SEQ ID NO: 402921 - DNA, 20 bp, human
gtgtagtcctacaggccccc

SEQ ID NO: 402922 - DNA, 20 bp, human
gctggctggccctgaagctc

SEQ ID NO: 402923 - DNA, 20 bp, human
gctatgagcctgtgcggtag

SEQ ID NO: 402924 - DNA, 20 bp, human
gtacaggcccccgggcttcc

SEQ ID NO: 402925 - DNA, 20 bp, human
gatgtctcgcttggccttct

SEQ ID NO: 402926 - DNA, 20 bp, human
ggggccgaacagggtttcaa

SEQ ID NO: 402927 - DNA, 20 bp, human
gctggccccgcctacgtcta

SEQ ID NO: 402928 - DNA, 20 bp, human
gaggggaggtatcttagtgc

SEQ ID NO: 402929 - DNA, 20 bp, human
ggaagggcggggcttccaac

SEQ ID NO: 402930 - DNA, 20 bp, human
gggggccagacaggcttcta

SEQ ID NO: 402931 - DNA, 20 bp, human
gtagtgccggctggtgggtc

SEQ ID NO: 402932 - DNA, 20 bp, human
ggggaggccgtagacgtagg

SEQ ID NO: 402933 - DNA, 20 bp, human
ggaaactcctcggaagggcg

SEQ ID NO: 402934 - DNA, 20 bp, human
ggggccggtgtctccagtat

SEQ ID NO: 402935 - DNA, 20 bp, human
gtatcttagtgccggctggt

SEQ ID NO: 402936 - DNA, 20 bp, human
ggggccccccgaacgaaggg

SEQ ID NO: 402937 - DNA, 20 bp, human
gcgggccaggaccccattac

SEQ ID NO: 402938 - DNA, 20 bp, human
gctaacccgcggcgcccagg

SEQ ID NO: 402939 - DNA, 20 bp, human
ggagctacgcgcagagggaa

SEQ ID NO: 402940 - DNA, 20 bp, human
gccccccgaacgaagggagg

SEQ ID NO: 402941 - DNA, 20 bp, human
gggacctcgcgacctccgct

SEQ ID NO: 402942 - DNA, 20 bp, human
gaatcagcgcggctaacccg

SEQ ID NO: 402943 - DNA, 20 bp, human
gcacacccacgcggagggaa

SEQ ID NO: 402944 - DNA, 20 bp, human
ggggcgggccgctggcagag

SEQ ID NO: 402945 - DNA, 20 bp, human
ggcactcacacccacgcgga

SEQ ID NO: 402946 - DNA, 20 bp, human
gggacgccccgcacagcctt

SEQ ID NO: 402947 - DNA, 20 bp, human
ggccaatcagcgaagtgcgg

SEQ ID NO: 402948 - DNA, 20 bp, human
ggaaagagtcgcaaattccc

SEQ ID NO: 402949 - DNA, 20 bp, human
gaatcagcgaagtgcggggg

SEQ ID NO: 402950 - DNA, 20 bp, human
ggctgcacttgacgctccgc

SEQ ID NO: 402951 - DNA, 20 bp, human
ggcggccaatcagcgaagtg

SEQ ID NO: 402952 - DNA, 20 bp, human
gtgcagcttgattagaccga

SEQ ID NO: 402953 - DNA, 20 bp, human
gcgtgacgagcgggctagtg

SEQ ID NO: 402954 - DNA, 20 bp, human
gctctgcccaaggctgtgcg

SEQ ID NO: 402955 - DNA, 20 bp, human
ggggctcaactctgcatctt

SEQ ID NO: 402956 - DNA, 20 bp, human
ggaggaaagtcgggcgggaa

SEQ ID NO: 402957 - DNA, 20 bp, human
gaatgtccgtgacacgtgaa

SEQ ID NO: 402958 - DNA, 20 bp, human
gagtaggaggaaagtcgggc

SEQ ID NO: 402959 - DNA, 20 bp, human
ggtctcagtgatgtcataca

SEQ ID NO: 402960 - DNA, 20 bp, human
gacatcactgagacacctag

SEQ ID NO: 402961 - DNA, 20 bp, human
gcggccccattcacgtgtca

SEQ ID NO: 402962 - DNA, 20 bp, human
gcttgagtaggaggaaagtc

SEQ ID NO: 402963 - DNA, 20 bp, human
gtgcttttggcttcttgagt

SEQ ID NO: 402964 - DNA, 20 bp, human
ggtcatacaaggtttgcaca

SEQ ID NO: 402965 - DNA, 20 bp, human
gttttggcttcttgagtagg

SEQ ID NO: 402966 - DNA, 20 bp, human
gaagctcgagcgggatgcac

SEQ ID NO: 402967 - DNA, 20 bp, human
gacgggctgcagcttaacga

SEQ ID NO: 402968 - DNA, 20 bp, human
ggccgggtggttggaggcca

SEQ ID NO: 402969 - DNA, 20 bp, human
gcgaggaagcgaagctcgag

SEQ ID NO: 402970 - DNA, 20 bp, human
gggccatggtgaacagcagc

SEQ ID NO: 402971 - DNA, 20 bp, human
ggtcgatgtgcgtgagcgtg

SEQ ID NO: 402972 - DNA, 20 bp, human
gtgaacggcggcgggggcca

SEQ ID NO: 402973 - DNA, 20 bp, human
gacggcggcgggggccacgg

SEQ ID NO: 402974 - DNA, 20 bp, human
gaccatggcctccaaccacc

SEQ ID NO: 402975 - DNA, 20 bp, human
gagcccgtagttgtggatga

SEQ ID NO: 402976 - DNA, 20 bp, human
gtggtcaacctgtggctggt

SEQ ID NO: 402977 - DNA, 20 bp, human
ggaacaaaggtttagtcaga

SEQ ID NO: 402978 - DNA, 20 bp, human
gagcttggtcaacctgtggc

SEQ ID NO: 402979 - DNA, 20 bp, human
ggaaaacccaaagtgatctc

SEQ ID NO: 402980 - DNA, 20 bp, human
gtgatctcaggtgattatcc

SEQ ID NO: 402981 - DNA, 20 bp, human
gaaaaaagatactttagaac

SEQ ID NO: 402982 - DNA, 20 bp, human
gctttgttctaaagcaagct

SEQ ID NO: 402983 - DNA, 20 bp, human
gtccttttccttgtaatata

SEQ ID NO: 402984 - DNA, 20 bp, human
gagatagttaatatcacagc

SEQ ID NO: 402985 - DNA, 20 bp, human
gtagaacacataaaggactt

SEQ ID NO: 402986 - DNA, 20 bp, human
gccagcttggaagaaccaat

SEQ ID NO: 402987 - DNA, 20 bp, human
gtgaccgcgctgccgctctc

SEQ ID NO: 402988 - DNA, 20 bp, human
ggcggcagcgcggtcagtgg

SEQ ID NO: 402989 - DNA, 20 bp, human
gtatccgagggcggtgcaaa

SEQ ID NO: 402990 - DNA, 20 bp, human
gagacccagcgcgcctaggg

SEQ ID NO: 402991 - DNA, 20 bp, human
gcttgtgggtggaaacgcgc

SEQ ID NO: 402992 - DNA, 20 bp, human
gctctcaggcgccacgcaat

SEQ ID NO: 402993 - DNA, 20 bp, human
gggaaatattgaaagccgat

SEQ ID NO: 402994 - DNA, 20 bp, human
gtgtggaggaaggactaatt

SEQ ID NO: 402995 - DNA, 20 bp, human
gtaggcgcgctgggtcttgt

SEQ ID NO: 402996 - DNA, 20 bp, human
gaggagagccgaggtgtaag

SEQ ID NO: 402997 - DNA, 20 bp, human
ggggctgcggcagacaggcg

SEQ ID NO: 402998 - DNA, 20 bp, human
gagccgaggtgtaaggggat

SEQ ID NO: 402999 - DNA, 20 bp, human
gcggccaatcagcggggcga

SEQ ID NO: 403000 - DNA, 20 bp, human
ggctactgctagcaagaagg

SEQ ID NO: 403001 - DNA, 20 bp, human
gcagctcggacgcacggact

SEQ ID NO: 403002 - DNA, 20 bp, human
gctcctccgggcttttagac

SEQ ID NO: 403003 - DNA, 20 bp, human
gggcgggggctgcggcagac

SEQ ID NO: 403004 - DNA, 20 bp, human
gcgtcagcagctcggacgca

SEQ ID NO: 403005 - DNA, 20 bp, human
gcggcacggcgtcagcagct

SEQ ID NO: 403006 - DNA, 20 bp, human
gagaaaggcggccccccagg

SEQ ID NO: 403007 - DNA, 20 bp, human
gaatcagcaccgcgaatcga

SEQ ID NO: 403008 - DNA, 20 bp, human
gaggcggccggccagcagtt

SEQ ID NO: 403009 - DNA, 20 bp, human
ggcacccgggctcccagaac

SEQ ID NO: 403010 - DNA, 20 bp, human
gcgagccggtgaggacggag

SEQ ID NO: 403011 - DNA, 20 bp, human
gtggggggccgcctttctcc

SEQ ID NO: 403012 - DNA, 20 bp, human
gcgtgcgaggcccacgtgag

SEQ ID NO: 403013 - DNA, 20 bp, human
gccctcaggaaaggtgagag

SEQ ID NO: 403014 - DNA, 20 bp, human
ggccggccagcagttgggcg

SEQ ID NO: 403015 - DNA, 20 bp, human
gcgtgagggtagcccgggag

SEQ ID NO: 403016 - DNA, 20 bp, human
gtcagccgcgaggcagatag

SEQ ID NO: 403017 - DNA, 20 bp, human
gcactgtcctcgccctgcat

SEQ ID NO: 403018 - DNA, 20 bp, human
gcgatccgctatctgcctcg

SEQ ID NO: 403019 - DNA, 20 bp, human
ggacagtgccaggcggggca

SEQ ID NO: 403020 - DNA, 20 bp, human
gaatatgaaccgtcaggggt

SEQ ID NO: 403021 - DNA, 20 bp, human
gtcgcggctgacccctccag

SEQ ID NO: 403022 - DNA, 20 bp, human
gcgccggggccgcagtcggg

SEQ ID NO: 403023 - DNA, 20 bp, human
gcccggagccgccgctggag

SEQ ID NO: 403024 - DNA, 20 bp, human
gcttgggcggggcctcgcat

SEQ ID NO: 403025 - DNA, 20 bp, human
gagacagccaatgcagggcg

SEQ ID NO: 403026 - DNA, 20 bp, human
gccctcaaaggtatcacatg

SEQ ID NO: 403027 - DNA, 20 bp, human
gccgcccgccggggctgtgt

SEQ ID NO: 403028 - DNA, 20 bp, human
gccaaacccgcgctggggaa

SEQ ID NO: 403029 - DNA, 20 bp, human
gcctccgtccgcagcgggat

SEQ ID NO: 403030 - DNA, 20 bp, human
gcccgctgcggacggaggtg

SEQ ID NO: 403031 - DNA, 20 bp, human
gctggggaaagggccgcctc

SEQ ID NO: 403032 - DNA, 20 bp, human
gggctgccaaacccgcgctg

SEQ ID NO: 403033 - DNA, 20 bp, human
gtcccccgccgcgccctcaa

SEQ ID NO: 403034 - DNA, 20 bp, human
ggtgaggttggagcgagcgc

SEQ ID NO: 403035 - DNA, 20 bp, human
gggcgcatattggccagcgc

SEQ ID NO: 403036 - DNA, 20 bp, human
gccaccgctaggggccgctt

SEQ ID NO: 403037 - DNA, 20 bp, human
gcctgcgagccccaccgcta

SEQ ID NO: 403038 - DNA, 20 bp, human
gtgggcggggactgcgtttc

SEQ ID NO: 403039 - DNA, 20 bp, human
ggcacctaagcggcccctag

SEQ ID NO: 403040 - DNA, 20 bp, human
gttaggaggagcttgggcgg

SEQ ID NO: 403041 - DNA, 20 bp, human
gacagcgcccccaggcgctt

SEQ ID NO: 403042 - DNA, 20 bp, human
gcctgggggctgcacctaag

SEQ ID NO: 403043 - DNA, 20 bp, human
ggggactgcgtttcggggcg

SEQ ID NO: 403044 - DNA, 20 bp, human
ggctcctcctaagcgcctgg

SEQ ID NO: 403045 - DNA, 20 bp, human
ggggtcgctttgggtcgcgg

SEQ ID NO: 403046 - DNA, 20 bp, human
gtcagagctgcaaggaaagt

SEQ ID NO: 403047 - DNA, 20 bp, human
gcttgcagctctgaactgtg

SEQ ID NO: 403048 - DNA, 20 bp, human
gtaaaagggtacaaatgtca

SEQ ID NO: 403049 - DNA, 20 bp, human
gtcagggagaccaattgtgt

SEQ ID NO: 403050 - DNA, 20 bp, human
gaaaaccctagggactgaat

SEQ ID NO: 403051 - DNA, 20 bp, human
gggagaccaattgtgttggt

SEQ ID NO: 403052 - DNA, 20 bp, human
gattgcaaggaaaaacccta

SEQ ID NO: 403053 - DNA, 20 bp, human
gaagtacccaccaacacaat

SEQ ID NO: 403054 - DNA, 20 bp, human
gttgaatgaccacagtggtt

SEQ ID NO: 403055 - DNA, 20 bp, human
gctgaataggtagtaagcaa

SEQ ID NO: 403056 - DNA, 20 bp, human
gcggcggagcgctagggcgg

SEQ ID NO: 403057 - DNA, 20 bp, human
gggggcgcgtcgctcgtttc

SEQ ID NO: 403058 - DNA, 20 bp, human
gacctggagcgagtgcgctg

SEQ ID NO: 403059 - DNA, 20 bp, human
gtgtgcgcggcggagcgcta

SEQ ID NO: 403060 - DNA, 20 bp, human
gcgcactcgctccaggtgtc

SEQ ID NO: 403061 - DNA, 20 bp, human
gggccaggctggcaaaggcg

SEQ ID NO: 403062 - DNA, 20 bp, human
gcgggcgcaaccgtcggagc

SEQ ID NO: 403063 - DNA, 20 bp, human
ggctagggcgggggcacagt

SEQ ID NO: 403064 - DNA, 20 bp, human
gtcgaagccgggagagaaaa

SEQ ID NO: 403065 - DNA, 20 bp, human
ggtgcgctggggcgccggac

SEQ ID NO: 403066 - DNA, 20 bp, human
gcaggtgggcggggacggaa

SEQ ID NO: 403067 - DNA, 20 bp, human
gctgatgtgcgcatgcgtag

SEQ ID NO: 403068 - DNA, 20 bp, human
gcacatcaggcgcggcaggt

SEQ ID NO: 403069 - DNA, 20 bp, human
ggtgggcggggacggaaagg

SEQ ID NO: 403070 - DNA, 20 bp, human
ggggagggaaggcacttccg

SEQ ID NO: 403071 - DNA, 20 bp, human
gcgcatgcgcacatcaggcg

SEQ ID NO: 403072 - DNA, 20 bp, human
gtgccccgcccataattatt

SEQ ID NO: 403073 - DNA, 20 bp, human
gaacctaataattatgggcg

SEQ ID NO: 403074 - DNA, 20 bp, human
gaaggcaaacctaataatta

SEQ ID NO: 403075 - DNA, 20 bp, human
gtgcgcacatcaggcgcggc

SEQ ID NO: 403076 - DNA, 20 bp, human
ggaaagctgcacacggggcg

SEQ ID NO: 403077 - DNA, 20 bp, human
ggggcaatcgcaagcccgat

SEQ ID NO: 403078 - DNA, 20 bp, human
gcgcacggagccacccgcta

SEQ ID NO: 403079 - DNA, 20 bp, human
ggaatgcagcggggcctatc

SEQ ID NO: 403080 - DNA, 20 bp, human
gtacaactcccggaatgcag

SEQ ID NO: 403081 - DNA, 20 bp, human
ggcccggaggacggcatgct

SEQ ID NO: 403082 - DNA, 20 bp, human
ggccgcgaaagctgcacacg

SEQ ID NO: 403083 - DNA, 20 bp, human
gcttgcgattgcccggagga

SEQ ID NO: 403084 - DNA, 20 bp, human
gcgctagagactacaactcc

SEQ ID NO: 403085 - DNA, 20 bp, human
ggtcccagcatgccgtcctc

SEQ ID NO: 403086 - DNA, 20 bp, human
gactcgtgggcgtcaatact

SEQ ID NO: 403087 - DNA, 20 bp, human
gttgtggcgcgcttagtgat

SEQ ID NO: 403088 - DNA, 20 bp, human
gtgtagcaggcgagatagac

SEQ ID NO: 403089 - DNA, 20 bp, human
gggcgcgcttagtgatggga

SEQ ID NO: 403090 - DNA, 20 bp, human
gatagacgggaagatcggta

SEQ ID NO: 403091 - DNA, 20 bp, human
gagggtgggagatgccggaa

SEQ ID NO: 403092 - DNA, 20 bp, human
gtgatgggatggccctgtgc

SEQ ID NO: 403093 - DNA, 20 bp, human
ggcgagatagacgggaagat

SEQ ID NO: 403094 - DNA, 20 bp, human
gtcgtgtcggcgtcctgcac

SEQ ID NO: 403095 - DNA, 20 bp, human
ggacgggaagatcggtaggg

SEQ ID NO: 403096 - DNA, 20 bp, human
gtgcgggctgctaaacgggg

SEQ ID NO: 403097 - DNA, 20 bp, human
gtctcccggagggccagagt

SEQ ID NO: 403098 - DNA, 20 bp, human
gcacgctctgcatccatctc

SEQ ID NO: 403099 - DNA, 20 bp, human
gtacctacctgggataacgg

SEQ ID NO: 403100 - DNA, 20 bp, human
gatggatgcagagcgtgtgc

SEQ ID NO: 403101 - DNA, 20 bp, human
gcatttacggggtctcccgg

SEQ ID NO: 403102 - DNA, 20 bp, human
gcgtgtgcgggctgctaaac

SEQ ID NO: 403103 - DNA, 20 bp, human
gcgcgccggaagtacctacc

SEQ ID NO: 403104 - DNA, 20 bp, human
ggataacggcggcgagcgga

SEQ ID NO: 403105 - DNA, 20 bp, human
gctgctaaacgggggggagt

SEQ ID NO: 403106 - DNA, 20 bp, human
gggagtgggcggatgcgttg

SEQ ID NO: 403107 - DNA, 20 bp, human
gaactgacgggccagtgagc

SEQ ID NO: 403108 - DNA, 20 bp, human
gggcctctcaacacccaccg

SEQ ID NO: 403109 - DNA, 20 bp, human
gcactggcccgtcagttcgc

SEQ ID NO: 403110 - DNA, 20 bp, human
ggagaggcccgcgaactgac

SEQ ID NO: 403111 - DNA, 20 bp, human
gaaacggctgagtcgttctc

SEQ ID NO: 403112 - DNA, 20 bp, human
ggggcggatgcgttggggtt

SEQ ID NO: 403113 - DNA, 20 bp, human
ggtgagcgggcgtcgggagt

SEQ ID NO: 403114 - DNA, 20 bp, human
gaccgggcggcgcatctccc

SEQ ID NO: 403115 - DNA, 20 bp, human
gaacgactcagccgtttcgg

SEQ ID NO: 403116 - DNA, 20 bp, human
gtgagtgactcgccagggac

SEQ ID NO: 403117 - DNA, 20 bp, human
gccagggacgggtggaggat

SEQ ID NO: 403118 - DNA, 20 bp, human
gtgggccgctccctagtcaa

SEQ ID NO: 403119 - DNA, 20 bp, human
ggagcccgggacgttctgga

SEQ ID NO: 403120 - DNA, 20 bp, human
ggggaccagcacgggccgga

SEQ ID NO: 403121 - DNA, 20 bp, human
gaccccctgcacttgatcga

SEQ ID NO: 403122 - DNA, 20 bp, human
gcctccttccagaacgtccc

SEQ ID NO: 403123 - DNA, 20 bp, human
ggaaagggatgcccaggagt

SEQ ID NO: 403124 - DNA, 20 bp, human
gggggcggccctacgtagcc

SEQ ID NO: 403125 - DNA, 20 bp, human
gccagaagccaggctacgta

SEQ ID NO: 403126 - DNA, 20 bp, human
gagtggggccctgaccaggg

SEQ ID NO: 403127 - DNA, 20 bp, human
gcggagtggggccctgacca

SEQ ID NO: 403128 - DNA, 20 bp, human
gaaagcggacacttcctccc

SEQ ID NO: 403129 - DNA, 20 bp, human
gaggaaggggctcctccgcc

SEQ ID NO: 403130 - DNA, 20 bp, human
gactcactctcccacccggg

SEQ ID NO: 403131 - DNA, 20 bp, human
gtgagtggagtcgcgactcg

SEQ ID NO: 403132 - DNA, 20 bp, human
gaccccttctgacgcaggag

SEQ ID NO: 403133 - DNA, 20 bp, human
gcctccagaagctcttaaag

SEQ ID NO: 403134 - DNA, 20 bp, human
ggatttcccaagctccggag

SEQ ID NO: 403135 - DNA, 20 bp, human
gccactcacgcaggcatcca

SEQ ID NO: 403136 - DNA, 20 bp, human
gcgcgccggtcccccggcca

SEQ ID NO: 403137 - DNA, 20 bp, human
gttaggaagaatctgggaat

SEQ ID NO: 403138 - DNA, 20 bp, human
ggccgactggggcaccaaga

SEQ ID NO: 403139 - DNA, 20 bp, human
ggggcccgttcccctgacaa

SEQ ID NO: 403140 - DNA, 20 bp, human
ggccagggcggggcttgcca

SEQ ID NO: 403141 - DNA, 20 bp, human
gaagctgtgactcgggagta

SEQ ID NO: 403142 - DNA, 20 bp, human
ggtagcccgcgccgttgtca

SEQ ID NO: 403143 - DNA, 20 bp, human
ggggctacggcgccccacag

SEQ ID NO: 403144 - DNA, 20 bp, human
gccggtcccccggccagggc

SEQ ID NO: 403145 - DNA, 20 bp, human
ggcgctgcgtcactccgcgc

SEQ ID NO: 403146 - DNA, 20 bp, human
gtcggtgcagggccccgccc

SEQ ID NO: 403147 - DNA, 20 bp, human
ggacctgcgccgtcagatcc

SEQ ID NO: 403148 - DNA, 20 bp, human
ggggacctgtcgctgtgtgg

SEQ ID NO: 403149 - DNA, 20 bp, human
gtcacagagaccaaggggac

SEQ ID NO: 403150 - DNA, 20 bp, human
ggggtcctgcgccacgccag

SEQ ID NO: 403151 - DNA, 20 bp, human
ggacaaacacagactctcca

SEQ ID NO: 403152 - DNA, 20 bp, human
ggcgccgtcagatcctggga

SEQ ID NO: 403153 - DNA, 20 bp, human
gggtcaggacaggacagcgt

SEQ ID NO: 403154 - DNA, 20 bp, human
gcatgtctgttcattcccct

SEQ ID NO: 403155 - DNA, 20 bp, human
gccttggtctctgtgacagt

SEQ ID NO: 403156 - DNA, 20 bp, human
gccagggtgtggaggaccct

SEQ ID NO: 403157 - DNA, 20 bp, human
gggtctccctgacagtgggt

SEQ ID NO: 403158 - DNA, 20 bp, human
gacctggcctgtggcagacc

SEQ ID NO: 403159 - DNA, 20 bp, human
ggccggccccacccactgtc

SEQ ID NO: 403160 - DNA, 20 bp, human
ggccccacatgtgtgtgggt

SEQ ID NO: 403161 - DNA, 20 bp, human
gccccacccacacacatgtg

SEQ ID NO: 403162 - DNA, 20 bp, human
gcggccctccccggagctga

SEQ ID NO: 403163 - DNA, 20 bp, human
gaccagggcgcagctgaagc

SEQ ID NO: 403164 - DNA, 20 bp, human
gcccgtggtctccctgacag

SEQ ID NO: 403165 - DNA, 20 bp, human
gcagggagaccacggggact

SEQ ID NO: 403166 - DNA, 20 bp, human
gcgggcacaggggaacgcgg

SEQ ID NO: 403167 - DNA, 20 bp, human
gagccaacaggtgcctgaag

SEQ ID NO: 403168 - DNA, 20 bp, human
gcgcatgcgcgaggctgcga

SEQ ID NO: 403169 - DNA, 20 bp, human
gggtcagggaggctgcctat

SEQ ID NO: 403170 - DNA, 20 bp, human
ggactggtggatctaggcgt

SEQ ID NO: 403171 - DNA, 20 bp, human
ggggcgggccctccgaggga

SEQ ID NO: 403172 - DNA, 20 bp, human
gagcctcttcaggcacctgt

SEQ ID NO: 403173 - DNA, 20 bp, human
gcaggcacctgttggcttga

SEQ ID NO: 403174 - DNA, 20 bp, human
ggcggggccggactgggtca

SEQ ID NO: 403175 - DNA, 20 bp, human
ggccgcagatgccatccaat

SEQ ID NO: 403176 - DNA, 20 bp, human
gcccgcccctagccgatgga

SEQ ID NO: 403177 - DNA, 20 bp, human
gcccagccctccatcggcta

SEQ ID NO: 403178 - DNA, 20 bp, human
gggccccagatgtgcgtcca

SEQ ID NO: 403179 - DNA, 20 bp, human
gctggggcccgtggcacctg

SEQ ID NO: 403180 - DNA, 20 bp, human
gacggctcagggcacgagcg

SEQ ID NO: 403181 - DNA, 20 bp, human
ggcacgagcggggaccgcag

SEQ ID NO: 403182 - DNA, 20 bp, human
gagggctgggattggttctc

SEQ ID NO: 403183 - DNA, 20 bp, human
ggctgtgaacagctcgccag

SEQ ID NO: 403184 - DNA, 20 bp, human
gcgggactttctcacctcct

SEQ ID NO: 403185 - DNA, 20 bp, human
gagggaggggcgctcggtcc

SEQ ID NO: 403186 - DNA, 20 bp, human
gccctcgggcgggcgccctg

SEQ ID NO: 403187 - DNA, 20 bp, human
gcgcgcgcggcgctccgagt

SEQ ID NO: 403188 - DNA, 20 bp, human
gcgccggtgccctggcttcg

SEQ ID NO: 403189 - DNA, 20 bp, human
gccgcgagacggactgaagt

SEQ ID NO: 403190 - DNA, 20 bp, human
gcggaggaggcggacccact

SEQ ID NO: 403191 - DNA, 20 bp, human
gctcctcgcccgcgaagcca

SEQ ID NO: 403192 - DNA, 20 bp, human
ggcgcccgcccgagggggct

SEQ ID NO: 403193 - DNA, 20 bp, human
gccgccgcgcagtgcgctcc

SEQ ID NO: 403194 - DNA, 20 bp, human
gggctggaatctcgctgcgc

SEQ ID NO: 403195 - DNA, 20 bp, human
gtccgggtaggagggagcaa

SEQ ID NO: 403196 - DNA, 20 bp, human
ggcgccctgcctggcacaac

SEQ ID NO: 403197 - DNA, 20 bp, human
gggagccttcgccacctgtg

SEQ ID NO: 403198 - DNA, 20 bp, human
ggcagccccacaggtggcga

SEQ ID NO: 403199 - DNA, 20 bp, human
gccagccttgaaacagggtg

SEQ ID NO: 403200 - DNA, 20 bp, human
gtggcgaaggctccgcgaga

SEQ ID NO: 403201 - DNA, 20 bp, human
ggggtcagggaaagctacaa

SEQ ID NO: 403202 - DNA, 20 bp, human
gggaactagccatgttggag

SEQ ID NO: 403203 - DNA, 20 bp, human
gcggagctagcacgctcaga

SEQ ID NO: 403204 - DNA, 20 bp, human
gctgcatccagccttgaaac

SEQ ID NO: 403205 - DNA, 20 bp, human
gtcctccccaccctgtttca

SEQ ID NO: 403206 - DNA, 20 bp, human
gttactgcggaactgtgcct

SEQ ID NO: 403207 - DNA, 20 bp, human
gtgcgcgtgtggttgaggat

SEQ ID NO: 403208 - DNA, 20 bp, human
gtaccccgggacaaatccgg

SEQ ID NO: 403209 - DNA, 20 bp, human
gaaacggcctacagcttctg

SEQ ID NO: 403210 - DNA, 20 bp, human
gttgccgctgtcccaaaacc

SEQ ID NO: 403211 - DNA, 20 bp, human
ggcgcctgcgcgtgtggttg

SEQ ID NO: 403212 - DNA, 20 bp, human
gcgtacagagtcctggatag

SEQ ID NO: 403213 - DNA, 20 bp, human
gctgtgagatactgcatccc

SEQ ID NO: 403214 - DNA, 20 bp, human
gcgggaagcgctcacttacc

SEQ ID NO: 403215 - DNA, 20 bp, human
gcgcccccggatttgtcccg

SEQ ID NO: 403216 - DNA, 20 bp, human
gaacccgcgccctccgaggg

SEQ ID NO: 403217 - DNA, 20 bp, human
gagaaacccgcgccctccga

SEQ ID NO: 403218 - DNA, 20 bp, human
gtcacgggggcaggagaaga

SEQ ID NO: 403219 - DNA, 20 bp, human
ggggacagagggggcgtcac

SEQ ID NO: 403220 - DNA, 20 bp, human
gagccccgccggaggcgacg

SEQ ID NO: 403221 - DNA, 20 bp, human
ggctctgctgcactgcgctg

SEQ ID NO: 403222 - DNA, 20 bp, human
gcagagcgcgatccagtctg

SEQ ID NO: 403223 - DNA, 20 bp, human
gctgtcccctcccccctcgg

SEQ ID NO: 403224 - DNA, 20 bp, human
gctgcgctggggacggcgga

SEQ ID NO: 403225 - DNA, 20 bp, human
ggacccctcttcaggaactc

SEQ ID NO: 403226 - DNA, 20 bp, human
ggacctgcggggccccgccg

SEQ ID NO: 403227 - DNA, 20 bp, human
ggctcggcccggtcccggag

SEQ ID NO: 403228 - DNA, 20 bp, human
gtgggagggccggggacctg

SEQ ID NO: 403229 - DNA, 20 bp, human
gcccgccgcgggtcagagct

SEQ ID NO: 403230 - DNA, 20 bp, human
gcaagcgccatcccgggccc

SEQ ID NO: 403231 - DNA, 20 bp, human
gccatcccgggcccaggcgg

SEQ ID NO: 403232 - DNA, 20 bp, human
gccgctgctcggcccggtcc

SEQ ID NO: 403233 - DNA, 20 bp, human
ggaggcccagctctgacccg

SEQ ID NO: 403234 - DNA, 20 bp, human
gccagcagacgcgcactcga

SEQ ID NO: 403235 - DNA, 20 bp, human
ggcccagctctgacccgcgg

SEQ ID NO: 403236 - DNA, 20 bp, human
gcccaccccgacatgtgctg

SEQ ID NO: 403237 - DNA, 20 bp, human
gtggaagtgcctgtcaccgg

SEQ ID NO: 403238 - DNA, 20 bp, human
gcggttccccagcacatgtc

SEQ ID NO: 403239 - DNA, 20 bp, human
gtccccagcacatgtcgggg

SEQ ID NO: 403240 - DNA, 20 bp, human
gcctgagaggctgatgttgt

SEQ ID NO: 403241 - DNA, 20 bp, human
gaccggaggcagctagagca

SEQ ID NO: 403242 - DNA, 20 bp, human
ggctgcagacagttctgctg

SEQ ID NO: 403243 - DNA, 20 bp, human
gtctagctgcctccggtgac

SEQ ID NO: 403244 - DNA, 20 bp, human
gattacagggattacagcgc

SEQ ID NO: 403245 - DNA, 20 bp, human
gtgttggaagtgcctgtcac

SEQ ID NO: 403246 - DNA, 20 bp, human
ggtgccgggcgcctagggag

SEQ ID NO: 403247 - DNA, 20 bp, human
ggggatgcggggccctcgct

SEQ ID NO: 403248 - DNA, 20 bp, human
ggaggcggcggggccacggt

SEQ ID NO: 403249 - DNA, 20 bp, human
gggcgcagcctgccacgcca

SEQ ID NO: 403250 - DNA, 20 bp, human
gcagcctgccacgccagggg

SEQ ID NO: 403251 - DNA, 20 bp, human
gccggcgtctggcatgggag

SEQ ID NO: 403252 - DNA, 20 bp, human
gcctaggcgcccggcacccg

SEQ ID NO: 403253 - DNA, 20 bp, human
gctcgctcgggccacctcgc

SEQ ID NO: 403254 - DNA, 20 bp, human
gcgggctctgcggggatgcg

SEQ ID NO: 403255 - DNA, 20 bp, human
gccgcctccccggaatccag

SEQ ID NO: 403256 - DNA, 20 bp, human
gtctccgcgtcgttggggcg

SEQ ID NO: 403257 - DNA, 20 bp, human
gccaacgacgcggagaccgg

SEQ ID NO: 403258 - DNA, 20 bp, human
gggctggcggggacggacgc

SEQ ID NO: 403259 - DNA, 20 bp, human
gaccgcccatggggcgtggc

SEQ ID NO: 403260 - DNA, 20 bp, human
gggcggggctggatgcggac

SEQ ID NO: 403261 - DNA, 20 bp, human
gaaaccccgccccaacgacg

SEQ ID NO: 403262 - DNA, 20 bp, human
ggcggccggggaggcggtga

SEQ ID NO: 403263 - DNA, 20 bp, human
gcggacaggctgggcggacg

SEQ ID NO: 403264 - DNA, 20 bp, human
gtgtccctctcatccatcaa

SEQ ID NO: 403265 - DNA, 20 bp, human
gtggatgcggacaggctggg

SEQ ID NO: 403266 - DNA, 20 bp, human
gtcggccggtccaggccctc

SEQ ID NO: 403267 - DNA, 20 bp, human
gtccgcttccgggagcctga

SEQ ID NO: 403268 - DNA, 20 bp, human
gccctcagcggctcccatcg

SEQ ID NO: 403269 - DNA, 20 bp, human
gcccgcgcgcccgcgtgggg

SEQ ID NO: 403270 - DNA, 20 bp, human
gggacatcccagaacacctg

SEQ ID NO: 403271 - DNA, 20 bp, human
gagctcccgggagccgcgat

SEQ ID NO: 403272 - DNA, 20 bp, human
ggggcatgcggacacccact

SEQ ID NO: 403273 - DNA, 20 bp, human
ggcgccaggtgcaagcgctc

SEQ ID NO: 403274 - DNA, 20 bp, human
gacacccactcggccggtcc

SEQ ID NO: 403275 - DNA, 20 bp, human
gcaggagtttcggccctcag

SEQ ID NO: 403276 - DNA, 20 bp, human
gcggactgaaggaaccctgg

SEQ ID NO: 403277 - DNA, 20 bp, human
gggctggagaatccacatca

SEQ ID NO: 403278 - DNA, 20 bp, human
gggacctagccgagagggaa

SEQ ID NO: 403279 - DNA, 20 bp, human
gccgctcaaggggaatcgag

SEQ ID NO: 403280 - DNA, 20 bp, human
gctagccgagagggaagggc

SEQ ID NO: 403281 - DNA, 20 bp, human
gggaagggcaggatgatggc

SEQ ID NO: 403282 - DNA, 20 bp, human
gcaaggggaatcgagagggg

SEQ ID NO: 403283 - DNA, 20 bp, human
gggagagcagggaaggtcgt

SEQ ID NO: 403284 - DNA, 20 bp, human
gcgggcgctgaaaccaggca

SEQ ID NO: 403285 - DNA, 20 bp, human
gtcgtgggacctagccgaga

SEQ ID NO: 403286 - DNA, 20 bp, human
ggcgccgggaaggggaaaat

SEQ ID NO: 403287 - DNA, 20 bp, human
ggctccggaggctgtcccac

SEQ ID NO: 403288 - DNA, 20 bp, human
gccgcaccccggggctccgg

SEQ ID NO: 403289 - DNA, 20 bp, human
gccggggtgcggacgaggtg

SEQ ID NO: 403290 - DNA, 20 bp, human
ggcctcctggacgcgctctc

SEQ ID NO: 403291 - DNA, 20 bp, human
ggggcggcgcacgtgcggac

SEQ ID NO: 403292 - DNA, 20 bp, human
ggaggtgggtcccgcacctc

SEQ ID NO: 403293 - DNA, 20 bp, human
gtcccgagagcgcgtccagg

SEQ ID NO: 403294 - DNA, 20 bp, human
gggctcccgagagcgcgtcc

SEQ ID NO: 403295 - DNA, 20 bp, human
gagaaggtcagcgaaactgg

SEQ ID NO: 403296 - DNA, 20 bp, human
gggcggggctccgacgggat

SEQ ID NO: 403297 - DNA, 20 bp, human
ggaggctcctcccatcccgt

SEQ ID NO: 403298 - DNA, 20 bp, human
gcccacgcggcgagttgatc

SEQ ID NO: 403299 - DNA, 20 bp, human
ggccaacggaccagcagtgg

SEQ ID NO: 403300 - DNA, 20 bp, human
gtggagcccggataacgccg

SEQ ID NO: 403301 - DNA, 20 bp, human
gggaggcgctcggaatcccg

SEQ ID NO: 403302 - DNA, 20 bp, human
gggcgagcgctcagactctc

SEQ ID NO: 403303 - DNA, 20 bp, human
gagggaacggccggcccacg

SEQ ID NO: 403304 - DNA, 20 bp, human
ggggcgggtcaatcactccg

SEQ ID NO: 403305 - DNA, 20 bp, human
gggggcggctgtggggagta

SEQ ID NO: 403306 - DNA, 20 bp, human
gagggccaggctgaacccgg

SEQ ID NO: 403307 - DNA, 20 bp, human
gagaaggtgtacatcgtgca

SEQ ID NO: 403308 - DNA, 20 bp, human
gagatgacgtgcggctcgtg

SEQ ID NO: 403309 - DNA, 20 bp, human
gacgtgggggcgcggtccag

SEQ ID NO: 403310 - DNA, 20 bp, human
ggggggcgcggtccagagga

SEQ ID NO: 403311 - DNA, 20 bp, human
gtacagcagcggcgttgggt

SEQ ID NO: 403312 - DNA, 20 bp, human
ggtggggcagctcggcagca

SEQ ID NO: 403313 - DNA, 20 bp, human
gctcctcactggcaaaccca

SEQ ID NO: 403314 - DNA, 20 bp, human
gtgcggctcgtggggcagct

SEQ ID NO: 403315 - DNA, 20 bp, human
gtagctacagcagcggcgtt

SEQ ID NO: 403316 - DNA, 20 bp, human
ggtccccaggctggctgcga

SEQ ID NO: 403317 - DNA, 20 bp, human
gcccggccacggaggtcccc

SEQ ID NO: 403318 - DNA, 20 bp, human
gttccggcggaagtgtgcga

SEQ ID NO: 403319 - DNA, 20 bp, human
gtcagcacggcgcccctgag

SEQ ID NO: 403320 - DNA, 20 bp, human
gggccctcgcacacttccgc

SEQ ID NO: 403321 - DNA, 20 bp, human
gcgtggccgggtgtaaccgc

SEQ ID NO: 403322 - DNA, 20 bp, human
gctgaggggctgacttccgg

SEQ ID NO: 403323 - DNA, 20 bp, human
gagcccagcggctggcggta

SEQ ID NO: 403324 - DNA, 20 bp, human
gaagtgtgcgagggccgccg

SEQ ID NO: 403325 - DNA, 20 bp, human
gactccagccccgcaacccg

SEQ ID NO: 403326 - DNA, 20 bp, human
gagcgcgcacgtaaggccgt

SEQ ID NO: 403327 - DNA, 20 bp, human
ggtcgcgcgagcccggacta

SEQ ID NO: 403328 - DNA, 20 bp, human
gagggagccaatgggaacgc

SEQ ID NO: 403329 - DNA, 20 bp, human
gacaactaagagacaaggat

SEQ ID NO: 403330 - DNA, 20 bp, human
ggtaccacctcagtaggaga

SEQ ID NO: 403331 - DNA, 20 bp, human
ggcacgccccagatcggagt

SEQ ID NO: 403332 - DNA, 20 bp, human
ggtaaggccgtggggttgcg

SEQ ID NO: 403333 - DNA, 20 bp, human
gccaccccgactccgatctg

SEQ ID NO: 403334 - DNA, 20 bp, human
gcggggacaactaagagaca

SEQ ID NO: 403335 - DNA, 20 bp, human
ggacccggcactgagggcaa

SEQ ID NO: 403336 - DNA, 20 bp, human
ggcgacgaacaaccaggaag

SEQ ID NO: 403337 - DNA, 20 bp, human
ggattcccagaacacgaagg

SEQ ID NO: 403338 - DNA, 20 bp, human
gagagcagaacggagaaccg

SEQ ID NO: 403339 - DNA, 20 bp, human
gtggggggaggcactaattg

SEQ ID NO: 403340 - DNA, 20 bp, human
gtcagggaaagggcctcgag

SEQ ID NO: 403341 - DNA, 20 bp, human
gctctcgggggcaccttccg

SEQ ID NO: 403342 - DNA, 20 bp, human
gtccggagggaggtttgagg

SEQ ID NO: 403343 - DNA, 20 bp, human
ggccttgtagcgtgtggatc

SEQ ID NO: 403344 - DNA, 20 bp, human
ggaacaaccaggaagcggct

SEQ ID NO: 403345 - DNA, 20 bp, human
ggtaacagagactgcgcagg

SEQ ID NO: 403346 - DNA, 20 bp, human
gcggagaggggcgctcgagg

SEQ ID NO: 403347 - DNA, 20 bp, human
gcgcgcagctctcgcggaga

SEQ ID NO: 403348 - DNA, 20 bp, human
ggggcgctcgaggcggtttg

SEQ ID NO: 403349 - DNA, 20 bp, human
ggaggtcagtgacgtcacgc

SEQ ID NO: 403350 - DNA, 20 bp, human
gggagaaaggataggggcta

SEQ ID NO: 403351 - DNA, 20 bp, human
ggcggtttgaggggacccgg

SEQ ID NO: 403352 - DNA, 20 bp, human
gtcgcggagaggggcgctcg

SEQ ID NO: 403353 - DNA, 20 bp, human
ggggtccaagccacgccgtt

SEQ ID NO: 403354 - DNA, 20 bp, human
gacctcgtcgggttcacttc

SEQ ID NO: 403355 - DNA, 20 bp, human
gatgccgccaaactgaagtc

SEQ ID NO: 403356 - DNA, 20 bp, human
gcgggcggggcgagttgatg

SEQ ID NO: 403357 - DNA, 20 bp, human
gagcccagtggcccgaggga

SEQ ID NO: 403358 - DNA, 20 bp, human
gaggtcccgcgaaccggtgg

SEQ ID NO: 403359 - DNA, 20 bp, human
gggttcgcgggaccttcgga

SEQ ID NO: 403360 - DNA, 20 bp, human
gagcgcccggtccaccttaa

SEQ ID NO: 403361 - DNA, 20 bp, human
gcgaaccggtggcggtcccc

SEQ ID NO: 403362 - DNA, 20 bp, human
ggggcgagttgatggggccc

SEQ ID NO: 403363 - DNA, 20 bp, human
gccgccgccgcccgtggggt

SEQ ID NO: 403364 - DNA, 20 bp, human
ggtggtgggcaccacggcga

SEQ ID NO: 403365 - DNA, 20 bp, human
gccccctcgtgaattccaag

SEQ ID NO: 403366 - DNA, 20 bp, human
gaggccgatcggccaataga

SEQ ID NO: 403367 - DNA, 20 bp, human
gcggaggcgccgaggccgat

SEQ ID NO: 403368 - DNA, 20 bp, human
gtggcgttaggcaaaaccaa

SEQ ID NO: 403369 - DNA, 20 bp, human
gtggcagttcgggatagggg

SEQ ID NO: 403370 - DNA, 20 bp, human
ggggcggaggcatcgtcgag

SEQ ID NO: 403371 - DNA, 20 bp, human
gcaatggcagttcgggatag

SEQ ID NO: 403372 - DNA, 20 bp, human
ggcaaaaccaatggcagttc

SEQ ID NO: 403373 - DNA, 20 bp, human
gggagcgacctggtgacgtg

SEQ ID NO: 403374 - DNA, 20 bp, human
ggtagttgctcgccctctat

SEQ ID NO: 403375 - DNA, 20 bp, human
gagcaactactggagcgacc

SEQ ID NO: 403376 - DNA, 20 bp, human
gcgcccggtccctagcaaca

SEQ ID NO: 403377 - DNA, 20 bp, human
gggccggaaccttgttgcta

SEQ ID NO: 403378 - DNA, 20 bp, human
ggtccctagcaacaaggttc

SEQ ID NO: 403379 - DNA, 20 bp, human
ggacgcggtcagaaaggcga

SEQ ID NO: 403380 - DNA, 20 bp, human
gcggatgccgggaaaccgta

SEQ ID NO: 403381 - DNA, 20 bp, human
ggcgagagcctctaggtgta

SEQ ID NO: 403382 - DNA, 20 bp, human
ggagcctctaggtgtaagga

SEQ ID NO: 403383 - DNA, 20 bp, human
ggagtgtcgtaaaccaggtg

SEQ ID NO: 403384 - DNA, 20 bp, human
gcgtagggacgcggtcagaa

SEQ ID NO: 403385 - DNA, 20 bp, human
gcgagggaaaagttttcctc

SEQ ID NO: 403386 - DNA, 20 bp, human
gcggaccgaggggctcgctt

SEQ ID NO: 403387 - DNA, 20 bp, human
gagaaagggagcccaggcgc

SEQ ID NO: 403388 - DNA, 20 bp, human
gctgcagcgtcgagaaaacg

SEQ ID NO: 403389 - DNA, 20 bp, human
ggcaataaatgcgtctataa

SEQ ID NO: 403390 - DNA, 20 bp, human
gatacaaacaggtaccgggg

SEQ ID NO: 403391 - DNA, 20 bp, human
ggacagttcctgtggcgaga

SEQ ID NO: 403392 - DNA, 20 bp, human
gcaaccaccaccacatgttc

SEQ ID NO: 403393 - DNA, 20 bp, human
gtctgctgattgttattgtc

SEQ ID NO: 403394 - DNA, 20 bp, human
gggaaccaaagcgagcccct

SEQ ID NO: 403395 - DNA, 20 bp, human
gccgcagcccaggctatata

SEQ ID NO: 403396 - DNA, 20 bp, human
gataggtggcgcgtgtttca

SEQ ID NO: 403397 - DNA, 20 bp, human
gaacacgtcagtccgtcccc

SEQ ID NO: 403398 - DNA, 20 bp, human
gttctctctgggaaaggatc

SEQ ID NO: 403399 - DNA, 20 bp, human
gccacctatctttgtgggga

SEQ ID NO: 403400 - DNA, 20 bp, human
gatgccaaaggcttgacggg

SEQ ID NO: 403401 - DNA, 20 bp, human
gacgcgccacctatctttgt

SEQ ID NO: 403402 - DNA, 20 bp, human
gggaggcgaaggcgaaaggg

SEQ ID NO: 403403 - DNA, 20 bp, human
gaaggcttgacgggcgggga

SEQ ID NO: 403404 - DNA, 20 bp, human
gtgatcgccaagtttctctc

SEQ ID NO: 403405 - DNA, 20 bp, human
gatgatgccaaaggcttgac

SEQ ID NO: 403406 - DNA, 20 bp, human
ggcccccggctcgggaactt

SEQ ID NO: 403407 - DNA, 20 bp, human
gggggctgaggacttttcga

SEQ ID NO: 403408 - DNA, 20 bp, human
gtatgagggaatgcacacgg

SEQ ID NO: 403409 - DNA, 20 bp, human
gagtaagaccgcttgactca

SEQ ID NO: 403410 - DNA, 20 bp, human
ggaggacttttcgaaggaaa

SEQ ID NO: 403411 - DNA, 20 bp, human
gataactcctgaccgtatga

SEQ ID NO: 403412 - DNA, 20 bp, human
gcaccccaagttcccgagcc

SEQ ID NO: 403413 - DNA, 20 bp, human
gcgcttgactcagggctagg

SEQ ID NO: 403414 - DNA, 20 bp, human
gcccctggatgaagcacact

SEQ ID NO: 403415 - DNA, 20 bp, human
gtgcattccctcatacggtc

SEQ ID NO: 403416 - DNA, 20 bp, human
gctccgaggggcctgttcgt

SEQ ID NO: 403417 - DNA, 20 bp, human
gcgggcccggcacgttacgc

SEQ ID NO: 403418 - DNA, 20 bp, human
gtccaccggcgtaacgtgcc

SEQ ID NO: 403419 - DNA, 20 bp, human
gccggggcgcgtcacttccg

SEQ ID NO: 403420 - DNA, 20 bp, human
gtagccgcgggacgggtcgg

SEQ ID NO: 403421 - DNA, 20 bp, human
gggcgggcggctcctttccc

SEQ ID NO: 403422 - DNA, 20 bp, human
ggcccggcacgttacgccgg

SEQ ID NO: 403423 - DNA, 20 bp, human
gaatgacgcgttctctcggg

SEQ ID NO: 403424 - DNA, 20 bp, human
gctgaatgacgcgttctctc

SEQ ID NO: 403425 - DNA, 20 bp, human
ggcctggggggggcatcccg

SEQ ID NO: 403426 - DNA, 20 bp, human
gaggcggagtctacaggtgg

SEQ ID NO: 403427 - DNA, 20 bp, human
ggttctgtgagtgttcttct

SEQ ID NO: 403428 - DNA, 20 bp, human
gcagctgtgcgatttgtcct

SEQ ID NO: 403429 - DNA, 20 bp, human
gaagaacactcacagaacag

SEQ ID NO: 403430 - DNA, 20 bp, human
gggtccgccactctcccgtc

SEQ ID NO: 403431 - DNA, 20 bp, human
gcagaggcggagtctacagg

SEQ ID NO: 403432 - DNA, 20 bp, human
ggcaggtgggtatttcttta

SEQ ID NO: 403433 - DNA, 20 bp, human
ggcggcgcctgacgggagag

SEQ ID NO: 403434 - DNA, 20 bp, human
gcggagtctacaggtggggg

SEQ ID NO: 403435 - DNA, 20 bp, human
gaggtgcattcgccgtgacc

SEQ ID NO: 403436 - DNA, 20 bp, human
gtcctctcggggacccagac

SEQ ID NO: 403437 - DNA, 20 bp, human
gtgagcaaggcagtcctctc

SEQ ID NO: 403438 - DNA, 20 bp, human
ggggacccagaccggaaagg

SEQ ID NO: 403439 - DNA, 20 bp, human
gtcggggacccagaccggaa

SEQ ID NO: 403440 - DNA, 20 bp, human
gcccaggagggccgcctttc

SEQ ID NO: 403441 - DNA, 20 bp, human
ggggcctctcgggagctccc

SEQ ID NO: 403442 - DNA, 20 bp, human
gacaggtgacacacactcca

SEQ ID NO: 403443 - DNA, 20 bp, human
gccgcccagccgctgtgcag

SEQ ID NO: 403444 - DNA, 20 bp, human
gcagccgctgtgcagcgggg

SEQ ID NO: 403445 - DNA, 20 bp, human
ggggaatcaacaagtcgtcc

SEQ ID NO: 403446 - DNA, 20 bp, human
ggagcggggaagctgactca

SEQ ID NO: 403447 - DNA, 20 bp, human
gtggagaagcgaggagtggg

SEQ ID NO: 403448 - DNA, 20 bp, human
ggacacttcgagaagggaag

SEQ ID NO: 403449 - DNA, 20 bp, human
gaagtggagaagcgaggagt

SEQ ID NO: 403450 - DNA, 20 bp, human
ggccgcctgcgagaagcgac

SEQ ID NO: 403451 - DNA, 20 bp, human
gcgcttgctgggtcacagtg

SEQ ID NO: 403452 - DNA, 20 bp, human
ggcgaccggacacttcgaga

SEQ ID NO: 403453 - DNA, 20 bp, human
gggcgcgcccggaaacccca

SEQ ID NO: 403454 - DNA, 20 bp, human
gctgcggccggggtcctgcg

SEQ ID NO: 403455 - DNA, 20 bp, human
gcgcgaggccggcctgaggg

SEQ ID NO: 403456 - DNA, 20 bp, human
gttgctctagaaggctgagt

SEQ ID NO: 403457 - DNA, 20 bp, human
ggcgagagggtgttgatgcg

SEQ ID NO: 403458 - DNA, 20 bp, human
ggagtcggaagactgtcccg

SEQ ID NO: 403459 - DNA, 20 bp, human
gcgcagaggaaggccagcga

SEQ ID NO: 403460 - DNA, 20 bp, human
gaaggcaaagacggatatct

SEQ ID NO: 403461 - DNA, 20 bp, human
ggcggggcggggctcaaccg

SEQ ID NO: 403462 - DNA, 20 bp, human
ggcgctgacgtcatcccgca

SEQ ID NO: 403463 - DNA, 20 bp, human
gaagactgtcccgaggcgag

SEQ ID NO: 403464 - DNA, 20 bp, human
gggcgtagctccgcagagga

SEQ ID NO: 403465 - DNA, 20 bp, human
gcgcgggcgtagctccgcag

SEQ ID NO: 403466 - DNA, 20 bp, human
gaccgcacaggacatctctc

SEQ ID NO: 403467 - DNA, 20 bp, human
ggggacacagacgccctcgg

SEQ ID NO: 403468 - DNA, 20 bp, human
gagggcccggggcttcagag

SEQ ID NO: 403469 - DNA, 20 bp, human
gcagcgcagcctccggggga

SEQ ID NO: 403470 - DNA, 20 bp, human
ggggcggagcggccattgtc

SEQ ID NO: 403471 - DNA, 20 bp, human
gcggcggtgagacccgccga

SEQ ID NO: 403472 - DNA, 20 bp, human
gccggatcccagctgatcag

SEQ ID NO: 403473 - DNA, 20 bp, human
ggcggacgcaccgaggaccg

SEQ ID NO: 403474 - DNA, 20 bp, human
gggagggacacagacgccct

SEQ ID NO: 403475 - DNA, 20 bp, human
gtcggcctgcggagacgggg

SEQ ID NO: 403476 - DNA, 20 bp, human
gcctggcccccggacgtggg

SEQ ID NO: 403477 - DNA, 20 bp, human
gcggcaaccgcccacgtccg

SEQ ID NO: 403478 - DNA, 20 bp, human
gcaggcctggcccccggacg

SEQ ID NO: 403479 - DNA, 20 bp, human
gggtaggtggtgtcacaaag

SEQ ID NO: 403480 - DNA, 20 bp, human
gggctcgctcgcccgcctac

SEQ ID NO: 403481 - DNA, 20 bp, human
gccccgcccgcgctgattgg

SEQ ID NO: 403482 - DNA, 20 bp, human
gagccagcggacaagactgc

SEQ ID NO: 403483 - DNA, 20 bp, human
gggccctgtcgacctgtagg

SEQ ID NO: 403484 - DNA, 20 bp, human
gggcggcagcggagcgttgt

SEQ ID NO: 403485 - DNA, 20 bp, human
gccgtccagcgattggtagg

SEQ ID NO: 403486 - DNA, 20 bp, human
gtcagtaggtccaggaggcg

SEQ ID NO: 403487 - DNA, 20 bp, human
gcccccggtgccctgtcagt

SEQ ID NO: 403488 - DNA, 20 bp, human
ggcctggcagtcggccccta

SEQ ID NO: 403489 - DNA, 20 bp, human
gcctcctggacctactgaca

SEQ ID NO: 403490 - DNA, 20 bp, human
ggggcggcgagtgcgttagt

SEQ ID NO: 403491 - DNA, 20 bp, human
gctgggaagagcgagtcctg

SEQ ID NO: 403492 - DNA, 20 bp, human
gggaagagcgagtcctgtgg

SEQ ID NO: 403493 - DNA, 20 bp, human
gtcagcgaaaaccccggcgg

SEQ ID NO: 403494 - DNA, 20 bp, human
gcggcccctagggtggagct

SEQ ID NO: 403495 - DNA, 20 bp, human
ggggttgctgtgccttctcg

SEQ ID NO: 403496 - DNA, 20 bp, human
ggcgggaagcgccccagaga

SEQ ID NO: 403497 - DNA, 20 bp, human
gcccgcccgctaattattac

SEQ ID NO: 403498 - DNA, 20 bp, human
gggagcgcacggcaattggc

SEQ ID NO: 403499 - DNA, 20 bp, human
gcgcgccggtaataattagc

SEQ ID NO: 403500 - DNA, 20 bp, human
gcggaggagagccactggat

SEQ ID NO: 403501 - DNA, 20 bp, human
ggggacactggaggtgcaga

SEQ ID NO: 403502 - DNA, 20 bp, human
ggcgcacggcaattggccgg

SEQ ID NO: 403503 - DNA, 20 bp, human
ggctcggagcgcacggcaat

SEQ ID NO: 403504 - DNA, 20 bp, human
gcgggagccggccaatccag

SEQ ID NO: 403505 - DNA, 20 bp, human
gacggcaattggccggaggc

SEQ ID NO: 403506 - DNA, 20 bp, human
ggaggggccctcgggaggtc

SEQ ID NO: 403507 - DNA, 20 bp, human
ggcagcggaatccgtgaagt

SEQ ID NO: 403508 - DNA, 20 bp, human
gggcgtgcaaggagagttct

SEQ ID NO: 403509 - DNA, 20 bp, human
gcgcgcatgctcgcagtcgg

SEQ ID NO: 403510 - DNA, 20 bp, human
gttgagccacgcccagggag

SEQ ID NO: 403511 - DNA, 20 bp, human
gcccacatgccgcgggtcta

SEQ ID NO: 403512 - DNA, 20 bp, human
gcgccgagcgcggcccggca

SEQ ID NO: 403513 - DNA, 20 bp, human
gcaggcgtctgcgccccgtg

SEQ ID NO: 403514 - DNA, 20 bp, human
gctgggcgtggctcaaaacg

SEQ ID NO: 403515 - DNA, 20 bp, human
gccgcgctccggacctcccg

SEQ ID NO: 403516 - DNA, 20 bp, human
gagaccaaccagcactccga

SEQ ID NO: 403517 - DNA, 20 bp, human
gaccccctcggagtgctggt

SEQ ID NO: 403518 - DNA, 20 bp, human
gggctcccagagacctagga

SEQ ID NO: 403519 - DNA, 20 bp, human
ggccctgcccaggtgggaca

SEQ ID NO: 403520 - DNA, 20 bp, human
gccgccacagaggctctgat

SEQ ID NO: 403521 - DNA, 20 bp, human
gagcccgctccagtcccagg

SEQ ID NO: 403522 - DNA, 20 bp, human
ggtgccagccagggataact

SEQ ID NO: 403523 - DNA, 20 bp, human
ggggcatcctgccgccacag

SEQ ID NO: 403524 - DNA, 20 bp, human
gcagccagggataactagga

SEQ ID NO: 403525 - DNA, 20 bp, human
gggtgtcatgtgctcattct

SEQ ID NO: 403526 - DNA, 20 bp, human
ggtgggtgtgaccctaggac

SEQ ID NO: 403527 - DNA, 20 bp, human
gtcacacccaccgcagggtc

SEQ ID NO: 403528 - DNA, 20 bp, human
gggtctggcttggtacagtt

SEQ ID NO: 403529 - DNA, 20 bp, human
gtagggtcacacccaccgca

SEQ ID NO: 403530 - DNA, 20 bp, human
gtgcgacacgcaggaaacaa

SEQ ID NO: 403531 - DNA, 20 bp, human
ggagaaagggactctggtag

SEQ ID NO: 403532 - DNA, 20 bp, human
gggaagaaggggtgtgtatg

SEQ ID NO: 403533 - DNA, 20 bp, human
gtcgcaggaagtgacgtttc

SEQ ID NO: 403534 - DNA, 20 bp, human
ggggtgcatgcagaagtagg

SEQ ID NO: 403535 - DNA, 20 bp, human
ggtagtctttcgtctttctt

SEQ ID NO: 403536 - DNA, 20 bp, human
gtcgcgggacccagggccgg

SEQ ID NO: 403537 - DNA, 20 bp, human
gcgcctgcctcgcgggaccc

SEQ ID NO: 403538 - DNA, 20 bp, human
ggccctgggtcccgcgaggc

SEQ ID NO: 403539 - DNA, 20 bp, human
ggcaggccggccagcccacc

SEQ ID NO: 403540 - DNA, 20 bp, human
gagcccaccaggtcgcctcc

SEQ ID NO: 403541 - DNA, 20 bp, human
gcggggctgccccactgagc

SEQ ID NO: 403542 - DNA, 20 bp, human
ggaacctggaggcgacctgg

SEQ ID NO: 403543 - DNA, 20 bp, human
gcaagccggtgcctgcaaag

SEQ ID NO: 403544 - DNA, 20 bp, human
gccggcctgcccccggccct

SEQ ID NO: 403545 - DNA, 20 bp, human
gggcaccggcttgaacctgg

SEQ ID NO: 403546 - DNA, 20 bp, human
gccgtgcggggccaacaatg

SEQ ID NO: 403547 - DNA, 20 bp, human
gccgaggcgcggatgcatga

SEQ ID NO: 403548 - DNA, 20 bp, human
gggtacaggtctcatgcctg

SEQ ID NO: 403549 - DNA, 20 bp, human
gacacgcgctatgtaatggg

SEQ ID NO: 403550 - DNA, 20 bp, human
gggaaagggcaggtcctccc

SEQ ID NO: 403551 - DNA, 20 bp, human
ggagacacgcgctatgtaat

SEQ ID NO: 403552 - DNA, 20 bp, human
gctcgcgggacccacagagg

SEQ ID NO: 403553 - DNA, 20 bp, human
gcctcgcgagtgtatggcgt

SEQ ID NO: 403554 - DNA, 20 bp, human
ggtcccgcgaggagactctc

SEQ ID NO: 403555 - DNA, 20 bp, human
ggggacccacagagggggaa

SEQ ID NO: 403556 - DNA, 20 bp, human
gtacccaggcacgacgggaa

SEQ ID NO: 403557 - DNA, 20 bp, human
ggggagaagagcctagaaga

SEQ ID NO: 403558 - DNA, 20 bp, human
gagcccttcccgtcgtgcct

SEQ ID NO: 403559 - DNA, 20 bp, human
ggggctaattagccaccttc

SEQ ID NO: 403560 - DNA, 20 bp, human
gaggagcaacaataggaacc

SEQ ID NO: 403561 - DNA, 20 bp, human
gcttcattacccaggcacga

SEQ ID NO: 403562 - DNA, 20 bp, human
ggcacacacacaccgagaag

SEQ ID NO: 403563 - DNA, 20 bp, human
gcaaagaatgggggcattag

SEQ ID NO: 403564 - DNA, 20 bp, human
gaatgggggcattagtggag

SEQ ID NO: 403565 - DNA, 20 bp, human
gaatcacagccattttttgc

SEQ ID NO: 403566 - DNA, 20 bp, human
ggccccggatgcggcgaccg

SEQ ID NO: 403567 - DNA, 20 bp, human
gtccgcggtcgccgcatccg

SEQ ID NO: 403568 - DNA, 20 bp, human
gcgtagggtgcgagacccgg

SEQ ID NO: 403569 - DNA, 20 bp, human
ggtcgcgcgcaggggcgcgt

SEQ ID NO: 403570 - DNA, 20 bp, human
gcattcccagagtgcatatc

SEQ ID NO: 403571 - DNA, 20 bp, human
gtccaaagctcccagcgctg

SEQ ID NO: 403572 - DNA, 20 bp, human
ggagagaggtgtaattagtg

SEQ ID NO: 403573 - DNA, 20 bp, human
ggcgcgtagggtgcgagacc

SEQ ID NO: 403574 - DNA, 20 bp, human
ggcgcgtcatttgcagtctg

SEQ ID NO: 403575 - DNA, 20 bp, human
ggagcagctccggagcctca

SEQ ID NO: 403576 - DNA, 20 bp, human
gcgcggctttagggactctc

SEQ ID NO: 403577 - DNA, 20 bp, human
gaagtcttcgccttgttagg

SEQ ID NO: 403578 - DNA, 20 bp, human
ggggtggaccatccacgttc

SEQ ID NO: 403579 - DNA, 20 bp, human
gccgcggccccggaggcttg

SEQ ID NO: 403580 - DNA, 20 bp, human
gctccggggccgcggcttta

SEQ ID NO: 403581 - DNA, 20 bp, human
ggtccctaaagccgcggccc

SEQ ID NO: 403582 - DNA, 20 bp, human
gggaaatgtagtcccgaacg

SEQ ID NO: 403583 - DNA, 20 bp, human
gtggatggtccacccctccg

SEQ ID NO: 403584 - DNA, 20 bp, human
ggttcccagggtcctcggag

SEQ ID NO: 403585 - DNA, 20 bp, human
gtgcacatgcgcagaaacag

SEQ ID NO: 403586 - DNA, 20 bp, human
gaaggccctccgcgctgcgt

SEQ ID NO: 403587 - DNA, 20 bp, human
gcggagccccgggtgcgctc

SEQ ID NO: 403588 - DNA, 20 bp, human
gcactccgcgcagcccgttg

SEQ ID NO: 403589 - DNA, 20 bp, human
ggggaaatgtagtccgccga

SEQ ID NO: 403590 - DNA, 20 bp, human
gcccgccccgagcgcacccg

SEQ ID NO: 403591 - DNA, 20 bp, human
gtggaaccagtccctcccat

SEQ ID NO: 403592 - DNA, 20 bp, human
gaaccagtccctcccatcgg

SEQ ID NO: 403593 - DNA, 20 bp, human
ggactggttccagccccaac

SEQ ID NO: 403594 - DNA, 20 bp, human
gccgcgcagcccgttggggc

SEQ ID NO: 403595 - DNA, 20 bp, human
gatgtagtccgccgatggga

SEQ ID NO: 403596 - DNA, 20 bp, human
gaacggggccccagagggca

SEQ ID NO: 403597 - DNA, 20 bp, human
gcccaggcggccccttaccc

SEQ ID NO: 403598 - DNA, 20 bp, human
gacgactttagccggggtaa

SEQ ID NO: 403599 - DNA, 20 bp, human
gcctgcagaggccacaccgt

SEQ ID NO: 403600 - DNA, 20 bp, human
gccggctaaagtcgtctctc

SEQ ID NO: 403601 - DNA, 20 bp, human
gtaaagtcgtctctctggcc

SEQ ID NO: 403602 - DNA, 20 bp, human
gggtgtgtccaggcgggacg

SEQ ID NO: 403603 - DNA, 20 bp, human
ggcaggtcatcggtgtgtcc

SEQ ID NO: 403604 - DNA, 20 bp, human
gcgtcggcgtgtgcgagaac

SEQ ID NO: 403605 - DNA, 20 bp, human
gtgcgagaacggggccccag

SEQ ID NO: 403606 - DNA, 20 bp, human
ggggaagcgtagtcccaagc

SEQ ID NO: 403607 - DNA, 20 bp, human
gaggcagcgccgccggaacc

SEQ ID NO: 403608 - DNA, 20 bp, human
gaggccacgcccggttccgg

SEQ ID NO: 403609 - DNA, 20 bp, human
gcaagcagggacggatgcgg

SEQ ID NO: 403610 - DNA, 20 bp, human
gtcccaagcagggacggatg

SEQ ID NO: 403611 - DNA, 20 bp, human
gcaggggtgtgggtctgtga

SEQ ID NO: 403612 - DNA, 20 bp, human
gcctcggcgcaatgcccgct

SEQ ID NO: 403613 - DNA, 20 bp, human
gctgcctgcgcactggaagt

SEQ ID NO: 403614 - DNA, 20 bp, human
gccgaggccacgcccggttc

SEQ ID NO: 403615 - DNA, 20 bp, human
ggcgtagtcccaagcaggga

SEQ ID NO: 403616 - DNA, 20 bp, human
gcggcggcgacgtggaactt

SEQ ID NO: 403617 - DNA, 20 bp, human
gcgacgtggaacttgggcta

SEQ ID NO: 403618 - DNA, 20 bp, human
gtccccgcgggaatgcgaag

SEQ ID NO: 403619 - DNA, 20 bp, human
ggggctgaagtgggcatcga

SEQ ID NO: 403620 - DNA, 20 bp, human
gggcgcgcgtcgcactccgc

SEQ ID NO: 403621 - DNA, 20 bp, human
gggaacaggtctctcctcgg

SEQ ID NO: 403622 - DNA, 20 bp, human
gtgcttggggagcgacacga

SEQ ID NO: 403623 - DNA, 20 bp, human
gggaaaaggcaagggggcgt

SEQ ID NO: 403624 - DNA, 20 bp, human
gcaggtcgtcaatgattccg

SEQ ID NO: 403625 - DNA, 20 bp, human
gggcgcagagcggcagatcg

SEQ ID NO: 403626 - DNA, 20 bp, human
gcggggagacggagccagag

SEQ ID NO: 403627 - DNA, 20 bp, human
ggggtctcggcggggatagt

SEQ ID NO: 403628 - DNA, 20 bp, human
gggcggggatagtcgggccg

SEQ ID NO: 403629 - DNA, 20 bp, human
gtcggctcggagacaggcgg

SEQ ID NO: 403630 - DNA, 20 bp, human
gcctgaggcgagggacactg

SEQ ID NO: 403631 - DNA, 20 bp, human
ggtggggccgggtctcggcg

SEQ ID NO: 403632 - DNA, 20 bp, human
gagtcagcggcgccagaata

SEQ ID NO: 403633 - DNA, 20 bp, human
ggcactggtcagtcacgggg

SEQ ID NO: 403634 - DNA, 20 bp, human
ggggcggccattacaggtag

SEQ ID NO: 403635 - DNA, 20 bp, human
gaggtagaggcctgaggcga

SEQ ID NO: 403636 - DNA, 20 bp, human
gaccgagcggggaatgcgtg

SEQ ID NO: 403637 - DNA, 20 bp, human
ggcggaagggaaccagtcca

SEQ ID NO: 403638 - DNA, 20 bp, human
gctgtccaccggccaagctc

SEQ ID NO: 403639 - DNA, 20 bp, human
gaaactgcaagcacggggcg

SEQ ID NO: 403640 - DNA, 20 bp, human
ggacaagagcagaagcccga

SEQ ID NO: 403641 - DNA, 20 bp, human
ggggcaggaggggcgcttcc

SEQ ID NO: 403642 - DNA, 20 bp, human
gggacagccgtgaccgagcg

SEQ ID NO: 403643 - DNA, 20 bp, human
gagcggggaatgcgtgggga

SEQ ID NO: 403644 - DNA, 20 bp, human
gggcggggagagacgcagag

SEQ ID NO: 403645 - DNA, 20 bp, human
ggccagccaggctgcgccgg

SEQ ID NO: 403646 - DNA, 20 bp, human
gttcaggcgccccctctccg

SEQ ID NO: 403647 - DNA, 20 bp, human
gcttccctacccggcgcttc

SEQ ID NO: 403648 - DNA, 20 bp, human
gcccgcgcggccccggagag

SEQ ID NO: 403649 - DNA, 20 bp, human
gttgaatcagccatgcggtc

SEQ ID NO: 403650 - DNA, 20 bp, human
gccctccccgcctgaccgca

SEQ ID NO: 403651 - DNA, 20 bp, human
gacgtcacagccgcgctctg

SEQ ID NO: 403652 - DNA, 20 bp, human
ggcgcctgaagcgccgggta

SEQ ID NO: 403653 - DNA, 20 bp, human
ggccatgcggtcaggcgggg

SEQ ID NO: 403654 - DNA, 20 bp, human
gctctgaggctgacaaagga

SEQ ID NO: 403655 - DNA, 20 bp, human
gaatcagccatgcggtcagg

SEQ ID NO: 403656 - DNA, 20 bp, human
gggtggtggggtgggatgtt

SEQ ID NO: 403657 - DNA, 20 bp, human
gtgggccgcaggaccccaga

SEQ ID NO: 403658 - DNA, 20 bp, human
gctggagcgcgtcccttcgt

SEQ ID NO: 403659 - DNA, 20 bp, human
ggggccgcccctccccacga

SEQ ID NO: 403660 - DNA, 20 bp, human
gaaagtcttcggagtgaagg

SEQ ID NO: 403661 - DNA, 20 bp, human
gagcgcgtcccttcgtgggg

SEQ ID NO: 403662 - DNA, 20 bp, human
gtgcgggtgtacgtattcat

SEQ ID NO: 403663 - DNA, 20 bp, human
gggacgcgctccaggcgaat

SEQ ID NO: 403664 - DNA, 20 bp, human
gctgccttgaggtgcgcctg

SEQ ID NO: 403665 - DNA, 20 bp, human
ggtgcgcctggggtccagat

SEQ ID NO: 403666 - DNA, 20 bp, human
gaggcacggctgttctcctc

SEQ ID NO: 403667 - DNA, 20 bp, human
gcgagagctacacgccacac

SEQ ID NO: 403668 - DNA, 20 bp, human
gcacccggcggcatccactg

SEQ ID NO: 403669 - DNA, 20 bp, human
gggaggaaaaaaattggcgg

SEQ ID NO: 403670 - DNA, 20 bp, human
ggggtggcggcgggaaggca

SEQ ID NO: 403671 - DNA, 20 bp, human
gcccggaggaaaaaaattgg

SEQ ID NO: 403672 - DNA, 20 bp, human
gggtgctggaggcctccggg

SEQ ID NO: 403673 - DNA, 20 bp, human
ggccgccgcggcagtcttgc

SEQ ID NO: 403674 - DNA, 20 bp, human
gtccgaccgcgcagccccgg

SEQ ID NO: 403675 - DNA, 20 bp, human
gtgcctggagaccccggcgg

SEQ ID NO: 403676 - DNA, 20 bp, human
gcggaagtgcggggacttct

SEQ ID NO: 403677 - DNA, 20 bp, human
gcccgtgcgctattaccgaa

SEQ ID NO: 403678 - DNA, 20 bp, human
gacttctgggacaattagat

SEQ ID NO: 403679 - DNA, 20 bp, human
gtggcgagggcgttacttgc

SEQ ID NO: 403680 - DNA, 20 bp, human
gtccccgcacttccgctgta

SEQ ID NO: 403681 - DNA, 20 bp, human
ggcggctgccggacccgcta

SEQ ID NO: 403682 - DNA, 20 bp, human
gcggccagcggctagaagtc

SEQ ID NO: 403683 - DNA, 20 bp, human
gacaacccactgccggagtt

SEQ ID NO: 403684 - DNA, 20 bp, human
gcgcacgggcgcggccatct

SEQ ID NO: 403685 - DNA, 20 bp, human
ggcgtaacggaactcggttc

SEQ ID NO: 403686 - DNA, 20 bp, human
gcgggcgtggcggcagttat

SEQ ID NO: 403687 - DNA, 20 bp, human
gatcggggcggggtcttcgg

SEQ ID NO: 403688 - DNA, 20 bp, human
ggggtcttcgggggcggagt

SEQ ID NO: 403689 - DNA, 20 bp, human
gaaggggcggggtcagctcg

SEQ ID NO: 403690 - DNA, 20 bp, human
ggggagggacctgatttcgg

SEQ ID NO: 403691 - DNA, 20 bp, human
gaggggaagccggctcggga

SEQ ID NO: 403692 - DNA, 20 bp, human
gtgccatagacgactgtaaa

SEQ ID NO: 403693 - DNA, 20 bp, human
ggggcggagtcggctgggga

SEQ ID NO: 403694 - DNA, 20 bp, human
gatagacgactgtaaagggg

SEQ ID NO: 403695 - DNA, 20 bp, human
gaactgccgccacgcccgca

SEQ ID NO: 403696 - DNA, 20 bp, human
gccacccatcagctccgcca

SEQ ID NO: 403697 - DNA, 20 bp, human
ggggcagagagtgaacgcgc

SEQ ID NO: 403698 - DNA, 20 bp, human
gacgccctccctaaccctgg

SEQ ID NO: 403699 - DNA, 20 bp, human
gggctgaggggtgaacgcgg

SEQ ID NO: 403700 - DNA, 20 bp, human
gctaaccctggcggagctga

SEQ ID NO: 403701 - DNA, 20 bp, human
gagtccggagggtgggtctt

SEQ ID NO: 403702 - DNA, 20 bp, human
gggactgacgcggtctaatc

SEQ ID NO: 403703 - DNA, 20 bp, human
gccgggctgaggggtgaacg

SEQ ID NO: 403704 - DNA, 20 bp, human
ggagcccagacgcccggcgt

SEQ ID NO: 403705 - DNA, 20 bp, human
gcccggagccgcctggcacc

SEQ ID NO: 403706 - DNA, 20 bp, human
ggtcccacccaacacgtgtc

SEQ ID NO: 403707 - DNA, 20 bp, human
gagggttccaataacttgtg

SEQ ID NO: 403708 - DNA, 20 bp, human
ggggtgtccccacaagttat

SEQ ID NO: 403709 - DNA, 20 bp, human
gtgctcacctgacacgtgtt

SEQ ID NO: 403710 - DNA, 20 bp, human
gcacctgacacgtgttgggt

SEQ ID NO: 403711 - DNA, 20 bp, human
gacaaacatctatgcctcca

SEQ ID NO: 403712 - DNA, 20 bp, human
gtactcagatcactactgcc

SEQ ID NO: 403713 - DNA, 20 bp, human
gcatgagtatgtctactcca

SEQ ID NO: 403714 - DNA, 20 bp, human
gttgtgatccatcagtaaac

SEQ ID NO: 403715 - DNA, 20 bp, human
ggagaagacaaatgtattat

SEQ ID NO: 403716 - DNA, 20 bp, human
ggggtcaaggggcacattct

SEQ ID NO: 403717 - DNA, 20 bp, human
gtcaaggggcacattctcgg

SEQ ID NO: 403718 - DNA, 20 bp, human
ggggaccagcagctatcagt

SEQ ID NO: 403719 - DNA, 20 bp, human
ggcagctatcagttggtcgg

SEQ ID NO: 403720 - DNA, 20 bp, human
gcgaagtggtggtgcatggc

SEQ ID NO: 403721 - DNA, 20 bp, human
gactgggagggagcggaaga

SEQ ID NO: 403722 - DNA, 20 bp, human
gccccttgacccagatgaga

SEQ ID NO: 403723 - DNA, 20 bp, human
gcaccctctcatctgggtca

SEQ ID NO: 403724 - DNA, 20 bp, human
gaggatgggaagcttgacct

SEQ ID NO: 403725 - DNA, 20 bp, human
gtgagagggtgagcccgcca

SEQ ID NO: 403726 - DNA, 20 bp, human
gcggccggaagaacccgcgc

SEQ ID NO: 403727 - DNA, 20 bp, human
gcggccgcggactcacgtac

SEQ ID NO: 403728 - DNA, 20 bp, human
ggacttgagagtgattgcga

SEQ ID NO: 403729 - DNA, 20 bp, human
ggagggcagagagacctcta

SEQ ID NO: 403730 - DNA, 20 bp, human
gcctcctcggctatttattg

SEQ ID NO: 403731 - DNA, 20 bp, human
gcggggacgttcccggaagt

SEQ ID NO: 403732 - DNA, 20 bp, human
ggccctctctgggacgctgg

SEQ ID NO: 403733 - DNA, 20 bp, human
ggacccggccaaaaagggga

SEQ ID NO: 403734 - DNA, 20 bp, human
gccaagctggcgccccgggt

SEQ ID NO: 403735 - DNA, 20 bp, human
gcgctggaggactgactcga

SEQ ID NO: 403736 - DNA, 20 bp, human
gaagcggcgggcgaatcccg

SEQ ID NO: 403737 - DNA, 20 bp, human
ggggcgaccgcgggtggcga

SEQ ID NO: 403738 - DNA, 20 bp, human
gtggccatccagctccccgg

SEQ ID NO: 403739 - DNA, 20 bp, human
gacgcccccggggagctgga

SEQ ID NO: 403740 - DNA, 20 bp, human
ggggaggccaatcgcgtccg

SEQ ID NO: 403741 - DNA, 20 bp, human
gcgggcgaatcccgaggccc

SEQ ID NO: 403742 - DNA, 20 bp, human
gttgcagcagcggctccccg

SEQ ID NO: 403743 - DNA, 20 bp, human
gcgtgctgggcgaccgcggg

SEQ ID NO: 403744 - DNA, 20 bp, human
gtgcacttccgctgcctaga

SEQ ID NO: 403745 - DNA, 20 bp, human
gccgcactctgcgttctccg

SEQ ID NO: 403746 - DNA, 20 bp, human
gagggcgcgcgctgcttccc

SEQ ID NO: 403747 - DNA, 20 bp, human
gcgcgcccccgagggccgtc

SEQ ID NO: 403748 - DNA, 20 bp, human
gggttccggacggccctcgg

SEQ ID NO: 403749 - DNA, 20 bp, human
gggaaggcgcttcaccggaa

SEQ ID NO: 403750 - DNA, 20 bp, human
gaccgctgtgaggaaacggg

SEQ ID NO: 403751 - DNA, 20 bp, human
gcgccctcgaacccggaagc

SEQ ID NO: 403752 - DNA, 20 bp, human
ggagggccgtccggaaccgt

SEQ ID NO: 403753 - DNA, 20 bp, human
gaacccgcgcgtcttccggc

SEQ ID NO: 403754 - DNA, 20 bp, human
gaacccgccggaagacgcgc

SEQ ID NO: 403755 - DNA, 20 bp, human
gtggccgctacccacggttc

SEQ ID NO: 403756 - DNA, 20 bp, human
gccgggttggctgcgttcag

SEQ ID NO: 403757 - DNA, 20 bp, human
gcaacccggcgcgcaccggt

SEQ ID NO: 403758 - DNA, 20 bp, human
gctcgcagggatcggatact

SEQ ID NO: 403759 - DNA, 20 bp, human
gcaggctgatgatgctcgca

SEQ ID NO: 403760 - DNA, 20 bp, human
gtgatgatgctcgcagggat

SEQ ID NO: 403761 - DNA, 20 bp, human
gcgcccccaccggtgcgcgc

SEQ ID NO: 403762 - DNA, 20 bp, human
gggttcccagcgtcctcccg

SEQ ID NO: 403763 - DNA, 20 bp, human
ggcccgccgcagcgctacgt

SEQ ID NO: 403764 - DNA, 20 bp, human
gaagctcccacgtagcgctg

SEQ ID NO: 403765 - DNA, 20 bp, human
ggtctggggcccaagaacgc

SEQ ID NO: 403766 - DNA, 20 bp, human
gcaggcgcggccagtctcaa

SEQ ID NO: 403767 - DNA, 20 bp, human
gactcgaagcgcagcctcgc

SEQ ID NO: 403768 - DNA, 20 bp, human
gtgaacccggagccggagct

SEQ ID NO: 403769 - DNA, 20 bp, human
ggcgccgtccccaggcgcta

SEQ ID NO: 403770 - DNA, 20 bp, human
gccgggttcacgcagagcag

SEQ ID NO: 403771 - DNA, 20 bp, human
gcctccgcgcgcagcccgtt

SEQ ID NO: 403772 - DNA, 20 bp, human
ggggtcacgccacaatcccc

SEQ ID NO: 403773 - DNA, 20 bp, human
gtggctggcgcgttaaagag

SEQ ID NO: 403774 - DNA, 20 bp, human
gcaggggctgcaccagcgag

SEQ ID NO: 403775 - DNA, 20 bp, human
gggcgctgcgagtctgtccc

SEQ ID NO: 403776 - DNA, 20 bp, human
ggcgttagggacccttgcga

SEQ ID NO: 403777 - DNA, 20 bp, human
gcctccctcggccctcgcaa

SEQ ID NO: 403778 - DNA, 20 bp, human
gggacccttgcgagggccga

SEQ ID NO: 403779 - DNA, 20 bp, human
gccgcctaggcggcttccga

SEQ ID NO: 403780 - DNA, 20 bp, human
gggcttccgaaggcgcgtta

SEQ ID NO: 403781 - DNA, 20 bp, human
gtccgcctcctctttgcaag

SEQ ID NO: 403782 - DNA, 20 bp, human
gaatcggccgggaaagaccc

SEQ ID NO: 403783 - DNA, 20 bp, human
gcctgcgcgcgcgggcctct

SEQ ID NO: 403784 - DNA, 20 bp, human
gcaagccccttgcaaagagg

SEQ ID NO: 403785 - DNA, 20 bp, human
gggacagtgactggaataca

SEQ ID NO: 403786 - DNA, 20 bp, human
gtgggcaagaaggcactcct

SEQ ID NO: 403787 - DNA, 20 bp, human
gcggggcgcggggtttgaag

SEQ ID NO: 403788 - DNA, 20 bp, human
ggaaaccgggaacgcagggg

SEQ ID NO: 403789 - DNA, 20 bp, human
gggggcgggacgagagagac

SEQ ID NO: 403790 - DNA, 20 bp, human
gcaactacgtggcttgtgat

SEQ ID NO: 403791 - DNA, 20 bp, human
gctctccatgacaacggcct

SEQ ID NO: 403792 - DNA, 20 bp, human
gcggaggatgaggcattcag

SEQ ID NO: 403793 - DNA, 20 bp, human
gagtagctagcagaacccgg

SEQ ID NO: 403794 - DNA, 20 bp, human
ggggtccctgatgctctccc

SEQ ID NO: 403795 - DNA, 20 bp, human
gcgtcccgcccctgcgttcc

SEQ ID NO: 403796 - DNA, 20 bp, human
gaatcaggaaacggctaaaa

SEQ ID NO: 403797 - DNA, 20 bp, human
ggagaacgggtgcgcgggga

SEQ ID NO: 403798 - DNA, 20 bp, human
ggctaaaaggggagcgcgcg

SEQ ID NO: 403799 - DNA, 20 bp, human
gcgaggggcaggtctcgcga

SEQ ID NO: 403800 - DNA, 20 bp, human
ggcgcgcgttgaagtctgga

SEQ ID NO: 403801 - DNA, 20 bp, human
ggcgctaggggcagtgcgag

SEQ ID NO: 403802 - DNA, 20 bp, human
gcgtgtaagactgcgagggg

SEQ ID NO: 403803 - DNA, 20 bp, human
gacggtgagaacgggtgcgc

SEQ ID NO: 403804 - DNA, 20 bp, human
gtcctgattggctgaaggaa

SEQ ID NO: 403805 - DNA, 20 bp, human
gcgcgcgccgccagcggtag

SEQ ID NO: 403806 - DNA, 20 bp, human
gcagaaggtctgatggtgag

SEQ ID NO: 403807 - DNA, 20 bp, human
gcaccatcagaccttctgta

SEQ ID NO: 403808 - DNA, 20 bp, human
gcacaacagaccagggaaat

SEQ ID NO: 403809 - DNA, 20 bp, human
gccccaggaagccatacaga

SEQ ID NO: 403810 - DNA, 20 bp, human
gcaggctgccctgggctcac

SEQ ID NO: 403811 - DNA, 20 bp, human
ggccgaaaatggcgagaaag

SEQ ID NO: 403812 - DNA, 20 bp, human
gaaaggggcttcagtggagc

SEQ ID NO: 403813 - DNA, 20 bp, human
gaccttctgtatggcttcct

SEQ ID NO: 403814 - DNA, 20 bp, human
gagccatacagaaggtctga

SEQ ID NO: 403815 - DNA, 20 bp, human
gagaggccaagaaggattgc

SEQ ID NO: 403816 - DNA, 20 bp, human
ggacgggtggaaaagactcg

SEQ ID NO: 403817 - DNA, 20 bp, human
gtggcagcggagggataatc

SEQ ID NO: 403818 - DNA, 20 bp, human
gggaagtgacgtagggctag

SEQ ID NO: 403819 - DNA, 20 bp, human
gagggcgcgcgggagacgtg

SEQ ID NO: 403820 - DNA, 20 bp, human
gtgccgctagaggtgaagac

SEQ ID NO: 403821 - DNA, 20 bp, human
ggggcgcgcgccaaccggga

SEQ ID NO: 403822 - DNA, 20 bp, human
gaaaagactcggggttccga

SEQ ID NO: 403823 - DNA, 20 bp, human
gacgtagggctagcggtctg

SEQ ID NO: 403824 - DNA, 20 bp, human
gacgcctccgctgccgctag

SEQ ID NO: 403825 - DNA, 20 bp, human
gggaggaggcgcccttaaaa

SEQ ID NO: 403826 - DNA, 20 bp, human
gcaacgaagagccgggctgg

SEQ ID NO: 403827 - DNA, 20 bp, human
ggacccaaccaggtcgggtc

SEQ ID NO: 403828 - DNA, 20 bp, human
gcccgccccgtgcctcctgc

SEQ ID NO: 403829 - DNA, 20 bp, human
ggagcaggcggccactgcga

SEQ ID NO: 403830 - DNA, 20 bp, human
gtgaaggcccagacggacag

SEQ ID NO: 403831 - DNA, 20 bp, human
gactgcgagggcgctcctgg

SEQ ID NO: 403832 - DNA, 20 bp, human
gaggcccagacggacagggg

SEQ ID NO: 403833 - DNA, 20 bp, human
gggccgggcctgagcgtcgt

SEQ ID NO: 403834 - DNA, 20 bp, human
ggcgccgtaaagagcgaggc

SEQ ID NO: 403835 - DNA, 20 bp, human
gggcggggccgaaccaggaa

SEQ ID NO: 403836 - DNA, 20 bp, human
ggatgcagccaatcctcctt

SEQ ID NO: 403837 - DNA, 20 bp, human
gtacggccccggccttggtc

SEQ ID NO: 403838 - DNA, 20 bp, human
gttggtcgggcgaagtgcgg

SEQ ID NO: 403839 - DNA, 20 bp, human
gcggggccgtagtttgcatc

SEQ ID NO: 403840 - DNA, 20 bp, human
ggccttggtcgggcgaagtg

SEQ ID NO: 403841 - DNA, 20 bp, human
gcgtggggacggcttggagg

SEQ ID NO: 403842 - DNA, 20 bp, human
gccatcagccaaaggaggat

SEQ ID NO: 403843 - DNA, 20 bp, human
gggggatccaggcggtggtg

SEQ ID NO: 403844 - DNA, 20 bp, human
ggaggcggcgaggcgcgcga

SEQ ID NO: 403845 - DNA, 20 bp, human
ggactggcgaggcgtgagag

SEQ ID NO: 403846 - DNA, 20 bp, human
gccaggcccctcttcccccg

SEQ ID NO: 403847 - DNA, 20 bp, human
ggtcaccaccacttcggaga

SEQ ID NO: 403848 - DNA, 20 bp, human
gcgggcgcggggaagcccgc

SEQ ID NO: 403849 - DNA, 20 bp, human
gctcccccgggcgcgtgccg

SEQ ID NO: 403850 - DNA, 20 bp, human
gcccgggggagccgcgaaga

SEQ ID NO: 403851 - DNA, 20 bp, human
ggaggccccggcacgcgccc

SEQ ID NO: 403852 - DNA, 20 bp, human
gcgcctgtgctcggcatcct

SEQ ID NO: 403853 - DNA, 20 bp, human
ggtagtccccgccgtcttcg

SEQ ID NO: 403854 - DNA, 20 bp, human
gtgcgcagtgcggtcggagg

SEQ ID NO: 403855 - DNA, 20 bp, human
ggggggagccgcgaagacgg

SEQ ID NO: 403856 - DNA, 20 bp, human
ggggctctgcgtaggaggcg

SEQ ID NO: 403857 - DNA, 20 bp, human
gagtggttaaagggaatgtg

SEQ ID NO: 403858 - DNA, 20 bp, human
gagggcttctagcatgggcg

SEQ ID NO: 403859 - DNA, 20 bp, human
ggaaggaagcgagaaggtga

SEQ ID NO: 403860 - DNA, 20 bp, human
gctaagagaaggaagcgaga

SEQ ID NO: 403861 - DNA, 20 bp, human
gagtgggtaaagggaaggca

SEQ ID NO: 403862 - DNA, 20 bp, human
gaaggtgagggcttcgcgca

SEQ ID NO: 403863 - DNA, 20 bp, human
gcggggcaggtgtggtcgcg

SEQ ID NO: 403864 - DNA, 20 bp, human
gcgcgagcggcacgcggctc

SEQ ID NO: 403865 - DNA, 20 bp, human
ggaggcagggcttctagcat

SEQ ID NO: 403866 - DNA, 20 bp, human
gaaaatgcggaagggtagac

SEQ ID NO: 403867 - DNA, 20 bp, human
gtcctcctggcaccccgtgt

SEQ ID NO: 403868 - DNA, 20 bp, human
ggccaggaggacccaccggg

SEQ ID NO: 403869 - DNA, 20 bp, human
gtccgcccggtgggtcctcc

SEQ ID NO: 403870 - DNA, 20 bp, human
gagacccaggaaaatgcgga

SEQ ID NO: 403871 - DNA, 20 bp, human
ggcggcccacgggacatggt

SEQ ID NO: 403872 - DNA, 20 bp, human
gcgggagcggcgccgacacg

SEQ ID NO: 403873 - DNA, 20 bp, human
ggggccgcctgcctctccgc

SEQ ID NO: 403874 - DNA, 20 bp, human
ggccccccaccatgtcccgt

SEQ ID NO: 403875 - DNA, 20 bp, human
gactgcgggcgggggtctga

SEQ ID NO: 403876 - DNA, 20 bp, human
gcgtgaccggcgccgacccg

SEQ ID NO: 403877 - DNA, 20 bp, human
ggagtccagtgacctcactg

SEQ ID NO: 403878 - DNA, 20 bp, human
gaaaatgcgggatggtagtt

SEQ ID NO: 403879 - DNA, 20 bp, human
gcgccgagaggcccaccggg

SEQ ID NO: 403880 - DNA, 20 bp, human
gcggtcacgccccgagtccg

SEQ ID NO: 403881 - DNA, 20 bp, human
gggtgcgcaagtagtggtga

SEQ ID NO: 403882 - DNA, 20 bp, human
gtgcacgcaaccaactaagg

SEQ ID NO: 403883 - DNA, 20 bp, human
gccgagaggcgataggtctc

SEQ ID NO: 403884 - DNA, 20 bp, human
ggagaggcccaccgggcgga

SEQ ID NO: 403885 - DNA, 20 bp, human
ggagaaaaggaacgttgtga

SEQ ID NO: 403886 - DNA, 20 bp, human
gctcgcccctcatcccggaa

SEQ ID NO: 403887 - DNA, 20 bp, human
ggcgctctcgcccctcatcc

SEQ ID NO: 403888 - DNA, 20 bp, human
gaggatcccggcgccagcaa

SEQ ID NO: 403889 - DNA, 20 bp, human
gtcgaggagctacatctccc

SEQ ID NO: 403890 - DNA, 20 bp, human
ggtagtgcgcactgcctcct

SEQ ID NO: 403891 - DNA, 20 bp, human
gacaactcccagtactgaag

SEQ ID NO: 403892 - DNA, 20 bp, human
gactaacaggaaggcgtgag

SEQ ID NO: 403893 - DNA, 20 bp, human
gtctcccagctcggactaac

SEQ ID NO: 403894 - DNA, 20 bp, human
gcggtggggacaggctacgg

SEQ ID NO: 403895 - DNA, 20 bp, human
gccagctcggactaacagga

SEQ ID NO: 403896 - DNA, 20 bp, human
gcgcttgcgcactacgacgc

SEQ ID NO: 403897 - DNA, 20 bp, human
gagtgcctgagtgggttgtt

SEQ ID NO: 403898 - DNA, 20 bp, human
gagacggccgcggatgccga

SEQ ID NO: 403899 - DNA, 20 bp, human
gctctctgcgctgcccggtg

SEQ ID NO: 403900 - DNA, 20 bp, human
gcaacccactcaggcacttc

SEQ ID NO: 403901 - DNA, 20 bp, human
ggtaagaaatctagtgccct

SEQ ID NO: 403902 - DNA, 20 bp, human
gcagaggacgctttcctctt

SEQ ID NO: 403903 - DNA, 20 bp, human
gtgagtgggttgttgggtga

SEQ ID NO: 403904 - DNA, 20 bp, human
gggcatccgcggccgtctcc

SEQ ID NO: 403905 - DNA, 20 bp, human
gtcgtagtgcgcaagcgccc

SEQ ID NO: 403906 - DNA, 20 bp, human
gtggcaagggggcatgaaaa

SEQ ID NO: 403907 - DNA, 20 bp, human
gaaggcagaagcggaaacgg

SEQ ID NO: 403908 - DNA, 20 bp, human
gtacggcagcggcggcaacg

SEQ ID NO: 403909 - DNA, 20 bp, human
gcaggaggatcagaaggtta

SEQ ID NO: 403910 - DNA, 20 bp, human
gtcatcggtcacattggcaa

SEQ ID NO: 403911 - DNA, 20 bp, human
ggggaattgtgttctgggtc

SEQ ID NO: 403912 - DNA, 20 bp, human
ggacaaagaggtgagaacgg

SEQ ID NO: 403913 - DNA, 20 bp, human
gccgcggcctctaggagaca

SEQ ID NO: 403914 - DNA, 20 bp, human
gagaggaagcggggtacaga

SEQ ID NO: 403915 - DNA, 20 bp, human
gtcagcatgtgctagttagt

SEQ ID NO: 403916 - DNA, 20 bp, human
gggcgcgaaaagggcggata

SEQ ID NO: 403917 - DNA, 20 bp, human
gcctgcggcggcgacgaaac

SEQ ID NO: 403918 - DNA, 20 bp, human
ggtcttcgagggcgcgaaaa

SEQ ID NO: 403919 - DNA, 20 bp, human
ggattcgaatagtggagggc

SEQ ID NO: 403920 - DNA, 20 bp, human
ggcgctttccgaacgaggga

SEQ ID NO: 403921 - DNA, 20 bp, human
gtggggagcggagagaaagt

SEQ ID NO: 403922 - DNA, 20 bp, human
gtacggattcgaatagtgga

SEQ ID NO: 403923 - DNA, 20 bp, human
ggtcgagcgccgagtcttcg

SEQ ID NO: 403924 - DNA, 20 bp, human
gcggatacggattcgaatag

SEQ ID NO: 403925 - DNA, 20 bp, human
gttcgagggcgcgaaaaggg

SEQ ID NO: 403926 - DNA, 20 bp, human
gggtacgctccgcccctctc

SEQ ID NO: 403927 - DNA, 20 bp, human
gcccttacacggattggaga

SEQ ID NO: 403928 - DNA, 20 bp, human
gcaggggcggtgcccttaca

SEQ ID NO: 403929 - DNA, 20 bp, human
gaccaatcggcggcgagggc

SEQ ID NO: 403930 - DNA, 20 bp, human
gctcagggagattgagactt

SEQ ID NO: 403931 - DNA, 20 bp, human
gggcgcctagcaccctgagt

SEQ ID NO: 403932 - DNA, 20 bp, human
gccacggagcgcggactaat

SEQ ID NO: 403933 - DNA, 20 bp, human
gattggagagggcagcgatg

SEQ ID NO: 403934 - DNA, 20 bp, human
ggatcaccaatcggcggcga

SEQ ID NO: 403935 - DNA, 20 bp, human
gcctgaggtcgatcaccaat

SEQ ID NO: 403936 - DNA, 20 bp, human
gtcacgtgacgccacctctc

SEQ ID NO: 403937 - DNA, 20 bp, human
gccccactcctattggctca

SEQ ID NO: 403938 - DNA, 20 bp, human
gactccgaacagcggtggtg

SEQ ID NO: 403939 - DNA, 20 bp, human
gcgaacagcggtggtggggg

SEQ ID NO: 403940 - DNA, 20 bp, human
gttccctactcccggagagg

SEQ ID NO: 403941 - DNA, 20 bp, human
ggaaatcagctacctggctg

SEQ ID NO: 403942 - DNA, 20 bp, human
gcgccacctctccgggagta

SEQ ID NO: 403943 - DNA, 20 bp, human
gccggagctgtcacaattga

SEQ ID NO: 403944 - DNA, 20 bp, human
gctgtcacaattgagggaga

SEQ ID NO: 403945 - DNA, 20 bp, human
gttccctgccttgagccaat

SEQ ID NO: 403946 - DNA, 20 bp, human
gaactccagcctggagcgcg

SEQ ID NO: 403947 - DNA, 20 bp, human
gcgcaggcgcactgctggca

SEQ ID NO: 403948 - DNA, 20 bp, human
ggcgcgcgggaaagacgcgc

SEQ ID NO: 403949 - DNA, 20 bp, human
gcgtaggcggaggagatttt

SEQ ID NO: 403950 - DNA, 20 bp, human
ggacagaattaactccagcc

SEQ ID NO: 403951 - DNA, 20 bp, human
gcgggacgcgaatcgctctg

SEQ ID NO: 403952 - DNA, 20 bp, human
ggcggagctaaacccggagc

SEQ ID NO: 403953 - DNA, 20 bp, human
ggggtgggcggagctaaacc

SEQ ID NO: 403954 - DNA, 20 bp, human
ggtcctcaaggctttgtgaa

SEQ ID NO: 403955 - DNA, 20 bp, human
ggccaagcacgtgcttccaa

SEQ ID NO: 403956 - DNA, 20 bp, human
gccgcggcgctgtgtattgt

SEQ ID NO: 403957 - DNA, 20 bp, human
ggcgcggcgggtcgccccgc

SEQ ID NO: 403958 - DNA, 20 bp, human
ggcggggcggccgtgaccag

SEQ ID NO: 403959 - DNA, 20 bp, human
gggcacgctccgccgccatc

SEQ ID NO: 403960 - DNA, 20 bp, human
ggaggcgcgctccctgccgg

SEQ ID NO: 403961 - DNA, 20 bp, human
gcccggtaggcaggacgccg

SEQ ID NO: 403962 - DNA, 20 bp, human
gacgctccgccgccatcggg

SEQ ID NO: 403963 - DNA, 20 bp, human
ggcagggagcgcgcctcggg

SEQ ID NO: 403964 - DNA, 20 bp, human
ggcggcgcccgcgcagggat

SEQ ID NO: 403965 - DNA, 20 bp, human
gaggcggcccaatccctgcg

SEQ ID NO: 403966 - DNA, 20 bp, human
gtacggcgtcgggactgcgg

SEQ ID NO: 403967 - DNA, 20 bp, human
gcgagccgcagggaacgcta

SEQ ID NO: 403968 - DNA, 20 bp, human
gcgctccttagcgttccctg

SEQ ID NO: 403969 - DNA, 20 bp, human
ggggctacgcagggagcacg

SEQ ID NO: 403970 - DNA, 20 bp, human
ggcgctgggcacgagccgca

SEQ ID NO: 403971 - DNA, 20 bp, human
gtggaccccacgtccggcta

SEQ ID NO: 403972 - DNA, 20 bp, human
ggcgggggcggggaacgcca

SEQ ID NO: 403973 - DNA, 20 bp, human
ggactccgcttcccgggaac

SEQ ID NO: 403974 - DNA, 20 bp, human
gcggacccgcacctgagagc

SEQ ID NO: 403975 - DNA, 20 bp, human
ggctaaggagcgcggcctgg

SEQ ID NO: 403976 - DNA, 20 bp, human
gtcaacagatactacagcat

SEQ ID NO: 403977 - DNA, 20 bp, human
ggtaagattctctgagttcc

SEQ ID NO: 403978 - DNA, 20 bp, human
gctgtagtatctgttgacta

SEQ ID NO: 403979 - DNA, 20 bp, human
gttgactatggggtagaggc

SEQ ID NO: 403980 - DNA, 20 bp, human
gattctctgagttcctggct

SEQ ID NO: 403981 - DNA, 20 bp, human
gcctccctcctgattagttg

SEQ ID NO: 403982 - DNA, 20 bp, human
gcctgacacctgatccgaag

SEQ ID NO: 403983 - DNA, 20 bp, human
gtgagcaacctcttcggatc

SEQ ID NO: 403984 - DNA, 20 bp, human
gggtgaggttcacacaataa

SEQ ID NO: 403985 - DNA, 20 bp, human
gtcacacaataaagggcagg

SEQ ID NO: 403986 - DNA, 20 bp, human
gtggccgtggggctcttcct

SEQ ID NO: 403987 - DNA, 20 bp, human
gggccctgagagagcctgaa

SEQ ID NO: 403988 - DNA, 20 bp, human
gaagaagcgaggggccgcca

SEQ ID NO: 403989 - DNA, 20 bp, human
ggggccccacggagcttctg

SEQ ID NO: 403990 - DNA, 20 bp, human
gactccaggtcgcccacggc

SEQ ID NO: 403991 - DNA, 20 bp, human
gttctcagcttcgtttatgt

SEQ ID NO: 403992 - DNA, 20 bp, human
gggaagccatcaggctgcgc

SEQ ID NO: 403993 - DNA, 20 bp, human
gggggcccaggagagtataa

SEQ ID NO: 403994 - DNA, 20 bp, human
gacaggaaggagctggccgt

SEQ ID NO: 403995 - DNA, 20 bp, human
gtctaagggcagtgccttga

SEQ ID NO: 403996 - DNA, 20 bp, human
gctccctgagggctctaaat

SEQ ID NO: 403997 - DNA, 20 bp, human
gcccccaacagcatctgcag

SEQ ID NO: 403998 - DNA, 20 bp, human
ggcaccgaggcccactcagc

SEQ ID NO: 403999 - DNA, 20 bp, human
ggtgactcagcccaagtgga

SEQ ID NO: 404000 - DNA, 20 bp, human
gtggggaagcaagatggaga

SEQ ID NO: 404001 - DNA, 20 bp, human
gtgcaggggattcctgagaa

SEQ ID NO: 404002 - DNA, 20 bp, human
gtccccatttagagccctca

SEQ ID NO: 404003 - DNA, 20 bp, human
gccctgcagtagccgttctc

SEQ ID NO: 404004 - DNA, 20 bp, human
ggcctcggtgcctcctgggt

SEQ ID NO: 404005 - DNA, 20 bp, human
ggatggagaaggggggggca

SEQ ID NO: 404006 - DNA, 20 bp, human
gtagtcccgcgagcagggga

SEQ ID NO: 404007 - DNA, 20 bp, human
ggccgcgcggggttagcgcg

SEQ ID NO: 404008 - DNA, 20 bp, human
ggggacgcgggccggcctca

SEQ ID NO: 404009 - DNA, 20 bp, human
gagggacgaggagtcgggaa

SEQ ID NO: 404010 - DNA, 20 bp, human
gcccgcgcgccaagcacttc

SEQ ID NO: 404011 - DNA, 20 bp, human
gtggcagggaacgactgcga

SEQ ID NO: 404012 - DNA, 20 bp, human
ggttagcgcggggtcagcgg

SEQ ID NO: 404013 - DNA, 20 bp, human
gcctcccccgggcttctcca

SEQ ID NO: 404014 - DNA, 20 bp, human
ggggtcagcggaggtcagcg

SEQ ID NO: 404015 - DNA, 20 bp, human
ggggcgcggcggacgcaggt

SEQ ID NO: 404016 - DNA, 20 bp, human
ggaccccggcccctagtccg

SEQ ID NO: 404017 - DNA, 20 bp, human
ggatgggcgtgtgatgacaa

SEQ ID NO: 404018 - DNA, 20 bp, human
ggcggggcttctgttgacag

SEQ ID NO: 404019 - DNA, 20 bp, human
gtgcgccaatccccggacta

SEQ ID NO: 404020 - DNA, 20 bp, human
gcggggcgtctcctgacagg

SEQ ID NO: 404021 - DNA, 20 bp, human
gccctggggcgacacgaccc

SEQ ID NO: 404022 - DNA, 20 bp, human
gaatccccggactaggggcc

SEQ ID NO: 404023 - DNA, 20 bp, human
ggctcggcgccgcacggggt

SEQ ID NO: 404024 - DNA, 20 bp, human
ggagacgccccgccttccca

SEQ ID NO: 404025 - DNA, 20 bp, human
gcggtcgcaggcaaagggcg

SEQ ID NO: 404026 - DNA, 20 bp, human
gcggggcgtctcctgacagg

SEQ ID NO: 404027 - DNA, 20 bp, human
ggcggggcttctgttgacag

SEQ ID NO: 404028 - DNA, 20 bp, human
ggagacgccccgccttccca

SEQ ID NO: 404029 - DNA, 20 bp, human
ggaccccggcccctagtccg

SEQ ID NO: 404030 - DNA, 20 bp, human
gcggtcgcaggcaaagggcg

SEQ ID NO: 404031 - DNA, 20 bp, human
gcggagcggtcgcaggcaaa

SEQ ID NO: 404032 - DNA, 20 bp, human
ggatgggcgtgtgatgacaa

SEQ ID NO: 404033 - DNA, 20 bp, human
gtggcgcaccgcgggaggta

SEQ ID NO: 404034 - DNA, 20 bp, human
gtgcgccaatccccggacta

SEQ ID NO: 404035 - DNA, 20 bp, human
ggcttccgcagtctggggcg

SEQ ID NO: 404036 - DNA, 20 bp, human
gaccacccgagctgccaccc

SEQ ID NO: 404037 - DNA, 20 bp, human
gtcgccggtgtctccggagg

SEQ ID NO: 404038 - DNA, 20 bp, human
gcgagcccgggtggcagctc

SEQ ID NO: 404039 - DNA, 20 bp, human
gcagccccctccggagacac

SEQ ID NO: 404040 - DNA, 20 bp, human
gggggggaggctagccctaa

SEQ ID NO: 404041 - DNA, 20 bp, human
gaggctagccctaaaggcgc

SEQ ID NO: 404042 - DNA, 20 bp, human
ggcccgggtggcagctcggg

SEQ ID NO: 404043 - DNA, 20 bp, human
ggttactggccaaggtaggg

SEQ ID NO: 404044 - DNA, 20 bp, human
ggccccgggaccctttgcgt

SEQ ID NO: 404045 - DNA, 20 bp, human
gccagtaaccagcgccttta

SEQ ID NO: 404046 - DNA, 20 bp, human
gcggccgccagaggcgacct

SEQ ID NO: 404047 - DNA, 20 bp, human
gccgccagaggcgacctggg

SEQ ID NO: 404048 - DNA, 20 bp, human
gtccccgccccaccgtgtgg

SEQ ID NO: 404049 - DNA, 20 bp, human
gagtccgcccaggtcgcctc

SEQ ID NO: 404050 - DNA, 20 bp, human
gcgctccccgcgacgtcagg

SEQ ID NO: 404051 - DNA, 20 bp, human
gcagccgagcggcccggagt

SEQ ID NO: 404052 - DNA, 20 bp, human
gcccccagccgagtcgagca

SEQ ID NO: 404053 - DNA, 20 bp, human
gccgagtcgagcaaggccga

SEQ ID NO: 404054 - DNA, 20 bp, human
gcttcagcctccacacggtg

SEQ ID NO: 404055 - DNA, 20 bp, human
gtgtggaggctgaagaagac

SEQ ID NO: 404056 - DNA, 20 bp, human
gcagccgccgcgccaacgga

SEQ ID NO: 404057 - DNA, 20 bp, human
ggggaatgcgggcgcaccaa

SEQ ID NO: 404058 - DNA, 20 bp, human
ggcgccctccgttggcgcgg

SEQ ID NO: 404059 - DNA, 20 bp, human
gccggggtgcgggagggcaa

SEQ ID NO: 404060 - DNA, 20 bp, human
gggcgcgccctccgttggcg

SEQ ID NO: 404061 - DNA, 20 bp, human
gtgctcccattcatcaaggg

SEQ ID NO: 404062 - DNA, 20 bp, human
gcgtcccccccttgatgaat

SEQ ID NO: 404063 - DNA, 20 bp, human
gcaccaatgggcgccagcgt

SEQ ID NO: 404064 - DNA, 20 bp, human
gggcgccgcgcgcagctcat

SEQ ID NO: 404065 - DNA, 20 bp, human
gcgcccgcctcatcaatccc

SEQ ID NO: 404066 - DNA, 20 bp, human
ggctccgcgctcggcacccg

SEQ ID NO: 404067 - DNA, 20 bp, human
gacgggcgaggagaggaccg

SEQ ID NO: 404068 - DNA, 20 bp, human
gcgggtgcgcgcaggggtgg

SEQ ID NO: 404069 - DNA, 20 bp, human
gaggagaggggggctaccgg

SEQ ID NO: 404070 - DNA, 20 bp, human
gtagaatgcagtcacaaccg

SEQ ID NO: 404071 - DNA, 20 bp, human
gcggccgcaccgagcagcgc

SEQ ID NO: 404072 - DNA, 20 bp, human
gggctccccacacctccctc

SEQ ID NO: 404073 - DNA, 20 bp, human
gcgcccccgccgcggtcagg

SEQ ID NO: 404074 - DNA, 20 bp, human
gagtccaggcgtcctctccg

SEQ ID NO: 404075 - DNA, 20 bp, human
gctaccggcgctgctcggtg

SEQ ID NO: 404076 - DNA, 20 bp, human
gctgccaatcagcctcgcgg

SEQ ID NO: 404077 - DNA, 20 bp, human
gctgcccattggccgccgcg

SEQ ID NO: 404078 - DNA, 20 bp, human
gtcacctgccaggcacccgg

SEQ ID NO: 404079 - DNA, 20 bp, human
gacgccgccgggactctcgc

SEQ ID NO: 404080 - DNA, 20 bp, human
gtggccgccgcgaggctgat

SEQ ID NO: 404081 - DNA, 20 bp, human
gggaaagcccgcgagagtcc

SEQ ID NO: 404082 - DNA, 20 bp, human
gccggcggctgcccaatcag

SEQ ID NO: 404083 - DNA, 20 bp, human
gcgagcgacccccgctgatt

SEQ ID NO: 404084 - DNA, 20 bp, human
ggggctccaccgggcttgag

SEQ ID NO: 404085 - DNA, 20 bp, human
gccggaggtcaggtgaccgc

SEQ ID NO: 404086 - DNA, 20 bp, human
ggccgtgagctccccgattg

SEQ ID NO: 404087 - DNA, 20 bp, human
gccccgattggggctcggtc

SEQ ID NO: 404088 - DNA, 20 bp, human
gggccggaccgagccccaat

SEQ ID NO: 404089 - DNA, 20 bp, human
ggccccaatcggggagctca

SEQ ID NO: 404090 - DNA, 20 bp, human
ggctacctagcgtctagctg

SEQ ID NO: 404091 - DNA, 20 bp, human
ggctggcataggccggggag

SEQ ID NO: 404092 - DNA, 20 bp, human
ggctgcaagtgctgcggaaa

SEQ ID NO: 404093 - DNA, 20 bp, human
ggcgggagaagcaactacaa

SEQ ID NO: 404094 - DNA, 20 bp, human
ggcaagtgctgcggaaatgg

SEQ ID NO: 404095 - DNA, 20 bp, human
gcggaagcctagattcctgc

SEQ ID NO: 404096 - DNA, 20 bp, human
ggggaagggtagctgttggg

SEQ ID NO: 404097 - DNA, 20 bp, human
ggtccccgttggattttcca

SEQ ID NO: 404098 - DNA, 20 bp, human
gcaacggggacgttgacaag

SEQ ID NO: 404099 - DNA, 20 bp, human
gacaagggaggggacctaag

SEQ ID NO: 404100 - DNA, 20 bp, human
gcactcttaccctgtatatt

SEQ ID NO: 404101 - DNA, 20 bp, human
gcccgcgtgtgtttcctgaa

SEQ ID NO: 404102 - DNA, 20 bp, human
gagtccgtggaaaatccaac

SEQ ID NO: 404103 - DNA, 20 bp, human
gcacacacacacaacaaggg

SEQ ID NO: 404104 - DNA, 20 bp, human
gtctctgcaggaaacgcgaa

SEQ ID NO: 404105 - DNA, 20 bp, human
gttgacaagagggtattttt

SEQ ID NO: 404106 - DNA, 20 bp, human
gtgcaacttgggcatccccg

SEQ ID NO: 404107 - DNA, 20 bp, human
gggtgcgtcaaggaagagcg

SEQ ID NO: 404108 - DNA, 20 bp, human
gaccaaggctgcagcacggg

SEQ ID NO: 404109 - DNA, 20 bp, human
ggcgttcccggcacacccgg

SEQ ID NO: 404110 - DNA, 20 bp, human
gtggtcgcgcaccccggcgc

SEQ ID NO: 404111 - DNA, 20 bp, human
ggcgcgggcagctacccctg

SEQ ID NO: 404112 - DNA, 20 bp, human
gcgggcagctacccctgcgg

SEQ ID NO: 404113 - DNA, 20 bp, human
gtgtgccgggaacgcctggg

SEQ ID NO: 404114 - DNA, 20 bp, human
gaggcggaggtgcgcgacgg

SEQ ID NO: 404115 - DNA, 20 bp, human
ggcggcccggagttgggagt

SEQ ID NO: 404116 - DNA, 20 bp, human
gtagtccccgctggtcccca

SEQ ID NO: 404117 - DNA, 20 bp, human
gggggactacagaacccaga

SEQ ID NO: 404118 - DNA, 20 bp, human
gtcagccctggggaccagcg

SEQ ID NO: 404119 - DNA, 20 bp, human
ggccgcttggcttttgtttg

SEQ ID NO: 404120 - DNA, 20 bp, human
ggaccacagaaatcgaccag

SEQ ID NO: 404121 - DNA, 20 bp, human
gcgacccattggtcccaaag

SEQ ID NO: 404122 - DNA, 20 bp, human
gtgggttctgtagtccccgc

SEQ ID NO: 404123 - DNA, 20 bp, human
gccaatccgcgctgagaaaa

SEQ ID NO: 404124 - DNA, 20 bp, human
ggtcgccacaatgcaggaga

SEQ ID NO: 404125 - DNA, 20 bp, human
gcgctgggggcgcagggaaa

SEQ ID NO: 404126 - DNA, 20 bp, human
gtggtgagggggcccggaga

SEQ ID NO: 404127 - DNA, 20 bp, human
ggccctgtgacgtgccaatc

SEQ ID NO: 404128 - DNA, 20 bp, human
gcaaagccaggtctggaaaa

SEQ ID NO: 404129 - DNA, 20 bp, human
gcggagaagccctgacaagg

SEQ ID NO: 404130 - DNA, 20 bp, human
gtgacgtgccaatcaggctg

SEQ ID NO: 404131 - DNA, 20 bp, human
gaaagaaatgggggtcgaaa

SEQ ID NO: 404132 - DNA, 20 bp, human
gtgagggggcccggagaggg

SEQ ID NO: 404133 - DNA, 20 bp, human
gcaccccccttttccagacc

SEQ ID NO: 404134 - DNA, 20 bp, human
gagtttggcgcgaaggctgg

SEQ ID NO: 404135 - DNA, 20 bp, human
ggcctgattggcacgtcaca

SEQ ID NO: 404136 - DNA, 20 bp, human
gcgcccgacagaaagaattc

SEQ ID NO: 404137 - DNA, 20 bp, human
gtcaggctccaacctccaac

SEQ ID NO: 404138 - DNA, 20 bp, human
gtcgggcggagagcacttta

SEQ ID NO: 404139 - DNA, 20 bp, human
gaagagattttgccagttgg

SEQ ID NO: 404140 - DNA, 20 bp, human
gaaagaaatagggccagcgg

SEQ ID NO: 404141 - DNA, 20 bp, human
gggcattgttccacctccgc

SEQ ID NO: 404142 - DNA, 20 bp, human
gattttcatcctctgacatt

SEQ ID NO: 404143 - DNA, 20 bp, human
ggagcctgaattctttctgt

SEQ ID NO: 404144 - DNA, 20 bp, human
gaacattatccaaatgtcag

SEQ ID NO: 404145 - DNA, 20 bp, human
gaactttgaaatagaaagca

SEQ ID NO: 404146 - DNA, 20 bp, human
gtggaggcttgaaaactcaa

SEQ ID NO: 404147 - DNA, 20 bp, human
gtagtccctgcattaactag

SEQ ID NO: 404148 - DNA, 20 bp, human
ggggacctgatcctccaagc

SEQ ID NO: 404149 - DNA, 20 bp, human
gtccgcccctagttaatgca

SEQ ID NO: 404150 - DNA, 20 bp, human
gcattaactaggggcggact

SEQ ID NO: 404151 - DNA, 20 bp, human
gtccctgcattaactagggg

SEQ ID NO: 404152 - DNA, 20 bp, human
gggcgcggtcccggaagacg

SEQ ID NO: 404153 - DNA, 20 bp, human
gggcgcctggtccagcgatt

SEQ ID NO: 404154 - DNA, 20 bp, human
ggcggtcccggaagacgagg

SEQ ID NO: 404155 - DNA, 20 bp, human
gtagagaggacccggaagcg

SEQ ID NO: 404156 - DNA, 20 bp, human
gcgccccccgcgctctccgc

SEQ ID NO: 404157 - DNA, 20 bp, human
gttcaggcggagaatctagg

SEQ ID NO: 404158 - DNA, 20 bp, human
gcccgcgcgaggcgtcctgg

SEQ ID NO: 404159 - DNA, 20 bp, human
gagggactttaagattgtag

SEQ ID NO: 404160 - DNA, 20 bp, human
gcggggcggagggacacaga

SEQ ID NO: 404161 - DNA, 20 bp, human
ggcgcggagggtcctccccg

SEQ ID NO: 404162 - DNA, 20 bp, human
ggcgcggtgactcgtcgctg

SEQ ID NO: 404163 - DNA, 20 bp, human
gccgtcgcgagtcccgcttc

SEQ ID NO: 404164 - DNA, 20 bp, human
ggagctgcggggcgaagcca

SEQ ID NO: 404165 - DNA, 20 bp, human
ggaggcgtcctggcgggcga

SEQ ID NO: 404166 - DNA, 20 bp, human
ggggcacagaagccacttcc

SEQ ID NO: 404167 - DNA, 20 bp, human
gacgacagagtctgtcaggg

SEQ ID NO: 404168 - DNA, 20 bp, human
ggcaaacgacagagtctgtc

SEQ ID NO: 404169 - DNA, 20 bp, human
gggcgtcggccttccactgt

SEQ ID NO: 404170 - DNA, 20 bp, human
gaaactagcaaaccacccgc

SEQ ID NO: 404171 - DNA, 20 bp, human
gcccgcggctctcctcctgt

SEQ ID NO: 404172 - DNA, 20 bp, human
ggcttctgtgccccgccctg

SEQ ID NO: 404173 - DNA, 20 bp, human
gtctttaatagcaaaagggg

SEQ ID NO: 404174 - DNA, 20 bp, human
gcagaaactgagtgaaaacg

SEQ ID NO: 404175 - DNA, 20 bp, human
gttcaagcactttgtgagta

SEQ ID NO: 404176 - DNA, 20 bp, human
gggaactaaggccacttcct

SEQ ID NO: 404177 - DNA, 20 bp, human
gtaaggacagggtagctaat

SEQ ID NO: 404178 - DNA, 20 bp, human
gcgcaagggaaggcagttaa

SEQ ID NO: 404179 - DNA, 20 bp, human
gtgtccttacctccacgcaa

SEQ ID NO: 404180 - DNA, 20 bp, human
gtccccctgccagggttctt

SEQ ID NO: 404181 - DNA, 20 bp, human
ggcatccttccaggatttaa

SEQ ID NO: 404182 - DNA, 20 bp, human
gtctaggaagcttctctcgg

SEQ ID NO: 404183 - DNA, 20 bp, human
gggactgagcctttaaatcc

SEQ ID NO: 404184 - DNA, 20 bp, human
ggaggtgagggctacagtca

SEQ ID NO: 404185 - DNA, 20 bp, human
ggccgcagcggcatccttcc

SEQ ID NO: 404186 - DNA, 20 bp, human
ggggcggggcctccagagtt

SEQ ID NO: 404187 - DNA, 20 bp, human
gcgtccgagtcactgagggt

SEQ ID NO: 404188 - DNA, 20 bp, human
ggaccaatcggcggggagat

SEQ ID NO: 404189 - DNA, 20 bp, human
ggagacgtccgagtcactga

SEQ ID NO: 404190 - DNA, 20 bp, human
gcggcggggagatgggacgc

SEQ ID NO: 404191 - DNA, 20 bp, human
gtcctctctaggaatcccgg

SEQ ID NO: 404192 - DNA, 20 bp, human
gggggggcggaccaatcggc

SEQ ID NO: 404193 - DNA, 20 bp, human
gaggacctcacctcgcacgg

SEQ ID NO: 404194 - DNA, 20 bp, human
gggccctgccaccttctgat

SEQ ID NO: 404195 - DNA, 20 bp, human
gaggacgcggaagtgctttc

SEQ ID NO: 404196 - DNA, 20 bp, human
gcggggtcggggtctcgcga

SEQ ID NO: 404197 - DNA, 20 bp, human
gcgtctggatcccccgacta

SEQ ID NO: 404198 - DNA, 20 bp, human
gcccgcccgcggcaggtggc

SEQ ID NO: 404199 - DNA, 20 bp, human
gcacctgccgcgggcggggt

SEQ ID NO: 404200 - DNA, 20 bp, human
gtccccgcacccgggagagc

SEQ ID NO: 404201 - DNA, 20 bp, human
ggtgcccggccacctgccgc

SEQ ID NO: 404202 - DNA, 20 bp, human
gcctgagagcgggatgtgag

SEQ ID NO: 404203 - DNA, 20 bp, human
gctgccagctctcccgggtg

SEQ ID NO: 404204 - DNA, 20 bp, human
gccgactatggcctgagagc

SEQ ID NO: 404205 - DNA, 20 bp, human
ggggctgggagcaccgcatg

SEQ ID NO: 404206 - DNA, 20 bp, human
gggtgaggggcgtggtactc

SEQ ID NO: 404207 - DNA, 20 bp, human
gcgagcgcgcggagctgcat

SEQ ID NO: 404208 - DNA, 20 bp, human
gccgaggcacagcacacagc

SEQ ID NO: 404209 - DNA, 20 bp, human
gcgctcgctgtcaatagtaa

SEQ ID NO: 404210 - DNA, 20 bp, human
gggctggagctgtgaatagg

SEQ ID NO: 404211 - DNA, 20 bp, human
gaatagtaacggtcccctgg

SEQ ID NO: 404212 - DNA, 20 bp, human
gggtctacaagctctatggt

SEQ ID NO: 404213 - DNA, 20 bp, human
gagcctgaggcacgcagacg

SEQ ID NO: 404214 - DNA, 20 bp, human
ggtcggccgactgagggtac

SEQ ID NO: 404215 - DNA, 20 bp, human
gtgaggcacgcagacgcggg

SEQ ID NO: 404216 - DNA, 20 bp, human
ggggtgacgcaaggcagtgg

SEQ ID NO: 404217 - DNA, 20 bp, human
ggggcttaaagctctccgat

SEQ ID NO: 404218 - DNA, 20 bp, human
ggtggggtgacgcaaggcag

SEQ ID NO: 404219 - DNA, 20 bp, human
gggactgaggagcgagaacg

SEQ ID NO: 404220 - DNA, 20 bp, human
gggcaaagggcaaaaagcgc

SEQ ID NO: 404221 - DNA, 20 bp, human
ggggaagcaacgacggccaa

SEQ ID NO: 404222 - DNA, 20 bp, human
gcaccccacctccctttgga

SEQ ID NO: 404223 - DNA, 20 bp, human
gcgctcctcagtccaccaat

SEQ ID NO: 404224 - DNA, 20 bp, human
gcggggctaaaggagcttaa

SEQ ID NO: 404225 - DNA, 20 bp, human
gtttggaggggaagcaacga

SEQ ID NO: 404226 - DNA, 20 bp, human
gtgcgcctgcgctgtctcct

SEQ ID NO: 404227 - DNA, 20 bp, human
gaaacgagctaaggactgga

SEQ ID NO: 404228 - DNA, 20 bp, human
ggagacagcgcaggcgcaag

SEQ ID NO: 404229 - DNA, 20 bp, human
gtgctccaaggagacagcgc

SEQ ID NO: 404230 - DNA, 20 bp, human
gatgaagcaacacggaagta

SEQ ID NO: 404231 - DNA, 20 bp, human
gttgtgttctaaacgagcta

SEQ ID NO: 404232 - DNA, 20 bp, human
gagactccaagcttattgga

SEQ ID NO: 404233 - DNA, 20 bp, human
gagaggagtatgaagcaaca

SEQ ID NO: 404234 - DNA, 20 bp, human
gggagggctatcttgcctta

SEQ ID NO: 404235 - DNA, 20 bp, human
gggcgcttcggccttaaaaa

SEQ ID NO: 404236 - DNA, 20 bp, human
gaccaactctggtacaaatt

SEQ ID NO: 404237 - DNA, 20 bp, human
gcagagtaggaataccaaga

SEQ ID NO: 404238 - DNA, 20 bp, human
gagtaggaataccaagaggg

SEQ ID NO: 404239 - DNA, 20 bp, human
ggagggtggggctcatcctg

SEQ ID NO: 404240 - DNA, 20 bp, human
ggtaccagagttggtctgtt

SEQ ID NO: 404241 - DNA, 20 bp, human
gggaagagactacacagagt

SEQ ID NO: 404242 - DNA, 20 bp, human
gatgccttctgtctttgttt

SEQ ID NO: 404243 - DNA, 20 bp, human
gtatactctctcgaaagcta

SEQ ID NO: 404244 - DNA, 20 bp, human
gctgctcacaataaagcaac

SEQ ID NO: 404245 - DNA, 20 bp, human
gtatagaaaggtctatgggg

SEQ ID NO: 404246 - DNA, 20 bp, human
gcaggggcgcggggttaggc

SEQ ID NO: 404247 - DNA, 20 bp, human
gccactgcgcatgtgcttgg

SEQ ID NO: 404248 - DNA, 20 bp, human
ggcccctgcgctcgcggcca

SEQ ID NO: 404249 - DNA, 20 bp, human
ggtgccctggccgcgagcgc

SEQ ID NO: 404250 - DNA, 20 bp, human
ggcgcgtgggtcaggtgccc

SEQ ID NO: 404251 - DNA, 20 bp, human
gaggaggagactgagggcgc

SEQ ID NO: 404252 - DNA, 20 bp, human
gcggggctgtctgctgagat

SEQ ID NO: 404253 - DNA, 20 bp, human
gcaaaggcacgagtgagagg

SEQ ID NO: 404254 - DNA, 20 bp, human
gcgcagtggcgacgccgagc

SEQ ID NO: 404255 - DNA, 20 bp, human
gaagtgactgcggaaccggg

SEQ ID NO: 404256 - DNA, 20 bp, human
gggctggaggagagccttac

SEQ ID NO: 404257 - DNA, 20 bp, human
gtcctgcccccacattgggc

SEQ ID NO: 404258 - DNA, 20 bp, human
gtctcctccagcccaatgtg

SEQ ID NO: 404259 - DNA, 20 bp, human
gccaaagcaatgagtgaggt

SEQ ID NO: 404260 - DNA, 20 bp, human
gtggctctccagtcccgggc

SEQ ID NO: 404261 - DNA, 20 bp, human
gccaatgtgggggcaggacc

SEQ ID NO: 404262 - DNA, 20 bp, human
gccgggaggccagtggagag

SEQ ID NO: 404263 - DNA, 20 bp, human
gaaactgtgggggggtagga

SEQ ID NO: 404264 - DNA, 20 bp, human
gacaggttgtcaatgaaaca

SEQ ID NO: 404265 - DNA, 20 bp, human
gaaaagaaggagaaactgtg

SEQ ID NO: 404266 - DNA, 20 bp, human
gtaagccgggactgggcgga

SEQ ID NO: 404267 - DNA, 20 bp, human
gagaaggtgatggcgcgcga

SEQ ID NO: 404268 - DNA, 20 bp, human
ggggaatctaagccgggact

SEQ ID NO: 404269 - DNA, 20 bp, human
gaatctaagccgggactggg

SEQ ID NO: 404270 - DNA, 20 bp, human
gcccgccctccgcccagtcc

SEQ ID NO: 404271 - DNA, 20 bp, human
ggtacgcgacgcgaggacgc

SEQ ID NO: 404272 - DNA, 20 bp, human
gaaggtacctggctccccgg

SEQ ID NO: 404273 - DNA, 20 bp, human
gtctgggaagggcgaactga

SEQ ID NO: 404274 - DNA, 20 bp, human
gcccggagctgcagccaccg

SEQ ID NO: 404275 - DNA, 20 bp, human
gtctgtggttcaaaacacga

SEQ ID NO: 404276 - DNA, 20 bp, human
ggtgcggagtcaggccggag

SEQ ID NO: 404277 - DNA, 20 bp, human
gagaacgaggagaggcgaaa

SEQ ID NO: 404278 - DNA, 20 bp, human
gcgcgagccaagccgagcgc

SEQ ID NO: 404279 - DNA, 20 bp, human
gaaaggcgagggagagaacg

SEQ ID NO: 404280 - DNA, 20 bp, human
ggccggccgcccgcaaaagc

SEQ ID NO: 404281 - DNA, 20 bp, human
gaccgaggagcgaggaagag

SEQ ID NO: 404282 - DNA, 20 bp, human
ggtaagtgaatcaactcgcc

SEQ ID NO: 404283 - DNA, 20 bp, human
gccgcccgcaaaagccggtg

SEQ ID NO: 404284 - DNA, 20 bp, human
ggggagtagcggagggagta

SEQ ID NO: 404285 - DNA, 20 bp, human
gcaaaagccggtgcggagtc

SEQ ID NO: 404286 - DNA, 20 bp, human
gctccattgtgccctcggag

SEQ ID NO: 404287 - DNA, 20 bp, human
gcggcccaaagcggcagggt

SEQ ID NO: 404288 - DNA, 20 bp, human
ggagcccgagcggcccaaag

SEQ ID NO: 404289 - DNA, 20 bp, human
ggatccagagagccggggtg

SEQ ID NO: 404290 - DNA, 20 bp, human
ggggggcgcaggtcgcgatc

SEQ ID NO: 404291 - DNA, 20 bp, human
gcggcgggcggggacacgac

SEQ ID NO: 404292 - DNA, 20 bp, human
ggcggggccgagtggaaggc

SEQ ID NO: 404293 - DNA, 20 bp, human
gcgttcagaaaggtgtggag

SEQ ID NO: 404294 - DNA, 20 bp, human
ggcgagcaggaagagcgcag

SEQ ID NO: 404295 - DNA, 20 bp, human
ggggcggccgcgagcccgag

SEQ ID NO: 404296 - DNA, 20 bp, human
gtagaaactaggagggacta

SEQ ID NO: 404297 - DNA, 20 bp, human
gggccggaagtgaggaaggt

SEQ ID NO: 404298 - DNA, 20 bp, human
ggaacccagcgtcaagacgt

SEQ ID NO: 404299 - DNA, 20 bp, human
ggacccaaacgccgagttcc

SEQ ID NO: 404300 - DNA, 20 bp, human
gaccgcggggacgctctgaa

SEQ ID NO: 404301 - DNA, 20 bp, human
ggggcccggaactcggcgtt

SEQ ID NO: 404302 - DNA, 20 bp, human
gtttgggccggaagtgagga

SEQ ID NO: 404303 - DNA, 20 bp, human
gacttccggcccaaagaggg

SEQ ID NO: 404304 - DNA, 20 bp, human
gtgggggcgggtatcggcgt

SEQ ID NO: 404305 - DNA, 20 bp, human
gtttgggtccccgccctctt

SEQ ID NO: 404306 - DNA, 20 bp, human
gggtcccagctccctgaatt

SEQ ID NO: 404307 - DNA, 20 bp, human
ggagtccttacggcccgcat

SEQ ID NO: 404308 - DNA, 20 bp, human
ggggaggggaagagtcctta

SEQ ID NO: 404309 - DNA, 20 bp, human
gttacccttgaagtcgtcgc

SEQ ID NO: 404310 - DNA, 20 bp, human
gtcaagggtaagatcctatg

SEQ ID NO: 404311 - DNA, 20 bp, human
gaattgggaagagcgacttt

SEQ ID NO: 404312 - DNA, 20 bp, human
gtgagtcaagggtcctactt

SEQ ID NO: 404313 - DNA, 20 bp, human
gctcaaccgcagagcacgac

SEQ ID NO: 404314 - DNA, 20 bp, human
gccagccagcgacgacttca

SEQ ID NO: 404315 - DNA, 20 bp, human
gtgcctgagctctgagtcaa

SEQ ID NO: 404316 - DNA, 20 bp, human
gggaccaccctaccgagggg

SEQ ID NO: 404317 - DNA, 20 bp, human
gggacccggccaggagtcga

SEQ ID NO: 404318 - DNA, 20 bp, human
gctcggtagggtggtccgaa

SEQ ID NO: 404319 - DNA, 20 bp, human
gtcagggccccccctcggta

SEQ ID NO: 404320 - DNA, 20 bp, human
gtgaccctggcagacccggt

SEQ ID NO: 404321 - DNA, 20 bp, human
gagtggaacggcagggccgg

SEQ ID NO: 404322 - DNA, 20 bp, human
gcaggtgcgggccactcccc

SEQ ID NO: 404323 - DNA, 20 bp, human
gagccgaagcgggttcggta

SEQ ID NO: 404324 - DNA, 20 bp, human
ggggccccccctcggtaggg

SEQ ID NO: 404325 - DNA, 20 bp, human
gaaggctggccggagcgctt

SEQ ID NO: 404326 - DNA, 20 bp, human
gtggactgggagtctcgcgc

SEQ ID NO: 404327 - DNA, 20 bp, human
gtccaggcggccactggact

SEQ ID NO: 404328 - DNA, 20 bp, human
gtcgagccagccaatggggt

SEQ ID NO: 404329 - DNA, 20 bp, human
gaatgagaggaggggatcac

SEQ ID NO: 404330 - DNA, 20 bp, human
ggggcgggacccggagaggt

SEQ ID NO: 404331 - DNA, 20 bp, human
gccgcctggaaattgcggag

SEQ ID NO: 404332 - DNA, 20 bp, human
ggggacgccgcctttcccgg

SEQ ID NO: 404333 - DNA, 20 bp, human
gaactaacggggccccgggc

SEQ ID NO: 404334 - DNA, 20 bp, human
gggggccccgttagttgaga

SEQ ID NO: 404335 - DNA, 20 bp, human
gagccaatggggttggttgc

SEQ ID NO: 404336 - DNA, 20 bp, human
gtgtgggtgtggctgaggtt

SEQ ID NO: 404337 - DNA, 20 bp, human
gaggactacaagagcaggag

SEQ ID NO: 404338 - DNA, 20 bp, human
gtgaggttaggctagagaag

SEQ ID NO: 404339 - DNA, 20 bp, human
ggctggaaggaagtctcctt

SEQ ID NO: 404340 - DNA, 20 bp, human
gggcaggctagaataggcac

SEQ ID NO: 404341 - DNA, 20 bp, human
gtgctaaggaccatccagga

SEQ ID NO: 404342 - DNA, 20 bp, human
gcaacgaggcaggctagaat

SEQ ID NO: 404343 - DNA, 20 bp, human
ggtagccgaactactagagg

SEQ ID NO: 404344 - DNA, 20 bp, human
gaggaagtctccttaggaac

SEQ ID NO: 404345 - DNA, 20 bp, human
ggagaggccagaagtcaacg

SEQ ID NO: 404346 - DNA, 20 bp, human
gcgcgcacgctcaggaccgg

SEQ ID NO: 404347 - DNA, 20 bp, human
gcatcaggggcgcgcgcaag

SEQ ID NO: 404348 - DNA, 20 bp, human
gtgctcccaccactcaacta

SEQ ID NO: 404349 - DNA, 20 bp, human
gagcggccatagttgagtgg

SEQ ID NO: 404350 - DNA, 20 bp, human
gtaccgcgcacgctcaggac

SEQ ID NO: 404351 - DNA, 20 bp, human
gcctgagcgtgcgcggtaag

SEQ ID NO: 404352 - DNA, 20 bp, human
gcgtgcgcggtaagtggcca

SEQ ID NO: 404353 - DNA, 20 bp, human
gtcaggaccgggggcttggt

SEQ ID NO: 404354 - DNA, 20 bp, human
ggggagcggccatagttgag

SEQ ID NO: 404355 - DNA, 20 bp, human
gtccaaggggccccgtgagt

SEQ ID NO: 404356 - DNA, 20 bp, human
gcaacccgaccgggagttga

SEQ ID NO: 404357 - DNA, 20 bp, human
gtcagggcgccccctcggtg

SEQ ID NO: 404358 - DNA, 20 bp, human
gggcggggagacaacccgac

SEQ ID NO: 404359 - DNA, 20 bp, human
gccaccctccgtgcgctcgt

SEQ ID NO: 404360 - DNA, 20 bp, human
gccagccctcaactcccggt

SEQ ID NO: 404361 - DNA, 20 bp, human
gttcggccaccccaccgagg

SEQ ID NO: 404362 - DNA, 20 bp, human
gtgcgctcgttggctggcga

SEQ ID NO: 404363 - DNA, 20 bp, human
gagtggaactgcagggccgc

SEQ ID NO: 404364 - DNA, 20 bp, human
ggaggcggagaagcagggga

SEQ ID NO: 404365 - DNA, 20 bp, human
gtggcgagggagacgagcct

SEQ ID NO: 404366 - DNA, 20 bp, human
gggagcctgacgggaaaaga

SEQ ID NO: 404367 - DNA, 20 bp, human
ggaaaagagggcggagacca

SEQ ID NO: 404368 - DNA, 20 bp, human
ggtcccgcccactaccactg

SEQ ID NO: 404369 - DNA, 20 bp, human
gcggccgcagtggtagtggg

SEQ ID NO: 404370 - DNA, 20 bp, human
gcagggaggcgacagaaggt

SEQ ID NO: 404371 - DNA, 20 bp, human
ggggaagttctactcagctc

SEQ ID NO: 404372 - DNA, 20 bp, human
gaaggctgcgcaggcgtggt

SEQ ID NO: 404373 - DNA, 20 bp, human
ggtcgcctccctgctaccgg

SEQ ID NO: 404374 - DNA, 20 bp, human
gcgttgcgttgggatggatc

SEQ ID NO: 404375 - DNA, 20 bp, human
gaccggaggagcactggaat

SEQ ID NO: 404376 - DNA, 20 bp, human
gcagcctcgcgaccccctgg

SEQ ID NO: 404377 - DNA, 20 bp, human
gagtgctggcagacacgggt

SEQ ID NO: 404378 - DNA, 20 bp, human
gtcgcgaggctgcagtactg

SEQ ID NO: 404379 - DNA, 20 bp, human
ggtctgccagcactccgtat

SEQ ID NO: 404380 - DNA, 20 bp, human
gcagggcgcccccatcttac

SEQ ID NO: 404381 - DNA, 20 bp, human
gtcgcgaccccctggagggt

SEQ ID NO: 404382 - DNA, 20 bp, human
gcagacacgggtgggtgtct

SEQ ID NO: 404383 - DNA, 20 bp, human
gggctggtaactgactaaac

SEQ ID NO: 404384 - DNA, 20 bp, human
ggaagcccggggtcttttga

SEQ ID NO: 404385 - DNA, 20 bp, human
ggaaaacccgcccctgccgc

SEQ ID NO: 404386 - DNA, 20 bp, human
gtaggcgcgagccacctcca

SEQ ID NO: 404387 - DNA, 20 bp, human
gggcccaggccgcactgcgc

SEQ ID NO: 404388 - DNA, 20 bp, human
gggcagtcgcgtaggcgagg

SEQ ID NO: 404389 - DNA, 20 bp, human
gcgcctgcgcagtgcggcct

SEQ ID NO: 404390 - DNA, 20 bp, human
gtggcgattggcagtcgcgt

SEQ ID NO: 404391 - DNA, 20 bp, human
gcgcggctaacccgtttcca

SEQ ID NO: 404392 - DNA, 20 bp, human
gtagagacccgcccggattt

SEQ ID NO: 404393 - DNA, 20 bp, human
gtgccaatcgccatagtatt

SEQ ID NO: 404394 - DNA, 20 bp, human
gggacaggacagttgcggga

SEQ ID NO: 404395 - DNA, 20 bp, human
gggtggctcgcgcctaaatc

SEQ ID NO: 404396 - DNA, 20 bp, human
gggcgcgagggggcattgtc

SEQ ID NO: 404397 - DNA, 20 bp, human
gcaggcaccgggtccacccg

SEQ ID NO: 404398 - DNA, 20 bp, human
gcgaagggctccgggctcga

SEQ ID NO: 404399 - DNA, 20 bp, human
ggcgaccgcggcgttctctg

SEQ ID NO: 404400 - DNA, 20 bp, human
ggcgccgaagacaggacgtg

SEQ ID NO: 404401 - DNA, 20 bp, human
gcgcggtcgcgcctgagcga

SEQ ID NO: 404402 - DNA, 20 bp, human
gggtcgcgcctgagcgaggg

SEQ ID NO: 404403 - DNA, 20 bp, human
gggaagacgcgagtaagtgc

SEQ ID NO: 404404 - DNA, 20 bp, human
gaccgcggcgttctctgagg

SEQ ID NO: 404405 - DNA, 20 bp, human
gaggtggagtattacaaaca

SEQ ID NO: 404406 - DNA, 20 bp, human
gggacctagtgtcaaaagaa

SEQ ID NO: 404407 - DNA, 20 bp, human
gccgcgccgtactgagtggg

SEQ ID NO: 404408 - DNA, 20 bp, human
ggctgggtgggcatctggta

SEQ ID NO: 404409 - DNA, 20 bp, human
gggccgagaaacgactccca

SEQ ID NO: 404410 - DNA, 20 bp, human
gtccagaaaggcccgtacag

SEQ ID NO: 404411 - DNA, 20 bp, human
gacaccaggtaggcgagaag

SEQ ID NO: 404412 - DNA, 20 bp, human
ggcgccgcgccgtactgagt

SEQ ID NO: 404413 - DNA, 20 bp, human
gacaagtcccacgggtcaaa

SEQ ID NO: 404414 - DNA, 20 bp, human
gggcgcctgcgcacgtttcg

SEQ ID NO: 404415 - DNA, 20 bp, human
gaggctaggaaacgaacgtg

SEQ ID NO: 404416 - DNA, 20 bp, human
gctgggcccggctccgtcga

SEQ ID NO: 404417 - DNA, 20 bp, human
gcagccgcctcacaggtcgg

SEQ ID NO: 404418 - DNA, 20 bp, human
gggaagtgaaagtgcctcgg

SEQ ID NO: 404419 - DNA, 20 bp, human
gacggcccgaggagccgatt

SEQ ID NO: 404420 - DNA, 20 bp, human
gctcctgaaccgaaccgaat

SEQ ID NO: 404421 - DNA, 20 bp, human
gccgaggagccgattcggtt

SEQ ID NO: 404422 - DNA, 20 bp, human
ggcccggctccgtcgaggga

SEQ ID NO: 404423 - DNA, 20 bp, human
gcgtccgccgacctgtgagg

SEQ ID NO: 404424 - DNA, 20 bp, human
gcgccgccggagttttcttt

SEQ ID NO: 404425 - DNA, 20 bp, human
ggacgcagggaaagccgagg

SEQ ID NO: 404426 - DNA, 20 bp, human
ggcactcgccctcctcctat

SEQ ID NO: 404427 - DNA, 20 bp, human
ggcgccggcgctctggggag

SEQ ID NO: 404428 - DNA, 20 bp, human
gcagcggcgccgcgcctaga

SEQ ID NO: 404429 - DNA, 20 bp, human
ggcaacaaccaataggagga

SEQ ID NO: 404430 - DNA, 20 bp, human
ggccgtgcgcgcctagccat

SEQ ID NO: 404431 - DNA, 20 bp, human
gcgcgccgacgtcagtttcg

SEQ ID NO: 404432 - DNA, 20 bp, human
gccccgcaacaaccaatagg

SEQ ID NO: 404433 - DNA, 20 bp, human
gcttcccgcgaaactgacgt

SEQ ID NO: 404434 - DNA, 20 bp, human
gcgccgctcggccaatggct

SEQ ID NO: 404435 - DNA, 20 bp, human
gcgcaccacagcgagcggag

SEQ ID NO: 404436 - DNA, 20 bp, human
gttgccggggcagccaatcg

SEQ ID NO: 404437 - DNA, 20 bp, human
ggtgtaaagccgccccggat

SEQ ID NO: 404438 - DNA, 20 bp, human
gctcacaaagataatcgctc

SEQ ID NO: 404439 - DNA, 20 bp, human
gcatccccgattggctgccc

SEQ ID NO: 404440 - DNA, 20 bp, human
gtcggagtgtaaagccgccc

SEQ ID NO: 404441 - DNA, 20 bp, human
gattggctgccccggcaaat

SEQ ID NO: 404442 - DNA, 20 bp, human
gaagtgtttcagccaatccg

SEQ ID NO: 404443 - DNA, 20 bp, human
ggtgcaggagaagtgcgtgt

SEQ ID NO: 404444 - DNA, 20 bp, human
ggtgccgggaaatctagcca

SEQ ID NO: 404445 - DNA, 20 bp, human
ggcccggaggtccctgggaa

SEQ ID NO: 404446 - DNA, 20 bp, human
gggcgggcgtaggaccaatg

SEQ ID NO: 404447 - DNA, 20 bp, human
gcgccccgggaccctagagc

SEQ ID NO: 404448 - DNA, 20 bp, human
gcgcgcggctgacgggctgg

SEQ ID NO: 404449 - DNA, 20 bp, human
gcgtccgcggtcccgcccga

SEQ ID NO: 404450 - DNA, 20 bp, human
gcccggggcgcgcggctgac

SEQ ID NO: 404451 - DNA, 20 bp, human
gcacagaccaggcccctctg

SEQ ID NO: 404452 - DNA, 20 bp, human
gagagccggcgattcgtcgc

SEQ ID NO: 404453 - DNA, 20 bp, human
gcgtgcgttcgcagcagggg

SEQ ID NO: 404454 - DNA, 20 bp, human
ggggcctggtctgtgcgtca

SEQ ID NO: 404455 - DNA, 20 bp, human
gactctgtgccggaccctgc

SEQ ID NO: 404456 - DNA, 20 bp, human
gactgccccctcttctgaca

SEQ ID NO: 404457 - DNA, 20 bp, human
gcttaaatccccgccctgtc

SEQ ID NO: 404458 - DNA, 20 bp, human
gtgtcactcaaagcctgaca

SEQ ID NO: 404459 - DNA, 20 bp, human
gactcaaagcctgacagggc

SEQ ID NO: 404460 - DNA, 20 bp, human
gctcaggctgcctgctcaaa

SEQ ID NO: 404461 - DNA, 20 bp, human
gaccttatacacaaatttaa

SEQ ID NO: 404462 - DNA, 20 bp, human
gggcaaatactctctgggat

SEQ ID NO: 404463 - DNA, 20 bp, human
gttctcttttctaaaatctc

SEQ ID NO: 404464 - DNA, 20 bp, human
gaaaatttcaaatccacatg

SEQ ID NO: 404465 - DNA, 20 bp, human
ggcctttaaatttgtgtata

SEQ ID NO: 404466 - DNA, 20 bp, human
gcccctggggcttgagcgac

SEQ ID NO: 404467 - DNA, 20 bp, human
gggggcttgagcgacaggag

SEQ ID NO: 404468 - DNA, 20 bp, human
gacagcgagcggattatttg

SEQ ID NO: 404469 - DNA, 20 bp, human
gtgtgtggggtgtgactgac

SEQ ID NO: 404470 - DNA, 20 bp, human
gtcacaccccacacagcgag

SEQ ID NO: 404471 - DNA, 20 bp, human
ggccgcacagcgcctctgac

SEQ ID NO: 404472 - DNA, 20 bp, human
gtcctcccggcgcacctgat

SEQ ID NO: 404473 - DNA, 20 bp, human
gggtccaaggtcccagcgag

SEQ ID NO: 404474 - DNA, 20 bp, human
gtgcggcaaactgtccaatc

SEQ ID NO: 404475 - DNA, 20 bp, human
gaataatccgctcgctgtgt

SEQ ID NO: 404476 - DNA, 20 bp, human
gtagtccaggcaaacttttt

SEQ ID NO: 404477 - DNA, 20 bp, human
ggggtggaaacaagagtagg

SEQ ID NO: 404478 - DNA, 20 bp, human
gcccaagtcggtaactaaat

SEQ ID NO: 404479 - DNA, 20 bp, human
gtccggaatcctcacattcc

SEQ ID NO: 404480 - DNA, 20 bp, human
gggcgcagccaatcccaagt

SEQ ID NO: 404481 - DNA, 20 bp, human
ggcctggaatgtgaggattc

SEQ ID NO: 404482 - DNA, 20 bp, human
gcaggcaaacttttttggtc

SEQ ID NO: 404483 - DNA, 20 bp, human
gtccagtgaaagttaagggg

SEQ ID NO: 404484 - DNA, 20 bp, human
gcggaccccaggagtagtcc

SEQ ID NO: 404485 - DNA, 20 bp, human
gaagactggcttctgaagac

SEQ ID NO: 404486 - DNA, 20 bp, human
ggtggacctggctcaactca

SEQ ID NO: 404487 - DNA, 20 bp, human
gccagcccagcagtcctgat

SEQ ID NO: 404488 - DNA, 20 bp, human
gttatccaatcaggactgct

SEQ ID NO: 404489 - DNA, 20 bp, human
gatgccttctggggtggacc

SEQ ID NO: 404490 - DNA, 20 bp, human
gctcagggcctgagggagca

SEQ ID NO: 404491 - DNA, 20 bp, human
gtctcaatcggcctgctcaa

SEQ ID NO: 404492 - DNA, 20 bp, human
gtagcagtcaaacttcaaga

SEQ ID NO: 404493 - DNA, 20 bp, human
gtgcatatgactttatatac

SEQ ID NO: 404494 - DNA, 20 bp, human
gaaaatttagaatacacatg

SEQ ID NO: 404495 - DNA, 20 bp, human
ggattgagagtttaaaaagg

SEQ ID NO: 404496 - DNA, 20 bp, human
gtgcctaggacgcaagtacc

SEQ ID NO: 404497 - DNA, 20 bp, human
ggccgtctccctgatcccgt

SEQ ID NO: 404498 - DNA, 20 bp, human
gaggctctcagcttggcacc

SEQ ID NO: 404499 - DNA, 20 bp, human
gtggactagcagtataaaat

SEQ ID NO: 404500 - DNA, 20 bp, human
gggtcagagacacacgcgcc

SEQ ID NO: 404501 - DNA, 20 bp, human
ggagacacacgcgccaggaa

SEQ ID NO: 404502 - DNA, 20 bp, human
ggcatgaaaggcgcctttcc

SEQ ID NO: 404503 - DNA, 20 bp, human
gctttcatgcacggtccgct

SEQ ID NO: 404504 - DNA, 20 bp, human
ggcatttcggttccaggaag

SEQ ID NO: 404505 - DNA, 20 bp, human
gctagcagtataaaattgga

SEQ ID NO: 404506 - DNA, 20 bp, human
gtaaaagggcggaaacagac

SEQ ID NO: 404507 - DNA, 20 bp, human
gagggcggaaacagacaggt

SEQ ID NO: 404508 - DNA, 20 bp, human
gccccccatccgttgactag

SEQ ID NO: 404509 - DNA, 20 bp, human
gagccgctagtcaacggatg

SEQ ID NO: 404510 - DNA, 20 bp, human
gagcccgcaaggaggcgcgt

SEQ ID NO: 404511 - DNA, 20 bp, human
gcagccaacgcgcctccttg

SEQ ID NO: 404512 - DNA, 20 bp, human
gagcaagcggccggagtctc

SEQ ID NO: 404513 - DNA, 20 bp, human
ggtagcaaaaacataaaaat

SEQ ID NO: 404514 - DNA, 20 bp, human
gcgcccttttacagtactga

SEQ ID NO: 404515 - DNA, 20 bp, human
gctggagagcctaggaacgg

SEQ ID NO: 404516 - DNA, 20 bp, human
gggcaaatgccgtctgggga

SEQ ID NO: 404517 - DNA, 20 bp, human
gacaaggcaaatgccgtctg

SEQ ID NO: 404518 - DNA, 20 bp, human
ggctctgcctgaaaaggctt

SEQ ID NO: 404519 - DNA, 20 bp, human
ggtgaaccctaagccttttc

SEQ ID NO: 404520 - DNA, 20 bp, human
gctacaggatagctggaata

SEQ ID NO: 404521 - DNA, 20 bp, human
gttcagacggttgccttaca

SEQ ID NO: 404522 - DNA, 20 bp, human
gaggaagcacaggaggtttg

SEQ ID NO: 404523 - DNA, 20 bp, human
ggctcacattttatttcaga

SEQ ID NO: 404524 - DNA, 20 bp, human
gtgctagaaaggtaaaatac

SEQ ID NO: 404525 - DNA, 20 bp, human
ggaactgcgatgtgctagaa

SEQ ID NO: 404526 - DNA, 20 bp, human
ggggacccgccgccggtccc

SEQ ID NO: 404527 - DNA, 20 bp, human
ggagaggggtgcacatgcgc

SEQ ID NO: 404528 - DNA, 20 bp, human
gcacatgcgcaggaatgcac

SEQ ID NO: 404529 - DNA, 20 bp, human
gcgcgaacacgcacacagag

SEQ ID NO: 404530 - DNA, 20 bp, human
gaagacgttcccttaaacta

SEQ ID NO: 404531 - DNA, 20 bp, human
ggagtcacggtatttgtcct

SEQ ID NO: 404532 - DNA, 20 bp, human
gcaaatggctcctaaatttg

SEQ ID NO: 404533 - DNA, 20 bp, human
gtgggccagtcctgccttac

SEQ ID NO: 404534 - DNA, 20 bp, human
gttaagggaacgtcttcatg

SEQ ID NO: 404535 - DNA, 20 bp, human
gatctggtctagcggttaag

SEQ ID NO: 404536 - DNA, 20 bp, human
gcggacaggcccttacttgg

SEQ ID NO: 404537 - DNA, 20 bp, human
gcccgcccttccagcaggtc

SEQ ID NO: 404538 - DNA, 20 bp, human
gacaggcccttacttggggg

SEQ ID NO: 404539 - DNA, 20 bp, human
ggtggccggacctgctggaa

SEQ ID NO: 404540 - DNA, 20 bp, human
ggtccggccacctgaaccgc

SEQ ID NO: 404541 - DNA, 20 bp, human
gcacctgggaaaagctctgc

SEQ ID NO: 404542 - DNA, 20 bp, human
gcccggctagccggcggttc

SEQ ID NO: 404543 - DNA, 20 bp, human
ggtgggacccggctagccgg

SEQ ID NO: 404544 - DNA, 20 bp, human
gtgtttgactgggtcctatg

SEQ ID NO: 404545 - DNA, 20 bp, human
ggttcgagtttcagccacat

SEQ ID NO: 404546 - DNA, 20 bp, human
ggccccggcagcggcagcta

SEQ ID NO: 404547 - DNA, 20 bp, human
gtggcgctcacgaagggcga

SEQ ID NO: 404548 - DNA, 20 bp, human
gagtgccggcccggtcgggg

SEQ ID NO: 404549 - DNA, 20 bp, human
gccactgaggggtgtgggta

SEQ ID NO: 404550 - DNA, 20 bp, human
gaccgggccggcactcactg

SEQ ID NO: 404551 - DNA, 20 bp, human
gtccgggcgccgaccagcaa

SEQ ID NO: 404552 - DNA, 20 bp, human
gccgtcaccgcgtcgagctc

SEQ ID NO: 404553 - DNA, 20 bp, human
gagcggggcccgagcagaag

SEQ ID NO: 404554 - DNA, 20 bp, human
ggagggcgacccacgggtta

SEQ ID NO: 404555 - DNA, 20 bp, human
gcgccgaccagcaagggaac

SEQ ID NO: 404556 - DNA, 20 bp, human
gagggaaatagcgtcataga

SEQ ID NO: 404557 - DNA, 20 bp, human
gggcaccgcgagggtccttc

SEQ ID NO: 404558 - DNA, 20 bp, human
ggacctagcagtagcgtgac

SEQ ID NO: 404559 - DNA, 20 bp, human
gccggaagtgcctgtctcct

SEQ ID NO: 404560 - DNA, 20 bp, human
gccgagctgtcattgagagg

SEQ ID NO: 404561 - DNA, 20 bp, human
gtgccaaggtgattgaggaa

SEQ ID NO: 404562 - DNA, 20 bp, human
gggaccctcgcggtgcctca

SEQ ID NO: 404563 - DNA, 20 bp, human
gtgcccgtcacgctactgct

SEQ ID NO: 404564 - DNA, 20 bp, human
gggaccgcgttgtcaggcga

SEQ ID NO: 404565 - DNA, 20 bp, human
ggaaatagcgtcatagacgg

SEQ ID NO: 404566 - DNA, 20 bp, human
ggccaccaggcgcgccctga

SEQ ID NO: 404567 - DNA, 20 bp, human
gaaggggcggggccggtacc

SEQ ID NO: 404568 - DNA, 20 bp, human
gtggtggcgccgagcatcct

SEQ ID NO: 404569 - DNA, 20 bp, human
gtgccacagtggccattctc

SEQ ID NO: 404570 - DNA, 20 bp, human
ggggtgcggaagtcgctcca

SEQ ID NO: 404571 - DNA, 20 bp, human
gagggccaggcactcttctc

SEQ ID NO: 404572 - DNA, 20 bp, human
gagctcccattggcctctga

SEQ ID NO: 404573 - DNA, 20 bp, human
gagtaacacgctccggtcac

SEQ ID NO: 404574 - DNA, 20 bp, human
gacagaggcgctcagaagga

SEQ ID NO: 404575 - DNA, 20 bp, human
gcagaaggagggtcacagta

SEQ ID NO: 404576 - DNA, 20 bp, human
ggcccggcggcggcactctt

SEQ ID NO: 404577 - DNA, 20 bp, human
gtcccctgcacgctgggcaa

SEQ ID NO: 404578 - DNA, 20 bp, human
ggggcggcgcacaggtttct

SEQ ID NO: 404579 - DNA, 20 bp, human
gaggccaaatggtactgcga

SEQ ID NO: 404580 - DNA, 20 bp, human
gtggcctttgcccagcgtgc

SEQ ID NO: 404581 - DNA, 20 bp, human
gcggacggaagctctctggg

SEQ ID NO: 404582 - DNA, 20 bp, human
ggtgcacttggccgtggtga

SEQ ID NO: 404583 - DNA, 20 bp, human
gccctgagactctgaggtca

SEQ ID NO: 404584 - DNA, 20 bp, human
gaaacctgtgcgccgcccgg

SEQ ID NO: 404585 - DNA, 20 bp, human
gggggagttagccgtcacca

SEQ ID NO: 404586 - DNA, 20 bp, human
gggtgcctgggcatcaacgc

SEQ ID NO: 404587 - DNA, 20 bp, human
ggactgggcctggtgaaaca

SEQ ID NO: 404588 - DNA, 20 bp, human
gaaagcccgtgtggtcgcgc

SEQ ID NO: 404589 - DNA, 20 bp, human
ggggtccggggatcttcctg

SEQ ID NO: 404590 - DNA, 20 bp, human
gaacgccaagggcgagagcg

SEQ ID NO: 404591 - DNA, 20 bp, human
gtgagctaggccggcgagga

SEQ ID NO: 404592 - DNA, 20 bp, human
ggctcccggcgcgaccacac

SEQ ID NO: 404593 - DNA, 20 bp, human
gaccacacgggctttcgtgt

SEQ ID NO: 404594 - DNA, 20 bp, human
gccaagggcgagagcgaggt

SEQ ID NO: 404595 - DNA, 20 bp, human
gtgagagctcacgaacgcca

SEQ ID NO: 404596 - DNA, 20 bp, human
gcgaagctgtacccaatcag

SEQ ID NO: 404597 - DNA, 20 bp, human
gtctgcagctgcgtccccga

SEQ ID NO: 404598 - DNA, 20 bp, human
gacatctgtcaagatgcagg

SEQ ID NO: 404599 - DNA, 20 bp, human
gggccccagccctcaaacgc

SEQ ID NO: 404600 - DNA, 20 bp, human
gccccgacggcgcgcctgat

SEQ ID NO: 404601 - DNA, 20 bp, human
gctctgcgatcggtccaatc

SEQ ID NO: 404602 - DNA, 20 bp, human
gcggggaggagctctgcgat

SEQ ID NO: 404603 - DNA, 20 bp, human
gaagtccaccctgcgtttga

SEQ ID NO: 404604 - DNA, 20 bp, human
gaccctgcgtttgagggctg

SEQ ID NO: 404605 - DNA, 20 bp, human
gagtacagtgaaggggacga

SEQ ID NO: 404606 - DNA, 20 bp, human
ggacagatgtgctcaggtgc

SEQ ID NO: 404607 - DNA, 20 bp, human
gggacatgacgtcttccggg

SEQ ID NO: 404608 - DNA, 20 bp, human
gacgtcatgtccgctccagc

SEQ ID NO: 404609 - DNA, 20 bp, human
gagcagcagccttttccaga

SEQ ID NO: 404610 - DNA, 20 bp, human
gagcggacatgacgtcttcc

SEQ ID NO: 404611 - DNA, 20 bp, human
gggtctttgtctcgctgcag

SEQ ID NO: 404612 - DNA, 20 bp, human
gcatgacgtcttccgggagg

SEQ ID NO: 404613 - DNA, 20 bp, human
ggagcccgagatgcggagtt

SEQ ID NO: 404614 - DNA, 20 bp, human
gccagtacggttataaaatc

SEQ ID NO: 404615 - DNA, 20 bp, human
ggattggaccgttcccagcc

SEQ ID NO: 404616 - DNA, 20 bp, human
gagtgacagcggagcaggaa

SEQ ID NO: 404617 - DNA, 20 bp, human
gaacacttaaaatggatggg

SEQ ID NO: 404618 - DNA, 20 bp, human
gggaaggggcgtggttgagc

SEQ ID NO: 404619 - DNA, 20 bp, human
ggacaagccggactgaagcc

SEQ ID NO: 404620 - DNA, 20 bp, human
gcgtcctggcggggacaagc

SEQ ID NO: 404621 - DNA, 20 bp, human
gggtttaaacgcaaacgtcc

SEQ ID NO: 404622 - DNA, 20 bp, human
gtaaacgcaaacgtcctggc

SEQ ID NO: 404623 - DNA, 20 bp, human
gccattggatctgtccaatc

SEQ ID NO: 404624 - DNA, 20 bp, human
gtcactcagtgataaagagg

SEQ ID NO: 404625 - DNA, 20 bp, human
ggataaagaggcggggccat

SEQ ID NO: 404626 - DNA, 20 bp, human
ggcgctctgggagttccagt

SEQ ID NO: 404627 - DNA, 20 bp, human
gggcctggttggggtgacgt

SEQ ID NO: 404628 - DNA, 20 bp, human
gaccgtgcgcaaaagagcgg

SEQ ID NO: 404629 - DNA, 20 bp, human
gctgccgtgcccagaacgcc

SEQ ID NO: 404630 - DNA, 20 bp, human
gcacgccagcgaagcactgt

SEQ ID NO: 404631 - DNA, 20 bp, human
ggcccggtgcgccagagcat

SEQ ID NO: 404632 - DNA, 20 bp, human
gcggggtcgcggttgtttct

SEQ ID NO: 404633 - DNA, 20 bp, human
gcttgcgcgcagggccgcat

SEQ ID NO: 404634 - DNA, 20 bp, human
ggactcccacagtgcttcgc

SEQ ID NO: 404635 - DNA, 20 bp, human
ggccaggagacaaagaacga

SEQ ID NO: 404636 - DNA, 20 bp, human
gtcactcaaggtctgatggc

SEQ ID NO: 404637 - DNA, 20 bp, human
gtcactctcgccacattccg

SEQ ID NO: 404638 - DNA, 20 bp, human
ggtggcgagagtgacagccg

SEQ ID NO: 404639 - DNA, 20 bp, human
ggagagctgtgcacccaact

SEQ ID NO: 404640 - DNA, 20 bp, human
gccacattccgtggagtatg

SEQ ID NO: 404641 - DNA, 20 bp, human
gtgtgaggacggactgaggt

SEQ ID NO: 404642 - DNA, 20 bp, human
gagaggaggcggtggcttcc

SEQ ID NO: 404643 - DNA, 20 bp, human
ggcgcgaggagcaggttcac

SEQ ID NO: 404644 - DNA, 20 bp, human
gccagtgcgctgattggata

SEQ ID NO: 404645 - DNA, 20 bp, human
gtgcgtgtataatttctaaa

SEQ ID NO: 404646 - DNA, 20 bp, human
gcggtgagagggctgagtga

SEQ ID NO: 404647 - DNA, 20 bp, human
ggagagtcacggcggtgaga

SEQ ID NO: 404648 - DNA, 20 bp, human
ggagggccagagagtcacgg

SEQ ID NO: 404649 - DNA, 20 bp, human
gctctggggtagagtggcgt

SEQ ID NO: 404650 - DNA, 20 bp, human
gtagatgaaaggacccgggg

SEQ ID NO: 404651 - DNA, 20 bp, human
ggctctcgatggtgcttctc

SEQ ID NO: 404652 - DNA, 20 bp, human
gcgcggtgaaaccatcgaga

SEQ ID NO: 404653 - DNA, 20 bp, human
gctctggccctccgtctcga

SEQ ID NO: 404654 - DNA, 20 bp, human
gagcaccatcgagagctctg

SEQ ID NO: 404655 - DNA, 20 bp, human
gttaccccaaaccatgtggc

SEQ ID NO: 404656 - DNA, 20 bp, human
gtgcgcgagccactcagggg

SEQ ID NO: 404657 - DNA, 20 bp, human
gtggctgacgtcagttgagt

SEQ ID NO: 404658 - DNA, 20 bp, human
gaacccgcatagtgtgtctg

SEQ ID NO: 404659 - DNA, 20 bp, human
gtgagtgggcgcggctaggg

SEQ ID NO: 404660 - DNA, 20 bp, human
ggacgcttccggttttccat

SEQ ID NO: 404661 - DNA, 20 bp, human
gactcgctagtcagtgaggc

SEQ ID NO: 404662 - DNA, 20 bp, human
ggacgtcagttgagtgggcg

SEQ ID NO: 404663 - DNA, 20 bp, human
ggggcctcagacacactatg

SEQ ID NO: 404664 - DNA, 20 bp, human
gacagcccaatggaagctgg

SEQ ID NO: 404665 - DNA, 20 bp, human
gggggtccgtctgggataag

SEQ ID NO: 404666 - DNA, 20 bp, human
gaggcggccaagttcgcggg

SEQ ID NO: 404667 - DNA, 20 bp, human
gtcgaccagtaaagcctcaa

SEQ ID NO: 404668 - DNA, 20 bp, human
gcggcccgcctcggtcaccg

SEQ ID NO: 404669 - DNA, 20 bp, human
ggcctgagaagcgacgttgc

SEQ ID NO: 404670 - DNA, 20 bp, human
gaccagcaacgtcgcttctc

SEQ ID NO: 404671 - DNA, 20 bp, human
gaaggaggcggccaagttcg

SEQ ID NO: 404672 - DNA, 20 bp, human
gccgcgtcgcggagacttct

SEQ ID NO: 404673 - DNA, 20 bp, human
gtgtgacgatggagctcttg

SEQ ID NO: 404674 - DNA, 20 bp, human
ggctccatcgtcacagaagg

SEQ ID NO: 404675 - DNA, 20 bp, human
gaacgtcgcttctcaggcct

SEQ ID NO: 404676 - DNA, 20 bp, human
gtctctgcgccagacgaggg

SEQ ID NO: 404677 - DNA, 20 bp, human
gtggctggaaagacacagcg

SEQ ID NO: 404678 - DNA, 20 bp, human
gaggtctctgcgccagacga

SEQ ID NO: 404679 - DNA, 20 bp, human
gcctgcgtgtcaccagccca

SEQ ID NO: 404680 - DNA, 20 bp, human
gcgcggcggcgctctagctg

SEQ ID NO: 404681 - DNA, 20 bp, human
ggcacacgggaagcgctccg

SEQ ID NO: 404682 - DNA, 20 bp, human
ggctggtgacacgcaggcgc

SEQ ID NO: 404683 - DNA, 20 bp, human
gtctggcgcagagacctggc

SEQ ID NO: 404684 - DNA, 20 bp, human
gtgtgggaagccccgcacac

SEQ ID NO: 404685 - DNA, 20 bp, human
gggctcgggtccagcttcca

SEQ ID NO: 404686 - DNA, 20 bp, human
gggcgctgggcgatgagaaa

SEQ ID NO: 404687 - DNA, 20 bp, human
gtgtgactctcaaggaaagt

SEQ ID NO: 404688 - DNA, 20 bp, human
ggatcccgaggtgggtgccg

SEQ ID NO: 404689 - DNA, 20 bp, human
gaagcgaagctccagggcgc

SEQ ID NO: 404690 - DNA, 20 bp, human
gggttggtgcaaagggtccc

SEQ ID NO: 404691 - DNA, 20 bp, human
gagaaaggacgggacttttg

SEQ ID NO: 404692 - DNA, 20 bp, human
gtaaaatggccgccacgaag

SEQ ID NO: 404693 - DNA, 20 bp, human
gggccattttagcttctctg

SEQ ID NO: 404694 - DNA, 20 bp, human
gggagtaaaagcgaagctcc

SEQ ID NO: 404695 - DNA, 20 bp, human
gcctccactgccctaggact

SEQ ID NO: 404696 - DNA, 20 bp, human
gggcgtttcgcgagtagctt

SEQ ID NO: 404697 - DNA, 20 bp, human
ggtttcgcgagtagcttggg

SEQ ID NO: 404698 - DNA, 20 bp, human
gcgagtagcttgggaggcgt

SEQ ID NO: 404699 - DNA, 20 bp, human
gtgtggagtcgtgggaactt

SEQ ID NO: 404700 - DNA, 20 bp, human
gttgggaggcgtgggaattt

SEQ ID NO: 404701 - DNA, 20 bp, human
gctgcgggagtctaattgcc

SEQ ID NO: 404702 - DNA, 20 bp, human
gggtcgatgcgcaggaaatt

SEQ ID NO: 404703 - DNA, 20 bp, human
gggcgtgggaattttggccc

SEQ ID NO: 404704 - DNA, 20 bp, human
ggaagtgtcgatgatgccac

SEQ ID NO: 404705 - DNA, 20 bp, human
gggcgtgagaattttggctc

SEQ ID NO: 404706 - DNA, 20 bp, human
gatccccagagcatgagtca

SEQ ID NO: 404707 - DNA, 20 bp, human
gtggtagagccactcaagaa

SEQ ID NO: 404708 - DNA, 20 bp, human
ggagtagcgagtgaagcacc

SEQ ID NO: 404709 - DNA, 20 bp, human
gtcaaggcagatctgggttt

SEQ ID NO: 404710 - DNA, 20 bp, human
gagaactggggcagtgctta

SEQ ID NO: 404711 - DNA, 20 bp, human
gacctggtgggtgactgtga

SEQ ID NO: 404712 - DNA, 20 bp, human
gctggggatgctgaacattg

SEQ ID NO: 404713 - DNA, 20 bp, human
ggggccaaattaatgagctt

SEQ ID NO: 404714 - DNA, 20 bp, human
gccaccttgactcatgctct

SEQ ID NO: 404715 - DNA, 20 bp, human
gcttggggtcccttcttgag

SEQ ID NO: 404716 - DNA, 20 bp, human
ggctagtgggaccaggtctg

SEQ ID NO: 404717 - DNA, 20 bp, human
gggaggccggggcgactctg

SEQ ID NO: 404718 - DNA, 20 bp, human
gggcctcccgccatctagag

SEQ ID NO: 404719 - DNA, 20 bp, human
gccgccgctcgttctatctg

SEQ ID NO: 404720 - DNA, 20 bp, human
gctgccccagatagaacgag

SEQ ID NO: 404721 - DNA, 20 bp, human
ggcagcgtagcctctctaga

SEQ ID NO: 404722 - DNA, 20 bp, human
gggtcaactctgaaaaaaag

SEQ ID NO: 404723 - DNA, 20 bp, human
gagcctctctagatggcggg

SEQ ID NO: 404724 - DNA, 20 bp, human
gcaaccagacgcagggtccc

SEQ ID NO: 404725 - DNA, 20 bp, human
gaagacgtctcagccaacgc

SEQ ID NO: 404726 - DNA, 20 bp, human
gccggggcggggtccgagat

SEQ ID NO: 404727 - DNA, 20 bp, human
gggaccccagggaaggaacg

SEQ ID NO: 404728 - DNA, 20 bp, human
ggaacggggaggagccaccg

SEQ ID NO: 404729 - DNA, 20 bp, human
ggaagggcggggaggaaccg

SEQ ID NO: 404730 - DNA, 20 bp, human
gaccaagtggagggacccgg

SEQ ID NO: 404731 - DNA, 20 bp, human
gtggggagtgaccaagtgga

SEQ ID NO: 404732 - DNA, 20 bp, human
gaagcaggggccgccaggca

SEQ ID NO: 404733 - DNA, 20 bp, human
gaaccgcgggaagggaccgc

SEQ ID NO: 404734 - DNA, 20 bp, human
gcggggaggaaccgcgggaa

SEQ ID NO: 404735 - DNA, 20 bp, human
ggaaggcgaagggaccgcgg

SEQ ID NO: 404736 - DNA, 20 bp, human
ggatctcagggcttgaagga

SEQ ID NO: 404737 - DNA, 20 bp, human
gcgcccgaagagacccagga

SEQ ID NO: 404738 - DNA, 20 bp, human
ggtgagtctgcgcagaaggc

SEQ ID NO: 404739 - DNA, 20 bp, human
gactcacaagtccctgtgga

SEQ ID NO: 404740 - DNA, 20 bp, human
ggagactatcctggtttacg

SEQ ID NO: 404741 - DNA, 20 bp, human
ggggtgtcaccgcgtaaacc

SEQ ID NO: 404742 - DNA, 20 bp, human
gcaggacggagcaggtcacc

SEQ ID NO: 404743 - DNA, 20 bp, human
gtgaagatctcagggcttga

SEQ ID NO: 404744 - DNA, 20 bp, human
gatccttcctgggtctcttc

SEQ ID NO: 404745 - DNA, 20 bp, human
gacttgtgagtctgcgcaga

SEQ ID NO: 404746 - DNA, 20 bp, human
ggctccagggcatccacggt

SEQ ID NO: 404747 - DNA, 20 bp, human
gaacatccagaatgctgcga

SEQ ID NO: 404748 - DNA, 20 bp, human
gtgcgcgccccgtggcagtc

SEQ ID NO: 404749 - DNA, 20 bp, human
gtaccctaccgtggatgccc

SEQ ID NO: 404750 - DNA, 20 bp, human
gttcgggtctatgagaaggg

SEQ ID NO: 404751 - DNA, 20 bp, human
gcgcgagccggactgcccct

SEQ ID NO: 404752 - DNA, 20 bp, human
ggcgcgcaactaccctaccg

SEQ ID NO: 404753 - DNA, 20 bp, human
gtccagaatgctgcgagggg

SEQ ID NO: 404754 - DNA, 20 bp, human
gcccgcccctcgcagcattc

SEQ ID NO: 404755 - DNA, 20 bp, human
ggtctatgagaagggtggtc

SEQ ID NO: 404756 - DNA, 20 bp, human
gtacccaaaagacacagcgg

SEQ ID NO: 404757 - DNA, 20 bp, human
gtgtccgccgctgtgtcttt

SEQ ID NO: 404758 - DNA, 20 bp, human
gtagcagagcggcgtctacg

SEQ ID NO: 404759 - DNA, 20 bp, human
gcgctctgctaggccttcat

SEQ ID NO: 404760 - DNA, 20 bp, human
gagcctcaggaggatcctcc

SEQ ID NO: 404761 - DNA, 20 bp, human
gttgcggggctccaaggacg

SEQ ID NO: 404762 - DNA, 20 bp, human
gttaagttcagaagcggggc

SEQ ID NO: 404763 - DNA, 20 bp, human
gggacgtggaggggcttcat

SEQ ID NO: 404764 - DNA, 20 bp, human
gcgggggttcgcaatgcgtg

SEQ ID NO: 404765 - DNA, 20 bp, human
gtaacttaagttcagaagcg

SEQ ID NO: 404766 - DNA, 20 bp, human
gcaggggcgtgcgtaatggg

SEQ ID NO: 404767 - DNA, 20 bp, human
gaggcgcagcaaccaataga

SEQ ID NO: 404768 - DNA, 20 bp, human
ggggccgatgccactcgctg

SEQ ID NO: 404769 - DNA, 20 bp, human
gcctccgggccggaagtcag

SEQ ID NO: 404770 - DNA, 20 bp, human
gctcccgggatgcactgcga

SEQ ID NO: 404771 - DNA, 20 bp, human
gggcccgcaagccgaattgc

SEQ ID NO: 404772 - DNA, 20 bp, human
ggagctgcagtccggcaatt

SEQ ID NO: 404773 - DNA, 20 bp, human
gcccgccggccgcaaggaag

SEQ ID NO: 404774 - DNA, 20 bp, human
gaatgcccttggcaggaggc

SEQ ID NO: 404775 - DNA, 20 bp, human
ggaatcgcgccgctgacttc

SEQ ID NO: 404776 - DNA, 20 bp, human
gcggcatggccgcacccata

SEQ ID NO: 404777 - DNA, 20 bp, human
gggaggccgccatcgtcaaa

SEQ ID NO: 404778 - DNA, 20 bp, human
gtgaatgaaccgcggaataa

SEQ ID NO: 404779 - DNA, 20 bp, human
ggctccgccaacagttatca

SEQ ID NO: 404780 - DNA, 20 bp, human
gacggcgtacctttattccg

SEQ ID NO: 404781 - DNA, 20 bp, human
gcccatacggattatgatat

SEQ ID NO: 404782 - DNA, 20 bp, human
gcgcctacggaaatcctaac

SEQ ID NO: 404783 - DNA, 20 bp, human
gaaaagccctttgacgatgg

SEQ ID NO: 404784 - DNA, 20 bp, human
gtatacgccatgataactgt

SEQ ID NO: 404785 - DNA, 20 bp, human
gggtcgctctaggccacttc

SEQ ID NO: 404786 - DNA, 20 bp, human
gacacgccgcgcacgcgcaa

SEQ ID NO: 404787 - DNA, 20 bp, human
gcaaaggctaggaccaccta

SEQ ID NO: 404788 - DNA, 20 bp, human
gagcgcaagtgtcaccggta

SEQ ID NO: 404789 - DNA, 20 bp, human
gcagccacgcgagagtagaa

SEQ ID NO: 404790 - DNA, 20 bp, human
gcgggaacgcgctgttaaga

SEQ ID NO: 404791 - DNA, 20 bp, human
ggaacgcgctgttaagatgg

SEQ ID NO: 404792 - DNA, 20 bp, human
gcgcagcagctgatgggccc

SEQ ID NO: 404793 - DNA, 20 bp, human
ggtgcgcggcgtgtctgcgt

SEQ ID NO: 404794 - DNA, 20 bp, human
gaaaaagccgcagcagctga

SEQ ID NO: 404795 - DNA, 20 bp, human
gtgatgggcccgggaacccg

SEQ ID NO: 404796 - DNA, 20 bp, human
ggagacccaagcaagttaat

SEQ ID NO: 404797 - DNA, 20 bp, human
ggtcccagccttcgccctaa

SEQ ID NO: 404798 - DNA, 20 bp, human
gtccggccagcagctgaaag

SEQ ID NO: 404799 - DNA, 20 bp, human
gcttgggaacggggcatcgc

SEQ ID NO: 404800 - DNA, 20 bp, human
ggcccagctcgcacatttgg

SEQ ID NO: 404801 - DNA, 20 bp, human
gctcccttagggcgaaggct

SEQ ID NO: 404802 - DNA, 20 bp, human
gtcctgctcccttagggcga

SEQ ID NO: 404803 - DNA, 20 bp, human
ggctgcccagctcgcacatt

SEQ ID NO: 404804 - DNA, 20 bp, human
gagtacggattctagttctg

SEQ ID NO: 404805 - DNA, 20 bp, human
gccctgaggacttgggaacg

SEQ ID NO: 404806 - DNA, 20 bp, human
ggggctgcaacgccagagag

SEQ ID NO: 404807 - DNA, 20 bp, human
gagaggcggggcgtccccga

SEQ ID NO: 404808 - DNA, 20 bp, human
gaacctcgctgccatgtcgg

SEQ ID NO: 404809 - DNA, 20 bp, human
ggggacgccccgcctctctc

SEQ ID NO: 404810 - DNA, 20 bp, human
ggcaacgccagagagaggcg

SEQ ID NO: 404811 - DNA, 20 bp, human
gaaggaacggaggatggcgt

SEQ ID NO: 404812 - DNA, 20 bp, human
ggcggcaggcgaacgacgtg

SEQ ID NO: 404813 - DNA, 20 bp, human
ggggaacctcgctgccatgt

SEQ ID NO: 404814 - DNA, 20 bp, human
gaacgacgtgcggcaccggg

SEQ ID NO: 404815 - DNA, 20 bp, human
gcatgtcggtggaggctcct

SEQ ID NO: 404816 - DNA, 20 bp, human
gtcctcgtccggggcccggg

SEQ ID NO: 404817 - DNA, 20 bp, human
gaccgggccagaagctaaga

SEQ ID NO: 404818 - DNA, 20 bp, human
ggacgcatggggagtcgctc

SEQ ID NO: 404819 - DNA, 20 bp, human
gaagagggcgtcctcgtccg

SEQ ID NO: 404820 - DNA, 20 bp, human
gcacaggtgtggcgcccccc

SEQ ID NO: 404821 - DNA, 20 bp, human
gcctagacctgcacatgcac

SEQ ID NO: 404822 - DNA, 20 bp, human
gcggggttccggcttctcca

SEQ ID NO: 404823 - DNA, 20 bp, human
gcggtcagtaggcggggttc

SEQ ID NO: 404824 - DNA, 20 bp, human
ggtggcgcccccccgggccc

SEQ ID NO: 404825 - DNA, 20 bp, human
gccggcttctccaaggaagt

SEQ ID NO: 404826 - DNA, 20 bp, human
gcgcggccgcagagactcct

SEQ ID NO: 404827 - DNA, 20 bp, human
ggccgcgggcaaacagatct

SEQ ID NO: 404828 - DNA, 20 bp, human
gagggtggcccttggttccg

SEQ ID NO: 404829 - DNA, 20 bp, human
gcggccgtggcaaactcttc

SEQ ID NO: 404830 - DNA, 20 bp, human
gcacttcccaggagtctctg

SEQ ID NO: 404831 - DNA, 20 bp, human
gacaaggtctgcccacgtcc

SEQ ID NO: 404832 - DNA, 20 bp, human
gccaggcggtttagtttttt

SEQ ID NO: 404833 - DNA, 20 bp, human
gaatgtcgatcggctgtggg

SEQ ID NO: 404834 - DNA, 20 bp, human
gaaaagtagagggtggccct

SEQ ID NO: 404835 - DNA, 20 bp, human
gcgcaacgaaccgcaggtac

SEQ ID NO: 404836 - DNA, 20 bp, human
gacacggtgggcacgccatc

SEQ ID NO: 404837 - DNA, 20 bp, human
gagagggaaggtagccttgc

SEQ ID NO: 404838 - DNA, 20 bp, human
gagcagtgacgtcaccggca

SEQ ID NO: 404839 - DNA, 20 bp, human
ggaggggaagtgcccaacta

SEQ ID NO: 404840 - DNA, 20 bp, human
ggcggccccatgttgactat

SEQ ID NO: 404841 - DNA, 20 bp, human
gcctggagcagtgacgtcac

SEQ ID NO: 404842 - DNA, 20 bp, human
ggtcactgctccaggccaga

SEQ ID NO: 404843 - DNA, 20 bp, human
gtccgccaatagtcaacatg

SEQ ID NO: 404844 - DNA, 20 bp, human
ggtgggcacgccatctggcc

SEQ ID NO: 404845 - DNA, 20 bp, human
gcggttctgcgcacgctcag

SEQ ID NO: 404846 - DNA, 20 bp, human
gaaaatgtgcggcccatcgc

SEQ ID NO: 404847 - DNA, 20 bp, human
gttcccagaacactccgcga

SEQ ID NO: 404848 - DNA, 20 bp, human
gaagttcaggaacaccttcg

SEQ ID NO: 404849 - DNA, 20 bp, human
gtgtaggcgtggaaagaggt

SEQ ID NO: 404850 - DNA, 20 bp, human
ggaccgttgaagccggttgt

SEQ ID NO: 404851 - DNA, 20 bp, human
gggggctcgctcgtaacgac

SEQ ID NO: 404852 - DNA, 20 bp, human
ggacccgggatcagagtgtg

SEQ ID NO: 404853 - DNA, 20 bp, human
ggactggcggcgaaaatgtg

SEQ ID NO: 404854 - DNA, 20 bp, human
gcggagtgttctgggaacgc

SEQ ID NO: 404855 - DNA, 20 bp, human
gcagtgtgcccgcccggcgc

SEQ ID NO: 404856 - DNA, 20 bp, human
gcacgcgtcgcgtacgctgg

SEQ ID NO: 404857 - DNA, 20 bp, human
gtacgcaggcgtactcacta

SEQ ID NO: 404858 - DNA, 20 bp, human
gggcgagcgcgcattcgcgc

SEQ ID NO: 404859 - DNA, 20 bp, human
ggcccgctacccagatttcg

SEQ ID NO: 404860 - DNA, 20 bp, human
gcgtgctcgccgaggtgcac

SEQ ID NO: 404861 - DNA, 20 bp, human
gtacgggcgcgtgctcgccg

SEQ ID NO: 404862 - DNA, 20 bp, human
gcgtgcgcgcctgtgcacct

SEQ ID NO: 404863 - DNA, 20 bp, human
gaaatctgggtagcgggcac

SEQ ID NO: 404864 - DNA, 20 bp, human
gtccccgaaatctgggtagc

SEQ ID NO: 404865 - DNA, 20 bp, human
ggggcactgcgaccgagttc

SEQ ID NO: 404866 - DNA, 20 bp, human
gtcccagcgtgcaaagggcg

SEQ ID NO: 404867 - DNA, 20 bp, human
gacgggagttgtagttgagg

SEQ ID NO: 404868 - DNA, 20 bp, human
gcaatcggatacaatcccag

SEQ ID NO: 404869 - DNA, 20 bp, human
gggtctgggcgcgtcactgc

SEQ ID NO: 404870 - DNA, 20 bp, human
ggctggcggcgtctggaccg

SEQ ID NO: 404871 - DNA, 20 bp, human
gatgctcggaaagagcgccg

SEQ ID NO: 404872 - DNA, 20 bp, human
gaaagggcgagggagcctac

SEQ ID NO: 404873 - DNA, 20 bp, human
gcgcccgcccccggaccaga

SEQ ID NO: 404874 - DNA, 20 bp, human
gagagctttctttttcctgt

SEQ ID NO: 404875 - DNA, 20 bp, human
gtgggtgacgccttctggtc

SEQ ID NO: 404876 - DNA, 20 bp, human
gcccgggtggaaactcctcc

SEQ ID NO: 404877 - DNA, 20 bp, human
ggccggagcggtcttctcag

SEQ ID NO: 404878 - DNA, 20 bp, human
gagagtacgcgtgtgagcct

SEQ ID NO: 404879 - DNA, 20 bp, human
ggctcacacgcgtactctct

SEQ ID NO: 404880 - DNA, 20 bp, human
gtcggtgacagtcacagata

SEQ ID NO: 404881 - DNA, 20 bp, human
gatcctcagagaccttgaat

SEQ ID NO: 404882 - DNA, 20 bp, human
gactctctaggatgccggag

SEQ ID NO: 404883 - DNA, 20 bp, human
gaccactgagaagaccgctc

SEQ ID NO: 404884 - DNA, 20 bp, human
gggtgggcccgataacaaca

SEQ ID NO: 404885 - DNA, 20 bp, human
gcccgggaggagtttccacc

SEQ ID NO: 404886 - DNA, 20 bp, human
gaggagctgtaatcagacaa

SEQ ID NO: 404887 - DNA, 20 bp, human
gcctactcctctgattggat

SEQ ID NO: 404888 - DNA, 20 bp, human
gaggtggggccggacagcgc

SEQ ID NO: 404889 - DNA, 20 bp, human
gcgaatgagacagcaaggac

SEQ ID NO: 404890 - DNA, 20 bp, human
gcaatcagaggagtaggggc

SEQ ID NO: 404891 - DNA, 20 bp, human
ggccccgctccaaaagatcg

SEQ ID NO: 404892 - DNA, 20 bp, human
ggtccaatcaggcacatgtc

SEQ ID NO: 404893 - DNA, 20 bp, human
ggctgtccggccccacctag

SEQ ID NO: 404894 - DNA, 20 bp, human
gtggagctctgtcgggacaa

SEQ ID NO: 404895 - DNA, 20 bp, human
gatcaggcacatgtctggag

SEQ ID NO: 404896 - DNA, 20 bp, human
gagacaggacccagggtctc

SEQ ID NO: 404897 - DNA, 20 bp, human
gaaggaacactagtacccaa

SEQ ID NO: 404898 - DNA, 20 bp, human
gccgctgtttcagaccggaa

SEQ ID NO: 404899 - DNA, 20 bp, human
gcagccgaggcacagaataa

SEQ ID NO: 404900 - DNA, 20 bp, human
gtgcaccccgcccctcatcc

SEQ ID NO: 404901 - DNA, 20 bp, human
gagagatccgggatgagggg

SEQ ID NO: 404902 - DNA, 20 bp, human
gatgaggggcggggtgcaac

SEQ ID NO: 404903 - DNA, 20 bp, human
gactggccgctgtttcagac

SEQ ID NO: 404904 - DNA, 20 bp, human
ggcggaactcctgagccctt

SEQ ID NO: 404905 - DNA, 20 bp, human
gccgagaatactgcgacttc

SEQ ID NO: 404906 - DNA, 20 bp, human
gcgaaggccccgcattgatt

SEQ ID NO: 404907 - DNA, 20 bp, human
gcggctcgctctcccagcta

SEQ ID NO: 404908 - DNA, 20 bp, human
gtgcaaacgccggcttcccg

SEQ ID NO: 404909 - DNA, 20 bp, human
gtggagggacgcgacactag

SEQ ID NO: 404910 - DNA, 20 bp, human
ggctcccatcggatactgga

SEQ ID NO: 404911 - DNA, 20 bp, human
gactgcgctcccaatcaatg

SEQ ID NO: 404912 - DNA, 20 bp, human
gcaccggacgccgagacttc

SEQ ID NO: 404913 - DNA, 20 bp, human
gggctgaacaggatccaaaa

SEQ ID NO: 404914 - DNA, 20 bp, human
ggtcagctggcgttgggaga

SEQ ID NO: 404915 - DNA, 20 bp, human
gtagaggcaggcagtacttc

SEQ ID NO: 404916 - DNA, 20 bp, human
gagctcgcttagataatctg

SEQ ID NO: 404917 - DNA, 20 bp, human
gactcaggaccgatgggacg

SEQ ID NO: 404918 - DNA, 20 bp, human
ggctccagtccccgtcccat

SEQ ID NO: 404919 - DNA, 20 bp, human
gagggacagcccattgagtg

SEQ ID NO: 404920 - DNA, 20 bp, human
gcgcttagataatctgtggt

SEQ ID NO: 404921 - DNA, 20 bp, human
gtagcaattcggagcaaatt

SEQ ID NO: 404922 - DNA, 20 bp, human
gagccctgggtaacaaggcc

SEQ ID NO: 404923 - DNA, 20 bp, human
gacccaaagagcaagacgca

SEQ ID NO: 404924 - DNA, 20 bp, human
gcggcctccccttccccgga

SEQ ID NO: 404925 - DNA, 20 bp, human
gtgccgggccttgttaccca

SEQ ID NO: 404926 - DNA, 20 bp, human
gccccctcagaactgagtga

SEQ ID NO: 404927 - DNA, 20 bp, human
ggtaacgagccctgcaaagc

SEQ ID NO: 404928 - DNA, 20 bp, human
gtggctagaaccgatcagtc

SEQ ID NO: 404929 - DNA, 20 bp, human
gttgcagggctcgttaccca

SEQ ID NO: 404930 - DNA, 20 bp, human
gagccacagcttctctctaa

SEQ ID NO: 404931 - DNA, 20 bp, human
gctgccgtcactcagttctg

SEQ ID NO: 404932 - DNA, 20 bp, human
gcaacggtccgtccggaagg

SEQ ID NO: 404933 - DNA, 20 bp, human
gcgttggccgggctccgccc

SEQ ID NO: 404934 - DNA, 20 bp, human
gtatccaatgaccagggctc

SEQ ID NO: 404935 - DNA, 20 bp, human
gcgatcagtccggctttgca

SEQ ID NO: 404936 - DNA, 20 bp, human
gggctccgaacggggagacc

SEQ ID NO: 404937 - DNA, 20 bp, human
gtgcggccagtctaacccca

SEQ ID NO: 404938 - DNA, 20 bp, human
ggagaggtgccagcccgtcg

SEQ ID NO: 404939 - DNA, 20 bp, human
gagactgccggctccgaacg

SEQ ID NO: 404940 - DNA, 20 bp, human
gaggagctctcagggccgga

SEQ ID NO: 404941 - DNA, 20 bp, human
gtgggaagtcgggcgctctg

SEQ ID NO: 404942 - DNA, 20 bp, human
ggcgcctgacggtcgtccat

SEQ ID NO: 404943 - DNA, 20 bp, human
ggaagcctggtctccccgtt

SEQ ID NO: 404944 - DNA, 20 bp, human
ggacggctgtagcctctctg

SEQ ID NO: 404945 - DNA, 20 bp, human
gggctctagtcatccacgac

SEQ ID NO: 404946 - DNA, 20 bp, human
gacccagtgcgaagaagcct

SEQ ID NO: 404947 - DNA, 20 bp, human
gtcttcgcactgggtccttg

SEQ ID NO: 404948 - DNA, 20 bp, human
gccgcggagggcgcatagag

SEQ ID NO: 404949 - DNA, 20 bp, human
gtcgctgcagagtggagtta

SEQ ID NO: 404950 - DNA, 20 bp, human
ggtcgcggacggcagctgtg

SEQ ID NO: 404951 - DNA, 20 bp, human
gatgcgccctccgcgggttg

SEQ ID NO: 404952 - DNA, 20 bp, human
gtggagttaggggtcgcgga

SEQ ID NO: 404953 - DNA, 20 bp, human
gctagcgggtcggaacacgt

SEQ ID NO: 404954 - DNA, 20 bp, human
ggggcctttgcgcccggaac

SEQ ID NO: 404955 - DNA, 20 bp, human
gactgagccgcaacccgcgg

SEQ ID NO: 404956 - DNA, 20 bp, human
gctgcatggggaatgggatc

SEQ ID NO: 404957 - DNA, 20 bp, human
gcaaaaccgggaacgctgta

SEQ ID NO: 404958 - DNA, 20 bp, human
gtcacctcccggccaagagc

SEQ ID NO: 404959 - DNA, 20 bp, human
gagccaccaaaacagaaaaa

SEQ ID NO: 404960 - DNA, 20 bp, human
gcacccggaaccctcaaaac

SEQ ID NO: 404961 - DNA, 20 bp, human
gtgagctggcattgcggctc

SEQ ID NO: 404962 - DNA, 20 bp, human
gtcccggttttgagggttcc

SEQ ID NO: 404963 - DNA, 20 bp, human
ggtagggctgcggctgcatg

SEQ ID NO: 404964 - DNA, 20 bp, human
gcgcagccctacagcgttcc

SEQ ID NO: 404965 - DNA, 20 bp, human
ggaaagaagggcattttgca

SEQ ID NO: 404966 - DNA, 20 bp, human
gacctccgccctgagtgggt

SEQ ID NO: 404967 - DNA, 20 bp, human
gctgagtgggtgggactaag

SEQ ID NO: 404968 - DNA, 20 bp, human
gcaagcactgcggtaggagg

SEQ ID NO: 404969 - DNA, 20 bp, human
ggggactaagaggcgcgaag

SEQ ID NO: 404970 - DNA, 20 bp, human
gtaccgcagtgcttgacggg

SEQ ID NO: 404971 - DNA, 20 bp, human
gtcccacccactcagggcgg

SEQ ID NO: 404972 - DNA, 20 bp, human
gaactctgaaacggacaaga

SEQ ID NO: 404973 - DNA, 20 bp, human
ggcagacctccgccctgagt

SEQ ID NO: 404974 - DNA, 20 bp, human
gtcctaccgcagtgcttgac

SEQ ID NO: 404975 - DNA, 20 bp, human
gtgatcggccctaactgcac

SEQ ID NO: 404976 - DNA, 20 bp, human
gcagtattaattgaattttt

SEQ ID NO: 404977 - DNA, 20 bp, human
gcgttaatcttgtttaatat

SEQ ID NO: 404978 - DNA, 20 bp, human
gattttacctttcataggac

SEQ ID NO: 404979 - DNA, 20 bp, human
gaagtcttgctctgcgatgc

SEQ ID NO: 404980 - DNA, 20 bp, human
gtcagtgctttaggtagctg

SEQ ID NO: 404981 - DNA, 20 bp, human
gaggtgaggtcttgaacttt

SEQ ID NO: 404982 - DNA, 20 bp, human
gtttcttagtttttactcta

SEQ ID NO: 404983 - DNA, 20 bp, human
ggatgcaggctgtacagcag

SEQ ID NO: 404984 - DNA, 20 bp, human
gttggcctcaagtgatccta

SEQ ID NO: 404985 - DNA, 20 bp, human
gtggggggggggtaaaggtg

SEQ ID NO: 404986 - DNA, 20 bp, human
ggaagaaagagagccagcgt

SEQ ID NO: 404987 - DNA, 20 bp, human
ggaaaggttgcagcctacgc

SEQ ID NO: 404988 - DNA, 20 bp, human
gggctgcaacctttcaggca

SEQ ID NO: 404989 - DNA, 20 bp, human
ggttttatgtattattaaca

SEQ ID NO: 404990 - DNA, 20 bp, human
gcaaaggaccgaccacatcc

SEQ ID NO: 404991 - DNA, 20 bp, human
ggggtttcaccctatcgacc

SEQ ID NO: 404992 - DNA, 20 bp, human
gcaagaccagcctggtcgat

SEQ ID NO: 404993 - DNA, 20 bp, human
gtactaaaggccgggcgcga

SEQ ID NO: 404994 - DNA, 20 bp, human
gtgttatcaatactaaaggc

SEQ ID NO: 404995 - DNA, 20 bp, human
gagtaaaaattaatttactc

SEQ ID NO: 404996 - DNA, 20 bp, human
ggggtaatgtagtctccccc

SEQ ID NO: 404997 - DNA, 20 bp, human
gcgccctccgtcgcagcctg

SEQ ID NO: 404998 - DNA, 20 bp, human
gctcccccaggctgcgacgg

SEQ ID NO: 404999 - DNA, 20 bp, human
gagtctcccccaggctgcga

SEQ ID NO: 405000 - DNA, 20 bp, human
gccccccagggcgggacttg

SEQ ID NO: 405001 - DNA, 20 bp, human
ggccttccagggcgactgag

SEQ ID NO: 405002 - DNA, 20 bp, human
gtgtctctggggcaagaggt

SEQ ID NO: 405003 - DNA, 20 bp, human
gcgaagcccctcagtcgccc

SEQ ID NO: 405004 - DNA, 20 bp, human
gggtgtttgaggtcttaagt

SEQ ID NO: 405005 - DNA, 20 bp, human
gacgccacaagtcccgccct

SEQ ID NO: 405006 - DNA, 20 bp, human
gggcactcccggccagagtg

SEQ ID NO: 405007 - DNA, 20 bp, human
gtctccctcccgccgcacgg

SEQ ID NO: 405008 - DNA, 20 bp, human
gccattgtgcccccgtgcgg

SEQ ID NO: 405009 - DNA, 20 bp, human
gctggtgcccgcactctggc

SEQ ID NO: 405010 - DNA, 20 bp, human
gtcactcaaaagtcaagacc

SEQ ID NO: 405011 - DNA, 20 bp, human
ggacctccccggcacaagac

SEQ ID NO: 405012 - DNA, 20 bp, human
gcctgcacagtgaggaagag

SEQ ID NO: 405013 - DNA, 20 bp, human
gcgggagggagaacgctgct

SEQ ID NO: 405014 - DNA, 20 bp, human
gtgtgcccccgtgcggcggg

SEQ ID NO: 405015 - DNA, 20 bp, human
gtgggcatacggaagacagc

SEQ ID NO: 405016 - DNA, 20 bp, human
gaacggctttctgggagctg

SEQ ID NO: 405017 - DNA, 20 bp, human
gtggccatcggtcatggaga

SEQ ID NO: 405018 - DNA, 20 bp, human
gccgccttctccatgaccga

SEQ ID NO: 405019 - DNA, 20 bp, human
gagtcctcgcggggctcgct

SEQ ID NO: 405020 - DNA, 20 bp, human
gcggcgccggaagtcctcgc

SEQ ID NO: 405021 - DNA, 20 bp, human
ggggagctcgcggcggaagt

SEQ ID NO: 405022 - DNA, 20 bp, human
gggcggaagtgggatctcct

SEQ ID NO: 405023 - DNA, 20 bp, human
gtgcaggtgtatgacgcgta

SEQ ID NO: 405024 - DNA, 20 bp, human
gatggagaaggcgggctcag

SEQ ID NO: 405025 - DNA, 20 bp, human
gtgaccgatggccaatgaac

SEQ ID NO: 405026 - DNA, 20 bp, human
gaatgccagcggccaaaggt

SEQ ID NO: 405027 - DNA, 20 bp, human
gccagcggccaaaggtcggg

SEQ ID NO: 405028 - DNA, 20 bp, human
ggggaggcgcgggatacttc

SEQ ID NO: 405029 - DNA, 20 bp, human
gtgcgggcgctcgggggata

SEQ ID NO: 405030 - DNA, 20 bp, human
gcaggaatgccagcggccaa

SEQ ID NO: 405031 - DNA, 20 bp, human
ggggcgggaagagagagcgc

SEQ ID NO: 405032 - DNA, 20 bp, human
ggaaacggagctactggctt

SEQ ID NO: 405033 - DNA, 20 bp, human
gaccccgaggaaacgctgtc

SEQ ID NO: 405034 - DNA, 20 bp, human
ggcccgcgcaggaatgccag

SEQ ID NO: 405035 - DNA, 20 bp, human
gggccgctggcattcctgcg

SEQ ID NO: 405036 - DNA, 20 bp, human
gggccagagttccaagtgtg

SEQ ID NO: 405037 - DNA, 20 bp, human
gtcaccgtgagtccattcac

SEQ ID NO: 405038 - DNA, 20 bp, human
ggagcccccgcgacccggat

SEQ ID NO: 405039 - DNA, 20 bp, human
gagttccaagtgtgcggcgt

SEQ ID NO: 405040 - DNA, 20 bp, human
gtggactagtttccccggac

SEQ ID NO: 405041 - DNA, 20 bp, human
gaaagggacggggctggcaa

SEQ ID NO: 405042 - DNA, 20 bp, human
gtcaccgatccgggtcgcgg

SEQ ID NO: 405043 - DNA, 20 bp, human
gcaagtgtgcggcgtgggcg

SEQ ID NO: 405044 - DNA, 20 bp, human
ggcgctgcctcatcccgtcc

SEQ ID NO: 405045 - DNA, 20 bp, human
gggccctgtgaatggactca

SEQ ID NO: 405046 - DNA, 20 bp, human
gtccccgcgcggacgagtag

SEQ ID NO: 405047 - DNA, 20 bp, human
gggggtgcgcacgggggcaa

SEQ ID NO: 405048 - DNA, 20 bp, human
gcacctcgggcgcggggcta

SEQ ID NO: 405049 - DNA, 20 bp, human
gcccccgcccggagaatata

SEQ ID NO: 405050 - DNA, 20 bp, human
gcgcggggctaaggtgagcg

SEQ ID NO: 405051 - DNA, 20 bp, human
gcgcctgcactgtccccgcg

SEQ ID NO: 405052 - DNA, 20 bp, human
gcggggacagtgcaggcgcg

SEQ ID NO: 405053 - DNA, 20 bp, human
ggccccctactcgtccgcgc

SEQ ID NO: 405054 - DNA, 20 bp, human
gcgcacgggggcaaaggcgc

SEQ ID NO: 405055 - DNA, 20 bp, human
ggcccggagaatataggggc

SEQ ID NO: 405056 - DNA, 20 bp, human
gaatagcaatacaaactagt

SEQ ID NO: 405057 - DNA, 20 bp, human
gacaaactagttggaacagt

SEQ ID NO: 405058 - DNA, 20 bp, human
gagttggaacttacatacat

SEQ ID NO: 405059 - DNA, 20 bp, human
gactgtacataaaacatatg

SEQ ID NO: 405060 - DNA, 20 bp, human
gaactgacctagaaatgcaa

SEQ ID NO: 405061 - DNA, 20 bp, human
gtgttttccttaggtcttgg

SEQ ID NO: 405062 - DNA, 20 bp, human
gtcatcctttgagaagcgaa

SEQ ID NO: 405063 - DNA, 20 bp, human
gtagaacccattgcatttct

SEQ ID NO: 405064 - DNA, 20 bp, human
ggaattgaccaaataagaag

SEQ ID NO: 405065 - DNA, 20 bp, human
gaacttacatacatggggac

SEQ ID NO: 405066 - DNA, 20 bp, human
gaacccggacataccaggga

SEQ ID NO: 405067 - DNA, 20 bp, human
gcctaaacccggacatacca

SEQ ID NO: 405068 - DNA, 20 bp, human
ggcagtgctgcttggaggct

SEQ ID NO: 405069 - DNA, 20 bp, human
ggacataccagggaaggagt

SEQ ID NO: 405070 - DNA, 20 bp, human
gccctggcccgcattgtgtg

SEQ ID NO: 405071 - DNA, 20 bp, human
gcccccgcatgctaatggcc

SEQ ID NO: 405072 - DNA, 20 bp, human
gggctctggctccggggaca

SEQ ID NO: 405073 - DNA, 20 bp, human
gagacggggggcgctgtcgg

SEQ ID NO: 405074 - DNA, 20 bp, human
gggtgcgggcggtttggaga

SEQ ID NO: 405075 - DNA, 20 bp, human
gcgggcggtttggagacggg

SEQ ID NO: 405076 - DNA, 20 bp, human
gaaggcgtcctgtgaccccc

SEQ ID NO: 405077 - DNA, 20 bp, human
gagcgaccctctatggtccc

SEQ ID NO: 405078 - DNA, 20 bp, human
gctcctccccccaactcgga

SEQ ID NO: 405079 - DNA, 20 bp, human
ggcgaggccctcacttccgg

SEQ ID NO: 405080 - DNA, 20 bp, human
gtgactgagcacggccagga

SEQ ID NO: 405081 - DNA, 20 bp, human
gggtgggcccgggaccatag

SEQ ID NO: 405082 - DNA, 20 bp, human
ggaggagctccccagggagt

SEQ ID NO: 405083 - DNA, 20 bp, human
gacagctcttgaggtcccgg

SEQ ID NO: 405084 - DNA, 20 bp, human
ggcgccgccgcggtcgctct

SEQ ID NO: 405085 - DNA, 20 bp, human
gagggagtgggggaacacgg

SEQ ID NO: 405086 - DNA, 20 bp, human
gtagttgcaacacttccccc

SEQ ID NO: 405087 - DNA, 20 bp, human
gcttccaagtccccggagaa

SEQ ID NO: 405088 - DNA, 20 bp, human
gtgcaacacttccccctgga

SEQ ID NO: 405089 - DNA, 20 bp, human
gagtgtcccaacggtcggtg

SEQ ID NO: 405090 - DNA, 20 bp, human
gccggtcaggcaggcggatc

SEQ ID NO: 405091 - DNA, 20 bp, human
gtgtggagtcgcgggagcta

SEQ ID NO: 405092 - DNA, 20 bp, human
gtgggaagtgtcccaacggt

SEQ ID NO: 405093 - DNA, 20 bp, human
gcgggcacttccggtcaggc

SEQ ID NO: 405094 - DNA, 20 bp, human
gcgcaaccccaccgaccgtt

SEQ ID NO: 405095 - DNA, 20 bp, human
gattctgggaagtgtcccaa

SEQ ID NO: 405096 - DNA, 20 bp, human
gactcgcccgtgtgagacaa

SEQ ID NO: 405097 - DNA, 20 bp, human
gcaacgtcacagttggggac

SEQ ID NO: 405098 - DNA, 20 bp, human
gaggaatggcaatagtggtt

SEQ ID NO: 405099 - DNA, 20 bp, human
gcgagcctccacagagcgtg

SEQ ID NO: 405100 - DNA, 20 bp, human
ggagtccacacgctctgtgg

SEQ ID NO: 405101 - DNA, 20 bp, human
gtctcacacgggcgagtccg

SEQ ID NO: 405102 - DNA, 20 bp, human
gtgtgtcccgaataagcagt

SEQ ID NO: 405103 - DNA, 20 bp, human
gaaatagcaacgtcacagtt

SEQ ID NO: 405104 - DNA, 20 bp, human
gaaaatttctagctagatga

SEQ ID NO: 405105 - DNA, 20 bp, human
ggcgggccctttgtctcaca

SEQ ID NO: 405106 - DNA, 20 bp, human
ggcgggtccggggaattctg

SEQ ID NO: 405107 - DNA, 20 bp, human
gtacgggaagtgtagtccac

SEQ ID NO: 405108 - DNA, 20 bp, human
gcgggactccgcagagtgtc

SEQ ID NO: 405109 - DNA, 20 bp, human
gcaggtgaaccgttgaattc

SEQ ID NO: 405110 - DNA, 20 bp, human
gtggctcaggggggcgggtc

SEQ ID NO: 405111 - DNA, 20 bp, human
ggagtggagtccagacactc

SEQ ID NO: 405112 - DNA, 20 bp, human
gaggaatcccgcaaggtgtc

SEQ ID NO: 405113 - DNA, 20 bp, human
gtatcgttcccagaattcaa

SEQ ID NO: 405114 - DNA, 20 bp, human
gctacctgagctgaagtatc

SEQ ID NO: 405115 - DNA, 20 bp, human
gcactggctcgtggaacact

SEQ ID NO: 405116 - DNA, 20 bp, human
ggtacagtccagaccctcag

SEQ ID NO: 405117 - DNA, 20 bp, human
gccgaccgcgattccactga

SEQ ID NO: 405118 - DNA, 20 bp, human
gcagaccctcagtggaatcg

SEQ ID NO: 405119 - DNA, 20 bp, human
gccgtgggaagagtggtcaa

SEQ ID NO: 405120 - DNA, 20 bp, human
gggaagtgttgacgactact

SEQ ID NO: 405121 - DNA, 20 bp, human
ggtacccccgagcgcctgtt

SEQ ID NO: 405122 - DNA, 20 bp, human
gctgcagcattacactcaaa

SEQ ID NO: 405123 - DNA, 20 bp, human
gagtggagtcgcggtcagtt

SEQ ID NO: 405124 - DNA, 20 bp, human
gcaaacattcggtggagtcg

SEQ ID NO: 405125 - DNA, 20 bp, human
gatcgcggtcggtttagctc

SEQ ID NO: 405126 - DNA, 20 bp, human
gaggcgaatcaggggatttc

SEQ ID NO: 405127 - DNA, 20 bp, human
ggctccggcaggcgaatcag

SEQ ID NO: 405128 - DNA, 20 bp, human
gaagtgtagtccagacgctc

SEQ ID NO: 405129 - DNA, 20 bp, human
gactccggcaggtggatccc

SEQ ID NO: 405130 - DNA, 20 bp, human
gcaacctcacagtaacggag

SEQ ID NO: 405131 - DNA, 20 bp, human
ggtctcggtcaatttgactc

SEQ ID NO: 405132 - DNA, 20 bp, human
gttccctgggatccacctgc

SEQ ID NO: 405133 - DNA, 20 bp, human
gcgtacacactggctccaga

SEQ ID NO: 405134 - DNA, 20 bp, human
gagtggagtagcggtcagct

SEQ ID NO: 405135 - DNA, 20 bp, human
gtcaatttgactccggcagg

SEQ ID NO: 405136 - DNA, 20 bp, human
gagttcccaggattccgcag

SEQ ID NO: 405137 - DNA, 20 bp, human
gccctcctggactacacttc

SEQ ID NO: 405138 - DNA, 20 bp, human
gggaagtgcctgcgagtatc

SEQ ID NO: 405139 - DNA, 20 bp, human
gtggacacttccacatcaga

SEQ ID NO: 405140 - DNA, 20 bp, human
gtgagctatgcgcgactaca

SEQ ID NO: 405141 - DNA, 20 bp, human
ggcgcgactacacggaactc

SEQ ID NO: 405142 - DNA, 20 bp, human
gggcacttccggctcgagga

SEQ ID NO: 405143 - DNA, 20 bp, human
gtccggaagtgtagtccagg

SEQ ID NO: 405144 - DNA, 20 bp, human
ggcggaatcctgggaactgt

SEQ ID NO: 405145 - DNA, 20 bp, human
ggtttcccctgcggaatcct

SEQ ID NO: 405146 - DNA, 20 bp, human
gtccccggatccccctgcgt

SEQ ID NO: 405147 - DNA, 20 bp, human
gtgcccgcgactccactgat

SEQ ID NO: 405148 - DNA, 20 bp, human
gtgggcagtgcgggaatcgt

SEQ ID NO: 405149 - DNA, 20 bp, human
gtccccctgcgtgggtcaaa

SEQ ID NO: 405150 - DNA, 20 bp, human
gacccacgcagggggatccg

SEQ ID NO: 405151 - DNA, 20 bp, human
gcacgactccactgagcgtt

SEQ ID NO: 405152 - DNA, 20 bp, human
gtggtccatttgacccacgc

SEQ ID NO: 405153 - DNA, 20 bp, human
ggaagagggggcgattgtca

SEQ ID NO: 405154 - DNA, 20 bp, human
gtcccatcgcttttccctga

SEQ ID NO: 405155 - DNA, 20 bp, human
gccgccaatcagtggagtcg

SEQ ID NO: 405156 - DNA, 20 bp, human
ggaagagggcggcacctgga

SEQ ID NO: 405157 - DNA, 20 bp, human
gcctgcggcccaattgtttc

SEQ ID NO: 405158 - DNA, 20 bp, human
gcggagcgagcgagtgagag

SEQ ID NO: 405159 - DNA, 20 bp, human
ggaggccgccaccatctttt

SEQ ID NO: 405160 - DNA, 20 bp, human
gcagaaggcccgcgctcctg

SEQ ID NO: 405161 - DNA, 20 bp, human
ggcggcctcgctttccgggg

SEQ ID NO: 405162 - DNA, 20 bp, human
ggtggcggcctcgctttccg

SEQ ID NO: 405163 - DNA, 20 bp, human
gacctcccggacccaaaaga

SEQ ID NO: 405164 - DNA, 20 bp, human
ggattctggatgttgtagtc

SEQ ID NO: 405165 - DNA, 20 bp, human
gacagcaataagccgtgaag

SEQ ID NO: 405166 - DNA, 20 bp, human
gtcgcagtgggcgtgactcg

SEQ ID NO: 405167 - DNA, 20 bp, human
ggcagcgcagtccgatccta

SEQ ID NO: 405168 - DNA, 20 bp, human
ggcctcccgccgcctcgcag

SEQ ID NO: 405169 - DNA, 20 bp, human
gagtccgatcctaggggcga

SEQ ID NO: 405170 - DNA, 20 bp, human
gagtcacgcccactgcgagg

SEQ ID NO: 405171 - DNA, 20 bp, human
gaacggaagtagtcgactcg

SEQ ID NO: 405172 - DNA, 20 bp, human
ggtgacgcgcccaccggaaa

SEQ ID NO: 405173 - DNA, 20 bp, human
gactgcgctgcggagggttc

SEQ ID NO: 405174 - DNA, 20 bp, human
gacaccatcgcccctaggat

SEQ ID NO: 405175 - DNA, 20 bp, human
gttacgacaccatcgcccct

SEQ ID NO: 405176 - DNA, 20 bp, human
gcatccctgtcggctagctc

SEQ ID NO: 405177 - DNA, 20 bp, human
gccacggtgactgttacccc

SEQ ID NO: 405178 - DNA, 20 bp, human
gagacccgagctagccgaca

SEQ ID NO: 405179 - DNA, 20 bp, human
ggctgtggccgcatccctgt

SEQ ID NO: 405180 - DNA, 20 bp, human
gctagctcgggtctggccca

SEQ ID NO: 405181 - DNA, 20 bp, human
gggtcacgcccggccagctg

SEQ ID NO: 405182 - DNA, 20 bp, human
gactgttacccctggggaat

SEQ ID NO: 405183 - DNA, 20 bp, human
gccgggcgtgaccaccaccg

SEQ ID NO: 405184 - DNA, 20 bp, human
gcagccacgtgtgggagtct

SEQ ID NO: 405185 - DNA, 20 bp, human
ggagcaaggtcgctgcgcct

SEQ ID NO: 405186 - DNA, 20 bp, human
gggacaatgacccaggcgtg

SEQ ID NO: 405187 - DNA, 20 bp, human
gctgacaatcaactgctccc

SEQ ID NO: 405188 - DNA, 20 bp, human
gtgtgtacaaggaaaggaag

SEQ ID NO: 405189 - DNA, 20 bp, human
ggaagaggatgtctcccaat

SEQ ID NO: 405190 - DNA, 20 bp, human
gagagaaaaaagtgtgtaca

SEQ ID NO: 405191 - DNA, 20 bp, human
ggagcagttgattgtcagga

SEQ ID NO: 405192 - DNA, 20 bp, human
gcccaggcgtgaggttcctg

SEQ ID NO: 405193 - DNA, 20 bp, human
gaaaaagtgtgtacaaggaa

SEQ ID NO: 405194 - DNA, 20 bp, human
ggagtggcagagcttgtgaa

SEQ ID NO: 405195 - DNA, 20 bp, human
gaaagcgatcgcttctgccc

SEQ ID NO: 405196 - DNA, 20 bp, human
ggggtggacgagtgaattct

SEQ ID NO: 405197 - DNA, 20 bp, human
ggcaagttggctcaggcggg

SEQ ID NO: 405198 - DNA, 20 bp, human
gggctcaagcagttgaaccg

SEQ ID NO: 405199 - DNA, 20 bp, human
gcagacacactctgagtcgc

SEQ ID NO: 405200 - DNA, 20 bp, human
ggtcgcgggcaagttggctc

SEQ ID NO: 405201 - DNA, 20 bp, human
gagttgaaccggggaattct

SEQ ID NO: 405202 - DNA, 20 bp, human
gcatggaatggcggaccctt

SEQ ID NO: 405203 - DNA, 20 bp, human
gctctgagtcgcgggcaagt

SEQ ID NO: 405204 - DNA, 20 bp, human
gcatcaacttcatggaatgg

SEQ ID NO: 405205 - DNA, 20 bp, human
ggtgtagtcaaggaccaccg

SEQ ID NO: 405206 - DNA, 20 bp, human
gagcgcgccgcctgcacgac

SEQ ID NO: 405207 - DNA, 20 bp, human
ggactttggcccaggcgcgt

SEQ ID NO: 405208 - DNA, 20 bp, human
gctgcacgactggactggag

SEQ ID NO: 405209 - DNA, 20 bp, human
gcggcagcgcccacgcgcct

SEQ ID NO: 405210 - DNA, 20 bp, human
gcggcggcgaggaggattct

SEQ ID NO: 405211 - DNA, 20 bp, human
ggagagtgagcccttgtaag

SEQ ID NO: 405212 - DNA, 20 bp, human
ggccgcctgcacgactggac

SEQ ID NO: 405213 - DNA, 20 bp, human
gtgtacctgaagggcggtgc

SEQ ID NO: 405214 - DNA, 20 bp, human
gcgttcgcggactttggccc

SEQ ID NO: 405215 - DNA, 20 bp, human
gaccggttcctggacttgag

SEQ ID NO: 405216 - DNA, 20 bp, human
ggggctggggcacacgtcgg

SEQ ID NO: 405217 - DNA, 20 bp, human
gctactggatggggcgggtg

SEQ ID NO: 405218 - DNA, 20 bp, human
gtccccgcaccgccggtggg

SEQ ID NO: 405219 - DNA, 20 bp, human
gtctaccacccccccaccgg

SEQ ID NO: 405220 - DNA, 20 bp, human
gtccccgcccgggcacggcc

SEQ ID NO: 405221 - DNA, 20 bp, human
gtccgggccaggccgtgccc

SEQ ID NO: 405222 - DNA, 20 bp, human
gacccccccaccggcggtgc

SEQ ID NO: 405223 - DNA, 20 bp, human
ggcctctaccacccccccac

SEQ ID NO: 405224 - DNA, 20 bp, human
ggagatctactggatggggc

SEQ ID NO: 405225 - DNA, 20 bp, human
ggccaggccgtgcccgggcg

SEQ ID NO: 405226 - DNA, 20 bp, human
gcagccaagagggaccaaga

SEQ ID NO: 405227 - DNA, 20 bp, human
ggaagtacacaaggttgcaa

SEQ ID NO: 405228 - DNA, 20 bp, human
gagaatgcccgagcggaaac

SEQ ID NO: 405229 - DNA, 20 bp, human
gcggtagcctgtttccgctc

SEQ ID NO: 405230 - DNA, 20 bp, human
gcctgcagcggaagtacaca

SEQ ID NO: 405231 - DNA, 20 bp, human
ggcctgccatttcagaaaga

SEQ ID NO: 405232 - DNA, 20 bp, human
gaaatatttacagttctgta

SEQ ID NO: 405233 - DNA, 20 bp, human
gggcccctcttggtccctct

SEQ ID NO: 405234 - DNA, 20 bp, human
gcactgcacctggcccctct

SEQ ID NO: 405235 - DNA, 20 bp, human
gtgatatgtactgtagaatg

SEQ ID NO: 405236 - DNA, 20 bp, human
gagttcccaggattccgcag

SEQ ID NO: 405237 - DNA, 20 bp, human
gccctcctggactacacttc

SEQ ID NO: 405238 - DNA, 20 bp, human
gggaagtgcctgcgagtatc

SEQ ID NO: 405239 - DNA, 20 bp, human
gtggacacttccacatcaga

SEQ ID NO: 405240 - DNA, 20 bp, human
gtgagctatgcgcgactaca

SEQ ID NO: 405241 - DNA, 20 bp, human
ggcgcgactacacggaactc

SEQ ID NO: 405242 - DNA, 20 bp, human
gggcacttccggctcgagga

SEQ ID NO: 405243 - DNA, 20 bp, human
gtccggaagtgtagtccagg

SEQ ID NO: 405244 - DNA, 20 bp, human
ggcggaatcctgggaactgt

SEQ ID NO: 405245 - DNA, 20 bp, human
ggtttcccctgcggaatcct

SEQ ID NO: 405246 - DNA, 20 bp, human
gtccccggatccccctgcgt

SEQ ID NO: 405247 - DNA, 20 bp, human
gtgcccgcgactccactgat

SEQ ID NO: 405248 - DNA, 20 bp, human
gtgggcagtgcgggaatcgt

SEQ ID NO: 405249 - DNA, 20 bp, human
gtccccctgcgtgggtcaaa

SEQ ID NO: 405250 - DNA, 20 bp, human
gacccacgcagggggatccg

SEQ ID NO: 405251 - DNA, 20 bp, human
gcacgactccactgagcgtt

SEQ ID NO: 405252 - DNA, 20 bp, human
gtggtccatttgacccacgc

SEQ ID NO: 405253 - DNA, 20 bp, human
ggaagagggggcgattgtca

SEQ ID NO: 405254 - DNA, 20 bp, human
gtcccatcgcttttccctga

SEQ ID NO: 405255 - DNA, 20 bp, human
gccgccaatcagtggagtcg

SEQ ID NO: 405256 - DNA, 20 bp, human
gaaaacaaagcccagctggt

SEQ ID NO: 405257 - DNA, 20 bp, human
ggaagtggctcaaacccaac

SEQ ID NO: 405258 - DNA, 20 bp, human
ggctgcccttggagcattct

SEQ ID NO: 405259 - DNA, 20 bp, human
gagtagtagcaccagagaag

SEQ ID NO: 405260 - DNA, 20 bp, human
gtgggtttgagccacttctc

SEQ ID NO: 405261 - DNA, 20 bp, human
gtccgagtgcccacggttcg

SEQ ID NO: 405262 - DNA, 20 bp, human
gaagtggagtccacgaaccg

SEQ ID NO: 405263 - DNA, 20 bp, human
gacttcccagaattcctaag

SEQ ID NO: 405264 - DNA, 20 bp, human
gagtcaaaacaaagcccagc

SEQ ID NO: 405265 - DNA, 20 bp, human
ggcagagggtaggctaaaat

SEQ ID NO: 405266 - DNA, 20 bp, human
gcccgccaggccgagctcta

SEQ ID NO: 405267 - DNA, 20 bp, human
ggccgcggggccttagcgga

SEQ ID NO: 405268 - DNA, 20 bp, human
gtcggcctggcggggaccct

SEQ ID NO: 405269 - DNA, 20 bp, human
ggaccgcagcatggctcgga

SEQ ID NO: 405270 - DNA, 20 bp, human
gcggcgccgcggggccttag

SEQ ID NO: 405271 - DNA, 20 bp, human
gcggggccttagcggacgga

SEQ ID NO: 405272 - DNA, 20 bp, human
ggcgcccaacgcccccaccg

SEQ ID NO: 405273 - DNA, 20 bp, human
gcgccctccgagccatgctg

SEQ ID NO: 405274 - DNA, 20 bp, human
gcccagccggcgctagaggc

SEQ ID NO: 405275 - DNA, 20 bp, human
gcactagggcggcgcgagta

SEQ ID NO: 405276 - DNA, 20 bp, human
gtgtgcggagcgggattctt

SEQ ID NO: 405277 - DNA, 20 bp, human
ggagcgggattcttgggcgg

SEQ ID NO: 405278 - DNA, 20 bp, human
gccgcacagcgcagagttca

SEQ ID NO: 405279 - DNA, 20 bp, human
gagtgggcgtggttcgcccg

SEQ ID NO: 405280 - DNA, 20 bp, human
gaggggcccgcgccggaagt

SEQ ID NO: 405281 - DNA, 20 bp, human
gctgaccgctcgcgcgccta

SEQ ID NO: 405282 - DNA, 20 bp, human
gaactctgcgctgtgcggag

SEQ ID NO: 405283 - DNA, 20 bp, human
gggcgaaccacgcccacttc

SEQ ID NO: 405284 - DNA, 20 bp, human
gcgcgcgagcggtcagcatc

SEQ ID NO: 405285 - DNA, 20 bp, human
gcgcgtcgctgactcaaaga

SEQ ID NO: 405286 - DNA, 20 bp, human
gtcaatgcggtcattgtcgt

SEQ ID NO: 405287 - DNA, 20 bp, human
gcgcccggggcgcttctcca

SEQ ID NO: 405288 - DNA, 20 bp, human
ggccaagcgcagcctcaatg

SEQ ID NO: 405289 - DNA, 20 bp, human
gaaacggtccagaggacgct

SEQ ID NO: 405290 - DNA, 20 bp, human
gcgctgggctgttcgaggag

SEQ ID NO: 405291 - DNA, 20 bp, human
gttgccatggagaagcgccc

SEQ ID NO: 405292 - DNA, 20 bp, human
gccggtctgcgggcctgagg

SEQ ID NO: 405293 - DNA, 20 bp, human
ggcgggctgcttccggtctg

SEQ ID NO: 405294 - DNA, 20 bp, human
gcaagataatgcacgtgaaa

SEQ ID NO: 405295 - DNA, 20 bp, human
gccccggcgcgggctgcttc

SEQ ID NO: 405296 - DNA, 20 bp, human
gcgcactggcccgaagggga

SEQ ID NO: 405297 - DNA, 20 bp, human
gaagtcctgtagcacggggt

SEQ ID NO: 405298 - DNA, 20 bp, human
gcagccagttccctcccctt

SEQ ID NO: 405299 - DNA, 20 bp, human
gagggcgtctctgtcagaag

SEQ ID NO: 405300 - DNA, 20 bp, human
gaatgcgcactggcccgaag

SEQ ID NO: 405301 - DNA, 20 bp, human
gcggggatgcacatgcgcag

SEQ ID NO: 405302 - DNA, 20 bp, human
gtgcacatgcgcagagggag

SEQ ID NO: 405303 - DNA, 20 bp, human
ggaggccgagcgcccgagtt

SEQ ID NO: 405304 - DNA, 20 bp, human
gcggggtaggcaatgcgcac

SEQ ID NO: 405305 - DNA, 20 bp, human
gtgcggcgacggtgggacga

SEQ ID NO: 405306 - DNA, 20 bp, human
ggaagcgtagttctggagta

SEQ ID NO: 405307 - DNA, 20 bp, human
ggagctgcaccctgcacgtc

SEQ ID NO: 405308 - DNA, 20 bp, human
gtagttctggagtagggcta

SEQ ID NO: 405309 - DNA, 20 bp, human
gcaatcactcaggccgctgg

SEQ ID NO: 405310 - DNA, 20 bp, human
ggtccttgctcagtgatggc

SEQ ID NO: 405311 - DNA, 20 bp, human
gcggcctgagtgattgctgt

SEQ ID NO: 405312 - DNA, 20 bp, human
gtggatgacgtcgtgaggcg

SEQ ID NO: 405313 - DNA, 20 bp, human
gcatcttggatgacgtcgtg

SEQ ID NO: 405314 - DNA, 20 bp, human
ggtgctccaaggaacactga

SEQ ID NO: 405315 - DNA, 20 bp, human
gtgattgctgtcgggtttcc

SEQ ID NO: 405316 - DNA, 20 bp, human
ggcccctctagggatcgcgg

SEQ ID NO: 405317 - DNA, 20 bp, human
gagacctccgcgatccctag

SEQ ID NO: 405318 - DNA, 20 bp, human
ggcggaggtctggctctcgg

SEQ ID NO: 405319 - DNA, 20 bp, human
gcaccgagaaaggcttcggg

SEQ ID NO: 405320 - DNA, 20 bp, human
gagcgggtaaggctcggcga

SEQ ID NO: 405321 - DNA, 20 bp, human
gtgcagtcggtcaccgagaa

SEQ ID NO: 405322 - DNA, 20 bp, human
ggcgcagccgccaatccctg

SEQ ID NO: 405323 - DNA, 20 bp, human
gagccagcgcaagtcgagga

SEQ ID NO: 405324 - DNA, 20 bp, human
ggtgcccgaagcctccacac

SEQ ID NO: 405325 - DNA, 20 bp, human
gcggtcaccgagaaaggctt

SEQ ID NO: 405326 - DNA, 20 bp, human
ggggaaccggaagccagccg

SEQ ID NO: 405327 - DNA, 20 bp, human
gcggttcccggcgttctcgg

SEQ ID NO: 405328 - DNA, 20 bp, human
gcggaaccgcggctggcttc

SEQ ID NO: 405329 - DNA, 20 bp, human
gaagaatccgggcggaaccg

SEQ ID NO: 405330 - DNA, 20 bp, human
gagcggccccggaagaatcc

SEQ ID NO: 405331 - DNA, 20 bp, human
gggcctgcgccgtctatggt

SEQ ID NO: 405332 - DNA, 20 bp, human
ggcctccagtcatcccagag

SEQ ID NO: 405333 - DNA, 20 bp, human
ggttccgcccggattcttcc

SEQ ID NO: 405334 - DNA, 20 bp, human
gggccccggaagaatccggg

SEQ ID NO: 405335 - DNA, 20 bp, human
gcgtactgaggccccgcagg

SEQ ID NO: 405336 - DNA, 20 bp, human
gacagatgtgatcagatact

SEQ ID NO: 405337 - DNA, 20 bp, human
ggatcacatctgtcactcag

SEQ ID NO: 405338 - DNA, 20 bp, human
gccggcccagcgtccctcat

SEQ ID NO: 405339 - DNA, 20 bp, human
gtgtcactcagcggctgggg

SEQ ID NO: 405340 - DNA, 20 bp, human
gatctgtcactcagcggctg

SEQ ID NO: 405341 - DNA, 20 bp, human
gccttaggcattatccaatg

SEQ ID NO: 405342 - DNA, 20 bp, human
ggcagctggagcgaaccaca

SEQ ID NO: 405343 - DNA, 20 bp, human
ggagcgaaccacatggtttc

SEQ ID NO: 405344 - DNA, 20 bp, human
gcgaaccacatggtttctgg

SEQ ID NO: 405345 - DNA, 20 bp, human
ggctggggaggcggggcctt

SEQ ID NO: 405346 - DNA, 20 bp, human
ggaagatgtgatcacaccct

SEQ ID NO: 405347 - DNA, 20 bp, human
gacagctggactggacaaag

SEQ ID NO: 405348 - DNA, 20 bp, human
gcactcagggtctgagtagg

SEQ ID NO: 405349 - DNA, 20 bp, human
gcaactagggacgttgggct

SEQ ID NO: 405350 - DNA, 20 bp, human
ggaggaagccctgcccgata

SEQ ID NO: 405351 - DNA, 20 bp, human
ggcctaagctgcagccttat

SEQ ID NO: 405352 - DNA, 20 bp, human
ggctgcagccttatcgggca

SEQ ID NO: 405353 - DNA, 20 bp, human
gcaaagcggcttccgggata

SEQ ID NO: 405354 - DNA, 20 bp, human
gagcggcttccgggatatgg

SEQ ID NO: 405355 - DNA, 20 bp, human
ggactggacaaagcggcttc

SEQ ID NO: 405356 - DNA, 20 bp, human
ggcgcacggcgggagagtga

SEQ ID NO: 405357 - DNA, 20 bp, human
gtctcccgccgtgcgcctgt

SEQ ID NO: 405358 - DNA, 20 bp, human
gtaaaggccaaacccctgta

SEQ ID NO: 405359 - DNA, 20 bp, human
gaatggcctgcgttgggcga

SEQ ID NO: 405360 - DNA, 20 bp, human
gggaaatggacactccaggt

SEQ ID NO: 405361 - DNA, 20 bp, human
ggcccaacgcaggccattct

SEQ ID NO: 405362 - DNA, 20 bp, human
gacactccaggttggggcgg

SEQ ID NO: 405363 - DNA, 20 bp, human
gttcccagcgccccctacag

SEQ ID NO: 405364 - DNA, 20 bp, human
gtggacactccaggttgggg

SEQ ID NO: 405365 - DNA, 20 bp, human
gcctcgcctccgccccaacc

SEQ ID NO: 405366 - DNA, 20 bp, human
gctccagcttcgtgtctgat

SEQ ID NO: 405367 - DNA, 20 bp, human
ggtccaatcagacacgaagc

SEQ ID NO: 405368 - DNA, 20 bp, human
gtgagccaggcccaacccaa

SEQ ID NO: 405369 - DNA, 20 bp, human
gtttaaggcctcgccccttt

SEQ ID NO: 405370 - DNA, 20 bp, human
gaatacctttgggttgggcc

SEQ ID NO: 405371 - DNA, 20 bp, human
gcataatacataatatggcc

SEQ ID NO: 405372 - DNA, 20 bp, human
gaaaacctgcctgaaaaggc

SEQ ID NO: 405373 - DNA, 20 bp, human
gatgcaaatacctttgggtt

SEQ ID NO: 405374 - DNA, 20 bp, human
gtcagctttcctgaccttcc

SEQ ID NO: 405375 - DNA, 20 bp, human
ggttaaatgcaaataccttt

SEQ ID NO: 405376 - DNA, 20 bp, human
gcggggaacaatgtcgtcaa

SEQ ID NO: 405377 - DNA, 20 bp, human
gggaagtgacggctgagttg

SEQ ID NO: 405378 - DNA, 20 bp, human
gtggcggaagtgacgggaga

SEQ ID NO: 405379 - DNA, 20 bp, human
ggaagtgacgggagaggggt

SEQ ID NO: 405380 - DNA, 20 bp, human
gccaccgcacggggttctat

SEQ ID NO: 405381 - DNA, 20 bp, human
gggaccaatagaaccccgtg

SEQ ID NO: 405382 - DNA, 20 bp, human
gagccttgacgacaaggggc

SEQ ID NO: 405383 - DNA, 20 bp, human
ggagtctgcggctttttttg

SEQ ID NO: 405384 - DNA, 20 bp, human
gacaagagccttgacgacaa

SEQ ID NO: 405385 - DNA, 20 bp, human
gggctgagttgaggtggatc

SEQ ID NO: 405386 - DNA, 20 bp, human
ggggcacagcctgacgggaa

SEQ ID NO: 405387 - DNA, 20 bp, human
gacagcctgacgggaaagga

SEQ ID NO: 405388 - DNA, 20 bp, human
gtcgatgcgccaggacgcga

SEQ ID NO: 405389 - DNA, 20 bp, human
ggaagccaggcctgtaacga

SEQ ID NO: 405390 - DNA, 20 bp, human
ggagaaggctccctcgttac

SEQ ID NO: 405391 - DNA, 20 bp, human
gaacgagggagccttctccg

SEQ ID NO: 405392 - DNA, 20 bp, human
gcgccaggacgcgaaggcgc

SEQ ID NO: 405393 - DNA, 20 bp, human
gctcccacaatcctcggaga

SEQ ID NO: 405394 - DNA, 20 bp, human
ggtgcccctctctagatccg

SEQ ID NO: 405395 - DNA, 20 bp, human
gggcgtccaggctccgagga

SEQ ID NO: 405396 - DNA, 20 bp, human
ggagacagtcccacaagctc

SEQ ID NO: 405397 - DNA, 20 bp, human
ggccccgactcagaaccgga

SEQ ID NO: 405398 - DNA, 20 bp, human
ggcgctcccagaggtctcct

SEQ ID NO: 405399 - DNA, 20 bp, human
gcctcccctcgcgactcccg

SEQ ID NO: 405400 - DNA, 20 bp, human
gtgctggcctctgagcgggt

SEQ ID NO: 405401 - DNA, 20 bp, human
gtgtctccctggccggggca

SEQ ID NO: 405402 - DNA, 20 bp, human
gacagtcccacaagctctgg

SEQ ID NO: 405403 - DNA, 20 bp, human
gtccgagccgacccgctcag

SEQ ID NO: 405404 - DNA, 20 bp, human
gtaccctcaaaagagtggca

SEQ ID NO: 405405 - DNA, 20 bp, human
gtagtctaccctcaaaagag

SEQ ID NO: 405406 - DNA, 20 bp, human
gagaagggaagattggccta

SEQ ID NO: 405407 - DNA, 20 bp, human
gcaccgcctaccaatgagaa

SEQ ID NO: 405408 - DNA, 20 bp, human
ggggcgcgccctgaaattct

SEQ ID NO: 405409 - DNA, 20 bp, human
gctccagcgcccattaggtc

SEQ ID NO: 405410 - DNA, 20 bp, human
gacggggactggatgagcga

SEQ ID NO: 405411 - DNA, 20 bp, human
gaaattctgggagtgactgg

SEQ ID NO: 405412 - DNA, 20 bp, human
gtggagaaacctgacctaat

SEQ ID NO: 405413 - DNA, 20 bp, human
ggggaccaattggagacgag

SEQ ID NO: 405414 - DNA, 20 bp, human
gggatgagcgagggaccaat

SEQ ID NO: 405415 - DNA, 20 bp, human
ggcgaactccagcgcccatt

SEQ ID NO: 405416 - DNA, 20 bp, human
ggaagggcggagcaccttag

SEQ ID NO: 405417 - DNA, 20 bp, human
gaatgacagcagcacggggc

SEQ ID NO: 405418 - DNA, 20 bp, human
gtgggaatgacagcagcacg

SEQ ID NO: 405419 - DNA, 20 bp, human
gtcagcaaacggaacctcaa

SEQ ID NO: 405420 - DNA, 20 bp, human
ggcaaaacagggtgaggcgt

SEQ ID NO: 405421 - DNA, 20 bp, human
ggcaatccccggccaccaaa

SEQ ID NO: 405422 - DNA, 20 bp, human
ggtcagtgctgctgcttagt

SEQ ID NO: 405423 - DNA, 20 bp, human
gggctgacaggctagtgaaa

SEQ ID NO: 405424 - DNA, 20 bp, human
gttagttggtaagaaaacaa

SEQ ID NO: 405425 - DNA, 20 bp, human
ggctttggacacgcaatccc

SEQ ID NO: 405426 - DNA, 20 bp, human
gccccaccggcgtgagccgt

SEQ ID NO: 405427 - DNA, 20 bp, human
gtacggtgggcacaactcga

SEQ ID NO: 405428 - DNA, 20 bp, human
ggtgcccaccgtaaagaggt

SEQ ID NO: 405429 - DNA, 20 bp, human
gccccgtcctaggccgtcgt

SEQ ID NO: 405430 - DNA, 20 bp, human
ggcgggagctgggccaacga

SEQ ID NO: 405431 - DNA, 20 bp, human
gaaaggcactccaggacccg

SEQ ID NO: 405432 - DNA, 20 bp, human
gtgggtctggagcgtctcct

SEQ ID NO: 405433 - DNA, 20 bp, human
gaggacggggacgtttccga

SEQ ID NO: 405434 - DNA, 20 bp, human
gggagggaaccgaggggcaa

SEQ ID NO: 405435 - DNA, 20 bp, human
gcaccgtaaagaggtgggtc

SEQ ID NO: 405436 - DNA, 20 bp, human
ggacggggctaacctagggt

SEQ ID NO: 405437 - DNA, 20 bp, human
gagggtgctaggaacgtggg

SEQ ID NO: 405438 - DNA, 20 bp, human
gtgcctgaggttgttcagct

SEQ ID NO: 405439 - DNA, 20 bp, human
gggaggcggaagtgacgtca

SEQ ID NO: 405440 - DNA, 20 bp, human
gtgcggacggggctaaccta

SEQ ID NO: 405441 - DNA, 20 bp, human
gccgcctccagcctcaaacc

SEQ ID NO: 405442 - DNA, 20 bp, human
gtcaaggtgagcagactcca

SEQ ID NO: 405443 - DNA, 20 bp, human
gagccgagctgaacaacctc

SEQ ID NO: 405444 - DNA, 20 bp, human
gaaggcgtctccgtagccac

SEQ ID NO: 405445 - DNA, 20 bp, human
ggctgtggggcgaaactcat

SEQ ID NO: 405446 - DNA, 20 bp, human
gctccggcttcactcctgat

SEQ ID NO: 405447 - DNA, 20 bp, human
gggcactaataatgaggggg

SEQ ID NO: 405448 - DNA, 20 bp, human
gcatggagctttatccaatc

SEQ ID NO: 405449 - DNA, 20 bp, human
gaaaaaggcactaataatga

SEQ ID NO: 405450 - DNA, 20 bp, human
gaagagaggtgctaagggac

SEQ ID NO: 405451 - DNA, 20 bp, human
ggtccaatcaggagtgaagc

SEQ ID NO: 405452 - DNA, 20 bp, human
gtcggctccagttagagctc

SEQ ID NO: 405453 - DNA, 20 bp, human
gttagcagtggggtacagtg

SEQ ID NO: 405454 - DNA, 20 bp, human
gcggcccgcaacatcctcct

SEQ ID NO: 405455 - DNA, 20 bp, human
gctctaactggagccgacga

SEQ ID NO: 405456 - DNA, 20 bp, human
gataactgtcatttcatctt

SEQ ID NO: 405457 - DNA, 20 bp, human
gcacaggaatatacattttt

SEQ ID NO: 405458 - DNA, 20 bp, human
gtgatcttactgaataattc

SEQ ID NO: 405459 - DNA, 20 bp, human
gtcagctgtgtataattctc

SEQ ID NO: 405460 - DNA, 20 bp, human
gaatatctacactagttttg

SEQ ID NO: 405461 - DNA, 20 bp, human
gaaaactaaggcatcaacac

SEQ ID NO: 405462 - DNA, 20 bp, human
gaatgtagtctcaaactctg

SEQ ID NO: 405463 - DNA, 20 bp, human
gtacactgaccatgtggcca

SEQ ID NO: 405464 - DNA, 20 bp, human
gcaaaggcagagtctgattc

SEQ ID NO: 405465 - DNA, 20 bp, human
ggaactctgccatggccaca

SEQ ID NO: 405466 - DNA, 20 bp, human
gcggccaagggccaccggga

SEQ ID NO: 405467 - DNA, 20 bp, human
gggggcgtgctaagatgacc

SEQ ID NO: 405468 - DNA, 20 bp, human
gctgcaagcgcgggagctca

SEQ ID NO: 405469 - DNA, 20 bp, human
ggccggagggctccggccaa

SEQ ID NO: 405470 - DNA, 20 bp, human
ggcgcgggagctcagggacc

SEQ ID NO: 405471 - DNA, 20 bp, human
gccggaagctcaggccttcc

SEQ ID NO: 405472 - DNA, 20 bp, human
gactcccagaggcctctgcg

SEQ ID NO: 405473 - DNA, 20 bp, human
ggagttactcccgcgccgga

SEQ ID NO: 405474 - DNA, 20 bp, human
gcgaggagttactcccgcgc

SEQ ID NO: 405475 - DNA, 20 bp, human
gcgggagtaactcctcgcag

SEQ ID NO: 405476 - DNA, 20 bp, human
gactgcaggcttttcagtca

SEQ ID NO: 405477 - DNA, 20 bp, human
ggcccagcgtccctgattgg

SEQ ID NO: 405478 - DNA, 20 bp, human
gagcacaccttctgtcattc

SEQ ID NO: 405479 - DNA, 20 bp, human
gaataccccgtgggtgggcc

SEQ ID NO: 405480 - DNA, 20 bp, human
gcttaaacatcctccaatca

SEQ ID NO: 405481 - DNA, 20 bp, human
gaatgcaaataccccgtggg

SEQ ID NO: 405482 - DNA, 20 bp, human
gagaatgaaacctaaactgc

SEQ ID NO: 405483 - DNA, 20 bp, human
ggttaaatgcaaataccccg

SEQ ID NO: 405484 - DNA, 20 bp, human
gctgattgcctccttttccc

SEQ ID NO: 405485 - DNA, 20 bp, human
gtccttttcccaggctaatc

SEQ ID NO: 405486 - DNA, 20 bp, human
ggcctcctggggcgtctccg

SEQ ID NO: 405487 - DNA, 20 bp, human
ggacggcctggtcaggaaaa

SEQ ID NO: 405488 - DNA, 20 bp, human
gaatcgggtcccagggggtt

SEQ ID NO: 405489 - DNA, 20 bp, human
gcccgcctaagcaaggacaa

SEQ ID NO: 405490 - DNA, 20 bp, human
ggcaggaatcgggtcccagg

SEQ ID NO: 405491 - DNA, 20 bp, human
gtcgaccacagggcctcctg

SEQ ID NO: 405492 - DNA, 20 bp, human
gaccacggagacgccccagg

SEQ ID NO: 405493 - DNA, 20 bp, human
ggggactcccttcccgaaaa

SEQ ID NO: 405494 - DNA, 20 bp, human
gctgcctgcgactaccattg

SEQ ID NO: 405495 - DNA, 20 bp, human
gaacggcccgggatgaaggg

SEQ ID NO: 405496 - DNA, 20 bp, human
gagggcggggagaatgtagg

SEQ ID NO: 405497 - DNA, 20 bp, human
gacgtcccttgggaagagga

SEQ ID NO: 405498 - DNA, 20 bp, human
ggggagggcggggagaatgt

SEQ ID NO: 405499 - DNA, 20 bp, human
gactggaagacggaagtcgc

SEQ ID NO: 405500 - DNA, 20 bp, human
gcggggagaatgtaggaggc

SEQ ID NO: 405501 - DNA, 20 bp, human
ggggtcctgcctgaaagtga

SEQ ID NO: 405502 - DNA, 20 bp, human
gggtagggccggaagtgcag

SEQ ID NO: 405503 - DNA, 20 bp, human
gggaagacggaagtcgcggg

SEQ ID NO: 405504 - DNA, 20 bp, human
gccacgaaggcgaccactct

SEQ ID NO: 405505 - DNA, 20 bp, human
gtaggggcggcaggcgaagc

SEQ ID NO: 405506 - DNA, 20 bp, human
ggggctggacgcttgggtgg

SEQ ID NO: 405507 - DNA, 20 bp, human
gtggacgcttgggtggaggt

SEQ ID NO: 405508 - DNA, 20 bp, human
gaagtctgatcagcctgcgg

SEQ ID NO: 405509 - DNA, 20 bp, human
gcgcgggctggacgcttggg

SEQ ID NO: 405510 - DNA, 20 bp, human
gccaatcggggacgagactg

SEQ ID NO: 405511 - DNA, 20 bp, human
gggcaagtctgatcagcctg

SEQ ID NO: 405512 - DNA, 20 bp, human
gtccccgattggcccgggaa

SEQ ID NO: 405513 - DNA, 20 bp, human
ggtgaagggtcgggaactga

SEQ ID NO: 405514 - DNA, 20 bp, human
gccccttcccgggccaatcg

SEQ ID NO: 405515 - DNA, 20 bp, human
gtctcgtccccgattggccc

SEQ ID NO: 405516 - DNA, 20 bp, human
gccgccctcgggcccgagag

SEQ ID NO: 405517 - DNA, 20 bp, human
gaggggagcggtacgagcgg

SEQ ID NO: 405518 - DNA, 20 bp, human
ggggctggacgggcgaccgg

SEQ ID NO: 405519 - DNA, 20 bp, human
gtgcccgcctctgtcgccaa

SEQ ID NO: 405520 - DNA, 20 bp, human
gaggactcgtcgtgaggtgt

SEQ ID NO: 405521 - DNA, 20 bp, human
gggcaccgcgggtggaacct

SEQ ID NO: 405522 - DNA, 20 bp, human
gggcgggcgggctgcagaaa

SEQ ID NO: 405523 - DNA, 20 bp, human
gcccgccactaacacccgtg

SEQ ID NO: 405524 - DNA, 20 bp, human
gccacggtaagaggcggtga

SEQ ID NO: 405525 - DNA, 20 bp, human
ggggcccgcagtacgcgcgg

SEQ ID NO: 405526 - DNA, 20 bp, human
gaacacgccggggcactctc

SEQ ID NO: 405527 - DNA, 20 bp, human
ggggcgcggcaaatgtggtt

SEQ ID NO: 405528 - DNA, 20 bp, human
ggccgcgcccacttccggga

SEQ ID NO: 405529 - DNA, 20 bp, human
ggaagtgggcgcggcaaatg

SEQ ID NO: 405530 - DNA, 20 bp, human
gggcaaatgtggttcggggc

SEQ ID NO: 405531 - DNA, 20 bp, human
ggtacccgggagcgcgtcgg

SEQ ID NO: 405532 - DNA, 20 bp, human
gggtgcgccggagagtgccc

SEQ ID NO: 405533 - DNA, 20 bp, human
gttggtccagagcgcggcgt

SEQ ID NO: 405534 - DNA, 20 bp, human
gccagagcgcggcgtaggtg

SEQ ID NO: 405535 - DNA, 20 bp, human
ggcctccccatcccggaagt

SEQ ID NO: 405536 - DNA, 20 bp, human
gcctcccaggccatgttctc

SEQ ID NO: 405537 - DNA, 20 bp, human
ggggagatacagcttgcatt

SEQ ID NO: 405538 - DNA, 20 bp, human
gaaagcctgagaacatggcc

SEQ ID NO: 405539 - DNA, 20 bp, human
gaatttgcttgtgcgagaca

SEQ ID NO: 405540 - DNA, 20 bp, human
gttctcaggcttttgaaccc

SEQ ID NO: 405541 - DNA, 20 bp, human
gaactaactggatatccaca

SEQ ID NO: 405542 - DNA, 20 bp, human
gatgtgctgggacaactaac

SEQ ID NO: 405543 - DNA, 20 bp, human
gatctcttttacaaatgtgc

SEQ ID NO: 405544 - DNA, 20 bp, human
gaacattactcttttccgtg

SEQ ID NO: 405545 - DNA, 20 bp, human
ggccccgctcgcctcctcgt

SEQ ID NO: 405546 - DNA, 20 bp, human
gcctgggccctcagctattg

SEQ ID NO: 405547 - DNA, 20 bp, human
gacgggagctcggtcttcaa

SEQ ID NO: 405548 - DNA, 20 bp, human
gtcctccaattgctactcaa

SEQ ID NO: 405549 - DNA, 20 bp, human
gatcagcagctcaatcaacc

SEQ ID NO: 405550 - DNA, 20 bp, human
gcagctattggggatgagaa

SEQ ID NO: 405551 - DNA, 20 bp, human
gaaaatgattgggcaataag

SEQ ID NO: 405552 - DNA, 20 bp, human
gaacaactgaaaatccaatc

SEQ ID NO: 405553 - DNA, 20 bp, human
ggatgagaagggatgcggag

SEQ ID NO: 405554 - DNA, 20 bp, human
gacgtgactggaaaaatgat

SEQ ID NO: 405555 - DNA, 20 bp, human
gaaacttttggcaatcaagc

SEQ ID NO: 405556 - DNA, 20 bp, human
gctgacgcccctggtggcga

SEQ ID NO: 405557 - DNA, 20 bp, human
gggcagcagcaatacccctg

SEQ ID NO: 405558 - DNA, 20 bp, human
gacgcggggttaaattgaga

SEQ ID NO: 405559 - DNA, 20 bp, human
gcggggttaaattgagaagg

SEQ ID NO: 405560 - DNA, 20 bp, human
gactgcctggaaccgtgatc

SEQ ID NO: 405561 - DNA, 20 bp, human
gcgcgctctgacgcccctgg

SEQ ID NO: 405562 - DNA, 20 bp, human
gtgccggcgcgagatcggcg

SEQ ID NO: 405563 - DNA, 20 bp, human
gcgcgcgcatgctcctagct

SEQ ID NO: 405564 - DNA, 20 bp, human
gcgtccagccgtcgccacca

SEQ ID NO: 405565 - DNA, 20 bp, human
ggaggccttgaaaggatctt

SEQ ID NO: 405566 - DNA, 20 bp, human
gttaaccgcccacggacgga

SEQ ID NO: 405567 - DNA, 20 bp, human
gtccgcgctggaagtctccg

SEQ ID NO: 405568 - DNA, 20 bp, human
gtccaccccctgaacatccg

SEQ ID NO: 405569 - DNA, 20 bp, human
gaaggccccggatgttcagg

SEQ ID NO: 405570 - DNA, 20 bp, human
gtgagacgccggttccgcgc

SEQ ID NO: 405571 - DNA, 20 bp, human
gtcagcaacagcgactcccc

SEQ ID NO: 405572 - DNA, 20 bp, human
ggagtcggcgtctacccatg

SEQ ID NO: 405573 - DNA, 20 bp, human
gggaaccggcgtctcagccg

SEQ ID NO: 405574 - DNA, 20 bp, human
gctgcccccggctgagacgc

SEQ ID NO: 405575 - DNA, 20 bp, human
gcccccggagacttccagcg

SEQ ID NO: 405576 - DNA, 20 bp, human
gagggagctcggacacgggg

SEQ ID NO: 405577 - DNA, 20 bp, human
gagccggcgcgctgcctcat

SEQ ID NO: 405578 - DNA, 20 bp, human
gccgcgtcggcgagaagaca

SEQ ID NO: 405579 - DNA, 20 bp, human
gggggcgcgtgggtcttcga

SEQ ID NO: 405580 - DNA, 20 bp, human
gagacagggagctcggacac

SEQ ID NO: 405581 - DNA, 20 bp, human
gtacccatgaggcagcgcgc

SEQ ID NO: 405582 - DNA, 20 bp, human
gtggcagccgagccgtggaa

SEQ ID NO: 405583 - DNA, 20 bp, human
gctgcctcatgggtaggctc

SEQ ID NO: 405584 - DNA, 20 bp, human
gggacacggggaggctgacc

SEQ ID NO: 405585 - DNA, 20 bp, human
gacggcggcggctcccattg

SEQ ID NO: 405586 - DNA, 20 bp, human
ggcgaacaggcgtgattggt

SEQ ID NO: 405587 - DNA, 20 bp, human
gatttggagccctgctaaaa

SEQ ID NO: 405588 - DNA, 20 bp, human
gtcgacccggccagagggga

SEQ ID NO: 405589 - DNA, 20 bp, human
gctgcgccgcagcttccgcc

SEQ ID NO: 405590 - DNA, 20 bp, human
gcggcctgcctgtcaatcac

SEQ ID NO: 405591 - DNA, 20 bp, human
gcactggggccgttgggcgg

SEQ ID NO: 405592 - DNA, 20 bp, human
gaatcactggggccgttggg

SEQ ID NO: 405593 - DNA, 20 bp, human
gcggctgcgcagtacacggg

SEQ ID NO: 405594 - DNA, 20 bp, human
gcggccagaggggagggcta

SEQ ID NO: 405595 - DNA, 20 bp, human
gaaggggcgggaagttacgg

SEQ ID NO: 405596 - DNA, 20 bp, human
ggggtcaggccccctcaatc

SEQ ID NO: 405597 - DNA, 20 bp, human
gggccccggtaggtccccgc

SEQ ID NO: 405598 - DNA, 20 bp, human
gtccccgctcgggtcggcca

SEQ ID NO: 405599 - DNA, 20 bp, human
gggcggggagcgccgccgaa

SEQ ID NO: 405600 - DNA, 20 bp, human
gcggggccactcccggactg

SEQ ID NO: 405601 - DNA, 20 bp, human
gtggcgcgcgggctgccaag

SEQ ID NO: 405602 - DNA, 20 bp, human
gccgcctgcggggacctacc

SEQ ID NO: 405603 - DNA, 20 bp, human
gaggagcaaacagtcccctt

SEQ ID NO: 405604 - DNA, 20 bp, human
gagcaaacagtccccttcgg

SEQ ID NO: 405605 - DNA, 20 bp, human
gtctccctggccgacccgag

SEQ ID NO: 405606 - DNA, 20 bp, human
gtccacagcggcagagtctc

SEQ ID NO: 405607 - DNA, 20 bp, human
gagagcctggaaatgctcgc

SEQ ID NO: 405608 - DNA, 20 bp, human
ggtgaagccaagttgcatgc

SEQ ID NO: 405609 - DNA, 20 bp, human
ggtctccggaagttgaaacc

SEQ ID NO: 405610 - DNA, 20 bp, human
gtccggagactctgccgctg

SEQ ID NO: 405611 - DNA, 20 bp, human
gccctaaaaggcctgtgccc

SEQ ID NO: 405612 - DNA, 20 bp, human
gctgtccaggtttcaacttc

SEQ ID NO: 405613 - DNA, 20 bp, human
ggcacaggccttttaggggc

SEQ ID NO: 405614 - DNA, 20 bp, human
ggtggttagtttggacccag

SEQ ID NO: 405615 - DNA, 20 bp, human
gcgaaaaaagcgcctttgac

SEQ ID NO: 405616 - DNA, 20 bp, human
gcaacctcgccccccgggag

SEQ ID NO: 405617 - DNA, 20 bp, human
ggggcacttccgctcccggg

SEQ ID NO: 405618 - DNA, 20 bp, human
gaggctcaggacggcgtatc

SEQ ID NO: 405619 - DNA, 20 bp, human
gcgagcaagtaggctcagga

SEQ ID NO: 405620 - DNA, 20 bp, human
gtaggggcacttccgctccc

SEQ ID NO: 405621 - DNA, 20 bp, human
gacacttccttgaatctcaa

SEQ ID NO: 405622 - DNA, 20 bp, human
gggagtcccacgcttcccgc

SEQ ID NO: 405623 - DNA, 20 bp, human
gtgttgaatgacgagcaagt

SEQ ID NO: 405624 - DNA, 20 bp, human
gaccttccggcgggaagcgt

SEQ ID NO: 405625 - DNA, 20 bp, human
gcacacgctgcgcggggtag

SEQ ID NO: 405626 - DNA, 20 bp, human
gcgcaaggctaccctggtga

SEQ ID NO: 405627 - DNA, 20 bp, human
ggctgcgcgcggggctttct

SEQ ID NO: 405628 - DNA, 20 bp, human
gaaagccccgcgcgcagcag

SEQ ID NO: 405629 - DNA, 20 bp, human
gaaggctaccctggtgaagg

SEQ ID NO: 405630 - DNA, 20 bp, human
gaacagaaataaaacatggg

SEQ ID NO: 405631 - DNA, 20 bp, human
gataaaacatggggggggcg

SEQ ID NO: 405632 - DNA, 20 bp, human
ggttattttagacgaatgca

SEQ ID NO: 405633 - DNA, 20 bp, human
gttttagtgaagacttttat

SEQ ID NO: 405634 - DNA, 20 bp, human
ggttgtaatgtgtctctttt

SEQ ID NO: 405635 - DNA, 20 bp, human
gtcaaaggccaccttcacca

SEQ ID NO: 405636 - DNA, 20 bp, human
ggattctcccagccgcacca

SEQ ID NO: 405637 - DNA, 20 bp, human
gggagcacccgtggtgcggc

SEQ ID NO: 405638 - DNA, 20 bp, human
ggtagttccgggcgggatga

SEQ ID NO: 405639 - DNA, 20 bp, human
gttaaacatatcataaaagg

SEQ ID NO: 405640 - DNA, 20 bp, human
gcacgaagctggaggtggat

SEQ ID NO: 405641 - DNA, 20 bp, human
gagtctagacacgaagctgg

SEQ ID NO: 405642 - DNA, 20 bp, human
gctagacacgaagctggagg

SEQ ID NO: 405643 - DNA, 20 bp, human
gtcattcactgagaaaagga

SEQ ID NO: 405644 - DNA, 20 bp, human
gggcagtctagacacgaagc

SEQ ID NO: 405645 - DNA, 20 bp, human
gataaaaggtggttctttca

SEQ ID NO: 405646 - DNA, 20 bp, human
gacggacggagctcttcgat

SEQ ID NO: 405647 - DNA, 20 bp, human
gggagcacccatggtgaggt

SEQ ID NO: 405648 - DNA, 20 bp, human
gatggtgaggttgggagaat

SEQ ID NO: 405649 - DNA, 20 bp, human
gtctcctgtgtctaatcctc

SEQ ID NO: 405650 - DNA, 20 bp, human
gttaaacgtagcataaaagg

SEQ ID NO: 405651 - DNA, 20 bp, human
gagtttaaacgtagcataaa

SEQ ID NO: 405652 - DNA, 20 bp, human
gaaggtggttctttcaaggg

SEQ ID NO: 405653 - DNA, 20 bp, human
gtaaaaggtggttctttcaa

SEQ ID NO: 405654 - DNA, 20 bp, human
gccgcaggtgggagcaccca

SEQ ID NO: 405655 - DNA, 20 bp, human
ggccctaagcactgtgccac

SEQ ID NO: 405656 - DNA, 20 bp, human
gacaagcaagtcagagcgat

SEQ ID NO: 405657 - DNA, 20 bp, human
gaagtcagagcgatgggtgg

SEQ ID NO: 405658 - DNA, 20 bp, human
gcgggcgcgcagcgttcctc

SEQ ID NO: 405659 - DNA, 20 bp, human
ggaaactttgaagttccctt

SEQ ID NO: 405660 - DNA, 20 bp, human
gagcaagtcagagcgatggg

SEQ ID NO: 405661 - DNA, 20 bp, human
ggttcccttcggaacctcgc

SEQ ID NO: 405662 - DNA, 20 bp, human
gggaacttcaaagtttcccc

SEQ ID NO: 405663 - DNA, 20 bp, human
gccagggaggtgccagtagc

SEQ ID NO: 405664 - DNA, 20 bp, human
gtgggcgccagatttcctag

SEQ ID NO: 405665 - DNA, 20 bp, human
gcggcagcttgggctccgat

SEQ ID NO: 405666 - DNA, 20 bp, human
gggcccgatggggaagatat

SEQ ID NO: 405667 - DNA, 20 bp, human
gcacgtacaaagggcccgat

SEQ ID NO: 405668 - DNA, 20 bp, human
ggggcagcagcggccgaaag

SEQ ID NO: 405669 - DNA, 20 bp, human
ggctgcccacttcccgctcg

SEQ ID NO: 405670 - DNA, 20 bp, human
gcggcgccgagcacgtacaa

SEQ ID NO: 405671 - DNA, 20 bp, human
gatggggaagatatgggggt

SEQ ID NO: 405672 - DNA, 20 bp, human
gggggcggtgcggaaaacgg

SEQ ID NO: 405673 - DNA, 20 bp, human
gcagcagcggccgaaagggg

SEQ ID NO: 405674 - DNA, 20 bp, human
gcccgagggaggtgaaggca

SEQ ID NO: 405675 - DNA, 20 bp, human
gagtggcgcgagagagcccg

SEQ ID NO: 405676 - DNA, 20 bp, human
gggaccgagccgccctgctg

SEQ ID NO: 405677 - DNA, 20 bp, human
gcctgctggggccctgacgg

SEQ ID NO: 405678 - DNA, 20 bp, human
gacactgcctagattgagtt

SEQ ID NO: 405679 - DNA, 20 bp, human
gcggcggcctaactcaatct

SEQ ID NO: 405680 - DNA, 20 bp, human
gcccgtggctccgcctacca

SEQ ID NO: 405681 - DNA, 20 bp, human
gggcgggtgaaactgagaca

SEQ ID NO: 405682 - DNA, 20 bp, human
gaggcagtgtcccgtgcgtt

SEQ ID NO: 405683 - DNA, 20 bp, human
gcccaagcgagaaaaatagt

SEQ ID NO: 405684 - DNA, 20 bp, human
gccgccctaaaacgggatca

SEQ ID NO: 405685 - DNA, 20 bp, human
gaaagctggaaaggcggaga

SEQ ID NO: 405686 - DNA, 20 bp, human
gggaggtcctcgcctctctg

SEQ ID NO: 405687 - DNA, 20 bp, human
gagcgaggcggggatagtca

SEQ ID NO: 405688 - DNA, 20 bp, human
ggaagctacaggtggaagcg

SEQ ID NO: 405689 - DNA, 20 bp, human
gctggcaggcggcgagggca

SEQ ID NO: 405690 - DNA, 20 bp, human
gggccacgaatgtgcgaaag

SEQ ID NO: 405691 - DNA, 20 bp, human
gaggagcgcgatcgctgacg

SEQ ID NO: 405692 - DNA, 20 bp, human
ggtggtttgctgactcaggg

SEQ ID NO: 405693 - DNA, 20 bp, human
gatcgctgacgcggcactcg

SEQ ID NO: 405694 - DNA, 20 bp, human
gcgctggagcacatgtcctg

SEQ ID NO: 405695 - DNA, 20 bp, human
gcccccaaggccggcgacgc

SEQ ID NO: 405696 - DNA, 20 bp, human
ggacacctgaggcccgaagt

SEQ ID NO: 405697 - DNA, 20 bp, human
ggccccagcttcgaggtcta

SEQ ID NO: 405698 - DNA, 20 bp, human
gctggggcgtctgacacctg

SEQ ID NO: 405699 - DNA, 20 bp, human
gacttctgggcgctcccgtc

SEQ ID NO: 405700 - DNA, 20 bp, human
gaggtggccagcttcttaga

SEQ ID NO: 405701 - DNA, 20 bp, human
ggggagcgcccagaagtctc

SEQ ID NO: 405702 - DNA, 20 bp, human
gctcggcggtgtgacggctc

SEQ ID NO: 405703 - DNA, 20 bp, human
ggtcagacgccccagcttcg

SEQ ID NO: 405704 - DNA, 20 bp, human
gccggcgcccggagacttct

SEQ ID NO: 405705 - DNA, 20 bp, human
gctgcgccgggcatgctcgg

SEQ ID NO: 405706 - DNA, 20 bp, human
gcagtcgaatctcccggcat

SEQ ID NO: 405707 - DNA, 20 bp, human
ggtaccacagcggcagcgaa

SEQ ID NO: 405708 - DNA, 20 bp, human
gacagcggcagcgaagggag

SEQ ID NO: 405709 - DNA, 20 bp, human
ggggagattcgactgctcag

SEQ ID NO: 405710 - DNA, 20 bp, human
ggaagcatgcttctgacgaa

SEQ ID NO: 405711 - DNA, 20 bp, human
gaaaggggaggaattttaga

SEQ ID NO: 405712 - DNA, 20 bp, human
ggacgaccgggctctcaaga

SEQ ID NO: 405713 - DNA, 20 bp, human
ggaatggtgcggtcctctcc

SEQ ID NO: 405714 - DNA, 20 bp, human
gctgtggtacagcccattct

SEQ ID NO: 405715 - DNA, 20 bp, human
gctccagggagatttcactg

SEQ ID NO: 405716 - DNA, 20 bp, human
gcgcagccgcagagaccctt

SEQ ID NO: 405717 - DNA, 20 bp, human
gcacttcccaagggtctctg

SEQ ID NO: 405718 - DNA, 20 bp, human
gccctgcggtacaaatgtcc

SEQ ID NO: 405719 - DNA, 20 bp, human
ggccgcgggcaaaccggtca

SEQ ID NO: 405720 - DNA, 20 bp, human
gtggtgcgccgcgggcaaac

SEQ ID NO: 405721 - DNA, 20 bp, human
gctggccggctctaggtcga

SEQ ID NO: 405722 - DNA, 20 bp, human
ggccaggcctgaagctatcg

SEQ ID NO: 405723 - DNA, 20 bp, human
gccatgcgcaaattgtcctg

SEQ ID NO: 405724 - DNA, 20 bp, human
ggtcctagctggccggctct

SEQ ID NO: 405725 - DNA, 20 bp, human
gctaggtcgacggccccagg

SEQ ID NO: 405726 - DNA, 20 bp, human
gcgccggctaacaatgagct

SEQ ID NO: 405727 - DNA, 20 bp, human
gacatccgggagaacccgaa

SEQ ID NO: 405728 - DNA, 20 bp, human
gagcgcctttcgggttctcc

SEQ ID NO: 405729 - DNA, 20 bp, human
gttgtaccctgcatccaacc

SEQ ID NO: 405730 - DNA, 20 bp, human
gcgcctcttggcagacatcc

SEQ ID NO: 405731 - DNA, 20 bp, human
gtgccaagaggcgtcgtgca

SEQ ID NO: 405732 - DNA, 20 bp, human
gctcccggatgtctgccaag

SEQ ID NO: 405733 - DNA, 20 bp, human
gcaggaaacgcccagtttct

SEQ ID NO: 405734 - DNA, 20 bp, human
gaaggcgctcgttgcctggt

SEQ ID NO: 405735 - DNA, 20 bp, human
ggctgtcattggctgcacgc

SEQ ID NO: 405736 - DNA, 20 bp, human
gggcccgggtatttaggtga

SEQ ID NO: 405737 - DNA, 20 bp, human
gctaaatacccgggcccctg

SEQ ID NO: 405738 - DNA, 20 bp, human
ggcccctggggttgcaggca

SEQ ID NO: 405739 - DNA, 20 bp, human
gttgaggagggagtcggctg

SEQ ID NO: 405740 - DNA, 20 bp, human
gtggggaatggcttcgaggg

SEQ ID NO: 405741 - DNA, 20 bp, human
gcccccctcacctaaatacc

SEQ ID NO: 405742 - DNA, 20 bp, human
gttcttggggagagtaccgg

SEQ ID NO: 405743 - DNA, 20 bp, human
gttggggccagatttgagga

SEQ ID NO: 405744 - DNA, 20 bp, human
gtctgtgccttgggccgtcg

SEQ ID NO: 405745 - DNA, 20 bp, human
gacgcacgcaaactcctaga

SEQ ID NO: 405746 - DNA, 20 bp, human
ggcggcgtctaatacggaag

SEQ ID NO: 405747 - DNA, 20 bp, human
ggtgccccggtggaatctga

SEQ ID NO: 405748 - DNA, 20 bp, human
gaagtcccgcgagaattgga

SEQ ID NO: 405749 - DNA, 20 bp, human
gtcccgcgagaattggaagg

SEQ ID NO: 405750 - DNA, 20 bp, human
gtctcgcgggacttcattgg

SEQ ID NO: 405751 - DNA, 20 bp, human
gcatggcggccgtgccccgg

SEQ ID NO: 405752 - DNA, 20 bp, human
gggaccgtcagattccaccg

SEQ ID NO: 405753 - DNA, 20 bp, human
ggtctaatacggaagcgggg

SEQ ID NO: 405754 - DNA, 20 bp, human
gtcaacctttaccactacga

SEQ ID NO: 405755 - DNA, 20 bp, human
gtcattggcggcgtctaata

SEQ ID NO: 405756 - DNA, 20 bp, human
ggaggagcggggaaccccgg

SEQ ID NO: 405757 - DNA, 20 bp, human
gggccgccacgtgacccctg

SEQ ID NO: 405758 - DNA, 20 bp, human
gttccccgctcctccactca

SEQ ID NO: 405759 - DNA, 20 bp, human
gacccctgtggcctccgcgc

SEQ ID NO: 405760 - DNA, 20 bp, human
ggcggggcgtgcagagctca

SEQ ID NO: 405761 - DNA, 20 bp, human
gcgctccctgagtggaggag

SEQ ID NO: 405762 - DNA, 20 bp, human
gtggggaggagcacagacgc

SEQ ID NO: 405763 - DNA, 20 bp, human
ggtgggcggagcggaaggaa

SEQ ID NO: 405764 - DNA, 20 bp, human
gcccgcggctggcggttgga

SEQ ID NO: 405765 - DNA, 20 bp, human
gggaggccacaggggtcacg

SEQ ID NO: 405766 - DNA, 20 bp, human
gggggaaggcagaggtgctc

SEQ ID NO: 405767 - DNA, 20 bp, human
gacaaaccacacatcgggga

SEQ ID NO: 405768 - DNA, 20 bp, human
ggcggggcactgaggtgggt

SEQ ID NO: 405769 - DNA, 20 bp, human
gctctctgattgcctaagaa

SEQ ID NO: 405770 - DNA, 20 bp, human
gtgcgggcaggacagggaga

SEQ ID NO: 405771 - DNA, 20 bp, human
gcatcacaaaccacacatcg

SEQ ID NO: 405772 - DNA, 20 bp, human
gggatgtcctggcccagggg

SEQ ID NO: 405773 - DNA, 20 bp, human
gggaggggacttgtggaggc

SEQ ID NO: 405774 - DNA, 20 bp, human
gcagaacggatcactgggga

SEQ ID NO: 405775 - DNA, 20 bp, human
gctctgccttccccgatgtg

SEQ ID NO: 405776 - DNA, 20 bp, human
gacccgagggcgagccccga

SEQ ID NO: 405777 - DNA, 20 bp, human
ggctgtcagacagtgtcccc

SEQ ID NO: 405778 - DNA, 20 bp, human
gcatcttccggaagggaggg

SEQ ID NO: 405779 - DNA, 20 bp, human
gggtgctgcagaccaagcca

SEQ ID NO: 405780 - DNA, 20 bp, human
gtaccactctaagccttctc

SEQ ID NO: 405781 - DNA, 20 bp, human
ggccgggccatcccggacga

SEQ ID NO: 405782 - DNA, 20 bp, human
ggccttctcgggacagagag

SEQ ID NO: 405783 - DNA, 20 bp, human
ggggctggagaaaggcccca

SEQ ID NO: 405784 - DNA, 20 bp, human
ggtcccgagaaggcttagag

SEQ ID NO: 405785 - DNA, 20 bp, human
gtctgtgatcactccgcaaa

SEQ ID NO: 405786 - DNA, 20 bp, human
gcccgcaggtccctagggcg

SEQ ID NO: 405787 - DNA, 20 bp, human
ggtaatccggagactcacag

SEQ ID NO: 405788 - DNA, 20 bp, human
gggctcgcggggagactcct

SEQ ID NO: 405789 - DNA, 20 bp, human
ggacctcaagccgtcccgtt

SEQ ID NO: 405790 - DNA, 20 bp, human
gtcgggccccgcaggtccct

SEQ ID NO: 405791 - DNA, 20 bp, human
gattaccagtccaaacggga

SEQ ID NO: 405792 - DNA, 20 bp, human
gttgaggtccccgcgcccta

SEQ ID NO: 405793 - DNA, 20 bp, human
gcctgcggggcccgagcgca

SEQ ID NO: 405794 - DNA, 20 bp, human
gtctggcgcgccctgcgctc

SEQ ID NO: 405795 - DNA, 20 bp, human
gcggcttcccaagagctctg

SEQ ID NO: 405796 - DNA, 20 bp, human
gggacccccgagaaggtagg

SEQ ID NO: 405797 - DNA, 20 bp, human
ggcgggacccccgagaaggt

SEQ ID NO: 405798 - DNA, 20 bp, human
gctgggcgggacccccgaga

SEQ ID NO: 405799 - DNA, 20 bp, human
gaggccccgcctaccttctc

SEQ ID NO: 405800 - DNA, 20 bp, human
ggcggggcctggactaggcc

SEQ ID NO: 405801 - DNA, 20 bp, human
ggggatgagacgcgaagagg

SEQ ID NO: 405802 - DNA, 20 bp, human
gggcggggttgagaaacaag

SEQ ID NO: 405803 - DNA, 20 bp, human
gggcctgaacaaggccgggg

SEQ ID NO: 405804 - DNA, 20 bp, human
gcggggcctgaacaaggccg

SEQ ID NO: 405805 - DNA, 20 bp, human
gctggctgggagaagagtcc

SEQ ID NO: 405806 - DNA, 20 bp, human
gggagccgagtcttcggaaa

SEQ ID NO: 405807 - DNA, 20 bp, human
ggcccggggcgcctgcgctc

SEQ ID NO: 405808 - DNA, 20 bp, human
gcctcccaccaaaacgccga

SEQ ID NO: 405809 - DNA, 20 bp, human
ggagccctcggcgttttggt

SEQ ID NO: 405810 - DNA, 20 bp, human
gtgctggcgcagtggaaggc

SEQ ID NO: 405811 - DNA, 20 bp, human
gccaataggagccgagtctt

SEQ ID NO: 405812 - DNA, 20 bp, human
gacgccctagtggccggaga

SEQ ID NO: 405813 - DNA, 20 bp, human
ggtcttgctggcgcagtgga

SEQ ID NO: 405814 - DNA, 20 bp, human
gtcacatgatcacccctctc

SEQ ID NO: 405815 - DNA, 20 bp, human
gtccccaaggctgttaaccg

SEQ ID NO: 405816 - DNA, 20 bp, human
gggcggcctcgggttttcaa

SEQ ID NO: 405817 - DNA, 20 bp, human
ggggaaccacgtgacccgga

SEQ ID NO: 405818 - DNA, 20 bp, human
ggggccactaccggtctcct

SEQ ID NO: 405819 - DNA, 20 bp, human
ggggaaatggagtcgcgcgg

SEQ ID NO: 405820 - DNA, 20 bp, human
gaggcgggaaccacgtgacc

SEQ ID NO: 405821 - DNA, 20 bp, human
gtgggccaatgagaaccgaa

SEQ ID NO: 405822 - DNA, 20 bp, human
gttgccaaggagaccggtag

SEQ ID NO: 405823 - DNA, 20 bp, human
ggccccgcgcggcaggggct

SEQ ID NO: 405824 - DNA, 20 bp, human
gcgcttgcgtacagccttcc

SEQ ID NO: 405825 - DNA, 20 bp, human
gccagcccttcggttctcat

SEQ ID NO: 405826 - DNA, 20 bp, human
ggggccattaccagtctcca

SEQ ID NO: 405827 - DNA, 20 bp, human
gagctgccgcgggtttccaa

SEQ ID NO: 405828 - DNA, 20 bp, human
gtggggcaatgtgagctctg

SEQ ID NO: 405829 - DNA, 20 bp, human
gcgcgctgggcgcctggaaa

SEQ ID NO: 405830 - DNA, 20 bp, human
gaggaaccacataacccaga

SEQ ID NO: 405831 - DNA, 20 bp, human
gcgcttgcgcacagccttct

SEQ ID NO: 405832 - DNA, 20 bp, human
ggctgcgctactccatttcc

SEQ ID NO: 405833 - DNA, 20 bp, human
gtccgcgccgaaaaacaggc

SEQ ID NO: 405834 - DNA, 20 bp, human
gagcgtctgcgcgcgtattg

SEQ ID NO: 405835 - DNA, 20 bp, human
ggaactgggaatccccaacg

SEQ ID NO: 405836 - DNA, 20 bp, human
gctcggaggtgctgaccctc

SEQ ID NO: 405837 - DNA, 20 bp, human
ggagcgctaaagattggcgg

SEQ ID NO: 405838 - DNA, 20 bp, human
gccctctggagccgctgacg

SEQ ID NO: 405839 - DNA, 20 bp, human
gcaagccgagtgtacgggaa

SEQ ID NO: 405840 - DNA, 20 bp, human
gggtccgctgtcacgctcgg

SEQ ID NO: 405841 - DNA, 20 bp, human
gtgggcgggccctcgcgtgg

SEQ ID NO: 405842 - DNA, 20 bp, human
ggctaccagccccatcggcg

SEQ ID NO: 405843 - DNA, 20 bp, human
ggcctgctattggctgacgc

SEQ ID NO: 405844 - DNA, 20 bp, human
gcatcggcgcggcctgctat

SEQ ID NO: 405845 - DNA, 20 bp, human
gaaagattggcgggggttgt

SEQ ID NO: 405846 - DNA, 20 bp, human
gccgaggcaagtccacgcca

SEQ ID NO: 405847 - DNA, 20 bp, human
gcacgcgcacatccttgtcc

SEQ ID NO: 405848 - DNA, 20 bp, human
gctggggcggccgcgggtac

SEQ ID NO: 405849 - DNA, 20 bp, human
gacaaggatgtgcgcgtgcg

SEQ ID NO: 405850 - DNA, 20 bp, human
gccaacgctggggcggccgc

SEQ ID NO: 405851 - DNA, 20 bp, human
gcccccgcccaacgctgggg

SEQ ID NO: 405852 - DNA, 20 bp, human
ggcgtggacttgcctcgggg

SEQ ID NO: 405853 - DNA, 20 bp, human
gaccgggttattcattaccc

SEQ ID NO: 405854 - DNA, 20 bp, human
ggccgccccagcgttgggcg

SEQ ID NO: 405855 - DNA, 20 bp, human
gagcttcccccgcccaacgc

SEQ ID NO: 405856 - DNA, 20 bp, human
gcgcggctaacgcaacccga

SEQ ID NO: 405857 - DNA, 20 bp, human
gccagcgtcggggcactgag

SEQ ID NO: 405858 - DNA, 20 bp, human
gaacccgagggcggaagcgg

SEQ ID NO: 405859 - DNA, 20 bp, human
gctccaccgcttccgccctc

SEQ ID NO: 405860 - DNA, 20 bp, human
ggcccaagccttggcatcac

SEQ ID NO: 405861 - DNA, 20 bp, human
ggaagggaccccaacgtgag

SEQ ID NO: 405862 - DNA, 20 bp, human
gaaagacgcccgtgatgcca

SEQ ID NO: 405863 - DNA, 20 bp, human
gtgcggtgtgcaggttttct

SEQ ID NO: 405864 - DNA, 20 bp, human
gacctggcgccgaccttgaa

SEQ ID NO: 405865 - DNA, 20 bp, human
gggctaacgcaacccgaggg

SEQ ID NO: 405866 - DNA, 20 bp, human
gtccccgcccactcctgcgg

SEQ ID NO: 405867 - DNA, 20 bp, human
gccttccccgcccactcctg

SEQ ID NO: 405868 - DNA, 20 bp, human
ggaaaaggaagggaatgcga

SEQ ID NO: 405869 - DNA, 20 bp, human
gtggcccccgcaggagtggg

SEQ ID NO: 405870 - DNA, 20 bp, human
gcattggcccccgcaggagt

SEQ ID NO: 405871 - DNA, 20 bp, human
gacggctgacgtcataggac

SEQ ID NO: 405872 - DNA, 20 bp, human
ggccttacggctgacgtcat

SEQ ID NO: 405873 - DNA, 20 bp, human
ggggaatgcgagggaaaata

SEQ ID NO: 405874 - DNA, 20 bp, human
gcagatcctctgcttaggaa

SEQ ID NO: 405875 - DNA, 20 bp, human
gaaggcgctgctgtcgtaaa

SEQ ID NO: 405876 - DNA, 20 bp, human
gcaggtgagattggcgccca

SEQ ID NO: 405877 - DNA, 20 bp, human
ggacacagcggttgcgtcac

SEQ ID NO: 405878 - DNA, 20 bp, human
ggctcggtgcgcttctgcac

SEQ ID NO: 405879 - DNA, 20 bp, human
gaagcgtcattgggggtgat

SEQ ID NO: 405880 - DNA, 20 bp, human
gcgggctctccccataacta

SEQ ID NO: 405881 - DNA, 20 bp, human
gtcggtcccgccacccatgg

SEQ ID NO: 405882 - DNA, 20 bp, human
gcacgcgcacatgtgtgtcg

SEQ ID NO: 405883 - DNA, 20 bp, human
gtctccccataactagggct

SEQ ID NO: 405884 - DNA, 20 bp, human
gcgcatgcgcaccccggact

SEQ ID NO: 405885 - DNA, 20 bp, human
gtgcgcaccccggactcggg

SEQ ID NO: 405886 - DNA, 20 bp, human
gcggactggcggagatgcag

SEQ ID NO: 405887 - DNA, 20 bp, human
gacccccggtcaccagttat

SEQ ID NO: 405888 - DNA, 20 bp, human
gtccgaggggagacgggcac

SEQ ID NO: 405889 - DNA, 20 bp, human
gtacgtgcacatacgtgtag

SEQ ID NO: 405890 - DNA, 20 bp, human
gtacgctcacatacgtgtcg

SEQ ID NO: 405891 - DNA, 20 bp, human
gcaggtgagattggtgcgcg

SEQ ID NO: 405892 - DNA, 20 bp, human
gcacccgtgtcacagttacg

SEQ ID NO: 405893 - DNA, 20 bp, human
gttggtgcgcgtggctccga

SEQ ID NO: 405894 - DNA, 20 bp, human
gcgggcacacagaccctgac

SEQ ID NO: 405895 - DNA, 20 bp, human
gactcggtcccgccaccccc

SEQ ID NO: 405896 - DNA, 20 bp, human
gaggtcccggggcaaaagtg

SEQ ID NO: 405897 - DNA, 20 bp, human
ggggccgccgggaacggaag

SEQ ID NO: 405898 - DNA, 20 bp, human
gccgcccatcagccatcgga

SEQ ID NO: 405899 - DNA, 20 bp, human
gagtgtggcttgccctccga

SEQ ID NO: 405900 - DNA, 20 bp, human
ggaggggacctgggcttcaa

SEQ ID NO: 405901 - DNA, 20 bp, human
ggtccgagagacagggatag

SEQ ID NO: 405902 - DNA, 20 bp, human
gttacccgggggatgaggtt

SEQ ID NO: 405903 - DNA, 20 bp, human
gcgcctcaggggcaaaaatg

SEQ ID NO: 405904 - DNA, 20 bp, human
gagtggggtcccacagagca

SEQ ID NO: 405905 - DNA, 20 bp, human
gagcctatgtccgagagaca

SEQ ID NO: 405906 - DNA, 20 bp, human
gggccaccgccctaccctga

SEQ ID NO: 405907 - DNA, 20 bp, human
ggtggccgcgacgccttctg

SEQ ID NO: 405908 - DNA, 20 bp, human
gagagcctggcgaaccggaa

SEQ ID NO: 405909 - DNA, 20 bp, human
gtcaaagatccctcagggta

SEQ ID NO: 405910 - DNA, 20 bp, human
gaagatccctcagggtaggg

SEQ ID NO: 405911 - DNA, 20 bp, human
gcatgcgcagaaaggccccc

SEQ ID NO: 405912 - DNA, 20 bp, human
gcccgggagagccccgggaa

SEQ ID NO: 405913 - DNA, 20 bp, human
gggactgtggtccggaaagc

SEQ ID NO: 405914 - DNA, 20 bp, human
gggtccggaaagccggcggg

SEQ ID NO: 405915 - DNA, 20 bp, human
ggaacagcacatgcgcagaa

SEQ ID NO: 405916 - DNA, 20 bp, human
gaaccctgcggcctagggaa

SEQ ID NO: 405917 - DNA, 20 bp, human
gccagcgggggaagtagttc

SEQ ID NO: 405918 - DNA, 20 bp, human
ggggctcagtgccaaacacc

SEQ ID NO: 405919 - DNA, 20 bp, human
gcgcccaaccctgcggccta

SEQ ID NO: 405920 - DNA, 20 bp, human
gctaacgggcagagctcgat

SEQ ID NO: 405921 - DNA, 20 bp, human
gtctcggcggagtgttacgt

SEQ ID NO: 405922 - DNA, 20 bp, human
gttcgccgcgcccaaccctg

SEQ ID NO: 405923 - DNA, 20 bp, human
ggccccgctctcttggggcg

SEQ ID NO: 405924 - DNA, 20 bp, human
gcggagtgttacgtaggaag

SEQ ID NO: 405925 - DNA, 20 bp, human
gggggcgtggctcccagtgg

SEQ ID NO: 405926 - DNA, 20 bp, human
gacgactcccgaggactctg

SEQ ID NO: 405927 - DNA, 20 bp, human
gtgtacctggacgactcccg

SEQ ID NO: 405928 - DNA, 20 bp, human
ggggagtgtagtccaccgag

SEQ ID NO: 405929 - DNA, 20 bp, human
gcctgcgcgtcgcatcccct

SEQ ID NO: 405930 - DNA, 20 bp, human
gctacccagcatcctcggcg

SEQ ID NO: 405931 - DNA, 20 bp, human
ggagtcctcgggagtcgtcc

SEQ ID NO: 405932 - DNA, 20 bp, human
gcggccgcgctgaggattct

SEQ ID NO: 405933 - DNA, 20 bp, human
gtggtcatagcggtccaccc

SEQ ID NO: 405934 - DNA, 20 bp, human
gctacgctacccagcatcct

SEQ ID NO: 405935 - DNA, 20 bp, human
ggcgacccggaatccttgga

SEQ ID NO: 405936 - DNA, 20 bp, human
gtttccccggggcactccaa

SEQ ID NO: 405937 - DNA, 20 bp, human
ggctgctcgcccggcctcac

SEQ ID NO: 405938 - DNA, 20 bp, human
gacttctctaccaatccgaa

SEQ ID NO: 405939 - DNA, 20 bp, human
gaagtgccccgctaggcagt

SEQ ID NO: 405940 - DNA, 20 bp, human
gtcgcccggcctcacgggaa

SEQ ID NO: 405941 - DNA, 20 bp, human
ggagtgccccggggaaagcc

SEQ ID NO: 405942 - DNA, 20 bp, human
ggaaacgcagacgtagccgg

SEQ ID NO: 405943 - DNA, 20 bp, human
gcagacgtagccggcggacg

SEQ ID NO: 405944 - DNA, 20 bp, human
gggccgggcgagcagccctt

SEQ ID NO: 405945 - DNA, 20 bp, human
gagcatcaagctgtgcgcgt

SEQ ID NO: 405946 - DNA, 20 bp, human
gtctcccggggcgacccaaa

SEQ ID NO: 405947 - DNA, 20 bp, human
ggacgcgagagcagcccttc

SEQ ID NO: 405948 - DNA, 20 bp, human
ggagagcagcccttcgggat

SEQ ID NO: 405949 - DNA, 20 bp, human
gcggaaacgcagaaacgcag

SEQ ID NO: 405950 - DNA, 20 bp, human
gcagaggtagccagtggatg

SEQ ID NO: 405951 - DNA, 20 bp, human
gcctctctgccaatcccgaa

SEQ ID NO: 405952 - DNA, 20 bp, human
ggctgctctcgcgtcctcac

SEQ ID NO: 405953 - DNA, 20 bp, human
gagcgccaggctttgagcgt

SEQ ID NO: 405954 - DNA, 20 bp, human
ggaaacgcagaggtagccag

SEQ ID NO: 405955 - DNA, 20 bp, human
gcgcagccctggctctcccg

SEQ ID NO: 405956 - DNA, 20 bp, human
gtgtcggctgcccacctccc

SEQ ID NO: 405957 - DNA, 20 bp, human
gaagctaggacgccgcgtgt

SEQ ID NO: 405958 - DNA, 20 bp, human
ggaggtgggcagccgacacg

SEQ ID NO: 405959 - DNA, 20 bp, human
gaatggcaaagccgtaaagc

SEQ ID NO: 405960 - DNA, 20 bp, human
gcgcctcggacccagacagt

SEQ ID NO: 405961 - DNA, 20 bp, human
gcttcccagagcggcccgga

SEQ ID NO: 405962 - DNA, 20 bp, human
gtgggtccgaggcgccgtcc

SEQ ID NO: 405963 - DNA, 20 bp, human
ggggccgaacgggcgaggtt

SEQ ID NO: 405964 - DNA, 20 bp, human
gacctccctggcttgcagta

SEQ ID NO: 405965 - DNA, 20 bp, human
gccgccaatcggaaccgatc

SEQ ID NO: 405966 - DNA, 20 bp, human
gaaacccaacctaggctcgc

SEQ ID NO: 405967 - DNA, 20 bp, human
gaggcggggtccacactcgg

SEQ ID NO: 405968 - DNA, 20 bp, human
gtgtgcggcggatataaggt

SEQ ID NO: 405969 - DNA, 20 bp, human
ggggcagcccagagatgctg

SEQ ID NO: 405970 - DNA, 20 bp, human
gagcctaggttgggtttcca

SEQ ID NO: 405971 - DNA, 20 bp, human
gcactcgataacccagtcac

SEQ ID NO: 405972 - DNA, 20 bp, human
ggggtcgggtccggtgagat

SEQ ID NO: 405973 - DNA, 20 bp, human
gcgcgggaccccagcatctc

SEQ ID NO: 405974 - DNA, 20 bp, human
ggactcacgtgctgtgggaa

SEQ ID NO: 405975 - DNA, 20 bp, human
gggccccgactcaaccgcca

SEQ ID NO: 405976 - DNA, 20 bp, human
ggggcatcacagtatgagac

SEQ ID NO: 405977 - DNA, 20 bp, human
gccaggaagcacatagttga

SEQ ID NO: 405978 - DNA, 20 bp, human
ggtcatacccgcagagtagt

SEQ ID NO: 405979 - DNA, 20 bp, human
gccccccagattgctgcttg

SEQ ID NO: 405980 - DNA, 20 bp, human
gcccgcagagtagtgggaag

SEQ ID NO: 405981 - DNA, 20 bp, human
ggaccacaagcagcaatctg

SEQ ID NO: 405982 - DNA, 20 bp, human
gaaaaagcaagactatgtca

SEQ ID NO: 405983 - DNA, 20 bp, human
gatgctgcgacttgacatgc

SEQ ID NO: 405984 - DNA, 20 bp, human
gaatacatcctcgtcatctg

SEQ ID NO: 405985 - DNA, 20 bp, human
gtgtggcttcgaaaactccc

SEQ ID NO: 405986 - DNA, 20 bp, human
gcactccccacaagcctctg

SEQ ID NO: 405987 - DNA, 20 bp, human
ggagcaatgcgctgtctgtc

SEQ ID NO: 405988 - DNA, 20 bp, human
gtgtctgtcaggcgtgtgtt

SEQ ID NO: 405989 - DNA, 20 bp, human
gcggaccacctgaattccct

SEQ ID NO: 405990 - DNA, 20 bp, human
gcaggcgcttccggaagctg

SEQ ID NO: 405991 - DNA, 20 bp, human
gtggctctgtggcggccaat

SEQ ID NO: 405992 - DNA, 20 bp, human
ggagagaagtcatttccgat

SEQ ID NO: 405993 - DNA, 20 bp, human
gtcagcccagggaattcagg

SEQ ID NO: 405994 - DNA, 20 bp, human
gtccgattggcgaatctagc

SEQ ID NO: 405995 - DNA, 20 bp, human
gccaacatcctcgcaggctt

SEQ ID NO: 405996 - DNA, 20 bp, human
gcgcgccaggggaatcggga

SEQ ID NO: 405997 - DNA, 20 bp, human
gaggcctggccaagcaaaaa

SEQ ID NO: 405998 - DNA, 20 bp, human
gccaggggaatcgggatggc

SEQ ID NO: 405999 - DNA, 20 bp, human
ggagtccgcgccaggggaat

SEQ ID NO: 406000 - DNA, 20 bp, human
gcggtccagtatgtctcccg

SEQ ID NO: 406001 - DNA, 20 bp, human
gactcccggaaggctccgat

SEQ ID NO: 406002 - DNA, 20 bp, human
gccagcatggggagtcggaa

SEQ ID NO: 406003 - DNA, 20 bp, human
gctgactaaagcttggtcta

SEQ ID NO: 406004 - DNA, 20 bp, human
ggtcaggtgagactcccgga

SEQ ID NO: 406005 - DNA, 20 bp, human
gtatcgcgggagagtgccct

SEQ ID NO: 406006 - DNA, 20 bp, human
ggggtcccgcacggcagcgc

SEQ ID NO: 406007 - DNA, 20 bp, human
gagagcgtgtgccgtggatt

SEQ ID NO: 406008 - DNA, 20 bp, human
gtacctcagagcgtgtgccg

SEQ ID NO: 406009 - DNA, 20 bp, human
gacacgctctgaggtaccag

SEQ ID NO: 406010 - DNA, 20 bp, human
gtgcacccgcgctgccgtgc

SEQ ID NO: 406011 - DNA, 20 bp, human
gtatcgcgagatttggtggg

SEQ ID NO: 406012 - DNA, 20 bp, human
gccacacgagcctctccggg

SEQ ID NO: 406013 - DNA, 20 bp, human
gcaaacctcgcgagatttgt

SEQ ID NO: 406014 - DNA, 20 bp, human
gccagccaacaaatctcgcg

SEQ ID NO: 406015 - DNA, 20 bp, human
gaggtatcgcgagatttggt

SEQ ID NO: 406016 - DNA, 20 bp, human
gcgtgcgcggaaaagagccc

SEQ ID NO: 406017 - DNA, 20 bp, human
ggaaaagagcccgggcactc

SEQ ID NO: 406018 - DNA, 20 bp, human
ggtctgcggacgaaacgctg

SEQ ID NO: 406019 - DNA, 20 bp, human
gaaaaatgagactgcgggct

SEQ ID NO: 406020 - DNA, 20 bp, human
gaacggggatctgggaatcg

SEQ ID NO: 406021 - DNA, 20 bp, human
gaagcggatcgtgttgggtg

SEQ ID NO: 406022 - DNA, 20 bp, human
gtgcggacgaaacgctgggg

SEQ ID NO: 406023 - DNA, 20 bp, human
gtccggaagcggatcgtgtt

SEQ ID NO: 406024 - DNA, 20 bp, human
ggaaacgctggggcggagct

SEQ ID NO: 406025 - DNA, 20 bp, human
gtgcgggctaggcaggctga

SEQ ID NO: 406026 - DNA, 20 bp, human
ggaggggcgcatcccaagca

SEQ ID NO: 406027 - DNA, 20 bp, human
gggatggggcagaagcgctt

SEQ ID NO: 406028 - DNA, 20 bp, human
gcgagaggaaagcacctccg

SEQ ID NO: 406029 - DNA, 20 bp, human
gtggggcagaagcgcttagg

SEQ ID NO: 406030 - DNA, 20 bp, human
ggtcgccccagaccagggat

SEQ ID NO: 406031 - DNA, 20 bp, human
ggaggtgctttcctctcgat

SEQ ID NO: 406032 - DNA, 20 bp, human
gctaagtgagcctcagggag

SEQ ID NO: 406033 - DNA, 20 bp, human
ggcctctctaggaacctcgg

SEQ ID NO: 406034 - DNA, 20 bp, human
gacaggaagtgcctcgggat

SEQ ID NO: 406035 - DNA, 20 bp, human
gccctggtctggggcgacat

SEQ ID NO: 406036 - DNA, 20 bp, human
gttcaaacatggctgccgtc

SEQ ID NO: 406037 - DNA, 20 bp, human
gccgtcaggagccacggcta

SEQ ID NO: 406038 - DNA, 20 bp, human
gtggctgccgtcaggagcca

SEQ ID NO: 406039 - DNA, 20 bp, human
gatggccgcgcccatagccg

SEQ ID NO: 406040 - DNA, 20 bp, human
gtgaaaattggacgcacaga

SEQ ID NO: 406041 - DNA, 20 bp, human
gttggacgcacagaaggcag

SEQ ID NO: 406042 - DNA, 20 bp, human
gtggaccataaacccgtgcg

SEQ ID NO: 406043 - DNA, 20 bp, human
ggcaaggacaagcgcattta

SEQ ID NO: 406044 - DNA, 20 bp, human
ggtgcgaggactccagaagt

SEQ ID NO: 406045 - DNA, 20 bp, human
gcgggtttatggtccaccta

SEQ ID NO: 406046 - DNA, 20 bp, human
ggggaaatggagtccacgag

SEQ ID NO: 406047 - DNA, 20 bp, human
ggggccctcttgtggcatgt

SEQ ID NO: 406048 - DNA, 20 bp, human
gtggggccctccagctcaca

SEQ ID NO: 406049 - DNA, 20 bp, human
gggcgtgggcggcaggaaaa

SEQ ID NO: 406050 - DNA, 20 bp, human
gataaggggaggttcgctga

SEQ ID NO: 406051 - DNA, 20 bp, human
ggctcacaggggccctcttg

SEQ ID NO: 406052 - DNA, 20 bp, human
gttatagggaagataagggg

SEQ ID NO: 406053 - DNA, 20 bp, human
gcgcccagacgccgtcgggg

SEQ ID NO: 406054 - DNA, 20 bp, human
gcgcgcccacatgccacaag

SEQ ID NO: 406055 - DNA, 20 bp, human
ggagaggacacctgcattcg

SEQ ID NO: 406056 - DNA, 20 bp, human
gctcacccgggccctctcat

SEQ ID NO: 406057 - DNA, 20 bp, human
gagaaggggaggttcccgga

SEQ ID NO: 406058 - DNA, 20 bp, human
gccccgggttcctggttctt

SEQ ID NO: 406059 - DNA, 20 bp, human
gggcgcccagacctatgaga

SEQ ID NO: 406060 - DNA, 20 bp, human
gcgggtgagctgtagagccc

SEQ ID NO: 406061 - DNA, 20 bp, human
gccgggccctctcataggtc

SEQ ID NO: 406062 - DNA, 20 bp, human
gaatttcaggatggcgtggg

SEQ ID NO: 406063 - DNA, 20 bp, human
gtccgaagaaccaggaaccc

SEQ ID NO: 406064 - DNA, 20 bp, human
ggggaggacgctggctttct

SEQ ID NO: 406065 - DNA, 20 bp, human
gcagagcgcctgggacctag

SEQ ID NO: 406066 - DNA, 20 bp, human
gaaaggcgacagtgcgcgga

SEQ ID NO: 406067 - DNA, 20 bp, human
gagacctcctgcctcgtgtg

SEQ ID NO: 406068 - DNA, 20 bp, human
ggtcccctgggaagtgtagt

SEQ ID NO: 406069 - DNA, 20 bp, human
ggggaagtgtagtcggcgtg

SEQ ID NO: 406070 - DNA, 20 bp, human
gagtacgcacgccgcacacg

SEQ ID NO: 406071 - DNA, 20 bp, human
ggtgctgtagctcccaccgc

SEQ ID NO: 406072 - DNA, 20 bp, human
gcgccaacgagagctctcaa

SEQ ID NO: 406073 - DNA, 20 bp, human
gtctcaaaggcgacagtgcg

SEQ ID NO: 406074 - DNA, 20 bp, human
gtaacaagtgcgcgggctgt

SEQ ID NO: 406075 - DNA, 20 bp, human
gcgcacgccgcacacgaggc

SEQ ID NO: 406076 - DNA, 20 bp, human
ggggacaaaggcctgcccgg

SEQ ID NO: 406077 - DNA, 20 bp, human
gcaggcctttgtccccggcc

SEQ ID NO: 406078 - DNA, 20 bp, human
gccaggaggagactagggat

SEQ ID NO: 406079 - DNA, 20 bp, human
gccagggctgcgtgcgggcg

SEQ ID NO: 406080 - DNA, 20 bp, human
gagagaaagagatagggcca

SEQ ID NO: 406081 - DNA, 20 bp, human
gccgcgcggtcggggtggcc

SEQ ID NO: 406082 - DNA, 20 bp, human
gcacggtgcagacaaaggcg

SEQ ID NO: 406083 - DNA, 20 bp, human
gaaggcgcggccgcgcggtc

SEQ ID NO: 406084 - DNA, 20 bp, human
ggtcccagcagctcccgctg

SEQ ID NO: 406085 - DNA, 20 bp, human
gggccggccgagggccgcag

SEQ ID NO: 406086 - DNA, 20 bp, human
ggtacggccgcgccccagtg

SEQ ID NO: 406087 - DNA, 20 bp, human
ggctgtgcgtgcggcgatgc

SEQ ID NO: 406088 - DNA, 20 bp, human
gacatggggtcgggatcttg

SEQ ID NO: 406089 - DNA, 20 bp, human
gctggtggccaagacctggg

SEQ ID NO: 406090 - DNA, 20 bp, human
gggaaggctcgcccgcaatc

SEQ ID NO: 406091 - DNA, 20 bp, human
gagccccggcgatccaaaag

SEQ ID NO: 406092 - DNA, 20 bp, human
ggtacggggccaatcacatc

SEQ ID NO: 406093 - DNA, 20 bp, human
ggcgcggccgtaccagtgcg

SEQ ID NO: 406094 - DNA, 20 bp, human
ggcgggaagtccttcagcca

SEQ ID NO: 406095 - DNA, 20 bp, human
gagggtggcaccgtggctga

SEQ ID NO: 406096 - DNA, 20 bp, human
gcccactcgcgggagccccc

SEQ ID NO: 406097 - DNA, 20 bp, human
gacgggctgcgcagccggag

SEQ ID NO: 406098 - DNA, 20 bp, human
gagcccccgcgctggggaag

SEQ ID NO: 406099 - DNA, 20 bp, human
ggcgactgcgcgagagggga

SEQ ID NO: 406100 - DNA, 20 bp, human
ggagccgcgcgcaaaccttc

SEQ ID NO: 406101 - DNA, 20 bp, human
gggccccggggcccgagtgg

SEQ ID NO: 406102 - DNA, 20 bp, human
ggcagcccgtccggccccgg

SEQ ID NO: 406103 - DNA, 20 bp, human
gggctcgccgagcgcactgg

SEQ ID NO: 406104 - DNA, 20 bp, human
gctgcgcagccggagaggcg

SEQ ID NO: 406105 - DNA, 20 bp, human
gagcgcgagacgaggccccg

SEQ ID NO: 406106 - DNA, 20 bp, human
ggggcaccgcgccgtgggtg

SEQ ID NO: 406107 - DNA, 20 bp, human
gagagcaagggtgttccccg

SEQ ID NO: 406108 - DNA, 20 bp, human
gcgggagcccgatccgactc

SEQ ID NO: 406109 - DNA, 20 bp, human
gatgctgggatcattccccg

SEQ ID NO: 406110 - DNA, 20 bp, human
gcggcgctcgcgggcaccgt

SEQ ID NO: 406111 - DNA, 20 bp, human
gggaccggcggcgtccaggg

SEQ ID NO: 406112 - DNA, 20 bp, human
gtccggaacccccgcaccca

SEQ ID NO: 406113 - DNA, 20 bp, human
gagaaagcgccgcgactgcg

SEQ ID NO: 406114 - DNA, 20 bp, human
gcccgcggaggtggcagccc

SEQ ID NO: 406115 - DNA, 20 bp, human
gagggtgttccccgcggagg

SEQ ID NO: 406116 - DNA, 20 bp, human
ggcctgcagcctctggtatc

SEQ ID NO: 406117 - DNA, 20 bp, human
ggggtccactgtataaagtt

SEQ ID NO: 406118 - DNA, 20 bp, human
ggcagcctgtaagacagtgt

SEQ ID NO: 406119 - DNA, 20 bp, human
gaggactcctggcttttctt

SEQ ID NO: 406120 - DNA, 20 bp, human
ggtaccttcgggaagaagga

SEQ ID NO: 406121 - DNA, 20 bp, human
ggaggcaggagcagttaaaa

SEQ ID NO: 406122 - DNA, 20 bp, human
gtatcaaggtagaagacttg

SEQ ID NO: 406123 - DNA, 20 bp, human
gttaccttggttagcacaac

SEQ ID NO: 406124 - DNA, 20 bp, human
gtggcctgttgtgctaacca

SEQ ID NO: 406125 - DNA, 20 bp, human
gaacggtgttccagacaggc

SEQ ID NO: 406126 - DNA, 20 bp, human
ggcagcggcctcgcggtgac

SEQ ID NO: 406127 - DNA, 20 bp, human
gggcggggagggcggcaaga

SEQ ID NO: 406128 - DNA, 20 bp, human
gccccggccggctggaaaga

SEQ ID NO: 406129 - DNA, 20 bp, human
gggccgcaccggcgagtgac

SEQ ID NO: 406130 - DNA, 20 bp, human
gcgcaccggcgagtgacagg

SEQ ID NO: 406131 - DNA, 20 bp, human
gtaaccacgcggagggacgg

SEQ ID NO: 406132 - DNA, 20 bp, human
gcggcggccaatggcgaggt

SEQ ID NO: 406133 - DNA, 20 bp, human
ggcggcaggcgggtgtgtcc

SEQ ID NO: 406134 - DNA, 20 bp, human
gagggcggctgattggacag

SEQ ID NO: 406135 - DNA, 20 bp, human
ggcccggactaaccacgcgg

SEQ ID NO: 406136 - DNA, 20 bp, human
ggggaactaactgcccaatg

SEQ ID NO: 406137 - DNA, 20 bp, human
gaggacggccaaatcatcag

SEQ ID NO: 406138 - DNA, 20 bp, human
gttcaaaaggagtggcgcga

SEQ ID NO: 406139 - DNA, 20 bp, human
gggcagttagttcccagatg

SEQ ID NO: 406140 - DNA, 20 bp, human
gaacctcatgccctttcaaa

SEQ ID NO: 406141 - DNA, 20 bp, human
gatgtagtctgcactttcta

SEQ ID NO: 406142 - DNA, 20 bp, human
ggtactgcacttgccgcatc

SEQ ID NO: 406143 - DNA, 20 bp, human
gcatgaggtttcagccgcat

SEQ ID NO: 406144 - DNA, 20 bp, human
gggtgctgcggcagcgtcgc

SEQ ID NO: 406145 - DNA, 20 bp, human
gcacaggaaccgacctcgtc

SEQ ID NO: 406146 - DNA, 20 bp, human
ggcaggggacctgggttcat

SEQ ID NO: 406147 - DNA, 20 bp, human
gggcccaatcggggacagtc

SEQ ID NO: 406148 - DNA, 20 bp, human
gtgggcccgcgggactgagt

SEQ ID NO: 406149 - DNA, 20 bp, human
gaaaacgaacaccaggtcaa

SEQ ID NO: 406150 - DNA, 20 bp, human
gtcaacggaaaagggagccg

SEQ ID NO: 406151 - DNA, 20 bp, human
gcgagaagagctcacggcag

SEQ ID NO: 406152 - DNA, 20 bp, human
gagtgccagccgcaataggg

SEQ ID NO: 406153 - DNA, 20 bp, human
gaacaccaggtcaacggaaa

SEQ ID NO: 406154 - DNA, 20 bp, human
ggcagcctcgccaacctctg

SEQ ID NO: 406155 - DNA, 20 bp, human
ggcccccccgggaccatcac

SEQ ID NO: 406156 - DNA, 20 bp, human
ggggttggccggtaccatgg

SEQ ID NO: 406157 - DNA, 20 bp, human
ggagacgcggggtagcggtt

SEQ ID NO: 406158 - DNA, 20 bp, human
gcgctggggcaagtggaagg

SEQ ID NO: 406159 - DNA, 20 bp, human
gtctcggcgcggtcctactc

SEQ ID NO: 406160 - DNA, 20 bp, human
gtaggaccgcgccgagaaga

SEQ ID NO: 406161 - DNA, 20 bp, human
ggcaggaaggggtgaggcgc

SEQ ID NO: 406162 - DNA, 20 bp, human
gtcaacatctggcccgaagc

SEQ ID NO: 406163 - DNA, 20 bp, human
ggtccagcaggcaaatgaag

SEQ ID NO: 406164 - DNA, 20 bp, human
ggggaaatacagtccggagt

SEQ ID NO: 406165 - DNA, 20 bp, human
gaagatggcgcctgtttttt

SEQ ID NO: 406166 - DNA, 20 bp, human
gggagcgccggaaacgaaaa

SEQ ID NO: 406167 - DNA, 20 bp, human
gtggaggaactggggttcgc

SEQ ID NO: 406168 - DNA, 20 bp, human
ggggcgctaatggagaaaga

SEQ ID NO: 406169 - DNA, 20 bp, human
gtagcgctgcgagatattca

SEQ ID NO: 406170 - DNA, 20 bp, human
gcagaagccgagtcacttcc

SEQ ID NO: 406171 - DNA, 20 bp, human
gagctctgcggagagaaggc

SEQ ID NO: 406172 - DNA, 20 bp, human
gaggggggcgtggaggaact

SEQ ID NO: 406173 - DNA, 20 bp, human
gggagtggctggaacacttc

SEQ ID NO: 406174 - DNA, 20 bp, human
gtaggggcaaaagctgaaac

SEQ ID NO: 406175 - DNA, 20 bp, human
ggcgccggaaacgaaaaggg

SEQ ID NO: 406176 - DNA, 20 bp, human
gcagaagaagagggtggcca

SEQ ID NO: 406177 - DNA, 20 bp, human
gtgcctaaggagtttggggg

SEQ ID NO: 406178 - DNA, 20 bp, human
ggaaaaccacccagaaggga

SEQ ID NO: 406179 - DNA, 20 bp, human
gaagtgaaaaccacccagaa

SEQ ID NO: 406180 - DNA, 20 bp, human
gggagtcctgctggttcagc

SEQ ID NO: 406181 - DNA, 20 bp, human
gaatgtgcctaaggagtttg

SEQ ID NO: 406182 - DNA, 20 bp, human
gaaaaggtatgagctcttac

SEQ ID NO: 406183 - DNA, 20 bp, human
gccaagctttaggatcccct

SEQ ID NO: 406184 - DNA, 20 bp, human
gatggagcacagtgccctgt

SEQ ID NO: 406185 - DNA, 20 bp, human
gtaaagcttggtatcgcccc

SEQ ID NO: 406186 - DNA, 20 bp, human
ggccctcagcaggtgaagac

SEQ ID NO: 406187 - DNA, 20 bp, human
ggaacaggacgtctagaaga

SEQ ID NO: 406188 - DNA, 20 bp, human
ggaggggacccgggcactca

SEQ ID NO: 406189 - DNA, 20 bp, human
gatgcctgggttcccgggaa

SEQ ID NO: 406190 - DNA, 20 bp, human
gcactcagggctccgcgagg

SEQ ID NO: 406191 - DNA, 20 bp, human
gacgtctagaagacggtgtg

SEQ ID NO: 406192 - DNA, 20 bp, human
gctggtgctgggctgatatg

SEQ ID NO: 406193 - DNA, 20 bp, human
gtgctggcctcctgggttta

SEQ ID NO: 406194 - DNA, 20 bp, human
gctcagactcagcccttccc

SEQ ID NO: 406195 - DNA, 20 bp, human
gtgggtttacggtgtcactg

SEQ ID NO: 406196 - DNA, 20 bp, human
gcccccgggctgaggaccgc

SEQ ID NO: 406197 - DNA, 20 bp, human
gagcccaggggtggtcaaag

SEQ ID NO: 406198 - DNA, 20 bp, human
gaccgcgggggaccccaggt

SEQ ID NO: 406199 - DNA, 20 bp, human
ggggtccccgaagagatcct

SEQ ID NO: 406200 - DNA, 20 bp, human
ggtcctcagcccgggggctc

SEQ ID NO: 406201 - DNA, 20 bp, human
gttcggggacccgagccccc

SEQ ID NO: 406202 - DNA, 20 bp, human
gaggaggctccgtcccgacc

SEQ ID NO: 406203 - DNA, 20 bp, human
gccattgccaaggatctctt

SEQ ID NO: 406204 - DNA, 20 bp, human
gagatccttggcaatggcag

SEQ ID NO: 406205 - DNA, 20 bp, human
ggccaagccccgcgatgggg

SEQ ID NO: 406206 - DNA, 20 bp, human
gggtggaagggcgcataatg

SEQ ID NO: 406207 - DNA, 20 bp, human
gccagcccgaggatggtgga

SEQ ID NO: 406208 - DNA, 20 bp, human
ggcgcccttccaccatcctc

SEQ ID NO: 406209 - DNA, 20 bp, human
gcaaagcagcattaaaactt

SEQ ID NO: 406210 - DNA, 20 bp, human
gaacttgggactcttggctg

SEQ ID NO: 406211 - DNA, 20 bp, human
gctcaagaccgggagacacg

SEQ ID NO: 406212 - DNA, 20 bp, human
gtctgaaatgccccagcccg

SEQ ID NO: 406213 - DNA, 20 bp, human
gttcttagagagagcaggag

SEQ ID NO: 406214 - DNA, 20 bp, human
ggcatttcagagggatatag

SEQ ID NO: 406215 - DNA, 20 bp, human
ggtgcaatgacacccgatct

SEQ ID NO: 406216 - DNA, 20 bp, human
gtgcctgcctggaccaacca

SEQ ID NO: 406217 - DNA, 20 bp, human
gcggctgctaacccagggtg

SEQ ID NO: 406218 - DNA, 20 bp, human
gttaaagcgagaagagtgtc

SEQ ID NO: 406219 - DNA, 20 bp, human
gagagtgtcgggatccacac

SEQ ID NO: 406220 - DNA, 20 bp, human
gttgggaaggggcggagtga

SEQ ID NO: 406221 - DNA, 20 bp, human
ggcgcggcaaggacatcgca

SEQ ID NO: 406222 - DNA, 20 bp, human
gtaaaacggcagtacgaaga

SEQ ID NO: 406223 - DNA, 20 bp, human
ggtcggagcacctcgtggag

SEQ ID NO: 406224 - DNA, 20 bp, human
ggtggcattcacaggagggg

SEQ ID NO: 406225 - DNA, 20 bp, human
gtgcaggagggacgtggtta

SEQ ID NO: 406226 - DNA, 20 bp, human
gcgactgcccagacaatgac

SEQ ID NO: 406227 - DNA, 20 bp, human
gccctcccctggtatgcgag

SEQ ID NO: 406228 - DNA, 20 bp, human
gtgatcagcagcagtctgag

SEQ ID NO: 406229 - DNA, 20 bp, human
gggacctaagtctcctgacg

SEQ ID NO: 406230 - DNA, 20 bp, human
gacgttgctcagtctcagtg

SEQ ID NO: 406231 - DNA, 20 bp, human
gtcagcctctcgcataccag

SEQ ID NO: 406232 - DNA, 20 bp, human
gtgatcttagggaacctgat

SEQ ID NO: 406233 - DNA, 20 bp, human
gctgctgatcatgctctgct

SEQ ID NO: 406234 - DNA, 20 bp, human
gcgctgctccaacgcccatc

SEQ ID NO: 406235 - DNA, 20 bp, human
ggagcagcggttcgacgcat

SEQ ID NO: 406236 - DNA, 20 bp, human
gccgacgcagagggtcttga

SEQ ID NO: 406237 - DNA, 20 bp, human
gcggacgcccgtatttcctc

SEQ ID NO: 406238 - DNA, 20 bp, human
gggggtgaggtgcatctcgc

SEQ ID NO: 406239 - DNA, 20 bp, human
ggcctctctaggcgcctgat

SEQ ID NO: 406240 - DNA, 20 bp, human
gagaccctctgcgtcgggcg

SEQ ID NO: 406241 - DNA, 20 bp, human
gtagccccgcccgacgcaga

SEQ ID NO: 406242 - DNA, 20 bp, human
ggagaggccccggaaatgca

SEQ ID NO: 406243 - DNA, 20 bp, human
gcttgccggagctcggccac

SEQ ID NO: 406244 - DNA, 20 bp, human
gcaggcgcctagagaggccc

SEQ ID NO: 406245 - DNA, 20 bp, human
ggaaatacgggcgtccgagc

SEQ ID NO: 406246 - DNA, 20 bp, human
gtgtgcgcgaggagtcgctc

SEQ ID NO: 406247 - DNA, 20 bp, human
gccggattcccgcccgggaa

SEQ ID NO: 406248 - DNA, 20 bp, human
gttcccgcccgggaagggag

SEQ ID NO: 406249 - DNA, 20 bp, human
gtacgtgagcgcagtgtccc

SEQ ID NO: 406250 - DNA, 20 bp, human
gtgtagcccaggcgcgctgg

SEQ ID NO: 406251 - DNA, 20 bp, human
gcgcctgggctacacacccc

SEQ ID NO: 406252 - DNA, 20 bp, human
gaggggccgggctcgaccca

SEQ ID NO: 406253 - DNA, 20 bp, human
ggagtgtcgccgctgggcgc

SEQ ID NO: 406254 - DNA, 20 bp, human
gccggcccggattcccgccc

SEQ ID NO: 406255 - DNA, 20 bp, human
gcagcccggagccaaacttg

SEQ ID NO: 406256 - DNA, 20 bp, human
gtggccgcgcacttgggaca

SEQ ID NO: 406257 - DNA, 20 bp, human
gccacagcggctcttctcca

SEQ ID NO: 406258 - DNA, 20 bp, human
gaaccgggaggctcgaccgg

SEQ ID NO: 406259 - DNA, 20 bp, human
ggaacgcggggacgttgcca

SEQ ID NO: 406260 - DNA, 20 bp, human
gcccaagtgcgcggccacag

SEQ ID NO: 406261 - DNA, 20 bp, human
ggagaaccgggaggctcgac

SEQ ID NO: 406262 - DNA, 20 bp, human
gtcccaccggtcgagcctcc

SEQ ID NO: 406263 - DNA, 20 bp, human
gctgtgaaagcatggggttg

SEQ ID NO: 406264 - DNA, 20 bp, human
gtccggttctggtggcgggt

SEQ ID NO: 406265 - DNA, 20 bp, human
gttactccggtaactcagta

SEQ ID NO: 406266 - DNA, 20 bp, human
gagggtgcgctaggagtcag

SEQ ID NO: 406267 - DNA, 20 bp, human
gtagcccggcggaatctcca

SEQ ID NO: 406268 - DNA, 20 bp, human
ggggcggcggaggacccgaa

SEQ ID NO: 406269 - DNA, 20 bp, human
ggacccgaagggcgcgagag

SEQ ID NO: 406270 - DNA, 20 bp, human
ggtggaaactgtagagcccg

SEQ ID NO: 406271 - DNA, 20 bp, human
gcaggggtccttgtgagcgg

SEQ ID NO: 406272 - DNA, 20 bp, human
gagtcaggggtccttgtgag

SEQ ID NO: 406273 - DNA, 20 bp, human
gaacggcccaggcgagatgc

SEQ ID NO: 406274 - DNA, 20 bp, human
gtggccttggagattccgcc

SEQ ID NO: 406275 - DNA, 20 bp, human
gaggtagccaatcagagccg

SEQ ID NO: 406276 - DNA, 20 bp, human
gtgtggggagggttgttatt

SEQ ID NO: 406277 - DNA, 20 bp, human
ggtgagctgaaccttctcgt

SEQ ID NO: 406278 - DNA, 20 bp, human
gagctcttgggcttcggtgt

SEQ ID NO: 406279 - DNA, 20 bp, human
gagtgcaccgggaaccgcgc

SEQ ID NO: 406280 - DNA, 20 bp, human
gtagaacagcggaaatgtgc

SEQ ID NO: 406281 - DNA, 20 bp, human
gtgagaaagcggaacacacg

SEQ ID NO: 406282 - DNA, 20 bp, human
gaatgtgcagggtgagagta

SEQ ID NO: 406283 - DNA, 20 bp, human
gtcgcgctgcccagccaccg

SEQ ID NO: 406284 - DNA, 20 bp, human
gcttgggcttcggtgtgggg

SEQ ID NO: 406285 - DNA, 20 bp, human
ggcaaagccgggctcattct

SEQ ID NO: 406286 - DNA, 20 bp, human
gcaatcttaaggaatcctgt

SEQ ID NO: 406287 - DNA, 20 bp, human
ggagttacaagatgatgaca

SEQ ID NO: 406288 - DNA, 20 bp, human
gggattccttaagattgtgt

SEQ ID NO: 406289 - DNA, 20 bp, human
gcaacatcgctgaatgtcaa

SEQ ID NO: 406290 - DNA, 20 bp, human
gaatccctgttattccgtgt

SEQ ID NO: 406291 - DNA, 20 bp, human
ggagtgcccacacaatctta

SEQ ID NO: 406292 - DNA, 20 bp, human
gcagccaacacggaataaca

SEQ ID NO: 406293 - DNA, 20 bp, human
gtatggcttaggtacgtaga

SEQ ID NO: 406294 - DNA, 20 bp, human
gacattaaattgcaataaag

SEQ ID NO: 406295 - DNA, 20 bp, human
gtattaatattatatggctt

SEQ ID NO: 406296 - DNA, 20 bp, human
gtcttctggagtcaacaata

SEQ ID NO: 406297 - DNA, 20 bp, human
ggactccagaagaaatacta

SEQ ID NO: 406298 - DNA, 20 bp, human
gagaaatactatggtatctt

SEQ ID NO: 406299 - DNA, 20 bp, human
gagtataaagggtgtttcat

SEQ ID NO: 406300 - DNA, 20 bp, human
ggggcttctgttagaggtta

SEQ ID NO: 406301 - DNA, 20 bp, human
gttagaggttaaggagggga

SEQ ID NO: 406302 - DNA, 20 bp, human
gaaattcatctcagtataaa

SEQ ID NO: 406303 - DNA, 20 bp, human
ggtagtaaattgaagtatgc

SEQ ID NO: 406304 - DNA, 20 bp, human
gggacttgggcttctgttag

SEQ ID NO: 406305 - DNA, 20 bp, human
ggataccatagtatttcttc

SEQ ID NO: 406306 - DNA, 20 bp, human
gcctcagagctggacctcat

SEQ ID NO: 406307 - DNA, 20 bp, human
gtcccagctagtcgaatcac

SEQ ID NO: 406308 - DNA, 20 bp, human
gcccgcctaagttcctgcct

SEQ ID NO: 406309 - DNA, 20 bp, human
gggtgcacctccggaatccg

SEQ ID NO: 406310 - DNA, 20 bp, human
gagaagaggaagctcacttc

SEQ ID NO: 406311 - DNA, 20 bp, human
gtcagaaagcctccctacgc

SEQ ID NO: 406312 - DNA, 20 bp, human
gaggtgtggcggaaatggtt

SEQ ID NO: 406313 - DNA, 20 bp, human
gagggagcagtgcccgagcg

SEQ ID NO: 406314 - DNA, 20 bp, human
gccgaggttcgcattgctct

SEQ ID NO: 406315 - DNA, 20 bp, human
gtttggggccggaagtgggt

SEQ ID NO: 406316 - DNA, 20 bp, human
ggatctgtgcagggagtcat

SEQ ID NO: 406317 - DNA, 20 bp, human
gccccccgcggcaactgcac

SEQ ID NO: 406318 - DNA, 20 bp, human
gtgcacagatccacggtccc

SEQ ID NO: 406319 - DNA, 20 bp, human
gccactggaaaatcccacag

SEQ ID NO: 406320 - DNA, 20 bp, human
gaacctgtgcagttgccgcg

SEQ ID NO: 406321 - DNA, 20 bp, human
ggggtcaaaaggcgtgtgtg

SEQ ID NO: 406322 - DNA, 20 bp, human
gagccggccggggtccaggt

SEQ ID NO: 406323 - DNA, 20 bp, human
gtgtgggcgcagagggttgc

SEQ ID NO: 406324 - DNA, 20 bp, human
ggattcagcgcccgggaccg

SEQ ID NO: 406325 - DNA, 20 bp, human
gcacccaccaggtgtaattg

SEQ ID NO: 406326 - DNA, 20 bp, human
gctcgggacccagacgtcaa

SEQ ID NO: 406327 - DNA, 20 bp, human
ggggcggagccctgcgtcgc

SEQ ID NO: 406328 - DNA, 20 bp, human
ggtgctggcggggcctcccc

SEQ ID NO: 406329 - DNA, 20 bp, human
ggcggacataggagtcccga

SEQ ID NO: 406330 - DNA, 20 bp, human
gcggctcctcctgtccgggg

SEQ ID NO: 406331 - DNA, 20 bp, human
gctgcggctcctcctgtccg

SEQ ID NO: 406332 - DNA, 20 bp, human
gagcgagtgggtgtgtgcgt

SEQ ID NO: 406333 - DNA, 20 bp, human
gtccccaggcccgcgacgca

SEQ ID NO: 406334 - DNA, 20 bp, human
gcgctcgcctcagtgtcgtg

SEQ ID NO: 406335 - DNA, 20 bp, human
ggacactgaggcgagcgagt

SEQ ID NO: 406336 - DNA, 20 bp, human
gtgcgcagggcgctcggaga

SEQ ID NO: 406337 - DNA, 20 bp, human
gactccgtgcacggagatcc

SEQ ID NO: 406338 - DNA, 20 bp, human
gtggagctcaggtcggacgc

SEQ ID NO: 406339 - DNA, 20 bp, human
gctgtcctagtcttcaaagt

SEQ ID NO: 406340 - DNA, 20 bp, human
ggctgtttatcgcctgtcca

SEQ ID NO: 406341 - DNA, 20 bp, human
ggaagtgcgcgctgactgcc

SEQ ID NO: 406342 - DNA, 20 bp, human
gcctgtccagggctgatctt

SEQ ID NO: 406343 - DNA, 20 bp, human
gatcttgggacaagactaga

SEQ ID NO: 406344 - DNA, 20 bp, human
ggtcaccctggagctcaggt

SEQ ID NO: 406345 - DNA, 20 bp, human
gcatcccggatctccgtgca

SEQ ID NO: 406346 - DNA, 20 bp, human
gttgtgtgggccacttatgg

SEQ ID NO: 406347 - DNA, 20 bp, human
gccaccgaaatcccagttcc

SEQ ID NO: 406348 - DNA, 20 bp, human
gagtccgggaactgggattt

SEQ ID NO: 406349 - DNA, 20 bp, human
gaagagcccgggcagcctga

SEQ ID NO: 406350 - DNA, 20 bp, human
gtggggcaataaaagacata

SEQ ID NO: 406351 - DNA, 20 bp, human
ggtgtctggaatcactccac

SEQ ID NO: 406352 - DNA, 20 bp, human
gcgcatgcgcagtttcctac

SEQ ID NO: 406353 - DNA, 20 bp, human
gcctgaaggaatggctggag

SEQ ID NO: 406354 - DNA, 20 bp, human
gcggggtctgcgccgcttta

SEQ ID NO: 406355 - DNA, 20 bp, human
gcagttggaagtacctgtag

SEQ ID NO: 406356 - DNA, 20 bp, human
gtccgggtgaatctcaggga

SEQ ID NO: 406357 - DNA, 20 bp, human
ggggagggcaccggaaccct

SEQ ID NO: 406358 - DNA, 20 bp, human
gcccactgaagggagtgtct

SEQ ID NO: 406359 - DNA, 20 bp, human
gtgagattcacccggaacaa

SEQ ID NO: 406360 - DNA, 20 bp, human
gacccggaacaagggctaag

SEQ ID NO: 406361 - DNA, 20 bp, human
gcagtcccatacccactgaa

SEQ ID NO: 406362 - DNA, 20 bp, human
gggtatgggactgcggaaat

SEQ ID NO: 406363 - DNA, 20 bp, human
gacactcccttcagtgggta

SEQ ID NO: 406364 - DNA, 20 bp, human
ggcttggcgctcggcattat

SEQ ID NO: 406365 - DNA, 20 bp, human
ggcggagccaatcaacgttc

SEQ ID NO: 406366 - DNA, 20 bp, human
gatacccagagtccatctgc

SEQ ID NO: 406367 - DNA, 20 bp, human
gaaaagcccgccatcaggtc

SEQ ID NO: 406368 - DNA, 20 bp, human
gcagaagggtgcgcttttta

SEQ ID NO: 406369 - DNA, 20 bp, human
ggaacccctgacctgatggc

SEQ ID NO: 406370 - DNA, 20 bp, human
gaaagcgcacccttctggcc

SEQ ID NO: 406371 - DNA, 20 bp, human
ggcaggaaaagcccgccatc

SEQ ID NO: 406372 - DNA, 20 bp, human
gttttcctgcagatggactc

SEQ ID NO: 406373 - DNA, 20 bp, human
gtttagcgccatggaaagtg

SEQ ID NO: 406374 - DNA, 20 bp, human
gtgtagttccccactttcca

SEQ ID NO: 406375 - DNA, 20 bp, human
gggcgggcttttcctgcaga

SEQ ID NO: 406376 - DNA, 20 bp, human
gcagaagcgcctttgggaag

SEQ ID NO: 406377 - DNA, 20 bp, human
gagtcccagccctacctcag

SEQ ID NO: 406378 - DNA, 20 bp, human
gtcccaaaggcgcttctgca

SEQ ID NO: 406379 - DNA, 20 bp, human
ggagctatgggtccgaaccg

SEQ ID NO: 406380 - DNA, 20 bp, human
gttaatgaaccccctgaggt

SEQ ID NO: 406381 - DNA, 20 bp, human
gtgcgcacgtaacgtagtgg

SEQ ID NO: 406382 - DNA, 20 bp, human
gcgggattctcagcgttctc

SEQ ID NO: 406383 - DNA, 20 bp, human
ggaaccccctgaggtagggc

SEQ ID NO: 406384 - DNA, 20 bp, human
ggtgagaggcgctggagcta

SEQ ID NO: 406385 - DNA, 20 bp, human
gtcaatatggcctctaagga

SEQ ID NO: 406386 - DNA, 20 bp, human
gatccctgaccaatgaaaag

SEQ ID NO: 406387 - DNA, 20 bp, human
gtcgcggcgctgcgcctttt

SEQ ID NO: 406388 - DNA, 20 bp, human
gcgagcgtgcgacacgcaat

SEQ ID NO: 406389 - DNA, 20 bp, human
ggggaactacattgcccaaa

SEQ ID NO: 406390 - DNA, 20 bp, human
gaaggcgcagcgccgcgagg

SEQ ID NO: 406391 - DNA, 20 bp, human
ggtcagggatcgccgcctcg

SEQ ID NO: 406392 - DNA, 20 bp, human
ggagataacggaataggaga

SEQ ID NO: 406393 - DNA, 20 bp, human
ggacctcttttcattggtca

SEQ ID NO: 406394 - DNA, 20 bp, human
gtcctggaagtttggaggca

SEQ ID NO: 406395 - DNA, 20 bp, human
ggtaggtgatgagagagtat

SEQ ID NO: 406396 - DNA, 20 bp, human
gcacccctcgaggggctcgt

SEQ ID NO: 406397 - DNA, 20 bp, human
ggagcccacgagcccctcga

SEQ ID NO: 406398 - DNA, 20 bp, human
gcgggccgctcacccctcga

SEQ ID NO: 406399 - DNA, 20 bp, human
ggggcactcccagaaacctc

SEQ ID NO: 406400 - DNA, 20 bp, human
gcgcaggcgtcagacgctca

SEQ ID NO: 406401 - DNA, 20 bp, human
gtggccggctagccaagcgc

SEQ ID NO: 406402 - DNA, 20 bp, human
ggctccggacgccgtgcctc

SEQ ID NO: 406403 - DNA, 20 bp, human
gcccgggcctcctggcgttc

SEQ ID NO: 406404 - DNA, 20 bp, human
gagccggccagaacgccagg

SEQ ID NO: 406405 - DNA, 20 bp, human
ggctagccggccagaacgcc

SEQ ID NO: 406406 - DNA, 20 bp, human
gctggagcgagcaggtgatc

SEQ ID NO: 406407 - DNA, 20 bp, human
gggaactggtgaagactgtc

SEQ ID NO: 406408 - DNA, 20 bp, human
ggcaggtgatcgggagaagt

SEQ ID NO: 406409 - DNA, 20 bp, human
gacgagggctcaggaagaca

SEQ ID NO: 406410 - DNA, 20 bp, human
ggaggtcagatggctgacct

SEQ ID NO: 406411 - DNA, 20 bp, human
ggagatacatctcccggccc

SEQ ID NO: 406412 - DNA, 20 bp, human
gttgaggagggatgaggcgg

SEQ ID NO: 406413 - DNA, 20 bp, human
gttgtcagagacgagggctc

SEQ ID NO: 406414 - DNA, 20 bp, human
gataaaagagatacatctcc

SEQ ID NO: 406415 - DNA, 20 bp, human
ggctggaggctggagcgagc

SEQ ID NO: 406416 - DNA, 20 bp, human
gacctctgggccatacccca

SEQ ID NO: 406417 - DNA, 20 bp, human
gatggcccagaggtcaggat

SEQ ID NO: 406418 - DNA, 20 bp, human
ggcccagaggtcaggatagg

SEQ ID NO: 406419 - DNA, 20 bp, human
gcaggggatcagccatccag

SEQ ID NO: 406420 - DNA, 20 bp, human
gactacttaacgacttgccc

SEQ ID NO: 406421 - DNA, 20 bp, human
ggaaggaccttgctcaagac

SEQ ID NO: 406422 - DNA, 20 bp, human
ggctgcgtagatgactacct

SEQ ID NO: 406423 - DNA, 20 bp, human
ggaggcccgagtcggggaca

SEQ ID NO: 406424 - DNA, 20 bp, human
gtccctggggtatggcccag

SEQ ID NO: 406425 - DNA, 20 bp, human
gggcctcctatcctgacctc

SEQ ID NO: 406426 - DNA, 20 bp, human
ggtgctgcggcccgcacgga

SEQ ID NO: 406427 - DNA, 20 bp, human
gagagggagtcggtcctcag

SEQ ID NO: 406428 - DNA, 20 bp, human
gggcccgggcaccctccgtg

SEQ ID NO: 406429 - DNA, 20 bp, human
ggcggtcgaagacgagatga

SEQ ID NO: 406430 - DNA, 20 bp, human
gctcccggatctgcatgcga

SEQ ID NO: 406431 - DNA, 20 bp, human
gcacccacggggaccggacg

SEQ ID NO: 406432 - DNA, 20 bp, human
ggatctgcatgcgagggatg

SEQ ID NO: 406433 - DNA, 20 bp, human
gcaccacgtccggtccccgt

SEQ ID NO: 406434 - DNA, 20 bp, human
ggcccgcacggagggtgccc

SEQ ID NO: 406435 - DNA, 20 bp, human
gccgctcctcccgcccgcag

SEQ ID NO: 406436 - DNA, 20 bp, human
gggtccagaaggcaaggtcg

SEQ ID NO: 406437 - DNA, 20 bp, human
gagagcgtaaatgacgtcag

SEQ ID NO: 406438 - DNA, 20 bp, human
ggcagggcggccatagggga

SEQ ID NO: 406439 - DNA, 20 bp, human
gctgctgcggcctcgcccac

SEQ ID NO: 406440 - DNA, 20 bp, human
gtgggcagggctacgggcag

SEQ ID NO: 406441 - DNA, 20 bp, human
gaatgtgggtccaggcccag

SEQ ID NO: 406442 - DNA, 20 bp, human
gaggcggggtttcgggacta

SEQ ID NO: 406443 - DNA, 20 bp, human
ggctgcggaggaccttgggg

SEQ ID NO: 406444 - DNA, 20 bp, human
gcttggctgcggaggacctt

SEQ ID NO: 406445 - DNA, 20 bp, human
ggaaatgggtccagaaggca

SEQ ID NO: 406446 - DNA, 20 bp, human
gcccgcgcgggtctcgtcga

SEQ ID NO: 406447 - DNA, 20 bp, human
gggggtggagggcgctagtt

SEQ ID NO: 406448 - DNA, 20 bp, human
gcaaaactgggatgcgctgg

SEQ ID NO: 406449 - DNA, 20 bp, human
gctctggagtaaggcccctc

SEQ ID NO: 406450 - DNA, 20 bp, human
gctgtagcgctgtgggaaga

SEQ ID NO: 406451 - DNA, 20 bp, human
gggctgtaccaagtaaaccc

SEQ ID NO: 406452 - DNA, 20 bp, human
gggaacgcgccttacaaaac

SEQ ID NO: 406453 - DNA, 20 bp, human
gcctgcgtcgcaagtagggt

SEQ ID NO: 406454 - DNA, 20 bp, human
gcctagcgcgggacaatgaa

SEQ ID NO: 406455 - DNA, 20 bp, human
gggccctcgtgccctctctc

SEQ ID NO: 406456 - DNA, 20 bp, human
gacagagggtgatcagttgc

SEQ ID NO: 406457 - DNA, 20 bp, human
gcgcagctggagcgacagga

SEQ ID NO: 406458 - DNA, 20 bp, human
ggtttaagacccgccctctc

SEQ ID NO: 406459 - DNA, 20 bp, human
gaaaagaaacatgaaacacg

SEQ ID NO: 406460 - DNA, 20 bp, human
gtataatactttaaacatat

SEQ ID NO: 406461 - DNA, 20 bp, human
ggatcaccctctgtcactca

SEQ ID NO: 406462 - DNA, 20 bp, human
ggctcaaaggaccagaagct

SEQ ID NO: 406463 - DNA, 20 bp, human
gtgggcccccaaaattacta

SEQ ID NO: 406464 - DNA, 20 bp, human
gcatttataaatatactata

SEQ ID NO: 406465 - DNA, 20 bp, human
gactaaggaaaactcaagct

SEQ ID NO: 406466 - DNA, 20 bp, human
gcctgattggataacttcta

SEQ ID NO: 406467 - DNA, 20 bp, human
ggtccaatcaggcacggggc

SEQ ID NO: 406468 - DNA, 20 bp, human
gctcctgccccgtgcctgat

SEQ ID NO: 406469 - DNA, 20 bp, human
ggaaagatgtgatcagacgc

SEQ ID NO: 406470 - DNA, 20 bp, human
gagagcaggcccaacccaga

SEQ ID NO: 406471 - DNA, 20 bp, human
gaaaccgtccaatcaggcac

SEQ ID NO: 406472 - DNA, 20 bp, human
gtgatcacatctttcattca

SEQ ID NO: 406473 - DNA, 20 bp, human
gggcaaataccctctgggtt

SEQ ID NO: 406474 - DNA, 20 bp, human
gtttcattcagggtttgcgg

SEQ ID NO: 406475 - DNA, 20 bp, human
ggctcaagcctagattgctg

SEQ ID NO: 406476 - DNA, 20 bp, human
gcgcaaacgctagggagggt

SEQ ID NO: 406477 - DNA, 20 bp, human
gaaacaggctcaagtaggcg

SEQ ID NO: 406478 - DNA, 20 bp, human
gaaatgcgcaaacgctaggg

SEQ ID NO: 406479 - DNA, 20 bp, human
gataaaatgcgcaaacgcta

SEQ ID NO: 406480 - DNA, 20 bp, human
gtaggcggggcacatgccca

SEQ ID NO: 406481 - DNA, 20 bp, human
gtcagacgcgcagttggaga

SEQ ID NO: 406482 - DNA, 20 bp, human
gtccaactgcgcgtctgatt

SEQ ID NO: 406483 - DNA, 20 bp, human
gaactgcgcgtctgattggg

SEQ ID NO: 406484 - DNA, 20 bp, human
gaccctcagggatgggacga

SEQ ID NO: 406485 - DNA, 20 bp, human
gcaaaggccccgccaaaagc

SEQ ID NO: 406486 - DNA, 20 bp, human
gcccctcaggccatgattga

SEQ ID NO: 406487 - DNA, 20 bp, human
gtccgtcaatcatggcctga

SEQ ID NO: 406488 - DNA, 20 bp, human
ggaagatgtgatgagatgcg

SEQ ID NO: 406489 - DNA, 20 bp, human
ggcacgcaggtgaagcggac

SEQ ID NO: 406490 - DNA, 20 bp, human
gcaatcagagacgctaggca

SEQ ID NO: 406491 - DNA, 20 bp, human
ggggcctttgtccctcgctg

SEQ ID NO: 406492 - DNA, 20 bp, human
gatcaggcacgcaggtgaag

SEQ ID NO: 406493 - DNA, 20 bp, human
gttaaatgcaaataacctct

SEQ ID NO: 406494 - DNA, 20 bp, human
gtacctgggataacacacat

SEQ ID NO: 406495 - DNA, 20 bp, human
gggcccatgtgtgttatccc

SEQ ID NO: 406496 - DNA, 20 bp, human
gcttaggctgccgtcttttc

SEQ ID NO: 406497 - DNA, 20 bp, human
gctgctgaaagaccagaagc

SEQ ID NO: 406498 - DNA, 20 bp, human
ggccgtctgaaattttagaa

SEQ ID NO: 406499 - DNA, 20 bp, human
ggtctgaaattttagaacgg

SEQ ID NO: 406500 - DNA, 20 bp, human
ggaagatgcgaacagatgct

SEQ ID NO: 406501 - DNA, 20 bp, human
ggaaagaccagaagccggga

SEQ ID NO: 406502 - DNA, 20 bp, human
gattcttttcatttgtgaat

SEQ ID NO: 406503 - DNA, 20 bp, human
gctcagggcctgagaaggtg

SEQ ID NO: 406504 - DNA, 20 bp, human
gcaatcagcgacgctaggct

SEQ ID NO: 406505 - DNA, 20 bp, human
ggcatgtgactttacacaca

SEQ ID NO: 406506 - DNA, 20 bp, human
gcgggagacgcggtggacgg

SEQ ID NO: 406507 - DNA, 20 bp, human
gtgacgtacagaaggcacag

SEQ ID NO: 406508 - DNA, 20 bp, human
gggaaatcggacagtttaag

SEQ ID NO: 406509 - DNA, 20 bp, human
gtccgctctccatggaaacg

SEQ ID NO: 406510 - DNA, 20 bp, human
gggccgggagacgcggtgga

SEQ ID NO: 406511 - DNA, 20 bp, human
gcgtcgcctcgccgctctgg

SEQ ID NO: 406512 - DNA, 20 bp, human
gcgtctctggaggtttagag

SEQ ID NO: 406513 - DNA, 20 bp, human
gtgagtacgtgacgtacaga

SEQ ID NO: 406514 - DNA, 20 bp, human
gtacagaaggcacagcggcc

SEQ ID NO: 406515 - DNA, 20 bp, human
gcctcgcaggggacagtgaa

SEQ ID NO: 406516 - DNA, 20 bp, human
gggtaacggggctctgaaaa

SEQ ID NO: 406517 - DNA, 20 bp, human
gttcagagccccgttaccaa

SEQ ID NO: 406518 - DNA, 20 bp, human
gaatagaagcccttggtaac

SEQ ID NO: 406519 - DNA, 20 bp, human
ggccgagtgtccatcgggga

SEQ ID NO: 406520 - DNA, 20 bp, human
gcgaaactatctgcccccgt

SEQ ID NO: 406521 - DNA, 20 bp, human
ggggcctgccgagtgtccat

SEQ ID NO: 406522 - DNA, 20 bp, human
gctctgaaaacgggtttgac

SEQ ID NO: 406523 - DNA, 20 bp, human
gccggcgcttcgtccaatca

SEQ ID NO: 406524 - DNA, 20 bp, human
ggaagacagttctcctacgg

SEQ ID NO: 406525 - DNA, 20 bp, human
gagaggcattagtctgtcat

SEQ ID NO: 406526 - DNA, 20 bp, human
ggcaggcacaggcgcactag

SEQ ID NO: 406527 - DNA, 20 bp, human
ggcagctgccggaaaggacc

SEQ ID NO: 406528 - DNA, 20 bp, human
ggcagagcggaggcgttccc

SEQ ID NO: 406529 - DNA, 20 bp, human
gtggaactccaactcccggc

SEQ ID NO: 406530 - DNA, 20 bp, human
gatagtgttccgcctctgat

SEQ ID NO: 406531 - DNA, 20 bp, human
gcggcctcgagatggcagag

SEQ ID NO: 406532 - DNA, 20 bp, human
gaaaggacccggcctcgaga

SEQ ID NO: 406533 - DNA, 20 bp, human
gacgaacttcgctcgctgat

SEQ ID NO: 406534 - DNA, 20 bp, human
ggactcaagagaagcttcta

SEQ ID NO: 406535 - DNA, 20 bp, human
gcctcgagatggcagagcgg

SEQ ID NO: 406536 - DNA, 20 bp, human
gggaaagtctgcattatggc

SEQ ID NO: 406537 - DNA, 20 bp, human
gaatgggaaagtctgcatta

SEQ ID NO: 406538 - DNA, 20 bp, human
gctgttgtctctaactgtac

SEQ ID NO: 406539 - DNA, 20 bp, human
gttagagacaacaggcttcc

SEQ ID NO: 406540 - DNA, 20 bp, human
gcagatagatccacccactg

SEQ ID NO: 406541 - DNA, 20 bp, human
gggcacgtagccaaggttct

SEQ ID NO: 406542 - DNA, 20 bp, human
gataaatatccccagaacct

SEQ ID NO: 406543 - DNA, 20 bp, human
ggcttccgggcacgtagcca

SEQ ID NO: 406544 - DNA, 20 bp, human
gctttccacccgcaactgtg

SEQ ID NO: 406545 - DNA, 20 bp, human
gctcatctaaagtcgatccg

SEQ ID NO: 406546 - DNA, 20 bp, human
gtctgcgcccgcatgcctgt

SEQ ID NO: 406547 - DNA, 20 bp, human
gggaggtgcgtggagctcga

SEQ ID NO: 406548 - DNA, 20 bp, human
gtcgagggcgtggagctcgg

SEQ ID NO: 406549 - DNA, 20 bp, human
gcggggtgtctgctacgggg

SEQ ID NO: 406550 - DNA, 20 bp, human
gctgcgcggggtgtctgcta

SEQ ID NO: 406551 - DNA, 20 bp, human
ggcgaagcccacaggcatgc

SEQ ID NO: 406552 - DNA, 20 bp, human
gaggtcaagccacggggcgc

SEQ ID NO: 406553 - DNA, 20 bp, human
gcccggtcggcgaagcccac

SEQ ID NO: 406554 - DNA, 20 bp, human
gccgccgcaggcgccccggt

SEQ ID NO: 406555 - DNA, 20 bp, human
gtaaacaagctgtcgccctg

SEQ ID NO: 406556 - DNA, 20 bp, human
gtgaaacagtggagcttatg

SEQ ID NO: 406557 - DNA, 20 bp, human
gtgactcagtgtggagacaa

SEQ ID NO: 406558 - DNA, 20 bp, human
gggggaggagaagtcttctt

SEQ ID NO: 406559 - DNA, 20 bp, human
gctaggtgtaaattgagggg

SEQ ID NO: 406560 - DNA, 20 bp, human
gtggtcattaccaaggaaaa

SEQ ID NO: 406561 - DNA, 20 bp, human
gtgatctatggtcattacca

SEQ ID NO: 406562 - DNA, 20 bp, human
gaatctctaggtgtaaattg

SEQ ID NO: 406563 - DNA, 20 bp, human
gacacctagagattgttcat

SEQ ID NO: 406564 - DNA, 20 bp, human
gttaaggtcagaagactgcc

SEQ ID NO: 406565 - DNA, 20 bp, human
gagtgactataaaccagcaa

SEQ ID NO: 406566 - DNA, 20 bp, human
gccctgggtatcaggccctg

SEQ ID NO: 406567 - DNA, 20 bp, human
gtccgctgtcacttagacgt

SEQ ID NO: 406568 - DNA, 20 bp, human
ggctgtcacttagacgtggg

SEQ ID NO: 406569 - DNA, 20 bp, human
gcccactgtgcatccaggca

SEQ ID NO: 406570 - DNA, 20 bp, human
gcaatcagaggcactggctc

SEQ ID NO: 406571 - DNA, 20 bp, human
gtccgtgcctggatgcacag

SEQ ID NO: 406572 - DNA, 20 bp, human
gctgtcagtctggctccgca

SEQ ID NO: 406573 - DNA, 20 bp, human
gccctgcccactgtgcatcc

SEQ ID NO: 406574 - DNA, 20 bp, human
gctcacctggggttaagctt

SEQ ID NO: 406575 - DNA, 20 bp, human
gacgagctgcttcctgcact

SEQ ID NO: 406576 - DNA, 20 bp, human
gacgggtcgggtcacaacgc

SEQ ID NO: 406577 - DNA, 20 bp, human
ggctacccaatcaaagtcgt

SEQ ID NO: 406578 - DNA, 20 bp, human
gccctgccaggggccgggtc

SEQ ID NO: 406579 - DNA, 20 bp, human
gcgcctgattgacaattctc

SEQ ID NO: 406580 - DNA, 20 bp, human
gccaggaggcgggacctgga

SEQ ID NO: 406581 - DNA, 20 bp, human
gttcctgagaattgtcaatc

SEQ ID NO: 406582 - DNA, 20 bp, human
ggaggagggtgtgacgttcc

SEQ ID NO: 406583 - DNA, 20 bp, human
ggggcccactgcgtacaggt

SEQ ID NO: 406584 - DNA, 20 bp, human
gaatcaggcgcgaggcagag

SEQ ID NO: 406585 - DNA, 20 bp, human
gaaaagggcccactgcgtac

SEQ ID NO: 406586 - DNA, 20 bp, human
gtgcaggacccggttaccca

SEQ ID NO: 406587 - DNA, 20 bp, human
gctgtcactcagcacggagg

SEQ ID NO: 406588 - DNA, 20 bp, human
gtgctcgctcagagacgctg

SEQ ID NO: 406589 - DNA, 20 bp, human
gctgctgtcactcagcacgg

SEQ ID NO: 406590 - DNA, 20 bp, human
gggaaggcgctcgcttagag

SEQ ID NO: 406591 - DNA, 20 bp, human
gcccggatggacagttgaca

SEQ ID NO: 406592 - DNA, 20 bp, human
gcttctgctgtcactcagca

SEQ ID NO: 406593 - DNA, 20 bp, human
gactgtccatccggggaagg

SEQ ID NO: 406594 - DNA, 20 bp, human
ggatcatgtctgacttgttc

SEQ ID NO: 406595 - DNA, 20 bp, human
gcaagtcagacatgatctgc

SEQ ID NO: 406596 - DNA, 20 bp, human
gaagaagcgatctcgggcag

SEQ ID NO: 406597 - DNA, 20 bp, human
gtcccccgggcactgagtaa

SEQ ID NO: 406598 - DNA, 20 bp, human
gtaacggaagaagcgatctc

SEQ ID NO: 406599 - DNA, 20 bp, human
ggaggaagctagtcctctca

SEQ ID NO: 406600 - DNA, 20 bp, human
gaggcgcactgaccggagga

SEQ ID NO: 406601 - DNA, 20 bp, human
gtccaatcagggccgcgggg

SEQ ID NO: 406602 - DNA, 20 bp, human
gtgaaccttgcaccctcctc

SEQ ID NO: 406603 - DNA, 20 bp, human
gtgtctggaatctgtttatc

SEQ ID NO: 406604 - DNA, 20 bp, human
gtcttccgttactcagtgcc

SEQ ID NO: 406605 - DNA, 20 bp, human
gaatcaggcgcactgaccgg

SEQ ID NO: 406606 - DNA, 20 bp, human
gaggaagcccaccctatcaa

SEQ ID NO: 406607 - DNA, 20 bp, human
gggaactgattgacagaaga

SEQ ID NO: 406608 - DNA, 20 bp, human
gctgtcaatcagttccctgg

SEQ ID NO: 406609 - DNA, 20 bp, human
gacacagcccttgatagggt

SEQ ID NO: 406610 - DNA, 20 bp, human
gctcgcccccaacactgatt

SEQ ID NO: 406611 - DNA, 20 bp, human
gtctacccaatcagtgttgg

SEQ ID NO: 406612 - DNA, 20 bp, human
ggggtccccgtccaggaaga

SEQ ID NO: 406613 - DNA, 20 bp, human
gtcccggcagcgcgcctgac

SEQ ID NO: 406614 - DNA, 20 bp, human
gttcttgggaactgccagtc

SEQ ID NO: 406615 - DNA, 20 bp, human
gtccctgggggggcggaatt

SEQ ID NO: 406616 - DNA, 20 bp, human
gtctgtcaatcagccctcag

SEQ ID NO: 406617 - DNA, 20 bp, human
gtcaatcagccctcaggggg

SEQ ID NO: 406618 - DNA, 20 bp, human
gctatccaatcaggggcgtg

SEQ ID NO: 406619 - DNA, 20 bp, human
gctgcccagagaagtgtgtg

SEQ ID NO: 406620 - DNA, 20 bp, human
gcctgattggatagggcgtc

SEQ ID NO: 406621 - DNA, 20 bp, human
gcccacctgcgctcggctct

SEQ ID NO: 406622 - DNA, 20 bp, human
gagtgcaaatataacccggg

SEQ ID NO: 406623 - DNA, 20 bp, human
gagaacccagagccgagcgc

SEQ ID NO: 406624 - DNA, 20 bp, human
gagtttgtcagtccgtgtcc

SEQ ID NO: 406625 - DNA, 20 bp, human
ggaacccacccaggaggcga

SEQ ID NO: 406626 - DNA, 20 bp, human
gacgccacgcggtgacaaac

SEQ ID NO: 406627 - DNA, 20 bp, human
gaacgagcggctcggagtat

SEQ ID NO: 406628 - DNA, 20 bp, human
gggaagcatcgcggcaaagg

SEQ ID NO: 406629 - DNA, 20 bp, human
ggccaattggccctcgcctg

SEQ ID NO: 406630 - DNA, 20 bp, human
gccaggaagcatcgcggcaa

SEQ ID NO: 406631 - DNA, 20 bp, human
gtgcgccgtcaaggccaaat

SEQ ID NO: 406632 - DNA, 20 bp, human
ggtagttcggggtgaggccg

SEQ ID NO: 406633 - DNA, 20 bp, human
ggcggtgacaaacaggagta

SEQ ID NO: 406634 - DNA, 20 bp, human
gggcccgcgcgcagaccact

SEQ ID NO: 406635 - DNA, 20 bp, human
gagttgttgggctgaacgag

SEQ ID NO: 406636 - DNA, 20 bp, human
gtgggcatccgagcgtggaa

SEQ ID NO: 406637 - DNA, 20 bp, human
ggccccgcagacacgacagg

SEQ ID NO: 406638 - DNA, 20 bp, human
gaaagctaggggtgaaaata

SEQ ID NO: 406639 - DNA, 20 bp, human
gcggagagaagcagagacgt

SEQ ID NO: 406640 - DNA, 20 bp, human
ggtccaactgagggaggtga

SEQ ID NO: 406641 - DNA, 20 bp, human
gccgcccgccgcaccggagc

SEQ ID NO: 406642 - DNA, 20 bp, human
ggcggctgggcatccgagcg

SEQ ID NO: 406643 - DNA, 20 bp, human
gaagggaaatgtccaactga

SEQ ID NO: 406644 - DNA, 20 bp, human
gcttctctccggctccggtg

SEQ ID NO: 406645 - DNA, 20 bp, human
gggaaatgtccaactgaggg

SEQ ID NO: 406646 - DNA, 20 bp, human
gagcgcctctcaggcgtcag

SEQ ID NO: 406647 - DNA, 20 bp, human
ggcgtcgccggggcaacacc

SEQ ID NO: 406648 - DNA, 20 bp, human
gactctgccgtacctcctag

SEQ ID NO: 406649 - DNA, 20 bp, human
gggcctccaagcaaccgctc

SEQ ID NO: 406650 - DNA, 20 bp, human
gcctcagccgggtgttgccc

SEQ ID NO: 406651 - DNA, 20 bp, human
gctggcccggggaatggcgt

SEQ ID NO: 406652 - DNA, 20 bp, human
ggctgcaaatgcgggtcagc

SEQ ID NO: 406653 - DNA, 20 bp, human
gaatgcgggtcagcgggtca

SEQ ID NO: 406654 - DNA, 20 bp, human
gcgctcacctcaacccggag

SEQ ID NO: 406655 - DNA, 20 bp, human
gcccaagccctcccacgggg

SEQ ID NO: 406656 - DNA, 20 bp, human
gcccacagggatgctgacgt

SEQ ID NO: 406657 - DNA, 20 bp, human
gtagtcgcagggtgttgggt

SEQ ID NO: 406658 - DNA, 20 bp, human
gagggatgctgacgtgggag

SEQ ID NO: 406659 - DNA, 20 bp, human
gcgccgggctgtgcgcccac

SEQ ID NO: 406660 - DNA, 20 bp, human
gaaccagcctcaagctgttt

SEQ ID NO: 406661 - DNA, 20 bp, human
gcaggcgcgggactgcgcta

SEQ ID NO: 406662 - DNA, 20 bp, human
gatgctgacgtgggaggggc

SEQ ID NO: 406663 - DNA, 20 bp, human
gcgggtcgtaacagatttaa

SEQ ID NO: 406664 - DNA, 20 bp, human
gcaggccacacgccgcccgc

SEQ ID NO: 406665 - DNA, 20 bp, human
gttaagcgcttcttagtcgc

SEQ ID NO: 406666 - DNA, 20 bp, human
gccccagtgctcagtgggtt

SEQ ID NO: 406667 - DNA, 20 bp, human
gcgtcccagaatcctctgta

SEQ ID NO: 406668 - DNA, 20 bp, human
gcagccctacagaggattct

SEQ ID NO: 406669 - DNA, 20 bp, human
ggtggtacttcgactatttg

SEQ ID NO: 406670 - DNA, 20 bp, human
gccactgagcactggggtat

SEQ ID NO: 406671 - DNA, 20 bp, human
gagcggcttccgttcctccc

SEQ ID NO: 406672 - DNA, 20 bp, human
gtcttgccgcggaagtgccc

SEQ ID NO: 406673 - DNA, 20 bp, human
ggctctcccgggcacttccg

SEQ ID NO: 406674 - DNA, 20 bp, human
gagaaataagattcggccgt

SEQ ID NO: 406675 - DNA, 20 bp, human
gcagtgctcagtgggttcgg

SEQ ID NO: 406676 - DNA, 20 bp, human
gccggcgaggggcggtctcg

SEQ ID NO: 406677 - DNA, 20 bp, human
ggggcatagcgggccagtaa

SEQ ID NO: 406678 - DNA, 20 bp, human
ggagtgagagaaagcggctc

SEQ ID NO: 406679 - DNA, 20 bp, human
gtgagagaaagcggctccgg

SEQ ID NO: 406680 - DNA, 20 bp, human
ggacgccagctgcagtgggt

SEQ ID NO: 406681 - DNA, 20 bp, human
gccgcgccgcgcaggatgct

SEQ ID NO: 406682 - DNA, 20 bp, human
gaaggaggagcggcccttac

SEQ ID NO: 406683 - DNA, 20 bp, human
ggagactgacgctagggaag

SEQ ID NO: 406684 - DNA, 20 bp, human
gctatctcacaggacccagc

SEQ ID NO: 406685 - DNA, 20 bp, human
gactgcagctggcgtctttt

SEQ ID NO: 406686 - DNA, 20 bp, human
ggcaatgagcgcgctgaggt

SEQ ID NO: 406687 - DNA, 20 bp, human
gttcccagagggacaatcgg

SEQ ID NO: 406688 - DNA, 20 bp, human
ggcgctgaggtcggcgtgga

SEQ ID NO: 406689 - DNA, 20 bp, human
gtcggcgtggaggggtctct

SEQ ID NO: 406690 - DNA, 20 bp, human
gggcgggccagcgtgtgctg

SEQ ID NO: 406691 - DNA, 20 bp, human
gtgacgagagaggatcggga

SEQ ID NO: 406692 - DNA, 20 bp, human
ggggcaagggaggttagtcc

SEQ ID NO: 406693 - DNA, 20 bp, human
gtctccgccgattgtccctc

SEQ ID NO: 406694 - DNA, 20 bp, human
gggcccggccccggcgcttt

SEQ ID NO: 406695 - DNA, 20 bp, human
gccgaattcccacaagtctc

SEQ ID NO: 406696 - DNA, 20 bp, human
gaaggcactgccccttgcgt

SEQ ID NO: 406697 - DNA, 20 bp, human
gaagtccctgcatcctacga

SEQ ID NO: 406698 - DNA, 20 bp, human
gccaaaggaggcccaataga

SEQ ID NO: 406699 - DNA, 20 bp, human
gggccgggcccagccttcgt

SEQ ID NO: 406700 - DNA, 20 bp, human
gggtacgggaagtccacacg

SEQ ID NO: 406701 - DNA, 20 bp, human
gtacgtgcagtcggatgcgc

SEQ ID NO: 406702 - DNA, 20 bp, human
gtcctgtcctgggtcgtcaa

SEQ ID NO: 406703 - DNA, 20 bp, human
ggacttccgggtgatgtaat

SEQ ID NO: 406704 - DNA, 20 bp, human
ggtggacttcccgtaccctg

SEQ ID NO: 406705 - DNA, 20 bp, human
ggcctccccacctcagggta

SEQ ID NO: 406706 - DNA, 20 bp, human
gtgtccgaaggtgactccgg

SEQ ID NO: 406707 - DNA, 20 bp, human
gaaggtgactccggaggaga

SEQ ID NO: 406708 - DNA, 20 bp, human
gcccgcggaggccgccttga

SEQ ID NO: 406709 - DNA, 20 bp, human
gtgaggacggatttcggaat

SEQ ID NO: 406710 - DNA, 20 bp, human
gtggacttcgggttccgctg

SEQ ID NO: 406711 - DNA, 20 bp, human
gtgccccgaacccctcaagg

SEQ ID NO: 406712 - DNA, 20 bp, human
ggaggccgccttgaggggtt

SEQ ID NO: 406713 - DNA, 20 bp, human
gggtgtgttccgccgggctc

SEQ ID NO: 406714 - DNA, 20 bp, human
gcggcgggcgcggactaacc

SEQ ID NO: 406715 - DNA, 20 bp, human
gctgggaaatgcagtccgag

SEQ ID NO: 406716 - DNA, 20 bp, human
gaaaacgccggagcaccagg

SEQ ID NO: 406717 - DNA, 20 bp, human
gtgaataatgagcaaccagg

SEQ ID NO: 406718 - DNA, 20 bp, human
gtcctcctcttgcatctcac

SEQ ID NO: 406719 - DNA, 20 bp, human
gcgcgcaccccctggtgctc

SEQ ID NO: 406720 - DNA, 20 bp, human
gggtgctccggcgttttgtg

SEQ ID NO: 406721 - DNA, 20 bp, human
gcaaggtggttgcaaagtta

SEQ ID NO: 406722 - DNA, 20 bp, human
ggccagtgagatgcaagagg

SEQ ID NO: 406723 - DNA, 20 bp, human
gctccggcgttttgtgtggc

SEQ ID NO: 406724 - DNA, 20 bp, human
gacaacaacgtgcagcagag

SEQ ID NO: 406725 - DNA, 20 bp, human
gggagagagacggatatctc

SEQ ID NO: 406726 - DNA, 20 bp, human
gacggcagcgcacgactcgc

SEQ ID NO: 406727 - DNA, 20 bp, human
gctcccgcgggaggacggcc

SEQ ID NO: 406728 - DNA, 20 bp, human
gaacgaggaggggccgtgtc

SEQ ID NO: 406729 - DNA, 20 bp, human
gggcaccggcgacttagaga

SEQ ID NO: 406730 - DNA, 20 bp, human
ggcggcgctgcacacccggc

SEQ ID NO: 406731 - DNA, 20 bp, human
ggaggaggggccgtgtcggg

SEQ ID NO: 406732 - DNA, 20 bp, human
gggaggacggcccggggggt

SEQ ID NO: 406733 - DNA, 20 bp, human
ggtggatcggggtggaatcc

SEQ ID NO: 406734 - DNA, 20 bp, human
gctgcacacccggctggcac

SEQ ID NO: 406735 - DNA, 20 bp, human
gccgtcctcccgcgggagcg

SEQ ID NO: 406736 - DNA, 20 bp, human
gaaaacccggagaacgggtt

SEQ ID NO: 406737 - DNA, 20 bp, human
gtcctcccaacccgttctcc

SEQ ID NO: 406738 - DNA, 20 bp, human
ggccgccaaaacccggagaa

SEQ ID NO: 406739 - DNA, 20 bp, human
gacccggagaacgggttggg

SEQ ID NO: 406740 - DNA, 20 bp, human
gcctggaatagtctggaagg

SEQ ID NO: 406741 - DNA, 20 bp, human
gcctacgttccgcccagaaa

SEQ ID NO: 406742 - DNA, 20 bp, human
gcccgttctccgggttttgg

SEQ ID NO: 406743 - DNA, 20 bp, human
ggcactccgtctggcatccc

SEQ ID NO: 406744 - DNA, 20 bp, human
gtttggcggcgagagccccc

SEQ ID NO: 406745 - DNA, 20 bp, human
gaattatccgtctgccttcc

SEQ ID NO: 406746 - DNA, 20 bp, human
gcttccctggggcccatcga

SEQ ID NO: 406747 - DNA, 20 bp, human
gaagcgcggagcttctgtga

SEQ ID NO: 406748 - DNA, 20 bp, human
gaagctccctgtctaggcga

SEQ ID NO: 406749 - DNA, 20 bp, human
gggtggccctcgcctagaca

SEQ ID NO: 406750 - DNA, 20 bp, human
ggggacccttccctgtctta

SEQ ID NO: 406751 - DNA, 20 bp, human
gagcttctaggctctccatg

SEQ ID NO: 406752 - DNA, 20 bp, human
gtcagcccctacctagaagc

SEQ ID NO: 406753 - DNA, 20 bp, human
gcatcccgccagatggaaca

SEQ ID NO: 406754 - DNA, 20 bp, human
gctctccatgcgggtgtggc

SEQ ID NO: 406755 - DNA, 20 bp, human
gagaagctccgcgcttagaa

SEQ ID NO: 406756 - DNA, 20 bp, human
gttcccaggggctattgcag

SEQ ID NO: 406757 - DNA, 20 bp, human
ggaagtgtagtccggaacgg

SEQ ID NO: 406758 - DNA, 20 bp, human
ggaccaggagaggcccaaaa

SEQ ID NO: 406759 - DNA, 20 bp, human
ggaggcggcgttcagaaata

SEQ ID NO: 406760 - DNA, 20 bp, human
gaacactcggagcctggcga

SEQ ID NO: 406761 - DNA, 20 bp, human
gcacgtcccgccggttgctg

SEQ ID NO: 406762 - DNA, 20 bp, human
ggaggcccaaaaggggacac

SEQ ID NO: 406763 - DNA, 20 bp, human
gggctcctctccaagcctgg

SEQ ID NO: 406764 - DNA, 20 bp, human
ggtgtagtccggaacggagg

SEQ ID NO: 406765 - DNA, 20 bp, human
ggtgggtcgcttcagtgaag

SEQ ID NO: 406766 - DNA, 20 bp, human
gtaagagcaggagtgtgcgc

SEQ ID NO: 406767 - DNA, 20 bp, human
gggttccggcgggtaagagc

SEQ ID NO: 406768 - DNA, 20 bp, human
ggcgtggcccagggttccgg

SEQ ID NO: 406769 - DNA, 20 bp, human
gcactcctgctcttacccgc

SEQ ID NO: 406770 - DNA, 20 bp, human
gcaccgcccgctctgctcta

SEQ ID NO: 406771 - DNA, 20 bp, human
gctggtctctaggcgaggag

SEQ ID NO: 406772 - DNA, 20 bp, human
gcgggcgtggcccagggttc

SEQ ID NO: 406773 - DNA, 20 bp, human
gtccaggggtcggacgagag

SEQ ID NO: 406774 - DNA, 20 bp, human
gccccaggaactagtaacta

SEQ ID NO: 406775 - DNA, 20 bp, human
ggtctctaggcgaggagagg

SEQ ID NO: 406776 - DNA, 20 bp, human
gcggctagaacggaggggag

SEQ ID NO: 406777 - DNA, 20 bp, human
gctgcacccaggatcctccg

SEQ ID NO: 406778 - DNA, 20 bp, human
ggaagtaaggggcggagttg

SEQ ID NO: 406779 - DNA, 20 bp, human
gcaggactctatttcccaga

SEQ ID NO: 406780 - DNA, 20 bp, human
gcaacctaccgcttgctctt

SEQ ID NO: 406781 - DNA, 20 bp, human
ggtacctctccaccaatcag

SEQ ID NO: 406782 - DNA, 20 bp, human
gccaaagcggctagaacgga

SEQ ID NO: 406783 - DNA, 20 bp, human
gtagaaagagaatcaggacc

SEQ ID NO: 406784 - DNA, 20 bp, human
ggtgtcagtgtcagaccaat

SEQ ID NO: 406785 - DNA, 20 bp, human
gctctactcccacagtgcta

SEQ ID NO: 406786 - DNA, 20 bp, human
gtggcaacctgtcaacaaaa

SEQ ID NO: 406787 - DNA, 20 bp, human
gaacctgtcaacaaaaggga

SEQ ID NO: 406788 - DNA, 20 bp, human
ggagttctctagtaactgat

SEQ ID NO: 406789 - DNA, 20 bp, human
gactccaggaactttaccga

SEQ ID NO: 406790 - DNA, 20 bp, human
gaggttgccaggatacatcc

SEQ ID NO: 406791 - DNA, 20 bp, human
gttgttgcctggatgtatcc

SEQ ID NO: 406792 - DNA, 20 bp, human
gagtccatcggtaaagttcc

SEQ ID NO: 406793 - DNA, 20 bp, human
ggatggactgagcaaccaac

SEQ ID NO: 406794 - DNA, 20 bp, human
gtcccgtcccttttgttgac

SEQ ID NO: 406795 - DNA, 20 bp, human
gtttgaggctgctgagtaac

SEQ ID NO: 406796 - DNA, 20 bp, human
ggcagggcttcttcctcgat

SEQ ID NO: 406797 - DNA, 20 bp, human
ggttggcctggctccgatcg

SEQ ID NO: 406798 - DNA, 20 bp, human
gaattctcgtccgtgtgcag

SEQ ID NO: 406799 - DNA, 20 bp, human
ggtgacatggtgtgtctttc

SEQ ID NO: 406800 - DNA, 20 bp, human
gttcttcctcgatcggagcc

SEQ ID NO: 406801 - DNA, 20 bp, human
ggccggcaggtcactagttc

SEQ ID NO: 406802 - DNA, 20 bp, human
gtcctgaactagtgacctgc

SEQ ID NO: 406803 - DNA, 20 bp, human
gacacaccatgtcactgcaa

SEQ ID NO: 406804 - DNA, 20 bp, human
ggtccaatcaggcttgcagc

SEQ ID NO: 406805 - DNA, 20 bp, human
gggagccaggccaacttcag

SEQ ID NO: 406806 - DNA, 20 bp, human
gcgcgtcggcggtagctctg

SEQ ID NO: 406807 - DNA, 20 bp, human
ggaggccggcggcccgaact

SEQ ID NO: 406808 - DNA, 20 bp, human
gtcggcggtagctctgtggc

SEQ ID NO: 406809 - DNA, 20 bp, human
ggccggcggcccgaactcgg

SEQ ID NO: 406810 - DNA, 20 bp, human
gctcctccaaggtcctagag

SEQ ID NO: 406811 - DNA, 20 bp, human
gagcgccagccactccgacc

SEQ ID NO: 406812 - DNA, 20 bp, human
gagccgctctaggaccttgg

SEQ ID NO: 406813 - DNA, 20 bp, human
gcaggggctactctaagccg

SEQ ID NO: 406814 - DNA, 20 bp, human
gcggagccgctctaggacct

SEQ ID NO: 406815 - DNA, 20 bp, human
ggggcggggcgccgagacgt

SEQ ID NO: 406816 - DNA, 20 bp, human
ggcactggaagcgaggcgga

SEQ ID NO: 406817 - DNA, 20 bp, human
gagaggcactggaagcgagg

SEQ ID NO: 406818 - DNA, 20 bp, human
gttgccggggagacctgtca

SEQ ID NO: 406819 - DNA, 20 bp, human
gaggtctccccggcaaaacc

SEQ ID NO: 406820 - DNA, 20 bp, human
gcagcggaggggtccgagcg

SEQ ID NO: 406821 - DNA, 20 bp, human
gtgccgggactgagcaaagt

SEQ ID NO: 406822 - DNA, 20 bp, human
gggagacctgtcaaggagac

SEQ ID NO: 406823 - DNA, 20 bp, human
gtcggctaatgattagatcc

SEQ ID NO: 406824 - DNA, 20 bp, human
gtgttttccgggttttgccg

SEQ ID NO: 406825 - DNA, 20 bp, human
gaggtgcccgaccgcacggt

SEQ ID NO: 406826 - DNA, 20 bp, human
ggcgcatggtcactgggaag

SEQ ID NO: 406827 - DNA, 20 bp, human
gtcactgggaagcggctagt

SEQ ID NO: 406828 - DNA, 20 bp, human
ggggaagcggctagtgggct

SEQ ID NO: 406829 - DNA, 20 bp, human
gaccatgcgcaacaggcagg

SEQ ID NO: 406830 - DNA, 20 bp, human
ggcctgttgcgcatggtcac

SEQ ID NO: 406831 - DNA, 20 bp, human
gcccacctgcctgttgcgca

SEQ ID NO: 406832 - DNA, 20 bp, human
gtgggagcctatggaaagcg

SEQ ID NO: 406833 - DNA, 20 bp, human
gagaggcctagaatcgtatg

SEQ ID NO: 406834 - DNA, 20 bp, human
gctgcgcagaggcgctgaac

SEQ ID NO: 406835 - DNA, 20 bp, human
gtatggaaagcgcggacttt

SEQ ID NO: 406836 - DNA, 20 bp, human
gcctgtgggcggccatgttg

SEQ ID NO: 406837 - DNA, 20 bp, human
ggtagagactgagaggctga

SEQ ID NO: 406838 - DNA, 20 bp, human
gaaagcgccatgttgattac

SEQ ID NO: 406839 - DNA, 20 bp, human
gccagcctaagccgctgaaa

SEQ ID NO: 406840 - DNA, 20 bp, human
gaaacacgctcccgtttcag

SEQ ID NO: 406841 - DNA, 20 bp, human
gacaggccagagtgtctaca

SEQ ID NO: 406842 - DNA, 20 bp, human
gttgattactggcaaccttc

SEQ ID NO: 406843 - DNA, 20 bp, human
ggcaagatatgaagtaacct

SEQ ID NO: 406844 - DNA, 20 bp, human
gcacattttattcgtgtcga

SEQ ID NO: 406845 - DNA, 20 bp, human
gaggtcatgtagagactgag

SEQ ID NO: 406846 - DNA, 20 bp, human
ggagcccctaagaccccaag

SEQ ID NO: 406847 - DNA, 20 bp, human
ggggccgcttggggtcttag

SEQ ID NO: 406848 - DNA, 20 bp, human
ggaagtggctgaggccgcgg

SEQ ID NO: 406849 - DNA, 20 bp, human
gggtccagcctgtctccgcg

SEQ ID NO: 406850 - DNA, 20 bp, human
ggcaaaatctggtaaaaaat

SEQ ID NO: 406851 - DNA, 20 bp, human
ggctcgcaccacgcggagac

SEQ ID NO: 406852 - DNA, 20 bp, human
ggtgcagcgctcgcaccacg

SEQ ID NO: 406853 - DNA, 20 bp, human
gaacgtagtctgggccgctt

SEQ ID NO: 406854 - DNA, 20 bp, human
gtctggtaaaaaattggaca

SEQ ID NO: 406855 - DNA, 20 bp, human
ggagatagtccttcaaaagc

SEQ ID NO: 406856 - DNA, 20 bp, human
gttttcccttgctctagggt

SEQ ID NO: 406857 - DNA, 20 bp, human
gagtaatttcaaattgttac

SEQ ID NO: 406858 - DNA, 20 bp, human
gcaggcccaccctagagcaa

SEQ ID NO: 406859 - DNA, 20 bp, human
gacaatttgaaattacttaa

SEQ ID NO: 406860 - DNA, 20 bp, human
gcaaatctgatttatatata

SEQ ID NO: 406861 - DNA, 20 bp, human
gactcagggactgagtgggc

SEQ ID NO: 406862 - DNA, 20 bp, human
gtgtcactcagggactgagt

SEQ ID NO: 406863 - DNA, 20 bp, human
gagaattttcccttgctcta

SEQ ID NO: 406864 - DNA, 20 bp, human
ggcaggcagctggagcaaag

SEQ ID NO: 406865 - DNA, 20 bp, human
gtatatgtgtaaatctcgag

SEQ ID NO: 406866 - DNA, 20 bp, human
gcacgccccgaaggcgggag

SEQ ID NO: 406867 - DNA, 20 bp, human
gtcggcgtcgcccaccccca

SEQ ID NO: 406868 - DNA, 20 bp, human
ggcccaggaccagagggcgt

SEQ ID NO: 406869 - DNA, 20 bp, human
gtcgggcgcccaggaccaga

SEQ ID NO: 406870 - DNA, 20 bp, human
ggaagggccgggcagcccag

SEQ ID NO: 406871 - DNA, 20 bp, human
gaagctccagccttcggggc

SEQ ID NO: 406872 - DNA, 20 bp, human
gcaagccgctcccgccttcg

SEQ ID NO: 406873 - DNA, 20 bp, human
ggagaccacgccccgaaggc

SEQ ID NO: 406874 - DNA, 20 bp, human
gagaagggggttttctcccg

SEQ ID NO: 406875 - DNA, 20 bp, human
gccgcggagatgcccccagc

SEQ ID NO: 406876 - DNA, 20 bp, human
gggccagtaaagagtgtcag

SEQ ID NO: 406877 - DNA, 20 bp, human
gcacaatgacagagtgacga

SEQ ID NO: 406878 - DNA, 20 bp, human
gaacaagaggagcccttccc

SEQ ID NO: 406879 - DNA, 20 bp, human
gcagctgccctagacggcga

SEQ ID NO: 406880 - DNA, 20 bp, human
gtcagcaagtgctgcatcct

SEQ ID NO: 406881 - DNA, 20 bp, human
ggtgtgaactgaacctactg

SEQ ID NO: 406882 - DNA, 20 bp, human
gtgtcagggggtgagagccc

SEQ ID NO: 406883 - DNA, 20 bp, human
gaccccctgacactctttac

SEQ ID NO: 406884 - DNA, 20 bp, human
ggagctccccaagtctacag

SEQ ID NO: 406885 - DNA, 20 bp, human
ggatctgagggctctgaaag

SEQ ID NO: 406886 - DNA, 20 bp, human
gggcgccggaaaggagggta

SEQ ID NO: 406887 - DNA, 20 bp, human
gggggcggcgccggaaagga

SEQ ID NO: 406888 - DNA, 20 bp, human
gtccgccggtgggacggaac

SEQ ID NO: 406889 - DNA, 20 bp, human
ggctacgtcactgtgcgatc

SEQ ID NO: 406890 - DNA, 20 bp, human
ggtacagcgcatccgatgca

SEQ ID NO: 406891 - DNA, 20 bp, human
gtcattcggacaaaaagggg

SEQ ID NO: 406892 - DNA, 20 bp, human
gggcaccagttccgtcccac

SEQ ID NO: 406893 - DNA, 20 bp, human
ggatgcgctgtaccctgcgc

SEQ ID NO: 406894 - DNA, 20 bp, human
gcacccgcgaggccggaaaa

SEQ ID NO: 406895 - DNA, 20 bp, human
ggctgtcattcggacaaaaa

SEQ ID NO: 406896 - DNA, 20 bp, human
gctgcagggctccgttaccc

SEQ ID NO: 406897 - DNA, 20 bp, human
gtcctctacagggcgggaat

SEQ ID NO: 406898 - DNA, 20 bp, human
gaatcaggggccctgggacg

SEQ ID NO: 406899 - DNA, 20 bp, human
gcctagctacagcctttcta

SEQ ID NO: 406900 - DNA, 20 bp, human
gccctcagccctgagtgaca

SEQ ID NO: 406901 - DNA, 20 bp, human
gtaatcagccgggctctgca

SEQ ID NO: 406902 - DNA, 20 bp, human
ggagtgacagggtaagccct

SEQ ID NO: 406903 - DNA, 20 bp, human
gctccctgcgccctggtcgt

SEQ ID NO: 406904 - DNA, 20 bp, human
ggccctgccaactgtcaatc

SEQ ID NO: 406905 - DNA, 20 bp, human
gcagggtaagccctgggtaa

SEQ ID NO: 406906 - DNA, 20 bp, human
gaggacagagtgacagccga

SEQ ID NO: 406907 - DNA, 20 bp, human
gaccttacacacaacgttaa

SEQ ID NO: 406908 - DNA, 20 bp, human
gccaaacgctgggccgaatg

SEQ ID NO: 406909 - DNA, 20 bp, human
gagaagatgtaaccaaacgc

SEQ ID NO: 406910 - DNA, 20 bp, human
gacaccttctgcggtgtgct

SEQ ID NO: 406911 - DNA, 20 bp, human
gccaggccagcgtcgctgaa

SEQ ID NO: 406912 - DNA, 20 bp, human
gtaaaggcaaacaccttctg

SEQ ID NO: 406913 - DNA, 20 bp, human
ggagccaagcacaccgcaga

SEQ ID NO: 406914 - DNA, 20 bp, human
gctgtcactctgtcctcatt

SEQ ID NO: 406915 - DNA, 20 bp, human
gcctgaaaaggctgcacctt

SEQ ID NO: 406916 - DNA, 20 bp, human
gtaagggaaaataccctcta

SEQ ID NO: 406917 - DNA, 20 bp, human
gaactgggaaccgtccaatt

SEQ ID NO: 406918 - DNA, 20 bp, human
ggagccaggcacaccttaga

SEQ ID NO: 406919 - DNA, 20 bp, human
gcaatcagacacgcagaact

SEQ ID NO: 406920 - DNA, 20 bp, human
gataccctctaaggtgtgcc

SEQ ID NO: 406921 - DNA, 20 bp, human
gtctgattggatacggttta

SEQ ID NO: 406922 - DNA, 20 bp, human
gacatttggagcggcgagga

SEQ ID NO: 406923 - DNA, 20 bp, human
ggtccaattaggcacacatt

SEQ ID NO: 406924 - DNA, 20 bp, human
ggcacacatttggagcggcg

SEQ ID NO: 406925 - DNA, 20 bp, human
ggctgctagttcaaaggact

SEQ ID NO: 406926 - DNA, 20 bp, human
gccccggccgaggtgtgcgc

SEQ ID NO: 406927 - DNA, 20 bp, human
gggagcaggaagtgtcccag

SEQ ID NO: 406928 - DNA, 20 bp, human
gcccgccggacgccgaggaa

SEQ ID NO: 406929 - DNA, 20 bp, human
gcctgcgccgcccgccaaca

SEQ ID NO: 406930 - DNA, 20 bp, human
gcctgctccgctctaggact

SEQ ID NO: 406931 - DNA, 20 bp, human
gacccacaaagcccccggcc

SEQ ID NO: 406932 - DNA, 20 bp, human
gcccagccgcgactcccggt

SEQ ID NO: 406933 - DNA, 20 bp, human
ggcacacctcggccgggggg

SEQ ID NO: 406934 - DNA, 20 bp, human
gactcccggtcggccgttcc

SEQ ID NO: 406935 - DNA, 20 bp, human
gtcacccccagcgcacacct

SEQ ID NO: 406936 - DNA, 20 bp, human
gaggctggccgggtgcagga

SEQ ID NO: 406937 - DNA, 20 bp, human
gcgcctgcgtaactatgccg

SEQ ID NO: 406938 - DNA, 20 bp, human
gcgcccgagtagcttggctg

SEQ ID NO: 406939 - DNA, 20 bp, human
gcgcgccttctggttcccat

SEQ ID NO: 406940 - DNA, 20 bp, human
gcgccacagccaagctactc

SEQ ID NO: 406941 - DNA, 20 bp, human
ggctgtggcgccgtccccat

SEQ ID NO: 406942 - DNA, 20 bp, human
gcgtccccatgggaaccaga

SEQ ID NO: 406943 - DNA, 20 bp, human
gagcgcatccatggcaacgc

SEQ ID NO: 406944 - DNA, 20 bp, human
gggccggaggaggaccgcca

SEQ ID NO: 406945 - DNA, 20 bp, human
ggggagaaacgcgacgcctt

SEQ ID NO: 406946 - DNA, 20 bp, human
gtggttaatgtggtcctcaa

SEQ ID NO: 406947 - DNA, 20 bp, human
gacgtgcactgtggttaatg

SEQ ID NO: 406948 - DNA, 20 bp, human
gcacgctcgcgcggtcaccg

SEQ ID NO: 406949 - DNA, 20 bp, human
gggcccgcaggcggcattgt

SEQ ID NO: 406950 - DNA, 20 bp, human
ggggtccgcgacgtgcactg

SEQ ID NO: 406951 - DNA, 20 bp, human
ggcaacacggccgagtgggc

SEQ ID NO: 406952 - DNA, 20 bp, human
gcctcaaaggcacgcattgt

SEQ ID NO: 406953 - DNA, 20 bp, human
gttgccacgcccccaacggc

SEQ ID NO: 406954 - DNA, 20 bp, human
gcacccgctccgctctcctc

SEQ ID NO: 406955 - DNA, 20 bp, human
gcgtggcaacacggccgagt

SEQ ID NO: 406956 - DNA, 20 bp, human
ggaaacccgtagctgcgtgc

SEQ ID NO: 406957 - DNA, 20 bp, human
ggcacgccaggtggggtcgc

SEQ ID NO: 406958 - DNA, 20 bp, human
gacgtcagcagtccgcgcct

SEQ ID NO: 406959 - DNA, 20 bp, human
ggtctcctctctaggaaggt

SEQ ID NO: 406960 - DNA, 20 bp, human
gaaacgggatggaagtcaga

SEQ ID NO: 406961 - DNA, 20 bp, human
gtggggtcgcaggttgtttc

SEQ ID NO: 406962 - DNA, 20 bp, human
gccttcccgcacgcagctac

SEQ ID NO: 406963 - DNA, 20 bp, human
gcggactgctgacgtcacgc

SEQ ID NO: 406964 - DNA, 20 bp, human
gcgctcccaccttcctagag

SEQ ID NO: 406965 - DNA, 20 bp, human
gccccaaaggacagtaacat

SEQ ID NO: 406966 - DNA, 20 bp, human
gagcgggaggaacatctcta

SEQ ID NO: 406967 - DNA, 20 bp, human
ggttacaggctgggtttgga

SEQ ID NO: 406968 - DNA, 20 bp, human
gtctatgggaccctagaaga

SEQ ID NO: 406969 - DNA, 20 bp, human
ggagggaatgccttcttcta

SEQ ID NO: 406970 - DNA, 20 bp, human
gtagagggagacgttaggga

SEQ ID NO: 406971 - DNA, 20 bp, human
gggaacgcgactgggcttga

SEQ ID NO: 406972 - DNA, 20 bp, human
gactgtagagggagacgtta

SEQ ID NO: 406973 - DNA, 20 bp, human
gctcgctgctgacgcactac

SEQ ID NO: 406974 - DNA, 20 bp, human
gttcctagagaatcagagaa

SEQ ID NO: 406975 - DNA, 20 bp, human
gtgattctctaggaagcggg

SEQ ID NO: 406976 - DNA, 20 bp, human
gggagcccgaggtgattgga

SEQ ID NO: 406977 - DNA, 20 bp, human
ggggagctgcccattaaaac

SEQ ID NO: 406978 - DNA, 20 bp, human
ggagggaggggacacacagg

SEQ ID NO: 406979 - DNA, 20 bp, human
gtcccagcgaaatcgaggga

SEQ ID NO: 406980 - DNA, 20 bp, human
ggtcctcccagcgaaatcga

SEQ ID NO: 406981 - DNA, 20 bp, human
ggaggtgattggagggtcaa

SEQ ID NO: 406982 - DNA, 20 bp, human
gcacaggggggcggcgaaga

SEQ ID NO: 406983 - DNA, 20 bp, human
gcggcgcagcgcagccacca

SEQ ID NO: 406984 - DNA, 20 bp, human
gcgtgaggaacagactgcgg

SEQ ID NO: 406985 - DNA, 20 bp, human
gtgtccagaaggagcaccgg

SEQ ID NO: 406986 - DNA, 20 bp, human
gatcacgtcttctgtaactc

SEQ ID NO: 406987 - DNA, 20 bp, human
gagaagacgtgatccgatgc

SEQ ID NO: 406988 - DNA, 20 bp, human
ggcagctgtagcgaacagga

SEQ ID NO: 406989 - DNA, 20 bp, human
gacaatgggcccgccaaagc

SEQ ID NO: 406990 - DNA, 20 bp, human
gggcgtcagcgagagacaat

SEQ ID NO: 406991 - DNA, 20 bp, human
gtccggcttccggctttggc

SEQ ID NO: 406992 - DNA, 20 bp, human
ggaggaagtcctgtttgaaa

SEQ ID NO: 406993 - DNA, 20 bp, human
gcaggacggtttccggcttc

SEQ ID NO: 406994 - DNA, 20 bp, human
ggaaaaggctgcagctggcc

SEQ ID NO: 406995 - DNA, 20 bp, human
gggtttccggcttccggctt

SEQ ID NO: 406996 - DNA, 20 bp, human
ggggttcgggcccagttgtc

SEQ ID NO: 406997 - DNA, 20 bp, human
gtggggagcctccctctcgc

SEQ ID NO: 406998 - DNA, 20 bp, human
gcgggagccagggtttgcaa

SEQ ID NO: 406999 - DNA, 20 bp, human
gggtttgcaaggggctaaac

SEQ ID NO: 407000 - DNA, 20 bp, human
gcgaggctggacccgcgaga

SEQ ID NO: 407001 - DNA, 20 bp, human
gcaaggggctaaaccggctg

SEQ ID NO: 407002 - DNA, 20 bp, human
gaggctcaggccccgcctac

SEQ ID NO: 407003 - DNA, 20 bp, human
gccccgcctaccggcgtccc

SEQ ID NO: 407004 - DNA, 20 bp, human
gaaatctagacgtctggaag

SEQ ID NO: 407005 - DNA, 20 bp, human
gggcccgggacgccggtagg

SEQ ID NO: 407006 - DNA, 20 bp, human
gaacccgggctccagttatc

SEQ ID NO: 407007 - DNA, 20 bp, human
ggtctaacccacaacctctg

SEQ ID NO: 407008 - DNA, 20 bp, human
gttattacgccataaatctt

SEQ ID NO: 407009 - DNA, 20 bp, human
gcgggctccagttatcagga

SEQ ID NO: 407010 - DNA, 20 bp, human
gtcagagccccagaggttgt

SEQ ID NO: 407011 - DNA, 20 bp, human
gcatggaccgtcctgataac

SEQ ID NO: 407012 - DNA, 20 bp, human
gggttaccgcgcagcatgct

SEQ ID NO: 407013 - DNA, 20 bp, human
gctacgtttcacatgcagta

SEQ ID NO: 407014 - DNA, 20 bp, human
gacgtagtcttgcatgttat

SEQ ID NO: 407015 - DNA, 20 bp, human
gttacagaaagcaagagccg

SEQ ID NO: 407016 - DNA, 20 bp, human
gtcacttccgccgccgtcgg

SEQ ID NO: 407017 - DNA, 20 bp, human
ggggccgcggggcaagacgc

SEQ ID NO: 407018 - DNA, 20 bp, human
gtggccggtgcaggcccgaa

SEQ ID NO: 407019 - DNA, 20 bp, human
gcagcggtccccgaactctg

SEQ ID NO: 407020 - DNA, 20 bp, human
ggcccgacactcagccgggg

SEQ ID NO: 407021 - DNA, 20 bp, human
ggggggcccacgaggcgacg

SEQ ID NO: 407022 - DNA, 20 bp, human
ggggaccgctgcacagccag

SEQ ID NO: 407023 - DNA, 20 bp, human
gttagagggaacaagatcca

SEQ ID NO: 407024 - DNA, 20 bp, human
gcgggcgtgatgagggggtt

SEQ ID NO: 407025 - DNA, 20 bp, human
ggccagccccgtcgcctcgt

SEQ ID NO: 407026 - DNA, 20 bp, human
ggggtctcagaggaatcgga

SEQ ID NO: 407027 - DNA, 20 bp, human
gacccgggaacctatgggtg

SEQ ID NO: 407028 - DNA, 20 bp, human
ggcgggacccgggaacctat

SEQ ID NO: 407029 - DNA, 20 bp, human
gccgcctagcagcttccgag

SEQ ID NO: 407030 - DNA, 20 bp, human
gggcggggtctcagaggaat

SEQ ID NO: 407031 - DNA, 20 bp, human
gcactccagaccccacccat

SEQ ID NO: 407032 - DNA, 20 bp, human
gggaacctatgggtggggtc

SEQ ID NO: 407033 - DNA, 20 bp, human
gcccgcgtcgcgatcccagt

SEQ ID NO: 407034 - DNA, 20 bp, human
gtcgcgatcccagtggggcg

SEQ ID NO: 407035 - DNA, 20 bp, human
gccccactgggatcgcgacg

SEQ ID NO: 407036 - DNA, 20 bp, human
ggccgctccgcgacggggag

SEQ ID NO: 407037 - DNA, 20 bp, human
ggggcggaaccgcggagcgg

SEQ ID NO: 407038 - DNA, 20 bp, human
ggggaaccacaggccagcgc

SEQ ID NO: 407039 - DNA, 20 bp, human
gaactctcgcgttattcccg

SEQ ID NO: 407040 - DNA, 20 bp, human
gcgccccaggacggcagaac

SEQ ID NO: 407041 - DNA, 20 bp, human
gtcccgcggccgctccgcga

SEQ ID NO: 407042 - DNA, 20 bp, human
gacggcagaaccggctactc

SEQ ID NO: 407043 - DNA, 20 bp, human
gccccctccccgtcgcggag

SEQ ID NO: 407044 - DNA, 20 bp, human
gaagccgccaggcacctccg

SEQ ID NO: 407045 - DNA, 20 bp, human
gactgcgggcccggccgacg

SEQ ID NO: 407046 - DNA, 20 bp, human
gcggggagcaagccaatcag

SEQ ID NO: 407047 - DNA, 20 bp, human
ggccgcggcgggagcctcaa

SEQ ID NO: 407048 - DNA, 20 bp, human
gggagcctcaatggcgtgac

SEQ ID NO: 407049 - DNA, 20 bp, human
gccgggaagtgattgtgacg

SEQ ID NO: 407050 - DNA, 20 bp, human
ggctccccgctgccgctgat

SEQ ID NO: 407051 - DNA, 20 bp, human
gcggtcccaacctgtccctg

SEQ ID NO: 407052 - DNA, 20 bp, human
gggacaggttgggaccggtc

SEQ ID NO: 407053 - DNA, 20 bp, human
gaagtgattgtgacgaggcg

SEQ ID NO: 407054 - DNA, 20 bp, human
gacgcgtagtccgtgggaag

SEQ ID NO: 407055 - DNA, 20 bp, human
gcacgggacgcgtagtccgt

SEQ ID NO: 407056 - DNA, 20 bp, human
gaccctgtgcgcaggcgcgt

SEQ ID NO: 407057 - DNA, 20 bp, human
gcgaaggccccgcattgatt

SEQ ID NO: 407058 - DNA, 20 bp, human
gcactctgtgccggaggtga

SEQ ID NO: 407059 - DNA, 20 bp, human
gcctccggcacagagtgctc

SEQ ID NO: 407060 - DNA, 20 bp, human
gactgcgctcccaatcaatg

SEQ ID NO: 407061 - DNA, 20 bp, human
gagaggggacatgagaactt

SEQ ID NO: 407062 - DNA, 20 bp, human
ggagcgcagcagccgagaga

SEQ ID NO: 407063 - DNA, 20 bp, human
ggggaagacggcgcctcttc

SEQ ID NO: 407064 - DNA, 20 bp, human
ggcacagagtgctcgggacc

SEQ ID NO: 407065 - DNA, 20 bp, human
gcaccggacgccgagacttc

SEQ ID NO: 407066 - DNA, 20 bp, human
gagcaccccgccaccggcgc

SEQ ID NO: 407067 - DNA, 20 bp, human
ggccgcgtctgcgcaagctc

SEQ ID NO: 407068 - DNA, 20 bp, human
gcgcaagctcgggacggcct

SEQ ID NO: 407069 - DNA, 20 bp, human
gagctcgggacggcctcggg

SEQ ID NO: 407070 - DNA, 20 bp, human
gcgagcacggcccctcccag

SEQ ID NO: 407071 - DNA, 20 bp, human
gggtgctggcgcggcgaagc

SEQ ID NO: 407072 - DNA, 20 bp, human
gcgcgccagcaccccgccac

SEQ ID NO: 407073 - DNA, 20 bp, human
ggcgcctgtaggacctccgc

SEQ ID NO: 407074 - DNA, 20 bp, human
gtcgggacggcctcgggagg

SEQ ID NO: 407075 - DNA, 20 bp, human
gccttcagagccagcgccgg

SEQ ID NO: 407076 - DNA, 20 bp, human
gcgcccctcgtcaaggtcta

SEQ ID NO: 407077 - DNA, 20 bp, human
gcccgcggggcggacgcgtc

SEQ ID NO: 407078 - DNA, 20 bp, human
gctcgcgccggggcccccgc

SEQ ID NO: 407079 - DNA, 20 bp, human
gcatacgtacagacgtgctc

SEQ ID NO: 407080 - DNA, 20 bp, human
gtgtgctgatgagacaatag

SEQ ID NO: 407081 - DNA, 20 bp, human
gccacactgaggggacagtc

SEQ ID NO: 407082 - DNA, 20 bp, human
gccccgagcccggctcgcgc

SEQ ID NO: 407083 - DNA, 20 bp, human
gcgggcgcagctggcgcggt

SEQ ID NO: 407084 - DNA, 20 bp, human
gacggcccggcgcaggccgg

SEQ ID NO: 407085 - DNA, 20 bp, human
ggaagcctccggcctgcgcc

SEQ ID NO: 407086 - DNA, 20 bp, human
ggtcgccagggccccagcta

SEQ ID NO: 407087 - DNA, 20 bp, human
ggatggcgctcgcgtctcga

SEQ ID NO: 407088 - DNA, 20 bp, human
ggggcagagagtgggcgcaa

SEQ ID NO: 407089 - DNA, 20 bp, human
ggccgctgcgccgctctggg

SEQ ID NO: 407090 - DNA, 20 bp, human
ggcgcagcggccgtttccgg

SEQ ID NO: 407091 - DNA, 20 bp, human
gtatcagtcccaggcccgac

SEQ ID NO: 407092 - DNA, 20 bp, human
gctgggactgatacccggtc

SEQ ID NO: 407093 - DNA, 20 bp, human
gtcctccaggcctcccagag

SEQ ID NO: 407094 - DNA, 20 bp, human
gccagctaggggcgcgcctg

SEQ ID NO: 407095 - DNA, 20 bp, human
gtctagcccctgcggcgcgg

SEQ ID NO: 407096 - DNA, 20 bp, human
ggagactaggccatggagct

SEQ ID NO: 407097 - DNA, 20 bp, human
gtagtagtgggtcactggac

SEQ ID NO: 407098 - DNA, 20 bp, human
gctaccgggagcgcacgctg

SEQ ID NO: 407099 - DNA, 20 bp, human
gggagcgcacgctgcggcgg

SEQ ID NO: 407100 - DNA, 20 bp, human
gagtgggtcactggactggt

SEQ ID NO: 407101 - DNA, 20 bp, human
gggccgcgcgctagatggag

SEQ ID NO: 407102 - DNA, 20 bp, human
gagcggcgaacccagctcca

SEQ ID NO: 407103 - DNA, 20 bp, human
ggaccattcccagtcagcaa

SEQ ID NO: 407104 - DNA, 20 bp, human
ggacctctccatctagcgcg

SEQ ID NO: 407105 - DNA, 20 bp, human
ggtgagcaaagaggtagtag

SEQ ID NO: 407106 - DNA, 20 bp, human
gccatgccgcaggcaaaaga

SEQ ID NO: 407107 - DNA, 20 bp, human
gccttagagacctcaggcgc

SEQ ID NO: 407108 - DNA, 20 bp, human
gcagcttagaagcccggcgg

SEQ ID NO: 407109 - DNA, 20 bp, human
gccagccgagccccacttct

SEQ ID NO: 407110 - DNA, 20 bp, human
gtaagcccagaagtggggct

SEQ ID NO: 407111 - DNA, 20 bp, human
gggtctgaggctccccgctc

SEQ ID NO: 407112 - DNA, 20 bp, human
gccagcgaggccggcgcctg

SEQ ID NO: 407113 - DNA, 20 bp, human
gcgtgcgcaatgtgaagcgg

SEQ ID NO: 407114 - DNA, 20 bp, human
ggctacggtgcgaacgtgtt

SEQ ID NO: 407115 - DNA, 20 bp, human
gttctaagctgtccagagcg

SEQ ID NO: 407116 - DNA, 20 bp, human
gggtcatttttttagcattg

SEQ ID NO: 407117 - DNA, 20 bp, human
gaaaaagagtcctgacatgg

SEQ ID NO: 407118 - DNA, 20 bp, human
gcagcactctgagaggccag

SEQ ID NO: 407119 - DNA, 20 bp, human
gggaatgagccgagagtgac

SEQ ID NO: 407120 - DNA, 20 bp, human
gcacgcaaggcctgaggtcg

SEQ ID NO: 407121 - DNA, 20 bp, human
gactatccaatcagggctct

SEQ ID NO: 407122 - DNA, 20 bp, human
ggtgcaggcaccgcgacctc

SEQ ID NO: 407123 - DNA, 20 bp, human
gtgctaaaaaaatgacccct

SEQ ID NO: 407124 - DNA, 20 bp, human
gccaatcagggctctggggt

SEQ ID NO: 407125 - DNA, 20 bp, human
ggatgctaccatacactgca

SEQ ID NO: 407126 - DNA, 20 bp, human
gctcggccgccgcctggctc

SEQ ID NO: 407127 - DNA, 20 bp, human
gagagccccgagatccgccg

SEQ ID NO: 407128 - DNA, 20 bp, human
gggcccgccaagacccggac

SEQ ID NO: 407129 - DNA, 20 bp, human
ggagggggcccgccaagacc

SEQ ID NO: 407130 - DNA, 20 bp, human
gtgcactcacacacagacag

SEQ ID NO: 407131 - DNA, 20 bp, human
gcctccagtccgggtcttgg

SEQ ID NO: 407132 - DNA, 20 bp, human
gggcgcgcggatccggagcc

SEQ ID NO: 407133 - DNA, 20 bp, human
gagacccggactggaggcgc

SEQ ID NO: 407134 - DNA, 20 bp, human
gtctaataacgcagctgcgg

SEQ ID NO: 407135 - DNA, 20 bp, human
ggggtgtgcgagcggccggg

SEQ ID NO: 407136 - DNA, 20 bp, human
gggaaacaaaggggactcgc

SEQ ID NO: 407137 - DNA, 20 bp, human
ggggcccggcgcttctccga

SEQ ID NO: 407138 - DNA, 20 bp, human
ggggtcctaacgaccggtcg

SEQ ID NO: 407139 - DNA, 20 bp, human
ggcgcccgcgggaaacaaag

SEQ ID NO: 407140 - DNA, 20 bp, human
gagtcccctttgtttcccgc

SEQ ID NO: 407141 - DNA, 20 bp, human
gctcgctgggtcctaacgac

SEQ ID NO: 407142 - DNA, 20 bp, human
gtatccacttagcactccat

SEQ ID NO: 407143 - DNA, 20 bp, human
gaagcccatggagtgctaag

SEQ ID NO: 407144 - DNA, 20 bp, human
gtcgccgccgccgaggggca

SEQ ID NO: 407145 - DNA, 20 bp, human
gccgcccctcggagaagcgc

SEQ ID NO: 407146 - DNA, 20 bp, human
gcgcctgcgtgttgccacac

SEQ ID NO: 407147 - DNA, 20 bp, human
gtgggcggtgcccttacccg

SEQ ID NO: 407148 - DNA, 20 bp, human
ggcgacccagagaaatgcgc

SEQ ID NO: 407149 - DNA, 20 bp, human
gtgggcccatggagtgaact

SEQ ID NO: 407150 - DNA, 20 bp, human
gcacatcttcgccctgtggg

SEQ ID NO: 407151 - DNA, 20 bp, human
gtgcgcctgcgcatttctct

SEQ ID NO: 407152 - DNA, 20 bp, human
ggcgtgttgccacacaggcg

SEQ ID NO: 407153 - DNA, 20 bp, human
ggcacacatcttcgccctgt

SEQ ID NO: 407154 - DNA, 20 bp, human
ggccgcccagttcactccat

SEQ ID NO: 407155 - DNA, 20 bp, human
ggcccatggagtgaactggg

SEQ ID NO: 407156 - DNA, 20 bp, human
gtggcgcaggcgcgcagtgg

SEQ ID NO: 407157 - DNA, 20 bp, human
gttctggggctcgtggttcg

SEQ ID NO: 407158 - DNA, 20 bp, human
ggtacctgcccccgtggcgc

SEQ ID NO: 407159 - DNA, 20 bp, human
gcgtggcgcaaagcgttctg

SEQ ID NO: 407160 - DNA, 20 bp, human
ggagggctgtgtgcggtcgt

SEQ ID NO: 407161 - DNA, 20 bp, human
gagggggccgcggggttctc

SEQ ID NO: 407162 - DNA, 20 bp, human
gagatgtagttcaacgatga

SEQ ID NO: 407163 - DNA, 20 bp, human
ggctgactggttgaatgctt

SEQ ID NO: 407164 - DNA, 20 bp, human
gactgcgcgcctgcgccacg

SEQ ID NO: 407165 - DNA, 20 bp, human
ggcggggtccatggggaacg

SEQ ID NO: 407166 - DNA, 20 bp, human
ggcgggccgggacaaagcct

SEQ ID NO: 407167 - DNA, 20 bp, human
gtacctgcgcagagcaaaat

SEQ ID NO: 407168 - DNA, 20 bp, human
gcgcatcctagaggccggac

SEQ ID NO: 407169 - DNA, 20 bp, human
gaaacccggaagcggaccgc

SEQ ID NO: 407170 - DNA, 20 bp, human
ggcgcgcgcatcctagaggc

SEQ ID NO: 407171 - DNA, 20 bp, human
gcctagaggccggactggct

SEQ ID NO: 407172 - DNA, 20 bp, human
gcccggaagcggaccgcggg

SEQ ID NO: 407173 - DNA, 20 bp, human
gctaccggaaactgcgctct

SEQ ID NO: 407174 - DNA, 20 bp, human
gaatcggcttccgggtctac

SEQ ID NO: 407175 - DNA, 20 bp, human
gacgcctagagcgcagtttc

SEQ ID NO: 407176 - DNA, 20 bp, human
gtgcgcacccggaaactcca

SEQ ID NO: 407177 - DNA, 20 bp, human
ggctgcgcgtcccctaggcg

SEQ ID NO: 407178 - DNA, 20 bp, human
gcccagaccctggagtttcc

SEQ ID NO: 407179 - DNA, 20 bp, human
gaagctcaagcggagcccgc

SEQ ID NO: 407180 - DNA, 20 bp, human
gagacccttgccatcagcag

SEQ ID NO: 407181 - DNA, 20 bp, human
gcgtcccctaggcgcggaag

SEQ ID NO: 407182 - DNA, 20 bp, human
gctgccgctgcgcgtcccct

SEQ ID NO: 407183 - DNA, 20 bp, human
gtgaagtcgaggcagtaatc

SEQ ID NO: 407184 - DNA, 20 bp, human
ggaacaggaagctggggcga

SEQ ID NO: 407185 - DNA, 20 bp, human
gaaaggtcgaagttcatccg

SEQ ID NO: 407186 - DNA, 20 bp, human
gaccccgttgctatggagaa

SEQ ID NO: 407187 - DNA, 20 bp, human
gtccctcccctgagcctcat

SEQ ID NO: 407188 - DNA, 20 bp, human
ggtagttctcaccgcttctt

SEQ ID NO: 407189 - DNA, 20 bp, human
gaacctggctcacgggcctc

SEQ ID NO: 407190 - DNA, 20 bp, human
gcttctcctggacctcaggg

SEQ ID NO: 407191 - DNA, 20 bp, human
gaggaatgaccccgttgcta

SEQ ID NO: 407192 - DNA, 20 bp, human
gtggctccacgccaagaacc

SEQ ID NO: 407193 - DNA, 20 bp, human
ggcagaggtcgcccttctcc

SEQ ID NO: 407194 - DNA, 20 bp, human
gtcttggcgtggagccaatg

SEQ ID NO: 407195 - DNA, 20 bp, human
gacggggtcattcctccctg

SEQ ID NO: 407196 - DNA, 20 bp, human
gagcacaggggggatctcgc

SEQ ID NO: 407197 - DNA, 20 bp, human
gtccaaggctgtgtgctcgt

SEQ ID NO: 407198 - DNA, 20 bp, human
gtcctcaggaagacctaaga

SEQ ID NO: 407199 - DNA, 20 bp, human
ggagggggaaacagtgtctg

SEQ ID NO: 407200 - DNA, 20 bp, human
ggggctctggggtgcttgcg

SEQ ID NO: 407201 - DNA, 20 bp, human
ggggaaacagtgtctgcggt

SEQ ID NO: 407202 - DNA, 20 bp, human
ggaccagaaccggctgaaac

SEQ ID NO: 407203 - DNA, 20 bp, human
gaggttgtgggaggtaagtg

SEQ ID NO: 407204 - DNA, 20 bp, human
gtgtgtgctcgtggggtggg

SEQ ID NO: 407205 - DNA, 20 bp, human
gccctgaaaatcatcagcac

SEQ ID NO: 407206 - DNA, 20 bp, human
gcgagccagcggccccgtat

SEQ ID NO: 407207 - DNA, 20 bp, human
ggccccgtatgggcgagact

SEQ ID NO: 407208 - DNA, 20 bp, human
gtgagagcccgcaatgtcgt

SEQ ID NO: 407209 - DNA, 20 bp, human
ggcggcttggggccacggaa

SEQ ID NO: 407210 - DNA, 20 bp, human
gccaccccgctccactcccg

SEQ ID NO: 407211 - DNA, 20 bp, human
gtggggccacggaaaggact

SEQ ID NO: 407212 - DNA, 20 bp, human
gctgccaagtctcgcccata

SEQ ID NO: 407213 - DNA, 20 bp, human
gaagtcgcggcttggggcca

SEQ ID NO: 407214 - DNA, 20 bp, human
gtggctcgcggcttcgcccc

SEQ ID NO: 407215 - DNA, 20 bp, human
gctcgcccatacggggccgc

SEQ ID NO: 407216 - DNA, 20 bp, human
gtgctggggcagagcaaaat

SEQ ID NO: 407217 - DNA, 20 bp, human
gggacagggcgggctcaagg

SEQ ID NO: 407218 - DNA, 20 bp, human
ggacccggaagtcgagatca

SEQ ID NO: 407219 - DNA, 20 bp, human
gcgcgcgcatcgtacaggcc

SEQ ID NO: 407220 - DNA, 20 bp, human
gccgggacagggcgggctca

SEQ ID NO: 407221 - DNA, 20 bp, human
gggggcagagcaaaatcggt

SEQ ID NO: 407222 - DNA, 20 bp, human
gctgtaaacagatcttgctg

SEQ ID NO: 407223 - DNA, 20 bp, human
gaattgcgcgcgcatcgtac

SEQ ID NO: 407224 - DNA, 20 bp, human
ggtaataacaggaattctcg

SEQ ID NO: 407225 - DNA, 20 bp, human
gtcctgttttagggttttgg

SEQ ID NO: 407226 - DNA, 20 bp, human
ggtcccggcagtaccagggg

SEQ ID NO: 407227 - DNA, 20 bp, human
gactaactgcctctgctcac

SEQ ID NO: 407228 - DNA, 20 bp, human
gaccaggggcggctcccagc

SEQ ID NO: 407229 - DNA, 20 bp, human
ggagtcctgcctctgaaggc

SEQ ID NO: 407230 - DNA, 20 bp, human
gtcagaggcaggactcagaa

SEQ ID NO: 407231 - DNA, 20 bp, human
gcagcaaaatcacacaagag

SEQ ID NO: 407232 - DNA, 20 bp, human
gtgcaattagggcccatctt

SEQ ID NO: 407233 - DNA, 20 bp, human
gcatgtacttaggatgggat

SEQ ID NO: 407234 - DNA, 20 bp, human
gcgtgtcccggcagtaccag

SEQ ID NO: 407235 - DNA, 20 bp, human
gcggccctgggattttgctg

SEQ ID NO: 407236 - DNA, 20 bp, human
gacgttgcgcagcgacgcgg

SEQ ID NO: 407237 - DNA, 20 bp, human
gggcctgcgcagacacgatc

SEQ ID NO: 407238 - DNA, 20 bp, human
gggaaccgctcgcagctttt

SEQ ID NO: 407239 - DNA, 20 bp, human
gcaggcccagcagctaagat

SEQ ID NO: 407240 - DNA, 20 bp, human
ggcacggagcttgtctgcgc

SEQ ID NO: 407241 - DNA, 20 bp, human
ggggaaatgtagtctacaac

SEQ ID NO: 407242 - DNA, 20 bp, human
ggctcggtgctgacaggaac

SEQ ID NO: 407243 - DNA, 20 bp, human
ggtgaggccgcccactcacc

SEQ ID NO: 407244 - DNA, 20 bp, human
gctgcgagcggttcccggtg

SEQ ID NO: 407245 - DNA, 20 bp, human
gcggccttgcgcttgcggag

SEQ ID NO: 407246 - DNA, 20 bp, human
gtggcgctgccgcaacgtca

SEQ ID NO: 407247 - DNA, 20 bp, human
gagggcccataggaaaacgg

SEQ ID NO: 407248 - DNA, 20 bp, human
gctcagggcccataggaaaa

SEQ ID NO: 407249 - DNA, 20 bp, human
ggcccataggaaaacggtgg

SEQ ID NO: 407250 - DNA, 20 bp, human
ggtggaggccgtgctggctg

SEQ ID NO: 407251 - DNA, 20 bp, human
gccagacccgtacacgaagt

SEQ ID NO: 407252 - DNA, 20 bp, human
gcgcaacgtcagggctctca

SEQ ID NO: 407253 - DNA, 20 bp, human
gtgcgtgagaccagcagcgc

SEQ ID NO: 407254 - DNA, 20 bp, human
gcgcgcgtcaccaggcgcga

SEQ ID NO: 407255 - DNA, 20 bp, human
gactgaggtcaggactgtca

SEQ ID NO: 407256 - DNA, 20 bp, human
gtggcctggcatactggcat

SEQ ID NO: 407257 - DNA, 20 bp, human
gcaagtcatgtgtcagataa

SEQ ID NO: 407258 - DNA, 20 bp, human
gtatttatgataccatttgc

SEQ ID NO: 407259 - DNA, 20 bp, human
gaaatgtaaaacttttagcc

SEQ ID NO: 407260 - DNA, 20 bp, human
gatgaccttggattagacag

SEQ ID NO: 407261 - DNA, 20 bp, human
ggaaaccactgtctaatcca

SEQ ID NO: 407262 - DNA, 20 bp, human
gtaatttgtctgttttgctt

SEQ ID NO: 407263 - DNA, 20 bp, human
gaaaacttttgtcctgcaaa

SEQ ID NO: 407264 - DNA, 20 bp, human
gcaaatattctttcattttg

SEQ ID NO: 407265 - DNA, 20 bp, human
gaggcccatgccagtatgcc

SEQ ID NO: 407266 - DNA, 20 bp, human
gaaggcaccaccccttgcgt

SEQ ID NO: 407267 - DNA, 20 bp, human
ggggtggtgccttctgagta

SEQ ID NO: 407268 - DNA, 20 bp, human
gccgtgtcctggcccgtcat

SEQ ID NO: 407269 - DNA, 20 bp, human
gaaaaactgccttactcaga

SEQ ID NO: 407270 - DNA, 20 bp, human
ggcggactctaggccaatga

SEQ ID NO: 407271 - DNA, 20 bp, human
gaggacacgggcgatttctg

SEQ ID NO: 407272 - DNA, 20 bp, human
gatgacgtcacgcgacgaag

SEQ ID NO: 407273 - DNA, 20 bp, human
gagggccgccgctttactat

SEQ ID NO: 407274 - DNA, 20 bp, human
gcagcccatgatctcaatcg

SEQ ID NO: 407275 - DNA, 20 bp, human
gtgtgcccatagtaaagcgg

SEQ ID NO: 407276 - DNA, 20 bp, human
ggggctcggcgctgtcatct

SEQ ID NO: 407277 - DNA, 20 bp, human
gaaccagcgtggcccgttta

SEQ ID NO: 407278 - DNA, 20 bp, human
gcagcgtggcccgtttaagg

SEQ ID NO: 407279 - DNA, 20 bp, human
gcgactagcattgtggctta

SEQ ID NO: 407280 - DNA, 20 bp, human
gaggcggcggtcggcgtcca

SEQ ID NO: 407281 - DNA, 20 bp, human
gtccaagcagggcactcccg

SEQ ID NO: 407282 - DNA, 20 bp, human
gtaccggcgcgcggccttct

SEQ ID NO: 407283 - DNA, 20 bp, human
gaccgaagccgagactgtgg

SEQ ID NO: 407284 - DNA, 20 bp, human
gtgacagcgccgagccccat

SEQ ID NO: 407285 - DNA, 20 bp, human
gcggtagccgttgctcccac

SEQ ID NO: 407286 - DNA, 20 bp, human
gaccgccgagtgtgaccctg

SEQ ID NO: 407287 - DNA, 20 bp, human
ggaacccacgcaggaagctg

SEQ ID NO: 407288 - DNA, 20 bp, human
gcaggcgcgcgcgcatccgg

SEQ ID NO: 407289 - DNA, 20 bp, human
ggcctcagggtcacactcgg

SEQ ID NO: 407290 - DNA, 20 bp, human
ggtcccacgctcaagtggcc

SEQ ID NO: 407291 - DNA, 20 bp, human
gggccgggccacttgagcgt

SEQ ID NO: 407292 - DNA, 20 bp, human
gccggcgtgtagtacataat

SEQ ID NO: 407293 - DNA, 20 bp, human
ggaggagaacagacgcctct

SEQ ID NO: 407294 - DNA, 20 bp, human
gtcggcctcagggtcacact

SEQ ID NO: 407295 - DNA, 20 bp, human
gcgtgtgtgtggcactgtga

SEQ ID NO: 407296 - DNA, 20 bp, human
gcgtgctcgcgcatcgtagg

SEQ ID NO: 407297 - DNA, 20 bp, human
gctcgcgcatcgtaggaggg

SEQ ID NO: 407298 - DNA, 20 bp, human
gaggactgaccaacgctcta

SEQ ID NO: 407299 - DNA, 20 bp, human
gcctcgtgctcgcgcatcgt

SEQ ID NO: 407300 - DNA, 20 bp, human
ggagctggtaaacagagtgc

SEQ ID NO: 407301 - DNA, 20 bp, human
gagcctctatccgccatata

SEQ ID NO: 407302 - DNA, 20 bp, human
gttccggcgtcctcttgccg

SEQ ID NO: 407303 - DNA, 20 bp, human
gatggcggatagaggctcag

SEQ ID NO: 407304 - DNA, 20 bp, human
gggctcagtggcaccgtcag

SEQ ID NO: 407305 - DNA, 20 bp, human
gaaccacggcaagaggacgc

SEQ ID NO: 407306 - DNA, 20 bp, human
gaagacactgcagctctcgg

SEQ ID NO: 407307 - DNA, 20 bp, human
gcggaagtcccgccctccga

SEQ ID NO: 407308 - DNA, 20 bp, human
gcgtgcgtgcgcaccgtcgg

SEQ ID NO: 407309 - DNA, 20 bp, human
gtggcactgtcaggggagct

SEQ ID NO: 407310 - DNA, 20 bp, human
gtacccaataaaggcttaga

SEQ ID NO: 407311 - DNA, 20 bp, human
gtctaagacaagtccggaag

SEQ ID NO: 407312 - DNA, 20 bp, human
gcaacgctctaagacaagtc

SEQ ID NO: 407313 - DNA, 20 bp, human
gtccccttctaagcctttat

SEQ ID NO: 407314 - DNA, 20 bp, human
gaaggcccagtggcactgtc

SEQ ID NO: 407315 - DNA, 20 bp, human
gagtccccgactccaaagac

SEQ ID NO: 407316 - DNA, 20 bp, human
ggctcggcgcacagtattct

SEQ ID NO: 407317 - DNA, 20 bp, human
gcggcgcacagtattctggg

SEQ ID NO: 407318 - DNA, 20 bp, human
ggaaaaaacccatcaaacta

SEQ ID NO: 407319 - DNA, 20 bp, human
gcggcggactgcggcgtggt

SEQ ID NO: 407320 - DNA, 20 bp, human
gctgggcaatgattggtcta

SEQ ID NO: 407321 - DNA, 20 bp, human
gctcacagcgcggcggactg

SEQ ID NO: 407322 - DNA, 20 bp, human
gaccaccaccggaaagacgc

SEQ ID NO: 407323 - DNA, 20 bp, human
ggaaagacgccggaagattc

SEQ ID NO: 407324 - DNA, 20 bp, human
gtgggtccgggccaggtaac

SEQ ID NO: 407325 - DNA, 20 bp, human
gctggcgtattgcgcactta

SEQ ID NO: 407326 - DNA, 20 bp, human
gcctcaacgtccctacaagc

SEQ ID NO: 407327 - DNA, 20 bp, human
gggcgtggacgtttgtggtg

SEQ ID NO: 407328 - DNA, 20 bp, human
ggcggagcaagtgtacacac

SEQ ID NO: 407329 - DNA, 20 bp, human
gaagtcccgcccctgtgtcg

SEQ ID NO: 407330 - DNA, 20 bp, human
gtcactgggtcactcagagg

SEQ ID NO: 407331 - DNA, 20 bp, human
gacagtgcctggcgtcaggg

SEQ ID NO: 407332 - DNA, 20 bp, human
gagcggggaacctcgtggca

SEQ ID NO: 407333 - DNA, 20 bp, human
ggcgaccgcgacacaggggc

SEQ ID NO: 407334 - DNA, 20 bp, human
ggcgggacttccggcctcgc

SEQ ID NO: 407335 - DNA, 20 bp, human
gtggcaggcgaccgcgacac

SEQ ID NO: 407336 - DNA, 20 bp, human
gagtgcagagcgcaaaacgg

SEQ ID NO: 407337 - DNA, 20 bp, human
ggcagagcgcaaaacggcgg

SEQ ID NO: 407338 - DNA, 20 bp, human
gaagctcagggtgcccctag

SEQ ID NO: 407339 - DNA, 20 bp, human
gaaaactccacggagctctt

SEQ ID NO: 407340 - DNA, 20 bp, human
gccgtcgcgctgcgcgtgcg

SEQ ID NO: 407341 - DNA, 20 bp, human
gtgcagggaaatggcgactt

SEQ ID NO: 407342 - DNA, 20 bp, human
gaggaggacgccggaagttc

SEQ ID NO: 407343 - DNA, 20 bp, human
gcacactccgaagagctccg

SEQ ID NO: 407344 - DNA, 20 bp, human
gtgtgccccgtgcagggaaa

SEQ ID NO: 407345 - DNA, 20 bp, human
gcgcggaagtgttgctatcc

SEQ ID NO: 407346 - DNA, 20 bp, human
ggtaaagagagagattccca

SEQ ID NO: 407347 - DNA, 20 bp, human
gtgcgcaagtaaggtagagg

SEQ ID NO: 407348 - DNA, 20 bp, human
gcgccaccgtgcgggtcagg

SEQ ID NO: 407349 - DNA, 20 bp, human
gtctgcgtcaaatgacagca

SEQ ID NO: 407350 - DNA, 20 bp, human
ggtgtgcgcaagtaaggtag

SEQ ID NO: 407351 - DNA, 20 bp, human
ggagattcccaggggcgctt

SEQ ID NO: 407352 - DNA, 20 bp, human
gtctttacggccttggaacc

SEQ ID NO: 407353 - DNA, 20 bp, human
ggcgcgccaccgtgcgggtc

SEQ ID NO: 407354 - DNA, 20 bp, human
gggaagcctcctgacccgca

SEQ ID NO: 407355 - DNA, 20 bp, human
gcagtgagagttcacattga

SEQ ID NO: 407356 - DNA, 20 bp, human
ggactccagcgaaccacacg

SEQ ID NO: 407357 - DNA, 20 bp, human
gcaggaccacgatgcccctg

SEQ ID NO: 407358 - DNA, 20 bp, human
gctgttggatccaccccgtg

SEQ ID NO: 407359 - DNA, 20 bp, human
gtgacccaggttggagagtc

SEQ ID NO: 407360 - DNA, 20 bp, human
gtccagcgaaccacacgggg

SEQ ID NO: 407361 - DNA, 20 bp, human
ggcgaaccccacaacacccg

SEQ ID NO: 407362 - DNA, 20 bp, human
gcgcgcgtcggggttggtgg

SEQ ID NO: 407363 - DNA, 20 bp, human
gaacagccgcaggggcatcg

SEQ ID NO: 407364 - DNA, 20 bp, human
gtggagtccccgggtgttgt

SEQ ID NO: 407365 - DNA, 20 bp, human
ggcaagccgccgggaaacga

SEQ ID NO: 407366 - DNA, 20 bp, human
ggggacgcccaatcggaatc

SEQ ID NO: 407367 - DNA, 20 bp, human
ggggaactacccagtcagga

SEQ ID NO: 407368 - DNA, 20 bp, human
gtcccctggcgctgtaaatt

SEQ ID NO: 407369 - DNA, 20 bp, human
gacccagtcaggacgggcgg

SEQ ID NO: 407370 - DNA, 20 bp, human
gccgattgggcgtccctcat

SEQ ID NO: 407371 - DNA, 20 bp, human
ggggaagccgcgcttctgat

SEQ ID NO: 407372 - DNA, 20 bp, human
gctgactgggtagttcccta

SEQ ID NO: 407373 - DNA, 20 bp, human
gtggacagtgctgccaacgt

SEQ ID NO: 407374 - DNA, 20 bp, human
gccgagacaagtatccaatg

SEQ ID NO: 407375 - DNA, 20 bp, human
gctcccgtcactcaccggca

SEQ ID NO: 407376 - DNA, 20 bp, human
gctgaccaaccagaagagga

SEQ ID NO: 407377 - DNA, 20 bp, human
gtgcccaatcaggggagctc

SEQ ID NO: 407378 - DNA, 20 bp, human
gcaagctgaccaaccagaag

SEQ ID NO: 407379 - DNA, 20 bp, human
gaggggagttgggatgtgac

SEQ ID NO: 407380 - DNA, 20 bp, human
gctgcccctcctcttctggt

SEQ ID NO: 407381 - DNA, 20 bp, human
gcccctgagctcccctgatt

SEQ ID NO: 407382 - DNA, 20 bp, human
gcgtggaaacatgaccaatt

SEQ ID NO: 407383 - DNA, 20 bp, human
gccgcccctggggctgtgat

SEQ ID NO: 407384 - DNA, 20 bp, human
gtggagacctgtcaaatcaa

SEQ ID NO: 407385 - DNA, 20 bp, human
gcaattaggaaagctggggt

SEQ ID NO: 407386 - DNA, 20 bp, human
gctggcgcgggtctgtggca

SEQ ID NO: 407387 - DNA, 20 bp, human
gggcggaactagctcttgag

SEQ ID NO: 407388 - DNA, 20 bp, human
gcaggacgaccctgcctccg

SEQ ID NO: 407389 - DNA, 20 bp, human
ggcaccccagcctccggctg

SEQ ID NO: 407390 - DNA, 20 bp, human
gtgacggggaccagttccgg

SEQ ID NO: 407391 - DNA, 20 bp, human
gaggcgggcctgagtgttga

SEQ ID NO: 407392 - DNA, 20 bp, human
gcacctgcagcctgaacccg

SEQ ID NO: 407393 - DNA, 20 bp, human
gccctggctagggacagccg

SEQ ID NO: 407394 - DNA, 20 bp, human
gaggcagggtcgtcctggcg

SEQ ID NO: 407395 - DNA, 20 bp, human
gtggctagggacagccgcgg

SEQ ID NO: 407396 - DNA, 20 bp, human
gtctcggggcggatggtata

SEQ ID NO: 407397 - DNA, 20 bp, human
gcggggcggtaccgtgggag

SEQ ID NO: 407398 - DNA, 20 bp, human
gtgcccaaggctggggttcg

SEQ ID NO: 407399 - DNA, 20 bp, human
ggaagcgcggggcggtaccg

SEQ ID NO: 407400 - DNA, 20 bp, human
gctggagggcgaggctgatt

SEQ ID NO: 407401 - DNA, 20 bp, human
gaaccggctgaggccgtacc

SEQ ID NO: 407402 - DNA, 20 bp, human
gtgcgctgcacgtccccttc

SEQ ID NO: 407403 - DNA, 20 bp, human
gttacccccgctactgcccc

SEQ ID NO: 407404 - DNA, 20 bp, human
ggggtggggcccagttctcg

SEQ ID NO: 407405 - DNA, 20 bp, human
ggagcagagaccagttacag

SEQ ID NO: 407406 - DNA, 20 bp, human
gagcgcaagtgtcaccggta

SEQ ID NO: 407407 - DNA, 20 bp, human
gacacgccgcgcacgcgcaa

SEQ ID NO: 407408 - DNA, 20 bp, human
gcagccacgcgagagtagaa

SEQ ID NO: 407409 - DNA, 20 bp, human
gcaaaggctaggaccaccta

SEQ ID NO: 407410 - DNA, 20 bp, human
gacacttgcgctcttcgggg

SEQ ID NO: 407411 - DNA, 20 bp, human
gcgaagagcgcaagtgtcac

SEQ ID NO: 407412 - DNA, 20 bp, human
gcgggaacgcgctgttaaga

SEQ ID NO: 407413 - DNA, 20 bp, human
ggaacgcgctgttaagatgg

SEQ ID NO: 407414 - DNA, 20 bp, human
gcgcagcagctgatgggccc

SEQ ID NO: 407415 - DNA, 20 bp, human
gaaaaagccgcagcagctga

SEQ ID NO: 407416 - DNA, 20 bp, human
ggcagccgcctcgacccctg

SEQ ID NO: 407417 - DNA, 20 bp, human
gagcctcatagggcccggcg

SEQ ID NO: 407418 - DNA, 20 bp, human
gacacgccgcgcacgcgcaa

SEQ ID NO: 407419 - DNA, 20 bp, human
gcaaaggctaggaccaccta

SEQ ID NO: 407420 - DNA, 20 bp, human
gagcgcaagtgtcaccggta

SEQ ID NO: 407421 - DNA, 20 bp, human
gactcatgaaggttctgttt

SEQ ID NO: 407422 - DNA, 20 bp, human
gacacttgcgctcttcgggg

SEQ ID NO: 407423 - DNA, 20 bp, human
gcgcagcagctgatgggccc

SEQ ID NO: 407424 - DNA, 20 bp, human
gaaaaagccgcagcagctga

SEQ ID NO: 407425 - DNA, 20 bp, human
gcgaagagcgcaagtgtcac

SEQ ID NO: 407426 - DNA, 20 bp, human
gtgggtgcggaggtatcaag

SEQ ID NO: 407427 - DNA, 20 bp, human
gaaaggtgggggttaaatca

SEQ ID NO: 407428 - DNA, 20 bp, human
ggaccaggaaggcgaaacgt

SEQ ID NO: 407429 - DNA, 20 bp, human
gtacctccgcacccacgcgg

SEQ ID NO: 407430 - DNA, 20 bp, human
gcagccccgcccccgggcat

SEQ ID NO: 407431 - DNA, 20 bp, human
gggacaggatggaactcttc

SEQ ID NO: 407432 - DNA, 20 bp, human
gacccagccggtggcttcgg

SEQ ID NO: 407433 - DNA, 20 bp, human
gtgggaccagacccagccgg

SEQ ID NO: 407434 - DNA, 20 bp, human
gaaggggtcggctcagtgcc

SEQ ID NO: 407435 - DNA, 20 bp, human
gtgggcggggcccatgcccg

SEQ ID NO: 407436 - DNA, 20 bp, human
ggggaggggctcgtactcgg

SEQ ID NO: 407437 - DNA, 20 bp, human
gcagacggaactgtgggcga

SEQ ID NO: 407438 - DNA, 20 bp, human
gtactcggggggtgatttag

SEQ ID NO: 407439 - DNA, 20 bp, human
gcccgcccttccagcccgac

SEQ ID NO: 407440 - DNA, 20 bp, human
ggaggggaggggctcgtact

SEQ ID NO: 407441 - DNA, 20 bp, human
gttagaaccgggcctccaga

SEQ ID NO: 407442 - DNA, 20 bp, human
gctggccgggcgaggctcgt

SEQ ID NO: 407443 - DNA, 20 bp, human
gagggacccggcctagccgg

SEQ ID NO: 407444 - DNA, 20 bp, human
gggatgggacgcatccccgg

SEQ ID NO: 407445 - DNA, 20 bp, human
gggtggttcaggtggccggt

SEQ ID NO: 407446 - DNA, 20 bp, human
gtgggtgccggacagtgcct

SEQ ID NO: 407447 - DNA, 20 bp, human
ggggtggggcccatatttgg

SEQ ID NO: 407448 - DNA, 20 bp, human
gtggacggaaccgtgggcga

SEQ ID NO: 407449 - DNA, 20 bp, human
ggtgcccagacgggttggaa

SEQ ID NO: 407450 - DNA, 20 bp, human
ggggccccacccctcgccca

SEQ ID NO: 407451 - DNA, 20 bp, human
gcccgcctttccaacccgtc

SEQ ID NO: 407452 - DNA, 20 bp, human
gccggcctagcccgcgtttc

SEQ ID NO: 407453 - DNA, 20 bp, human
ggacctctggacggaaccgt

SEQ ID NO: 407454 - DNA, 20 bp, human
gctaaaccgcccccaaatat

SEQ ID NO: 407455 - DNA, 20 bp, human
ggtgccaccgccatctttac

SEQ ID NO: 407456 - DNA, 20 bp, human
gacacagtgctgagtcgagc

SEQ ID NO: 407457 - DNA, 20 bp, human
gcaatcagagctatggggcg

SEQ ID NO: 407458 - DNA, 20 bp, human
gaggcgcacggctggcagta

SEQ ID NO: 407459 - DNA, 20 bp, human
gtccaggcacagcccttgac

SEQ ID NO: 407460 - DNA, 20 bp, human
gcccatagctctgattggat

SEQ ID NO: 407461 - DNA, 20 bp, human
gcaggaggaaaaggcagtaa

SEQ ID NO: 407462 - DNA, 20 bp, human
gagcgggatgaacgagttcc

SEQ ID NO: 407463 - DNA, 20 bp, human
gggatcaggacagcacaggg

SEQ ID NO: 407464 - DNA, 20 bp, human
ggtaagggcctgctgagtac

SEQ ID NO: 407465 - DNA, 20 bp, human
gccctatccaatcagagcta

SEQ ID NO: 407466 - DNA, 20 bp, human
gaggaagcccggcccgcgaa

SEQ ID NO: 407467 - DNA, 20 bp, human
gagtgacaggagaagcaatg

SEQ ID NO: 407468 - DNA, 20 bp, human
gcccggcccgcgaagggcag

SEQ ID NO: 407469 - DNA, 20 bp, human
gccccttggtactgagtgac

SEQ ID NO: 407470 - DNA, 20 bp, human
gggagaagcaatgcggtatg

SEQ ID NO: 407471 - DNA, 20 bp, human
ggattcaagtcctgccccct

SEQ ID NO: 407472 - DNA, 20 bp, human
gtaaatgcaaatatcctccc

SEQ ID NO: 407473 - DNA, 20 bp, human
gtgaatcatcacccaatcag

SEQ ID NO: 407474 - DNA, 20 bp, human
gtcctgtcactcagtaccaa

SEQ ID NO: 407475 - DNA, 20 bp, human
ggtaaccttctgtgccgggg

SEQ ID NO: 407476 - DNA, 20 bp, human
gcggaccggggaggttaaag

SEQ ID NO: 407477 - DNA, 20 bp, human
gtggcgcgaaagtaggaggt

SEQ ID NO: 407478 - DNA, 20 bp, human
gaggcggccaagttcgcggg

SEQ ID NO: 407479 - DNA, 20 bp, human
gtcgaccagtaaagcctcaa

SEQ ID NO: 407480 - DNA, 20 bp, human
gccgcgtcgcggagacttct

SEQ ID NO: 407481 - DNA, 20 bp, human
ggccctctccgaagactcgt

SEQ ID NO: 407482 - DNA, 20 bp, human
gcggcccgcctcggtcaccg

SEQ ID NO: 407483 - DNA, 20 bp, human
gcacgtggcgcgaaagtagg

SEQ ID NO: 407484 - DNA, 20 bp, human
gtctcgggtcggtcggaccg

SEQ ID NO: 407485 - DNA, 20 bp, human
gcaggggccgtactgacccg

SEQ ID NO: 407486 - DNA, 20 bp, human
gggcgcgagcggtttgacta

SEQ ID NO: 407487 - DNA, 20 bp, human
ggggggcgatcctttcggcg

SEQ ID NO: 407488 - DNA, 20 bp, human
ggcggggctgacgcaaggcg

SEQ ID NO: 407489 - DNA, 20 bp, human
gcctgaggcgggactccatg

SEQ ID NO: 407490 - DNA, 20 bp, human
gggactccatgaggcctctg

SEQ ID NO: 407491 - DNA, 20 bp, human
gggacaggaattctgacgat

SEQ ID NO: 407492 - DNA, 20 bp, human
ggaggcctctggggcgcgag

SEQ ID NO: 407493 - DNA, 20 bp, human
gcgcctgggggcagtaggac

SEQ ID NO: 407494 - DNA, 20 bp, human
ggggggcagtaggacgggtc

SEQ ID NO: 407495 - DNA, 20 bp, human
ggatcgggaaccatcttgtc

SEQ ID NO: 407496 - DNA, 20 bp, human
gagctcccgggacgcagaca

SEQ ID NO: 407497 - DNA, 20 bp, human
gtggagaaggcgcgcgtagc

SEQ ID NO: 407498 - DNA, 20 bp, human
ggcactatgagaatttggaa

SEQ ID NO: 407499 - DNA, 20 bp, human
gaacgcgccgcggagacacc

SEQ ID NO: 407500 - DNA, 20 bp, human
ggggatgagggcggcgctca

SEQ ID NO: 407501 - DNA, 20 bp, human
ggacgcagacagggtgtgca

SEQ ID NO: 407502 - DNA, 20 bp, human
gaaacgcccggatgtggaga

SEQ ID NO: 407503 - DNA, 20 bp, human
gaaaaccgcccgggcgcctg

SEQ ID NO: 407504 - DNA, 20 bp, human
gatagtgcgtggctgggatg

SEQ ID NO: 407505 - DNA, 20 bp, human
ggcgcgttcctgctgtccac

SEQ ID NO: 407506 - DNA, 20 bp, human
gacggcgacccgcaactccg

SEQ ID NO: 407507 - DNA, 20 bp, human
ggacccgcaactccgaggct

SEQ ID NO: 407508 - DNA, 20 bp, human
gcgcctgggcccacccgaaa

SEQ ID NO: 407509 - DNA, 20 bp, human
gcagccgagcctcggagttg

SEQ ID NO: 407510 - DNA, 20 bp, human
gttgggccgggttccccggg

SEQ ID NO: 407511 - DNA, 20 bp, human
ggggagcagccgtttcgggt

SEQ ID NO: 407512 - DNA, 20 bp, human
gagctgacaggaatcggcgt

SEQ ID NO: 407513 - DNA, 20 bp, human
gtcgccgtagcgctgcgcaa

SEQ ID NO: 407514 - DNA, 20 bp, human
gcaatggagatgagcctccc

SEQ ID NO: 407515 - DNA, 20 bp, human
gtcctgtcagctcctcgcct

SEQ ID NO: 407516 - DNA, 20 bp, human
gcggggaagtagggccgcga

SEQ ID NO: 407517 - DNA, 20 bp, human
ggctccagccgactgtaaga

SEQ ID NO: 407518 - DNA, 20 bp, human
gagggctcacagctccgcgc

SEQ ID NO: 407519 - DNA, 20 bp, human
ggagcccagctctgagagat

SEQ ID NO: 407520 - DNA, 20 bp, human
gaaggtccgtgaaggaagcc

SEQ ID NO: 407521 - DNA, 20 bp, human
gagcagaccacggtgttcca

SEQ ID NO: 407522 - DNA, 20 bp, human
gagagattgggagcgcaact

SEQ ID NO: 407523 - DNA, 20 bp, human
gcctgacagcggctagaaga

SEQ ID NO: 407524 - DNA, 20 bp, human
gctagaatacagcggggtga

SEQ ID NO: 407525 - DNA, 20 bp, human
gcccccgcggctcacccggg

SEQ ID NO: 407526 - DNA, 20 bp, human
gcgaaggccccaggggtgaa

SEQ ID NO: 407527 - DNA, 20 bp, human
gcagagcgttgaaagggcgg

SEQ ID NO: 407528 - DNA, 20 bp, human
gacaccgggaagcggattgc

SEQ ID NO: 407529 - DNA, 20 bp, human
gcgcccccggagcacctgat

SEQ ID NO: 407530 - DNA, 20 bp, human
gggcctcggagctcaggaag

SEQ ID NO: 407531 - DNA, 20 bp, human
gcctcggggcctcggagctc

SEQ ID NO: 407532 - DNA, 20 bp, human
gggcgcgtagccaacgctag

SEQ ID NO: 407533 - DNA, 20 bp, human
gtcactcgggcgacaggagg

SEQ ID NO: 407534 - DNA, 20 bp, human
gtccgctcagagcgttgaaa

SEQ ID NO: 407535 - DNA, 20 bp, human
gaaactgtccaatcaaggca

SEQ ID NO: 407536 - DNA, 20 bp, human
ggcccagcgtcacactacac

SEQ ID NO: 407537 - DNA, 20 bp, human
gcctcccttagcaaccaggg

SEQ ID NO: 407538 - DNA, 20 bp, human
ggccggggagaggccagtgt

SEQ ID NO: 407539 - DNA, 20 bp, human
gcctggcccggtcacaggga

SEQ ID NO: 407540 - DNA, 20 bp, human
gtccccgccctggttgctaa

SEQ ID NO: 407541 - DNA, 20 bp, human
ggcggggagttgagaatcgc

SEQ ID NO: 407542 - DNA, 20 bp, human
gcagcggtgcagctccgcgc

SEQ ID NO: 407543 - DNA, 20 bp, human
gaactcccgcggggtccgct

SEQ ID NO: 407544 - DNA, 20 bp, human
gtctctggaaggccggggag

SEQ ID NO: 407545 - DNA, 20 bp, human
gccgagcctggcccggtcac

SEQ ID NO: 407546 - DNA, 20 bp, human
gcggggaagtagggccgcga

SEQ ID NO: 407547 - DNA, 20 bp, human
gagggctcacagctccgcgc

SEQ ID NO: 407548 - DNA, 20 bp, human
gagcagaccacggtgttcca

SEQ ID NO: 407549 - DNA, 20 bp, human
gcccccgcggctcacccggg

SEQ ID NO: 407550 - DNA, 20 bp, human
ggagcccagctctgagagat

SEQ ID NO: 407551 - DNA, 20 bp, human
gagtgaagccagtcccgccc

SEQ ID NO: 407552 - DNA, 20 bp, human
gagagattgggagcgcaact

SEQ ID NO: 407553 - DNA, 20 bp, human
ggtcccgcccgggtgagccg

SEQ ID NO: 407554 - DNA, 20 bp, human
gaatcggggcctgtgtccgc

SEQ ID NO: 407555 - DNA, 20 bp, human
ggctcccaatctctcagagc

SEQ ID NO: 407556 - DNA, 20 bp, human
gcaggcccagcagctaagat

SEQ ID NO: 407557 - DNA, 20 bp, human
gggcctgcgcagacacgatc

SEQ ID NO: 407558 - DNA, 20 bp, human
gcagcagctaagatcgggtc

SEQ ID NO: 407559 - DNA, 20 bp, human
gcagaacagaacgatccctg

SEQ ID NO: 407560 - DNA, 20 bp, human
gacgttgcgcagcgacgcgg

SEQ ID NO: 407561 - DNA, 20 bp, human
ggggaaatgtagtctacaac

SEQ ID NO: 407562 - DNA, 20 bp, human
ggctcccttgctcgaactgt

SEQ ID NO: 407563 - DNA, 20 bp, human
gggccggatcgtgtctgcgc

SEQ ID NO: 407564 - DNA, 20 bp, human
gggtaggctcggaccatagt

SEQ ID NO: 407565 - DNA, 20 bp, human
gtgcaaaaggctgtcaggta

SEQ ID NO: 407566 - DNA, 20 bp, human
gcctggaccagaaggagcgt

SEQ ID NO: 407567 - DNA, 20 bp, human
gttctggtccaggaccctaa

SEQ ID NO: 407568 - DNA, 20 bp, human
ggtcaggcggcttacgacag

SEQ ID NO: 407569 - DNA, 20 bp, human
gtcccccggcggctttgctg

SEQ ID NO: 407570 - DNA, 20 bp, human
gtcgttgatcttaaccctta

SEQ ID NO: 407571 - DNA, 20 bp, human
gggccccagcaaagccgccg

SEQ ID NO: 407572 - DNA, 20 bp, human
gagttggctggtcacagcac

SEQ ID NO: 407573 - DNA, 20 bp, human
ggctttgctggggccgttct

SEQ ID NO: 407574 - DNA, 20 bp, human
gggttaagatcaacgagagt

SEQ ID NO: 407575 - DNA, 20 bp, human
gccgttctaggaaacagtga

SEQ ID NO: 407576 - DNA, 20 bp, human
gcggtggcttgtgggaaaag

SEQ ID NO: 407577 - DNA, 20 bp, human
gtccacttctcagccttctg

SEQ ID NO: 407578 - DNA, 20 bp, human
gtaaagctccatgaccgcgg

SEQ ID NO: 407579 - DNA, 20 bp, human
ggcgctggcgaagatggctg

SEQ ID NO: 407580 - DNA, 20 bp, human
gtctacactcaaacagcccg

SEQ ID NO: 407581 - DNA, 20 bp, human
gggctcggaaccccaaatcc

SEQ ID NO: 407582 - DNA, 20 bp, human
gtgcaggcaccgccggacgc

SEQ ID NO: 407583 - DNA, 20 bp, human
gatcggttatgagctcccga

SEQ ID NO: 407584 - DNA, 20 bp, human
gtcttcacactcctggtaga

SEQ ID NO: 407585 - DNA, 20 bp, human
ggtgtagagccggtagggga

SEQ ID NO: 407586 - DNA, 20 bp, human
gggcccgagcgggcaatgat

SEQ ID NO: 407587 - DNA, 20 bp, human
ggcgggcactatccacccga

SEQ ID NO: 407588 - DNA, 20 bp, human
gggtgagggaacgacgctaa

SEQ ID NO: 407589 - DNA, 20 bp, human
gggaggaggagcatcctcta

SEQ ID NO: 407590 - DNA, 20 bp, human
ggaggcttgggccaatagtg

SEQ ID NO: 407591 - DNA, 20 bp, human
gccctcaccggtcagccctc

SEQ ID NO: 407592 - DNA, 20 bp, human
gtcccctctggagccgtcgg

SEQ ID NO: 407593 - DNA, 20 bp, human
ggggaacgacgctaaaggat

SEQ ID NO: 407594 - DNA, 20 bp, human
ggggaactctgagcggaggg

SEQ ID NO: 407595 - DNA, 20 bp, human
ggcctccgacggctccagag

SEQ ID NO: 407596 - DNA, 20 bp, human
gggaggccctagaacaactg

SEQ ID NO: 407597 - DNA, 20 bp, human
ggtggatggtgctggagctc

SEQ ID NO: 407598 - DNA, 20 bp, human
gagtaccagtgcctggagtg

SEQ ID NO: 407599 - DNA, 20 bp, human
gacaggggcaggagccttgg

SEQ ID NO: 407600 - DNA, 20 bp, human
gtacgagtgtgtggattgca

SEQ ID NO: 407601 - DNA, 20 bp, human
gaccatccactacgagtgtg

SEQ ID NO: 407602 - DNA, 20 bp, human
ggcactcagagcagacatag

SEQ ID NO: 407603 - DNA, 20 bp, human
gcactcgtagtggatggtgc

SEQ ID NO: 407604 - DNA, 20 bp, human
gccggaggtgcgtctgccgg

SEQ ID NO: 407605 - DNA, 20 bp, human
gctgagtgcaaccagctgta

SEQ ID NO: 407606 - DNA, 20 bp, human
gtcctcccacgctggaccaa

SEQ ID NO: 407607 - DNA, 20 bp, human
gggcgcgcgtccggcgtcgg

SEQ ID NO: 407608 - DNA, 20 bp, human
gcccggcgcgcgtccggcgt

SEQ ID NO: 407609 - DNA, 20 bp, human
gaagcatgcgcagtgcgggc

SEQ ID NO: 407610 - DNA, 20 bp, human
ggactccagtcagccaccgt

SEQ ID NO: 407611 - DNA, 20 bp, human
gcagaaagcatgcgcagtgc

SEQ ID NO: 407612 - DNA, 20 bp, human
gacagaaagtgcaccgccgg

SEQ ID NO: 407613 - DNA, 20 bp, human
gaaagtgcaccgccggtggc

SEQ ID NO: 407614 - DNA, 20 bp, human
gccgccggtggcggggccta

SEQ ID NO: 407615 - DNA, 20 bp, human
gtcgacagaaagtgcaccgc

SEQ ID NO: 407616 - DNA, 20 bp, human
gagaggctcatctggcaaaa

SEQ ID NO: 407617 - DNA, 20 bp, human
gcccagagagaagtgggata

SEQ ID NO: 407618 - DNA, 20 bp, human
gccgggatctcggctccgag

SEQ ID NO: 407619 - DNA, 20 bp, human
gggtgcgactatactactgc

SEQ ID NO: 407620 - DNA, 20 bp, human
gttccaagacacaccccctt

SEQ ID NO: 407621 - DNA, 20 bp, human
gcggtcctcaaaataacggg

SEQ ID NO: 407622 - DNA, 20 bp, human
gaagggcgcggaaaccacgg

SEQ ID NO: 407623 - DNA, 20 bp, human
gtctgcgcaggcgcggcgaa

SEQ ID NO: 407624 - DNA, 20 bp, human
gccctgaggccgccaaagag

SEQ ID NO: 407625 - DNA, 20 bp, human
gaagccttttgcgcatgcgt

SEQ ID NO: 407626 - DNA, 20 bp, human
gacggcagtagggttgaaaa

SEQ ID NO: 407627 - DNA, 20 bp, human
gcgcctgctctacggcagta

SEQ ID NO: 407628 - DNA, 20 bp, human
gagggactccgcctgctcta

SEQ ID NO: 407629 - DNA, 20 bp, human
gcgcccaggggacgcttgct

SEQ ID NO: 407630 - DNA, 20 bp, human
gttcgcgccttaagacaggt

SEQ ID NO: 407631 - DNA, 20 bp, human
gtcagaacctacctgtctta

SEQ ID NO: 407632 - DNA, 20 bp, human
gaaccctactgccgtagagc

SEQ ID NO: 407633 - DNA, 20 bp, human
ggctcccagcaagcgtcccc

SEQ ID NO: 407634 - DNA, 20 bp, human
gtgtcttaaggcgcgaaaag

SEQ ID NO: 407635 - DNA, 20 bp, human
ggcgacactcgcaagtttcg

SEQ ID NO: 407636 - DNA, 20 bp, human
gctgccttcggcctgtctct

SEQ ID NO: 407637 - DNA, 20 bp, human
gaacagacgcgcccagagac

SEQ ID NO: 407638 - DNA, 20 bp, human
gaaacccggaagtgaatcat

SEQ ID NO: 407639 - DNA, 20 bp, human
gcgagacccgagagaagaga

SEQ ID NO: 407640 - DNA, 20 bp, human
gtggctgctggtcaccgata

SEQ ID NO: 407641 - DNA, 20 bp, human
gaccgcgcgcagctgaggcc

SEQ ID NO: 407642 - DNA, 20 bp, human
gacctgggatctctatgaga

SEQ ID NO: 407643 - DNA, 20 bp, human
gccctggcctcagctgcgcg

SEQ ID NO: 407644 - DNA, 20 bp, human
ggaccagcagccaagcagtc

SEQ ID NO: 407645 - DNA, 20 bp, human
gtctatgagagggtcaaagt

SEQ ID NO: 407646 - DNA, 20 bp, human
gaggacgggggacctggaga

SEQ ID NO: 407647 - DNA, 20 bp, human
ggaaaggccaggtttccggg

SEQ ID NO: 407648 - DNA, 20 bp, human
gtggctgggaagccggaagc

SEQ ID NO: 407649 - DNA, 20 bp, human
ggaaggcagcttgcactaca

SEQ ID NO: 407650 - DNA, 20 bp, human
ggccggaagcgggaggacgg

SEQ ID NO: 407651 - DNA, 20 bp, human
gtcccccgtcctcccgcttc

SEQ ID NO: 407652 - DNA, 20 bp, human
gctgggaagccggaagcggg

SEQ ID NO: 407653 - DNA, 20 bp, human
gacagggtcctgtgagggga

SEQ ID NO: 407654 - DNA, 20 bp, human
gtagctggacccagtgttcc

SEQ ID NO: 407655 - DNA, 20 bp, human
gcccccgggctcccagaggg

SEQ ID NO: 407656 - DNA, 20 bp, human
gcccgcagggcgctccgcag

SEQ ID NO: 407657 - DNA, 20 bp, human
gcgggggcgggcgtcttcag

SEQ ID NO: 407658 - DNA, 20 bp, human
gcggcggaatcgttccgttc

SEQ ID NO: 407659 - DNA, 20 bp, human
gctccgcagaggcgaggggt

SEQ ID NO: 407660 - DNA, 20 bp, human
gtcagtggaccccacgcctc

SEQ ID NO: 407661 - DNA, 20 bp, human
ggaagcgcgcgagcccagtg

SEQ ID NO: 407662 - DNA, 20 bp, human
gttccgttcgggaggtggga

SEQ ID NO: 407663 - DNA, 20 bp, human
gacggccgagcaggcagcga

SEQ ID NO: 407664 - DNA, 20 bp, human
ggcctctgcggagcgccctg

SEQ ID NO: 407665 - DNA, 20 bp, human
gcgggggtgcgaggggttgg

SEQ ID NO: 407666 - DNA, 20 bp, human
ggtagcaaggtgcgcgacgc

SEQ ID NO: 407667 - DNA, 20 bp, human
gggagggaatacaacagaga

SEQ ID NO: 407668 - DNA, 20 bp, human
gcgtgccggatgctgaggga

SEQ ID NO: 407669 - DNA, 20 bp, human
gcggccgcagtgacgacttc

SEQ ID NO: 407670 - DNA, 20 bp, human
gctccagcagcttccggatt

SEQ ID NO: 407671 - DNA, 20 bp, human
gtccggattcggagagcagc

SEQ ID NO: 407672 - DNA, 20 bp, human
ggcgccgtgccggatgctga

SEQ ID NO: 407673 - DNA, 20 bp, human
ggagcagcaggaaagcactc

SEQ ID NO: 407674 - DNA, 20 bp, human
gcgcaggaacctttctcttg

SEQ ID NO: 407675 - DNA, 20 bp, human
gtcctgctgctctccgaatc

SEQ ID NO: 407676 - DNA, 20 bp, human
gtacccaagcgaggaagatc

SEQ ID NO: 407677 - DNA, 20 bp, human
ggcaaggaagagcctgaaaa

SEQ ID NO: 407678 - DNA, 20 bp, human
gcgcccgggccgtcgcgaaa

SEQ ID NO: 407679 - DNA, 20 bp, human
gttattgagcaaagggtcgg

SEQ ID NO: 407680 - DNA, 20 bp, human
gagagcctgaaaatggagtg

SEQ ID NO: 407681 - DNA, 20 bp, human
gagaggaaagtacccaagcg

SEQ ID NO: 407682 - DNA, 20 bp, human
gtgcgtgcacgttgggtgct

SEQ ID NO: 407683 - DNA, 20 bp, human
gcacgttgggtgctgggggg

SEQ ID NO: 407684 - DNA, 20 bp, human
gctctggagcggtgaaccgg

SEQ ID NO: 407685 - DNA, 20 bp, human
ggaaccggtggttgtctgcg

SEQ ID NO: 407686 - DNA, 20 bp, human
ggtagcaaggtgcgcgacgc

SEQ ID NO: 407687 - DNA, 20 bp, human
gggagggaatacaacagaga

SEQ ID NO: 407688 - DNA, 20 bp, human
gcgtgccggatgctgaggga

SEQ ID NO: 407689 - DNA, 20 bp, human
gcggccgcagtgacgacttc

SEQ ID NO: 407690 - DNA, 20 bp, human
gctccagcagcttccggatt

SEQ ID NO: 407691 - DNA, 20 bp, human
gtccggattcggagagcagc

SEQ ID NO: 407692 - DNA, 20 bp, human
ggcgccgtgccggatgctga

SEQ ID NO: 407693 - DNA, 20 bp, human
ggagcagcaggaaagcactc

SEQ ID NO: 407694 - DNA, 20 bp, human
gcgcaggaacctttctcttg

SEQ ID NO: 407695 - DNA, 20 bp, human
gtcctgctgctctccgaatc

SEQ ID NO: 407696 - DNA, 20 bp, human
ggaccccaggaagcaaccca

SEQ ID NO: 407697 - DNA, 20 bp, human
gagtccctgggttgcttcct

SEQ ID NO: 407698 - DNA, 20 bp, human
ggtgcctgcgcagtgcgcgg

SEQ ID NO: 407699 - DNA, 20 bp, human
gggcgtgcctgcgcagtgcg

SEQ ID NO: 407700 - DNA, 20 bp, human
gcgagatccggcttcaaggc

SEQ ID NO: 407701 - DNA, 20 bp, human
gcggatctcgcgatgtttca

SEQ ID NO: 407702 - DNA, 20 bp, human
gagcagcccggccttgaagc

SEQ ID NO: 407703 - DNA, 20 bp, human
ggcgcaggcacgcctgcgtc

SEQ ID NO: 407704 - DNA, 20 bp, human
gccctatcatggcgcagcat

SEQ ID NO: 407705 - DNA, 20 bp, human
gttcagggtgagccggacgc

SEQ ID NO: 407706 - DNA, 20 bp, human
gggaacgggtggaacgggtg

SEQ ID NO: 407707 - DNA, 20 bp, human
ggcgcctgcgcaggtggaac

SEQ ID NO: 407708 - DNA, 20 bp, human
gcaggtggaacgggtggaac

SEQ ID NO: 407709 - DNA, 20 bp, human
gtctgaaggccagcggaggt

SEQ ID NO: 407710 - DNA, 20 bp, human
gcgcgtgcgcctcaccgcgc

SEQ ID NO: 407711 - DNA, 20 bp, human
gcctgcgcaggtggaacggg

SEQ ID NO: 407712 - DNA, 20 bp, human
ggcccctgcggcctgcccta

SEQ ID NO: 407713 - DNA, 20 bp, human
gagcggaggtgggcttacta

SEQ ID NO: 407714 - DNA, 20 bp, human
gcgtccgcgctccagcgctc

SEQ ID NO: 407715 - DNA, 20 bp, human
ggcagaggatgctgggatgt

SEQ ID NO: 407716 - DNA, 20 bp, human
gacgtggggccgttcagact

SEQ ID NO: 407717 - DNA, 20 bp, human
ggccaatggcggcccaggaa

SEQ ID NO: 407718 - DNA, 20 bp, human
gtctgaacggccccacgtcg

SEQ ID NO: 407719 - DNA, 20 bp, human
gggaagccccgccccacgca

SEQ ID NO: 407720 - DNA, 20 bp, human
gcccgaacgttcccgttcct

SEQ ID NO: 407721 - DNA, 20 bp, human
ggcccaggaacgggaacgtt

SEQ ID NO: 407722 - DNA, 20 bp, human
ggcgccctcccttatcgcct

SEQ ID NO: 407723 - DNA, 20 bp, human
gggtccgcagaaacgaacga

SEQ ID NO: 407724 - DNA, 20 bp, human
gcccacgtcgaggctcctta

SEQ ID NO: 407725 - DNA, 20 bp, human
ggggatcattgggcggtggg

SEQ ID NO: 407726 - DNA, 20 bp, human
ggggcgcagacacagcgcac

SEQ ID NO: 407727 - DNA, 20 bp, human
gtccgtaatgtggcgctgtc

SEQ ID NO: 407728 - DNA, 20 bp, human
ggcgcggccatgttctctgc

SEQ ID NO: 407729 - DNA, 20 bp, human
gggccaattcctctgctcta

SEQ ID NO: 407730 - DNA, 20 bp, human
ggccggacagcgccacatta

SEQ ID NO: 407731 - DNA, 20 bp, human
ggaggcaggtatagttacat

SEQ ID NO: 407732 - DNA, 20 bp, human
gcgctgtccggcagagaaca

SEQ ID NO: 407733 - DNA, 20 bp, human
ggcgcacaggttccgtaatg

SEQ ID NO: 407734 - DNA, 20 bp, human
ggagcagaggaattggccgc

SEQ ID NO: 407735 - DNA, 20 bp, human
ggcgccctgttgactgttcg

SEQ ID NO: 407736 - DNA, 20 bp, human
gttccgtaatcggcgctcac

SEQ ID NO: 407737 - DNA, 20 bp, human
gtgcccgtgagcgccgatta

SEQ ID NO: 407738 - DNA, 20 bp, human
gggcggactcctccactgta

SEQ ID NO: 407739 - DNA, 20 bp, human
gaatcgatacgcatcaaaga

SEQ ID NO: 407740 - DNA, 20 bp, human
ggttgactgtgggctgaaat

SEQ ID NO: 407741 - DNA, 20 bp, human
gtggagtgttgactagagta

SEQ ID NO: 407742 - DNA, 20 bp, human
gtatcgattccgtacagtgg

SEQ ID NO: 407743 - DNA, 20 bp, human
ggtgtgctccctgttgactg

SEQ ID NO: 407744 - DNA, 20 bp, human
gatcaacagtccataagggg

SEQ ID NO: 407745 - DNA, 20 bp, human
gggtacaagcgtggtcacac

SEQ ID NO: 407746 - DNA, 20 bp, human
ggccctgcgaaatggtaacg

SEQ ID NO: 407747 - DNA, 20 bp, human
gactccaggtccagatgcgg

SEQ ID NO: 407748 - DNA, 20 bp, human
gggggcaagctccactgcga

SEQ ID NO: 407749 - DNA, 20 bp, human
gacatgggcagcgcttaagg

SEQ ID NO: 407750 - DNA, 20 bp, human
ggcgactccaggtccagatg

SEQ ID NO: 407751 - DNA, 20 bp, human
ggctaggacgccggaagtcc

SEQ ID NO: 407752 - DNA, 20 bp, human
gcagacatgggcagcgctta

SEQ ID NO: 407753 - DNA, 20 bp, human
ggccacgttaccatttcgca

SEQ ID NO: 407754 - DNA, 20 bp, human
gagaagccgtgccattgccg

SEQ ID NO: 407755 - DNA, 20 bp, human
ggctgccacggctaggacgc

SEQ ID NO: 407756 - DNA, 20 bp, human
gatgttgtgtcatggaaagt

SEQ ID NO: 407757 - DNA, 20 bp, human
gtggtaaccatgttgtgtca

SEQ ID NO: 407758 - DNA, 20 bp, human
gcggctgtgtatcggcgatg

SEQ ID NO: 407759 - DNA, 20 bp, human
gcagaccatgttacattctg

SEQ ID NO: 407760 - DNA, 20 bp, human
gacctgtattactctagctg

SEQ ID NO: 407761 - DNA, 20 bp, human
gtccaagcctttgtacctat

SEQ ID NO: 407762 - DNA, 20 bp, human
gcctgctcacacctcaaagg

SEQ ID NO: 407763 - DNA, 20 bp, human
gcatcaactgtgggtggagc

SEQ ID NO: 407764 - DNA, 20 bp, human
gcttgcaactagcgccttct

SEQ ID NO: 407765 - DNA, 20 bp, human
gaggccagggagtactgggt

SEQ ID NO: 407766 - DNA, 20 bp, human
gtccgcatggaatgacagag

SEQ ID NO: 407767 - DNA, 20 bp, human
gagtcagggcgcatatctta

SEQ ID NO: 407768 - DNA, 20 bp, human
gtatcttaaggatactcctg

SEQ ID NO: 407769 - DNA, 20 bp, human
gttacccagaaaactccgca

SEQ ID NO: 407770 - DNA, 20 bp, human
gattccatgcggagttttct

SEQ ID NO: 407771 - DNA, 20 bp, human
gatactcctgaggtggagct

SEQ ID NO: 407772 - DNA, 20 bp, human
gcttaaggatactcctgagg

SEQ ID NO: 407773 - DNA, 20 bp, human
gagggcacaattcccagagg

SEQ ID NO: 407774 - DNA, 20 bp, human
gagcatgtgaggaccttcac

SEQ ID NO: 407775 - DNA, 20 bp, human
gtgagagatacccataggta

SEQ ID NO: 407776 - DNA, 20 bp, human
gtagttctcggggcgaaatg

SEQ ID NO: 407777 - DNA, 20 bp, human
gtgaccttctaggtccccct

SEQ ID NO: 407778 - DNA, 20 bp, human
ggcgaaatgcggcttgtgca

SEQ ID NO: 407779 - DNA, 20 bp, human
gtgccgggaagcgtagttct

SEQ ID NO: 407780 - DNA, 20 bp, human
gcccctcggccgcaatattt

SEQ ID NO: 407781 - DNA, 20 bp, human
gaccccaaatattgcggccg

SEQ ID NO: 407782 - DNA, 20 bp, human
gccccgagaactacgcttcc

SEQ ID NO: 407783 - DNA, 20 bp, human
gggtgaagtgcgtcaccgcg

SEQ ID NO: 407784 - DNA, 20 bp, human
gttggggttgtgcttaccac

SEQ ID NO: 407785 - DNA, 20 bp, human
gagcacaaccccaaatattg

SEQ ID NO: 407786 - DNA, 20 bp, human
gacgacggcggcggcgggta

SEQ ID NO: 407787 - DNA, 20 bp, human
ggacaagaggcccaggtcgc

SEQ ID NO: 407788 - DNA, 20 bp, human
gccctccaccgcaccgtcct

SEQ ID NO: 407789 - DNA, 20 bp, human
gctgccccgaggcgcgtcag

SEQ ID NO: 407790 - DNA, 20 bp, human
gccgcgcagcccgcctcggg

SEQ ID NO: 407791 - DNA, 20 bp, human
gccaccgcaccgtcctgggc

SEQ ID NO: 407792 - DNA, 20 bp, human
ggctgcctgcccgaccgcac

SEQ ID NO: 407793 - DNA, 20 bp, human
gcggaaggcgactcggacct

SEQ ID NO: 407794 - DNA, 20 bp, human
gcgcggcgcaggcccggcga

SEQ ID NO: 407795 - DNA, 20 bp, human
gcctacgcagctgtctcgcc

SEQ ID NO: 407796 - DNA, 20 bp, human
ggctcggtcactgacgtcga

SEQ ID NO: 407797 - DNA, 20 bp, human
gcggggccatgcccttcagt

SEQ ID NO: 407798 - DNA, 20 bp, human
gcagaagtgtgcccactgaa

SEQ ID NO: 407799 - DNA, 20 bp, human
ggacgtcagtgaccgagctc

SEQ ID NO: 407800 - DNA, 20 bp, human
gtcagtgaccgagctcagga

SEQ ID NO: 407801 - DNA, 20 bp, human
gtgggagcccgtcctgagct

SEQ ID NO: 407802 - DNA, 20 bp, human
ggacgtcatcagaggcggtc

SEQ ID NO: 407803 - DNA, 20 bp, human
gagagtgacgtcatcagagg

SEQ ID NO: 407804 - DNA, 20 bp, human
ggtggcctgacgtagctgat

SEQ ID NO: 407805 - DNA, 20 bp, human
gtacgtcaggccacgccggg

SEQ ID NO: 407806 - DNA, 20 bp, human
gtcccctggccgtctcccac

SEQ ID NO: 407807 - DNA, 20 bp, human
ggagctacgccagcgccgac

SEQ ID NO: 407808 - DNA, 20 bp, human
gaggagacacctgatccggt

SEQ ID NO: 407809 - DNA, 20 bp, human
gccagcgccgactggcgtcg

SEQ ID NO: 407810 - DNA, 20 bp, human
gccgcccagccgtcccccgt

SEQ ID NO: 407811 - DNA, 20 bp, human
ggcggagtctgacttccgga

SEQ ID NO: 407812 - DNA, 20 bp, human
gggccgtctcccaccggatc

SEQ ID NO: 407813 - DNA, 20 bp, human
gactcctccacgacgccagt

SEQ ID NO: 407814 - DNA, 20 bp, human
gtgggcggggcgcggactgg

SEQ ID NO: 407815 - DNA, 20 bp, human
gcacctgatccggtgggaga

SEQ ID NO: 407816 - DNA, 20 bp, human
ggggctgcgtcaggccaagc

SEQ ID NO: 407817 - DNA, 20 bp, human
gaaggcccgagggcggggat

SEQ ID NO: 407818 - DNA, 20 bp, human
gctgatgtggcaagagtgac

SEQ ID NO: 407819 - DNA, 20 bp, human
gagagaaagccccgcctgaa

SEQ ID NO: 407820 - DNA, 20 bp, human
gaacacccctgggctgcgtc

SEQ ID NO: 407821 - DNA, 20 bp, human
ggtggcaagagtgacaggct

SEQ ID NO: 407822 - DNA, 20 bp, human
ggttactcaaggcccgaggg

SEQ ID NO: 407823 - DNA, 20 bp, human
gctggcgcggcgttttcctc

SEQ ID NO: 407824 - DNA, 20 bp, human
gcccgcctgaaagggcctgg

SEQ ID NO: 407825 - DNA, 20 bp, human
gaggttaaaaaaaacacccc

SEQ ID NO: 407826 - DNA, 20 bp, human
ggaactagttgtgacttatg

SEQ ID NO: 407827 - DNA, 20 bp, human
ggaaacttaacaggatctgt

SEQ ID NO: 407828 - DNA, 20 bp, human
gtaccaaaaccaagcaaagc

SEQ ID NO: 407829 - DNA, 20 bp, human
ggtcacacaagaaacttaac

SEQ ID NO: 407830 - DNA, 20 bp, human
gtgtgacttatggggctgac

SEQ ID NO: 407831 - DNA, 20 bp, human
gaactgccatgtgatcctac

SEQ ID NO: 407832 - DNA, 20 bp, human
gcacgtctcattaaagtaac

SEQ ID NO: 407833 - DNA, 20 bp, human
gttgcagcaacaaaaattgc

SEQ ID NO: 407834 - DNA, 20 bp, human
gcttgtgtgacattacagtg

SEQ ID NO: 407835 - DNA, 20 bp, human
gtcacaggacctgctttgct

SEQ ID NO: 407836 - DNA, 20 bp, human
gcctcccctccctgcacgta

SEQ ID NO: 407837 - DNA, 20 bp, human
gaacggattctccggagccg

SEQ ID NO: 407838 - DNA, 20 bp, human
gaaaaggcggggccgggccg

SEQ ID NO: 407839 - DNA, 20 bp, human
gcccgagcggacctcggctc

SEQ ID NO: 407840 - DNA, 20 bp, human
ggacccggaaacggattctc

SEQ ID NO: 407841 - DNA, 20 bp, human
ggggcccgtacgtgcaggga

SEQ ID NO: 407842 - DNA, 20 bp, human
gggcggggcccgtacgtgca

SEQ ID NO: 407843 - DNA, 20 bp, human
gtgaaagcgcgtgtctgcgt

SEQ ID NO: 407844 - DNA, 20 bp, human
gccagaaacgcgcgcagcgg

SEQ ID NO: 407845 - DNA, 20 bp, human
gtgtctgcgtcgggttctgt

SEQ ID NO: 407846 - DNA, 20 bp, human
gcaaacaggcccggagctca

SEQ ID NO: 407847 - DNA, 20 bp, human
gccgccagcggaagcggaaa

SEQ ID NO: 407848 - DNA, 20 bp, human
gcccagtggctacaggtcct

SEQ ID NO: 407849 - DNA, 20 bp, human
gggctacaggtcctcggtta

SEQ ID NO: 407850 - DNA, 20 bp, human
gaagggcaggatggcggaga

SEQ ID NO: 407851 - DNA, 20 bp, human
ggcagctgcccagtggctac

SEQ ID NO: 407852 - DNA, 20 bp, human
gcctgctgaagtagagtctt

SEQ ID NO: 407853 - DNA, 20 bp, human
gaccgaggacctgtagccac

SEQ ID NO: 407854 - DNA, 20 bp, human
gtggtcgaagttctcccgaa

SEQ ID NO: 407855 - DNA, 20 bp, human
gctcggttaaggtgttcaat

SEQ ID NO: 407856 - DNA, 20 bp, human
ggtgtcacgtcaacactcgc

SEQ ID NO: 407857 - DNA, 20 bp, human
gagtgttgacgtgacacgcg

SEQ ID NO: 407858 - DNA, 20 bp, human
gccttcgagcggtcggctca

SEQ ID NO: 407859 - DNA, 20 bp, human
gctcgccgggctccacgaac

SEQ ID NO: 407860 - DNA, 20 bp, human
gggtagagcggcctctatca

SEQ ID NO: 407861 - DNA, 20 bp, human
gggccgcgcggaccttcgag

SEQ ID NO: 407862 - DNA, 20 bp, human
ggcgcggaccttcgagcggt

SEQ ID NO: 407863 - DNA, 20 bp, human
gagcgcggcgccggctagag

SEQ ID NO: 407864 - DNA, 20 bp, human
ggaaggtccgcgcggccacg

SEQ ID NO: 407865 - DNA, 20 bp, human
gcgtgacacgcgtggcccag

SEQ ID NO: 407866 - DNA, 20 bp, human
gcctctgcgccttccgtcta

SEQ ID NO: 407867 - DNA, 20 bp, human
gaccccaagccatagacgga

SEQ ID NO: 407868 - DNA, 20 bp, human
gcagaggggcgttcccgtag

SEQ ID NO: 407869 - DNA, 20 bp, human
gacggaatccgggtggtacc

SEQ ID NO: 407870 - DNA, 20 bp, human
gtagtttgacggaatccggg

SEQ ID NO: 407871 - DNA, 20 bp, human
gagaacagaaagtgcgctcc

SEQ ID NO: 407872 - DNA, 20 bp, human
gtcggtgaggcggcttctca

SEQ ID NO: 407873 - DNA, 20 bp, human
gtctcaaggctcccaagaaa

SEQ ID NO: 407874 - DNA, 20 bp, human
gcccagaaggcagtgctaca

SEQ ID NO: 407875 - DNA, 20 bp, human
ggtgcgctccaggtaccacc

SEQ ID NO: 407876 - DNA, 20 bp, human
gaacagaggcgctgagtgcg

SEQ ID NO: 407877 - DNA, 20 bp, human
ggggcaggttggctggacct

SEQ ID NO: 407878 - DNA, 20 bp, human
gccaaaaactcgaaaaacag

SEQ ID NO: 407879 - DNA, 20 bp, human
gcaggttggctggacctggg

SEQ ID NO: 407880 - DNA, 20 bp, human
ggagtttttggaggcgacag

SEQ ID NO: 407881 - DNA, 20 bp, human
gtcctgggcgcgcacaaacc

SEQ ID NO: 407882 - DNA, 20 bp, human
gtccgggtttgtgcgcgccc

SEQ ID NO: 407883 - DNA, 20 bp, human
gaagccaggccggggcaggt

SEQ ID NO: 407884 - DNA, 20 bp, human
ggtgcgaggctgagaagcac

SEQ ID NO: 407885 - DNA, 20 bp, human
gggagaatccctgaacctgg

SEQ ID NO: 407886 - DNA, 20 bp, human
gccttggcggctaactgggg

SEQ ID NO: 407887 - DNA, 20 bp, human
ggcggccctgcgaggtccga

SEQ ID NO: 407888 - DNA, 20 bp, human
gggcggacacggcccgatcg

SEQ ID NO: 407889 - DNA, 20 bp, human
gtggaactacacttcccggg

SEQ ID NO: 407890 - DNA, 20 bp, human
ggccccttggcggctaactg

SEQ ID NO: 407891 - DNA, 20 bp, human
ggtaagggagcgtgcagcgg

SEQ ID NO: 407892 - DNA, 20 bp, human
ggcggggtcaccgcgatccc

SEQ ID NO: 407893 - DNA, 20 bp, human
ggccaaggggcttttccaac

SEQ ID NO: 407894 - DNA, 20 bp, human
ggtgcaccgccgagcccccc

SEQ ID NO: 407895 - DNA, 20 bp, human
gggctcggcggtgcacccgc

SEQ ID NO: 407896 - DNA, 20 bp, human
ggggagctgtagttccaggc

SEQ ID NO: 407897 - DNA, 20 bp, human
gcggcgccgctgcccgacgc

SEQ ID NO: 407898 - DNA, 20 bp, human
gaagcagccgccattgtccg

SEQ ID NO: 407899 - DNA, 20 bp, human
ggcctcgccctgcctgggcg

SEQ ID NO: 407900 - DNA, 20 bp, human
ggccgccatgacaggttcct

SEQ ID NO: 407901 - DNA, 20 bp, human
ggggagaggcggcgtcaggg

SEQ ID NO: 407902 - DNA, 20 bp, human
ggcagcggcgccgccatgac

SEQ ID NO: 407903 - DNA, 20 bp, human
gacggtggaggagggtggtc

SEQ ID NO: 407904 - DNA, 20 bp, human
ggtcgcctcccactgcaaaa

SEQ ID NO: 407905 - DNA, 20 bp, human
gcccccaagccccgcagcta

SEQ ID NO: 407906 - DNA, 20 bp, human
gcagcaggtgatcccttccg

SEQ ID NO: 407907 - DNA, 20 bp, human
ggatccaggtagcctcggaa

SEQ ID NO: 407908 - DNA, 20 bp, human
gcgttcttagggccagtagg

SEQ ID NO: 407909 - DNA, 20 bp, human
gtggggcgccgaaaccctca

SEQ ID NO: 407910 - DNA, 20 bp, human
ggaagggatcacctgctgga

SEQ ID NO: 407911 - DNA, 20 bp, human
ggcccctggcctgaggctta

SEQ ID NO: 407912 - DNA, 20 bp, human
gtctacctcaggagccatga

SEQ ID NO: 407913 - DNA, 20 bp, human
gtgcgcagatcggccactac

SEQ ID NO: 407914 - DNA, 20 bp, human
gggtgtgagctcctcagggt

SEQ ID NO: 407915 - DNA, 20 bp, human
ggccactcccagaagtctcc

SEQ ID NO: 407916 - DNA, 20 bp, human
gtcctagtatagctcccgag

SEQ ID NO: 407917 - DNA, 20 bp, human
gccacttcccgactaacagg

SEQ ID NO: 407918 - DNA, 20 bp, human
gaagggtgggatgagaaact

SEQ ID NO: 407919 - DNA, 20 bp, human
gagggaaaaactcccgaaaa

SEQ ID NO: 407920 - DNA, 20 bp, human
gtcgggataaattagtgaaa

SEQ ID NO: 407921 - DNA, 20 bp, human
gcggggggcttggggcggtg

SEQ ID NO: 407922 - DNA, 20 bp, human
gtcccctcgggagctatact

SEQ ID NO: 407923 - DNA, 20 bp, human
gaaatcaaatctgtcaggac

SEQ ID NO: 407924 - DNA, 20 bp, human
gtatcgaattaccacatgac

SEQ ID NO: 407925 - DNA, 20 bp, human
gcagaggattccactcccct

SEQ ID NO: 407926 - DNA, 20 bp, human
gtgaaactgggctctctcat

SEQ ID NO: 407927 - DNA, 20 bp, human
gttctcttggctactgtagg

SEQ ID NO: 407928 - DNA, 20 bp, human
gacacactgagagcgggtgg

SEQ ID NO: 407929 - DNA, 20 bp, human
gtgattggcccgatgcgaaa

SEQ ID NO: 407930 - DNA, 20 bp, human
gagcgcgtagcgaagagaaa

SEQ ID NO: 407931 - DNA, 20 bp, human
gggctgcgaggagaggatgt

SEQ ID NO: 407932 - DNA, 20 bp, human
ggagcagcttttatgaaact

SEQ ID NO: 407933 - DNA, 20 bp, human
gtaaaacacacactgagagc

SEQ ID NO: 407934 - DNA, 20 bp, human
gggaacctcccgcagtaaga

SEQ ID NO: 407935 - DNA, 20 bp, human
gaagtccctttcaggtatag

SEQ ID NO: 407936 - DNA, 20 bp, human
gttcccctagggagatggag

SEQ ID NO: 407937 - DNA, 20 bp, human
gaaaaacagacccttcctat

SEQ ID NO: 407938 - DNA, 20 bp, human
gcaattgcccagagattcca

SEQ ID NO: 407939 - DNA, 20 bp, human
gttcccactccatctcccta

SEQ ID NO: 407940 - DNA, 20 bp, human
gtccatggtaagtcttaact

SEQ ID NO: 407941 - DNA, 20 bp, human
gagtgggaaattaactctag

SEQ ID NO: 407942 - DNA, 20 bp, human
gggaagggtctgtttttgtg

SEQ ID NO: 407943 - DNA, 20 bp, human
gtatgatagccccataggaa

SEQ ID NO: 407944 - DNA, 20 bp, human
gccttaggtccaatgtaact

SEQ ID NO: 407945 - DNA, 20 bp, human
gttgggaaggaaaagtctta

SEQ ID NO: 407946 - DNA, 20 bp, human
ggcactggaggcgtggccta

SEQ ID NO: 407947 - DNA, 20 bp, human
gcatagagagcggaccggga

SEQ ID NO: 407948 - DNA, 20 bp, human
gagagcggaccgggacggga

SEQ ID NO: 407949 - DNA, 20 bp, human
ggcgcgcgcagcatagagag

SEQ ID NO: 407950 - DNA, 20 bp, human
ggcagcatagagagcggacc

SEQ ID NO: 407951 - DNA, 20 bp, human
gagcaaagcaacgtcagttg

SEQ ID NO: 407952 - DNA, 20 bp, human
gagcggatcgcgtgggtaga

SEQ ID NO: 407953 - DNA, 20 bp, human
gccgggttttgctggcagtg

SEQ ID NO: 407954 - DNA, 20 bp, human
ggcaggatcccagtttgcag

SEQ ID NO: 407955 - DNA, 20 bp, human
gtcagttgaggattagatcc

SEQ ID NO: 407956 - DNA, 20 bp, human
gtacctcccacttcccgccc

SEQ ID NO: 407957 - DNA, 20 bp, human
gtctctctctccctgatcac

SEQ ID NO: 407958 - DNA, 20 bp, human
gaaccaggcctggatccgcc

SEQ ID NO: 407959 - DNA, 20 bp, human
gggccaggcggatccaggcc

SEQ ID NO: 407960 - DNA, 20 bp, human
ggtttaggccaggcggatcc

SEQ ID NO: 407961 - DNA, 20 bp, human
gcgtctctgttttcaggttt

SEQ ID NO: 407962 - DNA, 20 bp, human
gcgggaagtgggaggtaggc

SEQ ID NO: 407963 - DNA, 20 bp, human
gtcccagcgtctctgttttc

SEQ ID NO: 407964 - DNA, 20 bp, human
ggtgggaggtaggcggggcc

SEQ ID NO: 407965 - DNA, 20 bp, human
gtgactgattgagcaagcaa

SEQ ID NO: 407966 - DNA, 20 bp, human
gcctccaagccggcctacgg

SEQ ID NO: 407967 - DNA, 20 bp, human
ggaggaaggtctgaagttgc

SEQ ID NO: 407968 - DNA, 20 bp, human
gtgtacggagcacggacgac

SEQ ID NO: 407969 - DNA, 20 bp, human
gctctcgtcacggatactgg

SEQ ID NO: 407970 - DNA, 20 bp, human
gagttcgcgtcctctcgtca

SEQ ID NO: 407971 - DNA, 20 bp, human
ggcgctatccctgaatactt

SEQ ID NO: 407972 - DNA, 20 bp, human
gtgaatcctgcacgtacgga

SEQ ID NO: 407973 - DNA, 20 bp, human
ggtctgaagttgcaggtgta

SEQ ID NO: 407974 - DNA, 20 bp, human
gttcctcggccgccgtaggc

SEQ ID NO: 407975 - DNA, 20 bp, human
ggttgcaggtgtacggagca

SEQ ID NO: 407976 - DNA, 20 bp, human
ggcagcgtttctgacaggag

SEQ ID NO: 407977 - DNA, 20 bp, human
gcgccgctctatgaggtcac

SEQ ID NO: 407978 - DNA, 20 bp, human
gctgacaggagcggccataa

SEQ ID NO: 407979 - DNA, 20 bp, human
gagtctgaactcgcgatccc

SEQ ID NO: 407980 - DNA, 20 bp, human
ggaggaaggcagcagccgta

SEQ ID NO: 407981 - DNA, 20 bp, human
gtgaactcgcgatcccgggc

SEQ ID NO: 407982 - DNA, 20 bp, human
gcctgtcagaaacgctgcga

SEQ ID NO: 407983 - DNA, 20 bp, human
gctgctgccttcctctaaga

SEQ ID NO: 407984 - DNA, 20 bp, human
ggcccatggtgctccagcta

SEQ ID NO: 407985 - DNA, 20 bp, human
gtgaagcgaggcgaggacca

SEQ ID NO: 407986 - DNA, 20 bp, human
gggtgaccgggggtgaccgg

SEQ ID NO: 407987 - DNA, 20 bp, human
gttttggcgctggtgaccgg

SEQ ID NO: 407988 - DNA, 20 bp, human
gaaagggcgcgttttggcgc

SEQ ID NO: 407989 - DNA, 20 bp, human
gctgacgtacacaaggcaaa

SEQ ID NO: 407990 - DNA, 20 bp, human
gaatacgggtccatatacag

SEQ ID NO: 407991 - DNA, 20 bp, human
gggttgaggtgccaggaaat

SEQ ID NO: 407992 - DNA, 20 bp, human
ggcgttttggcgctggtgac

SEQ ID NO: 407993 - DNA, 20 bp, human
gcgtttgcgcagatgcaaga

SEQ ID NO: 407994 - DNA, 20 bp, human
gtatggacccgtatttatga

SEQ ID NO: 407995 - DNA, 20 bp, human
gcgtcgccttggctccatgg

SEQ ID NO: 407996 - DNA, 20 bp, human
ggcagtgggcgtggctaggt

SEQ ID NO: 407997 - DNA, 20 bp, human
gggagccgcggcggaggatg

SEQ ID NO: 407998 - DNA, 20 bp, human
gagccgcgaccagcaagggg

SEQ ID NO: 407999 - DNA, 20 bp, human
gggcgagccgcgaccagcaa

SEQ ID NO: 408000 - DNA, 20 bp, human
gaggggcgggtcggaaagag

SEQ ID NO: 408001 - DNA, 20 bp, human
ggaaagaggggcctgactcg

SEQ ID NO: 408002 - DNA, 20 bp, human
ggccacgcccactgccgctc

SEQ ID NO: 408003 - DNA, 20 bp, human
ggatggggcggggtttcatg

SEQ ID NO: 408004 - DNA, 20 bp, human
ggcccggctccaccctctca

SEQ ID NO: 408005 - DNA, 20 bp, human
gcggggtttcatggggtaag

SEQ ID NO: 408006 - DNA, 20 bp, human
gcccgcgaggggcggctcgg

SEQ ID NO: 408007 - DNA, 20 bp, human
ggccgccgagccgcccctcg

SEQ ID NO: 408008 - DNA, 20 bp, human
gcggaacgcaagaggttaat

SEQ ID NO: 408009 - DNA, 20 bp, human
gtcagggagccggctctcgg

SEQ ID NO: 408010 - DNA, 20 bp, human
gcgggtgtgccgcggcactg

SEQ ID NO: 408011 - DNA, 20 bp, human
gctggggctggcggacggga

SEQ ID NO: 408012 - DNA, 20 bp, human
gcgcgctgccggcctccgcg

SEQ ID NO: 408013 - DNA, 20 bp, human
gggcactggggctggcggac

SEQ ID NO: 408014 - DNA, 20 bp, human
gggcgggcgcgcccctggac

SEQ ID NO: 408015 - DNA, 20 bp, human
gggcgcgggaaagtttgggg

SEQ ID NO: 408016 - DNA, 20 bp, human
gggaggctggcccttctcta

SEQ ID NO: 408017 - DNA, 20 bp, human
gtcgtgggaaccatagagaa

SEQ ID NO: 408018 - DNA, 20 bp, human
gaccaggcgcagagcggttg

SEQ ID NO: 408019 - DNA, 20 bp, human
gcgcagagcggttgtggaga

SEQ ID NO: 408020 - DNA, 20 bp, human
gggttggagtttcgtttcgt

SEQ ID NO: 408021 - DNA, 20 bp, human
gccagctaatgcttccgtct

SEQ ID NO: 408022 - DNA, 20 bp, human
gcggtccctacagcctctct

SEQ ID NO: 408023 - DNA, 20 bp, human
gtccacaaccgctctgcgcc

SEQ ID NO: 408024 - DNA, 20 bp, human
gactgtgacctaagaccatg

SEQ ID NO: 408025 - DNA, 20 bp, human
gtgagcaagtccatatagag

SEQ ID NO: 408026 - DNA, 20 bp, human
ggacactggcgctgacggcg

SEQ ID NO: 408027 - DNA, 20 bp, human
gtctcaggcagtagggacac

SEQ ID NO: 408028 - DNA, 20 bp, human
gggtaggaaaccacagagac

SEQ ID NO: 408029 - DNA, 20 bp, human
gaaagcttgagaccctccgc

SEQ ID NO: 408030 - DNA, 20 bp, human
ggtcctgcagcgcccacacc

SEQ ID NO: 408031 - DNA, 20 bp, human
gcagagactggcaacttccc

SEQ ID NO: 408032 - DNA, 20 bp, human
gctactgcctgagacaacac

SEQ ID NO: 408033 - DNA, 20 bp, human
gtccttcggggcatgacgtc

SEQ ID NO: 408034 - DNA, 20 bp, human
gacacctggtagctccttcg

SEQ ID NO: 408035 - DNA, 20 bp, human
ggaaaacgcacttccggcgg

SEQ ID NO: 408036 - DNA, 20 bp, human
gcagccagaggcgatgccga

SEQ ID NO: 408037 - DNA, 20 bp, human
gcggggccagccatgaaagg

SEQ ID NO: 408038 - DNA, 20 bp, human
gaggacccaagcaagatcct

SEQ ID NO: 408039 - DNA, 20 bp, human
gaccggctgggctgagaggc

SEQ ID NO: 408040 - DNA, 20 bp, human
gcaacctcgcctcttccgca

SEQ ID NO: 408041 - DNA, 20 bp, human
gcagccgtcggcatcgcctc

SEQ ID NO: 408042 - DNA, 20 bp, human
gaggcgcagcccgtgaactg

SEQ ID NO: 408043 - DNA, 20 bp, human
ggaggttgcggcgaccggct

SEQ ID NO: 408044 - DNA, 20 bp, human
gcacggggcgaccgagatgg

SEQ ID NO: 408045 - DNA, 20 bp, human
gggctgggctgagaggccgg

SEQ ID NO: 408046 - DNA, 20 bp, human
gcgaggtggctgttgattga

SEQ ID NO: 408047 - DNA, 20 bp, human
gggtccgctcagtcagcccg

SEQ ID NO: 408048 - DNA, 20 bp, human
gaccagggaaggtaactggg

SEQ ID NO: 408049 - DNA, 20 bp, human
ggggaacgctgtggctgaaa

SEQ ID NO: 408050 - DNA, 20 bp, human
ggggacggctacgcgagaat

SEQ ID NO: 408051 - DNA, 20 bp, human
gccgagcggcacaaccacca

SEQ ID NO: 408052 - DNA, 20 bp, human
ggacaggaaacccgcctctc

SEQ ID NO: 408053 - DNA, 20 bp, human
gaaacccgcctctcaggctg

SEQ ID NO: 408054 - DNA, 20 bp, human
gaccaccagggaaggtaact

SEQ ID NO: 408055 - DNA, 20 bp, human
gtcggtgtgacgcggtcaag

SEQ ID NO: 408056 - DNA, 20 bp, human
gaagtccgcaccactgagag

SEQ ID NO: 408057 - DNA, 20 bp, human
gggatcggctcccctctcag

SEQ ID NO: 408058 - DNA, 20 bp, human
ggggactaagacccccggag

SEQ ID NO: 408059 - DNA, 20 bp, human
gaagacccccggaggggcca

SEQ ID NO: 408060 - DNA, 20 bp, human
gcaggagcggcgttgctacg

SEQ ID NO: 408061 - DNA, 20 bp, human
ggcccggggactaagacccc

SEQ ID NO: 408062 - DNA, 20 bp, human
gggctcccctctcagtggtg

SEQ ID NO: 408063 - DNA, 20 bp, human
gagcgcgggctcggaaactc

SEQ ID NO: 408064 - DNA, 20 bp, human
gcgttgctacgcggttggga

SEQ ID NO: 408065 - DNA, 20 bp, human
gctcctgagaagctggtctt

SEQ ID NO: 408066 - DNA, 20 bp, human
ggaaggaattggctcttcga

SEQ ID NO: 408067 - DNA, 20 bp, human
gctaacgcagacaaaagggg

SEQ ID NO: 408068 - DNA, 20 bp, human
gctcaggcgctgaggattct

SEQ ID NO: 408069 - DNA, 20 bp, human
gtctgcgttagtgaaggaat

SEQ ID NO: 408070 - DNA, 20 bp, human
gttcactaacgcagacaaaa

SEQ ID NO: 408071 - DNA, 20 bp, human
ggccgagccgccgccattgc

SEQ ID NO: 408072 - DNA, 20 bp, human
gacgcagacaaaaggggcgg

SEQ ID NO: 408073 - DNA, 20 bp, human
gacgcttccagcaatggcgg

SEQ ID NO: 408074 - DNA, 20 bp, human
gcatctatctgttctctcga

SEQ ID NO: 408075 - DNA, 20 bp, human
gcctaaatgttccaagacaa

SEQ ID NO: 408076 - DNA, 20 bp, human
gagctcgcttagataatctg

SEQ ID NO: 408077 - DNA, 20 bp, human
gactcaggaccgatgggacg

SEQ ID NO: 408078 - DNA, 20 bp, human
ggctccagtccccgtcccat

SEQ ID NO: 408079 - DNA, 20 bp, human
gagggacagcccattgagtg

SEQ ID NO: 408080 - DNA, 20 bp, human
gcgcttagataatctgtggt

SEQ ID NO: 408081 - DNA, 20 bp, human
gagtcaggaaagcgggaatg

SEQ ID NO: 408082 - DNA, 20 bp, human
gcggcctccccttccccgga

SEQ ID NO: 408083 - DNA, 20 bp, human
gagccctgggtaacaaggcc

SEQ ID NO: 408084 - DNA, 20 bp, human
gtagcaattcggagcaaatt

SEQ ID NO: 408085 - DNA, 20 bp, human
gacccaaagagcaagacgca

SEQ ID NO: 408086 - DNA, 20 bp, human
gactgtcactcagggcctca

SEQ ID NO: 408087 - DNA, 20 bp, human
gagcgaagaggacggtttcc

SEQ ID NO: 408088 - DNA, 20 bp, human
gagcattatccaatcaggga

SEQ ID NO: 408089 - DNA, 20 bp, human
gacaaatttgattttttata

SEQ ID NO: 408090 - DNA, 20 bp, human
gacagtttgaaattacttaa

SEQ ID NO: 408091 - DNA, 20 bp, human
gttatccaatcagggatggt

SEQ ID NO: 408092 - DNA, 20 bp, human
gccaatcagggatggtgggc

SEQ ID NO: 408093 - DNA, 20 bp, human
gatagaattctcccatgctc

SEQ ID NO: 408094 - DNA, 20 bp, human
gacggtttccgggtttggtg

SEQ ID NO: 408095 - DNA, 20 bp, human
gaatgtattatcaatactaa

SEQ ID NO: 408096 - DNA, 20 bp, human
gcagcccgagggatatttga

SEQ ID NO: 408097 - DNA, 20 bp, human
gaaaccctcaaatatccctc

SEQ ID NO: 408098 - DNA, 20 bp, human
gtgtgcgtagcagtgttgac

SEQ ID NO: 408099 - DNA, 20 bp, human
gtctcccgggcccatctgaa

SEQ ID NO: 408100 - DNA, 20 bp, human
gcctaaggcctgagtgacgt

SEQ ID NO: 408101 - DNA, 20 bp, human
gtctagccactgcgcctctc

SEQ ID NO: 408102 - DNA, 20 bp, human
gggaggaaactcggcctgag

SEQ ID NO: 408103 - DNA, 20 bp, human
gtgagtgacgtaggaagcca

SEQ ID NO: 408104 - DNA, 20 bp, human
gatccctcgggctgggtgca

SEQ ID NO: 408105 - DNA, 20 bp, human
gtcactcaggccttaggggg

SEQ ID NO: 408106 - DNA, 20 bp, human
gactccagttgtcaggtctt

SEQ ID NO: 408107 - DNA, 20 bp, human
ggcccccaagacctgacaac

SEQ ID NO: 408108 - DNA, 20 bp, human
gggagtccgcgaccacaact

SEQ ID NO: 408109 - DNA, 20 bp, human
gcctggccttgggctcaccg

SEQ ID NO: 408110 - DNA, 20 bp, human
ggcgaggcctcgtcgagctc

SEQ ID NO: 408111 - DNA, 20 bp, human
gcgaggccccggtgagccca

SEQ ID NO: 408112 - DNA, 20 bp, human
gagggaatcgggattaataa

SEQ ID NO: 408113 - DNA, 20 bp, human
gcggggcccgcttcacggga

SEQ ID NO: 408114 - DNA, 20 bp, human
ggcgaccccgcgtctcgagc

SEQ ID NO: 408115 - DNA, 20 bp, human
gacggccagctcgagacgcg

SEQ ID NO: 408116 - DNA, 20 bp, human
gcctgctcccactggagacg

SEQ ID NO: 408117 - DNA, 20 bp, human
gcccactggagacggggaca

SEQ ID NO: 408118 - DNA, 20 bp, human
ggaaaaaaggggacagcggt

SEQ ID NO: 408119 - DNA, 20 bp, human
gccgcagcctggggaaaaaa

SEQ ID NO: 408120 - DNA, 20 bp, human
gagagccccgatgcccgcga

SEQ ID NO: 408121 - DNA, 20 bp, human
gagcaggcagcgtgggcatc

SEQ ID NO: 408122 - DNA, 20 bp, human
gtggggaaaaaaggggacag

SEQ ID NO: 408123 - DNA, 20 bp, human
ggaagagcggccagaagccc

SEQ ID NO: 408124 - DNA, 20 bp, human
gctagaggggcccgggaagc

SEQ ID NO: 408125 - DNA, 20 bp, human
ggcccctgcgaaatgaagag

SEQ ID NO: 408126 - DNA, 20 bp, human
gagggcgccgaggccaggtg

SEQ ID NO: 408127 - DNA, 20 bp, human
gaaaggctgcatgatgtcaa

SEQ ID NO: 408128 - DNA, 20 bp, human
gtgggcagtgagtgacagat

SEQ ID NO: 408129 - DNA, 20 bp, human
gtgcggaggaatctcccggg

SEQ ID NO: 408130 - DNA, 20 bp, human
gcctaaaacgtctggagaaa

SEQ ID NO: 408131 - DNA, 20 bp, human
gcgtggcgacatggcagggt

SEQ ID NO: 408132 - DNA, 20 bp, human
gggctcctttgaacacggaa

SEQ ID NO: 408133 - DNA, 20 bp, human
gtgggcccttccgtgttcaa

SEQ ID NO: 408134 - DNA, 20 bp, human
ggagccaatggaggaccggt

SEQ ID NO: 408135 - DNA, 20 bp, human
gaaggcgtggcgacatggca

SEQ ID NO: 408136 - DNA, 20 bp, human
gaaggggcgctcccgcgtgg

SEQ ID NO: 408137 - DNA, 20 bp, human
ggcggagcgggctcccggaa

SEQ ID NO: 408138 - DNA, 20 bp, human
ggctccgcccggctcttctc

SEQ ID NO: 408139 - DNA, 20 bp, human
gaggcgccgggagcctacga

SEQ ID NO: 408140 - DNA, 20 bp, human
gtggtggcggcgaaggcgtg

SEQ ID NO: 408141 - DNA, 20 bp, human
gagctcctgcgagccctcgt

SEQ ID NO: 408142 - DNA, 20 bp, human
gacgcgggagcgccccttcc

SEQ ID NO: 408143 - DNA, 20 bp, human
gaagcccgagaagagccggg

SEQ ID NO: 408144 - DNA, 20 bp, human
gcgggcgagcgcggtgccag

SEQ ID NO: 408145 - DNA, 20 bp, human
gtcccgcgtggtggcggcga

SEQ ID NO: 408146 - DNA, 20 bp, human
gtggcgtggagtaatcctag

SEQ ID NO: 408147 - DNA, 20 bp, human
gggcgcaaggcctccggcag

SEQ ID NO: 408148 - DNA, 20 bp, human
gtggagtaatcctagagggt

SEQ ID NO: 408149 - DNA, 20 bp, human
ggccgccgcagtctccttct

SEQ ID NO: 408150 - DNA, 20 bp, human
gcctgcgccgcgcacctcag

SEQ ID NO: 408151 - DNA, 20 bp, human
ggcgggcgggataaattcgc

SEQ ID NO: 408152 - DNA, 20 bp, human
gtgcggcggcgcaaggcctc

SEQ ID NO: 408153 - DNA, 20 bp, human
gcccgcccagaaggagactg

SEQ ID NO: 408154 - DNA, 20 bp, human
gcacaccagagaaccaccta

SEQ ID NO: 408155 - DNA, 20 bp, human
ggggctcttccccgcccaga

SEQ ID NO: 408156 - DNA, 20 bp, human
gcgcttccggggctctgcgg

SEQ ID NO: 408157 - DNA, 20 bp, human
gggaggcccagtagccagag

SEQ ID NO: 408158 - DNA, 20 bp, human
gggtcccgggttcgcgtttg

SEQ ID NO: 408159 - DNA, 20 bp, human
ggctcccagacgcaagcgga

SEQ ID NO: 408160 - DNA, 20 bp, human
gcccagacgcaagcggaggg

SEQ ID NO: 408161 - DNA, 20 bp, human
gacctccgcgcccgccgctg

SEQ ID NO: 408162 - DNA, 20 bp, human
ggcggcccgagacgcttgga

SEQ ID NO: 408163 - DNA, 20 bp, human
gcgcgcccgccgctgtgggg

SEQ ID NO: 408164 - DNA, 20 bp, human
gagccagcgacaggcggaga

SEQ ID NO: 408165 - DNA, 20 bp, human
ggcgcccccaaacgcgaacc

SEQ ID NO: 408166 - DNA, 20 bp, human
gagcgtgcctactttggggc

SEQ ID NO: 408167 - DNA, 20 bp, human
gaacctccttgggagtgatt

SEQ ID NO: 408168 - DNA, 20 bp, human
gcaccagcgcgaagcttccc

SEQ ID NO: 408169 - DNA, 20 bp, human
gttggggcgggaacctcctt

SEQ ID NO: 408170 - DNA, 20 bp, human
gcttcccgggagctcctcgc

SEQ ID NO: 408171 - DNA, 20 bp, human
gctcccgggaagcttcgcgc

SEQ ID NO: 408172 - DNA, 20 bp, human
gggagtgattaggtcagcgc

SEQ ID NO: 408173 - DNA, 20 bp, human
gtggccagcgaggagctccc

SEQ ID NO: 408174 - DNA, 20 bp, human
ggggccaattagacaaacga

SEQ ID NO: 408175 - DNA, 20 bp, human
ggctgacctaatcactccca

SEQ ID NO: 408176 - DNA, 20 bp, human
gcactctagtgagggaattt

SEQ ID NO: 408177 - DNA, 20 bp, human
gtaaacgtcaaagcagtgga

SEQ ID NO: 408178 - DNA, 20 bp, human
gtcaaagcagtggagggttg

SEQ ID NO: 408179 - DNA, 20 bp, human
gtcactagagtggtgggaca

SEQ ID NO: 408180 - DNA, 20 bp, human
gactttcgcctcctaggctg

SEQ ID NO: 408181 - DNA, 20 bp, human
ggttactggcacatgactcc

SEQ ID NO: 408182 - DNA, 20 bp, human
gattccctcactagagtggt

SEQ ID NO: 408183 - DNA, 20 bp, human
gacgttgataatgggttact

SEQ ID NO: 408184 - DNA, 20 bp, human
gtttcggctcacaagggacc

SEQ ID NO: 408185 - DNA, 20 bp, human
ggatcgcactttcgcctcct

SEQ ID NO: 408186 - DNA, 20 bp, human
gtaaaactgcggctcggagg

SEQ ID NO: 408187 - DNA, 20 bp, human
gcggctgactccgcccacgt

SEQ ID NO: 408188 - DNA, 20 bp, human
ggccgcgttgtgacctacgt

SEQ ID NO: 408189 - DNA, 20 bp, human
gacttccggcgctaagttct

SEQ ID NO: 408190 - DNA, 20 bp, human
gcagacctagaacttagcgc

SEQ ID NO: 408191 - DNA, 20 bp, human
ggcgttgtgacctacgtggg

SEQ ID NO: 408192 - DNA, 20 bp, human
gaggaagtgtccgtagagct

SEQ ID NO: 408193 - DNA, 20 bp, human
gagagcagctagaatcgttc

SEQ ID NO: 408194 - DNA, 20 bp, human
gccccgcgaaacttccgctt

SEQ ID NO: 408195 - DNA, 20 bp, human
gacaggcagtgctcccgaag

SEQ ID NO: 408196 - DNA, 20 bp, human
gggagccagaggatcggttc

SEQ ID NO: 408197 - DNA, 20 bp, human
gcataccagggctaaagtga

SEQ ID NO: 408198 - DNA, 20 bp, human
gtctctggatgcaggcagga

SEQ ID NO: 408199 - DNA, 20 bp, human
gactgcctgaaccgatcctc

SEQ ID NO: 408200 - DNA, 20 bp, human
ggaggcatagggccacctgc

SEQ ID NO: 408201 - DNA, 20 bp, human
gaggagtgaaagtgaacaag

SEQ ID NO: 408202 - DNA, 20 bp, human
gcggttcaggcagtgagaga

SEQ ID NO: 408203 - DNA, 20 bp, human
ggtggcccatgggcatacca

SEQ ID NO: 408204 - DNA, 20 bp, human
ggaaggcagaacagagtatt

SEQ ID NO: 408205 - DNA, 20 bp, human
ggaagctcacaagtgacatg

SEQ ID NO: 408206 - DNA, 20 bp, human
gcccagagagccgtggctca

SEQ ID NO: 408207 - DNA, 20 bp, human
gcgctaggacgatgggacat

SEQ ID NO: 408208 - DNA, 20 bp, human
gatgtccgcgccctgagcca

SEQ ID NO: 408209 - DNA, 20 bp, human
ggtagatctgccgtacagaa

SEQ ID NO: 408210 - DNA, 20 bp, human
gcaactgtttcccttctgta

SEQ ID NO: 408211 - DNA, 20 bp, human
gggacatgggcttctcttcg

SEQ ID NO: 408212 - DNA, 20 bp, human
gcatgggcttctcttcgagg

SEQ ID NO: 408213 - DNA, 20 bp, human
gagaagcgcgagacttcttt

SEQ ID NO: 408214 - DNA, 20 bp, human
gtctgccgcgctaggacgat

SEQ ID NO: 408215 - DNA, 20 bp, human
ggttcttgtgtcattaaacc

SEQ ID NO: 408216 - DNA, 20 bp, human
gccgccgcccagataaccgc

SEQ ID NO: 408217 - DNA, 20 bp, human
gcggcggagcgctcacaatg

SEQ ID NO: 408218 - DNA, 20 bp, human
ggagccggcggttatctggg

SEQ ID NO: 408219 - DNA, 20 bp, human
gtgcgcgccgccgctcccag

SEQ ID NO: 408220 - DNA, 20 bp, human
gcccagcggccgggatgctg

SEQ ID NO: 408221 - DNA, 20 bp, human
ggaggtgtcgggatccccgt

SEQ ID NO: 408222 - DNA, 20 bp, human
gcggggagccggcggttatc

SEQ ID NO: 408223 - DNA, 20 bp, human
gtgtggatgtgtgtgccgga

SEQ ID NO: 408224 - DNA, 20 bp, human
gggggggcgtggttgccgaa

SEQ ID NO: 408225 - DNA, 20 bp, human
ggcgctctccgtgagtcggg

SEQ ID NO: 408226 - DNA, 20 bp, human
gaccgtgagaaatttctcgg

SEQ ID NO: 408227 - DNA, 20 bp, human
gcggaagtggcgcgcatctt

SEQ ID NO: 408228 - DNA, 20 bp, human
ggcgcctgcagattctggag

SEQ ID NO: 408229 - DNA, 20 bp, human
ggctggcagcccgagatcct

SEQ ID NO: 408230 - DNA, 20 bp, human
gggtctcgcctgcccatcgc

SEQ ID NO: 408231 - DNA, 20 bp, human
gatgcgcgccacttccggtc

SEQ ID NO: 408232 - DNA, 20 bp, human
gacagcccgtgccctcgcgc

SEQ ID NO: 408233 - DNA, 20 bp, human
gcgaggaggcggtggactga

SEQ ID NO: 408234 - DNA, 20 bp, human
gcagaggcgcctgcagattc

SEQ ID NO: 408235 - DNA, 20 bp, human
ggctgccccagggcgccaaa

SEQ ID NO: 408236 - DNA, 20 bp, human
gtgagagtgcacaaatcctg

SEQ ID NO: 408237 - DNA, 20 bp, human
gcagatgaagaatataatga

SEQ ID NO: 408238 - DNA, 20 bp, human
gacagtacgatacgcttcta

SEQ ID NO: 408239 - DNA, 20 bp, human
gagttttgggatcatcatga

SEQ ID NO: 408240 - DNA, 20 bp, human
gtgaggatctccaaatcatt

SEQ ID NO: 408241 - DNA, 20 bp, human
gttacgaagttccaaaattc

SEQ ID NO: 408242 - DNA, 20 bp, human
gggtaatctaaaaaggacgg

SEQ ID NO: 408243 - DNA, 20 bp, human
gcattttttgccaaatgatt

SEQ ID NO: 408244 - DNA, 20 bp, human
gtttctaaatgaaagcacac

SEQ ID NO: 408245 - DNA, 20 bp, human
gactagtataaccatttttt

SEQ ID NO: 408246 - DNA, 20 bp, human
gccccggatgaggaactcgg

SEQ ID NO: 408247 - DNA, 20 bp, human
ggggccgtcactcacatccg

SEQ ID NO: 408248 - DNA, 20 bp, human
gtgagtgacggccccggatg

SEQ ID NO: 408249 - DNA, 20 bp, human
gccgcgcgtccatgattcga

SEQ ID NO: 408250 - DNA, 20 bp, human
gcatccgggaccctcatccg

SEQ ID NO: 408251 - DNA, 20 bp, human
gaaaacgagccttcgaatca

SEQ ID NO: 408252 - DNA, 20 bp, human
gcggccccggatgaggaact

SEQ ID NO: 408253 - DNA, 20 bp, human
gccagtgggtgcgtgtcgtg

SEQ ID NO: 408254 - DNA, 20 bp, human
gagtgcagggtcccgaatga

SEQ ID NO: 408255 - DNA, 20 bp, human
ggaccctcatgcctgggcgg

SEQ ID NO: 408256 - DNA, 20 bp, human
gctttgggaatggggtttcg

SEQ ID NO: 408257 - DNA, 20 bp, human
ggaccacaaactgcgaagtg

SEQ ID NO: 408258 - DNA, 20 bp, human
gaattgttaatgtctgttta

SEQ ID NO: 408259 - DNA, 20 bp, human
gaccggctgggagggacctt

SEQ ID NO: 408260 - DNA, 20 bp, human
gctgacaacctccgggaatt

SEQ ID NO: 408261 - DNA, 20 bp, human
gggaaatccctgggctccga

SEQ ID NO: 408262 - DNA, 20 bp, human
gtcccaaagtgctgcgcggt

SEQ ID NO: 408263 - DNA, 20 bp, human
gtggtcatgctgacaacctc

SEQ ID NO: 408264 - DNA, 20 bp, human
gtccgaaggtccctcccagc

SEQ ID NO: 408265 - DNA, 20 bp, human
gcgggaatttgggaaatccc

SEQ ID NO: 408266 - DNA, 20 bp, human
gaccgcgcggggcttctgag

SEQ ID NO: 408267 - DNA, 20 bp, human
gtccagggccctcctcacat

SEQ ID NO: 408268 - DNA, 20 bp, human
ggccctatcattggatggaa

SEQ ID NO: 408269 - DNA, 20 bp, human
gtgggcagggggcttggtta

SEQ ID NO: 408270 - DNA, 20 bp, human
gccgggctttgccctatcat

SEQ ID NO: 408271 - DNA, 20 bp, human
ggaagcctagaagggccgga

SEQ ID NO: 408272 - DNA, 20 bp, human
gagcgtcggccgaccgcgcg

SEQ ID NO: 408273 - DNA, 20 bp, human
ggtggtggaagctgggcagg

SEQ ID NO: 408274 - DNA, 20 bp, human
gggcccttctaggcttcgtg

SEQ ID NO: 408275 - DNA, 20 bp, human
gaccgagcatctgggtggcc

SEQ ID NO: 408276 - DNA, 20 bp, human
gtggcctagagcgcagggga

SEQ ID NO: 408277 - DNA, 20 bp, human
gtgcacccctaccccggtag

SEQ ID NO: 408278 - DNA, 20 bp, human
ggtaggggtgcaggcggctg

SEQ ID NO: 408279 - DNA, 20 bp, human
gaccggggtaggggtgcagg

SEQ ID NO: 408280 - DNA, 20 bp, human
gaaggggtggcctagagcgc

SEQ ID NO: 408281 - DNA, 20 bp, human
gggagggcgccgcatctctg

SEQ ID NO: 408282 - DNA, 20 bp, human
gtggagacacggacgatccc

SEQ ID NO: 408283 - DNA, 20 bp, human
gagggaccgctaccggggta

SEQ ID NO: 408284 - DNA, 20 bp, human
ggatcccagggaccgctacc

SEQ ID NO: 408285 - DNA, 20 bp, human
gcctccccgagcgagaaagg

SEQ ID NO: 408286 - DNA, 20 bp, human
gtaacgcggcccgagggagg

SEQ ID NO: 408287 - DNA, 20 bp, human
gggacgcaggcgcacagctc

SEQ ID NO: 408288 - DNA, 20 bp, human
gcaggcgcacagctcaggtg

SEQ ID NO: 408289 - DNA, 20 bp, human
ggggcgaaggccgaggggaa

SEQ ID NO: 408290 - DNA, 20 bp, human
gccgaggggaagggagggtc

SEQ ID NO: 408291 - DNA, 20 bp, human
gcctcgggccgcgttaccca

SEQ ID NO: 408292 - DNA, 20 bp, human
gctcaggtgcggccgcactg

SEQ ID NO: 408293 - DNA, 20 bp, human
gcacgcgcgctgtcccccgg

SEQ ID NO: 408294 - DNA, 20 bp, human
gaggcctggccgcgctgacc

SEQ ID NO: 408295 - DNA, 20 bp, human
gctgtcccccggaggcgtct

SEQ ID NO: 408296 - DNA, 20 bp, human
gggacgcaggcgcacagctc

SEQ ID NO: 408297 - DNA, 20 bp, human
gcaggcgcacagctcaggtg

SEQ ID NO: 408298 - DNA, 20 bp, human
ggtaacgcggcccgagggag

SEQ ID NO: 408299 - DNA, 20 bp, human
ggggcgaaggccgaggggaa

SEQ ID NO: 408300 - DNA, 20 bp, human
gccgaggggaagggagggtc

SEQ ID NO: 408301 - DNA, 20 bp, human
gcctcgggccgcgttaccca

SEQ ID NO: 408302 - DNA, 20 bp, human
gctcaggtgcggccgcactg

SEQ ID NO: 408303 - DNA, 20 bp, human
gcacgcgcgctgtcccccgg

SEQ ID NO: 408304 - DNA, 20 bp, human
gaggcctggccgcgctgacc

SEQ ID NO: 408305 - DNA, 20 bp, human
gctgtcccccggaggcgtct

SEQ ID NO: 408306 - DNA, 20 bp, human
gtgcccgcgcagtaggcaaa

SEQ ID NO: 408307 - DNA, 20 bp, human
gtaggcaaaggggcgggttg

SEQ ID NO: 408308 - DNA, 20 bp, human
ggaaaggccaggcgttggga

SEQ ID NO: 408309 - DNA, 20 bp, human
gcaaaggggcgggttgcggt

SEQ ID NO: 408310 - DNA, 20 bp, human
gtgggagggactgagagcat

SEQ ID NO: 408311 - DNA, 20 bp, human
gtggggaaaggccaggcgtt

SEQ ID NO: 408312 - DNA, 20 bp, human
gagggactgagagcataggg

SEQ ID NO: 408313 - DNA, 20 bp, human
gggaagggatcagtgaggtg

SEQ ID NO: 408314 - DNA, 20 bp, human
ggagaaggggcgttgagcct

SEQ ID NO: 408315 - DNA, 20 bp, human
ggggcagtttcttgcaaacc

SEQ ID NO: 408316 - DNA, 20 bp, human
ggagccggcctcacccgcgg

SEQ ID NO: 408317 - DNA, 20 bp, human
ggcggcgaattggggaggtt

SEQ ID NO: 408318 - DNA, 20 bp, human
gacgcacaccggtctcctag

SEQ ID NO: 408319 - DNA, 20 bp, human
gggaaggcggcgaattgggg

SEQ ID NO: 408320 - DNA, 20 bp, human
gcgccagtcccctaggagac

SEQ ID NO: 408321 - DNA, 20 bp, human
ggtgtccgcctccgcgggtg

SEQ ID NO: 408322 - DNA, 20 bp, human
ggtgtgcgtgccagcctcgg

SEQ ID NO: 408323 - DNA, 20 bp, human
gcttgtgcgtgtggcgctga

SEQ ID NO: 408324 - DNA, 20 bp, human
gtgcgctcacccgcctctcg

SEQ ID NO: 408325 - DNA, 20 bp, human
gcgtgtggcgctgaggggtc

SEQ ID NO: 408326 - DNA, 20 bp, human
gaggggagctagttgctgag

SEQ ID NO: 408327 - DNA, 20 bp, human
gggagcccagcccccatcgg

SEQ ID NO: 408328 - DNA, 20 bp, human
gcggcacgagcgctcacacc

SEQ ID NO: 408329 - DNA, 20 bp, human
ggcgcactgagctgtgagtg

SEQ ID NO: 408330 - DNA, 20 bp, human
gcacaatgacgctgctgcgt

SEQ ID NO: 408331 - DNA, 20 bp, human
gctcggcacacaaactgggg

SEQ ID NO: 408332 - DNA, 20 bp, human
ggctcctggtcccttggaag

SEQ ID NO: 408333 - DNA, 20 bp, human
gttgctgaggggtagggatc

SEQ ID NO: 408334 - DNA, 20 bp, human
ggaaggccttgggacaatgg

SEQ ID NO: 408335 - DNA, 20 bp, human
gtacaggaagcccccgatgg

SEQ ID NO: 408336 - DNA, 20 bp, human
ggagattgcgatctcacgtg

SEQ ID NO: 408337 - DNA, 20 bp, human
gcgcaatctcctgtcactca

SEQ ID NO: 408338 - DNA, 20 bp, human
ggggtggggaccgttcaatc

SEQ ID NO: 408339 - DNA, 20 bp, human
gcgcgccgccggaaaggaga

SEQ ID NO: 408340 - DNA, 20 bp, human
gcaaaccgctaggccaaaag

SEQ ID NO: 408341 - DNA, 20 bp, human
gaggtcagaatgaccgcttt

SEQ ID NO: 408342 - DNA, 20 bp, human
gggcggcgcgcctgattgaa

SEQ ID NO: 408343 - DNA, 20 bp, human
gttgcgatctcacgtgaggc

SEQ ID NO: 408344 - DNA, 20 bp, human
ggggatccgaccatgcaaga

SEQ ID NO: 408345 - DNA, 20 bp, human
ggcttccgggatctgcctgg

SEQ ID NO: 408346 - DNA, 20 bp, human
ggggcgccaggtctcagcac

SEQ ID NO: 408347 - DNA, 20 bp, human
gaatgggaaagtcccccggg

SEQ ID NO: 408348 - DNA, 20 bp, human
gtcactcaggactgaagggg

SEQ ID NO: 408349 - DNA, 20 bp, human
gccaatcgggcgctgggaag

SEQ ID NO: 408350 - DNA, 20 bp, human
gcgggagatgcaatcagaca

SEQ ID NO: 408351 - DNA, 20 bp, human
gggactgcagggaaagaacc

SEQ ID NO: 408352 - DNA, 20 bp, human
gccgtcactcaggactgaag

SEQ ID NO: 408353 - DNA, 20 bp, human
gtcagacacggcgctgagtg

SEQ ID NO: 408354 - DNA, 20 bp, human
gcaagcgcgccgcgaaagga

SEQ ID NO: 408355 - DNA, 20 bp, human
gtcccagcgcccgattggac

SEQ ID NO: 408356 - DNA, 20 bp, human
gcccactgagctatccttca

SEQ ID NO: 408357 - DNA, 20 bp, human
gcctctcctgggccctcatt

SEQ ID NO: 408358 - DNA, 20 bp, human
gcgagaatcccctgccttga

SEQ ID NO: 408359 - DNA, 20 bp, human
gtaggagggccaagttgttt

SEQ ID NO: 408360 - DNA, 20 bp, human
ggggaaaactcgaagtagga

SEQ ID NO: 408361 - DNA, 20 bp, human
ggccttgaaggatagctcag

SEQ ID NO: 408362 - DNA, 20 bp, human
gatgcaacgtataggtttgt

SEQ ID NO: 408363 - DNA, 20 bp, human
gcattgggtatgcaacgtat

SEQ ID NO: 408364 - DNA, 20 bp, human
gcgagttttcccaagagccc

SEQ ID NO: 408365 - DNA, 20 bp, human
gtcttgggaaaactcgaagt

SEQ ID NO: 408366 - DNA, 20 bp, human
gctgaggcgcgcgcagggat

SEQ ID NO: 408367 - DNA, 20 bp, human
gcctcgtcccgcccaatcag

SEQ ID NO: 408368 - DNA, 20 bp, human
gtcccgggactccgcggctg

SEQ ID NO: 408369 - DNA, 20 bp, human
gctgctggaagactagacgg

SEQ ID NO: 408370 - DNA, 20 bp, human
gaaggccccgccctctcttc

SEQ ID NO: 408371 - DNA, 20 bp, human
gggcgccctttcctctgatt

SEQ ID NO: 408372 - DNA, 20 bp, human
gtgtctgttggcccacccct

SEQ ID NO: 408373 - DNA, 20 bp, human
ggagctgctggaagactaga

SEQ ID NO: 408374 - DNA, 20 bp, human
ggtgggccaacagacaaagc

SEQ ID NO: 408375 - DNA, 20 bp, human
ggcgcctcagcccccagccg

SEQ ID NO: 408376 - DNA, 20 bp, human
ggggccgaggagcgccacat

SEQ ID NO: 408377 - DNA, 20 bp, human
gacaaagcctgtggccgatg

SEQ ID NO: 408378 - DNA, 20 bp, human
gtcctcggcccgcgcttcag

SEQ ID NO: 408379 - DNA, 20 bp, human
gggcggggcaacaaagcctg

SEQ ID NO: 408380 - DNA, 20 bp, human
gtgaacgaagcgccaccctc

SEQ ID NO: 408381 - DNA, 20 bp, human
gaatgctcggctgacccgga

SEQ ID NO: 408382 - DNA, 20 bp, human
gggtccggggaggcgtacct

SEQ ID NO: 408383 - DNA, 20 bp, human
gggagcgccacatcggccac

SEQ ID NO: 408384 - DNA, 20 bp, human
gttgacttcacgttcccagg

SEQ ID NO: 408385 - DNA, 20 bp, human
gccggggaggcgtacctggg

SEQ ID NO: 408386 - DNA, 20 bp, human
gttgtccaatcaggcacgct

SEQ ID NO: 408387 - DNA, 20 bp, human
gtttaaggtcctgacccttc

SEQ ID NO: 408388 - DNA, 20 bp, human
gataccctatgggatgggcc

SEQ ID NO: 408389 - DNA, 20 bp, human
gtacaaataccctatgggat

SEQ ID NO: 408390 - DNA, 20 bp, human
gttaaatacaaataccctat

SEQ ID NO: 408391 - DNA, 20 bp, human
ggagcagacaagatggcttc

SEQ ID NO: 408392 - DNA, 20 bp, human
ggtggctcacattttatttg

SEQ ID NO: 408393 - DNA, 20 bp, human
gtacatttataaatgatata

SEQ ID NO: 408394 - DNA, 20 bp, human
gtactaaaatgatagtactt

SEQ ID NO: 408395 - DNA, 20 bp, human
ggctgaaaaggctgcagcgc

SEQ ID NO: 408396 - DNA, 20 bp, human
gggcgggcaaatggcgggga

SEQ ID NO: 408397 - DNA, 20 bp, human
gggactgccggacctctcct

SEQ ID NO: 408398 - DNA, 20 bp, human
gggggcggcgcaaggggcaa

SEQ ID NO: 408399 - DNA, 20 bp, human
gggacaccatagagattcaa

SEQ ID NO: 408400 - DNA, 20 bp, human
ggtggggatgggcgggcaaa

SEQ ID NO: 408401 - DNA, 20 bp, human
gggcctaggggtcggactgc

SEQ ID NO: 408402 - DNA, 20 bp, human
gggcagggcgcggacaactg

SEQ ID NO: 408403 - DNA, 20 bp, human
gtgcactggggcggcgcaag

SEQ ID NO: 408404 - DNA, 20 bp, human
gcggggctactggcgctctc

SEQ ID NO: 408405 - DNA, 20 bp, human
ggggccccttatattggaat

SEQ ID NO: 408406 - DNA, 20 bp, human
gcaatcagggacattgacgt

SEQ ID NO: 408407 - DNA, 20 bp, human
gaaccaaaggaggcgggtcc

SEQ ID NO: 408408 - DNA, 20 bp, human
gtcaatgtccctgattggac

SEQ ID NO: 408409 - DNA, 20 bp, human
gtcctgtcactcataaccaa

SEQ ID NO: 408410 - DNA, 20 bp, human
gaggagcgcagcttgagagg

SEQ ID NO: 408411 - DNA, 20 bp, human
gcagaagccgaggcgtgctt

SEQ ID NO: 408412 - DNA, 20 bp, human
gagcgcagcttgagaggcgg

SEQ ID NO: 408413 - DNA, 20 bp, human
ggacatggaacaattttgga

SEQ ID NO: 408414 - DNA, 20 bp, human
gtcctttggttatgagtgac

SEQ ID NO: 408415 - DNA, 20 bp, human
ggggcagggcagcgcatggt

SEQ ID NO: 408416 - DNA, 20 bp, human
gtgagccaggccaaccttag

SEQ ID NO: 408417 - DNA, 20 bp, human
gtaaatgcaaatgtcctcta

SEQ ID NO: 408418 - DNA, 20 bp, human
gtgcaaatgtcctctaaggt

SEQ ID NO: 408419 - DNA, 20 bp, human
gatgtcctctaaggttggcc

SEQ ID NO: 408420 - DNA, 20 bp, human
ggtaattcatggccaggcgt

SEQ ID NO: 408421 - DNA, 20 bp, human
gcagacgcccgccaacaccc

SEQ ID NO: 408422 - DNA, 20 bp, human
gcgtcatatgcatttataaa

SEQ ID NO: 408423 - DNA, 20 bp, human
gttatgaccttccttgctgc

SEQ ID NO: 408424 - DNA, 20 bp, human
ggtgaggcgggtggataatg

SEQ ID NO: 408425 - DNA, 20 bp, human
gtaaacaaagcaaaaataac

SEQ ID NO: 408426 - DNA, 20 bp, human
gctgcagggttctcagggaa

SEQ ID NO: 408427 - DNA, 20 bp, human
gcttcctccctgaacggacc

SEQ ID NO: 408428 - DNA, 20 bp, human
gctgtcactcagggcattag

SEQ ID NO: 408429 - DNA, 20 bp, human
ggagtgaaatccaagctgca

SEQ ID NO: 408430 - DNA, 20 bp, human
gtgtgagcctggtccgttca

SEQ ID NO: 408431 - DNA, 20 bp, human
ggagcctggtccgttcaggg

SEQ ID NO: 408432 - DNA, 20 bp, human
gcactcagggcattaggggg

SEQ ID NO: 408433 - DNA, 20 bp, human
gagccaggagctcataaaat

SEQ ID NO: 408434 - DNA, 20 bp, human
gtgtcaggctacccgctcaa

SEQ ID NO: 408435 - DNA, 20 bp, human
gggcatacgaccttatacgc

SEQ ID NO: 408436 - DNA, 20 bp, human
gactcaggacctgaggggtg

SEQ ID NO: 408437 - DNA, 20 bp, human
ggattaaaaccccacccctc

SEQ ID NO: 408438 - DNA, 20 bp, human
gaagccaggcccacccaaca

SEQ ID NO: 408439 - DNA, 20 bp, human
ggctgtcggggtagggacta

SEQ ID NO: 408440 - DNA, 20 bp, human
gggcaaataccctgttgggt

SEQ ID NO: 408441 - DNA, 20 bp, human
gctaaagagcgcgtgagtga

SEQ ID NO: 408442 - DNA, 20 bp, human
gataccctgttgggtgggcc

SEQ ID NO: 408443 - DNA, 20 bp, human
gcaggtgaactctgggtgta

SEQ ID NO: 408444 - DNA, 20 bp, human
ggcatgtgaccttacacaga

SEQ ID NO: 408445 - DNA, 20 bp, human
gtggtggggattgtagatcc

SEQ ID NO: 408446 - DNA, 20 bp, human
gggtgcgcagccaaggtaga

SEQ ID NO: 408447 - DNA, 20 bp, human
ggcctcccttgcgacatctt

SEQ ID NO: 408448 - DNA, 20 bp, human
gtggaactgtatccaatcat

SEQ ID NO: 408449 - DNA, 20 bp, human
ggacaccgccccctctacct

SEQ ID NO: 408450 - DNA, 20 bp, human
gcaatcatgggcgctagagt

SEQ ID NO: 408451 - DNA, 20 bp, human
gaaggaagcgcgccagaaaa

SEQ ID NO: 408452 - DNA, 20 bp, human
gtgcctgctcaaaagactgg

SEQ ID NO: 408453 - DNA, 20 bp, human
gaagggccagtttccaattc

SEQ ID NO: 408454 - DNA, 20 bp, human
ggcgcgccagaaaagggttc

SEQ ID NO: 408455 - DNA, 20 bp, human
ggccagtttccaattcagga

SEQ ID NO: 408456 - DNA, 20 bp, human
gggaggacaacctgctgatg

SEQ ID NO: 408457 - DNA, 20 bp, human
ggccctgcaaggtctgacaa

SEQ ID NO: 408458 - DNA, 20 bp, human
gtcctcccgtccagccatct

SEQ ID NO: 408459 - DNA, 20 bp, human
ggatgtggattgcagtgaac

SEQ ID NO: 408460 - DNA, 20 bp, human
gccccagtgggagtgagaga

SEQ ID NO: 408461 - DNA, 20 bp, human
gtgcctacctgtggcaactc

SEQ ID NO: 408462 - DNA, 20 bp, human
gcactgcaatccacatcagc

SEQ ID NO: 408463 - DNA, 20 bp, human
ggccaagctgagatgaagat

SEQ ID NO: 408464 - DNA, 20 bp, human
gctacctgtggcaactctgg

SEQ ID NO: 408465 - DNA, 20 bp, human
gtgtcctccagagttgccac

SEQ ID NO: 408466 - DNA, 20 bp, human
ggggtggtgcggagattccc

SEQ ID NO: 408467 - DNA, 20 bp, human
ggctgcttcctcttgggggg

SEQ ID NO: 408468 - DNA, 20 bp, human
gggccagtggagctcgtttc

SEQ ID NO: 408469 - DNA, 20 bp, human
gcagacgctgcttcctcttg

SEQ ID NO: 408470 - DNA, 20 bp, human
gctacacccgggaggagtcc

SEQ ID NO: 408471 - DNA, 20 bp, human
ggcaatagagataccaaccc

SEQ ID NO: 408472 - DNA, 20 bp, human
gccgggtgtaggccatccgt

SEQ ID NO: 408473 - DNA, 20 bp, human
gagcagcgtctgacgtcttc

SEQ ID NO: 408474 - DNA, 20 bp, human
gggagtccaggaactctagg

SEQ ID NO: 408475 - DNA, 20 bp, human
gcgagctccactggccttat

SEQ ID NO: 408476 - DNA, 20 bp, human
ggaccccggcgcagccaatg

SEQ ID NO: 408477 - DNA, 20 bp, human
ggaaaaggggagcccttaaa

SEQ ID NO: 408478 - DNA, 20 bp, human
gagcataagaggactgtgcg

SEQ ID NO: 408479 - DNA, 20 bp, human
ggggcgtggcaacaaagcgc

SEQ ID NO: 408480 - DNA, 20 bp, human
ggggacctaaaggttgggaa

SEQ ID NO: 408481 - DNA, 20 bp, human
gtgaagatacctctccccat

SEQ ID NO: 408482 - DNA, 20 bp, human
gcccagacctggagcgcgga

SEQ ID NO: 408483 - DNA, 20 bp, human
ggggtgctcccccttccagt

SEQ ID NO: 408484 - DNA, 20 bp, human
gggggagaggtatcttcaga

SEQ ID NO: 408485 - DNA, 20 bp, human
gcccagcttgcctactggaa

SEQ ID NO: 408486 - DNA, 20 bp, human
gaccacccttcaattgtcac

SEQ ID NO: 408487 - DNA, 20 bp, human
gtgtctgggaagtagaggag

SEQ ID NO: 408488 - DNA, 20 bp, human
gacacccgggttaagggacc

SEQ ID NO: 408489 - DNA, 20 bp, human
ggcagcctgtgacaattgaa

SEQ ID NO: 408490 - DNA, 20 bp, human
ggcctgtgacaattgaaggg

SEQ ID NO: 408491 - DNA, 20 bp, human
gcaaccgaagtagcagggac

SEQ ID NO: 408492 - DNA, 20 bp, human
gtagcagggactggctgcta

SEQ ID NO: 408493 - DNA, 20 bp, human
gccttccgggtcccttaacc

SEQ ID NO: 408494 - DNA, 20 bp, human
gtggtcgccatattttcaga

SEQ ID NO: 408495 - DNA, 20 bp, human
gatacgcaacggccgatgat

SEQ ID NO: 408496 - DNA, 20 bp, human
gtgaacgcgcgtattgggga

SEQ ID NO: 408497 - DNA, 20 bp, human
gaagctggactgctaggatc

SEQ ID NO: 408498 - DNA, 20 bp, human
ggaagatcgagcgttctgat

SEQ ID NO: 408499 - DNA, 20 bp, human
gccaagagctgcataagggc

SEQ ID NO: 408500 - DNA, 20 bp, human
gccaatgaacgcgcgtattg

SEQ ID NO: 408501 - DNA, 20 bp, human
gctaggatcaggcgactaca

SEQ ID NO: 408502 - DNA, 20 bp, human
ggcagcgccattacacttga

SEQ ID NO: 408503 - DNA, 20 bp, human
ggattgggtgctagcaaagg

SEQ ID NO: 408504 - DNA, 20 bp, human
gtctgattgggtgctagcaa

SEQ ID NO: 408505 - DNA, 20 bp, human
gcgaagccaagagctgcata

SEQ ID NO: 408506 - DNA, 20 bp, human
gcgaccccctcagtgtctgg

SEQ ID NO: 408507 - DNA, 20 bp, human
gctgaccacagcttttccaa

SEQ ID NO: 408508 - DNA, 20 bp, human
gtggtcagaatccgtctgtc

SEQ ID NO: 408509 - DNA, 20 bp, human
gcagggacaaaggtgaggta

SEQ ID NO: 408510 - DNA, 20 bp, human
gtccgctgtcactcagacat

SEQ ID NO: 408511 - DNA, 20 bp, human
ggcaggaaggagctcgccct

SEQ ID NO: 408512 - DNA, 20 bp, human
ggctgtcactcagacatggg

SEQ ID NO: 408513 - DNA, 20 bp, human
gctcgcccttggaaaagctg

SEQ ID NO: 408514 - DNA, 20 bp, human
gcaatcagaggcattgtggc

SEQ ID NO: 408515 - DNA, 20 bp, human
gcagtgtctggaggaacagt

SEQ ID NO: 408516 - DNA, 20 bp, human
gtcccagcatgccacgccag

SEQ ID NO: 408517 - DNA, 20 bp, human
gacaacgcaagcgacctggc

SEQ ID NO: 408518 - DNA, 20 bp, human
gaccgctggcgtggcatgct

SEQ ID NO: 408519 - DNA, 20 bp, human
gcgccctactactccaggat

SEQ ID NO: 408520 - DNA, 20 bp, human
gagcggtcaaagcttattgg

SEQ ID NO: 408521 - DNA, 20 bp, human
gcggaaagaaatcccaccgt

SEQ ID NO: 408522 - DNA, 20 bp, human
gcgagtggccctgagacttg

SEQ ID NO: 408523 - DNA, 20 bp, human
gtgccacaacgcaagcgacc

SEQ ID NO: 408524 - DNA, 20 bp, human
ggccagcggtcaaagcttat

SEQ ID NO: 408525 - DNA, 20 bp, human
gaagaaatcccaccgtagga

SEQ ID NO: 408526 - DNA, 20 bp, human
gccccgcggcagttgtggtt

SEQ ID NO: 408527 - DNA, 20 bp, human
gcgcgcgggcgacttgagtc

SEQ ID NO: 408528 - DNA, 20 bp, human
gcaacgcccgccgggaatcg

SEQ ID NO: 408529 - DNA, 20 bp, human
ggccccgcgcaacgcccgcc

SEQ ID NO: 408530 - DNA, 20 bp, human
gaagtcgcccgcgcgtgtcg

SEQ ID NO: 408531 - DNA, 20 bp, human
gcacccaaccacaactgccg

SEQ ID NO: 408532 - DNA, 20 bp, human
gactgtgagggggaaatcga

SEQ ID NO: 408533 - DNA, 20 bp, human
gaggcccgcgccccagaggg

SEQ ID NO: 408534 - DNA, 20 bp, human
gcgactcgcccctccctctg

SEQ ID NO: 408535 - DNA, 20 bp, human
gcggagccccgcggcagttg

SEQ ID NO: 408536 - DNA, 20 bp, human
gctagcgccgctgactggat

SEQ ID NO: 408537 - DNA, 20 bp, human
gtggagccccatccagtcag

SEQ ID NO: 408538 - DNA, 20 bp, human
gaggaggtgcgatcagacac

SEQ ID NO: 408539 - DNA, 20 bp, human
ggaggaatgtcgcttcaaaa

SEQ ID NO: 408540 - DNA, 20 bp, human
ggcgtgcagccagagaggaa

SEQ ID NO: 408541 - DNA, 20 bp, human
gcgacctggacccacctgcc

SEQ ID NO: 408542 - DNA, 20 bp, human
gactcaagacctgagggggt

SEQ ID NO: 408543 - DNA, 20 bp, human
gtcctcacggcacttcgacc

SEQ ID NO: 408544 - DNA, 20 bp, human
gacaagagtgacaggttttt

SEQ ID NO: 408545 - DNA, 20 bp, human
gatcaggcgtgcagccagag

SEQ ID NO: 408546 - DNA, 20 bp, human
gaggacagcgcgctcggcgg

SEQ ID NO: 408547 - DNA, 20 bp, human
gctggggtgtcgattcggga

SEQ ID NO: 408548 - DNA, 20 bp, human
gccgctgcccagagcgtcgc

SEQ ID NO: 408549 - DNA, 20 bp, human
ggccccggcttctcttgctg

SEQ ID NO: 408550 - DNA, 20 bp, human
ggagcgggacggcccagccg

SEQ ID NO: 408551 - DNA, 20 bp, human
ggcgtcgccggaagtgccga

SEQ ID NO: 408552 - DNA, 20 bp, human
gctgcccggcaggaaggact

SEQ ID NO: 408553 - DNA, 20 bp, human
ggacggggcggggaccgtag

SEQ ID NO: 408554 - DNA, 20 bp, human
gcgggcaaccgatgagctga

SEQ ID NO: 408555 - DNA, 20 bp, human
gagctgaaggcgccgcggct

SEQ ID NO: 408556 - DNA, 20 bp, human
gctggcccgagctacctcca

SEQ ID NO: 408557 - DNA, 20 bp, human
gtgcggtggcaggaagtccc

SEQ ID NO: 408558 - DNA, 20 bp, human
gcccggctgactcctcactg

SEQ ID NO: 408559 - DNA, 20 bp, human
gcgggccaggctaggactcc

SEQ ID NO: 408560 - DNA, 20 bp, human
gggcgccctggaggtagctc

SEQ ID NO: 408561 - DNA, 20 bp, human
gccccgggaactacaaatcg

SEQ ID NO: 408562 - DNA, 20 bp, human
gctcactggggcttcctgta

SEQ ID NO: 408563 - DNA, 20 bp, human
gctcaaggagcccgctgtcc

SEQ ID NO: 408564 - DNA, 20 bp, human
gggcgtggggcaagacccgc

SEQ ID NO: 408565 - DNA, 20 bp, human
gagcgcctttcctcctgtcc

SEQ ID NO: 408566 - DNA, 20 bp, human
ggggcaggggcagtggtcta

SEQ ID NO: 408567 - DNA, 20 bp, human
ggagcagggtatatttactt

SEQ ID NO: 408568 - DNA, 20 bp, human
ggcactgttttgtatctcta

SEQ ID NO: 408569 - DNA, 20 bp, human
ggtatctctagggggacgta

SEQ ID NO: 408570 - DNA, 20 bp, human
gccactttcccacaagagca

SEQ ID NO: 408571 - DNA, 20 bp, human
ggagatacaaaacagtgctc

SEQ ID NO: 408572 - DNA, 20 bp, human
gcaccccttggctggctaac

SEQ ID NO: 408573 - DNA, 20 bp, human
gagttgttacttataattga

SEQ ID NO: 408574 - DNA, 20 bp, human
gctttcttgaatttgagatg

SEQ ID NO: 408575 - DNA, 20 bp, human
gaaagcctgttagccagcca

SEQ ID NO: 408576 - DNA, 20 bp, human
ggcaaatggcgtatggggcg

SEQ ID NO: 408577 - DNA, 20 bp, human
ggcgctgcaaatggcgtatg

SEQ ID NO: 408578 - DNA, 20 bp, human
ggcctgggaagcgggacttg

SEQ ID NO: 408579 - DNA, 20 bp, human
gggaactggggctagaccta

SEQ ID NO: 408580 - DNA, 20 bp, human
gacctcaagtcccgcttccc

SEQ ID NO: 408581 - DNA, 20 bp, human
gctgccccgggtcgggtccg

SEQ ID NO: 408582 - DNA, 20 bp, human
gagacgcgggcggaggcgta

SEQ ID NO: 408583 - DNA, 20 bp, human
gctcccgcggacccgacccg

SEQ ID NO: 408584 - DNA, 20 bp, human
ggcggaggcgtagggtgaca

SEQ ID NO: 408585 - DNA, 20 bp, human
ggggatgcaaaggagcgcca

SEQ ID NO: 408586 - DNA, 20 bp, human
gtggagtcagagccgaggag

SEQ ID NO: 408587 - DNA, 20 bp, human
ggcccgagggacaagaacct

SEQ ID NO: 408588 - DNA, 20 bp, human
gtgggcttctggtcccgccc

SEQ ID NO: 408589 - DNA, 20 bp, human
ggcgccagccccgcctatct

SEQ ID NO: 408590 - DNA, 20 bp, human
gcgggaccagaagcccagat

SEQ ID NO: 408591 - DNA, 20 bp, human
gagtccgcaactcccggccc

SEQ ID NO: 408592 - DNA, 20 bp, human
ggcggggtacagtcagaggc

SEQ ID NO: 408593 - DNA, 20 bp, human
ggtgggcggtgcctgagcag

SEQ ID NO: 408594 - DNA, 20 bp, human
ggaccagaagcccagatagg

SEQ ID NO: 408595 - DNA, 20 bp, human
gaagcccagataggcggggc

SEQ ID NO: 408596 - DNA, 20 bp, human
gtcgccgcgcgaagccgccc

SEQ ID NO: 408597 - DNA, 20 bp, human
gggaggtcccggcgtctcgg

SEQ ID NO: 408598 - DNA, 20 bp, human
gcgcgcggcgacaaccggcg

SEQ ID NO: 408599 - DNA, 20 bp, human
gggacacaaggacccgaatc

SEQ ID NO: 408600 - DNA, 20 bp, human
gggcttcgcgcggcgacaac

SEQ ID NO: 408601 - DNA, 20 bp, human
gagacgccgggacctccgcg

SEQ ID NO: 408602 - DNA, 20 bp, human
gccagcacgcgcttcgggga

SEQ ID NO: 408603 - DNA, 20 bp, human
gcggcgacaaccggcgcggt

SEQ ID NO: 408604 - DNA, 20 bp, human
ggcgcggcctagagtggtcc

SEQ ID NO: 408605 - DNA, 20 bp, human
ggaagcgcgtgctggacgtg

SEQ ID NO: 408606 - DNA, 20 bp, human
gccccgcagagccagactga

SEQ ID NO: 408607 - DNA, 20 bp, human
gacgccccagcacctctgat

SEQ ID NO: 408608 - DNA, 20 bp, human
gtcagctgtcactcagatgt

SEQ ID NO: 408609 - DNA, 20 bp, human
ggcactgcccacagttcatc

SEQ ID NO: 408610 - DNA, 20 bp, human
gatccgtcagtctggctctg

SEQ ID NO: 408611 - DNA, 20 bp, human
gcccacagttcatccggaaa

SEQ ID NO: 408612 - DNA, 20 bp, human
gcattttcacaaggggatgg

SEQ ID NO: 408613 - DNA, 20 bp, human
gtctgattggatgaaatact

SEQ ID NO: 408614 - DNA, 20 bp, human
gtcatccaatcagaggtgct

SEQ ID NO: 408615 - DNA, 20 bp, human
gtgaagttgacagtttactt

SEQ ID NO: 408616 - DNA, 20 bp, human
ggccccgcccaccttctcgt

SEQ ID NO: 408617 - DNA, 20 bp, human
ggaggcgagagcggtcagga

SEQ ID NO: 408618 - DNA, 20 bp, human
ggtggagccaacgagaaggt

SEQ ID NO: 408619 - DNA, 20 bp, human
ggcctgatcgaggtagaggc

SEQ ID NO: 408620 - DNA, 20 bp, human
ggcccgaaaaatagagtcgc

SEQ ID NO: 408621 - DNA, 20 bp, human
gtcccagcgactctattttt

SEQ ID NO: 408622 - DNA, 20 bp, human
gcgggctttggaggcgagag

SEQ ID NO: 408623 - DNA, 20 bp, human
ggactctatttttcgggctt

SEQ ID NO: 408624 - DNA, 20 bp, human
gccccgcctctacctcgatc

SEQ ID NO: 408625 - DNA, 20 bp, human
gtttggaggcgagagcggtc

SEQ ID NO: 408626 - DNA, 20 bp, human
gtgaggccggctccatcggt

SEQ ID NO: 408627 - DNA, 20 bp, human
ggggctgaggccggctccat

SEQ ID NO: 408628 - DNA, 20 bp, human
ggggcggggagagccttaaa

SEQ ID NO: 408629 - DNA, 20 bp, human
ggcgaggaaggcccagtcgg

SEQ ID NO: 408630 - DNA, 20 bp, human
ggggagggatcgcacggcgc

SEQ ID NO: 408631 - DNA, 20 bp, human
ggcctgggacgggacttctc

SEQ ID NO: 408632 - DNA, 20 bp, human
gatcggcagccacacttcaa

SEQ ID NO: 408633 - DNA, 20 bp, human
gcgcccgccgtgtgtgtccg

SEQ ID NO: 408634 - DNA, 20 bp, human
ggccgccgctgcctcggtct

SEQ ID NO: 408635 - DNA, 20 bp, human
ggcagctctcgccgggaccc

SEQ ID NO: 408636 - DNA, 20 bp, human
gggcccgcaaccccgcgctc

SEQ ID NO: 408637 - DNA, 20 bp, human
gcggggactcgcggccgcaa

SEQ ID NO: 408638 - DNA, 20 bp, human
gccggccggtccagcgaagg

SEQ ID NO: 408639 - DNA, 20 bp, human
ggggccgggcccgggacagg

SEQ ID NO: 408640 - DNA, 20 bp, human
gcgttcaaagagtgtgagat

SEQ ID NO: 408641 - DNA, 20 bp, human
gcgcctgcatgcctgagcgc

SEQ ID NO: 408642 - DNA, 20 bp, human
gctgcagcgcggcgcccccc

SEQ ID NO: 408643 - DNA, 20 bp, human
gccaaggcagctcaatcgca

SEQ ID NO: 408644 - DNA, 20 bp, human
gcccccgctcagacaaaacc

SEQ ID NO: 408645 - DNA, 20 bp, human
gctactcccctccctccgga

SEQ ID NO: 408646 - DNA, 20 bp, human
gaaataaaatacagagacac

SEQ ID NO: 408647 - DNA, 20 bp, human
ggtaatttttaactaaacga

SEQ ID NO: 408648 - DNA, 20 bp, human
gttacataagatagcacctt

SEQ ID NO: 408649 - DNA, 20 bp, human
gggtgctatcttatgtaaat

SEQ ID NO: 408650 - DNA, 20 bp, human
gtttttaactaaacgaggga

SEQ ID NO: 408651 - DNA, 20 bp, human
ggaataaatcagtaatcaag

SEQ ID NO: 408652 - DNA, 20 bp, human
gatgaaattggaactaactt

SEQ ID NO: 408653 - DNA, 20 bp, human
gaaggagtaaagagatgaag

SEQ ID NO: 408654 - DNA, 20 bp, human
gaacttcagaaactctaaaa

SEQ ID NO: 408655 - DNA, 20 bp, human
gaaaactatctttatgtttt

SEQ ID NO: 408656 - DNA, 20 bp, human
gtgagggaaagaagggtggt

SEQ ID NO: 408657 - DNA, 20 bp, human
ggggtcatatcaatgggcag

SEQ ID NO: 408658 - DNA, 20 bp, human
ggacagaagtcaggtttgag

SEQ ID NO: 408659 - DNA, 20 bp, human
gagtggcagtgagggaaaga

SEQ ID NO: 408660 - DNA, 20 bp, human
gaagaagggtggtaggatgt

SEQ ID NO: 408661 - DNA, 20 bp, human
ggtgtagcacccctttcata

SEQ ID NO: 408662 - DNA, 20 bp, human
ggaccctattgacagaagtc

SEQ ID NO: 408663 - DNA, 20 bp, human
gttcagggaaaccctatgaa

SEQ ID NO: 408664 - DNA, 20 bp, human
gcaggtttgagtggcagtga

SEQ ID NO: 408665 - DNA, 20 bp, human
gaattaggggtcatatcaat

SEQ ID NO: 408666 - DNA, 20 bp, human
gagaagagcatgagcagggc

SEQ ID NO: 408667 - DNA, 20 bp, human
gaggtagaagagcatgagca

SEQ ID NO: 408668 - DNA, 20 bp, human
gcactagaaatgtcaggtga

SEQ ID NO: 408669 - DNA, 20 bp, human
gctgacatttctagtgggta

SEQ ID NO: 408670 - DNA, 20 bp, human
gtgtgtggtagttactgcat

SEQ ID NO: 408671 - DNA, 20 bp, human
ggtagtaatagccaaagtct

SEQ ID NO: 408672 - DNA, 20 bp, human
gtgactagtagttactatat

SEQ ID NO: 408673 - DNA, 20 bp, human
gcaagattctagatctgcat

SEQ ID NO: 408674 - DNA, 20 bp, human
gactttggctattactacta

SEQ ID NO: 408675 - DNA, 20 bp, human
gcatcacagaaaatcgtgtt

SEQ ID NO: 408676 - DNA, 20 bp, human
gagaagagcatgagcagggc

SEQ ID NO: 408677 - DNA, 20 bp, human
gaggtagaagagcatgagca

SEQ ID NO: 408678 - DNA, 20 bp, human
gcactagaaatgtcaggtga

SEQ ID NO: 408679 - DNA, 20 bp, human
gctgacatttctagtgggta

SEQ ID NO: 408680 - DNA, 20 bp, human
gtgtgtggtagttactgcat

SEQ ID NO: 408681 - DNA, 20 bp, human
ggtagtaatagccaaagtct

SEQ ID NO: 408682 - DNA, 20 bp, human
gtgactagtagttactatat

SEQ ID NO: 408683 - DNA, 20 bp, human
gcaagattctagatctgcat

SEQ ID NO: 408684 - DNA, 20 bp, human
gactttggctattactacta

SEQ ID NO: 408685 - DNA, 20 bp, human
gcatcacagaaaatcgtgtt

SEQ ID NO: 408686 - DNA, 20 bp, human
gtgaaaataaaagtggagta

SEQ ID NO: 408687 - DNA, 20 bp, human
gagtggagtaaggcttcaga

SEQ ID NO: 408688 - DNA, 20 bp, human
gctatggttgctaataaaga

SEQ ID NO: 408689 - DNA, 20 bp, human
gagttgagtgaaaataaaag

SEQ ID NO: 408690 - DNA, 20 bp, human
gtgtatttccccttggaact

SEQ ID NO: 408691 - DNA, 20 bp, human
gtgacttttgtatttcccct

SEQ ID NO: 408692 - DNA, 20 bp, human
gaacagacacaaacatgcag

SEQ ID NO: 408693 - DNA, 20 bp, human
gggcctctcctcttttcccg

SEQ ID NO: 408694 - DNA, 20 bp, human
ggtaaggcttcagaaggctg

SEQ ID NO: 408695 - DNA, 20 bp, human
gtgaaaattgtgcacaagac

SEQ ID NO: 408696 - DNA, 20 bp, human
ggacagaagtcaggtttgag

SEQ ID NO: 408697 - DNA, 20 bp, human
ggggtcatatcaatgggcag

SEQ ID NO: 408698 - DNA, 20 bp, human
gtgagggaaagaagggtggt

SEQ ID NO: 408699 - DNA, 20 bp, human
gaagaagggtggtaggatgt

SEQ ID NO: 408700 - DNA, 20 bp, human
gagtggcagtgagggaaaga

SEQ ID NO: 408701 - DNA, 20 bp, human
ggaccctattgacagaagtc

SEQ ID NO: 408702 - DNA, 20 bp, human
gaaacctgacttctgtcaat

SEQ ID NO: 408703 - DNA, 20 bp, human
gttcagggaaaccctatgaa

SEQ ID NO: 408704 - DNA, 20 bp, human
gcaggtttgagtggcagtga

SEQ ID NO: 408705 - DNA, 20 bp, human
gaattaggggtcatatcaat

SEQ ID NO: 408706 - DNA, 20 bp, human
gccctcgcgcttatgtaata

SEQ ID NO: 408707 - DNA, 20 bp, human
gcgcaggcgtgcgagcgggg

SEQ ID NO: 408708 - DNA, 20 bp, human
gccgcccatgtgcctttctg

SEQ ID NO: 408709 - DNA, 20 bp, human
gcgctcgcacgcctgcgccc

SEQ ID NO: 408710 - DNA, 20 bp, human
gcacgccgcgccgctctcct

SEQ ID NO: 408711 - DNA, 20 bp, human
gcagccgcagaaaggcacat

SEQ ID NO: 408712 - DNA, 20 bp, human
gcgagcgcgccggagaggag

SEQ ID NO: 408713 - DNA, 20 bp, human
gctggctgacacaaacttca

SEQ ID NO: 408714 - DNA, 20 bp, human
gcggaccgagcgcgccggag

SEQ ID NO: 408715 - DNA, 20 bp, human
gcgggatcacgtggctccca

SEQ ID NO: 408716 - DNA, 20 bp, human
gcgcttggctgtgaccgggg

SEQ ID NO: 408717 - DNA, 20 bp, human
ggcggaaccacaagcggtgc

SEQ ID NO: 408718 - DNA, 20 bp, human
ggctgcggcggaaccacaag

SEQ ID NO: 408719 - DNA, 20 bp, human
gctaggagcccacgtctcgg

SEQ ID NO: 408720 - DNA, 20 bp, human
gtggcgcttggctgtgaccg

SEQ ID NO: 408721 - DNA, 20 bp, human
gcctcgccccgcaccgcttg

SEQ ID NO: 408722 - DNA, 20 bp, human
gcctctaggagcccacgtct

SEQ ID NO: 408723 - DNA, 20 bp, human
gtagaggggccggaagcttt

SEQ ID NO: 408724 - DNA, 20 bp, human
gtggttccgccgcagccggc

SEQ ID NO: 408725 - DNA, 20 bp, human
ggcggcctggacggcctgga

SEQ ID NO: 408726 - DNA, 20 bp, human
gtaaaggcaaacaccctctc

SEQ ID NO: 408727 - DNA, 20 bp, human
gggcaaacaccctctcgggt

SEQ ID NO: 408728 - DNA, 20 bp, human
gacacgcagctggaccggac

SEQ ID NO: 408729 - DNA, 20 bp, human
gatcacatcttccgtccctc

SEQ ID NO: 408730 - DNA, 20 bp, human
gtgttaaaacccgccccttc

SEQ ID NO: 408731 - DNA, 20 bp, human
ggttcactcagacacgcagc

SEQ ID NO: 408732 - DNA, 20 bp, human
gaaattttttttagaacaat

SEQ ID NO: 408733 - DNA, 20 bp, human
gctcagacacgcagctggac

SEQ ID NO: 408734 - DNA, 20 bp, human
gatatagcatattatttata

SEQ ID NO: 408735 - DNA, 20 bp, human
gtgagccaggcccacccgag

SEQ ID NO: 408736 - DNA, 20 bp, human
gaggaagcccggcccgcgaa

SEQ ID NO: 408737 - DNA, 20 bp, human
gagtgacaggagaagcaatg

SEQ ID NO: 408738 - DNA, 20 bp, human
gcccggcccgcgaagggcag

SEQ ID NO: 408739 - DNA, 20 bp, human
gctgtcactcagtaccaagg

SEQ ID NO: 408740 - DNA, 20 bp, human
gggagaagcaatgcggtatg

SEQ ID NO: 408741 - DNA, 20 bp, human
ggattcaagtcctgccccct

SEQ ID NO: 408742 - DNA, 20 bp, human
gtaaatgcaaatatcctccc

SEQ ID NO: 408743 - DNA, 20 bp, human
gtgaatcatcacccaatcag

SEQ ID NO: 408744 - DNA, 20 bp, human
gcactcagtaccaagggggc

SEQ ID NO: 408745 - DNA, 20 bp, human
ggtaaccttctgtgccgggg

SEQ ID NO: 408746 - DNA, 20 bp, human
ggcgagagggaggattgagg

SEQ ID NO: 408747 - DNA, 20 bp, human
gtgagatggaggagctcagt

SEQ ID NO: 408748 - DNA, 20 bp, human
gggctccgctcggctccact

SEQ ID NO: 408749 - DNA, 20 bp, human
gcatctcacagaggactccg

SEQ ID NO: 408750 - DNA, 20 bp, human
ggggctcggctgaaaaaagc

SEQ ID NO: 408751 - DNA, 20 bp, human
gagtccggcgcagtccgcgc

SEQ ID NO: 408752 - DNA, 20 bp, human
gaggagagagaagagacgga

SEQ ID NO: 408753 - DNA, 20 bp, human
ggtggcgcgcgcgggtttct

SEQ ID NO: 408754 - DNA, 20 bp, human
gagggtggaaagaaagacgg

SEQ ID NO: 408755 - DNA, 20 bp, human
gcgacggcagtgcgcctgcg

SEQ ID NO: 408756 - DNA, 20 bp, human
gctgacaagagggaggtgtt

SEQ ID NO: 408757 - DNA, 20 bp, human
ggaggcagggctgacgtgaa

SEQ ID NO: 408758 - DNA, 20 bp, human
gctcctaagccagctcgcag

SEQ ID NO: 408759 - DNA, 20 bp, human
gacttgggctgacaagaggg

SEQ ID NO: 408760 - DNA, 20 bp, human
gggaagccaggggcgtcctc

SEQ ID NO: 408761 - DNA, 20 bp, human
gtcattcccttcttccaggg

SEQ ID NO: 408762 - DNA, 20 bp, human
ggccctgtccggtacaaagg

SEQ ID NO: 408763 - DNA, 20 bp, human
gttcctctgcgagctggctt

SEQ ID NO: 408764 - DNA, 20 bp, human
gtcaggctttcaattcgagt

SEQ ID NO: 408765 - DNA, 20 bp, human
ggccccctttgtaccggaca

SEQ ID NO: 408766 - DNA, 20 bp, human
gaccccgccggcttgaggcg

SEQ ID NO: 408767 - DNA, 20 bp, human
gcaggggcgcgccgagatct

SEQ ID NO: 408768 - DNA, 20 bp, human
gacgcagagtagattgtgat

SEQ ID NO: 408769 - DNA, 20 bp, human
ggccccctaccctgcagcaa

SEQ ID NO: 408770 - DNA, 20 bp, human
gcgtgcgcgagacccccctt

SEQ ID NO: 408771 - DNA, 20 bp, human
gcatgtcagcagcaatataa

SEQ ID NO: 408772 - DNA, 20 bp, human
gagcccccgcctcaagccgg

SEQ ID NO: 408773 - DNA, 20 bp, human
gtctcgcactaacctagcgc

SEQ ID NO: 408774 - DNA, 20 bp, human
gggttagtgcgagaccccgc

SEQ ID NO: 408775 - DNA, 20 bp, human
gggcagctgtggatccctta

SEQ ID NO: 408776 - DNA, 20 bp, human
gggaccggaaaattctggga

SEQ ID NO: 408777 - DNA, 20 bp, human
gcatgcgtattggggatctg

SEQ ID NO: 408778 - DNA, 20 bp, human
ggccccaggagcccagtcac

SEQ ID NO: 408779 - DNA, 20 bp, human
ggggaaggaggggtgattcc

SEQ ID NO: 408780 - DNA, 20 bp, human
gcaccgggcgtcattggctc

SEQ ID NO: 408781 - DNA, 20 bp, human
gccaacgcttctaattggca

SEQ ID NO: 408782 - DNA, 20 bp, human
gctgggaaggctcgaggccg

SEQ ID NO: 408783 - DNA, 20 bp, human
gtcccgggtctgtttttcat

SEQ ID NO: 408784 - DNA, 20 bp, human
gccgccgcggtggacccggg

SEQ ID NO: 408785 - DNA, 20 bp, human
gatgcggaccccggggaccg

SEQ ID NO: 408786 - DNA, 20 bp, human
gactcagggcacgagaaggt

SEQ ID NO: 408787 - DNA, 20 bp, human
gtgtcactcagggcacgaga

SEQ ID NO: 408788 - DNA, 20 bp, human
gtttaaaggcaaattccctc

SEQ ID NO: 408789 - DNA, 20 bp, human
gaatatatggctcttcacaa

SEQ ID NO: 408790 - DNA, 20 bp, human
gttctggtctttgagcaggc

SEQ ID NO: 408791 - DNA, 20 bp, human
gggctgagattttagaaagg

SEQ ID NO: 408792 - DNA, 20 bp, human
gttctttctggtctttgagc

SEQ ID NO: 408793 - DNA, 20 bp, human
gactttacacacaagtttaa

SEQ ID NO: 408794 - DNA, 20 bp, human
gaaaacttaaaattcacata

SEQ ID NO: 408795 - DNA, 20 bp, human
gcaaagaccagaaagaagcc

SEQ ID NO: 408796 - DNA, 20 bp, human
gaaagcaaaagtaacaggtt

SEQ ID NO: 408797 - DNA, 20 bp, human
gagaacaggacgcttccgta

SEQ ID NO: 408798 - DNA, 20 bp, human
gttaaatgcaagtatcctct

SEQ ID NO: 408799 - DNA, 20 bp, human
gtgaataaagcaaaagtaac

SEQ ID NO: 408800 - DNA, 20 bp, human
ggaagaagccttggctgtaa

SEQ ID NO: 408801 - DNA, 20 bp, human
ggacgcttccgtaaggttac

SEQ ID NO: 408802 - DNA, 20 bp, human
ggagcggggaaggcgaaggc

SEQ ID NO: 408803 - DNA, 20 bp, human
gaaaagaacccgtaacctta

SEQ ID NO: 408804 - DNA, 20 bp, human
gttggacagtttctatttca

SEQ ID NO: 408805 - DNA, 20 bp, human
gtgtccaatcaggaatgcag

SEQ ID NO: 408806 - DNA, 20 bp, human
gcggcttgggttcctaaccg

SEQ ID NO: 408807 - DNA, 20 bp, human
gaaaacagaatgtccggctt

SEQ ID NO: 408808 - DNA, 20 bp, human
gcatgaggctctgcggtccc

SEQ ID NO: 408809 - DNA, 20 bp, human
gggctctgcggtccccggtt

SEQ ID NO: 408810 - DNA, 20 bp, human
gtgatggtaacatcattgga

SEQ ID NO: 408811 - DNA, 20 bp, human
gaatggagaaatttcaatag

SEQ ID NO: 408812 - DNA, 20 bp, human
gaatttcaatagaggccaat

SEQ ID NO: 408813 - DNA, 20 bp, human
gtccttgatggtaacatcat

SEQ ID NO: 408814 - DNA, 20 bp, human
gcatgcgcagagagaaaagc

SEQ ID NO: 408815 - DNA, 20 bp, human
gggtaactggactcactgct

SEQ ID NO: 408816 - DNA, 20 bp, human
gcaaaaggacatgagaaacg

SEQ ID NO: 408817 - DNA, 20 bp, human
gtccttttggtataagtttg

SEQ ID NO: 408818 - DNA, 20 bp, human
gtccacaaacttataccaaa

SEQ ID NO: 408819 - DNA, 20 bp, human
gcaaaacctttggacagtgc

SEQ ID NO: 408820 - DNA, 20 bp, human
gaaaaatgtgctgggaatga

SEQ ID NO: 408821 - DNA, 20 bp, human
gtatgccctgcactgtccaa

SEQ ID NO: 408822 - DNA, 20 bp, human
gtatttgcccaccttggcct

SEQ ID NO: 408823 - DNA, 20 bp, human
ggtgggcaaataatgaggta

SEQ ID NO: 408824 - DNA, 20 bp, human
gaaaagtataaatgagtgta

SEQ ID NO: 408825 - DNA, 20 bp, human
gtcatttcacccaaaacctt

SEQ ID NO: 408826 - DNA, 20 bp, human
gaaaaatgtgctgggaatga

SEQ ID NO: 408827 - DNA, 20 bp, human
ggtgggcaaataatgaggta

SEQ ID NO: 408828 - DNA, 20 bp, human
gtatttgcccaccttggcct

SEQ ID NO: 408829 - DNA, 20 bp, human
gtaaatatactttacaggcc

SEQ ID NO: 408830 - DNA, 20 bp, human
gtcatataaatatactttac

SEQ ID NO: 408831 - DNA, 20 bp, human
gatttatagatttcacacaa

SEQ ID NO: 408832 - DNA, 20 bp, human
gccaaggtgggcaaataatg

SEQ ID NO: 408833 - DNA, 20 bp, human
gctcacactgtcaccttttc

SEQ ID NO: 408834 - DNA, 20 bp, human
gtggcttgagctatagtgcc

SEQ ID NO: 408835 - DNA, 20 bp, human
gaatacaaaaaaaatgtgct

SEQ ID NO: 408836 - DNA, 20 bp, human
gaatgaggcgcgcagcagag

SEQ ID NO: 408837 - DNA, 20 bp, human
ggctgtaagtctcccgcctc

SEQ ID NO: 408838 - DNA, 20 bp, human
ggtgacaggctctggcctcc

SEQ ID NO: 408839 - DNA, 20 bp, human
gcctcctggtactttgaggc

SEQ ID NO: 408840 - DNA, 20 bp, human
gctggcctcctggtactttg

SEQ ID NO: 408841 - DNA, 20 bp, human
ggtcaatccagcgctctaat

SEQ ID NO: 408842 - DNA, 20 bp, human
ggattgacaactgccgaatg

SEQ ID NO: 408843 - DNA, 20 bp, human
gccatacacagcactgaatg

SEQ ID NO: 408844 - DNA, 20 bp, human
gctctatccaattagagcgc

SEQ ID NO: 408845 - DNA, 20 bp, human
gggggtgttatctctgtgct

SEQ ID NO: 408846 - DNA, 20 bp, human
gcagaacgagtgagagggcg

SEQ ID NO: 408847 - DNA, 20 bp, human
gctctccggctactcccgat

SEQ ID NO: 408848 - DNA, 20 bp, human
gactcgttctgctttttgaa

SEQ ID NO: 408849 - DNA, 20 bp, human
gaaaaagcagaacgagtgag

SEQ ID NO: 408850 - DNA, 20 bp, human
gccaatcagtggcgtcggag

SEQ ID NO: 408851 - DNA, 20 bp, human
gtttacccaatcagtggcgt

SEQ ID NO: 408852 - DNA, 20 bp, human
gctgctcaggacataactgt

SEQ ID NO: 408853 - DNA, 20 bp, human
gtgctttttgaatgggagac

SEQ ID NO: 408854 - DNA, 20 bp, human
gggagtggaaatcctccaat

SEQ ID NO: 408855 - DNA, 20 bp, human
gtcctccaatcgggagtagc

SEQ ID NO: 408856 - DNA, 20 bp, human
ggggcggcatccgggatctt

SEQ ID NO: 408857 - DNA, 20 bp, human
ggtccaggcttcacgccctc

SEQ ID NO: 408858 - DNA, 20 bp, human
gaggcgcgcagtctgagagg

SEQ ID NO: 408859 - DNA, 20 bp, human
gtctgattggatatgggtcc

SEQ ID NO: 408860 - DNA, 20 bp, human
gcgcgcagtctgagaggagg

SEQ ID NO: 408861 - DNA, 20 bp, human
gggcgcttaatctctgtgct

SEQ ID NO: 408862 - DNA, 20 bp, human
gcggcatccgggatcttcgg

SEQ ID NO: 408863 - DNA, 20 bp, human
gatcaggcgcgcagtctgag

SEQ ID NO: 408864 - DNA, 20 bp, human
gcctcattcagtgcattgta

SEQ ID NO: 408865 - DNA, 20 bp, human
ggtgacagactagtacctcc

SEQ ID NO: 408866 - DNA, 20 bp, human
gcggaagcgcggctgcagca

SEQ ID NO: 408867 - DNA, 20 bp, human
gggacacgctaggctggatg

SEQ ID NO: 408868 - DNA, 20 bp, human
ggcagggcgaggctccaggt

SEQ ID NO: 408869 - DNA, 20 bp, human
gctacctggagccggaagcg

SEQ ID NO: 408870 - DNA, 20 bp, human
gtggcgttattgcttagagg

SEQ ID NO: 408871 - DNA, 20 bp, human
gagccgggaagaatccccga

SEQ ID NO: 408872 - DNA, 20 bp, human
gcactgtcgctgcgacgata

SEQ ID NO: 408873 - DNA, 20 bp, human
gtctgaggtggggaccataa

SEQ ID NO: 408874 - DNA, 20 bp, human
gacctcgatcgctacgcaac

SEQ ID NO: 408875 - DNA, 20 bp, human
gacagtggcgtcacgtccgc

SEQ ID NO: 408876 - DNA, 20 bp, human
gagaagatgtcatcagacgt

SEQ ID NO: 408877 - DNA, 20 bp, human
gttcctcccggagctgaacg

SEQ ID NO: 408878 - DNA, 20 bp, human
gcctaagcctcagccttttc

SEQ ID NO: 408879 - DNA, 20 bp, human
gcactcagggccttagaaag

SEQ ID NO: 408880 - DNA, 20 bp, human
gttaagaaccccgctttcta

SEQ ID NO: 408881 - DNA, 20 bp, human
ggcctcagccttttcaggcg

SEQ ID NO: 408882 - DNA, 20 bp, human
ggatgggcctcgttcagctc

SEQ ID NO: 408883 - DNA, 20 bp, human
gtttttccgtgttctgagat

SEQ ID NO: 408884 - DNA, 20 bp, human
gctttgtctctatctgcggc

SEQ ID NO: 408885 - DNA, 20 bp, human
ggggcctttgtctctatctg

SEQ ID NO: 408886 - DNA, 20 bp, human
gagggtctaaatgtgtgggg

SEQ ID NO: 408887 - DNA, 20 bp, human
gcgatcagggtctaaatgtg

SEQ ID NO: 408888 - DNA, 20 bp, human
gtcacgctagcaccactgat

SEQ ID NO: 408889 - DNA, 20 bp, human
gtagcaccactgattggctg

SEQ ID NO: 408890 - DNA, 20 bp, human
gaggagatgtaatgagacac

SEQ ID NO: 408891 - DNA, 20 bp, human
gcaccgaggagctaatggag

SEQ ID NO: 408892 - DNA, 20 bp, human
gtctagctgcgcacctgatt

SEQ ID NO: 408893 - DNA, 20 bp, human
gcctagaagctaggagacga

SEQ ID NO: 408894 - DNA, 20 bp, human
gaggataacaggggctatgg

SEQ ID NO: 408895 - DNA, 20 bp, human
gggagtcaccgaggagctaa

SEQ ID NO: 408896 - DNA, 20 bp, human
gccagcccagtctgccgcaa

SEQ ID NO: 408897 - DNA, 20 bp, human
gcctccgcctcccaaaccga

SEQ ID NO: 408898 - DNA, 20 bp, human
gccggcctttgcggcagact

SEQ ID NO: 408899 - DNA, 20 bp, human
gcaacggtcctaccacatcc

SEQ ID NO: 408900 - DNA, 20 bp, human
gccatcacgcccggcctttg

SEQ ID NO: 408901 - DNA, 20 bp, human
gaagactagcctggtcgacc

SEQ ID NO: 408902 - DNA, 20 bp, human
gtcaaaaatgacaaatttga

SEQ ID NO: 408903 - DNA, 20 bp, human
gtaagattttactaaaatta

SEQ ID NO: 408904 - DNA, 20 bp, human
gggactgggaccgtccaatc

SEQ ID NO: 408905 - DNA, 20 bp, human
gataacatcttccgtcactc

SEQ ID NO: 408906 - DNA, 20 bp, human
gactcaggatctgaggaggc

SEQ ID NO: 408907 - DNA, 20 bp, human
gttttgtcactcaggatctg

SEQ ID NO: 408908 - DNA, 20 bp, human
gttgggagggaagcccaagc

SEQ ID NO: 408909 - DNA, 20 bp, human
gagactgataggccgcgcgg

SEQ ID NO: 408910 - DNA, 20 bp, human
gggagggaagcccaagcggg

SEQ ID NO: 408911 - DNA, 20 bp, human
gcaacggccccgccacatct

SEQ ID NO: 408912 - DNA, 20 bp, human
gtgaagactgataggccgcg

SEQ ID NO: 408913 - DNA, 20 bp, human
gaaaggcggcatccgagatg

SEQ ID NO: 408914 - DNA, 20 bp, human
gtccctgagctaagtaagcc

SEQ ID NO: 408915 - DNA, 20 bp, human
ggcctggcttacttagctca

SEQ ID NO: 408916 - DNA, 20 bp, human
gcaatcggggacactgggcg

SEQ ID NO: 408917 - DNA, 20 bp, human
gagtcagtaccctctggggt

SEQ ID NO: 408918 - DNA, 20 bp, human
gggcggggggccgtccaatc

SEQ ID NO: 408919 - DNA, 20 bp, human
ggaggaagtcctgcccgaaa

SEQ ID NO: 408920 - DNA, 20 bp, human
ggttaaagtcagtaccctct

SEQ ID NO: 408921 - DNA, 20 bp, human
ggttatccaatcggggacac

SEQ ID NO: 408922 - DNA, 20 bp, human
gaatcaaaagaacatagacc

SEQ ID NO: 408923 - DNA, 20 bp, human
gacatatgatcttacacaaa

SEQ ID NO: 408924 - DNA, 20 bp, human
ggccctgtctgctccagctg

SEQ ID NO: 408925 - DNA, 20 bp, human
gttcctccctgaactgagac

SEQ ID NO: 408926 - DNA, 20 bp, human
gtcactcaaattctgagcgt

SEQ ID NO: 408927 - DNA, 20 bp, human
gccacacagtgcacttaatg

SEQ ID NO: 408928 - DNA, 20 bp, human
gcctgactgaaaatacctgg

SEQ ID NO: 408929 - DNA, 20 bp, human
gagccctgactgaaaatacc

SEQ ID NO: 408930 - DNA, 20 bp, human
gattctgagcgtggggagct

SEQ ID NO: 408931 - DNA, 20 bp, human
gtcttatccaatcagagcgc

SEQ ID NO: 408932 - DNA, 20 bp, human
gacgtacacaatttataaat

SEQ ID NO: 408933 - DNA, 20 bp, human
ggagacagactcgtgcctcc

SEQ ID NO: 408934 - DNA, 20 bp, human
gtcataacctctctgtcctc

SEQ ID NO: 408935 - DNA, 20 bp, human
gtttgagtaggattttaagg

SEQ ID NO: 408936 - DNA, 20 bp, human
gaaaaggcccggtaaaatta

SEQ ID NO: 408937 - DNA, 20 bp, human
gaggcccggtaaaattacgg

SEQ ID NO: 408938 - DNA, 20 bp, human
gaagaagccctgcctgtaaa

SEQ ID NO: 408939 - DNA, 20 bp, human
gggacgcagagaaacacaaa

SEQ ID NO: 408940 - DNA, 20 bp, human
ggacgcctccgtaattttac

SEQ ID NO: 408941 - DNA, 20 bp, human
gtgcaaatatcctctggtgt

SEQ ID NO: 408942 - DNA, 20 bp, human
ggtgatatggtttgactccg

SEQ ID NO: 408943 - DNA, 20 bp, human
gtatggcccctgatgggata

SEQ ID NO: 408944 - DNA, 20 bp, human
gctgaaaccttatcccatca

SEQ ID NO: 408945 - DNA, 20 bp, human
gtattagaaactgtataatc

SEQ ID NO: 408946 - DNA, 20 bp, human
gtggcgccactgattggcta

SEQ ID NO: 408947 - DNA, 20 bp, human
gcttaggattgaaacgggtg

SEQ ID NO: 408948 - DNA, 20 bp, human
gtgtcacttaggattgaaac

SEQ ID NO: 408949 - DNA, 20 bp, human
ggattgaaacgggtggggcc

SEQ ID NO: 408950 - DNA, 20 bp, human
gatcaagtgcgcagctacag

SEQ ID NO: 408951 - DNA, 20 bp, human
gccaggcccccagcacaggg

SEQ ID NO: 408952 - DNA, 20 bp, human
gtgattggacagtttcacgc

SEQ ID NO: 408953 - DNA, 20 bp, human
gactcgcctgaaaacgctgc

SEQ ID NO: 408954 - DNA, 20 bp, human
gcggcctcttcaatatggcg

SEQ ID NO: 408955 - DNA, 20 bp, human
gcacctctaaccaatctgct

SEQ ID NO: 408956 - DNA, 20 bp, human
gccagcatgcgcaagtctgg

SEQ ID NO: 408957 - DNA, 20 bp, human
ggcgcaccgccgtgtcccca

SEQ ID NO: 408958 - DNA, 20 bp, human
gcctgcagtcctgcaaccta

SEQ ID NO: 408959 - DNA, 20 bp, human
gttaacctctcgcagtccct

SEQ ID NO: 408960 - DNA, 20 bp, human
gtatgcccaaaccccgagcc

SEQ ID NO: 408961 - DNA, 20 bp, human
gctcgcagtccctaggttgc

SEQ ID NO: 408962 - DNA, 20 bp, human
gggggcggtgcgaagccctg

SEQ ID NO: 408963 - DNA, 20 bp, human
gatcccagcatgcgcaagtc

SEQ ID NO: 408964 - DNA, 20 bp, human
ggcgcacctcgccgggcgtg

SEQ ID NO: 408965 - DNA, 20 bp, human
gggcatagctttagaaagag

SEQ ID NO: 408966 - DNA, 20 bp, human
ggaagccttccgcttcactc

SEQ ID NO: 408967 - DNA, 20 bp, human
ggcagccagagtgaagcgga

SEQ ID NO: 408968 - DNA, 20 bp, human
gaaaagccagctgcttaggc

SEQ ID NO: 408969 - DNA, 20 bp, human
gggaaggcttccgggttttg

SEQ ID NO: 408970 - DNA, 20 bp, human
ggagtgccagcctaagcagc

SEQ ID NO: 408971 - DNA, 20 bp, human
ggcacgcagccagagtgaag

SEQ ID NO: 408972 - DNA, 20 bp, human
gtttgaaaagccagctgctt

SEQ ID NO: 408973 - DNA, 20 bp, human
gcttgttgaatgtattaaaa

SEQ ID NO: 408974 - DNA, 20 bp, human
gtttaatttccaacagctat

SEQ ID NO: 408975 - DNA, 20 bp, human
gacaaaggccccgcaaaacc

SEQ ID NO: 408976 - DNA, 20 bp, human
gggcccacagccgggagctc

SEQ ID NO: 408977 - DNA, 20 bp, human
gccgcccgcaagagcatggt

SEQ ID NO: 408978 - DNA, 20 bp, human
gcggcgcaaacgctcccggg

SEQ ID NO: 408979 - DNA, 20 bp, human
ggggacgtggacgaactaac

SEQ ID NO: 408980 - DNA, 20 bp, human
gtcctagagcgagttcgggc

SEQ ID NO: 408981 - DNA, 20 bp, human
gtgccggagctcccggctgt

SEQ ID NO: 408982 - DNA, 20 bp, human
gccgaactcgctctaggaaa

SEQ ID NO: 408983 - DNA, 20 bp, human
gacatccgcccgcaagagca

SEQ ID NO: 408984 - DNA, 20 bp, human
gcgcgtcgggacgcaagcac

SEQ ID NO: 408985 - DNA, 20 bp, human
ggcacccaccatgctcttgc

SEQ ID NO: 408986 - DNA, 20 bp, human
ggggcggcgccgtgcgccga

SEQ ID NO: 408987 - DNA, 20 bp, human
gtgggtgctcgatgggagga

SEQ ID NO: 408988 - DNA, 20 bp, human
ggtcctgccctcagtctcga

SEQ ID NO: 408989 - DNA, 20 bp, human
gcctcagagcgggtgagctt

SEQ ID NO: 408990 - DNA, 20 bp, human
gtagctgccgagcccggaag

SEQ ID NO: 408991 - DNA, 20 bp, human
gagcttggggacgcacggag

SEQ ID NO: 408992 - DNA, 20 bp, human
gtcggcagctagactagcgg

SEQ ID NO: 408993 - DNA, 20 bp, human
gccggccgccatcgagactg

SEQ ID NO: 408994 - DNA, 20 bp, human
gtgtacgctgggtgctcgat

SEQ ID NO: 408995 - DNA, 20 bp, human
gagactgagggcaggaccct

SEQ ID NO: 408996 - DNA, 20 bp, human
gccaggcgggtcccatgagg

SEQ ID NO: 408997 - DNA, 20 bp, human
gcgcctgccgttcgcctctc

SEQ ID NO: 408998 - DNA, 20 bp, human
ggtcgctaggtcctcccgtc

SEQ ID NO: 408999 - DNA, 20 bp, human
gcggcagacgaaggcccgtg

SEQ ID NO: 409000 - DNA, 20 bp, human
gagcctgagaggcgaacggc

SEQ ID NO: 409001 - DNA, 20 bp, human
gcggccaggcgggtcccatg

SEQ ID NO: 409002 - DNA, 20 bp, human
ggggaggacctagcgacccc

SEQ ID NO: 409003 - DNA, 20 bp, human
gtcctcccgtcgggccccgc

SEQ ID NO: 409004 - DNA, 20 bp, human
gcgcgcccgcgggcgagcac

SEQ ID NO: 409005 - DNA, 20 bp, human
gtccgggcagggcgtccccc

SEQ ID NO: 409006 - DNA, 20 bp, human
gcagctcagagcttccgccc

SEQ ID NO: 409007 - DNA, 20 bp, human
gggaacaaagcagcgccctg

SEQ ID NO: 409008 - DNA, 20 bp, human
gccgttgcggctacaggcgc

SEQ ID NO: 409009 - DNA, 20 bp, human
gctaacttctgagttcacga

SEQ ID NO: 409010 - DNA, 20 bp, human
gttgttcccgcaaacccggg

SEQ ID NO: 409011 - DNA, 20 bp, human
ggacaaaacgagacagtgat

SEQ ID NO: 409012 - DNA, 20 bp, human
ggctgcgccgcctcacctgg

SEQ ID NO: 409013 - DNA, 20 bp, human
gcaaagcagcgccctgcgga

SEQ ID NO: 409014 - DNA, 20 bp, human
gtgagctgcgccgcctcacc

SEQ ID NO: 409015 - DNA, 20 bp, human
gagcttccgcccgggtttgc

SEQ ID NO: 409016 - DNA, 20 bp, human
gcgcccagcattgtgaggcg

SEQ ID NO: 409017 - DNA, 20 bp, human
ggcgaggcaggcagcagcgt

SEQ ID NO: 409018 - DNA, 20 bp, human
gaagacactgcgggcgacac

SEQ ID NO: 409019 - DNA, 20 bp, human
gggctcttaaggacgtggag

SEQ ID NO: 409020 - DNA, 20 bp, human
gtgcctcgcctcacaatgct

SEQ ID NO: 409021 - DNA, 20 bp, human
ggggcagcgagtgtagccat

SEQ ID NO: 409022 - DNA, 20 bp, human
gcgtctctctgctagaccaa

SEQ ID NO: 409023 - DNA, 20 bp, human
gttacccagaagacactgcg

SEQ ID NO: 409024 - DNA, 20 bp, human
gaggtctcaattgtgtgggc

SEQ ID NO: 409025 - DNA, 20 bp, human
gcctcacaatgctgggcgcg

SEQ ID NO: 409026 - DNA, 20 bp, human
gtggacggccatatgtcaga

SEQ ID NO: 409027 - DNA, 20 bp, human
gctgcccgcagcagctcggt

SEQ ID NO: 409028 - DNA, 20 bp, human
gaacacatgaatcgtagctg

SEQ ID NO: 409029 - DNA, 20 bp, human
gtggagacagcgctgggagt

SEQ ID NO: 409030 - DNA, 20 bp, human
gtgcgggcaggaggaatatc

SEQ ID NO: 409031 - DNA, 20 bp, human
gaggtccagtgaggcctttg

SEQ ID NO: 409032 - DNA, 20 bp, human
gctgtctgtgagtgcggcgt

SEQ ID NO: 409033 - DNA, 20 bp, human
gtgcttgctgggtccagtgc

SEQ ID NO: 409034 - DNA, 20 bp, human
gtggagcctgctgttccagt

SEQ ID NO: 409035 - DNA, 20 bp, human
gtgagtctggagacagcgct

SEQ ID NO: 409036 - DNA, 20 bp, human
gaaactgctgtcttccccgg

SEQ ID NO: 409037 - DNA, 20 bp, human
gtaacccttccctaccgccg

SEQ ID NO: 409038 - DNA, 20 bp, human
gagacccgctgaagcctaga

SEQ ID NO: 409039 - DNA, 20 bp, human
gtgcgacgcctcccccactg

SEQ ID NO: 409040 - DNA, 20 bp, human
gagcgggtctggatactcgg

SEQ ID NO: 409041 - DNA, 20 bp, human
gtcgggcggcgtttggtccc

SEQ ID NO: 409042 - DNA, 20 bp, human
ggggaagacagcagtttctc

SEQ ID NO: 409043 - DNA, 20 bp, human
gcttccccggcggtagggaa

SEQ ID NO: 409044 - DNA, 20 bp, human
gcgggagcctcgccgggtaa

SEQ ID NO: 409045 - DNA, 20 bp, human
gcagccacgcagaacagacg

SEQ ID NO: 409046 - DNA, 20 bp, human
gttaaccccagagacctccg

SEQ ID NO: 409047 - DNA, 20 bp, human
gagacctccgtggctgttga

SEQ ID NO: 409048 - DNA, 20 bp, human
ggtggctagacctgatccaa

SEQ ID NO: 409049 - DNA, 20 bp, human
gcctctgccttcaacagcca

SEQ ID NO: 409050 - DNA, 20 bp, human
gtgaactgcaggcggacgac

SEQ ID NO: 409051 - DNA, 20 bp, human
gctgccttcaacagccacgg

SEQ ID NO: 409052 - DNA, 20 bp, human
gctccaggacgggaccagcg

SEQ ID NO: 409053 - DNA, 20 bp, human
gccgcctcttgtctttcaat

SEQ ID NO: 409054 - DNA, 20 bp, human
gtgttgaaggcagagggtaa

SEQ ID NO: 409055 - DNA, 20 bp, human
ggaagcttaggtcttgaaga

SEQ ID NO: 409056 - DNA, 20 bp, human
gccccggaaccaggataagt

SEQ ID NO: 409057 - DNA, 20 bp, human
gggaaccaggataagttgga

SEQ ID NO: 409058 - DNA, 20 bp, human
gcgtcaccccggccttggtg

SEQ ID NO: 409059 - DNA, 20 bp, human
ggcagccatccaacttatcc

SEQ ID NO: 409060 - DNA, 20 bp, human
gccaaggccggggtgacgca

SEQ ID NO: 409061 - DNA, 20 bp, human
gcgtcacgacgcccgggtca

SEQ ID NO: 409062 - DNA, 20 bp, human
gacgtcagcacgccttccct

SEQ ID NO: 409063 - DNA, 20 bp, human
ggggtgacgcatggccagcg

SEQ ID NO: 409064 - DNA, 20 bp, human
ggggtcgtcgctatagcaat

SEQ ID NO: 409065 - DNA, 20 bp, human
gataagttggatggctgccg

SEQ ID NO: 409066 - DNA, 20 bp, human
ggagaagctgagaggagcac

SEQ ID NO: 409067 - DNA, 20 bp, human
gagaccttgcgctttagagc

SEQ ID NO: 409068 - DNA, 20 bp, human
gaaggtgagaccgcccagga

SEQ ID NO: 409069 - DNA, 20 bp, human
gggtgaaggtgagaccgccc

SEQ ID NO: 409070 - DNA, 20 bp, human
gcggggcctggacgaggcag

SEQ ID NO: 409071 - DNA, 20 bp, human
ggcccaggaaggctgacgca

SEQ ID NO: 409072 - DNA, 20 bp, human
gctctcctagcacctgtttt

SEQ ID NO: 409073 - DNA, 20 bp, human
gtccatgcgtcagccttcct

SEQ ID NO: 409074 - DNA, 20 bp, human
gctgccggctctaaagcgca

SEQ ID NO: 409075 - DNA, 20 bp, human
gaccttcaccacccgaaaac

SEQ ID NO: 409076 - DNA, 20 bp, human
gccccgcagagccagactga

SEQ ID NO: 409077 - DNA, 20 bp, human
gacgccccagcacctctgat

SEQ ID NO: 409078 - DNA, 20 bp, human
gtcagctgtcactcagatgt

SEQ ID NO: 409079 - DNA, 20 bp, human
ggcactgcccacagttcatc

SEQ ID NO: 409080 - DNA, 20 bp, human
gatccgtcagtctggctctg

SEQ ID NO: 409081 - DNA, 20 bp, human
gcccacagttcatccggaaa

SEQ ID NO: 409082 - DNA, 20 bp, human
gcattttcacaaggggatgg

SEQ ID NO: 409083 - DNA, 20 bp, human
gtctgattggatgaaatact

SEQ ID NO: 409084 - DNA, 20 bp, human
gtcatccaatcagaggtgct

SEQ ID NO: 409085 - DNA, 20 bp, human
gtgaagttgacagtttactt

SEQ ID NO: 409086 - DNA, 20 bp, human
ggccggggactaaacatgcg

SEQ ID NO: 409087 - DNA, 20 bp, human
gaggccagctcactcccgcg

SEQ ID NO: 409088 - DNA, 20 bp, human
gcacgactgcgtaggggcaa

SEQ ID NO: 409089 - DNA, 20 bp, human
ggtgcccaagacaacgcccc

SEQ ID NO: 409090 - DNA, 20 bp, human
gtccgtaccctcatccaaaa

SEQ ID NO: 409091 - DNA, 20 bp, human
gaacgcggactggagatacc

SEQ ID NO: 409092 - DNA, 20 bp, human
gtgagggtacggagagaacg

SEQ ID NO: 409093 - DNA, 20 bp, human
gcggtgactaatacagaggc

SEQ ID NO: 409094 - DNA, 20 bp, human
ggccattttggatgagggta

SEQ ID NO: 409095 - DNA, 20 bp, human
gataccgggggcgttgtctt

SEQ ID NO: 409096 - DNA, 20 bp, human
gggcgggcttgggcgaggta

SEQ ID NO: 409097 - DNA, 20 bp, human
gctccaaaacccgaaaactg

SEQ ID NO: 409098 - DNA, 20 bp, human
gggcctcagttttcgggttt

SEQ ID NO: 409099 - DNA, 20 bp, human
gaagcccgcccacctcctcg

SEQ ID NO: 409100 - DNA, 20 bp, human
gcaccgcctgggatgtggga

SEQ ID NO: 409101 - DNA, 20 bp, human
ggaaatcgtacgttccatcc

SEQ ID NO: 409102 - DNA, 20 bp, human
gcctgctgtgtttatccaga

SEQ ID NO: 409103 - DNA, 20 bp, human
gtcgtacgttccatccaggc

SEQ ID NO: 409104 - DNA, 20 bp, human
ggggccaccgcctgggatgt

SEQ ID NO: 409105 - DNA, 20 bp, human
gagtgaatggagactggaaa

SEQ ID NO: 409106 - DNA, 20 bp, human
gaacccaaaaacagaggcgg

SEQ ID NO: 409107 - DNA, 20 bp, human
gaaaaacagaggcggtggga

SEQ ID NO: 409108 - DNA, 20 bp, human
gctccaaaacccaaaaacag

SEQ ID NO: 409109 - DNA, 20 bp, human
gactcaggaagcagggcggg

SEQ ID NO: 409110 - DNA, 20 bp, human
ggggcttttgaatcatggat

SEQ ID NO: 409111 - DNA, 20 bp, human
gaatcatggatcggccttcc

SEQ ID NO: 409112 - DNA, 20 bp, human
gacagcaaggatgcggacgc

SEQ ID NO: 409113 - DNA, 20 bp, human
gtgtaagttctgcccaagca

SEQ ID NO: 409114 - DNA, 20 bp, human
gcaccgcctgggatgctgga

SEQ ID NO: 409115 - DNA, 20 bp, human
gttttggaggcgagatggcc

SEQ ID NO: 409116 - DNA, 20 bp, human
gggagcggctccagcctgac

SEQ ID NO: 409117 - DNA, 20 bp, human
gaccctcctagtgagatccc

SEQ ID NO: 409118 - DNA, 20 bp, human
gcggctgcgcgcgaacggag

SEQ ID NO: 409119 - DNA, 20 bp, human
ggcggggcctgaatacttat

SEQ ID NO: 409120 - DNA, 20 bp, human
gggcctgaatacttattgga

SEQ ID NO: 409121 - DNA, 20 bp, human
gacctgggatctcactagga

SEQ ID NO: 409122 - DNA, 20 bp, human
ggctccacggtttgtgacct

SEQ ID NO: 409123 - DNA, 20 bp, human
gagggtcaacgtctgttgtt

SEQ ID NO: 409124 - DNA, 20 bp, human
ggatcccaggtcacaaaccg

SEQ ID NO: 409125 - DNA, 20 bp, human
gaagtgtggcttgcaaaacg

SEQ ID NO: 409126 - DNA, 20 bp, human
gggccggggtccagaaggtg

SEQ ID NO: 409127 - DNA, 20 bp, human
gcccggggccggggtccaga

SEQ ID NO: 409128 - DNA, 20 bp, human
gtggaccccggccccgggct

SEQ ID NO: 409129 - DNA, 20 bp, human
gcccgcgcgtcgcggcctcg

SEQ ID NO: 409130 - DNA, 20 bp, human
gcgcggccaggtccccccgc

SEQ ID NO: 409131 - DNA, 20 bp, human
gaggggcccggccacggggt

SEQ ID NO: 409132 - DNA, 20 bp, human
gacggggaggccgagacctt

SEQ ID NO: 409133 - DNA, 20 bp, human
gggaggccgagaccttggga

SEQ ID NO: 409134 - DNA, 20 bp, human
gaggggcttcgcgactaccc

SEQ ID NO: 409135 - DNA, 20 bp, human
gcgtcgcggcctcggggatg

SEQ ID NO: 409136 - DNA, 20 bp, human
gcagctcagagcttccgccc

SEQ ID NO: 409137 - DNA, 20 bp, human
gggaacaaagcagcgccctg

SEQ ID NO: 409138 - DNA, 20 bp, human
gccgttgcggctacaggcgc

SEQ ID NO: 409139 - DNA, 20 bp, human
gctaacttctgagttcacga

SEQ ID NO: 409140 - DNA, 20 bp, human
gttgttcccgcaaacccggg

SEQ ID NO: 409141 - DNA, 20 bp, human
ggctgcgccgcctcacctgg

SEQ ID NO: 409142 - DNA, 20 bp, human
ggacaaaacgagacagtgat

SEQ ID NO: 409143 - DNA, 20 bp, human
gcaaagcagcgccctgcgga

SEQ ID NO: 409144 - DNA, 20 bp, human
gtgagctgcgccgcctcacc

SEQ ID NO: 409145 - DNA, 20 bp, human
gagcttccgcccgggtttgc

SEQ ID NO: 409146 - DNA, 20 bp, human
gcggagccctgcccaatcaa

SEQ ID NO: 409147 - DNA, 20 bp, human
gccccctagcgcccttgatt

SEQ ID NO: 409148 - DNA, 20 bp, human
gtggagaattctccaatcag

SEQ ID NO: 409149 - DNA, 20 bp, human
ggggaagtggagactctgat

SEQ ID NO: 409150 - DNA, 20 bp, human
gaattctccaatcaggggtg

SEQ ID NO: 409151 - DNA, 20 bp, human
gcagagacgttaatccgaag

SEQ ID NO: 409152 - DNA, 20 bp, human
gtcgactccgcacccctgat

SEQ ID NO: 409153 - DNA, 20 bp, human
gggctcgtcgagaacacgcg

SEQ ID NO: 409154 - DNA, 20 bp, human
gcgcccctgcctgtcctgat

SEQ ID NO: 409155 - DNA, 20 bp, human
gtcggattaacgtctctgat

SEQ ID NO: 409156 - DNA, 20 bp, human
ggaccgcccggaggcgacaa

SEQ ID NO: 409157 - DNA, 20 bp, human
gcccgagcggactgggactc

SEQ ID NO: 409158 - DNA, 20 bp, human
ggcaatgacagggtgaatgg

SEQ ID NO: 409159 - DNA, 20 bp, human
gacaacggccctgaaattgg

SEQ ID NO: 409160 - DNA, 20 bp, human
gagagagggctgccccgaat

SEQ ID NO: 409161 - DNA, 20 bp, human
ggtcgcctccgggcggtccg

SEQ ID NO: 409162 - DNA, 20 bp, human
gggacccgcggaccgcccgg

SEQ ID NO: 409163 - DNA, 20 bp, human
gtgacagggtgaatggcggt

SEQ ID NO: 409164 - DNA, 20 bp, human
gtcagggccgttgtcgcctc

SEQ ID NO: 409165 - DNA, 20 bp, human
gccgcgggtcccgagcggac

SEQ ID NO: 409166 - DNA, 20 bp, human
gggcccaaacggctcggaga

SEQ ID NO: 409167 - DNA, 20 bp, human
gccaaacggctcggagaggg

SEQ ID NO: 409168 - DNA, 20 bp, human
gcccaggcgtccggcccaaa

SEQ ID NO: 409169 - DNA, 20 bp, human
gaggttaggttggaactcgg

SEQ ID NO: 409170 - DNA, 20 bp, human
gagggcggcgagctcagact

SEQ ID NO: 409171 - DNA, 20 bp, human
ggcgtccggcccaaacggct

SEQ ID NO: 409172 - DNA, 20 bp, human
gcctctgctccgcccgaaat

SEQ ID NO: 409173 - DNA, 20 bp, human
gggggcggctccaggtgctt

SEQ ID NO: 409174 - DNA, 20 bp, human
ggcggcccgtctcctggggc

SEQ ID NO: 409175 - DNA, 20 bp, human
gcggcaaggaccttgaacgc

SEQ ID NO: 409176 - DNA, 20 bp, human
ggcccctggcggtcttctct

SEQ ID NO: 409177 - DNA, 20 bp, human
gagacgccgcttactagtgt

SEQ ID NO: 409178 - DNA, 20 bp, human
gagcccagagaagaccgcca

SEQ ID NO: 409179 - DNA, 20 bp, human
gggaagtcccgccctgacgt

SEQ ID NO: 409180 - DNA, 20 bp, human
gcggcaccaacactagtaag

SEQ ID NO: 409181 - DNA, 20 bp, human
gcttctctgggcttttaacc

SEQ ID NO: 409182 - DNA, 20 bp, human
ggtccacccgaggatggtag

SEQ ID NO: 409183 - DNA, 20 bp, human
gtgacgttggtgaggaccaa

SEQ ID NO: 409184 - DNA, 20 bp, human
gtcccgccctgacgttggtg

SEQ ID NO: 409185 - DNA, 20 bp, human
gtctgggccaatgaaaaccc

SEQ ID NO: 409186 - DNA, 20 bp, human
gcgcgtggctccaaacttcg

SEQ ID NO: 409187 - DNA, 20 bp, human
ggcgaactacactgcccaga

SEQ ID NO: 409188 - DNA, 20 bp, human
gcgagagtgcgacgcgcaat

SEQ ID NO: 409189 - DNA, 20 bp, human
gaaccgccgaggggagacgc

SEQ ID NO: 409190 - DNA, 20 bp, human
gttccggcgtctcccctcgg

SEQ ID NO: 409191 - DNA, 20 bp, human
gcgccgtgagccgcgatgct

SEQ ID NO: 409192 - DNA, 20 bp, human
ggctccaaacttcgaggaag

SEQ ID NO: 409193 - DNA, 20 bp, human
gcagcgaaagcaaccgccga

SEQ ID NO: 409194 - DNA, 20 bp, human
gatgcttggccaatgaaaag

SEQ ID NO: 409195 - DNA, 20 bp, human
gggccaagcatcgcggctca

SEQ ID NO: 409196 - DNA, 20 bp, human
gctccaaacaggcggttccg

SEQ ID NO: 409197 - DNA, 20 bp, human
gtccgggggaccggtagctg

SEQ ID NO: 409198 - DNA, 20 bp, human
ggtcccgagcaagacctcaa

SEQ ID NO: 409199 - DNA, 20 bp, human
gagcaagacctcaaaggact

SEQ ID NO: 409200 - DNA, 20 bp, human
gtcccccggaaccgcctgtt

SEQ ID NO: 409201 - DNA, 20 bp, human
gcacggctccgagtcctttg

SEQ ID NO: 409202 - DNA, 20 bp, human
gccgaccgggattcgtgaca

SEQ ID NO: 409203 - DNA, 20 bp, human
gaagccaatagcaagaggat

SEQ ID NO: 409204 - DNA, 20 bp, human
gggaccggtagctggggaat

SEQ ID NO: 409205 - DNA, 20 bp, human
gagaatttttctctgtccat

SEQ ID NO: 409206 - DNA, 20 bp, human
ggggcggctcctttgttctc

SEQ ID NO: 409207 - DNA, 20 bp, human
gcccgcgggctgctccgata

SEQ ID NO: 409208 - DNA, 20 bp, human
gaacaaaggagccgccccgc

SEQ ID NO: 409209 - DNA, 20 bp, human
gggccgcccagccactccat

SEQ ID NO: 409210 - DNA, 20 bp, human
ggccaatagccgagggggga

SEQ ID NO: 409211 - DNA, 20 bp, human
ggccgggcgggtcatctgag

SEQ ID NO: 409212 - DNA, 20 bp, human
gatgacccgcccggccctat

SEQ ID NO: 409213 - DNA, 20 bp, human
ggccgcggggaggagacctt

SEQ ID NO: 409214 - DNA, 20 bp, human
gagcggcgcagccaatggag

SEQ ID NO: 409215 - DNA, 20 bp, human
gcctgccccgggaatggcca

SEQ ID NO: 409216 - DNA, 20 bp, human
gttccaagacagttccaagg

SEQ ID NO: 409217 - DNA, 20 bp, human
gcaatcaagcgcctctgaga

SEQ ID NO: 409218 - DNA, 20 bp, human
gtaccgccttggaactgtct

SEQ ID NO: 409219 - DNA, 20 bp, human
gaaggccttctttaccgcct

SEQ ID NO: 409220 - DNA, 20 bp, human
gaggttccaagacagttcca

SEQ ID NO: 409221 - DNA, 20 bp, human
gagttccaaggcggtaaaga

SEQ ID NO: 409222 - DNA, 20 bp, human
gggcgcttgattgcacagag

SEQ ID NO: 409223 - DNA, 20 bp, human
gagtataaaggtgggacttc

SEQ ID NO: 409224 - DNA, 20 bp, human
gcgcggaaacagtataaagg

SEQ ID NO: 409225 - DNA, 20 bp, human
gcattcgacgcagagatttc

SEQ ID NO: 409226 - DNA, 20 bp, human
ggccagacgggtcatttagg

SEQ ID NO: 409227 - DNA, 20 bp, human
gcagcccaggcgacgtgctg

SEQ ID NO: 409228 - DNA, 20 bp, human
gacgtgctggggtctggagg

SEQ ID NO: 409229 - DNA, 20 bp, human
gtgtgagcgcaggttttgaa

SEQ ID NO: 409230 - DNA, 20 bp, human
gtgtgagaggcgcaggggat

SEQ ID NO: 409231 - DNA, 20 bp, human
gagcccgcgtccctggaacc

SEQ ID NO: 409232 - DNA, 20 bp, human
ggaagcacagcccgcgtccc

SEQ ID NO: 409233 - DNA, 20 bp, human
ggggctttctctggtgtgac

SEQ ID NO: 409234 - DNA, 20 bp, human
gcaaaacctgcgctcacaaa

SEQ ID NO: 409235 - DNA, 20 bp, human
gagaccccagcacgtcgcct

SEQ ID NO: 409236 - DNA, 20 bp, human
gccggggcgcccttgggaac

SEQ ID NO: 409237 - DNA, 20 bp, human
gagggccccggggcgccctt

SEQ ID NO: 409238 - DNA, 20 bp, human
gcctccagcccggttcccaa

SEQ ID NO: 409239 - DNA, 20 bp, human
ggcgcccttgggaaccgggc

SEQ ID NO: 409240 - DNA, 20 bp, human
gcggggccggcgccggaaga

SEQ ID NO: 409241 - DNA, 20 bp, human
gcttccgcgagggtgcggga

SEQ ID NO: 409242 - DNA, 20 bp, human
gtacgtccgcctggtcctcc

SEQ ID NO: 409243 - DNA, 20 bp, human
gagaggggccggcgcgtctt

SEQ ID NO: 409244 - DNA, 20 bp, human
ggaagctttggcctatggtg

SEQ ID NO: 409245 - DNA, 20 bp, human
ggggccgaagctttggccta

SEQ ID NO: 409246 - DNA, 20 bp, human
gtgatcccagcatactatgg

SEQ ID NO: 409247 - DNA, 20 bp, human
gctaagggagccgagcctag

SEQ ID NO: 409248 - DNA, 20 bp, human
gcgaccccggagaccggaag

SEQ ID NO: 409249 - DNA, 20 bp, human
gcccacgaatccactaggct

SEQ ID NO: 409250 - DNA, 20 bp, human
gccggagaccggaagtggac

SEQ ID NO: 409251 - DNA, 20 bp, human
ggaactcccacgaatccact

SEQ ID NO: 409252 - DNA, 20 bp, human
gtatgggggctgacccctaa

SEQ ID NO: 409253 - DNA, 20 bp, human
ggccgagcctagtggattcg

SEQ ID NO: 409254 - DNA, 20 bp, human
gtccagcccgcggggtgcac

SEQ ID NO: 409255 - DNA, 20 bp, human
gaagtggaagcctatcgctg

SEQ ID NO: 409256 - DNA, 20 bp, human
gtgatcccagcatacattgg

SEQ ID NO: 409257 - DNA, 20 bp, human
gcctcagaagtcttggtcta

SEQ ID NO: 409258 - DNA, 20 bp, human
gaggagcccccaatgtatgc

SEQ ID NO: 409259 - DNA, 20 bp, human
gccgtggggtgcagaggttg

SEQ ID NO: 409260 - DNA, 20 bp, human
ggcaacgctcctctcagatg

SEQ ID NO: 409261 - DNA, 20 bp, human
gatacattgggggctcctaa

SEQ ID NO: 409262 - DNA, 20 bp, human
gcattaggctcgggtccctt

SEQ ID NO: 409263 - DNA, 20 bp, human
gggaaccgctaattccggtg

SEQ ID NO: 409264 - DNA, 20 bp, human
ggcgagaatccccatctgag

SEQ ID NO: 409265 - DNA, 20 bp, human
ggtgggagttccagaccgtg

SEQ ID NO: 409266 - DNA, 20 bp, human
gaggctcagggctgcccgag

SEQ ID NO: 409267 - DNA, 20 bp, human
gcccagagccagtgctgtca

SEQ ID NO: 409268 - DNA, 20 bp, human
gaacgcagccgcctcccgac

SEQ ID NO: 409269 - DNA, 20 bp, human
gggaagaccatgtgtgtctg

SEQ ID NO: 409270 - DNA, 20 bp, human
gcgactggaggacgcggtag

SEQ ID NO: 409271 - DNA, 20 bp, human
gaccgcgtcctccagtcggg

SEQ ID NO: 409272 - DNA, 20 bp, human
gaacgcggcggaaccggttg

SEQ ID NO: 409273 - DNA, 20 bp, human
ggcgtcctccagtcgggagg

SEQ ID NO: 409274 - DNA, 20 bp, human
ggctctgggactaagcccct

SEQ ID NO: 409275 - DNA, 20 bp, human
gcggccgacgtgcttcgcgc

SEQ ID NO: 409276 - DNA, 20 bp, human
gacgtgaggagtcacgtcga

SEQ ID NO: 409277 - DNA, 20 bp, human
gtgaggagtcacgtcgaagg

SEQ ID NO: 409278 - DNA, 20 bp, human
gggtcggctcggaaagtaga

SEQ ID NO: 409279 - DNA, 20 bp, human
gcggcgaaccagactcattc

SEQ ID NO: 409280 - DNA, 20 bp, human
ggttcgccgcgcagcactct

SEQ ID NO: 409281 - DNA, 20 bp, human
gctggctgcacaggcgcaga

SEQ ID NO: 409282 - DNA, 20 bp, human
gggcggacgcaagagcttat

SEQ ID NO: 409283 - DNA, 20 bp, human
gtcggcgattcagaattggc

SEQ ID NO: 409284 - DNA, 20 bp, human
gtcaaccgggaaccaatgga

SEQ ID NO: 409285 - DNA, 20 bp, human
gcgtttcggcgattcagaat

SEQ ID NO: 409286 - DNA, 20 bp, human
gtcccacgcgggagccggga

SEQ ID NO: 409287 - DNA, 20 bp, human
gaaagtgcgaaacctcgcga

SEQ ID NO: 409288 - DNA, 20 bp, human
gactcccgcgccccgggtga

SEQ ID NO: 409289 - DNA, 20 bp, human
gaggcgctgcaacagagtct

SEQ ID NO: 409290 - DNA, 20 bp, human
gggcgcgggagttgacgcca

SEQ ID NO: 409291 - DNA, 20 bp, human
gacgcctgacgtagccccgc

SEQ ID NO: 409292 - DNA, 20 bp, human
gcctccagcggggctacgtc

SEQ ID NO: 409293 - DNA, 20 bp, human
gagcgccccctgcagcccgt

SEQ ID NO: 409294 - DNA, 20 bp, human
gcgcgggcgtgcggtcctac

SEQ ID NO: 409295 - DNA, 20 bp, human
gggcgtgccacggcctccag

SEQ ID NO: 409296 - DNA, 20 bp, human
gacacagagcgtaccctcgg

SEQ ID NO: 409297 - DNA, 20 bp, human
gtaccctcggagggacagac

SEQ ID NO: 409298 - DNA, 20 bp, human
ggcgcagtgcggggctgcga

SEQ ID NO: 409299 - DNA, 20 bp, human
gtacctgtctgtccctccga

SEQ ID NO: 409300 - DNA, 20 bp, human
ggaacaactcacattctccc

SEQ ID NO: 409301 - DNA, 20 bp, human
gactgcgcaggcgcagtgcg

SEQ ID NO: 409302 - DNA, 20 bp, human
gggcgtaagagctactgcgc

SEQ ID NO: 409303 - DNA, 20 bp, human
gttcgctctgaaagggggtg

SEQ ID NO: 409304 - DNA, 20 bp, human
gcgagggggcgtggtgcagc

SEQ ID NO: 409305 - DNA, 20 bp, human
gacgccaagtttataaacgt

SEQ ID NO: 409306 - DNA, 20 bp, human
gcgagggaaaccagcgggaa

SEQ ID NO: 409307 - DNA, 20 bp, human
gtggacagtgccggaaggcc

SEQ ID NO: 409308 - DNA, 20 bp, human
gctgcctttacacaccacga

SEQ ID NO: 409309 - DNA, 20 bp, human
gcaccctcagcctttcaaac

SEQ ID NO: 409310 - DNA, 20 bp, human
gaacaccactaaccgataga

SEQ ID NO: 409311 - DNA, 20 bp, human
gatagatggcgtacgttgat

SEQ ID NO: 409312 - DNA, 20 bp, human
ggcgccaggggcggccccat

SEQ ID NO: 409313 - DNA, 20 bp, human
gtatcggttagtggtgttgc

SEQ ID NO: 409314 - DNA, 20 bp, human
ggtggtgtgtaaaggcagag

SEQ ID NO: 409315 - DNA, 20 bp, human
gttgattggacagtgccgga

SEQ ID NO: 409316 - DNA, 20 bp, human
gcccctgggtccctcctctg

SEQ ID NO: 409317 - DNA, 20 bp, human
gcctgagcgtcggtcctcag

SEQ ID NO: 409318 - DNA, 20 bp, human
ggaggcgctgtaggactgag

SEQ ID NO: 409319 - DNA, 20 bp, human
gtggcccccaaacgcagcgc

SEQ ID NO: 409320 - DNA, 20 bp, human
gagcggcgctgcctgagcgt

SEQ ID NO: 409321 - DNA, 20 bp, human
gctgtgcgtgggagtcgggt

SEQ ID NO: 409322 - DNA, 20 bp, human
gcgggctgtgcgtgggagtc

SEQ ID NO: 409323 - DNA, 20 bp, human
gctcccacgcacagcccggg

SEQ ID NO: 409324 - DNA, 20 bp, human
gggccacccgggctgtgcgt

SEQ ID NO: 409325 - DNA, 20 bp, human
gccggccggcgctgcgtttg

SEQ ID NO: 409326 - DNA, 20 bp, human
ggggcgccatagagcatgga

SEQ ID NO: 409327 - DNA, 20 bp, human
ggggcaccgccctagacacc

SEQ ID NO: 409328 - DNA, 20 bp, human
gcgccatagagcatggacgg

SEQ ID NO: 409329 - DNA, 20 bp, human
gcgcggggcgccatagagca

SEQ ID NO: 409330 - DNA, 20 bp, human
ggggcggtggccgggatagc

SEQ ID NO: 409331 - DNA, 20 bp, human
gaggtgcagcggcagagaag

SEQ ID NO: 409332 - DNA, 20 bp, human
ggccccgcgccgaggggctt

SEQ ID NO: 409333 - DNA, 20 bp, human
gcgcacctcctgtccgggaa

SEQ ID NO: 409334 - DNA, 20 bp, human
gtgtcctcgccgctctagga

SEQ ID NO: 409335 - DNA, 20 bp, human
gggagacttccgggtgtcta

SEQ ID NO: 409336 - DNA, 20 bp, human
gcaccgagagagtcacgtga

SEQ ID NO: 409337 - DNA, 20 bp, human
gggttcgggcccactcgcgc

SEQ ID NO: 409338 - DNA, 20 bp, human
gagagtggcgcccgcgcgag

SEQ ID NO: 409339 - DNA, 20 bp, human
gagagagtcacgtgatggac

SEQ ID NO: 409340 - DNA, 20 bp, human
ggtgggcccgaaccaatcaa

SEQ ID NO: 409341 - DNA, 20 bp, human
gactctctcggtgctgtctc

SEQ ID NO: 409342 - DNA, 20 bp, human
gggggagggcggccgttgat

SEQ ID NO: 409343 - DNA, 20 bp, human
ggctgtctccggccgttgat

SEQ ID NO: 409344 - DNA, 20 bp, human
gtccggccgttgattggcct

SEQ ID NO: 409345 - DNA, 20 bp, human
gggcggccgttgattggttc

SEQ ID NO: 409346 - DNA, 20 bp, human
gaccggaagtggcgccaatc

SEQ ID NO: 409347 - DNA, 20 bp, human
gcgtgtgtgtatcataaacc

SEQ ID NO: 409348 - DNA, 20 bp, human
ggagccccgcggcgacttct

SEQ ID NO: 409349 - DNA, 20 bp, human
ggtcatgcgcacatgccccg

SEQ ID NO: 409350 - DNA, 20 bp, human
gtgccccgcggcggccacac

SEQ ID NO: 409351 - DNA, 20 bp, human
gccaatcaggcgcgtccctc

SEQ ID NO: 409352 - DNA, 20 bp, human
gcgccgcggggctctgtttc

SEQ ID NO: 409353 - DNA, 20 bp, human
ggggaatgctgggcttacag

SEQ ID NO: 409354 - DNA, 20 bp, human
gaggcgcgtccctctggcgc

SEQ ID NO: 409355 - DNA, 20 bp, human
gtgcgcagagagctgcggag

SEQ ID NO: 409356 - DNA, 20 bp, human
gacaccgcggtcaccattaa

SEQ ID NO: 409357 - DNA, 20 bp, human
ggggcagttaaagacggccc

SEQ ID NO: 409358 - DNA, 20 bp, human
gttaactgccccggacaccg

SEQ ID NO: 409359 - DNA, 20 bp, human
gaatggtgaccgcggtgtcc

SEQ ID NO: 409360 - DNA, 20 bp, human
gttaaccctaaagggacaga

SEQ ID NO: 409361 - DNA, 20 bp, human
gagtaagcccaggccatctt

SEQ ID NO: 409362 - DNA, 20 bp, human
gggtccgttaatggtgaccg

SEQ ID NO: 409363 - DNA, 20 bp, human
gttaaagacggcccaggctc

SEQ ID NO: 409364 - DNA, 20 bp, human
gcaaatgcagggtccgttaa

SEQ ID NO: 409365 - DNA, 20 bp, human
gagcagatgtgagcggtgtg

SEQ ID NO: 409366 - DNA, 20 bp, human
gaggcctggccaagcaaaaa

SEQ ID NO: 409367 - DNA, 20 bp, human
gggctgggtgaaggagttaa

SEQ ID NO: 409368 - DNA, 20 bp, human
gcggtccagtatgtctcccg

SEQ ID NO: 409369 - DNA, 20 bp, human
ggaaagaaagcttgccccag

SEQ ID NO: 409370 - DNA, 20 bp, human
gcgcgccaggggaatcggga

SEQ ID NO: 409371 - DNA, 20 bp, human
gggagccgccctctgaggct

SEQ ID NO: 409372 - DNA, 20 bp, human
gctggaccgcagggtctcct

SEQ ID NO: 409373 - DNA, 20 bp, human
gggggggattgttactaaac

SEQ ID NO: 409374 - DNA, 20 bp, human
gccgggcttccgcccctcct

SEQ ID NO: 409375 - DNA, 20 bp, human
gtatcgcgggagagtgccct

SEQ ID NO: 409376 - DNA, 20 bp, human
gtccgccggtgggacggaac

SEQ ID NO: 409377 - DNA, 20 bp, human
gggcaccagttccgtcccac

SEQ ID NO: 409378 - DNA, 20 bp, human
gggcgccggaaaggagggta

SEQ ID NO: 409379 - DNA, 20 bp, human
gaccagttccgtcccaccgg

SEQ ID NO: 409380 - DNA, 20 bp, human
gtcaacacaattgtccacgg

SEQ ID NO: 409381 - DNA, 20 bp, human
gctcgcttccgccggtggga

SEQ ID NO: 409382 - DNA, 20 bp, human
gggcagcaggtctagtagct

SEQ ID NO: 409383 - DNA, 20 bp, human
gcagatctcgcttccgccgg

SEQ ID NO: 409384 - DNA, 20 bp, human
gaggcagatctcgcttccgc

SEQ ID NO: 409385 - DNA, 20 bp, human
gccgtgtccgacccgagatc

SEQ ID NO: 409386 - DNA, 20 bp, human
gccaccctccgaggtccagg

SEQ ID NO: 409387 - DNA, 20 bp, human
gggccgatgcccacacgcgc

SEQ ID NO: 409388 - DNA, 20 bp, human
gtctcctcctggacctcgga

SEQ ID NO: 409389 - DNA, 20 bp, human
ggggctctcctcctggacct

SEQ ID NO: 409390 - DNA, 20 bp, human
gagcactggggctctcctcc

SEQ ID NO: 409391 - DNA, 20 bp, human
gccagccgcttcacccctaa

SEQ ID NO: 409392 - DNA, 20 bp, human
gttcctgcgcgtgtgggcat

SEQ ID NO: 409393 - DNA, 20 bp, human
gcgcccaccctccgaggtcc

SEQ ID NO: 409394 - DNA, 20 bp, human
ggcggctgcaggctcgggag

SEQ ID NO: 409395 - DNA, 20 bp, human
gctcgggccttccccttaaa

SEQ ID NO: 409396 - DNA, 20 bp, human
gcccacttgactcctacctg

SEQ ID NO: 409397 - DNA, 20 bp, human
gcgcaccggccattcaggat

SEQ ID NO: 409398 - DNA, 20 bp, human
ggccccaggtaggagtcaag

SEQ ID NO: 409399 - DNA, 20 bp, human
gttccagtgaacaggattct

SEQ ID NO: 409400 - DNA, 20 bp, human
ggagccgcaaggaaagggcg

SEQ ID NO: 409401 - DNA, 20 bp, human
ggggcgtgacttcacggaaa

SEQ ID NO: 409402 - DNA, 20 bp, human
gtcactggaaggttgccggg

SEQ ID NO: 409403 - DNA, 20 bp, human
gcagccccgccctttccttg

SEQ ID NO: 409404 - DNA, 20 bp, human
gtctcctaggagctccccta

SEQ ID NO: 409405 - DNA, 20 bp, human
gaaacatggccgccccaggt

SEQ ID NO: 409406 - DNA, 20 bp, human
gccacggcccttactggata

SEQ ID NO: 409407 - DNA, 20 bp, human
gtctgtcaatcagtccacga

SEQ ID NO: 409408 - DNA, 20 bp, human
gtcaatcagtccacgagggg

SEQ ID NO: 409409 - DNA, 20 bp, human
gagtgcaaatatccctcggg

SEQ ID NO: 409410 - DNA, 20 bp, human
gctgacgccgtatccagtaa

SEQ ID NO: 409411 - DNA, 20 bp, human
gttgatctgaatcctcccga

SEQ ID NO: 409412 - DNA, 20 bp, human
gcttaagtgcaaatatccct

SEQ ID NO: 409413 - DNA, 20 bp, human
gttcaaccacacactcctct

SEQ ID NO: 409414 - DNA, 20 bp, human
gttgtcagtcagtgtacagg

SEQ ID NO: 409415 - DNA, 20 bp, human
gcgacctccgcctcctaggt

SEQ ID NO: 409416 - DNA, 20 bp, human
gcaatgggagcactcagcta

SEQ ID NO: 409417 - DNA, 20 bp, human
gcggggctgcgatgcccctt

SEQ ID NO: 409418 - DNA, 20 bp, human
ggccagaggccagcgggtgg

SEQ ID NO: 409419 - DNA, 20 bp, human
gccgctggcctctggccaat

SEQ ID NO: 409420 - DNA, 20 bp, human
ggtgggggcggtgttgctcg

SEQ ID NO: 409421 - DNA, 20 bp, human
gcaaccagaggcctcactcg

SEQ ID NO: 409422 - DNA, 20 bp, human
gtctggttgcccgcaaccta

SEQ ID NO: 409423 - DNA, 20 bp, human
gccgagagatgactgattgt

SEQ ID NO: 409424 - DNA, 20 bp, human
gactcagctaaggctggtgg

SEQ ID NO: 409425 - DNA, 20 bp, human
gcggcccgcgcagacgtgca

SEQ ID NO: 409426 - DNA, 20 bp, human
gtgtgcccgccgcggccggt

SEQ ID NO: 409427 - DNA, 20 bp, human
gcgaggggagggaaccgggg

SEQ ID NO: 409428 - DNA, 20 bp, human
gacaagctcaccgagtgggt

SEQ ID NO: 409429 - DNA, 20 bp, human
gactgaccccggacggagat

SEQ ID NO: 409430 - DNA, 20 bp, human
gtggaactgaaactcgggga

SEQ ID NO: 409431 - DNA, 20 bp, human
ggcgcgagggccgtgtccga

SEQ ID NO: 409432 - DNA, 20 bp, human
gctaccgccgcggagcgcgt

SEQ ID NO: 409433 - DNA, 20 bp, human
gccgcggagcgcgtaggaag

SEQ ID NO: 409434 - DNA, 20 bp, human
gcagcgcgtcgcctacccac

SEQ ID NO: 409435 - DNA, 20 bp, human
ggccctggtgtcccccgccc

SEQ ID NO: 409436 - DNA, 20 bp, human
gccccggccctctgcggcag

SEQ ID NO: 409437 - DNA, 20 bp, human
ggcgccagcccgagcgcgag

SEQ ID NO: 409438 - DNA, 20 bp, human
gggcgctcccactcgcgctc

SEQ ID NO: 409439 - DNA, 20 bp, human
gccaatggcagggagccact

SEQ ID NO: 409440 - DNA, 20 bp, human
gtcgcgtccccggccctctg

SEQ ID NO: 409441 - DNA, 20 bp, human
gctcccactcgcgctcgggc

SEQ ID NO: 409442 - DNA, 20 bp, human
ggcggtggccgtcgcgtccc

SEQ ID NO: 409443 - DNA, 20 bp, human
gcttgcctggcagtcggcgt

SEQ ID NO: 409444 - DNA, 20 bp, human
gtgatactgagagctgtcag

SEQ ID NO: 409445 - DNA, 20 bp, human
gcttccaggagtctcccact

SEQ ID NO: 409446 - DNA, 20 bp, human
gacgcccccggccggacgat

SEQ ID NO: 409447 - DNA, 20 bp, human
ggtacccatcgtccggccgg

SEQ ID NO: 409448 - DNA, 20 bp, human
ggccaccgccgctgctttgt

SEQ ID NO: 409449 - DNA, 20 bp, human
ggcgccaggcgcgaaggcag

SEQ ID NO: 409450 - DNA, 20 bp, human
gcccccgctgcagtcgggag

SEQ ID NO: 409451 - DNA, 20 bp, human
gtctccccacaaagcagcgg

SEQ ID NO: 409452 - DNA, 20 bp, human
gtgcagtcgggagagggcgg

SEQ ID NO: 409453 - DNA, 20 bp, human
gtcacctgggaggactgggg

SEQ ID NO: 409454 - DNA, 20 bp, human
ggcctgcccgggggatgctc

SEQ ID NO: 409455 - DNA, 20 bp, human
gatagggcagaagaaccggg

SEQ ID NO: 409456 - DNA, 20 bp, human
gcccaagcttcgcaacccac

SEQ ID NO: 409457 - DNA, 20 bp, human
gcgggccctggggccaatga

SEQ ID NO: 409458 - DNA, 20 bp, human
ggggttgcgaagcttggggc

SEQ ID NO: 409459 - DNA, 20 bp, human
ggccaatgatggtccaggac

SEQ ID NO: 409460 - DNA, 20 bp, human
gctggggccaatgatggtcc

SEQ ID NO: 409461 - DNA, 20 bp, human
gccctgtcctggaccatcat

SEQ ID NO: 409462 - DNA, 20 bp, human
gtccctagagccggcgtgga

SEQ ID NO: 409463 - DNA, 20 bp, human
gggacgtaatttgggagcga

SEQ ID NO: 409464 - DNA, 20 bp, human
ggcattgccaggtgcgacgg

SEQ ID NO: 409465 - DNA, 20 bp, human
gtcgcagcgggcctacagcc

SEQ ID NO: 409466 - DNA, 20 bp, human
gaacagagacgctaggagag

SEQ ID NO: 409467 - DNA, 20 bp, human
gcgtctctgtttttaggttg

SEQ ID NO: 409468 - DNA, 20 bp, human
gctagtgaatggagatagaa

SEQ ID NO: 409469 - DNA, 20 bp, human
gcgtcccgcacccctggcgg

SEQ ID NO: 409470 - DNA, 20 bp, human
gtatctccattcactaggga

SEQ ID NO: 409471 - DNA, 20 bp, human
gggcggcatgtacgatgtca

SEQ ID NO: 409472 - DNA, 20 bp, human
gatgtacgatgtcatggtga

SEQ ID NO: 409473 - DNA, 20 bp, human
gtccttaaagccaccgccag

SEQ ID NO: 409474 - DNA, 20 bp, human
gcggagtgcttaggccagga

SEQ ID NO: 409475 - DNA, 20 bp, human
gctggcttccgtcctgcgcg

SEQ ID NO: 409476 - DNA, 20 bp, human
gcaccgaaaaaaacaggcgc

SEQ ID NO: 409477 - DNA, 20 bp, human
gtccaaacaccgaaaaaaac

SEQ ID NO: 409478 - DNA, 20 bp, human
ggccggcgaacagtttggcg

SEQ ID NO: 409479 - DNA, 20 bp, human
ggcctgtttttttcggtgtt

SEQ ID NO: 409480 - DNA, 20 bp, human
gcgtatattccgccccggca

SEQ ID NO: 409481 - DNA, 20 bp, human
gaaaacaggcgctgggtgcg

SEQ ID NO: 409482 - DNA, 20 bp, human
ggggagaatcgctgaacctg

SEQ ID NO: 409483 - DNA, 20 bp, human
gctactcaggaagcagcggc

SEQ ID NO: 409484 - DNA, 20 bp, human
gtcgctgaacctgggggtcc

SEQ ID NO: 409485 - DNA, 20 bp, human
ggaaatgcaaagccctgccg

SEQ ID NO: 409486 - DNA, 20 bp, human
gccatggggaagcgcgacgt

SEQ ID NO: 409487 - DNA, 20 bp, human
gacccctcggcggcgtggtc

SEQ ID NO: 409488 - DNA, 20 bp, human
gccaacatggtgtatcccat

SEQ ID NO: 409489 - DNA, 20 bp, human
ggggaagcgcgacgtgggcg

SEQ ID NO: 409490 - DNA, 20 bp, human
gagtcaacatggagaagtta

SEQ ID NO: 409491 - DNA, 20 bp, human
gctaacagcagcttcaaagg

SEQ ID NO: 409492 - DNA, 20 bp, human
gtcggcggcgtggtcaggtg

SEQ ID NO: 409493 - DNA, 20 bp, human
ggacgttcggtacccctcgg

SEQ ID NO: 409494 - DNA, 20 bp, human
gaagcggctgcggttctcgc

SEQ ID NO: 409495 - DNA, 20 bp, human
gtgggacgttcggtacccct

SEQ ID NO: 409496 - DNA, 20 bp, human
ggaaaccggacgctgcagta

SEQ ID NO: 409497 - DNA, 20 bp, human
gtctgacttggtagccaacc

SEQ ID NO: 409498 - DNA, 20 bp, human
gtccaccctactgcagcgtc

SEQ ID NO: 409499 - DNA, 20 bp, human
gaccggacgctgcagtaggg

SEQ ID NO: 409500 - DNA, 20 bp, human
gccactctctgagccaaccc

SEQ ID NO: 409501 - DNA, 20 bp, human
gctcctgggtgggtgcagac

SEQ ID NO: 409502 - DNA, 20 bp, human
gacattcttaagtatctgtg

SEQ ID NO: 409503 - DNA, 20 bp, human
gagaggaacctctacttttc

SEQ ID NO: 409504 - DNA, 20 bp, human
gtcacattctgtatttgacc

SEQ ID NO: 409505 - DNA, 20 bp, human
ggtgcagacagggcctgggt

SEQ ID NO: 409506 - DNA, 20 bp, human
gaaaacaggcgctggagcga

SEQ ID NO: 409507 - DNA, 20 bp, human
ggcgagggtgacggactcac

SEQ ID NO: 409508 - DNA, 20 bp, human
ggggcggggcctgacgaagc

SEQ ID NO: 409509 - DNA, 20 bp, human
ggagtcgagaccggccagta

SEQ ID NO: 409510 - DNA, 20 bp, human
gggcgctggagcgagggtga

SEQ ID NO: 409511 - DNA, 20 bp, human
ggccccgcccctgcttcgtc

SEQ ID NO: 409512 - DNA, 20 bp, human
gaaaaccctaaaacaggcgc

SEQ ID NO: 409513 - DNA, 20 bp, human
ggtgcctcaaccttactggc

SEQ ID NO: 409514 - DNA, 20 bp, human
gcgccctctgcgccttccaa

SEQ ID NO: 409515 - DNA, 20 bp, human
ggccctttggaaggcgcaga

SEQ ID NO: 409516 - DNA, 20 bp, human
gtagcgtagaagacctctga

SEQ ID NO: 409517 - DNA, 20 bp, human
gagtcaggacgcacatctta

SEQ ID NO: 409518 - DNA, 20 bp, human
gatactcccgaggtgaagct

SEQ ID NO: 409519 - DNA, 20 bp, human
gtcttctacgctatcattcg

SEQ ID NO: 409520 - DNA, 20 bp, human
ggaaaagcccagcttcacct

SEQ ID NO: 409521 - DNA, 20 bp, human
gcatcttaaggatactcccg

SEQ ID NO: 409522 - DNA, 20 bp, human
gcattcgaggctgagttttc

SEQ ID NO: 409523 - DNA, 20 bp, human
gaaccctaaccccaacctta

SEQ ID NO: 409524 - DNA, 20 bp, human
gttagcggagtgtggtcggg

SEQ ID NO: 409525 - DNA, 20 bp, human
gtcccagctgccctaaggtt

SEQ ID NO: 409526 - DNA, 20 bp, human
ggggctgggaggagtccgcg

SEQ ID NO: 409527 - DNA, 20 bp, human
ggcgcggaagagaagagtct

SEQ ID NO: 409528 - DNA, 20 bp, human
gaggccccgcccacctctcg

SEQ ID NO: 409529 - DNA, 20 bp, human
ggtgcaaaggacaaggggcc

SEQ ID NO: 409530 - DNA, 20 bp, human
gtccctagggccaccgtctg

SEQ ID NO: 409531 - DNA, 20 bp, human
gggccagatccccgagaggt

SEQ ID NO: 409532 - DNA, 20 bp, human
gcctgggccagatccccgag

SEQ ID NO: 409533 - DNA, 20 bp, human
gtgggaggagtccgcggggg

SEQ ID NO: 409534 - DNA, 20 bp, human
gggtctgtgccaatcggcgc

SEQ ID NO: 409535 - DNA, 20 bp, human
gaccccagacggtggcccta

SEQ ID NO: 409536 - DNA, 20 bp, human
ggccctctgtctgttctgaa

SEQ ID NO: 409537 - DNA, 20 bp, human
gacccgaaaaattgaggctc

SEQ ID NO: 409538 - DNA, 20 bp, human
gtcccagagcctcaattttt

SEQ ID NO: 409539 - DNA, 20 bp, human
gtccaaaacccgaaaaattg

SEQ ID NO: 409540 - DNA, 20 bp, human
gagcaggaatgcgggcgcgg

SEQ ID NO: 409541 - DNA, 20 bp, human
gtgcccttcagaacagacag

SEQ ID NO: 409542 - DNA, 20 bp, human
gctgctcaggaagcagcggc

SEQ ID NO: 409543 - DNA, 20 bp, human
ggcgcgggggcggaagtctg

SEQ ID NO: 409544 - DNA, 20 bp, human
gaattgaggctctgggagcc

SEQ ID NO: 409545 - DNA, 20 bp, human
gatcccaggcggaggccctg

SEQ ID NO: 409546 - DNA, 20 bp, human
gccggggagcgcccaatccc

SEQ ID NO: 409547 - DNA, 20 bp, human
gaggggctcgcccgcgttcc

SEQ ID NO: 409548 - DNA, 20 bp, human
gcgcgccgggccgcggggaa

SEQ ID NO: 409549 - DNA, 20 bp, human
ggggatccgggctaaggaga

SEQ ID NO: 409550 - DNA, 20 bp, human
gcgcgcctggcgttgtgggc

SEQ ID NO: 409551 - DNA, 20 bp, human
gacgcgggcgagcccctctc

SEQ ID NO: 409552 - DNA, 20 bp, human
gtgggggaatgaggcgaaga

SEQ ID NO: 409553 - DNA, 20 bp, human
ggggtaagaaaccaggatcg

SEQ ID NO: 409554 - DNA, 20 bp, human
gggcgcgcgcctggcgttgt

SEQ ID NO: 409555 - DNA, 20 bp, human
gccattcccgggtctttctc

SEQ ID NO: 409556 - DNA, 20 bp, human
gtatccaatcagggatgagg

SEQ ID NO: 409557 - DNA, 20 bp, human
gtctgtcaatcagccaccaa

SEQ ID NO: 409558 - DNA, 20 bp, human
gtcaatcagccaccaagggg

SEQ ID NO: 409559 - DNA, 20 bp, human
gaaggcgggcttcctcccaa

SEQ ID NO: 409560 - DNA, 20 bp, human
gaggggtcaggtcactccgt

SEQ ID NO: 409561 - DNA, 20 bp, human
ggactcagagcgcaggggcg

SEQ ID NO: 409562 - DNA, 20 bp, human
ggcgctctgagtcctggctc

SEQ ID NO: 409563 - DNA, 20 bp, human
ggggaatggctccactggac

SEQ ID NO: 409564 - DNA, 20 bp, human
ggcaaacgtcacttcgggag

SEQ ID NO: 409565 - DNA, 20 bp, human
gaatcaggcacgctgcaggg

SEQ ID NO: 409566 - DNA, 20 bp, human
gcacaagaggcacagactga

SEQ ID NO: 409567 - DNA, 20 bp, human
gagcccctaacactaatgtc

SEQ ID NO: 409568 - DNA, 20 bp, human
gcagagcggttgtaaatccg

SEQ ID NO: 409569 - DNA, 20 bp, human
gaagtgccccaaggctccca

SEQ ID NO: 409570 - DNA, 20 bp, human
gatcccgacattagtgttag

SEQ ID NO: 409571 - DNA, 20 bp, human
gtaaatgagtgccggtgcgg

SEQ ID NO: 409572 - DNA, 20 bp, human
ggccatagacaccgccgcac

SEQ ID NO: 409573 - DNA, 20 bp, human
gtccgaggctgagtccgccc

SEQ ID NO: 409574 - DNA, 20 bp, human
gacactaatgtcgggatcaa

SEQ ID NO: 409575 - DNA, 20 bp, human
gggctcggagacacagagcg

SEQ ID NO: 409576 - DNA, 20 bp, human
gacggcgacccgcaactccg

SEQ ID NO: 409577 - DNA, 20 bp, human
ggaaacgtcgctggcgcgga

SEQ ID NO: 409578 - DNA, 20 bp, human
gctggcgcggagggatggtt

SEQ ID NO: 409579 - DNA, 20 bp, human
gacgggacacggatcctcta

SEQ ID NO: 409580 - DNA, 20 bp, human
ggacccgcaactccgaggct

SEQ ID NO: 409581 - DNA, 20 bp, human
gggggcgagcaagggactcg

SEQ ID NO: 409582 - DNA, 20 bp, human
gcagccgagcctcggagttg

SEQ ID NO: 409583 - DNA, 20 bp, human
gcgcctgggcccacccgaaa

SEQ ID NO: 409584 - DNA, 20 bp, human
gtgctgggaggtgttgtcct

SEQ ID NO: 409585 - DNA, 20 bp, human
gacggcacgaataatctgat

SEQ ID NO: 409586 - DNA, 20 bp, human
gcccactgctggttctaaag

SEQ ID NO: 409587 - DNA, 20 bp, human
gcggggcctggatgaggtag

SEQ ID NO: 409588 - DNA, 20 bp, human
gtgggcggggcccgcgaggt

SEQ ID NO: 409589 - DNA, 20 bp, human
gttagaaccagcagtgggcg

SEQ ID NO: 409590 - DNA, 20 bp, human
gccgaaaaatgcctctgcgc

SEQ ID NO: 409591 - DNA, 20 bp, human
gagcatcgttcccagcgcag

SEQ ID NO: 409592 - DNA, 20 bp, human
ggagtgctcaggccaaggat

SEQ ID NO: 409593 - DNA, 20 bp, human
gagaggcatttttcgggttt

SEQ ID NO: 409594 - DNA, 20 bp, human
ggcagtacagaagccaggtc

SEQ ID NO: 409595 - DNA, 20 bp, human
ggcactccatcctgcatctc

SEQ ID NO: 409596 - DNA, 20 bp, human
gtgtggaaccacagatcccc

SEQ ID NO: 409597 - DNA, 20 bp, human
gcagagggcaaagtagaggg

SEQ ID NO: 409598 - DNA, 20 bp, human
gaccccctgtccccaatatg

SEQ ID NO: 409599 - DNA, 20 bp, human
gggaggagctcgttttccgg

SEQ ID NO: 409600 - DNA, 20 bp, human
ggatctgtggttccacatat

SEQ ID NO: 409601 - DNA, 20 bp, human
gtccacatattggggacagg

SEQ ID NO: 409602 - DNA, 20 bp, human
gcccggaggagctcgttttc

SEQ ID NO: 409603 - DNA, 20 bp, human
gtgtgtcggccaaaggcatt

SEQ ID NO: 409604 - DNA, 20 bp, human
gctgtgattgtgtcggccaa

SEQ ID NO: 409605 - DNA, 20 bp, human
ggagctcgttttccgggggc

SEQ ID NO: 409606 - DNA, 20 bp, human
gcctctgaacggttaggcta

SEQ ID NO: 409607 - DNA, 20 bp, human
gtaggctatggctgcgataa

SEQ ID NO: 409608 - DNA, 20 bp, human
gataaaggccgtcaactcca

SEQ ID NO: 409609 - DNA, 20 bp, human
gtaagggcgatgattggccg

SEQ ID NO: 409610 - DNA, 20 bp, human
gataacgtcacttcctgtaa

SEQ ID NO: 409611 - DNA, 20 bp, human
gttcctgtaagggcgatgat

SEQ ID NO: 409612 - DNA, 20 bp, human
gttgctcagaatcgcgacta

SEQ ID NO: 409613 - DNA, 20 bp, human
ggtgcctttaggacccaagt

SEQ ID NO: 409614 - DNA, 20 bp, human
gagggcgacaggacaccaac

SEQ ID NO: 409615 - DNA, 20 bp, human
gcggaaaccagaatcgtttt

SEQ ID NO: 409616 - DNA, 20 bp, human
ggaagcctgacaatccccta

SEQ ID NO: 409617 - DNA, 20 bp, human
gtactctcatcccaagcgag

SEQ ID NO: 409618 - DNA, 20 bp, human
gaaggtactctcatccaaaa

SEQ ID NO: 409619 - DNA, 20 bp, human
ggatgagagtacattcctta

SEQ ID NO: 409620 - DNA, 20 bp, human
ggagtaccttcctctcgctt

SEQ ID NO: 409621 - DNA, 20 bp, human
gcattccttaggggattgtc

SEQ ID NO: 409622 - DNA, 20 bp, human
ggggattgtcaggcttccgt

SEQ ID NO: 409623 - DNA, 20 bp, human
gcaagcacttcatcacccaa

SEQ ID NO: 409624 - DNA, 20 bp, human
gaggtgcccatggtaaagtt

SEQ ID NO: 409625 - DNA, 20 bp, human
gtcagggccttcccactctg

SEQ ID NO: 409626 - DNA, 20 bp, human
gccgcagggcgctgacccct

SEQ ID NO: 409627 - DNA, 20 bp, human
gcgcccaccgccatgcactg

SEQ ID NO: 409628 - DNA, 20 bp, human
gcactgaggctgtagtgggc

SEQ ID NO: 409629 - DNA, 20 bp, human
gggcgcttccagtaactcag

SEQ ID NO: 409630 - DNA, 20 bp, human
gtgcacacgctaggtccgca

SEQ ID NO: 409631 - DNA, 20 bp, human
ggggatgaggccgagcccac

SEQ ID NO: 409632 - DNA, 20 bp, human
gcatgcactgaggctgtagt

SEQ ID NO: 409633 - DNA, 20 bp, human
ggctttgcaagctttagtcg

SEQ ID NO: 409634 - DNA, 20 bp, human
gcagcctcagtgcatggcgg

SEQ ID NO: 409635 - DNA, 20 bp, human
gggcgctcctcgggccccca

SEQ ID NO: 409636 - DNA, 20 bp, human
gtgggaaccctgaaagggtg

SEQ ID NO: 409637 - DNA, 20 bp, human
ggtgcgacccgcaagggaaa

SEQ ID NO: 409638 - DNA, 20 bp, human
gaccctgaaagggtggggca

SEQ ID NO: 409639 - DNA, 20 bp, human
ggcaaggctgatgcggtagt

SEQ ID NO: 409640 - DNA, 20 bp, human
gaagactgagagacctgggg

SEQ ID NO: 409641 - DNA, 20 bp, human
ggggtggggcaaggctgatg

SEQ ID NO: 409642 - DNA, 20 bp, human
gggaaggcagagcgaataac

SEQ ID NO: 409643 - DNA, 20 bp, human
gagaacaaagacttgctggg

SEQ ID NO: 409644 - DNA, 20 bp, human
gggcggggtgcgacccgcaa

SEQ ID NO: 409645 - DNA, 20 bp, human
gtaagcgggacgggcggtgt

SEQ ID NO: 409646 - DNA, 20 bp, human
ggagaaagcggtgtagggag

SEQ ID NO: 409647 - DNA, 20 bp, human
gcccctcgggtgggagagtt

SEQ ID NO: 409648 - DNA, 20 bp, human
gaacccgcgcggggactgct

SEQ ID NO: 409649 - DNA, 20 bp, human
gaagaaacggcgttctggac

SEQ ID NO: 409650 - DNA, 20 bp, human
gctgcggagaaagcggtgta

SEQ ID NO: 409651 - DNA, 20 bp, human
gacacctaaaaggcggggcg

SEQ ID NO: 409652 - DNA, 20 bp, human
ggccggctacacctaaaagg

SEQ ID NO: 409653 - DNA, 20 bp, human
ggcggtgtagggagaggctt

SEQ ID NO: 409654 - DNA, 20 bp, human
gtagggagaggcttgggctt

SEQ ID NO: 409655 - DNA, 20 bp, human
ggaggccggctacacctaaa

SEQ ID NO: 409656 - DNA, 20 bp, human
gctaggaaggcgaccgtgtc

SEQ ID NO: 409657 - DNA, 20 bp, human
gccccagccgacaaccgccg

SEQ ID NO: 409658 - DNA, 20 bp, human
gacaaccgccgcggctctta

SEQ ID NO: 409659 - DNA, 20 bp, human
gtgtctggccgggaaagtcg

SEQ ID NO: 409660 - DNA, 20 bp, human
ggaaggcgaccgtgtctggc

SEQ ID NO: 409661 - DNA, 20 bp, human
ggggcactccacgactttcc

SEQ ID NO: 409662 - DNA, 20 bp, human
gagccgcggcggttgtcggc

SEQ ID NO: 409663 - DNA, 20 bp, human
gcgggctacgagtgcctcgc

SEQ ID NO: 409664 - DNA, 20 bp, human
gccgggacagctcccagaga

SEQ ID NO: 409665 - DNA, 20 bp, human
gaaccccgaagacctccccc

SEQ ID NO: 409666 - DNA, 20 bp, human
gaacgggccgggacgagtcg

SEQ ID NO: 409667 - DNA, 20 bp, human
gctcccgggcggctccgaac

SEQ ID NO: 409668 - DNA, 20 bp, human
gcgtacactcccctctcacg

SEQ ID NO: 409669 - DNA, 20 bp, human
gagacggagtgactccaaac

SEQ ID NO: 409670 - DNA, 20 bp, human
gtgtgcgcatgcgcgaagga

SEQ ID NO: 409671 - DNA, 20 bp, human
gtccaagcgacaggcacttc

SEQ ID NO: 409672 - DNA, 20 bp, human
gccctctcacgtggcagcga

SEQ ID NO: 409673 - DNA, 20 bp, human
gcgacaggcacttccggacg

SEQ ID NO: 409674 - DNA, 20 bp, human
gcactcttggtaatgcttgc

SEQ ID NO: 409675 - DNA, 20 bp, human
ggccgcccgggagcgcacaa

SEQ ID NO: 409676 - DNA, 20 bp, human
ggcggggcgcgactaggaaa

SEQ ID NO: 409677 - DNA, 20 bp, human
gggaaagactggcctgactt

SEQ ID NO: 409678 - DNA, 20 bp, human
gacttgggagtggcccgaaa

SEQ ID NO: 409679 - DNA, 20 bp, human
gcgactaggaaagggctggg

SEQ ID NO: 409680 - DNA, 20 bp, human
ggtgggaggcccagggcggt

SEQ ID NO: 409681 - DNA, 20 bp, human
ggggcgcggaaagaaaaact

SEQ ID NO: 409682 - DNA, 20 bp, human
gggaggcccagggcggtagg

SEQ ID NO: 409683 - DNA, 20 bp, human
gtccgggtgtgcaggaaact

SEQ ID NO: 409684 - DNA, 20 bp, human
gtgggagtggcccgaaaggg

SEQ ID NO: 409685 - DNA, 20 bp, human
ggggcctcccaccacccttt

SEQ ID NO: 409686 - DNA, 20 bp, human
ggactccctcatcctggtca

SEQ ID NO: 409687 - DNA, 20 bp, human
gaggtcggggcagtatttgg

SEQ ID NO: 409688 - DNA, 20 bp, human
gaggacgcctccagctccca

SEQ ID NO: 409689 - DNA, 20 bp, human
ggagacgcgcaaaaggtggg

SEQ ID NO: 409690 - DNA, 20 bp, human
gcgccctatgactgaggtta

SEQ ID NO: 409691 - DNA, 20 bp, human
gacggagcgccctatgactg

SEQ ID NO: 409692 - DNA, 20 bp, human
gagaaacgaccgagacactg

SEQ ID NO: 409693 - DNA, 20 bp, human
gggtctcaggcagctgttag

SEQ ID NO: 409694 - DNA, 20 bp, human
gcgtctcgcccgggcatcga

SEQ ID NO: 409695 - DNA, 20 bp, human
gcctccctaacctcagtcat

SEQ ID NO: 409696 - DNA, 20 bp, human
gcaccccggcgactctgatt

SEQ ID NO: 409697 - DNA, 20 bp, human
gcgcttcaagccacagtcca

SEQ ID NO: 409698 - DNA, 20 bp, human
gaaagagcagggcgtagaga

SEQ ID NO: 409699 - DNA, 20 bp, human
gtccacccaatcagagtcgc

SEQ ID NO: 409700 - DNA, 20 bp, human
gccggccaactgtttatccg

SEQ ID NO: 409701 - DNA, 20 bp, human
gtcactcaggatgcaggggg

SEQ ID NO: 409702 - DNA, 20 bp, human
gcccggcgactctgattggg

SEQ ID NO: 409703 - DNA, 20 bp, human
gcggtcagtcctgctctgct

SEQ ID NO: 409704 - DNA, 20 bp, human
gctgtgcaggacgaagaagc

SEQ ID NO: 409705 - DNA, 20 bp, human
gtctgattgggtggagcgcc

SEQ ID NO: 409706 - DNA, 20 bp, human
gagacgcacgggtcccaccc

SEQ ID NO: 409707 - DNA, 20 bp, human
gagcgaggttgagagacgca

SEQ ID NO: 409708 - DNA, 20 bp, human
gctgccaattctaaagggga

SEQ ID NO: 409709 - DNA, 20 bp, human
gttagaattggcagaaggcg

SEQ ID NO: 409710 - DNA, 20 bp, human
ggctcgaaaacaagaggcgc

SEQ ID NO: 409711 - DNA, 20 bp, human
ggcctcttgttttcgagctt

SEQ ID NO: 409712 - DNA, 20 bp, human
gattggcagaaggcggggcc

SEQ ID NO: 409713 - DNA, 20 bp, human
gtcttgttttcgagctttgg

SEQ ID NO: 409714 - DNA, 20 bp, human
gggcgcggggcgaaagcctg

SEQ ID NO: 409715 - DNA, 20 bp, human
gatctctgaagctgaggaca

SEQ ID NO: 409716 - DNA, 20 bp, human
gaatacgtatagctgcgcgc

SEQ ID NO: 409717 - DNA, 20 bp, human
gtgcgcacggcattaagtgt

SEQ ID NO: 409718 - DNA, 20 bp, human
gggccgagccccaagagctt

SEQ ID NO: 409719 - DNA, 20 bp, human
gccccaagagctttggaatg

SEQ ID NO: 409720 - DNA, 20 bp, human
gctaggttgagcatgagcgc

SEQ ID NO: 409721 - DNA, 20 bp, human
gcggaagcggaagtgccagc

SEQ ID NO: 409722 - DNA, 20 bp, human
gaaacccagcgccaagggcc

SEQ ID NO: 409723 - DNA, 20 bp, human
ggggtcggagggtgacgctc

SEQ ID NO: 409724 - DNA, 20 bp, human
gcgcgtggaggcgtcaccta

SEQ ID NO: 409725 - DNA, 20 bp, human
gccagcgccaagggccgggt

SEQ ID NO: 409726 - DNA, 20 bp, human
gaacgcagctggtgcggata

SEQ ID NO: 409727 - DNA, 20 bp, human
ggcagctggtgcggataggg

SEQ ID NO: 409728 - DNA, 20 bp, human
gcactcagggcctgaaaaga

SEQ ID NO: 409729 - DNA, 20 bp, human
gatcaggaacgcagctggtg

SEQ ID NO: 409730 - DNA, 20 bp, human
gcagaggattgcctgttcaa

SEQ ID NO: 409731 - DNA, 20 bp, human
gaaattgatacacaaggtaa

SEQ ID NO: 409732 - DNA, 20 bp, human
gaaaggaccagaatacagga

SEQ ID NO: 409733 - DNA, 20 bp, human
ggttcaaaggaccagaatac

SEQ ID NO: 409734 - DNA, 20 bp, human
gttatgaccttcctgtattc

SEQ ID NO: 409735 - DNA, 20 bp, human
ggcatataaattgatacaca

SEQ ID NO: 409736 - DNA, 20 bp, human
gagggctctgcgatcctcgt

SEQ ID NO: 409737 - DNA, 20 bp, human
ggcagagccctcatgccgag

SEQ ID NO: 409738 - DNA, 20 bp, human
gtagtccagagcccgactgc

SEQ ID NO: 409739 - DNA, 20 bp, human
gagcgagccgctcggcatga

SEQ ID NO: 409740 - DNA, 20 bp, human
ggaagcccgcagtcgggctc

SEQ ID NO: 409741 - DNA, 20 bp, human
gtcggcctgcgggatcctct

SEQ ID NO: 409742 - DNA, 20 bp, human
gcaggcctgaccactctagc

SEQ ID NO: 409743 - DNA, 20 bp, human
gcggtaaaaggaaacaagcc

SEQ ID NO: 409744 - DNA, 20 bp, human
gcatagggaagcccgcagtc

SEQ ID NO: 409745 - DNA, 20 bp, human
ggcttggaaatgagaggcat

SEQ ID NO: 409746 - DNA, 20 bp, human
gtgtccgcggaaggaggcga

SEQ ID NO: 409747 - DNA, 20 bp, human
gggcccagggccgctggcgg

SEQ ID NO: 409748 - DNA, 20 bp, human
gcctctctaggaaactggga

SEQ ID NO: 409749 - DNA, 20 bp, human
gcgtgcgcaactggggaagc

SEQ ID NO: 409750 - DNA, 20 bp, human
gcgtggaagacaagtgtccg

SEQ ID NO: 409751 - DNA, 20 bp, human
ggaagacaagtgtccgcgga

SEQ ID NO: 409752 - DNA, 20 bp, human
ggcagccgtgcagaaccgat

SEQ ID NO: 409753 - DNA, 20 bp, human
ggccgtgcagaaccgatggg

SEQ ID NO: 409754 - DNA, 20 bp, human
ggcgcgctccagaactctat

SEQ ID NO: 409755 - DNA, 20 bp, human
gcgacgcgcgtgcgcaactg

SEQ ID NO: 409756 - DNA, 20 bp, human
gggggccagtgaaatcgctg

SEQ ID NO: 409757 - DNA, 20 bp, human
ggcggctgttgctgcggctc

SEQ ID NO: 409758 - DNA, 20 bp, human
ggttgcagctgctcgtgttg

SEQ ID NO: 409759 - DNA, 20 bp, human
gagcggtgggagcgagagtc

SEQ ID NO: 409760 - DNA, 20 bp, human
gggtgggagcgagagtcagg

SEQ ID NO: 409761 - DNA, 20 bp, human
gtgaaatcgctgaggaaacc

SEQ ID NO: 409762 - DNA, 20 bp, human
gccacagcggccagcagtct

SEQ ID NO: 409763 - DNA, 20 bp, human
gcggctgctgttgcagttct

SEQ ID NO: 409764 - DNA, 20 bp, human
gcagcagtctcggccccagt

SEQ ID NO: 409765 - DNA, 20 bp, human
ggctgttgcagttctaggtg

SEQ ID NO: 409766 - DNA, 20 bp, human
ggcgacctcggcagcccaga

SEQ ID NO: 409767 - DNA, 20 bp, human
gaggcgcagggccaccccgg

SEQ ID NO: 409768 - DNA, 20 bp, human
ggggctgccgaggtcgccct

SEQ ID NO: 409769 - DNA, 20 bp, human
gggagcggccgagcagaagt

SEQ ID NO: 409770 - DNA, 20 bp, human
gaggcgacgcgggtcctcgg

SEQ ID NO: 409771 - DNA, 20 bp, human
ggcggccgagcagaagttgg

SEQ ID NO: 409772 - DNA, 20 bp, human
gccagagggcgtggaccctc

SEQ ID NO: 409773 - DNA, 20 bp, human
gcccaggcggggccaccccg

SEQ ID NO: 409774 - DNA, 20 bp, human
gctcggcagcccagagggcg

SEQ ID NO: 409775 - DNA, 20 bp, human
ggctttctgggcactccgga

SEQ ID NO: 409776 - DNA, 20 bp, human
gaggtcccgaggtggataag

SEQ ID NO: 409777 - DNA, 20 bp, human
ggccctcgggacactctagg

SEQ ID NO: 409778 - DNA, 20 bp, human
gtcccgaggtggataagggg

SEQ ID NO: 409779 - DNA, 20 bp, human
gaaggaatgcgtgggtgact

SEQ ID NO: 409780 - DNA, 20 bp, human
gcgggtggaccgggtgggtg

SEQ ID NO: 409781 - DNA, 20 bp, human
gtggacccgcccggcctgac

SEQ ID NO: 409782 - DNA, 20 bp, human
ggcctcctagagtgtcccga

SEQ ID NO: 409783 - DNA, 20 bp, human
gaccctctcttggatccgaa

SEQ ID NO: 409784 - DNA, 20 bp, human
gcaggccctcgggacactct

SEQ ID NO: 409785 - DNA, 20 bp, human
ggccgggcgggtccatatcc

SEQ ID NO: 409786 - DNA, 20 bp, human
gagggcaaagcgctctgatt

SEQ ID NO: 409787 - DNA, 20 bp, human
gccaggcggcggggcgtgac

SEQ ID NO: 409788 - DNA, 20 bp, human
ggcgccgccggcgtccaatc

SEQ ID NO: 409789 - DNA, 20 bp, human
ggtagtccgctctaggtgag

SEQ ID NO: 409790 - DNA, 20 bp, human
gccggaacgcaggtcctgat

SEQ ID NO: 409791 - DNA, 20 bp, human
gagtaactgtcgccggaggg

SEQ ID NO: 409792 - DNA, 20 bp, human
gggcgacagttactaggcaa

SEQ ID NO: 409793 - DNA, 20 bp, human
gaactgtcgccggagggagg

SEQ ID NO: 409794 - DNA, 20 bp, human
gcggctctcgaagctgctat

SEQ ID NO: 409795 - DNA, 20 bp, human
ggagagccgctcacctagag

SEQ ID NO: 409796 - DNA, 20 bp, human
gtcaggaccccagaaaagat

SEQ ID NO: 409797 - DNA, 20 bp, human
gcgcacaaggatggatgagt

SEQ ID NO: 409798 - DNA, 20 bp, human
ggggactggaagcctaaatc

SEQ ID NO: 409799 - DNA, 20 bp, human
gggggtgatccgcacaagga

SEQ ID NO: 409800 - DNA, 20 bp, human
gtctgcctgtccaccccaaa

SEQ ID NO: 409801 - DNA, 20 bp, human
gcccctagccttccagattt

SEQ ID NO: 409802 - DNA, 20 bp, human
ggaagggctgccctttgggg

SEQ ID NO: 409803 - DNA, 20 bp, human
gggtgagtaggagagtcctg

SEQ ID NO: 409804 - DNA, 20 bp, human
gcatctctccccatcttttc

SEQ ID NO: 409805 - DNA, 20 bp, human
gagaggaagggctgcccttt

SEQ ID NO: 409806 - DNA, 20 bp, human
ggccctgccactgtcctcca

SEQ ID NO: 409807 - DNA, 20 bp, human
gtggccagaaccagtcgctt

SEQ ID NO: 409808 - DNA, 20 bp, human
ggctgcagagccgaagcgac

SEQ ID NO: 409809 - DNA, 20 bp, human
ggagccgaagcgactggttc

SEQ ID NO: 409810 - DNA, 20 bp, human
gagggacggcccacggagtg

SEQ ID NO: 409811 - DNA, 20 bp, human
gagcgcccctgattggatag

SEQ ID NO: 409812 - DNA, 20 bp, human
gggagggagggagctgacct

SEQ ID NO: 409813 - DNA, 20 bp, human
gctgctgtcactcagggaag

SEQ ID NO: 409814 - DNA, 20 bp, human
gttgctccgaactgctagaa

SEQ ID NO: 409815 - DNA, 20 bp, human
gattcgaagtaaaggtggga

SEQ ID NO: 409816 - DNA, 20 bp, human
gcgggctgtggagttcgaga

SEQ ID NO: 409817 - DNA, 20 bp, human
gcgagagcggagaacgcggt

SEQ ID NO: 409818 - DNA, 20 bp, human
gttagcggagggagagtagt

SEQ ID NO: 409819 - DNA, 20 bp, human
ggcgccgagagcggagaacg

SEQ ID NO: 409820 - DNA, 20 bp, human
gacaatgggtggtttagcgg

SEQ ID NO: 409821 - DNA, 20 bp, human
gtccggagggacaaacgctg

SEQ ID NO: 409822 - DNA, 20 bp, human
gttctccgctctcggcgctg

SEQ ID NO: 409823 - DNA, 20 bp, human
ggctgcggcaccaccactta

SEQ ID NO: 409824 - DNA, 20 bp, human
gtagttggagcccaagctga

SEQ ID NO: 409825 - DNA, 20 bp, human
gggagaacgcggtcgggctg

SEQ ID NO: 409826 - DNA, 20 bp, human
gaggcccgggtgggattggg

SEQ ID NO: 409827 - DNA, 20 bp, human
ggctccgcccaatcccaccc

SEQ ID NO: 409828 - DNA, 20 bp, human
gggagtgcagcgcacgacct

SEQ ID NO: 409829 - DNA, 20 bp, human
gctcccagctcgtctcgttt

SEQ ID NO: 409830 - DNA, 20 bp, human
gctagacctgccgtggagac

SEQ ID NO: 409831 - DNA, 20 bp, human
gctggaaatagattgtgtcc

SEQ ID NO: 409832 - DNA, 20 bp, human
gttggaggctagacctgccg

SEQ ID NO: 409833 - DNA, 20 bp, human
gcgcgcgcagctgagaggcg

SEQ ID NO: 409834 - DNA, 20 bp, human
gccagctcgtctcgttttgg

SEQ ID NO: 409835 - DNA, 20 bp, human
gacgagacgagctgggagcg

SEQ ID NO: 409836 - DNA, 20 bp, human
gcgtgcgcaggcgtacttcc

SEQ ID NO: 409837 - DNA, 20 bp, human
gtgaaagacgcagctcaaga

SEQ ID NO: 409838 - DNA, 20 bp, human
ggtgtctttctaatgctttg

SEQ ID NO: 409839 - DNA, 20 bp, human
ggcgctttgcagaagatgct

SEQ ID NO: 409840 - DNA, 20 bp, human
gggtattacttttgtgtctg

SEQ ID NO: 409841 - DNA, 20 bp, human
gttcttggatggaatctctc

SEQ ID NO: 409842 - DNA, 20 bp, human
ggaatgaggtcatacttttg

SEQ ID NO: 409843 - DNA, 20 bp, human
ggttgaggggacggtggcgg

SEQ ID NO: 409844 - DNA, 20 bp, human
ggtatgacctcattcttgga

SEQ ID NO: 409845 - DNA, 20 bp, human
gcgcaaactttgcatctctt

SEQ ID NO: 409846 - DNA, 20 bp, human
ggctgcagcagtagggatct

SEQ ID NO: 409847 - DNA, 20 bp, human
gctgaccaaaccacttgcag

SEQ ID NO: 409848 - DNA, 20 bp, human
gcagcagtagggatctgggc

SEQ ID NO: 409849 - DNA, 20 bp, human
gagggacaataaactcctat

SEQ ID NO: 409850 - DNA, 20 bp, human
gggagtgggagttttcctat

SEQ ID NO: 409851 - DNA, 20 bp, human
gaaaactcccactccccttc

SEQ ID NO: 409852 - DNA, 20 bp, human
gttattgtccctggtatggt

SEQ ID NO: 409853 - DNA, 20 bp, human
gtctgggtctgtgccttgaa

SEQ ID NO: 409854 - DNA, 20 bp, human
ggagtttattgtccctggta

SEQ ID NO: 409855 - DNA, 20 bp, human
gtatgtgtcgttgttttaca

SEQ ID NO: 409856 - DNA, 20 bp, human
gaaaacagcggctaggtacg

SEQ ID NO: 409857 - DNA, 20 bp, human
gagaaccggcagacgcgggg

SEQ ID NO: 409858 - DNA, 20 bp, human
gcacctcgttggctccacgg

SEQ ID NO: 409859 - DNA, 20 bp, human
gcgcgtctgccggttctaca

SEQ ID NO: 409860 - DNA, 20 bp, human
gtacctagccgctgtttttc

SEQ ID NO: 409861 - DNA, 20 bp, human
ggtcccagatatatacacag

SEQ ID NO: 409862 - DNA, 20 bp, human
ggcccccgccccgcgtctgc

SEQ ID NO: 409863 - DNA, 20 bp, human
gaacccgaaaaacagcggct

SEQ ID NO: 409864 - DNA, 20 bp, human
gcagggcaggtctctccgcc

SEQ ID NO: 409865 - DNA, 20 bp, human
gtggttttgggcgtggcgca

SEQ ID NO: 409866 - DNA, 20 bp, human
gggcgggcgtaggaccaatg

SEQ ID NO: 409867 - DNA, 20 bp, human
gcgccccgggaccctagagc

SEQ ID NO: 409868 - DNA, 20 bp, human
gggcgtcagaggtgagtctg

SEQ ID NO: 409869 - DNA, 20 bp, human
gagagccggcgattcgtcgc

SEQ ID NO: 409870 - DNA, 20 bp, human
gcggcacagagtggcggctg

SEQ ID NO: 409871 - DNA, 20 bp, human
gcgtgcgttcgcagcagggg

SEQ ID NO: 409872 - DNA, 20 bp, human
gactctgtgccggaccctgc

SEQ ID NO: 409873 - DNA, 20 bp, human
gggcgccggcgacgaatcgc

SEQ ID NO: 409874 - DNA, 20 bp, human
gcccggggcgcgcggctgac

SEQ ID NO: 409875 - DNA, 20 bp, human
gcgcgcggctgacgggctgg

SEQ ID NO: 409876 - DNA, 20 bp, human
gcaggcccaccggagagcat

SEQ ID NO: 409877 - DNA, 20 bp, human
gagaggaaggctttcgggtt

SEQ ID NO: 409878 - DNA, 20 bp, human
gtgtatatgtaagtctcgag

SEQ ID NO: 409879 - DNA, 20 bp, human
gactgttataggagacagaa

SEQ ID NO: 409880 - DNA, 20 bp, human
gattttcccatgctctccgg

SEQ ID NO: 409881 - DNA, 20 bp, human
ggagcgaagaggaaggcttt

SEQ ID NO: 409882 - DNA, 20 bp, human
gcaagagaaaacttttactt

SEQ ID NO: 409883 - DNA, 20 bp, human
gagtaatttcaaactgttat

SEQ ID NO: 409884 - DNA, 20 bp, human
gcaaatttgatttacttaca

SEQ ID NO: 409885 - DNA, 20 bp, human
gcctgaaaaggctgcagctg

SEQ ID NO: 409886 - DNA, 20 bp, human
gtaaatgcaaatactgtctg

SEQ ID NO: 409887 - DNA, 20 bp, human
gcccgtcactcagggcccga

SEQ ID NO: 409888 - DNA, 20 bp, human
gtgcaaatactgtctggggt

SEQ ID NO: 409889 - DNA, 20 bp, human
ggagcggacagcacagcttc

SEQ ID NO: 409890 - DNA, 20 bp, human
ggcatatggccttattcaca

SEQ ID NO: 409891 - DNA, 20 bp, human
gaacaacaaaaccagaagcc

SEQ ID NO: 409892 - DNA, 20 bp, human
gtctgaaaattttgaataat

SEQ ID NO: 409893 - DNA, 20 bp, human
ggaggaagccccgtctgaaa

SEQ ID NO: 409894 - DNA, 20 bp, human
gccagcccagcgttcctgat

SEQ ID NO: 409895 - DNA, 20 bp, human
gttatccaatcaggaacgct

SEQ ID NO: 409896 - DNA, 20 bp, human
ggaagccgccctgttcggtc

SEQ ID NO: 409897 - DNA, 20 bp, human
gcaagcagccggaccgaaca

SEQ ID NO: 409898 - DNA, 20 bp, human
gaacagggcggcttctggtt

SEQ ID NO: 409899 - DNA, 20 bp, human
gccatgctctggggtggacg

SEQ ID NO: 409900 - DNA, 20 bp, human
ggggcggcttctggtttggc

SEQ ID NO: 409901 - DNA, 20 bp, human
ggtccggctgcttgcctgat

SEQ ID NO: 409902 - DNA, 20 bp, human
gccgttggaagtaaagtgtt

SEQ ID NO: 409903 - DNA, 20 bp, human
gtggcgggtcctttgtctct

SEQ ID NO: 409904 - DNA, 20 bp, human
gggggtccgaccctagccca

SEQ ID NO: 409905 - DNA, 20 bp, human
gaaaacttttgcctgagtac

SEQ ID NO: 409906 - DNA, 20 bp, human
gactcagggcgtgagggcga

SEQ ID NO: 409907 - DNA, 20 bp, human
gcctgaaaagggggcacctt

SEQ ID NO: 409908 - DNA, 20 bp, human
gaagaaagactgacagccga

SEQ ID NO: 409909 - DNA, 20 bp, human
gaagtcagagacgctggcct

SEQ ID NO: 409910 - DNA, 20 bp, human
ggttaacaagtcagagacgc

SEQ ID NO: 409911 - DNA, 20 bp, human
gaccttatatacaaggttta

SEQ ID NO: 409912 - DNA, 20 bp, human
ggtccaatcaggcacgcggt

SEQ ID NO: 409913 - DNA, 20 bp, human
gaaggcaaacaccctctggg

SEQ ID NO: 409914 - DNA, 20 bp, human
gacatgagaccttatataca

SEQ ID NO: 409915 - DNA, 20 bp, human
ggtttaaggcaaacaccctc

SEQ ID NO: 409916 - DNA, 20 bp, human
ggagctgaatgaagagtgac

SEQ ID NO: 409917 - DNA, 20 bp, human
gagcggaaagggcggcttgt

SEQ ID NO: 409918 - DNA, 20 bp, human
ggaatgaagagtgacgggcc

SEQ ID NO: 409919 - DNA, 20 bp, human
gggcggcttgtgggatgtgg

SEQ ID NO: 409920 - DNA, 20 bp, human
gaagagtgacgggccgggcg

SEQ ID NO: 409921 - DNA, 20 bp, human
gaaggaaaggatgacagtct

SEQ ID NO: 409922 - DNA, 20 bp, human
gaagggcggcttgtgggatg

SEQ ID NO: 409923 - DNA, 20 bp, human
gctggttccagctggagctc

SEQ ID NO: 409924 - DNA, 20 bp, human
gaataaaaattaggctggtg

SEQ ID NO: 409925 - DNA, 20 bp, human
gtttaaatccccgcctcctc

SEQ ID NO: 409926 - DNA, 20 bp, human
gcggctccgcccagggtctg

SEQ ID NO: 409927 - DNA, 20 bp, human
ggggtggcccggcgtgtaga

SEQ ID NO: 409928 - DNA, 20 bp, human
gggaaggggaacccgtcgag

SEQ ID NO: 409929 - DNA, 20 bp, human
ggaggtgacgccctcctcga

SEQ ID NO: 409930 - DNA, 20 bp, human
ggcgggaaagagagcgtttc

SEQ ID NO: 409931 - DNA, 20 bp, human
ggcccggcgtgtagagggaa

SEQ ID NO: 409932 - DNA, 20 bp, human
gcccagggtggagagcacga

SEQ ID NO: 409933 - DNA, 20 bp, human
gcggacaagcccgggtggcc

SEQ ID NO: 409934 - DNA, 20 bp, human
ggcgcctccgccctcgagga

SEQ ID NO: 409935 - DNA, 20 bp, human
gacaactactagagcgcctc

SEQ ID NO: 409936 - DNA, 20 bp, human
gtacacctccacactgaggc

SEQ ID NO: 409937 - DNA, 20 bp, human
gtgtggaggtgtaaatcttg

SEQ ID NO: 409938 - DNA, 20 bp, human
gagagtgcgggcggaagacg

SEQ ID NO: 409939 - DNA, 20 bp, human
ggcagcccctggagcttctc

SEQ ID NO: 409940 - DNA, 20 bp, human
gacaaggcgaggattgtccc

SEQ ID NO: 409941 - DNA, 20 bp, human
gcctgcccagagagtgcggg

SEQ ID NO: 409942 - DNA, 20 bp, human
gtctgcccggagaagctcca

SEQ ID NO: 409943 - DNA, 20 bp, human
gcgcacgcgtactaacccca

SEQ ID NO: 409944 - DNA, 20 bp, human
gcctccccgggatctcacct

SEQ ID NO: 409945 - DNA, 20 bp, human
gggccggcgggcgggagaca

SEQ ID NO: 409946 - DNA, 20 bp, human
gctccttgcgtcatcgcata

SEQ ID NO: 409947 - DNA, 20 bp, human
gccctactagggaaaggggt

SEQ ID NO: 409948 - DNA, 20 bp, human
gctctcgccctactagggaa

SEQ ID NO: 409949 - DNA, 20 bp, human
gacgcaaggagcgaaaaaat

SEQ ID NO: 409950 - DNA, 20 bp, human
gtgcgtcatcgcatagggcg

SEQ ID NO: 409951 - DNA, 20 bp, human
ggcctgctctcgccctacta

SEQ ID NO: 409952 - DNA, 20 bp, human
gccccacccctttccctagt

SEQ ID NO: 409953 - DNA, 20 bp, human
gggtctggcgagcgcttcgc

SEQ ID NO: 409954 - DNA, 20 bp, human
ggggcttggctttcgggcgt

SEQ ID NO: 409955 - DNA, 20 bp, human
gggggctcgtacctgacgcc

SEQ ID NO: 409956 - DNA, 20 bp, human
gtatcgacgctctaagtacg

SEQ ID NO: 409957 - DNA, 20 bp, human
gacgctctaagtacgagggc

SEQ ID NO: 409958 - DNA, 20 bp, human
gcacacctggacagtgtcga

SEQ ID NO: 409959 - DNA, 20 bp, human
ggagggctggaacagtgagc

SEQ ID NO: 409960 - DNA, 20 bp, human
gagcaggtaggcaaaagcaa

SEQ ID NO: 409961 - DNA, 20 bp, human
gcatctattagctgcgtccc

SEQ ID NO: 409962 - DNA, 20 bp, human
gcacacggccgcatagggac

SEQ ID NO: 409963 - DNA, 20 bp, human
gcaagccatcgacactgtcc

SEQ ID NO: 409964 - DNA, 20 bp, human
ggccgcatagggacagggac

SEQ ID NO: 409965 - DNA, 20 bp, human
ggcgggcgcggctgcgtgag

SEQ ID NO: 409966 - DNA, 20 bp, human
gaggccctgccggattctct

SEQ ID NO: 409967 - DNA, 20 bp, human
gaaggagacgagaaccccag

SEQ ID NO: 409968 - DNA, 20 bp, human
gggcccaggaggcttctcta

SEQ ID NO: 409969 - DNA, 20 bp, human
gtcgcccagagaatccggca

SEQ ID NO: 409970 - DNA, 20 bp, human
gacactctttacacccagca

SEQ ID NO: 409971 - DNA, 20 bp, human
gaggcttctctaagggaaga

SEQ ID NO: 409972 - DNA, 20 bp, human
gagctctacaagtcgtgaag

SEQ ID NO: 409973 - DNA, 20 bp, human
gtgtaaagagtgtaggagac

SEQ ID NO: 409974 - DNA, 20 bp, human
gactgcgtgacttgcccgct

SEQ ID NO: 409975 - DNA, 20 bp, human
ggcgtcaagcaggctattcc

SEQ ID NO: 409976 - DNA, 20 bp, human
ggtctcgggagcgttagaga

SEQ ID NO: 409977 - DNA, 20 bp, human
gcggggcagcgagatagagc

SEQ ID NO: 409978 - DNA, 20 bp, human
gtggagactaacgtcttcca

SEQ ID NO: 409979 - DNA, 20 bp, human
gtgcgtctccactttcaccc

SEQ ID NO: 409980 - DNA, 20 bp, human
gaggctttcgcgttgacgat

SEQ ID NO: 409981 - DNA, 20 bp, human
gtaattgcgaaccgtgtctc

SEQ ID NO: 409982 - DNA, 20 bp, human
gcccgcgactgcgttcctgt

SEQ ID NO: 409983 - DNA, 20 bp, human
ggtggagacgcaatctccct

SEQ ID NO: 409984 - DNA, 20 bp, human
gtgctcaacctctcagtacc

SEQ ID NO: 409985 - DNA, 20 bp, human
ggccagctctgcgcccgcgg

SEQ ID NO: 409986 - DNA, 20 bp, human
gcccggccggcctgtgacct

SEQ ID NO: 409987 - DNA, 20 bp, human
gaggggcagcaatggttcga

SEQ ID NO: 409988 - DNA, 20 bp, human
gcgccgcagggaccgcgaaa

SEQ ID NO: 409989 - DNA, 20 bp, human
ggtcaggccgcccaggtcac

SEQ ID NO: 409990 - DNA, 20 bp, human
gacgccgcgaccatggacgg

SEQ ID NO: 409991 - DNA, 20 bp, human
ggaaagggttaacccggcgg

SEQ ID NO: 409992 - DNA, 20 bp, human
gccgtggagacaatggaggg

SEQ ID NO: 409993 - DNA, 20 bp, human
gaaccctttcgcggtccctg

SEQ ID NO: 409994 - DNA, 20 bp, human
gcgtgaggggtgcttggatg

SEQ ID NO: 409995 - DNA, 20 bp, human
ggccaggaggggagctcgac

SEQ ID NO: 409996 - DNA, 20 bp, human
gggccccgcgaggaagacaa

SEQ ID NO: 409997 - DNA, 20 bp, human
gagcaggggcaggcaggtcg

SEQ ID NO: 409998 - DNA, 20 bp, human
ggggcaggcaggtcgcggaa

SEQ ID NO: 409999 - DNA, 20 bp, human
gtcgccaaggtactgcggtg

SEQ ID NO: 410000 - DNA, 20 bp, human
gcaaggtactgcggtgtggt

SEQ ID NO: 410001 - DNA, 20 bp, human
gcggggcctacgccgatagg

SEQ ID NO: 410002 - DNA, 20 bp, human
gacaccgggcgccaaccaga

SEQ ID NO: 410003 - DNA, 20 bp, human
gaaggccggcgggagccaat

SEQ ID NO: 410004 - DNA, 20 bp, human
gcccctgctccgcctcgcca

SEQ ID NO: 410005 - DNA, 20 bp, human
gcctacgccgataggaggaa

SEQ ID NO: 410006 - DNA, 20 bp, human
ggggaggagcgaggataaag

SEQ ID NO: 410007 - DNA, 20 bp, human
ggggacccgcctctcgccgc

SEQ ID NO: 410008 - DNA, 20 bp, human
gggggcggagctgggatgat

SEQ ID NO: 410009 - DNA, 20 bp, human
ggcggagcacagatagaaac

SEQ ID NO: 410010 - DNA, 20 bp, human
ggggggcggagcgagaataa

SEQ ID NO: 410011 - DNA, 20 bp, human
ggggaggggaggggcgttct

SEQ ID NO: 410012 - DNA, 20 bp, human
gaggagaaatgtctgccgta

SEQ ID NO: 410013 - DNA, 20 bp, human
ggcacagatagaaacagggg

SEQ ID NO: 410014 - DNA, 20 bp, human
gatggggtggagcaagacgg

SEQ ID NO: 410015 - DNA, 20 bp, human
gttctcactccccacggcgg

SEQ ID NO: 410016 - DNA, 20 bp, human
gtcaaagcttgcccgggtac

SEQ ID NO: 410017 - DNA, 20 bp, human
gtgcctgggcctgtggccaa

SEQ ID NO: 410018 - DNA, 20 bp, human
ggcccagggatgcttcaaaa

SEQ ID NO: 410019 - DNA, 20 bp, human
gatccattggccacaggccc

SEQ ID NO: 410020 - DNA, 20 bp, human
gtgaaggctcagggtatctt

SEQ ID NO: 410021 - DNA, 20 bp, human
gtcctgggacagaatgtagc

SEQ ID NO: 410022 - DNA, 20 bp, human
gggcgtggcttgaacaagtc

SEQ ID NO: 410023 - DNA, 20 bp, human
gctttgagataacttcttga

SEQ ID NO: 410024 - DNA, 20 bp, human
ggctgaatctgcactgctgg

SEQ ID NO: 410025 - DNA, 20 bp, human
ggatgcttcaaaagggctgc

SEQ ID NO: 410026 - DNA, 20 bp, human
gtggctcaggtgggtaccta

SEQ ID NO: 410027 - DNA, 20 bp, human
gcaggtgggtacctagggtt

SEQ ID NO: 410028 - DNA, 20 bp, human
gtcttctcacgatgcagggg

SEQ ID NO: 410029 - DNA, 20 bp, human
ggggaggacatttactgtgc

SEQ ID NO: 410030 - DNA, 20 bp, human
gagcagtgccaggtggcctc

SEQ ID NO: 410031 - DNA, 20 bp, human
gtagtaacagggaacctctc

SEQ ID NO: 410032 - DNA, 20 bp, human
gagtttgcaaatcatggccc

SEQ ID NO: 410033 - DNA, 20 bp, human
gtgctatgacaacaccagag

SEQ ID NO: 410034 - DNA, 20 bp, human
gatcactctgtcccaaccct

SEQ ID NO: 410035 - DNA, 20 bp, human
ggaagttcttctcacgatgc

SEQ ID NO: 410036 - DNA, 20 bp, human
ggcaagctgtcaggaatcag

SEQ ID NO: 410037 - DNA, 20 bp, human
gggtgcccccaatggggaga

SEQ ID NO: 410038 - DNA, 20 bp, human
gatacccggcgcaagctgtc

SEQ ID NO: 410039 - DNA, 20 bp, human
gtagagccaaagagaatcat

SEQ ID NO: 410040 - DNA, 20 bp, human
gggagaatgggacaagattc

SEQ ID NO: 410041 - DNA, 20 bp, human
gcagctgaaacggaaggatt

SEQ ID NO: 410042 - DNA, 20 bp, human
gatttcatgcctggcccaca

SEQ ID NO: 410043 - DNA, 20 bp, human
ggattcaggtgcccccaatg

SEQ ID NO: 410044 - DNA, 20 bp, human
gattcctgacagcttgcgcc

SEQ ID NO: 410045 - DNA, 20 bp, human
gttctcccagctgaaacgga

SEQ ID NO: 410046 - DNA, 20 bp, human
gctggaggaggaggcttcgg

SEQ ID NO: 410047 - DNA, 20 bp, human
gtgcgcaggtgcgggctcta

SEQ ID NO: 410048 - DNA, 20 bp, human
gggccctgtggcaatgctgg

SEQ ID NO: 410049 - DNA, 20 bp, human
gcggggccctgtggcaatgc

SEQ ID NO: 410050 - DNA, 20 bp, human
gtcggaggcacttctagaac

SEQ ID NO: 410051 - DNA, 20 bp, human
gggctctaggggcgatgggc

SEQ ID NO: 410052 - DNA, 20 bp, human
gggagttctgggatattcgg

SEQ ID NO: 410053 - DNA, 20 bp, human
gcctgtggcaatgctggagg

SEQ ID NO: 410054 - DNA, 20 bp, human
ggatgctgcctggagagctc

SEQ ID NO: 410055 - DNA, 20 bp, human
ggttgtgcacaccccagccc

SEQ ID NO: 410056 - DNA, 20 bp, human
ggctatgttgagcaaccctg

SEQ ID NO: 410057 - DNA, 20 bp, human
gcctctagcctcatttgctt

SEQ ID NO: 410058 - DNA, 20 bp, human
gaggtgggatgccttcagaa

SEQ ID NO: 410059 - DNA, 20 bp, human
gaggaaagaaagcttcctca

SEQ ID NO: 410060 - DNA, 20 bp, human
gagtgctcagtcaacattgt

SEQ ID NO: 410061 - DNA, 20 bp, human
gcatctttgtgacactcagg

SEQ ID NO: 410062 - DNA, 20 bp, human
ggcacatctttgtgacactc

SEQ ID NO: 410063 - DNA, 20 bp, human
gagaccccatagttcataga

SEQ ID NO: 410064 - DNA, 20 bp, human
gcaaatgtgcaaaattctag

SEQ ID NO: 410065 - DNA, 20 bp, human
gataagttcaataaactggt

SEQ ID NO: 410066 - DNA, 20 bp, human
gccgccggggtggtagacta

SEQ ID NO: 410067 - DNA, 20 bp, human
ggacgtgctcccacttccgc

SEQ ID NO: 410068 - DNA, 20 bp, human
ggacccctagtctaccaccc

SEQ ID NO: 410069 - DNA, 20 bp, human
gcgtggctgtgttgtcctga

SEQ ID NO: 410070 - DNA, 20 bp, human
ggggcggaggaccggaacaa

SEQ ID NO: 410071 - DNA, 20 bp, human
ggctcccacttccgccgggg

SEQ ID NO: 410072 - DNA, 20 bp, human
ggtgcagcccccgggccttc

SEQ ID NO: 410073 - DNA, 20 bp, human
gctaccaccccggcggaagt

SEQ ID NO: 410074 - DNA, 20 bp, human
gagagctgagagagaatcgt

SEQ ID NO: 410075 - DNA, 20 bp, human
ggtgttgtcctgaaggcccg

SEQ ID NO: 410076 - DNA, 20 bp, human
gaggtcccaaggaccgtggt

SEQ ID NO: 410077 - DNA, 20 bp, human
ggagcgcgggaaaatggcgc

SEQ ID NO: 410078 - DNA, 20 bp, human
ggctccgctcagagagcaag

SEQ ID NO: 410079 - DNA, 20 bp, human
gtggtggggtagggcggcta

SEQ ID NO: 410080 - DNA, 20 bp, human
gtctgagcggagcggaaggc

SEQ ID NO: 410081 - DNA, 20 bp, human
gtccggggattccccagtct

SEQ ID NO: 410082 - DNA, 20 bp, human
gagatcctctggcgcccacg

SEQ ID NO: 410083 - DNA, 20 bp, human
gcccctaggaaggggacctg

SEQ ID NO: 410084 - DNA, 20 bp, human
gggccaggagcgcgggaaaa

SEQ ID NO: 410085 - DNA, 20 bp, human
gcccttcggcccctagactg

SEQ ID NO: 410086 - DNA, 20 bp, human
gagctctgatctggttataa

SEQ ID NO: 410087 - DNA, 20 bp, human
gtgcacctgcctaagatcta

SEQ ID NO: 410088 - DNA, 20 bp, human
gaatgtagaacctgattctg

SEQ ID NO: 410089 - DNA, 20 bp, human
gggtgcttgctgtcccactg

SEQ ID NO: 410090 - DNA, 20 bp, human
gctcaggctccctagatctt

SEQ ID NO: 410091 - DNA, 20 bp, human
gtttactctggaataatcta

SEQ ID NO: 410092 - DNA, 20 bp, human
gccacagtctgagatgataa

SEQ ID NO: 410093 - DNA, 20 bp, human
gttgctgcacttagatgtgg

SEQ ID NO: 410094 - DNA, 20 bp, human
gggctccctagatcttaggc

SEQ ID NO: 410095 - DNA, 20 bp, human
ggtgtattttagctctgatc

SEQ ID NO: 410096 - DNA, 20 bp, human
gactggacagaaaatctctg

SEQ ID NO: 410097 - DNA, 20 bp, human
gtggccagaaacccgagacc

SEQ ID NO: 410098 - DNA, 20 bp, human
gtggctcccaccggggccat

SEQ ID NO: 410099 - DNA, 20 bp, human
gactatgaatccataaggtg

SEQ ID NO: 410100 - DNA, 20 bp, human
gcccggtgggagccaggtct

SEQ ID NO: 410101 - DNA, 20 bp, human
gacatgaggccactacagcc

SEQ ID NO: 410102 - DNA, 20 bp, human
gtgcaatcaaccacacctta

SEQ ID NO: 410103 - DNA, 20 bp, human
gagagatgtgtgacttccca

SEQ ID NO: 410104 - DNA, 20 bp, human
gctagaggaaatagtagaga

SEQ ID NO: 410105 - DNA, 20 bp, human
gtagagagggtaatgggata

SEQ ID NO: 410106 - DNA, 20 bp, human
gctgtgctaattaagaacag

SEQ ID NO: 410107 - DNA, 20 bp, human
ggaaacatgttgagaagtaa

SEQ ID NO: 410108 - DNA, 20 bp, human
gggaaaattaaatctgtgga

SEQ ID NO: 410109 - DNA, 20 bp, human
gaaaaaagaagactgtactg

SEQ ID NO: 410110 - DNA, 20 bp, human
gtattttatcattctcgcta

SEQ ID NO: 410111 - DNA, 20 bp, human
gctcaaaatctagttctatc

SEQ ID NO: 410112 - DNA, 20 bp, human
gaaatctaattcatggccgg

SEQ ID NO: 410113 - DNA, 20 bp, human
gattggaatgattatgctac

SEQ ID NO: 410114 - DNA, 20 bp, human
gtgtgttcataatttgagaa

SEQ ID NO: 410115 - DNA, 20 bp, human
gttgaggctacagattatca

SEQ ID NO: 410116 - DNA, 20 bp, human
gtccttaggtggagctggaa

SEQ ID NO: 410117 - DNA, 20 bp, human
ggaggcttctagtgccacga

SEQ ID NO: 410118 - DNA, 20 bp, human
gagagccccctacaggtggg

SEQ ID NO: 410119 - DNA, 20 bp, human
gcggagagccccctacaggt

SEQ ID NO: 410120 - DNA, 20 bp, human
gtgggtcctcccacctgtag

SEQ ID NO: 410121 - DNA, 20 bp, human
gggcgccataaggacaaccc

SEQ ID NO: 410122 - DNA, 20 bp, human
gaaaacgggccggggacttt

SEQ ID NO: 410123 - DNA, 20 bp, human
gggggcgtggggttcgttta

SEQ ID NO: 410124 - DNA, 20 bp, human
ggcctcggagagccccctac

SEQ ID NO: 410125 - DNA, 20 bp, human
gtagcacaggcatcttagtc

SEQ ID NO: 410126 - DNA, 20 bp, human
ggctagtgcgtggtgggaag

SEQ ID NO: 410127 - DNA, 20 bp, human
gacccgttagcgctaagggg

SEQ ID NO: 410128 - DNA, 20 bp, human
gcggtgtccgggctggtgat

SEQ ID NO: 410129 - DNA, 20 bp, human
gaagaggcggggctagtgcg

SEQ ID NO: 410130 - DNA, 20 bp, human
gggcggggctagtgcgtggt

SEQ ID NO: 410131 - DNA, 20 bp, human
gcaaagagaacgaagaggcg

SEQ ID NO: 410132 - DNA, 20 bp, human
ggcacggctctccgcggcct

SEQ ID NO: 410133 - DNA, 20 bp, human
gcaagggcggttacttacca

SEQ ID NO: 410134 - DNA, 20 bp, human
gcaccgcgacaagtgaacgg

SEQ ID NO: 410135 - DNA, 20 bp, human
gacctcaggctccaactcgt

SEQ ID NO: 410136 - DNA, 20 bp, human
ggaagcgacaattacttcta

SEQ ID NO: 410137 - DNA, 20 bp, human
ggaaagccggaggtaccctt

SEQ ID NO: 410138 - DNA, 20 bp, human
ggagcaacctccaccagcgt

SEQ ID NO: 410139 - DNA, 20 bp, human
gcgtcctgctagggcgagga

SEQ ID NO: 410140 - DNA, 20 bp, human
ggccacaacacgtcctgcta

SEQ ID NO: 410141 - DNA, 20 bp, human
ggcgctgataggtggatcgg

SEQ ID NO: 410142 - DNA, 20 bp, human
ggggacttgaaacggaaagc

SEQ ID NO: 410143 - DNA, 20 bp, human
ggaggagtttacaatcgagg

SEQ ID NO: 410144 - DNA, 20 bp, human
gcgggcctaagagtcgagac

SEQ ID NO: 410145 - DNA, 20 bp, human
gggagacagtgatacagcac

SEQ ID NO: 410146 - DNA, 20 bp, human
ggcggcccgaggtaactgga

SEQ ID NO: 410147 - DNA, 20 bp, human
ggcggggcgctcatcccagg

SEQ ID NO: 410148 - DNA, 20 bp, human
ggggccgcggggcaaaacga

SEQ ID NO: 410149 - DNA, 20 bp, human
ggggatgcgcatgtacgatg

SEQ ID NO: 410150 - DNA, 20 bp, human
gtcaccgctgcgggactccc

SEQ ID NO: 410151 - DNA, 20 bp, human
gctgcccgggagtcccgcag

SEQ ID NO: 410152 - DNA, 20 bp, human
gggggctgtgacgcacgagg

SEQ ID NO: 410153 - DNA, 20 bp, human
gggcggggctgtgacgcacg

SEQ ID NO: 410154 - DNA, 20 bp, human
gaaccgcggcccgaggtaac

SEQ ID NO: 410155 - DNA, 20 bp, human
gcggaaagtggagacggtgg

SEQ ID NO: 410156 - DNA, 20 bp, human
gcccagtttgggagcgggat

SEQ ID NO: 410157 - DNA, 20 bp, human
gaccaggccagtcttgattt

SEQ ID NO: 410158 - DNA, 20 bp, human
gtaagctcccagtttgggag

SEQ ID NO: 410159 - DNA, 20 bp, human
gggagcccttgcttcgtcat

SEQ ID NO: 410160 - DNA, 20 bp, human
gttacactctcacacaggct

SEQ ID NO: 410161 - DNA, 20 bp, human
gcactgtgggcatttaaaaa

SEQ ID NO: 410162 - DNA, 20 bp, human
gtcccatcccgctcccaaac

SEQ ID NO: 410163 - DNA, 20 bp, human
gaggcactgttacaaagcag

SEQ ID NO: 410164 - DNA, 20 bp, human
gtctcaggggcttacattct

SEQ ID NO: 410165 - DNA, 20 bp, human
gaggccagtcttgatttggg

SEQ ID NO: 410166 - DNA, 20 bp, human
gcgcgcggggcgcacttccg

SEQ ID NO: 410167 - DNA, 20 bp, human
gtctaggaagggagcgaaag

SEQ ID NO: 410168 - DNA, 20 bp, human
gaacccgttccatttaccag

SEQ ID NO: 410169 - DNA, 20 bp, human
ggcgcgtctacgtgagagga

SEQ ID NO: 410170 - DNA, 20 bp, human
gaggaaggttgatggctttc

SEQ ID NO: 410171 - DNA, 20 bp, human
gtccgcggccgctctaggaa

SEQ ID NO: 410172 - DNA, 20 bp, human
gtcgggggaagtgtggacaa

SEQ ID NO: 410173 - DNA, 20 bp, human
gggaagtgtggacaatggct

SEQ ID NO: 410174 - DNA, 20 bp, human
gttccgcgcgtctacgtgag

SEQ ID NO: 410175 - DNA, 20 bp, human
gcgaccacccatcgggtcgg

SEQ ID NO: 410176 - DNA, 20 bp, human
gtaaaagccgggtcctccac

SEQ ID NO: 410177 - DNA, 20 bp, human
gccgggtcctccactggcta

SEQ ID NO: 410178 - DNA, 20 bp, human
gccactggctagggccgagg

SEQ ID NO: 410179 - DNA, 20 bp, human
gggcgcccggccgcttcagc

SEQ ID NO: 410180 - DNA, 20 bp, human
gtaacggtgtaatatatcta

SEQ ID NO: 410181 - DNA, 20 bp, human
gaatacgaggcgtaaaagcc

SEQ ID NO: 410182 - DNA, 20 bp, human
gagagcggcccggaagtgcc

SEQ ID NO: 410183 - DNA, 20 bp, human
ggtgcagaggggaaaaagcg

SEQ ID NO: 410184 - DNA, 20 bp, human
ggaagcggccgggcgccgat

SEQ ID NO: 410185 - DNA, 20 bp, human
gccgcaatcccatcaatacg

SEQ ID NO: 410186 - DNA, 20 bp, human
gccggcgcctgcgtcatttt

SEQ ID NO: 410187 - DNA, 20 bp, human
gacgcaggcgccggagtggg

SEQ ID NO: 410188 - DNA, 20 bp, human
gcgagcaagggagccgtgac

SEQ ID NO: 410189 - DNA, 20 bp, human
gatgacgcaggcgccggagt

SEQ ID NO: 410190 - DNA, 20 bp, human
gggccaatcagacgcgagtg

SEQ ID NO: 410191 - DNA, 20 bp, human
gcccggcgtcccgcccactc

SEQ ID NO: 410192 - DNA, 20 bp, human
gcgcgcaccggggcgagcaa

SEQ ID NO: 410193 - DNA, 20 bp, human
gaaggcccacagacgctcgg

SEQ ID NO: 410194 - DNA, 20 bp, human
ggccggagtgggcgggacgc

SEQ ID NO: 410195 - DNA, 20 bp, human
gatggtgcccaaaatgacgc

SEQ ID NO: 410196 - DNA, 20 bp, human
gacaaggtgctcgtccgcag

SEQ ID NO: 410197 - DNA, 20 bp, human
gccccagcgtccggtgtcac

SEQ ID NO: 410198 - DNA, 20 bp, human
ggggcctagtgcgacgaggg

SEQ ID NO: 410199 - DNA, 20 bp, human
gtgcgagcgctcccaggttc

SEQ ID NO: 410200 - DNA, 20 bp, human
ggcggggcctagtgcgacga

SEQ ID NO: 410201 - DNA, 20 bp, human
ggacgagcaccttgtctctc

SEQ ID NO: 410202 - DNA, 20 bp, human
gctgcctggcagccagaacc

SEQ ID NO: 410203 - DNA, 20 bp, human
gtcacacgggtcccactcgt

SEQ ID NO: 410204 - DNA, 20 bp, human
gaggctcgcaagcggatata

SEQ ID NO: 410205 - DNA, 20 bp, human
gaaggacaaagaaccccgaa

SEQ ID NO: 410206 - DNA, 20 bp, human
ggtccccggagtagggtttg

SEQ ID NO: 410207 - DNA, 20 bp, human
ggaccgcggtccccggagta

SEQ ID NO: 410208 - DNA, 20 bp, human
ggggcaccgagaacaatgga

SEQ ID NO: 410209 - DNA, 20 bp, human
gagccccaaaccctactccg

SEQ ID NO: 410210 - DNA, 20 bp, human
gccgcggtcaggttcgtctc

SEQ ID NO: 410211 - DNA, 20 bp, human
gcgaacctgaccgcggtccc

SEQ ID NO: 410212 - DNA, 20 bp, human
gcaccccggctcaagcccgt

SEQ ID NO: 410213 - DNA, 20 bp, human
gaaccctactccggggaccg

SEQ ID NO: 410214 - DNA, 20 bp, human
gggtcaggttcgtctccggg

SEQ ID NO: 410215 - DNA, 20 bp, human
ggtccgctctcgccggtcga

SEQ ID NO: 410216 - DNA, 20 bp, human
gggaacgggcgcgacacatg

SEQ ID NO: 410217 - DNA, 20 bp, human
ggcactggaacaaatcggaa

SEQ ID NO: 410218 - DNA, 20 bp, human
gtagaagatgacatatctat

SEQ ID NO: 410219 - DNA, 20 bp, human
gcgctcgcgcggttccttct

SEQ ID NO: 410220 - DNA, 20 bp, human
gggagggcactcgagcagaa

SEQ ID NO: 410221 - DNA, 20 bp, human
gccctggcactggaacaaat

SEQ ID NO: 410222 - DNA, 20 bp, human
ggaaaggcagcaaacggagg

SEQ ID NO: 410223 - DNA, 20 bp, human
gagggggcccagttctactg

SEQ ID NO: 410224 - DNA, 20 bp, human
gacagcaccgcccaatggga

SEQ ID NO: 410225 - DNA, 20 bp, human
gagcggcgccaccctgggaa

SEQ ID NO: 410226 - DNA, 20 bp, human
gcccccgcggaaaagtagtg

SEQ ID NO: 410227 - DNA, 20 bp, human
gaaccgccgcagccttcatc

SEQ ID NO: 410228 - DNA, 20 bp, human
gtccacgagggtgaccgagg

SEQ ID NO: 410229 - DNA, 20 bp, human
gtgccccagggcgtcggggt

SEQ ID NO: 410230 - DNA, 20 bp, human
gtccctgccccagggcgtcg

SEQ ID NO: 410231 - DNA, 20 bp, human
gacccaaccccgacgccctg

SEQ ID NO: 410232 - DNA, 20 bp, human
gacctcccgaatttctagag

SEQ ID NO: 410233 - DNA, 20 bp, human
gagacggtcagaccagatga

SEQ ID NO: 410234 - DNA, 20 bp, human
ggggcccagctcctcggtcc

SEQ ID NO: 410235 - DNA, 20 bp, human
ggcccctctagaaattcggg

SEQ ID NO: 410236 - DNA, 20 bp, human
ggatcccagcccggcctttg

SEQ ID NO: 410237 - DNA, 20 bp, human
gcgccacctcagtcccacaa

SEQ ID NO: 410238 - DNA, 20 bp, human
gcggaagctcaagtgtaccc

SEQ ID NO: 410239 - DNA, 20 bp, human
gacctcagtcccacaaaggc

SEQ ID NO: 410240 - DNA, 20 bp, human
gtggtcagcacggaggccac

SEQ ID NO: 410241 - DNA, 20 bp, human
gagtcccacaaaggccgggc

SEQ ID NO: 410242 - DNA, 20 bp, human
ggcagcaggcgatgcgcgaa

SEQ ID NO: 410243 - DNA, 20 bp, human
gtgggaattgtagttgacgt

SEQ ID NO: 410244 - DNA, 20 bp, human
gacgccgggaattgtagtcc

SEQ ID NO: 410245 - DNA, 20 bp, human
gtgggcccttgaggtgtgct

SEQ ID NO: 410246 - DNA, 20 bp, human
gaacctccggccttcctaga

SEQ ID NO: 410247 - DNA, 20 bp, human
gctccgcgaaacagcggttc

SEQ ID NO: 410248 - DNA, 20 bp, human
gttcagagtgacgaccacag

SEQ ID NO: 410249 - DNA, 20 bp, human
gccacgcggcaatataataa

SEQ ID NO: 410250 - DNA, 20 bp, human
gtagtcttaagtgagatact

SEQ ID NO: 410251 - DNA, 20 bp, human
gcccgctctccgcgaaacag

SEQ ID NO: 410252 - DNA, 20 bp, human
gtctcacttaagactacaga

SEQ ID NO: 410253 - DNA, 20 bp, human
gtgacacattgtcttccacg

SEQ ID NO: 410254 - DNA, 20 bp, human
gttcctagaaggaacacagc

SEQ ID NO: 410255 - DNA, 20 bp, human
gggccgcggtgacgcatttc

SEQ ID NO: 410256 - DNA, 20 bp, human
ggagctgggcagtcaatcct

SEQ ID NO: 410257 - DNA, 20 bp, human
gggcgaggcgaagaccacca

SEQ ID NO: 410258 - DNA, 20 bp, human
gtaggggcagaggagatagg

SEQ ID NO: 410259 - DNA, 20 bp, human
gtgctgttccgaacccggcg

SEQ ID NO: 410260 - DNA, 20 bp, human
gtcctctctaggatgctcgg

SEQ ID NO: 410261 - DNA, 20 bp, human
gacctccgagcatcctagag

SEQ ID NO: 410262 - DNA, 20 bp, human
gccacagagcgcctcgagct

SEQ ID NO: 410263 - DNA, 20 bp, human
gggggcgcactggatctaac

SEQ ID NO: 410264 - DNA, 20 bp, human
gagggccttgcgcgaggcgt

SEQ ID NO: 410265 - DNA, 20 bp, human
ggccctccgtggaaaggact

SEQ ID NO: 410266 - DNA, 20 bp, human
gggtccgctcacctggtcaa

SEQ ID NO: 410267 - DNA, 20 bp, human
gaccccgccccctcggtcga

SEQ ID NO: 410268 - DNA, 20 bp, human
gcgcagaaggagactaacat

SEQ ID NO: 410269 - DNA, 20 bp, human
ggccgcttaggcatcgcaga

SEQ ID NO: 410270 - DNA, 20 bp, human
gcggcagcaccatcgagcca

SEQ ID NO: 410271 - DNA, 20 bp, human
ggaccctggagctgggcccc

SEQ ID NO: 410272 - DNA, 20 bp, human
gctggaggaccttggctcga

SEQ ID NO: 410273 - DNA, 20 bp, human
gaagagctagagctgacact

SEQ ID NO: 410274 - DNA, 20 bp, human
gtccttctgcgatgcctaag

SEQ ID NO: 410275 - DNA, 20 bp, human
gggagcagctgcttcccggc

SEQ ID NO: 410276 - DNA, 20 bp, human
gacccctacaaccctggcca

SEQ ID NO: 410277 - DNA, 20 bp, human
ggccagggttgtaggggtga

SEQ ID NO: 410278 - DNA, 20 bp, human
gtaatgaggggcattcccag

SEQ ID NO: 410279 - DNA, 20 bp, human
gagccatggccagggttgta

SEQ ID NO: 410280 - DNA, 20 bp, human
gaggtcacagtctctgtgaa

SEQ ID NO: 410281 - DNA, 20 bp, human
gttgcagtgacaattaacgg

SEQ ID NO: 410282 - DNA, 20 bp, human
gtcactgcaagatcataatg

SEQ ID NO: 410283 - DNA, 20 bp, human
gaaggggcaggaagtgcgct

SEQ ID NO: 410284 - DNA, 20 bp, human
gacagtctctgtgaaggggc

SEQ ID NO: 410285 - DNA, 20 bp, human
gggaaaaactcattatgaca

SEQ ID NO: 410286 - DNA, 20 bp, human
gtccgctctaggaatctggg

SEQ ID NO: 410287 - DNA, 20 bp, human
gcggtgaccaagtcgaggta

SEQ ID NO: 410288 - DNA, 20 bp, human
gacagctcgcggcggttcgg

SEQ ID NO: 410289 - DNA, 20 bp, human
gcctagagcggacagggcga

SEQ ID NO: 410290 - DNA, 20 bp, human
gcggtccggtgaccaagtcg

SEQ ID NO: 410291 - DNA, 20 bp, human
ggtggggcaccgggtgacgg

SEQ ID NO: 410292 - DNA, 20 bp, human
gggggtggggcaccgggtga

SEQ ID NO: 410293 - DNA, 20 bp, human
gtaagggtgatgtcggctcg

SEQ ID NO: 410294 - DNA, 20 bp, human
gctatggcgcttcaccgcgc

SEQ ID NO: 410295 - DNA, 20 bp, human
gccgggcacggagagacgat

SEQ ID NO: 410296 - DNA, 20 bp, human
gaggcccaatgtatacatag

SEQ ID NO: 410297 - DNA, 20 bp, human
gtatgtctccctcggccaag

SEQ ID NO: 410298 - DNA, 20 bp, human
gacccagggctgatacacac

SEQ ID NO: 410299 - DNA, 20 bp, human
ggtacacaggcccaatatat

SEQ ID NO: 410300 - DNA, 20 bp, human
gtgtgccaaacctatatatt

SEQ ID NO: 410301 - DNA, 20 bp, human
ggcccgccccaacaccctaa

SEQ ID NO: 410302 - DNA, 20 bp, human
gcaagcctctatgtatacat

SEQ ID NO: 410303 - DNA, 20 bp, human
gagcctgtgtgtatcagccc

SEQ ID NO: 410304 - DNA, 20 bp, human
ggccccaacaccctaaaggt

SEQ ID NO: 410305 - DNA, 20 bp, human
gggtagggaagcaaaaaccc

SEQ ID NO: 410306 - DNA, 20 bp, human
gtctccgcctcgcacccagt

SEQ ID NO: 410307 - DNA, 20 bp, human
gggtgcgaggcggagaaatc

SEQ ID NO: 410308 - DNA, 20 bp, human
gccccatagaaatgcctcgc

SEQ ID NO: 410309 - DNA, 20 bp, human
gggccccggggtttgcaata

SEQ ID NO: 410310 - DNA, 20 bp, human
gagacccaaaacattagagc

SEQ ID NO: 410311 - DNA, 20 bp, human
gaacgtagagagcgagtaac

SEQ ID NO: 410312 - DNA, 20 bp, human
gcctaactggaactcttcgc

SEQ ID NO: 410313 - DNA, 20 bp, human
gcctcgcacccagtgggact

SEQ ID NO: 410314 - DNA, 20 bp, human
ggaggcatttctatggggag

SEQ ID NO: 410315 - DNA, 20 bp, human
gcaaaaatcccagtcccact

SEQ ID NO: 410316 - DNA, 20 bp, human
ggggccgatgccactcgctg

SEQ ID NO: 410317 - DNA, 20 bp, human
gaggcgcagcaaccaataga

SEQ ID NO: 410318 - DNA, 20 bp, human
gaatgcccttggcaggaggc

SEQ ID NO: 410319 - DNA, 20 bp, human
gtctccgcagcgagtggcat

SEQ ID NO: 410320 - DNA, 20 bp, human
gcaggggcgtgcgtaatggg

SEQ ID NO: 410321 - DNA, 20 bp, human
ggggacttaggacccgacac

SEQ ID NO: 410322 - DNA, 20 bp, human
gctcccgggatgcactgcga

SEQ ID NO: 410323 - DNA, 20 bp, human
gctgaggacaactactgaca

SEQ ID NO: 410324 - DNA, 20 bp, human
ggcccccagcccgtgctcgc

SEQ ID NO: 410325 - DNA, 20 bp, human
gagacgcccactagctgctg

SEQ ID NO: 410326 - DNA, 20 bp, human
gagcgcctggtcacctagtg

SEQ ID NO: 410327 - DNA, 20 bp, human
gccaggctggtgaaacagag

SEQ ID NO: 410328 - DNA, 20 bp, human
ggcacagcttccaccacact

SEQ ID NO: 410329 - DNA, 20 bp, human
gacatgaggcttgagagaga

SEQ ID NO: 410330 - DNA, 20 bp, human
gtccaccacactaggtgacc

SEQ ID NO: 410331 - DNA, 20 bp, human
gtaggattatatcagtggaa

SEQ ID NO: 410332 - DNA, 20 bp, human
gtgaggcttgagagagatgg

SEQ ID NO: 410333 - DNA, 20 bp, human
ggcctcagcctgtatgaggg

SEQ ID NO: 410334 - DNA, 20 bp, human
ggcctggtcacctagtgtgg

SEQ ID NO: 410335 - DNA, 20 bp, human
gcaaagcctcagcctgtatg

SEQ ID NO: 410336 - DNA, 20 bp, human
gacgtaatcggcgttgatta

SEQ ID NO: 410337 - DNA, 20 bp, human
gcgggaaatatttgcacagt

SEQ ID NO: 410338 - DNA, 20 bp, human
gcaacgccgattacgtaaaa

SEQ ID NO: 410339 - DNA, 20 bp, human
gagagtccattttacgtaat

SEQ ID NO: 410340 - DNA, 20 bp, human
gagaacatgttaagagctgg

SEQ ID NO: 410341 - DNA, 20 bp, human
gttgcgagttttaaccattt

SEQ ID NO: 410342 - DNA, 20 bp, human
gatggccctaaaccaatcac

SEQ ID NO: 410343 - DNA, 20 bp, human
gagaatattggagttgacat

SEQ ID NO: 410344 - DNA, 20 bp, human
gtaaagaacatgttaagagc

SEQ ID NO: 410345 - DNA, 20 bp, human
gccctaaaccaatcacgggg

SEQ ID NO: 410346 - DNA, 20 bp, human
gacgccagcgctgacctgaa

SEQ ID NO: 410347 - DNA, 20 bp, human
gctgacctgaacggatccct

SEQ ID NO: 410348 - DNA, 20 bp, human
gcggaggctgggccattatg

SEQ ID NO: 410349 - DNA, 20 bp, human
gtcggggcggtccgtctcag

SEQ ID NO: 410350 - DNA, 20 bp, human
gtgggcggctgaatggccag

SEQ ID NO: 410351 - DNA, 20 bp, human
gaaccacccgggcgcatacg

SEQ ID NO: 410352 - DNA, 20 bp, human
gctactcccagaaaccaccc

SEQ ID NO: 410353 - DNA, 20 bp, human
ggccgctgcttcaggtcggc

SEQ ID NO: 410354 - DNA, 20 bp, human
gccacctccaaactcaggcc

SEQ ID NO: 410355 - DNA, 20 bp, human
gcgtccgggcctgagtttgg

SEQ ID NO: 410356 - DNA, 20 bp, human
ggacaagtggggtccaggat

SEQ ID NO: 410357 - DNA, 20 bp, human
gtgggatgagggatttggaa

SEQ ID NO: 410358 - DNA, 20 bp, human
ggggctgagtccgatgccca

SEQ ID NO: 410359 - DNA, 20 bp, human
gccatggacaagtggggtcc

SEQ ID NO: 410360 - DNA, 20 bp, human
gtccgatgcccatggacaag

SEQ ID NO: 410361 - DNA, 20 bp, human
ggtagaaagttaaaataatc

SEQ ID NO: 410362 - DNA, 20 bp, human
gcttctctgactacatgttc

SEQ ID NO: 410363 - DNA, 20 bp, human
gccttggatcttgtcttgac

SEQ ID NO: 410364 - DNA, 20 bp, human
gaattgagacctatttacac

SEQ ID NO: 410365 - DNA, 20 bp, human
gcagtgttgttccagttgaa

SEQ ID NO: 410366 - DNA, 20 bp, human
gctgcaagttttaaccactt

SEQ ID NO: 410367 - DNA, 20 bp, human
gcctactgtgcaaataatac

SEQ ID NO: 410368 - DNA, 20 bp, human
gtccaagatgttgaaaattg

SEQ ID NO: 410369 - DNA, 20 bp, human
gagccttatataaaagcagt

SEQ ID NO: 410370 - DNA, 20 bp, human
ggtaatatcctaacaagtaa

SEQ ID NO: 410371 - DNA, 20 bp, human
gctggaatgaatgcagagtg

SEQ ID NO: 410372 - DNA, 20 bp, human
gaaaaatgagattaaatcac

SEQ ID NO: 410373 - DNA, 20 bp, human
ggggaccatgtgcctttctc

SEQ ID NO: 410374 - DNA, 20 bp, human
gagcagtgggaaccagagaa

SEQ ID NO: 410375 - DNA, 20 bp, human
gggaaccagagaaaggcaca

SEQ ID NO: 410376 - DNA, 20 bp, human
gcctgtgggcagggtttcat

SEQ ID NO: 410377 - DNA, 20 bp, human
gttgggaaatgtaatcaact

SEQ ID NO: 410378 - DNA, 20 bp, human
gattaaaacttgtggaccta

SEQ ID NO: 410379 - DNA, 20 bp, human
gccacaagttttaatcactt

SEQ ID NO: 410380 - DNA, 20 bp, human
gccacaagtttttttttgtt

SEQ ID NO: 410381 - DNA, 20 bp, human
gaacttgtggacctagggcc

SEQ ID NO: 410382 - DNA, 20 bp, human
ggtggacctagggccaggtg

SEQ ID NO: 410383 - DNA, 20 bp, human
gactttaacttcctgtgggc

SEQ ID NO: 410384 - DNA, 20 bp, human
gttaatactttaacttcctg

SEQ ID NO: 410385 - DNA, 20 bp, human
ggacaaataattcagtagag

SEQ ID NO: 410386 - DNA, 20 bp, human
gggactaaggaggggtaggt

SEQ ID NO: 410387 - DNA, 20 bp, human
gaactggacgccaggaaatt

SEQ ID NO: 410388 - DNA, 20 bp, human
gtccggcgttcaccttgctt

SEQ ID NO: 410389 - DNA, 20 bp, human
gaacgccggacatcgagaca

SEQ ID NO: 410390 - DNA, 20 bp, human
gtcggggagtgggactaagg

SEQ ID NO: 410391 - DNA, 20 bp, human
gagtgggactaaggaggggt

SEQ ID NO: 410392 - DNA, 20 bp, human
ggactcaacccccaatttcc

SEQ ID NO: 410393 - DNA, 20 bp, human
ggatgccgacctctcctcga

SEQ ID NO: 410394 - DNA, 20 bp, human
ggggggttgagtccgaagca

SEQ ID NO: 410395 - DNA, 20 bp, human
gagcagaggcacttccgggc

SEQ ID NO: 410396 - DNA, 20 bp, human
gcgggcgggccgtgttgcca

SEQ ID NO: 410397 - DNA, 20 bp, human
gggtaaagatacttgcatct

SEQ ID NO: 410398 - DNA, 20 bp, human
gtgactcggaccaatgtctg

SEQ ID NO: 410399 - DNA, 20 bp, human
gagctccggggcttcccttc

SEQ ID NO: 410400 - DNA, 20 bp, human
gccgtgttgccagggttaca

SEQ ID NO: 410401 - DNA, 20 bp, human
gtagcgtgacgattcgcggg

SEQ ID NO: 410402 - DNA, 20 bp, human
gtcacgctacgattggtccg

SEQ ID NO: 410403 - DNA, 20 bp, human
gcgtcagcatcgcagtgact

SEQ ID NO: 410404 - DNA, 20 bp, human
gcactgcgatgctgacgctg

SEQ ID NO: 410405 - DNA, 20 bp, human
gcggggcttcccttcaggct

SEQ ID NO: 410406 - DNA, 20 bp, human
gtcgaaacgcagtggaggct

SEQ ID NO: 410407 - DNA, 20 bp, human
ggggcgacaaaggtgcggga

SEQ ID NO: 410408 - DNA, 20 bp, human
ggcgtcgcttcgaaacgcag

SEQ ID NO: 410409 - DNA, 20 bp, human
gcagagcccagactgcaatc

SEQ ID NO: 410410 - DNA, 20 bp, human
ggaagcgacgcccttgactg

SEQ ID NO: 410411 - DNA, 20 bp, human
gtggccgacttggaagctgg

SEQ ID NO: 410412 - DNA, 20 bp, human
ggcaaacccgattgcagtct

SEQ ID NO: 410413 - DNA, 20 bp, human
gtcgcttcgaaacgcagtgg

SEQ ID NO: 410414 - DNA, 20 bp, human
ggccctgcgccgaagaagag

SEQ ID NO: 410415 - DNA, 20 bp, human
gacaaaggtgcgggatggca

SEQ ID NO: 410416 - DNA, 20 bp, human
gactcctgtcagtccgctgg

SEQ ID NO: 410417 - DNA, 20 bp, human
ggaggaatctaggttatgat

SEQ ID NO: 410418 - DNA, 20 bp, human
ggcaatctgccggaagagtc

SEQ ID NO: 410419 - DNA, 20 bp, human
gaggaaccctaggcctgacc

SEQ ID NO: 410420 - DNA, 20 bp, human
gactggatatgtcgctgagg

SEQ ID NO: 410421 - DNA, 20 bp, human
gacgctacggaggtccccag

SEQ ID NO: 410422 - DNA, 20 bp, human
gagggtttataggcaggcgt

SEQ ID NO: 410423 - DNA, 20 bp, human
ggccctgcacacccgctccg

SEQ ID NO: 410424 - DNA, 20 bp, human
gtgaccgggttacaagagga

SEQ ID NO: 410425 - DNA, 20 bp, human
gggcagattgccctagtaac

SEQ ID NO: 410426 - DNA, 20 bp, human
ggaggggcgctgtcaatcac

SEQ ID NO: 410427 - DNA, 20 bp, human
gcaaccagagcgcacagcga

SEQ ID NO: 410428 - DNA, 20 bp, human
gcgcccctcgctgtgcgctc

SEQ ID NO: 410429 - DNA, 20 bp, human
ggagcagcgaggcttggaca

SEQ ID NO: 410430 - DNA, 20 bp, human
ggccagaggccaatcagagt

SEQ ID NO: 410431 - DNA, 20 bp, human
gtccagcccaagagaggcgg

SEQ ID NO: 410432 - DNA, 20 bp, human
gtgggtaaacaagaaaagac

SEQ ID NO: 410433 - DNA, 20 bp, human
ggtcaatcacggggcgccag

SEQ ID NO: 410434 - DNA, 20 bp, human
gtggcggcgcagccaatggc

SEQ ID NO: 410435 - DNA, 20 bp, human
gagtcatcgagtgagcagcg

SEQ ID NO: 410436 - DNA, 20 bp, human
gcggccgcggttccccactc

SEQ ID NO: 410437 - DNA, 20 bp, human
ggcgccgcgagggcagacgc

SEQ ID NO: 410438 - DNA, 20 bp, human
gcggcccgagtggggaaccg

SEQ ID NO: 410439 - DNA, 20 bp, human
gccgccgcggacgcgaagac

SEQ ID NO: 410440 - DNA, 20 bp, human
gccgcctcacgctaccctgc

SEQ ID NO: 410441 - DNA, 20 bp, human
ggagccagccggcccgagtg

SEQ ID NO: 410442 - DNA, 20 bp, human
gccgcccgcgtctgccctcg

SEQ ID NO: 410443 - DNA, 20 bp, human
gctcgcggatccggcgaccg

SEQ ID NO: 410444 - DNA, 20 bp, human
gagcgctcggctcgcgttct

SEQ ID NO: 410445 - DNA, 20 bp, human
gccgcggacgcgaagacagg

SEQ ID NO: 410446 - DNA, 20 bp, human
gggggcggggctctgatagg

SEQ ID NO: 410447 - DNA, 20 bp, human
gggcccgccgctccttgtat

SEQ ID NO: 410448 - DNA, 20 bp, human
gcttgtatgggcacaagagg

SEQ ID NO: 410449 - DNA, 20 bp, human
gtcagcccagcgatttgcat

SEQ ID NO: 410450 - DNA, 20 bp, human
gggggcctatgcaaatcgct

SEQ ID NO: 410451 - DNA, 20 bp, human
gctctgatagggggaaccta

SEQ ID NO: 410452 - DNA, 20 bp, human
gcccagcttctgcgtcacag

SEQ ID NO: 410453 - DNA, 20 bp, human
gagggggaacctagggccgg

SEQ ID NO: 410454 - DNA, 20 bp, human
ggacgccacgatgccatcta

SEQ ID NO: 410455 - DNA, 20 bp, human
gagagcgcttggcggacacg

SEQ ID NO: 410456 - DNA, 20 bp, human
gagggcccggccaatccgga

SEQ ID NO: 410457 - DNA, 20 bp, human
ggcgctcggcgcgtggtcgg

SEQ ID NO: 410458 - DNA, 20 bp, human
gacgcggcgggagcatgttc

SEQ ID NO: 410459 - DNA, 20 bp, human
gatgtcctgctcagtcgtca

SEQ ID NO: 410460 - DNA, 20 bp, human
gcgccgagcgccctccggat

SEQ ID NO: 410461 - DNA, 20 bp, human
ggggcgagacggagtgacgt

SEQ ID NO: 410462 - DNA, 20 bp, human
gagtgcgcagaggacgcggc

SEQ ID NO: 410463 - DNA, 20 bp, human
gtcatcgcgcgtgcggacgc

SEQ ID NO: 410464 - DNA, 20 bp, human
gccacgcgccgagcgccctc

SEQ ID NO: 410465 - DNA, 20 bp, human
gcgtcagggcccggccaatc

SEQ ID NO: 410466 - DNA, 20 bp, human
ggatccggatcgggtacggg

SEQ ID NO: 410467 - DNA, 20 bp, human
gcaccctcagacatcataag

SEQ ID NO: 410468 - DNA, 20 bp, human
gcgggatccggatcgggtac

SEQ ID NO: 410469 - DNA, 20 bp, human
gcgcgctcgggatccggatc

SEQ ID NO: 410470 - DNA, 20 bp, human
gcatgcatgttgggaattgt

SEQ ID NO: 410471 - DNA, 20 bp, human
gccggatcccgagcgcgcga

SEQ ID NO: 410472 - DNA, 20 bp, human
gtgtctgagggtgggctcga

SEQ ID NO: 410473 - DNA, 20 bp, human
gtggactccgagttgttgct

SEQ ID NO: 410474 - DNA, 20 bp, human
gcgggtacgggcggatgtag

SEQ ID NO: 410475 - DNA, 20 bp, human
gcatccgcccgtacccgatc

SEQ ID NO: 410476 - DNA, 20 bp, human
gcatagagaccggcgtggag

SEQ ID NO: 410477 - DNA, 20 bp, human
gagaatgcgccgctccacgc

SEQ ID NO: 410478 - DNA, 20 bp, human
gcactgcatagagaccggcg

SEQ ID NO: 410479 - DNA, 20 bp, human
ggtctctatgcagtgcattc

SEQ ID NO: 410480 - DNA, 20 bp, human
ggagtggcaggaaactcgat

SEQ ID NO: 410481 - DNA, 20 bp, human
gcaaatagcagtctacacta

SEQ ID NO: 410482 - DNA, 20 bp, human
gaatgaggtactgagggcca

SEQ ID NO: 410483 - DNA, 20 bp, human
gcttttgaatgaggtactga

SEQ ID NO: 410484 - DNA, 20 bp, human
gggaaaaactcggaaatggg

SEQ ID NO: 410485 - DNA, 20 bp, human
gtgggattacttcttttccg

SEQ ID NO: 410486 - DNA, 20 bp, human
gaccgtggaaatcccatctc

SEQ ID NO: 410487 - DNA, 20 bp, human
gaccgccgcccggaaggcga

SEQ ID NO: 410488 - DNA, 20 bp, human
gggaaatcccatctcgggat

SEQ ID NO: 410489 - DNA, 20 bp, human
gaccgcgccaatcccgagat

SEQ ID NO: 410490 - DNA, 20 bp, human
gccttccgggcggcggtctg

SEQ ID NO: 410491 - DNA, 20 bp, human
gccgggaaacggagtctcgc

SEQ ID NO: 410492 - DNA, 20 bp, human
gtcaagacggccggcgggac

SEQ ID NO: 410493 - DNA, 20 bp, human
gtcctccagtgaaaaacggg

SEQ ID NO: 410494 - DNA, 20 bp, human
gttccacggtgtcccgtagt

SEQ ID NO: 410495 - DNA, 20 bp, human
ggattggcgcggtgcctgct

SEQ ID NO: 410496 - DNA, 20 bp, human
gggcaaggtggggcggtcaa

SEQ ID NO: 410497 - DNA, 20 bp, human
gggaaggtgacatatacagc

SEQ ID NO: 410498 - DNA, 20 bp, human
gacccctgacgtcgccggtc

SEQ ID NO: 410499 - DNA, 20 bp, human
gacaaacaggacttattgta

SEQ ID NO: 410500 - DNA, 20 bp, human
gttgcggaataatccatagg

SEQ ID NO: 410501 - DNA, 20 bp, human
ggtgacatatacagcgggag

SEQ ID NO: 410502 - DNA, 20 bp, human
ggtggtcaaaatagtcccgg

SEQ ID NO: 410503 - DNA, 20 bp, human
gtcttaggcggggcaaggtg

SEQ ID NO: 410504 - DNA, 20 bp, human
gtacctcgactcgcgagagt

SEQ ID NO: 410505 - DNA, 20 bp, human
ggccggaccggcgacgtcag

SEQ ID NO: 410506 - DNA, 20 bp, human
gggctgcagaggttagtggg

SEQ ID NO: 410507 - DNA, 20 bp, human
gggtgccagagactataagt

SEQ ID NO: 410508 - DNA, 20 bp, human
gcgcaagcgcggttatggct

SEQ ID NO: 410509 - DNA, 20 bp, human
gcaagcccacttatagtctc

SEQ ID NO: 410510 - DNA, 20 bp, human
gcaggcgcggattcgctcgt

SEQ ID NO: 410511 - DNA, 20 bp, human
gattggctgcagaggttagt

SEQ ID NO: 410512 - DNA, 20 bp, human
gcttggcgcaagcgcggtta

SEQ ID NO: 410513 - DNA, 20 bp, human
ggaccattgtgcgctctaat

SEQ ID NO: 410514 - DNA, 20 bp, human
gcgcgtaaggactagcgcgc

SEQ ID NO: 410515 - DNA, 20 bp, human
gcgcggattcgctcgttggc

SEQ ID NO: 410516 - DNA, 20 bp, human
gcctgctccggcgccccagg

SEQ ID NO: 410517 - DNA, 20 bp, human
gggggggcgatcagacacct

SEQ ID NO: 410518 - DNA, 20 bp, human
gcctgcgcagagcagcccgc

SEQ ID NO: 410519 - DNA, 20 bp, human
gttgcgggaacccagcttgg

SEQ ID NO: 410520 - DNA, 20 bp, human
gatggggcctcggcgcgaac

SEQ ID NO: 410521 - DNA, 20 bp, human
gggcgcgggttctgcgggct

SEQ ID NO: 410522 - DNA, 20 bp, human
gggaggtcggaccgcagctc

SEQ ID NO: 410523 - DNA, 20 bp, human
ggcagaacccgcgcctgctc

SEQ ID NO: 410524 - DNA, 20 bp, human
gggcttgcgggaacccagct

SEQ ID NO: 410525 - DNA, 20 bp, human
gttctgcgggctcggctagc

SEQ ID NO: 410526 - DNA, 20 bp, human
gccgcggggcccactgcgct

SEQ ID NO: 410527 - DNA, 20 bp, human
ggagcggcgcgaatcccgcg

SEQ ID NO: 410528 - DNA, 20 bp, human
ggcggggcgatcagacaccc

SEQ ID NO: 410529 - DNA, 20 bp, human
gccggagcccagcggtccgc

SEQ ID NO: 410530 - DNA, 20 bp, human
gccagctccggcgcctgagg

SEQ ID NO: 410531 - DNA, 20 bp, human
gagcgggggcctagcgcagt

SEQ ID NO: 410532 - DNA, 20 bp, human
ggagctggcgcgggttcggc

SEQ ID NO: 410533 - DNA, 20 bp, human
ggaggtctggcggcagctct

SEQ ID NO: 410534 - DNA, 20 bp, human
gcaagtacagcaccacgcct

SEQ ID NO: 410535 - DNA, 20 bp, human
gtacagcaccacgcctgggc

SEQ ID NO: 410536 - DNA, 20 bp, human
gcaagccccggcgtagagtc

SEQ ID NO: 410537 - DNA, 20 bp, human
gggagcgccggcacctacga

SEQ ID NO: 410538 - DNA, 20 bp, human
gggggcgccgggaccgacta

SEQ ID NO: 410539 - DNA, 20 bp, human
ggctgggctgacgtgacgtg

SEQ ID NO: 410540 - DNA, 20 bp, human
gcgcacgcgcggttccgagc

SEQ ID NO: 410541 - DNA, 20 bp, human
ggcggggcacgggaccgaca

SEQ ID NO: 410542 - DNA, 20 bp, human
ggccccgccctagtcggtcc

SEQ ID NO: 410543 - DNA, 20 bp, human
ggcgccgggaccgactaggg

SEQ ID NO: 410544 - DNA, 20 bp, human
gaccgacaggggacggggtg

SEQ ID NO: 410545 - DNA, 20 bp, human
gcccgctggcgtggaagacg

SEQ ID NO: 410546 - DNA, 20 bp, human
ggagggcggatggggctagg

SEQ ID NO: 410547 - DNA, 20 bp, human
gtgagcggctgggtcgtggc

SEQ ID NO: 410548 - DNA, 20 bp, human
gcggctgggtcgtggcaggt

SEQ ID NO: 410549 - DNA, 20 bp, human
ggcgtgtcggagggcggatg

SEQ ID NO: 410550 - DNA, 20 bp, human
gctagctccgtgtgcctcgc

SEQ ID NO: 410551 - DNA, 20 bp, human
ggtggcaggttggtctgggg

SEQ ID NO: 410552 - DNA, 20 bp, human
gggtcgtggcaggttggtct

SEQ ID NO: 410553 - DNA, 20 bp, human
ggaggcgggaggagaacggt

SEQ ID NO: 410554 - DNA, 20 bp, human
ggggctaggaggccgcccgg

SEQ ID NO: 410555 - DNA, 20 bp, human
ggaacggttggccccggcag

SEQ ID NO: 410556 - DNA, 20 bp, human
gcgcccgggcgggtcctcgc

SEQ ID NO: 410557 - DNA, 20 bp, human
ggctcctttaagggcctggg

SEQ ID NO: 410558 - DNA, 20 bp, human
gaatgcgcagactcagacga

SEQ ID NO: 410559 - DNA, 20 bp, human
ggggtgtgtggctcctttaa

SEQ ID NO: 410560 - DNA, 20 bp, human
gtgagtctgcgcattgagag

SEQ ID NO: 410561 - DNA, 20 bp, human
gaagctggaggtcgggctgg

SEQ ID NO: 410562 - DNA, 20 bp, human
ggaagggatgctaggatttg

SEQ ID NO: 410563 - DNA, 20 bp, human
gccccctcccaggcccttaa

SEQ ID NO: 410564 - DNA, 20 bp, human
gtgcgctctggttcgggctg

SEQ ID NO: 410565 - DNA, 20 bp, human
ggaatgacagaggagtctat

SEQ ID NO: 410566 - DNA, 20 bp, human
gacaaggagcggcccggaga

SEQ ID NO: 410567 - DNA, 20 bp, human
ggaccgggacgcagagtctg

SEQ ID NO: 410568 - DNA, 20 bp, human
gccggcctgaggcaggatca

SEQ ID NO: 410569 - DNA, 20 bp, human
ggggagggacacacggaagg

SEQ ID NO: 410570 - DNA, 20 bp, human
ggcggggagggacacacgga

SEQ ID NO: 410571 - DNA, 20 bp, human
gcggacctcggcggagcctc

SEQ ID NO: 410572 - DNA, 20 bp, human
gggacggtgagtcagatctc

SEQ ID NO: 410573 - DNA, 20 bp, human
ggaggcggccacccgagacg

SEQ ID NO: 410574 - DNA, 20 bp, human
ggcccagaccatacaaggag

SEQ ID NO: 410575 - DNA, 20 bp, human
gaggaaactcccccaggaag

SEQ ID NO: 410576 - DNA, 20 bp, human
gatggcggcagcggaggcta

SEQ ID NO: 410577 - DNA, 20 bp, human
ggcgccgtcacgtagatagg

SEQ ID NO: 410578 - DNA, 20 bp, human
ggcggggagcgccgcctcaa

SEQ ID NO: 410579 - DNA, 20 bp, human
gaaggcgccgtcacgtagat

SEQ ID NO: 410580 - DNA, 20 bp, human
ggacgcggaggagacgacgg

SEQ ID NO: 410581 - DNA, 20 bp, human
gccgcctagctgtcgtgagt

SEQ ID NO: 410582 - DNA, 20 bp, human
gctgagacagactcgtcctc

SEQ ID NO: 410583 - DNA, 20 bp, human
gaggccgcctatctacgtga

SEQ ID NO: 410584 - DNA, 20 bp, human
gtcagccccaacaaagatgg

SEQ ID NO: 410585 - DNA, 20 bp, human
gaagccaagaagtacgagaa

SEQ ID NO: 410586 - DNA, 20 bp, human
gcccgccacggcacttgctc

SEQ ID NO: 410587 - DNA, 20 bp, human
gcgtgcagcgcccgcgggtc

SEQ ID NO: 410588 - DNA, 20 bp, human
ggctgcaggaagctcgatag

SEQ ID NO: 410589 - DNA, 20 bp, human
gtgtgcgcgggcgaaagggg

SEQ ID NO: 410590 - DNA, 20 bp, human
gccgcccgccagtcccaacg

SEQ ID NO: 410591 - DNA, 20 bp, human
ggagaaaggaggggaccgga

SEQ ID NO: 410592 - DNA, 20 bp, human
gtccactagacccaacatgg

SEQ ID NO: 410593 - DNA, 20 bp, human
gccaggttggacggttgcaa

SEQ ID NO: 410594 - DNA, 20 bp, human
gaagaccaaacttcgcccag

SEQ ID NO: 410595 - DNA, 20 bp, human
gacccgagcaagtgccgtgg

SEQ ID NO: 410596 - DNA, 20 bp, mouse
gtagtactggatcgtcaggt

SEQ ID NO: 410597 - DNA, 20 bp, mouse
ggcagtagtactggatcgtc

SEQ ID NO: 410598 - DNA, 20 bp, mouse
ggatactgctgcagtagtac

SEQ ID NO: 410599 - DNA, 20 bp, mouse
gatcgtcaggtaggagaatt

SEQ ID NO: 410600 - DNA, 20 bp, mouse
gtgggaccggagctggccta

SEQ ID NO: 410601 - DNA, 20 bp, mouse
gaagtggcccaggtggactt

SEQ ID NO: 410602 - DNA, 20 bp, mouse
ggcccaggtggacttgggac

SEQ ID NO: 410603 - DNA, 20 bp, mouse
gtccggtcccaagtccacct

SEQ ID NO: 410604 - DNA, 20 bp, mouse
gcaggtaggagaatttggag

SEQ ID NO: 410605 - DNA, 20 bp, mouse
gtgagtggtgtagctaggat

SEQ ID NO: 410606 - DNA, 20 bp, mouse
gcgacttccctctagttcag

SEQ ID NO: 410607 - DNA, 20 bp, mouse
gggggcagacaagctcaaag

SEQ ID NO: 410608 - DNA, 20 bp, mouse
ggcagtctcggctagtcggt

SEQ ID NO: 410609 - DNA, 20 bp, mouse
gggtgggcggagctaccccg

SEQ ID NO: 410610 - DNA, 20 bp, mouse
ggcggagctaccccgcgggg

SEQ ID NO: 410611 - DNA, 20 bp, mouse
gactagagggaagtcggctt

SEQ ID NO: 410612 - DNA, 20 bp, mouse
gggacgttgagtgtgtgtga

SEQ ID NO: 410613 - DNA, 20 bp, mouse
gacctccaggtgctaggcaa

SEQ ID NO: 410614 - DNA, 20 bp, mouse
gaagtcgggagctagagact

SEQ ID NO: 410615 - DNA, 20 bp, mouse
gagggaagtcggcttaggtg

SEQ ID NO: 410616 - DNA, 20 bp, mouse
gaaagtccgcgtctcaaatt

SEQ ID NO: 410617 - DNA, 20 bp, mouse
ggcgatgcaagcggctaaga

SEQ ID NO: 410618 - DNA, 20 bp, mouse
ggccagggggctctcaatag

SEQ ID NO: 410619 - DNA, 20 bp, mouse
gcgttctctgtagtgtgact

SEQ ID NO: 410620 - DNA, 20 bp, mouse
gcatcttggcgggctgatgt

SEQ ID NO: 410621 - DNA, 20 bp, mouse
ggtcctgggctcgtcctcag

SEQ ID NO: 410622 - DNA, 20 bp, mouse
gaagcttccccaactatggg

SEQ ID NO: 410623 - DNA, 20 bp, mouse
ggacttggagcatcttttct

SEQ ID NO: 410624 - DNA, 20 bp, mouse
gggttaccgtaagatccctc

SEQ ID NO: 410625 - DNA, 20 bp, mouse
ggtccctccgcccatagttg

SEQ ID NO: 410626 - DNA, 20 bp, mouse
gacccccgcgagcaagaacc

SEQ ID NO: 410627 - DNA, 20 bp, mouse
gagcaagaaccgggcctccc

SEQ ID NO: 410628 - DNA, 20 bp, mouse
ggggcacaggattcacatag

SEQ ID NO: 410629 - DNA, 20 bp, mouse
gcgggccgcgccccgatctg

SEQ ID NO: 410630 - DNA, 20 bp, mouse
gcgggactcaccccagatcg

SEQ ID NO: 410631 - DNA, 20 bp, mouse
gccgcccgccagggacacgt

SEQ ID NO: 410632 - DNA, 20 bp, mouse
gcgcagggcgcctgacgggt

SEQ ID NO: 410633 - DNA, 20 bp, mouse
gctgctacgcggcagtcccg

SEQ ID NO: 410634 - DNA, 20 bp, mouse
gcggggtcgcgagcgcgcgg

SEQ ID NO: 410635 - DNA, 20 bp, mouse
gctgtagagaaaggtcctgg

SEQ ID NO: 410636 - DNA, 20 bp, mouse
gggatcgaggcccaaaggac

SEQ ID NO: 410637 - DNA, 20 bp, mouse
gccgagggatcgaggcccaa

SEQ ID NO: 410638 - DNA, 20 bp, mouse
ggccgctgcgctgtccccag

SEQ ID NO: 410639 - DNA, 20 bp, mouse
ggacagcgcagcggccactc

SEQ ID NO: 410640 - DNA, 20 bp, mouse
gccctcggctgcaggctcta

SEQ ID NO: 410641 - DNA, 20 bp, mouse
ggaggcccaaaggacgggac

SEQ ID NO: 410642 - DNA, 20 bp, mouse
ggccgctggggacagcgcag

SEQ ID NO: 410643 - DNA, 20 bp, mouse
ggcctgcagccgagggatcg

SEQ ID NO: 410644 - DNA, 20 bp, mouse
gcgccatagcgccagtgggt

SEQ ID NO: 410645 - DNA, 20 bp, mouse
gctgggaagggcgggacaga

SEQ ID NO: 410646 - DNA, 20 bp, mouse
gcggcgcacacgccaggctg

SEQ ID NO: 410647 - DNA, 20 bp, mouse
gcccgcgctcgcgcccagaa

SEQ ID NO: 410648 - DNA, 20 bp, mouse
ggcgacccggcgcacacgcc

SEQ ID NO: 410649 - DNA, 20 bp, mouse
gtagcgggcgcaggcgggtg

SEQ ID NO: 410650 - DNA, 20 bp, mouse
gcgcccagaacggcgcgacc

SEQ ID NO: 410651 - DNA, 20 bp, mouse
ggctccgtcgccaagagcgt

SEQ ID NO: 410652 - DNA, 20 bp, mouse
gccactcggaagctggagtg

SEQ ID NO: 410653 - DNA, 20 bp, mouse
ggaggcggcctcacgagccg

SEQ ID NO: 410654 - DNA, 20 bp, mouse
gggagcgccgctgcccatcc

SEQ ID NO: 410655 - DNA, 20 bp, mouse
ggcccctcggcgctcttgct

SEQ ID NO: 410656 - DNA, 20 bp, mouse
ggccatggagggcggaggta

SEQ ID NO: 410657 - DNA, 20 bp, mouse
gtgagcggagcacagaagcc

SEQ ID NO: 410658 - DNA, 20 bp, mouse
gaccctggaaatgctaggac

SEQ ID NO: 410659 - DNA, 20 bp, mouse
gtggagggcggaggtaggga

SEQ ID NO: 410660 - DNA, 20 bp, mouse
gtcctgtcctagcatttcca

SEQ ID NO: 410661 - DNA, 20 bp, mouse
gacaggagcgacgccatgga

SEQ ID NO: 410662 - DNA, 20 bp, mouse
gggaggtagggagggatcgc

SEQ ID NO: 410663 - DNA, 20 bp, mouse
gcagcacaggagcgacgcca

SEQ ID NO: 410664 - DNA, 20 bp, mouse
gggagcgacgccatggaggg

SEQ ID NO: 410665 - DNA, 20 bp, mouse
gtttccagggttccctctcc

SEQ ID NO: 410666 - DNA, 20 bp, mouse
gggccccgcgcacctcctca

SEQ ID NO: 410667 - DNA, 20 bp, mouse
gccacgcgagctggaaacca

SEQ ID NO: 410668 - DNA, 20 bp, mouse
gcgcgagggaggtcgaacct

SEQ ID NO: 410669 - DNA, 20 bp, mouse
gccggctgccgggctctccg

SEQ ID NO: 410670 - DNA, 20 bp, mouse
ggagggaggtcgaaccttgg

SEQ ID NO: 410671 - DNA, 20 bp, mouse
ggcggcggagcgtctccgtg

SEQ ID NO: 410672 - DNA, 20 bp, mouse
ggcggagcgtctccgtgagg

SEQ ID NO: 410673 - DNA, 20 bp, mouse
gcagggagcgcagtccgcga

SEQ ID NO: 410674 - DNA, 20 bp, mouse
ggaagatctctccaacctgg

SEQ ID NO: 410675 - DNA, 20 bp, mouse
gggcggagcagcattacggg

SEQ ID NO: 410676 - DNA, 20 bp, mouse
gggcggagtacggacaggat

SEQ ID NO: 410677 - DNA, 20 bp, mouse
gctgggcaggatccacatac

SEQ ID NO: 410678 - DNA, 20 bp, mouse
gatactggcggagtacggac

SEQ ID NO: 410679 - DNA, 20 bp, mouse
gggcaggatccacatactgg

SEQ ID NO: 410680 - DNA, 20 bp, mouse
gaacgctgcctggacaggtg

SEQ ID NO: 410681 - DNA, 20 bp, mouse
gcgcaccgctgcgatgatga

SEQ ID NO: 410682 - DNA, 20 bp, mouse
gtccacatactggcggagta

SEQ ID NO: 410683 - DNA, 20 bp, mouse
gcagccccaagcggccgcaa

SEQ ID NO: 410684 - DNA, 20 bp, mouse
ggcagccatcatcatcgcag

SEQ ID NO: 410685 - DNA, 20 bp, mouse
gggccttcccgaatgccgag

SEQ ID NO: 410686 - DNA, 20 bp, mouse
ggggagtcgcaagcaacacg

SEQ ID NO: 410687 - DNA, 20 bp, mouse
ggcagtgactctgcagagcc

SEQ ID NO: 410688 - DNA, 20 bp, mouse
ggggtccggcccctgtcccc

SEQ ID NO: 410689 - DNA, 20 bp, mouse
gacaggggccggacccagtg

SEQ ID NO: 410690 - DNA, 20 bp, mouse
gggccggacccagtgaggtc

SEQ ID NO: 410691 - DNA, 20 bp, mouse
gggtgagcttctggacacaa

SEQ ID NO: 410692 - DNA, 20 bp, mouse
ggccacagcgcttgccagag

SEQ ID NO: 410693 - DNA, 20 bp, mouse
ggcccctgtccccgggagtc

SEQ ID NO: 410694 - DNA, 20 bp, mouse
gttgcgactcccgactcccg

SEQ ID NO: 410695 - DNA, 20 bp, mouse
gcggtaagcgttgcagctcc

SEQ ID NO: 410696 - DNA, 20 bp, mouse
ggccgaaggccctaattccg

SEQ ID NO: 410697 - DNA, 20 bp, mouse
ggcagttgtggcggttacgg

SEQ ID NO: 410698 - DNA, 20 bp, mouse
gaattccgcggcagttgtgg

SEQ ID NO: 410699 - DNA, 20 bp, mouse
ggcggcagttgtggcggtta

SEQ ID NO: 410700 - DNA, 20 bp, mouse
gcggagccggaagccgaggt

SEQ ID NO: 410701 - DNA, 20 bp, mouse
gggtcggcggccggaagtca

SEQ ID NO: 410702 - DNA, 20 bp, mouse
gtggaggcggcccaggatca

SEQ ID NO: 410703 - DNA, 20 bp, mouse
ggtacccagcatacgaatgg

SEQ ID NO: 410704 - DNA, 20 bp, mouse
gaaccccggcccgtgatcct

SEQ ID NO: 410705 - DNA, 20 bp, mouse
gcccagcatacgaatggagg

SEQ ID NO: 410706 - DNA, 20 bp, mouse
gccatggggtaggggcacag

SEQ ID NO: 410707 - DNA, 20 bp, mouse
gaggggacccagccccagtg

SEQ ID NO: 410708 - DNA, 20 bp, mouse
gaaaaggagccatggggtag

SEQ ID NO: 410709 - DNA, 20 bp, mouse
gggaatctgggacaacagag

SEQ ID NO: 410710 - DNA, 20 bp, mouse
gtagactcaaaaggagccat

SEQ ID NO: 410711 - DNA, 20 bp, mouse
gatctgggacaacagagggg

SEQ ID NO: 410712 - DNA, 20 bp, mouse
gcgctgagtttaactagctg

SEQ ID NO: 410713 - DNA, 20 bp, mouse
ggaagagactcgccaggtaa

SEQ ID NO: 410714 - DNA, 20 bp, mouse
gaaggagtcatgtgactctg

SEQ ID NO: 410715 - DNA, 20 bp, mouse
gcaacccagagagctcagtg

SEQ ID NO: 410716 - DNA, 20 bp, mouse
gcagctatgggggtaaggag

SEQ ID NO: 410717 - DNA, 20 bp, mouse
gcgtggaccggcagctatgg

SEQ ID NO: 410718 - DNA, 20 bp, mouse
gggcgtggcacgcagctgag

SEQ ID NO: 410719 - DNA, 20 bp, mouse
ggcagcgacttaacgtggac

SEQ ID NO: 410720 - DNA, 20 bp, mouse
gggaagggaggagcatccgg

SEQ ID NO: 410721 - DNA, 20 bp, mouse
gctgtcgcagcgacttaacg

SEQ ID NO: 410722 - DNA, 20 bp, mouse
gtaacgtggaccggcagcta

SEQ ID NO: 410723 - DNA, 20 bp, mouse
gggagcatccggaggcagtg

SEQ ID NO: 410724 - DNA, 20 bp, mouse
gcggaaggcgggttcctcta

SEQ ID NO: 410725 - DNA, 20 bp, mouse
ggaggcagtggggcatctta

SEQ ID NO: 410726 - DNA, 20 bp, mouse
ggacgcgaggaggaactatg

SEQ ID NO: 410727 - DNA, 20 bp, mouse
gccgaggcccacgaagccat

SEQ ID NO: 410728 - DNA, 20 bp, mouse
gggcggcggctccagagtcg

SEQ ID NO: 410729 - DNA, 20 bp, mouse
gcgcgctgggacacgcgagt

SEQ ID NO: 410730 - DNA, 20 bp, mouse
gctgcagcgcgacaggctcc

SEQ ID NO: 410731 - DNA, 20 bp, mouse
ggccccgccgcaggtaagta

SEQ ID NO: 410732 - DNA, 20 bp, mouse
ggcggcgcccatggcttcgt

SEQ ID NO: 410733 - DNA, 20 bp, mouse
gaagtcacggaattcaacct

SEQ ID NO: 410734 - DNA, 20 bp, mouse
gtccagagtcgcggcgccca

SEQ ID NO: 410735 - DNA, 20 bp, mouse
gcccggaccgtacttacctg

SEQ ID NO: 410736 - DNA, 20 bp, mouse
gctcctgtacctctaggctg

SEQ ID NO: 410737 - DNA, 20 bp, mouse
gtcagcagcagcatgaagct

SEQ ID NO: 410738 - DNA, 20 bp, mouse
gaccctcagcctagaggtac

SEQ ID NO: 410739 - DNA, 20 bp, mouse
gtcagaggtgaccatcaagg

SEQ ID NO: 410740 - DNA, 20 bp, mouse
gaattcagaggtgaccatca

SEQ ID NO: 410741 - DNA, 20 bp, mouse
gagtagagaaggagacgtct

SEQ ID NO: 410742 - DNA, 20 bp, mouse
gtcttggccctgctgcgtat

SEQ ID NO: 410743 - DNA, 20 bp, mouse
gctagaggtacaggagctgc

SEQ ID NO: 410744 - DNA, 20 bp, mouse
gaggtacgtctgggcaaaca

SEQ ID NO: 410745 - DNA, 20 bp, mouse
gggtccagtcaggtgaccca

SEQ ID NO: 410746 - DNA, 20 bp, mouse
ggccacacattggggaacag

SEQ ID NO: 410747 - DNA, 20 bp, mouse
gactgcccggtccttacctg

SEQ ID NO: 410748 - DNA, 20 bp, mouse
gtgtaggcccgagggaggaa

SEQ ID NO: 410749 - DNA, 20 bp, mouse
gttgcgcagtcgggttgcgg

SEQ ID NO: 410750 - DNA, 20 bp, mouse
ggaccccacgcgccacacat

SEQ ID NO: 410751 - DNA, 20 bp, mouse
gcgcttgcgcagtcgggttg

SEQ ID NO: 410752 - DNA, 20 bp, mouse
gtccagtgtaggcccgaggg

SEQ ID NO: 410753 - DNA, 20 bp, mouse
gaaggcggcgctgcgaccgg

SEQ ID NO: 410754 - DNA, 20 bp, mouse
ggagcacccagccttacccg

SEQ ID NO: 410755 - DNA, 20 bp, mouse
gtgctccagtgtaggcccga

SEQ ID NO: 410756 - DNA, 20 bp, mouse
gacctcgcccgaggcagtga

SEQ ID NO: 410757 - DNA, 20 bp, mouse
ggtccccggcgcgcactctg

SEQ ID NO: 410758 - DNA, 20 bp, mouse
gtccaaggacagaaaaatgg

SEQ ID NO: 410759 - DNA, 20 bp, mouse
ggtagcgcagctccctcaga

SEQ ID NO: 410760 - DNA, 20 bp, mouse
ggacccgcaggtggaggaca

SEQ ID NO: 410761 - DNA, 20 bp, mouse
gcggtctgcgcaggtgatag

SEQ ID NO: 410762 - DNA, 20 bp, mouse
ggccttaacgaggtaccggt

SEQ ID NO: 410763 - DNA, 20 bp, mouse
gccccgcagagtgcgcgccg

SEQ ID NO: 410764 - DNA, 20 bp, mouse
ggagctgcgctacctgaacg

SEQ ID NO: 410765 - DNA, 20 bp, mouse
gtggtgagacccgcaggtgg

SEQ ID NO: 410766 - DNA, 20 bp, mouse
gaggaccagagggaggctcg

SEQ ID NO: 410767 - DNA, 20 bp, mouse
gggagacgtcagagccaaac

SEQ ID NO: 410768 - DNA, 20 bp, mouse
gtgacaaagaataggaccag

SEQ ID NO: 410769 - DNA, 20 bp, mouse
gagttcctcgagcctccctc

SEQ ID NO: 410770 - DNA, 20 bp, mouse
gaaagtagcccaatcggaag

SEQ ID NO: 410771 - DNA, 20 bp, mouse
gttacaatctgacaaagaat

SEQ ID NO: 410772 - DNA, 20 bp, mouse
ggtcagagccaaacgggctg

SEQ ID NO: 410773 - DNA, 20 bp, mouse
ggggtgaagcggttgactct

SEQ ID NO: 410774 - DNA, 20 bp, mouse
gagccaagccccttccgatt

SEQ ID NO: 410775 - DNA, 20 bp, mouse
gaccctgaaagtagcccaat

SEQ ID NO: 410776 - DNA, 20 bp, mouse
ggcatctgtaggtcggacag

SEQ ID NO: 410777 - DNA, 20 bp, mouse
ggcgacgaagcagcatctgt

SEQ ID NO: 410778 - DNA, 20 bp, mouse
gggggtctgccagaaatgaa

SEQ ID NO: 410779 - DNA, 20 bp, mouse
gcgaagcagcatctgtaggt

SEQ ID NO: 410780 - DNA, 20 bp, mouse
ggcctcggcaagccagaggg

SEQ ID NO: 410781 - DNA, 20 bp, mouse
gtcccggaggggccacagag

SEQ ID NO: 410782 - DNA, 20 bp, mouse
ggtgggagggctcccaaaag

SEQ ID NO: 410783 - DNA, 20 bp, mouse
gcaggggctgaagaactggg

SEQ ID NO: 410784 - DNA, 20 bp, mouse
gagagcgacaaagctgtaca

SEQ ID NO: 410785 - DNA, 20 bp, mouse
gtgacagcgtcggtgggtgg

SEQ ID NO: 410786 - DNA, 20 bp, mouse
gtgtggtacaggctcaggta

SEQ ID NO: 410787 - DNA, 20 bp, mouse
gcgtgcgcaagggctcgatg

SEQ ID NO: 410788 - DNA, 20 bp, mouse
gcatccgacccacagaccat

SEQ ID NO: 410789 - DNA, 20 bp, mouse
ggagcccttgcgcacgacgg

SEQ ID NO: 410790 - DNA, 20 bp, mouse
gagggcggcccatggtctgt

SEQ ID NO: 410791 - DNA, 20 bp, mouse
gtgcagcgtgtgttgaggag

SEQ ID NO: 410792 - DNA, 20 bp, mouse
gacccgccgggaagatcttc

SEQ ID NO: 410793 - DNA, 20 bp, mouse
gcgccagaagatcttcccgg

SEQ ID NO: 410794 - DNA, 20 bp, mouse
gggtctgtgggtcggatgtc

SEQ ID NO: 410795 - DNA, 20 bp, mouse
gggagacaccggaagtgcag

SEQ ID NO: 410796 - DNA, 20 bp, mouse
gcggagcagcggttaatctc

SEQ ID NO: 410797 - DNA, 20 bp, mouse
gctgcggggcagggaccacg

SEQ ID NO: 410798 - DNA, 20 bp, mouse
gggaccacgaggcccgagcc

SEQ ID NO: 410799 - DNA, 20 bp, mouse
gctgctccgaggaggaaccg

SEQ ID NO: 410800 - DNA, 20 bp, mouse
gggtgtgggtccggccgacc

SEQ ID NO: 410801 - DNA, 20 bp, mouse
gcgccgaggtggcaaggctg

SEQ ID NO: 410802 - DNA, 20 bp, mouse
ggttaatctcaggctggtgt

SEQ ID NO: 410803 - DNA, 20 bp, mouse
gattaaccgctgctccgagg

SEQ ID NO: 410804 - DNA, 20 bp, mouse
ggcagcggttaatctcaggc

SEQ ID NO: 410805 - DNA, 20 bp, mouse
gggtggcccgcgtctacaac

SEQ ID NO: 410806 - DNA, 20 bp, mouse
ggcagcagtgacgactgtag

SEQ ID NO: 410807 - DNA, 20 bp, mouse
ggagggttgaggcctagtga

SEQ ID NO: 410808 - DNA, 20 bp, mouse
gtgaggcctagtgaaggctg

SEQ ID NO: 410809 - DNA, 20 bp, mouse
ggagacctgcgtaggaacgg

SEQ ID NO: 410810 - DNA, 20 bp, mouse
gagaagcgcccgaaggaagg

SEQ ID NO: 410811 - DNA, 20 bp, mouse
gggctggggtaggccgggaa

SEQ ID NO: 410812 - DNA, 20 bp, mouse
ggcctaccccagccttcact

SEQ ID NO: 410813 - DNA, 20 bp, mouse
ggactgtagcggtgaagggc

SEQ ID NO: 410814 - DNA, 20 bp, mouse
gtgacgactgtagcggtgaa

SEQ ID NO: 410815 - DNA, 20 bp, mouse
gtcgttgcgcccccttcctt

SEQ ID NO: 410816 - DNA, 20 bp, mouse
gacagccgaggacgacgggg

SEQ ID NO: 410817 - DNA, 20 bp, mouse
ggacccgcgcccacctgtca

SEQ ID NO: 410818 - DNA, 20 bp, mouse
gcctgtcatggcggaggaca

SEQ ID NO: 410819 - DNA, 20 bp, mouse
gtcgctgggcgggacctata

SEQ ID NO: 410820 - DNA, 20 bp, mouse
gccgcgcccacctgtcatgg

SEQ ID NO: 410821 - DNA, 20 bp, mouse
gttagggccaggcctgcggg

SEQ ID NO: 410822 - DNA, 20 bp, mouse
ggcggacagccgaggacgac

SEQ ID NO: 410823 - DNA, 20 bp, mouse
gggtctcgggtgctgagtgg

SEQ ID NO: 410824 - DNA, 20 bp, mouse
gtgtccgccgcccggcgcga

SEQ ID NO: 410825 - DNA, 20 bp, mouse
ggccgggcggcggacagccg

SEQ ID NO: 410826 - DNA, 20 bp, mouse
gtccgggcagcgagggacag

SEQ ID NO: 410827 - DNA, 20 bp, mouse
ggcggtagtccgggcagcga

SEQ ID NO: 410828 - DNA, 20 bp, mouse
gggggcggcagcggtagtcc

SEQ ID NO: 410829 - DNA, 20 bp, mouse
ggagggacagtggcccgccg

SEQ ID NO: 410830 - DNA, 20 bp, mouse
gctctgctcgctctgcccag

SEQ ID NO: 410831 - DNA, 20 bp, mouse
ggccaagccgaagggagtcg

SEQ ID NO: 410832 - DNA, 20 bp, mouse
gggccccgcccctccctcgg

SEQ ID NO: 410833 - DNA, 20 bp, mouse
gggcgcgacgggaggatgag

SEQ ID NO: 410834 - DNA, 20 bp, mouse
ggacgcggcctgggacgaca

SEQ ID NO: 410835 - DNA, 20 bp, mouse
ggccggggcgagggagaccc

SEQ ID NO: 410836 - DNA, 20 bp, mouse
gctgaagctccggagagagg

SEQ ID NO: 410837 - DNA, 20 bp, mouse
gagaggtggcaagtgaccgt

SEQ ID NO: 410838 - DNA, 20 bp, mouse
gttaatttgagttcagactg

SEQ ID NO: 410839 - DNA, 20 bp, mouse
gtacctgaagctccggagag

SEQ ID NO: 410840 - DNA, 20 bp, mouse
ggtgttttctctgagcaacc

SEQ ID NO: 410841 - DNA, 20 bp, mouse
ggggaaagcagcggctccca

SEQ ID NO: 410842 - DNA, 20 bp, mouse
ggtttatttaatgagatgcc

SEQ ID NO: 410843 - DNA, 20 bp, mouse
gatctcattaaataaacaga

SEQ ID NO: 410844 - DNA, 20 bp, mouse
ggtatatgaaatatatccag

SEQ ID NO: 410845 - DNA, 20 bp, mouse
ggtctttaggatgttcataa

SEQ ID NO: 410846 - DNA, 20 bp, mouse
gcccagcaagggatgcgggt

SEQ ID NO: 410847 - DNA, 20 bp, mouse
gcgcaccggttgcccagcaa

SEQ ID NO: 410848 - DNA, 20 bp, mouse
ggggacgtaccagtgcgcag

SEQ ID NO: 410849 - DNA, 20 bp, mouse
gcaggggtggggcgtcgcac

SEQ ID NO: 410850 - DNA, 20 bp, mouse
gcgtaccagtgcgcaggggt

SEQ ID NO: 410851 - DNA, 20 bp, mouse
ggttgcccagcaagggatgc

SEQ ID NO: 410852 - DNA, 20 bp, mouse
ggggtgggcgcgtgtcgctg

SEQ ID NO: 410853 - DNA, 20 bp, mouse
gagcgcgagggcggggtata

SEQ ID NO: 410854 - DNA, 20 bp, mouse
gtgcacaaggtaggaatggg

SEQ ID NO: 410855 - DNA, 20 bp, mouse
ggcgttgctactctgctgtt

SEQ ID NO: 410856 - DNA, 20 bp, mouse
ggacgcctggacgccatctt

SEQ ID NO: 410857 - DNA, 20 bp, mouse
gacgccatcttgggcacggg

SEQ ID NO: 410858 - DNA, 20 bp, mouse
gtggacgccatcttgggcac

SEQ ID NO: 410859 - DNA, 20 bp, mouse
gtgggcacgggcggaagcct

SEQ ID NO: 410860 - DNA, 20 bp, mouse
gagacaggtggaagttaatt

SEQ ID NO: 410861 - DNA, 20 bp, mouse
gcagacttcgccaagacagg

SEQ ID NO: 410862 - DNA, 20 bp, mouse
gcttccgcccgtgcccaaga

SEQ ID NO: 410863 - DNA, 20 bp, mouse
gaatggagtcccgtaacctg

SEQ ID NO: 410864 - DNA, 20 bp, mouse
ggcgtgcgcgccacaggtta

SEQ ID NO: 410865 - DNA, 20 bp, mouse
gctggagcgcttgaattcca

SEQ ID NO: 410866 - DNA, 20 bp, mouse
ggccacgcgaagatggaact

SEQ ID NO: 410867 - DNA, 20 bp, mouse
gccggaagcgtggaacgcag

SEQ ID NO: 410868 - DNA, 20 bp, mouse
gcgatcgtcgcgcggaaagc

SEQ ID NO: 410869 - DNA, 20 bp, mouse
ggaccctcggacagtactcc

SEQ ID NO: 410870 - DNA, 20 bp, mouse
gtgccgggagtactgtccga

SEQ ID NO: 410871 - DNA, 20 bp, mouse
gcggggaagcaggtgacctg

SEQ ID NO: 410872 - DNA, 20 bp, mouse
gcgcagaggccacgcgaaga

SEQ ID NO: 410873 - DNA, 20 bp, mouse
gagtactcccggcaatgcaa

SEQ ID NO: 410874 - DNA, 20 bp, mouse
ggagcagctggttgagcacc

SEQ ID NO: 410875 - DNA, 20 bp, mouse
gtgtccgagggtctggaatc

SEQ ID NO: 410876 - DNA, 20 bp, mouse
gcgggcacggatgtgtttct

SEQ ID NO: 410877 - DNA, 20 bp, mouse
gtaactttaactggcgttct

SEQ ID NO: 410878 - DNA, 20 bp, mouse
gctatagccttaactttaac

SEQ ID NO: 410879 - DNA, 20 bp, mouse
gggctggggtgtcctcaatg

SEQ ID NO: 410880 - DNA, 20 bp, mouse
gtgctgggccagcccaagac

SEQ ID NO: 410881 - DNA, 20 bp, mouse
gaattgtgtaagttcgggca

SEQ ID NO: 410882 - DNA, 20 bp, mouse
gcatccacactgcatcactt

SEQ ID NO: 410883 - DNA, 20 bp, mouse
gcacaggtaacctgttgagt

SEQ ID NO: 410884 - DNA, 20 bp, mouse
gacgtaaattgtgtaagttc

SEQ ID NO: 410885 - DNA, 20 bp, mouse
ggggatgggggcaagctcga

SEQ ID NO: 410886 - DNA, 20 bp, mouse
ggcttaggaggatattccaa

SEQ ID NO: 410887 - DNA, 20 bp, mouse
gagcagctccctgttctcct

SEQ ID NO: 410888 - DNA, 20 bp, mouse
gcacagcggggtacaatctg

SEQ ID NO: 410889 - DNA, 20 bp, mouse
gaagacagtctggatattct

SEQ ID NO: 410890 - DNA, 20 bp, mouse
gacggtaaacggcggaggga

SEQ ID NO: 410891 - DNA, 20 bp, mouse
gacagtctggatattctggg

SEQ ID NO: 410892 - DNA, 20 bp, mouse
gcaacgcctacggtaaacgg

SEQ ID NO: 410893 - DNA, 20 bp, mouse
gtactgagtgcgaacgagga

SEQ ID NO: 410894 - DNA, 20 bp, mouse
gaggagcgcctcaacgccta

SEQ ID NO: 410895 - DNA, 20 bp, mouse
gcctcaacgcctacggtaaa

SEQ ID NO: 410896 - DNA, 20 bp, mouse
gaaggggtcacagcatctag

SEQ ID NO: 410897 - DNA, 20 bp, mouse
gatactgagaggtcccccaa

SEQ ID NO: 410898 - DNA, 20 bp, mouse
ggagaggtcccccaaaggaa

SEQ ID NO: 410899 - DNA, 20 bp, mouse
gggaggtgtgggctatttag

SEQ ID NO: 410900 - DNA, 20 bp, mouse
gtgagggggaagatactgag

SEQ ID NO: 410901 - DNA, 20 bp, mouse
gcccacacctccggcctgga

SEQ ID NO: 410902 - DNA, 20 bp, mouse
ggcatctaggggcaccttcc

SEQ ID NO: 410903 - DNA, 20 bp, mouse
gatggaggtaggagccctgt

SEQ ID NO: 410904 - DNA, 20 bp, mouse
gtccagcaggagtccttgag

SEQ ID NO: 410905 - DNA, 20 bp, mouse
gacctacagtgactcctaca

SEQ ID NO: 410906 - DNA, 20 bp, mouse
gagccagtaagagtatctca

SEQ ID NO: 410907 - DNA, 20 bp, mouse
gtctaaggttcagaaagaat

SEQ ID NO: 410908 - DNA, 20 bp, mouse
ggcagtcctagaatcacaat

SEQ ID NO: 410909 - DNA, 20 bp, mouse
gaagaatggggttgagaatt

SEQ ID NO: 410910 - DNA, 20 bp, mouse
gtggctccaattgtgattct

SEQ ID NO: 410911 - DNA, 20 bp, mouse
gtctttctgaaccttagact

SEQ ID NO: 410912 - DNA, 20 bp, mouse
gtcatcttcatccgagtcta

SEQ ID NO: 410913 - DNA, 20 bp, mouse
gctccatgagatactcttac

SEQ ID NO: 410914 - DNA, 20 bp, mouse
gcattctatttctcttgaga

SEQ ID NO: 410915 - DNA, 20 bp, mouse
gtcttgagaaggaaagtcta

SEQ ID NO: 410916 - DNA, 20 bp, mouse
gactgctcgggagcttcgag

SEQ ID NO: 410917 - DNA, 20 bp, mouse
ggaggcgcacaaaggtgaag

SEQ ID NO: 410918 - DNA, 20 bp, mouse
gttcgagcggggaagtaaaa

SEQ ID NO: 410919 - DNA, 20 bp, mouse
gagcctttggaggcgcacaa

SEQ ID NO: 410920 - DNA, 20 bp, mouse
gcacctggagatatgttgag

SEQ ID NO: 410921 - DNA, 20 bp, mouse
gcgagtcctgcgtattccag

SEQ ID NO: 410922 - DNA, 20 bp, mouse
gaacatttggagctactgct

SEQ ID NO: 410923 - DNA, 20 bp, mouse
gcataactgtcactaactga

SEQ ID NO: 410924 - DNA, 20 bp, mouse
ggcatcaacagcttgttacc

SEQ ID NO: 410925 - DNA, 20 bp, mouse
ggtactcggacggcccaaca

SEQ ID NO: 410926 - DNA, 20 bp, mouse
gcaccatcgacagatgacca

SEQ ID NO: 410927 - DNA, 20 bp, mouse
gcagtgaaggatgggattgt

SEQ ID NO: 410928 - DNA, 20 bp, mouse
gtactacagcagtgaaggat

SEQ ID NO: 410929 - DNA, 20 bp, mouse
gaaccatggtcatctgtcga

SEQ ID NO: 410930 - DNA, 20 bp, mouse
gacccaactgccttttcaca

SEQ ID NO: 410931 - DNA, 20 bp, mouse
gttccctgtgaaaaggcagt

SEQ ID NO: 410932 - DNA, 20 bp, mouse
gggttgtgtctctcaaacca

SEQ ID NO: 410933 - DNA, 20 bp, mouse
gcatcttgctcctaagtcca

SEQ ID NO: 410934 - DNA, 20 bp, mouse
gaagcctggtccttggactt

SEQ ID NO: 410935 - DNA, 20 bp, mouse
ggaacttgaaaggtcaggtt

SEQ ID NO: 410936 - DNA, 20 bp, mouse
ggcctgcgctgggtctctct

SEQ ID NO: 410937 - DNA, 20 bp, mouse
ggggtcccgggagaagcgtg

SEQ ID NO: 410938 - DNA, 20 bp, mouse
gagaagagcgcggcgggcaa

SEQ ID NO: 410939 - DNA, 20 bp, mouse
gtgctcacttggccacgctg

SEQ ID NO: 410940 - DNA, 20 bp, mouse
gccgcggagatgaacagagc

SEQ ID NO: 410941 - DNA, 20 bp, mouse
gggccaagtgagcaccgctc

SEQ ID NO: 410942 - DNA, 20 bp, mouse
gcccgcgccccggctacctg

SEQ ID NO: 410943 - DNA, 20 bp, mouse
gctcgggccgcaggtagccg

SEQ ID NO: 410944 - DNA, 20 bp, mouse
gaacagagccggcctgcgct

SEQ ID NO: 410945 - DNA, 20 bp, mouse
gtgggtctctctgggcatct

SEQ ID NO: 410946 - DNA, 20 bp, mouse
gttcccaccgccctccagaa

SEQ ID NO: 410947 - DNA, 20 bp, mouse
gggtcagccggtgagtgaca

SEQ ID NO: 410948 - DNA, 20 bp, mouse
gacggcagaaaaaccggcag

SEQ ID NO: 410949 - DNA, 20 bp, mouse
gagagccccgtgtcactcac

SEQ ID NO: 410950 - DNA, 20 bp, mouse
ggggctctgagaacctctgc

SEQ ID NO: 410951 - DNA, 20 bp, mouse
ggaccgcaagagcccggaac

SEQ ID NO: 410952 - DNA, 20 bp, mouse
gtaaaggcgtgggctaccag

SEQ ID NO: 410953 - DNA, 20 bp, mouse
ggtttttctgccgttctgga

SEQ ID NO: 410954 - DNA, 20 bp, mouse
gtgccgttctggagggcggt

SEQ ID NO: 410955 - DNA, 20 bp, mouse
gagcccggaaccggaagcgc

SEQ ID NO: 410956 - DNA, 20 bp, mouse
gccgcccgcggcagacatgg

SEQ ID NO: 410957 - DNA, 20 bp, mouse
gcccccgcccgcggcagaca

SEQ ID NO: 410958 - DNA, 20 bp, mouse
ggaccgggagatgacttccg

SEQ ID NO: 410959 - DNA, 20 bp, mouse
gtctcccggtcccccgcccg

SEQ ID NO: 410960 - DNA, 20 bp, mouse
gatggcggtggactcgtcta

SEQ ID NO: 410961 - DNA, 20 bp, mouse
gacatccgagcgctgaggta

SEQ ID NO: 410962 - DNA, 20 bp, mouse
gcgagcccggtggccctggg

SEQ ID NO: 410963 - DNA, 20 bp, mouse
gcaggggtaccggaactgag

SEQ ID NO: 410964 - DNA, 20 bp, mouse
gtgccccggaagtcatctcc

SEQ ID NO: 410965 - DNA, 20 bp, mouse
gtggatagtccgtaccctga

SEQ ID NO: 410966 - DNA, 20 bp, mouse
gcggccgctccgactaatgg

SEQ ID NO: 410967 - DNA, 20 bp, mouse
gcggcggccgctccgactaa

SEQ ID NO: 410968 - DNA, 20 bp, mouse
gtgtggcgaggccctaggtg

SEQ ID NO: 410969 - DNA, 20 bp, mouse
gcacagggtctccccaccta

SEQ ID NO: 410970 - DNA, 20 bp, mouse
gctgcggagaggaggttccg

SEQ ID NO: 410971 - DNA, 20 bp, mouse
gccgccggaacccatcccgt

SEQ ID NO: 410972 - DNA, 20 bp, mouse
gtcaccgccattagtcggag

SEQ ID NO: 410973 - DNA, 20 bp, mouse
gtgcaggttgcactgaactg

SEQ ID NO: 410974 - DNA, 20 bp, mouse
gactaatggcggtgagctgt

SEQ ID NO: 410975 - DNA, 20 bp, mouse
ggttgcactgaactgcggag

SEQ ID NO: 410976 - DNA, 20 bp, mouse
gctggagcgtggaaactacc

SEQ ID NO: 410977 - DNA, 20 bp, mouse
gcagagacaggctgtaacct

SEQ ID NO: 410978 - DNA, 20 bp, mouse
ggactcagcatcctttgacc

SEQ ID NO: 410979 - DNA, 20 bp, mouse
gccggtagagctaggcgctc

SEQ ID NO: 410980 - DNA, 20 bp, mouse
ggtggaaactacccggtcaa

SEQ ID NO: 410981 - DNA, 20 bp, mouse
gggactacgagtatctgggt

SEQ ID NO: 410982 - DNA, 20 bp, mouse
gcaggctgtaacctgggttc

SEQ ID NO: 410983 - DNA, 20 bp, mouse
gcggccagaggagaactaga

SEQ ID NO: 410984 - DNA, 20 bp, mouse
ggacaggggcggagcctgaa

SEQ ID NO: 410985 - DNA, 20 bp, mouse
gagggcctgagcctgaatgt

SEQ ID NO: 410986 - DNA, 20 bp, mouse
gggctttgccgagacgtcgg

SEQ ID NO: 410987 - DNA, 20 bp, mouse
gtgaggctttgccgagacgt

SEQ ID NO: 410988 - DNA, 20 bp, mouse
ggcccactcacaaggtattg

SEQ ID NO: 410989 - DNA, 20 bp, mouse
gaccccaataccttgtgagt

SEQ ID NO: 410990 - DNA, 20 bp, mouse
gcagacaaaccacacagtac

SEQ ID NO: 410991 - DNA, 20 bp, mouse
gggaacttccgggtctggtg

SEQ ID NO: 410992 - DNA, 20 bp, mouse
gtgtctgaggaagggcacgt

SEQ ID NO: 410993 - DNA, 20 bp, mouse
gcaggcggaacttccgggtc

SEQ ID NO: 410994 - DNA, 20 bp, mouse
ggggtcgtccgccgacgtct

SEQ ID NO: 410995 - DNA, 20 bp, mouse
gtaggccgtgcggtacgcga

SEQ ID NO: 410996 - DNA, 20 bp, mouse
gtggagaagaggaatatgat

SEQ ID NO: 410997 - DNA, 20 bp, mouse
gcctcacagagtttaaacta

SEQ ID NO: 410998 - DNA, 20 bp, mouse
ggatgtgactatggtagcta

SEQ ID NO: 410999 - DNA, 20 bp, mouse
gactatggtagctatggcta

SEQ ID NO: 411000 - DNA, 20 bp, mouse
gtgcaaccaagttggagaag

SEQ ID NO: 411001 - DNA, 20 bp, mouse
gtttatttgaagcatataca

SEQ ID NO: 411002 - DNA, 20 bp, mouse
gacagagtttaaactaaggt

SEQ ID NO: 411003 - DNA, 20 bp, mouse
gttgaagcatatacatggaa

SEQ ID NO: 411004 - DNA, 20 bp, mouse
gatattcctcttctccaact

SEQ ID NO: 411005 - DNA, 20 bp, mouse
gttaggatcatctgaagaga

SEQ ID NO: 411006 - DNA, 20 bp, mouse
ggtcatccgtgaaacggaaa

SEQ ID NO: 411007 - DNA, 20 bp, mouse
ggcgcgtgcgcagacgctgt

SEQ ID NO: 411008 - DNA, 20 bp, mouse
ggctgtgggagccggcgcaa

SEQ ID NO: 411009 - DNA, 20 bp, mouse
gcgtgaaacggaaagggtcg

SEQ ID NO: 411010 - DNA, 20 bp, mouse
gtgcgcacgcgcaccaaggt

SEQ ID NO: 411011 - DNA, 20 bp, mouse
gcaactctcaggaccccggg

SEQ ID NO: 411012 - DNA, 20 bp, mouse
ggtcgtggagaccattgcgc

SEQ ID NO: 411013 - DNA, 20 bp, mouse
gtgggaggggcgctccacag

SEQ ID NO: 411014 - DNA, 20 bp, mouse
gacgaaagtcatccgtgaaa

SEQ ID NO: 411015 - DNA, 20 bp, mouse
gcacgcgcaccaaggtggga

SEQ ID NO: 411016 - DNA, 20 bp, mouse
ggtggcgccgagactggata

SEQ ID NO: 411017 - DNA, 20 bp, mouse
ggttctgactgccatcccag

SEQ ID NO: 411018 - DNA, 20 bp, mouse
gaatctcaagcactgtaaat

SEQ ID NO: 411019 - DNA, 20 bp, mouse
gaggcaacgtgactcggtcc

SEQ ID NO: 411020 - DNA, 20 bp, mouse
gactgcagccaagactaact

SEQ ID NO: 411021 - DNA, 20 bp, mouse
gggtcagcacatctcagtag

SEQ ID NO: 411022 - DNA, 20 bp, mouse
ggcgggggcgtgatccaggt

SEQ ID NO: 411023 - DNA, 20 bp, mouse
gtcagtagtggcgccgagac

SEQ ID NO: 411024 - DNA, 20 bp, mouse
gaacaggcaagggcctacct

SEQ ID NO: 411025 - DNA, 20 bp, mouse
gagagtgttcagaccaaggt

SEQ ID NO: 411026 - DNA, 20 bp, mouse
ggcactcggcagacttggca

SEQ ID NO: 411027 - DNA, 20 bp, mouse
gaaatagcactcggcagact

SEQ ID NO: 411028 - DNA, 20 bp, mouse
gggctctgcgggccgcacat

SEQ ID NO: 411029 - DNA, 20 bp, mouse
gagatagagggtctgactcg

SEQ ID NO: 411030 - DNA, 20 bp, mouse
gcaccgtagagaccaaggtg

SEQ ID NO: 411031 - DNA, 20 bp, mouse
ggggccgcacataggacact

SEQ ID NO: 411032 - DNA, 20 bp, mouse
ggggcccaccgtagagacca

SEQ ID NO: 411033 - DNA, 20 bp, mouse
gcaccgaggagccggaagtg

SEQ ID NO: 411034 - DNA, 20 bp, mouse
gagggacctgtcagttacgt

SEQ ID NO: 411035 - DNA, 20 bp, mouse
ggccgagtgctatttattgt

SEQ ID NO: 411036 - DNA, 20 bp, mouse
gcagcaccagccgagtagtc

SEQ ID NO: 411037 - DNA, 20 bp, mouse
gatcacttctccagactact

SEQ ID NO: 411038 - DNA, 20 bp, mouse
gcttctccagactactcggc

SEQ ID NO: 411039 - DNA, 20 bp, mouse
gaaagattactttcatgaga

SEQ ID NO: 411040 - DNA, 20 bp, mouse
ggctggtgctggtgttcagc

SEQ ID NO: 411041 - DNA, 20 bp, mouse
ggttattaatgtgtttacta

SEQ ID NO: 411042 - DNA, 20 bp, mouse
gcatggcttgtactgaaaat

SEQ ID NO: 411043 - DNA, 20 bp, mouse
gttactatggcaaggacaag

SEQ ID NO: 411044 - DNA, 20 bp, mouse
gattctattacagaagtcaa

SEQ ID NO: 411045 - DNA, 20 bp, mouse
ggtctctggggagttggcac

SEQ ID NO: 411046 - DNA, 20 bp, mouse
ggctggacgccgtggagcag

SEQ ID NO: 411047 - DNA, 20 bp, mouse
gtgccgctgccgctgctcca

SEQ ID NO: 411048 - DNA, 20 bp, mouse
gtgccgcagcatctcctcac

SEQ ID NO: 411049 - DNA, 20 bp, mouse
gcagcagctgctggacgccg

SEQ ID NO: 411050 - DNA, 20 bp, mouse
gctcaggagggcgtaggagg

SEQ ID NO: 411051 - DNA, 20 bp, mouse
gccccaccccgctccaaagg

SEQ ID NO: 411052 - DNA, 20 bp, mouse
gcgcagcatctcctcacagg

SEQ ID NO: 411053 - DNA, 20 bp, mouse
gatctcctcacaggcggcga

SEQ ID NO: 411054 - DNA, 20 bp, mouse
ggctgggcgcgttcatctcg

SEQ ID NO: 411055 - DNA, 20 bp, mouse
gcggcgcaggctggtcacgg

SEQ ID NO: 411056 - DNA, 20 bp, mouse
ggcggcagcgaaggaacccg

SEQ ID NO: 411057 - DNA, 20 bp, mouse
gagcgaaggaacccgaggac

SEQ ID NO: 411058 - DNA, 20 bp, mouse
gccgcggcgcagacggaggg

SEQ ID NO: 411059 - DNA, 20 bp, mouse
gaggcccgcggcgcagacgg

SEQ ID NO: 411060 - DNA, 20 bp, mouse
ggccggcgcagcccgtcctc

SEQ ID NO: 411061 - DNA, 20 bp, mouse
ggccaggaggcgagcagcga

SEQ ID NO: 411062 - DNA, 20 bp, mouse
gagcgcggcgacttcccgat

SEQ ID NO: 411063 - DNA, 20 bp, mouse
ggttgtggagacagccgatc

SEQ ID NO: 411064 - DNA, 20 bp, mouse
ggggctgcgccggccgagcg

SEQ ID NO: 411065 - DNA, 20 bp, mouse
gcccacggcgccgaggcccg

SEQ ID NO: 411066 - DNA, 20 bp, mouse
gcctgctagggtgtaaagaa

SEQ ID NO: 411067 - DNA, 20 bp, mouse
gctttccccaggcggagctg

SEQ ID NO: 411068 - DNA, 20 bp, mouse
ggtgaactgatatcctgcta

SEQ ID NO: 411069 - DNA, 20 bp, mouse
gtaaagaaaggcaagtgtcc

SEQ ID NO: 411070 - DNA, 20 bp, mouse
gatagcgcgtggctttcccc

SEQ ID NO: 411071 - DNA, 20 bp, mouse
gtagtaccttaaagatgaat

SEQ ID NO: 411072 - DNA, 20 bp, mouse
ggcgcgtggctttccccagg

SEQ ID NO: 411073 - DNA, 20 bp, mouse
gaccttaaagatgaatcggc

SEQ ID NO: 411074 - DNA, 20 bp, mouse
ggaggtttcagaatagcgcg

SEQ ID NO: 411075 - DNA, 20 bp, mouse
gcgatgagttgagggtttgg

SEQ ID NO: 411076 - DNA, 20 bp, mouse
gggcggccgtgagggacacc

SEQ ID NO: 411077 - DNA, 20 bp, mouse
gggccgggccatgacccccg

SEQ ID NO: 411078 - DNA, 20 bp, mouse
gcccagcgcgccccaggaag

SEQ ID NO: 411079 - DNA, 20 bp, mouse
ggcgacgcgcttgcagccgt

SEQ ID NO: 411080 - DNA, 20 bp, mouse
gcgaggtggggaatccgaga

SEQ ID NO: 411081 - DNA, 20 bp, mouse
gacccaggacgagggacccc

SEQ ID NO: 411082 - DNA, 20 bp, mouse
gccatgacccccgcggccca

SEQ ID NO: 411083 - DNA, 20 bp, mouse
gcgtggagatctgggaccaa

SEQ ID NO: 411084 - DNA, 20 bp, mouse
gttgcagccgtgggccgcgg

SEQ ID NO: 411085 - DNA, 20 bp, mouse
gcgacctgggatagggaccc

SEQ ID NO: 411086 - DNA, 20 bp, mouse
gctcgtgcgcgcatagtcgt

SEQ ID NO: 411087 - DNA, 20 bp, mouse
gtgagtcgcaacaccacctc

SEQ ID NO: 411088 - DNA, 20 bp, mouse
ggttgcgggggcacccgagg

SEQ ID NO: 411089 - DNA, 20 bp, mouse
ggaagttgcgggggcacccg

SEQ ID NO: 411090 - DNA, 20 bp, mouse
ggcggaggcaatactcgcgc

SEQ ID NO: 411091 - DNA, 20 bp, mouse
ggtcgcgggggaggaagttg

SEQ ID NO: 411092 - DNA, 20 bp, mouse
gtgagtgttaagagcgagct

SEQ ID NO: 411093 - DNA, 20 bp, mouse
gagctaggtatccaaacact

SEQ ID NO: 411094 - DNA, 20 bp, mouse
gattgtttctgacggacttg

SEQ ID NO: 411095 - DNA, 20 bp, mouse
gcgcactcgattgtttctga

SEQ ID NO: 411096 - DNA, 20 bp, mouse
gggccggctggcagctatgg

SEQ ID NO: 411097 - DNA, 20 bp, mouse
gggcctgcgagtgtctgtga

SEQ ID NO: 411098 - DNA, 20 bp, mouse
gcccaaagccggcccagcgg

SEQ ID NO: 411099 - DNA, 20 bp, mouse
gcagctatggcggccgtccg

SEQ ID NO: 411100 - DNA, 20 bp, mouse
gtgcggccggctggcagcta

SEQ ID NO: 411101 - DNA, 20 bp, mouse
ggacactcgcaggccgcgga

SEQ ID NO: 411102 - DNA, 20 bp, mouse
gcgagtgtctgtgaaggcgg

SEQ ID NO: 411103 - DNA, 20 bp, mouse
gctctaggcggcgggagtga

SEQ ID NO: 411104 - DNA, 20 bp, mouse
gtcggcgacggcgctctagg

SEQ ID NO: 411105 - DNA, 20 bp, mouse
gctcccggtacgggcgagag

SEQ ID NO: 411106 - DNA, 20 bp, mouse
gtgtggatgctgcggtcctg

SEQ ID NO: 411107 - DNA, 20 bp, mouse
gaccgtggctctgactgaca

SEQ ID NO: 411108 - DNA, 20 bp, mouse
gcaggcaggcggacatgaaa

SEQ ID NO: 411109 - DNA, 20 bp, mouse
gctggggctgctccgttcct

SEQ ID NO: 411110 - DNA, 20 bp, mouse
gtaaacaagcttccgaggaa

SEQ ID NO: 411111 - DNA, 20 bp, mouse
gcgcggtactgtggatgctg

SEQ ID NO: 411112 - DNA, 20 bp, mouse
gagtcagagccacggtgagt

SEQ ID NO: 411113 - DNA, 20 bp, mouse
gacgactgtgcgcggtactg

SEQ ID NO: 411114 - DNA, 20 bp, mouse
gctcggaagcttgtttatga

SEQ ID NO: 411115 - DNA, 20 bp, mouse
gtccgtgtcagtcagagcca

SEQ ID NO: 411116 - DNA, 20 bp, mouse
gagggtccccaagcatagaa

SEQ ID NO: 411117 - DNA, 20 bp, mouse
ggtaaagtgcacctaggctg

SEQ ID NO: 411118 - DNA, 20 bp, mouse
gttctgggtaaagtgcacct

SEQ ID NO: 411119 - DNA, 20 bp, mouse
gctctcagcacactcaccta

SEQ ID NO: 411120 - DNA, 20 bp, mouse
gactatgaccgcctcagtga

SEQ ID NO: 411121 - DNA, 20 bp, mouse
ggcagcctcattttcaactg

SEQ ID NO: 411122 - DNA, 20 bp, mouse
gtagagaagagtaatcactt

SEQ ID NO: 411123 - DNA, 20 bp, mouse
gcctggtattaaggaggatg

SEQ ID NO: 411124 - DNA, 20 bp, mouse
ggagggcaaaggacagccgg

SEQ ID NO: 411125 - DNA, 20 bp, mouse
gtcagtcaacactgccttct

SEQ ID NO: 411126 - DNA, 20 bp, mouse
gggcagggagaccggagcca

SEQ ID NO: 411127 - DNA, 20 bp, mouse
ggccaaggcccagtccagcg

SEQ ID NO: 411128 - DNA, 20 bp, mouse
gagccaaggctgatgacatg

SEQ ID NO: 411129 - DNA, 20 bp, mouse
gtgtggagccgaggccggag

SEQ ID NO: 411130 - DNA, 20 bp, mouse
gcccagtccagcgcggcact

SEQ ID NO: 411131 - DNA, 20 bp, mouse
gtccagcgcggcactgggca

SEQ ID NO: 411132 - DNA, 20 bp, mouse
ggaggggcctggaaagtcag

SEQ ID NO: 411133 - DNA, 20 bp, mouse
ggaaagtgccatcagaggag

SEQ ID NO: 411134 - DNA, 20 bp, mouse
gggcaggagggtaggcgata

SEQ ID NO: 411135 - DNA, 20 bp, mouse
gtgactacatgagcagaggt

SEQ ID NO: 411136 - DNA, 20 bp, mouse
gatagtaaggagaggtacca

SEQ ID NO: 411137 - DNA, 20 bp, mouse
gagaggtagcagtcttgggt

SEQ ID NO: 411138 - DNA, 20 bp, mouse
ggccaagaggtagcagtctt

SEQ ID NO: 411139 - DNA, 20 bp, mouse
gtacctcttggcccactcag

SEQ ID NO: 411140 - DNA, 20 bp, mouse
gggtctttgatagtaaggag

SEQ ID NO: 411141 - DNA, 20 bp, mouse
gtggggggccgcagagagaa

SEQ ID NO: 411142 - DNA, 20 bp, mouse
ggacaggccactgctcccac

SEQ ID NO: 411143 - DNA, 20 bp, mouse
gagaagggtctttgatagta

SEQ ID NO: 411144 - DNA, 20 bp, mouse
ggacaagctccatctcccgt

SEQ ID NO: 411145 - DNA, 20 bp, mouse
gggctaacaccgagccgctc

SEQ ID NO: 411146 - DNA, 20 bp, mouse
gccagagcgcggcttccctg

SEQ ID NO: 411147 - DNA, 20 bp, mouse
gtccctgcgggtggcgcgat

SEQ ID NO: 411148 - DNA, 20 bp, mouse
gccgcgcgccgcctccttct

SEQ ID NO: 411149 - DNA, 20 bp, mouse
gcgtgaccgcccccgcacag

SEQ ID NO: 411150 - DNA, 20 bp, mouse
gatgggttgcgggaactcca

SEQ ID NO: 411151 - DNA, 20 bp, mouse
gacccatcgcgccacccgca

SEQ ID NO: 411152 - DNA, 20 bp, mouse
gtgcttctggaaagaccgag

SEQ ID NO: 411153 - DNA, 20 bp, mouse
ggtaggtccctcgggagagg

SEQ ID NO: 411154 - DNA, 20 bp, mouse
gagcgcggcttccctgcggg

SEQ ID NO: 411155 - DNA, 20 bp, mouse
gcggtcacgcccggattcag

SEQ ID NO: 411156 - DNA, 20 bp, mouse
gttgctccggcggcaccccc

SEQ ID NO: 411157 - DNA, 20 bp, mouse
ggcctccgcaacaccgcgta

SEQ ID NO: 411158 - DNA, 20 bp, mouse
ggccctacgcggtgttgcgg

SEQ ID NO: 411159 - DNA, 20 bp, mouse
ggagcaaagccagccctacg

SEQ ID NO: 411160 - DNA, 20 bp, mouse
gggcgtggggagcttgtgcg

SEQ ID NO: 411161 - DNA, 20 bp, mouse
gccccgcgctccgtgcagtg

SEQ ID NO: 411162 - DNA, 20 bp, mouse
gcggcggcacccccgggctc

SEQ ID NO: 411163 - DNA, 20 bp, mouse
gtacccatattcataggtgt

SEQ ID NO: 411164 - DNA, 20 bp, mouse
gcggcctagcctctggttgt

SEQ ID NO: 411165 - DNA, 20 bp, mouse
gcgcaggccggcctagcctc

SEQ ID NO: 411166 - DNA, 20 bp, mouse
gcggagggacgagacatatc

SEQ ID NO: 411167 - DNA, 20 bp, mouse
gtctgcaagttaaccccgga

SEQ ID NO: 411168 - DNA, 20 bp, mouse
gtaggagccgccggaacgaa

SEQ ID NO: 411169 - DNA, 20 bp, mouse
gaacgaaaggacgagagcgg

SEQ ID NO: 411170 - DNA, 20 bp, mouse
gagaagaccagggtcctcga

SEQ ID NO: 411171 - DNA, 20 bp, mouse
gaccatctgcaagttaaccc

SEQ ID NO: 411172 - DNA, 20 bp, mouse
ggcctcagcgcccgcggtag

SEQ ID NO: 411173 - DNA, 20 bp, mouse
gcgccgccaaggtctatata

SEQ ID NO: 411174 - DNA, 20 bp, mouse
gagggagagaagggcatcga

SEQ ID NO: 411175 - DNA, 20 bp, mouse
ggcccagtgagcacggggag

SEQ ID NO: 411176 - DNA, 20 bp, mouse
gagcagagccagcccggcaa

SEQ ID NO: 411177 - DNA, 20 bp, mouse
gcgcgcagacgaggtgctca

SEQ ID NO: 411178 - DNA, 20 bp, mouse
gactgcaggccgcgcagacg

SEQ ID NO: 411179 - DNA, 20 bp, mouse
gagtgctgcaaagtagctgg

SEQ ID NO: 411180 - DNA, 20 bp, mouse
gcggcaagggccaggactgc

SEQ ID NO: 411181 - DNA, 20 bp, mouse
ggtaagtggaggatacctgg

SEQ ID NO: 411182 - DNA, 20 bp, mouse
gagccagcccggcaagggcc

SEQ ID NO: 411183 - DNA, 20 bp, mouse
gtgaagggagtatcattctg

SEQ ID NO: 411184 - DNA, 20 bp, mouse
ggctctgggcgggacccaca

SEQ ID NO: 411185 - DNA, 20 bp, mouse
ggatttgcagcagacccgca

SEQ ID NO: 411186 - DNA, 20 bp, mouse
gccaggaacccccaagaaca

SEQ ID NO: 411187 - DNA, 20 bp, mouse
gctgtgactgggaaccggag

SEQ ID NO: 411188 - DNA, 20 bp, mouse
gggagcggccctgttcttgg

SEQ ID NO: 411189 - DNA, 20 bp, mouse
ggacagaaatgcagccctgg

SEQ ID NO: 411190 - DNA, 20 bp, mouse
gtcatggcgtgcagtgccat

SEQ ID NO: 411191 - DNA, 20 bp, mouse
gcagggccgctccatcctcc

SEQ ID NO: 411192 - DNA, 20 bp, mouse
ggctcttagacaataggcag

SEQ ID NO: 411193 - DNA, 20 bp, mouse
gcctgacagaaatgcagccc

SEQ ID NO: 411194 - DNA, 20 bp, mouse
gggcgtgcagtgccatgggc

SEQ ID NO: 411195 - DNA, 20 bp, mouse
ggggtgccaagctcaatcac

SEQ ID NO: 411196 - DNA, 20 bp, mouse
gcggaaggcgcgggactcct

SEQ ID NO: 411197 - DNA, 20 bp, mouse
gagcgcagtctgcgggtagt

SEQ ID NO: 411198 - DNA, 20 bp, mouse
gcaccggtgagcgcagtctg

SEQ ID NO: 411199 - DNA, 20 bp, mouse
gtccgttgcacgagacccac

SEQ ID NO: 411200 - DNA, 20 bp, mouse
ggcgcgggactccttggcgg

SEQ ID NO: 411201 - DNA, 20 bp, mouse
gcgatcggcgcaggagtcca

SEQ ID NO: 411202 - DNA, 20 bp, mouse
gctcctgcgccgatcggcag

SEQ ID NO: 411203 - DNA, 20 bp, mouse
gtcggcagcggcagttggag

SEQ ID NO: 411204 - DNA, 20 bp, mouse
gtggcggcggcaaaaatgct

SEQ ID NO: 411205 - DNA, 20 bp, mouse
gtagcctacccggaagtggg

SEQ ID NO: 411206 - DNA, 20 bp, mouse
gaccagggttgctacaccag

SEQ ID NO: 411207 - DNA, 20 bp, mouse
gtgccatgccggagctgagg

SEQ ID NO: 411208 - DNA, 20 bp, mouse
gtcctctggtgtagcaaccc

SEQ ID NO: 411209 - DNA, 20 bp, mouse
gtgcacttccgcctcagctc

SEQ ID NO: 411210 - DNA, 20 bp, mouse
gttccgcctcagctccggca

SEQ ID NO: 411211 - DNA, 20 bp, mouse
gcagcatctagtgagtcagg

SEQ ID NO: 411212 - DNA, 20 bp, mouse
gggagttttcagcggaacca

SEQ ID NO: 411213 - DNA, 20 bp, mouse
ggcacctaaaagcccggatg

SEQ ID NO: 411214 - DNA, 20 bp, mouse
ggttataaggtgggcccggc

SEQ ID NO: 411215 - DNA, 20 bp, mouse
gagcatgcgtagtgccatgc

SEQ ID NO: 411216 - DNA, 20 bp, mouse
gcgcagcacccgcagcaccc

SEQ ID NO: 411217 - DNA, 20 bp, mouse
ggccagctggggcgagttcc

SEQ ID NO: 411218 - DNA, 20 bp, mouse
ggccccagctggcggaaaag

SEQ ID NO: 411219 - DNA, 20 bp, mouse
gagagaagggataaagagta

SEQ ID NO: 411220 - DNA, 20 bp, mouse
ggcctcttttccgccagctg

SEQ ID NO: 411221 - DNA, 20 bp, mouse
ggaggccgcgcccggaagtg

SEQ ID NO: 411222 - DNA, 20 bp, mouse
ggtcccgggaaccgacggtg

SEQ ID NO: 411223 - DNA, 20 bp, mouse
gcagggagtagccatcgctg

SEQ ID NO: 411224 - DNA, 20 bp, mouse
gcctgggtcccgggaaccga

SEQ ID NO: 411225 - DNA, 20 bp, mouse
ggcctggaactcgccccagc

SEQ ID NO: 411226 - DNA, 20 bp, mouse
gaagcaggtgctaggtgtct

SEQ ID NO: 411227 - DNA, 20 bp, mouse
ggtgggctatagagacacag

SEQ ID NO: 411228 - DNA, 20 bp, mouse
ggcttcctcaaggctcaggt

SEQ ID NO: 411229 - DNA, 20 bp, mouse
gaggtgctaggtgtctaggc

SEQ ID NO: 411230 - DNA, 20 bp, mouse
gtcacagctagtgggcctct

SEQ ID NO: 411231 - DNA, 20 bp, mouse
gggcaggcctcacagctagt

SEQ ID NO: 411232 - DNA, 20 bp, mouse
gggtatcctcctctgctggc

SEQ ID NO: 411233 - DNA, 20 bp, mouse
gatagcccacctgagccttg

SEQ ID NO: 411234 - DNA, 20 bp, mouse
gttgcaagcccggctacctg

SEQ ID NO: 411235 - DNA, 20 bp, mouse
gttcatgaccccaggtagcc

SEQ ID NO: 411236 - DNA, 20 bp, mouse
gctttaccgagctggagtct

SEQ ID NO: 411237 - DNA, 20 bp, mouse
gtgctctgccagctccagag

SEQ ID NO: 411238 - DNA, 20 bp, mouse
gacaccgtagggtccccgac

SEQ ID NO: 411239 - DNA, 20 bp, mouse
gaagccggtcggggacccta

SEQ ID NO: 411240 - DNA, 20 bp, mouse
gtggcctgtgaacgcctctc

SEQ ID NO: 411241 - DNA, 20 bp, mouse
gccagagagggaggaaatct

SEQ ID NO: 411242 - DNA, 20 bp, mouse
gtaagctgcagcgccgaggt

SEQ ID NO: 411243 - DNA, 20 bp, mouse
gcgaccggcttcgcagaccc

SEQ ID NO: 411244 - DNA, 20 bp, mouse
gctcccaagcatccaggttg

SEQ ID NO: 411245 - DNA, 20 bp, mouse
gcactgggcctgacaccgta

SEQ ID NO: 411246 - DNA, 20 bp, mouse
gactcccagtgggtagactg

SEQ ID NO: 411247 - DNA, 20 bp, mouse
gctgggagtcccggaaaggg

SEQ ID NO: 411248 - DNA, 20 bp, mouse
gccccagtgggtccaagtga

SEQ ID NO: 411249 - DNA, 20 bp, mouse
ggtccaagcctgccaggcct

SEQ ID NO: 411250 - DNA, 20 bp, mouse
gtgtagcagggaggtacgtg

SEQ ID NO: 411251 - DNA, 20 bp, mouse
gggttagagccagctcacct

SEQ ID NO: 411252 - DNA, 20 bp, mouse
gtctgtagatgggtcgaact

SEQ ID NO: 411253 - DNA, 20 bp, mouse
gccactgggagtcccggaaa

SEQ ID NO: 411254 - DNA, 20 bp, mouse
ggtctacccactgggagtcc

SEQ ID NO: 411255 - DNA, 20 bp, mouse
gcagggaggtacgtgaggct

SEQ ID NO: 411256 - DNA, 20 bp, mouse
gactgcagaactacacagga

SEQ ID NO: 411257 - DNA, 20 bp, mouse
ggtggactgcagaactacac

SEQ ID NO: 411258 - DNA, 20 bp, mouse
gggtgcacatggaatgtgaa

SEQ ID NO: 411259 - DNA, 20 bp, mouse
gctcagtgagtagtctacgc

SEQ ID NO: 411260 - DNA, 20 bp, mouse
gaagcagaatgaggtgcaca

SEQ ID NO: 411261 - DNA, 20 bp, mouse
ggctcggccagagcaggtaa

SEQ ID NO: 411262 - DNA, 20 bp, mouse
ggagaggggtctacccggga

SEQ ID NO: 411263 - DNA, 20 bp, mouse
gaggagggctcggccagagc

SEQ ID NO: 411264 - DNA, 20 bp, mouse
gaatgtgaagggtgagcgag

SEQ ID NO: 411265 - DNA, 20 bp, mouse
gagaactacacaggagggct

SEQ ID NO: 411266 - DNA, 20 bp, mouse
ggacttcagctgacttcact

SEQ ID NO: 411267 - DNA, 20 bp, mouse
gcaagacctacacagtgctg

SEQ ID NO: 411268 - DNA, 20 bp, mouse
gggaaacagacaaggctgaa

SEQ ID NO: 411269 - DNA, 20 bp, mouse
gcacaaaagagcctgacact

SEQ ID NO: 411270 - DNA, 20 bp, mouse
gcattgcagaccgccccagg

SEQ ID NO: 411271 - DNA, 20 bp, mouse
gagttacccagcccagtgtc

SEQ ID NO: 411272 - DNA, 20 bp, mouse
gtcaggtctgcgaatacccg

SEQ ID NO: 411273 - DNA, 20 bp, mouse
gcagacaaggctgaagggca

SEQ ID NO: 411274 - DNA, 20 bp, mouse
ggaaatgctgctgcccgata

SEQ ID NO: 411275 - DNA, 20 bp, mouse
ggggcagcagcatttctatg

SEQ ID NO: 411276 - DNA, 20 bp, mouse
gccttccctaggccttctgt

SEQ ID NO: 411277 - DNA, 20 bp, mouse
gtaaacccacagaaggccta

SEQ ID NO: 411278 - DNA, 20 bp, mouse
gtttaggcctcaggtgagtt

SEQ ID NO: 411279 - DNA, 20 bp, mouse
gggtgagttcctgggctgag

SEQ ID NO: 411280 - DNA, 20 bp, mouse
gccaggtgtgggaacctcac

SEQ ID NO: 411281 - DNA, 20 bp, mouse
gtgactactcaataggacat

SEQ ID NO: 411282 - DNA, 20 bp, mouse
gccctacttaaactcaggct

SEQ ID NO: 411283 - DNA, 20 bp, mouse
ggacagcaggtcactttcct

SEQ ID NO: 411284 - DNA, 20 bp, mouse
gggacatgagtaggagtttc

SEQ ID NO: 411285 - DNA, 20 bp, mouse
gtctttctgaggaggcttac

SEQ ID NO: 411286 - DNA, 20 bp, mouse
ggcctggcagtagtaagact

SEQ ID NO: 411287 - DNA, 20 bp, mouse
gaaggagcggagcgacagca

SEQ ID NO: 411288 - DNA, 20 bp, mouse
gagtcccaggtgtggaagca

SEQ ID NO: 411289 - DNA, 20 bp, mouse
gagctccaccgagaacaaag

SEQ ID NO: 411290 - DNA, 20 bp, mouse
gcggagcgacagcatggtcc

SEQ ID NO: 411291 - DNA, 20 bp, mouse
gacgcaggacccattatcac

SEQ ID NO: 411292 - DNA, 20 bp, mouse
gtagtaagactaggtgtgac

SEQ ID NO: 411293 - DNA, 20 bp, mouse
gttatcactggcagagaggg

SEQ ID NO: 411294 - DNA, 20 bp, mouse
gacctatacaggtatgtcaa

SEQ ID NO: 411295 - DNA, 20 bp, mouse
gccccaggcagatcacaccc

SEQ ID NO: 411296 - DNA, 20 bp, mouse
gagcacagaggcatttagag

SEQ ID NO: 411297 - DNA, 20 bp, mouse
gccagtctccgggctcagta

SEQ ID NO: 411298 - DNA, 20 bp, mouse
gcctagctcgaccaggatta

SEQ ID NO: 411299 - DNA, 20 bp, mouse
ggtcctaacctagctcgacc

SEQ ID NO: 411300 - DNA, 20 bp, mouse
gatcctggtcgagctaggtt

SEQ ID NO: 411301 - DNA, 20 bp, mouse
gagtgggactatccacccgc

SEQ ID NO: 411302 - DNA, 20 bp, mouse
gttgataagaaccctaatcc

SEQ ID NO: 411303 - DNA, 20 bp, mouse
gggagttgtagtctctctct

SEQ ID NO: 411304 - DNA, 20 bp, mouse
ggactctgtttaacacccct

SEQ ID NO: 411305 - DNA, 20 bp, mouse
gagtcccacttcacagccta

SEQ ID NO: 411306 - DNA, 20 bp, mouse
gcgctacggaaggccatggt

SEQ ID NO: 411307 - DNA, 20 bp, mouse
gcccgcgctacggaaggcca

SEQ ID NO: 411308 - DNA, 20 bp, mouse
gggtgctgcgagccccggcg

SEQ ID NO: 411309 - DNA, 20 bp, mouse
gcattagtgtgcccgcgcta

SEQ ID NO: 411310 - DNA, 20 bp, mouse
gtggtgggtgctgcgagccc

SEQ ID NO: 411311 - DNA, 20 bp, mouse
gagtgtgcccgcgctacgga

SEQ ID NO: 411312 - DNA, 20 bp, mouse
gagcccccagatccagaggg

SEQ ID NO: 411313 - DNA, 20 bp, mouse
gatgagagctgggggcacga

SEQ ID NO: 411314 - DNA, 20 bp, mouse
gcagctggctgtttaccgca

SEQ ID NO: 411315 - DNA, 20 bp, mouse
gggtgcctagcagcttaccc

SEQ ID NO: 411316 - DNA, 20 bp, mouse
ggtgccctcccaagacaccc

SEQ ID NO: 411317 - DNA, 20 bp, mouse
gggtgaaatgggacttctgg

SEQ ID NO: 411318 - DNA, 20 bp, mouse
ggcaccggggtgtcttggga

SEQ ID NO: 411319 - DNA, 20 bp, mouse
gtagaaatccagaggcaccg

SEQ ID NO: 411320 - DNA, 20 bp, mouse
gctttcaacatctttgacta

SEQ ID NO: 411321 - DNA, 20 bp, mouse
gagctggggcttgaattaca

SEQ ID NO: 411322 - DNA, 20 bp, mouse
ggaacacaggtggcctggaa

SEQ ID NO: 411323 - DNA, 20 bp, mouse
gctgtgttctgtgggggtca

SEQ ID NO: 411324 - DNA, 20 bp, mouse
ggctctgctgtgttctgtgg

SEQ ID NO: 411325 - DNA, 20 bp, mouse
gccaagtctaaaggtacctg

SEQ ID NO: 411326 - DNA, 20 bp, mouse
ggtggcgcggtagcgactga

SEQ ID NO: 411327 - DNA, 20 bp, mouse
gtcgctaccgcgccacaccg

SEQ ID NO: 411328 - DNA, 20 bp, mouse
gccagcatcaaaaagtcggt

SEQ ID NO: 411329 - DNA, 20 bp, mouse
gcgcgcagagagggcacctg

SEQ ID NO: 411330 - DNA, 20 bp, mouse
gcagcacttgtgggaggttg

SEQ ID NO: 411331 - DNA, 20 bp, mouse
gactgaaggtagtgcgcgtc

SEQ ID NO: 411332 - DNA, 20 bp, mouse
ggcctaagcccagcacttgt

SEQ ID NO: 411333 - DNA, 20 bp, mouse
gaaaaccagcatcaaaaagt

SEQ ID NO: 411334 - DNA, 20 bp, mouse
gacctcctggaatgacagag

SEQ ID NO: 411335 - DNA, 20 bp, mouse
gtaccgcgccacaccgcggt

SEQ ID NO: 411336 - DNA, 20 bp, mouse
gcagacaagtaagtcgggta

SEQ ID NO: 411337 - DNA, 20 bp, mouse
gatgcctgaagtgtgacaga

SEQ ID NO: 411338 - DNA, 20 bp, mouse
gtataacagcccagaatacg

SEQ ID NO: 411339 - DNA, 20 bp, mouse
gggcgcctgggcatacagtc

SEQ ID NO: 411340 - DNA, 20 bp, mouse
gaggcaggaggagctaaatg

SEQ ID NO: 411341 - DNA, 20 bp, mouse
gggagccagactgtatgccc

SEQ ID NO: 411342 - DNA, 20 bp, mouse
ggctgttatagttgaatcgg

SEQ ID NO: 411343 - DNA, 20 bp, mouse
gtgggctgttatagttgaat

SEQ ID NO: 411344 - DNA, 20 bp, mouse
gagttgaatcgggggcgcct

SEQ ID NO: 411345 - DNA, 20 bp, mouse
gcattatgctgaacagcagc

SEQ ID NO: 411346 - DNA, 20 bp, mouse
gccaggaggtaagtctagaa

SEQ ID NO: 411347 - DNA, 20 bp, mouse
ggtctcacaagtgattccct

SEQ ID NO: 411348 - DNA, 20 bp, mouse
gaatgaacatgctacccagg

SEQ ID NO: 411349 - DNA, 20 bp, mouse
gaggcagctagagcaatcct

SEQ ID NO: 411350 - DNA, 20 bp, mouse
gatcacttgtgagacaagaa

SEQ ID NO: 411351 - DNA, 20 bp, mouse
gcctaacagtagctggagag

SEQ ID NO: 411352 - DNA, 20 bp, mouse
gattctgtccccaagaaagt

SEQ ID NO: 411353 - DNA, 20 bp, mouse
gaagtcggctcaaatttagg

SEQ ID NO: 411354 - DNA, 20 bp, mouse
gtaaggtccctgataagagg

SEQ ID NO: 411355 - DNA, 20 bp, mouse
gacttgtaaaggacaggata

SEQ ID NO: 411356 - DNA, 20 bp, mouse
gccagttcctccatcaggtt

SEQ ID NO: 411357 - DNA, 20 bp, mouse
gaagccacctaacctgatgg

SEQ ID NO: 411358 - DNA, 20 bp, mouse
gggagggcgatggaccccgg

SEQ ID NO: 411359 - DNA, 20 bp, mouse
gagcggagggcgatggaccc

SEQ ID NO: 411360 - DNA, 20 bp, mouse
ggccgtaagggacctgacaa

SEQ ID NO: 411361 - DNA, 20 bp, mouse
gggaactggccaagaaagag

SEQ ID NO: 411362 - DNA, 20 bp, mouse
gaagctggtagtgctgagat

SEQ ID NO: 411363 - DNA, 20 bp, mouse
gccgagtgcagacgcttgga

SEQ ID NO: 411364 - DNA, 20 bp, mouse
gactggccaagaaagagcgg

SEQ ID NO: 411365 - DNA, 20 bp, mouse
ggagctgtccagactatgat

SEQ ID NO: 411366 - DNA, 20 bp, mouse
ggggcagcagaagccgactc

SEQ ID NO: 411367 - DNA, 20 bp, mouse
ggccgggacacagcaggcta

SEQ ID NO: 411368 - DNA, 20 bp, mouse
gagtccatagcgccgggaag

SEQ ID NO: 411369 - DNA, 20 bp, mouse
ggctagggtcctgccggagt

SEQ ID NO: 411370 - DNA, 20 bp, mouse
gcagcaggctagggtcctgc

SEQ ID NO: 411371 - DNA, 20 bp, mouse
gcccggcgcaaaggcggtga

SEQ ID NO: 411372 - DNA, 20 bp, mouse
gagcagaagccgactccggc

SEQ ID NO: 411373 - DNA, 20 bp, mouse
gcggcagccgcttaacaggg

SEQ ID NO: 411374 - DNA, 20 bp, mouse
gctgtgtcccggcgcaaagg

SEQ ID NO: 411375 - DNA, 20 bp, mouse
ggcccaagggatatcccgac

SEQ ID NO: 411376 - DNA, 20 bp, mouse
gtcagactcgaagactgcgg

SEQ ID NO: 411377 - DNA, 20 bp, mouse
gaagactgcggtggttagga

SEQ ID NO: 411378 - DNA, 20 bp, mouse
gctctcagactcgaagactg

SEQ ID NO: 411379 - DNA, 20 bp, mouse
gttgttgttacaacagtcct

SEQ ID NO: 411380 - DNA, 20 bp, mouse
gcgcagggtgcgggcctcag

SEQ ID NO: 411381 - DNA, 20 bp, mouse
gtcagtgaagtccccatcta

SEQ ID NO: 411382 - DNA, 20 bp, mouse
gtgcggaaaactgatcaggt

SEQ ID NO: 411383 - DNA, 20 bp, mouse
ggaagtaccgacgactgtgg

SEQ ID NO: 411384 - DNA, 20 bp, mouse
gctttctggagccttagatg

SEQ ID NO: 411385 - DNA, 20 bp, mouse
gccggaagtaccgacgactg

SEQ ID NO: 411386 - DNA, 20 bp, mouse
gcaacgatggagggtcctga

SEQ ID NO: 411387 - DNA, 20 bp, mouse
gtgcagtggccgcgacccaa

SEQ ID NO: 411388 - DNA, 20 bp, mouse
gggttgccgaggagaccgtt

SEQ ID NO: 411389 - DNA, 20 bp, mouse
ggccactgcagctacaacga

SEQ ID NO: 411390 - DNA, 20 bp, mouse
gctgcagctacaacgatgga

SEQ ID NO: 411391 - DNA, 20 bp, mouse
gccctcagggaccgaggtac

SEQ ID NO: 411392 - DNA, 20 bp, mouse
gccctgagggaaagggtcaa

SEQ ID NO: 411393 - DNA, 20 bp, mouse
ggtgttggtgggtaaaccag

SEQ ID NO: 411394 - DNA, 20 bp, mouse
gaacggctggaccaggccaa

SEQ ID NO: 411395 - DNA, 20 bp, mouse
gcgcgacccaacggtctcct

SEQ ID NO: 411396 - DNA, 20 bp, mouse
gggcagggccgaggcagcat

SEQ ID NO: 411397 - DNA, 20 bp, mouse
gctgtgaccagtcctatcat

SEQ ID NO: 411398 - DNA, 20 bp, mouse
gataggactggtcacaggac

SEQ ID NO: 411399 - DNA, 20 bp, mouse
gggtgctttggtcctcttgt

SEQ ID NO: 411400 - DNA, 20 bp, mouse
gtcacaggactggtcactag

SEQ ID NO: 411401 - DNA, 20 bp, mouse
gggccctgccctctaaccag

SEQ ID NO: 411402 - DNA, 20 bp, mouse
gtataggtagtagtagtata

SEQ ID NO: 411403 - DNA, 20 bp, mouse
gaactgctgtttcccatgat

SEQ ID NO: 411404 - DNA, 20 bp, mouse
gctagagagaacaggatctc

SEQ ID NO: 411405 - DNA, 20 bp, mouse
gtgtccttgttggcctgatt

SEQ ID NO: 411406 - DNA, 20 bp, mouse
gcaaagatgacctctgtggt

SEQ ID NO: 411407 - DNA, 20 bp, mouse
gtcgtggtggggtcctggac

SEQ ID NO: 411408 - DNA, 20 bp, mouse
gggactggatggcttttcaa

SEQ ID NO: 411409 - DNA, 20 bp, mouse
gtctttggtgtttagtgcca

SEQ ID NO: 411410 - DNA, 20 bp, mouse
gcatgtcagaaaaatatcta

SEQ ID NO: 411411 - DNA, 20 bp, mouse
gcagtgggggacatgctcag

SEQ ID NO: 411412 - DNA, 20 bp, mouse
ggcattgaacattattaaca

SEQ ID NO: 411413 - DNA, 20 bp, mouse
gaagaggtaaaactactaga

SEQ ID NO: 411414 - DNA, 20 bp, mouse
gtgaagaataccttcgtggt

SEQ ID NO: 411415 - DNA, 20 bp, mouse
gtaattcttaacatcaccac

SEQ ID NO: 411416 - DNA, 20 bp, mouse
gcggccaagcccagcgccca

SEQ ID NO: 411417 - DNA, 20 bp, mouse
ggccagccccagatcctaag

SEQ ID NO: 411418 - DNA, 20 bp, mouse
gcggtacacccgcgacttaa

SEQ ID NO: 411419 - DNA, 20 bp, mouse
ggctccaggccgttaagtcg

SEQ ID NO: 411420 - DNA, 20 bp, mouse
ggcttggccggaacgccaac

SEQ ID NO: 411421 - DNA, 20 bp, mouse
ggggtgtaccggcgagaaga

SEQ ID NO: 411422 - DNA, 20 bp, mouse
gccggaacgccaaccggccg

SEQ ID NO: 411423 - DNA, 20 bp, mouse
gcgggagagccgcggccggt

SEQ ID NO: 411424 - DNA, 20 bp, mouse
gagtaggtaacctacagggt

SEQ ID NO: 411425 - DNA, 20 bp, mouse
gccatcagcgagcatatctg

SEQ ID NO: 411426 - DNA, 20 bp, mouse
gtgccacagaagaccatcca

SEQ ID NO: 411427 - DNA, 20 bp, mouse
gagaagaccatccagggaaa

SEQ ID NO: 411428 - DNA, 20 bp, mouse
gggcactaaagaccaaaggt

SEQ ID NO: 411429 - DNA, 20 bp, mouse
gtaaagaccaaaggtaggta

SEQ ID NO: 411430 - DNA, 20 bp, mouse
gtttacactggaggctgaaa

SEQ ID NO: 411431 - DNA, 20 bp, mouse
gctgtggcactaaagaccaa

SEQ ID NO: 411432 - DNA, 20 bp, mouse
ggaaatggagaccctttccc

SEQ ID NO: 411433 - DNA, 20 bp, mouse
gtttaaaaatacctttacac

SEQ ID NO: 411434 - DNA, 20 bp, mouse
gaaaaatacctttacactgg

SEQ ID NO: 411435 - DNA, 20 bp, mouse
gagataggattgcaatgtca

SEQ ID NO: 411436 - DNA, 20 bp, mouse
ggggtaggccaaataatcca

SEQ ID NO: 411437 - DNA, 20 bp, mouse
gttagaaacgattacagggt

SEQ ID NO: 411438 - DNA, 20 bp, mouse
ggtgattagaaacgattaca

SEQ ID NO: 411439 - DNA, 20 bp, mouse
gtttctgaagctagactagg

SEQ ID NO: 411440 - DNA, 20 bp, mouse
gcgtgggacacaatggtcgg

SEQ ID NO: 411441 - DNA, 20 bp, mouse
gcctagctgtggggtgacgt

SEQ ID NO: 411442 - DNA, 20 bp, mouse
ggagaaaatgaacaattcct

SEQ ID NO: 411443 - DNA, 20 bp, mouse
gcattcctagagagtctatt

SEQ ID NO: 411444 - DNA, 20 bp, mouse
gaacaattccttggattatt

SEQ ID NO: 411445 - DNA, 20 bp, mouse
gggggtgacgtgggacacaa

SEQ ID NO: 411446 - DNA, 20 bp, mouse
gaggaggtcctggccctcag

SEQ ID NO: 411447 - DNA, 20 bp, mouse
gcttgctgcagcacctctga

SEQ ID NO: 411448 - DNA, 20 bp, mouse
gggagctaaggagacaacaa

SEQ ID NO: 411449 - DNA, 20 bp, mouse
gtgctgccccaaagagaagt

SEQ ID NO: 411450 - DNA, 20 bp, mouse
gtcacggggccaggaggtcc

SEQ ID NO: 411451 - DNA, 20 bp, mouse
gaccaatcctggcggctcac

SEQ ID NO: 411452 - DNA, 20 bp, mouse
ggattgggagagtgccctgg

SEQ ID NO: 411453 - DNA, 20 bp, mouse
gctaaggagacaacaagggt

SEQ ID NO: 411454 - DNA, 20 bp, mouse
gccccgtgagccgccaggat

SEQ ID NO: 411455 - DNA, 20 bp, mouse
gggagatttaccaatcctgg

SEQ ID NO: 411456 - DNA, 20 bp, mouse
gcgcgatggatcaggacgag

SEQ ID NO: 411457 - DNA, 20 bp, mouse
gccgcccacaccggttacta

SEQ ID NO: 411458 - DNA, 20 bp, mouse
ggagtccaggaagtcttcat

SEQ ID NO: 411459 - DNA, 20 bp, mouse
gggtgtagccgcgatggatc

SEQ ID NO: 411460 - DNA, 20 bp, mouse
gccggttactagggacgcgt

SEQ ID NO: 411461 - DNA, 20 bp, mouse
ggatcaggacgaggggctga

SEQ ID NO: 411462 - DNA, 20 bp, mouse
gcgcgtcggtgtagccgcga

SEQ ID NO: 411463 - DNA, 20 bp, mouse
ggcgtccggcccgcccacac

SEQ ID NO: 411464 - DNA, 20 bp, mouse
gtgtgtgacaatgttgtcca

SEQ ID NO: 411465 - DNA, 20 bp, mouse
gcgtccctagtaaccggtgt

SEQ ID NO: 411466 - DNA, 20 bp, mouse
ggagacataagagctaacaa

SEQ ID NO: 411467 - DNA, 20 bp, mouse
gcagcatgtgcctcagacta

SEQ ID NO: 411468 - DNA, 20 bp, mouse
ggaagagcttactttcagaa

SEQ ID NO: 411469 - DNA, 20 bp, mouse
gtctgggtatgagagctgaa

SEQ ID NO: 411470 - DNA, 20 bp, mouse
gttatgtctcccctagtctg

SEQ ID NO: 411471 - DNA, 20 bp, mouse
gaggaaaattgtaattacta

SEQ ID NO: 411472 - DNA, 20 bp, mouse
gcctagacagcagctactgg

SEQ ID NO: 411473 - DNA, 20 bp, mouse
gggtgtgatgccattcacca

SEQ ID NO: 411474 - DNA, 20 bp, mouse
gtttcagaagggcggcctgc

SEQ ID NO: 411475 - DNA, 20 bp, mouse
gtagctgctgtctaggtgtg

SEQ ID NO: 411476 - DNA, 20 bp, mouse
gtagtcgctggtcttctctg

SEQ ID NO: 411477 - DNA, 20 bp, mouse
ggctcctccgcggactgttg

SEQ ID NO: 411478 - DNA, 20 bp, mouse
ggatctgggctagtttcctg

SEQ ID NO: 411479 - DNA, 20 bp, mouse
ggaaaaacctcaacagtccg

SEQ ID NO: 411480 - DNA, 20 bp, mouse
gtagcgagaagctcccagtc

SEQ ID NO: 411481 - DNA, 20 bp, mouse
gaaacctcaacagtccgcgg

SEQ ID NO: 411482 - DNA, 20 bp, mouse
ggtctgtgcctgctgcggca

SEQ ID NO: 411483 - DNA, 20 bp, mouse
gagtcaggttcaacaacccg

SEQ ID NO: 411484 - DNA, 20 bp, mouse
gcagacatttggcctcccgc

SEQ ID NO: 411485 - DNA, 20 bp, mouse
gggcaaggcgtcctgttgct

SEQ ID NO: 411486 - DNA, 20 bp, mouse
gtagatggaagtactttcag

SEQ ID NO: 411487 - DNA, 20 bp, mouse
gtccagaagacgggttgcag

SEQ ID NO: 411488 - DNA, 20 bp, mouse
ggacatgacaatccagaaga

SEQ ID NO: 411489 - DNA, 20 bp, mouse
gagtagtgggatctacttgg

SEQ ID NO: 411490 - DNA, 20 bp, mouse
gatgcttgagacccagtagt

SEQ ID NO: 411491 - DNA, 20 bp, mouse
ggtcaaagtcttggggtaga

SEQ ID NO: 411492 - DNA, 20 bp, mouse
ggcctctgcaacccgtcttc

SEQ ID NO: 411493 - DNA, 20 bp, mouse
gacagcgagagtcgacacat

SEQ ID NO: 411494 - DNA, 20 bp, mouse
gttgagtcagttgggagtta

SEQ ID NO: 411495 - DNA, 20 bp, mouse
gattgtcatgtctctgctca

SEQ ID NO: 411496 - DNA, 20 bp, mouse
gcaccggagaatcaattgta

SEQ ID NO: 411497 - DNA, 20 bp, mouse
gtcattaggtctccacccac

SEQ ID NO: 411498 - DNA, 20 bp, mouse
gtcatcatagtcgatggtat

SEQ ID NO: 411499 - DNA, 20 bp, mouse
ggtggagacctaatgaccat

SEQ ID NO: 411500 - DNA, 20 bp, mouse
gatagtcgatggtattggca

SEQ ID NO: 411501 - DNA, 20 bp, mouse
gtaccgtacaattgattctc

SEQ ID NO: 411502 - DNA, 20 bp, mouse
gcaattgattctccggtggg

SEQ ID NO: 411503 - DNA, 20 bp, mouse
gaatctttcatcatagtcga

SEQ ID NO: 411504 - DNA, 20 bp, mouse
gaatcagctatagttaacga

SEQ ID NO: 411505 - DNA, 20 bp, mouse
gaattgaaccaatggtcatt

SEQ ID NO: 411506 - DNA, 20 bp, mouse
ggaaagaggtaaggaaccaa

SEQ ID NO: 411507 - DNA, 20 bp, mouse
ggtaagagcagccatcaacg

SEQ ID NO: 411508 - DNA, 20 bp, mouse
gaacacccaggaccagaaag

SEQ ID NO: 411509 - DNA, 20 bp, mouse
gagcagccatcaacggggaa

SEQ ID NO: 411510 - DNA, 20 bp, mouse
ggaaaggcagtcaaacaccc

SEQ ID NO: 411511 - DNA, 20 bp, mouse
gtctcttggaggccttagaa

SEQ ID NO: 411512 - DNA, 20 bp, mouse
gctctgtgactccctggtag

SEQ ID NO: 411513 - DNA, 20 bp, mouse
ggactgcctttccccgttga

SEQ ID NO: 411514 - DNA, 20 bp, mouse
gtaccagccaaactagagag

SEQ ID NO: 411515 - DNA, 20 bp, mouse
ggcctccaagagaaaggacc

SEQ ID NO: 411516 - DNA, 20 bp, mouse
gtcagcaccggctagactcc

SEQ ID NO: 411517 - DNA, 20 bp, mouse
gctgatggagaaaaagacca

SEQ ID NO: 411518 - DNA, 20 bp, mouse
gtgaggagggggcaatccag

SEQ ID NO: 411519 - DNA, 20 bp, mouse
ggctcgaggaccaacagtgt

SEQ ID NO: 411520 - DNA, 20 bp, mouse
gaaaccacgagggacaaaca

SEQ ID NO: 411521 - DNA, 20 bp, mouse
gtccaggatgcagccagagg

SEQ ID NO: 411522 - DNA, 20 bp, mouse
gctaggggggaggggacggt

SEQ ID NO: 411523 - DNA, 20 bp, mouse
gatggagaaaaagaccaggg

SEQ ID NO: 411524 - DNA, 20 bp, mouse
gttgtctccaggagtctagc

SEQ ID NO: 411525 - DNA, 20 bp, mouse
ggacaggtgagcaggtctgg

SEQ ID NO: 411526 - DNA, 20 bp, mouse
ggtggcgtaacatctttgag

SEQ ID NO: 411527 - DNA, 20 bp, mouse
ggctgacaggaagaactgct

SEQ ID NO: 411528 - DNA, 20 bp, mouse
gagttgctagctgatatcgg

SEQ ID NO: 411529 - DNA, 20 bp, mouse
gtggtgacaagcctgaacgt

SEQ ID NO: 411530 - DNA, 20 bp, mouse
gagttctgggcaaaaggctg

SEQ ID NO: 411531 - DNA, 20 bp, mouse
gctcagttgctagctgatat

SEQ ID NO: 411532 - DNA, 20 bp, mouse
ggctggggtagagggaaaat

SEQ ID NO: 411533 - DNA, 20 bp, mouse
gtgatcagggtgaaagacta

SEQ ID NO: 411534 - DNA, 20 bp, mouse
gaatgggcgggaggttcgaa

SEQ ID NO: 411535 - DNA, 20 bp, mouse
gatgaagtattcttcagagg

SEQ ID NO: 411536 - DNA, 20 bp, mouse
gcgagatggcccctccctaa

SEQ ID NO: 411537 - DNA, 20 bp, mouse
ggaaggcccacagggactcc

SEQ ID NO: 411538 - DNA, 20 bp, mouse
ggctgcagtgctgaccgaga

SEQ ID NO: 411539 - DNA, 20 bp, mouse
ggacaggctcctttagggag

SEQ ID NO: 411540 - DNA, 20 bp, mouse
gcagcttccccagctctatc

SEQ ID NO: 411541 - DNA, 20 bp, mouse
gttcagagacaggctccttt

SEQ ID NO: 411542 - DNA, 20 bp, mouse
ggggtgagatcataagtcag

SEQ ID NO: 411543 - DNA, 20 bp, mouse
ggttgagaagagagactcag

SEQ ID NO: 411544 - DNA, 20 bp, mouse
gcaatgaccacagtcggtaa

SEQ ID NO: 411545 - DNA, 20 bp, mouse
gggtaagggccgcaagatct

SEQ ID NO: 411546 - DNA, 20 bp, mouse
ggccccaagcaggcaaggta

SEQ ID NO: 411547 - DNA, 20 bp, mouse
ggaatcgagtgcacagatct

SEQ ID NO: 411548 - DNA, 20 bp, mouse
ggccacagttcataagagaa

SEQ ID NO: 411549 - DNA, 20 bp, mouse
gtgattcagggcagaaacag

SEQ ID NO: 411550 - DNA, 20 bp, mouse
gacagttcataagagaaggg

SEQ ID NO: 411551 - DNA, 20 bp, mouse
ggtcccactaaggaaagatt

SEQ ID NO: 411552 - DNA, 20 bp, mouse
gtccttaccttgcctgcttg

SEQ ID NO: 411553 - DNA, 20 bp, mouse
gcaggcaaggtaaggaattt

SEQ ID NO: 411554 - DNA, 20 bp, mouse
gctgtgcactcgattcagga

SEQ ID NO: 411555 - DNA, 20 bp, mouse
gagagaggaaaggggctgac

SEQ ID NO: 411556 - DNA, 20 bp, mouse
ggagcaagcgcttacctggt

SEQ ID NO: 411557 - DNA, 20 bp, mouse
gactaactacagtgccaacc

SEQ ID NO: 411558 - DNA, 20 bp, mouse
ggatgggagcgggcagtcaa

SEQ ID NO: 411559 - DNA, 20 bp, mouse
gtgacgagcaagcgcttacc

SEQ ID NO: 411560 - DNA, 20 bp, mouse
gtgctccccagtggtccccg

SEQ ID NO: 411561 - DNA, 20 bp, mouse
gggcccaggaacaagcaaag

SEQ ID NO: 411562 - DNA, 20 bp, mouse
gcaacaagtgtaaacagcac

SEQ ID NO: 411563 - DNA, 20 bp, mouse
gcctgcctcggggaccactg

SEQ ID NO: 411564 - DNA, 20 bp, mouse
ggggtagagatgctccccag

SEQ ID NO: 411565 - DNA, 20 bp, mouse
ggaacaagcaaagaggatct

SEQ ID NO: 411566 - DNA, 20 bp, mouse
gtgctgaggacagcccaggt

SEQ ID NO: 411567 - DNA, 20 bp, mouse
gctggaccttggagaataac

SEQ ID NO: 411568 - DNA, 20 bp, mouse
gacagaggtaggaaccacag

SEQ ID NO: 411569 - DNA, 20 bp, mouse
gaggctcctgttattctcca

SEQ ID NO: 411570 - DNA, 20 bp, mouse
gtgctgtgtcacagatgagg

SEQ ID NO: 411571 - DNA, 20 bp, mouse
gggagcctttgttcccacct

SEQ ID NO: 411572 - DNA, 20 bp, mouse
gaccccgctccccttcctgt

SEQ ID NO: 411573 - DNA, 20 bp, mouse
gagacttggacatccccaca

SEQ ID NO: 411574 - DNA, 20 bp, mouse
gttccacgactcagttacag

SEQ ID NO: 411575 - DNA, 20 bp, mouse
gtgggtgaaacggagagact

SEQ ID NO: 411576 - DNA, 20 bp, mouse
gggtctggtccagagctctc

SEQ ID NO: 411577 - DNA, 20 bp, mouse
ggccaggccaagcaacggtt

SEQ ID NO: 411578 - DNA, 20 bp, mouse
gggcaaatcttcactatctt

SEQ ID NO: 411579 - DNA, 20 bp, mouse
gattgtaggagacgggctat

SEQ ID NO: 411580 - DNA, 20 bp, mouse
ggtaagcacagtcttttctc

SEQ ID NO: 411581 - DNA, 20 bp, mouse
gagctctcccaaccgttgct

SEQ ID NO: 411582 - DNA, 20 bp, mouse
gcaacggttgggagagctgg

SEQ ID NO: 411583 - DNA, 20 bp, mouse
gtggctcaacatcaggtgtg

SEQ ID NO: 411584 - DNA, 20 bp, mouse
gaggcaagtgtccactgtct

SEQ ID NO: 411585 - DNA, 20 bp, mouse
ggttcggaagtccaggttga

SEQ ID NO: 411586 - DNA, 20 bp, mouse
gagtgtttgaaacggtgagt

SEQ ID NO: 411587 - DNA, 20 bp, mouse
ggggacacgcacaacagaac

SEQ ID NO: 411588 - DNA, 20 bp, mouse
ggcagtctctttagcatgag

SEQ ID NO: 411589 - DNA, 20 bp, mouse
ggtgggtcccacatctgtgt

SEQ ID NO: 411590 - DNA, 20 bp, mouse
gacgaagccaacacagatgt

SEQ ID NO: 411591 - DNA, 20 bp, mouse
gcaacagaactggtgtgagt

SEQ ID NO: 411592 - DNA, 20 bp, mouse
gtatgtcctgggaagacact

SEQ ID NO: 411593 - DNA, 20 bp, mouse
gtctcaacagctgtgtcatc

SEQ ID NO: 411594 - DNA, 20 bp, mouse
gacactgaccaggtgctgat

SEQ ID NO: 411595 - DNA, 20 bp, mouse
gaggttactgggaatgatac

SEQ ID NO: 411596 - DNA, 20 bp, mouse
gggcagcgagccgaccagag

SEQ ID NO: 411597 - DNA, 20 bp, mouse
ggagccgaccagaggggcaa

SEQ ID NO: 411598 - DNA, 20 bp, mouse
gaggcagaccacttacagtc

SEQ ID NO: 411599 - DNA, 20 bp, mouse
gcagccattgcccctctggt

SEQ ID NO: 411600 - DNA, 20 bp, mouse
gctggtcggctcgctgccaa

SEQ ID NO: 411601 - DNA, 20 bp, mouse
gtcctcagccattgcccctc

SEQ ID NO: 411602 - DNA, 20 bp, mouse
gcctgtggccatgacctgag

SEQ ID NO: 411603 - DNA, 20 bp, mouse
gaccccgccaggaaacagag

SEQ ID NO: 411604 - DNA, 20 bp, mouse
gtcctggacaaacatcaacc

SEQ ID NO: 411605 - DNA, 20 bp, mouse
gggtctgcctctatttttgt

SEQ ID NO: 411606 - DNA, 20 bp, mouse
gaactcaagaggattcttgt

SEQ ID NO: 411607 - DNA, 20 bp, mouse
gggttgacaacagaactcaa

SEQ ID NO: 411608 - DNA, 20 bp, mouse
gtcaagaggattcttgtagg

SEQ ID NO: 411609 - DNA, 20 bp, mouse
gaagctaataccaactcaag

SEQ ID NO: 411610 - DNA, 20 bp, mouse
gactcaatggtctgaaactc

SEQ ID NO: 411611 - DNA, 20 bp, mouse
gatttaaatgtacaatatgt

SEQ ID NO: 411612 - DNA, 20 bp, mouse
gtgtacaatatgtgggttat

SEQ ID NO: 411613 - DNA, 20 bp, mouse
gttaaattactcagaagtta

SEQ ID NO: 411614 - DNA, 20 bp, mouse
ggataggtgatagatgaatg

SEQ ID NO: 411615 - DNA, 20 bp, mouse
gtagatgaatggggagagag

SEQ ID NO: 411616 - DNA, 20 bp, mouse
gtggtgctcgagaggtttgg

SEQ ID NO: 411617 - DNA, 20 bp, mouse
gccatgggcaagcctcacca

SEQ ID NO: 411618 - DNA, 20 bp, mouse
gatcaggaggtcctttacca

SEQ ID NO: 411619 - DNA, 20 bp, mouse
gctgtggtgctcgagaggtt

SEQ ID NO: 411620 - DNA, 20 bp, mouse
gctaggctgtggtgctcgag

SEQ ID NO: 411621 - DNA, 20 bp, mouse
ggaggtttggaggcatcagg

SEQ ID NO: 411622 - DNA, 20 bp, mouse
ggaggtcctttaccatggtg

SEQ ID NO: 411623 - DNA, 20 bp, mouse
ggcaagcctcaccatggtaa

SEQ ID NO: 411624 - DNA, 20 bp, mouse
gcgagaggtttggaggcatc

SEQ ID NO: 411625 - DNA, 20 bp, mouse
gcacgtgactaatgagccat

SEQ ID NO: 411626 - DNA, 20 bp, mouse
gactgacccgtggcaagagg

SEQ ID NO: 411627 - DNA, 20 bp, mouse
gagctcgagggcctgaagta

SEQ ID NO: 411628 - DNA, 20 bp, mouse
gtggcaagaggaggtcgcaa

SEQ ID NO: 411629 - DNA, 20 bp, mouse
gggctgccagcactgacccg

SEQ ID NO: 411630 - DNA, 20 bp, mouse
gtgggggctatgacaacggt

SEQ ID NO: 411631 - DNA, 20 bp, mouse
ggtggtgggggctatgacaa

SEQ ID NO: 411632 - DNA, 20 bp, mouse
gccgtggccacggttcctag

SEQ ID NO: 411633 - DNA, 20 bp, mouse
gtcttgccacgggtcagtgc

SEQ ID NO: 411634 - DNA, 20 bp, mouse
gaggtcttctcttggtactg

SEQ ID NO: 411635 - DNA, 20 bp, mouse
gacggttcctagcggttccg

SEQ ID NO: 411636 - DNA, 20 bp, mouse
gagtgtcgaggtacagaaca

SEQ ID NO: 411637 - DNA, 20 bp, mouse
ggccagagtagttagtgtcg

SEQ ID NO: 411638 - DNA, 20 bp, mouse
gaacagggaagatgtcatga

SEQ ID NO: 411639 - DNA, 20 bp, mouse
gtgttttcaggagtttacct

SEQ ID NO: 411640 - DNA, 20 bp, mouse
gcactccaaggctcaccctc

SEQ ID NO: 411641 - DNA, 20 bp, mouse
gacctcgacactaactactc

SEQ ID NO: 411642 - DNA, 20 bp, mouse
gcacctgctttggtaagccg

SEQ ID NO: 411643 - DNA, 20 bp, mouse
gagaacacagggccagttga

SEQ ID NO: 411644 - DNA, 20 bp, mouse
gactactctggccacttcct

SEQ ID NO: 411645 - DNA, 20 bp, mouse
gtacctcggcttaccaaagc

SEQ ID NO: 411646 - DNA, 20 bp, mouse
gcatggacagaggatctcaa

SEQ ID NO: 411647 - DNA, 20 bp, mouse
gtcaatgggcctgccaagat

SEQ ID NO: 411648 - DNA, 20 bp, mouse
gggtgtctgtccatggacag

SEQ ID NO: 411649 - DNA, 20 bp, mouse
gctgtgacatcctcccatct

SEQ ID NO: 411650 - DNA, 20 bp, mouse
ggttagtcggtgtctgtcca

SEQ ID NO: 411651 - DNA, 20 bp, mouse
gcctaaggaatgaggttagt

SEQ ID NO: 411652 - DNA, 20 bp, mouse
gcgctgaggtctcaatatct

SEQ ID NO: 411653 - DNA, 20 bp, mouse
gcagggattccaaaacccta

SEQ ID NO: 411654 - DNA, 20 bp, mouse
gtccaaaaccctaaggaatg

SEQ ID NO: 411655 - DNA, 20 bp, mouse
ggacatcctcccatcttggc

SEQ ID NO: 411656 - DNA, 20 bp, mouse
gtcaagccctgggcagagcg

SEQ ID NO: 411657 - DNA, 20 bp, mouse
ggagcgcctcgctctgccca

SEQ ID NO: 411658 - DNA, 20 bp, mouse
ggtgtgtcatggctatgggc

SEQ ID NO: 411659 - DNA, 20 bp, mouse
ggtggcaggatgagacacgg

SEQ ID NO: 411660 - DNA, 20 bp, mouse
gaccggctggcccagagagt

SEQ ID NO: 411661 - DNA, 20 bp, mouse
ggttgcaggaagctcttgac

SEQ ID NO: 411662 - DNA, 20 bp, mouse
gtcccggtaactccctgagt

SEQ ID NO: 411663 - DNA, 20 bp, mouse
gacctactcagggagttacc

SEQ ID NO: 411664 - DNA, 20 bp, mouse
gctccctgagtaggttgtca

SEQ ID NO: 411665 - DNA, 20 bp, mouse
gagttaccgggaaaagcaac

SEQ ID NO: 411666 - DNA, 20 bp, mouse
ggtaagagacttacctgccc

SEQ ID NO: 411667 - DNA, 20 bp, mouse
gagggggcggaggtttaacc

SEQ ID NO: 411668 - DNA, 20 bp, mouse
ggcggaaggagcaggttccc

SEQ ID NO: 411669 - DNA, 20 bp, mouse
gtaaacctccgccccctgga

SEQ ID NO: 411670 - DNA, 20 bp, mouse
gacaagaagggtcacctgcc

SEQ ID NO: 411671 - DNA, 20 bp, mouse
gtgctccttccgcaaggtcc

SEQ ID NO: 411672 - DNA, 20 bp, mouse
gggcggaggtttaacctggc

SEQ ID NO: 411673 - DNA, 20 bp, mouse
gttgctgtgagtggagagag

SEQ ID NO: 411674 - DNA, 20 bp, mouse
gccctccaggaccttgcgga

SEQ ID NO: 411675 - DNA, 20 bp, mouse
gagaggcaggggctggctca

SEQ ID NO: 411676 - DNA, 20 bp, mouse
gaggagggtctgtacttcag

SEQ ID NO: 411677 - DNA, 20 bp, mouse
gtcctttacagctagaggat

SEQ ID NO: 411678 - DNA, 20 bp, mouse
ggcccatcctctagctgtaa

SEQ ID NO: 411679 - DNA, 20 bp, mouse
gtctgtacttcagcggtgag

SEQ ID NO: 411680 - DNA, 20 bp, mouse
gtacttcagcggtgagtggc

SEQ ID NO: 411681 - DNA, 20 bp, mouse
gactctacagggtaaactga

SEQ ID NO: 411682 - DNA, 20 bp, mouse
gtcatcttgacctggaagtt

SEQ ID NO: 411683 - DNA, 20 bp, mouse
gtctgctactctaaatcctt

SEQ ID NO: 411684 - DNA, 20 bp, mouse
gctttcctagctccaaccag

SEQ ID NO: 411685 - DNA, 20 bp, mouse
gcatgacaccccaagcaagg

SEQ ID NO: 411686 - DNA, 20 bp, mouse
gagcctcagagtcaggatct

SEQ ID NO: 411687 - DNA, 20 bp, mouse
ggcaatctccacaaatcctg

SEQ ID NO: 411688 - DNA, 20 bp, mouse
gatcctagatcctgactctg

SEQ ID NO: 411689 - DNA, 20 bp, mouse
gcgaggcaggcagaagggtt

SEQ ID NO: 411690 - DNA, 20 bp, mouse
ggactcaacagtgttgacgg

SEQ ID NO: 411691 - DNA, 20 bp, mouse
ggggtaccacagatttcccg

SEQ ID NO: 411692 - DNA, 20 bp, mouse
gataaaggcaacggctaaga

SEQ ID NO: 411693 - DNA, 20 bp, mouse
gtttcccgaggcaggcagaa

SEQ ID NO: 411694 - DNA, 20 bp, mouse
ggtcctgtgacgtcaagctc

SEQ ID NO: 411695 - DNA, 20 bp, mouse
gttgtgtgagcaaaggatgg

SEQ ID NO: 411696 - DNA, 20 bp, mouse
ggaggccgtggagaccccgg

SEQ ID NO: 411697 - DNA, 20 bp, mouse
gagaccccggtggcatgagg

SEQ ID NO: 411698 - DNA, 20 bp, mouse
gtgagaggccgtggagaccc

SEQ ID NO: 411699 - DNA, 20 bp, mouse
gagccggtggcggagttgag

SEQ ID NO: 411700 - DNA, 20 bp, mouse
ggttccagagcagccggtgg

SEQ ID NO: 411701 - DNA, 20 bp, mouse
gctggcagggacagcctcag

SEQ ID NO: 411702 - DNA, 20 bp, mouse
gtggagaccccggtggcatg

SEQ ID NO: 411703 - DNA, 20 bp, mouse
gggcctctcaactccgccac

SEQ ID NO: 411704 - DNA, 20 bp, mouse
gctgccgcctcatgccaccg

SEQ ID NO: 411705 - DNA, 20 bp, mouse
gccttcgcggcccgcctctg

SEQ ID NO: 411706 - DNA, 20 bp, mouse
gctacccctcatgaataggt

SEQ ID NO: 411707 - DNA, 20 bp, mouse
gaggtgacactgtcaaactt

SEQ ID NO: 411708 - DNA, 20 bp, mouse
gtcatctacccctcatgaat

SEQ ID NO: 411709 - DNA, 20 bp, mouse
ggccatgctttcaacctcag

SEQ ID NO: 411710 - DNA, 20 bp, mouse
gtcaacctcagtggttcctg

SEQ ID NO: 411711 - DNA, 20 bp, mouse
gtctgccttagcagattcag

SEQ ID NO: 411712 - DNA, 20 bp, mouse
gtcacctacctattcatgag

SEQ ID NO: 411713 - DNA, 20 bp, mouse
gctccatggtgacagactct

SEQ ID NO: 411714 - DNA, 20 bp, mouse
gaagactctggtgtaaggta

SEQ ID NO: 411715 - DNA, 20 bp, mouse
ggggccttcgtcctctacat

SEQ ID NO: 411716 - DNA, 20 bp, mouse
ggagccaaggtatgccactt

SEQ ID NO: 411717 - DNA, 20 bp, mouse
gatggcagagattgatccag

SEQ ID NO: 411718 - DNA, 20 bp, mouse
gttgggaacagactgacccc

SEQ ID NO: 411719 - DNA, 20 bp, mouse
ggtcttccctcctgtccaaa

SEQ ID NO: 411720 - DNA, 20 bp, mouse
gcaatctctgccatttggac

SEQ ID NO: 411721 - DNA, 20 bp, mouse
gagctagcccaagggatcta

SEQ ID NO: 411722 - DNA, 20 bp, mouse
gagctcaaggctgtgatcca

SEQ ID NO: 411723 - DNA, 20 bp, mouse
gggcataccttggctctatg

SEQ ID NO: 411724 - DNA, 20 bp, mouse
ggtcatagctatggtcactt

SEQ ID NO: 411725 - DNA, 20 bp, mouse
ggattagtgtatggacctag

SEQ ID NO: 411726 - DNA, 20 bp, mouse
ggagacgcacgcttactccc

SEQ ID NO: 411727 - DNA, 20 bp, mouse
ggtgcagcctcagcacgacc

SEQ ID NO: 411728 - DNA, 20 bp, mouse
gtgcgaaccaggtcgtgctg

SEQ ID NO: 411729 - DNA, 20 bp, mouse
ggaggctgaagcatgtttaa

SEQ ID NO: 411730 - DNA, 20 bp, mouse
gaatagcggacctaggagac

SEQ ID NO: 411731 - DNA, 20 bp, mouse
gtgaggctgcactagtctcc

SEQ ID NO: 411732 - DNA, 20 bp, mouse
ggtcttcgtcgcgtaaggca

SEQ ID NO: 411733 - DNA, 20 bp, mouse
ggtctgtcaaagcagtgatg

SEQ ID NO: 411734 - DNA, 20 bp, mouse
gccccactgggaatttgctg

SEQ ID NO: 411735 - DNA, 20 bp, mouse
gagacgcaaatagcggacct

SEQ ID NO: 411736 - DNA, 20 bp, mouse
gtagatgacatagacctccc

SEQ ID NO: 411737 - DNA, 20 bp, mouse
ggtctggagcggcagaaaga

SEQ ID NO: 411738 - DNA, 20 bp, mouse
ggcctctctcaccctttctt

SEQ ID NO: 411739 - DNA, 20 bp, mouse
gtctctcaccctttcttagg

SEQ ID NO: 411740 - DNA, 20 bp, mouse
ggtcatctacctcctaagaa

SEQ ID NO: 411741 - DNA, 20 bp, mouse
ggcggagctggcagtagtca

SEQ ID NO: 411742 - DNA, 20 bp, mouse
gagtagtcagggagactctc

SEQ ID NO: 411743 - DNA, 20 bp, mouse
gtagagtaggggttgaggtg

SEQ ID NO: 411744 - DNA, 20 bp, mouse
ggaggggccgtggcaggaga

SEQ ID NO: 411745 - DNA, 20 bp, mouse
gtatgacatggccagcagtc

SEQ ID NO: 411746 - DNA, 20 bp, mouse
gggccgctgaagccgaccag

SEQ ID NO: 411747 - DNA, 20 bp, mouse
ggaggagaggccaagacctc

SEQ ID NO: 411748 - DNA, 20 bp, mouse
gtcaccttcacacccctggt

SEQ ID NO: 411749 - DNA, 20 bp, mouse
gttcagcggccttcgaggag

SEQ ID NO: 411750 - DNA, 20 bp, mouse
gcagtagtgaagcggaacgt

SEQ ID NO: 411751 - DNA, 20 bp, mouse
gaagccgaccaggggtgtga

SEQ ID NO: 411752 - DNA, 20 bp, mouse
ggcttcactactgtgaggag

SEQ ID NO: 411753 - DNA, 20 bp, mouse
ggtgaagcggaacgttggtg

SEQ ID NO: 411754 - DNA, 20 bp, mouse
gttggtggggccagaggtct

SEQ ID NO: 411755 - DNA, 20 bp, mouse
gtcggcttcagcggccttcg

SEQ ID NO: 411756 - DNA, 20 bp, mouse
gaagtgctggcagatcacta

SEQ ID NO: 411757 - DNA, 20 bp, mouse
gatgggtcggattccaatcg

SEQ ID NO: 411758 - DNA, 20 bp, mouse
gctctctggagatcacccct

SEQ ID NO: 411759 - DNA, 20 bp, mouse
ggaagctccgaccttctcca

SEQ ID NO: 411760 - DNA, 20 bp, mouse
gataaggggagatcagactg

SEQ ID NO: 411761 - DNA, 20 bp, mouse
gtccgtgtgagtcagcaatg

SEQ ID NO: 411762 - DNA, 20 bp, mouse
gaatcgtggtgtgttgttca

SEQ ID NO: 411763 - DNA, 20 bp, mouse
gcaatggggcctccccatca

SEQ ID NO: 411764 - DNA, 20 bp, mouse
gtctgaggttgcacatgagc

SEQ ID NO: 411765 - DNA, 20 bp, mouse
gcgatgaagatgcgtctctc

SEQ ID NO: 411766 - DNA, 20 bp, mouse
ggggcagaggaagagatacg

SEQ ID NO: 411767 - DNA, 20 bp, mouse
gacgaggtctgggagtgctg

SEQ ID NO: 411768 - DNA, 20 bp, mouse
gccatgctctgaccacacag

SEQ ID NO: 411769 - DNA, 20 bp, mouse
gatgtccggaaaagcactca

SEQ ID NO: 411770 - DNA, 20 bp, mouse
ggtagtaggctgaagatcat

SEQ ID NO: 411771 - DNA, 20 bp, mouse
gggaaaagcactcagggcag

SEQ ID NO: 411772 - DNA, 20 bp, mouse
ggaggaagagatacgaggtc

SEQ ID NO: 411773 - DNA, 20 bp, mouse
gtgaccacacaggggaacgg

SEQ ID NO: 411774 - DNA, 20 bp, mouse
gtgacctccgttcccctgtg

SEQ ID NO: 411775 - DNA, 20 bp, mouse
gtcttaaaccggcaagtagt

SEQ ID NO: 411776 - DNA, 20 bp, mouse
gctagtccggtacccaaagg

SEQ ID NO: 411777 - DNA, 20 bp, mouse
gtgtctagtccggtacccaa

SEQ ID NO: 411778 - DNA, 20 bp, mouse
gatggctcctctcccccttt

SEQ ID NO: 411779 - DNA, 20 bp, mouse
gaggattatcctgtctagtc

SEQ ID NO: 411780 - DNA, 20 bp, mouse
gccggtacccaaagggggag

SEQ ID NO: 411781 - DNA, 20 bp, mouse
gacaggagggcccagcgccc

SEQ ID NO: 411782 - DNA, 20 bp, mouse
gctggatgagagctacagag

SEQ ID NO: 411783 - DNA, 20 bp, mouse
gagggcccagcgcccagggc

SEQ ID NO: 411784 - DNA, 20 bp, mouse
gctgggcaggttccctgagc

SEQ ID NO: 411785 - DNA, 20 bp, mouse
ggactaaaacccaccatcac

SEQ ID NO: 411786 - DNA, 20 bp, mouse
gcagagctctaaggtgccct

SEQ ID NO: 411787 - DNA, 20 bp, mouse
gcacatgctgcagagctcta

SEQ ID NO: 411788 - DNA, 20 bp, mouse
gtgccttcgagttaaggatg

SEQ ID NO: 411789 - DNA, 20 bp, mouse
gtttaggcagtaggtgccta

SEQ ID NO: 411790 - DNA, 20 bp, mouse
gagacctcagagaactcact

SEQ ID NO: 411791 - DNA, 20 bp, mouse
gctcctcatccttaactcga

SEQ ID NO: 411792 - DNA, 20 bp, mouse
ggctggtaagaagactactg

SEQ ID NO: 411793 - DNA, 20 bp, mouse
gagcatgtgccttcgagtta

SEQ ID NO: 411794 - DNA, 20 bp, mouse
gctacccagtgagttctctg

SEQ ID NO: 411795 - DNA, 20 bp, mouse
ggggacatgagtggcacttt

SEQ ID NO: 411796 - DNA, 20 bp, mouse
ggcttggcttgggcagcagt

SEQ ID NO: 411797 - DNA, 20 bp, mouse
gattgagccacctctgtgtg

SEQ ID NO: 411798 - DNA, 20 bp, mouse
gcaaagaagttttcctctga

SEQ ID NO: 411799 - DNA, 20 bp, mouse
gcatgtagccacggagtgag

SEQ ID NO: 411800 - DNA, 20 bp, mouse
ggacacccaggataacacag

SEQ ID NO: 411801 - DNA, 20 bp, mouse
gggctacatggctaaatgag

SEQ ID NO: 411802 - DNA, 20 bp, mouse
gaagagccttgctgcattac

SEQ ID NO: 411803 - DNA, 20 bp, mouse
gccaagccggtaatgcagca

SEQ ID NO: 411804 - DNA, 20 bp, mouse
gaaaacttctttgaagaagg

SEQ ID NO: 411805 - DNA, 20 bp, mouse
gatttcctctgtgttatcct

SEQ ID NO: 411806 - DNA, 20 bp, mouse
gatccgagagatcaaggctg

SEQ ID NO: 411807 - DNA, 20 bp, mouse
gccacgtatccgagagatca

SEQ ID NO: 411808 - DNA, 20 bp, mouse
gctggcagatagaaaactat

SEQ ID NO: 411809 - DNA, 20 bp, mouse
ggcctcctccttctgctgga

SEQ ID NO: 411810 - DNA, 20 bp, mouse
ggctgaagaccttccaggga

SEQ ID NO: 411811 - DNA, 20 bp, mouse
gtggtgatgtcacaggtctc

SEQ ID NO: 411812 - DNA, 20 bp, mouse
gactataggcacgatgaatc

SEQ ID NO: 411813 - DNA, 20 bp, mouse
gatgaatcaggcaggcaatg

SEQ ID NO: 411814 - DNA, 20 bp, mouse
ggctttcaggtagagtcccc

SEQ ID NO: 411815 - DNA, 20 bp, mouse
gttactgggcacggccccca

SEQ ID NO: 411816 - DNA, 20 bp, mouse
gcggaggtcgcggaaagaca

SEQ ID NO: 411817 - DNA, 20 bp, mouse
ggccgggtgcagccttactg

SEQ ID NO: 411818 - DNA, 20 bp, mouse
ggagatcctgggaagcccac

SEQ ID NO: 411819 - DNA, 20 bp, mouse
gctgcacccggctttcccgt

SEQ ID NO: 411820 - DNA, 20 bp, mouse
gaggggagtctcgagatcct

SEQ ID NO: 411821 - DNA, 20 bp, mouse
ggacaggaagcgaagagggg

SEQ ID NO: 411822 - DNA, 20 bp, mouse
gcaggacaggaagcgaagag

SEQ ID NO: 411823 - DNA, 20 bp, mouse
gggcgccccagtggactctt

SEQ ID NO: 411824 - DNA, 20 bp, mouse
gctgcgaactctacagagac

SEQ ID NO: 411825 - DNA, 20 bp, mouse
ggggtgcagccttactgcgg

SEQ ID NO: 411826 - DNA, 20 bp, mouse
ggcaagccggcgcaagtcgg

SEQ ID NO: 411827 - DNA, 20 bp, mouse
gcaagcaagccggcgcaagt

SEQ ID NO: 411828 - DNA, 20 bp, mouse
gggagcacgagcaagcaagc

SEQ ID NO: 411829 - DNA, 20 bp, mouse
gcatggccgcgcactcgcag

SEQ ID NO: 411830 - DNA, 20 bp, mouse
gtggccgcgcccccgaccca

SEQ ID NO: 411831 - DNA, 20 bp, mouse
ggggtgcgctggctacctaa

SEQ ID NO: 411832 - DNA, 20 bp, mouse
gggagcagcacgggctggaa

SEQ ID NO: 411833 - DNA, 20 bp, mouse
gttccagacagaaccggcta

SEQ ID NO: 411834 - DNA, 20 bp, mouse
gtcaccggcatggaacccca

SEQ ID NO: 411835 - DNA, 20 bp, mouse
gcccagccgccgacttgcgc

SEQ ID NO: 411836 - DNA, 20 bp, mouse
gcagaggacccgcacctggc

SEQ ID NO: 411837 - DNA, 20 bp, mouse
gacagcagaggacccgcacc

SEQ ID NO: 411838 - DNA, 20 bp, mouse
gaggcggtgcccacgatggg

SEQ ID NO: 411839 - DNA, 20 bp, mouse
gccaagctgcctcccatcgt

SEQ ID NO: 411840 - DNA, 20 bp, mouse
gcggaggcggtgcccacgat

SEQ ID NO: 411841 - DNA, 20 bp, mouse
gcctggagcccgccaggtgc

SEQ ID NO: 411842 - DNA, 20 bp, mouse
gtccgagctggccaaacgga

SEQ ID NO: 411843 - DNA, 20 bp, mouse
gcgccgcaccggtcccacca

SEQ ID NO: 411844 - DNA, 20 bp, mouse
gtgtttccgggcacgcaggt

SEQ ID NO: 411845 - DNA, 20 bp, mouse
gcacgcaggtcggggacccg

SEQ ID NO: 411846 - DNA, 20 bp, mouse
gggccttgcgcgggaagtcg

SEQ ID NO: 411847 - DNA, 20 bp, mouse
gcgcccagcggcagcacgaa

SEQ ID NO: 411848 - DNA, 20 bp, mouse
ggaccacaaacggcgcccag

SEQ ID NO: 411849 - DNA, 20 bp, mouse
gtcgcgcggaacgtctctct

SEQ ID NO: 411850 - DNA, 20 bp, mouse
gccccgctcgggaccacaaa

SEQ ID NO: 411851 - DNA, 20 bp, mouse
gggcagcacgaacggtcgcg

SEQ ID NO: 411852 - DNA, 20 bp, mouse
gttgcgcgggaagtcgcggc

SEQ ID NO: 411853 - DNA, 20 bp, mouse
gcagggacccgcagcctagg

SEQ ID NO: 411854 - DNA, 20 bp, mouse
gagcctggtgctctgaaggt

SEQ ID NO: 411855 - DNA, 20 bp, mouse
gccaagtcctggcaaagtct

SEQ ID NO: 411856 - DNA, 20 bp, mouse
gtcgcgagtagggaatgaag

SEQ ID NO: 411857 - DNA, 20 bp, mouse
gtgggcaacctggcatccag

SEQ ID NO: 411858 - DNA, 20 bp, mouse
gacaggaggcagcgcccact

SEQ ID NO: 411859 - DNA, 20 bp, mouse
gtgtggtctggtgggcaacc

SEQ ID NO: 411860 - DNA, 20 bp, mouse
gcagagtgatgtggtctggt

SEQ ID NO: 411861 - DNA, 20 bp, mouse
gcaggatgagagagtcccag

SEQ ID NO: 411862 - DNA, 20 bp, mouse
gagcgcccactgggctccac

SEQ ID NO: 411863 - DNA, 20 bp, mouse
ggatggtgatgggagaactc

SEQ ID NO: 411864 - DNA, 20 bp, mouse
gggttcaaaaggaaactcta

SEQ ID NO: 411865 - DNA, 20 bp, mouse
ggagagagtcccagcggcca

SEQ ID NO: 411866 - DNA, 20 bp, mouse
gatttctgcaaagctagaga

SEQ ID NO: 411867 - DNA, 20 bp, mouse
gtttgcagaaatgttgaaag

SEQ ID NO: 411868 - DNA, 20 bp, mouse
gcaggatatgaaaaatacat

SEQ ID NO: 411869 - DNA, 20 bp, mouse
ggtaatagtgaggaaaattc

SEQ ID NO: 411870 - DNA, 20 bp, mouse
gatactactgatagcctcaa

SEQ ID NO: 411871 - DNA, 20 bp, mouse
ggaactatcagtgtgtaagg

SEQ ID NO: 411872 - DNA, 20 bp, mouse
ggtaatatactgtcaacagg

SEQ ID NO: 411873 - DNA, 20 bp, mouse
gattgaaaatggcagaagtt

SEQ ID NO: 411874 - DNA, 20 bp, mouse
gtgtgtaatatactgtcaac

SEQ ID NO: 411875 - DNA, 20 bp, mouse
gggcttttccataagagtta

SEQ ID NO: 411876 - DNA, 20 bp, mouse
gtagcgagagcgtgagtggt

SEQ ID NO: 411877 - DNA, 20 bp, mouse
ggtctaaaccccgcaggtca

SEQ ID NO: 411878 - DNA, 20 bp, mouse
gccgcagggagcacccggag

SEQ ID NO: 411879 - DNA, 20 bp, mouse
ggccctagcgagagcgtgag

SEQ ID NO: 411880 - DNA, 20 bp, mouse
gaccccgcaggtcagggtga

SEQ ID NO: 411881 - DNA, 20 bp, mouse
ggccgtcaccctgacctgcg

SEQ ID NO: 411882 - DNA, 20 bp, mouse
gagtaggttgaagagcccaa

SEQ ID NO: 411883 - DNA, 20 bp, mouse
gtgacggccccggggtcgta

SEQ ID NO: 411884 - DNA, 20 bp, mouse
gacctgcggggtttagactc

SEQ ID NO: 411885 - DNA, 20 bp, mouse
gccccgcggccgcacaaagg

SEQ ID NO: 411886 - DNA, 20 bp, mouse
ggagaagcagcgcaaccctc

SEQ ID NO: 411887 - DNA, 20 bp, mouse
gagtcggaccagagcctcca

SEQ ID NO: 411888 - DNA, 20 bp, mouse
ggtcagcccagagtccacac

SEQ ID NO: 411889 - DNA, 20 bp, mouse
gccgaggctgcccagtccag

SEQ ID NO: 411890 - DNA, 20 bp, mouse
gcagtccagcggtagcgcag

SEQ ID NO: 411891 - DNA, 20 bp, mouse
gctggctttagtgaggacct

SEQ ID NO: 411892 - DNA, 20 bp, mouse
gcaaccctctggctttagtg

SEQ ID NO: 411893 - DNA, 20 bp, mouse
gcatgtgctatacagccagt

SEQ ID NO: 411894 - DNA, 20 bp, mouse
gtgtcatgatgcactgtgtt

SEQ ID NO: 411895 - DNA, 20 bp, mouse
gggtcacccgtgtggactct

SEQ ID NO: 411896 - DNA, 20 bp, mouse
ggctgcaccagcaatctgat

SEQ ID NO: 411897 - DNA, 20 bp, mouse
gggccttctatcctctgtgt

SEQ ID NO: 411898 - DNA, 20 bp, mouse
gactgcaggcgggctcttgg

SEQ ID NO: 411899 - DNA, 20 bp, mouse
gagcctacacagaggataga

SEQ ID NO: 411900 - DNA, 20 bp, mouse
gtcgtcaacggacccgtaat

SEQ ID NO: 411901 - DNA, 20 bp, mouse
gcccgtaatcggcataggtg

SEQ ID NO: 411902 - DNA, 20 bp, mouse
ggaactgcgcatgcacccgg

SEQ ID NO: 411903 - DNA, 20 bp, mouse
gacggacccgtaatcggcat

SEQ ID NO: 411904 - DNA, 20 bp, mouse
gtggactgcaggcgggctct

SEQ ID NO: 411905 - DNA, 20 bp, mouse
gggagcaagtccatcaccta

SEQ ID NO: 411906 - DNA, 20 bp, mouse
gaaaggtaaggcctaagggt

SEQ ID NO: 411907 - DNA, 20 bp, mouse
gtaagtggggctcaaaggta

SEQ ID NO: 411908 - DNA, 20 bp, mouse
gacaagtaagtggggctcaa

SEQ ID NO: 411909 - DNA, 20 bp, mouse
gtgccagcaacaagtaagtg

SEQ ID NO: 411910 - DNA, 20 bp, mouse
ggctcaaaggtaaggcctaa

SEQ ID NO: 411911 - DNA, 20 bp, mouse
gggtaaggcctaagggtggg

SEQ ID NO: 411912 - DNA, 20 bp, mouse
gactgttgtggggatgtggt

SEQ ID NO: 411913 - DNA, 20 bp, mouse
ggtaggcagagagaaactga

SEQ ID NO: 411914 - DNA, 20 bp, mouse
ggatggcagtgtccccacac

SEQ ID NO: 411915 - DNA, 20 bp, mouse
gagagctggaggagtcactt

SEQ ID NO: 411916 - DNA, 20 bp, mouse
gcttctggcatgcttcagac

SEQ ID NO: 411917 - DNA, 20 bp, mouse
gagggacctcgggggatcag

SEQ ID NO: 411918 - DNA, 20 bp, mouse
gcggtccccctgatcccccg

SEQ ID NO: 411919 - DNA, 20 bp, mouse
gtccctgacttactactctg

SEQ ID NO: 411920 - DNA, 20 bp, mouse
gcccccagagtagtaagtca

SEQ ID NO: 411921 - DNA, 20 bp, mouse
gggccaaggtcaccacgctt

SEQ ID NO: 411922 - DNA, 20 bp, mouse
gtgggggtgcttggaagaac

SEQ ID NO: 411923 - DNA, 20 bp, mouse
gtagcaggaaaccttctcct

SEQ ID NO: 411924 - DNA, 20 bp, mouse
gtgtgaggacagatgtagaa

SEQ ID NO: 411925 - DNA, 20 bp, mouse
ggcttcagacaggaatccca

SEQ ID NO: 411926 - DNA, 20 bp, mouse
gtggctggagcaggcagcaa

SEQ ID NO: 411927 - DNA, 20 bp, mouse
gccacgcgccctgcacaata

SEQ ID NO: 411928 - DNA, 20 bp, mouse
gccagccgttacctccatcc

SEQ ID NO: 411929 - DNA, 20 bp, mouse
gaccttggctacccggatgg

SEQ ID NO: 411930 - DNA, 20 bp, mouse
gctccagtaggcctccatgt

SEQ ID NO: 411931 - DNA, 20 bp, mouse
ggagaccttggctacccgga

SEQ ID NO: 411932 - DNA, 20 bp, mouse
ggtgttgctgggattgaggg

SEQ ID NO: 411933 - DNA, 20 bp, mouse
ggcgccctgcacaatatggc

SEQ ID NO: 411934 - DNA, 20 bp, mouse
gcggagagaccttggctacc

SEQ ID NO: 411935 - DNA, 20 bp, mouse
ggctccagccatattgtgca

SEQ ID NO: 411936 - DNA, 20 bp, mouse
ggaccagaagaccatcccct

SEQ ID NO: 411937 - DNA, 20 bp, mouse
ggatacagacctaccttact

SEQ ID NO: 411938 - DNA, 20 bp, mouse
gctggccctggttatcccag

SEQ ID NO: 411939 - DNA, 20 bp, mouse
gttcattaacccagtaaggt

SEQ ID NO: 411940 - DNA, 20 bp, mouse
gcttgggttaacctctagaa

SEQ ID NO: 411941 - DNA, 20 bp, mouse
gaagattcattaacccagta

SEQ ID NO: 411942 - DNA, 20 bp, mouse
gttcagatccgagtactata

SEQ ID NO: 411943 - DNA, 20 bp, mouse
gccgagtactatagggtaca

SEQ ID NO: 411944 - DNA, 20 bp, mouse
gtagcctaggtattggatat

SEQ ID NO: 411945 - DNA, 20 bp, mouse
ggtcttctggtcctttctag

SEQ ID NO: 411946 - DNA, 20 bp, mouse
ggccgaagcctgaaaaggtg

SEQ ID NO: 411947 - DNA, 20 bp, mouse
gggacgtccgccctactcca

SEQ ID NO: 411948 - DNA, 20 bp, mouse
gagggagccgaagcctgaaa

SEQ ID NO: 411949 - DNA, 20 bp, mouse
gcagcccgggctcccagggt

SEQ ID NO: 411950 - DNA, 20 bp, mouse
gtgggtgctgccccccaggg

SEQ ID NO: 411951 - DNA, 20 bp, mouse
ggccgcagcccgggctccca

SEQ ID NO: 411952 - DNA, 20 bp, mouse
ggctggcccgctgcagtgta

SEQ ID NO: 411953 - DNA, 20 bp, mouse
gcgtctcccctggagtaggg

SEQ ID NO: 411954 - DNA, 20 bp, mouse
gcaacgtctcccctggagta

SEQ ID NO: 411955 - DNA, 20 bp, mouse
ggaaaaggtgcggcatggcc

SEQ ID NO: 411956 - DNA, 20 bp, mouse
gactacacgagaggacagag

SEQ ID NO: 411957 - DNA, 20 bp, mouse
gtcctggacacttggaactg

SEQ ID NO: 411958 - DNA, 20 bp, mouse
gcaggctccaatgacatcca

SEQ ID NO: 411959 - DNA, 20 bp, mouse
ggattctccctggatgtcat

SEQ ID NO: 411960 - DNA, 20 bp, mouse
gaactgtggtactacacgag

SEQ ID NO: 411961 - DNA, 20 bp, mouse
gtccagtctggaccctgaag

SEQ ID NO: 411962 - DNA, 20 bp, mouse
gaggacagagaggtgagact

SEQ ID NO: 411963 - DNA, 20 bp, mouse
gatccagggagaatctacca

SEQ ID NO: 411964 - DNA, 20 bp, mouse
gctagaggttcatcagaccc

SEQ ID NO: 411965 - DNA, 20 bp, mouse
gtgaagccatcctggacact

SEQ ID NO: 411966 - DNA, 20 bp, mouse
gagaagccaggtagttgcta

SEQ ID NO: 411967 - DNA, 20 bp, mouse
ggatgcagggcaagaagata

SEQ ID NO: 411968 - DNA, 20 bp, mouse
gtctccttgcctcctttgtt

SEQ ID NO: 411969 - DNA, 20 bp, mouse
gctggtccacccccacagga

SEQ ID NO: 411970 - DNA, 20 bp, mouse
gaacttccttagcaactacc

SEQ ID NO: 411971 - DNA, 20 bp, mouse
gtttttggagccatggctga

SEQ ID NO: 411972 - DNA, 20 bp, mouse
ggaggacaggctggcccggt

SEQ ID NO: 411973 - DNA, 20 bp, mouse
gaatgaagcagggaaggata

SEQ ID NO: 411974 - DNA, 20 bp, mouse
gaaccctgcgagtgctgaga

SEQ ID NO: 411975 - DNA, 20 bp, mouse
gactccagagttggccatgg

SEQ ID NO: 411976 - DNA, 20 bp, mouse
gaccagaccactatgaatca

SEQ ID NO: 411977 - DNA, 20 bp, mouse
gtcaaggaacatcatcagga

SEQ ID NO: 411978 - DNA, 20 bp, mouse
gcaccaaaaaggactaataa

SEQ ID NO: 411979 - DNA, 20 bp, mouse
ggatgttccttgattcatag

SEQ ID NO: 411980 - DNA, 20 bp, mouse
gagctccaggagttcaacaa

SEQ ID NO: 411981 - DNA, 20 bp, mouse
ggtcttgggtttggatgtcg

SEQ ID NO: 411982 - DNA, 20 bp, mouse
gtccttgattcatagtggtc

SEQ ID NO: 411983 - DNA, 20 bp, mouse
gtccaaacccaagacagtga

SEQ ID NO: 411984 - DNA, 20 bp, mouse
gtttggaacaggatttacga

SEQ ID NO: 411985 - DNA, 20 bp, mouse
ggcatgctaaccaaagacct

SEQ ID NO: 411986 - DNA, 20 bp, mouse
ggtgagagcaggggccccgt

SEQ ID NO: 411987 - DNA, 20 bp, mouse
ggggatgctcaagccagcgg

SEQ ID NO: 411988 - DNA, 20 bp, mouse
ggcatccccagggaaccagg

SEQ ID NO: 411989 - DNA, 20 bp, mouse
ggggccccgtgggaagtgaa

SEQ ID NO: 411990 - DNA, 20 bp, mouse
gagagccgcctggttccctg

SEQ ID NO: 411991 - DNA, 20 bp, mouse
ggctggcttgagcatcccca

SEQ ID NO: 411992 - DNA, 20 bp, mouse
gcccctgctctcacctccgc

SEQ ID NO: 411993 - DNA, 20 bp, mouse
gtcggaagaaaggcaggaca

SEQ ID NO: 411994 - DNA, 20 bp, mouse
gagccagggtgatctcacaa

SEQ ID NO: 411995 - DNA, 20 bp, mouse
ggctttggatgggggcacga

SEQ ID NO: 411996 - DNA, 20 bp, mouse
gtggcttcagggtcttccaa

SEQ ID NO: 411997 - DNA, 20 bp, mouse
gaaccaccataagtagcagg

SEQ ID NO: 411998 - DNA, 20 bp, mouse
gtatggtggttgggaaggag

SEQ ID NO: 411999 - DNA, 20 bp, mouse
gtgccccctgctacttatgg

SEQ ID NO: 412000 - DNA, 20 bp, mouse
gctatgccccctgctactta

SEQ ID NO: 412001 - DNA, 20 bp, mouse
gtcagctgtgttgtccgagg

SEQ ID NO: 412002 - DNA, 20 bp, mouse
gggagtggcttggccctgct

SEQ ID NO: 412003 - DNA, 20 bp, mouse
gtgttgtccgaggaggcctc

SEQ ID NO: 412004 - DNA, 20 bp, mouse
gtggacaactgagcctagca

SEQ ID NO: 412005 - DNA, 20 bp, mouse
gttcgtcgatgtctcctggt

SEQ ID NO: 412006 - DNA, 20 bp, mouse
gtggtcacccaagtgggagg

SEQ ID NO: 412007 - DNA, 20 bp, mouse
ggaatggtcacccaagtggg

SEQ ID NO: 412008 - DNA, 20 bp, mouse
gctagaatggtcacccaagt

SEQ ID NO: 412009 - DNA, 20 bp, mouse
gctggctgaagtcccagggg

SEQ ID NO: 412010 - DNA, 20 bp, mouse
gggccttggcagacactcaa

SEQ ID NO: 412011 - DNA, 20 bp, mouse
gcagacccctgggaaggagt

SEQ ID NO: 412012 - DNA, 20 bp, mouse
ggagtgggatggctttagaa

SEQ ID NO: 412013 - DNA, 20 bp, mouse
ggctcctggacagtatccta

SEQ ID NO: 412014 - DNA, 20 bp, mouse
gctccaggatccagacccct

SEQ ID NO: 412015 - DNA, 20 bp, mouse
ggccatcccactccttccca

SEQ ID NO: 412016 - DNA, 20 bp, mouse
ggaacaggcagtacagcatt

SEQ ID NO: 412017 - DNA, 20 bp, mouse
gcatcccagtccctgaccag

SEQ ID NO: 412018 - DNA, 20 bp, mouse
gctgtactgcctgttccctc

SEQ ID NO: 412019 - DNA, 20 bp, mouse
gtggtgagtggggctagaaa

SEQ ID NO: 412020 - DNA, 20 bp, mouse
gggtccgaacaagcaaagat

SEQ ID NO: 412021 - DNA, 20 bp, mouse
gaagataggagaactgatgg

SEQ ID NO: 412022 - DNA, 20 bp, mouse
gaaaccatgtggagttctat

SEQ ID NO: 412023 - DNA, 20 bp, mouse
gagtggggctagaaagggtg

SEQ ID NO: 412024 - DNA, 20 bp, mouse
gggattgtagaagcacagat

SEQ ID NO: 412025 - DNA, 20 bp, mouse
ggttccctctggtcagggac

SEQ ID NO: 412026 - DNA, 20 bp, mouse
gagtagggcccgaggtctgt

SEQ ID NO: 412027 - DNA, 20 bp, mouse
gggcccgaggtctgtcggtg

SEQ ID NO: 412028 - DNA, 20 bp, mouse
gtggccgtgtgaccccacgg

SEQ ID NO: 412029 - DNA, 20 bp, mouse
gcaccccaccgacagacctc

SEQ ID NO: 412030 - DNA, 20 bp, mouse
gcggaggcccgtgggaacca

SEQ ID NO: 412031 - DNA, 20 bp, mouse
ggtgtggccgtgtgacccca

SEQ ID NO: 412032 - DNA, 20 bp, mouse
gctgggaggtcacctccgtg

SEQ ID NO: 412033 - DNA, 20 bp, mouse
gaggatcagcgcatacactg

SEQ ID NO: 412034 - DNA, 20 bp, mouse
ggttctggaagtagggcccg

SEQ ID NO: 412035 - DNA, 20 bp, mouse
gtcacctccgtggggtcaca

SEQ ID NO: 412036 - DNA, 20 bp, mouse
gaggtagggagactagacaa

SEQ ID NO: 412037 - DNA, 20 bp, mouse
ggtgctgtgaggacaaggta

SEQ ID NO: 412038 - DNA, 20 bp, mouse
ggagactagacaaggggtag

SEQ ID NO: 412039 - DNA, 20 bp, mouse
gtccagtaaaacaacgaaat

SEQ ID NO: 412040 - DNA, 20 bp, mouse
ggtagagggtctgaaggtcc

SEQ ID NO: 412041 - DNA, 20 bp, mouse
gggaggaaacaggagctcat

SEQ ID NO: 412042 - DNA, 20 bp, mouse
gatttcagtagagggtctga

SEQ ID NO: 412043 - DNA, 20 bp, mouse
ggagaaagaaagtggagatg

SEQ ID NO: 412044 - DNA, 20 bp, mouse
gtcacagggagggattggtt

SEQ ID NO: 412045 - DNA, 20 bp, mouse
gctggaaggagatcacaggg

SEQ ID NO: 412046 - DNA, 20 bp, mouse
gtgttcagggacgaagatgg

SEQ ID NO: 412047 - DNA, 20 bp, mouse
gctagcatggagacactcca

SEQ ID NO: 412048 - DNA, 20 bp, mouse
gagccgtgagtgactgacag

SEQ ID NO: 412049 - DNA, 20 bp, mouse
gcacagggagatggatgttc

SEQ ID NO: 412050 - DNA, 20 bp, mouse
ggtttgtgtttgcaacccac

SEQ ID NO: 412051 - DNA, 20 bp, mouse
gtgcccctgtcagtcactca

SEQ ID NO: 412052 - DNA, 20 bp, mouse
ggtctattcatccccaggaa

SEQ ID NO: 412053 - DNA, 20 bp, mouse
gccccaggaatggctgggac

SEQ ID NO: 412054 - DNA, 20 bp, mouse
gttcatccccaggaatggct

SEQ ID NO: 412055 - DNA, 20 bp, mouse
ggtgcaagagacaaagccac

SEQ ID NO: 412056 - DNA, 20 bp, mouse
gtgagccggcgggccagtag

SEQ ID NO: 412057 - DNA, 20 bp, mouse
gcagtccgctggtccctccc

SEQ ID NO: 412058 - DNA, 20 bp, mouse
gggtcggcgcggtccgggga

SEQ ID NO: 412059 - DNA, 20 bp, mouse
gggtggctcccgcctgcggt

SEQ ID NO: 412060 - DNA, 20 bp, mouse
gggaccgcgccgaccgcagg

SEQ ID NO: 412061 - DNA, 20 bp, mouse
gcaggtgagtgcgcccctac

SEQ ID NO: 412062 - DNA, 20 bp, mouse
gcccggaccgcgccgaccgc

SEQ ID NO: 412063 - DNA, 20 bp, mouse
gcggaggtggctcccgcctg

SEQ ID NO: 412064 - DNA, 20 bp, mouse
gggcggggcaggtgcggagg

SEQ ID NO: 412065 - DNA, 20 bp, mouse
gagggaccagcggactgcgc

SEQ ID NO: 412066 - DNA, 20 bp, mouse
ggcggagaccgcgggagcca

SEQ ID NO: 412067 - DNA, 20 bp, mouse
gttctgcgccatggctcccg

SEQ ID NO: 412068 - DNA, 20 bp, mouse
gattaaggactcatagtcta

SEQ ID NO: 412069 - DNA, 20 bp, mouse
gggcaggagcacacgggttt

SEQ ID NO: 412070 - DNA, 20 bp, mouse
gtttgggtttgcggagaccg

SEQ ID NO: 412071 - DNA, 20 bp, mouse
ggcaaccggtctcccagcaa

SEQ ID NO: 412072 - DNA, 20 bp, mouse
gacaagtcgagtatacacca

SEQ ID NO: 412073 - DNA, 20 bp, mouse
gagcaacgggactataatta

SEQ ID NO: 412074 - DNA, 20 bp, mouse
gagtcgagtatacaccaggg

SEQ ID NO: 412075 - DNA, 20 bp, mouse
gaggactcatagtctaaggc

SEQ ID NO: 412076 - DNA, 20 bp, mouse
gcccggagcaccctcaagag

SEQ ID NO: 412077 - DNA, 20 bp, mouse
gcctgacagcgacagagtca

SEQ ID NO: 412078 - DNA, 20 bp, mouse
gagcaccctcaagagagggg

SEQ ID NO: 412079 - DNA, 20 bp, mouse
ggcgggagcacagggagact

SEQ ID NO: 412080 - DNA, 20 bp, mouse
gtgggagcggctggcagtcg

SEQ ID NO: 412081 - DNA, 20 bp, mouse
gcaggccgcttcgaccgcca

SEQ ID NO: 412082 - DNA, 20 bp, mouse
ggcgcgggaatggatcttgg

SEQ ID NO: 412083 - DNA, 20 bp, mouse
gtccaagaggagggactggt

SEQ ID NO: 412084 - DNA, 20 bp, mouse
gagggcgcgggaatggatct

SEQ ID NO: 412085 - DNA, 20 bp, mouse
gagggacggtgagcaactgt

SEQ ID NO: 412086 - DNA, 20 bp, mouse
gtcttgtagaggcgaatgtt

SEQ ID NO: 412087 - DNA, 20 bp, mouse
gggatctaaactgaccctga

SEQ ID NO: 412088 - DNA, 20 bp, mouse
gggaggaaactcatccccaa

SEQ ID NO: 412089 - DNA, 20 bp, mouse
gagataggcagtatcaggct

SEQ ID NO: 412090 - DNA, 20 bp, mouse
gtactaaggtaacagaactt

SEQ ID NO: 412091 - DNA, 20 bp, mouse
gtcgcctctacaagaaccaa

SEQ ID NO: 412092 - DNA, 20 bp, mouse
ggagcctttggttcttgtag

SEQ ID NO: 412093 - DNA, 20 bp, mouse
gtcaggcttggacgccattg

SEQ ID NO: 412094 - DNA, 20 bp, mouse
ggcccctgcctaatacacca

SEQ ID NO: 412095 - DNA, 20 bp, mouse
gagagccgatcgttgatcag

SEQ ID NO: 412096 - DNA, 20 bp, mouse
gttagggctaaggaagatat

SEQ ID NO: 412097 - DNA, 20 bp, mouse
gatggtggcagctcagaggg

SEQ ID NO: 412098 - DNA, 20 bp, mouse
gtgccagaaggcttgcttta

SEQ ID NO: 412099 - DNA, 20 bp, mouse
gttggcagatccgaagatgg

SEQ ID NO: 412100 - DNA, 20 bp, mouse
gcagattccctggactatgg

SEQ ID NO: 412101 - DNA, 20 bp, mouse
gaaatggaatggctgccaga

SEQ ID NO: 412102 - DNA, 20 bp, mouse
ggacccatgtccaaggtcag

SEQ ID NO: 412103 - DNA, 20 bp, mouse
gtacctgcctccatagtcca

SEQ ID NO: 412104 - DNA, 20 bp, mouse
gaaggcttgctttagggcta

SEQ ID NO: 412105 - DNA, 20 bp, mouse
gaaatgacacaaggcaaggt

SEQ ID NO: 412106 - DNA, 20 bp, mouse
gaccagggcaacagtccagt

SEQ ID NO: 412107 - DNA, 20 bp, mouse
gagtgggctgatcctcactg

SEQ ID NO: 412108 - DNA, 20 bp, mouse
ggtggacttcagacaggctt

SEQ ID NO: 412109 - DNA, 20 bp, mouse
gacagcattgtcattcctac

SEQ ID NO: 412110 - DNA, 20 bp, mouse
gatacagtctacacactgac

SEQ ID NO: 412111 - DNA, 20 bp, mouse
gccatgacctggcttgacct

SEQ ID NO: 412112 - DNA, 20 bp, mouse
gctcccaggaggctgtcagg

SEQ ID NO: 412113 - DNA, 20 bp, mouse
gtgtcccagtgcctcccagg

SEQ ID NO: 412114 - DNA, 20 bp, mouse
ggaaaacacgaggctggaca

SEQ ID NO: 412115 - DNA, 20 bp, mouse
gtcatggctctcacagtcca

SEQ ID NO: 412116 - DNA, 20 bp, mouse
ggcggagctgaggctgtccc

SEQ ID NO: 412117 - DNA, 20 bp, mouse
gggagtggacaggtgattcg

SEQ ID NO: 412118 - DNA, 20 bp, mouse
gtccgcgaactgagtttggg

SEQ ID NO: 412119 - DNA, 20 bp, mouse
gtccaggagcctgagcacaa

SEQ ID NO: 412120 - DNA, 20 bp, mouse
gcactccgcgaactgagttt

SEQ ID NO: 412121 - DNA, 20 bp, mouse
gctcagttcgcggagtggac

SEQ ID NO: 412122 - DNA, 20 bp, mouse
ggccgcccaaactcagttcg

SEQ ID NO: 412123 - DNA, 20 bp, mouse
ggctgtcccgggcagggcgc

SEQ ID NO: 412124 - DNA, 20 bp, mouse
gggtagccggagcttctaac

SEQ ID NO: 412125 - DNA, 20 bp, mouse
gagctgaggctgtcccgggc

SEQ ID NO: 412126 - DNA, 20 bp, mouse
gctcagggcgcacagatcgc

SEQ ID NO: 412127 - DNA, 20 bp, mouse
ggggcgcacagatcgcaggt

SEQ ID NO: 412128 - DNA, 20 bp, mouse
gcaggttggttgctgcctca

SEQ ID NO: 412129 - DNA, 20 bp, mouse
gatgaggcttcgcgatctca

SEQ ID NO: 412130 - DNA, 20 bp, mouse
gttggttgctgcctcagggt

SEQ ID NO: 412131 - DNA, 20 bp, mouse
ggtcagcgcaccagaggcca

SEQ ID NO: 412132 - DNA, 20 bp, mouse
gagcaaggcggggcttgttt

SEQ ID NO: 412133 - DNA, 20 bp, mouse
gccttccatgcacacaggag

SEQ ID NO: 412134 - DNA, 20 bp, mouse
ggcctcagggtcgggggtca

SEQ ID NO: 412135 - DNA, 20 bp, mouse
gggtcaggggcgggaggttt

SEQ ID NO: 412136 - DNA, 20 bp, mouse
ggaggcctggggaccatgga

SEQ ID NO: 412137 - DNA, 20 bp, mouse
gggggctaggagagaatcct

SEQ ID NO: 412138 - DNA, 20 bp, mouse
gagaatcctgggttcagaat

SEQ ID NO: 412139 - DNA, 20 bp, mouse
gccagggagcttaccctcca

SEQ ID NO: 412140 - DNA, 20 bp, mouse
gtctcccacggcacctgtgg

SEQ ID NO: 412141 - DNA, 20 bp, mouse
gccagggccagaggaggcct

SEQ ID NO: 412142 - DNA, 20 bp, mouse
gaggggcctggggtctccca

SEQ ID NO: 412143 - DNA, 20 bp, mouse
gtagggcacaggacacttat

SEQ ID NO: 412144 - DNA, 20 bp, mouse
ggggtaagctccctggggct

SEQ ID NO: 412145 - DNA, 20 bp, mouse
gagtgtcactagggcatcag

SEQ ID NO: 412146 - DNA, 20 bp, mouse
ggcaaccctttccagctgta

SEQ ID NO: 412147 - DNA, 20 bp, mouse
gcctctccataccatacagc

SEQ ID NO: 412148 - DNA, 20 bp, mouse
gaggataggctgtttttttt

SEQ ID NO: 412149 - DNA, 20 bp, mouse
gctggaaagggttgctgtca

SEQ ID NO: 412150 - DNA, 20 bp, mouse
gactggagtctgaggaccag

SEQ ID NO: 412151 - DNA, 20 bp, mouse
gatcatggctctccatccac

SEQ ID NO: 412152 - DNA, 20 bp, mouse
gtgtggggctcttggaggtc

SEQ ID NO: 412153 - DNA, 20 bp, mouse
gaagctagcagtgaccaact

SEQ ID NO: 412154 - DNA, 20 bp, mouse
gtggtatggagaggtgactc

SEQ ID NO: 412155 - DNA, 20 bp, mouse
gtcctcacctcctgacacag

SEQ ID NO: 412156 - DNA, 20 bp, mouse
gtggctgagagaggttgtca

SEQ ID NO: 412157 - DNA, 20 bp, mouse
gacaggcccactgcgctgta

SEQ ID NO: 412158 - DNA, 20 bp, mouse
gcaggcatggtgctttgtcc

SEQ ID NO: 412159 - DNA, 20 bp, mouse
gctgtagggcccatagcgca

SEQ ID NO: 412160 - DNA, 20 bp, mouse
gggaaggaggtactttactg

SEQ ID NO: 412161 - DNA, 20 bp, mouse
gggagagaaggtctaagtag

SEQ ID NO: 412162 - DNA, 20 bp, mouse
gtgcagaccctgcagtcggt

SEQ ID NO: 412163 - DNA, 20 bp, mouse
gggtgcggtgctccacggac

SEQ ID NO: 412164 - DNA, 20 bp, mouse
gcggtggtgaccttgcgcta

SEQ ID NO: 412165 - DNA, 20 bp, mouse
gtatgggccctacagcgcag

SEQ ID NO: 412166 - DNA, 20 bp, mouse
gttgtcctttaggaatggag

SEQ ID NO: 412167 - DNA, 20 bp, mouse
gggagaaacaacatctacaa

SEQ ID NO: 412168 - DNA, 20 bp, mouse
gagggccagaggatgtcggt

SEQ ID NO: 412169 - DNA, 20 bp, mouse
ggagaagggccagaggatgt

SEQ ID NO: 412170 - DNA, 20 bp, mouse
gttctcctctccattcctaa

SEQ ID NO: 412171 - DNA, 20 bp, mouse
ggtgacacatcactataagt

SEQ ID NO: 412172 - DNA, 20 bp, mouse
gtctccttgtcctttaggaa

SEQ ID NO: 412173 - DNA, 20 bp, mouse
gagcattgtcttttgaaggt

SEQ ID NO: 412174 - DNA, 20 bp, mouse
gtgcctgctggatatctcct

SEQ ID NO: 412175 - DNA, 20 bp, mouse
gacagccaaccgacatcctc

SEQ ID NO: 412176 - DNA, 20 bp, mouse
gactgcaagctggctggcgg

SEQ ID NO: 412177 - DNA, 20 bp, mouse
gggccccaggatccaactct

SEQ ID NO: 412178 - DNA, 20 bp, mouse
ggtgactgcaagctggctgg

SEQ ID NO: 412179 - DNA, 20 bp, mouse
gctgcctaggaggaccacaa

SEQ ID NO: 412180 - DNA, 20 bp, mouse
ggcggaggcgagagcattgt

SEQ ID NO: 412181 - DNA, 20 bp, mouse
gaggcgaagtgactgcaagc

SEQ ID NO: 412182 - DNA, 20 bp, mouse
ggaagtgactgcaagctggc

SEQ ID NO: 412183 - DNA, 20 bp, mouse
gtccaaaggaggaagctcta

SEQ ID NO: 412184 - DNA, 20 bp, mouse
gcttcccagagttggatcct

SEQ ID NO: 412185 - DNA, 20 bp, mouse
gagcccaggtggagcaggtg

SEQ ID NO: 412186 - DNA, 20 bp, mouse
gtggattggtggacaaggac

SEQ ID NO: 412187 - DNA, 20 bp, mouse
ggtgcccagagtcactggat

SEQ ID NO: 412188 - DNA, 20 bp, mouse
ggctggtcaacctgactccc

SEQ ID NO: 412189 - DNA, 20 bp, mouse
ggcttttacgcccctaacct

SEQ ID NO: 412190 - DNA, 20 bp, mouse
gcaacctgactcccaggtta

SEQ ID NO: 412191 - DNA, 20 bp, mouse
gcgcccctaacctgggagtc

SEQ ID NO: 412192 - DNA, 20 bp, mouse
gcccacccagcagggggaca

SEQ ID NO: 412193 - DNA, 20 bp, mouse
ggcaagcacgtgctgctcca

SEQ ID NO: 412194 - DNA, 20 bp, mouse
gcaccttccctaggccaggg

SEQ ID NO: 412195 - DNA, 20 bp, mouse
gcttctggtagccacaatgg

SEQ ID NO: 412196 - DNA, 20 bp, mouse
gatccgcaagaggtaatgag

SEQ ID NO: 412197 - DNA, 20 bp, mouse
gcacgtggcacccttcacca

SEQ ID NO: 412198 - DNA, 20 bp, mouse
gaatgaggggcacatgaagg

SEQ ID NO: 412199 - DNA, 20 bp, mouse
gggtaatgaggggcacatga

SEQ ID NO: 412200 - DNA, 20 bp, mouse
gcacctggagggttgtactg

SEQ ID NO: 412201 - DNA, 20 bp, mouse
ggctgcgctggatccgcaag

SEQ ID NO: 412202 - DNA, 20 bp, mouse
gtcagagcaaccgtggtgaa

SEQ ID NO: 412203 - DNA, 20 bp, mouse
gaacagaccacattaaggac

SEQ ID NO: 412204 - DNA, 20 bp, mouse
gttgtgtctcagagcaaccg

SEQ ID NO: 412205 - DNA, 20 bp, mouse
gctgcgtggccctcctcacg

SEQ ID NO: 412206 - DNA, 20 bp, mouse
gggaacggccccccgggagt

SEQ ID NO: 412207 - DNA, 20 bp, mouse
ggagccccggccacactgta

SEQ ID NO: 412208 - DNA, 20 bp, mouse
gctccctgcccactcccggg

SEQ ID NO: 412209 - DNA, 20 bp, mouse
gcggcggccgcgccacggaa

SEQ ID NO: 412210 - DNA, 20 bp, mouse
gactcggagcgaggagggag

SEQ ID NO: 412211 - DNA, 20 bp, mouse
gcgccacggaacggcccccc

SEQ ID NO: 412212 - DNA, 20 bp, mouse
ggagcgggagctggcagact

SEQ ID NO: 412213 - DNA, 20 bp, mouse
ggagtgggcagggagcgagc

SEQ ID NO: 412214 - DNA, 20 bp, mouse
gggccccccgggagtgggca

SEQ ID NO: 412215 - DNA, 20 bp, mouse
gggcagactcggagcgagga

SEQ ID NO: 412216 - DNA, 20 bp, mouse
gctggctttcaagagagcaa

SEQ ID NO: 412217 - DNA, 20 bp, mouse
gcgatggcgcagaacgtgta

SEQ ID NO: 412218 - DNA, 20 bp, mouse
gatggtcctggagtgcggat

SEQ ID NO: 412219 - DNA, 20 bp, mouse
gtcaagagagcaaggggcga

SEQ ID NO: 412220 - DNA, 20 bp, mouse
gtctgagtgtcagtggaggc

SEQ ID NO: 412221 - DNA, 20 bp, mouse
gcgcagaacgtgtatggtcc

SEQ ID NO: 412222 - DNA, 20 bp, mouse
gacagcaggtgaactacctc

SEQ ID NO: 412223 - DNA, 20 bp, mouse
ggatagggtctgggatccta

SEQ ID NO: 412224 - DNA, 20 bp, mouse
gaggtgcacagggggggtgg

SEQ ID NO: 412225 - DNA, 20 bp, mouse
gcgtgtatggtcctggagtg

SEQ ID NO: 412226 - DNA, 20 bp, mouse
gcggggccgcacacccacgg

SEQ ID NO: 412227 - DNA, 20 bp, mouse
gggaggcactgcaagcttct

SEQ ID NO: 412228 - DNA, 20 bp, mouse
ggccagtccaagtcaaacca

SEQ ID NO: 412229 - DNA, 20 bp, mouse
gaagcttgcagtgcctccgt

SEQ ID NO: 412230 - DNA, 20 bp, mouse
gggcaagggtggcatcgtgg

SEQ ID NO: 412231 - DNA, 20 bp, mouse
ggacttgtggctatcatcgt

SEQ ID NO: 412232 - DNA, 20 bp, mouse
gtgggcactctgtgaggcga

SEQ ID NO: 412233 - DNA, 20 bp, mouse
gtgtgtagtaacccagaggg

SEQ ID NO: 412234 - DNA, 20 bp, mouse
gagtcaaaccagggtaaagg

SEQ ID NO: 412235 - DNA, 20 bp, mouse
ggctccatccccctttaccc

SEQ ID NO: 412236 - DNA, 20 bp, mouse
gcactcacgaaggcttacgg

SEQ ID NO: 412237 - DNA, 20 bp, mouse
gacagcagggtcactcacga

SEQ ID NO: 412238 - DNA, 20 bp, mouse
gcagttggaggggttccaag

SEQ ID NO: 412239 - DNA, 20 bp, mouse
gagcagccctgggaattgac

SEQ ID NO: 412240 - DNA, 20 bp, mouse
gtagcccagccctaacagca

SEQ ID NO: 412241 - DNA, 20 bp, mouse
ggtgagtgaccctgctgtta

SEQ ID NO: 412242 - DNA, 20 bp, mouse
gggtcactcacgaaggctta

SEQ ID NO: 412243 - DNA, 20 bp, mouse
ggcctggctagatcagggtg

SEQ ID NO: 412244 - DNA, 20 bp, mouse
ggctaggcctggctagatca

SEQ ID NO: 412245 - DNA, 20 bp, mouse
gtgggctagtggggactgga

SEQ ID NO: 412246 - DNA, 20 bp, mouse
gcccagtccaccgggcgcta

SEQ ID NO: 412247 - DNA, 20 bp, mouse
gagtccaccgggcgctaggg

SEQ ID NO: 412248 - DNA, 20 bp, mouse
gggaggagcgaagtgcagca

SEQ ID NO: 412249 - DNA, 20 bp, mouse
gtcgggaagcccagtccacc

SEQ ID NO: 412250 - DNA, 20 bp, mouse
gcccttgagaggccctgaca

SEQ ID NO: 412251 - DNA, 20 bp, mouse
ggctcctccctagcgcccgg

SEQ ID NO: 412252 - DNA, 20 bp, mouse
ggcggctctacaatcccaca

SEQ ID NO: 412253 - DNA, 20 bp, mouse
gggcttgcggcaccacccgc

SEQ ID NO: 412254 - DNA, 20 bp, mouse
gggcaggcccgaggtgcagg

SEQ ID NO: 412255 - DNA, 20 bp, mouse
gcaccgggagaaacaaactg

SEQ ID NO: 412256 - DNA, 20 bp, mouse
gtagagctggacgggcgctg

SEQ ID NO: 412257 - DNA, 20 bp, mouse
gcgtccagctctacattata

SEQ ID NO: 412258 - DNA, 20 bp, mouse
gaccaggaatacaccaacac

SEQ ID NO: 412259 - DNA, 20 bp, mouse
gcattatacggacaaagatt

SEQ ID NO: 412260 - DNA, 20 bp, mouse
gtcaactgtagcgcaggcat

SEQ ID NO: 412261 - DNA, 20 bp, mouse
gtcgtgacattggctatcaa

SEQ ID NO: 412262 - DNA, 20 bp, mouse
gaaatactcggagccagtgt

SEQ ID NO: 412263 - DNA, 20 bp, mouse
gagttcttgggtcctaggga

SEQ ID NO: 412264 - DNA, 20 bp, mouse
gtgtccgtataatgtagagc

SEQ ID NO: 412265 - DNA, 20 bp, mouse
ggccagtgttggtgtattcc

SEQ ID NO: 412266 - DNA, 20 bp, mouse
gtgtttgttgatttaaaagg

SEQ ID NO: 412267 - DNA, 20 bp, mouse
gtgacaaggaaatgagctcc

SEQ ID NO: 412268 - DNA, 20 bp, mouse
gtgccaagtggcaccccaaa

SEQ ID NO: 412269 - DNA, 20 bp, mouse
ggtaatagggaagtagggta

SEQ ID NO: 412270 - DNA, 20 bp, mouse
gagggtgcaacaaaagaagt

SEQ ID NO: 412271 - DNA, 20 bp, mouse
gaagggcgagcagtacaata

SEQ ID NO: 412272 - DNA, 20 bp, mouse
gcaggctgtaatagggaagt

SEQ ID NO: 412273 - DNA, 20 bp, mouse
gccttgtttgttgatttaaa

SEQ ID NO: 412274 - DNA, 20 bp, mouse
gctaacttcaggctgtaata

SEQ ID NO: 412275 - DNA, 20 bp, mouse
gagttatggagagccttttg

SEQ ID NO: 412276 - DNA, 20 bp, mouse
gaggctggcagagatgcctt

SEQ ID NO: 412277 - DNA, 20 bp, mouse
gcgccgcgcacaggaagcac

SEQ ID NO: 412278 - DNA, 20 bp, mouse
gtacgcaaggagctaggtaa

SEQ ID NO: 412279 - DNA, 20 bp, mouse
ggaaggaccccgccgcgcac

SEQ ID NO: 412280 - DNA, 20 bp, mouse
gggtggcttgcaccagaagg

SEQ ID NO: 412281 - DNA, 20 bp, mouse
gtgacggggcggaactccag

SEQ ID NO: 412282 - DNA, 20 bp, mouse
gttctccatcctgacccaga

SEQ ID NO: 412283 - DNA, 20 bp, mouse
gagggcagggcgccaggccc

SEQ ID NO: 412284 - DNA, 20 bp, mouse
ggcttcctgatgcagactgg

SEQ ID NO: 412285 - DNA, 20 bp, mouse
gccctccttccctctgggtc

SEQ ID NO: 412286 - DNA, 20 bp, mouse
ggagactgagtccagccctg

SEQ ID NO: 412287 - DNA, 20 bp, mouse
ggagtgcgcctgccaagatg

SEQ ID NO: 412288 - DNA, 20 bp, mouse
ggcagatagcccccacagca

SEQ ID NO: 412289 - DNA, 20 bp, mouse
gagccctagcggacctctaa

SEQ ID NO: 412290 - DNA, 20 bp, mouse
gtgccaagatgaggtaaaaa

SEQ ID NO: 412291 - DNA, 20 bp, mouse
gcatccaccaggcctgagag

SEQ ID NO: 412292 - DNA, 20 bp, mouse
ggggctctgtaccccagggc

SEQ ID NO: 412293 - DNA, 20 bp, mouse
gtcaggcctggtggatggta

SEQ ID NO: 412294 - DNA, 20 bp, mouse
gagaggctgaccattatcct

SEQ ID NO: 412295 - DNA, 20 bp, mouse
ggaggctgcaacagttccag

SEQ ID NO: 412296 - DNA, 20 bp, mouse
gggcagcttgcggaactgtg

SEQ ID NO: 412297 - DNA, 20 bp, mouse
ggcggcctaacatgcgccag

SEQ ID NO: 412298 - DNA, 20 bp, mouse
gaggaaaggtagcttgaagt

SEQ ID NO: 412299 - DNA, 20 bp, mouse
ggcagagcccgaagagctcg

SEQ ID NO: 412300 - DNA, 20 bp, mouse
ggactcggcctcgcagacat

SEQ ID NO: 412301 - DNA, 20 bp, mouse
ggcctctgctgctgcgctct

SEQ ID NO: 412302 - DNA, 20 bp, mouse
gtgaagtaggcaggtagcta

SEQ ID NO: 412303 - DNA, 20 bp, mouse
gatgcgccagcggcagcttg

SEQ ID NO: 412304 - DNA, 20 bp, mouse
ggctgccgctggcgcatgtt

SEQ ID NO: 412305 - DNA, 20 bp, mouse
gctgctgctgcgctctaggc

SEQ ID NO: 412306 - DNA, 20 bp, mouse
ggtcgtaaccatggaagtgt

SEQ ID NO: 412307 - DNA, 20 bp, mouse
gatggaggacccagatcccg

SEQ ID NO: 412308 - DNA, 20 bp, mouse
gcggaggagaagataacgga

SEQ ID NO: 412309 - DNA, 20 bp, mouse
gcgggtcgtcgtcgtaacca

SEQ ID NO: 412310 - DNA, 20 bp, mouse
gtagtgggggttggataggc

SEQ ID NO: 412311 - DNA, 20 bp, mouse
gcggtccgctgcggcccgaa

SEQ ID NO: 412312 - DNA, 20 bp, mouse
ggggttggataggcgggggc

SEQ ID NO: 412313 - DNA, 20 bp, mouse
gttggataggcgggggccgg

SEQ ID NO: 412314 - DNA, 20 bp, mouse
gatgacagctgcagtagtgg

SEQ ID NO: 412315 - DNA, 20 bp, mouse
ggggccggaggagaagataa

SEQ ID NO: 412316 - DNA, 20 bp, mouse
gttagagtgaggtcagaata

SEQ ID NO: 412317 - DNA, 20 bp, mouse
gagggcggcgtcgaggccag

SEQ ID NO: 412318 - DNA, 20 bp, mouse
ggccgcttacacttagagtg

SEQ ID NO: 412319 - DNA, 20 bp, mouse
ggaggccagcggctgggagg

SEQ ID NO: 412320 - DNA, 20 bp, mouse
gctctccgagggcggcgtcg

SEQ ID NO: 412321 - DNA, 20 bp, mouse
gcggcgtcgaggccagcggc

SEQ ID NO: 412322 - DNA, 20 bp, mouse
gccgtcactgccggcgctct

SEQ ID NO: 412323 - DNA, 20 bp, mouse
gctgccggcgctctgggaat

SEQ ID NO: 412324 - DNA, 20 bp, mouse
ggcgggacgggctgggaatg

SEQ ID NO: 412325 - DNA, 20 bp, mouse
gtatccgattcccagagcgc

SEQ ID NO: 412326 - DNA, 20 bp, mouse
gccgacgcggccgtaaccta

SEQ ID NO: 412327 - DNA, 20 bp, mouse
gccgcgaggtaaggaaggtc

SEQ ID NO: 412328 - DNA, 20 bp, mouse
ggcaacagcccggctcttgg

SEQ ID NO: 412329 - DNA, 20 bp, mouse
gcggggccgcgaggtaagga

SEQ ID NO: 412330 - DNA, 20 bp, mouse
gccccgtaggagcgtctgag

SEQ ID NO: 412331 - DNA, 20 bp, mouse
gcctacggggccgcgaggta

SEQ ID NO: 412332 - DNA, 20 bp, mouse
gggtccggagcggcaagtcg

SEQ ID NO: 412333 - DNA, 20 bp, mouse
gcctaggcccgcctccgacg

SEQ ID NO: 412334 - DNA, 20 bp, mouse
gagccgcttgggcctcaggg

SEQ ID NO: 412335 - DNA, 20 bp, mouse
gggtaagcgagacgaagatg

SEQ ID NO: 412336 - DNA, 20 bp, mouse
gctgaggcaaccgcacactg

SEQ ID NO: 412337 - DNA, 20 bp, mouse
gtagcgaggaaactgagtat

SEQ ID NO: 412338 - DNA, 20 bp, mouse
gggcttcagcctcaaagtat

SEQ ID NO: 412339 - DNA, 20 bp, mouse
gcactggggcctatactttg

SEQ ID NO: 412340 - DNA, 20 bp, mouse
ggtcacctgagtagctgcgt

SEQ ID NO: 412341 - DNA, 20 bp, mouse
gcctcatctggagagcgatg

SEQ ID NO: 412342 - DNA, 20 bp, mouse
ggcgttggcttcttcccgct

SEQ ID NO: 412343 - DNA, 20 bp, mouse
ggaagccaacgcagctactc

SEQ ID NO: 412344 - DNA, 20 bp, mouse
gccagagcaggtacagatat

SEQ ID NO: 412345 - DNA, 20 bp, mouse
ggacctcacagtgatcaagt

SEQ ID NO: 412346 - DNA, 20 bp, mouse
gtggctccctgggtcaaaca

SEQ ID NO: 412347 - DNA, 20 bp, mouse
gctcctagctatggctccct

SEQ ID NO: 412348 - DNA, 20 bp, mouse
gttatgccctgtttgaccca

SEQ ID NO: 412349 - DNA, 20 bp, mouse
gatgacagcatggtctgaag

SEQ ID NO: 412350 - DNA, 20 bp, mouse
gggagatagagcctcctctg

SEQ ID NO: 412351 - DNA, 20 bp, mouse
ggacaaacagcccccagagg

SEQ ID NO: 412352 - DNA, 20 bp, mouse
gaggctctatctcctagcta

SEQ ID NO: 412353 - DNA, 20 bp, mouse
gctgaggcaggaaagtggtg

SEQ ID NO: 412354 - DNA, 20 bp, mouse
gagggcataacattacaccc

SEQ ID NO: 412355 - DNA, 20 bp, mouse
gcagtttccaaggggatcaa

SEQ ID NO: 412356 - DNA, 20 bp, mouse
gcagccatgcccgaatatca

SEQ ID NO: 412357 - DNA, 20 bp, mouse
ggcagcatcctaggatcctg

SEQ ID NO: 412358 - DNA, 20 bp, mouse
gaatatcagggcagcatcct

SEQ ID NO: 412359 - DNA, 20 bp, mouse
ggtggacctgtggacagata

SEQ ID NO: 412360 - DNA, 20 bp, mouse
gtcgggcatggctggcccca

SEQ ID NO: 412361 - DNA, 20 bp, mouse
gctgccctgatattcgggca

SEQ ID NO: 412362 - DNA, 20 bp, mouse
gctacttctgatgcaatctg

SEQ ID NO: 412363 - DNA, 20 bp, mouse
ggaagcagcaagcaaaatac

SEQ ID NO: 412364 - DNA, 20 bp, mouse
gttttacacctgagagccac

SEQ ID NO: 412365 - DNA, 20 bp, mouse
ggttactcctgtgagagcat

SEQ ID NO: 412366 - DNA, 20 bp, mouse
gggccgggcgccggaccagg

SEQ ID NO: 412367 - DNA, 20 bp, mouse
gcaggaggagaccaacacgc

SEQ ID NO: 412368 - DNA, 20 bp, mouse
ggtgttggccaccagcgtgt

SEQ ID NO: 412369 - DNA, 20 bp, mouse
gccgggccgggcgccggacc

SEQ ID NO: 412370 - DNA, 20 bp, mouse
gtgttggtctcctcctggtc

SEQ ID NO: 412371 - DNA, 20 bp, mouse
ggccacggccacctcgccaa

SEQ ID NO: 412372 - DNA, 20 bp, mouse
gggccgcgcgggggtcgagg

SEQ ID NO: 412373 - DNA, 20 bp, mouse
gccaacaccagcaattccaa

SEQ ID NO: 412374 - DNA, 20 bp, mouse
gaacgggctgaaggcggacc

SEQ ID NO: 412375 - DNA, 20 bp, mouse
ggcggctgctgcatctcatg

SEQ ID NO: 412376 - DNA, 20 bp, mouse
ggggggagaagagaatgtct

SEQ ID NO: 412377 - DNA, 20 bp, mouse
gtgtgtgacttccaaggcgg

SEQ ID NO: 412378 - DNA, 20 bp, mouse
ggcctgtgtgacttccaagg

SEQ ID NO: 412379 - DNA, 20 bp, mouse
gccaggcgcggagagaagca

SEQ ID NO: 412380 - DNA, 20 bp, mouse
gcccagccctgctaaggaca

SEQ ID NO: 412381 - DNA, 20 bp, mouse
gctgcaaacgccatcacagg

SEQ ID NO: 412382 - DNA, 20 bp, mouse
ggagaagagaatgtctaggc

SEQ ID NO: 412383 - DNA, 20 bp, mouse
gatgtcacaagagaagcttg

SEQ ID NO: 412384 - DNA, 20 bp, mouse
gtctagatccaggaaacggg

SEQ ID NO: 412385 - DNA, 20 bp, mouse
gaagagaatgtctaggctgg

SEQ ID NO: 412386 - DNA, 20 bp, mouse
gagacaggcgcttccagcag

SEQ ID NO: 412387 - DNA, 20 bp, mouse
gctgggcagccctcagatca

SEQ ID NO: 412388 - DNA, 20 bp, mouse
gagggctgcccagatgagac

SEQ ID NO: 412389 - DNA, 20 bp, mouse
gggaagcgcctgtctcatct

SEQ ID NO: 412390 - DNA, 20 bp, mouse
gactgagacatgggctctga

SEQ ID NO: 412391 - DNA, 20 bp, mouse
gtcagatcagggcatgacaa

SEQ ID NO: 412392 - DNA, 20 bp, mouse
gccatcttcccaccatctga

SEQ ID NO: 412393 - DNA, 20 bp, mouse
gaaacttctcagaagcagtt

SEQ ID NO: 412394 - DNA, 20 bp, mouse
gaaacatgccatcagatggt

SEQ ID NO: 412395 - DNA, 20 bp, mouse
gtatcagtaggtgacaccta

SEQ ID NO: 412396 - DNA, 20 bp, mouse
gggaaaagcgatgctgtcaa

SEQ ID NO: 412397 - DNA, 20 bp, mouse
gataggacacatagaatcag

SEQ ID NO: 412398 - DNA, 20 bp, mouse
gctgctgctccaagtgaagg

SEQ ID NO: 412399 - DNA, 20 bp, mouse
ggccatggcagcgatgtcat

SEQ ID NO: 412400 - DNA, 20 bp, mouse
ggtaagagctaagaaaggga

SEQ ID NO: 412401 - DNA, 20 bp, mouse
gcaaagtgtcctctgaaggt

SEQ ID NO: 412402 - DNA, 20 bp, mouse
gtagtgagtgcaagcttgga

SEQ ID NO: 412403 - DNA, 20 bp, mouse
ggtcctctgaaggtgggtag

SEQ ID NO: 412404 - DNA, 20 bp, mouse
gctcctctacccaccttcag

SEQ ID NO: 412405 - DNA, 20 bp, mouse
gggaggggtgctggacataa

SEQ ID NO: 412406 - DNA, 20 bp, mouse
gcccgaagcatgagtcacat

SEQ ID NO: 412407 - DNA, 20 bp, mouse
gctgcctgtgaaccctccac

SEQ ID NO: 412408 - DNA, 20 bp, mouse
gagaagatcaacgattaccc

SEQ ID NO: 412409 - DNA, 20 bp, mouse
gcacaggactcagctgagag

SEQ ID NO: 412410 - DNA, 20 bp, mouse
ggtcttgggcctgggaggcg

SEQ ID NO: 412411 - DNA, 20 bp, mouse
ggattacccaggtgtttcct

SEQ ID NO: 412412 - DNA, 20 bp, mouse
gttcacaggcagagcagtca

SEQ ID NO: 412413 - DNA, 20 bp, mouse
gtccgggctgtgcagttgag

SEQ ID NO: 412414 - DNA, 20 bp, mouse
gtcctgagaggccaccctct

SEQ ID NO: 412415 - DNA, 20 bp, mouse
ggtgaccgcactcaagacac

SEQ ID NO: 412416 - DNA, 20 bp, mouse
gcctcgctccacagtttcca

SEQ ID NO: 412417 - DNA, 20 bp, mouse
ggtgctgaccctgacaccct

SEQ ID NO: 412418 - DNA, 20 bp, mouse
gacctctggcgcgcgagtct

SEQ ID NO: 412419 - DNA, 20 bp, mouse
gtaccacgcctagggtgtca

SEQ ID NO: 412420 - DNA, 20 bp, mouse
gggtgcccttggctagaaca

SEQ ID NO: 412421 - DNA, 20 bp, mouse
ggcccttggctagaacacgg

SEQ ID NO: 412422 - DNA, 20 bp, mouse
gcgcgcgccagaggttgccc

SEQ ID NO: 412423 - DNA, 20 bp, mouse
ggcccagactcgcgcgccag

SEQ ID NO: 412424 - DNA, 20 bp, mouse
gccaggaagggtgggcgata

SEQ ID NO: 412425 - DNA, 20 bp, mouse
gggcgataaggaaaatgggt

SEQ ID NO: 412426 - DNA, 20 bp, mouse
gggcgagccccgcggccagg

SEQ ID NO: 412427 - DNA, 20 bp, mouse
gaggcggtcagaaacgaccg

SEQ ID NO: 412428 - DNA, 20 bp, mouse
gtcagaaacgaccgcggagg

SEQ ID NO: 412429 - DNA, 20 bp, mouse
gaccttgcaggcgagccccg

SEQ ID NO: 412430 - DNA, 20 bp, mouse
gtagcagcagcagaacgggc

SEQ ID NO: 412431 - DNA, 20 bp, mouse
gcggtcagaaacgaccgcgg

SEQ ID NO: 412432 - DNA, 20 bp, mouse
gagagccacgaggaccaggt

SEQ ID NO: 412433 - DNA, 20 bp, mouse
gaaggtgagatgggccctcc

SEQ ID NO: 412434 - DNA, 20 bp, mouse
gccgggcaccggaggctcag

SEQ ID NO: 412435 - DNA, 20 bp, mouse
gtgaactagacggagcccgg

SEQ ID NO: 412436 - DNA, 20 bp, mouse
gtctccacctaccagcctag

SEQ ID NO: 412437 - DNA, 20 bp, mouse
gtcacctctaggctggtagg

SEQ ID NO: 412438 - DNA, 20 bp, mouse
gactccctcggcctcggcat

SEQ ID NO: 412439 - DNA, 20 bp, mouse
gttctctactccctcggcct

SEQ ID NO: 412440 - DNA, 20 bp, mouse
ggtgcccatgccgaggccga

SEQ ID NO: 412441 - DNA, 20 bp, mouse
gtaaggcgggtaccatcgag

SEQ ID NO: 412442 - DNA, 20 bp, mouse
gtgatgtaattctcacctct

SEQ ID NO: 412443 - DNA, 20 bp, mouse
gtatgatagtgcccatgccg

SEQ ID NO: 412444 - DNA, 20 bp, mouse
gggtgagaattacatcaagt

SEQ ID NO: 412445 - DNA, 20 bp, mouse
gagaggtgggtgatattatc

SEQ ID NO: 412446 - DNA, 20 bp, mouse
ggcccaggaggtcaatcctg

SEQ ID NO: 412447 - DNA, 20 bp, mouse
gtcgccaaggcaaccgtggt

SEQ ID NO: 412448 - DNA, 20 bp, mouse
gcctactggcgacaccccag

SEQ ID NO: 412449 - DNA, 20 bp, mouse
ggaagcagccttcatcgcca

SEQ ID NO: 412450 - DNA, 20 bp, mouse
gccaaggcaaccgtggtggg

SEQ ID NO: 412451 - DNA, 20 bp, mouse
gacggttgccttggcgatga

SEQ ID NO: 412452 - DNA, 20 bp, mouse
gctctaaagaaaacgtgtca

SEQ ID NO: 412453 - DNA, 20 bp, mouse
gacgtgtcagggtcgtccac

SEQ ID NO: 412454 - DNA, 20 bp, mouse
gcggggcctgagcttcggtt

SEQ ID NO: 412455 - DNA, 20 bp, mouse
gtccacaggattgacctcct

SEQ ID NO: 412456 - DNA, 20 bp, mouse
gggtgtccggcgccatccca

SEQ ID NO: 412457 - DNA, 20 bp, mouse
gtagcggagtcgatgtggac

SEQ ID NO: 412458 - DNA, 20 bp, mouse
gtcccagggcaggcctgcgt

SEQ ID NO: 412459 - DNA, 20 bp, mouse
gtccctggggcgagctgaag

SEQ ID NO: 412460 - DNA, 20 bp, mouse
gtcccacgcaggcctgccct

SEQ ID NO: 412461 - DNA, 20 bp, mouse
ggtccttagcggagtcgatg

SEQ ID NO: 412462 - DNA, 20 bp, mouse
gggtctcgccggagtcactc

SEQ ID NO: 412463 - DNA, 20 bp, mouse
gaggcctgcgtgggagccga

SEQ ID NO: 412464 - DNA, 20 bp, mouse
gtaggcagctgtgagactag

SEQ ID NO: 412465 - DNA, 20 bp, mouse
gcagggaccaactttcacaa

SEQ ID NO: 412466 - DNA, 20 bp, mouse
gcagttatgcgaggcagtag

SEQ ID NO: 412467 - DNA, 20 bp, mouse
gcgaggcagtagaggcaaca

SEQ ID NO: 412468 - DNA, 20 bp, mouse
gcgggctaaacgctcagagc

SEQ ID NO: 412469 - DNA, 20 bp, mouse
gctcagaactagaactagtc

SEQ ID NO: 412470 - DNA, 20 bp, mouse
ggctaaacgctcagagctgg

SEQ ID NO: 412471 - DNA, 20 bp, mouse
ggtagaggcaacaaggaaat

SEQ ID NO: 412472 - DNA, 20 bp, mouse
ggctggtggttaagccagca

SEQ ID NO: 412473 - DNA, 20 bp, mouse
gcgtggagttgaactctcct

SEQ ID NO: 412474 - DNA, 20 bp, mouse
gtcctctcactaggactttg

SEQ ID NO: 412475 - DNA, 20 bp, mouse
ggttgctagggcccagagta

SEQ ID NO: 412476 - DNA, 20 bp, mouse
ggtcaagcccggaggccgag

SEQ ID NO: 412477 - DNA, 20 bp, mouse
gccatccctggccttcggta

SEQ ID NO: 412478 - DNA, 20 bp, mouse
gacaagctgagaaggcccca

SEQ ID NO: 412479 - DNA, 20 bp, mouse
gagggagaagtcaagcccgg

SEQ ID NO: 412480 - DNA, 20 bp, mouse
gagaaggccccatggctaca

SEQ ID NO: 412481 - DNA, 20 bp, mouse
gttggccagcagaacccctc

SEQ ID NO: 412482 - DNA, 20 bp, mouse
gggagctccctgtagccatg

SEQ ID NO: 412483 - DNA, 20 bp, mouse
gtggctacagggagctcctg

SEQ ID NO: 412484 - DNA, 20 bp, mouse
gttcgagcccctcggcctcc

SEQ ID NO: 412485 - DNA, 20 bp, mouse
ggtgtagccgcaggacatac

SEQ ID NO: 412486 - DNA, 20 bp, mouse
gctcaggccttgaggaccca

SEQ ID NO: 412487 - DNA, 20 bp, mouse
ggagctaggtgaccacagga

SEQ ID NO: 412488 - DNA, 20 bp, mouse
gttctgagctaggtgaccac

SEQ ID NO: 412489 - DNA, 20 bp, mouse
gaggtgaccacaggatggaa

SEQ ID NO: 412490 - DNA, 20 bp, mouse
gaggacccacggaacaagga

SEQ ID NO: 412491 - DNA, 20 bp, mouse
gagctcagtgggaagaattt

SEQ ID NO: 412492 - DNA, 20 bp, mouse
gcttgaggacccacggaaca

SEQ ID NO: 412493 - DNA, 20 bp, mouse
ggctgttggcccagctcagt

SEQ ID NO: 412494 - DNA, 20 bp, mouse
ggacacctggcgggaagatc

SEQ ID NO: 412495 - DNA, 20 bp, mouse
ggatcgggatgtgtgttctt

SEQ ID NO: 412496 - DNA, 20 bp, mouse
gctttgccgggagggtggac

SEQ ID NO: 412497 - DNA, 20 bp, mouse
gagcagccagtccaccctcc

SEQ ID NO: 412498 - DNA, 20 bp, mouse
gccgcaggaaggatcctacc

SEQ ID NO: 412499 - DNA, 20 bp, mouse
gggcgttccgagacgcgaca

SEQ ID NO: 412500 - DNA, 20 bp, mouse
gaaaggcgcgcctggatcgc

SEQ ID NO: 412501 - DNA, 20 bp, mouse
gcaggtaggttggcgaagag

SEQ ID NO: 412502 - DNA, 20 bp, mouse
ggcggcctgggcgacccggt

SEQ ID NO: 412503 - DNA, 20 bp, mouse
ggcgggagagaccgaggcag

SEQ ID NO: 412504 - DNA, 20 bp, mouse
gaggcgcgcctttgccggga

SEQ ID NO: 412505 - DNA, 20 bp, mouse
gatccaggcgcgcctttgcc

SEQ ID NO: 412506 - DNA, 20 bp, mouse
gtaggatgagaggtccttcc

SEQ ID NO: 412507 - DNA, 20 bp, mouse
gtgcattagacctatgggtt

SEQ ID NO: 412508 - DNA, 20 bp, mouse
gttccctgcattagacctat

SEQ ID NO: 412509 - DNA, 20 bp, mouse
gctccggaactgtcaaagaa

SEQ ID NO: 412510 - DNA, 20 bp, mouse
gtaatgcagggaaaaggtgg

SEQ ID NO: 412511 - DNA, 20 bp, mouse
gcacctcagcaggagctgtc

SEQ ID NO: 412512 - DNA, 20 bp, mouse
ggtccctcaagagttgtcta

SEQ ID NO: 412513 - DNA, 20 bp, mouse
gagccagtaagatgcccctc

SEQ ID NO: 412514 - DNA, 20 bp, mouse
ggtgggatagatagttccta

SEQ ID NO: 412515 - DNA, 20 bp, mouse
ggctcctgtgggcatcttgt

SEQ ID NO: 412516 - DNA, 20 bp, mouse
gcaagagccgggcttcacgg

SEQ ID NO: 412517 - DNA, 20 bp, mouse
gtgggctccgctcgcagatc

SEQ ID NO: 412518 - DNA, 20 bp, mouse
ggggatgccagatctgcgag

SEQ ID NO: 412519 - DNA, 20 bp, mouse
ggtgtgcggacggtcgtata

SEQ ID NO: 412520 - DNA, 20 bp, mouse
gccccaagagccgggcttca

SEQ ID NO: 412521 - DNA, 20 bp, mouse
gtgcctcaggccttactcca

SEQ ID NO: 412522 - DNA, 20 bp, mouse
gcctcctaggtcaccctcgg

SEQ ID NO: 412523 - DNA, 20 bp, mouse
gagtaaggagaggtcaggct

SEQ ID NO: 412524 - DNA, 20 bp, mouse
ggcaaagcccccgtgaagcc

SEQ ID NO: 412525 - DNA, 20 bp, mouse
ggtgccaccgagggtgacct

SEQ ID NO: 412526 - DNA, 20 bp, mouse
gccgagtgcgaccaacaggt

SEQ ID NO: 412527 - DNA, 20 bp, mouse
ggccaaccgccgccgagcaa

SEQ ID NO: 412528 - DNA, 20 bp, mouse
ggcgggtggccgttgctcgg

SEQ ID NO: 412529 - DNA, 20 bp, mouse
gggtggccgttgctcggcgg

SEQ ID NO: 412530 - DNA, 20 bp, mouse
gcgcctccacggctgggtcg

SEQ ID NO: 412531 - DNA, 20 bp, mouse
gagcggtccaccgccttaga

SEQ ID NO: 412532 - DNA, 20 bp, mouse
ggcgctgtgtggagcagcgg

SEQ ID NO: 412533 - DNA, 20 bp, mouse
gatcgccacgccctctaagg

SEQ ID NO: 412534 - DNA, 20 bp, mouse
ggtgcgaccaacaggtgggc

SEQ ID NO: 412535 - DNA, 20 bp, mouse
gtgggctgggccggcgcgag

SEQ ID NO: 412536 - DNA, 20 bp, mouse
gggggactcggccatcacac

SEQ ID NO: 412537 - DNA, 20 bp, mouse
gccgggcgacgccagttgag

SEQ ID NO: 412538 - DNA, 20 bp, mouse
gggcgtcgcccggggttcaa

SEQ ID NO: 412539 - DNA, 20 bp, mouse
gaccgcggccgttgaacccc

SEQ ID NO: 412540 - DNA, 20 bp, mouse
ggcaccacaagccactcaac

SEQ ID NO: 412541 - DNA, 20 bp, mouse
gttagcggaaagaaacgccg

SEQ ID NO: 412542 - DNA, 20 bp, mouse
gggctctctcccaccgaggt

SEQ ID NO: 412543 - DNA, 20 bp, mouse
gagttcgagtcccacctcgg

SEQ ID NO: 412544 - DNA, 20 bp, mouse
ggcttgtggtgccggtgtga

SEQ ID NO: 412545 - DNA, 20 bp, mouse
gaacggccgcggttccagaa

SEQ ID NO: 412546 - DNA, 20 bp, mouse
gcctggttcaccagcaggac

SEQ ID NO: 412547 - DNA, 20 bp, mouse
gtgaaccaggcagagcttac

SEQ ID NO: 412548 - DNA, 20 bp, mouse
gaccacctccaggatgtagt

SEQ ID NO: 412549 - DNA, 20 bp, mouse
gggctccggtaagctctgcc

SEQ ID NO: 412550 - DNA, 20 bp, mouse
gcatgatggtttgatggatt

SEQ ID NO: 412551 - DNA, 20 bp, mouse
gtgcctggacccagaaggaa

SEQ ID NO: 412552 - DNA, 20 bp, mouse
gtcggtgaggtaatcaagca

SEQ ID NO: 412553 - DNA, 20 bp, mouse
gctctgcctggttcaccagc

SEQ ID NO: 412554 - DNA, 20 bp, mouse
gctccaggatgtagtcggtg

SEQ ID NO: 412555 - DNA, 20 bp, mouse
gctccgacatgatggtttga

SEQ ID NO: 412556 - DNA, 20 bp, mouse
gatctccagctcacagcgag

SEQ ID NO: 412557 - DNA, 20 bp, mouse
gtggcttggtgggcacacgt

SEQ ID NO: 412558 - DNA, 20 bp, mouse
gagaagccgagtgagacgaa

SEQ ID NO: 412559 - DNA, 20 bp, mouse
ggtccagcatagcaacggga

SEQ ID NO: 412560 - DNA, 20 bp, mouse
gataccgcaagaggccaagg

SEQ ID NO: 412561 - DNA, 20 bp, mouse
ggtcagcgcgagccaatgga

SEQ ID NO: 412562 - DNA, 20 bp, mouse
ggctcgcgctgactgtgacc

SEQ ID NO: 412563 - DNA, 20 bp, mouse
gggtataccgcaagaggcca

SEQ ID NO: 412564 - DNA, 20 bp, mouse
gacttcctctcgctgtgagc

SEQ ID NO: 412565 - DNA, 20 bp, mouse
gcagacgtccagcatagcaa

SEQ ID NO: 412566 - DNA, 20 bp, mouse
gggagccagcgggataggag

SEQ ID NO: 412567 - DNA, 20 bp, mouse
ggagcaggagccagcgggat

SEQ ID NO: 412568 - DNA, 20 bp, mouse
gacacccacgagcagatcag

SEQ ID NO: 412569 - DNA, 20 bp, mouse
gccaggggttgagaccacta

SEQ ID NO: 412570 - DNA, 20 bp, mouse
gcacttagagtgattggcag

SEQ ID NO: 412571 - DNA, 20 bp, mouse
gctacccctgatctgctcgt

SEQ ID NO: 412572 - DNA, 20 bp, mouse
gagctcctctcctatcccgc

SEQ ID NO: 412573 - DNA, 20 bp, mouse
ggagtgataggtggaccagg

SEQ ID NO: 412574 - DNA, 20 bp, mouse
gaactccaccaggacagaca

SEQ ID NO: 412575 - DNA, 20 bp, mouse
gggtaggtacacctgctgag

SEQ ID NO: 412576 - DNA, 20 bp, mouse
ggacgcggttaacccttcct

SEQ ID NO: 412577 - DNA, 20 bp, mouse
ggccgcgcgggagagcagta

SEQ ID NO: 412578 - DNA, 20 bp, mouse
gaaacctaggcagcaggacg

SEQ ID NO: 412579 - DNA, 20 bp, mouse
gagcagtagggcagccggag

SEQ ID NO: 412580 - DNA, 20 bp, mouse
gccattgacacttcagtccc

SEQ ID NO: 412581 - DNA, 20 bp, mouse
gtctatttacatgtaaacct

SEQ ID NO: 412582 - DNA, 20 bp, mouse
gtgacacttcagtcccagga

SEQ ID NO: 412583 - DNA, 20 bp, mouse
gccgggcccgcttggagcag

SEQ ID NO: 412584 - DNA, 20 bp, mouse
gtcgaagccgggtccctcca

SEQ ID NO: 412585 - DNA, 20 bp, mouse
gactccggagagctactcgg

SEQ ID NO: 412586 - DNA, 20 bp, mouse
gctaccttagaggttatgga

SEQ ID NO: 412587 - DNA, 20 bp, mouse
gatggctaccttagaggtta

SEQ ID NO: 412588 - DNA, 20 bp, mouse
gctgaaagatagttatgaaa

SEQ ID NO: 412589 - DNA, 20 bp, mouse
gcttatagcccaccatgata

SEQ ID NO: 412590 - DNA, 20 bp, mouse
gtatgaaatggctaccttag

SEQ ID NO: 412591 - DNA, 20 bp, mouse
gaacaagaccatatcatggt

SEQ ID NO: 412592 - DNA, 20 bp, mouse
gactacttctcacagtctag

SEQ ID NO: 412593 - DNA, 20 bp, mouse
gcaggtgtattgggtgatgt

SEQ ID NO: 412594 - DNA, 20 bp, mouse
gttaggaaaggtccagaatg

SEQ ID NO: 412595 - DNA, 20 bp, mouse
gcacctgatatgagttagac

SEQ ID NO: 412596 - DNA, 20 bp, mouse
gcccatgaggagagaagtag

SEQ ID NO: 412597 - DNA, 20 bp, mouse
ggagagaagatgattccgtg

SEQ ID NO: 412598 - DNA, 20 bp, mouse
gctgggcagtctgataagag

SEQ ID NO: 412599 - DNA, 20 bp, mouse
gagaggggcccagtggacca

SEQ ID NO: 412600 - DNA, 20 bp, mouse
gaccaggtagctcagagggt

SEQ ID NO: 412601 - DNA, 20 bp, mouse
gtcagcactaagcctttctg

SEQ ID NO: 412602 - DNA, 20 bp, mouse
gtctgataagaggggcccag

SEQ ID NO: 412603 - DNA, 20 bp, mouse
gaatagaccaggtagctcag

SEQ ID NO: 412604 - DNA, 20 bp, mouse
gtactgaaaacaccaggcta

SEQ ID NO: 412605 - DNA, 20 bp, mouse
gagccagcactagagctgag

SEQ ID NO: 412606 - DNA, 20 bp, mouse
gcttctgtggctacagtggg

SEQ ID NO: 412607 - DNA, 20 bp, mouse
gctgtggctacagtgggagg

SEQ ID NO: 412608 - DNA, 20 bp, mouse
gtggaggatgtccagtctgg

SEQ ID NO: 412609 - DNA, 20 bp, mouse
gttatcaactggtacgacag

SEQ ID NO: 412610 - DNA, 20 bp, mouse
ggagtgctgtgtgaactcaa

SEQ ID NO: 412611 - DNA, 20 bp, mouse
gtgtccttctgtggctacag

SEQ ID NO: 412612 - DNA, 20 bp, mouse
gggagacccctactgctcac

SEQ ID NO: 412613 - DNA, 20 bp, mouse
gcactaggcacagaaggtcc

SEQ ID NO: 412614 - DNA, 20 bp, mouse
ggtagaagggaatgttctgg

SEQ ID NO: 412615 - DNA, 20 bp, mouse
gctacatgggactctggaga

SEQ ID NO: 412616 - DNA, 20 bp, mouse
gagtccaggactccacccaa

SEQ ID NO: 412617 - DNA, 20 bp, mouse
gcttccattgggtggagtcc

SEQ ID NO: 412618 - DNA, 20 bp, mouse
gagcagagaacgcagtgccc

SEQ ID NO: 412619 - DNA, 20 bp, mouse
gtcctcaggagtcagatgtc

SEQ ID NO: 412620 - DNA, 20 bp, mouse
gagaggtggcattcttccat

SEQ ID NO: 412621 - DNA, 20 bp, mouse
ggtggcattcttccattggg

SEQ ID NO: 412622 - DNA, 20 bp, mouse
ggactcctgaggactgaagt

SEQ ID NO: 412623 - DNA, 20 bp, mouse
gtgaagttggaagtcacaag

SEQ ID NO: 412624 - DNA, 20 bp, mouse
gactctctcagacatgctaa

SEQ ID NO: 412625 - DNA, 20 bp, mouse
gctcctttttaacttagtcc

SEQ ID NO: 412626 - DNA, 20 bp, mouse
ggccaacatggcctctccca

SEQ ID NO: 412627 - DNA, 20 bp, mouse
ggtctcgggcccacaccaca

SEQ ID NO: 412628 - DNA, 20 bp, mouse
gaagcatacgggacttccct

SEQ ID NO: 412629 - DNA, 20 bp, mouse
gcgtcaggtcaaccaagagt

SEQ ID NO: 412630 - DNA, 20 bp, mouse
gcacaaggctgtccctaaat

SEQ ID NO: 412631 - DNA, 20 bp, mouse
gtgtgcagccctggagtctc

SEQ ID NO: 412632 - DNA, 20 bp, mouse
ggatagtgctagggaaactc

SEQ ID NO: 412633 - DNA, 20 bp, mouse
gtccctaaattggaagcata

SEQ ID NO: 412634 - DNA, 20 bp, mouse
gggggcctgagacgccaaca

SEQ ID NO: 412635 - DNA, 20 bp, mouse
ggagcagcagcgccttggag

SEQ ID NO: 412636 - DNA, 20 bp, mouse
gggagagcgctctcactatg

SEQ ID NO: 412637 - DNA, 20 bp, mouse
gtccgaccagtcccagagta

SEQ ID NO: 412638 - DNA, 20 bp, mouse
gggtagtacacccgtactct

SEQ ID NO: 412639 - DNA, 20 bp, mouse
gacgtgaggaaccgacttag

SEQ ID NO: 412640 - DNA, 20 bp, mouse
gtacacccgtactctgggac

SEQ ID NO: 412641 - DNA, 20 bp, mouse
ggggtgtactaccactaagt

SEQ ID NO: 412642 - DNA, 20 bp, mouse
gtcgcgcaaccgcatacgtg

SEQ ID NO: 412643 - DNA, 20 bp, mouse
ggtggggccccgggcaagac

SEQ ID NO: 412644 - DNA, 20 bp, mouse
gtagctgagagtggggcccc

SEQ ID NO: 412645 - DNA, 20 bp, mouse
gcgcaaaaggttgacgagta

SEQ ID NO: 412646 - DNA, 20 bp, mouse
ggaaatcccagaggcgacag

SEQ ID NO: 412647 - DNA, 20 bp, mouse
ggagtgcgtgacctactcca

SEQ ID NO: 412648 - DNA, 20 bp, mouse
gatcccagaggcgacagggg

SEQ ID NO: 412649 - DNA, 20 bp, mouse
gactcgcctgggagggaaag

SEQ ID NO: 412650 - DNA, 20 bp, mouse
ggtaggtcacgcactcgcct

SEQ ID NO: 412651 - DNA, 20 bp, mouse
ggccactgtgagggagggaa

SEQ ID NO: 412652 - DNA, 20 bp, mouse
gactgtgagggagggaacgg

SEQ ID NO: 412653 - DNA, 20 bp, mouse
gcgcccatggtgacaccgag

SEQ ID NO: 412654 - DNA, 20 bp, mouse
gaccgagagcggcttccggg

SEQ ID NO: 412655 - DNA, 20 bp, mouse
gtgcgggagttggccaggta

SEQ ID NO: 412656 - DNA, 20 bp, mouse
gtcgtcgtcgagtttgggta

SEQ ID NO: 412657 - DNA, 20 bp, mouse
gtggcttcagaaaaagatga

SEQ ID NO: 412658 - DNA, 20 bp, mouse
gctgtcattgctgccagtga

SEQ ID NO: 412659 - DNA, 20 bp, mouse
gggttgtcgtcgtcgagttt

SEQ ID NO: 412660 - DNA, 20 bp, mouse
gtcagaaaaagatgacggtc

SEQ ID NO: 412661 - DNA, 20 bp, mouse
gggaggcagtgattgaacac

SEQ ID NO: 412662 - DNA, 20 bp, mouse
gcgtcgagtttgggtaaggc

SEQ ID NO: 412663 - DNA, 20 bp, mouse
gggagatggtgagactggta

SEQ ID NO: 412664 - DNA, 20 bp, mouse
gaagggaatacgcacgcact

SEQ ID NO: 412665 - DNA, 20 bp, mouse
gagagcagcctcaacagctc

SEQ ID NO: 412666 - DNA, 20 bp, mouse
gccaggtagggactgagcta

SEQ ID NO: 412667 - DNA, 20 bp, mouse
gagacgtggcagctccaggt

SEQ ID NO: 412668 - DNA, 20 bp, mouse
gcccaggaaccccacagacg

SEQ ID NO: 412669 - DNA, 20 bp, mouse
gcgcagagttctcttgggac

SEQ ID NO: 412670 - DNA, 20 bp, mouse
gctacctggtgcattgtcca

SEQ ID NO: 412671 - DNA, 20 bp, mouse
gccccacagtgagttaggaa

SEQ ID NO: 412672 - DNA, 20 bp, mouse
gctggtgcattgtccagggc

SEQ ID NO: 412673 - DNA, 20 bp, mouse
gggctggcgcagagttctct

SEQ ID NO: 412674 - DNA, 20 bp, mouse
gtgaaggacccagggagtcg

SEQ ID NO: 412675 - DNA, 20 bp, mouse
gtcctggctatgcccagggt

SEQ ID NO: 412676 - DNA, 20 bp, mouse
ggacgccgcgaccccagcat

SEQ ID NO: 412677 - DNA, 20 bp, mouse
ggccgggtgagcggccctgg

SEQ ID NO: 412678 - DNA, 20 bp, mouse
gcgtggagcgctgcagacgg

SEQ ID NO: 412679 - DNA, 20 bp, mouse
ggccgctcacccggcagcga

SEQ ID NO: 412680 - DNA, 20 bp, mouse
gggcggctcgagcccatgct

SEQ ID NO: 412681 - DNA, 20 bp, mouse
ggccgccagggccgctcacc

SEQ ID NO: 412682 - DNA, 20 bp, mouse
ggctggggtcgcggcgtctg

SEQ ID NO: 412683 - DNA, 20 bp, mouse
ggccctcgctgccgggtgag

SEQ ID NO: 412684 - DNA, 20 bp, mouse
gcgagcccatgctggggtcg

SEQ ID NO: 412685 - DNA, 20 bp, mouse
gcggggcctcggctgcccaa

SEQ ID NO: 412686 - DNA, 20 bp, mouse
ggtcgaggccgggctgagtg

SEQ ID NO: 412687 - DNA, 20 bp, mouse
gacctggggccgaccggctt

SEQ ID NO: 412688 - DNA, 20 bp, mouse
ggggagacccgagacttcag

SEQ ID NO: 412689 - DNA, 20 bp, mouse
gggcgccggcagagacgtcg

SEQ ID NO: 412690 - DNA, 20 bp, mouse
ggcacacacctggggccgac

SEQ ID NO: 412691 - DNA, 20 bp, mouse
gcccggcgggcgaccacgaa

SEQ ID NO: 412692 - DNA, 20 bp, mouse
gaccacgaagggtctccata

SEQ ID NO: 412693 - DNA, 20 bp, mouse
gacgaagggtctccataggg

SEQ ID NO: 412694 - DNA, 20 bp, mouse
ggctcactgcccaagccggt

SEQ ID NO: 412695 - DNA, 20 bp, mouse
gcccaggtgtgtgcgctccc

SEQ ID NO: 412696 - DNA, 20 bp, mouse
gaaagctagtgctagaggta

SEQ ID NO: 412697 - DNA, 20 bp, mouse
ggtcagaagaggtggcacga

SEQ ID NO: 412698 - DNA, 20 bp, mouse
gggacaggctggacatttca

SEQ ID NO: 412699 - DNA, 20 bp, mouse
gctcagaaagctagtgctag

SEQ ID NO: 412700 - DNA, 20 bp, mouse
gggtggcacgagggacaggc

SEQ ID NO: 412701 - DNA, 20 bp, mouse
gggaactgacatgtgactga

SEQ ID NO: 412702 - DNA, 20 bp, mouse
gccttctctggagacccatt

SEQ ID NO: 412703 - DNA, 20 bp, mouse
ggagtccttgaaagtccaag

SEQ ID NO: 412704 - DNA, 20 bp, mouse
gaggggccgattctacaaca

SEQ ID NO: 412705 - DNA, 20 bp, mouse
gctctactgagagaatttgg

SEQ ID NO: 412706 - DNA, 20 bp, mouse
gctggcgcggtgatgagcgt

SEQ ID NO: 412707 - DNA, 20 bp, mouse
gggcgccgttaccttggaca

SEQ ID NO: 412708 - DNA, 20 bp, mouse
ggccgccatgtccaaggtaa

SEQ ID NO: 412709 - DNA, 20 bp, mouse
ggccgttaccttggacatgg

SEQ ID NO: 412710 - DNA, 20 bp, mouse
ggtcgcgcggccgcccaagt

SEQ ID NO: 412711 - DNA, 20 bp, mouse
ggcaaccgccgccatgtcca

SEQ ID NO: 412712 - DNA, 20 bp, mouse
gtcccgcccgccgccaccgg

SEQ ID NO: 412713 - DNA, 20 bp, mouse
gggcgctctgaggtggtgta

SEQ ID NO: 412714 - DNA, 20 bp, mouse
gcaagagagcggcgaccgag

SEQ ID NO: 412715 - DNA, 20 bp, mouse
ggggcccgggccgccggtgg

SEQ ID NO: 412716 - DNA, 20 bp, mouse
ggagttgtttgggtgagcag

SEQ ID NO: 412717 - DNA, 20 bp, mouse
gaactcccagcctaaccagg

SEQ ID NO: 412718 - DNA, 20 bp, mouse
gccgaggctgcctcctggtt

SEQ ID NO: 412719 - DNA, 20 bp, mouse
ggcctcggcaatcgacagtt

SEQ ID NO: 412720 - DNA, 20 bp, mouse
gtccgcggaggcgcccacct

SEQ ID NO: 412721 - DNA, 20 bp, mouse
ggcctaactgtcgattgccg

SEQ ID NO: 412722 - DNA, 20 bp, mouse
gtcccaggtgggcgcctccg

SEQ ID NO: 412723 - DNA, 20 bp, mouse
gggtcgataaaagtcatccg

SEQ ID NO: 412724 - DNA, 20 bp, mouse
gtgttgacctgtccagaagt

SEQ ID NO: 412725 - DNA, 20 bp, mouse
gtgctcttcggctagctccc

SEQ ID NO: 412726 - DNA, 20 bp, mouse
gggcactgaacaggaaatcc

SEQ ID NO: 412727 - DNA, 20 bp, mouse
ggccaggcaagtagtgtgta

SEQ ID NO: 412728 - DNA, 20 bp, mouse
ggagactctgggcactgaac

SEQ ID NO: 412729 - DNA, 20 bp, mouse
gcagtgaagtctctaggaaa

SEQ ID NO: 412730 - DNA, 20 bp, mouse
ggtgtgtagggtggcaactt

SEQ ID NO: 412731 - DNA, 20 bp, mouse
gagatggcaccagttgacac

SEQ ID NO: 412732 - DNA, 20 bp, mouse
gggttcacgtggcaaggcca

SEQ ID NO: 412733 - DNA, 20 bp, mouse
gtacgctgagtttaaggacc

SEQ ID NO: 412734 - DNA, 20 bp, mouse
gagagacttcactgagactc

SEQ ID NO: 412735 - DNA, 20 bp, mouse
ggagcagcttcatggaacac

SEQ ID NO: 412736 - DNA, 20 bp, mouse
gcagggtttgactctaatgt

SEQ ID NO: 412737 - DNA, 20 bp, mouse
gaagcaccaagaaccagtct

SEQ ID NO: 412738 - DNA, 20 bp, mouse
gggtttgactctaatgtagg

SEQ ID NO: 412739 - DNA, 20 bp, mouse
gctcagtagagcaaactagg

SEQ ID NO: 412740 - DNA, 20 bp, mouse
gagatgtacgggagtcagca

SEQ ID NO: 412741 - DNA, 20 bp, mouse
gctgatctatcaagatgtac

SEQ ID NO: 412742 - DNA, 20 bp, mouse
ggaggaccaagactggttct

SEQ ID NO: 412743 - DNA, 20 bp, mouse
gaagggttttagtatcacac

SEQ ID NO: 412744 - DNA, 20 bp, mouse
gagcttatgagataggacgg

SEQ ID NO: 412745 - DNA, 20 bp, mouse
gaatctcagtagagcaaact

SEQ ID NO: 412746 - DNA, 20 bp, mouse
gcacaaggccccaggctgac

SEQ ID NO: 412747 - DNA, 20 bp, mouse
gtcagggtccatgggcagaa

SEQ ID NO: 412748 - DNA, 20 bp, mouse
gagaacggagacaccagtgc

SEQ ID NO: 412749 - DNA, 20 bp, mouse
gaccaggcggtggagaagtc

SEQ ID NO: 412750 - DNA, 20 bp, mouse
gagcctggggccttgtgacc

SEQ ID NO: 412751 - DNA, 20 bp, mouse
gacagcatcctgtcagcctg

SEQ ID NO: 412752 - DNA, 20 bp, mouse
gccatggaccctgaaggcat

SEQ ID NO: 412753 - DNA, 20 bp, mouse
gtctccaccgcctggtcaca

SEQ ID NO: 412754 - DNA, 20 bp, mouse
gagccacgccctagtccgat

SEQ ID NO: 412755 - DNA, 20 bp, mouse
gcaaagagcacccctggatc

SEQ ID NO: 412756 - DNA, 20 bp, mouse
gccgttaggagcagccatca

SEQ ID NO: 412757 - DNA, 20 bp, mouse
ggcataaaccggcaccctga

SEQ ID NO: 412758 - DNA, 20 bp, mouse
gcagaatgtgtggcataaac

SEQ ID NO: 412759 - DNA, 20 bp, mouse
gtgccacacattctgagtcc

SEQ ID NO: 412760 - DNA, 20 bp, mouse
gaacggccaccgggtccagt

SEQ ID NO: 412761 - DNA, 20 bp, mouse
gatgtgcccactggacccgg

SEQ ID NO: 412762 - DNA, 20 bp, mouse
ggggactcaggccggccgtt

SEQ ID NO: 412763 - DNA, 20 bp, mouse
gaccctaaaaatcacttacc

SEQ ID NO: 412764 - DNA, 20 bp, mouse
gtgcatccggggactcaggc

SEQ ID NO: 412765 - DNA, 20 bp, mouse
gggaatgtgcccactggacc

SEQ ID NO: 412766 - DNA, 20 bp, mouse
ggcttcacccaaaaatacag

SEQ ID NO: 412767 - DNA, 20 bp, mouse
gtgctaccccctgtattttt

SEQ ID NO: 412768 - DNA, 20 bp, mouse
gggtgaggagctgggtttgc

SEQ ID NO: 412769 - DNA, 20 bp, mouse
ggggaagggggatcagtgag

SEQ ID NO: 412770 - DNA, 20 bp, mouse
gggggctaaggccagacaca

SEQ ID NO: 412771 - DNA, 20 bp, mouse
gaatcaaactgactcgaatt

SEQ ID NO: 412772 - DNA, 20 bp, mouse
gtcctggtccagcccattta

SEQ ID NO: 412773 - DNA, 20 bp, mouse
gaccgtaaatgggctggacc

SEQ ID NO: 412774 - DNA, 20 bp, mouse
gtcaaagaccgtaaatgggc

SEQ ID NO: 412775 - DNA, 20 bp, mouse
gattagagctgccttgtgtc

SEQ ID NO: 412776 - DNA, 20 bp, mouse
ggtgcgtgtccagcaactag

SEQ ID NO: 412777 - DNA, 20 bp, mouse
gtggcagcagcaacgtgaag

SEQ ID NO: 412778 - DNA, 20 bp, mouse
ggcctgaagaaattgttccg

SEQ ID NO: 412779 - DNA, 20 bp, mouse
gctagccctcaacgccactt

SEQ ID NO: 412780 - DNA, 20 bp, mouse
gtttgcctaagtggcgttga

SEQ ID NO: 412781 - DNA, 20 bp, mouse
gcaaatctgaggtctgtccg

SEQ ID NO: 412782 - DNA, 20 bp, mouse
ggaccttgacaaagatgcca

SEQ ID NO: 412783 - DNA, 20 bp, mouse
gagacatcacctctagttgc

SEQ ID NO: 412784 - DNA, 20 bp, mouse
ggaggtgatgtctcgtgctt

SEQ ID NO: 412785 - DNA, 20 bp, mouse
gatcttttgtacttgattcc

SEQ ID NO: 412786 - DNA, 20 bp, mouse
gacgcaccctgaataatggg

SEQ ID NO: 412787 - DNA, 20 bp, mouse
gatgaacgcaccctgaataa

SEQ ID NO: 412788 - DNA, 20 bp, mouse
gtaagagacggactaagaaa

SEQ ID NO: 412789 - DNA, 20 bp, mouse
gtgtggcctcccattattca

SEQ ID NO: 412790 - DNA, 20 bp, mouse
gcaaaggaccaataaaggca

SEQ ID NO: 412791 - DNA, 20 bp, mouse
gcagctctttcaacaaacgg

SEQ ID NO: 412792 - DNA, 20 bp, mouse
gagagctgtcaacaggtact

SEQ ID NO: 412793 - DNA, 20 bp, mouse
gtgttgaaagagctgtcaac

SEQ ID NO: 412794 - DNA, 20 bp, mouse
gtgaaggggattgtaagaga

SEQ ID NO: 412795 - DNA, 20 bp, mouse
ggacggactaagaaagggtt

SEQ ID NO: 412796 - DNA, 20 bp, mouse
gaagtgagctaggtggggag

SEQ ID NO: 412797 - DNA, 20 bp, mouse
gtaccggaaagaggtcacta

SEQ ID NO: 412798 - DNA, 20 bp, mouse
gtccgcctgaaggtagaatt

SEQ ID NO: 412799 - DNA, 20 bp, mouse
gctcaagctcacctctctac

SEQ ID NO: 412800 - DNA, 20 bp, mouse
gtgacctctttccggtagag

SEQ ID NO: 412801 - DNA, 20 bp, mouse
gttacagaaagtgagctagg

SEQ ID NO: 412802 - DNA, 20 bp, mouse
gggccttagtgacctctttc

SEQ ID NO: 412803 - DNA, 20 bp, mouse
gaggaagagtctagcatgta

SEQ ID NO: 412804 - DNA, 20 bp, mouse
ggaactttccagagtagggt

SEQ ID NO: 412805 - DNA, 20 bp, mouse
gtcacctctctaccggaaag

SEQ ID NO: 412806 - DNA, 20 bp, mouse
ggaggcgcttcagagaagga

SEQ ID NO: 412807 - DNA, 20 bp, mouse
ggcgagaggcgcttcagaga

SEQ ID NO: 412808 - DNA, 20 bp, mouse
ggaaggagggaccgacctgc

SEQ ID NO: 412809 - DNA, 20 bp, mouse
gaaggtgtcactcttcggac

SEQ ID NO: 412810 - DNA, 20 bp, mouse
gagagaagacgcgttcccta

SEQ ID NO: 412811 - DNA, 20 bp, mouse
gcgttctgagccggagcgag

SEQ ID NO: 412812 - DNA, 20 bp, mouse
gagacagtagcgaacagagg

SEQ ID NO: 412813 - DNA, 20 bp, mouse
gcagccaggcatctgacccg

SEQ ID NO: 412814 - DNA, 20 bp, mouse
gagctggaggcagctcccaa

SEQ ID NO: 412815 - DNA, 20 bp, mouse
gggtaagtggacccctctca

SEQ ID NO: 412816 - DNA, 20 bp, mouse
gtccgcacggagaaactcca

SEQ ID NO: 412817 - DNA, 20 bp, mouse
gcgtgacagagccctccgca

SEQ ID NO: 412818 - DNA, 20 bp, mouse
gccatgggagggccctagga

SEQ ID NO: 412819 - DNA, 20 bp, mouse
gtaacaaggagcgattagtg

SEQ ID NO: 412820 - DNA, 20 bp, mouse
gggattgcgaagcgtaacta

SEQ ID NO: 412821 - DNA, 20 bp, mouse
gacgcccaggtcatcgccta

SEQ ID NO: 412822 - DNA, 20 bp, mouse
gctatcgtgacggtccgggg

SEQ ID NO: 412823 - DNA, 20 bp, mouse
gtccttggagtttctccgtg

SEQ ID NO: 412824 - DNA, 20 bp, mouse
gggggaggagcgctcacctt

SEQ ID NO: 412825 - DNA, 20 bp, mouse
gcccatggcttcccaggaaa

SEQ ID NO: 412826 - DNA, 20 bp, mouse
gagcagcccatggccccgaa

SEQ ID NO: 412827 - DNA, 20 bp, mouse
gtgtcaggacaagaaccgtt

SEQ ID NO: 412828 - DNA, 20 bp, mouse
gttgctcatccgaggcccaa

SEQ ID NO: 412829 - DNA, 20 bp, mouse
gtcccttgcttgctcatccg

SEQ ID NO: 412830 - DNA, 20 bp, mouse
gtgaccgcgaggactcccga

SEQ ID NO: 412831 - DNA, 20 bp, mouse
ggacaagaaccgttgggcct

SEQ ID NO: 412832 - DNA, 20 bp, mouse
ggggatgaagtaacagagga

SEQ ID NO: 412833 - DNA, 20 bp, mouse
gctgcgcctttcggggccat

SEQ ID NO: 412834 - DNA, 20 bp, mouse
ggtgcttgtaggcaacgaag

SEQ ID NO: 412835 - DNA, 20 bp, mouse
gaagggactgccccagaggt

SEQ ID NO: 412836 - DNA, 20 bp, mouse
gttggacccactgcttactc

SEQ ID NO: 412837 - DNA, 20 bp, mouse
ggtcagcctgagtaagcagt

SEQ ID NO: 412838 - DNA, 20 bp, mouse
gcaaaattgccaaaacccaa

SEQ ID NO: 412839 - DNA, 20 bp, mouse
gtccaagtcctcactccttt

SEQ ID NO: 412840 - DNA, 20 bp, mouse
gggtcactgagagaagaatc

SEQ ID NO: 412841 - DNA, 20 bp, mouse
gtggcaattttgggatgagg

SEQ ID NO: 412842 - DNA, 20 bp, mouse
ggactctgaagctcctcagt

SEQ ID NO: 412843 - DNA, 20 bp, mouse
gtgagagaagaatcaggact

SEQ ID NO: 412844 - DNA, 20 bp, mouse
gagaaatctgcattcaaact

SEQ ID NO: 412845 - DNA, 20 bp, mouse
gagtgacactgggaaaatag

SEQ ID NO: 412846 - DNA, 20 bp, mouse
gaagtttggggacactggga

SEQ ID NO: 412847 - DNA, 20 bp, mouse
gtagaagaggtatggagggt

SEQ ID NO: 412848 - DNA, 20 bp, mouse
gaaactagaagaggtatgga

SEQ ID NO: 412849 - DNA, 20 bp, mouse
ggacaaaactagaagaggta

SEQ ID NO: 412850 - DNA, 20 bp, mouse
ggaagtagtgagcttcatag

SEQ ID NO: 412851 - DNA, 20 bp, mouse
gtcggtggtgcctcagggag

SEQ ID NO: 412852 - DNA, 20 bp, mouse
gaactgcttgtggaacagag

SEQ ID NO: 412853 - DNA, 20 bp, mouse
ggggagagttggcaatatat

SEQ ID NO: 412854 - DNA, 20 bp, mouse
ggtatggagggtcggaaaga

SEQ ID NO: 412855 - DNA, 20 bp, mouse
gtggaagcataagggagagt

SEQ ID NO: 412856 - DNA, 20 bp, mouse
ggccggatcaggcatcccag

SEQ ID NO: 412857 - DNA, 20 bp, mouse
gagccaaggtctaatcccgg

SEQ ID NO: 412858 - DNA, 20 bp, mouse
gtgcagccaaggtctaatcc

SEQ ID NO: 412859 - DNA, 20 bp, mouse
gaaacccgggaaagacctca

SEQ ID NO: 412860 - DNA, 20 bp, mouse
gtctaatcccggaggcccct

SEQ ID NO: 412861 - DNA, 20 bp, mouse
gagacagcgcagaactctgt

SEQ ID NO: 412862 - DNA, 20 bp, mouse
ggcccctgggatgcctgatc

SEQ ID NO: 412863 - DNA, 20 bp, mouse
gagcagctggaacccatcgg

SEQ ID NO: 412864 - DNA, 20 bp, mouse
gcggtggtcgacatccgtac

SEQ ID NO: 412865 - DNA, 20 bp, mouse
gctcgcagcagactgagaga

SEQ ID NO: 412866 - DNA, 20 bp, mouse
gagaacgctcggctcacagg

SEQ ID NO: 412867 - DNA, 20 bp, mouse
gggcccaggggtgttcacta

SEQ ID NO: 412868 - DNA, 20 bp, mouse
gcaccttagtgaacacccct

SEQ ID NO: 412869 - DNA, 20 bp, mouse
gaggaggtgtagcccaccat

SEQ ID NO: 412870 - DNA, 20 bp, mouse
gaaggctcatgtcaatccag

SEQ ID NO: 412871 - DNA, 20 bp, mouse
ggcagcaaggaatatcactt

SEQ ID NO: 412872 - DNA, 20 bp, mouse
gaggcaagcgccccaggaac

SEQ ID NO: 412873 - DNA, 20 bp, mouse
gggtgggctacacctcctga

SEQ ID NO: 412874 - DNA, 20 bp, mouse
ggtgaacacccctgggcctc

SEQ ID NO: 412875 - DNA, 20 bp, mouse
gctggactctactaccaaga

SEQ ID NO: 412876 - DNA, 20 bp, mouse
gggaggacgctggcgagtag

SEQ ID NO: 412877 - DNA, 20 bp, mouse
gggctccgccgcgcttggga

SEQ ID NO: 412878 - DNA, 20 bp, mouse
gggacgctggcgagtagcgg

SEQ ID NO: 412879 - DNA, 20 bp, mouse
gcgcttgggagggcggtgac

SEQ ID NO: 412880 - DNA, 20 bp, mouse
gcccggactgaggaccaaag

SEQ ID NO: 412881 - DNA, 20 bp, mouse
gtccgccgcgcttgggaggg

SEQ ID NO: 412882 - DNA, 20 bp, mouse
gggcggtgaccggaggacgc

SEQ ID NO: 412883 - DNA, 20 bp, mouse
gacccggagactacaggtgt

SEQ ID NO: 412884 - DNA, 20 bp, mouse
gcccggaggcccgcccccaa

SEQ ID NO: 412885 - DNA, 20 bp, mouse
gccgcgcgcaccaccagcct

SEQ ID NO: 412886 - DNA, 20 bp, mouse
gcggctgggtgaggactcaa

SEQ ID NO: 412887 - DNA, 20 bp, mouse
gtggccagcctagacaggac

SEQ ID NO: 412888 - DNA, 20 bp, mouse
gtgtctgggcccccaaacta

SEQ ID NO: 412889 - DNA, 20 bp, mouse
ggccgcacaagagtgcccaa

SEQ ID NO: 412890 - DNA, 20 bp, mouse
gaccgttgggcactcttgtg

SEQ ID NO: 412891 - DNA, 20 bp, mouse
ggtgcggcaacggctgggtg

SEQ ID NO: 412892 - DNA, 20 bp, mouse
gctcttgtgcggcaacggct

SEQ ID NO: 412893 - DNA, 20 bp, mouse
gagcaactgggcgcagtagt

SEQ ID NO: 412894 - DNA, 20 bp, mouse
gagaggacccagggtcacgg

SEQ ID NO: 412895 - DNA, 20 bp, mouse
gaactatggccagcctagac

SEQ ID NO: 412896 - DNA, 20 bp, mouse
ggctctgctctagggaagaa

SEQ ID NO: 412897 - DNA, 20 bp, mouse
gctctaccagctctgctcta

SEQ ID NO: 412898 - DNA, 20 bp, mouse
gagagctggtagagtaaacg

SEQ ID NO: 412899 - DNA, 20 bp, mouse
gacgaccggagcgcgctcaa

SEQ ID NO: 412900 - DNA, 20 bp, mouse
ggtagagtaaacgtggctac

SEQ ID NO: 412901 - DNA, 20 bp, mouse
ggcatggagcagcacttggt

SEQ ID NO: 412902 - DNA, 20 bp, mouse
gcggtcgtcatggaaactcg

SEQ ID NO: 412903 - DNA, 20 bp, mouse
gaggccaatcagggcaacac

SEQ ID NO: 412904 - DNA, 20 bp, mouse
ggagcgcgctcaaaggctgc

SEQ ID NO: 412905 - DNA, 20 bp, mouse
ggagcgcgctccggtcgtca

SEQ ID NO: 412906 - DNA, 20 bp, mouse
gtctctgcagaaggagataa

SEQ ID NO: 412907 - DNA, 20 bp, mouse
gatggaccctgcctgaaaga

SEQ ID NO: 412908 - DNA, 20 bp, mouse
gtgaaggtgaataccttaca

SEQ ID NO: 412909 - DNA, 20 bp, mouse
ggagttggaggacttcaagg

SEQ ID NO: 412910 - DNA, 20 bp, mouse
gggcggcgcgagtgaagcag

SEQ ID NO: 412911 - DNA, 20 bp, mouse
ggaaggcgtcctccaagtaa

SEQ ID NO: 412912 - DNA, 20 bp, mouse
ggtattcaccttcataagaa

SEQ ID NO: 412913 - DNA, 20 bp, mouse
ggaaggtggccggggtacaa

SEQ ID NO: 412914 - DNA, 20 bp, mouse
ggagggccatgactgagaca

SEQ ID NO: 412915 - DNA, 20 bp, mouse
gggaagccctctttcaggca

SEQ ID NO: 412916 - DNA, 20 bp, mouse
ggtagagttagtaccagctt

SEQ ID NO: 412917 - DNA, 20 bp, mouse
gtgagctgaagccaatgtga

SEQ ID NO: 412918 - DNA, 20 bp, mouse
gagcttggaggtggactatt

SEQ ID NO: 412919 - DNA, 20 bp, mouse
gagggctctgaaaaaaatgg

SEQ ID NO: 412920 - DNA, 20 bp, mouse
gaaggcgctgaggcagtgtc

SEQ ID NO: 412921 - DNA, 20 bp, mouse
gctcagtctggaagatgaac

SEQ ID NO: 412922 - DNA, 20 bp, mouse
gagcgccttgattcagtgag

SEQ ID NO: 412923 - DNA, 20 bp, mouse
gtcagtgagaggtcggtcga

SEQ ID NO: 412924 - DNA, 20 bp, mouse
gacgaagagtcggtttctag

SEQ ID NO: 412925 - DNA, 20 bp, mouse
gccttgattcagtgagaggt

SEQ ID NO: 412926 - DNA, 20 bp, mouse
ggccccaaatgggagctgag

SEQ ID NO: 412927 - DNA, 20 bp, mouse
ggctggtaaaaaggctccaa

SEQ ID NO: 412928 - DNA, 20 bp, mouse
gcggcgttgccgccccaaat

SEQ ID NO: 412929 - DNA, 20 bp, mouse
ggcccctcagctcccatttg

SEQ ID NO: 412930 - DNA, 20 bp, mouse
gaggcaaagcctcagtccct

SEQ ID NO: 412931 - DNA, 20 bp, mouse
ggtagggccagctggtaaaa

SEQ ID NO: 412932 - DNA, 20 bp, mouse
ggttagggttcagaaagtgg

SEQ ID NO: 412933 - DNA, 20 bp, mouse
ggaaggaacgcactctggta

SEQ ID NO: 412934 - DNA, 20 bp, mouse
gaaagcagcgagggccaatg

SEQ ID NO: 412935 - DNA, 20 bp, mouse
gctgctcggactggaatact

SEQ ID NO: 412936 - DNA, 20 bp, mouse
ggctatgggagacgacccac

SEQ ID NO: 412937 - DNA, 20 bp, mouse
gccgtctacaggaggtgagt

SEQ ID NO: 412938 - DNA, 20 bp, mouse
gatgaaatgaaatggcaaca

SEQ ID NO: 412939 - DNA, 20 bp, mouse
gatagctggtaattatataa

SEQ ID NO: 412940 - DNA, 20 bp, mouse
gtacatagaccgtctacagg

SEQ ID NO: 412941 - DNA, 20 bp, mouse
ggaacaactagaatacccag

SEQ ID NO: 412942 - DNA, 20 bp, mouse
gtccgtcagctggttgctat

SEQ ID NO: 412943 - DNA, 20 bp, mouse
gatataagggaaaatccgaa

SEQ ID NO: 412944 - DNA, 20 bp, mouse
ggagtcacagaatacctgta

SEQ ID NO: 412945 - DNA, 20 bp, mouse
gcatcctcagccatccctct

SEQ ID NO: 412946 - DNA, 20 bp, mouse
gtggctgggctcatggtcag

SEQ ID NO: 412947 - DNA, 20 bp, mouse
gtgctgggttcctgccacaa

SEQ ID NO: 412948 - DNA, 20 bp, mouse
gaccatgagcccagccattg

SEQ ID NO: 412949 - DNA, 20 bp, mouse
gtggatcccgggactagatg

SEQ ID NO: 412950 - DNA, 20 bp, mouse
gtggcaggaacccagcaggc

SEQ ID NO: 412951 - DNA, 20 bp, mouse
gggttcctgccacaatggct

SEQ ID NO: 412952 - DNA, 20 bp, mouse
gaggcgggcggcactgagca

SEQ ID NO: 412953 - DNA, 20 bp, mouse
gcagtggaactcaagtaagt

SEQ ID NO: 412954 - DNA, 20 bp, mouse
ggtgagccccatctagtccc

SEQ ID NO: 412955 - DNA, 20 bp, mouse
gatcacaccactacaaagtg

SEQ ID NO: 412956 - DNA, 20 bp, mouse
gcagcggcgggcacaggata

SEQ ID NO: 412957 - DNA, 20 bp, mouse
gcaggcagaagacaagtcgt

SEQ ID NO: 412958 - DNA, 20 bp, mouse
gtctgcagctgcaggtagac

SEQ ID NO: 412959 - DNA, 20 bp, mouse
gcaactcgtttggaaggcag

SEQ ID NO: 412960 - DNA, 20 bp, mouse
gtgcccggaggtgtccataa

SEQ ID NO: 412961 - DNA, 20 bp, mouse
ggagccacccctaccagagg

SEQ ID NO: 412962 - DNA, 20 bp, mouse
gctcgtttggaaggcagcgg

SEQ ID NO: 412963 - DNA, 20 bp, mouse
gcgagagccacccctaccag

SEQ ID NO: 412964 - DNA, 20 bp, mouse
gcggaggtgtccataagggt

SEQ ID NO: 412965 - DNA, 20 bp, mouse
gtggggccaactcgtttgga

SEQ ID NO: 412966 - DNA, 20 bp, mouse
gtaaggtggggtctggagta

SEQ ID NO: 412967 - DNA, 20 bp, mouse
gaccttagttaagtaaggtg

SEQ ID NO: 412968 - DNA, 20 bp, mouse
gaccccaccttacttaacta

SEQ ID NO: 412969 - DNA, 20 bp, mouse
gcaccaagggaacacctcat

SEQ ID NO: 412970 - DNA, 20 bp, mouse
gtccaggtacatctcaccaa

SEQ ID NO: 412971 - DNA, 20 bp, mouse
gagcatggctaacggacaga

SEQ ID NO: 412972 - DNA, 20 bp, mouse
gcttctggcattgcatcaca

SEQ ID NO: 412973 - DNA, 20 bp, mouse
gtaaggttaaaccccagagc

SEQ ID NO: 412974 - DNA, 20 bp, mouse
gcaatgccagaaggtttcca

SEQ ID NO: 412975 - DNA, 20 bp, mouse
gtggatgcatccaggtccgt

SEQ ID NO: 412976 - DNA, 20 bp, mouse
ggagctggagagccgcccag

SEQ ID NO: 412977 - DNA, 20 bp, mouse
gggagagccctaagcgatgg

SEQ ID NO: 412978 - DNA, 20 bp, mouse
gcgactcaccgggtctctca

SEQ ID NO: 412979 - DNA, 20 bp, mouse
gcagggagagccctaagcga

SEQ ID NO: 412980 - DNA, 20 bp, mouse
gagccctaagcgatggagga

SEQ ID NO: 412981 - DNA, 20 bp, mouse
gggctgaaggaggaaggtct

SEQ ID NO: 412982 - DNA, 20 bp, mouse
gctccctgccctgagagacc

SEQ ID NO: 412983 - DNA, 20 bp, mouse
gcaccgggtctctcagggca

SEQ ID NO: 412984 - DNA, 20 bp, mouse
gactaccccgaacccacggg

SEQ ID NO: 412985 - DNA, 20 bp, mouse
gtcggtccggagagtgctgg

SEQ ID NO: 412986 - DNA, 20 bp, mouse
gccgagtggataggatggag

SEQ ID NO: 412987 - DNA, 20 bp, mouse
gctactccgagtggatagga

SEQ ID NO: 412988 - DNA, 20 bp, mouse
gctatccactcggagtagaa

SEQ ID NO: 412989 - DNA, 20 bp, mouse
gccttcccttctactccgag

SEQ ID NO: 412990 - DNA, 20 bp, mouse
gcacttggccagtggctgac

SEQ ID NO: 412991 - DNA, 20 bp, mouse
gccagtggctgacaggccac

SEQ ID NO: 412992 - DNA, 20 bp, mouse
gaaggaagaaagccccacta

SEQ ID NO: 412993 - DNA, 20 bp, mouse
ggccttactaagccatagtg

SEQ ID NO: 412994 - DNA, 20 bp, mouse
gtccaaagtcacttggccag

SEQ ID NO: 412995 - DNA, 20 bp, mouse
gggataggatggagtggcat

SEQ ID NO: 412996 - DNA, 20 bp, mouse
ggatttggcgggaagttcca

SEQ ID NO: 412997 - DNA, 20 bp, mouse
ggtcaaaagactgcgggcca

SEQ ID NO: 412998 - DNA, 20 bp, mouse
gcttgtgcacatcaagctaa

SEQ ID NO: 412999 - DNA, 20 bp, mouse
ggcgtgcgcggaggatttgg

SEQ ID NO: 413000 - DNA, 20 bp, mouse
gagtgtgcgagcgacaagtg

SEQ ID NO: 413001 - DNA, 20 bp, mouse
gtgcgcgtgcgcggaggatt

SEQ ID NO: 413002 - DNA, 20 bp, mouse
ggcccagaaacttccctcca

SEQ ID NO: 413003 - DNA, 20 bp, mouse
gtcctccagaggctgcgtgt

SEQ ID NO: 413004 - DNA, 20 bp, mouse
ggagcgggttccgccttgga

SEQ ID NO: 413005 - DNA, 20 bp, mouse
gaccctctggaggctcatgg

SEQ ID NO: 413006 - DNA, 20 bp, mouse
gcctctggaagcctgaaaac

SEQ ID NO: 413007 - DNA, 20 bp, mouse
ggactcttgtagttgaactg

SEQ ID NO: 413008 - DNA, 20 bp, mouse
gaggtcgccttgtctgcttt

SEQ ID NO: 413009 - DNA, 20 bp, mouse
ggtagcatacgtttggtaca

SEQ ID NO: 413010 - DNA, 20 bp, mouse
gacgtctccaaaagcagaca

SEQ ID NO: 413011 - DNA, 20 bp, mouse
gtggaggacctaaaggaagc

SEQ ID NO: 413012 - DNA, 20 bp, mouse
gagaacatcctgcttccttt

SEQ ID NO: 413013 - DNA, 20 bp, mouse
gaggatgttctcctgttttc

SEQ ID NO: 413014 - DNA, 20 bp, mouse
gcagacaaggcgacctctct

SEQ ID NO: 413015 - DNA, 20 bp, mouse
gacacccaggcagtgacctc

SEQ ID NO: 413016 - DNA, 20 bp, mouse
gtcagtgtgggacacagagg

SEQ ID NO: 413017 - DNA, 20 bp, mouse
gactgagcggagggacgtct

SEQ ID NO: 413018 - DNA, 20 bp, mouse
gacgtccctccgctcagtgt

SEQ ID NO: 413019 - DNA, 20 bp, mouse
gtgtgtcccacactgagcgg

SEQ ID NO: 413020 - DNA, 20 bp, mouse
gggagcctggagagatttgg

SEQ ID NO: 413021 - DNA, 20 bp, mouse
gaaggagacgccgaagagga

SEQ ID NO: 413022 - DNA, 20 bp, mouse
gcgtctccaaaaagtgtcca

SEQ ID NO: 413023 - DNA, 20 bp, mouse
gtggcaaggagacgccgaag

SEQ ID NO: 413024 - DNA, 20 bp, mouse
ggagaatgttccctcctctt

SEQ ID NO: 413025 - DNA, 20 bp, mouse
ggtctgggcctgataccact

SEQ ID NO: 413026 - DNA, 20 bp, mouse
ggcgcgagcccaaaatggga

SEQ ID NO: 413027 - DNA, 20 bp, mouse
gacgcgcacggtggttggtg

SEQ ID NO: 413028 - DNA, 20 bp, mouse
gacgccggttcccgccttaa

SEQ ID NO: 413029 - DNA, 20 bp, mouse
gagcggcgcgagcccaaaat

SEQ ID NO: 413030 - DNA, 20 bp, mouse
gctggtcaagcggctcaaag

SEQ ID NO: 413031 - DNA, 20 bp, mouse
ggcgaggcctagccaagagc

SEQ ID NO: 413032 - DNA, 20 bp, mouse
ggttcccgccttaacggcag

SEQ ID NO: 413033 - DNA, 20 bp, mouse
ggctgggatagagataacgc

SEQ ID NO: 413034 - DNA, 20 bp, mouse
ggctcgcgccgctgccgtta

SEQ ID NO: 413035 - DNA, 20 bp, mouse
ggcgccgctgccgttaaggc

SEQ ID NO: 413036 - DNA, 20 bp, mouse
gtccatctcaacagctgggt

SEQ ID NO: 413037 - DNA, 20 bp, mouse
gagctgggtgggcagacacc

SEQ ID NO: 413038 - DNA, 20 bp, mouse
ggcagtaagttagaagtctg

SEQ ID NO: 413039 - DNA, 20 bp, mouse
gccaacctgcccactacctg

SEQ ID NO: 413040 - DNA, 20 bp, mouse
gcctgagtgccccaggtagt

SEQ ID NO: 413041 - DNA, 20 bp, mouse
gggagtcaaacccaggacta

SEQ ID NO: 413042 - DNA, 20 bp, mouse
gtcacccccttgccaatctg

SEQ ID NO: 413043 - DNA, 20 bp, mouse
gccccagagccgcaaagcag

SEQ ID NO: 413044 - DNA, 20 bp, mouse
gtgagatggaagcctcagat

SEQ ID NO: 413045 - DNA, 20 bp, mouse
gacctgagactgtgctatcc

SEQ ID NO: 413046 - DNA, 20 bp, mouse
gagcaagtgctccttcggaa

SEQ ID NO: 413047 - DNA, 20 bp, mouse
ggctccttcggaaaggaaga

SEQ ID NO: 413048 - DNA, 20 bp, mouse
gctcatactcctaggtgtag

SEQ ID NO: 413049 - DNA, 20 bp, mouse
gtcctaggtgtagaggtctc

SEQ ID NO: 413050 - DNA, 20 bp, mouse
gccggtatggtgacattcag

SEQ ID NO: 413051 - DNA, 20 bp, mouse
gaaactagcaagtgctcctt

SEQ ID NO: 413052 - DNA, 20 bp, mouse
gagtgacgccgaggaagccc

SEQ ID NO: 413053 - DNA, 20 bp, mouse
gtgccacaaacagggtatgg

SEQ ID NO: 413054 - DNA, 20 bp, mouse
gtaccgggagaacttctctt

SEQ ID NO: 413055 - DNA, 20 bp, mouse
gcacaaacagggtatggagg

SEQ ID NO: 413056 - DNA, 20 bp, mouse
ggtaaagtaagagctctgca

SEQ ID NO: 413057 - DNA, 20 bp, mouse
gtaagagctctgcagggtct

SEQ ID NO: 413058 - DNA, 20 bp, mouse
ggtagacttcccaaaatcct

SEQ ID NO: 413059 - DNA, 20 bp, mouse
gaggcatgggagtctgaggt

SEQ ID NO: 413060 - DNA, 20 bp, mouse
ggctgaggcatgggagtctg

SEQ ID NO: 413061 - DNA, 20 bp, mouse
ggcagagaaagatccttagg

SEQ ID NO: 413062 - DNA, 20 bp, mouse
gagcagtgctcttggagaag

SEQ ID NO: 413063 - DNA, 20 bp, mouse
gcatagcaatcattaaggtg

SEQ ID NO: 413064 - DNA, 20 bp, mouse
gagagctcttactttactga

SEQ ID NO: 413065 - DNA, 20 bp, mouse
ggagggttggtacgaaaggt

SEQ ID NO: 413066 - DNA, 20 bp, mouse
gtagccatggcacctccggg

SEQ ID NO: 413067 - DNA, 20 bp, mouse
ggtgtagccatggcacctcc

SEQ ID NO: 413068 - DNA, 20 bp, mouse
ggagccgcggagtgtagcca

SEQ ID NO: 413069 - DNA, 20 bp, mouse
ggtgccatggctacactccg

SEQ ID NO: 413070 - DNA, 20 bp, mouse
gccggacggtgactgaactg

SEQ ID NO: 413071 - DNA, 20 bp, mouse
ggcggaacctgtgagcggag

SEQ ID NO: 413072 - DNA, 20 bp, mouse
ggtgactgaactgtgggagt

SEQ ID NO: 413073 - DNA, 20 bp, mouse
gtttcctcccggaggtgcca

SEQ ID NO: 413074 - DNA, 20 bp, mouse
gcggggctgtgatagacgaa

SEQ ID NO: 413075 - DNA, 20 bp, mouse
gggatgctctgaaacctggt

SEQ ID NO: 413076 - DNA, 20 bp, mouse
ggctcccagaaaagtgaaga

SEQ ID NO: 413077 - DNA, 20 bp, mouse
gcagtgcaaatgaacttaat

SEQ ID NO: 413078 - DNA, 20 bp, mouse
ggtaaatattccatgtgcaa

SEQ ID NO: 413079 - DNA, 20 bp, mouse
gtttcatgggtaaaaacttt

SEQ ID NO: 413080 - DNA, 20 bp, mouse
gggaaaaatgatattttcta

SEQ ID NO: 413081 - DNA, 20 bp, mouse
gatcataattagaagagata

SEQ ID NO: 413082 - DNA, 20 bp, mouse
gtcaccttcttcacttttct

SEQ ID NO: 413083 - DNA, 20 bp, mouse
gtattcagcaacactgatat

SEQ ID NO: 413084 - DNA, 20 bp, mouse
ggagatagggtatttttcat

SEQ ID NO: 413085 - DNA, 20 bp, mouse
gacttcttcacacaaatgtc

SEQ ID NO: 413086 - DNA, 20 bp, mouse
ggggaccccagagctcatag

SEQ ID NO: 413087 - DNA, 20 bp, mouse
gagaggaggactctcagtaa

SEQ ID NO: 413088 - DNA, 20 bp, mouse
ggacaccactatgagctctg

SEQ ID NO: 413089 - DNA, 20 bp, mouse
gctgccttcacttacctaag

SEQ ID NO: 413090 - DNA, 20 bp, mouse
gcttcctcttaggtaagtga

SEQ ID NO: 413091 - DNA, 20 bp, mouse
gctgtagatgagacacccat

SEQ ID NO: 413092 - DNA, 20 bp, mouse
gtagatggccttgctgactt

SEQ ID NO: 413093 - DNA, 20 bp, mouse
gctgacttgggtgggatagt

SEQ ID NO: 413094 - DNA, 20 bp, mouse
ggcaaggccatctagcccga

SEQ ID NO: 413095 - DNA, 20 bp, mouse
gaattcagaaggaagcccat

SEQ ID NO: 413096 - DNA, 20 bp, mouse
gtcagcttgggcacttccag

SEQ ID NO: 413097 - DNA, 20 bp, mouse
gcatcgatgtgggtcttcca

SEQ ID NO: 413098 - DNA, 20 bp, mouse
gcgaagagacgaggacatgc

SEQ ID NO: 413099 - DNA, 20 bp, mouse
gaggaactccggagacaaga

SEQ ID NO: 413100 - DNA, 20 bp, mouse
ggagtaagcccgtccatcca

SEQ ID NO: 413101 - DNA, 20 bp, mouse
ggcttggctttcatcgatgt

SEQ ID NO: 413102 - DNA, 20 bp, mouse
ggtggtagccgtggatggac

SEQ ID NO: 413103 - DNA, 20 bp, mouse
gggacatgctggtggcttga

SEQ ID NO: 413104 - DNA, 20 bp, mouse
ggggcttactcgaagagacg

SEQ ID NO: 413105 - DNA, 20 bp, mouse
gagaggctcttcaggaactc

SEQ ID NO: 413106 - DNA, 20 bp, mouse
gcggcggcgcaggccggaca

SEQ ID NO: 413107 - DNA, 20 bp, mouse
ggtcttcgaggtgggctcgg

SEQ ID NO: 413108 - DNA, 20 bp, mouse
ggagcccacctcgaagactg

SEQ ID NO: 413109 - DNA, 20 bp, mouse
ggggaacgccggttggagag

SEQ ID NO: 413110 - DNA, 20 bp, mouse
gaacgccggttggagagcgg

SEQ ID NO: 413111 - DNA, 20 bp, mouse
gcaggccggacagggaacgc

SEQ ID NO: 413112 - DNA, 20 bp, mouse
ggactgaggaacgtcgtcta

SEQ ID NO: 413113 - DNA, 20 bp, mouse
gccggacagggaacgccggt

SEQ ID NO: 413114 - DNA, 20 bp, mouse
gaccgccgccgctctccaac

SEQ ID NO: 413115 - DNA, 20 bp, mouse
gtgaggaacgtcgtctacgg

SEQ ID NO: 413116 - DNA, 20 bp, mouse
gcccccctcggcactcacct

SEQ ID NO: 413117 - DNA, 20 bp, mouse
gacccaggtgagtgccgagg

SEQ ID NO: 413118 - DNA, 20 bp, mouse
gtcgcaggtaagcgtctcgc

SEQ ID NO: 413119 - DNA, 20 bp, mouse
gaccccggaagtggacgtcg

SEQ ID NO: 413120 - DNA, 20 bp, mouse
gggaggccgcgcctggacgg

SEQ ID NO: 413121 - DNA, 20 bp, mouse
gctccagggtcacccacccg

SEQ ID NO: 413122 - DNA, 20 bp, mouse
gtaagcgtctcgcgggagcg

SEQ ID NO: 413123 - DNA, 20 bp, mouse
gagacgcttacctgcgaccc

SEQ ID NO: 413124 - DNA, 20 bp, mouse
gctgggtcctagcaccccag

SEQ ID NO: 413125 - DNA, 20 bp, mouse
ggcgctggtggcaagcgagg

SEQ ID NO: 413126 - DNA, 20 bp, mouse
gtgagcagccgcgtgaactt

SEQ ID NO: 413127 - DNA, 20 bp, mouse
gcttctcaccaaagttcacg

SEQ ID NO: 413128 - DNA, 20 bp, mouse
gctttggtgagaagctaatg

SEQ ID NO: 413129 - DNA, 20 bp, mouse
ggcccacgaggaatcgatag

SEQ ID NO: 413130 - DNA, 20 bp, mouse
gttgcggccaccccttagca

SEQ ID NO: 413131 - DNA, 20 bp, mouse
gaaaataccctgctaagggg

SEQ ID NO: 413132 - DNA, 20 bp, mouse
gcgtgggcgatcgaactccc

SEQ ID NO: 413133 - DNA, 20 bp, mouse
ggcccaggcccgaaaccttg

SEQ ID NO: 413134 - DNA, 20 bp, mouse
gctcaggacacaggaagttc

SEQ ID NO: 413135 - DNA, 20 bp, mouse
gtcctctatcgattcctcgt

SEQ ID NO: 413136 - DNA, 20 bp, mouse
ggcacgcgcgtgtgtctcgt

SEQ ID NO: 413137 - DNA, 20 bp, mouse
gtctacctgcgacagagcca

SEQ ID NO: 413138 - DNA, 20 bp, mouse
gcgtgtgtctcgtcggtcaa

SEQ ID NO: 413139 - DNA, 20 bp, mouse
gcacacgcgcgtgcaaattg

SEQ ID NO: 413140 - DNA, 20 bp, mouse
ggcaggcaaacggaaactaa

SEQ ID NO: 413141 - DNA, 20 bp, mouse
gacgcttaggggttgggcct

SEQ ID NO: 413142 - DNA, 20 bp, mouse
gccagtcggttactagaact

SEQ ID NO: 413143 - DNA, 20 bp, mouse
gcagtagtacatccgggtca

SEQ ID NO: 413144 - DNA, 20 bp, mouse
ggcgtgcaaattgtggttcc

SEQ ID NO: 413145 - DNA, 20 bp, mouse
gaaacggaaactaagggata

SEQ ID NO: 413146 - DNA, 20 bp, mouse
gactcggctgaggaaccgca

SEQ ID NO: 413147 - DNA, 20 bp, mouse
gtaagagattctggtccggt

SEQ ID NO: 413148 - DNA, 20 bp, mouse
ggacgcgactgagtgagtag

SEQ ID NO: 413149 - DNA, 20 bp, mouse
gctcttaagagattctggtc

SEQ ID NO: 413150 - DNA, 20 bp, mouse
gcccgcttcaccgtgcccac

SEQ ID NO: 413151 - DNA, 20 bp, mouse
gctgctccgggactacgctg

SEQ ID NO: 413152 - DNA, 20 bp, mouse
ggattctggtccggtgggca

SEQ ID NO: 413153 - DNA, 20 bp, mouse
gtggcagaaggctgcagggt

SEQ ID NO: 413154 - DNA, 20 bp, mouse
gctgcaggaacgcctccgag

SEQ ID NO: 413155 - DNA, 20 bp, mouse
gacgcgcaaccgccactcgg

SEQ ID NO: 413156 - DNA, 20 bp, mouse
gcgccttcaggagtaagaca

SEQ ID NO: 413157 - DNA, 20 bp, mouse
gcttcaggagtaagacatgg

SEQ ID NO: 413158 - DNA, 20 bp, mouse
gtactcggcgcaattgaggc

SEQ ID NO: 413159 - DNA, 20 bp, mouse
ggctgcgtgggagcatccca

SEQ ID NO: 413160 - DNA, 20 bp, mouse
gtgcgccgagtacaaaaact

SEQ ID NO: 413161 - DNA, 20 bp, mouse
ggctgcaccgggaaccgccg

SEQ ID NO: 413162 - DNA, 20 bp, mouse
gtaagcacgcgcagcaccct

SEQ ID NO: 413163 - DNA, 20 bp, mouse
gtaccgccggccccgccttc

SEQ ID NO: 413164 - DNA, 20 bp, mouse
ggcaggtagcatggggtcca

SEQ ID NO: 413165 - DNA, 20 bp, mouse
ggagctgctgaccccgaact

SEQ ID NO: 413166 - DNA, 20 bp, mouse
ggcggcagaggacctcggaa

SEQ ID NO: 413167 - DNA, 20 bp, mouse
gccaaagcttaggcctttca

SEQ ID NO: 413168 - DNA, 20 bp, mouse
gttatggccgcgcgggtctg

SEQ ID NO: 413169 - DNA, 20 bp, mouse
gagaacaccacagacccgcg

SEQ ID NO: 413170 - DNA, 20 bp, mouse
ggcgtgtcgacggtatgtgt

SEQ ID NO: 413171 - DNA, 20 bp, mouse
gaccctcaatggagacccca

SEQ ID NO: 413172 - DNA, 20 bp, mouse
gttaccatcacccaaagctt

SEQ ID NO: 413173 - DNA, 20 bp, mouse
gttggaagttatggccgcgc

SEQ ID NO: 413174 - DNA, 20 bp, mouse
ggccgcgtgtttggaagtta

SEQ ID NO: 413175 - DNA, 20 bp, mouse
gaggtcctctgccgcgtgtt

SEQ ID NO: 413176 - DNA, 20 bp, mouse
gctcccaggataagaaccgg

SEQ ID NO: 413177 - DNA, 20 bp, mouse
gttcctccggttcttatcct

SEQ ID NO: 413178 - DNA, 20 bp, mouse
gatatgtggggagtcagtag

SEQ ID NO: 413179 - DNA, 20 bp, mouse
gctaggggcgggaaggggaa

SEQ ID NO: 413180 - DNA, 20 bp, mouse
gggaagccaggtcatgatga

SEQ ID NO: 413181 - DNA, 20 bp, mouse
gggtccagcgcctaaggctg

SEQ ID NO: 413182 - DNA, 20 bp, mouse
gttgggaggtccagcgccta

SEQ ID NO: 413183 - DNA, 20 bp, mouse
gaggatcctaggggcgggaa

SEQ ID NO: 413184 - DNA, 20 bp, mouse
gaagaagtgtggctgaaggt

SEQ ID NO: 413185 - DNA, 20 bp, mouse
ggagactcatctagatatgt

SEQ ID NO: 413186 - DNA, 20 bp, mouse
gcaactcaggatactcacca

SEQ ID NO: 413187 - DNA, 20 bp, mouse
gcggaattggttgctagact

SEQ ID NO: 413188 - DNA, 20 bp, mouse
gcagtcttctcggagaggga

SEQ ID NO: 413189 - DNA, 20 bp, mouse
ggatttccttgacaccccag

SEQ ID NO: 413190 - DNA, 20 bp, mouse
gcccagtggcaagaggagtg

SEQ ID NO: 413191 - DNA, 20 bp, mouse
gtggcggggttacccggaat

SEQ ID NO: 413192 - DNA, 20 bp, mouse
gggcggggcgcctagtcgat

SEQ ID NO: 413193 - DNA, 20 bp, mouse
ggaagagcttaggaagctgg

SEQ ID NO: 413194 - DNA, 20 bp, mouse
ggtaaccccgccaatcgact

SEQ ID NO: 413195 - DNA, 20 bp, mouse
gcagctagagatggcggagt

SEQ ID NO: 413196 - DNA, 20 bp, mouse
ggcggcggccgagctgaacg

SEQ ID NO: 413197 - DNA, 20 bp, mouse
gaccggcgcggggcagcaga

SEQ ID NO: 413198 - DNA, 20 bp, mouse
gagagaagcgcaggccgaac

SEQ ID NO: 413199 - DNA, 20 bp, mouse
ggccaggctgcgggcgcgtg

SEQ ID NO: 413200 - DNA, 20 bp, mouse
gggacgcgcgtggggcgcag

SEQ ID NO: 413201 - DNA, 20 bp, mouse
gctacatagcgaggagcgac

SEQ ID NO: 413202 - DNA, 20 bp, mouse
gaccaggctgggagtcgctg

SEQ ID NO: 413203 - DNA, 20 bp, mouse
ggtcgccgaacaggaaccca

SEQ ID NO: 413204 - DNA, 20 bp, mouse
gacgcagtgctgaggatcgc

SEQ ID NO: 413205 - DNA, 20 bp, mouse
gcaggaccgggcgacagcgg

SEQ ID NO: 413206 - DNA, 20 bp, mouse
gccgctagccgagtgtacag

SEQ ID NO: 413207 - DNA, 20 bp, mouse
gtagccgagtgtacagcgga

SEQ ID NO: 413208 - DNA, 20 bp, mouse
gccgagtgtacagcggaggg

SEQ ID NO: 413209 - DNA, 20 bp, mouse
gtacactcggctagcgggag

SEQ ID NO: 413210 - DNA, 20 bp, mouse
gtgtacagcggagggcggcc

SEQ ID NO: 413211 - DNA, 20 bp, mouse
gcgcagcggcgcgtctccag

SEQ ID NO: 413212 - DNA, 20 bp, mouse
ggcgggagaggcctgcgcag

SEQ ID NO: 413213 - DNA, 20 bp, mouse
gtgtctacagggagagactg

SEQ ID NO: 413214 - DNA, 20 bp, mouse
gtttcgtgtcagcttcatgg

SEQ ID NO: 413215 - DNA, 20 bp, mouse
gcgaagccttggctcgggac

SEQ ID NO: 413216 - DNA, 20 bp, mouse
ggaagaggcagggcccaaga

SEQ ID NO: 413217 - DNA, 20 bp, mouse
gctcatgtctgtgaacggag

SEQ ID NO: 413218 - DNA, 20 bp, mouse
ggcgccctcgagagcctaaa

SEQ ID NO: 413219 - DNA, 20 bp, mouse
gctcggggaaggctcggaaa

SEQ ID NO: 413220 - DNA, 20 bp, mouse
gtgtgaacggagcggtgtgg

SEQ ID NO: 413221 - DNA, 20 bp, mouse
ggtctgtgaacggagcggtg

SEQ ID NO: 413222 - DNA, 20 bp, mouse
gccgaggcctgagggaagac

SEQ ID NO: 413223 - DNA, 20 bp, mouse
gggtccttttaggctctcga

SEQ ID NO: 413224 - DNA, 20 bp, mouse
gacgcgttcgactccggaag

SEQ ID NO: 413225 - DNA, 20 bp, mouse
ggccgccagatgctcgggga

SEQ ID NO: 413226 - DNA, 20 bp, mouse
gcaccacccaggatggacag

SEQ ID NO: 413227 - DNA, 20 bp, mouse
gccctaaggacatttctcag

SEQ ID NO: 413228 - DNA, 20 bp, mouse
ggggaggggtcctgaactct

SEQ ID NO: 413229 - DNA, 20 bp, mouse
gcagaaggcttccttcacac

SEQ ID NO: 413230 - DNA, 20 bp, mouse
gcaccgctgtccatcctggg

SEQ ID NO: 413231 - DNA, 20 bp, mouse
gactgtggcaccacccagga

SEQ ID NO: 413232 - DNA, 20 bp, mouse
gactcaccgctgtccatcct

SEQ ID NO: 413233 - DNA, 20 bp, mouse
gtggcactgtggcaccaccc

SEQ ID NO: 413234 - DNA, 20 bp, mouse
gtgactgcagaagcatcact

SEQ ID NO: 413235 - DNA, 20 bp, mouse
gcaggctctgagaacaaagc

SEQ ID NO: 413236 - DNA, 20 bp, mouse
gagcaggacgacgacgacaa

SEQ ID NO: 413237 - DNA, 20 bp, mouse
ggagccgcgccggaccgaca

SEQ ID NO: 413238 - DNA, 20 bp, mouse
ggtcgtcgtcctgctcgtcg

SEQ ID NO: 413239 - DNA, 20 bp, mouse
ggctgccgacaaggagcggg

SEQ ID NO: 413240 - DNA, 20 bp, mouse
ggggcgactccaaggaaacg

SEQ ID NO: 413241 - DNA, 20 bp, mouse
ggaacgctgccgacaaggag

SEQ ID NO: 413242 - DNA, 20 bp, mouse
ggtcgtcctgctcgtcgcgg

SEQ ID NO: 413243 - DNA, 20 bp, mouse
ggcgtcgatggggtacacaa

SEQ ID NO: 413244 - DNA, 20 bp, mouse
gcccgccgcccgctccttgt

SEQ ID NO: 413245 - DNA, 20 bp, mouse
gcccggggccggggccgtga

SEQ ID NO: 413246 - DNA, 20 bp, mouse
gcggggctgaatcgctgaag

SEQ ID NO: 413247 - DNA, 20 bp, mouse
gcgctgaagtggctgcgctg

SEQ ID NO: 413248 - DNA, 20 bp, mouse
ggcagtgcgggtcacttacc

SEQ ID NO: 413249 - DNA, 20 bp, mouse
ggaggaatggagattcaagg

SEQ ID NO: 413250 - DNA, 20 bp, mouse
gcgggtcacttacccggacg

SEQ ID NO: 413251 - DNA, 20 bp, mouse
gtgcgctaggcggtgaggaa

SEQ ID NO: 413252 - DNA, 20 bp, mouse
gggtgaggaatggagattca

SEQ ID NO: 413253 - DNA, 20 bp, mouse
gagcatggatgcgcaggagg

SEQ ID NO: 413254 - DNA, 20 bp, mouse
gcccggtgcgctaggcggtg

SEQ ID NO: 413255 - DNA, 20 bp, mouse
gagctaactgggtttcgctg

SEQ ID NO: 413256 - DNA, 20 bp, mouse
ggggtgtgtctagagagtta

SEQ ID NO: 413257 - DNA, 20 bp, mouse
gtgcggtgcaagacgctgtg

SEQ ID NO: 413258 - DNA, 20 bp, mouse
gcagctacacggacatccag

SEQ ID NO: 413259 - DNA, 20 bp, mouse
gcgcaggcgcaggagcatag

SEQ ID NO: 413260 - DNA, 20 bp, mouse
gcgctgcaggcccaggggtc

SEQ ID NO: 413261 - DNA, 20 bp, mouse
gctggaggcgctgcaggccc

SEQ ID NO: 413262 - DNA, 20 bp, mouse
gggatgtccgtgtagctgat

SEQ ID NO: 413263 - DNA, 20 bp, mouse
ggcaagaagaagctaaccga

SEQ ID NO: 413264 - DNA, 20 bp, mouse
gctagacacacccagacccc

SEQ ID NO: 413265 - DNA, 20 bp, mouse
gtgcaccgcactctaagcat

SEQ ID NO: 413266 - DNA, 20 bp, mouse
gcaggtggcacctgaatgaa

SEQ ID NO: 413267 - DNA, 20 bp, mouse
gacttcacctagggttgaca

SEQ ID NO: 413268 - DNA, 20 bp, mouse
ggttttcaggcccttcattc

SEQ ID NO: 413269 - DNA, 20 bp, mouse
gccagcagcctccagcaaac

SEQ ID NO: 413270 - DNA, 20 bp, mouse
gtcattgccctgtcaaccct

SEQ ID NO: 413271 - DNA, 20 bp, mouse
gcctaggtgaagtcggtgtc

SEQ ID NO: 413272 - DNA, 20 bp, mouse
gagtaggttcccctgttttc

SEQ ID NO: 413273 - DNA, 20 bp, mouse
ggtgataggatctgtccgag

SEQ ID NO: 413274 - DNA, 20 bp, mouse
gtcaggtaaaaccagtttgc

SEQ ID NO: 413275 - DNA, 20 bp, mouse
gagctaggctgaagtggtgc

SEQ ID NO: 413276 - DNA, 20 bp, mouse
gactcctctggaggcagggg

SEQ ID NO: 413277 - DNA, 20 bp, mouse
gcaggtgtcatggcccacac

SEQ ID NO: 413278 - DNA, 20 bp, mouse
gctagagaaaaggtgaaagg

SEQ ID NO: 413279 - DNA, 20 bp, mouse
ggcagtctcatctagagaaa

SEQ ID NO: 413280 - DNA, 20 bp, mouse
ggacccttagctagggacat

SEQ ID NO: 413281 - DNA, 20 bp, mouse
gagcccatgtccctagctaa

SEQ ID NO: 413282 - DNA, 20 bp, mouse
gctgcctcccctgcctccag

SEQ ID NO: 413283 - DNA, 20 bp, mouse
ggagtgatttaggaagtaag

SEQ ID NO: 413284 - DNA, 20 bp, mouse
gctggaaattctcaccaaaa

SEQ ID NO: 413285 - DNA, 20 bp, mouse
ggaaaagcaggaatcctttt

SEQ ID NO: 413286 - DNA, 20 bp, mouse
gggctgtggccccgacgact

SEQ ID NO: 413287 - DNA, 20 bp, mouse
ggccaagctggagctagaac

SEQ ID NO: 413288 - DNA, 20 bp, mouse
gggagacgctgcccagtcgt

SEQ ID NO: 413289 - DNA, 20 bp, mouse
gctagaactggagcgccgcg

SEQ ID NO: 413290 - DNA, 20 bp, mouse
gccagcttggcggctcggaa

SEQ ID NO: 413291 - DNA, 20 bp, mouse
ggtcgccggggagagattga

SEQ ID NO: 413292 - DNA, 20 bp, mouse
ggcagaggctgccccctcca

SEQ ID NO: 413293 - DNA, 20 bp, mouse
gctggggcaggaggctccgt

SEQ ID NO: 413294 - DNA, 20 bp, mouse
ggcctgcacagagggagccc

SEQ ID NO: 413295 - DNA, 20 bp, mouse
gacgcgcagtgagctggagg

SEQ ID NO: 413296 - DNA, 20 bp, mouse
gagccataggccttgcgagg

SEQ ID NO: 413297 - DNA, 20 bp, mouse
gggcccccagcaaagtaggt

SEQ ID NO: 413298 - DNA, 20 bp, mouse
ggtttgcacagtctgctcag

SEQ ID NO: 413299 - DNA, 20 bp, mouse
gttgtgagtatccagcaagg

SEQ ID NO: 413300 - DNA, 20 bp, mouse
gggctggcccccagcaaagt

SEQ ID NO: 413301 - DNA, 20 bp, mouse
ggtggcctttgcattaatgg

SEQ ID NO: 413302 - DNA, 20 bp, mouse
gaggccttgcgagggggcag

SEQ ID NO: 413303 - DNA, 20 bp, mouse
ggtggttgggttgtccatta

SEQ ID NO: 413304 - DNA, 20 bp, mouse
gctgggggccagccatggtt

SEQ ID NO: 413305 - DNA, 20 bp, mouse
gttcctaagtgaagctggca

SEQ ID NO: 413306 - DNA, 20 bp, mouse
gcctagaagctagcactggt

SEQ ID NO: 413307 - DNA, 20 bp, mouse
ggactcatggagcctcccat

SEQ ID NO: 413308 - DNA, 20 bp, mouse
gggtccccgatggcacggaa

SEQ ID NO: 413309 - DNA, 20 bp, mouse
ggagggccggggttctctaa

SEQ ID NO: 413310 - DNA, 20 bp, mouse
gcatggagcctcccatagga

SEQ ID NO: 413311 - DNA, 20 bp, mouse
gccaggtcgcaggtccccga

SEQ ID NO: 413312 - DNA, 20 bp, mouse
ggagaggaggaggcagccgg

SEQ ID NO: 413313 - DNA, 20 bp, mouse
gtctaaaggactggctacgc

SEQ ID NO: 413314 - DNA, 20 bp, mouse
gactgggccgtgagaagtcc

SEQ ID NO: 413315 - DNA, 20 bp, mouse
ggagaaccccggccctccta

SEQ ID NO: 413316 - DNA, 20 bp, mouse
gatgcaataagacctgcctg

SEQ ID NO: 413317 - DNA, 20 bp, mouse
gggccccacgttaagagtgt

SEQ ID NO: 413318 - DNA, 20 bp, mouse
gtaatcaaatgttagaaatt

SEQ ID NO: 413319 - DNA, 20 bp, mouse
gagttgaaagtgggacatta

SEQ ID NO: 413320 - DNA, 20 bp, mouse
gtttcccacactcttaacgt

SEQ ID NO: 413321 - DNA, 20 bp, mouse
gcttggccaattttattctt

SEQ ID NO: 413322 - DNA, 20 bp, mouse
gtatttatacagttgaaagt

SEQ ID NO: 413323 - DNA, 20 bp, mouse
gaacatcccaagaataaaat

SEQ ID NO: 413324 - DNA, 20 bp, mouse
gtaacatttgattaataatt

SEQ ID NO: 413325 - DNA, 20 bp, mouse
gaataagtgtggcctcaggc

SEQ ID NO: 413326 - DNA, 20 bp, mouse
gtgtctgtgacctagcagga

SEQ ID NO: 413327 - DNA, 20 bp, mouse
gccagtgtctgtgacctagc

SEQ ID NO: 413328 - DNA, 20 bp, mouse
gctatgaggtaaaaagtctg

SEQ ID NO: 413329 - DNA, 20 bp, mouse
gaggaagcaggagttctatg

SEQ ID NO: 413330 - DNA, 20 bp, mouse
gtaaaaacaagccaaaacat

SEQ ID NO: 413331 - DNA, 20 bp, mouse
ggcctaaaggaatctcaggt

SEQ ID NO: 413332 - DNA, 20 bp, mouse
gcctggcctaaaggaatctc

SEQ ID NO: 413333 - DNA, 20 bp, mouse
gactggacaggcaagccttg

SEQ ID NO: 413334 - DNA, 20 bp, mouse
gaggaatctcaggtgggtca

SEQ ID NO: 413335 - DNA, 20 bp, mouse
ggggatccaagaagacaggt

SEQ ID NO: 413336 - DNA, 20 bp, mouse
gtccgtgagaagccccttca

SEQ ID NO: 413337 - DNA, 20 bp, mouse
gagttgaggtgatggcgact

SEQ ID NO: 413338 - DNA, 20 bp, mouse
gtgatcgctagttgaggtga

SEQ ID NO: 413339 - DNA, 20 bp, mouse
ggcgctggctccgggagagg

SEQ ID NO: 413340 - DNA, 20 bp, mouse
gtccgtgaaggggcttctca

SEQ ID NO: 413341 - DNA, 20 bp, mouse
gttcacggactgaccaaatc

SEQ ID NO: 413342 - DNA, 20 bp, mouse
gcggattcgcaagcccgatt

SEQ ID NO: 413343 - DNA, 20 bp, mouse
gatcacccgcagccggacga

SEQ ID NO: 413344 - DNA, 20 bp, mouse
gtgcgggtgatcgctagttg

SEQ ID NO: 413345 - DNA, 20 bp, mouse
gcagcgctgggaggaggact

SEQ ID NO: 413346 - DNA, 20 bp, mouse
gtccttaagccgctagacca

SEQ ID NO: 413347 - DNA, 20 bp, mouse
gctacgcagcctcagaccca

SEQ ID NO: 413348 - DNA, 20 bp, mouse
gttaagaggccatggtctag

SEQ ID NO: 413349 - DNA, 20 bp, mouse
gtcagacccacggtggctgg

SEQ ID NO: 413350 - DNA, 20 bp, mouse
ggggcagtcgggccgttaag

SEQ ID NO: 413351 - DNA, 20 bp, mouse
gtcgggccgttaagaggcca

SEQ ID NO: 413352 - DNA, 20 bp, mouse
gctcaggaacggctcctcgg

SEQ ID NO: 413353 - DNA, 20 bp, mouse
ggcaaaggtcccccaagagt

SEQ ID NO: 413354 - DNA, 20 bp, mouse
gtaaggaactgattctgcgg

SEQ ID NO: 413355 - DNA, 20 bp, mouse
gtggcaaacctcctcaggaa

SEQ ID NO: 413356 - DNA, 20 bp, mouse
gtgtaaataaactcaccaca

SEQ ID NO: 413357 - DNA, 20 bp, mouse
gtccatagtctgatcttcac

SEQ ID NO: 413358 - DNA, 20 bp, mouse
ggcctgtgaagatcagacta

SEQ ID NO: 413359 - DNA, 20 bp, mouse
gaggtgatcgtgagcagtgg

SEQ ID NO: 413360 - DNA, 20 bp, mouse
gcaggcatccctcgctgcct

SEQ ID NO: 413361 - DNA, 20 bp, mouse
gcacagctgcttctgggcca

SEQ ID NO: 413362 - DNA, 20 bp, mouse
gttacaaacccaggcagcga

SEQ ID NO: 413363 - DNA, 20 bp, mouse
gcgtgagcagtggaggatga

SEQ ID NO: 413364 - DNA, 20 bp, mouse
ggcaagaagtgttcagtcct

SEQ ID NO: 413365 - DNA, 20 bp, mouse
ggcctcgtggggcacagcac

SEQ ID NO: 413366 - DNA, 20 bp, mouse
gagctggctatcgaaactgc

SEQ ID NO: 413367 - DNA, 20 bp, mouse
ggattgtgaatggcttatat

SEQ ID NO: 413368 - DNA, 20 bp, mouse
gtctataggttgaagtaatt

SEQ ID NO: 413369 - DNA, 20 bp, mouse
ggaatgctggttaattcctt

SEQ ID NO: 413370 - DNA, 20 bp, mouse
gtctgtggggaaataagtaa

SEQ ID NO: 413371 - DNA, 20 bp, mouse
ggtttcagtatccaagccta

SEQ ID NO: 413372 - DNA, 20 bp, mouse
gaagtaaacaactccaataa

SEQ ID NO: 413373 - DNA, 20 bp, mouse
gacaatctcagttcaccagc

SEQ ID NO: 413374 - DNA, 20 bp, mouse
gctggttaattccttaggct

SEQ ID NO: 413375 - DNA, 20 bp, mouse
gcttaggtgaaaaattctgt

SEQ ID NO: 413376 - DNA, 20 bp, mouse
gtccgcgggaccaagaccac

SEQ ID NO: 413377 - DNA, 20 bp, mouse
gggtcccgcggaggtaagag

SEQ ID NO: 413378 - DNA, 20 bp, mouse
gacagtcgcggggaacccgg

SEQ ID NO: 413379 - DNA, 20 bp, mouse
gcctgtagtaggcggcgcag

SEQ ID NO: 413380 - DNA, 20 bp, mouse
gcccattctgtagcagaatt

SEQ ID NO: 413381 - DNA, 20 bp, mouse
gtactacagggagggtccac

SEQ ID NO: 413382 - DNA, 20 bp, mouse
ggaaaggtcacagagcacgc

SEQ ID NO: 413383 - DNA, 20 bp, mouse
ggcgccgcctactacaggga

SEQ ID NO: 413384 - DNA, 20 bp, mouse
ggcctgtggtcttggtcccg

SEQ ID NO: 413385 - DNA, 20 bp, mouse
gcagtctggatgactcagcc

SEQ ID NO: 413386 - DNA, 20 bp, mouse
gaggatgcccgagttcatca

SEQ ID NO: 413387 - DNA, 20 bp, mouse
ggccttatgcacatgcgtaa

SEQ ID NO: 413388 - DNA, 20 bp, mouse
gacatgcgtaaaggtgtcta

SEQ ID NO: 413389 - DNA, 20 bp, mouse
gtgcataaggctggctttga

SEQ ID NO: 413390 - DNA, 20 bp, mouse
gaccctgagaagctgcagac

SEQ ID NO: 413391 - DNA, 20 bp, mouse
gggtacctgcagccttacca

SEQ ID NO: 413392 - DNA, 20 bp, mouse
gtccaggtgctcctgaccac

SEQ ID NO: 413393 - DNA, 20 bp, mouse
gtccacatactgtgggagaa

SEQ ID NO: 413394 - DNA, 20 bp, mouse
gttcggttccaggggaccaa

SEQ ID NO: 413395 - DNA, 20 bp, mouse
gggagaagccaaacacgaag

SEQ ID NO: 413396 - DNA, 20 bp, mouse
ggcttcctgtgaggtcaggt

SEQ ID NO: 413397 - DNA, 20 bp, mouse
gcccggggctcggcgtccac

SEQ ID NO: 413398 - DNA, 20 bp, mouse
gcctgcgcgcacggttcccg

SEQ ID NO: 413399 - DNA, 20 bp, mouse
gcaggaagcgcgcaccgcag

SEQ ID NO: 413400 - DNA, 20 bp, mouse
gaaccgtgcgcgcaggtggg

SEQ ID NO: 413401 - DNA, 20 bp, mouse
ggtggctccaggccccgcag

SEQ ID NO: 413402 - DNA, 20 bp, mouse
ggccccgcagcggtgggaag

SEQ ID NO: 413403 - DNA, 20 bp, mouse
ggcgcgcttcctgtgaggtc

SEQ ID NO: 413404 - DNA, 20 bp, mouse
gctccaggccccgcagcggt

SEQ ID NO: 413405 - DNA, 20 bp, mouse
gcgggttgagatgaacacgg

SEQ ID NO: 413406 - DNA, 20 bp, mouse
gtgcgtccgtgggacaccgg

SEQ ID NO: 413407 - DNA, 20 bp, mouse
gcctgtgcgtccataagaca

SEQ ID NO: 413408 - DNA, 20 bp, mouse
gctatgcgtccgtgggacac

SEQ ID NO: 413409 - DNA, 20 bp, mouse
gtgggacaccggaggtggcc

SEQ ID NO: 413410 - DNA, 20 bp, mouse
ggtctcttcctggccacctc

SEQ ID NO: 413411 - DNA, 20 bp, mouse
gaactctcctatgcgtccgt

SEQ ID NO: 413412 - DNA, 20 bp, mouse
gggagggctaaggacaagtt

SEQ ID NO: 413413 - DNA, 20 bp, mouse
gagcttccggagacgacctg

SEQ ID NO: 413414 - DNA, 20 bp, mouse
ggtcaccgaacaggcggcgg

SEQ ID NO: 413415 - DNA, 20 bp, mouse
ggcctgttcggtgacgtaag

SEQ ID NO: 413416 - DNA, 20 bp, mouse
ggcaggtgagtcctcatctt

SEQ ID NO: 413417 - DNA, 20 bp, mouse
ggaggatcccagcagaatca

SEQ ID NO: 413418 - DNA, 20 bp, mouse
ggctctcattgcccaagatg

SEQ ID NO: 413419 - DNA, 20 bp, mouse
gcaggggcaacaaccaaagc

SEQ ID NO: 413420 - DNA, 20 bp, mouse
gaggacaggatgctagacag

SEQ ID NO: 413421 - DNA, 20 bp, mouse
gcagaggaggtgttggcata

SEQ ID NO: 413422 - DNA, 20 bp, mouse
gatgcggtcctgctgtccag

SEQ ID NO: 413423 - DNA, 20 bp, mouse
gccacttccttgcttaccag

SEQ ID NO: 413424 - DNA, 20 bp, mouse
gagcaggaccgcatcatctg

SEQ ID NO: 413425 - DNA, 20 bp, mouse
ggtctctgtccagctagcac

SEQ ID NO: 413426 - DNA, 20 bp, mouse
gggctggtgttggccatgag

SEQ ID NO: 413427 - DNA, 20 bp, mouse
gatgagaggcagatcatccc

SEQ ID NO: 413428 - DNA, 20 bp, mouse
gaggcagatcatcccgggaa

SEQ ID NO: 413429 - DNA, 20 bp, mouse
gataaagctggacccttccc

SEQ ID NO: 413430 - DNA, 20 bp, mouse
gccaactgcagactacacca

SEQ ID NO: 413431 - DNA, 20 bp, mouse
gacaagcatgtggctggtgt

SEQ ID NO: 413432 - DNA, 20 bp, mouse
gcttgtgaagcactacatac

SEQ ID NO: 413433 - DNA, 20 bp, mouse
gattctctatgtcccatctt

SEQ ID NO: 413434 - DNA, 20 bp, mouse
gcgaatccatctcaggaaca

SEQ ID NO: 413435 - DNA, 20 bp, mouse
gaagcactacatactggatt

SEQ ID NO: 413436 - DNA, 20 bp, mouse
gtatctagcaatccccaagg

SEQ ID NO: 413437 - DNA, 20 bp, mouse
gtgcaactgcagggacattt

SEQ ID NO: 413438 - DNA, 20 bp, mouse
gggctggtgttggccatgag

SEQ ID NO: 413439 - DNA, 20 bp, mouse
gatgagaggcagatcatccc

SEQ ID NO: 413440 - DNA, 20 bp, mouse
gctgcaggatctgcaactgc

SEQ ID NO: 413441 - DNA, 20 bp, mouse
gaggcagatcatcccgggaa

SEQ ID NO: 413442 - DNA, 20 bp, mouse
ggataagatagccaacctgc

SEQ ID NO: 413443 - DNA, 20 bp, mouse
gccaactgcagactacacca

SEQ ID NO: 413444 - DNA, 20 bp, mouse
gtccacaactttcaattccc

SEQ ID NO: 413445 - DNA, 20 bp, mouse
gagtagctcagaatcacaaa

SEQ ID NO: 413446 - DNA, 20 bp, mouse
ggcgctcccggctcccgact

SEQ ID NO: 413447 - DNA, 20 bp, mouse
ggattcacctagagacgggg

SEQ ID NO: 413448 - DNA, 20 bp, mouse
ggggccgcgcgcagccgagt

SEQ ID NO: 413449 - DNA, 20 bp, mouse
gagtccgcggggacaagcgg

SEQ ID NO: 413450 - DNA, 20 bp, mouse
gcgcgggcgcgaccctcggg

SEQ ID NO: 413451 - DNA, 20 bp, mouse
gggccagcgcggccgcccga

SEQ ID NO: 413452 - DNA, 20 bp, mouse
gtgcgtggggcgcagaccca

SEQ ID NO: 413453 - DNA, 20 bp, mouse
gcgcgcagcaggtggcggta

SEQ ID NO: 413454 - DNA, 20 bp, mouse
gttggcgagcgtgccgggaa

SEQ ID NO: 413455 - DNA, 20 bp, mouse
ggctccagtgccaggtacct

SEQ ID NO: 413456 - DNA, 20 bp, mouse
gctgtttagggatatctgga

SEQ ID NO: 413457 - DNA, 20 bp, mouse
gtgtggtaggatggaacttt

SEQ ID NO: 413458 - DNA, 20 bp, mouse
gtgaggtataccaagcgttt

SEQ ID NO: 413459 - DNA, 20 bp, mouse
ggaaaaaaaccccaaacgct

SEQ ID NO: 413460 - DNA, 20 bp, mouse
gtggcaaagatgtagagtaa

SEQ ID NO: 413461 - DNA, 20 bp, mouse
gactcaagtaagtgtccttg

SEQ ID NO: 413462 - DNA, 20 bp, mouse
gacacatgtcagaatggcta

SEQ ID NO: 413463 - DNA, 20 bp, mouse
gtatgagtaacagctcatgc

SEQ ID NO: 413464 - DNA, 20 bp, mouse
gcaaactaatacaaccacta

SEQ ID NO: 413465 - DNA, 20 bp, mouse
gtaatatacaaaatgtataa

SEQ ID NO: 413466 - DNA, 20 bp, mouse
gccctggctggtcagtgcaa

SEQ ID NO: 413467 - DNA, 20 bp, mouse
gcccaccccaaaacccaggg

SEQ ID NO: 413468 - DNA, 20 bp, mouse
gggactgtcttccaggtact

SEQ ID NO: 413469 - DNA, 20 bp, mouse
gccccaaaacccagggaggt

SEQ ID NO: 413470 - DNA, 20 bp, mouse
gcagtcctgcaacttctttc

SEQ ID NO: 413471 - DNA, 20 bp, mouse
gcacagctcagaaaggaaca

SEQ ID NO: 413472 - DNA, 20 bp, mouse
gccagcctgaaagaagttgc

SEQ ID NO: 413473 - DNA, 20 bp, mouse
gtcctttgcactgaccagcc

SEQ ID NO: 413474 - DNA, 20 bp, mouse
gtatgtatagtgaaatagac

SEQ ID NO: 413475 - DNA, 20 bp, mouse
gatcccccaccccaaaaccc

SEQ ID NO: 413476 - DNA, 20 bp, mouse
gtccccggggaacttacctg

SEQ ID NO: 413477 - DNA, 20 bp, mouse
ggccgcaggtaagttccccg

SEQ ID NO: 413478 - DNA, 20 bp, mouse
ggcaaatccaccactccccg

SEQ ID NO: 413479 - DNA, 20 bp, mouse
ggcggccaagtcaaactcca

SEQ ID NO: 413480 - DNA, 20 bp, mouse
gctggatggccggaaacttt

SEQ ID NO: 413481 - DNA, 20 bp, mouse
ggcccgcccggcgctttaag

SEQ ID NO: 413482 - DNA, 20 bp, mouse
ggcttcccttcagtattccc

SEQ ID NO: 413483 - DNA, 20 bp, mouse
gtgtggccgaggaccaagga

SEQ ID NO: 413484 - DNA, 20 bp, mouse
gccagagacacgctagatgg

SEQ ID NO: 413485 - DNA, 20 bp, mouse
gagcagctccagcgactcag

SEQ ID NO: 413486 - DNA, 20 bp, mouse
gttaccaactcaaggtctgt

SEQ ID NO: 413487 - DNA, 20 bp, mouse
gagacctacagaccttgagt

SEQ ID NO: 413488 - DNA, 20 bp, mouse
ggattagttatggacaatga

SEQ ID NO: 413489 - DNA, 20 bp, mouse
gtagttatggacaatgaggg

SEQ ID NO: 413490 - DNA, 20 bp, mouse
gatagggaggggattctaag

SEQ ID NO: 413491 - DNA, 20 bp, mouse
gactaatcattaccaactca

SEQ ID NO: 413492 - DNA, 20 bp, mouse
gctatcctaagccagggata

SEQ ID NO: 413493 - DNA, 20 bp, mouse
gcactcctcagtccctgaga

SEQ ID NO: 413494 - DNA, 20 bp, mouse
gctctggcagtagcaagaag

SEQ ID NO: 413495 - DNA, 20 bp, mouse
gtaattgagaacgataggga

SEQ ID NO: 413496 - DNA, 20 bp, mouse
gtcaccagcagctccaagga

SEQ ID NO: 413497 - DNA, 20 bp, mouse
ggtactcaccagcagctcca

SEQ ID NO: 413498 - DNA, 20 bp, mouse
gaggaaggcaaggaagatta

SEQ ID NO: 413499 - DNA, 20 bp, mouse
gtgtggctagagcagtcaat

SEQ ID NO: 413500 - DNA, 20 bp, mouse
gaggaagattaaggtcttca

SEQ ID NO: 413501 - DNA, 20 bp, mouse
gagtaaaacaggcatcatat

SEQ ID NO: 413502 - DNA, 20 bp, mouse
gggattatatatgttggaag

SEQ ID NO: 413503 - DNA, 20 bp, mouse
gcttgtacttggatccttgg

SEQ ID NO: 413504 - DNA, 20 bp, mouse
gaaggatccaagtacaagga

SEQ ID NO: 413505 - DNA, 20 bp, mouse
gtcaagacttagtgaatacc

SEQ ID NO: 413506 - DNA, 20 bp, mouse
gtgcagcggcgcagcatcta

SEQ ID NO: 413507 - DNA, 20 bp, mouse
gggacggcgctggcttgcag

SEQ ID NO: 413508 - DNA, 20 bp, mouse
gtccggagcctagcgcccgg

SEQ ID NO: 413509 - DNA, 20 bp, mouse
gagaggcagccagagaccgg

SEQ ID NO: 413510 - DNA, 20 bp, mouse
gagcgcttgagttcgtccag

SEQ ID NO: 413511 - DNA, 20 bp, mouse
gttgaggctgcggcggagga

SEQ ID NO: 413512 - DNA, 20 bp, mouse
gtgagttcgtccagcggctg

SEQ ID NO: 413513 - DNA, 20 bp, mouse
gcatcgaacgcgaggctcac

SEQ ID NO: 413514 - DNA, 20 bp, mouse
ggcagtgacggggcaacgag

SEQ ID NO: 413515 - DNA, 20 bp, mouse
gggatcctcactccaggagt

SEQ ID NO: 413516 - DNA, 20 bp, mouse
gggacctcagacccggaagt

SEQ ID NO: 413517 - DNA, 20 bp, mouse
gggagcctcggcctccgcca

SEQ ID NO: 413518 - DNA, 20 bp, mouse
gactcgcgcggcgaaagcgg

SEQ ID NO: 413519 - DNA, 20 bp, mouse
gaagtgcttggccctggcgg

SEQ ID NO: 413520 - DNA, 20 bp, mouse
gaacttccggacctcagacc

SEQ ID NO: 413521 - DNA, 20 bp, mouse
gccgggttcgaaacagcatg

SEQ ID NO: 413522 - DNA, 20 bp, mouse
gccgactcgcgcggcgaaag

SEQ ID NO: 413523 - DNA, 20 bp, mouse
gggaagtgggcgcaagtgct

SEQ ID NO: 413524 - DNA, 20 bp, mouse
gtgtttcgaacccggagcct

SEQ ID NO: 413525 - DNA, 20 bp, mouse
gttggccctggcggaggccg

SEQ ID NO: 413526 - DNA, 20 bp, mouse
gcgctgggcgccaccatcct

SEQ ID NO: 413527 - DNA, 20 bp, mouse
gcccttgcggcatcccagga

SEQ ID NO: 413528 - DNA, 20 bp, mouse
gagcggtgcaatgagcgatt

SEQ ID NO: 413529 - DNA, 20 bp, mouse
gttgcggcatcccaggatgg

SEQ ID NO: 413530 - DNA, 20 bp, mouse
gagtagcagcagcgatgcgg

SEQ ID NO: 413531 - DNA, 20 bp, mouse
gagcagcgatgcggaggaat

SEQ ID NO: 413532 - DNA, 20 bp, mouse
ggggatcacactgacaccga

SEQ ID NO: 413533 - DNA, 20 bp, mouse
gattcccgtggaggccgcag

SEQ ID NO: 413534 - DNA, 20 bp, mouse
ggccggtaggggactttctg

SEQ ID NO: 413535 - DNA, 20 bp, mouse
gcaaccccttgcggcatccc

SEQ ID NO: 413536 - DNA, 20 bp, mouse
gggctcctccgccaagacta

SEQ ID NO: 413537 - DNA, 20 bp, mouse
gcgccatcttgccccttctg

SEQ ID NO: 413538 - DNA, 20 bp, mouse
ggccaagactaggggacacc

SEQ ID NO: 413539 - DNA, 20 bp, mouse
gctaggggacaccaggaatt

SEQ ID NO: 413540 - DNA, 20 bp, mouse
gtcctcagcggagacgacaa

SEQ ID NO: 413541 - DNA, 20 bp, mouse
gcgcctcgcgcactcctcag

SEQ ID NO: 413542 - DNA, 20 bp, mouse
gtgtcccctagtcttggcgg

SEQ ID NO: 413543 - DNA, 20 bp, mouse
gctttcggggctcatctaaa

SEQ ID NO: 413544 - DNA, 20 bp, mouse
gcacatgcgcaaggaagtct

SEQ ID NO: 413545 - DNA, 20 bp, mouse
gtgtttgcggtgcctcagaa

SEQ ID NO: 413546 - DNA, 20 bp, mouse
gagcctgcccaaggtgtcca

SEQ ID NO: 413547 - DNA, 20 bp, mouse
gtgctggccatggacacctt

SEQ ID NO: 413548 - DNA, 20 bp, mouse
ggagctgccaggggcttagg

SEQ ID NO: 413549 - DNA, 20 bp, mouse
gagcagcagcagcctgccca

SEQ ID NO: 413550 - DNA, 20 bp, mouse
gggatgttagatcagagaca

SEQ ID NO: 413551 - DNA, 20 bp, mouse
gaggggtctgcgggagagag

SEQ ID NO: 413552 - DNA, 20 bp, mouse
gcacacctgcagctgaacgt

SEQ ID NO: 413553 - DNA, 20 bp, mouse
gagtgaagagggcactggtg

SEQ ID NO: 413554 - DNA, 20 bp, mouse
gagctgcacagggctcgggt

SEQ ID NO: 413555 - DNA, 20 bp, mouse
ggcccagcagggtaggacta

SEQ ID NO: 413556 - DNA, 20 bp, mouse
gaggaaactagcaaagatcc

SEQ ID NO: 413557 - DNA, 20 bp, mouse
gtgtaagaagtaattcacag

SEQ ID NO: 413558 - DNA, 20 bp, mouse
gtcagaatatccccactgta

SEQ ID NO: 413559 - DNA, 20 bp, mouse
gtatgatcaggaatgtgaat

SEQ ID NO: 413560 - DNA, 20 bp, mouse
ggtcttctaaaccctacagt

SEQ ID NO: 413561 - DNA, 20 bp, mouse
gaaaaatgtttaatattggt

SEQ ID NO: 413562 - DNA, 20 bp, mouse
ggagggagtgaagaagggat

SEQ ID NO: 413563 - DNA, 20 bp, mouse
gtgttagagggagtgaagaa

SEQ ID NO: 413564 - DNA, 20 bp, mouse
gaagatccaggtatgttaga

SEQ ID NO: 413565 - DNA, 20 bp, mouse
gtcactccctctaacatacc

SEQ ID NO: 413566 - DNA, 20 bp, mouse
gccaagaaggctcttctgaa

SEQ ID NO: 413567 - DNA, 20 bp, mouse
ggaaggctcttctgaaagga

SEQ ID NO: 413568 - DNA, 20 bp, mouse
ggcctccacctgttctccag

SEQ ID NO: 413569 - DNA, 20 bp, mouse
gaactcctctggagaacagg

SEQ ID NO: 413570 - DNA, 20 bp, mouse
ggtggaggccatccattagg

SEQ ID NO: 413571 - DNA, 20 bp, mouse
ggactcggccatgtcaactg

SEQ ID NO: 413572 - DNA, 20 bp, mouse
gtccccttccacagttgaca

SEQ ID NO: 413573 - DNA, 20 bp, mouse
gcatgcctggataaaggata

SEQ ID NO: 413574 - DNA, 20 bp, mouse
gatggatggcctccaccacc

SEQ ID NO: 413575 - DNA, 20 bp, mouse
gtcaccttccccctaatgga

SEQ ID NO: 413576 - DNA, 20 bp, mouse
gctggccagaaccaaatagt

SEQ ID NO: 413577 - DNA, 20 bp, mouse
gcgctctcgagcggtcgcca

SEQ ID NO: 413578 - DNA, 20 bp, mouse
gtgtcagtgacgctctcgag

SEQ ID NO: 413579 - DNA, 20 bp, mouse
ggacagtgagccggatccca

SEQ ID NO: 413580 - DNA, 20 bp, mouse
gaggacggccgggaagtcag

SEQ ID NO: 413581 - DNA, 20 bp, mouse
gaccaaatagtcggcatctc

SEQ ID NO: 413582 - DNA, 20 bp, mouse
gtccagcctcaaggaggatc

SEQ ID NO: 413583 - DNA, 20 bp, mouse
gtcggcatctcaggcagccc

SEQ ID NO: 413584 - DNA, 20 bp, mouse
ggcaggatcagcgccataga

SEQ ID NO: 413585 - DNA, 20 bp, mouse
ggcctgagatgccgactatt

SEQ ID NO: 413586 - DNA, 20 bp, mouse
ggatgcagagccacgcaggt

SEQ ID NO: 413587 - DNA, 20 bp, mouse
gtaggttcccgagggaagtg

SEQ ID NO: 413588 - DNA, 20 bp, mouse
gggagtgccagtacagaatc

SEQ ID NO: 413589 - DNA, 20 bp, mouse
gacagatcaggagcaagccc

SEQ ID NO: 413590 - DNA, 20 bp, mouse
ggtgggagccgggctcccct

SEQ ID NO: 413591 - DNA, 20 bp, mouse
gaggctgtccagggttaagg

SEQ ID NO: 413592 - DNA, 20 bp, mouse
ggcaagatgcagagccacgc

SEQ ID NO: 413593 - DNA, 20 bp, mouse
gtaagggagaaggtgaaggt

SEQ ID NO: 413594 - DNA, 20 bp, mouse
gttggggcccaggcagaagc

SEQ ID NO: 413595 - DNA, 20 bp, mouse
gcacccgaccaacaggataa

SEQ ID NO: 413596 - DNA, 20 bp, mouse
gctgaccatggtatctgagt

SEQ ID NO: 413597 - DNA, 20 bp, mouse
ggggctggtagcacacagat

SEQ ID NO: 413598 - DNA, 20 bp, mouse
ggctagaattaacacagcta

SEQ ID NO: 413599 - DNA, 20 bp, mouse
ggaggcggcaacggctggag

SEQ ID NO: 413600 - DNA, 20 bp, mouse
gatctccaactcagatacca

SEQ ID NO: 413601 - DNA, 20 bp, mouse
ggctggagcggcagctggaa

SEQ ID NO: 413602 - DNA, 20 bp, mouse
gaccacagcagaggcggcaa

SEQ ID NO: 413603 - DNA, 20 bp, mouse
ggggtttccaaatgaatgta

SEQ ID NO: 413604 - DNA, 20 bp, mouse
gagaactaccacagcagagg

SEQ ID NO: 413605 - DNA, 20 bp, mouse
gtctggacatctccataccc

SEQ ID NO: 413606 - DNA, 20 bp, mouse
gccccgacgcggagaacatg

SEQ ID NO: 413607 - DNA, 20 bp, mouse
ggaaggacacagctaagtag

SEQ ID NO: 413608 - DNA, 20 bp, mouse
gagctccatgctcaagacca

SEQ ID NO: 413609 - DNA, 20 bp, mouse
gtaagtaggggcagtaggga

SEQ ID NO: 413610 - DNA, 20 bp, mouse
ggctcaagaccacggccaga

SEQ ID NO: 413611 - DNA, 20 bp, mouse
ggcatggagctaggtgagtc

SEQ ID NO: 413612 - DNA, 20 bp, mouse
gcagctaagtaggggcagta

SEQ ID NO: 413613 - DNA, 20 bp, mouse
gcacaagcaggtataagggg

SEQ ID NO: 413614 - DNA, 20 bp, mouse
ggctaggtgagtcaggaata

SEQ ID NO: 413615 - DNA, 20 bp, mouse
ggaacatgaggcttcccttc

SEQ ID NO: 413616 - DNA, 20 bp, mouse
gggcccacgaggctacgctg

SEQ ID NO: 413617 - DNA, 20 bp, mouse
gagccgcagcgtagcctcgt

SEQ ID NO: 413618 - DNA, 20 bp, mouse
ggcctcgtgggccctccgca

SEQ ID NO: 413619 - DNA, 20 bp, mouse
gcccggccatggaggccctg

SEQ ID NO: 413620 - DNA, 20 bp, mouse
gcccagaggcccggccccag

SEQ ID NO: 413621 - DNA, 20 bp, mouse
gcggcgtgccccggccatgg

SEQ ID NO: 413622 - DNA, 20 bp, mouse
gcgttgtggaccgcactgta

SEQ ID NO: 413623 - DNA, 20 bp, mouse
ggccatggaggccctgcgga

SEQ ID NO: 413624 - DNA, 20 bp, mouse
gggcgcccgaggcccagggc

SEQ ID NO: 413625 - DNA, 20 bp, mouse
ggccctgcggagggcccacg

SEQ ID NO: 413626 - DNA, 20 bp, mouse
gggcaggcgagtcatcggga

SEQ ID NO: 413627 - DNA, 20 bp, mouse
gggacgcgcctgtcaagaca

SEQ ID NO: 413628 - DNA, 20 bp, mouse
gctggggcaggcgagtcatc

SEQ ID NO: 413629 - DNA, 20 bp, mouse
ggagggagccctgtcttgac

SEQ ID NO: 413630 - DNA, 20 bp, mouse
gcgcgccccaagaagccagt

SEQ ID NO: 413631 - DNA, 20 bp, mouse
ggacggtagccgagaaggac

SEQ ID NO: 413632 - DNA, 20 bp, mouse
gtggccgagaaggctctgga

SEQ ID NO: 413633 - DNA, 20 bp, mouse
gtggcggccaccagcgccca

SEQ ID NO: 413634 - DNA, 20 bp, mouse
ggctcgggcgaagggtaaga

SEQ ID NO: 413635 - DNA, 20 bp, mouse
gcgggcgaagggtaagacgg

SEQ ID NO: 413636 - DNA, 20 bp, mouse
gctagacaaggactcacctg

SEQ ID NO: 413637 - DNA, 20 bp, mouse
gagcgtccaggggagagcag

SEQ ID NO: 413638 - DNA, 20 bp, mouse
gtcgggatatggctctccaa

SEQ ID NO: 413639 - DNA, 20 bp, mouse
ggctcacccgcactgggacc

SEQ ID NO: 413640 - DNA, 20 bp, mouse
gtagctctgctcacccgcac

SEQ ID NO: 413641 - DNA, 20 bp, mouse
gggcactgatgagcgtccag

SEQ ID NO: 413642 - DNA, 20 bp, mouse
gctggggcagcagttagagg

SEQ ID NO: 413643 - DNA, 20 bp, mouse
gttcttggatacttgatgga

SEQ ID NO: 413644 - DNA, 20 bp, mouse
ggcctacctccaatacacac

SEQ ID NO: 413645 - DNA, 20 bp, mouse
gcagagcgcaggtgagcccg

SEQ ID NO: 413646 - DNA, 20 bp, mouse
gtcaaaggcaggcccggatg

SEQ ID NO: 413647 - DNA, 20 bp, mouse
ggcagcagaggttgtctcaa

SEQ ID NO: 413648 - DNA, 20 bp, mouse
gctggagccgcgggagctat

SEQ ID NO: 413649 - DNA, 20 bp, mouse
gcatcgcccgaggtctccac

SEQ ID NO: 413650 - DNA, 20 bp, mouse
ggtgactccgatagctcccg

SEQ ID NO: 413651 - DNA, 20 bp, mouse
gcgggcgcagacagcaccca

SEQ ID NO: 413652 - DNA, 20 bp, mouse
gcgcgcgggtccccagacag

SEQ ID NO: 413653 - DNA, 20 bp, mouse
gagaccaggcgtagatcgag

SEQ ID NO: 413654 - DNA, 20 bp, mouse
gccaggcgtagatcgagggg

SEQ ID NO: 413655 - DNA, 20 bp, mouse
ggcggctccagtggagacct

SEQ ID NO: 413656 - DNA, 20 bp, mouse
gctactgccaagagaccctt

SEQ ID NO: 413657 - DNA, 20 bp, mouse
gattctgtttcaaaggacca

SEQ ID NO: 413658 - DNA, 20 bp, mouse
gttgctggttgcatatgtac

SEQ ID NO: 413659 - DNA, 20 bp, mouse
ggatcttcctaagggtctct

SEQ ID NO: 413660 - DNA, 20 bp, mouse
gtataatgagatcttcctaa

SEQ ID NO: 413661 - DNA, 20 bp, mouse
ggcatagaatgacagcccgg

SEQ ID NO: 413662 - DNA, 20 bp, mouse
gttgtccgtctgctgaaaca

SEQ ID NO: 413663 - DNA, 20 bp, mouse
ggaagcaatcacacttaact

SEQ ID NO: 413664 - DNA, 20 bp, mouse
ggcatttcgaggtatgacct

SEQ ID NO: 413665 - DNA, 20 bp, mouse
gctgctgaaacacggctcca

SEQ ID NO: 413666 - DNA, 20 bp, mouse
gcggccgtaaagcctggagg

SEQ ID NO: 413667 - DNA, 20 bp, mouse
gcgggcagcagaagtccgac

SEQ ID NO: 413668 - DNA, 20 bp, mouse
gggaagcgcccgccatcctg

SEQ ID NO: 413669 - DNA, 20 bp, mouse
ggcgccaggagagcgaggtc

SEQ ID NO: 413670 - DNA, 20 bp, mouse
gccggcgcccgcaggatggc

SEQ ID NO: 413671 - DNA, 20 bp, mouse
gtggcccggcgcccgcagga

SEQ ID NO: 413672 - DNA, 20 bp, mouse
ggagctgcaggtgccatacc

SEQ ID NO: 413673 - DNA, 20 bp, mouse
ggtccagcgagtccaacgac

SEQ ID NO: 413674 - DNA, 20 bp, mouse
gccgccgctcggcctccgag

SEQ ID NO: 413675 - DNA, 20 bp, mouse
ggccgttccgaggtgagccg

SEQ ID NO: 413676 - DNA, 20 bp, mouse
gacaagaaagaggccttata

SEQ ID NO: 413677 - DNA, 20 bp, mouse
gtccttgctgaaggattctg

SEQ ID NO: 413678 - DNA, 20 bp, mouse
gaaaattaacatgaagacaa

SEQ ID NO: 413679 - DNA, 20 bp, mouse
gcgaaaatgaaatctagaca

SEQ ID NO: 413680 - DNA, 20 bp, mouse
gactcagtagttaccttata

SEQ ID NO: 413681 - DNA, 20 bp, mouse
gacaaaggtgagataatgtg

SEQ ID NO: 413682 - DNA, 20 bp, mouse
gactatttagatacaaatta

SEQ ID NO: 413683 - DNA, 20 bp, mouse
gctttgtatcgactttaaca

SEQ ID NO: 413684 - DNA, 20 bp, mouse
gcgtttccgactgatgaaaa

SEQ ID NO: 413685 - DNA, 20 bp, mouse
gagtcgatacaaagggtaac

SEQ ID NO: 413686 - DNA, 20 bp, mouse
gcaattgcggatactgctca

SEQ ID NO: 413687 - DNA, 20 bp, mouse
ggctcctctgggctgttgca

SEQ ID NO: 413688 - DNA, 20 bp, mouse
gaacagcatagcgctcctct

SEQ ID NO: 413689 - DNA, 20 bp, mouse
ggtcggcccatatcacccaa

SEQ ID NO: 413690 - DNA, 20 bp, mouse
gatggctcgggagcaagagt

SEQ ID NO: 413691 - DNA, 20 bp, mouse
gtaccacacttaagcaattg

SEQ ID NO: 413692 - DNA, 20 bp, mouse
gatccgcaattgcttaagtg

SEQ ID NO: 413693 - DNA, 20 bp, mouse
gtggtaccaagcaagatgaa

SEQ ID NO: 413694 - DNA, 20 bp, mouse
ggcatacgcaaacaggtgta

SEQ ID NO: 413695 - DNA, 20 bp, mouse
gaactttggtttgataatat

SEQ ID NO: 413696 - DNA, 20 bp, mouse
gcaccgggcagggcacccac

SEQ ID NO: 413697 - DNA, 20 bp, mouse
gcccactggcaggtatggag

SEQ ID NO: 413698 - DNA, 20 bp, mouse
ggggcacccactggcaggta

SEQ ID NO: 413699 - DNA, 20 bp, mouse
gagggaggcggcaccgggca

SEQ ID NO: 413700 - DNA, 20 bp, mouse
gaggtatggaggggtttgta

SEQ ID NO: 413701 - DNA, 20 bp, mouse
gtgcacaactctgagcaggg

SEQ ID NO: 413702 - DNA, 20 bp, mouse
gttctaggagaagcagtctc

SEQ ID NO: 413703 - DNA, 20 bp, mouse
gacccctccatacctgccag

SEQ ID NO: 413704 - DNA, 20 bp, mouse
gttctgagccatgagaaggg

SEQ ID NO: 413705 - DNA, 20 bp, mouse
gtgggagaagagccaccctc

SEQ ID NO: 413706 - DNA, 20 bp, mouse
gtcgggagtgggaactggag

SEQ ID NO: 413707 - DNA, 20 bp, mouse
ggggcccggcctcaccatag

SEQ ID NO: 413708 - DNA, 20 bp, mouse
gaaggtaacttaacctgcta

SEQ ID NO: 413709 - DNA, 20 bp, mouse
gctccctcgggagtgggaac

SEQ ID NO: 413710 - DNA, 20 bp, mouse
gacacagagcacagccccta

SEQ ID NO: 413711 - DNA, 20 bp, mouse
ggagtggaccgggaagaagg

SEQ ID NO: 413712 - DNA, 20 bp, mouse
gcatggcctccctcgggagt

SEQ ID NO: 413713 - DNA, 20 bp, mouse
gatgggactgtccaagggaa

SEQ ID NO: 413714 - DNA, 20 bp, mouse
gagggagatccctaactaag

SEQ ID NO: 413715 - DNA, 20 bp, mouse
gggagctggggtaaactctg

SEQ ID NO: 413716 - DNA, 20 bp, mouse
ggctggcgagggtatcgctt

SEQ ID NO: 413717 - DNA, 20 bp, mouse
gcagatcccctgggcggcca

SEQ ID NO: 413718 - DNA, 20 bp, mouse
gcggcgccatggccgcccag

SEQ ID NO: 413719 - DNA, 20 bp, mouse
ggccatggcgccggcgcggt

SEQ ID NO: 413720 - DNA, 20 bp, mouse
ggccggcgcggtgggaggcg

SEQ ID NO: 413721 - DNA, 20 bp, mouse
gcctgcccacgccccacctc

SEQ ID NO: 413722 - DNA, 20 bp, mouse
gggcggccatggcgccggcg

SEQ ID NO: 413723 - DNA, 20 bp, mouse
ggccagcgtccagatcccct

SEQ ID NO: 413724 - DNA, 20 bp, mouse
ggggatctggacgctggcga

SEQ ID NO: 413725 - DNA, 20 bp, mouse
ggcccaggggatctggacgc

SEQ ID NO: 413726 - DNA, 20 bp, mouse
gaggttcttggaacgaagat

SEQ ID NO: 413727 - DNA, 20 bp, mouse
gttggaacgaagataggcag

SEQ ID NO: 413728 - DNA, 20 bp, mouse
gcggaagtgccggaacgtag

SEQ ID NO: 413729 - DNA, 20 bp, mouse
gtggcggccgcctaggttct

SEQ ID NO: 413730 - DNA, 20 bp, mouse
gtggagcgcgcgctaactgg

SEQ ID NO: 413731 - DNA, 20 bp, mouse
ggagatcgagccaaactccg

SEQ ID NO: 413732 - DNA, 20 bp, mouse
gacctacaagatgaactcca

SEQ ID NO: 413733 - DNA, 20 bp, mouse
ggaggagggaaagcgagacg

SEQ ID NO: 413734 - DNA, 20 bp, mouse
ggccttggagttcatcttgt

SEQ ID NO: 413735 - DNA, 20 bp, mouse
gagtgctccgaactcttggg

SEQ ID NO: 413736 - DNA, 20 bp, mouse
gcacaaggaaaggtgtctac

SEQ ID NO: 413737 - DNA, 20 bp, mouse
gggagcacttagctacctag

SEQ ID NO: 413738 - DNA, 20 bp, mouse
ggacgctgcaatcccgcaca

SEQ ID NO: 413739 - DNA, 20 bp, mouse
gaaggaaaggtgtctacagg

SEQ ID NO: 413740 - DNA, 20 bp, mouse
gggcagacaagccagaaatt

SEQ ID NO: 413741 - DNA, 20 bp, mouse
ggaggagcagagtaggtcta

SEQ ID NO: 413742 - DNA, 20 bp, mouse
gtttcagagaggagcagagt

SEQ ID NO: 413743 - DNA, 20 bp, mouse
gcggagtaattaagactcca

SEQ ID NO: 413744 - DNA, 20 bp, mouse
gccttgagtaagaatagtcc

SEQ ID NO: 413745 - DNA, 20 bp, mouse
gtaaggaagcaaaaaagcga

SEQ ID NO: 413746 - DNA, 20 bp, mouse
gaggaagggcggccattccc

SEQ ID NO: 413747 - DNA, 20 bp, mouse
gaaacaccatctgctctcca

SEQ ID NO: 413748 - DNA, 20 bp, mouse
gcatggacgaaaagctcact

SEQ ID NO: 413749 - DNA, 20 bp, mouse
ggtagtgttgacacagggag

SEQ ID NO: 413750 - DNA, 20 bp, mouse
gttactgttcaggggtgcaa

SEQ ID NO: 413751 - DNA, 20 bp, mouse
gttcgtccatggagagcaga

SEQ ID NO: 413752 - DNA, 20 bp, mouse
ggcggccattcccaggactt

SEQ ID NO: 413753 - DNA, 20 bp, mouse
ggggtcaagctgcaagccca

SEQ ID NO: 413754 - DNA, 20 bp, mouse
gggagccaagtccaaagtcc

SEQ ID NO: 413755 - DNA, 20 bp, mouse
gaggcagtggaaaccagctt

SEQ ID NO: 413756 - DNA, 20 bp, mouse
gccaggaactgctcaagggt

SEQ ID NO: 413757 - DNA, 20 bp, mouse
gtggctgcagcttacttgag

SEQ ID NO: 413758 - DNA, 20 bp, mouse
gggtgcagagttactatccg

SEQ ID NO: 413759 - DNA, 20 bp, mouse
gcattcaaaatgacaaaagg

SEQ ID NO: 413760 - DNA, 20 bp, mouse
gtccccagctaatctgaaga

SEQ ID NO: 413761 - DNA, 20 bp, mouse
ggaccctaacgaggagactg

SEQ ID NO: 413762 - DNA, 20 bp, mouse
gtatatgcaaggcgtgagat

SEQ ID NO: 413763 - DNA, 20 bp, mouse
gacagaccctgaccctaacg

SEQ ID NO: 413764 - DNA, 20 bp, mouse
ggcagttcctggagctaatg

SEQ ID NO: 413765 - DNA, 20 bp, mouse
gggccttcttcagattagct

SEQ ID NO: 413766 - DNA, 20 bp, mouse
gacagttggcgcgacccgga

SEQ ID NO: 413767 - DNA, 20 bp, mouse
gttggcgcgacccggagggc

SEQ ID NO: 413768 - DNA, 20 bp, mouse
ggcgggcgggcgcctcgtgg

SEQ ID NO: 413769 - DNA, 20 bp, mouse
gggcgggcggcccaggccga

SEQ ID NO: 413770 - DNA, 20 bp, mouse
gtctgacagttggcgcgacc

SEQ ID NO: 413771 - DNA, 20 bp, mouse
ggcacctcacctggcactct

SEQ ID NO: 413772 - DNA, 20 bp, mouse
ggtctggcttccggtatcaa

SEQ ID NO: 413773 - DNA, 20 bp, mouse
gcccagtcccgcacctcacc

SEQ ID NO: 413774 - DNA, 20 bp, mouse
gctgtcagacactcctccct

SEQ ID NO: 413775 - DNA, 20 bp, mouse
gaagggcaggacttccgggg

SEQ ID NO: 413776 - DNA, 20 bp, mouse
ggctctctggggtgactgat

SEQ ID NO: 413777 - DNA, 20 bp, mouse
ggaacagctggactctactg

SEQ ID NO: 413778 - DNA, 20 bp, mouse
gtggccttgaccctgcttcc

SEQ ID NO: 413779 - DNA, 20 bp, mouse
gaagttcgggaggcccatct

SEQ ID NO: 413780 - DNA, 20 bp, mouse
gcgatggtctcagtgactat

SEQ ID NO: 413781 - DNA, 20 bp, mouse
ggggtctagagagatagagg

SEQ ID NO: 413782 - DNA, 20 bp, mouse
gtgagtctggtgtccctaca

SEQ ID NO: 413783 - DNA, 20 bp, mouse
ggcctcccgaacttagagta

SEQ ID NO: 413784 - DNA, 20 bp, mouse
gcggggctggagcctgtgca

SEQ ID NO: 413785 - DNA, 20 bp, mouse
gaccaacccaccagcagaag

SEQ ID NO: 413786 - DNA, 20 bp, mouse
gccgggtatggcgtcgatgg

SEQ ID NO: 413787 - DNA, 20 bp, mouse
ggccgctggacgaccgggag

SEQ ID NO: 413788 - DNA, 20 bp, mouse
gggtatggcgtcgatggcgg

SEQ ID NO: 413789 - DNA, 20 bp, mouse
gggccggttcccgctcatga

SEQ ID NO: 413790 - DNA, 20 bp, mouse
gtccgctcccggtcgtccag

SEQ ID NO: 413791 - DNA, 20 bp, mouse
ggtgtcccgggaaggtctgg

SEQ ID NO: 413792 - DNA, 20 bp, mouse
gaaccggccgctggacgacc

SEQ ID NO: 413793 - DNA, 20 bp, mouse
gctcatgacggccgaacgcg

SEQ ID NO: 413794 - DNA, 20 bp, mouse
ggagaagtacgggcccgagt

SEQ ID NO: 413795 - DNA, 20 bp, mouse
gcggcgggacgggccaccca

SEQ ID NO: 413796 - DNA, 20 bp, mouse
gctctgctccacctaggacg

SEQ ID NO: 413797 - DNA, 20 bp, mouse
gcagcagagccggtttccca

SEQ ID NO: 413798 - DNA, 20 bp, mouse
gatggcggttgtgtctccca

SEQ ID NO: 413799 - DNA, 20 bp, mouse
gctggagagtggccagaggt

SEQ ID NO: 413800 - DNA, 20 bp, mouse
gaaaaccagctgggctccct

SEQ ID NO: 413801 - DNA, 20 bp, mouse
gggctcccaggaagtctgtc

SEQ ID NO: 413802 - DNA, 20 bp, mouse
ggtagggccgaaaggtggag

SEQ ID NO: 413803 - DNA, 20 bp, mouse
gcagagccggtttcccatgg

SEQ ID NO: 413804 - DNA, 20 bp, mouse
gccggccaagatgggaacaa

SEQ ID NO: 413805 - DNA, 20 bp, mouse
gccacctgccacgtcctagg

SEQ ID NO: 413806 - DNA, 20 bp, mouse
gggtactgaaggctgtgcag

SEQ ID NO: 413807 - DNA, 20 bp, mouse
gtagagaccgcgggtactga

SEQ ID NO: 413808 - DNA, 20 bp, mouse
gccgcgattggagccgaaca

SEQ ID NO: 413809 - DNA, 20 bp, mouse
ggaagtccgactagagaccg

SEQ ID NO: 413810 - DNA, 20 bp, mouse
gagtacccgcggtctctagt

SEQ ID NO: 413811 - DNA, 20 bp, mouse
ggtggctccagcgccatgtt

SEQ ID NO: 413812 - DNA, 20 bp, mouse
ggcacagccttcagtacccg

SEQ ID NO: 413813 - DNA, 20 bp, mouse
gggctgccagctcttcctca

SEQ ID NO: 413814 - DNA, 20 bp, mouse
gagcagagggagaactactt

SEQ ID NO: 413815 - DNA, 20 bp, mouse
gccgagccgtgaggaagagc

SEQ ID NO: 413816 - DNA, 20 bp, mouse
ggtgcagcagcggctgagac

SEQ ID NO: 413817 - DNA, 20 bp, mouse
gtcggctactggtgcagcag

SEQ ID NO: 413818 - DNA, 20 bp, mouse
gctagagcctaggccggact

SEQ ID NO: 413819 - DNA, 20 bp, mouse
gggaggtgctgctgcatacc

SEQ ID NO: 413820 - DNA, 20 bp, mouse
ggccagttctcgcgagacta

SEQ ID NO: 413821 - DNA, 20 bp, mouse
gctaggctctaggtgaggag

SEQ ID NO: 413822 - DNA, 20 bp, mouse
gcgcctgcagagtcggctac

SEQ ID NO: 413823 - DNA, 20 bp, mouse
gcgagagccgccgaccacct

SEQ ID NO: 413824 - DNA, 20 bp, mouse
gtcctgacagaataagatgg

SEQ ID NO: 413825 - DNA, 20 bp, mouse
gtctcgcgagactagggacc

SEQ ID NO: 413826 - DNA, 20 bp, mouse
gggctccgcccgtctccctc

SEQ ID NO: 413827 - DNA, 20 bp, mouse
gatggctgcccgagggagac

SEQ ID NO: 413828 - DNA, 20 bp, mouse
ggctgcccgagggagacggg

SEQ ID NO: 413829 - DNA, 20 bp, mouse
gacggcatctggccacaaaa

SEQ ID NO: 413830 - DNA, 20 bp, mouse
gccacaaaatggctgcccga

SEQ ID NO: 413831 - DNA, 20 bp, mouse
gcgggcgcctcccgacccgg

SEQ ID NO: 413832 - DNA, 20 bp, mouse
gacgggcggagcctccgggt

SEQ ID NO: 413833 - DNA, 20 bp, mouse
ggtgcaaaggacgtcgggaa

SEQ ID NO: 413834 - DNA, 20 bp, mouse
gggcagcggcaggagccgat

SEQ ID NO: 413835 - DNA, 20 bp, mouse
ggtggccagatgccgtgcaa

SEQ ID NO: 413836 - DNA, 20 bp, mouse
ggcggtgtctccagtccgag

SEQ ID NO: 413837 - DNA, 20 bp, mouse
ggccagtgcaccgctcggac

SEQ ID NO: 413838 - DNA, 20 bp, mouse
gaggtgcaggagctccgcca

SEQ ID NO: 413839 - DNA, 20 bp, mouse
gtccagtccgagcggtgcac

SEQ ID NO: 413840 - DNA, 20 bp, mouse
gggcaggacatggaccagcg

SEQ ID NO: 413841 - DNA, 20 bp, mouse
gctccgagggagcagagacg

SEQ ID NO: 413842 - DNA, 20 bp, mouse
gcagacgccagtgcaccgct

SEQ ID NO: 413843 - DNA, 20 bp, mouse
ggatccgggggatgagctgg

SEQ ID NO: 413844 - DNA, 20 bp, mouse
gccagggcttgggcctccga

SEQ ID NO: 413845 - DNA, 20 bp, mouse
ggtccagccgcccaactcga

SEQ ID NO: 413846 - DNA, 20 bp, mouse
gtaggacccatagaagaaag

SEQ ID NO: 413847 - DNA, 20 bp, mouse
gcatagaagaaaggggctaa

SEQ ID NO: 413848 - DNA, 20 bp, mouse
ggggctaagggtatcttacc

SEQ ID NO: 413849 - DNA, 20 bp, mouse
gcagcagccagctagggcca

SEQ ID NO: 413850 - DNA, 20 bp, mouse
gccatggagctatcatctag

SEQ ID NO: 413851 - DNA, 20 bp, mouse
gatagctccatggccctagc

SEQ ID NO: 413852 - DNA, 20 bp, mouse
ggccagctatgtctagaata

SEQ ID NO: 413853 - DNA, 20 bp, mouse
gcagagcaggaatagatagg

SEQ ID NO: 413854 - DNA, 20 bp, mouse
gcctctccaggggattagag

SEQ ID NO: 413855 - DNA, 20 bp, mouse
gaccctgaggacagccagaa

SEQ ID NO: 413856 - DNA, 20 bp, mouse
gcgccgggctggtcatggag

SEQ ID NO: 413857 - DNA, 20 bp, mouse
ggtcatggagtcgtggggac

SEQ ID NO: 413858 - DNA, 20 bp, mouse
gaggttgtcatggagtcgtg

SEQ ID NO: 413859 - DNA, 20 bp, mouse
gaccagcccggcgggttagc

SEQ ID NO: 413860 - DNA, 20 bp, mouse
gtaacccgccgggctggtca

SEQ ID NO: 413861 - DNA, 20 bp, mouse
gtcgagacccggcgaatacc

SEQ ID NO: 413862 - DNA, 20 bp, mouse
gggcgaataccaggttgtca

SEQ ID NO: 413863 - DNA, 20 bp, mouse
gagcaggcgcatgcgcgagc

SEQ ID NO: 413864 - DNA, 20 bp, mouse
gtcggggatagctcgagacc

SEQ ID NO: 413865 - DNA, 20 bp, mouse
gcctggcccttaggtgagaa

SEQ ID NO: 413866 - DNA, 20 bp, mouse
gctgctggctgccttcacta

SEQ ID NO: 413867 - DNA, 20 bp, mouse
gggcccctccaacccctcta

SEQ ID NO: 413868 - DNA, 20 bp, mouse
ggccagcagagcccagaaac

SEQ ID NO: 413869 - DNA, 20 bp, mouse
gtcaggttcttccatagtga

SEQ ID NO: 413870 - DNA, 20 bp, mouse
gtagcagggagtccttgacg

SEQ ID NO: 413871 - DNA, 20 bp, mouse
ggaccctagaggggttggag

SEQ ID NO: 413872 - DNA, 20 bp, mouse
gggttggaggggcctagaga

SEQ ID NO: 413873 - DNA, 20 bp, mouse
gtgcgggaccctagaggggt

SEQ ID NO: 413874 - DNA, 20 bp, mouse
gggtgttgcgggaccctaga

SEQ ID NO: 413875 - DNA, 20 bp, mouse
gacctcccggcgggagacac

SEQ ID NO: 413876 - DNA, 20 bp, mouse
gcagtatggaggccgcccag

SEQ ID NO: 413877 - DNA, 20 bp, mouse
gtccggcccgagccgcccct

SEQ ID NO: 413878 - DNA, 20 bp, mouse
gcggcctccatactgagggt

SEQ ID NO: 413879 - DNA, 20 bp, mouse
gggcccgagccgcccctggg

SEQ ID NO: 413880 - DNA, 20 bp, mouse
gccggcccccaccctcagta

SEQ ID NO: 413881 - DNA, 20 bp, mouse
gcagctccgaccgaaagctc

SEQ ID NO: 413882 - DNA, 20 bp, mouse
gaccaggccgcgactttcag

SEQ ID NO: 413883 - DNA, 20 bp, mouse
ggcccccaccctcagtatgg

SEQ ID NO: 413884 - DNA, 20 bp, mouse
gcgacggcagaccctcagag

SEQ ID NO: 413885 - DNA, 20 bp, mouse
gcgctgaccggggagcccgg

SEQ ID NO: 413886 - DNA, 20 bp, mouse
ggaaggtaagtcttgttgtt

SEQ ID NO: 413887 - DNA, 20 bp, mouse
gcaagacttaccttctttcc

SEQ ID NO: 413888 - DNA, 20 bp, mouse
gatagacttgaggtagagtt

SEQ ID NO: 413889 - DNA, 20 bp, mouse
gacttgaggtagagttgggg

SEQ ID NO: 413890 - DNA, 20 bp, mouse
gccaacccaggaagtcctca

SEQ ID NO: 413891 - DNA, 20 bp, mouse
gacccaggaagtcctcaggg

SEQ ID NO: 413892 - DNA, 20 bp, mouse
gcagggacttcaagagaacc

SEQ ID NO: 413893 - DNA, 20 bp, mouse
gccctccctgaggacttcct

SEQ ID NO: 413894 - DNA, 20 bp, mouse
gaagagaaccaggttcctct

SEQ ID NO: 413895 - DNA, 20 bp, mouse
gaactcgtgctggatagggg

SEQ ID NO: 413896 - DNA, 20 bp, mouse
ggcttcctgggtctgggtac

SEQ ID NO: 413897 - DNA, 20 bp, mouse
gcctgggtctgggtactggc

SEQ ID NO: 413898 - DNA, 20 bp, mouse
gttctgtgcagctgtagcag

SEQ ID NO: 413899 - DNA, 20 bp, mouse
ggcacgcttggctcccagtt

SEQ ID NO: 413900 - DNA, 20 bp, mouse
gacagccatggtgccaaact

SEQ ID NO: 413901 - DNA, 20 bp, mouse
gcagggctgtcttcccataa

SEQ ID NO: 413902 - DNA, 20 bp, mouse
gcttcccataaaggaggata

SEQ ID NO: 413903 - DNA, 20 bp, mouse
gggctcccagtttggcacca

SEQ ID NO: 413904 - DNA, 20 bp, mouse
gaaaacaagacagtagtata

SEQ ID NO: 413905 - DNA, 20 bp, mouse
ggggatgtacagaatcttac

SEQ ID NO: 413906 - DNA, 20 bp, mouse
gcccaggacgaggtcagcgt

SEQ ID NO: 413907 - DNA, 20 bp, mouse
ggttccgacgccgcctgggt

SEQ ID NO: 413908 - DNA, 20 bp, mouse
gagaggttccgacgccgcct

SEQ ID NO: 413909 - DNA, 20 bp, mouse
gacgctgctgaggagccggg

SEQ ID NO: 413910 - DNA, 20 bp, mouse
gggaggacgggagccgagac

SEQ ID NO: 413911 - DNA, 20 bp, mouse
ggagaccgcgatcgaagacg

SEQ ID NO: 413912 - DNA, 20 bp, mouse
gagtcccgcgtcttcgatcg

SEQ ID NO: 413913 - DNA, 20 bp, mouse
gccgacgccgcctgggttgg

SEQ ID NO: 413914 - DNA, 20 bp, mouse
gcacgccgcatcccaggacg

SEQ ID NO: 413915 - DNA, 20 bp, mouse
gaagacgcgggactggaccg

SEQ ID NO: 413916 - DNA, 20 bp, mouse
gagctgtaggccatcttgag

SEQ ID NO: 413917 - DNA, 20 bp, mouse
gaactcaactctccagtgga

SEQ ID NO: 413918 - DNA, 20 bp, mouse
ggaggagatgtaacttatgc

SEQ ID NO: 413919 - DNA, 20 bp, mouse
ggaatttgaatgccatccac

SEQ ID NO: 413920 - DNA, 20 bp, mouse
ggttacatctcctctcaaga

SEQ ID NO: 413921 - DNA, 20 bp, mouse
gtgccctggcagggacggca

SEQ ID NO: 413922 - DNA, 20 bp, mouse
gtagcagcttctagaaccat

SEQ ID NO: 413923 - DNA, 20 bp, mouse
gagagccagcatatgtgccc

SEQ ID NO: 413924 - DNA, 20 bp, mouse
gatatgtgccctggcaggga

SEQ ID NO: 413925 - DNA, 20 bp, mouse
gcacacaggacctctggcag

SEQ ID NO: 413926 - DNA, 20 bp, mouse
gcccggcgaggagacggaga

SEQ ID NO: 413927 - DNA, 20 bp, mouse
ggacggagacgggacgcggg

SEQ ID NO: 413928 - DNA, 20 bp, mouse
gctccaggcacaggtaagaa

SEQ ID NO: 413929 - DNA, 20 bp, mouse
ggcagcacacgggtggtcag

SEQ ID NO: 413930 - DNA, 20 bp, mouse
gcccggagccggcttcgtga

SEQ ID NO: 413931 - DNA, 20 bp, mouse
gtggtgttccgggagtgaac

SEQ ID NO: 413932 - DNA, 20 bp, mouse
gaggagacggagacgggacg

SEQ ID NO: 413933 - DNA, 20 bp, mouse
gcacacgtgcagcacacggg

SEQ ID NO: 413934 - DNA, 20 bp, mouse
ggcttcgtgaaggggaaagg

SEQ ID NO: 413935 - DNA, 20 bp, mouse
gctcctcagagccggccgag

SEQ ID NO: 413936 - DNA, 20 bp, mouse
gagctgtaggtcatgttgag

SEQ ID NO: 413937 - DNA, 20 bp, mouse
gtaggtcatgttgagaggag

SEQ ID NO: 413938 - DNA, 20 bp, mouse
gtgacctccataggatctag

SEQ ID NO: 413939 - DNA, 20 bp, mouse
gcgatcagctaggtgtcaat

SEQ ID NO: 413940 - DNA, 20 bp, mouse
gcttccagaacggcagctgt

SEQ ID NO: 413941 - DNA, 20 bp, mouse
gaggagaggtacgatcagct

SEQ ID NO: 413942 - DNA, 20 bp, mouse
ggcttctcctctagatccta

SEQ ID NO: 413943 - DNA, 20 bp, mouse
ggaaagaggaacccagatgg

SEQ ID NO: 413944 - DNA, 20 bp, mouse
gtagcacagttgacctccat

SEQ ID NO: 413945 - DNA, 20 bp, mouse
ggttctgatgatagccgtga

SEQ ID NO: 413946 - DNA, 20 bp, mouse
ggcctcgggtaggaactcag

SEQ ID NO: 413947 - DNA, 20 bp, mouse
ggagttgcccacaacggaca

SEQ ID NO: 413948 - DNA, 20 bp, mouse
gttcacctccccgcctccag

SEQ ID NO: 413949 - DNA, 20 bp, mouse
gtccgttgtgggcaactctg

SEQ ID NO: 413950 - DNA, 20 bp, mouse
ggctgcggcccctggaggcg

SEQ ID NO: 413951 - DNA, 20 bp, mouse
ggttgtgggcaactctgagg

SEQ ID NO: 413952 - DNA, 20 bp, mouse
gggcgctcctcgcctcgggt

SEQ ID NO: 413953 - DNA, 20 bp, mouse
gtagcaagtggcaccaaagg

SEQ ID NO: 413954 - DNA, 20 bp, mouse
gcgaggaagaccgtccgagg

SEQ ID NO: 413955 - DNA, 20 bp, mouse
gcagggaggggtgaggacgc

SEQ ID NO: 413956 - DNA, 20 bp, mouse
ggctctcctactagcagcca

SEQ ID NO: 413957 - DNA, 20 bp, mouse
gaatagagagacagacaacc

SEQ ID NO: 413958 - DNA, 20 bp, mouse
gccagctgcaacaggagcac

SEQ ID NO: 413959 - DNA, 20 bp, mouse
gcctacaagacgaagagctg

SEQ ID NO: 413960 - DNA, 20 bp, mouse
gctgctagtaggagagcaag

SEQ ID NO: 413961 - DNA, 20 bp, mouse
gaatcggagagcagactgaa

SEQ ID NO: 413962 - DNA, 20 bp, mouse
gttggaacgtagcaactcat

SEQ ID NO: 413963 - DNA, 20 bp, mouse
gtggttgattggcaactcct

SEQ ID NO: 413964 - DNA, 20 bp, mouse
gaactcctgggctcaccgca

SEQ ID NO: 413965 - DNA, 20 bp, mouse
gagagccctgcggtgagccc

SEQ ID NO: 413966 - DNA, 20 bp, mouse
gggtaccgaggccaacaccg

SEQ ID NO: 413967 - DNA, 20 bp, mouse
gggcgatcgcgtgtgaggtg

SEQ ID NO: 413968 - DNA, 20 bp, mouse
gacaccgtggaaaaactcac

SEQ ID NO: 413969 - DNA, 20 bp, mouse
gcaccgactggaaggtaccg

SEQ ID NO: 413970 - DNA, 20 bp, mouse
gcccggctaaggcaagacaa

SEQ ID NO: 413971 - DNA, 20 bp, mouse
ggtcccggtgagtttttcca

SEQ ID NO: 413972 - DNA, 20 bp, mouse
gaccaggccacggacacctc

SEQ ID NO: 413973 - DNA, 20 bp, mouse
ggtcgcgcggacgggctcaa

SEQ ID NO: 413974 - DNA, 20 bp, mouse
gggcctcggtaccttccagt

SEQ ID NO: 413975 - DNA, 20 bp, mouse
gaccagggtttctctcgaag

SEQ ID NO: 413976 - DNA, 20 bp, mouse
gcttccggccgagagagggt

SEQ ID NO: 413977 - DNA, 20 bp, mouse
gtgggaacccgcggccgtca

SEQ ID NO: 413978 - DNA, 20 bp, mouse
gaagccgcgaagtagctcaa

SEQ ID NO: 413979 - DNA, 20 bp, mouse
ggtcatggcagccgaagaga

SEQ ID NO: 413980 - DNA, 20 bp, mouse
ggacccgttgagctacttcg

SEQ ID NO: 413981 - DNA, 20 bp, mouse
gccggcttccggccgagaga

SEQ ID NO: 413982 - DNA, 20 bp, mouse
gcgggaagcaggcggagaag

SEQ ID NO: 413983 - DNA, 20 bp, mouse
gcaagcagatcgactgggag

SEQ ID NO: 413984 - DNA, 20 bp, mouse
gagcagcagctccgactcgt

SEQ ID NO: 413985 - DNA, 20 bp, mouse
gccagccgggcgacgactaa

SEQ ID NO: 413986 - DNA, 20 bp, mouse
gacaaaaactctccaggctg

SEQ ID NO: 413987 - DNA, 20 bp, mouse
gctcagagagagtgactgat

SEQ ID NO: 413988 - DNA, 20 bp, mouse
gcatgggcagccaacatcgt

SEQ ID NO: 413989 - DNA, 20 bp, mouse
gaggcaagctgcctggtagg

SEQ ID NO: 413990 - DNA, 20 bp, mouse
ggcagcagggccatccccca

SEQ ID NO: 413991 - DNA, 20 bp, mouse
ggcgacagtcaacacaagca

SEQ ID NO: 413992 - DNA, 20 bp, mouse
gtgggggacaaaaactctcc

SEQ ID NO: 413993 - DNA, 20 bp, mouse
gcccagggccgcagaaattg

SEQ ID NO: 413994 - DNA, 20 bp, mouse
gtgagctcgaaatccggtga

SEQ ID NO: 413995 - DNA, 20 bp, mouse
gaatccggtgagggacgaag

SEQ ID NO: 413996 - DNA, 20 bp, mouse
gagacggaaaaggtcaggtt

SEQ ID NO: 413997 - DNA, 20 bp, mouse
gccaggactcccgcttccag

SEQ ID NO: 413998 - DNA, 20 bp, mouse
ggatattgcgtacgcaaggt

SEQ ID NO: 413999 - DNA, 20 bp, mouse
gaccggaacccaagttcaga

SEQ ID NO: 414000 - DNA, 20 bp, mouse
ggcaggtcgacgccgtccag

SEQ ID NO: 414001 - DNA, 20 bp, mouse
gacccaagttcagacggaaa

SEQ ID NO: 414002 - DNA, 20 bp, mouse
gagttcagacggaaaaggtc

SEQ ID NO: 414003 - DNA, 20 bp, mouse
gtaggctgcacctctggaag

SEQ ID NO: 414004 - DNA, 20 bp, mouse
gtcaggttaggctgcacctc

SEQ ID NO: 414005 - DNA, 20 bp, mouse
gcagcctgacactcctgggg

SEQ ID NO: 414006 - DNA, 20 bp, mouse
gagcgagagactaaccatgg

SEQ ID NO: 414007 - DNA, 20 bp, mouse
ggaccacactcgagccacca

SEQ ID NO: 414008 - DNA, 20 bp, mouse
gaaccatggtggctcgagtg

SEQ ID NO: 414009 - DNA, 20 bp, mouse
gggtgcgtggacaatcgtgg

SEQ ID NO: 414010 - DNA, 20 bp, mouse
gtgaggtgcgtggacaatcg

SEQ ID NO: 414011 - DNA, 20 bp, mouse
ggaggccctgagaaagttcg

SEQ ID NO: 414012 - DNA, 20 bp, mouse
gcagcgacaccaaccggaag

SEQ ID NO: 414013 - DNA, 20 bp, mouse
gtcgagtgtggtcgctaatg

SEQ ID NO: 414014 - DNA, 20 bp, mouse
ggtcagctacggagggagat

SEQ ID NO: 414015 - DNA, 20 bp, mouse
gtgaagcagtagggtgataa

SEQ ID NO: 414016 - DNA, 20 bp, mouse
gctatggacgagctaccgaa

SEQ ID NO: 414017 - DNA, 20 bp, mouse
gacgagctaccgaatggcaa

SEQ ID NO: 414018 - DNA, 20 bp, mouse
gctaccgaatggcaacggtg

SEQ ID NO: 414019 - DNA, 20 bp, mouse
gcggtagctcgtccatagcg

SEQ ID NO: 414020 - DNA, 20 bp, mouse
gaccacggccgcggaagcgt

SEQ ID NO: 414021 - DNA, 20 bp, mouse
ggactcggactcgaaagtgg

SEQ ID NO: 414022 - DNA, 20 bp, mouse
gtaggacccaggaagacggt

SEQ ID NO: 414023 - DNA, 20 bp, mouse
ggcgccgcaccgttgccatt

SEQ ID NO: 414024 - DNA, 20 bp, mouse
ggcgctccggagcgaggact

SEQ ID NO: 414025 - DNA, 20 bp, mouse
ggcggccccggaagatccga

SEQ ID NO: 414026 - DNA, 20 bp, mouse
gacgcactcgccctctaggt

SEQ ID NO: 414027 - DNA, 20 bp, mouse
gctccacgcactcgccctct

SEQ ID NO: 414028 - DNA, 20 bp, mouse
ggaactgtaggtatccgcgg

SEQ ID NO: 414029 - DNA, 20 bp, mouse
gccgctggtggactaggcca

SEQ ID NO: 414030 - DNA, 20 bp, mouse
ggaaggcctgcgggatccca

SEQ ID NO: 414031 - DNA, 20 bp, mouse
gaggagtccgctggtggact

SEQ ID NO: 414032 - DNA, 20 bp, mouse
ggccatcataagcgaactgt

SEQ ID NO: 414033 - DNA, 20 bp, mouse
ggctcgtgacctcccaccca

SEQ ID NO: 414034 - DNA, 20 bp, mouse
gggcggtgagtgaccctggg

SEQ ID NO: 414035 - DNA, 20 bp, mouse
ggtcacagccgaacaacagc

SEQ ID NO: 414036 - DNA, 20 bp, mouse
gaagggtcacgcgggaagtg

SEQ ID NO: 414037 - DNA, 20 bp, mouse
ggcttaaggtgcagacaccg

SEQ ID NO: 414038 - DNA, 20 bp, mouse
gccggccagaagggtcacgc

SEQ ID NO: 414039 - DNA, 20 bp, mouse
gcacgcgggaagtgcggatt

SEQ ID NO: 414040 - DNA, 20 bp, mouse
ggggtctcacccggccagaa

SEQ ID NO: 414041 - DNA, 20 bp, mouse
gaagccgagggtgagatgga

SEQ ID NO: 414042 - DNA, 20 bp, mouse
ggtccagacacaacaaactc

SEQ ID NO: 414043 - DNA, 20 bp, mouse
ggctctgtgcactccgggag

SEQ ID NO: 414044 - DNA, 20 bp, mouse
ggagggcatagtctaagagg

SEQ ID NO: 414045 - DNA, 20 bp, mouse
gagggatccgctaccagggg

SEQ ID NO: 414046 - DNA, 20 bp, mouse
gcagcagctggcagatgtcg

SEQ ID NO: 414047 - DNA, 20 bp, mouse
gtgagccccggaggaggcgc

SEQ ID NO: 414048 - DNA, 20 bp, mouse
gtagaaggagacgcccgggt

SEQ ID NO: 414049 - DNA, 20 bp, mouse
gcggcggcgatgagctcaaa

SEQ ID NO: 414050 - DNA, 20 bp, mouse
gggcagatgtcgcggagaag

SEQ ID NO: 414051 - DNA, 20 bp, mouse
gccagggtgccagggagcgg

SEQ ID NO: 414052 - DNA, 20 bp, mouse
gcgggagccgtgagccccgg

SEQ ID NO: 414053 - DNA, 20 bp, mouse
gctgcgctccgtctcctcgg

SEQ ID NO: 414054 - DNA, 20 bp, mouse
gtcccatgggagcctctatg

SEQ ID NO: 414055 - DNA, 20 bp, mouse
ggccccatagaggctcccat

SEQ ID NO: 414056 - DNA, 20 bp, mouse
gtccaggcgaagtctcccag

SEQ ID NO: 414057 - DNA, 20 bp, mouse
ggcctgagggcaggaaggat

SEQ ID NO: 414058 - DNA, 20 bp, mouse
ggctttccaggacctttgac

SEQ ID NO: 414059 - DNA, 20 bp, mouse
ggtcgtcagctatcacgtgg

SEQ ID NO: 414060 - DNA, 20 bp, mouse
gatgtctgaagcgggaaatg

SEQ ID NO: 414061 - DNA, 20 bp, mouse
gggcagctgccagatcccca

SEQ ID NO: 414062 - DNA, 20 bp, mouse
gaccactgggagacttcgcc

SEQ ID NO: 414063 - DNA, 20 bp, mouse
gtagcgcttcagagaccact

SEQ ID NO: 414064 - DNA, 20 bp, mouse
ggacttcgcctggaagtccg

SEQ ID NO: 414065 - DNA, 20 bp, mouse
gggcctgtgcaaggactgga

SEQ ID NO: 414066 - DNA, 20 bp, mouse
gctcccaccgaggaccgcag

SEQ ID NO: 414067 - DNA, 20 bp, mouse
gtcgcctggacacggctctg

SEQ ID NO: 414068 - DNA, 20 bp, mouse
gcccacgcgtcgcctggaca

SEQ ID NO: 414069 - DNA, 20 bp, mouse
gcctggacacggctctgggg

SEQ ID NO: 414070 - DNA, 20 bp, mouse
gcagcctctgcggtcctcgg

SEQ ID NO: 414071 - DNA, 20 bp, mouse
gaggccgccacctcccaccg

SEQ ID NO: 414072 - DNA, 20 bp, mouse
ggcccctggggaaggtccca

SEQ ID NO: 414073 - DNA, 20 bp, mouse
ggccttgggaccttccccag

SEQ ID NO: 414074 - DNA, 20 bp, mouse
ggcccctcacacctccacag

SEQ ID NO: 414075 - DNA, 20 bp, mouse
gcctgcccggaggtcccctg

SEQ ID NO: 414076 - DNA, 20 bp, mouse
gcgctcatgaggtgagtatc

SEQ ID NO: 414077 - DNA, 20 bp, mouse
gagtggacagaacctcgtgg

SEQ ID NO: 414078 - DNA, 20 bp, mouse
gtgaaaggagaagggaagtt

SEQ ID NO: 414079 - DNA, 20 bp, mouse
gtccccaagaggtgatgcta

SEQ ID NO: 414080 - DNA, 20 bp, mouse
gtaagccagacactcctgtt

SEQ ID NO: 414081 - DNA, 20 bp, mouse
gaacacctaacaggagtgtc

SEQ ID NO: 414082 - DNA, 20 bp, mouse
gccctgctggagtccccaag

SEQ ID NO: 414083 - DNA, 20 bp, mouse
gcatgaggtgagtatctggc

SEQ ID NO: 414084 - DNA, 20 bp, mouse
ggttaaagaaatgaacggga

SEQ ID NO: 414085 - DNA, 20 bp, mouse
gggatgaagaggatgtcgat

SEQ ID NO: 414086 - DNA, 20 bp, mouse
ggcgaatggaggcctgaggg

SEQ ID NO: 414087 - DNA, 20 bp, mouse
gcggagcgcagcgcgaatgg

SEQ ID NO: 414088 - DNA, 20 bp, mouse
ggcgggtcccgaaaccctgg

SEQ ID NO: 414089 - DNA, 20 bp, mouse
gagcgcgaatggaggcctga

SEQ ID NO: 414090 - DNA, 20 bp, mouse
gcggccgaggcccccgctcg

SEQ ID NO: 414091 - DNA, 20 bp, mouse
gtggcggagcgcagcgcgaa

SEQ ID NO: 414092 - DNA, 20 bp, mouse
gtgcgcgggtcccgaaaccc

SEQ ID NO: 414093 - DNA, 20 bp, mouse
gaatggaggcctgagggcgg

SEQ ID NO: 414094 - DNA, 20 bp, mouse
ggaggcgggccccgagactg

SEQ ID NO: 414095 - DNA, 20 bp, mouse
gcgcgccgacgaccaggcta

SEQ ID NO: 414096 - DNA, 20 bp, mouse
gaggcgcagagacgacccca

SEQ ID NO: 414097 - DNA, 20 bp, mouse
gcaggttcagcatcccggta

SEQ ID NO: 414098 - DNA, 20 bp, mouse
gtgctggaagcggattgcag

SEQ ID NO: 414099 - DNA, 20 bp, mouse
gagcgagaggccgaaaacca

SEQ ID NO: 414100 - DNA, 20 bp, mouse
gagggcagaggacaacgcaa

SEQ ID NO: 414101 - DNA, 20 bp, mouse
gtggaggacggagggagcta

SEQ ID NO: 414102 - DNA, 20 bp, mouse
gtcagaggacagaggatcaa

SEQ ID NO: 414103 - DNA, 20 bp, mouse
gcgggaaggtaaagcagtgc

SEQ ID NO: 414104 - DNA, 20 bp, mouse
gttgcaggggtcatgccgtg

SEQ ID NO: 414105 - DNA, 20 bp, mouse
gggaagcaggatcggaagga

SEQ ID NO: 414106 - DNA, 20 bp, mouse
gtggctatgatagccgaaca

SEQ ID NO: 414107 - DNA, 20 bp, mouse
gactcggtcaaatcgaactg

SEQ ID NO: 414108 - DNA, 20 bp, mouse
gccaggaggatcttaatact

SEQ ID NO: 414109 - DNA, 20 bp, mouse
gtcgaactgtggaccctgtt

SEQ ID NO: 414110 - DNA, 20 bp, mouse
gggagctgatgcgcctcgcc

SEQ ID NO: 414111 - DNA, 20 bp, mouse
gaatggtgagtgatcctata

SEQ ID NO: 414112 - DNA, 20 bp, mouse
gtcactcaccattctctctc

SEQ ID NO: 414113 - DNA, 20 bp, mouse
gccaggagcgcaggtcctct

SEQ ID NO: 414114 - DNA, 20 bp, mouse
ggtgagtgatcctatatgga

SEQ ID NO: 414115 - DNA, 20 bp, mouse
ggtggtcagcaccatgtccc

SEQ ID NO: 414116 - DNA, 20 bp, mouse
gacttctgtgtcaggtaata

SEQ ID NO: 414117 - DNA, 20 bp, mouse
gatcaccatgtatttttaca

SEQ ID NO: 414118 - DNA, 20 bp, mouse
gagtcttacctatagaagta

SEQ ID NO: 414119 - DNA, 20 bp, mouse
gatttccttgtaaaaataca

SEQ ID NO: 414120 - DNA, 20 bp, mouse
gttgtatcatacacatttct

SEQ ID NO: 414121 - DNA, 20 bp, mouse
gagaatacaacttctgtgtc

SEQ ID NO: 414122 - DNA, 20 bp, mouse
gaaagaagagtggaatttgc

SEQ ID NO: 414123 - DNA, 20 bp, mouse
gctgtattttaggctacaaa

SEQ ID NO: 414124 - DNA, 20 bp, mouse
gttttcttttgctgtatttt

SEQ ID NO: 414125 - DNA, 20 bp, mouse
gtaagcgaacaaatgttttt

SEQ ID NO: 414126 - DNA, 20 bp, mouse
gacacggggcctggacatgg

SEQ ID NO: 414127 - DNA, 20 bp, mouse
ggcggtcgcagggagctggc

SEQ ID NO: 414128 - DNA, 20 bp, mouse
ggagagacagcggagagcgc

SEQ ID NO: 414129 - DNA, 20 bp, mouse
gcatggcggtcgcagggagc

SEQ ID NO: 414130 - DNA, 20 bp, mouse
gagagcgcgggcagccccca

SEQ ID NO: 414131 - DNA, 20 bp, mouse
gaggccccgtgtgactgaca

SEQ ID NO: 414132 - DNA, 20 bp, mouse
gcctggacatggcggtcgca

SEQ ID NO: 414133 - DNA, 20 bp, mouse
gactaactgccgcgagtggg

SEQ ID NO: 414134 - DNA, 20 bp, mouse
ggctggcaggtgagtgtgct

SEQ ID NO: 414135 - DNA, 20 bp, mouse
gtaggacgtgcccgacgctg

SEQ ID NO: 414136 - DNA, 20 bp, mouse
ggcaacgcggaggcctccag

SEQ ID NO: 414137 - DNA, 20 bp, mouse
gtggctgctggtccacggac

SEQ ID NO: 414138 - DNA, 20 bp, mouse
gtgctggtccacggacgggg

SEQ ID NO: 414139 - DNA, 20 bp, mouse
gccgtcagctcaggccgcga

SEQ ID NO: 414140 - DNA, 20 bp, mouse
ggccgagcgacaggcggtag

SEQ ID NO: 414141 - DNA, 20 bp, mouse
ggggaggcggccgtcagctc

SEQ ID NO: 414142 - DNA, 20 bp, mouse
gggcccggcgcccgaggacg

SEQ ID NO: 414143 - DNA, 20 bp, mouse
ggagatccgcgagaagttcc

SEQ ID NO: 414144 - DNA, 20 bp, mouse
ggaactcagagggagttggt

SEQ ID NO: 414145 - DNA, 20 bp, mouse
gcgagccggctgctgacgat

SEQ ID NO: 414146 - DNA, 20 bp, mouse
ggggccgggagcctaggaca

SEQ ID NO: 414147 - DNA, 20 bp, mouse
ggctgccgaggagccgcccg

SEQ ID NO: 414148 - DNA, 20 bp, mouse
gggaggcagcaggcctggcc

SEQ ID NO: 414149 - DNA, 20 bp, mouse
gtcgctgctccctccccggg

SEQ ID NO: 414150 - DNA, 20 bp, mouse
gagggagcagcgacccggcc

SEQ ID NO: 414151 - DNA, 20 bp, mouse
gccctccccgggcggctcct

SEQ ID NO: 414152 - DNA, 20 bp, mouse
gggctggaagagcgagaaag

SEQ ID NO: 414153 - DNA, 20 bp, mouse
ggtggccgcactcatctctc

SEQ ID NO: 414154 - DNA, 20 bp, mouse
ggccagccccaggctcctgt

SEQ ID NO: 414155 - DNA, 20 bp, mouse
ggggcgacagcaggccgacg

SEQ ID NO: 414156 - DNA, 20 bp, mouse
gctgcggcgggcgttgagga

SEQ ID NO: 414157 - DNA, 20 bp, mouse
gtaggaggcaaccaagaaga

SEQ ID NO: 414158 - DNA, 20 bp, mouse
gacgcggcccggggagtgag

SEQ ID NO: 414159 - DNA, 20 bp, mouse
gcaagaggccgagcaggcag

SEQ ID NO: 414160 - DNA, 20 bp, mouse
gcagcaccaagaggccgagc

SEQ ID NO: 414161 - DNA, 20 bp, mouse
gccacaggagcagcaccaag

SEQ ID NO: 414162 - DNA, 20 bp, mouse
gcgggtggccgcctccagac

SEQ ID NO: 414163 - DNA, 20 bp, mouse
gagcggtgaaggtgtctgct

SEQ ID NO: 414164 - DNA, 20 bp, mouse
gcccggagctcgcgaaccac

SEQ ID NO: 414165 - DNA, 20 bp, mouse
gcggcccggggagtgagcgg

SEQ ID NO: 414166 - DNA, 20 bp, mouse
gcaagcagcgcgggaacgaa

SEQ ID NO: 414167 - DNA, 20 bp, mouse
gaggtacctccaagcagcgc

SEQ ID NO: 414168 - DNA, 20 bp, mouse
ggtctcctcagacgccgcct

SEQ ID NO: 414169 - DNA, 20 bp, mouse
gaaaggccagcgttcctgcc

SEQ ID NO: 414170 - DNA, 20 bp, mouse
gcacgtcacagagaagtacc

SEQ ID NO: 414171 - DNA, 20 bp, mouse
gctgtgctcggtaggtggga

SEQ ID NO: 414172 - DNA, 20 bp, mouse
gacgcgcacgcgccctggac

SEQ ID NO: 414173 - DNA, 20 bp, mouse
gcgcgccctggacgggaagg

SEQ ID NO: 414174 - DNA, 20 bp, mouse
gcttcctgtgctcggtaggt

SEQ ID NO: 414175 - DNA, 20 bp, mouse
gaagtacccggcatgcgcag

SEQ ID NO: 414176 - DNA, 20 bp, mouse
gcagctgtataatgaggaaa

SEQ ID NO: 414177 - DNA, 20 bp, mouse
ggtgggctccaccaggatag

SEQ ID NO: 414178 - DNA, 20 bp, mouse
gcacgtccccctggcagaga

SEQ ID NO: 414179 - DNA, 20 bp, mouse
gcattcgggatgcacttcga

SEQ ID NO: 414180 - DNA, 20 bp, mouse
gactgtagattaggttactc

SEQ ID NO: 414181 - DNA, 20 bp, mouse
gagtctcctgaaacctgtct

SEQ ID NO: 414182 - DNA, 20 bp, mouse
gattgccaagccaccaagac

SEQ ID NO: 414183 - DNA, 20 bp, mouse
ggtagattaggttactcagg

SEQ ID NO: 414184 - DNA, 20 bp, mouse
gggtgcgtcctctatcctgg

SEQ ID NO: 414185 - DNA, 20 bp, mouse
gatggatctgagatgctgat

SEQ ID NO: 414186 - DNA, 20 bp, mouse
gttagcagtaccactcagaa

SEQ ID NO: 414187 - DNA, 20 bp, mouse
gagctccaggcggcatgctc

SEQ ID NO: 414188 - DNA, 20 bp, mouse
ggctcgggtgcccttctgag

SEQ ID NO: 414189 - DNA, 20 bp, mouse
gaaaggatcagtcagactgg

SEQ ID NO: 414190 - DNA, 20 bp, mouse
ggggacgcccgagacatgta

SEQ ID NO: 414191 - DNA, 20 bp, mouse
gcctggggcccagcatagaa

SEQ ID NO: 414192 - DNA, 20 bp, mouse
gcctctggtgagagatccag

SEQ ID NO: 414193 - DNA, 20 bp, mouse
gcccaagggctaggtcagaa

SEQ ID NO: 414194 - DNA, 20 bp, mouse
gatgtactgccgagccccaa

SEQ ID NO: 414195 - DNA, 20 bp, mouse
gcttctctgggtagagagag

SEQ ID NO: 414196 - DNA, 20 bp, mouse
gacactaggagaatcaatcc

SEQ ID NO: 414197 - DNA, 20 bp, mouse
gggctgctttcggtccggta

SEQ ID NO: 414198 - DNA, 20 bp, mouse
ggaatcaatcctggaatccc

SEQ ID NO: 414199 - DNA, 20 bp, mouse
gctgctctccattcctgtaa

SEQ ID NO: 414200 - DNA, 20 bp, mouse
gtgggttgtgcaagtacact

SEQ ID NO: 414201 - DNA, 20 bp, mouse
gagcggagtttgtaccttac

SEQ ID NO: 414202 - DNA, 20 bp, mouse
gaaagcagccattacaggaa

SEQ ID NO: 414203 - DNA, 20 bp, mouse
ggtaatggctgctttcggtc

SEQ ID NO: 414204 - DNA, 20 bp, mouse
gctccgctcccggggattcc

SEQ ID NO: 414205 - DNA, 20 bp, mouse
gggtacaaactccgctcccg

SEQ ID NO: 414206 - DNA, 20 bp, mouse
gggaggagcggagactgcgg

SEQ ID NO: 414207 - DNA, 20 bp, mouse
ggaccgcgccccgagagagg

SEQ ID NO: 414208 - DNA, 20 bp, mouse
gcagctaggcgggaacatcg

SEQ ID NO: 414209 - DNA, 20 bp, mouse
ggaggcgggacagagcggaa

SEQ ID NO: 414210 - DNA, 20 bp, mouse
gagcgaccgcgccccgagag

SEQ ID NO: 414211 - DNA, 20 bp, mouse
ggacgctgtttggagaagga

SEQ ID NO: 414212 - DNA, 20 bp, mouse
ggtcggaggccgcccgcggg

SEQ ID NO: 414213 - DNA, 20 bp, mouse
gagacaccgggaaggcgatg

SEQ ID NO: 414214 - DNA, 20 bp, mouse
gtccctccgagagaaaccaa

SEQ ID NO: 414215 - DNA, 20 bp, mouse
ggagtcagccggggcatcca

SEQ ID NO: 414216 - DNA, 20 bp, mouse
gcaggtaacacgcgggacag

SEQ ID NO: 414217 - DNA, 20 bp, mouse
gctaaaccgaaacaggaagt

SEQ ID NO: 414218 - DNA, 20 bp, mouse
gcggttgtagcgggtttcga

SEQ ID NO: 414219 - DNA, 20 bp, mouse
gggctggacccgcgagttgt

SEQ ID NO: 414220 - DNA, 20 bp, mouse
gggagtcccacgagctagag

SEQ ID NO: 414221 - DNA, 20 bp, mouse
gcggagggtggcggttgtag

SEQ ID NO: 414222 - DNA, 20 bp, mouse
gcgcgagttgtgggtcgctt

SEQ ID NO: 414223 - DNA, 20 bp, mouse
gggtcgcttgggcgcgcgga

SEQ ID NO: 414224 - DNA, 20 bp, mouse
gttgggcgcgcggagggtgg

SEQ ID NO: 414225 - DNA, 20 bp, mouse
gtggtgccaggacctagggg

SEQ ID NO: 414226 - DNA, 20 bp, mouse
ggccttgaaggacctgacaa

SEQ ID NO: 414227 - DNA, 20 bp, mouse
ggaaggatcggaaatcactg

SEQ ID NO: 414228 - DNA, 20 bp, mouse
ggatccttcggaactggatg

SEQ ID NO: 414229 - DNA, 20 bp, mouse
gtagcctcatccagttccga

SEQ ID NO: 414230 - DNA, 20 bp, mouse
gtccccaccgcgactgtcac

SEQ ID NO: 414231 - DNA, 20 bp, mouse
gtacagatctaagatggccg

SEQ ID NO: 414232 - DNA, 20 bp, mouse
ggatggccggggacagacaa

SEQ ID NO: 414233 - DNA, 20 bp, mouse
gcgcgcaggacgcaggatgt

SEQ ID NO: 414234 - DNA, 20 bp, mouse
gctcggaggccagtaagcaa

SEQ ID NO: 414235 - DNA, 20 bp, mouse
gcgcgactgtcacaggagac

SEQ ID NO: 414236 - DNA, 20 bp, mouse
gtgctgctggcgccccaggg

SEQ ID NO: 414237 - DNA, 20 bp, mouse
gcaggtaaggatgcccccgg

SEQ ID NO: 414238 - DNA, 20 bp, mouse
gttgaggcggaccctccctg

SEQ ID NO: 414239 - DNA, 20 bp, mouse
gcactctcgggcctagactt

SEQ ID NO: 414240 - DNA, 20 bp, mouse
gacgtgctgctggcgcccca

SEQ ID NO: 414241 - DNA, 20 bp, mouse
gtagggctgtgcaggctcta

SEQ ID NO: 414242 - DNA, 20 bp, mouse
gggaagagtgaggaagcgca

SEQ ID NO: 414243 - DNA, 20 bp, mouse
ggggtagccaaggccaggta

SEQ ID NO: 414244 - DNA, 20 bp, mouse
gtgcccccgggggaagagtg

SEQ ID NO: 414245 - DNA, 20 bp, mouse
gggcgcagttgtctctgttg

SEQ ID NO: 414246 - DNA, 20 bp, mouse
ggcggcgaggcgcagcaaag

SEQ ID NO: 414247 - DNA, 20 bp, mouse
ggaatgcagggcttgacctg

SEQ ID NO: 414248 - DNA, 20 bp, mouse
gcgcagcaaagcggcatcac

SEQ ID NO: 414249 - DNA, 20 bp, mouse
gtgcagggcttgacctgtgg

SEQ ID NO: 414250 - DNA, 20 bp, mouse
gaggtcccaggcaccgccac

SEQ ID NO: 414251 - DNA, 20 bp, mouse
gaggcaggcgagcggcagag

SEQ ID NO: 414252 - DNA, 20 bp, mouse
ggcctcgccgctttaggaag

SEQ ID NO: 414253 - DNA, 20 bp, mouse
gcaccaggcaccagggacca

SEQ ID NO: 414254 - DNA, 20 bp, mouse
ggctgcagagatacctccgt

SEQ ID NO: 414255 - DNA, 20 bp, mouse
gagcggcatcactggagccc

SEQ ID NO: 414256 - DNA, 20 bp, mouse
ggcgtcgtgcgcagagcgag

SEQ ID NO: 414257 - DNA, 20 bp, mouse
gctgcgcacgacgcgcctca

SEQ ID NO: 414258 - DNA, 20 bp, mouse
gaagtttaaagcgctccctg

SEQ ID NO: 414259 - DNA, 20 bp, mouse
ggacccgggggcgtggacag

SEQ ID NO: 414260 - DNA, 20 bp, mouse
gagcctgatggagcaagaga

SEQ ID NO: 414261 - DNA, 20 bp, mouse
gctggagagaggccgcgaca

SEQ ID NO: 414262 - DNA, 20 bp, mouse
ggacggcttaaattgaggaa

SEQ ID NO: 414263 - DNA, 20 bp, mouse
ggacgaggtggtacaaccaa

SEQ ID NO: 414264 - DNA, 20 bp, mouse
ggaccgcgagccacaagcca

SEQ ID NO: 414265 - DNA, 20 bp, mouse
gagcgctttaaacttcgcga

SEQ ID NO: 414266 - DNA, 20 bp, mouse
gcttggaggctggaccgttg

SEQ ID NO: 414267 - DNA, 20 bp, mouse
gtaggaccgcttgtgcttgg

SEQ ID NO: 414268 - DNA, 20 bp, mouse
gctggtaagtggtctgtgag

SEQ ID NO: 414269 - DNA, 20 bp, mouse
gagcacagcacattgatctt

SEQ ID NO: 414270 - DNA, 20 bp, mouse
gcgtcaggctggcaggacac

SEQ ID NO: 414271 - DNA, 20 bp, mouse
gaccagctactcaaacacta

SEQ ID NO: 414272 - DNA, 20 bp, mouse
gagggcgacataaatacgtt

SEQ ID NO: 414273 - DNA, 20 bp, mouse
gacaccgggctgtcgcgccg

SEQ ID NO: 414274 - DNA, 20 bp, mouse
gaaaccgcggcgcgacagcc

SEQ ID NO: 414275 - DNA, 20 bp, mouse
gatacgtttggtcccagttt

SEQ ID NO: 414276 - DNA, 20 bp, mouse
gggcaccatgatccctgagg

SEQ ID NO: 414277 - DNA, 20 bp, mouse
gagagccccctcagggatca

SEQ ID NO: 414278 - DNA, 20 bp, mouse
ggaagggccaaggcagagtg

SEQ ID NO: 414279 - DNA, 20 bp, mouse
gggcactgtggtccagggaa

SEQ ID NO: 414280 - DNA, 20 bp, mouse
gtgcctcaagacaggtaaat

SEQ ID NO: 414281 - DNA, 20 bp, mouse
gtatacataacgaagggcca

SEQ ID NO: 414282 - DNA, 20 bp, mouse
ggatcatggtgcctcaagac

SEQ ID NO: 414283 - DNA, 20 bp, mouse
gataacaaagagccccctca

SEQ ID NO: 414284 - DNA, 20 bp, mouse
gaagggattaacaacagtag

SEQ ID NO: 414285 - DNA, 20 bp, mouse
gctcccatttacctgtcttg

SEQ ID NO: 414286 - DNA, 20 bp, mouse
gtccccacgccgaggccctg

SEQ ID NO: 414287 - DNA, 20 bp, mouse
gcgtagggcggggcacctcg

SEQ ID NO: 414288 - DNA, 20 bp, mouse
gtccgcggctgaccaggggt

SEQ ID NO: 414289 - DNA, 20 bp, mouse
gtccgctactggccagaggt

SEQ ID NO: 414290 - DNA, 20 bp, mouse
gggatgctcccaggccacta

SEQ ID NO: 414291 - DNA, 20 bp, mouse
gggcgctatcctggtagatg

SEQ ID NO: 414292 - DNA, 20 bp, mouse
gctcggggacaggagcttgg

SEQ ID NO: 414293 - DNA, 20 bp, mouse
gttcttccgcggctgaccag

SEQ ID NO: 414294 - DNA, 20 bp, mouse
gccggttgctggccagagat

SEQ ID NO: 414295 - DNA, 20 bp, mouse
gagccacagggcctcggcgt

SEQ ID NO: 414296 - DNA, 20 bp, mouse
gattcgcgaaggctttaccc

SEQ ID NO: 414297 - DNA, 20 bp, mouse
gacatataatcagcttacct

SEQ ID NO: 414298 - DNA, 20 bp, mouse
gcagcttaaatacattgtat

SEQ ID NO: 414299 - DNA, 20 bp, mouse
gtgcaaatgcgtagtttgaa

SEQ ID NO: 414300 - DNA, 20 bp, mouse
gatagccaagaaaaatggct

SEQ ID NO: 414301 - DNA, 20 bp, mouse
gattcactctgaatgtagga

SEQ ID NO: 414302 - DNA, 20 bp, mouse
gacatattcttcgtttgaag

SEQ ID NO: 414303 - DNA, 20 bp, mouse
gcattatccatatcctaatt

SEQ ID NO: 414304 - DNA, 20 bp, mouse
gaaaatgcagttgacaagcc

SEQ ID NO: 414305 - DNA, 20 bp, mouse
gtccaaatgcacattttgtt

SEQ ID NO: 414306 - DNA, 20 bp, mouse
gcctaggccacccgagtcgg

SEQ ID NO: 414307 - DNA, 20 bp, mouse
gcagcctaggccacccgagt

SEQ ID NO: 414308 - DNA, 20 bp, mouse
ggccacgcctccgactcggg

SEQ ID NO: 414309 - DNA, 20 bp, mouse
gggcggggagcaaagacaag

SEQ ID NO: 414310 - DNA, 20 bp, mouse
gtcccggaccgcttctggaa

SEQ ID NO: 414311 - DNA, 20 bp, mouse
gagccgcgggccttctcagg

SEQ ID NO: 414312 - DNA, 20 bp, mouse
gcaaggaggagccagggcgg

SEQ ID NO: 414313 - DNA, 20 bp, mouse
gggcagccgcgggccttctc

SEQ ID NO: 414314 - DNA, 20 bp, mouse
gagacaaaggcgcttctggc

SEQ ID NO: 414315 - DNA, 20 bp, mouse
gtcacctcttgaccactcgc

SEQ ID NO: 414316 - DNA, 20 bp, mouse
gatatcagtgagattctggt

SEQ ID NO: 414317 - DNA, 20 bp, mouse
gttgcgttttaggctataat

SEQ ID NO: 414318 - DNA, 20 bp, mouse
ggttatttcagttgaaaatg

SEQ ID NO: 414319 - DNA, 20 bp, mouse
gacctatatcagtgagattc

SEQ ID NO: 414320 - DNA, 20 bp, mouse
gtgatacaaatacaactctg

SEQ ID NO: 414321 - DNA, 20 bp, mouse
gttttctggtattgcgtttt

SEQ ID NO: 414322 - DNA, 20 bp, mouse
gagaatgagctgagtaaatc

SEQ ID NO: 414323 - DNA, 20 bp, mouse
ggctgagtaaatcaggttca

SEQ ID NO: 414324 - DNA, 20 bp, mouse
gctctatgaagaggtgatgt

SEQ ID NO: 414325 - DNA, 20 bp, mouse
gtcttcatagagtcttttct

SEQ ID NO: 414326 - DNA, 20 bp, mouse
gcaggccctagagaacgaag

SEQ ID NO: 414327 - DNA, 20 bp, mouse
gtatgtctacaaagtgacaa

SEQ ID NO: 414328 - DNA, 20 bp, mouse
gactttgtagacataccaga

SEQ ID NO: 414329 - DNA, 20 bp, mouse
gcaggtccacctgtgtgtgt

SEQ ID NO: 414330 - DNA, 20 bp, mouse
gtgctggcaagagcctggac

SEQ ID NO: 414331 - DNA, 20 bp, mouse
gtcgtcctcttcgttctcta

SEQ ID NO: 414332 - DNA, 20 bp, mouse
gtgcttggtaaggtataacc

SEQ ID NO: 414333 - DNA, 20 bp, mouse
gcgttctctagggcctgtcc

SEQ ID NO: 414334 - DNA, 20 bp, mouse
gctgaggagtcaggtctgat

SEQ ID NO: 414335 - DNA, 20 bp, mouse
gtacaaagtgacaagggtac

SEQ ID NO: 414336 - DNA, 20 bp, mouse
ggggtcgagtctgcagaact

SEQ ID NO: 414337 - DNA, 20 bp, mouse
gcgctggccggtggtttcca

SEQ ID NO: 414338 - DNA, 20 bp, mouse
gcgcacagcggcgaccggaa

SEQ ID NO: 414339 - DNA, 20 bp, mouse
gagcggcccaaaggcgacgg

SEQ ID NO: 414340 - DNA, 20 bp, mouse
gaggttagggctgtcaggta

SEQ ID NO: 414341 - DNA, 20 bp, mouse
ggcggcggcggctcgcacag

SEQ ID NO: 414342 - DNA, 20 bp, mouse
ggtgacccgagggccgtcga

SEQ ID NO: 414343 - DNA, 20 bp, mouse
gggcttaggcgccccgagca

SEQ ID NO: 414344 - DNA, 20 bp, mouse
ggttaacgcaggcgggtgga

SEQ ID NO: 414345 - DNA, 20 bp, mouse
ggcaggcgcggaaggttgtg

SEQ ID NO: 414346 - DNA, 20 bp, mouse
gtgccaaggccaggtgtctc

SEQ ID NO: 414347 - DNA, 20 bp, mouse
gatggctgctgagacgtgtg

SEQ ID NO: 414348 - DNA, 20 bp, mouse
gagtatgtggcaccgcagag

SEQ ID NO: 414349 - DNA, 20 bp, mouse
gagagactacctttccacgg

SEQ ID NO: 414350 - DNA, 20 bp, mouse
ggcatagctacaggtatcat

SEQ ID NO: 414351 - DNA, 20 bp, mouse
gggagcaaagcagcttgcca

SEQ ID NO: 414352 - DNA, 20 bp, mouse
gggaggcagagcatagctac

SEQ ID NO: 414353 - DNA, 20 bp, mouse
gtatcatcggctccgctctg

SEQ ID NO: 414354 - DNA, 20 bp, mouse
gcaaagtcactcccagtatg

SEQ ID NO: 414355 - DNA, 20 bp, mouse
gcagagagactacctttcca

SEQ ID NO: 414356 - DNA, 20 bp, mouse
gcttagtggaagatccaggt

SEQ ID NO: 414357 - DNA, 20 bp, mouse
ggggttgtccagatatgacg

SEQ ID NO: 414358 - DNA, 20 bp, mouse
gggaagatccaggtaggcgg

SEQ ID NO: 414359 - DNA, 20 bp, mouse
gagggagagagggcgccacg

SEQ ID NO: 414360 - DNA, 20 bp, mouse
gagggcgccacgaggtgctg

SEQ ID NO: 414361 - DNA, 20 bp, mouse
ggaagggcgagcacccgagg

SEQ ID NO: 414362 - DNA, 20 bp, mouse
ggccctagttctgctcttct

SEQ ID NO: 414363 - DNA, 20 bp, mouse
ggcggcggccccgtcatatc

SEQ ID NO: 414364 - DNA, 20 bp, mouse
gcacgaggtgctgaggtgcg

SEQ ID NO: 414365 - DNA, 20 bp, mouse
gggccctcgggactgtcaga

SEQ ID NO: 414366 - DNA, 20 bp, mouse
gacagcgcggagagaaatag

SEQ ID NO: 414367 - DNA, 20 bp, mouse
gtctagccacagggtcgggg

SEQ ID NO: 414368 - DNA, 20 bp, mouse
gtcagggcccggcatggcgg

SEQ ID NO: 414369 - DNA, 20 bp, mouse
gccggaaccgcacagcgccg

SEQ ID NO: 414370 - DNA, 20 bp, mouse
gccatgccgggccctgacgc

SEQ ID NO: 414371 - DNA, 20 bp, mouse
gagcccgccgcggcgctgtg

SEQ ID NO: 414372 - DNA, 20 bp, mouse
ggaggacacggaggcgaacg

SEQ ID NO: 414373 - DNA, 20 bp, mouse
gcggttccggcgtcagggcc

SEQ ID NO: 414374 - DNA, 20 bp, mouse
gaggaaagggagaccaccga

SEQ ID NO: 414375 - DNA, 20 bp, mouse
gaggcgaacggggcaggaaa

SEQ ID NO: 414376 - DNA, 20 bp, mouse
gccgcgctgcaaggagcgag

SEQ ID NO: 414377 - DNA, 20 bp, mouse
gggcgtggggagcttgtaca

SEQ ID NO: 414378 - DNA, 20 bp, mouse
ggtcctacgaggtgctgcgg

SEQ ID NO: 414379 - DNA, 20 bp, mouse
gctgctccggcggcaacccg

SEQ ID NO: 414380 - DNA, 20 bp, mouse
ggagcagagccggtcctacg

SEQ ID NO: 414381 - DNA, 20 bp, mouse
gggcggggcttacggcggaa

SEQ ID NO: 414382 - DNA, 20 bp, mouse
ggggagcttgtacagggcgg

SEQ ID NO: 414383 - DNA, 20 bp, mouse
gggcccgggcctctggttgt

SEQ ID NO: 414384 - DNA, 20 bp, mouse
gtgcctccgcagcacctcgt

SEQ ID NO: 414385 - DNA, 20 bp, mouse
ggtggggagcttgtacaggg

SEQ ID NO: 414386 - DNA, 20 bp, mouse
gctccctaggcgtgagactc

SEQ ID NO: 414387 - DNA, 20 bp, mouse
gagccggagtctcacgccta

SEQ ID NO: 414388 - DNA, 20 bp, mouse
ggctagaagtctcatagtga

SEQ ID NO: 414389 - DNA, 20 bp, mouse
ggccaaagggaggtctttcg

SEQ ID NO: 414390 - DNA, 20 bp, mouse
gccacggagtcaatgcccag

SEQ ID NO: 414391 - DNA, 20 bp, mouse
gacaaggtaagtacagccag

SEQ ID NO: 414392 - DNA, 20 bp, mouse
ggccacgaaagacctccctt

SEQ ID NO: 414393 - DNA, 20 bp, mouse
gcagaaggtaacctgcccct

SEQ ID NO: 414394 - DNA, 20 bp, mouse
gagttcccaagctattcgtt

SEQ ID NO: 414395 - DNA, 20 bp, mouse
gggaagacgttgcagttcca

SEQ ID NO: 414396 - DNA, 20 bp, mouse
gcactttgcacagtccgtgg

SEQ ID NO: 414397 - DNA, 20 bp, mouse
gctgctgaacctggacaggt

SEQ ID NO: 414398 - DNA, 20 bp, mouse
gctggccctcccacctgtcc

SEQ ID NO: 414399 - DNA, 20 bp, mouse
gagacactttgcacagtccg

SEQ ID NO: 414400 - DNA, 20 bp, mouse
gtgaaggtgggagcggaaag

SEQ ID NO: 414401 - DNA, 20 bp, mouse
gcggctgagactgctgaacc

SEQ ID NO: 414402 - DNA, 20 bp, mouse
gtgtgcaaagtgtctgaagg

SEQ ID NO: 414403 - DNA, 20 bp, mouse
ggagcggaaaggggacgttg

SEQ ID NO: 414404 - DNA, 20 bp, mouse
gtgaacctggacaggtggga

SEQ ID NO: 414405 - DNA, 20 bp, mouse
ggagactgctgaacctggac

SEQ ID NO: 414406 - DNA, 20 bp, mouse
gactagcgggcgctcggaag

SEQ ID NO: 414407 - DNA, 20 bp, mouse
ggctgcggctgcgggatggt

SEQ ID NO: 414408 - DNA, 20 bp, mouse
gccggggcgggaccgcaggt

SEQ ID NO: 414409 - DNA, 20 bp, mouse
ggcggctgcgggatggttgg

SEQ ID NO: 414410 - DNA, 20 bp, mouse
gagccgcagcgagcgagcca

SEQ ID NO: 414411 - DNA, 20 bp, mouse
gtcggaagcggcaggagcgc

SEQ ID NO: 414412 - DNA, 20 bp, mouse
ggctgcgggatggttggcgg

SEQ ID NO: 414413 - DNA, 20 bp, mouse
gtgaacccggaagcactagc

SEQ ID NO: 414414 - DNA, 20 bp, mouse
ggctggctgcagagcttcgt

SEQ ID NO: 414415 - DNA, 20 bp, mouse
ggctccgccccctgagacgg

SEQ ID NO: 414416 - DNA, 20 bp, mouse
ggcaggcagaaactctgcaa

SEQ ID NO: 414417 - DNA, 20 bp, mouse
ggtgtatcaccgctcactgc

SEQ ID NO: 414418 - DNA, 20 bp, mouse
gaacaccgtttatcagtcat

SEQ ID NO: 414419 - DNA, 20 bp, mouse
gccttcctatgactgataaa

SEQ ID NO: 414420 - DNA, 20 bp, mouse
gggaacaatgagggcagccc

SEQ ID NO: 414421 - DNA, 20 bp, mouse
gacggtgtttggtttggatc

SEQ ID NO: 414422 - DNA, 20 bp, mouse
gaggtgctcgggataacagg

SEQ ID NO: 414423 - DNA, 20 bp, mouse
gggtaaggtgtcctccagtg

SEQ ID NO: 414424 - DNA, 20 bp, mouse
gctgcactcaaagccaccgg

SEQ ID NO: 414425 - DNA, 20 bp, mouse
ggttctccccagccataaca

SEQ ID NO: 414426 - DNA, 20 bp, mouse
ggcgtgtgtgccggactctg

SEQ ID NO: 414427 - DNA, 20 bp, mouse
gtcagagtctccacagagtc

SEQ ID NO: 414428 - DNA, 20 bp, mouse
gcatgcgtgctgacgctcaa

SEQ ID NO: 414429 - DNA, 20 bp, mouse
ggcgtgctgacgctcaaggg

SEQ ID NO: 414430 - DNA, 20 bp, mouse
ggactctgaagactaagttg

SEQ ID NO: 414431 - DNA, 20 bp, mouse
gcccaacagacgtggaggcg

SEQ ID NO: 414432 - DNA, 20 bp, mouse
ggctcaagggcgggttttcg

SEQ ID NO: 414433 - DNA, 20 bp, mouse
gtaaggagacccagacgagc

SEQ ID NO: 414434 - DNA, 20 bp, mouse
gatcaagacggcgtgtgtgc

SEQ ID NO: 414435 - DNA, 20 bp, mouse
gggcgggttttcggggaaga

SEQ ID NO: 414436 - DNA, 20 bp, mouse
ggaggcggcgacaggaacgc

SEQ ID NO: 414437 - DNA, 20 bp, mouse
gagagggacggacccaggga

SEQ ID NO: 414438 - DNA, 20 bp, mouse
gaacgcgggcccagagtcgc

SEQ ID NO: 414439 - DNA, 20 bp, mouse
ggttcctgtcgccgcctcca

SEQ ID NO: 414440 - DNA, 20 bp, mouse
ggcgtctggtcgcctcccca

SEQ ID NO: 414441 - DNA, 20 bp, mouse
ggtccgagtcgctcgctctg

SEQ ID NO: 414442 - DNA, 20 bp, mouse
gcagcggctcgcacttccgg

SEQ ID NO: 414443 - DNA, 20 bp, mouse
ggaggttctcctgcgactct

SEQ ID NO: 414444 - DNA, 20 bp, mouse
gcgaccagacgcgcgagccc

SEQ ID NO: 414445 - DNA, 20 bp, mouse
gacctgtgcagaaggctcct

SEQ ID NO: 414446 - DNA, 20 bp, mouse
gcgccgggacaggagaagcg

SEQ ID NO: 414447 - DNA, 20 bp, mouse
gaggcgggcagcgcaggcac

SEQ ID NO: 414448 - DNA, 20 bp, mouse
gccggacccggacccagacc

SEQ ID NO: 414449 - DNA, 20 bp, mouse
gaagcctgccgagcgcctca

SEQ ID NO: 414450 - DNA, 20 bp, mouse
gcccgggcctccgccgggac

SEQ ID NO: 414451 - DNA, 20 bp, mouse
gcaccggcgacgcggcgaag

SEQ ID NO: 414452 - DNA, 20 bp, mouse
gcccggcagccgctgccctg

SEQ ID NO: 414453 - DNA, 20 bp, mouse
gagcgcaggcaccggcgacg

SEQ ID NO: 414454 - DNA, 20 bp, mouse
gaccggtgcgtcctgcacag

SEQ ID NO: 414455 - DNA, 20 bp, mouse
gcggcgacgcggcgaagggg

SEQ ID NO: 414456 - DNA, 20 bp, mouse
gactgagttctcgagcgatg

SEQ ID NO: 414457 - DNA, 20 bp, mouse
gcagaagtattacattgaag

SEQ ID NO: 414458 - DNA, 20 bp, mouse
gacctcctgtaagagagggg

SEQ ID NO: 414459 - DNA, 20 bp, mouse
gtaagagaggggcggaggac

SEQ ID NO: 414460 - DNA, 20 bp, mouse
gctacagttcgacacacggt

SEQ ID NO: 414461 - DNA, 20 bp, mouse
gacacacggtaggagaacgc

SEQ ID NO: 414462 - DNA, 20 bp, mouse
ggtgacaaaggccgtagcca

SEQ ID NO: 414463 - DNA, 20 bp, mouse
gagaactccacgccggaagt

SEQ ID NO: 414464 - DNA, 20 bp, mouse
gcggtacctcctgtaagaga

SEQ ID NO: 414465 - DNA, 20 bp, mouse
ggagaggggcggaggacggg

SEQ ID NO: 414466 - DNA, 20 bp, mouse
gtccggaaagcatcctctct

SEQ ID NO: 414467 - DNA, 20 bp, mouse
gtgttggcagcctcgagatg

SEQ ID NO: 414468 - DNA, 20 bp, mouse
gtgcttccgggccaaactgt

SEQ ID NO: 414469 - DNA, 20 bp, mouse
gccggaggcggcccagtctc

SEQ ID NO: 414470 - DNA, 20 bp, mouse
ggtgccccaggtaggaaagg

SEQ ID NO: 414471 - DNA, 20 bp, mouse
gctgggctctgcagccagcg

SEQ ID NO: 414472 - DNA, 20 bp, mouse
ggactgggccacccgagact

SEQ ID NO: 414473 - DNA, 20 bp, mouse
ggtagtgtgtgccagcctag

SEQ ID NO: 414474 - DNA, 20 bp, mouse
gagcccggcgtgccccaggt

SEQ ID NO: 414475 - DNA, 20 bp, mouse
ggaggcggcccagtctcggg

SEQ ID NO: 414476 - DNA, 20 bp, mouse
ggggcgcggggcgcattcac

SEQ ID NO: 414477 - DNA, 20 bp, mouse
ggggcggccggccgcacgga

SEQ ID NO: 414478 - DNA, 20 bp, mouse
gcgcggggcgcattcacggg

SEQ ID NO: 414479 - DNA, 20 bp, mouse
ggagcagtcagccgtccgtg

SEQ ID NO: 414480 - DNA, 20 bp, mouse
gcggagcccgaggaggacga

SEQ ID NO: 414481 - DNA, 20 bp, mouse
gctcggtgcgcggggccccc

SEQ ID NO: 414482 - DNA, 20 bp, mouse
gagcccgaggaggacgacgg

SEQ ID NO: 414483 - DNA, 20 bp, mouse
gtcacgggcggccggccgca

SEQ ID NO: 414484 - DNA, 20 bp, mouse
gcggccgccgaacaaagcgg

SEQ ID NO: 414485 - DNA, 20 bp, mouse
ggggaccaccggagccggag

SEQ ID NO: 414486 - DNA, 20 bp, mouse
gccgcgccacccggagggag

SEQ ID NO: 414487 - DNA, 20 bp, mouse
gcggcggccgctggcagtgg

SEQ ID NO: 414488 - DNA, 20 bp, mouse
gagccgtggccgggacgaag

SEQ ID NO: 414489 - DNA, 20 bp, mouse
ggccgccccgcgccacccgg

SEQ ID NO: 414490 - DNA, 20 bp, mouse
gtcgggaagctgacaggaag

SEQ ID NO: 414491 - DNA, 20 bp, mouse
gggccgccgctccctccggg

SEQ ID NO: 414492 - DNA, 20 bp, mouse
gctggcagtgggggcgaaag

SEQ ID NO: 414493 - DNA, 20 bp, mouse
ggagcggcggccgctggcag

SEQ ID NO: 414494 - DNA, 20 bp, mouse
gccttcctcgggaagctgac

SEQ ID NO: 414495 - DNA, 20 bp, mouse
gtcccgagccagatgagccg

SEQ ID NO: 414496 - DNA, 20 bp, mouse
gggcgcgttggtggaataag

SEQ ID NO: 414497 - DNA, 20 bp, mouse
gataaggggcgatgcaactc

SEQ ID NO: 414498 - DNA, 20 bp, mouse
ggacaagcgcgagaaactgg

SEQ ID NO: 414499 - DNA, 20 bp, mouse
gagcaaagggaaatgtgcgg

SEQ ID NO: 414500 - DNA, 20 bp, mouse
gactttgcatctgtgattcc

SEQ ID NO: 414501 - DNA, 20 bp, mouse
gtccgtgccatggcccccca

SEQ ID NO: 414502 - DNA, 20 bp, mouse
ggaccgtggtcattgagcat

SEQ ID NO: 414503 - DNA, 20 bp, mouse
ggccgcgcctatggagacgg

SEQ ID NO: 414504 - DNA, 20 bp, mouse
gacccgtccaaaccgcggag

SEQ ID NO: 414505 - DNA, 20 bp, mouse
gggctgctggtttgtctctc

SEQ ID NO: 414506 - DNA, 20 bp, mouse
ggcgcggacaagccaagagc

SEQ ID NO: 414507 - DNA, 20 bp, mouse
ggcacaaagccccgcgtcta

SEQ ID NO: 414508 - DNA, 20 bp, mouse
gagagtgcagaactccgcaa

SEQ ID NO: 414509 - DNA, 20 bp, mouse
gctcccccgaaaggatagaa

SEQ ID NO: 414510 - DNA, 20 bp, mouse
gaccccttctatcctttcgg

SEQ ID NO: 414511 - DNA, 20 bp, mouse
gcgtctacggctcccccgaa

SEQ ID NO: 414512 - DNA, 20 bp, mouse
gggctgtggagttatcctca

SEQ ID NO: 414513 - DNA, 20 bp, mouse
ggggtcgcagcgcgcgtgtc

SEQ ID NO: 414514 - DNA, 20 bp, mouse
gcgcaagggcgcgcggccta

SEQ ID NO: 414515 - DNA, 20 bp, mouse
gcgggggagccgtagacgcg

SEQ ID NO: 414516 - DNA, 20 bp, mouse
gggagtgcctccgaaccagg

SEQ ID NO: 414517 - DNA, 20 bp, mouse
gatggcggcggagcacgatt

SEQ ID NO: 414518 - DNA, 20 bp, mouse
ggtctccgtgctgattccca

SEQ ID NO: 414519 - DNA, 20 bp, mouse
gtcgtagagggtccgcagaa

SEQ ID NO: 414520 - DNA, 20 bp, mouse
gccaggagtgcctccgaacc

SEQ ID NO: 414521 - DNA, 20 bp, mouse
gcgccggaagcggaagtggt

SEQ ID NO: 414522 - DNA, 20 bp, mouse
gaaggtcggccaacaagtgg

SEQ ID NO: 414523 - DNA, 20 bp, mouse
gggcactgggcgggatctgg

SEQ ID NO: 414524 - DNA, 20 bp, mouse
ggccgccatgggaatcagca

SEQ ID NO: 414525 - DNA, 20 bp, mouse
gacgctcacccaggtcgtag

SEQ ID NO: 414526 - DNA, 20 bp, mouse
gcggcgagactctaaaccca

SEQ ID NO: 414527 - DNA, 20 bp, mouse
gacctcgggccggaagcatt

SEQ ID NO: 414528 - DNA, 20 bp, mouse
gcccatcctcggtctaccgt

SEQ ID NO: 414529 - DNA, 20 bp, mouse
gctaaacccacggtagaccg

SEQ ID NO: 414530 - DNA, 20 bp, mouse
gctgtgcaggtgcttacctc

SEQ ID NO: 414531 - DNA, 20 bp, mouse
gaccgaggatgggaaatcta

SEQ ID NO: 414532 - DNA, 20 bp, mouse
gccaggctcggactagtcag

SEQ ID NO: 414533 - DNA, 20 bp, mouse
gacgtgctacccctacccta

SEQ ID NO: 414534 - DNA, 20 bp, mouse
gcactgaacgcgaggaggag

SEQ ID NO: 414535 - DNA, 20 bp, mouse
ggcaggtgcttacctcgggc

SEQ ID NO: 414536 - DNA, 20 bp, mouse
ggcaggtttttatgtgacca

SEQ ID NO: 414537 - DNA, 20 bp, mouse
gcacataacagggactcacg

SEQ ID NO: 414538 - DNA, 20 bp, mouse
gtggaggatggaggttgatg

SEQ ID NO: 414539 - DNA, 20 bp, mouse
gttcctctaccacagttcag

SEQ ID NO: 414540 - DNA, 20 bp, mouse
gttgagagaggcacataaca

SEQ ID NO: 414541 - DNA, 20 bp, mouse
gaatgctattgcttatgtgg

SEQ ID NO: 414542 - DNA, 20 bp, mouse
gaacctctgaactgtggtag

SEQ ID NO: 414543 - DNA, 20 bp, mouse
gaccacagttcagaggttac

SEQ ID NO: 414544 - DNA, 20 bp, mouse
gataagtaaacgattgaatg

SEQ ID NO: 414545 - DNA, 20 bp, mouse
gcataatgctattgcttatg

SEQ ID NO: 414546 - DNA, 20 bp, mouse
ggccagcggtactcaccaga

SEQ ID NO: 414547 - DNA, 20 bp, mouse
ggtcctgtgccagcctgtct

SEQ ID NO: 414548 - DNA, 20 bp, mouse
gaggaggaggagacgagata

SEQ ID NO: 414549 - DNA, 20 bp, mouse
ggacaacgggacactagaca

SEQ ID NO: 414550 - DNA, 20 bp, mouse
gtgcacacagacgcccagac

SEQ ID NO: 414551 - DNA, 20 bp, mouse
ggcggtactcaccagaaggc

SEQ ID NO: 414552 - DNA, 20 bp, mouse
gaccgagggcgacagagact

SEQ ID NO: 414553 - DNA, 20 bp, mouse
ggcacggcgcccgcccctgc

SEQ ID NO: 414554 - DNA, 20 bp, mouse
gttgtggcactggggtcagg

SEQ ID NO: 414555 - DNA, 20 bp, mouse
gttgcttccggtttccgagg

SEQ ID NO: 414556 - DNA, 20 bp, mouse
gggatccccgcaccgagagg

SEQ ID NO: 414557 - DNA, 20 bp, mouse
gcgaggatccccgcaccgag

SEQ ID NO: 414558 - DNA, 20 bp, mouse
gggcgggagccggtcagagg

SEQ ID NO: 414559 - DNA, 20 bp, mouse
gccccgcaccgagaggcggt

SEQ ID NO: 414560 - DNA, 20 bp, mouse
gcgggcaccgaaatactcag

SEQ ID NO: 414561 - DNA, 20 bp, mouse
ggtcggagcaggatagtctt

SEQ ID NO: 414562 - DNA, 20 bp, mouse
gctcccttgtggaggaacca

SEQ ID NO: 414563 - DNA, 20 bp, mouse
gtgcttccaccagcagctcg

SEQ ID NO: 414564 - DNA, 20 bp, mouse
gtgagcccccgaggcgacgg

SEQ ID NO: 414565 - DNA, 20 bp, mouse
gctccgaccgcctctcggtg

SEQ ID NO: 414566 - DNA, 20 bp, mouse
gggcctgaaaacctccctgg

SEQ ID NO: 414567 - DNA, 20 bp, mouse
ggatctcctagcccccaggg

SEQ ID NO: 414568 - DNA, 20 bp, mouse
ggatggcctgaaaacctccc

SEQ ID NO: 414569 - DNA, 20 bp, mouse
ggatctgtactgaatctcta

SEQ ID NO: 414570 - DNA, 20 bp, mouse
ggattcagtacagatccctg

SEQ ID NO: 414571 - DNA, 20 bp, mouse
gtgacagttggagaactagc

SEQ ID NO: 414572 - DNA, 20 bp, mouse
gtccaactgtcagagctccc

SEQ ID NO: 414573 - DNA, 20 bp, mouse
gctggacagcatcctactta

SEQ ID NO: 414574 - DNA, 20 bp, mouse
gagttggtagtgagataagg

SEQ ID NO: 414575 - DNA, 20 bp, mouse
gcattgacacgaagtaggta

SEQ ID NO: 414576 - DNA, 20 bp, mouse
gcggctgcaggggatccctg

SEQ ID NO: 414577 - DNA, 20 bp, mouse
gcaaccacggacacacccgc

SEQ ID NO: 414578 - DNA, 20 bp, mouse
ggccccaggctcaatgccag

SEQ ID NO: 414579 - DNA, 20 bp, mouse
gacccgctggcattgagcct

SEQ ID NO: 414580 - DNA, 20 bp, mouse
gggctggagtgtcataggga

SEQ ID NO: 414581 - DNA, 20 bp, mouse
gtccaggctggagtgtcata

SEQ ID NO: 414582 - DNA, 20 bp, mouse
gatgccagcgggtgtgtccg

SEQ ID NO: 414583 - DNA, 20 bp, mouse
gcaacacctgaggaaactgg

SEQ ID NO: 414584 - DNA, 20 bp, mouse
gggcccggcgcgcggctgca

SEQ ID NO: 414585 - DNA, 20 bp, mouse
gccagcctggagaaggagta

SEQ ID NO: 414586 - DNA, 20 bp, mouse
ggcgctccctgcggacatgg

SEQ ID NO: 414587 - DNA, 20 bp, mouse
ggcaggccgccatgtccgca

SEQ ID NO: 414588 - DNA, 20 bp, mouse
ggccgcggtgcgagagggaa

SEQ ID NO: 414589 - DNA, 20 bp, mouse
gtagttggcgggtggttgac

SEQ ID NO: 414590 - DNA, 20 bp, mouse
ggtcgcgctccctgcggaca

SEQ ID NO: 414591 - DNA, 20 bp, mouse
gggatgtgtcgcgctccctg

SEQ ID NO: 414592 - DNA, 20 bp, mouse
gtcctgccgctggcgggtaa

SEQ ID NO: 414593 - DNA, 20 bp, mouse
ggcgggtggttgactggagc

SEQ ID NO: 414594 - DNA, 20 bp, mouse
ggcccttacccgccagcggc

SEQ ID NO: 414595 - DNA, 20 bp, mouse
gcgacacatcctgccgctgg

SEQ ID NO: 414596 - DNA, 20 bp, mouse
gatgaggacccagacttcag

SEQ ID NO: 414597 - DNA, 20 bp, mouse
gagccacgggaatgaaacta

SEQ ID NO: 414598 - DNA, 20 bp, mouse
ggaatgcccagcctatgtgt

SEQ ID NO: 414599 - DNA, 20 bp, mouse
gcacaacaaccgctccgtgt

SEQ ID NO: 414600 - DNA, 20 bp, mouse
gtgcgcactcccctgaagtc

SEQ ID NO: 414601 - DNA, 20 bp, mouse
gcatcagtaccgggacatca

SEQ ID NO: 414602 - DNA, 20 bp, mouse
gaattcaggatccaaaccag

SEQ ID NO: 414603 - DNA, 20 bp, mouse
gtcatgacctgggtgagcac

SEQ ID NO: 414604 - DNA, 20 bp, mouse
gcaccgtgctacccacacat

SEQ ID NO: 414605 - DNA, 20 bp, mouse
gctgtttagccttgctgatg

SEQ ID NO: 414606 - DNA, 20 bp, mouse
gcctcagcgccagggagaag

SEQ ID NO: 414607 - DNA, 20 bp, mouse
gtatgtgcagctagaagggt

SEQ ID NO: 414608 - DNA, 20 bp, mouse
gtgggggctccgggtcagac

SEQ ID NO: 414609 - DNA, 20 bp, mouse
ggaggaggtccggtctgacc

SEQ ID NO: 414610 - DNA, 20 bp, mouse
ggccctagaaacccccccag

SEQ ID NO: 414611 - DNA, 20 bp, mouse
gctgcactgaggccactaac

SEQ ID NO: 414612 - DNA, 20 bp, mouse
ggttggccctgcccccatcg

SEQ ID NO: 414613 - DNA, 20 bp, mouse
gggcgggcggtgggcgctgg

SEQ ID NO: 414614 - DNA, 20 bp, mouse
gcagtgcagaatcccctggg

SEQ ID NO: 414615 - DNA, 20 bp, mouse
gttcacctgcctcagcgcca

SEQ ID NO: 414616 - DNA, 20 bp, mouse
gatggctggcacgtcctcgg

SEQ ID NO: 414617 - DNA, 20 bp, mouse
gggcatggctggcacgtcct

SEQ ID NO: 414618 - DNA, 20 bp, mouse
ggctggcacgtcctcggagg

SEQ ID NO: 414619 - DNA, 20 bp, mouse
gcagtgggacgtgagagacg

SEQ ID NO: 414620 - DNA, 20 bp, mouse
gggccggcggcggacagtgc

SEQ ID NO: 414621 - DNA, 20 bp, mouse
gccccgcgaaccaaacagaa

SEQ ID NO: 414622 - DNA, 20 bp, mouse
gggcaatgcttaaggactca

SEQ ID NO: 414623 - DNA, 20 bp, mouse
gacggggctccgatttctag

SEQ ID NO: 414624 - DNA, 20 bp, mouse
gaggactcaaggcgacagtc

SEQ ID NO: 414625 - DNA, 20 bp, mouse
ggatcctgtcccctagaaat

SEQ ID NO: 414626 - DNA, 20 bp, mouse
gccctaggcagcctgtccag

SEQ ID NO: 414627 - DNA, 20 bp, mouse
gaagagacccatttaaacgg

SEQ ID NO: 414628 - DNA, 20 bp, mouse
gcttctagctgctcaatggg

SEQ ID NO: 414629 - DNA, 20 bp, mouse
gaggtggcagggggttccct

SEQ ID NO: 414630 - DNA, 20 bp, mouse
gtcccaggccagtaaagagg

SEQ ID NO: 414631 - DNA, 20 bp, mouse
gccaggggtggagacgccca

SEQ ID NO: 414632 - DNA, 20 bp, mouse
gggtaaatgatgcagcgagg

SEQ ID NO: 414633 - DNA, 20 bp, mouse
gcagtcccaggccagtaaag

SEQ ID NO: 414634 - DNA, 20 bp, mouse
gagacccatttaaacggtgg

SEQ ID NO: 414635 - DNA, 20 bp, mouse
gctaataagctgcagagaac

SEQ ID NO: 414636 - DNA, 20 bp, mouse
ggcagcagccaacacctctg

SEQ ID NO: 414637 - DNA, 20 bp, mouse
ggcagccaacacctctgtgg

SEQ ID NO: 414638 - DNA, 20 bp, mouse
gcgctcactggtctagacgg

SEQ ID NO: 414639 - DNA, 20 bp, mouse
gacgcggactccgcagaccc

SEQ ID NO: 414640 - DNA, 20 bp, mouse
ggacttggtcggaagaggtg

SEQ ID NO: 414641 - DNA, 20 bp, mouse
gaagcgaagtctagaagggt

SEQ ID NO: 414642 - DNA, 20 bp, mouse
ggtggggagagagccagatc

SEQ ID NO: 414643 - DNA, 20 bp, mouse
ggcatgactgcgcagtcaag

SEQ ID NO: 414644 - DNA, 20 bp, mouse
gcctcaggcaagctctccca

SEQ ID NO: 414645 - DNA, 20 bp, mouse
gtgcctgagggggacctgag

SEQ ID NO: 414646 - DNA, 20 bp, mouse
gcccagctcggcgcaggagg

SEQ ID NO: 414647 - DNA, 20 bp, mouse
gagcatggagagcgagctgg

SEQ ID NO: 414648 - DNA, 20 bp, mouse
gcctccaccaacgcctggaa

SEQ ID NO: 414649 - DNA, 20 bp, mouse
ggccagcatggagagcgagc

SEQ ID NO: 414650 - DNA, 20 bp, mouse
gggcgtgtcggccgaggcag

SEQ ID NO: 414651 - DNA, 20 bp, mouse
gggaggtcagcgatccgacg

SEQ ID NO: 414652 - DNA, 20 bp, mouse
gggcacagcacgaaaacgag

SEQ ID NO: 414653 - DNA, 20 bp, mouse
gcggcgccgcgactcccggg

SEQ ID NO: 414654 - DNA, 20 bp, mouse
gtgcgcgaccggaggtgtga

SEQ ID NO: 414655 - DNA, 20 bp, mouse
ggcggactccggcgggaaca

SEQ ID NO: 414656 - DNA, 20 bp, mouse
ggcttacacgccaatagcaa

SEQ ID NO: 414657 - DNA, 20 bp, mouse
gcgcagagcgcgcagaggtt

SEQ ID NO: 414658 - DNA, 20 bp, mouse
ggctggacccgccccaacga

SEQ ID NO: 414659 - DNA, 20 bp, mouse
gacgccaatagcaagggacg

SEQ ID NO: 414660 - DNA, 20 bp, mouse
gcgtgtaagcacccgccggg

SEQ ID NO: 414661 - DNA, 20 bp, mouse
gaagcagacctgccgcccgg

SEQ ID NO: 414662 - DNA, 20 bp, mouse
gaggcctcgtcccttgctat

SEQ ID NO: 414663 - DNA, 20 bp, mouse
gccaagcgcagagcgcgcag

SEQ ID NO: 414664 - DNA, 20 bp, mouse
gcgcgctctgcgcttggcag

SEQ ID NO: 414665 - DNA, 20 bp, mouse
gccctccgccgggacagagg

SEQ ID NO: 414666 - DNA, 20 bp, mouse
ggtgctggagattgaagaga

SEQ ID NO: 414667 - DNA, 20 bp, mouse
gcccatcctgggtaccagtt

SEQ ID NO: 414668 - DNA, 20 bp, mouse
gaatgggcccggcgttgctg

SEQ ID NO: 414669 - DNA, 20 bp, mouse
gcctctcaggcgttatgggg

SEQ ID NO: 414670 - DNA, 20 bp, mouse
ggcacctgaaagctcccaac

SEQ ID NO: 414671 - DNA, 20 bp, mouse
gtcccaactggtacccagga

SEQ ID NO: 414672 - DNA, 20 bp, mouse
gcaaaagaggggaccctcca

SEQ ID NO: 414673 - DNA, 20 bp, mouse
ggtaccagttgggagctttc

SEQ ID NO: 414674 - DNA, 20 bp, mouse
gtgcccgcggggaacagcaa

SEQ ID NO: 414675 - DNA, 20 bp, mouse
gtaacgcctgagaggcttct

SEQ ID NO: 414676 - DNA, 20 bp, mouse
ggccagggctcatagccagg

SEQ ID NO: 414677 - DNA, 20 bp, mouse
ggccacctggctatgagccc

SEQ ID NO: 414678 - DNA, 20 bp, mouse
gggcctgacagccctgtaag

SEQ ID NO: 414679 - DNA, 20 bp, mouse
gagcggccacggccacctct

SEQ ID NO: 414680 - DNA, 20 bp, mouse
gaaactgctgcggtacctgt

SEQ ID NO: 414681 - DNA, 20 bp, mouse
ggtggccgtggccgcttaca

SEQ ID NO: 414682 - DNA, 20 bp, mouse
gggctgcagtttcaccccag

SEQ ID NO: 414683 - DNA, 20 bp, mouse
gtgcagtttcaccccagagg

SEQ ID NO: 414684 - DNA, 20 bp, mouse
ggcccccagagtcaaattca

SEQ ID NO: 414685 - DNA, 20 bp, mouse
gacagccctgtaagcggcca

SEQ ID NO: 414686 - DNA, 20 bp, mouse
gccgaagctgagaggtccca

SEQ ID NO: 414687 - DNA, 20 bp, mouse
gcacggtgccaggagcagtt

SEQ ID NO: 414688 - DNA, 20 bp, mouse
gtggctgctgcaaccctggg

SEQ ID NO: 414689 - DNA, 20 bp, mouse
gcttgggctccgaagctgag

SEQ ID NO: 414690 - DNA, 20 bp, mouse
ggaaggaaaagcagccggga

SEQ ID NO: 414691 - DNA, 20 bp, mouse
gaaggcgagagatgcctgcg

SEQ ID NO: 414692 - DNA, 20 bp, mouse
gaagaggtacctggacttag

SEQ ID NO: 414693 - DNA, 20 bp, mouse
gtatctgtcgccctgcctct

SEQ ID NO: 414694 - DNA, 20 bp, mouse
gagagatgcctgcggggctt

SEQ ID NO: 414695 - DNA, 20 bp, mouse
gacagcatccgaactgctcc

SEQ ID NO: 414696 - DNA, 20 bp, mouse
gtccaatgaacgcgtagtga

SEQ ID NO: 414697 - DNA, 20 bp, mouse
ggtagcgcaaccccaagaaa

SEQ ID NO: 414698 - DNA, 20 bp, mouse
gccgatgcaggtgtgttgtc

SEQ ID NO: 414699 - DNA, 20 bp, mouse
gcgcaaccccaagaaaagga

SEQ ID NO: 414700 - DNA, 20 bp, mouse
ggccctcactacgcgttcat

SEQ ID NO: 414701 - DNA, 20 bp, mouse
gacaccaagccagcactggg

SEQ ID NO: 414702 - DNA, 20 bp, mouse
ggccctctagcatacaataa

SEQ ID NO: 414703 - DNA, 20 bp, mouse
gttagtgtatcacagtctta

SEQ ID NO: 414704 - DNA, 20 bp, mouse
gagggcagcggtgagaaagc

SEQ ID NO: 414705 - DNA, 20 bp, mouse
ggtctccagtaattactgtc

SEQ ID NO: 414706 - DNA, 20 bp, mouse
gaagtaattctatcttgtgt

SEQ ID NO: 414707 - DNA, 20 bp, mouse
gtagagtgatgcacaaggtt

SEQ ID NO: 414708 - DNA, 20 bp, mouse
gttccactgctctagccact

SEQ ID NO: 414709 - DNA, 20 bp, mouse
ggctagagcagtggaatgtt

SEQ ID NO: 414710 - DNA, 20 bp, mouse
gcttctatgggacagcccag

SEQ ID NO: 414711 - DNA, 20 bp, mouse
gggctaacgcccccagtgtg

SEQ ID NO: 414712 - DNA, 20 bp, mouse
ggtattgcaagtaagcctct

SEQ ID NO: 414713 - DNA, 20 bp, mouse
gaggatcagaaccagatgtg

SEQ ID NO: 414714 - DNA, 20 bp, mouse
gagaaaacaacagacttatc

SEQ ID NO: 414715 - DNA, 20 bp, mouse
gctacaagttttcttttcaa

SEQ ID NO: 414716 - DNA, 20 bp, mouse
gctctctgccggaactgact

SEQ ID NO: 414717 - DNA, 20 bp, mouse
gtccggtgccgctccagcct

SEQ ID NO: 414718 - DNA, 20 bp, mouse
ggcccaggctggagcggcac

SEQ ID NO: 414719 - DNA, 20 bp, mouse
gttggcaattcttctcgccc

SEQ ID NO: 414720 - DNA, 20 bp, mouse
gcaattcttctcgcccaggc

SEQ ID NO: 414721 - DNA, 20 bp, mouse
gtctccggtggtgtttttgc

SEQ ID NO: 414722 - DNA, 20 bp, mouse
gtggtgtttttgcgggcttc

SEQ ID NO: 414723 - DNA, 20 bp, mouse
gcttctcgcccaggctggag

SEQ ID NO: 414724 - DNA, 20 bp, mouse
gagaattgccaagtcagttc

SEQ ID NO: 414725 - DNA, 20 bp, mouse
gcagagagcgcagcgagctc

SEQ ID NO: 414726 - DNA, 20 bp, mouse
gcgggagagtgagtcctgaa

SEQ ID NO: 414727 - DNA, 20 bp, mouse
gctgatgcgcctgaaagatg

SEQ ID NO: 414728 - DNA, 20 bp, mouse
ggcagagcccgagctcacgg

SEQ ID NO: 414729 - DNA, 20 bp, mouse
gagtgagtcctgaatggcgc

SEQ ID NO: 414730 - DNA, 20 bp, mouse
gattgcagagcccgagctca

SEQ ID NO: 414731 - DNA, 20 bp, mouse
gactctcccgccgtgagctc

SEQ ID NO: 414732 - DNA, 20 bp, mouse
gacggtgggcgagatatgga

SEQ ID NO: 414733 - DNA, 20 bp, mouse
gctttcaggcgcatcaggtg

SEQ ID NO: 414734 - DNA, 20 bp, mouse
ggccggaaccagcgcaggtt

SEQ ID NO: 414735 - DNA, 20 bp, mouse
gcgacatacactgggctggg

SEQ ID NO: 414736 - DNA, 20 bp, mouse
gcccagatggaggccagaat

SEQ ID NO: 414737 - DNA, 20 bp, mouse
gggacaccatgagtacttat

SEQ ID NO: 414738 - DNA, 20 bp, mouse
ggtacttatgggtagactca

SEQ ID NO: 414739 - DNA, 20 bp, mouse
ggcctccatggggacaacta

SEQ ID NO: 414740 - DNA, 20 bp, mouse
gtgggggagaagccataaat

SEQ ID NO: 414741 - DNA, 20 bp, mouse
ggtctacccataagtactca

SEQ ID NO: 414742 - DNA, 20 bp, mouse
gcatctggaacctgccccgt

SEQ ID NO: 414743 - DNA, 20 bp, mouse
gggtaggagatgcagttggt

SEQ ID NO: 414744 - DNA, 20 bp, mouse
gcatggctctaccctattta

SEQ ID NO: 414745 - DNA, 20 bp, mouse
gttatggcttctcccccaga

SEQ ID NO: 414746 - DNA, 20 bp, mouse
gcaggaccccgcggaagtag

SEQ ID NO: 414747 - DNA, 20 bp, mouse
gcccgcggaagtagaggaca

SEQ ID NO: 414748 - DNA, 20 bp, mouse
gctagtggcgaggtgagctt

SEQ ID NO: 414749 - DNA, 20 bp, mouse
gctcacctcgccactagtcc

SEQ ID NO: 414750 - DNA, 20 bp, mouse
gacttccgcggggtcctggc

SEQ ID NO: 414751 - DNA, 20 bp, mouse
gtccgcggggtcctggcagg

SEQ ID NO: 414752 - DNA, 20 bp, mouse
ggtgggtcttcgcctcgtaa

SEQ ID NO: 414753 - DNA, 20 bp, mouse
gggcgaggtgagcttcggca

SEQ ID NO: 414754 - DNA, 20 bp, mouse
gggtaccaggactagtggcg

SEQ ID NO: 414755 - DNA, 20 bp, mouse
ggtgtggggtggtaatggtc

SEQ ID NO: 414756 - DNA, 20 bp, mouse
gtgcgcgtcccagccatggg

SEQ ID NO: 414757 - DNA, 20 bp, mouse
gtgcccggtgtactgtacag

SEQ ID NO: 414758 - DNA, 20 bp, mouse
ggcgcacagctcttccgcag

SEQ ID NO: 414759 - DNA, 20 bp, mouse
gggcggcgaggactactacc

SEQ ID NO: 414760 - DNA, 20 bp, mouse
gctgtgcgcgtcccagccat

SEQ ID NO: 414761 - DNA, 20 bp, mouse
ggtcctcgccgcccatggct

SEQ ID NO: 414762 - DNA, 20 bp, mouse
gcgagcggcggccgggatcg

SEQ ID NO: 414763 - DNA, 20 bp, mouse
gcggccgctcgcacagctcc

SEQ ID NO: 414764 - DNA, 20 bp, mouse
gtagtagtcctcgccgccca

SEQ ID NO: 414765 - DNA, 20 bp, mouse
gcagtacaccgggcactctt

SEQ ID NO: 414766 - DNA, 20 bp, mouse
gtgcccgtgcaggcaggaca

SEQ ID NO: 414767 - DNA, 20 bp, mouse
gtccggactgctcctcccaa

SEQ ID NO: 414768 - DNA, 20 bp, mouse
gccccatgtcctgcctgcac

SEQ ID NO: 414769 - DNA, 20 bp, mouse
ggcacgcagcgacaggcatc

SEQ ID NO: 414770 - DNA, 20 bp, mouse
gagagcgcgggacacagtga

SEQ ID NO: 414771 - DNA, 20 bp, mouse
gagcgcacctccacccacca

SEQ ID NO: 414772 - DNA, 20 bp, mouse
ggcctgcacgggcatgggtc

SEQ ID NO: 414773 - DNA, 20 bp, mouse
ggagcggtcgcgccgttggg

SEQ ID NO: 414774 - DNA, 20 bp, mouse
gcttggtgtactgccatggt

SEQ ID NO: 414775 - DNA, 20 bp, mouse
gcacgggacgcaggaaaagg

SEQ ID NO: 414776 - DNA, 20 bp, mouse
gaggagccgcggggcacgtt

SEQ ID NO: 414777 - DNA, 20 bp, mouse
ggtgcaggaccgacaagtat

SEQ ID NO: 414778 - DNA, 20 bp, mouse
gacccttcccggacccaaga

SEQ ID NO: 414779 - DNA, 20 bp, mouse
gctgctcccaacgtgccccg

SEQ ID NO: 414780 - DNA, 20 bp, mouse
ggacgggacattctccgtca

SEQ ID NO: 414781 - DNA, 20 bp, mouse
gattctccgtcagggcagtt

SEQ ID NO: 414782 - DNA, 20 bp, mouse
gtccccggtgcacagcgcaa

SEQ ID NO: 414783 - DNA, 20 bp, mouse
gtccctcttgggtccgggaa

SEQ ID NO: 414784 - DNA, 20 bp, mouse
gttattgcgcacgcgcgggg

SEQ ID NO: 414785 - DNA, 20 bp, mouse
gtctcatgcggattggaaag

SEQ ID NO: 414786 - DNA, 20 bp, mouse
gtggccacgtgcacagactc

SEQ ID NO: 414787 - DNA, 20 bp, mouse
gctgaggtggacacagggga

SEQ ID NO: 414788 - DNA, 20 bp, mouse
gcatacatcctggaaaccaa

SEQ ID NO: 414789 - DNA, 20 bp, mouse
gtccaggatgtatgatggaa

SEQ ID NO: 414790 - DNA, 20 bp, mouse
gtggaaaccaagggtaagag

SEQ ID NO: 414791 - DNA, 20 bp, mouse
gagggatgatctgtcagaaa

SEQ ID NO: 414792 - DNA, 20 bp, mouse
gcagcccgagtctgtgcacg

SEQ ID NO: 414793 - DNA, 20 bp, mouse
ggcagctccttgtcattgtg

SEQ ID NO: 414794 - DNA, 20 bp, mouse
gacaccgaaaatgcttctgt

SEQ ID NO: 414795 - DNA, 20 bp, mouse
gaagtgaaatgtgaacttaa

SEQ ID NO: 414796 - DNA, 20 bp, mouse
gtagcggggcgcttcccagt

SEQ ID NO: 414797 - DNA, 20 bp, mouse
gggcgcgcggtcccgtggag

SEQ ID NO: 414798 - DNA, 20 bp, mouse
ggtcccgtggagcggcgtag

SEQ ID NO: 414799 - DNA, 20 bp, mouse
ggcgcttcccagtgggacga

SEQ ID NO: 414800 - DNA, 20 bp, mouse
ggccccgctacgccgctcca

SEQ ID NO: 414801 - DNA, 20 bp, mouse
gatcctggcgcgcggtcccg

SEQ ID NO: 414802 - DNA, 20 bp, mouse
ggcgccaggatcgacaagtg

SEQ ID NO: 414803 - DNA, 20 bp, mouse
gatattgagcgaggaaggtg

SEQ ID NO: 414804 - DNA, 20 bp, mouse
gggctttccctcgtcccact

SEQ ID NO: 414805 - DNA, 20 bp, mouse
ggcgccgcacttgtcgatcc

SEQ ID NO: 414806 - DNA, 20 bp, mouse
ggtcctgtctcagaaactgt

SEQ ID NO: 414807 - DNA, 20 bp, mouse
gcagctgaaagtcttctctc

SEQ ID NO: 414808 - DNA, 20 bp, mouse
gactgtaggttcattcacac

SEQ ID NO: 414809 - DNA, 20 bp, mouse
gtgcagggttaaaagacaat

SEQ ID NO: 414810 - DNA, 20 bp, mouse
gttgtcgacagataattata

SEQ ID NO: 414811 - DNA, 20 bp, mouse
gtctttgtcctcctttgtaa

SEQ ID NO: 414812 - DNA, 20 bp, mouse
gattcacactggctaatgca

SEQ ID NO: 414813 - DNA, 20 bp, mouse
gtaacagtaaaagctactta

SEQ ID NO: 414814 - DNA, 20 bp, mouse
gtcagctccccttacaaagg

SEQ ID NO: 414815 - DNA, 20 bp, mouse
ggtaattatagtaagtttgt

SEQ ID NO: 414816 - DNA, 20 bp, mouse
gcctagctgagagggagaga

SEQ ID NO: 414817 - DNA, 20 bp, mouse
gagctgtgcgctaactgagt

SEQ ID NO: 414818 - DNA, 20 bp, mouse
ggcggtgagactgtcatgag

SEQ ID NO: 414819 - DNA, 20 bp, mouse
ggtgtctgccgcagtgaatt

SEQ ID NO: 414820 - DNA, 20 bp, mouse
gggctcccggacaccctgca

SEQ ID NO: 414821 - DNA, 20 bp, mouse
gagggtctcctaagccagtc

SEQ ID NO: 414822 - DNA, 20 bp, mouse
gggactagggctccagagag

SEQ ID NO: 414823 - DNA, 20 bp, mouse
gcccttggaaggaatcaccg

SEQ ID NO: 414824 - DNA, 20 bp, mouse
gaggctccgtgttcaatcaa

SEQ ID NO: 414825 - DNA, 20 bp, mouse
gttaggagaccctgggacta

SEQ ID NO: 414826 - DNA, 20 bp, mouse
ggacagacggaaatctccag

SEQ ID NO: 414827 - DNA, 20 bp, mouse
gcccttctaagaagcagggt

SEQ ID NO: 414828 - DNA, 20 bp, mouse
gtctgggagaagctggagta

SEQ ID NO: 414829 - DNA, 20 bp, mouse
gacctaccctgcttcttaga

SEQ ID NO: 414830 - DNA, 20 bp, mouse
gagaagctggagtatggctg

SEQ ID NO: 414831 - DNA, 20 bp, mouse
gccgtctgtctgggagaagc

SEQ ID NO: 414832 - DNA, 20 bp, mouse
ggtcttcaagaactgagtgg

SEQ ID NO: 414833 - DNA, 20 bp, mouse
gggctgtgcagattttcctc

SEQ ID NO: 414834 - DNA, 20 bp, mouse
gtggtaaagcagggcaattg

SEQ ID NO: 414835 - DNA, 20 bp, mouse
gtcctactgtaagagttaaa

SEQ ID NO: 414836 - DNA, 20 bp, mouse
gccacacaggagtctaacag

SEQ ID NO: 414837 - DNA, 20 bp, mouse
ggcgatcagccaccataggg

SEQ ID NO: 414838 - DNA, 20 bp, mouse
gttgtcgcaccggctttctt

SEQ ID NO: 414839 - DNA, 20 bp, mouse
ggctgctgcttgctgtaggt

SEQ ID NO: 414840 - DNA, 20 bp, mouse
ggctcgccctaaggatgagt

SEQ ID NO: 414841 - DNA, 20 bp, mouse
gtctcagacctggacccgaa

SEQ ID NO: 414842 - DNA, 20 bp, mouse
gcgctggcgcctgcgtggtt

SEQ ID NO: 414843 - DNA, 20 bp, mouse
gagacgcagcgcctggaggg

SEQ ID NO: 414844 - DNA, 20 bp, mouse
ggtggtcagcgggtgcgcag

SEQ ID NO: 414845 - DNA, 20 bp, mouse
gagtgagagagcaaagacgg

SEQ ID NO: 414846 - DNA, 20 bp, mouse
gaggcgcagcagcggcgagt

SEQ ID NO: 414847 - DNA, 20 bp, mouse
gggcggtgaaggcgcagcag

SEQ ID NO: 414848 - DNA, 20 bp, mouse
gccggcccgcgagccgaccg

SEQ ID NO: 414849 - DNA, 20 bp, mouse
ggtccctgcgccggcggtga

SEQ ID NO: 414850 - DNA, 20 bp, mouse
gagtgggtgagtgagacgcg

SEQ ID NO: 414851 - DNA, 20 bp, mouse
gtcccggagggttccctcaa

SEQ ID NO: 414852 - DNA, 20 bp, mouse
ggtgtctagacagtccaggg

SEQ ID NO: 414853 - DNA, 20 bp, mouse
gggtgagtgagacgcgcggg

SEQ ID NO: 414854 - DNA, 20 bp, mouse
gggccttgcaggagttgcgg

SEQ ID NO: 414855 - DNA, 20 bp, mouse
ggtggtgtctagacagtcca

SEQ ID NO: 414856 - DNA, 20 bp, mouse
gtcccacgccacgagaggca

SEQ ID NO: 414857 - DNA, 20 bp, mouse
gtgtcctcccacgccacgag

SEQ ID NO: 414858 - DNA, 20 bp, mouse
gggaggatagcaggaatctc

SEQ ID NO: 414859 - DNA, 20 bp, mouse
gcaggcggctccctcagtga

SEQ ID NO: 414860 - DNA, 20 bp, mouse
gaagctccaggcattgagaa

SEQ ID NO: 414861 - DNA, 20 bp, mouse
ggagggcgaacagccaggaa

SEQ ID NO: 414862 - DNA, 20 bp, mouse
gtccctgcctctcgtggcgt

SEQ ID NO: 414863 - DNA, 20 bp, mouse
ggagggccacgtgagcatcg

SEQ ID NO: 414864 - DNA, 20 bp, mouse
gtgggcgcgcaggaaccagg

SEQ ID NO: 414865 - DNA, 20 bp, mouse
gaacaacgcggctcacgggg

SEQ ID NO: 414866 - DNA, 20 bp, mouse
gcgccgcgcggggaatggtg

SEQ ID NO: 414867 - DNA, 20 bp, mouse
gttccccaccattccccgcg

SEQ ID NO: 414868 - DNA, 20 bp, mouse
gggctgacgtgggcgccgcg

SEQ ID NO: 414869 - DNA, 20 bp, mouse
gcccttgtcaacacaatttt

SEQ ID NO: 414870 - DNA, 20 bp, mouse
gacctaaaattgtgttgaca

SEQ ID NO: 414871 - DNA, 20 bp, mouse
gccaggtcagagaagctgag

SEQ ID NO: 414872 - DNA, 20 bp, mouse
gaggatccagggcggtaggg

SEQ ID NO: 414873 - DNA, 20 bp, mouse
ggggaggatccagggcggta

SEQ ID NO: 414874 - DNA, 20 bp, mouse
ggacctgggaggatccaggg

SEQ ID NO: 414875 - DNA, 20 bp, mouse
gatccagggcggtagggagg

SEQ ID NO: 414876 - DNA, 20 bp, mouse
gagggaagtgtgaagcgtgt

SEQ ID NO: 414877 - DNA, 20 bp, mouse
ggcacgtacgcagacgacag

SEQ ID NO: 414878 - DNA, 20 bp, mouse
gtacgtgcaaggcgacagga

SEQ ID NO: 414879 - DNA, 20 bp, mouse
gccgctcctaagagacttgg

SEQ ID NO: 414880 - DNA, 20 bp, mouse
gcagcggttccctggttcga

SEQ ID NO: 414881 - DNA, 20 bp, mouse
gggttccctggttcgaggga

SEQ ID NO: 414882 - DNA, 20 bp, mouse
gcgcgacccccaagtctctt

SEQ ID NO: 414883 - DNA, 20 bp, mouse
gggttcgagggagggcgttg

SEQ ID NO: 414884 - DNA, 20 bp, mouse
gtgcgtacgtgcaaggcgac

SEQ ID NO: 414885 - DNA, 20 bp, mouse
gcaggaaggcagcggttccc

SEQ ID NO: 414886 - DNA, 20 bp, mouse
ggcagagggcgcagagccgg

SEQ ID NO: 414887 - DNA, 20 bp, mouse
gggggacaggatggaaccgt

SEQ ID NO: 414888 - DNA, 20 bp, mouse
gatggaaccgtgggcaagag

SEQ ID NO: 414889 - DNA, 20 bp, mouse
gctctgcgccctctgcggta

SEQ ID NO: 414890 - DNA, 20 bp, mouse
ggcgctgcggtccttcccgt

SEQ ID NO: 414891 - DNA, 20 bp, mouse
gtgccctcccctcttgccca

SEQ ID NO: 414892 - DNA, 20 bp, mouse
ggcgccctctgcggtaggga

SEQ ID NO: 414893 - DNA, 20 bp, mouse
gactccctccctaccgcaga

SEQ ID NO: 414894 - DNA, 20 bp, mouse
gccttgcggcgggcaggacc

SEQ ID NO: 414895 - DNA, 20 bp, mouse
gtctgaatccccggaaccca

SEQ ID NO: 414896 - DNA, 20 bp, mouse
gcagcgagcgacccgcatcc

SEQ ID NO: 414897 - DNA, 20 bp, mouse
gcggctgcagggcacaccgt

SEQ ID NO: 414898 - DNA, 20 bp, mouse
gtcagggcggccaccggctc

SEQ ID NO: 414899 - DNA, 20 bp, mouse
gctggatgagcctgagccgg

SEQ ID NO: 414900 - DNA, 20 bp, mouse
gtcgctggatgagcctgagc

SEQ ID NO: 414901 - DNA, 20 bp, mouse
gcagagcggccgagtcctcc

SEQ ID NO: 414902 - DNA, 20 bp, mouse
gtgcagggcacaccgtgggt

SEQ ID NO: 414903 - DNA, 20 bp, mouse
gcagagccctcagagccgga

SEQ ID NO: 414904 - DNA, 20 bp, mouse
gcccgcggacgccgggatgc

SEQ ID NO: 414905 - DNA, 20 bp, mouse
gagggcacaccgtgggtcgg

SEQ ID NO: 414906 - DNA, 20 bp, mouse
gtgggacacagaggactagg

SEQ ID NO: 414907 - DNA, 20 bp, mouse
gttatgggacacagaggact

SEQ ID NO: 414908 - DNA, 20 bp, mouse
gcagggagtgagcagtctta

SEQ ID NO: 414909 - DNA, 20 bp, mouse
gtgctcactccctgccagga

SEQ ID NO: 414910 - DNA, 20 bp, mouse
gacaagatgccatcctggca

SEQ ID NO: 414911 - DNA, 20 bp, mouse
gggactaggcggctgggctc

SEQ ID NO: 414912 - DNA, 20 bp, mouse
gggctcaggcagcgggaaag

SEQ ID NO: 414913 - DNA, 20 bp, mouse
gagcagcagcgccacgcgca

SEQ ID NO: 414914 - DNA, 20 bp, mouse
gtaaaggccagagaccctct

SEQ ID NO: 414915 - DNA, 20 bp, mouse
gtgaggggcttgtaccccat

SEQ ID NO: 414916 - DNA, 20 bp, mouse
gggcagaggtgtgcgagagt

SEQ ID NO: 414917 - DNA, 20 bp, mouse
gtgcaggtgcgtgctgggta

SEQ ID NO: 414918 - DNA, 20 bp, mouse
gtggtggaggcgcgtggcag

SEQ ID NO: 414919 - DNA, 20 bp, mouse
gggtgcgtgctgggtagggt

SEQ ID NO: 414920 - DNA, 20 bp, mouse
gggtagggtggggtgacggg

SEQ ID NO: 414921 - DNA, 20 bp, mouse
gtggtcgcctgtatcaacag

SEQ ID NO: 414922 - DNA, 20 bp, mouse
gcccaggaccgcgtctcccc

SEQ ID NO: 414923 - DNA, 20 bp, mouse
gtcaacaggggtaaatgggt

SEQ ID NO: 414924 - DNA, 20 bp, mouse
gtgatcttctgagggcggga

SEQ ID NO: 414925 - DNA, 20 bp, mouse
gttctgagggcgggacggcg

SEQ ID NO: 414926 - DNA, 20 bp, mouse
gcccgggacggcgaaccccg

SEQ ID NO: 414927 - DNA, 20 bp, mouse
gcatgccatggagaagctgg

SEQ ID NO: 414928 - DNA, 20 bp, mouse
gccggggagcgcccatgcca

SEQ ID NO: 414929 - DNA, 20 bp, mouse
gccgggctgcgctggagcat

SEQ ID NO: 414930 - DNA, 20 bp, mouse
gggctgacgatgaggtccag

SEQ ID NO: 414931 - DNA, 20 bp, mouse
ggcggcagcggctgacgatg

SEQ ID NO: 414932 - DNA, 20 bp, mouse
gggccgtcggggtcccggga

SEQ ID NO: 414933 - DNA, 20 bp, mouse
gtggccagcctccttccacg

SEQ ID NO: 414934 - DNA, 20 bp, mouse
gggcggggatgctcagactg

SEQ ID NO: 414935 - DNA, 20 bp, mouse
ggctgatgccccgtggaagg

SEQ ID NO: 414936 - DNA, 20 bp, mouse
ggcaatagggacgcagttat

SEQ ID NO: 414937 - DNA, 20 bp, mouse
gctctgcagtcgtggctagg

SEQ ID NO: 414938 - DNA, 20 bp, mouse
gccaaagactctgcgcaata

SEQ ID NO: 414939 - DNA, 20 bp, mouse
gctgagggaccgtagaccag

SEQ ID NO: 414940 - DNA, 20 bp, mouse
ggcctggacttaaatgacag

SEQ ID NO: 414941 - DNA, 20 bp, mouse
gggtctctgcagtcgtggct

SEQ ID NO: 414942 - DNA, 20 bp, mouse
gacgttggtctctgcagtcg

SEQ ID NO: 414943 - DNA, 20 bp, mouse
gacaaagactgcagaggggg

SEQ ID NO: 414944 - DNA, 20 bp, mouse
gctctgactccagaagtgaa

SEQ ID NO: 414945 - DNA, 20 bp, mouse
ggatccagtcattctcacgt

SEQ ID NO: 414946 - DNA, 20 bp, mouse
gtgaagcagataaatcccga

SEQ ID NO: 414947 - DNA, 20 bp, mouse
ggggccatacagaaaccctc

SEQ ID NO: 414948 - DNA, 20 bp, mouse
gctgtcatgggtcttccccg

SEQ ID NO: 414949 - DNA, 20 bp, mouse
gatgccaagcagaaatactc

SEQ ID NO: 414950 - DNA, 20 bp, mouse
gaatcccgagggtttctgta

SEQ ID NO: 414951 - DNA, 20 bp, mouse
gctctcctcacgggactccg

SEQ ID NO: 414952 - DNA, 20 bp, mouse
gagtcccgtgaggagagctc

SEQ ID NO: 414953 - DNA, 20 bp, mouse
gtgtttatcacggagccccg

SEQ ID NO: 414954 - DNA, 20 bp, mouse
gggatttatctgcttcataa

SEQ ID NO: 414955 - DNA, 20 bp, mouse
gagaagaaggcgggctttac

SEQ ID NO: 414956 - DNA, 20 bp, mouse
gaagtctcagaagcttaccc

SEQ ID NO: 414957 - DNA, 20 bp, mouse
gggccagaaactgctagacg

SEQ ID NO: 414958 - DNA, 20 bp, mouse
gctggcctggggaaaccaaa

SEQ ID NO: 414959 - DNA, 20 bp, mouse
ggaaaccaaacggtgctcag

SEQ ID NO: 414960 - DNA, 20 bp, mouse
gctgggatctggagggtaca

SEQ ID NO: 414961 - DNA, 20 bp, mouse
gacccaggcagagactggcc

SEQ ID NO: 414962 - DNA, 20 bp, mouse
gagcaccgtttggtttcccc

SEQ ID NO: 414963 - DNA, 20 bp, mouse
gctcaccaggtttcccactt

SEQ ID NO: 414964 - DNA, 20 bp, mouse
ggcagctgggacgctcgcac

SEQ ID NO: 414965 - DNA, 20 bp, mouse
gacgggagacggaagatgga

SEQ ID NO: 414966 - DNA, 20 bp, mouse
gcagacagccaagggagtgt

SEQ ID NO: 414967 - DNA, 20 bp, mouse
ggcggcctctacgtgagtcg

SEQ ID NO: 414968 - DNA, 20 bp, mouse
gtgcagggagctccacccta

SEQ ID NO: 414969 - DNA, 20 bp, mouse
gacagccaagggagtgtagg

SEQ ID NO: 414970 - DNA, 20 bp, mouse
gcctgccacgactcacgtag

SEQ ID NO: 414971 - DNA, 20 bp, mouse
gggcctgcaagattcctcca

SEQ ID NO: 414972 - DNA, 20 bp, mouse
gtggcagggatggctggcac

SEQ ID NO: 414973 - DNA, 20 bp, mouse
gtgtgagtggggcagcccta

SEQ ID NO: 414974 - DNA, 20 bp, mouse
gtagcatcccagacagccaa

SEQ ID NO: 414975 - DNA, 20 bp, mouse
ggtctgggatgctagaggga

SEQ ID NO: 414976 - DNA, 20 bp, mouse
gggtagaggaaaatgaagac

SEQ ID NO: 414977 - DNA, 20 bp, mouse
ggcctttcaataccaggtag

SEQ ID NO: 414978 - DNA, 20 bp, mouse
gggggcggaggtgttacttc

SEQ ID NO: 414979 - DNA, 20 bp, mouse
gtcctctacctggtattgaa

SEQ ID NO: 414980 - DNA, 20 bp, mouse
gaatctggcctttcaatacc

SEQ ID NO: 414981 - DNA, 20 bp, mouse
gccacgaagccgagtttttg

SEQ ID NO: 414982 - DNA, 20 bp, mouse
ggcatactgggtaacaggat

SEQ ID NO: 414983 - DNA, 20 bp, mouse
gcttcgcttcctcaaaaact

SEQ ID NO: 414984 - DNA, 20 bp, mouse
gttcttgaggtatcatggta

SEQ ID NO: 414985 - DNA, 20 bp, mouse
gtgaggaagcgaagttcttg

SEQ ID NO: 414986 - DNA, 20 bp, mouse
gtagcccctgaggcaagggg

SEQ ID NO: 414987 - DNA, 20 bp, mouse
gcatcccccccttgcctcag

SEQ ID NO: 414988 - DNA, 20 bp, mouse
gctcagaggtgggcgcagtg

SEQ ID NO: 414989 - DNA, 20 bp, mouse
gtgaggaggaagctaatgag

SEQ ID NO: 414990 - DNA, 20 bp, mouse
gctcttccgggaacgcgcca

SEQ ID NO: 414991 - DNA, 20 bp, mouse
gcttgcgcaggcgtcgtcca

SEQ ID NO: 414992 - DNA, 20 bp, mouse
gcgacgcctgcgcaagacct

SEQ ID NO: 414993 - DNA, 20 bp, mouse
gaggcaagggggggatgagg

SEQ ID NO: 414994 - DNA, 20 bp, mouse
gggaagagaggcggcaggag

SEQ ID NO: 414995 - DNA, 20 bp, mouse
ggcccgtagcccctgaggca

SEQ ID NO: 414996 - DNA, 20 bp, mouse
gccgtccgcgggaacgggaa

SEQ ID NO: 414997 - DNA, 20 bp, mouse
gttcggggcgcgggactgag

SEQ ID NO: 414998 - DNA, 20 bp, mouse
gaggccgcagccgagctggg

SEQ ID NO: 414999 - DNA, 20 bp, mouse
ggccaggccgcagccgagct

SEQ ID NO: 415000 - DNA, 20 bp, mouse
ggccccgcccagctcggctg

SEQ ID NO: 415001 - DNA, 20 bp, mouse
gaacgggttgagggccgagt

SEQ ID NO: 415002 - DNA, 20 bp, mouse
gggccctcaacccgttcctg

SEQ ID NO: 415003 - DNA, 20 bp, mouse
gtgcacgctgccgcaggaac

SEQ ID NO: 415004 - DNA, 20 bp, mouse
ggcccgctggtagcccagga

SEQ ID NO: 415005 - DNA, 20 bp, mouse
gccgcgtgcggaatcaaacc

SEQ ID NO: 415006 - DNA, 20 bp, mouse
gttgtgtgtccggagataca

SEQ ID NO: 415007 - DNA, 20 bp, mouse
ggagcccaggtgagagtcga

SEQ ID NO: 415008 - DNA, 20 bp, mouse
gtcagcacgccgtgtatctc

SEQ ID NO: 415009 - DNA, 20 bp, mouse
gaattcagagctggcacacc

SEQ ID NO: 415010 - DNA, 20 bp, mouse
gcgtgagcaccccaagtccc

SEQ ID NO: 415011 - DNA, 20 bp, mouse
gcccaggtgagagtcgaggg

SEQ ID NO: 415012 - DNA, 20 bp, mouse
gctacttctggggacttcag

SEQ ID NO: 415013 - DNA, 20 bp, mouse
gcacctgggctccaatagca

SEQ ID NO: 415014 - DNA, 20 bp, mouse
gccgattccccccaagtctc

SEQ ID NO: 415015 - DNA, 20 bp, mouse
gcggacacacaattcagagc

SEQ ID NO: 415016 - DNA, 20 bp, mouse
gggtaacaaaacctatagag

SEQ ID NO: 415017 - DNA, 20 bp, mouse
gtgtgacgaagaagccaggt

SEQ ID NO: 415018 - DNA, 20 bp, mouse
gctggagtagatggaactgt

SEQ ID NO: 415019 - DNA, 20 bp, mouse
gtactggtgacgctgaatag

SEQ ID NO: 415020 - DNA, 20 bp, mouse
gatgatttacgtcttaacaa

SEQ ID NO: 415021 - DNA, 20 bp, mouse
gatagaggggcatcgaagca

SEQ ID NO: 415022 - DNA, 20 bp, mouse
ggtgtgaagcatcctggtgt

SEQ ID NO: 415023 - DNA, 20 bp, mouse
ggggattgtgatctatagtt

SEQ ID NO: 415024 - DNA, 20 bp, mouse
ggttaggcattgttacgtca

SEQ ID NO: 415025 - DNA, 20 bp, mouse
gttgggataagacctcaaag

SEQ ID NO: 415026 - DNA, 20 bp, mouse
ggtgagacacccgtcccggt

SEQ ID NO: 415027 - DNA, 20 bp, mouse
gcaggtccctcccaccggga

SEQ ID NO: 415028 - DNA, 20 bp, mouse
ggcttgtgagacacccgtcc

SEQ ID NO: 415029 - DNA, 20 bp, mouse
gagcccaggtccctcccacc

SEQ ID NO: 415030 - DNA, 20 bp, mouse
ggacacccgtcccggtggga

SEQ ID NO: 415031 - DNA, 20 bp, mouse
gacgggtgtctcacaagctt

SEQ ID NO: 415032 - DNA, 20 bp, mouse
gcactgatgggggaacaaag

SEQ ID NO: 415033 - DNA, 20 bp, mouse
ggtggagctccaaatccggg

SEQ ID NO: 415034 - DNA, 20 bp, mouse
ggaacttggggtgacgcggt

SEQ ID NO: 415035 - DNA, 20 bp, mouse
gttggggtgacgcggtaggt

SEQ ID NO: 415036 - DNA, 20 bp, mouse
gggagtaccagcttgaggag

SEQ ID NO: 415037 - DNA, 20 bp, mouse
gtgacacctggcggagacgt

SEQ ID NO: 415038 - DNA, 20 bp, mouse
gggagacgtgggagggaacc

SEQ ID NO: 415039 - DNA, 20 bp, mouse
gacctggcggagacgtggga

SEQ ID NO: 415040 - DNA, 20 bp, mouse
ggcacgattgtgacacctgg

SEQ ID NO: 415041 - DNA, 20 bp, mouse
ggtaccagcttgaggagagg

SEQ ID NO: 415042 - DNA, 20 bp, mouse
ggtccggcaggaacactccg

SEQ ID NO: 415043 - DNA, 20 bp, mouse
gaaccgggagtaccagcttg

SEQ ID NO: 415044 - DNA, 20 bp, mouse
gagagcacgattgtgacacc

SEQ ID NO: 415045 - DNA, 20 bp, mouse
gtccctcccacgtctccgcc

SEQ ID NO: 415046 - DNA, 20 bp, mouse
gggccatgcgccgcacgcgg

SEQ ID NO: 415047 - DNA, 20 bp, mouse
gccggtgcctgtgttcccag

SEQ ID NO: 415048 - DNA, 20 bp, mouse
gccggcccgacgacccccat

SEQ ID NO: 415049 - DNA, 20 bp, mouse
gacgacccccatgggaatac

SEQ ID NO: 415050 - DNA, 20 bp, mouse
gggggccgcgggacgcaagc

SEQ ID NO: 415051 - DNA, 20 bp, mouse
ggtcccgcggcccccgcgtg

SEQ ID NO: 415052 - DNA, 20 bp, mouse
gggaagccagagtcccgcgc

SEQ ID NO: 415053 - DNA, 20 bp, mouse
gcaggagcgtagataaccca

SEQ ID NO: 415054 - DNA, 20 bp, mouse
ggcttcctgcttgcgtcccg

SEQ ID NO: 415055 - DNA, 20 bp, mouse
gtctgaggggacagatggtg

SEQ ID NO: 415056 - DNA, 20 bp, mouse
ggagtccagaggtccgtctg

SEQ ID NO: 415057 - DNA, 20 bp, mouse
gagaacgtacttcattccag

SEQ ID NO: 415058 - DNA, 20 bp, mouse
gttccggattaagagtccag

SEQ ID NO: 415059 - DNA, 20 bp, mouse
ggatgctgcaggccaggtgg

SEQ ID NO: 415060 - DNA, 20 bp, mouse
gcaaaccacagacggacctc

SEQ ID NO: 415061 - DNA, 20 bp, mouse
ggtgcggtccggagccggta

SEQ ID NO: 415062 - DNA, 20 bp, mouse
gcgcggggcaagcgagtgga

SEQ ID NO: 415063 - DNA, 20 bp, mouse
ggacctctggactcttaatc

SEQ ID NO: 415064 - DNA, 20 bp, mouse
gcctgtccgggagtgcggtc

SEQ ID NO: 415065 - DNA, 20 bp, mouse
gtatgctgcaccgaagtgag

SEQ ID NO: 415066 - DNA, 20 bp, mouse
ggcgggactccaggagccca

SEQ ID NO: 415067 - DNA, 20 bp, mouse
gcgtgtacagccggctccct

SEQ ID NO: 415068 - DNA, 20 bp, mouse
gggtgctagcgagagctcta

SEQ ID NO: 415069 - DNA, 20 bp, mouse
ggagtacagcccggtagtgt

SEQ ID NO: 415070 - DNA, 20 bp, mouse
gttggagcaagcgggactcc

SEQ ID NO: 415071 - DNA, 20 bp, mouse
gagcgagcggcgtgtacagc

SEQ ID NO: 415072 - DNA, 20 bp, mouse
gattcactctagcgagcgag

SEQ ID NO: 415073 - DNA, 20 bp, mouse
gtacagcccggtagtgtagg

SEQ ID NO: 415074 - DNA, 20 bp, mouse
gagctctagggagtacagcc

SEQ ID NO: 415075 - DNA, 20 bp, mouse
gctcgggtcagggaagtgtc

SEQ ID NO: 415076 - DNA, 20 bp, mouse
gcaggggactaccaacacag

SEQ ID NO: 415077 - DNA, 20 bp, mouse
gcagtggcagtgcagataag

SEQ ID NO: 415078 - DNA, 20 bp, mouse
gtcttgggaagcaggctctt

SEQ ID NO: 415079 - DNA, 20 bp, mouse
gttggtgtacttactcagaa

SEQ ID NO: 415080 - DNA, 20 bp, mouse
ggcaaggagtttctgtttag

SEQ ID NO: 415081 - DNA, 20 bp, mouse
gatccccaagagacgatcct

SEQ ID NO: 415082 - DNA, 20 bp, mouse
gttggggatgctggatgaca

SEQ ID NO: 415083 - DNA, 20 bp, mouse
gttgtgcaatgaggtgatgt

SEQ ID NO: 415084 - DNA, 20 bp, mouse
gatccgaggatcgtctcttg

SEQ ID NO: 415085 - DNA, 20 bp, mouse
gtgcaatgaggtgatgtagg

SEQ ID NO: 415086 - DNA, 20 bp, mouse
gggcggaccgagcggccgga

SEQ ID NO: 415087 - DNA, 20 bp, mouse
gagcgtctcacctgaggcaa

SEQ ID NO: 415088 - DNA, 20 bp, mouse
ggagggcggagcggttgccc

SEQ ID NO: 415089 - DNA, 20 bp, mouse
gcaggtgagacgctgaaaaa

SEQ ID NO: 415090 - DNA, 20 bp, mouse
ggccggctacgaggttaaac

SEQ ID NO: 415091 - DNA, 20 bp, mouse
gcttccggcggaagaggacg

SEQ ID NO: 415092 - DNA, 20 bp, mouse
gggtggagagactcctgacg

SEQ ID NO: 415093 - DNA, 20 bp, mouse
gagggctcgactttcaacgg

SEQ ID NO: 415094 - DNA, 20 bp, mouse
ggtcaagacggtccttccgg

SEQ ID NO: 415095 - DNA, 20 bp, mouse
ggaaaaaaggagttcttggg

SEQ ID NO: 415096 - DNA, 20 bp, mouse
gggcttgccagaaagatata

SEQ ID NO: 415097 - DNA, 20 bp, mouse
gtagtggtctgggagatgcc

SEQ ID NO: 415098 - DNA, 20 bp, mouse
gaaacagaggcctagtggaa

SEQ ID NO: 415099 - DNA, 20 bp, mouse
gacaggaaacagaggcctag

SEQ ID NO: 415100 - DNA, 20 bp, mouse
gtcaaataaacaggaaacag

SEQ ID NO: 415101 - DNA, 20 bp, mouse
gcctagtggaacggctcaat

SEQ ID NO: 415102 - DNA, 20 bp, mouse
gaaagggtggcagcagatca

SEQ ID NO: 415103 - DNA, 20 bp, mouse
gctctcctaacatagtggtc

SEQ ID NO: 415104 - DNA, 20 bp, mouse
gacttcagggttgtgcttgt

SEQ ID NO: 415105 - DNA, 20 bp, mouse
gccagctttagtctacagaa

SEQ ID NO: 415106 - DNA, 20 bp, mouse
gcctgacgggaggaacctag

SEQ ID NO: 415107 - DNA, 20 bp, mouse
ggccggagtgccctgacggg

SEQ ID NO: 415108 - DNA, 20 bp, mouse
gcactccggggtcgggacaa

SEQ ID NO: 415109 - DNA, 20 bp, mouse
gagggccggagtgccctgac

SEQ ID NO: 415110 - DNA, 20 bp, mouse
ggaccccggagtgcaagcat

SEQ ID NO: 415111 - DNA, 20 bp, mouse
gggacaaaggcatcacctct

SEQ ID NO: 415112 - DNA, 20 bp, mouse
gcgggctcgggaaaccggag

SEQ ID NO: 415113 - DNA, 20 bp, mouse
gctcggtgcactggagtgtc

SEQ ID NO: 415114 - DNA, 20 bp, mouse
gggttcgccggagcgtctgg

SEQ ID NO: 415115 - DNA, 20 bp, mouse
gcaccgatgcttgcactccg

SEQ ID NO: 415116 - DNA, 20 bp, mouse
ggaggatcgctgggtcatgg

SEQ ID NO: 415117 - DNA, 20 bp, mouse
gggtcagtggagcaaaagaa

SEQ ID NO: 415118 - DNA, 20 bp, mouse
gcaggcaagctagactccga

SEQ ID NO: 415119 - DNA, 20 bp, mouse
gcggtgaccatcaagtctgg

SEQ ID NO: 415120 - DNA, 20 bp, mouse
gagtcgttgtcaaaggtcag

SEQ ID NO: 415121 - DNA, 20 bp, mouse
gaccgaggatcgctgggtca

SEQ ID NO: 415122 - DNA, 20 bp, mouse
gtggtggaagtcgttgtcaa

SEQ ID NO: 415123 - DNA, 20 bp, mouse
gagagcgggaagagtttcgg

SEQ ID NO: 415124 - DNA, 20 bp, mouse
gatggtcaccgaggatcgct

SEQ ID NO: 415125 - DNA, 20 bp, mouse
gggaaggaggctagccgagg

SEQ ID NO: 415126 - DNA, 20 bp, mouse
gggacttacctggaccaacc

SEQ ID NO: 415127 - DNA, 20 bp, mouse
gtgccccatagggatcggtt

SEQ ID NO: 415128 - DNA, 20 bp, mouse
gcagctctcctggttggtcc

SEQ ID NO: 415129 - DNA, 20 bp, mouse
gaaagccgaaggtacgcgag

SEQ ID NO: 415130 - DNA, 20 bp, mouse
gattctggaaaggacttacc

SEQ ID NO: 415131 - DNA, 20 bp, mouse
gcatgacagcaggaaatgaa

SEQ ID NO: 415132 - DNA, 20 bp, mouse
ggcaaggaaggtagaatcaa

SEQ ID NO: 415133 - DNA, 20 bp, mouse
gcggttcgactaaaagccga

SEQ ID NO: 415134 - DNA, 20 bp, mouse
ggagtgagggagcttagtca

SEQ ID NO: 415135 - DNA, 20 bp, mouse
gcgtgcaggacaagcaagga

SEQ ID NO: 415136 - DNA, 20 bp, mouse
gagggacagaacaagagcgg

SEQ ID NO: 415137 - DNA, 20 bp, mouse
gctaggagcccgagaagact

SEQ ID NO: 415138 - DNA, 20 bp, mouse
gcttctcgggctcctagagg

SEQ ID NO: 415139 - DNA, 20 bp, mouse
ggaacaagagcggagggact

SEQ ID NO: 415140 - DNA, 20 bp, mouse
gagcgggttaaacccaggac

SEQ ID NO: 415141 - DNA, 20 bp, mouse
gcagcagcagggccaccccg

SEQ ID NO: 415142 - DNA, 20 bp, mouse
gggagactagcgacagacag

SEQ ID NO: 415143 - DNA, 20 bp, mouse
gggctcatggcgggagactg

SEQ ID NO: 415144 - DNA, 20 bp, mouse
gcagacagcgggttaaaccc

SEQ ID NO: 415145 - DNA, 20 bp, mouse
gacccccgcacaggagccca

SEQ ID NO: 415146 - DNA, 20 bp, mouse
gcacaaatgtcttcatgcaa

SEQ ID NO: 415147 - DNA, 20 bp, mouse
ggggtgaccctccaggccca

SEQ ID NO: 415148 - DNA, 20 bp, mouse
gattagacccacagattcaa

SEQ ID NO: 415149 - DNA, 20 bp, mouse
gcctaatgttgggatgacgg

SEQ ID NO: 415150 - DNA, 20 bp, mouse
gcctgatgcccagttggact

SEQ ID NO: 415151 - DNA, 20 bp, mouse
ggcgagactctgacccagac

SEQ ID NO: 415152 - DNA, 20 bp, mouse
gtgcccagttggactgggat

SEQ ID NO: 415153 - DNA, 20 bp, mouse
gccactggcacagggtagtg

SEQ ID NO: 415154 - DNA, 20 bp, mouse
gtagatgcagggccagacgc

SEQ ID NO: 415155 - DNA, 20 bp, mouse
gaataacacagggtggccac

SEQ ID NO: 415156 - DNA, 20 bp, mouse
gtggagcctcccgcaccgag

SEQ ID NO: 415157 - DNA, 20 bp, mouse
gggagaccgccccttcctct

SEQ ID NO: 415158 - DNA, 20 bp, mouse
gcacaaagcgaggcagcagt

SEQ ID NO: 415159 - DNA, 20 bp, mouse
gtacattacggaaggaaccg

SEQ ID NO: 415160 - DNA, 20 bp, mouse
gccgccccttcctctcggtg

SEQ ID NO: 415161 - DNA, 20 bp, mouse
ggcctcccgcaccgagagga

SEQ ID NO: 415162 - DNA, 20 bp, mouse
gaacttgcaacactcaccgg

SEQ ID NO: 415163 - DNA, 20 bp, mouse
gctcggtagttaatacatta

SEQ ID NO: 415164 - DNA, 20 bp, mouse
ggggcagcatcggcgacgcg

SEQ ID NO: 415165 - DNA, 20 bp, mouse
gcgatgctgccccagaggac

SEQ ID NO: 415166 - DNA, 20 bp, mouse
gttaactacagaccaaaaca

SEQ ID NO: 415167 - DNA, 20 bp, mouse
ggtcaacttagataatctca

SEQ ID NO: 415168 - DNA, 20 bp, mouse
gagcaggaggcaaatggcaa

SEQ ID NO: 415169 - DNA, 20 bp, mouse
gtgcccagcgtgccctgttt

SEQ ID NO: 415170 - DNA, 20 bp, mouse
gtgctgtggaatgaaatagg

SEQ ID NO: 415171 - DNA, 20 bp, mouse
ggatctcctgccaggtgtac

SEQ ID NO: 415172 - DNA, 20 bp, mouse
ggatccaggaataatgaagt

SEQ ID NO: 415173 - DNA, 20 bp, mouse
gtggctcaggctctgtactc

SEQ ID NO: 415174 - DNA, 20 bp, mouse
gagaccaaaacagggcacgc

SEQ ID NO: 415175 - DNA, 20 bp, mouse
gcgggaaaccgatagctaat

SEQ ID NO: 415176 - DNA, 20 bp, mouse
gagaggcggaggatgcgact

SEQ ID NO: 415177 - DNA, 20 bp, mouse
gctggcagccgccgaggcag

SEQ ID NO: 415178 - DNA, 20 bp, mouse
ggcgagtagaggagcaccgg

SEQ ID NO: 415179 - DNA, 20 bp, mouse
gccgaggtggcgcgaggcgg

SEQ ID NO: 415180 - DNA, 20 bp, mouse
ggcatcctccgcctctgcct

SEQ ID NO: 415181 - DNA, 20 bp, mouse
gcccgccgccgcgcccccgg

SEQ ID NO: 415182 - DNA, 20 bp, mouse
gtgagcgccacgggcagcag

SEQ ID NO: 415183 - DNA, 20 bp, mouse
gcgccgaggcacagccaccg

SEQ ID NO: 415184 - DNA, 20 bp, mouse
gccccctccgggctccgccg

SEQ ID NO: 415185 - DNA, 20 bp, mouse
gacagccaccgggggcgcgg

SEQ ID NO: 415186 - DNA, 20 bp, mouse
ggtgaacaccagtaatccag

SEQ ID NO: 415187 - DNA, 20 bp, mouse
gggcccagaggctgtcctag

SEQ ID NO: 415188 - DNA, 20 bp, mouse
gagcagtcagaggctaccgg

SEQ ID NO: 415189 - DNA, 20 bp, mouse
ggacccgaggcagcagtcag

SEQ ID NO: 415190 - DNA, 20 bp, mouse
gccaggggagcagatttcct

SEQ ID NO: 415191 - DNA, 20 bp, mouse
gccatggaaacggggcccag

SEQ ID NO: 415192 - DNA, 20 bp, mouse
gggctgtcctagcggcagga

SEQ ID NO: 415193 - DNA, 20 bp, mouse
ggggcgggacgccagagcta

SEQ ID NO: 415194 - DNA, 20 bp, mouse
ggtcagcacgagctgagatt

SEQ ID NO: 415195 - DNA, 20 bp, mouse
gcagaggctgtcctagcggc

SEQ ID NO: 415196 - DNA, 20 bp, mouse
gcgcgacgaacgctccccta

SEQ ID NO: 415197 - DNA, 20 bp, mouse
gcggcgactgtcctccgtag

SEQ ID NO: 415198 - DNA, 20 bp, mouse
ggacgaacgctcccctacgg

SEQ ID NO: 415199 - DNA, 20 bp, mouse
ggttcgtcgcgctctcacga

SEQ ID NO: 415200 - DNA, 20 bp, mouse
gacctgcgacagtctcgggg

SEQ ID NO: 415201 - DNA, 20 bp, mouse
gtgtccctcgagccccgcta

SEQ ID NO: 415202 - DNA, 20 bp, mouse
gccgcggcgccccggaactc

SEQ ID NO: 415203 - DNA, 20 bp, mouse
gcctcctgcgagagagtcgt

SEQ ID NO: 415204 - DNA, 20 bp, mouse
gacggaggacagtcgccggc

SEQ ID NO: 415205 - DNA, 20 bp, mouse
gcagtctcggggtggtttgg

SEQ ID NO: 415206 - DNA, 20 bp, mouse
gtggcctgtgaagggctcaa

SEQ ID NO: 415207 - DNA, 20 bp, mouse
gagaggtttcaggtatctgt

SEQ ID NO: 415208 - DNA, 20 bp, mouse
ggttacagaagcttcttgag

SEQ ID NO: 415209 - DNA, 20 bp, mouse
gctttgaccctgaagtcagg

SEQ ID NO: 415210 - DNA, 20 bp, mouse
gaaagtaagtggcctgtgaa

SEQ ID NO: 415211 - DNA, 20 bp, mouse
gtagggctcccagtcatcaa

SEQ ID NO: 415212 - DNA, 20 bp, mouse
gacttcagggtcaaagtaag

SEQ ID NO: 415213 - DNA, 20 bp, mouse
ggcaccaaggccatcctcac

SEQ ID NO: 415214 - DNA, 20 bp, mouse
ggtcgacaaagacaatacac

SEQ ID NO: 415215 - DNA, 20 bp, mouse
ggccgcactcaatcatgaag

SEQ ID NO: 415216 - DNA, 20 bp, mouse
ggcagttgggagcatggcgg

SEQ ID NO: 415217 - DNA, 20 bp, mouse
ggaactccaagcgagcagtt

SEQ ID NO: 415218 - DNA, 20 bp, mouse
gtgctcaatagccccctcga

SEQ ID NO: 415219 - DNA, 20 bp, mouse
ggccctgtggtctatggagt

SEQ ID NO: 415220 - DNA, 20 bp, mouse
gaagaatggacgaagacacg

SEQ ID NO: 415221 - DNA, 20 bp, mouse
ggattctccagaccctcgag

SEQ ID NO: 415222 - DNA, 20 bp, mouse
gcgacgaggctgtggagaac

SEQ ID NO: 415223 - DNA, 20 bp, mouse
ggcgggcaggtcacctggaa

SEQ ID NO: 415224 - DNA, 20 bp, mouse
gtaataagaggcataggacc

SEQ ID NO: 415225 - DNA, 20 bp, mouse
gctgaagcgcgtgcaagtag

SEQ ID NO: 415226 - DNA, 20 bp, mouse
gcgcggggcgtggaatttcg

SEQ ID NO: 415227 - DNA, 20 bp, mouse
gtcttgtctcgggatctggt

SEQ ID NO: 415228 - DNA, 20 bp, mouse
ggggaccggagtcctccgaa

SEQ ID NO: 415229 - DNA, 20 bp, mouse
ggcgggggaagaaggccaga

SEQ ID NO: 415230 - DNA, 20 bp, mouse
gctggtgggtctcctctccg

SEQ ID NO: 415231 - DNA, 20 bp, mouse
gcggagtcctccgaagggac

SEQ ID NO: 415232 - DNA, 20 bp, mouse
ggggagcgtgcgggcaggtg

SEQ ID NO: 415233 - DNA, 20 bp, mouse
gctagaagccgtgcagccag

SEQ ID NO: 415234 - DNA, 20 bp, mouse
ggagaagcccgtcccttcgg

SEQ ID NO: 415235 - DNA, 20 bp, mouse
gaattccacgccccgcggag

SEQ ID NO: 415236 - DNA, 20 bp, mouse
gatcaggcatgctggaccga

SEQ ID NO: 415237 - DNA, 20 bp, mouse
ggggactgacatgcaagggg

SEQ ID NO: 415238 - DNA, 20 bp, mouse
gcacagggactgacatgcaa

SEQ ID NO: 415239 - DNA, 20 bp, mouse
gatagcaagggaccacacac

SEQ ID NO: 415240 - DNA, 20 bp, mouse
ggatgagcttctgttgtaat

SEQ ID NO: 415241 - DNA, 20 bp, mouse
gcaagggaccacacaccggg

SEQ ID NO: 415242 - DNA, 20 bp, mouse
gcgaattcaggagtaagcat

SEQ ID NO: 415243 - DNA, 20 bp, mouse
gcctcgggctgccatagcaa

SEQ ID NO: 415244 - DNA, 20 bp, mouse
gcaaaggaagcaggccttat

SEQ ID NO: 415245 - DNA, 20 bp, mouse
gcttctactcagaatctcaa

SEQ ID NO: 415246 - DNA, 20 bp, mouse
ggcttgaggttgacaggtac

SEQ ID NO: 415247 - DNA, 20 bp, mouse
gtcggattctggagaaggtt

SEQ ID NO: 415248 - DNA, 20 bp, mouse
gtttactgcttgaggttgac

SEQ ID NO: 415249 - DNA, 20 bp, mouse
gaacagcaatgaaaatgagt

SEQ ID NO: 415250 - DNA, 20 bp, mouse
gtggactcggattctggaga

SEQ ID NO: 415251 - DNA, 20 bp, mouse
gcggttttggactcggattc

SEQ ID NO: 415252 - DNA, 20 bp, mouse
ggtttgggagacgtggactg

SEQ ID NO: 415253 - DNA, 20 bp, mouse
ggcccgaggctggtttggtg

SEQ ID NO: 415254 - DNA, 20 bp, mouse
gtttggtgtggagagtggtt

SEQ ID NO: 415255 - DNA, 20 bp, mouse
ggtactgcccgaggctggtt

SEQ ID NO: 415256 - DNA, 20 bp, mouse
gttgtgacatgggaacccaa

SEQ ID NO: 415257 - DNA, 20 bp, mouse
gagtttctcaagaataagaa

SEQ ID NO: 415258 - DNA, 20 bp, mouse
gctgaaacatgtataaaact

SEQ ID NO: 415259 - DNA, 20 bp, mouse
gggatttgataacaatcata

SEQ ID NO: 415260 - DNA, 20 bp, mouse
gataacaatcatagggaaag

SEQ ID NO: 415261 - DNA, 20 bp, mouse
ggacttagatcatgtggtgg

SEQ ID NO: 415262 - DNA, 20 bp, mouse
gatgaaagacttagatcatg

SEQ ID NO: 415263 - DNA, 20 bp, mouse
gacatactgtgttgtgacat

SEQ ID NO: 415264 - DNA, 20 bp, mouse
gtaattcacttcacatatga

SEQ ID NO: 415265 - DNA, 20 bp, mouse
gctagcaatttgctgaactt

SEQ ID NO: 415266 - DNA, 20 bp, mouse
ggcactggcagttggaagca

SEQ ID NO: 415267 - DNA, 20 bp, mouse
gtggcagaggtcaagccaag

SEQ ID NO: 415268 - DNA, 20 bp, mouse
ggaggacagttgaggggaca

SEQ ID NO: 415269 - DNA, 20 bp, mouse
gtctggagaggacagttgag

SEQ ID NO: 415270 - DNA, 20 bp, mouse
ggacctcagacctcaaagac

SEQ ID NO: 415271 - DNA, 20 bp, mouse
ggttaaggtgccctgggagt

SEQ ID NO: 415272 - DNA, 20 bp, mouse
ggtacatttacctgtctttg

SEQ ID NO: 415273 - DNA, 20 bp, mouse
gaagaaagttaaggtgccct

SEQ ID NO: 415274 - DNA, 20 bp, mouse
ggggacagggcactggcagt

SEQ ID NO: 415275 - DNA, 20 bp, mouse
gatgttccaaccccactccc

SEQ ID NO: 415276 - DNA, 20 bp, mouse
ggacgtaaaatgccctgtgt

SEQ ID NO: 415277 - DNA, 20 bp, mouse
ggacctgttccacctacaca

SEQ ID NO: 415278 - DNA, 20 bp, mouse
gtatgaatgatggcctagaa

SEQ ID NO: 415279 - DNA, 20 bp, mouse
gtgccctgtgtaggtggaac

SEQ ID NO: 415280 - DNA, 20 bp, mouse
ggtaaaatgccctgtgtagg

SEQ ID NO: 415281 - DNA, 20 bp, mouse
gagagatctccagctactgt

SEQ ID NO: 415282 - DNA, 20 bp, mouse
gagctactgtgggaaactaa

SEQ ID NO: 415283 - DNA, 20 bp, mouse
gactaaaggcaacactacct

SEQ ID NO: 415284 - DNA, 20 bp, mouse
gccgtggcaacaacccagaa

SEQ ID NO: 415285 - DNA, 20 bp, mouse
gtgaatactgaagctgtgtg

SEQ ID NO: 415286 - DNA, 20 bp, mouse
gatgtggaggaaagcagtcg

SEQ ID NO: 415287 - DNA, 20 bp, mouse
gacaatagagaacaatgtgg

SEQ ID NO: 415288 - DNA, 20 bp, mouse
gaagcagtcggggtggagca

SEQ ID NO: 415289 - DNA, 20 bp, mouse
gaaaacaatagagaacaatg

SEQ ID NO: 415290 - DNA, 20 bp, mouse
gactttgaggggcattcgag

SEQ ID NO: 415291 - DNA, 20 bp, mouse
ggaccaaatgcgagagaagg

SEQ ID NO: 415292 - DNA, 20 bp, mouse
gttgggagggtacctttgaa

SEQ ID NO: 415293 - DNA, 20 bp, mouse
gtcgaggggcatatcactca

SEQ ID NO: 415294 - DNA, 20 bp, mouse
gggtatgacctaactggaag

SEQ ID NO: 415295 - DNA, 20 bp, mouse
ggagaagtagatggataaga

SEQ ID NO: 415296 - DNA, 20 bp, mouse
ggccatgggtcgcactgctg

SEQ ID NO: 415297 - DNA, 20 bp, mouse
gcagaccatccaggaggcgg

SEQ ID NO: 415298 - DNA, 20 bp, mouse
gctcctggatggtctgccat

SEQ ID NO: 415299 - DNA, 20 bp, mouse
ggtcgcactgctgtggcaga

SEQ ID NO: 415300 - DNA, 20 bp, mouse
ggtcccacactaaagaatct

SEQ ID NO: 415301 - DNA, 20 bp, mouse
ggtgacccgtcaggacccaa

SEQ ID NO: 415302 - DNA, 20 bp, mouse
gacggctggacttgagcaga

SEQ ID NO: 415303 - DNA, 20 bp, mouse
gcactgctgtggcagacggc

SEQ ID NO: 415304 - DNA, 20 bp, mouse
gagataaatgcaggcaagaa

SEQ ID NO: 415305 - DNA, 20 bp, mouse
gtctttagtgtgggacacgt

SEQ ID NO: 415306 - DNA, 20 bp, mouse
gcaatagtctctgaagtccc

SEQ ID NO: 415307 - DNA, 20 bp, mouse
gtgggcctggggcctaccag

SEQ ID NO: 415308 - DNA, 20 bp, mouse
gaggctgagtgtcattcccc

SEQ ID NO: 415309 - DNA, 20 bp, mouse
ggagctgaggagctaaggca

SEQ ID NO: 415310 - DNA, 20 bp, mouse
gcttcagagactattgacaa

SEQ ID NO: 415311 - DNA, 20 bp, mouse
gtgagtgtcattcccctggt

SEQ ID NO: 415312 - DNA, 20 bp, mouse
gcttcaagcagcctcagaag

SEQ ID NO: 415313 - DNA, 20 bp, mouse
gtgaactgtgggaatccaag

SEQ ID NO: 415314 - DNA, 20 bp, mouse
ggtcatgcctaagtatctgt

SEQ ID NO: 415315 - DNA, 20 bp, mouse
ggcactatcatacttcagtt

SEQ ID NO: 415316 - DNA, 20 bp, mouse
gagctccactaccaacgtct

SEQ ID NO: 415317 - DNA, 20 bp, mouse
ggaaaagtcctcccagacgt

SEQ ID NO: 415318 - DNA, 20 bp, mouse
gtcctcccagacgttggtag

SEQ ID NO: 415319 - DNA, 20 bp, mouse
gtgcggggagaggaccggaa

SEQ ID NO: 415320 - DNA, 20 bp, mouse
gtccactaccaacgtctggg

SEQ ID NO: 415321 - DNA, 20 bp, mouse
ggttcttgcggggagaggac

SEQ ID NO: 415322 - DNA, 20 bp, mouse
gacaccccgcgaccccacag

SEQ ID NO: 415323 - DNA, 20 bp, mouse
gcttgttctgaagtacggag

SEQ ID NO: 415324 - DNA, 20 bp, mouse
gagaggaccggaaagggagc

SEQ ID NO: 415325 - DNA, 20 bp, mouse
gaccacggctgtgacttcta

SEQ ID NO: 415326 - DNA, 20 bp, mouse
ggcgctgtgtggagcagcgg

SEQ ID NO: 415327 - DNA, 20 bp, mouse
ggccggcccgggaccagaag

SEQ ID NO: 415328 - DNA, 20 bp, mouse
gggagtgaggacgcgctgtg

SEQ ID NO: 415329 - DNA, 20 bp, mouse
gcgcctccacggctgggtcg

SEQ ID NO: 415330 - DNA, 20 bp, mouse
ggccaaccgccgccgagcaa

SEQ ID NO: 415331 - DNA, 20 bp, mouse
gccgagtgcgaccaacaggt

SEQ ID NO: 415332 - DNA, 20 bp, mouse
gacgcgcacgcgcgcctcca

SEQ ID NO: 415333 - DNA, 20 bp, mouse
gtccacggctgggtcgcggc

SEQ ID NO: 415334 - DNA, 20 bp, mouse
gcttccaccgctgctcagga

SEQ ID NO: 415335 - DNA, 20 bp, mouse
gtcgctccccgccacctggg

SEQ ID NO: 415336 - DNA, 20 bp, mouse
gctgtcgcactggtaggaga

SEQ ID NO: 415337 - DNA, 20 bp, mouse
gtctggaggccaggtgacaa

SEQ ID NO: 415338 - DNA, 20 bp, mouse
gaggagatggtgtcatcagc

SEQ ID NO: 415339 - DNA, 20 bp, mouse
gctatttgtattcttactaa

SEQ ID NO: 415340 - DNA, 20 bp, mouse
ggaagttgtgtctgtcgcac

SEQ ID NO: 415341 - DNA, 20 bp, mouse
gggcttccagggattctagt

SEQ ID NO: 415342 - DNA, 20 bp, mouse
gaagtaactgaacagttagt

SEQ ID NO: 415343 - DNA, 20 bp, mouse
gaggtccaagcataaacaga

SEQ ID NO: 415344 - DNA, 20 bp, mouse
gatgaagtgataagttctgg

SEQ ID NO: 415345 - DNA, 20 bp, mouse
ggaatccctggaagcctaat

SEQ ID NO: 415346 - DNA, 20 bp, mouse
ggtaactgttgtgataccag

SEQ ID NO: 415347 - DNA, 20 bp, mouse
gtacagagcgatagtagtgt

SEQ ID NO: 415348 - DNA, 20 bp, mouse
ggttatagacgtgtactctg

SEQ ID NO: 415349 - DNA, 20 bp, mouse
gaggaaatctcaaagtatac

SEQ ID NO: 415350 - DNA, 20 bp, mouse
ggcttttgcttcaaatagac

SEQ ID NO: 415351 - DNA, 20 bp, mouse
ggctagcaatatcatacctc

SEQ ID NO: 415352 - DNA, 20 bp, mouse
gtgttggaatctgagtataa

SEQ ID NO: 415353 - DNA, 20 bp, mouse
gttgaagcaaaagcactaaa

SEQ ID NO: 415354 - DNA, 20 bp, mouse
gtgtgtagcgctgcctatcc

SEQ ID NO: 415355 - DNA, 20 bp, mouse
gtgaagcacaatcttgaggg

SEQ ID NO: 415356 - DNA, 20 bp, mouse
gtaacggcccccccttccag

SEQ ID NO: 415357 - DNA, 20 bp, mouse
ggcacacagaacccctggaa

SEQ ID NO: 415358 - DNA, 20 bp, mouse
gtctgagcaggcaactgcac

SEQ ID NO: 415359 - DNA, 20 bp, mouse
ggagaggcacacagaacccc

SEQ ID NO: 415360 - DNA, 20 bp, mouse
gtcattgtgtaccttcatgg

SEQ ID NO: 415361 - DNA, 20 bp, mouse
gggccgttaggccaccatga

SEQ ID NO: 415362 - DNA, 20 bp, mouse
gccacccaggccccagcagt

SEQ ID NO: 415363 - DNA, 20 bp, mouse
gccagggtgagcctcacact

SEQ ID NO: 415364 - DNA, 20 bp, mouse
ggcacaggtcacccctcaga

SEQ ID NO: 415365 - DNA, 20 bp, mouse
ggcttcattgtgtaccttca

SEQ ID NO: 415366 - DNA, 20 bp, mouse
ggaacagagcaatgtaagtc

SEQ ID NO: 415367 - DNA, 20 bp, mouse
ggcatttacttagcgttctt

SEQ ID NO: 415368 - DNA, 20 bp, mouse
gtaggagagttaaaagattt

SEQ ID NO: 415369 - DNA, 20 bp, mouse
ggcctggtttctgtgactat

SEQ ID NO: 415370 - DNA, 20 bp, mouse
gtcctatagtcacagaaacc

SEQ ID NO: 415371 - DNA, 20 bp, mouse
gttggtggtagcaatctaat

SEQ ID NO: 415372 - DNA, 20 bp, mouse
gacctaccggatgacccata

SEQ ID NO: 415373 - DNA, 20 bp, mouse
gtccttatgggtcatccggt

SEQ ID NO: 415374 - DNA, 20 bp, mouse
ggcattgagtggatacctac

SEQ ID NO: 415375 - DNA, 20 bp, mouse
gtctaagtcacttgtaagcc

SEQ ID NO: 415376 - DNA, 20 bp, mouse
gctagcaagacctaaaacca

SEQ ID NO: 415377 - DNA, 20 bp, mouse
gctgtgtagcggtctctgac

SEQ ID NO: 415378 - DNA, 20 bp, mouse
gactggctagagagcgactc

SEQ ID NO: 415379 - DNA, 20 bp, mouse
ggccgcaggaagtagatctg

SEQ ID NO: 415380 - DNA, 20 bp, mouse
ggcaagacctaaaaccatgg

SEQ ID NO: 415381 - DNA, 20 bp, mouse
gaccatggtggaaagacacg

SEQ ID NO: 415382 - DNA, 20 bp, mouse
gcagacccgggaccccgtaa

SEQ ID NO: 415383 - DNA, 20 bp, mouse
ggcagagcaactatctacac

SEQ ID NO: 415384 - DNA, 20 bp, mouse
gcaggaagtagatctgtggt

SEQ ID NO: 415385 - DNA, 20 bp, mouse
ggatctgtggttggacgtgg

SEQ ID NO: 415386 - DNA, 20 bp, mouse
gctttcagcggatataactg

SEQ ID NO: 415387 - DNA, 20 bp, mouse
ggatataactggggcaggac

SEQ ID NO: 415388 - DNA, 20 bp, mouse
ggtacccgaggccttcctgt

SEQ ID NO: 415389 - DNA, 20 bp, mouse
gttagctgctgagaccagta

SEQ ID NO: 415390 - DNA, 20 bp, mouse
gcagcggatataactggggc

SEQ ID NO: 415391 - DNA, 20 bp, mouse
gagaccagtacggagacagg

SEQ ID NO: 415392 - DNA, 20 bp, mouse
gtttaccatgctcctttcag

SEQ ID NO: 415393 - DNA, 20 bp, mouse
gtaatggtagtattgtggtc

SEQ ID NO: 415394 - DNA, 20 bp, mouse
ggctggactacaagacccac

SEQ ID NO: 415395 - DNA, 20 bp, mouse
gagcactgacagggtacccg

SEQ ID NO: 415396 - DNA, 20 bp, mouse
gtggcggccgtaagggacgt

SEQ ID NO: 415397 - DNA, 20 bp, mouse
gcaggatgtggcggccgtaa

SEQ ID NO: 415398 - DNA, 20 bp, mouse
gacggctctgcaggatgtgg

SEQ ID NO: 415399 - DNA, 20 bp, mouse
ggccgcgcccacgtccctta

SEQ ID NO: 415400 - DNA, 20 bp, mouse
gacatcctgcagagccgtga

SEQ ID NO: 415401 - DNA, 20 bp, mouse
gcaacctggaaacaacaaca

SEQ ID NO: 415402 - DNA, 20 bp, mouse
ggcgctctcccggaaagtcc

SEQ ID NO: 415403 - DNA, 20 bp, mouse
gtggagtcccgacagaggag

SEQ ID NO: 415404 - DNA, 20 bp, mouse
gagacttggagtcccgacag

SEQ ID NO: 415405 - DNA, 20 bp, mouse
gataaagattggaaccttca

SEQ ID NO: 415406 - DNA, 20 bp, mouse
gatcaggttaaggcttcctg

SEQ ID NO: 415407 - DNA, 20 bp, mouse
ggtattcctggatcaggtta

SEQ ID NO: 415408 - DNA, 20 bp, mouse
gagaatggggctgtgactca

SEQ ID NO: 415409 - DNA, 20 bp, mouse
gaaccccggaggacacagag

SEQ ID NO: 415410 - DNA, 20 bp, mouse
gggaagccttaacctgatcc

SEQ ID NO: 415411 - DNA, 20 bp, mouse
gtgaccatagaatcagaatg

SEQ ID NO: 415412 - DNA, 20 bp, mouse
gtgagtatgcccaaccccaa

SEQ ID NO: 415413 - DNA, 20 bp, mouse
gaaggcagtattcctggatc

SEQ ID NO: 415414 - DNA, 20 bp, mouse
gtgactcaaggcagtattcc

SEQ ID NO: 415415 - DNA, 20 bp, mouse
ggctcattcctgagatgaga

SEQ ID NO: 415416 - DNA, 20 bp, mouse
ggctggcgtctgtaccctgt

SEQ ID NO: 415417 - DNA, 20 bp, mouse
gccccctgcaccagtgcgga

SEQ ID NO: 415418 - DNA, 20 bp, mouse
gcacggtgccatccattcag

SEQ ID NO: 415419 - DNA, 20 bp, mouse
gggtacagacgccagccgct

SEQ ID NO: 415420 - DNA, 20 bp, mouse
gaaagttaactgtaattctt

SEQ ID NO: 415421 - DNA, 20 bp, mouse
ggggcggatggcagaagagt

SEQ ID NO: 415422 - DNA, 20 bp, mouse
ggcagagtgtgccaagcggc

SEQ ID NO: 415423 - DNA, 20 bp, mouse
gggcgttgcccctgaatgga

SEQ ID NO: 415424 - DNA, 20 bp, mouse
ggtatgcgggccagacagtg

SEQ ID NO: 415425 - DNA, 20 bp, mouse
gccaaggaagggctcatagt

SEQ ID NO: 415426 - DNA, 20 bp, mouse
gtagcaccactccagcgtga

SEQ ID NO: 415427 - DNA, 20 bp, mouse
gctagagcaagattgataga

SEQ ID NO: 415428 - DNA, 20 bp, mouse
gggtagtctgggtgaagtgt

SEQ ID NO: 415429 - DNA, 20 bp, mouse
ggtgctaccgttagaggaca

SEQ ID NO: 415430 - DNA, 20 bp, mouse
ggggccacaagacatctcac

SEQ ID NO: 415431 - DNA, 20 bp, mouse
gtcaaagctctagactcgga

SEQ ID NO: 415432 - DNA, 20 bp, mouse
gtcatgcagaaccatcacgc

SEQ ID NO: 415433 - DNA, 20 bp, mouse
gtcggagggctgagtttctt

SEQ ID NO: 415434 - DNA, 20 bp, mouse
gtggagcgtgctaccgttag

SEQ ID NO: 415435 - DNA, 20 bp, mouse
ggtgtcggtctgcatagaaa

SEQ ID NO: 415436 - DNA, 20 bp, mouse
gactctgggccagccgggaa

SEQ ID NO: 415437 - DNA, 20 bp, mouse
gctggcccagagtctacaga

SEQ ID NO: 415438 - DNA, 20 bp, mouse
gagctccccataggaccgtg

SEQ ID NO: 415439 - DNA, 20 bp, mouse
gggttccccgagctccccat

SEQ ID NO: 415440 - DNA, 20 bp, mouse
ggtctgcagtggccccctga

SEQ ID NO: 415441 - DNA, 20 bp, mouse
ggccgggaagggagcatggc

SEQ ID NO: 415442 - DNA, 20 bp, mouse
gcgccggcgggaccgcccag

SEQ ID NO: 415443 - DNA, 20 bp, mouse
gatcgagaccgaggtgccct

SEQ ID NO: 415444 - DNA, 20 bp, mouse
ggtcgaccttctgtagactc

SEQ ID NO: 415445 - DNA, 20 bp, mouse
ggcccagtgggcgaacactt

SEQ ID NO: 415446 - DNA, 20 bp, mouse
gccatgtggcagtcagccag

SEQ ID NO: 415447 - DNA, 20 bp, mouse
gactgtgtggagcggagcat

SEQ ID NO: 415448 - DNA, 20 bp, mouse
gagttgagtagcccagagag

SEQ ID NO: 415449 - DNA, 20 bp, mouse
gagcggagcatgggtttgag

SEQ ID NO: 415450 - DNA, 20 bp, mouse
gacctcctccagggtttctt

SEQ ID NO: 415451 - DNA, 20 bp, mouse
ggacagtcggacactccctg

SEQ ID NO: 415452 - DNA, 20 bp, mouse
gggagcatgggtttgagtgg

SEQ ID NO: 415453 - DNA, 20 bp, mouse
ggcttcaactgctctatcaa

SEQ ID NO: 415454 - DNA, 20 bp, mouse
ggctgcccaagaaaccctgg

SEQ ID NO: 415455 - DNA, 20 bp, mouse
gcaccgtctccagaatccac

SEQ ID NO: 415456 - DNA, 20 bp, mouse
ggggtcgaacgagtccatgg

SEQ ID NO: 415457 - DNA, 20 bp, mouse
gaggctggcggcgtaggacc

SEQ ID NO: 415458 - DNA, 20 bp, mouse
gcggccccagcgaccctccg

SEQ ID NO: 415459 - DNA, 20 bp, mouse
gtgggggtcgaacgagtcca

SEQ ID NO: 415460 - DNA, 20 bp, mouse
gccatggaggctggcggcgt

SEQ ID NO: 415461 - DNA, 20 bp, mouse
gggcagggcgtggtctgata

SEQ ID NO: 415462 - DNA, 20 bp, mouse
gaggacctgggggccgcgga

SEQ ID NO: 415463 - DNA, 20 bp, mouse
gcgaacgagtccatggaggc

SEQ ID NO: 415464 - DNA, 20 bp, mouse
gctcgacgcggcatacctga

SEQ ID NO: 415465 - DNA, 20 bp, mouse
ggagcgagggtgcgccaagg

SEQ ID NO: 415466 - DNA, 20 bp, mouse
gacagcggccgtggctccac

SEQ ID NO: 415467 - DNA, 20 bp, mouse
ggagacagagaccgcggcaa

SEQ ID NO: 415468 - DNA, 20 bp, mouse
gtccacaggcagaaatacta

SEQ ID NO: 415469 - DNA, 20 bp, mouse
gaaggcagagacagcggccg

SEQ ID NO: 415470 - DNA, 20 bp, mouse
gtccagggagccaggcccgt

SEQ ID NO: 415471 - DNA, 20 bp, mouse
gctatggtaaggaacgatca

SEQ ID NO: 415472 - DNA, 20 bp, mouse
gcaacaccgacactatggta

SEQ ID NO: 415473 - DNA, 20 bp, mouse
ggctgtctctgcctttgccg

SEQ ID NO: 415474 - DNA, 20 bp, mouse
ggagatgaccccacacagtg

SEQ ID NO: 415475 - DNA, 20 bp, mouse
gcacttaagacagcatctca

SEQ ID NO: 415476 - DNA, 20 bp, mouse
ggactgaggcagccccgaca

SEQ ID NO: 415477 - DNA, 20 bp, mouse
gtgtgggtggccattacctc

SEQ ID NO: 415478 - DNA, 20 bp, mouse
ggccgtaaaaagcgggactg

SEQ ID NO: 415479 - DNA, 20 bp, mouse
gacagtgcaacaccctgtcg

SEQ ID NO: 415480 - DNA, 20 bp, mouse
ggaaggcaatggacaagata

SEQ ID NO: 415481 - DNA, 20 bp, mouse
gggtgggtgggcctcggcaa

SEQ ID NO: 415482 - DNA, 20 bp, mouse
gcattacctcgggaaggcaa

SEQ ID NO: 415483 - DNA, 20 bp, mouse
gcagggtgttgcactgtggg

SEQ ID NO: 415484 - DNA, 20 bp, mouse
ggactatacccgcaagaaga

SEQ ID NO: 415485 - DNA, 20 bp, mouse
gagctcacagcggccaaggt

SEQ ID NO: 415486 - DNA, 20 bp, mouse
gttcggagggcccgctggag

SEQ ID NO: 415487 - DNA, 20 bp, mouse
gcaggtaatgagagtaacca

SEQ ID NO: 415488 - DNA, 20 bp, mouse
gcggctcgcgcggctcctcg

SEQ ID NO: 415489 - DNA, 20 bp, mouse
ggcgcgtgccggcccgggtt

SEQ ID NO: 415490 - DNA, 20 bp, mouse
gaaccatggcaacccaccag

SEQ ID NO: 415491 - DNA, 20 bp, mouse
gcagcgggccctccgaaccc

SEQ ID NO: 415492 - DNA, 20 bp, mouse
gaccagctgtcagtgcaggg

SEQ ID NO: 415493 - DNA, 20 bp, mouse
ggtgccggcccgggttcgga

SEQ ID NO: 415494 - DNA, 20 bp, mouse
ggggccctccgaacccgggc

SEQ ID NO: 415495 - DNA, 20 bp, mouse
gtgggcagcgtcgggactga

SEQ ID NO: 415496 - DNA, 20 bp, mouse
ggcgtgtgggcctcgcggta

SEQ ID NO: 415497 - DNA, 20 bp, mouse
gacggagtgtcaagagcacg

SEQ ID NO: 415498 - DNA, 20 bp, mouse
gccgcgaggcccacacgcgt

SEQ ID NO: 415499 - DNA, 20 bp, mouse
gtgggtcactccactctcgg

SEQ ID NO: 415500 - DNA, 20 bp, mouse
gaccaagggcaggaacccac

SEQ ID NO: 415501 - DNA, 20 bp, mouse
ggctgcggggaggcacggaa

SEQ ID NO: 415502 - DNA, 20 bp, mouse
gaggtgggatactcaccggg

SEQ ID NO: 415503 - DNA, 20 bp, mouse
gcagccgtgccaacgcgtgt

SEQ ID NO: 415504 - DNA, 20 bp, mouse
ggcacggggcagcttgtacc

SEQ ID NO: 415505 - DNA, 20 bp, mouse
gaggcccacacgcgttggca

SEQ ID NO: 415506 - DNA, 20 bp, mouse
gcccagaagtggtaacaaca

SEQ ID NO: 415507 - DNA, 20 bp, mouse
gacatggcaaggcttaggtc

SEQ ID NO: 415508 - DNA, 20 bp, mouse
gaatggacctatcacagcac

SEQ ID NO: 415509 - DNA, 20 bp, mouse
ggatctgccagatcagaaag

SEQ ID NO: 415510 - DNA, 20 bp, mouse
gaagtggtaacaacatggca

SEQ ID NO: 415511 - DNA, 20 bp, mouse
gcccattcagggccctggaa

SEQ ID NO: 415512 - DNA, 20 bp, mouse
gtaacaacatggcaaggctt

SEQ ID NO: 415513 - DNA, 20 bp, mouse
ggggacaggaggcccctcac

SEQ ID NO: 415514 - DNA, 20 bp, mouse
gcctcactggctcccattca

SEQ ID NO: 415515 - DNA, 20 bp, mouse
gtccattccagggccctgaa

SEQ ID NO: 415516 - DNA, 20 bp, mouse
ggactagaagggacaggata

SEQ ID NO: 415517 - DNA, 20 bp, mouse
gggcctggtgacgcaagcca

SEQ ID NO: 415518 - DNA, 20 bp, mouse
gtactgcgactagaagggac

SEQ ID NO: 415519 - DNA, 20 bp, mouse
gcatcctggaccagcgctag

SEQ ID NO: 415520 - DNA, 20 bp, mouse
gagggaaggggcagacatcc

SEQ ID NO: 415521 - DNA, 20 bp, mouse
ggttcctactgcgactagaa

SEQ ID NO: 415522 - DNA, 20 bp, mouse
gagggagatgatccaggcat

SEQ ID NO: 415523 - DNA, 20 bp, mouse
ggagatgatccaggcatagg

SEQ ID NO: 415524 - DNA, 20 bp, mouse
ggccagggtgcccctagcgc

SEQ ID NO: 415525 - DNA, 20 bp, mouse
gcccaacagctggagagaac

SEQ ID NO: 415526 - DNA, 20 bp, mouse
ggcaggaatgtctgaaatct

SEQ ID NO: 415527 - DNA, 20 bp, mouse
gtaaacagtgacaagtaatg

SEQ ID NO: 415528 - DNA, 20 bp, mouse
gctggggttactgaagccat

SEQ ID NO: 415529 - DNA, 20 bp, mouse
gctgggcaaagggagccagc

SEQ ID NO: 415530 - DNA, 20 bp, mouse
gtgccaataggaaggtccat

SEQ ID NO: 415531 - DNA, 20 bp, mouse
gccaagattgcagagctaga

SEQ ID NO: 415532 - DNA, 20 bp, mouse
gtgtctgaaatctgggcaaa

SEQ ID NO: 415533 - DNA, 20 bp, mouse
gtcagtaaccccaggtgcta

SEQ ID NO: 415534 - DNA, 20 bp, mouse
gcaataggaaggtccatggg

SEQ ID NO: 415535 - DNA, 20 bp, mouse
gtatagttccatagcacctg

SEQ ID NO: 415536 - DNA, 20 bp, mouse
gagacccaccgggaagaagg

SEQ ID NO: 415537 - DNA, 20 bp, mouse
gggagagggagggccgaggt

SEQ ID NO: 415538 - DNA, 20 bp, mouse
gcgagcaaggcgggtcagac

SEQ ID NO: 415539 - DNA, 20 bp, mouse
gaggagggggataccggaga

SEQ ID NO: 415540 - DNA, 20 bp, mouse
ggtctcgccgacgccacact

SEQ ID NO: 415541 - DNA, 20 bp, mouse
gcaccacccgccaagggaag

SEQ ID NO: 415542 - DNA, 20 bp, mouse
ggggggataccggagaggga

SEQ ID NO: 415543 - DNA, 20 bp, mouse
gtgggtctcggagccgacct

SEQ ID NO: 415544 - DNA, 20 bp, mouse
gggcttgaggccggagggaa

SEQ ID NO: 415545 - DNA, 20 bp, mouse
gcggtacaccgagccagacc

SEQ ID NO: 415546 - DNA, 20 bp, mouse
gggacggcggccagcgacag

SEQ ID NO: 415547 - DNA, 20 bp, mouse
gagcaaggcgcagagcagga

SEQ ID NO: 415548 - DNA, 20 bp, mouse
gaaggcgcagagcaggacgg

SEQ ID NO: 415549 - DNA, 20 bp, mouse
gagcgacagcggcgagagca

SEQ ID NO: 415550 - DNA, 20 bp, mouse
gacccagcttgggtacacat

SEQ ID NO: 415551 - DNA, 20 bp, mouse
gaagtcaagggagcccctag

SEQ ID NO: 415552 - DNA, 20 bp, mouse
gggcgagagcacggagcccg

SEQ ID NO: 415553 - DNA, 20 bp, mouse
gcagcttgggtacacatggg

SEQ ID NO: 415554 - DNA, 20 bp, mouse
gtgcggggcctcgaagtcaa

SEQ ID NO: 415555 - DNA, 20 bp, mouse
gagacaccacgggaaggcaa

SEQ ID NO: 415556 - DNA, 20 bp, mouse
ggttctggccaaggtagcaa

SEQ ID NO: 415557 - DNA, 20 bp, mouse
ggttggtgatagttcagaaa

SEQ ID NO: 415558 - DNA, 20 bp, mouse
gataagcagtggaaaaacgt

SEQ ID NO: 415559 - DNA, 20 bp, mouse
gggtgatagttcagaaaggg

SEQ ID NO: 415560 - DNA, 20 bp, mouse
gcattctgacataaccaagg

SEQ ID NO: 415561 - DNA, 20 bp, mouse
gagcaagggacagcaacttc

SEQ ID NO: 415562 - DNA, 20 bp, mouse
gaatgacagaggctaataga

SEQ ID NO: 415563 - DNA, 20 bp, mouse
gagggaggattgagaagtat

SEQ ID NO: 415564 - DNA, 20 bp, mouse
gaaacattctgacataacca

SEQ ID NO: 415565 - DNA, 20 bp, mouse
gtacgtcattacgattactg

SEQ ID NO: 415566 - DNA, 20 bp, mouse
ggtagacattctaaagagaa

SEQ ID NO: 415567 - DNA, 20 bp, mouse
gaaggaggactcagcacggt

SEQ ID NO: 415568 - DNA, 20 bp, mouse
ggctatgaagtaacaggaag

SEQ ID NO: 415569 - DNA, 20 bp, mouse
gctccaggttctagtaacca

SEQ ID NO: 415570 - DNA, 20 bp, mouse
gacagctcaagaaacaagta

SEQ ID NO: 415571 - DNA, 20 bp, mouse
ggctcaagaaacaagtaagg

SEQ ID NO: 415572 - DNA, 20 bp, mouse
gatgtctacactggagctcc

SEQ ID NO: 415573 - DNA, 20 bp, mouse
ggtggaggagaaaggatctc

SEQ ID NO: 415574 - DNA, 20 bp, mouse
gaaaggaaatgactcggaag

SEQ ID NO: 415575 - DNA, 20 bp, mouse
ggttgaaagcataaaggtgg

SEQ ID NO: 415576 - DNA, 20 bp, mouse
gcccttcttgcctagaacac

SEQ ID NO: 415577 - DNA, 20 bp, mouse
gtgtcattgagccggtgaag

SEQ ID NO: 415578 - DNA, 20 bp, mouse
gggcgggagaaattagaaag

SEQ ID NO: 415579 - DNA, 20 bp, mouse
gcaagaagggtggacagacc

SEQ ID NO: 415580 - DNA, 20 bp, mouse
gggctgacataggaccaagg

SEQ ID NO: 415581 - DNA, 20 bp, mouse
gtcccgtgttctaggcaaga

SEQ ID NO: 415582 - DNA, 20 bp, mouse
ggtggacagaccgggcgact

SEQ ID NO: 415583 - DNA, 20 bp, mouse
ggcctcacccggcactctaa

SEQ ID NO: 415584 - DNA, 20 bp, mouse
ggccgttagagtgccgggtg

SEQ ID NO: 415585 - DNA, 20 bp, mouse
gcaaccgggatgggccgcta

SEQ ID NO: 415586 - DNA, 20 bp, mouse
gacagaacagcttaacggtc

SEQ ID NO: 415587 - DNA, 20 bp, mouse
gctcgtcttagcaccggtgg

SEQ ID NO: 415588 - DNA, 20 bp, mouse
gagagtgctcgtcttagcac

SEQ ID NO: 415589 - DNA, 20 bp, mouse
gagccaagggagctccgagg

SEQ ID NO: 415590 - DNA, 20 bp, mouse
ggctaagacgagcactctcc

SEQ ID NO: 415591 - DNA, 20 bp, mouse
ggtgctcgtcttagcaccgg

SEQ ID NO: 415592 - DNA, 20 bp, mouse
gagcgcacagaacagcttaa

SEQ ID NO: 415593 - DNA, 20 bp, mouse
gcccttggcacgggaagcgg

SEQ ID NO: 415594 - DNA, 20 bp, mouse
ggcagcggcgccgacgggcg

SEQ ID NO: 415595 - DNA, 20 bp, mouse
gggcggggcgggtgcggatg

SEQ ID NO: 415596 - DNA, 20 bp, mouse
ggcggcgacagcctcaggca

SEQ ID NO: 415597 - DNA, 20 bp, mouse
gtagtgctggctgtatgcgg

SEQ ID NO: 415598 - DNA, 20 bp, mouse
gtcagcgcggcgacagcctc

SEQ ID NO: 415599 - DNA, 20 bp, mouse
gggcaggcaccgactcagcg

SEQ ID NO: 415600 - DNA, 20 bp, mouse
ggtcccgagcgggcaatccg

SEQ ID NO: 415601 - DNA, 20 bp, mouse
gtgctggctgtatgcggcgg

SEQ ID NO: 415602 - DNA, 20 bp, mouse
ggtctagtgctggctgtatg

SEQ ID NO: 415603 - DNA, 20 bp, mouse
gggctgtcgccgcgctgagt

SEQ ID NO: 415604 - DNA, 20 bp, mouse
ggcgttgcctgggctgatgt

SEQ ID NO: 415605 - DNA, 20 bp, mouse
ggcggtgaggctattcgagt

SEQ ID NO: 415606 - DNA, 20 bp, mouse
gagtcaggtatggagtccag

SEQ ID NO: 415607 - DNA, 20 bp, mouse
ggactcagagctgatggtaa

SEQ ID NO: 415608 - DNA, 20 bp, mouse
ggagtccagtggagctgaca

SEQ ID NO: 415609 - DNA, 20 bp, mouse
ggtggagctgacaaggaaag

SEQ ID NO: 415610 - DNA, 20 bp, mouse
ggatggtaaaggaacctcaa

SEQ ID NO: 415611 - DNA, 20 bp, mouse
gctgatggtggtagattatg

SEQ ID NO: 415612 - DNA, 20 bp, mouse
gaacggggccctagggaagg

SEQ ID NO: 415613 - DNA, 20 bp, mouse
gtctgagtctggcttaatac

SEQ ID NO: 415614 - DNA, 20 bp, mouse
gattatgtggcagggcagtc

SEQ ID NO: 415615 - DNA, 20 bp, mouse
gtctggttagtagagctgta

SEQ ID NO: 415616 - DNA, 20 bp, mouse
ggagcaccgagtcgccgagg

SEQ ID NO: 415617 - DNA, 20 bp, mouse
ggccgaggcggctgtgcgaa

SEQ ID NO: 415618 - DNA, 20 bp, mouse
gcgggagcaccgagtcgccg

SEQ ID NO: 415619 - DNA, 20 bp, mouse
gtcctgcgaggatgccggcc

SEQ ID NO: 415620 - DNA, 20 bp, mouse
ggccattcgcacagccgcct

SEQ ID NO: 415621 - DNA, 20 bp, mouse
gatggctgcgggatcgggat

SEQ ID NO: 415622 - DNA, 20 bp, mouse
gcacagccgcctcggcgact

SEQ ID NO: 415623 - DNA, 20 bp, mouse
gcggcggcgagcgcagaaag

SEQ ID NO: 415624 - DNA, 20 bp, mouse
gagcttgcccagcccgggaa

SEQ ID NO: 415625 - DNA, 20 bp, mouse
gcctcgcccgcggcgtccag

SEQ ID NO: 415626 - DNA, 20 bp, mouse
gtacataaggtcccccacaa

SEQ ID NO: 415627 - DNA, 20 bp, mouse
ggtcccccacaacggttgta

SEQ ID NO: 415628 - DNA, 20 bp, mouse
gcacaacggttgtagggtgg

SEQ ID NO: 415629 - DNA, 20 bp, mouse
gccccacaacggttgtaggg

SEQ ID NO: 415630 - DNA, 20 bp, mouse
ggatacagttgatagaatct

SEQ ID NO: 415631 - DNA, 20 bp, mouse
gattctatcaactgtatctg

SEQ ID NO: 415632 - DNA, 20 bp, mouse
gtggtcttcggatatcacag

SEQ ID NO: 415633 - DNA, 20 bp, mouse
gactagtgagtctaagaata

SEQ ID NO: 415634 - DNA, 20 bp, mouse
gaagcgacgctggtaaacat

SEQ ID NO: 415635 - DNA, 20 bp, mouse
gtccaccaggctgcaagcga

SEQ ID NO: 415636 - DNA, 20 bp, mouse
gcttagttactcaccagtct

SEQ ID NO: 415637 - DNA, 20 bp, mouse
gacactcatgtcaagcaggc

SEQ ID NO: 415638 - DNA, 20 bp, mouse
gttgacatgagtgtggtaat

SEQ ID NO: 415639 - DNA, 20 bp, mouse
gctaccagctcagtctttag

SEQ ID NO: 415640 - DNA, 20 bp, mouse
gatacctctaaagactgagc

SEQ ID NO: 415641 - DNA, 20 bp, mouse
gtaccacactcatgtcaagc

SEQ ID NO: 415642 - DNA, 20 bp, mouse
gatgagtgtggtaatgggtg

SEQ ID NO: 415643 - DNA, 20 bp, mouse
ggtgtggtaatgggtgagga

SEQ ID NO: 415644 - DNA, 20 bp, mouse
gggctggcaccagcccagac

SEQ ID NO: 415645 - DNA, 20 bp, mouse
ggtaatgggtgaggatgggt

SEQ ID NO: 415646 - DNA, 20 bp, mouse
gtctccggagtggaccttgg

SEQ ID NO: 415647 - DNA, 20 bp, mouse
gggtccactccggagagagg

SEQ ID NO: 415648 - DNA, 20 bp, mouse
gtggtgcagttaggatcttc

SEQ ID NO: 415649 - DNA, 20 bp, mouse
gtccccgcctctctccggag

SEQ ID NO: 415650 - DNA, 20 bp, mouse
ggggagcatcaggtacccgg

SEQ ID NO: 415651 - DNA, 20 bp, mouse
ggcagttaggatcttctggc

SEQ ID NO: 415652 - DNA, 20 bp, mouse
gagaggcggggactcactac

SEQ ID NO: 415653 - DNA, 20 bp, mouse
ggatcctaactgcaccacca

SEQ ID NO: 415654 - DNA, 20 bp, mouse
gcgcccggggcccagcgcag

SEQ ID NO: 415655 - DNA, 20 bp, mouse
gtaaaacgtgctgggctccg

SEQ ID NO: 415656 - DNA, 20 bp, mouse
gcagagggaagggtgctcct

SEQ ID NO: 415657 - DNA, 20 bp, mouse
ggaagctgcaggccccggct

SEQ ID NO: 415658 - DNA, 20 bp, mouse
ggatctgggtccaagacgca

SEQ ID NO: 415659 - DNA, 20 bp, mouse
gctgctggatcagattagtg

SEQ ID NO: 415660 - DNA, 20 bp, mouse
gtagtgcgggctctaatgct

SEQ ID NO: 415661 - DNA, 20 bp, mouse
gagacacaaagacaccccgc

SEQ ID NO: 415662 - DNA, 20 bp, mouse
gggagataggcagtgagccg

SEQ ID NO: 415663 - DNA, 20 bp, mouse
gggtgccgcccagacaataa

SEQ ID NO: 415664 - DNA, 20 bp, mouse
gcatcaggccaagctggacc

SEQ ID NO: 415665 - DNA, 20 bp, mouse
gggtctgtctggagtgagaa

SEQ ID NO: 415666 - DNA, 20 bp, mouse
gcatggaccatcgccgtgat

SEQ ID NO: 415667 - DNA, 20 bp, mouse
gggaccatcgccgtgatggg

SEQ ID NO: 415668 - DNA, 20 bp, mouse
ggcggaacgttatccatcat

SEQ ID NO: 415669 - DNA, 20 bp, mouse
ggataacgttccgcccatca

SEQ ID NO: 415670 - DNA, 20 bp, mouse
gtactgtggacggagggaaa

SEQ ID NO: 415671 - DNA, 20 bp, mouse
ggtcacaataagctattaac

SEQ ID NO: 415672 - DNA, 20 bp, mouse
gcagccacaggagcaggtaa

SEQ ID NO: 415673 - DNA, 20 bp, mouse
gtaggcagtactgtggacgg

SEQ ID NO: 415674 - DNA, 20 bp, mouse
gcactctgtgagccatctgg

SEQ ID NO: 415675 - DNA, 20 bp, mouse
gcaggcagtaggatgccaca

SEQ ID NO: 415676 - DNA, 20 bp, mouse
ggagttgcttcagcgtagaa

SEQ ID NO: 415677 - DNA, 20 bp, mouse
gattacgaaggataaagtct

SEQ ID NO: 415678 - DNA, 20 bp, mouse
gcatggccagatattgtcca

SEQ ID NO: 415679 - DNA, 20 bp, mouse
ggagactcagaggcttagaa

SEQ ID NO: 415680 - DNA, 20 bp, mouse
gcaaaacttaaggtaatgtt

SEQ ID NO: 415681 - DNA, 20 bp, mouse
gaacttacttcgagactcag

SEQ ID NO: 415682 - DNA, 20 bp, mouse
gacgctgaagcaactctccc

SEQ ID NO: 415683 - DNA, 20 bp, mouse
gcaactttgacggtcactaa

SEQ ID NO: 415684 - DNA, 20 bp, mouse
gaacttaaggtaatgttagg

SEQ ID NO: 415685 - DNA, 20 bp, mouse
gataatattttaaattacga

SEQ ID NO: 415686 - DNA, 20 bp, mouse
gacctgggccacagcagtaa

SEQ ID NO: 415687 - DNA, 20 bp, mouse
gagtcgggacgaggtcaacc

SEQ ID NO: 415688 - DNA, 20 bp, mouse
gagttgctctgtccttagtc

SEQ ID NO: 415689 - DNA, 20 bp, mouse
gcttcagactgtgggaccca

SEQ ID NO: 415690 - DNA, 20 bp, mouse
gcatctggcagcctgatgag

SEQ ID NO: 415691 - DNA, 20 bp, mouse
gaacgttacgccagtgacct

SEQ ID NO: 415692 - DNA, 20 bp, mouse
gaataggtcgcctaggtcac

SEQ ID NO: 415693 - DNA, 20 bp, mouse
gaggtcaacctggatctgat

SEQ ID NO: 415694 - DNA, 20 bp, mouse
gcctattccccatcagatcc

SEQ ID NO: 415695 - DNA, 20 bp, mouse
ggatggggaataggtcgcct

SEQ ID NO: 415696 - DNA, 20 bp, mouse
gccatggtagcccaagtgtg

SEQ ID NO: 415697 - DNA, 20 bp, mouse
gactcgacaagagttcccac

SEQ ID NO: 415698 - DNA, 20 bp, mouse
gcatcaaggttgggaagcca

SEQ ID NO: 415699 - DNA, 20 bp, mouse
ggtcgagtatgctgtcacaa

SEQ ID NO: 415700 - DNA, 20 bp, mouse
gacttcaaactggagccagt

SEQ ID NO: 415701 - DNA, 20 bp, mouse
gtccagtttgaagtccatca

SEQ ID NO: 415702 - DNA, 20 bp, mouse
gaccttgatggacttcaaac

SEQ ID NO: 415703 - DNA, 20 bp, mouse
gtcttggctaccttcacaca

SEQ ID NO: 415704 - DNA, 20 bp, mouse
ggctttgtagcaactccttg

SEQ ID NO: 415705 - DNA, 20 bp, mouse
gaggagttgctacaaagcca

SEQ ID NO: 415706 - DNA, 20 bp, mouse
gagtttggtgagatcagtca

SEQ ID NO: 415707 - DNA, 20 bp, mouse
gagaagactatggatcctag

SEQ ID NO: 415708 - DNA, 20 bp, mouse
gctgtaaacaactggatcac

SEQ ID NO: 415709 - DNA, 20 bp, mouse
gggagctacctgtaaacaac

SEQ ID NO: 415710 - DNA, 20 bp, mouse
gtattaagaaccaaagctaa

SEQ ID NO: 415711 - DNA, 20 bp, mouse
gttgagatatctgtacctct

SEQ ID NO: 415712 - DNA, 20 bp, mouse
gagggagaccatcgcaatca

SEQ ID NO: 415713 - DNA, 20 bp, mouse
gaatttaaggtaattattga

SEQ ID NO: 415714 - DNA, 20 bp, mouse
ggaatctaccatgattgcga

SEQ ID NO: 415715 - DNA, 20 bp, mouse
gtgtctgctagtggacagag

SEQ ID NO: 415716 - DNA, 20 bp, mouse
gcgagaggcggagtccagag

SEQ ID NO: 415717 - DNA, 20 bp, mouse
ggcctgtggcaccaatctgg

SEQ ID NO: 415718 - DNA, 20 bp, mouse
gcaggacaagcgcggaactt

SEQ ID NO: 415719 - DNA, 20 bp, mouse
gcggaacttagaaatgatga

SEQ ID NO: 415720 - DNA, 20 bp, mouse
gacaagcgcggaacttaggc

SEQ ID NO: 415721 - DNA, 20 bp, mouse
ggggcactggccacagagtc

SEQ ID NO: 415722 - DNA, 20 bp, mouse
gggcggagcccggggtacag

SEQ ID NO: 415723 - DNA, 20 bp, mouse
gcaggcctgtggcaccaatc

SEQ ID NO: 415724 - DNA, 20 bp, mouse
gagtaattgggctgaggacc

SEQ ID NO: 415725 - DNA, 20 bp, mouse
gtgggctgaggaccgggttt

SEQ ID NO: 415726 - DNA, 20 bp, mouse
gggttcaaggattcatctgg

SEQ ID NO: 415727 - DNA, 20 bp, mouse
gcaggccaggcccttcacag

SEQ ID NO: 415728 - DNA, 20 bp, mouse
gcatggttcaaggattcatc

SEQ ID NO: 415729 - DNA, 20 bp, mouse
gttgttcttctcgttatctg

SEQ ID NO: 415730 - DNA, 20 bp, mouse
gatgcaggttctagacagac

SEQ ID NO: 415731 - DNA, 20 bp, mouse
gccaaagtacctggcaactg

SEQ ID NO: 415732 - DNA, 20 bp, mouse
gagaggttctgaacatgctg

SEQ ID NO: 415733 - DNA, 20 bp, mouse
gagagcgcagactatctgag

SEQ ID NO: 415734 - DNA, 20 bp, mouse
gttctcgttatctggggctc

SEQ ID NO: 415735 - DNA, 20 bp, mouse
gtttctgctgcacctctgac

SEQ ID NO: 415736 - DNA, 20 bp, mouse
gaggaaacaaagagtgggac

SEQ ID NO: 415737 - DNA, 20 bp, mouse
gcctccaccaggagcatcat

SEQ ID NO: 415738 - DNA, 20 bp, mouse
gagacaagagcgtgccacat

SEQ ID NO: 415739 - DNA, 20 bp, mouse
gtcataaggcgtgggtgagg

SEQ ID NO: 415740 - DNA, 20 bp, mouse
gagcgtgccacatgggggca

SEQ ID NO: 415741 - DNA, 20 bp, mouse
gtggcacgctcttgtctcat

SEQ ID NO: 415742 - DNA, 20 bp, mouse
gaattcataaggcgtgggtg

SEQ ID NO: 415743 - DNA, 20 bp, mouse
ggtgaggaggagtaaatatg

SEQ ID NO: 415744 - DNA, 20 bp, mouse
gtgttcatgaagcggcattt

SEQ ID NO: 415745 - DNA, 20 bp, mouse
gtgctcctggtggaggcaga

SEQ ID NO: 415746 - DNA, 20 bp, mouse
ggaagttcgatgaagagagt

SEQ ID NO: 415747 - DNA, 20 bp, mouse
gtctcttcatcgaacttctc

SEQ ID NO: 415748 - DNA, 20 bp, mouse
gtctggcttgtcagcagacc

SEQ ID NO: 415749 - DNA, 20 bp, mouse
gggcaaaagggacctgacac

SEQ ID NO: 415750 - DNA, 20 bp, mouse
gatacctagaagcctgcctg

SEQ ID NO: 415751 - DNA, 20 bp, mouse
gagatgaagctggactcctt

SEQ ID NO: 415752 - DNA, 20 bp, mouse
gagtcatgggctcatgacag

SEQ ID NO: 415753 - DNA, 20 bp, mouse
ggggaaagcacccccttcta

SEQ ID NO: 415754 - DNA, 20 bp, mouse
gagctctggctctgtggaca

SEQ ID NO: 415755 - DNA, 20 bp, mouse
ggaaggtcagagttccggac

SEQ ID NO: 415756 - DNA, 20 bp, mouse
gaacctgacaccccacactg

SEQ ID NO: 415757 - DNA, 20 bp, mouse
gccccacactggggagcgga

SEQ ID NO: 415758 - DNA, 20 bp, mouse
gtggctgagacggtaagagt

SEQ ID NO: 415759 - DNA, 20 bp, mouse
gagccctccgctccccagtg

SEQ ID NO: 415760 - DNA, 20 bp, mouse
gagctggtctcatggaactc

SEQ ID NO: 415761 - DNA, 20 bp, mouse
gtctacccacaatttggtca

SEQ ID NO: 415762 - DNA, 20 bp, mouse
gtctaccatgaccaaattgt

SEQ ID NO: 415763 - DNA, 20 bp, mouse
gtagagatactagtgagcac

SEQ ID NO: 415764 - DNA, 20 bp, mouse
gcgctctcttcaggaacctc

SEQ ID NO: 415765 - DNA, 20 bp, mouse
gaagagcatactcaaatact

SEQ ID NO: 415766 - DNA, 20 bp, mouse
gccagcagcccacacttcgg

SEQ ID NO: 415767 - DNA, 20 bp, mouse
ggaggttgcctccgaagtgt

SEQ ID NO: 415768 - DNA, 20 bp, mouse
gaatccagcagcccacactt

SEQ ID NO: 415769 - DNA, 20 bp, mouse
gtccgctctggaaaagtcag

SEQ ID NO: 415770 - DNA, 20 bp, mouse
ggagttaaacatcattggtg

SEQ ID NO: 415771 - DNA, 20 bp, mouse
gctttcgcttggtactatac

SEQ ID NO: 415772 - DNA, 20 bp, mouse
gttttagagggtgttcactc

SEQ ID NO: 415773 - DNA, 20 bp, mouse
gtaatcactagtgagacagc

SEQ ID NO: 415774 - DNA, 20 bp, mouse
gcaatgatgtttaactcacg

SEQ ID NO: 415775 - DNA, 20 bp, mouse
ggcaggtcagggtcagtcaa

SEQ ID NO: 415776 - DNA, 20 bp, mouse
gaggatgtctgggccagcgg

SEQ ID NO: 415777 - DNA, 20 bp, mouse
gagccagcgacggccgtggg

SEQ ID NO: 415778 - DNA, 20 bp, mouse
gacgggcgcctagcaaccaa

SEQ ID NO: 415779 - DNA, 20 bp, mouse
ggagagctcgcgtccaccca

SEQ ID NO: 415780 - DNA, 20 bp, mouse
gggtggacagcccggagacg

SEQ ID NO: 415781 - DNA, 20 bp, mouse
gtagcaaccaacggtgtacc

SEQ ID NO: 415782 - DNA, 20 bp, mouse
gacggtgtaccgggcaagcg

SEQ ID NO: 415783 - DNA, 20 bp, mouse
gggacgcgagctctcggctg

SEQ ID NO: 415784 - DNA, 20 bp, mouse
gggcaccaaggaggatgtct

SEQ ID NO: 415785 - DNA, 20 bp, mouse
gcgtccccgcagctgtacag

SEQ ID NO: 415786 - DNA, 20 bp, mouse
gccaggctcttcccaagccc

SEQ ID NO: 415787 - DNA, 20 bp, mouse
gtcagggctgttctctgcca

SEQ ID NO: 415788 - DNA, 20 bp, mouse
gtggcttaatctagactgtg

SEQ ID NO: 415789 - DNA, 20 bp, mouse
gacagtggtacagtgtggtc

SEQ ID NO: 415790 - DNA, 20 bp, mouse
gcagagacgcaacaatcctg

SEQ ID NO: 415791 - DNA, 20 bp, mouse
gcaaagctctcaaggcccgt

SEQ ID NO: 415792 - DNA, 20 bp, mouse
gggaagagcctggtttccat

SEQ ID NO: 415793 - DNA, 20 bp, mouse
gtccaccacaggcccttgtt

SEQ ID NO: 415794 - DNA, 20 bp, mouse
gttatttattcaggaagaca

SEQ ID NO: 415795 - DNA, 20 bp, mouse
gaagacagggagccttgcgt

SEQ ID NO: 415796 - DNA, 20 bp, mouse
gtaaacctcagaaggtctgg

SEQ ID NO: 415797 - DNA, 20 bp, mouse
gtctcaaggccccagccaaa

SEQ ID NO: 415798 - DNA, 20 bp, mouse
gggtccccgggtccccaggg

SEQ ID NO: 415799 - DNA, 20 bp, mouse
gaacaccaccagaccttctg

SEQ ID NO: 415800 - DNA, 20 bp, mouse
gtcttaaacctcagaaggtc

SEQ ID NO: 415801 - DNA, 20 bp, mouse
gaccccgccctggggacccg

SEQ ID NO: 415802 - DNA, 20 bp, mouse
gaggtccctacgggtcccca

SEQ ID NO: 415803 - DNA, 20 bp, mouse
gttcccagaaccccgccctg

SEQ ID NO: 415804 - DNA, 20 bp, mouse
gcggatgtccggggacccgt

SEQ ID NO: 415805 - DNA, 20 bp, mouse
gccgctgaggggagcatctg

SEQ ID NO: 415806 - DNA, 20 bp, mouse
gtcatgatgaaagcaagaac

SEQ ID NO: 415807 - DNA, 20 bp, mouse
ggttctgagaatgagtatat

SEQ ID NO: 415808 - DNA, 20 bp, mouse
gagcaagaactggtctgccc

SEQ ID NO: 415809 - DNA, 20 bp, mouse
gcaagacagaacaatctcta

SEQ ID NO: 415810 - DNA, 20 bp, mouse
gcttgctttcatcatgacta

SEQ ID NO: 415811 - DNA, 20 bp, mouse
ggactaaacggaggaagatg

SEQ ID NO: 415812 - DNA, 20 bp, mouse
ggactccaatgactaaacgg

SEQ ID NO: 415813 - DNA, 20 bp, mouse
gatgagtatataggtgtatc

SEQ ID NO: 415814 - DNA, 20 bp, mouse
ggtacctggaagaacaataa

SEQ ID NO: 415815 - DNA, 20 bp, mouse
gaatcttgggataaagttaa

SEQ ID NO: 415816 - DNA, 20 bp, mouse
gcgtgagtagtgttccatgg

SEQ ID NO: 415817 - DNA, 20 bp, mouse
gcctacaaggcaaagggcag

SEQ ID NO: 415818 - DNA, 20 bp, mouse
ggttccatggaggtcgagaa

SEQ ID NO: 415819 - DNA, 20 bp, mouse
gcatcgtgagtagtgttcca

SEQ ID NO: 415820 - DNA, 20 bp, mouse
ggaggcaggaccaagctcat

SEQ ID NO: 415821 - DNA, 20 bp, mouse
gacgggtgaaagtctccagg

SEQ ID NO: 415822 - DNA, 20 bp, mouse
ggaatggaatccaccggtca

SEQ ID NO: 415823 - DNA, 20 bp, mouse
gttggtgctaccatgaccgg

SEQ ID NO: 415824 - DNA, 20 bp, mouse
gaagaaggtcagctgcaaat

SEQ ID NO: 415825 - DNA, 20 bp, mouse
gtgggtaaactttaacccaa

SEQ ID NO: 415826 - DNA, 20 bp, mouse
gtcccaaagcagaaagcagt

SEQ ID NO: 415827 - DNA, 20 bp, mouse
ggatgggcccaggttctaca

SEQ ID NO: 415828 - DNA, 20 bp, mouse
gcccgcacaggagagacgtg

SEQ ID NO: 415829 - DNA, 20 bp, mouse
gcccattctgcttcaaggag

SEQ ID NO: 415830 - DNA, 20 bp, mouse
gacctgggcccatctgaaag

SEQ ID NO: 415831 - DNA, 20 bp, mouse
gagcattcgtcatcccgcac

SEQ ID NO: 415832 - DNA, 20 bp, mouse
gccagtcgcagaaagtgttg

SEQ ID NO: 415833 - DNA, 20 bp, mouse
ggtagcattcattctagcag

SEQ ID NO: 415834 - DNA, 20 bp, mouse
gaaagcagaacataaacaat

SEQ ID NO: 415835 - DNA, 20 bp, mouse
gtcctctttcagatgggccc

SEQ ID NO: 415836 - DNA, 20 bp, mouse
gagagtctgcgtcccggact

SEQ ID NO: 415837 - DNA, 20 bp, mouse
gtagtgagagtaaacatgaa

SEQ ID NO: 415838 - DNA, 20 bp, mouse
gcgaccggcaccctctgtgg

SEQ ID NO: 415839 - DNA, 20 bp, mouse
gttccaggcggtgagctgtg

SEQ ID NO: 415840 - DNA, 20 bp, mouse
ggtggttagagtctgcgtcc

SEQ ID NO: 415841 - DNA, 20 bp, mouse
gtcccgcaaaagtggtggga

SEQ ID NO: 415842 - DNA, 20 bp, mouse
gcaactaggaccccacgcgg

SEQ ID NO: 415843 - DNA, 20 bp, mouse
gggaccccacgcggaggatg

SEQ ID NO: 415844 - DNA, 20 bp, mouse
gaaccgaccggcaccctctg

SEQ ID NO: 415845 - DNA, 20 bp, mouse
gcattcttctgaacttcgca

SEQ ID NO: 415846 - DNA, 20 bp, mouse
gcagagccctccgcagggat

SEQ ID NO: 415847 - DNA, 20 bp, mouse
gttctacagtcagtatctga

SEQ ID NO: 415848 - DNA, 20 bp, mouse
gctccctgggaacaccatgg

SEQ ID NO: 415849 - DNA, 20 bp, mouse
gagccctccgcagggatagg

SEQ ID NO: 415850 - DNA, 20 bp, mouse
gcttctccctgggaacacca

SEQ ID NO: 415851 - DNA, 20 bp, mouse
gagcagctgctcaggaccta

SEQ ID NO: 415852 - DNA, 20 bp, mouse
gggcatggagctcaccctca

SEQ ID NO: 415853 - DNA, 20 bp, mouse
gtggccagttctctccctca

SEQ ID NO: 415854 - DNA, 20 bp, mouse
gatgcagacacctaccttga

SEQ ID NO: 415855 - DNA, 20 bp, mouse
ggtcctccatggtgttccca

SEQ ID NO: 415856 - DNA, 20 bp, mouse
gtggctgtgggtagccgtag

SEQ ID NO: 415857 - DNA, 20 bp, mouse
gagctggggaccatagaaac

SEQ ID NO: 415858 - DNA, 20 bp, mouse
gatcaacatccacaccccta

SEQ ID NO: 415859 - DNA, 20 bp, mouse
ggggaccatagaaacaggtg

SEQ ID NO: 415860 - DNA, 20 bp, mouse
gcaggtggggaactgagttc

SEQ ID NO: 415861 - DNA, 20 bp, mouse
gaactgagttcaggaatagt

SEQ ID NO: 415862 - DNA, 20 bp, mouse
gggaatagtaggaataaggg

SEQ ID NO: 415863 - DNA, 20 bp, mouse
gagttccccacctgtttcta

SEQ ID NO: 415864 - DNA, 20 bp, mouse
ggtaaaatgagacaaaaggg

SEQ ID NO: 415865 - DNA, 20 bp, mouse
ggtgggtagccgtaggggtg

SEQ ID NO: 415866 - DNA, 20 bp, mouse
gagctgcagggcggtcacgt

SEQ ID NO: 415867 - DNA, 20 bp, mouse
ggttacacgcagtcactcgg

SEQ ID NO: 415868 - DNA, 20 bp, mouse
gtaggttacacgcagtcact

SEQ ID NO: 415869 - DNA, 20 bp, mouse
gccgccctgcagctacctcc

SEQ ID NO: 415870 - DNA, 20 bp, mouse
ggtgcccggaggtagctgca

SEQ ID NO: 415871 - DNA, 20 bp, mouse
gccccgggcggggaccagaa

SEQ ID NO: 415872 - DNA, 20 bp, mouse
ggcggtcggtttgtgcccgg

SEQ ID NO: 415873 - DNA, 20 bp, mouse
gccgcagagggccctgtgtt

SEQ ID NO: 415874 - DNA, 20 bp, mouse
ggtcactcggcggagcccgc

SEQ ID NO: 415875 - DNA, 20 bp, mouse
ggggtggcacagcggcctgc

SEQ ID NO: 415876 - DNA, 20 bp, mouse
ggccggcccgcgggccgtga

SEQ ID NO: 415877 - DNA, 20 bp, mouse
gcgcttgcgagggattgaaa

SEQ ID NO: 415878 - DNA, 20 bp, mouse
ggcctgtggaccgccaaggt

SEQ ID NO: 415879 - DNA, 20 bp, mouse
gagaggccggagccccaagt

SEQ ID NO: 415880 - DNA, 20 bp, mouse
gtgcagcctgtggaccgcca

SEQ ID NO: 415881 - DNA, 20 bp, mouse
gggaccgccaaggtaggcgc

SEQ ID NO: 415882 - DNA, 20 bp, mouse
gcccctgccggcgcctacct

SEQ ID NO: 415883 - DNA, 20 bp, mouse
ggtgtctgttgccaaggcgc

SEQ ID NO: 415884 - DNA, 20 bp, mouse
ggcctaccttggcggtccac

SEQ ID NO: 415885 - DNA, 20 bp, mouse
gcaacccggaggccttccct

SEQ ID NO: 415886 - DNA, 20 bp, mouse
gagcagaccagagtccacga

SEQ ID NO: 415887 - DNA, 20 bp, mouse
gagtgtcatggagggtcaca

SEQ ID NO: 415888 - DNA, 20 bp, mouse
gactaagccttcgtggactc

SEQ ID NO: 415889 - DNA, 20 bp, mouse
gctggtgaagggaagactcc

SEQ ID NO: 415890 - DNA, 20 bp, mouse
gcgaactgtcaggagcggag

SEQ ID NO: 415891 - DNA, 20 bp, mouse
gtaatgagggtgcactgggg

SEQ ID NO: 415892 - DNA, 20 bp, mouse
gaaacagaactaagccttcg

SEQ ID NO: 415893 - DNA, 20 bp, mouse
gaaggtgcgtccttggagag

SEQ ID NO: 415894 - DNA, 20 bp, mouse
gttctctacttggaaggcct

SEQ ID NO: 415895 - DNA, 20 bp, mouse
gctgtccttgacttctagaa

SEQ ID NO: 415896 - DNA, 20 bp, mouse
gcagggccacatcctaatgg

SEQ ID NO: 415897 - DNA, 20 bp, mouse
gacaatgtaggggaccccag

SEQ ID NO: 415898 - DNA, 20 bp, mouse
gtttcagggccacatcctaa

SEQ ID NO: 415899 - DNA, 20 bp, mouse
ggaggagagatgtcatgctt

SEQ ID NO: 415900 - DNA, 20 bp, mouse
ggagcattaaacacaatgta

SEQ ID NO: 415901 - DNA, 20 bp, mouse
gcctaggacctgttgtttca

SEQ ID NO: 415902 - DNA, 20 bp, mouse
gtgtagtttgatcaaggcct

SEQ ID NO: 415903 - DNA, 20 bp, mouse
gcttagggtcatttccactg

SEQ ID NO: 415904 - DNA, 20 bp, mouse
gatgacatctctcctccatt

SEQ ID NO: 415905 - DNA, 20 bp, mouse
gctgttgtttcagggtatgc

SEQ ID NO: 415906 - DNA, 20 bp, mouse
gccaggcttgaaggacacta

SEQ ID NO: 415907 - DNA, 20 bp, mouse
gggcttgaaggacactaggg

SEQ ID NO: 415908 - DNA, 20 bp, mouse
gatctcaacgggtagtgcta

SEQ ID NO: 415909 - DNA, 20 bp, mouse
gggtctcagaaccctcaata

SEQ ID NO: 415910 - DNA, 20 bp, mouse
ggactgtaaagtcactaacc

SEQ ID NO: 415911 - DNA, 20 bp, mouse
ggaatttggagatatctcaa

SEQ ID NO: 415912 - DNA, 20 bp, mouse
gagtcactaaccaggcttga

SEQ ID NO: 415913 - DNA, 20 bp, mouse
gacctgaggcatatgaacag

SEQ ID NO: 415914 - DNA, 20 bp, mouse
gtgactgactctggaaaagt

SEQ ID NO: 415915 - DNA, 20 bp, mouse
gtagcaacataggcaagtag

SEQ ID NO: 415916 - DNA, 20 bp, mouse
gattcagctgcgggtcagaa

SEQ ID NO: 415917 - DNA, 20 bp, mouse
gcctgggtgagtgggttctg

SEQ ID NO: 415918 - DNA, 20 bp, mouse
ggcgggtcagaagggcacct

SEQ ID NO: 415919 - DNA, 20 bp, mouse
ggactgatgggtctcagaca

SEQ ID NO: 415920 - DNA, 20 bp, mouse
gggcggtcagaggcctgttt

SEQ ID NO: 415921 - DNA, 20 bp, mouse
ggtgagtgggttctgcggca

SEQ ID NO: 415922 - DNA, 20 bp, mouse
gtttgggatacattcagctg

SEQ ID NO: 415923 - DNA, 20 bp, mouse
gcactgaacgagacgcctgg

SEQ ID NO: 415924 - DNA, 20 bp, mouse
ggtctggggaagaagccgtg

SEQ ID NO: 415925 - DNA, 20 bp, mouse
gctgagacccatcagtctgc

SEQ ID NO: 415926 - DNA, 20 bp, mouse
gggtgtcttaggactactag

SEQ ID NO: 415927 - DNA, 20 bp, mouse
gaggccatggaagtgtctgg

SEQ ID NO: 415928 - DNA, 20 bp, mouse
gagaaggccatggaagtgtc

SEQ ID NO: 415929 - DNA, 20 bp, mouse
gcttaggactactagaggct

SEQ ID NO: 415930 - DNA, 20 bp, mouse
gtggaagtgtctggaggcac

SEQ ID NO: 415931 - DNA, 20 bp, mouse
gttctggtcttgcttaccct

SEQ ID NO: 415932 - DNA, 20 bp, mouse
gaaatggccacaggcgttga

SEQ ID NO: 415933 - DNA, 20 bp, mouse
gaaatatagagacaaagaag

SEQ ID NO: 415934 - DNA, 20 bp, mouse
gtttggcagaatgataattt

SEQ ID NO: 415935 - DNA, 20 bp, mouse
gggggctgcctctcagaact

SEQ ID NO: 415936 - DNA, 20 bp, mouse
gagatatcatgggggatcag

SEQ ID NO: 415937 - DNA, 20 bp, mouse
ggcttgcacctgggtaatcg

SEQ ID NO: 415938 - DNA, 20 bp, mouse
gagagccatagatatcatgg

SEQ ID NO: 415939 - DNA, 20 bp, mouse
gctcagagccatagatatca

SEQ ID NO: 415940 - DNA, 20 bp, mouse
gtggtcctccatgaaaggag

SEQ ID NO: 415941 - DNA, 20 bp, mouse
gcctgggtaatcgaggaagc

SEQ ID NO: 415942 - DNA, 20 bp, mouse
gttcttcacaaaccatccag

SEQ ID NO: 415943 - DNA, 20 bp, mouse
gttcaagacaggcttgcacc

SEQ ID NO: 415944 - DNA, 20 bp, mouse
gtaatttatgagaaattctg

SEQ ID NO: 415945 - DNA, 20 bp, mouse
gggtgatggtcctccatgaa

SEQ ID NO: 415946 - DNA, 20 bp, mouse
gaattcaccagtcaggcgtg

SEQ ID NO: 415947 - DNA, 20 bp, mouse
gtggagactgactaacccta

SEQ ID NO: 415948 - DNA, 20 bp, mouse
gacgcagacccattctatgg

SEQ ID NO: 415949 - DNA, 20 bp, mouse
gcaagcgtatggcctggcag

SEQ ID NO: 415950 - DNA, 20 bp, mouse
gagaagacaattcaccagtc

SEQ ID NO: 415951 - DNA, 20 bp, mouse
gatacgcttgctggaggtca

SEQ ID NO: 415952 - DNA, 20 bp, mouse
ggaggggagcccccatagaa

SEQ ID NO: 415953 - DNA, 20 bp, mouse
gcacacgcagacccattcta

SEQ ID NO: 415954 - DNA, 20 bp, mouse
gaaaaaacggatcctgtgag

SEQ ID NO: 415955 - DNA, 20 bp, mouse
gacctgcccctgctgggtgc

SEQ ID NO: 415956 - DNA, 20 bp, mouse
gcctcaggcttgagtttcag

SEQ ID NO: 415957 - DNA, 20 bp, mouse
gagcctgaggaaatcgtctg

SEQ ID NO: 415958 - DNA, 20 bp, mouse
gtgtcctagtaggctcacct

SEQ ID NO: 415959 - DNA, 20 bp, mouse
gctcctcagacgatttcctc

SEQ ID NO: 415960 - DNA, 20 bp, mouse
gaagcaggcagatccctcag

SEQ ID NO: 415961 - DNA, 20 bp, mouse
gttgagtttcagaggatctt

SEQ ID NO: 415962 - DNA, 20 bp, mouse
gtagaggaactggggaggtt

SEQ ID NO: 415963 - DNA, 20 bp, mouse
gcagtgtagaggaactgggg

SEQ ID NO: 415964 - DNA, 20 bp, mouse
gacacccaggtgagcctact

SEQ ID NO: 415965 - DNA, 20 bp, mouse
gctcagatgtcaaggtctaa

SEQ ID NO: 415966 - DNA, 20 bp, mouse
gggtctttggtcctgtaggt

SEQ ID NO: 415967 - DNA, 20 bp, mouse
gagctgtctgaggtatacgg

SEQ ID NO: 415968 - DNA, 20 bp, mouse
gggacatgggcaggacatgg

SEQ ID NO: 415969 - DNA, 20 bp, mouse
gtatgcttgagccgggacat

SEQ ID NO: 415970 - DNA, 20 bp, mouse
ggcgtcctccgcctggcccc

SEQ ID NO: 415971 - DNA, 20 bp, mouse
gggaggcaggaactgcttga

SEQ ID NO: 415972 - DNA, 20 bp, mouse
gccgcctggcccccggtctt

SEQ ID NO: 415973 - DNA, 20 bp, mouse
gtgcagctgtctgaggtata

SEQ ID NO: 415974 - DNA, 20 bp, mouse
gttgcggaaaccatactccg

SEQ ID NO: 415975 - DNA, 20 bp, mouse
gagcataagcgtcctccgcc

SEQ ID NO: 415976 - DNA, 20 bp, mouse
ggactagacaggctgtacag

SEQ ID NO: 415977 - DNA, 20 bp, mouse
gagacaggctgtacagagga

SEQ ID NO: 415978 - DNA, 20 bp, mouse
gagtctaagactcccacagg

SEQ ID NO: 415979 - DNA, 20 bp, mouse
gtgggagtcttagactagac

SEQ ID NO: 415980 - DNA, 20 bp, mouse
gcagaggacggacgtagaat

SEQ ID NO: 415981 - DNA, 20 bp, mouse
gtgctgattagggctctccc

SEQ ID NO: 415982 - DNA, 20 bp, mouse
gtccagtaggtggcatacga

SEQ ID NO: 415983 - DNA, 20 bp, mouse
gaggaaagcagacccgaagg

SEQ ID NO: 415984 - DNA, 20 bp, mouse
gcaaaggaaagcagacccga

SEQ ID NO: 415985 - DNA, 20 bp, mouse
gagggtgcaaggcaagggac

SEQ ID NO: 415986 - DNA, 20 bp, mouse
gggaatttctccaccagaag

SEQ ID NO: 415987 - DNA, 20 bp, mouse
gctgaggacgacgcattccg

SEQ ID NO: 415988 - DNA, 20 bp, mouse
gtttggggtgaagcctcttc

SEQ ID NO: 415989 - DNA, 20 bp, mouse
gtcaccccaaaaaccatgtg

SEQ ID NO: 415990 - DNA, 20 bp, mouse
ggcatcagataagatgtgat

SEQ ID NO: 415991 - DNA, 20 bp, mouse
ggtctcctgggttcttgtct

SEQ ID NO: 415992 - DNA, 20 bp, mouse
gtacacccagacaagaaccc

SEQ ID NO: 415993 - DNA, 20 bp, mouse
gtttcctcacatggtttttg

SEQ ID NO: 415994 - DNA, 20 bp, mouse
gaaagctctcttgatatctg

SEQ ID NO: 415995 - DNA, 20 bp, mouse
gcaaagtactaggggtgcca

SEQ ID NO: 415996 - DNA, 20 bp, mouse
gagttcttaatatctactga

SEQ ID NO: 415997 - DNA, 20 bp, mouse
gtgtgacatcacctgggttg

SEQ ID NO: 415998 - DNA, 20 bp, mouse
ggaattcattagacatagac

SEQ ID NO: 415999 - DNA, 20 bp, mouse
gaatcttctgtgacatcacc

SEQ ID NO: 416000 - DNA, 20 bp, mouse
gctcagaaattctattctct

SEQ ID NO: 416001 - DNA, 20 bp, mouse
gggttacaacaacagcttgt

SEQ ID NO: 416002 - DNA, 20 bp, mouse
gtgccctgagaagggtctat

SEQ ID NO: 416003 - DNA, 20 bp, mouse
ggttgttgtaaccacaaccc

SEQ ID NO: 416004 - DNA, 20 bp, mouse
gttcaactccctacgaataa

SEQ ID NO: 416005 - DNA, 20 bp, mouse
gcaatgtgtcccttattcgt

SEQ ID NO: 416006 - DNA, 20 bp, mouse
ggcgtccggccttcctgcgg

SEQ ID NO: 416007 - DNA, 20 bp, mouse
gtctatgggagggcacggta

SEQ ID NO: 416008 - DNA, 20 bp, mouse
gcgggcgtccggccttcctg

SEQ ID NO: 416009 - DNA, 20 bp, mouse
gatagcggtcccgaggaagg

SEQ ID NO: 416010 - DNA, 20 bp, mouse
gtccccgcagaggactcacc

SEQ ID NO: 416011 - DNA, 20 bp, mouse
gacgcgggtgctgggataga

SEQ ID NO: 416012 - DNA, 20 bp, mouse
ggaaatagcggtcccgagga

SEQ ID NO: 416013 - DNA, 20 bp, mouse
gtccggccttcctgcggtgg

SEQ ID NO: 416014 - DNA, 20 bp, mouse
ggatgctgcgctccccgcag

SEQ ID NO: 416015 - DNA, 20 bp, mouse
gtgtcccggtgagtcctctg

SEQ ID NO: 416016 - DNA, 20 bp, mouse
ggaatcccagcaccaggtac

SEQ ID NO: 416017 - DNA, 20 bp, mouse
ggactctggggaatctggtg

SEQ ID NO: 416018 - DNA, 20 bp, mouse
gaaaaccaagaaccagtacc

SEQ ID NO: 416019 - DNA, 20 bp, mouse
gcttcaggccatacaagtct

SEQ ID NO: 416020 - DNA, 20 bp, mouse
gtggatgaactgggaaagtt

SEQ ID NO: 416021 - DNA, 20 bp, mouse
gatgcagtttggcctacttt

SEQ ID NO: 416022 - DNA, 20 bp, mouse
gtgctgacagccggactctg

SEQ ID NO: 416023 - DNA, 20 bp, mouse
gagaaccagtacctggtgct

SEQ ID NO: 416024 - DNA, 20 bp, mouse
gtccctccccacacccatgt

SEQ ID NO: 416025 - DNA, 20 bp, mouse
gcaggccatacaagtctagg

SEQ ID NO: 416026 - DNA, 20 bp, mouse
gagcaacgctggagtcacag

SEQ ID NO: 416027 - DNA, 20 bp, mouse
gggctggagggggccatgga

SEQ ID NO: 416028 - DNA, 20 bp, mouse
ggaagcagcagtaagtgcca

SEQ ID NO: 416029 - DNA, 20 bp, mouse
ggacactcctagctgccacg

SEQ ID NO: 416030 - DNA, 20 bp, mouse
gaaaatagaaagctgaaccc

SEQ ID NO: 416031 - DNA, 20 bp, mouse
ggctaggcgactgagagctc

SEQ ID NO: 416032 - DNA, 20 bp, mouse
ggactgagtgaggacaagag

SEQ ID NO: 416033 - DNA, 20 bp, mouse
ggagaggaagcaatgaacag

SEQ ID NO: 416034 - DNA, 20 bp, mouse
ggcccctttctagcaagaat

SEQ ID NO: 416035 - DNA, 20 bp, mouse
gctcctagctgccacgtggc

SEQ ID NO: 416036 - DNA, 20 bp, mouse
ggagaggcgagggggacacg

SEQ ID NO: 416037 - DNA, 20 bp, mouse
ggcagaaagcaagatgccgg

SEQ ID NO: 416038 - DNA, 20 bp, mouse
gcaaggagggagaggcgagg

SEQ ID NO: 416039 - DNA, 20 bp, mouse
gcagccgcacgccgcgccac

SEQ ID NO: 416040 - DNA, 20 bp, mouse
gggcgtgcggctgcactacc

SEQ ID NO: 416041 - DNA, 20 bp, mouse
gtggggataaaaggcaagga

SEQ ID NO: 416042 - DNA, 20 bp, mouse
ggggagcgatcccaacttcc

SEQ ID NO: 416043 - DNA, 20 bp, mouse
gtggccacggctggcacctg

SEQ ID NO: 416044 - DNA, 20 bp, mouse
gaagcaagatgccggtggcg

SEQ ID NO: 416045 - DNA, 20 bp, mouse
ggctgcactacccggaagtt

SEQ ID NO: 416046 - DNA, 20 bp, mouse
gctcctagagtcctcatgga

SEQ ID NO: 416047 - DNA, 20 bp, mouse
gaggactctaggagcacaag

SEQ ID NO: 416048 - DNA, 20 bp, mouse
gcacaagcggcgcaccactt

SEQ ID NO: 416049 - DNA, 20 bp, mouse
gtgtgctcctagagtcctca

SEQ ID NO: 416050 - DNA, 20 bp, mouse
gccagcgccgatggcgacgt

SEQ ID NO: 416051 - DNA, 20 bp, mouse
gcatcggcgctgggaccctg

SEQ ID NO: 416052 - DNA, 20 bp, mouse
gagtgagtgctggagcctcc

SEQ ID NO: 416053 - DNA, 20 bp, mouse
gaccctgccgctctgccggg

SEQ ID NO: 416054 - DNA, 20 bp, mouse
ggaccccacgagagcgcgaa

SEQ ID NO: 416055 - DNA, 20 bp, mouse
gcccacagcaaggtacaccg

SEQ ID NO: 416056 - DNA, 20 bp, mouse
gaccacagttggaggaaaac

SEQ ID NO: 416057 - DNA, 20 bp, mouse
gctccaactgtggtatgaag

SEQ ID NO: 416058 - DNA, 20 bp, mouse
ggtcatcaagttatagtgca

SEQ ID NO: 416059 - DNA, 20 bp, mouse
gcacaggttacggccatggt

SEQ ID NO: 416060 - DNA, 20 bp, mouse
gtcatgatgacaacttggtt

SEQ ID NO: 416061 - DNA, 20 bp, mouse
gatgaaggggttaatagctc

SEQ ID NO: 416062 - DNA, 20 bp, mouse
gtcaggtgtccagagagagc

SEQ ID NO: 416063 - DNA, 20 bp, mouse
gtgggatgtctgctactaca

SEQ ID NO: 416064 - DNA, 20 bp, mouse
ggacataaaccagctctctc

SEQ ID NO: 416065 - DNA, 20 bp, mouse
gcaagcacaggttacggcca

SEQ ID NO: 416066 - DNA, 20 bp, mouse
ggcttctcagctctgctacc

SEQ ID NO: 416067 - DNA, 20 bp, mouse
ggccatccaaacagccagcc

SEQ ID NO: 416068 - DNA, 20 bp, mouse
gggttctgaacgacagttaa

SEQ ID NO: 416069 - DNA, 20 bp, mouse
gtgaacgacagttaagggag

SEQ ID NO: 416070 - DNA, 20 bp, mouse
ggatgctcaaataaccaagt

SEQ ID NO: 416071 - DNA, 20 bp, mouse
gtgctacctggctggctgtt

SEQ ID NO: 416072 - DNA, 20 bp, mouse
gttgttcctgaaacacaaat

SEQ ID NO: 416073 - DNA, 20 bp, mouse
gtggctgtttggatggctgc

SEQ ID NO: 416074 - DNA, 20 bp, mouse
ggaatcgtcacgaaagttga

SEQ ID NO: 416075 - DNA, 20 bp, mouse
ggacactgtagataccaact

SEQ ID NO: 416076 - DNA, 20 bp, mouse
gtgtgctagatagatgctct

SEQ ID NO: 416077 - DNA, 20 bp, mouse
gttgaagacaaaggctgtgt

SEQ ID NO: 416078 - DNA, 20 bp, mouse
gtttgtgccattgaagacaa

SEQ ID NO: 416079 - DNA, 20 bp, mouse
ggattggagaaggctcctat

SEQ ID NO: 416080 - DNA, 20 bp, mouse
gcacttgaacactaccccat

SEQ ID NO: 416081 - DNA, 20 bp, mouse
gacttgatgaggctcgagag

SEQ ID NO: 416082 - DNA, 20 bp, mouse
ggtcaaggctgggagtctac

SEQ ID NO: 416083 - DNA, 20 bp, mouse
gaaggctgggagtctacagg

SEQ ID NO: 416084 - DNA, 20 bp, mouse
gtcagatcgtggccatcaag

SEQ ID NO: 416085 - DNA, 20 bp, mouse
gctcgagcctcatcaagtaa

SEQ ID NO: 416086 - DNA, 20 bp, mouse
gtcacatacaggatggtcac

SEQ ID NO: 416087 - DNA, 20 bp, mouse
gtcacatctcacatacagga

SEQ ID NO: 416088 - DNA, 20 bp, mouse
gttggtcacatctcacatac

SEQ ID NO: 416089 - DNA, 20 bp, mouse
gaaaatatgttgtattatta

SEQ ID NO: 416090 - DNA, 20 bp, mouse
gtggtggcatatttggacaa

SEQ ID NO: 416091 - DNA, 20 bp, mouse
ggtccaaatatgccaccaga

SEQ ID NO: 416092 - DNA, 20 bp, mouse
gttaacttaaggaatcagat

SEQ ID NO: 416093 - DNA, 20 bp, mouse
gatatgccaccagagggcac

SEQ ID NO: 416094 - DNA, 20 bp, mouse
gcatatttggacaatggcat

SEQ ID NO: 416095 - DNA, 20 bp, mouse
gaacccttggagaagacaca

SEQ ID NO: 416096 - DNA, 20 bp, mouse
gctggaaacagaccatcctg

SEQ ID NO: 416097 - DNA, 20 bp, mouse
gaaggtgagctctaacaagt

SEQ ID NO: 416098 - DNA, 20 bp, mouse
gtctttctacccagtaacta

SEQ ID NO: 416099 - DNA, 20 bp, mouse
ggaccatcctggggcagaga

SEQ ID NO: 416100 - DNA, 20 bp, mouse
gagagctcaccttagttact

SEQ ID NO: 416101 - DNA, 20 bp, mouse
gttggtgtctgagggaggaa

SEQ ID NO: 416102 - DNA, 20 bp, mouse
ggaacagagttggtgtctga

SEQ ID NO: 416103 - DNA, 20 bp, mouse
gcaaataaatgactaaatga

SEQ ID NO: 416104 - DNA, 20 bp, mouse
gaaagggccttggaatttga

SEQ ID NO: 416105 - DNA, 20 bp, mouse
gaatatgagagtatgtaaaa

SEQ ID NO: 416106 - DNA, 20 bp, mouse
gaggctacctgagatacata

SEQ ID NO: 416107 - DNA, 20 bp, mouse
gtctcaggtagcctccaact

SEQ ID NO: 416108 - DNA, 20 bp, mouse
gttcagctatatagccaagt

SEQ ID NO: 416109 - DNA, 20 bp, mouse
gacctgagatacataaggcc

SEQ ID NO: 416110 - DNA, 20 bp, mouse
gcactctgtcaacagggcta

SEQ ID NO: 416111 - DNA, 20 bp, mouse
gtgtctcctcatatgtagag

SEQ ID NO: 416112 - DNA, 20 bp, mouse
gtagttctctgaaaaggtta

SEQ ID NO: 416113 - DNA, 20 bp, mouse
gtttttgtcacaggggtcct

SEQ ID NO: 416114 - DNA, 20 bp, mouse
ggggctagggctttagctct

SEQ ID NO: 416115 - DNA, 20 bp, mouse
gtctgagatacaggcttgtc

SEQ ID NO: 416116 - DNA, 20 bp, mouse
gcggttcacgtccagtcgga

SEQ ID NO: 416117 - DNA, 20 bp, mouse
gtgtgtctaggtgagctgag

SEQ ID NO: 416118 - DNA, 20 bp, mouse
gagtcggagggcagtggacc

SEQ ID NO: 416119 - DNA, 20 bp, mouse
gtgagcggttcacgtccagt

SEQ ID NO: 416120 - DNA, 20 bp, mouse
gcagctcacctagacacagt

SEQ ID NO: 416121 - DNA, 20 bp, mouse
gcatcccagccgaccagtga

SEQ ID NO: 416122 - DNA, 20 bp, mouse
gcatatcacttggccctcac

SEQ ID NO: 416123 - DNA, 20 bp, mouse
ggtgcgcctgcccatcgcca

SEQ ID NO: 416124 - DNA, 20 bp, mouse
gtgttctgtacagtcttcaa

SEQ ID NO: 416125 - DNA, 20 bp, mouse
gcgatgggcaggcgcacgcc

SEQ ID NO: 416126 - DNA, 20 bp, mouse
gaaggggacagtgggcttaa

SEQ ID NO: 416127 - DNA, 20 bp, mouse
ggtctggtgaagagggtacc

SEQ ID NO: 416128 - DNA, 20 bp, mouse
ggcctcagttatctggacac

SEQ ID NO: 416129 - DNA, 20 bp, mouse
ggcacctgcatagagtctag

SEQ ID NO: 416130 - DNA, 20 bp, mouse
gtactggggcctcagttatc

SEQ ID NO: 416131 - DNA, 20 bp, mouse
gattatagagaagcgtactg

SEQ ID NO: 416132 - DNA, 20 bp, mouse
ggattcgaaggtgaccgact

SEQ ID NO: 416133 - DNA, 20 bp, mouse
gttaagcatgtctggtgaag

SEQ ID NO: 416134 - DNA, 20 bp, mouse
gactagaatttaagcatgtc

SEQ ID NO: 416135 - DNA, 20 bp, mouse
ggaccgactgggcaagtgtg

SEQ ID NO: 416136 - DNA, 20 bp, mouse
gcccgctccgactccccggg

SEQ ID NO: 416137 - DNA, 20 bp, mouse
gcgatcttcgaggccctgga

SEQ ID NO: 416138 - DNA, 20 bp, mouse
gagccccgctccgactcccc

SEQ ID NO: 416139 - DNA, 20 bp, mouse
gccgacgcgctcaccctcca

SEQ ID NO: 416140 - DNA, 20 bp, mouse
ggctccgactccccgggcgg

SEQ ID NO: 416141 - DNA, 20 bp, mouse
gctgccgccgcccggggagt

SEQ ID NO: 416142 - DNA, 20 bp, mouse
gggtgcgtgttgaagaactg

SEQ ID NO: 416143 - DNA, 20 bp, mouse
gaagatcgcctgcgccatct

SEQ ID NO: 416144 - DNA, 20 bp, mouse
ggcaagcattgtgagaaccg

SEQ ID NO: 416145 - DNA, 20 bp, mouse
gatggcgcaggcgatcttcg

SEQ ID NO: 416146 - DNA, 20 bp, mouse
ggagaacagaaagagatttc

SEQ ID NO: 416147 - DNA, 20 bp, mouse
gactagactgtctcaccatt

SEQ ID NO: 416148 - DNA, 20 bp, mouse
gaatgaatttgagttctctt

SEQ ID NO: 416149 - DNA, 20 bp, mouse
gtggggaccaccagtttctt

SEQ ID NO: 416150 - DNA, 20 bp, mouse
gaagtcatgtgacagagttc

SEQ ID NO: 416151 - DNA, 20 bp, mouse
gagtagaaattgtaacattt

SEQ ID NO: 416152 - DNA, 20 bp, mouse
ggtcacatgacttcacctaa

SEQ ID NO: 416153 - DNA, 20 bp, mouse
ggttgagagcaagagaaaga

SEQ ID NO: 416154 - DNA, 20 bp, mouse
gcaaaaaaaaagacagagag

SEQ ID NO: 416155 - DNA, 20 bp, mouse
ggcacctgggaggcggggtc

SEQ ID NO: 416156 - DNA, 20 bp, mouse
gggagcaagcggcagagcaa

SEQ ID NO: 416157 - DNA, 20 bp, mouse
gaagcggcagagcaatggca

SEQ ID NO: 416158 - DNA, 20 bp, mouse
gcaatggcaggggagtggtg

SEQ ID NO: 416159 - DNA, 20 bp, mouse
ggacagagagcagtgaacag

SEQ ID NO: 416160 - DNA, 20 bp, mouse
gtgagcggcgcaaactgctg

SEQ ID NO: 416161 - DNA, 20 bp, mouse
gcggcgcaaactgctggggt

SEQ ID NO: 416162 - DNA, 20 bp, mouse
ggtttgcgccgctcagaccc

SEQ ID NO: 416163 - DNA, 20 bp, mouse
ggtctttcccgaaactgctt

SEQ ID NO: 416164 - DNA, 20 bp, mouse
gatgccactgaatgctgttt

SEQ ID NO: 416165 - DNA, 20 bp, mouse
ggcagattcccaagcagttt

SEQ ID NO: 416166 - DNA, 20 bp, mouse
gccaggtcccgggagagagg

SEQ ID NO: 416167 - DNA, 20 bp, mouse
gctagtttaaggtaggagtt

SEQ ID NO: 416168 - DNA, 20 bp, mouse
ggtgcctcctagtttaaggt

SEQ ID NO: 416169 - DNA, 20 bp, mouse
gcactggccgggagacccgg

SEQ ID NO: 416170 - DNA, 20 bp, mouse
gggacactggccgggagacc

SEQ ID NO: 416171 - DNA, 20 bp, mouse
gcccgggacctggcagtggg

SEQ ID NO: 416172 - DNA, 20 bp, mouse
gacccgcgctgcgtgtgctg

SEQ ID NO: 416173 - DNA, 20 bp, mouse
gcggtgctctgaagtgactt

SEQ ID NO: 416174 - DNA, 20 bp, mouse
gtgaagtgacttgggcacaa

SEQ ID NO: 416175 - DNA, 20 bp, mouse
gacctcagccagggacgcag

SEQ ID NO: 416176 - DNA, 20 bp, mouse
gcggagccggcctgagcaca

SEQ ID NO: 416177 - DNA, 20 bp, mouse
gcatctctcggcctcctgtc

SEQ ID NO: 416178 - DNA, 20 bp, mouse
gctcctgtcgggcaacctgc

SEQ ID NO: 416179 - DNA, 20 bp, mouse
gcgggcaacctgcgggacct

SEQ ID NO: 416180 - DNA, 20 bp, mouse
gacctgcgggacctcggagc

SEQ ID NO: 416181 - DNA, 20 bp, mouse
ggccggctccgaggtcccgc

SEQ ID NO: 416182 - DNA, 20 bp, mouse
ggcggctgggcaccatctct

SEQ ID NO: 416183 - DNA, 20 bp, mouse
gcggcctgagcacagggcgt

SEQ ID NO: 416184 - DNA, 20 bp, mouse
ggcagcgcaagcaggtggca

SEQ ID NO: 416185 - DNA, 20 bp, mouse
gcaccccacgccctgtgctc

SEQ ID NO: 416186 - DNA, 20 bp, mouse
gtcggaggagcagttcggag

SEQ ID NO: 416187 - DNA, 20 bp, mouse
gctatgtcggaggagcagtt

SEQ ID NO: 416188 - DNA, 20 bp, mouse
gggcagtagcactatgtcgg

SEQ ID NO: 416189 - DNA, 20 bp, mouse
gcggcaacggcggcggtagg

SEQ ID NO: 416190 - DNA, 20 bp, mouse
gtcgcgaggcaccctagaca

SEQ ID NO: 416191 - DNA, 20 bp, mouse
gggagcagttcggaggggac

SEQ ID NO: 416192 - DNA, 20 bp, mouse
gcgcgctgcgcgagagtggg

SEQ ID NO: 416193 - DNA, 20 bp, mouse
gggcgcgcgcgtggctgcaa

SEQ ID NO: 416194 - DNA, 20 bp, mouse
gacggcggcggtaggcggct

SEQ ID NO: 416195 - DNA, 20 bp, mouse
gcacgcgcgcgccttgtcta

SEQ ID NO: 416196 - DNA, 20 bp, mouse
gaagactaatgaaatacacg

SEQ ID NO: 416197 - DNA, 20 bp, mouse
gataacagtgtgggtatcat

SEQ ID NO: 416198 - DNA, 20 bp, mouse
ggtcagtaattcacaagttc

SEQ ID NO: 416199 - DNA, 20 bp, mouse
gagtgtcactactatcctga

SEQ ID NO: 416200 - DNA, 20 bp, mouse
gcagtctcatttaatatata

SEQ ID NO: 416201 - DNA, 20 bp, mouse
ggtctttaatatcttaagac

SEQ ID NO: 416202 - DNA, 20 bp, mouse
gggcctctgacatataggtt

SEQ ID NO: 416203 - DNA, 20 bp, mouse
gcagttagttatacagtgca

SEQ ID NO: 416204 - DNA, 20 bp, mouse
gaacctactttaaacccctc

SEQ ID NO: 416205 - DNA, 20 bp, mouse
gaatgagactgataacagtg

SEQ ID NO: 416206 - DNA, 20 bp, mouse
ggattcttactcaccagtct

SEQ ID NO: 416207 - DNA, 20 bp, mouse
gacactcatgttaagcaggt

SEQ ID NO: 416208 - DNA, 20 bp, mouse
ggactaccagctcagtctgg

SEQ ID NO: 416209 - DNA, 20 bp, mouse
gtctgactaccagctcagtc

SEQ ID NO: 416210 - DNA, 20 bp, mouse
ggtactcctccagactgagc

SEQ ID NO: 416211 - DNA, 20 bp, mouse
gatgagtgtggtaatggatg

SEQ ID NO: 416212 - DNA, 20 bp, mouse
ggtgtggtaatggatgagga

SEQ ID NO: 416213 - DNA, 20 bp, mouse
gtaccacactcatgttaagc

SEQ ID NO: 416214 - DNA, 20 bp, mouse
gggttggcaccagcccagac

SEQ ID NO: 416215 - DNA, 20 bp, mouse
ggtaatggatgaggatgggt

SEQ ID NO: 416216 - DNA, 20 bp, mouse
ggaaacggcagaaagtatga

SEQ ID NO: 416217 - DNA, 20 bp, mouse
gatctaggcctccccatccc

SEQ ID NO: 416218 - DNA, 20 bp, mouse
gacctaccagctcaacatct

SEQ ID NO: 416219 - DNA, 20 bp, mouse
ggaagtcaggagcttcaact

SEQ ID NO: 416220 - DNA, 20 bp, mouse
gctaggcaacatagtcacta

SEQ ID NO: 416221 - DNA, 20 bp, mouse
gtactttctgccgtttcggt

SEQ ID NO: 416222 - DNA, 20 bp, mouse
gtgggtgagaagtagagaca

SEQ ID NO: 416223 - DNA, 20 bp, mouse
gtcctggcctatctccttat

SEQ ID NO: 416224 - DNA, 20 bp, mouse
gaagaagaatggctcagaga

SEQ ID NO: 416225 - DNA, 20 bp, mouse
gcgtttcggtgggaagtctt

SEQ ID NO: 416226 - DNA, 20 bp, mouse
gctggagctgcgggtgaggt

SEQ ID NO: 416227 - DNA, 20 bp, mouse
ggctgcgccgcagggatata

SEQ ID NO: 416228 - DNA, 20 bp, mouse
ggctgcgggtgaggtgggta

SEQ ID NO: 416229 - DNA, 20 bp, mouse
gccagagccctatatccctg

SEQ ID NO: 416230 - DNA, 20 bp, mouse
gactgtgtgcgcgtcctctg

SEQ ID NO: 416231 - DNA, 20 bp, mouse
gcgcatcccggagatagacc

SEQ ID NO: 416232 - DNA, 20 bp, mouse
gaggccgtggcacctttgag

SEQ ID NO: 416233 - DNA, 20 bp, mouse
gttcaggtgtagaaactccg

SEQ ID NO: 416234 - DNA, 20 bp, mouse
gcttgctggagctgcgggtg

SEQ ID NO: 416235 - DNA, 20 bp, mouse
gtatagggctctggcggcga

SEQ ID NO: 416236 - DNA, 20 bp, mouse
gtggccaggaatgaacccta

SEQ ID NO: 416237 - DNA, 20 bp, mouse
gcttccatttactagaccag

SEQ ID NO: 416238 - DNA, 20 bp, mouse
gccaaggatgatgctccata

SEQ ID NO: 416239 - DNA, 20 bp, mouse
gtttactagaccaggggcag

SEQ ID NO: 416240 - DNA, 20 bp, mouse
gttcataaagaagtacagtt

SEQ ID NO: 416241 - DNA, 20 bp, mouse
gtagaccaggggcagtggcc

SEQ ID NO: 416242 - DNA, 20 bp, mouse
gtacagttgggcagcaagag

SEQ ID NO: 416243 - DNA, 20 bp, mouse
gcagcaagagcggtgtttgg

SEQ ID NO: 416244 - DNA, 20 bp, mouse
ggctccatagggttcattcc

SEQ ID NO: 416245 - DNA, 20 bp, mouse
gtccgagtagaacccagaac

SEQ ID NO: 416246 - DNA, 20 bp, mouse
ggggtgtgatgtgacctgag

SEQ ID NO: 416247 - DNA, 20 bp, mouse
ggacctgagaggacatggaa

SEQ ID NO: 416248 - DNA, 20 bp, mouse
gggcgtcagtagtagaaata

SEQ ID NO: 416249 - DNA, 20 bp, mouse
gaggacatggaaaggatcca

SEQ ID NO: 416250 - DNA, 20 bp, mouse
gggccacgggcaaaaagaaa

SEQ ID NO: 416251 - DNA, 20 bp, mouse
gaccagataccagtggccac

SEQ ID NO: 416252 - DNA, 20 bp, mouse
gaggcaggtggacagcaaga

SEQ ID NO: 416253 - DNA, 20 bp, mouse
gatgatagaccagataccag

SEQ ID NO: 416254 - DNA, 20 bp, mouse
gtatgctgtgaccacagatg

SEQ ID NO: 416255 - DNA, 20 bp, mouse
ggtcttgactctgacctctc

SEQ ID NO: 416256 - DNA, 20 bp, mouse
gacaagggcagcgaccagaa

SEQ ID NO: 416257 - DNA, 20 bp, mouse
ggaagggaggagttctaggg

SEQ ID NO: 416258 - DNA, 20 bp, mouse
gagggcagcgaccagaaggg

SEQ ID NO: 416259 - DNA, 20 bp, mouse
ggtgggccgggcaaaaccaa

SEQ ID NO: 416260 - DNA, 20 bp, mouse
gggagttctagggcggtgac

SEQ ID NO: 416261 - DNA, 20 bp, mouse
gggcctccgagggtcgaggg

SEQ ID NO: 416262 - DNA, 20 bp, mouse
gaggaggcctgagagggtgg

SEQ ID NO: 416263 - DNA, 20 bp, mouse
ggccccataagcaggatcct

SEQ ID NO: 416264 - DNA, 20 bp, mouse
gcaggtggcgggtgcccagg

SEQ ID NO: 416265 - DNA, 20 bp, mouse
gccctcggaggcccaggtcg

SEQ ID NO: 416266 - DNA, 20 bp, mouse
gagtggggaatgcttacctg

SEQ ID NO: 416267 - DNA, 20 bp, mouse
gacattcctaggtgatgctg

SEQ ID NO: 416268 - DNA, 20 bp, mouse
gctggggatcaaacattcct

SEQ ID NO: 416269 - DNA, 20 bp, mouse
ggctttcccgctgccttttg

SEQ ID NO: 416270 - DNA, 20 bp, mouse
ggagctcccaggtcccgctg

SEQ ID NO: 416271 - DNA, 20 bp, mouse
ggccagctcctgcacagacc

SEQ ID NO: 416272 - DNA, 20 bp, mouse
gtacccggacaacctgcggg

SEQ ID NO: 416273 - DNA, 20 bp, mouse
gggtgacagtgtgtgcgatg

SEQ ID NO: 416274 - DNA, 20 bp, mouse
gagatgagggtgcatcgatg

SEQ ID NO: 416275 - DNA, 20 bp, mouse
gctgtgggcccaccccatgt

SEQ ID NO: 416276 - DNA, 20 bp, mouse
gtgctggagctgacccacaa

SEQ ID NO: 416277 - DNA, 20 bp, mouse
ggcaagctagaagcagaatt

SEQ ID NO: 416278 - DNA, 20 bp, mouse
gaacagcagcttcttctccc

SEQ ID NO: 416279 - DNA, 20 bp, mouse
gaggagtcgctgctgtcccg

SEQ ID NO: 416280 - DNA, 20 bp, mouse
ggttatgtagaagtcctttg

SEQ ID NO: 416281 - DNA, 20 bp, mouse
gttcttctccctggaagtgc

SEQ ID NO: 416282 - DNA, 20 bp, mouse
gctagaagcagaattaggtc

SEQ ID NO: 416283 - DNA, 20 bp, mouse
gggctgggattccttgatct

SEQ ID NO: 416284 - DNA, 20 bp, mouse
gtgtgcaggggtgtcatggg

SEQ ID NO: 416285 - DNA, 20 bp, mouse
ggcaatgggtgggtatttca

SEQ ID NO: 416286 - DNA, 20 bp, mouse
gccaggctcgctgcatgacg

SEQ ID NO: 416287 - DNA, 20 bp, mouse
gggctcgctgcatgacgggg

SEQ ID NO: 416288 - DNA, 20 bp, mouse
ggcgcgggggcgcagttcta

SEQ ID NO: 416289 - DNA, 20 bp, mouse
gcggaggagacgaaccggag

SEQ ID NO: 416290 - DNA, 20 bp, mouse
gtgacggggcggcggcgtcg

SEQ ID NO: 416291 - DNA, 20 bp, mouse
gagcgacggaggagacgaac

SEQ ID NO: 416292 - DNA, 20 bp, mouse
gtcgctgcatgacggggcgg

SEQ ID NO: 416293 - DNA, 20 bp, mouse
gacgcccgaggaggaagcgt

SEQ ID NO: 416294 - DNA, 20 bp, mouse
ggggtgaagaacgatgtggt

SEQ ID NO: 416295 - DNA, 20 bp, mouse
gcgggggcgcagttctatgg

SEQ ID NO: 416296 - DNA, 20 bp, mouse
gaagtggtagacccacagca

SEQ ID NO: 416297 - DNA, 20 bp, mouse
gcatctgttgcggacatgaa

SEQ ID NO: 416298 - DNA, 20 bp, mouse
gaggctgtaaggccacctgg

SEQ ID NO: 416299 - DNA, 20 bp, mouse
ggttccagggaagatagaag

SEQ ID NO: 416300 - DNA, 20 bp, mouse
gccagggaagatagaagtgg

SEQ ID NO: 416301 - DNA, 20 bp, mouse
gcacccagaaggccacccta

SEQ ID NO: 416302 - DNA, 20 bp, mouse
gacagatggtatatgcagaa

SEQ ID NO: 416303 - DNA, 20 bp, mouse
ggcggccacagcaagttcca

SEQ ID NO: 416304 - DNA, 20 bp, mouse
ggcagggtgtccaaattgct

SEQ ID NO: 416305 - DNA, 20 bp, mouse
ggaggagcaagggtagtgag

SEQ ID NO: 416306 - DNA, 20 bp, mouse
gagaggtggtggctcaggat

SEQ ID NO: 416307 - DNA, 20 bp, mouse
gagtgttggaaggccggtgg

SEQ ID NO: 416308 - DNA, 20 bp, mouse
gaggctctcagactacaccc

SEQ ID NO: 416309 - DNA, 20 bp, mouse
ggaaggccggtggcggaggg

SEQ ID NO: 416310 - DNA, 20 bp, mouse
gtcctgcctccctccgccac

SEQ ID NO: 416311 - DNA, 20 bp, mouse
ggcagtagcaaaaacatcct

SEQ ID NO: 416312 - DNA, 20 bp, mouse
gttggaaggccggtggcgga

SEQ ID NO: 416313 - DNA, 20 bp, mouse
gctgtggtctgagaagtccc

SEQ ID NO: 416314 - DNA, 20 bp, mouse
gctaggcaatggctgccatc

SEQ ID NO: 416315 - DNA, 20 bp, mouse
gctgtgggcacgtaaacctc

SEQ ID NO: 416316 - DNA, 20 bp, mouse
ggcttgatgaaactccctca

SEQ ID NO: 416317 - DNA, 20 bp, mouse
gtgatgaaactccctcaggg

SEQ ID NO: 416318 - DNA, 20 bp, mouse
ggaaactccctcagggaggt

SEQ ID NO: 416319 - DNA, 20 bp, mouse
gtcatcaagccgaagctggg

SEQ ID NO: 416320 - DNA, 20 bp, mouse
gatgcgcacccacccagctt

SEQ ID NO: 416321 - DNA, 20 bp, mouse
gtgagctgacttgtaagaga

SEQ ID NO: 416322 - DNA, 20 bp, mouse
ggtgggatgaagttctgcaa

SEQ ID NO: 416323 - DNA, 20 bp, mouse
gccgggaccacaggatatcg

SEQ ID NO: 416324 - DNA, 20 bp, mouse
gtatcctgtggtcccggagg

SEQ ID NO: 416325 - DNA, 20 bp, mouse
gggcgtggcagcagtctgga

SEQ ID NO: 416326 - DNA, 20 bp, mouse
gctttggtcgagagtgaacg

SEQ ID NO: 416327 - DNA, 20 bp, mouse
gtcgagagtgaacggggtga

SEQ ID NO: 416328 - DNA, 20 bp, mouse
gcatttgataggcacctctt

SEQ ID NO: 416329 - DNA, 20 bp, mouse
gaactcagcaaagtagacca

SEQ ID NO: 416330 - DNA, 20 bp, mouse
gggtcacttcacaacactga

SEQ ID NO: 416331 - DNA, 20 bp, mouse
gatggtgacaatggtaacta

SEQ ID NO: 416332 - DNA, 20 bp, mouse
gagaccagggttacacacac

SEQ ID NO: 416333 - DNA, 20 bp, mouse
gaatggtaactatggagatg

SEQ ID NO: 416334 - DNA, 20 bp, mouse
gtcccttaggccattgatcc

SEQ ID NO: 416335 - DNA, 20 bp, mouse
ggtgtggcttcctggatcaa

SEQ ID NO: 416336 - DNA, 20 bp, mouse
ggctagaggaaggttgccag

SEQ ID NO: 416337 - DNA, 20 bp, mouse
gagcatcaggctccagctag

SEQ ID NO: 416338 - DNA, 20 bp, mouse
gtcaggctccagctagagga

SEQ ID NO: 416339 - DNA, 20 bp, mouse
gacacggaggcgttcctcat

SEQ ID NO: 416340 - DNA, 20 bp, mouse
ggagagtctaaagacagtaa

SEQ ID NO: 416341 - DNA, 20 bp, mouse
gatcttcagggcatccacgt

SEQ ID NO: 416342 - DNA, 20 bp, mouse
gaaacagctggcagacacgg

SEQ ID NO: 416343 - DNA, 20 bp, mouse
gcagaagagacaggcccacg

SEQ ID NO: 416344 - DNA, 20 bp, mouse
gtggcccagccacaaattta

SEQ ID NO: 416345 - DNA, 20 bp, mouse
gggtgggacagagaccaatg

SEQ ID NO: 416346 - DNA, 20 bp, mouse
gagcagatcggacttctcag

SEQ ID NO: 416347 - DNA, 20 bp, mouse
ggaaggttctaagagcagat

SEQ ID NO: 416348 - DNA, 20 bp, mouse
gctggaaaagttgctgttgt

SEQ ID NO: 416349 - DNA, 20 bp, mouse
gggggtccatctgtaagggg

SEQ ID NO: 416350 - DNA, 20 bp, mouse
gcccaggggtccatctgtaa

SEQ ID NO: 416351 - DNA, 20 bp, mouse
gcttagtacacaggtacgaa

SEQ ID NO: 416352 - DNA, 20 bp, mouse
gcactgcactgtggattccc

SEQ ID NO: 416353 - DNA, 20 bp, mouse
gtgtactaagaggagtctca

SEQ ID NO: 416354 - DNA, 20 bp, mouse
ggtttccaactgagccagag

SEQ ID NO: 416355 - DNA, 20 bp, mouse
gatgcagatgagacaaaaag

SEQ ID NO: 416356 - DNA, 20 bp, mouse
gtgtctcttcagtcctatca

SEQ ID NO: 416357 - DNA, 20 bp, mouse
gacatatgcgtaagaaagaa

SEQ ID NO: 416358 - DNA, 20 bp, mouse
gtacacttggactgaatata

SEQ ID NO: 416359 - DNA, 20 bp, mouse
gtaactgaacttagattatt

SEQ ID NO: 416360 - DNA, 20 bp, mouse
gtgattatagtcactgacaa

SEQ ID NO: 416361 - DNA, 20 bp, mouse
ggactgagagtatgaacaga

SEQ ID NO: 416362 - DNA, 20 bp, mouse
gacaattgccagaaagcttg

SEQ ID NO: 416363 - DNA, 20 bp, mouse
ggttcagttacttttacact

SEQ ID NO: 416364 - DNA, 20 bp, mouse
gaaattttcaaaaaagaact

SEQ ID NO: 416365 - DNA, 20 bp, mouse
gaagaatggactcaagaaaa

SEQ ID NO: 416366 - DNA, 20 bp, mouse
gtagtacctaaggaatggga

SEQ ID NO: 416367 - DNA, 20 bp, mouse
gtgactggtgctagtaccta

SEQ ID NO: 416368 - DNA, 20 bp, mouse
ggtgctagtacctaaggaat

SEQ ID NO: 416369 - DNA, 20 bp, mouse
gtccaaccttcccattcctt

SEQ ID NO: 416370 - DNA, 20 bp, mouse
gacctaaggaatgggaaggt

SEQ ID NO: 416371 - DNA, 20 bp, mouse
gatatagtggtaggccaggg

SEQ ID NO: 416372 - DNA, 20 bp, mouse
ggaatgggatgtaggaggag

SEQ ID NO: 416373 - DNA, 20 bp, mouse
gtagtagctgaatgggatgt

SEQ ID NO: 416374 - DNA, 20 bp, mouse
gatgggacttcgcacagctg

SEQ ID NO: 416375 - DNA, 20 bp, mouse
gaggatatagtggtaggcca

SEQ ID NO: 416376 - DNA, 20 bp, mouse
gcagtcccctccataacagg

SEQ ID NO: 416377 - DNA, 20 bp, mouse
gagaagaagcaaggaacccg

SEQ ID NO: 416378 - DNA, 20 bp, mouse
gattagttcccccaacatcg

SEQ ID NO: 416379 - DNA, 20 bp, mouse
gtcttctgaggagtctccac

SEQ ID NO: 416380 - DNA, 20 bp, mouse
gccctctgtgccacgatgtt

SEQ ID NO: 416381 - DNA, 20 bp, mouse
gaatgcctcctgttatggag

SEQ ID NO: 416382 - DNA, 20 bp, mouse
gatcgtggcacagaggggca

SEQ ID NO: 416383 - DNA, 20 bp, mouse
gcacagaggggcaaggcccc

SEQ ID NO: 416384 - DNA, 20 bp, mouse
gtatggaggggactgaagca

SEQ ID NO: 416385 - DNA, 20 bp, mouse
gagtgtgggagagtctagta

SEQ ID NO: 416386 - DNA, 20 bp, mouse
gagcggagagcgacagagat

SEQ ID NO: 416387 - DNA, 20 bp, mouse
gaccagacaccagagcagaa

SEQ ID NO: 416388 - DNA, 20 bp, mouse
gacagagattggcaagtcaa

SEQ ID NO: 416389 - DNA, 20 bp, mouse
gaccagagcagaaaggagct

SEQ ID NO: 416390 - DNA, 20 bp, mouse
gagctgcagctcctgagtta

SEQ ID NO: 416391 - DNA, 20 bp, mouse
gagttagggcgaggctggag

SEQ ID NO: 416392 - DNA, 20 bp, mouse
gcagctcctgagttagggcg

SEQ ID NO: 416393 - DNA, 20 bp, mouse
gagcaactgtgccaggagag

SEQ ID NO: 416394 - DNA, 20 bp, mouse
gggaaacccaatgcgagagg

SEQ ID NO: 416395 - DNA, 20 bp, mouse
gactgactaagtcgttacca

SEQ ID NO: 416396 - DNA, 20 bp, mouse
ggtcttcgttcagctgaagg

SEQ ID NO: 416397 - DNA, 20 bp, mouse
ggaacgaagacgtctgcacc

SEQ ID NO: 416398 - DNA, 20 bp, mouse
gcggctatctgaagaaagta

SEQ ID NO: 416399 - DNA, 20 bp, mouse
gagcagcagggctctagtga

SEQ ID NO: 416400 - DNA, 20 bp, mouse
gcttaccttcaagcaccaca

SEQ ID NO: 416401 - DNA, 20 bp, mouse
gaaagggagggaggcatacc

SEQ ID NO: 416402 - DNA, 20 bp, mouse
gaaagtaaggaatcgaagcc

SEQ ID NO: 416403 - DNA, 20 bp, mouse
gcaggccctgtggtgcttga

SEQ ID NO: 416404 - DNA, 20 bp, mouse
gcagctgaaggaggcattgc

SEQ ID NO: 416405 - DNA, 20 bp, mouse
gcgaaacggaagtcactata

SEQ ID NO: 416406 - DNA, 20 bp, mouse
gggcaggcagcacctaaagg

SEQ ID NO: 416407 - DNA, 20 bp, mouse
gggtagacaagttattagag

SEQ ID NO: 416408 - DNA, 20 bp, mouse
gatgggcaggcagcacctaa

SEQ ID NO: 416409 - DNA, 20 bp, mouse
gaacaggaggaacccacgat

SEQ ID NO: 416410 - DNA, 20 bp, mouse
gtgagagatgtgagttctgg

SEQ ID NO: 416411 - DNA, 20 bp, mouse
gggtgctgcctgcccatcgt

SEQ ID NO: 416412 - DNA, 20 bp, mouse
ggtagcagggcacctggcag

SEQ ID NO: 416413 - DNA, 20 bp, mouse
gagaaactctggcagctagt

SEQ ID NO: 416414 - DNA, 20 bp, mouse
gggaggaacccacgatgggc

SEQ ID NO: 416415 - DNA, 20 bp, mouse
gtggcagccactgttgaaag

SEQ ID NO: 416416 - DNA, 20 bp, mouse
gtggagacaggaaaacactg

SEQ ID NO: 416417 - DNA, 20 bp, mouse
gccgcataggggctctccca

SEQ ID NO: 416418 - DNA, 20 bp, mouse
ggagaggaaaggcacccgtg

SEQ ID NO: 416419 - DNA, 20 bp, mouse
gctttgggcgagaaagctgg

SEQ ID NO: 416420 - DNA, 20 bp, mouse
ggtgcggcgccagtgcctgt

SEQ ID NO: 416421 - DNA, 20 bp, mouse
gcggaccaatatgcacccac

SEQ ID NO: 416422 - DNA, 20 bp, mouse
gcgctacagtgacgtcatag

SEQ ID NO: 416423 - DNA, 20 bp, mouse
gtaggggctctcccacggtg

SEQ ID NO: 416424 - DNA, 20 bp, mouse
gaatatgcacccacaggcac

SEQ ID NO: 416425 - DNA, 20 bp, mouse
gggaaaaaagcgaaagtttc

SEQ ID NO: 416426 - DNA, 20 bp, mouse
ggaccagatgctgcaggagt

SEQ ID NO: 416427 - DNA, 20 bp, mouse
gaacatatccgggcacgggg

SEQ ID NO: 416428 - DNA, 20 bp, mouse
ggaggaatcagcgattgcta

SEQ ID NO: 416429 - DNA, 20 bp, mouse
gatggatagtcaaacatatc

SEQ ID NO: 416430 - DNA, 20 bp, mouse
gagtcaaacatatccgggca

SEQ ID NO: 416431 - DNA, 20 bp, mouse
gcgtggagtctatgaaagaa

SEQ ID NO: 416432 - DNA, 20 bp, mouse
gctactataaagctatacaa

SEQ ID NO: 416433 - DNA, 20 bp, mouse
ggtcttaggtggtaaaccta

SEQ ID NO: 416434 - DNA, 20 bp, mouse
gcaacttagacacgattcca

SEQ ID NO: 416435 - DNA, 20 bp, mouse
ggcatcttcctccccgtgcc

SEQ ID NO: 416436 - DNA, 20 bp, mouse
gcctagaagggtggatttgt

SEQ ID NO: 416437 - DNA, 20 bp, mouse
gccagagaaaccagcttaca

SEQ ID NO: 416438 - DNA, 20 bp, mouse
gtccccaccaaaactcctac

SEQ ID NO: 416439 - DNA, 20 bp, mouse
gggataggcacttcctagaa

SEQ ID NO: 416440 - DNA, 20 bp, mouse
gtaggcacttcctagaaggg

SEQ ID NO: 416441 - DNA, 20 bp, mouse
gataattgctcggtgagaag

SEQ ID NO: 416442 - DNA, 20 bp, mouse
gagaaaccagcttacaaggc

SEQ ID NO: 416443 - DNA, 20 bp, mouse
ggagaaaccataagtctttt

SEQ ID NO: 416444 - DNA, 20 bp, mouse
gtgcctgtaggagttttggt

SEQ ID NO: 416445 - DNA, 20 bp, mouse
gcctgtgcctgtaggagttt

SEQ ID NO: 416446 - DNA, 20 bp, mouse
gggcagaccccagatcagaa

SEQ ID NO: 416447 - DNA, 20 bp, mouse
gagcgttgctccctcttcag

SEQ ID NO: 416448 - DNA, 20 bp, mouse
gaagggagactgaactgaat

SEQ ID NO: 416449 - DNA, 20 bp, mouse
gtgaataggaaacatcaatc

SEQ ID NO: 416450 - DNA, 20 bp, mouse
ggcagctttgcccctgaaga

SEQ ID NO: 416451 - DNA, 20 bp, mouse
gcagtctcccttctgatctg

SEQ ID NO: 416452 - DNA, 20 bp, mouse
gtctatgaggcaccaagacc

SEQ ID NO: 416453 - DNA, 20 bp, mouse
gaacaggcgtagaagagttc

SEQ ID NO: 416454 - DNA, 20 bp, mouse
ggttcatcgatgttatcagt

SEQ ID NO: 416455 - DNA, 20 bp, mouse
gacagtcagctcaagaatgc

SEQ ID NO: 416456 - DNA, 20 bp, mouse
ggttaggcaccaaagcaggt

SEQ ID NO: 416457 - DNA, 20 bp, mouse
gctggtgttgaaagtatgga

SEQ ID NO: 416458 - DNA, 20 bp, mouse
ggctacagtacctcttggtt

SEQ ID NO: 416459 - DNA, 20 bp, mouse
ggctttggtgcctaaccaag

SEQ ID NO: 416460 - DNA, 20 bp, mouse
gaagtcattcaagtgcctgt

SEQ ID NO: 416461 - DNA, 20 bp, mouse
gaaaaaagagagctaaaggt

SEQ ID NO: 416462 - DNA, 20 bp, mouse
gatggaaaaaagagagctaa

SEQ ID NO: 416463 - DNA, 20 bp, mouse
gtacctctttgtgctgtcaa

SEQ ID NO: 416464 - DNA, 20 bp, mouse
gtccccttgacagcacaaag

SEQ ID NO: 416465 - DNA, 20 bp, mouse
gtatactgttaatagtatgt

SEQ ID NO: 416466 - DNA, 20 bp, mouse
gtacaccaacaggtcctgag

SEQ ID NO: 416467 - DNA, 20 bp, mouse
gttggggtggcaagtcacag

SEQ ID NO: 416468 - DNA, 20 bp, mouse
gcaagcctctcaggacctgt

SEQ ID NO: 416469 - DNA, 20 bp, mouse
gtgtccttggggacaagtag

SEQ ID NO: 416470 - DNA, 20 bp, mouse
gttgccaccccaagcctctc

SEQ ID NO: 416471 - DNA, 20 bp, mouse
gaggatgccagagaacatgg

SEQ ID NO: 416472 - DNA, 20 bp, mouse
ggtagccatcccacagtgtg

SEQ ID NO: 416473 - DNA, 20 bp, mouse
gtctgaactgctacaccaac

SEQ ID NO: 416474 - DNA, 20 bp, mouse
ggttcacgaccccacactgt

SEQ ID NO: 416475 - DNA, 20 bp, mouse
ggccctggagcaggagatga

SEQ ID NO: 416476 - DNA, 20 bp, mouse
gagggtgaggcagggcgaca

SEQ ID NO: 416477 - DNA, 20 bp, mouse
ggagcacttaggatgataca

SEQ ID NO: 416478 - DNA, 20 bp, mouse
gagggcaccaagcaatactt

SEQ ID NO: 416479 - DNA, 20 bp, mouse
gttctgctctctggtgtcta

SEQ ID NO: 416480 - DNA, 20 bp, mouse
gactttgggcttctgctctc

SEQ ID NO: 416481 - DNA, 20 bp, mouse
gcacttgtgtccagagtcag

SEQ ID NO: 416482 - DNA, 20 bp, mouse
ggctctctggtgtctatggg

SEQ ID NO: 416483 - DNA, 20 bp, mouse
gcctaagacagaagacttgg

SEQ ID NO: 416484 - DNA, 20 bp, mouse
gtagggcaactgagagaagt

SEQ ID NO: 416485 - DNA, 20 bp, mouse
ggagagtctgcgacaggaag

SEQ ID NO: 416486 - DNA, 20 bp, mouse
gctcccagaactccccagat

SEQ ID NO: 416487 - DNA, 20 bp, mouse
ggtttgtgaagcgagccatg

SEQ ID NO: 416488 - DNA, 20 bp, mouse
gcgtgtaggatacaccacga

SEQ ID NO: 416489 - DNA, 20 bp, mouse
ggcgctgtcaaactgacttc

SEQ ID NO: 416490 - DNA, 20 bp, mouse
gcagagcgttgagatactga

SEQ ID NO: 416491 - DNA, 20 bp, mouse
ggctgggggcagtcaaggat

SEQ ID NO: 416492 - DNA, 20 bp, mouse
gccaaagacagacaaggagg

SEQ ID NO: 416493 - DNA, 20 bp, mouse
gggtgtatcctacacgctgg

SEQ ID NO: 416494 - DNA, 20 bp, mouse
gatgttgtgaagagggccta

SEQ ID NO: 416495 - DNA, 20 bp, mouse
gcatcgtggtcaaagggaga

SEQ ID NO: 416496 - DNA, 20 bp, mouse
gagctcgtgcaggatcgcag

SEQ ID NO: 416497 - DNA, 20 bp, mouse
ggggagttaagcccgctcaa

SEQ ID NO: 416498 - DNA, 20 bp, mouse
gtgcgggactgatttcacag

SEQ ID NO: 416499 - DNA, 20 bp, mouse
gaaatcagtcccgcaccagg

SEQ ID NO: 416500 - DNA, 20 bp, mouse
ggaggcagggaagcttgtgt

SEQ ID NO: 416501 - DNA, 20 bp, mouse
gcctgcacgagctcttctgc

SEQ ID NO: 416502 - DNA, 20 bp, mouse
ggagacaagctctgtccacc

SEQ ID NO: 416503 - DNA, 20 bp, mouse
ggaactgggagctcacatgc

SEQ ID NO: 416504 - DNA, 20 bp, mouse
gagctctgtccacctggtgc

SEQ ID NO: 416505 - DNA, 20 bp, mouse
gttatttagaagcctttgag

SEQ ID NO: 416506 - DNA, 20 bp, mouse
ggcggccaggatccaagatt

SEQ ID NO: 416507 - DNA, 20 bp, mouse
gggagagagagagtccaggg

SEQ ID NO: 416508 - DNA, 20 bp, mouse
gcttaaactcgagattggaa

SEQ ID NO: 416509 - DNA, 20 bp, mouse
ggaagggtgcagttgactcg

SEQ ID NO: 416510 - DNA, 20 bp, mouse
ggattgggtaagagctctga

SEQ ID NO: 416511 - DNA, 20 bp, mouse
gtccagggtggcagagtcca

SEQ ID NO: 416512 - DNA, 20 bp, mouse
gcttcctttccagggcccaa

SEQ ID NO: 416513 - DNA, 20 bp, mouse
gcagcctttgggccctggaa

SEQ ID NO: 416514 - DNA, 20 bp, mouse
gcagagtccaaggatagcaa

SEQ ID NO: 416515 - DNA, 20 bp, mouse
gagcgacttaaactcgagat

SEQ ID NO: 416516 - DNA, 20 bp, mouse
gcagcaacagccccacccta

SEQ ID NO: 416517 - DNA, 20 bp, mouse
ggcagttgtgaggtacggtg

SEQ ID NO: 416518 - DNA, 20 bp, mouse
gtacctgagaaacaacgtaa

SEQ ID NO: 416519 - DNA, 20 bp, mouse
gtgagaaacaacgtaagggg

SEQ ID NO: 416520 - DNA, 20 bp, mouse
ggaatatacacctaagacgt

SEQ ID NO: 416521 - DNA, 20 bp, mouse
ggtcggaaaccagtgccgta

SEQ ID NO: 416522 - DNA, 20 bp, mouse
gaaaccagtgccgtagggtg

SEQ ID NO: 416523 - DNA, 20 bp, mouse
ggtgggcagtgccatactgt

SEQ ID NO: 416524 - DNA, 20 bp, mouse
ggcttccccagcccacagta

SEQ ID NO: 416525 - DNA, 20 bp, mouse
gggttacttttctcaaggat

SEQ ID NO: 416526 - DNA, 20 bp, mouse
gatgatatcgcatgcagggt

SEQ ID NO: 416527 - DNA, 20 bp, mouse
gtagattacttcattaatgt

SEQ ID NO: 416528 - DNA, 20 bp, mouse
ggcgtttggaagtccatgtt

SEQ ID NO: 416529 - DNA, 20 bp, mouse
gtggaatgatatcgcatgca

SEQ ID NO: 416530 - DNA, 20 bp, mouse
gggtcttgtttgggagtatg

SEQ ID NO: 416531 - DNA, 20 bp, mouse
ggtacagagagttattccca

SEQ ID NO: 416532 - DNA, 20 bp, mouse
gttggaagtccatgttgggt

SEQ ID NO: 416533 - DNA, 20 bp, mouse
gcagcttatggccaatgtga

SEQ ID NO: 416534 - DNA, 20 bp, mouse
gtaaagaaaagaggctattt

SEQ ID NO: 416535 - DNA, 20 bp, mouse
gtcttgctgtcatggaaacc

SEQ ID NO: 416536 - DNA, 20 bp, mouse
gtgagcgcaccagccactca

SEQ ID NO: 416537 - DNA, 20 bp, mouse
gatatctaaggtaccatgag

SEQ ID NO: 416538 - DNA, 20 bp, mouse
gagcactcagtggccactac

SEQ ID NO: 416539 - DNA, 20 bp, mouse
gtctcagaggccccatggag

SEQ ID NO: 416540 - DNA, 20 bp, mouse
gacagttgttcgaccagtag

SEQ ID NO: 416541 - DNA, 20 bp, mouse
gaccggatggccatggaaga

SEQ ID NO: 416542 - DNA, 20 bp, mouse
gacaactgtcttagaaagtc

SEQ ID NO: 416543 - DNA, 20 bp, mouse
ggcctctgagaccacataaa

SEQ ID NO: 416544 - DNA, 20 bp, mouse
gccagccgaaagtccaactc

SEQ ID NO: 416545 - DNA, 20 bp, mouse
gactgcatgggagaacactc

SEQ ID NO: 416546 - DNA, 20 bp, mouse
gtaccagctcaggtattgtg

SEQ ID NO: 416547 - DNA, 20 bp, mouse
gtaccacacaatacctgagc

SEQ ID NO: 416548 - DNA, 20 bp, mouse
gagaaaactccggcaacaga

SEQ ID NO: 416549 - DNA, 20 bp, mouse
gttgccggagttttctctca

SEQ ID NO: 416550 - DNA, 20 bp, mouse
gtcattaaggtcacatggac

SEQ ID NO: 416551 - DNA, 20 bp, mouse
gtttgagtgaagtaagactg

SEQ ID NO: 416552 - DNA, 20 bp, mouse
gtgtggtatccttctgttgc

SEQ ID NO: 416553 - DNA, 20 bp, mouse
gacatggacaggaaacagcc

SEQ ID NO: 416554 - DNA, 20 bp, mouse
gtaatgtcattaaggtcaca

SEQ ID NO: 416555 - DNA, 20 bp, mouse
gtgatatatcaaggtgttct

SEQ ID NO: 416556 - DNA, 20 bp, mouse
gaggagtgccaagggttcta

SEQ ID NO: 416557 - DNA, 20 bp, mouse
gtatttggccctagaaccct

SEQ ID NO: 416558 - DNA, 20 bp, mouse
gtgaggtctgatttgaccac

SEQ ID NO: 416559 - DNA, 20 bp, mouse
gcagacctcactggcctctc

SEQ ID NO: 416560 - DNA, 20 bp, mouse
gaagaaggcacagtagttgg

SEQ ID NO: 416561 - DNA, 20 bp, mouse
gtatgggcctatgaggaagt

SEQ ID NO: 416562 - DNA, 20 bp, mouse
gagaccagcctgtgtcatca

SEQ ID NO: 416563 - DNA, 20 bp, mouse
gagtggcgggaatgccggat

SEQ ID NO: 416564 - DNA, 20 bp, mouse
gtggcctctctggcagtgac

SEQ ID NO: 416565 - DNA, 20 bp, mouse
gcatgttctatgaatctatt

SEQ ID NO: 416566 - DNA, 20 bp, mouse
gggagcccagcgaagacggt

SEQ ID NO: 416567 - DNA, 20 bp, mouse
gcagcgaagacggttggcac

SEQ ID NO: 416568 - DNA, 20 bp, mouse
gacgtgcgaactaccggacg

SEQ ID NO: 416569 - DNA, 20 bp, mouse
gcttcgctgggctccacgtc

SEQ ID NO: 416570 - DNA, 20 bp, mouse
gagtagtccaaggttcgggt

SEQ ID NO: 416571 - DNA, 20 bp, mouse
gacgccgacgtgcgaactac

SEQ ID NO: 416572 - DNA, 20 bp, mouse
gccgtgaagaagtcacccag

SEQ ID NO: 416573 - DNA, 20 bp, mouse
gagatgcagcaaggactcat

SEQ ID NO: 416574 - DNA, 20 bp, mouse
gtgggagtgggaaaccaccg

SEQ ID NO: 416575 - DNA, 20 bp, mouse
gaggcagacggaaggacagg

SEQ ID NO: 416576 - DNA, 20 bp, mouse
gccaccaaggcggaaaacag

SEQ ID NO: 416577 - DNA, 20 bp, mouse
gctgccccccgccaccaagg

SEQ ID NO: 416578 - DNA, 20 bp, mouse
gccactgccccccgccacca

SEQ ID NO: 416579 - DNA, 20 bp, mouse
gggattggtttatccaggag

SEQ ID NO: 416580 - DNA, 20 bp, mouse
gggccacaaccaacattcag

SEQ ID NO: 416581 - DNA, 20 bp, mouse
gcctggaggcctctgaatgt

SEQ ID NO: 416582 - DNA, 20 bp, mouse
gatccaggagggggccctgg

SEQ ID NO: 416583 - DNA, 20 bp, mouse
gtcttgaatgggctgagatg

SEQ ID NO: 416584 - DNA, 20 bp, mouse
gcagtgggattggtttatcc

SEQ ID NO: 416585 - DNA, 20 bp, mouse
ggggtgttcccaaggtacta

SEQ ID NO: 416586 - DNA, 20 bp, mouse
gagtgtaccgctgaccacca

SEQ ID NO: 416587 - DNA, 20 bp, mouse
gttgcagccgtggtggtcag

SEQ ID NO: 416588 - DNA, 20 bp, mouse
gagccagtgttggtggaagg

SEQ ID NO: 416589 - DNA, 20 bp, mouse
gtgcaacacagagcgcagga

SEQ ID NO: 416590 - DNA, 20 bp, mouse
gtcagagctgcacagaggtt

SEQ ID NO: 416591 - DNA, 20 bp, mouse
gcggctgcaacacagagcgc

SEQ ID NO: 416592 - DNA, 20 bp, mouse
gcagccgggctagccagtgt

SEQ ID NO: 416593 - DNA, 20 bp, mouse
gggatggagtcccaatggcg

SEQ ID NO: 416594 - DNA, 20 bp, mouse
gagctgcagcaccacgccat

SEQ ID NO: 416595 - DNA, 20 bp, mouse
gaggttaggcctgaccagaa

SEQ ID NO: 416596 - DNA, 20 bp, mouse
gtcaaaccaggaaggcaatg

SEQ ID NO: 416597 - DNA, 20 bp, mouse
gcctccccctcaaaccagga

SEQ ID NO: 416598 - DNA, 20 bp, mouse
gttgccttcctggtttgagg

SEQ ID NO: 416599 - DNA, 20 bp, mouse
gggttagcaagatttttcat

SEQ ID NO: 416600 - DNA, 20 bp, mouse
ggctactaagaagtttaaaa

SEQ ID NO: 416601 - DNA, 20 bp, mouse
gagcaagatttttcatcggg

SEQ ID NO: 416602 - DNA, 20 bp, mouse
gggaaatgaatgcagtaagc

SEQ ID NO: 416603 - DNA, 20 bp, mouse
gaaaaaaaaaaaagtttgaa

SEQ ID NO: 416604 - DNA, 20 bp, mouse
gggattccccattgccttcc

SEQ ID NO: 416605 - DNA, 20 bp, mouse
gtctgacaaccacagcagtc

SEQ ID NO: 416606 - DNA, 20 bp, mouse
gctgggaggagtcaggacca

SEQ ID NO: 416607 - DNA, 20 bp, mouse
gtggcactcctaacacccca

SEQ ID NO: 416608 - DNA, 20 bp, mouse
gaggtctcctagcaactggg

SEQ ID NO: 416609 - DNA, 20 bp, mouse
ggtgaggtctcctagcaact

SEQ ID NO: 416610 - DNA, 20 bp, mouse
gcttcactccctggggtgtt

SEQ ID NO: 416611 - DNA, 20 bp, mouse
gaccatatcctctggagcaa

SEQ ID NO: 416612 - DNA, 20 bp, mouse
ggggtcccacagggaagtct

SEQ ID NO: 416613 - DNA, 20 bp, mouse
gatcatctctgagggcacaa

SEQ ID NO: 416614 - DNA, 20 bp, mouse
gaccttcccaccatatcctc

SEQ ID NO: 416615 - DNA, 20 bp, mouse
gccagatcttcacctgaaac

SEQ ID NO: 416616 - DNA, 20 bp, mouse
gcagggagaatgctagcagg

SEQ ID NO: 416617 - DNA, 20 bp, mouse
gactaggctctgagaaggta

SEQ ID NO: 416618 - DNA, 20 bp, mouse
gtggagggagtgactcaatg

SEQ ID NO: 416619 - DNA, 20 bp, mouse
gtgagaaggtaaggtctgga

SEQ ID NO: 416620 - DNA, 20 bp, mouse
gagcaaactaggctctgaga

SEQ ID NO: 416621 - DNA, 20 bp, mouse
gccagacacaaccttaaagg

SEQ ID NO: 416622 - DNA, 20 bp, mouse
ggacaagttcagagcaaact

SEQ ID NO: 416623 - DNA, 20 bp, mouse
gaaaccagacacaaccttaa

SEQ ID NO: 416624 - DNA, 20 bp, mouse
gtcagtccgcagaagcgaga

SEQ ID NO: 416625 - DNA, 20 bp, mouse
gcaatgaggccccaccttta

SEQ ID NO: 416626 - DNA, 20 bp, mouse
gtacagagcgataatagtat

SEQ ID NO: 416627 - DNA, 20 bp, mouse
gggaactgttgtgacaccag

SEQ ID NO: 416628 - DNA, 20 bp, mouse
ggcaaagtctcaaagtatac

SEQ ID NO: 416629 - DNA, 20 bp, mouse
gttggaatttgagtataatg

SEQ ID NO: 416630 - DNA, 20 bp, mouse
gtagttatagacatgtactt

SEQ ID NO: 416631 - DNA, 20 bp, mouse
gataattctaaagcctggtg

SEQ ID NO: 416632 - DNA, 20 bp, mouse
gggaattcactttgctgacc

SEQ ID NO: 416633 - DNA, 20 bp, mouse
ggatagtaatatcatacctc

SEQ ID NO: 416634 - DNA, 20 bp, mouse
gttgaagcaaaagcactaaa

SEQ ID NO: 416635 - DNA, 20 bp, mouse
gattctaaagcctggtgtgg

SEQ ID NO: 416636 - DNA, 20 bp, mouse
gacagcacaggctcacatca

SEQ ID NO: 416637 - DNA, 20 bp, mouse
gcgccacctaaggctatatc

SEQ ID NO: 416638 - DNA, 20 bp, mouse
ggttaacctgatatagcctt

SEQ ID NO: 416639 - DNA, 20 bp, mouse
gtgtgctgcttcgccaccta

SEQ ID NO: 416640 - DNA, 20 bp, mouse
gagaaggaggatgcacactg

SEQ ID NO: 416641 - DNA, 20 bp, mouse
gaggctggagaagatgttca

SEQ ID NO: 416642 - DNA, 20 bp, mouse
ggagccgctgctgagtgaaa

SEQ ID NO: 416643 - DNA, 20 bp, mouse
gacggcgtttgacgagaatg

SEQ ID NO: 416644 - DNA, 20 bp, mouse
ggtgccgtctgtctcactga

SEQ ID NO: 416645 - DNA, 20 bp, mouse
ggctggtctcaaacagaagg

SEQ ID NO: 416646 - DNA, 20 bp, mouse
gggtcgaaaggcagttggtg

SEQ ID NO: 416647 - DNA, 20 bp, mouse
gaaggcagttggtgagggtt

SEQ ID NO: 416648 - DNA, 20 bp, mouse
gtagccccagctcactccca

SEQ ID NO: 416649 - DNA, 20 bp, mouse
gcgagcggtcgaaaggcagt

SEQ ID NO: 416650 - DNA, 20 bp, mouse
gatggggcgggactccgtgt

SEQ ID NO: 416651 - DNA, 20 bp, mouse
ggctcgcgcccaaagcccat

SEQ ID NO: 416652 - DNA, 20 bp, mouse
gactcctcagagtcagccat

SEQ ID NO: 416653 - DNA, 20 bp, mouse
gagggttcggttgcttgatc

SEQ ID NO: 416654 - DNA, 20 bp, mouse
ggggaggaggcggagcctat

SEQ ID NO: 416655 - DNA, 20 bp, mouse
gaagtgctccgagggatggg

SEQ ID NO: 416656 - DNA, 20 bp, mouse
gtattgctgtggccagagtt

SEQ ID NO: 416657 - DNA, 20 bp, mouse
gagagttgggcggtgactag

SEQ ID NO: 416658 - DNA, 20 bp, mouse
gtccggaacggggcccagag

SEQ ID NO: 416659 - DNA, 20 bp, mouse
gcggtgactagcggcggtct

SEQ ID NO: 416660 - DNA, 20 bp, mouse
gactccagcgggctccggaa

SEQ ID NO: 416661 - DNA, 20 bp, mouse
ggttgggcggtgactagcgg

SEQ ID NO: 416662 - DNA, 20 bp, mouse
gctgatggagtgtattgctg

SEQ ID NO: 416663 - DNA, 20 bp, mouse
gcctttctgaaactgaccga

SEQ ID NO: 416664 - DNA, 20 bp, mouse
gaccgaggcggaaaagatgt

SEQ ID NO: 416665 - DNA, 20 bp, mouse
gtcttgggtgaaaccgaccg

SEQ ID NO: 416666 - DNA, 20 bp, mouse
ggagctgccatcagtaccgt

SEQ ID NO: 416667 - DNA, 20 bp, mouse
gtgcggagaggacagaatct

SEQ ID NO: 416668 - DNA, 20 bp, mouse
ggtgcagacaagcgatgtgg

SEQ ID NO: 416669 - DNA, 20 bp, mouse
gtccttgcccacggtactga

SEQ ID NO: 416670 - DNA, 20 bp, mouse
gggagggaggaggtgcggag

SEQ ID NO: 416671 - DNA, 20 bp, mouse
gcctgatagtaggagactgt

SEQ ID NO: 416672 - DNA, 20 bp, mouse
gatgccacaagagccactgg

SEQ ID NO: 416673 - DNA, 20 bp, mouse
ggggggcccacaactctctg

SEQ ID NO: 416674 - DNA, 20 bp, mouse
gaggcagacaccacatctcg

SEQ ID NO: 416675 - DNA, 20 bp, mouse
gcaacactggcctcgagatg

SEQ ID NO: 416676 - DNA, 20 bp, mouse
gcttaggatgaactgcccta

SEQ ID NO: 416677 - DNA, 20 bp, mouse
gcacagtgttcttagcccga

SEQ ID NO: 416678 - DNA, 20 bp, mouse
gcatgtgtctaggtaagttt

SEQ ID NO: 416679 - DNA, 20 bp, mouse
gctggactctgagttgccct

SEQ ID NO: 416680 - DNA, 20 bp, mouse
ggttatttctagctttcctt

SEQ ID NO: 416681 - DNA, 20 bp, mouse
gtactgagcttgtctaggaa

SEQ ID NO: 416682 - DNA, 20 bp, mouse
ggaggctggagtccaggtcc

SEQ ID NO: 416683 - DNA, 20 bp, mouse
ggtgtgactcactcagtgtg

SEQ ID NO: 416684 - DNA, 20 bp, mouse
gaggtgagagatcagtaccc

SEQ ID NO: 416685 - DNA, 20 bp, mouse
gctagatcagcaaccctgtg

SEQ ID NO: 416686 - DNA, 20 bp, mouse
gcccggcgagtgataactcc

SEQ ID NO: 416687 - DNA, 20 bp, mouse
gccctgcgccgacatcacta

SEQ ID NO: 416688 - DNA, 20 bp, mouse
gcactcgccgggctcttact

SEQ ID NO: 416689 - DNA, 20 bp, mouse
gggcgtacccctagtgatgt

SEQ ID NO: 416690 - DNA, 20 bp, mouse
ggactccctagcagaaaacg

SEQ ID NO: 416691 - DNA, 20 bp, mouse
gaaatgaggaccaagttcaa

SEQ ID NO: 416692 - DNA, 20 bp, mouse
gtggggctagagagttgggc

SEQ ID NO: 416693 - DNA, 20 bp, mouse
gctccagagcacaactatgg

SEQ ID NO: 416694 - DNA, 20 bp, mouse
gagaggcctaacgtctccat

SEQ ID NO: 416695 - DNA, 20 bp, mouse
gaatccccagcagcaacgtc

SEQ ID NO: 416696 - DNA, 20 bp, mouse
gaggaaacttgagccacata

SEQ ID NO: 416697 - DNA, 20 bp, mouse
gacttgagccacatatggtg

SEQ ID NO: 416698 - DNA, 20 bp, mouse
ggtttccttttgaaccagta

SEQ ID NO: 416699 - DNA, 20 bp, mouse
gtagaatccggaacaggggt

SEQ ID NO: 416700 - DNA, 20 bp, mouse
gcttgccttactggttcaaa

SEQ ID NO: 416701 - DNA, 20 bp, mouse
gccggaacaggggtgggtac

SEQ ID NO: 416702 - DNA, 20 bp, mouse
gggactcgtgtgacttatgg

SEQ ID NO: 416703 - DNA, 20 bp, mouse
ggcattttatgtgaacagtc

SEQ ID NO: 416704 - DNA, 20 bp, mouse
gcattcacgtgtactggcga

SEQ ID NO: 416705 - DNA, 20 bp, mouse
gctgactcagcttgccttac

SEQ ID NO: 416706 - DNA, 20 bp, mouse
gagagaagccaggatacctg

SEQ ID NO: 416707 - DNA, 20 bp, mouse
gttcccaggttccgccgtca

SEQ ID NO: 416708 - DNA, 20 bp, mouse
gtctagagaagtgacttccc

SEQ ID NO: 416709 - DNA, 20 bp, mouse
gtgccttgacggcggaacct

SEQ ID NO: 416710 - DNA, 20 bp, mouse
gcttctctgtgccttgacgg

SEQ ID NO: 416711 - DNA, 20 bp, mouse
gccaggatacctgtggagaa

SEQ ID NO: 416712 - DNA, 20 bp, mouse
gatccgcactaagacagtag

SEQ ID NO: 416713 - DNA, 20 bp, mouse
gcactaagacagtagaggag

SEQ ID NO: 416714 - DNA, 20 bp, mouse
gcttactaagatctacagta

SEQ ID NO: 416715 - DNA, 20 bp, mouse
ggactggatggctaacgctg

SEQ ID NO: 416716 - DNA, 20 bp, mouse
gggtctcgtgtcaaatgtac

SEQ ID NO: 416717 - DNA, 20 bp, mouse
gcaacacatggaccttgata

SEQ ID NO: 416718 - DNA, 20 bp, mouse
gtctaacagtccaagcctcg

SEQ ID NO: 416719 - DNA, 20 bp, mouse
ggccttcccgagctacaatc

SEQ ID NO: 416720 - DNA, 20 bp, mouse
gcggctatgaacgttttctc

SEQ ID NO: 416721 - DNA, 20 bp, mouse
gcatttgacacgagaccacg

SEQ ID NO: 416722 - DNA, 20 bp, mouse
ggacacgagaccacgaggct

SEQ ID NO: 416723 - DNA, 20 bp, mouse
gttgttgtagaaatggatga

SEQ ID NO: 416724 - DNA, 20 bp, mouse
gggaaggcaataccagtaca

SEQ ID NO: 416725 - DNA, 20 bp, mouse
ggatggaatgacctgcctca

SEQ ID NO: 416726 - DNA, 20 bp, mouse
gtgtctgagaccctagagga

SEQ ID NO: 416727 - DNA, 20 bp, mouse
gcccttgtctgagaccctag

SEQ ID NO: 416728 - DNA, 20 bp, mouse
gctgagaccctagaggaagg

SEQ ID NO: 416729 - DNA, 20 bp, mouse
ggaacatcctccttcctcta

SEQ ID NO: 416730 - DNA, 20 bp, mouse
gacaagggagcctggtggac

SEQ ID NO: 416731 - DNA, 20 bp, mouse
gtgcttagagccagtccacc

SEQ ID NO: 416732 - DNA, 20 bp, mouse
ggctgtcttcggactactcg

SEQ ID NO: 416733 - DNA, 20 bp, mouse
gacgcctccagacaccacca

SEQ ID NO: 416734 - DNA, 20 bp, mouse
gtactcgaggctcaggccac

SEQ ID NO: 416735 - DNA, 20 bp, mouse
gtgctcccttggatcttctg

SEQ ID NO: 416736 - DNA, 20 bp, mouse
gggagagccggactcccagg

SEQ ID NO: 416737 - DNA, 20 bp, mouse
gcgcggagagccggactccc

SEQ ID NO: 416738 - DNA, 20 bp, mouse
ggagctggagcggagtaggg

SEQ ID NO: 416739 - DNA, 20 bp, mouse
gcggcgaagagtgagtgcca

SEQ ID NO: 416740 - DNA, 20 bp, mouse
gacgcgcgtctagagatcgg

SEQ ID NO: 416741 - DNA, 20 bp, mouse
gttcacgagggaccctgcgg

SEQ ID NO: 416742 - DNA, 20 bp, mouse
ggcgggtaaggagctgatcg

SEQ ID NO: 416743 - DNA, 20 bp, mouse
ggccagcccgcgggacccac

SEQ ID NO: 416744 - DNA, 20 bp, mouse
gacaggcggccccgaagtag

SEQ ID NO: 416745 - DNA, 20 bp, mouse
gaggccgagcgaggcagcta

SEQ ID NO: 416746 - DNA, 20 bp, mouse
gagcttggtgaccattactg

SEQ ID NO: 416747 - DNA, 20 bp, mouse
ggaacaagcaggaataaggg

SEQ ID NO: 416748 - DNA, 20 bp, mouse
gagctgcttcggccacagct

SEQ ID NO: 416749 - DNA, 20 bp, mouse
ggccaaaagaaaagatctca

SEQ ID NO: 416750 - DNA, 20 bp, mouse
gaagatctcacggttgtcca

SEQ ID NO: 416751 - DNA, 20 bp, mouse
gtgttctcaaccaaagccaa

SEQ ID NO: 416752 - DNA, 20 bp, mouse
gaagatgggtgacaacctgg

SEQ ID NO: 416753 - DNA, 20 bp, mouse
gctggcctctgtccctatgc

SEQ ID NO: 416754 - DNA, 20 bp, mouse
gacttctcattgtcctgcat

SEQ ID NO: 416755 - DNA, 20 bp, mouse
gaatgccatcacctcagtaa

SEQ ID NO: 416756 - DNA, 20 bp, mouse
gcctagactaggacagacta

SEQ ID NO: 416757 - DNA, 20 bp, mouse
gaggaacgacgtcctagact

SEQ ID NO: 416758 - DNA, 20 bp, mouse
gtctcaagaggagagtgtct

SEQ ID NO: 416759 - DNA, 20 bp, mouse
ggcccacctgatgagcccac

SEQ ID NO: 416760 - DNA, 20 bp, mouse
ggtgtctgggctgatcagtt

SEQ ID NO: 416761 - DNA, 20 bp, mouse
gaggacgtcgttcctcctgt

SEQ ID NO: 416762 - DNA, 20 bp, mouse
ggattctagagggacaaact

SEQ ID NO: 416763 - DNA, 20 bp, mouse
gccctggtcttggtttccta

SEQ ID NO: 416764 - DNA, 20 bp, mouse
ggtgggcggggcttctcaag

SEQ ID NO: 416765 - DNA, 20 bp, mouse
gctgaggagcccggagccct

SEQ ID NO: 416766 - DNA, 20 bp, mouse
gtccactcaggttcgaacac

SEQ ID NO: 416767 - DNA, 20 bp, mouse
ggctatcagaaaagactggc

SEQ ID NO: 416768 - DNA, 20 bp, mouse
gctaggccaagggagagccg

SEQ ID NO: 416769 - DNA, 20 bp, mouse
gacctgtgttcgaacctgag

SEQ ID NO: 416770 - DNA, 20 bp, mouse
gcggtaccccggctctccct

SEQ ID NO: 416771 - DNA, 20 bp, mouse
ggaaggccttctttccactc

SEQ ID NO: 416772 - DNA, 20 bp, mouse
gagaaggccttcctgcaagt

SEQ ID NO: 416773 - DNA, 20 bp, mouse
gctctctgtcagactaaggg

SEQ ID NO: 416774 - DNA, 20 bp, mouse
gtgtcctcccacttgcagga

SEQ ID NO: 416775 - DNA, 20 bp, mouse
ggcaagtgggaggacactgc

SEQ ID NO: 416776 - DNA, 20 bp, mouse
ggcgcttcgcaggtgaggta

SEQ ID NO: 416777 - DNA, 20 bp, mouse
gcggtgtacacagccggtcc

SEQ ID NO: 416778 - DNA, 20 bp, mouse
gtgtacacagccggtccggg

SEQ ID NO: 416779 - DNA, 20 bp, mouse
gctgcgaagcgccccggctc

SEQ ID NO: 416780 - DNA, 20 bp, mouse
ggtcgccagcgggctcgggt

SEQ ID NO: 416781 - DNA, 20 bp, mouse
gcccgggacgagaccctgag

SEQ ID NO: 416782 - DNA, 20 bp, mouse
gcctcacctgcgaagcgccc

SEQ ID NO: 416783 - DNA, 20 bp, mouse
gtgtacaccggaagtgacgt

SEQ ID NO: 416784 - DNA, 20 bp, mouse
gggtgaggtacggtcgccag

SEQ ID NO: 416785 - DNA, 20 bp, mouse
gcgcgccgagaggcccctcc

SEQ ID NO: 416786 - DNA, 20 bp, mouse
gctccatcttcagaatcaca

SEQ ID NO: 416787 - DNA, 20 bp, mouse
gagagaaaagaacaccccaa

SEQ ID NO: 416788 - DNA, 20 bp, mouse
gggcagatctcaggatctac

SEQ ID NO: 416789 - DNA, 20 bp, mouse
gcaggatctactggatctac

SEQ ID NO: 416790 - DNA, 20 bp, mouse
gagccctgactgaaatacaa

SEQ ID NO: 416791 - DNA, 20 bp, mouse
gcctgactgaaatacaatgg

SEQ ID NO: 416792 - DNA, 20 bp, mouse
gctactatggacatggagca

SEQ ID NO: 416793 - DNA, 20 bp, mouse
gtctagggaatgtgagatta

SEQ ID NO: 416794 - DNA, 20 bp, mouse
gcttaagctctaacagggat

SEQ ID NO: 416795 - DNA, 20 bp, mouse
ggaaggacaggtgtgaaata

SEQ ID NO: 416796 - DNA, 20 bp, mouse
gtgaaggcaccatgtctgag

SEQ ID NO: 416797 - DNA, 20 bp, mouse
gactcacaacgggcattgag

SEQ ID NO: 416798 - DNA, 20 bp, mouse
gaggtctctccggtccagta

SEQ ID NO: 416799 - DNA, 20 bp, mouse
gggttccaccaactcacaac

SEQ ID NO: 416800 - DNA, 20 bp, mouse
gcctcttgcttaacttctgg

SEQ ID NO: 416801 - DNA, 20 bp, mouse
gtccagcttcaagactccgg

SEQ ID NO: 416802 - DNA, 20 bp, mouse
gtcccaggaggtaaaatcag

SEQ ID NO: 416803 - DNA, 20 bp, mouse
ggtctggagtagtaggtaag

SEQ ID NO: 416804 - DNA, 20 bp, mouse
ggaaggagtgagcacaggtc

SEQ ID NO: 416805 - DNA, 20 bp, mouse
gcttgaagctggaacagttc

SEQ ID NO: 416806 - DNA, 20 bp, mouse
gaggatactcgaaggtcgta

SEQ ID NO: 416807 - DNA, 20 bp, mouse
gatggaaaaaggatactcga

SEQ ID NO: 416808 - DNA, 20 bp, mouse
ggtctgggaacagttgcaca

SEQ ID NO: 416809 - DNA, 20 bp, mouse
gtgcaaaaaaggaggactcg

SEQ ID NO: 416810 - DNA, 20 bp, mouse
gcatgccaaaggctttgtga

SEQ ID NO: 416811 - DNA, 20 bp, mouse
gagagatctgtggcagtgct

SEQ ID NO: 416812 - DNA, 20 bp, mouse
gttttaaaaatagagatctg

SEQ ID NO: 416813 - DNA, 20 bp, mouse
gaaaatctgtaaattggtct

SEQ ID NO: 416814 - DNA, 20 bp, mouse
gtgaggaaactgttgctaag

SEQ ID NO: 416815 - DNA, 20 bp, mouse
gattcgtgtgtgtgcaaaaa

SEQ ID NO: 416816 - DNA, 20 bp, mouse
gactaggtttctaagatcaa

SEQ ID NO: 416817 - DNA, 20 bp, mouse
ggattgcccaggatacccgg

SEQ ID NO: 416818 - DNA, 20 bp, mouse
gatgctttggactctattgt

SEQ ID NO: 416819 - DNA, 20 bp, mouse
gtgttaccacagcacgctaa

SEQ ID NO: 416820 - DNA, 20 bp, mouse
gagagcaaatgggaaacgag

SEQ ID NO: 416821 - DNA, 20 bp, mouse
ggtggctgaatggcatgctt

SEQ ID NO: 416822 - DNA, 20 bp, mouse
gccccccggaactttatgac

SEQ ID NO: 416823 - DNA, 20 bp, mouse
gtcctgagtgcagtgcacgg

SEQ ID NO: 416824 - DNA, 20 bp, mouse
ggccagtcataaagttccgg

SEQ ID NO: 416825 - DNA, 20 bp, mouse
gtaagcatcaacggtccatg

SEQ ID NO: 416826 - DNA, 20 bp, mouse
ggccgggttgcggaagagag

SEQ ID NO: 416827 - DNA, 20 bp, mouse
ggcgctagaccaggccccaa

SEQ ID NO: 416828 - DNA, 20 bp, mouse
gtgcgcgtgggccgagacag

SEQ ID NO: 416829 - DNA, 20 bp, mouse
gtccgcggggtgcaggacca

SEQ ID NO: 416830 - DNA, 20 bp, mouse
gctggtctagcgctgtggaa

SEQ ID NO: 416831 - DNA, 20 bp, mouse
gtgagcagcagagggtcggt

SEQ ID NO: 416832 - DNA, 20 bp, mouse
ggcgcgacagggatgcgcgt

SEQ ID NO: 416833 - DNA, 20 bp, mouse
ggggccagcgagggtccgcg

SEQ ID NO: 416834 - DNA, 20 bp, mouse
gagggaccccaggcgcgaca

SEQ ID NO: 416835 - DNA, 20 bp, mouse
ggaccctcgctggccctttg

SEQ ID NO: 416836 - DNA, 20 bp, mouse
gtatcaactgcagggacagt

SEQ ID NO: 416837 - DNA, 20 bp, mouse
gtcttgtcaagccatactgg

SEQ ID NO: 416838 - DNA, 20 bp, mouse
gggtggacgcaaatatgcaa

SEQ ID NO: 416839 - DNA, 20 bp, mouse
gatatttgcgtccaccagta

SEQ ID NO: 416840 - DNA, 20 bp, mouse
gtcccttcaagtctgctccc

SEQ ID NO: 416841 - DNA, 20 bp, mouse
gttagtgtctatcaactgca

SEQ ID NO: 416842 - DNA, 20 bp, mouse
gagaagcctggaaaccccaa

SEQ ID NO: 416843 - DNA, 20 bp, mouse
gatatcgcagaaacccaagg

SEQ ID NO: 416844 - DNA, 20 bp, mouse
gtataattcgatatgagatg

SEQ ID NO: 416845 - DNA, 20 bp, mouse
gtatttggataaggatgagt

SEQ ID NO: 416846 - DNA, 20 bp, mouse
gtcgctggccgccgagacca

SEQ ID NO: 416847 - DNA, 20 bp, mouse
gcctagctccgccctccatt

SEQ ID NO: 416848 - DNA, 20 bp, mouse
gtctttggcgcgggcttcca

SEQ ID NO: 416849 - DNA, 20 bp, mouse
ggtgagtgcgtgggacgaga

SEQ ID NO: 416850 - DNA, 20 bp, mouse
gctttgaggagcaggaactg

SEQ ID NO: 416851 - DNA, 20 bp, mouse
ggcgcgggcttccatggtct

SEQ ID NO: 416852 - DNA, 20 bp, mouse
gcgggcttccatggtctcgg

SEQ ID NO: 416853 - DNA, 20 bp, mouse
ggctcctcaaagccgatcgc

SEQ ID NO: 416854 - DNA, 20 bp, mouse
gaaataaagggcgtgagaca

SEQ ID NO: 416855 - DNA, 20 bp, mouse
ggcccgagtgcgcgtgtctt

SEQ ID NO: 416856 - DNA, 20 bp, mouse
gaagtagatcgacctgggtt

SEQ ID NO: 416857 - DNA, 20 bp, mouse
gggatcccacagcctaaccc

SEQ ID NO: 416858 - DNA, 20 bp, mouse
gtagttaagtagatcgacct

SEQ ID NO: 416859 - DNA, 20 bp, mouse
gagagaagctgtgaactctc

SEQ ID NO: 416860 - DNA, 20 bp, mouse
gctctcaggagctagcatga

SEQ ID NO: 416861 - DNA, 20 bp, mouse
gatcgacctgggttaggctg

SEQ ID NO: 416862 - DNA, 20 bp, mouse
gtcgtcccgttcagggtcta

SEQ ID NO: 416863 - DNA, 20 bp, mouse
gcgatctacttaactagaaa

SEQ ID NO: 416864 - DNA, 20 bp, mouse
gggcagccatagaccctgaa

SEQ ID NO: 416865 - DNA, 20 bp, mouse
gtcccagctcgtcccgttca

SEQ ID NO: 416866 - DNA, 20 bp, mouse
ggagtgctgagactcctagg

SEQ ID NO: 416867 - DNA, 20 bp, mouse
gtcaccacacggtcatctta

SEQ ID NO: 416868 - DNA, 20 bp, mouse
gtcgccctaagatgaccgtg

SEQ ID NO: 416869 - DNA, 20 bp, mouse
gggcgagcacactcaccaca

SEQ ID NO: 416870 - DNA, 20 bp, mouse
gtctgagtgctgagactcct

SEQ ID NO: 416871 - DNA, 20 bp, mouse
gaggtggcatcaccaacaca

SEQ ID NO: 416872 - DNA, 20 bp, mouse
gcgaaaagttggccatgtgt

SEQ ID NO: 416873 - DNA, 20 bp, mouse
gggggaaattaaagccacgt

SEQ ID NO: 416874 - DNA, 20 bp, mouse
gagccaacccaactctgcgg

SEQ ID NO: 416875 - DNA, 20 bp, mouse
gtcatcttagggcgaaaagt

SEQ ID NO: 416876 - DNA, 20 bp, mouse
ggtgttctaaacaggctgaa

SEQ ID NO: 416877 - DNA, 20 bp, mouse
ggaaggaggcgacccactgg

SEQ ID NO: 416878 - DNA, 20 bp, mouse
gtgtatggacaaagcggtgt

SEQ ID NO: 416879 - DNA, 20 bp, mouse
gctcacctgtatggacaaag

SEQ ID NO: 416880 - DNA, 20 bp, mouse
gggcagacactaggttgtgt

SEQ ID NO: 416881 - DNA, 20 bp, mouse
ggggcagcaatgggtatcct

SEQ ID NO: 416882 - DNA, 20 bp, mouse
gggtcagccatcacaggcaa

SEQ ID NO: 416883 - DNA, 20 bp, mouse
gcctgctgacacacatggag

SEQ ID NO: 416884 - DNA, 20 bp, mouse
gagagttgaaagcccttgtg

SEQ ID NO: 416885 - DNA, 20 bp, mouse
gaggcgacccactggaggta

SEQ ID NO: 416886 - DNA, 20 bp, mouse
gagcgcggccagatgacctt

SEQ ID NO: 416887 - DNA, 20 bp, mouse
gtggattctgattacataga

SEQ ID NO: 416888 - DNA, 20 bp, mouse
gaggaacgggggaagaacag

SEQ ID NO: 416889 - DNA, 20 bp, mouse
gcgctcagaccccagaccca

SEQ ID NO: 416890 - DNA, 20 bp, mouse
gccccagacccaaggtcatc

SEQ ID NO: 416891 - DNA, 20 bp, mouse
gggtagcagaccctaaactt

SEQ ID NO: 416892 - DNA, 20 bp, mouse
ggattctagaaagcacggat

SEQ ID NO: 416893 - DNA, 20 bp, mouse
gtctggtaccggagtaagag

SEQ ID NO: 416894 - DNA, 20 bp, mouse
ggcgaatcattgattagcac

SEQ ID NO: 416895 - DNA, 20 bp, mouse
gtgattacatagagggctgc

SEQ ID NO: 416896 - DNA, 20 bp, mouse
gtgtagggctacactggcag

SEQ ID NO: 416897 - DNA, 20 bp, mouse
gacctggctcccatagcggg

SEQ ID NO: 416898 - DNA, 20 bp, mouse
gatgggagccaggtggctgt

SEQ ID NO: 416899 - DNA, 20 bp, mouse
ggtgtagccctacagccacc

SEQ ID NO: 416900 - DNA, 20 bp, mouse
gagccacctggctcccatag

SEQ ID NO: 416901 - DNA, 20 bp, mouse
gaagcagctgccccccgcta

SEQ ID NO: 416902 - DNA, 20 bp, mouse
gagccagctggtgtctggta

SEQ ID NO: 416903 - DNA, 20 bp, mouse
ggacatcaccgaacacctac

SEQ ID NO: 416904 - DNA, 20 bp, mouse
gaggacgcagggttacctga

SEQ ID NO: 416905 - DNA, 20 bp, mouse
gactggcaggggggacctgc

SEQ ID NO: 416906 - DNA, 20 bp, mouse
gcaactagtggactcaaacc

SEQ ID NO: 416907 - DNA, 20 bp, mouse
gtataaatgagaatataaac

SEQ ID NO: 416908 - DNA, 20 bp, mouse
gacagaatcctaacaactag

SEQ ID NO: 416909 - DNA, 20 bp, mouse
gtttgagtccactagttgtt

SEQ ID NO: 416910 - DNA, 20 bp, mouse
gccaggacagttttgatgct

SEQ ID NO: 416911 - DNA, 20 bp, mouse
gacatccttcaccttctcca

SEQ ID NO: 416912 - DNA, 20 bp, mouse
gcctctgctgcagaaactgt

SEQ ID NO: 416913 - DNA, 20 bp, mouse
gagaaactgttggccagccg

SEQ ID NO: 416914 - DNA, 20 bp, mouse
gatcaagatttaacagaagc

SEQ ID NO: 416915 - DNA, 20 bp, mouse
gatcctaaaaccacacactg

SEQ ID NO: 416916 - DNA, 20 bp, mouse
gagtaagcagcagagacctc

SEQ ID NO: 416917 - DNA, 20 bp, mouse
gaaagggagcaggtcactct

SEQ ID NO: 416918 - DNA, 20 bp, mouse
gcaggtcactctaggaatta

SEQ ID NO: 416919 - DNA, 20 bp, mouse
gtctgtagaaggcagaacaa

SEQ ID NO: 416920 - DNA, 20 bp, mouse
gtgctgcccaacactgtcac

SEQ ID NO: 416921 - DNA, 20 bp, mouse
ggaacagcgttgaccttcga

SEQ ID NO: 416922 - DNA, 20 bp, mouse
ggtcaacgctgttctgtaga

SEQ ID NO: 416923 - DNA, 20 bp, mouse
ggtcctgcctgtgacagtgt

SEQ ID NO: 416924 - DNA, 20 bp, mouse
gtggagaagtctgttcatct

SEQ ID NO: 416925 - DNA, 20 bp, mouse
gcatggacaagtatgcttaa

SEQ ID NO: 416926 - DNA, 20 bp, mouse
ggcgcgtgctccggacggag

SEQ ID NO: 416927 - DNA, 20 bp, mouse
ggagcggccgagggtccccg

SEQ ID NO: 416928 - DNA, 20 bp, mouse
gcccgtgcgcgtgctccgga

SEQ ID NO: 416929 - DNA, 20 bp, mouse
gctgcctgcggacagatgca

SEQ ID NO: 416930 - DNA, 20 bp, mouse
gctcctcgcaggctcacggg

SEQ ID NO: 416931 - DNA, 20 bp, mouse
gtcagagcctcggggaccct

SEQ ID NO: 416932 - DNA, 20 bp, mouse
gcgggcacgcgatgtgagag

SEQ ID NO: 416933 - DNA, 20 bp, mouse
gaccctcggccgctcgcgag

SEQ ID NO: 416934 - DNA, 20 bp, mouse
gctggaggcgtcttgaaagg

SEQ ID NO: 416935 - DNA, 20 bp, mouse
ggggagtgtccgctcgcgag

SEQ ID NO: 416936 - DNA, 20 bp, mouse
gagagcggcatgatgaaggg

SEQ ID NO: 416937 - DNA, 20 bp, mouse
gcgtcctatggatcccgcaa

SEQ ID NO: 416938 - DNA, 20 bp, mouse
gccagagagcggcatgatga

SEQ ID NO: 416939 - DNA, 20 bp, mouse
gctacccttgcgggatccat

SEQ ID NO: 416940 - DNA, 20 bp, mouse
gcaggtcatcctacagagag

SEQ ID NO: 416941 - DNA, 20 bp, mouse
gaagggtagtgtagtatact

SEQ ID NO: 416942 - DNA, 20 bp, mouse
gcagggccgccgctctctgt

SEQ ID NO: 416943 - DNA, 20 bp, mouse
gacaggagaggaagtcacag

SEQ ID NO: 416944 - DNA, 20 bp, mouse
gggagtgcacgtcctagtgg

SEQ ID NO: 416945 - DNA, 20 bp, mouse
ggtagtgtagtatacttggc

SEQ ID NO: 416946 - DNA, 20 bp, mouse
gtgcacaggtctagaccaag

SEQ ID NO: 416947 - DNA, 20 bp, mouse
gggtccaaaatcattaagca

SEQ ID NO: 416948 - DNA, 20 bp, mouse
gatgataaattagagtgcac

SEQ ID NO: 416949 - DNA, 20 bp, mouse
gacttagtgaggactcagac

SEQ ID NO: 416950 - DNA, 20 bp, mouse
ggaactgctgcccttaaaga

SEQ ID NO: 416951 - DNA, 20 bp, mouse
gttaatgattttggacctct

SEQ ID NO: 416952 - DNA, 20 bp, mouse
gattaaagtttaactagagt

SEQ ID NO: 416953 - DNA, 20 bp, mouse
gacatatcaaccatctttaa

SEQ ID NO: 416954 - DNA, 20 bp, mouse
gattctgaaggcaaagcatg

SEQ ID NO: 416955 - DNA, 20 bp, mouse
gttcattagcttcattctga

SEQ ID NO: 416956 - DNA, 20 bp, mouse
gaataacacgtagcctggaa

SEQ ID NO: 416957 - DNA, 20 bp, mouse
gaagagtaagaatccaatgg

SEQ ID NO: 416958 - DNA, 20 bp, mouse
gtattgagaatgacaagata

SEQ ID NO: 416959 - DNA, 20 bp, mouse
gtgaaagagtaagaatccaa

SEQ ID NO: 416960 - DNA, 20 bp, mouse
gctgatactttatcctttcc

SEQ ID NO: 416961 - DNA, 20 bp, mouse
gaggtacaacacaaactgaa

SEQ ID NO: 416962 - DNA, 20 bp, mouse
gtttaagatctagcttaggc

SEQ ID NO: 416963 - DNA, 20 bp, mouse
gaagagggacaatacaaaaa

SEQ ID NO: 416964 - DNA, 20 bp, mouse
gcctcaggattctgttgtca

SEQ ID NO: 416965 - DNA, 20 bp, mouse
gggccatgactatgatattt

SEQ ID NO: 416966 - DNA, 20 bp, mouse
gatagtgatggtagtaggaa

SEQ ID NO: 416967 - DNA, 20 bp, mouse
gtaattcatcttctgaagaa

SEQ ID NO: 416968 - DNA, 20 bp, mouse
ggaggctaaaataagagaac

SEQ ID NO: 416969 - DNA, 20 bp, mouse
gtccaaatagtgatggtagt

SEQ ID NO: 416970 - DNA, 20 bp, mouse
ggcctctctgaaactttgtt

SEQ ID NO: 416971 - DNA, 20 bp, mouse
gaaggccttccaaatagtga

SEQ ID NO: 416972 - DNA, 20 bp, mouse
ggaaagcataactgggtcag

SEQ ID NO: 416973 - DNA, 20 bp, mouse
gggtctttgaaagcataact

SEQ ID NO: 416974 - DNA, 20 bp, mouse
gtcccaacaaagtttcagag

SEQ ID NO: 416975 - DNA, 20 bp, mouse
gtggggtactacagtactta

SEQ ID NO: 416976 - DNA, 20 bp, mouse
gggcatgaatatcttatcta

SEQ ID NO: 416977 - DNA, 20 bp, mouse
gagcgtaaaggaaaaaatgg

SEQ ID NO: 416978 - DNA, 20 bp, mouse
gtctaaggaagaaagcgtaa

SEQ ID NO: 416979 - DNA, 20 bp, mouse
gccccagatctcaggatagg

SEQ ID NO: 416980 - DNA, 20 bp, mouse
gatgccccagatctcaggat

SEQ ID NO: 416981 - DNA, 20 bp, mouse
gtgaatatgaagaatacctt

SEQ ID NO: 416982 - DNA, 20 bp, mouse
gtattcatgccccagatctc

SEQ ID NO: 416983 - DNA, 20 bp, mouse
gaatgtcctgggaaccacga

SEQ ID NO: 416984 - DNA, 20 bp, mouse
gcctgggaaccacgatggaa

SEQ ID NO: 416985 - DNA, 20 bp, mouse
gaggagttacaggaaggatt

SEQ ID NO: 416986 - DNA, 20 bp, mouse
gcagtcattgaaggagggta

SEQ ID NO: 416987 - DNA, 20 bp, mouse
gcaggacagtcattgaagga

SEQ ID NO: 416988 - DNA, 20 bp, mouse
gtgactgtcctgagcatcag

SEQ ID NO: 416989 - DNA, 20 bp, mouse
gactagccttgggtagacaa

SEQ ID NO: 416990 - DNA, 20 bp, mouse
gtgctcaggacagtcattga

SEQ ID NO: 416991 - DNA, 20 bp, mouse
gtctgggtattgtccagtgt

SEQ ID NO: 416992 - DNA, 20 bp, mouse
gtgggcatcacacccatgag

SEQ ID NO: 416993 - DNA, 20 bp, mouse
gtgcagggttgcccttaagg

SEQ ID NO: 416994 - DNA, 20 bp, mouse
gtgagataggagagtacaga

SEQ ID NO: 416995 - DNA, 20 bp, mouse
gcaatgagttaactagcctt

SEQ ID NO: 416996 - DNA, 20 bp, mouse
gcagcctgcgggctctcgag

SEQ ID NO: 416997 - DNA, 20 bp, mouse
ggaggacgtgccgccctcag

SEQ ID NO: 416998 - DNA, 20 bp, mouse
gcctgctgttggccccgcgg

SEQ ID NO: 416999 - DNA, 20 bp, mouse
ggagcagcgaggcgacgctg

SEQ ID NO: 417000 - DNA, 20 bp, mouse
gcgagagcccgcaggctgct

SEQ ID NO: 417001 - DNA, 20 bp, mouse
gaggagcgcactctgcaccg

SEQ ID NO: 417002 - DNA, 20 bp, mouse
gcaacagcaggtacctgttg

SEQ ID NO: 417003 - DNA, 20 bp, mouse
gcccatctcagtccacgcag

SEQ ID NO: 417004 - DNA, 20 bp, mouse
gtgcaccgcggtctcgggaa

SEQ ID NO: 417005 - DNA, 20 bp, mouse
ggtacctgctgttggccccg

SEQ ID NO: 417006 - DNA, 20 bp, mouse
gaggtttgttaagtaaggaa

SEQ ID NO: 417007 - DNA, 20 bp, mouse
gaatattctgccagaactaa

SEQ ID NO: 417008 - DNA, 20 bp, mouse
ggaagggatgataagtatca

SEQ ID NO: 417009 - DNA, 20 bp, mouse
ggagagaggtttgttaagta

SEQ ID NO: 417010 - DNA, 20 bp, mouse
ggacagaggacaaaaaacca

SEQ ID NO: 417011 - DNA, 20 bp, mouse
ggatagcaacttctagacag

SEQ ID NO: 417012 - DNA, 20 bp, mouse
gttcctggctaaggtagcga

SEQ ID NO: 417013 - DNA, 20 bp, mouse
gactgagcctcccttagttc

SEQ ID NO: 417014 - DNA, 20 bp, mouse
gcaaggtctgaactaggacg

SEQ ID NO: 417015 - DNA, 20 bp, mouse
ggaagagacatagatcatca

SEQ ID NO: 417016 - DNA, 20 bp, mouse
ggaggaccccactaacagaa

SEQ ID NO: 417017 - DNA, 20 bp, mouse
gcggctccccgaatccacat

SEQ ID NO: 417018 - DNA, 20 bp, mouse
gacagacttagaggggacct

SEQ ID NO: 417019 - DNA, 20 bp, mouse
ggctaccttgaaaacgatgt

SEQ ID NO: 417020 - DNA, 20 bp, mouse
ggagacgaacagacttagag

SEQ ID NO: 417021 - DNA, 20 bp, mouse
gcccgcagccccgcacctgg

SEQ ID NO: 417022 - DNA, 20 bp, mouse
gaccttgaaaacgatgtggg

SEQ ID NO: 417023 - DNA, 20 bp, mouse
gcggcaccccggagctccta

SEQ ID NO: 417024 - DNA, 20 bp, mouse
gagcgcgcgcgggtgcacgg

SEQ ID NO: 417025 - DNA, 20 bp, mouse
gtggagcagagaggaacacg

SEQ ID NO: 417026 - DNA, 20 bp, mouse
ggcctcggacacccatgggg

SEQ ID NO: 417027 - DNA, 20 bp, mouse
ggggcggaggagtagagccg

SEQ ID NO: 417028 - DNA, 20 bp, mouse
gccgccgcctcggacaccca

SEQ ID NO: 417029 - DNA, 20 bp, mouse
gtcggacacccatggggcgg

SEQ ID NO: 417030 - DNA, 20 bp, mouse
gggtatgccctaccagacga

SEQ ID NO: 417031 - DNA, 20 bp, mouse
gctctactcctccgccccat

SEQ ID NO: 417032 - DNA, 20 bp, mouse
gcgagggccgagccaacccg

SEQ ID NO: 417033 - DNA, 20 bp, mouse
gctgagggtgtaagcatcag

SEQ ID NO: 417034 - DNA, 20 bp, mouse
gctggcagcgtatcacgtca

SEQ ID NO: 417035 - DNA, 20 bp, mouse
ggcaccgcagctgcgtcaac

SEQ ID NO: 417036 - DNA, 20 bp, mouse
gcaaggtctgcagattggac

SEQ ID NO: 417037 - DNA, 20 bp, mouse
gagccagggtgaaggcgcag

SEQ ID NO: 417038 - DNA, 20 bp, mouse
gagctccaaggtctgcagat

SEQ ID NO: 417039 - DNA, 20 bp, mouse
gcaggcaaggccctgccgtg

SEQ ID NO: 417040 - DNA, 20 bp, mouse
gggtgaaggcgcagtggcca

SEQ ID NO: 417041 - DNA, 20 bp, mouse
gtagggcactaagcaaggag

SEQ ID NO: 417042 - DNA, 20 bp, mouse
ggactggaggggctctatca

SEQ ID NO: 417043 - DNA, 20 bp, mouse
gggcgttttaaacagagcag

SEQ ID NO: 417044 - DNA, 20 bp, mouse
gattttgcggccccacggca

SEQ ID NO: 417045 - DNA, 20 bp, mouse
gtctgcagattggacaggca

SEQ ID NO: 417046 - DNA, 20 bp, mouse
ggcttgttcgggcgtcatgg

SEQ ID NO: 417047 - DNA, 20 bp, mouse
gagggtagctaaaaatctca

SEQ ID NO: 417048 - DNA, 20 bp, mouse
gtgaagtccatggaaggcat

SEQ ID NO: 417049 - DNA, 20 bp, mouse
gtgttcgggcgtcatggggg

SEQ ID NO: 417050 - DNA, 20 bp, mouse
gccttccatggacttcagag

SEQ ID NO: 417051 - DNA, 20 bp, mouse
gccaatgggcttacgacggt

SEQ ID NO: 417052 - DNA, 20 bp, mouse
ggctggagagcattcaccga

SEQ ID NO: 417053 - DNA, 20 bp, mouse
gttacgacggtgggcaagac

SEQ ID NO: 417054 - DNA, 20 bp, mouse
gcttgcctggggtgcccgag

SEQ ID NO: 417055 - DNA, 20 bp, mouse
gggcaccccgcgtctctcca

SEQ ID NO: 417056 - DNA, 20 bp, mouse
ggtgttcgaaagtttcaggg

SEQ ID NO: 417057 - DNA, 20 bp, mouse
gtggaagttggtccggcagt

SEQ ID NO: 417058 - DNA, 20 bp, mouse
ggcggtgttcgaaagtttca

SEQ ID NO: 417059 - DNA, 20 bp, mouse
gagcgcttcggtaagaagtt

SEQ ID NO: 417060 - DNA, 20 bp, mouse
gggctctgtctgcatcagta

SEQ ID NO: 417061 - DNA, 20 bp, mouse
gcacatacccccgcaactcc

SEQ ID NO: 417062 - DNA, 20 bp, mouse
gaacttccaaatgttacgag

SEQ ID NO: 417063 - DNA, 20 bp, mouse
gtctccatctccagaccctg

SEQ ID NO: 417064 - DNA, 20 bp, mouse
ggcaagtactgctaatacta

SEQ ID NO: 417065 - DNA, 20 bp, mouse
gtggcattaagcaagcgctt

SEQ ID NO: 417066 - DNA, 20 bp, mouse
gccacggggtggtcagccgg

SEQ ID NO: 417067 - DNA, 20 bp, mouse
gctccagcgtcccttcagag

SEQ ID NO: 417068 - DNA, 20 bp, mouse
gcgtcccttcagagaggagc

SEQ ID NO: 417069 - DNA, 20 bp, mouse
gtgagatgcatagagtcccc

SEQ ID NO: 417070 - DNA, 20 bp, mouse
gtccctattagcccacgggg

SEQ ID NO: 417071 - DNA, 20 bp, mouse
gaccaccccgtgggctaata

SEQ ID NO: 417072 - DNA, 20 bp, mouse
ggctgcctgctcctctctga

SEQ ID NO: 417073 - DNA, 20 bp, mouse
gaggtccctattagcccacg

SEQ ID NO: 417074 - DNA, 20 bp, mouse
gtggattcaaaaggtcagaa

SEQ ID NO: 417075 - DNA, 20 bp, mouse
gggcaaagcccagggaagtc

SEQ ID NO: 417076 - DNA, 20 bp, mouse
gtattctctggcgatgaaca

SEQ ID NO: 417077 - DNA, 20 bp, mouse
gtgtatgctggttagaaggg

SEQ ID NO: 417078 - DNA, 20 bp, mouse
gacctgtatgctggttagaa

SEQ ID NO: 417079 - DNA, 20 bp, mouse
gtggaaaccggagccctagt

SEQ ID NO: 417080 - DNA, 20 bp, mouse
gaacaaggcatctacttgat

SEQ ID NO: 417081 - DNA, 20 bp, mouse
ggtggcgtgcactctgagat

SEQ ID NO: 417082 - DNA, 20 bp, mouse
gattctgcttaaaatcaggt

SEQ ID NO: 417083 - DNA, 20 bp, mouse
gggctccggtttccacaata

SEQ ID NO: 417084 - DNA, 20 bp, mouse
gaactaatgagtctgtgtag

SEQ ID NO: 417085 - DNA, 20 bp, mouse
gtcttttcctatacccacta

SEQ ID NO: 417086 - DNA, 20 bp, mouse
gttttagacgaggtaaccag

SEQ ID NO: 417087 - DNA, 20 bp, mouse
gtgtgccgcagaacagctga

SEQ ID NO: 417088 - DNA, 20 bp, mouse
gtagggccagaaattcttca

SEQ ID NO: 417089 - DNA, 20 bp, mouse
gacaggaaagaaggaagcta

SEQ ID NO: 417090 - DNA, 20 bp, mouse
gaaggcttcttggattcctc

SEQ ID NO: 417091 - DNA, 20 bp, mouse
ggatggtagggacaccgcag

SEQ ID NO: 417092 - DNA, 20 bp, mouse
gaagactattgtctaatggt

SEQ ID NO: 417093 - DNA, 20 bp, mouse
gtagacaatagtcttcagaa

SEQ ID NO: 417094 - DNA, 20 bp, mouse
gcgcaagagcctgtctctta

SEQ ID NO: 417095 - DNA, 20 bp, mouse
gccaagaagccttaagagac

SEQ ID NO: 417096 - DNA, 20 bp, mouse
gtctgtccgaagtctaagac

SEQ ID NO: 417097 - DNA, 20 bp, mouse
ggctccaggtagcagccacc

SEQ ID NO: 417098 - DNA, 20 bp, mouse
gcaggtagcagccaccaggc

SEQ ID NO: 417099 - DNA, 20 bp, mouse
gagggccttggaaggacact

SEQ ID NO: 417100 - DNA, 20 bp, mouse
gcttccagtctgttccagcc

SEQ ID NO: 417101 - DNA, 20 bp, mouse
gaacattaaggagttgaggg

SEQ ID NO: 417102 - DNA, 20 bp, mouse
ggaacagactggaagcctct

SEQ ID NO: 417103 - DNA, 20 bp, mouse
gtggcagaactgggtcaggc

SEQ ID NO: 417104 - DNA, 20 bp, mouse
gctttcctcaatatttcctg

SEQ ID NO: 417105 - DNA, 20 bp, mouse
gccttttgtgagatagcatt

SEQ ID NO: 417106 - DNA, 20 bp, mouse
gcctctggatgtagtgacaa

SEQ ID NO: 417107 - DNA, 20 bp, mouse
gagtctgtcactcttctctc

SEQ ID NO: 417108 - DNA, 20 bp, mouse
gagtggctggagcggaggca

SEQ ID NO: 417109 - DNA, 20 bp, mouse
ggacagaggcaggaaacaag

SEQ ID NO: 417110 - DNA, 20 bp, mouse
ggagatggcttaccatagat

SEQ ID NO: 417111 - DNA, 20 bp, mouse
ggatcctggattggctggtg

SEQ ID NO: 417112 - DNA, 20 bp, mouse
gagctagtgggcaagcccta

SEQ ID NO: 417113 - DNA, 20 bp, mouse
ggaatctgatgcccactgag

SEQ ID NO: 417114 - DNA, 20 bp, mouse
gcccatcatacacacctgaa

SEQ ID NO: 417115 - DNA, 20 bp, mouse
gccactccagcacccgggtc

SEQ ID NO: 417116 - DNA, 20 bp, mouse
gatgctccggcaataggtta

SEQ ID NO: 417117 - DNA, 20 bp, mouse
gtattgccggagcatgatta

SEQ ID NO: 417118 - DNA, 20 bp, mouse
gggcaggaggtgttactgtc

SEQ ID NO: 417119 - DNA, 20 bp, mouse
gccggagcatgattaaggag

SEQ ID NO: 417120 - DNA, 20 bp, mouse
gtccggcaataggttagggc

SEQ ID NO: 417121 - DNA, 20 bp, mouse
gggcaataggttagggcagg

SEQ ID NO: 417122 - DNA, 20 bp, mouse
gtgcagtgacaaccatccct

SEQ ID NO: 417123 - DNA, 20 bp, mouse
gaggaagggaccccagccga

SEQ ID NO: 417124 - DNA, 20 bp, mouse
gggttgaggctgcacaggaa

SEQ ID NO: 417125 - DNA, 20 bp, mouse
ggatttcccacaccacaaag

SEQ ID NO: 417126 - DNA, 20 bp, mouse
ggctgtggcagaacaccctg

SEQ ID NO: 417127 - DNA, 20 bp, mouse
gactggcatgaaaacagtgt

SEQ ID NO: 417128 - DNA, 20 bp, mouse
gtattgctcgcagcacctca

SEQ ID NO: 417129 - DNA, 20 bp, mouse
ggggggtcctaaggccacct

SEQ ID NO: 417130 - DNA, 20 bp, mouse
ggagcccctgccacatctgg

SEQ ID NO: 417131 - DNA, 20 bp, mouse
gtgccacagctggttttcca

SEQ ID NO: 417132 - DNA, 20 bp, mouse
gaccccacccatgtctctaa

SEQ ID NO: 417133 - DNA, 20 bp, mouse
gcccctgccacatctggagg

SEQ ID NO: 417134 - DNA, 20 bp, mouse
gagcaagcatctttcagtac

SEQ ID NO: 417135 - DNA, 20 bp, mouse
gtggcttcccttagagacat

SEQ ID NO: 417136 - DNA, 20 bp, mouse
gtagtgggaaaaagggcaac

SEQ ID NO: 417137 - DNA, 20 bp, mouse
gggggacttagaatttcaga

SEQ ID NO: 417138 - DNA, 20 bp, mouse
gcctccagcaccaatataga

SEQ ID NO: 417139 - DNA, 20 bp, mouse
gtatattggtgctggaggac

SEQ ID NO: 417140 - DNA, 20 bp, mouse
gagatagagctaaataggaa

SEQ ID NO: 417141 - DNA, 20 bp, mouse
gtagttggagccctctatat

SEQ ID NO: 417142 - DNA, 20 bp, mouse
gcaataccccacatttattg

SEQ ID NO: 417143 - DNA, 20 bp, mouse
gctaagtccccaataaatgt

SEQ ID NO: 417144 - DNA, 20 bp, mouse
gtgggcattgaggccattcc

SEQ ID NO: 417145 - DNA, 20 bp, mouse
gtgtttacttctgtttggga

SEQ ID NO: 417146 - DNA, 20 bp, mouse
gtatccatcagagggacctg

SEQ ID NO: 417147 - DNA, 20 bp, mouse
gccctgaaggtatccatcag

SEQ ID NO: 417148 - DNA, 20 bp, mouse
gtgcgtctgtactggaagtt

SEQ ID NO: 417149 - DNA, 20 bp, mouse
gaccaccccaccactaacta

SEQ ID NO: 417150 - DNA, 20 bp, mouse
gtaactccttagttagtggt

SEQ ID NO: 417151 - DNA, 20 bp, mouse
ggaagtttttggttttacaa

SEQ ID NO: 417152 - DNA, 20 bp, mouse
gctggggcttatgaatcagg

SEQ ID NO: 417153 - DNA, 20 bp, mouse
gacaggaattgccagtccag

SEQ ID NO: 417154 - DNA, 20 bp, mouse
gcccagcaacccacccctga

SEQ ID NO: 417155 - DNA, 20 bp, mouse
gtaatgcggaaaatcgggaa

SEQ ID NO: 417156 - DNA, 20 bp, mouse
gtggtactcagtgctggtag

SEQ ID NO: 417157 - DNA, 20 bp, mouse
ggtaggggagacaggttgag

SEQ ID NO: 417158 - DNA, 20 bp, mouse
ggagagccttgaggtgactt

SEQ ID NO: 417159 - DNA, 20 bp, mouse
gaggagtgattctaagtctc

SEQ ID NO: 417160 - DNA, 20 bp, mouse
gcagccagaaacccagaatg

SEQ ID NO: 417161 - DNA, 20 bp, mouse
gctaagtctcgggtctcaac

SEQ ID NO: 417162 - DNA, 20 bp, mouse
ggggtttgtagttccagatg

SEQ ID NO: 417163 - DNA, 20 bp, mouse
ggcagcagtagggttagccc

SEQ ID NO: 417164 - DNA, 20 bp, mouse
gaaacctcaggcccagagcg

SEQ ID NO: 417165 - DNA, 20 bp, mouse
gaccagtccagccccgctct

SEQ ID NO: 417166 - DNA, 20 bp, mouse
ggccaagaaacacagcatat

SEQ ID NO: 417167 - DNA, 20 bp, mouse
ggtgtttcttggccattcta

SEQ ID NO: 417168 - DNA, 20 bp, mouse
ggtgttgtgagacttgtaac

SEQ ID NO: 417169 - DNA, 20 bp, mouse
gtatggaggaagacacacgg

SEQ ID NO: 417170 - DNA, 20 bp, mouse
gacacactacctccctagaa

SEQ ID NO: 417171 - DNA, 20 bp, mouse
gcaggcccaatgccatctcc

SEQ ID NO: 417172 - DNA, 20 bp, mouse
ggtcttgaaatggacgacac

SEQ ID NO: 417173 - DNA, 20 bp, mouse
gcgggcaggcagattgtggt

SEQ ID NO: 417174 - DNA, 20 bp, mouse
gggaaccgtgtcgctctgaa

SEQ ID NO: 417175 - DNA, 20 bp, mouse
gtgctctcatggccatccgt

SEQ ID NO: 417176 - DNA, 20 bp, mouse
gcaggacctgaggcaaatct

SEQ ID NO: 417177 - DNA, 20 bp, mouse
gggcagcgtggttggttctg

SEQ ID NO: 417178 - DNA, 20 bp, mouse
gcagtgtcagtcaggacctg

SEQ ID NO: 417179 - DNA, 20 bp, mouse
gagggacaggtagaagacca

SEQ ID NO: 417180 - DNA, 20 bp, mouse
gcaggtggcgccatgttcca

SEQ ID NO: 417181 - DNA, 20 bp, mouse
gaggatccccaggagtcagg

SEQ ID NO: 417182 - DNA, 20 bp, mouse
gtctggggtaggaagatggg

SEQ ID NO: 417183 - DNA, 20 bp, mouse
gcctgaggcaaatctggggt

SEQ ID NO: 417184 - DNA, 20 bp, mouse
gcagctaaacaggaagtcgg

SEQ ID NO: 417185 - DNA, 20 bp, mouse
ggacacgctgaggtacccca

SEQ ID NO: 417186 - DNA, 20 bp, mouse
ggcttcagagaagccactct

SEQ ID NO: 417187 - DNA, 20 bp, mouse
gatgctgcttgaagcttaac

SEQ ID NO: 417188 - DNA, 20 bp, mouse
gaccccctaccagaagatgt

SEQ ID NO: 417189 - DNA, 20 bp, mouse
ggaaaacaacttaatgttga

SEQ ID NO: 417190 - DNA, 20 bp, mouse
gctagccagaaagacttcta

SEQ ID NO: 417191 - DNA, 20 bp, mouse
gggtttctttcaggtttcta

SEQ ID NO: 417192 - DNA, 20 bp, mouse
gattattatgggaactagac

SEQ ID NO: 417193 - DNA, 20 bp, mouse
gatttccatagaagtctttc

SEQ ID NO: 417194 - DNA, 20 bp, mouse
ggggaactagacaggcttag

SEQ ID NO: 417195 - DNA, 20 bp, mouse
gaccaacatcttctggtagg

SEQ ID NO: 417196 - DNA, 20 bp, mouse
ggagccaggctcgctaacag

SEQ ID NO: 417197 - DNA, 20 bp, mouse
gacagcggctcggaagtcag

SEQ ID NO: 417198 - DNA, 20 bp, mouse
ggagttcacccgaagccact

SEQ ID NO: 417199 - DNA, 20 bp, mouse
gaggctcgctaacagcggct

SEQ ID NO: 417200 - DNA, 20 bp, mouse
gtctgggtcgccgcctcaga

SEQ ID NO: 417201 - DNA, 20 bp, mouse
gcggctgggcgactgcgtca

SEQ ID NO: 417202 - DNA, 20 bp, mouse
gcaaggcagtctctgccgag

SEQ ID NO: 417203 - DNA, 20 bp, mouse
gtggctggcttctccgcagg

SEQ ID NO: 417204 - DNA, 20 bp, mouse
ggccagaagctctctcactg

SEQ ID NO: 417205 - DNA, 20 bp, mouse
gccaaagcaggaccactcaa

SEQ ID NO: 417206 - DNA, 20 bp, mouse
gcttggcagaaagcatccaa

SEQ ID NO: 417207 - DNA, 20 bp, mouse
gctctctgtgcaggacacaa

SEQ ID NO: 417208 - DNA, 20 bp, mouse
gacacaaaggcccaaagcta

SEQ ID NO: 417209 - DNA, 20 bp, mouse
gcatccaaaggcacagtgtg

SEQ ID NO: 417210 - DNA, 20 bp, mouse
gggccctagtcagaggaact

SEQ ID NO: 417211 - DNA, 20 bp, mouse
gcacagtactgggacaggtg

SEQ ID NO: 417212 - DNA, 20 bp, mouse
gagtactgggacaggtgtgg

SEQ ID NO: 417213 - DNA, 20 bp, mouse
gagaggctgagggaggccta

SEQ ID NO: 417214 - DNA, 20 bp, mouse
gggctgttggaaacacccca

SEQ ID NO: 417215 - DNA, 20 bp, mouse
ggtgctccccagatcttgta

SEQ ID NO: 417216 - DNA, 20 bp, mouse
gaaactgaattcaacttctc

SEQ ID NO: 417217 - DNA, 20 bp, mouse
gcttaacactgaggaaatcc

SEQ ID NO: 417218 - DNA, 20 bp, mouse
gctcttaactcctgcaactg

SEQ ID NO: 417219 - DNA, 20 bp, mouse
gtgtagcaccagataaaacc

SEQ ID NO: 417220 - DNA, 20 bp, mouse
gggtgctacaaatggagtcc

SEQ ID NO: 417221 - DNA, 20 bp, mouse
gctaggtcatcttaacactg

SEQ ID NO: 417222 - DNA, 20 bp, mouse
gaaggtgacctggttttatc

SEQ ID NO: 417223 - DNA, 20 bp, mouse
gatgttggctcctcagttgc

SEQ ID NO: 417224 - DNA, 20 bp, mouse
ggaaaaaagaaaattgcaaa

SEQ ID NO: 417225 - DNA, 20 bp, mouse
gaaagctatatctagatgct

SEQ ID NO: 417226 - DNA, 20 bp, mouse
gcctcgtggggatgaatggg

SEQ ID NO: 417227 - DNA, 20 bp, mouse
gcagccgcgcggcgcctcgt

SEQ ID NO: 417228 - DNA, 20 bp, mouse
gggcgcctcgtggggatgaa

SEQ ID NO: 417229 - DNA, 20 bp, mouse
gccgccaaggcctccgacgt

SEQ ID NO: 417230 - DNA, 20 bp, mouse
gggatgaatgggaggcgcag

SEQ ID NO: 417231 - DNA, 20 bp, mouse
gcggcgtgaggtgaaaggtc

SEQ ID NO: 417232 - DNA, 20 bp, mouse
gaggacgatgagcgccgcgg

SEQ ID NO: 417233 - DNA, 20 bp, mouse
gcacagaagccgagacaacg

SEQ ID NO: 417234 - DNA, 20 bp, mouse
gatccccacgaggcgccgcg

SEQ ID NO: 417235 - DNA, 20 bp, mouse
ggaatgggaggcgcaggggg

SEQ ID NO: 417236 - DNA, 20 bp, mouse
gtgtttgggcagacatagtg

SEQ ID NO: 417237 - DNA, 20 bp, mouse
ggaagtctggtagtactgct

SEQ ID NO: 417238 - DNA, 20 bp, mouse
gcatcacagggtatacttac

SEQ ID NO: 417239 - DNA, 20 bp, mouse
ggcatcagctgctcatgtag

SEQ ID NO: 417240 - DNA, 20 bp, mouse
gtacccatggaggtaaagag

SEQ ID NO: 417241 - DNA, 20 bp, mouse
gggagttattaacaaaccta

SEQ ID NO: 417242 - DNA, 20 bp, mouse
gcagaatggaagtaagccaa

SEQ ID NO: 417243 - DNA, 20 bp, mouse
gctcacataggactttccct

SEQ ID NO: 417244 - DNA, 20 bp, mouse
ggctctttgggacttcgcaa

SEQ ID NO: 417245 - DNA, 20 bp, mouse
gggatcagagcatgaaaggc

SEQ ID NO: 417246 - DNA, 20 bp, mouse
gccgctgcaggtggctgtta

SEQ ID NO: 417247 - DNA, 20 bp, mouse
gatgggctatagcgaagaga

SEQ ID NO: 417248 - DNA, 20 bp, mouse
gcgacaatggcctccccaaa

SEQ ID NO: 417249 - DNA, 20 bp, mouse
gttcgctatagcccatacag

SEQ ID NO: 417250 - DNA, 20 bp, mouse
gctgttatggagaccctttg

SEQ ID NO: 417251 - DNA, 20 bp, mouse
ggttcttccagccactgtat

SEQ ID NO: 417252 - DNA, 20 bp, mouse
gttagcctcctggtcaaaca

SEQ ID NO: 417253 - DNA, 20 bp, mouse
gtggtcaaacatggcgacaa

SEQ ID NO: 417254 - DNA, 20 bp, mouse
gctatagcccatacagtggc

SEQ ID NO: 417255 - DNA, 20 bp, mouse
gttatggagaccctttgggg

SEQ ID NO: 417256 - DNA, 20 bp, mouse
gtcaggactcctaaaataag

SEQ ID NO: 417257 - DNA, 20 bp, mouse
gaagtcccaagtcttgtccc

SEQ ID NO: 417258 - DNA, 20 bp, mouse
gaggcacaaacactaatggt

SEQ ID NO: 417259 - DNA, 20 bp, mouse
gcgcagcaggccgtttctcc

SEQ ID NO: 417260 - DNA, 20 bp, mouse
gccgtttctccaggctcaaa

SEQ ID NO: 417261 - DNA, 20 bp, mouse
gcaagtcttgtccctggctc

SEQ ID NO: 417262 - DNA, 20 bp, mouse
gaaacaagaaggtaagagca

SEQ ID NO: 417263 - DNA, 20 bp, mouse
gacaatcttcctcttatttt

SEQ ID NO: 417264 - DNA, 20 bp, mouse
gctgcaatgtgatctctgaa

SEQ ID NO: 417265 - DNA, 20 bp, mouse
gacttgggacttcacgcagc

SEQ ID NO: 417266 - DNA, 20 bp, mouse
gaagagcacagtgggagtgc

SEQ ID NO: 417267 - DNA, 20 bp, mouse
gttgctcggtgggattccag

SEQ ID NO: 417268 - DNA, 20 bp, mouse
gggttcatgcttgaagggac

SEQ ID NO: 417269 - DNA, 20 bp, mouse
gagcatgaaccttaccatct

SEQ ID NO: 417270 - DNA, 20 bp, mouse
gggtaaggttcatgcttgaa

SEQ ID NO: 417271 - DNA, 20 bp, mouse
ggtgaggcctagggccctgg

SEQ ID NO: 417272 - DNA, 20 bp, mouse
gagaagtcctccagggccct

SEQ ID NO: 417273 - DNA, 20 bp, mouse
gttgtcttctgtagtctcag

SEQ ID NO: 417274 - DNA, 20 bp, mouse
ggggcaacctctcctcggat

SEQ ID NO: 417275 - DNA, 20 bp, mouse
gaaccccaagaagtcctcca

SEQ ID NO: 417276 - DNA, 20 bp, mouse
gcgcggggcgcaagagtccg

SEQ ID NO: 417277 - DNA, 20 bp, mouse
gggggcgcaagagtccgtgg

SEQ ID NO: 417278 - DNA, 20 bp, mouse
gctgcgaactgtggccgcca

SEQ ID NO: 417279 - DNA, 20 bp, mouse
ggctggagaccgaccggatg

SEQ ID NO: 417280 - DNA, 20 bp, mouse
gtcgcccgctggagaccgac

SEQ ID NO: 417281 - DNA, 20 bp, mouse
ggccgctcacctgcgaactg

SEQ ID NO: 417282 - DNA, 20 bp, mouse
ggccacagttcgcaggtgag

SEQ ID NO: 417283 - DNA, 20 bp, mouse
gtcgcaggtgagcggcgctc

SEQ ID NO: 417284 - DNA, 20 bp, mouse
ggctagcgaggccgaggtgg

SEQ ID NO: 417285 - DNA, 20 bp, mouse
gagaacccgaacgctccgcg

SEQ ID NO: 417286 - DNA, 20 bp, mouse
ggaccggtactcacccgcag

SEQ ID NO: 417287 - DNA, 20 bp, mouse
gactcacccgcagcggacag

SEQ ID NO: 417288 - DNA, 20 bp, mouse
ggtccgctgcgggtgagtac

SEQ ID NO: 417289 - DNA, 20 bp, mouse
gtcttcctggagccggctgg

SEQ ID NO: 417290 - DNA, 20 bp, mouse
gcacgcgaggcagtcgagac

SEQ ID NO: 417291 - DNA, 20 bp, mouse
gtccaggaagagacgaagtc

SEQ ID NO: 417292 - DNA, 20 bp, mouse
gacccgcagcggacagcgga

SEQ ID NO: 417293 - DNA, 20 bp, mouse
ggaccgtccgctgtccgctg

SEQ ID NO: 417294 - DNA, 20 bp, mouse
ggccggacttcgtctcttcc

SEQ ID NO: 417295 - DNA, 20 bp, mouse
ggcgatgccaccgacagcag

SEQ ID NO: 417296 - DNA, 20 bp, mouse
gagagtggagacctcaacac

SEQ ID NO: 417297 - DNA, 20 bp, mouse
gcttccgggactggcaacat

SEQ ID NO: 417298 - DNA, 20 bp, mouse
gggcaacatgggctcttctg

SEQ ID NO: 417299 - DNA, 20 bp, mouse
gcttggcaggccttaagaca

SEQ ID NO: 417300 - DNA, 20 bp, mouse
ggcgtcagagaacccatccg

SEQ ID NO: 417301 - DNA, 20 bp, mouse
ggagcccatgttgccagtcc

SEQ ID NO: 417302 - DNA, 20 bp, mouse
gggcctgccaagagcaacga

SEQ ID NO: 417303 - DNA, 20 bp, mouse
ggagagggtaggttccccaa

SEQ ID NO: 417304 - DNA, 20 bp, mouse
gtctccggcccaaagcacca

SEQ ID NO: 417305 - DNA, 20 bp, mouse
gggcccaaagcaccacggat

SEQ ID NO: 417306 - DNA, 20 bp, mouse
ggagccaggagaggcggctt

SEQ ID NO: 417307 - DNA, 20 bp, mouse
gtacctcgtacacagcctgg

SEQ ID NO: 417308 - DNA, 20 bp, mouse
gcgaggtacatatgaaacaa

SEQ ID NO: 417309 - DNA, 20 bp, mouse
gcctcttcaacctgttgccc

SEQ ID NO: 417310 - DNA, 20 bp, mouse
gcacctccaggctgtgtacg

SEQ ID NO: 417311 - DNA, 20 bp, mouse
gtgactgaggctcatcacaa

SEQ ID NO: 417312 - DNA, 20 bp, mouse
gatgtatgtcaaactatgtt

SEQ ID NO: 417313 - DNA, 20 bp, mouse
gtcatcacaaaggtcaaatg

SEQ ID NO: 417314 - DNA, 20 bp, mouse
ggatgtctatgatttgactg

SEQ ID NO: 417315 - DNA, 20 bp, mouse
gaaggcatggcgtctcaaag

SEQ ID NO: 417316 - DNA, 20 bp, mouse
gaccgtgggcatcaaggaag

SEQ ID NO: 417317 - DNA, 20 bp, mouse
gggctttgcctcgcaaccgt

SEQ ID NO: 417318 - DNA, 20 bp, mouse
gctgagggtcagagctgcgt

SEQ ID NO: 417319 - DNA, 20 bp, mouse
gctcgcaaccgtgggcatca

SEQ ID NO: 417320 - DNA, 20 bp, mouse
gttggcgttgatggctcctg

SEQ ID NO: 417321 - DNA, 20 bp, mouse
ggtcatccaggtggaagatc

SEQ ID NO: 417322 - DNA, 20 bp, mouse
gagagctgcgttggcgttga

SEQ ID NO: 417323 - DNA, 20 bp, mouse
ggaggaaaaataccagccag

SEQ ID NO: 417324 - DNA, 20 bp, mouse
gttctcagggcctgttagag

SEQ ID NO: 417325 - DNA, 20 bp, mouse
gctgaccctcagggttctca

SEQ ID NO: 417326 - DNA, 20 bp, mouse
gggtgtggtggatacatcag

SEQ ID NO: 417327 - DNA, 20 bp, mouse
ggatcgatctgatgtagcta

SEQ ID NO: 417328 - DNA, 20 bp, mouse
ggagtcaaagagaaccaaga

SEQ ID NO: 417329 - DNA, 20 bp, mouse
gcagggacggccaggaaggt

SEQ ID NO: 417330 - DNA, 20 bp, mouse
gcctatgctggttgagaaaa

SEQ ID NO: 417331 - DNA, 20 bp, mouse
ggtcagatttaacggcgata

SEQ ID NO: 417332 - DNA, 20 bp, mouse
gtgagcagatggatgtctca

SEQ ID NO: 417333 - DNA, 20 bp, mouse
ggctactgagtcagatttaa

SEQ ID NO: 417334 - DNA, 20 bp, mouse
gcaaagagaaccaagatggc

SEQ ID NO: 417335 - DNA, 20 bp, mouse
gagcgtgtggccaaccttcc

SEQ ID NO: 417336 - DNA, 20 bp, mouse
gcaaagctggcccccccgag

SEQ ID NO: 417337 - DNA, 20 bp, mouse
gggacagcggcccctcgggg

SEQ ID NO: 417338 - DNA, 20 bp, mouse
gggctcatacgtggccccag

SEQ ID NO: 417339 - DNA, 20 bp, mouse
gagctgcgcaggctcatacg

SEQ ID NO: 417340 - DNA, 20 bp, mouse
gacctgctagacaggatccg

SEQ ID NO: 417341 - DNA, 20 bp, mouse
gggcctggatcagtcaaagc

SEQ ID NO: 417342 - DNA, 20 bp, mouse
gccaggtgagacggccacat

SEQ ID NO: 417343 - DNA, 20 bp, mouse
gctgatccaggccccgagcc

SEQ ID NO: 417344 - DNA, 20 bp, mouse
ggtccaggaggcagctgcgc

SEQ ID NO: 417345 - DNA, 20 bp, mouse
gccagagctcgagatcgatg

SEQ ID NO: 417346 - DNA, 20 bp, mouse
gtaatggcttccccacacct

SEQ ID NO: 417347 - DNA, 20 bp, mouse
gaggccaccgaagcctgccg

SEQ ID NO: 417348 - DNA, 20 bp, mouse
gcgaagcctgccgaggtgtg

SEQ ID NO: 417349 - DNA, 20 bp, mouse
ggaggccctgcggttaccag

SEQ ID NO: 417350 - DNA, 20 bp, mouse
ggtaggcagctggcctctaa

SEQ ID NO: 417351 - DNA, 20 bp, mouse
gaggccagctgcctacctgg

SEQ ID NO: 417352 - DNA, 20 bp, mouse
ggccctgcggttaccagcgg

SEQ ID NO: 417353 - DNA, 20 bp, mouse
gccgcgccagagctgaggtg

SEQ ID NO: 417354 - DNA, 20 bp, mouse
gtcctgtgtcccgggccacc

SEQ ID NO: 417355 - DNA, 20 bp, mouse
gggcccgaggtgacgtgcag

SEQ ID NO: 417356 - DNA, 20 bp, mouse
gacttgcatggcaagtctct

SEQ ID NO: 417357 - DNA, 20 bp, mouse
gggcttctcaagccataatg

SEQ ID NO: 417358 - DNA, 20 bp, mouse
gcaccatctcctcatggaga

SEQ ID NO: 417359 - DNA, 20 bp, mouse
ggtaacttagaagaccatca

SEQ ID NO: 417360 - DNA, 20 bp, mouse
gtctatgtccacgtccatga

SEQ ID NO: 417361 - DNA, 20 bp, mouse
ggcacttccaccaagtgatt

SEQ ID NO: 417362 - DNA, 20 bp, mouse
gacaaaaacaaatgtatgta

SEQ ID NO: 417363 - DNA, 20 bp, mouse
gttgtcctcttcgcttctgt

SEQ ID NO: 417364 - DNA, 20 bp, mouse
gtacccacatctagaagagg

SEQ ID NO: 417365 - DNA, 20 bp, mouse
gtagtacccacatctagaag

SEQ ID NO: 417366 - DNA, 20 bp, mouse
gtctgcaagtctggaaacag

SEQ ID NO: 417367 - DNA, 20 bp, mouse
ggccagagcctctgcaagtc

SEQ ID NO: 417368 - DNA, 20 bp, mouse
gtccagacttgcagaggctc

SEQ ID NO: 417369 - DNA, 20 bp, mouse
ggtgttcccatgagacactg

SEQ ID NO: 417370 - DNA, 20 bp, mouse
gactcttgtagtcgaatcgg

SEQ ID NO: 417371 - DNA, 20 bp, mouse
gcaaaaaagccaagagcagt

SEQ ID NO: 417372 - DNA, 20 bp, mouse
gaacaaaaaagttcctgcta

SEQ ID NO: 417373 - DNA, 20 bp, mouse
gtagtcgaatcgggggtgat

SEQ ID NO: 417374 - DNA, 20 bp, mouse
ggtagcatatgttcggtaca

SEQ ID NO: 417375 - DNA, 20 bp, mouse
gtcgactcttgtagtcgaat

SEQ ID NO: 417376 - DNA, 20 bp, mouse
gcaatcatcggtccacaggt

SEQ ID NO: 417377 - DNA, 20 bp, mouse
gaaacagcggccacagagaa

SEQ ID NO: 417378 - DNA, 20 bp, mouse
ggagagaagacggcaatcat

SEQ ID NO: 417379 - DNA, 20 bp, mouse
gactcaggtaccaggaccta

SEQ ID NO: 417380 - DNA, 20 bp, mouse
ggtccacaggtaggcacaag

SEQ ID NO: 417381 - DNA, 20 bp, mouse
gacgccctcagagctggtga

SEQ ID NO: 417382 - DNA, 20 bp, mouse
ggcacttaggagggaaggtc

SEQ ID NO: 417383 - DNA, 20 bp, mouse
gacggcaatcatcggtccac

SEQ ID NO: 417384 - DNA, 20 bp, mouse
gggtaggcacaagaggatgc

SEQ ID NO: 417385 - DNA, 20 bp, mouse
gtagggaaccaggactgcat

SEQ ID NO: 417386 - DNA, 20 bp, mouse
gtgagaaatggaggcccctg

SEQ ID NO: 417387 - DNA, 20 bp, mouse
gccaagcttcgcaggctgag

SEQ ID NO: 417388 - DNA, 20 bp, mouse
gctagactgtacctgagaaa

SEQ ID NO: 417389 - DNA, 20 bp, mouse
ggacgcctctctcagaacct

SEQ ID NO: 417390 - DNA, 20 bp, mouse
ggctgagggggtgccagagc

SEQ ID NO: 417391 - DNA, 20 bp, mouse
ggctgccgaggttctgagag

SEQ ID NO: 417392 - DNA, 20 bp, mouse
gggtctggcaagaaacatgg

SEQ ID NO: 417393 - DNA, 20 bp, mouse
ggtactgaagagcctgtagg

SEQ ID NO: 417394 - DNA, 20 bp, mouse
gtaggaggcgctgctaggtg

SEQ ID NO: 417395 - DNA, 20 bp, mouse
gtctcctgactggttcccct

SEQ ID NO: 417396 - DNA, 20 bp, mouse
gtcctgaggatggaacgcgg

SEQ ID NO: 417397 - DNA, 20 bp, mouse
gcgggcgctgacgaaggagg

SEQ ID NO: 417398 - DNA, 20 bp, mouse
gacgaggacgaggacgcgag

SEQ ID NO: 417399 - DNA, 20 bp, mouse
gggctcctgaggatggaacg

SEQ ID NO: 417400 - DNA, 20 bp, mouse
gaggacgaggacgcgagcgg

SEQ ID NO: 417401 - DNA, 20 bp, mouse
gggccgcgtgagccagacca

SEQ ID NO: 417402 - DNA, 20 bp, mouse
ggccgccgcgttccatcctc

SEQ ID NO: 417403 - DNA, 20 bp, mouse
gacagctgggccagtgacgc

SEQ ID NO: 417404 - DNA, 20 bp, mouse
gcggcggtgacaactcaccc

SEQ ID NO: 417405 - DNA, 20 bp, mouse
ggtgacaactcacccgggag

SEQ ID NO: 417406 - DNA, 20 bp, mouse
gttcgctagggcagactcac

SEQ ID NO: 417407 - DNA, 20 bp, mouse
gactcaccggaagctcactc

SEQ ID NO: 417408 - DNA, 20 bp, mouse
ggaggacttccctttcgcta

SEQ ID NO: 417409 - DNA, 20 bp, mouse
gcccaaggggactcactcta

SEQ ID NO: 417410 - DNA, 20 bp, mouse
gtcccgctctccttgcacgg

SEQ ID NO: 417411 - DNA, 20 bp, mouse
ggtctcaggatgctgaccta

SEQ ID NO: 417412 - DNA, 20 bp, mouse
ggaatcccgctctccttgca

SEQ ID NO: 417413 - DNA, 20 bp, mouse
ggtcctccgtgcaaggagag

SEQ ID NO: 417414 - DNA, 20 bp, mouse
gaagggaagtcctccgtgca

SEQ ID NO: 417415 - DNA, 20 bp, mouse
gttgtgcctgagtgagcttc

SEQ ID NO: 417416 - DNA, 20 bp, mouse
gcgccgcgcccaaaccaggt

SEQ ID NO: 417417 - DNA, 20 bp, mouse
gcggccaccaagagatcgta

SEQ ID NO: 417418 - DNA, 20 bp, mouse
gcggaagcgaggcctagcgt

SEQ ID NO: 417419 - DNA, 20 bp, mouse
ggccgcgccgcgcccaaacc

SEQ ID NO: 417420 - DNA, 20 bp, mouse
ggcccaagcccacctggttt

SEQ ID NO: 417421 - DNA, 20 bp, mouse
ggggctacgcaggtgtacac

SEQ ID NO: 417422 - DNA, 20 bp, mouse
gtcgccttacgatctcttgg

SEQ ID NO: 417423 - DNA, 20 bp, mouse
gcgtaaggcgaccccacgct

SEQ ID NO: 417424 - DNA, 20 bp, mouse
ggcctctcgcccagtcgtca

SEQ ID NO: 417425 - DNA, 20 bp, mouse
gctctgtgggcgaggaggtg

SEQ ID NO: 417426 - DNA, 20 bp, mouse
ggctaaggggcgaccaagca

SEQ ID NO: 417427 - DNA, 20 bp, mouse
gggaaacgcgaagcgccctg

SEQ ID NO: 417428 - DNA, 20 bp, mouse
gtggtgtctaggtcgctaag

SEQ ID NO: 417429 - DNA, 20 bp, mouse
ggcttttgttgttctaccgg

SEQ ID NO: 417430 - DNA, 20 bp, mouse
gaccaagcaaggaagcggtc

SEQ ID NO: 417431 - DNA, 20 bp, mouse
gcgagacagaagtctcccgg

SEQ ID NO: 417432 - DNA, 20 bp, mouse
gatagcgtagaggctttgag

SEQ ID NO: 417433 - DNA, 20 bp, mouse
ggttcagggatctagagact

SEQ ID NO: 417434 - DNA, 20 bp, mouse
gttgcggtgggaggtaccca

SEQ ID NO: 417435 - DNA, 20 bp, mouse
gttctgtctcggtggtgtct

SEQ ID NO: 417436 - DNA, 20 bp, mouse
gcagttccggagtgtggagg

SEQ ID NO: 417437 - DNA, 20 bp, mouse
ggccgaggactactaattct

SEQ ID NO: 417438 - DNA, 20 bp, mouse
gctccagttccggagtgtgg

SEQ ID NO: 417439 - DNA, 20 bp, mouse
ggcccagaattagtagtcct

SEQ ID NO: 417440 - DNA, 20 bp, mouse
gactggagtgcactcaactg

SEQ ID NO: 417441 - DNA, 20 bp, mouse
gtggcgaacaccgggtgccg

SEQ ID NO: 417442 - DNA, 20 bp, mouse
gaggtggctttggcgaacac

SEQ ID NO: 417443 - DNA, 20 bp, mouse
ggcatccgaaaccctcgggt

SEQ ID NO: 417444 - DNA, 20 bp, mouse
gtccctccgagcatcaccga

SEQ ID NO: 417445 - DNA, 20 bp, mouse
gcaaagccacctccacactc

SEQ ID NO: 417446 - DNA, 20 bp, mouse
gcagaggccagtgaacatca

SEQ ID NO: 417447 - DNA, 20 bp, mouse
ggtctcagggcaggtcacta

SEQ ID NO: 417448 - DNA, 20 bp, mouse
gagtggagcattgacagcag

SEQ ID NO: 417449 - DNA, 20 bp, mouse
gcacagtgtgagatcaatca

SEQ ID NO: 417450 - DNA, 20 bp, mouse
gtaaataccctgatgttcac

SEQ ID NO: 417451 - DNA, 20 bp, mouse
gcagaagagccccaacgtag

SEQ ID NO: 417452 - DNA, 20 bp, mouse
gaacaggcaacaccccacta

SEQ ID NO: 417453 - DNA, 20 bp, mouse
gaactgtgccaggccatagt

SEQ ID NO: 417454 - DNA, 20 bp, mouse
gctgtgctgcagtatctcta

SEQ ID NO: 417455 - DNA, 20 bp, mouse
ggacatcaccccctacgttg

SEQ ID NO: 417456 - DNA, 20 bp, mouse
gggacgcaggagccacccga

SEQ ID NO: 417457 - DNA, 20 bp, mouse
gggtcgcctcagccccccta

SEQ ID NO: 417458 - DNA, 20 bp, mouse
gttcgtcgggtgccgtaggg

SEQ ID NO: 417459 - DNA, 20 bp, mouse
gggcgcacaaggctgcggtg

SEQ ID NO: 417460 - DNA, 20 bp, mouse
gaggcgaccaggggcctcct

SEQ ID NO: 417461 - DNA, 20 bp, mouse
gccggcagctgcccctcggg

SEQ ID NO: 417462 - DNA, 20 bp, mouse
gggcccggcagctgcccctc

SEQ ID NO: 417463 - DNA, 20 bp, mouse
gggggggctgaggcgaccag

SEQ ID NO: 417464 - DNA, 20 bp, mouse
gtccgccgcaggccgttcgt

SEQ ID NO: 417465 - DNA, 20 bp, mouse
gccgttcgtcgggtgccgta

SEQ ID NO: 417466 - DNA, 20 bp, mouse
gcggagcagcctatcgagac

SEQ ID NO: 417467 - DNA, 20 bp, mouse
gtcttgtagccagtctcgat

SEQ ID NO: 417468 - DNA, 20 bp, mouse
gctatagaccaagcacgagt

SEQ ID NO: 417469 - DNA, 20 bp, mouse
gcatcgcagaggaagagggt

SEQ ID NO: 417470 - DNA, 20 bp, mouse
gacgggtgagccagtggagt

SEQ ID NO: 417471 - DNA, 20 bp, mouse
gaagtatagaatacctaaaa

SEQ ID NO: 417472 - DNA, 20 bp, mouse
ggtggtgagagccatcgcag

SEQ ID NO: 417473 - DNA, 20 bp, mouse
gtacctgaccaagagggagg

SEQ ID NO: 417474 - DNA, 20 bp, mouse
gctaggagctttgaaggtgt

SEQ ID NO: 417475 - DNA, 20 bp, mouse
ggattacctgaccaagaggg

SEQ ID NO: 417476 - DNA, 20 bp, mouse
gcacagagccctcggccgag

SEQ ID NO: 417477 - DNA, 20 bp, mouse
gacgcaggcgacacaagaag

SEQ ID NO: 417478 - DNA, 20 bp, mouse
gcgccgggatggtctcgagg

SEQ ID NO: 417479 - DNA, 20 bp, mouse
gcggcgccgggatggtctcg

SEQ ID NO: 417480 - DNA, 20 bp, mouse
gggatggtctcgaggcggga

SEQ ID NO: 417481 - DNA, 20 bp, mouse
ggacggcgggaagaccacgg

SEQ ID NO: 417482 - DNA, 20 bp, mouse
gcgaggcgggacggtgttag

SEQ ID NO: 417483 - DNA, 20 bp, mouse
gccgggcggagcggccaaca

SEQ ID NO: 417484 - DNA, 20 bp, mouse
gacggacggcgggaagacca

SEQ ID NO: 417485 - DNA, 20 bp, mouse
ggctccacgtcagaaggaac

SEQ ID NO: 417486 - DNA, 20 bp, mouse
gcggggctgatgtagcagag

SEQ ID NO: 417487 - DNA, 20 bp, mouse
gtgcctagcttggaaagggt

SEQ ID NO: 417488 - DNA, 20 bp, mouse
gctacactggggacttgtgg

SEQ ID NO: 417489 - DNA, 20 bp, mouse
ggggctacactggggacttg

SEQ ID NO: 417490 - DNA, 20 bp, mouse
gtgatgtagcagagaggctg

SEQ ID NO: 417491 - DNA, 20 bp, mouse
gccgctgctaggcaaccgtg

SEQ ID NO: 417492 - DNA, 20 bp, mouse
gggcacgctgggagaatcga

SEQ ID NO: 417493 - DNA, 20 bp, mouse
ggcgtagactgagccgggag

SEQ ID NO: 417494 - DNA, 20 bp, mouse
gctggtgcctagcttggaaa

SEQ ID NO: 417495 - DNA, 20 bp, mouse
gatggaaagctgggctacac

SEQ ID NO: 417496 - DNA, 20 bp, mouse
ggtgggaacgacaacccagt

SEQ ID NO: 417497 - DNA, 20 bp, mouse
ggaggcaaacactggactcg

SEQ ID NO: 417498 - DNA, 20 bp, mouse
gaagaggtttctgactcagg

SEQ ID NO: 417499 - DNA, 20 bp, mouse
gttatggtgggaccaggagc

SEQ ID NO: 417500 - DNA, 20 bp, mouse
gctgatcaaagttcattctg

SEQ ID NO: 417501 - DNA, 20 bp, mouse
gactccccaggccaaaatgg

SEQ ID NO: 417502 - DNA, 20 bp, mouse
gcagcagcactgggcctgca

SEQ ID NO: 417503 - DNA, 20 bp, mouse
gttcagagggcagtcgatgg

SEQ ID NO: 417504 - DNA, 20 bp, mouse
ggccctctgaaattactggg

SEQ ID NO: 417505 - DNA, 20 bp, mouse
ggagagagctgtgtgagtga

SEQ ID NO: 417506 - DNA, 20 bp, mouse
gaaatgttcggagagctcca

SEQ ID NO: 417507 - DNA, 20 bp, mouse
gtcaggggctagtaacggag

SEQ ID NO: 417508 - DNA, 20 bp, mouse
ggtgggtcaggggctagtaa

SEQ ID NO: 417509 - DNA, 20 bp, mouse
gcggagaggcatgttaatct

SEQ ID NO: 417510 - DNA, 20 bp, mouse
gttcaggagtccggctcaga

SEQ ID NO: 417511 - DNA, 20 bp, mouse
ggccgggtcgctaaggacgg

SEQ ID NO: 417512 - DNA, 20 bp, mouse
gtaaggacggaggtgggtca

SEQ ID NO: 417513 - DNA, 20 bp, mouse
gggtcgctaaggacggaggt

SEQ ID NO: 417514 - DNA, 20 bp, mouse
gggctaacgcgcgagcgcgg

SEQ ID NO: 417515 - DNA, 20 bp, mouse
gctcagacaaatgccacaag

SEQ ID NO: 417516 - DNA, 20 bp, mouse
gaagagcaggacggcaacga

SEQ ID NO: 417517 - DNA, 20 bp, mouse
gtgcctgtgcagcctggtgt

SEQ ID NO: 417518 - DNA, 20 bp, mouse
gacgttcttggccttcatcg

SEQ ID NO: 417519 - DNA, 20 bp, mouse
gggcatcccgagaggcagga

SEQ ID NO: 417520 - DNA, 20 bp, mouse
gagtgacgctgccacgatga

SEQ ID NO: 417521 - DNA, 20 bp, mouse
gggtgatggggcatcccgag

SEQ ID NO: 417522 - DNA, 20 bp, mouse
gagccctcgcagacaccgtg

SEQ ID NO: 417523 - DNA, 20 bp, mouse
gtgccccacggtgtctgcga

SEQ ID NO: 417524 - DNA, 20 bp, mouse
gcagcgtcactgccaacacc

SEQ ID NO: 417525 - DNA, 20 bp, mouse
ggatgccccatcaccagggg

SEQ ID NO: 417526 - DNA, 20 bp, mouse
gggcttcacaatggacaagt

SEQ ID NO: 417527 - DNA, 20 bp, mouse
gtgctgaagatacagactca

SEQ ID NO: 417528 - DNA, 20 bp, mouse
gctagggtgtgggttgaaca

SEQ ID NO: 417529 - DNA, 20 bp, mouse
ggacagctacttggccctct

SEQ ID NO: 417530 - DNA, 20 bp, mouse
ggaaaagagggaccttactt

SEQ ID NO: 417531 - DNA, 20 bp, mouse
gtgccagaacccctagatac

SEQ ID NO: 417532 - DNA, 20 bp, mouse
gcctggggaagtggcattga

SEQ ID NO: 417533 - DNA, 20 bp, mouse
gcacaagggtctggcccaga

SEQ ID NO: 417534 - DNA, 20 bp, mouse
gcagggagtttaagctaggt

SEQ ID NO: 417535 - DNA, 20 bp, mouse
gtcctaaagcctgtatctag

SEQ ID NO: 417536 - DNA, 20 bp, mouse
gagacagaggagaggcaact

SEQ ID NO: 417537 - DNA, 20 bp, mouse
gttggctggctgcagtttca

SEQ ID NO: 417538 - DNA, 20 bp, mouse
gcggcagttacacaacctaa

SEQ ID NO: 417539 - DNA, 20 bp, mouse
gcgaaatgttatgggatctt

SEQ ID NO: 417540 - DNA, 20 bp, mouse
ggagatggcttgggtcatgg

SEQ ID NO: 417541 - DNA, 20 bp, mouse
ggtcatctaggatagcactg

SEQ ID NO: 417542 - DNA, 20 bp, mouse
gatttcgaagctggatgaga

SEQ ID NO: 417543 - DNA, 20 bp, mouse
gggatgagatggtaagaacc

SEQ ID NO: 417544 - DNA, 20 bp, mouse
ggtcattaggtcaggagcaa

SEQ ID NO: 417545 - DNA, 20 bp, mouse
gggaggatcgagcgtggaat

SEQ ID NO: 417546 - DNA, 20 bp, mouse
gtagtttggagaaagacgag

SEQ ID NO: 417547 - DNA, 20 bp, mouse
gccgggcggtggttgtagtt

SEQ ID NO: 417548 - DNA, 20 bp, mouse
ggcggccccccggcaggccc

SEQ ID NO: 417549 - DNA, 20 bp, mouse
gttcacaagactgggcggga

SEQ ID NO: 417550 - DNA, 20 bp, mouse
gcccagtcttgtgaaactcc

SEQ ID NO: 417551 - DNA, 20 bp, mouse
gcgctctgtcagcggccccc

SEQ ID NO: 417552 - DNA, 20 bp, mouse
gagacgagcgggcgctcacg

SEQ ID NO: 417553 - DNA, 20 bp, mouse
gacagagcgtaagccgcggt

SEQ ID NO: 417554 - DNA, 20 bp, mouse
gctgagggctggagtccggt

SEQ ID NO: 417555 - DNA, 20 bp, mouse
gacgcggtccccagctccgt

SEQ ID NO: 417556 - DNA, 20 bp, mouse
gcggagctgttggcacacgg

SEQ ID NO: 417557 - DNA, 20 bp, mouse
gcccgtggcagcgacaggtt

SEQ ID NO: 417558 - DNA, 20 bp, mouse
gagctgttggcacacggagg

SEQ ID NO: 417559 - DNA, 20 bp, mouse
gatcagaacctcggagctgt

SEQ ID NO: 417560 - DNA, 20 bp, mouse
gtcgctgccacggggcaagg

SEQ ID NO: 417561 - DNA, 20 bp, mouse
gcctcggagctgttggcaca

SEQ ID NO: 417562 - DNA, 20 bp, mouse
gaaatagccaccttgccccg

SEQ ID NO: 417563 - DNA, 20 bp, mouse
gccaccgacccgccaaccct

SEQ ID NO: 417564 - DNA, 20 bp, mouse
ggcgggtcggtggcgtccga

SEQ ID NO: 417565 - DNA, 20 bp, mouse
ggggcaaggtggctatttgg

SEQ ID NO: 417566 - DNA, 20 bp, mouse
gtgacgtctccacgcctcgg

SEQ ID NO: 417567 - DNA, 20 bp, mouse
ggcgtgaggatgctactagt

SEQ ID NO: 417568 - DNA, 20 bp, mouse
gcgacgcggcctctccgccg

SEQ ID NO: 417569 - DNA, 20 bp, mouse
gcgtggagacgtcacgctag

SEQ ID NO: 417570 - DNA, 20 bp, mouse
gtctccacgcctcggcggag

SEQ ID NO: 417571 - DNA, 20 bp, mouse
gagccctcaagcctggatgt

SEQ ID NO: 417572 - DNA, 20 bp, mouse
gccgcagcccataaccaaga

SEQ ID NO: 417573 - DNA, 20 bp, mouse
gtatgggctgcggcccgacg

SEQ ID NO: 417574 - DNA, 20 bp, mouse
gtcgccgccatcttggttat

SEQ ID NO: 417575 - DNA, 20 bp, mouse
gagcctcctcagccactagt

SEQ ID NO: 417576 - DNA, 20 bp, mouse
gcgagatgttaagaaggctc

SEQ ID NO: 417577 - DNA, 20 bp, mouse
gagtgcacgagatgttaaga

SEQ ID NO: 417578 - DNA, 20 bp, mouse
gagatcctgccctcctgagg

SEQ ID NO: 417579 - DNA, 20 bp, mouse
gttcacaggaaggtccgggt

SEQ ID NO: 417580 - DNA, 20 bp, mouse
gtccctaagcttggtcaagg

SEQ ID NO: 417581 - DNA, 20 bp, mouse
gaaccaccttgaccaagctt

SEQ ID NO: 417582 - DNA, 20 bp, mouse
gacttcaaagactctgcaat

SEQ ID NO: 417583 - DNA, 20 bp, mouse
gttcccctgagaacaaacca

SEQ ID NO: 417584 - DNA, 20 bp, mouse
gatttcttcttatcgtgagt

SEQ ID NO: 417585 - DNA, 20 bp, mouse
gcaactgtctccccagccta

SEQ ID NO: 417586 - DNA, 20 bp, mouse
gtgtgctccgaggtcggcgg

SEQ ID NO: 417587 - DNA, 20 bp, mouse
gcgctgtgctccgaggtcgg

SEQ ID NO: 417588 - DNA, 20 bp, mouse
gctccgctgtgctccgaggt

SEQ ID NO: 417589 - DNA, 20 bp, mouse
gccgaggtcggcggtggcga

SEQ ID NO: 417590 - DNA, 20 bp, mouse
ggcggcgacgcacacaaaag

SEQ ID NO: 417591 - DNA, 20 bp, mouse
gcggagggcaaggagcacag

SEQ ID NO: 417592 - DNA, 20 bp, mouse
gagtgctccgctgtgctccg

SEQ ID NO: 417593 - DNA, 20 bp, mouse
gacccaggccgcagacctca

SEQ ID NO: 417594 - DNA, 20 bp, mouse
gaggcacaggccctgcccgg

SEQ ID NO: 417595 - DNA, 20 bp, mouse
gctgtccacggactcccggg

SEQ ID NO: 417596 - DNA, 20 bp, mouse
gcagcctgcggatgaatcag

SEQ ID NO: 417597 - DNA, 20 bp, mouse
gggagtaggactccacccag

SEQ ID NO: 417598 - DNA, 20 bp, mouse
gggccaggctgcaaggagaa

SEQ ID NO: 417599 - DNA, 20 bp, mouse
gctgtgaggatgtcactggc

SEQ ID NO: 417600 - DNA, 20 bp, mouse
gtcctctggccccctcctgt

SEQ ID NO: 417601 - DNA, 20 bp, mouse
gccacccacgggcatcacag

SEQ ID NO: 417602 - DNA, 20 bp, mouse
ggagccactgattcatccgc

SEQ ID NO: 417603 - DNA, 20 bp, mouse
ggagcctacccaggcaacga

SEQ ID NO: 417604 - DNA, 20 bp, mouse
gggatgaatcagtggctcct

SEQ ID NO: 417605 - DNA, 20 bp, mouse
gccgagcagacttcagcctg

SEQ ID NO: 417606 - DNA, 20 bp, mouse
gcgctctcgctggggttgag

SEQ ID NO: 417607 - DNA, 20 bp, mouse
gctgtggatgctggccaggg

SEQ ID NO: 417608 - DNA, 20 bp, mouse
gtggatgctggccagggcgg

SEQ ID NO: 417609 - DNA, 20 bp, mouse
gaggtcaaggagggaggtcg

SEQ ID NO: 417610 - DNA, 20 bp, mouse
gggcctaaggtcaaggaggg

SEQ ID NO: 417611 - DNA, 20 bp, mouse
gtcgcggggcgctctcgctg

SEQ ID NO: 417612 - DNA, 20 bp, mouse
gcctcccgccggccaggcct

SEQ ID NO: 417613 - DNA, 20 bp, mouse
gcgccggccaggcctcggcc

SEQ ID NO: 417614 - DNA, 20 bp, mouse
gctccgaaaagccaccgccc

SEQ ID NO: 417615 - DNA, 20 bp, mouse
gagggggcctaaggtcaagg

SEQ ID NO: 417616 - DNA, 20 bp, mouse
gccagcccgggtgcatagaa

SEQ ID NO: 417617 - DNA, 20 bp, mouse
gcggcgagccgcacagagca

SEQ ID NO: 417618 - DNA, 20 bp, mouse
ggcacggcgagcgcacggcg

SEQ ID NO: 417619 - DNA, 20 bp, mouse
gcagttgcggagagacaacc

SEQ ID NO: 417620 - DNA, 20 bp, mouse
gcgggtgcatagaagggtta

SEQ ID NO: 417621 - DNA, 20 bp, mouse
ggcggcgctcgctccagggg

SEQ ID NO: 417622 - DNA, 20 bp, mouse
ggaggcgcgcgagcaccgat

SEQ ID NO: 417623 - DNA, 20 bp, mouse
gactaggttgcagggagccg

SEQ ID NO: 417624 - DNA, 20 bp, mouse
ggagacaacccggcctcccc

SEQ ID NO: 417625 - DNA, 20 bp, mouse
gtccccgacaccgaccggag

SEQ ID NO: 417626 - DNA, 20 bp, mouse
gctggctcaggacagcgcta

SEQ ID NO: 417627 - DNA, 20 bp, mouse
gcctgagccagcggcagtag

SEQ ID NO: 417628 - DNA, 20 bp, mouse
gccgtctctggcagaaggat

SEQ ID NO: 417629 - DNA, 20 bp, mouse
gtggctgcttatgctggcag

SEQ ID NO: 417630 - DNA, 20 bp, mouse
gaaggatgggggttgtgacc

SEQ ID NO: 417631 - DNA, 20 bp, mouse
gaagtgagatcaggtcaagg

SEQ ID NO: 417632 - DNA, 20 bp, mouse
gagcggctcaggtgctgcgg

SEQ ID NO: 417633 - DNA, 20 bp, mouse
gccagcggcagtagcggctc

SEQ ID NO: 417634 - DNA, 20 bp, mouse
ggcaacagccacagaagccg

SEQ ID NO: 417635 - DNA, 20 bp, mouse
gctgcggtggctgcttatgc

SEQ ID NO: 417636 - DNA, 20 bp, mouse
gtacgggcagggacagttat

SEQ ID NO: 417637 - DNA, 20 bp, mouse
gaagagaaggtagtacgggc

SEQ ID NO: 417638 - DNA, 20 bp, mouse
gctggcacagaggagaatag

SEQ ID NO: 417639 - DNA, 20 bp, mouse
ggtctgtcagtaaatttcac

SEQ ID NO: 417640 - DNA, 20 bp, mouse
gttcgctctggacttcagtc

SEQ ID NO: 417641 - DNA, 20 bp, mouse
gccgaagtccccgggagaac

SEQ ID NO: 417642 - DNA, 20 bp, mouse
gaatttcacaggcttcgctc

SEQ ID NO: 417643 - DNA, 20 bp, mouse
gagccaagtggcatccaatc

SEQ ID NO: 417644 - DNA, 20 bp, mouse
gggagaatagaggagcacct

SEQ ID NO: 417645 - DNA, 20 bp, mouse
gcgggacctggattttagga

SEQ ID NO: 417646 - DNA, 20 bp, mouse
gtagaagcgcggcctgggtg

SEQ ID NO: 417647 - DNA, 20 bp, mouse
gacgggcagacctgtcagaa

SEQ ID NO: 417648 - DNA, 20 bp, mouse
gccgcgtaggctgctcggag

SEQ ID NO: 417649 - DNA, 20 bp, mouse
gagagctgtcagccgcaccc

SEQ ID NO: 417650 - DNA, 20 bp, mouse
gaggcgaaactgctccgcgt

SEQ ID NO: 417651 - DNA, 20 bp, mouse
gcaggacgctcgcactcttg

SEQ ID NO: 417652 - DNA, 20 bp, mouse
gcaggatgccctgaacgctc

SEQ ID NO: 417653 - DNA, 20 bp, mouse
gctaattggcgactctccag

SEQ ID NO: 417654 - DNA, 20 bp, mouse
gaggtaggcgggacgtggac

SEQ ID NO: 417655 - DNA, 20 bp, mouse
ggtcaggacacagtcccgtt

SEQ ID NO: 417656 - DNA, 20 bp, mouse
gcagcaactcggagaagagg

SEQ ID NO: 417657 - DNA, 20 bp, mouse
ggacccagctccagagagat

SEQ ID NO: 417658 - DNA, 20 bp, mouse
ggagctgggtccgggaatgg

SEQ ID NO: 417659 - DNA, 20 bp, mouse
gcccgccaagaaacccgtga

SEQ ID NO: 417660 - DNA, 20 bp, mouse
ggccagcgagggcgaagacg

SEQ ID NO: 417661 - DNA, 20 bp, mouse
ggatgggggtgagccctcac

SEQ ID NO: 417662 - DNA, 20 bp, mouse
ggccctcacgggtttcttgg

SEQ ID NO: 417663 - DNA, 20 bp, mouse
ggggctcacccccatctctc

SEQ ID NO: 417664 - DNA, 20 bp, mouse
gccggggcccgtcctaccgt

SEQ ID NO: 417665 - DNA, 20 bp, mouse
ggacaggtcacgcccacggt

SEQ ID NO: 417666 - DNA, 20 bp, mouse
gccagaggttggccaatcaa

SEQ ID NO: 417667 - DNA, 20 bp, mouse
gttaagaaatcaacatccag

SEQ ID NO: 417668 - DNA, 20 bp, mouse
ggaaatcaacatccagaggt

SEQ ID NO: 417669 - DNA, 20 bp, mouse
gcatcagtaaaaaatgatac

SEQ ID NO: 417670 - DNA, 20 bp, mouse
gtctcaagtgctggaagtaa

SEQ ID NO: 417671 - DNA, 20 bp, mouse
gaatgatacaggaaatagta

SEQ ID NO: 417672 - DNA, 20 bp, mouse
gaatgatacaggccggccag

SEQ ID NO: 417673 - DNA, 20 bp, mouse
gagaatcctggaggaagcca

SEQ ID NO: 417674 - DNA, 20 bp, mouse
ggccctgacctcagctcaaa

SEQ ID NO: 417675 - DNA, 20 bp, mouse
ggcttcctccaggattcttc

SEQ ID NO: 417676 - DNA, 20 bp, mouse
gaaaaaaaaagaatgataca

SEQ ID NO: 417677 - DNA, 20 bp, mouse
gtaaaaaaatgatacaggct

SEQ ID NO: 417678 - DNA, 20 bp, mouse
ggctagtttagaacataaac

SEQ ID NO: 417679 - DNA, 20 bp, mouse
gaaatcaatatccagagagt

SEQ ID NO: 417680 - DNA, 20 bp, mouse
gagaatcctggaggaagcca

SEQ ID NO: 417681 - DNA, 20 bp, mouse
gcagagagttggccaatcaa

SEQ ID NO: 417682 - DNA, 20 bp, mouse
ggccctgacctcagctcaaa

SEQ ID NO: 417683 - DNA, 20 bp, mouse
ggcttcctccaggattcttc

SEQ ID NO: 417684 - DNA, 20 bp, mouse
gaatgatacagggagtaata

SEQ ID NO: 417685 - DNA, 20 bp, mouse
gattagtaaaaaaatgatac

SEQ ID NO: 417686 - DNA, 20 bp, mouse
gttctgtctagtacgaaaga

SEQ ID NO: 417687 - DNA, 20 bp, mouse
gtaatgcaatcacaattagc

SEQ ID NO: 417688 - DNA, 20 bp, mouse
gtcctaatctactctctagc

SEQ ID NO: 417689 - DNA, 20 bp, mouse
gattagcaggaacttcacca

SEQ ID NO: 417690 - DNA, 20 bp, mouse
gcttcggaaggagagaatcc

SEQ ID NO: 417691 - DNA, 20 bp, mouse
ggagaatccaggctctacca

SEQ ID NO: 417692 - DNA, 20 bp, mouse
ggtctctgaactccttcgga

SEQ ID NO: 417693 - DNA, 20 bp, mouse
gcttggtctctgaactcctt

SEQ ID NO: 417694 - DNA, 20 bp, mouse
gagagaccaagggcaggtga

SEQ ID NO: 417695 - DNA, 20 bp, mouse
ggagttcagagaccaagggc

SEQ ID NO: 417696 - DNA, 20 bp, mouse
ggacggagagcacagaacag

SEQ ID NO: 417697 - DNA, 20 bp, mouse
gaacaggggaccaatcaagt

SEQ ID NO: 417698 - DNA, 20 bp, mouse
gttctgtgctctccgtcctg

SEQ ID NO: 417699 - DNA, 20 bp, mouse
gctaaacagcattcagcctc

SEQ ID NO: 417700 - DNA, 20 bp, mouse
ggcacagatgcagcccccac

SEQ ID NO: 417701 - DNA, 20 bp, mouse
gtgcgctgcgtgggaatccg

SEQ ID NO: 417702 - DNA, 20 bp, mouse
gaatgctgtttagggtgctc

SEQ ID NO: 417703 - DNA, 20 bp, mouse
gagttggactctctgagtat

SEQ ID NO: 417704 - DNA, 20 bp, mouse
gctgaataacttccccgtgg

SEQ ID NO: 417705 - DNA, 20 bp, mouse
gcagcgcgagctgctagtgt

SEQ ID NO: 417706 - DNA, 20 bp, mouse
gctggaaaccctcccaacat

SEQ ID NO: 417707 - DNA, 20 bp, mouse
gcagccaaagtaggcgggtg

SEQ ID NO: 417708 - DNA, 20 bp, mouse
gctgtgtacctgcttcaggt

SEQ ID NO: 417709 - DNA, 20 bp, mouse
gctgccacacccgcctactt

SEQ ID NO: 417710 - DNA, 20 bp, mouse
gcgggtgtggcagcccatgt

SEQ ID NO: 417711 - DNA, 20 bp, mouse
gccacagtagcagtcaacag

SEQ ID NO: 417712 - DNA, 20 bp, mouse
gaccagatcaaggggatgtg

SEQ ID NO: 417713 - DNA, 20 bp, mouse
gaacagcagccaaagtaggc

SEQ ID NO: 417714 - DNA, 20 bp, mouse
gtgtggcagcccatgttggg

SEQ ID NO: 417715 - DNA, 20 bp, mouse
gggccaagacgagccagcaa

SEQ ID NO: 417716 - DNA, 20 bp, mouse
gggagaagacacgcgcgaag

SEQ ID NO: 417717 - DNA, 20 bp, mouse
ggttcgaaagccacaggtca

SEQ ID NO: 417718 - DNA, 20 bp, mouse
gagggccttcaatgacccag

SEQ ID NO: 417719 - DNA, 20 bp, mouse
ggagagaagttgacagtgtt

SEQ ID NO: 417720 - DNA, 20 bp, mouse
gccaaggctggacagtgagg

SEQ ID NO: 417721 - DNA, 20 bp, mouse
gactgaggccgtgtgtcccc

SEQ ID NO: 417722 - DNA, 20 bp, mouse
gtttccagttcgaaagccac

SEQ ID NO: 417723 - DNA, 20 bp, mouse
gtgagcacatgatgtgctcc

SEQ ID NO: 417724 - DNA, 20 bp, mouse
gaagccacaggtcatggtgg

SEQ ID NO: 417725 - DNA, 20 bp, mouse
gtctcctccaccatgacctg

SEQ ID NO: 417726 - DNA, 20 bp, mouse
gtgaagtcctgtgtggacct

SEQ ID NO: 417727 - DNA, 20 bp, mouse
gccgtgctgaggccgagtcc

SEQ ID NO: 417728 - DNA, 20 bp, mouse
ggtcacatcctggtcctcat

SEQ ID NO: 417729 - DNA, 20 bp, mouse
gagagatgcccatgaggacc

SEQ ID NO: 417730 - DNA, 20 bp, mouse
gacatctgtcatcgtcaaga

SEQ ID NO: 417731 - DNA, 20 bp, mouse
gctgggcaggtctgagaggt

SEQ ID NO: 417732 - DNA, 20 bp, mouse
gggacctgggcaggtctgag

SEQ ID NO: 417733 - DNA, 20 bp, mouse
gaggttggcagagatgtgtg

SEQ ID NO: 417734 - DNA, 20 bp, mouse
gggcagagatgtgtggggtt

SEQ ID NO: 417735 - DNA, 20 bp, mouse
ggtgactgtgaagtcctgtg

SEQ ID NO: 417736 - DNA, 20 bp, mouse
gatcagtgatactaagaagg

SEQ ID NO: 417737 - DNA, 20 bp, mouse
ggagaagaactagccagaca

SEQ ID NO: 417738 - DNA, 20 bp, mouse
gactccggtgaaggtaaggg

SEQ ID NO: 417739 - DNA, 20 bp, mouse
gtcaaaggctaagaaagcgt

SEQ ID NO: 417740 - DNA, 20 bp, mouse
gaggatcagtgatactaaga

SEQ ID NO: 417741 - DNA, 20 bp, mouse
gcttgagttctaatgatcaa

SEQ ID NO: 417742 - DNA, 20 bp, mouse
gtgtgttgctgcaggatcca

SEQ ID NO: 417743 - DNA, 20 bp, mouse
ggaaacaactcttgttccat

SEQ ID NO: 417744 - DNA, 20 bp, mouse
ggacataaggatgtcaggga

SEQ ID NO: 417745 - DNA, 20 bp, mouse
ggcagactccggtgaaggta

SEQ ID NO: 417746 - DNA, 20 bp, mouse
gagtctgtgcacagaaagag

SEQ ID NO: 417747 - DNA, 20 bp, mouse
gaggaaaactcagagggaag

SEQ ID NO: 417748 - DNA, 20 bp, mouse
gtgggtctctcttctaggag

SEQ ID NO: 417749 - DNA, 20 bp, mouse
gccagcctgggaacctgcaa

SEQ ID NO: 417750 - DNA, 20 bp, mouse
ggaacagttccggcgcagat

SEQ ID NO: 417751 - DNA, 20 bp, mouse
ggtgaagaggaaaagaaacc

SEQ ID NO: 417752 - DNA, 20 bp, mouse
gccagtattgagaacgcaaa

SEQ ID NO: 417753 - DNA, 20 bp, mouse
gagggagcggggcccagcct

SEQ ID NO: 417754 - DNA, 20 bp, mouse
gaggtgggagttctaggtct

SEQ ID NO: 417755 - DNA, 20 bp, mouse
gttgagaacgcaaacggttt

SEQ ID NO: 417756 - DNA, 20 bp, mouse
ggtaatgaaacatgaaaaaa

SEQ ID NO: 417757 - DNA, 20 bp, mouse
gatgtctttagcatataaca

SEQ ID NO: 417758 - DNA, 20 bp, mouse
gtaaaaaaggggatatagca

SEQ ID NO: 417759 - DNA, 20 bp, mouse
gagggcagaggaaggtacca

SEQ ID NO: 417760 - DNA, 20 bp, mouse
ggatcccactccataatcct

SEQ ID NO: 417761 - DNA, 20 bp, mouse
gcatttctcagcacacagtt

SEQ ID NO: 417762 - DNA, 20 bp, mouse
gggatttctgtgagacaggt

SEQ ID NO: 417763 - DNA, 20 bp, mouse
gggtaccaaggattatggag

SEQ ID NO: 417764 - DNA, 20 bp, mouse
gaggaaggtaccaaggatta

SEQ ID NO: 417765 - DNA, 20 bp, mouse
ggagaagaaaacaggattat

SEQ ID NO: 417766 - DNA, 20 bp, mouse
ggtgccaggaggcaagcaaa

SEQ ID NO: 417767 - DNA, 20 bp, mouse
gaagatggaagaacacccag

SEQ ID NO: 417768 - DNA, 20 bp, mouse
gatgaggtttcagtgccagg

SEQ ID NO: 417769 - DNA, 20 bp, mouse
gaatgtcactgacagtaact

SEQ ID NO: 417770 - DNA, 20 bp, mouse
gtggcactgaaacctcatta

SEQ ID NO: 417771 - DNA, 20 bp, mouse
gtaggcagaagaggcagcac

SEQ ID NO: 417772 - DNA, 20 bp, mouse
gactgaccccaggtctccac

SEQ ID NO: 417773 - DNA, 20 bp, mouse
gttctgtcagagccctaatg

SEQ ID NO: 417774 - DNA, 20 bp, mouse
gcagtgacattagcaacttt

SEQ ID NO: 417775 - DNA, 20 bp, mouse
gccgggtggctcatgcaaga

SEQ ID NO: 417776 - DNA, 20 bp, mouse
gtgacgcggctgcttggtcc

SEQ ID NO: 417777 - DNA, 20 bp, mouse
gtgcagcgagcaggacccga

SEQ ID NO: 417778 - DNA, 20 bp, mouse
ggcgaccctaatctctgcag

SEQ ID NO: 417779 - DNA, 20 bp, mouse
gctgctggactccgcagccc

SEQ ID NO: 417780 - DNA, 20 bp, mouse
ggaaccgaaccggcccacgt

SEQ ID NO: 417781 - DNA, 20 bp, mouse
gtccctaacccgctttccgg

SEQ ID NO: 417782 - DNA, 20 bp, mouse
ggtagcaagccccgcaggag

SEQ ID NO: 417783 - DNA, 20 bp, mouse
gccatcagggcccggactca

SEQ ID NO: 417784 - DNA, 20 bp, mouse
gagaggcgcccgctcctgcg

SEQ ID NO: 417785 - DNA, 20 bp, mouse
gtcaccacgcgtgcacgcgc

SEQ ID NO: 417786 - DNA, 20 bp, mouse
gtggagagcagcgaagaggg

SEQ ID NO: 417787 - DNA, 20 bp, mouse
ggggacacagggccccgagg

SEQ ID NO: 417788 - DNA, 20 bp, mouse
gtgcaaagacgggagcatcg

SEQ ID NO: 417789 - DNA, 20 bp, mouse
gcccatcgggccagagacct

SEQ ID NO: 417790 - DNA, 20 bp, mouse
gtcgctggatggggatgaaa

SEQ ID NO: 417791 - DNA, 20 bp, mouse
gttgcaggaatcgctggatg

SEQ ID NO: 417792 - DNA, 20 bp, mouse
gagcatcgcggcaacctcct

SEQ ID NO: 417793 - DNA, 20 bp, mouse
gcagcgattcctgcaaagac

SEQ ID NO: 417794 - DNA, 20 bp, mouse
gtcaggggctacgatgacag

SEQ ID NO: 417795 - DNA, 20 bp, mouse
gtcgagtctccgctcctccg

SEQ ID NO: 417796 - DNA, 20 bp, mouse
gcccctggtcttgcacacaa

SEQ ID NO: 417797 - DNA, 20 bp, mouse
ggtgttacagctctacacaa

SEQ ID NO: 417798 - DNA, 20 bp, mouse
gaattcagacagcaaaacaa

SEQ ID NO: 417799 - DNA, 20 bp, mouse
gtcttggagcaggtattatc

SEQ ID NO: 417800 - DNA, 20 bp, mouse
gtagtcaccaggcataagct

SEQ ID NO: 417801 - DNA, 20 bp, mouse
gtgggtatgaagcatggcag

SEQ ID NO: 417802 - DNA, 20 bp, mouse
ggggagaaaagatatgacag

SEQ ID NO: 417803 - DNA, 20 bp, mouse
ggatcatcccagcttatgcc

SEQ ID NO: 417804 - DNA, 20 bp, mouse
gtttccacggtgctcagtgt

SEQ ID NO: 417805 - DNA, 20 bp, mouse
ggagtgagcacattgcgtct

SEQ ID NO: 417806 - DNA, 20 bp, mouse
ggcgggagcgcacagtcagt

SEQ ID NO: 417807 - DNA, 20 bp, mouse
gcggcatcgccagggcgtcc

SEQ ID NO: 417808 - DNA, 20 bp, mouse
gtaaaggggagggcccggat

SEQ ID NO: 417809 - DNA, 20 bp, mouse
gacgcctcccgctaaagggg

SEQ ID NO: 417810 - DNA, 20 bp, mouse
gcggacgcctcccgctaaag

SEQ ID NO: 417811 - DNA, 20 bp, mouse
ggcaaccgtggcggcaatcg

SEQ ID NO: 417812 - DNA, 20 bp, mouse
gggccctcccctttagcggg

SEQ ID NO: 417813 - DNA, 20 bp, mouse
gggcaggagactagcgtcgc

SEQ ID NO: 417814 - DNA, 20 bp, mouse
gtcgccagggcgtccgggcg

SEQ ID NO: 417815 - DNA, 20 bp, mouse
gcgccacggttgcccggcac

SEQ ID NO: 417816 - DNA, 20 bp, mouse
gggcgagcggctgacaggag

SEQ ID NO: 417817 - DNA, 20 bp, mouse
gcgggactcccgacgcacac

SEQ ID NO: 417818 - DNA, 20 bp, mouse
ggccggcgggcgcgcttcta

SEQ ID NO: 417819 - DNA, 20 bp, mouse
gtgcgtcgggagtcccggtg

SEQ ID NO: 417820 - DNA, 20 bp, mouse
gagcgcgcccgccggcctgg

SEQ ID NO: 417821 - DNA, 20 bp, mouse
gcggctgccgctggccacac

SEQ ID NO: 417822 - DNA, 20 bp, mouse
ggagtgcgacgaggacgggg

SEQ ID NO: 417823 - DNA, 20 bp, mouse
ggcctgggggccagaagtgc

SEQ ID NO: 417824 - DNA, 20 bp, mouse
gggttgaggagccggagcac

SEQ ID NO: 417825 - DNA, 20 bp, mouse
gccgtgcgggcggccggagt

SEQ ID NO: 417826 - DNA, 20 bp, mouse
gggcggtcgccgagtcctcg

SEQ ID NO: 417827 - DNA, 20 bp, mouse
ggctgcgcgccccgaggact

SEQ ID NO: 417828 - DNA, 20 bp, mouse
gcatggcggagcgagcacac

SEQ ID NO: 417829 - DNA, 20 bp, mouse
gccctggccggtaagtgacg

SEQ ID NO: 417830 - DNA, 20 bp, mouse
gggggacggcggaacagcag

SEQ ID NO: 417831 - DNA, 20 bp, mouse
gcggtcgcagggcctcgcgg

SEQ ID NO: 417832 - DNA, 20 bp, mouse
gacggcggaacagcaggggc

SEQ ID NO: 417833 - DNA, 20 bp, mouse
ggggccctccgcctccgcag

SEQ ID NO: 417834 - DNA, 20 bp, mouse
gggggacgcgagggaaatag

SEQ ID NO: 417835 - DNA, 20 bp, mouse
gagagccgaacagaccgaga

SEQ ID NO: 417836 - DNA, 20 bp, mouse
ggaccttgaggtgacatgag

SEQ ID NO: 417837 - DNA, 20 bp, mouse
gagcgtgtggtgagcttcct

SEQ ID NO: 417838 - DNA, 20 bp, mouse
gcacctctcatgtcacctca

SEQ ID NO: 417839 - DNA, 20 bp, mouse
gcttccagatcagggcattg

SEQ ID NO: 417840 - DNA, 20 bp, mouse
ggcaagagcaccaggcggcc

SEQ ID NO: 417841 - DNA, 20 bp, mouse
ggtgcctcaatgccctgatc

SEQ ID NO: 417842 - DNA, 20 bp, mouse
ggcctggtgctcttgctccc

SEQ ID NO: 417843 - DNA, 20 bp, mouse
gtgggctcaggggtaattgg

SEQ ID NO: 417844 - DNA, 20 bp, mouse
gcaaggtctcccaggccgcc

SEQ ID NO: 417845 - DNA, 20 bp, mouse
gtaggcctactcatagacac

SEQ ID NO: 417846 - DNA, 20 bp, mouse
gctctccccaaggctccccc

SEQ ID NO: 417847 - DNA, 20 bp, mouse
gctgcagaggatgaagaccg

SEQ ID NO: 417848 - DNA, 20 bp, mouse
ggagctcggtgggacaggta

SEQ ID NO: 417849 - DNA, 20 bp, mouse
ggaggtatttcatttaactt

SEQ ID NO: 417850 - DNA, 20 bp, mouse
gaaatgaaatacctccgggg

SEQ ID NO: 417851 - DNA, 20 bp, mouse
ggttaaatgaaatacctccg

SEQ ID NO: 417852 - DNA, 20 bp, mouse
gtcctggccaggttccgaga

SEQ ID NO: 417853 - DNA, 20 bp, mouse
gctcggtgggacaggtaagg

SEQ ID NO: 417854 - DNA, 20 bp, mouse
gacggagcgcgggagaactg

SEQ ID NO: 417855 - DNA, 20 bp, mouse
gaggccggcctagaaggaga

SEQ ID NO: 417856 - DNA, 20 bp, mouse
gggaagagcccgggacgtgt

SEQ ID NO: 417857 - DNA, 20 bp, mouse
gggccgtgagaaccagacct

SEQ ID NO: 417858 - DNA, 20 bp, mouse
ggctcagacagtccactcct

SEQ ID NO: 417859 - DNA, 20 bp, mouse
gacgtgtaggaggtgagagc

SEQ ID NO: 417860 - DNA, 20 bp, mouse
gagagcccgggacgtgtagg

SEQ ID NO: 417861 - DNA, 20 bp, mouse
ggcagcggcgcaacttgaaa

SEQ ID NO: 417862 - DNA, 20 bp, mouse
gtggactgtctgagccaagg

SEQ ID NO: 417863 - DNA, 20 bp, mouse
ggacagtccactcctaggtc

SEQ ID NO: 417864 - DNA, 20 bp, mouse
gccacctaggtgctagtcga

SEQ ID NO: 417865 - DNA, 20 bp, mouse
gctcacctcctacacgtccc

SEQ ID NO: 417866 - DNA, 20 bp, mouse
gccaaggtagatgtgatcaa

SEQ ID NO: 417867 - DNA, 20 bp, mouse
gaaccctcccatggatccca

SEQ ID NO: 417868 - DNA, 20 bp, mouse
gcatctaccttgggatccat

SEQ ID NO: 417869 - DNA, 20 bp, mouse
gcgcctagggctctagagca

SEQ ID NO: 417870 - DNA, 20 bp, mouse
gcgccatgctctagagccct

SEQ ID NO: 417871 - DNA, 20 bp, mouse
ggcaaatggccattcgccta

SEQ ID NO: 417872 - DNA, 20 bp, mouse
gagggagatggacaaggtta

SEQ ID NO: 417873 - DNA, 20 bp, mouse
gaccatagagaaataaggac

SEQ ID NO: 417874 - DNA, 20 bp, mouse
gctctagagccctaggcgaa

SEQ ID NO: 417875 - DNA, 20 bp, mouse
gtaaagaccatagagaaata

SEQ ID NO: 417876 - DNA, 20 bp, mouse
gtcttcctgaaggcagagac

SEQ ID NO: 417877 - DNA, 20 bp, mouse
gtggggagctgtacttacaa

SEQ ID NO: 417878 - DNA, 20 bp, mouse
gacacaggtatatagtacat

SEQ ID NO: 417879 - DNA, 20 bp, mouse
ggttctgaagccatcagcct

SEQ ID NO: 417880 - DNA, 20 bp, mouse
gagcaggtcagcagcagtag

SEQ ID NO: 417881 - DNA, 20 bp, mouse
gaaacgcacatacaaagtaa

SEQ ID NO: 417882 - DNA, 20 bp, mouse
ggtacataggtgacttctca

SEQ ID NO: 417883 - DNA, 20 bp, mouse
gccttgggtgtcagggacac

SEQ ID NO: 417884 - DNA, 20 bp, mouse
gtagggattagggagtaatg

SEQ ID NO: 417885 - DNA, 20 bp, mouse
gctgtacttacaaaggagag

SEQ ID NO: 417886 - DNA, 20 bp, mouse
ggggcgcgcggacgactcag

SEQ ID NO: 417887 - DNA, 20 bp, mouse
gtgcgcggcttggagaagca

SEQ ID NO: 417888 - DNA, 20 bp, mouse
gtgctacggcggccccatgt

SEQ ID NO: 417889 - DNA, 20 bp, mouse
gaagcagggctcgtgtgcta

SEQ ID NO: 417890 - DNA, 20 bp, mouse
gcggctgaacgcacccacat

SEQ ID NO: 417891 - DNA, 20 bp, mouse
gagcggcctgtaaccatgcg

SEQ ID NO: 417892 - DNA, 20 bp, mouse
gccaagccgcgcatggttac

SEQ ID NO: 417893 - DNA, 20 bp, mouse
ggtccttgccgccaaagtaa

SEQ ID NO: 417894 - DNA, 20 bp, mouse
gcggaagcggaaatcagcgt

SEQ ID NO: 417895 - DNA, 20 bp, mouse
gcgttacctgcctccagggc

SEQ ID NO: 417896 - DNA, 20 bp, mouse
ggtctggcctcacgacacac

SEQ ID NO: 417897 - DNA, 20 bp, mouse
gctgcgggacagccatgacc

SEQ ID NO: 417898 - DNA, 20 bp, mouse
ggtaccagaagagctacggg

SEQ ID NO: 417899 - DNA, 20 bp, mouse
gggctacccagcagccgttt

SEQ ID NO: 417900 - DNA, 20 bp, mouse
gacaggcacccgcacccggc

SEQ ID NO: 417901 - DNA, 20 bp, mouse
ggcagccgtttgggtacctg

SEQ ID NO: 417902 - DNA, 20 bp, mouse
gcggccagccagaagaaccc

SEQ ID NO: 417903 - DNA, 20 bp, mouse
gacacacaggcacccgcacc

SEQ ID NO: 417904 - DNA, 20 bp, mouse
gagtgacgagagccgggtca

SEQ ID NO: 417905 - DNA, 20 bp, mouse
gcgggtgcctgtgtgtcgtg

SEQ ID NO: 417906 - DNA, 20 bp, mouse
gggctgggaacgctgaagga

SEQ ID NO: 417907 - DNA, 20 bp, mouse
gacagggccaagccccgacc

SEQ ID NO: 417908 - DNA, 20 bp, mouse
gggcaggctgggaacgctga

SEQ ID NO: 417909 - DNA, 20 bp, mouse
ggcagagtggagacctgcgt

SEQ ID NO: 417910 - DNA, 20 bp, mouse
gaagcgcgcagtctgcagag

SEQ ID NO: 417911 - DNA, 20 bp, mouse
ggtagatagttcgggcgagt

SEQ ID NO: 417912 - DNA, 20 bp, mouse
gacaaggcacgagtgtctga

SEQ ID NO: 417913 - DNA, 20 bp, mouse
gacttactgcgcccggtgct

SEQ ID NO: 417914 - DNA, 20 bp, mouse
gcaccacaggaggctatatt

SEQ ID NO: 417915 - DNA, 20 bp, mouse
gggtgtcacagtgggagata

SEQ ID NO: 417916 - DNA, 20 bp, mouse
ggcgagcagtgtgcaggctg

SEQ ID NO: 417917 - DNA, 20 bp, mouse
gccctgggcgagcagtgtgc

SEQ ID NO: 417918 - DNA, 20 bp, mouse
gctccctggacacaagccct

SEQ ID NO: 417919 - DNA, 20 bp, mouse
gcgcccagggcttgtgtcca

SEQ ID NO: 417920 - DNA, 20 bp, mouse
ggcctgcacactgctcgccc

SEQ ID NO: 417921 - DNA, 20 bp, mouse
gaagcttataggccaggcgg

SEQ ID NO: 417922 - DNA, 20 bp, mouse
gcccggagctctggctatgg

SEQ ID NO: 417923 - DNA, 20 bp, mouse
gttctttatcgggcactccc

SEQ ID NO: 417924 - DNA, 20 bp, mouse
gagttgagtagaggtgtccc

SEQ ID NO: 417925 - DNA, 20 bp, mouse
gcaaaagcttataggccagg

SEQ ID NO: 417926 - DNA, 20 bp, mouse
gggcacgtgtgcctgcgcat

SEQ ID NO: 417927 - DNA, 20 bp, mouse
gggcgtatagcagccatcag

SEQ ID NO: 417928 - DNA, 20 bp, mouse
gtgccgcaacatgcaagtgg

SEQ ID NO: 417929 - DNA, 20 bp, mouse
gttagtgcagggttagagac

SEQ ID NO: 417930 - DNA, 20 bp, mouse
gtagatgcagataggagccc

SEQ ID NO: 417931 - DNA, 20 bp, mouse
gtagcagccatcagtggtgg

SEQ ID NO: 417932 - DNA, 20 bp, mouse
gacgtgccgcaacatgcaag

SEQ ID NO: 417933 - DNA, 20 bp, mouse
gactgttatggagaccgcgt

SEQ ID NO: 417934 - DNA, 20 bp, mouse
gttcgcgtgtgcccatgcgc

SEQ ID NO: 417935 - DNA, 20 bp, mouse
gcacctccacttgcatgttg

SEQ ID NO: 417936 - DNA, 20 bp, mouse
gcggtttcatgacagtccat

SEQ ID NO: 417937 - DNA, 20 bp, mouse
gcatgaaaccggacaaactc

SEQ ID NO: 417938 - DNA, 20 bp, mouse
gggccacacaggcagcagat

SEQ ID NO: 417939 - DNA, 20 bp, mouse
gccttacacataggccacac

SEQ ID NO: 417940 - DNA, 20 bp, mouse
gtggggtagtcccagaggag

SEQ ID NO: 417941 - DNA, 20 bp, mouse
gctagactggggacaaagaa

SEQ ID NO: 417942 - DNA, 20 bp, mouse
gtattcactagaaaagctaa

SEQ ID NO: 417943 - DNA, 20 bp, mouse
ggtttttcttaaggctccca

SEQ ID NO: 417944 - DNA, 20 bp, mouse
gtaaagtggggtagtcccag

SEQ ID NO: 417945 - DNA, 20 bp, mouse
gaggagtggcctcaacgtac

SEQ ID NO: 417946 - DNA, 20 bp, mouse
gaggtctgtaggccagatgt

SEQ ID NO: 417947 - DNA, 20 bp, mouse
gtcacgcctctaggagagaa

SEQ ID NO: 417948 - DNA, 20 bp, mouse
gaaaggaacgagcatggctt

SEQ ID NO: 417949 - DNA, 20 bp, mouse
gggagagaaaggaacgagca

SEQ ID NO: 417950 - DNA, 20 bp, mouse
gaagatctccagttggaatt

SEQ ID NO: 417951 - DNA, 20 bp, mouse
ggcctgctgccaacatcgga

SEQ ID NO: 417952 - DNA, 20 bp, mouse
gaagtgtgctcctggaagag

SEQ ID NO: 417953 - DNA, 20 bp, mouse
gatctagcaagatctccagt

SEQ ID NO: 417954 - DNA, 20 bp, mouse
gtcgttcctttctctcctag

SEQ ID NO: 417955 - DNA, 20 bp, mouse
gcctagcctgctgccaacat

SEQ ID NO: 417956 - DNA, 20 bp, mouse
gtcaggggatagctcagggt

SEQ ID NO: 417957 - DNA, 20 bp, mouse
gggattcaggggatagctca

SEQ ID NO: 417958 - DNA, 20 bp, mouse
gtaagaagtaacttacttgc

SEQ ID NO: 417959 - DNA, 20 bp, mouse
gagtaacttacttgctggtg

SEQ ID NO: 417960 - DNA, 20 bp, mouse
gtcagggtaggatgctggtc

SEQ ID NO: 417961 - DNA, 20 bp, mouse
gatgtttactacactttgat

SEQ ID NO: 417962 - DNA, 20 bp, mouse
gtcttgttactggagttact

SEQ ID NO: 417963 - DNA, 20 bp, mouse
gtgctatgtgcgtaacatta

SEQ ID NO: 417964 - DNA, 20 bp, mouse
gatagctcagggtaggatgc

SEQ ID NO: 417965 - DNA, 20 bp, mouse
gagttgactttcaggattca

SEQ ID NO: 417966 - DNA, 20 bp, mouse
ggcatgaacggctcacaggt

SEQ ID NO: 417967 - DNA, 20 bp, mouse
ggggagcatgaacggctcac

SEQ ID NO: 417968 - DNA, 20 bp, mouse
ggagctgctgcaaccagtcc

SEQ ID NO: 417969 - DNA, 20 bp, mouse
gagccctgctggcccgagaa

SEQ ID NO: 417970 - DNA, 20 bp, mouse
gtatcaggccctgagcgcgg

SEQ ID NO: 417971 - DNA, 20 bp, mouse
gaccatgcgtggcccctctg

SEQ ID NO: 417972 - DNA, 20 bp, mouse
ggccactcggacccccagag

SEQ ID NO: 417973 - DNA, 20 bp, mouse
gcaggccctgagcgcggagg

SEQ ID NO: 417974 - DNA, 20 bp, mouse
gtctgtgggatcctgttcct

SEQ ID NO: 417975 - DNA, 20 bp, mouse
ggctgtgtcagaagtctcta

SEQ ID NO: 417976 - DNA, 20 bp, mouse
gcgggcgcaggctccctcaa

SEQ ID NO: 417977 - DNA, 20 bp, mouse
gctgccagcgccgaggcgag

SEQ ID NO: 417978 - DNA, 20 bp, mouse
gcgagcccggcggcctttga

SEQ ID NO: 417979 - DNA, 20 bp, mouse
gctcggcgctggcagtgaag

SEQ ID NO: 417980 - DNA, 20 bp, mouse
gagggagcctgcgcccggcc

SEQ ID NO: 417981 - DNA, 20 bp, mouse
gcccggccgggcggccagtc

SEQ ID NO: 417982 - DNA, 20 bp, mouse
gaaaggccgccgggctcgcg

SEQ ID NO: 417983 - DNA, 20 bp, mouse
gccgccgcgccccgccggac

SEQ ID NO: 417984 - DNA, 20 bp, mouse
gggctccctcaaaggccgcc

SEQ ID NO: 417985 - DNA, 20 bp, mouse
gcgccgggtagctgccgatg

SEQ ID NO: 417986 - DNA, 20 bp, mouse
gccttcggatgagaatagtg

SEQ ID NO: 417987 - DNA, 20 bp, mouse
gctgaagccgaaggacgggg

SEQ ID NO: 417988 - DNA, 20 bp, mouse
gcagggacgccgcgatgcag

SEQ ID NO: 417989 - DNA, 20 bp, mouse
gaggctgacggacggacgag

SEQ ID NO: 417990 - DNA, 20 bp, mouse
gttcctgaagccgaaggacg

SEQ ID NO: 417991 - DNA, 20 bp, mouse
gccacacacttatcccaggg

SEQ ID NO: 417992 - DNA, 20 bp, mouse
gccgcactggcgcagggatg

SEQ ID NO: 417993 - DNA, 20 bp, mouse
gtcctgagccggacgaccgg

SEQ ID NO: 417994 - DNA, 20 bp, mouse
gaggccacacacttatccca

SEQ ID NO: 417995 - DNA, 20 bp, mouse
gggaggcagagtccacaatg

SEQ ID NO: 417996 - DNA, 20 bp, mouse
gccttgtagacaacagacaa

SEQ ID NO: 417997 - DNA, 20 bp, mouse
gggagaattgtggattggaa

SEQ ID NO: 417998 - DNA, 20 bp, mouse
gagaaataatacctcaatct

SEQ ID NO: 417999 - DNA, 20 bp, mouse
gcaagggatttagcaacaga

SEQ ID NO: 418000 - DNA, 20 bp, mouse
ggctgtttggccttggacag

SEQ ID NO: 418001 - DNA, 20 bp, mouse
gaatctgggagtccagagct

SEQ ID NO: 418002 - DNA, 20 bp, mouse
gttttctgtttggctgaaga

SEQ ID NO: 418003 - DNA, 20 bp, mouse
gaggttctgtcccctgtcca

SEQ ID NO: 418004 - DNA, 20 bp, mouse
gtaatccatgcagttctagg

SEQ ID NO: 418005 - DNA, 20 bp, mouse
gtggtatgcagtgattaata

SEQ ID NO: 418006 - DNA, 20 bp, mouse
ggtctccgcgcgtctcaggg

SEQ ID NO: 418007 - DNA, 20 bp, mouse
ggccgcgggacacgcgggag

SEQ ID NO: 418008 - DNA, 20 bp, mouse
gcgcccccaaggcacgatcg

SEQ ID NO: 418009 - DNA, 20 bp, mouse
gcgccgcgatcgtgccttgg

SEQ ID NO: 418010 - DNA, 20 bp, mouse
gtcctctcccgcgtgtcccg

SEQ ID NO: 418011 - DNA, 20 bp, mouse
gccgaagccgcgcgccccca

SEQ ID NO: 418012 - DNA, 20 bp, mouse
gacaggctgcagccagcgtt

SEQ ID NO: 418013 - DNA, 20 bp, mouse
ggcggcctccctgagacgcg

SEQ ID NO: 418014 - DNA, 20 bp, mouse
ggagcgggcgacacaagcca

SEQ ID NO: 418015 - DNA, 20 bp, mouse
gggcagtgcagtcgtaaagt

SEQ ID NO: 418016 - DNA, 20 bp, mouse
gggagcgccatgcgtctgtg

SEQ ID NO: 418017 - DNA, 20 bp, mouse
gggaagggccttgagagagt

SEQ ID NO: 418018 - DNA, 20 bp, mouse
gctcacccagcatggcaaag

SEQ ID NO: 418019 - DNA, 20 bp, mouse
ggccatgcgtctgtgaggtt

SEQ ID NO: 418020 - DNA, 20 bp, mouse
ggagtctcctgcagacatca

SEQ ID NO: 418021 - DNA, 20 bp, mouse
gagagagagacacggtgaga

SEQ ID NO: 418022 - DNA, 20 bp, mouse
gcccaaaggcggaagcaccc

SEQ ID NO: 418023 - DNA, 20 bp, mouse
gcctgcagacatcacgggaa

SEQ ID NO: 418024 - DNA, 20 bp, mouse
gccctgagcctactctctca

SEQ ID NO: 418025 - DNA, 20 bp, mouse
gcacatactacatacaccag

SEQ ID NO: 418026 - DNA, 20 bp, mouse
gagcagaggctgagtatctg

SEQ ID NO: 418027 - DNA, 20 bp, mouse
gtacagaccgggccaaggac

SEQ ID NO: 418028 - DNA, 20 bp, mouse
gacacaggcagagttgcgtg

SEQ ID NO: 418029 - DNA, 20 bp, mouse
gaggctgagtatctgcggtg

SEQ ID NO: 418030 - DNA, 20 bp, mouse
gagttgctctgtgatctgca

SEQ ID NO: 418031 - DNA, 20 bp, mouse
gtgtctggagaatgcttgtt

SEQ ID NO: 418032 - DNA, 20 bp, mouse
ggcggtgtggaatacagacc

SEQ ID NO: 418033 - DNA, 20 bp, mouse
gcccggggccatctagaccc

SEQ ID NO: 418034 - DNA, 20 bp, mouse
gctgtccaagcattgagaaa

SEQ ID NO: 418035 - DNA, 20 bp, mouse
gctgagtatctgcggtgggg

SEQ ID NO: 418036 - DNA, 20 bp, mouse
gtcaacaccagagaaccgaa

SEQ ID NO: 418037 - DNA, 20 bp, mouse
ggcagaggaagaagcttggc

SEQ ID NO: 418038 - DNA, 20 bp, mouse
gcaactgagacagacccgaa

SEQ ID NO: 418039 - DNA, 20 bp, mouse
gccccgctgggacagatacg

SEQ ID NO: 418040 - DNA, 20 bp, mouse
gcagagaaccgaaaggacgc

SEQ ID NO: 418041 - DNA, 20 bp, mouse
ggagacagcagttgctatct

SEQ ID NO: 418042 - DNA, 20 bp, mouse
gactcagctgtgggacaaca

SEQ ID NO: 418043 - DNA, 20 bp, mouse
gcccggggtgaaagggatgg

SEQ ID NO: 418044 - DNA, 20 bp, mouse
ggagacagacccgaaaggaa

SEQ ID NO: 418045 - DNA, 20 bp, mouse
gtgaagtctagctcaggtct

SEQ ID NO: 418046 - DNA, 20 bp, mouse
gcgcactggcctcctgagaa

SEQ ID NO: 418047 - DNA, 20 bp, mouse
ggcagccgcccggggcacca

SEQ ID NO: 418048 - DNA, 20 bp, mouse
ggctatgcgcccttctcagg

SEQ ID NO: 418049 - DNA, 20 bp, mouse
gcgcgctatgcgcccttctc

SEQ ID NO: 418050 - DNA, 20 bp, mouse
gcaccgggaagggcatgtag

SEQ ID NO: 418051 - DNA, 20 bp, mouse
gcacctgtgctaggagggtg

SEQ ID NO: 418052 - DNA, 20 bp, mouse
gtcaggaggccagtgcgctc

SEQ ID NO: 418053 - DNA, 20 bp, mouse
gaaagacgccgagaccgcgg

SEQ ID NO: 418054 - DNA, 20 bp, mouse
gtggtggtctaggtacccag

SEQ ID NO: 418055 - DNA, 20 bp, mouse
gagctggtggacacatccac

SEQ ID NO: 418056 - DNA, 20 bp, mouse
ggctcctaaagccagcgacg

SEQ ID NO: 418057 - DNA, 20 bp, mouse
gcgacggggagcgagcgcgg

SEQ ID NO: 418058 - DNA, 20 bp, mouse
gcagcacggggaacgcacca

SEQ ID NO: 418059 - DNA, 20 bp, mouse
gcagcgacggggagcgagcg

SEQ ID NO: 418060 - DNA, 20 bp, mouse
ggcgcggcggcggccagcac

SEQ ID NO: 418061 - DNA, 20 bp, mouse
gggactgcccggagccctca

SEQ ID NO: 418062 - DNA, 20 bp, mouse
gccctcagggagaggcgagg

SEQ ID NO: 418063 - DNA, 20 bp, mouse
ggctggctttaggagcgacc

SEQ ID NO: 418064 - DNA, 20 bp, mouse
gagcggcgagaggaaggccc

SEQ ID NO: 418065 - DNA, 20 bp, mouse
ggctgacggcagcaaatatg

SEQ ID NO: 418066 - DNA, 20 bp, mouse
gtgagcctgcgaggtcgtaa

SEQ ID NO: 418067 - DNA, 20 bp, mouse
ggtcgtaagggtgacagtcg

SEQ ID NO: 418068 - DNA, 20 bp, mouse
ggtcaggccgggaggagcag

SEQ ID NO: 418069 - DNA, 20 bp, mouse
gcaccggctcatccacaggg

SEQ ID NO: 418070 - DNA, 20 bp, mouse
gggctcaccggctcatccac

SEQ ID NO: 418071 - DNA, 20 bp, mouse
ggcctgaccatcccacatag

SEQ ID NO: 418072 - DNA, 20 bp, mouse
gggaggagcagcggagagac

SEQ ID NO: 418073 - DNA, 20 bp, mouse
ggtcctccctgtggatgagc

SEQ ID NO: 418074 - DNA, 20 bp, mouse
ggttgggtaggtgagttgag

SEQ ID NO: 418075 - DNA, 20 bp, mouse
ggggtgcacagctttaggag

SEQ ID NO: 418076 - DNA, 20 bp, mouse
ggccctgggtggcaacctct

SEQ ID NO: 418077 - DNA, 20 bp, mouse
gtggagtaggggccccccca

SEQ ID NO: 418078 - DNA, 20 bp, mouse
ggaacccgcacaggggaatg

SEQ ID NO: 418079 - DNA, 20 bp, mouse
gtgggtggcaacctcttggc

SEQ ID NO: 418080 - DNA, 20 bp, mouse
gagtaggggcccccccaggg

SEQ ID NO: 418081 - DNA, 20 bp, mouse
gcaacctcttggcaggtcct

SEQ ID NO: 418082 - DNA, 20 bp, mouse
ggtcctggggaacccgcaca

SEQ ID NO: 418083 - DNA, 20 bp, mouse
ggaagccccgcgagttagag

SEQ ID NO: 418084 - DNA, 20 bp, mouse
gaccaccccattcccctgtg

SEQ ID NO: 418085 - DNA, 20 bp, mouse
gggttgccacccagggcagt

SEQ ID NO: 418086 - DNA, 20 bp, mouse
ggtcaggcgtgggatctgca

SEQ ID NO: 418087 - DNA, 20 bp, mouse
ggtcacccgagcctgagcgg

SEQ ID NO: 418088 - DNA, 20 bp, mouse
ggcagggcgggtgatttctg

SEQ ID NO: 418089 - DNA, 20 bp, mouse
ggcgtgggatctgcagggca

SEQ ID NO: 418090 - DNA, 20 bp, mouse
gatcccacgcctgacgcgtg

SEQ ID NO: 418091 - DNA, 20 bp, mouse
gggtcagggagcaaacccgg

SEQ ID NO: 418092 - DNA, 20 bp, mouse
gtctccgccgagtcgcccta

SEQ ID NO: 418093 - DNA, 20 bp, mouse
ggcgtccctccgctcaggct

SEQ ID NO: 418094 - DNA, 20 bp, mouse
ggcccgaggccaggtacggt

SEQ ID NO: 418095 - DNA, 20 bp, mouse
gtgacgcgtggggcgggaag

SEQ ID NO: 418096 - DNA, 20 bp, mouse
ggagcggtgagccaggccaa

SEQ ID NO: 418097 - DNA, 20 bp, mouse
gaggccaatggcggtgactg

SEQ ID NO: 418098 - DNA, 20 bp, mouse
ggtgcgactgtcgcgttggg

SEQ ID NO: 418099 - DNA, 20 bp, mouse
ggcggggttgcggacagagt

SEQ ID NO: 418100 - DNA, 20 bp, mouse
ggcagtgcgactgtcgcgtt

SEQ ID NO: 418101 - DNA, 20 bp, mouse
gtgtccgcaaccccgcccaa

SEQ ID NO: 418102 - DNA, 20 bp, mouse
ggcacggacccggagccctt

SEQ ID NO: 418103 - DNA, 20 bp, mouse
gacaaaggcggcggtgctgg

SEQ ID NO: 418104 - DNA, 20 bp, mouse
ggtggcgcagcgcattgagc

SEQ ID NO: 418105 - DNA, 20 bp, mouse
gggacccggagcccttgggc

SEQ ID NO: 418106 - DNA, 20 bp, mouse
gagaatttatgaccatgagg

SEQ ID NO: 418107 - DNA, 20 bp, mouse
gttgctgaaaagtgtccagg

SEQ ID NO: 418108 - DNA, 20 bp, mouse
gtccaggaggcagagctctt

SEQ ID NO: 418109 - DNA, 20 bp, mouse
gtggtcataaattctcatag

SEQ ID NO: 418110 - DNA, 20 bp, mouse
ggaaggtgatgtggtgacag

SEQ ID NO: 418111 - DNA, 20 bp, mouse
gtggatagcctctcttcttc

SEQ ID NO: 418112 - DNA, 20 bp, mouse
gggtttcctggataaaaccc

SEQ ID NO: 418113 - DNA, 20 bp, mouse
ggatacctcccctttttcgt

SEQ ID NO: 418114 - DNA, 20 bp, mouse
ggaggactacaggctgttag

SEQ ID NO: 418115 - DNA, 20 bp, mouse
gtgtgcccacgaaaaagggg

SEQ ID NO: 418116 - DNA, 20 bp, mouse
gggaggctaggatagtaaaa

SEQ ID NO: 418117 - DNA, 20 bp, mouse
ggctgaggccacaggcgcta

SEQ ID NO: 418118 - DNA, 20 bp, mouse
ggtgaagacccagaaatcca

SEQ ID NO: 418119 - DNA, 20 bp, mouse
gcttatttccagctggcgaa

SEQ ID NO: 418120 - DNA, 20 bp, mouse
ggctggcgaagggaagagcc

SEQ ID NO: 418121 - DNA, 20 bp, mouse
ggccagctggaaataagctg

SEQ ID NO: 418122 - DNA, 20 bp, mouse
ggcctcagcttatttccagc

SEQ ID NO: 418123 - DNA, 20 bp, mouse
ggacgaggtcgaaggtctag

SEQ ID NO: 418124 - DNA, 20 bp, mouse
gtccccgaggagaaaaaaac

SEQ ID NO: 418125 - DNA, 20 bp, mouse
gcctccagctaaaggtggag

SEQ ID NO: 418126 - DNA, 20 bp, mouse
gactgagcatggcagagaag

SEQ ID NO: 418127 - DNA, 20 bp, mouse
gaaacacagcggaagaaacc

SEQ ID NO: 418128 - DNA, 20 bp, mouse
ggtgccgcgtctcccagcaa

SEQ ID NO: 418129 - DNA, 20 bp, mouse
ggtgagggcgaggcgctatg

SEQ ID NO: 418130 - DNA, 20 bp, mouse
gcacccacacccgtactagg

SEQ ID NO: 418131 - DNA, 20 bp, mouse
gggaccgttgctgggagacg

SEQ ID NO: 418132 - DNA, 20 bp, mouse
gtatgaatatccccaggcgt

SEQ ID NO: 418133 - DNA, 20 bp, mouse
gtatggggcggatgatgaag

SEQ ID NO: 418134 - DNA, 20 bp, mouse
ggactcgtgctccttaggaa

SEQ ID NO: 418135 - DNA, 20 bp, mouse
gccaggtcagaccaagtggt

SEQ ID NO: 418136 - DNA, 20 bp, mouse
gtggtcgcgcggtgcatccg

SEQ ID NO: 418137 - DNA, 20 bp, mouse
ggcctcagaaggacccggca

SEQ ID NO: 418138 - DNA, 20 bp, mouse
ggccgcgcctcagaaggacc

SEQ ID NO: 418139 - DNA, 20 bp, mouse
gcccgcgggaccgggcaggg

SEQ ID NO: 418140 - DNA, 20 bp, mouse
ggggcgggcaggacgccgtc

SEQ ID NO: 418141 - DNA, 20 bp, mouse
gagggccgcgagctgctcag

SEQ ID NO: 418142 - DNA, 20 bp, mouse
gcagaaggacccggcacggc

SEQ ID NO: 418143 - DNA, 20 bp, mouse
gcggcccgcgggaccgggca

SEQ ID NO: 418144 - DNA, 20 bp, mouse
gcgtaggtcgcacccgtgtg

SEQ ID NO: 418145 - DNA, 20 bp, mouse
gtgcagggttgatgagacgt

SEQ ID NO: 418146 - DNA, 20 bp, mouse
gtgcggagtgacagcacctg

SEQ ID NO: 418147 - DNA, 20 bp, mouse
gaaggagaggcacttaccac

SEQ ID NO: 418148 - DNA, 20 bp, mouse
gggctctggcggggtcaagt

SEQ ID NO: 418149 - DNA, 20 bp, mouse
gagagggcggtgcttgggtg

SEQ ID NO: 418150 - DNA, 20 bp, mouse
ggagcacagagggcggtgct

SEQ ID NO: 418151 - DNA, 20 bp, mouse
ggtgcctctccttggacctt

SEQ ID NO: 418152 - DNA, 20 bp, mouse
gaacgctgcggtggctctgg

SEQ ID NO: 418153 - DNA, 20 bp, mouse
gtaactggcttgcaaggtga

SEQ ID NO: 418154 - DNA, 20 bp, mouse
ggctcccagcccgcccctct

SEQ ID NO: 418155 - DNA, 20 bp, mouse
gggcatgagaatctctgcag

SEQ ID NO: 418156 - DNA, 20 bp, mouse
gggcgacaggtcccgactca

SEQ ID NO: 418157 - DNA, 20 bp, mouse
gcgcaaggcggaccttgagt

SEQ ID NO: 418158 - DNA, 20 bp, mouse
gtggctgacaacctgagctg

SEQ ID NO: 418159 - DNA, 20 bp, mouse
gacccaggcccgggcgttgg

SEQ ID NO: 418160 - DNA, 20 bp, mouse
gatcctgcgcgcacgcaagg

SEQ ID NO: 418161 - DNA, 20 bp, mouse
gagtgacccgcaggaggcgt

SEQ ID NO: 418162 - DNA, 20 bp, mouse
gctgggtccggaccacggag

SEQ ID NO: 418163 - DNA, 20 bp, mouse
gagaaaccacagggtcgtgg

SEQ ID NO: 418164 - DNA, 20 bp, mouse
gtgagctcggcgcaccggag

SEQ ID NO: 418165 - DNA, 20 bp, mouse
gcagtctgagaagctaaggt

SEQ ID NO: 418166 - DNA, 20 bp, mouse
gagcgcagcccgggctatcc

SEQ ID NO: 418167 - DNA, 20 bp, mouse
gacgctcctaggccgacccg

SEQ ID NO: 418168 - DNA, 20 bp, mouse
gatccaggatgcaacttcca

SEQ ID NO: 418169 - DNA, 20 bp, mouse
gctaggagcgtgagaatgaa

SEQ ID NO: 418170 - DNA, 20 bp, mouse
gggatgcaacttccacgggt

SEQ ID NO: 418171 - DNA, 20 bp, mouse
ggctcggccgagctctagct

SEQ ID NO: 418172 - DNA, 20 bp, mouse
gaggatggccgagaaagacc

SEQ ID NO: 418173 - DNA, 20 bp, mouse
gagagctccgagctagagct

SEQ ID NO: 418174 - DNA, 20 bp, mouse
gaacttccacgggtcggcct

SEQ ID NO: 418175 - DNA, 20 bp, mouse
gcatagagcggtgcagacga

SEQ ID NO: 418176 - DNA, 20 bp, mouse
ggcgccgtcgcccacctcgg

SEQ ID NO: 418177 - DNA, 20 bp, mouse
ggaaatcgcgcctccgaggt

SEQ ID NO: 418178 - DNA, 20 bp, mouse
gccagggcaacctcttccaa

SEQ ID NO: 418179 - DNA, 20 bp, mouse
gagagactatggaaacccca

SEQ ID NO: 418180 - DNA, 20 bp, mouse
gtcggaggcgcgatttcccg

SEQ ID NO: 418181 - DNA, 20 bp, mouse
gcggcccggcagctgttatc

SEQ ID NO: 418182 - DNA, 20 bp, mouse
gcattccgtaggaatagcgg

SEQ ID NO: 418183 - DNA, 20 bp, mouse
ggccgaacgagccggccatt

SEQ ID NO: 418184 - DNA, 20 bp, mouse
gtgagaaacctccaagccgg

SEQ ID NO: 418185 - DNA, 20 bp, mouse
gtttcccgcggcctaatggc

SEQ ID NO: 418186 - DNA, 20 bp, mouse
gccaggagcccggcaccccg

SEQ ID NO: 418187 - DNA, 20 bp, mouse
gcccgcgggcggacgcagga

SEQ ID NO: 418188 - DNA, 20 bp, mouse
ggccaggcttcggcccgcac

SEQ ID NO: 418189 - DNA, 20 bp, mouse
gagcttggcgcggcagctgg

SEQ ID NO: 418190 - DNA, 20 bp, mouse
ggcggcctggcgcgtggtga

SEQ ID NO: 418191 - DNA, 20 bp, mouse
gttggcgcggcagctggagg

SEQ ID NO: 418192 - DNA, 20 bp, mouse
ggcaggatggcggcgctgcg

SEQ ID NO: 418193 - DNA, 20 bp, mouse
ggccatcctgcgtccgcccg

SEQ ID NO: 418194 - DNA, 20 bp, mouse
ggctgccgcgccaagctccg

SEQ ID NO: 418195 - DNA, 20 bp, mouse
gccccgcggcactccacaac

SEQ ID NO: 418196 - DNA, 20 bp, mouse
gcggagagaatgcagagtag

SEQ ID NO: 418197 - DNA, 20 bp, mouse
gcattctctccgttgcgagc

SEQ ID NO: 418198 - DNA, 20 bp, mouse
gcctctgaggcaaggctctc

SEQ ID NO: 418199 - DNA, 20 bp, mouse
gtccgaataggcccgccaat

SEQ ID NO: 418200 - DNA, 20 bp, mouse
gtcctattggcgggcctatt

SEQ ID NO: 418201 - DNA, 20 bp, mouse
gatcttaagtctcagtcgct

SEQ ID NO: 418202 - DNA, 20 bp, mouse
ggtgacttcaactagcatgc

SEQ ID NO: 418203 - DNA, 20 bp, mouse
gggcccgccaataggagtag

SEQ ID NO: 418204 - DNA, 20 bp, mouse
gaatgcagagtaggggaaca

SEQ ID NO: 418205 - DNA, 20 bp, mouse
ggaggaaccaagaatggtca

SEQ ID NO: 418206 - DNA, 20 bp, mouse
gctgtctccagataccggtg

SEQ ID NO: 418207 - DNA, 20 bp, mouse
gataggctgtctccagatac

SEQ ID NO: 418208 - DNA, 20 bp, mouse
ggaggcggcagaagcctcac

SEQ ID NO: 418209 - DNA, 20 bp, mouse
gggagacagcctatacccag

SEQ ID NO: 418210 - DNA, 20 bp, mouse
gaacggatcccaaggagact

SEQ ID NO: 418211 - DNA, 20 bp, mouse
gggatccgttcttagacaag

SEQ ID NO: 418212 - DNA, 20 bp, mouse
gatccaggtcctctgggtat

SEQ ID NO: 418213 - DNA, 20 bp, mouse
gcagaagcctcaccggtatc

SEQ ID NO: 418214 - DNA, 20 bp, mouse
gaagctcgcctagtctcctt

SEQ ID NO: 418215 - DNA, 20 bp, mouse
gggctgctggatccctgctt

SEQ ID NO: 418216 - DNA, 20 bp, mouse
ggagaatcagtgggctctct

SEQ ID NO: 418217 - DNA, 20 bp, mouse
gttcaggtacaactcttgtc

SEQ ID NO: 418218 - DNA, 20 bp, mouse
gagcaggctgctgtagttgg

SEQ ID NO: 418219 - DNA, 20 bp, mouse
gagaaccaaggtcctctccc

SEQ ID NO: 418220 - DNA, 20 bp, mouse
gctttttcaagagaatcagt

SEQ ID NO: 418221 - DNA, 20 bp, mouse
gactacagcagcctgctcag

SEQ ID NO: 418222 - DNA, 20 bp, mouse
ggagggtgcttggcaggagt

SEQ ID NO: 418223 - DNA, 20 bp, mouse
gccctcgtcctggcaaggac

SEQ ID NO: 418224 - DNA, 20 bp, mouse
gctgctgtagttggaggcga

SEQ ID NO: 418225 - DNA, 20 bp, mouse
gcagacccaagtgggctggt

SEQ ID NO: 418226 - DNA, 20 bp, mouse
gctgtgggtaccgaatgcaa

SEQ ID NO: 418227 - DNA, 20 bp, mouse
gcagcagatctgagattcgg

SEQ ID NO: 418228 - DNA, 20 bp, mouse
gtggccatttccacacttag

SEQ ID NO: 418229 - DNA, 20 bp, mouse
ggcagtgtggccactggagt

SEQ ID NO: 418230 - DNA, 20 bp, mouse
gggcttctggctgaacaggt

SEQ ID NO: 418231 - DNA, 20 bp, mouse
gacattagcagtgtggccac

SEQ ID NO: 418232 - DNA, 20 bp, mouse
gagcctgagttcaacagcct

SEQ ID NO: 418233 - DNA, 20 bp, mouse
gaccaggagagaaactaggg

SEQ ID NO: 418234 - DNA, 20 bp, mouse
gtaccagcagatctgagatt

SEQ ID NO: 418235 - DNA, 20 bp, mouse
gagaaatggggcaactgacc

SEQ ID NO: 418236 - DNA, 20 bp, mouse
gtaagagccaggcaccaacc

SEQ ID NO: 418237 - DNA, 20 bp, mouse
gtggcaccccctacccacag

SEQ ID NO: 418238 - DNA, 20 bp, mouse
ggcctggctcttagcagatg

SEQ ID NO: 418239 - DNA, 20 bp, mouse
gaccccatctgctaagagcc

SEQ ID NO: 418240 - DNA, 20 bp, mouse
gaacagtcagggactcctca

SEQ ID NO: 418241 - DNA, 20 bp, mouse
ggtctcttgggataacccaa

SEQ ID NO: 418242 - DNA, 20 bp, mouse
gggtggcttgggagagctga

SEQ ID NO: 418243 - DNA, 20 bp, mouse
ggttgagcactcacagttcc

SEQ ID NO: 418244 - DNA, 20 bp, mouse
gaacctaagaggttaagtgg

SEQ ID NO: 418245 - DNA, 20 bp, mouse
gcattctccccactaccacg

SEQ ID NO: 418246 - DNA, 20 bp, mouse
gcaaccagtcctacaagcat

SEQ ID NO: 418247 - DNA, 20 bp, mouse
gagcccctaggctgatacta

SEQ ID NO: 418248 - DNA, 20 bp, mouse
gactaaggacagtcatgtcg

SEQ ID NO: 418249 - DNA, 20 bp, mouse
gaggacagtcatgtcgtgga

SEQ ID NO: 418250 - DNA, 20 bp, mouse
gggacacaagggtaaaggga

SEQ ID NO: 418251 - DNA, 20 bp, mouse
gtgtgctaggcactcatata

SEQ ID NO: 418252 - DNA, 20 bp, mouse
ggcccaaggctcttcatgag

SEQ ID NO: 418253 - DNA, 20 bp, mouse
gcatacaagttgctcgaagt

SEQ ID NO: 418254 - DNA, 20 bp, mouse
ggctggggacacaagggtaa

SEQ ID NO: 418255 - DNA, 20 bp, mouse
gaaaagggctttatcatctg

SEQ ID NO: 418256 - DNA, 20 bp, mouse
gttaactgagaggcaaatgg

SEQ ID NO: 418257 - DNA, 20 bp, mouse
gctgcccttgggtcacagta

SEQ ID NO: 418258 - DNA, 20 bp, mouse
gccaggcctgcacatcaaac

SEQ ID NO: 418259 - DNA, 20 bp, mouse
ggtatagttactaaaattgg

SEQ ID NO: 418260 - DNA, 20 bp, mouse
gtgcaggcctggaaaccacc

SEQ ID NO: 418261 - DNA, 20 bp, mouse
ggtattaactgagaggcaaa

SEQ ID NO: 418262 - DNA, 20 bp, mouse
gtgacttgagttctgccctt

SEQ ID NO: 418263 - DNA, 20 bp, mouse
gttattaagctaatacctgg

SEQ ID NO: 418264 - DNA, 20 bp, mouse
gcagggcttctgacagacat

SEQ ID NO: 418265 - DNA, 20 bp, mouse
ggaaccagaaagaatccatt

SEQ ID NO: 418266 - DNA, 20 bp, mouse
gggcggcgcggacgactgaa

SEQ ID NO: 418267 - DNA, 20 bp, mouse
gttggtgttggaggctgcgg

SEQ ID NO: 418268 - DNA, 20 bp, mouse
gctcctcagacgactcccag

SEQ ID NO: 418269 - DNA, 20 bp, mouse
ggaggacgcgagggtcacag

SEQ ID NO: 418270 - DNA, 20 bp, mouse
gagtgaggcgcagagcggaa

SEQ ID NO: 418271 - DNA, 20 bp, mouse
gactgaagggaatttggtgt

SEQ ID NO: 418272 - DNA, 20 bp, mouse
gaatttggtgttggaggctg

SEQ ID NO: 418273 - DNA, 20 bp, mouse
ggaagggaatttggtgttgg

SEQ ID NO: 418274 - DNA, 20 bp, mouse
gtcacgagcacctccccggg

SEQ ID NO: 418275 - DNA, 20 bp, mouse
ggcggaagtgaggcgcagag

SEQ ID NO: 418276 - DNA, 20 bp, mouse
ggtctccccgctcctcacca

SEQ ID NO: 418277 - DNA, 20 bp, mouse
gtagctgtgacgaaaggccg

SEQ ID NO: 418278 - DNA, 20 bp, mouse
gtcggcagcatgcgatacgg

SEQ ID NO: 418279 - DNA, 20 bp, mouse
gatgtcggcagcatgcgata

SEQ ID NO: 418280 - DNA, 20 bp, mouse
gcgaaggctcgccaagttct

SEQ ID NO: 418281 - DNA, 20 bp, mouse
gaaggccgtggtgaggagcg

SEQ ID NO: 418282 - DNA, 20 bp, mouse
ggtgacgaaaggccgtggtg

SEQ ID NO: 418283 - DNA, 20 bp, mouse
gggcggtttcgagacttcga

SEQ ID NO: 418284 - DNA, 20 bp, mouse
gcaactcctgggctgatcac

SEQ ID NO: 418285 - DNA, 20 bp, mouse
ggcaagcttctccgagaact

SEQ ID NO: 418286 - DNA, 20 bp, mouse
gggtttgccagaccgcacag

SEQ ID NO: 418287 - DNA, 20 bp, mouse
gtctctagctcttggtccct

SEQ ID NO: 418288 - DNA, 20 bp, mouse
gcctctaaaggaagccccag

SEQ ID NO: 418289 - DNA, 20 bp, mouse
gctaaaggaagccccagagg

SEQ ID NO: 418290 - DNA, 20 bp, mouse
gagtcaggccgtgaaagctc

SEQ ID NO: 418291 - DNA, 20 bp, mouse
gtgtaagtcagcagtcaggg

SEQ ID NO: 418292 - DNA, 20 bp, mouse
ggaggcgggcagtcacagcc

SEQ ID NO: 418293 - DNA, 20 bp, mouse
gcagccgggtctctagctct

SEQ ID NO: 418294 - DNA, 20 bp, mouse
gaaagtgtcaagccaaaggg

SEQ ID NO: 418295 - DNA, 20 bp, mouse
gtactggatagagagcaggg

SEQ ID NO: 418296 - DNA, 20 bp, mouse
ggctctcaagctcccgggta

SEQ ID NO: 418297 - DNA, 20 bp, mouse
gctggacagcactgtcgcca

SEQ ID NO: 418298 - DNA, 20 bp, mouse
ggggctgcagactccttacc

SEQ ID NO: 418299 - DNA, 20 bp, mouse
gcgcacgggggcctccgcca

SEQ ID NO: 418300 - DNA, 20 bp, mouse
gggactctcggggactcccg

SEQ ID NO: 418301 - DNA, 20 bp, mouse
gtccagggctctcaagctcc

SEQ ID NO: 418302 - DNA, 20 bp, mouse
gcggtccccgactcacaccc

SEQ ID NO: 418303 - DNA, 20 bp, mouse
gggctcccgggtgtgagtcg

SEQ ID NO: 418304 - DNA, 20 bp, mouse
gtacacttcccggcaggacg

SEQ ID NO: 418305 - DNA, 20 bp, mouse
gtagtcccggcgctcaggga

SEQ ID NO: 418306 - DNA, 20 bp, mouse
gcgagaggaaataaacgtcg

SEQ ID NO: 418307 - DNA, 20 bp, mouse
gtgtaactggtcgtcccaca

SEQ ID NO: 418308 - DNA, 20 bp, mouse
gagggtagcatgtaaccgag

SEQ ID NO: 418309 - DNA, 20 bp, mouse
gcggttacatgctaccctgt

SEQ ID NO: 418310 - DNA, 20 bp, mouse
gaagatcagggatccaatat

SEQ ID NO: 418311 - DNA, 20 bp, mouse
gtcgccttcaccagggacag

SEQ ID NO: 418312 - DNA, 20 bp, mouse
gtctctggccaaaaagaaga

SEQ ID NO: 418313 - DNA, 20 bp, mouse
ggacgaccagttacattctc

SEQ ID NO: 418314 - DNA, 20 bp, mouse
ggaggaggactcaatggcgt

SEQ ID NO: 418315 - DNA, 20 bp, mouse
gacagctgggggatgtcccg

SEQ ID NO: 418316 - DNA, 20 bp, mouse
gccgcgccagagccacaccg

SEQ ID NO: 418317 - DNA, 20 bp, mouse
gtccgggcccggaggtgcag

SEQ ID NO: 418318 - DNA, 20 bp, mouse
gccacaccgcgggacagccc

SEQ ID NO: 418319 - DNA, 20 bp, mouse
gggcggagcaggaggcgagt

SEQ ID NO: 418320 - DNA, 20 bp, mouse
gcgcggcccgggctgtcccg

SEQ ID NO: 418321 - DNA, 20 bp, mouse
gctcctgcatcccggccggg

SEQ ID NO: 418322 - DNA, 20 bp, mouse
ggcggccgggaacccaagat

SEQ ID NO: 418323 - DNA, 20 bp, mouse
gtgtatgtgccggtcaagac

SEQ ID NO: 418324 - DNA, 20 bp, mouse
gcaggcaccagtcccggaac

SEQ ID NO: 418325 - DNA, 20 bp, mouse
gtctctcctgcatcccggcc

SEQ ID NO: 418326 - DNA, 20 bp, mouse
gctgacgcggagcctcccag

SEQ ID NO: 418327 - DNA, 20 bp, mouse
gcgacccccgggccctgacg

SEQ ID NO: 418328 - DNA, 20 bp, mouse
ggctccgcgtcagggcccgg

SEQ ID NO: 418329 - DNA, 20 bp, mouse
gtcccggaccgaccagtaga

SEQ ID NO: 418330 - DNA, 20 bp, mouse
ggacggtcgagaagacaagg

SEQ ID NO: 418331 - DNA, 20 bp, mouse
ggcctcccagcggcgcgcgg

SEQ ID NO: 418332 - DNA, 20 bp, mouse
gctaggcctactgctagtcc

SEQ ID NO: 418333 - DNA, 20 bp, mouse
ggcccgccttcccgaccccc

SEQ ID NO: 418334 - DNA, 20 bp, mouse
gggagacgctcccctcccga

SEQ ID NO: 418335 - DNA, 20 bp, mouse
ggtggacggtcgagaagaca

SEQ ID NO: 418336 - DNA, 20 bp, mouse
ggccggaagcgatggaggta

SEQ ID NO: 418337 - DNA, 20 bp, mouse
gcccgagccggaagcgatgg

SEQ ID NO: 418338 - DNA, 20 bp, mouse
ggaacagcaactcagaataa

SEQ ID NO: 418339 - DNA, 20 bp, mouse
ggctgcgggcctgccaggac

SEQ ID NO: 418340 - DNA, 20 bp, mouse
ggcaactcagaataagggat

SEQ ID NO: 418341 - DNA, 20 bp, mouse
gcgacccgagccggaagcga

SEQ ID NO: 418342 - DNA, 20 bp, mouse
gagagcgccgcgacccgagc

SEQ ID NO: 418343 - DNA, 20 bp, mouse
gctgttccaggagcccgtcc

SEQ ID NO: 418344 - DNA, 20 bp, mouse
ggcccagaagcaccgagtta

SEQ ID NO: 418345 - DNA, 20 bp, mouse
ggccctacctccatcgcttc

SEQ ID NO: 418346 - DNA, 20 bp, mouse
gcccgccgcccaggagcagg

SEQ ID NO: 418347 - DNA, 20 bp, mouse
ggaggtggcggctccgagta

SEQ ID NO: 418348 - DNA, 20 bp, mouse
gctggcggccgcctgctcct

SEQ ID NO: 418349 - DNA, 20 bp, mouse
ggtgcccgccgcccaggagc

SEQ ID NO: 418350 - DNA, 20 bp, mouse
gggatgctgcgcggctccgg

SEQ ID NO: 418351 - DNA, 20 bp, mouse
gtggcggctccgagtagggc

SEQ ID NO: 418352 - DNA, 20 bp, mouse
gaaagggcgcagggacctga

SEQ ID NO: 418353 - DNA, 20 bp, mouse
gtggaggtggagcgctgaaa

SEQ ID NO: 418354 - DNA, 20 bp, mouse
gggcgggcaccggccctact

SEQ ID NO: 418355 - DNA, 20 bp, mouse
gacggagctcgggagcagga

SEQ ID NO: 418356 - DNA, 20 bp, mouse
ggagcgagcttccttctgaa

SEQ ID NO: 418357 - DNA, 20 bp, mouse
ggtctctgatctacatgcct

SEQ ID NO: 418358 - DNA, 20 bp, mouse
ggcagagctgtagcagccag

SEQ ID NO: 418359 - DNA, 20 bp, mouse
gggtgtgtggatgttgccta

SEQ ID NO: 418360 - DNA, 20 bp, mouse
gtcagcagggaacgtgaacg

SEQ ID NO: 418361 - DNA, 20 bp, mouse
gggtgcctggggctgtgccc

SEQ ID NO: 418362 - DNA, 20 bp, mouse
ggccaccagcttgctctgcc

SEQ ID NO: 418363 - DNA, 20 bp, mouse
gctgaaaggccatcccagga

SEQ ID NO: 418364 - DNA, 20 bp, mouse
gcatgcctgggcacagcccc

SEQ ID NO: 418365 - DNA, 20 bp, mouse
gaaacgcttgggctgggata

SEQ ID NO: 418366 - DNA, 20 bp, mouse
gggagctgtgaggtggcaaa

SEQ ID NO: 418367 - DNA, 20 bp, mouse
gggcagacatgaattcttca

SEQ ID NO: 418368 - DNA, 20 bp, mouse
ggctgcacagataaaaacct

SEQ ID NO: 418369 - DNA, 20 bp, mouse
ggccagcacacttcagtcac

SEQ ID NO: 418370 - DNA, 20 bp, mouse
gtgtgagattaggaaaagct

SEQ ID NO: 418371 - DNA, 20 bp, mouse
gtgaggagggagctgtgagg

SEQ ID NO: 418372 - DNA, 20 bp, mouse
gagataaaaaccttggaagt

SEQ ID NO: 418373 - DNA, 20 bp, mouse
gcccagtgactgaagtgtgc

SEQ ID NO: 418374 - DNA, 20 bp, mouse
gagacccctgatcacatccc

SEQ ID NO: 418375 - DNA, 20 bp, mouse
gagattaggaaaagctgggt

SEQ ID NO: 418376 - DNA, 20 bp, mouse
gtgcaaaagagcccagacac

SEQ ID NO: 418377 - DNA, 20 bp, mouse
gagtccgcgcccaggcgccg

SEQ ID NO: 418378 - DNA, 20 bp, mouse
gttgttcaagtcccgagcgg

SEQ ID NO: 418379 - DNA, 20 bp, mouse
gtcgccacggcgcctgggcg

SEQ ID NO: 418380 - DNA, 20 bp, mouse
gcggcatcgccacggcgcct

SEQ ID NO: 418381 - DNA, 20 bp, mouse
gttcaagtcccgagcggcgg

SEQ ID NO: 418382 - DNA, 20 bp, mouse
gtttttgttcaagtcccgag

SEQ ID NO: 418383 - DNA, 20 bp, mouse
gactgtgcgcgcccgtgtct

SEQ ID NO: 418384 - DNA, 20 bp, mouse
ggggagcggaagtcgccacg

SEQ ID NO: 418385 - DNA, 20 bp, mouse
gacaaaaagaagcgcgggag

SEQ ID NO: 418386 - DNA, 20 bp, mouse
gcctccccgaagcctactag

SEQ ID NO: 418387 - DNA, 20 bp, mouse
gtaaggaaaaacccgctagt

SEQ ID NO: 418388 - DNA, 20 bp, mouse
gaacaggcgatcatgtgact

SEQ ID NO: 418389 - DNA, 20 bp, mouse
gtgaaggagctgcggaacag

SEQ ID NO: 418390 - DNA, 20 bp, mouse
ggtgccaacgtctcccaagg

SEQ ID NO: 418391 - DNA, 20 bp, mouse
gaacccgctagtaggcttcg

SEQ ID NO: 418392 - DNA, 20 bp, mouse
gctcagacggactccatcca

SEQ ID NO: 418393 - DNA, 20 bp, mouse
gccaacgtctcccaaggagg

SEQ ID NO: 418394 - DNA, 20 bp, mouse
gtccctggatgtgagaaaag

SEQ ID NO: 418395 - DNA, 20 bp, mouse
gaggagcagagtactgacag

SEQ ID NO: 418396 - DNA, 20 bp, mouse
gggagctgggcagaccccaa

SEQ ID NO: 418397 - DNA, 20 bp, mouse
gctgcccagctccatcccgg

SEQ ID NO: 418398 - DNA, 20 bp, mouse
gtaccctccgggatggagct

SEQ ID NO: 418399 - DNA, 20 bp, mouse
ggagcactcagagcgccctt

SEQ ID NO: 418400 - DNA, 20 bp, mouse
gtaggggagccagaatccaa

SEQ ID NO: 418401 - DNA, 20 bp, mouse
gaactatctaccctccggga

SEQ ID NO: 418402 - DNA, 20 bp, mouse
ggcatgaactatctaccctc

SEQ ID NO: 418403 - DNA, 20 bp, mouse
gtcccagaactgaagaaacg

SEQ ID NO: 418404 - DNA, 20 bp, mouse
ggagaggtggttgggaacac

SEQ ID NO: 418405 - DNA, 20 bp, mouse
gtccgccagcgcaggattag

SEQ ID NO: 418406 - DNA, 20 bp, mouse
gagggtgctagagaagccgg

SEQ ID NO: 418407 - DNA, 20 bp, mouse
ggcctgctcgctcccgactc

SEQ ID NO: 418408 - DNA, 20 bp, mouse
ggcaggcctgcgagctgcta

SEQ ID NO: 418409 - DNA, 20 bp, mouse
ggccactgctccggaatcac

SEQ ID NO: 418410 - DNA, 20 bp, mouse
ggcccgtgattccggagcag

SEQ ID NO: 418411 - DNA, 20 bp, mouse
gtggcggcgtcgccggagtc

SEQ ID NO: 418412 - DNA, 20 bp, mouse
gtagcaccctagcagctcgc

SEQ ID NO: 418413 - DNA, 20 bp, mouse
ggcgccgcttaccgagcccc

SEQ ID NO: 418414 - DNA, 20 bp, mouse
gggagcagtggcggcgtcgc

SEQ ID NO: 418415 - DNA, 20 bp, mouse
gtctgcgtccaggcctagta

SEQ ID NO: 418416 - DNA, 20 bp, mouse
gggcgtgcgagactgaccca

SEQ ID NO: 418417 - DNA, 20 bp, mouse
gagtcacgtggtgcaaccct

SEQ ID NO: 418418 - DNA, 20 bp, mouse
gccgcgaagttcacagccca

SEQ ID NO: 418419 - DNA, 20 bp, mouse
gatggcgcagcggattgcac

SEQ ID NO: 418420 - DNA, 20 bp, mouse
ggactcccctcacagaccct

SEQ ID NO: 418421 - DNA, 20 bp, mouse
gctgacccagggtctgtgag

SEQ ID NO: 418422 - DNA, 20 bp, mouse
gcgtctcagggtcctgccca

SEQ ID NO: 418423 - DNA, 20 bp, mouse
gacttgggcgcggcgtctca

SEQ ID NO: 418424 - DNA, 20 bp, mouse
gcagcggattgcactggacg

SEQ ID NO: 418425 - DNA, 20 bp, mouse
gccaagtccacacttttaag

SEQ ID NO: 418426 - DNA, 20 bp, mouse
gccgactcgcaagataactg

SEQ ID NO: 418427 - DNA, 20 bp, mouse
gctgcggcggcgctattccg

SEQ ID NO: 418428 - DNA, 20 bp, mouse
gtctgcgactgtgcaagtac

SEQ ID NO: 418429 - DNA, 20 bp, mouse
ggagcggaactggaagaggg

SEQ ID NO: 418430 - DNA, 20 bp, mouse
gccgcggggcgtctgatcct

SEQ ID NO: 418431 - DNA, 20 bp, mouse
gggacgtaccgggagcgaag

SEQ ID NO: 418432 - DNA, 20 bp, mouse
gcccgagagactctaggaag

SEQ ID NO: 418433 - DNA, 20 bp, mouse
gactcgcaagataactgcgg

SEQ ID NO: 418434 - DNA, 20 bp, mouse
gtgcacagtcgcagaagaca

SEQ ID NO: 418435 - DNA, 20 bp, mouse
ggcgtggccaggctgctcct

SEQ ID NO: 418436 - DNA, 20 bp, mouse
gtctggagattacttaccaa

SEQ ID NO: 418437 - DNA, 20 bp, mouse
gtgggaacgacagtcatact

SEQ ID NO: 418438 - DNA, 20 bp, mouse
gagtaacaagctgtctccac

SEQ ID NO: 418439 - DNA, 20 bp, mouse
gaggagcaaattggtaaata

SEQ ID NO: 418440 - DNA, 20 bp, mouse
gctctcctgttgaccttaac

SEQ ID NO: 418441 - DNA, 20 bp, mouse
ggaaaacaacaaaccagtta

SEQ ID NO: 418442 - DNA, 20 bp, mouse
gacttcacaaattatgctct

SEQ ID NO: 418443 - DNA, 20 bp, mouse
gtcattattttgtgctcact

SEQ ID NO: 418444 - DNA, 20 bp, mouse
gctcttgtgcacactctggg

SEQ ID NO: 418445 - DNA, 20 bp, mouse
gaggcagcagaatcctgcca

SEQ ID NO: 418446 - DNA, 20 bp, mouse
ggcccgaggccgtagatcca

SEQ ID NO: 418447 - DNA, 20 bp, mouse
ggctgggagccctggatcta

SEQ ID NO: 418448 - DNA, 20 bp, mouse
gtgaagcggggtccagcggt

SEQ ID NO: 418449 - DNA, 20 bp, mouse
ggcagcgcggggccaaggat

SEQ ID NO: 418450 - DNA, 20 bp, mouse
gttggtgaagcggggtccag

SEQ ID NO: 418451 - DNA, 20 bp, mouse
ggtgcagaggagggcaatga

SEQ ID NO: 418452 - DNA, 20 bp, mouse
gctcccgccggccgcaccag

SEQ ID NO: 418453 - DNA, 20 bp, mouse
gctacggcctcgggccgggg

SEQ ID NO: 418454 - DNA, 20 bp, mouse
ggcagggcaggggcccaacg

SEQ ID NO: 418455 - DNA, 20 bp, mouse
ggccaaggattggtgaagcg

SEQ ID NO: 418456 - DNA, 20 bp, mouse
gaaagcccaccacagaggtt

SEQ ID NO: 418457 - DNA, 20 bp, mouse
gacagaggttaggctgctga

SEQ ID NO: 418458 - DNA, 20 bp, mouse
gcctcaggaagagctagcga

SEQ ID NO: 418459 - DNA, 20 bp, mouse
ggcagcctaacctctgtggt

SEQ ID NO: 418460 - DNA, 20 bp, mouse
gccaggctccacggaagagg

SEQ ID NO: 418461 - DNA, 20 bp, mouse
gagctcagactggccaagat

SEQ ID NO: 418462 - DNA, 20 bp, mouse
gtagcagttgtggcatcaga

SEQ ID NO: 418463 - DNA, 20 bp, mouse
gggtagtcggtggggccctc

SEQ ID NO: 418464 - DNA, 20 bp, mouse
gggccagcttgacaccaaag

SEQ ID NO: 418465 - DNA, 20 bp, mouse
ggagccaggctccacggaag

SEQ ID NO: 418466 - DNA, 20 bp, mouse
ggcaccaggtggcaagatct

SEQ ID NO: 418467 - DNA, 20 bp, mouse
gagatggcttctatccctct

SEQ ID NO: 418468 - DNA, 20 bp, mouse
gtctaaggtgaggacttaca

SEQ ID NO: 418469 - DNA, 20 bp, mouse
gaaggtgaggacttacaggg

SEQ ID NO: 418470 - DNA, 20 bp, mouse
ggcaccaggattagaaaaga

SEQ ID NO: 418471 - DNA, 20 bp, mouse
gatagaagccatctaaggtg

SEQ ID NO: 418472 - DNA, 20 bp, mouse
gtgtggcgaaaactgcctag

SEQ ID NO: 418473 - DNA, 20 bp, mouse
gggacttacagggaggacga

SEQ ID NO: 418474 - DNA, 20 bp, mouse
gctggcttagaggtaatgaa

SEQ ID NO: 418475 - DNA, 20 bp, mouse
gcctgaatactggctggatg

SEQ ID NO: 418476 - DNA, 20 bp, mouse
gggcaaggtagagtgtagag

SEQ ID NO: 418477 - DNA, 20 bp, mouse
gagccgcgccaaggctgccg

SEQ ID NO: 418478 - DNA, 20 bp, mouse
gcgccaaggctgccgaggca

SEQ ID NO: 418479 - DNA, 20 bp, mouse
gacggagacagacaacccga

SEQ ID NO: 418480 - DNA, 20 bp, mouse
gccgcaggccggctccagag

SEQ ID NO: 418481 - DNA, 20 bp, mouse
ggtagagtgtagagcggcac

SEQ ID NO: 418482 - DNA, 20 bp, mouse
gggccggctccagagcggag

SEQ ID NO: 418483 - DNA, 20 bp, mouse
gcagggcgggtggacagtga

SEQ ID NO: 418484 - DNA, 20 bp, mouse
gcaggcctgcaaggatgcta

SEQ ID NO: 418485 - DNA, 20 bp, mouse
gcgcgccgcccacacggaag

SEQ ID NO: 418486 - DNA, 20 bp, mouse
gtccaggtgcaactccgaga

SEQ ID NO: 418487 - DNA, 20 bp, mouse
gctggagcagatcctagggc

SEQ ID NO: 418488 - DNA, 20 bp, mouse
gggtgtgcacaccagccatg

SEQ ID NO: 418489 - DNA, 20 bp, mouse
gtcactggaagatgctgagt

SEQ ID NO: 418490 - DNA, 20 bp, mouse
gagtgatgcgagtttcctca

SEQ ID NO: 418491 - DNA, 20 bp, mouse
gtgagtgggtgtacaatgat

SEQ ID NO: 418492 - DNA, 20 bp, mouse
gaccctctcggagttgcacc

SEQ ID NO: 418493 - DNA, 20 bp, mouse
gccacaaggctctgcatcct

SEQ ID NO: 418494 - DNA, 20 bp, mouse
gctctcctgggtaaacgaaa

SEQ ID NO: 418495 - DNA, 20 bp, mouse
ggcaactccgagagggtgac

SEQ ID NO: 418496 - DNA, 20 bp, mouse
ggcccaggacatcccatcaa

SEQ ID NO: 418497 - DNA, 20 bp, mouse
ggtacgagccgggctggagg

SEQ ID NO: 418498 - DNA, 20 bp, mouse
ggcccttgatgggatgtcct

SEQ ID NO: 418499 - DNA, 20 bp, mouse
gccatcaagggccaggagtc

SEQ ID NO: 418500 - DNA, 20 bp, mouse
gagtcaggtacgagccgggc

SEQ ID NO: 418501 - DNA, 20 bp, mouse
gccggctcgtacctgactcc

SEQ ID NO: 418502 - DNA, 20 bp, mouse
gagcagcagatgacaggcgg

SEQ ID NO: 418503 - DNA, 20 bp, mouse
gcggaggagcagcagatgac

SEQ ID NO: 418504 - DNA, 20 bp, mouse
gctggaggaggctgcacata

SEQ ID NO: 418505 - DNA, 20 bp, mouse
gccaggagcgagtagtgtgc

SEQ ID NO: 418506 - DNA, 20 bp, mouse
gtgatgccaagagtccctga

SEQ ID NO: 418507 - DNA, 20 bp, mouse
ggactcttggcatcagtgtg

SEQ ID NO: 418508 - DNA, 20 bp, mouse
ggaagaagagacttcggttg

SEQ ID NO: 418509 - DNA, 20 bp, mouse
ggtgagcatagtcctgttca

SEQ ID NO: 418510 - DNA, 20 bp, mouse
gccctctcacactgggtcat

SEQ ID NO: 418511 - DNA, 20 bp, mouse
ggagacttcggttggggcat

SEQ ID NO: 418512 - DNA, 20 bp, mouse
gcagcaaccctgctccatgt

SEQ ID NO: 418513 - DNA, 20 bp, mouse
ggtgtctgctgccttggtca

SEQ ID NO: 418514 - DNA, 20 bp, mouse
gcctctggatcatagaatga

SEQ ID NO: 418515 - DNA, 20 bp, mouse
gtctacactaggaccacaac

SEQ ID NO: 418516 - DNA, 20 bp, mouse
gagtcgcgcgtaaggaggaa

SEQ ID NO: 418517 - DNA, 20 bp, mouse
gggtcctgggaagatgtgac

SEQ ID NO: 418518 - DNA, 20 bp, mouse
gaactgtccaggaaagccgt

SEQ ID NO: 418519 - DNA, 20 bp, mouse
gtgcattagggcaacaggtt

SEQ ID NO: 418520 - DNA, 20 bp, mouse
ggagtgggtgataccaggat

SEQ ID NO: 418521 - DNA, 20 bp, mouse
gcttacgcgcgactggatgg

SEQ ID NO: 418522 - DNA, 20 bp, mouse
gccagctctccgccaccaag

SEQ ID NO: 418523 - DNA, 20 bp, mouse
ggctttcctggacagttcat

SEQ ID NO: 418524 - DNA, 20 bp, mouse
gcagttcatagggtgcatta

SEQ ID NO: 418525 - DNA, 20 bp, mouse
gagctggagcgacagggctg

SEQ ID NO: 418526 - DNA, 20 bp, mouse
ggagccagtaatattgtcca

SEQ ID NO: 418527 - DNA, 20 bp, mouse
ggggctgtaagggcaaagac

SEQ ID NO: 418528 - DNA, 20 bp, mouse
gtaaaggaacagggctgtaa

SEQ ID NO: 418529 - DNA, 20 bp, mouse
gttgtcgccagcggggaaga

SEQ ID NO: 418530 - DNA, 20 bp, mouse
ggcagagccatcttccccgc

SEQ ID NO: 418531 - DNA, 20 bp, mouse
gctgccctggacaatattac

SEQ ID NO: 418532 - DNA, 20 bp, mouse
ggctggcgacaatatgatgc

SEQ ID NO: 418533 - DNA, 20 bp, mouse
gtgtccagggagctcaggca

SEQ ID NO: 418534 - DNA, 20 bp, mouse
gcaatattactggctctctc

SEQ ID NO: 418535 - DNA, 20 bp, mouse
gcaagagaatccccagaggg

SEQ ID NO: 418536 - DNA, 20 bp, mouse
gcggcgtacgggactcggag

SEQ ID NO: 418537 - DNA, 20 bp, mouse
gtcgtcctgtgacagaccgt

SEQ ID NO: 418538 - DNA, 20 bp, mouse
ggcttggaccgggcagatcg

SEQ ID NO: 418539 - DNA, 20 bp, mouse
gagttcgtggagaacagcgg

SEQ ID NO: 418540 - DNA, 20 bp, mouse
ggaccgtgggcagtcggaca

SEQ ID NO: 418541 - DNA, 20 bp, mouse
gggaccgcgacgcttggacc

SEQ ID NO: 418542 - DNA, 20 bp, mouse
gacgggactcggaggggacc

SEQ ID NO: 418543 - DNA, 20 bp, mouse
gtgcagttcgtggagaacag

SEQ ID NO: 418544 - DNA, 20 bp, mouse
gtacatcggcgtacgggact

SEQ ID NO: 418545 - DNA, 20 bp, mouse
gaggtccgagggaggagtcg

SEQ ID NO: 418546 - DNA, 20 bp, mouse
ggaagctctgtgatttggag

SEQ ID NO: 418547 - DNA, 20 bp, mouse
gtacccagccgtgccagacc

SEQ ID NO: 418548 - DNA, 20 bp, mouse
gaggtgtgccatgccgggtc

SEQ ID NO: 418549 - DNA, 20 bp, mouse
gtgccatgccgggtctggca

SEQ ID NO: 418550 - DNA, 20 bp, mouse
gggagttaaaggtccaagac

SEQ ID NO: 418551 - DNA, 20 bp, mouse
gtctggcacggctgggtaag

SEQ ID NO: 418552 - DNA, 20 bp, mouse
gcaaatgaagctctgtgatt

SEQ ID NO: 418553 - DNA, 20 bp, mouse
gtgccgggtctggcacggct

SEQ ID NO: 418554 - DNA, 20 bp, mouse
gagaaacactgcctgataca

SEQ ID NO: 418555 - DNA, 20 bp, mouse
gagtgagcactccctgtatc

SEQ ID NO: 418556 - DNA, 20 bp, mouse
gaggcatagtacacagtcag

SEQ ID NO: 418557 - DNA, 20 bp, mouse
gccaagttcacactggagga

SEQ ID NO: 418558 - DNA, 20 bp, mouse
gtcagtttccaagttcacac

SEQ ID NO: 418559 - DNA, 20 bp, mouse
ggtttccaagttcacactgg

SEQ ID NO: 418560 - DNA, 20 bp, mouse
gtctctgttattctggatag

SEQ ID NO: 418561 - DNA, 20 bp, mouse
gccagaataacagagaatag

SEQ ID NO: 418562 - DNA, 20 bp, mouse
gagaatgcatttgtttccca

SEQ ID NO: 418563 - DNA, 20 bp, mouse
gatctgatgctccagaacga

SEQ ID NO: 418564 - DNA, 20 bp, mouse
gaagcgagaatcagttcaac

SEQ ID NO: 418565 - DNA, 20 bp, mouse
ggtcataaggaggtctttgt

SEQ ID NO: 418566 - DNA, 20 bp, mouse
gcggctggggagccacggga

SEQ ID NO: 418567 - DNA, 20 bp, mouse
gtccatagtgacacagcggt

SEQ ID NO: 418568 - DNA, 20 bp, mouse
gctggtcataagcaggatgg

SEQ ID NO: 418569 - DNA, 20 bp, mouse
gagtagccgcctccatcccg

SEQ ID NO: 418570 - DNA, 20 bp, mouse
gtcctaccgctgtgtcacta

SEQ ID NO: 418571 - DNA, 20 bp, mouse
gctggggagccacgggatgg

SEQ ID NO: 418572 - DNA, 20 bp, mouse
gaccctggtcataagcagga

SEQ ID NO: 418573 - DNA, 20 bp, mouse
ggcgacgagaaggttctatg

SEQ ID NO: 418574 - DNA, 20 bp, mouse
ggggagccacgggatggagg

SEQ ID NO: 418575 - DNA, 20 bp, mouse
gacggacacgaacacgaaca

SEQ ID NO: 418576 - DNA, 20 bp, mouse
gaagctcctgcccatatcct

SEQ ID NO: 418577 - DNA, 20 bp, mouse
gctgcatcaacagaaagtgt

SEQ ID NO: 418578 - DNA, 20 bp, mouse
gacagtgtggaaccaacaca

SEQ ID NO: 418579 - DNA, 20 bp, mouse
gtaggaaaactcacagactt

SEQ ID NO: 418580 - DNA, 20 bp, mouse
gctgtgggtgttttgtgagt

SEQ ID NO: 418581 - DNA, 20 bp, mouse
gtaagaagtcaagtctctcc

SEQ ID NO: 418582 - DNA, 20 bp, mouse
gcaagaacagtggaacagtg

SEQ ID NO: 418583 - DNA, 20 bp, mouse
gttgagctgctcccaggata

SEQ ID NO: 418584 - DNA, 20 bp, mouse
gtctcagtctgggatatcag

SEQ ID NO: 418585 - DNA, 20 bp, mouse
gacccacaggcaggtgtgta

SEQ ID NO: 418586 - DNA, 20 bp, mouse
gtgtaaccaggaccgtacaa

SEQ ID NO: 418587 - DNA, 20 bp, mouse
gacccaggcatgtgaacctg

SEQ ID NO: 418588 - DNA, 20 bp, mouse
gtctataaaatgcagctgaa

SEQ ID NO: 418589 - DNA, 20 bp, mouse
ggaactccattgtacggtcc

SEQ ID NO: 418590 - DNA, 20 bp, mouse
ggcctcaggttcacatgcct

SEQ ID NO: 418591 - DNA, 20 bp, mouse
ggatatccagatacacagca

SEQ ID NO: 418592 - DNA, 20 bp, mouse
gtgagttcatctcttgactt

SEQ ID NO: 418593 - DNA, 20 bp, mouse
gcagtcattcctccaccctg

SEQ ID NO: 418594 - DNA, 20 bp, mouse
ggcatccctgtccaagaaat

SEQ ID NO: 418595 - DNA, 20 bp, mouse
gtccaagaaatgggtttgtt

SEQ ID NO: 418596 - DNA, 20 bp, mouse
ggcaggaggtagaaagtaca

SEQ ID NO: 418597 - DNA, 20 bp, mouse
ggggctgccagggcatttct

SEQ ID NO: 418598 - DNA, 20 bp, mouse
gggcatttctaggtagcagg

SEQ ID NO: 418599 - DNA, 20 bp, mouse
gtctgtgcactgtctgtctc

SEQ ID NO: 418600 - DNA, 20 bp, mouse
ggactgtgggaggatctata

SEQ ID NO: 418601 - DNA, 20 bp, mouse
ggacgctgcactggacccat

SEQ ID NO: 418602 - DNA, 20 bp, mouse
gcagccactcgggttcccat

SEQ ID NO: 418603 - DNA, 20 bp, mouse
gcaccttgccgagagttaca

SEQ ID NO: 418604 - DNA, 20 bp, mouse
gagttacagggtgagaccgt

SEQ ID NO: 418605 - DNA, 20 bp, mouse
ggctcatgacccagccactc

SEQ ID NO: 418606 - DNA, 20 bp, mouse
gtatagctggaacatcttgg

SEQ ID NO: 418607 - DNA, 20 bp, mouse
gagaagtagtgaatgaggta

SEQ ID NO: 418608 - DNA, 20 bp, mouse
gtagtgaatgaggtacggag

SEQ ID NO: 418609 - DNA, 20 bp, mouse
gaaatatagctggaacatct

SEQ ID NO: 418610 - DNA, 20 bp, mouse
ggactcagaagtagtgaatg

SEQ ID NO: 418611 - DNA, 20 bp, mouse
ggttatgctataggaggaaa

SEQ ID NO: 418612 - DNA, 20 bp, mouse
gctactatgaaatgacttaa

SEQ ID NO: 418613 - DNA, 20 bp, mouse
gtgagtagggaactcttgga

SEQ ID NO: 418614 - DNA, 20 bp, mouse
gttggtggtactttgtcaga

SEQ ID NO: 418615 - DNA, 20 bp, mouse
gaagcttctggaacataatt

SEQ ID NO: 418616 - DNA, 20 bp, mouse
gaccgctactggtccagcag

SEQ ID NO: 418617 - DNA, 20 bp, mouse
gtccactgctggaccagtag

SEQ ID NO: 418618 - DNA, 20 bp, mouse
gagagacggggcccagacca

SEQ ID NO: 418619 - DNA, 20 bp, mouse
ggtatagttgagggcctcca

SEQ ID NO: 418620 - DNA, 20 bp, mouse
gtagcggttgcctagagacg

SEQ ID NO: 418621 - DNA, 20 bp, mouse
gagtggagctgtatagttga

SEQ ID NO: 418622 - DNA, 20 bp, mouse
gccactcagcgactaggcca

SEQ ID NO: 418623 - DNA, 20 bp, mouse
gcccgtgcccggaatcaaca

SEQ ID NO: 418624 - DNA, 20 bp, mouse
gtgcgttatgatcaggtcca

SEQ ID NO: 418625 - DNA, 20 bp, mouse
gtcctctggcacagaaatat

SEQ ID NO: 418626 - DNA, 20 bp, mouse
gacagtacaacaaggcgcgg

SEQ ID NO: 418627 - DNA, 20 bp, mouse
gggcaaggcacagtacaaca

SEQ ID NO: 418628 - DNA, 20 bp, mouse
gggcacagtacaacaaggcg

SEQ ID NO: 418629 - DNA, 20 bp, mouse
gggccgtcgtccaccgggta

SEQ ID NO: 418630 - DNA, 20 bp, mouse
gctctcgctgccgtacccgg

SEQ ID NO: 418631 - DNA, 20 bp, mouse
gtgccgtacccggtggacga

SEQ ID NO: 418632 - DNA, 20 bp, mouse
gaaggcgcggcggcagctgg

SEQ ID NO: 418633 - DNA, 20 bp, mouse
ggtggacgacggccgcggca

SEQ ID NO: 418634 - DNA, 20 bp, mouse
ggacgcgcgccaggaacccc

SEQ ID NO: 418635 - DNA, 20 bp, mouse
gcgagcagcggtaatcctgg

SEQ ID NO: 418636 - DNA, 20 bp, mouse
ggaactggggagtcgagagt

SEQ ID NO: 418637 - DNA, 20 bp, mouse
ggctgggtggccaggaactg

SEQ ID NO: 418638 - DNA, 20 bp, mouse
gagagtaggcgacagctgta

SEQ ID NO: 418639 - DNA, 20 bp, mouse
ggcccctggcccaacctcca

SEQ ID NO: 418640 - DNA, 20 bp, mouse
gcttggattagtgtgaaaag

SEQ ID NO: 418641 - DNA, 20 bp, mouse
gagggttcctttctatacta

SEQ ID NO: 418642 - DNA, 20 bp, mouse
gctggggttgagaggagagt

SEQ ID NO: 418643 - DNA, 20 bp, mouse
gtagggcgtgaagagagccg

SEQ ID NO: 418644 - DNA, 20 bp, mouse
gtccctgaagcccctacctg

SEQ ID NO: 418645 - DNA, 20 bp, mouse
gaaagcggccgtgggaccgt

SEQ ID NO: 418646 - DNA, 20 bp, mouse
ggcgtttgtcaggaccactg

SEQ ID NO: 418647 - DNA, 20 bp, mouse
ggaccactgtggaagatgaa

SEQ ID NO: 418648 - DNA, 20 bp, mouse
gtcttaaagaacagtctcag

SEQ ID NO: 418649 - DNA, 20 bp, mouse
gtgtgtggccagtctagcaa

SEQ ID NO: 418650 - DNA, 20 bp, mouse
gcagtgggcagggtacataa

SEQ ID NO: 418651 - DNA, 20 bp, mouse
gaaacttgaacgagcaaact

SEQ ID NO: 418652 - DNA, 20 bp, mouse
gtggctgggcctccgaacag

SEQ ID NO: 418653 - DNA, 20 bp, mouse
ggctgttcaactgctaaggg

SEQ ID NO: 418654 - DNA, 20 bp, mouse
gtaccctgcccactgttcgg

SEQ ID NO: 418655 - DNA, 20 bp, mouse
gatttgcaaaggcgtttgtc

SEQ ID NO: 418656 - DNA, 20 bp, mouse
gagacacgtgagggtcgcgc

SEQ ID NO: 418657 - DNA, 20 bp, mouse
ggctggcctggagacacgtg

SEQ ID NO: 418658 - DNA, 20 bp, mouse
gagcgtcgcgagcgcttcaa

SEQ ID NO: 418659 - DNA, 20 bp, mouse
gtccccagggcgctccagga

SEQ ID NO: 418660 - DNA, 20 bp, mouse
ggtgtcacctgcgcccaggg

SEQ ID NO: 418661 - DNA, 20 bp, mouse
gggcgccgcccgcatcccca

SEQ ID NO: 418662 - DNA, 20 bp, mouse
gagagtgtcacctgcgccca

SEQ ID NO: 418663 - DNA, 20 bp, mouse
gggcgcaggtgacactctcc

SEQ ID NO: 418664 - DNA, 20 bp, mouse
gtccccgcgcgcaaccctgg

SEQ ID NO: 418665 - DNA, 20 bp, mouse
gactttctgtgccaggccgg

SEQ ID NO: 418666 - DNA, 20 bp, mouse
gcgtgccctccagctctagg

SEQ ID NO: 418667 - DNA, 20 bp, mouse
gagggcacggtgagccgcca

SEQ ID NO: 418668 - DNA, 20 bp, mouse
ggtgagtaaggtcgccgtgg

SEQ ID NO: 418669 - DNA, 20 bp, mouse
gcgacggcagaccctcagag

SEQ ID NO: 418670 - DNA, 20 bp, mouse
gaaagtgagtaaggtcgccg

SEQ ID NO: 418671 - DNA, 20 bp, mouse
gtccagccccctagagctgg

SEQ ID NO: 418672 - DNA, 20 bp, mouse
gtggagctgccgcagcaaga

SEQ ID NO: 418673 - DNA, 20 bp, mouse
ggccgtcgagggagccccgg

SEQ ID NO: 418674 - DNA, 20 bp, mouse
ggttggccacaaagtgagta

SEQ ID NO: 418675 - DNA, 20 bp, mouse
gccgggtaccaggaggacgg

SEQ ID NO: 418676 - DNA, 20 bp, mouse
gctgtcctggaagatggaca

SEQ ID NO: 418677 - DNA, 20 bp, mouse
gccaggacagtaaagtgcag

SEQ ID NO: 418678 - DNA, 20 bp, mouse
gcagctttgtgagttgagag

SEQ ID NO: 418679 - DNA, 20 bp, mouse
ggagctggtattgtatgctg

SEQ ID NO: 418680 - DNA, 20 bp, mouse
gtgtggccagcactgcaagg

SEQ ID NO: 418681 - DNA, 20 bp, mouse
gaagtgtggccagcactgca

SEQ ID NO: 418682 - DNA, 20 bp, mouse
gaggatagcgtgacagagca

SEQ ID NO: 418683 - DNA, 20 bp, mouse
gcgtgacagagcaagggagc

SEQ ID NO: 418684 - DNA, 20 bp, mouse
gctgccctttgtccatcctg

SEQ ID NO: 418685 - DNA, 20 bp, mouse
ggggtcgagagagaggatac

SEQ ID NO: 418686 - DNA, 20 bp, mouse
gacagtcaactggcgtccag

SEQ ID NO: 418687 - DNA, 20 bp, mouse
gagggtctcatcgaagtcgg

SEQ ID NO: 418688 - DNA, 20 bp, mouse
gtcatggagccccccaggaa

SEQ ID NO: 418689 - DNA, 20 bp, mouse
gcgcgtccctgaggaacagg

SEQ ID NO: 418690 - DNA, 20 bp, mouse
gacccgccgcctgttcctca

SEQ ID NO: 418691 - DNA, 20 bp, mouse
gcaatcgcgccacagtcaac

SEQ ID NO: 418692 - DNA, 20 bp, mouse
ggagcgcgtccctgaggaac

SEQ ID NO: 418693 - DNA, 20 bp, mouse
gagcactgacctggcaccat

SEQ ID NO: 418694 - DNA, 20 bp, mouse
ggtccctgaggaacaggcgg

SEQ ID NO: 418695 - DNA, 20 bp, mouse
ggtctcatcgaagtcggagg

SEQ ID NO: 418696 - DNA, 20 bp, mouse
gaaatccaggcggggctcca

SEQ ID NO: 418697 - DNA, 20 bp, mouse
ggctcctagccagctagcag

SEQ ID NO: 418698 - DNA, 20 bp, mouse
gggaagcgggcggccagagg

SEQ ID NO: 418699 - DNA, 20 bp, mouse
gcgccagagggagggaccgt

SEQ ID NO: 418700 - DNA, 20 bp, mouse
gagagggagggtgagtatct

SEQ ID NO: 418701 - DNA, 20 bp, mouse
gcggctgcccgcgctgcgag

SEQ ID NO: 418702 - DNA, 20 bp, mouse
gagggtgagcagcagcatcc

SEQ ID NO: 418703 - DNA, 20 bp, mouse
gttggcacgcaggaagcggg

SEQ ID NO: 418704 - DNA, 20 bp, mouse
gcccggtgctgctcacctct

SEQ ID NO: 418705 - DNA, 20 bp, mouse
ggcaggctgccaggcagttt

SEQ ID NO: 418706 - DNA, 20 bp, mouse
gcaagggtaagagtccattg

SEQ ID NO: 418707 - DNA, 20 bp, mouse
gctgtagggagaccagtcct

SEQ ID NO: 418708 - DNA, 20 bp, mouse
gctttcgagaaggaagtcag

SEQ ID NO: 418709 - DNA, 20 bp, mouse
gtctgtagctagtctctgta

SEQ ID NO: 418710 - DNA, 20 bp, mouse
gcacagttcagtttcctcaa

SEQ ID NO: 418711 - DNA, 20 bp, mouse
gctcttaagccccaaccaca

SEQ ID NO: 418712 - DNA, 20 bp, mouse
gactgtgtctagaacggcca

SEQ ID NO: 418713 - DNA, 20 bp, mouse
gtaacataacaagtacagtg

SEQ ID NO: 418714 - DNA, 20 bp, mouse
gcataatacacatacactca

SEQ ID NO: 418715 - DNA, 20 bp, mouse
gcagttccacaggactctag

SEQ ID NO: 418716 - DNA, 20 bp, mouse
gagagagtaagtaagccact

SEQ ID NO: 418717 - DNA, 20 bp, mouse
gtgggactacataaaaggct

SEQ ID NO: 418718 - DNA, 20 bp, mouse
gatgtctgataagacttcca

SEQ ID NO: 418719 - DNA, 20 bp, mouse
ggccattgggactacataaa

SEQ ID NO: 418720 - DNA, 20 bp, mouse
gttcctggcacaaacttctt

SEQ ID NO: 418721 - DNA, 20 bp, mouse
gaatcgttgtaatcagtccc

SEQ ID NO: 418722 - DNA, 20 bp, mouse
gatcatggcaacatttctaa

SEQ ID NO: 418723 - DNA, 20 bp, mouse
gtgattccataggggccatt

SEQ ID NO: 418724 - DNA, 20 bp, mouse
gtggaggaataaggaacctt

SEQ ID NO: 418725 - DNA, 20 bp, mouse
gcactctctgtgattccata

SEQ ID NO: 418726 - DNA, 20 bp, mouse
gtccctctgaaggaatacaa

SEQ ID NO: 418727 - DNA, 20 bp, mouse
gattccttcagagggagccg

SEQ ID NO: 418728 - DNA, 20 bp, mouse
gcgaggaaaacatgtaccct

SEQ ID NO: 418729 - DNA, 20 bp, mouse
ggtaccctgggaagacttca

SEQ ID NO: 418730 - DNA, 20 bp, mouse
ggcctttgtattccttcaga

SEQ ID NO: 418731 - DNA, 20 bp, mouse
ggtcctgggagtcaacgtgt

SEQ ID NO: 418732 - DNA, 20 bp, mouse
gaatcccaccaagtaaagca

SEQ ID NO: 418733 - DNA, 20 bp, mouse
gacaaaggccatgctttact

SEQ ID NO: 418734 - DNA, 20 bp, mouse
gtcacagggtgtggaatgga

SEQ ID NO: 418735 - DNA, 20 bp, mouse
gaggccatgctttacttggt

SEQ ID NO: 418736 - DNA, 20 bp, mouse
gggctgcagcgacgccgtaa

SEQ ID NO: 418737 - DNA, 20 bp, mouse
ggtgagtgagggccctgctc

SEQ ID NO: 418738 - DNA, 20 bp, mouse
gcgcgggtagcgcagactct

SEQ ID NO: 418739 - DNA, 20 bp, mouse
gagtgagggccctgctctgg

SEQ ID NO: 418740 - DNA, 20 bp, mouse
ggctggcgagtggtgagtga

SEQ ID NO: 418741 - DNA, 20 bp, mouse
ggagggccctgctctggcgg

SEQ ID NO: 418742 - DNA, 20 bp, mouse
gagcgacgccgtaaaggccg

SEQ ID NO: 418743 - DNA, 20 bp, mouse
gtggaccgcgagctgcacgg

SEQ ID NO: 418744 - DNA, 20 bp, mouse
ggcacggaggtggaggacgt

SEQ ID NO: 418745 - DNA, 20 bp, mouse
gaccgcgagctgcacggagg

SEQ ID NO: 418746 - DNA, 20 bp, mouse
ggcagcggccgggaaagcag

SEQ ID NO: 418747 - DNA, 20 bp, mouse
gaggtgaaaggtcacaaaca

SEQ ID NO: 418748 - DNA, 20 bp, mouse
gggtgactgaccccagaggg

SEQ ID NO: 418749 - DNA, 20 bp, mouse
gggagtcgggtgaccgggcc

SEQ ID NO: 418750 - DNA, 20 bp, mouse
gacaggcatgcagaggtgaa

SEQ ID NO: 418751 - DNA, 20 bp, mouse
gcgcacggcggggagcccga

SEQ ID NO: 418752 - DNA, 20 bp, mouse
gccggccgagaagggatctt

SEQ ID NO: 418753 - DNA, 20 bp, mouse
gcgtaggtgactgaccccag

SEQ ID NO: 418754 - DNA, 20 bp, mouse
gtagctgcggctgggactag

SEQ ID NO: 418755 - DNA, 20 bp, mouse
ggcccaggcgacggcggcac

SEQ ID NO: 418756 - DNA, 20 bp, mouse
gtggtccccgccgggcgaag

SEQ ID NO: 418757 - DNA, 20 bp, mouse
gccggtagtagcaggctggg

SEQ ID NO: 418758 - DNA, 20 bp, mouse
gcacccggtagtagcaggct

SEQ ID NO: 418759 - DNA, 20 bp, mouse
gccgccgggcgaagcggcag

SEQ ID NO: 418760 - DNA, 20 bp, mouse
gacagtatgcgggaaccggt

SEQ ID NO: 418761 - DNA, 20 bp, mouse
gtgtggcgcgggacagtatg

SEQ ID NO: 418762 - DNA, 20 bp, mouse
ggctgccaggacttaccgac

SEQ ID NO: 418763 - DNA, 20 bp, mouse
gagcccagtccgggtcccga

SEQ ID NO: 418764 - DNA, 20 bp, mouse
ggtcccctcacgccaagaca

SEQ ID NO: 418765 - DNA, 20 bp, mouse
gggaaccggtcggtaagtcc

SEQ ID NO: 418766 - DNA, 20 bp, mouse
gaggaagcggaggcctggac

SEQ ID NO: 418767 - DNA, 20 bp, mouse
ggacagcagtgcagacgacg

SEQ ID NO: 418768 - DNA, 20 bp, mouse
ggcctggaccggcgtctgta

SEQ ID NO: 418769 - DNA, 20 bp, mouse
ggaccggcgtctgtagggtc

SEQ ID NO: 418770 - DNA, 20 bp, mouse
ggtccagaccctacagacgc

SEQ ID NO: 418771 - DNA, 20 bp, mouse
gtagggaagaaggggacccg

SEQ ID NO: 418772 - DNA, 20 bp, mouse
gaaggggacccgaggctgag

SEQ ID NO: 418773 - DNA, 20 bp, mouse
gctgcactgctgtcccgaga

SEQ ID NO: 418774 - DNA, 20 bp, mouse
gtgttcgcgttagggaagaa

SEQ ID NO: 418775 - DNA, 20 bp, mouse
gccggttccaccctccgaac

SEQ ID NO: 418776 - DNA, 20 bp, mouse
ggtcgggccgctggagacgg

SEQ ID NO: 418777 - DNA, 20 bp, mouse
gcgcctctcaggccactcgg

SEQ ID NO: 418778 - DNA, 20 bp, mouse
gcgcctccgagtggcctgag

SEQ ID NO: 418779 - DNA, 20 bp, mouse
gcgacgccaggctgtccatg

SEQ ID NO: 418780 - DNA, 20 bp, mouse
gggcgtcgggccgctggaga

SEQ ID NO: 418781 - DNA, 20 bp, mouse
gcgtcctccgccgtctccag

SEQ ID NO: 418782 - DNA, 20 bp, mouse
gagtggttcccgcctccgag

SEQ ID NO: 418783 - DNA, 20 bp, mouse
gtgaagccgcatggacagcc

SEQ ID NO: 418784 - DNA, 20 bp, mouse
ggaggagctgccagcggcag

SEQ ID NO: 418785 - DNA, 20 bp, mouse
gggcggtacgtgaagccgca

SEQ ID NO: 418786 - DNA, 20 bp, mouse
gcctgcgtatctctaggatg

SEQ ID NO: 418787 - DNA, 20 bp, mouse
gcggatccctgcgtatctct

SEQ ID NO: 418788 - DNA, 20 bp, mouse
gaggaggtggcaggtaggtt

SEQ ID NO: 418789 - DNA, 20 bp, mouse
gcttcccaaagcatggacta

SEQ ID NO: 418790 - DNA, 20 bp, mouse
ggcacaatgcttgactactg

SEQ ID NO: 418791 - DNA, 20 bp, mouse
gggcccagctaataaagtca

SEQ ID NO: 418792 - DNA, 20 bp, mouse
gcctactatgagccaggctt

SEQ ID NO: 418793 - DNA, 20 bp, mouse
gtgggtgagggggtaatacc

SEQ ID NO: 418794 - DNA, 20 bp, mouse
gcaggcttaggcactgtggt

SEQ ID NO: 418795 - DNA, 20 bp, mouse
gtaggcaatgtgtgaaaggt

SEQ ID NO: 418796 - DNA, 20 bp, mouse
ggagtatgctgcatccgtgg

SEQ ID NO: 418797 - DNA, 20 bp, mouse
ggcatccgtggaggtggaac

SEQ ID NO: 418798 - DNA, 20 bp, mouse
gcctcggaggggggacccaa

SEQ ID NO: 418799 - DNA, 20 bp, mouse
gtggtggaaaggccttgtca

SEQ ID NO: 418800 - DNA, 20 bp, mouse
ggcgtgcaaccgcaacaaga

SEQ ID NO: 418801 - DNA, 20 bp, mouse
gtatgctgcatccgtggagg

SEQ ID NO: 418802 - DNA, 20 bp, mouse
gagccagaaccgggattcag

SEQ ID NO: 418803 - DNA, 20 bp, mouse
gttgtcacggttgcacgagg

SEQ ID NO: 418804 - DNA, 20 bp, mouse
gggatgctgcgtcctcggag

SEQ ID NO: 418805 - DNA, 20 bp, mouse
gatactcagaactctgatcc

SEQ ID NO: 418806 - DNA, 20 bp, mouse
gacagcagccacagggatcg

SEQ ID NO: 418807 - DNA, 20 bp, mouse
gggtgttacctcgatccctg

SEQ ID NO: 418808 - DNA, 20 bp, mouse
gcattctgattgccagccag

SEQ ID NO: 418809 - DNA, 20 bp, mouse
gtctgattgccagccagggg

SEQ ID NO: 418810 - DNA, 20 bp, mouse
gtgtatctcacagtcagact

SEQ ID NO: 418811 - DNA, 20 bp, mouse
gagagctgggcagcacacgc

SEQ ID NO: 418812 - DNA, 20 bp, mouse
gatttgcagatgttaaaccc

SEQ ID NO: 418813 - DNA, 20 bp, mouse
gatgtgaccacaaccctact

SEQ ID NO: 418814 - DNA, 20 bp, mouse
ggggtagatgagaatatggc

SEQ ID NO: 418815 - DNA, 20 bp, mouse
gaaatggagcagatgcagtg

SEQ ID NO: 418816 - DNA, 20 bp, mouse
gcaggaggagccctagagta

SEQ ID NO: 418817 - DNA, 20 bp, mouse
gcctagagtaaggagagtta

SEQ ID NO: 418818 - DNA, 20 bp, mouse
gaggtttccaggcaacatga

SEQ ID NO: 418819 - DNA, 20 bp, mouse
gaccttgccctggatggtga

SEQ ID NO: 418820 - DNA, 20 bp, mouse
gtcgctctgggcagttgctg

SEQ ID NO: 418821 - DNA, 20 bp, mouse
gtgccgtgcgcagggaggaa

SEQ ID NO: 418822 - DNA, 20 bp, mouse
gactggggcctgatcgctct

SEQ ID NO: 418823 - DNA, 20 bp, mouse
gagaagtgccgtgcgcaggg

SEQ ID NO: 418824 - DNA, 20 bp, mouse
gagttgctgaggaggtttcc

SEQ ID NO: 418825 - DNA, 20 bp, mouse
gtcggtcgtagaccttgccc

SEQ ID NO: 418826 - DNA, 20 bp, mouse
gctggagcaaccctcctatg

SEQ ID NO: 418827 - DNA, 20 bp, mouse
gggatccctgtggagctgtt

SEQ ID NO: 418828 - DNA, 20 bp, mouse
gtggagctgttgggcactct

SEQ ID NO: 418829 - DNA, 20 bp, mouse
gagagatggaggctcagata

SEQ ID NO: 418830 - DNA, 20 bp, mouse
gtcaatctgacttaccccat

SEQ ID NO: 418831 - DNA, 20 bp, mouse
ggctgttgggcactctgggc

SEQ ID NO: 418832 - DNA, 20 bp, mouse
gaggccccaggacgtggatg

SEQ ID NO: 418833 - DNA, 20 bp, mouse
gggcccgagggaacaagaaa

SEQ ID NO: 418834 - DNA, 20 bp, mouse
gaacatgcaagaaatgaggt

SEQ ID NO: 418835 - DNA, 20 bp, mouse
gggatcccatatctgcagca

SEQ ID NO: 418836 - DNA, 20 bp, mouse
gagcaacagcgcaggctcgg

SEQ ID NO: 418837 - DNA, 20 bp, mouse
gagggcggaggcggccataa

SEQ ID NO: 418838 - DNA, 20 bp, mouse
gcacattctgcccagggcgg

SEQ ID NO: 418839 - DNA, 20 bp, mouse
gccgcacattctgcccaggg

SEQ ID NO: 418840 - DNA, 20 bp, mouse
ggccccgcacattctgccca

SEQ ID NO: 418841 - DNA, 20 bp, mouse
ggaggcggccataacggact

SEQ ID NO: 418842 - DNA, 20 bp, mouse
gattctgcccagggcggagg

SEQ ID NO: 418843 - DNA, 20 bp, mouse
gacggagcgccgccgactca

SEQ ID NO: 418844 - DNA, 20 bp, mouse
ggagcgccgccgactcacgg

SEQ ID NO: 418845 - DNA, 20 bp, mouse
ggactcacggtggttcccac

SEQ ID NO: 418846 - DNA, 20 bp, mouse
gaggaccacgtcttacccag

SEQ ID NO: 418847 - DNA, 20 bp, mouse
gggcagctcgagaccagatg

SEQ ID NO: 418848 - DNA, 20 bp, mouse
gaggctggaaagcgctctgg

SEQ ID NO: 418849 - DNA, 20 bp, mouse
gcagaggctggaaagcgctc

SEQ ID NO: 418850 - DNA, 20 bp, mouse
gagaccagatggggcaggac

SEQ ID NO: 418851 - DNA, 20 bp, mouse
ggactggcagcgcaaggtgg

SEQ ID NO: 418852 - DNA, 20 bp, mouse
gccagcctctgggtaagacg

SEQ ID NO: 418853 - DNA, 20 bp, mouse
gtcgcgtaacgggtgagtgt

SEQ ID NO: 418854 - DNA, 20 bp, mouse
gcagagctaagaacccgcca

SEQ ID NO: 418855 - DNA, 20 bp, mouse
gcaggactggcagcgcaagg

SEQ ID NO: 418856 - DNA, 20 bp, mouse
gagccggccccagcaatcac

SEQ ID NO: 418857 - DNA, 20 bp, mouse
gagcgagaggacccctactg

SEQ ID NO: 418858 - DNA, 20 bp, mouse
gcgcagagcccaggatccgg

SEQ ID NO: 418859 - DNA, 20 bp, mouse
gcctcctctcgcaggctggg

SEQ ID NO: 418860 - DNA, 20 bp, mouse
gaaagaacgacggccccagg

SEQ ID NO: 418861 - DNA, 20 bp, mouse
gcaagcccgcagtggcgtga

SEQ ID NO: 418862 - DNA, 20 bp, mouse
gtggcgcctggggacgtcgg

SEQ ID NO: 418863 - DNA, 20 bp, mouse
ggcttaacccgtgattgctg

SEQ ID NO: 418864 - DNA, 20 bp, mouse
gccggctgttgctcctcctg

SEQ ID NO: 418865 - DNA, 20 bp, mouse
gttcctgcccaagcccgcag

SEQ ID NO: 418866 - DNA, 20 bp, mouse
gagacgcgtgagccacgacc

SEQ ID NO: 418867 - DNA, 20 bp, mouse
gctgctgcagagccgggtcg

SEQ ID NO: 418868 - DNA, 20 bp, mouse
ggcaaagtggtcccagagtc

SEQ ID NO: 418869 - DNA, 20 bp, mouse
gcctcgctgcgcctgactct

SEQ ID NO: 418870 - DNA, 20 bp, mouse
gcggcaactgcgatactcac

SEQ ID NO: 418871 - DNA, 20 bp, mouse
gcactggcggataacggtca

SEQ ID NO: 418872 - DNA, 20 bp, mouse
ggtgcagacggaagtagtgc

SEQ ID NO: 418873 - DNA, 20 bp, mouse
gggaagtagtgcaggcaaag

SEQ ID NO: 418874 - DNA, 20 bp, mouse
gcaactgcgatactcactgg

SEQ ID NO: 418875 - DNA, 20 bp, mouse
gtaacggtcaaggcgaagcg

SEQ ID NO: 418876 - DNA, 20 bp, mouse
ggttggtctatctcaagatg

SEQ ID NO: 418877 - DNA, 20 bp, mouse
gtaatcccaatgctagacaa

SEQ ID NO: 418878 - DNA, 20 bp, mouse
gcactgtgtccttgaaggag

SEQ ID NO: 418879 - DNA, 20 bp, mouse
gggcaacaacctctccttca

SEQ ID NO: 418880 - DNA, 20 bp, mouse
gtctttccctttggagaagt

SEQ ID NO: 418881 - DNA, 20 bp, mouse
gtaaagaaggccagatatgt

SEQ ID NO: 418882 - DNA, 20 bp, mouse
gcaaacacagaaatgtcagt

SEQ ID NO: 418883 - DNA, 20 bp, mouse
gaagtgcaggccaacatatc

SEQ ID NO: 418884 - DNA, 20 bp, mouse
gagcgaaagctctttccctt

SEQ ID NO: 418885 - DNA, 20 bp, mouse
ggtgcaaaactaggagacag

SEQ ID NO: 418886 - DNA, 20 bp, mouse
gagctacaggcttcgagtct

SEQ ID NO: 418887 - DNA, 20 bp, mouse
gactcgaagcctgtagctgg

SEQ ID NO: 418888 - DNA, 20 bp, mouse
gaagctgggcaaggtctgta

SEQ ID NO: 418889 - DNA, 20 bp, mouse
gctgtggatcctccagctac

SEQ ID NO: 418890 - DNA, 20 bp, mouse
gggccttctcagccctcctc

SEQ ID NO: 418891 - DNA, 20 bp, mouse
gtctcctgacgcacaaggcc

SEQ ID NO: 418892 - DNA, 20 bp, mouse
gaggcctggccttgtgcgtc

SEQ ID NO: 418893 - DNA, 20 bp, mouse
gaaggaagcaggttgaggac

SEQ ID NO: 418894 - DNA, 20 bp, mouse
gtctgatctcctgacgcaca

SEQ ID NO: 418895 - DNA, 20 bp, mouse
gatggggctcagtgcttggg

SEQ ID NO: 418896 - DNA, 20 bp, mouse
gcggttccaaactatatctg

SEQ ID NO: 418897 - DNA, 20 bp, mouse
gaaactatatctgaggagtg

SEQ ID NO: 418898 - DNA, 20 bp, mouse
ggaaccggcagcatagcacc

SEQ ID NO: 418899 - DNA, 20 bp, mouse
gaagtggccctgtatacctg

SEQ ID NO: 418900 - DNA, 20 bp, mouse
gcgcgaacctcaggtataca

SEQ ID NO: 418901 - DNA, 20 bp, mouse
ggtatacagggccacttgtg

SEQ ID NO: 418902 - DNA, 20 bp, mouse
gggtgcgcaccgcgaacctc

SEQ ID NO: 418903 - DNA, 20 bp, mouse
gcaaccctatagccaataag

SEQ ID NO: 418904 - DNA, 20 bp, mouse
gttaccccttattggctata

SEQ ID NO: 418905 - DNA, 20 bp, mouse
gatatctgaggagtgtggtg

SEQ ID NO: 418906 - DNA, 20 bp, mouse
ggcggcaccggagtgatctc

SEQ ID NO: 418907 - DNA, 20 bp, mouse
gcagcacagctagggacttg

SEQ ID NO: 418908 - DNA, 20 bp, mouse
ggggacgcccgagatcactc

SEQ ID NO: 418909 - DNA, 20 bp, mouse
gcatctgggcagggatccac

SEQ ID NO: 418910 - DNA, 20 bp, mouse
gagccgctccagcacagcta

SEQ ID NO: 418911 - DNA, 20 bp, mouse
ggaaaccgctgcagcggcac

SEQ ID NO: 418912 - DNA, 20 bp, mouse
gcactccggtgccgctgcag

SEQ ID NO: 418913 - DNA, 20 bp, mouse
ggcatggcgtgttccagacg

SEQ ID NO: 418914 - DNA, 20 bp, mouse
ggtccctagctgtgctggag

SEQ ID NO: 418915 - DNA, 20 bp, mouse
gtaggagacgaccccagggt

SEQ ID NO: 418916 - DNA, 20 bp, mouse
ggagcgccttctgcgctgag

SEQ ID NO: 418917 - DNA, 20 bp, mouse
gggtaagaggaccggagcta

SEQ ID NO: 418918 - DNA, 20 bp, mouse
gggtctcggtcatcaacctg

SEQ ID NO: 418919 - DNA, 20 bp, mouse
ggcgctgagtggcagtggtc

SEQ ID NO: 418920 - DNA, 20 bp, mouse
ggagcgcgcggagtcgagcg

SEQ ID NO: 418921 - DNA, 20 bp, mouse
gcagagacgaaggaccgtgg

SEQ ID NO: 418922 - DNA, 20 bp, mouse
gcttctgcgctgagtggcag

SEQ ID NO: 418923 - DNA, 20 bp, mouse
gagatccccgaggcgtggca

SEQ ID NO: 418924 - DNA, 20 bp, mouse
ggggatcagatactagacta

SEQ ID NO: 418925 - DNA, 20 bp, mouse
ggctcaggagctcaacgcgt

SEQ ID NO: 418926 - DNA, 20 bp, mouse
gaggaggcggcgcacggacc

SEQ ID NO: 418927 - DNA, 20 bp, mouse
gtccccccgcaggtagacag

SEQ ID NO: 418928 - DNA, 20 bp, mouse
gggcggcgcacggaccgggc

SEQ ID NO: 418929 - DNA, 20 bp, mouse
gcggcggcaacgccccccaa

SEQ ID NO: 418930 - DNA, 20 bp, mouse
gtctacctgcggggggaccc

SEQ ID NO: 418931 - DNA, 20 bp, mouse
gccccgcaggtagacagggg

SEQ ID NO: 418932 - DNA, 20 bp, mouse
ggcggcgccgcggatctctg

SEQ ID NO: 418933 - DNA, 20 bp, mouse
gaccccctcccgggccgacg

SEQ ID NO: 418934 - DNA, 20 bp, mouse
ggagggggcgaggactaaga

SEQ ID NO: 418935 - DNA, 20 bp, mouse
gcaggctgggtcgagaggag

SEQ ID NO: 418936 - DNA, 20 bp, mouse
ggcccgtcgctgcctctcta

SEQ ID NO: 418937 - DNA, 20 bp, mouse
ggacgggccatggccaccta

SEQ ID NO: 418938 - DNA, 20 bp, mouse
ggccatggccacctagggca

SEQ ID NO: 418939 - DNA, 20 bp, mouse
gccctcctcaccttccatgg

SEQ ID NO: 418940 - DNA, 20 bp, mouse
ggccctagagaggcagcgac

SEQ ID NO: 418941 - DNA, 20 bp, mouse
gctagggcacggcaggacag

SEQ ID NO: 418942 - DNA, 20 bp, mouse
gtcctcaccttccatggagg

SEQ ID NO: 418943 - DNA, 20 bp, mouse
ggaagactgggcagtcacct

SEQ ID NO: 418944 - DNA, 20 bp, mouse
gtgcatggtcagcgtggtag

SEQ ID NO: 418945 - DNA, 20 bp, mouse
ggccgtgccctaggtggcca

SEQ ID NO: 418946 - DNA, 20 bp, mouse
gctctgtaaaccagaaacag

SEQ ID NO: 418947 - DNA, 20 bp, mouse
gaagggagggactgcaatga

SEQ ID NO: 418948 - DNA, 20 bp, mouse
gtaaaccagaaacagaggtc

SEQ ID NO: 418949 - DNA, 20 bp, mouse
gtctggagagaagaacagat

SEQ ID NO: 418950 - DNA, 20 bp, mouse
gaggagggccactggcatca

SEQ ID NO: 418951 - DNA, 20 bp, mouse
gaggaggtgacatcacagga

SEQ ID NO: 418952 - DNA, 20 bp, mouse
gacagatcgatgcacagtgt

SEQ ID NO: 418953 - DNA, 20 bp, mouse
ggacatcacaggagggccac

SEQ ID NO: 418954 - DNA, 20 bp, mouse
ggctgcacttagaacccttc

SEQ ID NO: 418955 - DNA, 20 bp, mouse
ggccactggcatcacggctc

SEQ ID NO: 418956 - DNA, 20 bp, mouse
gctctgtaaaccagaaacag

SEQ ID NO: 418957 - DNA, 20 bp, mouse
gaagggagggactgcaatga

SEQ ID NO: 418958 - DNA, 20 bp, mouse
gtaaaccagaaacagaggtc

SEQ ID NO: 418959 - DNA, 20 bp, mouse
gaggagggccactggcatca

SEQ ID NO: 418960 - DNA, 20 bp, mouse
gtctggagagaagaacagat

SEQ ID NO: 418961 - DNA, 20 bp, mouse
gaggaggtgacatcacagga

SEQ ID NO: 418962 - DNA, 20 bp, mouse
gacagatcgatgcacagtgt

SEQ ID NO: 418963 - DNA, 20 bp, mouse
ggacatcacaggagggccac

SEQ ID NO: 418964 - DNA, 20 bp, mouse
ggctgcacttagaacccttc

SEQ ID NO: 418965 - DNA, 20 bp, mouse
ggccactggcatcacggctc

SEQ ID NO: 418966 - DNA, 20 bp, mouse
gccctcccacgccccacact

SEQ ID NO: 418967 - DNA, 20 bp, mouse
gcgctggcgggcaggcggaa

SEQ ID NO: 418968 - DNA, 20 bp, mouse
gcgtcaggctgtctttccct

SEQ ID NO: 418969 - DNA, 20 bp, mouse
gagtaccgagtgtggggcgt

SEQ ID NO: 418970 - DNA, 20 bp, mouse
gggagcgtgccttcctagaa

SEQ ID NO: 418971 - DNA, 20 bp, mouse
gagggcactacgccgctggc

SEQ ID NO: 418972 - DNA, 20 bp, mouse
ggctcgtgccccagttctag

SEQ ID NO: 418973 - DNA, 20 bp, mouse
gatttccgccgcaggttcgg

SEQ ID NO: 418974 - DNA, 20 bp, mouse
ggccagtgcgcatgcacgtc

SEQ ID NO: 418975 - DNA, 20 bp, mouse
gcccacacgtgcctacgcgg

SEQ ID NO: 418976 - DNA, 20 bp, mouse
gtggcagtcacagctcctgc

SEQ ID NO: 418977 - DNA, 20 bp, mouse
ggctgtgctcaggcgtgttc

SEQ ID NO: 418978 - DNA, 20 bp, mouse
gtcaggcaggctgtaaaagg

SEQ ID NO: 418979 - DNA, 20 bp, mouse
gtgctcaggcgtgttccggc

SEQ ID NO: 418980 - DNA, 20 bp, mouse
gcacatgtgcggtctccacg

SEQ ID NO: 418981 - DNA, 20 bp, mouse
ggatttcatgtgtaaaacac

SEQ ID NO: 418982 - DNA, 20 bp, mouse
gtcactagaaacatactcgt

SEQ ID NO: 418983 - DNA, 20 bp, mouse
gttgaagcgcgtgattaaga

SEQ ID NO: 418984 - DNA, 20 bp, mouse
gcggttaaataatatttgtt

SEQ ID NO: 418985 - DNA, 20 bp, mouse
gctatttttccttgagaaaa

SEQ ID NO: 418986 - DNA, 20 bp, mouse
ggctccaggaaggctaacct

SEQ ID NO: 418987 - DNA, 20 bp, mouse
gacagtgtgaggctccagga

SEQ ID NO: 418988 - DNA, 20 bp, mouse
ggtgcccaggttagccttcc

SEQ ID NO: 418989 - DNA, 20 bp, mouse
gtctgtgagcaaaacctgaa

SEQ ID NO: 418990 - DNA, 20 bp, mouse
gcaaatagtattccttttta

SEQ ID NO: 418991 - DNA, 20 bp, mouse
gcctgtggcctcggagaatc

SEQ ID NO: 418992 - DNA, 20 bp, mouse
gattgtgacagcggtttatc

SEQ ID NO: 418993 - DNA, 20 bp, mouse
gttttctcctctccttaaaa

SEQ ID NO: 418994 - DNA, 20 bp, mouse
ggtgtttggaggccttgaga

SEQ ID NO: 418995 - DNA, 20 bp, mouse
ggacgccgggcggaggaccg

SEQ ID NO: 418996 - DNA, 20 bp, mouse
gcggacatggaggacctctt

SEQ ID NO: 418997 - DNA, 20 bp, mouse
ggccgcggaccaagctgcta

SEQ ID NO: 418998 - DNA, 20 bp, mouse
ggctgctatggcggacatgg

SEQ ID NO: 418999 - DNA, 20 bp, mouse
gagagcgaggccgagcgcaa

SEQ ID NO: 419000 - DNA, 20 bp, mouse
gcgggcgagcgcagacaccg

SEQ ID NO: 419001 - DNA, 20 bp, mouse
gcaagctgctatggcggaca

SEQ ID NO: 419002 - DNA, 20 bp, mouse
ggctcgagccgagcaagcca

SEQ ID NO: 419003 - DNA, 20 bp, mouse
ggccgagcgcaaaggtgcgg

SEQ ID NO: 419004 - DNA, 20 bp, mouse
ggcggaccaagctgctatgg

SEQ ID NO: 419005 - DNA, 20 bp, mouse
ggagcgggctaacggagtag

SEQ ID NO: 419006 - DNA, 20 bp, mouse
gggcagtgaacctaaactat

SEQ ID NO: 419007 - DNA, 20 bp, mouse
gctgtagggagcatctgcgg

SEQ ID NO: 419008 - DNA, 20 bp, mouse
gcagtccctgctggaaccct

SEQ ID NO: 419009 - DNA, 20 bp, mouse
gtaggttcactgccagaatc

SEQ ID NO: 419010 - DNA, 20 bp, mouse
gtgctcggtaagttcagcaa

SEQ ID NO: 419011 - DNA, 20 bp, mouse
gcgagctgatccagaacggg

SEQ ID NO: 419012 - DNA, 20 bp, mouse
gtcagctcgaagaccttagt

SEQ ID NO: 419013 - DNA, 20 bp, mouse
gcaatggcctatgggttacg

SEQ ID NO: 419014 - DNA, 20 bp, mouse
gccattacaagtaacaacag

SEQ ID NO: 419015 - DNA, 20 bp, mouse
gcccaaaagttctagatctc

SEQ ID NO: 419016 - DNA, 20 bp, mouse
ggaggttccccacccggaaa

SEQ ID NO: 419017 - DNA, 20 bp, mouse
gctcagaaattgctcaggta

SEQ ID NO: 419018 - DNA, 20 bp, mouse
ggggaagtggagtcatccgt

SEQ ID NO: 419019 - DNA, 20 bp, mouse
ggctgaattcgccataatca

SEQ ID NO: 419020 - DNA, 20 bp, mouse
gggttaggtttgcagcacat

SEQ ID NO: 419021 - DNA, 20 bp, mouse
gcaacagctagctggaggtt

SEQ ID NO: 419022 - DNA, 20 bp, mouse
gtcaaggaaccttttccggg

SEQ ID NO: 419023 - DNA, 20 bp, mouse
gaattctgggttgtagtgtc

SEQ ID NO: 419024 - DNA, 20 bp, mouse
gttgtcgggtcctagagatc

SEQ ID NO: 419025 - DNA, 20 bp, mouse
gggaaaaggttccttgatta

SEQ ID NO: 419026 - DNA, 20 bp, mouse
gggacccaaggaggtgtcga

SEQ ID NO: 419027 - DNA, 20 bp, mouse
gaggtggccgggaagatgag

SEQ ID NO: 419028 - DNA, 20 bp, mouse
gacagcagtgctgggcaatc

SEQ ID NO: 419029 - DNA, 20 bp, mouse
ggtatggtttggacccaagg

SEQ ID NO: 419030 - DNA, 20 bp, mouse
gaagccgtcgacacctcctt

SEQ ID NO: 419031 - DNA, 20 bp, mouse
gctcccccgtcgcctcggta

SEQ ID NO: 419032 - DNA, 20 bp, mouse
gcaagtgcggcagcgtgcag

SEQ ID NO: 419033 - DNA, 20 bp, mouse
gctggaacgtctagataact

SEQ ID NO: 419034 - DNA, 20 bp, mouse
gtgggcaatcaggtaaagac

SEQ ID NO: 419035 - DNA, 20 bp, mouse
gtggcccaggtcttcatcct

SEQ ID NO: 419036 - DNA, 20 bp, mouse
ggtgtctgtgggaggttccg

SEQ ID NO: 419037 - DNA, 20 bp, mouse
ggtgtccacggccatcgccg

SEQ ID NO: 419038 - DNA, 20 bp, mouse
gcgcggtcgaagtcccagtc

SEQ ID NO: 419039 - DNA, 20 bp, mouse
gtcgcggctgtggctgctcg

SEQ ID NO: 419040 - DNA, 20 bp, mouse
gcagcgggagggtcccgaga

SEQ ID NO: 419041 - DNA, 20 bp, mouse
gtcgggcgacagagtgtcca

SEQ ID NO: 419042 - DNA, 20 bp, mouse
gtggggtgaggcccgcgtcg

SEQ ID NO: 419043 - DNA, 20 bp, mouse
gaagtcacgtgccgtgacag

SEQ ID NO: 419044 - DNA, 20 bp, mouse
gagcagccacagccgcgacg

SEQ ID NO: 419045 - DNA, 20 bp, mouse
gacggccagacgcgaccaca

SEQ ID NO: 419046 - DNA, 20 bp, mouse
gaggcccgggagcaccaccc

SEQ ID NO: 419047 - DNA, 20 bp, mouse
gaccacccgggagcactaca

SEQ ID NO: 419048 - DNA, 20 bp, mouse
ggacatgtgaccgactgcag

SEQ ID NO: 419049 - DNA, 20 bp, mouse
gcgcgctgctgcgcaggacg

SEQ ID NO: 419050 - DNA, 20 bp, mouse
gtgctgcgcaggacgcggtg

SEQ ID NO: 419051 - DNA, 20 bp, mouse
ggaggcgcgctcggaggccc

SEQ ID NO: 419052 - DNA, 20 bp, mouse
gcgcgccctgtagtgctccc

SEQ ID NO: 419053 - DNA, 20 bp, mouse
gcgcggtgaggcgcgctcgg

SEQ ID NO: 419054 - DNA, 20 bp, mouse
gccactgtgcccagggatag

SEQ ID NO: 419055 - DNA, 20 bp, mouse
gatggtggccggagcacacc

SEQ ID NO: 419056 - DNA, 20 bp, mouse
gagctgcggctggagactac

SEQ ID NO: 419057 - DNA, 20 bp, mouse
gtgagtaagcagacgggcaa

SEQ ID NO: 419058 - DNA, 20 bp, mouse
gtgagttaacaggcagaagg

SEQ ID NO: 419059 - DNA, 20 bp, mouse
gagactactggtgagttaac

SEQ ID NO: 419060 - DNA, 20 bp, mouse
gcggtcaggtgtcccctccg

SEQ ID NO: 419061 - DNA, 20 bp, mouse
gtgctggagtccctgcgtcc

SEQ ID NO: 419062 - DNA, 20 bp, mouse
ggggcagggaagggtcgaga

SEQ ID NO: 419063 - DNA, 20 bp, mouse
gagcagacgggcaagggcgt

SEQ ID NO: 419064 - DNA, 20 bp, mouse
gcaaggatcgccccagccct

SEQ ID NO: 419065 - DNA, 20 bp, mouse
ggaggacacgccaagggctg

SEQ ID NO: 419066 - DNA, 20 bp, mouse
gcggaagtgactactcaccg

SEQ ID NO: 419067 - DNA, 20 bp, mouse
ggtccggctccgagagacca

SEQ ID NO: 419068 - DNA, 20 bp, mouse
gaagtgactactcaccgggg

SEQ ID NO: 419069 - DNA, 20 bp, mouse
ggccgcagcgaccgaaaccc

SEQ ID NO: 419070 - DNA, 20 bp, mouse
gggagtcggagccaacgctc

SEQ ID NO: 419071 - DNA, 20 bp, mouse
gctcacctgaaccccaacgt

SEQ ID NO: 419072 - DNA, 20 bp, mouse
ggggaggacagcggcacccg

SEQ ID NO: 419073 - DNA, 20 bp, mouse
ggagccccacgacagcgacg

SEQ ID NO: 419074 - DNA, 20 bp, mouse
gaggctgggccatggtctct

SEQ ID NO: 419075 - DNA, 20 bp, mouse
gctgggtgctggccggggtc

SEQ ID NO: 419076 - DNA, 20 bp, mouse
gaagcgccagcggtgagtgt

SEQ ID NO: 419077 - DNA, 20 bp, mouse
ggagtccccgcaagcgccag

SEQ ID NO: 419078 - DNA, 20 bp, mouse
gctgcgggcgggcaagggtg

SEQ ID NO: 419079 - DNA, 20 bp, mouse
gtgagtgtcggtgagtgtgc

SEQ ID NO: 419080 - DNA, 20 bp, mouse
gagagcttggaggagaccga

SEQ ID NO: 419081 - DNA, 20 bp, mouse
gctcggaggacggaaccctg

SEQ ID NO: 419082 - DNA, 20 bp, mouse
gctgccaaggtgcacctcgg

SEQ ID NO: 419083 - DNA, 20 bp, mouse
ggacgggtgtgggtcccccc

SEQ ID NO: 419084 - DNA, 20 bp, mouse
gactcaccgacactcaccgc

SEQ ID NO: 419085 - DNA, 20 bp, mouse
gtggctgccaaggtgcacct

SEQ ID NO: 419086 - DNA, 20 bp, mouse
gacaaggtaatggtccgggt

SEQ ID NO: 419087 - DNA, 20 bp, mouse
gtggcacagacctggaacca

SEQ ID NO: 419088 - DNA, 20 bp, mouse
gctcaacaaggtaatggtcc

SEQ ID NO: 419089 - DNA, 20 bp, mouse
gaggcgggccagacttggag

SEQ ID NO: 419090 - DNA, 20 bp, mouse
gcgtatccgcgcttcttcag

SEQ ID NO: 419091 - DNA, 20 bp, mouse
ggcgcggatacgatgtcacc

SEQ ID NO: 419092 - DNA, 20 bp, mouse
gagggcgagaccaaggtcag

SEQ ID NO: 419093 - DNA, 20 bp, mouse
gtagagggcacccctgacct

SEQ ID NO: 419094 - DNA, 20 bp, mouse
gctctccgagagctcaggtc

SEQ ID NO: 419095 - DNA, 20 bp, mouse
gaggaacccccatctcaaca

SEQ ID NO: 419096 - DNA, 20 bp, mouse
gccctcccaggcgactccat

SEQ ID NO: 419097 - DNA, 20 bp, mouse
gtcagcagggcctcattcca

SEQ ID NO: 419098 - DNA, 20 bp, mouse
gcccatgccgagcgcagact

SEQ ID NO: 419099 - DNA, 20 bp, mouse
gtggggtcgccttccctccc

SEQ ID NO: 419100 - DNA, 20 bp, mouse
gacagttcgcaaaattacat

SEQ ID NO: 419101 - DNA, 20 bp, mouse
ggcagagagggccatctcta

SEQ ID NO: 419102 - DNA, 20 bp, mouse
gtcgcctggggcagagggtt

SEQ ID NO: 419103 - DNA, 20 bp, mouse
gaccaagtctgcgctcggca

SEQ ID NO: 419104 - DNA, 20 bp, mouse
gcattcccatggagtcgcct

SEQ ID NO: 419105 - DNA, 20 bp, mouse
ggcagtggggaccctagaga

SEQ ID NO: 419106 - DNA, 20 bp, mouse
gaaggctgaaagagagacaa

SEQ ID NO: 419107 - DNA, 20 bp, mouse
gtcgaggtccaagtggaagg

SEQ ID NO: 419108 - DNA, 20 bp, mouse
gttctcgaggtccaagtgga

SEQ ID NO: 419109 - DNA, 20 bp, mouse
gatagttctcgaggtccaag

SEQ ID NO: 419110 - DNA, 20 bp, mouse
gggacatgtgagatctgata

SEQ ID NO: 419111 - DNA, 20 bp, mouse
gggcaggcagggcacgagag

SEQ ID NO: 419112 - DNA, 20 bp, mouse
gccctggggaaattagagga

SEQ ID NO: 419113 - DNA, 20 bp, mouse
ggggcgcagtatagttctcg

SEQ ID NO: 419114 - DNA, 20 bp, mouse
ggtttccctggggaaattag

SEQ ID NO: 419115 - DNA, 20 bp, mouse
gaaagagagacaagggcaaa

SEQ ID NO: 419116 - DNA, 20 bp, mouse
gacgttcaggaccagatctc

SEQ ID NO: 419117 - DNA, 20 bp, mouse
gagatctctggcggggagca

SEQ ID NO: 419118 - DNA, 20 bp, mouse
gctgcagcatggggaagcgc

SEQ ID NO: 419119 - DNA, 20 bp, mouse
ggtctcagcagagccacagg

SEQ ID NO: 419120 - DNA, 20 bp, mouse
ggtggtgctgaggcatttgt

SEQ ID NO: 419121 - DNA, 20 bp, mouse
gccagtcctctctgcagcat

SEQ ID NO: 419122 - DNA, 20 bp, mouse
gaacgtgctgaggagcagct

SEQ ID NO: 419123 - DNA, 20 bp, mouse
gtgaggaggaataatgagtg

SEQ ID NO: 419124 - DNA, 20 bp, mouse
gaacgccctgaggaatgtaa

SEQ ID NO: 419125 - DNA, 20 bp, mouse
gctggcgttcggtggactca

SEQ ID NO: 419126 - DNA, 20 bp, mouse
gctgcgcgcaaagcttggaa

SEQ ID NO: 419127 - DNA, 20 bp, mouse
gcttcacccggtgactccgg

SEQ ID NO: 419128 - DNA, 20 bp, mouse
gctccgccgccggagtcacc

SEQ ID NO: 419129 - DNA, 20 bp, mouse
gctagagagagaaagctgga

SEQ ID NO: 419130 - DNA, 20 bp, mouse
gggaagggctcatcttcacc

SEQ ID NO: 419131 - DNA, 20 bp, mouse
gcgccgcgccgccaagctct

SEQ ID NO: 419132 - DNA, 20 bp, mouse
gcacccggtgactccggcgg

SEQ ID NO: 419133 - DNA, 20 bp, mouse
ggcgggctgcgcgcaaagct

SEQ ID NO: 419134 - DNA, 20 bp, mouse
gcatcttcacccggtgactc

SEQ ID NO: 419135 - DNA, 20 bp, mouse
ggatttgcagagaagtgaat

SEQ ID NO: 419136 - DNA, 20 bp, mouse
gcagcggcagctgcacatgt

SEQ ID NO: 419137 - DNA, 20 bp, mouse
ggtggggtgagttgcagcag

SEQ ID NO: 419138 - DNA, 20 bp, mouse
gagatctccggcctgtaagg

SEQ ID NO: 419139 - DNA, 20 bp, mouse
gacttatatccgggattgtg

SEQ ID NO: 419140 - DNA, 20 bp, mouse
gaggggcaggacttatatcc

SEQ ID NO: 419141 - DNA, 20 bp, mouse
gtccccgtgggcagttactg

SEQ ID NO: 419142 - DNA, 20 bp, mouse
gtcctccgacgcggtccggg

SEQ ID NO: 419143 - DNA, 20 bp, mouse
gtgcacctcccggaccgcgt

SEQ ID NO: 419144 - DNA, 20 bp, mouse
gggaaggatgagggttaccg

SEQ ID NO: 419145 - DNA, 20 bp, mouse
gcagctggaacagctggcca

SEQ ID NO: 419146 - DNA, 20 bp, mouse
gggtgccttggtcctcctgt

SEQ ID NO: 419147 - DNA, 20 bp, mouse
gccccgccgcagcaacatag

SEQ ID NO: 419148 - DNA, 20 bp, mouse
gaggctccagggcaacccag

SEQ ID NO: 419149 - DNA, 20 bp, mouse
gtgctgttagtgcccacagg

SEQ ID NO: 419150 - DNA, 20 bp, mouse
gtgtgggcactaacagcagt

SEQ ID NO: 419151 - DNA, 20 bp, mouse
ggtgcagcaggagcggagaa

SEQ ID NO: 419152 - DNA, 20 bp, mouse
gagaagggcataaggctcca

SEQ ID NO: 419153 - DNA, 20 bp, mouse
gcctggaggctagtgaagag

SEQ ID NO: 419154 - DNA, 20 bp, mouse
gtagcccagctgatccctgg

SEQ ID NO: 419155 - DNA, 20 bp, mouse
gtggagcgcgctgggtgcct

SEQ ID NO: 419156 - DNA, 20 bp, mouse
gcggggagcgatgtaacttg

SEQ ID NO: 419157 - DNA, 20 bp, mouse
gatcccgatgctggaccccg

SEQ ID NO: 419158 - DNA, 20 bp, mouse
gcgaggggaccgtcccaccc

SEQ ID NO: 419159 - DNA, 20 bp, mouse
ggctccccggggtccagcat

SEQ ID NO: 419160 - DNA, 20 bp, mouse
gccgcagtggcctcccgggt

SEQ ID NO: 419161 - DNA, 20 bp, mouse
gcgggacccgcatctcaaca

SEQ ID NO: 419162 - DNA, 20 bp, mouse
gggacctgcgtgccaccgag

SEQ ID NO: 419163 - DNA, 20 bp, mouse
ggagggcgccggctccgcag

SEQ ID NO: 419164 - DNA, 20 bp, mouse
gatcgggatgctgagaggcg

SEQ ID NO: 419165 - DNA, 20 bp, mouse
gggctccgcagtggcctccc

SEQ ID NO: 419166 - DNA, 20 bp, mouse
gcgcggggccgggagcagac

SEQ ID NO: 419167 - DNA, 20 bp, mouse
gcagagggcgggagccgacg

SEQ ID NO: 419168 - DNA, 20 bp, mouse
gggaggcgaacgcacccgga

SEQ ID NO: 419169 - DNA, 20 bp, mouse
gagacgggcgcgcagggtgc

SEQ ID NO: 419170 - DNA, 20 bp, mouse
ggggagcagacgggcgcgca

SEQ ID NO: 419171 - DNA, 20 bp, mouse
gcggttccccggtcccccgt

SEQ ID NO: 419172 - DNA, 20 bp, mouse
ggcggagcggtgcattgtgg

SEQ ID NO: 419173 - DNA, 20 bp, mouse
ggggagccgacgggggaccg

SEQ ID NO: 419174 - DNA, 20 bp, mouse
gggagttgcagtggcccggg

SEQ ID NO: 419175 - DNA, 20 bp, mouse
gaccggggaaccgcggggcc

SEQ ID NO: 419176 - DNA, 20 bp, mouse
gcagcagcagcccgagcgag

SEQ ID NO: 419177 - DNA, 20 bp, mouse
ggaagggctgcactagaggg

SEQ ID NO: 419178 - DNA, 20 bp, mouse
gggcaggcaggtagcatcaa

SEQ ID NO: 419179 - DNA, 20 bp, mouse
ggacgctggtcagggagagt

SEQ ID NO: 419180 - DNA, 20 bp, mouse
ggcagccgagcgcagcagcc

SEQ ID NO: 419181 - DNA, 20 bp, mouse
ggcaggacgttggtactcac

SEQ ID NO: 419182 - DNA, 20 bp, mouse
ggctagagacccaatttgaa

SEQ ID NO: 419183 - DNA, 20 bp, mouse
gaggacagcaggcaggacgt

SEQ ID NO: 419184 - DNA, 20 bp, mouse
ggccaggaggacaggaaatg

SEQ ID NO: 419185 - DNA, 20 bp, mouse
gactggaactagcaatctgc

SEQ ID NO: 419186 - DNA, 20 bp, mouse
gggatgcggagtgaagattg

SEQ ID NO: 419187 - DNA, 20 bp, mouse
gggcaggtggagtaagagca

SEQ ID NO: 419188 - DNA, 20 bp, mouse
gtgctgggtccaagacatca

SEQ ID NO: 419189 - DNA, 20 bp, mouse
ggacatcaaggtaagtgaga

SEQ ID NO: 419190 - DNA, 20 bp, mouse
gaaaacctgtcttcaggatg

SEQ ID NO: 419191 - DNA, 20 bp, mouse
gagcagggccgaacagacct

SEQ ID NO: 419192 - DNA, 20 bp, mouse
gtcttccaacggatggacag

SEQ ID NO: 419193 - DNA, 20 bp, mouse
ggtgtgagaagccgtctcct

SEQ ID NO: 419194 - DNA, 20 bp, mouse
gccagcctctgtccatccgt

SEQ ID NO: 419195 - DNA, 20 bp, mouse
gatgtcttggacccagcaca

SEQ ID NO: 419196 - DNA, 20 bp, mouse
ggagccgcgcgattgagact

SEQ ID NO: 419197 - DNA, 20 bp, mouse
gccgcgcgattgagacttgg

SEQ ID NO: 419198 - DNA, 20 bp, mouse
ggcggaggagcgttaggccg

SEQ ID NO: 419199 - DNA, 20 bp, mouse
ggacttggcggaggagcgtt

SEQ ID NO: 419200 - DNA, 20 bp, mouse
gtcctcatgagtgagcgccc

SEQ ID NO: 419201 - DNA, 20 bp, mouse
gggcagtgggacgggagcta

SEQ ID NO: 419202 - DNA, 20 bp, mouse
gctgggagagtgcggctcgg

SEQ ID NO: 419203 - DNA, 20 bp, mouse
gcagtagcccgcacggccga

SEQ ID NO: 419204 - DNA, 20 bp, mouse
gcatctgtgggcagtgcgag

SEQ ID NO: 419205 - DNA, 20 bp, mouse
ggctgcagcacgcccatctg

SEQ ID NO: 419206 - DNA, 20 bp, mouse
gtgtctgggaccctccatat

SEQ ID NO: 419207 - DNA, 20 bp, mouse
ggaatcactgtatgctgcta

SEQ ID NO: 419208 - DNA, 20 bp, mouse
gaaaaggcgccagaaccctc

SEQ ID NO: 419209 - DNA, 20 bp, mouse
ggatggtgagaagacgccag

SEQ ID NO: 419210 - DNA, 20 bp, mouse
ggggccacggagagaacgaa

SEQ ID NO: 419211 - DNA, 20 bp, mouse
ggcatacagtgattccaata

SEQ ID NO: 419212 - DNA, 20 bp, mouse
gcagcaaccccgcagcccag

SEQ ID NO: 419213 - DNA, 20 bp, mouse
gcagctgatctggatcccct

SEQ ID NO: 419214 - DNA, 20 bp, mouse
gggacttggtggatcatcag

SEQ ID NO: 419215 - DNA, 20 bp, mouse
ggtctgcggtgaggcctcct

SEQ ID NO: 419216 - DNA, 20 bp, mouse
gtgacgcctacggcaggtac

SEQ ID NO: 419217 - DNA, 20 bp, mouse
gagcaggggtcagcaaggag

SEQ ID NO: 419218 - DNA, 20 bp, mouse
gtacggcaggtacaggctga

SEQ ID NO: 419219 - DNA, 20 bp, mouse
gaggtgggttatgaggatct

SEQ ID NO: 419220 - DNA, 20 bp, mouse
gcaaatggaggtgggttatg

SEQ ID NO: 419221 - DNA, 20 bp, mouse
gtacttccccgtgacgccta

SEQ ID NO: 419222 - DNA, 20 bp, mouse
gtccccgtgacgcctacggc

SEQ ID NO: 419223 - DNA, 20 bp, mouse
gagccaggctaaccacagag

SEQ ID NO: 419224 - DNA, 20 bp, mouse
gacctgccgtaggcgtcacg

SEQ ID NO: 419225 - DNA, 20 bp, mouse
gggagaaaacaaatggaggt

SEQ ID NO: 419226 - DNA, 20 bp, mouse
gtggtgtcgccaaggcaata

SEQ ID NO: 419227 - DNA, 20 bp, mouse
ggaacctcaacagcctccga

SEQ ID NO: 419228 - DNA, 20 bp, mouse
gggcgacaccaggtaacctc

SEQ ID NO: 419229 - DNA, 20 bp, mouse
gtcaacagcctccgagggac

SEQ ID NO: 419230 - DNA, 20 bp, mouse
gcaactctccagaggttacc

SEQ ID NO: 419231 - DNA, 20 bp, mouse
gaggctctgccctattgcct

SEQ ID NO: 419232 - DNA, 20 bp, mouse
gcaaaccagaaagtccagta

SEQ ID NO: 419233 - DNA, 20 bp, mouse
gaccagtgttggaatcactg

SEQ ID NO: 419234 - DNA, 20 bp, mouse
ggcactccctaagctgggta

SEQ ID NO: 419235 - DNA, 20 bp, mouse
ggcctgaagcagatcaacat

SEQ ID NO: 419236 - DNA, 20 bp, mouse
gcggcagggagaggccgaca

SEQ ID NO: 419237 - DNA, 20 bp, mouse
gagcgaagcagaagccggca

SEQ ID NO: 419238 - DNA, 20 bp, mouse
gtgagcagcgaagcagaagc

SEQ ID NO: 419239 - DNA, 20 bp, mouse
gagctcccgggagccagagc

SEQ ID NO: 419240 - DNA, 20 bp, mouse
gccaccagagccggccctgt

SEQ ID NO: 419241 - DNA, 20 bp, mouse
gagggagaggccgacagggc

SEQ ID NO: 419242 - DNA, 20 bp, mouse
ggagaaagagagccacgagg

SEQ ID NO: 419243 - DNA, 20 bp, mouse
gctcctgtgcgaggacactg

SEQ ID NO: 419244 - DNA, 20 bp, mouse
gaccagctgtccccagaatg

SEQ ID NO: 419245 - DNA, 20 bp, mouse
gtcgcagagggcgaggaccg

SEQ ID NO: 419246 - DNA, 20 bp, mouse
gcggaggtacctggatctca

SEQ ID NO: 419247 - DNA, 20 bp, mouse
ggtacctccggctcccgcgt

SEQ ID NO: 419248 - DNA, 20 bp, mouse
gatctcagggacagggcagc

SEQ ID NO: 419249 - DNA, 20 bp, mouse
gggcggcagctgagggacca

SEQ ID NO: 419250 - DNA, 20 bp, mouse
gctcaagccaccgccctcca

SEQ ID NO: 419251 - DNA, 20 bp, mouse
ggtacctggatctcagggac

SEQ ID NO: 419252 - DNA, 20 bp, mouse
gagcccaggaggccctcgga

SEQ ID NO: 419253 - DNA, 20 bp, mouse
gcggagggcgaggttcacgg

SEQ ID NO: 419254 - DNA, 20 bp, mouse
gcctttccagcctagaacag

SEQ ID NO: 419255 - DNA, 20 bp, mouse
ggcgggcagggggatctcgt

SEQ ID NO: 419256 - DNA, 20 bp, mouse
ggagttaccagactgcatac

SEQ ID NO: 419257 - DNA, 20 bp, mouse
gcttggaccctggacttcag

SEQ ID NO: 419258 - DNA, 20 bp, mouse
gatttgaagtcttagaagtg

SEQ ID NO: 419259 - DNA, 20 bp, mouse
gcttctaagacttcaaatac

SEQ ID NO: 419260 - DNA, 20 bp, mouse
gtgactgaaaagtaagttct

SEQ ID NO: 419261 - DNA, 20 bp, mouse
gagaattgttcgagtaggac

SEQ ID NO: 419262 - DNA, 20 bp, mouse
gccatctgccactgaagtcc

SEQ ID NO: 419263 - DNA, 20 bp, mouse
gtgactataactattagagg

SEQ ID NO: 419264 - DNA, 20 bp, mouse
gtcatgactataactattag

SEQ ID NO: 419265 - DNA, 20 bp, mouse
gaaagggccttcttggaccc

SEQ ID NO: 419266 - DNA, 20 bp, mouse
gtcagcacgagggccccgat

SEQ ID NO: 419267 - DNA, 20 bp, mouse
gctgtgctctgtgtacgagt

SEQ ID NO: 419268 - DNA, 20 bp, mouse
gtacgagtaggtagcccctt

SEQ ID NO: 419269 - DNA, 20 bp, mouse
gcccttcggaaagacttctg

SEQ ID NO: 419270 - DNA, 20 bp, mouse
ggctctgcagttcagcacga

SEQ ID NO: 419271 - DNA, 20 bp, mouse
gatgggcgcaagaggctgct

SEQ ID NO: 419272 - DNA, 20 bp, mouse
gtggttgcttcttccttcat

SEQ ID NO: 419273 - DNA, 20 bp, mouse
gtccacagaagtctttccga

SEQ ID NO: 419274 - DNA, 20 bp, mouse
gtcgtctgtgttgcctatcg

SEQ ID NO: 419275 - DNA, 20 bp, mouse
gtcaccatggacacgctcga

SEQ ID NO: 419276 - DNA, 20 bp, mouse
gagcacaggctgggtggtgt

SEQ ID NO: 419277 - DNA, 20 bp, mouse
gggtaaatatgttcttctct

SEQ ID NO: 419278 - DNA, 20 bp, mouse
gagtactttctggtccacag

SEQ ID NO: 419279 - DNA, 20 bp, mouse
ggttcttctctcggtagact

SEQ ID NO: 419280 - DNA, 20 bp, mouse
gatgagctaaagggcagaga

SEQ ID NO: 419281 - DNA, 20 bp, mouse
gtcggtcccaaagccccaag

SEQ ID NO: 419282 - DNA, 20 bp, mouse
gaatctagatatgagctaaa

SEQ ID NO: 419283 - DNA, 20 bp, mouse
gctagattaatgccagtgcc

SEQ ID NO: 419284 - DNA, 20 bp, mouse
gggatgcttaagcctcttat

SEQ ID NO: 419285 - DNA, 20 bp, mouse
gatacagcaattcccataag

SEQ ID NO: 419286 - DNA, 20 bp, mouse
gactccaaggaaccggttca

SEQ ID NO: 419287 - DNA, 20 bp, mouse
gtacacagactccaaggaac

SEQ ID NO: 419288 - DNA, 20 bp, mouse
gctaccctgaaccggttcct

SEQ ID NO: 419289 - DNA, 20 bp, mouse
gcctctggggcagagactag

SEQ ID NO: 419290 - DNA, 20 bp, mouse
gcgaacccctctgagtctct

SEQ ID NO: 419291 - DNA, 20 bp, mouse
gactctgctgctcaattatc

SEQ ID NO: 419292 - DNA, 20 bp, mouse
ggtcccttaaccctaagcgg

SEQ ID NO: 419293 - DNA, 20 bp, mouse
gggttaggataggaagaaag

SEQ ID NO: 419294 - DNA, 20 bp, mouse
gcaggcaccgcccccgctta

SEQ ID NO: 419295 - DNA, 20 bp, mouse
gccttaaccctaagcggggg

SEQ ID NO: 419296 - DNA, 20 bp, mouse
ggagtaacgttgttcagctg

SEQ ID NO: 419297 - DNA, 20 bp, mouse
gttcagctgcggtgaaatga

SEQ ID NO: 419298 - DNA, 20 bp, mouse
gggctatccgggagttatgt

SEQ ID NO: 419299 - DNA, 20 bp, mouse
gcccttacaggtacaaggat

SEQ ID NO: 419300 - DNA, 20 bp, mouse
gaggaacccttacaggtaca

SEQ ID NO: 419301 - DNA, 20 bp, mouse
gacttcatttcagcttcata

SEQ ID NO: 419302 - DNA, 20 bp, mouse
ggcccatccttgtacctgta

SEQ ID NO: 419303 - DNA, 20 bp, mouse
ggtgaaatgatggactgaag

SEQ ID NO: 419304 - DNA, 20 bp, mouse
ggttatgtgggaagaaacta

SEQ ID NO: 419305 - DNA, 20 bp, mouse
gtcagcagcagaaaccaaaa

SEQ ID NO: 419306 - DNA, 20 bp, mouse
gtttgaggagtgaagtttga

SEQ ID NO: 419307 - DNA, 20 bp, mouse
gcgtcattagaaagggccat

SEQ ID NO: 419308 - DNA, 20 bp, mouse
gtaaggaagttcgagtccga

SEQ ID NO: 419309 - DNA, 20 bp, mouse
gtaatgacgaaacaggaacc

SEQ ID NO: 419310 - DNA, 20 bp, mouse
gcctgtttcgtcattagaaa

SEQ ID NO: 419311 - DNA, 20 bp, mouse
gccgtcagcatctcgggaac

SEQ ID NO: 419312 - DNA, 20 bp, mouse
gggatttctgagatggagtt

SEQ ID NO: 419313 - DNA, 20 bp, mouse
gcagacctgaaagaaggcgc

SEQ ID NO: 419314 - DNA, 20 bp, mouse
gtgagatggagttcggtgca

SEQ ID NO: 419315 - DNA, 20 bp, mouse
ggggaccagcgccttctttc

SEQ ID NO: 419316 - DNA, 20 bp, mouse
gagttctgcaggagctcccg

SEQ ID NO: 419317 - DNA, 20 bp, mouse
gggaggggagctctgaagag

SEQ ID NO: 419318 - DNA, 20 bp, mouse
gtatgctcagaactttttga

SEQ ID NO: 419319 - DNA, 20 bp, mouse
gctgcaggagctcccgagga

SEQ ID NO: 419320 - DNA, 20 bp, mouse
gaggagagctgagaacgccc

SEQ ID NO: 419321 - DNA, 20 bp, mouse
gagagctgagaacgcccagg

SEQ ID NO: 419322 - DNA, 20 bp, mouse
gaggacagagggaagaaacc

SEQ ID NO: 419323 - DNA, 20 bp, mouse
gcagaactttttgaaggcag

SEQ ID NO: 419324 - DNA, 20 bp, mouse
gactttttgaaggcagcggc

SEQ ID NO: 419325 - DNA, 20 bp, mouse
gcaaggtctgtgcagtcctg

SEQ ID NO: 419326 - DNA, 20 bp, mouse
ggagcgatgtaggagtatgg

SEQ ID NO: 419327 - DNA, 20 bp, mouse
gcagcaagccgtacacgcgg

SEQ ID NO: 419328 - DNA, 20 bp, mouse
ggcgcagcaagccgtacacg

SEQ ID NO: 419329 - DNA, 20 bp, mouse
ggcgggcggacgcctgacac

SEQ ID NO: 419330 - DNA, 20 bp, mouse
gatggcgatgagagcgatgt

SEQ ID NO: 419331 - DNA, 20 bp, mouse
ggcgtccgcccgcggagtcg

SEQ ID NO: 419332 - DNA, 20 bp, mouse
gtggccatccgcgactccgc

SEQ ID NO: 419333 - DNA, 20 bp, mouse
ggcggcgagaggaattcgag

SEQ ID NO: 419334 - DNA, 20 bp, mouse
gagatcaacgagtacctcat

SEQ ID NO: 419335 - DNA, 20 bp, mouse
ggcggcgccggggatctgga

SEQ ID NO: 419336 - DNA, 20 bp, mouse
gctagccccagctggattgg

SEQ ID NO: 419337 - DNA, 20 bp, mouse
gttgggggagagcgtacctg

SEQ ID NO: 419338 - DNA, 20 bp, mouse
gctctcccccaatccagctg

SEQ ID NO: 419339 - DNA, 20 bp, mouse
gtggggaaggcacaagaacg

SEQ ID NO: 419340 - DNA, 20 bp, mouse
ggatttggcttgggttccag

SEQ ID NO: 419341 - DNA, 20 bp, mouse
gagcctagccccagctggat

SEQ ID NO: 419342 - DNA, 20 bp, mouse
gcacaagaacgtggcaccac

SEQ ID NO: 419343 - DNA, 20 bp, mouse
ggaacccaagccaaatccga

SEQ ID NO: 419344 - DNA, 20 bp, mouse
gtacctggggccttcggatt

SEQ ID NO: 419345 - DNA, 20 bp, mouse
gcctaccgctggcacactgg

SEQ ID NO: 419346 - DNA, 20 bp, mouse
ggtagaacaacagatgacca

SEQ ID NO: 419347 - DNA, 20 bp, mouse
gtagttgtgatcgatcctgg

SEQ ID NO: 419348 - DNA, 20 bp, mouse
gaggatcgatcacaactaga

SEQ ID NO: 419349 - DNA, 20 bp, mouse
ggatcacaactagaaggagc

SEQ ID NO: 419350 - DNA, 20 bp, mouse
gagcaggcaagtactttgga

SEQ ID NO: 419351 - DNA, 20 bp, mouse
gagacagtgtaggagagcaa

SEQ ID NO: 419352 - DNA, 20 bp, mouse
gaaggagcaggcaagtactt

SEQ ID NO: 419353 - DNA, 20 bp, mouse
ggcatgggagatagccagac

SEQ ID NO: 419354 - DNA, 20 bp, mouse
gcagtgtaggagagcaaggg

SEQ ID NO: 419355 - DNA, 20 bp, mouse
gtctgagaaataacaaaagg

SEQ ID NO: 419356 - DNA, 20 bp, mouse
gggtctgggggagtccgcag

SEQ ID NO: 419357 - DNA, 20 bp, mouse
gaagctaggacctcgatctg

SEQ ID NO: 419358 - DNA, 20 bp, mouse
gtcacggcgggcgtcaattg

SEQ ID NO: 419359 - DNA, 20 bp, mouse
gccttcagccttcctcacgg

SEQ ID NO: 419360 - DNA, 20 bp, mouse
gtaggacctcgatctggggt

SEQ ID NO: 419361 - DNA, 20 bp, mouse
ggacccaaggtagctaactg

SEQ ID NO: 419362 - DNA, 20 bp, mouse
gctaaacccaccccagatcg

SEQ ID NO: 419363 - DNA, 20 bp, mouse
ggcggactcccccagaccca

SEQ ID NO: 419364 - DNA, 20 bp, mouse
gttgacgcccgccgtgagga

SEQ ID NO: 419365 - DNA, 20 bp, mouse
ggattgtctcatgccaggag

SEQ ID NO: 419366 - DNA, 20 bp, mouse
ggcagatcccgggctctcag

SEQ ID NO: 419367 - DNA, 20 bp, mouse
ggatcccgggctctcagcgg

SEQ ID NO: 419368 - DNA, 20 bp, mouse
gtgatgtgtcagctccgcag

SEQ ID NO: 419369 - DNA, 20 bp, mouse
gcggagaccactgcagatcc

SEQ ID NO: 419370 - DNA, 20 bp, mouse
gtccagggccgacgaaccca

SEQ ID NO: 419371 - DNA, 20 bp, mouse
gcgtgtagccgacgcggagt

SEQ ID NO: 419372 - DNA, 20 bp, mouse
gagggccgacgaacccatgg

SEQ ID NO: 419373 - DNA, 20 bp, mouse
gtgggtgaggaagtcacgcg

SEQ ID NO: 419374 - DNA, 20 bp, mouse
gaaacctccgctgagagccc

SEQ ID NO: 419375 - DNA, 20 bp, mouse
gagctccgcaggggttttgg

SEQ ID NO: 419376 - DNA, 20 bp, mouse
gcttcagaggtaataggtag

SEQ ID NO: 419377 - DNA, 20 bp, mouse
gaggtactttccactaattt

SEQ ID NO: 419378 - DNA, 20 bp, mouse
gatgtcacttcccaaattag

SEQ ID NO: 419379 - DNA, 20 bp, mouse
gaggaatgaaggtgtgaaga

SEQ ID NO: 419380 - DNA, 20 bp, mouse
gacatgtgtacttatgtctg

SEQ ID NO: 419381 - DNA, 20 bp, mouse
gaaagagttcaaaaactttt

SEQ ID NO: 419382 - DNA, 20 bp, mouse
gtcttagaaagtgactagca

SEQ ID NO: 419383 - DNA, 20 bp, mouse
gcatacttttaacacaagtc

SEQ ID NO: 419384 - DNA, 20 bp, mouse
gtttttacatcagaacatgt

SEQ ID NO: 419385 - DNA, 20 bp, mouse
ggaaggacaaacacccataa

SEQ ID NO: 419386 - DNA, 20 bp, mouse
ggagagctaacccatcccag

SEQ ID NO: 419387 - DNA, 20 bp, mouse
gaggctctggtctcctatca

SEQ ID NO: 419388 - DNA, 20 bp, mouse
ggggagtcacacaccttgat

SEQ ID NO: 419389 - DNA, 20 bp, mouse
gggaaatgaattagctccaa

SEQ ID NO: 419390 - DNA, 20 bp, mouse
ggagtgagcagagggtgcta

SEQ ID NO: 419391 - DNA, 20 bp, mouse
gccgtggtcacagagaaaca

SEQ ID NO: 419392 - DNA, 20 bp, mouse
gggtcacagagaaacaaggt

SEQ ID NO: 419393 - DNA, 20 bp, mouse
gagggtcagaggagatatag

SEQ ID NO: 419394 - DNA, 20 bp, mouse
gataggagaccagagcctct

SEQ ID NO: 419395 - DNA, 20 bp, mouse
gcaacatgagctgacagaca

SEQ ID NO: 419396 - DNA, 20 bp, mouse
gagttcactacaggatatct

SEQ ID NO: 419397 - DNA, 20 bp, mouse
gtatctgggtagaaagggta

SEQ ID NO: 419398 - DNA, 20 bp, mouse
ggtagaaagggtaaggttct

SEQ ID NO: 419399 - DNA, 20 bp, mouse
gtgccactgacaaaaaccag

SEQ ID NO: 419400 - DNA, 20 bp, mouse
gttgcccacaatatcctctg

SEQ ID NO: 419401 - DNA, 20 bp, mouse
gaggcttttacagctagaag

SEQ ID NO: 419402 - DNA, 20 bp, mouse
gaaagcctgcagttcactac

SEQ ID NO: 419403 - DNA, 20 bp, mouse
gagacaacgactgtaatacg

SEQ ID NO: 419404 - DNA, 20 bp, mouse
gcggtcatgtgcctttgcta

SEQ ID NO: 419405 - DNA, 20 bp, mouse
gatcgtttacctctaatggg

SEQ ID NO: 419406 - DNA, 20 bp, mouse
gcagctcagaacccaaggag

SEQ ID NO: 419407 - DNA, 20 bp, mouse
gcagcaagactgcaatgagt

SEQ ID NO: 419408 - DNA, 20 bp, mouse
gcagaacccaaggagaggta

SEQ ID NO: 419409 - DNA, 20 bp, mouse
gtatttccatacctctcctt

SEQ ID NO: 419410 - DNA, 20 bp, mouse
gtaatggcctgtaggttctt

SEQ ID NO: 419411 - DNA, 20 bp, mouse
gggtgatcacacaaactgaa

SEQ ID NO: 419412 - DNA, 20 bp, mouse
gatgagaccgaagaattctc

SEQ ID NO: 419413 - DNA, 20 bp, mouse
gggcctgtaggttcttggga

SEQ ID NO: 419414 - DNA, 20 bp, mouse
gtgggctgagaaagatctac

SEQ ID NO: 419415 - DNA, 20 bp, mouse
gcaggagagaaacacaaatg

SEQ ID NO: 419416 - DNA, 20 bp, mouse
gcctagcttgggactttggt

SEQ ID NO: 419417 - DNA, 20 bp, mouse
ggctaggaagcagctggtgc

SEQ ID NO: 419418 - DNA, 20 bp, mouse
gtcccaagctaggaagcagc

SEQ ID NO: 419419 - DNA, 20 bp, mouse
gcccccgtgacacttccaca

SEQ ID NO: 419420 - DNA, 20 bp, mouse
gtgagttccaggatgtccaa

SEQ ID NO: 419421 - DNA, 20 bp, mouse
gctggtgccattaataaagg

SEQ ID NO: 419422 - DNA, 20 bp, mouse
gatagctggctgcctaggca

SEQ ID NO: 419423 - DNA, 20 bp, mouse
gctactatagctggctgcct

SEQ ID NO: 419424 - DNA, 20 bp, mouse
gcatgtctgattcctgacaa

SEQ ID NO: 419425 - DNA, 20 bp, mouse
ggcttcctagcttgggactt

SEQ ID NO: 419426 - DNA, 20 bp, mouse
ggagctagcataggccagag

SEQ ID NO: 419427 - DNA, 20 bp, mouse
ggcctatgctagctcagtca

SEQ ID NO: 419428 - DNA, 20 bp, mouse
gtccctgactgagctagcat

SEQ ID NO: 419429 - DNA, 20 bp, mouse
gcctgtcacaagaacctcag

SEQ ID NO: 419430 - DNA, 20 bp, mouse
gtgttcccagggaagaacgg

SEQ ID NO: 419431 - DNA, 20 bp, mouse
gcccagccttaagctcactc

SEQ ID NO: 419432 - DNA, 20 bp, mouse
ggacaaccagagtgagctta

SEQ ID NO: 419433 - DNA, 20 bp, mouse
gtggaagaaggacaatgcat

SEQ ID NO: 419434 - DNA, 20 bp, mouse
gttccctgggaacaagggtt

SEQ ID NO: 419435 - DNA, 20 bp, mouse
gggaatggggaggtagcaca

SEQ ID NO: 419436 - DNA, 20 bp, mouse
gctataggtggtctagtcta

SEQ ID NO: 419437 - DNA, 20 bp, mouse
ggtctccttcatccctacta

SEQ ID NO: 419438 - DNA, 20 bp, mouse
ggcagccctagtagggatga

SEQ ID NO: 419439 - DNA, 20 bp, mouse
gtgttgtatgcagccctagt

SEQ ID NO: 419440 - DNA, 20 bp, mouse
gatccatccatcatgaggtg

SEQ ID NO: 419441 - DNA, 20 bp, mouse
ggcaacgtgttcttaggcaa

SEQ ID NO: 419442 - DNA, 20 bp, mouse
gctatcagcaacgtgttctt

SEQ ID NO: 419443 - DNA, 20 bp, mouse
gacggatgacccctggagtt

SEQ ID NO: 419444 - DNA, 20 bp, mouse
gcactgacctcacctcatga

SEQ ID NO: 419445 - DNA, 20 bp, mouse
gacaggaaggaggactcgtg

SEQ ID NO: 419446 - DNA, 20 bp, mouse
gacctcttgttgctactctt

SEQ ID NO: 419447 - DNA, 20 bp, mouse
gactatagcggtcatatcag

SEQ ID NO: 419448 - DNA, 20 bp, mouse
gtcctaggctctcactgcaa

SEQ ID NO: 419449 - DNA, 20 bp, mouse
gagtgcagggcagagtactc

SEQ ID NO: 419450 - DNA, 20 bp, mouse
gaaggagaatgaacaagtat

SEQ ID NO: 419451 - DNA, 20 bp, mouse
ggaacaagtataggagtgaa

SEQ ID NO: 419452 - DNA, 20 bp, mouse
gcctggcaaatggtattggt

SEQ ID NO: 419453 - DNA, 20 bp, mouse
ggcggtcatatcagaggcaa

SEQ ID NO: 419454 - DNA, 20 bp, mouse
gagtataggagtgaagggtc

SEQ ID NO: 419455 - DNA, 20 bp, mouse
gaattcatagatgtaaatgt

SEQ ID NO: 419456 - DNA, 20 bp, mouse
gtggctaaggagctgagata

SEQ ID NO: 419457 - DNA, 20 bp, mouse
gtaaggagctgagatagggc

SEQ ID NO: 419458 - DNA, 20 bp, mouse
gcaggcacggctgtttggga

SEQ ID NO: 419459 - DNA, 20 bp, mouse
gagctgagatagggcaggca

SEQ ID NO: 419460 - DNA, 20 bp, mouse
gtgcggtaccctgccatagt

SEQ ID NO: 419461 - DNA, 20 bp, mouse
gggtaccctgccatagtggg

SEQ ID NO: 419462 - DNA, 20 bp, mouse
gcttaaagagaaactggcta

SEQ ID NO: 419463 - DNA, 20 bp, mouse
gtagggcaggcacggctgtt

SEQ ID NO: 419464 - DNA, 20 bp, mouse
gaacacctcccactatggca

SEQ ID NO: 419465 - DNA, 20 bp, mouse
ggcaacccccctgcaagaaa

SEQ ID NO: 419466 - DNA, 20 bp, mouse
gtggccgagaaccccacctt

SEQ ID NO: 419467 - DNA, 20 bp, mouse
ggaggcgaggtccaaggctg

SEQ ID NO: 419468 - DNA, 20 bp, mouse
gacagcagaggcgaggtcca

SEQ ID NO: 419469 - DNA, 20 bp, mouse
gtcctgacacagcagaggcg

SEQ ID NO: 419470 - DNA, 20 bp, mouse
gccacagagacaaccagggt

SEQ ID NO: 419471 - DNA, 20 bp, mouse
gtgcactgacaggcctgggt

SEQ ID NO: 419472 - DNA, 20 bp, mouse
gcccactggcgtgcactgac

SEQ ID NO: 419473 - DNA, 20 bp, mouse
gtgacaggcctgggttggat

SEQ ID NO: 419474 - DNA, 20 bp, mouse
ggcaggtagactcctgagcc

SEQ ID NO: 419475 - DNA, 20 bp, mouse
gatagccacagagacaacca

SEQ ID NO: 419476 - DNA, 20 bp, mouse
gtgtggacccggctgagaac

SEQ ID NO: 419477 - DNA, 20 bp, mouse
gtagttccgaggtgtggacc

SEQ ID NO: 419478 - DNA, 20 bp, mouse
gtcccgggctggacacccca

SEQ ID NO: 419479 - DNA, 20 bp, mouse
gcacacctcggaactaccag

SEQ ID NO: 419480 - DNA, 20 bp, mouse
gacaggcgatgaaagttaaa

SEQ ID NO: 419481 - DNA, 20 bp, mouse
gaactcgagggctcccggta

SEQ ID NO: 419482 - DNA, 20 bp, mouse
gagttcccctggtagttccg

SEQ ID NO: 419483 - DNA, 20 bp, mouse
gagcatcctagcgtccagat

SEQ ID NO: 419484 - DNA, 20 bp, mouse
ggagaggccagggccctacc

SEQ ID NO: 419485 - DNA, 20 bp, mouse
gaggtctggagtatagagtg

SEQ ID NO: 419486 - DNA, 20 bp, mouse
gaccggcgggaagtctcagg

SEQ ID NO: 419487 - DNA, 20 bp, mouse
ggagaccggcgggaagtctc

SEQ ID NO: 419488 - DNA, 20 bp, mouse
gggagaccgcgggccgagac

SEQ ID NO: 419489 - DNA, 20 bp, mouse
ggaggcagtacagctcgtag

SEQ ID NO: 419490 - DNA, 20 bp, mouse
gccagccccgtagccaacgg

SEQ ID NO: 419491 - DNA, 20 bp, mouse
gagcgtgagctggagaccgc

SEQ ID NO: 419492 - DNA, 20 bp, mouse
ggaccgcgggccgagaccgg

SEQ ID NO: 419493 - DNA, 20 bp, mouse
ggcggccagaactcccccgt

SEQ ID NO: 419494 - DNA, 20 bp, mouse
gtctcaggcggctggcgctg

SEQ ID NO: 419495 - DNA, 20 bp, mouse
gccaccagccccgtagccaa

SEQ ID NO: 419496 - DNA, 20 bp, mouse
gactcacaggtaagatctaa

SEQ ID NO: 419497 - DNA, 20 bp, mouse
gctaagggcataaaaataaa

SEQ ID NO: 419498 - DNA, 20 bp, mouse
gcaaaaccttgtctactcac

SEQ ID NO: 419499 - DNA, 20 bp, mouse
gttatggaggcgcctgacag

SEQ ID NO: 419500 - DNA, 20 bp, mouse
gctagcctcgcgagatttcc

SEQ ID NO: 419501 - DNA, 20 bp, mouse
gacaaatctgaaccgaggat

SEQ ID NO: 419502 - DNA, 20 bp, mouse
ggcgaggctagcctgcagaa

SEQ ID NO: 419503 - DNA, 20 bp, mouse
ggcctcgcgagatttccggg

SEQ ID NO: 419504 - DNA, 20 bp, mouse
gaagcgaagctacccctgtc

SEQ ID NO: 419505 - DNA, 20 bp, mouse
gaaggctcaggctttctcaa

SEQ ID NO: 419506 - DNA, 20 bp, mouse
ggctagaggagttacaacca

SEQ ID NO: 419507 - DNA, 20 bp, mouse
ggcctgaggagctctgtccg

SEQ ID NO: 419508 - DNA, 20 bp, mouse
ggagctcctcaggcctgcca

SEQ ID NO: 419509 - DNA, 20 bp, mouse
gagagctcagtggggaccct

SEQ ID NO: 419510 - DNA, 20 bp, mouse
gtgagagctgcagccaccaa

SEQ ID NO: 419511 - DNA, 20 bp, mouse
gctgctccaagcttggctag

SEQ ID NO: 419512 - DNA, 20 bp, mouse
gtggcagcagtgaggaccct

SEQ ID NO: 419513 - DNA, 20 bp, mouse
gtcaggcctgccaggggtca

SEQ ID NO: 419514 - DNA, 20 bp, mouse
gtgcctggattccttcccat

SEQ ID NO: 419515 - DNA, 20 bp, mouse
ggcttggaaaagtctcccta

SEQ ID NO: 419516 - DNA, 20 bp, mouse
gtgcagtgggtgaggagact

SEQ ID NO: 419517 - DNA, 20 bp, mouse
gtgatcctgccagaaaccca

SEQ ID NO: 419518 - DNA, 20 bp, mouse
gaaagcacacagccagcatc

SEQ ID NO: 419519 - DNA, 20 bp, mouse
gaaagtagtagagattgcag

SEQ ID NO: 419520 - DNA, 20 bp, mouse
ggtagagattgcagtgggtg

SEQ ID NO: 419521 - DNA, 20 bp, mouse
gagccagcatcaggcagcgc

SEQ ID NO: 419522 - DNA, 20 bp, mouse
gtggcttgggatgtctccct

SEQ ID NO: 419523 - DNA, 20 bp, mouse
gtctgacttcaactcatata

SEQ ID NO: 419524 - DNA, 20 bp, mouse
gagaaagccaacgatgtcaa

SEQ ID NO: 419525 - DNA, 20 bp, mouse
ggcagcacgcactcagctaa

SEQ ID NO: 419526 - DNA, 20 bp, mouse
ggcgtagggaagcacggacc

SEQ ID NO: 419527 - DNA, 20 bp, mouse
gtctaatgcgtagggaagca

SEQ ID NO: 419528 - DNA, 20 bp, mouse
gccaggtggaatccagggag

SEQ ID NO: 419529 - DNA, 20 bp, mouse
gctttgctccgacaatgtga

SEQ ID NO: 419530 - DNA, 20 bp, mouse
gtggaaagagtaaaatttgt

SEQ ID NO: 419531 - DNA, 20 bp, mouse
ggatacctctctaatgcgta

SEQ ID NO: 419532 - DNA, 20 bp, mouse
gtgactcgggatgcaataga

SEQ ID NO: 419533 - DNA, 20 bp, mouse
gttcaagtccttcacattgt

SEQ ID NO: 419534 - DNA, 20 bp, mouse
gtcctatagtacttactgaa

SEQ ID NO: 419535 - DNA, 20 bp, mouse
gtgtctctaccaggctccct

SEQ ID NO: 419536 - DNA, 20 bp, mouse
ggagaggacatggtgaggct

SEQ ID NO: 419537 - DNA, 20 bp, mouse
gggcagacacgctccgactc

SEQ ID NO: 419538 - DNA, 20 bp, mouse
gatgtcctctctacacttgg

SEQ ID NO: 419539 - DNA, 20 bp, mouse
gtccaaggagggggacacta

SEQ ID NO: 419540 - DNA, 20 bp, mouse
gacttcggctcccttctgga

SEQ ID NO: 419541 - DNA, 20 bp, mouse
gctggtgtgcacttacttca

SEQ ID NO: 419542 - DNA, 20 bp, mouse
gccttctggagggcgggaag

SEQ ID NO: 419543 - DNA, 20 bp, mouse
gaggatgtaagtaggcactt

SEQ ID NO: 419544 - DNA, 20 bp, mouse
gctcaggggatgtcagaggg

SEQ ID NO: 419545 - DNA, 20 bp, mouse
ggaggaaccaaaactctcag

SEQ ID NO: 419546 - DNA, 20 bp, mouse
ggaggggcgtttagtcgtag

SEQ ID NO: 419547 - DNA, 20 bp, mouse
gacgactaaacgcccctctt

SEQ ID NO: 419548 - DNA, 20 bp, mouse
gcgacctgcattagacgtag

SEQ ID NO: 419549 - DNA, 20 bp, mouse
gaacttgctcaacccaagag

SEQ ID NO: 419550 - DNA, 20 bp, mouse
gccgctagcgctacagccag

SEQ ID NO: 419551 - DNA, 20 bp, mouse
ggcgtttagtcgtagcggac

SEQ ID NO: 419552 - DNA, 20 bp, mouse
gaagcgtgtacacagcaggg

SEQ ID NO: 419553 - DNA, 20 bp, mouse
gagacctgtgattgataggt

SEQ ID NO: 419554 - DNA, 20 bp, mouse
gcgaggccaagcgaccttaa

SEQ ID NO: 419555 - DNA, 20 bp, mouse
gagtcgtagcggactggaat

SEQ ID NO: 419556 - DNA, 20 bp, mouse
gtgctgcaggatgcccaaca

SEQ ID NO: 419557 - DNA, 20 bp, mouse
gtgggcatcctgcagcacgt

SEQ ID NO: 419558 - DNA, 20 bp, mouse
gtttatgaccaggccctgtt

SEQ ID NO: 419559 - DNA, 20 bp, mouse
ggagcacgcgcagaaagtcc

SEQ ID NO: 419560 - DNA, 20 bp, mouse
gcgagggacgcgaacacagt

SEQ ID NO: 419561 - DNA, 20 bp, mouse
ggcggtagaagtcggtcttg

SEQ ID NO: 419562 - DNA, 20 bp, mouse
gtcagcagccccgggctcca

SEQ ID NO: 419563 - DNA, 20 bp, mouse
gcccccggacagcgaagacg

SEQ ID NO: 419564 - DNA, 20 bp, mouse
gagtgggcaccgcctcacac

SEQ ID NO: 419565 - DNA, 20 bp, mouse
gggtagtaacaagcgcggac

SEQ ID NO: 419566 - DNA, 20 bp, mouse
gaagcttcagactataggag

SEQ ID NO: 419567 - DNA, 20 bp, mouse
gaaagagtccggcagtgcta

SEQ ID NO: 419568 - DNA, 20 bp, mouse
gtgcagtcaatgaaagagtc

SEQ ID NO: 419569 - DNA, 20 bp, mouse
gacccgaagcttcagactat

SEQ ID NO: 419570 - DNA, 20 bp, mouse
ggttgcagccaagtcagcat

SEQ ID NO: 419571 - DNA, 20 bp, mouse
gcattgactgcaagacaaca

SEQ ID NO: 419572 - DNA, 20 bp, mouse
gtggggtgtcctgcagtacg

SEQ ID NO: 419573 - DNA, 20 bp, mouse
gaaaccaaccaagattgaat

SEQ ID NO: 419574 - DNA, 20 bp, mouse
gcagcatgtgtggatactgt

SEQ ID NO: 419575 - DNA, 20 bp, mouse
gaagtacgcaaagattactt

SEQ ID NO: 419576 - DNA, 20 bp, mouse
gatcagcagaaaattcaagt

SEQ ID NO: 419577 - DNA, 20 bp, mouse
gtctatgctgttcgtcacac

SEQ ID NO: 419578 - DNA, 20 bp, mouse
ggctgtgcgtggtaagctgt

SEQ ID NO: 419579 - DNA, 20 bp, mouse
gggtaagctgtgggccttcc

SEQ ID NO: 419580 - DNA, 20 bp, mouse
gtcacaaagaccatcatctg

SEQ ID NO: 419581 - DNA, 20 bp, mouse
ggtgggagcttgaagtgaaa

SEQ ID NO: 419582 - DNA, 20 bp, mouse
gccaaaactagcgatgtgtt

SEQ ID NO: 419583 - DNA, 20 bp, mouse
gtagaaagactgtaccagga

SEQ ID NO: 419584 - DNA, 20 bp, mouse
ggtaggtatgttgttcttcg

SEQ ID NO: 419585 - DNA, 20 bp, mouse
ggcgagcttctgttcagcaa

SEQ ID NO: 419586 - DNA, 20 bp, mouse
gaggagctgggcgcacaccg

SEQ ID NO: 419587 - DNA, 20 bp, mouse
gcggaaagcggagagcgggt

SEQ ID NO: 419588 - DNA, 20 bp, mouse
ggccttcgcgagccgagcgg

SEQ ID NO: 419589 - DNA, 20 bp, mouse
ggccgccgaggcgaaatcgc

SEQ ID NO: 419590 - DNA, 20 bp, mouse
gacagctctactctacccca

SEQ ID NO: 419591 - DNA, 20 bp, mouse
gaaccgcccagagcgcgcca

SEQ ID NO: 419592 - DNA, 20 bp, mouse
gggctggtctgtcctctggg

SEQ ID NO: 419593 - DNA, 20 bp, mouse
gaccaactcagacaactccg

SEQ ID NO: 419594 - DNA, 20 bp, mouse
gccgcaggggcgacagcgcg

SEQ ID NO: 419595 - DNA, 20 bp, mouse
ggcacaccgtggcgcgctct

SEQ ID NO: 419596 - DNA, 20 bp, mouse
gagcactaggaacccggagg

SEQ ID NO: 419597 - DNA, 20 bp, mouse
gtggagcactaggaacccgg

SEQ ID NO: 419598 - DNA, 20 bp, mouse
ggtgccgcttacctttgcac

SEQ ID NO: 419599 - DNA, 20 bp, mouse
gcacccgagcgcctgaaggt

SEQ ID NO: 419600 - DNA, 20 bp, mouse
gtagaagggaggggcgtctc

SEQ ID NO: 419601 - DNA, 20 bp, mouse
ggcaggtcccatttcaccct

SEQ ID NO: 419602 - DNA, 20 bp, mouse
gagttacagctgcttgccct

SEQ ID NO: 419603 - DNA, 20 bp, mouse
gtgaatatccatcagtagaa

SEQ ID NO: 419604 - DNA, 20 bp, mouse
gattaactatatgttaatca

SEQ ID NO: 419605 - DNA, 20 bp, mouse
gcccccaccttcaggcgctc

SEQ ID NO: 419606 - DNA, 20 bp, mouse
gaaggccctcgaaggctgag

SEQ ID NO: 419607 - DNA, 20 bp, mouse
gcattctccaaggcccgatc

SEQ ID NO: 419608 - DNA, 20 bp, mouse
gagcactggagttgaggagg

SEQ ID NO: 419609 - DNA, 20 bp, mouse
gggcccgatctggattgact

SEQ ID NO: 419610 - DNA, 20 bp, mouse
gctctcttgctcattctcca

SEQ ID NO: 419611 - DNA, 20 bp, mouse
gctcggaagcactggagttg

SEQ ID NO: 419612 - DNA, 20 bp, mouse
ggacaagataaggccctcga

SEQ ID NO: 419613 - DNA, 20 bp, mouse
gctcggtcacagggaggtga

SEQ ID NO: 419614 - DNA, 20 bp, mouse
gagttgaaggtgacaagata

SEQ ID NO: 419615 - DNA, 20 bp, mouse
gaaagagctcggtcacaggg

SEQ ID NO: 419616 - DNA, 20 bp, mouse
gggacgcgcggtggcatcag

SEQ ID NO: 419617 - DNA, 20 bp, mouse
ggccagcagggcaaggagtt

SEQ ID NO: 419618 - DNA, 20 bp, mouse
gcttgccctgctggctccat

SEQ ID NO: 419619 - DNA, 20 bp, mouse
gctgctgcgcgtcttcaggt

SEQ ID NO: 419620 - DNA, 20 bp, mouse
gagcatggtgacgccgccca

SEQ ID NO: 419621 - DNA, 20 bp, mouse
gcctgtgcgcgcaggtgggg

SEQ ID NO: 419622 - DNA, 20 bp, mouse
gaggtggggaggacgcgcgg

SEQ ID NO: 419623 - DNA, 20 bp, mouse
gcgcaggtggggaggacgcg

SEQ ID NO: 419624 - DNA, 20 bp, mouse
gtcaccgtcgccttcagggt

SEQ ID NO: 419625 - DNA, 20 bp, mouse
gatgctacccagctgggatc

SEQ ID NO: 419626 - DNA, 20 bp, mouse
gagctgcgcgacgggcgagg

SEQ ID NO: 419627 - DNA, 20 bp, mouse
ggcgacgggcgaggcggtga

SEQ ID NO: 419628 - DNA, 20 bp, mouse
ggaggcgggagctgcgcgac

SEQ ID NO: 419629 - DNA, 20 bp, mouse
gcgtgagaaccgccactcgt

SEQ ID NO: 419630 - DNA, 20 bp, mouse
ggagcctgagcctcgagggg

SEQ ID NO: 419631 - DNA, 20 bp, mouse
gcagaacccaccccccctca

SEQ ID NO: 419632 - DNA, 20 bp, mouse
gcccagcgtgaaccggagaa

SEQ ID NO: 419633 - DNA, 20 bp, mouse
ggcggcggaggcttcggcga

SEQ ID NO: 419634 - DNA, 20 bp, mouse
gagggagcctgagcctcgag

SEQ ID NO: 419635 - DNA, 20 bp, mouse
gcaggtgcccgagctggcgg

SEQ ID NO: 419636 - DNA, 20 bp, mouse
gagtccgcggaggggagacg

SEQ ID NO: 419637 - DNA, 20 bp, mouse
gttgagccttggctggagtg

SEQ ID NO: 419638 - DNA, 20 bp, mouse
gtggtcggggcggactcgtg

SEQ ID NO: 419639 - DNA, 20 bp, mouse
gaggccttgaggctacttct

SEQ ID NO: 419640 - DNA, 20 bp, mouse
gaggctcctagtcttccgag

SEQ ID NO: 419641 - DNA, 20 bp, mouse
gctgcgcgctgccctggtcg

SEQ ID NO: 419642 - DNA, 20 bp, mouse
gaagcccagaagtagcctca

SEQ ID NO: 419643 - DNA, 20 bp, mouse
gccaggcacccagatcccgg

SEQ ID NO: 419644 - DNA, 20 bp, mouse
ggggagacgcggaggctgag

SEQ ID NO: 419645 - DNA, 20 bp, mouse
ggcggagaggtacccgagaa

SEQ ID NO: 419646 - DNA, 20 bp, mouse
gtgcgggcgtgaggaggcgt

SEQ ID NO: 419647 - DNA, 20 bp, mouse
gcgggaaacagcacgcaggg

SEQ ID NO: 419648 - DNA, 20 bp, mouse
gaagctgaggccgcccggaa

SEQ ID NO: 419649 - DNA, 20 bp, mouse
gtggagttgcgggcgtgagg

SEQ ID NO: 419650 - DNA, 20 bp, mouse
gggatgggcgcggagaccga

SEQ ID NO: 419651 - DNA, 20 bp, mouse
gggagcctgacaggaaactc

SEQ ID NO: 419652 - DNA, 20 bp, mouse
gcggggctgacccttccggg

SEQ ID NO: 419653 - DNA, 20 bp, mouse
gctgtccgggtgataagctg

SEQ ID NO: 419654 - DNA, 20 bp, mouse
gacggctgggctcggagaag

SEQ ID NO: 419655 - DNA, 20 bp, mouse
gcgcaagaacaagcttcgac

SEQ ID NO: 419656 - DNA, 20 bp, mouse
ggcaggcagcagtgctaagt

SEQ ID NO: 419657 - DNA, 20 bp, mouse
gatcttcagggagattaggt

SEQ ID NO: 419658 - DNA, 20 bp, mouse
gatggtggtgcggatagcag

SEQ ID NO: 419659 - DNA, 20 bp, mouse
gctgtcaggtcagtttaact

SEQ ID NO: 419660 - DNA, 20 bp, mouse
gtagtgagtgctgacagatt

SEQ ID NO: 419661 - DNA, 20 bp, mouse
gtaagggaatttaccatcta

SEQ ID NO: 419662 - DNA, 20 bp, mouse
gtaccatctaaggaggcccc

SEQ ID NO: 419663 - DNA, 20 bp, mouse
gaatgagttctggaagtctg

SEQ ID NO: 419664 - DNA, 20 bp, mouse
gattatgaaaagatattctt

SEQ ID NO: 419665 - DNA, 20 bp, mouse
gggatggaggccagagaaga

SEQ ID NO: 419666 - DNA, 20 bp, mouse
gagagttctgttgaaatggt

SEQ ID NO: 419667 - DNA, 20 bp, mouse
gtcacaggagaggggcaagg

SEQ ID NO: 419668 - DNA, 20 bp, mouse
ggtcatcttagtcaagagga

SEQ ID NO: 419669 - DNA, 20 bp, mouse
ggagggaaacgccatttgtg

SEQ ID NO: 419670 - DNA, 20 bp, mouse
gcccaggccggaagctgggg

SEQ ID NO: 419671 - DNA, 20 bp, mouse
gaggatggtagccacacaaa

SEQ ID NO: 419672 - DNA, 20 bp, mouse
gcctggagctaacccaaagg

SEQ ID NO: 419673 - DNA, 20 bp, mouse
gggtctgtggtgaggcacag

SEQ ID NO: 419674 - DNA, 20 bp, mouse
gcaagagagttctgttgaaa

SEQ ID NO: 419675 - DNA, 20 bp, mouse
gtaggctacagcttgctcag

SEQ ID NO: 419676 - DNA, 20 bp, mouse
gggagtcagcgagtcctgga

SEQ ID NO: 419677 - DNA, 20 bp, mouse
ggtcctggagggccttgcgg

SEQ ID NO: 419678 - DNA, 20 bp, mouse
gaccccccgcaaggccctcc

SEQ ID NO: 419679 - DNA, 20 bp, mouse
gggagatgacagaccgctcc

SEQ ID NO: 419680 - DNA, 20 bp, mouse
gctatagctcgttcctggag

SEQ ID NO: 419681 - DNA, 20 bp, mouse
gtctccaccgagggtgacta

SEQ ID NO: 419682 - DNA, 20 bp, mouse
gtcgccctccagacgcacac

SEQ ID NO: 419683 - DNA, 20 bp, mouse
ggtgcgtctggagggcgatt

SEQ ID NO: 419684 - DNA, 20 bp, mouse
gcactggcaggaacaaccgg

SEQ ID NO: 419685 - DNA, 20 bp, mouse
gcgagtcctggagggccttg

SEQ ID NO: 419686 - DNA, 20 bp, mouse
gttgcacgctggcacagaca

SEQ ID NO: 419687 - DNA, 20 bp, mouse
gctaaagtctgagatggagc

SEQ ID NO: 419688 - DNA, 20 bp, mouse
gcgctggcacagacacggcc

SEQ ID NO: 419689 - DNA, 20 bp, mouse
gtggagctggtgagcgaagc

SEQ ID NO: 419690 - DNA, 20 bp, mouse
ggcagccgcttagggttcaa

SEQ ID NO: 419691 - DNA, 20 bp, mouse
gacagacacggccaggcagc

SEQ ID NO: 419692 - DNA, 20 bp, mouse
ggctccaggccgtgccgttg

SEQ ID NO: 419693 - DNA, 20 bp, mouse
gtctcttcacacaaaggtaa

SEQ ID NO: 419694 - DNA, 20 bp, mouse
gcacagatgtagccagctcc

SEQ ID NO: 419695 - DNA, 20 bp, mouse
gcaggaatctgccagactct

SEQ ID NO: 419696 - DNA, 20 bp, mouse
gtcccgcagcgcggaggcag

SEQ ID NO: 419697 - DNA, 20 bp, mouse
gtgagaggagcagacagccg

SEQ ID NO: 419698 - DNA, 20 bp, mouse
gcacccgggcacctcccgag

SEQ ID NO: 419699 - DNA, 20 bp, mouse
gtgccactcgggaggtgccc

SEQ ID NO: 419700 - DNA, 20 bp, mouse
gggtgaggctaacgcagccc

SEQ ID NO: 419701 - DNA, 20 bp, mouse
gcgggaggtgcccgggtgag

SEQ ID NO: 419702 - DNA, 20 bp, mouse
gtagtgacattcagctggtg

SEQ ID NO: 419703 - DNA, 20 bp, mouse
gcaagtggtggggaccctag

SEQ ID NO: 419704 - DNA, 20 bp, mouse
gctcgtcgctgccactcggg

SEQ ID NO: 419705 - DNA, 20 bp, mouse
gaggcccagagacccccgac

SEQ ID NO: 419706 - DNA, 20 bp, mouse
ggatggcgtgaagcttatgg

SEQ ID NO: 419707 - DNA, 20 bp, mouse
gatgatccccgcgcagaagt

SEQ ID NO: 419708 - DNA, 20 bp, mouse
ggtcgaacaggtgcagctgg

SEQ ID NO: 419709 - DNA, 20 bp, mouse
ggcgggagcaaacgccacag

SEQ ID NO: 419710 - DNA, 20 bp, mouse
ggccacagaggcattggaca

SEQ ID NO: 419711 - DNA, 20 bp, mouse
ggtggatggcgtgaagctta

SEQ ID NO: 419712 - DNA, 20 bp, mouse
ggcggggatcatgtcgtcga

SEQ ID NO: 419713 - DNA, 20 bp, mouse
gggctcatccgaagtcgaac

SEQ ID NO: 419714 - DNA, 20 bp, mouse
gccgcgcagaagtaggcgca

SEQ ID NO: 419715 - DNA, 20 bp, mouse
ggcaaacgccacagaggcat

SEQ ID NO: 419716 - DNA, 20 bp, mouse
ggtgccgcaagagattggag

SEQ ID NO: 419717 - DNA, 20 bp, mouse
gcgctgggactgctcctgga

SEQ ID NO: 419718 - DNA, 20 bp, mouse
gcgcaggcgcccaccaaagt

SEQ ID NO: 419719 - DNA, 20 bp, mouse
gcgaggtccagagctagaag

SEQ ID NO: 419720 - DNA, 20 bp, mouse
ggacgcgctgggactgctcc

SEQ ID NO: 419721 - DNA, 20 bp, mouse
gatctcttgcggcactgtgg

SEQ ID NO: 419722 - DNA, 20 bp, mouse
gagaagcggcggcaactcca

SEQ ID NO: 419723 - DNA, 20 bp, mouse
gaatggcaggatgtatccag

SEQ ID NO: 419724 - DNA, 20 bp, mouse
gcactgccctgcgcactcac

SEQ ID NO: 419725 - DNA, 20 bp, mouse
gaagaggtgggagtcgtctg

SEQ ID NO: 419726 - DNA, 20 bp, mouse
gagactgggaactcaagaga

SEQ ID NO: 419727 - DNA, 20 bp, mouse
ggtgtcaccggacggagtga

SEQ ID NO: 419728 - DNA, 20 bp, mouse
gtgcttaggactgctgtgta

SEQ ID NO: 419729 - DNA, 20 bp, mouse
gaacaagccgggatcctcat

SEQ ID NO: 419730 - DNA, 20 bp, mouse
ggtatacctgagcagcactc

SEQ ID NO: 419731 - DNA, 20 bp, mouse
ggaccgggagaaggttcttc

SEQ ID NO: 419732 - DNA, 20 bp, mouse
gctcacaagcgtctggaaga

SEQ ID NO: 419733 - DNA, 20 bp, mouse
ggctataattagccaagtgc

SEQ ID NO: 419734 - DNA, 20 bp, mouse
gaagttagtgtgtcaccgga

SEQ ID NO: 419735 - DNA, 20 bp, mouse
gtatggcgctaactaaccat

SEQ ID NO: 419736 - DNA, 20 bp, mouse
ggaatgggaggctgcgtgag

SEQ ID NO: 419737 - DNA, 20 bp, mouse
ggcgtcccgcccgccttcag

SEQ ID NO: 419738 - DNA, 20 bp, mouse
gcgtgagaggaaccccgcgc

SEQ ID NO: 419739 - DNA, 20 bp, mouse
gccttcggcatcttttgaat

SEQ ID NO: 419740 - DNA, 20 bp, mouse
gccggccgctggctcatctt

SEQ ID NO: 419741 - DNA, 20 bp, mouse
gctccgaactcctagacacg

SEQ ID NO: 419742 - DNA, 20 bp, mouse
gagaagcgcagaggctcgta

SEQ ID NO: 419743 - DNA, 20 bp, mouse
gggctttggcgcgcgtctcc

SEQ ID NO: 419744 - DNA, 20 bp, mouse
ggggtgccagaggcagggat

SEQ ID NO: 419745 - DNA, 20 bp, mouse
ggcgccaaagccccgtgtct

SEQ ID NO: 419746 - DNA, 20 bp, mouse
gtgagctgtgggacgcgagg

SEQ ID NO: 419747 - DNA, 20 bp, mouse
gcgaggtggcgaaggtgctg

SEQ ID NO: 419748 - DNA, 20 bp, mouse
ggccaaggctgctcacgtca

SEQ ID NO: 419749 - DNA, 20 bp, mouse
ggcctggtgtgtctgagctg

SEQ ID NO: 419750 - DNA, 20 bp, mouse
gcggatgttcgggagtgggt

SEQ ID NO: 419751 - DNA, 20 bp, mouse
ggtctgagctgtgggacgcg

SEQ ID NO: 419752 - DNA, 20 bp, mouse
gcggaggggcctgggctcca

SEQ ID NO: 419753 - DNA, 20 bp, mouse
ggctgcggctgcacgcacac

SEQ ID NO: 419754 - DNA, 20 bp, mouse
gagagagagagagcgatcgg

SEQ ID NO: 419755 - DNA, 20 bp, mouse
ggctcagacacaccaggccc

SEQ ID NO: 419756 - DNA, 20 bp, mouse
gtaccctgaactttcctgtt

SEQ ID NO: 419757 - DNA, 20 bp, mouse
gctgggtgcgtggacgtcaa

SEQ ID NO: 419758 - DNA, 20 bp, mouse
gaaaaaagcaggtagaacag

SEQ ID NO: 419759 - DNA, 20 bp, mouse
ggagcccatcccgaagtcat

SEQ ID NO: 419760 - DNA, 20 bp, mouse
ggacgtccacgcacccagca

SEQ ID NO: 419761 - DNA, 20 bp, mouse
gtttattgtttgtatagtgt

SEQ ID NO: 419762 - DNA, 20 bp, mouse
gtgagcacactgttcccaac

SEQ ID NO: 419763 - DNA, 20 bp, mouse
ggaattgtgtgtgctgtatg

SEQ ID NO: 419764 - DNA, 20 bp, mouse
gtcggagagcatgccttgct

SEQ ID NO: 419765 - DNA, 20 bp, mouse
gcaacgggcagcgttggagt

SEQ ID NO: 419766 - DNA, 20 bp, mouse
gggaacagaaacgaagagag

SEQ ID NO: 419767 - DNA, 20 bp, mouse
gtcaggacttcggtcgaagg

SEQ ID NO: 419768 - DNA, 20 bp, mouse
ggcgcttcctatccctgtag

SEQ ID NO: 419769 - DNA, 20 bp, mouse
gcctgacggttgcccccgag

SEQ ID NO: 419770 - DNA, 20 bp, mouse
gcggttgcccccgagaggcc

SEQ ID NO: 419771 - DNA, 20 bp, mouse
gtctgttcccctacagggat

SEQ ID NO: 419772 - DNA, 20 bp, mouse
ggaggcctgagggggaacta

SEQ ID NO: 419773 - DNA, 20 bp, mouse
gagcggtcgcccggcctctc

SEQ ID NO: 419774 - DNA, 20 bp, mouse
gccctcttaaagggaccgca

SEQ ID NO: 419775 - DNA, 20 bp, mouse
gggggcaaccgtcaggactt

SEQ ID NO: 419776 - DNA, 20 bp, mouse
gctggcaatgggaattctaa

SEQ ID NO: 419777 - DNA, 20 bp, mouse
gtgggtgagccacaataata

SEQ ID NO: 419778 - DNA, 20 bp, mouse
gggattggggaggagcactc

SEQ ID NO: 419779 - DNA, 20 bp, mouse
gaagtagcgagggtcgggag

SEQ ID NO: 419780 - DNA, 20 bp, mouse
gtcatctgtcaagcatctcc

SEQ ID NO: 419781 - DNA, 20 bp, mouse
gagctgtgtggaacactaga

SEQ ID NO: 419782 - DNA, 20 bp, mouse
ggaagcactacagtagtgcc

SEQ ID NO: 419783 - DNA, 20 bp, mouse
ggttagaagtagcgagggtc

SEQ ID NO: 419784 - DNA, 20 bp, mouse
ggtcaagcatctcctggcaa

SEQ ID NO: 419785 - DNA, 20 bp, mouse
gtcgggagaggtaaaagata

SEQ ID NO: 419786 - DNA, 20 bp, mouse
gaaaggagacgcacctaggg

SEQ ID NO: 419787 - DNA, 20 bp, mouse
gcagaaaggagacgcaccta

SEQ ID NO: 419788 - DNA, 20 bp, mouse
gagcggttggctgcatataa

SEQ ID NO: 419789 - DNA, 20 bp, mouse
gtcctggccgcagccgccct

SEQ ID NO: 419790 - DNA, 20 bp, mouse
ggttaacgcccagaagcgag

SEQ ID NO: 419791 - DNA, 20 bp, mouse
gtctgggcgttaacatctcc

SEQ ID NO: 419792 - DNA, 20 bp, mouse
gacctagggcggctgcggcc

SEQ ID NO: 419793 - DNA, 20 bp, mouse
gacgcgcggccctccccgag

SEQ ID NO: 419794 - DNA, 20 bp, mouse
gataagggccgctcgcttct

SEQ ID NO: 419795 - DNA, 20 bp, mouse
ggcagccaaccgctcgggga

SEQ ID NO: 419796 - DNA, 20 bp, mouse
ggcccgcgcgagcgtgacct

SEQ ID NO: 419797 - DNA, 20 bp, mouse
ggcaggcgcggtgtccctca

SEQ ID NO: 419798 - DNA, 20 bp, mouse
gcgctcgcgcgggcaggtcc

SEQ ID NO: 419799 - DNA, 20 bp, mouse
gaggcctccggtgtgcaggg

SEQ ID NO: 419800 - DNA, 20 bp, mouse
gtcccaggtcacgctcgcgc

SEQ ID NO: 419801 - DNA, 20 bp, mouse
gcccgggagccaacaacgcc

SEQ ID NO: 419802 - DNA, 20 bp, mouse
ggcggcacaaagcaccacgg

SEQ ID NO: 419803 - DNA, 20 bp, mouse
gaaggcggcacaaagcacca

SEQ ID NO: 419804 - DNA, 20 bp, mouse
gaggcgctctgctaccgtga

SEQ ID NO: 419805 - DNA, 20 bp, mouse
ggcggggaggctccgctccc

SEQ ID NO: 419806 - DNA, 20 bp, mouse
ggggccaccgggagctccat

SEQ ID NO: 419807 - DNA, 20 bp, mouse
gcggcctccgatacacgctc

SEQ ID NO: 419808 - DNA, 20 bp, mouse
ggccctgccggagcgtgtat

SEQ ID NO: 419809 - DNA, 20 bp, mouse
gacgctccggcagggccacc

SEQ ID NO: 419810 - DNA, 20 bp, mouse
gaggttccgaacccagtctc

SEQ ID NO: 419811 - DNA, 20 bp, mouse
ggttccacattagccctgta

SEQ ID NO: 419812 - DNA, 20 bp, mouse
gctgccggagcgtgtatcgg

SEQ ID NO: 419813 - DNA, 20 bp, mouse
gcgtgtatcggaggccggat

SEQ ID NO: 419814 - DNA, 20 bp, mouse
ggggagggaaatagggtgat

SEQ ID NO: 419815 - DNA, 20 bp, mouse
gtttccctacagggctaatg

SEQ ID NO: 419816 - DNA, 20 bp, mouse
gtctgccctctggaatagaa

SEQ ID NO: 419817 - DNA, 20 bp, mouse
ggtaggagacacggcctgag

SEQ ID NO: 419818 - DNA, 20 bp, mouse
gaagaaaccagtaggagaca

SEQ ID NO: 419819 - DNA, 20 bp, mouse
ggtcaaaggaagaaaccagt

SEQ ID NO: 419820 - DNA, 20 bp, mouse
gtggagaccgcttgcctctc

SEQ ID NO: 419821 - DNA, 20 bp, mouse
gcctgtctaggtaagtcagg

SEQ ID NO: 419822 - DNA, 20 bp, mouse
gaccccaggtccggtgtaaa

SEQ ID NO: 419823 - DNA, 20 bp, mouse
ggaaggcaaagctatatata

SEQ ID NO: 419824 - DNA, 20 bp, mouse
gtgattgactcaccttctct

SEQ ID NO: 419825 - DNA, 20 bp, mouse
gtatatatagggctgtgctg

SEQ ID NO: 419826 - DNA, 20 bp, mouse
gaaatccagatgcagcgctg

SEQ ID NO: 419827 - DNA, 20 bp, mouse
gtaaggaagttcgattccgg

SEQ ID NO: 419828 - DNA, 20 bp, mouse
ggaataaggaagttcgattc

SEQ ID NO: 419829 - DNA, 20 bp, mouse
gtgatgatgtcacaggaccc

SEQ ID NO: 419830 - DNA, 20 bp, mouse
gcatcatcagaaagggccgc

SEQ ID NO: 419831 - DNA, 20 bp, mouse
gggaagctgctgacctaggc

SEQ ID NO: 419832 - DNA, 20 bp, mouse
ggagtgaagtttgaagaata

SEQ ID NO: 419833 - DNA, 20 bp, mouse
gcaaaccagaagtagactct

SEQ ID NO: 419834 - DNA, 20 bp, mouse
gtcctgtgacatcatcagaa

SEQ ID NO: 419835 - DNA, 20 bp, mouse
gatgtcctagagtctacttc

SEQ ID NO: 419836 - DNA, 20 bp, mouse
gcgctcggctgcagaggagg

SEQ ID NO: 419837 - DNA, 20 bp, mouse
gaaagcattaggggagccca

SEQ ID NO: 419838 - DNA, 20 bp, mouse
ggtgcgctcggctgcagagg

SEQ ID NO: 419839 - DNA, 20 bp, mouse
gtgtggagaggaaagcatta

SEQ ID NO: 419840 - DNA, 20 bp, mouse
ggcagcctggcgtgacaagt

SEQ ID NO: 419841 - DNA, 20 bp, mouse
gccatcatgtgacaccggag

SEQ ID NO: 419842 - DNA, 20 bp, mouse
gggcgacagggtccccggag

SEQ ID NO: 419843 - DNA, 20 bp, mouse
ggcgatggggactctgagac

SEQ ID NO: 419844 - DNA, 20 bp, mouse
gtgcgtgcgctcggctgcag

SEQ ID NO: 419845 - DNA, 20 bp, mouse
gttccatagagaggcctctc

SEQ ID NO: 419846 - DNA, 20 bp, mouse
gcgccgggcgagcgcggtcg

SEQ ID NO: 419847 - DNA, 20 bp, mouse
ggcgcttaccggcctccgcc

SEQ ID NO: 419848 - DNA, 20 bp, mouse
gggaggccggtaagcgcact

SEQ ID NO: 419849 - DNA, 20 bp, mouse
ggtgatgcgcggcagcaggt

SEQ ID NO: 419850 - DNA, 20 bp, mouse
gggagcccggggtaccgagg

SEQ ID NO: 419851 - DNA, 20 bp, mouse
gggccttcagcgacttcaag

SEQ ID NO: 419852 - DNA, 20 bp, mouse
gcaggcacgccacaaggccg

SEQ ID NO: 419853 - DNA, 20 bp, mouse
gcaacgccaagtgcgcttac

SEQ ID NO: 419854 - DNA, 20 bp, mouse
ggaaggccgccagcgcagtc

SEQ ID NO: 419855 - DNA, 20 bp, mouse
gcttgtggcgtgcctggtgg

SEQ ID NO: 419856 - DNA, 20 bp, mouse
gcccgtgcagatcaaagacc

SEQ ID NO: 419857 - DNA, 20 bp, mouse
gttccagcacgtacaaggta

SEQ ID NO: 419858 - DNA, 20 bp, mouse
ggtgcagatcaaagaccagg

SEQ ID NO: 419859 - DNA, 20 bp, mouse
gaattagctggaaatcgcag

SEQ ID NO: 419860 - DNA, 20 bp, mouse
ggaagagcggttgtcagcat

SEQ ID NO: 419861 - DNA, 20 bp, mouse
gtactgttccagcacgtaca

SEQ ID NO: 419862 - DNA, 20 bp, mouse
gcagaccagacaatgaagag

SEQ ID NO: 419863 - DNA, 20 bp, mouse
gggtctggcccgacgcacag

SEQ ID NO: 419864 - DNA, 20 bp, mouse
gtgagttgcgacagccttgg

SEQ ID NO: 419865 - DNA, 20 bp, mouse
gtaaacacagtagcattgta

SEQ ID NO: 419866 - DNA, 20 bp, mouse
gccaaggccacggggatctg

SEQ ID NO: 419867 - DNA, 20 bp, mouse
gtgccagcccgagaccacag

SEQ ID NO: 419868 - DNA, 20 bp, mouse
gagggagccccagatccccg

SEQ ID NO: 419869 - DNA, 20 bp, mouse
ggcatctctcctcccatgta

SEQ ID NO: 419870 - DNA, 20 bp, mouse
gctccgctgtggtctcgggc

SEQ ID NO: 419871 - DNA, 20 bp, mouse
gctttctccgctgtggtctc

SEQ ID NO: 419872 - DNA, 20 bp, mouse
ggcttctcctttctccgctg

SEQ ID NO: 419873 - DNA, 20 bp, mouse
gactgctggcgggaaggtgt

SEQ ID NO: 419874 - DNA, 20 bp, mouse
gcaaacagcaggatggtcca

SEQ ID NO: 419875 - DNA, 20 bp, mouse
gagaaaggagaagcgagtgt

SEQ ID NO: 419876 - DNA, 20 bp, mouse
gaagaaaagagagaaatatg

SEQ ID NO: 419877 - DNA, 20 bp, mouse
ggcactggaaaatttctaat

SEQ ID NO: 419878 - DNA, 20 bp, mouse
gaggcgtgtgctacccatca

SEQ ID NO: 419879 - DNA, 20 bp, mouse
gaccccggaaattaaacctt

SEQ ID NO: 419880 - DNA, 20 bp, mouse
gggaggaatacaaacctaac

SEQ ID NO: 419881 - DNA, 20 bp, mouse
gacaaacactgtgccatgat

SEQ ID NO: 419882 - DNA, 20 bp, mouse
gcagtgctgtttctccagtt

SEQ ID NO: 419883 - DNA, 20 bp, mouse
ggggattcatcatgtacctc

SEQ ID NO: 419884 - DNA, 20 bp, mouse
ggaaacagttgtcaaagatc

SEQ ID NO: 419885 - DNA, 20 bp, mouse
ggcaacagccctgactgtct

SEQ ID NO: 419886 - DNA, 20 bp, mouse
gagaagtcttatgtcaatgg

SEQ ID NO: 419887 - DNA, 20 bp, mouse
ggaggtctgagtgaacgaga

SEQ ID NO: 419888 - DNA, 20 bp, mouse
gtcaggcctggagcagaggg

SEQ ID NO: 419889 - DNA, 20 bp, mouse
gctccatacgacagaggagg

SEQ ID NO: 419890 - DNA, 20 bp, mouse
gtcgagggttgtgggttcca

SEQ ID NO: 419891 - DNA, 20 bp, mouse
gtcacccaggacgttcacca

SEQ ID NO: 419892 - DNA, 20 bp, mouse
gtatgtcaatgggggcttcg

SEQ ID NO: 419893 - DNA, 20 bp, mouse
gtggtcctgaaccggtccct

SEQ ID NO: 419894 - DNA, 20 bp, mouse
gtctgagtcttcgttatcga

SEQ ID NO: 419895 - DNA, 20 bp, mouse
gggaccatggtgaacgtcct

SEQ ID NO: 419896 - DNA, 20 bp, mouse
gcaagagttgccggtgagag

SEQ ID NO: 419897 - DNA, 20 bp, mouse
gctcccacagtcctgagcca

SEQ ID NO: 419898 - DNA, 20 bp, mouse
gagcacaagtagcaaggccc

SEQ ID NO: 419899 - DNA, 20 bp, mouse
gtgccatggctcaggactgt

SEQ ID NO: 419900 - DNA, 20 bp, mouse
ggagccatggcaagagttgc

SEQ ID NO: 419901 - DNA, 20 bp, mouse
gtcaccggcaactcttgcca

SEQ ID NO: 419902 - DNA, 20 bp, mouse
gcaagggagggagaacgtgt

SEQ ID NO: 419903 - DNA, 20 bp, mouse
gggagagacaagcttaagta

SEQ ID NO: 419904 - DNA, 20 bp, mouse
gcgtgtgggcctggaggaag

SEQ ID NO: 419905 - DNA, 20 bp, mouse
ggaacaagatgaacttgccc

SEQ ID NO: 419906 - DNA, 20 bp, mouse
gtactcctcaagagctgtat

SEQ ID NO: 419907 - DNA, 20 bp, mouse
ggcttcctatacagctcttg

SEQ ID NO: 419908 - DNA, 20 bp, mouse
gtagaagatggaatcacaca

SEQ ID NO: 419909 - DNA, 20 bp, mouse
gatttattaagataacttac

SEQ ID NO: 419910 - DNA, 20 bp, mouse
gtactctctctttcttggca

SEQ ID NO: 419911 - DNA, 20 bp, mouse
gcactagctgaactaaaact

SEQ ID NO: 419912 - DNA, 20 bp, mouse
gggcacccaagtagatttga

SEQ ID NO: 419913 - DNA, 20 bp, mouse
gagctgagacatccagcctc

SEQ ID NO: 419914 - DNA, 20 bp, mouse
gctcaggaactgagaacttc

SEQ ID NO: 419915 - DNA, 20 bp, mouse
gctataggtgacgactagac

SEQ ID NO: 419916 - DNA, 20 bp, mouse
gatgtatcttggacaagaca

SEQ ID NO: 419917 - DNA, 20 bp, mouse
ggtctgcagtgcatgctctt

SEQ ID NO: 419918 - DNA, 20 bp, mouse
ggtacacagggaaggtagta

SEQ ID NO: 419919 - DNA, 20 bp, mouse
gctggaatatcgtggtctca

SEQ ID NO: 419920 - DNA, 20 bp, mouse
gggcacaattcaatccggag

SEQ ID NO: 419921 - DNA, 20 bp, mouse
ggctcagacctggaatatcg

SEQ ID NO: 419922 - DNA, 20 bp, mouse
gttcggaatgtgatgtatct

SEQ ID NO: 419923 - DNA, 20 bp, mouse
gtctctgaatcagaaagtca

SEQ ID NO: 419924 - DNA, 20 bp, mouse
gccactgccatgaggatgac

SEQ ID NO: 419925 - DNA, 20 bp, mouse
gatcagaaagtcaaggactt

SEQ ID NO: 419926 - DNA, 20 bp, mouse
gccactcttggccctgatgt

SEQ ID NO: 419927 - DNA, 20 bp, mouse
gtagagagaatcaggagggt

SEQ ID NO: 419928 - DNA, 20 bp, mouse
gacagatccttctccactct

SEQ ID NO: 419929 - DNA, 20 bp, mouse
ggagcatgagcagatgtgta

SEQ ID NO: 419930 - DNA, 20 bp, mouse
gtgctgtaagtctgacagga

SEQ ID NO: 419931 - DNA, 20 bp, mouse
ggtagggtgtaagctttgaa

SEQ ID NO: 419932 - DNA, 20 bp, mouse
ggaatcaggagggtagggct

SEQ ID NO: 419933 - DNA, 20 bp, mouse
gcatctgctcatgctcacct

SEQ ID NO: 419934 - DNA, 20 bp, mouse
gacagaaacctggcagtacc

SEQ ID NO: 419935 - DNA, 20 bp, mouse
gtcagctctgttcctctctc

SEQ ID NO: 419936 - DNA, 20 bp, mouse
ggtctcactagtccttaact

SEQ ID NO: 419937 - DNA, 20 bp, mouse
gaacccagcggctcacactt

SEQ ID NO: 419938 - DNA, 20 bp, mouse
gctccgaagtgtgagccgct

SEQ ID NO: 419939 - DNA, 20 bp, mouse
gagactaatcgtcctagtta

SEQ ID NO: 419940 - DNA, 20 bp, mouse
gactcctgagttttccagag

SEQ ID NO: 419941 - DNA, 20 bp, mouse
ggctctgggtggaaactctc

SEQ ID NO: 419942 - DNA, 20 bp, mouse
gggtccactctggaaaactc

SEQ ID NO: 419943 - DNA, 20 bp, mouse
gtttcacttggaaatttgaa

SEQ ID NO: 419944 - DNA, 20 bp, mouse
gtaaacatcattggtgagct

SEQ ID NO: 419945 - DNA, 20 bp, mouse
gttggtgaatagtcagagat

SEQ ID NO: 419946 - DNA, 20 bp, mouse
gctccccaggcgggagatga

SEQ ID NO: 419947 - DNA, 20 bp, mouse
ggctcgggccaggaactcga

SEQ ID NO: 419948 - DNA, 20 bp, mouse
ggggagcacgagcccactgc

SEQ ID NO: 419949 - DNA, 20 bp, mouse
ggccccagcatcatgcaagt

SEQ ID NO: 419950 - DNA, 20 bp, mouse
gagtgggctcgtgctcccta

SEQ ID NO: 419951 - DNA, 20 bp, mouse
ggtgctccctagggcgggag

SEQ ID NO: 419952 - DNA, 20 bp, mouse
gctccatcatctcccgcctg

SEQ ID NO: 419953 - DNA, 20 bp, mouse
ggtctgcccctcccgcccta

SEQ ID NO: 419954 - DNA, 20 bp, mouse
ggtcgcacccgggctttcct

SEQ ID NO: 419955 - DNA, 20 bp, mouse
gagcttcccgaaggttccct

SEQ ID NO: 419956 - DNA, 20 bp, mouse
gcagagcgaatcctgagctc

SEQ ID NO: 419957 - DNA, 20 bp, mouse
ggccacagccggggaagccc

SEQ ID NO: 419958 - DNA, 20 bp, mouse
ggtacctgctgccggagctc

SEQ ID NO: 419959 - DNA, 20 bp, mouse
ggccggacgaccatcctctg

SEQ ID NO: 419960 - DNA, 20 bp, mouse
ggagaggggagccccgggag

SEQ ID NO: 419961 - DNA, 20 bp, mouse
gaagaccccgtgctccccag

SEQ ID NO: 419962 - DNA, 20 bp, mouse
gccgcagctggacccgaacc

SEQ ID NO: 419963 - DNA, 20 bp, mouse
ggggcgggtgagggaggcaa

SEQ ID NO: 419964 - DNA, 20 bp, mouse
ggcaaagccacaaaccccta

SEQ ID NO: 419965 - DNA, 20 bp, mouse
gccccgtgctccccagagga

SEQ ID NO: 419966 - DNA, 20 bp, mouse
gtcagtgagtggctaaccca

SEQ ID NO: 419967 - DNA, 20 bp, mouse
gaaaagcccatagcttgaga

SEQ ID NO: 419968 - DNA, 20 bp, mouse
gtgataccgtctcaagctat

SEQ ID NO: 419969 - DNA, 20 bp, mouse
gcccagttagagtcagtgag

SEQ ID NO: 419970 - DNA, 20 bp, mouse
ggtggtccaacagctgccgt

SEQ ID NO: 419971 - DNA, 20 bp, mouse
gctgtccttacaggcagggg

SEQ ID NO: 419972 - DNA, 20 bp, mouse
ggctaacccacggcagctgt

SEQ ID NO: 419973 - DNA, 20 bp, mouse
gattcagatgtgtgtctcag

SEQ ID NO: 419974 - DNA, 20 bp, mouse
ggccactcactgactctaac

SEQ ID NO: 419975 - DNA, 20 bp, mouse
ggtaatagctctgtccttac

SEQ ID NO: 419976 - DNA, 20 bp, mouse
gccggacggaggaagagacg

SEQ ID NO: 419977 - DNA, 20 bp, mouse
gggaacacgcgcccggacgg

SEQ ID NO: 419978 - DNA, 20 bp, mouse
gggaggaacacgcgcccgga

SEQ ID NO: 419979 - DNA, 20 bp, mouse
gtgttcctccagctccgacc

SEQ ID NO: 419980 - DNA, 20 bp, mouse
gagagcggggctcgaatcgg

SEQ ID NO: 419981 - DNA, 20 bp, mouse
gagtagagcggggctcgaat

SEQ ID NO: 419982 - DNA, 20 bp, mouse
gtcctccagctccgaccagg

SEQ ID NO: 419983 - DNA, 20 bp, mouse
ggggctcgaatcggaggagg

SEQ ID NO: 419984 - DNA, 20 bp, mouse
gacgtccgcctggtcggagc

SEQ ID NO: 419985 - DNA, 20 bp, mouse
gccgcgtgagagacccgagg

SEQ ID NO: 419986 - DNA, 20 bp, mouse
ggagggacctcggagactgg

SEQ ID NO: 419987 - DNA, 20 bp, mouse
gggctgcggagagctactgg

SEQ ID NO: 419988 - DNA, 20 bp, mouse
ggtgctatcaggagggacct

SEQ ID NO: 419989 - DNA, 20 bp, mouse
gcaggagggacctcggagac

SEQ ID NO: 419990 - DNA, 20 bp, mouse
gcctgagtgccgagccccag

SEQ ID NO: 419991 - DNA, 20 bp, mouse
gggggccggtgcaccctctg

SEQ ID NO: 419992 - DNA, 20 bp, mouse
gcaccaggcggagacccggg

SEQ ID NO: 419993 - DNA, 20 bp, mouse
gccctggggacagtgctatc

SEQ ID NO: 419994 - DNA, 20 bp, mouse
ggagagcgagcaggccacgg

SEQ ID NO: 419995 - DNA, 20 bp, mouse
gtggggacagtgctatcagg

SEQ ID NO: 419996 - DNA, 20 bp, mouse
gcggggccggggccaaccca

SEQ ID NO: 419997 - DNA, 20 bp, mouse
ggccctgacagcaacacctt

SEQ ID NO: 419998 - DNA, 20 bp, mouse
ggcgctggaggactcttccg

SEQ ID NO: 419999 - DNA, 20 bp, mouse
gaggcatggccgggttggat

SEQ ID NO: 420000 - DNA, 20 bp, mouse
gtgacagcaacaccttgggt

SEQ ID NO: 420001 - DNA, 20 bp, mouse
gtgctgtcagggctgcacgg

SEQ ID NO: 420002 - DNA, 20 bp, mouse
gcacggcgggaggtaaggca

SEQ ID NO: 420003 - DNA, 20 bp, mouse
gaaggtatgaggccactctt

SEQ ID NO: 420004 - DNA, 20 bp, mouse
gcagcgcgtgatcaaaggag

SEQ ID NO: 420005 - DNA, 20 bp, mouse
ggccgagagggtagggacat

SEQ ID NO: 420006 - DNA, 20 bp, mouse
gacccggaagaagaagctcg

SEQ ID NO: 420007 - DNA, 20 bp, mouse
ggccgacagggcacaatctt

SEQ ID NO: 420008 - DNA, 20 bp, mouse
ggggtctggaaccagtaaag

SEQ ID NO: 420009 - DNA, 20 bp, mouse
gccagtaaagaggagccgac

SEQ ID NO: 420010 - DNA, 20 bp, mouse
gcaaccaggaaaggcatacc

SEQ ID NO: 420011 - DNA, 20 bp, mouse
gctcatctgcacaggacccg

SEQ ID NO: 420012 - DNA, 20 bp, mouse
gctctggtcaaaaatgggtc

SEQ ID NO: 420013 - DNA, 20 bp, mouse
ggccgcgagcttcttcttcc

SEQ ID NO: 420014 - DNA, 20 bp, mouse
gctggtgggagtctacggtc

SEQ ID NO: 420015 - DNA, 20 bp, mouse
gccacctgctcagaagccgg

SEQ ID NO: 420016 - DNA, 20 bp, mouse
gtctaggctgcgggaggaag

SEQ ID NO: 420017 - DNA, 20 bp, mouse
gagggagcggtgagatgtca

SEQ ID NO: 420018 - DNA, 20 bp, mouse
gctctagcccgcatagggag

SEQ ID NO: 420019 - DNA, 20 bp, mouse
ggctttacgagccacctcca

SEQ ID NO: 420020 - DNA, 20 bp, mouse
gaggtcgctctagcccgcat

SEQ ID NO: 420021 - DNA, 20 bp, mouse
gcttccttctaggctgcggg

SEQ ID NO: 420022 - DNA, 20 bp, mouse
ggtagtgtaatccgccatgg

SEQ ID NO: 420023 - DNA, 20 bp, mouse
gattctgggcgaaaagacag

SEQ ID NO: 420024 - DNA, 20 bp, mouse
gctagagcgacctaggagag

SEQ ID NO: 420025 - DNA, 20 bp, mouse
gccccgagctgggtgtgcgt

SEQ ID NO: 420026 - DNA, 20 bp, mouse
gagccaggcagcaacccgca

SEQ ID NO: 420027 - DNA, 20 bp, mouse
ggaccgccacacggaagaaa

SEQ ID NO: 420028 - DNA, 20 bp, mouse
gctagcgtagaaagatcagc

SEQ ID NO: 420029 - DNA, 20 bp, mouse
gcaccccacacgatccaaag

SEQ ID NO: 420030 - DNA, 20 bp, mouse
ggtgtggcggtcactgaggt

SEQ ID NO: 420031 - DNA, 20 bp, mouse
ggggcgcaggaggggctcca

SEQ ID NO: 420032 - DNA, 20 bp, mouse
gtgaggtaggtgaacctagt

SEQ ID NO: 420033 - DNA, 20 bp, mouse
gtgatcagccacagccctgc

SEQ ID NO: 420034 - DNA, 20 bp, mouse
gcaccctcactgggacccaa

SEQ ID NO: 420035 - DNA, 20 bp, mouse
gtgtcggacacagttgggag

SEQ ID NO: 420036 - DNA, 20 bp, mouse
gggaagaagggctctgaaaa

SEQ ID NO: 420037 - DNA, 20 bp, mouse
gcacaacagggccacctcca

SEQ ID NO: 420038 - DNA, 20 bp, mouse
gacctccaaggagagcggtt

SEQ ID NO: 420039 - DNA, 20 bp, mouse
gcaccctcccggcatgcact

SEQ ID NO: 420040 - DNA, 20 bp, mouse
gttcccagtgcatgccggga

SEQ ID NO: 420041 - DNA, 20 bp, mouse
gcgatctgaaaggccctgga

SEQ ID NO: 420042 - DNA, 20 bp, mouse
gccggcatgcactgggaaga

SEQ ID NO: 420043 - DNA, 20 bp, mouse
gagcagacaggccagtgatt

SEQ ID NO: 420044 - DNA, 20 bp, mouse
gacctaaccgctctccttgg

SEQ ID NO: 420045 - DNA, 20 bp, mouse
gacagccagatagcacaaca

SEQ ID NO: 420046 - DNA, 20 bp, mouse
gttgctctcccatttcctgg

SEQ ID NO: 420047 - DNA, 20 bp, mouse
gtgctgaatgccagagatat

SEQ ID NO: 420048 - DNA, 20 bp, mouse
gagccatgtgactgtgatag

SEQ ID NO: 420049 - DNA, 20 bp, mouse
gttatctgcccccaggaaat

SEQ ID NO: 420050 - DNA, 20 bp, mouse
gatgcataggagccaaacaa

SEQ ID NO: 420051 - DNA, 20 bp, mouse
gtaagtgattcagaatgtgg

SEQ ID NO: 420052 - DNA, 20 bp, mouse
gagtggggtttgatgtagag

SEQ ID NO: 420053 - DNA, 20 bp, mouse
gtatgcataggaatcagctg

SEQ ID NO: 420054 - DNA, 20 bp, mouse
gtaacatggccatggggtgt

SEQ ID NO: 420055 - DNA, 20 bp, mouse
gaatacagtgcctatatctc

SEQ ID NO: 420056 - DNA, 20 bp, mouse
ggaccaagccggaggacccg

SEQ ID NO: 420057 - DNA, 20 bp, mouse
ggctagcctccaccagggaa

SEQ ID NO: 420058 - DNA, 20 bp, mouse
gcggcctgcgcaggcacctc

SEQ ID NO: 420059 - DNA, 20 bp, mouse
gcaggtaagagacagtggtc

SEQ ID NO: 420060 - DNA, 20 bp, mouse
ggcgggtaagaccactcccg

SEQ ID NO: 420061 - DNA, 20 bp, mouse
gaaagcgctagcctccacca

SEQ ID NO: 420062 - DNA, 20 bp, mouse
ggtcaggatgaaggcttcca

SEQ ID NO: 420063 - DNA, 20 bp, mouse
gccactggggcccctggcca

SEQ ID NO: 420064 - DNA, 20 bp, mouse
gtgaaggcttccatggccag

SEQ ID NO: 420065 - DNA, 20 bp, mouse
gctgacgtcaccggcctctc

SEQ ID NO: 420066 - DNA, 20 bp, mouse
ggtgcgaggtcggtgcgagg

SEQ ID NO: 420067 - DNA, 20 bp, mouse
gtcagaagtcggaagactct

SEQ ID NO: 420068 - DNA, 20 bp, mouse
gtcttctccggctcagaagt

SEQ ID NO: 420069 - DNA, 20 bp, mouse
ggagccggagaagagcatct

SEQ ID NO: 420070 - DNA, 20 bp, mouse
gcgaggtcggtgcgaggcgg

SEQ ID NO: 420071 - DNA, 20 bp, mouse
gcgacctagatgctcttctc

SEQ ID NO: 420072 - DNA, 20 bp, mouse
gaagactctcggtgcgaggt

SEQ ID NO: 420073 - DNA, 20 bp, mouse
ggctcccggcctcgaccccg

SEQ ID NO: 420074 - DNA, 20 bp, mouse
gccctgatgcggcccgggag

SEQ ID NO: 420075 - DNA, 20 bp, mouse
gggcagcagaggccctgatg

SEQ ID NO: 420076 - DNA, 20 bp, mouse
gggtctcctggcgacaacca

SEQ ID NO: 420077 - DNA, 20 bp, mouse
gctcctggcgacaaccatgg

SEQ ID NO: 420078 - DNA, 20 bp, mouse
ggtgaggaggaggaactcct

SEQ ID NO: 420079 - DNA, 20 bp, mouse
ggtgggcggtcgcagctgta

SEQ ID NO: 420080 - DNA, 20 bp, mouse
gctggcgacaaccatggcgg

SEQ ID NO: 420081 - DNA, 20 bp, mouse
gcaaccatggcgggggatgt

SEQ ID NO: 420082 - DNA, 20 bp, mouse
gccgcccacatcccccgcca

SEQ ID NO: 420083 - DNA, 20 bp, mouse
gccttgtgggaggccggcca

SEQ ID NO: 420084 - DNA, 20 bp, mouse
gctcccacaaggcactgcgg

SEQ ID NO: 420085 - DNA, 20 bp, mouse
gggtcgcagctgtacggacg

SEQ ID NO: 420086 - DNA, 20 bp, mouse
gcccactcatctgtaaccca

SEQ ID NO: 420087 - DNA, 20 bp, mouse
gaccatgggttacagatgag

SEQ ID NO: 420088 - DNA, 20 bp, mouse
gccttggaggccaggtatgt

SEQ ID NO: 420089 - DNA, 20 bp, mouse
gactggttccatgatatcaa

SEQ ID NO: 420090 - DNA, 20 bp, mouse
ggtgctctggattgcagacc

SEQ ID NO: 420091 - DNA, 20 bp, mouse
gtccaaggaccctagagtcc

SEQ ID NO: 420092 - DNA, 20 bp, mouse
gatgcatgaccgcagagcac

SEQ ID NO: 420093 - DNA, 20 bp, mouse
gctttgcttctcaggagtcc

SEQ ID NO: 420094 - DNA, 20 bp, mouse
gggaggggctgcatctgcac

SEQ ID NO: 420095 - DNA, 20 bp, mouse
ggtccatgggtgaagcacag

SEQ ID NO: 420096 - DNA, 20 bp, mouse
gaagcgtggggtgtaaagga

SEQ ID NO: 420097 - DNA, 20 bp, mouse
gactgaagcgtggggtgtaa

SEQ ID NO: 420098 - DNA, 20 bp, mouse
gtcgagtaggtaggtagatc

SEQ ID NO: 420099 - DNA, 20 bp, mouse
gaaggaaggcactagtgatt

SEQ ID NO: 420100 - DNA, 20 bp, mouse
ggcagcagaaatatccaagg

SEQ ID NO: 420101 - DNA, 20 bp, mouse
gaaatgagaaactgaagcgt

SEQ ID NO: 420102 - DNA, 20 bp, mouse
gatcgcagcagaaatatcca

SEQ ID NO: 420103 - DNA, 20 bp, mouse
gccttcaacaacacaagaag

SEQ ID NO: 420104 - DNA, 20 bp, mouse
gttgcagctgggaccagccc

SEQ ID NO: 420105 - DNA, 20 bp, mouse
gacagcacatgtcagaataa

SEQ ID NO: 420106 - DNA, 20 bp, mouse
gcacccggcgacaggtggtg

SEQ ID NO: 420107 - DNA, 20 bp, mouse
gccgcgcacccggcgacagg

SEQ ID NO: 420108 - DNA, 20 bp, mouse
gccccgcagcgtcttcccag

SEQ ID NO: 420109 - DNA, 20 bp, mouse
gcgcatttccaggcgagcgg

SEQ ID NO: 420110 - DNA, 20 bp, mouse
gggagcgcggctggggacca

SEQ ID NO: 420111 - DNA, 20 bp, mouse
gatttccaggcgagcggcgg

SEQ ID NO: 420112 - DNA, 20 bp, mouse
gaggggacactagcaggcca

SEQ ID NO: 420113 - DNA, 20 bp, mouse
gcctcgtgggtgaaaatcca

SEQ ID NO: 420114 - DNA, 20 bp, mouse
gcgcccgcgcacccggcgac

SEQ ID NO: 420115 - DNA, 20 bp, mouse
gagctacctggacaggtaag

SEQ ID NO: 420116 - DNA, 20 bp, mouse
gcttccttgataaagctgaa

SEQ ID NO: 420117 - DNA, 20 bp, mouse
gaagcaggtacaagaggaag

SEQ ID NO: 420118 - DNA, 20 bp, mouse
gacagagaaagagaggcctc

SEQ ID NO: 420119 - DNA, 20 bp, mouse
gcccccaaagcaggtacaag

SEQ ID NO: 420120 - DNA, 20 bp, mouse
gttccagatgaaggttgtag

SEQ ID NO: 420121 - DNA, 20 bp, mouse
gcagacagttttggaaggta

SEQ ID NO: 420122 - DNA, 20 bp, mouse
gttccagcctggtcacccag

SEQ ID NO: 420123 - DNA, 20 bp, mouse
gggtgaccaggctggaatga

SEQ ID NO: 420124 - DNA, 20 bp, mouse
ggaatgatggctttctccag

SEQ ID NO: 420125 - DNA, 20 bp, mouse
gggcctctgggtgaccaggc

SEQ ID NO: 420126 - DNA, 20 bp, mouse
gcccgcgagtgcggctggag

SEQ ID NO: 420127 - DNA, 20 bp, mouse
gcccgcagcgcgtcagtctc

SEQ ID NO: 420128 - DNA, 20 bp, mouse
gcactcgcgggcactgctgg

SEQ ID NO: 420129 - DNA, 20 bp, mouse
gcactgctggtggatggctg

SEQ ID NO: 420130 - DNA, 20 bp, mouse
gacacgggcgggatcaagga

SEQ ID NO: 420131 - DNA, 20 bp, mouse
gagggctcggggtcgagacg

SEQ ID NO: 420132 - DNA, 20 bp, mouse
ggagtgctcacaggtcacag

SEQ ID NO: 420133 - DNA, 20 bp, mouse
ggcctctccagccgcactcg

SEQ ID NO: 420134 - DNA, 20 bp, mouse
gtggatcgaagacctgtcta

SEQ ID NO: 420135 - DNA, 20 bp, mouse
gtaggctccccgcccctcta

SEQ ID NO: 420136 - DNA, 20 bp, mouse
gtggcgggaccctaagatgg

SEQ ID NO: 420137 - DNA, 20 bp, mouse
gaggtggcgggaccctaaga

SEQ ID NO: 420138 - DNA, 20 bp, mouse
gcggcggcgcagcagatccc

SEQ ID NO: 420139 - DNA, 20 bp, mouse
ggcagggtcgccaacctcag

SEQ ID NO: 420140 - DNA, 20 bp, mouse
gcgccgccgccgccatctta

SEQ ID NO: 420141 - DNA, 20 bp, mouse
gaatggcggcggatgtggta

SEQ ID NO: 420142 - DNA, 20 bp, mouse
gtgcggggtggcgagaggga

SEQ ID NO: 420143 - DNA, 20 bp, mouse
gctgtgggcactaatggcgg

SEQ ID NO: 420144 - DNA, 20 bp, mouse
gtataaagttgttgttgagg

SEQ ID NO: 420145 - DNA, 20 bp, mouse
ggccgggcccgaagttgggt

SEQ ID NO: 420146 - DNA, 20 bp, mouse
ggccatggcgaggcgaagaa

SEQ ID NO: 420147 - DNA, 20 bp, mouse
gaacgcgtcacgaccccggg

SEQ ID NO: 420148 - DNA, 20 bp, mouse
gccggccgccccgccagcca

SEQ ID NO: 420149 - DNA, 20 bp, mouse
gcgtgacgcgttgaagcccg

SEQ ID NO: 420150 - DNA, 20 bp, mouse
gtcacgaccccgggcgggga

SEQ ID NO: 420151 - DNA, 20 bp, mouse
ggagcctccataaaagggag

SEQ ID NO: 420152 - DNA, 20 bp, mouse
ggatcgaaccctccccgccc

SEQ ID NO: 420153 - DNA, 20 bp, mouse
gttcaacgcgtcacgacccc

SEQ ID NO: 420154 - DNA, 20 bp, mouse
ggcggggagggttcgatccg

SEQ ID NO: 420155 - DNA, 20 bp, mouse
gcgtagccgcggaccggaca

SEQ ID NO: 420156 - DNA, 20 bp, mouse
ggagcgcgggcaccgcggag

SEQ ID NO: 420157 - DNA, 20 bp, mouse
ggcggggctggatctccggt

SEQ ID NO: 420158 - DNA, 20 bp, mouse
gcgcagtccgaggtgagccc

SEQ ID NO: 420159 - DNA, 20 bp, mouse
ggaaccgcagacgcaccagg

SEQ ID NO: 420160 - DNA, 20 bp, mouse
gcagacgcaccaggaggcgt

SEQ ID NO: 420161 - DNA, 20 bp, mouse
gagctcggtgtagagtacgc

SEQ ID NO: 420162 - DNA, 20 bp, mouse
gttttggagactgcgccggg

SEQ ID NO: 420163 - DNA, 20 bp, mouse
gccgagcgaccggtcccgga

SEQ ID NO: 420164 - DNA, 20 bp, mouse
ggtacgcggggctggatctc

SEQ ID NO: 420165 - DNA, 20 bp, mouse
gagtccgaggtgagccccgg

SEQ ID NO: 420166 - DNA, 20 bp, mouse
gggcagtttcagctctataa

SEQ ID NO: 420167 - DNA, 20 bp, mouse
gctgccgcaaggaacccgga

SEQ ID NO: 420168 - DNA, 20 bp, mouse
gagagaaggcgggaccttcc

SEQ ID NO: 420169 - DNA, 20 bp, mouse
gtgtgtagcagaagttggta

SEQ ID NO: 420170 - DNA, 20 bp, mouse
ggctctataacggaccctgc

SEQ ID NO: 420171 - DNA, 20 bp, mouse
gggaccttccgggttccttg

SEQ ID NO: 420172 - DNA, 20 bp, mouse
ggcagttgtgtagcagaagt

SEQ ID NO: 420173 - DNA, 20 bp, mouse
gattccctgaacccagcggt

SEQ ID NO: 420174 - DNA, 20 bp, mouse
ggaaactgccgcaaggaacc

SEQ ID NO: 420175 - DNA, 20 bp, mouse
ggactgacaaatccacccca

SEQ ID NO: 420176 - DNA, 20 bp, mouse
gtactcgcccgaaagctcca

SEQ ID NO: 420177 - DNA, 20 bp, mouse
ggcgcgctgttgaagctgag

SEQ ID NO: 420178 - DNA, 20 bp, mouse
gtgaagctgagtggtcgcca

SEQ ID NO: 420179 - DNA, 20 bp, mouse
gtccgggtggcgtttctccg

SEQ ID NO: 420180 - DNA, 20 bp, mouse
gagctttcgggcgagtacgt

SEQ ID NO: 420181 - DNA, 20 bp, mouse
gaggacactcgtagccgctg

SEQ ID NO: 420182 - DNA, 20 bp, mouse
gcggctacgagtgtcctgtg

SEQ ID NO: 420183 - DNA, 20 bp, mouse
gcgggaccgggcagtgtgaa

SEQ ID NO: 420184 - DNA, 20 bp, mouse
ggagaaacgccacccggaag

SEQ ID NO: 420185 - DNA, 20 bp, mouse
gcaaggcttggcggaagatc

SEQ ID NO: 420186 - DNA, 20 bp, mouse
gcgacctcgcagggcgacgg

SEQ ID NO: 420187 - DNA, 20 bp, mouse
ggcagcggccccggcgacag

SEQ ID NO: 420188 - DNA, 20 bp, mouse
gcggcgacctcgcagggcga

SEQ ID NO: 420189 - DNA, 20 bp, mouse
ggccccggcgacagtggcga

SEQ ID NO: 420190 - DNA, 20 bp, mouse
gtgcccggagcgccgaggag

SEQ ID NO: 420191 - DNA, 20 bp, mouse
gagcgccgaggagaggacga

SEQ ID NO: 420192 - DNA, 20 bp, mouse
gccctggagcacgcaggcaa

SEQ ID NO: 420193 - DNA, 20 bp, mouse
gttggttgtcaagatggctg

SEQ ID NO: 420194 - DNA, 20 bp, mouse
gcgcccgtgacgcgagacct

SEQ ID NO: 420195 - DNA, 20 bp, mouse
gcgtcggttggttgtcaaga

SEQ ID NO: 420196 - DNA, 20 bp, mouse
ggtatctgctccgctgaggg

SEQ ID NO: 420197 - DNA, 20 bp, mouse
gtcctcctttcccccctcag

SEQ ID NO: 420198 - DNA, 20 bp, mouse
gtgctccgctgaggggggaa

SEQ ID NO: 420199 - DNA, 20 bp, mouse
gggccagaggactgaagtgt

SEQ ID NO: 420200 - DNA, 20 bp, mouse
gacacgcctggccggacggg

SEQ ID NO: 420201 - DNA, 20 bp, mouse
gcctgtctgaggaagagggt

SEQ ID NO: 420202 - DNA, 20 bp, mouse
gcaggcctgtctgaggaaga

SEQ ID NO: 420203 - DNA, 20 bp, mouse
gcacttctcgcgagaagtgg

SEQ ID NO: 420204 - DNA, 20 bp, mouse
gcgcccccgtccaacagact

SEQ ID NO: 420205 - DNA, 20 bp, mouse
ggaaagtatctgctccgctg

SEQ ID NO: 420206 - DNA, 20 bp, mouse
gtgtaggccatggtagctcc

SEQ ID NO: 420207 - DNA, 20 bp, mouse
gagcactgcgaagcagtacc

SEQ ID NO: 420208 - DNA, 20 bp, mouse
ggagctgcaagctgttagtt

SEQ ID NO: 420209 - DNA, 20 bp, mouse
ggcagtacccggagctacca

SEQ ID NO: 420210 - DNA, 20 bp, mouse
gtcctgcgggctgtaggcca

SEQ ID NO: 420211 - DNA, 20 bp, mouse
ggccgctggccattcctcca

SEQ ID NO: 420212 - DNA, 20 bp, mouse
gaccatggcctacagcccgc

SEQ ID NO: 420213 - DNA, 20 bp, mouse
gatggactgatactgccaag

SEQ ID NO: 420214 - DNA, 20 bp, mouse
gacagcaccgaagaagtcaa

SEQ ID NO: 420215 - DNA, 20 bp, mouse
gggaattgcccgtgccttgg

SEQ ID NO: 420216 - DNA, 20 bp, mouse
ggaggagcagaacagcggga

SEQ ID NO: 420217 - DNA, 20 bp, mouse
gctggatgaagtgagcctgg

SEQ ID NO: 420218 - DNA, 20 bp, mouse
ggtgcctccaaggcagttgg

SEQ ID NO: 420219 - DNA, 20 bp, mouse
gcaatcaagctggatagaag

SEQ ID NO: 420220 - DNA, 20 bp, mouse
gtcctgagtcaggaagagca

SEQ ID NO: 420221 - DNA, 20 bp, mouse
gtccttgctcttcctgactc

SEQ ID NO: 420222 - DNA, 20 bp, mouse
gaagctggatagaagaggtt

SEQ ID NO: 420223 - DNA, 20 bp, mouse
gctcacttcatccagccagg

SEQ ID NO: 420224 - DNA, 20 bp, mouse
gctggcgtggactggagctg

SEQ ID NO: 420225 - DNA, 20 bp, mouse
gcatggttcttagagaagac

SEQ ID NO: 420226 - DNA, 20 bp, mouse
gcttctgtgcagcacagatc

SEQ ID NO: 420227 - DNA, 20 bp, mouse
gcaagtgacttaccagacac

SEQ ID NO: 420228 - DNA, 20 bp, mouse
gggatgaaatcctggagtgc

SEQ ID NO: 420229 - DNA, 20 bp, mouse
gggaacacatccagcactcc

SEQ ID NO: 420230 - DNA, 20 bp, mouse
ggctacagtgagttctaaga

SEQ ID NO: 420231 - DNA, 20 bp, mouse
gaattctttaaggtaggagg

SEQ ID NO: 420232 - DNA, 20 bp, mouse
gccatcctacaggcccaaga

SEQ ID NO: 420233 - DNA, 20 bp, mouse
gagaagctgaaaattcttta

SEQ ID NO: 420234 - DNA, 20 bp, mouse
gcgctttgttgtaggtggaa

SEQ ID NO: 420235 - DNA, 20 bp, mouse
gcaagcaggttgtacactac

SEQ ID NO: 420236 - DNA, 20 bp, mouse
gaggctgcggcgcacggtat

SEQ ID NO: 420237 - DNA, 20 bp, mouse
gtcactcccgggacagaatg

SEQ ID NO: 420238 - DNA, 20 bp, mouse
gagcccgctgacagacatgg

SEQ ID NO: 420239 - DNA, 20 bp, mouse
gtgtcgggagggcgttgcga

SEQ ID NO: 420240 - DNA, 20 bp, mouse
gagtatctagagtgcctcgg

SEQ ID NO: 420241 - DNA, 20 bp, mouse
ggggacagaatggggacaca

SEQ ID NO: 420242 - DNA, 20 bp, mouse
gcagcctcgcgtggcggggt

SEQ ID NO: 420243 - DNA, 20 bp, mouse
gctgacgggtgcaggaagga

SEQ ID NO: 420244 - DNA, 20 bp, mouse
ggatacttcctggggcccaa

SEQ ID NO: 420245 - DNA, 20 bp, mouse
gcctgggcctcgggtgagga

SEQ ID NO: 420246 - DNA, 20 bp, mouse
gacactgaggagaagtgtgg

SEQ ID NO: 420247 - DNA, 20 bp, mouse
gtggcagggccagcagcagg

SEQ ID NO: 420248 - DNA, 20 bp, mouse
gtcctgtcatggcgagactc

SEQ ID NO: 420249 - DNA, 20 bp, mouse
gatgacactgaggagaagtg

SEQ ID NO: 420250 - DNA, 20 bp, mouse
gaccagcagaaatcctgtca

SEQ ID NO: 420251 - DNA, 20 bp, mouse
ggcccgagtctcgccatgac

SEQ ID NO: 420252 - DNA, 20 bp, mouse
ggacactgcacagggcacca

SEQ ID NO: 420253 - DNA, 20 bp, mouse
gctgtcctccaagaacaagg

SEQ ID NO: 420254 - DNA, 20 bp, mouse
ggccatgacaggatttctgc

SEQ ID NO: 420255 - DNA, 20 bp, mouse
gcaccatccaggttgattgt

SEQ ID NO: 420256 - DNA, 20 bp, mouse
ggtaccggccgggaaccccg

SEQ ID NO: 420257 - DNA, 20 bp, mouse
ggtcggggtgagctccacca

SEQ ID NO: 420258 - DNA, 20 bp, mouse
gtgggaccgaggtgctgtta

SEQ ID NO: 420259 - DNA, 20 bp, mouse
gagactgagctccctgcggg

SEQ ID NO: 420260 - DNA, 20 bp, mouse
gcctgcgggtggtgggaccg

SEQ ID NO: 420261 - DNA, 20 bp, mouse
ggaccgaggtgctgttatgg

SEQ ID NO: 420262 - DNA, 20 bp, mouse
gttcccggccggtacgaaag

SEQ ID NO: 420263 - DNA, 20 bp, mouse
gagtggtacgggaaatctgg

SEQ ID NO: 420264 - DNA, 20 bp, mouse
gaccagagccaggccgccgg

SEQ ID NO: 420265 - DNA, 20 bp, mouse
gtgagctccctgcgggtggt

SEQ ID NO: 420266 - DNA, 20 bp, mouse
ggggtagtgaccacatacag

SEQ ID NO: 420267 - DNA, 20 bp, mouse
gtagtgaccacatacagtgg

SEQ ID NO: 420268 - DNA, 20 bp, mouse
gcactacccagcatcctcgc

SEQ ID NO: 420269 - DNA, 20 bp, mouse
gggccgaggtggtccctcgg

SEQ ID NO: 420270 - DNA, 20 bp, mouse
gggcttcctgagagccagcg

SEQ ID NO: 420271 - DNA, 20 bp, mouse
gggtcaggccgagctctctc

SEQ ID NO: 420272 - DNA, 20 bp, mouse
gagcctcgaagccgaaatgg

SEQ ID NO: 420273 - DNA, 20 bp, mouse
gatacagtggaggagcgcag

SEQ ID NO: 420274 - DNA, 20 bp, mouse
gatgtcggtccaacagcgtc

SEQ ID NO: 420275 - DNA, 20 bp, mouse
gtgggccaccgccaccctca

SEQ ID NO: 420276 - DNA, 20 bp, mouse
gaggtccaggggaatcccga

SEQ ID NO: 420277 - DNA, 20 bp, mouse
gccgagggtaggccatccct

SEQ ID NO: 420278 - DNA, 20 bp, mouse
gggcagcagcggcaggacca

SEQ ID NO: 420279 - DNA, 20 bp, mouse
gtgggggagggagatagtta

SEQ ID NO: 420280 - DNA, 20 bp, mouse
gggccatggttgggatgtgg

SEQ ID NO: 420281 - DNA, 20 bp, mouse
ggttgctctcaaaggtccag

SEQ ID NO: 420282 - DNA, 20 bp, mouse
gcctaccctcgggattcccc

SEQ ID NO: 420283 - DNA, 20 bp, mouse
gatccctgggaagttgtgat

SEQ ID NO: 420284 - DNA, 20 bp, mouse
ggaccaccacatcccaacca

SEQ ID NO: 420285 - DNA, 20 bp, mouse
gtgcccatcacaacttccca

SEQ ID NO: 420286 - DNA, 20 bp, mouse
gccgcggtcgctgtccaggg

SEQ ID NO: 420287 - DNA, 20 bp, mouse
gaagagggagctgtccgggt

SEQ ID NO: 420288 - DNA, 20 bp, mouse
gaggcaagagggagctgtcc

SEQ ID NO: 420289 - DNA, 20 bp, mouse
gcggccgcggtcgctgtcca

SEQ ID NO: 420290 - DNA, 20 bp, mouse
gcttctctcccctcacgcag

SEQ ID NO: 420291 - DNA, 20 bp, mouse
gccgccccggccacctaccg

SEQ ID NO: 420292 - DNA, 20 bp, mouse
gatatgggcagaccaggctg

SEQ ID NO: 420293 - DNA, 20 bp, mouse
gtgtggccctgagccccggt

SEQ ID NO: 420294 - DNA, 20 bp, mouse
gcagccgcgagcccaaaagt

SEQ ID NO: 420295 - DNA, 20 bp, mouse
gactcgggacgaggctgcag

SEQ ID NO: 420296 - DNA, 20 bp, mouse
gtcactgcgcccaacatgga

SEQ ID NO: 420297 - DNA, 20 bp, mouse
gagggtcactgcgcccaaca

SEQ ID NO: 420298 - DNA, 20 bp, mouse
gagactcctccatccatgtt

SEQ ID NO: 420299 - DNA, 20 bp, mouse
gacctgcgggaccacaactc

SEQ ID NO: 420300 - DNA, 20 bp, mouse
gggagacctaagtcaatgag

SEQ ID NO: 420301 - DNA, 20 bp, mouse
gctcggggtgcgggaactgg

SEQ ID NO: 420302 - DNA, 20 bp, mouse
gggcgggcacttccggtgtg

SEQ ID NO: 420303 - DNA, 20 bp, mouse
ggaggtccgaatccgcgcca

SEQ ID NO: 420304 - DNA, 20 bp, mouse
ggcgctgtcattgtcaaggg

SEQ ID NO: 420305 - DNA, 20 bp, mouse
ggcggggaggagcagatccg

SEQ ID NO: 420306 - DNA, 20 bp, mouse
ggccccggtgcgcaccgcgt

SEQ ID NO: 420307 - DNA, 20 bp, mouse
ggtccaggtccagctagcga

SEQ ID NO: 420308 - DNA, 20 bp, mouse
ggcccacgcggtgcgcaccg

SEQ ID NO: 420309 - DNA, 20 bp, mouse
gcctgcgacaccgaacccgg

SEQ ID NO: 420310 - DNA, 20 bp, mouse
gaggtacagcgtggaaagcc

SEQ ID NO: 420311 - DNA, 20 bp, mouse
gcggggcgccaggtacagcg

SEQ ID NO: 420312 - DNA, 20 bp, mouse
ggcgcctgcgacaccgaacc

SEQ ID NO: 420313 - DNA, 20 bp, mouse
gtcgcaggcgctcgcccacg

SEQ ID NO: 420314 - DNA, 20 bp, mouse
ggcgcccgcggtcgcagtga

SEQ ID NO: 420315 - DNA, 20 bp, mouse
ggagggctgagacgctcgcc

SEQ ID NO: 420316 - DNA, 20 bp, mouse
gagaggagacagcactaggt

SEQ ID NO: 420317 - DNA, 20 bp, mouse
gctgggatgaggccttccat

SEQ ID NO: 420318 - DNA, 20 bp, mouse
gtgtaaggggaaatctatag

SEQ ID NO: 420319 - DNA, 20 bp, mouse
gagtacctcttgatctgtaa

SEQ ID NO: 420320 - DNA, 20 bp, mouse
ggggagacatcttgcagctc

SEQ ID NO: 420321 - DNA, 20 bp, mouse
gtagtgggtaagaaggccca

SEQ ID NO: 420322 - DNA, 20 bp, mouse
gggcttagaattgagttctg

SEQ ID NO: 420323 - DNA, 20 bp, mouse
ggggtaagaaggcccatgga

SEQ ID NO: 420324 - DNA, 20 bp, mouse
gcactaggtaggcatatgaa

SEQ ID NO: 420325 - DNA, 20 bp, mouse
gggaagatatagttcttgtg

SEQ ID NO: 420326 - DNA, 20 bp, mouse
gcggcaggagctgaggtgat

SEQ ID NO: 420327 - DNA, 20 bp, mouse
gtgaggtgatgggtccttcc

SEQ ID NO: 420328 - DNA, 20 bp, mouse
gggtccttcccggtgcggga

SEQ ID NO: 420329 - DNA, 20 bp, mouse
gtgatgggtccttcccggtg

SEQ ID NO: 420330 - DNA, 20 bp, mouse
ggactggcaggtccacctca

SEQ ID NO: 420331 - DNA, 20 bp, mouse
gaacgcgagtacctccctga

SEQ ID NO: 420332 - DNA, 20 bp, mouse
gctgcacaccctaaccctca

SEQ ID NO: 420333 - DNA, 20 bp, mouse
gtttccatcccgcaccggga

SEQ ID NO: 420334 - DNA, 20 bp, mouse
gcacaccctaaccctcaggg

SEQ ID NO: 420335 - DNA, 20 bp, mouse
gagtacctccctgagggtta

SEQ ID NO: 420336 - DNA, 20 bp, mouse
ggtgcttagaggccagagta

SEQ ID NO: 420337 - DNA, 20 bp, mouse
gcaccatgcgcacatggcga

SEQ ID NO: 420338 - DNA, 20 bp, mouse
gtaatgccagaggcgggact

SEQ ID NO: 420339 - DNA, 20 bp, mouse
ggccagacaccatgcgcaca

SEQ ID NO: 420340 - DNA, 20 bp, mouse
gccgggtctcggggcaggaa

SEQ ID NO: 420341 - DNA, 20 bp, mouse
gcagctggcctagtgcttag

SEQ ID NO: 420342 - DNA, 20 bp, mouse
gcggaaccacgtaatgccag

SEQ ID NO: 420343 - DNA, 20 bp, mouse
gagaggcgggactcggcagg

SEQ ID NO: 420344 - DNA, 20 bp, mouse
gctcaccttgttctgctgag

SEQ ID NO: 420345 - DNA, 20 bp, mouse
ggtgaggatccggggaccaa

SEQ ID NO: 420346 - DNA, 20 bp, mouse
ggcggccgcggtgtccggtg

SEQ ID NO: 420347 - DNA, 20 bp, mouse
gcgcggtgtccggtgtggtg

SEQ ID NO: 420348 - DNA, 20 bp, mouse
gtccacccgcctcaccacac

SEQ ID NO: 420349 - DNA, 20 bp, mouse
ggtggtcacgtggacagggc

SEQ ID NO: 420350 - DNA, 20 bp, mouse
gtccggtgtggtgaggcggg

SEQ ID NO: 420351 - DNA, 20 bp, mouse
gaggcgggtggaagagctcg

SEQ ID NO: 420352 - DNA, 20 bp, mouse
gggcgcgcccgagctggcca

SEQ ID NO: 420353 - DNA, 20 bp, mouse
ggtgtccggtgtggtgaggc

SEQ ID NO: 420354 - DNA, 20 bp, mouse
gcaggccgtcaggtgatctg

SEQ ID NO: 420355 - DNA, 20 bp, mouse
gtcacgtggtcacgtggaca

SEQ ID NO: 420356 - DNA, 20 bp, mouse
ggctccggtgtggaccctca

SEQ ID NO: 420357 - DNA, 20 bp, mouse
gggtggacgtggaagaccga

SEQ ID NO: 420358 - DNA, 20 bp, mouse
ggagcaggagactcacccaa

SEQ ID NO: 420359 - DNA, 20 bp, mouse
gtccacaccggagctgatcc

SEQ ID NO: 420360 - DNA, 20 bp, mouse
gagtcacccgggatcagctc

SEQ ID NO: 420361 - DNA, 20 bp, mouse
ggcttctcagtgagtcaccc

SEQ ID NO: 420362 - DNA, 20 bp, mouse
gttgttgctggtggtggacg

SEQ ID NO: 420363 - DNA, 20 bp, mouse
ggccactgcaggaggttgag

SEQ ID NO: 420364 - DNA, 20 bp, mouse
gcccgggatcagctccggtg

SEQ ID NO: 420365 - DNA, 20 bp, mouse
gtatatgagaaagggtggag

SEQ ID NO: 420366 - DNA, 20 bp, mouse
gcagtcgcggctccagaacg

SEQ ID NO: 420367 - DNA, 20 bp, mouse
gacgcggagcccggcaggaa

SEQ ID NO: 420368 - DNA, 20 bp, mouse
gggctccacgcctccagtgg

SEQ ID NO: 420369 - DNA, 20 bp, mouse
gccagaacgcggagcccggc

SEQ ID NO: 420370 - DNA, 20 bp, mouse
gggggcaaaggatacagtcg

SEQ ID NO: 420371 - DNA, 20 bp, mouse
ggcgcggcgccccctagcag

SEQ ID NO: 420372 - DNA, 20 bp, mouse
gcagaaccccgggctaagga

SEQ ID NO: 420373 - DNA, 20 bp, mouse
gttgaaacaaccgccactgg

SEQ ID NO: 420374 - DNA, 20 bp, mouse
gacacgtcgtcgccaggtga

SEQ ID NO: 420375 - DNA, 20 bp, mouse
gggcggttgtttcaagatgg

SEQ ID NO: 420376 - DNA, 20 bp, mouse
gtgttgggatcgtcagtgtg

SEQ ID NO: 420377 - DNA, 20 bp, mouse
gtgccagtcaatgaatgatt

SEQ ID NO: 420378 - DNA, 20 bp, mouse
gtctagagataggatggagg

SEQ ID NO: 420379 - DNA, 20 bp, mouse
gcactctagagataggatgg

SEQ ID NO: 420380 - DNA, 20 bp, mouse
gagacttggaaagtcaagga

SEQ ID NO: 420381 - DNA, 20 bp, mouse
gagggcttgggattcctgga

SEQ ID NO: 420382 - DNA, 20 bp, mouse
gactgagcatggcttccata

SEQ ID NO: 420383 - DNA, 20 bp, mouse
gactgtgctatgaggacaag

SEQ ID NO: 420384 - DNA, 20 bp, mouse
gaagctgattgaatccggat

SEQ ID NO: 420385 - DNA, 20 bp, mouse
gactgacgatcccaacatca

SEQ ID NO: 420386 - DNA, 20 bp, mouse
gaaggactgagcctcaccag

SEQ ID NO: 420387 - DNA, 20 bp, mouse
ggcttctgcacagtccacgt

SEQ ID NO: 420388 - DNA, 20 bp, mouse
gtcgactccgcggcccctaa

SEQ ID NO: 420389 - DNA, 20 bp, mouse
ggacagacacctcgactccg

SEQ ID NO: 420390 - DNA, 20 bp, mouse
ggaggtgtctgtctcccggg

SEQ ID NO: 420391 - DNA, 20 bp, mouse
ggtgaggctcagtcctttag

SEQ ID NO: 420392 - DNA, 20 bp, mouse
ggagggaagcgtctataccg

SEQ ID NO: 420393 - DNA, 20 bp, mouse
ggtattagaggaggactgga

SEQ ID NO: 420394 - DNA, 20 bp, mouse
gcgtgcgcaggactgcgagg

SEQ ID NO: 420395 - DNA, 20 bp, mouse
gacgcagatggcccccgccc

SEQ ID NO: 420396 - DNA, 20 bp, mouse
gacttttggggaaacattgt

SEQ ID NO: 420397 - DNA, 20 bp, mouse
gatgaatgagccctaagacc

SEQ ID NO: 420398 - DNA, 20 bp, mouse
gttcacaggactgggtaagt

SEQ ID NO: 420399 - DNA, 20 bp, mouse
gatagtcactttgatgtgag

SEQ ID NO: 420400 - DNA, 20 bp, mouse
gtcttttcatcctggtctta

SEQ ID NO: 420401 - DNA, 20 bp, mouse
gggactgggtaagttggctt

SEQ ID NO: 420402 - DNA, 20 bp, mouse
gaataagagttcatgacttt

SEQ ID NO: 420403 - DNA, 20 bp, mouse
gtattctctgatcagatgag

SEQ ID NO: 420404 - DNA, 20 bp, mouse
ggtcctgtgaaaatgtgttg

SEQ ID NO: 420405 - DNA, 20 bp, mouse
gaccctcaacacattttcac

SEQ ID NO: 420406 - DNA, 20 bp, mouse
ggtaccccctcggaagaatg

SEQ ID NO: 420407 - DNA, 20 bp, mouse
gtagctgacatgactctggg

SEQ ID NO: 420408 - DNA, 20 bp, mouse
ggtaccccattcttccgagg

SEQ ID NO: 420409 - DNA, 20 bp, mouse
gatatagcgtgcaggctcac

SEQ ID NO: 420410 - DNA, 20 bp, mouse
gggagtaccccattcttccg

SEQ ID NO: 420411 - DNA, 20 bp, mouse
ggtgagtcatctggaacccg

SEQ ID NO: 420412 - DNA, 20 bp, mouse
gattctttgttggaaagcgg

SEQ ID NO: 420413 - DNA, 20 bp, mouse
ggccttggatctgcatggtt

SEQ ID NO: 420414 - DNA, 20 bp, mouse
gacctaaccatgcagatcca

SEQ ID NO: 420415 - DNA, 20 bp, mouse
gtgacatgactctgggaggg

SEQ ID NO: 420416 - DNA, 20 bp, mouse
gaggagacaccaagcacact

SEQ ID NO: 420417 - DNA, 20 bp, mouse
ggaatcagcctggacataga

SEQ ID NO: 420418 - DNA, 20 bp, mouse
gctgctggccttctatgtcc

SEQ ID NO: 420419 - DNA, 20 bp, mouse
ggtctcttcatcagtctctt

SEQ ID NO: 420420 - DNA, 20 bp, mouse
gactgagagaaggcattcat

SEQ ID NO: 420421 - DNA, 20 bp, mouse
gtgctcttgacagaatacca

SEQ ID NO: 420422 - DNA, 20 bp, mouse
gcaacctccacactgagaga

SEQ ID NO: 420423 - DNA, 20 bp, mouse
gagagaaggcattcattggt

SEQ ID NO: 420424 - DNA, 20 bp, mouse
gaagttcttagaggatcaag

SEQ ID NO: 420425 - DNA, 20 bp, mouse
gctcttgggtagaatcagcc

SEQ ID NO: 420426 - DNA, 20 bp, mouse
ggagagcgtctggaatcgac

SEQ ID NO: 420427 - DNA, 20 bp, mouse
gggcggggggaacaacccca

SEQ ID NO: 420428 - DNA, 20 bp, mouse
gttccagacgctctccggac

SEQ ID NO: 420429 - DNA, 20 bp, mouse
gtggcaagatgtgctccctg

SEQ ID NO: 420430 - DNA, 20 bp, mouse
gtgacttgacctctaggcgg

SEQ ID NO: 420431 - DNA, 20 bp, mouse
gtgccagtccggagagcgtc

SEQ ID NO: 420432 - DNA, 20 bp, mouse
ggaatcgacaggctcccggc

SEQ ID NO: 420433 - DNA, 20 bp, mouse
gacctctaggcggcggcggg

SEQ ID NO: 420434 - DNA, 20 bp, mouse
gtctggaatcgacaggctcc

SEQ ID NO: 420435 - DNA, 20 bp, mouse
gctagagaagacctgatgga

SEQ ID NO: 420436 - DNA, 20 bp, mouse
gaaggcgtggagcggatcag

SEQ ID NO: 420437 - DNA, 20 bp, mouse
ggtctcgcgctgtggttcgt

SEQ ID NO: 420438 - DNA, 20 bp, mouse
gaggccgcaggcggtaccca

SEQ ID NO: 420439 - DNA, 20 bp, mouse
ggctgagagcggagagcgca

SEQ ID NO: 420440 - DNA, 20 bp, mouse
gctggcgcttggtgagtacg

SEQ ID NO: 420441 - DNA, 20 bp, mouse
gaccaggccggatgtcccac

SEQ ID NO: 420442 - DNA, 20 bp, mouse
gcagatggaccgcttccggg

SEQ ID NO: 420443 - DNA, 20 bp, mouse
gacccacggccgcccggaag

SEQ ID NO: 420444 - DNA, 20 bp, mouse
gagccgcgccagcttggaca

SEQ ID NO: 420445 - DNA, 20 bp, mouse
gcggccgtgggtaccgcctg

SEQ ID NO: 420446 - DNA, 20 bp, mouse
ggaaagagcagaaggaaaca

SEQ ID NO: 420447 - DNA, 20 bp, mouse
ggagccttggaaggtagtat

SEQ ID NO: 420448 - DNA, 20 bp, mouse
gcttcaatagcatctggaag

SEQ ID NO: 420449 - DNA, 20 bp, mouse
gctggaatcagatctagaga

SEQ ID NO: 420450 - DNA, 20 bp, mouse
gcagtcagcaaccagacaga

SEQ ID NO: 420451 - DNA, 20 bp, mouse
gtttcccatactaccttcca

SEQ ID NO: 420452 - DNA, 20 bp, mouse
gttgcagtactgccaagtga

SEQ ID NO: 420453 - DNA, 20 bp, mouse
gtattcagcattcataaggt

SEQ ID NO: 420454 - DNA, 20 bp, mouse
gaagttattcagcattcata

SEQ ID NO: 420455 - DNA, 20 bp, mouse
gagatgctattgaagagcct

SEQ ID NO: 420456 - DNA, 20 bp, mouse
gcacagaatgagtacagact

SEQ ID NO: 420457 - DNA, 20 bp, mouse
gacagactgggaaccgtctc

SEQ ID NO: 420458 - DNA, 20 bp, mouse
gtatattcttcttaccataa

SEQ ID NO: 420459 - DNA, 20 bp, mouse
gtagttgtatttacctgaga

SEQ ID NO: 420460 - DNA, 20 bp, mouse
gtctgcactgggaagagttt

SEQ ID NO: 420461 - DNA, 20 bp, mouse
ggaagagtttaggatactat

SEQ ID NO: 420462 - DNA, 20 bp, mouse
gaagaatcagattcccattg

SEQ ID NO: 420463 - DNA, 20 bp, mouse
ggctaaaacttgttccctta

SEQ ID NO: 420464 - DNA, 20 bp, mouse
gaatacaactattccacaat

SEQ ID NO: 420465 - DNA, 20 bp, mouse
gtcaagttctaagaaaacac

SEQ ID NO: 420466 - DNA, 20 bp, mouse
ggaacctacaaggagtgtca

SEQ ID NO: 420467 - DNA, 20 bp, mouse
gctctgaggtagaggcatca

SEQ ID NO: 420468 - DNA, 20 bp, mouse
gggcagatacagatgatact

SEQ ID NO: 420469 - DNA, 20 bp, mouse
gcttcgtcttccatggcctg

SEQ ID NO: 420470 - DNA, 20 bp, mouse
gtcctaacttcaggcaaagg

SEQ ID NO: 420471 - DNA, 20 bp, mouse
gcacagcaactgaacctaca

SEQ ID NO: 420472 - DNA, 20 bp, mouse
ggaggattcgaagcctccag

SEQ ID NO: 420473 - DNA, 20 bp, mouse
gtgatctgcttcgtcttcca

SEQ ID NO: 420474 - DNA, 20 bp, mouse
gaggcatcactcacccctgg

SEQ ID NO: 420475 - DNA, 20 bp, mouse
gtgaaggcatcactcacccc

SEQ ID NO: 420476 - DNA, 20 bp, mouse
ggattgggtggcactacaca

SEQ ID NO: 420477 - DNA, 20 bp, mouse
ggacacctaccgcagccggt

SEQ ID NO: 420478 - DNA, 20 bp, mouse
gagcggtgagcgccaaaaca

SEQ ID NO: 420479 - DNA, 20 bp, mouse
gacagtgcatcccgagtgac

SEQ ID NO: 420480 - DNA, 20 bp, mouse
ggaatgggcacaaaccctag

SEQ ID NO: 420481 - DNA, 20 bp, mouse
gcactcttgcagagcaggga

SEQ ID NO: 420482 - DNA, 20 bp, mouse
gtctgcctgcctaccggctg

SEQ ID NO: 420483 - DNA, 20 bp, mouse
gtcttagcggaagctctgca

SEQ ID NO: 420484 - DNA, 20 bp, mouse
gagccaaagggccaagcatg

SEQ ID NO: 420485 - DNA, 20 bp, mouse
gggccaggctcgttgcagtg

SEQ ID NO: 420486 - DNA, 20 bp, mouse
gcggtgacgcggcaggtcag

SEQ ID NO: 420487 - DNA, 20 bp, mouse
gggtcggtggctgacctgag

SEQ ID NO: 420488 - DNA, 20 bp, mouse
ggatctgggcggccaacgag

SEQ ID NO: 420489 - DNA, 20 bp, mouse
ggcgcggccatcgcggagga

SEQ ID NO: 420490 - DNA, 20 bp, mouse
ggatggccgcgccggtgacg

SEQ ID NO: 420491 - DNA, 20 bp, mouse
gcggtcgccctcctccgcga

SEQ ID NO: 420492 - DNA, 20 bp, mouse
ggtgagggtgagcacgggta

SEQ ID NO: 420493 - DNA, 20 bp, mouse
gcggaggagggcgaccgctc

SEQ ID NO: 420494 - DNA, 20 bp, mouse
gccgccgcggcccaggatct

SEQ ID NO: 420495 - DNA, 20 bp, mouse
ggtcagccaccgaccgcggg

SEQ ID NO: 420496 - DNA, 20 bp, mouse
gaccagcgcgcagggtacac

SEQ ID NO: 420497 - DNA, 20 bp, mouse
gcggtccccggtgaaggtgg

SEQ ID NO: 420498 - DNA, 20 bp, mouse
gagccggtccccggtgaagg

SEQ ID NO: 420499 - DNA, 20 bp, mouse
ggcagtggtacggcccaagg

SEQ ID NO: 420500 - DNA, 20 bp, mouse
gcgcctggcgccgagacctg

SEQ ID NO: 420501 - DNA, 20 bp, mouse
gaccagccggtccccggtga

SEQ ID NO: 420502 - DNA, 20 bp, mouse
gcccaaggcggaagcagcgc

SEQ ID NO: 420503 - DNA, 20 bp, mouse
gacccgctctgccgcagcga

SEQ ID NO: 420504 - DNA, 20 bp, mouse
ggctgctccgccaccttcac

SEQ ID NO: 420505 - DNA, 20 bp, mouse
gagctggtaaccagcgcgca

SEQ ID NO: 420506 - DNA, 20 bp, mouse
ggcctgcgacacgaaggagg

SEQ ID NO: 420507 - DNA, 20 bp, mouse
gcgaagcggccccggctctg

SEQ ID NO: 420508 - DNA, 20 bp, mouse
gccgccggcctgcgacacga

SEQ ID NO: 420509 - DNA, 20 bp, mouse
gcagccccgcgacatggcca

SEQ ID NO: 420510 - DNA, 20 bp, mouse
gcccactagcggccgctcgg

SEQ ID NO: 420511 - DNA, 20 bp, mouse
gcggcgctgccgcagagccg

SEQ ID NO: 420512 - DNA, 20 bp, mouse
gagcacaggccgtcatccag

SEQ ID NO: 420513 - DNA, 20 bp, mouse
ggcctaactgccgggtccta

SEQ ID NO: 420514 - DNA, 20 bp, mouse
ggcgggcgccgaagcggccc

SEQ ID NO: 420515 - DNA, 20 bp, mouse
gcgggtcctagggaaagcac

SEQ ID NO: 420516 - DNA, 20 bp, mouse
gctcggctagctgcagggaa

SEQ ID NO: 420517 - DNA, 20 bp, mouse
gggtgaagcacggatccgac

SEQ ID NO: 420518 - DNA, 20 bp, mouse
gcctggtggctgaaccgctg

SEQ ID NO: 420519 - DNA, 20 bp, mouse
ggcagtagcgaccccgaagt

SEQ ID NO: 420520 - DNA, 20 bp, mouse
gagtccctcggctagctgca

SEQ ID NO: 420521 - DNA, 20 bp, mouse
ggaagcacggatccgactgg

SEQ ID NO: 420522 - DNA, 20 bp, mouse
gtgcagggaaaggtgaagca

SEQ ID NO: 420523 - DNA, 20 bp, mouse
gtcgcggttgttcctccagt

SEQ ID NO: 420524 - DNA, 20 bp, mouse
ggaggagagaggttaggaga

SEQ ID NO: 420525 - DNA, 20 bp, mouse
ggcaaaagagaatggcaggg

SEQ ID NO: 420526 - DNA, 20 bp, mouse
ggtcgcgcagagctgactct

SEQ ID NO: 420527 - DNA, 20 bp, mouse
gcgccgcatggagtccgaat

SEQ ID NO: 420528 - DNA, 20 bp, mouse
gtccagaggcggggtgtcag

SEQ ID NO: 420529 - DNA, 20 bp, mouse
gctccgattcggactccatg

SEQ ID NO: 420530 - DNA, 20 bp, mouse
ggccgctccgctctccgatt

SEQ ID NO: 420531 - DNA, 20 bp, mouse
gtcggtaggaacgaccggta

SEQ ID NO: 420532 - DNA, 20 bp, mouse
gctgggggcggagtcatgta

SEQ ID NO: 420533 - DNA, 20 bp, mouse
gtggagtccgaatcggagag

SEQ ID NO: 420534 - DNA, 20 bp, mouse
gaacgaccggtagggaaggg

SEQ ID NO: 420535 - DNA, 20 bp, mouse
gcccgggaggaagtaggcgt

SEQ ID NO: 420536 - DNA, 20 bp, mouse
ggagtgcaggtgttgtcctg

SEQ ID NO: 420537 - DNA, 20 bp, mouse
gtgtcctgggggctgtcact

SEQ ID NO: 420538 - DNA, 20 bp, mouse
ggcacccagtgacagccccc

SEQ ID NO: 420539 - DNA, 20 bp, mouse
gacttaccagaactttaaga

SEQ ID NO: 420540 - DNA, 20 bp, mouse
ggaactttaagaaggagtgc

SEQ ID NO: 420541 - DNA, 20 bp, mouse
gtaagtgggccccccatccc

SEQ ID NO: 420542 - DNA, 20 bp, mouse
gtacatagagccagggatgg

SEQ ID NO: 420543 - DNA, 20 bp, mouse
ggctgagactcctgactgca

SEQ ID NO: 420544 - DNA, 20 bp, mouse
gatatacatagagccaggga

SEQ ID NO: 420545 - DNA, 20 bp, mouse
gatcctaggaccagagacac

SEQ ID NO: 420546 - DNA, 20 bp, mouse
gaccggagcttgaggtgcta

SEQ ID NO: 420547 - DNA, 20 bp, mouse
gaggccgaaaggcgcaccga

SEQ ID NO: 420548 - DNA, 20 bp, mouse
gccacacacaaggaaaccgg

SEQ ID NO: 420549 - DNA, 20 bp, mouse
gaaggaaaccggaggccgaa

SEQ ID NO: 420550 - DNA, 20 bp, mouse
gaccgtggtcagggtctctg

SEQ ID NO: 420551 - DNA, 20 bp, mouse
gggtggcccgaccacacaca

SEQ ID NO: 420552 - DNA, 20 bp, mouse
gcgaccacacacaaggaaac

SEQ ID NO: 420553 - DNA, 20 bp, mouse
gaccgtagcacctcaagctc

SEQ ID NO: 420554 - DNA, 20 bp, mouse
gtccgcggaaccggagcttg

SEQ ID NO: 420555 - DNA, 20 bp, mouse
gtctgagacaagaagcgagg

SEQ ID NO: 420556 - DNA, 20 bp, mouse
gctctacggagtctctggaa

SEQ ID NO: 420557 - DNA, 20 bp, mouse
gggatgtcccggggactcta

SEQ ID NO: 420558 - DNA, 20 bp, mouse
gtgcagaaaaggaccacgat

SEQ ID NO: 420559 - DNA, 20 bp, mouse
ggcagacagaggatgtcccg

SEQ ID NO: 420560 - DNA, 20 bp, mouse
gtagtcacccaagcccatcg

SEQ ID NO: 420561 - DNA, 20 bp, mouse
gaaaggaccacgatgggctt

SEQ ID NO: 420562 - DNA, 20 bp, mouse
ggaagtgccagagcacgtcc

SEQ ID NO: 420563 - DNA, 20 bp, mouse
gagagactccgtagagtccc

SEQ ID NO: 420564 - DNA, 20 bp, mouse
gtgcaccgggtggaagactg

SEQ ID NO: 420565 - DNA, 20 bp, mouse
gaggcatgcggtgcaccggg

SEQ ID NO: 420566 - DNA, 20 bp, mouse
gggtaactgccggcgagtgg

SEQ ID NO: 420567 - DNA, 20 bp, mouse
gggagcccaccgccactcgc

SEQ ID NO: 420568 - DNA, 20 bp, mouse
gtgagggagcaggtaactgc

SEQ ID NO: 420569 - DNA, 20 bp, mouse
ggcttcttgtgcgcatctga

SEQ ID NO: 420570 - DNA, 20 bp, mouse
ggctctggcaccggttgtgg

SEQ ID NO: 420571 - DNA, 20 bp, mouse
gctgattggatggtgaggta

SEQ ID NO: 420572 - DNA, 20 bp, mouse
gctccgggcaaggaaggacc

SEQ ID NO: 420573 - DNA, 20 bp, mouse
gactgccggcgagtggcggt

SEQ ID NO: 420574 - DNA, 20 bp, mouse
gtggcggtgggctccgggca

SEQ ID NO: 420575 - DNA, 20 bp, mouse
ggcaggtaactgccggcgag

SEQ ID NO: 420576 - DNA, 20 bp, mouse
gcatgggcacgacctcccaa

SEQ ID NO: 420577 - DNA, 20 bp, mouse
gtgccgcagccggtaagctg

SEQ ID NO: 420578 - DNA, 20 bp, mouse
ggctgcggcgagccattggg

SEQ ID NO: 420579 - DNA, 20 bp, mouse
gttgcccggagctaagatgg

SEQ ID NO: 420580 - DNA, 20 bp, mouse
gccgttgcccggagctaaga

SEQ ID NO: 420581 - DNA, 20 bp, mouse
gcgccgcagcttaccggctg

SEQ ID NO: 420582 - DNA, 20 bp, mouse
ggaccgggctcggttgagaa

SEQ ID NO: 420583 - DNA, 20 bp, mouse
gtaagctgcggcgagccatt

SEQ ID NO: 420584 - DNA, 20 bp, mouse
ggctaagatggcggtggcgt

SEQ ID NO: 420585 - DNA, 20 bp, mouse
ggcaggcatgaaccaggtag

SEQ ID NO: 420586 - DNA, 20 bp, mouse
gagggtcctgagaccgaggg

SEQ ID NO: 420587 - DNA, 20 bp, mouse
gcagcgcgacagctacgcac

SEQ ID NO: 420588 - DNA, 20 bp, mouse
gacgggaggtgcggaccggt

SEQ ID NO: 420589 - DNA, 20 bp, mouse
gcgcgacagctacgcacggg

SEQ ID NO: 420590 - DNA, 20 bp, mouse
gccggcctaggagaccgcga

SEQ ID NO: 420591 - DNA, 20 bp, mouse
gcagctacgcacgggaggtg

SEQ ID NO: 420592 - DNA, 20 bp, mouse
gacgcacgggaggtgcggac

SEQ ID NO: 420593 - DNA, 20 bp, mouse
gtctcaggaccctcgcccac

SEQ ID NO: 420594 - DNA, 20 bp, mouse
ggtagctgtcgcgctgacac

SEQ ID NO: 420595 - DNA, 20 bp, mouse
gggactacaggagaccacgg

SEQ ID NO: 420596 - DNA, 20 bp, mouse
gagctggagtcaccatggaa

SEQ ID NO: 420597 - DNA, 20 bp, mouse
gtgtaggacctgtatgatgg

SEQ ID NO: 420598 - DNA, 20 bp, mouse
gggggcagctggagtcacca

SEQ ID NO: 420599 - DNA, 20 bp, mouse
gatatgtaggacctgtatga

SEQ ID NO: 420600 - DNA, 20 bp, mouse
gtgggactccaaaagccacg

SEQ ID NO: 420601 - DNA, 20 bp, mouse
gcagcggcttctacaaatgt

SEQ ID NO: 420602 - DNA, 20 bp, mouse
gcctgaaactcaccgttcca

SEQ ID NO: 420603 - DNA, 20 bp, mouse
gtttcaggccgccatcatac

SEQ ID NO: 420604 - DNA, 20 bp, mouse
gtctgcaggaaaacggacag

SEQ ID NO: 420605 - DNA, 20 bp, mouse
gtcctagaatctaaagatag

SEQ ID NO: 420606 - DNA, 20 bp, mouse
ggcgctgtcgtgagaaggtg

SEQ ID NO: 420607 - DNA, 20 bp, mouse
ggagcgtctgcggctgggct

SEQ ID NO: 420608 - DNA, 20 bp, mouse
ggcgcccgaagatgacgcag

SEQ ID NO: 420609 - DNA, 20 bp, mouse
gggagagcgcgggcgacccg

SEQ ID NO: 420610 - DNA, 20 bp, mouse
gggttccgagagccaacgag

SEQ ID NO: 420611 - DNA, 20 bp, mouse
ggccacgcgctgtcgtgaga

SEQ ID NO: 420612 - DNA, 20 bp, mouse
gtcggaaccacgctaagagg

SEQ ID NO: 420613 - DNA, 20 bp, mouse
ggccgctccaagctggggtc

SEQ ID NO: 420614 - DNA, 20 bp, mouse
ggcagctcacaaagtctccc

SEQ ID NO: 420615 - DNA, 20 bp, mouse
gtactgggcattatatatat

SEQ ID NO: 420616 - DNA, 20 bp, mouse
ggcggggaacaccatacgac

SEQ ID NO: 420617 - DNA, 20 bp, mouse
gcgtcagcgtctgctctacc

SEQ ID NO: 420618 - DNA, 20 bp, mouse
gaacgaacgccctccatgga

SEQ ID NO: 420619 - DNA, 20 bp, mouse
gaccacgcacagcctcttag

SEQ ID NO: 420620 - DNA, 20 bp, mouse
gtccacaggcaacctcacaa

SEQ ID NO: 420621 - DNA, 20 bp, mouse
ggaacaccatacgaccggct

SEQ ID NO: 420622 - DNA, 20 bp, mouse
gcggaggagaaggagcgcat

SEQ ID NO: 420623 - DNA, 20 bp, mouse
gcgcagactccggagcgacg

SEQ ID NO: 420624 - DNA, 20 bp, mouse
gtcgcaggcctcaagtacca

SEQ ID NO: 420625 - DNA, 20 bp, mouse
ggcccaacgaacgccctcca

SEQ ID NO: 420626 - DNA, 20 bp, mouse
ggcagggaaatcagtctgta

SEQ ID NO: 420627 - DNA, 20 bp, mouse
ggctcactgtgacagaacta

SEQ ID NO: 420628 - DNA, 20 bp, mouse
gggcccccttctcaccttgt

SEQ ID NO: 420629 - DNA, 20 bp, mouse
gaacctacaaggtgagaagg

SEQ ID NO: 420630 - DNA, 20 bp, mouse
gcactgtgacagaactaggg

SEQ ID NO: 420631 - DNA, 20 bp, mouse
gggtccagattcaagagctc

SEQ ID NO: 420632 - DNA, 20 bp, mouse
gcacccagagctcttgaatc

SEQ ID NO: 420633 - DNA, 20 bp, mouse
gcataacctacaaggtgaga

SEQ ID NO: 420634 - DNA, 20 bp, mouse
gactaacagctggagtcccg

SEQ ID NO: 420635 - DNA, 20 bp, mouse
gaggtgagaagggggccggg

SEQ ID NO: 420636 - DNA, 20 bp, mouse
gctacggcccagactctact

SEQ ID NO: 420637 - DNA, 20 bp, mouse
gcaaggcggagacctcgcgg

SEQ ID NO: 420638 - DNA, 20 bp, mouse
ggactctacttggcaactca

SEQ ID NO: 420639 - DNA, 20 bp, mouse
gactcgcagcagtggcgcta

SEQ ID NO: 420640 - DNA, 20 bp, mouse
gggcccgacactcgcagcag

SEQ ID NO: 420641 - DNA, 20 bp, mouse
gactcaaggcggagacctcg

SEQ ID NO: 420642 - DNA, 20 bp, mouse
gggagggtgaggcctgactg

SEQ ID NO: 420643 - DNA, 20 bp, mouse
gggcggagacctcgcggagg

SEQ ID NO: 420644 - DNA, 20 bp, mouse
ggcagtggctccgacttcaa

SEQ ID NO: 420645 - DNA, 20 bp, mouse
gctgaggccgacccggagga

SEQ ID NO: 420646 - DNA, 20 bp, mouse
gaagccaagcccaaacagca

SEQ ID NO: 420647 - DNA, 20 bp, mouse
gctctgctctgggcatcccc

SEQ ID NO: 420648 - DNA, 20 bp, mouse
gggacctcaagtctccatcc

SEQ ID NO: 420649 - DNA, 20 bp, mouse
gggctctggagagcgtggtc

SEQ ID NO: 420650 - DNA, 20 bp, mouse
gtactcctggggatccccta

SEQ ID NO: 420651 - DNA, 20 bp, mouse
gaggtaagcatgccccgggg

SEQ ID NO: 420652 - DNA, 20 bp, mouse
gctccatccaggcaaagcct

SEQ ID NO: 420653 - DNA, 20 bp, mouse
gggaaggtaagcatgccccg

SEQ ID NO: 420654 - DNA, 20 bp, mouse
ggaagctggtgccgaggcct

SEQ ID NO: 420655 - DNA, 20 bp, mouse
gtcgagggccagtgtctctt

SEQ ID NO: 420656 - DNA, 20 bp, mouse
ggcagcgcgggcaccagtgg

SEQ ID NO: 420657 - DNA, 20 bp, mouse
ggtgggggcggcgacagact

SEQ ID NO: 420658 - DNA, 20 bp, mouse
ggcgcgggcaccagtggggg

SEQ ID NO: 420659 - DNA, 20 bp, mouse
gagcgcgatgagcatcccca

SEQ ID NO: 420660 - DNA, 20 bp, mouse
ggcgatgagcatccccaggg

SEQ ID NO: 420661 - DNA, 20 bp, mouse
ggactcacccgggtcgaagt

SEQ ID NO: 420662 - DNA, 20 bp, mouse
ggtgcagtccgaaaacacgc

SEQ ID NO: 420663 - DNA, 20 bp, mouse
gcggcggtagggagacaggt

SEQ ID NO: 420664 - DNA, 20 bp, mouse
ggagtccccgcagaagaaca

SEQ ID NO: 420665 - DNA, 20 bp, mouse
gggctccagcagcatcatgt

SEQ ID NO: 420666 - DNA, 20 bp, mouse
gggcccgggctgcgatctac

SEQ ID NO: 420667 - DNA, 20 bp, mouse
gatctacaggctgcgatccg

SEQ ID NO: 420668 - DNA, 20 bp, mouse
ggagcctggtgagtcgctgg

SEQ ID NO: 420669 - DNA, 20 bp, mouse
ggaaggtgatcgcgcaagtc

SEQ ID NO: 420670 - DNA, 20 bp, mouse
ggggaagcggagcagacgcc

SEQ ID NO: 420671 - DNA, 20 bp, mouse
ggatcgcagcccgggcctgg

SEQ ID NO: 420672 - DNA, 20 bp, mouse
gagggtctagatattagcgg

SEQ ID NO: 420673 - DNA, 20 bp, mouse
gtggagggcccggattctag

SEQ ID NO: 420674 - DNA, 20 bp, mouse
gatcgcgcaagtccggcccg

SEQ ID NO: 420675 - DNA, 20 bp, mouse
gcaggctgcgatccgcgggc

SEQ ID NO: 420676 - DNA, 20 bp, mouse
gctgcgccgcggagagaagt

SEQ ID NO: 420677 - DNA, 20 bp, mouse
gcagagcccacttctctccg

SEQ ID NO: 420678 - DNA, 20 bp, mouse
gattccgggagacccgagtg

SEQ ID NO: 420679 - DNA, 20 bp, mouse
gtgtggttgcgcgggtcccg

SEQ ID NO: 420680 - DNA, 20 bp, mouse
gcaaaaaccagtaattccga

SEQ ID NO: 420681 - DNA, 20 bp, mouse
gtacaggggaggcataaaca

SEQ ID NO: 420682 - DNA, 20 bp, mouse
gctgagtcccagggtcgaca

SEQ ID NO: 420683 - DNA, 20 bp, mouse
gctataaaaggaactagtcg

SEQ ID NO: 420684 - DNA, 20 bp, mouse
gaattccgagggcgagcgag

SEQ ID NO: 420685 - DNA, 20 bp, mouse
gcgagcgccggggttactac

SEQ ID NO: 420686 - DNA, 20 bp, mouse
gataagcacaagccactgaa

SEQ ID NO: 420687 - DNA, 20 bp, mouse
gagtgtggacttcgcacaag

SEQ ID NO: 420688 - DNA, 20 bp, mouse
gttgggaagagaagaactgt

SEQ ID NO: 420689 - DNA, 20 bp, mouse
ggaaaaggctcccaacgcac

SEQ ID NO: 420690 - DNA, 20 bp, mouse
gctccagtcctcaagagaag

SEQ ID NO: 420691 - DNA, 20 bp, mouse
gaaacaaagaaactcctcac

SEQ ID NO: 420692 - DNA, 20 bp, mouse
gggcatacagcatattagac

SEQ ID NO: 420693 - DNA, 20 bp, mouse
gtgtcaaaaggcagccggtg

SEQ ID NO: 420694 - DNA, 20 bp, mouse
gttcacggcatagcttcgta

SEQ ID NO: 420695 - DNA, 20 bp, mouse
gactcattctctctggagtg

SEQ ID NO: 420696 - DNA, 20 bp, mouse
ggcagggagcagccggcatg

SEQ ID NO: 420697 - DNA, 20 bp, mouse
gagccggcatggggcacgct

SEQ ID NO: 420698 - DNA, 20 bp, mouse
gcgcccagcgtgccccatgc

SEQ ID NO: 420699 - DNA, 20 bp, mouse
ggaactggatttgcagactc

SEQ ID NO: 420700 - DNA, 20 bp, mouse
gtcagcaacattggcccata

SEQ ID NO: 420701 - DNA, 20 bp, mouse
gcaacattggcccatagggt

SEQ ID NO: 420702 - DNA, 20 bp, mouse
gacaggggacctggactgca

SEQ ID NO: 420703 - DNA, 20 bp, mouse
gcccatagggtaggttctga

SEQ ID NO: 420704 - DNA, 20 bp, mouse
gcaggacacttactggatgc

SEQ ID NO: 420705 - DNA, 20 bp, mouse
gtccatcagaacctacccta

SEQ ID NO: 420706 - DNA, 20 bp, mouse
ggtccgagaggtgtgtgtca

SEQ ID NO: 420707 - DNA, 20 bp, mouse
gggactcctggggcgtctaa

SEQ ID NO: 420708 - DNA, 20 bp, mouse
ggctagagcgttgagaggag

SEQ ID NO: 420709 - DNA, 20 bp, mouse
gccaccatcacagccacgag

SEQ ID NO: 420710 - DNA, 20 bp, mouse
gatccctgacacacacctct

SEQ ID NO: 420711 - DNA, 20 bp, mouse
gggcgacgagcgtcccctcg

SEQ ID NO: 420712 - DNA, 20 bp, mouse
gggttggctagagcgttgag

SEQ ID NO: 420713 - DNA, 20 bp, mouse
gggctgttgtgtagtccgag

SEQ ID NO: 420714 - DNA, 20 bp, mouse
gcgtcccctcgtggctgtga

SEQ ID NO: 420715 - DNA, 20 bp, mouse
gtgaggtgggacacttctaa

SEQ ID NO: 420716 - DNA, 20 bp, mouse
gcctacaggacggttagcta

SEQ ID NO: 420717 - DNA, 20 bp, mouse
ggagagcaggggacacacaa

SEQ ID NO: 420718 - DNA, 20 bp, mouse
gcgatccggggccacgatct

SEQ ID NO: 420719 - DNA, 20 bp, mouse
ggcatcatatggcccagttc

SEQ ID NO: 420720 - DNA, 20 bp, mouse
gagaaagagcactaccctac

SEQ ID NO: 420721 - DNA, 20 bp, mouse
gtccaccgaagagcatcata

SEQ ID NO: 420722 - DNA, 20 bp, mouse
gctcttcctgcacacaagca

SEQ ID NO: 420723 - DNA, 20 bp, mouse
gtaaggccttgcttgtgtgc

SEQ ID NO: 420724 - DNA, 20 bp, mouse
gaggaagagcttccagaact

SEQ ID NO: 420725 - DNA, 20 bp, mouse
gttgcacgagatccgatccg

SEQ ID NO: 420726 - DNA, 20 bp, mouse
ggagcccagcagcgattcat

SEQ ID NO: 420727 - DNA, 20 bp, mouse
gcccagcagcgattcattgg

SEQ ID NO: 420728 - DNA, 20 bp, mouse
gcgattcattggaggaaaca

SEQ ID NO: 420729 - DNA, 20 bp, mouse
ggggtgttgagggtgttgag

SEQ ID NO: 420730 - DNA, 20 bp, mouse
gggcggttgctagctctgag

SEQ ID NO: 420731 - DNA, 20 bp, mouse
gtgctctgcgcagtctccct

SEQ ID NO: 420732 - DNA, 20 bp, mouse
gtgaggaacagctcaagttt

SEQ ID NO: 420733 - DNA, 20 bp, mouse
gacacacacggggaatggta

SEQ ID NO: 420734 - DNA, 20 bp, mouse
gcggttgatccgggtgttga

SEQ ID NO: 420735 - DNA, 20 bp, mouse
gttgagcggaagtgctgctc

SEQ ID NO: 420736 - DNA, 20 bp, mouse
ggtgcccgtggccacggaca

SEQ ID NO: 420737 - DNA, 20 bp, mouse
ggctgcgcctcactcaccgc

SEQ ID NO: 420738 - DNA, 20 bp, mouse
gaccgcaggcaccctgtccg

SEQ ID NO: 420739 - DNA, 20 bp, mouse
ggcaccctgtccgtggccac

SEQ ID NO: 420740 - DNA, 20 bp, mouse
gccgtggccacgggcactga

SEQ ID NO: 420741 - DNA, 20 bp, mouse
ggccacggacagggtgcctg

SEQ ID NO: 420742 - DNA, 20 bp, mouse
gcggggccaacagtcgtcga

SEQ ID NO: 420743 - DNA, 20 bp, mouse
gtcgtcgagggcgatccagc

SEQ ID NO: 420744 - DNA, 20 bp, mouse
ggcagcccggaatccgggga

SEQ ID NO: 420745 - DNA, 20 bp, mouse
gagtgaggcgcagccctccc

SEQ ID NO: 420746 - DNA, 20 bp, mouse
gccgcgcgggcgatgccgag

SEQ ID NO: 420747 - DNA, 20 bp, mouse
ggcgcgcgcagaccccggga

SEQ ID NO: 420748 - DNA, 20 bp, mouse
ggtgcacgcggagagcgcac

SEQ ID NO: 420749 - DNA, 20 bp, mouse
gcgcgcagaggacagggccg

SEQ ID NO: 420750 - DNA, 20 bp, mouse
ggcggcctgcgagcccctaa

SEQ ID NO: 420751 - DNA, 20 bp, mouse
gcagggccgcggcgctgaag

SEQ ID NO: 420752 - DNA, 20 bp, mouse
ggagccgcgcccgcccttag

SEQ ID NO: 420753 - DNA, 20 bp, mouse
ggagagcgcaccggcaaatt

SEQ ID NO: 420754 - DNA, 20 bp, mouse
gccccgaacagggtctccgg

SEQ ID NO: 420755 - DNA, 20 bp, mouse
gccccgccgggccccgctgc

SEQ ID NO: 420756 - DNA, 20 bp, mouse
gcggccgaagctgacaactg

SEQ ID NO: 420757 - DNA, 20 bp, mouse
gccgaagctgacaactgagg

SEQ ID NO: 420758 - DNA, 20 bp, mouse
gagcaggaccgggagtctaa

SEQ ID NO: 420759 - DNA, 20 bp, mouse
gggaccgggagtctaaggga

SEQ ID NO: 420760 - DNA, 20 bp, mouse
ggagaggaggcgcctgcgac

SEQ ID NO: 420761 - DNA, 20 bp, mouse
ggctgacaactgaggcggcg

SEQ ID NO: 420762 - DNA, 20 bp, mouse
gaggtcccggcgataggcag

SEQ ID NO: 420763 - DNA, 20 bp, mouse
gtccaggagccggagcttcc

SEQ ID NO: 420764 - DNA, 20 bp, mouse
gggccgcaaccgccccagca

SEQ ID NO: 420765 - DNA, 20 bp, mouse
gcgggcagcgccccaacctg

SEQ ID NO: 420766 - DNA, 20 bp, mouse
gggagaatcaccccgagctg

SEQ ID NO: 420767 - DNA, 20 bp, mouse
gaggcaagcaccggacacaa

SEQ ID NO: 420768 - DNA, 20 bp, mouse
ggagctggacgtggtcctag

SEQ ID NO: 420769 - DNA, 20 bp, mouse
gtcctagcggcctttgtgtc

SEQ ID NO: 420770 - DNA, 20 bp, mouse
gatcaccagaaggacacagc

SEQ ID NO: 420771 - DNA, 20 bp, mouse
gagggtgtcatcctgtggga

SEQ ID NO: 420772 - DNA, 20 bp, mouse
ggagaagggtgtcatcctgt

SEQ ID NO: 420773 - DNA, 20 bp, mouse
gttgcctgagccccagctcg

SEQ ID NO: 420774 - DNA, 20 bp, mouse
gcccagctcccaccacaggt

SEQ ID NO: 420775 - DNA, 20 bp, mouse
ggcaggtgtcgaagctggag

SEQ ID NO: 420776 - DNA, 20 bp, mouse
gccgcgaccgcggtaagtga

SEQ ID NO: 420777 - DNA, 20 bp, mouse
gcaagccgcgagcttacctg

SEQ ID NO: 420778 - DNA, 20 bp, mouse
gggagctcggaaattctgcg

SEQ ID NO: 420779 - DNA, 20 bp, mouse
gcgagctccgtcacttaccg

SEQ ID NO: 420780 - DNA, 20 bp, mouse
gtctgcggagagaggtgacg

SEQ ID NO: 420781 - DNA, 20 bp, mouse
gctctctcggcgtagcgggg

SEQ ID NO: 420782 - DNA, 20 bp, mouse
gtgtgtgaccagaggactcg

SEQ ID NO: 420783 - DNA, 20 bp, mouse
ggaaattctgcgcggagacg

SEQ ID NO: 420784 - DNA, 20 bp, mouse
gggcgctgacagggatccct

SEQ ID NO: 420785 - DNA, 20 bp, mouse
ggccacccgccagcatcctc

SEQ ID NO: 420786 - DNA, 20 bp, mouse
ggcagtgtgcaaaggaaccg

SEQ ID NO: 420787 - DNA, 20 bp, mouse
gagtaggtggctgctctccg

SEQ ID NO: 420788 - DNA, 20 bp, mouse
ggagtgaccacatccccttt

SEQ ID NO: 420789 - DNA, 20 bp, mouse
gtgctttccgaaaggggatg

SEQ ID NO: 420790 - DNA, 20 bp, mouse
gtaaacatttcttaagtagg

SEQ ID NO: 420791 - DNA, 20 bp, mouse
ggctctgccgaataaatggg

SEQ ID NO: 420792 - DNA, 20 bp, mouse
ggcacactgctttccgaaag

SEQ ID NO: 420793 - DNA, 20 bp, mouse
gtgtgctctgccgaataaat

SEQ ID NO: 420794 - DNA, 20 bp, mouse
gtcgcactcccggaacaggc

SEQ ID NO: 420795 - DNA, 20 bp, mouse
gaaggagagaaagtgctcaa

SEQ ID NO: 420796 - DNA, 20 bp, mouse
gagcggggctccacttaaag

SEQ ID NO: 420797 - DNA, 20 bp, mouse
gtccccggaaggataaggaa

SEQ ID NO: 420798 - DNA, 20 bp, mouse
gctcccccgccgaggccgag

SEQ ID NO: 420799 - DNA, 20 bp, mouse
gggcgtcgtccgcaattgag

SEQ ID NO: 420800 - DNA, 20 bp, mouse
gtagggcaccgggttgcgaa

SEQ ID NO: 420801 - DNA, 20 bp, mouse
ggagtttgggggcctcagaa

SEQ ID NO: 420802 - DNA, 20 bp, mouse
gtcgctcctctcggcctcgg

SEQ ID NO: 420803 - DNA, 20 bp, mouse
gcgagaggagcgaaagtgga

SEQ ID NO: 420804 - DNA, 20 bp, mouse
gcacactccccggaaggata

SEQ ID NO: 420805 - DNA, 20 bp, mouse
gtgaccgctgtgaggatcgg

SEQ ID NO: 420806 - DNA, 20 bp, mouse
ggactgggaatgctcaaaac

SEQ ID NO: 420807 - DNA, 20 bp, mouse
gacagatgtgatagagaccg

SEQ ID NO: 420808 - DNA, 20 bp, mouse
gaaaagcagtcaggctgact

SEQ ID NO: 420809 - DNA, 20 bp, mouse
gttccccactccaagagaat

SEQ ID NO: 420810 - DNA, 20 bp, mouse
gggtctgcaaggggaagttg

SEQ ID NO: 420811 - DNA, 20 bp, mouse
ggcctgtaatgtgttagtaa

SEQ ID NO: 420812 - DNA, 20 bp, mouse
gactcaatgagaacttttta

SEQ ID NO: 420813 - DNA, 20 bp, mouse
gtgcttttggaggaagattg

SEQ ID NO: 420814 - DNA, 20 bp, mouse
ggcatgaactgtacagtaac

SEQ ID NO: 420815 - DNA, 20 bp, mouse
gtgtgtgtctaactgcagct

SEQ ID NO: 420816 - DNA, 20 bp, mouse
gaaaggtgctggagaatagg

SEQ ID NO: 420817 - DNA, 20 bp, mouse
gtgctggagaatagggggag

SEQ ID NO: 420818 - DNA, 20 bp, mouse
gtagaaaggtgctggagaat

SEQ ID NO: 420819 - DNA, 20 bp, mouse
gtggtgaaagctgctctcag

SEQ ID NO: 420820 - DNA, 20 bp, mouse
gttaaactctagaaaggtgc

SEQ ID NO: 420821 - DNA, 20 bp, mouse
gtgctgtccgtgaacgcgac

SEQ ID NO: 420822 - DNA, 20 bp, mouse
gagccgcaccatttaatcac

SEQ ID NO: 420823 - DNA, 20 bp, mouse
gctttcaccagtcgcgttca

SEQ ID NO: 420824 - DNA, 20 bp, mouse
gagacacttcaggattgagt

SEQ ID NO: 420825 - DNA, 20 bp, mouse
gagcccgtgattaaatggtg

SEQ ID NO: 420826 - DNA, 20 bp, mouse
gttcttctgagggttcagac

SEQ ID NO: 420827 - DNA, 20 bp, mouse
gggagaaagtcgccaagtgt

SEQ ID NO: 420828 - DNA, 20 bp, mouse
gcctccgggacaaagatctg

SEQ ID NO: 420829 - DNA, 20 bp, mouse
ggaaccaaccgtccacgata

SEQ ID NO: 420830 - DNA, 20 bp, mouse
gtctgaagagaattcttctg

SEQ ID NO: 420831 - DNA, 20 bp, mouse
gtagaggttaacttactctg

SEQ ID NO: 420832 - DNA, 20 bp, mouse
gttcctcagcagggatcctg

SEQ ID NO: 420833 - DNA, 20 bp, mouse
ggctagcaaccacagtctag

SEQ ID NO: 420834 - DNA, 20 bp, mouse
gtcctgtggttgcagatggt

SEQ ID NO: 420835 - DNA, 20 bp, mouse
gtatcacagaacaggcaagt

SEQ ID NO: 420836 - DNA, 20 bp, mouse
gagtagcgccctagcagaag

SEQ ID NO: 420837 - DNA, 20 bp, mouse
gccggttggtgagactgtcc

SEQ ID NO: 420838 - DNA, 20 bp, mouse
ggcacggcagggccccgacg

SEQ ID NO: 420839 - DNA, 20 bp, mouse
gcgccaggcagcccggatag

SEQ ID NO: 420840 - DNA, 20 bp, mouse
gatgcgcgccccttctgcta

SEQ ID NO: 420841 - DNA, 20 bp, mouse
ggaccgggcgctcagaagta

SEQ ID NO: 420842 - DNA, 20 bp, mouse
ggaaagcggaggcccgaacc

SEQ ID NO: 420843 - DNA, 20 bp, mouse
gcagtgggccacctcctcgg

SEQ ID NO: 420844 - DNA, 20 bp, mouse
gggcgtgcggcccggccggt

SEQ ID NO: 420845 - DNA, 20 bp, mouse
gccaaggtctcgcacaccgg

SEQ ID NO: 420846 - DNA, 20 bp, mouse
ggaagcgagagacgccactg

SEQ ID NO: 420847 - DNA, 20 bp, mouse
ggacgccactgtggaaagtc

SEQ ID NO: 420848 - DNA, 20 bp, mouse
gtgaaaactgaacttggaaa

SEQ ID NO: 420849 - DNA, 20 bp, mouse
gtggcgtctctcgcttctcc

SEQ ID NO: 420850 - DNA, 20 bp, mouse
gccctcaaattcacatctgt

SEQ ID NO: 420851 - DNA, 20 bp, mouse
gtttactggatgacaaggtt

SEQ ID NO: 420852 - DNA, 20 bp, mouse
ggtagctttactggatgaca

SEQ ID NO: 420853 - DNA, 20 bp, mouse
ggtagacgtgtgaagacaaa

SEQ ID NO: 420854 - DNA, 20 bp, mouse
gcagtaaagctacagtgctt

SEQ ID NO: 420855 - DNA, 20 bp, mouse
gtggtagtctcagtttatgg

SEQ ID NO: 420856 - DNA, 20 bp, mouse
gcccaggcacagtggaacag

SEQ ID NO: 420857 - DNA, 20 bp, mouse
ggagcagagccttggaagat

SEQ ID NO: 420858 - DNA, 20 bp, mouse
gtcctgtccacagaaagccc

SEQ ID NO: 420859 - DNA, 20 bp, mouse
gtgacacccggaccaggctc

SEQ ID NO: 420860 - DNA, 20 bp, mouse
gcgggaggtagagacacgtg

SEQ ID NO: 420861 - DNA, 20 bp, mouse
gtctgagttgagcagagcct

SEQ ID NO: 420862 - DNA, 20 bp, mouse
gggacgctgacacccggacc

SEQ ID NO: 420863 - DNA, 20 bp, mouse
gactgtgcctgggctttctg

SEQ ID NO: 420864 - DNA, 20 bp, mouse
gtcacgaggacgctgacacc

SEQ ID NO: 420865 - DNA, 20 bp, mouse
gaactcacccggggaatccc

SEQ ID NO: 420866 - DNA, 20 bp, mouse
gtgagcggaacctcagaaga

SEQ ID NO: 420867 - DNA, 20 bp, mouse
gttgaagccgtaagaggctg

SEQ ID NO: 420868 - DNA, 20 bp, mouse
gctctggctccttcccgcag

SEQ ID NO: 420869 - DNA, 20 bp, mouse
gcggcttcaagagccactgc

SEQ ID NO: 420870 - DNA, 20 bp, mouse
gtgcctgagtccggtccggg

SEQ ID NO: 420871 - DNA, 20 bp, mouse
gtcagccaagatgtagaatt

SEQ ID NO: 420872 - DNA, 20 bp, mouse
gaggacgctaccacccggac

SEQ ID NO: 420873 - DNA, 20 bp, mouse
gggatgcctgagtccggtcc

SEQ ID NO: 420874 - DNA, 20 bp, mouse
gtaccacccggaccggactc

SEQ ID NO: 420875 - DNA, 20 bp, mouse
gtcaagaggacgctaccacc

SEQ ID NO: 420876 - DNA, 20 bp, mouse
ggttcaggtgagggaggacg

SEQ ID NO: 420877 - DNA, 20 bp, mouse
gcggagacgcgcgcccctgg

SEQ ID NO: 420878 - DNA, 20 bp, mouse
ggaggacgcggcgggagaaa

SEQ ID NO: 420879 - DNA, 20 bp, mouse
ggcgcgtgaagttcaggtga

SEQ ID NO: 420880 - DNA, 20 bp, mouse
ggaccgagggaaggcagttg

SEQ ID NO: 420881 - DNA, 20 bp, mouse
ggcttgcgggagctctcctg

SEQ ID NO: 420882 - DNA, 20 bp, mouse
gggcgagggcgacacgctgg

SEQ ID NO: 420883 - DNA, 20 bp, mouse
gcaggtgagggaggacgcgg

SEQ ID NO: 420884 - DNA, 20 bp, mouse
ggcagagccgggggcactgg

SEQ ID NO: 420885 - DNA, 20 bp, mouse
gcgacacgctggtggcgctg

SEQ ID NO: 420886 - DNA, 20 bp, mouse
gatagcgagtatgatagata

SEQ ID NO: 420887 - DNA, 20 bp, mouse
gccacacattcataacatga

SEQ ID NO: 420888 - DNA, 20 bp, mouse
ggaacatgatctgttgtcca

SEQ ID NO: 420889 - DNA, 20 bp, mouse
ggtgtcccaatgagtcagaa

SEQ ID NO: 420890 - DNA, 20 bp, mouse
gtggacacaagattcgtgtg

SEQ ID NO: 420891 - DNA, 20 bp, mouse
gatgggtgtaacttgtagag

SEQ ID NO: 420892 - DNA, 20 bp, mouse
gttaaatagtataaagcata

SEQ ID NO: 420893 - DNA, 20 bp, mouse
gaacttatacacacaatgat

SEQ ID NO: 420894 - DNA, 20 bp, mouse
gtgtgatgatattaaagata

SEQ ID NO: 420895 - DNA, 20 bp, mouse
gaacaaatgagactggtcat

SEQ ID NO: 420896 - DNA, 20 bp, mouse
ggctagcagctgggacccta

SEQ ID NO: 420897 - DNA, 20 bp, mouse
ggtcccagctgctagcgagt

SEQ ID NO: 420898 - DNA, 20 bp, mouse
ggcgcgtgcgtgaagagagt

SEQ ID NO: 420899 - DNA, 20 bp, mouse
ggctgctagcgagtgggaac

SEQ ID NO: 420900 - DNA, 20 bp, mouse
gccagagtcaggagtgtcga

SEQ ID NO: 420901 - DNA, 20 bp, mouse
gggtcactgcacaaagagtc

SEQ ID NO: 420902 - DNA, 20 bp, mouse
ggagtgggaaccggcaagca

SEQ ID NO: 420903 - DNA, 20 bp, mouse
gatctgcggccctctctgaa

SEQ ID NO: 420904 - DNA, 20 bp, mouse
gcgggctgacccttcagaga

SEQ ID NO: 420905 - DNA, 20 bp, mouse
ggagagggccgcagatgcca

SEQ ID NO: 420906 - DNA, 20 bp, mouse
ggctgctcgcgatacattcc

SEQ ID NO: 420907 - DNA, 20 bp, mouse
gagcgcgcggccacacacct

SEQ ID NO: 420908 - DNA, 20 bp, mouse
gagggcgagctcaagagtgg

SEQ ID NO: 420909 - DNA, 20 bp, mouse
gcacatggagactagagccc

SEQ ID NO: 420910 - DNA, 20 bp, mouse
ggtcagggcgagctcaagag

SEQ ID NO: 420911 - DNA, 20 bp, mouse
gaggaaaaaggaaccgagag

SEQ ID NO: 420912 - DNA, 20 bp, mouse
gcggcgagggtaggaagtta

SEQ ID NO: 420913 - DNA, 20 bp, mouse
gaaaaaggaaccgagagagg

SEQ ID NO: 420914 - DNA, 20 bp, mouse
gggagagcagggtgaaggac

SEQ ID NO: 420915 - DNA, 20 bp, mouse
gtcccacaatcctcctctct

SEQ ID NO: 420916 - DNA, 20 bp, mouse
gtgttgaggcaataagatag

SEQ ID NO: 420917 - DNA, 20 bp, mouse
gagataggggcagccagcaa

SEQ ID NO: 420918 - DNA, 20 bp, mouse
gcgaacatggaaccctcggt

SEQ ID NO: 420919 - DNA, 20 bp, mouse
gatagcgaacatggaaccct

SEQ ID NO: 420920 - DNA, 20 bp, mouse
gctcacacttatcctaccga

SEQ ID NO: 420921 - DNA, 20 bp, mouse
ggatggggccatagcgaaca

SEQ ID NO: 420922 - DNA, 20 bp, mouse
gagcccggaactacatatcc

SEQ ID NO: 420923 - DNA, 20 bp, mouse
ggtgagtggcgccccttagt

SEQ ID NO: 420924 - DNA, 20 bp, mouse
gggccccgcgcgatgtcgga

SEQ ID NO: 420925 - DNA, 20 bp, mouse
ggtcaccactgcccactaag

SEQ ID NO: 420926 - DNA, 20 bp, mouse
gctaggctccgaccttgtag

SEQ ID NO: 420927 - DNA, 20 bp, mouse
gctctcaccgagcccgctct

SEQ ID NO: 420928 - DNA, 20 bp, mouse
ggcgccggctccgagcaaag

SEQ ID NO: 420929 - DNA, 20 bp, mouse
gcgctgcgccgctacaaggt

SEQ ID NO: 420930 - DNA, 20 bp, mouse
gccggcgctgcgccgctaca

SEQ ID NO: 420931 - DNA, 20 bp, mouse
gtggcgctcgcagccctcag

SEQ ID NO: 420932 - DNA, 20 bp, mouse
ggcggtgcccagagcgggct

SEQ ID NO: 420933 - DNA, 20 bp, mouse
gcgtttggaggagaccctgg

SEQ ID NO: 420934 - DNA, 20 bp, mouse
gggcaccgcccgcctgtcag

SEQ ID NO: 420935 - DNA, 20 bp, mouse
gctctgggcaccgctttgct

SEQ ID NO: 420936 - DNA, 20 bp, mouse
gaagctgcgcagcgccatgc

SEQ ID NO: 420937 - DNA, 20 bp, mouse
ggatggctccgatccactct

SEQ ID NO: 420938 - DNA, 20 bp, mouse
gccccagagtaagagagcgg

SEQ ID NO: 420939 - DNA, 20 bp, mouse
gcgatccactctgggtaagg

SEQ ID NO: 420940 - DNA, 20 bp, mouse
gctgcgcagcgccatgcggg

SEQ ID NO: 420941 - DNA, 20 bp, mouse
ggaagggacgccagatctgg

SEQ ID NO: 420942 - DNA, 20 bp, mouse
gctccgatccactctgggta

SEQ ID NO: 420943 - DNA, 20 bp, mouse
ggcagcttctgcagcgctga

SEQ ID NO: 420944 - DNA, 20 bp, mouse
ggtaaggtggtgggccgcgg

SEQ ID NO: 420945 - DNA, 20 bp, mouse
gatctggcgtcccttcccga

SEQ ID NO: 420946 - DNA, 20 bp, mouse
gctccatagacacctcaccc

SEQ ID NO: 420947 - DNA, 20 bp, mouse
gcgcccgggtgaggtgtcta

SEQ ID NO: 420948 - DNA, 20 bp, mouse
ggcggaagccaagagtgaca

SEQ ID NO: 420949 - DNA, 20 bp, mouse
ggcgtccgtgccacacagct

SEQ ID NO: 420950 - DNA, 20 bp, mouse
gggattgcgaggtctctgta

SEQ ID NO: 420951 - DNA, 20 bp, mouse
gtcactcttggcttccgccc

SEQ ID NO: 420952 - DNA, 20 bp, mouse
gccaaggtgagactgcaacg

SEQ ID NO: 420953 - DNA, 20 bp, mouse
gcttggcttccgcccgggtg

SEQ ID NO: 420954 - DNA, 20 bp, mouse
gcgcaatcccagggacatct

SEQ ID NO: 420955 - DNA, 20 bp, mouse
gctagggggcggggattcag

SEQ ID NO: 420956 - DNA, 20 bp, mouse
gaggagggctcccagcaggt

SEQ ID NO: 420957 - DNA, 20 bp, mouse
gatggggcagttggagagga

SEQ ID NO: 420958 - DNA, 20 bp, mouse
gtgggagtggcagttgaatg

SEQ ID NO: 420959 - DNA, 20 bp, mouse
gccagggcttcttcctacag

SEQ ID NO: 420960 - DNA, 20 bp, mouse
ggctcccagcaggtgggaca

SEQ ID NO: 420961 - DNA, 20 bp, mouse
gttgaatggggcagttggag

SEQ ID NO: 420962 - DNA, 20 bp, mouse
ggcccctcatgactaaacag

SEQ ID NO: 420963 - DNA, 20 bp, mouse
gggaggaagctaggtaagac

SEQ ID NO: 420964 - DNA, 20 bp, mouse
gctccggaaatcccaggcca

SEQ ID NO: 420965 - DNA, 20 bp, mouse
gacgtgcagcacagcctgat

SEQ ID NO: 420966 - DNA, 20 bp, mouse
gtcaagggaagcagatgtta

SEQ ID NO: 420967 - DNA, 20 bp, mouse
gtctttaccatctgcctcaa

SEQ ID NO: 420968 - DNA, 20 bp, mouse
gttaattgggcagtgaggat

SEQ ID NO: 420969 - DNA, 20 bp, mouse
gtcgtccatcgtgatttcca

SEQ ID NO: 420970 - DNA, 20 bp, mouse
gagtgccctggaaatcacga

SEQ ID NO: 420971 - DNA, 20 bp, mouse
gtaggaagggaattgttgta

SEQ ID NO: 420972 - DNA, 20 bp, mouse
gctgcttcccttgaggcaga

SEQ ID NO: 420973 - DNA, 20 bp, mouse
gtatgaaccggtaaatttag

SEQ ID NO: 420974 - DNA, 20 bp, mouse
gcatggctatcggtatgaac

SEQ ID NO: 420975 - DNA, 20 bp, mouse
gccacatgattataacacgt

SEQ ID NO: 420976 - DNA, 20 bp, mouse
ggcggtgcaccagagccaca

SEQ ID NO: 420977 - DNA, 20 bp, mouse
gctctccggagccgcacagg

SEQ ID NO: 420978 - DNA, 20 bp, mouse
gcagctctccggagccgcac

SEQ ID NO: 420979 - DNA, 20 bp, mouse
ggccgcacaggcggtccatg

SEQ ID NO: 420980 - DNA, 20 bp, mouse
ggccacatggaccgcctgtg

SEQ ID NO: 420981 - DNA, 20 bp, mouse
gggagtcagaggcggttccg

SEQ ID NO: 420982 - DNA, 20 bp, mouse
gtccgtgctacggaggaagt

SEQ ID NO: 420983 - DNA, 20 bp, mouse
gcaggcggtccatgtggctc

SEQ ID NO: 420984 - DNA, 20 bp, mouse
ggatgtgcatagtcagacct

SEQ ID NO: 420985 - DNA, 20 bp, mouse
gacgcttcttacccagaact

SEQ ID NO: 420986 - DNA, 20 bp, mouse
ggagcctcgcaggcaagcag

SEQ ID NO: 420987 - DNA, 20 bp, mouse
ggctccgggaagcgcgggtg

SEQ ID NO: 420988 - DNA, 20 bp, mouse
ggccgacgcggagcatctcg

SEQ ID NO: 420989 - DNA, 20 bp, mouse
ggcctcggccggagcctcgc

SEQ ID NO: 420990 - DNA, 20 bp, mouse
gggtgaggatgctcgagctc

SEQ ID NO: 420991 - DNA, 20 bp, mouse
ggatgctcgagctccggcct

SEQ ID NO: 420992 - DNA, 20 bp, mouse
gtcctccgaccatcagggac

SEQ ID NO: 420993 - DNA, 20 bp, mouse
gacgcggagcatctcgtgga

SEQ ID NO: 420994 - DNA, 20 bp, mouse
gtgcccctcctggaggagag

SEQ ID NO: 420995 - DNA, 20 bp, mouse
gacaaggagcccggagtgta

SEQ ID NO: 420996 - DNA, 20 bp, mouse
gacacgagagcaaacagccc

SEQ ID NO: 420997 - DNA, 20 bp, mouse
gcgggcacgctcgcgaacat

SEQ ID NO: 420998 - DNA, 20 bp, mouse
ggcggtgggaagcctcggac

SEQ ID NO: 420999 - DNA, 20 bp, mouse
ggcctcggacgggagaaacg

SEQ ID NO: 421000 - DNA, 20 bp, mouse
gcagtgtcggaggctgtcac

SEQ ID NO: 421001 - DNA, 20 bp, mouse
gcgaggtcgccaacaagccg

SEQ ID NO: 421002 - DNA, 20 bp, mouse
gctctccgcgcggccaccag

SEQ ID NO: 421003 - DNA, 20 bp, mouse
gcagtcccggagggaggttg

SEQ ID NO: 421004 - DNA, 20 bp, mouse
gggggactatgccgctataa

SEQ ID NO: 421005 - DNA, 20 bp, mouse
ggggctctccaaggcggggt

SEQ ID NO: 421006 - DNA, 20 bp, mouse
ggactcagactgatgaacag

SEQ ID NO: 421007 - DNA, 20 bp, mouse
ggagcagtgcgccggcctga

SEQ ID NO: 421008 - DNA, 20 bp, mouse
gatgaacagagggcgctcca

SEQ ID NO: 421009 - DNA, 20 bp, mouse
ggcaggctggactcaccctc

SEQ ID NO: 421010 - DNA, 20 bp, mouse
gggccggcgcactgctctcc

SEQ ID NO: 421011 - DNA, 20 bp, mouse
ggagcccctgccagccactg

SEQ ID NO: 421012 - DNA, 20 bp, mouse
ggctggactcaccctcaggc

SEQ ID NO: 421013 - DNA, 20 bp, mouse
gtgctctccaggcgtggcca

SEQ ID NO: 421014 - DNA, 20 bp, mouse
gggcgctccatggccacgcc

SEQ ID NO: 421015 - DNA, 20 bp, mouse
gcatagactagtgtaagata

SEQ ID NO: 421016 - DNA, 20 bp, mouse
gagggtgctgcgaggaacag

SEQ ID NO: 421017 - DNA, 20 bp, mouse
gcggtgccgcagaaggccaa

SEQ ID NO: 421018 - DNA, 20 bp, mouse
gccgcagaaggccaagggca

SEQ ID NO: 421019 - DNA, 20 bp, mouse
gacaccttggtccacccggt

SEQ ID NO: 421020 - DNA, 20 bp, mouse
ggcgcgcacgggctctgctc

SEQ ID NO: 421021 - DNA, 20 bp, mouse
gcacccggtaggcggccgag

SEQ ID NO: 421022 - DNA, 20 bp, mouse
gtgcggcaccgagaaccact

SEQ ID NO: 421023 - DNA, 20 bp, mouse
gcgggccgtgcgggagccca

SEQ ID NO: 421024 - DNA, 20 bp, mouse
ggcgcgcgcccagcgacgga

SEQ ID NO: 421025 - DNA, 20 bp, mouse
gtaggcggccgagtggttct

SEQ ID NO: 421026 - DNA, 20 bp, mouse
gaggagctcacgcactccat

SEQ ID NO: 421027 - DNA, 20 bp, mouse
gcgccggctgctgacccggg

SEQ ID NO: 421028 - DNA, 20 bp, mouse
gagccagtgactcctcagag

SEQ ID NO: 421029 - DNA, 20 bp, mouse
gatctctctgtagcaagccg

SEQ ID NO: 421030 - DNA, 20 bp, mouse
gcactcgccggctgctgacc

SEQ ID NO: 421031 - DNA, 20 bp, mouse
ggagatccccaaccactctg

SEQ ID NO: 421032 - DNA, 20 bp, mouse
ggacttgctggcgagaaggt

SEQ ID NO: 421033 - DNA, 20 bp, mouse
gaaccactctgaggagtcac

SEQ ID NO: 421034 - DNA, 20 bp, mouse
gtgccggctggagccgaaac

SEQ ID NO: 421035 - DNA, 20 bp, mouse
gctggcgagaaggtgggatc

SEQ ID NO: 421036 - DNA, 20 bp, mouse
gtaaggggacagtctgtaga

SEQ ID NO: 421037 - DNA, 20 bp, mouse
gcttcaggcagcccgggtgg

SEQ ID NO: 421038 - DNA, 20 bp, mouse
gtctgacctcaggggctaag

SEQ ID NO: 421039 - DNA, 20 bp, mouse
ggaagccagttcctccaccc

SEQ ID NO: 421040 - DNA, 20 bp, mouse
gcctcttcaggcagcccggg

SEQ ID NO: 421041 - DNA, 20 bp, mouse
gtggcctcttcaggcagccc

SEQ ID NO: 421042 - DNA, 20 bp, mouse
gagagcctcgagaggtctta

SEQ ID NO: 421043 - DNA, 20 bp, mouse
gctctccttaagacctctcg

SEQ ID NO: 421044 - DNA, 20 bp, mouse
gtctcgaggctctgacctca

SEQ ID NO: 421045 - DNA, 20 bp, mouse
gttgcagacagatcctggaa

SEQ ID NO: 421046 - DNA, 20 bp, mouse
ggactcgcccccggaggatg

SEQ ID NO: 421047 - DNA, 20 bp, mouse
gtccgcggaaagcccagcaa

SEQ ID NO: 421048 - DNA, 20 bp, mouse
gactccaccgcatcctccgg

SEQ ID NO: 421049 - DNA, 20 bp, mouse
ggattagagccaccgagtgg

SEQ ID NO: 421050 - DNA, 20 bp, mouse
gaagcagcctggccacagga

SEQ ID NO: 421051 - DNA, 20 bp, mouse
gagcatatgccgcagccacc

SEQ ID NO: 421052 - DNA, 20 bp, mouse
gtggctctgcctccactcgg

SEQ ID NO: 421053 - DNA, 20 bp, mouse
gctgctgagggactcgcccc

SEQ ID NO: 421054 - DNA, 20 bp, mouse
gctgagggactcgcccccgg

SEQ ID NO: 421055 - DNA, 20 bp, mouse
gagatccggtgctgctaaaa

SEQ ID NO: 421056 - DNA, 20 bp, mouse
gtacttgctgaaggccgcca

SEQ ID NO: 421057 - DNA, 20 bp, mouse
gcgagcgagccgcgggatag

SEQ ID NO: 421058 - DNA, 20 bp, mouse
gctgaaggccgccatggcac

SEQ ID NO: 421059 - DNA, 20 bp, mouse
gcggcgcgtcccctatcccg

SEQ ID NO: 421060 - DNA, 20 bp, mouse
gctcagtgcaggaaccgcgg

SEQ ID NO: 421061 - DNA, 20 bp, mouse
gggccgccatggcaccggca

SEQ ID NO: 421062 - DNA, 20 bp, mouse
ggccttcagcaagtacttga

SEQ ID NO: 421063 - DNA, 20 bp, mouse
gggcagggcgagcgagccgc

SEQ ID NO: 421064 - DNA, 20 bp, mouse
gcctgcactgaggttgtcgc

SEQ ID NO: 421065 - DNA, 20 bp, mouse
gaacctcagtgcaggaaccg

SEQ ID NO: 421066 - DNA, 20 bp, mouse
gacccgggatgcaagcgacg

SEQ ID NO: 421067 - DNA, 20 bp, mouse
gtctgcccggggaggacacc

SEQ ID NO: 421068 - DNA, 20 bp, mouse
gagctctgaggactctgccc

SEQ ID NO: 421069 - DNA, 20 bp, mouse
gcccgggaccgccatgaccc

SEQ ID NO: 421070 - DNA, 20 bp, mouse
gctgaggactctgcccgggg

SEQ ID NO: 421071 - DNA, 20 bp, mouse
ggcaagcccggtgtcctccc

SEQ ID NO: 421072 - DNA, 20 bp, mouse
gcttgcatcccgggtcatgg

SEQ ID NO: 421073 - DNA, 20 bp, mouse
gccccgccctaggaggaaag

SEQ ID NO: 421074 - DNA, 20 bp, mouse
gcgaggcgaccgagcaagcc

SEQ ID NO: 421075 - DNA, 20 bp, mouse
gtgcaaggaaggacccgcag

SEQ ID NO: 421076 - DNA, 20 bp, mouse
gccgccaccggcaaagatgg

SEQ ID NO: 421077 - DNA, 20 bp, mouse
gcgcctcgcgcaaggcatga

SEQ ID NO: 421078 - DNA, 20 bp, mouse
gttaccgccaccggcaaaga

SEQ ID NO: 421079 - DNA, 20 bp, mouse
ggtaagttaggcctcagtag

SEQ ID NO: 421080 - DNA, 20 bp, mouse
ggcaccgccatctttgccgg

SEQ ID NO: 421081 - DNA, 20 bp, mouse
gagcgtgttcttaccgccac

SEQ ID NO: 421082 - DNA, 20 bp, mouse
gcggagcgtcctccacagaa

SEQ ID NO: 421083 - DNA, 20 bp, mouse
gcagcgggccccttacagcg

SEQ ID NO: 421084 - DNA, 20 bp, mouse
gagactcttagggacacagt

SEQ ID NO: 421085 - DNA, 20 bp, mouse
gggacgcgcgcggaacgctc

SEQ ID NO: 421086 - DNA, 20 bp, mouse
gggacccttcggcatcgcgg

SEQ ID NO: 421087 - DNA, 20 bp, mouse
gctgccgccgcgatgccgaa

SEQ ID NO: 421088 - DNA, 20 bp, mouse
ggccgtcctagagcccagag

SEQ ID NO: 421089 - DNA, 20 bp, mouse
gcgccgtccccgatccactc

SEQ ID NO: 421090 - DNA, 20 bp, mouse
gagagcccagagaggcggac

SEQ ID NO: 421091 - DNA, 20 bp, mouse
gcccgagcccgagtggatcg

SEQ ID NO: 421092 - DNA, 20 bp, mouse
gacatcgccggaagcggaaa

SEQ ID NO: 421093 - DNA, 20 bp, mouse
gagcccgagtggatcgggga

SEQ ID NO: 421094 - DNA, 20 bp, mouse
gagagaggcggacgggagac

SEQ ID NO: 421095 - DNA, 20 bp, mouse
ggcctctctgggctctagga

SEQ ID NO: 421096 - DNA, 20 bp, mouse
gccgcacgcggaggagctca

SEQ ID NO: 421097 - DNA, 20 bp, mouse
gtgttgcgacagaggccgag

SEQ ID NO: 421098 - DNA, 20 bp, mouse
ggaggccccgtgagttgagg

SEQ ID NO: 421099 - DNA, 20 bp, mouse
ggggagccggccgcacgcgg

SEQ ID NO: 421100 - DNA, 20 bp, mouse
ggcgagcgcagagaccctta

SEQ ID NO: 421101 - DNA, 20 bp, mouse
gctccccagcgggtccctaa

SEQ ID NO: 421102 - DNA, 20 bp, mouse
gcccttccccctcaactcac

SEQ ID NO: 421103 - DNA, 20 bp, mouse
gttggggagccggccgcacg

SEQ ID NO: 421104 - DNA, 20 bp, mouse
gggcgaggccccgtgagttg

SEQ ID NO: 421105 - DNA, 20 bp, mouse
gttcggaaactggagacgag

SEQ ID NO: 421106 - DNA, 20 bp, mouse
ggacctgcccgtcaatttca

SEQ ID NO: 421107 - DNA, 20 bp, mouse
gcgagttccctgaaattgac

SEQ ID NO: 421108 - DNA, 20 bp, mouse
gattggatcccgagtgaaca

SEQ ID NO: 421109 - DNA, 20 bp, mouse
gaggtcttcgactacgtgac

SEQ ID NO: 421110 - DNA, 20 bp, mouse
gcaagtcgccatgttcactc

SEQ ID NO: 421111 - DNA, 20 bp, mouse
gtgtctgtacagctcactcg

SEQ ID NO: 421112 - DNA, 20 bp, mouse
gacgcagagagaccagatag

SEQ ID NO: 421113 - DNA, 20 bp, mouse
gcaacgggtagggcggatat

SEQ ID NO: 421114 - DNA, 20 bp, mouse
gtcggggcaccagaccccac

SEQ ID NO: 421115 - DNA, 20 bp, mouse
gacaagacagacaacgggta

SEQ ID NO: 421116 - DNA, 20 bp, mouse
ggtggagacaagtctgcggg

SEQ ID NO: 421117 - DNA, 20 bp, mouse
gggacgaggttgcaggaacg

SEQ ID NO: 421118 - DNA, 20 bp, mouse
ggcagtggagacaagtctgc

SEQ ID NO: 421119 - DNA, 20 bp, mouse
gcagacaggccatgccccgg

SEQ ID NO: 421120 - DNA, 20 bp, mouse
gcggaggatgcgctcatagg

SEQ ID NO: 421121 - DNA, 20 bp, mouse
ggcccggaggatgcgctcat

SEQ ID NO: 421122 - DNA, 20 bp, mouse
gtcctccgggcgctgacctg

SEQ ID NO: 421123 - DNA, 20 bp, mouse
gacaggccatgccccggggg

SEQ ID NO: 421124 - DNA, 20 bp, mouse
ggacctggggtgctctggag

SEQ ID NO: 421125 - DNA, 20 bp, mouse
ggcttgctcctgctcctccg

SEQ ID NO: 421126 - DNA, 20 bp, mouse
gctcacctcgcggtccctgg

SEQ ID NO: 421127 - DNA, 20 bp, mouse
ggtgtgtgcgagttctggcg

SEQ ID NO: 421128 - DNA, 20 bp, mouse
gccgcactccgctcacctcg

SEQ ID NO: 421129 - DNA, 20 bp, mouse
ggcgggcagacgctcctggc

SEQ ID NO: 421130 - DNA, 20 bp, mouse
ggcggcgcctagcacactcc

SEQ ID NO: 421131 - DNA, 20 bp, mouse
gccgctcacctcgcggtccc

SEQ ID NO: 421132 - DNA, 20 bp, mouse
gagtgtgctaggcgccgcgg

SEQ ID NO: 421133 - DNA, 20 bp, mouse
gcggagtgcggggaagctcc

SEQ ID NO: 421134 - DNA, 20 bp, mouse
gctggcgggcgagcgtgtgc

SEQ ID NO: 421135 - DNA, 20 bp, mouse
gtctgagtgtgtgcgagttc

SEQ ID NO: 421136 - DNA, 20 bp, mouse
gctcctgaccacgaccacag

SEQ ID NO: 421137 - DNA, 20 bp, mouse
gagagctcttggagcctctg

SEQ ID NO: 421138 - DNA, 20 bp, mouse
ggggaacccgaagagagcag

SEQ ID NO: 421139 - DNA, 20 bp, mouse
gtgcagctcgggtctttgga

SEQ ID NO: 421140 - DNA, 20 bp, mouse
gagcctctgtggtcgtggtc

SEQ ID NO: 421141 - DNA, 20 bp, mouse
ggtggtcgtggtcaggagca

SEQ ID NO: 421142 - DNA, 20 bp, mouse
gcttggagcctctgtggtcg

SEQ ID NO: 421143 - DNA, 20 bp, mouse
gccactgtgagataatgcag

SEQ ID NO: 421144 - DNA, 20 bp, mouse
gatctcacagtggtgagtgt

SEQ ID NO: 421145 - DNA, 20 bp, mouse
gacaggaagatttgcagctc

SEQ ID NO: 421146 - DNA, 20 bp, mouse
ggccgcccgactaggtccag

SEQ ID NO: 421147 - DNA, 20 bp, mouse
gtcctctggacctagtcggg

SEQ ID NO: 421148 - DNA, 20 bp, mouse
gctgtcctctggacctagtc

SEQ ID NO: 421149 - DNA, 20 bp, mouse
gccagactacgagaacccgg

SEQ ID NO: 421150 - DNA, 20 bp, mouse
gcccggaggtcaccaaggga

SEQ ID NO: 421151 - DNA, 20 bp, mouse
gtcaacccggaggtcaccaa

SEQ ID NO: 421152 - DNA, 20 bp, mouse
ggcgcgggaggtggacactc

SEQ ID NO: 421153 - DNA, 20 bp, mouse
gagaacactgccgcccgact

SEQ ID NO: 421154 - DNA, 20 bp, mouse
ggtccccagcgcctgtcctc

SEQ ID NO: 421155 - DNA, 20 bp, mouse
gccaccgggacagggagccg

SEQ ID NO: 421156 - DNA, 20 bp, mouse
gctccctctggactcagaaa

SEQ ID NO: 421157 - DNA, 20 bp, mouse
gtgagtccagagggagccag

SEQ ID NO: 421158 - DNA, 20 bp, mouse
ggagggcctcacatcaacag

SEQ ID NO: 421159 - DNA, 20 bp, mouse
gtggtgggcgagtcaaggaa

SEQ ID NO: 421160 - DNA, 20 bp, mouse
gagctgccctggagccggac

SEQ ID NO: 421161 - DNA, 20 bp, mouse
gagtggcctgtccggctcca

SEQ ID NO: 421162 - DNA, 20 bp, mouse
gtctacacaggacaggtggt

SEQ ID NO: 421163 - DNA, 20 bp, mouse
gcagctcacccatggctagc

SEQ ID NO: 421164 - DNA, 20 bp, mouse
gagctccctggagcaaggtt

SEQ ID NO: 421165 - DNA, 20 bp, mouse
gcagcaagcggcttcaggca

SEQ ID NO: 421166 - DNA, 20 bp, mouse
gagcaggggaggccacacaa

SEQ ID NO: 421167 - DNA, 20 bp, mouse
gagagagagcccaacagcag

SEQ ID NO: 421168 - DNA, 20 bp, mouse
ggagagcccaacagcagggg

SEQ ID NO: 421169 - DNA, 20 bp, mouse
gctcaggtgccccagctcta

SEQ ID NO: 421170 - DNA, 20 bp, mouse
ggcacaaacagcactggtca

SEQ ID NO: 421171 - DNA, 20 bp, mouse
gtgtggcctcccctgctgtt

SEQ ID NO: 421172 - DNA, 20 bp, mouse
gcacagctgggtctcttctt

SEQ ID NO: 421173 - DNA, 20 bp, mouse
ggtcagaccaagaatctcag

SEQ ID NO: 421174 - DNA, 20 bp, mouse
gcgtggggaagtgacctcag

SEQ ID NO: 421175 - DNA, 20 bp, mouse
gtgagtgagctctgccaggg

SEQ ID NO: 421176 - DNA, 20 bp, mouse
gcgccaagccggctccagac

SEQ ID NO: 421177 - DNA, 20 bp, mouse
gggcctgggccccttgtcgg

SEQ ID NO: 421178 - DNA, 20 bp, mouse
gctagctcggaagcccccac

SEQ ID NO: 421179 - DNA, 20 bp, mouse
gccagccccacctccgacaa

SEQ ID NO: 421180 - DNA, 20 bp, mouse
ggctccagacgggcactgga

SEQ ID NO: 421181 - DNA, 20 bp, mouse
gcacctccgacaaggggccc

SEQ ID NO: 421182 - DNA, 20 bp, mouse
gagcgggcgcaggggcagct

SEQ ID NO: 421183 - DNA, 20 bp, mouse
ggacctgcgcgcgtctgtag

SEQ ID NO: 421184 - DNA, 20 bp, mouse
gtggctctcaggttagtgta

SEQ ID NO: 421185 - DNA, 20 bp, mouse
gggcggcctgggccccttgt

SEQ ID NO: 421186 - DNA, 20 bp, mouse
ggcgtgcgcaggacagccct

SEQ ID NO: 421187 - DNA, 20 bp, mouse
gggaggcaccgagtacccca

SEQ ID NO: 421188 - DNA, 20 bp, mouse
gcgcgtgcgaagtggaccag

SEQ ID NO: 421189 - DNA, 20 bp, mouse
gggcaccgagtaccccacgg

SEQ ID NO: 421190 - DNA, 20 bp, mouse
ggccctagttggaatagaca

SEQ ID NO: 421191 - DNA, 20 bp, mouse
ggggccaccatggagtaagg

SEQ ID NO: 421192 - DNA, 20 bp, mouse
gagcgtggagggtcccccgt

SEQ ID NO: 421193 - DNA, 20 bp, mouse
gaggggcgaggccaaaggag

SEQ ID NO: 421194 - DNA, 20 bp, mouse
gccgatctgaggtcagccaa

SEQ ID NO: 421195 - DNA, 20 bp, mouse
ggtcagccaagggcactggg

SEQ ID NO: 421196 - DNA, 20 bp, mouse
gcggagccgggagcccactg

SEQ ID NO: 421197 - DNA, 20 bp, mouse
gctgggatgtgacccgcagt

SEQ ID NO: 421198 - DNA, 20 bp, mouse
gaggcgggcgggcgaaacca

SEQ ID NO: 421199 - DNA, 20 bp, mouse
gcgtctggcgggcaagggga

SEQ ID NO: 421200 - DNA, 20 bp, mouse
ggctcacagccgtcaccacc

SEQ ID NO: 421201 - DNA, 20 bp, mouse
gggttgaaggagagctccag

SEQ ID NO: 421202 - DNA, 20 bp, mouse
gctccggcgctggtccatag

SEQ ID NO: 421203 - DNA, 20 bp, mouse
ggcggcgactgcagcgaggt

SEQ ID NO: 421204 - DNA, 20 bp, mouse
ggcgctgggcaggtgagatg

SEQ ID NO: 421205 - DNA, 20 bp, mouse
gtccctgcgggccagacgag

SEQ ID NO: 421206 - DNA, 20 bp, mouse
gcagtggaggcacctcagga

SEQ ID NO: 421207 - DNA, 20 bp, mouse
gtcagcagtggaggcacctc

SEQ ID NO: 421208 - DNA, 20 bp, mouse
gcacctcaggatggacgcta

SEQ ID NO: 421209 - DNA, 20 bp, mouse
ggtccctagcgtccatcctg

SEQ ID NO: 421210 - DNA, 20 bp, mouse
ggcccaccaggaggtcacag

SEQ ID NO: 421211 - DNA, 20 bp, mouse
ggagctgccacaggcttcca

SEQ ID NO: 421212 - DNA, 20 bp, mouse
gaggaggtcacagaggaaca

SEQ ID NO: 421213 - DNA, 20 bp, mouse
gtccagacctaggagaacca

SEQ ID NO: 421214 - DNA, 20 bp, mouse
gacctaggagaaccatggac

SEQ ID NO: 421215 - DNA, 20 bp, mouse
gagggactgtgatgcagcct

SEQ ID NO: 421216 - DNA, 20 bp, mouse
gggagctccgggctagacag

SEQ ID NO: 421217 - DNA, 20 bp, mouse
ggccgcgccgcaggagctcc

SEQ ID NO: 421218 - DNA, 20 bp, mouse
ggtctagcccggagctcctg

SEQ ID NO: 421219 - DNA, 20 bp, mouse
gccgggctagacagtggcga

SEQ ID NO: 421220 - DNA, 20 bp, mouse
gctgttctgggagtagatac

SEQ ID NO: 421221 - DNA, 20 bp, mouse
gcggcgggaggaagacgatg

SEQ ID NO: 421222 - DNA, 20 bp, mouse
gtccgagctgcggggtgagg

SEQ ID NO: 421223 - DNA, 20 bp, mouse
gggctagacagtggcgacgg

SEQ ID NO: 421224 - DNA, 20 bp, mouse
gccgcgagcctgagtaagtg

SEQ ID NO: 421225 - DNA, 20 bp, mouse
gctgcggggtgaggaggtcg

SEQ ID NO: 421226 - DNA, 20 bp, mouse
gagccgtctggttaccaagg

SEQ ID NO: 421227 - DNA, 20 bp, mouse
gggagtgaccagaaaggctc

SEQ ID NO: 421228 - DNA, 20 bp, mouse
gcaactgccaaacagcctag

SEQ ID NO: 421229 - DNA, 20 bp, mouse
gaggcggggcccggcctagg

SEQ ID NO: 421230 - DNA, 20 bp, mouse
gcagacactcgcgtgcccag

SEQ ID NO: 421231 - DNA, 20 bp, mouse
gcggtgagtgtccccagaga

SEQ ID NO: 421232 - DNA, 20 bp, mouse
gtgatccggggacaacctga

SEQ ID NO: 421233 - DNA, 20 bp, mouse
ggacaaggatggctgatccg

SEQ ID NO: 421234 - DNA, 20 bp, mouse
gccacagccgctaggctgtt

SEQ ID NO: 421235 - DNA, 20 bp, mouse
ggaaaggctccggtgaggcg

SEQ ID NO: 421236 - DNA, 20 bp, mouse
ggagagggagtcgagagtac

SEQ ID NO: 421237 - DNA, 20 bp, mouse
gtgagtggagacgccaagag

SEQ ID NO: 421238 - DNA, 20 bp, mouse
gagagtacaggaaatgtgcg

SEQ ID NO: 421239 - DNA, 20 bp, mouse
ggtctgtctggaggaagcaa

SEQ ID NO: 421240 - DNA, 20 bp, mouse
ggaagaccacgcacatttcc

SEQ ID NO: 421241 - DNA, 20 bp, mouse
gcgtgtgctattgacgggtg

SEQ ID NO: 421242 - DNA, 20 bp, mouse
gaatggcgtgtgctattgac

SEQ ID NO: 421243 - DNA, 20 bp, mouse
gggggcaggtgggttctgag

SEQ ID NO: 421244 - DNA, 20 bp, mouse
gaactgtggccagtgagccg

SEQ ID NO: 421245 - DNA, 20 bp, mouse
gaccgcagcgtcaactggtt

SEQ ID NO: 421246 - DNA, 20 bp, mouse
ggaacgaggagcccgacgag
